United States Patent 7,655,785 (BIOINFORMATICALLY DETECTABLE GROUP OF NOVEL REGULATORY OLIGONUCLEOTIDES AND USES THEREOF) - sequence listing, part 37

SEQ ID NO: 1521832 - RNA, 15 nt, Homo sapiens
ccucgcccuccacaa

SEQ ID NO: 1521833 - RNA, 16 nt, Homo sapiens
ccucgcccuccacaaa

SEQ ID NO: 1521834 - RNA, 12 nt, Homo sapiens
ccucucuugccu

SEQ ID NO: 1521835 - RNA, 21 nt, Homo sapiens
ccugaacccagaaacaacaca

SEQ ID NO: 1521836 - RNA, 22 nt, Homo sapiens
ccugaaguaagcaaagacuuuc

SEQ ID NO: 1521837 - RNA, 17 nt, Homo sapiens
ccugccccugacugugu

SEQ ID NO: 1521838 - RNA, 18 nt, Homo sapiens
ccugcuaauaauuugcca

SEQ ID NO: 1521839 - RNA, 16 nt, Homo sapiens
ccugucuacaguuuaa

SEQ ID NO: 1521840 - RNA, 14 nt, Homo sapiens
ccugugaaauacca

SEQ ID NO: 1521841 - RNA, 15 nt, Homo sapiens
ccuuccuacuuugcu

SEQ ID NO: 1521842 - RNA, 13 nt, Homo sapiens
ccuugaaggguuc

SEQ ID NO: 1521843 - RNA, 18 nt, Homo sapiens
cgcagauguccuugaugc

SEQ ID NO: 1521844 - RNA, 19 nt, Homo sapiens
cgcccaggcuggagugcag

SEQ ID NO: 1521845 - RNA, 12 nt, Homo sapiens
cgcgacuuccac

SEQ ID NO: 1521846 - RNA, 14 nt, Homo sapiens
cguuugaaucacag

SEQ ID NO: 1521847 - RNA, 14 nt, Homo sapiens
cuaaaauguucuaa

SEQ ID NO: 1521848 - RNA, 20 nt, Homo sapiens
cuaagcugccgguucuuaaa

SEQ ID NO: 1521849 - RNA, 14 nt, Homo sapiens
cuaauaauuugcca

SEQ ID NO: 1521850 - RNA, 14 nt, Homo sapiens
cuacuugggagcac

SEQ ID NO: 1521851 - RNA, 18 nt, Homo sapiens
cuagauaauaaaauugcu

SEQ ID NO: 1521852 - RNA, 14 nt, Homo sapiens
cuaggaaugcuuuu

SEQ ID NO: 1521853 - RNA, 23 nt, Homo sapiens
cuaguuucuuuugauaguauuua

SEQ ID NO: 1521854 - RNA, 21 nt, Homo sapiens
cuauauuccuuuuucuaugaa

SEQ ID NO: 1521855 - RNA, 17 nt, Homo sapiens
cuauggcucuacuuuca

SEQ ID NO: 1521856 - RNA, 20 nt, Homo sapiens
cuaugucacccaaugcauau

SEQ ID NO: 1521857 - RNA, 14 nt, Homo sapiens
cuaugugcaugcag

SEQ ID NO: 1521858 - RNA, 13 nt, Homo sapiens
cuauguugauaaa

SEQ ID NO: 1521859 - RNA, 17 nt, Homo sapiens
cuauguuuucuacucca

SEQ ID NO: 1521860 - RNA, 22 nt, Homo sapiens
cuauuaaagauauuucuuuaaa

SEQ ID NO: 1521861 - RNA, 21 nt, Homo sapiens
cuauuuauuuauuuauucauu

SEQ ID NO: 1521862 - RNA, 21 nt, Homo sapiens
cucaauaaacuuuuaccacaa

SEQ ID NO: 1521863 - RNA, 16 nt, Homo sapiens
cuuuuuaaaaaaggaa

SEQ ID NO: 1521864 - RNA, 18 nt, Homo sapiens
gaaaaauaaaaaccauaa

SEQ ID NO: 1521865 - RNA, 17 nt, Homo sapiens
gaaaacaguauuuucca

SEQ ID NO: 1521866 - RNA, 11 nt, Homo sapiens
gaaaacauuuu

SEQ ID NO: 1521867 - RNA, 18 nt, Homo sapiens
gaaaagaacacuugccca

SEQ ID NO: 1521868 - RNA, 20 nt, Homo sapiens
gaaaauauuuuuuuccuuug

SEQ ID NO: 1521869 - RNA, 21 nt, Homo sapiens
gaaaaugcuguauuagucaca

SEQ ID NO: 1521870 - RNA, 18 nt, Homo sapiens
gaaagauccacccucaaa

SEQ ID NO: 1521871 - RNA, 12 nt, Homo sapiens
gaaaucaagggc

SEQ ID NO: 1521872 - RNA, 13 nt, Homo sapiens
gaaaucuaugaaa

SEQ ID NO: 1521873 - RNA, 17 nt, Homo sapiens
gaaauuaauuugugaau

SEQ ID NO: 1521874 - RNA, 16 nt, Homo sapiens
gaaauuuagagucaau

SEQ ID NO: 1521875 - RNA, 15 nt, Homo sapiens
gaacaugaccaaaaa

SEQ ID NO: 1521876 - RNA, 15 nt, Homo sapiens
gaaccaggcaacuug

SEQ ID NO: 1521877 - RNA, 20 nt, Homo sapiens
gaacccccucaaaagccaaa

SEQ ID NO: 1521878 - RNA, 21 nt, Homo sapiens
gaacccccucaaaagccaaaa

SEQ ID NO: 1521879 - RNA, 16 nt, Homo sapiens
gaaccgaacauaucau

SEQ ID NO: 1521880 - RNA, 19 nt, Homo sapiens
gaaccgaacauaucauuug

SEQ ID NO: 1521881 - RNA, 13 nt, Homo sapiens
gaacgcgugucaa

SEQ ID NO: 1521882 - RNA, 13 nt, Homo sapiens
gaacggggagaaa

SEQ ID NO: 1521883 - RNA, 23 nt, Homo sapiens
gaacuaagagaugagggaggcac

SEQ ID NO: 1521884 - RNA, 13 nt, Homo sapiens
gaacuagacuccc

SEQ ID NO: 1521885 - RNA, 16 nt, Homo sapiens
gaacuuucaccuucau

SEQ ID NO: 1521886 - RNA, 17 nt, Homo sapiens
gaagagaaugugacagg

SEQ ID NO: 1521887 - RNA, 16 nt, Homo sapiens
gaagcauaaagcaauu

SEQ ID NO: 1521888 - RNA, 12 nt, Homo sapiens
gaagccuugcca

SEQ ID NO: 1521889 - RNA, 15 nt, Homo sapiens
gaagucaugcguuua

SEQ ID NO: 1521890 - RNA, 13 nt, Homo sapiens
gaagucccggcuu

SEQ ID NO: 1521891 - RNA, 14 nt, Homo sapiens
gaauaaaauugcac

SEQ ID NO: 1521892 - RNA, 13 nt, Homo sapiens
gaauaauccagaa

SEQ ID NO: 1521893 - RNA, 13 nt, Homo sapiens
gaauaugacauac

SEQ ID NO: 1521894 - RNA, 17 nt, Homo sapiens
gacaacuucccaaagca

SEQ ID NO: 1521895 - RNA, 23 nt, Homo sapiens
gacaggcacagaugaaugggagu

SEQ ID NO: 1521896 - RNA, 16 nt, Homo sapiens
gacaucaaauuugcca

SEQ ID NO: 1521897 - RNA, 15 nt, Homo sapiens
gaccugaaucacaac

SEQ ID NO: 1521898 - RNA, 20 nt, Homo sapiens
gaccuggguggggucaggga

SEQ ID NO: 1521899 - RNA, 16 nt, Homo sapiens
gagaaagaccaugcau

SEQ ID NO: 1521900 - RNA, 14 nt, Homo sapiens
gagacaacuuccca

SEQ ID NO: 1521901 - RNA, 16 nt, Homo sapiens
gagacaauuucacaug

SEQ ID NO: 1521902 - RNA, 20 nt, Homo sapiens
gagacuuugacucuccagaa

SEQ ID NO: 1521903 - RNA, 13 nt, Homo sapiens
gagagacccaagg

SEQ ID NO: 1521904 - RNA, 16 nt, Homo sapiens
gaggaaaaacagggaa

SEQ ID NO: 1521905 - RNA, 21 nt, Homo sapiens
gaggaagcaaaagacucugua

SEQ ID NO: 1521906 - RNA, 18 nt, Homo sapiens
gaggagggcgugacucac

SEQ ID NO: 1521907 - RNA, 19 nt, Homo sapiens
gagguggagguugcaguga

SEQ ID NO: 1521908 - RNA, 22 nt, Homo sapiens
gagucucccacugcaacuugug

SEQ ID NO: 1521909 - RNA, 15 nt, Homo sapiens
gagugugcagacuga

SEQ ID NO: 1521910 - RNA, 16 nt, Homo sapiens
gaguuaguuugaguua

SEQ ID NO: 1521911 - RNA, 11 nt, Homo sapiens
gaguuugccac

SEQ ID NO: 1521912 - RNA, 19 nt, Homo sapiens
gauaaugcuguugccucau

SEQ ID NO: 1521913 - RNA, 21 nt, Homo sapiens
gauccacauuguuaggugcug

SEQ ID NO: 1521914 - RNA, 22 nt, Homo sapiens
gauccacauuguuaggugcuga

SEQ ID NO: 1521915 - RNA, 16 nt, Homo sapiens
gaucuacccucuaguu

SEQ ID NO: 1521916 - RNA, 18 nt, Homo sapiens
gaugucguuugaaucaca

SEQ ID NO: 1521917 - RNA, 12 nt, Homo sapiens
gauuauuugccc

SEQ ID NO: 1521918 - RNA, 14 nt, Homo sapiens
gauucacaguguga

SEQ ID NO: 1521919 - RNA, 16 nt, Homo sapiens
gcaaagacuuuccucu

SEQ ID NO: 1521920 - RNA, 14 nt, Homo sapiens
gcaagaaacacugg

SEQ ID NO: 1521921 - RNA, 13 nt, Homo sapiens
gcaaucaaaggca

SEQ ID NO: 1521922 - RNA, 17 nt, Homo sapiens
gcacccuucuuuccucu

SEQ ID NO: 1521923 - RNA, 23 nt, Homo sapiens
gcacuucuguuccagguuuuucu

SEQ ID NO: 1521924 - RNA, 21 nt, Homo sapiens
gcagaagaauugaacccagga

SEQ ID NO: 1521925 - RNA, 14 nt, Homo sapiens
gcagaggaugucuc

SEQ ID NO: 1521926 - RNA, 22 nt, Homo sapiens
gcagaucuuggaaugaaugaca

SEQ ID NO: 1521927 - RNA, 13 nt, Homo sapiens
gcagcuuugcccu

SEQ ID NO: 1521928 - RNA, 17 nt, Homo sapiens
gcaggacggguaccaug

SEQ ID NO: 1521929 - RNA, 21 nt, Homo sapiens
gcauguggaaaugacccaaac

SEQ ID NO: 1521930 - RNA, 18 nt, Homo sapiens
gcauuuucuguuccaggu

SEQ ID NO: 1521931 - RNA, 22 nt, Homo sapiens
gcauuuucuguuccagguuucu

SEQ ID NO: 1521932 - RNA, 16 nt, Homo sapiens
gccagauccacccuau

SEQ ID NO: 1521933 - RNA, 13 nt, Homo sapiens
gccagcucaggau

SEQ ID NO: 1521934 - RNA, 22 nt, Homo sapiens
gccaugauaacugcaauuuuaa

SEQ ID NO: 1521935 - RNA, 22 nt, Homo sapiens
gcccaaaucuucuucagauuca

SEQ ID NO: 1521936 - RNA, 15 nt, Homo sapiens
gcccgcugcucacuu

SEQ ID NO: 1521937 - RNA, 11 nt, Homo sapiens
gcccugaccuc

SEQ ID NO: 1521938 - RNA, 21 nt, Homo sapiens
gcccuugcccugaccucccag

SEQ ID NO: 1521939 - RNA, 22 nt, Homo sapiens
gccggcaaccccaguucugcuc

SEQ ID NO: 1521940 - RNA, 16 nt, Homo sapiens
gccucuggcuucucag

SEQ ID NO: 1521941 - RNA, 22 nt, Homo sapiens
gccuuaccuccugcccaggaga

SEQ ID NO: 1521942 - RNA, 18 nt, Homo sapiens
gcuaucgcaaaucacaaa

SEQ ID NO: 1521943 - RNA, 19 nt, Homo sapiens
gcucaggcuuuuccaggaa

SEQ ID NO: 1521944 - RNA, 15 nt, Homo sapiens
gcucccgaguacagu

SEQ ID NO: 1521945 - RNA, 14 nt, Homo sapiens
gcuccugccagcuc

SEQ ID NO: 1521946 - RNA, 16 nt, Homo sapiens
gcucuauuaagauuuc

SEQ ID NO: 1521947 - RNA, 21 nt, Homo sapiens
gcugcucacuuuccacccucu

SEQ ID NO: 1521948 - RNA, 19 nt, Homo sapiens
gcuucacagaugugugauu

SEQ ID NO: 1521949 - RNA, 17 nt, Homo sapiens
gcuucuguccaggacau

SEQ ID NO: 1521950 - RNA, 17 nt, Homo sapiens
gcuucuucaucuuuaaa

SEQ ID NO: 1521951 - RNA, 17 nt, Homo sapiens
gcuuguuucuuguuauu

SEQ ID NO: 1521952 - RNA, 20 nt, Homo sapiens
ggaaaauaaaucaaugcuau

SEQ ID NO: 1521953 - RNA, 23 nt, Homo sapiens
ggaaacaauguauugucugccca

SEQ ID NO: 1521954 - RNA, 22 nt, Homo sapiens
ggaaacagacaagcaacccaaa

SEQ ID NO: 1521955 - RNA, 15 nt, Homo sapiens
ggacucaagggucca

SEQ ID NO: 1521956 - RNA, 14 nt, Homo sapiens
ggagguugcaguga

SEQ ID NO: 1521957 - RNA, 15 nt, Homo sapiens
ggauauuauguuucu

SEQ ID NO: 1521958 - RNA, 18 nt, Homo sapiens
ggauguguccuagacucc

SEQ ID NO: 1521959 - RNA, 14 nt, Homo sapiens
ggcagccucaggag

SEQ ID NO: 1521960 - RNA, 22 nt, Homo sapiens
ggcuccccauuuuauaccaaag

SEQ ID NO: 1521961 - RNA, 17 nt, Homo sapiens
ggcucuugcaacaucuc

SEQ ID NO: 1521962 - RNA, 20 nt, Homo sapiens
gggacagagcagaacuuuca

SEQ ID NO: 1521963 - RNA, 22 nt, Homo sapiens
gggcagcuuugcccuccaagag

SEQ ID NO: 1521964 - RNA, 22 nt, Homo sapiens
gggcuagggagaaugcagagag

SEQ ID NO: 1521965 - RNA, 15 nt, Homo sapiens
ggguaccaugcugcc

SEQ ID NO: 1521966 - RNA, 14 nt, Homo sapiens
gggucccagggaag

SEQ ID NO: 1521967 - RNA, 15 nt, Homo sapiens
ggucauaguguauaa

SEQ ID NO: 1521968 - RNA, 22 nt, Homo sapiens
gguccagcuugcucuucagugg

SEQ ID NO: 1521969 - RNA, 17 nt, Homo sapiens
gguccccaucaucccag

SEQ ID NO: 1521970 - RNA, 16 nt, Homo sapiens
gguguaaauauguuuc

SEQ ID NO: 1521971 - RNA, 22 nt, Homo sapiens
gguuggaaaacaguauuuucca

SEQ ID NO: 1521972 - RNA, 18 nt, Homo sapiens
guaaagaguuaguuugag

SEQ ID NO: 1521973 - RNA, 15 nt, Homo sapiens
guaaugucaccaccu

SEQ ID NO: 1521974 - RNA, 13 nt, Homo sapiens
guaccaugcugcc

SEQ ID NO: 1521975 - RNA, 12 nt, Homo sapiens
guauauguauaa

SEQ ID NO: 1521976 - RNA, 19 nt, Homo sapiens
guaugauccuaaugaaugc

SEQ ID NO: 1521977 - RNA, 23 nt, Homo sapiens
guaugauccuaaugaaugcauaa

SEQ ID NO: 1521978 - RNA, 18 nt, Homo sapiens
guauuccaccacaggaau

SEQ ID NO: 1521979 - RNA, 17 nt, Homo sapiens
gucaauacugagccauu

SEQ ID NO: 1521980 - RNA, 20 nt, Homo sapiens
gucaccggggcaacugccug

SEQ ID NO: 1521981 - RNA, 14 nt, Homo sapiens
gucaccuggccugc

SEQ ID NO: 1521982 - RNA, 22 nt, Homo sapiens
gucagauuugcuguucacccac

SEQ ID NO: 1521983 - RNA, 15 nt, Homo sapiens
gucauaugcguuugu

SEQ ID NO: 1521984 - RNA, 18 nt, Homo sapiens
gucaugcguuuaaucaca

SEQ ID NO: 1521985 - RNA, 18 nt, Homo sapiens
guccagcuugcucuucag

SEQ ID NO: 1521986 - RNA, 16 nt, Homo sapiens
gucccucccaucucua

SEQ ID NO: 1521987 - RNA, 18 nt, Homo sapiens
gucccucccaucucuacc

SEQ ID NO: 1521988 - RNA, 23 nt, Homo sapiens
aaaaaauuugauuuagcauucau

SEQ ID NO: 1521989 - RNA, 20 nt, Homo sapiens
aaaaaccauaaacauuugca

SEQ ID NO: 1521990 - RNA, 22 nt, Homo sapiens
aaaaagugcuuauuaugugcaa

SEQ ID NO: 1521991 - RNA, 16 nt, Homo sapiens
aaaaaugggagacaau

SEQ ID NO: 1521992 - RNA, 16 nt, Homo sapiens
aaaacccaaacuucca

SEQ ID NO: 1521993 - RNA, 22 nt, Homo sapiens
aaaacuguggguagagacuuug

SEQ ID NO: 1521994 - RNA, 22 nt, Homo sapiens
aaaagaugcauuaucuaugaua

SEQ ID NO: 1521995 - RNA, 12 nt, Homo sapiens
aaaagccaaaaa

SEQ ID NO: 1521996 - RNA, 18 nt, Homo sapiens
aaaaugaauuugggauac

SEQ ID NO: 1521997 - RNA, 19 nt, Homo sapiens
aaaauuuuuaaaacacaga

SEQ ID NO: 1521998 - RNA, 13 nt, Homo sapiens
aaaccaguaucgu

SEQ ID NO: 1521999 - RNA, 18 nt, Homo sapiens
aaaccauaaacauuugca

SEQ ID NO: 1522000 - RNA, 18 nt, Homo sapiens
aaagacagaaugucacca

SEQ ID NO: 1522001 - RNA, 20 nt, Homo sapiens
aaagagagcaggacucacag

SEQ ID NO: 1522002 - RNA, 13 nt, Homo sapiens
aaagcucaucuca

SEQ ID NO: 1522003 - RNA, 20 nt, Homo sapiens
aaagcucuauuaagauuucc

SEQ ID NO: 1522004 - RNA, 22 nt, Homo sapiens
aaaggcaaugcucaaacaccca

SEQ ID NO: 1522005 - RNA, 16 nt, Homo sapiens
aaaguaugcagauuau

SEQ ID NO: 1522006 - RNA, 13 nt, Homo sapiens
aaagugcauucaa

SEQ ID NO: 1522007 - RNA, 21 nt, Homo sapiens
aaaguuuaggcaugcucagaa

SEQ ID NO: 1522008 - RNA, 23 nt, Homo sapiens
aaauauaauucuuaguggaagac

SEQ ID NO: 1522009 - RNA, 21 nt, Homo sapiens
aaauauauuuuaugauuuaaa

SEQ ID NO: 1522010 - RNA, 21 nt, Homo sapiens
aaaucaaguuggcuucuaauc

SEQ ID NO: 1522011 - RNA, 14 nt, Homo sapiens
aaauccaguauuau

SEQ ID NO: 1522012 - RNA, 18 nt, Homo sapiens
aaaucuaugaaauaucau

SEQ ID NO: 1522013 - RNA, 16 nt, Homo sapiens
aaaucuccagucucau

SEQ ID NO: 1522014 - RNA, 15 nt, Homo sapiens
aaaucugucucccca

SEQ ID NO: 1522015 - RNA, 14 nt, Homo sapiens
aaaugucacaguaa

SEQ ID NO: 1522016 - RNA, 13 nt, Homo sapiens
aaauuaaagcuga

SEQ ID NO: 1522017 - RNA, 19 nt, Homo sapiens
aaauuggaugcuagagaau

SEQ ID NO: 1522018 - RNA, 15 nt, Homo sapiens
aacaaacuacaugua

SEQ ID NO: 1522019 - RNA, 19 nt, Homo sapiens
aacacagaaacuauaugca

SEQ ID NO: 1522020 - RNA, 22 nt, Homo sapiens
aacacuuucccaugagugugau

SEQ ID NO: 1522021 - RNA, 13 nt, Homo sapiens
aacauuugcacca

SEQ ID NO: 1522022 - RNA, 18 nt, Homo sapiens
aaccaaaagugcauucaa

SEQ ID NO: 1522023 - RNA, 12 nt, Homo sapiens
aaccaaugagcu

SEQ ID NO: 1522024 - RNA, 14 nt, Homo sapiens
aaccuuaccaaaaa

SEQ ID NO: 1522025 - RNA, 18 nt, Homo sapiens
aacgggccagcucuagua

SEQ ID NO: 1522026 - RNA, 22 nt, Homo sapiens
aacguacauuugugcuguuuuc

SEQ ID NO: 1522027 - RNA, 12 nt, Homo sapiens
aacuacauguaa

SEQ ID NO: 1522028 - RNA, 16 nt, Homo sapiens
aacuacauguaaucca

SEQ ID NO: 1522029 - RNA, 16 nt, Homo sapiens
aacuaccucaaaacac

SEQ ID NO: 1522030 - RNA, 23 nt, Homo sapiens
aacuaccucaaaacacuuuccca

SEQ ID NO: 1522031 - RNA, 19 nt, Homo sapiens
aacugaacccccucaaaag

SEQ ID NO: 1522032 - RNA, 13 nt, Homo sapiens
aagaaacccaagu

SEQ ID NO: 1522033 - RNA, 21 nt, Homo sapiens
aagaaauacuccuguauugag

SEQ ID NO: 1522034 - RNA, 21 nt, Homo sapiens
aagaauaaaauugcacuuuua

SEQ ID NO: 1522035 - RNA, 13 nt, Homo sapiens
aagaaucaccuca

SEQ ID NO: 1522036 - RNA, 21 nt, Homo sapiens
aagauccacccucaaauguca

SEQ ID NO: 1522037 - RNA, 20 nt, Homo sapiens
aagaugcauuaucuaugaua

SEQ ID NO: 1522038 - RNA, 17 nt, Homo sapiens
aagcaaaagacucugua

SEQ ID NO: 1522039 - RNA, 14 nt, Homo sapiens
aagcauaaagcaau

SEQ ID NO: 1522040 - RNA, 22 nt, Homo sapiens
aagcauguggaaaugacccaaa

SEQ ID NO: 1522041 - RNA, 20 nt, Homo sapiens
aagcauguuugguuuuccaa

SEQ ID NO: 1522042 - RNA, 21 nt, Homo sapiens
aagccaaaaaaugggagacaa

SEQ ID NO: 1522043 - RNA, 13 nt, Homo sapiens
aagcucaucucag

SEQ ID NO: 1522044 - RNA, 17 nt, Homo sapiens
aagcucuauuaagauuu

SEQ ID NO: 1522045 - RNA, 21 nt, Homo sapiens
aagcugagugacuguaggcag

SEQ ID NO: 1522046 - RNA, 19 nt, Homo sapiens
aagcuuuugguaauauuca

SEQ ID NO: 1522047 - RNA, 23 nt, Homo sapiens
aaggagacucaccucugccucaa

SEQ ID NO: 1522048 - RNA, 17 nt, Homo sapiens
aaggcaaugcucaaaca

SEQ ID NO: 1522049 - RNA, 19 nt, Homo sapiens
aagggccacgacaaagcag

SEQ ID NO: 1522050 - RNA, 20 nt, Homo sapiens
aagggccagcuggaggugaa

SEQ ID NO: 1522051 - RNA, 18 nt, Homo sapiens
aaggguucaccaggucag

SEQ ID NO: 1522052 - RNA, 20 nt, Homo sapiens
aaguaugcagauuauuugcc

SEQ ID NO: 1522053 - RNA, 15 nt, Homo sapiens
aagugugugaucugu

SEQ ID NO: 1522054 - RNA, 22 nt, Homo sapiens
aauaaucauucuuuccccucag

SEQ ID NO: 1522055 - RNA, 18 nt, Homo sapiens
aauaaugccuaguggcuu

SEQ ID NO: 1522056 - RNA, 20 nt, Homo sapiens
aauacaugcugcuaauucaa

SEQ ID NO: 1522057 - RNA, 11 nt, Homo sapiens
aauacugagcc

SEQ ID NO: 1522058 - RNA, 18 nt, Homo sapiens
aauacugccggucaccca

SEQ ID NO: 1522059 - RNA, 19 nt, Homo sapiens
aauacugccggucacccag

SEQ ID NO: 1522060 - RNA, 14 nt, Homo sapiens
aauagacacaucaa

SEQ ID NO: 1522061 - RNA, 19 nt, Homo sapiens
aauaguuuuaaauaugaac

SEQ ID NO: 1522062 - RNA, 21 nt, Homo sapiens
cucccaucucuaccccaaaga

SEQ ID NO: 1522063 - RNA, 12 nt, Homo sapiens
cuccccuaucca

SEQ ID NO: 1522064 - RNA, 21 nt, Homo sapiens
cuccuauuuaugaaaaccaua

SEQ ID NO: 1522065 - RNA, 18 nt, Homo sapiens
cuccucgaagucccggcu

SEQ ID NO: 1522066 - RNA, 15 nt, Homo sapiens
cucuauuacacugga

SEQ ID NO: 1522067 - RNA, 18 nt, Homo sapiens
cucuuccccuugcccuug

SEQ ID NO: 1522068 - RNA, 15 nt, Homo sapiens
cucuuuuucuagucu

SEQ ID NO: 1522069 - RNA, 17 nt, Homo sapiens
cugaaguaagcaaagac

SEQ ID NO: 1522070 - RNA, 12 nt, Homo sapiens
cugaaucacaac

SEQ ID NO: 1522071 - RNA, 16 nt, Homo sapiens
cugagagacccaagga

SEQ ID NO: 1522072 - RNA, 22 nt, Homo sapiens
cugagagacccaaggaggaaaa

SEQ ID NO: 1522073 - RNA, 13 nt, Homo sapiens
cugaucugaugca

SEQ ID NO: 1522074 - RNA, 15 nt, Homo sapiens
cugauuccacuuuua

SEQ ID NO: 1522075 - RNA, 20 nt, Homo sapiens
cugcaacuugugaacuccau

SEQ ID NO: 1522076 - RNA, 21 nt, Homo sapiens
cugccaaagaagccuugccau

SEQ ID NO: 1522077 - RNA, 22 nt, Homo sapiens
cugccaaagaagccuugccauc

SEQ ID NO: 1522078 - RNA, 23 nt, Homo sapiens
cugcccaaugccuugacaacaga

SEQ ID NO: 1522079 - RNA, 19 nt, Homo sapiens
cugcgcaggccaugcaugg

SEQ ID NO: 1522080 - RNA, 17 nt, Homo sapiens
cugcuaauagcugcuag

SEQ ID NO: 1522081 - RNA, 11 nt, Homo sapiens
cuggaccugcu

SEQ ID NO: 1522082 - RNA, 12 nt, Homo sapiens
cuggaccugcug

SEQ ID NO: 1522083 - RNA, 19 nt, Homo sapiens
cuggagccagagagacaga

SEQ ID NO: 1522084 - RNA, 20 nt, Homo sapiens
cuggcuucacagauguguga

SEQ ID NO: 1522085 - RNA, 15 nt, Homo sapiens
cugggccccaccacc

SEQ ID NO: 1522086 - RNA, 16 nt, Homo sapiens
cuguaacacacuaaca

SEQ ID NO: 1522087 - RNA, 14 nt, Homo sapiens
cuguauuagucaca

SEQ ID NO: 1522088 - RNA, 19 nt, Homo sapiens
cuguguccuugcaccugca

SEQ ID NO: 1522089 - RNA, 19 nt, Homo sapiens
cugugugugcaaaggugag

SEQ ID NO: 1522090 - RNA, 17 nt, Homo sapiens
cuuauuaugugcaacau

SEQ ID NO: 1522091 - RNA, 15 nt, Homo sapiens
cuucacucaaucucu

SEQ ID NO: 1522092 - RNA, 21 nt, Homo sapiens
cuucaggaagcauaaagcaau

SEQ ID NO: 1522093 - RNA, 22 nt, Homo sapiens
cuuccacagagggaaguuuaaa

SEQ ID NO: 1522094 - RNA, 18 nt, Homo sapiens
cuucccaaagcacaaagc

SEQ ID NO: 1522095 - RNA, 21 nt, Homo sapiens
cuucccuggcuuguaacucca

SEQ ID NO: 1522096 - RNA, 21 nt, Homo sapiens
cuucuuccuuauuucacugaa

SEQ ID NO: 1522097 - RNA, 15 nt, Homo sapiens
cuugaaaucaagggc

SEQ ID NO: 1522098 - RNA, 22 nt, Homo sapiens
cuugaagaauguugauggugcu

SEQ ID NO: 1522099 - RNA, 19 nt, Homo sapiens
cuugcccagggcagcuuug

SEQ ID NO: 1522100 - RNA, 23 nt, Homo sapiens
cuugcugauuuucagacagggaa

SEQ ID NO: 1522101 - RNA, 17 nt, Homo sapiens
cuuguaaaugugguaaa

SEQ ID NO: 1522102 - RNA, 22 nt, Homo sapiens
cuuuauuacaguuuaucuaugg

SEQ ID NO: 1522103 - RNA, 14 nt, Homo sapiens
cuuucgaaagcaau

SEQ ID NO: 1522104 - RNA, 21 nt, Homo sapiens
cuuugucauuauuagucuuca

SEQ ID NO: 1522105 - RNA, 21 nt, Homo sapiens
cuuuuaaacccuauugguaaa

SEQ ID NO: 1522106 - RNA, 21 nt, Homo sapiens
cuuuuccccggucccuugaga

SEQ ID NO: 1522107 - RNA, 21 nt, Homo sapiens
gaaaaugagggccgcuuugag

SEQ ID NO: 1522108 - RNA, 19 nt, Homo sapiens
gaaaauuauugacagcaau

SEQ ID NO: 1522109 - RNA, 14 nt, Homo sapiens
gaaaccccaaugcu

SEQ ID NO: 1522110 - RNA, 13 nt, Homo sapiens
gaaagacuaccuc

SEQ ID NO: 1522111 - RNA, 16 nt, Homo sapiens
gaagagaaugugacag

SEQ ID NO: 1522112 - RNA, 15 nt, Homo sapiens
gaagcauaaagcaau

SEQ ID NO: 1522113 - RNA, 13 nt, Homo sapiens
gaagccuugccau

SEQ ID NO: 1522114 - RNA, 22 nt, Homo sapiens
gaagcucccugaaguaagcaaa

SEQ ID NO: 1522115 - RNA, 22 nt, Homo sapiens
gaagcuguguccuugcaccugc

SEQ ID NO: 1522116 - RNA, 17 nt, Homo sapiens
gaagcuugguccacuug

SEQ ID NO: 1522117 - RNA, 22 nt, Homo sapiens
gaaggguucaccaggucaggga

SEQ ID NO: 1522118 - RNA, 21 nt, Homo sapiens
gaaguaagcaaagacuuuccu

SEQ ID NO: 1522119 - RNA, 17 nt, Homo sapiens
gaagucccggcuuccac

SEQ ID NO: 1522120 - RNA, 23 nt, Homo sapiens
gaagucucucuauuacacuggag

SEQ ID NO: 1522121 - RNA, 19 nt, Homo sapiens
gaauaaaauugcacuuuua

SEQ ID NO: 1522122 - RNA, 18 nt, Homo sapiens
gaaucagacuucacacug

SEQ ID NO: 1522123 - RNA, 23 nt, Homo sapiens
gaaugagccguauacaaggaaua

SEQ ID NO: 1522124 - RNA, 20 nt, Homo sapiens
gaauuguggcuguucacucc

SEQ ID NO: 1522125 - RNA, 16 nt, Homo sapiens
gaauuugcaacaguaa

SEQ ID NO: 1522126 - RNA, 17 nt, Homo sapiens
gacaaagaaacccaagu

SEQ ID NO: 1522127 - RNA, 14 nt, Homo sapiens
gacaagcaacccaa

SEQ ID NO: 1522128 - RNA, 16 nt, Homo sapiens
gacaagcaacccaaac

SEQ ID NO: 1522129 - RNA, 19 nt, Homo sapiens
gacagagcagaacuuucac

SEQ ID NO: 1522130 - RNA, 16 nt, Homo sapiens
gaccucccagcccuau

SEQ ID NO: 1522131 - RNA, 12 nt, Homo sapiens
gaccugcugaca

SEQ ID NO: 1522132 - RNA, 16 nt, Homo sapiens
gacuaguuucuuauua

SEQ ID NO: 1522133 - RNA, 19 nt, Homo sapiens
gacucuccagaaagcucau

SEQ ID NO: 1522134 - RNA, 23 nt, Homo sapiens
gacucuccagaaagcucaucuca

SEQ ID NO: 1522135 - RNA, 18 nt, Homo sapiens
gacugaugggacaucaaa

SEQ ID NO: 1522136 - RNA, 16 nt, Homo sapiens
gagaaaaugaauuugg

SEQ ID NO: 1522137 - RNA, 19 nt, Homo sapiens
gagaaggaaggagacucac

SEQ ID NO: 1522138 - RNA, 23 nt, Homo sapiens
gagacaacuucccaaagcacaaa

SEQ ID NO: 1522139 - RNA, 18 nt, Homo sapiens
gagacagaccgggguuca

SEQ ID NO: 1522140 - RNA, 19 nt, Homo sapiens
gagacccccuuuucuuccc

SEQ ID NO: 1522141 - RNA, 15 nt, Homo sapiens
gagacugcugaguca

SEQ ID NO: 1522142 - RNA, 23 nt, Homo sapiens
gagaggagaaggagggagacaug

SEQ ID NO: 1522143 - RNA, 13 nt, Homo sapiens
gagaguuugccac

SEQ ID NO: 1522144 - RNA, 18 nt, Homo sapiens
gagauaauucuagcuuug

SEQ ID NO: 1522145 - RNA, 15 nt, Homo sapiens
gagcagaacuuucac

SEQ ID NO: 1522146 - RNA, 21 nt, Homo sapiens
gagcuguaucuguaauuaaua

SEQ ID NO: 1522147 - RNA, 19 nt, Homo sapiens
gagggaaguuuaaaaccca

SEQ ID NO: 1522148 - RNA, 20 nt, Homo sapiens
gagggaaucacuggugcuau

SEQ ID NO: 1522149 - RNA, 22 nt, Homo sapiens
gagggauaguggggucagggcu

SEQ ID NO: 1522150 - RNA, 13 nt, Homo sapiens
gagucaccaggaa

SEQ ID NO: 1522151 - RNA, 16 nt, Homo sapiens
gauaaauuuguugaau

SEQ ID NO: 1522152 - RNA, 14 nt, Homo sapiens
gauaacugcaauuu

SEQ ID NO: 1522153 - RNA, 17 nt, Homo sapiens
gauaguggggucagggc

SEQ ID NO: 1522154 - RNA, 13 nt, Homo sapiens
gaucagagcauug

SEQ ID NO: 1522155 - RNA, 17 nt, Homo sapiens
gaucugaugcaagcaag

SEQ ID NO: 1522156 - RNA, 13 nt, Homo sapiens
gaugcaagcaaga

SEQ ID NO: 1522157 - RNA, 19 nt, Homo sapiens
gauguaggguaaggugccu

SEQ ID NO: 1522158 - RNA, 13 nt, Homo sapiens
gauucagcauuug

SEQ ID NO: 1522159 - RNA, 13 nt, Homo sapiens
gauucccagagac

SEQ ID NO: 1522160 - RNA, 18 nt, Homo sapiens
gauuuagcauucauauuu

SEQ ID NO: 1522161 - RNA, 12 nt, Homo sapiens
gcaaaucacaaa

SEQ ID NO: 1522162 - RNA, 11 nt, Homo sapiens
gcaacccaaac

SEQ ID NO: 1522163 - RNA, 13 nt, Homo sapiens
gcaaccccaguuc

SEQ ID NO: 1522164 - RNA, 11 nt, Homo sapiens
gcaacugccug

SEQ ID NO: 1522165 - RNA, 22 nt, Homo sapiens
gcacauuagccuaugugcaugc

SEQ ID NO: 1522166 - RNA, 21 nt, Homo sapiens
gcaccaggcacgaacccaccu

SEQ ID NO: 1522167 - RNA, 21 nt, Homo sapiens
gcaccccuccuauaccauaug

SEQ ID NO: 1522168 - RNA, 17 nt, Homo sapiens
gcacuucuguuccaggu

SEQ ID NO: 1522169 - RNA, 22 nt, Homo sapiens
gcagaaacaucggauuugggga

SEQ ID NO: 1522170 - RNA, 13 nt, Homo sapiens
gcagaacuuucac

SEQ ID NO: 1522171 - RNA, 16 nt, Homo sapiens
gcagaggaugucucaa

SEQ ID NO: 1522172 - RNA, 18 nt, Homo sapiens
gccaauauuucugauaua

SEQ ID NO: 1522173 - RNA, 21 nt, Homo sapiens
gccauguuuagauuccaggau

SEQ ID NO: 1522174 - RNA, 19 nt, Homo sapiens
gcccugggccccaccaccu

SEQ ID NO: 1522175 - RNA, 19 nt, Homo sapiens
gcccuugcccugaccuccc

SEQ ID NO: 1522176 - RNA, 19 nt, Homo sapiens
gccgcauucccugagucac

SEQ ID NO: 1522177 - RNA, 23 nt, Homo sapiens
gccggcaaccccaguucugcucc

SEQ ID NO: 1522178 - RNA, 19 nt, Homo sapiens
gccugcuaauagcugcuag

SEQ ID NO: 1522179 - RNA, 15 nt, Homo sapiens
gcuccuugucaauac

SEQ ID NO: 1522180 - RNA, 16 nt, Homo sapiens
gcugaaagacuaccuc

SEQ ID NO: 1522181 - RNA, 18 nt, Homo sapiens
gcuguuguaaagaauugg

SEQ ID NO: 1522182 - RNA, 14 nt, Homo sapiens
gcuuaaauuuccag

SEQ ID NO: 1522183 - RNA, 15 nt, Homo sapiens
gcuucuguccaggac

SEQ ID NO: 1522184 - RNA, 17 nt, Homo sapiens
ggaaaacagaguauuuc

SEQ ID NO: 1522185 - RNA, 19 nt, Homo sapiens
uaugucacccaaugcauau

SEQ ID NO: 1522186 - RNA, 20 nt, Homo sapiens
uaugucacccaaugcauauc

SEQ ID NO: 1522187 - RNA, 15 nt, Homo sapiens
uauguuucacccugu

SEQ ID NO: 1522188 - RNA, 21 nt, Homo sapiens
uauuaaaaucacugucaauau

SEQ ID NO: 1522189 - RNA, 15 nt, Homo sapiens
uauuaagauuuccaa

SEQ ID NO: 1522190 - RNA, 22 nt, Homo sapiens
uauuaauacugccggucaccca

SEQ ID NO: 1522191 - RNA, 18 nt, Homo sapiens
uauuauagaauugcacau

SEQ ID NO: 1522192 - RNA, 22 nt, Homo sapiens
uauuaugugcaacauuaugauu

SEQ ID NO: 1522193 - RNA, 15 nt, Homo sapiens
uauuauugagcucua

SEQ ID NO: 1522194 - RNA, 16 nt, Homo sapiens
uauuauugagcucuau

SEQ ID NO: 1522195 - RNA, 19 nt, Homo sapiens
uauucucacuccaccaccc

SEQ ID NO: 1522196 - RNA, 16 nt, Homo sapiens
uauugcauaauuuaua

SEQ ID NO: 1522197 - RNA, 22 nt, Homo sapiens
uauuuccccaccccacuauccu

SEQ ID NO: 1522198 - RNA, 16 nt, Homo sapiens
uauuuugguugcugau

SEQ ID NO: 1522199 - RNA, 20 nt, Homo sapiens
ucaaaacacuuucccaugag

SEQ ID NO: 1522200 - RNA, 13 nt, Homo sapiens
ucaaaagccaaaa

SEQ ID NO: 1522201 - RNA, 15 nt, Homo sapiens
ucaaaagccaaaaaa

SEQ ID NO: 1522202 - RNA, 19 nt, Homo sapiens
ucaaagcccacauacugga

SEQ ID NO: 1522203 - RNA, 23 nt, Homo sapiens
ucaaagcucuauuaagauuucca

SEQ ID NO: 1522204 - RNA, 15 nt, Homo sapiens
ucaaccaauguagaa

SEQ ID NO: 1522205 - RNA, 20 nt, Homo sapiens
ucaaguuggcuucuaaucaa

SEQ ID NO: 1522206 - RNA, 16 nt, Homo sapiens
ucacagaugugugauu

SEQ ID NO: 1522207 - RNA, 18 nt, Homo sapiens
ucacauucgaguguuuca

SEQ ID NO: 1522208 - RNA, 16 nt, Homo sapiens
ucaccaggucagggag

SEQ ID NO: 1522209 - RNA, 15 nt, Homo sapiens
ucaccucugccucaa

SEQ ID NO: 1522210 - RNA, 18 nt, Homo sapiens
ucacucaaucucugauuc

SEQ ID NO: 1522211 - RNA, 20 nt, Homo sapiens
ucagagcuauguucccucca

SEQ ID NO: 1522212 - RNA, 17 nt, Homo sapiens
ucagauucagcauuugu

SEQ ID NO: 1522213 - RNA, 18 nt, Homo sapiens
ucagcuggaucuccauuc

SEQ ID NO: 1522214 - RNA, 21 nt, Homo sapiens
ucagcuggaucuccauucucu

SEQ ID NO: 1522215 - RNA, 23 nt, Homo sapiens
ucaggccacauggcuaaagaagg

SEQ ID NO: 1522216 - RNA, 20 nt, Homo sapiens
ucagggagaguuugggaacu

SEQ ID NO: 1522217 - RNA, 14 nt, Homo sapiens
ucagguggaaaaac

SEQ ID NO: 1522218 - RNA, 16 nt, Homo sapiens
ucagugaauuugucca

SEQ ID NO: 1522219 - RNA, 21 nt, Homo sapiens
ucagugcuucgcagauguccu

SEQ ID NO: 1522220 - RNA, 19 nt, Homo sapiens
ucauaguguauaauaauau

SEQ ID NO: 1522221 - RNA, 14 nt, Homo sapiens
ucauauuuugccac

SEQ ID NO: 1522222 - RNA, 14 nt, Homo sapiens
ucauuuuugccagu

SEQ ID NO: 1522223 - RNA, 20 nt, Homo sapiens
uccacaagauucccagagac

SEQ ID NO: 1522224 - RNA, 19 nt, Homo sapiens
uccacccacgagcacuuua

SEQ ID NO: 1522225 - RNA, 19 nt, Homo sapiens
uccaccccucuccucagag

SEQ ID NO: 1522226 - RNA, 19 nt, Homo sapiens
uccaucauucauccaggac

SEQ ID NO: 1522227 - RNA, 16 nt, Homo sapiens
uccauuucuucugcac

SEQ ID NO: 1522228 - RNA, 21 nt, Homo sapiens
ucccacccaacagcucagaga

SEQ ID NO: 1522229 - RNA, 14 nt, Homo sapiens
ucccucuggcccug

SEQ ID NO: 1522230 - RNA, 23 nt, Homo sapiens
ucccugaaguaagcaaagacuuu

SEQ ID NO: 1522231 - RNA, 19 nt, Homo sapiens
uccuaaugaaugcauaaaa

SEQ ID NO: 1522232 - RNA, 24 nt, Homo sapiens
uccucagggacagagacaccugca

SEQ ID NO: 1522233 - RNA, 17 nt, Homo sapiens
uccugccagcucaggau

SEQ ID NO: 1522234 - RNA, 14 nt, Homo sapiens
uccugcguccucug

SEQ ID NO: 1522235 - RNA, 20 nt, Homo sapiens
uccuguccaaccuaaccccu

SEQ ID NO: 1522236 - RNA, 13 nt, Homo sapiens
uccuuccauuucu

SEQ ID NO: 1522237 - RNA, 17 nt, Homo sapiens
uccuuucgaaagcaaug

SEQ ID NO: 1522238 - RNA, 17 nt, Homo sapiens
ucgagguagguggauca

SEQ ID NO: 1522239 - RNA, 13 nt, Homo sapiens
ucgcaaaucacaa

SEQ ID NO: 1522240 - RNA, 23 nt, Homo sapiens
ucgcguggaucuacccucuaguu

SEQ ID NO: 1522241 - RNA, 14 nt, Homo sapiens
ucuagcaguaaaag

SEQ ID NO: 1522242 - RNA, 16 nt, Homo sapiens
ucucauuaaaauccag

SEQ ID NO: 1522243 - RNA, 20 nt, Homo sapiens
ucucauuaaaauccaguauu

SEQ ID NO: 1522244 - RNA, 16 nt, Homo sapiens
ucuccagaaagcucau

SEQ ID NO: 1522245 - RNA, 20 nt, Homo sapiens
ucuccagaaagcucaucuca

SEQ ID NO: 1522246 - RNA, 20 nt, Homo sapiens
ucucuuuacuucccaguaua

SEQ ID NO: 1522247 - RNA, 16 nt, Homo sapiens
ucucuuugccauuucu

SEQ ID NO: 1522248 - RNA, 22 nt, Homo sapiens
ucugaaacccuccuccacagcu

SEQ ID NO: 1522249 - RNA, 18 nt, Homo sapiens
ucugaaugugcugaucau

SEQ ID NO: 1522250 - RNA, 17 nt, Homo sapiens
ucugauguuacugagau

SEQ ID NO: 1522251 - RNA, 13 nt, Homo sapiens
ucugggugcagua

SEQ ID NO: 1522252 - RNA, 16 nt, Homo sapiens
ucuuagucgagccaag

SEQ ID NO: 1522253 - RNA, 16 nt, Homo sapiens
ucuuaguggaagacaa

SEQ ID NO: 1522254 - RNA, 18 nt, Homo sapiens
ucuucacucaaucucuga

SEQ ID NO: 1522255 - RNA, 16 nt, Homo sapiens
ucuucuucagauucag

SEQ ID NO: 1522256 - RNA, 19 nt, Homo sapiens
ucuuuguaaugucaccacc

SEQ ID NO: 1522257 - RNA, 20 nt, Homo sapiens
ugaaacccuccaaaucucca

SEQ ID NO: 1522258 - RNA, 20 nt, Homo sapiens
ugaaauauuaaaaucacugu

SEQ ID NO: 1522259 - RNA, 20 nt, Homo sapiens
ugaaauuaauuugugaauuu

SEQ ID NO: 1522260 - RNA, 22 nt, Homo sapiens
ugaaauuaauuugugaauuugc

SEQ ID NO: 1522261 - RNA, 14 nt, Homo sapiens
ugaacuaguuuuac

SEQ ID NO: 1522262 - RNA, 14 nt, Homo sapiens
ugaauacaggcaua

SEQ ID NO: 1522263 - RNA, 14 nt, Homo sapiens
ugaauaucuuccac

SEQ ID NO: 1522264 - RNA, 14 nt, Homo sapiens
ugaauccugugaua

SEQ ID NO: 1522265 - RNA, 17 nt, Homo sapiens
ugaaucuuggugucuac

SEQ ID NO: 1522266 - RNA, 12 nt, Homo sapiens
ugaaugauuucc

SEQ ID NO: 1522267 - RNA, 11 nt, Homo sapiens
ugaaugugcug

SEQ ID NO: 1522268 - RNA, 16 nt, Homo sapiens
ugaauuuuaaauguuc

SEQ ID NO: 1522269 - RNA, 12 nt, Homo sapiens
ugacccaaacau

SEQ ID NO: 1522270 - RNA, 13 nt, Homo sapiens
ugacuucuagaaa

SEQ ID NO: 1522271 - RNA, 19 nt, Homo sapiens
ugagaggagagagacucca

SEQ ID NO: 1522272 - RNA, 23 nt, Homo sapiens
ugagaggagagagacuccagcug

SEQ ID NO: 1522273 - RNA, 18 nt, Homo sapiens
ugagcaggacggguacca

SEQ ID NO: 1522274 - RNA, 16 nt, Homo sapiens
ugagggaucugucuca

SEQ ID NO: 1522275 - RNA, 15 nt, Homo sapiens
ugagggccgcuuuga

SEQ ID NO: 1522276 - RNA, 13 nt, Homo sapiens
ugaggucugggau

SEQ ID NO: 1522277 - RNA, 20 nt, Homo sapiens
ugaguauuccaccacaggaa

SEQ ID NO: 1522278 - RNA, 20 nt, Homo sapiens
ugagucaugaucucccugcc

SEQ ID NO: 1522279 - RNA, 19 nt, Homo sapiens
ugaguuacuaucaugucaa

SEQ ID NO: 1522280 - RNA, 14 nt, Homo sapiens
ugauaaaguauuau

SEQ ID NO: 1522281 - RNA, 15 nt, Homo sapiens
ugaucacugagccau

SEQ ID NO: 1522282 - RNA, 15 nt, Homo sapiens
ugaugggacaucaaa

SEQ ID NO: 1522283 - RNA, 17 nt, Homo sapiens
ugaugucguuugaauca

SEQ ID NO: 1522284 - RNA, 17 nt, Homo sapiens
ugauuaaaaaacugaca

SEQ ID NO: 1522285 - RNA, 18 nt, Homo sapiens
ugauuaaucugauuauac

SEQ ID NO: 1522286 - RNA, 15 nt, Homo sapiens
ugauucacaguguga

SEQ ID NO: 1522287 - RNA, 14 nt, Homo sapiens
ugauuuagcauuca

SEQ ID NO: 1522288 - RNA, 11 nt, Homo sapiens
ugcacuuuuaa

SEQ ID NO: 1522289 - RNA, 19 nt, Homo sapiens
ugcagaaauuugaaugaca

SEQ ID NO: 1522290 - RNA, 18 nt, Homo sapiens
ugcauccguaguucccug

SEQ ID NO: 1522291 - RNA, 22 nt, Homo sapiens
ugcauggcucccgaguacagua

SEQ ID NO: 1522292 - RNA, 17 nt, Homo sapiens
ugcauuaucuaugauau

SEQ ID NO: 1522293 - RNA, 21 nt, Homo sapiens
ugcauucaaccuuaccaaaaa

SEQ ID NO: 1522294 - RNA, 14 nt, Homo sapiens
ugccauguuuagau

SEQ ID NO: 1522295 - RNA, 16 nt, Homo sapiens
ugcccaguguguuucu

SEQ ID NO: 1522296 - RNA, 18 nt, Homo sapiens
ugcccuccaagaggcucc

SEQ ID NO: 1522297 - RNA, 21 nt, Homo sapiens
ugccucauuaccuugugcuaa

SEQ ID NO: 1522298 - RNA, 22 nt, Homo sapiens
ugccucauuaccuugugcuaau

SEQ ID NO: 1522299 - RNA, 20 nt, Homo sapiens
ugcggaaaaacaaacaugaa

SEQ ID NO: 1522300 - RNA, 14 nt, Homo sapiens
ugcguccucugucc

SEQ ID NO: 1522301 - RNA, 18 nt, Homo sapiens
ugcuaauucaaagcucua

SEQ ID NO: 1522302 - RNA, 18 nt, Homo sapiens
ugcuaucgcaaaucacaa

SEQ ID NO: 1522303 - RNA, 22 nt, Homo sapiens
ugcucagggaauaauccagaaa

SEQ ID NO: 1522304 - RNA, 21 nt, Homo sapiens
ugcuccuugauaaaguauuau

SEQ ID NO: 1522305 - RNA, 19 nt, Homo sapiens
uggaaguaguaauugcaag

SEQ ID NO: 1522306 - RNA, 15 nt, Homo sapiens
uggaagugugugauc

SEQ ID NO: 1522307 - RNA, 17 nt, Homo sapiens
uggacagauggaccaaa

SEQ ID NO: 1522308 - RNA, 15 nt, Homo sapiens
uggcacccaugcacc

SEQ ID NO: 1522309 - RNA, 17 nt, Homo sapiens
aauuuuaaauguucaca

SEQ ID NO: 1522310 - RNA, 12 nt, Homo sapiens
aauuuugugcua

SEQ ID NO: 1522311 - RNA, 13 nt, Homo sapiens
acaaaggugcuaa

SEQ ID NO: 1522312 - RNA, 20 nt, Homo sapiens
acaacgggccagcucuagua

SEQ ID NO: 1522313 - RNA, 16 nt, Homo sapiens
acaagaaucaccucaa

SEQ ID NO: 1522314 - RNA, 15 nt, Homo sapiens
acaagcaacccaaac

SEQ ID NO: 1522315 - RNA, 15 nt, Homo sapiens
acaaucuguauauaa

SEQ ID NO: 1522316 - RNA, 21 nt, Homo sapiens
acacacuaacaaaagcaugaa

SEQ ID NO: 1522317 - RNA, 12 nt, Homo sapiens
acacuuucccau

SEQ ID NO: 1522318 - RNA, 15 nt, Homo sapiens
acaguaaugcaagca

SEQ ID NO: 1522319 - RNA, 20 nt, Homo sapiens
acaguguuauguaguauugu

SEQ ID NO: 1522320 - RNA, 20 nt, Homo sapiens
acaucaaauuugccaccacu

SEQ ID NO: 1522321 - RNA, 19 nt, Homo sapiens
acaugaccaaaaaccaaaa

SEQ ID NO: 1522322 - RNA, 14 nt, Homo sapiens
acaugauacugaug

SEQ ID NO: 1522323 - RNA, 22 nt, Homo sapiens
acaugcuagugauaucuagaaa

SEQ ID NO: 1522324 - RNA, 18 nt, Homo sapiens
acaugcugcuaauucaaa

SEQ ID NO: 1522325 - RNA, 21 nt, Homo sapiens
acauggaaaacagaguauuuc

SEQ ID NO: 1522326 - RNA, 16 nt, Homo sapiens
acauuugcaccacuug

SEQ ID NO: 1522327 - RNA, 14 nt, Homo sapiens
acauuugugcagaa

SEQ ID NO: 1522328 - RNA, 20 nt, Homo sapiens
acauuuuuguggcuuaugac

SEQ ID NO: 1522329 - RNA, 17 nt, Homo sapiens
accaaugagcuguaucu

SEQ ID NO: 1522330 - RNA, 13 nt, Homo sapiens
accaggucaggga

SEQ ID NO: 1522331 - RNA, 14 nt, Homo sapiens
accaggucagggag

SEQ ID NO: 1522332 - RNA, 22 nt, Homo sapiens
accauccuuguagacucagaaa

SEQ ID NO: 1522333 - RNA, 21 nt, Homo sapiens
acccccucaaaagccaaaaaa

SEQ ID NO: 1522334 - RNA, 23 nt, Homo sapiens
acccuccugcgcaggccaugcau

SEQ ID NO: 1522335 - RNA, 21 nt, Homo sapiens
acccugcucccacgccugcuu

SEQ ID NO: 1522336 - RNA, 17 nt, Homo sapiens
accucacugacacaggg

SEQ ID NO: 1522337 - RNA, 13 nt, Homo sapiens
accugaaucacaa

SEQ ID NO: 1522338 - RNA, 21 nt, Homo sapiens
accugcugacauaguggaugg

SEQ ID NO: 1522339 - RNA, 19 nt, Homo sapiens
accuggguggggucaggga

SEQ ID NO: 1522340 - RNA, 13 nt, Homo sapiens
accuuaccaaaaa

SEQ ID NO: 1522341 - RNA, 15 nt, Homo sapiens
acggguaccaugcug

SEQ ID NO: 1522342 - RNA, 20 nt, Homo sapiens
acguuucucauuaaaaucca

SEQ ID NO: 1522343 - RNA, 18 nt, Homo sapiens
acuaccucaaaacacuuu

SEQ ID NO: 1522344 - RNA, 21 nt, Homo sapiens
acucaaucucugauucuguca

SEQ ID NO: 1522345 - RNA, 14 nt, Homo sapiens
acuccaucauucau

SEQ ID NO: 1522346 - RNA, 17 nt, Homo sapiens
acuccccuaaacuccag

SEQ ID NO: 1522347 - RNA, 13 nt, Homo sapiens
acuccuaaaucaa

SEQ ID NO: 1522348 - RNA, 22 nt, Homo sapiens
acucuccagaaagcucaucuca

SEQ ID NO: 1522349 - RNA, 16 nt, Homo sapiens
acugaaaaaugucagu

SEQ ID NO: 1522350 - RNA, 21 nt, Homo sapiens
acugcaacuugugaacuccau

SEQ ID NO: 1522351 - RNA, 20 nt, Homo sapiens
acuucccaaagcacaaagca

SEQ ID NO: 1522352 - RNA, 23 nt, Homo sapiens
acuuuaauuuccuugacuguaaa

SEQ ID NO: 1522353 - RNA, 22 nt, Homo sapiens
acuuucucuuugccauuucuuc

SEQ ID NO: 1522354 - RNA, 12 nt, Homo sapiens
agaaaacauuuu

SEQ ID NO: 1522355 - RNA, 11 nt, Homo sapiens
agaaaaccaaa

SEQ ID NO: 1522356 - RNA, 13 nt, Homo sapiens
agaaacacugggc

SEQ ID NO: 1522357 - RNA, 12 nt, Homo sapiens
agaaacccaagu

SEQ ID NO: 1522358 - RNA, 21 nt, Homo sapiens
agaagauggcagauacaggag

SEQ ID NO: 1522359 - RNA, 18 nt, Homo sapiens
agaaggagggagacauga

SEQ ID NO: 1522360 - RNA, 15 nt, Homo sapiens
agaaugugacaggca

SEQ ID NO: 1522361 - RNA, 13 nt, Homo sapiens
agaauuacauaaa

SEQ ID NO: 1522362 - RNA, 22 nt, Homo sapiens
agaauuccugaagccagaucca

SEQ ID NO: 1522363 - RNA, 20 nt, Homo sapiens
agaccgggguucaagccaug

SEQ ID NO: 1522364 - RNA, 14 nt, Homo sapiens
agacugccaaagaa

SEQ ID NO: 1522365 - RNA, 12 nt, Homo sapiens
agacuuugacuc

SEQ ID NO: 1522366 - RNA, 13 nt, Homo sapiens
agagacaccugca

SEQ ID NO: 1522367 - RNA, 19 nt, Homo sapiens
agagacuuugacucuccag

SEQ ID NO: 1522368 - RNA, 19 nt, Homo sapiens
agagggaaguuuaaaaccc

SEQ ID NO: 1522369 - RNA, 21 nt, Homo sapiens
agagggaaguuuaaaacccaa

SEQ ID NO: 1522370 - RNA, 19 nt, Homo sapiens
agagucccggcguuuaccu

SEQ ID NO: 1522371 - RNA, 23 nt, Homo sapiens
agagucugaaagacagaauguca

SEQ ID NO: 1522372 - RNA, 18 nt, Homo sapiens
agauccacccuaucccug

SEQ ID NO: 1522373 - RNA, 22 nt, Homo sapiens
agauccacccucaaaugucaga

SEQ ID NO: 1522374 - RNA, 20 nt, Homo sapiens
agaugcauuaucuaugauau

SEQ ID NO: 1522375 - RNA, 21 nt, Homo sapiens
agauuauuucuguauuuggcu

SEQ ID NO: 1522376 - RNA, 16 nt, Homo sapiens
agauuauuugcccaaa

SEQ ID NO: 1522377 - RNA, 20 nt, Homo sapiens
agcacacaauaagcauucaa

SEQ ID NO: 1522378 - RNA, 19 nt, Homo sapiens
agcauuuguucuuugccag

SEQ ID NO: 1522379 - RNA, 10 nt, Homo sapiens
agccaaaaaa

SEQ ID NO: 1522380 - RNA, 21 nt, Homo sapiens
agccugcucccccacccccuc

SEQ ID NO: 1522381 - RNA, 13 nt, Homo sapiens
agcuguacuguaa

SEQ ID NO: 1522382 - RNA, 20 nt, Homo sapiens
aggaauauuuucuucugcac

SEQ ID NO: 1522383 - RNA, 23 nt, Homo sapiens
aggcaaugcucaaacacccaagu

SEQ ID NO: 1522384 - RNA, 13 nt, Homo sapiens
aggcacagaugaa

SEQ ID NO: 1522385 - RNA, 22 nt, Homo sapiens
aggcaguauuauugagcucuau

SEQ ID NO: 1522386 - RNA, 17 nt, Homo sapiens
agggaauaauccagaaa

SEQ ID NO: 1522387 - RNA, 23 nt, Homo sapiens
agguccuuguuuuguuuuguuca

SEQ ID NO: 1522388 - RNA, 17 nt, Homo sapiens
aggucugggaugcugcg

SEQ ID NO: 1522389 - RNA, 15 nt, Homo sapiens
agguucaaaagcaau

SEQ ID NO: 1522390 - RNA, 13 nt, Homo sapiens
aguaaugaugucg

SEQ ID NO: 1522391 - RNA, 22 nt, Homo sapiens
aguaaugcaagcaaaguaucaa

SEQ ID NO: 1522392 - RNA, 14 nt, Homo sapiens
aguaauugcaagag

SEQ ID NO: 1522393 - RNA, 11 nt, Homo sapiens
aguaauuuugc

SEQ ID NO: 1522394 - RNA, 18 nt, Homo sapiens
aguacaguaguaucugcu

SEQ ID NO: 1522395 - RNA, 20 nt, Homo sapiens
aguaugcagauuauuugccc

SEQ ID NO: 1522396 - RNA, 16 nt, Homo sapiens
agucaauuugcugaaa

SEQ ID NO: 1522397 - RNA, 11 nt, Homo sapiens
agucccggcuu

SEQ ID NO: 1522398 - RNA, 19 nt, Homo sapiens
aguccugcccaaugccuug

SEQ ID NO: 1522399 - RNA, 17 nt, Homo sapiens
agucuaggagcugggag

SEQ ID NO: 1522400 - RNA, 16 nt, Homo sapiens
agucugaaagacagaa

SEQ ID NO: 1522401 - RNA, 23 nt, Homo sapiens
agucuguccugcguccucugucc

SEQ ID NO: 1522402 - RNA, 21 nt, Homo sapiens
agugaauugacccauguuccc

SEQ ID NO: 1522403 - RNA, 20 nt, Homo sapiens
agugccaauauuucugauau

SEQ ID NO: 1522404 - RNA, 21 nt, Homo sapiens
aguuuaaaacccaaacuucca

SEQ ID NO: 1522405 - RNA, 23 nt, Homo sapiens
aguuugaguuacuaucaugucaa

SEQ ID NO: 1522406 - RNA, 13 nt, Homo sapiens
auaaaaaccauaa

SEQ ID NO: 1522407 - RNA, 14 nt, Homo sapiens
auaaaauugcacuu

SEQ ID NO: 1522408 - RNA, 14 nt, Homo sapiens
auaaauugauuugu

SEQ ID NO: 1522409 - RNA, 21 nt, Homo sapiens
auaauaaaucugccugcaacu

SEQ ID NO: 1522410 - RNA, 18 nt, Homo sapiens
auaauacaaaggugcuaa

SEQ ID NO: 1522411 - RNA, 17 nt, Homo sapiens
auaaugcuguugccuca

SEQ ID NO: 1522412 - RNA, 18 nt, Homo sapiens
auaauuuuguugcuacau

SEQ ID NO: 1522413 - RNA, 13 nt, Homo sapiens
auacaugcugcua

SEQ ID NO: 1522414 - RNA, 14 nt, Homo sapiens
auagccacuauuaa

SEQ ID NO: 1522415 - RNA, 18 nt, Homo sapiens
auagguucaaaagcaauc

SEQ ID NO: 1522416 - RNA, 13 nt, Homo sapiens
auaucaugcucca

SEQ ID NO: 1522417 - RNA, 22 nt, Homo sapiens
auauuuguaugauccuaaugaa

SEQ ID NO: 1522418 - RNA, 12 nt, Homo sapiens
auauuuugccac

SEQ ID NO: 1522419 - RNA, 16 nt, Homo sapiens
auauuuuucuaaagaa

SEQ ID NO: 1522420 - RNA, 23 nt, Homo sapiens
auauuuuuuuccuuugcauucau

SEQ ID NO: 1522421 - RNA, 18 nt, Homo sapiens
aucaaauuugccaccacu

SEQ ID NO: 1522422 - RNA, 19 nt, Homo sapiens
aucacauucgaguguuuca

SEQ ID NO: 1522423 - RNA, 17 nt, Homo sapiens
aucacucauucuaugaa

SEQ ID NO: 1522424 - RNA, 19 nt, Homo sapiens
aucacucauucuaugaaca

SEQ ID NO: 1522425 - RNA, 15 nt, Homo sapiens
aucauuaugaaguca

SEQ ID NO: 1522426 - RNA, 17 nt, Homo sapiens
aucauuuccugggagaa

SEQ ID NO: 1522427 - RNA, 17 nt, Homo sapiens
auccaacaugugcucag

SEQ ID NO: 1522428 - RNA, 20 nt, Homo sapiens
auccaacaugugcucaggga

SEQ ID NO: 1522429 - RNA, 23 nt, Homo sapiens
auccaagcgaggucaacagagaa

SEQ ID NO: 1522430 - RNA, 20 nt, Homo sapiens
aucccacccaacagcucaga

SEQ ID NO: 1522431 - RNA, 16 nt, Homo sapiens
aucuaugauaugcuaa

SEQ ID NO: 1522432 - RNA, 15 nt, Homo sapiens
aucuccauucucuca

SEQ ID NO: 1522433 - RNA, 14 nt, Homo sapiens
aaaacccaaacuuc

SEQ ID NO: 1522434 - RNA, 14 nt, Homo sapiens
aaaacugacagagg

SEQ ID NO: 1522435 - RNA, 13 nt, Homo sapiens
aaaacugccaaaa

SEQ ID NO: 1522436 - RNA, 17 nt, Homo sapiens
aaaaugucagucugguu

SEQ ID NO: 1522437 - RNA, 15 nt, Homo sapiens
aaaauugcacuuuua

SEQ ID NO: 1522438 - RNA, 13 nt, Homo sapiens
aaacacuuuccca

SEQ ID NO: 1522439 - RNA, 17 nt, Homo sapiens
aaacauuuuuguggcuu

SEQ ID NO: 1522440 - RNA, 18 nt, Homo sapiens
aaaccaaaagugcauuca

SEQ ID NO: 1522441 - RNA, 19 nt, Homo sapiens
aaaccauaaacauuugcac

SEQ ID NO: 1522442 - RNA, 16 nt, Homo sapiens
aaacccaaacuuccaa

SEQ ID NO: 1522443 - RNA, 17 nt, Homo sapiens
aaacuacccuccagagu

SEQ ID NO: 1522444 - RNA, 17 nt, Homo sapiens
aaacuaccuuccaguuc

SEQ ID NO: 1522445 - RNA, 16 nt, Homo sapiens
aaacuauggcuuuaaa

SEQ ID NO: 1522446 - RNA, 13 nt, Homo sapiens
aaagaagguuuca

SEQ ID NO: 1522447 - RNA, 15 nt, Homo sapiens
aaagauccacccuca

SEQ ID NO: 1522448 - RNA, 15 nt, Homo sapiens
aaagcaggugcccag

SEQ ID NO: 1522449 - RNA, 15 nt, Homo sapiens
aaagcauugagaucu

SEQ ID NO: 1522450 - RNA, 12 nt, Homo sapiens
aaagccaaaaaa

SEQ ID NO: 1522451 - RNA, 13 nt, Homo sapiens
aaagccaaaaaau

SEQ ID NO: 1522452 - RNA, 22 nt, Homo sapiens
aaaggugcuauuuaacauggga

SEQ ID NO: 1522453 - RNA, 12 nt, Homo sapiens
aaagugcauuca

SEQ ID NO: 1522454 - RNA, 15 nt, Homo sapiens
aaauagccacuauua

SEQ ID NO: 1522455 - RNA, 13 nt, Homo sapiens
aaauaguuuuaaa

SEQ ID NO: 1522456 - RNA, 13 nt, Homo sapiens
aaaucacugucaa

SEQ ID NO: 1522457 - RNA, 20 nt, Homo sapiens
aaaugaggagguacauugaa

SEQ ID NO: 1522458 - RNA, 18 nt, Homo sapiens
aaaugcauccauuccuca

SEQ ID NO: 1522459 - RNA, 17 nt, Homo sapiens
aaaugucacaguaaugc

SEQ ID NO: 1522460 - RNA, 21 nt, Homo sapiens
aaauuaucuauaaucucagaa

SEQ ID NO: 1522461 - RNA, 23 nt, Homo sapiens
aaucacacgucuggcuucacaga

SEQ ID NO: 1522462 - RNA, 23 nt, Homo sapiens
aauccugaauaaaccaguaucgu

SEQ ID NO: 1522463 - RNA, 22 nt, Homo sapiens
aauccuuccauuucuucugcac

SEQ ID NO: 1522464 - RNA, 16 nt, Homo sapiens
aaucucagaacccaga

SEQ ID NO: 1522465 - RNA, 20 nt, Homo sapiens
aaucugucuccccagaagac

SEQ ID NO: 1522466 - RNA, 23 nt, Homo sapiens
aaucuucuucagauucagcauuu

SEQ ID NO: 1522467 - RNA, 17 nt, Homo sapiens
aaugagcuguaucugua

SEQ ID NO: 1522468 - RNA, 19 nt, Homo sapiens
aaugcauauccaacaugug

SEQ ID NO: 1522469 - RNA, 17 nt, Homo sapiens
aaugcuauaacuauguu

SEQ ID NO: 1522470 - RNA, 19 nt, Homo sapiens
aaugggagacaauuucaca

SEQ ID NO: 1522471 - RNA, 22 nt, Homo sapiens
aaugguuucccgggcccagaaa

SEQ ID NO: 1522472 - RNA, 23 nt, Homo sapiens
aauguuaaguugauggugaugaa

SEQ ID NO: 1522473 - RNA, 14 nt, Homo sapiens
aauuaauacagagu

SEQ ID NO: 1522474 - RNA, 21 nt, Homo sapiens
aauuaauuugugaauuugcaa

SEQ ID NO: 1522475 - RNA, 19 nt, Homo sapiens
aauucugauguuacugaga

SEQ ID NO: 1522476 - RNA, 21 nt, Homo sapiens
aauugauuauucugauuccac

SEQ ID NO: 1522477 - RNA, 14 nt, Homo sapiens
aauugcacauaguu

SEQ ID NO: 1522478 - RNA, 15 nt, Homo sapiens
aauuuagagucaauu

SEQ ID NO: 1522479 - RNA, 15 nt, Homo sapiens
aauuuagucacacca

SEQ ID NO: 1522480 - RNA, 23 nt, Homo sapiens
aauuugcaacaguaaucagaguu

SEQ ID NO: 1522481 - RNA, 13 nt, Homo sapiens
aauuuugugcuau

SEQ ID NO: 1522482 - RNA, 21 nt, Homo sapiens
acaaaaauguaaugaucauaa

SEQ ID NO: 1522483 - RNA, 13 nt, Homo sapiens
acaaaacugccaa

SEQ ID NO: 1522484 - RNA, 16 nt, Homo sapiens
acaaacuacauguaau

SEQ ID NO: 1522485 - RNA, 15 nt, Homo sapiens
acaaauaguucugaa

SEQ ID NO: 1522486 - RNA, 17 nt, Homo sapiens
acaacauaaggagaaug

SEQ ID NO: 1522487 - RNA, 23 nt, Homo sapiens
acaauauaaacugaaaaauguca

SEQ ID NO: 1522488 - RNA, 22 nt, Homo sapiens
acacacuaacaaaagcaugaaa

SEQ ID NO: 1522489 - RNA, 21 nt, Homo sapiens
acacugggcuucuagaaccag

SEQ ID NO: 1522490 - RNA, 15 nt, Homo sapiens
acagagcagaacuuu

SEQ ID NO: 1522491 - RNA, 18 nt, Homo sapiens
acagagcagaacuuucac

SEQ ID NO: 1522492 - RNA, 14 nt, Homo sapiens
acagggugcuccuu

SEQ ID NO: 1522493 - RNA, 17 nt, Homo sapiens
acaguauacgcuccauc

SEQ ID NO: 1522494 - RNA, 15 nt, Homo sapiens
acauaucauuuguga

SEQ ID NO: 1522495 - RNA, 17 nt, Homo sapiens
acaugaauccugugaua

SEQ ID NO: 1522496 - RNA, 14 nt, Homo sapiens
acaugaccaaaaac

SEQ ID NO: 1522497 - RNA, 16 nt, Homo sapiens
acauucgaguguuuca

SEQ ID NO: 1522498 - RNA, 15 nt, Homo sapiens
acauuguuaggugcu

SEQ ID NO: 1522499 - RNA, 15 nt, Homo sapiens
acauuugcaccacuu

SEQ ID NO: 1522500 - RNA, 14 nt, Homo sapiens
acauuugugcuguu

SEQ ID NO: 1522501 - RNA, 16 nt, Homo sapiens
accaaaagugcauuca

SEQ ID NO: 1522502 - RNA, 19 nt, Homo sapiens
accaaaauaaaaauugaaa

SEQ ID NO: 1522503 - RNA, 14 nt, Homo sapiens
accaaaggugcuac

SEQ ID NO: 1522504 - RNA, 14 nt, Homo sapiens
accaacauggagaa

SEQ ID NO: 1522505 - RNA, 16 nt, Homo sapiens
accaaccgaacaugac

SEQ ID NO: 1522506 - RNA, 20 nt, Homo sapiens
accaccuucccagcucuccc

SEQ ID NO: 1522507 - RNA, 15 nt, Homo sapiens
acccacaucuaaugu

SEQ ID NO: 1522508 - RNA, 17 nt, Homo sapiens
acccacaucuaaugucu

SEQ ID NO: 1522509 - RNA, 15 nt, Homo sapiens
acccucaaaugucag

SEQ ID NO: 1522510 - RNA, 11 nt, Homo sapiens
accucagggcu

SEQ ID NO: 1522511 - RNA, 13 nt, Homo sapiens
accucguggugug

SEQ ID NO: 1522512 - RNA, 15 nt, Homo sapiens
accucugcaagacaa

SEQ ID NO: 1522513 - RNA, 23 nt, Homo sapiens
accuuacauuugaaaucuaugaa

SEQ ID NO: 1522514 - RNA, 17 nt, Homo sapiens
accuugaaccugucacc

SEQ ID NO: 1522515 - RNA, 16 nt, Homo sapiens
acuaguuuuacuuuga

SEQ ID NO: 1522516 - RNA, 15 nt, Homo sapiens
acuauccucacuccc

SEQ ID NO: 1522517 - RNA, 13 nt, Homo sapiens
acucaaucucuga

SEQ ID NO: 1522518 - RNA, 12 nt, Homo sapiens
acucacccaagc

SEQ ID NO: 1522519 - RNA, 17 nt, Homo sapiens
acucaccucugccucaa

SEQ ID NO: 1522520 - RNA, 14 nt, Homo sapiens
acuccuaaaucaag

SEQ ID NO: 1522521 - RNA, 15 nt, Homo sapiens
acucuuacaccuguu

SEQ ID NO: 1522522 - RNA, 19 nt, Homo sapiens
acugugugugcaaagguga

SEQ ID NO: 1522523 - RNA, 13 nt, Homo sapiens
acuucaagugcau

SEQ ID NO: 1522524 - RNA, 17 nt, Homo sapiens
acuugcuuaaauugugg

SEQ ID NO: 1522525 - RNA, 13 nt, Homo sapiens
acuugggaacuag

SEQ ID NO: 1522526 - RNA, 23 nt, Homo sapiens
acuuuccacccucucuccaccug

SEQ ID NO: 1522527 - RNA, 19 nt, Homo sapiens
acuuucucuuugccauuuc

SEQ ID NO: 1522528 - RNA, 16 nt, Homo sapiens
acuuuugauaaguauc

SEQ ID NO: 1522529 - RNA, 14 nt, Homo sapiens
agaaagcucaucuc

SEQ ID NO: 1522530 - RNA, 21 nt, Homo sapiens
auucucacuccaccacccaaa

SEQ ID NO: 1522531 - RNA, 21 nt, Homo sapiens
auucucucaggcuugcugcca

SEQ ID NO: 1522532 - RNA, 22 nt, Homo sapiens
auucuuuccccucagagcucuu

SEQ ID NO: 1522533 - RNA, 22 nt, Homo sapiens
auugaguuguaucguguggugu

SEQ ID NO: 1522534 - RNA, 22 nt, Homo sapiens
auugaucagagcauugugcaau

SEQ ID NO: 1522535 - RNA, 22 nt, Homo sapiens
auugcacauaguucugcccaaa

SEQ ID NO: 1522536 - RNA, 19 nt, Homo sapiens
auugcacuuuuaaaccucu

SEQ ID NO: 1522537 - RNA, 19 nt, Homo sapiens
auugucagaguucugcucu

SEQ ID NO: 1522538 - RNA, 20 nt, Homo sapiens
auugucagaguucugcucua

SEQ ID NO: 1522539 - RNA, 19 nt, Homo sapiens
auugugcaauacaguuuca

SEQ ID NO: 1522540 - RNA, 19 nt, Homo sapiens
auuguuaggugcugaccua

SEQ ID NO: 1522541 - RNA, 18 nt, Homo sapiens
auuuagagucaauuugcu

SEQ ID NO: 1522542 - RNA, 17 nt, Homo sapiens
auuuagucacaccaucu

SEQ ID NO: 1522543 - RNA, 19 nt, Homo sapiens
auuucagauacuugaagaa

SEQ ID NO: 1522544 - RNA, 20 nt, Homo sapiens
auuucagauacuugaagaau

SEQ ID NO: 1522545 - RNA, 21 nt, Homo sapiens
auuucugauauaacaaacuac

SEQ ID NO: 1522546 - RNA, 16 nt, Homo sapiens
auuugaaugacaagau

SEQ ID NO: 1522547 - RNA, 14 nt, Homo sapiens
auuugagaagaaau

SEQ ID NO: 1522548 - RNA, 13 nt, Homo sapiens
auuugccaccacu

SEQ ID NO: 1522549 - RNA, 20 nt, Homo sapiens
auuuuguccagaagaauuca

SEQ ID NO: 1522550 - RNA, 21 nt, Homo sapiens
auuuuugaaaauccugaauaa

SEQ ID NO: 1522551 - RNA, 13 nt, Homo sapiens
caaaaaccaaaag

SEQ ID NO: 1522552 - RNA, 19 nt, Homo sapiens
caaaaauguaaugaucaua

SEQ ID NO: 1522553 - RNA, 12 nt, Homo sapiens
caaaagccaaaa

SEQ ID NO: 1522554 - RNA, 14 nt, Homo sapiens
caaaagugcauuca

SEQ ID NO: 1522555 - RNA, 16 nt, Homo sapiens
caaacuacauguaauc

SEQ ID NO: 1522556 - RNA, 23 nt, Homo sapiens
caaacuaccuuccaguuccucau

SEQ ID NO: 1522557 - RNA, 14 nt, Homo sapiens
caaacuucaagggu

SEQ ID NO: 1522558 - RNA, 17 nt, Homo sapiens
caaagaaucuaucacua

SEQ ID NO: 1522559 - RNA, 16 nt, Homo sapiens
caaagacaaaggugag

SEQ ID NO: 1522560 - RNA, 12 nt, Homo sapiens
caaagcacaaag

SEQ ID NO: 1522561 - RNA, 21 nt, Homo sapiens
caaaucuaguuuccuauggaa

SEQ ID NO: 1522562 - RNA, 22 nt, Homo sapiens
caaaucugucuccccagaagac

SEQ ID NO: 1522563 - RNA, 21 nt, Homo sapiens
caaaugucagagcuauguucc

SEQ ID NO: 1522564 - RNA, 20 nt, Homo sapiens
caaauuacuccaagguuuau

SEQ ID NO: 1522565 - RNA, 19 nt, Homo sapiens
caacaauacaugcugcuaa

SEQ ID NO: 1522566 - RNA, 21 nt, Homo sapiens
caacauaaggagaauguaucu

SEQ ID NO: 1522567 - RNA, 20 nt, Homo sapiens
caacccaauaguuguugauu

SEQ ID NO: 1522568 - RNA, 19 nt, Homo sapiens
caacgggccagcucuagua

SEQ ID NO: 1522569 - RNA, 20 nt, Homo sapiens
caacuucccaaagcacaaag

SEQ ID NO: 1522570 - RNA, 20 nt, Homo sapiens
caagaggaaaaacagggaaa

SEQ ID NO: 1522571 - RNA, 14 nt, Homo sapiens
caagcaacccaaac

SEQ ID NO: 1522572 - RNA, 17 nt, Homo sapiens
caagcugagugacugua

SEQ ID NO: 1522573 - RNA, 16 nt, Homo sapiens
caaggcauccaugaaa

SEQ ID NO: 1522574 - RNA, 19 nt, Homo sapiens
caaguggcccccacccuca

SEQ ID NO: 1522575 - RNA, 15 nt, Homo sapiens
caauacaugcugcua

SEQ ID NO: 1522576 - RNA, 17 nt, Homo sapiens
caauacaugcugcuaau

SEQ ID NO: 1522577 - RNA, 21 nt, Homo sapiens
caauacaugcugcuaauucaa

SEQ ID NO: 1522578 - RNA, 12 nt, Homo sapiens
caauacugagcc

SEQ ID NO: 1522579 - RNA, 14 nt, Homo sapiens
caauacugagccau

SEQ ID NO: 1522580 - RNA, 15 nt, Homo sapiens
caauaguuguugauu

SEQ ID NO: 1522581 - RNA, 16 nt, Homo sapiens
caauauuucugauaua

SEQ ID NO: 1522582 - RNA, 22 nt, Homo sapiens
caaugccuugacaacagacuga

SEQ ID NO: 1522583 - RNA, 23 nt, Homo sapiens
caaugccuugacaacagacugaa

SEQ ID NO: 1522584 - RNA, 22 nt, Homo sapiens
caauuaaaaguaugcagauuau

SEQ ID NO: 1522585 - RNA, 22 nt, Homo sapiens
caauuucacauggacuuuggaa

SEQ ID NO: 1522586 - RNA, 18 nt, Homo sapiens
cacagaaacuauaugcaa

SEQ ID NO: 1522587 - RNA, 16 nt, Homo sapiens
cacagaugugugauuc

SEQ ID NO: 1522588 - RNA, 17 nt, Homo sapiens
cucagcuggaucuccau

SEQ ID NO: 1522589 - RNA, 19 nt, Homo sapiens
cucaggauauuauguuucu

SEQ ID NO: 1522590 - RNA, 14 nt, Homo sapiens
cucaucuaugucau

SEQ ID NO: 1522591 - RNA, 21 nt, Homo sapiens
cucauucuaugaacagugaca

SEQ ID NO: 1522592 - RNA, 19 nt, Homo sapiens
cucauuuucaucuucuucc

SEQ ID NO: 1522593 - RNA, 16 nt, Homo sapiens
cuccacauaaguccau

SEQ ID NO: 1522594 - RNA, 18 nt, Homo sapiens
cuccacuccuucccaaau

SEQ ID NO: 1522595 - RNA, 14 nt, Homo sapiens
cuccccccacugca

SEQ ID NO: 1522596 - RNA, 14 nt, Homo sapiens
cucccuguccuccu

SEQ ID NO: 1522597 - RNA, 20 nt, Homo sapiens
cuccuccagggccacgugcc

SEQ ID NO: 1522598 - RNA, 19 nt, Homo sapiens
cuccugcgcaggccaugca

SEQ ID NO: 1522599 - RNA, 12 nt, Homo sapiens
cuccuugauaaa

SEQ ID NO: 1522600 - RNA, 21 nt, Homo sapiens
cuccuugucaauacugagcca

SEQ ID NO: 1522601 - RNA, 11 nt, Homo sapiens
cucguccuccc

SEQ ID NO: 1522602 - RNA, 16 nt, Homo sapiens
cucuggagccagagag

SEQ ID NO: 1522603 - RNA, 15 nt, Homo sapiens
cucuuugccauuucu

SEQ ID NO: 1522604 - RNA, 13 nt, Homo sapiens
cugaaaaauguca

SEQ ID NO: 1522605 - RNA, 19 nt, Homo sapiens
cugaaagacagaaugucac

SEQ ID NO: 1522606 - RNA, 21 nt, Homo sapiens
cugaaagcugaauccuuccau

SEQ ID NO: 1522607 - RNA, 21 nt, Homo sapiens
cugaacuggcugaaguucaag

SEQ ID NO: 1522608 - RNA, 15 nt, Homo sapiens
cugagaggucacaaa

SEQ ID NO: 1522609 - RNA, 16 nt, Homo sapiens
cugaucauuugaggaa

SEQ ID NO: 1522610 - RNA, 22 nt, Homo sapiens
cugauucugucaaugucuugaa

SEQ ID NO: 1522611 - RNA, 17 nt, Homo sapiens
cugcaauuuuaauugau

SEQ ID NO: 1522612 - RNA, 22 nt, Homo sapiens
cugccaaaaauauaauucuuag

SEQ ID NO: 1522613 - RNA, 20 nt, Homo sapiens
cugccagugccuuaccuccu

SEQ ID NO: 1522614 - RNA, 14 nt, Homo sapiens
cugcccaaugccuu

SEQ ID NO: 1522615 - RNA, 21 nt, Homo sapiens
cugcccagcaaucaaaggcaa

SEQ ID NO: 1522616 - RNA, 16 nt, Homo sapiens
cugcuauuauguaaca

SEQ ID NO: 1522617 - RNA, 21 nt, Homo sapiens
cugcucccaaauaaacuccag

SEQ ID NO: 1522618 - RNA, 20 nt, Homo sapiens
cuggauuuguuucugugauc

SEQ ID NO: 1522619 - RNA, 16 nt, Homo sapiens
cugggcuagggagaau

SEQ ID NO: 1522620 - RNA, 23 nt, Homo sapiens
cuggguggaaggcagaccugaau

SEQ ID NO: 1522621 - RNA, 23 nt, Homo sapiens
cuguccugcuucugaaugugcug

SEQ ID NO: 1522622 - RNA, 14 nt, Homo sapiens
cugucucacuggca

SEQ ID NO: 1522623 - RNA, 17 nt, Homo sapiens
cuguguguacuaauaca

SEQ ID NO: 1522624 - RNA, 17 nt, Homo sapiens
cuguuaucaauucacau

SEQ ID NO: 1522625 - RNA, 13 nt, Homo sapiens
cuguuccagguuu

SEQ ID NO: 1522626 - RNA, 15 nt, Homo sapiens
cuguuguaauagucc

SEQ ID NO: 1522627 - RNA, 20 nt, Homo sapiens
cuuaaccucucuaagccaca

SEQ ID NO: 1522628 - RNA, 23 nt, Homo sapiens
cuucacagaugugugauucacag

SEQ ID NO: 1522629 - RNA, 22 nt, Homo sapiens
cuucaggaagcauaaagcaauu

SEQ ID NO: 1522630 - RNA, 14 nt, Homo sapiens
cuucagguggaaaa

SEQ ID NO: 1522631 - RNA, 19 nt, Homo sapiens
cuuccccuugcccuugccc

SEQ ID NO: 1522632 - RNA, 14 nt, Homo sapiens
cuucuaaucaaagc

SEQ ID NO: 1522633 - RNA, 14 nt, Homo sapiens
cuucuagaaaacau

SEQ ID NO: 1522634 - RNA, 19 nt, Homo sapiens
cuucucaggccucugcucu

SEQ ID NO: 1522635 - RNA, 14 nt, Homo sapiens
cuucuguccaggac

SEQ ID NO: 1522636 - RNA, 17 nt, Homo sapiens
cuugacaacagacugaa

SEQ ID NO: 1522637 - RNA, 12 nt, Homo sapiens
cuugcugccaaa

SEQ ID NO: 1522638 - RNA, 15 nt, Homo sapiens
cuuguagacucagaa

SEQ ID NO: 1522639 - RNA, 15 nt, Homo sapiens
cuugugaauuuuucu

SEQ ID NO: 1522640 - RNA, 15 nt, Homo sapiens
cuuuaaagagaguuu

SEQ ID NO: 1522641 - RNA, 18 nt, Homo sapiens
cuuuagcuguacuguaau

SEQ ID NO: 1522642 - RNA, 16 nt, Homo sapiens
cuuucaugccccggcu

SEQ ID NO: 1522643 - RNA, 18 nt, Homo sapiens
cuuuccacccucucucca

SEQ ID NO: 1522644 - RNA, 14 nt, Homo sapiens
cuuuccuuguggca

SEQ ID NO: 1522645 - RNA, 13 nt, Homo sapiens
cuuucucuuugcc

SEQ ID NO: 1522646 - RNA, 14 nt, Homo sapiens
cuuucucuuugcca

SEQ ID NO: 1522647 - RNA, 19 nt, Homo sapiens
cuuucugcuccuuucucca

SEQ ID NO: 1522648 - RNA, 11 nt, Homo sapiens
cuuugcauuca

SEQ ID NO: 1522649 - RNA, 18 nt, Homo sapiens
cuuugcauucaucucuca

SEQ ID NO: 1522650 - RNA, 19 nt, Homo sapiens
gauaaaccaaugucauaac

SEQ ID NO: 1522651 - RNA, 22 nt, Homo sapiens
gaucucugcuuuggaaaucaca

SEQ ID NO: 1522652 - RNA, 18 nt, Homo sapiens
gauguaggguaaggugcc

SEQ ID NO: 1522653 - RNA, 15 nt, Homo sapiens
gauuauaagaguaau

SEQ ID NO: 1522654 - RNA, 12 nt, Homo sapiens
gauuauucugau

SEQ ID NO: 1522655 - RNA, 18 nt, Homo sapiens
gauuggcaggaguuggaa

SEQ ID NO: 1522656 - RNA, 13 nt, Homo sapiens
gauuuagcauuca

SEQ ID NO: 1522657 - RNA, 13 nt, Homo sapiens
gcaaagugcugaa

SEQ ID NO: 1522658 - RNA, 17 nt, Homo sapiens
gcaacauuaugauuaau

SEQ ID NO: 1522659 - RNA, 15 nt, Homo sapiens
gcaaucuggucugaa

SEQ ID NO: 1522660 - RNA, 19 nt, Homo sapiens
gcacacaauaagcauucaa

SEQ ID NO: 1522661 - RNA, 15 nt, Homo sapiens
gcagaucuuggaaug

SEQ ID NO: 1522662 - RNA, 14 nt, Homo sapiens
gcaguagugagcag

SEQ ID NO: 1522663 - RNA, 19 nt, Homo sapiens
gcauagaguucagacuuuu

SEQ ID NO: 1522664 - RNA, 21 nt, Homo sapiens
gcauggcucccgaguacagua

SEQ ID NO: 1522665 - RNA, 20 nt, Homo sapiens
gcauucaucucucaaacuua

SEQ ID NO: 1522666 - RNA, 13 nt, Homo sapiens
gccaaaagccuuu

SEQ ID NO: 1522667 - RNA, 17 nt, Homo sapiens
gccacuauuaacauuuc

SEQ ID NO: 1522668 - RNA, 23 nt, Homo sapiens
gccacuccccuaaacuccaggau

SEQ ID NO: 1522669 - RNA, 21 nt, Homo sapiens
gccacugccuuucagaaguga

SEQ ID NO: 1522670 - RNA, 17 nt, Homo sapiens
gccauguuuagauucca

SEQ ID NO: 1522671 - RNA, 15 nt, Homo sapiens
gcccaguguguuucu

SEQ ID NO: 1522672 - RNA, 22 nt, Homo sapiens
gccguauacaaggaauaugaca

SEQ ID NO: 1522673 - RNA, 16 nt, Homo sapiens
gccuugacaacagacu

SEQ ID NO: 1522674 - RNA, 17 nt, Homo sapiens
gccuugcacauaggaaa

SEQ ID NO: 1522675 - RNA, 14 nt, Homo sapiens
gccuuuuguguuuu

SEQ ID NO: 1522676 - RNA, 13 nt, Homo sapiens
gcgcaggccaugc

SEQ ID NO: 1522677 - RNA, 14 nt, Homo sapiens
gcgcgguggcucac

SEQ ID NO: 1522678 - RNA, 17 nt, Homo sapiens
gcgugacucacccaagc

SEQ ID NO: 1522679 - RNA, 21 nt, Homo sapiens
gcguggaucuacccucuaguu

SEQ ID NO: 1522680 - RNA, 15 nt, Homo sapiens
gcuaauagcugcuag

SEQ ID NO: 1522681 - RNA, 17 nt, Homo sapiens
uauggcucuacuuucag

SEQ ID NO: 1522682 - RNA, 17 nt, Homo sapiens
uauguugcccagugugu

SEQ ID NO: 1522683 - RNA, 23 nt, Homo sapiens
uauuaagauuuccaagugccaau

SEQ ID NO: 1522684 - RNA, 22 nt, Homo sapiens
uauuacaguuuaucuauggcac

SEQ ID NO: 1522685 - RNA, 17 nt, Homo sapiens
uauucucacuccaccac

SEQ ID NO: 1522686 - RNA, 15 nt, Homo sapiens
uauucugauuccacu

SEQ ID NO: 1522687 - RNA, 17 nt, Homo sapiens
uauucugauuccacuuu

SEQ ID NO: 1522688 - RNA, 18 nt, Homo sapiens
uauuucuguauuuggcua

SEQ ID NO: 1522689 - RNA, 14 nt, Homo sapiens
uauuuuacauagau

SEQ ID NO: 1522690 - RNA, 21 nt, Homo sapiens
uauuuuuuuccuuugcauuca

SEQ ID NO: 1522691 - RNA, 17 nt, Homo sapiens
ucaaagcccacauacug

SEQ ID NO: 1522692 - RNA, 15 nt, Homo sapiens
ucaaaugucagagcu

SEQ ID NO: 1522693 - RNA, 23 nt, Homo sapiens
ucaaauuugccaccacuagagcu

SEQ ID NO: 1522694 - RNA, 15 nt, Homo sapiens
ucaaccuuaccaaaa

SEQ ID NO: 1522695 - RNA, 16 nt, Homo sapiens
ucaaccuuaccaaaaa

SEQ ID NO: 1522696 - RNA, 11 nt, Homo sapiens
ucaagccaugg

SEQ ID NO: 1522697 - RNA, 16 nt, Homo sapiens
ucaaguuggcuucuaa

SEQ ID NO: 1522698 - RNA, 12 nt, Homo sapiens
ucaaugcuauaa

SEQ ID NO: 1522699 - RNA, 22 nt, Homo sapiens
ucaaugcuauaacuauguugau

SEQ ID NO: 1522700 - RNA, 13 nt, Homo sapiens
ucaauuugcugaa

SEQ ID NO: 1522701 - RNA, 21 nt, Homo sapiens
ucacagagauaauucuagcuu

SEQ ID NO: 1522702 - RNA, 18 nt, Homo sapiens
ucacagaugugugauuca

SEQ ID NO: 1522703 - RNA, 19 nt, Homo sapiens
ucacaguaaugcaagcaaa

SEQ ID NO: 1522704 - RNA, 19 nt, Homo sapiens
ucaccaagcucacaguucc

SEQ ID NO: 1522705 - RNA, 14 nt, Homo sapiens
ucacccaaugcaua

SEQ ID NO: 1522706 - RNA, 22 nt, Homo sapiens
ucacuaaaaauuuuuacaaaac

SEQ ID NO: 1522707 - RNA, 23 nt, Homo sapiens
ucacuagccaugauaacugcaau

SEQ ID NO: 1522708 - RNA, 13 nt, Homo sapiens
ucagacugccaaa

SEQ ID NO: 1522709 - RNA, 15 nt, Homo sapiens
ucagauucagcauuu

SEQ ID NO: 1522710 - RNA, 16 nt, Homo sapiens
ucagauucagcauuug

SEQ ID NO: 1522711 - RNA, 14 nt, Homo sapiens
ucaggaaaacugac

SEQ ID NO: 1522712 - RNA, 15 nt, Homo sapiens
ucagucaauucugau

SEQ ID NO: 1522713 - RNA, 19 nt, Homo sapiens
ucauaauuucuucacucaa

SEQ ID NO: 1522714 - RNA, 18 nt, Homo sapiens
ucaugccccggcugcaca

SEQ ID NO: 1522715 - RNA, 14 nt, Homo sapiens
uccaacaugugcuc

SEQ ID NO: 1522716 - RNA, 15 nt, Homo sapiens
uccaacaugugcuca

SEQ ID NO: 1522717 - RNA, 19 nt, Homo sapiens
uccacauuguuaggugcug

SEQ ID NO: 1522718 - RNA, 18 nt, Homo sapiens
uccacccucaaaugucag

SEQ ID NO: 1522719 - RNA, 16 nt, Homo sapiens
uccacuccuucccaaa

SEQ ID NO: 1522720 - RNA, 21 nt, Homo sapiens
uccagguuuuucuggcauuuu

SEQ ID NO: 1522721 - RNA, 21 nt, Homo sapiens
uccaucacuagccaugauaac

SEQ ID NO: 1522722 - RNA, 15 nt, Homo sapiens
ucccaaauaaacucc

SEQ ID NO: 1522723 - RNA, 19 nt, Homo sapiens
ucccauaagcuaagccuua

SEQ ID NO: 1522724 - RNA, 19 nt, Homo sapiens
ucccucccacccaaccaac

SEQ ID NO: 1522725 - RNA, 16 nt, Homo sapiens
uccguaguucccugaa

SEQ ID NO: 1522726 - RNA, 11 nt, Homo sapiens
uccuacugugu

SEQ ID NO: 1522727 - RNA, 12 nt, Homo sapiens
uccugccagcuc

SEQ ID NO: 1522728 - RNA, 16 nt, Homo sapiens
uccuuauuucacugaa

SEQ ID NO: 1522729 - RNA, 19 nt, Homo sapiens
uccuuccuauaacuugaug

SEQ ID NO: 1522730 - RNA, 14 nt, Homo sapiens
uccuugacuguaaa

SEQ ID NO: 1522731 - RNA, 14 nt, Homo sapiens
uccuugcaccugca

SEQ ID NO: 1522732 - RNA, 14 nt, Homo sapiens
uccuuugcauucau

SEQ ID NO: 1522733 - RNA, 19 nt, Homo sapiens
ucgaagaaaggcagaagaa

SEQ ID NO: 1522734 - RNA, 12 nt, Homo sapiens
ucgaguguuuca

SEQ ID NO: 1522735 - RNA, 19 nt, Homo sapiens
ucggcucuggagauuaucc

SEQ ID NO: 1522736 - RNA, 15 nt, Homo sapiens
ucguuugaaucacag

SEQ ID NO: 1522737 - RNA, 19 nt, Homo sapiens
ucguuugaaucacaguaua

SEQ ID NO: 1522738 - RNA, 23 nt, Homo sapiens
ucuaaguguugugaaacuguaaa

SEQ ID NO: 1522739 - RNA, 16 nt, Homo sapiens
ucuauggcacccaugc

SEQ ID NO: 1522740 - RNA, 18 nt, Homo sapiens
ucuauggcacccaugcac

SEQ ID NO: 1522741 - RNA, 20 nt, Homo sapiens
ucuauggcacccaugcaccu

SEQ ID NO: 1522742 - RNA, 14 nt, Homo sapiens
ucuauuacacugga

SEQ ID NO: 1522743 - RNA, 14 nt, Homo sapiens
ucucagaauucuuc

SEQ ID NO: 1522744 - RNA, 13 nt, Homo sapiens
ucucauuaaaauc

SEQ ID NO: 1522745 - RNA, 21 nt, Homo sapiens
ucucugcuuuggaaaucacac

SEQ ID NO: 1522746 - RNA, 16 nt, Homo sapiens
ucugaucugaugcaag

SEQ ID NO: 1522747 - RNA, 19 nt, Homo sapiens
ucugauuauacaccauuuu

SEQ ID NO: 1522748 - RNA, 19 nt, Homo sapiens
ucugcacuucuguuccagg

SEQ ID NO: 1522749 - RNA, 22 nt, Homo sapiens
ucugcggaaaaacaaacaugaa

SEQ ID NO: 1522750 - RNA, 21 nt, Homo sapiens
ucuggcauuuucuguuccagg

SEQ ID NO: 1522751 - RNA, 18 nt, Homo sapiens
ucuguccguuuacuccaa

SEQ ID NO: 1522752 - RNA, 16 nt, Homo sapiens
ucuuagaaguggacca

SEQ ID NO: 1522753 - RNA, 16 nt, Homo sapiens
ucuucauaauuucuuc

SEQ ID NO: 1522754 - RNA, 16 nt, Homo sapiens
ucuuggaaugaaugac

SEQ ID NO: 1522755 - RNA, 21 nt, Homo sapiens
ucuuuguaaugucaccaccuu

SEQ ID NO: 1522756 - RNA, 21 nt, Homo sapiens
ugaaaaaacuuucucuuugcc

SEQ ID NO: 1522757 - RNA, 17 nt, Homo sapiens
ugaaaaauaaaaaccau

SEQ ID NO: 1522758 - RNA, 20 nt, Homo sapiens
ugaaaaugcuguauuaguca

SEQ ID NO: 1522759 - RNA, 22 nt, Homo sapiens
ugaaaaugcuguauuagucaca

SEQ ID NO: 1522760 - RNA, 15 nt, Homo sapiens
ugaagccagauccac

SEQ ID NO: 1522761 - RNA, 22 nt, Homo sapiens
ugaagggggccacagccugggu

SEQ ID NO: 1522762 - RNA, 23 nt, Homo sapiens
ugaaggguucaccaggucaggga

SEQ ID NO: 1522763 - RNA, 23 nt, Homo sapiens
ugaagucaugcguuuaaucacau

SEQ ID NO: 1522764 - RNA, 13 nt, Homo sapiens
ugaauaucuucca

SEQ ID NO: 1522765 - RNA, 19 nt, Homo sapiens
ugaaucacaacgggccagc

SEQ ID NO: 1522766 - RNA, 12 nt, Homo sapiens
ugaaucacagua

SEQ ID NO: 1522767 - RNA, 22 nt, Homo sapiens
ugaaucacaguauacgcuccau

SEQ ID NO: 1522768 - RNA, 19 nt, Homo sapiens
uugugcuccugccagcuca

SEQ ID NO: 1522769 - RNA, 20 nt, Homo sapiens
uuguugcuacauuuacuuua

SEQ ID NO: 1522770 - RNA, 20 nt, Homo sapiens
uuuaaaguauguuauugcau

SEQ ID NO: 1522771 - RNA, 14 nt, Homo sapiens
uuuaaucacauucg

SEQ ID NO: 1522772 - RNA, 20 nt, Homo sapiens
uuuagcauucauauuuucca

SEQ ID NO: 1522773 - RNA, 18 nt, Homo sapiens
uuuaucuauggcacccau

SEQ ID NO: 1522774 - RNA, 21 nt, Homo sapiens
uuuaucuauggcacccaugca

SEQ ID NO: 1522775 - RNA, 14 nt, Homo sapiens
uuucaccuucauau

SEQ ID NO: 1522776 - RNA, 14 nt, Homo sapiens
uuuccccucagagc

SEQ ID NO: 1522777 - RNA, 13 nt, Homo sapiens
uuucucuuugcca

SEQ ID NO: 1522778 - RNA, 12 nt, Homo sapiens
uuucuguuccag

SEQ ID NO: 1522779 - RNA, 15 nt, Homo sapiens
uuugaaaucuaugaa

SEQ ID NO: 1522780 - RNA, 19 nt, Homo sapiens
uuugaauacaggcauagag

SEQ ID NO: 1522781 - RNA, 18 nt, Homo sapiens
uuugaaugacaagauuag

SEQ ID NO: 1522782 - RNA, 13 nt, Homo sapiens
uuugaggggguca

SEQ ID NO: 1522783 - RNA, 10 nt, Homo sapiens
uuuguaaaac

SEQ ID NO: 1522784 - RNA, 20 nt, Homo sapiens
uuuguuuuguaucauuauga

SEQ ID NO: 1522785 - RNA, 17 nt, Homo sapiens
uuuuaacaacuaugauu

SEQ ID NO: 1522786 - RNA, 12 nt, Homo sapiens
uuuuauaugauu

SEQ ID NO: 1522787 - RNA, 16 nt, Homo sapiens
uuuuauuuagugccua

SEQ ID NO: 1522788 - RNA, 15 nt, Homo sapiens
uuuugguaauauuca

SEQ ID NO: 1522789 - RNA, 11 nt, Homo sapiens
uuuuuguggau

SEQ ID NO: 1522790 - RNA, 21 nt, Homo sapiens
aaauuuagagucaauuugcug

SEQ ID NO: 1522791 - RNA, 14 nt, Homo sapiens
aaauuugaaugaca

SEQ ID NO: 1522792 - RNA, 20 nt, Homo sapiens
aaauuuuuaaaacacagaaa

SEQ ID NO: 1522793 - RNA, 20 nt, Homo sapiens
aacaaaaauguaaugaucau

SEQ ID NO: 1522794 - RNA, 14 nt, Homo sapiens
aacagauauuguca

SEQ ID NO: 1522795 - RNA, 12 nt, Homo sapiens
aacagggaaaaa

SEQ ID NO: 1522796 - RNA, 21 nt, Homo sapiens
aacauaucauuugugaagaau

SEQ ID NO: 1522797 - RNA, 21 nt, Homo sapiens
aacaugaccaaaaaccaaaag

SEQ ID NO: 1522798 - RNA, 16 nt, Homo sapiens
aacaugugcucaggga

SEQ ID NO: 1522799 - RNA, 19 nt, Homo sapiens
aacccuauugguaaagaau

SEQ ID NO: 1522800 - RNA, 19 nt, Homo sapiens
aaccgaacaugaccaaaaa

SEQ ID NO: 1522801 - RNA, 20 nt, Homo sapiens
aaccucucuaagccacagcu

SEQ ID NO: 1522802 - RNA, 16 nt, Homo sapiens
aacguacauuugugcu

SEQ ID NO: 1522803 - RNA, 19 nt, Homo sapiens
aacuaccucaaaacacuuu

SEQ ID NO: 1522804 - RNA, 19 nt, Homo sapiens
aacuucagaugggaggaaa

SEQ ID NO: 1522805 - RNA, 13 nt, Homo sapiens
aacuucccaaagc

SEQ ID NO: 1522806 - RNA, 14 nt, Homo sapiens
aacuucccaaagca

SEQ ID NO: 1522807 - RNA, 15 nt, Homo sapiens
aacuuucucuuugcc

SEQ ID NO: 1522808 - RNA, 21 nt, Homo sapiens
aacuuucucuuugccauuucu

SEQ ID NO: 1522809 - RNA, 13 nt, Homo sapiens
aagaaagauccac

SEQ ID NO: 1522810 - RNA, 15 nt, Homo sapiens
aagaaucaccucaaa

SEQ ID NO: 1522811 - RNA, 17 nt, Homo sapiens
aagaauugaacccagga

SEQ ID NO: 1522812 - RNA, 14 nt, Homo sapiens
aagacagaauguca

SEQ ID NO: 1522813 - RNA, 21 nt, Homo sapiens
aagacugggcuagggagaaug

SEQ ID NO: 1522814 - RNA, 15 nt, Homo sapiens
aagauccacccucaa

SEQ ID NO: 1522815 - RNA, 23 nt, Homo sapiens
aagauguaugcuuugaaugcaaa

SEQ ID NO: 1522816 - RNA, 14 nt, Homo sapiens
aagcaaaguaucaa

SEQ ID NO: 1522817 - RNA, 17 nt, Homo sapiens
aagcaccugccgaccuc

SEQ ID NO: 1522818 - RNA, 12 nt, Homo sapiens
aagccuguccau

SEQ ID NO: 1522819 - RNA, 23 nt, Homo sapiens
aagcuguguccuugcaccugcau

SEQ ID NO: 1522820 - RNA, 15 nt, Homo sapiens
aagcuugguccacuu

SEQ ID NO: 1522821 - RNA, 18 nt, Homo sapiens
aagcuugguccacuugcu

SEQ ID NO: 1522822 - RNA, 15 nt, Homo sapiens
aaggcauccaugaaa

SEQ ID NO: 1522823 - RNA, 22 nt, Homo sapiens
aagggccagcuggaggugaaga

SEQ ID NO: 1522824 - RNA, 20 nt, Homo sapiens
aaguaauuuugcuccuugau

SEQ ID NO: 1522825 - RNA, 13 nt, Homo sapiens
aagucccuuucug

SEQ ID NO: 1522826 - RNA, 21 nt, Homo sapiens
aagucucucuauuacacugga

SEQ ID NO: 1522827 - RNA, 12 nt, Homo sapiens
aagugugugauc

SEQ ID NO: 1522828 - RNA, 14 nt, Homo sapiens
aaguuggcuucuaa

SEQ ID NO: 1522829 - RNA, 13 nt, Homo sapiens
aauaaauugugaa

SEQ ID NO: 1522830 - RNA, 13 nt, Homo sapiens
aauaauccagaaa

SEQ ID NO: 1522831 - RNA, 14 nt, Homo sapiens
aauacaaaggugcu

SEQ ID NO: 1522832 - RNA, 12 nt, Homo sapiens
aauacaguauac

SEQ ID NO: 1522833 - RNA, 19 nt, Homo sapiens
aauacaugcugcuaauuca

SEQ ID NO: 1522834 - RNA, 13 nt, Homo sapiens
aauacuaguauua

SEQ ID NO: 1522835 - RNA, 14 nt, Homo sapiens
aauacuaguauuaa

SEQ ID NO: 1522836 - RNA, 13 nt, Homo sapiens
aauacugagccau

SEQ ID NO: 1522837 - RNA, 19 nt, Homo sapiens
aauaguuguugaguauucc

SEQ ID NO: 1522838 - RNA, 21 nt, Homo sapiens
aauauaaacugaaaaauguca

SEQ ID NO: 1522839 - RNA, 13 nt, Homo sapiens
aauauauugcuaa

SEQ ID NO: 1522840 - RNA, 15 nt, Homo sapiens
aauaucaugcuccau

SEQ ID NO: 1522841 - RNA, 16 nt, Homo sapiens
aauaucuuccacagag

SEQ ID NO: 1522842 - RNA, 23 nt, Homo sapiens
aauauuaaaaucacugucaauau

SEQ ID NO: 1522843 - RNA, 15 nt, Homo sapiens
aaucaaugcuauaac

SEQ ID NO: 1522844 - RNA, 13 nt, Homo sapiens
auacgaaggugag

SEQ ID NO: 1522845 - RNA, 17 nt, Homo sapiens
auacuaaaguaguuuaa

SEQ ID NO: 1522846 - RNA, 13 nt, Homo sapiens
auagaauugcaca

SEQ ID NO: 1522847 - RNA, 12 nt, Homo sapiens
auagauaaguca

SEQ ID NO: 1522848 - RNA, 15 nt, Homo sapiens
auagauaagucaaua

SEQ ID NO: 1522849 - RNA, 18 nt, Homo sapiens
auaguuguugaguauucc

SEQ ID NO: 1522850 - RNA, 14 nt, Homo sapiens
auaucaugcuccau

SEQ ID NO: 1522851 - RNA, 16 nt, Homo sapiens
auaucauuugugaaga

SEQ ID NO: 1522852 - RNA, 17 nt, Homo sapiens
auaucauuugugaagaa

SEQ ID NO: 1522853 - RNA, 11 nt, Homo sapiens
auaucuuccac

SEQ ID NO: 1522854 - RNA, 22 nt, Homo sapiens
auaugucugcuucuguccagga

SEQ ID NO: 1522855 - RNA, 18 nt, Homo sapiens
auauuccuauauguagcu

SEQ ID NO: 1522856 - RNA, 21 nt, Homo sapiens
aucaaaugccccgaauuuagu

SEQ ID NO: 1522857 - RNA, 23 nt, Homo sapiens
aucacuagccaugauaacugcaa

SEQ ID NO: 1522858 - RNA, 13 nt, Homo sapiens
aucacugucaaua

SEQ ID NO: 1522859 - RNA, 21 nt, Homo sapiens
aucagcuguuaaccauuugca

SEQ ID NO: 1522860 - RNA, 22 nt, Homo sapiens
aucaucccagcugcucccaaau

SEQ ID NO: 1522861 - RNA, 15 nt, Homo sapiens
aucauuugaggaaua

SEQ ID NO: 1522862 - RNA, 22 nt, Homo sapiens
auccacauuguuaggugcugac

SEQ ID NO: 1522863 - RNA, 15 nt, Homo sapiens
auccaggacugagau

SEQ ID NO: 1522864 - RNA, 22 nt, Homo sapiens
auccaucacuagccaugauaac

SEQ ID NO: 1522865 - RNA, 17 nt, Homo sapiens
auccaugaaacauuaca

SEQ ID NO: 1522866 - RNA, 16 nt, Homo sapiens
aucccacccaacagcu

SEQ ID NO: 1522867 - RNA, 17 nt, Homo sapiens
auccguaguucccugaa

SEQ ID NO: 1522868 - RNA, 20 nt, Homo sapiens
auccugaauaaaccaguauc

SEQ ID NO: 1522869 - RNA, 14 nt, Homo sapiens
aucgcaaaucacaa

SEQ ID NO: 1522870 - RNA, 16 nt, Homo sapiens
aucgcugucaucucag

SEQ ID NO: 1522871 - RNA, 22 nt, Homo sapiens
aucgcugucaucucagcuggau

SEQ ID NO: 1522872 - RNA, 17 nt, Homo sapiens
aucgugaucacugagcc

SEQ ID NO: 1522873 - RNA, 23 nt, Homo sapiens
aucucagcuccugaaaaaugccu

SEQ ID NO: 1522874 - RNA, 19 nt, Homo sapiens
aucucagcuggaucuccau

SEQ ID NO: 1522875 - RNA, 22 nt, Homo sapiens
aucucccugccgccucaaugug

SEQ ID NO: 1522876 - RNA, 22 nt, Homo sapiens
aucucugcuuuggaaaucacac

SEQ ID NO: 1522877 - RNA, 14 nt, Homo sapiens
aucuuaaaugacag

SEQ ID NO: 1522878 - RNA, 19 nt, Homo sapiens
augaaacuuuccuuuguca

SEQ ID NO: 1522879 - RNA, 16 nt, Homo sapiens
augauccuaaugaaug

SEQ ID NO: 1522880 - RNA, 18 nt, Homo sapiens
augauccuaaugaaugca

SEQ ID NO: 1522881 - RNA, 22 nt, Homo sapiens
augauccuaaugaaugcauaaa

SEQ ID NO: 1522882 - RNA, 19 nt, Homo sapiens
augaugucguuugaaucac

SEQ ID NO: 1522883 - RNA, 15 nt, Homo sapiens
auggaaaaugucaac

SEQ ID NO: 1522884 - RNA, 21 nt, Homo sapiens
auggacagauggaccaaaaga

SEQ ID NO: 1522885 - RNA, 16 nt, Homo sapiens
auggcucuacuuucag

SEQ ID NO: 1522886 - RNA, 18 nt, Homo sapiens
auggugcuagaagaauuu

SEQ ID NO: 1522887 - RNA, 22 nt, Homo sapiens
auggugcuagaagaauuugaga

SEQ ID NO: 1522888 - RNA, 17 nt, Homo sapiens
auguaaacagugccugc

SEQ ID NO: 1522889 - RNA, 18 nt, Homo sapiens
auguaggguaaggugccu

SEQ ID NO: 1522890 - RNA, 19 nt, Homo sapiens
augucaaccuuuguaagaa

SEQ ID NO: 1522891 - RNA, 22 nt, Homo sapiens
augugggguccccaucauccca

SEQ ID NO: 1522892 - RNA, 16 nt, Homo sapiens
augugugauucacagu

SEQ ID NO: 1522893 - RNA, 13 nt, Homo sapiens
auguuacugagau

SEQ ID NO: 1522894 - RNA, 16 nt, Homo sapiens
auguugauggugcuag

SEQ ID NO: 1522895 - RNA, 14 nt, Homo sapiens
auguugcccagugu

SEQ ID NO: 1522896 - RNA, 20 nt, Homo sapiens
auguugcccaguguguuucu

SEQ ID NO: 1522897 - RNA, 17 nt, Homo sapiens
auguuuuugcugcuacu

SEQ ID NO: 1522898 - RNA, 21 nt, Homo sapiens
auuaauuauauuucuacagag

SEQ ID NO: 1522899 - RNA, 21 nt, Homo sapiens
auuaauuugugaauuugcaac

SEQ ID NO: 1522900 - RNA, 22 nt, Homo sapiens
auuaauuugugaauuugcaaca

SEQ ID NO: 1522901 - RNA, 11 nt, Homo sapiens
auuacacugga

SEQ ID NO: 1522902 - RNA, 20 nt, Homo sapiens
auuaccuagaagugcaagaa

SEQ ID NO: 1522903 - RNA, 14 nt, Homo sapiens
auuaccuugugcua

SEQ ID NO: 1522904 - RNA, 20 nt, Homo sapiens
auuaguaaauaugugaagaa

SEQ ID NO: 1522905 - RNA, 20 nt, Homo sapiens
auuauauuaucauaucucuc

SEQ ID NO: 1522906 - RNA, 20 nt, Homo sapiens
auuaugauuaaucugauuau

SEQ ID NO: 1522907 - RNA, 15 nt, Homo sapiens
auuauuuaauuugua

SEQ ID NO: 1522908 - RNA, 14 nt, Homo sapiens
auucauauuuucca

SEQ ID NO: 1522909 - RNA, 14 nt, Homo sapiens
auucaucuuuucau

SEQ ID NO: 1522910 - RNA, 14 nt, Homo sapiens
ccaggcauguccua

SEQ ID NO: 1522911 - RNA, 20 nt, Homo sapiens
ccaugaaacauuacaggaaa

SEQ ID NO: 1522912 - RNA, 17 nt, Homo sapiens
cccagcccuauggaugu

SEQ ID NO: 1522913 - RNA, 13 nt, Homo sapiens
cccagcuacucag

SEQ ID NO: 1522914 - RNA, 15 nt, Homo sapiens
cccagggcagcuuug

SEQ ID NO: 1522915 - RNA, 12 nt, Homo sapiens
cccaguucugcu

SEQ ID NO: 1522916 - RNA, 14 nt, Homo sapiens
cccauguacauaau

SEQ ID NO: 1522917 - RNA, 21 nt, Homo sapiens
ccccaucaucccagcugcucc

SEQ ID NO: 1522918 - RNA, 15 nt, Homo sapiens
cccuccugucucuaa

SEQ ID NO: 1522919 - RNA, 22 nt, Homo sapiens
cccugaaguaagcaaagacuuu

SEQ ID NO: 1522920 - RNA, 16 nt, Homo sapiens
cccugaccucccagcc

SEQ ID NO: 1522921 - RNA, 22 nt, Homo sapiens
ccgccgcgggccgucugcacuu

SEQ ID NO: 1522922 - RNA, 22 nt, Homo sapiens
ccuaaaucaaguuggcuucuaa

SEQ ID NO: 1522923 - RNA, 18 nt, Homo sapiens
ccuaaugaaugcauaaaa

SEQ ID NO: 1522924 - RNA, 12 nt, Homo sapiens
ccuauaccauau

SEQ ID NO: 1522925 - RNA, 13 nt, Homo sapiens
ccuauauguagcu

SEQ ID NO: 1522926 - RNA, 17 nt, Homo sapiens
ccuauauguagcuuuau

SEQ ID NO: 1522927 - RNA, 10 nt, Homo sapiens
ccucagggcu

SEQ ID NO: 1522928 - RNA, 17 nt, Homo sapiens
ccucucuccaccugccu

SEQ ID NO: 1522929 - RNA, 16 nt, Homo sapiens
ccucuuccccuugccc

SEQ ID NO: 1522930 - RNA, 18 nt, Homo sapiens
ccucuuccccuugcccuu

SEQ ID NO: 1522931 - RNA, 20 nt, Homo sapiens
ccucuuuuucuagucuucau

SEQ ID NO: 1522932 - RNA, 14 nt, Homo sapiens
ccugaaauuaauuu

SEQ ID NO: 1522933 - RNA, 22 nt, Homo sapiens
ccugaaguaagcaaagacuuuc

SEQ ID NO: 1522934 - RNA, 15 nt, Homo sapiens
ccuggccggcaaccc

SEQ ID NO: 1522935 - RNA, 23 nt, Homo sapiens
ccugggagaaagaccaugcauuu

SEQ ID NO: 1522936 - RNA, 18 nt, Homo sapiens
ccugggccccaccaccua

SEQ ID NO: 1522937 - RNA, 13 nt, Homo sapiens
ccugggguucuca

SEQ ID NO: 1522938 - RNA, 20 nt, Homo sapiens
ccuuaaccucucuaagccac

SEQ ID NO: 1522939 - RNA, 19 nt, Homo sapiens
ccuuccacggauccaugua

SEQ ID NO: 1522940 - RNA, 14 nt, Homo sapiens
ccuuccauuucuuc

SEQ ID NO: 1522941 - RNA, 15 nt, Homo sapiens
ccuugauauuuuucu

SEQ ID NO: 1522942 - RNA, 13 nt, Homo sapiens
ccuugcccagaga

SEQ ID NO: 1522943 - RNA, 19 nt, Homo sapiens
ccuugugcuccugccagcu

SEQ ID NO: 1522944 - RNA, 21 nt, Homo sapiens
ccuuugcauucaucucucaaa

SEQ ID NO: 1522945 - RNA, 16 nt, Homo sapiens
cgaacaugaccaaaaa

SEQ ID NO: 1522946 - RNA, 12 nt, Homo sapiens
cgcaaaucacaa

SEQ ID NO: 1522947 - RNA, 13 nt, Homo sapiens
cgcauucccugag

SEQ ID NO: 1522948 - RNA, 22 nt, Homo sapiens
cgcguggaucuacccucuaguu

SEQ ID NO: 1522949 - RNA, 23 nt, Homo sapiens
cgcucccauggcucuugcaacau

SEQ ID NO: 1522950 - RNA, 17 nt, Homo sapiens
cgugaucacugagccau

SEQ ID NO: 1522951 - RNA, 18 nt, Homo sapiens
cuaaacuccaggauuuau

SEQ ID NO: 1522952 - RNA, 12 nt, Homo sapiens
cuaaaggugcua

SEQ ID NO: 1522953 - RNA, 18 nt, Homo sapiens
cuaauuaauaguauuuca

SEQ ID NO: 1522954 - RNA, 23 nt, Homo sapiens
cuacucaggaggcugaggcagaa

SEQ ID NO: 1522955 - RNA, 23 nt, Homo sapiens
cuagaaagggcuaauuaggucuc

SEQ ID NO: 1522956 - RNA, 23 nt, Homo sapiens
cuagagauauggcagcgaaagga

SEQ ID NO: 1522957 - RNA, 19 nt, Homo sapiens
cuaggagcugggaggaaaa

SEQ ID NO: 1522958 - RNA, 21 nt, Homo sapiens
cuaggggugggaggaagcaaa

SEQ ID NO: 1522959 - RNA, 16 nt, Homo sapiens
cuaucgcaaaucacaa

SEQ ID NO: 1522960 - RNA, 15 nt, Homo sapiens
cuaugauaugcuaau

SEQ ID NO: 1522961 - RNA, 20 nt, Homo sapiens
cuauggcacccaugcaccuu

SEQ ID NO: 1522962 - RNA, 18 nt, Homo sapiens
cuauggcucuacuuucag

SEQ ID NO: 1522963 - RNA, 20 nt, Homo sapiens
cuaugucacccaaugcauau

SEQ ID NO: 1522964 - RNA, 13 nt, Homo sapiens
cuauguugauaaa

SEQ ID NO: 1522965 - RNA, 15 nt, Homo sapiens
cucaaaacacuuucc

SEQ ID NO: 1522966 - RNA, 12 nt, Homo sapiens
cucaaaugucag

SEQ ID NO: 1522967 - RNA, 18 nt, Homo sapiens
cucacagaagaauaugac

SEQ ID NO: 1522968 - RNA, 15 nt, Homo sapiens
cucacuccaccaccc

SEQ ID NO: 1522969 - RNA, 16 nt, Homo sapiens
cucagacugccaaaga

SEQ ID NO: 1522970 - RNA, 23 nt, Homo sapiens
cucagcccugggccccaccaccu

SEQ ID NO: 1522971 - RNA, 16 nt, Homo sapiens
cucagcuggaucucca

SEQ ID NO: 1522972 - RNA, 12 nt, Homo sapiens
aaaaaccaaaag

SEQ ID NO: 1522973 - RNA, 20 nt, Homo sapiens
aaaaacuuucucuuugccau

SEQ ID NO: 1522974 - RNA, 13 nt, Homo sapiens
aaaacacuuuccc

SEQ ID NO: 1522975 - RNA, 18 nt, Homo sapiens
aaaacagccucacagaag

SEQ ID NO: 1522976 - RNA, 16 nt, Homo sapiens
aaaaccauaaacauuu

SEQ ID NO: 1522977 - RNA, 13 nt, Homo sapiens
aaaacccagagag

SEQ ID NO: 1522978 - RNA, 13 nt, Homo sapiens
aaaagcaccugcc

SEQ ID NO: 1522979 - RNA, 23 nt, Homo sapiens
aaaaguaugcagauuauuugccc

SEQ ID NO: 1522980 - RNA, 18 nt, Homo sapiens
aaaagugcauucaaccuu

SEQ ID NO: 1522981 - RNA, 11 nt, Homo sapiens
aaaauagcuua

SEQ ID NO: 1522982 - RNA, 15 nt, Homo sapiens
aaaauguaaugauca

SEQ ID NO: 1522983 - RNA, 14 nt, Homo sapiens
aaacagacaagcaa

SEQ ID NO: 1522984 - RNA, 16 nt, Homo sapiens
aaaccaaaagugcauu

SEQ ID NO: 1522985 - RNA, 19 nt, Homo sapiens
aaaccaaugagcuguaucu

SEQ ID NO: 1522986 - RNA, 20 nt, Homo sapiens
aaacuaccucaaaacacuuu

SEQ ID NO: 1522987 - RNA, 22 nt, Homo sapiens
aaacuuucucuuugccauuucu

SEQ ID NO: 1522988 - RNA, 18 nt, Homo sapiens
aaagaagccuugccaucu

SEQ ID NO: 1522989 - RNA, 19 nt, Homo sapiens
aaagacuuuccucuuaguc

SEQ ID NO: 1522990 - RNA, 22 nt, Homo sapiens
aaagauccacccucaaauguca

SEQ ID NO: 1522991 - RNA, 13 nt, Homo sapiens
aaagcacaaagca

SEQ ID NO: 1522992 - RNA, 12 nt, Homo sapiens
aaagcaccugcc

SEQ ID NO: 1522993 - RNA, 20 nt, Homo sapiens
aaagcugaauccuuccauuu

SEQ ID NO: 1522994 - RNA, 11 nt, Homo sapiens
aaaggugcuac

SEQ ID NO: 1522995 - RNA, 17 nt, Homo sapiens
aaaggugcuauuuaaca

SEQ ID NO: 1522996 - RNA, 10 nt, Homo sapiens
aaagguuuaa

SEQ ID NO: 1522997 - RNA, 16 nt, Homo sapiens
aaagguuuaaacuacc

SEQ ID NO: 1522998 - RNA, 16 nt, Homo sapiens
aaagucaaaaggugcc

SEQ ID NO: 1522999 - RNA, 18 nt, Homo sapiens
aaagucuuagcugagaac

SEQ ID NO: 1523000 - RNA, 21 nt, Homo sapiens
aaauaaggauaauaaucauuc

SEQ ID NO: 1523001 - RNA, 14 nt, Homo sapiens
aaauauauuauuca

SEQ ID NO: 1523002 - RNA, 12 nt, Homo sapiens
aaaucuaugaaa

SEQ ID NO: 1523003 - RNA, 22 nt, Homo sapiens
aaaugcuguauuagucacagag

SEQ ID NO: 1523004 - RNA, 20 nt, Homo sapiens
aaauugcacuuuuaaaccuc

SEQ ID NO: 1523005 - RNA, 16 nt, Homo sapiens
aaauuuuuguuuauaa

SEQ ID NO: 1523006 - RNA, 19 nt, Homo sapiens
aacaaaaauguaaugauca

SEQ ID NO: 1523007 - RNA, 20 nt, Homo sapiens
aacauccagaagguuugcac

SEQ ID NO: 1523008 - RNA, 15 nt, Homo sapiens
aacaugaccaaaaac

SEQ ID NO: 1523009 - RNA, 18 nt, Homo sapiens
aaccgaacaugaccaaaa

SEQ ID NO: 1523010 - RNA, 18 nt, Homo sapiens
aaccucucuaagccacag

SEQ ID NO: 1523011 - RNA, 22 nt, Homo sapiens
aaccugucaccuggccugccac

SEQ ID NO: 1523012 - RNA, 13 nt, Homo sapiens
aacgggccagcuc

SEQ ID NO: 1523013 - RNA, 18 nt, Homo sapiens
aacuccaucauucaucca

SEQ ID NO: 1523014 - RNA, 19 nt, Homo sapiens
aacucuggauuuugaauua

SEQ ID NO: 1523015 - RNA, 11 nt, Homo sapiens
aagaaaaccaa

SEQ ID NO: 1523016 - RNA, 12 nt, Homo sapiens
aagaggggaaaa

SEQ ID NO: 1523017 - RNA, 13 nt, Homo sapiens
aagauccacccuc

SEQ ID NO: 1523018 - RNA, 18 nt, Homo sapiens
aagauuuuugaaaauccu

SEQ ID NO: 1523019 - RNA, 18 nt, Homo sapiens
aagcucaucucagcuccu

SEQ ID NO: 1523020 - RNA, 22 nt, Homo sapiens
aagcucaucucagcuccugaaa

SEQ ID NO: 1523021 - RNA, 16 nt, Homo sapiens
aagcugagugacugua

SEQ ID NO: 1523022 - RNA, 20 nt, Homo sapiens
aaggcagaccugaaucacaa

SEQ ID NO: 1523023 - RNA, 21 nt, Homo sapiens
aagggauaauagacacaucaa

SEQ ID NO: 1523024 - RNA, 18 nt, Homo sapiens
aagggccacgacaaagca

SEQ ID NO: 1523025 - RNA, 22 nt, Homo sapiens
aaggguucaccaggucagggag

SEQ ID NO: 1523026 - RNA, 22 nt, Homo sapiens
aaggugagcugggggcgagaaa

SEQ ID NO: 1523027 - RNA, 23 nt, Homo sapiens
aaggugaggucugggaugcugcg

SEQ ID NO: 1523028 - RNA, 20 nt, Homo sapiens
aaguagcuuugaacuaguuu

SEQ ID NO: 1523029 - RNA, 16 nt, Homo sapiens
aaguauucuccauccu

SEQ ID NO: 1523030 - RNA, 13 nt, Homo sapiens
aagucaauuccac

SEQ ID NO: 1523031 - RNA, 12 nt, Homo sapiens
aagucccggcuu

SEQ ID NO: 1523032 - RNA, 17 nt, Homo sapiens
aagucuaaauaaaugaa

SEQ ID NO: 1523033 - RNA, 12 nt, Homo sapiens
aagugcauucaa

SEQ ID NO: 1523034 - RNA, 13 nt, Homo sapiens
aaguuuaaaaccc

SEQ ID NO: 1523035 - RNA, 20 nt, Homo sapiens
aauaauccagaaaaacugug

SEQ ID NO: 1523036 - RNA, 22 nt, Homo sapiens
aauacaguauaccgcaguggcu

SEQ ID NO: 1523037 - RNA, 15 nt, Homo sapiens
aauaucaguuacuca

SEQ ID NO: 1523038 - RNA, 20 nt, Homo sapiens
aauauucauuuuaaagugga

SEQ ID NO: 1523039 - RNA, 23 nt, Homo sapiens
aauauuccuauauguagcuuuau

SEQ ID NO: 1523040 - RNA, 22 nt, Homo sapiens
aaucaaguuggcuucuaaucaa

SEQ ID NO: 1523041 - RNA, 21 nt, Homo sapiens
aaucacaaaaaaacuguuauc

SEQ ID NO: 1523042 - RNA, 18 nt, Homo sapiens
aaucacaacgggccagcu

SEQ ID NO: 1523043 - RNA, 20 nt, Homo sapiens
aaucacacgucuggcuucac

SEQ ID NO: 1523044 - RNA, 14 nt, Homo sapiens
aaucacugucaaua

SEQ ID NO: 1523045 - RNA, 12 nt, Homo sapiens
aauccaguauua

SEQ ID NO: 1523046 - RNA, 23 nt, Homo sapiens
aauccaucacuagccaugauaac

SEQ ID NO: 1523047 - RNA, 15 nt, Homo sapiens
aaucuccagucucau

SEQ ID NO: 1523048 - RNA, 23 nt, Homo sapiens
aaucuggucugaauaacacugga

SEQ ID NO: 1523049 - RNA, 19 nt, Homo sapiens
aaugaugucguuugaauca

SEQ ID NO: 1523050 - RNA, 21 nt, Homo sapiens
aaugaugucguuugaaucaca

SEQ ID NO: 1523051 - RNA, 23 nt, Homo sapiens
aaugcauauccaacaugugcuca

SEQ ID NO: 1523052 - RNA, 22 nt, Homo sapiens
aaugugauaauauauugcuaaa

SEQ ID NO: 1523053 - RNA, 22 nt, Homo sapiens
aauguuccuuucgaaagcaaug

SEQ ID NO: 1523054 - RNA, 15 nt, Homo sapiens
aauguugauggugcu

SEQ ID NO: 1523055 - RNA, 20 nt, Homo sapiens
aauguugauggugcuagaag

SEQ ID NO: 1523056 - RNA, 23 nt, Homo sapiens
aauuaauuugugaauuugcaaca

SEQ ID NO: 1523057 - RNA, 18 nt, Homo sapiens
aauuaugugaaaugcuua

SEQ ID NO: 1523058 - RNA, 21 nt, Homo sapiens
guccuaggcucugggugcagu

SEQ ID NO: 1523059 - RNA, 22 nt, Homo sapiens
gucuccuaccugcugcugcuau

SEQ ID NO: 1523060 - RNA, 18 nt, Homo sapiens
gucuguccugcguccucu

SEQ ID NO: 1523061 - RNA, 16 nt, Homo sapiens
gugagcaaagggcuca

SEQ ID NO: 1523062 - RNA, 23 nt, Homo sapiens
gugagggauaguggggucagggc

SEQ ID NO: 1523063 - RNA, 17 nt, Homo sapiens
gugaucacugagccauc

SEQ ID NO: 1523064 - RNA, 19 nt, Homo sapiens
gugcagaaauuugaaugac

SEQ ID NO: 1523065 - RNA, 15 nt, Homo sapiens
gugcccaccaacauc

SEQ ID NO: 1523066 - RNA, 16 nt, Homo sapiens
guggaaaugacccaaa

SEQ ID NO: 1523067 - RNA, 23 nt, Homo sapiens
guguauuuaaccuugaaggguuc

SEQ ID NO: 1523068 - RNA, 10 nt, Homo sapiens
guuccagguu

SEQ ID NO: 1523069 - RNA, 16 nt, Homo sapiens
guucccuauuuugcca

SEQ ID NO: 1523070 - RNA, 12 nt, Homo sapiens
guucccuuuaaa

SEQ ID NO: 1523071 - RNA, 16 nt, Homo sapiens
guucgagaccaaccug

SEQ ID NO: 1523072 - RNA, 13 nt, Homo sapiens
guucuaucccacc

SEQ ID NO: 1523073 - RNA, 11 nt, Homo sapiens
guucucagacu

SEQ ID NO: 1523074 - RNA, 13 nt, Homo sapiens
guugauggugcua

SEQ ID NO: 1523075 - RNA, 15 nt, Homo sapiens
guugcugauguuuau

SEQ ID NO: 1523076 - RNA, 24 nt, Homo sapiens
guuguuuucagacucagacuccau

SEQ ID NO: 1523077 - RNA, 17 nt, Homo sapiens
guuugaaucacaguaua

SEQ ID NO: 1523078 - RNA, 16 nt, Homo sapiens
guuuuguucauaauac

SEQ ID NO: 1523079 - RNA, 22 nt, Homo sapiens
uaaaaaauaaauauaauuggga

SEQ ID NO: 1523080 - RNA, 21 nt, Homo sapiens
uaaaagaauaaaauugcacuu

SEQ ID NO: 1523081 - RNA, 21 nt, Homo sapiens
uaaaagaugcauuaucuauga

SEQ ID NO: 1523082 - RNA, 14 nt, Homo sapiens
uaaaaucacuguca

SEQ ID NO: 1523083 - RNA, 15 nt, Homo sapiens
uaaaauuauuuuucc

SEQ ID NO: 1523084 - RNA, 11 nt, Homo sapiens
uaaacagugcc

SEQ ID NO: 1523085 - RNA, 23 nt, Homo sapiens
uaaaccaaugucauaacaggcau

SEQ ID NO: 1523086 - RNA, 18 nt, Homo sapiens
uaaacugaaaaaugucag

SEQ ID NO: 1523087 - RNA, 16 nt, Homo sapiens
uaaagagaguuugcca

SEQ ID NO: 1523088 - RNA, 22 nt, Homo sapiens
uaaagcauguuugguuuuccaa

SEQ ID NO: 1523089 - RNA, 12 nt, Homo sapiens
uaaauacuguuu

SEQ ID NO: 1523090 - RNA, 14 nt, Homo sapiens
uaacaacuaugauu

SEQ ID NO: 1523091 - RNA, 23 nt, Homo sapiens
uaacacuggauuuguuucuguga

SEQ ID NO: 1523092 - RNA, 14 nt, Homo sapiens
uaacuauguugaua

SEQ ID NO: 1523093 - RNA, 12 nt, Homo sapiens
uaagaaaaccaa

SEQ ID NO: 1523094 - RNA, 18 nt, Homo sapiens
uaagauuuccaagugcca

SEQ ID NO: 1523095 - RNA, 21 nt, Homo sapiens
uaagauuuuugaaaauccuga

SEQ ID NO: 1523096 - RNA, 15 nt, Homo sapiens
uaaguaaugaugucg

SEQ ID NO: 1523097 - RNA, 14 nt, Homo sapiens
uaagugcaugacau

SEQ ID NO: 1523098 - RNA, 23 nt, Homo sapiens
uaauacaaaggugcuaauuaaua

SEQ ID NO: 1523099 - RNA, 19 nt, Homo sapiens
uaauaguuguugaguauuc

SEQ ID NO: 1523100 - RNA, 18 nt, Homo sapiens
uaauccagaaaaacugug

SEQ ID NO: 1523101 - RNA, 14 nt, Homo sapiens
uaaugucaccaccu

SEQ ID NO: 1523102 - RNA, 17 nt, Homo sapiens
uaauuugugaauuugca

SEQ ID NO: 1523103 - RNA, 13 nt, Homo sapiens
uacaaaggugcua

SEQ ID NO: 1523104 - RNA, 17 nt, Homo sapiens
uacaacuucaagugcau

SEQ ID NO: 1523105 - RNA, 13 nt, Homo sapiens
uaccccaccacga

SEQ ID NO: 1523106 - RNA, 23 nt, Homo sapiens
uaccccaccacgauguggcccug

SEQ ID NO: 1523107 - RNA, 22 nt, Homo sapiens
uaccuuaaaauguaaaacaaaa

SEQ ID NO: 1523108 - RNA, 13 nt, Homo sapiens
uaccuugugcuaa

SEQ ID NO: 1523109 - RNA, 21 nt, Homo sapiens
uacgaaggugaggucugggau

SEQ ID NO: 1523110 - RNA, 20 nt, Homo sapiens
uacgcuccaucgcugucauc

SEQ ID NO: 1523111 - RNA, 14 nt, Homo sapiens
uacuaucaugucaa

SEQ ID NO: 1523112 - RNA, 15 nt, Homo sapiens
uacuaucaugucaaa

SEQ ID NO: 1523113 - RNA, 15 nt, Homo sapiens
uacuucccaguauaa

SEQ ID NO: 1523114 - RNA, 22 nt, Homo sapiens
uacuucuguggaaguagcuuug

SEQ ID NO: 1523115 - RNA, 17 nt, Homo sapiens
uacuugaagaauguuga

SEQ ID NO: 1523116 - RNA, 18 nt, Homo sapiens
uagacacaucaaaugccc

SEQ ID NO: 1523117 - RNA, 12 nt, Homo sapiens
uagacuaguuuc

SEQ ID NO: 1523118 - RNA, 16 nt, Homo sapiens
uagagucaauuugcug

SEQ ID NO: 1523119 - RNA, 15 nt, Homo sapiens
uagaguucagacuuu

SEQ ID NO: 1523120 - RNA, 17 nt, Homo sapiens
uaggcucugggugcagu

SEQ ID NO: 1523121 - RNA, 16 nt, Homo sapiens
uagggcaacaauacau

SEQ ID NO: 1523122 - RNA, 15 nt, Homo sapiens
uuauaaagcagauua

SEQ ID NO: 1523123 - RNA, 23 nt, Homo sapiens
uuauaaagggagauaacaaucug

SEQ ID NO: 1523124 - RNA, 19 nt, Homo sapiens
uuauaccaccauccuugua

SEQ ID NO: 1523125 - RNA, 19 nt, Homo sapiens
uuauauaaggcaguauuau

SEQ ID NO: 1523126 - RNA, 21 nt, Homo sapiens
uuauccuuaggaaaaugcuuc

SEQ ID NO: 1523127 - RNA, 13 nt, Homo sapiens
uuaucuauggcac

SEQ ID NO: 1523128 - RNA, 18 nt, Homo sapiens
uuaugauuaaucugauua

SEQ ID NO: 1523129 - RNA, 14 nt, Homo sapiens
uuauguaacaucca

SEQ ID NO: 1523130 - RNA, 18 nt, Homo sapiens
uuaugugagccccuucag

SEQ ID NO: 1523131 - RNA, 18 nt, Homo sapiens
uuauuauagaauugcaca

SEQ ID NO: 1523132 - RNA, 13 nt, Homo sapiens
uucaaaagcaauc

SEQ ID NO: 1523133 - RNA, 23 nt, Homo sapiens
uucacucccgaggauguguccua

SEQ ID NO: 1523134 - RNA, 13 nt, Homo sapiens
uucagaaagaagu

SEQ ID NO: 1523135 - RNA, 21 nt, Homo sapiens
uucaggaagcauaaagcaauu

SEQ ID NO: 1523136 - RNA, 18 nt, Homo sapiens
uucauauauuuguaugau

SEQ ID NO: 1523137 - RNA, 18 nt, Homo sapiens
uucauccaggacugagau

SEQ ID NO: 1523138 - RNA, 21 nt, Homo sapiens
uuccagguuuuucuggcauuu

SEQ ID NO: 1523139 - RNA, 21 nt, Homo sapiens
uucccuauuuugccaguggga

SEQ ID NO: 1523140 - RNA, 14 nt, Homo sapiens
uucccuucuugcau

SEQ ID NO: 1523141 - RNA, 16 nt, Homo sapiens
uuccuuugucauuauu

SEQ ID NO: 1523142 - RNA, 13 nt, Homo sapiens
uucuaaucaaagc

SEQ ID NO: 1523143 - RNA, 19 nt, Homo sapiens
uucucagacugccaaagaa

SEQ ID NO: 1523144 - RNA, 13 nt, Homo sapiens
uucucuuugccau

SEQ ID NO: 1523145 - RNA, 19 nt, Homo sapiens
uucugaaugugcugaucau

SEQ ID NO: 1523146 - RNA, 22 nt, Homo sapiens
uucuguuguaauaguccaugga

SEQ ID NO: 1523147 - RNA, 14 nt, Homo sapiens
uucuuaggccacau

SEQ ID NO: 1523148 - RNA, 15 nt, Homo sapiens
uucuuaguggaagac

SEQ ID NO: 1523149 - RNA, 17 nt, Homo sapiens
uucuucacucaaucucu

SEQ ID NO: 1523150 - RNA, 12 nt, Homo sapiens
uucuuccuuauu

SEQ ID NO: 1523151 - RNA, 23 nt, Homo sapiens
uucuuuccucuuccccuugcccu

SEQ ID NO: 1523152 - RNA, 17 nt, Homo sapiens
uugaaaaauaaaaacca

SEQ ID NO: 1523153 - RNA, 19 nt, Homo sapiens
uugaauaucuuccacagag

SEQ ID NO: 1523154 - RNA, 19 nt, Homo sapiens
uugacaaagaaacccaagu

SEQ ID NO: 1523155 - RNA, 23 nt, Homo sapiens
uugcaccccuccuauaccauaug

SEQ ID NO: 1523156 - RNA, 20 nt, Homo sapiens
uugcauuugucaaagcauug

SEQ ID NO: 1523157 - RNA, 15 nt, Homo sapiens
uugccuucuuucaua

SEQ ID NO: 1523158 - RNA, 14 nt, Homo sapiens
uugcuuugggagac

SEQ ID NO: 1523159 - RNA, 12 nt, Homo sapiens
uuggaaaucaca

SEQ ID NO: 1523160 - RNA, 14 nt, Homo sapiens
uuggaagagaauca

SEQ ID NO: 1523161 - RNA, 19 nt, Homo sapiens
uuggaagugugugaucugu

SEQ ID NO: 1523162 - RNA, 16 nt, Homo sapiens
uuggcuucuaaucaaa

SEQ ID NO: 1523163 - RNA, 15 nt, Homo sapiens
uugggaacugcaaua

SEQ ID NO: 1523164 - RNA, 13 nt, Homo sapiens
uuguaacuccacc

SEQ ID NO: 1523165 - RNA, 19 nt, Homo sapiens
uuguauauaguuaguaucu

SEQ ID NO: 1523166 - RNA, 18 nt, Homo sapiens
uuguaugauccuaaugaa

SEQ ID NO: 1523167 - RNA, 19 nt, Homo sapiens
uuuaaagagaguuugccac

SEQ ID NO: 1523168 - RNA, 16 nt, Homo sapiens
uuuagcgagcccagag

SEQ ID NO: 1523169 - RNA, 23 nt, Homo sapiens
uuuauaaagggagauaacaaucu

SEQ ID NO: 1523170 - RNA, 19 nt, Homo sapiens
uuuauuuuacauagaucau

SEQ ID NO: 1523171 - RNA, 14 nt, Homo sapiens
uuucauacauuuga

SEQ ID NO: 1523172 - RNA, 18 nt, Homo sapiens
uuuccacccucucuccac

SEQ ID NO: 1523173 - RNA, 21 nt, Homo sapiens
uuuccucuuccccuugcccuu

SEQ ID NO: 1523174 - RNA, 20 nt, Homo sapiens
uuuccuuugcauucaucucu

SEQ ID NO: 1523175 - RNA, 22 nt, Homo sapiens
uuuccuuugcauucaucucuca

SEQ ID NO: 1523176 - RNA, 14 nt, Homo sapiens
uuucucuuugccau

SEQ ID NO: 1523177 - RNA, 16 nt, Homo sapiens
uuucugaucugaugca

SEQ ID NO: 1523178 - RNA, 15 nt, Homo sapiens
uuucuguaacacacu

SEQ ID NO: 1523179 - RNA, 22 nt, Homo sapiens
uuugagucccccagagauguca

SEQ ID NO: 1523180 - RNA, 19 nt, Homo sapiens
uuugcauaagugcaugaca

SEQ ID NO: 1523181 - RNA, 20 nt, Homo sapiens
uuugggaacugcaauaaccu

SEQ ID NO: 1523182 - RNA, 17 nt, Homo sapiens
uuuguaagaaaaccaaa

SEQ ID NO: 1523183 - RNA, 15 nt, Homo sapiens
uuuguaugcuaaaug

SEQ ID NO: 1523184 - RNA, 21 nt, Homo sapiens
uuuuacauagaucauauugua

SEQ ID NO: 1523185 - RNA, 12 nt, Homo sapiens
uuuucuguucca

SEQ ID NO: 1523186 - RNA, 15 nt, Homo sapiens
uuuugauaaguaucu

SEQ ID NO: 1523187 - RNA, 21 nt, Homo sapiens
uuuuuguuuacaaacauggaa

SEQ ID NO: 1523188 - RNA, 13 nt, Homo sapiens
aauugauuauucu

SEQ ID NO: 1523189 - RNA, 22 nt, Homo sapiens
aauugcacauaguucugcccaa

SEQ ID NO: 1523190 - RNA, 20 nt, Homo sapiens
aauugcacuuuuaaaccucu

SEQ ID NO: 1523191 - RNA, 12 nt, Homo sapiens
aauuuccuugac

SEQ ID NO: 1523192 - RNA, 18 nt, Homo sapiens
aauuugauuuagcauuca

SEQ ID NO: 1523193 - RNA, 15 nt, Homo sapiens
aauuugccaccacua

SEQ ID NO: 1523194 - RNA, 22 nt, Homo sapiens
aauuuuaaauguucacaacaua

SEQ ID NO: 1523195 - RNA, 18 nt, Homo sapiens
aauuuuucuaaaggugcu

SEQ ID NO: 1523196 - RNA, 19 nt, Homo sapiens
aauuuuuuuuucaacacuc

SEQ ID NO: 1523197 - RNA, 16 nt, Homo sapiens
acaaaacugccaaaaa

SEQ ID NO: 1523198 - RNA, 14 nt, Homo sapiens
acaaaugugauaau

SEQ ID NO: 1523199 - RNA, 21 nt, Homo sapiens
acaaaugugauaauauauugc

SEQ ID NO: 1523200 - RNA, 22 nt, Homo sapiens
acaacauaaggagaauguaucu

SEQ ID NO: 1523201 - RNA, 13 nt, Homo sapiens
acaacuucccaaa

SEQ ID NO: 1523202 - RNA, 19 nt, Homo sapiens
acaacuucccaaagcacaa

SEQ ID NO: 1523203 - RNA, 11 nt, Homo sapiens
acaagauuccc

SEQ ID NO: 1523204 - RNA, 15 nt, Homo sapiens
acaauagaaaccugu

SEQ ID NO: 1523205 - RNA, 20 nt, Homo sapiens
acaccaucuuaaaugacagu

SEQ ID NO: 1523206 - RNA, 20 nt, Homo sapiens
acacuaacaaaagcaugaaa

SEQ ID NO: 1523207 - RNA, 17 nt, Homo sapiens
acagacuaugucaccca

SEQ ID NO: 1523208 - RNA, 24 nt, Homo sapiens
acagacuaugucacccaaugcaua

SEQ ID NO: 1523209 - RNA, 23 nt, Homo sapiens
acagacugaauuuuaaauguuca

SEQ ID NO: 1523210 - RNA, 13 nt, Homo sapiens
acagauggaccaa

SEQ ID NO: 1523211 - RNA, 22 nt, Homo sapiens
acagcaucgugaucacugagcc

SEQ ID NO: 1523212 - RNA, 19 nt, Homo sapiens
acagcucagagaugaaacu

SEQ ID NO: 1523213 - RNA, 16 nt, Homo sapiens
acaucccauugcccug

SEQ ID NO: 1523214 - RNA, 12 nt, Homo sapiens
acaucgucugug

SEQ ID NO: 1523215 - RNA, 13 nt, Homo sapiens
acaucuaaugucu

SEQ ID NO: 1523216 - RNA, 21 nt, Homo sapiens
acaugaccaaaaaccaaaagu

SEQ ID NO: 1523217 - RNA, 15 nt, Homo sapiens
acauuagccuaugug

SEQ ID NO: 1523218 - RNA, 22 nt, Homo sapiens
acauuugaaaucuaugaaauau

SEQ ID NO: 1523219 - RNA, 15 nt, Homo sapiens
accaaugucauaaca

SEQ ID NO: 1523220 - RNA, 13 nt, Homo sapiens
accauaaacauuu

SEQ ID NO: 1523221 - RNA, 18 nt, Homo sapiens
acccaauaguuguugauu

SEQ ID NO: 1523222 - RNA, 14 nt, Homo sapiens
acccccuucagugc

SEQ ID NO: 1523223 - RNA, 16 nt, Homo sapiens
accgggguucaagcca

SEQ ID NO: 1523224 - RNA, 18 nt, Homo sapiens
accuauuuuguaugugua

SEQ ID NO: 1523225 - RNA, 14 nt, Homo sapiens
accucaaaacacuu

SEQ ID NO: 1523226 - RNA, 15 nt, Homo sapiens
accucccagcccuau

SEQ ID NO: 1523227 - RNA, 19 nt, Homo sapiens
accucucuaagccacagcu

SEQ ID NO: 1523228 - RNA, 15 nt, Homo sapiens
accugcugcugcuau

SEQ ID NO: 1523229 - RNA, 22 nt, Homo sapiens
accuuacauuugaaaucuauga

SEQ ID NO: 1523230 - RNA, 12 nt, Homo sapiens
accuuaccaaaa

SEQ ID NO: 1523231 - RNA, 16 nt, Homo sapiens
accuuugaaauauuaa

SEQ ID NO: 1523232 - RNA, 21 nt, Homo sapiens
accuuuguaagaaaaccaaaa

SEQ ID NO: 1523233 - RNA, 15 nt, Homo sapiens
acgaacccaccugcu

SEQ ID NO: 1523234 - RNA, 14 nt, Homo sapiens
acgacaaagcagaa

SEQ ID NO: 1523235 - RNA, 23 nt, Homo sapiens
acgagacccauuuccuugugcuc

SEQ ID NO: 1523236 - RNA, 14 nt, Homo sapiens
acgagauaauguau

SEQ ID NO: 1523237 - RNA, 17 nt, Homo sapiens
acggguaccaugcugcc

SEQ ID NO: 1523238 - RNA, 16 nt, Homo sapiens
acuaauacagacuaug

SEQ ID NO: 1523239 - RNA, 19 nt, Homo sapiens
acuaccucguucuugucuu

SEQ ID NO: 1523240 - RNA, 22 nt, Homo sapiens
acuauccucacucccauaagcu

SEQ ID NO: 1523241 - RNA, 19 nt, Homo sapiens
acuauggcucuacuuucag

SEQ ID NO: 1523242 - RNA, 20 nt, Homo sapiens
acucccgaggauguguccua

SEQ ID NO: 1523243 - RNA, 13 nt, Homo sapiens
acuccuucccaaa

SEQ ID NO: 1523244 - RNA, 22 nt, Homo sapiens
acugaacccccucaaaagccaa

SEQ ID NO: 1523245 - RNA, 14 nt, Homo sapiens
acugagaugcaaau

SEQ ID NO: 1523246 - RNA, 17 nt, Homo sapiens
acugaugccauguuuag

SEQ ID NO: 1523247 - RNA, 22 nt, Homo sapiens
acugaugccauguuuagauucc

SEQ ID NO: 1523248 - RNA, 14 nt, Homo sapiens
acugcaacuuguga

SEQ ID NO: 1523249 - RNA, 20 nt, Homo sapiens
acugcauaaaccaaugagcu

SEQ ID NO: 1523250 - RNA, 17 nt, Homo sapiens
acuguguugacuuugcu

SEQ ID NO: 1523251 - RNA, 13 nt, Homo sapiens
acuucaaggguuu

SEQ ID NO: 1523252 - RNA, 13 nt, Homo sapiens
acuucuguuccag

SEQ ID NO: 1523253 - RNA, 14 nt, Homo sapiens
acuucuguuccagg

SEQ ID NO: 1523254 - RNA, 14 nt, Homo sapiens
agaaacuauaugca

SEQ ID NO: 1523255 - RNA, 17 nt, Homo sapiens
agaaagcucaucucagc

SEQ ID NO: 1523256 - RNA, 22 nt, Homo sapiens
agaaauuuagagucaauuugcu

SEQ ID NO: 1523257 - RNA, 13 nt, Homo sapiens
agaaggagggaga

SEQ ID NO: 1523258 - RNA, 15 nt, Homo sapiens
agaauggaaggugga

SEQ ID NO: 1523259 - RNA, 19 nt, Homo sapiens
agaauuccugaagccagau

SEQ ID NO: 1523260 - RNA, 23 nt, Homo sapiens
agacaacuucccaaagcacaaag

SEQ ID NO: 1523261 - RNA, 17 nt, Homo sapiens
agacaauuucacaugga

SEQ ID NO: 1523262 - RNA, 18 nt, Homo sapiens
agacaugagcauggcuga

SEQ ID NO: 1523263 - RNA, 23 nt, Homo sapiens
agacugaauuuuaaauguucaca

SEQ ID NO: 1523264 - RNA, 15 nt, Homo sapiens
agagaguuugccacu

SEQ ID NO: 1523265 - RNA, 23 nt, Homo sapiens
agaguaacguacauuugugcugu

SEQ ID NO: 1523266 - RNA, 17 nt, Homo sapiens
agauaauucuagcuuug

SEQ ID NO: 1523267 - RNA, 17 nt, Homo sapiens
agaucuccacggucaga

SEQ ID NO: 1523268 - RNA, 14 nt, Homo sapiens
agaugaaugggagu

SEQ ID NO: 1523269 - RNA, 19 nt, Homo sapiens
agauguccuugaugcucau

SEQ ID NO: 1523270 - RNA, 21 nt, Homo sapiens
agauguuuaaauaaauuguga

SEQ ID NO: 1523271 - RNA, 17 nt, Homo sapiens
agauuaguaaauaugug

SEQ ID NO: 1523272 - RNA, 14 nt, Homo sapiens
agcaaauguuccuu

SEQ ID NO: 1523273 - RNA, 21 nt, Homo sapiens
agcaauugugaaauacaguau

SEQ ID NO: 1523274 - RNA, 14 nt, Homo sapiens
agcauaaagcaauu

SEQ ID NO: 1523275 - RNA, 18 nt, Homo sapiens
agcauuuguucuuugcca

SEQ ID NO: 1523276 - RNA, 15 nt, Homo sapiens
agccaaguuaagaau

SEQ ID NO: 1523277 - RNA, 17 nt, Homo sapiens
agccacuauuaacauuu

SEQ ID NO: 1523278 - RNA, 18 nt, Homo sapiens
agccacuauuaacauuuc

SEQ ID NO: 1523279 - RNA, 14 nt, Homo sapiens
agccuuaugugagc

SEQ ID NO: 1523280 - RNA, 21 nt, Homo sapiens
agcuagaagugggccaggaca

SEQ ID NO: 1523281 - RNA, 12 nt, Homo sapiens
agcucaucucag

SEQ ID NO: 1523282 - RNA, 13 nt, Homo sapiens
agcucaucucagc

SEQ ID NO: 1523283 - RNA, 17 nt, Homo sapiens
agcugaauccuuccauu

SEQ ID NO: 1523284 - RNA, 16 nt, Homo sapiens
agcugcucccaaauaa

SEQ ID NO: 1523285 - RNA, 22 nt, Homo sapiens
agcuggguuggaaaacaguauu

SEQ ID NO: 1523286 - RNA, 19 nt, Homo sapiens
agcuuauuauagaauugca

SEQ ID NO: 1523287 - RNA, 17 nt, Homo sapiens
agcuugcucuucagugg

SEQ ID NO: 1523288 - RNA, 23 nt, Homo sapiens
agcuugcucuucagugggagaaa

SEQ ID NO: 1523289 - RNA, 14 nt, Homo sapiens
aggaaaaagugcuu

SEQ ID NO: 1523290 - RNA, 16 nt, Homo sapiens
aggaagauguaugcuu

SEQ ID NO: 1523291 - RNA, 22 nt, Homo sapiens
aggaagcuugguccacuugcuu

SEQ ID NO: 1523292 - RNA, 22 nt, Homo sapiens
aggacaugauacugaugccaug

SEQ ID NO: 1523293 - RNA, 11 nt, Homo sapiens
aggacugagau

SEQ ID NO: 1523294 - RNA, 23 nt, Homo sapiens
aggagggcgugacucacccaagc

SEQ ID NO: 1523295 - RNA, 18 nt, Homo sapiens
aggcaagauaaaccaaug

SEQ ID NO: 1523296 - RNA, 21 nt, Homo sapiens
aggcagggccuugcccagaga

SEQ ID NO: 1523297 - RNA, 13 nt, Homo sapiens
aggcauguccuag

SEQ ID NO: 1523298 - RNA, 13 nt, Homo sapiens
aggccucugcucu

SEQ ID NO: 1523299 - RNA, 12 nt, Homo sapiens
aggcuucuucag

SEQ ID NO: 1523300 - RNA, 15 nt, Homo sapiens
agggaauaauccaga

SEQ ID NO: 1523301 - RNA, 15 nt, Homo sapiens
agggccacgacaaag

SEQ ID NO: 1523302 - RNA, 14 nt, Homo sapiens
agggcuggggccaa

SEQ ID NO: 1523303 - RNA, 15 nt, Homo sapiens
aggugaggucuggga

SEQ ID NO: 1523304 - RNA, 15 nt, Homo sapiens
agguuugcaccccuc

SEQ ID NO: 1523305 - RNA, 15 nt, Homo sapiens
aguaguaucugcuua

SEQ ID NO: 1523306 - RNA, 14 nt, Homo sapiens
agucaauauuguau

SEQ ID NO: 1523307 - RNA, 13 nt, Homo sapiens
agucaccaggaau

SEQ ID NO: 1523308 - RNA, 20 nt, Homo sapiens
agucaugcguuuaaucacau

SEQ ID NO: 1523309 - RNA, 18 nt, Homo sapiens
agucuauuuuuauuccuu

SEQ ID NO: 1523310 - RNA, 19 nt, Homo sapiens
agucuauuuuuauuccuug

SEQ ID NO: 1523311 - RNA, 21 nt, Homo sapiens
agucugaaagacagaauguca

SEQ ID NO: 1523312 - RNA, 23 nt, Homo sapiens
agucugaaagacagaaugucacc

SEQ ID NO: 1523313 - RNA, 11 nt, Homo sapiens
aauaucuucca

SEQ ID NO: 1523314 - RNA, 17 nt, Homo sapiens
aauaucuuccacagagg

SEQ ID NO: 1523315 - RNA, 20 nt, Homo sapiens
aauauguuucacccuguccc

SEQ ID NO: 1523316 - RNA, 13 nt, Homo sapiens
aaucaacuugugg

SEQ ID NO: 1523317 - RNA, 18 nt, Homo sapiens
aaucaaguuggcuucuaa

SEQ ID NO: 1523318 - RNA, 20 nt, Homo sapiens
aaucagacuucacacugcaa

SEQ ID NO: 1523319 - RNA, 20 nt, Homo sapiens
aauccugaauaaaccaguau

SEQ ID NO: 1523320 - RNA, 16 nt, Homo sapiens
aaucugccugcaacuu

SEQ ID NO: 1523321 - RNA, 14 nt, Homo sapiens
aaucuucuucagau

SEQ ID NO: 1523322 - RNA, 17 nt, Homo sapiens
aaucuucuucagauuca

SEQ ID NO: 1523323 - RNA, 12 nt, Homo sapiens
aaugaaugacau

SEQ ID NO: 1523324 - RNA, 20 nt, Homo sapiens
aaugcauauccaacaugugc

SEQ ID NO: 1523325 - RNA, 20 nt, Homo sapiens
aauguauauaaaguacuuua

SEQ ID NO: 1523326 - RNA, 14 nt, Homo sapiens
aaugucaccaccuu

SEQ ID NO: 1523327 - RNA, 15 nt, Homo sapiens
aauuaacugcuccaa

SEQ ID NO: 1523328 - RNA, 21 nt, Homo sapiens
aauucuuaguggaagacaaua

SEQ ID NO: 1523329 - RNA, 22 nt, Homo sapiens
agucuucauaauuucuucacuc

SEQ ID NO: 1523330 - RNA, 22 nt, Homo sapiens
agugcauucaaccuuaccaaaa

SEQ ID NO: 1523331 - RNA, 14 nt, Homo sapiens
agugccuuaccucc

SEQ ID NO: 1523332 - RNA, 16 nt, Homo sapiens
agugcugaacuggcug

SEQ ID NO: 1523333 - RNA, 21 nt, Homo sapiens
aguggcccccacccucagccc

SEQ ID NO: 1523334 - RNA, 14 nt, Homo sapiens
aguggggucagggc

SEQ ID NO: 1523335 - RNA, 13 nt, Homo sapiens
aguucagacuuuu

SEQ ID NO: 1523336 - RNA, 15 nt, Homo sapiens
aguucugaacauuuu

SEQ ID NO: 1523337 - RNA, 18 nt, Homo sapiens
aguuggaagugugugauc

SEQ ID NO: 1523338 - RNA, 12 nt, Homo sapiens
auaaacugagag

SEQ ID NO: 1523339 - RNA, 23 nt, Homo sapiens
auaaacugagaggucacaaagaa

SEQ ID NO: 1523340 - RNA, 23 nt, Homo sapiens
auaaagcauguuugguuuuccaa

SEQ ID NO: 1523341 - RNA, 18 nt, Homo sapiens
auaaagcuccucugcucc

SEQ ID NO: 1523342 - RNA, 14 nt, Homo sapiens
auaaaucaauucau

SEQ ID NO: 1523343 - RNA, 14 nt, Homo sapiens
auaagcauucaaua

SEQ ID NO: 1523344 - RNA, 15 nt, Homo sapiens
auaagugcaugacau

SEQ ID NO: 1523345 - RNA, 17 nt, Homo sapiens
auaauaaugccuagugg

SEQ ID NO: 1523346 - RNA, 14 nt, Homo sapiens
auaauauacuguac

SEQ ID NO: 1523347 - RNA, 14 nt, Homo sapiens
auacaaaggugcua

SEQ ID NO: 1523348 - RNA, 18 nt, Homo sapiens
auacaugcugcuaauuca

SEQ ID NO: 1523349 - RNA, 14 nt, Homo sapiens
auaccaaaggugcu

SEQ ID NO: 1523350 - RNA, 17 nt, Homo sapiens
auacucccuuuaaagag

SEQ ID NO: 1523351 - RNA, 17 nt, Homo sapiens
auacugccggucaccca

SEQ ID NO: 1523352 - RNA, 17 nt, Homo sapiens
auaguccauggacaaua

SEQ ID NO: 1523353 - RNA, 22 nt, Homo sapiens
auauccaacaugugcucaggga

SEQ ID NO: 1523354 - RNA, 11 nt, Homo sapiens
auaugcaauau

SEQ ID NO: 1523355 - RNA, 20 nt, Homo sapiens
auauguagcuuuauccuuag

SEQ ID NO: 1523356 - RNA, 19 nt, Homo sapiens
auauuuauggggggagaac

SEQ ID NO: 1523357 - RNA, 21 nt, Homo sapiens
auauuuuccaucuuauuccca

SEQ ID NO: 1523358 - RNA, 19 nt, Homo sapiens
aucacaacgggccagcucu

SEQ ID NO: 1523359 - RNA, 15 nt, Homo sapiens
aucacuggugcuaua

SEQ ID NO: 1523360 - RNA, 22 nt, Homo sapiens
aucauucauccaggacugagau

SEQ ID NO: 1523361 - RNA, 20 nt, Homo sapiens
auccacccucaaaugucaga

SEQ ID NO: 1523362 - RNA, 21 nt, Homo sapiens
auccagaagguuugcaccccu

SEQ ID NO: 1523363 - RNA, 23 nt, Homo sapiens
auccauuccucagggacagagac

SEQ ID NO: 1523364 - RNA, 19 nt, Homo sapiens
auccuuaggaaaaugcuuc

SEQ ID NO: 1523365 - RNA, 14 nt, Homo sapiens
auccuuccauuucu

SEQ ID NO: 1523366 - RNA, 15 nt, Homo sapiens
aucgcugucaucuca

SEQ ID NO: 1523367 - RNA, 22 nt, Homo sapiens
aucuaugaaauaucaugcucca

SEQ ID NO: 1523368 - RNA, 18 nt, Homo sapiens
aucugcuuaggugccagg

SEQ ID NO: 1523369 - RNA, 18 nt, Homo sapiens
aucugguuaaugacauac

SEQ ID NO: 1523370 - RNA, 16 nt, Homo sapiens
aucuucuucagauuca

SEQ ID NO: 1523371 - RNA, 23 nt, Homo sapiens
aucuucuucagauucagcauuug

SEQ ID NO: 1523372 - RNA, 24 nt, Homo sapiens
aucuucuucagauucagcauuugu

SEQ ID NO: 1523373 - RNA, 16 nt, Homo sapiens
augaaauguaaauacu

SEQ ID NO: 1523374 - RNA, 23 nt, Homo sapiens
augaauuugggauacuaaaguag

SEQ ID NO: 1523375 - RNA, 12 nt, Homo sapiens
augaccaaaaac

SEQ ID NO: 1523376 - RNA, 19 nt, Homo sapiens
augagugugauccacauug

SEQ ID NO: 1523377 - RNA, 16 nt, Homo sapiens
augauaacugcaauuu

SEQ ID NO: 1523378 - RNA, 14 nt, Homo sapiens
augcagcaucuaag

SEQ ID NO: 1523379 - RNA, 16 nt, Homo sapiens
augcguuuaaucacau

SEQ ID NO: 1523380 - RNA, 22 nt, Homo sapiens
auguauaaauuaauacagagua

SEQ ID NO: 1523381 - RNA, 15 nt, Homo sapiens
auguauaugcaauau

SEQ ID NO: 1523382 - RNA, 21 nt, Homo sapiens
auguaugcuuugaaugcaaaa

SEQ ID NO: 1523383 - RNA, 20 nt, Homo sapiens
augucacaguaaugcaagca

SEQ ID NO: 1523384 - RNA, 17 nt, Homo sapiens
augucguuugaaucaca

SEQ ID NO: 1523385 - RNA, 19 nt, Homo sapiens
augucguuugaaucacagu

SEQ ID NO: 1523386 - RNA, 21 nt, Homo sapiens
augugcucagggaauaaucca

SEQ ID NO: 1523387 - RNA, 20 nt, Homo sapiens
augugggguccccaucaucc

SEQ ID NO: 1523388 - RNA, 21 nt, Homo sapiens
augugggguccccaucauccc

SEQ ID NO: 1523389 - RNA, 13 nt, Homo sapiens
augugugauucac

SEQ ID NO: 1523390 - RNA, 20 nt, Homo sapiens
auguuccuuucgaaagcaau

SEQ ID NO: 1523391 - RNA, 21 nt, Homo sapiens
auguuccuuucgaaagcaaug

SEQ ID NO: 1523392 - RNA, 18 nt, Homo sapiens
auguuuauaaacugagag

SEQ ID NO: 1523393 - RNA, 18 nt, Homo sapiens
auuaucuaugauaugcua

SEQ ID NO: 1523394 - RNA, 11 nt, Homo sapiens
auuauucugau

SEQ ID NO: 1523395 - RNA, 21 nt, Homo sapiens
auuauucugauuccacuuuua

SEQ ID NO: 1523396 - RNA, 17 nt, Homo sapiens
auucaaccuuaccaaaa

SEQ ID NO: 1523397 - RNA, 13 nt, Homo sapiens
auucacaguguga

SEQ ID NO: 1523398 - RNA, 16 nt, Homo sapiens
auucagccaggagaug

SEQ ID NO: 1523399 - RNA, 21 nt, Homo sapiens
auucccaauuaaaaguaugca

SEQ ID NO: 1523400 - RNA, 16 nt, Homo sapiens
auuccugaagccagau

SEQ ID NO: 1523401 - RNA, 18 nt, Homo sapiens
auucuaugaacagugaca

SEQ ID NO: 1523402 - RNA, 16 nt, Homo sapiens
auucugucaaugucuu

SEQ ID NO: 1523403 - RNA, 16 nt, Homo sapiens
auugacccauguuccc

SEQ ID NO: 1523404 - RNA, 20 nt, Homo sapiens
auugaucagagcauugugca

SEQ ID NO: 1523405 - RNA, 22 nt, Homo sapiens
auugguccagcuugcucuucag

SEQ ID NO: 1523406 - RNA, 14 nt, Homo sapiens
auuuaaaguauucu

SEQ ID NO: 1523407 - RNA, 14 nt, Homo sapiens
auuucacugaagau

SEQ ID NO: 1523408 - RNA, 16 nt, Homo sapiens
auuucagauacuugaa

SEQ ID NO: 1523409 - RNA, 15 nt, Homo sapiens
auuucuucugcacau

SEQ ID NO: 1523410 - RNA, 17 nt, Homo sapiens
auuugauuuagcauuca

SEQ ID NO: 1523411 - RNA, 16 nt, Homo sapiens
auuugcuguucaccca

SEQ ID NO: 1523412 - RNA, 15 nt, Homo sapiens
auuuguucuuugcca

SEQ ID NO: 1523413 - RNA, 13 nt, Homo sapiens
auuuuaauuaucu

SEQ ID NO: 1523414 - RNA, 14 nt, Homo sapiens
auuuuaauuaucuu

SEQ ID NO: 1523415 - RNA, 14 nt, Homo sapiens
auuuuauaccaaag

SEQ ID NO: 1523416 - RNA, 15 nt, Homo sapiens
auuuuauaccaaagg

SEQ ID NO: 1523417 - RNA, 22 nt, Homo sapiens
auuuuauaccaaaggugcuaca

SEQ ID NO: 1523418 - RNA, 19 nt, Homo sapiens
auuuugccacugccuuuca

SEQ ID NO: 1523419 - RNA, 17 nt, Homo sapiens
auuuuugccagucuguu

SEQ ID NO: 1523420 - RNA, 17 nt, Homo sapiens
auuuuuucaugaaagau

SEQ ID NO: 1523421 - RNA, 16 nt, Homo sapiens
auuuuuuuaaauuuca

SEQ ID NO: 1523422 - RNA, 13 nt, Homo sapiens
caaaaauguaaug

SEQ ID NO: 1523423 - RNA, 12 nt, Homo sapiens
caaaaauuugaa

SEQ ID NO: 1523424 - RNA, 20 nt, Homo sapiens
caaacaugaauccugugaua

SEQ ID NO: 1523425 - RNA, 14 nt, Homo sapiens
caaacuaccuucca

SEQ ID NO: 1523426 - RNA, 22 nt, Homo sapiens
caaagaauuccugaagccagau

SEQ ID NO: 1523427 - RNA, 13 nt, Homo sapiens
caaagacuuuccu

SEQ ID NO: 1523428 - RNA, 12 nt, Homo sapiens
caaaggugcuaa

SEQ ID NO: 1523429 - RNA, 20 nt, Homo sapiens
caaauaguucugaacauuuu

SEQ ID NO: 1523430 - RNA, 22 nt, Homo sapiens
caaaucacaaaaaaacuguuau

SEQ ID NO: 1523431 - RNA, 11 nt, Homo sapiens
aaaaacaggga

SEQ ID NO: 1523432 - RNA, 18 nt, Homo sapiens
aaaaaccauaaacauuug

SEQ ID NO: 1523433 - RNA, 23 nt, Homo sapiens
aaaaaccauaaacauuugcacca

SEQ ID NO: 1523434 - RNA, 19 nt, Homo sapiens
aaaaacuuucucuuugcca

SEQ ID NO: 1523435 - RNA, 18 nt, Homo sapiens
aaaaauuaaauuguaccu

SEQ ID NO: 1523436 - RNA, 20 nt, Homo sapiens
aaaaccaaaagugcauucaa

SEQ ID NO: 1523437 - RNA, 21 nt, Homo sapiens
aaaacuuucucuuugccauuu

SEQ ID NO: 1523438 - RNA, 11 nt, Homo sapiens
aaaagccaaaa

SEQ ID NO: 1523439 - RNA, 18 nt, Homo sapiens
aaaauauugaauaaugcg

SEQ ID NO: 1523440 - RNA, 15 nt, Homo sapiens
aaaccaaugucauaa

SEQ ID NO: 1523441 - RNA, 13 nt, Homo sapiens
aaacuucaagggu

SEQ ID NO: 1523442 - RNA, 17 nt, Homo sapiens
aaacuuucucuuugcca

SEQ ID NO: 1523443 - RNA, 22 nt, Homo sapiens
aaagaaaaaaaaaagaaaaagg

SEQ ID NO: 1523444 - RNA, 19 nt, Homo sapiens
aaagaaauuuagagucaau

SEQ ID NO: 1523445 - RNA, 14 nt, Homo sapiens
aaagaaguggggac

SEQ ID NO: 1523446 - RNA, 20 nt, Homo sapiens
aaagaauuccugaagccaga

SEQ ID NO: 1523447 - RNA, 15 nt, Homo sapiens
aaagacagaauguca

SEQ ID NO: 1523448 - RNA, 22 nt, Homo sapiens
aaagaugcauuaucuaugauau

SEQ ID NO: 1523449 - RNA, 15 nt, Homo sapiens
aaagcaauugugaaa

SEQ ID NO: 1523450 - RNA, 21 nt, Homo sapiens
aaagcauguuugguuuuccaa

SEQ ID NO: 1523451 - RNA, 15 nt, Homo sapiens
aaaggugcuauuuaa

SEQ ID NO: 1523452 - RNA, 15 nt, Homo sapiens
aaauaaaaaccauaa

SEQ ID NO: 1523453 - RNA, 19 nt, Homo sapiens
aaaucacaaaaaaacuguu

SEQ ID NO: 1523454 - RNA, 17 nt, Homo sapiens
aaaugaaguauuucuca

SEQ ID NO: 1523455 - RNA, 20 nt, Homo sapiens
aaaugcuguauuagucacag

SEQ ID NO: 1523456 - RNA, 17 nt, Homo sapiens
aaauuaaauuguaccua

SEQ ID NO: 1523457 - RNA, 16 nt, Homo sapiens
aaauuaacugcuccaa

SEQ ID NO: 1523458 - RNA, 15 nt, Homo sapiens
aaauuugaaugacaa

SEQ ID NO: 1523459 - RNA, 21 nt, Homo sapiens
aaauuuuuacaaaacugccaa

SEQ ID NO: 1523460 - RNA, 23 nt, Homo sapiens
aacaaacuacauguaauccauca

SEQ ID NO: 1523461 - RNA, 21 nt, Homo sapiens
aacaauacaugcugcuaauuc

SEQ ID NO: 1523462 - RNA, 13 nt, Homo sapiens
aacaugaccaaaa

SEQ ID NO: 1523463 - RNA, 19 nt, Homo sapiens
aacaugaccaaaaaccaaa

SEQ ID NO: 1523464 - RNA, 18 nt, Homo sapiens
aacaugagaaaugugaac

SEQ ID NO: 1523465 - RNA, 17 nt, Homo sapiens
aacauggaaaacagagu

SEQ ID NO: 1523466 - RNA, 13 nt, Homo sapiens
aacaugugcucag

SEQ ID NO: 1523467 - RNA, 14 nt, Homo sapiens
aacaugugcucagg

SEQ ID NO: 1523468 - RNA, 16 nt, Homo sapiens
aacauuugcaccacuu

SEQ ID NO: 1523469 - RNA, 15 nt, Homo sapiens
aaccauaaacauuug

SEQ ID NO: 1523470 - RNA, 15 nt, Homo sapiens
aacccaaacuuccaa

SEQ ID NO: 1523471 - RNA, 12 nt, Homo sapiens
aacccaccugcu

SEQ ID NO: 1523472 - RNA, 11 nt, Homo sapiens
aaccucagggc

SEQ ID NO: 1523473 - RNA, 17 nt, Homo sapiens
aaccucucuaagccaca

SEQ ID NO: 1523474 - RNA, 18 nt, Homo sapiens
aaccucucuucuaccuua

SEQ ID NO: 1523475 - RNA, 23 nt, Homo sapiens
aaccuguaaagcaggugcccagg

SEQ ID NO: 1523476 - RNA, 21 nt, Homo sapiens
aaccuuaaccucucuaagcca

SEQ ID NO: 1523477 - RNA, 15 nt, Homo sapiens
aaccuuaccaaaaaa

SEQ ID NO: 1523478 - RNA, 16 nt, Homo sapiens
aacugaaaaaugucag

SEQ ID NO: 1523479 - RNA, 22 nt, Homo sapiens
aacugaaagcugaauccuucca

SEQ ID NO: 1523480 - RNA, 23 nt, Homo sapiens
aacugaaagcugaauccuuccau

SEQ ID NO: 1523481 - RNA, 14 nt, Homo sapiens
aacuguguugcuga

SEQ ID NO: 1523482 - RNA, 23 nt, Homo sapiens
aagaagggauaauagacacauca

SEQ ID NO: 1523483 - RNA, 17 nt, Homo sapiens
aagaauaaaauugcacu

SEQ ID NO: 1523484 - RNA, 14 nt, Homo sapiens
aagaaucaccucaa

SEQ ID NO: 1523485 - RNA, 20 nt, Homo sapiens
aagaauuccugaagccagau

SEQ ID NO: 1523486 - RNA, 23 nt, Homo sapiens
aagaauuggucuuaauguugaau

SEQ ID NO: 1523487 - RNA, 21 nt, Homo sapiens
aagcagaaaaauuaaauugua

SEQ ID NO: 1523488 - RNA, 14 nt, Homo sapiens
aagcuaagccuuau

SEQ ID NO: 1523489 - RNA, 21 nt, Homo sapiens
aagcugaauccuuccauuucu

SEQ ID NO: 1523490 - RNA, 22 nt, Homo sapiens
aagcuguguccuugcaccugca

SEQ ID NO: 1523491 - RNA, 14 nt, Homo sapiens
aaggcaaugcucaa

SEQ ID NO: 1523492 - RNA, 18 nt, Homo sapiens
aaggcuuauuaaagugga

SEQ ID NO: 1523493 - RNA, 18 nt, Homo sapiens
aagggcucacgcauucag

SEQ ID NO: 1523494 - RNA, 17 nt, Homo sapiens
aaggugagcaaagggcu

SEQ ID NO: 1523495 - RNA, 21 nt, Homo sapiens
aaggugagcugggggcgagaa

SEQ ID NO: 1523496 - RNA, 23 nt, Homo sapiens
aagucuaaauaaaugaaguauuu

SEQ ID NO: 1523497 - RNA, 17 nt, Homo sapiens
aaguuuaaaacccaaac

SEQ ID NO: 1523498 - RNA, 12 nt, Homo sapiens
aauaaaaaccau

SEQ ID NO: 1523499 - RNA, 23 nt, Homo sapiens
aauaaaaauuaucuauaaucuca

SEQ ID NO: 1523500 - RNA, 12 nt, Homo sapiens
aauaacacugga

SEQ ID NO: 1523501 - RNA, 15 nt, Homo sapiens
aauagacacaucaaa

SEQ ID NO: 1523502 - RNA, 12 nt, Homo sapiens
aauagcugcuag

SEQ ID NO: 1523503 - RNA, 22 nt, Homo sapiens
aauagcugcuaggguaggaaag

SEQ ID NO: 1523504 - RNA, 19 nt, Homo sapiens
aauagguucaaaagcaauc

SEQ ID NO: 1523505 - RNA, 22 nt, Homo sapiens
aauaguauuucagauacuugaa

SEQ ID NO: 1523506 - RNA, 12 nt, Homo sapiens
aauaucuuccac

SEQ ID NO: 1523507 - RNA, 14 nt, Homo sapiens
aauaucuuccacag

SEQ ID NO: 1523508 - RNA, 23 nt, Homo sapiens
aauauuuuuuuccuuugcauuca

SEQ ID NO: 1523509 - RNA, 12 nt, Homo sapiens
aaucacaguaua

SEQ ID NO: 1523510 - RNA, 16 nt, Homo sapiens
aaucacuggugcuaua

SEQ ID NO: 1523511 - RNA, 21 nt, Homo sapiens
aaucauucuuuccccucagag

SEQ ID NO: 1523512 - RNA, 16 nt, Homo sapiens
aaugaucauaagucua

SEQ ID NO: 1523513 - RNA, 23 nt, Homo sapiens
aaugauuucccacucagggcugg

SEQ ID NO: 1523514 - RNA, 17 nt, Homo sapiens
aaugccuugacaacaga

SEQ ID NO: 1523515 - RNA, 18 nt, Homo sapiens
aaugucacaguaaugcaa

SEQ ID NO: 1523516 - RNA, 19 nt, Homo sapiens
aauguguauuuuauaugau

SEQ ID NO: 1523517 - RNA, 14 nt, Homo sapiens
aauguucacaacau

SEQ ID NO: 1523518 - RNA, 20 nt, Homo sapiens
aauguuccuuuuuguucaaa

SEQ ID NO: 1523519 - RNA, 17 nt, Homo sapiens
aauuaacugcuccaaau

SEQ ID NO: 1523520 - RNA, 15 nt, Homo sapiens
aauuaauuugugaau

SEQ ID NO: 1523521 - RNA, 20 nt, Homo sapiens
aauucuagcuuugagcuuaa

SEQ ID NO: 1523522 - RNA, 13 nt, Homo sapiens
aauuguuaggaag

SEQ ID NO: 1523523 - RNA, 13 nt, Homo sapiens
aauuuaaccauaa

SEQ ID NO: 1523524 - RNA, 17 nt, Homo sapiens
aauuuagucacaccauc

SEQ ID NO: 1523525 - RNA, 23 nt, Homo sapiens
aauuucccuucuugcauccuucc

SEQ ID NO: 1523526 - RNA, 14 nt, Homo sapiens
aauuuuaaauguuc

SEQ ID NO: 1523527 - RNA, 22 nt, Homo sapiens
aucuggucugaauaacacugga

SEQ ID NO: 1523528 - RNA, 14 nt, Homo sapiens
aucuuauucccaau

SEQ ID NO: 1523529 - RNA, 16 nt, Homo sapiens
augaaauaucaugcuc

SEQ ID NO: 1523530 - RNA, 17 nt, Homo sapiens
augaaauaucaugcucc

SEQ ID NO: 1523531 - RNA, 15 nt, Homo sapiens
augaaugacaugacc

SEQ ID NO: 1523532 - RNA, 13 nt, Homo sapiens
augaucucccugc

SEQ ID NO: 1523533 - RNA, 11 nt, Homo sapiens
augauuuccca

SEQ ID NO: 1523534 - RNA, 12 nt, Homo sapiens
augcaacauuug

SEQ ID NO: 1523535 - RNA, 18 nt, Homo sapiens
augcagauuauuugccca

SEQ ID NO: 1523536 - RNA, 16 nt, Homo sapiens
augcagcaucuaagua

SEQ ID NO: 1523537 - RNA, 20 nt, Homo sapiens
augccccgaauuuagucaca

SEQ ID NO: 1523538 - RNA, 19 nt, Homo sapiens
augccucauuaccuugugc

SEQ ID NO: 1523539 - RNA, 15 nt, Homo sapiens
augcguuuaaucaca

SEQ ID NO: 1523540 - RNA, 20 nt, Homo sapiens
auggagucucccacugcaac

SEQ ID NO: 1523541 - RNA, 22 nt, Homo sapiens
auggcucccgaguacaguagua

SEQ ID NO: 1523542 - RNA, 13 nt, Homo sapiens
auguaaauacugu

SEQ ID NO: 1523543 - RNA, 15 nt, Homo sapiens
auguauugucugccc

SEQ ID NO: 1523544 - RNA, 13 nt, Homo sapiens
augucaccaccuu

SEQ ID NO: 1523545 - RNA, 19 nt, Homo sapiens
augucagagcuauguuccc

SEQ ID NO: 1523546 - RNA, 21 nt, Homo sapiens
augucguuugaaucacaguau

SEQ ID NO: 1523547 - RNA, 21 nt, Homo sapiens
augucucucagaauucuucag

SEQ ID NO: 1523548 - RNA, 18 nt, Homo sapiens
augugucaccggggcaac

SEQ ID NO: 1523549 - RNA, 23 nt, Homo sapiens
augugucaccggggcaacugccu

SEQ ID NO: 1523550 - RNA, 12 nt, Homo sapiens
augugugauuca

SEQ ID NO: 1523551 - RNA, 16 nt, Homo sapiens
auguugcccagugugu

SEQ ID NO: 1523552 - RNA, 20 nt, Homo sapiens
auuaaaaucacugucaauau

SEQ ID NO: 1523553 - RNA, 22 nt, Homo sapiens
auuaccuugugcuaauccucuu

SEQ ID NO: 1523554 - RNA, 19 nt, Homo sapiens
auuagccuaugugcaugca

SEQ ID NO: 1523555 - RNA, 16 nt, Homo sapiens
auuauagaauugcaca

SEQ ID NO: 1523556 - RNA, 14 nt, Homo sapiens
auuauauuucuaca

SEQ ID NO: 1523557 - RNA, 13 nt, Homo sapiens
auuaugaagucau

SEQ ID NO: 1523558 - RNA, 22 nt, Homo sapiens
auuaugugaaaugcuuaugcuu

SEQ ID NO: 1523559 - RNA, 18 nt, Homo sapiens
auucaaccuuaccaaaaa

SEQ ID NO: 1523560 - RNA, 19 nt, Homo sapiens
auucaaccuuaccaaaaaa

SEQ ID NO: 1523561 - RNA, 14 nt, Homo sapiens
auucaucucucaaa

SEQ ID NO: 1523562 - RNA, 18 nt, Homo sapiens
auuccacuuuuauucauu

SEQ ID NO: 1523563 - RNA, 16 nt, Homo sapiens
auuccuauauguagcu

SEQ ID NO: 1523564 - RNA, 19 nt, Homo sapiens
auucugauguuacugagau

SEQ ID NO: 1523565 - RNA, 16 nt, Homo sapiens
auucuuuagcuguacu

SEQ ID NO: 1523566 - RNA, 20 nt, Homo sapiens
auugaaaaauaaaaaccaua

SEQ ID NO: 1523567 - RNA, 17 nt, Homo sapiens
auugaaacccuccaaau

SEQ ID NO: 1523568 - RNA, 16 nt, Homo sapiens
auugucagaguucugc

SEQ ID NO: 1523569 - RNA, 21 nt, Homo sapiens
auugucugcccagcaaucaaa

SEQ ID NO: 1523570 - RNA, 13 nt, Homo sapiens
auuuagcauucau

SEQ ID NO: 1523571 - RNA, 14 nt, Homo sapiens
auuuccuugugcuc

SEQ ID NO: 1523572 - RNA, 13 nt, Homo sapiens
auuucuucacuca

SEQ ID NO: 1523573 - RNA, 19 nt, Homo sapiens
auuucuucacucaaucucu

SEQ ID NO: 1523574 - RNA, 20 nt, Homo sapiens
auuugaauuuuuuuuucaac

SEQ ID NO: 1523575 - RNA, 13 nt, Homo sapiens
auuugcaccacuu

SEQ ID NO: 1523576 - RNA, 15 nt, Homo sapiens
auuugugaauuugca

SEQ ID NO: 1523577 - RNA, 16 nt, Homo sapiens
auuuguucuuugccag

SEQ ID NO: 1523578 - RNA, 21 nt, Homo sapiens
auuuuagauguuauuaugcua

SEQ ID NO: 1523579 - RNA, 12 nt, Homo sapiens
auuuucuguucc

SEQ ID NO: 1523580 - RNA, 15 nt, Homo sapiens
auuuucuguuccagg

SEQ ID NO: 1523581 - RNA, 14 nt, Homo sapiens
auuuuucuaaagaa

SEQ ID NO: 1523582 - RNA, 13 nt, Homo sapiens
caaaaagauguau

SEQ ID NO: 1523583 - RNA, 12 nt, Homo sapiens
caaaaauguaau

SEQ ID NO: 1523584 - RNA, 18 nt, Homo sapiens
caaaaauguaaugaucau

SEQ ID NO: 1523585 - RNA, 14 nt, Homo sapiens
caaacuacauguaa

SEQ ID NO: 1523586 - RNA, 19 nt, Homo sapiens
caaacugaacccccucaaa

SEQ ID NO: 1523587 - RNA, 20 nt, Homo sapiens
caaacugaacccccucaaaa

SEQ ID NO: 1523588 - RNA, 21 nt, Homo sapiens
caaacuuaguuuuuaucuuug

SEQ ID NO: 1523589 - RNA, 17 nt, Homo sapiens
caaaggcaaugcucaaa

SEQ ID NO: 1523590 - RNA, 12 nt, Homo sapiens
caaaggugcuac

SEQ ID NO: 1523591 - RNA, 13 nt, Homo sapiens
caaauaaacucca

SEQ ID NO: 1523592 - RNA, 13 nt, Homo sapiens
caacaauacaugc

SEQ ID NO: 1523593 - RNA, 17 nt, Homo sapiens
caacaauacaugcugcu

SEQ ID NO: 1523594 - RNA, 16 nt, Homo sapiens
caacacucuuacaccu

SEQ ID NO: 1523595 - RNA, 17 nt, Homo sapiens
caacaugugcucaggga

SEQ ID NO: 1523596 - RNA, 18 nt, Homo sapiens
caacaugugcucagggaa

SEQ ID NO: 1523597 - RNA, 17 nt, Homo sapiens
caaccuaaccccuuucc

SEQ ID NO: 1523598 - RNA, 14 nt, Homo sapiens
caaccuuaccaaaa

SEQ ID NO: 1523599 - RNA, 12 nt, Homo sapiens
caacuccuggaa

SEQ ID NO: 1523600 - RNA, 14 nt, Homo sapiens
caacuucccaaagc

SEQ ID NO: 1523601 - RNA, 20 nt, Homo sapiens
caacuugggaacuagacucc

SEQ ID NO: 1523602 - RNA, 16 nt, Homo sapiens
caagaaucaccucaaa

SEQ ID NO: 1523603 - RNA, 16 nt, Homo sapiens
caagcuggacuauggc

SEQ ID NO: 1523604 - RNA, 21 nt, Homo sapiens
caagggccagcuggaggugaa

SEQ ID NO: 1523605 - RNA, 13 nt, Homo sapiens
caauacaguuuca

SEQ ID NO: 1523606 - RNA, 14 nt, Homo sapiens
caaucacaguguua

SEQ ID NO: 1523607 - RNA, 14 nt, Homo sapiens
caaugcucaaacac

SEQ ID NO: 1523608 - RNA, 20 nt, Homo sapiens
caauucacauucaucaucag

SEQ ID NO: 1523609 - RNA, 16 nt, Homo sapiens
cacaacgggccagcuc

SEQ ID NO: 1523610 - RNA, 21 nt, Homo sapiens
cacagagauaauucuagcuuu

SEQ ID NO: 1523611 - RNA, 18 nt, Homo sapiens
cacagagggaaguuuaaa

SEQ ID NO: 1523612 - RNA, 21 nt, Homo sapiens
cacauaggaaacuuuugauaa

SEQ ID NO: 1523613 - RNA, 17 nt, Homo sapiens
cacauucgaguguuuca

SEQ ID NO: 1523614 - RNA, 17 nt, Homo sapiens
cacauuguuaggugcug

SEQ ID NO: 1523615 - RNA, 16 nt, Homo sapiens
caccaccuucccagcu

SEQ ID NO: 1523616 - RNA, 15 nt, Homo sapiens
caccaggucagggag

SEQ ID NO: 1523617 - RNA, 14 nt, Homo sapiens
cacccaaaagucaa

SEQ ID NO: 1523618 - RNA, 14 nt, Homo sapiens
cacccaaugcauau

SEQ ID NO: 1523619 - RNA, 17 nt, Homo sapiens
caccccuccucgaaguc

SEQ ID NO: 1523620 - RNA, 17 nt, Homo sapiens
cacggauccauguagca

SEQ ID NO: 1523621 - RNA, 18 nt, Homo sapiens
cacucccgaggauguguc

SEQ ID NO: 1523622 - RNA, 14 nt, Homo sapiens
cagaaaaugagggc

SEQ ID NO: 1523623 - RNA, 15 nt, Homo sapiens
cagaagugauuuagu

SEQ ID NO: 1523624 - RNA, 11 nt, Homo sapiens
cagaaugucac

SEQ ID NO: 1523625 - RNA, 14 nt, Homo sapiens
cagaauuacauaaa

SEQ ID NO: 1523626 - RNA, 23 nt, Homo sapiens
cagacuaugucacccaaugcaua

SEQ ID NO: 1523627 - RNA, 15 nt, Homo sapiens
cagaggcuucuucag

SEQ ID NO: 1523628 - RNA, 22 nt, Homo sapiens
cagauacagggugcuccuuguc

SEQ ID NO: 1523629 - RNA, 14 nt, Homo sapiens
cagauggaccaaaa

SEQ ID NO: 1523630 - RNA, 14 nt, Homo sapiens
cagauucagcauuu

SEQ ID NO: 1523631 - RNA, 24 nt, Homo sapiens
cagcaaucaaaggcaaugcucaaa

SEQ ID NO: 1523632 - RNA, 18 nt, Homo sapiens
ugcauaagugcaugacau

SEQ ID NO: 1523633 - RNA, 16 nt, Homo sapiens
ugcaugcagcaucuaa

SEQ ID NO: 1523634 - RNA, 21 nt, Homo sapiens
ugcauggcucccgaguacagu

SEQ ID NO: 1523635 - RNA, 12 nt, Homo sapiens
ugcauuaucuau

SEQ ID NO: 1523636 - RNA, 14 nt, Homo sapiens
ugcauuaucuauga

SEQ ID NO: 1523637 - RNA, 18 nt, Homo sapiens
ugcauucaaccuuaccaa

SEQ ID NO: 1523638 - RNA, 21 nt, Homo sapiens
ugccagucuguuaaguaaaau

SEQ ID NO: 1523639 - RNA, 18 nt, Homo sapiens
ugccauguuuagauucca

SEQ ID NO: 1523640 - RNA, 11 nt, Homo sapiens
ugccccggcug

SEQ ID NO: 1523641 - RNA, 16 nt, Homo sapiens
ugcuagaagaauuuga

SEQ ID NO: 1523642 - RNA, 13 nt, Homo sapiens
ugcuccugccagc

SEQ ID NO: 1523643 - RNA, 18 nt, Homo sapiens
ugcuggcagccucaggag

SEQ ID NO: 1523644 - RNA, 19 nt, Homo sapiens
ugcuuaaauugugggcaaa

SEQ ID NO: 1523645 - RNA, 16 nt, Homo sapiens
ugcuuuggaaaucaca

SEQ ID NO: 1523646 - RNA, 14 nt, Homo sapiens
uggaaaauaaauca

SEQ ID NO: 1523647 - RNA, 23 nt, Homo sapiens
uggaaggcagaccugaaucacaa

SEQ ID NO: 1523648 - RNA, 21 nt, Homo sapiens
uggacuauggcucuacuuuca

SEQ ID NO: 1523649 - RNA, 18 nt, Homo sapiens
uggaguccgaugauucuc

SEQ ID NO: 1523650 - RNA, 14 nt, Homo sapiens
uggauaacgaugaa

SEQ ID NO: 1523651 - RNA, 21 nt, Homo sapiens
uggaugggguugugaccaaga

SEQ ID NO: 1523652 - RNA, 16 nt, Homo sapiens
uggauguggggucccc

SEQ ID NO: 1523653 - RNA, 16 nt, Homo sapiens
uggcacccaugcaccu

SEQ ID NO: 1523654 - RNA, 14 nt, Homo sapiens
uggccccaugucuc

SEQ ID NO: 1523655 - RNA, 15 nt, Homo sapiens
uggcucuacuuucag

SEQ ID NO: 1523656 - RNA, 16 nt, Homo sapiens
uggcugagcccauuuu

SEQ ID NO: 1523657 - RNA, 17 nt, Homo sapiens
uggcuuuaagccauuau

SEQ ID NO: 1523658 - RNA, 18 nt, Homo sapiens
ugggaacuagacucccaa

SEQ ID NO: 1523659 - RNA, 13 nt, Homo sapiens
ugggaacuccuaa

SEQ ID NO: 1523660 - RNA, 15 nt, Homo sapiens
ugggaacugcaauaa

SEQ ID NO: 1523661 - RNA, 14 nt, Homo sapiens
ugggagugagggau

SEQ ID NO: 1523662 - RNA, 21 nt, Homo sapiens
ugggauguccaccacaguaaa

SEQ ID NO: 1523663 - RNA, 13 nt, Homo sapiens
ugggcuucuagaa

SEQ ID NO: 1523664 - RNA, 13 nt, Homo sapiens
uggggucagggaa

SEQ ID NO: 1523665 - RNA, 20 nt, Homo sapiens
uggguggggcugcuccucca

SEQ ID NO: 1523666 - RNA, 15 nt, Homo sapiens
ugguauuaauacugc

SEQ ID NO: 1523667 - RNA, 13 nt, Homo sapiens
ugguuccacagaa

SEQ ID NO: 1523668 - RNA, 21 nt, Homo sapiens
uguaacuguguugcugaaaga

SEQ ID NO: 1523669 - RNA, 15 nt, Homo sapiens
ugucacccaaugcau

SEQ ID NO: 1523670 - RNA, 17 nt, Homo sapiens
ugugaacuccaucauuc

SEQ ID NO: 1523671 - RNA, 12 nt, Homo sapiens
ugugcucaggga

SEQ ID NO: 1523672 - RNA, 13 nt, Homo sapiens
ugugcucagggaa

SEQ ID NO: 1523673 - RNA, 18 nt, Homo sapiens
ugugugaucugugggcac

SEQ ID NO: 1523674 - RNA, 13 nt, Homo sapiens
uguucagaugcuu

SEQ ID NO: 1523675 - RNA, 22 nt, Homo sapiens
uguucauaauacaaaggugcua

SEQ ID NO: 1523676 - RNA, 23 nt, Homo sapiens
uguucccuauuuugccaguggga

SEQ ID NO: 1523677 - RNA, 13 nt, Homo sapiens
uguugaacaauag

SEQ ID NO: 1523678 - RNA, 17 nt, Homo sapiens
uguugugaaacuguaaa

SEQ ID NO: 1523679 - RNA, 14 nt, Homo sapiens
uguuucugaucuga

SEQ ID NO: 1523680 - RNA, 18 nt, Homo sapiens
uguuucugaucugaugca

SEQ ID NO: 1523681 - RNA, 22 nt, Homo sapiens
uuaaaaaagaaagaaauuugaa

SEQ ID NO: 1523682 - RNA, 16 nt, Homo sapiens
uuaaaaucacugucaa

SEQ ID NO: 1523683 - RNA, 18 nt, Homo sapiens
uuaaaccucucuucuacc

SEQ ID NO: 1523684 - RNA, 15 nt, Homo sapiens
uuaaaugacagugaa

SEQ ID NO: 1523685 - RNA, 18 nt, Homo sapiens
uuaauuugugaauuugca

SEQ ID NO: 1523686 - RNA, 15 nt, Homo sapiens
uuacaaauaguucug

SEQ ID NO: 1523687 - RNA, 11 nt, Homo sapiens
uuaccaaaaaa

SEQ ID NO: 1523688 - RNA, 16 nt, Homo sapiens
uuacuaucaugucaaa

SEQ ID NO: 1523689 - RNA, 17 nt, Homo sapiens
uuagagucaauuugcug

SEQ ID NO: 1523690 - RNA, 16 nt, Homo sapiens
uuagcuguacuguaau

SEQ ID NO: 1523691 - RNA, 17 nt, Homo sapiens
uuauaaaagaugcauua

SEQ ID NO: 1523692 - RNA, 22 nt, Homo sapiens
caaauuacuccaagguuuauaa

SEQ ID NO: 1523693 - RNA, 12 nt, Homo sapiens
caacagacugaa

SEQ ID NO: 1523694 - RNA, 19 nt, Homo sapiens
caaccgaacaugaccaaaa

SEQ ID NO: 1523695 - RNA, 23 nt, Homo sapiens
caaccuuuguaagaaaaccaaaa

SEQ ID NO: 1523696 - RNA, 17 nt, Homo sapiens
caacuugggaacuagac

SEQ ID NO: 1523697 - RNA, 13 nt, Homo sapiens
caagaggaaaaac

SEQ ID NO: 1523698 - RNA, 20 nt, Homo sapiens
caagcugagugacuguaggc

SEQ ID NO: 1523699 - RNA, 16 nt, Homo sapiens
caaggguuuguugaac

SEQ ID NO: 1523700 - RNA, 20 nt, Homo sapiens
caaguuggcuucuaaucaaa

SEQ ID NO: 1523701 - RNA, 22 nt, Homo sapiens
caaugcuauaacuauguugaua

SEQ ID NO: 1523702 - RNA, 17 nt, Homo sapiens
caaugcugcccuuucug

SEQ ID NO: 1523703 - RNA, 21 nt, Homo sapiens
caaugcuucuaucaaauacua

SEQ ID NO: 1523704 - RNA, 23 nt, Homo sapiens
caauuuuaauugauuauucugau

SEQ ID NO: 1523705 - RNA, 14 nt, Homo sapiens
cacagaagcuuugu

SEQ ID NO: 1523706 - RNA, 23 nt, Homo sapiens
cacagugugaaucuuggugucua

SEQ ID NO: 1523707 - RNA, 18 nt, Homo sapiens
cacaucuacuugcuuaaa

SEQ ID NO: 1523708 - RNA, 16 nt, Homo sapiens
caccaaugcaacauuu

SEQ ID NO: 1523709 - RNA, 18 nt, Homo sapiens
caccauguuugagcucag

SEQ ID NO: 1523710 - RNA, 18 nt, Homo sapiens
caccucugccucaaugug

SEQ ID NO: 1523711 - RNA, 21 nt, Homo sapiens
caccugggaaaauaccagaaa

SEQ ID NO: 1523712 - RNA, 21 nt, Homo sapiens
cacucccgaggauguguccua

SEQ ID NO: 1523713 - RNA, 15 nt, Homo sapiens
cacugcaacuuguga

SEQ ID NO: 1523714 - RNA, 14 nt, Homo sapiens
cacugggcuucuag

SEQ ID NO: 1523715 - RNA, 18 nt, Homo sapiens
agugccaauauuucugau

SEQ ID NO: 1523716 - RNA, 17 nt, Homo sapiens
aguguugugaaacugua

SEQ ID NO: 1523717 - RNA, 11 nt, Homo sapiens
auaaaaaccau

SEQ ID NO: 1523718 - RNA, 13 nt, Homo sapiens
auaaacauuugca

SEQ ID NO: 1523719 - RNA, 16 nt, Homo sapiens
auaaacauuugcacca

SEQ ID NO: 1523720 - RNA, 13 nt, Homo sapiens
auaaauaaauaac

SEQ ID NO: 1523721 - RNA, 20 nt, Homo sapiens
auaaaugaaguauuucucac

SEQ ID NO: 1523722 - RNA, 17 nt, Homo sapiens
auaguggggucagggcu

SEQ ID NO: 1523723 - RNA, 17 nt, Homo sapiens
auauccaacaugugcuc

SEQ ID NO: 1523724 - RNA, 18 nt, Homo sapiens
auaugcuaauauauguau

SEQ ID NO: 1523725 - RNA, 19 nt, Homo sapiens
auauguuucacccuguccc

SEQ ID NO: 1523726 - RNA, 14 nt, Homo sapiens
aucaaauacuagua

SEQ ID NO: 1523727 - RNA, 23 nt, Homo sapiens
aucacacgucuggcuucacagau

SEQ ID NO: 1523728 - RNA, 17 nt, Homo sapiens
aucacuagccaugauaa

SEQ ID NO: 1523729 - RNA, 14 nt, Homo sapiens
aucacugucaauau

SEQ ID NO: 1523730 - RNA, 14 nt, Homo sapiens
aucagagcauugug

SEQ ID NO: 1523731 - RNA, 23 nt, Homo sapiens
aucauuuccugggagaaagacca

SEQ ID NO: 1523732 - RNA, 22 nt, Homo sapiens
aucauuugugaagaauuauuca

SEQ ID NO: 1523733 - RNA, 15 nt, Homo sapiens
aucgaugacgggcug

SEQ ID NO: 1523734 - RNA, 21 nt, Homo sapiens
aucuacuugcuuaaauugugg

SEQ ID NO: 1523735 - RNA, 13 nt, Homo sapiens
aucuaugucauau

SEQ ID NO: 1523736 - RNA, 21 nt, Homo sapiens
aucuccacggucagauuugcu

SEQ ID NO: 1523737 - RNA, 22 nt, Homo sapiens
aucucugauucugucaaugucu

SEQ ID NO: 1523738 - RNA, 15 nt, Homo sapiens
aucugccacguguau

SEQ ID NO: 1523739 - RNA, 19 nt, Homo sapiens
aucuuaaaugacagugaau

SEQ ID NO: 1523740 - RNA, 12 nt, Homo sapiens
aucuucuuccau

SEQ ID NO: 1523741 - RNA, 14 nt, Homo sapiens
augaaugacaugac

SEQ ID NO: 1523742 - RNA, 17 nt, Homo sapiens
augaaugggagugaggg

SEQ ID NO: 1523743 - RNA, 18 nt, Homo sapiens
augacagcugucccuguc

SEQ ID NO: 1523744 - RNA, 21 nt, Homo sapiens
augcaagcaagaaacacuggg

SEQ ID NO: 1523745 - RNA, 13 nt, Homo sapiens
augcagcaucuaa

SEQ ID NO: 1523746 - RNA, 15 nt, Homo sapiens
augcauaaaauguua

SEQ ID NO: 1523747 - RNA, 23 nt, Homo sapiens
augcauauccaacaugugcucag

SEQ ID NO: 1523748 - RNA, 22 nt, Homo sapiens
augccucauuaccuugugcuaa

SEQ ID NO: 1523749 - RNA, 12 nt, Homo sapiens
augcuagugaua

SEQ ID NO: 1523750 - RNA, 18 nt, Homo sapiens
augcuauaacuauguuga

SEQ ID NO: 1523751 - RNA, 15 nt, Homo sapiens
augcugcuaauucaa

SEQ ID NO: 1523752 - RNA, 15 nt, Homo sapiens
augcuguugccucau

SEQ ID NO: 1523753 - RNA, 21 nt, Homo sapiens
auggaaaaugucaaccuuugu

SEQ ID NO: 1523754 - RNA, 16 nt, Homo sapiens
auggcacccaugcacc

SEQ ID NO: 1523755 - RNA, 17 nt, Homo sapiens
auggcacccaugcaccu

SEQ ID NO: 1523756 - RNA, 13 nt, Homo sapiens
augggacaucaaa

SEQ ID NO: 1523757 - RNA, 14 nt, Homo sapiens
auggugaugaaaug

SEQ ID NO: 1523758 - RNA, 19 nt, Homo sapiens
augguuccacagaagcuuu

SEQ ID NO: 1523759 - RNA, 21 nt, Homo sapiens
augguuccacagaagcuuugu

SEQ ID NO: 1523760 - RNA, 20 nt, Homo sapiens
auguaaugaucauaagucua

SEQ ID NO: 1523761 - RNA, 18 nt, Homo sapiens
augucauauuuugccacu

SEQ ID NO: 1523762 - RNA, 14 nt, Homo sapiens
augugcucagggaa

SEQ ID NO: 1523763 - RNA, 15 nt, Homo sapiens
auguuuagauuccag

SEQ ID NO: 1523764 - RNA, 22 nt, Homo sapiens
auuaaaauuggaugcuagagaa

SEQ ID NO: 1523765 - RNA, 14 nt, Homo sapiens
auuaugugcaacau

SEQ ID NO: 1523766 - RNA, 11 nt, Homo sapiens
auuauuugccc

SEQ ID NO: 1523767 - RNA, 13 nt, Homo sapiens
auucaaagcucua

SEQ ID NO: 1523768 - RNA, 18 nt, Homo sapiens
auucuuaauagguucaaa

SEQ ID NO: 1523769 - RNA, 24 nt, Homo sapiens
auucuuuccccucagagcucuuau

SEQ ID NO: 1523770 - RNA, 19 nt, Homo sapiens
auugaaaaauaaaaaccau

SEQ ID NO: 1523771 - RNA, 14 nt, Homo sapiens
auugauuauucuga

SEQ ID NO: 1523772 - RNA, 17 nt, Homo sapiens
auuguaucaggcaagau

SEQ ID NO: 1523773 - RNA, 18 nt, Homo sapiens
auuuaauuuguaugcuaa

SEQ ID NO: 1523774 - RNA, 14 nt, Homo sapiens
auuuagagucaauu

SEQ ID NO: 1523775 - RNA, 14 nt, Homo sapiens
auuucuucacucaa

SEQ ID NO: 1523776 - RNA, 19 nt, Homo sapiens
auuugcccaaaucuucuuc

SEQ ID NO: 1523777 - RNA, 21 nt, Homo sapiens
auuugcuguucacccacaucu

SEQ ID NO: 1523778 - RNA, 18 nt, Homo sapiens
auuuggaaaauaaaucaa

SEQ ID NO: 1523779 - RNA, 20 nt, Homo sapiens
auuuuaauugauuauucuga

SEQ ID NO: 1523780 - RNA, 15 nt, Homo sapiens
auuuucaucuucuuc

SEQ ID NO: 1523781 - RNA, 18 nt, Homo sapiens
auuuucaucuucuuccau

SEQ ID NO: 1523782 - RNA, 14 nt, Homo sapiens
auuuucuguuccag

SEQ ID NO: 1523783 - RNA, 13 nt, Homo sapiens
auuuuugaauaca

SEQ ID NO: 1523784 - RNA, 19 nt, Homo sapiens
auuuuugaauacaggcaua

SEQ ID NO: 1523785 - RNA, 12 nt, Homo sapiens
caaaacacuuuc

SEQ ID NO: 1523786 - RNA, 13 nt, Homo sapiens
caaaagcaugaaa

SEQ ID NO: 1523787 - RNA, 15 nt, Homo sapiens
caaaagugcauucaa

SEQ ID NO: 1523788 - RNA, 18 nt, Homo sapiens
caaacaugaauccuguga

SEQ ID NO: 1523789 - RNA, 15 nt, Homo sapiens
caaacuacauguaau

SEQ ID NO: 1523790 - RNA, 19 nt, Homo sapiens
caaaucuucuucagauuca

SEQ ID NO: 1523791 - RNA, 19 nt, Homo sapiens
caacaaacuucaaggguuu

SEQ ID NO: 1523792 - RNA, 18 nt, Homo sapiens
caacagcucagagaugaa

SEQ ID NO: 1523793 - RNA, 14 nt, Homo sapiens
caacaucccauugc

SEQ ID NO: 1523794 - RNA, 20 nt, Homo sapiens
caaccgaacaugaccaaaaa

SEQ ID NO: 1523795 - RNA, 15 nt, Homo sapiens
caaccuuaccaaaaa

SEQ ID NO: 1523796 - RNA, 16 nt, Homo sapiens
caacuucccaaagcac

SEQ ID NO: 1523797 - RNA, 21 nt, Homo sapiens
caagaaagauccacccucaaa

SEQ ID NO: 1523798 - RNA, 16 nt, Homo sapiens
caauacaugcugcuaa

SEQ ID NO: 1523799 - RNA, 18 nt, Homo sapiens
caauacaugcugcuaauu

SEQ ID NO: 1523800 - RNA, 18 nt, Homo sapiens
caaucucugauucuguca

SEQ ID NO: 1523801 - RNA, 23 nt, Homo sapiens
caaugcuauaacuauguugauaa

SEQ ID NO: 1523802 - RNA, 21 nt, Homo sapiens
caauucugauguuacugagau

SEQ ID NO: 1523803 - RNA, 21 nt, Homo sapiens
cacacgucuggcuucacagau

SEQ ID NO: 1523804 - RNA, 15 nt, Homo sapiens
cacagaaacuauaug

SEQ ID NO: 1523805 - RNA, 17 nt, Homo sapiens
cacccacgagcacuuua

SEQ ID NO: 1523806 - RNA, 22 nt, Homo sapiens
cacccuaucccuguacagagua

SEQ ID NO: 1523807 - RNA, 21 nt, Homo sapiens
cacccucaaaugucagagcua

SEQ ID NO: 1523808 - RNA, 20 nt, Homo sapiens
caccucugccucaaugugaa

SEQ ID NO: 1523809 - RNA, 16 nt, Homo sapiens
cacgaacccaccugcu

SEQ ID NO: 1523810 - RNA, 13 nt, Homo sapiens
cacgacaaagcag

SEQ ID NO: 1523811 - RNA, 18 nt, Homo sapiens
cacgucuggcuucacaga

SEQ ID NO: 1523812 - RNA, 22 nt, Homo sapiens
cacuccaccacccaaaagucaa

SEQ ID NO: 1523813 - RNA, 13 nt, Homo sapiens
cacuucuguucca

SEQ ID NO: 1523814 - RNA, 14 nt, Homo sapiens
cacuucuguuccag

SEQ ID NO: 1523815 - RNA, 18 nt, Homo sapiens
cagaaaaauuaaauugua

SEQ ID NO: 1523816 - RNA, 16 nt, Homo sapiens
cagaaagcucaucuca

SEQ ID NO: 1523817 - RNA, 18 nt, Homo sapiens
cagaagguuugcaccccu

SEQ ID NO: 1523818 - RNA, 13 nt, Homo sapiens
cagaauucuucag

SEQ ID NO: 1523819 - RNA, 16 nt, Homo sapiens
cagacucagacuccau

SEQ ID NO: 1523820 - RNA, 19 nt, Homo sapiens
cagacucagacuccauuug

SEQ ID NO: 1523821 - RNA, 14 nt, Homo sapiens
cagacugccaaaga

SEQ ID NO: 1523822 - RNA, 17 nt, Homo sapiens
cagacuucacacugcaa

SEQ ID NO: 1523823 - RNA, 21 nt, Homo sapiens
cagagacaacuucccaaagca

SEQ ID NO: 1523824 - RNA, 16 nt, Homo sapiens
cagagacaggaaaauc

SEQ ID NO: 1523825 - RNA, 17 nt, Homo sapiens
cagagaugaaacuaugg

SEQ ID NO: 1523826 - RNA, 19 nt, Homo sapiens
cagagaugccuccaccgcu

SEQ ID NO: 1523827 - RNA, 16 nt, Homo sapiens
cagagcagaacuuuca

SEQ ID NO: 1523828 - RNA, 17 nt, Homo sapiens
cagagcagaacuuucac

SEQ ID NO: 1523829 - RNA, 15 nt, Homo sapiens
cagagcauugugcaa

SEQ ID NO: 1523830 - RNA, 20 nt, Homo sapiens
cagaggagggcgugacucac

SEQ ID NO: 1523831 - RNA, 21 nt, Homo sapiens
cagaucgcuuuacuccaggaa

SEQ ID NO: 1523832 - RNA, 14 nt, Homo sapiens
cagaugaaugggag

SEQ ID NO: 1523833 - RNA, 12 nt, Homo sapiens
cagauggaccaa

SEQ ID NO: 1523834 - RNA, 16 nt, Homo sapiens
cagauggaccaaaaga

SEQ ID NO: 1523835 - RNA, 20 nt, Homo sapiens
cagauguccuugaugcucau

SEQ ID NO: 1523836 - RNA, 13 nt, Homo sapiens
cagaugugugauu

SEQ ID NO: 1523837 - RNA, 17 nt, Homo sapiens
cagauuugcuguucacc

SEQ ID NO: 1523838 - RNA, 21 nt, Homo sapiens
cagauuugcuguucacccaca

SEQ ID NO: 1523839 - RNA, 11 nt, Homo sapiens
ggaaaucacac

SEQ ID NO: 1523840 - RNA, 21 nt, Homo sapiens
ggaaccacaccaaugcaacau

SEQ ID NO: 1523841 - RNA, 17 nt, Homo sapiens
ggaagugugugaucugu

SEQ ID NO: 1523842 - RNA, 16 nt, Homo sapiens
ggaauggagucuccca

SEQ ID NO: 1523843 - RNA, 17 nt, Homo sapiens
ggacaucaaauuugcca

SEQ ID NO: 1523844 - RNA, 22 nt, Homo sapiens
ggagggcgugacucacccaagc

SEQ ID NO: 1523845 - RNA, 20 nt, Homo sapiens
ggauaaugcuguugccucau

SEQ ID NO: 1523846 - RNA, 23 nt, Homo sapiens
ggcaacaauacaugcugcuaauu

SEQ ID NO: 1523847 - RNA, 23 nt, Homo sapiens
ggcaagauaaaccaaugucauaa

SEQ ID NO: 1523848 - RNA, 21 nt, Homo sapiens
ggcauguccuaggcucugggu

SEQ ID NO: 1523849 - RNA, 15 nt, Homo sapiens
ggcauuuucuguucc

SEQ ID NO: 1523850 - RNA, 19 nt, Homo sapiens
ggccacgacaaagcagaaa

SEQ ID NO: 1523851 - RNA, 15 nt, Homo sapiens
gggagaaagaccaug

SEQ ID NO: 1523852 - RNA, 21 nt, Homo sapiens
gggcaacaauacaugcugcua

SEQ ID NO: 1523853 - RNA, 14 nt, Homo sapiens
gggcagcuuugccc

SEQ ID NO: 1523854 - RNA, 13 nt, Homo sapiens
gggguaagucccu

SEQ ID NO: 1523855 - RNA, 22 nt, Homo sapiens
gggguucucagacugccaaaga

SEQ ID NO: 1523856 - RNA, 20 nt, Homo sapiens
ggguucaccaggucagggag

SEQ ID NO: 1523857 - RNA, 16 nt, Homo sapiens
gguaauauucauuuua

SEQ ID NO: 1523858 - RNA, 12 nt, Homo sapiens
gguccugucuaa

SEQ ID NO: 1523859 - RNA, 18 nt, Homo sapiens
ggucugaauaacacugga

SEQ ID NO: 1523860 - RNA, 17 nt, Homo sapiens
gguguaaauauguuuca

SEQ ID NO: 1523861 - RNA, 13 nt, Homo sapiens
gguugcagugagc

SEQ ID NO: 1523862 - RNA, 11 nt, Homo sapiens
guaacuguguu

SEQ ID NO: 1523863 - RNA, 18 nt, Homo sapiens
guaauaguccauggacaa

SEQ ID NO: 1523864 - RNA, 20 nt, Homo sapiens
guacauaauauccaauggaa

SEQ ID NO: 1523865 - RNA, 15 nt, Homo sapiens
guaucguguggugua

SEQ ID NO: 1523866 - RNA, 13 nt, Homo sapiens
guaugaccugggu

SEQ ID NO: 1523867 - RNA, 21 nt, Homo sapiens
guauguuugggagacugcuga

SEQ ID NO: 1523868 - RNA, 17 nt, Homo sapiens
guauuaauuuauguauc

SEQ ID NO: 1523869 - RNA, 12 nt, Homo sapiens
guauuagucaca

SEQ ID NO: 1523870 - RNA, 12 nt, Homo sapiens
guauugguggcu

SEQ ID NO: 1523871 - RNA, 14 nt, Homo sapiens
gucaaaaggugccu

SEQ ID NO: 1523872 - RNA, 13 nt, Homo sapiens
gucagaguucugc

SEQ ID NO: 1523873 - RNA, 15 nt, Homo sapiens
gucagaguucugcuc

SEQ ID NO: 1523874 - RNA, 20 nt, Homo sapiens
guccuuagccccaucugcca

SEQ ID NO: 1523875 - RNA, 14 nt, Homo sapiens
guccuugaugcuca

SEQ ID NO: 1523876 - RNA, 22 nt, Homo sapiens
gucucauuuucaucuucuucca

SEQ ID NO: 1523877 - RNA, 18 nt, Homo sapiens
gucugaauaacacuggau

SEQ ID NO: 1523878 - RNA, 22 nt, Homo sapiens
gucuucauaauuucuucacuca

SEQ ID NO: 1523879 - RNA, 16 nt, Homo sapiens
gugaaauacaguauac

SEQ ID NO: 1523880 - RNA, 14 nt, Homo sapiens
gugaauugacccau

SEQ ID NO: 1523881 - RNA, 23 nt, Homo sapiens
gugaauuuuucuaaaggugcuau

SEQ ID NO: 1523882 - RNA, 14 nt, Homo sapiens
gugcaaaggugagc

SEQ ID NO: 1523883 - RNA, 17 nt, Homo sapiens
gugcaugcagcaucuaa

SEQ ID NO: 1523884 - RNA, 20 nt, Homo sapiens
gugcaugcagcaucuaagua

SEQ ID NO: 1523885 - RNA, 12 nt, Homo sapiens
gugcaugcucuc

SEQ ID NO: 1523886 - RNA, 9 nt, Homo sapiens
gugcauuca

SEQ ID NO: 1523887 - RNA, 10 nt, Homo sapiens
gugcauucaa

SEQ ID NO: 1523888 - RNA, 17 nt, Homo sapiens
gugccaauauuucugau

SEQ ID NO: 1523889 - RNA, 20 nt, Homo sapiens
gugggguccccaucauccca

SEQ ID NO: 1523890 - RNA, 22 nt, Homo sapiens
gugucaccggggcaacugccug

SEQ ID NO: 1523891 - RNA, 15 nt, Homo sapiens
guuauuuuaauuauc

SEQ ID NO: 1523892 - RNA, 14 nt, Homo sapiens
guucaaaagcaauc

SEQ ID NO: 1523893 - RNA, 13 nt, Homo sapiens
guucaccagguca

SEQ ID NO: 1523894 - RNA, 14 nt, Homo sapiens
guucagaugcuucu

SEQ ID NO: 1523895 - RNA, 19 nt, Homo sapiens
guuccaagaaagauccacc

SEQ ID NO: 1523896 - RNA, 18 nt, Homo sapiens
guuccacagaagcuuugu

SEQ ID NO: 1523897 - RNA, 17 nt, Homo sapiens
guuccagguuucuucca

SEQ ID NO: 1523898 - RNA, 14 nt, Homo sapiens
guugcccagugugu

SEQ ID NO: 1523899 - RNA, 12 nt, Homo sapiens
guuggcuucuaa

SEQ ID NO: 1523900 - RNA, 18 nt, Homo sapiens
guuuauaaaagaugcauu

SEQ ID NO: 1523901 - RNA, 15 nt, Homo sapiens
guuucuugggguccc

SEQ ID NO: 1523902 - RNA, 18 nt, Homo sapiens
guuugcagaaaagcaccu

SEQ ID NO: 1523903 - RNA, 20 nt, Homo sapiens
uaaaaaagaaagaaauuuga

SEQ ID NO: 1523904 - RNA, 17 nt, Homo sapiens
uaaaaguaugcagauua

SEQ ID NO: 1523905 - RNA, 20 nt, Homo sapiens
uaaaauaaggauaauaauca

SEQ ID NO: 1523906 - RNA, 15 nt, Homo sapiens
uaaaauugcacuuuu

SEQ ID NO: 1523907 - RNA, 22 nt, Homo sapiens
uaaaccaaugagcuguaucugu

SEQ ID NO: 1523908 - RNA, 16 nt, Homo sapiens
uaaacgagauaaugua

SEQ ID NO: 1523909 - RNA, 16 nt, Homo sapiens
uaaagcaggugcccag

SEQ ID NO: 1523910 - RNA, 15 nt, Homo sapiens
uaaauugauuuguua

SEQ ID NO: 1523911 - RNA, 19 nt, Homo sapiens
uaaguugauggugaugaaa

SEQ ID NO: 1523912 - RNA, 14 nt, Homo sapiens
uaauagacacauca

SEQ ID NO: 1523913 - RNA, 16 nt, Homo sapiens
uaauagacacaucaaa

SEQ ID NO: 1523914 - RNA, 22 nt, Homo sapiens
uaauauauguauaugcaauaua

SEQ ID NO: 1523915 - RNA, 17 nt, Homo sapiens
uaauccaucacuagcca

SEQ ID NO: 1523916 - RNA, 19 nt, Homo sapiens
uaaucugauuauacaccau

SEQ ID NO: 1523917 - RNA, 13 nt, Homo sapiens
uaaugaaugcaua

SEQ ID NO: 1523918 - RNA, 15 nt, Homo sapiens
uaaugcaagcaaagu

SEQ ID NO: 1523919 - RNA, 16 nt, Homo sapiens
uaaugcaagcaaagua

SEQ ID NO: 1523920 - RNA, 17 nt, Homo sapiens
uaaugcuguugccucau

SEQ ID NO: 1523921 - RNA, 16 nt, Homo sapiens
uaauuaaaagacucca

SEQ ID NO: 1523922 - RNA, 16 nt, Homo sapiens
uaauucuagcuuugag

SEQ ID NO: 1523923 - RNA, 21 nt, Homo sapiens
uaauugauuauucugauucca

SEQ ID NO: 1523924 - RNA, 15 nt, Homo sapiens
uaauuuguaugcuaa

SEQ ID NO: 1523925 - RNA, 20 nt, Homo sapiens
uacagagaaaaugaauuugg

SEQ ID NO: 1523926 - RNA, 14 nt, Homo sapiens
uacaguuuaucuau

SEQ ID NO: 1523927 - RNA, 22 nt, Homo sapiens
uacaguuucauuaacuccuucc

SEQ ID NO: 1523928 - RNA, 13 nt, Homo sapiens
uacauguaaucca

SEQ ID NO: 1523929 - RNA, 15 nt, Homo sapiens
uacauguaauccauc

SEQ ID NO: 1523930 - RNA, 21 nt, Homo sapiens
uacauugaaacccuccaaauc

SEQ ID NO: 1523931 - RNA, 14 nt, Homo sapiens
uaccaaaggugcua

SEQ ID NO: 1523932 - RNA, 16 nt, Homo sapiens
uaccaaaggugcuaca

SEQ ID NO: 1523933 - RNA, 19 nt, Homo sapiens
uaccacugauuuggagaua

SEQ ID NO: 1523934 - RNA, 21 nt, Homo sapiens
uaccuauuuuguauguguaua

SEQ ID NO: 1523935 - RNA, 23 nt, Homo sapiens
uaccucgugguguguuugccuug

SEQ ID NO: 1523936 - RNA, 16 nt, Homo sapiens
uaccugcugcugcuau

SEQ ID NO: 1523937 - RNA, 15 nt, Homo sapiens
uacguuaccaggcag

SEQ ID NO: 1523938 - RNA, 14 nt, Homo sapiens
uacugcuguaaaua

SEQ ID NO: 1523939 - RNA, 20 nt, Homo sapiens
uacuggcuuucauagcuuuu

SEQ ID NO: 1523940 - RNA, 13 nt, Homo sapiens
uagaaccaggcaa

SEQ ID NO: 1523941 - RNA, 14 nt, Homo sapiens
uagaauugcacaua

SEQ ID NO: 1523942 - RNA, 17 nt, Homo sapiens
uagagcugagagucuga

SEQ ID NO: 1523943 - RNA, 16 nt, Homo sapiens
uagaguucagacuuuu

SEQ ID NO: 1523944 - RNA, 15 nt, Homo sapiens
uagauaagucaauau

SEQ ID NO: 1523945 - RNA, 18 nt, Homo sapiens
uagcauucauauuuucca

SEQ ID NO: 1523946 - RNA, 17 nt, Homo sapiens
uaggaaaaugcuucugu

SEQ ID NO: 1523947 - RNA, 20 nt, Homo sapiens
uaguaucugcuuaggugcca

SEQ ID NO: 1523948 - RNA, 14 nt, Homo sapiens
uagucacaccaucu

SEQ ID NO: 1523949 - RNA, 22 nt, Homo sapiens
uagucacagagauaauucuagc

SEQ ID NO: 1523950 - RNA, 23 nt, Homo sapiens
uagugccugaauuuguucucuuu

SEQ ID NO: 1523951 - RNA, 16 nt, Homo sapiens
uaguggggucagggcu

SEQ ID NO: 1523952 - RNA, 18 nt, Homo sapiens
uauaacuauguugauaaa

SEQ ID NO: 1523953 - RNA, 22 nt, Homo sapiens
uauaccauaugucugcuucugu

SEQ ID NO: 1523954 - RNA, 16 nt, Homo sapiens
uauauaacaacaaacu

SEQ ID NO: 1523955 - RNA, 19 nt, Homo sapiens
uauauaguuaguaucuuua

SEQ ID NO: 1523956 - RNA, 14 nt, Homo sapiens
uauaugcaaagaaa

SEQ ID NO: 1523957 - RNA, 12 nt, Homo sapiens
uaucaauucaca

SEQ ID NO: 1523958 - RNA, 22 nt, Homo sapiens
uauccacccagcccauucucuc

SEQ ID NO: 1523959 - RNA, 21 nt, Homo sapiens
uaucuauggcacccaugcacc

SEQ ID NO: 1523960 - RNA, 18 nt, Homo sapiens
uaugcagauuauuugccc

SEQ ID NO: 1523961 - RNA, 20 nt, Homo sapiens
uaugcagauuauuugcccaa

SEQ ID NO: 1523962 - RNA, 19 nt, Homo sapiens
uaugcuuugaaugcaaaag

SEQ ID NO: 1523963 - RNA, 18 nt, Homo sapiens
uauggcacccaugcaccu

SEQ ID NO: 1523964 - RNA, 21 nt, Homo sapiens
cagcaucgugaucacugagcc

SEQ ID NO: 1523965 - RNA, 14 nt, Homo sapiens
cagcaucuaaguaa

SEQ ID NO: 1523966 - RNA, 18 nt, Homo sapiens
cagcauuuguucuuugcc

SEQ ID NO: 1523967 - RNA, 13 nt, Homo sapiens
cagcucaggauau

SEQ ID NO: 1523968 - RNA, 23 nt, Homo sapiens
cagcuggguuggaaaacaguauu

SEQ ID NO: 1523969 - RNA, 18 nt, Homo sapiens
caggaguuggaagugugu

SEQ ID NO: 1523970 - RNA, 17 nt, Homo sapiens
caggccaugcauggcuc

SEQ ID NO: 1523971 - RNA, 21 nt, Homo sapiens
caggcucuggagccagagaga

SEQ ID NO: 1523972 - RNA, 22 nt, Homo sapiens
cagggacucaaggguccagaag

SEQ ID NO: 1523973 - RNA, 20 nt, Homo sapiens
cagggcugggcgggagagac

SEQ ID NO: 1523974 - RNA, 16 nt, Homo sapiens
caguaaucagaguuac

SEQ ID NO: 1523975 - RNA, 22 nt, Homo sapiens
cagucucggguggcuagucaga

SEQ ID NO: 1523976 - RNA, 19 nt, Homo sapiens
cagucuguuaaguaaaaug

SEQ ID NO: 1523977 - RNA, 22 nt, Homo sapiens
cagugagccgcaucuucuccau

SEQ ID NO: 1523978 - RNA, 19 nt, Homo sapiens
cauaagucuaaauaaauga

SEQ ID NO: 1523979 - RNA, 17 nt, Homo sapiens
cauagaguucagacuuu

SEQ ID NO: 1523980 - RNA, 20 nt, Homo sapiens
caugagugugauccacauug

SEQ ID NO: 1523981 - RNA, 16 nt, Homo sapiens
cauggaaaacagagua

SEQ ID NO: 1523982 - RNA, 19 nt, Homo sapiens
cauggaaaacagaguauuu

SEQ ID NO: 1523983 - RNA, 15 nt, Homo sapiens
cauggagaaacccug

SEQ ID NO: 1523984 - RNA, 15 nt, Homo sapiens
caugugcucagggaa

SEQ ID NO: 1523985 - RNA, 18 nt, Homo sapiens
cauguuuagauuccagga

SEQ ID NO: 1523986 - RNA, 17 nt, Homo sapiens
cauuaaaauccaguauu

SEQ ID NO: 1523987 - RNA, 13 nt, Homo sapiens
cauucaucucuca

SEQ ID NO: 1523988 - RNA, 15 nt, Homo sapiens
cauucaucucucaaa

SEQ ID NO: 1523989 - RNA, 16 nt, Homo sapiens
cauuguuaggugcuga

SEQ ID NO: 1523990 - RNA, 19 nt, Homo sapiens
cauuguucagaugcuucuu

SEQ ID NO: 1523991 - RNA, 22 nt, Homo sapiens
cauuuguucuuugccagucuca

SEQ ID NO: 1523992 - RNA, 21 nt, Homo sapiens
cauuuuauaccaaaggugcua

SEQ ID NO: 1523993 - RNA, 14 nt, Homo sapiens
cauuuucuguucca

SEQ ID NO: 1523994 - RNA, 15 nt, Homo sapiens
cauuuucuguuccag

SEQ ID NO: 1523995 - RNA, 18 nt, Homo sapiens
cauuuucuguuccagguu

SEQ ID NO: 1523996 - RNA, 12 nt, Homo sapiens
ccaaaaauuuga

SEQ ID NO: 1523997 - RNA, 20 nt, Homo sapiens
ccaaccgaacaugaccaaaa

SEQ ID NO: 1523998 - RNA, 22 nt, Homo sapiens
ccaaccgaacaugaccaaaaac

SEQ ID NO: 1523999 - RNA, 20 nt, Homo sapiens
ccaagaggaaaaacagggaa

SEQ ID NO: 1524000 - RNA, 16 nt, Homo sapiens
ccaagugccaauauuu

SEQ ID NO: 1524001 - RNA, 18 nt, Homo sapiens
ccaccuugaaccugucac

SEQ ID NO: 1524002 - RNA, 13 nt, Homo sapiens
ccaggacugagau

SEQ ID NO: 1524003 - RNA, 15 nt, Homo sapiens
ccagucucauuuuca

SEQ ID NO: 1524004 - RNA, 14 nt, Homo sapiens
ccauaaacauuugc

SEQ ID NO: 1524005 - RNA, 19 nt, Homo sapiens
ccaugauaacugcaauuuu

SEQ ID NO: 1524006 - RNA, 20 nt, Homo sapiens
ccaugcauuuaaaguauucu

SEQ ID NO: 1524007 - RNA, 14 nt, Homo sapiens
ccaugguuccacag

SEQ ID NO: 1524008 - RNA, 13 nt, Homo sapiens
cccacgagcacuu

SEQ ID NO: 1524009 - RNA, 22 nt, Homo sapiens
cccagcccgcugcucacuuucc

SEQ ID NO: 1524010 - RNA, 18 nt, Homo sapiens
cccagguggcugacccag

SEQ ID NO: 1524011 - RNA, 21 nt, Homo sapiens
cccaguguguuucugaucuga

SEQ ID NO: 1524012 - RNA, 15 nt, Homo sapiens
ccccaguucugcucc

SEQ ID NO: 1524013 - RNA, 18 nt, Homo sapiens
cccccucaaaagccaaaa

SEQ ID NO: 1524014 - RNA, 16 nt, Homo sapiens
cccuauccacccagcc

SEQ ID NO: 1524015 - RNA, 16 nt, Homo sapiens
cccugucccucuaaua

SEQ ID NO: 1524016 - RNA, 21 nt, Homo sapiens
ccgcuuugagucccccagaga

SEQ ID NO: 1524017 - RNA, 14 nt, Homo sapiens
ccucagccaugagg

SEQ ID NO: 1524018 - RNA, 23 nt, Homo sapiens
ccucagggacagagacaccugca

SEQ ID NO: 1524019 - RNA, 18 nt, Homo sapiens
ccucuaaguguugugaaa

SEQ ID NO: 1524020 - RNA, 21 nt, Homo sapiens
ccugaaguaagcaaagacuuu

SEQ ID NO: 1524021 - RNA, 13 nt, Homo sapiens
ccugaaucacaac

SEQ ID NO: 1524022 - RNA, 16 nt, Homo sapiens
ccugucuaaaaauuca

SEQ ID NO: 1524023 - RNA, 22 nt, Homo sapiens
ccuuacauuugaaaucuaugaa

SEQ ID NO: 1524024 - RNA, 12 nt, Homo sapiens
ccuuaccaaaaa

SEQ ID NO: 1524025 - RNA, 23 nt, Homo sapiens
ccuuaggaaaaugcuucuguugu

SEQ ID NO: 1524026 - RNA, 15 nt, Homo sapiens
ccuucagggacucaa

SEQ ID NO: 1524027 - RNA, 14 nt, Homo sapiens
ccuugcccagagau

SEQ ID NO: 1524028 - RNA, 18 nt, Homo sapiens
ccuugcccugaccuccca

SEQ ID NO: 1524029 - RNA, 22 nt, Homo sapiens
ccuugucaauacugagccauuu

SEQ ID NO: 1524030 - RNA, 17 nt, Homo sapiens
ccuuguguaacuguguu

SEQ ID NO: 1524031 - RNA, 12 nt, Homo sapiens
ccuuucugcucc

SEQ ID NO: 1524032 - RNA, 13 nt, Homo sapiens
ccuuugcauucau

SEQ ID NO: 1524033 - RNA, 18 nt, Homo sapiens
ccuuuguaagaaaaccaa

SEQ ID NO: 1524034 - RNA, 22 nt, Homo sapiens
cgaaaagaagguauuuuuccaa

SEQ ID NO: 1524035 - RNA, 21 nt, Homo sapiens
cgcucccauggcucuugcaac

SEQ ID NO: 1524036 - RNA, 23 nt, Homo sapiens
cggcuuccaccccucuccucaga

SEQ ID NO: 1524037 - RNA, 16 nt, Homo sapiens
cggguaccaugcugcc

SEQ ID NO: 1524038 - RNA, 13 nt, Homo sapiens
cguuuaaucacau

SEQ ID NO: 1524039 - RNA, 14 nt, Homo sapiens
cguuugaaucacag

SEQ ID NO: 1524040 - RNA, 15 nt, Homo sapiens
cuaaagaagguuuca

SEQ ID NO: 1524041 - RNA, 22 nt, Homo sapiens
cuaaagaagguuucagaaagaa

SEQ ID NO: 1524042 - RNA, 14 nt, Homo sapiens
cuaaaggugcuauu

SEQ ID NO: 1524043 - RNA, 13 nt, Homo sapiens
cuaaauaaaugaa

SEQ ID NO: 1524044 - RNA, 15 nt, Homo sapiens
cuaagucaauuccac

SEQ ID NO: 1524045 - RNA, 16 nt, Homo sapiens
cuaagucaauuccacc

SEQ ID NO: 1524046 - RNA, 21 nt, Homo sapiens
cuaaguguugugaaacuguaa

SEQ ID NO: 1524047 - RNA, 22 nt, Homo sapiens
cuaaguguugugaaacuguaaa

SEQ ID NO: 1524048 - RNA, 17 nt, Homo sapiens
cuaauagagagauuagu

SEQ ID NO: 1524049 - RNA, 21 nt, Homo sapiens
cuaauccucuuuuucuagucu

SEQ ID NO: 1524050 - RNA, 15 nt, Homo sapiens
cuacauuuacuuuaa

SEQ ID NO: 1524051 - RNA, 20 nt, Homo sapiens
cuaccugcugcugcuauuau

SEQ ID NO: 1524052 - RNA, 22 nt, Homo sapiens
cuagccaugauaacugcaauuu

SEQ ID NO: 1524053 - RNA, 19 nt, Homo sapiens
cuaggcucugggugcagua

SEQ ID NO: 1524054 - RNA, 15 nt, Homo sapiens
cuaguuuuacuuuga

SEQ ID NO: 1524055 - RNA, 14 nt, Homo sapiens
cuauaaucucagaa

SEQ ID NO: 1524056 - RNA, 16 nt, Homo sapiens
cuauauguagcuuuau

SEQ ID NO: 1524057 - RNA, 20 nt, Homo sapiens
cuaugaaauaucaugcucca

SEQ ID NO: 1524058 - RNA, 21 nt, Homo sapiens
cuaugaaauaucaugcuccau

SEQ ID NO: 1524059 - RNA, 10 nt, Homo sapiens
cuauggaugu

SEQ ID NO: 1524060 - RNA, 13 nt, Homo sapiens
cuaugugcaugca

SEQ ID NO: 1524061 - RNA, 16 nt, Homo sapiens
cucaggccucugcucu

SEQ ID NO: 1524062 - RNA, 19 nt, Homo sapiens
cucagggcuggggccaaga

SEQ ID NO: 1524063 - RNA, 18 nt, Homo sapiens
cucauuaccuugugcuaa

SEQ ID NO: 1524064 - RNA, 18 nt, Homo sapiens
cuccaccaacccaucaga

SEQ ID NO: 1524065 - RNA, 19 nt, Homo sapiens
cuccaccuugaaccuguca

SEQ ID NO: 1524066 - RNA, 19 nt, Homo sapiens
cuccagaaagcucaucuca

SEQ ID NO: 1524067 - RNA, 23 nt, Homo sapiens
cuccagucucaucuaugucauau

SEQ ID NO: 1524068 - RNA, 18 nt, Homo sapiens
cucccaccccacccccuu

SEQ ID NO: 1524069 - RNA, 20 nt, Homo sapiens
cucccauaagcuaagccuua

SEQ ID NO: 1524070 - RNA, 17 nt, Homo sapiens
cucccccugccagugcc

SEQ ID NO: 1524071 - RNA, 14 nt, Homo sapiens
cucccgaguacagu

SEQ ID NO: 1524072 - RNA, 19 nt, Homo sapiens
cucccugaaguaagcaaag

SEQ ID NO: 1524073 - RNA, 21 nt, Homo sapiens
cuccucgaagucccggcuucc

SEQ ID NO: 1524074 - RNA, 13 nt, Homo sapiens
cuccucugcucca

SEQ ID NO: 1524075 - RNA, 14 nt, Homo sapiens
cucuccucagaguc

SEQ ID NO: 1524076 - RNA, 19 nt, Homo sapiens
cucuuuuugggugauuaaa

SEQ ID NO: 1524077 - RNA, 12 nt, Homo sapiens
cugaaagacaga

SEQ ID NO: 1524078 - RNA, 18 nt, Homo sapiens
cugaaagacagaauguca

SEQ ID NO: 1524079 - RNA, 14 nt, Homo sapiens
cugaagaaaguuau

SEQ ID NO: 1524080 - RNA, 11 nt, Homo sapiens
cugaagccaga

SEQ ID NO: 1524081 - RNA, 16 nt, Homo sapiens
cugaagccagauccac

SEQ ID NO: 1524082 - RNA, 14 nt, Homo sapiens
cugaauaacacugg

SEQ ID NO: 1524083 - RNA, 18 nt, Homo sapiens
cugaauccuuccauuucu

SEQ ID NO: 1524084 - RNA, 23 nt, Homo sapiens
cugagaacuaagagaugagggag

SEQ ID NO: 1524085 - RNA, 19 nt, Homo sapiens
cugaggaagaagggauaau

SEQ ID NO: 1524086 - RNA, 23 nt, Homo sapiens
cugauauaacaaacuacauguaa

SEQ ID NO: 1524087 - RNA, 15 nt, Homo sapiens
cugaugggacaucaa

SEQ ID NO: 1524088 - RNA, 16 nt, Homo sapiens
cugauguuacugagau

SEQ ID NO: 1524089 - RNA, 19 nt, Homo sapiens
ugguuccaagaaagaucca

SEQ ID NO: 1524090 - RNA, 15 nt, Homo sapiens
ugguugcauuuguca

SEQ ID NO: 1524091 - RNA, 20 nt, Homo sapiens
uguaaauacuguuuuuaaca

SEQ ID NO: 1524092 - RNA, 12 nt, Homo sapiens
uguaaugaucau

SEQ ID NO: 1524093 - RNA, 19 nt, Homo sapiens
uguacagaguaaguucuca

SEQ ID NO: 1524094 - RNA, 16 nt, Homo sapiens
uguaggguaaggugcc

SEQ ID NO: 1524095 - RNA, 18 nt, Homo sapiens
uguaucauuaugaaguca

SEQ ID NO: 1524096 - RNA, 21 nt, Homo sapiens
uguaugauccuaaugaaugca

SEQ ID NO: 1524097 - RNA, 15 nt, Homo sapiens
uguauugucugccca

SEQ ID NO: 1524098 - RNA, 21 nt, Homo sapiens
ugucaccggggcaacugccug

SEQ ID NO: 1524099 - RNA, 19 nt, Homo sapiens
ugucaccuggccugccacc

SEQ ID NO: 1524100 - RNA, 13 nt, Homo sapiens
ugucucaguuuac

SEQ ID NO: 1524101 - RNA, 14 nt, Homo sapiens
ugucuugauguguc

SEQ ID NO: 1524102 - RNA, 23 nt, Homo sapiens
ugugaauuuuucuaaaggugcua

SEQ ID NO: 1524103 - RNA, 22 nt, Homo sapiens
ugugauaauauauugcuaaaau

SEQ ID NO: 1524104 - RNA, 20 nt, Homo sapiens
ugugcuaucgcaaaucacaa

SEQ ID NO: 1524105 - RNA, 22 nt, Homo sapiens
uguggcuuuugaauaucuucca

SEQ ID NO: 1524106 - RNA, 20 nt, Homo sapiens
ugugggguccccaucauccc

SEQ ID NO: 1524107 - RNA, 12 nt, Homo sapiens
ugugugaucugu

SEQ ID NO: 1524108 - RNA, 16 nt, Homo sapiens
ugugugcaaaggugag

SEQ ID NO: 1524109 - RNA, 16 nt, Homo sapiens
uguuaucaauucacau

SEQ ID NO: 1524110 - RNA, 21 nt, Homo sapiens
uguucacaacauaaggagaau

SEQ ID NO: 1524111 - RNA, 15 nt, Homo sapiens
uguucccuauuuugc

SEQ ID NO: 1524112 - RNA, 22 nt, Homo sapiens
uguucuauuuuuguuuacaaac

SEQ ID NO: 1524113 - RNA, 13 nt, Homo sapiens
uguucuuugccag

SEQ ID NO: 1524114 - RNA, 14 nt, Homo sapiens
uguugauggugcua

SEQ ID NO: 1524115 - RNA, 20 nt, Homo sapiens
uguugcugaaagacuaccuc

SEQ ID NO: 1524116 - RNA, 16 nt, Homo sapiens
uuaaguugauggugau

SEQ ID NO: 1524117 - RNA, 17 nt, Homo sapiens
uuaaguugauggugaug

SEQ ID NO: 1524118 - RNA, 20 nt, Homo sapiens
uuaaguugauggugaugaaa

SEQ ID NO: 1524119 - RNA, 23 nt, Homo sapiens
uuacaaacauggaaaacagagua

SEQ ID NO: 1524120 - RNA, 14 nt, Homo sapiens
uuacuaucauguca

SEQ ID NO: 1524121 - RNA, 17 nt, Homo sapiens
uuacuaucaugucaaac

SEQ ID NO: 1524122 - RNA, 23 nt, Homo sapiens
uuauaaaagaauaaaauugcacu

SEQ ID NO: 1524123 - RNA, 24 nt, Homo sapiens
uuauaaaagaugcauuaucuauga

SEQ ID NO: 1524124 - RNA, 14 nt, Homo sapiens
uuauaaacugagag

SEQ ID NO: 1524125 - RNA, 14 nt, Homo sapiens
uuauuagucuucaa

SEQ ID NO: 1524126 - RNA, 15 nt, Homo sapiens
uuauucugauuccac

SEQ ID NO: 1524127 - RNA, 16 nt, Homo sapiens
uuauucugauuccacu

SEQ ID NO: 1524128 - RNA, 17 nt, Homo sapiens
uucaaccuuaccaaaaa

SEQ ID NO: 1524129 - RNA, 11 nt, Homo sapiens
uucacacugca

SEQ ID NO: 1524130 - RNA, 14 nt, Homo sapiens
uucacucaaucucu

SEQ ID NO: 1524131 - RNA, 22 nt, Homo sapiens
uucagcauuuguucuuugccag

SEQ ID NO: 1524132 - RNA, 15 nt, Homo sapiens
uuccaugguuccaca

SEQ ID NO: 1524133 - RNA, 14 nt, Homo sapiens
uucccagcucuccc

SEQ ID NO: 1524134 - RNA, 17 nt, Homo sapiens
uuccccucagagcucuu

SEQ ID NO: 1524135 - RNA, 17 nt, Homo sapiens
uucccuucuugcauccu

SEQ ID NO: 1524136 - RNA, 14 nt, Homo sapiens
uuccugaagccaga

SEQ ID NO: 1524137 - RNA, 15 nt, Homo sapiens
uucgagguggaucac

SEQ ID NO: 1524138 - RNA, 18 nt, Homo sapiens
uucuaucaaauacuagua

SEQ ID NO: 1524139 - RNA, 16 nt, Homo sapiens
uucugaucugaugcaa

SEQ ID NO: 1524140 - RNA, 19 nt, Homo sapiens
uucugcuccucuccaggca

SEQ ID NO: 1524141 - RNA, 18 nt, Homo sapiens
uucuuggggucccaggga

SEQ ID NO: 1524142 - RNA, 18 nt, Homo sapiens
uucuuuagcuguacugua

SEQ ID NO: 1524143 - RNA, 13 nt, Homo sapiens
uugaaaucuauga

SEQ ID NO: 1524144 - RNA, 15 nt, Homo sapiens
uugacucuccagaaa

SEQ ID NO: 1524145 - RNA, 14 nt, Homo sapiens
uugauggugaugaa

SEQ ID NO: 1524146 - RNA, 20 nt, Homo sapiens
uugcaccccuccuauaccau

SEQ ID NO: 1524147 - RNA, 19 nt, Homo sapiens
uugcccuugcccugaccuc

SEQ ID NO: 1524148 - RNA, 15 nt, Homo sapiens
uugugaaauacagua

SEQ ID NO: 1524149 - RNA, 22 nt, Homo sapiens
uuguucauaauacaaaggugcu

SEQ ID NO: 1524150 - RNA, 13 nt, Homo sapiens
uuguucuuugcca

SEQ ID NO: 1524151 - RNA, 15 nt, Homo sapiens
uuuaacaacuaugau

SEQ ID NO: 1524152 - RNA, 12 nt, Homo sapiens
uuuaauuaucuu

SEQ ID NO: 1524153 - RNA, 12 nt, Homo sapiens
uuuacuuugaac

SEQ ID NO: 1524154 - RNA, 21 nt, Homo sapiens
uuuauuacaguuuaucuaugg

SEQ ID NO: 1524155 - RNA, 20 nt, Homo sapiens
uuucaugccccggcugcaca

SEQ ID NO: 1524156 - RNA, 14 nt, Homo sapiens
uuucauuaacuccu

SEQ ID NO: 1524157 - RNA, 15 nt, Homo sapiens
uuucauuuuugccag

SEQ ID NO: 1524158 - RNA, 17 nt, Homo sapiens
uuucauuuuugccaguc

SEQ ID NO: 1524159 - RNA, 22 nt, Homo sapiens
uuuccacaagauucccagagac

SEQ ID NO: 1524160 - RNA, 19 nt, Homo sapiens
uuucugcuccuuucuccac

SEQ ID NO: 1524161 - RNA, 11 nt, Homo sapiens
uuugauuuagc

SEQ ID NO: 1524162 - RNA, 22 nt, Homo sapiens
uuuggaaaucacacgucuggcu

SEQ ID NO: 1524163 - RNA, 22 nt, Homo sapiens
uuuuaaaguauguuauugcaua

SEQ ID NO: 1524164 - RNA, 12 nt, Homo sapiens
uuuuaauugauu

SEQ ID NO: 1524165 - RNA, 18 nt, Homo sapiens
uuuucaauuuugugcuau

SEQ ID NO: 1524166 - RNA, 15 nt, Homo sapiens
uuuucagaccccagc

SEQ ID NO: 1524167 - RNA, 15 nt, Homo sapiens
uuuucuagucuucau

SEQ ID NO: 1524168 - RNA, 23 nt, Homo sapiens
uuuucuggcauuuucuguuccag

SEQ ID NO: 1524169 - RNA, 15 nt, Homo sapiens
ucacaguuccucgcc

SEQ ID NO: 1524170 - RNA, 14 nt, Homo sapiens
ucacccacaucuaa

SEQ ID NO: 1524171 - RNA, 16 nt, Homo sapiens
ucaccuggccugccac

SEQ ID NO: 1524172 - RNA, 22 nt, Homo sapiens
ucacuagccaugauaacugcaa

SEQ ID NO: 1524173 - RNA, 21 nt, Homo sapiens
ucacuuuccacccucucucca

SEQ ID NO: 1524174 - RNA, 20 nt, Homo sapiens
ucagacccuaccccaccacg

SEQ ID NO: 1524175 - RNA, 16 nt, Homo sapiens
ucagagcauugugcaa

SEQ ID NO: 1524176 - RNA, 15 nt, Homo sapiens
ucagcagcccuccuc

SEQ ID NO: 1524177 - RNA, 20 nt, Homo sapiens
ucagcauuuguucuuugcca

SEQ ID NO: 1524178 - RNA, 12 nt, Homo sapiens
ucagccaugagg

SEQ ID NO: 1524179 - RNA, 14 nt, Homo sapiens
ucagcuggaucucc

SEQ ID NO: 1524180 - RNA, 13 nt, Homo sapiens
ucagugaauuugu

SEQ ID NO: 1524181 - RNA, 18 nt, Homo sapiens
ucaguuacucagcccugg

SEQ ID NO: 1524182 - RNA, 19 nt, Homo sapiens
ucauaauacaaaggugcua

SEQ ID NO: 1524183 - RNA, 18 nt, Homo sapiens
ucauaauuucuucacuca

SEQ ID NO: 1524184 - RNA, 23 nt, Homo sapiens
ucaucagagcuccucuguccugc

SEQ ID NO: 1524185 - RNA, 17 nt, Homo sapiens
ucauccaggacugagau

SEQ ID NO: 1524186 - RNA, 16 nt, Homo sapiens
ucaucuauaacaugca

SEQ ID NO: 1524187 - RNA, 17 nt, Homo sapiens
ucaucuauaacaugcau

SEQ ID NO: 1524188 - RNA, 19 nt, Homo sapiens
ucaugccccggcugcacac

SEQ ID NO: 1524189 - RNA, 19 nt, Homo sapiens
uccaaacuaccuuccaguu

SEQ ID NO: 1524190 - RNA, 16 nt, Homo sapiens
uccaacaugugcucag

SEQ ID NO: 1524191 - RNA, 16 nt, Homo sapiens
uccaaccuaaccccuu

SEQ ID NO: 1524192 - RNA, 13 nt, Homo sapiens
uccaagugccaau

SEQ ID NO: 1524193 - RNA, 14 nt, Homo sapiens
uccaccacaguaaa

SEQ ID NO: 1524194 - RNA, 14 nt, Homo sapiens
uccacccuaucccu

SEQ ID NO: 1524195 - RNA, 11 nt, Homo sapiens
uccacuuuuau

SEQ ID NO: 1524196 - RNA, 14 nt, Homo sapiens
uccaggacugagau

SEQ ID NO: 1524197 - RNA, 20 nt, Homo sapiens
uccaggauuuauaaagcaaa

SEQ ID NO: 1524198 - RNA, 16 nt, Homo sapiens
uccaggguaccuuuga

SEQ ID NO: 1524199 - RNA, 18 nt, Homo sapiens
uccaucgcugucaucuca

SEQ ID NO: 1524200 - RNA, 16 nt, Homo sapiens
uccaucuuauucccaa

SEQ ID NO: 1524201 - RNA, 13 nt, Homo sapiens
ucccaaagcacaa

SEQ ID NO: 1524202 - RNA, 18 nt, Homo sapiens
ucccaaauaaacuccaga

SEQ ID NO: 1524203 - RNA, 14 nt, Homo sapiens
ucccacccaacagc

SEQ ID NO: 1524204 - RNA, 14 nt, Homo sapiens
ucccacccaaccaa

SEQ ID NO: 1524205 - RNA, 22 nt, Homo sapiens
ucccacucagggcuggggccaa

SEQ ID NO: 1524206 - RNA, 19 nt, Homo sapiens
ucccagcccuauggaugug

SEQ ID NO: 1524207 - RNA, 13 nt, Homo sapiens
ucccgaguacagu

SEQ ID NO: 1524208 - RNA, 18 nt, Homo sapiens
uccgaccucucuccucug

SEQ ID NO: 1524209 - RNA, 19 nt, Homo sapiens
uccuaccugcugcugcuau

SEQ ID NO: 1524210 - RNA, 20 nt, Homo sapiens
uccuauuuaugaaaaccaua

SEQ ID NO: 1524211 - RNA, 15 nt, Homo sapiens
uccucugccaccucc

SEQ ID NO: 1524212 - RNA, 18 nt, Homo sapiens
uccugucucuaagucaau

SEQ ID NO: 1524213 - RNA, 18 nt, Homo sapiens
uccuugauaaaguauuau

SEQ ID NO: 1524214 - RNA, 17 nt, Homo sapiens
ucgaaaagaagguauuu

SEQ ID NO: 1524215 - RNA, 15 nt, Homo sapiens
ucggggaacuccugg

SEQ ID NO: 1524216 - RNA, 22 nt, Homo sapiens
ucggggaacuccuggaaauauc

SEQ ID NO: 1524217 - RNA, 14 nt, Homo sapiens
ucuacuugcuuaaa

SEQ ID NO: 1524218 - RNA, 21 nt, Homo sapiens
ucuaucaaauacuaguauuaa

SEQ ID NO: 1524219 - RNA, 19 nt, Homo sapiens
ucuaucccacccaacagcu

SEQ ID NO: 1524220 - RNA, 17 nt, Homo sapiens
ucucagacugccaaaga

SEQ ID NO: 1524221 - RNA, 21 nt, Homo sapiens
ucucagcuggaucuccauucu

SEQ ID NO: 1524222 - RNA, 16 nt, Homo sapiens
ucuccuguccaaccua

SEQ ID NO: 1524223 - RNA, 14 nt, Homo sapiens
ucugaaagacagaa

SEQ ID NO: 1524224 - RNA, 18 nt, Homo sapiens
ucugaggaagaagggaua

SEQ ID NO: 1524225 - RNA, 16 nt, Homo sapiens
ucugaugcaagcaaga

SEQ ID NO: 1524226 - RNA, 21 nt, Homo sapiens
ucugaugcaagcaagaaacac

SEQ ID NO: 1524227 - RNA, 13 nt, Homo sapiens
ucuggagccagag

SEQ ID NO: 1524228 - RNA, 18 nt, Homo sapiens
ucuuauucucacuccacc

SEQ ID NO: 1524229 - RNA, 18 nt, Homo sapiens
ugaaaaauaaaaaccaua

SEQ ID NO: 1524230 - RNA, 12 nt, Homo sapiens
ugaaaaaugccu

SEQ ID NO: 1524231 - RNA, 13 nt, Homo sapiens
ugaaaaaugccuc

SEQ ID NO: 1524232 - RNA, 14 nt, Homo sapiens
ugaaagacuaccuc

SEQ ID NO: 1524233 - RNA, 18 nt, Homo sapiens
ugaaagcugaauccuucc

SEQ ID NO: 1524234 - RNA, 19 nt, Homo sapiens
ugaaagcugaauccuucca

SEQ ID NO: 1524235 - RNA, 15 nt, Homo sapiens
ugaaauuaauuugug

SEQ ID NO: 1524236 - RNA, 22 nt, Homo sapiens
ugaacccccucaaaagccaaaa

SEQ ID NO: 1524237 - RNA, 19 nt, Homo sapiens
ugaagaagagaaugugaca

SEQ ID NO: 1524238 - RNA, 21 nt, Homo sapiens
ugaagaauguugauggugcua

SEQ ID NO: 1524239 - RNA, 14 nt, Homo sapiens
ugaagccagaucca

SEQ ID NO: 1524240 - RNA, 16 nt, Homo sapiens
ugaaggagaaggugcc

SEQ ID NO: 1524241 - RNA, 14 nt, Homo sapiens
ugaaguaagcaaag

SEQ ID NO: 1524242 - RNA, 15 nt, Homo sapiens
ugaaguauuucucac

SEQ ID NO: 1524243 - RNA, 22 nt, Homo sapiens
ugaagucaugcguuuaaucaca

SEQ ID NO: 1524244 - RNA, 16 nt, Homo sapiens
ugaauaaaccaguauc

SEQ ID NO: 1524245 - RNA, 15 nt, Homo sapiens
ugaauaacacuggau

SEQ ID NO: 1524246 - RNA, 15 nt, Homo sapiens
ugaauaucuuccaca

SEQ ID NO: 1524247 - RNA, 18 nt, Homo sapiens
ugaauaucuuccacagag

SEQ ID NO: 1524248 - RNA, 20 nt, Homo sapiens
ugaaugugcugaucauuuga

SEQ ID NO: 1524249 - RNA, 18 nt, Homo sapiens
ugaauuguggcuguucac

SEQ ID NO: 1524250 - RNA, 16 nt, Homo sapiens
ugaccaaaaaccaaaa

SEQ ID NO: 1524251 - RNA, 16 nt, Homo sapiens
ugaccuagacagagau

SEQ ID NO: 1524252 - RNA, 14 nt, Homo sapiens
ugacucuccagaaa

SEQ ID NO: 1524253 - RNA, 15 nt, Homo sapiens
ugagauguuuuacca

SEQ ID NO: 1524254 - RNA, 21 nt, Homo sapiens
ugagcuuaagaauuuugagca

SEQ ID NO: 1524255 - RNA, 22 nt, Homo sapiens
ugagggaucugucucacuggca

SEQ ID NO: 1524256 - RNA, 14 nt, Homo sapiens
ugagucaugaucuc

SEQ ID NO: 1524257 - RNA, 20 nt, Homo sapiens
ugaucagagcauugugcaau

SEQ ID NO: 1524258 - RNA, 20 nt, Homo sapiens
ugauccuaaugaaugcauaa

SEQ ID NO: 1524259 - RNA, 18 nt, Homo sapiens
ugaugaaauguaaauacu

SEQ ID NO: 1524260 - RNA, 20 nt, Homo sapiens
ugauuaccuagaagugcaag

SEQ ID NO: 1524261 - RNA, 16 nt, Homo sapiens
ugauucugucaauguc

SEQ ID NO: 1524262 - RNA, 23 nt, Homo sapiens
ugauuuagcauucauauuuucca

SEQ ID NO: 1524263 - RNA, 18 nt, Homo sapiens
ugcaacuugugaacucca

SEQ ID NO: 1524264 - RNA, 17 nt, Homo sapiens
ugcagacacaucagcug

SEQ ID NO: 1524265 - RNA, 21 nt, Homo sapiens
ugcagacacaucagcuguuaa

SEQ ID NO: 1524266 - RNA, 20 nt, Homo sapiens
ugcauaaaauguuaaguuga

SEQ ID NO: 1524267 - RNA, 18 nt, Homo sapiens
ugcauaaaccaaugagcu

SEQ ID NO: 1524268 - RNA, 20 nt, Homo sapiens
ugcauauccaacaugugcuc

SEQ ID NO: 1524269 - RNA, 21 nt, Homo sapiens
ugcccagcaaucaaaggcaau

SEQ ID NO: 1524270 - RNA, 19 nt, Homo sapiens
ugcccaggaaccucagggc

SEQ ID NO: 1524271 - RNA, 17 nt, Homo sapiens
ugcccagggcagcuuug

SEQ ID NO: 1524272 - RNA, 15 nt, Homo sapiens
ugcccuuucugcucc

SEQ ID NO: 1524273 - RNA, 21 nt, Homo sapiens
ugccugcccuuucucccaaaa

SEQ ID NO: 1524274 - RNA, 18 nt, Homo sapiens
ugccuuucagaagugauu

SEQ ID NO: 1524275 - RNA, 22 nt, Homo sapiens
ugcuaauccucuuuuucuaguc

SEQ ID NO: 1524276 - RNA, 17 nt, Homo sapiens
ugcuaauucaaagcucu

SEQ ID NO: 1524277 - RNA, 17 nt, Homo sapiens
ugcuauaacuauguuga

SEQ ID NO: 1524278 - RNA, 21 nt, Homo sapiens
ugcuauaacuauguugauaaa

SEQ ID NO: 1524279 - RNA, 17 nt, Homo sapiens
ugcuauagaaauugaga

SEQ ID NO: 1524280 - RNA, 23 nt, Homo sapiens
ugcuauuauguaacauccagaag

SEQ ID NO: 1524281 - RNA, 14 nt, Homo sapiens
ugcuuaaauugugg

SEQ ID NO: 1524282 - RNA, 15 nt, Homo sapiens
ugcuucuguccagga

SEQ ID NO: 1524283 - RNA, 16 nt, Homo sapiens
uggaaaugacccaaac

SEQ ID NO: 1524284 - RNA, 14 nt, Homo sapiens
uggaaguaguaauu

SEQ ID NO: 1524285 - RNA, 14 nt, Homo sapiens
uggaaugaaugaca

SEQ ID NO: 1524286 - RNA, 19 nt, Homo sapiens
uggacagauggaccaaaag

SEQ ID NO: 1524287 - RNA, 13 nt, Homo sapiens
uggagaagcuccc

SEQ ID NO: 1524288 - RNA, 18 nt, Homo sapiens
uggaucuacccucuaguu

SEQ ID NO: 1524289 - RNA, 18 nt, Homo sapiens
uggaucuccauucucuca

SEQ ID NO: 1524290 - RNA, 15 nt, Homo sapiens
uggcagccucaggag

SEQ ID NO: 1524291 - RNA, 18 nt, Homo sapiens
uggcauguguacaaugaa

SEQ ID NO: 1524292 - RNA, 22 nt, Homo sapiens
uggggacagagcagaacuuuca

SEQ ID NO: 1524293 - RNA, 19 nt, Homo sapiens
uggguuggaaaacaguauu

SEQ ID NO: 1524294 - RNA, 14 nt, Homo sapiens
ggaaaugacccaaa

SEQ ID NO: 1524295 - RNA, 14 nt, Homo sapiens
ggaauaauccagaa

SEQ ID NO: 1524296 - RNA, 21 nt, Homo sapiens
ggacuauggcucuacuuucag

SEQ ID NO: 1524297 - RNA, 17 nt, Homo sapiens
ggacugcauaaaccaau

SEQ ID NO: 1524298 - RNA, 21 nt, Homo sapiens
ggagacucaccucugccucaa

SEQ ID NO: 1524299 - RNA, 14 nt, Homo sapiens
ggagagagacucca

SEQ ID NO: 1524300 - RNA, 17 nt, Homo sapiens
ggaucuacccucuaguu

SEQ ID NO: 1524301 - RNA, 19 nt, Homo sapiens
ggauggacagauggaccaa

SEQ ID NO: 1524302 - RNA, 12 nt, Homo sapiens
ggaugggggcag

SEQ ID NO: 1524303 - RNA, 17 nt, Homo sapiens
ggauuuauaaagcaaau

SEQ ID NO: 1524304 - RNA, 12 nt, Homo sapiens
ggcaacugccug

SEQ ID NO: 1524305 - RNA, 15 nt, Homo sapiens
ggcaaugcucaaaca

SEQ ID NO: 1524306 - RNA, 19 nt, Homo sapiens
ggcagaccugaaucacaac

SEQ ID NO: 1524307 - RNA, 22 nt, Homo sapiens
ggccaagaggaaaaacagggaa

SEQ ID NO: 1524308 - RNA, 16 nt, Homo sapiens
ggccacagccugggug

SEQ ID NO: 1524309 - RNA, 18 nt, Homo sapiens
ggccagcaaauguuccuu

SEQ ID NO: 1524310 - RNA, 17 nt, Homo sapiens
ggccgucugcacuucug

SEQ ID NO: 1524311 - RNA, 22 nt, Homo sapiens
ggccucugcucuccgaccucuc

SEQ ID NO: 1524312 - RNA, 23 nt, Homo sapiens
ggccucugcucuccgaccucucu

SEQ ID NO: 1524313 - RNA, 16 nt, Homo sapiens
ggcucccgaguacagu

SEQ ID NO: 1524314 - RNA, 18 nt, Homo sapiens
ggcucuggagccagagag

SEQ ID NO: 1524315 - RNA, 15 nt, Homo sapiens
ggcucugggugcagu

SEQ ID NO: 1524316 - RNA, 16 nt, Homo sapiens
ggcucugggugcagua

SEQ ID NO: 1524317 - RNA, 13 nt, Homo sapiens
ggcuugcugccaa

SEQ ID NO: 1524318 - RNA, 14 nt, Homo sapiens
ggcuuuuccaggaa

SEQ ID NO: 1524319 - RNA, 20 nt, Homo sapiens
gggauaauagacacaucaaa

SEQ ID NO: 1524320 - RNA, 19 nt, Homo sapiens
gggggcgcgcuuaaauuuc

SEQ ID NO: 1524321 - RNA, 19 nt, Homo sapiens
gggguucucagacugccaa

SEQ ID NO: 1524322 - RNA, 15 nt, Homo sapiens
gguucaaaagcaauc

SEQ ID NO: 1524323 - RNA, 15 nt, Homo sapiens
guaacguacauuugu

SEQ ID NO: 1524324 - RNA, 16 nt, Homo sapiens
guaacuccaccaaccc

SEQ ID NO: 1524325 - RNA, 17 nt, Homo sapiens
guacguuaaaagcaaaa

SEQ ID NO: 1524326 - RNA, 13 nt, Homo sapiens
guaggcagggaac

SEQ ID NO: 1524327 - RNA, 22 nt, Homo sapiens
guaguaucugcuuaggugccag

SEQ ID NO: 1524328 - RNA, 18 nt, Homo sapiens
guaucugcuuaggugcca

SEQ ID NO: 1524329 - RNA, 15 nt, Homo sapiens
guauguuauugcaua

SEQ ID NO: 1524330 - RNA, 22 nt, Homo sapiens
gucaacccaauaguuguugauu

SEQ ID NO: 1524331 - RNA, 14 nt, Homo sapiens
gucaauacugagcc

SEQ ID NO: 1524332 - RNA, 21 nt, Homo sapiens
gucacaguaaugcaagcaaag

SEQ ID NO: 1524333 - RNA, 15 nt, Homo sapiens
gucauauuuugccac

SEQ ID NO: 1524334 - RNA, 13 nt, Homo sapiens
gucaucggcacua

SEQ ID NO: 1524335 - RNA, 15 nt, Homo sapiens
guccauuaacugcuu

SEQ ID NO: 1524336 - RNA, 22 nt, Homo sapiens
gucuaaauaaaugaaguauuuc

SEQ ID NO: 1524337 - RNA, 19 nt, Homo sapiens
gucucucuauuacacugga

SEQ ID NO: 1524338 - RNA, 21 nt, Homo sapiens
gucugaaagacagaaugucac

SEQ ID NO: 1524339 - RNA, 15 nt, Homo sapiens
gucugggaugcugcg

SEQ ID NO: 1524340 - RNA, 21 nt, Homo sapiens
gucuuuguaaugucaccaccu

SEQ ID NO: 1524341 - RNA, 23 nt, Homo sapiens
gugauacaacuucaagugcaugc

SEQ ID NO: 1524342 - RNA, 19 nt, Homo sapiens
gugcagacugaugggacau

SEQ ID NO: 1524343 - RNA, 15 nt, Homo sapiens
gugcauucaaccuua

SEQ ID NO: 1524344 - RNA, 22 nt, Homo sapiens
gugcauucaaccuuaccaaaaa

SEQ ID NO: 1524345 - RNA, 16 nt, Homo sapiens
guggcagauuuaguga

SEQ ID NO: 1524346 - RNA, 16 nt, Homo sapiens
gugugcagacugaugg

SEQ ID NO: 1524347 - RNA, 18 nt, Homo sapiens
guguugugaaacuguaaa

SEQ ID NO: 1524348 - RNA, 13 nt, Homo sapiens
guuaaaagcaaaa

SEQ ID NO: 1524349 - RNA, 23 nt, Homo sapiens
guuaaaagcaaaaagauguauau

SEQ ID NO: 1524350 - RNA, 21 nt, Homo sapiens
guuacugagauguuuuaccau

SEQ ID NO: 1524351 - RNA, 12 nt, Homo sapiens
guucaagccaug

SEQ ID NO: 1524352 - RNA, 16 nt, Homo sapiens
guuccuuacugcagaa

SEQ ID NO: 1524353 - RNA, 19 nt, Homo sapiens
guuccuuucgaaagcaaug

SEQ ID NO: 1524354 - RNA, 14 nt, Homo sapiens
guugcauuugucaa

SEQ ID NO: 1524355 - RNA, 19 nt, Homo sapiens
guugcugaaagacuaccuc

SEQ ID NO: 1524356 - RNA, 21 nt, Homo sapiens
guugggcuuaugaaaccccaa

SEQ ID NO: 1524357 - RNA, 16 nt, Homo sapiens
guugugaaacuguaaa

SEQ ID NO: 1524358 - RNA, 19 nt, Homo sapiens
guuucagagacaacuuccc

SEQ ID NO: 1524359 - RNA, 23 nt, Homo sapiens
guuucuuuuuucauuuuugccag

SEQ ID NO: 1524360 - RNA, 14 nt, Homo sapiens
guuugaguuacuau

SEQ ID NO: 1524361 - RNA, 17 nt, Homo sapiens
uaaaacccaaacuucca

SEQ ID NO: 1524362 - RNA, 18 nt, Homo sapiens
uaaaacccaaacuuccaa

SEQ ID NO: 1524363 - RNA, 18 nt, Homo sapiens
uaaaagauaaauuuguug

SEQ ID NO: 1524364 - RNA, 23 nt, Homo sapiens
uaaaauauuuuagauguuauuau

SEQ ID NO: 1524365 - RNA, 16 nt, Homo sapiens
uaaaauccaguauuau

SEQ ID NO: 1524366 - RNA, 20 nt, Homo sapiens
uaaacuuaauuuuguaaaac

SEQ ID NO: 1524367 - RNA, 22 nt, Homo sapiens
uaaagggagauaacaaucugua

SEQ ID NO: 1524368 - RNA, 13 nt, Homo sapiens
uaaaggugcuauu

SEQ ID NO: 1524369 - RNA, 14 nt, Homo sapiens
uaaaguauucucca

SEQ ID NO: 1524370 - RNA, 14 nt, Homo sapiens
uaaaucaaugcuau

SEQ ID NO: 1524371 - RNA, 19 nt, Homo sapiens
uaacaaacuacauguaauc

SEQ ID NO: 1524372 - RNA, 15 nt, Homo sapiens
uaagcaaagacuuuc

SEQ ID NO: 1524373 - RNA, 19 nt, Homo sapiens
uaauacugccggucaccca

SEQ ID NO: 1524374 - RNA, 19 nt, Homo sapiens
uaauccucuuuuucuaguc

SEQ ID NO: 1524375 - RNA, 21 nt, Homo sapiens
uaaucuuaaauuuauuagaua

SEQ ID NO: 1524376 - RNA, 13 nt, Homo sapiens
uaaugacauacuu

SEQ ID NO: 1524377 - RNA, 15 nt, Homo sapiens
uaaugucaccaccuu

SEQ ID NO: 1524378 - RNA, 14 nt, Homo sapiens
uaauguugaugaau

SEQ ID NO: 1524379 - RNA, 14 nt, Homo sapiens
uaauuauauuucua

SEQ ID NO: 1524380 - RNA, 16 nt, Homo sapiens
uaauuugugaauuugc

SEQ ID NO: 1524381 - RNA, 18 nt, Homo sapiens
uaauuugugaauuugcaa

SEQ ID NO: 1524382 - RNA, 14 nt, Homo sapiens
uacauuugugcugu

SEQ ID NO: 1524383 - RNA, 19 nt, Homo sapiens
uaccucaaaacacuuuccc

SEQ ID NO: 1524384 - RNA, 21 nt, Homo sapiens
uaccuuugaaauauuaaaauc

SEQ ID NO: 1524385 - RNA, 22 nt, Homo sapiens
uaccuuugacuuuuuggcuuua

SEQ ID NO: 1524386 - RNA, 18 nt, Homo sapiens
uacuauauaauauaucau

SEQ ID NO: 1524387 - RNA, 15 nt, Homo sapiens
uagaagugcaagaaa

SEQ ID NO: 1524388 - RNA, 19 nt, Homo sapiens
uagcacacaauaagcauuc

SEQ ID NO: 1524389 - RNA, 19 nt, Homo sapiens
uagccaugauaacugcaau

SEQ ID NO: 1524390 - RNA, 20 nt, Homo sapiens
uagcgcugccgcaccccaga

SEQ ID NO: 1524391 - RNA, 17 nt, Homo sapiens
uagcuagaagugggcca

SEQ ID NO: 1524392 - RNA, 22 nt, Homo sapiens
uauaaacugagaggucacaaag

SEQ ID NO: 1524393 - RNA, 19 nt, Homo sapiens
uauaaagcaaauuacucca

SEQ ID NO: 1524394 - RNA, 15 nt, Homo sapiens
uauaacaaacuacau

SEQ ID NO: 1524395 - RNA, 21 nt, Homo sapiens
uauaacaaacuacauguaauc

SEQ ID NO: 1524396 - RNA, 17 nt, Homo sapiens
uauaauaauauacugua

SEQ ID NO: 1524397 - RNA, 12 nt, Homo sapiens
uauaccaaaggu

SEQ ID NO: 1524398 - RNA, 17 nt, Homo sapiens
uauaucgcuuaaucuua

SEQ ID NO: 1524399 - RNA, 15 nt, Homo sapiens
uauaugcagaauuac

SEQ ID NO: 1524400 - RNA, 22 nt, Homo sapiens
uaucauaucucucuuuacuucc

SEQ ID NO: 1524401 - RNA, 21 nt, Homo sapiens
uauccaacaugugcucaggga

SEQ ID NO: 1524402 - RNA, 15 nt, Homo sapiens
uaucgcaaaucacaa

SEQ ID NO: 1524403 - RNA, 17 nt, Homo sapiens
uaugaaaccccaaugcu

SEQ ID NO: 1524404 - RNA, 19 nt, Homo sapiens
uaugcagauuauuugccca

SEQ ID NO: 1524405 - RNA, 16 nt, Homo sapiens
uauggcacccaugcac

SEQ ID NO: 1524406 - RNA, 18 nt, Homo sapiens
uaugucauauuuugccac

SEQ ID NO: 1524407 - RNA, 17 nt, Homo sapiens
uauucuccauccuccca

SEQ ID NO: 1524408 - RNA, 19 nt, Homo sapiens
uauuugcccaaaucuucuu

SEQ ID NO: 1524409 - RNA, 14 nt, Homo sapiens
uauuuuauguauau

SEQ ID NO: 1524410 - RNA, 22 nt, Homo sapiens
uauuuugccagugggaacuccu

SEQ ID NO: 1524411 - RNA, 16 nt, Homo sapiens
ucaaaacacuuuccca

SEQ ID NO: 1524412 - RNA, 12 nt, Homo sapiens
ucaaaagcaauc

SEQ ID NO: 1524413 - RNA, 12 nt, Homo sapiens
ucaaaaggugcc

SEQ ID NO: 1524414 - RNA, 18 nt, Homo sapiens
ucaaaggcaaugcucaaa

SEQ ID NO: 1524415 - RNA, 20 nt, Homo sapiens
ucaaaggcaaugcucaaaca

SEQ ID NO: 1524416 - RNA, 19 nt, Homo sapiens
ucaaaugucagagcuaugu

SEQ ID NO: 1524417 - RNA, 18 nt, Homo sapiens
ucaaucucugauucuguc

SEQ ID NO: 1524418 - RNA, 22 nt, Homo sapiens
ucacaacgggccagcucuagua

SEQ ID NO: 1524419 - RNA, 20 nt, Homo sapiens
cugcaauuuuaauugauuau

SEQ ID NO: 1524420 - RNA, 15 nt, Homo sapiens
cugccagcucaggau

SEQ ID NO: 1524421 - RNA, 18 nt, Homo sapiens
cugccuaaguggcugcug

SEQ ID NO: 1524422 - RNA, 16 nt, Homo sapiens
cugcgcaggccaugca

SEQ ID NO: 1524423 - RNA, 16 nt, Homo sapiens
cugcuaauagcugcua

SEQ ID NO: 1524424 - RNA, 14 nt, Homo sapiens
cugcucacuuucca

SEQ ID NO: 1524425 - RNA, 16 nt, Homo sapiens
cugcuccaccuugaac

SEQ ID NO: 1524426 - RNA, 21 nt, Homo sapiens
cugcuuaggugccaggcaugu

SEQ ID NO: 1524427 - RNA, 16 nt, Homo sapiens
cugggccccaccaccu

SEQ ID NO: 1524428 - RNA, 16 nt, Homo sapiens
cuguacuguaauuucu

SEQ ID NO: 1524429 - RNA, 19 nt, Homo sapiens
cuguccaggacaugauacu

SEQ ID NO: 1524430 - RNA, 15 nt, Homo sapiens
cuguuccuuguguaa

SEQ ID NO: 1524431 - RNA, 18 nt, Homo sapiens
cuuaaaugacagugaauu

SEQ ID NO: 1524432 - RNA, 12 nt, Homo sapiens
cuuaaauuucca

SEQ ID NO: 1524433 - RNA, 22 nt, Homo sapiens
cuuaauagguucaaaagcaauc

SEQ ID NO: 1524434 - RNA, 20 nt, Homo sapiens
cuuacauuugaaaucuauga

SEQ ID NO: 1524435 - RNA, 19 nt, Homo sapiens
cuucccaaaucugucuccc

SEQ ID NO: 1524436 - RNA, 19 nt, Homo sapiens
cuucuaccuuaaaauguaa

SEQ ID NO: 1524437 - RNA, 12 nt, Homo sapiens
cuucuguuccag

SEQ ID NO: 1524438 - RNA, 14 nt, Homo sapiens
cuucuucagauuca

SEQ ID NO: 1524439 - RNA, 16 nt, Homo sapiens
cuucuucagauucagc

SEQ ID NO: 1524440 - RNA, 16 nt, Homo sapiens
cuugaagaauguugau

SEQ ID NO: 1524441 - RNA, 23 nt, Homo sapiens
cuugaagaauguugauggugcua

SEQ ID NO: 1524442 - RNA, 23 nt, Homo sapiens
cuugacuguaaagagaaguaauu

SEQ ID NO: 1524443 - RNA, 16 nt, Homo sapiens
cuugcccugaccuccc

SEQ ID NO: 1524444 - RNA, 22 nt, Homo sapiens
cuuuaaacuacccuccagagug

SEQ ID NO: 1524445 - RNA, 16 nt, Homo sapiens
cuuucacgcugaaaca

SEQ ID NO: 1524446 - RNA, 24 nt, Homo sapiens
cuuucaggccacauggcuaaagaa

SEQ ID NO: 1524447 - RNA, 15 nt, Homo sapiens
cuuucgaaagcaaug

SEQ ID NO: 1524448 - RNA, 12 nt, Homo sapiens
cuuugcauucau

SEQ ID NO: 1524449 - RNA, 13 nt, Homo sapiens
cuuugccauuucu

SEQ ID NO: 1524450 - RNA, 15 nt, Homo sapiens
cuuugccauuucuuc

SEQ ID NO: 1524451 - RNA, 15 nt, Homo sapiens
cuuuggaaaucacac

SEQ ID NO: 1524452 - RNA, 17 nt, Homo sapiens
cuuuguaagaaaaccaa

SEQ ID NO: 1524453 - RNA, 21 nt, Homo sapiens
cuuuugcauaagugcaugaca

SEQ ID NO: 1524454 - RNA, 20 nt, Homo sapiens
cuuuuuggcuuuaagccauu

SEQ ID NO: 1524455 - RNA, 12 nt, Homo sapiens
gaaaaacaggga

SEQ ID NO: 1524456 - RNA, 17 nt, Homo sapiens
gaaaaagaccugcauuu

SEQ ID NO: 1524457 - RNA, 16 nt, Homo sapiens
gaaaaagugcuuauua

SEQ ID NO: 1524458 - RNA, 15 nt, Homo sapiens
gaaaaauaaaaacca

SEQ ID NO: 1524459 - RNA, 12 nt, Homo sapiens
gaaaaccauaug

SEQ ID NO: 1524460 - RNA, 15 nt, Homo sapiens
gaaaacugcaacuug

SEQ ID NO: 1524461 - RNA, 22 nt, Homo sapiens
gaaacaauguauugucugccca

SEQ ID NO: 1524462 - RNA, 14 nt, Homo sapiens
gaaagaagugggga

SEQ ID NO: 1524463 - RNA, 22 nt, Homo sapiens
gaaauacaguauaccgcagugg

SEQ ID NO: 1524464 - RNA, 14 nt, Homo sapiens
gaaaucaacuugug

SEQ ID NO: 1524465 - RNA, 19 nt, Homo sapiens
gaaaucuaugaaauaucau

SEQ ID NO: 1524466 - RNA, 22 nt, Homo sapiens
gaacauaucauuugugaagaau

SEQ ID NO: 1524467 - RNA, 16 nt, Homo sapiens
gaacaugaccaaaaac

SEQ ID NO: 1524468 - RNA, 16 nt, Homo sapiens
gaaccaggcaacuugg

SEQ ID NO: 1524469 - RNA, 18 nt, Homo sapiens
gaaccaggcaacuuggga

SEQ ID NO: 1524470 - RNA, 12 nt, Homo sapiens
gaaccucagggc

SEQ ID NO: 1524471 - RNA, 19 nt, Homo sapiens
gaagaauguugauggugcu

SEQ ID NO: 1524472 - RNA, 21 nt, Homo sapiens
gaagaauguugauggugcuag

SEQ ID NO: 1524473 - RNA, 21 nt, Homo sapiens
gaagcuguguccuugcaccug

SEQ ID NO: 1524474 - RNA, 12 nt, Homo sapiens
gaaggagggaga

SEQ ID NO: 1524475 - RNA, 13 nt, Homo sapiens
gaagugugugauc

SEQ ID NO: 1524476 - RNA, 16 nt, Homo sapiens
gaagugugugaucugu

SEQ ID NO: 1524477 - RNA, 17 nt, Homo sapiens
gaaguuuaaaacccaaa

SEQ ID NO: 1524478 - RNA, 17 nt, Homo sapiens
gaauaaaauugcacuuu

SEQ ID NO: 1524479 - RNA, 14 nt, Homo sapiens
gaauagugccugaa

SEQ ID NO: 1524480 - RNA, 17 nt, Homo sapiens
gaaucgccccagacucc

SEQ ID NO: 1524481 - RNA, 15 nt, Homo sapiens
gaaugaaugacauga

SEQ ID NO: 1524482 - RNA, 20 nt, Homo sapiens
gaaugcggccgcauucccug

SEQ ID NO: 1524483 - RNA, 23 nt, Homo sapiens
gaauguuccuuucgaaagcaaug

SEQ ID NO: 1524484 - RNA, 17 nt, Homo sapiens
gaauguugauggugcua

SEQ ID NO: 1524485 - RNA, 24 nt, Homo sapiens
gaauuauucagugaauuuguccau

SEQ ID NO: 1524486 - RNA, 20 nt, Homo sapiens
gaauuuuucuaaaggugcua

SEQ ID NO: 1524487 - RNA, 13 nt, Homo sapiens
gacaacuucccaa

SEQ ID NO: 1524488 - RNA, 15 nt, Homo sapiens
gacagauggaccaaa

SEQ ID NO: 1524489 - RNA, 18 nt, Homo sapiens
gacagauggaccaaaaga

SEQ ID NO: 1524490 - RNA, 19 nt, Homo sapiens
gacauacuuggagagcaaa

SEQ ID NO: 1524491 - RNA, 22 nt, Homo sapiens
gaccaaccgaacaugaccaaaa

SEQ ID NO: 1524492 - RNA, 22 nt, Homo sapiens
gacuaugucacccaaugcauau

SEQ ID NO: 1524493 - RNA, 13 nt, Homo sapiens
gacuucacacugc

SEQ ID NO: 1524494 - RNA, 20 nt, Homo sapiens
gacuuuuuuuaaauaguaaa

SEQ ID NO: 1524495 - RNA, 14 nt, Homo sapiens
gagaagcagugagc

SEQ ID NO: 1524496 - RNA, 19 nt, Homo sapiens
gagacaugagcauggcuga

SEQ ID NO: 1524497 - RNA, 21 nt, Homo sapiens
gagaccuccccauguacauaa

SEQ ID NO: 1524498 - RNA, 20 nt, Homo sapiens
gagacucaccucugccucaa

SEQ ID NO: 1524499 - RNA, 19 nt, Homo sapiens
gagacuguucuguuccuug

SEQ ID NO: 1524500 - RNA, 22 nt, Homo sapiens
gagucaauccccucauucagga

SEQ ID NO: 1524501 - RNA, 13 nt, Homo sapiens
gauccacauuguu

SEQ ID NO: 1524502 - RNA, 19 nt, Homo sapiens
gaucucccugccgccucaa

SEQ ID NO: 1524503 - RNA, 13 nt, Homo sapiens
gauggaccaaaag

SEQ ID NO: 1524504 - RNA, 13 nt, Homo sapiens
gaugugggguccc

SEQ ID NO: 1524505 - RNA, 21 nt, Homo sapiens
gauguguccuagacuccgggu

SEQ ID NO: 1524506 - RNA, 14 nt, Homo sapiens
gauguuacugagau

SEQ ID NO: 1524507 - RNA, 18 nt, Homo sapiens
gauuauaagaguaauaua

SEQ ID NO: 1524508 - RNA, 13 nt, Homo sapiens
gauuauuugccca

SEQ ID NO: 1524509 - RNA, 19 nt, Homo sapiens
gauuauuugcccaaaucuu

SEQ ID NO: 1524510 - RNA, 13 nt, Homo sapiens
gauuccacuuuua

SEQ ID NO: 1524511 - RNA, 18 nt, Homo sapiens
gauugaucagagcauugu

SEQ ID NO: 1524512 - RNA, 21 nt, Homo sapiens
gcaagcaagaaacacugggcu

SEQ ID NO: 1524513 - RNA, 21 nt, Homo sapiens
gcaaugcucaaacacccaagu

SEQ ID NO: 1524514 - RNA, 13 nt, Homo sapiens
gcagccucaggag

SEQ ID NO: 1524515 - RNA, 22 nt, Homo sapiens
gcaggacggguaccaugcugcc

SEQ ID NO: 1524516 - RNA, 20 nt, Homo sapiens
gcagggccuugcccagagau

SEQ ID NO: 1524517 - RNA, 13 nt, Homo sapiens
gcauaaagcaauu

SEQ ID NO: 1524518 - RNA, 18 nt, Homo sapiens
gcauagaguucagacuuu

SEQ ID NO: 1524519 - RNA, 19 nt, Homo sapiens
gcauggcucccgaguacag

SEQ ID NO: 1524520 - RNA, 22 nt, Homo sapiens
gcauuaucuaugauaugcuaau

SEQ ID NO: 1524521 - RNA, 16 nt, Homo sapiens
gcauucagccaggaga

SEQ ID NO: 1524522 - RNA, 18 nt, Homo sapiens
gcauuuguucuuugccag

SEQ ID NO: 1524523 - RNA, 13 nt, Homo sapiens
gcccagcccagcu

SEQ ID NO: 1524524 - RNA, 16 nt, Homo sapiens
gcccuuucugcuccuu

SEQ ID NO: 1524525 - RNA, 13 nt, Homo sapiens
gccgucugcacuu

SEQ ID NO: 1524526 - RNA, 14 nt, Homo sapiens
gccuaugugcaugc

SEQ ID NO: 1524527 - RNA, 18 nt, Homo sapiens
gccuccaccgcugccuaa

SEQ ID NO: 1524528 - RNA, 22 nt, Homo sapiens
gcgcaagccuguaaucccagcu

SEQ ID NO: 1524529 - RNA, 17 nt, Homo sapiens
gcuauaacuauguugau

SEQ ID NO: 1524530 - RNA, 14 nt, Homo sapiens
gcucaaacacccaa

SEQ ID NO: 1524531 - RNA, 19 nt, Homo sapiens
gcucagggaauaauccaga

SEQ ID NO: 1524532 - RNA, 20 nt, Homo sapiens
gcuccccauuuuauaccaaa

SEQ ID NO: 1524533 - RNA, 15 nt, Homo sapiens
gcucccuccuagucu

SEQ ID NO: 1524534 - RNA, 19 nt, Homo sapiens
gcuccugccagcucaggau

SEQ ID NO: 1524535 - RNA, 22 nt, Homo sapiens
gcugauguuuauaaacugagag

SEQ ID NO: 1524536 - RNA, 22 nt, Homo sapiens
gcugcucacuuuccacccucuc

SEQ ID NO: 1524537 - RNA, 16 nt, Homo sapiens
gcuggaccugcugaca

SEQ ID NO: 1524538 - RNA, 13 nt, Homo sapiens
gcugucaucucag

SEQ ID NO: 1524539 - RNA, 17 nt, Homo sapiens
gcuuaugaaaccccaau

SEQ ID NO: 1524540 - RNA, 21 nt, Homo sapiens
gcuuaugacagagguuuugaa

SEQ ID NO: 1524541 - RNA, 18 nt, Homo sapiens
gcuuaugcuuguguauau

SEQ ID NO: 1524542 - RNA, 17 nt, Homo sapiens
gcuuauuauagaauugc

SEQ ID NO: 1524543 - RNA, 15 nt, Homo sapiens
gcuuuugguaauauu

SEQ ID NO: 1524544 - RNA, 20 nt, Homo sapiens
aauugaaaaauaaaaaccau

SEQ ID NO: 1524545 - RNA, 17 nt, Homo sapiens
aauuguggcuguucacu

SEQ ID NO: 1524546 - RNA, 16 nt, Homo sapiens
aauuuagucacaccau

SEQ ID NO: 1524547 - RNA, 14 nt, Homo sapiens
aauuucagucaauu

SEQ ID NO: 1524548 - RNA, 18 nt, Homo sapiens
aauuugcaacaguaauca

SEQ ID NO: 1524549 - RNA, 13 nt, Homo sapiens
aauuuuaauugau

SEQ ID NO: 1524550 - RNA, 13 nt, Homo sapiens
aauuuugcuccuu

SEQ ID NO: 1524551 - RNA, 16 nt, Homo sapiens
aauuuuguugcuacau

SEQ ID NO: 1524552 - RNA, 19 nt, Homo sapiens
aauuuuucuaaaggugcua

SEQ ID NO: 1524553 - RNA, 16 nt, Homo sapiens
acaacuaugauuugga

SEQ ID NO: 1524554 - RNA, 17 nt, Homo sapiens
acaauacaugcugcuaa

SEQ ID NO: 1524555 - RNA, 19 nt, Homo sapiens
acaauguauugucugccca

SEQ ID NO: 1524556 - RNA, 23 nt, Homo sapiens
acacuggauuuguuucugugauc

SEQ ID NO: 1524557 - RNA, 20 nt, Homo sapiens
acagagauaauucuagcuuu

SEQ ID NO: 1524558 - RNA, 17 nt, Homo sapiens
acagagcagaacuuuca

SEQ ID NO: 1524559 - RNA, 22 nt, Homo sapiens
acagaugugugauucacagugu

SEQ ID NO: 1524560 - RNA, 15 nt, Homo sapiens
acagcugucccuguc

SEQ ID NO: 1524561 - RNA, 19 nt, Homo sapiens
acagcuucuucaucuuuaa

SEQ ID NO: 1524562 - RNA, 13 nt, Homo sapiens
acaggcacuauaa

SEQ ID NO: 1524563 - RNA, 22 nt, Homo sapiens
acagggugcuccuugucaauac

SEQ ID NO: 1524564 - RNA, 12 nt, Homo sapiens
acauauuuagcg

SEQ ID NO: 1524565 - RNA, 14 nt, Homo sapiens
acaucaaauuugcc

SEQ ID NO: 1524566 - RNA, 13 nt, Homo sapiens
acaugaccaaaaa

SEQ ID NO: 1524567 - RNA, 21 nt, Homo sapiens
acauggcuaaagaagguuuca

SEQ ID NO: 1524568 - RNA, 23 nt, Homo sapiens
acauuuacuuuaauuuccuugac

SEQ ID NO: 1524569 - RNA, 18 nt, Homo sapiens
acauuugacuucuagaaa

SEQ ID NO: 1524570 - RNA, 12 nt, Homo sapiens
accaacuuuccc

SEQ ID NO: 1524571 - RNA, 21 nt, Homo sapiens
accaaugcaacauuugugcag

SEQ ID NO: 1524572 - RNA, 12 nt, Homo sapiens
accaauguagaa

SEQ ID NO: 1524573 - RNA, 14 nt, Homo sapiens
accaaugucauaac

SEQ ID NO: 1524574 - RNA, 15 nt, Homo sapiens
accacaccaaugcaa

SEQ ID NO: 1524575 - RNA, 20 nt, Homo sapiens
accaugcauuuaaaguauuc

SEQ ID NO: 1524576 - RNA, 17 nt, Homo sapiens
acccauuuccuugugcu

SEQ ID NO: 1524577 - RNA, 14 nt, Homo sapiens
acccucaaauguca

SEQ ID NO: 1524578 - RNA, 17 nt, Homo sapiens
accgaacaugaccaaaa

SEQ ID NO: 1524579 - RNA, 18 nt, Homo sapiens
accgaacaugaccaaaaa

SEQ ID NO: 1524580 - RNA, 22 nt, Homo sapiens
accucagggcuguguguacuaa

SEQ ID NO: 1524581 - RNA, 13 nt, Homo sapiens
accucguccuccc

SEQ ID NO: 1524582 - RNA, 23 nt, Homo sapiens
accugcaccuccccccacugcag

SEQ ID NO: 1524583 - RNA, 14 nt, Homo sapiens
accuuaaaauguaa

SEQ ID NO: 1524584 - RNA, 12 nt, Homo sapiens
acgaaggugagg

SEQ ID NO: 1524585 - RNA, 17 nt, Homo sapiens
acgggccagcucuagua

SEQ ID NO: 1524586 - RNA, 18 nt, Homo sapiens
acgugaccucugcaagac

SEQ ID NO: 1524587 - RNA, 18 nt, Homo sapiens
acuauggcucuacuuuca

SEQ ID NO: 1524588 - RNA, 23 nt, Homo sapiens
acucucauuccccagguggcuga

SEQ ID NO: 1524589 - RNA, 15 nt, Homo sapiens
acugaaaaaugucag

SEQ ID NO: 1524590 - RNA, 19 nt, Homo sapiens
acugaaggagaaggugccc

SEQ ID NO: 1524591 - RNA, 20 nt, Homo sapiens
acugaauuuuaaauguucac

SEQ ID NO: 1524592 - RNA, 13 nt, Homo sapiens
acugagaugcaaa

SEQ ID NO: 1524593 - RNA, 10 nt, Homo sapiens
acugcaauaa

SEQ ID NO: 1524594 - RNA, 12 nt, Homo sapiens
acugccaaagaa

SEQ ID NO: 1524595 - RNA, 18 nt, Homo sapiens
acugcccuggccuuugca

SEQ ID NO: 1524596 - RNA, 13 nt, Homo sapiens
acugggcuucuag

SEQ ID NO: 1524597 - RNA, 16 nt, Homo sapiens
acuguaggcagggaac

SEQ ID NO: 1524598 - RNA, 18 nt, Homo sapiens
acuguugcuuugggagac

SEQ ID NO: 1524599 - RNA, 22 nt, Homo sapiens
acuucaaggguuuguugaacaa

SEQ ID NO: 1524600 - RNA, 11 nt, Homo sapiens
acuucuguucc

SEQ ID NO: 1524601 - RNA, 17 nt, Homo sapiens
acuuuaauuuccuugac

SEQ ID NO: 1524602 - RNA, 16 nt, Homo sapiens
acuuucucuuugccau

SEQ ID NO: 1524603 - RNA, 15 nt, Homo sapiens
agaaaaacaaugaaa

SEQ ID NO: 1524604 - RNA, 15 nt, Homo sapiens
agaaagcucaucuca

SEQ ID NO: 1524605 - RNA, 22 nt, Homo sapiens
agaagacacaggaaacaaugua

SEQ ID NO: 1524606 - RNA, 12 nt, Homo sapiens
agaagacugggc

SEQ ID NO: 1524607 - RNA, 20 nt, Homo sapiens
agaagucccucccaucucua

SEQ ID NO: 1524608 - RNA, 17 nt, Homo sapiens
agaauguaucuccuccu

SEQ ID NO: 1524609 - RNA, 23 nt, Homo sapiens
agaauguucuuauguugcccagu

SEQ ID NO: 1524610 - RNA, 17 nt, Homo sapiens
agaauguugauggugcu

SEQ ID NO: 1524611 - RNA, 15 nt, Homo sapiens
agacaacuucccaaa

SEQ ID NO: 1524612 - RNA, 19 nt, Homo sapiens
agacaagcaacccaaacug

SEQ ID NO: 1524613 - RNA, 17 nt, Homo sapiens
agaccuccccauguaca

SEQ ID NO: 1524614 - RNA, 15 nt, Homo sapiens
agacuaugucaccca

SEQ ID NO: 1524615 - RNA, 16 nt, Homo sapiens
agacucccaagcugga

SEQ ID NO: 1524616 - RNA, 17 nt, Homo sapiens
agacucccaagcuggac

SEQ ID NO: 1524617 - RNA, 20 nt, Homo sapiens
agagacaacuucccaaagca

SEQ ID NO: 1524618 - RNA, 12 nt, Homo sapiens
agagacccaagg

SEQ ID NO: 1524619 - RNA, 15 nt, Homo sapiens
agagaugucaucaga

SEQ ID NO: 1524620 - RNA, 16 nt, Homo sapiens
agagaugucaucagag

SEQ ID NO: 1524621 - RNA, 15 nt, Homo sapiens
agaggagaaggaggg

SEQ ID NO: 1524622 - RNA, 21 nt, Homo sapiens
agaggagagagacuccagcug

SEQ ID NO: 1524623 - RNA, 22 nt, Homo sapiens
agaggaugucucaaacuucaga

SEQ ID NO: 1524624 - RNA, 13 nt, Homo sapiens
agaggggaaaaug

SEQ ID NO: 1524625 - RNA, 22 nt, Homo sapiens
agaguguuuggggguuccguga

SEQ ID NO: 1524626 - RNA, 15 nt, Homo sapiens
agaguucugcucuag

SEQ ID NO: 1524627 - RNA, 20 nt, Homo sapiens
agauaacaaucuguauauaa

SEQ ID NO: 1524628 - RNA, 21 nt, Homo sapiens
agaucauauuguauauaguua

SEQ ID NO: 1524629 - RNA, 24 nt, Homo sapiens
agauccacccuaucccuguacaga

SEQ ID NO: 1524630 - RNA, 22 nt, Homo sapiens
agaugugugauucacaguguga

SEQ ID NO: 1524631 - RNA, 18 nt, Homo sapiens
agauuugcuguucaccca

SEQ ID NO: 1524632 - RNA, 21 nt, Homo sapiens
agauuugcuguucacccacau

SEQ ID NO: 1524633 - RNA, 12 nt, Homo sapiens
agcaaagacuuu

SEQ ID NO: 1524634 - RNA, 21 nt, Homo sapiens
agcaaugcuucuaucaaauac

SEQ ID NO: 1524635 - RNA, 15 nt, Homo sapiens
agcagaaacaucgga

SEQ ID NO: 1524636 - RNA, 14 nt, Homo sapiens
agcagaacuuucac

SEQ ID NO: 1524637 - RNA, 16 nt, Homo sapiens
agcauugagaucucca

SEQ ID NO: 1524638 - RNA, 17 nt, Homo sapiens
agcauuuguucuuugcc

SEQ ID NO: 1524639 - RNA, 19 nt, Homo sapiens
agccacagcuucuucaucu

SEQ ID NO: 1524640 - RNA, 23 nt, Homo sapiens
agccauggcuucgucauuugcaa

SEQ ID NO: 1524641 - RNA, 19 nt, Homo sapiens
agcccagcccgcugcucac

SEQ ID NO: 1524642 - RNA, 18 nt, Homo sapiens
agccuggguggaaggcag

SEQ ID NO: 1524643 - RNA, 19 nt, Homo sapiens
agcugaauccuuccauuuc

SEQ ID NO: 1524644 - RNA, 18 nt, Homo sapiens
agcugccauaauaaugcc

SEQ ID NO: 1524645 - RNA, 21 nt, Homo sapiens
agcuggguuggaaaacaguau

SEQ ID NO: 1524646 - RNA, 13 nt, Homo sapiens
agcuuaagaauuu

SEQ ID NO: 1524647 - RNA, 21 nt, Homo sapiens
agcuuugagcuuaagaauuuu

SEQ ID NO: 1524648 - RNA, 14 nt, Homo sapiens
aggaaccucagggc

SEQ ID NO: 1524649 - RNA, 18 nt, Homo sapiens
aggaagcauaaagcaauu

SEQ ID NO: 1524650 - RNA, 22 nt, Homo sapiens
aggagacucaccucugccucaa

SEQ ID NO: 1524651 - RNA, 14 nt, Homo sapiens
aggauguguccuag

SEQ ID NO: 1524652 - RNA, 14 nt, Homo sapiens
aggcauccaugaaa

SEQ ID NO: 1524653 - RNA, 23 nt, Homo sapiens
agggcaacaauacaugcugcuaa

SEQ ID NO: 1524654 - RNA, 16 nt, Homo sapiens
agggugcuccuuguca

SEQ ID NO: 1524655 - RNA, 21 nt, Homo sapiens
aggguucaccaggucagggag

SEQ ID NO: 1524656 - RNA, 22 nt, Homo sapiens
aggugcccaggaaccucagggc

SEQ ID NO: 1524657 - RNA, 20 nt, Homo sapiens
aggugguauguuugggagac

SEQ ID NO: 1524658 - RNA, 20 nt, Homo sapiens
aguaacguacauuugugcug

SEQ ID NO: 1524659 - RNA, 19 nt, Homo sapiens
aguaauuuugcuccuugau

SEQ ID NO: 1524660 - RNA, 16 nt, Homo sapiens
aguagggguugaagaa

SEQ ID NO: 1524661 - RNA, 13 nt, Homo sapiens
aguaguaucugcu

SEQ ID NO: 1524662 - RNA, 18 nt, Homo sapiens
aguauuauugagcucuau

SEQ ID NO: 1524663 - RNA, 17 nt, Homo sapiens
agucaaccaauguagaa

SEQ ID NO: 1524664 - RNA, 23 nt, Homo sapiens
agucaauccccucauucaggaaa

SEQ ID NO: 1524665 - RNA, 13 nt, Homo sapiens
agucacaccaucu

SEQ ID NO: 1524666 - RNA, 20 nt, Homo sapiens
agucacagagauaauucuag

SEQ ID NO: 1524667 - RNA, 21 nt, Homo sapiens
agucccucccaucucuacccc

SEQ ID NO: 1524668 - RNA, 19 nt, Homo sapiens
cacaguaaugcaagcaaag

SEQ ID NO: 1524669 - RNA, 12 nt, Homo sapiens
cacagugugaau

SEQ ID NO: 1524670 - RNA, 14 nt, Homo sapiens
cacaucuaaugucu

SEQ ID NO: 1524671 - RNA, 16 nt, Homo sapiens
cacaucuaaugucucu

SEQ ID NO: 1524672 - RNA, 23 nt, Homo sapiens
cacccaaaagucaaaaggugccu

SEQ ID NO: 1524673 - RNA, 16 nt, Homo sapiens
cacccacgagcacuuu

SEQ ID NO: 1524674 - RNA, 13 nt, Homo sapiens
cacccaugcaccu

SEQ ID NO: 1524675 - RNA, 15 nt, Homo sapiens
cacccucaaauguca

SEQ ID NO: 1524676 - RNA, 16 nt, Homo sapiens
cacccucaaaugucag

SEQ ID NO: 1524677 - RNA, 17 nt, Homo sapiens
cacccucaaaugucaga

SEQ ID NO: 1524678 - RNA, 19 nt, Homo sapiens
cacgucaagcuuuggauaa

SEQ ID NO: 1524679 - RNA, 22 nt, Homo sapiens
cacuagccaugauaacugcaau

SEQ ID NO: 1524680 - RNA, 16 nt, Homo sapiens
cacuauccucacuccc

SEQ ID NO: 1524681 - RNA, 15 nt, Homo sapiens
cacucccgaggaugu

SEQ ID NO: 1524682 - RNA, 22 nt, Homo sapiens
cacugggcuucuagaaccaggc

SEQ ID NO: 1524683 - RNA, 15 nt, Homo sapiens
cacuuuccacccucu

SEQ ID NO: 1524684 - RNA, 14 nt, Homo sapiens
cagaaaaacugugg

SEQ ID NO: 1524685 - RNA, 17 nt, Homo sapiens
cagaaaaacugugggua

SEQ ID NO: 1524686 - RNA, 16 nt, Homo sapiens
cagaaaagcaccugcc

SEQ ID NO: 1524687 - RNA, 17 nt, Homo sapiens
cagacaagcaacccaaa

SEQ ID NO: 1524688 - RNA, 20 nt, Homo sapiens
cagaccgggguucaagccau

SEQ ID NO: 1524689 - RNA, 16 nt, Homo sapiens
cagaccugaaucacaa

SEQ ID NO: 1524690 - RNA, 14 nt, Homo sapiens
cagagacaccugca

SEQ ID NO: 1524691 - RNA, 19 nt, Homo sapiens
cagagauaauucuagcuuu

SEQ ID NO: 1524692 - RNA, 21 nt, Homo sapiens
cagagauaauucuagcuuuga

SEQ ID NO: 1524693 - RNA, 15 nt, Homo sapiens
cagaguucugcucua

SEQ ID NO: 1524694 - RNA, 15 nt, Homo sapiens
cagauggaccaaaag

SEQ ID NO: 1524695 - RNA, 18 nt, Homo sapiens
cagcagugguauuaauac

SEQ ID NO: 1524696 - RNA, 19 nt, Homo sapiens
cagcauuuguucuuugcca

SEQ ID NO: 1524697 - RNA, 11 nt, Homo sapiens
cagcccauucu

SEQ ID NO: 1524698 - RNA, 13 nt, Homo sapiens
cagcucagagaug

SEQ ID NO: 1524699 - RNA, 13 nt, Homo sapiens
caggaagauguau

SEQ ID NO: 1524700 - RNA, 23 nt, Homo sapiens
caggcacgaacccaccugcugag

SEQ ID NO: 1524701 - RNA, 16 nt, Homo sapiens
caggccucugcucucc

SEQ ID NO: 1524702 - RNA, 19 nt, Homo sapiens
cagggaaagucuuagcuga

SEQ ID NO: 1524703 - RNA, 22 nt, Homo sapiens
cagggaaagucuuagcugagaa

SEQ ID NO: 1524704 - RNA, 15 nt, Homo sapiens
cagggcuggggccaa

SEQ ID NO: 1524705 - RNA, 15 nt, Homo sapiens
cagggcuguguguac

SEQ ID NO: 1524706 - RNA, 16 nt, Homo sapiens
caguagcuguggugag

SEQ ID NO: 1524707 - RNA, 21 nt, Homo sapiens
cagugcccaccaacaucccau

SEQ ID NO: 1524708 - RNA, 12 nt, Homo sapiens
caguguguuucu

SEQ ID NO: 1524709 - RNA, 19 nt, Homo sapiens
caguguguuucugaucuga

SEQ ID NO: 1524710 - RNA, 21 nt, Homo sapiens
caguuugauuguuguuuauaa

SEQ ID NO: 1524711 - RNA, 14 nt, Homo sapiens
cauaaacauuugca

SEQ ID NO: 1524712 - RNA, 23 nt, Homo sapiens
cauaauuucuucacucaaucucu

SEQ ID NO: 1524713 - RNA, 19 nt, Homo sapiens
cauauuuugccacugccuu

SEQ ID NO: 1524714 - RNA, 19 nt, Homo sapiens
caucagcuguuaaccauuu

SEQ ID NO: 1524715 - RNA, 11 nt, Homo sapiens
caucaucccag

SEQ ID NO: 1524716 - RNA, 16 nt, Homo sapiens
cauccaggacugagau

SEQ ID NO: 1524717 - RNA, 12 nt, Homo sapiens
cauccuuccuau

SEQ ID NO: 1524718 - RNA, 18 nt, Homo sapiens
caugaccaaaaaccaaaa

SEQ ID NO: 1524719 - RNA, 17 nt, Homo sapiens
caugcguuuaaucacau

SEQ ID NO: 1524720 - RNA, 17 nt, Homo sapiens
cauggaaaacagaguau

SEQ ID NO: 1524721 - RNA, 13 nt, Homo sapiens
cauuaucuaugau

SEQ ID NO: 1524722 - RNA, 16 nt, Homo sapiens
cauuauuuaauuugua

SEQ ID NO: 1524723 - RNA, 18 nt, Homo sapiens
cauucaaccuuaccaaaa

SEQ ID NO: 1524724 - RNA, 11 nt, Homo sapiens
cauucccugag

SEQ ID NO: 1524725 - RNA, 23 nt, Homo sapiens
cauuugaaaucuaugaaauauca

SEQ ID NO: 1524726 - RNA, 20 nt, Homo sapiens
cauuuuugccagucuguuaa

SEQ ID NO: 1524727 - RNA, 20 nt, Homo sapiens
ccaaaucuucuucagauuca

SEQ ID NO: 1524728 - RNA, 21 nt, Homo sapiens
ccaaccgaacaugaccaaaaa

SEQ ID NO: 1524729 - RNA, 22 nt, Homo sapiens
ccaaugcugcccuuucugcucc

SEQ ID NO: 1524730 - RNA, 16 nt, Homo sapiens
ccacccaaaagucaaa

SEQ ID NO: 1524731 - RNA, 20 nt, Homo sapiens
ccagaaauagccacuauuaa

SEQ ID NO: 1524732 - RNA, 13 nt, Homo sapiens
agaagaaacugac

SEQ ID NO: 1524733 - RNA, 20 nt, Homo sapiens
agaagaaauacuccuguauu

SEQ ID NO: 1524734 - RNA, 14 nt, Homo sapiens
agaagccuugccau

SEQ ID NO: 1524735 - RNA, 16 nt, Homo sapiens
agaagccuugccaucu

SEQ ID NO: 1524736 - RNA, 22 nt, Homo sapiens
agaagguuugcaccccuccuau

SEQ ID NO: 1524737 - RNA, 15 nt, Homo sapiens
agaagucccucccau

SEQ ID NO: 1524738 - RNA, 14 nt, Homo sapiens
agaagugauuuagu

SEQ ID NO: 1524739 - RNA, 12 nt, Homo sapiens
agaaucaccuca

SEQ ID NO: 1524740 - RNA, 17 nt, Homo sapiens
agaauuccugaagccag

SEQ ID NO: 1524741 - RNA, 18 nt, Homo sapiens
agacaacuucccaaagca

SEQ ID NO: 1524742 - RNA, 14 nt, Homo sapiens
agacagaaugucac

SEQ ID NO: 1524743 - RNA, 20 nt, Homo sapiens
agacccauuuccuugugcuc

SEQ ID NO: 1524744 - RNA, 12 nt, Homo sapiens
agacugccaaag

SEQ ID NO: 1524745 - RNA, 20 nt, Homo sapiens
agacuuugacucuccagaaa

SEQ ID NO: 1524746 - RNA, 14 nt, Homo sapiens
agagcauugugcaa

SEQ ID NO: 1524747 - RNA, 14 nt, Homo sapiens
agagcuauguuccc

SEQ ID NO: 1524748 - RNA, 18 nt, Homo sapiens
agagggaaguuuaaaacc

SEQ ID NO: 1524749 - RNA, 22 nt, Homo sapiens
agauauugucagaguucugcuc

SEQ ID NO: 1524750 - RNA, 10 nt, Homo sapiens
agaugcauua

SEQ ID NO: 1524751 - RNA, 19 nt, Homo sapiens
agaugcauuaucuaugaua

SEQ ID NO: 1524752 - RNA, 17 nt, Homo sapiens
agauguuauuaugcuaa

SEQ ID NO: 1524753 - RNA, 13 nt, Homo sapiens
agcaaagggcuca

SEQ ID NO: 1524754 - RNA, 22 nt, Homo sapiens
agcaauugugaaauacaguaua

SEQ ID NO: 1524755 - RNA, 18 nt, Homo sapiens
agcagauuaccucuugcc

SEQ ID NO: 1524756 - RNA, 16 nt, Homo sapiens
agcagugguauuaaua

SEQ ID NO: 1524757 - RNA, 22 nt, Homo sapiens
agcauguggaaaugacccaaac

SEQ ID NO: 1524758 - RNA, 14 nt, Homo sapiens
agcauugugcaaua

SEQ ID NO: 1524759 - RNA, 16 nt, Homo sapiens
agcccacauacuggau

SEQ ID NO: 1524760 - RNA, 14 nt, Homo sapiens
agcccgcugcucac

SEQ ID NO: 1524761 - RNA, 21 nt, Homo sapiens
agcccugggccccaccaccua

SEQ ID NO: 1524762 - RNA, 14 nt, Homo sapiens
agcuguaucuguaa

SEQ ID NO: 1524763 - RNA, 15 nt, Homo sapiens
aggaaaaacagggaa

SEQ ID NO: 1524764 - RNA, 20 nt, Homo sapiens
aggacggguaccaugcugcc

SEQ ID NO: 1524765 - RNA, 13 nt, Homo sapiens
aggagaaggugcc

SEQ ID NO: 1524766 - RNA, 15 nt, Homo sapiens
aggagacucaccucu

SEQ ID NO: 1524767 - RNA, 14 nt, Homo sapiens
aggcguucuucgag

SEQ ID NO: 1524768 - RNA, 17 nt, Homo sapiens
aggcucuggagccagag

SEQ ID NO: 1524769 - RNA, 19 nt, Homo sapiens
agggaaucacuggugcuau

SEQ ID NO: 1524770 - RNA, 14 nt, Homo sapiens
agggggucaugccg

SEQ ID NO: 1524771 - RNA, 22 nt, Homo sapiens
aggguucaccaggucagggaga

SEQ ID NO: 1524772 - RNA, 11 nt, Homo sapiens
aggugagcugg

SEQ ID NO: 1524773 - RNA, 16 nt, Homo sapiens
aguaaaaggcuuauua

SEQ ID NO: 1524774 - RNA, 17 nt, Homo sapiens
aguaagcaaagacuuuc

SEQ ID NO: 1524775 - RNA, 17 nt, Homo sapiens
agucaaaaggugccugu

SEQ ID NO: 1524776 - RNA, 13 nt, Homo sapiens
agucacagagaua

SEQ ID NO: 1524777 - RNA, 17 nt, Homo sapiens
agugccaauauuucuga

SEQ ID NO: 1524778 - RNA, 13 nt, Homo sapiens
agugccugcugaa

SEQ ID NO: 1524779 - RNA, 18 nt, Homo sapiens
aguguagggcaacaauac

SEQ ID NO: 1524780 - RNA, 17 nt, Homo sapiens
aguuaguaucuuuauua

SEQ ID NO: 1524781 - RNA, 23 nt, Homo sapiens
aguuccucauuuuugaauacagg

SEQ ID NO: 1524782 - RNA, 17 nt, Homo sapiens
aguugauggugaugaaa

SEQ ID NO: 1524783 - RNA, 21 nt, Homo sapiens
auaaaauuaaagcugaaaacu

SEQ ID NO: 1524784 - RNA, 19 nt, Homo sapiens
auaaaccaaugagcuguau

SEQ ID NO: 1524785 - RNA, 15 nt, Homo sapiens
auaacuauguugaua

SEQ ID NO: 1524786 - RNA, 21 nt, Homo sapiens
auaaucacucauucuaugaac

SEQ ID NO: 1524787 - RNA, 18 nt, Homo sapiens
auaaugcuguugccucau

SEQ ID NO: 1524788 - RNA, 15 nt, Homo sapiens
auaccaaaggugcua

SEQ ID NO: 1524789 - RNA, 15 nt, Homo sapiens
ugccccgaauuuagu

SEQ ID NO: 1524790 - RNA, 15 nt, Homo sapiens
ugccccuguaaauag

SEQ ID NO: 1524791 - RNA, 15 nt, Homo sapiens
ugcggauacuuugcu

SEQ ID NO: 1524792 - RNA, 23 nt, Homo sapiens
ugcuaauauauguauaugcaaua

SEQ ID NO: 1524793 - RNA, 15 nt, Homo sapiens
ugcuaauucaaagcu

SEQ ID NO: 1524794 - RNA, 18 nt, Homo sapiens
ugcugaaagacuaccucg

SEQ ID NO: 1524795 - RNA, 18 nt, Homo sapiens
ugcugggcucuccaccuc

SEQ ID NO: 1524796 - RNA, 16 nt, Homo sapiens
ugcuucgcagaugucc

SEQ ID NO: 1524797 - RNA, 18 nt, Homo sapiens
ugcuucugaaugugcuga

SEQ ID NO: 1524798 - RNA, 19 nt, Homo sapiens
uggaaaacaguauuuucca

SEQ ID NO: 1524799 - RNA, 23 nt, Homo sapiens
uggaaagauuuuguccagaagaa

SEQ ID NO: 1524800 - RNA, 18 nt, Homo sapiens
uggaaaugacccaaacau

SEQ ID NO: 1524801 - RNA, 17 nt, Homo sapiens
uggaagacaauacuccc

SEQ ID NO: 1524802 - RNA, 16 nt, Homo sapiens
uggaagcccuccuucc

SEQ ID NO: 1524803 - RNA, 18 nt, Homo sapiens
uggaagcuguguccuugc

SEQ ID NO: 1524804 - RNA, 19 nt, Homo sapiens
uggaucuccauucucucag

SEQ ID NO: 1524805 - RNA, 15 nt, Homo sapiens
uggaugugggguccc

SEQ ID NO: 1524806 - RNA, 19 nt, Homo sapiens
uggcauguguacaaugaaa

SEQ ID NO: 1524807 - RNA, 18 nt, Homo sapiens
uggcauuuucuguuccag

SEQ ID NO: 1524808 - RNA, 19 nt, Homo sapiens
uggccugcugggcucucca

SEQ ID NO: 1524809 - RNA, 23 nt, Homo sapiens
uggccugcugggcucuccaccuc

SEQ ID NO: 1524810 - RNA, 17 nt, Homo sapiens
uggcugaaccaaagaaa

SEQ ID NO: 1524811 - RNA, 23 nt, Homo sapiens
uggcuucacagaugugugauuca

SEQ ID NO: 1524812 - RNA, 17 nt, Homo sapiens
uggcuucgucauuugca

SEQ ID NO: 1524813 - RNA, 14 nt, Homo sapiens
ugggaggaagcaaa

SEQ ID NO: 1524814 - RNA, 16 nt, Homo sapiens
ugggaggaagcaaaag

SEQ ID NO: 1524815 - RNA, 18 nt, Homo sapiens
ugggauguccaccacagu

SEQ ID NO: 1524816 - RNA, 11 nt, Homo sapiens
ugggcuucuag

SEQ ID NO: 1524817 - RNA, 21 nt, Homo sapiens
uggguggggcugcuccuccag

SEQ ID NO: 1524818 - RNA, 17 nt, Homo sapiens
uggguggggucagggaa

SEQ ID NO: 1524819 - RNA, 15 nt, Homo sapiens
ugguuccaagaaaga

SEQ ID NO: 1524820 - RNA, 19 nt, Homo sapiens
ugguuccacagaagcuuug

SEQ ID NO: 1524821 - RNA, 15 nt, Homo sapiens
uguaaagcaggugcc

SEQ ID NO: 1524822 - RNA, 15 nt, Homo sapiens
uguaaauauguuuca

SEQ ID NO: 1524823 - RNA, 17 nt, Homo sapiens
uguaaugucaccaccuu

SEQ ID NO: 1524824 - RNA, 20 nt, Homo sapiens
uguaucuguaauuaauauuc

SEQ ID NO: 1524825 - RNA, 21 nt, Homo sapiens
ugucaaagcauugagaucucc

SEQ ID NO: 1524826 - RNA, 18 nt, Homo sapiens
ugucuacguuaccaggca

SEQ ID NO: 1524827 - RNA, 14 nt, Homo sapiens
ugucugcccagcaa

SEQ ID NO: 1524828 - RNA, 21 nt, Homo sapiens
ugugaaacuguaaauuucaua

SEQ ID NO: 1524829 - RNA, 14 nt, Homo sapiens
ugugagauguuuaa

SEQ ID NO: 1524830 - RNA, 17 nt, Homo sapiens
ugugauucacaguguga

SEQ ID NO: 1524831 - RNA, 17 nt, Homo sapiens
ugugccccuguaaauag

SEQ ID NO: 1524832 - RNA, 13 nt, Homo sapiens
uguuccagguuuc

SEQ ID NO: 1524833 - RNA, 14 nt, Homo sapiens
uguuccuuguguaa

SEQ ID NO: 1524834 - RNA, 13 nt, Homo sapiens
uguugauggugcu

SEQ ID NO: 1524835 - RNA, 15 nt, Homo sapiens
uguuucuugggcaag

SEQ ID NO: 1524836 - RNA, 21 nt, Homo sapiens
uuaaacccuauugguaaagaa

SEQ ID NO: 1524837 - RNA, 19 nt, Homo sapiens
uuaaagagaguuugccacu

SEQ ID NO: 1524838 - RNA, 19 nt, Homo sapiens
uuaaagcugaaaacugcaa

SEQ ID NO: 1524839 - RNA, 15 nt, Homo sapiens
uuaauuauauuucua

SEQ ID NO: 1524840 - RNA, 19 nt, Homo sapiens
uuacauuugaaaucuauga

SEQ ID NO: 1524841 - RNA, 16 nt, Homo sapiens
uuaccuugugcuaauc

SEQ ID NO: 1524842 - RNA, 15 nt, Homo sapiens
uuagucgagccaagu

SEQ ID NO: 1524843 - RNA, 16 nt, Homo sapiens
uuaugaaaaccauaug

SEQ ID NO: 1524844 - RNA, 16 nt, Homo sapiens
uuauguaucugguuaa

SEQ ID NO: 1524845 - RNA, 19 nt, Homo sapiens
uuauuaauuuuuauuauga

SEQ ID NO: 1524846 - RNA, 14 nt, Homo sapiens
uuauucugauucca

SEQ ID NO: 1524847 - RNA, 12 nt, Homo sapiens
uuauugagcucu

SEQ ID NO: 1524848 - RNA, 12 nt, Homo sapiens
uucacaguguga

SEQ ID NO: 1524849 - RNA, 14 nt, Homo sapiens
uucauauuuuccau

SEQ ID NO: 1524850 - RNA, 15 nt, Homo sapiens
uucaucuucuuccau

SEQ ID NO: 1524851 - RNA, 15 nt, Homo sapiens
uucaugccccggcug

SEQ ID NO: 1524852 - RNA, 12 nt, Homo sapiens
uucccaaagcac

SEQ ID NO: 1524853 - RNA, 15 nt, Homo sapiens
uucccaugaguguga

SEQ ID NO: 1524854 - RNA, 20 nt, Homo sapiens
uucccuauuuugccaguggg

SEQ ID NO: 1524855 - RNA, 20 nt, Homo sapiens
uucccugaaaacccagagag

SEQ ID NO: 1524856 - RNA, 15 nt, Homo sapiens
uuccuugacuguaaa

SEQ ID NO: 1524857 - RNA, 13 nt, Homo sapiens
uucgaaagcaaug

SEQ ID NO: 1524858 - RNA, 21 nt, Homo sapiens
uucuaucccacccaacagcuc

SEQ ID NO: 1524859 - RNA, 16 nt, Homo sapiens
uucucacuccaccacc

SEQ ID NO: 1524860 - RNA, 18 nt, Homo sapiens
uucucaggccucugcucu

SEQ ID NO: 1524861 - RNA, 18 nt, Homo sapiens
uucugauguuacugagau

SEQ ID NO: 1524862 - RNA, 20 nt, Homo sapiens
uucuguggaaguagcuuuga

SEQ ID NO: 1524863 - RNA, 20 nt, Homo sapiens
uucuuaguggaagacaauac

SEQ ID NO: 1524864 - RNA, 18 nt, Homo sapiens
uugaaaaauaaaaaccau

SEQ ID NO: 1524865 - RNA, 15 nt, Homo sapiens
uugacaacagacuga

SEQ ID NO: 1524866 - RNA, 10 nt, Homo sapiens
uugcauucau

SEQ ID NO: 1524867 - RNA, 13 nt, Homo sapiens
uugcccagugugu

SEQ ID NO: 1524868 - RNA, 15 nt, Homo sapiens
uugcggauacuuugc

SEQ ID NO: 1524869 - RNA, 12 nt, Homo sapiens
uugcuguucacc

SEQ ID NO: 1524870 - RNA, 15 nt, Homo sapiens
uuggaaugaaugaca

SEQ ID NO: 1524871 - RNA, 16 nt, Homo sapiens
uuguaaugucaccacc

SEQ ID NO: 1524872 - RNA, 17 nt, Homo sapiens
uugucaaagcauugaga

SEQ ID NO: 1524873 - RNA, 17 nt, Homo sapiens
ugaaucagacccuaccc

SEQ ID NO: 1524874 - RNA, 14 nt, Homo sapiens
ugaaugauuuccca

SEQ ID NO: 1524875 - RNA, 22 nt, Homo sapiens
ugaauguauuuugguugcugau

SEQ ID NO: 1524876 - RNA, 18 nt, Homo sapiens
ugaauuagauuauuucug

SEQ ID NO: 1524877 - RNA, 19 nt, Homo sapiens
ugacagagguuuugaaaug

SEQ ID NO: 1524878 - RNA, 12 nt, Homo sapiens
ugacagaucucu

SEQ ID NO: 1524879 - RNA, 12 nt, Homo sapiens
ugacagugaauu

SEQ ID NO: 1524880 - RNA, 23 nt, Homo sapiens
ugaccaaccgaacaugaccaaaa

SEQ ID NO: 1524881 - RNA, 20 nt, Homo sapiens
ugacucuccagaaagcucau

SEQ ID NO: 1524882 - RNA, 23 nt, Homo sapiens
ugacucuccagaaagcucaucuc

SEQ ID NO: 1524883 - RNA, 22 nt, Homo sapiens
ugacuuuuuggcuuuaagccau

SEQ ID NO: 1524884 - RNA, 24 nt, Homo sapiens
ugagucccccagagaugucaucag

SEQ ID NO: 1524885 - RNA, 21 nt, Homo sapiens
ugaguuguaucguguggugua

SEQ ID NO: 1524886 - RNA, 21 nt, Homo sapiens
ugauauugggcucuucaggaa

SEQ ID NO: 1524887 - RNA, 18 nt, Homo sapiens
ugauccuaaugaaugcau

SEQ ID NO: 1524888 - RNA, 12 nt, Homo sapiens
ugaucugaugca

SEQ ID NO: 1524889 - RNA, 12 nt, Homo sapiens
ugaugugucacc

SEQ ID NO: 1524890 - RNA, 15 nt, Homo sapiens
ugauguuacugagau

SEQ ID NO: 1524891 - RNA, 13 nt, Homo sapiens
ugauucacagugu

SEQ ID NO: 1524892 - RNA, 15 nt, Homo sapiens
ugauuuuuaauaguu

SEQ ID NO: 1524893 - RNA, 12 nt, Homo sapiens
ugcaaaggugag

SEQ ID NO: 1524894 - RNA, 13 nt, Homo sapiens
ugcaacuuguaaa

SEQ ID NO: 1524895 - RNA, 15 nt, Homo sapiens
ugcacuucuguucca

SEQ ID NO: 1524896 - RNA, 18 nt, Homo sapiens
ugcacuuuuaaaccucuc

SEQ ID NO: 1524897 - RNA, 16 nt, Homo sapiens
ugcagaaauuugaaug

SEQ ID NO: 1524898 - RNA, 16 nt, Homo sapiens
ugcagauuauuugccc

SEQ ID NO: 1524899 - RNA, 16 nt, Homo sapiens
ugcauaagugcaugac

SEQ ID NO: 1524900 - RNA, 20 nt, Homo sapiens
ugcauaagugcaugacauau

SEQ ID NO: 1524901 - RNA, 21 nt, Homo sapiens
ugcauauccaacaugugcuca

SEQ ID NO: 1524902 - RNA, 23 nt, Homo sapiens
ugcauuugucaaagcauugagau

SEQ ID NO: 1524903 - RNA, 20 nt, Homo sapiens
ugccaaagaagccuugccau

SEQ ID NO: 1524904 - RNA, 17 nt, Homo sapiens
ugccaaccucacugaca

SEQ ID NO: 1524905 - RNA, 22 nt, Homo sapiens
ugccagugccuuaccuccugcc

SEQ ID NO: 1524906 - RNA, 17 nt, Homo sapiens
ugccagugggaacuccu

SEQ ID NO: 1524907 - RNA, 14 nt, Homo sapiens
ugcccaaaucuucu

SEQ ID NO: 1524908 - RNA, 20 nt, Homo sapiens
ugcccagcaaucaaaggcaa

SEQ ID NO: 1524909 - RNA, 22 nt, Homo sapiens
ugcccagggcagcuuugcccuc

SEQ ID NO: 1524910 - RNA, 12 nt, Homo sapiens
ugcccagugugu

SEQ ID NO: 1524911 - RNA, 14 nt, Homo sapiens
cagaaacucuggaa

SEQ ID NO: 1524912 - RNA, 20 nt, Homo sapiens
cagacccccacucucauucc

SEQ ID NO: 1524913 - RNA, 15 nt, Homo sapiens
cagacugccaaagaa

SEQ ID NO: 1524914 - RNA, 15 nt, Homo sapiens
cagagaaaaugaauu

SEQ ID NO: 1524915 - RNA, 18 nt, Homo sapiens
cagagaugaaacuauggc

SEQ ID NO: 1524916 - RNA, 21 nt, Homo sapiens
cagagaugucaucagagcucc

SEQ ID NO: 1524917 - RNA, 20 nt, Homo sapiens
cagagggaaguuuaaaaccc

SEQ ID NO: 1524918 - RNA, 18 nt, Homo sapiens
cagagugugcagacugau

SEQ ID NO: 1524919 - RNA, 19 nt, Homo sapiens
cagagugugcagacugaug

SEQ ID NO: 1524920 - RNA, 13 nt, Homo sapiens
cagauggaccaaa

SEQ ID NO: 1524921 - RNA, 24 nt, Homo sapiens
cagauucagcauuuguucuuugcc

SEQ ID NO: 1524922 - RNA, 20 nt, Homo sapiens
cagcccagcccgcugcucac

SEQ ID NO: 1524923 - RNA, 15 nt, Homo sapiens
cagcccagcuggugg

SEQ ID NO: 1524924 - RNA, 17 nt, Homo sapiens
cagcgaaaggauguaaa

SEQ ID NO: 1524925 - RNA, 16 nt, Homo sapiens
cagcuugcucuucagu

SEQ ID NO: 1524926 - RNA, 18 nt, Homo sapiens
cagcuuugcccuccaaga

SEQ ID NO: 1524927 - RNA, 15 nt, Homo sapiens
caggaaccucagggc

SEQ ID NO: 1524928 - RNA, 23 nt, Homo sapiens
caggaaccucagggcugugugua

SEQ ID NO: 1524929 - RNA, 13 nt, Homo sapiens
caggaauguauca

SEQ ID NO: 1524930 - RNA, 23 nt, Homo sapiens
caggaguuggaagugugugaucu

SEQ ID NO: 1524931 - RNA, 16 nt, Homo sapiens
cagggcagcuuugccc

SEQ ID NO: 1524932 - RNA, 15 nt, Homo sapiens
caguaaucagaguua

SEQ ID NO: 1524933 - RNA, 20 nt, Homo sapiens
caguguguuucugaucugau

SEQ ID NO: 1524934 - RNA, 14 nt, Homo sapiens
caguucugcuccuc

SEQ ID NO: 1524935 - RNA, 12 nt, Homo sapiens
cauaaagcaauu

SEQ ID NO: 1524936 - RNA, 18 nt, Homo sapiens
cauaauacaaaggugcua

SEQ ID NO: 1524937 - RNA, 18 nt, Homo sapiens
cauaauuucuucacucaa

SEQ ID NO: 1524938 - RNA, 13 nt, Homo sapiens
cauaugucugcuu

SEQ ID NO: 1524939 - RNA, 21 nt, Homo sapiens
caucauuuccugggagaaaga

SEQ ID NO: 1524940 - RNA, 18 nt, Homo sapiens
caucgugaucacugagcc

SEQ ID NO: 1524941 - RNA, 19 nt, Homo sapiens
caugaaacauuacaggaaa

SEQ ID NO: 1524942 - RNA, 20 nt, Homo sapiens
caugacauauuuuugcuuua

SEQ ID NO: 1524943 - RNA, 19 nt, Homo sapiens
caugaccaaaaaccaaaag

SEQ ID NO: 1524944 - RNA, 13 nt, Homo sapiens
caugccccggcug

SEQ ID NO: 1524945 - RNA, 17 nt, Homo sapiens
caugccgggggagccac

SEQ ID NO: 1524946 - RNA, 19 nt, Homo sapiens
cauuaaaauccaguauuau

SEQ ID NO: 1524947 - RNA, 16 nt, Homo sapiens
cauuaccuugugcuaa

SEQ ID NO: 1524948 - RNA, 20 nt, Homo sapiens
cauucauauuuuccaucuua

SEQ ID NO: 1524949 - RNA, 18 nt, Homo sapiens
cauuguaaaucugaagaa

SEQ ID NO: 1524950 - RNA, 20 nt, Homo sapiens
cauugugcaauacaguuuca

SEQ ID NO: 1524951 - RNA, 16 nt, Homo sapiens
cauuugaaaucuauga

SEQ ID NO: 1524952 - RNA, 12 nt, Homo sapiens
cauuuuugccag

SEQ ID NO: 1524953 - RNA, 13 nt, Homo sapiens
ccaaaaauuugaa

SEQ ID NO: 1524954 - RNA, 14 nt, Homo sapiens
ccaacaugugcuca

SEQ ID NO: 1524955 - RNA, 14 nt, Homo sapiens
ccaacccaucagaa

SEQ ID NO: 1524956 - RNA, 17 nt, Homo sapiens
ccaaccuggcucccucc

SEQ ID NO: 1524957 - RNA, 22 nt, Homo sapiens
ccaauuaaaaguaugcagauua

SEQ ID NO: 1524958 - RNA, 17 nt, Homo sapiens
ccacccacgagcacuuu

SEQ ID NO: 1524959 - RNA, 14 nt, Homo sapiens
ccacgacaaagcag

SEQ ID NO: 1524960 - RNA, 17 nt, Homo sapiens
ccagaaagcucaucuca

SEQ ID NO: 1524961 - RNA, 13 nt, Homo sapiens
ccagagagacaga

SEQ ID NO: 1524962 - RNA, 16 nt, Homo sapiens
ccagcagugguauuaa

SEQ ID NO: 1524963 - RNA, 12 nt, Homo sapiens
ccagcucaggau

SEQ ID NO: 1524964 - RNA, 12 nt, Homo sapiens
ccagcucuagua

SEQ ID NO: 1524965 - RNA, 13 nt, Homo sapiens
ccagcugcuccca

SEQ ID NO: 1524966 - RNA, 18 nt, Homo sapiens
ccagcugcucccaaauaa

SEQ ID NO: 1524967 - RNA, 18 nt, Homo sapiens
ccaggcaacuugggaacu

SEQ ID NO: 1524968 - RNA, 22 nt, Homo sapiens
ccauaugauauuuugucuccua

SEQ ID NO: 1524969 - RNA, 14 nt, Homo sapiens
ccauaugucugcuu

SEQ ID NO: 1524970 - RNA, 12 nt, Homo sapiens
ccaucacuggag

SEQ ID NO: 1524971 - RNA, 17 nt, Homo sapiens
ccauuuuauaccaaagg

SEQ ID NO: 1524972 - RNA, 15 nt, Homo sapiens
cccaaccaacuuucc

SEQ ID NO: 1524973 - RNA, 15 nt, Homo sapiens
cccacgagcacuuua

SEQ ID NO: 1524974 - RNA, 19 nt, Homo sapiens
cccaggcccugggggaccu

SEQ ID NO: 1524975 - RNA, 10 nt, Homo sapiens
cccagugugu

SEQ ID NO: 1524976 - RNA, 12 nt, Homo sapiens
cccaucauccca

SEQ ID NO: 1524977 - RNA, 18 nt, Homo sapiens
cccauuuuauaccaaagg

SEQ ID NO: 1524978 - RNA, 17 nt, Homo sapiens
ccccagagaugucauca

SEQ ID NO: 1524979 - RNA, 20 nt, Homo sapiens
cccccucaaaagccaaaaaa

SEQ ID NO: 1524980 - RNA, 22 nt, Homo sapiens
ccccucagagcucuuaugugga

SEQ ID NO: 1524981 - RNA, 19 nt, Homo sapiens
cccuauugguaaagaaugg

SEQ ID NO: 1524982 - RNA, 19 nt, Homo sapiens
cccugggccccaccaccua

SEQ ID NO: 1524983 - RNA, 15 nt, Homo sapiens
ccgaacaugaccaaa

SEQ ID NO: 1524984 - RNA, 18 nt, Homo sapiens
ccgcugcucacuuuccac

SEQ ID NO: 1524985 - RNA, 20 nt, Homo sapiens
ccuauuuaugaaaaccauau

SEQ ID NO: 1524986 - RNA, 20 nt, Homo sapiens
ccucauuaccuugugcuaau

SEQ ID NO: 1524987 - RNA, 19 nt, Homo sapiens
ccuccucggaucaccgaga

SEQ ID NO: 1524988 - RNA, 17 nt, Homo sapiens
ccuccugucucuaaguc

SEQ ID NO: 1524989 - RNA, 12 nt, Homo sapiens
ccucugccucaa

SEQ ID NO: 1524990 - RNA, 16 nt, Homo sapiens
ccucuuuuucuagucu

SEQ ID NO: 1524991 - RNA, 12 nt, Homo sapiens
ccugaaucacaa

SEQ ID NO: 1524992 - RNA, 11 nt, Homo sapiens
ccugccagcuc

SEQ ID NO: 1524993 - RNA, 14 nt, Homo sapiens
ccuguaaauaguuu

SEQ ID NO: 1524994 - RNA, 14 nt, Homo sapiens
ccuugaugcucaua

SEQ ID NO: 1524995 - RNA, 18 nt, Homo sapiens
ccuugggccuuucaugcc

SEQ ID NO: 1524996 - RNA, 18 nt, Homo sapiens
ccuugugcuccugccagc

SEQ ID NO: 1524997 - RNA, 18 nt, Homo sapiens
ccuuugucauuauuaguc

SEQ ID NO: 1524998 - RNA, 19 nt, Homo sapiens
cgagccaaguuaagaaugu

SEQ ID NO: 1524999 - RNA, 15 nt, Homo sapiens
cgaggauguguccua

SEQ ID NO: 1525000 - RNA, 22 nt, Homo sapiens
cgagucaauccccucauucagg

SEQ ID NO: 1525001 - RNA, 21 nt, Homo sapiens
cggcugagucaugaucucccu

SEQ ID NO: 1525002 - RNA, 17 nt, Homo sapiens
cggguaccaugcugccc

SEQ ID NO: 1525003 - RNA, 18 nt, Homo sapiens
cgguguaaauauguuuca

SEQ ID NO: 1525004 - RNA, 14 nt, Homo sapiens
cguaguucccugaa

SEQ ID NO: 1525005 - RNA, 12 nt, Homo sapiens
cguuuaaucaca

SEQ ID NO: 1525006 - RNA, 14 nt, Homo sapiens
cuaagucaauucca

SEQ ID NO: 1525007 - RNA, 19 nt, Homo sapiens
cuaauacagacuaugucac

SEQ ID NO: 1525008 - RNA, 22 nt, Homo sapiens
cuaauuagaaaucaacuugugg

SEQ ID NO: 1525009 - RNA, 13 nt, Homo sapiens
cuacccucuaguu

SEQ ID NO: 1525010 - RNA, 18 nt, Homo sapiens
uaauacagacuaugucac

SEQ ID NO: 1525011 - RNA, 13 nt, Homo sapiens
uaauagcugcuag

SEQ ID NO: 1525012 - RNA, 23 nt, Homo sapiens
uaaugaugucguuugaaucacag

SEQ ID NO: 1525013 - RNA, 16 nt, Homo sapiens
uacaaggaauaugaca

SEQ ID NO: 1525014 - RNA, 20 nt, Homo sapiens
uacaggcauagaguucagac

SEQ ID NO: 1525015 - RNA, 15 nt, Homo sapiens
uacaucuaugugaug

SEQ ID NO: 1525016 - RNA, 16 nt, Homo sapiens
uacauguaauccauca

SEQ ID NO: 1525017 - RNA, 13 nt, Homo sapiens
uacauuuacuuua

SEQ ID NO: 1525018 - RNA, 16 nt, Homo sapiens
uaccauaugucugcuu

SEQ ID NO: 1525019 - RNA, 12 nt, Homo sapiens
uaccaugcugcc

SEQ ID NO: 1525020 - RNA, 19 nt, Homo sapiens
uacgugaccucugcaagac

SEQ ID NO: 1525021 - RNA, 14 nt, Homo sapiens
uacucuccaaccug

SEQ ID NO: 1525022 - RNA, 17 nt, Homo sapiens
uacugccggucacccag

SEQ ID NO: 1525023 - RNA, 22 nt, Homo sapiens
uacuuucuauucuuuagcugua

SEQ ID NO: 1525024 - RNA, 22 nt, Homo sapiens
uagaagaauuugagaagaaaua

SEQ ID NO: 1525025 - RNA, 11 nt, Homo sapiens
uagacuaguuu

SEQ ID NO: 1525026 - RNA, 18 nt, Homo sapiens
uagauguuauuaugcuaa

SEQ ID NO: 1525027 - RNA, 15 nt, Homo sapiens
uagcuguacuguaau

SEQ ID NO: 1525028 - RNA, 21 nt, Homo sapiens
uaggcucugggugcaguagug

SEQ ID NO: 1525029 - RNA, 16 nt, Homo sapiens
uaggcuggaauguucc

SEQ ID NO: 1525030 - RNA, 23 nt, Homo sapiens
uagggcaacaauacaugcugcua

SEQ ID NO: 1525031 - RNA, 23 nt, Homo sapiens
uaggggugggaggaagcaaaaga

SEQ ID NO: 1525032 - RNA, 19 nt, Homo sapiens
uaggugcugaccuagacag

SEQ ID NO: 1525033 - RNA, 20 nt, Homo sapiens
uaguauuaauuuauguaucu

SEQ ID NO: 1525034 - RNA, 22 nt, Homo sapiens
uaguucccugaaaacccagaga

SEQ ID NO: 1525035 - RNA, 21 nt, Homo sapiens
uauaaaagaauaaaauugcac

SEQ ID NO: 1525036 - RNA, 12 nt, Homo sapiens
uauaaagcaaau

SEQ ID NO: 1525037 - RNA, 16 nt, Homo sapiens
uauaacuauguugaua

SEQ ID NO: 1525038 - RNA, 14 nt, Homo sapiens
uauaagaguaauau

SEQ ID NO: 1525039 - RNA, 16 nt, Homo sapiens
uauauguauaugcaau

SEQ ID NO: 1525040 - RNA, 17 nt, Homo sapiens
uaucaaauacuaguauu

SEQ ID NO: 1525041 - RNA, 19 nt, Homo sapiens
uaucaaauacuaguauuaa

SEQ ID NO: 1525042 - RNA, 13 nt, Homo sapiens
uaucaauucacau

SEQ ID NO: 1525043 - RNA, 12 nt, Homo sapiens
uaucuuccacag

SEQ ID NO: 1525044 - RNA, 19 nt, Homo sapiens
uaugauauuuugucuccua

SEQ ID NO: 1525045 - RNA, 17 nt, Homo sapiens
uagguucaaaagcaauc

SEQ ID NO: 1525046 - RNA, 18 nt, Homo sapiens
uaguaauacgaaggugag

SEQ ID NO: 1525047 - RNA, 16 nt, Homo sapiens
uagugauaucuagaaa

SEQ ID NO: 1525048 - RNA, 20 nt, Homo sapiens
uagugccugaauuuguucuc

SEQ ID NO: 1525049 - RNA, 21 nt, Homo sapiens
uaguggcuuccccucugucaa

SEQ ID NO: 1525050 - RNA, 12 nt, Homo sapiens
uauaugcaauau

SEQ ID NO: 1525051 - RNA, 23 nt, Homo sapiens
uaucacuaaaaauuuuuacaaaa

SEQ ID NO: 1525052 - RNA, 14 nt, Homo sapiens
uauccaacaugugc

SEQ ID NO: 1525053 - RNA, 17 nt, Homo sapiens
uaucugguuaaugacau

SEQ ID NO: 1525054 - RNA, 23 nt, Homo sapiens
uauguauaaauuaauacagagua

SEQ ID NO: 1525055 - RNA, 23 nt, Homo sapiens
uauguauauauuuuucugauuau

SEQ ID NO: 1525056 - RNA, 13 nt, Homo sapiens
uauguuauugcau

SEQ ID NO: 1525057 - RNA, 20 nt, Homo sapiens
uauuacaguuuaucuauggc

SEQ ID NO: 1525058 - RNA, 14 nt, Homo sapiens
uauuauauuaucau

SEQ ID NO: 1525059 - RNA, 14 nt, Homo sapiens
uauuaugugcaaca

SEQ ID NO: 1525060 - RNA, 14 nt, Homo sapiens
uauucuccuccgag

SEQ ID NO: 1525061 - RNA, 22 nt, Homo sapiens
uauugguccagcuugcucuuca

SEQ ID NO: 1525062 - RNA, 14 nt, Homo sapiens
uauuuuauaugauu

SEQ ID NO: 1525063 - RNA, 22 nt, Homo sapiens
ucaaacgugaaaaugcuguauu

SEQ ID NO: 1525064 - RNA, 14 nt, Homo sapiens
ucaaaggcaaugcu

SEQ ID NO: 1525065 - RNA, 22 nt, Homo sapiens
ucaagcuuuggauaacgaugaa

SEQ ID NO: 1525066 - RNA, 22 nt, Homo sapiens
ucaaguuggcuucuaaucaaag

SEQ ID NO: 1525067 - RNA, 16 nt, Homo sapiens
ucaaucucugauucug

SEQ ID NO: 1525068 - RNA, 15 nt, Homo sapiens
ucaauuuugugcuau

SEQ ID NO: 1525069 - RNA, 20 nt, Homo sapiens
ucacaaaaaaacuguuauca

SEQ ID NO: 1525070 - RNA, 20 nt, Homo sapiens
ucacaacgggccagcucuag

SEQ ID NO: 1525071 - RNA, 18 nt, Homo sapiens
ucacaagaaucaccucaa

SEQ ID NO: 1525072 - RNA, 19 nt, Homo sapiens
ucacauucgaguguuucag

SEQ ID NO: 1525073 - RNA, 22 nt, Homo sapiens
ucacccacaucuaaugucucuu

SEQ ID NO: 1525074 - RNA, 22 nt, Homo sapiens
ucacucaaucucugauucuguc

SEQ ID NO: 1525075 - RNA, 16 nt, Homo sapiens
ucacucccauaagcua

SEQ ID NO: 1525076 - RNA, 13 nt, Homo sapiens
ucacuggugcuau

SEQ ID NO: 1525077 - RNA, 14 nt, Homo sapiens
ucacuggugcuaua

SEQ ID NO: 1525078 - RNA, 14 nt, Homo sapiens
ucagaacccagaaa

SEQ ID NO: 1525079 - RNA, 13 nt, Homo sapiens
ucagaagugauuu

SEQ ID NO: 1525080 - RNA, 16 nt, Homo sapiens
ucagacugccaaagaa

SEQ ID NO: 1525081 - RNA, 17 nt, Homo sapiens
ucagagacaacuuccca

SEQ ID NO: 1525082 - RNA, 20 nt, Homo sapiens
ucagauuugcuguucaccca

SEQ ID NO: 1525083 - RNA, 15 nt, Homo sapiens
ucagcuggaucucca

SEQ ID NO: 1525084 - RNA, 20 nt, Homo sapiens
ucaggaagcauaaagcaauu

SEQ ID NO: 1525085 - RNA, 16 nt, Homo sapiens
ucaggccucugcucuc

SEQ ID NO: 1525086 - RNA, 18 nt, Homo sapiens
ucagggcugagaggagaa

SEQ ID NO: 1525087 - RNA, 13 nt, Homo sapiens
ucauauuuugcca

SEQ ID NO: 1525088 - RNA, 19 nt, Homo sapiens
ucauauuuugccacugccu

SEQ ID NO: 1525089 - RNA, 21 nt, Homo sapiens
ucauccaggacugagaugcaa

SEQ ID NO: 1525090 - RNA, 16 nt, Homo sapiens
ucauuauuagucuuca

SEQ ID NO: 1525091 - RNA, 20 nt, Homo sapiens
uccaaagguuuaaacuaccu

SEQ ID NO: 1525092 - RNA, 23 nt, Homo sapiens
uccaaauuuaaccauaaaucaau

SEQ ID NO: 1525093 - RNA, 20 nt, Homo sapiens
uccaacaugugcucagggaa

SEQ ID NO: 1525094 - RNA, 16 nt, Homo sapiens
uccaagaaagauccac

SEQ ID NO: 1525095 - RNA, 13 nt, Homo sapiens
uccaggacaugau

SEQ ID NO: 1525096 - RNA, 15 nt, Homo sapiens
uccaugguuccacag

SEQ ID NO: 1525097 - RNA, 19 nt, Homo sapiens
uccauuucuucugcacauc

SEQ ID NO: 1525098 - RNA, 19 nt, Homo sapiens
ucccacugcaacuugugaa

SEQ ID NO: 1525099 - RNA, 21 nt, Homo sapiens
ucccaugagugugauccacau

SEQ ID NO: 1525100 - RNA, 14 nt, Homo sapiens
uccccaucauccca

SEQ ID NO: 1525101 - RNA, 19 nt, Homo sapiens
uccccuugcccuugcccug

SEQ ID NO: 1525102 - RNA, 23 nt, Homo sapiens
ucccggcucccuccuagucuguc

SEQ ID NO: 1525103 - RNA, 15 nt, Homo sapiens
ucccgggcccagaaa

SEQ ID NO: 1525104 - RNA, 19 nt, Homo sapiens
ucccugaaaacccagagag

SEQ ID NO: 1525105 - RNA, 19 nt, Homo sapiens
ucccugggggaagcccugg

SEQ ID NO: 1525106 - RNA, 21 nt, Homo sapiens
ucccuguccuccucggaucac

SEQ ID NO: 1525107 - RNA, 13 nt, Homo sapiens
ucccuuucugccc

SEQ ID NO: 1525108 - RNA, 20 nt, Homo sapiens
uccuaggcucugggugcagu

SEQ ID NO: 1525109 - RNA, 21 nt, Homo sapiens
uccuaggcucugggugcagua

SEQ ID NO: 1525110 - RNA, 18 nt, Homo sapiens
uccuauaacuugaugcau

SEQ ID NO: 1525111 - RNA, 22 nt, Homo sapiens
uccucauuuuugaauacaggca

SEQ ID NO: 1525112 - RNA, 20 nt, Homo sapiens
uccucugaaacccuccucca

SEQ ID NO: 1525113 - RNA, 22 nt, Homo sapiens
uccucuguucuaucccacccaa

SEQ ID NO: 1525114 - RNA, 14 nt, Homo sapiens
uccuuccuucccug

SEQ ID NO: 1525115 - RNA, 17 nt, Homo sapiens
uccuugauaaaguauua

SEQ ID NO: 1525116 - RNA, 13 nt, Homo sapiens
uccuugucaauac

SEQ ID NO: 1525117 - RNA, 23 nt, Homo sapiens
uccuuguggcagaggaugucuca

SEQ ID NO: 1525118 - RNA, 13 nt, Homo sapiens
uccuuugcauuca

SEQ ID NO: 1525119 - RNA, 23 nt, Homo sapiens
uccuuugucauuauuagucuuca

SEQ ID NO: 1525120 - RNA, 12 nt, Homo sapiens
ucgaaagcaaug

SEQ ID NO: 1525121 - RNA, 16 nt, Homo sapiens
ucgagaccaaccugac

SEQ ID NO: 1525122 - RNA, 13 nt, Homo sapiens
ucgagguggauca

SEQ ID NO: 1525123 - RNA, 15 nt, Homo sapiens
ucgcugucaucucag

SEQ ID NO: 1525124 - RNA, 13 nt, Homo sapiens
ucuaaaggugcua

SEQ ID NO: 1525125 - RNA, 15 nt, Homo sapiens
ucuaaaggugcuauu

SEQ ID NO: 1525126 - RNA, 17 nt, Homo sapiens
ucuaaguaaugaugucg

SEQ ID NO: 1525127 - RNA, 14 nt, Homo sapiens
ucuacccucuaguu

SEQ ID NO: 1525128 - RNA, 20 nt, Homo sapiens
ucuagaaccaggcaacuugg

SEQ ID NO: 1525129 - RNA, 17 nt, Homo sapiens
ucuaugaaauaucaugc

SEQ ID NO: 1525130 - RNA, 19 nt, Homo sapiens
ucuaugaaauaucaugcuc

SEQ ID NO: 1525131 - RNA, 20 nt, Homo sapiens
ucucaauuauuggccugcua

SEQ ID NO: 1525132 - RNA, 17 nt, Homo sapiens
ucucauuuucaucuucu

SEQ ID NO: 1525133 - RNA, 16 nt, Homo sapiens
ucugauauaacaaacu

SEQ ID NO: 1525134 - RNA, 13 nt, Homo sapiens
ucugaugcaagca

SEQ ID NO: 1525135 - RNA, 23 nt, Homo sapiens
ucugcacuucuguuccagguuuu

SEQ ID NO: 1525136 - RNA, 18 nt, Homo sapiens
ucugcuccucuccaggca

SEQ ID NO: 1525137 - RNA, 14 nt, Homo sapiens
ucuggagccagaga

SEQ ID NO: 1525138 - RNA, 15 nt, Homo sapiens
ucugucaaugucuug

SEQ ID NO: 1525139 - RNA, 21 nt, Homo sapiens
ucuguggaaguagcuuugaac

SEQ ID NO: 1525140 - RNA, 21 nt, Homo sapiens
ucuucauaauuucuucacuca

SEQ ID NO: 1525141 - RNA, 20 nt, Homo sapiens
ucuuccacccacgagcacuu

SEQ ID NO: 1525142 - RNA, 18 nt, Homo sapiens
ucuucugcacaucuacuu

SEQ ID NO: 1525143 - RNA, 19 nt, Homo sapiens
ucuuggggucccagggaag

SEQ ID NO: 1525144 - RNA, 17 nt, Homo sapiens
ucuuuaaaauaaggaua

SEQ ID NO: 1525145 - RNA, 17 nt, Homo sapiens
ucuuuagagguaugauu

SEQ ID NO: 1525146 - RNA, 11 nt, Homo sapiens
ugaaaaccaua

SEQ ID NO: 1525147 - RNA, 18 nt, Homo sapiens
ugaaaaccauaugauauu

SEQ ID NO: 1525148 - RNA, 16 nt, Homo sapiens
ugaaauaucaugcucc

SEQ ID NO: 1525149 - RNA, 13 nt, Homo sapiens
ugaaaucuaugaa

SEQ ID NO: 1525150 - RNA, 16 nt, Homo sapiens
ugaaaugcuuaugcuu

SEQ ID NO: 1525151 - RNA, 13 nt, Homo sapiens
ugaaccacaccau

SEQ ID NO: 1525152 - RNA, 14 nt, Homo sapiens
ugaagaauuauuca

SEQ ID NO: 1525153 - RNA, 22 nt, Homo sapiens
ugaagaauuauucagugaauuu

SEQ ID NO: 1525154 - RNA, 14 nt, Homo sapiens
ugaaucacaguaua

SEQ ID NO: 1525155 - RNA, 15 nt, Homo sapiens
ugaaugacaugaccu

SEQ ID NO: 1525156 - RNA, 14 nt, Homo sapiens
ugagagacccaagg

SEQ ID NO: 1525157 - RNA, 23 nt, Homo sapiens
ugagaucgugccguuacucucca

SEQ ID NO: 1525158 - RNA, 19 nt, Homo sapiens
ugagaucuccacggucaga

SEQ ID NO: 1525159 - RNA, 14 nt, Homo sapiens
ugagccaucauuuc

SEQ ID NO: 1525160 - RNA, 14 nt, Homo sapiens
ugagggaggcacaa

SEQ ID NO: 1525161 - RNA, 14 nt, Homo sapiens
ugagguccugucua

SEQ ID NO: 1525162 - RNA, 18 nt, Homo sapiens
ugaguauuccaccacagg

SEQ ID NO: 1525163 - RNA, 20 nt, Homo sapiens
ugaugcaagcaagaaacacu

SEQ ID NO: 1525164 - RNA, 19 nt, Homo sapiens
ugcaagcaagaaacacugg

SEQ ID NO: 1525165 - RNA, 16 nt, Homo sapiens
ugcacaucuacuugcu

SEQ ID NO: 1525166 - RNA, 16 nt, Homo sapiens
ugcacuucuguuccag

SEQ ID NO: 1525167 - RNA, 17 nt, Homo sapiens
ugcacuuuuaaaccucu

SEQ ID NO: 1525168 - RNA, 17 nt, Homo sapiens
ugcagauuauuugccca

SEQ ID NO: 1525169 - RNA, 18 nt, Homo sapiens
ugcagauuauuugcccaa

SEQ ID NO: 1525170 - RNA, 12 nt, Homo sapiens
uuuuuuguggau

SEQ ID NO: 1525171 - RNA, 18 nt, Homo sapiens
cagcaucgugaucacuga

SEQ ID NO: 1525172 - RNA, 13 nt, Homo sapiens
cagcccuauggau

SEQ ID NO: 1525173 - RNA, 17 nt, Homo sapiens
cagcugcucccaaauaa

SEQ ID NO: 1525174 - RNA, 15 nt, Homo sapiens
cagcuggaucuccau

SEQ ID NO: 1525175 - RNA, 17 nt, Homo sapiens
cagcugugguacaaaug

SEQ ID NO: 1525176 - RNA, 18 nt, Homo sapiens
cagcuucuucaucuuuaa

SEQ ID NO: 1525177 - RNA, 23 nt, Homo sapiens
caggaucacaagaaucaccucaa

SEQ ID NO: 1525178 - RNA, 17 nt, Homo sapiens
caggcacuauaauuucu

SEQ ID NO: 1525179 - RNA, 15 nt, Homo sapiens
caggccacauggcua

SEQ ID NO: 1525180 - RNA, 17 nt, Homo sapiens
caggccccgcuugucca

SEQ ID NO: 1525181 - RNA, 19 nt, Homo sapiens
cagggcuggggccaagagg

SEQ ID NO: 1525182 - RNA, 22 nt, Homo sapiens
caguauuuuccaaacuaccuuc

SEQ ID NO: 1525183 - RNA, 14 nt, Homo sapiens
cauaaaauguuaag

SEQ ID NO: 1525184 - RNA, 20 nt, Homo sapiens
cauaaacauuugcaccacuu

SEQ ID NO: 1525185 - RNA, 18 nt, Homo sapiens
cauaagugcaugacauau

SEQ ID NO: 1525186 - RNA, 15 nt, Homo sapiens
cauauauuuguauga

SEQ ID NO: 1525187 - RNA, 14 nt, Homo sapiens
cauauccaacaugu

SEQ ID NO: 1525188 - RNA, 18 nt, Homo sapiens
cauauccaacaugugcuc

SEQ ID NO: 1525189 - RNA, 20 nt, Homo sapiens
cauauccaacaugugcucag

SEQ ID NO: 1525190 - RNA, 13 nt, Homo sapiens
cauauuuugccac

SEQ ID NO: 1525191 - RNA, 16 nt, Homo sapiens
caucacgucaagcuuu

SEQ ID NO: 1525192 - RNA, 20 nt, Homo sapiens
caucacuagccaugauaacu

SEQ ID NO: 1525193 - RNA, 17 nt, Homo sapiens
caucccagcugcuccca

SEQ ID NO: 1525194 - RNA, 15 nt, Homo sapiens
caucuucuccaucug

SEQ ID NO: 1525195 - RNA, 13 nt, Homo sapiens
caucuucuuccau

SEQ ID NO: 1525196 - RNA, 17 nt, Homo sapiens
caugaaagauaagcuuu

SEQ ID NO: 1525197 - RNA, 15 nt, Homo sapiens
caugauaacugcaau

SEQ ID NO: 1525198 - RNA, 22 nt, Homo sapiens
caugcugcuaauucaaagcucu

SEQ ID NO: 1525199 - RNA, 19 nt, Homo sapiens
cauggcucccgaguacagu

SEQ ID NO: 1525200 - RNA, 20 nt, Homo sapiens
cauggcucccgaguacagua

SEQ ID NO: 1525201 - RNA, 20 nt, Homo sapiens
cauuagccuaugugcaugca

SEQ ID NO: 1525202 - RNA, 18 nt, Homo sapiens
cauuauaacugaaggaga

SEQ ID NO: 1525203 - RNA, 12 nt, Homo sapiens
cauuaucuauga

SEQ ID NO: 1525204 - RNA, 23 nt, Homo sapiens
cauucaauaaauauuaguuaaua

SEQ ID NO: 1525205 - RNA, 15 nt, Homo sapiens
cauucauauuuucca

SEQ ID NO: 1525206 - RNA, 21 nt, Homo sapiens
cauucccugagucaccaggaa

SEQ ID NO: 1525207 - RNA, 15 nt, Homo sapiens
cauucgaguguuuca

SEQ ID NO: 1525208 - RNA, 15 nt, Homo sapiens
cauuguuaggugcug

SEQ ID NO: 1525209 - RNA, 17 nt, Homo sapiens
cauuuacuuuaauuucc

SEQ ID NO: 1525210 - RNA, 17 nt, Homo sapiens
cauuuguucuuugccag

SEQ ID NO: 1525211 - RNA, 19 nt, Homo sapiens
cauuuucaucuucuuccau

SEQ ID NO: 1525212 - RNA, 13 nt, Homo sapiens
cauuuuugccagu

SEQ ID NO: 1525213 - RNA, 16 nt, Homo sapiens
ccaaaagugcauucaa

SEQ ID NO: 1525214 - RNA, 21 nt, Homo sapiens
ccaaacuuccaaagguuuaaa

SEQ ID NO: 1525215 - RNA, 16 nt, Homo sapiens
ccaaagaagccuugcc

SEQ ID NO: 1525216 - RNA, 18 nt, Homo sapiens
ccaaagaagccuugccau

SEQ ID NO: 1525217 - RNA, 22 nt, Homo sapiens
ccaaagcacaaagcaguuuuuc

SEQ ID NO: 1525218 - RNA, 22 nt, Homo sapiens
ccaaagguuuaaacuaccucaa

SEQ ID NO: 1525219 - RNA, 14 nt, Homo sapiens
ccaaauaaacucca

SEQ ID NO: 1525220 - RNA, 18 nt, Homo sapiens
ccaacaugugcucaggga

SEQ ID NO: 1525221 - RNA, 15 nt, Homo sapiens
ccaaccucacugaca

SEQ ID NO: 1525222 - RNA, 19 nt, Homo sapiens
ccaaggaggaaaaacagac

SEQ ID NO: 1525223 - RNA, 19 nt, Homo sapiens
ccaaguggcccccacccuc

SEQ ID NO: 1525224 - RNA, 14 nt, Homo sapiens
ccaaugccuugaca

SEQ ID NO: 1525225 - RNA, 20 nt, Homo sapiens
ccacaccaaugcaacauuug

SEQ ID NO: 1525226 - RNA, 16 nt, Homo sapiens
ccacaucuaaugucuc

SEQ ID NO: 1525227 - RNA, 17 nt, Homo sapiens
ccacccccuucagugcc

SEQ ID NO: 1525228 - RNA, 17 nt, Homo sapiens
ccacccucaaaugucag

SEQ ID NO: 1525229 - RNA, 17 nt, Homo sapiens
ccacuauccucacuccc

SEQ ID NO: 1525230 - RNA, 19 nt, Homo sapiens
ccagagugugcagacugau

SEQ ID NO: 1525231 - RNA, 17 nt, Homo sapiens
ccagcucaggauauuau

SEQ ID NO: 1525232 - RNA, 16 nt, Homo sapiens
ccaggaaccucagggc

SEQ ID NO: 1525233 - RNA, 22 nt, Homo sapiens
ccaggcccggggcuggcggcua

SEQ ID NO: 1525234 - RNA, 13 nt, Homo sapiens
ccaggucagggag

SEQ ID NO: 1525235 - RNA, 23 nt, Homo sapiens
ccagucucauuuucaucuucuuc

SEQ ID NO: 1525236 - RNA, 20 nt, Homo sapiens
ccaguguguuucugaucuga

SEQ ID NO: 1525237 - RNA, 18 nt, Homo sapiens
ccauaugucugcuucugu

SEQ ID NO: 1525238 - RNA, 12 nt, Homo sapiens
ccaucaucccag

SEQ ID NO: 1525239 - RNA, 19 nt, Homo sapiens
ccauuguaaaucugaagaa

SEQ ID NO: 1525240 - RNA, 14 nt, Homo sapiens
cccaguguguuucu

SEQ ID NO: 1525241 - RNA, 17 nt, Homo sapiens
cccauggcucuugcaac

SEQ ID NO: 1525242 - RNA, 20 nt, Homo sapiens
ccccaucugccacguguauu

SEQ ID NO: 1525243 - RNA, 15 nt, Homo sapiens
cccccugccagugcc

SEQ ID NO: 1525244 - RNA, 14 nt, Homo sapiens
cccccuucagugcc

SEQ ID NO: 1525245 - RNA, 17 nt, Homo sapiens
cccgaauuuagucacac

SEQ ID NO: 1525246 - RNA, 22 nt, Homo sapiens
cccggggcuggcggcuacucag

SEQ ID NO: 1525247 - RNA, 17 nt, Homo sapiens
cccucaaaagccaaaaa

SEQ ID NO: 1525248 - RNA, 18 nt, Homo sapiens
cccucaaaagccaaaaaa

SEQ ID NO: 1525249 - RNA, 17 nt, Homo sapiens
cccugaaaacccagaga

SEQ ID NO: 1525250 - RNA, 11 nt, Homo sapiens
cccugaccucc

SEQ ID NO: 1525251 - RNA, 16 nt, Homo sapiens
cccugagucaccagga

SEQ ID NO: 1525252 - RNA, 17 nt, Homo sapiens
cccugucuaaaaauuca

SEQ ID NO: 1525253 - RNA, 18 nt, Homo sapiens
ccgaauuuagucacacca

SEQ ID NO: 1525254 - RNA, 18 nt, Homo sapiens
ccgcagggcugggcggga

SEQ ID NO: 1525255 - RNA, 13 nt, Homo sapiens
ccgucugcacuuc

SEQ ID NO: 1525256 - RNA, 13 nt, Homo sapiens
ccucaaaugucag

SEQ ID NO: 1525257 - RNA, 19 nt, Homo sapiens
ccucaaaugucagagcuau

SEQ ID NO: 1525258 - RNA, 17 nt, Homo sapiens
ccucagagcucuuaugu

SEQ ID NO: 1525259 - RNA, 15 nt, Homo sapiens
ccucagggacagaga

SEQ ID NO: 1525260 - RNA, 22 nt, Homo sapiens
ccucucuaagccacagcuucuu

SEQ ID NO: 1525261 - RNA, 21 nt, Homo sapiens
ccucuggcuggcuaacuggaa

SEQ ID NO: 1525262 - RNA, 22 nt, Homo sapiens
ccuggaaauaucaguuacucag

SEQ ID NO: 1525263 - RNA, 17 nt, Homo sapiens
ccuggguggggcugcuc

SEQ ID NO: 1525264 - RNA, 13 nt, Homo sapiens
ccuuaccaaaaaa

SEQ ID NO: 1525265 - RNA, 23 nt, Homo sapiens
ccuucccccgcucccccaaaaau

SEQ ID NO: 1525266 - RNA, 13 nt, Homo sapiens
ccuugaaggguuc

SEQ ID NO: 1525267 - RNA, 13 nt, Homo sapiens
ccuugcaccugca

SEQ ID NO: 1525268 - RNA, 18 nt, Homo sapiens
ccuugucaauacugagcc

SEQ ID NO: 1525269 - RNA, 13 nt, Homo sapiens
ccuugugcuccug

SEQ ID NO: 1525270 - RNA, 15 nt, Homo sapiens
ccuuucccuagagaa

SEQ ID NO: 1525271 - RNA, 12 nt, Homo sapiens
ccuuugcauuca

SEQ ID NO: 1525272 - RNA, 22 nt, Homo sapiens
cgaaagcaaugcuucuaucaaa

SEQ ID NO: 1525273 - RNA, 19 nt, Homo sapiens
cgaagucccggcuuccacc

SEQ ID NO: 1525274 - RNA, 18 nt, Homo sapiens
cgcagauguccuugaugc

SEQ ID NO: 1525275 - RNA, 21 nt, Homo sapiens
cgcuccccuggagagggugau

SEQ ID NO: 1525276 - RNA, 17 nt, Homo sapiens
cggcaaccccaguucug

SEQ ID NO: 1525277 - RNA, 17 nt, Homo sapiens
cgggccgucugcacuuc

SEQ ID NO: 1525278 - RNA, 14 nt, Homo sapiens
cggguaccaugcug

SEQ ID NO: 1525279 - RNA, 23 nt, Homo sapiens
cgucugcacuucuguuccagguu

SEQ ID NO: 1525280 - RNA, 16 nt, Homo sapiens
cgugaaaaugcuguau

SEQ ID NO: 1525281 - RNA, 21 nt, Homo sapiens
cuaaaauauuuuagauguuau

SEQ ID NO: 1525282 - RNA, 14 nt, Homo sapiens
cuaaaguaguuuaa

SEQ ID NO: 1525283 - RNA, 19 nt, Homo sapiens
cuaguaauacgaaggugag

SEQ ID NO: 1525284 - RNA, 20 nt, Homo sapiens
cuauaacuauguugauaaaa

SEQ ID NO: 1525285 - RNA, 22 nt, Homo sapiens
cuauaacuugaugcaugugguu

SEQ ID NO: 1525286 - RNA, 17 nt, Homo sapiens
cuauaauuucuguaaca

SEQ ID NO: 1525287 - RNA, 13 nt, Homo sapiens
cuaugaaauauca

SEQ ID NO: 1525288 - RNA, 16 nt, Homo sapiens
cuaugauaugcuaaua

SEQ ID NO: 1525289 - RNA, 17 nt, Homo sapiens
cuauggcucuacuuuca

SEQ ID NO: 1525290 - RNA, 11 nt, Homo sapiens
cuauguucccu

SEQ ID NO: 1525291 - RNA, 13 nt, Homo sapiens
cucaaaagccaaa

SEQ ID NO: 1525292 - RNA, 12 nt, Homo sapiens
cucaaucucuga

SEQ ID NO: 1525293 - RNA, 20 nt, Homo sapiens
cuccagagugugcagacuga

SEQ ID NO: 1525294 - RNA, 20 nt, Homo sapiens
cucccacccaaccaacuuuc

SEQ ID NO: 1525295 - RNA, 18 nt, Homo sapiens
uggccugcuaauagcugc

SEQ ID NO: 1525296 - RNA, 12 nt, Homo sapiens
uggcucuugcaa

SEQ ID NO: 1525297 - RNA, 21 nt, Homo sapiens
uggcuucacagaugugugauu

SEQ ID NO: 1525298 - RNA, 18 nt, Homo sapiens
uggcuucgucauuugcaa

SEQ ID NO: 1525299 - RNA, 11 nt, Homo sapiens
uggcuuucaua

SEQ ID NO: 1525300 - RNA, 17 nt, Homo sapiens
ugggaacuccuaaauca

SEQ ID NO: 1525301 - RNA, 18 nt, Homo sapiens
ugggagacugcugaguca

SEQ ID NO: 1525302 - RNA, 16 nt, Homo sapiens
ugggccccaccaccua

SEQ ID NO: 1525303 - RNA, 23 nt, Homo sapiens
uggggacagagcagaacuuucac

SEQ ID NO: 1525304 - RNA, 22 nt, Homo sapiens
uggguaaccagucccaggugaa

SEQ ID NO: 1525305 - RNA, 20 nt, Homo sapiens
ugguccuuagccccaucugc

SEQ ID NO: 1525306 - RNA, 22 nt, Homo sapiens
ugguugcauuugucaaagcauu

SEQ ID NO: 1525307 - RNA, 19 nt, Homo sapiens
ugguuuauauaaggcagua

SEQ ID NO: 1525308 - RNA, 21 nt, Homo sapiens
uguaaagcaggugcccaggaa

SEQ ID NO: 1525309 - RNA, 14 nt, Homo sapiens
uguaagaaaaccaa

SEQ ID NO: 1525310 - RNA, 15 nt, Homo sapiens
uguaagaaaaccaaa

SEQ ID NO: 1525311 - RNA, 16 nt, Homo sapiens
uguagcuuuauccuua

SEQ ID NO: 1525312 - RNA, 18 nt, Homo sapiens
uguaggcagggaaccuua

SEQ ID NO: 1525313 - RNA, 23 nt, Homo sapiens
uguauguguauaauaauuugaga

SEQ ID NO: 1525314 - RNA, 17 nt, Homo sapiens
uguauuagucacagaga

SEQ ID NO: 1525315 - RNA, 20 nt, Homo sapiens
uguauuauaugcagaauuac

SEQ ID NO: 1525316 - RNA, 16 nt, Homo sapiens
ugucaaucccuugugc

SEQ ID NO: 1525317 - RNA, 12 nt, Homo sapiens
ugucaaugucuu

SEQ ID NO: 1525318 - RNA, 11 nt, Homo sapiens
ugucaucucag

SEQ ID NO: 1525319 - RNA, 21 nt, Homo sapiens
ugucaucucagcuggaucucc

SEQ ID NO: 1525320 - RNA, 14 nt, Homo sapiens
ugucuccccagaag

SEQ ID NO: 1525321 - RNA, 21 nt, Homo sapiens
ugugaagaaaaagaccugcau

SEQ ID NO: 1525322 - RNA, 12 nt, Homo sapiens
ugugcagacuga

SEQ ID NO: 1525323 - RNA, 21 nt, Homo sapiens
ugugcuaucgcaaaucacaaa

SEQ ID NO: 1525324 - RNA, 21 nt, Homo sapiens
ugugugaucugugggcacauu

SEQ ID NO: 1525325 - RNA, 19 nt, Homo sapiens
uguguuuuguuuuguauca

SEQ ID NO: 1525326 - RNA, 15 nt, Homo sapiens
uguuaaccauuugca

SEQ ID NO: 1525327 - RNA, 13 nt, Homo sapiens
uguuaaguugaug

SEQ ID NO: 1525328 - RNA, 18 nt, Homo sapiens
uguuaggaagggacugca

SEQ ID NO: 1525329 - RNA, 15 nt, Homo sapiens
uguucacccacaucu

SEQ ID NO: 1525330 - RNA, 21 nt, Homo sapiens
uguucauaauacaaaggugcu

SEQ ID NO: 1525331 - RNA, 22 nt, Homo sapiens
uguucccuccagcagugguauu

SEQ ID NO: 1525332 - RNA, 15 nt, Homo sapiens
uguuugguuuuccaa

SEQ ID NO: 1525333 - RNA, 14 nt, Homo sapiens
uuaaaaaauuugau

SEQ ID NO: 1525334 - RNA, 18 nt, Homo sapiens
uuaaaguggacuuauuaa

SEQ ID NO: 1525335 - RNA, 12 nt, Homo sapiens
uuaaauaguaaa

SEQ ID NO: 1525336 - RNA, 20 nt, Homo sapiens
uuaagaauguucuuauguug

SEQ ID NO: 1525337 - RNA, 19 nt, Homo sapiens
uuaaguugauggugaugaa

SEQ ID NO: 1525338 - RNA, 15 nt, Homo sapiens
uuaauuuauguaucu

SEQ ID NO: 1525339 - RNA, 19 nt, Homo sapiens
uuacaguuuaucuauggca

SEQ ID NO: 1525340 - RNA, 17 nt, Homo sapiens
uuacauuugaaaucuau

SEQ ID NO: 1525341 - RNA, 15 nt, Homo sapiens
uuacuaucaugucaa

SEQ ID NO: 1525342 - RNA, 20 nt, Homo sapiens
uuagacuaguuucuuauuaa

SEQ ID NO: 1525343 - RNA, 15 nt, Homo sapiens
uuauaaaagaugcau

SEQ ID NO: 1525344 - RNA, 17 nt, Homo sapiens
uuauguaacauccagaa

SEQ ID NO: 1525345 - RNA, 12 nt, Homo sapiens
uuauugcauaau

SEQ ID NO: 1525346 - RNA, 18 nt, Homo sapiens
uuauuuugauugcuggaa

SEQ ID NO: 1525347 - RNA, 16 nt, Homo sapiens
uucaaccuuaccaaaa

SEQ ID NO: 1525348 - RNA, 16 nt, Homo sapiens
uucacagaugugugau

SEQ ID NO: 1525349 - RNA, 17 nt, Homo sapiens
uucacagaugugugauu

SEQ ID NO: 1525350 - RNA, 21 nt, Homo sapiens
uucagcauuuguucuuugcca

SEQ ID NO: 1525351 - RNA, 14 nt, Homo sapiens
uucagccaggagau

SEQ ID NO: 1525352 - RNA, 14 nt, Homo sapiens
uucagccccuccuc

SEQ ID NO: 1525353 - RNA, 16 nt, Homo sapiens
uucagugcuucgcaga

SEQ ID NO: 1525354 - RNA, 19 nt, Homo sapiens
uucauaauuucuucacuca

SEQ ID NO: 1525355 - RNA, 20 nt, Homo sapiens
uucauauauuuguaugaucc

SEQ ID NO: 1525356 - RNA, 13 nt, Homo sapiens
uucauauuuucca

SEQ ID NO: 1525357 - RNA, 14 nt, Homo sapiens
uuccaagugccaau

SEQ ID NO: 1525358 - RNA, 18 nt, Homo sapiens
uuccacccacgagcacuu

SEQ ID NO: 1525359 - RNA, 17 nt, Homo sapiens
uuccaugguuccacaga

SEQ ID NO: 1525360 - RNA, 14 nt, Homo sapiens
uucccaaaucuguc

SEQ ID NO: 1525361 - RNA, 23 nt, Homo sapiens
uucccaucacuggagcaccaggc

SEQ ID NO: 1525362 - RNA, 13 nt, Homo sapiens
uucccugagucac

SEQ ID NO: 1525363 - RNA, 20 nt, Homo sapiens
uuccucagggacagagacac

SEQ ID NO: 1525364 - RNA, 19 nt, Homo sapiens
uuccucuguucuaucccac

SEQ ID NO: 1525365 - RNA, 16 nt, Homo sapiens
uucuaaaggugcuauu

SEQ ID NO: 1525366 - RNA, 15 nt, Homo sapiens
uucuguccaggacau

SEQ ID NO: 1525367 - RNA, 17 nt, Homo sapiens
uucuuauguugcccagu

SEQ ID NO: 1525368 - RNA, 20 nt, Homo sapiens
uugaaaaauaaaaaccauaa

SEQ ID NO: 1525369 - RNA, 17 nt, Homo sapiens
uugaaccugucaccugg

SEQ ID NO: 1525370 - RNA, 23 nt, Homo sapiens
uugaagaauguugauggugcuag

SEQ ID NO: 1525371 - RNA, 16 nt, Homo sapiens
uugacccauguucccu

SEQ ID NO: 1525372 - RNA, 19 nt, Homo sapiens
uugagcuuaagaauuuuga

SEQ ID NO: 1525373 - RNA, 23 nt, Homo sapiens
uugauuauucugauuccacuuuu

SEQ ID NO: 1525374 - RNA, 17 nt, Homo sapiens
uugcccagagaugccuc

SEQ ID NO: 1525375 - RNA, 16 nt, Homo sapiens
uugcuguucacccaca

SEQ ID NO: 1525376 - RNA, 14 nt, Homo sapiens
uugcuucuauuauu

SEQ ID NO: 1525377 - RNA, 17 nt, Homo sapiens
uuggaaaauaaaucaau

SEQ ID NO: 1525378 - RNA, 14 nt, Homo sapiens
uuguaagaaaacca

SEQ ID NO: 1525379 - RNA, 21 nt, Homo sapiens
uuguaauaguccauggacaau

SEQ ID NO: 1525380 - RNA, 16 nt, Homo sapiens
uuguaucguguggugu

SEQ ID NO: 1525381 - RNA, 19 nt, Homo sapiens
uugucagaguucugcucua

SEQ ID NO: 1525382 - RNA, 16 nt, Homo sapiens
uugugaacuccaucau

SEQ ID NO: 1525383 - RNA, 23 nt, Homo sapiens
uugugcuccugccagcucaggau

SEQ ID NO: 1525384 - RNA, 20 nt, Homo sapiens
uuguguuuuguuuuguauca

SEQ ID NO: 1525385 - RNA, 15 nt, Homo sapiens
uuguucagaugcuuc

SEQ ID NO: 1525386 - RNA, 20 nt, Homo sapiens
uuguucuuugccagucucau

SEQ ID NO: 1525387 - RNA, 19 nt, Homo sapiens
uuguuguuuauaaagggag

SEQ ID NO: 1525388 - RNA, 17 nt, Homo sapiens
uuuaaaaauaauuuugu

SEQ ID NO: 1525389 - RNA, 17 nt, Homo sapiens
uuuaaaauaaggauaau

SEQ ID NO: 1525390 - RNA, 21 nt, Homo sapiens
uuuaaaguauguuauugcaua

SEQ ID NO: 1525391 - RNA, 17 nt, Homo sapiens
uuuaaaguauucuccau

SEQ ID NO: 1525392 - RNA, 14 nt, Homo sapiens
uuuaaauguucaca

SEQ ID NO: 1525393 - RNA, 15 nt, Homo sapiens
uuuaacguuucucau

SEQ ID NO: 1525394 - RNA, 16 nt, Homo sapiens
uuuaauugauuauucu

SEQ ID NO: 1525395 - RNA, 23 nt, Homo sapiens
uuuauaaaagaauaaaauugcac

SEQ ID NO: 1525396 - RNA, 15 nt, Homo sapiens
uuuauaaacugagag

SEQ ID NO: 1525397 - RNA, 16 nt, Homo sapiens
uuucaggccacauggc

SEQ ID NO: 1525398 - RNA, 21 nt, Homo sapiens
uuucaggccacauggcuaaag

SEQ ID NO: 1525399 - RNA, 16 nt, Homo sapiens
uuucauacauuugacu

SEQ ID NO: 1525400 - RNA, 18 nt, Homo sapiens
uuucccaugagugugauc

SEQ ID NO: 1525401 - RNA, 14 nt, Homo sapiens
uuugaaaucuauga

SEQ ID NO: 1525402 - RNA, 16 nt, Homo sapiens
uuugaaucacaguaua

SEQ ID NO: 1525403 - RNA, 18 nt, Homo sapiens
uuugccagugggaacucc

SEQ ID NO: 1525404 - RNA, 14 nt, Homo sapiens
uuuggaauuugaca

SEQ ID NO: 1525405 - RNA, 12 nt, Homo sapiens
uuugguuuucca

SEQ ID NO: 1525406 - RNA, 16 nt, Homo sapiens
uuuguaagaaaaccaa

SEQ ID NO: 1525407 - RNA, 16 nt, Homo sapiens
uuuguaucauuaugaa

SEQ ID NO: 1525408 - RNA, 20 nt, Homo sapiens
uuuguaucauuaugaaguca

SEQ ID NO: 1525409 - RNA, 22 nt, Homo sapiens
uuugugcuaucgcaaaucacaa

SEQ ID NO: 1525410 - RNA, 12 nt, Homo sapiens
uuuuaaaacaca

SEQ ID NO: 1525411 - RNA, 17 nt, Homo sapiens
uuuucaauuuugugcua

SEQ ID NO: 1525412 - RNA, 13 nt, Homo sapiens
uuuucaucuucuu

SEQ ID NO: 1525413 - RNA, 22 nt, Homo sapiens
uuuuccacaagauucccagaga

SEQ ID NO: 1525414 - RNA, 24 nt, Homo sapiens
uuuuuguggauggggacuugugaa

SEQ ID NO: 1525415 - RNA, 12 nt, Homo sapiens
gcucaaacaccc

SEQ ID NO: 1525416 - RNA, 10 nt, Homo sapiens
gcucagagau

SEQ ID NO: 1525417 - RNA, 18 nt, Homo sapiens
gcucauauuguucccuau

SEQ ID NO: 1525418 - RNA, 20 nt, Homo sapiens
gcuccaucgcugucaucuca

SEQ ID NO: 1525419 - RNA, 21 nt, Homo sapiens
gcuccaucgcugucaucucag

SEQ ID NO: 1525420 - RNA, 14 nt, Homo sapiens
gcuccuugucaaua

SEQ ID NO: 1525421 - RNA, 20 nt, Homo sapiens
gcugaaaacugcaacuugua

SEQ ID NO: 1525422 - RNA, 14 nt, Homo sapiens
gcugagagacccaa

SEQ ID NO: 1525423 - RNA, 17 nt, Homo sapiens
gcugcccuuucugcucc

SEQ ID NO: 1525424 - RNA, 17 nt, Homo sapiens
gcuggcagccucaggag

SEQ ID NO: 1525425 - RNA, 13 nt, Homo sapiens
gcuguugccucau

SEQ ID NO: 1525426 - RNA, 17 nt, Homo sapiens
gcuucuagaaccaggca

SEQ ID NO: 1525427 - RNA, 20 nt, Homo sapiens
gcuucucaggccucugcucu

SEQ ID NO: 1525428 - RNA, 22 nt, Homo sapiens
gcuuguaacuccaccaacccau

SEQ ID NO: 1525429 - RNA, 16 nt, Homo sapiens
gcuuuacuccaggaaa

SEQ ID NO: 1525430 - RNA, 17 nt, Homo sapiens
ggaaaaacaaacaugaa

SEQ ID NO: 1525431 - RNA, 13 nt, Homo sapiens
ggaaaacaguauu

SEQ ID NO: 1525432 - RNA, 23 nt, Homo sapiens
ggaaacagacaagcaacccaaac

SEQ ID NO: 1525433 - RNA, 15 nt, Homo sapiens
ggaaaugacccaaac

SEQ ID NO: 1525434 - RNA, 17 nt, Homo sapiens
ggaaaugacccaaacau

SEQ ID NO: 1525435 - RNA, 13 nt, Homo sapiens
ggaacugcaauaa

SEQ ID NO: 1525436 - RNA, 17 nt, Homo sapiens
ggacaugauacugaugc

SEQ ID NO: 1525437 - RNA, 13 nt, Homo sapiens
ggagacugcugag

SEQ ID NO: 1525438 - RNA, 23 nt, Homo sapiens
ggcaacuugggaacuagacuccc

SEQ ID NO: 1525439 - RNA, 22 nt, Homo sapiens
ggcaaugcucaaacacccaagu

SEQ ID NO: 1525440 - RNA, 22 nt, Homo sapiens
ggcagaagaauugaacccagga

SEQ ID NO: 1525441 - RNA, 21 nt, Homo sapiens
ggccgucugcacuucuguucc

SEQ ID NO: 1525442 - RNA, 18 nt, Homo sapiens
ggcuuccccucugucaaa

SEQ ID NO: 1525443 - RNA, 16 nt, Homo sapiens
ggcuucucaggccucu

SEQ ID NO: 1525444 - RNA, 15 nt, Homo sapiens
gggccccaccaccua

SEQ ID NO: 1525445 - RNA, 19 nt, Homo sapiens
gggcuucuagaaccaggca

SEQ ID NO: 1525446 - RNA, 13 nt, Homo sapiens
ggggguuccguga

SEQ ID NO: 1525447 - RNA, 20 nt, Homo sapiens
gggucuuugugagagugagc

SEQ ID NO: 1525448 - RNA, 19 nt, Homo sapiens
gguagagacuuugacucuc

SEQ ID NO: 1525449 - RNA, 16 nt, Homo sapiens
ggucugggaugcugcg

SEQ ID NO: 1525450 - RNA, 15 nt, Homo sapiens
ggugcaguagugagc

SEQ ID NO: 1525451 - RNA, 17 nt, Homo sapiens
gguggagguugcaguga

SEQ ID NO: 1525452 - RNA, 19 nt, Homo sapiens
gguucaccaggucagggag

SEQ ID NO: 1525453 - RNA, 22 nt, Homo sapiens
gguuuaaacuaccucaaaacac

SEQ ID NO: 1525454 - RNA, 14 nt, Homo sapiens
guaacguacauuug

SEQ ID NO: 1525455 - RNA, 18 nt, Homo sapiens
guaagcaaagacuuuccu

SEQ ID NO: 1525456 - RNA, 20 nt, Homo sapiens
guacauuugugcuguuuuca

SEQ ID NO: 1525457 - RNA, 22 nt, Homo sapiens
guaccuauuuuguauguguaua

SEQ ID NO: 1525458 - RNA, 21 nt, Homo sapiens
guacuaauacagacuauguca

SEQ ID NO: 1525459 - RNA, 16 nt, Homo sapiens
guagguggaucaccug

SEQ ID NO: 1525460 - RNA, 13 nt, Homo sapiens
guauaugcaauau

SEQ ID NO: 1525461 - RNA, 19 nt, Homo sapiens
guaucugcuuaggugccag

SEQ ID NO: 1525462 - RNA, 15 nt, Homo sapiens
guauguuugggagac

SEQ ID NO: 1525463 - RNA, 23 nt, Homo sapiens
guauguuugggagacugcugagu

SEQ ID NO: 1525464 - RNA, 17 nt, Homo sapiens
guauuccaccacaggaa

SEQ ID NO: 1525465 - RNA, 19 nt, Homo sapiens
gucaacaucaccccagugg

SEQ ID NO: 1525466 - RNA, 18 nt, Homo sapiens
gucaauccccucauucag

SEQ ID NO: 1525467 - RNA, 23 nt, Homo sapiens
gucaauucugauguuacugagau

SEQ ID NO: 1525468 - RNA, 15 nt, Homo sapiens
gucacaccaucuuaa

SEQ ID NO: 1525469 - RNA, 17 nt, Homo sapiens
gucagaguucugcucua

SEQ ID NO: 1525470 - RNA, 17 nt, Homo sapiens
guccccaguuugcagaa

SEQ ID NO: 1525471 - RNA, 18 nt, Homo sapiens
gucccugucaccaagcuc

SEQ ID NO: 1525472 - RNA, 14 nt, Homo sapiens
guccuaggcucugg

SEQ ID NO: 1525473 - RNA, 17 nt, Homo sapiens
guccuaggcucugggug

SEQ ID NO: 1525474 - RNA, 22 nt, Homo sapiens
guccugcccaaugccuugacaa

SEQ ID NO: 1525475 - RNA, 17 nt, Homo sapiens
gucuacguuaccaggca

SEQ ID NO: 1525476 - RNA, 15 nt, Homo sapiens
gucugaaagacagaa

SEQ ID NO: 1525477 - RNA, 19 nt, Homo sapiens
gucugcuucuguccaggac

SEQ ID NO: 1525478 - RNA, 14 nt, Homo sapiens
gugaaucagacccu

SEQ ID NO: 1525479 - RNA, 23 nt, Homo sapiens
gugcauucaaccuuaccaaaaaa

SEQ ID NO: 1525480 - RNA, 18 nt, Homo sapiens
gugccaauauuucugaua

SEQ ID NO: 1525481 - RNA, 15 nt, Homo sapiens
gugugcaaaggugag

SEQ ID NO: 1525482 - RNA, 17 nt, Homo sapiens
guuccucucugguggcu

SEQ ID NO: 1525483 - RNA, 20 nt, Homo sapiens
guuucugaucugaugcaagc

SEQ ID NO: 1525484 - RNA, 12 nt, Homo sapiens
guuuuugagggg

SEQ ID NO: 1525485 - RNA, 12 nt, Homo sapiens
uaaaaaauuuga

SEQ ID NO: 1525486 - RNA, 20 nt, Homo sapiens
uaaaaacaugagaaauguga

SEQ ID NO: 1525487 - RNA, 23 nt, Homo sapiens
uaaaaacaugagaaaugugaacu

SEQ ID NO: 1525488 - RNA, 23 nt, Homo sapiens
uaaaaauuuuuacaaaacugcca

SEQ ID NO: 1525489 - RNA, 13 nt, Homo sapiens
uaaaacacagaaa

SEQ ID NO: 1525490 - RNA, 22 nt, Homo sapiens
uaaaagaauaaaauugcacuuu

SEQ ID NO: 1525491 - RNA, 23 nt, Homo sapiens
uaaaagaugcauuaucuaugaua

SEQ ID NO: 1525492 - RNA, 14 nt, Homo sapiens
uaaaauugcacuuu

SEQ ID NO: 1525493 - RNA, 17 nt, Homo sapiens
uaaacugaaaaauguca

SEQ ID NO: 1525494 - RNA, 17 nt, Homo sapiens
uaaagagaguuugccac

SEQ ID NO: 1525495 - RNA, 16 nt, Homo sapiens
uaaagcugaaaacugc

SEQ ID NO: 1525496 - RNA, 19 nt, Homo sapiens
uaaaguauguuauugcaua

SEQ ID NO: 1525497 - RNA, 20 nt, Homo sapiens
uaaaguauguuauugcauaa

SEQ ID NO: 1525498 - RNA, 14 nt, Homo sapiens
uaaauaaauuguga

SEQ ID NO: 1525499 - RNA, 22 nt, Homo sapiens
uaaauaguuuuaaauaugaaca

SEQ ID NO: 1525500 - RNA, 15 nt, Homo sapiens
uaaaucaaugcuaua

SEQ ID NO: 1525501 - RNA, 21 nt, Homo sapiens
uaacugaaggagaaggugccc

SEQ ID NO: 1525502 - RNA, 12 nt, Homo sapiens
uaacugcaauuu

SEQ ID NO: 1525503 - RNA, 14 nt, Homo sapiens
uaagcuaagccuua

SEQ ID NO: 1525504 - RNA, 22 nt, Homo sapiens
uaauaaucauucuuuccccuca

SEQ ID NO: 1525505 - RNA, 17 nt, Homo sapiens
cugaagaaaguuauucu

SEQ ID NO: 1525506 - RNA, 16 nt, Homo sapiens
cugaaguaagcaaaga

SEQ ID NO: 1525507 - RNA, 18 nt, Homo sapiens
cugaaugauuuccaaaga

SEQ ID NO: 1525508 - RNA, 20 nt, Homo sapiens
cugaauuuuaaauguucaca

SEQ ID NO: 1525509 - RNA, 20 nt, Homo sapiens
cugagagucugaaagacaga

SEQ ID NO: 1525510 - RNA, 22 nt, Homo sapiens
cugauauaacaaacuacaugua

SEQ ID NO: 1525511 - RNA, 13 nt, Homo sapiens
cugaugcaagcaa

SEQ ID NO: 1525512 - RNA, 12 nt, Homo sapiens
cugaugggacau

SEQ ID NO: 1525513 - RNA, 13 nt, Homo sapiens
cugauguuuauaa

SEQ ID NO: 1525514 - RNA, 21 nt, Homo sapiens
cugauguuuauaaacugagag

SEQ ID NO: 1525515 - RNA, 15 nt, Homo sapiens
cugcacuucuguucc

SEQ ID NO: 1525516 - RNA, 16 nt, Homo sapiens
cugccugggggcgggg

SEQ ID NO: 1525517 - RNA, 12 nt, Homo sapiens
cugcugcugcua

SEQ ID NO: 1525518 - RNA, 13 nt, Homo sapiens
cugcugcugcuau

SEQ ID NO: 1525519 - RNA, 17 nt, Homo sapiens
cugcuuuggaaaucaca

SEQ ID NO: 1525520 - RNA, 23 nt, Homo sapiens
cuggaagcauguaggagaaucca

SEQ ID NO: 1525521 - RNA, 16 nt, Homo sapiens
cuggcagccucaggag

SEQ ID NO: 1525522 - RNA, 23 nt, Homo sapiens
cuggcugaaccaaagaaacaauu

SEQ ID NO: 1525523 - RNA, 13 nt, Homo sapiens
cugggaugcugcg

SEQ ID NO: 1525524 - RNA, 22 nt, Homo sapiens
cugggccccaccaccuaggcca

SEQ ID NO: 1525525 - RNA, 12 nt, Homo sapiens
cugggcucucca

SEQ ID NO: 1525526 - RNA, 19 nt, Homo sapiens
cugggggaccugggguucu

SEQ ID NO: 1525527 - RNA, 18 nt, Homo sapiens
cuggguggggucagggaa

SEQ ID NO: 1525528 - RNA, 17 nt, Homo sapiens
cuguauuagucacagag

SEQ ID NO: 1525529 - RNA, 17 nt, Homo sapiens
cugucaaaucuaguuuc

SEQ ID NO: 1525530 - RNA, 21 nt, Homo sapiens
cugucucuaagucaauuccac

SEQ ID NO: 1525531 - RNA, 16 nt, Homo sapiens
cuguggcggugccugg

SEQ ID NO: 1525532 - RNA, 21 nt, Homo sapiens
cuguuccagguuucuuccacc

SEQ ID NO: 1525533 - RNA, 18 nt, Homo sapiens
cuguucuguuccuugugu

SEQ ID NO: 1525534 - RNA, 13 nt, Homo sapiens
cuuaaauaagucu

SEQ ID NO: 1525535 - RNA, 22 nt, Homo sapiens
cuuaggugccaggcauguccua

SEQ ID NO: 1525536 - RNA, 23 nt, Homo sapiens
cuuaguuuuuaucuuugaccaac

SEQ ID NO: 1525537 - RNA, 13 nt, Homo sapiens
cuuaugugagccc

SEQ ID NO: 1525538 - RNA, 17 nt, Homo sapiens
cuucacucaaucucuga

SEQ ID NO: 1525539 - RNA, 16 nt, Homo sapiens
cuucagugggagaaaa

SEQ ID NO: 1525540 - RNA, 20 nt, Homo sapiens
cuucauaauuucuucacuca

SEQ ID NO: 1525541 - RNA, 16 nt, Homo sapiens
cuuccaaagguuuaaa

SEQ ID NO: 1525542 - RNA, 20 nt, Homo sapiens
cuuccauuucuucugcacau

SEQ ID NO: 1525543 - RNA, 17 nt, Homo sapiens
cuucuaaucaaagcuuu

SEQ ID NO: 1525544 - RNA, 13 nt, Homo sapiens
cuucuagaaccag

SEQ ID NO: 1525545 - RNA, 15 nt, Homo sapiens
cuucuguuccagguu

SEQ ID NO: 1525546 - RNA, 20 nt, Homo sapiens
cuugcccagagaugccucca

SEQ ID NO: 1525547 - RNA, 18 nt, Homo sapiens
cuugcugccaaaagccuu

SEQ ID NO: 1525548 - RNA, 23 nt, Homo sapiens
cuuguaaaugugguaaagaguua

SEQ ID NO: 1525549 - RNA, 12 nt, Homo sapiens
cuugugcuccug

SEQ ID NO: 1525550 - RNA, 19 nt, Homo sapiens
cuuuaaagagaguuugcca

SEQ ID NO: 1525551 - RNA, 22 nt, Homo sapiens
cuuuaauuuccuugacuguaaa

SEQ ID NO: 1525552 - RNA, 17 nt, Homo sapiens
cuuuacuucccaguaua

SEQ ID NO: 1525553 - RNA, 13 nt, Homo sapiens
cuuuagaaugaga

SEQ ID NO: 1525554 - RNA, 21 nt, Homo sapiens
cuuucaggccacauggcuaaa

SEQ ID NO: 1525555 - RNA, 13 nt, Homo sapiens
cuuuccuuccuaa

SEQ ID NO: 1525556 - RNA, 15 nt, Homo sapiens
cuuucucuuugccau

SEQ ID NO: 1525557 - RNA, 19 nt, Homo sapiens
cuuuugcauaagugcauga

SEQ ID NO: 1525558 - RNA, 22 nt, Homo sapiens
cuuuuugggugauuaaaaaacu

SEQ ID NO: 1525559 - RNA, 21 nt, Homo sapiens
gaaaaaacuuucucuuugcca

SEQ ID NO: 1525560 - RNA, 21 nt, Homo sapiens
gaaaauauuuuuuuccuuugc

SEQ ID NO: 1525561 - RNA, 18 nt, Homo sapiens
gaaacacugggcuucuag

SEQ ID NO: 1525562 - RNA, 23 nt, Homo sapiens
gaaacuuuccuuugucauuauua

SEQ ID NO: 1525563 - RNA, 17 nt, Homo sapiens
gaaauaucaugcuccau

SEQ ID NO: 1525564 - RNA, 14 nt, Homo sapiens
gaaauuaauuugug

SEQ ID NO: 1525565 - RNA, 22 nt, Homo sapiens
gaacacuugcccagggcagcuu

SEQ ID NO: 1525566 - RNA, 16 nt, Homo sapiens
gaacauaucauuugug

SEQ ID NO: 1525567 - RNA, 14 nt, Homo sapiens
gaacaugaccaaaa

SEQ ID NO: 1525568 - RNA, 17 nt, Homo sapiens
gaacccagaaauagcca

SEQ ID NO: 1525569 - RNA, 23 nt, Homo sapiens
gaacuccaucauucauccaggac

SEQ ID NO: 1525570 - RNA, 20 nt, Homo sapiens
gaagcuugguccacuugcuu

SEQ ID NO: 1525571 - RNA, 23 nt, Homo sapiens
gaaggauugaucagagcauugug

SEQ ID NO: 1525572 - RNA, 17 nt, Homo sapiens
gaaggugaggucuggga

SEQ ID NO: 1525573 - RNA, 19 nt, Homo sapiens
gaaguaagcaaagacuuuc

SEQ ID NO: 1525574 - RNA, 15 nt, Homo sapiens
gaauaaaauugcacu

SEQ ID NO: 1525575 - RNA, 14 nt, Homo sapiens
gaauaauccagaaa

SEQ ID NO: 1525576 - RNA, 13 nt, Homo sapiens
gaauaucuuccac

SEQ ID NO: 1525577 - RNA, 21 nt, Homo sapiens
gaaugauuucccacucagggc

SEQ ID NO: 1525578 - RNA, 20 nt, Homo sapiens
gaaugugcugaucauuugag

SEQ ID NO: 1525579 - RNA, 22 nt, Homo sapiens
gaauguuccuuucgaaagcaau

SEQ ID NO: 1525580 - RNA, 15 nt, Homo sapiens
gaauuauucagugaa

SEQ ID NO: 1525581 - RNA, 13 nt, Homo sapiens
gacaacagacuga

SEQ ID NO: 1525582 - RNA, 15 nt, Homo sapiens
gacaagcaacccaaa

SEQ ID NO: 1525583 - RNA, 13 nt, Homo sapiens
gacagaaugucac

SEQ ID NO: 1525584 - RNA, 22 nt, Homo sapiens
gacccugcucccacgccugcuu

SEQ ID NO: 1525585 - RNA, 16 nt, Homo sapiens
gacggguaccaugcug

SEQ ID NO: 1525586 - RNA, 20 nt, Homo sapiens
gacuauggcucuacuuucag

SEQ ID NO: 1525587 - RNA, 14 nt, Homo sapiens
gacugcugagucaa

SEQ ID NO: 1525588 - RNA, 23 nt, Homo sapiens
gagaagaauuuucagaccccagc

SEQ ID NO: 1525589 - RNA, 19 nt, Homo sapiens
gagaauaaggaugaaauaa

SEQ ID NO: 1525590 - RNA, 16 nt, Homo sapiens
gagacaacuucccaaa

SEQ ID NO: 1525591 - RNA, 22 nt, Homo sapiens
gagacaacuucccaaagcacaa

SEQ ID NO: 1525592 - RNA, 12 nt, Homo sapiens
gagagacuguuc

SEQ ID NO: 1525593 - RNA, 16 nt, Homo sapiens
gagaugucaucagagc

SEQ ID NO: 1525594 - RNA, 13 nt, Homo sapiens
gagcaggacucac

SEQ ID NO: 1525595 - RNA, 12 nt, Homo sapiens
gagccuggacaa

SEQ ID NO: 1525596 - RNA, 17 nt, Homo sapiens
gaggaaaaacagggaaa

SEQ ID NO: 1525597 - RNA, 20 nt, Homo sapiens
gagggaaguuuaaaacccaa

SEQ ID NO: 1525598 - RNA, 21 nt, Homo sapiens
gaguuugggaacugcaauaac

SEQ ID NO: 1525599 - RNA, 14 nt, Homo sapiens
cuaccucaaaacac

SEQ ID NO: 1525600 - RNA, 15 nt, Homo sapiens
cuagaagaauuugag

SEQ ID NO: 1525601 - RNA, 18 nt, Homo sapiens
cuagagcugagagucuga

SEQ ID NO: 1525602 - RNA, 21 nt, Homo sapiens
cuagcaguaaaagauaaauuu

SEQ ID NO: 1525603 - RNA, 21 nt, Homo sapiens
cuaggccacuccuccaaagga

SEQ ID NO: 1525604 - RNA, 16 nt, Homo sapiens
cuauaacuauguugau

SEQ ID NO: 1525605 - RNA, 17 nt, Homo sapiens
cuaucgcaaaucacaaa

SEQ ID NO: 1525606 - RNA, 16 nt, Homo sapiens
cuauggcacccaugca

SEQ ID NO: 1525607 - RNA, 14 nt, Homo sapiens
cuaugugcaugcag

SEQ ID NO: 1525608 - RNA, 21 nt, Homo sapiens
cuaugugcaugcagcaucuaa

SEQ ID NO: 1525609 - RNA, 18 nt, Homo sapiens
cuauuuaugaaaaccaua

SEQ ID NO: 1525610 - RNA, 16 nt, Homo sapiens
cucacucccauaagcu

SEQ ID NO: 1525611 - RNA, 14 nt, Homo sapiens
cucagacugccaaa

SEQ ID NO: 1525612 - RNA, 21 nt, Homo sapiens
cucauuuucaucuucuuccau

SEQ ID NO: 1525613 - RNA, 20 nt, Homo sapiens
cuccauuguucagaugcuuc

SEQ ID NO: 1525614 - RNA, 15 nt, Homo sapiens
cucccagcccuaugg

SEQ ID NO: 1525615 - RNA, 17 nt, Homo sapiens
cucccugaaguaagcaa

SEQ ID NO: 1525616 - RNA, 20 nt, Homo sapiens
cuccuaccugcugcugcuau

SEQ ID NO: 1525617 - RNA, 23 nt, Homo sapiens
cuccucgaagucccggcuuccac

SEQ ID NO: 1525618 - RNA, 18 nt, Homo sapiens
cuccugccagcucaggau

SEQ ID NO: 1525619 - RNA, 15 nt, Homo sapiens
cuccugcccaggaga

SEQ ID NO: 1525620 - RNA, 14 nt, Homo sapiens
cuccugccuacuca

SEQ ID NO: 1525621 - RNA, 16 nt, Homo sapiens
cucgaagucccggcuu

SEQ ID NO: 1525622 - RNA, 14 nt, Homo sapiens
cucucuccugucca

SEQ ID NO: 1525623 - RNA, 13 nt, Homo sapiens
cucuggcuucuca

SEQ ID NO: 1525624 - RNA, 18 nt, Homo sapiens
cucuguccccggguuuca

SEQ ID NO: 1525625 - RNA, 14 nt, Homo sapiens
cugaaaaaugucag

SEQ ID NO: 1525626 - RNA, 14 nt, Homo sapiens
ucagccaaacugua

SEQ ID NO: 1525627 - RNA, 17 nt, Homo sapiens
ucauaucuuuuaauugu

SEQ ID NO: 1525628 - RNA, 18 nt, Homo sapiens
uccacaauucaaaagcac

SEQ ID NO: 1525629 - RNA, 22 nt, Homo sapiens
ucccagcuacucagguggcuaa

SEQ ID NO: 1525630 - RNA, 21 nt, Homo sapiens
uccuguaagugcuuaaucaua

SEQ ID NO: 1525631 - RNA, 13 nt, Homo sapiens
uccuuacucugag

SEQ ID NO: 1525632 - RNA, 19 nt, Homo sapiens
ucgaccaaacucaguucaa

SEQ ID NO: 1525633 - RNA, 20 nt, Homo sapiens
ucuaaagaauguguucuaaa

SEQ ID NO: 1525634 - RNA, 12 nt, Homo sapiens
ucucuuugauaa

SEQ ID NO: 1525635 - RNA, 20 nt, Homo sapiens
ucugagagaccugugugaac

SEQ ID NO: 1525636 - RNA, 12 nt, Homo sapiens
ucuggcaugaau

SEQ ID NO: 1525637 - RNA, 20 nt, Homo sapiens
ugaaaccauacagcuucaua

SEQ ID NO: 1525638 - RNA, 22 nt, Homo sapiens
ugaaagugacucucacuaaaga

SEQ ID NO: 1525639 - RNA, 16 nt, Homo sapiens
ugaagaggagaacaaa

SEQ ID NO: 1525640 - RNA, 14 nt, Homo sapiens
ugaagucucccuug

SEQ ID NO: 1525641 - RNA, 17 nt, Homo sapiens
ugaccacugaauucacu

SEQ ID NO: 1525642 - RNA, 12 nt, Homo sapiens
ugagaacauucc

SEQ ID NO: 1525643 - RNA, 20 nt, Homo sapiens
ugagaagaucggaacagcuc

SEQ ID NO: 1525644 - RNA, 23 nt, Homo sapiens
ugagacuuaaaacauggugccua

SEQ ID NO: 1525645 - RNA, 14 nt, Homo sapiens
ugauaaauugcugc

SEQ ID NO: 1525646 - RNA, 22 nt, Homo sapiens
ugauaagcuauugucuguaaua

SEQ ID NO: 1525647 - RNA, 22 nt, Homo sapiens
ugauucuuauuugaugguggua

SEQ ID NO: 1525648 - RNA, 16 nt, Homo sapiens
ugcaagggucccuuaa

SEQ ID NO: 1525649 - RNA, 19 nt, Homo sapiens
ugcaauugacauaggcaau

SEQ ID NO: 1525650 - RNA, 14 nt, Homo sapiens
ugcagccagccaca

SEQ ID NO: 1525651 - RNA, 16 nt, Homo sapiens
ugcauaggaauugcac

SEQ ID NO: 1525652 - RNA, 22 nt, Homo sapiens
ugcauaggaauugcacaaucca

SEQ ID NO: 1525653 - RNA, 14 nt, Homo sapiens
ugcugcgugacaua

SEQ ID NO: 1525654 - RNA, 16 nt, Homo sapiens
uggaagaacugugaua

SEQ ID NO: 1525655 - RNA, 14 nt, Homo sapiens
uggaauuccucuuu

SEQ ID NO: 1525656 - RNA, 17 nt, Homo sapiens
uggauuccacacugcac

SEQ ID NO: 1525657 - RNA, 16 nt, Homo sapiens
ugggagcagagaaaau

SEQ ID NO: 1525658 - RNA, 14 nt, Homo sapiens
ugguuuuccagaag

SEQ ID NO: 1525659 - RNA, 13 nt, Homo sapiens
uguagcaugaugu

SEQ ID NO: 1525660 - RNA, 15 nt, Homo sapiens
ugugaaagugacucu

SEQ ID NO: 1525661 - RNA, 19 nt, Homo sapiens
uguguaauuuaagugacac

SEQ ID NO: 1525662 - RNA, 12 nt, Homo sapiens
uuaaagucagaa

SEQ ID NO: 1525663 - RNA, 18 nt, Homo sapiens
uuagaauuuacagcaaga

SEQ ID NO: 1525664 - RNA, 15 nt, Homo sapiens
uucagacaacauuau

SEQ ID NO: 1525665 - RNA, 20 nt, Homo sapiens
uucaguauguccccauaaga

SEQ ID NO: 1525666 - RNA, 16 nt, Homo sapiens
uuccacacugcacugu

SEQ ID NO: 1525667 - RNA, 12 nt, Homo sapiens
uucgaccaaacu

SEQ ID NO: 1525668 - RNA, 13 nt, Homo sapiens
uugacuucugaca

SEQ ID NO: 1525669 - RNA, 14 nt, Homo sapiens
uugacuucugacaa

SEQ ID NO: 1525670 - RNA, 14 nt, Homo sapiens
uugaggaacauuca

SEQ ID NO: 1525671 - RNA, 19 nt, Homo sapiens
uugcaaacugaaagaucug

SEQ ID NO: 1525672 - RNA, 13 nt, Homo sapiens
uugcaugcugaaa

SEQ ID NO: 1525673 - RNA, 14 nt, Homo sapiens
uugcugcgugacau

SEQ ID NO: 1525674 - RNA, 22 nt, Homo sapiens
uuguuaaaacauuggcauuuga

SEQ ID NO: 1525675 - RNA, 14 nt, Homo sapiens
uuguuuucuacuuu

SEQ ID NO: 1525676 - RNA, 18 nt, Homo sapiens
uuuaaaaaggaauuuugu

SEQ ID NO: 1525677 - RNA, 22 nt, Homo sapiens
uuuaaaaauguuugaguauucu

SEQ ID NO: 1525678 - RNA, 21 nt, Homo sapiens
uuuaguaauauuuuacuuuga

SEQ ID NO: 1525679 - RNA, 16 nt, Homo sapiens
uuugaggaacauucaa

SEQ ID NO: 1525680 - RNA, 21 nt, Homo sapiens
uuuguaaaacaaugccaugaa

SEQ ID NO: 1525681 - RNA, 16 nt, Homo sapiens
uuuuaaaaccauuuaa

SEQ ID NO: 1525682 - RNA, 22 nt, Homo sapiens
uuuucacaacaaaagcuuuuga

SEQ ID NO: 1525683 - RNA, 19 nt, Homo sapiens
acuacauuggaagcuuuga

SEQ ID NO: 1525684 - RNA, 18 nt, Homo sapiens
acucacauauaacaugca

SEQ ID NO: 1525685 - RNA, 21 nt, Homo sapiens
acucacauauaacaugcaaac

SEQ ID NO: 1525686 - RNA, 14 nt, Homo sapiens
acucucagcaccaa

SEQ ID NO: 1525687 - RNA, 23 nt, Homo sapiens
acuugaaaccugggcaugguggc

SEQ ID NO: 1525688 - RNA, 15 nt, Homo sapiens
agaaaaaugcugaau

SEQ ID NO: 1525689 - RNA, 15 nt, Homo sapiens
agaaaauuuuguaaa

SEQ ID NO: 1525690 - RNA, 18 nt, Homo sapiens
agaaugagcuuacaaagu

SEQ ID NO: 1525691 - RNA, 16 nt, Homo sapiens
agaccccaaagaucuc

SEQ ID NO: 1525692 - RNA, 16 nt, Homo sapiens
agaccugugugaacua

SEQ ID NO: 1525693 - RNA, 21 nt, Homo sapiens
agagaaaauugugaaagugac

SEQ ID NO: 1525694 - RNA, 17 nt, Homo sapiens
agagaccugugugaacu

SEQ ID NO: 1525695 - RNA, 15 nt, Homo sapiens
agaguggcuuggccu

SEQ ID NO: 1525696 - RNA, 20 nt, Homo sapiens
agauacuaguuuugcugaaa

SEQ ID NO: 1525697 - RNA, 21 nt, Homo sapiens
agaucaacuggaauggauggu

SEQ ID NO: 1525698 - RNA, 18 nt, Homo sapiens
agauguggucaauggaag

SEQ ID NO: 1525699 - RNA, 20 nt, Homo sapiens
agauguggucaauggaagaa

SEQ ID NO: 1525700 - RNA, 19 nt, Homo sapiens
agcaguauuaacuucacag

SEQ ID NO: 1525701 - RNA, 14 nt, Homo sapiens
agcauucagaaagu

SEQ ID NO: 1525702 - RNA, 15 nt, Homo sapiens
agccacaggacccca

SEQ ID NO: 1525703 - RNA, 23 nt, Homo sapiens
agccuuauguggaagaacuguga

SEQ ID NO: 1525704 - RNA, 20 nt, Homo sapiens
agcucacucuggauuccaca

SEQ ID NO: 1525705 - RNA, 15 nt, Homo sapiens
agcucugguauauaa

SEQ ID NO: 1525706 - RNA, 19 nt, Homo sapiens
agcucuuccuauccuguag

SEQ ID NO: 1525707 - RNA, 21 nt, Homo sapiens
agcuguuggaaggacuagguc

SEQ ID NO: 1525708 - RNA, 23 nt, Homo sapiens
aggaaggaagcuguugcuuucuu

SEQ ID NO: 1525709 - RNA, 16 nt, Homo sapiens
aggacagaaagaucuu

SEQ ID NO: 1525710 - RNA, 15 nt, Homo sapiens
aggcaccugugguga

SEQ ID NO: 1525711 - RNA, 23 nt, Homo sapiens
aggccagagaauucaaauuguua

SEQ ID NO: 1525712 - RNA, 18 nt, Homo sapiens
aggguuugauagcacuua

SEQ ID NO: 1525713 - RNA, 15 nt, Homo sapiens
aggucaggaguucga

SEQ ID NO: 1525714 - RNA, 20 nt, Homo sapiens
aggugggcagaucacuggag

SEQ ID NO: 1525715 - RNA, 15 nt, Homo sapiens
agucaugcaucucag

SEQ ID NO: 1525716 - RNA, 19 nt, Homo sapiens
aguccuugggcaguucuca

SEQ ID NO: 1525717 - RNA, 15 nt, Homo sapiens
agugagccaagauca

SEQ ID NO: 1525718 - RNA, 17 nt, Homo sapiens
agugaugaaaacauuca

SEQ ID NO: 1525719 - RNA, 19 nt, Homo sapiens
aguggcuuggccucaagag

SEQ ID NO: 1525720 - RNA, 14 nt, Homo sapiens
agugggcuccagua

SEQ ID NO: 1525721 - RNA, 20 nt, Homo sapiens
agugucuaauaaugcugaag

SEQ ID NO: 1525722 - RNA, 18 nt, Homo sapiens
aguuguucuagcagugaa

SEQ ID NO: 1525723 - RNA, 17 nt, Homo sapiens
auaaaaagaggagcuuu

SEQ ID NO: 1525724 - RNA, 17 nt, Homo sapiens
auaaaauauucacucuc

SEQ ID NO: 1525725 - RNA, 18 nt, Homo sapiens
auaaacgaccaaacucag

SEQ ID NO: 1525726 - RNA, 12 nt, Homo sapiens
auaaacuuuauu

SEQ ID NO: 1525727 - RNA, 15 nt, Homo sapiens
auaaccaaaaggagc

SEQ ID NO: 1525728 - RNA, 19 nt, Homo sapiens
auacccaugcacaguacaa

SEQ ID NO: 1525729 - RNA, 17 nt, Homo sapiens
auaccuuguaaguggau

SEQ ID NO: 1525730 - RNA, 22 nt, Homo sapiens
auagcaguuuguaaaaguguaa

SEQ ID NO: 1525731 - RNA, 14 nt, Homo sapiens
auaggaauugcaca

SEQ ID NO: 1525732 - RNA, 13 nt, Homo sapiens
auaggcaauaaua

SEQ ID NO: 1525733 - RNA, 16 nt, Homo sapiens
auaguguuaacuguca

SEQ ID NO: 1525734 - RNA, 17 nt, Homo sapiens
auauuugcuagauuucu

SEQ ID NO: 1525735 - RNA, 15 nt, Homo sapiens
aucccagcuacucag

SEQ ID NO: 1525736 - RNA, 13 nt, Homo sapiens
augaaaacauuca

SEQ ID NO: 1525737 - RNA, 21 nt, Homo sapiens
augaagugggcuccaguauua

SEQ ID NO: 1525738 - RNA, 19 nt, Homo sapiens
augaucuaauaaacuuuau

SEQ ID NO: 1525739 - RNA, 14 nt, Homo sapiens
augcacaguacaau

SEQ ID NO: 1525740 - RNA, 22 nt, Homo sapiens
augcacaguacaauaauguacu

SEQ ID NO: 1525741 - RNA, 17 nt, Homo sapiens
auggcacucaggaaagu

SEQ ID NO: 1525742 - RNA, 20 nt, Homo sapiens
augggaaaugagaacauucc

SEQ ID NO: 1525743 - RNA, 19 nt, Homo sapiens
auggugccuauaucugaga

SEQ ID NO: 1525744 - RNA, 15 nt, Homo sapiens
auggugguauuguga

SEQ ID NO: 1525745 - RNA, 18 nt, Homo sapiens
auuagccggucauggugg

SEQ ID NO: 1525746 - RNA, 21 nt, Homo sapiens
auucagacaacauuaugaucu

SEQ ID NO: 1525747 - RNA, 22 nt, Homo sapiens
auuuaagaaaaguguuuucaca

SEQ ID NO: 1525748 - RNA, 15 nt, Homo sapiens
ugaugaaaacauuca

SEQ ID NO: 1525749 - RNA, 19 nt, Homo sapiens
ugcccucauacccaugcac

SEQ ID NO: 1525750 - RNA, 18 nt, Homo sapiens
ugccuggacagaggacaa

SEQ ID NO: 1525751 - RNA, 21 nt, Homo sapiens
uggaaaucugccaugagcaca

SEQ ID NO: 1525752 - RNA, 17 nt, Homo sapiens
uggaaugaagguaauau

SEQ ID NO: 1525753 - RNA, 20 nt, Homo sapiens
uggagguugcagugagccaa

SEQ ID NO: 1525754 - RNA, 17 nt, Homo sapiens
uggcuuagggcuggaag

SEQ ID NO: 1525755 - RNA, 19 nt, Homo sapiens
ugggaaaugagaacauucc

SEQ ID NO: 1525756 - RNA, 15 nt, Homo sapiens
uggucaagugaugaa

SEQ ID NO: 1525757 - RNA, 19 nt, Homo sapiens
uguaaauguugugcuguua

SEQ ID NO: 1525758 - RNA, 14 nt, Homo sapiens
uguaacauccaugu

SEQ ID NO: 1525759 - RNA, 21 nt, Homo sapiens
uguacucacauauaacaugca

SEQ ID NO: 1525760 - RNA, 13 nt, Homo sapiens
ugugcaacauucu

SEQ ID NO: 1525761 - RNA, 17 nt, Homo sapiens
ugugcaagggcagugaa

SEQ ID NO: 1525762 - RNA, 15 nt, Homo sapiens
uguucuagcagugaa

SEQ ID NO: 1525763 - RNA, 16 nt, Homo sapiens
uuaacacugcaaauaa

SEQ ID NO: 1525764 - RNA, 16 nt, Homo sapiens
uuaauuguguauuuaa

SEQ ID NO: 1525765 - RNA, 20 nt, Homo sapiens
uuagcaaaagcguccagaaa

SEQ ID NO: 1525766 - RNA, 20 nt, Homo sapiens
uucagacaacauuaugaucu

SEQ ID NO: 1525767 - RNA, 14 nt, Homo sapiens
uuccacacugcacu

SEQ ID NO: 1525768 - RNA, 19 nt, Homo sapiens
uucuucacagugcagugaa

SEQ ID NO: 1525769 - RNA, 19 nt, Homo sapiens
uugaaaaaugagagcugua

SEQ ID NO: 1525770 - RNA, 14 nt, Homo sapiens
uugaaaagaacaaa

SEQ ID NO: 1525771 - RNA, 23 nt, Homo sapiens
uugacuucugacaaaggugguaa

SEQ ID NO: 1525772 - RNA, 23 nt, Homo sapiens
uugauaagcuauugucuguaaua

SEQ ID NO: 1525773 - RNA, 18 nt, Homo sapiens
uugcacaauccaugaaca

SEQ ID NO: 1525774 - RNA, 14 nt, Homo sapiens
uugcaucaguucau

SEQ ID NO: 1525775 - RNA, 18 nt, Homo sapiens
uugccaaggcaagaucua

SEQ ID NO: 1525776 - RNA, 18 nt, Homo sapiens
uugcucccuguugcugaa

SEQ ID NO: 1525777 - RNA, 12 nt, Homo sapiens
uugcuugcugaa

SEQ ID NO: 1525778 - RNA, 10 nt, Homo sapiens
uuucauaaac

SEQ ID NO: 1525779 - RNA, 21 nt, Homo sapiens
uuucccuaaguuuacuucucu

SEQ ID NO: 1525780 - RNA, 19 nt, Homo sapiens
uuucuuuuucccaggccag

SEQ ID NO: 1525781 - RNA, 13 nt, Homo sapiens
uuugaagucagag

SEQ ID NO: 1525782 - RNA, 15 nt, Homo sapiens
ucagcaggcaaagac

SEQ ID NO: 1525783 - RNA, 15 nt, Homo sapiens
ucauacccaugcaca

SEQ ID NO: 1525784 - RNA, 13 nt, Homo sapiens
uccaggacuguuu

SEQ ID NO: 1525785 - RNA, 15 nt, Homo sapiens
ucccccacagccacu

SEQ ID NO: 1525786 - RNA, 23 nt, Homo sapiens
ucccuuggaaaucugccaugagc

SEQ ID NO: 1525787 - RNA, 22 nt, Homo sapiens
uccucuuuaacaagggcugcaa

SEQ ID NO: 1525788 - RNA, 16 nt, Homo sapiens
ucuaauaaacuuuauu

SEQ ID NO: 1525789 - RNA, 15 nt, Homo sapiens
ucucaugucauuuaa

SEQ ID NO: 1525790 - RNA, 20 nt, Homo sapiens
ucuccauuagaaaauuuugu

SEQ ID NO: 1525791 - RNA, 22 nt, Homo sapiens
ucuuaaaauauaagaccucugg

SEQ ID NO: 1525792 - RNA, 13 nt, Homo sapiens
ugaaaacauucaa

SEQ ID NO: 1525793 - RNA, 20 nt, Homo sapiens
ugaaaccccaucucuacuaa

SEQ ID NO: 1525794 - RNA, 15 nt, Homo sapiens
ugaacagcauuagaa

SEQ ID NO: 1525795 - RNA, 15 nt, Homo sapiens
ugaaccuauaagcag

SEQ ID NO: 1525796 - RNA, 22 nt, Homo sapiens
ugaacuguuagguucugaugac

SEQ ID NO: 1525797 - RNA, 16 nt, Homo sapiens
ugaauauguugaucau

SEQ ID NO: 1525798 - RNA, 13 nt, Homo sapiens
ugaauauuucaua

SEQ ID NO: 1525799 - RNA, 14 nt, Homo sapiens
ugaauguaaugaga

SEQ ID NO: 1525800 - RNA, 23 nt, Homo sapiens
ugaauucacuccagucaacagau

SEQ ID NO: 1525801 - RNA, 17 nt, Homo sapiens
ugaauugggaucugauu

SEQ ID NO: 1525802 - RNA, 21 nt, Homo sapiens
ugagaagaucggaacagcucc

SEQ ID NO: 1525803 - RNA, 16 nt, Homo sapiens
ugagacaccugaugac

SEQ ID NO: 1525804 - RNA, 19 nt, Homo sapiens
ugagcagggagaagccaga

SEQ ID NO: 1525805 - RNA, 13 nt, Homo sapiens
ugaggaacauuca

SEQ ID NO: 1525806 - RNA, 14 nt, Homo sapiens
ugaggaacauucaa

SEQ ID NO: 1525807 - RNA, 23 nt, Homo sapiens
ugaguugacuucugacaaaggug

SEQ ID NO: 1525808 - RNA, 18 nt, Homo sapiens
ugcaaacugaaagaucug

SEQ ID NO: 1525809 - RNA, 11 nt, Homo sapiens
ugcaacauucu

SEQ ID NO: 1525810 - RNA, 21 nt, Homo sapiens
ugcacaguacaauaauguacu

SEQ ID NO: 1525811 - RNA, 17 nt, Homo sapiens
ugcauaggaauugcaca

SEQ ID NO: 1525812 - RNA, 12 nt, Homo sapiens
ugcuagauuucu

SEQ ID NO: 1525813 - RNA, 13 nt, Homo sapiens
uggaaaucugcca

SEQ ID NO: 1525814 - RNA, 23 nt, Homo sapiens
uggaagagauaaacgaccaaacu

SEQ ID NO: 1525815 - RNA, 22 nt, Homo sapiens
uggacuguaacauccauguugu

SEQ ID NO: 1525816 - RNA, 15 nt, Homo sapiens
uggagguugcaguga

SEQ ID NO: 1525817 - RNA, 16 nt, Homo sapiens
uggauuccacacugca

SEQ ID NO: 1525818 - RNA, 22 nt, Homo sapiens
uguaauuuaagugacacagaca

SEQ ID NO: 1525819 - RNA, 23 nt, Homo sapiens
uguacucacauauaacaugcaaa

SEQ ID NO: 1525820 - RNA, 20 nt, Homo sapiens
ugugaccacugaauucacuc

SEQ ID NO: 1525821 - RNA, 13 nt, Homo sapiens
uguuaguaguuuc

SEQ ID NO: 1525822 - RNA, 19 nt, Homo sapiens
uguuggaguggaacauugg

SEQ ID NO: 1525823 - RNA, 12 nt, Homo sapiens
uuaaagaaagaa

SEQ ID NO: 1525824 - RNA, 17 nt, Homo sapiens
uuaagugacacagacau

SEQ ID NO: 1525825 - RNA, 12 nt, Homo sapiens
uuacagcaagaa

SEQ ID NO: 1525826 - RNA, 20 nt, Homo sapiens
uucaaagauuuuuauuuuga

SEQ ID NO: 1525827 - RNA, 23 nt, Homo sapiens
uucaccaacaugcccacagauca

SEQ ID NO: 1525828 - RNA, 14 nt, Homo sapiens
uucacuauguuaca

SEQ ID NO: 1525829 - RNA, 15 nt, Homo sapiens
uucacuauguuacau

SEQ ID NO: 1525830 - RNA, 16 nt, Homo sapiens
uucacucuccauuaga

SEQ ID NO: 1525831 - RNA, 20 nt, Homo sapiens
uuccauaguguuaacuguca

SEQ ID NO: 1525832 - RNA, 21 nt, Homo sapiens
uucuggacauucucuuugaua

SEQ ID NO: 1525833 - RNA, 21 nt, Homo sapiens
uugacauaggcaauaauaagu

SEQ ID NO: 1525834 - RNA, 15 nt, Homo sapiens
uugacuucugacaaa

SEQ ID NO: 1525835 - RNA, 16 nt, Homo sapiens
uugcauaggaauugca

SEQ ID NO: 1525836 - RNA, 12 nt, Homo sapiens
uugcuagauuuc

SEQ ID NO: 1525837 - RNA, 13 nt, Homo sapiens
uugcugaaaccau

SEQ ID NO: 1525838 - RNA, 14 nt, Homo sapiens
uuggacuguaacau

SEQ ID NO: 1525839 - RNA, 11 nt, Homo sapiens
uugggcaguuc

SEQ ID NO: 1525840 - RNA, 12 nt, Homo sapiens
uuucaccugaga

SEQ ID NO: 1525841 - RNA, 23 nt, Homo sapiens
uuugaaaaaugagagcuguaacu

SEQ ID NO: 1525842 - RNA, 18 nt, Homo sapiens
uuuggcaguucaaaagac

SEQ ID NO: 1525843 - RNA, 16 nt, Homo sapiens
uuuuaaauaauugcau

SEQ ID NO: 1525844 - RNA, 18 nt, Homo sapiens
uuuuaaauaauugcauca

SEQ ID NO: 1525845 - RNA, 13 nt, Homo sapiens
uuuucaccugaga

SEQ ID NO: 1525846 - RNA, 18 nt, Homo sapiens
uuuuguaaaacaaugcca

SEQ ID NO: 1525847 - RNA, 22 nt, Homo sapiens
aaaaauguuugaguauucugca

SEQ ID NO: 1525848 - RNA, 19 nt, Homo sapiens
aaaacgaaagcugaaccua

SEQ ID NO: 1525849 - RNA, 16 nt, Homo sapiens
aaaauguagcaugaug

SEQ ID NO: 1525850 - RNA, 22 nt, Homo sapiens
aaaauguuuugaaaagaacaaa

SEQ ID NO: 1525851 - RNA, 18 nt, Homo sapiens
aaaaauguuugaguauuc

SEQ ID NO: 1525852 - RNA, 15 nt, Homo sapiens
aaaacaaugccauga

SEQ ID NO: 1525853 - RNA, 11 nt, Homo sapiens
aaaacauucaa

SEQ ID NO: 1525854 - RNA, 13 nt, Homo sapiens
aaaacauuggcau

SEQ ID NO: 1525855 - RNA, 14 nt, Homo sapiens
aaaaggugauucua

SEQ ID NO: 1525856 - RNA, 11 nt, Homo sapiens
aaaauugugaa

SEQ ID NO: 1525857 - RNA, 20 nt, Homo sapiens
aaaauuuuguaaaacaaugc

SEQ ID NO: 1525858 - RNA, 22 nt, Homo sapiens
aaacaggguuugauagcacuua

SEQ ID NO: 1525859 - RNA, 18 nt, Homo sapiens
aaaccauuucagccaaac

SEQ ID NO: 1525860 - RNA, 20 nt, Homo sapiens
aaacguggacucauuucacu

SEQ ID NO: 1525861 - RNA, 19 nt, Homo sapiens
aaacuuugaggaacauuca

SEQ ID NO: 1525862 - RNA, 16 nt, Homo sapiens
aaagcguaaaaggaga

SEQ ID NO: 1525863 - RNA, 16 nt, Homo sapiens
aaauauucacucucca

SEQ ID NO: 1525864 - RNA, 22 nt, Homo sapiens
aaauauucacucuccauuagaa

SEQ ID NO: 1525865 - RNA, 18 nt, Homo sapiens
aaaucugccaugagcaca

SEQ ID NO: 1525866 - RNA, 15 nt, Homo sapiens
aaauguuggagugga

SEQ ID NO: 1525867 - RNA, 16 nt, Homo sapiens
aacauccauguuguca

SEQ ID NO: 1525868 - RNA, 21 nt, Homo sapiens
aacauggugccuauaucugag

SEQ ID NO: 1525869 - RNA, 18 nt, Homo sapiens
aacauuaugaucuaauaa

SEQ ID NO: 1525870 - RNA, 15 nt, Homo sapiens
aacauuggcauuuga

SEQ ID NO: 1525871 - RNA, 15 nt, Homo sapiens
aacccuguguucaca

SEQ ID NO: 1525872 - RNA, 16 nt, Homo sapiens
aaccugggcauggugg

SEQ ID NO: 1525873 - RNA, 12 nt, Homo sapiens
aacgaccaaacu

SEQ ID NO: 1525874 - RNA, 20 nt, Homo sapiens
aacuaaucuaauuacugaag

SEQ ID NO: 1525875 - RNA, 12 nt, Homo sapiens
aacuauugagaa

SEQ ID NO: 1525876 - RNA, 11 nt, Homo sapiens
aacugugauaa

SEQ ID NO: 1525877 - RNA, 18 nt, Homo sapiens
aacuuugaggaacauuca

SEQ ID NO: 1525878 - RNA, 14 nt, Homo sapiens
aagacaaacacugc

SEQ ID NO: 1525879 - RNA, 14 nt, Homo sapiens
aagaccgauugcau

SEQ ID NO: 1525880 - RNA, 17 nt, Homo sapiens
aagagauaaacgaccaa

SEQ ID NO: 1525881 - RNA, 13 nt, Homo sapiens
aagaggagaacaa

SEQ ID NO: 1525882 - RNA, 16 nt, Homo sapiens
aagcucacucuggauu

SEQ ID NO: 1525883 - RNA, 21 nt, Homo sapiens
aagcucacucuggauuccaca

SEQ ID NO: 1525884 - RNA, 12 nt, Homo sapiens
aaggcaucucag

SEQ ID NO: 1525885 - RNA, 19 nt, Homo sapiens
aagggcugcaaugcccuca

SEQ ID NO: 1525886 - RNA, 22 nt, Homo sapiens
aagucagaggagauguggucaa

SEQ ID NO: 1525887 - RNA, 14 nt, Homo sapiens
aaguuuacuucucu

SEQ ID NO: 1525888 - RNA, 16 nt, Homo sapiens
aauaaaauauucacuc

SEQ ID NO: 1525889 - RNA, 15 nt, Homo sapiens
aauaagauauuuagu

SEQ ID NO: 1525890 - RNA, 19 nt, Homo sapiens
aauauaagaccucuggcau

SEQ ID NO: 1525891 - RNA, 11 nt, Homo sapiens
aauauucacuc

SEQ ID NO: 1525892 - RNA, 21 nt, Homo sapiens
aaucauaucuuuuaauugugu

SEQ ID NO: 1525893 - RNA, 20 nt, Homo sapiens
aauccaugaacagcauuaga

SEQ ID NO: 1525894 - RNA, 23 nt, Homo sapiens
aaugcccucauacccaugcacag

SEQ ID NO: 1525895 - RNA, 20 nt, Homo sapiens
aauuuuguaaaacaaugcca

SEQ ID NO: 1525896 - RNA, 15 nt, Homo sapiens
acaaacacugccaua

SEQ ID NO: 1525897 - RNA, 18 nt, Homo sapiens
acaagggcugcaaugccc

SEQ ID NO: 1525898 - RNA, 17 nt, Homo sapiens
acaccuguaaucccagc

SEQ ID NO: 1525899 - RNA, 21 nt, Homo sapiens
acacugcaaauaaacuuggua

SEQ ID NO: 1525900 - RNA, 19 nt, Homo sapiens
acagacauuuugugugaga

SEQ ID NO: 1525901 - RNA, 20 nt, Homo sapiens
acauuuugugugagacuuaa

SEQ ID NO: 1525902 - RNA, 21 nt, Homo sapiens
acccauuauccaggacuguuu

SEQ ID NO: 1525903 - RNA, 11 nt, Homo sapiens
acccuuggcac

SEQ ID NO: 1525904 - RNA, 18 nt, Homo sapiens
accuuuaaauauuucaca

SEQ ID NO: 1525905 - RNA, 12 nt, Homo sapiens
acuaaugaagug

SEQ ID NO: 1525906 - RNA, 17 nt, Homo sapiens
cagagaaaauugugaaa

SEQ ID NO: 1525907 - RNA, 20 nt, Homo sapiens
cagcagaagauuuucaagaa

SEQ ID NO: 1525908 - RNA, 13 nt, Homo sapiens
cagccaaacugua

SEQ ID NO: 1525909 - RNA, 17 nt, Homo sapiens
cagcuccuuacucugag

SEQ ID NO: 1525910 - RNA, 15 nt, Homo sapiens
cagcuguguggugcu

SEQ ID NO: 1525911 - RNA, 15 nt, Homo sapiens
caguaauggaaugaa

SEQ ID NO: 1525912 - RNA, 16 nt, Homo sapiens
caguacuaaugaagug

SEQ ID NO: 1525913 - RNA, 16 nt, Homo sapiens
cagugcccaugggcua

SEQ ID NO: 1525914 - RNA, 15 nt, Homo sapiens
cauggugguggacac

SEQ ID NO: 1525915 - RNA, 21 nt, Homo sapiens
cauuagaauuuacagcaagaa

SEQ ID NO: 1525916 - RNA, 20 nt, Homo sapiens
cauuaguaauaaguaaaaug

SEQ ID NO: 1525917 - RNA, 22 nt, Homo sapiens
cauuaugaucuaauaaacuuua

SEQ ID NO: 1525918 - RNA, 12 nt, Homo sapiens
ccaacaugguga

SEQ ID NO: 1525919 - RNA, 17 nt, Homo sapiens
ccaauugugguugugca

SEQ ID NO: 1525920 - RNA, 17 nt, Homo sapiens
ccacaggaccccaagaa

SEQ ID NO: 1525921 - RNA, 21 nt, Homo sapiens
ccagccuggccaacaugguga

SEQ ID NO: 1525922 - RNA, 14 nt, Homo sapiens
ccagugugcaaggg

SEQ ID NO: 1525923 - RNA, 21 nt, Homo sapiens
ccagugugcaagggcagugaa

SEQ ID NO: 1525924 - RNA, 23 nt, Homo sapiens
ccaugaacagcauuagaauuuac

SEQ ID NO: 1525925 - RNA, 18 nt, Homo sapiens
ccauugggacaugaaguu

SEQ ID NO: 1525926 - RNA, 20 nt, Homo sapiens
cccagugugcaagggcagug

SEQ ID NO: 1525927 - RNA, 12 nt, Homo sapiens
ccccaagaauga

SEQ ID NO: 1525928 - RNA, 15 nt, Homo sapiens
cccccagugugcaag

SEQ ID NO: 1525929 - RNA, 15 nt, Homo sapiens
ccgauuauuguguau

SEQ ID NO: 1525930 - RNA, 17 nt, Homo sapiens
ccggucaugguggugga

SEQ ID NO: 1525931 - RNA, 15 nt, Homo sapiens
ccuaugggaaguagu

SEQ ID NO: 1525932 - RNA, 11 nt, Homo sapiens
ccucaaaagac

SEQ ID NO: 1525933 - RNA, 15 nt, Homo sapiens
ccucauuaguaauaa

SEQ ID NO: 1525934 - RNA, 14 nt, Homo sapiens
ccugggcauggugg

SEQ ID NO: 1525935 - RNA, 23 nt, Homo sapiens
ccuguaaucccagcacuuuggga

SEQ ID NO: 1525936 - RNA, 18 nt, Homo sapiens
ccugugugaacuauugag

SEQ ID NO: 1525937 - RNA, 17 nt, Homo sapiens
ccuuuaaauauuucaca

SEQ ID NO: 1525938 - RNA, 22 nt, Homo sapiens
ccuuugcucccuguugcugaaa

SEQ ID NO: 1525939 - RNA, 20 nt, Homo sapiens
cuaaauaaaaaaaugaauau

SEQ ID NO: 1525940 - RNA, 14 nt, Homo sapiens
cuaauaaugcugaa

SEQ ID NO: 1525941 - RNA, 16 nt, Homo sapiens
cuacucagguggcuaa

SEQ ID NO: 1525942 - RNA, 17 nt, Homo sapiens
cuagaaaucuguugcua

SEQ ID NO: 1525943 - RNA, 12 nt, Homo sapiens
cuauaagccaga

SEQ ID NO: 1525944 - RNA, 14 nt, Homo sapiens
cuauaucugagaga

SEQ ID NO: 1525945 - RNA, 11 nt, Homo sapiens
cuaugcaaggg

SEQ ID NO: 1525946 - RNA, 17 nt, Homo sapiens
cuauguuacauguacau

SEQ ID NO: 1525947 - RNA, 16 nt, Homo sapiens
cucacauauaacaugc

SEQ ID NO: 1525948 - RNA, 18 nt, Homo sapiens
cucacauauaacaugcaa

SEQ ID NO: 1525949 - RNA, 18 nt, Homo sapiens
cucuaaaacccuguguuc

SEQ ID NO: 1525950 - RNA, 19 nt, Homo sapiens
cugagauauauuugcuaga

SEQ ID NO: 1525951 - RNA, 15 nt, Homo sapiens
cugaucuaacaaaau

SEQ ID NO: 1525952 - RNA, 21 nt, Homo sapiens
cugcaacuggagccaagaaga

SEQ ID NO: 1525953 - RNA, 18 nt, Homo sapiens
cuggauuccacacugcac

SEQ ID NO: 1525954 - RNA, 19 nt, Homo sapiens
cuguaagugcuuaaucaua

SEQ ID NO: 1525955 - RNA, 19 nt, Homo sapiens
cuguaaucccagcuacuca

SEQ ID NO: 1525956 - RNA, 20 nt, Homo sapiens
cuuaaagauuuucugcuuga

SEQ ID NO: 1525957 - RNA, 22 nt, Homo sapiens
cuuaauaagauauuuaguaaua

SEQ ID NO: 1525958 - RNA, 17 nt, Homo sapiens
cuuauguggaagaacug

SEQ ID NO: 1525959 - RNA, 15 nt, Homo sapiens
cuuuauaagguuguc

SEQ ID NO: 1525960 - RNA, 23 nt, Homo sapiens
cuuucaguauguccccauaagac

SEQ ID NO: 1525961 - RNA, 21 nt, Homo sapiens
cuuugaguugacuucugacaa

SEQ ID NO: 1525962 - RNA, 20 nt, Homo sapiens
cuuugcucccuguugcugaa

SEQ ID NO: 1525963 - RNA, 18 nt, Homo sapiens
gaagcacagaguggcuug

SEQ ID NO: 1525964 - RNA, 19 nt, Homo sapiens
gaauacccuauaagccaga

SEQ ID NO: 1525965 - RNA, 19 nt, Homo sapiens
gacaaaggugguaaauuca

SEQ ID NO: 1525966 - RNA, 22 nt, Homo sapiens
gacagaggacaauggcuuccau

SEQ ID NO: 1525967 - RNA, 17 nt, Homo sapiens
gaccacugaauucacuc

SEQ ID NO: 1525968 - RNA, 22 nt, Homo sapiens
gacuguuuauagcuguuggaag

SEQ ID NO: 1525969 - RNA, 22 nt, Homo sapiens
gagagucagacccuucaaugga

SEQ ID NO: 1525970 - RNA, 15 nt, Homo sapiens
gaggagaacaaaaug

SEQ ID NO: 1525971 - RNA, 19 nt, Homo sapiens
gaggagcaacagcuggaag

SEQ ID NO: 1525972 - RNA, 16 nt, Homo sapiens
gaggcagguauuagaa

SEQ ID NO: 1525973 - RNA, 15 nt, Homo sapiens
gaguagauacucuca

SEQ ID NO: 1525974 - RNA, 15 nt, Homo sapiens
gauaaacgaccaaac

SEQ ID NO: 1525975 - RNA, 22 nt, Homo sapiens
gauaguuguucuagcagugaag

SEQ ID NO: 1525976 - RNA, 19 nt, Homo sapiens
gaucuaacaaaauaagguu

SEQ ID NO: 1525977 - RNA, 16 nt, Homo sapiens
gauguggucaauggaa

SEQ ID NO: 1525978 - RNA, 20 nt, Homo sapiens
gauugcauaggaauugcaca

SEQ ID NO: 1525979 - RNA, 20 nt, Homo sapiens
gcaaacaggguuugauagca

SEQ ID NO: 1525980 - RNA, 22 nt, Homo sapiens
gcaaagaccgauugcauaggaa

SEQ ID NO: 1525981 - RNA, 16 nt, Homo sapiens
gcacagaguggcuugg

SEQ ID NO: 1525982 - RNA, 15 nt, Homo sapiens
gcagaauacauucaa

SEQ ID NO: 1525983 - RNA, 10 nt, Homo sapiens
gccuucacag

SEQ ID NO: 1525984 - RNA, 16 nt, Homo sapiens
gcuauugucuguaaua

SEQ ID NO: 1525985 - RNA, 13 nt, Homo sapiens
gcuauuucugggu

SEQ ID NO: 1525986 - RNA, 12 nt, Homo sapiens
gcugcaaugccc

SEQ ID NO: 1525987 - RNA, 22 nt, Homo sapiens
ggaaaucugccaugagcacaaa

SEQ ID NO: 1525988 - RNA, 20 nt, Homo sapiens
ggagguggagguugcaguga

SEQ ID NO: 1525989 - RNA, 15 nt, Homo sapiens
ggcagaucacuggag

SEQ ID NO: 1525990 - RNA, 19 nt, Homo sapiens
ggccaaggugggcagauca

SEQ ID NO: 1525991 - RNA, 17 nt, Homo sapiens
gguggagguugcaguga

SEQ ID NO: 1525992 - RNA, 16 nt, Homo sapiens
guaaaacaaugccaug

SEQ ID NO: 1525993 - RNA, 22 nt, Homo sapiens
guaacccgauuauuguguauua

SEQ ID NO: 1525994 - RNA, 19 nt, Homo sapiens
guaauuuaagugacacaga

SEQ ID NO: 1525995 - RNA, 21 nt, Homo sapiens
guacaaaauacguuuuguaaa

SEQ ID NO: 1525996 - RNA, 14 nt, Homo sapiens
guacucacauauaa

SEQ ID NO: 1525997 - RNA, 22 nt, Homo sapiens
guagauacucucagcaccaaga

SEQ ID NO: 1525998 - RNA, 17 nt, Homo sapiens
gucagaauaguccuugg

SEQ ID NO: 1525999 - RNA, 14 nt, Homo sapiens
gucuucuaauuccu

SEQ ID NO: 1526000 - RNA, 16 nt, Homo sapiens
gugaaagugacucuca

SEQ ID NO: 1526001 - RNA, 16 nt, Homo sapiens
gugaacggacacugaa

SEQ ID NO: 1526002 - RNA, 17 nt, Homo sapiens
gugaugaaaacauucaa

SEQ ID NO: 1526003 - RNA, 13 nt, Homo sapiens
guuaauaacucuc

SEQ ID NO: 1526004 - RNA, 12 nt, Homo sapiens
guucgaccaaac

SEQ ID NO: 1526005 - RNA, 16 nt, Homo sapiens
guuuacuucucuaaaa

SEQ ID NO: 1526006 - RNA, 17 nt, Homo sapiens
uaaaacauuggcauuug

SEQ ID NO: 1526007 - RNA, 13 nt, Homo sapiens
uaaaaguguaaca

SEQ ID NO: 1526008 - RNA, 16 nt, Homo sapiens
uaaagauuuucugcuu

SEQ ID NO: 1526009 - RNA, 18 nt, Homo sapiens
uaaauugcugcgugacau

SEQ ID NO: 1526010 - RNA, 14 nt, Homo sapiens
uaagacaaacacug

SEQ ID NO: 1526011 - RNA, 16 nt, Homo sapiens
uaagccagaauccaga

SEQ ID NO: 1526012 - RNA, 21 nt, Homo sapiens
uaaggcaacuuauugcagugu

SEQ ID NO: 1526013 - RNA, 13 nt, Homo sapiens
uaauaaagcuuuu

SEQ ID NO: 1526014 - RNA, 13 nt, Homo sapiens
uaaucccagcacu

SEQ ID NO: 1526015 - RNA, 14 nt, Homo sapiens
uacguauaccuugu

SEQ ID NO: 1526016 - RNA, 16 nt, Homo sapiens
uacuaguuuugcugaa

SEQ ID NO: 1526017 - RNA, 18 nt, Homo sapiens
uagggcuggaagcacaga

SEQ ID NO: 1526018 - RNA, 19 nt, Homo sapiens
uaguccuugggcaguucuc

SEQ ID NO: 1526019 - RNA, 15 nt, Homo sapiens
uaguuagcuauuucu

SEQ ID NO: 1526020 - RNA, 20 nt, Homo sapiens
uauguggaagaacugugaua

SEQ ID NO: 1526021 - RNA, 23 nt, Homo sapiens
uauucaggcuguuguuggcuuag

SEQ ID NO: 1526022 - RNA, 23 nt, Homo sapiens
uauugugaccacugaauucacuc

SEQ ID NO: 1526023 - RNA, 23 nt, Homo sapiens
uauuuaagaaaaguguuuucaca

SEQ ID NO: 1526024 - RNA, 20 nt, Homo sapiens
uauuugcagaauacauucaa

SEQ ID NO: 1526025 - RNA, 21 nt, Homo sapiens
ucaacuggaauggaugguaca

SEQ ID NO: 1526026 - RNA, 19 nt, Homo sapiens
ucagcaccaagagcagcug

SEQ ID NO: 1526027 - RNA, 17 nt, Homo sapiens
aacaaugccaugaacaa

SEQ ID NO: 1526028 - RNA, 18 nt, Homo sapiens
aacccgauuauuguguau

SEQ ID NO: 1526029 - RNA, 13 nt, Homo sapiens
aacccuguguuca

SEQ ID NO: 1526030 - RNA, 14 nt, Homo sapiens
aacggacacugaaa

SEQ ID NO: 1526031 - RNA, 21 nt, Homo sapiens
aacguggacucauuucacuau

SEQ ID NO: 1526032 - RNA, 21 nt, Homo sapiens
aagaggaaugugcaacauucu

SEQ ID NO: 1526033 - RNA, 20 nt, Homo sapiens
aagcgauccuaucaccucag

SEQ ID NO: 1526034 - RNA, 17 nt, Homo sapiens
aaggcguccuuuuggua

SEQ ID NO: 1526035 - RNA, 15 nt, Homo sapiens
aaggugggcagauca

SEQ ID NO: 1526036 - RNA, 14 nt, Homo sapiens
aagugaacuugaug

SEQ ID NO: 1526037 - RNA, 15 nt, Homo sapiens
aaguuucuagaauuu

SEQ ID NO: 1526038 - RNA, 16 nt, Homo sapiens
aauaaaaucauguagu

SEQ ID NO: 1526039 - RNA, 21 nt, Homo sapiens
aauaagauauuuaguaauauu

SEQ ID NO: 1526040 - RNA, 22 nt, Homo sapiens
aauaagugaagaauacaucaga

SEQ ID NO: 1526041 - RNA, 15 nt, Homo sapiens
aauaauaagugaugu

SEQ ID NO: 1526042 - RNA, 23 nt, Homo sapiens
aauacaucagaaaauaaaauauu

SEQ ID NO: 1526043 - RNA, 18 nt, Homo sapiens
aauauuucacauccugua

SEQ ID NO: 1526044 - RNA, 22 nt, Homo sapiens
aaucagccucuucucugaugac

SEQ ID NO: 1526045 - RNA, 14 nt, Homo sapiens
aauccauuccucuu

SEQ ID NO: 1526046 - RNA, 12 nt, Homo sapiens
aaucuguugcua

SEQ ID NO: 1526047 - RNA, 20 nt, Homo sapiens
aaugaaaaggaaacuugaaa

SEQ ID NO: 1526048 - RNA, 12 nt, Homo sapiens
aaugcaauggaa

SEQ ID NO: 1526049 - RNA, 17 nt, Homo sapiens
aaugccaugaacaaauu

SEQ ID NO: 1526050 - RNA, 22 nt, Homo sapiens
aauguuggaguggaacauuggg

SEQ ID NO: 1526051 - RNA, 19 nt, Homo sapiens
aauuagccggucauggugg

SEQ ID NO: 1526052 - RNA, 20 nt, Homo sapiens
aauuagccggucaugguggu

SEQ ID NO: 1526053 - RNA, 20 nt, Homo sapiens
aauucacuccagucaacaga

SEQ ID NO: 1526054 - RNA, 22 nt, Homo sapiens
aauucacuccagucaacagauu

SEQ ID NO: 1526055 - RNA, 13 nt, Homo sapiens
aauuguacugaau

SEQ ID NO: 1526056 - RNA, 15 nt, Homo sapiens
acaacaaaagcuuuu

SEQ ID NO: 1526057 - RNA, 18 nt, Homo sapiens
acaggguuugauagcacu

SEQ ID NO: 1526058 - RNA, 12 nt, Homo sapiens
acagugcaguga

SEQ ID NO: 1526059 - RNA, 22 nt, Homo sapiens
acaugguugauuuugugcuguu

SEQ ID NO: 1526060 - RNA, 13 nt, Homo sapiens
acauuaugaucua

SEQ ID NO: 1526061 - RNA, 14 nt, Homo sapiens
acauuaugaucuaa

SEQ ID NO: 1526062 - RNA, 18 nt, Homo sapiens
acauuggaagcuuugagu

SEQ ID NO: 1526063 - RNA, 16 nt, Homo sapiens
accaaacucaguucaa

SEQ ID NO: 1526064 - RNA, 22 nt, Homo sapiens
accacugaauucacuccaguca

SEQ ID NO: 1526065 - RNA, 23 nt, Homo sapiens
accagaagaaagggccuucacag

SEQ ID NO: 1526066 - RNA, 22 nt, Homo sapiens
accagccuggccaacaugguga

SEQ ID NO: 1526067 - RNA, 17 nt, Homo sapiens
acccaugcacaguacaa

SEQ ID NO: 1526068 - RNA, 15 nt, Homo sapiens
accccaucucuacua

SEQ ID NO: 1526069 - RNA, 15 nt, Homo sapiens
accuguaaucccagc

SEQ ID NO: 1526070 - RNA, 16 nt, Homo sapiens
acuagaagagauuucu

SEQ ID NO: 1526071 - RNA, 11 nt, Homo sapiens
acucauuucac

SEQ ID NO: 1526072 - RNA, 13 nt, Homo sapiens
acugaauucacuc

SEQ ID NO: 1526073 - RNA, 21 nt, Homo sapiens
acugaggacuguuugcaauug

SEQ ID NO: 1526074 - RNA, 12 nt, Homo sapiens
agaacugugaua

SEQ ID NO: 1526075 - RNA, 13 nt, Homo sapiens
agaagagauuucu

SEQ ID NO: 1526076 - RNA, 22 nt, Homo sapiens
agaagcuguguuagaacagcau

SEQ ID NO: 1526077 - RNA, 14 nt, Homo sapiens
agacaaacacugcc

SEQ ID NO: 1526078 - RNA, 22 nt, Homo sapiens
agacagucuucuaauuccucau

SEQ ID NO: 1526079 - RNA, 22 nt, Homo sapiens
agagaaaauugugaaagugacu

SEQ ID NO: 1526080 - RNA, 14 nt, Homo sapiens
agagaccuguguga

SEQ ID NO: 1526081 - RNA, 22 nt, Homo sapiens
agagucagacccuucaauggaa

SEQ ID NO: 1526082 - RNA, 23 nt, Homo sapiens
agaucauaccacggcacuccagc

SEQ ID NO: 1526083 - RNA, 14 nt, Homo sapiens
agaugcugauucau

SEQ ID NO: 1526084 - RNA, 18 nt, Homo sapiens
agccucuucucugaugac

SEQ ID NO: 1526085 - RNA, 18 nt, Homo sapiens
agccugaaaaggacuucu

SEQ ID NO: 1526086 - RNA, 19 nt, Homo sapiens
agcucugguauauaaucca

SEQ ID NO: 1526087 - RNA, 15 nt, Homo sapiens
aggacuucuggcuau

SEQ ID NO: 1526088 - RNA, 13 nt, Homo sapiens
aggagaugugguc

SEQ ID NO: 1526089 - RNA, 19 nt, Homo sapiens
aggagccaacauaacagau

SEQ ID NO: 1526090 - RNA, 15 nt, Homo sapiens
aggagcuggacaccu

SEQ ID NO: 1526091 - RNA, 23 nt, Homo sapiens
aggcaauaauaagugaugugcug

SEQ ID NO: 1526092 - RNA, 17 nt, Homo sapiens
aggcuguuguuggcuua

SEQ ID NO: 1526093 - RNA, 15 nt, Homo sapiens
agggcugcaaugccc

SEQ ID NO: 1526094 - RNA, 21 nt, Homo sapiens
aguauguccccauaagacaaa

SEQ ID NO: 1526095 - RNA, 23 nt, Homo sapiens
agucuauuaaagaaagaaaaaug

SEQ ID NO: 1526096 - RNA, 19 nt, Homo sapiens
aguguucaaauaccaguga

SEQ ID NO: 1526097 - RNA, 14 nt, Homo sapiens
aguucagacuguua

SEQ ID NO: 1526098 - RNA, 13 nt, Homo sapiens
aguuuuucagcuu

SEQ ID NO: 1526099 - RNA, 15 nt, Homo sapiens
auaaaauauucacuc

SEQ ID NO: 1526100 - RNA, 18 nt, Homo sapiens
auaaagcuuuuccugcau

SEQ ID NO: 1526101 - RNA, 18 nt, Homo sapiens
auaagacaaacacugcca

SEQ ID NO: 1526102 - RNA, 12 nt, Homo sapiens
auaaugcugaag

SEQ ID NO: 1526103 - RNA, 23 nt, Homo sapiens
auaaugcugaagaccccaaagau

SEQ ID NO: 1526104 - RNA, 16 nt, Homo sapiens
auuucacuauguuaca

SEQ ID NO: 1526105 - RNA, 12 nt, Homo sapiens
auuucagccaaa

SEQ ID NO: 1526106 - RNA, 18 nt, Homo sapiens
auuuugcuugcugaagga

SEQ ID NO: 1526107 - RNA, 19 nt, Homo sapiens
auuuuguaaaacaaugcca

SEQ ID NO: 1526108 - RNA, 19 nt, Homo sapiens
caaaacaucaaaaugaaua

SEQ ID NO: 1526109 - RNA, 20 nt, Homo sapiens
caaacaggguuugauagcac

SEQ ID NO: 1526110 - RNA, 17 nt, Homo sapiens
caaaggugguaaauuca

SEQ ID NO: 1526111 - RNA, 14 nt, Homo sapiens
caacagauucagaa

SEQ ID NO: 1526112 - RNA, 14 nt, Homo sapiens
caacauuaugaucu

SEQ ID NO: 1526113 - RNA, 23 nt, Homo sapiens
caagagcagcugggaacugacau

SEQ ID NO: 1526114 - RNA, 14 nt, Homo sapiens
caaggcaagaucua

SEQ ID NO: 1526115 - RNA, 18 nt, Homo sapiens
caaugcccucauacccau

SEQ ID NO: 1526116 - RNA, 23 nt, Homo sapiens
cacaacaaaagcuuuugauaaau

SEQ ID NO: 1526117 - RNA, 22 nt, Homo sapiens
cacagacauuuugugugagacu

SEQ ID NO: 1526118 - RNA, 13 nt, Homo sapiens
caccugagaagau

SEQ ID NO: 1526119 - RNA, 14 nt, Homo sapiens
caccuguggugacc

SEQ ID NO: 1526120 - RNA, 16 nt, Homo sapiens
cacgccuguaauccca

SEQ ID NO: 1526121 - RNA, 14 nt, Homo sapiens
cacuauguuacaug

SEQ ID NO: 1526122 - RNA, 21 nt, Homo sapiens
cacugaauucacuccagucaa

SEQ ID NO: 1526123 - RNA, 20 nt, Homo sapiens
cacugcaaauaaacuuggua

SEQ ID NO: 1526124 - RNA, 12 nt, Homo sapiens
cagaaagaucuu

SEQ ID NO: 1526125 - RNA, 18 nt, Homo sapiens
cagaagauuuucaagaac

SEQ ID NO: 1526126 - RNA, 22 nt, Homo sapiens
cagaugccuggacagaggacaa

SEQ ID NO: 1526127 - RNA, 18 nt, Homo sapiens
cagccacagguacagagc

SEQ ID NO: 1526128 - RNA, 21 nt, Homo sapiens
cagccuggccaacauggugaa

SEQ ID NO: 1526129 - RNA, 21 nt, Homo sapiens
cagcugagaggcauccagaaa

SEQ ID NO: 1526130 - RNA, 19 nt, Homo sapiens
cagcuguguggugcuucug

SEQ ID NO: 1526131 - RNA, 16 nt, Homo sapiens
cagucuucuaauuccu

SEQ ID NO: 1526132 - RNA, 14 nt, Homo sapiens
cagugagacugugg

SEQ ID NO: 1526133 - RNA, 12 nt, Homo sapiens
cagugcagugaa

SEQ ID NO: 1526134 - RNA, 20 nt, Homo sapiens
cauaagacaaacacugccau

SEQ ID NO: 1526135 - RNA, 20 nt, Homo sapiens
cauaucuuuuaauuguguau

SEQ ID NO: 1526136 - RNA, 15 nt, Homo sapiens
caucaaaaugaauag

SEQ ID NO: 1526137 - RNA, 15 nt, Homo sapiens
caucaguucauugac

SEQ ID NO: 1526138 - RNA, 19 nt, Homo sapiens
cauccuguaagugcuuaau

SEQ ID NO: 1526139 - RNA, 12 nt, Homo sapiens
caucucuacuaa

SEQ ID NO: 1526140 - RNA, 14 nt, Homo sapiens
caugaacagcauua

SEQ ID NO: 1526141 - RNA, 23 nt, Homo sapiens
caugaauauuucauaucuauaaa

SEQ ID NO: 1526142 - RNA, 19 nt, Homo sapiens
cauguugucaauacguaua

SEQ ID NO: 1526143 - RNA, 19 nt, Homo sapiens
cauuucagccaaacuguag

SEQ ID NO: 1526144 - RNA, 20 nt, Homo sapiens
cauuugaagaggagaacaaa

SEQ ID NO: 1526145 - RNA, 18 nt, Homo sapiens
ccaccaauugagcaagau

SEQ ID NO: 1526146 - RNA, 22 nt, Homo sapiens
ccagaagaaagggccuucacag

SEQ ID NO: 1526147 - RNA, 22 nt, Homo sapiens
ccagccuggccaacauggugaa

SEQ ID NO: 1526148 - RNA, 15 nt, Homo sapiens
ccagccugggugaca

SEQ ID NO: 1526149 - RNA, 19 nt, Homo sapiens
ccagugaugaaaacauuca

SEQ ID NO: 1526150 - RNA, 22 nt, Homo sapiens
cccaagaaugagcuuacaaagu

SEQ ID NO: 1526151 - RNA, 14 nt, Homo sapiens
ccgugccaaaagac

SEQ ID NO: 1526152 - RNA, 20 nt, Homo sapiens
ccugaaaaggacuucuggcu

SEQ ID NO: 1526153 - RNA, 13 nt, Homo sapiens
ccuguggugaccc

SEQ ID NO: 1526154 - RNA, 17 nt, Homo sapiens
ccuuuaguaaugaaugu

SEQ ID NO: 1526155 - RNA, 17 nt, Homo sapiens
ccuuuuuccauaguguu

SEQ ID NO: 1526156 - RNA, 23 nt, Homo sapiens
cgagaguggguguuggacagugu

SEQ ID NO: 1526157 - RNA, 19 nt, Homo sapiens
cuaaauaaaaaaaugaaua

SEQ ID NO: 1526158 - RNA, 18 nt, Homo sapiens
aaaaaggaauuuuguaaa

SEQ ID NO: 1526159 - RNA, 18 nt, Homo sapiens
aaaaugagagcuguaacu

SEQ ID NO: 1526160 - RNA, 18 nt, Homo sapiens
aaacacugccauauugug

SEQ ID NO: 1526161 - RNA, 16 nt, Homo sapiens
aaaccagccuggccaa

SEQ ID NO: 1526162 - RNA, 13 nt, Homo sapiens
aaaccccaucucu

SEQ ID NO: 1526163 - RNA, 22 nt, Homo sapiens
aaaccugggcaugguggcucac

SEQ ID NO: 1526164 - RNA, 20 nt, Homo sapiens
aaagauguuaguaguuucuc

SEQ ID NO: 1526165 - RNA, 20 nt, Homo sapiens
aaaggaaaaugaaacuagaa

SEQ ID NO: 1526166 - RNA, 14 nt, Homo sapiens
aaaggaaacuugaa

SEQ ID NO: 1526167 - RNA, 17 nt, Homo sapiens
aaagugacucucacuaa

SEQ ID NO: 1526168 - RNA, 16 nt, Homo sapiens
aaauaaaauauucacu

SEQ ID NO: 1526169 - RNA, 14 nt, Homo sapiens
aaauaccagugaac

SEQ ID NO: 1526170 - RNA, 15 nt, Homo sapiens
aaauauucacucucc

SEQ ID NO: 1526171 - RNA, 12 nt, Homo sapiens
aaauauuucaca

SEQ ID NO: 1526172 - RNA, 20 nt, Homo sapiens
aaauauuucacauccuguaa

SEQ ID NO: 1526173 - RNA, 20 nt, Homo sapiens
aaauguuuugaaaagaacaa

SEQ ID NO: 1526174 - RNA, 15 nt, Homo sapiens
aaauuagccggucau

SEQ ID NO: 1526175 - RNA, 19 nt, Homo sapiens
aacagcuuauugacuuaau

SEQ ID NO: 1526176 - RNA, 21 nt, Homo sapiens
aacaggguuugauagcacuua

SEQ ID NO: 1526177 - RNA, 19 nt, Homo sapiens
aacauggugccuauaucug

SEQ ID NO: 1526178 - RNA, 23 nt, Homo sapiens
aacugaggacuguuugcaauuga

SEQ ID NO: 1526179 - RNA, 13 nt, Homo sapiens
aagaacugugaua

SEQ ID NO: 1526180 - RNA, 14 nt, Homo sapiens
aagaauacaucaga

SEQ ID NO: 1526181 - RNA, 16 nt, Homo sapiens
aagacaaacacugcca

SEQ ID NO: 1526182 - RNA, 14 nt, Homo sapiens
aagaccucuggcau

SEQ ID NO: 1526183 - RNA, 24 nt, Homo sapiens
aagcacagaguggcuuggccucaa

SEQ ID NO: 1526184 - RNA, 18 nt, Homo sapiens
aagcuauugucuguaaua

SEQ ID NO: 1526185 - RNA, 13 nt, Homo sapiens
aaggccuuuagua

SEQ ID NO: 1526186 - RNA, 15 nt, Homo sapiens
aaguggccuuuccag

SEQ ID NO: 1526187 - RNA, 17 nt, Homo sapiens
aauaaaauauucacucu

SEQ ID NO: 1526188 - RNA, 21 nt, Homo sapiens
aauagaaacuacccaucucaa

SEQ ID NO: 1526189 - RNA, 16 nt, Homo sapiens
aauauaagaccucugg

SEQ ID NO: 1526190 - RNA, 15 nt, Homo sapiens
aaugugcaacauucu

SEQ ID NO: 1526191 - RNA, 17 nt, Homo sapiens
aauuuuguaaaguuucu

SEQ ID NO: 1526192 - RNA, 20 nt, Homo sapiens
acaagggcugcaaugcccuc

SEQ ID NO: 1526193 - RNA, 19 nt, Homo sapiens
acaauccaugaacagcauu

SEQ ID NO: 1526194 - RNA, 18 nt, Homo sapiens
acaccugaugaccuguua

SEQ ID NO: 1526195 - RNA, 19 nt, Homo sapiens
acagucuucuaauuccuca

SEQ ID NO: 1526196 - RNA, 18 nt, Homo sapiens
acauccuguaagugcuua

SEQ ID NO: 1526197 - RNA, 19 nt, Homo sapiens
acaucuaaaagaugaaguu

SEQ ID NO: 1526198 - RNA, 15 nt, Homo sapiens
acauucucuuugaua

SEQ ID NO: 1526199 - RNA, 16 nt, Homo sapiens
accacugaauucacuc

SEQ ID NO: 1526200 - RNA, 22 nt, Homo sapiens
accaggaaggaagcuguugcuu

SEQ ID NO: 1526201 - RNA, 16 nt, Homo sapiens
accauuucagccaaac

SEQ ID NO: 1526202 - RNA, 19 nt, Homo sapiens
uugaguugacuucugacaa

SEQ ID NO: 1526203 - RNA, 15 nt, Homo sapiens
uugcacaauccauga

SEQ ID NO: 1526204 - RNA, 13 nt, Homo sapiens
uugcuagauuucu

SEQ ID NO: 1526205 - RNA, 14 nt, Homo sapiens
uuggaaaucugcca

SEQ ID NO: 1526206 - RNA, 22 nt, Homo sapiens
uuggucagaaagauaagccagu

SEQ ID NO: 1526207 - RNA, 18 nt, Homo sapiens
uuguaaaguuucuagaau

SEQ ID NO: 1526208 - RNA, 21 nt, Homo sapiens
uugugaccacugaauucacuc

SEQ ID NO: 1526209 - RNA, 22 nt, Homo sapiens
uugugaccacugaauucacucc

SEQ ID NO: 1526210 - RNA, 15 nt, Homo sapiens
uuuacagcaagaaca

SEQ ID NO: 1526211 - RNA, 13 nt, Homo sapiens
uuugauagcacuu

SEQ ID NO: 1526212 - RNA, 18 nt, Homo sapiens
uuugcagaauacauucaa

SEQ ID NO: 1526213 - RNA, 18 nt, Homo sapiens
uuuguaaaacaaugccau

SEQ ID NO: 1526214 - RNA, 23 nt, Homo sapiens
uuuguaaaacaaugccaugaaca

SEQ ID NO: 1526215 - RNA, 16 nt, Homo sapiens
uuuugaaaagaacaaa

SEQ ID NO: 1526216 - RNA, 15 nt, Homo sapiens
gaaggagagugcuug

SEQ ID NO: 1526217 - RNA, 21 nt, Homo sapiens
gaagucagaggagaugugguc

SEQ ID NO: 1526218 - RNA, 17 nt, Homo sapiens
gaagucucccuuggaaa

SEQ ID NO: 1526219 - RNA, 16 nt, Homo sapiens
gaauauguugaucauu

SEQ ID NO: 1526220 - RNA, 18 nt, Homo sapiens
gaauggucaagugaugaa

SEQ ID NO: 1526221 - RNA, 12 nt, Homo sapiens
gacaaacacugc

SEQ ID NO: 1526222 - RNA, 16 nt, Homo sapiens
gacagaaagaucuuca

SEQ ID NO: 1526223 - RNA, 18 nt, Homo sapiens
gacaguguagcacucuac

SEQ ID NO: 1526224 - RNA, 13 nt, Homo sapiens
gagaaucacuuca

SEQ ID NO: 1526225 - RNA, 17 nt, Homo sapiens
gagauguggucaaugga

SEQ ID NO: 1526226 - RNA, 21 nt, Homo sapiens
gaguggcuuggccucaagaga

SEQ ID NO: 1526227 - RNA, 16 nt, Homo sapiens
gauggugguauuguga

SEQ ID NO: 1526228 - RNA, 20 nt, Homo sapiens
gauuccacacugcacuguua

SEQ ID NO: 1526229 - RNA, 12 nt, Homo sapiens
gcaauggaagaa

SEQ ID NO: 1526230 - RNA, 12 nt, Homo sapiens
gcaccuguggug

SEQ ID NO: 1526231 - RNA, 16 nt, Homo sapiens
gcagagaaaauuguga

SEQ ID NO: 1526232 - RNA, 22 nt, Homo sapiens
gcagagaaaauugugaaaguga

SEQ ID NO: 1526233 - RNA, 23 nt, Homo sapiens
gcagagaaaauugugaaagugac

SEQ ID NO: 1526234 - RNA, 17 nt, Homo sapiens
gcagcugggaacugaca

SEQ ID NO: 1526235 - RNA, 21 nt, Homo sapiens
gcauuugaagaggagaacaaa

SEQ ID NO: 1526236 - RNA, 20 nt, Homo sapiens
gccaggagcuggacaccuac

SEQ ID NO: 1526237 - RNA, 14 nt, Homo sapiens
gcccucauacccau

SEQ ID NO: 1526238 - RNA, 23 nt, Homo sapiens
gccugaaaaggacuucuggcuau

SEQ ID NO: 1526239 - RNA, 15 nt, Homo sapiens
gccugggugacagug

SEQ ID NO: 1526240 - RNA, 17 nt, Homo sapiens
ggaaaugagaacauucc

SEQ ID NO: 1526241 - RNA, 17 nt, Homo sapiens
ggaaugugcaacauucu

SEQ ID NO: 1526242 - RNA, 17 nt, Homo sapiens
ggcaaagaccgauugca

SEQ ID NO: 1526243 - RNA, 13 nt, Homo sapiens
ggcuaugcaaggg

SEQ ID NO: 1526244 - RNA, 20 nt, Homo sapiens
gggagguggagguugcagug

SEQ ID NO: 1526245 - RNA, 21 nt, Homo sapiens
ggggcuagaaaucuguugcua

SEQ ID NO: 1526246 - RNA, 21 nt, Homo sapiens
gguugcagugagccaagauca

SEQ ID NO: 1526247 - RNA, 17 nt, Homo sapiens
guaagaaaaaucugcua

SEQ ID NO: 1526248 - RNA, 13 nt, Homo sapiens
guaauaaguaaaa

SEQ ID NO: 1526249 - RNA, 22 nt, Homo sapiens
guacucacauauaacaugcaaa

SEQ ID NO: 1526250 - RNA, 20 nt, Homo sapiens
guauguccccauaagacaaa

SEQ ID NO: 1526251 - RNA, 16 nt, Homo sapiens
guauugugaccacuga

SEQ ID NO: 1526252 - RNA, 19 nt, Homo sapiens
gucugagauauauuugcua

SEQ ID NO: 1526253 - RNA, 14 nt, Homo sapiens
guggaacauugggg

SEQ ID NO: 1526254 - RNA, 17 nt, Homo sapiens
guggaagaacugugaua

SEQ ID NO: 1526255 - RNA, 22 nt, Homo sapiens
gugguuuuccagaagugaugaa

SEQ ID NO: 1526256 - RNA, 23 nt, Homo sapiens
guuucuggacauucucuuugaua

SEQ ID NO: 1526257 - RNA, 17 nt, Homo sapiens
guuuugaaaagaacaaa

SEQ ID NO: 1526258 - RNA, 17 nt, Homo sapiens
uaaaacagcagaagauu

SEQ ID NO: 1526259 - RNA, 15 nt, Homo sapiens
uaaaagucugagaua

SEQ ID NO: 1526260 - RNA, 15 nt, Homo sapiens
uaaaauauucacucu

SEQ ID NO: 1526261 - RNA, 13 nt, Homo sapiens
uaaagaagccagc

SEQ ID NO: 1526262 - RNA, 20 nt, Homo sapiens
uaacaagggcugcaaugccc

SEQ ID NO: 1526263 - RNA, 21 nt, Homo sapiens
uaacaagggcugcaaugcccu

SEQ ID NO: 1526264 - RNA, 18 nt, Homo sapiens
uaacagaugggcuggaag

SEQ ID NO: 1526265 - RNA, 18 nt, Homo sapiens
uaacugaggacuguuugc

SEQ ID NO: 1526266 - RNA, 22 nt, Homo sapiens
uaacugaggacuguuugcaauu

SEQ ID NO: 1526267 - RNA, 15 nt, Homo sapiens
uaagacaaacacugc

SEQ ID NO: 1526268 - RNA, 16 nt, Homo sapiens
uaagugacacagacau

SEQ ID NO: 1526269 - RNA, 20 nt, Homo sapiens
uaauaagauauuuaguaaua

SEQ ID NO: 1526270 - RNA, 22 nt, Homo sapiens
uaaugagagaaaauguuuugaa

SEQ ID NO: 1526271 - RNA, 23 nt, Homo sapiens
uaauugcaucaguucauugaccu

SEQ ID NO: 1526272 - RNA, 15 nt, Homo sapiens
uaauuuaagugacac

SEQ ID NO: 1526273 - RNA, 13 nt, Homo sapiens
uacagagccacag

SEQ ID NO: 1526274 - RNA, 13 nt, Homo sapiens
uacucacauauaa

SEQ ID NO: 1526275 - RNA, 19 nt, Homo sapiens
uagaagagauuucuaaaag

SEQ ID NO: 1526276 - RNA, 14 nt, Homo sapiens
uauaacaugcaaac

SEQ ID NO: 1526277 - RNA, 13 nt, Homo sapiens
uauaaccaaaagg

SEQ ID NO: 1526278 - RNA, 22 nt, Homo sapiens
uaucauuggaugauauguugau

SEQ ID NO: 1526279 - RNA, 19 nt, Homo sapiens
uaugugacuuaaagucaga

SEQ ID NO: 1526280 - RNA, 14 nt, Homo sapiens
uauuucauaucuau

SEQ ID NO: 1526281 - RNA, 13 nt, Homo sapiens
ucaaaaugaauag

SEQ ID NO: 1526282 - RNA, 16 nt, Homo sapiens
ucacuauguuacaugu

SEQ ID NO: 1526283 - RNA, 22 nt, Homo sapiens
ucagaaaauaaaauauucacuc

SEQ ID NO: 1526284 - RNA, 11 nt, Homo sapiens
ucagacuguua

SEQ ID NO: 1526285 - RNA, 15 nt, Homo sapiens
ucagccaaacuguag

SEQ ID NO: 1526286 - RNA, 18 nt, Homo sapiens
ucaggaguucgaaaccag

SEQ ID NO: 1526287 - RNA, 15 nt, Homo sapiens
ucaguauguccccau

SEQ ID NO: 1526288 - RNA, 16 nt, Homo sapiens
ucaguauguccccaua

SEQ ID NO: 1526289 - RNA, 14 nt, Homo sapiens
ucauacccaugcac

SEQ ID NO: 1526290 - RNA, 23 nt, Homo sapiens
ucauggugguggacaccuguaau

SEQ ID NO: 1526291 - RNA, 15 nt, Homo sapiens
uccagaacaaagcac

SEQ ID NO: 1526292 - RNA, 20 nt, Homo sapiens
ucccaggacagaaagaucuu

SEQ ID NO: 1526293 - RNA, 22 nt, Homo sapiens
ucccccacagccacuacugacu

SEQ ID NO: 1526294 - RNA, 14 nt, Homo sapiens
ucccuguugcugaa

SEQ ID NO: 1526295 - RNA, 21 nt, Homo sapiens
ucccuuaaagauuuucugcuu

SEQ ID NO: 1526296 - RNA, 12 nt, Homo sapiens
uccuauccugua

SEQ ID NO: 1526297 - RNA, 16 nt, Homo sapiens
uccucucacucuucag

SEQ ID NO: 1526298 - RNA, 15 nt, Homo sapiens
uccuuacucugagga

SEQ ID NO: 1526299 - RNA, 19 nt, Homo sapiens
uccuucuacuguccuggcu

SEQ ID NO: 1526300 - RNA, 19 nt, Homo sapiens
uccuuugcucccuguugcu

SEQ ID NO: 1526301 - RNA, 16 nt, Homo sapiens
ucuaaagaauguguuc

SEQ ID NO: 1526302 - RNA, 22 nt, Homo sapiens
ucuauucaggcuguuguuggcu

SEQ ID NO: 1526303 - RNA, 16 nt, Homo sapiens
ucucagcaggcaaaga

SEQ ID NO: 1526304 - RNA, 24 nt, Homo sapiens
ucugagacaccugaugaccuguua

SEQ ID NO: 1526305 - RNA, 17 nt, Homo sapiens
ucuuauuugaugguggu

SEQ ID NO: 1526306 - RNA, 14 nt, Homo sapiens
ucuuugaggugauu

SEQ ID NO: 1526307 - RNA, 13 nt, Homo sapiens
ugaaaagaacaaa

SEQ ID NO: 1526308 - RNA, 20 nt, Homo sapiens
ugaaacuagaagagauuucu

SEQ ID NO: 1526309 - RNA, 20 nt, Homo sapiens
ugacuacauuggaagcuuug

SEQ ID NO: 1526310 - RNA, 21 nt, Homo sapiens
ugagaagauuuuaaaaccauu

SEQ ID NO: 1526311 - RNA, 17 nt, Homo sapiens
ugagacuuaaaacaugg

SEQ ID NO: 1526312 - RNA, 12 nt, Homo sapiens
ugauuguacaaa

SEQ ID NO: 1526313 - RNA, 20 nt, Homo sapiens
ugcaaugcccucauacccau

SEQ ID NO: 1526314 - RNA, 19 nt, Homo sapiens
ugcaucaguucauugaccu

SEQ ID NO: 1526315 - RNA, 19 nt, Homo sapiens
ugccaaaguagcugaugua

SEQ ID NO: 1526316 - RNA, 17 nt, Homo sapiens
ugccaaggcaagaucua

SEQ ID NO: 1526317 - RNA, 14 nt, Homo sapiens
ugcccaugggcuau

SEQ ID NO: 1526318 - RNA, 15 nt, Homo sapiens
ugccuauaucugaga

SEQ ID NO: 1526319 - RNA, 13 nt, Homo sapiens
ugcgaaauccaga

SEQ ID NO: 1526320 - RNA, 13 nt, Homo sapiens
ugcugaaaccaua

SEQ ID NO: 1526321 - RNA, 22 nt, Homo sapiens
ugcugaaggaagaaaaaguguu

SEQ ID NO: 1526322 - RNA, 13 nt, Homo sapiens
ugcuuaaucauau

SEQ ID NO: 1526323 - RNA, 11 nt, Homo sapiens
ugcuugcugaa

SEQ ID NO: 1526324 - RNA, 15 nt, Homo sapiens
uggaagcacagagug

SEQ ID NO: 1526325 - RNA, 16 nt, Homo sapiens
uggaaugaagguaaua

SEQ ID NO: 1526326 - RNA, 21 nt, Homo sapiens
ugguugauuuugugcuguugu

SEQ ID NO: 1526327 - RNA, 19 nt, Homo sapiens
uguaaaguuucuagaauuu

SEQ ID NO: 1526328 - RNA, 16 nt, Homo sapiens
ugugcaagggcaguga

SEQ ID NO: 1526329 - RNA, 20 nt, Homo sapiens
uguguauuuaagaaaagugu

SEQ ID NO: 1526330 - RNA, 23 nt, Homo sapiens
uguguucacaaaggcagagaguc

SEQ ID NO: 1526331 - RNA, 17 nt, Homo sapiens
uguuguagcucugguau

SEQ ID NO: 1526332 - RNA, 11 nt, Homo sapiens
uguuuucacaa

SEQ ID NO: 1526333 - RNA, 21 nt, Homo sapiens
uuauguggaagaacugugaua

SEQ ID NO: 1526334 - RNA, 13 nt, Homo sapiens
uucauaucuauaa

SEQ ID NO: 1526335 - RNA, 14 nt, Homo sapiens
uuccucauuaguaa

SEQ ID NO: 1526336 - RNA, 17 nt, Homo sapiens
uugaagaggagaacaaa

SEQ ID NO: 1526337 - RNA, 20 nt, Homo sapiens
acccuuggcacaggugucca

SEQ ID NO: 1526338 - RNA, 22 nt, Homo sapiens
accucuggcaugaauauuucau

SEQ ID NO: 1526339 - RNA, 17 nt, Homo sapiens
acgccuguaaucccagc

SEQ ID NO: 1526340 - RNA, 17 nt, Homo sapiens
acucaguucgaccaaac

SEQ ID NO: 1526341 - RNA, 14 nt, Homo sapiens
acuguccuggcuac

SEQ ID NO: 1526342 - RNA, 16 nt, Homo sapiens
acuuaauaaagcuuuu

SEQ ID NO: 1526343 - RNA, 13 nt, Homo sapiens
acuugaaaccugg

SEQ ID NO: 1526344 - RNA, 22 nt, Homo sapiens
acuugaaaccugggcauggugg

SEQ ID NO: 1526345 - RNA, 23 nt, Homo sapiens
agaaaauuuuguaaaacaaugcc

SEQ ID NO: 1526346 - RNA, 13 nt, Homo sapiens
agaauacauucaa

SEQ ID NO: 1526347 - RNA, 16 nt, Homo sapiens
agaauggaauaagcag

SEQ ID NO: 1526348 - RNA, 18 nt, Homo sapiens
agacaacauuaugaucua

SEQ ID NO: 1526349 - RNA, 14 nt, Homo sapiens
agacaccugaugac

SEQ ID NO: 1526350 - RNA, 22 nt, Homo sapiens
agagaaacuagaaacaguuaaa

SEQ ID NO: 1526351 - RNA, 13 nt, Homo sapiens
agagaaucccagg

SEQ ID NO: 1526352 - RNA, 13 nt, Homo sapiens
agaggagaacaaa

SEQ ID NO: 1526353 - RNA, 23 nt, Homo sapiens
agaguggcuuggccucaagagaa

SEQ ID NO: 1526354 - RNA, 12 nt, Homo sapiens
agauacucucag

SEQ ID NO: 1526355 - RNA, 13 nt, Homo sapiens
agaucaacuggaa

SEQ ID NO: 1526356 - RNA, 14 nt, Homo sapiens
agaucaacuggaau

SEQ ID NO: 1526357 - RNA, 19 nt, Homo sapiens
agauguuaguaguuucuca

SEQ ID NO: 1526358 - RNA, 23 nt, Homo sapiens
agcacuuugggaggccaaggugg

SEQ ID NO: 1526359 - RNA, 16 nt, Homo sapiens
agccuggccaacaugg

SEQ ID NO: 1526360 - RNA, 18 nt, Homo sapiens
agcuccucucacucuuca

SEQ ID NO: 1526361 - RNA, 13 nt, Homo sapiens
aggaaacuugaaa

SEQ ID NO: 1526362 - RNA, 22 nt, Homo sapiens
aggcagagagucagacccuuca

SEQ ID NO: 1526363 - RNA, 12 nt, Homo sapiens
aguauucugcau

SEQ ID NO: 1526364 - RNA, 12 nt, Homo sapiens
agugcagugaau

SEQ ID NO: 1526365 - RNA, 21 nt, Homo sapiens
aguucgaccaaacucaguuca

SEQ ID NO: 1526366 - RNA, 22 nt, Homo sapiens
aguugacuucugacaaaggugg

SEQ ID NO: 1526367 - RNA, 17 nt, Homo sapiens
auaaagcuuuuccugca

SEQ ID NO: 1526368 - RNA, 17 nt, Homo sapiens
auaaugcaauggaagaa

SEQ ID NO: 1526369 - RNA, 16 nt, Homo sapiens
auacagcuucauaaau

SEQ ID NO: 1526370 - RNA, 23 nt, Homo sapiens
auauuugcuagauuucuaaagaa

SEQ ID NO: 1526371 - RNA, 22 nt, Homo sapiens
aucccagcuacucagguggcua

SEQ ID NO: 1526372 - RNA, 23 nt, Homo sapiens
aucggaacagcuccuuacucuga

SEQ ID NO: 1526373 - RNA, 13 nt, Homo sapiens
aucuguugcuaug

SEQ ID NO: 1526374 - RNA, 15 nt, Homo sapiens
augauuuugaaguca

SEQ ID NO: 1526375 - RNA, 18 nt, Homo sapiens
auggaauaagcagaaacu

SEQ ID NO: 1526376 - RNA, 18 nt, Homo sapiens
auguacaucagccugaaa

SEQ ID NO: 1526377 - RNA, 17 nt, Homo sapiens
auguggaagaacuguga

SEQ ID NO: 1526378 - RNA, 19 nt, Homo sapiens
auguuucuggacauucucu

SEQ ID NO: 1526379 - RNA, 18 nt, Homo sapiens
auguuugaguauucugca

SEQ ID NO: 1526380 - RNA, 16 nt, Homo sapiens
auuaugaucuaauaaa

SEQ ID NO: 1526381 - RNA, 14 nt, Homo sapiens
auucaaauuguuaa

SEQ ID NO: 1526382 - RNA, 15 nt, Homo sapiens
auucacuccagucaa

SEQ ID NO: 1526383 - RNA, 14 nt, Homo sapiens
auuccacacugcac

SEQ ID NO: 1526384 - RNA, 22 nt, Homo sapiens
auugacagcuucaacagaaagg

SEQ ID NO: 1526385 - RNA, 22 nt, Homo sapiens
auugagaagaucggaacagcuc

SEQ ID NO: 1526386 - RNA, 15 nt, Homo sapiens
auugugaccacugaa

SEQ ID NO: 1526387 - RNA, 24 nt, Homo sapiens
auuucacauccuguaagugcuuaa

SEQ ID NO: 1526388 - RNA, 18 nt, Homo sapiens
auuucagccaaacuguag

SEQ ID NO: 1526389 - RNA, 15 nt, Homo sapiens
auuuucugcuugaag

SEQ ID NO: 1526390 - RNA, 16 nt, Homo sapiens
auuuugaaaaaugaga

SEQ ID NO: 1526391 - RNA, 16 nt, Homo sapiens
auuuuucaccugagaa

SEQ ID NO: 1526392 - RNA, 21 nt, Homo sapiens
caaaauaagguuauaugagua

SEQ ID NO: 1526393 - RNA, 13 nt, Homo sapiens
caaacagguuguu

SEQ ID NO: 1526394 - RNA, 23 nt, Homo sapiens
caaacucaguucaaaccauuuca

SEQ ID NO: 1526395 - RNA, 17 nt, Homo sapiens
caaagcgagcaagagaa

SEQ ID NO: 1526396 - RNA, 14 nt, Homo sapiens
caaaguccaaaagu

SEQ ID NO: 1526397 - RNA, 14 nt, Homo sapiens
caacaaaagcuuuu

SEQ ID NO: 1526398 - RNA, 16 nt, Homo sapiens
caacauuaugaucuaa

SEQ ID NO: 1526399 - RNA, 16 nt, Homo sapiens
caagaaccgguuucca

SEQ ID NO: 1526400 - RNA, 13 nt, Homo sapiens
caagagaauagcu

SEQ ID NO: 1526401 - RNA, 21 nt, Homo sapiens
cagaaaauaaaauauucacuc

SEQ ID NO: 1526402 - RNA, 22 nt, Homo sapiens
cagaaaauaaaauauucacucu

SEQ ID NO: 1526403 - RNA, 18 nt, Homo sapiens
cagacauuuugugugaga

SEQ ID NO: 1526404 - RNA, 17 nt, Homo sapiens
cagacccuucaauggaa

SEQ ID NO: 1526405 - RNA, 17 nt, Homo sapiens
cagaggagaugugguca

SEQ ID NO: 1526406 - RNA, 13 nt, Homo sapiens
caggagaaucacu

SEQ ID NO: 1526407 - RNA, 16 nt, Homo sapiens
cagugaagacuugauu

SEQ ID NO: 1526408 - RNA, 13 nt, Homo sapiens
cagugugcaaggg

SEQ ID NO: 1526409 - RNA, 18 nt, Homo sapiens
caguucucaaauguugga

SEQ ID NO: 1526410 - RNA, 20 nt, Homo sapiens
caguuuguaaaaguguaaca

SEQ ID NO: 1526411 - RNA, 16 nt, Homo sapiens
cauacagcuucauaaa

SEQ ID NO: 1526412 - RNA, 15 nt, Homo sapiens
cauacccaugcacag

SEQ ID NO: 1526413 - RNA, 15 nt, Homo sapiens
cauaggaauugcaca

SEQ ID NO: 1526414 - RNA, 13 nt, Homo sapiens
cauauaacaugca

SEQ ID NO: 1526415 - RNA, 15 nt, Homo sapiens
cauauaacaugcaaa

SEQ ID NO: 1526416 - RNA, 15 nt, Homo sapiens
cauaucuauaaaaug

SEQ ID NO: 1526417 - RNA, 19 nt, Homo sapiens
caugaauauuucauaucua

SEQ ID NO: 1526418 - RNA, 17 nt, Homo sapiens
caugcaaacagguuguu

SEQ ID NO: 1526419 - RNA, 22 nt, Homo sapiens
caugguggcucacgccuguaau

SEQ ID NO: 1526420 - RNA, 22 nt, Homo sapiens
ccaaacucaguucgaccaaacu

SEQ ID NO: 1526421 - RNA, 15 nt, Homo sapiens
ccacagguacagagc

SEQ ID NO: 1526422 - RNA, 10 nt, Homo sapiens
ccauuccucu

SEQ ID NO: 1526423 - RNA, 13 nt, Homo sapiens
ccccaaagaucuc

SEQ ID NO: 1526424 - RNA, 15 nt, Homo sapiens
ccccccagugugcaa

SEQ ID NO: 1526425 - RNA, 22 nt, Homo sapiens
cccuuucaguauguccccauaa

SEQ ID NO: 1526426 - RNA, 18 nt, Homo sapiens
ccuaaguuuacuucucua

SEQ ID NO: 1526427 - RNA, 13 nt, Homo sapiens
ccuauucuuucua

SEQ ID NO: 1526428 - RNA, 21 nt, Homo sapiens
ccuuggaaaucugccaugagc

SEQ ID NO: 1526429 - RNA, 18 nt, Homo sapiens
ccuuuaaauauuucacau

SEQ ID NO: 1526430 - RNA, 17 nt, Homo sapiens
ccuuuauguaagaauga

SEQ ID NO: 1526431 - RNA, 19 nt, Homo sapiens
ccuuugcucccuguugcug

SEQ ID NO: 1526432 - RNA, 17 nt, Homo sapiens
cguggacucauuucacu

SEQ ID NO: 1526433 - RNA, 21 nt, Homo sapiens
cuaaagaauguguucuaaaac

SEQ ID NO: 1526434 - RNA, 13 nt, Homo sapiens
cuagaaaucuguu

SEQ ID NO: 1526435 - RNA, 20 nt, Homo sapiens
cuauucaggcuguuguuggc

SEQ ID NO: 1526436 - RNA, 17 nt, Homo sapiens
cuauuuugcaugcugaa

SEQ ID NO: 1526437 - RNA, 14 nt, Homo sapiens
cucaagcaauauua

SEQ ID NO: 1526438 - RNA, 14 nt, Homo sapiens
cucauacccaugca

SEQ ID NO: 1526439 - RNA, 20 nt, Homo sapiens
cuccagucaacagauucaga

SEQ ID NO: 1526440 - RNA, 14 nt, Homo sapiens
cuccauaucugauu

SEQ ID NO: 1526441 - RNA, 19 nt, Homo sapiens
cucuggauuccacacugca

SEQ ID NO: 1526442 - RNA, 22 nt, Homo sapiens
cugaaacuucucaaccagaaga

SEQ ID NO: 1526443 - RNA, 20 nt, Homo sapiens
cugacugcagccagccacag

SEQ ID NO: 1526444 - RNA, 19 nt, Homo sapiens
cugaggaaguugauucuua

SEQ ID NO: 1526445 - RNA, 15 nt, Homo sapiens
cugcauagcaguuug

SEQ ID NO: 1526446 - RNA, 19 nt, Homo sapiens
cuggacauucucuuugaua

SEQ ID NO: 1526447 - RNA, 17 nt, Homo sapiens
cuucaguccuucuacug

SEQ ID NO: 1526448 - RNA, 20 nt, Homo sapiens
cuuuaguacucaauguuucu

SEQ ID NO: 1526449 - RNA, 22 nt, Homo sapiens
cuuucuugauugguucuuccaa

SEQ ID NO: 1526450 - RNA, 16 nt, Homo sapiens
cuuugaggaacauuca

SEQ ID NO: 1526451 - RNA, 17 nt, Homo sapiens
cuuugaggaacauucaa

SEQ ID NO: 1526452 - RNA, 22 nt, Homo sapiens
cuuuucuuuuucccaggccaga

SEQ ID NO: 1526453 - RNA, 23 nt, Homo sapiens
gaaaauguuuugaaaagaacaaa

SEQ ID NO: 1526454 - RNA, 14 nt, Homo sapiens
gaaagcucacucug

SEQ ID NO: 1526455 - RNA, 13 nt, Homo sapiens
gaaaguucugcug

SEQ ID NO: 1526456 - RNA, 23 nt, Homo sapiens
gaaaugggaaaugagaacauucc

SEQ ID NO: 1526457 - RNA, 18 nt, Homo sapiens
gaacaaaacaucaaaaug

SEQ ID NO: 1526458 - RNA, 20 nt, Homo sapiens
cauaucuauaaaaugacaga

SEQ ID NO: 1526459 - RNA, 24 nt, Homo sapiens
caugaacaaauucuuuaguacuca

SEQ ID NO: 1526460 - RNA, 15 nt, Homo sapiens
caugcccacagauca

SEQ ID NO: 1526461 - RNA, 19 nt, Homo sapiens
cauucucuuugauaacaaa

SEQ ID NO: 1526462 - RNA, 18 nt, Homo sapiens
cauugaccucaucauuaa

SEQ ID NO: 1526463 - RNA, 14 nt, Homo sapiens
cauuggaagcuuug

SEQ ID NO: 1526464 - RNA, 20 nt, Homo sapiens
cauuggaagcuuugaguuga

SEQ ID NO: 1526465 - RNA, 21 nt, Homo sapiens
cauuucacuauguuacaugua

SEQ ID NO: 1526466 - RNA, 10 nt, Homo sapiens
ccaaacucag

SEQ ID NO: 1526467 - RNA, 21 nt, Homo sapiens
ccaaagacagucuucuaauuc

SEQ ID NO: 1526468 - RNA, 14 nt, Homo sapiens
ccaagaaugagcuu

SEQ ID NO: 1526469 - RNA, 22 nt, Homo sapiens
ccaagagcagcugggaacugac

SEQ ID NO: 1526470 - RNA, 12 nt, Homo sapiens
ccaaggugggca

SEQ ID NO: 1526471 - RNA, 19 nt, Homo sapiens
ccaaggugggcagaucacu

SEQ ID NO: 1526472 - RNA, 21 nt, Homo sapiens
ccacccaauugugguugugca

SEQ ID NO: 1526473 - RNA, 21 nt, Homo sapiens
ccacugaauucacuccaguca

SEQ ID NO: 1526474 - RNA, 21 nt, Homo sapiens
ccaggaaggaagcuguugcuu

SEQ ID NO: 1526475 - RNA, 23 nt, Homo sapiens
ccaguaauggaaugaagguaaua

SEQ ID NO: 1526476 - RNA, 16 nt, Homo sapiens
ccauuucagccaaacu

SEQ ID NO: 1526477 - RNA, 22 nt, Homo sapiens
cccaugggcuaucaacuuaaua

SEQ ID NO: 1526478 - RNA, 22 nt, Homo sapiens
cccgagaguggguguuggacag

SEQ ID NO: 1526479 - RNA, 23 nt, Homo sapiens
cccgggagguggagguugcagug

SEQ ID NO: 1526480 - RNA, 15 nt, Homo sapiens
ccucauacccaugca

SEQ ID NO: 1526481 - RNA, 15 nt, Homo sapiens
ccuucaauggaagga

SEQ ID NO: 1526482 - RNA, 16 nt, Homo sapiens
ccuuuauaagguuguc

SEQ ID NO: 1526483 - RNA, 19 nt, Homo sapiens
ccuuucaguauguccccau

SEQ ID NO: 1526484 - RNA, 19 nt, Homo sapiens
cguuuuguaaauguugugc

SEQ ID NO: 1526485 - RNA, 19 nt, Homo sapiens
cuaaggcaggagaaucacu

SEQ ID NO: 1526486 - RNA, 17 nt, Homo sapiens
cuacauuggaagcuuug

SEQ ID NO: 1526487 - RNA, 15 nt, Homo sapiens
cuaguuuugcugaaa

SEQ ID NO: 1526488 - RNA, 17 nt, Homo sapiens
cuauaaaaugacagauc

SEQ ID NO: 1526489 - RNA, 14 nt, Homo sapiens
cuauugucuguaau

SEQ ID NO: 1526490 - RNA, 15 nt, Homo sapiens
cuauugucuguaaua

SEQ ID NO: 1526491 - RNA, 22 nt, Homo sapiens
cucaauguuucuggacauucuc

SEQ ID NO: 1526492 - RNA, 16 nt, Homo sapiens
cucauacccaugcaca

SEQ ID NO: 1526493 - RNA, 13 nt, Homo sapiens
cucuuuaacaagg

SEQ ID NO: 1526494 - RNA, 17 nt, Homo sapiens
cugaaaaggacuucugg

SEQ ID NO: 1526495 - RNA, 18 nt, Homo sapiens
cugaauucacuccaguca

SEQ ID NO: 1526496 - RNA, 11 nt, Homo sapiens
cugggugaccc

SEQ ID NO: 1526497 - RNA, 15 nt, Homo sapiens
cuguccuggcuacua

SEQ ID NO: 1526498 - RNA, 12 nt, Homo sapiens
cuguugcugaaa

SEQ ID NO: 1526499 - RNA, 21 nt, Homo sapiens
cuguugcugaaaccauacagc

SEQ ID NO: 1526500 - RNA, 13 nt, Homo sapiens
cuuaaagucagaa

SEQ ID NO: 1526501 - RNA, 12 nt, Homo sapiens
cuuaagagccag

SEQ ID NO: 1526502 - RNA, 18 nt, Homo sapiens
cuucugacaaagguggua

SEQ ID NO: 1526503 - RNA, 16 nt, Homo sapiens
cuuguuuucuucacag

SEQ ID NO: 1526504 - RNA, 22 nt, Homo sapiens
cuuucaguauguccccauaaga

SEQ ID NO: 1526505 - RNA, 11 nt, Homo sapiens
gaaaacauuca

SEQ ID NO: 1526506 - RNA, 18 nt, Homo sapiens
gaaaaggacuucuggcua

SEQ ID NO: 1526507 - RNA, 16 nt, Homo sapiens
gaaaaugaaacuagaa

SEQ ID NO: 1526508 - RNA, 19 nt, Homo sapiens
gaaacaaaauguucugcua

SEQ ID NO: 1526509 - RNA, 20 nt, Homo sapiens
gaaaccccaucucuacuaaa

SEQ ID NO: 1526510 - RNA, 23 nt, Homo sapiens
gaacaaauucuuuaguacucaau

SEQ ID NO: 1526511 - RNA, 21 nt, Homo sapiens
gaacaucuaaaagaugaaguu

SEQ ID NO: 1526512 - RNA, 21 nt, Homo sapiens
gaacuguuagguucugaugac

SEQ ID NO: 1526513 - RNA, 20 nt, Homo sapiens
gaagagauaaacgaccaaac

SEQ ID NO: 1526514 - RNA, 15 nt, Homo sapiens
gaagaggagaacaaa

SEQ ID NO: 1526515 - RNA, 18 nt, Homo sapiens
gaagcuuugaguugacuu

SEQ ID NO: 1526516 - RNA, 16 nt, Homo sapiens
gaaugagaauggacgu

SEQ ID NO: 1526517 - RNA, 11 nt, Homo sapiens
gaauguguucu

SEQ ID NO: 1526518 - RNA, 15 nt, Homo sapiens
gacacagacauuuug

SEQ ID NO: 1526519 - RNA, 17 nt, Homo sapiens
gacagugagacuguggc

SEQ ID NO: 1526520 - RNA, 14 nt, Homo sapiens
gacuuaaaacaugg

SEQ ID NO: 1526521 - RNA, 20 nt, Homo sapiens
gacuuaaaacauggugccua

SEQ ID NO: 1526522 - RNA, 23 nt, Homo sapiens
gagagucagacccuucaauggaa

SEQ ID NO: 1526523 - RNA, 16 nt, Homo sapiens
gagcuuucaucauuca

SEQ ID NO: 1526524 - RNA, 23 nt, Homo sapiens
gaggucaggaguucgaaaccagc

SEQ ID NO: 1526525 - RNA, 16 nt, Homo sapiens
gaguugacuucugaca

SEQ ID NO: 1526526 - RNA, 21 nt, Homo sapiens
gauaaauugcugcgugacaua

SEQ ID NO: 1526527 - RNA, 16 nt, Homo sapiens
gauauuuaguaauauu

SEQ ID NO: 1526528 - RNA, 14 nt, Homo sapiens
gaugaaaacauuca

SEQ ID NO: 1526529 - RNA, 14 nt, Homo sapiens
gaugugugaggcac

SEQ ID NO: 1526530 - RNA, 21 nt, Homo sapiens
gcaaacaggguuugauagcac

SEQ ID NO: 1526531 - RNA, 15 nt, Homo sapiens
gcaagggcagugaag

SEQ ID NO: 1526532 - RNA, 17 nt, Homo sapiens
gcaauauuaaugaagua

SEQ ID NO: 1526533 - RNA, 20 nt, Homo sapiens
gcaucagucugaaagccagg

SEQ ID NO: 1526534 - RNA, 20 nt, Homo sapiens
gcccuauucuuucuauucag

SEQ ID NO: 1526535 - RNA, 23 nt, Homo sapiens
gccggucauggugguggacaccu

SEQ ID NO: 1526536 - RNA, 20 nt, Homo sapiens
gccuggccaacauggugaaa

SEQ ID NO: 1526537 - RNA, 12 nt, Homo sapiens
gcuucuguggug

SEQ ID NO: 1526538 - RNA, 15 nt, Homo sapiens
ggaagaacugugaua

SEQ ID NO: 1526539 - RNA, 17 nt, Homo sapiens
ggacauucucuuugaua

SEQ ID NO: 1526540 - RNA, 16 nt, Homo sapiens
ggcuaucaacuuaaua

SEQ ID NO: 1526541 - RNA, 13 nt, Homo sapiens
gggacaugaaguu

SEQ ID NO: 1526542 - RNA, 22 nt, Homo sapiens
gggacuauuuugcaugcugaaa

SEQ ID NO: 1526543 - RNA, 15 nt, Homo sapiens
gggucccuuaaagau

SEQ ID NO: 1526544 - RNA, 16 nt, Homo sapiens
gguuuccaaagacagu

SEQ ID NO: 1526545 - RNA, 18 nt, Homo sapiens
guaauauuuuacuuugag

SEQ ID NO: 1526546 - RNA, 12 nt, Homo sapiens
guauauaaucca

SEQ ID NO: 1526547 - RNA, 21 nt, Homo sapiens
gugaagacuugauuguacaaa

SEQ ID NO: 1526548 - RNA, 15 nt, Homo sapiens
guggaagaacuguga

SEQ ID NO: 1526549 - RNA, 23 nt, Homo sapiens
guuccagugaugaaaacauucaa

SEQ ID NO: 1526550 - RNA, 20 nt, Homo sapiens
guuuuuuccuuuauaagguu

SEQ ID NO: 1526551 - RNA, 16 nt, Homo sapiens
uaaaacauuggcauuu

SEQ ID NO: 1526552 - RNA, 13 nt, Homo sapiens
uaaaauauucacu

SEQ ID NO: 1526553 - RNA, 15 nt, Homo sapiens
uaaaaugacagaucc

SEQ ID NO: 1526554 - RNA, 13 nt, Homo sapiens
uaaauucagacaa

SEQ ID NO: 1526555 - RNA, 20 nt, Homo sapiens
uaaauuuuaaaaaggaauuu

SEQ ID NO: 1526556 - RNA, 18 nt, Homo sapiens
uaagccagaauccagaag

SEQ ID NO: 1526557 - RNA, 19 nt, Homo sapiens
uaagugaugugcugaauuu

SEQ ID NO: 1526558 - RNA, 23 nt, Homo sapiens
uaaucauaucuuuuaauugugua

SEQ ID NO: 1526559 - RNA, 23 nt, Homo sapiens
uaauucaugguuguuccaaagau

SEQ ID NO: 1526560 - RNA, 17 nt, Homo sapiens
uaauuuugcuugcugaa

SEQ ID NO: 1526561 - RNA, 14 nt, Homo sapiens
uacaauaauguacu

SEQ ID NO: 1526562 - RNA, 12 nt, Homo sapiens
uacagagccaca

SEQ ID NO: 1526563 - RNA, 22 nt, Homo sapiens
uacuaaauaaaaaaaugaauau

SEQ ID NO: 1526564 - RNA, 14 nt, Homo sapiens
uacucacauauaac

SEQ ID NO: 1526565 - RNA, 17 nt, Homo sapiens
uagaaagaaaaauugga

SEQ ID NO: 1526566 - RNA, 19 nt, Homo sapiens
uagcaguuuguaaaagugu

SEQ ID NO: 1526567 - RNA, 17 nt, Homo sapiens
uagcaugauguauuuaa

SEQ ID NO: 1526568 - RNA, 21 nt, Homo sapiens
uagcucugguauauaauccau

SEQ ID NO: 1526569 - RNA, 19 nt, Homo sapiens
uaguuguucuagcagugaa

SEQ ID NO: 1526570 - RNA, 18 nt, Homo sapiens
uauauaauccauuccucu

SEQ ID NO: 1526571 - RNA, 15 nt, Homo sapiens
uauccaggacuguuu

SEQ ID NO: 1526572 - RNA, 21 nt, Homo sapiens
uauuaccuuuaaauauuucac

SEQ ID NO: 1526573 - RNA, 15 nt, Homo sapiens
uauuugaugguggua

SEQ ID NO: 1526574 - RNA, 21 nt, Homo sapiens
ucaagaaccgguuuccaaaga

SEQ ID NO: 1526575 - RNA, 20 nt, Homo sapiens
ucacauccuguaagugcuua

SEQ ID NO: 1526576 - RNA, 18 nt, Homo sapiens
ucaccugagaagauuuua

SEQ ID NO: 1526577 - RNA, 14 nt, Homo sapiens
ucagcaggcaaaga

SEQ ID NO: 1526578 - RNA, 21 nt, Homo sapiens
guauuugcagaauacauucaa

SEQ ID NO: 1526579 - RNA, 13 nt, Homo sapiens
gucaauggaagaa

SEQ ID NO: 1526580 - RNA, 21 nt, Homo sapiens
gugaaaccccaucucuacuaa

SEQ ID NO: 1526581 - RNA, 20 nt, Homo sapiens
gugagacuguggcucaaaaa

SEQ ID NO: 1526582 - RNA, 18 nt, Homo sapiens
guggcuuggccucaagag

SEQ ID NO: 1526583 - RNA, 20 nt, Homo sapiens
guguucacaaaggcagagag

SEQ ID NO: 1526584 - RNA, 19 nt, Homo sapiens
uaaaacauuggcauuugaa

SEQ ID NO: 1526585 - RNA, 14 nt, Homo sapiens
uaaaauauucacuc

SEQ ID NO: 1526586 - RNA, 14 nt, Homo sapiens
uaaaaugacagauc

SEQ ID NO: 1526587 - RNA, 16 nt, Homo sapiens
uaaaguaaggccuuua

SEQ ID NO: 1526588 - RNA, 13 nt, Homo sapiens
uaaauauuucaca

SEQ ID NO: 1526589 - RNA, 18 nt, Homo sapiens
uaacccgauuauugugua

SEQ ID NO: 1526590 - RNA, 12 nt, Homo sapiens
uaacccuuuuuc

SEQ ID NO: 1526591 - RNA, 18 nt, Homo sapiens
uaagacaaacacugccau

SEQ ID NO: 1526592 - RNA, 17 nt, Homo sapiens
uaagauauuuaguaaua

SEQ ID NO: 1526593 - RNA, 18 nt, Homo sapiens
uaagauauuuaguaauau

SEQ ID NO: 1526594 - RNA, 16 nt, Homo sapiens
uaaggcaggagaauca

SEQ ID NO: 1526595 - RNA, 22 nt, Homo sapiens
uaauauugauaagcuauugucu

SEQ ID NO: 1526596 - RNA, 14 nt, Homo sapiens
uaauggaaugaagg

SEQ ID NO: 1526597 - RNA, 13 nt, Homo sapiens
uaauuuugcuugc

SEQ ID NO: 1526598 - RNA, 18 nt, Homo sapiens
uacccaugcacaguacaa

SEQ ID NO: 1526599 - RNA, 16 nt, Homo sapiens
uacuaaaaauacagaa

SEQ ID NO: 1526600 - RNA, 13 nt, Homo sapiens
uagauuucuaaag

SEQ ID NO: 1526601 - RNA, 23 nt, Homo sapiens
uaguacucaauguuucuggacau

SEQ ID NO: 1526602 - RNA, 21 nt, Homo sapiens
uaucugagagaccugugugaa

SEQ ID NO: 1526603 - RNA, 17 nt, Homo sapiens
uaugcaagggucccuua

SEQ ID NO: 1526604 - RNA, 14 nt, Homo sapiens
uaugugacuuaaag

SEQ ID NO: 1526605 - RNA, 13 nt, Homo sapiens
uauguugaucauu

SEQ ID NO: 1526606 - RNA, 14 nt, Homo sapiens
uauuaacuucacag

SEQ ID NO: 1526607 - RNA, 15 nt, Homo sapiens
ucaaggaaagaauga

SEQ ID NO: 1526608 - RNA, 17 nt, Homo sapiens
ucaauggaagaaaccac

SEQ ID NO: 1526609 - RNA, 22 nt, Homo sapiens
ucacaaaggcagagagucagac

SEQ ID NO: 1526610 - RNA, 17 nt, Homo sapiens
ucacauauaacaugcaa

SEQ ID NO: 1526611 - RNA, 15 nt, Homo sapiens
ucagaaagauaagcc

SEQ ID NO: 1526612 - RNA, 14 nt, Homo sapiens
ucagacaacauuau

SEQ ID NO: 1526613 - RNA, 20 nt, Homo sapiens
ucagacaacauuaugaucua

SEQ ID NO: 1526614 - RNA, 16 nt, Homo sapiens
ucauacccaugcacag

SEQ ID NO: 1526615 - RNA, 19 nt, Homo sapiens
ucauaucuuuuaauugugu

SEQ ID NO: 1526616 - RNA, 23 nt, Homo sapiens
ucauuggaugauauguugaucag

SEQ ID NO: 1526617 - RNA, 19 nt, Homo sapiens
uccaaagcgagcaagagaa

SEQ ID NO: 1526618 - RNA, 16 nt, Homo sapiens
ucccuuaaagauuuuc

SEQ ID NO: 1526619 - RNA, 19 nt, Homo sapiens
ucccuuggaaaucugccau

SEQ ID NO: 1526620 - RNA, 14 nt, Homo sapiens
ucgauuaugugacu

SEQ ID NO: 1526621 - RNA, 13 nt, Homo sapiens
ucuaucaucucag

SEQ ID NO: 1526622 - RNA, 19 nt, Homo sapiens
ucucacuaaagauguuagu

SEQ ID NO: 1526623 - RNA, 15 nt, Homo sapiens
ucuucuaauuccuca

SEQ ID NO: 1526624 - RNA, 12 nt, Homo sapiens
ugaaaacauuca

SEQ ID NO: 1526625 - RNA, 19 nt, Homo sapiens
ugaaaaggacuucuggcua

SEQ ID NO: 1526626 - RNA, 23 nt, Homo sapiens
ugaaacuagaagagauuucuaaa

SEQ ID NO: 1526627 - RNA, 12 nt, Homo sapiens
ugaagaaguagu

SEQ ID NO: 1526628 - RNA, 17 nt, Homo sapiens
ugacauaggcaauaaua

SEQ ID NO: 1526629 - RNA, 16 nt, Homo sapiens
ugacauauacuaaaua

SEQ ID NO: 1526630 - RNA, 19 nt, Homo sapiens
ugagaagaucggaacagcu

SEQ ID NO: 1526631 - RNA, 18 nt, Homo sapiens
aaaaacagaaccaaauaa

SEQ ID NO: 1526632 - RNA, 15 nt, Homo sapiens
aaaaauguuugagua

SEQ ID NO: 1526633 - RNA, 18 nt, Homo sapiens
aaaaggaaaaugaaacua

SEQ ID NO: 1526634 - RNA, 17 nt, Homo sapiens
aaaaguguuuucacaac

SEQ ID NO: 1526635 - RNA, 13 nt, Homo sapiens
aaaauauucacuc

SEQ ID NO: 1526636 - RNA, 23 nt, Homo sapiens
aaaauguagcaugauguauuuaa

SEQ ID NO: 1526637 - RNA, 22 nt, Homo sapiens
aaaauguuugaguauucugcau

SEQ ID NO: 1526638 - RNA, 23 nt, Homo sapiens
aaacaagcauagaaauggaagaa

SEQ ID NO: 1526639 - RNA, 15 nt, Homo sapiens
aaacaaugccaugaa

SEQ ID NO: 1526640 - RNA, 14 nt, Homo sapiens
aaacauggugccua

SEQ ID NO: 1526641 - RNA, 20 nt, Homo sapiens
aaacuuugaggaacauucaa

SEQ ID NO: 1526642 - RNA, 12 nt, Homo sapiens
aaagaagccagc

SEQ ID NO: 1526643 - RNA, 23 nt, Homo sapiens
aaagaggaacgggcuuggaagaa

SEQ ID NO: 1526644 - RNA, 23 nt, Homo sapiens
aaagucagaauaguccuugggca

SEQ ID NO: 1526645 - RNA, 13 nt, Homo sapiens
aaauauucacucu

SEQ ID NO: 1526646 - RNA, 15 nt, Homo sapiens
aaauguuugaguauu

SEQ ID NO: 1526647 - RNA, 15 nt, Homo sapiens
aaauucuuuaguacu

SEQ ID NO: 1526648 - RNA, 17 nt, Homo sapiens
aaauucuuuaguacuca

SEQ ID NO: 1526649 - RNA, 14 nt, Homo sapiens
aacaaauacugaac

SEQ ID NO: 1526650 - RNA, 21 nt, Homo sapiens
aacaaauucuuuaguacucaa

SEQ ID NO: 1526651 - RNA, 19 nt, Homo sapiens
auaauguaaacgcaaacag

SEQ ID NO: 1526652 - RNA, 22 nt, Homo sapiens
auaauguacucacauauaacau

SEQ ID NO: 1526653 - RNA, 17 nt, Homo sapiens
auaauugcaucaguuca

SEQ ID NO: 1526654 - RNA, 19 nt, Homo sapiens
auaauuuugcuugcugaag

SEQ ID NO: 1526655 - RNA, 18 nt, Homo sapiens
auagguuccagugaugaa

SEQ ID NO: 1526656 - RNA, 13 nt, Homo sapiens
auauaacaugcaa

SEQ ID NO: 1526657 - RNA, 19 nt, Homo sapiens
aucagaaaaagcaguauua

SEQ ID NO: 1526658 - RNA, 23 nt, Homo sapiens
aucagaaaauaaaauauucacuc

SEQ ID NO: 1526659 - RNA, 17 nt, Homo sapiens
auccaugaacagcauua

SEQ ID NO: 1526660 - RNA, 15 nt, Homo sapiens
aucucaggaacauca

SEQ ID NO: 1526661 - RNA, 13 nt, Homo sapiens
augaacagcauua

SEQ ID NO: 1526662 - RNA, 13 nt, Homo sapiens
augaagguaauau

SEQ ID NO: 1526663 - RNA, 13 nt, Homo sapiens
augagaacauucc

SEQ ID NO: 1526664 - RNA, 20 nt, Homo sapiens
augcccucauacccaugcac

SEQ ID NO: 1526665 - RNA, 22 nt, Homo sapiens
augcccucauacccaugcacag

SEQ ID NO: 1526666 - RNA, 17 nt, Homo sapiens
augggcuaucaacuuaa

SEQ ID NO: 1526667 - RNA, 19 nt, Homo sapiens
auggugaaaccccaucucu

SEQ ID NO: 1526668 - RNA, 20 nt, Homo sapiens
auggugguggacaccuguaa

SEQ ID NO: 1526669 - RNA, 13 nt, Homo sapiens
auguccauggugg

SEQ ID NO: 1526670 - RNA, 23 nt, Homo sapiens
augugacuuaaagucagaauagu

SEQ ID NO: 1526671 - RNA, 14 nt, Homo sapiens
augugcaacauucu

SEQ ID NO: 1526672 - RNA, 23 nt, Homo sapiens
auuaaagaaagaaaaaugcugaa

SEQ ID NO: 1526673 - RNA, 13 nt, Homo sapiens
auucucuuugaua

SEQ ID NO: 1526674 - RNA, 15 nt, Homo sapiens
auucugaggcaggua

SEQ ID NO: 1526675 - RNA, 18 nt, Homo sapiens
auuuaaaguaaggccuuu

SEQ ID NO: 1526676 - RNA, 18 nt, Homo sapiens
auuuaagugacacagaca

SEQ ID NO: 1526677 - RNA, 16 nt, Homo sapiens
auuucuaaaagucuga

SEQ ID NO: 1526678 - RNA, 15 nt, Homo sapiens
auuucugggugaccc

SEQ ID NO: 1526679 - RNA, 15 nt, Homo sapiens
auuugcuagauuucu

SEQ ID NO: 1526680 - RNA, 21 nt, Homo sapiens
caaaagcguccagaaaggaga

SEQ ID NO: 1526681 - RNA, 22 nt, Homo sapiens
caaacacugccauauuguguaa

SEQ ID NO: 1526682 - RNA, 15 nt, Homo sapiens
caaacaggguuugau

SEQ ID NO: 1526683 - RNA, 23 nt, Homo sapiens
caaacucaguucgaccaaacuca

SEQ ID NO: 1526684 - RNA, 18 nt, Homo sapiens
caagagcagcugggaacu

SEQ ID NO: 1526685 - RNA, 22 nt, Homo sapiens
caagcagaacuagguagaaaca

SEQ ID NO: 1526686 - RNA, 18 nt, Homo sapiens
caauugacauaggcaaua

SEQ ID NO: 1526687 - RNA, 20 nt, Homo sapiens
caauugagcaagaugcugau

SEQ ID NO: 1526688 - RNA, 23 nt, Homo sapiens
caccaggaaggaagcuguugcuu

SEQ ID NO: 1526689 - RNA, 14 nt, Homo sapiens
caccuguaauccca

SEQ ID NO: 1526690 - RNA, 17 nt, Homo sapiens
cacuaaagauguuagua

SEQ ID NO: 1526691 - RNA, 21 nt, Homo sapiens
cacugcaaauaaacuugguag

SEQ ID NO: 1526692 - RNA, 23 nt, Homo sapiens
cagaaauuagccggucauggugg

SEQ ID NO: 1526693 - RNA, 19 nt, Homo sapiens
cagacaacauuaugaucua

SEQ ID NO: 1526694 - RNA, 16 nt, Homo sapiens
cuagaauuuuauauca

SEQ ID NO: 1526695 - RNA, 16 nt, Homo sapiens
cuauguuacauguaca

SEQ ID NO: 1526696 - RNA, 23 nt, Homo sapiens
cuauucaggcuguuguuggcuua

SEQ ID NO: 1526697 - RNA, 17 nt, Homo sapiens
cucaguucgaccaaacu

SEQ ID NO: 1526698 - RNA, 22 nt, Homo sapiens
cucauacccaugcacaguacaa

SEQ ID NO: 1526699 - RNA, 22 nt, Homo sapiens
cucaucauuaauaagugaagaa

SEQ ID NO: 1526700 - RNA, 11 nt, Homo sapiens
cucauuucacu

SEQ ID NO: 1526701 - RNA, 13 nt, Homo sapiens
cucccuguugcug

SEQ ID NO: 1526702 - RNA, 19 nt, Homo sapiens
cucgaaaaagaaucugcuu

SEQ ID NO: 1526703 - RNA, 17 nt, Homo sapiens
cucucagcaggcaaaga

SEQ ID NO: 1526704 - RNA, 23 nt, Homo sapiens
cucugaugacccugaaucugauc

SEQ ID NO: 1526705 - RNA, 12 nt, Homo sapiens
cugaaagccagg

SEQ ID NO: 1526706 - RNA, 20 nt, Homo sapiens
cugaagaccccaaagaucuc

SEQ ID NO: 1526707 - RNA, 12 nt, Homo sapiens
cugaauucacuc

SEQ ID NO: 1526708 - RNA, 22 nt, Homo sapiens
cugacaaaggugguaaauucag

SEQ ID NO: 1526709 - RNA, 17 nt, Homo sapiens
cugagauauauuugcua

SEQ ID NO: 1526710 - RNA, 19 nt, Homo sapiens
cugaucuaacaaaauaagg

SEQ ID NO: 1526711 - RNA, 16 nt, Homo sapiens
cugcgaaauccagaac

SEQ ID NO: 1526712 - RNA, 16 nt, Homo sapiens
cugcgugacauauacu

SEQ ID NO: 1526713 - RNA, 14 nt, Homo sapiens
cuggacauucucuu

SEQ ID NO: 1526714 - RNA, 15 nt, Homo sapiens
cugguauauaaucca

SEQ ID NO: 1526715 - RNA, 21 nt, Homo sapiens
cuguaauaguuuuauauuguu

SEQ ID NO: 1526716 - RNA, 20 nt, Homo sapiens
cuguuguuuggacuguaaca

SEQ ID NO: 1526717 - RNA, 21 nt, Homo sapiens
cuguuguuuggacuguaacau

SEQ ID NO: 1526718 - RNA, 16 nt, Homo sapiens
cuuaaaacauggugcc

SEQ ID NO: 1526719 - RNA, 13 nt, Homo sapiens
cuuacucugagga

SEQ ID NO: 1526720 - RNA, 16 nt, Homo sapiens
cuuauuugaugguggu

SEQ ID NO: 1526721 - RNA, 16 nt, Homo sapiens
cuucagaauagaaacu

SEQ ID NO: 1526722 - RNA, 20 nt, Homo sapiens
cuucugacaaaggugguaaa

SEQ ID NO: 1526723 - RNA, 23 nt, Homo sapiens
cuugaggaccugcgaaauccaga

SEQ ID NO: 1526724 - RNA, 18 nt, Homo sapiens
cuugauugguucuuccaa

SEQ ID NO: 1526725 - RNA, 15 nt, Homo sapiens
cuuguuuucuucaca

SEQ ID NO: 1526726 - RNA, 21 nt, Homo sapiens
cuuugcucccuguugcugaaa

SEQ ID NO: 1526727 - RNA, 21 nt, Homo sapiens
gaaaacuuugaggaacauuca

SEQ ID NO: 1526728 - RNA, 16 nt, Homo sapiens
gaaauauuuucuagga

SEQ ID NO: 1526729 - RNA, 16 nt, Homo sapiens
gaaaugagaacauucc

SEQ ID NO: 1526730 - RNA, 14 nt, Homo sapiens
gaaggagcuuucau

SEQ ID NO: 1526731 - RNA, 16 nt, Homo sapiens
gaaggccuuucugcug

SEQ ID NO: 1526732 - RNA, 12 nt, Homo sapiens
gaauaguccuug

SEQ ID NO: 1526733 - RNA, 16 nt, Homo sapiens
gaaugaagguaauauu

SEQ ID NO: 1526734 - RNA, 16 nt, Homo sapiens
gaaugugcaacauucu

SEQ ID NO: 1526735 - RNA, 17 nt, Homo sapiens
gacaacauuaugaucua

SEQ ID NO: 1526736 - RNA, 13 nt, Homo sapiens
gacucauuucacu

SEQ ID NO: 1526737 - RNA, 18 nt, Homo sapiens
gagcagggagaagccaga

SEQ ID NO: 1526738 - RNA, 12 nt, Homo sapiens
gaggaacauuca

SEQ ID NO: 1526739 - RNA, 12 nt, Homo sapiens
gaggagaacaaa

SEQ ID NO: 1526740 - RNA, 20 nt, Homo sapiens
gagguggagguugcagugag

SEQ ID NO: 1526741 - RNA, 17 nt, Homo sapiens
gauacucucagcaccaa

SEQ ID NO: 1526742 - RNA, 20 nt, Homo sapiens
gaucauaccacggcacucca

SEQ ID NO: 1526743 - RNA, 17 nt, Homo sapiens
gcaauaauaagugaugu

SEQ ID NO: 1526744 - RNA, 17 nt, Homo sapiens
gcauagaaauggaagaa

SEQ ID NO: 1526745 - RNA, 22 nt, Homo sapiens
gcauagcaguuuguaaaagugu

SEQ ID NO: 1526746 - RNA, 15 nt, Homo sapiens
gcauaggaauugcac

SEQ ID NO: 1526747 - RNA, 19 nt, Homo sapiens
gccauauuguguaauuuaa

SEQ ID NO: 1526748 - RNA, 20 nt, Homo sapiens
gcccucauacccaugcacag

SEQ ID NO: 1526749 - RNA, 17 nt, Homo sapiens
gccucuucucugaugac

SEQ ID NO: 1526750 - RNA, 20 nt, Homo sapiens
gcucacucuggauuccacac

SEQ ID NO: 1526751 - RNA, 14 nt, Homo sapiens
gcuguuaacacugc

SEQ ID NO: 1526752 - RNA, 11 nt, Homo sapiens
gcuuggaagaa

SEQ ID NO: 1526753 - RNA, 21 nt, Homo sapiens
ggaagagauaaacgaccaaac

SEQ ID NO: 1526754 - RNA, 19 nt, Homo sapiens
ggagguggagguugcagug

SEQ ID NO: 1526755 - RNA, 13 nt, Homo sapiens
ggcaccuguggug

SEQ ID NO: 1526756 - RNA, 22 nt, Homo sapiens
gggagccagccuucuaacagcu

SEQ ID NO: 1526757 - RNA, 18 nt, Homo sapiens
gggggcuagaaaucuguu

SEQ ID NO: 1526758 - RNA, 20 nt, Homo sapiens
ggucagaaagauaagccagu

SEQ ID NO: 1526759 - RNA, 14 nt, Homo sapiens
guaaaacaaugcca

SEQ ID NO: 1526760 - RNA, 18 nt, Homo sapiens
guaaucccagcuacucag

SEQ ID NO: 1526761 - RNA, 11 nt, Homo sapiens
aaacaaugcca

SEQ ID NO: 1526762 - RNA, 24 nt, Homo sapiens
aaacaggguuugauagcacuuaaa

SEQ ID NO: 1526763 - RNA, 15 nt, Homo sapiens
aaaccagccuggcca

SEQ ID NO: 1526764 - RNA, 16 nt, Homo sapiens
aaaccauuucagccaa

SEQ ID NO: 1526765 - RNA, 12 nt, Homo sapiens
aaacucaguuca

SEQ ID NO: 1526766 - RNA, 15 nt, Homo sapiens
aaacugaaagaucug

SEQ ID NO: 1526767 - RNA, 14 nt, Homo sapiens
aaaguguuuucaca

SEQ ID NO: 1526768 - RNA, 15 nt, Homo sapiens
aaaguguuuucacaa

SEQ ID NO: 1526769 - RNA, 13 nt, Homo sapiens
aaauaauugcauc

SEQ ID NO: 1526770 - RNA, 12 nt, Homo sapiens
aaauauucacuc

SEQ ID NO: 1526771 - RNA, 20 nt, Homo sapiens
aaauguuugaguauucugca

SEQ ID NO: 1526772 - RNA, 20 nt, Homo sapiens
aacaagggcugcaaugcccu

SEQ ID NO: 1526773 - RNA, 17 nt, Homo sapiens
aacaugcccacagauca

SEQ ID NO: 1526774 - RNA, 18 nt, Homo sapiens
aaccauuucagccaaacu

SEQ ID NO: 1526775 - RNA, 20 nt, Homo sapiens
aaccauuucagccaaacugu

SEQ ID NO: 1526776 - RNA, 18 nt, Homo sapiens
aacuugaaaccugggcau

SEQ ID NO: 1526777 - RNA, 20 nt, Homo sapiens
aagaaccgguuuccaaagac

SEQ ID NO: 1526778 - RNA, 17 nt, Homo sapiens
aagaauguccauggugg

SEQ ID NO: 1526779 - RNA, 21 nt, Homo sapiens
aagacagucuucuaauuccuc

SEQ ID NO: 1526780 - RNA, 20 nt, Homo sapiens
aagauguuaguaguuucuca

SEQ ID NO: 1526781 - RNA, 17 nt, Homo sapiens
aaggacuaggucuuccc

SEQ ID NO: 1526782 - RNA, 20 nt, Homo sapiens
aaggugggcagaucacugga

SEQ ID NO: 1526783 - RNA, 19 nt, Homo sapiens
aagucagaggagauguggu

SEQ ID NO: 1526784 - RNA, 12 nt, Homo sapiens
aauaaagcuuuu

SEQ ID NO: 1526785 - RNA, 15 nt, Homo sapiens
aauaauguacucaca

SEQ ID NO: 1526786 - RNA, 20 nt, Homo sapiens
aauagaaagaaaaauuggaa

SEQ ID NO: 1526787 - RNA, 19 nt, Homo sapiens
aauauucacucuccauuag

SEQ ID NO: 1526788 - RNA, 13 nt, Homo sapiens
aauauuucacauc

SEQ ID NO: 1526789 - RNA, 12 nt, Homo sapiens
aaugacagaucc

SEQ ID NO: 1526790 - RNA, 20 nt, Homo sapiens
aauguuucuggacauucucu

SEQ ID NO: 1526791 - RNA, 17 nt, Homo sapiens
aauuuaagugacacaga

SEQ ID NO: 1526792 - RNA, 14 nt, Homo sapiens
aauuuuauaucauu

SEQ ID NO: 1526793 - RNA, 16 nt, Homo sapiens
aauuuugcuugcugaa

SEQ ID NO: 1526794 - RNA, 17 nt, Homo sapiens
aauuuugcuugcugaag

SEQ ID NO: 1526795 - RNA, 12 nt, Homo sapiens
acaaaagcuuuu

SEQ ID NO: 1526796 - RNA, 21 nt, Homo sapiens
acaaacacugccauauugugu

SEQ ID NO: 1526797 - RNA, 15 nt, Homo sapiens
acaacauuaugaucu

SEQ ID NO: 1526798 - RNA, 20 nt, Homo sapiens
acaauccaugaacagcauua

SEQ ID NO: 1526799 - RNA, 12 nt, Homo sapiens
acaccuaccuga

SEQ ID NO: 1526800 - RNA, 17 nt, Homo sapiens
acagacauuuuguguga

SEQ ID NO: 1526801 - RNA, 12 nt, Homo sapiens
acagaugcugag

SEQ ID NO: 1526802 - RNA, 21 nt, Homo sapiens
acaggaccccaagaaugagcu

SEQ ID NO: 1526803 - RNA, 22 nt, Homo sapiens
acagugcagugaauuggaagac

SEQ ID NO: 1526804 - RNA, 13 nt, Homo sapiens
acauauaacaugc

SEQ ID NO: 1526805 - RNA, 14 nt, Homo sapiens
accuguggugaccc

SEQ ID NO: 1526806 - RNA, 14 nt, Homo sapiens
acguuuuguaaaug

SEQ ID NO: 1526807 - RNA, 18 nt, Homo sapiens
acuccagccugggugaca

SEQ ID NO: 1526808 - RNA, 20 nt, Homo sapiens
acugaaauauuuucuaggaa

SEQ ID NO: 1526809 - RNA, 22 nt, Homo sapiens
acuucucuaaaacccuguguuc

SEQ ID NO: 1526810 - RNA, 16 nt, Homo sapiens
acuuuucuuuuuccca

SEQ ID NO: 1526811 - RNA, 15 nt, Homo sapiens
agacaaacacugcca

SEQ ID NO: 1526812 - RNA, 14 nt, Homo sapiens
agacuguggcucaa

SEQ ID NO: 1526813 - RNA, 16 nt, Homo sapiens
agagaaacuagaaaca

SEQ ID NO: 1526814 - RNA, 13 nt, Homo sapiens
agagauacugaag

SEQ ID NO: 1526815 - RNA, 14 nt, Homo sapiens
agagugcuugggau

SEQ ID NO: 1526816 - RNA, 16 nt, Homo sapiens
agcacagaguggcuug

SEQ ID NO: 1526817 - RNA, 17 nt, Homo sapiens
agcagagaaaauuguga

SEQ ID NO: 1526818 - RNA, 18 nt, Homo sapiens
agcuuguuuucuucacag

SEQ ID NO: 1526819 - RNA, 14 nt, Homo sapiens
agcuuuuccugcau

SEQ ID NO: 1526820 - RNA, 13 nt, Homo sapiens
aggaaaaugggua

SEQ ID NO: 1526821 - RNA, 20 nt, Homo sapiens
aggagauguggucaauggaa

SEQ ID NO: 1526822 - RNA, 13 nt, Homo sapiens
aggagcaacagcu

SEQ ID NO: 1526823 - RNA, 12 nt, Homo sapiens
aggcaagaucua

SEQ ID NO: 1526824 - RNA, 20 nt, Homo sapiens
agggucccuuaaagauuuuc

SEQ ID NO: 1526825 - RNA, 12 nt, Homo sapiens
agguuccaguga

SEQ ID NO: 1526826 - RNA, 13 nt, Homo sapiens
aguguuuucacaa

SEQ ID NO: 1526827 - RNA, 21 nt, Homo sapiens
auaaauuuuaaaaaggaauuu

SEQ ID NO: 1526828 - RNA, 15 nt, Homo sapiens
auaagaccucuggca

SEQ ID NO: 1526829 - RNA, 19 nt, Homo sapiens
auaagauauuuaguaauau

SEQ ID NO: 1526830 - RNA, 23 nt, Homo sapiens
auaucuuuuaauuguguauuuaa

SEQ ID NO: 1526831 - RNA, 14 nt, Homo sapiens
aucccagcuacuca

SEQ ID NO: 1526832 - RNA, 21 nt, Homo sapiens
aucccccacagccacuacuga

SEQ ID NO: 1526833 - RNA, 16 nt, Homo sapiens
aucuaauaaacuuuau

SEQ ID NO: 1526834 - RNA, 19 nt, Homo sapiens
aucuauaaaaugacagauc

SEQ ID NO: 1526835 - RNA, 14 nt, Homo sapiens
aucugaaugcugau

SEQ ID NO: 1526836 - RNA, 13 nt, Homo sapiens
augaacaaauucu

SEQ ID NO: 1526837 - RNA, 23 nt, Homo sapiens
augaacuguuagguucugaugac

SEQ ID NO: 1526838 - RNA, 14 nt, Homo sapiens
augaagguaauauu

SEQ ID NO: 1526839 - RNA, 20 nt, Homo sapiens
augccaaaguagcugaugua

SEQ ID NO: 1526840 - RNA, 17 nt, Homo sapiens
augcccucauacccaug

SEQ ID NO: 1526841 - RNA, 23 nt, Homo sapiens
auguacucacauauaacaugcaa

SEQ ID NO: 1526842 - RNA, 16 nt, Homo sapiens
augugacuuaaaguca

SEQ ID NO: 1526843 - RNA, 19 nt, Homo sapiens
auguggaagaacugugaua

SEQ ID NO: 1526844 - RNA, 15 nt, Homo sapiens
auguggucaauggaa

SEQ ID NO: 1526845 - RNA, 16 nt, Homo sapiens
auuaugugacuuaaag

SEQ ID NO: 1526846 - RNA, 21 nt, Homo sapiens
auuauuuaucagcccuauucu

SEQ ID NO: 1526847 - RNA, 22 nt, Homo sapiens
auucagacaacauuaugaucua

SEQ ID NO: 1526848 - RNA, 20 nt, Homo sapiens
auugacuuaauaaagcuuuu

SEQ ID NO: 1526849 - RNA, 14 nt, Homo sapiens
auugcaucaguuca

SEQ ID NO: 1526850 - RNA, 15 nt, Homo sapiens
auugcaucaguucau

SEQ ID NO: 1526851 - RNA, 19 nt, Homo sapiens
auuugaagaggagaacaaa

SEQ ID NO: 1526852 - RNA, 15 nt, Homo sapiens
auuuugaagucagag

SEQ ID NO: 1526853 - RNA, 13 nt, Homo sapiens
caaaauguagcau

SEQ ID NO: 1526854 - RNA, 21 nt, Homo sapiens
caaacaggguuugauagcacu

SEQ ID NO: 1526855 - RNA, 19 nt, Homo sapiens
caaaccauuucagccaaac

SEQ ID NO: 1526856 - RNA, 14 nt, Homo sapiens
caaacucaguucga

SEQ ID NO: 1526857 - RNA, 16 nt, Homo sapiens
caaacugaaagaucug

SEQ ID NO: 1526858 - RNA, 16 nt, Homo sapiens
caaagaccgauugcau

SEQ ID NO: 1526859 - RNA, 19 nt, Homo sapiens
caaaggcagagagucagac

SEQ ID NO: 1526860 - RNA, 18 nt, Homo sapiens
caaauucuuuaguacuca

SEQ ID NO: 1526861 - RNA, 21 nt, Homo sapiens
caacauggugaaaccccaucu

SEQ ID NO: 1526862 - RNA, 22 nt, Homo sapiens
caagaaccgguuuccaaagaca

SEQ ID NO: 1526863 - RNA, 16 nt, Homo sapiens
caauauuaaugaagua

SEQ ID NO: 1526864 - RNA, 15 nt, Homo sapiens
caaugccaugaacaa

SEQ ID NO: 1526865 - RNA, 16 nt, Homo sapiens
caaugccaugaacaaa

SEQ ID NO: 1526866 - RNA, 17 nt, Homo sapiens
caauugggcagaugugu

SEQ ID NO: 1526867 - RNA, 20 nt, Homo sapiens
cacagacauuuugugugaga

SEQ ID NO: 1526868 - RNA, 20 nt, Homo sapiens
cacaguacaauaauguacuc

SEQ ID NO: 1526869 - RNA, 13 nt, Homo sapiens
cacauauaacaug

SEQ ID NO: 1526870 - RNA, 14 nt, Homo sapiens
cacugaauucacuc

SEQ ID NO: 1526871 - RNA, 15 nt, Homo sapiens
cacugaauucacucc

SEQ ID NO: 1526872 - RNA, 19 nt, Homo sapiens
cagaaaccgugccaaaaga

SEQ ID NO: 1526873 - RNA, 13 nt, Homo sapiens
cagaagaaagggc

SEQ ID NO: 1526874 - RNA, 15 nt, Homo sapiens
cagagaaaauuguga

SEQ ID NO: 1526875 - RNA, 18 nt, Homo sapiens
cagaggagauguggucaa

SEQ ID NO: 1526876 - RNA, 16 nt, Homo sapiens
caggacagaaagaucu

SEQ ID NO: 1526877 - RNA, 17 nt, Homo sapiens
caggguuugauagcacu

SEQ ID NO: 1526878 - RNA, 14 nt, Homo sapiens
caguaauggaauga

SEQ ID NO: 1526879 - RNA, 20 nt, Homo sapiens
cagugugcaagggcagugaa

SEQ ID NO: 1526880 - RNA, 12 nt, Homo sapiens
cauacccaugca

SEQ ID NO: 1526881 - RNA, 19 nt, Homo sapiens
cauaguguuaacugucagu

SEQ ID NO: 1526882 - RNA, 23 nt, Homo sapiens
aggcuuuuauuagaaagccauau

SEQ ID NO: 1526883 - RNA, 19 nt, Homo sapiens
agggugcaagaagccauuu

SEQ ID NO: 1526884 - RNA, 15 nt, Homo sapiens
aggucccugacauuu

SEQ ID NO: 1526885 - RNA, 18 nt, Homo sapiens
aguugcuaggaacaugug

SEQ ID NO: 1526886 - RNA, 15 nt, Homo sapiens
auaaaugacauuauu

SEQ ID NO: 1526887 - RNA, 16 nt, Homo sapiens
auaaaugacauuauua

SEQ ID NO: 1526888 - RNA, 19 nt, Homo sapiens
auaagauuuguacauauua

SEQ ID NO: 1526889 - RNA, 19 nt, Homo sapiens
aucagcacuuuaaccaaug

SEQ ID NO: 1526890 - RNA, 20 nt, Homo sapiens
aucaucaucgaagucuuccc

SEQ ID NO: 1526891 - RNA, 17 nt, Homo sapiens
aucaucgaagucuuccc

SEQ ID NO: 1526892 - RNA, 17 nt, Homo sapiens
aucuguauaagcuguaa

SEQ ID NO: 1526893 - RNA, 14 nt, Homo sapiens
aucuuucucauuac

SEQ ID NO: 1526894 - RNA, 21 nt, Homo sapiens
augaggacuguccccaugccc

SEQ ID NO: 1526895 - RNA, 23 nt, Homo sapiens
augaggucuucccgcaaggccuc

SEQ ID NO: 1526896 - RNA, 17 nt, Homo sapiens
augcuagaggcuuuuau

SEQ ID NO: 1526897 - RNA, 18 nt, Homo sapiens
auggcuuucccagugugu

SEQ ID NO: 1526898 - RNA, 16 nt, Homo sapiens
auggggcuccuggaaa

SEQ ID NO: 1526899 - RNA, 13 nt, Homo sapiens
augguucuuacag

SEQ ID NO: 1526900 - RNA, 14 nt, Homo sapiens
auguuacccagccu

SEQ ID NO: 1526901 - RNA, 19 nt, Homo sapiens
auguugguuucacugagag

SEQ ID NO: 1526902 - RNA, 20 nt, Homo sapiens
auucugugccuccaggacca

SEQ ID NO: 1526903 - RNA, 13 nt, Homo sapiens
auuuauccaugcu

SEQ ID NO: 1526904 - RNA, 15 nt, Homo sapiens
auuucagcuaugcua

SEQ ID NO: 1526905 - RNA, 17 nt, Homo sapiens
auuuccaaaccaucagc

SEQ ID NO: 1526906 - RNA, 21 nt, Homo sapiens
auuuuauagaaaaugcauuau

SEQ ID NO: 1526907 - RNA, 17 nt, Homo sapiens
caaaguacugggauuac

SEQ ID NO: 1526908 - RNA, 20 nt, Homo sapiens
caaucuaauuaaauggcauc

SEQ ID NO: 1526909 - RNA, 20 nt, Homo sapiens
caauguugguuucacugaga

SEQ ID NO: 1526910 - RNA, 17 nt, Homo sapiens
caccauguuacccagcc

SEQ ID NO: 1526911 - RNA, 13 nt, Homo sapiens
cacccggcauucu

SEQ ID NO: 1526912 - RNA, 21 nt, Homo sapiens
cagcagcccgccgcacugggg

SEQ ID NO: 1526913 - RNA, 22 nt, Homo sapiens
cagccucggccucccaaaguac

SEQ ID NO: 1526914 - RNA, 14 nt, Homo sapiens
cagccugucccuga

SEQ ID NO: 1526915 - RNA, 18 nt, Homo sapiens
caguaauuuguggcacua

SEQ ID NO: 1526916 - RNA, 16 nt, Homo sapiens
cagugggccugcugag

SEQ ID NO: 1526917 - RNA, 22 nt, Homo sapiens
caugaagggagggucccugugu

SEQ ID NO: 1526918 - RNA, 15 nt, Homo sapiens
caugcccuccaugug

SEQ ID NO: 1526919 - RNA, 17 nt, Homo sapiens
ccaaaguacugggauua

SEQ ID NO: 1526920 - RNA, 17 nt, Homo sapiens
ccaggaccaggggccca

SEQ ID NO: 1526921 - RNA, 14 nt, Homo sapiens
cccagaugugacgg

SEQ ID NO: 1526922 - RNA, 21 nt, Homo sapiens
cccaguuauaaagaggucaca

SEQ ID NO: 1526923 - RNA, 19 nt, Homo sapiens
ccccggccacccagggauc

SEQ ID NO: 1526924 - RNA, 15 nt, Homo sapiens
cccugacauuuaguu

SEQ ID NO: 1526925 - RNA, 22 nt, Homo sapiens
ccgcaauguugguuucacugag

SEQ ID NO: 1526926 - RNA, 21 nt, Homo sapiens
ccucugguucugacacuuucu

SEQ ID NO: 1526927 - RNA, 19 nt, Homo sapiens
ccuggucucuucaccacug

SEQ ID NO: 1526928 - RNA, 18 nt, Homo sapiens
ccugugcuggaccagcug

SEQ ID NO: 1526929 - RNA, 21 nt, Homo sapiens
ccugugcuggaccagcuggcc

SEQ ID NO: 1526930 - RNA, 21 nt, Homo sapiens
ccugugugugugugugcugau

SEQ ID NO: 1526931 - RNA, 23 nt, Homo sapiens
ccuucucuugaggccugugcucu

SEQ ID NO: 1526932 - RNA, 19 nt, Homo sapiens
ccuugcuuagccugugcug

SEQ ID NO: 1526933 - RNA, 18 nt, Homo sapiens
uugcuaggaacauguggu

SEQ ID NO: 1526934 - RNA, 16 nt, Homo sapiens
auguucuauauucuca

SEQ ID NO: 1526935 - RNA, 16 nt, Homo sapiens
auguuggaaaacauau

SEQ ID NO: 1526936 - RNA, 15 nt, Homo sapiens
auuauuuucugcuac

SEQ ID NO: 1526937 - RNA, 20 nt, Homo sapiens
auucuguuuauuaugacaaa

SEQ ID NO: 1526938 - RNA, 19 nt, Homo sapiens
auuuccaaaccaucagcug

SEQ ID NO: 1526939 - RNA, 14 nt, Homo sapiens
auuuguacauauua

SEQ ID NO: 1526940 - RNA, 17 nt, Homo sapiens
caaauaaaugccuucca

SEQ ID NO: 1526941 - RNA, 17 nt, Homo sapiens
cagaacuaagcucagua

SEQ ID NO: 1526942 - RNA, 14 nt, Homo sapiens
cagcaguaauuugu

SEQ ID NO: 1526943 - RNA, 22 nt, Homo sapiens
cagcuaaagcaguccuccagcc

SEQ ID NO: 1526944 - RNA, 19 nt, Homo sapiens
caggaaaugggcuuuucag

SEQ ID NO: 1526945 - RNA, 19 nt, Homo sapiens
caggccagccugucccuga

SEQ ID NO: 1526946 - RNA, 17 nt, Homo sapiens
cagugacuaauuuugcc

SEQ ID NO: 1526947 - RNA, 13 nt, Homo sapiens
cauaggucccuga

SEQ ID NO: 1526948 - RNA, 21 nt, Homo sapiens
cauauuuguauuccuuuucau

SEQ ID NO: 1526949 - RNA, 23 nt, Homo sapiens
cauauuuguauuccuuuucauaa

SEQ ID NO: 1526950 - RNA, 20 nt, Homo sapiens
caugaagggagggucccugu

SEQ ID NO: 1526951 - RNA, 21 nt, Homo sapiens
cauguggugggacuuucauau

SEQ ID NO: 1526952 - RNA, 17 nt, Homo sapiens
cauuauuaaaguuuuca

SEQ ID NO: 1526953 - RNA, 12 nt, Homo sapiens
ccaaaguacugg

SEQ ID NO: 1526954 - RNA, 17 nt, Homo sapiens
ccaugcccuccaugugu

SEQ ID NO: 1526955 - RNA, 21 nt, Homo sapiens
ccauguguaagaacaaugcca

SEQ ID NO: 1526956 - RNA, 22 nt, Homo sapiens
ccauuuagaggauguggcugua

SEQ ID NO: 1526957 - RNA, 18 nt, Homo sapiens
cccagaucacacaucauc

SEQ ID NO: 1526958 - RNA, 12 nt, Homo sapiens
ccccauauuugu

SEQ ID NO: 1526959 - RNA, 17 nt, Homo sapiens
cccccagagacacgguc

SEQ ID NO: 1526960 - RNA, 21 nt, Homo sapiens
cccuugcuuagccugugcugg

SEQ ID NO: 1526961 - RNA, 17 nt, Homo sapiens
ccgggaaguucaaggaa

SEQ ID NO: 1526962 - RNA, 22 nt, Homo sapiens
ccucugguucugacacuuucug

SEQ ID NO: 1526963 - RNA, 21 nt, Homo sapiens
ccugaaagagaagauggccau

SEQ ID NO: 1526964 - RNA, 20 nt, Homo sapiens
ccugcgagacccaaggcuca

SEQ ID NO: 1526965 - RNA, 16 nt, Homo sapiens
ccugguacacucugau

SEQ ID NO: 1526966 - RNA, 14 nt, Homo sapiens
cggugguugucaca

SEQ ID NO: 1526967 - RNA, 21 nt, Homo sapiens
cuaaguugcuaggaacaugug

SEQ ID NO: 1526968 - RNA, 17 nt, Homo sapiens
cuagacuccauugugcc

SEQ ID NO: 1526969 - RNA, 12 nt, Homo sapiens
cuagguguuguc

SEQ ID NO: 1526970 - RNA, 15 nt, Homo sapiens
cuauuacaguauugc

SEQ ID NO: 1526971 - RNA, 17 nt, Homo sapiens
cucaagcaauccaagug

SEQ ID NO: 1526972 - RNA, 12 nt, Homo sapiens
cucacaguguuu

SEQ ID NO: 1526973 - RNA, 16 nt, Homo sapiens
cuccaacugcaggaaa

SEQ ID NO: 1526974 - RNA, 21 nt, Homo sapiens
cuccauguguaagaacaaugc

SEQ ID NO: 1526975 - RNA, 17 nt, Homo sapiens
cuccugggcucaagcaa

SEQ ID NO: 1526976 - RNA, 20 nt, Homo sapiens
cucucauuuccaaaccauca

SEQ ID NO: 1526977 - RNA, 15 nt, Homo sapiens
cucuggcccaggcua

SEQ ID NO: 1526978 - RNA, 14 nt, Homo sapiens
cucuucaccacugu

SEQ ID NO: 1526979 - RNA, 15 nt, Homo sapiens
cugacuucagggaag

SEQ ID NO: 1526980 - RNA, 13 nt, Homo sapiens
cugagaaggcuca

SEQ ID NO: 1526981 - RNA, 15 nt, Homo sapiens
cugcugggacugaga

SEQ ID NO: 1526982 - RNA, 20 nt, Homo sapiens
cuggcagaggcacucaggua

SEQ ID NO: 1526983 - RNA, 12 nt, Homo sapiens
cuggcuccuugc

SEQ ID NO: 1526984 - RNA, 18 nt, Homo sapiens
cuggggaggccaguguug

SEQ ID NO: 1526985 - RNA, 20 nt, Homo sapiens
cuggggaggccaguguugug

SEQ ID NO: 1526986 - RNA, 18 nt, Homo sapiens
cuggucucaaacucccca

SEQ ID NO: 1526987 - RNA, 20 nt, Homo sapiens
cuguuaaauuuguaaacaau

SEQ ID NO: 1526988 - RNA, 24 nt, Homo sapiens
cuuauuacugcuugcaguaauuca

SEQ ID NO: 1526989 - RNA, 16 nt, Homo sapiens
cuugcguagaauugca

SEQ ID NO: 1526990 - RNA, 21 nt, Homo sapiens
cuuguuucaccuuccauguca

SEQ ID NO: 1526991 - RNA, 15 nt, Homo sapiens
gaaaaauguucuaua

SEQ ID NO: 1526992 - RNA, 14 nt, Homo sapiens
gaaaauuauauucu

SEQ ID NO: 1526993 - RNA, 22 nt, Homo sapiens
gaaauggccauugagcuguuuc

SEQ ID NO: 1526994 - RNA, 16 nt, Homo sapiens
gaaaugggcuuuucag

SEQ ID NO: 1526995 - RNA, 15 nt, Homo sapiens
gaacaggacaugggg

SEQ ID NO: 1526996 - RNA, 13 nt, Homo sapiens
gaacccugucccu

SEQ ID NO: 1526997 - RNA, 20 nt, Homo sapiens
gaagagaccuuggcugcuca

SEQ ID NO: 1526998 - RNA, 12 nt, Homo sapiens
gaccacccggca

SEQ ID NO: 1526999 - RNA, 15 nt, Homo sapiens
gagaccuuggcugcu

SEQ ID NO: 1527000 - RNA, 14 nt, Homo sapiens
gaggauguggcugu

SEQ ID NO: 1527001 - RNA, 23 nt, Homo sapiens
gaggccaguguugugggcuuccu

SEQ ID NO: 1527002 - RNA, 22 nt, Homo sapiens
gaguaucuuuaaaagugccuua

SEQ ID NO: 1527003 - RNA, 20 nt, Homo sapiens
gaucacagcugcaggccacg

SEQ ID NO: 1527004 - RNA, 20 nt, Homo sapiens
gauguuuccugggugcccug

SEQ ID NO: 1527005 - RNA, 18 nt, Homo sapiens
gcaguaauuuguggcacu

SEQ ID NO: 1527006 - RNA, 15 nt, Homo sapiens
gcaucagcacuuuaa

SEQ ID NO: 1527007 - RNA, 23 nt, Homo sapiens
gccaguuucucugccuucuucca

SEQ ID NO: 1527008 - RNA, 14 nt, Homo sapiens
gcccagcacauagc

SEQ ID NO: 1527009 - RNA, 17 nt, Homo sapiens
gccccugcucacagugu

SEQ ID NO: 1527010 - RNA, 23 nt, Homo sapiens
gccgcacuggggcagaugucucc

SEQ ID NO: 1527011 - RNA, 22 nt, Homo sapiens
gccucugguucugacacuuucu

SEQ ID NO: 1527012 - RNA, 21 nt, Homo sapiens
gccuuguuucaccuuccaugu

SEQ ID NO: 1527013 - RNA, 20 nt, Homo sapiens
gcuagagugcaguggugcga

SEQ ID NO: 1527014 - RNA, 15 nt, Homo sapiens
gcuaggaacaugugg

SEQ ID NO: 1527015 - RNA, 16 nt, Homo sapiens
gcuggaugggacucca

SEQ ID NO: 1527016 - RNA, 22 nt, Homo sapiens
gcuuccuccccccgacuccccc

SEQ ID NO: 1527017 - RNA, 14 nt, Homo sapiens
ggaaguucaaggaa

SEQ ID NO: 1527018 - RNA, 22 nt, Homo sapiens
ggcagcaccgcagccucugccc

SEQ ID NO: 1527019 - RNA, 22 nt, Homo sapiens
ggcaggacaaauugcgcccauu

SEQ ID NO: 1527020 - RNA, 20 nt, Homo sapiens
ggcucaagcaauccaaguga

SEQ ID NO: 1527021 - RNA, 14 nt, Homo sapiens
gggcuaaacaugug

SEQ ID NO: 1527022 - RNA, 14 nt, Homo sapiens
ggucucuuucuuuu

SEQ ID NO: 1527023 - RNA, 12 nt, Homo sapiens
guaaacuguuuc

SEQ ID NO: 1527024 - RNA, 17 nt, Homo sapiens
gugccccugcucacagu

SEQ ID NO: 1527025 - RNA, 14 nt, Homo sapiens
guguucauuguaaa

SEQ ID NO: 1527026 - RNA, 22 nt, Homo sapiens
guuucucugccuucuuccagga

SEQ ID NO: 1527027 - RNA, 20 nt, Homo sapiens
guuugccacacccaggugau

SEQ ID NO: 1527028 - RNA, 22 nt, Homo sapiens
uaaaaguuacuaauauaucugu

SEQ ID NO: 1527029 - RNA, 11 nt, Homo sapiens
uaaacauguga

SEQ ID NO: 1527030 - RNA, 18 nt, Homo sapiens
uaaauggcaucagcacuu

SEQ ID NO: 1527031 - RNA, 21 nt, Homo sapiens
uaaauggcaucagcacuuuaa

SEQ ID NO: 1527032 - RNA, 21 nt, Homo sapiens
uaaauuuguaaacaaucuaau

SEQ ID NO: 1527033 - RNA, 20 nt, Homo sapiens
uaaguugcuaggaacaugug

SEQ ID NO: 1527034 - RNA, 15 nt, Homo sapiens
uaauuuauccaugcu

SEQ ID NO: 1527035 - RNA, 15 nt, Homo sapiens
uaauuuuaucuguau

SEQ ID NO: 1527036 - RNA, 13 nt, Homo sapiens
uagaggcuuuuau

SEQ ID NO: 1527037 - RNA, 13 nt, Homo sapiens
uauuccuuuucau

SEQ ID NO: 1527038 - RNA, 19 nt, Homo sapiens
uauuuguauuccuuuucau

SEQ ID NO: 1527039 - RNA, 21 nt, Homo sapiens
ucacugcagcgcgcuccugac

SEQ ID NO: 1527040 - RNA, 21 nt, Homo sapiens
ucagaucuggaucguuaucua

SEQ ID NO: 1527041 - RNA, 14 nt, Homo sapiens
ucauaggucccuga

SEQ ID NO: 1527042 - RNA, 21 nt, Homo sapiens
ucauuuccaaaccaucagcug

SEQ ID NO: 1527043 - RNA, 16 nt, Homo sapiens
uccaaaccaucagcug

SEQ ID NO: 1527044 - RNA, 22 nt, Homo sapiens
uccauguguaagaacaaugcca

SEQ ID NO: 1527045 - RNA, 17 nt, Homo sapiens
ucccagaucacacauca

SEQ ID NO: 1527046 - RNA, 22 nt, Homo sapiens
uccccggcacugcagucugcag

SEQ ID NO: 1527047 - RNA, 15 nt, Homo sapiens
ucccugacauuuagu

SEQ ID NO: 1527048 - RNA, 18 nt, Homo sapiens
uccugaccccucccugca

SEQ ID NO: 1527049 - RNA, 21 nt, Homo sapiens
ucuaauuaaauggcaucagca

SEQ ID NO: 1527050 - RNA, 21 nt, Homo sapiens
ucucucauuuccaaaccauca

SEQ ID NO: 1527051 - RNA, 12 nt, Homo sapiens
ucugcugugguc

SEQ ID NO: 1527052 - RNA, 12 nt, Homo sapiens
ucuggggguccc

SEQ ID NO: 1527053 - RNA, 22 nt, Homo sapiens
ucuucccgcaaggccucucaga

SEQ ID NO: 1527054 - RNA, 20 nt, Homo sapiens
ccuuggcugcucacugucca

SEQ ID NO: 1527055 - RNA, 12 nt, Homo sapiens
cgaagucuuccc

SEQ ID NO: 1527056 - RNA, 12 nt, Homo sapiens
cuaaacauguga

SEQ ID NO: 1527057 - RNA, 14 nt, Homo sapiens
cuaauagguacugc

SEQ ID NO: 1527058 - RNA, 19 nt, Homo sapiens
cuaauggcuuucacuuucu

SEQ ID NO: 1527059 - RNA, 13 nt, Homo sapiens
cuaggaacaugug

SEQ ID NO: 1527060 - RNA, 12 nt, Homo sapiens
cucccaccucaa

SEQ ID NO: 1527061 - RNA, 19 nt, Homo sapiens
cuccccugccacuccucaa

SEQ ID NO: 1527062 - RNA, 22 nt, Homo sapiens
cugaagagaccuuggcugcuca

SEQ ID NO: 1527063 - RNA, 22 nt, Homo sapiens
cugaaucuuuuuaaguuugugu

SEQ ID NO: 1527064 - RNA, 16 nt, Homo sapiens
cugacacuuucugcug

SEQ ID NO: 1527065 - RNA, 17 nt, Homo sapiens
cugcaggggcuacguua

SEQ ID NO: 1527066 - RNA, 17 nt, Homo sapiens
cugggacaggcuuugau

SEQ ID NO: 1527067 - RNA, 13 nt, Homo sapiens
cugggacugagaa

SEQ ID NO: 1527068 - RNA, 14 nt, Homo sapiens
cugggcucaagcaa

SEQ ID NO: 1527069 - RNA, 19 nt, Homo sapiens
cuggggucccucugaagag

SEQ ID NO: 1527070 - RNA, 19 nt, Homo sapiens
cuguuugccacacccaggu

SEQ ID NO: 1527071 - RNA, 22 nt, Homo sapiens
cuuauuacugcuugcaguaauu

SEQ ID NO: 1527072 - RNA, 16 nt, Homo sapiens
cuuauucuagaggucu

SEQ ID NO: 1527073 - RNA, 11 nt, Homo sapiens
cuucaccacug

SEQ ID NO: 1527074 - RNA, 11 nt, Homo sapiens
cuucuuaacau

SEQ ID NO: 1527075 - RNA, 16 nt, Homo sapiens
cuugaggccugugcuc

SEQ ID NO: 1527076 - RNA, 14 nt, Homo sapiens
cuugcgucccauga

SEQ ID NO: 1527077 - RNA, 19 nt, Homo sapiens
cuuucucauuaccagugac

SEQ ID NO: 1527078 - RNA, 16 nt, Homo sapiens
cuuugccuuccaggaa

SEQ ID NO: 1527079 - RNA, 12 nt, Homo sapiens
gaaaacauauga

SEQ ID NO: 1527080 - RNA, 15 nt, Homo sapiens
gaaaaugcauuauuu

SEQ ID NO: 1527081 - RNA, 14 nt, Homo sapiens
gaaaggacuaacau

SEQ ID NO: 1527082 - RNA, 14 nt, Homo sapiens
gaagcugucaggcu

SEQ ID NO: 1527083 - RNA, 15 nt, Homo sapiens
gaccccucccugcag

SEQ ID NO: 1527084 - RNA, 15 nt, Homo sapiens
gagauaguugcuaag

SEQ ID NO: 1527085 - RNA, 14 nt, Homo sapiens
gauauaagauuugu

SEQ ID NO: 1527086 - RNA, 22 nt, Homo sapiens
gauauaagauuuguacauauua

SEQ ID NO: 1527087 - RNA, 15 nt, Homo sapiens
gauaucuuuccuccc

SEQ ID NO: 1527088 - RNA, 17 nt, Homo sapiens
gaugucuccccugccac

SEQ ID NO: 1527089 - RNA, 16 nt, Homo sapiens
gcaaauaaaugccuuc

SEQ ID NO: 1527090 - RNA, 14 nt, Homo sapiens
gcaagaagccauuu

SEQ ID NO: 1527091 - RNA, 20 nt, Homo sapiens
gcaauccaagugauccuccc

SEQ ID NO: 1527092 - RNA, 22 nt, Homo sapiens
gcacugcagucugcagaguucu

SEQ ID NO: 1527093 - RNA, 16 nt, Homo sapiens
gcagaguucuccugga

SEQ ID NO: 1527094 - RNA, 18 nt, Homo sapiens
gcagcaccgcagccucug

SEQ ID NO: 1527095 - RNA, 15 nt, Homo sapiens
gccacacccagguga

SEQ ID NO: 1527096 - RNA, 16 nt, Homo sapiens
gccaugcccuccaugu

SEQ ID NO: 1527097 - RNA, 20 nt, Homo sapiens
gcccacuuugccuuccagga

SEQ ID NO: 1527098 - RNA, 19 nt, Homo sapiens
gcccaggcuagagugcagu

SEQ ID NO: 1527099 - RNA, 20 nt, Homo sapiens
gcccaggcuagagugcagug

SEQ ID NO: 1527100 - RNA, 15 nt, Homo sapiens
gccccagccccggcc

SEQ ID NO: 1527101 - RNA, 17 nt, Homo sapiens
gcccuggcuccuugcag

SEQ ID NO: 1527102 - RNA, 18 nt, Homo sapiens
gccuuguuucaccuucca

SEQ ID NO: 1527103 - RNA, 19 nt, Homo sapiens
gccuuguuucaccuuccau

SEQ ID NO: 1527104 - RNA, 13 nt, Homo sapiens
gcuaaacauguga

SEQ ID NO: 1527105 - RNA, 16 nt, Homo sapiens
gcuaggaacauguggu

SEQ ID NO: 1527106 - RNA, 16 nt, Homo sapiens
gcuggccugggguccc

SEQ ID NO: 1527107 - RNA, 14 nt, Homo sapiens
gcugggacugagaa

SEQ ID NO: 1527108 - RNA, 22 nt, Homo sapiens
ggaagcccugucuguuugccac

SEQ ID NO: 1527109 - RNA, 22 nt, Homo sapiens
ggaccagcuggccugggguccc

SEQ ID NO: 1527110 - RNA, 19 nt, Homo sapiens
ggagaaaaugaacaggaca

SEQ ID NO: 1527111 - RNA, 15 nt, Homo sapiens
ggcagaugucucccc

SEQ ID NO: 1527112 - RNA, 13 nt, Homo sapiens
ggccacccaggga

SEQ ID NO: 1527113 - RNA, 12 nt, Homo sapiens
ggccaugcccuc

SEQ ID NO: 1527114 - RNA, 20 nt, Homo sapiens
ggcccaggcuagagugcagu

SEQ ID NO: 1527115 - RNA, 13 nt, Homo sapiens
ggccugggguccc

SEQ ID NO: 1527116 - RNA, 21 nt, Homo sapiens
ggcuuuuauuagaaagccaua

SEQ ID NO: 1527117 - RNA, 19 nt, Homo sapiens
gggaguccuugcgucccau

SEQ ID NO: 1527118 - RNA, 21 nt, Homo sapiens
gggucgaggauucugugccuc

SEQ ID NO: 1527119 - RNA, 14 nt, Homo sapiens
ggucucucuggaaa

SEQ ID NO: 1527120 - RNA, 14 nt, Homo sapiens
guauuccuuuucau

SEQ ID NO: 1527121 - RNA, 22 nt, Homo sapiens
gucuaacuuaaauagcuuugag

SEQ ID NO: 1527122 - RNA, 14 nt, Homo sapiens
gugauaucuuucuc

SEQ ID NO: 1527123 - RNA, 18 nt, Homo sapiens
guuaucuacugacuauau

SEQ ID NO: 1527124 - RNA, 14 nt, Homo sapiens
ugaggccugugcuc

SEQ ID NO: 1527125 - RNA, 12 nt, Homo sapiens
ugauuuccucua

SEQ ID NO: 1527126 - RNA, 16 nt, Homo sapiens
ugccacacccagguga

SEQ ID NO: 1527127 - RNA, 11 nt, Homo sapiens
ugcccacuuug

SEQ ID NO: 1527128 - RNA, 21 nt, Homo sapiens
ugcguagaauugcaggucucu

SEQ ID NO: 1527129 - RNA, 12 nt, Homo sapiens
ugcucacagugu

SEQ ID NO: 1527130 - RNA, 14 nt, Homo sapiens
uggaaagaaagggc

SEQ ID NO: 1527131 - RNA, 24 nt, Homo sapiens
uggacagcggcagugggccugcug

SEQ ID NO: 1527132 - RNA, 20 nt, Homo sapiens
uggcaaccuggcucuggccc

SEQ ID NO: 1527133 - RNA, 20 nt, Homo sapiens
uggcccgaggaagcuggaca

SEQ ID NO: 1527134 - RNA, 14 nt, Homo sapiens
uggggaggccagug

SEQ ID NO: 1527135 - RNA, 14 nt, Homo sapiens
uggucucuucacca

SEQ ID NO: 1527136 - RNA, 14 nt, Homo sapiens
uguuucaccuucca

SEQ ID NO: 1527137 - RNA, 15 nt, Homo sapiens
uguuucaccuuccau

SEQ ID NO: 1527138 - RNA, 15 nt, Homo sapiens
uuaauaaccugccag

SEQ ID NO: 1527139 - RNA, 20 nt, Homo sapiens
uuaauaaccugccaguccca

SEQ ID NO: 1527140 - RNA, 13 nt, Homo sapiens
uuagccugugcug

SEQ ID NO: 1527141 - RNA, 23 nt, Homo sapiens
uuauaacuauauaaaugacauua

SEQ ID NO: 1527142 - RNA, 12 nt, Homo sapiens
uuauuacugcuu

SEQ ID NO: 1527143 - RNA, 19 nt, Homo sapiens
uucaccacuguaguucucu

SEQ ID NO: 1527144 - RNA, 18 nt, Homo sapiens
uucuagguggcaggacaa

SEQ ID NO: 1527145 - RNA, 16 nt, Homo sapiens
uucucauuuuucuaaa

SEQ ID NO: 1527146 - RNA, 15 nt, Homo sapiens
uucucucauuuccaa

SEQ ID NO: 1527147 - RNA, 16 nt, Homo sapiens
uucuguaaaaguuacu

SEQ ID NO: 1527148 - RNA, 23 nt, Homo sapiens
uugauaucuuuccucccucuuuu

SEQ ID NO: 1527149 - RNA, 13 nt, Homo sapiens
uugguuucacuga

SEQ ID NO: 1527150 - RNA, 20 nt, Homo sapiens
uuguuucaccuuccauguca

SEQ ID NO: 1527151 - RNA, 23 nt, Homo sapiens
uuuaaguuugugucguuccuuaa

SEQ ID NO: 1527152 - RNA, 14 nt, Homo sapiens
uuucaggaagugaa

SEQ ID NO: 1527153 - RNA, 18 nt, Homo sapiens
uuucucugccuucuucca

SEQ ID NO: 1527154 - RNA, 20 nt, Homo sapiens
uuuuaaguuugugucguucc

SEQ ID NO: 1527155 - RNA, 18 nt, Homo sapiens
uuuuagagauggcuuucc

SEQ ID NO: 1527156 - RNA, 17 nt, Homo sapiens
uuuuucuaauagguacu

SEQ ID NO: 1527157 - RNA, 20 nt, Homo sapiens
gcucacuguccacaugugaa

SEQ ID NO: 1527158 - RNA, 14 nt, Homo sapiens
gcucuggggguccc

SEQ ID NO: 1527159 - RNA, 22 nt, Homo sapiens
gcugcucacuguccacauguga

SEQ ID NO: 1527160 - RNA, 16 nt, Homo sapiens
gcuggaauuucugcug

SEQ ID NO: 1527161 - RNA, 19 nt, Homo sapiens
ggacauggggcuccuggaa

SEQ ID NO: 1527162 - RNA, 15 nt, Homo sapiens
ggaguagcugggauc

SEQ ID NO: 1527163 - RNA, 20 nt, Homo sapiens
ggaucacagcugcaggccac

SEQ ID NO: 1527164 - RNA, 12 nt, Homo sapiens
ggcuccuggaaa

SEQ ID NO: 1527165 - RNA, 14 nt, Homo sapiens
ggcuuucccagugu

SEQ ID NO: 1527166 - RNA, 21 nt, Homo sapiens
gggcagaugucuccccugcca

SEQ ID NO: 1527167 - RNA, 23 nt, Homo sapiens
gggcagaugucuccccugccacu

SEQ ID NO: 1527168 - RNA, 10 nt, Homo sapiens
gggucccugu

SEQ ID NO: 1527169 - RNA, 21 nt, Homo sapiens
gggugcccuggcuccuugcag

SEQ ID NO: 1527170 - RNA, 17 nt, Homo sapiens
gguacuugguaagcaaa

SEQ ID NO: 1527171 - RNA, 14 nt, Homo sapiens
guacgggccaguuu

SEQ ID NO: 1527172 - RNA, 22 nt, Homo sapiens
gucccuccuaacaaguguaucu

SEQ ID NO: 1527173 - RNA, 22 nt, Homo sapiens
gucucuguacgggccaguuucu

SEQ ID NO: 1527174 - RNA, 13 nt, Homo sapiens
gucuguuugccac

SEQ ID NO: 1527175 - RNA, 16 nt, Homo sapiens
gugcucuggggguccc

SEQ ID NO: 1527176 - RNA, 17 nt, Homo sapiens
guugcuaggaacaugug

SEQ ID NO: 1527177 - RNA, 13 nt, Homo sapiens
guuucacugagag

SEQ ID NO: 1527178 - RNA, 12 nt, Homo sapiens
uaaacaugugag

SEQ ID NO: 1527179 - RNA, 14 nt, Homo sapiens
uaaaugccuuccac

SEQ ID NO: 1527180 - RNA, 21 nt, Homo sapiens
uaagaucucuuuguagccauc

SEQ ID NO: 1527181 - RNA, 17 nt, Homo sapiens
uagaauugcaggucucu

SEQ ID NO: 1527182 - RNA, 18 nt, Homo sapiens
uagaggauguggcuguaa

SEQ ID NO: 1527183 - RNA, 12 nt, Homo sapiens
uagccugugcug

SEQ ID NO: 1527184 - RNA, 12 nt, Homo sapiens
uagcuccuuccc

SEQ ID NO: 1527185 - RNA, 22 nt, Homo sapiens
uagggugcaagaagccauuuag

SEQ ID NO: 1527186 - RNA, 14 nt, Homo sapiens
uauaaauuaucuga

SEQ ID NO: 1527187 - RNA, 11 nt, Homo sapiens
uauccaugcug

SEQ ID NO: 1527188 - RNA, 16 nt, Homo sapiens
ucacugagagcugccu

SEQ ID NO: 1527189 - RNA, 15 nt, Homo sapiens
ucaggccagccuguc

SEQ ID NO: 1527190 - RNA, 20 nt, Homo sapiens
ucaggccagccugucccuga

SEQ ID NO: 1527191 - RNA, 16 nt, Homo sapiens
ucauuaccagugacua

SEQ ID NO: 1527192 - RNA, 18 nt, Homo sapiens
uccaaaccaucagcugcu

SEQ ID NO: 1527193 - RNA, 22 nt, Homo sapiens
uccaacugucagaucuggaucg

SEQ ID NO: 1527194 - RNA, 14 nt, Homo sapiens
uccaugucaggcca

SEQ ID NO: 1527195 - RNA, 19 nt, Homo sapiens
uccccaugcccacggaugc

SEQ ID NO: 1527196 - RNA, 18 nt, Homo sapiens
uccuggaaagaaagggcc

SEQ ID NO: 1527197 - RNA, 20 nt, Homo sapiens
uccugggcucaagcaaucca

SEQ ID NO: 1527198 - RNA, 15 nt, Homo sapiens
ucugcagaguucucc

SEQ ID NO: 1527199 - RNA, 20 nt, Homo sapiens
ucugccuucuuccaggauca

SEQ ID NO: 1527200 - RNA, 11 nt, Homo sapiens
ucuguuuuccc

SEQ ID NO: 1527201 - RNA, 23 nt, Homo sapiens
ucuucaccacuguaguucucuca

SEQ ID NO: 1527202 - RNA, 17 nt, Homo sapiens
ucuugaggccugugcuc

SEQ ID NO: 1527203 - RNA, 12 nt, Homo sapiens
ugaacaggacau

SEQ ID NO: 1527204 - RNA, 11 nt, Homo sapiens
ugaggccugug

SEQ ID NO: 1527205 - RNA, 17 nt, Homo sapiens
ugaggcuuucagugaua

SEQ ID NO: 1527206 - RNA, 14 nt, Homo sapiens
ugaggguuagcaag

SEQ ID NO: 1527207 - RNA, 18 nt, Homo sapiens
ugaguaaacuguuucuca

SEQ ID NO: 1527208 - RNA, 21 nt, Homo sapiens
ugauguggagaaaggacuaac

SEQ ID NO: 1527209 - RNA, 17 nt, Homo sapiens
ugccccagccccggcca

SEQ ID NO: 1527210 - RNA, 11 nt, Homo sapiens
ugcgucccaug

SEQ ID NO: 1527211 - RNA, 23 nt, Homo sapiens
ugcugccuuguuucaccuuccau

SEQ ID NO: 1527212 - RNA, 22 nt, Homo sapiens
ugcuggcagaggcacucaggua

SEQ ID NO: 1527213 - RNA, 14 nt, Homo sapiens
ugcuugcaguaauu

SEQ ID NO: 1527214 - RNA, 13 nt, Homo sapiens
uggccaugcccuc

SEQ ID NO: 1527215 - RNA, 21 nt, Homo sapiens
uggcccaggcuagagugcagu

SEQ ID NO: 1527216 - RNA, 20 nt, Homo sapiens
ugggacugagaaggcucacg

SEQ ID NO: 1527217 - RNA, 20 nt, Homo sapiens
ugggcuuuucaggaagugaa

SEQ ID NO: 1527218 - RNA, 14 nt, Homo sapiens
uggggcuccuggaa

SEQ ID NO: 1527219 - RNA, 23 nt, Homo sapiens
uguaaacacuuuugggaaagggc

SEQ ID NO: 1527220 - RNA, 15 nt, Homo sapiens
uguagccauccuguu

SEQ ID NO: 1527221 - RNA, 19 nt, Homo sapiens
ugucucauaguuguguuaa

SEQ ID NO: 1527222 - RNA, 14 nt, Homo sapiens
ugugugugugcuga

SEQ ID NO: 1527223 - RNA, 19 nt, Homo sapiens
uguguguucauuguaaaca

SEQ ID NO: 1527224 - RNA, 22 nt, Homo sapiens
uuaagcagaacuaagcucagua

SEQ ID NO: 1527225 - RNA, 15 nt, Homo sapiens
uuaccagugacuaau

SEQ ID NO: 1527226 - RNA, 14 nt, Homo sapiens
uuagggugcaagaa

SEQ ID NO: 1527227 - RNA, 14 nt, Homo sapiens
uuauuaugacaaau

SEQ ID NO: 1527228 - RNA, 14 nt, Homo sapiens
uucaccuuccaugu

SEQ ID NO: 1527229 - RNA, 23 nt, Homo sapiens
uucauaacuuuucuugauaucuu

SEQ ID NO: 1527230 - RNA, 12 nt, Homo sapiens
uuccaaaccauc

SEQ ID NO: 1527231 - RNA, 17 nt, Homo sapiens
uuccaugucaggccagc

SEQ ID NO: 1527232 - RNA, 13 nt, Homo sapiens
uucuauauucuca

SEQ ID NO: 1527233 - RNA, 18 nt, Homo sapiens
uucucugccuucuuccag

SEQ ID NO: 1527234 - RNA, 18 nt, Homo sapiens
uucugacacuuucugcug

SEQ ID NO: 1527235 - RNA, 19 nt, Homo sapiens
uucuguaaaaguuacuaau

SEQ ID NO: 1527236 - RNA, 20 nt, Homo sapiens
uucuugauaucuuuccuccc

SEQ ID NO: 1527237 - RNA, 16 nt, Homo sapiens
uugcuauuuauauuca

SEQ ID NO: 1527238 - RNA, 20 nt, Homo sapiens
uugcuuagccugugcuggac

SEQ ID NO: 1527239 - RNA, 14 nt, Homo sapiens
uuguaaacacuuuu

SEQ ID NO: 1527240 - RNA, 17 nt, Homo sapiens
uuuaaaauaagaucucu

SEQ ID NO: 1527241 - RNA, 17 nt, Homo sapiens
uuuauaauuuuaucugu

SEQ ID NO: 1527242 - RNA, 13 nt, Homo sapiens
uuuccaaaccauc

SEQ ID NO: 1527243 - RNA, 17 nt, Homo sapiens
uuugccuuccaggaaau

SEQ ID NO: 1527244 - RNA, 18 nt, Homo sapiens
uuuguacauauuaucauc

SEQ ID NO: 1527245 - RNA, 14 nt, Homo sapiens
ggcuagagugcagu

SEQ ID NO: 1527246 - RNA, 16 nt, Homo sapiens
gggcuaaacaugugag

SEQ ID NO: 1527247 - RNA, 18 nt, Homo sapiens
gguaagcaaauuucuaaa

SEQ ID NO: 1527248 - RNA, 19 nt, Homo sapiens
ggugaaacagggcuugucc

SEQ ID NO: 1527249 - RNA, 19 nt, Homo sapiens
ggugauuuccucuaaagaa

SEQ ID NO: 1527250 - RNA, 11 nt, Homo sapiens
guacugggauu

SEQ ID NO: 1527251 - RNA, 20 nt, Homo sapiens
gugggccugcugaggccuuc

SEQ ID NO: 1527252 - RNA, 18 nt, Homo sapiens
guugauuauuuucugcua

SEQ ID NO: 1527253 - RNA, 14 nt, Homo sapiens
guuucaccuuccau

SEQ ID NO: 1527254 - RNA, 17 nt, Homo sapiens
guuuuccccccauauuu

SEQ ID NO: 1527255 - RNA, 14 nt, Homo sapiens
uaagaacaaugcca

SEQ ID NO: 1527256 - RNA, 21 nt, Homo sapiens
uaagcagaacuaagcucagua

SEQ ID NO: 1527257 - RNA, 12 nt, Homo sapiens
uacgggccaguu

SEQ ID NO: 1527258 - RNA, 16 nt, Homo sapiens
uagccugugcuggacc

SEQ ID NO: 1527259 - RNA, 12 nt, Homo sapiens
uauaacuauaua

SEQ ID NO: 1527260 - RNA, 14 nt, Homo sapiens
uauaagcuguaaua

SEQ ID NO: 1527261 - RNA, 17 nt, Homo sapiens
uauagcccggugcagcc

SEQ ID NO: 1527262 - RNA, 19 nt, Homo sapiens
uaugguuuuauaacuauau

SEQ ID NO: 1527263 - RNA, 12 nt, Homo sapiens
ucacacccugac

SEQ ID NO: 1527264 - RNA, 22 nt, Homo sapiens
ucaccacuguaguucucucauu

SEQ ID NO: 1527265 - RNA, 14 nt, Homo sapiens
ucaccuuccauguc

SEQ ID NO: 1527266 - RNA, 16 nt, Homo sapiens
ucaccuuccaugucag

SEQ ID NO: 1527267 - RNA, 15 nt, Homo sapiens
ucacugagagcugcc

SEQ ID NO: 1527268 - RNA, 16 nt, Homo sapiens
ucccauggaugaguaa

SEQ ID NO: 1527269 - RNA, 22 nt, Homo sapiens
uccccaugcccacggaugcuca

SEQ ID NO: 1527270 - RNA, 20 nt, Homo sapiens
ucccugugugugugugugcu

SEQ ID NO: 1527271 - RNA, 17 nt, Homo sapiens
ucucauuuccaaaccau

SEQ ID NO: 1527272 - RNA, 14 nt, Homo sapiens
ucucuucaccacug

SEQ ID NO: 1527273 - RNA, 13 nt, Homo sapiens
ucugcagaguucu

SEQ ID NO: 1527274 - RNA, 15 nt, Homo sapiens
ucugcuguggucuau

SEQ ID NO: 1527275 - RNA, 14 nt, Homo sapiens
ucuucugucucaua

SEQ ID NO: 1527276 - RNA, 15 nt, Homo sapiens
ucuugauaucuuucc

SEQ ID NO: 1527277 - RNA, 16 nt, Homo sapiens
ugaagggagggucccu

SEQ ID NO: 1527278 - RNA, 15 nt, Homo sapiens
ugaccuuacccgcua

SEQ ID NO: 1527279 - RNA, 20 nt, Homo sapiens
ugagggucucuuucuuuucu

SEQ ID NO: 1527280 - RNA, 17 nt, Homo sapiens
ugcagcggugguuguca

SEQ ID NO: 1527281 - RNA, 12 nt, Homo sapiens
ugccagucccag

SEQ ID NO: 1527282 - RNA, 15 nt, Homo sapiens
ugcccagggaguccu

SEQ ID NO: 1527283 - RNA, 13 nt, Homo sapiens
ugccuucuuccag

SEQ ID NO: 1527284 - RNA, 15 nt, Homo sapiens
ugcuauuuauauuca

SEQ ID NO: 1527285 - RNA, 15 nt, Homo sapiens
ugcugggacugagaa

SEQ ID NO: 1527286 - RNA, 19 nt, Homo sapiens
uggcaaccuggcucuggcc

SEQ ID NO: 1527287 - RNA, 15 nt, Homo sapiens
uggcuuucccagugu

SEQ ID NO: 1527288 - RNA, 23 nt, Homo sapiens
ugggccucugguucugacacuuu

SEQ ID NO: 1527289 - RNA, 12 nt, Homo sapiens
ugggggucccuu

SEQ ID NO: 1527290 - RNA, 19 nt, Homo sapiens
ugucguuccuuaagcagaa

SEQ ID NO: 1527291 - RNA, 17 nt, Homo sapiens
uguugguuucacugaga

SEQ ID NO: 1527292 - RNA, 17 nt, Homo sapiens
uuaaaguuuucaaauua

SEQ ID NO: 1527293 - RNA, 13 nt, Homo sapiens
uuacagaguaucu

SEQ ID NO: 1527294 - RNA, 14 nt, Homo sapiens
uuacuaauauaucu

SEQ ID NO: 1527295 - RNA, 21 nt, Homo sapiens
uuagaaagaaaauuauauucu

SEQ ID NO: 1527296 - RNA, 16 nt, Homo sapiens
uuagcagcccagcaca

SEQ ID NO: 1527297 - RNA, 19 nt, Homo sapiens
uuauaaagaggucacauag

SEQ ID NO: 1527298 - RNA, 23 nt, Homo sapiens
uuccuuaagcagaacuaagcuca

SEQ ID NO: 1527299 - RNA, 18 nt, Homo sapiens
uucugcuguggucuauaa

SEQ ID NO: 1527300 - RNA, 17 nt, Homo sapiens
uugccacacccagguga

SEQ ID NO: 1527301 - RNA, 16 nt, Homo sapiens
uugguuucacugagag

SEQ ID NO: 1527302 - RNA, 23 nt, Homo sapiens
uuuaguugauuauuuucugcuac

SEQ ID NO: 1527303 - RNA, 17 nt, Homo sapiens
uuucagugauaucuuuc

SEQ ID NO: 1527304 - RNA, 12 nt, Homo sapiens
aaaaauguucua

SEQ ID NO: 1527305 - RNA, 18 nt, Homo sapiens
aaaauaaacuucuuaaca

SEQ ID NO: 1527306 - RNA, 13 nt, Homo sapiens
aaaauaagaucuc

SEQ ID NO: 1527307 - RNA, 22 nt, Homo sapiens
aaagcaaauaaaugccuuccac

SEQ ID NO: 1527308 - RNA, 15 nt, Homo sapiens
aaauaagaucucuuu

SEQ ID NO: 1527309 - RNA, 18 nt, Homo sapiens
aaauggcaucagcacuuu

SEQ ID NO: 1527310 - RNA, 15 nt, Homo sapiens
aacaugugaggccug

SEQ ID NO: 1527311 - RNA, 20 nt, Homo sapiens
aacauguggugggacuuuca

SEQ ID NO: 1527312 - RNA, 22 nt, Homo sapiens
aagacaaagcaaauaaaugccu

SEQ ID NO: 1527313 - RNA, 19 nt, Homo sapiens
aagcucggagccagggcuc

SEQ ID NO: 1527314 - RNA, 17 nt, Homo sapiens
aagggagggucccugug

SEQ ID NO: 1527315 - RNA, 17 nt, Homo sapiens
aagggcuaaacauguga

SEQ ID NO: 1527316 - RNA, 19 nt, Homo sapiens
aagugauccucccaccuca

SEQ ID NO: 1527317 - RNA, 20 nt, Homo sapiens
aaguugcuaggaacaugugg

SEQ ID NO: 1527318 - RNA, 15 nt, Homo sapiens
aauaaaugccuucca

SEQ ID NO: 1527319 - RNA, 14 nt, Homo sapiens
aauugcaggucucu

SEQ ID NO: 1527320 - RNA, 20 nt, Homo sapiens
acaaaugaaagagaaaauau

SEQ ID NO: 1527321 - RNA, 12 nt, Homo sapiens
acacccagguga

SEQ ID NO: 1527322 - RNA, 18 nt, Homo sapiens
accaucagcugcuuuuaa

SEQ ID NO: 1527323 - RNA, 11 nt, Homo sapiens
acccaggugau

SEQ ID NO: 1527324 - RNA, 15 nt, Homo sapiens
acuguccccaugccc

SEQ ID NO: 1527325 - RNA, 17 nt, Homo sapiens
agaggucucucuggaaa

SEQ ID NO: 1527326 - RNA, 20 nt, Homo sapiens
agcaaauaaaugccuuccac

SEQ ID NO: 1527327 - RNA, 12 nt, Homo sapiens
agccccggccac

SEQ ID NO: 1527328 - RNA, 19 nt, Homo sapiens
agccuagguguugucagca

SEQ ID NO: 1527329 - RNA, 16 nt, Homo sapiens
agcuccccggcacugc

SEQ ID NO: 1527330 - RNA, 14 nt, Homo sapiens
aggaacauguggug

SEQ ID NO: 1527331 - RNA, 20 nt, Homo sapiens
aggacaaauugcgcccauuu

SEQ ID NO: 1527332 - RNA, 16 nt, Homo sapiens
aggaccgccugcccug

SEQ ID NO: 1527333 - RNA, 14 nt, Homo sapiens
aggacuaacaucuc

SEQ ID NO: 1527334 - RNA, 15 nt, Homo sapiens
agggcuaaacaugug

SEQ ID NO: 1527335 - RNA, 17 nt, Homo sapiens
agucugcagaguucucc

SEQ ID NO: 1527336 - RNA, 21 nt, Homo sapiens
auaagcuguaauaucauuuua

SEQ ID NO: 1527337 - RNA, 16 nt, Homo sapiens
aucacagcugcaggcc

SEQ ID NO: 1527338 - RNA, 19 nt, Homo sapiens
aucguuaucuacugacuau

SEQ ID NO: 1527339 - RNA, 13 nt, Homo sapiens
augaggucuuccc

SEQ ID NO: 1527340 - RNA, 16 nt, Homo sapiens
augcccuccaugugua

SEQ ID NO: 1527341 - RNA, 21 nt, Homo sapiens
augcuagaggcuuuuauuaga

SEQ ID NO: 1527342 - RNA, 13 nt, Homo sapiens
auggaaaguuugu

SEQ ID NO: 1527343 - RNA, 16 nt, Homo sapiens
auggcaucagcacuuu

SEQ ID NO: 1527344 - RNA, 13 nt, Homo sapiens
augggcuuuucag

SEQ ID NO: 1527345 - RNA, 23 nt, Homo sapiens
augucuaacuuaaauagcuuuga

SEQ ID NO: 1527346 - RNA, 17 nt, Homo sapiens
auguuggaaaacauaug

SEQ ID NO: 1527347 - RNA, 18 nt, Homo sapiens
auuaaauggcaucagcac

SEQ ID NO: 1527348 - RNA, 15 nt, Homo sapiens
auuacaguauugcua

SEQ ID NO: 1527349 - RNA, 23 nt, Homo sapiens
auuauagcccggugcagccucua

SEQ ID NO: 1527350 - RNA, 21 nt, Homo sapiens
auuauauucuguuuauuauga

SEQ ID NO: 1527351 - RNA, 18 nt, Homo sapiens
auucuagaggucucucug

SEQ ID NO: 1527352 - RNA, 17 nt, Homo sapiens
auuuuuaugacuauccu

SEQ ID NO: 1527353 - RNA, 19 nt, Homo sapiens
caaaacaagugacaugaag

SEQ ID NO: 1527354 - RNA, 18 nt, Homo sapiens
caacugcaggaaaacccu

SEQ ID NO: 1527355 - RNA, 20 nt, Homo sapiens
caaggaagaauaaaguugaa

SEQ ID NO: 1527356 - RNA, 19 nt, Homo sapiens
caauguugguuucacugag

SEQ ID NO: 1527357 - RNA, 21 nt, Homo sapiens
caauguugguuucacugagag

SEQ ID NO: 1527358 - RNA, 15 nt, Homo sapiens
cacacccugacuuca

SEQ ID NO: 1527359 - RNA, 13 nt, Homo sapiens
caccuuccauguc

SEQ ID NO: 1527360 - RNA, 14 nt, Homo sapiens
caccuuccauguca

SEQ ID NO: 1527361 - RNA, 16 nt, Homo sapiens
cacucagguacuuggu

SEQ ID NO: 1527362 - RNA, 23 nt, Homo sapiens
cacugcagucugcagaguucucc

SEQ ID NO: 1527363 - RNA, 18 nt, Homo sapiens
cacuggggcagaugucuc

SEQ ID NO: 1527364 - RNA, 19 nt, Homo sapiens
cacuggggcagaugucucc

SEQ ID NO: 1527365 - RNA, 19 nt, Homo sapiens
cagcaccgcagccucugcc

SEQ ID NO: 1527366 - RNA, 17 nt, Homo sapiens
cagccucggccucccaa

SEQ ID NO: 1527367 - RNA, 22 nt, Homo sapiens
cagccuggucucaaacucccca

SEQ ID NO: 1527368 - RNA, 20 nt, Homo sapiens
cagugauaucuuucucauua

SEQ ID NO: 1527369 - RNA, 18 nt, Homo sapiens
cauagcuccuucccagga

SEQ ID NO: 1527370 - RNA, 11 nt, Homo sapiens
caugucaggcc

SEQ ID NO: 1527371 - RNA, 15 nt, Homo sapiens
cauguggugggacuu

SEQ ID NO: 1527372 - RNA, 22 nt, Homo sapiens
ccaacugcaggaaaacccuuaa

SEQ ID NO: 1527373 - RNA, 20 nt, Homo sapiens
ccaggcuagagugcaguggu

SEQ ID NO: 1527374 - RNA, 15 nt, Homo sapiens
ccaugaggucuuccc

SEQ ID NO: 1527375 - RNA, 15 nt, Homo sapiens
ccauuuagggcagca

SEQ ID NO: 1527376 - RNA, 18 nt, Homo sapiens
cccaggugauuuccucua

SEQ ID NO: 1527377 - RNA, 19 nt, Homo sapiens
cccugcucacaguguuuua

SEQ ID NO: 1527378 - RNA, 22 nt, Homo sapiens
cccuugcuuagccugugcugga

SEQ ID NO: 1527379 - RNA, 16 nt, Homo sapiens
ccuaacaaguguaucu

SEQ ID NO: 1527380 - RNA, 21 nt, Homo sapiens
ccuaauggcuuucacuuucuc

SEQ ID NO: 1527381 - RNA, 18 nt, Homo sapiens
ccucccaaaguacuggga

SEQ ID NO: 1527382 - RNA, 20 nt, Homo sapiens
ccucccaaaguacugggauu

SEQ ID NO: 1527383 - RNA, 12 nt, Homo sapiens
cgcccauuuaga

SEQ ID NO: 1527384 - RNA, 11 nt, Homo sapiens
cuaaacaugug

SEQ ID NO: 1527385 - RNA, 22 nt, Homo sapiens
cuaaguugcuaggaacaugugg

SEQ ID NO: 1527386 - RNA, 13 nt, Homo sapiens
cuaauggcuuuca

SEQ ID NO: 1527387 - RNA, 14 nt, Homo sapiens
cuaauuaaauggca

SEQ ID NO: 1527388 - RNA, 20 nt, Homo sapiens
cuagagugcaguggugcgau

SEQ ID NO: 1527389 - RNA, 18 nt, Homo sapiens
cuauauuuucccuuauua

SEQ ID NO: 1527390 - RNA, 16 nt, Homo sapiens
cucauuaccagugacu

SEQ ID NO: 1527391 - RNA, 22 nt, Homo sapiens
cucauuuccaaaccaucagcug

SEQ ID NO: 1527392 - RNA, 16 nt, Homo sapiens
cucuggccuugcccca

SEQ ID NO: 1527393 - RNA, 17 nt, Homo sapiens
cucuguacgggccaguu

SEQ ID NO: 1527394 - RNA, 16 nt, Homo sapiens
cugcugggacugagaa

SEQ ID NO: 1527395 - RNA, 13 nt, Homo sapiens
cuggaagcuguca

SEQ ID NO: 1527396 - RNA, 18 nt, Homo sapiens
cuggucucuucaccacug

SEQ ID NO: 1527397 - RNA, 11 nt, Homo sapiens
cugucccugaa

SEQ ID NO: 1527398 - RNA, 16 nt, Homo sapiens
cugucuguuugccaca

SEQ ID NO: 1527399 - RNA, 17 nt, Homo sapiens
cuuaggggaacccuguc

SEQ ID NO: 1527400 - RNA, 20 nt, Homo sapiens
cuuccugcugggacugagaa

SEQ ID NO: 1527401 - RNA, 14 nt, Homo sapiens
cuugaggccugugc

SEQ ID NO: 1527402 - RNA, 14 nt, Homo sapiens
cuugcuuagccugu

SEQ ID NO: 1527403 - RNA, 18 nt, Homo sapiens
gaaaaugaacaggacaug

SEQ ID NO: 1527404 - RNA, 17 nt, Homo sapiens
gaauuucugcugugguc

SEQ ID NO: 1527405 - RNA, 17 nt, Homo sapiens
gaccacccggcauucuc

SEQ ID NO: 1527406 - RNA, 23 nt, Homo sapiens
gaccuuggcugcucacuguccac

SEQ ID NO: 1527407 - RNA, 20 nt, Homo sapiens
gacuccauagcuccuuccca

SEQ ID NO: 1527408 - RNA, 15 nt, Homo sapiens
gaggucucucuggaa

SEQ ID NO: 1527409 - RNA, 15 nt, Homo sapiens
gauucugugccucca

SEQ ID NO: 1527410 - RNA, 13 nt, Homo sapiens
gcaauccaaguga

SEQ ID NO: 1527411 - RNA, 21 nt, Homo sapiens
gcagaacuaagcucaguaugu

SEQ ID NO: 1527412 - RNA, 23 nt, Homo sapiens
gcagaacuaagcucaguauguga

SEQ ID NO: 1527413 - RNA, 14 nt, Homo sapiens
gcagaguucuccug

SEQ ID NO: 1527414 - RNA, 15 nt, Homo sapiens
gcagcgcgcuccuga

SEQ ID NO: 1527415 - RNA, 16 nt, Homo sapiens
gcagcuuggcauucuu

SEQ ID NO: 1527416 - RNA, 13 nt, Homo sapiens
gccacacccaggu

SEQ ID NO: 1527417 - RNA, 13 nt, Homo sapiens
gcccuccaugugu

SEQ ID NO: 1527418 - RNA, 15 nt, Homo sapiens
gccuucuuccaggau

SEQ ID NO: 1527419 - RNA, 12 nt, Homo sapiens
gcuaaacaugug

SEQ ID NO: 1527420 - RNA, 16 nt, Homo sapiens
acccgauuuauuucuc

SEQ ID NO: 1527421 - RNA, 19 nt, Homo sapiens
acugcagcgcgcuccugac

SEQ ID NO: 1527422 - RNA, 16 nt, Homo sapiens
acugucagaucuggau

SEQ ID NO: 1527423 - RNA, 17 nt, Homo sapiens
acuuuugggaaagggcu

SEQ ID NO: 1527424 - RNA, 16 nt, Homo sapiens
agacccaaggcucacu

SEQ ID NO: 1527425 - RNA, 14 nt, Homo sapiens
agauggccaugccc

SEQ ID NO: 1527426 - RNA, 19 nt, Homo sapiens
agcaaauaaaugccuucca

SEQ ID NO: 1527427 - RNA, 16 nt, Homo sapiens
agcacauagcuugccu

SEQ ID NO: 1527428 - RNA, 15 nt, Homo sapiens
agcacuuuaaccaau

SEQ ID NO: 1527429 - RNA, 15 nt, Homo sapiens
agcagcccagcacau

SEQ ID NO: 1527430 - RNA, 15 nt, Homo sapiens
agccauuuagggcag

SEQ ID NO: 1527431 - RNA, 19 nt, Homo sapiens
agccucuaacuccugggcu

SEQ ID NO: 1527432 - RNA, 14 nt, Homo sapiens
agccugucccugaa

SEQ ID NO: 1527433 - RNA, 11 nt, Homo sapiens
agccugugcug

SEQ ID NO: 1527434 - RNA, 17 nt, Homo sapiens
aggccagccugucccug

SEQ ID NO: 1527435 - RNA, 12 nt, Homo sapiens
aggccugugcuc

SEQ ID NO: 1527436 - RNA, 15 nt, Homo sapiens
aggcuggggaggcca

SEQ ID NO: 1527437 - RNA, 14 nt, Homo sapiens
aggggcugcugccu

SEQ ID NO: 1527438 - RNA, 15 nt, Homo sapiens
aguuacuaauauauc

SEQ ID NO: 1527439 - RNA, 18 nt, Homo sapiens
aguuguguuaagcuugcg

SEQ ID NO: 1527440 - RNA, 15 nt, Homo sapiens
auaaaugccuuccac

SEQ ID NO: 1527441 - RNA, 19 nt, Homo sapiens
auaacuauauaaaugacau

SEQ ID NO: 1527442 - RNA, 17 nt, Homo sapiens
auaagcuguaauaucau

SEQ ID NO: 1527443 - RNA, 23 nt, Homo sapiens
auauaaauuaucugaauauuaga

SEQ ID NO: 1527444 - RNA, 16 nt, Homo sapiens
aucagggguuagggug

SEQ ID NO: 1527445 - RNA, 13 nt, Homo sapiens
aucauuuuauaga

SEQ ID NO: 1527446 - RNA, 22 nt, Homo sapiens
aucuaauuaaauggcaucagca

SEQ ID NO: 1527447 - RNA, 16 nt, Homo sapiens
aucuguaacacuauua

SEQ ID NO: 1527448 - RNA, 13 nt, Homo sapiens
augacauuauuaa

SEQ ID NO: 1527449 - RNA, 20 nt, Homo sapiens
augacucauaggucccugac

SEQ ID NO: 1527450 - RNA, 17 nt, Homo sapiens
augcccuccauguguaa

SEQ ID NO: 1527451 - RNA, 17 nt, Homo sapiens
auggggcuccuggaaag

SEQ ID NO: 1527452 - RNA, 17 nt, Homo sapiens
auucugugccuccagga

SEQ ID NO: 1527453 - RNA, 21 nt, Homo sapiens
auucugugccuccaggaccag

SEQ ID NO: 1527454 - RNA, 13 nt, Homo sapiens
auugcaggucucu

SEQ ID NO: 1527455 - RNA, 15 nt, Homo sapiens
auugcgcccauuuag

SEQ ID NO: 1527456 - RNA, 18 nt, Homo sapiens
caaauuucuaaaacucca

SEQ ID NO: 1527457 - RNA, 22 nt, Homo sapiens
caagaagccauuuagggcagca

SEQ ID NO: 1527458 - RNA, 17 nt, Homo sapiens
cacccaggugauuuccu

SEQ ID NO: 1527459 - RNA, 23 nt, Homo sapiens
caccucaaccuucggaguagcug

SEQ ID NO: 1527460 - RNA, 14 nt, Homo sapiens
cacuguaguucucu

SEQ ID NO: 1527461 - RNA, 16 nt, Homo sapiens
cacuguccacauguga

SEQ ID NO: 1527462 - RNA, 16 nt, Homo sapiens
cagaggcacucaggua

SEQ ID NO: 1527463 - RNA, 15 nt, Homo sapiens
cagcacauagcuugc

SEQ ID NO: 1527464 - RNA, 20 nt, Homo sapiens
cagccuggucucaaacuccc

SEQ ID NO: 1527465 - RNA, 18 nt, Homo sapiens
cagcuauuuuuaugacua

SEQ ID NO: 1527466 - RNA, 22 nt, Homo sapiens
caggaaaugggcuuuucaggaa

SEQ ID NO: 1527467 - RNA, 14 nt, Homo sapiens
cauccgcaauguug

SEQ ID NO: 1527468 - RNA, 21 nt, Homo sapiens
caugaagggagggucccugug

SEQ ID NO: 1527469 - RNA, 14 nt, Homo sapiens
caugaggucuuccc

SEQ ID NO: 1527470 - RNA, 18 nt, Homo sapiens
caugcccacggaugcuca

SEQ ID NO: 1527471 - RNA, 16 nt, Homo sapiens
caugcuggcagaggca

SEQ ID NO: 1527472 - RNA, 17 nt, Homo sapiens
ccagcacauagcuugcc

SEQ ID NO: 1527473 - RNA, 21 nt, Homo sapiens
ccagccuggucucaaacuccc

SEQ ID NO: 1527474 - RNA, 19 nt, Homo sapiens
ccaguuauaaagaggucac

SEQ ID NO: 1527475 - RNA, 22 nt, Homo sapiens
ccauguguaagaacaaugccag

SEQ ID NO: 1527476 - RNA, 15 nt, Homo sapiens
cccaguguguguuca

SEQ ID NO: 1527477 - RNA, 22 nt, Homo sapiens
cccugucuguuugccacaccca

SEQ ID NO: 1527478 - RNA, 21 nt, Homo sapiens
cccugugugugugugugcuga

SEQ ID NO: 1527479 - RNA, 23 nt, Homo sapiens
ccgcaauguugguuucacugaga

SEQ ID NO: 1527480 - RNA, 22 nt, Homo sapiens
ccucagcuccccggcacugcag

SEQ ID NO: 1527481 - RNA, 15 nt, Homo sapiens
ccucccaaaguacug

SEQ ID NO: 1527482 - RNA, 23 nt, Homo sapiens
ccugccagucccagaucacacau

SEQ ID NO: 1527483 - RNA, 16 nt, Homo sapiens
ccugcugggacugaga

SEQ ID NO: 1527484 - RNA, 17 nt, Homo sapiens
ccugcugggacugagaa

SEQ ID NO: 1527485 - RNA, 23 nt, Homo sapiens
ccugcugggacugagaaggcuca

SEQ ID NO: 1527486 - RNA, 17 nt, Homo sapiens
ccuggcuccuugcagca

SEQ ID NO: 1527487 - RNA, 19 nt, Homo sapiens
cgacuccccccccagagac

SEQ ID NO: 1527488 - RNA, 21 nt, Homo sapiens
cgcuggccugcuuuacguauu

SEQ ID NO: 1527489 - RNA, 16 nt, Homo sapiens
cgggaaguucaaggaa

SEQ ID NO: 1527490 - RNA, 15 nt, Homo sapiens
cuaaaacuccaaguu

SEQ ID NO: 1527491 - RNA, 18 nt, Homo sapiens
cuaaaagaaacuaugaug

SEQ ID NO: 1527492 - RNA, 17 nt, Homo sapiens
cuaaagcaguccuccag

SEQ ID NO: 1527493 - RNA, 14 nt, Homo sapiens
cuacugacuauauu

SEQ ID NO: 1527494 - RNA, 22 nt, Homo sapiens
cuagguggcaggacaaauugcg

SEQ ID NO: 1527495 - RNA, 22 nt, Homo sapiens
cuauaaaauaaacuucuuaaca

SEQ ID NO: 1527496 - RNA, 22 nt, Homo sapiens
cuauauuuucccuuauuacugc

SEQ ID NO: 1527497 - RNA, 13 nt, Homo sapiens
cuauuuauauuca

SEQ ID NO: 1527498 - RNA, 16 nt, Homo sapiens
cucacaguguuuuaga

SEQ ID NO: 1527499 - RNA, 19 nt, Homo sapiens
cuccugggcucaagcaauc

SEQ ID NO: 1527500 - RNA, 15 nt, Homo sapiens
cugacauuuaguuga

SEQ ID NO: 1527501 - RNA, 17 nt, Homo sapiens
cugcagcuuggcauucu

SEQ ID NO: 1527502 - RNA, 17 nt, Homo sapiens
cugccagucccagauca

SEQ ID NO: 1527503 - RNA, 12 nt, Homo sapiens
cugcucacuguc

SEQ ID NO: 1527504 - RNA, 12 nt, Homo sapiens
cuggaccagcug

SEQ ID NO: 1527505 - RNA, 17 nt, Homo sapiens
cuggggucccucugaag

SEQ ID NO: 1527506 - RNA, 17 nt, Homo sapiens
cuguauaagcuguaaua

SEQ ID NO: 1527507 - RNA, 23 nt, Homo sapiens
cuguuaaauuuguaaacaaucua

SEQ ID NO: 1527508 - RNA, 14 nt, Homo sapiens
cuuagccugugcug

SEQ ID NO: 1527509 - RNA, 14 nt, Homo sapiens
cuucaccacuguag

SEQ ID NO: 1527510 - RNA, 13 nt, Homo sapiens
cuuucccagugug

SEQ ID NO: 1527511 - RNA, 18 nt, Homo sapiens
gaaauugaauguaccuua

SEQ ID NO: 1527512 - RNA, 22 nt, Homo sapiens
gaacauguggugggacuuucau

SEQ ID NO: 1527513 - RNA, 18 nt, Homo sapiens
gaagauggccaugcccuc

SEQ ID NO: 1527514 - RNA, 13 nt, Homo sapiens
gaccacccggcau

SEQ ID NO: 1527515 - RNA, 15 nt, Homo sapiens
gaccgccugcccugc

SEQ ID NO: 1527516 - RNA, 16 nt, Homo sapiens
gagacacggucccacc

SEQ ID NO: 1527517 - RNA, 14 nt, Homo sapiens
gagauaguugcuaa

SEQ ID NO: 1527518 - RNA, 16 nt, Homo sapiens
gaggauucugugccuc

SEQ ID NO: 1527519 - RNA, 17 nt, Homo sapiens
gauggccaugcccucca

SEQ ID NO: 1527520 - RNA, 14 nt, Homo sapiens
gauguuuccugggu

SEQ ID NO: 1527521 - RNA, 22 nt, Homo sapiens
gcaauguugguuucacugagag

SEQ ID NO: 1527522 - RNA, 15 nt, Homo sapiens
gcccacggaugcuca

SEQ ID NO: 1527523 - RNA, 21 nt, Homo sapiens
gccuaauggcuuucacuuucu

SEQ ID NO: 1527524 - RNA, 14 nt, Homo sapiens
gcuaggaacaugug

SEQ ID NO: 1527525 - RNA, 22 nt, Homo sapiens
gcucacuguccacaugugaacu

SEQ ID NO: 1527526 - RNA, 22 nt, Homo sapiens
gcugccuuguuucaccuuccau

SEQ ID NO: 1527527 - RNA, 21 nt, Homo sapiens
gcugcugccuuguuucaccuu

SEQ ID NO: 1527528 - RNA, 21 nt, Homo sapiens
ggaaagggcuaaacaugugag

SEQ ID NO: 1527529 - RNA, 15 nt, Homo sapiens
ggaccccucagcucc

SEQ ID NO: 1527530 - RNA, 15 nt, Homo sapiens
ggacuccauagcucc

SEQ ID NO: 1527531 - RNA, 17 nt, Homo sapiens
ggacuguccccaugccc

SEQ ID NO: 1527532 - RNA, 14 nt, Homo sapiens
ggcauccgcaaugu

SEQ ID NO: 1527533 - RNA, 15 nt, Homo sapiens
ggcauucuucuuauu

SEQ ID NO: 1527534 - RNA, 19 nt, Homo sapiens
ggccaguuucucugccuuc

SEQ ID NO: 1527535 - RNA, 22 nt, Homo sapiens
ggccucccaaaguacugggauu

SEQ ID NO: 1527536 - RNA, 17 nt, Homo sapiens
ggccugcugaggccuuc

SEQ ID NO: 1527537 - RNA, 13 nt, Homo sapiens
ggcuaaacaugug

SEQ ID NO: 1527538 - RNA, 23 nt, Homo sapiens
aaacuagacuccauugugccuua

SEQ ID NO: 1527539 - RNA, 18 nt, Homo sapiens
aaaggacuaacaucuccu

SEQ ID NO: 1527540 - RNA, 14 nt, Homo sapiens
aacaaguguaucuc

SEQ ID NO: 1527541 - RNA, 17 nt, Homo sapiens
aacuuaaauagcuuuga

SEQ ID NO: 1527542 - RNA, 12 nt, Homo sapiens
aagaacaaugcc

SEQ ID NO: 1527543 - RNA, 20 nt, Homo sapiens
aagaacaaugccagggccca

SEQ ID NO: 1527544 - RNA, 15 nt, Homo sapiens
aagauggccaugccc

SEQ ID NO: 1527545 - RNA, 20 nt, Homo sapiens
aagcaaauaaaugccuucca

SEQ ID NO: 1527546 - RNA, 17 nt, Homo sapiens
aagcagaacuaagcuca

SEQ ID NO: 1527547 - RNA, 19 nt, Homo sapiens
aaguugcuaggaacaugug

SEQ ID NO: 1527548 - RNA, 17 nt, Homo sapiens
aauauaaauuaucugaa

SEQ ID NO: 1527549 - RNA, 22 nt, Homo sapiens
aauccaacugucagaucuggau

SEQ ID NO: 1527550 - RNA, 22 nt, Homo sapiens
aauccaagugauccucccaccu

SEQ ID NO: 1527551 - RNA, 19 nt, Homo sapiens
aauguuggaaaacauauga

SEQ ID NO: 1527552 - RNA, 18 nt, Homo sapiens
aauucuccuaaaggugag

SEQ ID NO: 1527553 - RNA, 20 nt, Homo sapiens
acaaucuaauuaaauggcau

SEQ ID NO: 1527554 - RNA, 13 nt, Homo sapiens
acacccaggugau

SEQ ID NO: 1527555 - RNA, 22 nt, Homo sapiens
acaggacauggggcuccuggaa

SEQ ID NO: 1527556 - RNA, 23 nt, Homo sapiens
acaggacauggggcuccuggaaa

SEQ ID NO: 1527557 - RNA, 20 nt, Homo sapiens
accagcuggccugggguccc

SEQ ID NO: 1527558 - RNA, 21 nt, Homo sapiens
accugccagucccagaucaca

SEQ ID NO: 1527559 - RNA, 14 nt, Homo sapiens
acuaugauguggag

SEQ ID NO: 1527560 - RNA, 17 nt, Homo sapiens
acucauaggucccugac

SEQ ID NO: 1527561 - RNA, 13 nt, Homo sapiens
acugagaaggcuc

SEQ ID NO: 1527562 - RNA, 13 nt, Homo sapiens
acugagagcugcc

SEQ ID NO: 1527563 - RNA, 12 nt, Homo sapiens
acuuuaaccaau

SEQ ID NO: 1527564 - RNA, 15 nt, Homo sapiens
agaaaaugcauuauu

SEQ ID NO: 1527565 - RNA, 18 nt, Homo sapiens
agacccaaggcucacugc

SEQ ID NO: 1527566 - RNA, 14 nt, Homo sapiens
agagaccuuggcug

SEQ ID NO: 1527567 - RNA, 16 nt, Homo sapiens
agaggucucucuggaa

SEQ ID NO: 1527568 - RNA, 19 nt, Homo sapiens
agauaguugcuaaguugcu

SEQ ID NO: 1527569 - RNA, 17 nt, Homo sapiens
agcacauagcuugccua

SEQ ID NO: 1527570 - RNA, 21 nt, Homo sapiens
agccccggccacccagggauc

SEQ ID NO: 1527571 - RNA, 20 nt, Homo sapiens
agcccugucuguuugccaca

SEQ ID NO: 1527572 - RNA, 21 nt, Homo sapiens
agcccugucuguuugccacac

SEQ ID NO: 1527573 - RNA, 16 nt, Homo sapiens
aggaagugaauugaug

SEQ ID NO: 1527574 - RNA, 20 nt, Homo sapiens
aggaccgccugcccugccug

SEQ ID NO: 1527575 - RNA, 16 nt, Homo sapiens
aggccagccugucccu

SEQ ID NO: 1527576 - RNA, 17 nt, Homo sapiens
aggcucacgaagggcau

SEQ ID NO: 1527577 - RNA, 19 nt, Homo sapiens
aggcuggggaggccagugu

SEQ ID NO: 1527578 - RNA, 16 nt, Homo sapiens
agggcuaaacauguga

SEQ ID NO: 1527579 - RNA, 13 nt, Homo sapiens
aggucccugacau

SEQ ID NO: 1527580 - RNA, 23 nt, Homo sapiens
auaagauuuguacauauuaucau

SEQ ID NO: 1527581 - RNA, 16 nt, Homo sapiens
auagaaaaugcauuau

SEQ ID NO: 1527582 - RNA, 22 nt, Homo sapiens
auagcuugccuaauggcuuuca

SEQ ID NO: 1527583 - RNA, 15 nt, Homo sapiens
auagguacugccaua

SEQ ID NO: 1527584 - RNA, 22 nt, Homo sapiens
aucagggguuagggugcaagaa

SEQ ID NO: 1527585 - RNA, 15 nt, Homo sapiens
auccucccaccucaa

SEQ ID NO: 1527586 - RNA, 14 nt, Homo sapiens
aucgaagucuuccc

SEQ ID NO: 1527587 - RNA, 17 nt, Homo sapiens
aucuaauuaaauggcau

SEQ ID NO: 1527588 - RNA, 16 nt, Homo sapiens
augacuuaauuuuaga

SEQ ID NO: 1527589 - RNA, 22 nt, Homo sapiens
augccagggcccaggaggaccg

SEQ ID NO: 1527590 - RNA, 14 nt, Homo sapiens
augcccuccaugug

SEQ ID NO: 1527591 - RNA, 14 nt, Homo sapiens
auggcuuucacuuu

SEQ ID NO: 1527592 - RNA, 15 nt, Homo sapiens
augucaggccagccu

SEQ ID NO: 1527593 - RNA, 20 nt, Homo sapiens
aaaaauguucuauauucuca

SEQ ID NO: 1527594 - RNA, 14 nt, Homo sapiens
aaaagaaacuauga

SEQ ID NO: 1527595 - RNA, 22 nt, Homo sapiens
aaaugauugacaguaaguuuau

SEQ ID NO: 1527596 - RNA, 20 nt, Homo sapiens
aacaggacauggggcuccug

SEQ ID NO: 1527597 - RNA, 15 nt, Homo sapiens
aaccugccaguccca

SEQ ID NO: 1527598 - RNA, 20 nt, Homo sapiens
aacuauauaaaugacauuau

SEQ ID NO: 1527599 - RNA, 20 nt, Homo sapiens
aacuccccagcuaaagcagu

SEQ ID NO: 1527600 - RNA, 20 nt, Homo sapiens
aacuccugggcucaagcaau

SEQ ID NO: 1527601 - RNA, 23 nt, Homo sapiens
aagagaagauggccaugcccucc

SEQ ID NO: 1527602 - RNA, 19 nt, Homo sapiens
aagauggccaugcccucca

SEQ ID NO: 1527603 - RNA, 15 nt, Homo sapiens
aagcaaauaaaugcc

SEQ ID NO: 1527604 - RNA, 19 nt, Homo sapiens
aagcaaauaaaugccuucc

SEQ ID NO: 1527605 - RNA, 16 nt, Homo sapiens
aagggcuaaacaugug

SEQ ID NO: 1527606 - RNA, 20 nt, Homo sapiens
aagugauccucccaccucaa

SEQ ID NO: 1527607 - RNA, 17 nt, Homo sapiens
aauuaaauggcaucagc

SEQ ID NO: 1527608 - RNA, 12 nt, Homo sapiens
acagaguaucuu

SEQ ID NO: 1527609 - RNA, 19 nt, Homo sapiens
accaggggcccacccucug

SEQ ID NO: 1527610 - RNA, 15 nt, Homo sapiens
acccaggugauuucc

SEQ ID NO: 1527611 - RNA, 15 nt, Homo sapiens
acuccccccccagag

SEQ ID NO: 1527612 - RNA, 13 nt, Homo sapiens
acuguaguucucu

SEQ ID NO: 1527613 - RNA, 19 nt, Homo sapiens
acuugaggcuuucagugau

SEQ ID NO: 1527614 - RNA, 19 nt, Homo sapiens
agagacacggucccaccau

SEQ ID NO: 1527615 - RNA, 18 nt, Homo sapiens
agaggucucucuggaaaa

SEQ ID NO: 1527616 - RNA, 22 nt, Homo sapiens
agauauaagauuuguacauauu

SEQ ID NO: 1527617 - RNA, 19 nt, Homo sapiens
agaucucuuuguagccauc

SEQ ID NO: 1527618 - RNA, 16 nt, Homo sapiens
agauuuguacauauua

SEQ ID NO: 1527619 - RNA, 11 nt, Homo sapiens
agccauuuagg

SEQ ID NO: 1527620 - RNA, 14 nt, Homo sapiens
agccucggccuccc

SEQ ID NO: 1527621 - RNA, 13 nt, Homo sapiens
agcucaguaugug

SEQ ID NO: 1527622 - RNA, 15 nt, Homo sapiens
agcuccuucccagga

SEQ ID NO: 1527623 - RNA, 18 nt, Homo sapiens
agcugccuccuggucucu

SEQ ID NO: 1527624 - RNA, 21 nt, Homo sapiens
agcuuccuccccccgacuccc

SEQ ID NO: 1527625 - RNA, 16 nt, Homo sapiens
agcuugccuaauggcu

SEQ ID NO: 1527626 - RNA, 13 nt, Homo sapiens
aggcacucaggua

SEQ ID NO: 1527627 - RNA, 18 nt, Homo sapiens
uaaaagaaacuaugaugu

SEQ ID NO: 1527628 - RNA, 18 nt, Homo sapiens
uaaaauaaacuucuuaac

SEQ ID NO: 1527629 - RNA, 12 nt, Homo sapiens
uaaacuucuuaa

SEQ ID NO: 1527630 - RNA, 20 nt, Homo sapiens
uaaagaaacgguaugacuua

SEQ ID NO: 1527631 - RNA, 14 nt, Homo sapiens
uaaauuaucugaau

SEQ ID NO: 1527632 - RNA, 17 nt, Homo sapiens
uaaauuuguaaacaauc

SEQ ID NO: 1527633 - RNA, 13 nt, Homo sapiens
uaaccugcuggau

SEQ ID NO: 1527634 - RNA, 19 nt, Homo sapiens
uaauguaaagguuuucuca

SEQ ID NO: 1527635 - RNA, 18 nt, Homo sapiens
uaauuuguggcacuauga

SEQ ID NO: 1527636 - RNA, 23 nt, Homo sapiens
uaauuuugccacaggguacuaaa

SEQ ID NO: 1527637 - RNA, 18 nt, Homo sapiens
uacaguauugcuauuuau

SEQ ID NO: 1527638 - RNA, 20 nt, Homo sapiens
uaccagugacuaauuuugcc

SEQ ID NO: 1527639 - RNA, 15 nt, Homo sapiens
uacgggccaguuucu

SEQ ID NO: 1527640 - RNA, 21 nt, Homo sapiens
uagccugugcuggaccagcug

SEQ ID NO: 1527641 - RNA, 12 nt, Homo sapiens
uaggaacaugug

SEQ ID NO: 1527642 - RNA, 11 nt, Homo sapiens
uaguugcuaag

SEQ ID NO: 1527643 - RNA, 16 nt, Homo sapiens
uauuagaugcucugag

SEQ ID NO: 1527644 - RNA, 18 nt, Homo sapiens
ucaaacucgcagcaguaa

SEQ ID NO: 1527645 - RNA, 17 nt, Homo sapiens
ucaagcaauccaaguga

SEQ ID NO: 1527646 - RNA, 19 nt, Homo sapiens
ucaagcaauccaagugauc

SEQ ID NO: 1527647 - RNA, 14 nt, Homo sapiens
ucaggccagccugu

SEQ ID NO: 1527648 - RNA, 21 nt, Homo sapiens
ucaggccagccugucccugaa

SEQ ID NO: 1527649 - RNA, 18 nt, Homo sapiens
ucagugauaucuuucuca

SEQ ID NO: 1527650 - RNA, 15 nt, Homo sapiens
ucauaggucccugac

SEQ ID NO: 1527651 - RNA, 19 nt, Homo sapiens
ucaucaucgaagucuuccc

SEQ ID NO: 1527652 - RNA, 20 nt, Homo sapiens
uccaacugucagaucuggau

SEQ ID NO: 1527653 - RNA, 17 nt, Homo sapiens
ucccaugaggucuuccc

SEQ ID NO: 1527654 - RNA, 23 nt, Homo sapiens
ucccuuauuacugcuugcaguaa

SEQ ID NO: 1527655 - RNA, 18 nt, Homo sapiens
ucccuugcuuagccugug

SEQ ID NO: 1527656 - RNA, 20 nt, Homo sapiens
ugaauugaugaggacugucc

SEQ ID NO: 1527657 - RNA, 21 nt, Homo sapiens
ugacucauaggucccugacau

SEQ ID NO: 1527658 - RNA, 17 nt, Homo sapiens
ugccagucccagaucac

SEQ ID NO: 1527659 - RNA, 22 nt, Homo sapiens
ugcgucccaugaggucuucccg

SEQ ID NO: 1527660 - RNA, 16 nt, Homo sapiens
ugcuaggaacaugugg

SEQ ID NO: 1527661 - RNA, 13 nt, Homo sapiens
ugcucacaguguu

SEQ ID NO: 1527662 - RNA, 14 nt, Homo sapiens
ugcuggaccagcug

SEQ ID NO: 1527663 - RNA, 18 nt, Homo sapiens
uggccaugcccuccaugu

SEQ ID NO: 1527664 - RNA, 14 nt, Homo sapiens
uggccugggguccc

SEQ ID NO: 1527665 - RNA, 15 nt, Homo sapiens
uggccuggggucccu

SEQ ID NO: 1527666 - RNA, 12 nt, Homo sapiens
ugggacugagaa

SEQ ID NO: 1527667 - RNA, 11 nt, Homo sapiens
ugggggucccu

SEQ ID NO: 1527668 - RNA, 15 nt, Homo sapiens
ugguuucacugagag

SEQ ID NO: 1527669 - RNA, 13 nt, Homo sapiens
uguaauaucauuu

SEQ ID NO: 1527670 - RNA, 12 nt, Homo sapiens
uguagccauccu

SEQ ID NO: 1527671 - RNA, 17 nt, Homo sapiens
ugugcucuggggguccc

SEQ ID NO: 1527672 - RNA, 23 nt, Homo sapiens
uuagaaagaaaauuauauucugu

SEQ ID NO: 1527673 - RNA, 16 nt, Homo sapiens
uuaggggaacccuguc

SEQ ID NO: 1527674 - RNA, 20 nt, Homo sapiens
uuaugguuuuauaacuauau

SEQ ID NO: 1527675 - RNA, 22 nt, Homo sapiens
uucagugauaucuuucucauua

SEQ ID NO: 1527676 - RNA, 20 nt, Homo sapiens
uucuagaggucucucuggaa

SEQ ID NO: 1527677 - RNA, 21 nt, Homo sapiens
uucugacacuuucugcuggaa

SEQ ID NO: 1527678 - RNA, 12 nt, Homo sapiens
aaaccaucagcu

SEQ ID NO: 1527679 - RNA, 13 nt, Homo sapiens
aaacuccccagcu

SEQ ID NO: 1527680 - RNA, 17 nt, Homo sapiens
aaagggcuaaacaugug

SEQ ID NO: 1527681 - RNA, 16 nt, Homo sapiens
aaauaaaugccuucca

SEQ ID NO: 1527682 - RNA, 20 nt, Homo sapiens
aaauuuguaaacaaucuaau

SEQ ID NO: 1527683 - RNA, 22 nt, Homo sapiens
aacaaucuaauuaaauggcauc

SEQ ID NO: 1527684 - RNA, 15 nt, Homo sapiens
aacgguaugacuuaa

SEQ ID NO: 1527685 - RNA, 22 nt, Homo sapiens
aagaaaauuauauucuguuuau

SEQ ID NO: 1527686 - RNA, 18 nt, Homo sapiens
aagcucggagccagggcu

SEQ ID NO: 1527687 - RNA, 16 nt, Homo sapiens
aauaaccugccagucc

SEQ ID NO: 1527688 - RNA, 21 nt, Homo sapiens
aauauaucuguaacacuauua

SEQ ID NO: 1527689 - RNA, 21 nt, Homo sapiens
aaugacucauaggucccugac

SEQ ID NO: 1527690 - RNA, 22 nt, Homo sapiens
aaugggcuuuucaggaagugaa

SEQ ID NO: 1527691 - RNA, 13 nt, Homo sapiens
acauaugaaauau

SEQ ID NO: 1527692 - RNA, 23 nt, Homo sapiens
caugcacuuuauguggagacuac

SEQ ID NO: 1527693 - RNA, 16 nt, Homo sapiens
caugcuacacacugca

SEQ ID NO: 1527694 - RNA, 16 nt, Homo sapiens
cauggagacucugaga

SEQ ID NO: 1527695 - RNA, 17 nt, Homo sapiens
caugggucuucuuuuac

SEQ ID NO: 1527696 - RNA, 19 nt, Homo sapiens
cauuaucuagauacuguau

SEQ ID NO: 1527697 - RNA, 13 nt, Homo sapiens
cauucuagguagg

SEQ ID NO: 1527698 - RNA, 17 nt, Homo sapiens
cauucuccuuguguuac

SEQ ID NO: 1527699 - RNA, 23 nt, Homo sapiens
cauucuuauuaauucuucaccug

SEQ ID NO: 1527700 - RNA, 22 nt, Homo sapiens
cauuuagaaaauagagcuuuua

SEQ ID NO: 1527701 - RNA, 15 nt, Homo sapiens
cauuugcaccuaccu

SEQ ID NO: 1527702 - RNA, 16 nt, Homo sapiens
cauuugcaccuaccuc

SEQ ID NO: 1527703 - RNA, 14 nt, Homo sapiens
cauuuuacacaaag

SEQ ID NO: 1527704 - RNA, 14 nt, Homo sapiens
cauuuucaccccac

SEQ ID NO: 1527705 - RNA, 15 nt, Homo sapiens
cauuuuuuaaaugca

SEQ ID NO: 1527706 - RNA, 18 nt, Homo sapiens
ccaaaauauuuuuugcaa

SEQ ID NO: 1527707 - RNA, 13 nt, Homo sapiens
ccaaaauuugaug

SEQ ID NO: 1527708 - RNA, 23 nt, Homo sapiens
ccaaauuagggcaauuggaacaa

SEQ ID NO: 1527709 - RNA, 14 nt, Homo sapiens
ccaacccagcaguu

SEQ ID NO: 1527710 - RNA, 14 nt, Homo sapiens
ccaagccacauuca

SEQ ID NO: 1527711 - RNA, 14 nt, Homo sapiens
ccaagccacuagcc

SEQ ID NO: 1527712 - RNA, 15 nt, Homo sapiens
ccaaugguccugacu

SEQ ID NO: 1527713 - RNA, 19 nt, Homo sapiens
ccaauucaauuacuauuga

SEQ ID NO: 1527714 - RNA, 18 nt, Homo sapiens
ccacacauuaguacuuau

SEQ ID NO: 1527715 - RNA, 19 nt, Homo sapiens
ccacacauuaguacuuaug

SEQ ID NO: 1527716 - RNA, 13 nt, Homo sapiens
ccaccugucucag

SEQ ID NO: 1527717 - RNA, 15 nt, Homo sapiens
ccagauggacuccag

SEQ ID NO: 1527718 - RNA, 15 nt, Homo sapiens
ccagcaguucucugc

SEQ ID NO: 1527719 - RNA, 18 nt, Homo sapiens
ccagcaguucucugccaa

SEQ ID NO: 1527720 - RNA, 19 nt, Homo sapiens
ccagccagauggacuccag

SEQ ID NO: 1527721 - RNA, 16 nt, Homo sapiens
ccagcugugcacuuuc

SEQ ID NO: 1527722 - RNA, 20 nt, Homo sapiens
ccaggaaagguuuuccuuau

SEQ ID NO: 1527723 - RNA, 16 nt, Homo sapiens
ccaggcuggucucaaa

SEQ ID NO: 1527724 - RNA, 16 nt, Homo sapiens
ccaggugagaagugag

SEQ ID NO: 1527725 - RNA, 16 nt, Homo sapiens
ccaguguuguggauuu

SEQ ID NO: 1527726 - RNA, 19 nt, Homo sapiens
ccauaucccuuccucucag

SEQ ID NO: 1527727 - RNA, 16 nt, Homo sapiens
ccauaucugugaaaug

SEQ ID NO: 1527728 - RNA, 12 nt, Homo sapiens
ccaucagacugu

SEQ ID NO: 1527729 - RNA, 15 nt, Homo sapiens
ccaucagacugucaa

SEQ ID NO: 1527730 - RNA, 21 nt, Homo sapiens
ccaucucugugauuaccucuc

SEQ ID NO: 1527731 - RNA, 12 nt, Homo sapiens
ccaucuuuacaa

SEQ ID NO: 1527732 - RNA, 22 nt, Homo sapiens
cccagagucacaaguagccucu

SEQ ID NO: 1527733 - RNA, 22 nt, Homo sapiens
cccagagugcugggauuacaau

SEQ ID NO: 1527734 - RNA, 21 nt, Homo sapiens
cccaggaaagguuuuccuuau

SEQ ID NO: 1527735 - RNA, 11 nt, Homo sapiens
cccagucccau

SEQ ID NO: 1527736 - RNA, 15 nt, Homo sapiens
cccauaucugugaaa

SEQ ID NO: 1527737 - RNA, 16 nt, Homo sapiens
cccaucuuuacaaaga

SEQ ID NO: 1527738 - RNA, 20 nt, Homo sapiens
ccccagagaaaacccggagc

SEQ ID NO: 1527739 - RNA, 19 nt, Homo sapiens
cccccaucuuuacaaagaa

SEQ ID NO: 1527740 - RNA, 23 nt, Homo sapiens
cccccuuccuguccccaggggag

SEQ ID NO: 1527741 - RNA, 18 nt, Homo sapiens
cccuaagcgcacauucau

SEQ ID NO: 1527742 - RNA, 21 nt, Homo sapiens
cccucaggcuccccagugcuc

SEQ ID NO: 1527743 - RNA, 15 nt, Homo sapiens
cccuccccugccauu

SEQ ID NO: 1527744 - RNA, 13 nt, Homo sapiens
cccuggaaaugga

SEQ ID NO: 1527745 - RNA, 15 nt, Homo sapiens
ccuacagggccacaa

SEQ ID NO: 1527746 - RNA, 13 nt, Homo sapiens
ccuacauuaucuc

SEQ ID NO: 1527747 - RNA, 14 nt, Homo sapiens
ccuacauuaucuca

SEQ ID NO: 1527748 - RNA, 14 nt, Homo sapiens
ccuagaaagacaga

SEQ ID NO: 1527749 - RNA, 13 nt, Homo sapiens
cuccuuguguuac

SEQ ID NO: 1527750 - RNA, 21 nt, Homo sapiens
cucgggaaacuuagaucauca

SEQ ID NO: 1527751 - RNA, 18 nt, Homo sapiens
cucuacuguuuaacaaca

SEQ ID NO: 1527752 - RNA, 12 nt, Homo sapiens
cucuuggcaguc

SEQ ID NO: 1527753 - RNA, 14 nt, Homo sapiens
cucuuggcagucac

SEQ ID NO: 1527754 - RNA, 15 nt, Homo sapiens
cucuuucccaacccc

SEQ ID NO: 1527755 - RNA, 13 nt, Homo sapiens
cugaagccguguu

SEQ ID NO: 1527756 - RNA, 23 nt, Homo sapiens
cugagaaauaaaaagccugucau

SEQ ID NO: 1527757 - RNA, 22 nt, Homo sapiens
cugaggcaggaagauagcuuga

SEQ ID NO: 1527758 - RNA, 13 nt, Homo sapiens
cugaguguggacu

SEQ ID NO: 1527759 - RNA, 21 nt, Homo sapiens
cugcagguuccuuaucuguca

SEQ ID NO: 1527760 - RNA, 19 nt, Homo sapiens
cugcggggggcaccagagg

SEQ ID NO: 1527761 - RNA, 14 nt, Homo sapiens
cugcuuuaucuuuu

SEQ ID NO: 1527762 - RNA, 20 nt, Homo sapiens
cuggaaacagcaguguauau

SEQ ID NO: 1527763 - RNA, 23 nt, Homo sapiens
cugggucucgcuuuguugcccag

SEQ ID NO: 1527764 - RNA, 13 nt, Homo sapiens
cugguuagguaga

SEQ ID NO: 1527765 - RNA, 19 nt, Homo sapiens
cuguaaucucagcacuuug

SEQ ID NO: 1527766 - RNA, 15 nt, Homo sapiens
cuguagggugccauu

SEQ ID NO: 1527767 - RNA, 12 nt, Homo sapiens
cugucaagaaga

SEQ ID NO: 1527768 - RNA, 15 nt, Homo sapiens
cuguccagccgugug

SEQ ID NO: 1527769 - RNA, 14 nt, Homo sapiens
cugucucagccucc

SEQ ID NO: 1527770 - RNA, 22 nt, Homo sapiens
cugugaaaugcuggcauuugca

SEQ ID NO: 1527771 - RNA, 18 nt, Homo sapiens
cugugcagcgggugcugc

SEQ ID NO: 1527772 - RNA, 14 nt, Homo sapiens
cuguucuuucuggc

SEQ ID NO: 1527773 - RNA, 20 nt, Homo sapiens
cuguuuguuuuuguacauuu

SEQ ID NO: 1527774 - RNA, 15 nt, Homo sapiens
cuuaaaaucugugaa

SEQ ID NO: 1527775 - RNA, 22 nt, Homo sapiens
cuuaacccccuagaaagacaga

SEQ ID NO: 1527776 - RNA, 20 nt, Homo sapiens
cuuaccccacacacagucca

SEQ ID NO: 1527777 - RNA, 20 nt, Homo sapiens
cuuagaaaaggguuucuuga

SEQ ID NO: 1527778 - RNA, 22 nt, Homo sapiens
cuuauguugcacaaugagaaaa

SEQ ID NO: 1527779 - RNA, 21 nt, Homo sapiens
cuuauuuugugugcuuuccca

SEQ ID NO: 1527780 - RNA, 22 nt, Homo sapiens
cuucaaggcccauaucugugaa

SEQ ID NO: 1527781 - RNA, 19 nt, Homo sapiens
cuucuguugcugguguacu

SEQ ID NO: 1527782 - RNA, 22 nt, Homo sapiens
cuucuguugcugguguacucua

SEQ ID NO: 1527783 - RNA, 23 nt, Homo sapiens
cuugcaaaguaucccuacuguaa

SEQ ID NO: 1527784 - RNA, 11 nt, Homo sapiens
cuugcacuguc

SEQ ID NO: 1527785 - RNA, 17 nt, Homo sapiens
cuugcaguuaaggguua

SEQ ID NO: 1527786 - RNA, 22 nt, Homo sapiens
cuuggcuuacugcagccuuugc

SEQ ID NO: 1527787 - RNA, 21 nt, Homo sapiens
cuuguacauaaugcgugcaua

SEQ ID NO: 1527788 - RNA, 13 nt, Homo sapiens
cuugugugugaug

SEQ ID NO: 1527789 - RNA, 23 nt, Homo sapiens
cuuguuccccacugacagccucc

SEQ ID NO: 1527790 - RNA, 18 nt, Homo sapiens
cuuucccaaccccaggaa

SEQ ID NO: 1527791 - RNA, 17 nt, Homo sapiens
cuuugagacugggucuc

SEQ ID NO: 1527792 - RNA, 14 nt, Homo sapiens
cuuuuaucugcaga

SEQ ID NO: 1527793 - RNA, 12 nt, Homo sapiens
cuuuuauuacau

SEQ ID NO: 1527794 - RNA, 20 nt, Homo sapiens
cuuuugcuucaguugcauau

SEQ ID NO: 1527795 - RNA, 19 nt, Homo sapiens
gaaaaacaccgcuucugcc

SEQ ID NO: 1527796 - RNA, 18 nt, Homo sapiens
gaaaaggguuucuugaca

SEQ ID NO: 1527797 - RNA, 14 nt, Homo sapiens
gaaaauaucuugcu

SEQ ID NO: 1527798 - RNA, 16 nt, Homo sapiens
gaaacauuacaguuca

SEQ ID NO: 1527799 - RNA, 17 nt, Homo sapiens
gaaacugcuaaauucua

SEQ ID NO: 1527800 - RNA, 13 nt, Homo sapiens
gaaagaaccagag

SEQ ID NO: 1527801 - RNA, 21 nt, Homo sapiens
gaaauuaguuucaaauuuacc

SEQ ID NO: 1527802 - RNA, 17 nt, Homo sapiens
gaagacaaugacuuacu

SEQ ID NO: 1527803 - RNA, 14 nt, Homo sapiens
gugaaaugcuggca

SEQ ID NO: 1527804 - RNA, 19 nt, Homo sapiens
gugaaaugcuggcauuugc

SEQ ID NO: 1527805 - RNA, 13 nt, Homo sapiens
gugaggcacugug

SEQ ID NO: 1527806 - RNA, 16 nt, Homo sapiens
gugaugagagaaugga

SEQ ID NO: 1527807 - RNA, 12 nt, Homo sapiens
gugcaucuggca

SEQ ID NO: 1527808 - RNA, 21 nt, Homo sapiens
gugccaugcccuuacacgugc

SEQ ID NO: 1527809 - RNA, 18 nt, Homo sapiens
gugccucuuuucaguagu

SEQ ID NO: 1527810 - RNA, 24 nt, Homo sapiens
gugccucuuuucaguagugagcag

SEQ ID NO: 1527811 - RNA, 19 nt, Homo sapiens
gugccugguucgugccaug

SEQ ID NO: 1527812 - RNA, 15 nt, Homo sapiens
gugcuugcuggugcc

SEQ ID NO: 1527813 - RNA, 22 nt, Homo sapiens
gugcuuucccagucccauuccu

SEQ ID NO: 1527814 - RNA, 22 nt, Homo sapiens
gugggcuccugacaauacugua

SEQ ID NO: 1527815 - RNA, 13 nt, Homo sapiens
gugggugggaugg

SEQ ID NO: 1527816 - RNA, 11 nt, Homo sapiens
gugggugguga

SEQ ID NO: 1527817 - RNA, 20 nt, Homo sapiens
guguauauuuuugguggugg

SEQ ID NO: 1527818 - RNA, 14 nt, Homo sapiens
guguauuguguaug

SEQ ID NO: 1527819 - RNA, 20 nt, Homo sapiens
guuaauucaccuauguuauu

SEQ ID NO: 1527820 - RNA, 24 nt, Homo sapiens
guuacuggcuucucuugagucaca

SEQ ID NO: 1527821 - RNA, 20 nt, Homo sapiens
guucaacugcuuacucccaa

SEQ ID NO: 1527822 - RNA, 21 nt, Homo sapiens
guucccacucagcagugagag

SEQ ID NO: 1527823 - RNA, 20 nt, Homo sapiens
guuccccacugacagccucc

SEQ ID NO: 1527824 - RNA, 16 nt, Homo sapiens
guuccuuaucugucac

SEQ ID NO: 1527825 - RNA, 13 nt, Homo sapiens
guucuauccaaac

SEQ ID NO: 1527826 - RNA, 18 nt, Homo sapiens
guuggccugcacuggugu

SEQ ID NO: 1527827 - RNA, 18 nt, Homo sapiens
guuguugaggcugucaca

SEQ ID NO: 1527828 - RNA, 17 nt, Homo sapiens
uaaaaauguccugccuu

SEQ ID NO: 1527829 - RNA, 21 nt, Homo sapiens
uaaacaccauagggacccauu

SEQ ID NO: 1527830 - RNA, 19 nt, Homo sapiens
uaaacauuuugacacaaaa

SEQ ID NO: 1527831 - RNA, 23 nt, Homo sapiens
uaaacuucaccuacauuaucuca

SEQ ID NO: 1527832 - RNA, 21 nt, Homo sapiens
uaaagauauggagaauugcug

SEQ ID NO: 1527833 - RNA, 14 nt, Homo sapiens
uaaauaaaacugaa

SEQ ID NO: 1527834 - RNA, 15 nt, Homo sapiens
uaaauaccauugugu

SEQ ID NO: 1527835 - RNA, 18 nt, Homo sapiens
uaaccagcagaaaugccu

SEQ ID NO: 1527836 - RNA, 19 nt, Homo sapiens
uaaccaguguuguggauuu

SEQ ID NO: 1527837 - RNA, 15 nt, Homo sapiens
uaacuaaucaagaaa

SEQ ID NO: 1527838 - RNA, 20 nt, Homo sapiens
uaauaacuuugaagccauaa

SEQ ID NO: 1527839 - RNA, 16 nt, Homo sapiens
uaaucuguguguauau

SEQ ID NO: 1527840 - RNA, 18 nt, Homo sapiens
uaaugauggaacuuagac

SEQ ID NO: 1527841 - RNA, 20 nt, Homo sapiens
uaauggcagcuagugccuuu

SEQ ID NO: 1527842 - RNA, 21 nt, Homo sapiens
uacaauaaaacuuugcugcca

SEQ ID NO: 1527843 - RNA, 14 nt, Homo sapiens
uacauauuaucuca

SEQ ID NO: 1527844 - RNA, 15 nt, Homo sapiens
uacauauuaucucau

SEQ ID NO: 1527845 - RNA, 11 nt, Homo sapiens
uacaucuggcc

SEQ ID NO: 1527846 - RNA, 22 nt, Homo sapiens
uacaucugucuuucaucuccca

SEQ ID NO: 1527847 - RNA, 13 nt, Homo sapiens
uacauuaucucac

SEQ ID NO: 1527848 - RNA, 20 nt, Homo sapiens
uacauucugcaagcacaucu

SEQ ID NO: 1527849 - RNA, 22 nt, Homo sapiens
uacauucugcaagcacaucugc

SEQ ID NO: 1527850 - RNA, 19 nt, Homo sapiens
uaccucacagagugcauug

SEQ ID NO: 1527851 - RNA, 23 nt, Homo sapiens
uaccucacagagugcauugugag

SEQ ID NO: 1527852 - RNA, 12 nt, Homo sapiens
uacguugugcau

SEQ ID NO: 1527853 - RNA, 19 nt, Homo sapiens
uacuaaacuucaccuacau

SEQ ID NO: 1527854 - RNA, 20 nt, Homo sapiens
uacuccuggagcacuguaaa

SEQ ID NO: 1527855 - RNA, 22 nt, Homo sapiens
uacucugcccaccccagcauca

SEQ ID NO: 1527856 - RNA, 17 nt, Homo sapiens
uacuguaucagauguga

SEQ ID NO: 1527857 - RNA, 16 nt, Homo sapiens
uacuuaccauuugcua

SEQ ID NO: 1527858 - RNA, 13 nt, Homo sapiens
uacuuuugcuuca

SEQ ID NO: 1527859 - RNA, 16 nt, Homo sapiens
uagaaaccccucugua

SEQ ID NO: 1527860 - RNA, 14 nt, Homo sapiens
uagaguugauacua

SEQ ID NO: 1527861 - RNA, 16 nt, Homo sapiens
uagaucaucagucacc

SEQ ID NO: 1527862 - RNA, 17 nt, Homo sapiens
uagauguuucaacugug

SEQ ID NO: 1527863 - RNA, 19 nt, Homo sapiens
uagcaaauggcagaaccaa

SEQ ID NO: 1527864 - RNA, 16 nt, Homo sapiens
uagcacaaacuacaau

SEQ ID NO: 1527865 - RNA, 23 nt, Homo sapiens
uagcuaaauaaauggguguauau

SEQ ID NO: 1527866 - RNA, 18 nt, Homo sapiens
ucuagugucugacuuuug

SEQ ID NO: 1527867 - RNA, 16 nt, Homo sapiens
ucuaugacacaugcaa

SEQ ID NO: 1527868 - RNA, 14 nt, Homo sapiens
ucuauugacuuuuc

SEQ ID NO: 1527869 - RNA, 23 nt, Homo sapiens
ucuauuuaccuccuaauggcaug

SEQ ID NO: 1527870 - RNA, 12 nt, Homo sapiens
ucucagcacuuu

SEQ ID NO: 1527871 - RNA, 13 nt, Homo sapiens
ucucagcacuuug

SEQ ID NO: 1527872 - RNA, 21 nt, Homo sapiens
ucucaggcucuugacuacuug

SEQ ID NO: 1527873 - RNA, 21 nt, Homo sapiens
ucugcaagcacaucugcauuu

SEQ ID NO: 1527874 - RNA, 19 nt, Homo sapiens
ucugccacucuuaacacua

SEQ ID NO: 1527875 - RNA, 15 nt, Homo sapiens
ucugccuuuucacug

SEQ ID NO: 1527876 - RNA, 15 nt, Homo sapiens
ucuggcacguggcca

SEQ ID NO: 1527877 - RNA, 23 nt, Homo sapiens
ucugugacauacauauuaucuca

SEQ ID NO: 1527878 - RNA, 17 nt, Homo sapiens
ucuuaauucuuagcuca

SEQ ID NO: 1527879 - RNA, 18 nt, Homo sapiens
ucuucagaacuugucagg

SEQ ID NO: 1527880 - RNA, 23 nt, Homo sapiens
ucuuccuccgaggccaguaccuu

SEQ ID NO: 1527881 - RNA, 14 nt, Homo sapiens
ucuuuggauuugau

SEQ ID NO: 1527882 - RNA, 15 nt, Homo sapiens
ugaaaaugacauuaa

SEQ ID NO: 1527883 - RNA, 14 nt, Homo sapiens
ugaaagaaccagag

SEQ ID NO: 1527884 - RNA, 18 nt, Homo sapiens
ugaaaugcuggcauuugc

SEQ ID NO: 1527885 - RNA, 15 nt, Homo sapiens
ugaaauggccaggau

SEQ ID NO: 1527886 - RNA, 17 nt, Homo sapiens
ugaagauauuacuacuu

SEQ ID NO: 1527887 - RNA, 14 nt, Homo sapiens
ugaauauuacuccu

SEQ ID NO: 1527888 - RNA, 15 nt, Homo sapiens
ugaauauuacuccua

SEQ ID NO: 1527889 - RNA, 22 nt, Homo sapiens
ugaauuguuaauucacagaaua

SEQ ID NO: 1527890 - RNA, 19 nt, Homo sapiens
ugacaggccugaagauauu

SEQ ID NO: 1527891 - RNA, 17 nt, Homo sapiens
ugagaaaauaucuugcu

SEQ ID NO: 1527892 - RNA, 13 nt, Homo sapiens
ugagaagaucuga

SEQ ID NO: 1527893 - RNA, 19 nt, Homo sapiens
ugagaccucaaaucacugc

SEQ ID NO: 1527894 - RNA, 16 nt, Homo sapiens
ugaguacguugugcau

SEQ ID NO: 1527895 - RNA, 23 nt, Homo sapiens
ugaugagagaauggagacagagu

SEQ ID NO: 1527896 - RNA, 15 nt, Homo sapiens
ugauuaaauucuugc

SEQ ID NO: 1527897 - RNA, 16 nt, Homo sapiens
ugauuaccucucaauc

SEQ ID NO: 1527898 - RNA, 23 nt, Homo sapiens
ugcacauaguagguacccaauuc

SEQ ID NO: 1527899 - RNA, 16 nt, Homo sapiens
ugcaccugagccuguu

SEQ ID NO: 1527900 - RNA, 21 nt, Homo sapiens
ugcagguuccuuaucugucac

SEQ ID NO: 1527901 - RNA, 16 nt, Homo sapiens
ugcauugugaggguua

SEQ ID NO: 1527902 - RNA, 22 nt, Homo sapiens
ugccaaggcaaaaaacucuuaa

SEQ ID NO: 1527903 - RNA, 19 nt, Homo sapiens
ugccacagugguacucugu

SEQ ID NO: 1527904 - RNA, 18 nt, Homo sapiens
ugccuguaaucccaacac

SEQ ID NO: 1527905 - RNA, 20 nt, Homo sapiens
ugccuguaaucucagcacuu

SEQ ID NO: 1527906 - RNA, 18 nt, Homo sapiens
ugcuaccugcaccucugg

SEQ ID NO: 1527907 - RNA, 22 nt, Homo sapiens
ugcuagcaaauggcagaaccaa

SEQ ID NO: 1527908 - RNA, 16 nt, Homo sapiens
ugcuccuggcccuucu

SEQ ID NO: 1527909 - RNA, 23 nt, Homo sapiens
ugcugcaggccgugugucuguca

SEQ ID NO: 1527910 - RNA, 20 nt, Homo sapiens
ugcuguccgugcuugcuggu

SEQ ID NO: 1527911 - RNA, 16 nt, Homo sapiens
ugcuucaguugcauau

SEQ ID NO: 1527912 - RNA, 22 nt, Homo sapiens
ugcuugagcuuucugugcaugu

SEQ ID NO: 1527913 - RNA, 14 nt, Homo sapiens
ugcuugcuggugcc

SEQ ID NO: 1527914 - RNA, 19 nt, Homo sapiens
uggaaaagaacuguacugu

SEQ ID NO: 1527915 - RNA, 23 nt, Homo sapiens
uggaaccaaagcuggcccaguug

SEQ ID NO: 1527916 - RNA, 21 nt, Homo sapiens
uggaauauaauuucaaaccac

SEQ ID NO: 1527917 - RNA, 15 nt, Homo sapiens
uggaugaggagacag

SEQ ID NO: 1527918 - RNA, 20 nt, Homo sapiens
uggauucuggauucacagac

SEQ ID NO: 1527919 - RNA, 15 nt, Homo sapiens
uggcagucacaucuc

SEQ ID NO: 1527920 - RNA, 20 nt, Homo sapiens
uggcccaguuguccaugaca

SEQ ID NO: 1527921 - RNA, 22 nt, Homo sapiens
uggccgcuccucccucagaaaa

SEQ ID NO: 1527922 - RNA, 14 nt, Homo sapiens
uggccugcacuggu

SEQ ID NO: 1527923 - RNA, 17 nt, Homo sapiens
uggccuugaaaccaccu

SEQ ID NO: 1527924 - RNA, 21 nt, Homo sapiens
uggcucaugccuguaaucuca

SEQ ID NO: 1527925 - RNA, 22 nt, Homo sapiens
uggcucaugccuguaaucucag

SEQ ID NO: 1527926 - RNA, 20 nt, Homo sapiens
uggcucccaagccacauuca

SEQ ID NO: 1527927 - RNA, 15 nt, Homo sapiens
uggcuuuugugcauu

SEQ ID NO: 1527928 - RNA, 14 nt, Homo sapiens
ugggaauacaucug

SEQ ID NO: 1527929 - RNA, 17 nt, Homo sapiens
uggggcaggcugcuuca

SEQ ID NO: 1527930 - RNA, 20 nt, Homo sapiens
uggugccaccagccuuccug

SEQ ID NO: 1527931 - RNA, 13 nt, Homo sapiens
cuggagcacugua

SEQ ID NO: 1527932 - RNA, 22 nt, Homo sapiens
cuggcccuucuauuuauuugac

SEQ ID NO: 1527933 - RNA, 19 nt, Homo sapiens
cuggccgcuccucccucag

SEQ ID NO: 1527934 - RNA, 21 nt, Homo sapiens
cuggggugggagggaggcauc

SEQ ID NO: 1527935 - RNA, 17 nt, Homo sapiens
cuguaaucucagcacuu

SEQ ID NO: 1527936 - RNA, 21 nt, Homo sapiens
cuguacagaaaguaucacaaa

SEQ ID NO: 1527937 - RNA, 22 nt, Homo sapiens
cugucaagaagaggaaagggag

SEQ ID NO: 1527938 - RNA, 21 nt, Homo sapiens
cugucacguucuccacacggg

SEQ ID NO: 1527939 - RNA, 14 nt, Homo sapiens
cugucugacaaccu

SEQ ID NO: 1527940 - RNA, 23 nt, Homo sapiens
cugucugaucaggguggagggaa

SEQ ID NO: 1527941 - RNA, 21 nt, Homo sapiens
cugugacauacauauuaucuc

SEQ ID NO: 1527942 - RNA, 19 nt, Homo sapiens
cuuaaaacaauucugugac

SEQ ID NO: 1527943 - RNA, 14 nt, Homo sapiens
cuuaaaacuaaaug

SEQ ID NO: 1527944 - RNA, 22 nt, Homo sapiens
cuuaaaacuaaauguaauuuau

SEQ ID NO: 1527945 - RNA, 14 nt, Homo sapiens
cuuaaccuuuccag

SEQ ID NO: 1527946 - RNA, 13 nt, Homo sapiens
cuuagacacuuua

SEQ ID NO: 1527947 - RNA, 12 nt, Homo sapiens
cuuaguaaaauu

SEQ ID NO: 1527948 - RNA, 14 nt, Homo sapiens
cuuaucugucacac

SEQ ID NO: 1527949 - RNA, 16 nt, Homo sapiens
cuucacucaggucuca

SEQ ID NO: 1527950 - RNA, 20 nt, Homo sapiens
cuucagaucucuaacuucac

SEQ ID NO: 1527951 - RNA, 20 nt, Homo sapiens
cuuccugaguggccagggaa

SEQ ID NO: 1527952 - RNA, 16 nt, Homo sapiens
cuucucaucuugugaa

SEQ ID NO: 1527953 - RNA, 18 nt, Homo sapiens
cuugacccccuugagggu

SEQ ID NO: 1527954 - RNA, 20 nt, Homo sapiens
cuugagggugcuuguucccu

SEQ ID NO: 1527955 - RNA, 18 nt, Homo sapiens
cuugcaccugagccuguu

SEQ ID NO: 1527956 - RNA, 18 nt, Homo sapiens
cuugcaguuaaggguuag

SEQ ID NO: 1527957 - RNA, 21 nt, Homo sapiens
cuuucccagucccauuccuca

SEQ ID NO: 1527958 - RNA, 22 nt, Homo sapiens
cuuucccagucccauuccucag

SEQ ID NO: 1527959 - RNA, 17 nt, Homo sapiens
cuuugaucuucagggaa

SEQ ID NO: 1527960 - RNA, 13 nt, Homo sapiens
cuuugauucuccu

SEQ ID NO: 1527961 - RNA, 12 nt, Homo sapiens
cuuugcgcucuc

SEQ ID NO: 1527962 - RNA, 13 nt, Homo sapiens
cuuuuacauucug

SEQ ID NO: 1527963 - RNA, 14 nt, Homo sapiens
gaaaaguagacaau

SEQ ID NO: 1527964 - RNA, 18 nt, Homo sapiens
gaaaauaucuugcuuuca

SEQ ID NO: 1527965 - RNA, 16 nt, Homo sapiens
gaaagguuuuccuuau

SEQ ID NO: 1527966 - RNA, 15 nt, Homo sapiens
gaaauggaugcaaag

SEQ ID NO: 1527967 - RNA, 19 nt, Homo sapiens
gaaccgagguguugccagu

SEQ ID NO: 1527968 - RNA, 23 nt, Homo sapiens
gaagauauuacuacuuaccauuu

SEQ ID NO: 1527969 - RNA, 13 nt, Homo sapiens
gaaggauuaccug

SEQ ID NO: 1527970 - RNA, 16 nt, Homo sapiens
gaagggccgaggaaug

SEQ ID NO: 1527971 - RNA, 22 nt, Homo sapiens
gaauaauccaguauugcugauu

SEQ ID NO: 1527972 - RNA, 13 nt, Homo sapiens
gaauauaauuuca

SEQ ID NO: 1527973 - RNA, 14 nt, Homo sapiens
gaaugugaagccag

SEQ ID NO: 1527974 - RNA, 15 nt, Homo sapiens
gaauucacgccucuc

SEQ ID NO: 1527975 - RNA, 19 nt, Homo sapiens
gaauuuucucuaacuucaa

SEQ ID NO: 1527976 - RNA, 21 nt, Homo sapiens
gacaccuuuucuauuuaccuc

SEQ ID NO: 1527977 - RNA, 15 nt, Homo sapiens
gacacuuuaccucuu

SEQ ID NO: 1527978 - RNA, 17 nt, Homo sapiens
gacauacauauuaucuc

SEQ ID NO: 1527979 - RNA, 18 nt, Homo sapiens
agaaaaaggcaguggccu

SEQ ID NO: 1527980 - RNA, 20 nt, Homo sapiens
agaaaauaguggugugauuu

SEQ ID NO: 1527981 - RNA, 16 nt, Homo sapiens
agaaaauucuccugau

SEQ ID NO: 1527982 - RNA, 13 nt, Homo sapiens
agaaaccucggga

SEQ ID NO: 1527983 - RNA, 20 nt, Homo sapiens
agaaccagagaggcucugag

SEQ ID NO: 1527984 - RNA, 18 nt, Homo sapiens
agaagaaaauaguggugu

SEQ ID NO: 1527985 - RNA, 16 nt, Homo sapiens
agaagaggaaagggag

SEQ ID NO: 1527986 - RNA, 14 nt, Homo sapiens
agaaggcagugucc

SEQ ID NO: 1527987 - RNA, 19 nt, Homo sapiens
agaagugcagccccucuca

SEQ ID NO: 1527988 - RNA, 22 nt, Homo sapiens
agaaguucucaaaguuaauuca

SEQ ID NO: 1527989 - RNA, 14 nt, Homo sapiens
agaauagcacaaac

SEQ ID NO: 1527990 - RNA, 23 nt, Homo sapiens
agacacaauauguaugcuuuuua

SEQ ID NO: 1527991 - RNA, 13 nt, Homo sapiens
agacagaagcuua

SEQ ID NO: 1527992 - RNA, 17 nt, Homo sapiens
agaccucaaaucacugc

SEQ ID NO: 1527993 - RNA, 22 nt, Homo sapiens
agacuggaauauaauuucaaac

SEQ ID NO: 1527994 - RNA, 19 nt, Homo sapiens
agagaaugcacagauauac

SEQ ID NO: 1527995 - RNA, 19 nt, Homo sapiens
agagacucgcucacuccca

SEQ ID NO: 1527996 - RNA, 13 nt, Homo sapiens
agagcaucucugc

SEQ ID NO: 1527997 - RNA, 16 nt, Homo sapiens
agagccccucaugcca

SEQ ID NO: 1527998 - RNA, 21 nt, Homo sapiens
agaggugcuucugccugugca

SEQ ID NO: 1527999 - RNA, 23 nt, Homo sapiens
agagucacaaguagccucuggga

SEQ ID NO: 1528000 - RNA, 14 nt, Homo sapiens
agauauugauuacu

SEQ ID NO: 1528001 - RNA, 15 nt, Homo sapiens
agaucaucagucacc

SEQ ID NO: 1528002 - RNA, 23 nt, Homo sapiens
agauccuggaaacagcaguguau

SEQ ID NO: 1528003 - RNA, 16 nt, Homo sapiens
agaucucuaacuucac

SEQ ID NO: 1528004 - RNA, 21 nt, Homo sapiens
agauggggucucacaguguug

SEQ ID NO: 1528005 - RNA, 20 nt, Homo sapiens
agcacggcugugggugguga

SEQ ID NO: 1528006 - RNA, 12 nt, Homo sapiens
agcacuguaaaa

SEQ ID NO: 1528007 - RNA, 13 nt, Homo sapiens
agcagaaaugccu

SEQ ID NO: 1528008 - RNA, 14 nt, Homo sapiens
agcagaaaugccuu

SEQ ID NO: 1528009 - RNA, 13 nt, Homo sapiens
agcagaaccuugg

SEQ ID NO: 1528010 - RNA, 20 nt, Homo sapiens
agcaguucucugccaaagcu

SEQ ID NO: 1528011 - RNA, 15 nt, Homo sapiens
agccagcugugcacu

SEQ ID NO: 1528012 - RNA, 18 nt, Homo sapiens
agccaugggaaaugagcc

SEQ ID NO: 1528013 - RNA, 19 nt, Homo sapiens
agccucugggaucugccaa

SEQ ID NO: 1528014 - RNA, 17 nt, Homo sapiens
agccuguucccacucag

SEQ ID NO: 1528015 - RNA, 14 nt, Homo sapiens
agcuagugccuuua

SEQ ID NO: 1528016 - RNA, 19 nt, Homo sapiens
agcucagcauuuccacacc

SEQ ID NO: 1528017 - RNA, 20 nt, Homo sapiens
agcucagcauuuccacacca

SEQ ID NO: 1528018 - RNA, 21 nt, Homo sapiens
agcucccacacccaccucugc

SEQ ID NO: 1528019 - RNA, 23 nt, Homo sapiens
agcuggcccaguuguccaugaca

SEQ ID NO: 1528020 - RNA, 15 nt, Homo sapiens
agcugucgacuucau

SEQ ID NO: 1528021 - RNA, 17 nt, Homo sapiens
agcuuaaaaucugugaa

SEQ ID NO: 1528022 - RNA, 14 nt, Homo sapiens
agcuuucugugcau

SEQ ID NO: 1528023 - RNA, 19 nt, Homo sapiens
aggaaccgagguguugcca

SEQ ID NO: 1528024 - RNA, 16 nt, Homo sapiens
aggacuuccauuugcu

SEQ ID NO: 1528025 - RNA, 13 nt, Homo sapiens
aggaguucaagac

SEQ ID NO: 1528026 - RNA, 23 nt, Homo sapiens
aggcaaggaguuugagaccagcu

SEQ ID NO: 1528027 - RNA, 12 nt, Homo sapiens
aggcaguggccu

SEQ ID NO: 1528028 - RNA, 20 nt, Homo sapiens
aggcaucauacuaaacuuca

SEQ ID NO: 1528029 - RNA, 14 nt, Homo sapiens
aggcauggcucaga

SEQ ID NO: 1528030 - RNA, 13 nt, Homo sapiens
aggccuaccucuc

SEQ ID NO: 1528031 - RNA, 22 nt, Homo sapiens
aggcgauccaccugucucagcc

SEQ ID NO: 1528032 - RNA, 22 nt, Homo sapiens
aggggaaaagaaaaucuuuuaa

SEQ ID NO: 1528033 - RNA, 17 nt, Homo sapiens
aggguaccgucuucucc

SEQ ID NO: 1528034 - RNA, 15 nt, Homo sapiens
agguaguuuggauau

SEQ ID NO: 1528035 - RNA, 19 nt, Homo sapiens
aggugcuucugccugugca

SEQ ID NO: 1528036 - RNA, 15 nt, Homo sapiens
agguuuuuacuguga

SEQ ID NO: 1528037 - RNA, 16 nt, Homo sapiens
aguaaguagaugccug

SEQ ID NO: 1528038 - RNA, 14 nt, Homo sapiens
aguaauaugcacac

SEQ ID NO: 1528039 - RNA, 15 nt, Homo sapiens
aguaauuaugcacua

SEQ ID NO: 1528040 - RNA, 23 nt, Homo sapiens
aguacacuguuucaaacuuuacu

SEQ ID NO: 1528041 - RNA, 14 nt, Homo sapiens
aguagaugccuguu

SEQ ID NO: 1528042 - RNA, 16 nt, Homo sapiens
aguaugaggcauuugu

SEQ ID NO: 1528043 - RNA, 15 nt, Homo sapiens
agugaaugugucugg

SEQ ID NO: 1528044 - RNA, 23 nt, Homo sapiens
agugagaguuccucuuugcccug

SEQ ID NO: 1528045 - RNA, 14 nt, Homo sapiens
auguauaucauucu

SEQ ID NO: 1528046 - RNA, 22 nt, Homo sapiens
auguuauuuuguguacaaguug

SEQ ID NO: 1528047 - RNA, 20 nt, Homo sapiens
auguuguugaggcugucaca

SEQ ID NO: 1528048 - RNA, 17 nt, Homo sapiens
auuaaaacuaagcacaa

SEQ ID NO: 1528049 - RNA, 20 nt, Homo sapiens
auuaacuuuuauaaacuuua

SEQ ID NO: 1528050 - RNA, 15 nt, Homo sapiens
auuaauucuucaccu

SEQ ID NO: 1528051 - RNA, 13 nt, Homo sapiens
auuacuaucauaa

SEQ ID NO: 1528052 - RNA, 17 nt, Homo sapiens
auucaaccaaccaagga

SEQ ID NO: 1528053 - RNA, 13 nt, Homo sapiens
auucagcacuuaa

SEQ ID NO: 1528054 - RNA, 22 nt, Homo sapiens
auucaugugggcauuucuugcg

SEQ ID NO: 1528055 - RNA, 17 nt, Homo sapiens
auuccagugcuagaaaa

SEQ ID NO: 1528056 - RNA, 12 nt, Homo sapiens
auuccuugcaca

SEQ ID NO: 1528057 - RNA, 14 nt, Homo sapiens
auucuaagcccuuu

SEQ ID NO: 1528058 - RNA, 19 nt, Homo sapiens
auucuaagcccuuugccau

SEQ ID NO: 1528059 - RNA, 18 nt, Homo sapiens
auucucccaaaguaccuu

SEQ ID NO: 1528060 - RNA, 14 nt, Homo sapiens
auucucuccuguac

SEQ ID NO: 1528061 - RNA, 22 nt, Homo sapiens
auucuuguuggagacaugggau

SEQ ID NO: 1528062 - RNA, 17 nt, Homo sapiens
auugaaagaaccagaga

SEQ ID NO: 1528063 - RNA, 13 nt, Homo sapiens
auugcaugcaauu

SEQ ID NO: 1528064 - RNA, 20 nt, Homo sapiens
auuuacuauuacgugcuauu

SEQ ID NO: 1528065 - RNA, 16 nt, Homo sapiens
auuuauuaacuaauca

SEQ ID NO: 1528066 - RNA, 22 nt, Homo sapiens
auuucaugaaaaugacauuaaa

SEQ ID NO: 1528067 - RNA, 14 nt, Homo sapiens
auuuccacaccaag

SEQ ID NO: 1528068 - RNA, 18 nt, Homo sapiens
auuucuaaaucuccaaaa

SEQ ID NO: 1528069 - RNA, 22 nt, Homo sapiens
auuugauucgcccuccucccug

SEQ ID NO: 1528070 - RNA, 19 nt, Homo sapiens
auuugcaaaggcgacaaua

SEQ ID NO: 1528071 - RNA, 22 nt, Homo sapiens
auuuggaguucacagccuagaa

SEQ ID NO: 1528072 - RNA, 14 nt, Homo sapiens
auuuggucagcaua

SEQ ID NO: 1528073 - RNA, 15 nt, Homo sapiens
auuuuaauacauuga

SEQ ID NO: 1528074 - RNA, 17 nt, Homo sapiens
auuuuugccaaggcaaa

SEQ ID NO: 1528075 - RNA, 17 nt, Homo sapiens
caaaauauuuuuugcaa

SEQ ID NO: 1528076 - RNA, 16 nt, Homo sapiens
caaacauuguuuuauu

SEQ ID NO: 1528077 - RNA, 21 nt, Homo sapiens
caaacuugagaaaauaucuug

SEQ ID NO: 1528078 - RNA, 21 nt, Homo sapiens
caaagcacuagagaaugcaca

SEQ ID NO: 1528079 - RNA, 17 nt, Homo sapiens
caaaguaccuugaacuc

SEQ ID NO: 1528080 - RNA, 16 nt, Homo sapiens
caaaguuaauucaccu

SEQ ID NO: 1528081 - RNA, 15 nt, Homo sapiens
caaauauaagacauu

SEQ ID NO: 1528082 - RNA, 13 nt, Homo sapiens
caaaucacugcau

SEQ ID NO: 1528083 - RNA, 16 nt, Homo sapiens
caaauggcagaaccaa

SEQ ID NO: 1528084 - RNA, 23 nt, Homo sapiens
caacaaaauggucauccaaacuc

SEQ ID NO: 1528085 - RNA, 22 nt, Homo sapiens
caacccagcaguucucugccaa

SEQ ID NO: 1528086 - RNA, 18 nt, Homo sapiens
caagaagaggaaagggag

SEQ ID NO: 1528087 - RNA, 22 nt, Homo sapiens
caaggcccauaucugugaaaug

SEQ ID NO: 1528088 - RNA, 17 nt, Homo sapiens
caaguauuauuuuacaa

SEQ ID NO: 1528089 - RNA, 19 nt, Homo sapiens
caauaaagcagcguuucua

SEQ ID NO: 1528090 - RNA, 18 nt, Homo sapiens
caaucuauuuguuuuuaa

SEQ ID NO: 1528091 - RNA, 16 nt, Homo sapiens
caaugacuuacuguac

SEQ ID NO: 1528092 - RNA, 20 nt, Homo sapiens
caauuaaaacuaagcacaaa

SEQ ID NO: 1528093 - RNA, 19 nt, Homo sapiens
caauucagauugucuugca

SEQ ID NO: 1528094 - RNA, 23 nt, Homo sapiens
caauucugugacauacauauuau

SEQ ID NO: 1528095 - RNA, 14 nt, Homo sapiens
cacagagugcauug

SEQ ID NO: 1528096 - RNA, 23 nt, Homo sapiens
cacagcucuccuccuccaucuca

SEQ ID NO: 1528097 - RNA, 13 nt, Homo sapiens
cacaucugucacg

SEQ ID NO: 1528098 - RNA, 17 nt, Homo sapiens
cacaugcaaggucauuu

SEQ ID NO: 1528099 - RNA, 21 nt, Homo sapiens
cacauuaguacuuauguugca

SEQ ID NO: 1528100 - RNA, 16 nt, Homo sapiens
cacccuggaggauuuc

SEQ ID NO: 1528101 - RNA, 22 nt, Homo sapiens
caccucuggauucuggauucac

SEQ ID NO: 1528102 - RNA, 23 nt, Homo sapiens
cacguuucuaaaggcuaccuuug

SEQ ID NO: 1528103 - RNA, 16 nt, Homo sapiens
cacuaccguaaauguc

SEQ ID NO: 1528104 - RNA, 22 nt, Homo sapiens
cacuggaaauguuuguccuugc

SEQ ID NO: 1528105 - RNA, 13 nt, Homo sapiens
cacuuuaccucuu

SEQ ID NO: 1528106 - RNA, 19 nt, Homo sapiens
cacuuugagaagcugaggu

SEQ ID NO: 1528107 - RNA, 15 nt, Homo sapiens
cacuuuuguucugcu

SEQ ID NO: 1528108 - RNA, 19 nt, Homo sapiens
cagaggcaguaaccaugcc

SEQ ID NO: 1528109 - RNA, 23 nt, Homo sapiens
cagauccuggaaacagcagugua

SEQ ID NO: 1528110 - RNA, 13 nt, Homo sapiens
cagccacauucua

SEQ ID NO: 1528111 - RNA, 18 nt, Homo sapiens
caguagugagcagcaucu

SEQ ID NO: 1528112 - RNA, 17 nt, Homo sapiens
cagucccagacaauucc

SEQ ID NO: 1528113 - RNA, 21 nt, Homo sapiens
cagugagaguuccucuuugcc

SEQ ID NO: 1528114 - RNA, 20 nt, Homo sapiens
caguggucuccuucacauca

SEQ ID NO: 1528115 - RNA, 11 nt, Homo sapiens
caguguugccc

SEQ ID NO: 1528116 - RNA, 16 nt, Homo sapiens
caguucucugccaaag

SEQ ID NO: 1528117 - RNA, 15 nt, Homo sapiens
caguugcauaucuua

SEQ ID NO: 1528118 - RNA, 21 nt, Homo sapiens
cauaaaaauaaaucaguucau

SEQ ID NO: 1528119 - RNA, 14 nt, Homo sapiens
cauaaacaaugaug

SEQ ID NO: 1528120 - RNA, 15 nt, Homo sapiens
cauaauucagcacuu

SEQ ID NO: 1528121 - RNA, 17 nt, Homo sapiens
cauaauucagcacuuaa

SEQ ID NO: 1528122 - RNA, 21 nt, Homo sapiens
cauacauucccucuaauuuga

SEQ ID NO: 1528123 - RNA, 21 nt, Homo sapiens
cauaucccuuccucucaggcu

SEQ ID NO: 1528124 - RNA, 12 nt, Homo sapiens
cauauuaucuca

SEQ ID NO: 1528125 - RNA, 13 nt, Homo sapiens
caucagcacagcu

SEQ ID NO: 1528126 - RNA, 23 nt, Homo sapiens
cauccuuaaaacaauucugugac

SEQ ID NO: 1528127 - RNA, 18 nt, Homo sapiens
caucgauauguauaucau

SEQ ID NO: 1528128 - RNA, 21 nt, Homo sapiens
caucgauauguauaucauucu

SEQ ID NO: 1528129 - RNA, 13 nt, Homo sapiens
caucucagacugu

SEQ ID NO: 1528130 - RNA, 23 nt, Homo sapiens
caucucucccuccccugccauuu

SEQ ID NO: 1528131 - RNA, 18 nt, Homo sapiens
caucuguggacaagacau

SEQ ID NO: 1528132 - RNA, 14 nt, Homo sapiens
caucuuuggcugag

SEQ ID NO: 1528133 - RNA, 19 nt, Homo sapiens
caugaaguaauaugcacac

SEQ ID NO: 1528134 - RNA, 22 nt, Homo sapiens
caugccuguaaucucagcacuu

SEQ ID NO: 1528135 - RNA, 18 nt, Homo sapiens
caugguuaccugaccuaa

SEQ ID NO: 1528136 - RNA, 15 nt, Homo sapiens
cauuaucucacuuag

SEQ ID NO: 1528137 - RNA, 17 nt, Homo sapiens
cauucaugugggcauuu

SEQ ID NO: 1528138 - RNA, 19 nt, Homo sapiens
cauucuccuuguguuacua

SEQ ID NO: 1528139 - RNA, 15 nt, Homo sapiens
cauugugaggguuaa

SEQ ID NO: 1528140 - RNA, 13 nt, Homo sapiens
cauuugcaccuac

SEQ ID NO: 1528141 - RNA, 14 nt, Homo sapiens
cauuugcuuugucc

SEQ ID NO: 1528142 - RNA, 21 nt, Homo sapiens
cauuuuauuagaaaggacugu

SEQ ID NO: 1528143 - RNA, 17 nt, Homo sapiens
ccaaacucaaacuugag

SEQ ID NO: 1528144 - RNA, 22 nt, Homo sapiens
ccaaagcuggcccaguugucca

SEQ ID NO: 1528145 - RNA, 18 nt, Homo sapiens
ccaacccagcaguucucu

SEQ ID NO: 1528146 - RNA, 14 nt, Homo sapiens
ccaagagagguccu

SEQ ID NO: 1528147 - RNA, 23 nt, Homo sapiens
ccacacccaccucugccacucuu

SEQ ID NO: 1528148 - RNA, 15 nt, Homo sapiens
ccacacccagcucag

SEQ ID NO: 1528149 - RNA, 21 nt, Homo sapiens
ccaccacuuuuggauuuuaug

SEQ ID NO: 1528150 - RNA, 22 nt, Homo sapiens
ccaccccagcaucagcacagcu

SEQ ID NO: 1528151 - RNA, 19 nt, Homo sapiens
ccacuaccguaaaugucca

SEQ ID NO: 1528152 - RNA, 18 nt, Homo sapiens
ccacugcgcucuugggac

SEQ ID NO: 1528153 - RNA, 15 nt, Homo sapiens
ccagaggcaguaacc

SEQ ID NO: 1528154 - RNA, 14 nt, Homo sapiens
ccagaggugcuucu

SEQ ID NO: 1528155 - RNA, 21 nt, Homo sapiens
ccagcagacacccuguguccu

SEQ ID NO: 1528156 - RNA, 15 nt, Homo sapiens
ccagcugugcacuuu

SEQ ID NO: 1528157 - RNA, 22 nt, Homo sapiens
ccagcugugcacuuucuucucu

SEQ ID NO: 1528158 - RNA, 20 nt, Homo sapiens
ccaguaaaugggggugcauu

SEQ ID NO: 1528159 - RNA, 21 nt, Homo sapiens
ccaguaaaugggggugcauuu

SEQ ID NO: 1528160 - RNA, 20 nt, Homo sapiens
ccagugcuguccaugcuucu

SEQ ID NO: 1528161 - RNA, 21 nt, Homo sapiens
ccaguggagacggaaucugcc

SEQ ID NO: 1528162 - RNA, 22 nt, Homo sapiens
ccauaaaaauaaaucaguucau

SEQ ID NO: 1528163 - RNA, 21 nt, Homo sapiens
ccauagggacccauucuacac

SEQ ID NO: 1528164 - RNA, 20 nt, Homo sapiens
ccaucucugugauuaccucu

SEQ ID NO: 1528165 - RNA, 22 nt, Homo sapiens
ccaucucugugauuaccucuca

SEQ ID NO: 1528166 - RNA, 11 nt, Homo sapiens
ccaucuuuaca

SEQ ID NO: 1528167 - RNA, 15 nt, Homo sapiens
cccaacacuuugaga

SEQ ID NO: 1528168 - RNA, 22 nt, Homo sapiens
cccaagggcaucauccucagca

SEQ ID NO: 1528169 - RNA, 22 nt, Homo sapiens
cccacacccuggaggauuucau

SEQ ID NO: 1528170 - RNA, 14 nt, Homo sapiens
cccauaucugugaa

SEQ ID NO: 1528171 - RNA, 17 nt, Homo sapiens
cccauaucugugaaaug

SEQ ID NO: 1528172 - RNA, 11 nt, Homo sapiens
ccccacugaca

SEQ ID NO: 1528173 - RNA, 18 nt, Homo sapiens
cccccgaacggcauucuc

SEQ ID NO: 1528174 - RNA, 12 nt, Homo sapiens
cccguugugccu

SEQ ID NO: 1528175 - RNA, 14 nt, Homo sapiens
cccucagacauccc

SEQ ID NO: 1528176 - RNA, 19 nt, Homo sapiens
cccucuccaggcauuuauu

SEQ ID NO: 1528177 - RNA, 16 nt, Homo sapiens
cccugaggcucagucu

SEQ ID NO: 1528178 - RNA, 20 nt, Homo sapiens
cccuggcuccucuacuguuu

SEQ ID NO: 1528179 - RNA, 14 nt, Homo sapiens
cccuguagggugcc

SEQ ID NO: 1528180 - RNA, 14 nt, Homo sapiens
cccuguggcacuca

SEQ ID NO: 1528181 - RNA, 17 nt, Homo sapiens
cccuuaccccacacaca

SEQ ID NO: 1528182 - RNA, 20 nt, Homo sapiens
ccgaggaaugugaagccaga

SEQ ID NO: 1528183 - RNA, 14 nt, Homo sapiens
ccggaagaaccaga

SEQ ID NO: 1528184 - RNA, 21 nt, Homo sapiens
ccgucuucucccuauucccuc

SEQ ID NO: 1528185 - RNA, 20 nt, Homo sapiens
ccuacauuaucucacuuagu

SEQ ID NO: 1528186 - RNA, 12 nt, Homo sapiens
ccucagacaucc

SEQ ID NO: 1528187 - RNA, 13 nt, Homo sapiens
ccucagacauccc

SEQ ID NO: 1528188 - RNA, 18 nt, Homo sapiens
ccucucaggcucuugacu

SEQ ID NO: 1528189 - RNA, 15 nt, Homo sapiens
ccucugggaucugcc

SEQ ID NO: 1528190 - RNA, 15 nt, Homo sapiens
ccugcugaccuccca

SEQ ID NO: 1528191 - RNA, 20 nt, Homo sapiens
ccuguucccacucagcagug

SEQ ID NO: 1528192 - RNA, 15 nt, Homo sapiens
ccuuaaaacaauucu

SEQ ID NO: 1528193 - RNA, 19 nt, Homo sapiens
ccuucuauuuauuugacug

SEQ ID NO: 1528194 - RNA, 17 nt, Homo sapiens
ccuuuaucauccuuaaa

SEQ ID NO: 1528195 - RNA, 20 nt, Homo sapiens
ccuuuucuauuuaccuccua

SEQ ID NO: 1528196 - RNA, 19 nt, Homo sapiens
cgagguguugccagugcua

SEQ ID NO: 1528197 - RNA, 14 nt, Homo sapiens
cgugugucugucag

SEQ ID NO: 1528198 - RNA, 23 nt, Homo sapiens
cguugugccugguucgugccaug

SEQ ID NO: 1528199 - RNA, 17 nt, Homo sapiens
cuaaaaggaaaucucac

SEQ ID NO: 1528200 - RNA, 13 nt, Homo sapiens
cuaaauaaauggg

SEQ ID NO: 1528201 - RNA, 23 nt, Homo sapiens
cuaaccuuugggccaauuuacug

SEQ ID NO: 1528202 - RNA, 16 nt, Homo sapiens
cuaagcccuuugccau

SEQ ID NO: 1528203 - RNA, 22 nt, Homo sapiens
cuaaugucucacuguucugcaa

SEQ ID NO: 1528204 - RNA, 13 nt, Homo sapiens
cuacaaguauuau

SEQ ID NO: 1528205 - RNA, 19 nt, Homo sapiens
cuacaaguauuauuuuaca

SEQ ID NO: 1528206 - RNA, 23 nt, Homo sapiens
cuagcaaauggcagaaccaaagc

SEQ ID NO: 1528207 - RNA, 17 nt, Homo sapiens
cuagguaggggcccacu

SEQ ID NO: 1528208 - RNA, 19 nt, Homo sapiens
cuaucauaauucagcacuu

SEQ ID NO: 1528209 - RNA, 14 nt, Homo sapiens
cuaugagccaggca

SEQ ID NO: 1528210 - RNA, 20 nt, Homo sapiens
cuauucccucucucucccag

SEQ ID NO: 1528211 - RNA, 16 nt, Homo sapiens
cucaaacuugagaaaa

SEQ ID NO: 1528212 - RNA, 20 nt, Homo sapiens
cucacagagugcauugugag

SEQ ID NO: 1528213 - RNA, 22 nt, Homo sapiens
cucagacuguggaaccaaagcu

SEQ ID NO: 1528214 - RNA, 14 nt, Homo sapiens
cucagcauuuccac

SEQ ID NO: 1528215 - RNA, 15 nt, Homo sapiens
cucagcuucuucaca

SEQ ID NO: 1528216 - RNA, 23 nt, Homo sapiens
cucagcuucuucacaggcacucc

SEQ ID NO: 1528217 - RNA, 17 nt, Homo sapiens
cuccaggcauuuauuca

SEQ ID NO: 1528218 - RNA, 16 nt, Homo sapiens
cuccugcacuguuuaa

SEQ ID NO: 1528219 - RNA, 13 nt, Homo sapiens
cuccugggcucag

SEQ ID NO: 1528220 - RNA, 14 nt, Homo sapiens
cuccuucacaucag

SEQ ID NO: 1528221 - RNA, 12 nt, Homo sapiens
cucuaacuucaa

SEQ ID NO: 1528222 - RNA, 16 nt, Homo sapiens
cucugugauuaccucu

SEQ ID NO: 1528223 - RNA, 17 nt, Homo sapiens
cucugugauuaccucuc

SEQ ID NO: 1528224 - RNA, 16 nt, Homo sapiens
cucuuaaacuugugaa

SEQ ID NO: 1528225 - RNA, 18 nt, Homo sapiens
uggccuugaaaccaccuu

SEQ ID NO: 1528226 - RNA, 13 nt, Homo sapiens
ugggaucugccaa

SEQ ID NO: 1528227 - RNA, 12 nt, Homo sapiens
ugggcugcugca

SEQ ID NO: 1528228 - RNA, 20 nt, Homo sapiens
uggguuuugggucuuugaac

SEQ ID NO: 1528229 - RNA, 19 nt, Homo sapiens
uggucccagaguggcugca

SEQ ID NO: 1528230 - RNA, 12 nt, Homo sapiens
uggugcccuucc

SEQ ID NO: 1528231 - RNA, 11 nt, Homo sapiens
uguaaacugga

SEQ ID NO: 1528232 - RNA, 16 nt, Homo sapiens
uguaaucucagcacuu

SEQ ID NO: 1528233 - RNA, 20 nt, Homo sapiens
uguagagauggggucucaca

SEQ ID NO: 1528234 - RNA, 16 nt, Homo sapiens
uguccauuuauaucau

SEQ ID NO: 1528235 - RNA, 17 nt, Homo sapiens
ugugaagccagaucucg

SEQ ID NO: 1528236 - RNA, 14 nt, Homo sapiens
ugugaggguggugg

SEQ ID NO: 1528237 - RNA, 12 nt, Homo sapiens
ugugcagaauaa

SEQ ID NO: 1528238 - RNA, 23 nt, Homo sapiens
ugugcauuaucuagauacuguau

SEQ ID NO: 1528239 - RNA, 19 nt, Homo sapiens
ugugccugguucgugccau

SEQ ID NO: 1528240 - RNA, 13 nt, Homo sapiens
ugugucugucagc

SEQ ID NO: 1528241 - RNA, 10 nt, Homo sapiens
ugugugcaug

SEQ ID NO: 1528242 - RNA, 11 nt, Homo sapiens
ugugugccuuu

SEQ ID NO: 1528243 - RNA, 19 nt, Homo sapiens
ugugugccuuuguuuccca

SEQ ID NO: 1528244 - RNA, 12 nt, Homo sapiens
ugugugucugua

SEQ ID NO: 1528245 - RNA, 16 nt, Homo sapiens
uguuacagcuucgcug

SEQ ID NO: 1528246 - RNA, 18 nt, Homo sapiens
uguuaugguaaccauucu

SEQ ID NO: 1528247 - RNA, 14 nt, Homo sapiens
uguuccccacugac

SEQ ID NO: 1528248 - RNA, 16 nt, Homo sapiens
uguugaggcugucaca

SEQ ID NO: 1528249 - RNA, 18 nt, Homo sapiens
uguuguugaggcugucac

SEQ ID NO: 1528250 - RNA, 19 nt, Homo sapiens
uuaaaucuuuggauuugau

SEQ ID NO: 1528251 - RNA, 16 nt, Homo sapiens
uuaauacauugaucag

SEQ ID NO: 1528252 - RNA, 15 nt, Homo sapiens
uuaauucuucaccug

SEQ ID NO: 1528253 - RNA, 14 nt, Homo sapiens
uuacacaaagggaa

SEQ ID NO: 1528254 - RNA, 15 nt, Homo sapiens
uuaccaggugagaag

SEQ ID NO: 1528255 - RNA, 21 nt, Homo sapiens
uuagauaaauuguagggcuuu

SEQ ID NO: 1528256 - RNA, 20 nt, Homo sapiens
uuaguuuacaaucagccaca

SEQ ID NO: 1528257 - RNA, 20 nt, Homo sapiens
uuauaaacaaacaaacauug

SEQ ID NO: 1528258 - RNA, 18 nt, Homo sapiens
uuaucugucacaccugug

SEQ ID NO: 1528259 - RNA, 12 nt, Homo sapiens
uucaaacuuuac

SEQ ID NO: 1528260 - RNA, 18 nt, Homo sapiens
uucaacaaauguggguga

SEQ ID NO: 1528261 - RNA, 21 nt, Homo sapiens
uucaaugugcauaaugauaaa

SEQ ID NO: 1528262 - RNA, 18 nt, Homo sapiens
uucaccuacauuaucuca

SEQ ID NO: 1528263 - RNA, 16 nt, Homo sapiens
uucccuggaggucucu

SEQ ID NO: 1528264 - RNA, 21 nt, Homo sapiens
uuccuccgaggccaguaccuu

SEQ ID NO: 1528265 - RNA, 15 nt, Homo sapiens
uuccuuaucugucac

SEQ ID NO: 1528266 - RNA, 18 nt, Homo sapiens
uuccuucaaugugcauaa

SEQ ID NO: 1528267 - RNA, 17 nt, Homo sapiens
uucgugccaugcccuua

SEQ ID NO: 1528268 - RNA, 17 nt, Homo sapiens
uucuagguaggggccca

SEQ ID NO: 1528269 - RNA, 16 nt, Homo sapiens
uucuauuuaccuccua

SEQ ID NO: 1528270 - RNA, 14 nt, Homo sapiens
uucugccugugcag

SEQ ID NO: 1528271 - RNA, 18 nt, Homo sapiens
uucuucaacaugcuccaa

SEQ ID NO: 1528272 - RNA, 13 nt, Homo sapiens
uugaaagaaccag

SEQ ID NO: 1528273 - RNA, 14 nt, Homo sapiens
uugaaagaaccaga

SEQ ID NO: 1528274 - RNA, 16 nt, Homo sapiens
uugaaagaaccagaga

SEQ ID NO: 1528275 - RNA, 20 nt, Homo sapiens
uugaaauauaggaacuuaaa

SEQ ID NO: 1528276 - RNA, 13 nt, Homo sapiens
uugaacuuugacc

SEQ ID NO: 1528277 - RNA, 15 nt, Homo sapiens
uugaauauuacuccu

SEQ ID NO: 1528278 - RNA, 16 nt, Homo sapiens
uugacauacauucccu

SEQ ID NO: 1528279 - RNA, 21 nt, Homo sapiens
uugcaaaguaucccuacugua

SEQ ID NO: 1528280 - RNA, 22 nt, Homo sapiens
uugcacuguccagcugguugua

SEQ ID NO: 1528281 - RNA, 20 nt, Homo sapiens
uugcgagccucgcagccucc

SEQ ID NO: 1528282 - RNA, 14 nt, Homo sapiens
uugcuuauugcuua

SEQ ID NO: 1528283 - RNA, 12 nt, Homo sapiens
uuggaaauggau

SEQ ID NO: 1528284 - RNA, 23 nt, Homo sapiens
uuggcaauaaauaaagcuuggga

SEQ ID NO: 1528285 - RNA, 16 nt, Homo sapiens
uuggcccuucugcccu

SEQ ID NO: 1528286 - RNA, 16 nt, Homo sapiens
uugguauaauguuuaa

SEQ ID NO: 1528287 - RNA, 20 nt, Homo sapiens
uugguauacuuuugcuucag

SEQ ID NO: 1528288 - RNA, 21 nt, Homo sapiens
uuguacauaaugcgugcauac

SEQ ID NO: 1528289 - RNA, 15 nt, Homo sapiens
uugugagccaccacg

SEQ ID NO: 1528290 - RNA, 20 nt, Homo sapiens
uugugauacaaugcugugcc

SEQ ID NO: 1528291 - RNA, 21 nt, Homo sapiens
uugugcauuaucuagauacug

SEQ ID NO: 1528292 - RNA, 13 nt, Homo sapiens
uuguuacagcuuc

SEQ ID NO: 1528293 - RNA, 16 nt, Homo sapiens
uuuaacaacauggcuu

SEQ ID NO: 1528294 - RNA, 11 nt, Homo sapiens
uuuaaccuuaa

SEQ ID NO: 1528295 - RNA, 12 nt, Homo sapiens
uuuacaacuggg

SEQ ID NO: 1528296 - RNA, 23 nt, Homo sapiens
uuuacaauaaaacuuugcugcca

SEQ ID NO: 1528297 - RNA, 14 nt, Homo sapiens
uuuacauucugcaa

SEQ ID NO: 1528298 - RNA, 23 nt, Homo sapiens
uuuacguuugauacaacauuaag

SEQ ID NO: 1528299 - RNA, 13 nt, Homo sapiens
uuuaugacucuua

SEQ ID NO: 1528300 - RNA, 19 nt, Homo sapiens
uuuauggagaccucuccuu

SEQ ID NO: 1528301 - RNA, 12 nt, Homo sapiens
uuucaaacuuua

SEQ ID NO: 1528302 - RNA, 17 nt, Homo sapiens
uuucaacugugcucuug

SEQ ID NO: 1528303 - RNA, 13 nt, Homo sapiens
uuucuccagugcu

SEQ ID NO: 1528304 - RNA, 19 nt, Homo sapiens
uuugaacccuugcuugcaa

SEQ ID NO: 1528305 - RNA, 10 nt, Homo sapiens
uuuguaaaag

SEQ ID NO: 1528306 - RNA, 14 nt, Homo sapiens
uuuuaaaugacuug

SEQ ID NO: 1528307 - RNA, 18 nt, Homo sapiens
uuuuaauacauugaucag

SEQ ID NO: 1528308 - RNA, 13 nt, Homo sapiens
uuuucaccccacc

SEQ ID NO: 1528309 - RNA, 18 nt, Homo sapiens
uuuugccaaggcaaaaaa

SEQ ID NO: 1528310 - RNA, 23 nt, Homo sapiens
accuaaaaggaaaucucacccca

SEQ ID NO: 1528311 - RNA, 16 nt, Homo sapiens
accuacauuaucucac

SEQ ID NO: 1528312 - RNA, 22 nt, Homo sapiens
accucgggaaacuuagaucauc

SEQ ID NO: 1528313 - RNA, 14 nt, Homo sapiens
accuuuccauuuau

SEQ ID NO: 1528314 - RNA, 22 nt, Homo sapiens
accuuuguauucucuccuguac

SEQ ID NO: 1528315 - RNA, 20 nt, Homo sapiens
accuuuucuauuuaccuccu

SEQ ID NO: 1528316 - RNA, 22 nt, Homo sapiens
acguuucuaaaggcuaccuuug

SEQ ID NO: 1528317 - RNA, 21 nt, Homo sapiens
acuacuuggaacuaggcucuu

SEQ ID NO: 1528318 - RNA, 13 nt, Homo sapiens
acucaaacuugag

SEQ ID NO: 1528319 - RNA, 20 nt, Homo sapiens
acucccaagccacuagccca

SEQ ID NO: 1528320 - RNA, 22 nt, Homo sapiens
acugaguacguugugcauuugg

SEQ ID NO: 1528321 - RNA, 19 nt, Homo sapiens
acugcgccgaccccgccac

SEQ ID NO: 1528322 - RNA, 23 nt, Homo sapiens
acuggaauauaauuucaaaccac

SEQ ID NO: 1528323 - RNA, 10 nt, Homo sapiens
acuguaaaau

SEQ ID NO: 1528324 - RNA, 23 nt, Homo sapiens
acugucaagaagaggaaagggag

SEQ ID NO: 1528325 - RNA, 17 nt, Homo sapiens
acugugggaaggccagc

SEQ ID NO: 1528326 - RNA, 19 nt, Homo sapiens
acuuagacacuuuaccucu

SEQ ID NO: 1528327 - RNA, 15 nt, Homo sapiens
acuuagacuccucuu

SEQ ID NO: 1528328 - RNA, 23 nt, Homo sapiens
acuuagaucaucagucaccgaag

SEQ ID NO: 1528329 - RNA, 23 nt, Homo sapiens
acuuaguccuuuaucauccuuaa

SEQ ID NO: 1528330 - RNA, 23 nt, Homo sapiens
acuucaguuuuauuuuugccaag

SEQ ID NO: 1528331 - RNA, 15 nt, Homo sapiens
acuuugagaagcuga

SEQ ID NO: 1528332 - RNA, 20 nt, Homo sapiens
acuuuuuuugguauaauguu

SEQ ID NO: 1528333 - RNA, 16 nt, Homo sapiens
agaaaagaaauuaguu

SEQ ID NO: 1528334 - RNA, 17 nt, Homo sapiens
agaaaauagagcuuuua

SEQ ID NO: 1528335 - RNA, 16 nt, Homo sapiens
agaaacugaagccgug

SEQ ID NO: 1528336 - RNA, 16 nt, Homo sapiens
agaaaggacuguaaaa

SEQ ID NO: 1528337 - RNA, 14 nt, Homo sapiens
agaaauguguuauc

SEQ ID NO: 1528338 - RNA, 14 nt, Homo sapiens
agaaauuaguuuca

SEQ ID NO: 1528339 - RNA, 23 nt, Homo sapiens
agaaauuaguuucaaauuuaccu

SEQ ID NO: 1528340 - RNA, 20 nt, Homo sapiens
agaagcacccaggacuucca

SEQ ID NO: 1528341 - RNA, 16 nt, Homo sapiens
agaagcacggcugugg

SEQ ID NO: 1528342 - RNA, 18 nt, Homo sapiens
agacaaaccugggcaaug

SEQ ID NO: 1528343 - RNA, 19 nt, Homo sapiens
agacaauguuuucuucaac

SEQ ID NO: 1528344 - RNA, 15 nt, Homo sapiens
agacacaauauguau

SEQ ID NO: 1528345 - RNA, 15 nt, Homo sapiens
agacacuuuaccucu

SEQ ID NO: 1528346 - RNA, 17 nt, Homo sapiens
agacauacuaaccagca

SEQ ID NO: 1528347 - RNA, 21 nt, Homo sapiens
agaccucuccuuccuacccuc

SEQ ID NO: 1528348 - RNA, 15 nt, Homo sapiens
agacuccucuuccca

SEQ ID NO: 1528349 - RNA, 19 nt, Homo sapiens
agacuguggaaccaaagcu

SEQ ID NO: 1528350 - RNA, 20 nt, Homo sapiens
agagauggggucucacagug

SEQ ID NO: 1528351 - RNA, 16 nt, Homo sapiens
agagcaggacugcaca

SEQ ID NO: 1528352 - RNA, 13 nt, Homo sapiens
agaggcucugaga

SEQ ID NO: 1528353 - RNA, 15 nt, Homo sapiens
agauaauacaccacu

SEQ ID NO: 1528354 - RNA, 21 nt, Homo sapiens
agauauuuugcuuugugauuu

SEQ ID NO: 1528355 - RNA, 14 nt, Homo sapiens
agaucaucagucac

SEQ ID NO: 1528356 - RNA, 21 nt, Homo sapiens
agauccuggaaacagcagugu

SEQ ID NO: 1528357 - RNA, 23 nt, Homo sapiens
agaugccgcggaaggucccucag

SEQ ID NO: 1528358 - RNA, 15 nt, Homo sapiens
agcaaaucacgacca

SEQ ID NO: 1528359 - RNA, 20 nt, Homo sapiens
agcaaauggcagaaccaaag

SEQ ID NO: 1528360 - RNA, 12 nt, Homo sapiens
agcaacauuugu

SEQ ID NO: 1528361 - RNA, 23 nt, Homo sapiens
agcacagcucuccuccuccaucu

SEQ ID NO: 1528362 - RNA, 20 nt, Homo sapiens
agcacuagagaaugcacaga

SEQ ID NO: 1528363 - RNA, 19 nt, Homo sapiens
agcauaaauaaaacugaau

SEQ ID NO: 1528364 - RNA, 15 nt, Homo sapiens
agcaucagcacagcu

SEQ ID NO: 1528365 - RNA, 16 nt, Homo sapiens
agcaucucugccucca

SEQ ID NO: 1528366 - RNA, 20 nt, Homo sapiens
agccacuagcccacucccca

SEQ ID NO: 1528367 - RNA, 17 nt, Homo sapiens
agccauuaaaugaauau

SEQ ID NO: 1528368 - RNA, 18 nt, Homo sapiens
agcccacagcacaccaag

SEQ ID NO: 1528369 - RNA, 12 nt, Homo sapiens
agcccucugugg

SEQ ID NO: 1528370 - RNA, 16 nt, Homo sapiens
guacuuauguugcaca

SEQ ID NO: 1528371 - RNA, 20 nt, Homo sapiens
guacuuauguugcacaauga

SEQ ID NO: 1528372 - RNA, 22 nt, Homo sapiens
guagagggaguugucaagucuc

SEQ ID NO: 1528373 - RNA, 14 nt, Homo sapiens
guauuauaccuuuu

SEQ ID NO: 1528374 - RNA, 17 nt, Homo sapiens
guauuauuuuacaauca

SEQ ID NO: 1528375 - RNA, 12 nt, Homo sapiens
guauugacugua

SEQ ID NO: 1528376 - RNA, 15 nt, Homo sapiens
guauuggaaauggau

SEQ ID NO: 1528377 - RNA, 20 nt, Homo sapiens
gucaagaagaggaaagggag

SEQ ID NO: 1528378 - RNA, 20 nt, Homo sapiens
gucccggggcuccacugaac

SEQ ID NO: 1528379 - RNA, 17 nt, Homo sapiens
guccugccucagccucc

SEQ ID NO: 1528380 - RNA, 15 nt, Homo sapiens
gucggaaaacaugcu

SEQ ID NO: 1528381 - RNA, 13 nt, Homo sapiens
gucucgcuuuguu

SEQ ID NO: 1528382 - RNA, 14 nt, Homo sapiens
gucucucucguauu

SEQ ID NO: 1528383 - RNA, 19 nt, Homo sapiens
gugaacuagggaagcucag

SEQ ID NO: 1528384 - RNA, 12 nt, Homo sapiens
gugaaugcuucu

SEQ ID NO: 1528385 - RNA, 20 nt, Homo sapiens
gugccugguucgugccaugc

SEQ ID NO: 1528386 - RNA, 18 nt, Homo sapiens
gugggcagagccuuccac

SEQ ID NO: 1528387 - RNA, 19 nt, Homo sapiens
guggguuugggguggggaa

SEQ ID NO: 1528388 - RNA, 14 nt, Homo sapiens
gugugugcaugugc

SEQ ID NO: 1528389 - RNA, 17 nt, Homo sapiens
guguugccagugcuaag

SEQ ID NO: 1528390 - RNA, 18 nt, Homo sapiens
guuaaggguuaguuuaca

SEQ ID NO: 1528391 - RNA, 15 nt, Homo sapiens
guuccucuuugcccu

SEQ ID NO: 1528392 - RNA, 12 nt, Homo sapiens
guucucugccaa

SEQ ID NO: 1528393 - RNA, 21 nt, Homo sapiens
guucuuauauaagaucacuga

SEQ ID NO: 1528394 - RNA, 16 nt, Homo sapiens
guugaggcugucacag

SEQ ID NO: 1528395 - RNA, 19 nt, Homo sapiens
guuucccuggugcccuucc

SEQ ID NO: 1528396 - RNA, 18 nt, Homo sapiens
guuuguccuugcaccuga

SEQ ID NO: 1528397 - RNA, 23 nt, Homo sapiens
guuuuguagagauggggucucac

SEQ ID NO: 1528398 - RNA, 13 nt, Homo sapiens
guuuuuacuguga

SEQ ID NO: 1528399 - RNA, 13 nt, Homo sapiens
uaaaaauguccug

SEQ ID NO: 1528400 - RNA, 15 nt, Homo sapiens
uaaaacuaagcacaa

SEQ ID NO: 1528401 - RNA, 15 nt, Homo sapiens
uaaaacugaaucuca

SEQ ID NO: 1528402 - RNA, 15 nt, Homo sapiens
uaaaauuaccagaca

SEQ ID NO: 1528403 - RNA, 22 nt, Homo sapiens
uaaacuucaccuacauuaucuc

SEQ ID NO: 1528404 - RNA, 18 nt, Homo sapiens
uaacuaugagccaggcau

SEQ ID NO: 1528405 - RNA, 19 nt, Homo sapiens
uaagaaaaaggaugcacag

SEQ ID NO: 1528406 - RNA, 20 nt, Homo sapiens
uaaggguuaguuuacaauca

SEQ ID NO: 1528407 - RNA, 20 nt, Homo sapiens
uaaguuuuuguaaaaggaaa

SEQ ID NO: 1528408 - RNA, 13 nt, Homo sapiens
uaauaacuuugaa

SEQ ID NO: 1528409 - RNA, 19 nt, Homo sapiens
uaauacauugaucaggcca

SEQ ID NO: 1528410 - RNA, 17 nt, Homo sapiens
uaaucccaacacuuuga

SEQ ID NO: 1528411 - RNA, 19 nt, Homo sapiens
uaaucccaacacuuugaga

SEQ ID NO: 1528412 - RNA, 21 nt, Homo sapiens
uaauucacagaauagcacaaa

SEQ ID NO: 1528413 - RNA, 14 nt, Homo sapiens
uaauucagcacuua

SEQ ID NO: 1528414 - RNA, 20 nt, Homo sapiens
uacaaucagccacauucuag

SEQ ID NO: 1528415 - RNA, 13 nt, Homo sapiens
uacaauugugagc

SEQ ID NO: 1528416 - RNA, 16 nt, Homo sapiens
uacauuaucucacuua

SEQ ID NO: 1528417 - RNA, 17 nt, Homo sapiens
uaccauuuuucauucac

SEQ ID NO: 1528418 - RNA, 22 nt, Homo sapiens
uaccccacacacaguccaacuc

SEQ ID NO: 1528419 - RNA, 20 nt, Homo sapiens
uaccuugaacucuuagugau

SEQ ID NO: 1528420 - RNA, 20 nt, Homo sapiens
uacgacccuuuugagccuag

SEQ ID NO: 1528421 - RNA, 21 nt, Homo sapiens
uacgauggaggccuaccucuc

SEQ ID NO: 1528422 - RNA, 22 nt, Homo sapiens
uacuccuuuugccacugcugug

SEQ ID NO: 1528423 - RNA, 13 nt, Homo sapiens
uacugaagggaac

SEQ ID NO: 1528424 - RNA, 15 nt, Homo sapiens
uacuuauguugcaca

SEQ ID NO: 1528425 - RNA, 16 nt, Homo sapiens
uacuuggaacuaggcu

SEQ ID NO: 1528426 - RNA, 16 nt, Homo sapiens
uagacacuuuaccucu

SEQ ID NO: 1528427 - RNA, 17 nt, Homo sapiens
uagacacuuuaccucuu

SEQ ID NO: 1528428 - RNA, 16 nt, Homo sapiens
uagagcugcagggugg

SEQ ID NO: 1528429 - RNA, 12 nt, Homo sapiens
uagauacuguau

SEQ ID NO: 1528430 - RNA, 14 nt, Homo sapiens
uagauauaugccuu

SEQ ID NO: 1528431 - RNA, 17 nt, Homo sapiens
uagaugcaugacuugug

SEQ ID NO: 1528432 - RNA, 21 nt, Homo sapiens
uagcacgggauucaugcagug

SEQ ID NO: 1528433 - RNA, 20 nt, Homo sapiens
uagccucugggaucugccaa

SEQ ID NO: 1528434 - RNA, 20 nt, Homo sapiens
uagguaggggcccacuucac

SEQ ID NO: 1528435 - RNA, 20 nt, Homo sapiens
uaguauuuaacgaagccuag

SEQ ID NO: 1528436 - RNA, 21 nt, Homo sapiens
uuguuucccaucagacuguca

SEQ ID NO: 1528437 - RNA, 21 nt, Homo sapiens
uuuaagaaaaaggaugcacag

SEQ ID NO: 1528438 - RNA, 19 nt, Homo sapiens
uuuaagguuuuuacuguga

SEQ ID NO: 1528439 - RNA, 15 nt, Homo sapiens
uuucaaauuggcacu

SEQ ID NO: 1528440 - RNA, 21 nt, Homo sapiens
uuucccagucccauuccucag

SEQ ID NO: 1528441 - RNA, 19 nt, Homo sapiens
uuucuggcuaugcauuuga

SEQ ID NO: 1528442 - RNA, 17 nt, Homo sapiens
uuugagguaaagauaug

SEQ ID NO: 1528443 - RNA, 19 nt, Homo sapiens
uuugcccugaggcucaguc

SEQ ID NO: 1528444 - RNA, 21 nt, Homo sapiens
uuugggaagcucccacaccca

SEQ ID NO: 1528445 - RNA, 19 nt, Homo sapiens
uuugguagaugcaugacuu

SEQ ID NO: 1528446 - RNA, 22 nt, Homo sapiens
uuuuaagaagacauacugcuug

SEQ ID NO: 1528447 - RNA, 23 nt, Homo sapiens
uuuuacaauaaaacuuugcugcc

SEQ ID NO: 1528448 - RNA, 19 nt, Homo sapiens
uuuuauggcuuuugugcau

SEQ ID NO: 1528449 - RNA, 16 nt, Homo sapiens
uuuuuguaaacuggaa

SEQ ID NO: 1528450 - RNA, 15 nt, Homo sapiens
cagcuagugccuuua

SEQ ID NO: 1528451 - RNA, 19 nt, Homo sapiens
cagcuggaagggucaacau

SEQ ID NO: 1528452 - RNA, 21 nt, Homo sapiens
cagcuggaagggucaacaucu

SEQ ID NO: 1528453 - RNA, 21 nt, Homo sapiens
cagcuggcggguguggagacc

SEQ ID NO: 1528454 - RNA, 21 nt, Homo sapiens
cagcugugcacuuucuucucu

SEQ ID NO: 1528455 - RNA, 17 nt, Homo sapiens
cagcuucuucacaggca

SEQ ID NO: 1528456 - RNA, 19 nt, Homo sapiens
caguccugccucagccucc

SEQ ID NO: 1528457 - RNA, 20 nt, Homo sapiens
cagugaaugugucuggaccu

SEQ ID NO: 1528458 - RNA, 15 nt, Homo sapiens
cauaaugcgugcaua

SEQ ID NO: 1528459 - RNA, 17 nt, Homo sapiens
cauaucccuuccucuca

SEQ ID NO: 1528460 - RNA, 19 nt, Homo sapiens
caucagacugucaagaaga

SEQ ID NO: 1528461 - RNA, 24 nt, Homo sapiens
cauccuuaaaacaauucugugaca

SEQ ID NO: 1528462 - RNA, 17 nt, Homo sapiens
caucucagacuguggaa

SEQ ID NO: 1528463 - RNA, 19 nt, Homo sapiens
caucucugugauuaccucu

SEQ ID NO: 1528464 - RNA, 14 nt, Homo sapiens
caucucuuguauau

SEQ ID NO: 1528465 - RNA, 19 nt, Homo sapiens
caugcacuuuauguggaga

SEQ ID NO: 1528466 - RNA, 17 nt, Homo sapiens
cauguauguuaugauau

SEQ ID NO: 1528467 - RNA, 16 nt, Homo sapiens
cauuaaggaauuugau

SEQ ID NO: 1528468 - RNA, 11 nt, Homo sapiens
cauuuuugcug

SEQ ID NO: 1528469 - RNA, 19 nt, Homo sapiens
ccaaaauauuuuuugcaag

SEQ ID NO: 1528470 - RNA, 13 nt, Homo sapiens
ccaacacuuugag

SEQ ID NO: 1528471 - RNA, 13 nt, Homo sapiens
ccaacuuuugcau

SEQ ID NO: 1528472 - RNA, 20 nt, Homo sapiens
ccacacacaguccaacucuu

SEQ ID NO: 1528473 - RNA, 14 nt, Homo sapiens
ccacaccaagcagc

SEQ ID NO: 1528474 - RNA, 17 nt, Homo sapiens
ccacagugguacucugu

SEQ ID NO: 1528475 - RNA, 17 nt, Homo sapiens
ccacgauucucccaaag

SEQ ID NO: 1528476 - RNA, 22 nt, Homo sapiens
ccacguccagcuggaaggguca

SEQ ID NO: 1528477 - RNA, 14 nt, Homo sapiens
ccacuccccaguug

SEQ ID NO: 1528478 - RNA, 15 nt, Homo sapiens
ccagacaauuccauu

SEQ ID NO: 1528479 - RNA, 22 nt, Homo sapiens
ccagauccuggaaacagcagug

SEQ ID NO: 1528480 - RNA, 19 nt, Homo sapiens
ccagcugugcacuuucuuc

SEQ ID NO: 1528481 - RNA, 21 nt, Homo sapiens
ccagucccagacaauuccauu

SEQ ID NO: 1528482 - RNA, 21 nt, Homo sapiens
ccagugcuaagcugcccugag

SEQ ID NO: 1528483 - RNA, 22 nt, Homo sapiens
ccaguggagacggaaucugccg

SEQ ID NO: 1528484 - RNA, 18 nt, Homo sapiens
ccauuccucagcuucuuc

SEQ ID NO: 1528485 - RNA, 19 nt, Homo sapiens
cccagcaguucucugccaa

SEQ ID NO: 1528486 - RNA, 20 nt, Homo sapiens
cccagccaaacccugucuga

SEQ ID NO: 1528487 - RNA, 19 nt, Homo sapiens
cccagucccagacaauucc

SEQ ID NO: 1528488 - RNA, 15 nt, Homo sapiens
cccagucccauuccu

SEQ ID NO: 1528489 - RNA, 23 nt, Homo sapiens
cccauaucugugaaaugcuggca

SEQ ID NO: 1528490 - RNA, 12 nt, Homo sapiens
ccccagucccag

SEQ ID NO: 1528491 - RNA, 15 nt, Homo sapiens
ccccaucuuuacaaa

SEQ ID NO: 1528492 - RNA, 12 nt, Homo sapiens
cccccuugaggg

SEQ ID NO: 1528493 - RNA, 19 nt, Homo sapiens
cccucuguagccacuagua

SEQ ID NO: 1528494 - RNA, 15 nt, Homo sapiens
cccuggccuagcaua

SEQ ID NO: 1528495 - RNA, 12 nt, Homo sapiens
cccuguagggug

SEQ ID NO: 1528496 - RNA, 13 nt, Homo sapiens
ccggaggaaccga

SEQ ID NO: 1528497 - RNA, 16 nt, Homo sapiens
ccggggcuccacugaa

SEQ ID NO: 1528498 - RNA, 15 nt, Homo sapiens
aauuccuugcacaua

SEQ ID NO: 1528499 - RNA, 11 nt, Homo sapiens
aauucugugac

SEQ ID NO: 1528500 - RNA, 17 nt, Homo sapiens
aauuggaacaaagugaa

SEQ ID NO: 1528501 - RNA, 14 nt, Homo sapiens
aauuuacuggccac

SEQ ID NO: 1528502 - RNA, 15 nt, Homo sapiens
aauuucaaaccacac

SEQ ID NO: 1528503 - RNA, 18 nt, Homo sapiens
aauuuucauucauucacu

SEQ ID NO: 1528504 - RNA, 12 nt, Homo sapiens
acaaaaugguca

SEQ ID NO: 1528505 - RNA, 16 nt, Homo sapiens
acaaaauggucaucca

SEQ ID NO: 1528506 - RNA, 20 nt, Homo sapiens
acaaaauggucauccaaacu

SEQ ID NO: 1528507 - RNA, 21 nt, Homo sapiens
acaaguauuauuuuacaauca

SEQ ID NO: 1528508 - RNA, 16 nt, Homo sapiens
acaaucaacaaaaugg

SEQ ID NO: 1528509 - RNA, 13 nt, Homo sapiens
acacaguccaacu

SEQ ID NO: 1528510 - RNA, 17 nt, Homo sapiens
acacccaccucugccac

SEQ ID NO: 1528511 - RNA, 21 nt, Homo sapiens
acaccuuuucuauuuaccucc

SEQ ID NO: 1528512 - RNA, 19 nt, Homo sapiens
acagaaaguaucacaaaug

SEQ ID NO: 1528513 - RNA, 13 nt, Homo sapiens
acagagugcauug

SEQ ID NO: 1528514 - RNA, 23 nt, Homo sapiens
acagccucccacccccaucucuc

SEQ ID NO: 1528515 - RNA, 22 nt, Homo sapiens
acagcucuccuccuccaucuca

SEQ ID NO: 1528516 - RNA, 14 nt, Homo sapiens
acaggcagcucuga

SEQ ID NO: 1528517 - RNA, 14 nt, Homo sapiens
acaguguugcccag

SEQ ID NO: 1528518 - RNA, 17 nt, Homo sapiens
acauacauauuaucuca

SEQ ID NO: 1528519 - RNA, 13 nt, Homo sapiens
acauauuaucuca

SEQ ID NO: 1528520 - RNA, 15 nt, Homo sapiens
acaucugucuuucau

SEQ ID NO: 1528521 - RNA, 17 nt, Homo sapiens
acaucuuuuacauucug

SEQ ID NO: 1528522 - RNA, 20 nt, Homo sapiens
acauguuauuuaaccugagu

SEQ ID NO: 1528523 - RNA, 17 nt, Homo sapiens
accacgauucucccaaa

SEQ ID NO: 1528524 - RNA, 16 nt, Homo sapiens
accagaggugcuucug

SEQ ID NO: 1528525 - RNA, 20 nt, Homo sapiens
accauagggacccauucuac

SEQ ID NO: 1528526 - RNA, 14 nt, Homo sapiens
accaucucugugau

SEQ ID NO: 1528527 - RNA, 19 nt, Homo sapiens
accaucucugugauuaccu

SEQ ID NO: 1528528 - RNA, 18 nt, Homo sapiens
accgagguguugccagug

SEQ ID NO: 1528529 - RNA, 15 nt, Homo sapiens
accguaaauguccau

SEQ ID NO: 1528530 - RNA, 17 nt, Homo sapiens
accuauccgcccugcag

SEQ ID NO: 1528531 - RNA, 18 nt, Homo sapiens
accuuuuuuauacauaaa

SEQ ID NO: 1528532 - RNA, 19 nt, Homo sapiens
acgugcuauuuuacauauc

SEQ ID NO: 1528533 - RNA, 21 nt, Homo sapiens
acguggccaggagccaugaca

SEQ ID NO: 1528534 - RNA, 12 nt, Homo sapiens
acuaagcacaaa

SEQ ID NO: 1528535 - RNA, 23 nt, Homo sapiens
acuaggcucuuaugugugccuuu

SEQ ID NO: 1528536 - RNA, 15 nt, Homo sapiens
acuagggaagcucag

SEQ ID NO: 1528537 - RNA, 16 nt, Homo sapiens
acuauuacgugcuauu

SEQ ID NO: 1528538 - RNA, 19 nt, Homo sapiens
acugaagggaacagccuga

SEQ ID NO: 1528539 - RNA, 17 nt, Homo sapiens
acuggcuucucuugagu

SEQ ID NO: 1528540 - RNA, 12 nt, Homo sapiens
acuguacaugaa

SEQ ID NO: 1528541 - RNA, 22 nt, Homo sapiens
acuucaguuuuauuuuugccaa

SEQ ID NO: 1528542 - RNA, 20 nt, Homo sapiens
acuugagaaaauaucuugcu

SEQ ID NO: 1528543 - RNA, 12 nt, Homo sapiens
acuuuaccucuu

SEQ ID NO: 1528544 - RNA, 15 nt, Homo sapiens
acuuugaagccauaa

SEQ ID NO: 1528545 - RNA, 23 nt, Homo sapiens
acuuugaccucugcagcaauaaa

SEQ ID NO: 1528546 - RNA, 21 nt, Homo sapiens
agaaaaacaccgcuucugccu

SEQ ID NO: 1528547 - RNA, 21 nt, Homo sapiens
agugccugcugggugccaggu

SEQ ID NO: 1528548 - RNA, 17 nt, Homo sapiens
agugcugggauuacaau

SEQ ID NO: 1528549 - RNA, 15 nt, Homo sapiens
agugcuguccaugcu

SEQ ID NO: 1528550 - RNA, 17 nt, Homo sapiens
aguggcaccagaggugc

SEQ ID NO: 1528551 - RNA, 14 nt, Homo sapiens
aguuaauucaccua

SEQ ID NO: 1528552 - RNA, 15 nt, Homo sapiens
aguuaauucaccuau

SEQ ID NO: 1528553 - RNA, 20 nt, Homo sapiens
aguucacagccuagaagaag

SEQ ID NO: 1528554 - RNA, 13 nt, Homo sapiens
aguucucugccaa

SEQ ID NO: 1528555 - RNA, 20 nt, Homo sapiens
aguuggcccuucugcccuua

SEQ ID NO: 1528556 - RNA, 20 nt, Homo sapiens
aguuuucuggagugagcacu

SEQ ID NO: 1528557 - RNA, 22 nt, Homo sapiens
aguuuuuauggcuuuugugcau

SEQ ID NO: 1528558 - RNA, 20 nt, Homo sapiens
auaaaaauaaaucaguucau

SEQ ID NO: 1528559 - RNA, 14 nt, Homo sapiens
auaaaacugaaucu

SEQ ID NO: 1528560 - RNA, 17 nt, Homo sapiens
auaaauuguagggcuuu

SEQ ID NO: 1528561 - RNA, 21 nt, Homo sapiens
auaaugcgugcauaccacuuu

SEQ ID NO: 1528562 - RNA, 22 nt, Homo sapiens
auacagcccugacgcaaugaaa

SEQ ID NO: 1528563 - RNA, 20 nt, Homo sapiens
auacaucuguggacaagaca

SEQ ID NO: 1528564 - RNA, 23 nt, Homo sapiens
auacauucccucuaauuugaacu

SEQ ID NO: 1528565 - RNA, 22 nt, Homo sapiens
auagggagacccccaucuuuac

SEQ ID NO: 1528566 - RNA, 22 nt, Homo sapiens
auaguauuuaacgaagccuaga

SEQ ID NO: 1528567 - RNA, 16 nt, Homo sapiens
auaucaguaccucuca

SEQ ID NO: 1528568 - RNA, 18 nt, Homo sapiens
auaucccuuccucucagg

SEQ ID NO: 1528569 - RNA, 13 nt, Homo sapiens
auaucgaucucuu

SEQ ID NO: 1528570 - RNA, 15 nt, Homo sapiens
auaugaaggauuacu

SEQ ID NO: 1528571 - RNA, 18 nt, Homo sapiens
aucaagaaaaacaucuuu

SEQ ID NO: 1528572 - RNA, 19 nt, Homo sapiens
aucaauuggcagugacuuu

SEQ ID NO: 1528573 - RNA, 18 nt, Homo sapiens
aucauaauucagcacuua

SEQ ID NO: 1528574 - RNA, 19 nt, Homo sapiens
aucuaguuucccuggugcc

SEQ ID NO: 1528575 - RNA, 16 nt, Homo sapiens
aucucaccccauccca

SEQ ID NO: 1528576 - RNA, 12 nt, Homo sapiens
aucucagcacuu

SEQ ID NO: 1528577 - RNA, 20 nt, Homo sapiens
aucuccaaaauaaaacuuuu

SEQ ID NO: 1528578 - RNA, 17 nt, Homo sapiens
aucucuuauuuuacaau

SEQ ID NO: 1528579 - RNA, 18 nt, Homo sapiens
aucugcauuuucacccca

SEQ ID NO: 1528580 - RNA, 12 nt, Homo sapiens
aucugucuuuca

SEQ ID NO: 1528581 - RNA, 18 nt, Homo sapiens
aucugucuuucaucuccc

SEQ ID NO: 1528582 - RNA, 22 nt, Homo sapiens
aucuucagggaacugcauagau

SEQ ID NO: 1528583 - RNA, 20 nt, Homo sapiens
augaaggauuacucuccaua

SEQ ID NO: 1528584 - RNA, 13 nt, Homo sapiens
augaggcauuugu

SEQ ID NO: 1528585 - RNA, 14 nt, Homo sapiens
augcucagggucaa

SEQ ID NO: 1528586 - RNA, 23 nt, Homo sapiens
augcuggcccuacaguaccccca

SEQ ID NO: 1528587 - RNA, 17 nt, Homo sapiens
augcuuaaacuaaauaa

SEQ ID NO: 1528588 - RNA, 15 nt, Homo sapiens
augcuuguacauaau

SEQ ID NO: 1528589 - RNA, 18 nt, Homo sapiens
auggaaacauuacaguuc

SEQ ID NO: 1528590 - RNA, 17 nt, Homo sapiens
auggaggccuaccucuc

SEQ ID NO: 1528591 - RNA, 15 nt, Homo sapiens
auggcuuuugugcau

SEQ ID NO: 1528592 - RNA, 16 nt, Homo sapiens
auggcuuuugugcauu

SEQ ID NO: 1528593 - RNA, 18 nt, Homo sapiens
augggcagggaaggaauc

SEQ ID NO: 1528594 - RNA, 21 nt, Homo sapiens
auguagccagcugugcacuuu

SEQ ID NO: 1528595 - RNA, 16 nt, Homo sapiens
acagaauaauccagua

SEQ ID NO: 1528596 - RNA, 15 nt, Homo sapiens
acagaauagcacaaa

SEQ ID NO: 1528597 - RNA, 18 nt, Homo sapiens
acagagcaggacugcaca

SEQ ID NO: 1528598 - RNA, 17 nt, Homo sapiens
acagagugcauugugag

SEQ ID NO: 1528599 - RNA, 17 nt, Homo sapiens
acagggccacaacugcc

SEQ ID NO: 1528600 - RNA, 13 nt, Homo sapiens
acauacauucccu

SEQ ID NO: 1528601 - RNA, 15 nt, Homo sapiens
acaucugcauuuuca

SEQ ID NO: 1528602 - RNA, 22 nt, Homo sapiens
acaucuggccuugaaaccaccu

SEQ ID NO: 1528603 - RNA, 19 nt, Homo sapiens
acaucugucuuucaucucc

SEQ ID NO: 1528604 - RNA, 20 nt, Homo sapiens
acaucuguggacaagacaug

SEQ ID NO: 1528605 - RNA, 13 nt, Homo sapiens
acaucuuuuacau

SEQ ID NO: 1528606 - RNA, 19 nt, Homo sapiens
acaucuuuuacauucugca

SEQ ID NO: 1528607 - RNA, 17 nt, Homo sapiens
acauuaaggaauuugau

SEQ ID NO: 1528608 - RNA, 12 nt, Homo sapiens
acauuaucucac

SEQ ID NO: 1528609 - RNA, 22 nt, Homo sapiens
acauucccucuaauuugaacug

SEQ ID NO: 1528610 - RNA, 14 nt, Homo sapiens
acauucuguuaauc

SEQ ID NO: 1528611 - RNA, 21 nt, Homo sapiens
accaucucugugauuaccucu

SEQ ID NO: 1528612 - RNA, 14 nt, Homo sapiens
acccaccucugcca

SEQ ID NO: 1528613 - RNA, 14 nt, Homo sapiens
acccagcaguucuc

SEQ ID NO: 1528614 - RNA, 17 nt, Homo sapiens
acccauucuacacagag

SEQ ID NO: 1528615 - RNA, 18 nt, Homo sapiens
acccauucuacacagagc

SEQ ID NO: 1528616 - RNA, 21 nt, Homo sapiens
acccccaucuuuacaaagaaa

SEQ ID NO: 1528617 - RNA, 15 nt, Homo sapiens
acccccuccacaaag

SEQ ID NO: 1528618 - RNA, 14 nt, Homo sapiens
accccgccaugcau

SEQ ID NO: 1528619 - RNA, 15 nt, Homo sapiens
acccuggaaauggac

SEQ ID NO: 1528620 - RNA, 15 nt, Homo sapiens
accuacauuaucuca

SEQ ID NO: 1528621 - RNA, 15 nt, Homo sapiens
accucaaaucacugc

SEQ ID NO: 1528622 - RNA, 13 nt, Homo sapiens
accucccaccuau

SEQ ID NO: 1528623 - RNA, 17 nt, Homo sapiens
accugugccuccucaga

SEQ ID NO: 1528624 - RNA, 23 nt, Homo sapiens
accuuuccaguuuauaagacugg

SEQ ID NO: 1528625 - RNA, 19 nt, Homo sapiens
accuuuucuauuuaccucc

SEQ ID NO: 1528626 - RNA, 13 nt, Homo sapiens
acggaaucugccg

SEQ ID NO: 1528627 - RNA, 20 nt, Homo sapiens
acuaaaagcagcgucacucu

SEQ ID NO: 1528628 - RNA, 13 nt, Homo sapiens
acuaagcacaaag

SEQ ID NO: 1528629 - RNA, 13 nt, Homo sapiens
acuaaucaagaaa

SEQ ID NO: 1528630 - RNA, 11 nt, Homo sapiens
acucagcagug

SEQ ID NO: 1528631 - RNA, 17 nt, Homo sapiens
acucagggagcauuuaa

SEQ ID NO: 1528632 - RNA, 15 nt, Homo sapiens
acucuuaacacuaag

SEQ ID NO: 1528633 - RNA, 19 nt, Homo sapiens
acugaguacguugugcauu

SEQ ID NO: 1528634 - RNA, 15 nt, Homo sapiens
acugauagaugucua

SEQ ID NO: 1528635 - RNA, 10 nt, Homo sapiens
acugccagug

SEQ ID NO: 1528636 - RNA, 19 nt, Homo sapiens
acuggcuucucuugaguca

SEQ ID NO: 1528637 - RNA, 21 nt, Homo sapiens
acuggcuucucuugagucaca

SEQ ID NO: 1528638 - RNA, 16 nt, Homo sapiens
acuguaauuugugaua

SEQ ID NO: 1528639 - RNA, 19 nt, Homo sapiens
acuuacucuuuaaccagga

SEQ ID NO: 1528640 - RNA, 14 nt, Homo sapiens
acuucaccuacauu

SEQ ID NO: 1528641 - RNA, 20 nt, Homo sapiens
acuucaccuacauuaucuca

SEQ ID NO: 1528642 - RNA, 14 nt, Homo sapiens
acuuccauuugcuu

SEQ ID NO: 1528643 - RNA, 15 nt, Homo sapiens
acuuguuuuaugcuc

SEQ ID NO: 1528644 - RNA, 12 nt, Homo sapiens
acuuuaccuuuu

SEQ ID NO: 1528645 - RNA, 19 nt, Homo sapiens
acuuucuucucuuucccaa

SEQ ID NO: 1528646 - RNA, 13 nt, Homo sapiens
acuuugaccucug

SEQ ID NO: 1528647 - RNA, 17 nt, Homo sapiens
agaaaaaggaugcacag

SEQ ID NO: 1528648 - RNA, 16 nt, Homo sapiens
agaacuacgcacagcu

SEQ ID NO: 1528649 - RNA, 14 nt, Homo sapiens
agaacuugaccccc

SEQ ID NO: 1528650 - RNA, 20 nt, Homo sapiens
agaagcuuaaaaucugugaa

SEQ ID NO: 1528651 - RNA, 19 nt, Homo sapiens
agaauaauggaaacauuac

SEQ ID NO: 1528652 - RNA, 19 nt, Homo sapiens
agaaucccuuaaaauuacc

SEQ ID NO: 1528653 - RNA, 16 nt, Homo sapiens
agaauugguugccaua

SEQ ID NO: 1528654 - RNA, 19 nt, Homo sapiens
agacaaugacuuacuguac

SEQ ID NO: 1528655 - RNA, 23 nt, Homo sapiens
agacaccuuuucuauuuaccucc

SEQ ID NO: 1528656 - RNA, 20 nt, Homo sapiens
agacugaguacguugugcau

SEQ ID NO: 1528657 - RNA, 21 nt, Homo sapiens
agacugggucucgcuuuguug

SEQ ID NO: 1528658 - RNA, 22 nt, Homo sapiens
agagacucgcucacucccaugu

SEQ ID NO: 1528659 - RNA, 12 nt, Homo sapiens
agagucacaagu

SEQ ID NO: 1528660 - RNA, 17 nt, Homo sapiens
agauauugauuacuauc

SEQ ID NO: 1528661 - RNA, 13 nt, Homo sapiens
agaucacugaaga

SEQ ID NO: 1528662 - RNA, 21 nt, Homo sapiens
agaugcaugacuuguguguga

SEQ ID NO: 1528663 - RNA, 16 nt, Homo sapiens
agauggacuccagccu

SEQ ID NO: 1528664 - RNA, 22 nt, Homo sapiens
agauguaagaaauguucuugca

SEQ ID NO: 1528665 - RNA, 19 nt, Homo sapiens
agaugugaagccuggagcu

SEQ ID NO: 1528666 - RNA, 23 nt, Homo sapiens
agauugaucaaaguguaaacacc

SEQ ID NO: 1528667 - RNA, 18 nt, Homo sapiens
agcaaauggcagaaccaa

SEQ ID NO: 1528668 - RNA, 17 nt, Homo sapiens
agcacagcucuccuccu

SEQ ID NO: 1528669 - RNA, 15 nt, Homo sapiens
agcagacacccugug

SEQ ID NO: 1528670 - RNA, 14 nt, Homo sapiens
agcaguucucugcc

SEQ ID NO: 1528671 - RNA, 16 nt, Homo sapiens
agcaucuaguuucccu

SEQ ID NO: 1528672 - RNA, 23 nt, Homo sapiens
agccaacuuuugcauguuuugua

SEQ ID NO: 1528673 - RNA, 22 nt, Homo sapiens
agcccaagggcaucauccucag

SEQ ID NO: 1528674 - RNA, 14 nt, Homo sapiens
agccccucaugcca

SEQ ID NO: 1528675 - RNA, 20 nt, Homo sapiens
agcccugucccugcccucag

SEQ ID NO: 1528676 - RNA, 20 nt, Homo sapiens
agccuguucccacucagcag

SEQ ID NO: 1528677 - RNA, 17 nt, Homo sapiens
agccuuagagcaucucu

SEQ ID NO: 1528678 - RNA, 22 nt, Homo sapiens
agccuuagagcaucucugccuc

SEQ ID NO: 1528679 - RNA, 15 nt, Homo sapiens
agccuuccacaguga

SEQ ID NO: 1528680 - RNA, 14 nt, Homo sapiens
agccuuugccuccc

SEQ ID NO: 1528681 - RNA, 22 nt, Homo sapiens
agcgucacucuaccuaaugucu

SEQ ID NO: 1528682 - RNA, 18 nt, Homo sapiens
agcucagcauuuccacac

SEQ ID NO: 1528683 - RNA, 15 nt, Homo sapiens
agcucuccuccucca

SEQ ID NO: 1528684 - RNA, 20 nt, Homo sapiens
agcucuccuccuccaucuca

SEQ ID NO: 1528685 - RNA, 23 nt, Homo sapiens
agcuggaagggucaacaucuuuu

SEQ ID NO: 1528686 - RNA, 19 nt, Homo sapiens
agcugucccucacuguuga

SEQ ID NO: 1528687 - RNA, 18 nt, Homo sapiens
agcuuuuaaaaauguccu

SEQ ID NO: 1528688 - RNA, 21 nt, Homo sapiens
aggaaucauuccagugcuaga

SEQ ID NO: 1528689 - RNA, 13 nt, Homo sapiens
aggagccaugaca

SEQ ID NO: 1528690 - RNA, 20 nt, Homo sapiens
aggagcccccugagaguguc

SEQ ID NO: 1528691 - RNA, 13 nt, Homo sapiens
aggagcuacccuu

SEQ ID NO: 1528692 - RNA, 16 nt, Homo sapiens
aggcaaaaaacucuua

SEQ ID NO: 1528693 - RNA, 19 nt, Homo sapiens
aggcgauccaccugucuca

SEQ ID NO: 1528694 - RNA, 15 nt, Homo sapiens
agggcaucauccuca

SEQ ID NO: 1528695 - RNA, 20 nt, Homo sapiens
agguuccuuaucugucacac

SEQ ID NO: 1528696 - RNA, 17 nt, Homo sapiens
aguaauaugcacacauu

SEQ ID NO: 1528697 - RNA, 16 nt, Homo sapiens
aguacuuauguugcac

SEQ ID NO: 1528698 - RNA, 18 nt, Homo sapiens
aguagauauugauuacua

SEQ ID NO: 1528699 - RNA, 17 nt, Homo sapiens
aguagccucugggaucu

SEQ ID NO: 1528700 - RNA, 21 nt, Homo sapiens
aguagccucugggaucugcca

SEQ ID NO: 1528701 - RNA, 18 nt, Homo sapiens
aguauacuuuuccccugu

SEQ ID NO: 1528702 - RNA, 19 nt, Homo sapiens
aguauuuuuauccaugaca

SEQ ID NO: 1528703 - RNA, 21 nt, Homo sapiens
aguccaacucuuccaccucug

SEQ ID NO: 1528704 - RNA, 14 nt, Homo sapiens
aguccaauuccuug

SEQ ID NO: 1528705 - RNA, 20 nt, Homo sapiens
aguccaauuccuugcacaua

SEQ ID NO: 1528706 - RNA, 22 nt, Homo sapiens
agucccagacaauuccauucaa

SEQ ID NO: 1528707 - RNA, 18 nt, Homo sapiens
agugcuguccaugcuucu

SEQ ID NO: 1528708 - RNA, 20 nt, Homo sapiens
agugcuguccaugcuucuca

SEQ ID NO: 1528709 - RNA, 21 nt, Homo sapiens
agugcuguccaugcuucucau

SEQ ID NO: 1528710 - RNA, 19 nt, Homo sapiens
uagccucugggaucugcca

SEQ ID NO: 1528711 - RNA, 14 nt, Homo sapiens
uagggaagcucagg

SEQ ID NO: 1528712 - RNA, 14 nt, Homo sapiens
uagugucagccaug

SEQ ID NO: 1528713 - RNA, 18 nt, Homo sapiens
uauauuuuuggugguggu

SEQ ID NO: 1528714 - RNA, 16 nt, Homo sapiens
uaucuagauacuguau

SEQ ID NO: 1528715 - RNA, 11 nt, Homo sapiens
uaucugugaaa

SEQ ID NO: 1528716 - RNA, 22 nt, Homo sapiens
uaucugugaaaugcuggcauuu

SEQ ID NO: 1528717 - RNA, 22 nt, Homo sapiens
uaugagccaggcaucauacuaa

SEQ ID NO: 1528718 - RNA, 20 nt, Homo sapiens
uaugcaugaaguaauaugca

SEQ ID NO: 1528719 - RNA, 18 nt, Homo sapiens
uaugcucagggucaauuu

SEQ ID NO: 1528720 - RNA, 18 nt, Homo sapiens
uauggcuuuugugcauua

SEQ ID NO: 1528721 - RNA, 17 nt, Homo sapiens
uauguauaucauucuac

SEQ ID NO: 1528722 - RNA, 17 nt, Homo sapiens
uauuguguauguagccu

SEQ ID NO: 1528723 - RNA, 14 nt, Homo sapiens
ucaaaguuaauuca

SEQ ID NO: 1528724 - RNA, 19 nt, Homo sapiens
ucaacaaaauggucaucca

SEQ ID NO: 1528725 - RNA, 21 nt, Homo sapiens
ucaacaaaauggucauccaaa

SEQ ID NO: 1528726 - RNA, 16 nt, Homo sapiens
ucaagguuuaaccuua

SEQ ID NO: 1528727 - RNA, 17 nt, Homo sapiens
ucaaucuccuaaccuug

SEQ ID NO: 1528728 - RNA, 13 nt, Homo sapiens
ucacaaauggaau

SEQ ID NO: 1528729 - RNA, 16 nt, Homo sapiens
ucacaaguagccucug

SEQ ID NO: 1528730 - RNA, 15 nt, Homo sapiens
ucacaggcagcucug

SEQ ID NO: 1528731 - RNA, 17 nt, Homo sapiens
ucacccgacccgugcac

SEQ ID NO: 1528732 - RNA, 17 nt, Homo sapiens
ucaccuacauuaucuca

SEQ ID NO: 1528733 - RNA, 15 nt, Homo sapiens
ucaccuguuauguau

SEQ ID NO: 1528734 - RNA, 19 nt, Homo sapiens
ucagcauuuccacaccaag

SEQ ID NO: 1528735 - RNA, 15 nt, Homo sapiens
ucagggagcauuuaa

SEQ ID NO: 1528736 - RNA, 14 nt, Homo sapiens
ucaucucccagauc

SEQ ID NO: 1528737 - RNA, 17 nt, Homo sapiens
uccaaaguacacuguuu

SEQ ID NO: 1528738 - RNA, 19 nt, Homo sapiens
uccaaaguacacuguuuca

SEQ ID NO: 1528739 - RNA, 18 nt, Homo sapiens
uccaacucuuccaccucu

SEQ ID NO: 1528740 - RNA, 17 nt, Homo sapiens
uccaauuccuugcacau

SEQ ID NO: 1528741 - RNA, 18 nt, Homo sapiens
uccaauuccuugcacaua

SEQ ID NO: 1528742 - RNA, 19 nt, Homo sapiens
uccaauuccuugcacauag

SEQ ID NO: 1528743 - RNA, 14 nt, Homo sapiens
uccacacccagcuc

SEQ ID NO: 1528744 - RNA, 19 nt, Homo sapiens
uccauucuguagacuuuug

SEQ ID NO: 1528745 - RNA, 15 nt, Homo sapiens
ucccaaccccaggaa

SEQ ID NO: 1528746 - RNA, 16 nt, Homo sapiens
ucccacacccaccucu

SEQ ID NO: 1528747 - RNA, 21 nt, Homo sapiens
ucccacacccaccucugccac

SEQ ID NO: 1528748 - RNA, 14 nt, Homo sapiens
ucccgcagggcuga

SEQ ID NO: 1528749 - RNA, 19 nt, Homo sapiens
ucccugucauagagcugca

SEQ ID NO: 1528750 - RNA, 17 nt, Homo sapiens
ucccuuuuuauauccca

SEQ ID NO: 1528751 - RNA, 13 nt, Homo sapiens
uccgaggccagua

SEQ ID NO: 1528752 - RNA, 15 nt, Homo sapiens
uccgaggccaguacc

SEQ ID NO: 1528753 - RNA, 18 nt, Homo sapiens
uccuaguggaugacuguu

SEQ ID NO: 1528754 - RNA, 16 nt, Homo sapiens
uccucagaggacaguu

SEQ ID NO: 1528755 - RNA, 21 nt, Homo sapiens
uccuuaaaacaauucugugac

SEQ ID NO: 1528756 - RNA, 15 nt, Homo sapiens
uccuuaucugucaca

SEQ ID NO: 1528757 - RNA, 21 nt, Homo sapiens
uccuuauuuugugugcuuucc

SEQ ID NO: 1528758 - RNA, 16 nt, Homo sapiens
uccuugcacauaguag

SEQ ID NO: 1528759 - RNA, 19 nt, Homo sapiens
uccuugcaccugagccugu

SEQ ID NO: 1528760 - RNA, 17 nt, Homo sapiens
uccuuuuuaaaugacuu

SEQ ID NO: 1528761 - RNA, 16 nt, Homo sapiens
ucgcuuuguugcccag

SEQ ID NO: 1528762 - RNA, 14 nt, Homo sapiens
ucgggacucagauu

SEQ ID NO: 1528763 - RNA, 14 nt, Homo sapiens
ucuaugacacaugc

SEQ ID NO: 1528764 - RNA, 13 nt, Homo sapiens
ucuauuuaccucc

SEQ ID NO: 1528765 - RNA, 18 nt, Homo sapiens
ucucacaguguugcccag

SEQ ID NO: 1528766 - RNA, 19 nt, Homo sapiens
ucuccacuucuuguucccc

SEQ ID NO: 1528767 - RNA, 15 nt, Homo sapiens
ucucccaggucccag

SEQ ID NO: 1528768 - RNA, 15 nt, Homo sapiens
ucuccuucacaucag

SEQ ID NO: 1528769 - RNA, 23 nt, Homo sapiens
ucuccuuugaaaccugcucugua

SEQ ID NO: 1528770 - RNA, 12 nt, Homo sapiens
ucucgcuuuguu

SEQ ID NO: 1528771 - RNA, 21 nt, Homo sapiens
ucucuggggcaggcugcuuca

SEQ ID NO: 1528772 - RNA, 18 nt, Homo sapiens
ucucugugauuaccucuc

SEQ ID NO: 1528773 - RNA, 19 nt, Homo sapiens
ucugcccaccccagcauca

SEQ ID NO: 1528774 - RNA, 17 nt, Homo sapiens
ucugcuguacauuauua

SEQ ID NO: 1528775 - RNA, 12 nt, Homo sapiens
ucuggaggucau

SEQ ID NO: 1528776 - RNA, 18 nt, Homo sapiens
ucuggcaggcuacucugc

SEQ ID NO: 1528777 - RNA, 20 nt, Homo sapiens
ucuggccuugaaaccaccuu

SEQ ID NO: 1528778 - RNA, 18 nt, Homo sapiens
ucugucacguucuccaca

SEQ ID NO: 1528779 - RNA, 15 nt, Homo sapiens
ucugugauuaccucu

SEQ ID NO: 1528780 - RNA, 14 nt, Homo sapiens
ucuuaauucuuagc

SEQ ID NO: 1528781 - RNA, 17 nt, Homo sapiens
ucuuguuccccacugac

SEQ ID NO: 1528782 - RNA, 17 nt, Homo sapiens
ucuuuacaaagaaaaaa

SEQ ID NO: 1528783 - RNA, 21 nt, Homo sapiens
ucuuuaccccugcugaccucc

SEQ ID NO: 1528784 - RNA, 20 nt, Homo sapiens
ucuuugaacccuugcuugca

SEQ ID NO: 1528785 - RNA, 13 nt, Homo sapiens
ugaaaaugacauu

SEQ ID NO: 1528786 - RNA, 14 nt, Homo sapiens
ugaagacaaugacu

SEQ ID NO: 1528787 - RNA, 18 nt, Homo sapiens
ugaagauauuacuacuua

SEQ ID NO: 1528788 - RNA, 16 nt, Homo sapiens
ugaaggauuacucucc

SEQ ID NO: 1528789 - RNA, 17 nt, Homo sapiens
ugaaguaauaugcacac

SEQ ID NO: 1528790 - RNA, 22 nt, Homo sapiens
ugacaaggggcaguggugguuu

SEQ ID NO: 1528791 - RNA, 19 nt, Homo sapiens
ugacauacauauuaucuca

SEQ ID NO: 1528792 - RNA, 17 nt, Homo sapiens
ugacauuaaaugcaaua

SEQ ID NO: 1528793 - RNA, 15 nt, Homo sapiens
ugaccucccaccuau

SEQ ID NO: 1528794 - RNA, 17 nt, Homo sapiens
ugagcuuucugugcaug

SEQ ID NO: 1528795 - RNA, 15 nt, Homo sapiens
ugaggagacagaaua

SEQ ID NO: 1528796 - RNA, 15 nt, Homo sapiens
ugaggguuaaugaaa

SEQ ID NO: 1528797 - RNA, 17 nt, Homo sapiens
ugaguacguugugcauu

SEQ ID NO: 1528798 - RNA, 18 nt, Homo sapiens
ugaguacguugugcauuu

SEQ ID NO: 1528799 - RNA, 17 nt, Homo sapiens
ugaguuaauuuuaccaa

SEQ ID NO: 1528800 - RNA, 20 nt, Homo sapiens
ugauaauuguguaccuuaag

SEQ ID NO: 1528801 - RNA, 14 nt, Homo sapiens
ugauacaacauuaa

SEQ ID NO: 1528802 - RNA, 23 nt, Homo sapiens
ugauuauugcuucuuuccuugca

SEQ ID NO: 1528803 - RNA, 13 nt, Homo sapiens
ugcaaggucauuu

SEQ ID NO: 1528804 - RNA, 12 nt, Homo sapiens
ugcacuguccag

SEQ ID NO: 1528805 - RNA, 22 nt, Homo sapiens
ugcaggccgugugucugucagc

SEQ ID NO: 1528806 - RNA, 17 nt, Homo sapiens
ugcaugaaguaauaugc

SEQ ID NO: 1528807 - RNA, 20 nt, Homo sapiens
ugccaccauggccagccaac

SEQ ID NO: 1528808 - RNA, 17 nt, Homo sapiens
ugcccaggcuggucuca

SEQ ID NO: 1528809 - RNA, 13 nt, Homo sapiens
ugcccuuacccca

SEQ ID NO: 1528810 - RNA, 22 nt, Homo sapiens
ugcccuuaccccacacacaguc

SEQ ID NO: 1528811 - RNA, 14 nt, Homo sapiens
ugccuguaauccca

SEQ ID NO: 1528812 - RNA, 22 nt, Homo sapiens
ugccugugcagcgggugcugcu

SEQ ID NO: 1528813 - RNA, 21 nt, Homo sapiens
ugccuguuuugagaccagaag

SEQ ID NO: 1528814 - RNA, 19 nt, Homo sapiens
ugcgaaggcugggcacugc

SEQ ID NO: 1528815 - RNA, 13 nt, Homo sapiens
ugcgcucuuggga

SEQ ID NO: 1528816 - RNA, 17 nt, Homo sapiens
ugcuaccugcaccucug

SEQ ID NO: 1528817 - RNA, 17 nt, Homo sapiens
ugcuguccaugcuucuc

SEQ ID NO: 1528818 - RNA, 12 nt, Homo sapiens
uggaagggucaa

SEQ ID NO: 1528819 - RNA, 20 nt, Homo sapiens
uggaauauaucaguaccucu

SEQ ID NO: 1528820 - RNA, 14 nt, Homo sapiens
uggacugucugauc

SEQ ID NO: 1528821 - RNA, 16 nt, Homo sapiens
uggaggcagcagcucc

SEQ ID NO: 1528822 - RNA, 19 nt, Homo sapiens
uggcacucagggagcauuu

SEQ ID NO: 1528823 - RNA, 15 nt, Homo sapiens
uggcagaaccaaagc

SEQ ID NO: 1528824 - RNA, 14 nt, Homo sapiens
uggcccuucugccc

SEQ ID NO: 1528825 - RNA, 20 nt, Homo sapiens
aacuucaccuacauuaucuc

SEQ ID NO: 1528826 - RNA, 22 nt, Homo sapiens
aacuucaccuacauuaucucac

SEQ ID NO: 1528827 - RNA, 16 nt, Homo sapiens
aacuucagguggauga

SEQ ID NO: 1528828 - RNA, 16 nt, Homo sapiens
aagaaaaacaccgcuu

SEQ ID NO: 1528829 - RNA, 18 nt, Homo sapiens
aagaggcuuuugggccaa

SEQ ID NO: 1528830 - RNA, 15 nt, Homo sapiens
aagagggacagagcc

SEQ ID NO: 1528831 - RNA, 16 nt, Homo sapiens
aagcacggcugugggu

SEQ ID NO: 1528832 - RNA, 20 nt, Homo sapiens
aagcucccacacccaccucu

SEQ ID NO: 1528833 - RNA, 23 nt, Homo sapiens
aaguagccucugggaucugccaa

SEQ ID NO: 1528834 - RNA, 17 nt, Homo sapiens
aaguaucccuacuguaa

SEQ ID NO: 1528835 - RNA, 23 nt, Homo sapiens
aagucccgcgaaacccggugcau

SEQ ID NO: 1528836 - RNA, 12 nt, Homo sapiens
aauaaaacugaa

SEQ ID NO: 1528837 - RNA, 15 nt, Homo sapiens
aauauauaaccagug

SEQ ID NO: 1528838 - RNA, 18 nt, Homo sapiens
aaucaacaaaauggucau

SEQ ID NO: 1528839 - RNA, 16 nt, Homo sapiens
aaucagccacauucua

SEQ ID NO: 1528840 - RNA, 17 nt, Homo sapiens
aaucccaacacuuugag

SEQ ID NO: 1528841 - RNA, 18 nt, Homo sapiens
aaucucaccccaucccac

SEQ ID NO: 1528842 - RNA, 17 nt, Homo sapiens
aaucuuuuaaaucuuug

SEQ ID NO: 1528843 - RNA, 16 nt, Homo sapiens
aaugaauaaacugaau

SEQ ID NO: 1528844 - RNA, 15 nt, Homo sapiens
aaugagccuguccaa

SEQ ID NO: 1528845 - RNA, 14 nt, Homo sapiens
aauggucauccaaa

SEQ ID NO: 1528846 - RNA, 16 nt, Homo sapiens
aauguauuuuucuaca

SEQ ID NO: 1528847 - RNA, 12 nt, Homo sapiens
aauuaguuucaa

SEQ ID NO: 1528848 - RNA, 13 nt, Homo sapiens
aauucagcacuua

SEQ ID NO: 1528849 - RNA, 13 nt, Homo sapiens
aauuuagcccuuu

SEQ ID NO: 1528850 - RNA, 11 nt, Homo sapiens
aauuugaacug

SEQ ID NO: 1528851 - RNA, 17 nt, Homo sapiens
aauuugaugauuuucau

SEQ ID NO: 1528852 - RNA, 15 nt, Homo sapiens
aauuuuacuuaucau

SEQ ID NO: 1528853 - RNA, 15 nt, Homo sapiens
aauuuuaucaugcca

SEQ ID NO: 1528854 - RNA, 22 nt, Homo sapiens
acaaaauggucauccaaacuca

SEQ ID NO: 1528855 - RNA, 15 nt, Homo sapiens
acaaagcacuagaga

SEQ ID NO: 1528856 - RNA, 11 nt, Homo sapiens
acaacauuaag

SEQ ID NO: 1528857 - RNA, 23 nt, Homo sapiens
acaauucugugacauacauauua

SEQ ID NO: 1528858 - RNA, 18 nt, Homo sapiens
acacauuuuucuuaggga

SEQ ID NO: 1528859 - RNA, 20 nt, Homo sapiens
acacauuuuuuaaaugcacc

SEQ ID NO: 1528860 - RNA, 22 nt, Homo sapiens
acaccuuuucuauuuaccuccu

SEQ ID NO: 1528861 - RNA, 19 nt, Homo sapiens
acacugcauguuugugauu

SEQ ID NO: 1528862 - RNA, 13 nt, Homo sapiens
acagaaacuggau

SEQ ID NO: 1528863 - RNA, 14 nt, Homo sapiens
acagaauagcacaa

SEQ ID NO: 1528864 - RNA, 20 nt, Homo sapiens
acagacacaauauguaugcu

SEQ ID NO: 1528865 - RNA, 21 nt, Homo sapiens
acagagaccaagagagguccu

SEQ ID NO: 1528866 - RNA, 21 nt, Homo sapiens
acagagucccuggcuccucua

SEQ ID NO: 1528867 - RNA, 14 nt, Homo sapiens
acagaguuguuaca

SEQ ID NO: 1528868 - RNA, 20 nt, Homo sapiens
acagcucuccuccuccaucu

SEQ ID NO: 1528869 - RNA, 17 nt, Homo sapiens
acauaaugcgugcauac

SEQ ID NO: 1528870 - RNA, 18 nt, Homo sapiens
acauacauauuaucucau

SEQ ID NO: 1528871 - RNA, 22 nt, Homo sapiens
acauagcucaaucacacuggaa

SEQ ID NO: 1528872 - RNA, 22 nt, Homo sapiens
acauaguagguacccaauucaa

SEQ ID NO: 1528873 - RNA, 11 nt, Homo sapiens
acaucugucac

SEQ ID NO: 1528874 - RNA, 12 nt, Homo sapiens
acaucugucacg

SEQ ID NO: 1528875 - RNA, 16 nt, Homo sapiens
acauuaaggaauuuga

SEQ ID NO: 1528876 - RNA, 21 nt, Homo sapiens
acauucccucuaauuugaacu

SEQ ID NO: 1528877 - RNA, 13 nt, Homo sapiens
acauuuugacaca

SEQ ID NO: 1528878 - RNA, 15 nt, Homo sapiens
acauuuugacacaaa

SEQ ID NO: 1528879 - RNA, 23 nt, Homo sapiens
acauuuuuaagugcugcauuuaa

SEQ ID NO: 1528880 - RNA, 20 nt, Homo sapiens
accagagaggcucugagaaa

SEQ ID NO: 1528881 - RNA, 15 nt, Homo sapiens
acccaccucugccac

SEQ ID NO: 1528882 - RNA, 13 nt, Homo sapiens
acccccaucuuua

SEQ ID NO: 1528883 - RNA, 16 nt, Homo sapiens
acccccaucuuuacaa

SEQ ID NO: 1528884 - RNA, 19 nt, Homo sapiens
acccugcuuuggcggcccg

SEQ ID NO: 1528885 - RNA, 14 nt, Homo sapiens
accuacauuaucuc

SEQ ID NO: 1528886 - RNA, 17 nt, Homo sapiens
accucuugagccuugaa

SEQ ID NO: 1528887 - RNA, 20 nt, Homo sapiens
accuuuccauuuauucuuug

SEQ ID NO: 1528888 - RNA, 18 nt, Homo sapiens
acgcgcguacagaucucu

SEQ ID NO: 1528889 - RNA, 13 nt, Homo sapiens
acguugugcauuu

SEQ ID NO: 1528890 - RNA, 12 nt, Homo sapiens
acguuugauaca

SEQ ID NO: 1528891 - RNA, 17 nt, Homo sapiens
acuaaacuucaccuaca

SEQ ID NO: 1528892 - RNA, 22 nt, Homo sapiens
acuaaucaagaaaaacaucuuu

SEQ ID NO: 1528893 - RNA, 23 nt, Homo sapiens
acuaugagccaggcaucauacua

SEQ ID NO: 1528894 - RNA, 23 nt, Homo sapiens
acucagcagugagaguuccucuu

SEQ ID NO: 1528895 - RNA, 16 nt, Homo sapiens
acucagggagcauuua

SEQ ID NO: 1528896 - RNA, 17 nt, Homo sapiens
acuccuggagcacugua

SEQ ID NO: 1528897 - RNA, 21 nt, Homo sapiens
acugauagaugucuauucuug

SEQ ID NO: 1528898 - RNA, 14 nt, Homo sapiens
acugcccccgccac

SEQ ID NO: 1528899 - RNA, 11 nt, Homo sapiens
acugcgcucuu

SEQ ID NO: 1528900 - RNA, 22 nt, Homo sapiens
acugguauuguuuacguuugau

SEQ ID NO: 1528901 - RNA, 13 nt, Homo sapiens
acuuaacuaugag

SEQ ID NO: 1528902 - RNA, 11 nt, Homo sapiens
acuuacuguac

SEQ ID NO: 1528903 - RNA, 17 nt, Homo sapiens
acuuagaucaucaguca

SEQ ID NO: 1528904 - RNA, 13 nt, Homo sapiens
acuuccauuugcu

SEQ ID NO: 1528905 - RNA, 13 nt, Homo sapiens
acuugagaaaaua

SEQ ID NO: 1528906 - RNA, 15 nt, Homo sapiens
acuuggaacuaggcu

SEQ ID NO: 1528907 - RNA, 18 nt, Homo sapiens
acuuucuucucuuuccca

SEQ ID NO: 1528908 - RNA, 17 nt, Homo sapiens
agaaaaacaccgcuucu

SEQ ID NO: 1528909 - RNA, 15 nt, Homo sapiens
agaaaaguugcagau

SEQ ID NO: 1528910 - RNA, 12 nt, Homo sapiens
agaaaauaucuu

SEQ ID NO: 1528911 - RNA, 12 nt, Homo sapiens
agaaacugaagc

SEQ ID NO: 1528912 - RNA, 13 nt, Homo sapiens
agaaggauuaccu

SEQ ID NO: 1528913 - RNA, 12 nt, Homo sapiens
agacaaugacuu

SEQ ID NO: 1528914 - RNA, 16 nt, Homo sapiens
agacacuuuaccucuu

SEQ ID NO: 1528915 - RNA, 14 nt, Homo sapiens
agacagaagcuuaa

SEQ ID NO: 1528916 - RNA, 13 nt, Homo sapiens
agacugccagugg

SEQ ID NO: 1528917 - RNA, 20 nt, Homo sapiens
agacugggucucgcuuuguu

SEQ ID NO: 1528918 - RNA, 20 nt, Homo sapiens
agagagaaguucauacaaag

SEQ ID NO: 1528919 - RNA, 15 nt, Homo sapiens
agagaggcucugaga

SEQ ID NO: 1528920 - RNA, 20 nt, Homo sapiens
agagcuuuuaaaaauguccu

SEQ ID NO: 1528921 - RNA, 15 nt, Homo sapiens
agaggcucugagaaa

SEQ ID NO: 1528922 - RNA, 13 nt, Homo sapiens
agaggugcuucug

SEQ ID NO: 1528923 - RNA, 20 nt, Homo sapiens
agaguggcugcaccacuucc

SEQ ID NO: 1528924 - RNA, 23 nt, Homo sapiens
agaguuggggagaaacugaagcc

SEQ ID NO: 1528925 - RNA, 18 nt, Homo sapiens
agauccuggaaacagcag

SEQ ID NO: 1528926 - RNA, 22 nt, Homo sapiens
agaucucucgaaugcugagaag

SEQ ID NO: 1528927 - RNA, 19 nt, Homo sapiens
agauguuucaacugugcuc

SEQ ID NO: 1528928 - RNA, 15 nt, Homo sapiens
agcaggacugcacag

SEQ ID NO: 1528929 - RNA, 23 nt, Homo sapiens
agcaggucuuugggaagcuccca

SEQ ID NO: 1528930 - RNA, 16 nt, Homo sapiens
agcauacguacacauu

SEQ ID NO: 1528931 - RNA, 21 nt, Homo sapiens
agcauacguacacauuuuauu

SEQ ID NO: 1528932 - RNA, 23 nt, Homo sapiens
agcaucuaguuucccuggugccc

SEQ ID NO: 1528933 - RNA, 18 nt, Homo sapiens
caaauauaagacauuugu

SEQ ID NO: 1528934 - RNA, 17 nt, Homo sapiens
caaaucacgaccacuga

SEQ ID NO: 1528935 - RNA, 17 nt, Homo sapiens
caacagcaaaucacgac

SEQ ID NO: 1528936 - RNA, 18 nt, Homo sapiens
caaccuucacaucuguca

SEQ ID NO: 1528937 - RNA, 23 nt, Homo sapiens
caacuucaguuuuauuuuugcca

SEQ ID NO: 1528938 - RNA, 22 nt, Homo sapiens
caaguauuauuuuacaaucaac

SEQ ID NO: 1528939 - RNA, 23 nt, Homo sapiens
ccuuauuuugugugcuuucccag

SEQ ID NO: 1528940 - RNA, 24 nt, Homo sapiens
ccuuuagaggguaccgucuucucc

SEQ ID NO: 1528941 - RNA, 21 nt, Homo sapiens
ccuuugaaaccugcucuguag

SEQ ID NO: 1528942 - RNA, 14 nt, Homo sapiens
cgcguacagaucuc

SEQ ID NO: 1528943 - RNA, 20 nt, Homo sapiens
cggccgcccggcagugcacg

SEQ ID NO: 1528944 - RNA, 14 nt, Homo sapiens
cggccuccaugcac

SEQ ID NO: 1528945 - RNA, 13 nt, Homo sapiens
cggcugugggugg

SEQ ID NO: 1528946 - RNA, 15 nt, Homo sapiens
cggcuguggguggug

SEQ ID NO: 1528947 - RNA, 20 nt, Homo sapiens
cguccagcuggaagggucaa

SEQ ID NO: 1528948 - RNA, 19 nt, Homo sapiens
cguuucuaugacacaugca

SEQ ID NO: 1528949 - RNA, 19 nt, Homo sapiens
cguuucugcccagcccucu

SEQ ID NO: 1528950 - RNA, 21 nt, Homo sapiens
cuaaauaaugaauaaacugaa

SEQ ID NO: 1528951 - RNA, 17 nt, Homo sapiens
cuaacuucaaggcccau

SEQ ID NO: 1528952 - RNA, 15 nt, Homo sapiens
cuaagcgcacauuca

SEQ ID NO: 1528953 - RNA, 16 nt, Homo sapiens
cuaagcgcacauucau

SEQ ID NO: 1528954 - RNA, 13 nt, Homo sapiens
cuaagcugcccug

SEQ ID NO: 1528955 - RNA, 24 nt, Homo sapiens
cuaaucaagaaaaacaucuuuggc

SEQ ID NO: 1528956 - RNA, 14 nt, Homo sapiens
cuacauuaucucac

SEQ ID NO: 1528957 - RNA, 20 nt, Homo sapiens
cuagaaggggcuaugcauau

SEQ ID NO: 1528958 - RNA, 13 nt, Homo sapiens
cuagauacuguau

SEQ ID NO: 1528959 - RNA, 15 nt, Homo sapiens
cuagguaggggccca

SEQ ID NO: 1528960 - RNA, 12 nt, Homo sapiens
cuagugccuuua

SEQ ID NO: 1528961 - RNA, 12 nt, Homo sapiens
cuaugcauuuga

SEQ ID NO: 1528962 - RNA, 13 nt, Homo sapiens
cucaaacuugaga

SEQ ID NO: 1528963 - RNA, 22 nt, Homo sapiens
cucaaaucacugcauucauucu

SEQ ID NO: 1528964 - RNA, 14 nt, Homo sapiens
cucacaguguugcc

SEQ ID NO: 1528965 - RNA, 14 nt, Homo sapiens
cucacuguucugca

SEQ ID NO: 1528966 - RNA, 16 nt, Homo sapiens
cucacuguucugcaaa

SEQ ID NO: 1528967 - RNA, 22 nt, Homo sapiens
cucagauuggaauguuacaucu

SEQ ID NO: 1528968 - RNA, 13 nt, Homo sapiens
cucagcagcaucg

SEQ ID NO: 1528969 - RNA, 14 nt, Homo sapiens
cucagcuccacaac

SEQ ID NO: 1528970 - RNA, 15 nt, Homo sapiens
cucaggcucuugacu

SEQ ID NO: 1528971 - RNA, 23 nt, Homo sapiens
cucaugccacagugguacucugu

SEQ ID NO: 1528972 - RNA, 12 nt, Homo sapiens
cucaugccugua

SEQ ID NO: 1528973 - RNA, 20 nt, Homo sapiens
cucaugccuguaaucccaac

SEQ ID NO: 1528974 - RNA, 17 nt, Homo sapiens
cucaugccuguaaucuc

SEQ ID NO: 1528975 - RNA, 18 nt, Homo sapiens
cucaugccuguaaucuca

SEQ ID NO: 1528976 - RNA, 16 nt, Homo sapiens
cucauuuuacacaaag

SEQ ID NO: 1528977 - RNA, 18 nt, Homo sapiens
cucccaagccacauucau

SEQ ID NO: 1528978 - RNA, 19 nt, Homo sapiens
cucccaagccacuagccca

SEQ ID NO: 1528979 - RNA, 20 nt, Homo sapiens
cucccugucauagagcugca

SEQ ID NO: 1528980 - RNA, 17 nt, Homo sapiens
cuccuaauggcauggag

SEQ ID NO: 1528981 - RNA, 17 nt, Homo sapiens
cuccugacaauacugua

SEQ ID NO: 1528982 - RNA, 20 nt, Homo sapiens
cuccugaccccgccaugcau

SEQ ID NO: 1528983 - RNA, 18 nt, Homo sapiens
cuccuuugaaaccugcuc

SEQ ID NO: 1528984 - RNA, 16 nt, Homo sapiens
cucgagcaguccugcc

SEQ ID NO: 1528985 - RNA, 17 nt, Homo sapiens
cucgcuuuguugcccag

SEQ ID NO: 1528986 - RNA, 15 nt, Homo sapiens
cucguauuuuguccc

SEQ ID NO: 1528987 - RNA, 17 nt, Homo sapiens
cucuuguauaugaugau

SEQ ID NO: 1528988 - RNA, 21 nt, Homo sapiens
cucuuguauaugaugaucugg

SEQ ID NO: 1528989 - RNA, 22 nt, Homo sapiens
cugaaggcucguuuggcuuuau

SEQ ID NO: 1528990 - RNA, 16 nt, Homo sapiens
cugaccccgccaugca

SEQ ID NO: 1528991 - RNA, 23 nt, Homo sapiens
cugagccgaacauguuauuuaac

SEQ ID NO: 1528992 - RNA, 18 nt, Homo sapiens
cugaggcagaaggauuac

SEQ ID NO: 1528993 - RNA, 18 nt, Homo sapiens
cugcccgggagggcuucc

SEQ ID NO: 1528994 - RNA, 23 nt, Homo sapiens
cugcuagcaaauggcagaaccaa

SEQ ID NO: 1528995 - RNA, 21 nt, Homo sapiens
cugcuugagcuuucugugcau

SEQ ID NO: 1528996 - RNA, 13 nt, Homo sapiens
cuggagauaugaa

SEQ ID NO: 1528997 - RNA, 20 nt, Homo sapiens
cuggagauaugaaggauuac

SEQ ID NO: 1528998 - RNA, 20 nt, Homo sapiens
cuggaguggaguggcgugau

SEQ ID NO: 1528999 - RNA, 16 nt, Homo sapiens
cuggcuaugcauuuga

SEQ ID NO: 1529000 - RNA, 22 nt, Homo sapiens
cugggauuacaauugugagcca

SEQ ID NO: 1529001 - RNA, 23 nt, Homo sapiens
cuggucucaaacuccugggcuca

SEQ ID NO: 1529002 - RNA, 17 nt, Homo sapiens
cugguuagguagaggga

SEQ ID NO: 1529003 - RNA, 15 nt, Homo sapiens
cuguaaucccaacac

SEQ ID NO: 1529004 - RNA, 18 nt, Homo sapiens
cugucugaucagggugga

SEQ ID NO: 1529005 - RNA, 22 nt, Homo sapiens
cugugacauacauauuaucuca

SEQ ID NO: 1529006 - RNA, 14 nt, Homo sapiens
cugugauuaccucu

SEQ ID NO: 1529007 - RNA, 16 nt, Homo sapiens
cuuaaaauuaccagac

SEQ ID NO: 1529008 - RNA, 12 nt, Homo sapiens
cuuaacuaugag

SEQ ID NO: 1529009 - RNA, 15 nt, Homo sapiens
cuuacuguacaugaa

SEQ ID NO: 1529010 - RNA, 14 nt, Homo sapiens
cuuagugauugaga

SEQ ID NO: 1529011 - RNA, 14 nt, Homo sapiens
cuuauguugcacaa

SEQ ID NO: 1529012 - RNA, 17 nt, Homo sapiens
cuucagggaacugcaua

SEQ ID NO: 1529013 - RNA, 11 nt, Homo sapiens
cuuccauuugc

SEQ ID NO: 1529014 - RNA, 16 nt, Homo sapiens
cuucguuagaccgcuc

SEQ ID NO: 1529015 - RNA, 18 nt, Homo sapiens
cuucuauuuauuugacug

SEQ ID NO: 1529016 - RNA, 23 nt, Homo sapiens
cuucugcccuuaccccacacaca

SEQ ID NO: 1529017 - RNA, 16 nt, Homo sapiens
cuuggcucgaugcugu

SEQ ID NO: 1529018 - RNA, 16 nt, Homo sapiens
cuuguuuuaugcucag

SEQ ID NO: 1529019 - RNA, 13 nt, Homo sapiens
cuuucccagugag

SEQ ID NO: 1529020 - RNA, 13 nt, Homo sapiens
cuuucugugcaug

SEQ ID NO: 1529021 - RNA, 14 nt, Homo sapiens
cuuugucuguccag

SEQ ID NO: 1529022 - RNA, 13 nt, Homo sapiens
cuuuguggaccaa

SEQ ID NO: 1529023 - RNA, 15 nt, Homo sapiens
cuuuuaaaaaugucc

SEQ ID NO: 1529024 - RNA, 20 nt, Homo sapiens
cuuuuauaaacuuuaccuuu

SEQ ID NO: 1529025 - RNA, 17 nt, Homo sapiens
cuuuuccccagucccag

SEQ ID NO: 1529026 - RNA, 19 nt, Homo sapiens
cuuuucuguacuuccugag

SEQ ID NO: 1529027 - RNA, 21 nt, Homo sapiens
gaaaacaugcuacacacugca

SEQ ID NO: 1529028 - RNA, 19 nt, Homo sapiens
gaaaauaguggugugauuu

SEQ ID NO: 1529029 - RNA, 13 nt, Homo sapiens
gaaacacauucuu

SEQ ID NO: 1529030 - RNA, 21 nt, Homo sapiens
gaaauggaugcaaaguacaau

SEQ ID NO: 1529031 - RNA, 20 nt, Homo sapiens
gaaauggccaggauccucuc

SEQ ID NO: 1529032 - RNA, 19 nt, Homo sapiens
gaaauguuuguccuugcac

SEQ ID NO: 1529033 - RNA, 21 nt, Homo sapiens
gaaccacucuaucaaguauua

SEQ ID NO: 1529034 - RNA, 21 nt, Homo sapiens
gaaccagagaggcucugagaa

SEQ ID NO: 1529035 - RNA, 15 nt, Homo sapiens
gaagaggaaagggag

SEQ ID NO: 1529036 - RNA, 15 nt, Homo sapiens
gaaggauuacucucc

SEQ ID NO: 1529037 - RNA, 10 nt, Homo sapiens
gaaggccagc

SEQ ID NO: 1529038 - RNA, 20 nt, Homo sapiens
gaaggcucguuuggcuuuau

SEQ ID NO: 1529039 - RNA, 15 nt, Homo sapiens
gaaggucccucagac

SEQ ID NO: 1529040 - RNA, 16 nt, Homo sapiens
gaaggucccucagaca

SEQ ID NO: 1529041 - RNA, 16 nt, Homo sapiens
gaaugugaagccagau

SEQ ID NO: 1529042 - RNA, 13 nt, Homo sapiens
gacaauacuguau

SEQ ID NO: 1529043 - RNA, 22 nt, Homo sapiens
gacagagucccuggcuccucua

SEQ ID NO: 1529044 - RNA, 15 nt, Homo sapiens
gaccccgccaugcau

SEQ ID NO: 1529045 - RNA, 16 nt, Homo sapiens
gacccuggaaauggac

SEQ ID NO: 1529046 - RNA, 11 nt, Homo sapiens
gacuguaaaau

SEQ ID NO: 1529047 - RNA, 22 nt, Homo sapiens
gacuucaugacaagcauuuugu

SEQ ID NO: 1529048 - RNA, 20 nt, Homo sapiens
gacuuguuuuaugcucaggg

SEQ ID NO: 1529049 - RNA, 20 nt, Homo sapiens
gagacagaauagagugauag

SEQ ID NO: 1529050 - RNA, 13 nt, Homo sapiens
gagacugggucuc

SEQ ID NO: 1529051 - RNA, 17 nt, Homo sapiens
gagaguuccucuuugcc

SEQ ID NO: 1529052 - RNA, 20 nt, Homo sapiens
gagaguuccucuuugcccug

SEQ ID NO: 1529053 - RNA, 21 nt, Homo sapiens
gagaguuccucuuugcccuga

SEQ ID NO: 1529054 - RNA, 12 nt, Homo sapiens
gagcagcaucua

SEQ ID NO: 1529055 - RNA, 12 nt, Homo sapiens
gagccuguccaa

SEQ ID NO: 1529056 - RNA, 16 nt, Homo sapiens
gagccuuccacaguga

SEQ ID NO: 1529057 - RNA, 14 nt, Homo sapiens
gagcugcagggugg

SEQ ID NO: 1529058 - RNA, 13 nt, Homo sapiens
gaggaagggccga

SEQ ID NO: 1529059 - RNA, 19 nt, Homo sapiens
gaggccaguaccuuuccau

SEQ ID NO: 1529060 - RNA, 19 nt, Homo sapiens
gaggcuaacccugauccau

SEQ ID NO: 1529061 - RNA, 12 nt, Homo sapiens
gaggcugucaca

SEQ ID NO: 1529062 - RNA, 14 nt, Homo sapiens
gagguuaggaguag

SEQ ID NO: 1529063 - RNA, 11 nt, Homo sapiens
gaguggcugca

SEQ ID NO: 1529064 - RNA, 18 nt, Homo sapiens
gaucacuacaaguauuau

SEQ ID NO: 1529065 - RNA, 13 nt, Homo sapiens
gaucaucagucac

SEQ ID NO: 1529066 - RNA, 21 nt, Homo sapiens
gauccaccugucucagccucc

SEQ ID NO: 1529067 - RNA, 20 nt, Homo sapiens
gauccauagugcuaccugca

SEQ ID NO: 1529068 - RNA, 14 nt, Homo sapiens
gaugacuguugaug

SEQ ID NO: 1529069 - RNA, 21 nt, Homo sapiens
gaugaucuggauccaccaaga

SEQ ID NO: 1529070 - RNA, 13 nt, Homo sapiens
gauuaaacuuaau

SEQ ID NO: 1529071 - RNA, 16 nt, Homo sapiens
gauuacucuccauauc

SEQ ID NO: 1529072 - RNA, 22 nt, Homo sapiens
gauuauugcuucuuuccuugca

SEQ ID NO: 1529073 - RNA, 20 nt, Homo sapiens
gauucccgggcuuaccaggu

SEQ ID NO: 1529074 - RNA, 19 nt, Homo sapiens
gcaaauggcagaaccaaag

SEQ ID NO: 1529075 - RNA, 22 nt, Homo sapiens
gcaacagcaaaucacgaccacu

SEQ ID NO: 1529076 - RNA, 15 nt, Homo sapiens
gcaagcacaucugca

SEQ ID NO: 1529077 - RNA, 19 nt, Homo sapiens
gcaauguggggagacccca

SEQ ID NO: 1529078 - RNA, 15 nt, Homo sapiens
gcacagcugccgcgu

SEQ ID NO: 1529079 - RNA, 22 nt, Homo sapiens
gcacccaggacuuccauuugcu

SEQ ID NO: 1529080 - RNA, 20 nt, Homo sapiens
gcacguggccaggagccaug

SEQ ID NO: 1529081 - RNA, 20 nt, Homo sapiens
gcacucacgcccuaagcgca

SEQ ID NO: 1529082 - RNA, 20 nt, Homo sapiens
gcacuguccagcugguugua

SEQ ID NO: 1529083 - RNA, 14 nt, Homo sapiens
gcacuuucuucucu

SEQ ID NO: 1529084 - RNA, 17 nt, Homo sapiens
gcagaaccaaagcucaa

SEQ ID NO: 1529085 - RNA, 13 nt, Homo sapiens
gcaggacugcaca

SEQ ID NO: 1529086 - RNA, 20 nt, Homo sapiens
gcaggccgugugucugucag

SEQ ID NO: 1529087 - RNA, 21 nt, Homo sapiens
gcagguuccuuaucugucaca

SEQ ID NO: 1529088 - RNA, 15 nt, Homo sapiens
gcaguucucugccaa

SEQ ID NO: 1529089 - RNA, 19 nt, Homo sapiens
gcauagauugaucaaagug

SEQ ID NO: 1529090 - RNA, 12 nt, Homo sapiens
gcauuucuugcg

SEQ ID NO: 1529091 - RNA, 13 nt, Homo sapiens
gcauuuguuugaa

SEQ ID NO: 1529092 - RNA, 14 nt, Homo sapiens
gccacaacugcccc

SEQ ID NO: 1529093 - RNA, 18 nt, Homo sapiens
gccacuagcccacucccc

SEQ ID NO: 1529094 - RNA, 16 nt, Homo sapiens
gccagcugugcacuuu

SEQ ID NO: 1529095 - RNA, 21 nt, Homo sapiens
gccaggccucuuggcagucac

SEQ ID NO: 1529096 - RNA, 20 nt, Homo sapiens
gcccagaagaaaauucuccu

SEQ ID NO: 1529097 - RNA, 20 nt, Homo sapiens
gcccaggcuggaguggagug

SEQ ID NO: 1529098 - RNA, 18 nt, Homo sapiens
gcccauaucugugaaaug

SEQ ID NO: 1529099 - RNA, 19 nt, Homo sapiens
gcccugaggcucagucucu

SEQ ID NO: 1529100 - RNA, 11 nt, Homo sapiens
gccuaccucuc

SEQ ID NO: 1529101 - RNA, 12 nt, Homo sapiens
gccuaccucucg

SEQ ID NO: 1529102 - RNA, 17 nt, Homo sapiens
gccucugggaucugcca

SEQ ID NO: 1529103 - RNA, 21 nt, Homo sapiens
gccuguaaucucagcacuuug

SEQ ID NO: 1529104 - RNA, 22 nt, Homo sapiens
gccuguaaucucagcacuuugg

SEQ ID NO: 1529105 - RNA, 15 nt, Homo sapiens
gccuuuguuucccau

SEQ ID NO: 1529106 - RNA, 22 nt, Homo sapiens
gcgauccaccugucucagccuc

SEQ ID NO: 1529107 - RNA, 20 nt, Homo sapiens
gcgcauagcacgggauucau

SEQ ID NO: 1529108 - RNA, 22 nt, Homo sapiens
gcgcuggguauuggaaauggau

SEQ ID NO: 1529109 - RNA, 19 nt, Homo sapiens
gcggaaggucccucagaca

SEQ ID NO: 1529110 - RNA, 17 nt, Homo sapiens
gcuacagucucuugucc

SEQ ID NO: 1529111 - RNA, 15 nt, Homo sapiens
gcucagcauuuccac

SEQ ID NO: 1529112 - RNA, 19 nt, Homo sapiens
gcucaugccuguaaucuca

SEQ ID NO: 1529113 - RNA, 23 nt, Homo sapiens
gcucccacacccaccucugccac

SEQ ID NO: 1529114 - RNA, 21 nt, Homo sapiens
gcucugagccgcgcuuucccc

SEQ ID NO: 1529115 - RNA, 22 nt, Homo sapiens
gcugcaggccgugugucuguca

SEQ ID NO: 1529116 - RNA, 15 nt, Homo sapiens
gcuggacgugcgcga

SEQ ID NO: 1529117 - RNA, 22 nt, Homo sapiens
gcuggacgugcgcgaugccugg

SEQ ID NO: 1529118 - RNA, 19 nt, Homo sapiens
gcuggguauuggaaaugga

SEQ ID NO: 1529119 - RNA, 21 nt, Homo sapiens
gcuuaaccuuuccaguuuaua

SEQ ID NO: 1529120 - RNA, 14 nt, Homo sapiens
gcuucaguugcaua

SEQ ID NO: 1529121 - RNA, 15 nt, Homo sapiens
gcuucaguugcauau

SEQ ID NO: 1529122 - RNA, 17 nt, Homo sapiens
gcuucuucacaggcacu

SEQ ID NO: 1529123 - RNA, 11 nt, Homo sapiens
ggaagggucaa

SEQ ID NO: 1529124 - RNA, 17 nt, Homo sapiens
ggagauuuacaacuggg

SEQ ID NO: 1529125 - RNA, 19 nt, Homo sapiens
ggaggcggccuccaugcac

SEQ ID NO: 1529126 - RNA, 15 nt, Homo sapiens
ggcagaaccaaagcu

SEQ ID NO: 1529127 - RNA, 21 nt, Homo sapiens
ggcagagccuuccacagugaa

SEQ ID NO: 1529128 - RNA, 23 nt, Homo sapiens
ggcagcagcucccgcagggcuga

SEQ ID NO: 1529129 - RNA, 11 nt, Homo sapiens
ggcagugcacg

SEQ ID NO: 1529130 - RNA, 20 nt, Homo sapiens
ggcauuugcaccuaccucac

SEQ ID NO: 1529131 - RNA, 20 nt, Homo sapiens
ggcggguguggagaccaggc

SEQ ID NO: 1529132 - RNA, 16 nt, Homo sapiens
ggcucuugacuacuug

SEQ ID NO: 1529133 - RNA, 17 nt, Homo sapiens
ggcuguggguggugauu

SEQ ID NO: 1529134 - RNA, 20 nt, Homo sapiens
gggaguaggacauaccagcu

SEQ ID NO: 1529135 - RNA, 15 nt, Homo sapiens
gggcaucauccucag

SEQ ID NO: 1529136 - RNA, 23 nt, Homo sapiens
gggccaaaaugugaggguggugg

SEQ ID NO: 1529137 - RNA, 12 nt, Homo sapiens
gggccugggauu

SEQ ID NO: 1529138 - RNA, 20 nt, Homo sapiens
gggucucgcuuuguugccca

SEQ ID NO: 1529139 - RNA, 16 nt, Homo sapiens
gggucuuugaacccuu

SEQ ID NO: 1529140 - RNA, 13 nt, Homo sapiens
gguaaaauguauu

SEQ ID NO: 1529141 - RNA, 17 nt, Homo sapiens
ggucauccaaacucaaa

SEQ ID NO: 1529142 - RNA, 21 nt, Homo sapiens
ggugcaucuggcacguggcca

SEQ ID NO: 1529143 - RNA, 13 nt, Homo sapiens
ggugccugggaug

SEQ ID NO: 1529144 - RNA, 21 nt, Homo sapiens
gguggauuugagcuguggcug

SEQ ID NO: 1529145 - RNA, 15 nt, Homo sapiens
guaaauguccauuua

SEQ ID NO: 1529146 - RNA, 23 nt, Homo sapiens
guaauuuuuuuaucgucacugcu

SEQ ID NO: 1529147 - RNA, 14 nt, Homo sapiens
guaccgucuucucc

SEQ ID NO: 1529148 - RNA, 15 nt, Homo sapiens
guacguugugcauuu

SEQ ID NO: 1529149 - RNA, 20 nt, Homo sapiens
guagccucugggaucugcca

SEQ ID NO: 1529150 - RNA, 19 nt, Homo sapiens
guagccuuagagcaucucu

SEQ ID NO: 1529151 - RNA, 13 nt, Homo sapiens
guaggacauacca

SEQ ID NO: 1529152 - RNA, 14 nt, Homo sapiens
guauaucauucuac

SEQ ID NO: 1529153 - RNA, 21 nt, Homo sapiens
gucaacaucuuuuacauucug

SEQ ID NO: 1529154 - RNA, 15 nt, Homo sapiens
gucccagacaauucc

SEQ ID NO: 1529155 - RNA, 14 nt, Homo sapiens
gucccauuccucag

SEQ ID NO: 1529156 - RNA, 14 nt, Homo sapiens
guccuugcaccuga

SEQ ID NO: 1529157 - RNA, 17 nt, Homo sapiens
gucucacaguguugccc

SEQ ID NO: 1529158 - RNA, 22 nt, Homo sapiens
gucucacugugggaaggccagc

SEQ ID NO: 1529159 - RNA, 19 nt, Homo sapiens
gucucacuguucugcaaag

SEQ ID NO: 1529160 - RNA, 17 nt, Homo sapiens
gucucgcuuuguugccc

SEQ ID NO: 1529161 - RNA, 23 nt, Homo sapiens
gucuugaaaguggcaccagaggu

SEQ ID NO: 1529162 - RNA, 13 nt, Homo sapiens
gucuuucaucucc

SEQ ID NO: 1529163 - RNA, 20 nt, Homo sapiens
gugaaaugcuggcauuugca

SEQ ID NO: 1529164 - RNA, 23 nt, Homo sapiens
gugaagacaaugacuuacuguac

SEQ ID NO: 1529165 - RNA, 13 nt, Homo sapiens
gugauacaaugcu

SEQ ID NO: 1529166 - RNA, 13 nt, Homo sapiens
gugauuaccucuc

SEQ ID NO: 1529167 - RNA, 16 nt, Homo sapiens
gugcaugugccgaggu

SEQ ID NO: 1529168 - RNA, 18 nt, Homo sapiens
gugccauuuggaguucac

SEQ ID NO: 1529169 - RNA, 22 nt, Homo sapiens
gugcucuuguuuugucuugaaa

SEQ ID NO: 1529170 - RNA, 16 nt, Homo sapiens
gugcuugcuggugccu

SEQ ID NO: 1529171 - RNA, 20 nt, Homo sapiens
guggccaggagccaugacag

SEQ ID NO: 1529172 - RNA, 19 nt, Homo sapiens
gugggcuccugacaauacu

SEQ ID NO: 1529173 - RNA, 19 nt, Homo sapiens
gugucuggcaggcuacucu

SEQ ID NO: 1529174 - RNA, 23 nt, Homo sapiens
gugucuggcaggcuacucugccc

SEQ ID NO: 1529175 - RNA, 21 nt, Homo sapiens
guuagugucagccaugggaaa

SEQ ID NO: 1529176 - RNA, 16 nt, Homo sapiens
guuaugauauuguuua

SEQ ID NO: 1529177 - RNA, 23 nt, Homo sapiens
guuaugauauuguuuaaaauuca

SEQ ID NO: 1529178 - RNA, 13 nt, Homo sapiens
guuccccacugac

SEQ ID NO: 1529179 - RNA, 14 nt, Homo sapiens
guuccccacugaca

SEQ ID NO: 1529180 - RNA, 15 nt, Homo sapiens
guucuauccaaacau

SEQ ID NO: 1529181 - RNA, 19 nt, Homo sapiens
guucucaaaguuaauucac

SEQ ID NO: 1529182 - RNA, 23 nt, Homo sapiens
guucucaaaguuaauucaccuau

SEQ ID NO: 1529183 - RNA, 21 nt, Homo sapiens
guugaaaauguguuugcugcc

SEQ ID NO: 1529184 - RNA, 14 nt, Homo sapiens
guuucaacugugcu

SEQ ID NO: 1529185 - RNA, 21 nt, Homo sapiens
guuugggguggggaagggaag

SEQ ID NO: 1529186 - RNA, 18 nt, Homo sapiens
guuuuauggagaccucuc

SEQ ID NO: 1529187 - RNA, 22 nt, Homo sapiens
guuuuuauggcuuuugugcauu

SEQ ID NO: 1529188 - RNA, 23 nt, Homo sapiens
guuuuuauggcuuuugugcauua

SEQ ID NO: 1529189 - RNA, 16 nt, Homo sapiens
uaaaaauguccugccu

SEQ ID NO: 1529190 - RNA, 12 nt, Homo sapiens
uaaaacaauucu

SEQ ID NO: 1529191 - RNA, 14 nt, Homo sapiens
uaaaacuaagcaca

SEQ ID NO: 1529192 - RNA, 23 nt, Homo sapiens
uaaacaaugaugcccugcuccag

SEQ ID NO: 1529193 - RNA, 10 nt, Homo sapiens
uaaagauaug

SEQ ID NO: 1529194 - RNA, 14 nt, Homo sapiens
uaacagaaauguac

SEQ ID NO: 1529195 - RNA, 16 nt, Homo sapiens
uaacagaaauguacag

SEQ ID NO: 1529196 - RNA, 20 nt, Homo sapiens
uaacuucaaggcccauaucu

SEQ ID NO: 1529197 - RNA, 17 nt, Homo sapiens
uaacuuugaagccauaa

SEQ ID NO: 1529198 - RNA, 16 nt, Homo sapiens
uaaguuuuuguaaaag

SEQ ID NO: 1529199 - RNA, 15 nt, Homo sapiens
uaaucucagcacuuu

SEQ ID NO: 1529200 - RNA, 13 nt, Homo sapiens
uaauucagcacuu

SEQ ID NO: 1529201 - RNA, 15 nt, Homo sapiens
uacaaaagcauguga

SEQ ID NO: 1529202 - RNA, 16 nt, Homo sapiens
uacaaagcgugcacaa

SEQ ID NO: 1529203 - RNA, 16 nt, Homo sapiens
uacaacauuaaggaau

SEQ ID NO: 1529204 - RNA, 23 nt, Homo sapiens
uacaaguuguuauuguugaacau

SEQ ID NO: 1529205 - RNA, 17 nt, Homo sapiens
uacaauccuguuuauaa

SEQ ID NO: 1529206 - RNA, 20 nt, Homo sapiens
uacaauuaaaacuaagcaca

SEQ ID NO: 1529207 - RNA, 11 nt, Homo sapiens
uacaauuguga

SEQ ID NO: 1529208 - RNA, 12 nt, Homo sapiens
uacaauugugag

SEQ ID NO: 1529209 - RNA, 17 nt, Homo sapiens
uacauaaugcgugcaua

SEQ ID NO: 1529210 - RNA, 16 nt, Homo sapiens
uacauauuaucucauu

SEQ ID NO: 1529211 - RNA, 21 nt, Homo sapiens
uaccauuugcuacuguacaua

SEQ ID NO: 1529212 - RNA, 20 nt, Homo sapiens
uacccucuccaggcauuuau

SEQ ID NO: 1529213 - RNA, 14 nt, Homo sapiens
uaccuaaugucuca

SEQ ID NO: 1529214 - RNA, 13 nt, Homo sapiens
uaccugcaccucu

SEQ ID NO: 1529215 - RNA, 14 nt, Homo sapiens
uacguugugcauuu

SEQ ID NO: 1529216 - RNA, 16 nt, Homo sapiens
uacguugugcauuugg

SEQ ID NO: 1529217 - RNA, 16 nt, Homo sapiens
uacguuugauacaaca

SEQ ID NO: 1529218 - RNA, 15 nt, Homo sapiens
uacuaucauaauuca

SEQ ID NO: 1529219 - RNA, 22 nt, Homo sapiens
uacuccuggagcacuguaaaaa

SEQ ID NO: 1529220 - RNA, 18 nt, Homo sapiens
uacuguaauuugugauac

SEQ ID NO: 1529221 - RNA, 16 nt, Homo sapiens
uagaaaggacuguaaa

SEQ ID NO: 1529222 - RNA, 22 nt, Homo sapiens
uagaagcacggcuguggguggu

SEQ ID NO: 1529223 - RNA, 20 nt, Homo sapiens
uagcaaauggcagaaccaaa

SEQ ID NO: 1529224 - RNA, 17 nt, Homo sapiens
uagccagcugugcacuu

SEQ ID NO: 1529225 - RNA, 15 nt, Homo sapiens
uagggcuacagucuc

SEQ ID NO: 1529226 - RNA, 20 nt, Homo sapiens
uaguacuuauguugcacaau

SEQ ID NO: 1529227 - RNA, 15 nt, Homo sapiens
uagugagcagcaucu

SEQ ID NO: 1529228 - RNA, 21 nt, Homo sapiens
uauaauaacuuugaagccaua

SEQ ID NO: 1529229 - RNA, 15 nt, Homo sapiens
uauaaucugaagaua

SEQ ID NO: 1529230 - RNA, 20 nt, Homo sapiens
uaucaauuggcagugacuuu

SEQ ID NO: 1529231 - RNA, 12 nt, Homo sapiens
uaucaguaccuc

SEQ ID NO: 1529232 - RNA, 19 nt, Homo sapiens
uaucauaauucagcacuua

SEQ ID NO: 1529233 - RNA, 20 nt, Homo sapiens
uaucauaauucagcacuuaa

SEQ ID NO: 1529234 - RNA, 14 nt, Homo sapiens
uaucccuacuguaa

SEQ ID NO: 1529235 - RNA, 13 nt, Homo sapiens
uaucgaucucuua

SEQ ID NO: 1529236 - RNA, 22 nt, Homo sapiens
uaugcucagggucaauuucuuu

SEQ ID NO: 1529237 - RNA, 16 nt, Homo sapiens
uauggagaauugcuga

SEQ ID NO: 1529238 - RNA, 17 nt, Homo sapiens
uauggcuuuugugcauu

SEQ ID NO: 1529239 - RNA, 23 nt, Homo sapiens
uauguagccuuagagcaucucug

SEQ ID NO: 1529240 - RNA, 13 nt, Homo sapiens
uaugugugccuuu

SEQ ID NO: 1529241 - RNA, 14 nt, Homo sapiens
uauuaauucuucac

SEQ ID NO: 1529242 - RNA, 18 nt, Homo sapiens
uauuaauucuucaccugu

SEQ ID NO: 1529243 - RNA, 19 nt, Homo sapiens
uauuagaaaggacuguaaa

SEQ ID NO: 1529244 - RNA, 22 nt, Homo sapiens
uauuuuacaaucaacaaaaugg

SEQ ID NO: 1529245 - RNA, 12 nt, Homo sapiens
uauuuuuugcaa

SEQ ID NO: 1529246 - RNA, 23 nt, Homo sapiens
ucaaaaguugguguugacauaca

SEQ ID NO: 1529247 - RNA, 20 nt, Homo sapiens
ucaaagauauuuugcuuugu

SEQ ID NO: 1529248 - RNA, 21 nt, Homo sapiens
ucaaggcccauaucugugaaa

SEQ ID NO: 1529249 - RNA, 18 nt, Homo sapiens
ucaagguuuaaccuuaaa

SEQ ID NO: 1529250 - RNA, 16 nt, Homo sapiens
ucacagaauagcacaa

SEQ ID NO: 1529251 - RNA, 18 nt, Homo sapiens
ucacagagugcauuguga

SEQ ID NO: 1529252 - RNA, 16 nt, Homo sapiens
ucacaguguugcccag

SEQ ID NO: 1529253 - RNA, 13 nt, Homo sapiens
ucacaucugucac

SEQ ID NO: 1529254 - RNA, 16 nt, Homo sapiens
ucaccuacauuaucuc

SEQ ID NO: 1529255 - RNA, 18 nt, Homo sapiens
ucaccuacauuaucucac

SEQ ID NO: 1529256 - RNA, 16 nt, Homo sapiens
ucacugcuuaacuuca

SEQ ID NO: 1529257 - RNA, 13 nt, Homo sapiens
ucacuucucuuaa

SEQ ID NO: 1529258 - RNA, 17 nt, Homo sapiens
ucagaaauguguuauca

SEQ ID NO: 1529259 - RNA, 12 nt, Homo sapiens
ucagcagcaucg

SEQ ID NO: 1529260 - RNA, 23 nt, Homo sapiens
ucaggcgauccaccugucucagc

SEQ ID NO: 1529261 - RNA, 19 nt, Homo sapiens
ucaguagugagcagcaucu

SEQ ID NO: 1529262 - RNA, 16 nt, Homo sapiens
ucauaauucagcacuu

SEQ ID NO: 1529263 - RNA, 17 nt, Homo sapiens
ucauaauucagcacuua

SEQ ID NO: 1529264 - RNA, 18 nt, Homo sapiens
ucauacuaaacuucaccu

SEQ ID NO: 1529265 - RNA, 21 nt, Homo sapiens
ucaugccacagugguacucug

SEQ ID NO: 1529266 - RNA, 17 nt, Homo sapiens
ucaugccuguaaucuca

SEQ ID NO: 1529267 - RNA, 21 nt, Homo sapiens
ucauguuguugaggcugucac

SEQ ID NO: 1529268 - RNA, 22 nt, Homo sapiens
ucauguuguugaggcugucaca

SEQ ID NO: 1529269 - RNA, 19 nt, Homo sapiens
uccaaacucaaacuugaga

SEQ ID NO: 1529270 - RNA, 13 nt, Homo sapiens
uccaagcccguuc

SEQ ID NO: 1529271 - RNA, 13 nt, Homo sapiens
uccaccugucuca

SEQ ID NO: 1529272 - RNA, 19 nt, Homo sapiens
uccacuucuuguuccccac

SEQ ID NO: 1529273 - RNA, 23 nt, Homo sapiens
uccauaucccuuccucucaggcu

SEQ ID NO: 1529274 - RNA, 20 nt, Homo sapiens
uccauuuauucuuugaucuu

SEQ ID NO: 1529275 - RNA, 15 nt, Homo sapiens
uccauuugcuuuguc

SEQ ID NO: 1529276 - RNA, 17 nt, Homo sapiens
ucccacucagcagugag

SEQ ID NO: 1529277 - RNA, 18 nt, Homo sapiens
ucccggggcuccacugaa

SEQ ID NO: 1529278 - RNA, 18 nt, Homo sapiens
ucccucacuguugaauuu

SEQ ID NO: 1529279 - RNA, 16 nt, Homo sapiens
ucccuccccugccauu

SEQ ID NO: 1529280 - RNA, 12 nt, Homo sapiens
ucccugggaugg

SEQ ID NO: 1529281 - RNA, 21 nt, Homo sapiens
ucccuuuugcuagagcugaca

SEQ ID NO: 1529282 - RNA, 23 nt, Homo sapiens
ucccuuuuuauaucccauuuuua

SEQ ID NO: 1529283 - RNA, 21 nt, Homo sapiens
uccuaauggcauggagacucu

SEQ ID NO: 1529284 - RNA, 17 nt, Homo sapiens
uuauuauggcacaucag

SEQ ID NO: 1529285 - RNA, 20 nt, Homo sapiens
uuauuuaaccugaguauagu

SEQ ID NO: 1529286 - RNA, 16 nt, Homo sapiens
uucacagaauagcaca

SEQ ID NO: 1529287 - RNA, 19 nt, Homo sapiens
uucacagaauagcacaaac

SEQ ID NO: 1529288 - RNA, 18 nt, Homo sapiens
uucacaucagaagcagua

SEQ ID NO: 1529289 - RNA, 14 nt, Homo sapiens
uucacaucugucac

SEQ ID NO: 1529290 - RNA, 16 nt, Homo sapiens
uucaugacaagcauuu

SEQ ID NO: 1529291 - RNA, 17 nt, Homo sapiens
uuccaugguuaccugac

SEQ ID NO: 1529292 - RNA, 21 nt, Homo sapiens
uuccauuuauucuuugaucuu

SEQ ID NO: 1529293 - RNA, 13 nt, Homo sapiens
uucguaguuuuca

SEQ ID NO: 1529294 - RNA, 16 nt, Homo sapiens
uucuaaaggcuaccuu

SEQ ID NO: 1529295 - RNA, 21 nt, Homo sapiens
uucucaaaguuaauucaccua

SEQ ID NO: 1529296 - RNA, 11 nt, Homo sapiens
uucucugccaa

SEQ ID NO: 1529297 - RNA, 16 nt, Homo sapiens
uucuuugauucuccuu

SEQ ID NO: 1529298 - RNA, 20 nt, Homo sapiens
uugaacucuuagugauugag

SEQ ID NO: 1529299 - RNA, 17 nt, Homo sapiens
uugagcuguggcuguga

SEQ ID NO: 1529300 - RNA, 14 nt, Homo sapiens
uugaucacuacaag

SEQ ID NO: 1529301 - RNA, 20 nt, Homo sapiens
uugcccaggcuggucucaaa

SEQ ID NO: 1529302 - RNA, 11 nt, Homo sapiens
uugcuacugua

SEQ ID NO: 1529303 - RNA, 13 nt, Homo sapiens
uugggucuuugaa

SEQ ID NO: 1529304 - RNA, 19 nt, Homo sapiens
uuguagagauggggucuca

SEQ ID NO: 1529305 - RNA, 21 nt, Homo sapiens
uuguagggcuuuagcuuucuu

SEQ ID NO: 1529306 - RNA, 12 nt, Homo sapiens
uugugcauuugg

SEQ ID NO: 1529307 - RNA, 19 nt, Homo sapiens
uuguguggagaacucagug

SEQ ID NO: 1529308 - RNA, 21 nt, Homo sapiens
uuguuaguaugaggcauuugu

SEQ ID NO: 1529309 - RNA, 16 nt, Homo sapiens
uuuaaaugcaccugga

SEQ ID NO: 1529310 - RNA, 23 nt, Homo sapiens
uuuccaguuuauaagacuggaau

SEQ ID NO: 1529311 - RNA, 18 nt, Homo sapiens
uuucuaugacacaugcaa

SEQ ID NO: 1529312 - RNA, 23 nt, Homo sapiens
uuucuauuuaccuccuaauggca

SEQ ID NO: 1529313 - RNA, 17 nt, Homo sapiens
uuucuuuuccuucauuc

SEQ ID NO: 1529314 - RNA, 18 nt, Homo sapiens
uuugagcuguggcuguga

SEQ ID NO: 1529315 - RNA, 17 nt, Homo sapiens
uuugccaaggcaaaaaa

SEQ ID NO: 1529316 - RNA, 15 nt, Homo sapiens
uuuuaaaugcaccug

SEQ ID NO: 1529317 - RNA, 21 nt, Homo sapiens
uuuuaagaaaaaggaugcaca

SEQ ID NO: 1529318 - RNA, 20 nt, Homo sapiens
uuuuagaaaccccucuguag

SEQ ID NO: 1529319 - RNA, 11 nt, Homo sapiens
uuuucauucau

SEQ ID NO: 1529320 - RNA, 21 nt, Homo sapiens
uuuugguagaugcaugacuug

SEQ ID NO: 1529321 - RNA, 19 nt, Homo sapiens
uuuuuaagugcugcauuua

SEQ ID NO: 1529322 - RNA, 22 nt, Homo sapiens
uuuuucuuugagacugggucuc

SEQ ID NO: 1529323 - RNA, 16 nt, Homo sapiens
uccuacagggccacaa

SEQ ID NO: 1529324 - RNA, 23 nt, Homo sapiens
uccuacuccuggagcacuguaaa

SEQ ID NO: 1529325 - RNA, 17 nt, Homo sapiens
uccucuacuguuuaaca

SEQ ID NO: 1529326 - RNA, 14 nt, Homo sapiens
uccucuuugcccug

SEQ ID NO: 1529327 - RNA, 15 nt, Homo sapiens
uccugaugaugcugg

SEQ ID NO: 1529328 - RNA, 19 nt, Homo sapiens
uccuggagcacuguaaaaa

SEQ ID NO: 1529329 - RNA, 12 nt, Homo sapiens
uccuucuguugc

SEQ ID NO: 1529330 - RNA, 18 nt, Homo sapiens
ucuaaaggcuaccuuugu

SEQ ID NO: 1529331 - RNA, 16 nt, Homo sapiens
ucuacagaauaaucca

SEQ ID NO: 1529332 - RNA, 15 nt, Homo sapiens
ucuaugacacaugca

SEQ ID NO: 1529333 - RNA, 16 nt, Homo sapiens
ucuauuuauuugacug

SEQ ID NO: 1529334 - RNA, 15 nt, Homo sapiens
ucucaagcuaguguu

SEQ ID NO: 1529335 - RNA, 22 nt, Homo sapiens
ucucacugugggaaggccagcu

SEQ ID NO: 1529336 - RNA, 14 nt, Homo sapiens
ucucagcccagaag

SEQ ID NO: 1529337 - RNA, 22 nt, Homo sapiens
ucuccacacggagcuccuggca

SEQ ID NO: 1529338 - RNA, 12 nt, Homo sapiens
ucuccccagaau

SEQ ID NO: 1529339 - RNA, 23 nt, Homo sapiens
ucucccuguuggucgguggguug

SEQ ID NO: 1529340 - RNA, 22 nt, Homo sapiens
ucucguuucugcccagcccucu

SEQ ID NO: 1529341 - RNA, 21 nt, Homo sapiens
ucugcuguacauuauuaaaag

SEQ ID NO: 1529342 - RNA, 17 nt, Homo sapiens
ucuggccggagcugccu

SEQ ID NO: 1529343 - RNA, 20 nt, Homo sapiens
ucugggaagcugagggcaaa

SEQ ID NO: 1529344 - RNA, 15 nt, Homo sapiens
ucugugacauacaua

SEQ ID NO: 1529345 - RNA, 19 nt, Homo sapiens
ucuuaacccccuagaaaga

SEQ ID NO: 1529346 - RNA, 12 nt, Homo sapiens
ucuucacaggca

SEQ ID NO: 1529347 - RNA, 18 nt, Homo sapiens
ucuucacaggcacuccug

SEQ ID NO: 1529348 - RNA, 15 nt, Homo sapiens
ugaaaugcuggcauu

SEQ ID NO: 1529349 - RNA, 19 nt, Homo sapiens
ugaaaugcuggcauuugca

SEQ ID NO: 1529350 - RNA, 18 nt, Homo sapiens
ugaacuagggaagcucag

SEQ ID NO: 1529351 - RNA, 12 nt, Homo sapiens
ugaaugcuucuc

SEQ ID NO: 1529352 - RNA, 15 nt, Homo sapiens
ugaauucuaacauua

SEQ ID NO: 1529353 - RNA, 17 nt, Homo sapiens
ugaauuguuaauucaca

SEQ ID NO: 1529354 - RNA, 23 nt, Homo sapiens
ugaauuguuaauucacagaauag

SEQ ID NO: 1529355 - RNA, 12 nt, Homo sapiens
ugacagccuccc

SEQ ID NO: 1529356 - RNA, 13 nt, Homo sapiens
ugacauacauauu

SEQ ID NO: 1529357 - RNA, 16 nt, Homo sapiens
ugagaaaauaucuugc

SEQ ID NO: 1529358 - RNA, 23 nt, Homo sapiens
ugagaaauaaaaagccugucauu

SEQ ID NO: 1529359 - RNA, 14 nt, Homo sapiens
ugagaccucaaauc

SEQ ID NO: 1529360 - RNA, 18 nt, Homo sapiens
ugagaguuccucuuugcc

SEQ ID NO: 1529361 - RNA, 21 nt, Homo sapiens
ugagcucgguggcucaugccu

SEQ ID NO: 1529362 - RNA, 13 nt, Homo sapiens
ugaggcugucaca

SEQ ID NO: 1529363 - RNA, 14 nt, Homo sapiens
ugaggcugucacag

SEQ ID NO: 1529364 - RNA, 21 nt, Homo sapiens
ugagggaggaagaaggcagug

SEQ ID NO: 1529365 - RNA, 21 nt, Homo sapiens
ugauaggaagcgucuggcaga

SEQ ID NO: 1529366 - RNA, 20 nt, Homo sapiens
ugaugagagaauggagacag

SEQ ID NO: 1529367 - RNA, 15 nt, Homo sapiens
ugaugcaggcacuua

SEQ ID NO: 1529368 - RNA, 16 nt, Homo sapiens
ugaugcaggcacuuau

SEQ ID NO: 1529369 - RNA, 22 nt, Homo sapiens
ugauggaacuuagacuccucuu

SEQ ID NO: 1529370 - RNA, 19 nt, Homo sapiens
ugcaagcacaucugcauuu

SEQ ID NO: 1529371 - RNA, 18 nt, Homo sapiens
ugcaauaggugugcguca

SEQ ID NO: 1529372 - RNA, 23 nt, Homo sapiens
ugcacacauuuuuuaaaugcacc

SEQ ID NO: 1529373 - RNA, 15 nt, Homo sapiens
ugcauaaaugcauaa

SEQ ID NO: 1529374 - RNA, 23 nt, Homo sapiens
ugcauaccacuuuuguucuuggu

SEQ ID NO: 1529375 - RNA, 18 nt, Homo sapiens
ugcaugaaguaauaugca

SEQ ID NO: 1529376 - RNA, 20 nt, Homo sapiens
ugcauuaaaggagaucuucc

SEQ ID NO: 1529377 - RNA, 17 nt, Homo sapiens
ugcccuaaaguguauuu

SEQ ID NO: 1529378 - RNA, 17 nt, Homo sapiens
ugccuccaacccagcag

SEQ ID NO: 1529379 - RNA, 23 nt, Homo sapiens
ugccuccaacccagcaguucucu

SEQ ID NO: 1529380 - RNA, 22 nt, Homo sapiens
ugccuguaaucucagcacuuug

SEQ ID NO: 1529381 - RNA, 14 nt, Homo sapiens
ugcuggcauuugca

SEQ ID NO: 1529382 - RNA, 15 nt, Homo sapiens
ugcuggcauuugcac

SEQ ID NO: 1529383 - RNA, 22 nt, Homo sapiens
ugcuggcauuugcaccuaccuc

SEQ ID NO: 1529384 - RNA, 21 nt, Homo sapiens
ugcuugagcuuucugugcaug

SEQ ID NO: 1529385 - RNA, 20 nt, Homo sapiens
uggaaaccucuggaggucau

SEQ ID NO: 1529386 - RNA, 16 nt, Homo sapiens
uggaauguuacaucug

SEQ ID NO: 1529387 - RNA, 16 nt, Homo sapiens
uggaggccuaccucuc

SEQ ID NO: 1529388 - RNA, 20 nt, Homo sapiens
uggauuaaacuuaaucuaaa

SEQ ID NO: 1529389 - RNA, 17 nt, Homo sapiens
uggauuguuacagcuuc

SEQ ID NO: 1529390 - RNA, 23 nt, Homo sapiens
uggauuugaucacuacaaguauu

SEQ ID NO: 1529391 - RNA, 17 nt, Homo sapiens
uggcagcuagugccuuu

SEQ ID NO: 1529392 - RNA, 17 nt, Homo sapiens
uggcaggggggcugugg

SEQ ID NO: 1529393 - RNA, 21 nt, Homo sapiens
uggccaggccucuuggcaguc

SEQ ID NO: 1529394 - RNA, 13 nt, Homo sapiens
uggcccagccaaa

SEQ ID NO: 1529395 - RNA, 16 nt, Homo sapiens
uggcuccucuacuguu

SEQ ID NO: 1529396 - RNA, 22 nt, Homo sapiens
uggcugugagggguguuuggga

SEQ ID NO: 1529397 - RNA, 16 nt, Homo sapiens
uggcuuuugugcauua

SEQ ID NO: 1529398 - RNA, 22 nt, Homo sapiens
ugggcuccugacaauacuguau

SEQ ID NO: 1529399 - RNA, 15 nt, Homo sapiens
ugguauacuuuugcu

SEQ ID NO: 1529400 - RNA, 13 nt, Homo sapiens
uggucauccaaac

SEQ ID NO: 1529401 - RNA, 15 nt, Homo sapiens
uggucauccaaacuc

SEQ ID NO: 1529402 - RNA, 22 nt, Homo sapiens
ugguuguagugggaagucccgc

SEQ ID NO: 1529403 - RNA, 12 nt, Homo sapiens
uguaaucucagc

SEQ ID NO: 1529404 - RNA, 17 nt, Homo sapiens
uguaaucucagcacuuu

SEQ ID NO: 1529405 - RNA, 21 nt, Homo sapiens
uguaauuuauuaacuaaucaa

SEQ ID NO: 1529406 - RNA, 20 nt, Homo sapiens
uguaauuugugauacaaugc

SEQ ID NO: 1529407 - RNA, 12 nt, Homo sapiens
uguaucaugaca

SEQ ID NO: 1529408 - RNA, 15 nt, Homo sapiens
uguauguagccuuag

SEQ ID NO: 1529409 - RNA, 13 nt, Homo sapiens
ugucuauucuugu

SEQ ID NO: 1529410 - RNA, 15 nt, Homo sapiens
ugucuggccaggccu

SEQ ID NO: 1529411 - RNA, 13 nt, Homo sapiens
ugugaggcacugu

SEQ ID NO: 1529412 - RNA, 18 nt, Homo sapiens
ugugaggguggugggugg

SEQ ID NO: 1529413 - RNA, 23 nt, Homo sapiens
ugugcacuuucuucucuuuccca

SEQ ID NO: 1529414 - RNA, 14 nt, Homo sapiens
ugugugcuuuccca

SEQ ID NO: 1529415 - RNA, 22 nt, Homo sapiens
uguguggagaacucagugccac

SEQ ID NO: 1529416 - RNA, 23 nt, Homo sapiens
uguuaauucacagaauagcacaa

SEQ ID NO: 1529417 - RNA, 14 nt, Homo sapiens
uguucccacucagc

SEQ ID NO: 1529418 - RNA, 14 nt, Homo sapiens
uguugacauacauu

SEQ ID NO: 1529419 - RNA, 18 nt, Homo sapiens
uguugaugaaguauacuu

SEQ ID NO: 1529420 - RNA, 12 nt, Homo sapiens
uguugcaccuga

SEQ ID NO: 1529421 - RNA, 21 nt, Homo sapiens
uguugcccaggcuggucucaa

SEQ ID NO: 1529422 - RNA, 18 nt, Homo sapiens
uguuuacguuugauacaa

SEQ ID NO: 1529423 - RNA, 12 nt, Homo sapiens
uguuugugauug

SEQ ID NO: 1529424 - RNA, 19 nt, Homo sapiens
uuaaaacaauucugugaca

SEQ ID NO: 1529425 - RNA, 16 nt, Homo sapiens
uuaaaaucugugaaga

SEQ ID NO: 1529426 - RNA, 20 nt, Homo sapiens
uuaaauaaugugaaacugga

SEQ ID NO: 1529427 - RNA, 13 nt, Homo sapiens
uuaagaagacaua

SEQ ID NO: 1529428 - RNA, 15 nt, Homo sapiens
uuaagaagacauacu

SEQ ID NO: 1529429 - RNA, 22 nt, Homo sapiens
uuaauucacagaauagcacaaa

SEQ ID NO: 1529430 - RNA, 22 nt, Homo sapiens
uuagauguuucaacugugcucu

SEQ ID NO: 1529431 - RNA, 17 nt, Homo sapiens
uuaggaaaggagaucaa

SEQ ID NO: 1529432 - RNA, 17 nt, Homo sapiens
uuaguccaauuccuugc

SEQ ID NO: 1529433 - RNA, 14 nt, Homo sapiens
uuauaagacuggaa

SEQ ID NO: 1529434 - RNA, 12 nt, Homo sapiens
uuaucugucaca

SEQ ID NO: 1529435 - RNA, 18 nt, Homo sapiens
uuauggcuuuugugcauu

SEQ ID NO: 1529436 - RNA, 21 nt, Homo sapiens
uuauguguaguugucucucuu

SEQ ID NO: 1529437 - RNA, 14 nt, Homo sapiens
uuaugugugccuuu

SEQ ID NO: 1529438 - RNA, 15 nt, Homo sapiens
aaaaagccugucauu

SEQ ID NO: 1529439 - RNA, 15 nt, Homo sapiens
aaaaauguccugccu

SEQ ID NO: 1529440 - RNA, 22 nt, Homo sapiens
aaaacaacagcucgauccaaau

SEQ ID NO: 1529441 - RNA, 19 nt, Homo sapiens
aaaacaccgcuucugccuu

SEQ ID NO: 1529442 - RNA, 13 nt, Homo sapiens
aaaacuaagcaca

SEQ ID NO: 1529443 - RNA, 18 nt, Homo sapiens
aaaaggaaaaccaucucu

SEQ ID NO: 1529444 - RNA, 12 nt, Homo sapiens
aaaaugacauua

SEQ ID NO: 1529445 - RNA, 20 nt, Homo sapiens
aaaaugugaggguggugggu

SEQ ID NO: 1529446 - RNA, 15 nt, Homo sapiens
aaaauuuagcccuuu

SEQ ID NO: 1529447 - RNA, 23 nt, Homo sapiens
aaacauguauuuauguaaugaag

SEQ ID NO: 1529448 - RNA, 23 nt, Homo sapiens
aaaccaucucugugauuaccucu

SEQ ID NO: 1529449 - RNA, 14 nt, Homo sapiens
aaacuaagcacaaa

SEQ ID NO: 1529450 - RNA, 23 nt, Homo sapiens
aaacuucaccuacauuaucucac

SEQ ID NO: 1529451 - RNA, 14 nt, Homo sapiens
aaagguuuuccuua

SEQ ID NO: 1529452 - RNA, 22 nt, Homo sapiens
aaauacugugcagaauaaugga

SEQ ID NO: 1529453 - RNA, 16 nt, Homo sapiens
aaauauaagacauuug

SEQ ID NO: 1529454 - RNA, 15 nt, Homo sapiens
aaauauauauaaaga

SEQ ID NO: 1529455 - RNA, 12 nt, Homo sapiens
aaaucacugcau

SEQ ID NO: 1529456 - RNA, 19 nt, Homo sapiens
aacaccgcuucugccuuuu

SEQ ID NO: 1529457 - RNA, 13 nt, Homo sapiens
aacagcaaaucac

SEQ ID NO: 1529458 - RNA, 17 nt, Homo sapiens
aacagcucgauccaaau

SEQ ID NO: 1529459 - RNA, 17 nt, Homo sapiens
aacaucuuuuacauucu

SEQ ID NO: 1529460 - RNA, 18 nt, Homo sapiens
aacaucuuuuacauucug

SEQ ID NO: 1529461 - RNA, 13 nt, Homo sapiens
aaccagagaggcu

SEQ ID NO: 1529462 - RNA, 16 nt, Homo sapiens
aacccagcaguucucu

SEQ ID NO: 1529463 - RNA, 21 nt, Homo sapiens
aacccugcuguuucauuguua

SEQ ID NO: 1529464 - RNA, 19 nt, Homo sapiens
aaccuucacaucugucacg

SEQ ID NO: 1529465 - RNA, 14 nt, Homo sapiens
aaccuuugggccaa

SEQ ID NO: 1529466 - RNA, 20 nt, Homo sapiens
aacucaacugggcucugucc

SEQ ID NO: 1529467 - RNA, 15 nt, Homo sapiens
aacucuuccaccucu

SEQ ID NO: 1529468 - RNA, 19 nt, Homo sapiens
aacucuuccaccucugggg

SEQ ID NO: 1529469 - RNA, 16 nt, Homo sapiens
aacuggagugguuuga

SEQ ID NO: 1529470 - RNA, 12 nt, Homo sapiens
aacugugcucuu

SEQ ID NO: 1529471 - RNA, 20 nt, Homo sapiens
aacuuagaucaucagucacc

SEQ ID NO: 1529472 - RNA, 16 nt, Homo sapiens
aacuucaccuacauua

SEQ ID NO: 1529473 - RNA, 18 nt, Homo sapiens
aagaaaaacaucuuuggc

SEQ ID NO: 1529474 - RNA, 15 nt, Homo sapiens
aagacaugcuugggu

SEQ ID NO: 1529475 - RNA, 22 nt, Homo sapiens
aagaguauuuuaagaagacaua

SEQ ID NO: 1529476 - RNA, 19 nt, Homo sapiens
aagauauauuucacuuuug

SEQ ID NO: 1529477 - RNA, 17 nt, Homo sapiens
aagcgcacauucaugug

SEQ ID NO: 1529478 - RNA, 22 nt, Homo sapiens
aaggaaaaccaucucugugauu

SEQ ID NO: 1529479 - RNA, 15 nt, Homo sapiens
aaggaaaucucaccc

SEQ ID NO: 1529480 - RNA, 16 nt, Homo sapiens
aaggaauccuggugga

SEQ ID NO: 1529481 - RNA, 13 nt, Homo sapiens
aaggagauuuaca

SEQ ID NO: 1529482 - RNA, 16 nt, Homo sapiens
aaggauuacucuccau

SEQ ID NO: 1529483 - RNA, 23 nt, Homo sapiens
aaggcaaaaaacucuuaaucugu

SEQ ID NO: 1529484 - RNA, 16 nt, Homo sapiens
aagggcaucauccuca

SEQ ID NO: 1529485 - RNA, 12 nt, Homo sapiens
aagggccuggga

SEQ ID NO: 1529486 - RNA, 17 nt, Homo sapiens
aagguuuuuacugugag

SEQ ID NO: 1529487 - RNA, 18 nt, Homo sapiens
aaguaaguuaauaaugua

SEQ ID NO: 1529488 - RNA, 18 nt, Homo sapiens
aaguaccuugaacucuua

SEQ ID NO: 1529489 - RNA, 21 nt, Homo sapiens
aaguauacuuuuccccuguua

SEQ ID NO: 1529490 - RNA, 15 nt, Homo sapiens
aaguauuauuuuaca

SEQ ID NO: 1529491 - RNA, 23 nt, Homo sapiens
aagugaaggacauagagguauau

SEQ ID NO: 1529492 - RNA, 23 nt, Homo sapiens
aaguuuuuauggcuuuugugcau

SEQ ID NO: 1529493 - RNA, 22 nt, Homo sapiens
aauaacacuguauuuuaaugua

SEQ ID NO: 1529494 - RNA, 21 nt, Homo sapiens
aaucaacaaaauggucaucca

SEQ ID NO: 1529495 - RNA, 21 nt, Homo sapiens
caacccagcaguucucugcca

SEQ ID NO: 1529496 - RNA, 21 nt, Homo sapiens
caacugcccccgccacaaccc

SEQ ID NO: 1529497 - RNA, 19 nt, Homo sapiens
caaggcccauaucugugaa

SEQ ID NO: 1529498 - RNA, 20 nt, Homo sapiens
caauucagauugucuugcaa

SEQ ID NO: 1529499 - RNA, 20 nt, Homo sapiens
caauucugugacauacauau

SEQ ID NO: 1529500 - RNA, 11 nt, Homo sapiens
cacaaagggaa

SEQ ID NO: 1529501 - RNA, 17 nt, Homo sapiens
cacacccaccucugcca

SEQ ID NO: 1529502 - RNA, 18 nt, Homo sapiens
cacagacacaauauguau

SEQ ID NO: 1529503 - RNA, 20 nt, Homo sapiens
cacagagcaggacugcacag

SEQ ID NO: 1529504 - RNA, 23 nt, Homo sapiens
cacagagugcauugugaggguua

SEQ ID NO: 1529505 - RNA, 14 nt, Homo sapiens
cacagcguccuguc

SEQ ID NO: 1529506 - RNA, 19 nt, Homo sapiens
cacagcguccuguccacac

SEQ ID NO: 1529507 - RNA, 16 nt, Homo sapiens
cacagguucaugccac

SEQ ID NO: 1529508 - RNA, 12 nt, Homo sapiens
cacaucugucac

SEQ ID NO: 1529509 - RNA, 19 nt, Homo sapiens
cacauucaugugggcauuu

SEQ ID NO: 1529510 - RNA, 20 nt, Homo sapiens
caccaagcagcaacagcaaa

SEQ ID NO: 1529511 - RNA, 16 nt, Homo sapiens
cacccaccucugccac

SEQ ID NO: 1529512 - RNA, 21 nt, Homo sapiens
cacccuuccccuccuucuccc

SEQ ID NO: 1529513 - RNA, 21 nt, Homo sapiens
cacuaccguaaauguccauuu

SEQ ID NO: 1529514 - RNA, 16 nt, Homo sapiens
cacucagggagcauuu

SEQ ID NO: 1529515 - RNA, 18 nt, Homo sapiens
cacuggaaauguuugucc

SEQ ID NO: 1529516 - RNA, 23 nt, Homo sapiens
cacugugggaaggccagcugccc

SEQ ID NO: 1529517 - RNA, 19 nt, Homo sapiens
cacuuaguccuuuaucauc

SEQ ID NO: 1529518 - RNA, 20 nt, Homo sapiens
cagaaaguaucacaaaugga

SEQ ID NO: 1529519 - RNA, 17 nt, Homo sapiens
cagaacaucgauaugua

SEQ ID NO: 1529520 - RNA, 18 nt, Homo sapiens
cagaacaucgauauguau

SEQ ID NO: 1529521 - RNA, 20 nt, Homo sapiens
cagaacaucgauauguauau

SEQ ID NO: 1529522 - RNA, 21 nt, Homo sapiens
cagaaccuuggcgguuuauag

SEQ ID NO: 1529523 - RNA, 13 nt, Homo sapiens
cagaagcuuaaaa

SEQ ID NO: 1529524 - RNA, 13 nt, Homo sapiens
cagacaauuccau

SEQ ID NO: 1529525 - RNA, 16 nt, Homo sapiens
cagacugucaagaaga

SEQ ID NO: 1529526 - RNA, 21 nt, Homo sapiens
cagauggacuccagccugccu

SEQ ID NO: 1529527 - RNA, 11 nt, Homo sapiens
cagcagcaucg

SEQ ID NO: 1529528 - RNA, 14 nt, Homo sapiens
cagcauuuccacac

SEQ ID NO: 1529529 - RNA, 18 nt, Homo sapiens
caggagcccuacugaagg

SEQ ID NO: 1529530 - RNA, 17 nt, Homo sapiens
caggaguucaagaccag

SEQ ID NO: 1529531 - RNA, 19 nt, Homo sapiens
caggaugguggacuacaaa

SEQ ID NO: 1529532 - RNA, 22 nt, Homo sapiens
caggccucuuggcagucacauc

SEQ ID NO: 1529533 - RNA, 13 nt, Homo sapiens
caggcuacucugc

SEQ ID NO: 1529534 - RNA, 21 nt, Homo sapiens
caggggagguguauuguguau

SEQ ID NO: 1529535 - RNA, 14 nt, Homo sapiens
caggggggcugugg

SEQ ID NO: 1529536 - RNA, 17 nt, Homo sapiens
cagugucccuuuugcua

SEQ ID NO: 1529537 - RNA, 22 nt, Homo sapiens
caguucaacugcuuacucccaa

SEQ ID NO: 1529538 - RNA, 18 nt, Homo sapiens
caguuuuauuuuugccaa

SEQ ID NO: 1529539 - RNA, 20 nt, Homo sapiens
caguuuuauuuuugccaagg

SEQ ID NO: 1529540 - RNA, 20 nt, Homo sapiens
cauaaaaauaaaucaguuca

SEQ ID NO: 1529541 - RNA, 16 nt, Homo sapiens
cauaauucagcacuua

SEQ ID NO: 1529542 - RNA, 20 nt, Homo sapiens
cauaauucagcacuuaacua

SEQ ID NO: 1529543 - RNA, 22 nt, Homo sapiens
cauacauucccucuaauuugaa

SEQ ID NO: 1529544 - RNA, 22 nt, Homo sapiens
cauaguagguacccaauucaau

SEQ ID NO: 1529545 - RNA, 16 nt, Homo sapiens
cauaucaauuggcagu

SEQ ID NO: 1529546 - RNA, 19 nt, Homo sapiens
cauaucuuagguauauaau

SEQ ID NO: 1529547 - RNA, 15 nt, Homo sapiens
caucgcgaugucgca

SEQ ID NO: 1529548 - RNA, 14 nt, Homo sapiens
caucuugugaaaug

SEQ ID NO: 1529549 - RNA, 22 nt, Homo sapiens
caucuugugaaauggccaggau

SEQ ID NO: 1529550 - RNA, 18 nt, Homo sapiens
caucuuuuacauucugca

SEQ ID NO: 1529551 - RNA, 23 nt, Homo sapiens
gacauacauucccucuaauuuga

SEQ ID NO: 1529552 - RNA, 14 nt, Homo sapiens
gaccucauguuguu

SEQ ID NO: 1529553 - RNA, 22 nt, Homo sapiens
gacugaguacguugugcauuug

SEQ ID NO: 1529554 - RNA, 19 nt, Homo sapiens
gacuuccauuugcuuuguc

SEQ ID NO: 1529555 - RNA, 23 nt, Homo sapiens
gacuuggcaggugccuguugaau

SEQ ID NO: 1529556 - RNA, 20 nt, Homo sapiens
gagaaauaaaaagccuguca

SEQ ID NO: 1529557 - RNA, 12 nt, Homo sapiens
gagcacuguaaa

SEQ ID NO: 1529558 - RNA, 13 nt, Homo sapiens
gagcaucucugcc

SEQ ID NO: 1529559 - RNA, 18 nt, Homo sapiens
gagccccucaugccacag

SEQ ID NO: 1529560 - RNA, 20 nt, Homo sapiens
gagcuuuuaaaaauguccug

SEQ ID NO: 1529561 - RNA, 12 nt, Homo sapiens
gaggaaagggag

SEQ ID NO: 1529562 - RNA, 20 nt, Homo sapiens
gaggcaggaagauagcuuga

SEQ ID NO: 1529563 - RNA, 16 nt, Homo sapiens
gagggaggcaucugca

SEQ ID NO: 1529564 - RNA, 13 nt, Homo sapiens
gauagaugucuau

SEQ ID NO: 1529565 - RNA, 18 nt, Homo sapiens
gauauuacuacuuaccau

SEQ ID NO: 1529566 - RNA, 19 nt, Homo sapiens
gaucuucagggaacugcau

SEQ ID NO: 1529567 - RNA, 23 nt, Homo sapiens
gauuacucuccauaucccuuccu

SEQ ID NO: 1529568 - RNA, 21 nt, Homo sapiens
gauuacugaauuguaucaauu

SEQ ID NO: 1529569 - RNA, 21 nt, Homo sapiens
gauuccguauugguauacuuu

SEQ ID NO: 1529570 - RNA, 19 nt, Homo sapiens
gauucucccaaaguaccuu

SEQ ID NO: 1529571 - RNA, 16 nt, Homo sapiens
gauugaaagaaccaga

SEQ ID NO: 1529572 - RNA, 16 nt, Homo sapiens
gauuuccuuaaccuua

SEQ ID NO: 1529573 - RNA, 15 nt, Homo sapiens
gauuucuguuuagau

SEQ ID NO: 1529574 - RNA, 22 nt, Homo sapiens
gcacacugccagucucacugug

SEQ ID NO: 1529575 - RNA, 20 nt, Homo sapiens
gcacagcguccuguccacac

SEQ ID NO: 1529576 - RNA, 12 nt, Homo sapiens
gcaccuaccuca

SEQ ID NO: 1529577 - RNA, 13 nt, Homo sapiens
gcaccuaccucac

SEQ ID NO: 1529578 - RNA, 22 nt, Homo sapiens
gcacguggccaggagccaugac

SEQ ID NO: 1529579 - RNA, 18 nt, Homo sapiens
gcacuagagaaugcacag

SEQ ID NO: 1529580 - RNA, 17 nt, Homo sapiens
gcacucagggagcauuu

SEQ ID NO: 1529581 - RNA, 22 nt, Homo sapiens
gcacuguggggcaggacaaggg

SEQ ID NO: 1529582 - RNA, 9 nt, Homo sapiens
gcacuguuu

SEQ ID NO: 1529583 - RNA, 18 nt, Homo sapiens
gcagggaaggaauccugg

SEQ ID NO: 1529584 - RNA, 22 nt, Homo sapiens
gcagguuccuuaucugucacac

SEQ ID NO: 1529585 - RNA, 14 nt, Homo sapiens
gcauagauugauca

SEQ ID NO: 1529586 - RNA, 19 nt, Homo sapiens
gcaucucugccuccaaccc

SEQ ID NO: 1529587 - RNA, 19 nt, Homo sapiens
gcauuuggugguuucagaa

SEQ ID NO: 1529588 - RNA, 23 nt, Homo sapiens
gccacuuagacacuuuaccucuu

SEQ ID NO: 1529589 - RNA, 17 nt, Homo sapiens
gccagauggacuccagc

SEQ ID NO: 1529590 - RNA, 20 nt, Homo sapiens
gccaggauccucuccuuuga

SEQ ID NO: 1529591 - RNA, 22 nt, Homo sapiens
gccauuuuggguuuugggucuu

SEQ ID NO: 1529592 - RNA, 14 nt, Homo sapiens
gcccauaucuguga

SEQ ID NO: 1529593 - RNA, 18 nt, Homo sapiens
gcccuacaguacccccau

SEQ ID NO: 1529594 - RNA, 12 nt, Homo sapiens
gccgccaugcuu

SEQ ID NO: 1529595 - RNA, 18 nt, Homo sapiens
gccgcuuugucuguccag

SEQ ID NO: 1529596 - RNA, 20 nt, Homo sapiens
gccuaccucucguuucugcc

SEQ ID NO: 1529597 - RNA, 17 nt, Homo sapiens
gccucgcagccuccgga

SEQ ID NO: 1529598 - RNA, 16 nt, Homo sapiens
gccugccuggcaggcu

SEQ ID NO: 1529599 - RNA, 15 nt, Homo sapiens
gccuggugugguggc

SEQ ID NO: 1529600 - RNA, 23 nt, Homo sapiens
gccuguaaucccaacacuuugag

SEQ ID NO: 1529601 - RNA, 19 nt, Homo sapiens
gccuguaaucucagcacuu

SEQ ID NO: 1529602 - RNA, 10 nt, Homo sapiens
gccugucauu

SEQ ID NO: 1529603 - RNA, 14 nt, Homo sapiens
gccuuccacaguga

SEQ ID NO: 1529604 - RNA, 20 nt, Homo sapiens
gccuuccacagugaaugugu

SEQ ID NO: 1529605 - RNA, 13 nt, Homo sapiens
gcgcacuuaccug

SEQ ID NO: 1529606 - RNA, 22 nt, Homo sapiens
gcgcuuugagaggcugaggcag

SEQ ID NO: 1529607 - RNA, 14 nt, Homo sapiens
gcggccuccaugca

SEQ ID NO: 1529608 - RNA, 14 nt, Homo sapiens
gcguacagaucucu

SEQ ID NO: 1529609 - RNA, 15 nt, Homo sapiens
gcuaagcugcccuga

SEQ ID NO: 1529610 - RNA, 12 nt, Homo sapiens
gcuagugccuuu

SEQ ID NO: 1529611 - RNA, 15 nt, Homo sapiens
gcucaaucacacugg

SEQ ID NO: 1529612 - RNA, 13 nt, Homo sapiens
gcuccacugaaca

SEQ ID NO: 1529613 - RNA, 15 nt, Homo sapiens
gcugcaccacuucca

SEQ ID NO: 1529614 - RNA, 19 nt, Homo sapiens
gcugcaccacuuccagggu

SEQ ID NO: 1529615 - RNA, 20 nt, Homo sapiens
gcugcggggggcaccagagg

SEQ ID NO: 1529616 - RNA, 18 nt, Homo sapiens
gcuggcccaguuguccau

SEQ ID NO: 1529617 - RNA, 17 nt, Homo sapiens
gcuggcccuacaguacc

SEQ ID NO: 1529618 - RNA, 22 nt, Homo sapiens
ucccuuuugcuagagcugacag

SEQ ID NO: 1529619 - RNA, 22 nt, Homo sapiens
uccuaauggcauggagacucug

SEQ ID NO: 1529620 - RNA, 20 nt, Homo sapiens
uccuacccuccugcacuguu

SEQ ID NO: 1529621 - RNA, 18 nt, Homo sapiens
uccuggaaacagcagugu

SEQ ID NO: 1529622 - RNA, 14 nt, Homo sapiens
uccuggagcacugu

SEQ ID NO: 1529623 - RNA, 14 nt, Homo sapiens
uccuuaaccuuaac

SEQ ID NO: 1529624 - RNA, 22 nt, Homo sapiens
ucgauauguauaucauucuaca

SEQ ID NO: 1529625 - RNA, 21 nt, Homo sapiens
ucgauccaaauugugcuucuc

SEQ ID NO: 1529626 - RNA, 22 nt, Homo sapiens
ucggggaccagcccacagcaca

SEQ ID NO: 1529627 - RNA, 22 nt, Homo sapiens
ucguuuugcccgauuccguauu

SEQ ID NO: 1529628 - RNA, 16 nt, Homo sapiens
ucuagauacuguauca

SEQ ID NO: 1529629 - RNA, 13 nt, Homo sapiens
ucuauuugugcuu

SEQ ID NO: 1529630 - RNA, 19 nt, Homo sapiens
ucucaagcuaguguuucua

SEQ ID NO: 1529631 - RNA, 18 nt, Homo sapiens
ucucagacuguggaacca

SEQ ID NO: 1529632 - RNA, 19 nt, Homo sapiens
ucucccuccccugccauuu

SEQ ID NO: 1529633 - RNA, 17 nt, Homo sapiens
ucucgaaugcugagaag

SEQ ID NO: 1529634 - RNA, 18 nt, Homo sapiens
ucucgcuuuguugcccag

SEQ ID NO: 1529635 - RNA, 16 nt, Homo sapiens
ucucucccagguccca

SEQ ID NO: 1529636 - RNA, 23 nt, Homo sapiens
ucucucccaggucccagccccuu

SEQ ID NO: 1529637 - RNA, 23 nt, Homo sapiens
ucugaaggcucguuuggcuuuau

SEQ ID NO: 1529638 - RNA, 17 nt, Homo sapiens
ucuggcuaugcauuuga

SEQ ID NO: 1529639 - RNA, 22 nt, Homo sapiens
ucuguccagccgugugugcaug

SEQ ID NO: 1529640 - RNA, 14 nt, Homo sapiens
ucugugaagaaaga

SEQ ID NO: 1529641 - RNA, 19 nt, Homo sapiens
ucugugaagaaagagguua

SEQ ID NO: 1529642 - RNA, 16 nt, Homo sapiens
ucuuaugugugccuuu

SEQ ID NO: 1529643 - RNA, 21 nt, Homo sapiens
ucuucagggaacugcauagau

SEQ ID NO: 1529644 - RNA, 15 nt, Homo sapiens
ucuucuuuuacugga

SEQ ID NO: 1529645 - RNA, 22 nt, Homo sapiens
ucuugaaauauaggaacuuaaa

SEQ ID NO: 1529646 - RNA, 15 nt, Homo sapiens
ucuugcacuguccag

SEQ ID NO: 1529647 - RNA, 21 nt, Homo sapiens
ucuuggggcaagacugcaaac

SEQ ID NO: 1529648 - RNA, 17 nt, Homo sapiens
ucuuuggaggcuuuuaa

SEQ ID NO: 1529649 - RNA, 16 nt, Homo sapiens
ucuuuuacauucugca

SEQ ID NO: 1529650 - RNA, 15 nt, Homo sapiens
ugaaagaaccagaga

SEQ ID NO: 1529651 - RNA, 19 nt, Homo sapiens
ugaaauaauguacaucugg

SEQ ID NO: 1529652 - RNA, 16 nt, Homo sapiens
ugaaaugcuggcauuu

SEQ ID NO: 1529653 - RNA, 16 nt, Homo sapiens
ugaaggaaucauucca

SEQ ID NO: 1529654 - RNA, 12 nt, Homo sapiens
ugacaaccucuu

SEQ ID NO: 1529655 - RNA, 16 nt, Homo sapiens
ugaccccgccaugcau

SEQ ID NO: 1529656 - RNA, 13 nt, Homo sapiens
ugacuuacuguac

SEQ ID NO: 1529657 - RNA, 22 nt, Homo sapiens
ugagaaaagaaauuaguuucaa

SEQ ID NO: 1529658 - RNA, 22 nt, Homo sapiens
ugagaaaauaucuugcuuucaa

SEQ ID NO: 1529659 - RNA, 23 nt, Homo sapiens
ugagaaaauaucuugcuuucaaa

SEQ ID NO: 1529660 - RNA, 20 nt, Homo sapiens
ugaggguggugggugggaug

SEQ ID NO: 1529661 - RNA, 23 nt, Homo sapiens
ugauacaacauuaaggaauuuga

SEQ ID NO: 1529662 - RNA, 22 nt, Homo sapiens
ugaucuucagggaacugcauag

SEQ ID NO: 1529663 - RNA, 18 nt, Homo sapiens
ugaugauuuucauuucau

SEQ ID NO: 1529664 - RNA, 15 nt, Homo sapiens
ugauugagacucaaa

SEQ ID NO: 1529665 - RNA, 15 nt, Homo sapiens
ugcaagcacaucugc

SEQ ID NO: 1529666 - RNA, 20 nt, Homo sapiens
ugcagaacaucgauauguau

SEQ ID NO: 1529667 - RNA, 17 nt, Homo sapiens
ugcagccuuugccuccc

SEQ ID NO: 1529668 - RNA, 20 nt, Homo sapiens
ugcaggguggauuguuacag

SEQ ID NO: 1529669 - RNA, 22 nt, Homo sapiens
ugcagguuccuuaucugucaca

SEQ ID NO: 1529670 - RNA, 15 nt, Homo sapiens
ugcauuuggugguuu

SEQ ID NO: 1529671 - RNA, 22 nt, Homo sapiens
ugccaacacacguccacuccca

SEQ ID NO: 1529672 - RNA, 15 nt, Homo sapiens
ugccaaggcaaaaaa

SEQ ID NO: 1529673 - RNA, 20 nt, Homo sapiens
ugcccaggcuggaguggagu

SEQ ID NO: 1529674 - RNA, 20 nt, Homo sapiens
ugccuccucagaggacaguu

SEQ ID NO: 1529675 - RNA, 14 nt, Homo sapiens
ugccuguaaucuca

SEQ ID NO: 1529676 - RNA, 18 nt, Homo sapiens
ugcggggggcaccagagg

SEQ ID NO: 1529677 - RNA, 21 nt, Homo sapiens
ugcucuguaggagcuacccuu

SEQ ID NO: 1529678 - RNA, 13 nt, Homo sapiens
ugcuggcauuugc

SEQ ID NO: 1529679 - RNA, 17 nt, Homo sapiens
ugcugggugccaggugc

SEQ ID NO: 1529680 - RNA, 16 nt, Homo sapiens
ugcugguguacucuag

SEQ ID NO: 1529681 - RNA, 15 nt, Homo sapiens
ugcuguccgugcuug

SEQ ID NO: 1529682 - RNA, 16 nt, Homo sapiens
ugcuucuccccagaau

SEQ ID NO: 1529683 - RNA, 16 nt, Homo sapiens
ugcuuguacauaaugc

SEQ ID NO: 1529684 - RNA, 12 nt, Homo sapiens
ugcuuguucccu

SEQ ID NO: 1529685 - RNA, 13 nt, Homo sapiens
ugcuuugugauuu

SEQ ID NO: 1529686 - RNA, 21 nt, Homo sapiens
uggacuuggcaggugccuguu

SEQ ID NO: 1529687 - RNA, 19 nt, Homo sapiens
uggagaacucagugccaca

SEQ ID NO: 1529688 - RNA, 15 nt, Homo sapiens
uggagaccucuccuu

SEQ ID NO: 1529689 - RNA, 14 nt, Homo sapiens
uggaggccuaccuc

SEQ ID NO: 1529690 - RNA, 19 nt, Homo sapiens
uggaugaggagacagaaua

SEQ ID NO: 1529691 - RNA, 19 nt, Homo sapiens
uggcagaaccaaagcucaa

SEQ ID NO: 1529692 - RNA, 16 nt, Homo sapiens
uggcaggcuacucugc

SEQ ID NO: 1529693 - RNA, 15 nt, Homo sapiens
uggcauaggccugua

SEQ ID NO: 1529694 - RNA, 18 nt, Homo sapiens
uggccaggagccaugaca

SEQ ID NO: 1529695 - RNA, 14 nt, Homo sapiens
uggcccuacaguac

SEQ ID NO: 1529696 - RNA, 14 nt, Homo sapiens
uggcuuuugugcau

SEQ ID NO: 1529697 - RNA, 19 nt, Homo sapiens
uggggaguaggacauacca

SEQ ID NO: 1529698 - RNA, 16 nt, Homo sapiens
uggucgucaugcuguc

SEQ ID NO: 1529699 - RNA, 11 nt, Homo sapiens
uggugugauuu

SEQ ID NO: 1529700 - RNA, 13 nt, Homo sapiens
uguaaaugcauau

SEQ ID NO: 1529701 - RNA, 19 nt, Homo sapiens
uguacagaaaguaucacaa

SEQ ID NO: 1529702 - RNA, 15 nt, Homo sapiens
uguaucgggcaaaaa

SEQ ID NO: 1529703 - RNA, 22 nt, Homo sapiens
uguauugacuguaccacagaca

SEQ ID NO: 1529704 - RNA, 15 nt, Homo sapiens
ugucauagagcugca

SEQ ID NO: 1529705 - RNA, 20 nt, Homo sapiens
ugucccggggcuccacugaa

SEQ ID NO: 1529706 - RNA, 14 nt, Homo sapiens
ugucucagccuccc

SEQ ID NO: 1529707 - RNA, 14 nt, Homo sapiens
ugucugacaaccuc

SEQ ID NO: 1529708 - RNA, 16 nt, Homo sapiens
ugucugacaaccucuu

SEQ ID NO: 1529709 - RNA, 13 nt, Homo sapiens
ugugacauacaua

SEQ ID NO: 1529710 - RNA, 22 nt, Homo sapiens
ugugacauacauauuaucucau

SEQ ID NO: 1529711 - RNA, 13 nt, Homo sapiens
ugugauuaccucu

SEQ ID NO: 1529712 - RNA, 14 nt, Homo sapiens
ugugauuaccucuc

SEQ ID NO: 1529713 - RNA, 21 nt, Homo sapiens
uguggcacucagggagcauuu

SEQ ID NO: 1529714 - RNA, 18 nt, Homo sapiens
ugugggugaagugccugc

SEQ ID NO: 1529715 - RNA, 18 nt, Homo sapiens
uguugaaucugagcugca

SEQ ID NO: 1529716 - RNA, 12 nt, Homo sapiens
uguugacauaca

SEQ ID NO: 1529717 - RNA, 18 nt, Homo sapiens
uguuuucuucaacaugcu

SEQ ID NO: 1529718 - RNA, 24 nt, Homo sapiens
uguuuugauucccgggcuuaccag

SEQ ID NO: 1529719 - RNA, 19 nt, Homo sapiens
uuaaggaugcuuguacaua

SEQ ID NO: 1529720 - RNA, 20 nt, Homo sapiens
uuaauacauugaucaggcca

SEQ ID NO: 1529721 - RNA, 19 nt, Homo sapiens
uuacaaucagccacauucu

SEQ ID NO: 1529722 - RNA, 13 nt, Homo sapiens
uuacaauugugag

SEQ ID NO: 1529723 - RNA, 17 nt, Homo sapiens
uuagaaaauagagcuuu

SEQ ID NO: 1529724 - RNA, 16 nt, Homo sapiens
uuagaaccccagguga

SEQ ID NO: 1529725 - RNA, 18 nt, Homo sapiens
uuagacacuuuaccucuu

SEQ ID NO: 1529726 - RNA, 15 nt, Homo sapiens
uuagaccgcucucuu

SEQ ID NO: 1529727 - RNA, 15 nt, Homo sapiens
uuauuaauucuucac

SEQ ID NO: 1529728 - RNA, 17 nt, Homo sapiens
uuauuacauggggucua

SEQ ID NO: 1529729 - RNA, 12 nt, Homo sapiens
uucaaauuugau

SEQ ID NO: 1529730 - RNA, 17 nt, Homo sapiens
uucaacaugcuccaaau

SEQ ID NO: 1529731 - RNA, 15 nt, Homo sapiens
uucagggaacugcau

SEQ ID NO: 1529732 - RNA, 11 nt, Homo sapiens
uucaucucuug

SEQ ID NO: 1529733 - RNA, 12 nt, Homo sapiens
uuccccacugac

SEQ ID NO: 1529734 - RNA, 18 nt, Homo sapiens
uucccuggugccaccagc

SEQ ID NO: 1529735 - RNA, 14 nt, Homo sapiens
uuccuucuguugcu

SEQ ID NO: 1529736 - RNA, 23 nt, Homo sapiens
uucuacacagagcaggacugcac

SEQ ID NO: 1529737 - RNA, 17 nt, Homo sapiens
uucuggagugagcacuc

SEQ ID NO: 1529738 - RNA, 14 nt, Homo sapiens
uucuuuggaggcag

SEQ ID NO: 1529739 - RNA, 17 nt, Homo sapiens
uugaaaccugcucugua

SEQ ID NO: 1529740 - RNA, 15 nt, Homo sapiens
uugaaagaaccagag

SEQ ID NO: 1529741 - RNA, 13 nt, Homo sapiens
uugaucacuacaa

SEQ ID NO: 1529742 - RNA, 21 nt, Homo sapiens
uugaucuucagggaacugcau

SEQ ID NO: 1529743 - RNA, 18 nt, Homo sapiens
uugcccugaggcucaguc

SEQ ID NO: 1529744 - RNA, 21 nt, Homo sapiens
uuguagagauggggucucaca

SEQ ID NO: 1529745 - RNA, 22 nt, Homo sapiens
uuguagagauggggucucacag

SEQ ID NO: 1529746 - RNA, 19 nt, Homo sapiens
uuguauucucuccuguacc

SEQ ID NO: 1529747 - RNA, 23 nt, Homo sapiens
uugugcuuaguccaauuccuugc

SEQ ID NO: 1529748 - RNA, 23 nt, Homo sapiens
uuguggaggagggagagcccugu

SEQ ID NO: 1529749 - RNA, 21 nt, Homo sapiens
uuguuuuaugcucagggucaa

SEQ ID NO: 1529750 - RNA, 17 nt, Homo sapiens
uuuaagugggcuccuga

SEQ ID NO: 1529751 - RNA, 15 nt, Homo sapiens
uuuacacaaagggaa

SEQ ID NO: 1529752 - RNA, 19 nt, Homo sapiens
uuucccaucagacugucaa

SEQ ID NO: 1529753 - RNA, 15 nt, Homo sapiens
uuuccccagucccag

SEQ ID NO: 1529754 - RNA, 14 nt, Homo sapiens
uuuccuucauucau

SEQ ID NO: 1529755 - RNA, 15 nt, Homo sapiens
uuugcauguuuugua

SEQ ID NO: 1529756 - RNA, 17 nt, Homo sapiens
uuuggguuuugggucuu

SEQ ID NO: 1529757 - RNA, 22 nt, Homo sapiens
uuugucccggggcuccacugaa

SEQ ID NO: 1529758 - RNA, 22 nt, Homo sapiens
uuuguuaguaugaggcauuugu

SEQ ID NO: 1529759 - RNA, 12 nt, Homo sapiens
uuuguugcccag

SEQ ID NO: 1529760 - RNA, 17 nt, Homo sapiens
uuuuaagaagacauacu

SEQ ID NO: 1529761 - RNA, 17 nt, Homo sapiens
uuuucuauuuaccuccu

SEQ ID NO: 1529762 - RNA, 20 nt, Homo sapiens
uuuugguagaugcaugacuu

SEQ ID NO: 1529763 - RNA, 23 nt, Homo sapiens
uuuuuuaaaacacuaaaagcagc

SEQ ID NO: 1529764 - RNA, 22 nt, Homo sapiens
agcccugucccugcccucaggc

SEQ ID NO: 1529765 - RNA, 18 nt, Homo sapiens
agccucugggaucugcca

SEQ ID NO: 1529766 - RNA, 20 nt, Homo sapiens
agcugcccugaggguuuccu

SEQ ID NO: 1529767 - RNA, 22 nt, Homo sapiens
agcuggaagggucaacaucuuu

SEQ ID NO: 1529768 - RNA, 19 nt, Homo sapiens
agcugucgacuucaugaca

SEQ ID NO: 1529769 - RNA, 16 nt, Homo sapiens
agcuuaaaaucuguga

SEQ ID NO: 1529770 - RNA, 16 nt, Homo sapiens
agcuucuucacaggca

SEQ ID NO: 1529771 - RNA, 15 nt, Homo sapiens
agcuugagcucagaa

SEQ ID NO: 1529772 - RNA, 12 nt, Homo sapiens
aggaaucauucc

SEQ ID NO: 1529773 - RNA, 21 nt, Homo sapiens
aggacuuccauuugcuuuguc

SEQ ID NO: 1529774 - RNA, 15 nt, Homo sapiens
aggcagcucugagcc

SEQ ID NO: 1529775 - RNA, 14 nt, Homo sapiens
aggcaguaaccaug

SEQ ID NO: 1529776 - RNA, 15 nt, Homo sapiens
aggccgugugucugu

SEQ ID NO: 1529777 - RNA, 18 nt, Homo sapiens
aggccgugugucugucag

SEQ ID NO: 1529778 - RNA, 12 nt, Homo sapiens
aggccuuggacu

SEQ ID NO: 1529779 - RNA, 15 nt, Homo sapiens
aggcgauccaccugu

SEQ ID NO: 1529780 - RNA, 14 nt, Homo sapiens
aggcuacucugccc

SEQ ID NO: 1529781 - RNA, 11 nt, Homo sapiens
aggcucagucu

SEQ ID NO: 1529782 - RNA, 18 nt, Homo sapiens
aggcugggcacugcugug

SEQ ID NO: 1529783 - RNA, 12 nt, Homo sapiens
aggcugucacag

SEQ ID NO: 1529784 - RNA, 15 nt, Homo sapiens
aggcugucacagucc

SEQ ID NO: 1529785 - RNA, 18 nt, Homo sapiens
agggaagcugucccucac

SEQ ID NO: 1529786 - RNA, 21 nt, Homo sapiens
agggaagcugucccucacugu

SEQ ID NO: 1529787 - RNA, 22 nt, Homo sapiens
agggaccgggcgcagcccuccc

SEQ ID NO: 1529788 - RNA, 20 nt, Homo sapiens
agggcauucuuucccaguga

SEQ ID NO: 1529789 - RNA, 14 nt, Homo sapiens
agggcuacagucuc

SEQ ID NO: 1529790 - RNA, 14 nt, Homo sapiens
aggggcaguggugg

SEQ ID NO: 1529791 - RNA, 21 nt, Homo sapiens
aggguuuggauuuuaacuuuu

SEQ ID NO: 1529792 - RNA, 22 nt, Homo sapiens
agguggcccggaagaaccagaa

SEQ ID NO: 1529793 - RNA, 19 nt, Homo sapiens
agguuccuuaucugucaca

SEQ ID NO: 1529794 - RNA, 17 nt, Homo sapiens
aguaaguagaugccugu

SEQ ID NO: 1529795 - RNA, 17 nt, Homo sapiens
aguaaguuaauaaugua

SEQ ID NO: 1529796 - RNA, 22 nt, Homo sapiens
aguaccuuuccauuuauucuuu

SEQ ID NO: 1529797 - RNA, 14 nt, Homo sapiens
aguacguugugcau

SEQ ID NO: 1529798 - RNA, 18 nt, Homo sapiens
aguacguugugcauuugg

SEQ ID NO: 1529799 - RNA, 18 nt, Homo sapiens
aguacuuauguugcacaa

SEQ ID NO: 1529800 - RNA, 16 nt, Homo sapiens
aguaucccuacuguaa

SEQ ID NO: 1529801 - RNA, 21 nt, Homo sapiens
aguauuuaacgaagccuagaa

SEQ ID NO: 1529802 - RNA, 14 nt, Homo sapiens
agucacaucucuuc

SEQ ID NO: 1529803 - RNA, 16 nt, Homo sapiens
agucaccgaagguccu

SEQ ID NO: 1529804 - RNA, 15 nt, Homo sapiens
agugcuaagcugccc

SEQ ID NO: 1529805 - RNA, 14 nt, Homo sapiens
agugucagccaugg

SEQ ID NO: 1529806 - RNA, 12 nt, Homo sapiens
aguguugcccag

SEQ ID NO: 1529807 - RNA, 22 nt, Homo sapiens
aguguugcccaggcuggucuca

SEQ ID NO: 1529808 - RNA, 14 nt, Homo sapiens
aguuguccaugaca

SEQ ID NO: 1529809 - RNA, 15 nt, Homo sapiens
aguuuauaagacugg

SEQ ID NO: 1529810 - RNA, 15 nt, Homo sapiens
aguuucccuggugcc

SEQ ID NO: 1529811 - RNA, 17 nt, Homo sapiens
aguuuguagguaaaaug

SEQ ID NO: 1529812 - RNA, 16 nt, Homo sapiens
aguuuuuaauuugaug

SEQ ID NO: 1529813 - RNA, 15 nt, Homo sapiens
auaaaaauaaaucag

SEQ ID NO: 1529814 - RNA, 14 nt, Homo sapiens
auaaagcagcguuu

SEQ ID NO: 1529815 - RNA, 15 nt, Homo sapiens
auaaauggguguaua

SEQ ID NO: 1529816 - RNA, 22 nt, Homo sapiens
auaauucagcacuuaacuauga

SEQ ID NO: 1529817 - RNA, 19 nt, Homo sapiens
auacaacauuaaggaauuu

SEQ ID NO: 1529818 - RNA, 22 nt, Homo sapiens
auacaacauuaaggaauuugau

SEQ ID NO: 1529819 - RNA, 18 nt, Homo sapiens
gcugguaacaguggcugc

SEQ ID NO: 1529820 - RNA, 15 nt, Homo sapiens
gcuguuccugagaaa

SEQ ID NO: 1529821 - RNA, 20 nt, Homo sapiens
gcuuaaccuuuccaguuuau

SEQ ID NO: 1529822 - RNA, 13 nt, Homo sapiens
gcuucgcuggaaa

SEQ ID NO: 1529823 - RNA, 19 nt, Homo sapiens
gcuucucuugagucacacu

SEQ ID NO: 1529824 - RNA, 22 nt, Homo sapiens
gcuugcuggugccucuuuucag

SEQ ID NO: 1529825 - RNA, 20 nt, Homo sapiens
gcuuucguaguuuucauuua

SEQ ID NO: 1529826 - RNA, 14 nt, Homo sapiens
gcuuuugugcauua

SEQ ID NO: 1529827 - RNA, 13 nt, Homo sapiens
ggaaaaccaucuc

SEQ ID NO: 1529828 - RNA, 23 nt, Homo sapiens
ggaaauaaauggugccugggaug

SEQ ID NO: 1529829 - RNA, 19 nt, Homo sapiens
ggaaauguuuguccuugca

SEQ ID NO: 1529830 - RNA, 16 nt, Homo sapiens
ggaaccaaagcuggcc

SEQ ID NO: 1529831 - RNA, 22 nt, Homo sapiens
ggaaccgagguguugccagugc

SEQ ID NO: 1529832 - RNA, 20 nt, Homo sapiens
ggacccuguagggugccauu

SEQ ID NO: 1529833 - RNA, 14 nt, Homo sapiens
ggacgcugccggga

SEQ ID NO: 1529834 - RNA, 17 nt, Homo sapiens
ggagacggaaucugccg

SEQ ID NO: 1529835 - RNA, 12 nt, Homo sapiens
ggagccaugaca

SEQ ID NO: 1529836 - RNA, 15 nt, Homo sapiens
ggagcccuacugaag

SEQ ID NO: 1529837 - RNA, 13 nt, Homo sapiens
ggaggcaucugca

SEQ ID NO: 1529838 - RNA, 20 nt, Homo sapiens
ggaugauuauuuucuguucu

SEQ ID NO: 1529839 - RNA, 16 nt, Homo sapiens
ggauuguuacagcuuc

SEQ ID NO: 1529840 - RNA, 17 nt, Homo sapiens
ggccaguaccuuuccau

SEQ ID NO: 1529841 - RNA, 19 nt, Homo sapiens
ggcccaguuguccaugaca

SEQ ID NO: 1529842 - RNA, 23 nt, Homo sapiens
ggcccuggccuagcauacguaca

SEQ ID NO: 1529843 - RNA, 13 nt, Homo sapiens
ggccuccaugcac

SEQ ID NO: 1529844 - RNA, 19 nt, Homo sapiens
ggcucuuaugugugccuuu

SEQ ID NO: 1529845 - RNA, 14 nt, Homo sapiens
ggcugggcacugcu

SEQ ID NO: 1529846 - RNA, 19 nt, Homo sapiens
ggcuucucuugagucacac

SEQ ID NO: 1529847 - RNA, 13 nt, Homo sapiens
ggcuuuugugcau

SEQ ID NO: 1529848 - RNA, 20 nt, Homo sapiens
gggaaacccugcuguuucau

SEQ ID NO: 1529849 - RNA, 14 nt, Homo sapiens
gggaaacgggguga

SEQ ID NO: 1529850 - RNA, 22 nt, Homo sapiens
gggaaacuuagaucaucaguca

SEQ ID NO: 1529851 - RNA, 14 nt, Homo sapiens
gggaagcucagggg

SEQ ID NO: 1529852 - RNA, 18 nt, Homo sapiens
gggacuggcugggcugcu

SEQ ID NO: 1529853 - RNA, 20 nt, Homo sapiens
gggagagcccugucccugcc

SEQ ID NO: 1529854 - RNA, 23 nt, Homo sapiens
gggcccuuucuugcacuguccag

SEQ ID NO: 1529855 - RNA, 17 nt, Homo sapiens
ggggccggaggaaccga

SEQ ID NO: 1529856 - RNA, 23 nt, Homo sapiens
gggucccagaaagggacagggaa

SEQ ID NO: 1529857 - RNA, 18 nt, Homo sapiens
ggguuucuugacaauggg

SEQ ID NO: 1529858 - RNA, 19 nt, Homo sapiens
ggucaucucggcuguuccu

SEQ ID NO: 1529859 - RNA, 18 nt, Homo sapiens
ggucuucuuuuacuggac

SEQ ID NO: 1529860 - RNA, 14 nt, Homo sapiens
ggugaagugccugc

SEQ ID NO: 1529861 - RNA, 21 nt, Homo sapiens
gguggaugaggagacagaaua

SEQ ID NO: 1529862 - RNA, 18 nt, Homo sapiens
guaaaugggggugcauuu

SEQ ID NO: 1529863 - RNA, 15 nt, Homo sapiens
guaaucucagcacuu

SEQ ID NO: 1529864 - RNA, 16 nt, Homo sapiens
guaaucucagcacuuu

SEQ ID NO: 1529865 - RNA, 21 nt, Homo sapiens
guacacuguuucaaacuuuac

SEQ ID NO: 1529866 - RNA, 12 nt, Homo sapiens
guacaucuggcc

SEQ ID NO: 1529867 - RNA, 17 nt, Homo sapiens
guacguugugcauuugg

SEQ ID NO: 1529868 - RNA, 14 nt, Homo sapiens
uaguccaauuccuu

SEQ ID NO: 1529869 - RNA, 11 nt, Homo sapiens
uauaagacauu

SEQ ID NO: 1529870 - RNA, 14 nt, Homo sapiens
uauaagaucacuga

SEQ ID NO: 1529871 - RNA, 20 nt, Homo sapiens
uauaauuucaaaccacacau

SEQ ID NO: 1529872 - RNA, 22 nt, Homo sapiens
uauaauuucaaaccacacauua

SEQ ID NO: 1529873 - RNA, 17 nt, Homo sapiens
uauacauaaacaagacc

SEQ ID NO: 1529874 - RNA, 20 nt, Homo sapiens
uauaucauucuacagaauaa

SEQ ID NO: 1529875 - RNA, 14 nt, Homo sapiens
uauaucgaucucuu

SEQ ID NO: 1529876 - RNA, 17 nt, Homo sapiens
uauauuuuugguggugg

SEQ ID NO: 1529877 - RNA, 16 nt, Homo sapiens
uaucaguaccucucaa

SEQ ID NO: 1529878 - RNA, 23 nt, Homo sapiens
uaucucauuuuacacaaagggaa

SEQ ID NO: 1529879 - RNA, 21 nt, Homo sapiens
uaugaaggauuacucuccaua

SEQ ID NO: 1529880 - RNA, 18 nt, Homo sapiens
uaugagccaggcaucaua

SEQ ID NO: 1529881 - RNA, 22 nt, Homo sapiens
uaugaggcauuuguuugaacug

SEQ ID NO: 1529882 - RNA, 22 nt, Homo sapiens
uaugcaugaaguaauaugcaca

SEQ ID NO: 1529883 - RNA, 11 nt, Homo sapiens
uaugcauuuga

SEQ ID NO: 1529884 - RNA, 14 nt, Homo sapiens
uauguauaucauuc

SEQ ID NO: 1529885 - RNA, 21 nt, Homo sapiens
uauuagaaaggacuguaaaau

SEQ ID NO: 1529886 - RNA, 20 nt, Homo sapiens
uauucuaagcccuuugccau

SEQ ID NO: 1529887 - RNA, 14 nt, Homo sapiens
uauuuuuugcaagu

SEQ ID NO: 1529888 - RNA, 12 nt, Homo sapiens
ucaaaucacugc

SEQ ID NO: 1529889 - RNA, 20 nt, Homo sapiens
ucaacaucuuuuacauucug

SEQ ID NO: 1529890 - RNA, 13 nt, Homo sapiens
ucaagaagaggaa

SEQ ID NO: 1529891 - RNA, 19 nt, Homo sapiens
ucaagaagaggaaagggag

SEQ ID NO: 1529892 - RNA, 21 nt, Homo sapiens
ucaaucuuuggaggcuuuuaa

SEQ ID NO: 1529893 - RNA, 13 nt, Homo sapiens
ucaaugugcauaa

SEQ ID NO: 1529894 - RNA, 14 nt, Homo sapiens
ucacaucugucacg

SEQ ID NO: 1529895 - RNA, 13 nt, Homo sapiens
ucacugcauucau

SEQ ID NO: 1529896 - RNA, 17 nt, Homo sapiens
ucagaucucuaacuuca

SEQ ID NO: 1529897 - RNA, 22 nt, Homo sapiens
ucagauuggaauguuacaucug

SEQ ID NO: 1529898 - RNA, 23 nt, Homo sapiens
ucaguuuuauuuuugccaaggca

SEQ ID NO: 1529899 - RNA, 23 nt, Homo sapiens
ucauccuuaaaacaauucuguga

SEQ ID NO: 1529900 - RNA, 22 nt, Homo sapiens
ucaugccacagugguacucugu

SEQ ID NO: 1529901 - RNA, 23 nt, Homo sapiens
ucaugccaccauggccagccaac

SEQ ID NO: 1529902 - RNA, 23 nt, Homo sapiens
ucaugccuguaaucucagcacuu

SEQ ID NO: 1529903 - RNA, 13 nt, Homo sapiens
uccaauauuucug

SEQ ID NO: 1529904 - RNA, 12 nt, Homo sapiens
uccacaccaagc

SEQ ID NO: 1529905 - RNA, 23 nt, Homo sapiens
uccacuucuuguuccccacugac

SEQ ID NO: 1529906 - RNA, 15 nt, Homo sapiens
ucccaacacuuugag

SEQ ID NO: 1529907 - RNA, 16 nt, Homo sapiens
ucccaacacuuugaga

SEQ ID NO: 1529908 - RNA, 17 nt, Homo sapiens
ucccaagccacauucau

SEQ ID NO: 1529909 - RNA, 17 nt, Homo sapiens
ucccacccccaucucuc

SEQ ID NO: 1529910 - RNA, 12 nt, Homo sapiens
ucccagucccau

SEQ ID NO: 1529911 - RNA, 17 nt, Homo sapiens
uccccagucccagacaa

SEQ ID NO: 1529912 - RNA, 18 nt, Homo sapiens
uccccaguuggcccuucu

SEQ ID NO: 1529913 - RNA, 18 nt, Homo sapiens
ucccccagagccccucau

SEQ ID NO: 1529914 - RNA, 23 nt, Homo sapiens
uccccgauugaaagaaccagaga

SEQ ID NO: 1529915 - RNA, 19 nt, Homo sapiens
ucccgggcuuaccagguga

SEQ ID NO: 1529916 - RNA, 20 nt, Homo sapiens
ucccucagaaaaaggcagug

SEQ ID NO: 1529917 - RNA, 12 nt, Homo sapiens
aaaaauaaugug

SEQ ID NO: 1529918 - RNA, 16 nt, Homo sapiens
aaaaccaucucuguga

SEQ ID NO: 1529919 - RNA, 13 nt, Homo sapiens
aaaaugacauuaa

SEQ ID NO: 1529920 - RNA, 21 nt, Homo sapiens
aaaaugacauuaaaugcaaua

SEQ ID NO: 1529921 - RNA, 14 nt, Homo sapiens
aaaauggucaucca

SEQ ID NO: 1529922 - RNA, 16 nt, Homo sapiens
aaacaaaaaagacuug

SEQ ID NO: 1529923 - RNA, 20 nt, Homo sapiens
aaacaacagcucgauccaaa

SEQ ID NO: 1529924 - RNA, 17 nt, Homo sapiens
aaacaccgcuucugccu

SEQ ID NO: 1529925 - RNA, 13 nt, Homo sapiens
aaacauuuugaca

SEQ ID NO: 1529926 - RNA, 15 nt, Homo sapiens
aaaccaucucuguga

SEQ ID NO: 1529927 - RNA, 13 nt, Homo sapiens
aaacuuagaucau

SEQ ID NO: 1529928 - RNA, 22 nt, Homo sapiens
aaacuucaccuacauuaucuca

SEQ ID NO: 1529929 - RNA, 20 nt, Homo sapiens
aaacuugugaaugcuucuca

SEQ ID NO: 1529930 - RNA, 21 nt, Homo sapiens
aaacuugugaaugcuucucac

SEQ ID NO: 1529931 - RNA, 13 nt, Homo sapiens
aaagaaccagaga

SEQ ID NO: 1529932 - RNA, 16 nt, Homo sapiens
aaagacagaagcuuaa

SEQ ID NO: 1529933 - RNA, 13 nt, Homo sapiens
aaagauacaguua

SEQ ID NO: 1529934 - RNA, 14 nt, Homo sapiens
aaagcaugugagac

SEQ ID NO: 1529935 - RNA, 18 nt, Homo sapiens
aaaggaugcacagaguug

SEQ ID NO: 1529936 - RNA, 20 nt, Homo sapiens
aaaguaaguuaauaauguau

SEQ ID NO: 1529937 - RNA, 16 nt, Homo sapiens
aaauaaaucaguucau

SEQ ID NO: 1529938 - RNA, 16 nt, Homo sapiens
aaauaucuugcuuuca

SEQ ID NO: 1529939 - RNA, 19 nt, Homo sapiens
aaauguccauuuauaucau

SEQ ID NO: 1529940 - RNA, 13 nt, Homo sapiens
aacagccugagcc

SEQ ID NO: 1529941 - RNA, 12 nt, Homo sapiens
caaugaugcccu

SEQ ID NO: 1529942 - RNA, 17 nt, Homo sapiens
caauuucugcuguacau

SEQ ID NO: 1529943 - RNA, 14 nt, Homo sapiens
cacacugcuagcaa

SEQ ID NO: 1529944 - RNA, 17 nt, Homo sapiens
cacagaauagcacaaac

SEQ ID NO: 1529945 - RNA, 23 nt, Homo sapiens
cacauaguagguacccaauucaa

SEQ ID NO: 1529946 - RNA, 13 nt, Homo sapiens
cacaucugcauuu

SEQ ID NO: 1529947 - RNA, 14 nt, Homo sapiens
cacccugcuuuggc

SEQ ID NO: 1529948 - RNA, 17 nt, Homo sapiens
caccuacauuaucucac

SEQ ID NO: 1529949 - RNA, 19 nt, Homo sapiens
cacugccagucucacugug

SEQ ID NO: 1529950 - RNA, 16 nt, Homo sapiens
cacugcuuaacuucac

SEQ ID NO: 1529951 - RNA, 20 nt, Homo sapiens
cacuuagacacuuuaccucu

SEQ ID NO: 1529952 - RNA, 21 nt, Homo sapiens
cacuucuuguuccccacugac

SEQ ID NO: 1529953 - RNA, 12 nt, Homo sapiens
cacuuuaccucu

SEQ ID NO: 1529954 - RNA, 17 nt, Homo sapiens
cacuuugagaagcugag

SEQ ID NO: 1529955 - RNA, 21 nt, Homo sapiens
cagaaaguaucacaaauggaa

SEQ ID NO: 1529956 - RNA, 14 nt, Homo sapiens
cagaaauguguuau

SEQ ID NO: 1529957 - RNA, 17 nt, Homo sapiens
cagaagaaaauucuccu

SEQ ID NO: 1529958 - RNA, 20 nt, Homo sapiens
cagaaggauuaccugaggca

SEQ ID NO: 1529959 - RNA, 21 nt, Homo sapiens
cagaauaauggaaacauuaca

SEQ ID NO: 1529960 - RNA, 20 nt, Homo sapiens
cagacuguggaaccaaagcu

SEQ ID NO: 1529961 - RNA, 17 nt, Homo sapiens
cagagaggcucugagaa

SEQ ID NO: 1529962 - RNA, 17 nt, Homo sapiens
cagagccccucaugcca

SEQ ID NO: 1529963 - RNA, 13 nt, Homo sapiens
cagagucacaagu

SEQ ID NO: 1529964 - RNA, 17 nt, Homo sapiens
cagauguauugacugua

SEQ ID NO: 1529965 - RNA, 14 nt, Homo sapiens
cagcaaaucacgac

SEQ ID NO: 1529966 - RNA, 17 nt, Homo sapiens
cagcaacagcaaaucac

SEQ ID NO: 1529967 - RNA, 21 nt, Homo sapiens
cagcaguucucugccaaagcu

SEQ ID NO: 1529968 - RNA, 18 nt, Homo sapiens
cagcccaaccuucacauc

SEQ ID NO: 1529969 - RNA, 21 nt, Homo sapiens
cagcgagaacuacgcacagcu

SEQ ID NO: 1529970 - RNA, 14 nt, Homo sapiens
cagcgggugcugcu

SEQ ID NO: 1529971 - RNA, 22 nt, Homo sapiens
cagcguuucuaugacacaugca

SEQ ID NO: 1529972 - RNA, 21 nt, Homo sapiens
caggagcccuacugaagggaa

SEQ ID NO: 1529973 - RNA, 14 nt, Homo sapiens
caggcacuccugga

SEQ ID NO: 1529974 - RNA, 19 nt, Homo sapiens
caggccgugugucugucag

SEQ ID NO: 1529975 - RNA, 20 nt, Homo sapiens
caggcgauccaccugucuca

SEQ ID NO: 1529976 - RNA, 16 nt, Homo sapiens
caggcuccccagugcu

SEQ ID NO: 1529977 - RNA, 20 nt, Homo sapiens
caggcucuugacuacuugga

SEQ ID NO: 1529978 - RNA, 13 nt, Homo sapiens
caggcuggucuca

SEQ ID NO: 1529979 - RNA, 13 nt, Homo sapiens
cagggccacaacu

SEQ ID NO: 1529980 - RNA, 22 nt, Homo sapiens
cagguucaugccaccauggcca

SEQ ID NO: 1529981 - RNA, 15 nt, Homo sapiens
caguuguccaugaca

SEQ ID NO: 1529982 - RNA, 14 nt, Homo sapiens
cauaauucagcacu

SEQ ID NO: 1529983 - RNA, 15 nt, Homo sapiens
cauacauauuaucuc

SEQ ID NO: 1529984 - RNA, 16 nt, Homo sapiens
cauacauauuaucuca

SEQ ID NO: 1529985 - RNA, 17 nt, Homo sapiens
cauacauauuaucucau

SEQ ID NO: 1529986 - RNA, 16 nt, Homo sapiens
cauaucccuuccucuc

SEQ ID NO: 1529987 - RNA, 18 nt, Homo sapiens
cauaucuuaaaacuaaau

SEQ ID NO: 1529988 - RNA, 18 nt, Homo sapiens
cauaucuuagguauauaa

SEQ ID NO: 1529989 - RNA, 16 nt, Homo sapiens
cauauuaccacagaca

SEQ ID NO: 1529990 - RNA, 13 nt, Homo sapiens
cauauuaucucau

SEQ ID NO: 1529991 - RNA, 11 nt, Homo sapiens
caucuuuacaa

SEQ ID NO: 1529992 - RNA, 16 nt, Homo sapiens
caucuuuggcugagcu

SEQ ID NO: 1529993 - RNA, 15 nt, Homo sapiens
caugaaaaugacauu

SEQ ID NO: 1529994 - RNA, 21 nt, Homo sapiens
cauguuguugaggcugucaca

SEQ ID NO: 1529995 - RNA, 22 nt, Homo sapiens
cauguuguugaggcugucacag

SEQ ID NO: 1529996 - RNA, 19 nt, Homo sapiens
cauucaugugggcauuucu

SEQ ID NO: 1529997 - RNA, 22 nt, Homo sapiens
cauuccucagcuucuucacagg

SEQ ID NO: 1529998 - RNA, 18 nt, Homo sapiens
cauucugcaagcacaucu

SEQ ID NO: 1529999 - RNA, 21 nt, Homo sapiens
cauuggggggaccgucuuuac

SEQ ID NO: 1530000 - RNA, 22 nt, Homo sapiens
cauuugcaaaggcgacaauaaa

SEQ ID NO: 1530001 - RNA, 15 nt, Homo sapiens
cauuuugacacaaaa

SEQ ID NO: 1530002 - RNA, 12 nt, Homo sapiens
ccaaaauuugau

SEQ ID NO: 1530003 - RNA, 14 nt, Homo sapiens
ccaaacugacucaa

SEQ ID NO: 1530004 - RNA, 15 nt, Homo sapiens
ccaagaguaacuuua

SEQ ID NO: 1530005 - RNA, 16 nt, Homo sapiens
ccaauuccuugcacau

SEQ ID NO: 1530006 - RNA, 14 nt, Homo sapiens
ccaauuuacuggcc

SEQ ID NO: 1530007 - RNA, 21 nt, Homo sapiens
ccaauuucugcuguacauuau

SEQ ID NO: 1530008 - RNA, 22 nt, Homo sapiens
ccacaacccaagcaacauuugu

SEQ ID NO: 1530009 - RNA, 16 nt, Homo sapiens
ccacacauuaguacuu

SEQ ID NO: 1530010 - RNA, 22 nt, Homo sapiens
ccacacccuggaggauuucauc

SEQ ID NO: 1530011 - RNA, 21 nt, Homo sapiens
ccacuuagacacuuuaccucu

SEQ ID NO: 1530012 - RNA, 22 nt, Homo sapiens
ccagaagaaaauucuccugaua

SEQ ID NO: 1530013 - RNA, 17 nt, Homo sapiens
ccagcaguucucugcca

SEQ ID NO: 1530014 - RNA, 18 nt, Homo sapiens
ccagcccaagggcaucau

SEQ ID NO: 1530015 - RNA, 16 nt, Homo sapiens
ccagccugccuggcag

SEQ ID NO: 1530016 - RNA, 16 nt, Homo sapiens
ccaggccucuuggcag

SEQ ID NO: 1530017 - RNA, 14 nt, Homo sapiens
ccaggggaggugua

SEQ ID NO: 1530018 - RNA, 22 nt, Homo sapiens
ccaguuggcccuucugcccuua

SEQ ID NO: 1530019 - RNA, 19 nt, Homo sapiens
ccauagggacccauucuac

SEQ ID NO: 1530020 - RNA, 22 nt, Homo sapiens
cccaaccuucacaucugucacg

SEQ ID NO: 1530021 - RNA, 20 nt, Homo sapiens
cccacacccaccucugccac

SEQ ID NO: 1530022 - RNA, 17 nt, Homo sapiens
cccagaaagggacaggg

SEQ ID NO: 1530023 - RNA, 18 nt, Homo sapiens
cccagacaauuccauuca

SEQ ID NO: 1530024 - RNA, 20 nt, Homo sapiens
cccagacaauuccauucaau

SEQ ID NO: 1530025 - RNA, 16 nt, Homo sapiens
cccagcaguucucugc

SEQ ID NO: 1530026 - RNA, 20 nt, Homo sapiens
cccaucagacugucaagaag

SEQ ID NO: 1530027 - RNA, 22 nt, Homo sapiens
cccaucccacacccuggaggau

SEQ ID NO: 1530028 - RNA, 15 nt, Homo sapiens
cccauucuacacaga

SEQ ID NO: 1530029 - RNA, 19 nt, Homo sapiens
cccauucuacacagagcag

SEQ ID NO: 1530030 - RNA, 15 nt, Homo sapiens
ccccaggucugggaa

SEQ ID NO: 1530031 - RNA, 17 nt, Homo sapiens
cccccgaacggcauucu

SEQ ID NO: 1530032 - RNA, 22 nt, Homo sapiens
ccccgauugaaagaaccagaga

SEQ ID NO: 1530033 - RNA, 16 nt, Homo sapiens
cccgcccucccggaga

SEQ ID NO: 1530034 - RNA, 17 nt, Homo sapiens
cccggggcuccacugaa

SEQ ID NO: 1530035 - RNA, 15 nt, Homo sapiens
cccucacuguugaau

SEQ ID NO: 1530036 - RNA, 14 nt, Homo sapiens
cccuucuauuuauu

SEQ ID NO: 1530037 - RNA, 15 nt, Homo sapiens
cccuuucuugcacug

SEQ ID NO: 1530038 - RNA, 18 nt, Homo sapiens
ccuaaaaggaaaucucac

SEQ ID NO: 1530039 - RNA, 21 nt, Homo sapiens
ccuaccucacagagugcauug

SEQ ID NO: 1530040 - RNA, 20 nt, Homo sapiens
ccuagcagaggaaaguguaa

SEQ ID NO: 1530041 - RNA, 11 nt, Homo sapiens
ccuccaugcac

SEQ ID NO: 1530042 - RNA, 16 nt, Homo sapiens
ccucugggaucugcca

SEQ ID NO: 1530043 - RNA, 17 nt, Homo sapiens
ccucugggaucugccaa

SEQ ID NO: 1530044 - RNA, 13 nt, Homo sapiens
ccuggugcccuuc

SEQ ID NO: 1530045 - RNA, 19 nt, Homo sapiens
ccuguaaucucagcacuuu

SEQ ID NO: 1530046 - RNA, 16 nt, Homo sapiens
ccuguccacacccagc

SEQ ID NO: 1530047 - RNA, 19 nt, Homo sapiens
ccuuaaccuuaaaauugau

SEQ ID NO: 1530048 - RNA, 17 nt, Homo sapiens
ccuuagagcaucucugc

SEQ ID NO: 1530049 - RNA, 14 nt, Homo sapiens
ccuuaucugucaca

SEQ ID NO: 1530050 - RNA, 20 nt, Homo sapiens
agccuuccacagugaaugug

SEQ ID NO: 1530051 - RNA, 15 nt, Homo sapiens
agcgagaacuacgca

SEQ ID NO: 1530052 - RNA, 13 nt, Homo sapiens
agcuagugccuuu

SEQ ID NO: 1530053 - RNA, 16 nt, Homo sapiens
agcucagcauuuccac

SEQ ID NO: 1530054 - RNA, 23 nt, Homo sapiens
agcugguuguacccucuccaggc

SEQ ID NO: 1530055 - RNA, 17 nt, Homo sapiens
agcuucuucacaggcac

SEQ ID NO: 1530056 - RNA, 21 nt, Homo sapiens
aggaaaaccaucucugugauu

SEQ ID NO: 1530057 - RNA, 17 nt, Homo sapiens
aggaaugugaagccaga

SEQ ID NO: 1530058 - RNA, 11 nt, Homo sapiens
aggagccauga

SEQ ID NO: 1530059 - RNA, 17 nt, Homo sapiens
aggaugcuuguacauaa

SEQ ID NO: 1530060 - RNA, 23 nt, Homo sapiens
aggaugguggacuacaaaauaca

SEQ ID NO: 1530061 - RNA, 13 nt, Homo sapiens
aggcagugucccu

SEQ ID NO: 1530062 - RNA, 21 nt, Homo sapiens
aggcaucauacuaaacuucac

SEQ ID NO: 1530063 - RNA, 13 nt, Homo sapiens
aggccgugugucu

SEQ ID NO: 1530064 - RNA, 20 nt, Homo sapiens
aggcucuuaugugugccuuu

SEQ ID NO: 1530065 - RNA, 15 nt, Homo sapiens
agggaagcucagggg

SEQ ID NO: 1530066 - RNA, 22 nt, Homo sapiens
agggaagcugucccucacuguu

SEQ ID NO: 1530067 - RNA, 21 nt, Homo sapiens
agggagacccccaucuuuaca

SEQ ID NO: 1530068 - RNA, 22 nt, Homo sapiens
agggaggcggccuccaugcacu

SEQ ID NO: 1530069 - RNA, 18 nt, Homo sapiens
agggcaucauccucagca

SEQ ID NO: 1530070 - RNA, 19 nt, Homo sapiens
agguaggggcccacuucac

SEQ ID NO: 1530071 - RNA, 15 nt, Homo sapiens
aggucccucagacau

SEQ ID NO: 1530072 - RNA, 23 nt, Homo sapiens
agguccugcgaaggcugggcacu

SEQ ID NO: 1530073 - RNA, 22 nt, Homo sapiens
aggugagaccucaaaucacugc

SEQ ID NO: 1530074 - RNA, 18 nt, Homo sapiens
aguauuauuuuacaauca

SEQ ID NO: 1530075 - RNA, 17 nt, Homo sapiens
agucacaucucuuccuc

SEQ ID NO: 1530076 - RNA, 19 nt, Homo sapiens
agucccaaugguccugacu

SEQ ID NO: 1530077 - RNA, 23 nt, Homo sapiens
agucucacugugggaaggccagc

SEQ ID NO: 1530078 - RNA, 22 nt, Homo sapiens
agugagcacucacgcccuaagc

SEQ ID NO: 1530079 - RNA, 16 nt, Homo sapiens
agugcagccccucuca

SEQ ID NO: 1530080 - RNA, 14 nt, Homo sapiens
aguggcugcuucuc

SEQ ID NO: 1530081 - RNA, 15 nt, Homo sapiens
agugguacucugugu

SEQ ID NO: 1530082 - RNA, 21 nt, Homo sapiens
aguguauauuuuugguggugg

SEQ ID NO: 1530083 - RNA, 13 nt, Homo sapiens
aguuaauucaccu

SEQ ID NO: 1530084 - RNA, 17 nt, Homo sapiens
aguucucugccaaagcu

SEQ ID NO: 1530085 - RNA, 16 nt, Homo sapiens
aguuuacaaucagcca

SEQ ID NO: 1530086 - RNA, 20 nt, Homo sapiens
aguuuauaagacuggaauau

SEQ ID NO: 1530087 - RNA, 17 nt, Homo sapiens
auaacuuugaagccaua

SEQ ID NO: 1530088 - RNA, 13 nt, Homo sapiens
auaagacauuugu

SEQ ID NO: 1530089 - RNA, 13 nt, Homo sapiens
auaagaucacuga

SEQ ID NO: 1530090 - RNA, 15 nt, Homo sapiens
auaauucagcacuua

SEQ ID NO: 1530091 - RNA, 19 nt, Homo sapiens
auaauucagcacuuaacua

SEQ ID NO: 1530092 - RNA, 16 nt, Homo sapiens
auaauuucaaaccaca

SEQ ID NO: 1530093 - RNA, 17 nt, Homo sapiens
auaauuucaaaccacac

SEQ ID NO: 1530094 - RNA, 19 nt, Homo sapiens
auaauuucaaaccacacau

SEQ ID NO: 1530095 - RNA, 15 nt, Homo sapiens
auaauuuucauucau

SEQ ID NO: 1530096 - RNA, 20 nt, Homo sapiens
auaauuuucauucauucacu

SEQ ID NO: 1530097 - RNA, 20 nt, Homo sapiens
auagggagacccccaucuuu

SEQ ID NO: 1530098 - RNA, 15 nt, Homo sapiens
auaguggugugauuu

SEQ ID NO: 1530099 - RNA, 18 nt, Homo sapiens
auauaagaaugagccugu

SEQ ID NO: 1530100 - RNA, 22 nt, Homo sapiens
auauaagaaugagccuguccaa

SEQ ID NO: 1530101 - RNA, 16 nt, Homo sapiens
auauaauuucaaacca

SEQ ID NO: 1530102 - RNA, 18 nt, Homo sapiens
auauaugccuucccccac

SEQ ID NO: 1530103 - RNA, 13 nt, Homo sapiens
auaucaguaccuc

SEQ ID NO: 1530104 - RNA, 17 nt, Homo sapiens
auaugaaggauuacucu

SEQ ID NO: 1530105 - RNA, 21 nt, Homo sapiens
auauuuuuggugguggugggu

SEQ ID NO: 1530106 - RNA, 22 nt, Homo sapiens
aucauaauucagcacuuaacua

SEQ ID NO: 1530107 - RNA, 20 nt, Homo sapiens
aucauacuaaacuucaccua

SEQ ID NO: 1530108 - RNA, 21 nt, Homo sapiens
auccacuucaggagcccuacu

SEQ ID NO: 1530109 - RNA, 13 nt, Homo sapiens
aucccuacuguaa

SEQ ID NO: 1530110 - RNA, 17 nt, Homo sapiens
auccuuaaaacaauucu

SEQ ID NO: 1530111 - RNA, 23 nt, Homo sapiens
aucgcucguguguucuauccaaa

SEQ ID NO: 1530112 - RNA, 21 nt, Homo sapiens
aucgucacugcuuaacuucac

SEQ ID NO: 1530113 - RNA, 14 nt, Homo sapiens
aucguuuugcccga

SEQ ID NO: 1530114 - RNA, 16 nt, Homo sapiens
aucugccgcuuugucu

SEQ ID NO: 1530115 - RNA, 15 nt, Homo sapiens
aucuuuggauuugau

SEQ ID NO: 1530116 - RNA, 23 nt, Homo sapiens
augaaaagucguuuuccaaacug

SEQ ID NO: 1530117 - RNA, 17 nt, Homo sapiens
augaucuggauccacca

SEQ ID NO: 1530118 - RNA, 15 nt, Homo sapiens
augcaaggucauuuu

SEQ ID NO: 1530119 - RNA, 15 nt, Homo sapiens
augccuguaaucuca

SEQ ID NO: 1530120 - RNA, 17 nt, Homo sapiens
augccuguaaucucagc

SEQ ID NO: 1530121 - RNA, 23 nt, Homo sapiens
augccuguaaucucagcacuuug

SEQ ID NO: 1530122 - RNA, 21 nt, Homo sapiens
augcuccaaauauaagacauu

SEQ ID NO: 1530123 - RNA, 17 nt, Homo sapiens
augcugagaagaucuga

SEQ ID NO: 1530124 - RNA, 23 nt, Homo sapiens
augcuggcauuugcaccuaccuc

SEQ ID NO: 1530125 - RNA, 16 nt, Homo sapiens
augggggugcauuuga

SEQ ID NO: 1530126 - RNA, 19 nt, Homo sapiens
auguacaucuggccuugaa

SEQ ID NO: 1530127 - RNA, 13 nt, Homo sapiens
augugaagccaga

SEQ ID NO: 1530128 - RNA, 14 nt, Homo sapiens
augugaggcacugu

SEQ ID NO: 1530129 - RNA, 20 nt, Homo sapiens
auguguuuuucuccagugcu

SEQ ID NO: 1530130 - RNA, 19 nt, Homo sapiens
auuaaaacuaagcacaaag

SEQ ID NO: 1530131 - RNA, 20 nt, Homo sapiens
auuaagaauugguugccaua

SEQ ID NO: 1530132 - RNA, 15 nt, Homo sapiens
auuaccagacaaaaa

SEQ ID NO: 1530133 - RNA, 23 nt, Homo sapiens
auuacuacuuaccauuugcuacu

SEQ ID NO: 1530134 - RNA, 16 nt, Homo sapiens
auuacuaucauaauuc

SEQ ID NO: 1530135 - RNA, 23 nt, Homo sapiens
auuauuuacuauuacgugcuauu

SEQ ID NO: 1530136 - RNA, 20 nt, Homo sapiens
auucacagaauagcacaaac

SEQ ID NO: 1530137 - RNA, 15 nt, Homo sapiens
auucaccuauguuau

SEQ ID NO: 1530138 - RNA, 14 nt, Homo sapiens
auucauucugagcc

SEQ ID NO: 1530139 - RNA, 21 nt, Homo sapiens
auucgcccuccucccugucau

SEQ ID NO: 1530140 - RNA, 22 nt, Homo sapiens
auucgcccuccucccugucaua

SEQ ID NO: 1530141 - RNA, 16 nt, Homo sapiens
auucuacacagagcag

SEQ ID NO: 1530142 - RNA, 15 nt, Homo sapiens
auugauuacuaucau

SEQ ID NO: 1530143 - RNA, 20 nt, Homo sapiens
auugguauacuuuugcuuca

SEQ ID NO: 1530144 - RNA, 15 nt, Homo sapiens
auugugagccaccac

SEQ ID NO: 1530145 - RNA, 19 nt, Homo sapiens
auuuaacagaaauguacag

SEQ ID NO: 1530146 - RNA, 22 nt, Homo sapiens
auuuauggucuucaaccaaggc

SEQ ID NO: 1530147 - RNA, 12 nt, Homo sapiens
auuucaucucuu

SEQ ID NO: 1530148 - RNA, 19 nt, Homo sapiens
auuuccuucaaugugcaua

SEQ ID NO: 1530149 - RNA, 15 nt, Homo sapiens
auuugaucacuacaa

SEQ ID NO: 1530150 - RNA, 15 nt, Homo sapiens
auuugaugugacuuu

SEQ ID NO: 1530151 - RNA, 16 nt, Homo sapiens
auuuuaagaagacaua

SEQ ID NO: 1530152 - RNA, 15 nt, Homo sapiens
auuuuauuaugcaug

SEQ ID NO: 1530153 - RNA, 15 nt, Homo sapiens
auuuucauucauuca

SEQ ID NO: 1530154 - RNA, 17 nt, Homo sapiens
caaacucaaacuugaga

SEQ ID NO: 1530155 - RNA, 23 nt, Homo sapiens
caaagacugaguacguugugcau

SEQ ID NO: 1530156 - RNA, 16 nt, Homo sapiens
caaaggcgacaauaaa

SEQ ID NO: 1530157 - RNA, 11 nt, Homo sapiens
caaaguaccuu

SEQ ID NO: 1530158 - RNA, 21 nt, Homo sapiens
aaaaaacaguucaacugcuua

SEQ ID NO: 1530159 - RNA, 13 nt, Homo sapiens
aaaaauaaugugc

SEQ ID NO: 1530160 - RNA, 17 nt, Homo sapiens
aaaacaauucugugaca

SEQ ID NO: 1530161 - RNA, 18 nt, Homo sapiens
aaaaccaucucugugauu

SEQ ID NO: 1530162 - RNA, 17 nt, Homo sapiens
aaaaggguuucuugaca

SEQ ID NO: 1530163 - RNA, 16 nt, Homo sapiens
aaaauaccagccagua

SEQ ID NO: 1530164 - RNA, 14 nt, Homo sapiens
aaaaucguuuugcc

SEQ ID NO: 1530165 - RNA, 22 nt, Homo sapiens
aaaauggucauccaaacucaaa

SEQ ID NO: 1530166 - RNA, 15 nt, Homo sapiens
aaaauguccugccuu

SEQ ID NO: 1530167 - RNA, 16 nt, Homo sapiens
aaaauguccugccuuu

SEQ ID NO: 1530168 - RNA, 17 nt, Homo sapiens
aaaauguccugccuuuu

SEQ ID NO: 1530169 - RNA, 15 nt, Homo sapiens
aaacaauucugugac

SEQ ID NO: 1530170 - RNA, 21 nt, Homo sapiens
aaacaauuuuuuuuuuccucu

SEQ ID NO: 1530171 - RNA, 15 nt, Homo sapiens
aaacugaagccgugu

SEQ ID NO: 1530172 - RNA, 19 nt, Homo sapiens
aaacuuagaucaucaguca

SEQ ID NO: 1530173 - RNA, 13 nt, Homo sapiens
aaagcuggcccag

SEQ ID NO: 1530174 - RNA, 16 nt, Homo sapiens
aaaguaccuugaacuc

SEQ ID NO: 1530175 - RNA, 16 nt, Homo sapiens
aaaguugcagauguau

SEQ ID NO: 1530176 - RNA, 14 nt, Homo sapiens
aaauaaaacugaau

SEQ ID NO: 1530177 - RNA, 22 nt, Homo sapiens
aaauagagcuuuuaaaaauguc

SEQ ID NO: 1530178 - RNA, 19 nt, Homo sapiens
aaaucacgaccacugauag

SEQ ID NO: 1530179 - RNA, 19 nt, Homo sapiens
aaaucuuuggauuugauca

SEQ ID NO: 1530180 - RNA, 17 nt, Homo sapiens
aaaucuuuuaaaucuuu

SEQ ID NO: 1530181 - RNA, 13 nt, Homo sapiens
aaauguacagcaa

SEQ ID NO: 1530182 - RNA, 20 nt, Homo sapiens
aaauuaguuucaaauuuacc

SEQ ID NO: 1530183 - RNA, 15 nt, Homo sapiens
aaauuuaaaauuacg

SEQ ID NO: 1530184 - RNA, 14 nt, Homo sapiens
aacaauucugugac

SEQ ID NO: 1530185 - RNA, 15 nt, Homo sapiens
aacaauucugugaca

SEQ ID NO: 1530186 - RNA, 17 nt, Homo sapiens
aacacauucuuauuaau

SEQ ID NO: 1530187 - RNA, 23 nt, Homo sapiens
aacacauucuuauuaauucuuca

SEQ ID NO: 1530188 - RNA, 18 nt, Homo sapiens
aacauuaaggaauuugau

SEQ ID NO: 1530189 - RNA, 23 nt, Homo sapiens
aaccaucucugugauuaccucuc

SEQ ID NO: 1530190 - RNA, 19 nt, Homo sapiens
aacccaccccgcuuucgua

SEQ ID NO: 1530191 - RNA, 14 nt, Homo sapiens
aacccuugcuugca

SEQ ID NO: 1530192 - RNA, 16 nt, Homo sapiens
aaccugaguauaguau

SEQ ID NO: 1530193 - RNA, 13 nt, Homo sapiens
aacuaagcacaaa

SEQ ID NO: 1530194 - RNA, 21 nt, Homo sapiens
aagaaaaacaccgcuucugcc

SEQ ID NO: 1530195 - RNA, 14 nt, Homo sapiens
aagaaaaacaucuu

SEQ ID NO: 1530196 - RNA, 22 nt, Homo sapiens
aagaaccagagaggcucugaga

SEQ ID NO: 1530197 - RNA, 18 nt, Homo sapiens
aagaaugagccuguccaa

SEQ ID NO: 1530198 - RNA, 21 nt, Homo sapiens
aagacaauaauucuacauguu

SEQ ID NO: 1530199 - RNA, 22 nt, Homo sapiens
aagacugaguacguugugcauu

SEQ ID NO: 1530200 - RNA, 11 nt, Homo sapiens
aagacuugaga

SEQ ID NO: 1530201 - RNA, 17 nt, Homo sapiens
aagaguaacuuuacucu

SEQ ID NO: 1530202 - RNA, 22 nt, Homo sapiens
aagauauggagaauugcugaag

SEQ ID NO: 1530203 - RNA, 16 nt, Homo sapiens
aagcagcaacagcaaa

SEQ ID NO: 1530204 - RNA, 17 nt, Homo sapiens
aagcaugugagacuggu

SEQ ID NO: 1530205 - RNA, 13 nt, Homo sapiens
aagcccuuugcca

SEQ ID NO: 1530206 - RNA, 16 nt, Homo sapiens
aaguauuauuuuacaa

SEQ ID NO: 1530207 - RNA, 17 nt, Homo sapiens
aagugaagacaaugacu

SEQ ID NO: 1530208 - RNA, 18 nt, Homo sapiens
aauaauggaaacauuaca

SEQ ID NO: 1530209 - RNA, 14 nt, Homo sapiens
aauaauguacaucu

SEQ ID NO: 1530210 - RNA, 15 nt, Homo sapiens
aauaucuugcuuuca

SEQ ID NO: 1530211 - RNA, 20 nt, Homo sapiens
aaucaagaaaaacaucuuug

SEQ ID NO: 1530212 - RNA, 14 nt, Homo sapiens
aaucacugcauuca

SEQ ID NO: 1530213 - RNA, 13 nt, Homo sapiens
aaucuaaauggaa

SEQ ID NO: 1530214 - RNA, 14 nt, Homo sapiens
aaucucagcacuuu

SEQ ID NO: 1530215 - RNA, 13 nt, Homo sapiens
aaucugagcugca

SEQ ID NO: 1530216 - RNA, 20 nt, Homo sapiens
aaucugccgcuuugucuguc

SEQ ID NO: 1530217 - RNA, 23 nt, Homo sapiens
aaucugccgcuuugucuguccag

SEQ ID NO: 1530218 - RNA, 12 nt, Homo sapiens
aaugcugagaag

SEQ ID NO: 1530219 - RNA, 16 nt, Homo sapiens
aaugcuggcauuugca

SEQ ID NO: 1530220 - RNA, 16 nt, Homo sapiens
aauggcagaaccaaag

SEQ ID NO: 1530221 - RNA, 19 nt, Homo sapiens
aauggcagcuagugccuuu

SEQ ID NO: 1530222 - RNA, 15 nt, Homo sapiens
aaugggggugcauuu

SEQ ID NO: 1530223 - RNA, 15 nt, Homo sapiens
aauggucauccaaac

SEQ ID NO: 1530224 - RNA, 17 nt, Homo sapiens
aauggucauccaaacuc

SEQ ID NO: 1530225 - RNA, 20 nt, Homo sapiens
aauguauuguaaucuuucau

SEQ ID NO: 1530226 - RNA, 15 nt, Homo sapiens
aaugucucacuguuc

SEQ ID NO: 1530227 - RNA, 23 nt, Homo sapiens
aaugucucacuguucugcaaagg

SEQ ID NO: 1530228 - RNA, 16 nt, Homo sapiens
aaugugaggguggugg

SEQ ID NO: 1530229 - RNA, 20 nt, Homo sapiens
aauucucuaguuugauuaaa

SEQ ID NO: 1530230 - RNA, 22 nt, Homo sapiens
aauucugugacauacauauuau

SEQ ID NO: 1530231 - RNA, 19 nt, Homo sapiens
aauuuauuaacuaaucaag

SEQ ID NO: 1530232 - RNA, 13 nt, Homo sapiens
aauuuucauucau

SEQ ID NO: 1530233 - RNA, 20 nt, Homo sapiens
aauuuugguuuaugacucuu

SEQ ID NO: 1530234 - RNA, 21 nt, Homo sapiens
acaaaauggucauccaaacuc

SEQ ID NO: 1530235 - RNA, 16 nt, Homo sapiens
acaaacaaacauuguu

SEQ ID NO: 1530236 - RNA, 19 nt, Homo sapiens
acaacccaccccgcuuucg

SEQ ID NO: 1530237 - RNA, 19 nt, Homo sapiens
acaagguugguugcuaaga

SEQ ID NO: 1530238 - RNA, 14 nt, Homo sapiens
acacaguccaacuc

SEQ ID NO: 1530239 - RNA, 20 nt, Homo sapiens
acacccagcucagcauuucc

SEQ ID NO: 1530240 - RNA, 20 nt, Homo sapiens
acacugcauguuugugauug

SEQ ID NO: 1530241 - RNA, 22 nt, Homo sapiens
acagaagcuuaaaaucugugaa

SEQ ID NO: 1530242 - RNA, 17 nt, Homo sapiens
cucuuaugugugccuuu

SEQ ID NO: 1530243 - RNA, 18 nt, Homo sapiens
cucuuaugugugccuuug

SEQ ID NO: 1530244 - RNA, 12 nt, Homo sapiens
cucuugacuacu

SEQ ID NO: 1530245 - RNA, 11 nt, Homo sapiens
cugaagauauu

SEQ ID NO: 1530246 - RNA, 18 nt, Homo sapiens
cugaguauaguauuuaac

SEQ ID NO: 1530247 - RNA, 22 nt, Homo sapiens
cugcauucauucugagcccccu

SEQ ID NO: 1530248 - RNA, 18 nt, Homo sapiens
cugcccaccccagcauca

SEQ ID NO: 1530249 - RNA, 20 nt, Homo sapiens
cugccuccaacccagcaguu

SEQ ID NO: 1530250 - RNA, 22 nt, Homo sapiens
cugcuugauuuuaauacauuga

SEQ ID NO: 1530251 - RNA, 19 nt, Homo sapiens
cuggcauuugcaccuaccu

SEQ ID NO: 1530252 - RNA, 14 nt, Homo sapiens
cuggcccagccaaa

SEQ ID NO: 1530253 - RNA, 20 nt, Homo sapiens
cuggcuucucuugagucaca

SEQ ID NO: 1530254 - RNA, 21 nt, Homo sapiens
cugggucucgcuuuguugccc

SEQ ID NO: 1530255 - RNA, 20 nt, Homo sapiens
cugguauuguuuacguuuga

SEQ ID NO: 1530256 - RNA, 15 nt, Homo sapiens
cuggucucaaacucc

SEQ ID NO: 1530257 - RNA, 22 nt, Homo sapiens
cugguggaagucuuggguguua

SEQ ID NO: 1530258 - RNA, 20 nt, Homo sapiens
cugguucgugccaugcccuu

SEQ ID NO: 1530259 - RNA, 19 nt, Homo sapiens
cuguaaucccaacacuuug

SEQ ID NO: 1530260 - RNA, 18 nt, Homo sapiens
cuguaaucucagcacuuu

SEQ ID NO: 1530261 - RNA, 14 nt, Homo sapiens
cuguaucaugacaa

SEQ ID NO: 1530262 - RNA, 14 nt, Homo sapiens
cuguccacacccag

SEQ ID NO: 1530263 - RNA, 15 nt, Homo sapiens
cugucuuucaucucc

SEQ ID NO: 1530264 - RNA, 21 nt, Homo sapiens
cugugaaaugcuggcauuugc

SEQ ID NO: 1530265 - RNA, 13 nt, Homo sapiens
cugugggugguga

SEQ ID NO: 1530266 - RNA, 15 nt, Homo sapiens
cuguucuuuccaaag

SEQ ID NO: 1530267 - RNA, 18 nt, Homo sapiens
cuguugaaucugagcugc

SEQ ID NO: 1530268 - RNA, 18 nt, Homo sapiens
cuguuuguuuuuguacau

SEQ ID NO: 1530269 - RNA, 21 nt, Homo sapiens
cuuaaacuaaauaaugaauaa

SEQ ID NO: 1530270 - RNA, 21 nt, Homo sapiens
cuuagguauauaauaacuuug

SEQ ID NO: 1530271 - RNA, 23 nt, Homo sapiens
cuuaguccaauuccuugcacaua

SEQ ID NO: 1530272 - RNA, 14 nt, Homo sapiens
cuucacaucuguca

SEQ ID NO: 1530273 - RNA, 19 nt, Homo sapiens
cuucaccuacauuaucuca

SEQ ID NO: 1530274 - RNA, 13 nt, Homo sapiens
cuucagguggaug

SEQ ID NO: 1530275 - RNA, 12 nt, Homo sapiens
cuuccauuugcu

SEQ ID NO: 1530276 - RNA, 21 nt, Homo sapiens
cuuccucucaggcucuugacu

SEQ ID NO: 1530277 - RNA, 19 nt, Homo sapiens
cuucggggaccagcccaca

SEQ ID NO: 1530278 - RNA, 16 nt, Homo sapiens
cuucucuugagucaca

SEQ ID NO: 1530279 - RNA, 13 nt, Homo sapiens
cuucuuguucccc

SEQ ID NO: 1530280 - RNA, 16 nt, Homo sapiens
cuugcuugcaauaggu

SEQ ID NO: 1530281 - RNA, 16 nt, Homo sapiens
cuuguuccccacugac

SEQ ID NO: 1530282 - RNA, 14 nt, Homo sapiens
cuuucccaguccca

SEQ ID NO: 1530283 - RNA, 15 nt, Homo sapiens
cuuucccagucccau

SEQ ID NO: 1530284 - RNA, 18 nt, Homo sapiens
cuuucuugcacuguccag

SEQ ID NO: 1530285 - RNA, 22 nt, Homo sapiens
cuuugggaagcucccacaccca

SEQ ID NO: 1530286 - RNA, 17 nt, Homo sapiens
cuuugucccggggcucc

SEQ ID NO: 1530287 - RNA, 23 nt, Homo sapiens
cuuugucccggggcuccacugaa

SEQ ID NO: 1530288 - RNA, 11 nt, Homo sapiens
cuuuguugccc

SEQ ID NO: 1530289 - RNA, 16 nt, Homo sapiens
cuuuuccccaguccca

SEQ ID NO: 1530290 - RNA, 23 nt, Homo sapiens
cuuuugcuagagcugacagcuuu

SEQ ID NO: 1530291 - RNA, 11 nt, Homo sapiens
cuuuugugcau

SEQ ID NO: 1530292 - RNA, 13 nt, Homo sapiens
cuuuugugcauua

SEQ ID NO: 1530293 - RNA, 13 nt, Homo sapiens
cuuuuucuuugag

SEQ ID NO: 1530294 - RNA, 16 nt, Homo sapiens
gaaaaggguuucuuga

SEQ ID NO: 1530295 - RNA, 22 nt, Homo sapiens
gaaaaguagacaaucauuguuu

SEQ ID NO: 1530296 - RNA, 14 nt, Homo sapiens
gaaacuuagaucau

SEQ ID NO: 1530297 - RNA, 21 nt, Homo sapiens
gaaauaaauggugccugggau

SEQ ID NO: 1530298 - RNA, 13 nt, Homo sapiens
gaaaugagccagc

SEQ ID NO: 1530299 - RNA, 18 nt, Homo sapiens
gaaauguuuguccuugca

SEQ ID NO: 1530300 - RNA, 12 nt, Homo sapiens
gaacuaggcucu

SEQ ID NO: 1530301 - RNA, 16 nt, Homo sapiens
gaacucagugccacac

SEQ ID NO: 1530302 - RNA, 23 nt, Homo sapiens
gaagaaaauaguggugugauuug

SEQ ID NO: 1530303 - RNA, 21 nt, Homo sapiens
gaagcucccacacccaccucu

SEQ ID NO: 1530304 - RNA, 19 nt, Homo sapiens
gaagcuuaaaaucugugaa

SEQ ID NO: 1530305 - RNA, 19 nt, Homo sapiens
gaaggaauccugguggaag

SEQ ID NO: 1530306 - RNA, 20 nt, Homo sapiens
gaauauaauuucaaaccaca

SEQ ID NO: 1530307 - RNA, 23 nt, Homo sapiens
gaaugugaagccagaucucggga

SEQ ID NO: 1530308 - RNA, 14 nt, Homo sapiens
gaauugguugccau

SEQ ID NO: 1530309 - RNA, 20 nt, Homo sapiens
gaauuuucucuaacuucaag

SEQ ID NO: 1530310 - RNA, 17 nt, Homo sapiens
gacacaugcaaggucau

SEQ ID NO: 1530311 - RNA, 13 nt, Homo sapiens
gacacuuuaccuc

SEQ ID NO: 1530312 - RNA, 19 nt, Homo sapiens
gacuacuuggaacuaggcu

SEQ ID NO: 1530313 - RNA, 22 nt, Homo sapiens
gacugcacagcguccuguccac

SEQ ID NO: 1530314 - RNA, 18 nt, Homo sapiens
gacuguggaaccaaagcu

SEQ ID NO: 1530315 - RNA, 20 nt, Homo sapiens
gacuucaugacaagcauuuu

SEQ ID NO: 1530316 - RNA, 22 nt, Homo sapiens
gagacaaaccugggcaaugugg

SEQ ID NO: 1530317 - RNA, 19 nt, Homo sapiens
gagacaauguuuucuucaa

SEQ ID NO: 1530318 - RNA, 15 nt, Homo sapiens
gagaggcucugagaa

SEQ ID NO: 1530319 - RNA, 16 nt, Homo sapiens
gagagguuugcaucca

SEQ ID NO: 1530320 - RNA, 17 nt, Homo sapiens
gagcaguccugccucag

SEQ ID NO: 1530321 - RNA, 20 nt, Homo sapiens
gagccaccacguccagcugg

SEQ ID NO: 1530322 - RNA, 20 nt, Homo sapiens
gagcccccugagagugucag

SEQ ID NO: 1530323 - RNA, 14 nt, Homo sapiens
gaggcuaacccuga

SEQ ID NO: 1530324 - RNA, 22 nt, Homo sapiens
gaggcugaggcagaaggauuac

SEQ ID NO: 1530325 - RNA, 17 nt, Homo sapiens
gaggcugucacaguccu

SEQ ID NO: 1530326 - RNA, 15 nt, Homo sapiens
gagugagcacucacg

SEQ ID NO: 1530327 - RNA, 19 nt, Homo sapiens
gagugcauugugaggguua

SEQ ID NO: 1530328 - RNA, 17 nt, Homo sapiens
gaguugucaagucucug

SEQ ID NO: 1530329 - RNA, 22 nt, Homo sapiens
gauacuguaucaugacaaagac

SEQ ID NO: 1530330 - RNA, 15 nt, Homo sapiens
gauaugaaggauuac

SEQ ID NO: 1530331 - RNA, 20 nt, Homo sapiens
gaucaaaguguaaacaccau

SEQ ID NO: 1530332 - RNA, 18 nt, Homo sapiens
gaugcuggcccuacagua

SEQ ID NO: 1530333 - RNA, 18 nt, Homo sapiens
gauggaggccuaccucuc

SEQ ID NO: 1530334 - RNA, 23 nt, Homo sapiens
gauucgcccuccucccugucaua

SEQ ID NO: 1530335 - RNA, 17 nt, Homo sapiens
gcaacauuuguauggau

SEQ ID NO: 1530336 - RNA, 18 nt, Homo sapiens
gcacauagcucaaucaca

SEQ ID NO: 1530337 - RNA, 13 nt, Homo sapiens
gcacucacgcccu

SEQ ID NO: 1530338 - RNA, 18 nt, Homo sapiens
gcagcccguguccaggag

SEQ ID NO: 1530339 - RNA, 15 nt, Homo sapiens
gcagcuagugccuuu

SEQ ID NO: 1530340 - RNA, 20 nt, Homo sapiens
gcaggacaagggccugggau

SEQ ID NO: 1530341 - RNA, 15 nt, Homo sapiens
gcaggcuacucugcc

SEQ ID NO: 1530342 - RNA, 19 nt, Homo sapiens
gcaguccugccucagccuc

SEQ ID NO: 1530343 - RNA, 15 nt, Homo sapiens
gcaucagcacagcuc

SEQ ID NO: 1530344 - RNA, 13 nt, Homo sapiens
gcaucugcauggg

SEQ ID NO: 1530345 - RNA, 18 nt, Homo sapiens
gcaugaaguaauaugcac

SEQ ID NO: 1530346 - RNA, 21 nt, Homo sapiens
gccacauucaugggaaacccu

SEQ ID NO: 1530347 - RNA, 17 nt, Homo sapiens
gccagcugugcacuuuc

SEQ ID NO: 1530348 - RNA, 14 nt, Homo sapiens
gccaggagcccugg

SEQ ID NO: 1530349 - RNA, 21 nt, Homo sapiens
gccagugcuaagcugcccuga

SEQ ID NO: 1530350 - RNA, 12 nt, Homo sapiens
gccaugcccuua

SEQ ID NO: 1530351 - RNA, 18 nt, Homo sapiens
gcccaguuguccaugaca

SEQ ID NO: 1530352 - RNA, 16 nt, Homo sapiens
gcccccgccacaaccc

SEQ ID NO: 1530353 - RNA, 12 nt, Homo sapiens
gcccuacaguac

SEQ ID NO: 1530354 - RNA, 23 nt, Homo sapiens
gcccucaggcuccccagugcucc

SEQ ID NO: 1530355 - RNA, 16 nt, Homo sapiens
gccguguuuuuggccc

SEQ ID NO: 1530356 - RNA, 16 nt, Homo sapiens
ccguauugguauacuu

SEQ ID NO: 1530357 - RNA, 11 nt, Homo sapiens
ccgucuucucc

SEQ ID NO: 1530358 - RNA, 15 nt, Homo sapiens
ccuacauuaucucac

SEQ ID NO: 1530359 - RNA, 11 nt, Homo sapiens
ccuaccucucg

SEQ ID NO: 1530360 - RNA, 21 nt, Homo sapiens
ccuauucccucucucucccag

SEQ ID NO: 1530361 - RNA, 20 nt, Homo sapiens
ccucacagagugcauuguga

SEQ ID NO: 1530362 - RNA, 17 nt, Homo sapiens
ccucagcuucuucacag

SEQ ID NO: 1530363 - RNA, 18 nt, Homo sapiens
ccucagcuucuucacagg

SEQ ID NO: 1530364 - RNA, 19 nt, Homo sapiens
ccuccucagaggacaguuu

SEQ ID NO: 1530365 - RNA, 21 nt, Homo sapiens
ccucucucucccaggucccag

SEQ ID NO: 1530366 - RNA, 13 nt, Homo sapiens
ccuggaaauggac

SEQ ID NO: 1530367 - RNA, 19 nt, Homo sapiens
ccuguaaucccaacacuuu

SEQ ID NO: 1530368 - RNA, 20 nt, Homo sapiens
ccuguaaucccaacacuuug

SEQ ID NO: 1530369 - RNA, 18 nt, Homo sapiens
ccuguaaucucagcacuu

SEQ ID NO: 1530370 - RNA, 20 nt, Homo sapiens
ccuguaaucucagcacuuug

SEQ ID NO: 1530371 - RNA, 15 nt, Homo sapiens
ccuguccaauuucug

SEQ ID NO: 1530372 - RNA, 15 nt, Homo sapiens
ccugugccuccucag

SEQ ID NO: 1530373 - RNA, 12 nt, Homo sapiens
ccuuaaccuuaa

SEQ ID NO: 1530374 - RNA, 19 nt, Homo sapiens
ccuuugggccaauuuacug

SEQ ID NO: 1530375 - RNA, 18 nt, Homo sapiens
ccuuuuccccagucccag

SEQ ID NO: 1530376 - RNA, 20 nt, Homo sapiens
cgacuucaugacaagcauuu

SEQ ID NO: 1530377 - RNA, 17 nt, Homo sapiens
cgcccuccucccuguca

SEQ ID NO: 1530378 - RNA, 19 nt, Homo sapiens
cgcccuccucccugucaua

SEQ ID NO: 1530379 - RNA, 20 nt, Homo sapiens
cgcuggguauuggaaaugga

SEQ ID NO: 1530380 - RNA, 16 nt, Homo sapiens
cgcuuaaccuuuccag

SEQ ID NO: 1530381 - RNA, 19 nt, Homo sapiens
cgcuucugccuuuucacug

SEQ ID NO: 1530382 - RNA, 20 nt, Homo sapiens
cgcuucugccuuuucacugu

SEQ ID NO: 1530383 - RNA, 23 nt, Homo sapiens
cggaagcugucgacuucaugaca

SEQ ID NO: 1530384 - RNA, 18 nt, Homo sapiens
cggcugcggggggcacca

SEQ ID NO: 1530385 - RNA, 15 nt, Homo sapiens
cggggcuccacugaa

SEQ ID NO: 1530386 - RNA, 14 nt, Homo sapiens
cguugugcauuugg

SEQ ID NO: 1530387 - RNA, 20 nt, Homo sapiens
cuaaacuucaccuacauuau

SEQ ID NO: 1530388 - RNA, 21 nt, Homo sapiens
cuaaaguguauuuuuuuacua

SEQ ID NO: 1530389 - RNA, 12 nt, Homo sapiens
cuaagcacaaag

SEQ ID NO: 1530390 - RNA, 21 nt, Homo sapiens
cuacacagagcaggacugcac

SEQ ID NO: 1530391 - RNA, 13 nt, Homo sapiens
cuacccuguguau

SEQ ID NO: 1530392 - RNA, 18 nt, Homo sapiens
cuacuguaauuugugaua

SEQ ID NO: 1530393 - RNA, 20 nt, Homo sapiens
cuagagcugacagcuuuguu

SEQ ID NO: 1530394 - RNA, 22 nt, Homo sapiens
cuagggcccuuucuugcacugu

SEQ ID NO: 1530395 - RNA, 22 nt, Homo sapiens
cuaguaaguaauuaugcacuaa

SEQ ID NO: 1530396 - RNA, 20 nt, Homo sapiens
cuaucaaguauuauaccuuu

SEQ ID NO: 1530397 - RNA, 12 nt, Homo sapiens
cuauuuaccucc

SEQ ID NO: 1530398 - RNA, 21 nt, Homo sapiens
cucacugugggaaggccagcu

SEQ ID NO: 1530399 - RNA, 21 nt, Homo sapiens
cuccugauaaaacaacagcuc

SEQ ID NO: 1530400 - RNA, 15 nt, Homo sapiens
cuccuggagcacugu

SEQ ID NO: 1530401 - RNA, 13 nt, Homo sapiens
cucuccauauccc

SEQ ID NO: 1530402 - RNA, 14 nt, Homo sapiens
cucugccacucuua

SEQ ID NO: 1530403 - RNA, 16 nt, Homo sapiens
cucugggaucugccaa

SEQ ID NO: 1530404 - RNA, 14 nt, Homo sapiens
cucuuagugauuga

SEQ ID NO: 1530405 - RNA, 20 nt, Homo sapiens
cucuucccagagucacaagu

SEQ ID NO: 1530406 - RNA, 17 nt, Homo sapiens
cucuugagucacacugc

SEQ ID NO: 1530407 - RNA, 18 nt, Homo sapiens
cucuuguauaugaugauc

SEQ ID NO: 1530408 - RNA, 12 nt, Homo sapiens
cugaagauauau

SEQ ID NO: 1530409 - RNA, 13 nt, Homo sapiens
cugagaaaccucg

SEQ ID NO: 1530410 - RNA, 14 nt, Homo sapiens
cugagaagaucuga

SEQ ID NO: 1530411 - RNA, 22 nt, Homo sapiens
cugagaugaaaacuagggcuca

SEQ ID NO: 1530412 - RNA, 18 nt, Homo sapiens
cugagcccauaggucuca

SEQ ID NO: 1530413 - RNA, 23 nt, Homo sapiens
cugaggguuuccuucggggacca

SEQ ID NO: 1530414 - RNA, 17 nt, Homo sapiens
cugaguacguugugcau

SEQ ID NO: 1530415 - RNA, 19 nt, Homo sapiens
cugaguacguugugcauuu

SEQ ID NO: 1530416 - RNA, 16 nt, Homo sapiens
cugcaagcacaucugc

SEQ ID NO: 1530417 - RNA, 19 nt, Homo sapiens
cugccgcuuugucugucca

SEQ ID NO: 1530418 - RNA, 23 nt, Homo sapiens
cugccgggagacugccaguggag

SEQ ID NO: 1530419 - RNA, 20 nt, Homo sapiens
cugcuugauuuuaauacauu

SEQ ID NO: 1530420 - RNA, 15 nt, Homo sapiens
cuggaaacagcagug

SEQ ID NO: 1530421 - RNA, 12 nt, Homo sapiens
cuggaaauggac

SEQ ID NO: 1530422 - RNA, 13 nt, Homo sapiens
cuggaaauggacu

SEQ ID NO: 1530423 - RNA, 19 nt, Homo sapiens
agugguuuuugcucuaggg

SEQ ID NO: 1530424 - RNA, 15 nt, Homo sapiens
aguguaaacaccaua

SEQ ID NO: 1530425 - RNA, 18 nt, Homo sapiens
aguguggacuuggcaggu

SEQ ID NO: 1530426 - RNA, 23 nt, Homo sapiens
aguguugcccaggcuggucucaa

SEQ ID NO: 1530427 - RNA, 12 nt, Homo sapiens
aguuaaggguua

SEQ ID NO: 1530428 - RNA, 21 nt, Homo sapiens
aguucaacugcuuacucccaa

SEQ ID NO: 1530429 - RNA, 22 nt, Homo sapiens
aguucucugccaaagcuugugg

SEQ ID NO: 1530430 - RNA, 17 nt, Homo sapiens
aguuggcccuucugccc

SEQ ID NO: 1530431 - RNA, 14 nt, Homo sapiens
auaagaucacugaa

SEQ ID NO: 1530432 - RNA, 14 nt, Homo sapiens
auaauucagcacuu

SEQ ID NO: 1530433 - RNA, 21 nt, Homo sapiens
auacauaaacaagaccacguu

SEQ ID NO: 1530434 - RNA, 23 nt, Homo sapiens
auagagcuuuuaaaaauguccug

SEQ ID NO: 1530435 - RNA, 14 nt, Homo sapiens
auaucgaucucuua

SEQ ID NO: 1530436 - RNA, 12 nt, Homo sapiens
auauuaucucau

SEQ ID NO: 1530437 - RNA, 13 nt, Homo sapiens
auauucauauaca

SEQ ID NO: 1530438 - RNA, 19 nt, Homo sapiens
auauuuugcuuugugauuu

SEQ ID NO: 1530439 - RNA, 15 nt, Homo sapiens
aucagccacauucua

SEQ ID NO: 1530440 - RNA, 20 nt, Homo sapiens
aucccuuccucucaggcucu

SEQ ID NO: 1530441 - RNA, 19 nt, Homo sapiens
aucucacuuaguccuuuau

SEQ ID NO: 1530442 - RNA, 18 nt, Homo sapiens
aucucauuuuacacaaag

SEQ ID NO: 1530443 - RNA, 22 nt, Homo sapiens
aucucauuuuacacaaagggaa

SEQ ID NO: 1530444 - RNA, 19 nt, Homo sapiens
aucucggcuguuccugaga

SEQ ID NO: 1530445 - RNA, 20 nt, Homo sapiens
aucucugugauuaccucuca

SEQ ID NO: 1530446 - RNA, 17 nt, Homo sapiens
aucucuguugcaccuga

SEQ ID NO: 1530447 - RNA, 23 nt, Homo sapiens
aucucuuguauaugaugaucugg

SEQ ID NO: 1530448 - RNA, 21 nt, Homo sapiens
aucuucagggaacugcauaga

SEQ ID NO: 1530449 - RNA, 14 nt, Homo sapiens
augacuuacuguac

SEQ ID NO: 1530450 - RNA, 17 nt, Homo sapiens
augagaaaagaaauuag

SEQ ID NO: 1530451 - RNA, 12 nt, Homo sapiens
augaugaucugg

SEQ ID NO: 1530452 - RNA, 20 nt, Homo sapiens
augaugcccugcuccaggga

SEQ ID NO: 1530453 - RNA, 14 nt, Homo sapiens
augccuguaaucuc

SEQ ID NO: 1530454 - RNA, 16 nt, Homo sapiens
auggcagaaccaaagc

SEQ ID NO: 1530455 - RNA, 17 nt, Homo sapiens
auguccauuuauaucau

SEQ ID NO: 1530456 - RNA, 19 nt, Homo sapiens
auguguuuuucuccagugc

SEQ ID NO: 1530457 - RNA, 14 nt, Homo sapiens
auguugcacaauga

SEQ ID NO: 1530458 - RNA, 11 nt, Homo sapiens
auuaacuaauc

SEQ ID NO: 1530459 - RNA, 16 nt, Homo sapiens
auuaccagacaaaaaa

SEQ ID NO: 1530460 - RNA, 23 nt, Homo sapiens
auuacuaucauaauucagcacuu

SEQ ID NO: 1530461 - RNA, 16 nt, Homo sapiens
auuagaaaggacugua

SEQ ID NO: 1530462 - RNA, 18 nt, Homo sapiens
auuaguacuuauguugca

SEQ ID NO: 1530463 - RNA, 20 nt, Homo sapiens
auuaguacuuauguugcaca

SEQ ID NO: 1530464 - RNA, 18 nt, Homo sapiens
auuaucuagauacuguau

SEQ ID NO: 1530465 - RNA, 13 nt, Homo sapiens
auuaucucacuua

SEQ ID NO: 1530466 - RNA, 17 nt, Homo sapiens
auuauuuuacaaucaac

SEQ ID NO: 1530467 - RNA, 23 nt, Homo sapiens
auucaaucuuuggaggcuuuuaa

SEQ ID NO: 1530468 - RNA, 22 nt, Homo sapiens
auucauucugagcccccuuccu

SEQ ID NO: 1530469 - RNA, 14 nt, Homo sapiens
auuccuugcacaua

SEQ ID NO: 1530470 - RNA, 20 nt, Homo sapiens
auucucccaaaguaccuuga

SEQ ID NO: 1530471 - RNA, 21 nt, Homo sapiens
auucucccaaaguaccuugaa

SEQ ID NO: 1530472 - RNA, 16 nt, Homo sapiens
auucuuucccagugag

SEQ ID NO: 1530473 - RNA, 14 nt, Homo sapiens
auugaaagaaccag

SEQ ID NO: 1530474 - RNA, 23 nt, Homo sapiens
auugaacgcacauagcucaauca

SEQ ID NO: 1530475 - RNA, 13 nt, Homo sapiens
auuggaaauggau

SEQ ID NO: 1530476 - RNA, 22 nt, Homo sapiens
auuuaaaauuacguuuguuauu

SEQ ID NO: 1530477 - RNA, 22 nt, Homo sapiens
auuuagaaaauagagcuuuuaa

SEQ ID NO: 1530478 - RNA, 16 nt, Homo sapiens
auuugaucacuacaag

SEQ ID NO: 1530479 - RNA, 16 nt, Homo sapiens
caaaaaaacaaaaaag

SEQ ID NO: 1530480 - RNA, 19 nt, Homo sapiens
caaaaaucguuuugcccga

SEQ ID NO: 1530481 - RNA, 20 nt, Homo sapiens
caaaagaggcuuuugggcca

SEQ ID NO: 1530482 - RNA, 19 nt, Homo sapiens
caaaaugugaggguggugg

SEQ ID NO: 1530483 - RNA, 20 nt, Homo sapiens
caaacuuuuuuauaucuuuu

SEQ ID NO: 1530484 - RNA, 14 nt, Homo sapiens
caaagugaaggaca

SEQ ID NO: 1530485 - RNA, 23 nt, Homo sapiens
caaauggcagaaccaaagcucaa

SEQ ID NO: 1530486 - RNA, 15 nt, Homo sapiens
caacaugcuccaaau

SEQ ID NO: 1530487 - RNA, 15 nt, Homo sapiens
caacauggcuuucuu

SEQ ID NO: 1530488 - RNA, 17 nt, Homo sapiens
caagaaaaacaucuuug

SEQ ID NO: 1530489 - RNA, 16 nt, Homo sapiens
caagaccacguuucua

SEQ ID NO: 1530490 - RNA, 23 nt, Homo sapiens
caagcauuuugugaacuagggaa

SEQ ID NO: 1530491 - RNA, 17 nt, Homo sapiens
caagggcaucauccuca

SEQ ID NO: 1530492 - RNA, 17 nt, Homo sapiens
caaucagccacauucua

SEQ ID NO: 1530493 - RNA, 19 nt, Homo sapiens
caaugcuuaaacuaaauaa

SEQ ID NO: 1530494 - RNA, 16 nt, Homo sapiens
caauuauugauauaua

SEQ ID NO: 1530495 - RNA, 12 nt, Homo sapiens
caauucugugac

SEQ ID NO: 1530496 - RNA, 14 nt, Homo sapiens
cacaaaauucuuau

SEQ ID NO: 1530497 - RNA, 20 nt, Homo sapiens
cacacccuggaggauuucau

SEQ ID NO: 1530498 - RNA, 19 nt, Homo sapiens
cacaccugugccuccucag

SEQ ID NO: 1530499 - RNA, 14 nt, Homo sapiens
cacagaguuguuac

SEQ ID NO: 1530500 - RNA, 15 nt, Homo sapiens
cacauagcucaauca

SEQ ID NO: 1530501 - RNA, 22 nt, Homo sapiens
cacauaguagguacccaauuca

SEQ ID NO: 1530502 - RNA, 18 nt, Homo sapiens
cacaucagaagcaguaua

SEQ ID NO: 1530503 - RNA, 22 nt, Homo sapiens
caccauauuaccacagacauac

SEQ ID NO: 1530504 - RNA, 23 nt, Homo sapiens
cacccagcucagcauuuccacac

SEQ ID NO: 1530505 - RNA, 17 nt, Homo sapiens
cacccccaauuccuuga

SEQ ID NO: 1530506 - RNA, 21 nt, Homo sapiens
cacccuggaggauuucaucuc

SEQ ID NO: 1530507 - RNA, 16 nt, Homo sapiens
caccuacauuaucuca

SEQ ID NO: 1530508 - RNA, 17 nt, Homo sapiens
cacuaccguaaaugucc

SEQ ID NO: 1530509 - RNA, 12 nt, Homo sapiens
cacuagcccacu

SEQ ID NO: 1530510 - RNA, 17 nt, Homo sapiens
cacucagggagcauuua

SEQ ID NO: 1530511 - RNA, 24 nt, Homo sapiens
cacugcuuaacuucacauauugau

SEQ ID NO: 1530512 - RNA, 18 nt, Homo sapiens
cacugugggaaggccagc

SEQ ID NO: 1530513 - RNA, 16 nt, Homo sapiens
cacuuagacacuuuac

SEQ ID NO: 1530514 - RNA, 20 nt, Homo sapiens
cagaaagggacagggaaaua

SEQ ID NO: 1530515 - RNA, 19 nt, Homo sapiens
cagaaaugccuuacccuca

SEQ ID NO: 1530516 - RNA, 12 nt, Homo sapiens
cagaaccaaagc

SEQ ID NO: 1530517 - RNA, 16 nt, Homo sapiens
cagaaccaaagcucaa

SEQ ID NO: 1530518 - RNA, 14 nt, Homo sapiens
cagaauagcacaaa

SEQ ID NO: 1530519 - RNA, 22 nt, Homo sapiens
cagaccagcuggcgggugugga

SEQ ID NO: 1530520 - RNA, 20 nt, Homo sapiens
cagcagacacccuguguccu

SEQ ID NO: 1530521 - RNA, 17 nt, Homo sapiens
cagcauuuccacaccaa

SEQ ID NO: 1530522 - RNA, 18 nt, Homo sapiens
cagccaaacccugucuga

SEQ ID NO: 1530523 - RNA, 15 nt, Homo sapiens
cagccaacuuuugca

SEQ ID NO: 1530524 - RNA, 14 nt, Homo sapiens
cagcccaaccuuca

SEQ ID NO: 1530525 - RNA, 18 nt, Homo sapiens
cagcgucacucuaccuaa

SEQ ID NO: 1530526 - RNA, 14 nt, Homo sapiens
cagcuagugccuuu

SEQ ID NO: 1530527 - RNA, 14 nt, Homo sapiens
cagcugugcacuuu

SEQ ID NO: 1530528 - RNA, 15 nt, Homo sapiens
cagcugugcacuuuc

SEQ ID NO: 1530529 - RNA, 20 nt, Homo sapiens
caggacuuccauuugcuuug

SEQ ID NO: 1530530 - RNA, 14 nt, Homo sapiens
caggagccaugaca

SEQ ID NO: 1530531 - RNA, 19 nt, Homo sapiens
cagggaagcugucccucac

SEQ ID NO: 1530532 - RNA, 12 nt, Homo sapiens
cagggagcauuu

SEQ ID NO: 1530533 - RNA, 19 nt, Homo sapiens
cagguuccuuaucugucac

SEQ ID NO: 1530534 - RNA, 20 nt, Homo sapiens
cagguuccuuaucugucaca

SEQ ID NO: 1530535 - RNA, 21 nt, Homo sapiens
cagguuccuuaucugucacac

SEQ ID NO: 1530536 - RNA, 15 nt, Homo sapiens
caguaaccaugcccg

SEQ ID NO: 1530537 - RNA, 19 nt, Homo sapiens
gccucccacccccaucucu

SEQ ID NO: 1530538 - RNA, 20 nt, Homo sapiens
gccugaagauauuacuacuu

SEQ ID NO: 1530539 - RNA, 20 nt, Homo sapiens
gccuguaaucucagcacuuu

SEQ ID NO: 1530540 - RNA, 15 nt, Homo sapiens
gccuuuucacugugu

SEQ ID NO: 1530541 - RNA, 20 nt, Homo sapiens
gcgaaacccggugcaucugg

SEQ ID NO: 1530542 - RNA, 23 nt, Homo sapiens
gcgguuuauagguaaugauggaa

SEQ ID NO: 1530543 - RNA, 22 nt, Homo sapiens
gcguaagaugauggauuugauu

SEQ ID NO: 1530544 - RNA, 23 nt, Homo sapiens
gcuaaauaaauggguguauauaa

SEQ ID NO: 1530545 - RNA, 14 nt, Homo sapiens
gcuaugcauuugaa

SEQ ID NO: 1530546 - RNA, 16 nt, Homo sapiens
gcucauuuuugcuguu

SEQ ID NO: 1530547 - RNA, 11 nt, Homo sapiens
gcuccacugaa

SEQ ID NO: 1530548 - RNA, 17 nt, Homo sapiens
gcucccacacccaccuc

SEQ ID NO: 1530549 - RNA, 20 nt, Homo sapiens
gcucuuaugugugccuuugu

SEQ ID NO: 1530550 - RNA, 16 nt, Homo sapiens
gcuuaaaaucugugaa

SEQ ID NO: 1530551 - RNA, 17 nt, Homo sapiens
gcuuaaaaucugugaag

SEQ ID NO: 1530552 - RNA, 23 nt, Homo sapiens
gcuuaguccaauuccuugcacau

SEQ ID NO: 1530553 - RNA, 12 nt, Homo sapiens
gcuucgcuggaa

SEQ ID NO: 1530554 - RNA, 15 nt, Homo sapiens
gcuucuucacaggca

SEQ ID NO: 1530555 - RNA, 14 nt, Homo sapiens
gcuuuguugcccag

SEQ ID NO: 1530556 - RNA, 14 nt, Homo sapiens
ggaaacugcuaaau

SEQ ID NO: 1530557 - RNA, 23 nt, Homo sapiens
ggaacuuagacuccucuucccag

SEQ ID NO: 1530558 - RNA, 16 nt, Homo sapiens
ggaagcugucccucac

SEQ ID NO: 1530559 - RNA, 18 nt, Homo sapiens
ggaauauaucaguaccuc

SEQ ID NO: 1530560 - RNA, 20 nt, Homo sapiens
ggacaccacgauucucccaa

SEQ ID NO: 1530561 - RNA, 17 nt, Homo sapiens
ggacccuggaaauggac

SEQ ID NO: 1530562 - RNA, 16 nt, Homo sapiens
ggagacggaaucugcc

SEQ ID NO: 1530563 - RNA, 18 nt, Homo sapiens
ggagcugcuggguggcag

SEQ ID NO: 1530564 - RNA, 15 nt, Homo sapiens
ggaggccuaccucuc

SEQ ID NO: 1530565 - RNA, 16 nt, Homo sapiens
ggaguaggacauacca

SEQ ID NO: 1530566 - RNA, 13 nt, Homo sapiens
ggauccucuccuu

SEQ ID NO: 1530567 - RNA, 22 nt, Homo sapiens
ggaugauuauuuucuguucuau

SEQ ID NO: 1530568 - RNA, 21 nt, Homo sapiens
ggcacaagguugguugcuaag

SEQ ID NO: 1530569 - RNA, 20 nt, Homo sapiens
ggcacuccuggagauaugaa

SEQ ID NO: 1530570 - RNA, 16 nt, Homo sapiens
ggcagcuagugccuuu

SEQ ID NO: 1530571 - RNA, 17 nt, Homo sapiens
ggcccacuucaccguac

SEQ ID NO: 1530572 - RNA, 17 nt, Homo sapiens
ggcccuuucuugcacug

SEQ ID NO: 1530573 - RNA, 20 nt, Homo sapiens
ggcucccaagccacauucau

SEQ ID NO: 1530574 - RNA, 19 nt, Homo sapiens
ggcuggaguggaguggcgu

SEQ ID NO: 1530575 - RNA, 22 nt, Homo sapiens
gggaagcucccacacccaccuc

SEQ ID NO: 1530576 - RNA, 19 nt, Homo sapiens
gggaauacaucuguggaca

SEQ ID NO: 1530577 - RNA, 16 nt, Homo sapiens
gggagacugccagugg

SEQ ID NO: 1530578 - RNA, 22 nt, Homo sapiens
gggcagagccuuccacagugaa

SEQ ID NO: 1530579 - RNA, 15 nt, Homo sapiens
gggcuuaccagguga

SEQ ID NO: 1530580 - RNA, 19 nt, Homo sapiens
gggucucgcuuuguugccc

SEQ ID NO: 1530581 - RNA, 21 nt, Homo sapiens
gggucucgcuuuguugcccag

SEQ ID NO: 1530582 - RNA, 21 nt, Homo sapiens
ggguuaguuuacaaucagcca

SEQ ID NO: 1530583 - RNA, 16 nt, Homo sapiens
gguaacaguggcugcu

SEQ ID NO: 1530584 - RNA, 15 nt, Homo sapiens
ggucauccaaacuca

SEQ ID NO: 1530585 - RNA, 16 nt, Homo sapiens
gguccuacuccuggag

SEQ ID NO: 1530586 - RNA, 18 nt, Homo sapiens
gguuauucuaagcccuuu

SEQ ID NO: 1530587 - RNA, 21 nt, Homo sapiens
guaaaugggggugcauuugag

SEQ ID NO: 1530588 - RNA, 19 nt, Homo sapiens
guaauuuauuaacuaauca

SEQ ID NO: 1530589 - RNA, 20 nt, Homo sapiens
guaauuugugauacaaugcu

SEQ ID NO: 1530590 - RNA, 20 nt, Homo sapiens
guacgauggaggccuaccuc

SEQ ID NO: 1530591 - RNA, 22 nt, Homo sapiens
guacgauggaggccuaccucuc

SEQ ID NO: 1530592 - RNA, 14 nt, Homo sapiens
guacuuauguugca

SEQ ID NO: 1530593 - RNA, 23 nt, Homo sapiens
guacuuauguugcacaaugagaa

SEQ ID NO: 1530594 - RNA, 22 nt, Homo sapiens
guagccuuagagcaucucugcc

SEQ ID NO: 1530595 - RNA, 15 nt, Homo sapiens
guaugaggcauuugu

SEQ ID NO: 1530596 - RNA, 22 nt, Homo sapiens
guauuauuuuacaaucaacaaa

SEQ ID NO: 1530597 - RNA, 19 nt, Homo sapiens
guauugacuguaccacaga

SEQ ID NO: 1530598 - RNA, 17 nt, Homo sapiens
guauuuuuauccaugac

SEQ ID NO: 1530599 - RNA, 22 nt, Homo sapiens
gucauccaaacucaaacuugag

SEQ ID NO: 1530600 - RNA, 14 nt, Homo sapiens
guccaacucuucca

SEQ ID NO: 1530601 - RNA, 18 nt, Homo sapiens
guccaacucuuccaccuc

SEQ ID NO: 1530602 - RNA, 13 nt, Homo sapiens
guccacacccagc

SEQ ID NO: 1530603 - RNA, 17 nt, Homo sapiens
gucccaaugguccugac

SEQ ID NO: 1530604 - RNA, 16 nt, Homo sapiens
gucgacuucaugacaa

SEQ ID NO: 1530605 - RNA, 20 nt, Homo sapiens
gucuugcaacuucaguuuua

SEQ ID NO: 1530606 - RNA, 14 nt, Homo sapiens
gucuuugaacccuu

SEQ ID NO: 1530607 - RNA, 17 nt, Homo sapiens
gugaaccuuaguaccua

SEQ ID NO: 1530608 - RNA, 20 nt, Homo sapiens
gugaagaugguuucaauuca

SEQ ID NO: 1530609 - RNA, 17 nt, Homo sapiens
gugcagcgggugcugcu

SEQ ID NO: 1530610 - RNA, 17 nt, Homo sapiens
gugcaucuggcacgugg

SEQ ID NO: 1530611 - RNA, 19 nt, Homo sapiens
gugccuccucagaggacag

SEQ ID NO: 1530612 - RNA, 14 nt, Homo sapiens
guggaugacuguug

SEQ ID NO: 1530613 - RNA, 19 nt, Homo sapiens
guggcugcaccacuuccag

SEQ ID NO: 1530614 - RNA, 17 nt, Homo sapiens
gugggcagagccuucca

SEQ ID NO: 1530615 - RNA, 19 nt, Homo sapiens
gugucauuggggggaccgu

SEQ ID NO: 1530616 - RNA, 12 nt, Homo sapiens
gugucugucagc

SEQ ID NO: 1530617 - RNA, 17 nt, Homo sapiens
guguguucuauccaaac

SEQ ID NO: 1530618 - RNA, 17 nt, Homo sapiens
guuccgcccgcccuccc

SEQ ID NO: 1530619 - RNA, 15 nt, Homo sapiens
guugaggcugucaca

SEQ ID NO: 1530620 - RNA, 17 nt, Homo sapiens
guuucaacugugcucuu

SEQ ID NO: 1530621 - RNA, 18 nt, Homo sapiens
guuuccaugguuaccuga

SEQ ID NO: 1530622 - RNA, 21 nt, Homo sapiens
guuucccaucagacugucaag

SEQ ID NO: 1530623 - RNA, 21 nt, Homo sapiens
guuucuugacaauggggucag

SEQ ID NO: 1530624 - RNA, 15 nt, Homo sapiens
guuuugagaccagaa

SEQ ID NO: 1530625 - RNA, 20 nt, Homo sapiens
uaaaacuaaauguaauuuau

SEQ ID NO: 1530626 - RNA, 16 nt, Homo sapiens
uaaaacuaagcacaaa

SEQ ID NO: 1530627 - RNA, 19 nt, Homo sapiens
uaaaauaauuuucauucau

SEQ ID NO: 1530628 - RNA, 15 nt, Homo sapiens
uaaauaaaacugaau

SEQ ID NO: 1530629 - RNA, 20 nt, Homo sapiens
uaaauaaugaauaaacugaa

SEQ ID NO: 1530630 - RNA, 21 nt, Homo sapiens
uaaauaaugaauaaacugaau

SEQ ID NO: 1530631 - RNA, 17 nt, Homo sapiens
uaaaugggggugcauuu

SEQ ID NO: 1530632 - RNA, 19 nt, Homo sapiens
uaaaugggggugcauuuga

SEQ ID NO: 1530633 - RNA, 21 nt, Homo sapiens
uaaucaagaaaaacaucuuug

SEQ ID NO: 1530634 - RNA, 14 nt, Homo sapiens
uaaucucagcacuu

SEQ ID NO: 1530635 - RNA, 22 nt, Homo sapiens
uaaugaaauaauguacaucugg

SEQ ID NO: 1530636 - RNA, 14 nt, Homo sapiens
uaauguacaucugg

SEQ ID NO: 1530637 - RNA, 14 nt, Homo sapiens
uaaugucucacugu

SEQ ID NO: 1530638 - RNA, 19 nt, Homo sapiens
uacaaucagccacauucua

SEQ ID NO: 1530639 - RNA, 13 nt, Homo sapiens
uacauauuaucuc

SEQ ID NO: 1530640 - RNA, 14 nt, Homo sapiens
uaccucuucaguau

SEQ ID NO: 1530641 - RNA, 15 nt, Homo sapiens
uaccuugaacucuua

SEQ ID NO: 1530642 - RNA, 13 nt, Homo sapiens
uacguugugcauu

SEQ ID NO: 1530643 - RNA, 17 nt, Homo sapiens
uacugucuguuaugauu

SEQ ID NO: 1530644 - RNA, 21 nt, Homo sapiens
uacuuauguugcacaaugaga

SEQ ID NO: 1530645 - RNA, 23 nt, Homo sapiens
uagaaaaggguuucuugacaaug

SEQ ID NO: 1530646 - RNA, 16 nt, Homo sapiens
uagacuccucuuccca

SEQ ID NO: 1530647 - RNA, 22 nt, Homo sapiens
uagagauggggucucacagugu

SEQ ID NO: 1530648 - RNA, 21 nt, Homo sapiens
uagcaaauggcagaaccaaag

SEQ ID NO: 1530649 - RNA, 18 nt, Homo sapiens
uagccagcugugcacuuu

SEQ ID NO: 1530650 - RNA, 19 nt, Homo sapiens
uagccagcugugcacuuuc

SEQ ID NO: 1530651 - RNA, 13 nt, Homo sapiens
aaaaaauacauua

SEQ ID NO: 1530652 - RNA, 16 nt, Homo sapiens
aaaaaggaugcacaga

SEQ ID NO: 1530653 - RNA, 15 nt, Homo sapiens
aaaacuaagcacaaa

SEQ ID NO: 1530654 - RNA, 18 nt, Homo sapiens
aaaaggcuuugggccugg

SEQ ID NO: 1530655 - RNA, 23 nt, Homo sapiens
aaaaggguuucuugacaaugggg

SEQ ID NO: 1530656 - RNA, 18 nt, Homo sapiens
aaaagucguuuuccaaac

SEQ ID NO: 1530657 - RNA, 19 nt, Homo sapiens
aaaaguugguguugacaua

SEQ ID NO: 1530658 - RNA, 21 nt, Homo sapiens
aaaaguugguguugacauaca

SEQ ID NO: 1530659 - RNA, 18 nt, Homo sapiens
aaacuccugggcucaggc

SEQ ID NO: 1530660 - RNA, 12 nt, Homo sapiens
aaacuucaccua

SEQ ID NO: 1530661 - RNA, 21 nt, Homo sapiens
aaacuucaccuacauuaucuc

SEQ ID NO: 1530662 - RNA, 21 nt, Homo sapiens
aaaggaaaaccaucucuguga

SEQ ID NO: 1530663 - RNA, 19 nt, Homo sapiens
aaaguaaguuaauaaugua

SEQ ID NO: 1530664 - RNA, 16 nt, Homo sapiens
aaagucguuuuccaaa

SEQ ID NO: 1530665 - RNA, 17 nt, Homo sapiens
aaaguuuuuaauuugau

SEQ ID NO: 1530666 - RNA, 15 nt, Homo sapiens
aaauaccagccagua

SEQ ID NO: 1530667 - RNA, 23 nt, Homo sapiens
aaauagagcuuuuaaaaaugucc

SEQ ID NO: 1530668 - RNA, 17 nt, Homo sapiens
aaauaucuugcuuucaa

SEQ ID NO: 1530669 - RNA, 16 nt, Homo sapiens
aaaucuuuuguuuuaa

SEQ ID NO: 1530670 - RNA, 13 nt, Homo sapiens
aaaugacauuaaa

SEQ ID NO: 1530671 - RNA, 15 nt, Homo sapiens
aaauggcagaaccaa

SEQ ID NO: 1530672 - RNA, 18 nt, Homo sapiens
aaaugggggugcauuuga

SEQ ID NO: 1530673 - RNA, 18 nt, Homo sapiens
aaaugugagggugguggg

SEQ ID NO: 1530674 - RNA, 22 nt, Homo sapiens
aaauuauugacgcuuaaccuuu

SEQ ID NO: 1530675 - RNA, 14 nt, Homo sapiens
aacaaacauuguuu

SEQ ID NO: 1530676 - RNA, 20 nt, Homo sapiens
aacaaagugaaggacauaga

SEQ ID NO: 1530677 - RNA, 23 nt, Homo sapiens
aacaauuuuuuuuuuccucuuca

SEQ ID NO: 1530678 - RNA, 18 nt, Homo sapiens
aacaccgcuucugccuuu

SEQ ID NO: 1530679 - RNA, 15 nt, Homo sapiens
aacaucgauauguau

SEQ ID NO: 1530680 - RNA, 16 nt, Homo sapiens
aacauguauguauaca

SEQ ID NO: 1530681 - RNA, 22 nt, Homo sapiens
aaccaucucugugauuaccucu

SEQ ID NO: 1530682 - RNA, 15 nt, Homo sapiens
aacccagcaguucuc

SEQ ID NO: 1530683 - RNA, 17 nt, Homo sapiens
aacccagcaguucucug

SEQ ID NO: 1530684 - RNA, 20 nt, Homo sapiens
aacccagcaguucucugcca

SEQ ID NO: 1530685 - RNA, 18 nt, Homo sapiens
aacccggugcaucuggca

SEQ ID NO: 1530686 - RNA, 19 nt, Homo sapiens
aacccggugcaucuggcac

SEQ ID NO: 1530687 - RNA, 23 nt, Homo sapiens
aacugguauuguuuacguuugau

SEQ ID NO: 1530688 - RNA, 16 nt, Homo sapiens
aacuuagacuccucuu

SEQ ID NO: 1530689 - RNA, 21 nt, Homo sapiens
aacuucaccuacauuaucuca

SEQ ID NO: 1530690 - RNA, 14 nt, Homo sapiens
aacuugacccccuu

SEQ ID NO: 1530691 - RNA, 22 nt, Homo sapiens
aacuuuuauaaacuuuaccuuu

SEQ ID NO: 1530692 - RNA, 12 nt, Homo sapiens
aagaaccagaga

SEQ ID NO: 1530693 - RNA, 15 nt, Homo sapiens
aagacauacugcuug

SEQ ID NO: 1530694 - RNA, 21 nt, Homo sapiens
aagacugaguacguugugcau

SEQ ID NO: 1530695 - RNA, 20 nt, Homo sapiens
aagacuggaauauaauuuca

SEQ ID NO: 1530696 - RNA, 14 nt, Homo sapiens
aagaggaaagggag

SEQ ID NO: 1530697 - RNA, 19 nt, Homo sapiens
aagaugauuuaaguauaca

SEQ ID NO: 1530698 - RNA, 15 nt, Homo sapiens
aagcacaaagccauu

SEQ ID NO: 1530699 - RNA, 13 nt, Homo sapiens
aagcacaucugca

SEQ ID NO: 1530700 - RNA, 12 nt, Homo sapiens
aagccugucauu

SEQ ID NO: 1530701 - RNA, 21 nt, Homo sapiens
aagcugucccucacuguugaa

SEQ ID NO: 1530702 - RNA, 18 nt, Homo sapiens
aaggcccauaucugugaa

SEQ ID NO: 1530703 - RNA, 20 nt, Homo sapiens
aaguuaauucaccuauguua

SEQ ID NO: 1530704 - RNA, 16 nt, Homo sapiens
aauaauguacaucugg

SEQ ID NO: 1530705 - RNA, 18 nt, Homo sapiens
aauacaccacuacauucu

SEQ ID NO: 1530706 - RNA, 19 nt, Homo sapiens
aauauauauaaagaauaua

SEQ ID NO: 1530707 - RNA, 20 nt, Homo sapiens
aauauauauggucauauaca

SEQ ID NO: 1530708 - RNA, 17 nt, Homo sapiens
aauaucuugcuuucaaa

SEQ ID NO: 1530709 - RNA, 15 nt, Homo sapiens
aaucagccacauucu

SEQ ID NO: 1530710 - RNA, 23 nt, Homo sapiens
aauccagucccaaugguccugac

SEQ ID NO: 1530711 - RNA, 20 nt, Homo sapiens
aaucuaaauggaaccacucu

SEQ ID NO: 1530712 - RNA, 17 nt, Homo sapiens
aaugcuggcauuugcac

SEQ ID NO: 1530713 - RNA, 13 nt, Homo sapiens
aauguccauuuau

SEQ ID NO: 1530714 - RNA, 16 nt, Homo sapiens
aauuaugcacuaaaua

SEQ ID NO: 1530715 - RNA, 20 nt, Homo sapiens
aauucacagaauagcacaaa

SEQ ID NO: 1530716 - RNA, 21 nt, Homo sapiens
ccuagcugguagcauaaauaa

SEQ ID NO: 1530717 - RNA, 17 nt, Homo sapiens
ccuaguggaugacuguu

SEQ ID NO: 1530718 - RNA, 19 nt, Homo sapiens
ccuauuuuuguaaacugga

SEQ ID NO: 1530719 - RNA, 20 nt, Homo sapiens
ccucaaaucacugcauucau

SEQ ID NO: 1530720 - RNA, 23 nt, Homo sapiens
ccucacagagugcauugugaggg

SEQ ID NO: 1530721 - RNA, 16 nt, Homo sapiens
ccucagaggacaguuu

SEQ ID NO: 1530722 - RNA, 16 nt, Homo sapiens
ccucucccuaggagaa

SEQ ID NO: 1530723 - RNA, 17 nt, Homo sapiens
ccugauccauagugcua

SEQ ID NO: 1530724 - RNA, 22 nt, Homo sapiens
ccugccuuuuaacguagauaua

SEQ ID NO: 1530725 - RNA, 21 nt, Homo sapiens
ccugcugggugccaggugcug

SEQ ID NO: 1530726 - RNA, 20 nt, Homo sapiens
ccuggaaacagcaguguaua

SEQ ID NO: 1530727 - RNA, 17 nt, Homo sapiens
ccuguaaucucagcacu

SEQ ID NO: 1530728 - RNA, 13 nt, Homo sapiens
ccuuagagcaucu

SEQ ID NO: 1530729 - RNA, 14 nt, Homo sapiens
ccuuccacagugaa

SEQ ID NO: 1530730 - RNA, 16 nt, Homo sapiens
ccuuccucucaggcuc

SEQ ID NO: 1530731 - RNA, 13 nt, Homo sapiens
ccuuuccauuuau

SEQ ID NO: 1530732 - RNA, 14 nt, Homo sapiens
ccuuucuugcacug

SEQ ID NO: 1530733 - RNA, 18 nt, Homo sapiens
ccuuuucuauuuaccucc

SEQ ID NO: 1530734 - RNA, 19 nt, Homo sapiens
cgaaacccggugcaucugg

SEQ ID NO: 1530735 - RNA, 19 nt, Homo sapiens
cgauggaggccuaccucuc

SEQ ID NO: 1530736 - RNA, 16 nt, Homo sapiens
cgauugaaagaaccag

SEQ ID NO: 1530737 - RNA, 19 nt, Homo sapiens
cgauugaaagaaccagaga

SEQ ID NO: 1530738 - RNA, 23 nt, Homo sapiens
cgcacauagcucaaucacacugg

SEQ ID NO: 1530739 - RNA, 21 nt, Homo sapiens
cgcccagguccccgcuuucuu

SEQ ID NO: 1530740 - RNA, 15 nt, Homo sapiens
cgcuuuguugcccag

SEQ ID NO: 1530741 - RNA, 18 nt, Homo sapiens
cggaagcugucgacuuca

SEQ ID NO: 1530742 - RNA, 18 nt, Homo sapiens
cggaaggucccucagaca

SEQ ID NO: 1530743 - RNA, 16 nt, Homo sapiens
cgggcuuaccagguga

SEQ ID NO: 1530744 - RNA, 15 nt, Homo sapiens
cgguggcucaugccu

SEQ ID NO: 1530745 - RNA, 23 nt, Homo sapiens
cgguggcucccaagccacauuca

SEQ ID NO: 1530746 - RNA, 19 nt, Homo sapiens
cuacagggccacaacugcc

SEQ ID NO: 1530747 - RNA, 21 nt, Homo sapiens
cuacccuuuuccuuugugguu

SEQ ID NO: 1530748 - RNA, 15 nt, Homo sapiens
cuaccguaaaugucc

SEQ ID NO: 1530749 - RNA, 21 nt, Homo sapiens
cuacuccuggagcacuguaaa

SEQ ID NO: 1530750 - RNA, 16 nt, Homo sapiens
cuagaaagacagaagc

SEQ ID NO: 1530751 - RNA, 19 nt, Homo sapiens
cuagcagaggaaaguguaa

SEQ ID NO: 1530752 - RNA, 23 nt, Homo sapiens
cuagggcccuuucuugcacuguc

SEQ ID NO: 1530753 - RNA, 19 nt, Homo sapiens
cuaguaaguaauuaugcac

SEQ ID NO: 1530754 - RNA, 20 nt, Homo sapiens
cuaucauaauucagcacuua

SEQ ID NO: 1530755 - RNA, 13 nt, Homo sapiens
cuauuuauuugac

SEQ ID NO: 1530756 - RNA, 14 nt, Homo sapiens
cucacagagugcau

SEQ ID NO: 1530757 - RNA, 19 nt, Homo sapiens
cucacagagugcauuguga

SEQ ID NO: 1530758 - RNA, 21 nt, Homo sapiens
cucacagagugcauugugagg

SEQ ID NO: 1530759 - RNA, 19 nt, Homo sapiens
cucacgcccuaagcgcaca

SEQ ID NO: 1530760 - RNA, 17 nt, Homo sapiens
cucacuguugaauuuuc

SEQ ID NO: 1530761 - RNA, 16 nt, Homo sapiens
cucacuuaguccuuua

SEQ ID NO: 1530762 - RNA, 21 nt, Homo sapiens
cucaugccacagugguacucu

SEQ ID NO: 1530763 - RNA, 23 nt, Homo sapiens
cucauguuguugaggcugucaca

SEQ ID NO: 1530764 - RNA, 18 nt, Homo sapiens
cuccagugcuguccaugc

SEQ ID NO: 1530765 - RNA, 22 nt, Homo sapiens
cuccauaucccuuccucucagg

SEQ ID NO: 1530766 - RNA, 10 nt, Homo sapiens
cuccaugcac

SEQ ID NO: 1530767 - RNA, 15 nt, Homo sapiens
cucccaaaacagccu

SEQ ID NO: 1530768 - RNA, 15 nt, Homo sapiens
cucccaaaguaccuu

SEQ ID NO: 1530769 - RNA, 13 nt, Homo sapiens
cuccgaggccagu

SEQ ID NO: 1530770 - RNA, 14 nt, Homo sapiens
cuccgaggccagua

SEQ ID NO: 1530771 - RNA, 15 nt, Homo sapiens
cuccucccugucaua

SEQ ID NO: 1530772 - RNA, 19 nt, Homo sapiens
cuccuggcccuucuauuua

SEQ ID NO: 1530773 - RNA, 21 nt, Homo sapiens
cuccuuccuacccuccugcac

SEQ ID NO: 1530774 - RNA, 21 nt, Homo sapiens
uaggcucuuaugugugccuuu

SEQ ID NO: 1530775 - RNA, 17 nt, Homo sapiens
uaguaugaggcauuugu

SEQ ID NO: 1530776 - RNA, 19 nt, Homo sapiens
uaguauuuuuauccaugac

SEQ ID NO: 1530777 - RNA, 14 nt, Homo sapiens
uaguggugugauuu

SEQ ID NO: 1530778 - RNA, 23 nt, Homo sapiens
uauaauuucaaaccacacauuag

SEQ ID NO: 1530779 - RNA, 16 nt, Homo sapiens
uauacaugaccuuaau

SEQ ID NO: 1530780 - RNA, 23 nt, Homo sapiens
uauaguauuuaacgaagccuaga

SEQ ID NO: 1530781 - RNA, 22 nt, Homo sapiens
uauauaauuuuaugguggaaaa

SEQ ID NO: 1530782 - RNA, 18 nt, Homo sapiens
uaucauaauucagcacuu

SEQ ID NO: 1530783 - RNA, 17 nt, Homo sapiens
uaugaaggaaucauucc

SEQ ID NO: 1530784 - RNA, 14 nt, Homo sapiens
uaugaggcauuugu

SEQ ID NO: 1530785 - RNA, 16 nt, Homo sapiens
uauuuuuauccaugac

SEQ ID NO: 1530786 - RNA, 12 nt, Homo sapiens
uauuuuugccaa

SEQ ID NO: 1530787 - RNA, 20 nt, Homo sapiens
uauuuuuuaaaacacuaaaa

SEQ ID NO: 1530788 - RNA, 21 nt, Homo sapiens
ucaaaaguugguguugacaua

SEQ ID NO: 1530789 - RNA, 20 nt, Homo sapiens
ucaaaguguaaacaccauag

SEQ ID NO: 1530790 - RNA, 18 nt, Homo sapiens
ucaaauuuuaucaugcca

SEQ ID NO: 1530791 - RNA, 19 nt, Homo sapiens
ucaacaucuuuuacauucu

SEQ ID NO: 1530792 - RNA, 20 nt, Homo sapiens
ucaagaccagccugggcaac

SEQ ID NO: 1530793 - RNA, 14 nt, Homo sapiens
ucaaucucuguugc

SEQ ID NO: 1530794 - RNA, 17 nt, Homo sapiens
ucacaaguagccucugg

SEQ ID NO: 1530795 - RNA, 17 nt, Homo sapiens
ucacagaauagcacaaa

SEQ ID NO: 1530796 - RNA, 15 nt, Homo sapiens
ucacagagugcauug

SEQ ID NO: 1530797 - RNA, 16 nt, Homo sapiens
ucacagagugcauugu

SEQ ID NO: 1530798 - RNA, 23 nt, Homo sapiens
ucaccuauguuauuuuguguaca

SEQ ID NO: 1530799 - RNA, 19 nt, Homo sapiens
ucagaagcaguauauucua

SEQ ID NO: 1530800 - RNA, 14 nt, Homo sapiens
ucagccacauucua

SEQ ID NO: 1530801 - RNA, 12 nt, Homo sapiens
ucagcccagaag

SEQ ID NO: 1530802 - RNA, 20 nt, Homo sapiens
ucauaauucagcacuuaacu

SEQ ID NO: 1530803 - RNA, 20 nt, Homo sapiens
ucauacaaagcgugcacaag

SEQ ID NO: 1530804 - RNA, 13 nt, Homo sapiens
ucauguauguuau

SEQ ID NO: 1530805 - RNA, 14 nt, Homo sapiens
ucauucauucacuc

SEQ ID NO: 1530806 - RNA, 19 nt, Homo sapiens
ucauuuuacacaaagggaa

SEQ ID NO: 1530807 - RNA, 20 nt, Homo sapiens
uccaacucuuccaccucugg

SEQ ID NO: 1530808 - RNA, 19 nt, Homo sapiens
uccacucccaagccacuag

SEQ ID NO: 1530809 - RNA, 23 nt, Homo sapiens
uccagcuggaagggucaacaucu

SEQ ID NO: 1530810 - RNA, 18 nt, Homo sapiens
ucccacccccaucucucc

SEQ ID NO: 1530811 - RNA, 16 nt, Homo sapiens
uccccacccccaauuc

SEQ ID NO: 1530812 - RNA, 13 nt, Homo sapiens
uccccagucccag

SEQ ID NO: 1530813 - RNA, 16 nt, Homo sapiens
uccccagucccagaca

SEQ ID NO: 1530814 - RNA, 15 nt, Homo sapiens
ucccuggugcccuuc

SEQ ID NO: 1530815 - RNA, 21 nt, Homo sapiens
uccggaagcugucgacuucau

SEQ ID NO: 1530816 - RNA, 16 nt, Homo sapiens
uccucccugucauaga

SEQ ID NO: 1530817 - RNA, 19 nt, Homo sapiens
uccugaccccgccaugcau

SEQ ID NO: 1530818 - RNA, 22 nt, Homo sapiens
uccugcgaaggcugggcacugc

SEQ ID NO: 1530819 - RNA, 20 nt, Homo sapiens
ucgcccuccucccugucaua

SEQ ID NO: 1530820 - RNA, 16 nt, Homo sapiens
ucgguggcucaugccu

SEQ ID NO: 1530821 - RNA, 13 nt, Homo sapiens
ucuagaacuugac

SEQ ID NO: 1530822 - RNA, 22 nt, Homo sapiens
ucuagguaggggcccacuucac

SEQ ID NO: 1530823 - RNA, 22 nt, Homo sapiens
gaagucgggcaugguggcucau

SEQ ID NO: 1530824 - RNA, 12 nt, Homo sapiens
gaagucuugggu

SEQ ID NO: 1530825 - RNA, 12 nt, Homo sapiens
gaauagcacaaa

SEQ ID NO: 1530826 - RNA, 14 nt, Homo sapiens
gaauauuacuccua

SEQ ID NO: 1530827 - RNA, 21 nt, Homo sapiens
gaauuaagaauugguugccau

SEQ ID NO: 1530828 - RNA, 18 nt, Homo sapiens
gacauacauauuaucuca

SEQ ID NO: 1530829 - RNA, 19 nt, Homo sapiens
gacauacauauuaucucau

SEQ ID NO: 1530830 - RNA, 15 nt, Homo sapiens
gaccgucuuuacccc

SEQ ID NO: 1530831 - RNA, 21 nt, Homo sapiens
gacuacuuggaacuaggcucu

SEQ ID NO: 1530832 - RNA, 12 nt, Homo sapiens
gagacagaauag

SEQ ID NO: 1530833 - RNA, 18 nt, Homo sapiens
gagacucgcucacuccca

SEQ ID NO: 1530834 - RNA, 23 nt, Homo sapiens
gagcaucucugccuccaacccag

SEQ ID NO: 1530835 - RNA, 13 nt, Homo sapiens
gagcccugucccu

SEQ ID NO: 1530836 - RNA, 15 nt, Homo sapiens
gagcugcagguuccu

SEQ ID NO: 1530837 - RNA, 14 nt, Homo sapiens
gaggaaaccuagca

SEQ ID NO: 1530838 - RNA, 16 nt, Homo sapiens
gaggauuucaucucuu

SEQ ID NO: 1530839 - RNA, 13 nt, Homo sapiens
gaggccuaccucu

SEQ ID NO: 1530840 - RNA, 21 nt, Homo sapiens
gaggguuuccuucggggacca

SEQ ID NO: 1530841 - RNA, 17 nt, Homo sapiens
gauauugauuacuauca

SEQ ID NO: 1530842 - RNA, 18 nt, Homo sapiens
gaucucgggacucagauu

SEQ ID NO: 1530843 - RNA, 20 nt, Homo sapiens
gauggagcaggucuuuggga

SEQ ID NO: 1530844 - RNA, 23 nt, Homo sapiens
gauuauugcuucuuuccuugcau

SEQ ID NO: 1530845 - RNA, 20 nt, Homo sapiens
gcaaaguaucccuacuguaa

SEQ ID NO: 1530846 - RNA, 23 nt, Homo sapiens
gcaaauccagucccaaugguccu

SEQ ID NO: 1530847 - RNA, 22 nt, Homo sapiens
gcacaucugcauuuucacccca

SEQ ID NO: 1530848 - RNA, 20 nt, Homo sapiens
gcagcgucacucuaccuaau

SEQ ID NO: 1530849 - RNA, 17 nt, Homo sapiens
gcaggaagauagcuuga

SEQ ID NO: 1530850 - RNA, 20 nt, Homo sapiens
gcagguuccuuaucugucac

SEQ ID NO: 1530851 - RNA, 19 nt, Homo sapiens
gcaguucucugccaaagcu

SEQ ID NO: 1530852 - RNA, 15 nt, Homo sapiens
gcauguuugugauug

SEQ ID NO: 1530853 - RNA, 21 nt, Homo sapiens
gccaacacacguccacuccca

SEQ ID NO: 1530854 - RNA, 16 nt, Homo sapiens
gccacuuagacacuuu

SEQ ID NO: 1530855 - RNA, 22 nt, Homo sapiens
gccacuuagacacuuuaccucu

SEQ ID NO: 1530856 - RNA, 17 nt, Homo sapiens
gccaggauccucuccuu

SEQ ID NO: 1530857 - RNA, 22 nt, Homo sapiens
gccaguaaaugggggugcauuu

SEQ ID NO: 1530858 - RNA, 22 nt, Homo sapiens
gccauaaaaauaaaucaguuca

SEQ ID NO: 1530859 - RNA, 22 nt, Homo sapiens
gcccacuucaccguacuaacca

SEQ ID NO: 1530860 - RNA, 17 nt, Homo sapiens
gcccuccucccugucau

SEQ ID NO: 1530861 - RNA, 19 nt, Homo sapiens
gcccuuaccccacacacag

SEQ ID NO: 1530862 - RNA, 16 nt, Homo sapiens
gccguccggcggcccc

SEQ ID NO: 1530863 - RNA, 18 nt, Homo sapiens
gccucgcagccuccggaa

SEQ ID NO: 1530864 - RNA, 16 nt, Homo sapiens
gccucugggaucugcc

SEQ ID NO: 1530865 - RNA, 18 nt, Homo sapiens
gccucugggaucugccaa

SEQ ID NO: 1530866 - RNA, 13 nt, Homo sapiens
gccucuuggcagu

SEQ ID NO: 1530867 - RNA, 13 nt, Homo sapiens
gccugguguggug

SEQ ID NO: 1530868 - RNA, 14 nt, Homo sapiens
gccuguugaaucug

SEQ ID NO: 1530869 - RNA, 16 nt, Homo sapiens
gccuugaaaccaccuu

SEQ ID NO: 1530870 - RNA, 16 nt, Homo sapiens
gcuaaauucuauguua

SEQ ID NO: 1530871 - RNA, 18 nt, Homo sapiens
gcuacccuuuuccuuugu

SEQ ID NO: 1530872 - RNA, 16 nt, Homo sapiens
gcuaccugcaccucug

SEQ ID NO: 1530873 - RNA, 18 nt, Homo sapiens
gcuagagcugacagcuuu

SEQ ID NO: 1530874 - RNA, 13 nt, Homo sapiens
gcuaugcauuuga

SEQ ID NO: 1530875 - RNA, 18 nt, Homo sapiens
gcuauuuuacauauccca

SEQ ID NO: 1530876 - RNA, 19 nt, Homo sapiens
gcucccacacccaccucug

SEQ ID NO: 1530877 - RNA, 20 nt, Homo sapiens
gcuccugaccccgccaugca

SEQ ID NO: 1530878 - RNA, 15 nt, Homo sapiens
gcucgagcaguccug

SEQ ID NO: 1530879 - RNA, 17 nt, Homo sapiens
gcucguuuggcuuuaua

SEQ ID NO: 1530880 - RNA, 21 nt, Homo sapiens
gcucuagggcccuuucuugca

SEQ ID NO: 1530881 - RNA, 19 nt, Homo sapiens
gcucugagaaaccucggga

SEQ ID NO: 1530882 - RNA, 20 nt, Homo sapiens
gcucugagaaaccucgggaa

SEQ ID NO: 1530883 - RNA, 18 nt, Homo sapiens
gcucuuaugugugccuuu

SEQ ID NO: 1530884 - RNA, 22 nt, Homo sapiens
gcugcagguuccuuaucuguca

SEQ ID NO: 1530885 - RNA, 15 nt, Homo sapiens
gcuggcccagccaaa

SEQ ID NO: 1530886 - RNA, 15 nt, Homo sapiens
gcugguggugcugca

SEQ ID NO: 1530887 - RNA, 16 nt, Homo sapiens
gcugucgacuucauga

SEQ ID NO: 1530888 - RNA, 14 nt, Homo sapiens
gcuguuccugagaa

SEQ ID NO: 1530889 - RNA, 22 nt, Homo sapiens
gcuuaguccaauuccuugcaca

SEQ ID NO: 1530890 - RNA, 19 nt, Homo sapiens
gcuucaguugcauaucuua

SEQ ID NO: 1530891 - RNA, 18 nt, Homo sapiens
ggacaagggccugggauu

SEQ ID NO: 1530892 - RNA, 22 nt, Homo sapiens
ggacgcugccgggagacugcca

SEQ ID NO: 1530893 - RNA, 18 nt, Homo sapiens
ggacucuuccgaagggau

SEQ ID NO: 1530894 - RNA, 15 nt, Homo sapiens
ggacuuccauuugcu

SEQ ID NO: 1530895 - RNA, 18 nt, Homo sapiens
ggagaacucagugccaca

SEQ ID NO: 1530896 - RNA, 15 nt, Homo sapiens
ggagccccgccaggu

SEQ ID NO: 1530897 - RNA, 21 nt, Homo sapiens
ggaggacccuggaaauggacu

SEQ ID NO: 1530898 - RNA, 21 nt, Homo sapiens
ggaguuuucuggagugagcac

SEQ ID NO: 1530899 - RNA, 19 nt, Homo sapiens
ggaugugaggcacuguggg

SEQ ID NO: 1530900 - RNA, 18 nt, Homo sapiens
ggcacucagggagcauuu

SEQ ID NO: 1530901 - RNA, 16 nt, Homo sapiens
ggcaggcuacucugcc

SEQ ID NO: 1530902 - RNA, 17 nt, Homo sapiens
ggcaggugccuguugaa

SEQ ID NO: 1530903 - RNA, 19 nt, Homo sapiens
ggcauucucgguacuucug

SEQ ID NO: 1530904 - RNA, 16 nt, Homo sapiens
ggcccauaucugugaa

SEQ ID NO: 1530905 - RNA, 18 nt, Homo sapiens
ggcccgcaagagggacag

SEQ ID NO: 1530906 - RNA, 15 nt, Homo sapiens
ggccuccaugcacuu

SEQ ID NO: 1530907 - RNA, 15 nt, Homo sapiens
ggccugcacuggugu

SEQ ID NO: 1530908 - RNA, 12 nt, Homo sapiens
ggcgugaucuug

SEQ ID NO: 1530909 - RNA, 20 nt, Homo sapiens
ggcuacucugcccaccccag

SEQ ID NO: 1530910 - RNA, 20 nt, Homo sapiens
ggcucuuaugugugccuuug

SEQ ID NO: 1530911 - RNA, 13 nt, Homo sapiens
ggcuuguugacuu

SEQ ID NO: 1530912 - RNA, 12 nt, Homo sapiens
gggaucugccaa

SEQ ID NO: 1530913 - RNA, 17 nt, Homo sapiens
gggccaauuuacuggcc

SEQ ID NO: 1530914 - RNA, 16 nt, Homo sapiens
gggcuuaccaggugag

SEQ ID NO: 1530915 - RNA, 22 nt, Homo sapiens
gggcuuaccaggugagaaguga

SEQ ID NO: 1530916 - RNA, 13 nt, Homo sapiens
gggucaacaucuu

SEQ ID NO: 1530917 - RNA, 19 nt, Homo sapiens
gggucucacaguguugccc

SEQ ID NO: 1530918 - RNA, 20 nt, Homo sapiens
gggucucacaguguugccca

SEQ ID NO: 1530919 - RNA, 18 nt, Homo sapiens
ggguggagggaaggugag

SEQ ID NO: 1530920 - RNA, 13 nt, Homo sapiens
gguauaauguuua

SEQ ID NO: 1530921 - RNA, 20 nt, Homo sapiens
ggucucacaguguugcccag

SEQ ID NO: 1530922 - RNA, 20 nt, Homo sapiens
ggucucgcuuuguugcccag

SEQ ID NO: 1530923 - RNA, 20 nt, Homo sapiens
ggugaaccuuaguaccuaaa

SEQ ID NO: 1530924 - RNA, 19 nt, Homo sapiens
ggugcugggaauacaucug

SEQ ID NO: 1530925 - RNA, 14 nt, Homo sapiens
gguggcucaugccu

SEQ ID NO: 1530926 - RNA, 20 nt, Homo sapiens
guaaaugggggugcauuuga

SEQ ID NO: 1530927 - RNA, 16 nt, Homo sapiens
guaaucccaacacuuu

SEQ ID NO: 1530928 - RNA, 19 nt, Homo sapiens
guagccucugggaucugcc

SEQ ID NO: 1530929 - RNA, 17 nt, Homo sapiens
guaggggcccacuucac

SEQ ID NO: 1530930 - RNA, 18 nt, Homo sapiens
guaugaaggaaucauucc

SEQ ID NO: 1530931 - RNA, 14 nt, Homo sapiens
guaugaggcauuug

SEQ ID NO: 1530932 - RNA, 16 nt, Homo sapiens
guauuggaaauggaug

SEQ ID NO: 1530933 - RNA, 15 nt, Homo sapiens
gucccagaguggcug

SEQ ID NO: 1530934 - RNA, 16 nt, Homo sapiens
gucuccuucacaucag

SEQ ID NO: 1530935 - RNA, 17 nt, Homo sapiens
ugguguacucuaggacu

SEQ ID NO: 1530936 - RNA, 19 nt, Homo sapiens
ugguuauucuaagcccuuu

SEQ ID NO: 1530937 - RNA, 20 nt, Homo sapiens
ugguucgugccaugcccuua

SEQ ID NO: 1530938 - RNA, 21 nt, Homo sapiens
uguacagaaaguaucacaaau

SEQ ID NO: 1530939 - RNA, 16 nt, Homo sapiens
ugucccucacuguuga

SEQ ID NO: 1530940 - RNA, 22 nt, Homo sapiens
ugucuggcaggcuacucugccc

SEQ ID NO: 1530941 - RNA, 21 nt, Homo sapiens
ugucuugaaaguggcaccaga

SEQ ID NO: 1530942 - RNA, 23 nt, Homo sapiens
ugugaaacuggauuaaacuuaau

SEQ ID NO: 1530943 - RNA, 12 nt, Homo sapiens
ugugacauacau

SEQ ID NO: 1530944 - RNA, 16 nt, Homo sapiens
ugugagccaccacguc

SEQ ID NO: 1530945 - RNA, 13 nt, Homo sapiens
ugugaggguggug

SEQ ID NO: 1530946 - RNA, 20 nt, Homo sapiens
ugugauugacgggacuguug

SEQ ID NO: 1530947 - RNA, 18 nt, Homo sapiens
uguuaugauauuguuuaa

SEQ ID NO: 1530948 - RNA, 20 nt, Homo sapiens
uguuauuguugaacauacuu

SEQ ID NO: 1530949 - RNA, 16 nt, Homo sapiens
uguucuauuugugcuu

SEQ ID NO: 1530950 - RNA, 18 nt, Homo sapiens
uuaaaacaauucugugac

SEQ ID NO: 1530951 - RNA, 14 nt, Homo sapiens
uuaaaaucugugaa

SEQ ID NO: 1530952 - RNA, 20 nt, Homo sapiens
uuaaaugcaauaauuuuacu

SEQ ID NO: 1530953 - RNA, 13 nt, Homo sapiens
uuaaccuuaucag

SEQ ID NO: 1530954 - RNA, 13 nt, Homo sapiens
uuaaccuuuccag

SEQ ID NO: 1530955 - RNA, 22 nt, Homo sapiens
uuaaguagaaaaguugcagaug

SEQ ID NO: 1530956 - RNA, 21 nt, Homo sapiens
uuaauggcagcuagugccuuu

SEQ ID NO: 1530957 - RNA, 15 nt, Homo sapiens
uuaauucacagaaua

SEQ ID NO: 1530958 - RNA, 20 nt, Homo sapiens
uuacaaucagccacauucua

SEQ ID NO: 1530959 - RNA, 16 nt, Homo sapiens
uuacuaucauaauuca

SEQ ID NO: 1530960 - RNA, 21 nt, Homo sapiens
uuaguuucaaauuuaccucag

SEQ ID NO: 1530961 - RNA, 15 nt, Homo sapiens
uuaugguaaccauuc

SEQ ID NO: 1530962 - RNA, 19 nt, Homo sapiens
uuauuacauggggucuaga

SEQ ID NO: 1530963 - RNA, 14 nt, Homo sapiens
uuauuuuugucaaa

SEQ ID NO: 1530964 - RNA, 16 nt, Homo sapiens
uucacaggcacuccug

SEQ ID NO: 1530965 - RNA, 15 nt, Homo sapiens
uucacaucugucacg

SEQ ID NO: 1530966 - RNA, 16 nt, Homo sapiens
uucaccuacauuaucu

SEQ ID NO: 1530967 - RNA, 20 nt, Homo sapiens
uucaguagugagcagcaucu

SEQ ID NO: 1530968 - RNA, 14 nt, Homo sapiens
uuccugaugaugcu

SEQ ID NO: 1530969 - RNA, 17 nt, Homo sapiens
uuccuguccccagggga

SEQ ID NO: 1530970 - RNA, 12 nt, Homo sapiens
uuccuucaaugu

SEQ ID NO: 1530971 - RNA, 19 nt, Homo sapiens
uucugcuuuaucuuuucau

SEQ ID NO: 1530972 - RNA, 15 nt, Homo sapiens
uugaacauacuucaa

SEQ ID NO: 1530973 - RNA, 22 nt, Homo sapiens
uugauacaacauuaaggaauuu

SEQ ID NO: 1530974 - RNA, 13 nt, Homo sapiens
uugcacauaguag

SEQ ID NO: 1530975 - RNA, 22 nt, Homo sapiens
uugcacauaguagguacccaau

SEQ ID NO: 1530976 - RNA, 21 nt, Homo sapiens
uugcauaucuuaaaacuaaau

SEQ ID NO: 1530977 - RNA, 19 nt, Homo sapiens
uugccacugcugugugauu

SEQ ID NO: 1530978 - RNA, 21 nt, Homo sapiens
uugcccugaggcucagucucu

SEQ ID NO: 1530979 - RNA, 12 nt, Homo sapiens
uuggaguuuucu

SEQ ID NO: 1530980 - RNA, 15 nt, Homo sapiens
uugguguugacauac

SEQ ID NO: 1530981 - RNA, 13 nt, Homo sapiens
uugguuauucuaa

SEQ ID NO: 1530982 - RNA, 16 nt, Homo sapiens
uuguuccccacugaca

SEQ ID NO: 1530983 - RNA, 22 nt, Homo sapiens
aaucaacaaaauggucauccaa

SEQ ID NO: 1530984 - RNA, 13 nt, Homo sapiens
aaucucagcacuu

SEQ ID NO: 1530985 - RNA, 16 nt, Homo sapiens
aaucugagcugcaggu

SEQ ID NO: 1530986 - RNA, 24 nt, Homo sapiens
aaucuuuuguuuuaauauaagaau

SEQ ID NO: 1530987 - RNA, 21 nt, Homo sapiens
aaugacuuacuguacaugaaa

SEQ ID NO: 1530988 - RNA, 13 nt, Homo sapiens
aaugcaccuggaa

SEQ ID NO: 1530989 - RNA, 21 nt, Homo sapiens
aauggcauggagacucugaga

SEQ ID NO: 1530990 - RNA, 12 nt, Homo sapiens
aauggucaucca

SEQ ID NO: 1530991 - RNA, 23 nt, Homo sapiens
aauuaaaacuaagcacaaagcca

SEQ ID NO: 1530992 - RNA, 14 nt, Homo sapiens
aauucagcacuuaa

SEQ ID NO: 1530993 - RNA, 16 nt, Homo sapiens
aauucugugacauaca

SEQ ID NO: 1530994 - RNA, 20 nt, Homo sapiens
aauucugugacauacauauu

SEQ ID NO: 1530995 - RNA, 18 nt, Homo sapiens
aauuuauuaacuaaucaa

SEQ ID NO: 1530996 - RNA, 22 nt, Homo sapiens
acaaacauguauguauacauga

SEQ ID NO: 1530997 - RNA, 19 nt, Homo sapiens
acaaaccugggcaaugugg

SEQ ID NO: 1530998 - RNA, 18 nt, Homo sapiens
acaaguagccucugggau

SEQ ID NO: 1530999 - RNA, 13 nt, Homo sapiens
acaauaaauuauu

SEQ ID NO: 1531000 - RNA, 20 nt, Homo sapiens
acaaucauuguuuugaauau

SEQ ID NO: 1531001 - RNA, 17 nt, Homo sapiens
acaaugacuuacuguac

SEQ ID NO: 1531002 - RNA, 12 nt, Homo sapiens
acacaaagggaa

SEQ ID NO: 1531003 - RNA, 21 nt, Homo sapiens
acacacaguccaacucuucca

SEQ ID NO: 1531004 - RNA, 19 nt, Homo sapiens
acacagagcaggacugcac

SEQ ID NO: 1531005 - RNA, 22 nt, Homo sapiens
acacagagcaggacugcacagc

SEQ ID NO: 1531006 - RNA, 20 nt, Homo sapiens
acacaguccaacucuuccac

SEQ ID NO: 1531007 - RNA, 21 nt, Homo sapiens
acacauuuuuuaaaugcaccu

SEQ ID NO: 1531008 - RNA, 12 nt, Homo sapiens
acacccaccucu

SEQ ID NO: 1531009 - RNA, 16 nt, Homo sapiens
acaccuuuucuauuua

SEQ ID NO: 1531010 - RNA, 13 nt, Homo sapiens
acacuuuaccucu

SEQ ID NO: 1531011 - RNA, 16 nt, Homo sapiens
acagacacaauaugua

SEQ ID NO: 1531012 - RNA, 23 nt, Homo sapiens
acagacaccuuuucuauuuaccu

SEQ ID NO: 1531013 - RNA, 21 nt, Homo sapiens
acagccucccacccccaucuc

SEQ ID NO: 1531014 - RNA, 16 nt, Homo sapiens
acaggcagcucugagc

SEQ ID NO: 1531015 - RNA, 17 nt, Homo sapiens
acaggcagcucugagcc

SEQ ID NO: 1531016 - RNA, 14 nt, Homo sapiens
acagucucuugucc

SEQ ID NO: 1531017 - RNA, 12 nt, Homo sapiens
acaguggcugcu

SEQ ID NO: 1531018 - RNA, 17 nt, Homo sapiens
acagugguacucugugu

SEQ ID NO: 1531019 - RNA, 14 nt, Homo sapiens
acauauuaucucau

SEQ ID NO: 1531020 - RNA, 23 nt, Homo sapiens
acaucucuuccuccgaggccagu

SEQ ID NO: 1531021 - RNA, 20 nt, Homo sapiens
acauucugcaagcacaucug

SEQ ID NO: 1531022 - RNA, 23 nt, Homo sapiens
acauucugcaagcacaucugcau

SEQ ID NO: 1531023 - RNA, 16 nt, Homo sapiens
acauuuugacacaaaa

SEQ ID NO: 1531024 - RNA, 17 nt, Homo sapiens
accacagguucaugcca

SEQ ID NO: 1531025 - RNA, 11 nt, Homo sapiens
accagaggcag

SEQ ID NO: 1531026 - RNA, 13 nt, Homo sapiens
accagcuacccug

SEQ ID NO: 1531027 - RNA, 22 nt, Homo sapiens
accaucucugugauuaccucuc

SEQ ID NO: 1531028 - RNA, 23 nt, Homo sapiens
accaucucugugauuaccucuca

SEQ ID NO: 1531029 - RNA, 20 nt, Homo sapiens
acccaggacuuccauuugcu

SEQ ID NO: 1531030 - RNA, 13 nt, Homo sapiens
acccauucuacac

SEQ ID NO: 1531031 - RNA, 18 nt, Homo sapiens
acccuguagggugccauu

SEQ ID NO: 1531032 - RNA, 21 nt, Homo sapiens
accgagguguugccagugcua

SEQ ID NO: 1531033 - RNA, 23 nt, Homo sapiens
accgcuucugccuuuucacugug

SEQ ID NO: 1531034 - RNA, 21 nt, Homo sapiens
accgucuucucccuauucccu

SEQ ID NO: 1531035 - RNA, 14 nt, Homo sapiens
auacauauuaucuc

SEQ ID NO: 1531036 - RNA, 15 nt, Homo sapiens
auacauauuaucuca

SEQ ID NO: 1531037 - RNA, 17 nt, Homo sapiens
auacauauuaucucauu

SEQ ID NO: 1531038 - RNA, 14 nt, Homo sapiens
auacaucuguggac

SEQ ID NO: 1531039 - RNA, 13 nt, Homo sapiens
auagacaauuuau

SEQ ID NO: 1531040 - RNA, 22 nt, Homo sapiens
auagaugccgcggaaggucccu

SEQ ID NO: 1531041 - RNA, 13 nt, Homo sapiens
auauauuucacuu

SEQ ID NO: 1531042 - RNA, 16 nt, Homo sapiens
auaucuugcuuucaaa

SEQ ID NO: 1531043 - RNA, 23 nt, Homo sapiens
auaucuugcuuucaaauuggcac

SEQ ID NO: 1531044 - RNA, 20 nt, Homo sapiens
auaugaugaucuggauccac

SEQ ID NO: 1531045 - RNA, 15 nt, Homo sapiens
auauggucauauaca

SEQ ID NO: 1531046 - RNA, 12 nt, Homo sapiens
aucacgaccacu

SEQ ID NO: 1531047 - RNA, 16 nt, Homo sapiens
aucagcacagcucucc

SEQ ID NO: 1531048 - RNA, 16 nt, Homo sapiens
aucaguaccucucaag

SEQ ID NO: 1531049 - RNA, 17 nt, Homo sapiens
aucauaauucagcacuu

SEQ ID NO: 1531050 - RNA, 20 nt, Homo sapiens
auccaaaauauuuuuugcaa

SEQ ID NO: 1531051 - RNA, 20 nt, Homo sapiens
aucgucacugcuuaacuuca

SEQ ID NO: 1531052 - RNA, 15 nt, Homo sapiens
aucuagauacuguau

SEQ ID NO: 1531053 - RNA, 13 nt, Homo sapiens
aucucagcacuuu

SEQ ID NO: 1531054 - RNA, 14 nt, Homo sapiens
aucucagcacuuug

SEQ ID NO: 1531055 - RNA, 22 nt, Homo sapiens
aucucucccuccccugccauuu

SEQ ID NO: 1531056 - RNA, 19 nt, Homo sapiens
aucucugugauuaccucuc

SEQ ID NO: 1531057 - RNA, 16 nt, Homo sapiens
aucucuuauuuuacaa

SEQ ID NO: 1531058 - RNA, 21 nt, Homo sapiens
aucucuuccuccgaggccagu

SEQ ID NO: 1531059 - RNA, 11 nt, Homo sapiens
aucugccaaca

SEQ ID NO: 1531060 - RNA, 13 nt, Homo sapiens
aucuuaaaacuaa

SEQ ID NO: 1531061 - RNA, 13 nt, Homo sapiens
augaaggaaucau

SEQ ID NO: 1531062 - RNA, 17 nt, Homo sapiens
augaauaaacugaauau

SEQ ID NO: 1531063 - RNA, 14 nt, Homo sapiens
augacaaagacuga

SEQ ID NO: 1531064 - RNA, 21 nt, Homo sapiens
augagccagcccaagggcauc

SEQ ID NO: 1531065 - RNA, 15 nt, Homo sapiens
augcuggcauuugca

SEQ ID NO: 1531066 - RNA, 20 nt, Homo sapiens
auggaacuuagacuccucuu

SEQ ID NO: 1531067 - RNA, 15 nt, Homo sapiens
auggcagaaccaaag

SEQ ID NO: 1531068 - RNA, 13 nt, Homo sapiens
auggccagccaac

SEQ ID NO: 1531069 - RNA, 13 nt, Homo sapiens
auggugccuggga

SEQ ID NO: 1531070 - RNA, 19 nt, Homo sapiens
augguggaaaagaacugua

SEQ ID NO: 1531071 - RNA, 20 nt, Homo sapiens
auguaaauaaauuguaauau

SEQ ID NO: 1531072 - RNA, 15 nt, Homo sapiens
auguccugccuuuua

SEQ ID NO: 1531073 - RNA, 20 nt, Homo sapiens
auuaaaacaauaaugcaauu

SEQ ID NO: 1531074 - RNA, 21 nt, Homo sapiens
auuaacuuuuauaaacuuuac

SEQ ID NO: 1531075 - RNA, 14 nt, Homo sapiens
auuacaauugugag

SEQ ID NO: 1531076 - RNA, 18 nt, Homo sapiens
auuacauggggucuagaa

SEQ ID NO: 1531077 - RNA, 22 nt, Homo sapiens
auuagauguuucaacugugcuc

SEQ ID NO: 1531078 - RNA, 16 nt, Homo sapiens
auuauuuuacaaucaa

SEQ ID NO: 1531079 - RNA, 13 nt, Homo sapiens
auucacagaauag

SEQ ID NO: 1531080 - RNA, 19 nt, Homo sapiens
auucacagaauagcacaaa

SEQ ID NO: 1531081 - RNA, 12 nt, Homo sapiens
auucagcacuua

SEQ ID NO: 1531082 - RNA, 19 nt, Homo sapiens
auucucuccuguaccucuu

SEQ ID NO: 1531083 - RNA, 18 nt, Homo sapiens
auucuuuuguuuccaugg

SEQ ID NO: 1531084 - RNA, 16 nt, Homo sapiens
auugaaagaaccagag

SEQ ID NO: 1531085 - RNA, 17 nt, Homo sapiens
auuuauuaacuaaucaa

SEQ ID NO: 1531086 - RNA, 14 nt, Homo sapiens
auuucugcuuucuu

SEQ ID NO: 1531087 - RNA, 21 nt, Homo sapiens
auuuuaaaggcagagaaguuc

SEQ ID NO: 1531088 - RNA, 16 nt, Homo sapiens
auuuuaauacauugau

SEQ ID NO: 1531089 - RNA, 17 nt, Homo sapiens
auuuuacacaaagggaa

SEQ ID NO: 1531090 - RNA, 21 nt, Homo sapiens
auuuuuuaagugggcuccuga

SEQ ID NO: 1531091 - RNA, 16 nt, Homo sapiens
caaaauauuuuuugca

SEQ ID NO: 1531092 - RNA, 19 nt, Homo sapiens
caaacuacaauuaaaacua

SEQ ID NO: 1531093 - RNA, 11 nt, Homo sapiens
caaauuugaug

SEQ ID NO: 1531094 - RNA, 11 nt, Homo sapiens
aacaguggcug

SEQ ID NO: 1531095 - RNA, 23 nt, Homo sapiens
aacauacuucaaaaauaaugugc

SEQ ID NO: 1531096 - RNA, 12 nt, Homo sapiens
aaccaucucugu

SEQ ID NO: 1531097 - RNA, 21 nt, Homo sapiens
aacccagcaguucucugccaa

SEQ ID NO: 1531098 - RNA, 12 nt, Homo sapiens
aacccugucuga

SEQ ID NO: 1531099 - RNA, 20 nt, Homo sapiens
aaccgagguguugccagugc

SEQ ID NO: 1531100 - RNA, 22 nt, Homo sapiens
aacuaaucaagaaaaacaucuu

SEQ ID NO: 1531101 - RNA, 18 nt, Homo sapiens
aacuggaauuaaaaggau

SEQ ID NO: 1531102 - RNA, 17 nt, Homo sapiens
agcauuuccacaccaag

SEQ ID NO: 1531103 - RNA, 14 nt, Homo sapiens
agccaacuuuugca

SEQ ID NO: 1531104 - RNA, 18 nt, Homo sapiens
agccagcugugcacuuuc

SEQ ID NO: 1531105 - RNA, 19 nt, Homo sapiens
agcccaagggcaucauccu

SEQ ID NO: 1531106 - RNA, 22 nt, Homo sapiens
agccugccuggcaggcugucug

SEQ ID NO: 1531107 - RNA, 14 nt, Homo sapiens
agccugggcaacau

SEQ ID NO: 1531108 - RNA, 18 nt, Homo sapiens
ugauaaaugauagacaau

SEQ ID NO: 1531109 - RNA, 23 nt, Homo sapiens
ugaucagcuuauugucuagugaa

SEQ ID NO: 1531110 - RNA, 12 nt, Homo sapiens
ugaucucagcuc

SEQ ID NO: 1531111 - RNA, 20 nt, Homo sapiens
ugcaguaggggcuacuguga

SEQ ID NO: 1531112 - RNA, 20 nt, Homo sapiens
ugcagucucuauaccaauaa

SEQ ID NO: 1531113 - RNA, 18 nt, Homo sapiens
ugcaguggcaucaucuca

SEQ ID NO: 1531114 - RNA, 22 nt, Homo sapiens
ugcaguggcgcgaucucagcuc

SEQ ID NO: 1531115 - RNA, 21 nt, Homo sapiens
ugcaugcgagugcucauuuca

SEQ ID NO: 1531116 - RNA, 20 nt, Homo sapiens
ugccuaaguccaguguuucu

SEQ ID NO: 1531117 - RNA, 17 nt, Homo sapiens
ugcgagugcucauuuca

SEQ ID NO: 1531118 - RNA, 19 nt, Homo sapiens
ugcggaggaaggaggaccc

SEQ ID NO: 1531119 - RNA, 18 nt, Homo sapiens
ugcugaaacucagugcaa

SEQ ID NO: 1531120 - RNA, 21 nt, Homo sapiens
ugcugugugacucaaaccaaa

SEQ ID NO: 1531121 - RNA, 22 nt, Homo sapiens
ugcuucuccagccucagccucc

SEQ ID NO: 1531122 - RNA, 13 nt, Homo sapiens
ugcuucugcacac

SEQ ID NO: 1531123 - RNA, 18 nt, Homo sapiens
ugcuucugcacacaaaac

SEQ ID NO: 1531124 - RNA, 17 nt, Homo sapiens
uggaaaggcagcucuaa

SEQ ID NO: 1531125 - RNA, 15 nt, Homo sapiens
uggaaauucccuuca

SEQ ID NO: 1531126 - RNA, 18 nt, Homo sapiens
uggcaucaucucagcuca

SEQ ID NO: 1531127 - RNA, 19 nt, Homo sapiens
uggcaucaucucagcucac

SEQ ID NO: 1531128 - RNA, 23 nt, Homo sapiens
uggcauuacaggugugagccacg

SEQ ID NO: 1531129 - RNA, 15 nt, Homo sapiens
uggcgcgaucucagc

SEQ ID NO: 1531130 - RNA, 24 nt, Homo sapiens
uggcugggaacaacuucaguccaa

SEQ ID NO: 1531131 - RNA, 16 nt, Homo sapiens
ugggaaagggcuguua

SEQ ID NO: 1531132 - RNA, 21 nt, Homo sapiens
ugggacagucaccucauggaa

SEQ ID NO: 1531133 - RNA, 20 nt, Homo sapiens
ugggagacuggaaaagggaa

SEQ ID NO: 1531134 - RNA, 21 nt, Homo sapiens
ugggcugucagcccaugugca

SEQ ID NO: 1531135 - RNA, 18 nt, Homo sapiens
uggggcgagcacugugag

SEQ ID NO: 1531136 - RNA, 23 nt, Homo sapiens
ugguaccaccagucugacuguuu

SEQ ID NO: 1531137 - RNA, 21 nt, Homo sapiens
uguagaagacaaaauguucac

SEQ ID NO: 1531138 - RNA, 19 nt, Homo sapiens
uguauacuauaguaccagu

SEQ ID NO: 1531139 - RNA, 16 nt, Homo sapiens
ugucaggauucuucaa

SEQ ID NO: 1531140 - RNA, 12 nt, Homo sapiens
ugucccaaagaa

SEQ ID NO: 1531141 - RNA, 13 nt, Homo sapiens
uguccccuacccc

SEQ ID NO: 1531142 - RNA, 20 nt, Homo sapiens
ugucuauuuuuuucaguuua

SEQ ID NO: 1531143 - RNA, 21 nt, Homo sapiens
uguggaacauaaaaaggacau

SEQ ID NO: 1531144 - RNA, 14 nt, Homo sapiens
uguuaaaacuggga

SEQ ID NO: 1531145 - RNA, 17 nt, Homo sapiens
uuaaacaaauaauuuag

SEQ ID NO: 1531146 - RNA, 21 nt, Homo sapiens
uuaaauaaagucucucugacu

SEQ ID NO: 1531147 - RNA, 14 nt, Homo sapiens
uuaaauguauacua

SEQ ID NO: 1531148 - RNA, 18 nt, Homo sapiens
uuaacagguaugaaccac

SEQ ID NO: 1531149 - RNA, 14 nt, Homo sapiens
uuacagaacuacuu

SEQ ID NO: 1531150 - RNA, 15 nt, Homo sapiens
uuacagaacuacuuc

SEQ ID NO: 1531151 - RNA, 22 nt, Homo sapiens
uuaccugggaaagggcuguuau

SEQ ID NO: 1531152 - RNA, 18 nt, Homo sapiens
uuagggaaaacauuccau

SEQ ID NO: 1531153 - RNA, 21 nt, Homo sapiens
uuaguagagacggguuucacc

SEQ ID NO: 1531154 - RNA, 20 nt, Homo sapiens
uuauguuaaaacugggacag

SEQ ID NO: 1531155 - RNA, 13 nt, Homo sapiens
uucaaaauucuca

SEQ ID NO: 1531156 - RNA, 15 nt, Homo sapiens
uucaacaucuaguga

SEQ ID NO: 1531157 - RNA, 22 nt, Homo sapiens
uucaacaucuagugagcaguca

SEQ ID NO: 1531158 - RNA, 21 nt, Homo sapiens
uucaauaaaacgcaguugcaa

SEQ ID NO: 1531159 - RNA, 19 nt, Homo sapiens
uucaccauauuggccaguc

SEQ ID NO: 1531160 - RNA, 16 nt, Homo sapiens
uuccaagcaaguauua

SEQ ID NO: 1531161 - RNA, 17 nt, Homo sapiens
uuccaagcaaguauuag

SEQ ID NO: 1531162 - RNA, 22 nt, Homo sapiens
uucccaacuccagaaagugaca

SEQ ID NO: 1531163 - RNA, 17 nt, Homo sapiens
uuccucaagaacacagc

SEQ ID NO: 1531164 - RNA, 18 nt, Homo sapiens
uuccuuggccaugcagaa

SEQ ID NO: 1531165 - RNA, 21 nt, Homo sapiens
uucuaggcaguucaaagcagg

SEQ ID NO: 1531166 - RNA, 22 nt, Homo sapiens
uucuuauaccacguuccacgga

SEQ ID NO: 1531167 - RNA, 23 nt, Homo sapiens
uucuuauuauuuuugagacagag

SEQ ID NO: 1531168 - RNA, 16 nt, Homo sapiens
uugaaaucccaucagg

SEQ ID NO: 1531169 - RNA, 17 nt, Homo sapiens
uugaauaaauguaucug

SEQ ID NO: 1531170 - RNA, 11 nt, Homo sapiens
uugagacagag

SEQ ID NO: 1531171 - RNA, 14 nt, Homo sapiens
uugauuggugauua

SEQ ID NO: 1531172 - RNA, 13 nt, Homo sapiens
uugcaagccagau

SEQ ID NO: 1531173 - RNA, 13 nt, Homo sapiens
uugucugagacag

SEQ ID NO: 1531174 - RNA, 14 nt, Homo sapiens
uuucaaaauucuca

SEQ ID NO: 1531175 - RNA, 15 nt, Homo sapiens
uuucaguuuauuuga

SEQ ID NO: 1531176 - RNA, 13 nt, Homo sapiens
uuugagacagagu

SEQ ID NO: 1531177 - RNA, 19 nt, Homo sapiens
uuugccacccucaugcugu

SEQ ID NO: 1531178 - RNA, 13 nt, Homo sapiens
uuugcucauggaa

SEQ ID NO: 1531179 - RNA, 18 nt, Homo sapiens
uuuuaaauguauacuaua

SEQ ID NO: 1531180 - RNA, 11 nt, Homo sapiens
uuuuugcagcu

SEQ ID NO: 1531181 - RNA, 16 nt, Homo sapiens
gugcaaccaucaccag

SEQ ID NO: 1531182 - RNA, 19 nt, Homo sapiens
gugcacagggggaggccau

SEQ ID NO: 1531183 - RNA, 19 nt, Homo sapiens
gugcaguggcgcgaucuca

SEQ ID NO: 1531184 - RNA, 19 nt, Homo sapiens
gugcaguggcgugaucuca

SEQ ID NO: 1531185 - RNA, 21 nt, Homo sapiens
gugccagcccugcauugcuga

SEQ ID NO: 1531186 - RNA, 19 nt, Homo sapiens
gugcuggcauuacaggugu

SEQ ID NO: 1531187 - RNA, 21 nt, Homo sapiens
gugcuggcauuacagguguga

SEQ ID NO: 1531188 - RNA, 11 nt, Homo sapiens
gugcugggauu

SEQ ID NO: 1531189 - RNA, 19 nt, Homo sapiens
gugcugggauuaacaggua

SEQ ID NO: 1531190 - RNA, 14 nt, Homo sapiens
guggcgugaucuca

SEQ ID NO: 1531191 - RNA, 22 nt, Homo sapiens
gugggcgcuugcaccacuuccg

SEQ ID NO: 1531192 - RNA, 16 nt, Homo sapiens
guucugguaugaacuu

SEQ ID NO: 1531193 - RNA, 12 nt, Homo sapiens
guugacauggga

SEQ ID NO: 1531194 - RNA, 21 nt, Homo sapiens
guugccaggcuggagugcagu

SEQ ID NO: 1531195 - RNA, 15 nt, Homo sapiens
guuucaaaauucuca

SEQ ID NO: 1531196 - RNA, 18 nt, Homo sapiens
uaaagugacccugcucuc

SEQ ID NO: 1531197 - RNA, 19 nt, Homo sapiens
uaaagugacccugcucuca

SEQ ID NO: 1531198 - RNA, 20 nt, Homo sapiens
uaaagugacccugcucucac

SEQ ID NO: 1531199 - RNA, 18 nt, Homo sapiens
uaaaugauagacaauuga

SEQ ID NO: 1531200 - RNA, 21 nt, Homo sapiens
uaaauguauacuauaguacca

SEQ ID NO: 1531201 - RNA, 16 nt, Homo sapiens
uaaauguaucugaaua

SEQ ID NO: 1531202 - RNA, 17 nt, Homo sapiens
uaacauuuccuuacaga

SEQ ID NO: 1531203 - RNA, 14 nt, Homo sapiens
uaacugcauccagc

SEQ ID NO: 1531204 - RNA, 20 nt, Homo sapiens
uaagaaauaaauuuauuuca

SEQ ID NO: 1531205 - RNA, 18 nt, Homo sapiens
uaagcuggagugcagugg

SEQ ID NO: 1531206 - RNA, 15 nt, Homo sapiens
uaagcuuaugcuuaa

SEQ ID NO: 1531207 - RNA, 15 nt, Homo sapiens
uaaguacacaauaag

SEQ ID NO: 1531208 - RNA, 19 nt, Homo sapiens
uaagugauuuguaugucua

SEQ ID NO: 1531209 - RNA, 18 nt, Homo sapiens
uaauccaguaaaauaaua

SEQ ID NO: 1531210 - RNA, 15 nt, Homo sapiens
uaaugauaacuggaa

SEQ ID NO: 1531211 - RNA, 17 nt, Homo sapiens
uaaugauaacuggaaac

SEQ ID NO: 1531212 - RNA, 19 nt, Homo sapiens
uaauuaguaagcuagcaaa

SEQ ID NO: 1531213 - RNA, 17 nt, Homo sapiens
uacaaugaucaccgacu

SEQ ID NO: 1531214 - RNA, 14 nt, Homo sapiens
uacacaauaagcaa

SEQ ID NO: 1531215 - RNA, 22 nt, Homo sapiens
uacacaguggccaagcggccau

SEQ ID NO: 1531216 - RNA, 13 nt, Homo sapiens
uacagacugggga

SEQ ID NO: 1531217 - RNA, 18 nt, Homo sapiens
uacaucccuuaccuggga

SEQ ID NO: 1531218 - RNA, 17 nt, Homo sapiens
uacaucucccagacucu

SEQ ID NO: 1531219 - RNA, 19 nt, Homo sapiens
uacauucuuaaagugucga

SEQ ID NO: 1531220 - RNA, 21 nt, Homo sapiens
uaccaauaaagugacccugcu

SEQ ID NO: 1531221 - RNA, 17 nt, Homo sapiens
uacuagucaccagagac

SEQ ID NO: 1531222 - RNA, 16 nt, Homo sapiens
uacuauaguaccagua

SEQ ID NO: 1531223 - RNA, 16 nt, Homo sapiens
uacugcucuccuccac

SEQ ID NO: 1531224 - RNA, 18 nt, Homo sapiens
uacugggaaucaagacaa

SEQ ID NO: 1531225 - RNA, 22 nt, Homo sapiens
uacuucuuaggguuaugauuaa

SEQ ID NO: 1531226 - RNA, 16 nt, Homo sapiens
uagaaacacaacuaua

SEQ ID NO: 1531227 - RNA, 16 nt, Homo sapiens
uagaauaccacaggaa

SEQ ID NO: 1531228 - RNA, 13 nt, Homo sapiens
uagacuagucuca

SEQ ID NO: 1531229 - RNA, 17 nt, Homo sapiens
uagagauggggguuuca

SEQ ID NO: 1531230 - RNA, 19 nt, Homo sapiens
uagcaaauaguaaucugua

SEQ ID NO: 1531231 - RNA, 23 nt, Homo sapiens
uagcagcuuuagccaagugcagg

SEQ ID NO: 1531232 - RNA, 14 nt, Homo sapiens
uagccaagugcagg

SEQ ID NO: 1531233 - RNA, 16 nt, Homo sapiens
uaggcgcaggugcaca

SEQ ID NO: 1531234 - RNA, 17 nt, Homo sapiens
uaggcgcaggugcacag

SEQ ID NO: 1531235 - RNA, 13 nt, Homo sapiens
uaguaaucuguaa

SEQ ID NO: 1531236 - RNA, 15 nt, Homo sapiens
uauauagcagcuuua

SEQ ID NO: 1531237 - RNA, 18 nt, Homo sapiens
uaucuuugccacccucau

SEQ ID NO: 1531238 - RNA, 15 nt, Homo sapiens
uauuugaaccaauaa

SEQ ID NO: 1531239 - RNA, 12 nt, Homo sapiens
ucaaaauucuca

SEQ ID NO: 1531240 - RNA, 13 nt, Homo sapiens
ucaaaauucucau

SEQ ID NO: 1531241 - RNA, 13 nt, Homo sapiens
ucaaauccuugaa

SEQ ID NO: 1531242 - RNA, 11 nt, Homo sapiens
ucaaaugugca

SEQ ID NO: 1531243 - RNA, 13 nt, Homo sapiens
ucaaaugugcauc

SEQ ID NO: 1531244 - RNA, 21 nt, Homo sapiens
ucaacuccgugcuuaaccaaa

SEQ ID NO: 1531245 - RNA, 23 nt, Homo sapiens
ucacacugggacuugcaaaaagg

SEQ ID NO: 1531246 - RNA, 18 nt, Homo sapiens
ucaccaugcccagcuaau

SEQ ID NO: 1531247 - RNA, 21 nt, Homo sapiens
ucacccagguuggagugcagu

SEQ ID NO: 1531248 - RNA, 14 nt, Homo sapiens
ucacuacaaccucc

SEQ ID NO: 1531249 - RNA, 14 nt, Homo sapiens
ucagccucccaaag

SEQ ID NO: 1531250 - RNA, 15 nt, Homo sapiens
ucauccuuaccgcac

SEQ ID NO: 1531251 - RNA, 20 nt, Homo sapiens
ucaucuauagaaagcuauau

SEQ ID NO: 1531252 - RNA, 17 nt, Homo sapiens
uccacucguguguuucu

SEQ ID NO: 1531253 - RNA, 12 nt, Homo sapiens
uccaggggccac

SEQ ID NO: 1531254 - RNA, 14 nt, Homo sapiens
uccaucuccagugg

SEQ ID NO: 1531255 - RNA, 10 nt, Homo sapiens
ucccaaagaa

SEQ ID NO: 1531256 - RNA, 13 nt, Homo sapiens
ucccaaagugcug

SEQ ID NO: 1531257 - RNA, 20 nt, Homo sapiens
ucccuacccuaaccaaguuc

SEQ ID NO: 1531258 - RNA, 22 nt, Homo sapiens
ucccuaucuuugccacccucau

SEQ ID NO: 1531259 - RNA, 14 nt, Homo sapiens
ucccucugcagucu

SEQ ID NO: 1531260 - RNA, 18 nt, Homo sapiens
ucccucugcagucucuau

SEQ ID NO: 1531261 - RNA, 19 nt, Homo sapiens
ucccucugcagucucuaua

SEQ ID NO: 1531262 - RNA, 21 nt, Homo sapiens
ucccucugcagucucuauacc

SEQ ID NO: 1531263 - RNA, 19 nt, Homo sapiens
ucccuuaagagucauccag

SEQ ID NO: 1531264 - RNA, 18 nt, Homo sapiens
uccgugcuuaaccaaaga

SEQ ID NO: 1531265 - RNA, 18 nt, Homo sapiens
uccuaagcuggagugcag

SEQ ID NO: 1531266 - RNA, 14 nt, Homo sapiens
uccuccaagcuauu

SEQ ID NO: 1531267 - RNA, 21 nt, Homo sapiens
uccuccaggguggcagcaaca

SEQ ID NO: 1531268 - RNA, 19 nt, Homo sapiens
uccugaccuugugauccac

SEQ ID NO: 1531269 - RNA, 14 nt, Homo sapiens
ucgcagguucaagc

SEQ ID NO: 1531270 - RNA, 20 nt, Homo sapiens
ucgcaucuugugucgcugaa

SEQ ID NO: 1531271 - RNA, 23 nt, Homo sapiens
ucuaccaaaaaucucaauauuuc

SEQ ID NO: 1531272 - RNA, 14 nt, Homo sapiens
ucuauaccaauaaa

SEQ ID NO: 1531273 - RNA, 16 nt, Homo sapiens
ucuauuuaaauaaagu

SEQ ID NO: 1531274 - RNA, 23 nt, Homo sapiens
ucucaaaaaaaaaaacaaacaaa

SEQ ID NO: 1531275 - RNA, 22 nt, Homo sapiens
ucucagcucacuacaaccuccg

SEQ ID NO: 1531276 - RNA, 13 nt, Homo sapiens
ucucagcucacug

SEQ ID NO: 1531277 - RNA, 15 nt, Homo sapiens
ucucagcucacugca

SEQ ID NO: 1531278 - RNA, 22 nt, Homo sapiens
ucucagcucacugcaaccucug

SEQ ID NO: 1531279 - RNA, 21 nt, Homo sapiens
ucucauuuuucauuucuuuuc

SEQ ID NO: 1531280 - RNA, 17 nt, Homo sapiens
ucucuaacauuuccuua

SEQ ID NO: 1531281 - RNA, 15 nt, Homo sapiens
ucucuauaccaauaa

SEQ ID NO: 1531282 - RNA, 15 nt, Homo sapiens
ucugaggggcuacca

SEQ ID NO: 1531283 - RNA, 21 nt, Homo sapiens
ucugaggggcuaccaggaaag

SEQ ID NO: 1531284 - RNA, 14 nt, Homo sapiens
ucugggcugucagc

SEQ ID NO: 1531285 - RNA, 22 nt, Homo sapiens
ucugggcugucagcccaugugc

SEQ ID NO: 1531286 - RNA, 15 nt, Homo sapiens
ucuguaaaacuaaga

SEQ ID NO: 1531287 - RNA, 14 nt, Homo sapiens
ucugucccaaagaa

SEQ ID NO: 1531288 - RNA, 18 nt, Homo sapiens
ucuuacugcuuaauucaa

SEQ ID NO: 1531289 - RNA, 14 nt, Homo sapiens
ucuuagaugcaguu

SEQ ID NO: 1531290 - RNA, 21 nt, Homo sapiens
ucuucagucucuauaccaaua

SEQ ID NO: 1531291 - RNA, 15 nt, Homo sapiens
ucuucucguuuucac

SEQ ID NO: 1531292 - RNA, 22 nt, Homo sapiens
ucuucucugcugaguuugccuu

SEQ ID NO: 1531293 - RNA, 15 nt, Homo sapiens
ugaaaaacaaaaugg

SEQ ID NO: 1531294 - RNA, 16 nt, Homo sapiens
ugaaaacccuugccau

SEQ ID NO: 1531295 - RNA, 16 nt, Homo sapiens
ugaaagaugaucauuu

SEQ ID NO: 1531296 - RNA, 17 nt, Homo sapiens
ugaaaucccaucagguc

SEQ ID NO: 1531297 - RNA, 22 nt, Homo sapiens
ugaaauuaugugacauuuuaca

SEQ ID NO: 1531298 - RNA, 14 nt, Homo sapiens
ugaauaaauguauc

SEQ ID NO: 1531299 - RNA, 20 nt, Homo sapiens
ugaauacauuuccaaaaugg

SEQ ID NO: 1531300 - RNA, 17 nt, Homo sapiens
ugaauacugggaaucaa

SEQ ID NO: 1531301 - RNA, 22 nt, Homo sapiens
ugaccauggaggccagugccag

SEQ ID NO: 1531302 - RNA, 21 nt, Homo sapiens
ugacccuccaccgcagaagga

SEQ ID NO: 1531303 - RNA, 21 nt, Homo sapiens
ugacuuccugaacaaccagcu

SEQ ID NO: 1531304 - RNA, 13 nt, Homo sapiens
ugaggagcccagg

SEQ ID NO: 1531305 - RNA, 17 nt, Homo sapiens
ugauaaaugauagacaa

SEQ ID NO: 1531306 - RNA, 18 nt, Homo sapiens
gaaacggaggccagagag

SEQ ID NO: 1531307 - RNA, 17 nt, Homo sapiens
gaaagcugauggccuug

SEQ ID NO: 1531308 - RNA, 19 nt, Homo sapiens
gaacucagcugaggccuug

SEQ ID NO: 1531309 - RNA, 20 nt, Homo sapiens
gaacuuugcugagccuguaa

SEQ ID NO: 1531310 - RNA, 12 nt, Homo sapiens
gaagaacugaaa

SEQ ID NO: 1531311 - RNA, 15 nt, Homo sapiens
gaagccccauccaac

SEQ ID NO: 1531312 - RNA, 19 nt, Homo sapiens
gaaggcuccaucuccagug

SEQ ID NO: 1531313 - RNA, 17 nt, Homo sapiens
gaaguugacuuauagua

SEQ ID NO: 1531314 - RNA, 15 nt, Homo sapiens
gaaucaagacaagac

SEQ ID NO: 1531315 - RNA, 22 nt, Homo sapiens
gaaugauuaugaauuacauuug

SEQ ID NO: 1531316 - RNA, 21 nt, Homo sapiens
gaauuaguuuuauaugcuucu

SEQ ID NO: 1531317 - RNA, 15 nt, Homo sapiens
gacacuagccugugc

SEQ ID NO: 1531318 - RNA, 15 nt, Homo sapiens
gacacugauaugggu

SEQ ID NO: 1531319 - RNA, 23 nt, Homo sapiens
gacagagcaagaccccaucucaa

SEQ ID NO: 1531320 - RNA, 13 nt, Homo sapiens
gacagucaccuca

SEQ ID NO: 1531321 - RNA, 12 nt, Homo sapiens
gaccugcuucua

SEQ ID NO: 1531322 - RNA, 14 nt, Homo sapiens
gacgggacugcgga

SEQ ID NO: 1531323 - RNA, 16 nt, Homo sapiens
gacggguuucaccaug

SEQ ID NO: 1531324 - RNA, 22 nt, Homo sapiens
gacuauaggcaugcgccaccau

SEQ ID NO: 1531325 - RNA, 14 nt, Homo sapiens
gacucuuaagaaga

SEQ ID NO: 1531326 - RNA, 14 nt, Homo sapiens
gagacagaaucuca

SEQ ID NO: 1531327 - RNA, 13 nt, Homo sapiens
gagacuaauucua

SEQ ID NO: 1531328 - RNA, 18 nt, Homo sapiens
gagcaagaccccaucuca

SEQ ID NO: 1531329 - RNA, 12 nt, Homo sapiens
gagcacugugag

SEQ ID NO: 1531330 - RNA, 23 nt, Homo sapiens
gagcagagcugauggagaaggaa

SEQ ID NO: 1531331 - RNA, 17 nt, Homo sapiens
gagcgcuaccucuccag

SEQ ID NO: 1531332 - RNA, 15 nt, Homo sapiens
gaggccuauuguuga

SEQ ID NO: 1531333 - RNA, 19 nt, Homo sapiens
gaguugaucaaaaucaauu

SEQ ID NO: 1531334 - RNA, 20 nt, Homo sapiens
gauaaucacaauacaucccu

SEQ ID NO: 1531335 - RNA, 14 nt, Homo sapiens
gaucaaaaucaauu

SEQ ID NO: 1531336 - RNA, 17 nt, Homo sapiens
gauuacaggcauguguc

SEQ ID NO: 1531337 - RNA, 23 nt, Homo sapiens
gcaaauaguaaucuguaagcaua

SEQ ID NO: 1531338 - RNA, 14 nt, Homo sapiens
gcaaauugucacag

SEQ ID NO: 1531339 - RNA, 17 nt, Homo sapiens
gcaacagccaaguggaa

SEQ ID NO: 1531340 - RNA, 17 nt, Homo sapiens
gcaagaccccaucucaa

SEQ ID NO: 1531341 - RNA, 18 nt, Homo sapiens
gcaaggccugguguuucu

SEQ ID NO: 1531342 - RNA, 23 nt, Homo sapiens
gcaaguaaaaaggcuaaauggaa

SEQ ID NO: 1531343 - RNA, 15 nt, Homo sapiens
gcacugcuccagugg

SEQ ID NO: 1531344 - RNA, 16 nt, Homo sapiens
gcacugugagcaccug

SEQ ID NO: 1531345 - RNA, 22 nt, Homo sapiens
gcagaagucaacgccucggugg

SEQ ID NO: 1531346 - RNA, 20 nt, Homo sapiens
gcagauuuccagccuucuac

SEQ ID NO: 1531347 - RNA, 22 nt, Homo sapiens
gcaguggcaucaucucagcuca

SEQ ID NO: 1531348 - RNA, 17 nt, Homo sapiens
gcauuccaacuaucuca

SEQ ID NO: 1531349 - RNA, 20 nt, Homo sapiens
gccaagagccugagugacag

SEQ ID NO: 1531350 - RNA, 19 nt, Homo sapiens
gccacagggccuuuggcag

SEQ ID NO: 1531351 - RNA, 20 nt, Homo sapiens
gccagaccauggacacuaca

SEQ ID NO: 1531352 - RNA, 20 nt, Homo sapiens
gccaggaagaucccccagaa

SEQ ID NO: 1531353 - RNA, 18 nt, Homo sapiens
gccagugccagcaccugc

SEQ ID NO: 1531354 - RNA, 18 nt, Homo sapiens
gccccuggucccucugca

SEQ ID NO: 1531355 - RNA, 17 nt, Homo sapiens
gcccggaguggacugau

SEQ ID NO: 1531356 - RNA, 16 nt, Homo sapiens
gccggaucugagggag

SEQ ID NO: 1531357 - RNA, 15 nt, Homo sapiens
gccuauuguugaaua

SEQ ID NO: 1531358 - RNA, 17 nt, Homo sapiens
gccucccauguucaagc

SEQ ID NO: 1531359 - RNA, 19 nt, Homo sapiens
gccuucucuaaacauuuca

SEQ ID NO: 1531360 - RNA, 20 nt, Homo sapiens
gccuuggggcugaugcaguu

SEQ ID NO: 1531361 - RNA, 21 nt, Homo sapiens
gcgcccuuaacugcauccagc

SEQ ID NO: 1531362 - RNA, 17 nt, Homo sapiens
gcgugggcgcuugcacc

SEQ ID NO: 1531363 - RNA, 13 nt, Homo sapiens
gcuaaguacacaa

SEQ ID NO: 1531364 - RNA, 17 nt, Homo sapiens
gcuacagaagaaacugg

SEQ ID NO: 1531365 - RNA, 16 nt, Homo sapiens
gcuaccucuccagccu

SEQ ID NO: 1531366 - RNA, 16 nt, Homo sapiens
gcucacugcaaccucc

SEQ ID NO: 1531367 - RNA, 16 nt, Homo sapiens
gcucacugcaaccucu

SEQ ID NO: 1531368 - RNA, 17 nt, Homo sapiens
gcucacugcaaccucug

SEQ ID NO: 1531369 - RNA, 11 nt, Homo sapiens
gcucauuucag

SEQ ID NO: 1531370 - RNA, 17 nt, Homo sapiens
gcucuccuccaccucaa

SEQ ID NO: 1531371 - RNA, 21 nt, Homo sapiens
gcugaggcugaggcacuggcg

SEQ ID NO: 1531372 - RNA, 14 nt, Homo sapiens
gcugcaugcgagug

SEQ ID NO: 1531373 - RNA, 20 nt, Homo sapiens
gcuggagugcaguggcgcga

SEQ ID NO: 1531374 - RNA, 22 nt, Homo sapiens
gcugucagcccaugugcaccug

SEQ ID NO: 1531375 - RNA, 21 nt, Homo sapiens
gcuucucagauuucugaggaa

SEQ ID NO: 1531376 - RNA, 23 nt, Homo sapiens
ggaaccacaagacugcacaucaa

SEQ ID NO: 1531377 - RNA, 21 nt, Homo sapiens
ggaagacgugcgcgaugugac

SEQ ID NO: 1531378 - RNA, 22 nt, Homo sapiens
ggaagccccauccaacacugga

SEQ ID NO: 1531379 - RNA, 16 nt, Homo sapiens
ggagcucgugggacag

SEQ ID NO: 1531380 - RNA, 20 nt, Homo sapiens
ggaggccagugccagcaccu

SEQ ID NO: 1531381 - RNA, 16 nt, Homo sapiens
ggaggggcagagccag

SEQ ID NO: 1531382 - RNA, 17 nt, Homo sapiens
ggauggguccucacgca

SEQ ID NO: 1531383 - RNA, 17 nt, Homo sapiens
ggcauacagacugggga

SEQ ID NO: 1531384 - RNA, 20 nt, Homo sapiens
ggcccugccaugcucuccaa

SEQ ID NO: 1531385 - RNA, 15 nt, Homo sapiens
ggccuauuguugaau

SEQ ID NO: 1531386 - RNA, 23 nt, Homo sapiens
ggccuuguuucaaaauucucauu

SEQ ID NO: 1531387 - RNA, 14 nt, Homo sapiens
ggcgagcacuguga

SEQ ID NO: 1531388 - RNA, 17 nt, Homo sapiens
ggcgaggagagggcgcu

SEQ ID NO: 1531389 - RNA, 15 nt, Homo sapiens
ggcgcaggugcacag

SEQ ID NO: 1531390 - RNA, 16 nt, Homo sapiens
ggcuggagugcagugg

SEQ ID NO: 1531391 - RNA, 20 nt, Homo sapiens
ggcuggagugcaguggcgcg

SEQ ID NO: 1531392 - RNA, 13 nt, Homo sapiens
ggcugucagccca

SEQ ID NO: 1531393 - RNA, 22 nt, Homo sapiens
ggcuucccaaaguccugggauu

SEQ ID NO: 1531394 - RNA, 23 nt, Homo sapiens
gggaauggaggggcagagccagg

SEQ ID NO: 1531395 - RNA, 16 nt, Homo sapiens
gggacagucaccucau

SEQ ID NO: 1531396 - RNA, 16 nt, Homo sapiens
gggcaagggaccugcu

SEQ ID NO: 1531397 - RNA, 15 nt, Homo sapiens
gggcagagccaggaa

SEQ ID NO: 1531398 - RNA, 14 nt, Homo sapiens
gggcugaugcaguu

SEQ ID NO: 1531399 - RNA, 16 nt, Homo sapiens
ggggcugaugcaguug

SEQ ID NO: 1531400 - RNA, 15 nt, Homo sapiens
ggguaccuggcuaug

SEQ ID NO: 1531401 - RNA, 22 nt, Homo sapiens
ggguaggaaagaggaagcaaau

SEQ ID NO: 1531402 - RNA, 18 nt, Homo sapiens
ggucccucugcagucucu

SEQ ID NO: 1531403 - RNA, 19 nt, Homo sapiens
ggugugagccaccacaucc

SEQ ID NO: 1531404 - RNA, 16 nt, Homo sapiens
gguuggagugcagugg

SEQ ID NO: 1531405 - RNA, 20 nt, Homo sapiens
gguuggagugcaguggcgug

SEQ ID NO: 1531406 - RNA, 15 nt, Homo sapiens
gguuuugaaauccca

SEQ ID NO: 1531407 - RNA, 18 nt, Homo sapiens
guaaaaucaaaugugcau

SEQ ID NO: 1531408 - RNA, 23 nt, Homo sapiens
guacaugauaaaugauagacaau

SEQ ID NO: 1531409 - RNA, 15 nt, Homo sapiens
guagagaagcaagua

SEQ ID NO: 1531410 - RNA, 15 nt, Homo sapiens
guagauaggccaugg

SEQ ID NO: 1531411 - RNA, 19 nt, Homo sapiens
guaggaaagaggaagcaaa

SEQ ID NO: 1531412 - RNA, 16 nt, Homo sapiens
guaggggcuacuguga

SEQ ID NO: 1531413 - RNA, 11 nt, Homo sapiens
guauacuauag

SEQ ID NO: 1531414 - RNA, 18 nt, Homo sapiens
guauauuacaaugaucac

SEQ ID NO: 1531415 - RNA, 17 nt, Homo sapiens
guaucucuucagucucu

SEQ ID NO: 1531416 - RNA, 20 nt, Homo sapiens
guaucucuucagucucuaua

SEQ ID NO: 1531417 - RNA, 21 nt, Homo sapiens
guaugauucccagccagcaca

SEQ ID NO: 1531418 - RNA, 22 nt, Homo sapiens
guaugcacaguaaaaauggaaa

SEQ ID NO: 1531419 - RNA, 18 nt, Homo sapiens
gucacguuuggugcuucu

SEQ ID NO: 1531420 - RNA, 14 nt, Homo sapiens
gucagcccaugugc

SEQ ID NO: 1531421 - RNA, 17 nt, Homo sapiens
gucagcccaugugcacc

SEQ ID NO: 1531422 - RNA, 14 nt, Homo sapiens
guccccuaccccca

SEQ ID NO: 1531423 - RNA, 21 nt, Homo sapiens
guccccuacccccaguaaaau

SEQ ID NO: 1531424 - RNA, 21 nt, Homo sapiens
gucuccuaagcuggagugcag

SEQ ID NO: 1531425 - RNA, 19 nt, Homo sapiens
gucucuauaccaauaaagu

SEQ ID NO: 1531426 - RNA, 23 nt, Homo sapiens
gugaccauggaggccagugccag

SEQ ID NO: 1531427 - RNA, 16 nt, Homo sapiens
gugacccugcucucac

SEQ ID NO: 1531428 - RNA, 13 nt, Homo sapiens
gugagaccaccuc

SEQ ID NO: 1531429 - RNA, 15 nt, Homo sapiens
gugaucucagcucac

SEQ ID NO: 1531430 - RNA, 19 nt, Homo sapiens
gugcaaauugucacaggac

SEQ ID NO: 1531431 - RNA, 14 nt, Homo sapiens
uuagcaagacagca

SEQ ID NO: 1531432 - RNA, 22 nt, Homo sapiens
uuagcagucccuccacauuucc

SEQ ID NO: 1531433 - RNA, 22 nt, Homo sapiens
uuaguggagaugggguuucacc

SEQ ID NO: 1531434 - RNA, 15 nt, Homo sapiens
uuauaaaaagaauga

SEQ ID NO: 1531435 - RNA, 12 nt, Homo sapiens
uuauaaucuuuc

SEQ ID NO: 1531436 - RNA, 13 nt, Homo sapiens
uuauaguacauga

SEQ ID NO: 1531437 - RNA, 23 nt, Homo sapiens
uucaagugcuucuccagccucag

SEQ ID NO: 1531438 - RNA, 20 nt, Homo sapiens
uucaauaaagcugcugagaa

SEQ ID NO: 1531439 - RNA, 18 nt, Homo sapiens
uucagucucuauaccaau

SEQ ID NO: 1531440 - RNA, 20 nt, Homo sapiens
uucagucucuauaccaauaa

SEQ ID NO: 1531441 - RNA, 10 nt, Homo sapiens
uucauuccau

SEQ ID NO: 1531442 - RNA, 19 nt, Homo sapiens
uuccagcccaucuccgggg

SEQ ID NO: 1531443 - RNA, 13 nt, Homo sapiens
uuccauucuggaa

SEQ ID NO: 1531444 - RNA, 22 nt, Homo sapiens
uucccaaaagcccauucauucc

SEQ ID NO: 1531445 - RNA, 13 nt, Homo sapiens
uucccaacuccag

SEQ ID NO: 1531446 - RNA, 16 nt, Homo sapiens
uuccuuggccaugcag

SEQ ID NO: 1531447 - RNA, 19 nt, Homo sapiens
uucuccgcaacagccaagu

SEQ ID NO: 1531448 - RNA, 14 nt, Homo sapiens
uucuuacugcuuaa

SEQ ID NO: 1531449 - RNA, 9 nt, Homo sapiens
uugagacag

SEQ ID NO: 1531450 - RNA, 17 nt, Homo sapiens
uugaggacacaugucca

SEQ ID NO: 1531451 - RNA, 17 nt, Homo sapiens
uugaguagaguugauca

SEQ ID NO: 1531452 - RNA, 22 nt, Homo sapiens
uugccaagagccugagugacag

SEQ ID NO: 1531453 - RNA, 17 nt, Homo sapiens
uugcccacagcuguaug

SEQ ID NO: 1531454 - RNA, 14 nt, Homo sapiens
uugcucauggaauu

SEQ ID NO: 1531455 - RNA, 21 nt, Homo sapiens
uuguugaauaaauguaucuga

SEQ ID NO: 1531456 - RNA, 18 nt, Homo sapiens
uuguuucaaaauucucau

SEQ ID NO: 1531457 - RNA, 17 nt, Homo sapiens
uuuaguucuuacugcuu

SEQ ID NO: 1531458 - RNA, 17 nt, Homo sapiens
uuugaacuagaguuuag

SEQ ID NO: 1531459 - RNA, 22 nt, Homo sapiens
uuugcagcuuucucuaguucaa

SEQ ID NO: 1531460 - RNA, 17 nt, Homo sapiens
uuuugaaaucccaucag

SEQ ID NO: 1531461 - RNA, 13 nt, Homo sapiens
uuuugagacagag

SEQ ID NO: 1531462 - RNA, 13 nt, Homo sapiens
uuuuuguuauuaa

SEQ ID NO: 1531463 - RNA, 19 nt, Homo sapiens
uuuuuuaaaaaauagcagc

SEQ ID NO: 1531464 - RNA, 13 nt, Homo sapiens
agcuaaguacaca

SEQ ID NO: 1531465 - RNA, 17 nt, Homo sapiens
agcuaaguacacaauaa

SEQ ID NO: 1531466 - RNA, 20 nt, Homo sapiens
agcuaaguacacaauaagca

SEQ ID NO: 1531467 - RNA, 17 nt, Homo sapiens
agcucacugcaaccucc

SEQ ID NO: 1531468 - RNA, 22 nt, Homo sapiens
agcugagacuacaggcacacac

SEQ ID NO: 1531469 - RNA, 15 nt, Homo sapiens
agcuggagugcagug

SEQ ID NO: 1531470 - RNA, 22 nt, Homo sapiens
agcuguggccuaggcuaccuca

SEQ ID NO: 1531471 - RNA, 14 nt, Homo sapiens
aggaauuacgugcu

SEQ ID NO: 1531472 - RNA, 22 nt, Homo sapiens
aggaauuacgugcucugugggu

SEQ ID NO: 1531473 - RNA, 16 nt, Homo sapiens
aggacagcccuucuuu

SEQ ID NO: 1531474 - RNA, 14 nt, Homo sapiens
aggacuguaaucuu

SEQ ID NO: 1531475 - RNA, 19 nt, Homo sapiens
aggccagugccagcaccug

SEQ ID NO: 1531476 - RNA, 15 nt, Homo sapiens
aggcuaccucaagac

SEQ ID NO: 1531477 - RNA, 14 nt, Homo sapiens
aggcuggagugcag

SEQ ID NO: 1531478 - RNA, 17 nt, Homo sapiens
aggcuggagugcagugg

SEQ ID NO: 1531479 - RNA, 16 nt, Homo sapiens
agggaaaacauuccau

SEQ ID NO: 1531480 - RNA, 17 nt, Homo sapiens
agggaaaacauuccauc

SEQ ID NO: 1531481 - RNA, 18 nt, Homo sapiens
agggaaaacauuccaucc

SEQ ID NO: 1531482 - RNA, 16 nt, Homo sapiens
agggccuguaauccca

SEQ ID NO: 1531483 - RNA, 15 nt, Homo sapiens
aggggcuacugugac

SEQ ID NO: 1531484 - RNA, 23 nt, Homo sapiens
aggucggaccagcuuuucccaaa

SEQ ID NO: 1531485 - RNA, 14 nt, Homo sapiens
agguuggagugcag

SEQ ID NO: 1531486 - RNA, 15 nt, Homo sapiens
agguuggagugcagu

SEQ ID NO: 1531487 - RNA, 16 nt, Homo sapiens
aguaaaaucaaaugug

SEQ ID NO: 1531488 - RNA, 17 nt, Homo sapiens
aguaaaaucaaaugugc

SEQ ID NO: 1531489 - RNA, 20 nt, Homo sapiens
aguaaaaucaaaugugcauc

SEQ ID NO: 1531490 - RNA, 20 nt, Homo sapiens
aguaccgcccucggggcccg

SEQ ID NO: 1531491 - RNA, 22 nt, Homo sapiens
aguagcugggacuauaggcaug

SEQ ID NO: 1531492 - RNA, 16 nt, Homo sapiens
aguaucucuucagucu

SEQ ID NO: 1531493 - RNA, 17 nt, Homo sapiens
aguaucucuucagucuc

SEQ ID NO: 1531494 - RNA, 22 nt, Homo sapiens
agucaggaaagagaacuuccag

SEQ ID NO: 1531495 - RNA, 12 nt, Homo sapiens
agucucuauacc

SEQ ID NO: 1531496 - RNA, 16 nt, Homo sapiens
agucucuauaccaaua

SEQ ID NO: 1531497 - RNA, 14 nt, Homo sapiens
agugacccugcucu

SEQ ID NO: 1531498 - RNA, 16 nt, Homo sapiens
agugacccugcucuca

SEQ ID NO: 1531499 - RNA, 18 nt, Homo sapiens
agugcaguggcaucaucu

SEQ ID NO: 1531500 - RNA, 20 nt, Homo sapiens
agugcaguggcgugaucuca

SEQ ID NO: 1531501 - RNA, 23 nt, Homo sapiens
agugcaguggcgugaucucagcu

SEQ ID NO: 1531502 - RNA, 19 nt, Homo sapiens
agugcugaaggaauggaag

SEQ ID NO: 1531503 - RNA, 22 nt, Homo sapiens
agugcuucuccagccucagccu

SEQ ID NO: 1531504 - RNA, 16 nt, Homo sapiens
aguggcgugaucucag

SEQ ID NO: 1531505 - RNA, 20 nt, Homo sapiens
aguggcgugaucucagcuca

SEQ ID NO: 1531506 - RNA, 19 nt, Homo sapiens
agugggaggugagaccacc

SEQ ID NO: 1531507 - RNA, 12 nt, Homo sapiens
aguuaacuauug

SEQ ID NO: 1531508 - RNA, 14 nt, Homo sapiens
auaaagucucucug

SEQ ID NO: 1531509 - RNA, 20 nt, Homo sapiens
auaaagugacccugcucuca

SEQ ID NO: 1531510 - RNA, 12 nt, Homo sapiens
auaaauguaucu

SEQ ID NO: 1531511 - RNA, 18 nt, Homo sapiens
auaaauguaucugaauau

SEQ ID NO: 1531512 - RNA, 14 nt, Homo sapiens
auaacaaugcugua

SEQ ID NO: 1531513 - RNA, 16 nt, Homo sapiens
auaacuggaaacuuca

SEQ ID NO: 1531514 - RNA, 12 nt, Homo sapiens
auaccuuaucca

SEQ ID NO: 1531515 - RNA, 21 nt, Homo sapiens
auaguaccaguaggggcuuau

SEQ ID NO: 1531516 - RNA, 16 nt, Homo sapiens
auagugggacccuguc

SEQ ID NO: 1531517 - RNA, 17 nt, Homo sapiens
auauauaacaaugcugu

SEQ ID NO: 1531518 - RNA, 15 nt, Homo sapiens
auauauacuaaacaa

SEQ ID NO: 1531519 - RNA, 21 nt, Homo sapiens
auaugccuuuucccaacucca

SEQ ID NO: 1531520 - RNA, 14 nt, Homo sapiens
auauuguuuuacaa

SEQ ID NO: 1531521 - RNA, 23 nt, Homo sapiens
aucaaacaugcauggaugggucc

SEQ ID NO: 1531522 - RNA, 13 nt, Homo sapiens
aucaaaugugcau

SEQ ID NO: 1531523 - RNA, 13 nt, Homo sapiens
aucacacaacuca

SEQ ID NO: 1531524 - RNA, 23 nt, Homo sapiens
auccuaaaugaguaaacccagcu

SEQ ID NO: 1531525 - RNA, 13 nt, Homo sapiens
aucucagcucacu

SEQ ID NO: 1531526 - RNA, 22 nt, Homo sapiens
aucuccagugggaacucuucaa

SEQ ID NO: 1531527 - RNA, 11 nt, Homo sapiens
aucugaauauc

SEQ ID NO: 1531528 - RNA, 17 nt, Homo sapiens
aucuggauuccagagca

SEQ ID NO: 1531529 - RNA, 16 nt, Homo sapiens
aucuguaaaacuaaga

SEQ ID NO: 1531530 - RNA, 23 nt, Homo sapiens
augaccaguaaaggcugcugcua

SEQ ID NO: 1531531 - RNA, 15 nt, Homo sapiens
augauaacuggaaac

SEQ ID NO: 1531532 - RNA, 14 nt, Homo sapiens
augcgggggugccu

SEQ ID NO: 1531533 - RNA, 13 nt, Homo sapiens
auguaaacuacuu

SEQ ID NO: 1531534 - RNA, 15 nt, Homo sapiens
auguauguacuucau

SEQ ID NO: 1531535 - RNA, 13 nt, Homo sapiens
auuacaacuaagu

SEQ ID NO: 1531536 - RNA, 18 nt, Homo sapiens
auuacaggugugagccac

SEQ ID NO: 1531537 - RNA, 19 nt, Homo sapiens
auuaugugacauuuuacau

SEQ ID NO: 1531538 - RNA, 11 nt, Homo sapiens
auucauuccau

SEQ ID NO: 1531539 - RNA, 23 nt, Homo sapiens
auucuuuaaaauuacaacuaagu

SEQ ID NO: 1531540 - RNA, 15 nt, Homo sapiens
auugaggacacugau

SEQ ID NO: 1531541 - RNA, 17 nt, Homo sapiens
auuuauuacuguaagaa

SEQ ID NO: 1531542 - RNA, 15 nt, Homo sapiens
auuucaauauuagca

SEQ ID NO: 1531543 - RNA, 21 nt, Homo sapiens
auuuccuuacagaacuacuuc

SEQ ID NO: 1531544 - RNA, 22 nt, Homo sapiens
auuuccuuacagaacuacuucu

SEQ ID NO: 1531545 - RNA, 19 nt, Homo sapiens
auuuuaaaagaaugauuau

SEQ ID NO: 1531546 - RNA, 16 nt, Homo sapiens
auuuuugagacagagu

SEQ ID NO: 1531547 - RNA, 14 nt, Homo sapiens
caaaaaacuacuuc

SEQ ID NO: 1531548 - RNA, 18 nt, Homo sapiens
caaaagcccauucauucc

SEQ ID NO: 1531549 - RNA, 22 nt, Homo sapiens
caaaagcccauucauuccauuc

SEQ ID NO: 1531550 - RNA, 19 nt, Homo sapiens
caaaaugcuucugcacaca

SEQ ID NO: 1531551 - RNA, 13 nt, Homo sapiens
caaaauucucauu

SEQ ID NO: 1531552 - RNA, 18 nt, Homo sapiens
caaagugcuggcauuaca

SEQ ID NO: 1531553 - RNA, 15 nt, Homo sapiens
caaauaguaaucugu

SEQ ID NO: 1531554 - RNA, 15 nt, Homo sapiens
caacacacacaugcu

SEQ ID NO: 1531555 - RNA, 17 nt, Homo sapiens
caacuaucucauuucca

SEQ ID NO: 1531556 - RNA, 17 nt, Homo sapiens
caagacuauaccuuauc

SEQ ID NO: 1531557 - RNA, 16 nt, Homo sapiens
caagacucaccucauc

SEQ ID NO: 1531558 - RNA, 15 nt, Homo sapiens
caagagccugaguga

SEQ ID NO: 1531559 - RNA, 22 nt, Homo sapiens
caaggagaaugaauacugggaa

SEQ ID NO: 1531560 - RNA, 17 nt, Homo sapiens
caaguagcugagacuac

SEQ ID NO: 1531561 - RNA, 13 nt, Homo sapiens
caauaaagugacc

SEQ ID NO: 1531562 - RNA, 18 nt, Homo sapiens
caauaaagugacccugcu

SEQ ID NO: 1531563 - RNA, 16 nt, Homo sapiens
caauauuagcaagaca

SEQ ID NO: 1531564 - RNA, 16 nt, Homo sapiens
cacaagacugcacauc

SEQ ID NO: 1531565 - RNA, 21 nt, Homo sapiens
cacagccucuuagaugcaguu

SEQ ID NO: 1531566 - RNA, 14 nt, Homo sapiens
cacauccagccuaa

SEQ ID NO: 1531567 - RNA, 13 nt, Homo sapiens
caccauguuggcu

SEQ ID NO: 1531568 - RNA, 18 nt, Homo sapiens
cacccagguuggagugca

SEQ ID NO: 1531569 - RNA, 19 nt, Homo sapiens
cacccagguuggagugcag

SEQ ID NO: 1531570 - RNA, 15 nt, Homo sapiens
cacccagugcugaau

SEQ ID NO: 1531571 - RNA, 14 nt, Homo sapiens
caccgcagaaggaa

SEQ ID NO: 1531572 - RNA, 17 nt, Homo sapiens
caccgcgaggccuauug

SEQ ID NO: 1531573 - RNA, 22 nt, Homo sapiens
caccgcgaggccuauuguugaa

SEQ ID NO: 1531574 - RNA, 19 nt, Homo sapiens
caccucaacuccgugcuua

SEQ ID NO: 1531575 - RNA, 17 nt, Homo sapiens
caccuccugccucaggu

SEQ ID NO: 1531576 - RNA, 13 nt, Homo sapiens
caccugagcauga

SEQ ID NO: 1531577 - RNA, 22 nt, Homo sapiens
cacuacaaccuccgccucccau

SEQ ID NO: 1531578 - RNA, 16 nt, Homo sapiens
cacugugagcaccuga

SEQ ID NO: 1531579 - RNA, 18 nt, Homo sapiens
cacuguggguagacacac

SEQ ID NO: 1531580 - RNA, 13 nt, Homo sapiens
cacuucagccucc

SEQ ID NO: 1531581 - RNA, 17 nt, Homo sapiens
cacuuguguuuugcaag

SEQ ID NO: 1531582 - RNA, 19 nt, Homo sapiens
cagagcacugcuccagugg

SEQ ID NO: 1531583 - RNA, 19 nt, Homo sapiens
cagagcugauggagaagga

SEQ ID NO: 1531584 - RNA, 20 nt, Homo sapiens
cagcaauuuaaauguuauga

SEQ ID NO: 1531585 - RNA, 13 nt, Homo sapiens
cagcaugccuuca

SEQ ID NO: 1531586 - RNA, 19 nt, Homo sapiens
cagccucccaaguagcuga

SEQ ID NO: 1531587 - RNA, 15 nt, Homo sapiens
cagcuuauugucuag

SEQ ID NO: 1531588 - RNA, 18 nt, Homo sapiens
cagcuuauugucuaguga

SEQ ID NO: 1531589 - RNA, 19 nt, Homo sapiens
gcuuauugucuagugaaac

SEQ ID NO: 1531590 - RNA, 14 nt, Homo sapiens
gcuucugcacacaa

SEQ ID NO: 1531591 - RNA, 16 nt, Homo sapiens
gcuugcaccacuuccg

SEQ ID NO: 1531592 - RNA, 16 nt, Homo sapiens
ggaagcccuugccuga

SEQ ID NO: 1531593 - RNA, 13 nt, Homo sapiens
ggaaguccaucug

SEQ ID NO: 1531594 - RNA, 14 nt, Homo sapiens
ggaaguugacuuau

SEQ ID NO: 1531595 - RNA, 18 nt, Homo sapiens
ggacauuugcucauggaa

SEQ ID NO: 1531596 - RNA, 19 nt, Homo sapiens
ggagaaugaauacugggaa

SEQ ID NO: 1531597 - RNA, 20 nt, Homo sapiens
ggagaugaggccagaccaug

SEQ ID NO: 1531598 - RNA, 12 nt, Homo sapiens
ggagugcagugg

SEQ ID NO: 1531599 - RNA, 16 nt, Homo sapiens
ggaguggaugcgauaa

SEQ ID NO: 1531600 - RNA, 22 nt, Homo sapiens
ggaucaguuaacuauugcauuu

SEQ ID NO: 1531601 - RNA, 15 nt, Homo sapiens
ggauggguccucacg

SEQ ID NO: 1531602 - RNA, 14 nt, Homo sapiens
ggcaauagucaaau

SEQ ID NO: 1531603 - RNA, 22 nt, Homo sapiens
ggccagagagggcgugggcgcu

SEQ ID NO: 1531604 - RNA, 15 nt, Homo sapiens
ggccauaaagaucaa

SEQ ID NO: 1531605 - RNA, 19 nt, Homo sapiens
ggcccuaaguuaagcaaaa

SEQ ID NO: 1531606 - RNA, 14 nt, Homo sapiens
ggcccugccaugcu

SEQ ID NO: 1531607 - RNA, 24 nt, Homo sapiens
ggccuaggcuaccucaagacucac

SEQ ID NO: 1531608 - RNA, 18 nt, Homo sapiens
ggccuauuguugaauaaa

SEQ ID NO: 1531609 - RNA, 21 nt, Homo sapiens
ggccuggggcgagcacuguga

SEQ ID NO: 1531610 - RNA, 15 nt, Homo sapiens
ggcgagcacugugag

SEQ ID NO: 1531611 - RNA, 14 nt, Homo sapiens
ggcggccucuugcu

SEQ ID NO: 1531612 - RNA, 16 nt, Homo sapiens
ggcgucccuuccaacc

SEQ ID NO: 1531613 - RNA, 15 nt, Homo sapiens
ggcuggagugcagug

SEQ ID NO: 1531614 - RNA, 22 nt, Homo sapiens
ggcugucaggauucuucaagga

SEQ ID NO: 1531615 - RNA, 12 nt, Homo sapiens
gggacuugcaaa

SEQ ID NO: 1531616 - RNA, 15 nt, Homo sapiens
gggccuguaauccca

SEQ ID NO: 1531617 - RNA, 17 nt, Homo sapiens
gggcgugggcgcuugca

SEQ ID NO: 1531618 - RNA, 13 nt, Homo sapiens
gggcuaccaggaa

SEQ ID NO: 1531619 - RNA, 17 nt, Homo sapiens
gggcuacugugaccaug

SEQ ID NO: 1531620 - RNA, 14 nt, Homo sapiens
ggggcgagcacugu

SEQ ID NO: 1531621 - RNA, 16 nt, Homo sapiens
ggggcgagcacuguga

SEQ ID NO: 1531622 - RNA, 20 nt, Homo sapiens
gguuagggaaaacauuccau

SEQ ID NO: 1531623 - RNA, 13 nt, Homo sapiens
gguucaagugcuu

SEQ ID NO: 1531624 - RNA, 15 nt, Homo sapiens
gguuggagugcagug

SEQ ID NO: 1531625 - RNA, 16 nt, Homo sapiens
guacacugccuucuca

SEQ ID NO: 1531626 - RNA, 20 nt, Homo sapiens
guauuagaauaccacaggaa

SEQ ID NO: 1531627 - RNA, 21 nt, Homo sapiens
gucacccagguuggagugcag

SEQ ID NO: 1531628 - RNA, 22 nt, Homo sapiens
gucacccagguuggagugcagu

SEQ ID NO: 1531629 - RNA, 13 nt, Homo sapiens
gucaccucaugga

SEQ ID NO: 1531630 - RNA, 15 nt, Homo sapiens
gucaggauucuucaa

SEQ ID NO: 1531631 - RNA, 13 nt, Homo sapiens
guccaacugucaa

SEQ ID NO: 1531632 - RNA, 20 nt, Homo sapiens
guccaacugucaaccuagaa

SEQ ID NO: 1531633 - RNA, 12 nt, Homo sapiens
guccccuacccc

SEQ ID NO: 1531634 - RNA, 16 nt, Homo sapiens
gucccuccacauuucc

SEQ ID NO: 1531635 - RNA, 17 nt, Homo sapiens
gucccucugcagucucu

SEQ ID NO: 1531636 - RNA, 18 nt, Homo sapiens
guccucacgcagacacac

SEQ ID NO: 1531637 - RNA, 19 nt, Homo sapiens
guccucacgcagacacacc

SEQ ID NO: 1531638 - RNA, 15 nt, Homo sapiens
gucucuauaccaaua

SEQ ID NO: 1531639 - RNA, 22 nt, Homo sapiens
gucucuauaccaauaaagugac

SEQ ID NO: 1531640 - RNA, 19 nt, Homo sapiens
gucugacuguuuccaucaa

SEQ ID NO: 1531641 - RNA, 19 nt, Homo sapiens
gugaagaggaaaaugccuc

SEQ ID NO: 1531642 - RNA, 17 nt, Homo sapiens
gugacaagcucacagac

SEQ ID NO: 1531643 - RNA, 15 nt, Homo sapiens
gugccagcaccugcc

SEQ ID NO: 1531644 - RNA, 18 nt, Homo sapiens
gugcuggcauuacaggug

SEQ ID NO: 1531645 - RNA, 19 nt, Homo sapiens
guggccuaggcuaccucaa

SEQ ID NO: 1531646 - RNA, 21 nt, Homo sapiens
guuccaguaccgcccucgggg

SEQ ID NO: 1531647 - RNA, 19 nt, Homo sapiens
guuggcuagacuagucuca

SEQ ID NO: 1531648 - RNA, 20 nt, Homo sapiens
guuguaaaccaagugaucaa

SEQ ID NO: 1531649 - RNA, 21 nt, Homo sapiens
guuuacuucaaauuaacucua

SEQ ID NO: 1531650 - RNA, 15 nt, Homo sapiens
guuuugaaaucccau

SEQ ID NO: 1531651 - RNA, 16 nt, Homo sapiens
uaaaagaaugauuaug

SEQ ID NO: 1531652 - RNA, 18 nt, Homo sapiens
uaaaauaauuuuaucucu

SEQ ID NO: 1531653 - RNA, 16 nt, Homo sapiens
uaaaaucaaaugugca

SEQ ID NO: 1531654 - RNA, 17 nt, Homo sapiens
uaaaaucaaaugugcau

SEQ ID NO: 1531655 - RNA, 16 nt, Homo sapiens
uaaagucucucugacu

SEQ ID NO: 1531656 - RNA, 13 nt, Homo sapiens
uaaagugacccug

SEQ ID NO: 1531657 - RNA, 18 nt, Homo sapiens
uaaagugacccuguucuc

SEQ ID NO: 1531658 - RNA, 14 nt, Homo sapiens
uaaauguaucugaa

SEQ ID NO: 1531659 - RNA, 17 nt, Homo sapiens
uaaauguugacauggga

SEQ ID NO: 1531660 - RNA, 21 nt, Homo sapiens
uaagcaaaaugcuucugcaca

SEQ ID NO: 1531661 - RNA, 14 nt, Homo sapiens
uaaucccagcauuu

SEQ ID NO: 1531662 - RNA, 17 nt, Homo sapiens
uaaugaauacauuucca

SEQ ID NO: 1531663 - RNA, 15 nt, Homo sapiens
uacacacgugagcaa

SEQ ID NO: 1531664 - RNA, 11 nt, Homo sapiens
uaccacaggaa

SEQ ID NO: 1531665 - RNA, 13 nt, Homo sapiens
uacccuaaccaag

SEQ ID NO: 1531666 - RNA, 15 nt, Homo sapiens
uaccucaagacucac

SEQ ID NO: 1531667 - RNA, 20 nt, Homo sapiens
uacuucucuuguuagguaau

SEQ ID NO: 1531668 - RNA, 21 nt, Homo sapiens
uagacacgcacggcagccaca

SEQ ID NO: 1531669 - RNA, 14 nt, Homo sapiens
uagauaucaugcaa

SEQ ID NO: 1531670 - RNA, 13 nt, Homo sapiens
uagccugugcacg

SEQ ID NO: 1531671 - RNA, 15 nt, Homo sapiens
uauaacaaugcugua

SEQ ID NO: 1531672 - RNA, 15 nt, Homo sapiens
uauaccucaaugucc

SEQ ID NO: 1531673 - RNA, 12 nt, Homo sapiens
uauauguaccgu

SEQ ID NO: 1531674 - RNA, 15 nt, Homo sapiens
uaugcuuaaauucaa

SEQ ID NO: 1531675 - RNA, 13 nt, Homo sapiens
uauugucuaguga

SEQ ID NO: 1531676 - RNA, 23 nt, Homo sapiens
ucaaaaauuaucuauagcuaagu

SEQ ID NO: 1531677 - RNA, 12 nt, Homo sapiens
ucaaagugcugg

SEQ ID NO: 1531678 - RNA, 16 nt, Homo sapiens
ucaccagagacuuuag

SEQ ID NO: 1531679 - RNA, 20 nt, Homo sapiens
ucacccaggcuggacugcaa

SEQ ID NO: 1531680 - RNA, 14 nt, Homo sapiens
ucaccucauggaau

SEQ ID NO: 1531681 - RNA, 14 nt, Homo sapiens
ucacugcaaccucc

SEQ ID NO: 1531682 - RNA, 16 nt, Homo sapiens
ucacugcaaccuccac

SEQ ID NO: 1531683 - RNA, 21 nt, Homo sapiens
ucacuugucaauaaaauccau

SEQ ID NO: 1531684 - RNA, 23 nt, Homo sapiens
ucagccucccaagcaccugggau

SEQ ID NO: 1531685 - RNA, 14 nt, Homo sapiens
ucaggauucuucaa

SEQ ID NO: 1531686 - RNA, 20 nt, Homo sapiens
ucaggucaccgcgaggccua

SEQ ID NO: 1531687 - RNA, 13 nt, Homo sapiens
ucagucucuauac

SEQ ID NO: 1531688 - RNA, 23 nt, Homo sapiens
ucauaauguggugauggcccuaa

SEQ ID NO: 1531689 - RNA, 16 nt, Homo sapiens
ucaucucggaguucca

SEQ ID NO: 1531690 - RNA, 18 nt, Homo sapiens
ucaugcugugugacucaa

SEQ ID NO: 1531691 - RNA, 13 nt, Homo sapiens
ucauggaauugga

SEQ ID NO: 1531692 - RNA, 18 nt, Homo sapiens
ucauuuguaguugccuua

SEQ ID NO: 1531693 - RNA, 18 nt, Homo sapiens
uccaacccgccggucuca

SEQ ID NO: 1531694 - RNA, 11 nt, Homo sapiens
uccaagcauuu

SEQ ID NO: 1531695 - RNA, 16 nt, Homo sapiens
uccacccagugcugaa

SEQ ID NO: 1531696 - RNA, 14 nt, Homo sapiens
uccagcagauuucc

SEQ ID NO: 1531697 - RNA, 19 nt, Homo sapiens
uccagcccaucuccgggga

SEQ ID NO: 1531698 - RNA, 23 nt, Homo sapiens
uccaggggccacaagaccaucua

SEQ ID NO: 1531699 - RNA, 22 nt, Homo sapiens
uccauaggcgcaggugcacagg

SEQ ID NO: 1531700 - RNA, 16 nt, Homo sapiens
uccauccuugagucaa

SEQ ID NO: 1531701 - RNA, 21 nt, Homo sapiens
uccauccuugagucaaaaaau

SEQ ID NO: 1531702 - RNA, 18 nt, Homo sapiens
uccauggcccugccaugc

SEQ ID NO: 1531703 - RNA, 20 nt, Homo sapiens
ucccaaguaacugggauuac

SEQ ID NO: 1531704 - RNA, 20 nt, Homo sapiens
ucccaaguagcugagacuac

SEQ ID NO: 1531705 - RNA, 22 nt, Homo sapiens
ucccccagaaaagaaagcuaca

SEQ ID NO: 1531706 - RNA, 17 nt, Homo sapiens
uccccugccucaccagc

SEQ ID NO: 1531707 - RNA, 18 nt, Homo sapiens
ucccuacccuaaccaagu

SEQ ID NO: 1531708 - RNA, 15 nt, Homo sapiens
ucccuccacauuucc

SEQ ID NO: 1531709 - RNA, 16 nt, Homo sapiens
ucccucugcagucucu

SEQ ID NO: 1531710 - RNA, 15 nt, Homo sapiens
ucccuucaucuggaa

SEQ ID NO: 1531711 - RNA, 20 nt, Homo sapiens
uccgccucccauguucaagc

SEQ ID NO: 1531712 - RNA, 14 nt, Homo sapiens
uccucucugcacac

SEQ ID NO: 1531713 - RNA, 14 nt, Homo sapiens
uccuggcugggaac

SEQ ID NO: 1531714 - RNA, 18 nt, Homo sapiens
cuaucuuugccacccuca

SEQ ID NO: 1531715 - RNA, 18 nt, Homo sapiens
cuauucaauucuuuuaac

SEQ ID NO: 1531716 - RNA, 18 nt, Homo sapiens
cucaaaccaaaucacuga

SEQ ID NO: 1531717 - RNA, 16 nt, Homo sapiens
cucaagacucaccuca

SEQ ID NO: 1531718 - RNA, 22 nt, Homo sapiens
cucagaaaacaaggaugaauua

SEQ ID NO: 1531719 - RNA, 11 nt, Homo sapiens
cucagcucacu

SEQ ID NO: 1531720 - RNA, 20 nt, Homo sapiens
cucaugcugugugacucaaa

SEQ ID NO: 1531721 - RNA, 19 nt, Homo sapiens
cucauggaauuggagcucg

SEQ ID NO: 1531722 - RNA, 15 nt, Homo sapiens
cucauuuuucauuuc

SEQ ID NO: 1531723 - RNA, 21 nt, Homo sapiens
cuccaggguggcagcaacaau

SEQ ID NO: 1531724 - RNA, 19 nt, Homo sapiens
cucccaaagugcugggauu

SEQ ID NO: 1531725 - RNA, 13 nt, Homo sapiens
cuccgcaacagcc

SEQ ID NO: 1531726 - RNA, 20 nt, Homo sapiens
cuccgugcuuaaccaaagaa

SEQ ID NO: 1531727 - RNA, 19 nt, Homo sapiens
cuccuaagcuggagugcag

SEQ ID NO: 1531728 - RNA, 15 nt, Homo sapiens
cuccuauucaacaca

SEQ ID NO: 1531729 - RNA, 24 nt, Homo sapiens
cucgguggcauacagacuggggac

SEQ ID NO: 1531730 - RNA, 14 nt, Homo sapiens
cucuaaacauuuca

SEQ ID NO: 1531731 - RNA, 12 nt, Homo sapiens
cucuauaccaau

SEQ ID NO: 1531732 - RNA, 20 nt, Homo sapiens
cucucccaaaaaacuacuuc

SEQ ID NO: 1531733 - RNA, 21 nt, Homo sapiens
cucucccaaaaaacuacuucu

SEQ ID NO: 1531734 - RNA, 15 nt, Homo sapiens
cucucucauacccuc

SEQ ID NO: 1531735 - RNA, 22 nt, Homo sapiens
cucuucugaauaaagcaauuag

SEQ ID NO: 1531736 - RNA, 14 nt, Homo sapiens
cucuugcucaguga

SEQ ID NO: 1531737 - RNA, 15 nt, Homo sapiens
cucuuucuuucaaua

SEQ ID NO: 1531738 - RNA, 15 nt, Homo sapiens
cugaaagaugaucau

SEQ ID NO: 1531739 - RNA, 21 nt, Homo sapiens
cugaaaucauacuucuuaggg

SEQ ID NO: 1531740 - RNA, 18 nt, Homo sapiens
cugaauuucccucucuca

SEQ ID NO: 1531741 - RNA, 14 nt, Homo sapiens
cugagaaucuagcc

SEQ ID NO: 1531742 - RNA, 11 nt, Homo sapiens
cugcagucucu

SEQ ID NO: 1531743 - RNA, 15 nt, Homo sapiens
cugcagucucuauac

SEQ ID NO: 1531744 - RNA, 18 nt, Homo sapiens
cugcagucucuauaccaa

SEQ ID NO: 1531745 - RNA, 19 nt, Homo sapiens
cugcagucucuauaccaau

SEQ ID NO: 1531746 - RNA, 18 nt, Homo sapiens
cugcccugccaccugucu

SEQ ID NO: 1531747 - RNA, 20 nt, Homo sapiens
cugccucagguguccgcuau

SEQ ID NO: 1531748 - RNA, 16 nt, Homo sapiens
cuggagugcaguggcg

SEQ ID NO: 1531749 - RNA, 14 nt, Homo sapiens
cuggcaacugcuaa

SEQ ID NO: 1531750 - RNA, 20 nt, Homo sapiens
cuggcugggaacaacuucag

SEQ ID NO: 1531751 - RNA, 22 nt, Homo sapiens
cugggauuacaggugugagcca

SEQ ID NO: 1531752 - RNA, 17 nt, Homo sapiens
cuggucccucugcaguc

SEQ ID NO: 1531753 - RNA, 20 nt, Homo sapiens
cuggucccucugcagucucu

SEQ ID NO: 1531754 - RNA, 16 nt, Homo sapiens
cuguaaaacuaagaaa

SEQ ID NO: 1531755 - RNA, 12 nt, Homo sapiens
cuguaugauucc

SEQ ID NO: 1531756 - RNA, 18 nt, Homo sapiens
cugucaggauucuucaag

SEQ ID NO: 1531757 - RNA, 16 nt, Homo sapiens
cuguccccuaccccca

SEQ ID NO: 1531758 - RNA, 14 nt, Homo sapiens
cugucuacacuaag

SEQ ID NO: 1531759 - RNA, 20 nt, Homo sapiens
cuuaaaauaaugaauacauu

SEQ ID NO: 1531760 - RNA, 19 nt, Homo sapiens
cuuaauaaauuguguuucc

SEQ ID NO: 1531761 - RNA, 23 nt, Homo sapiens
cuuauccauaggcgcaggugcac

SEQ ID NO: 1531762 - RNA, 13 nt, Homo sapiens
cuucaaaucaauc

SEQ ID NO: 1531763 - RNA, 11 nt, Homo sapiens
cuucacugaca

SEQ ID NO: 1531764 - RNA, 15 nt, Homo sapiens
cuucagucucuauac

SEQ ID NO: 1531765 - RNA, 20 nt, Homo sapiens
cuucagucucuauaccaaua

SEQ ID NO: 1531766 - RNA, 18 nt, Homo sapiens
cuugauacauguaauucu

SEQ ID NO: 1531767 - RNA, 19 nt, Homo sapiens
cuugucaauaaaauccaua

SEQ ID NO: 1531768 - RNA, 20 nt, Homo sapiens
cuugucaauaaaauccauac

SEQ ID NO: 1531769 - RNA, 11 nt, Homo sapiens
cuuguccuucc

SEQ ID NO: 1531770 - RNA, 20 nt, Homo sapiens
cuuuaaaauuacaacuaagu

SEQ ID NO: 1531771 - RNA, 16 nt, Homo sapiens
cuuuagccaagugcag

SEQ ID NO: 1531772 - RNA, 18 nt, Homo sapiens
cuuuguauuguauauuac

SEQ ID NO: 1531773 - RNA, 15 nt, Homo sapiens
cuuuuugugucucca

SEQ ID NO: 1531774 - RNA, 17 nt, Homo sapiens
cuuuuuucaaaagaaag

SEQ ID NO: 1531775 - RNA, 15 nt, Homo sapiens
gaaagaggaagcaaa

SEQ ID NO: 1531776 - RNA, 18 nt, Homo sapiens
gaaagcuauauaagacaa

SEQ ID NO: 1531777 - RNA, 17 nt, Homo sapiens
gaaauaaauuuauuuca

SEQ ID NO: 1531778 - RNA, 17 nt, Homo sapiens
gaacauaaaaaggacau

SEQ ID NO: 1531779 - RNA, 15 nt, Homo sapiens
gaacuucccuuaaga

SEQ ID NO: 1531780 - RNA, 14 nt, Homo sapiens
gaagaaacuggggc

SEQ ID NO: 1531781 - RNA, 22 nt, Homo sapiens
gaagaacugaaaucauacuucu

SEQ ID NO: 1531782 - RNA, 18 nt, Homo sapiens
gaagauuuaccacuugug

SEQ ID NO: 1531783 - RNA, 15 nt, Homo sapiens
gaaguugauaugccu

SEQ ID NO: 1531784 - RNA, 14 nt, Homo sapiens
gaauaaauguaucu

SEQ ID NO: 1531785 - RNA, 17 nt, Homo sapiens
gaauaaauguaucugaa

SEQ ID NO: 1531786 - RNA, 21 nt, Homo sapiens
gaauacugggaaucaagacaa

SEQ ID NO: 1531787 - RNA, 17 nt, Homo sapiens
gaauuauauguucagau

SEQ ID NO: 1531788 - RNA, 21 nt, Homo sapiens
gacacuacacccagcaauaga

SEQ ID NO: 1531789 - RNA, 22 nt, Homo sapiens
gacagagcaagaccccaucuca

SEQ ID NO: 1531790 - RNA, 15 nt, Homo sapiens
gacaugggacauuug

SEQ ID NO: 1531791 - RNA, 19 nt, Homo sapiens
gacauugaccuauuuccag

SEQ ID NO: 1531792 - RNA, 15 nt, Homo sapiens
gaccauggaggccag

SEQ ID NO: 1531793 - RNA, 17 nt, Homo sapiens
gaccccaaguuauccac

SEQ ID NO: 1531794 - RNA, 17 nt, Homo sapiens
gaccccagccauccagg

SEQ ID NO: 1531795 - RNA, 23 nt, Homo sapiens
gaccuauuuccagaaauacaauu

SEQ ID NO: 1531796 - RNA, 16 nt, Homo sapiens
gaccucaagugaucug

SEQ ID NO: 1531797 - RNA, 21 nt, Homo sapiens
gacggguuucaccauguuggc

SEQ ID NO: 1531798 - RNA, 19 nt, Homo sapiens
gacucaccucauccuuacc

SEQ ID NO: 1531799 - RNA, 19 nt, Homo sapiens
gagacagaaucucagucug

SEQ ID NO: 1531800 - RNA, 21 nt, Homo sapiens
gagacagagucuuacucuguu

SEQ ID NO: 1531801 - RNA, 20 nt, Homo sapiens
gagacggguuucaccauguu

SEQ ID NO: 1531802 - RNA, 18 nt, Homo sapiens
gagagacacacugaagaa

SEQ ID NO: 1531803 - RNA, 19 nt, Homo sapiens
gagaggcugggaauggagg

SEQ ID NO: 1531804 - RNA, 19 nt, Homo sapiens
gagauaccccaccucccuc

SEQ ID NO: 1531805 - RNA, 16 nt, Homo sapiens
gagccaccacauccag

SEQ ID NO: 1531806 - RNA, 23 nt, Homo sapiens
gagcccggaguggacugauuuuc

SEQ ID NO: 1531807 - RNA, 12 nt, Homo sapiens
gagccugaguga

SEQ ID NO: 1531808 - RNA, 16 nt, Homo sapiens
gaggccuauuguugaa

SEQ ID NO: 1531809 - RNA, 23 nt, Homo sapiens
gaggccuauuguugaauaaaugu

SEQ ID NO: 1531810 - RNA, 16 nt, Homo sapiens
gaggugagaccaccuc

SEQ ID NO: 1531811 - RNA, 19 nt, Homo sapiens
gagugcaguggcgugaucu

SEQ ID NO: 1531812 - RNA, 17 nt, Homo sapiens
gauaaaugauagacaau

SEQ ID NO: 1531813 - RNA, 20 nt, Homo sapiens
gauauaauucuuaugccaua

SEQ ID NO: 1531814 - RNA, 14 nt, Homo sapiens
gauaucaugcaaau

SEQ ID NO: 1531815 - RNA, 14 nt, Homo sapiens
gaucucagcucacu

SEQ ID NO: 1531816 - RNA, 22 nt, Homo sapiens
gauggccuuguuucaaaauucu

SEQ ID NO: 1531817 - RNA, 14 nt, Homo sapiens
gauggguccucacg

SEQ ID NO: 1531818 - RNA, 22 nt, Homo sapiens
gauuaaguaaugauaacuggaa

SEQ ID NO: 1531819 - RNA, 15 nt, Homo sapiens
gauuacaggugugag

SEQ ID NO: 1531820 - RNA, 19 nt, Homo sapiens
gauuacaggugugagccac

SEQ ID NO: 1531821 - RNA, 15 nt, Homo sapiens
gauucugcagcaccg

SEQ ID NO: 1531822 - RNA, 17 nt, Homo sapiens
gcaaauaguaaucugua

SEQ ID NO: 1531823 - RNA, 16 nt, Homo sapiens
gcaaguuuccaucauc

SEQ ID NO: 1531824 - RNA, 22 nt, Homo sapiens
gcaauccucccacuucagccuc

SEQ ID NO: 1531825 - RNA, 22 nt, Homo sapiens
gcacagccucuuagaugcaguu

SEQ ID NO: 1531826 - RNA, 18 nt, Homo sapiens
gcacauuuaaggcgccau

SEQ ID NO: 1531827 - RNA, 17 nt, Homo sapiens
gcacugugagcaccuga

SEQ ID NO: 1531828 - RNA, 9 nt, Homo sapiens
gcagcuuua

SEQ ID NO: 1531829 - RNA, 21 nt, Homo sapiens
gcagcuuuagccaagugcagg

SEQ ID NO: 1531830 - RNA, 19 nt, Homo sapiens
gcagucccuccacauuucc

SEQ ID NO: 1531831 - RNA, 20 nt, Homo sapiens
gcagucucuauaccaauaaa

SEQ ID NO: 1531832 - RNA, 16 nt, Homo sapiens
gcaguggcaucaucuc

SEQ ID NO: 1531833 - RNA, 22 nt, Homo sapiens
gcaguggcgugaucucagcuca

SEQ ID NO: 1531834 - RNA, 23 nt, Homo sapiens
gcauacagacuggggacccugga

SEQ ID NO: 1531835 - RNA, 18 nt, Homo sapiens
gcaucaucucagcucacu

SEQ ID NO: 1531836 - RNA, 12 nt, Homo sapiens
gcauuacaggug

SEQ ID NO: 1531837 - RNA, 13 nt, Homo sapiens
gccagcacagccu

SEQ ID NO: 1531838 - RNA, 20 nt, Homo sapiens
gccccauccaacacuggaug

SEQ ID NO: 1531839 - RNA, 22 nt, Homo sapiens
gccccccagccuucacugacag

SEQ ID NO: 1531840 - RNA, 20 nt, Homo sapiens
gccccuggucccucugcagu

SEQ ID NO: 1531841 - RNA, 20 nt, Homo sapiens
gcccuucuauacccacccag

SEQ ID NO: 1531842 - RNA, 19 nt, Homo sapiens
gccuaaguccaguguuucu

SEQ ID NO: 1531843 - RNA, 21 nt, Homo sapiens
gccuauuguugaauaaaugua

SEQ ID NO: 1531844 - RNA, 20 nt, Homo sapiens
gccuccauggcagaagucaa

SEQ ID NO: 1531845 - RNA, 19 nt, Homo sapiens
gccuccccugccucaccag

SEQ ID NO: 1531846 - RNA, 17 nt, Homo sapiens
gccucuuagaugcaguu

SEQ ID NO: 1531847 - RNA, 14 nt, Homo sapiens
gccugaaagcaaga

SEQ ID NO: 1531848 - RNA, 13 nt, Homo sapiens
gccuucacugaca

SEQ ID NO: 1531849 - RNA, 14 nt, Homo sapiens
gccuucacugacag

SEQ ID NO: 1531850 - RNA, 18 nt, Homo sapiens
gccuucuacugcucuccu

SEQ ID NO: 1531851 - RNA, 21 nt, Homo sapiens
gcgagcacugugagcaccuga

SEQ ID NO: 1531852 - RNA, 14 nt, Homo sapiens
gcgcgugcacacac

SEQ ID NO: 1531853 - RNA, 22 nt, Homo sapiens
gcguuuuuuaaauguauacuau

SEQ ID NO: 1531854 - RNA, 13 nt, Homo sapiens
gcuaccaggaaag

SEQ ID NO: 1531855 - RNA, 14 nt, Homo sapiens
gcuagacuagucuc

SEQ ID NO: 1531856 - RNA, 16 nt, Homo sapiens
gcuccaucuccagugg

SEQ ID NO: 1531857 - RNA, 13 nt, Homo sapiens
gcuccggggccag

SEQ ID NO: 1531858 - RNA, 18 nt, Homo sapiens
gcugaaggcuuacuucag

SEQ ID NO: 1531859 - RNA, 20 nt, Homo sapiens
gcugaauuucccucucucau

SEQ ID NO: 1531860 - RNA, 16 nt, Homo sapiens
gcugagucaaucaaua

SEQ ID NO: 1531861 - RNA, 18 nt, Homo sapiens
gcugauggccuuguuuca

SEQ ID NO: 1531862 - RNA, 20 nt, Homo sapiens
gcugauggccuuguuucaaa

SEQ ID NO: 1531863 - RNA, 12 nt, Homo sapiens
gcugcagcugug

SEQ ID NO: 1531864 - RNA, 10 nt, Homo sapiens
gcugcugaga

SEQ ID NO: 1531865 - RNA, 20 nt, Homo sapiens
gcugcugagaaucuagccuc

SEQ ID NO: 1531866 - RNA, 16 nt, Homo sapiens
ggaauuacgugcucug

SEQ ID NO: 1531867 - RNA, 14 nt, Homo sapiens
ggacaggauccagg

SEQ ID NO: 1531868 - RNA, 19 nt, Homo sapiens
ggacagucaccucauggaa

SEQ ID NO: 1531869 - RNA, 12 nt, Homo sapiens
ggagacuggaaa

SEQ ID NO: 1531870 - RNA, 23 nt, Homo sapiens
ggagugcaguggcaucaucucag

SEQ ID NO: 1531871 - RNA, 22 nt, Homo sapiens
ggauuccagagcacugcuccag

SEQ ID NO: 1531872 - RNA, 21 nt, Homo sapiens
ggcaacuggaaaauacauguc

SEQ ID NO: 1531873 - RNA, 23 nt, Homo sapiens
ggcaagaggaauuacgugcucug

SEQ ID NO: 1531874 - RNA, 16 nt, Homo sapiens
ggcaagggaccugcuu

SEQ ID NO: 1531875 - RNA, 22 nt, Homo sapiens
ggcacuaguauuucuaugaaau

SEQ ID NO: 1531876 - RNA, 12 nt, Homo sapiens
ggcagagaagaa

SEQ ID NO: 1531877 - RNA, 18 nt, Homo sapiens
ggccauaaagaucaaaca

SEQ ID NO: 1531878 - RNA, 15 nt, Homo sapiens
ggccuuguuucaaaa

SEQ ID NO: 1531879 - RNA, 21 nt, Homo sapiens
ggcgagcacugugagcaccug

SEQ ID NO: 1531880 - RNA, 13 nt, Homo sapiens
ggcuaaauggaag

SEQ ID NO: 1531881 - RNA, 19 nt, Homo sapiens
ggcuccaucuccaguggga

SEQ ID NO: 1531882 - RNA, 13 nt, Homo sapiens
ggcugaugcaguu

SEQ ID NO: 1531883 - RNA, 22 nt, Homo sapiens
ggcugggaacaacuucagucca

SEQ ID NO: 1531884 - RNA, 17 nt, Homo sapiens
ggggcgagcacugugag

SEQ ID NO: 1531885 - RNA, 18 nt, Homo sapiens
ggggcgagcacugugagc

SEQ ID NO: 1531886 - RNA, 15 nt, Homo sapiens
ggggcguucgcugcg

SEQ ID NO: 1531887 - RNA, 17 nt, Homo sapiens
ggguagacacacaugaa

SEQ ID NO: 1531888 - RNA, 17 nt, Homo sapiens
ggugcuucucagauuuc

SEQ ID NO: 1531889 - RNA, 15 nt, Homo sapiens
ggugggauuccacuc

SEQ ID NO: 1531890 - RNA, 20 nt, Homo sapiens
ggugggauuccacucgugug

SEQ ID NO: 1531891 - RNA, 14 nt, Homo sapiens
gguuggagugcagu

SEQ ID NO: 1531892 - RNA, 19 nt, Homo sapiens
guagcugagacuacaggca

SEQ ID NO: 1531893 - RNA, 19 nt, Homo sapiens
guauauauguguaugcaca

SEQ ID NO: 1531894 - RNA, 18 nt, Homo sapiens
guaucucuucagucucua

SEQ ID NO: 1531895 - RNA, 19 nt, Homo sapiens
guaucucuucagucucuau

SEQ ID NO: 1531896 - RNA, 20 nt, Homo sapiens
gucagcccaugugcaccugc

SEQ ID NO: 1531897 - RNA, 12 nt, Homo sapiens
gucccucugcag

SEQ ID NO: 1531898 - RNA, 18 nt, Homo sapiens
guccugggauuacaggug

SEQ ID NO: 1531899 - RNA, 22 nt, Homo sapiens
gucuccuaagcuggagugcagu

SEQ ID NO: 1531900 - RNA, 12 nt, Homo sapiens
gucugucccaaa

SEQ ID NO: 1531901 - RNA, 23 nt, Homo sapiens
gugagaccaccucucaauauuca

SEQ ID NO: 1531902 - RNA, 17 nt, Homo sapiens
gugagcaccugagcaug

SEQ ID NO: 1531903 - RNA, 13 nt, Homo sapiens
gugagcacgcuga

SEQ ID NO: 1531904 - RNA, 23 nt, Homo sapiens
gugauauuaaccaggggccauga

SEQ ID NO: 1531905 - RNA, 13 nt, Homo sapiens
gugcaagaugggg

SEQ ID NO: 1531906 - RNA, 19 nt, Homo sapiens
gugcaguggcaucaucuca

SEQ ID NO: 1531907 - RNA, 20 nt, Homo sapiens
gugcaguggcaucaucucag

SEQ ID NO: 1531908 - RNA, 18 nt, Homo sapiens
gugcugaaggaauggaag

SEQ ID NO: 1531909 - RNA, 18 nt, Homo sapiens
gugcuucuccagccucag

SEQ ID NO: 1531910 - RNA, 14 nt, Homo sapiens
guggcgcgaucuca

SEQ ID NO: 1531911 - RNA, 21 nt, Homo sapiens
gugguagagaagcaaguaaaa

SEQ ID NO: 1531912 - RNA, 14 nt, Homo sapiens
guuaugacuaugua

SEQ ID NO: 1531913 - RNA, 15 nt, Homo sapiens
guuaugacuauguaa

SEQ ID NO: 1531914 - RNA, 16 nt, Homo sapiens
guucuuacugcuuaau

SEQ ID NO: 1531915 - RNA, 22 nt, Homo sapiens
guugaauaaauguaucugaaua

SEQ ID NO: 1531916 - RNA, 19 nt, Homo sapiens
guugacuuauaguacauga

SEQ ID NO: 1531917 - RNA, 20 nt, Homo sapiens
guugccaggcuggagugcag

SEQ ID NO: 1531918 - RNA, 13 nt, Homo sapiens
guuggagugcagu

SEQ ID NO: 1531919 - RNA, 16 nt, Homo sapiens
guuucaaaauucucau

SEQ ID NO: 1531920 - RNA, 16 nt, Homo sapiens
guuuuuuaaauguaua

SEQ ID NO: 1531921 - RNA, 21 nt, Homo sapiens
guuuuuugaaauuaugugaca

SEQ ID NO: 1531922 - RNA, 18 nt, Homo sapiens
uaaaaaggcuaaauggaa

SEQ ID NO: 1531923 - RNA, 21 nt, Homo sapiens
uaaaaggaaagaaaacaucuu

SEQ ID NO: 1531924 - RNA, 16 nt, Homo sapiens
uaaaccaagugaucaa

SEQ ID NO: 1531925 - RNA, 14 nt, Homo sapiens
uaaauguauacuau

SEQ ID NO: 1531926 - RNA, 17 nt, Homo sapiens
uaaauguauacuauagu

SEQ ID NO: 1531927 - RNA, 19 nt, Homo sapiens
uaaauguuaugacuaugua

SEQ ID NO: 1531928 - RNA, 14 nt, Homo sapiens
uaaauucaaguuua

SEQ ID NO: 1531929 - RNA, 14 nt, Homo sapiens
uaaauuguguuucc

SEQ ID NO: 1531930 - RNA, 15 nt, Homo sapiens
uaacuauugcauuua

SEQ ID NO: 1531931 - RNA, 17 nt, Homo sapiens
uaagagucauccagcuc

SEQ ID NO: 1531932 - RNA, 17 nt, Homo sapiens
uaagcauuccaacuauc

SEQ ID NO: 1531933 - RNA, 15 nt, Homo sapiens
uaagcuagcaaauag

SEQ ID NO: 1531934 - RNA, 15 nt, Homo sapiens
uaagcuggagugcag

SEQ ID NO: 1531935 - RNA, 16 nt, Homo sapiens
uaagcuggagugcagu

SEQ ID NO: 1531936 - RNA, 21 nt, Homo sapiens
uaagcuuaugcuuaaauucaa

SEQ ID NO: 1531937 - RNA, 16 nt, Homo sapiens
uaaguccaguguuucu

SEQ ID NO: 1531938 - RNA, 18 nt, Homo sapiens
uaaugaauacauuuccaa

SEQ ID NO: 1531939 - RNA, 14 nt, Homo sapiens
uaauucaaauaaua

SEQ ID NO: 1531940 - RNA, 22 nt, Homo sapiens
uacacugccuucucaacuccaa

SEQ ID NO: 1531941 - RNA, 16 nt, Homo sapiens
uacagaacuacuucuu

SEQ ID NO: 1531942 - RNA, 13 nt, Homo sapiens
uacaggugugagc

SEQ ID NO: 1531943 - RNA, 16 nt, Homo sapiens
uacaguuagggcuccu

SEQ ID NO: 1531944 - RNA, 20 nt, Homo sapiens
uacaucccuuaccugggaaa

SEQ ID NO: 1531945 - RNA, 14 nt, Homo sapiens
uaccaauaaaguga

SEQ ID NO: 1531946 - RNA, 18 nt, Homo sapiens
uacccccaguaaaaucaa

SEQ ID NO: 1531947 - RNA, 15 nt, Homo sapiens
uacugcuuaauucaa

SEQ ID NO: 1531948 - RNA, 15 nt, Homo sapiens
uagauaucaugcaaa

SEQ ID NO: 1531949 - RNA, 14 nt, Homo sapiens
uagcagcuuuagcc

SEQ ID NO: 1531950 - RNA, 17 nt, Homo sapiens
uaggcuaccucaagacu

SEQ ID NO: 1531951 - RNA, 17 nt, Homo sapiens
uagggaaaacauuccau

SEQ ID NO: 1531952 - RNA, 13 nt, Homo sapiens
uagucucuuuaaa

SEQ ID NO: 1531953 - RNA, 12 nt, Homo sapiens
uaguugccuuaa

SEQ ID NO: 1531954 - RNA, 23 nt, Homo sapiens
uaguuguaaaccaagugaucaaa

SEQ ID NO: 1531955 - RNA, 22 nt, Homo sapiens
uaguuuuaccuaccccagucuu

SEQ ID NO: 1531956 - RNA, 19 nt, Homo sapiens
uauaaauggaauuacacaa

SEQ ID NO: 1531957 - RNA, 13 nt, Homo sapiens
uauagcuaaguac

SEQ ID NO: 1531958 - RNA, 13 nt, Homo sapiens
uauauguaccgua

SEQ ID NO: 1531959 - RNA, 17 nt, Homo sapiens
uaucucuucagucucua

SEQ ID NO: 1531960 - RNA, 13 nt, Homo sapiens
uaugaacuugagg

SEQ ID NO: 1531961 - RNA, 16 nt, Homo sapiens
aaauuuugaaaacugu

SEQ ID NO: 1531962 - RNA, 19 nt, Homo sapiens
aacacccucacacugggac

SEQ ID NO: 1531963 - RNA, 10 nt, Homo sapiens
aacauuccau

SEQ ID NO: 1531964 - RNA, 21 nt, Homo sapiens
aaccaagguuuugaaauccca

SEQ ID NO: 1531965 - RNA, 20 nt, Homo sapiens
aaccaccgcgcccagccuuu

SEQ ID NO: 1531966 - RNA, 14 nt, Homo sapiens
aaccagagugcuga

SEQ ID NO: 1531967 - RNA, 19 nt, Homo sapiens
aaccauauauauacauaua

SEQ ID NO: 1531968 - RNA, 13 nt, Homo sapiens
aaccccuccacuc

SEQ ID NO: 1531969 - RNA, 13 nt, Homo sapiens
aacccuagcaaaa

SEQ ID NO: 1531970 - RNA, 21 nt, Homo sapiens
aaccucauccucuccacagcu

SEQ ID NO: 1531971 - RNA, 20 nt, Homo sapiens
aaccuccgcauccgggguuc

SEQ ID NO: 1531972 - RNA, 14 nt, Homo sapiens
aaccuccgccuccc

SEQ ID NO: 1531973 - RNA, 20 nt, Homo sapiens
aaccuuccacccagugcuga

SEQ ID NO: 1531974 - RNA, 23 nt, Homo sapiens
aacuacauauuguaaagcccauu

SEQ ID NO: 1531975 - RNA, 19 nt, Homo sapiens
aacuacuucuuacuucuuu

SEQ ID NO: 1531976 - RNA, 12 nt, Homo sapiens
aacuacuucuuu

SEQ ID NO: 1531977 - RNA, 15 nt, Homo sapiens
aacugugcaaggccu

SEQ ID NO: 1531978 - RNA, 20 nt, Homo sapiens
aacuugaggacacaugucca

SEQ ID NO: 1531979 - RNA, 15 nt, Homo sapiens
aagaaaauaucacuu

SEQ ID NO: 1531980 - RNA, 21 nt, Homo sapiens
aagacucaccucauccuuacc

SEQ ID NO: 1531981 - RNA, 19 nt, Homo sapiens
aagccagauuuuccugaaa

SEQ ID NO: 1531982 - RNA, 17 nt, Homo sapiens
aagcccauucauuccau

SEQ ID NO: 1531983 - RNA, 21 nt, Homo sapiens
aagccuuggggcugaugcagu

SEQ ID NO: 1531984 - RNA, 22 nt, Homo sapiens
aaggaaggcuccaucuccagug

SEQ ID NO: 1531985 - RNA, 21 nt, Homo sapiens
aaggacaucagcaaacaggau

SEQ ID NO: 1531986 - RNA, 16 nt, Homo sapiens
aaggcuccaucuccag

SEQ ID NO: 1531987 - RNA, 21 nt, Homo sapiens
aagguacuucaaauccuugaa

SEQ ID NO: 1531988 - RNA, 22 nt, Homo sapiens
aaggucggaccagcuuuuccca

SEQ ID NO: 1531989 - RNA, 16 nt, Homo sapiens
aaggucugcuuuucau

SEQ ID NO: 1531990 - RNA, 18 nt, Homo sapiens
aagguuuugaaaucccau

SEQ ID NO: 1531991 - RNA, 13 nt, Homo sapiens
aaguaacacucac

SEQ ID NO: 1531992 - RNA, 19 nt, Homo sapiens
aagugacaagcucacagac

SEQ ID NO: 1531993 - RNA, 18 nt, Homo sapiens
aagugacccugcucucac

SEQ ID NO: 1531994 - RNA, 15 nt, Homo sapiens
aagugaucaaacuac

SEQ ID NO: 1531995 - RNA, 19 nt, Homo sapiens
aagugcuucuccagccuca

SEQ ID NO: 1531996 - RNA, 19 nt, Homo sapiens
aaguucugguaugaacuug

SEQ ID NO: 1531997 - RNA, 12 nt, Homo sapiens
aaguugacuuau

SEQ ID NO: 1531998 - RNA, 17 nt, Homo sapiens
aauaaaaggucggacca

SEQ ID NO: 1531999 - RNA, 11 nt, Homo sapiens
aauaaagugac

SEQ ID NO: 1532000 - RNA, 20 nt, Homo sapiens
aauaaagugacccugcucuc

SEQ ID NO: 1532001 - RNA, 22 nt, Homo sapiens
aauaaagugacccugcucucac

SEQ ID NO: 1532002 - RNA, 11 nt, Homo sapiens
aauauucaaua

SEQ ID NO: 1532003 - RNA, 23 nt, Homo sapiens
aauauucaauaaagcugcugaga

SEQ ID NO: 1532004 - RNA, 16 nt, Homo sapiens
aaucaaaugugcaucc

SEQ ID NO: 1532005 - RNA, 22 nt, Homo sapiens
aauccuugaagauuuaccacuu

SEQ ID NO: 1532006 - RNA, 21 nt, Homo sapiens
aaucucaauauuucagauaau

SEQ ID NO: 1532007 - RNA, 17 nt, Homo sapiens
aaucucaauucuucccu

SEQ ID NO: 1532008 - RNA, 18 nt, Homo sapiens
aaugacuucuaguguaga

SEQ ID NO: 1532009 - RNA, 16 nt, Homo sapiens
aaugauagacaauuga

SEQ ID NO: 1532010 - RNA, 15 nt, Homo sapiens
aaugcuucugcacac

SEQ ID NO: 1532011 - RNA, 17 nt, Homo sapiens
aauggucucuaacauuu

SEQ ID NO: 1532012 - RNA, 14 nt, Homo sapiens
aauguaucugaaua

SEQ ID NO: 1532013 - RNA, 10 nt, Homo sapiens
aauucaccuu

SEQ ID NO: 1532014 - RNA, 15 nt, Homo sapiens
aauucccuucaucug

SEQ ID NO: 1532015 - RNA, 21 nt, Homo sapiens
aauucccuucaucuggaacca

SEQ ID NO: 1532016 - RNA, 22 nt, Homo sapiens
aauucuaccaaggucuucuuaa

SEQ ID NO: 1532017 - RNA, 12 nt, Homo sapiens
aauuguguuucc

SEQ ID NO: 1532018 - RNA, 18 nt, Homo sapiens
acaacuaagugauuugua

SEQ ID NO: 1532019 - RNA, 14 nt, Homo sapiens
acaagauugcuuaa

SEQ ID NO: 1532020 - RNA, 23 nt, Homo sapiens
acacggccuggggcgagcacugu

SEQ ID NO: 1532021 - RNA, 16 nt, Homo sapiens
acagaaucucagucug

SEQ ID NO: 1532022 - RNA, 16 nt, Homo sapiens
acagaccuuugaacua

SEQ ID NO: 1532023 - RNA, 20 nt, Homo sapiens
acagagucuuccucugucuc

SEQ ID NO: 1532024 - RNA, 20 nt, Homo sapiens
acagccucuuagaugcaguu

SEQ ID NO: 1532025 - RNA, 15 nt, Homo sapiens
acaggugugagccac

SEQ ID NO: 1532026 - RNA, 21 nt, Homo sapiens
acaguuagggcuccuauucaa

SEQ ID NO: 1532027 - RNA, 18 nt, Homo sapiens
acauauuguaaagcccau

SEQ ID NO: 1532028 - RNA, 17 nt, Homo sapiens
acauuucccccuagccu

SEQ ID NO: 1532029 - RNA, 13 nt, Homo sapiens
acauuuccuuaca

SEQ ID NO: 1532030 - RNA, 15 nt, Homo sapiens
acauuugcucaugga

SEQ ID NO: 1532031 - RNA, 23 nt, Homo sapiens
accaagguuuugaaaucccauca

SEQ ID NO: 1532032 - RNA, 19 nt, Homo sapiens
accaauaaagugacccugu

SEQ ID NO: 1532033 - RNA, 14 nt, Homo sapiens
accauggacacuac

SEQ ID NO: 1532034 - RNA, 14 nt, Homo sapiens
accauggccagcua

SEQ ID NO: 1532035 - RNA, 19 nt, Homo sapiens
acccagaaugagacaucca

SEQ ID NO: 1532036 - RNA, 21 nt, Homo sapiens
acccagaaugagacauccagc

SEQ ID NO: 1532037 - RNA, 18 nt, Homo sapiens
acccagugcugaauuucc

SEQ ID NO: 1532038 - RNA, 13 nt, Homo sapiens
acccugcucucac

SEQ ID NO: 1532039 - RNA, 19 nt, Homo sapiens
accuauuuccagaaauaca

SEQ ID NO: 1532040 - RNA, 12 nt, Homo sapiens
accuccugccuc

SEQ ID NO: 1532041 - RNA, 19 nt, Homo sapiens
accugccucccuucaugca

SEQ ID NO: 1532042 - RNA, 23 nt, Homo sapiens
accuuauccauaggcgcaggugc

SEQ ID NO: 1532043 - RNA, 14 nt, Homo sapiens
accuuccacccagu

SEQ ID NO: 1532044 - RNA, 18 nt, Homo sapiens
acuaauucuaauguggac

SEQ ID NO: 1532045 - RNA, 23 nt, Homo sapiens
acuacaguuagggcuccuauuca

SEQ ID NO: 1532046 - RNA, 22 nt, Homo sapiens
acuaucucauuuccaagcaagu

SEQ ID NO: 1532047 - RNA, 19 nt, Homo sapiens
acuccgugcuuaaccaaag

SEQ ID NO: 1532048 - RNA, 15 nt, Homo sapiens
acugcaaccucugcc

SEQ ID NO: 1532049 - RNA, 16 nt, Homo sapiens
acugcaaccucugccu

SEQ ID NO: 1532050 - RNA, 19 nt, Homo sapiens
acugccuucucaacuccaa

SEQ ID NO: 1532051 - RNA, 14 nt, Homo sapiens
acugcuuaauucaa

SEQ ID NO: 1532052 - RNA, 14 nt, Homo sapiens
acuggaaacuucag

SEQ ID NO: 1532053 - RNA, 17 nt, Homo sapiens
acuggauggucaucucg

SEQ ID NO: 1532054 - RNA, 22 nt, Homo sapiens
acugggacaggggagaaccuag

SEQ ID NO: 1532055 - RNA, 22 nt, Homo sapiens
acuguggguagacacacaugaa

SEQ ID NO: 1532056 - RNA, 14 nt, Homo sapiens
acuuaucaucacac

SEQ ID NO: 1532057 - RNA, 18 nt, Homo sapiens
acuuaucaucacacaacu

SEQ ID NO: 1532058 - RNA, 15 nt, Homo sapiens
acuucccuuaagagu

SEQ ID NO: 1532059 - RNA, 13 nt, Homo sapiens
acuuuuugcagcu

SEQ ID NO: 1532060 - RNA, 12 nt, Homo sapiens
agaaaacaucuu

SEQ ID NO: 1532061 - RNA, 14 nt, Homo sapiens
agaagucaacgccu

SEQ ID NO: 1532062 - RNA, 13 nt, Homo sapiens
agaaucuagccuc

SEQ ID NO: 1532063 - RNA, 14 nt, Homo sapiens
agacagagucuuac

SEQ ID NO: 1532064 - RNA, 18 nt, Homo sapiens
agaccaccucucaauauu

SEQ ID NO: 1532065 - RNA, 18 nt, Homo sapiens
agacgugcgcgaugugac

SEQ ID NO: 1532066 - RNA, 22 nt, Homo sapiens
agacucaccucauccuuaccgc

SEQ ID NO: 1532067 - RNA, 18 nt, Homo sapiens
agacucugggcugucagc

SEQ ID NO: 1532068 - RNA, 20 nt, Homo sapiens
agacuggggacccuggacau

SEQ ID NO: 1532069 - RNA, 20 nt, Homo sapiens
agagacggguuucaccaugu

SEQ ID NO: 1532070 - RNA, 19 nt, Homo sapiens
agagcaagaccccaucuca

SEQ ID NO: 1532071 - RNA, 20 nt, Homo sapiens
agagcaagaccccaucucaa

SEQ ID NO: 1532072 - RNA, 15 nt, Homo sapiens
agagcacugcuccag

SEQ ID NO: 1532073 - RNA, 21 nt, Homo sapiens
agagggcgugggcgcuugcac

SEQ ID NO: 1532074 - RNA, 20 nt, Homo sapiens
agaucaaacaugcauggaug

SEQ ID NO: 1532075 - RNA, 17 nt, Homo sapiens
agaugaggccagaccau

SEQ ID NO: 1532076 - RNA, 14 nt, Homo sapiens
agauuuaccacuug

SEQ ID NO: 1532077 - RNA, 19 nt, Homo sapiens
agcaaaaugcuucugcaca

SEQ ID NO: 1532078 - RNA, 15 nt, Homo sapiens
agcacugcuccagug

SEQ ID NO: 1532079 - RNA, 17 nt, Homo sapiens
agcacugugagcaccug

SEQ ID NO: 1532080 - RNA, 19 nt, Homo sapiens
agcccaugugcaccugccc

SEQ ID NO: 1532081 - RNA, 15 nt, Homo sapiens
agcccugaacgugag

SEQ ID NO: 1532082 - RNA, 18 nt, Homo sapiens
agccucuuagaugcaguu

SEQ ID NO: 1532083 - RNA, 22 nt, Homo sapiens
agcgccuccaacccuagcaaaa

SEQ ID NO: 1532084 - RNA, 13 nt, Homo sapiens
agcuaacuuauca

SEQ ID NO: 1532085 - RNA, 14 nt, Homo sapiens
uccuuccucaagaa

SEQ ID NO: 1532086 - RNA, 21 nt, Homo sapiens
ucucagcucacugcaaccucc

SEQ ID NO: 1532087 - RNA, 14 nt, Homo sapiens
ucucaguugcagcc

SEQ ID NO: 1532088 - RNA, 23 nt, Homo sapiens
ucuccaaaccacuuuuugcagcu

SEQ ID NO: 1532089 - RNA, 13 nt, Homo sapiens
ucuccagccucag

SEQ ID NO: 1532090 - RNA, 23 nt, Homo sapiens
ucuccaucucuugaccucgugau

SEQ ID NO: 1532091 - RNA, 22 nt, Homo sapiens
ucuccgcaacagccaaguggaa

SEQ ID NO: 1532092 - RNA, 13 nt, Homo sapiens
ucucuauaccaau

SEQ ID NO: 1532093 - RNA, 16 nt, Homo sapiens
ucucugguuuacuuca

SEQ ID NO: 1532094 - RNA, 10 nt, Homo sapiens
ucugagacag

SEQ ID NO: 1532095 - RNA, 12 nt, Homo sapiens
ucugagacagaa

SEQ ID NO: 1532096 - RNA, 16 nt, Homo sapiens
ucugcacacaaaacuc

SEQ ID NO: 1532097 - RNA, 14 nt, Homo sapiens
ucugcacaccuacu

SEQ ID NO: 1532098 - RNA, 14 nt, Homo sapiens
ucugcagucucuau

SEQ ID NO: 1532099 - RNA, 15 nt, Homo sapiens
ucugcagucucuaua

SEQ ID NO: 1532100 - RNA, 21 nt, Homo sapiens
ucugcagucucuauaccaaua

SEQ ID NO: 1532101 - RNA, 20 nt, Homo sapiens
ucugccucccagguucaagu

SEQ ID NO: 1532102 - RNA, 18 nt, Homo sapiens
ucuucaaggagaaugaau

SEQ ID NO: 1532103 - RNA, 17 nt, Homo sapiens
ucuucagucucuauacc

SEQ ID NO: 1532104 - RNA, 18 nt, Homo sapiens
ucuucagucucuauacca

SEQ ID NO: 1532105 - RNA, 13 nt, Homo sapiens
ucuuccagcccau

SEQ ID NO: 1532106 - RNA, 22 nt, Homo sapiens
ucuuccagcccaucuccgggga

SEQ ID NO: 1532107 - RNA, 14 nt, Homo sapiens
ucuucucguuuuca

SEQ ID NO: 1532108 - RNA, 15 nt, Homo sapiens
ucuugcucagugaag

SEQ ID NO: 1532109 - RNA, 13 nt, Homo sapiens
ugaaaucccauca

SEQ ID NO: 1532110 - RNA, 18 nt, Homo sapiens
ugaaaucccaucagguca

SEQ ID NO: 1532111 - RNA, 17 nt, Homo sapiens
ugaaggcuuacuucaga

SEQ ID NO: 1532112 - RNA, 21 nt, Homo sapiens
ugacagcccugaacgugagca

SEQ ID NO: 1532113 - RNA, 22 nt, Homo sapiens
ugacuuccugaacaaccagcug

SEQ ID NO: 1532114 - RNA, 21 nt, Homo sapiens
ugagaaagcugauggccuugu

SEQ ID NO: 1532115 - RNA, 20 nt, Homo sapiens
ugagacagagucuuccucug

SEQ ID NO: 1532116 - RNA, 17 nt, Homo sapiens
ugaggccagaccaugga

SEQ ID NO: 1532117 - RNA, 19 nt, Homo sapiens
ugagucaaaaaaucucaau

SEQ ID NO: 1532118 - RNA, 13 nt, Homo sapiens
ugaucucagcuca

SEQ ID NO: 1532119 - RNA, 17 nt, Homo sapiens
ugauggccuuguuucaa

SEQ ID NO: 1532120 - RNA, 13 nt, Homo sapiens
ugauuaugaauua

SEQ ID NO: 1532121 - RNA, 16 nt, Homo sapiens
ugcaaccaucaccaga

SEQ ID NO: 1532122 - RNA, 17 nt, Homo sapiens
ugcaaccucugccuccc

SEQ ID NO: 1532123 - RNA, 12 nt, Homo sapiens
ugcaauguauua

SEQ ID NO: 1532124 - RNA, 19 nt, Homo sapiens
ugcacagggggaggccaua

SEQ ID NO: 1532125 - RNA, 20 nt, Homo sapiens
ugcaccacuuccgucccauc

SEQ ID NO: 1532126 - RNA, 19 nt, Homo sapiens
ugcacgcgcgcgugcacac

SEQ ID NO: 1532127 - RNA, 21 nt, Homo sapiens
ugcagggccuguaaucccagc

SEQ ID NO: 1532128 - RNA, 21 nt, Homo sapiens
ugcaguaggggcuacugugac

SEQ ID NO: 1532129 - RNA, 10 nt, Homo sapiens
ugcagucucu

SEQ ID NO: 1532130 - RNA, 18 nt, Homo sapiens
ugcaguggcgugaucuca

SEQ ID NO: 1532131 - RNA, 19 nt, Homo sapiens
ugcaguggcgugaucucag

SEQ ID NO: 1532132 - RNA, 19 nt, Homo sapiens
ugccaggcuggagugcagu

SEQ ID NO: 1532133 - RNA, 18 nt, Homo sapiens
ugccucccuucaugcaug

SEQ ID NO: 1532134 - RNA, 14 nt, Homo sapiens
ugccuucaaaucaa

SEQ ID NO: 1532135 - RNA, 23 nt, Homo sapiens
ugcggaggaaggaggacccagga

SEQ ID NO: 1532136 - RNA, 19 nt, Homo sapiens
ugcugaaacucagugcaaa

SEQ ID NO: 1532137 - RNA, 16 nt, Homo sapiens
ugcugcuacaaugucc

SEQ ID NO: 1532138 - RNA, 13 nt, Homo sapiens
ugcuuaaauucaa

SEQ ID NO: 1532139 - RNA, 21 nt, Homo sapiens
ugcuuaauaaauuguguuucc

SEQ ID NO: 1532140 - RNA, 22 nt, Homo sapiens
uggaaaaguauguuagugcaaa

SEQ ID NO: 1532141 - RNA, 21 nt, Homo sapiens
uggagaaggaaggcuccaucu

SEQ ID NO: 1532142 - RNA, 17 nt, Homo sapiens
uggagcucgugggacag

SEQ ID NO: 1532143 - RNA, 20 nt, Homo sapiens
uggaggaucauuugagccca

SEQ ID NO: 1532144 - RNA, 16 nt, Homo sapiens
uggcgcgaucucagcu

SEQ ID NO: 1532145 - RNA, 18 nt, Homo sapiens
uggcgcgaucucagcuca

SEQ ID NO: 1532146 - RNA, 22 nt, Homo sapiens
ugggacagucaccucauggaau

SEQ ID NO: 1532147 - RNA, 20 nt, Homo sapiens
ugggacauuugcucauggaa

SEQ ID NO: 1532148 - RNA, 21 nt, Homo sapiens
ugggacauuugcucauggaau

SEQ ID NO: 1532149 - RNA, 22 nt, Homo sapiens
ugggcaagggaccugcuucuau

SEQ ID NO: 1532150 - RNA, 16 nt, Homo sapiens
uggggcugaugcaguu

SEQ ID NO: 1532151 - RNA, 20 nt, Homo sapiens
uggucccucugcagucucua

SEQ ID NO: 1532152 - RNA, 13 nt, Homo sapiens
ugguuuacuucaa

SEQ ID NO: 1532153 - RNA, 14 nt, Homo sapiens
ugucaccaugccca

SEQ ID NO: 1532154 - RNA, 17 nt, Homo sapiens
uguccgcuauccaccaa

SEQ ID NO: 1532155 - RNA, 16 nt, Homo sapiens
uguccuucuccaucua

SEQ ID NO: 1532156 - RNA, 21 nt, Homo sapiens
uguuaaaacugggacagggga

SEQ ID NO: 1532157 - RNA, 13 nt, Homo sapiens
uguuuccacuauu

SEQ ID NO: 1532158 - RNA, 23 nt, Homo sapiens
uguuuuuuuuuuuuuugagacag

SEQ ID NO: 1532159 - RNA, 15 nt, Homo sapiens
uuaacugcauccagc

SEQ ID NO: 1532160 - RNA, 14 nt, Homo sapiens
uuaauaauguuuca

SEQ ID NO: 1532161 - RNA, 21 nt, Homo sapiens
uuacauuuuuugggcagcaau

SEQ ID NO: 1532162 - RNA, 17 nt, Homo sapiens
uuagggaaaacauucca

SEQ ID NO: 1532163 - RNA, 23 nt, Homo sapiens
uuaguuguaaaccaagugaucaa

SEQ ID NO: 1532164 - RNA, 16 nt, Homo sapiens
uuauaaaaagaaugaa

SEQ ID NO: 1532165 - RNA, 21 nt, Homo sapiens
uuauuuaggaaguugacuuau

SEQ ID NO: 1532166 - RNA, 17 nt, Homo sapiens
uucaagugcuucuccag

SEQ ID NO: 1532167 - RNA, 18 nt, Homo sapiens
uucaagugcuucuccagc

SEQ ID NO: 1532168 - RNA, 14 nt, Homo sapiens
uucagucucuauac

SEQ ID NO: 1532169 - RNA, 17 nt, Homo sapiens
uucagucucuauaccaa

SEQ ID NO: 1532170 - RNA, 13 nt, Homo sapiens
uuccagccuucua

SEQ ID NO: 1532171 - RNA, 22 nt, Homo sapiens
uuccagccuucuacugcucucc

SEQ ID NO: 1532172 - RNA, 19 nt, Homo sapiens
uucccaaaagcccauucau

SEQ ID NO: 1532173 - RNA, 22 nt, Homo sapiens
uucccuucaucuggaaccauca

SEQ ID NO: 1532174 - RNA, 23 nt, Homo sapiens
uucucuaguucaaguucaccaga

SEQ ID NO: 1532175 - RNA, 22 nt, Homo sapiens
uucugagaagaaacuuguccuu

SEQ ID NO: 1532176 - RNA, 19 nt, Homo sapiens
uucugggguugcuccgggg

SEQ ID NO: 1532177 - RNA, 15 nt, Homo sapiens
uugaaaacugugcaa

SEQ ID NO: 1532178 - RNA, 18 nt, Homo sapiens
uugaauaaauguaucuga

SEQ ID NO: 1532179 - RNA, 22 nt, Homo sapiens
uugaauaaauguaucugaauau

SEQ ID NO: 1532180 - RNA, 17 nt, Homo sapiens
uugaccucgugauccac

SEQ ID NO: 1532181 - RNA, 12 nt, Homo sapiens
uuggagugcagu

SEQ ID NO: 1532182 - RNA, 13 nt, Homo sapiens
uuggagugcagug

SEQ ID NO: 1532183 - RNA, 23 nt, Homo sapiens
uuuaguuguaaaccaagugauca

SEQ ID NO: 1532184 - RNA, 12 nt, Homo sapiens
uuucaaaauucu

SEQ ID NO: 1532185 - RNA, 12 nt, Homo sapiens
uuugcucaugga

SEQ ID NO: 1532186 - RNA, 18 nt, Homo sapiens
uuuuaaaagaaugauuau

SEQ ID NO: 1532187 - RNA, 11 nt, Homo sapiens
uuuucccaaag

SEQ ID NO: 1532188 - RNA, 15 nt, Homo sapiens
uggcgugaucucagc

SEQ ID NO: 1532189 - RNA, 18 nt, Homo sapiens
uggcgugaucucagcuca

SEQ ID NO: 1532190 - RNA, 19 nt, Homo sapiens
uggcgugaucucagcucac

SEQ ID NO: 1532191 - RNA, 19 nt, Homo sapiens
uggcugauuaucaccaucc

SEQ ID NO: 1532192 - RNA, 13 nt, Homo sapiens
ugggagacuggaa

SEQ ID NO: 1532193 - RNA, 15 nt, Homo sapiens
ugggagacuggaaaa

SEQ ID NO: 1532194 - RNA, 23 nt, Homo sapiens
ugggauuacaggugugagccacc

SEQ ID NO: 1532195 - RNA, 21 nt, Homo sapiens
uggguuagggaaaacauucca

SEQ ID NO: 1532196 - RNA, 20 nt, Homo sapiens
ugguaugaacuugaggacac

SEQ ID NO: 1532197 - RNA, 19 nt, Homo sapiens
uggucccucugcagucucu

SEQ ID NO: 1532198 - RNA, 23 nt, Homo sapiens
uguaagaaaauaucacuugucaa

SEQ ID NO: 1532199 - RNA, 15 nt, Homo sapiens
ugucucuacaaaaaa

SEQ ID NO: 1532200 - RNA, 12 nt, Homo sapiens
ugucugagacag

SEQ ID NO: 1532201 - RNA, 19 nt, Homo sapiens
ugucugagacagaaucuca

SEQ ID NO: 1532202 - RNA, 14 nt, Homo sapiens
ugucugucccaaag

SEQ ID NO: 1532203 - RNA, 18 nt, Homo sapiens
ugugacauuuuacauuaa

SEQ ID NO: 1532204 - RNA, 12 nt, Homo sapiens
ugugagcaccug

SEQ ID NO: 1532205 - RNA, 16 nt, Homo sapiens
ugugaggugggcccca

SEQ ID NO: 1532206 - RNA, 22 nt, Homo sapiens
uguuaaguaacacucaccauca

SEQ ID NO: 1532207 - RNA, 22 nt, Homo sapiens
uguuauaaucuuucacagggga

SEQ ID NO: 1532208 - RNA, 17 nt, Homo sapiens
uguugaauaaauguauc

SEQ ID NO: 1532209 - RNA, 15 nt, Homo sapiens
uguuggccaggcuug

SEQ ID NO: 1532210 - RNA, 20 nt, Homo sapiens
uguuggcuagacuagucuca

SEQ ID NO: 1532211 - RNA, 17 nt, Homo sapiens
uguuucaaaauucucau

SEQ ID NO: 1532212 - RNA, 17 nt, Homo sapiens
uguuuccaucaagggua

SEQ ID NO: 1532213 - RNA, 13 nt, Homo sapiens
uuaaaauaaugaa

SEQ ID NO: 1532214 - RNA, 21 nt, Homo sapiens
uuaaaauaaugaauacauuuc

SEQ ID NO: 1532215 - RNA, 16 nt, Homo sapiens
uuaaauaaagucucuc

SEQ ID NO: 1532216 - RNA, 15 nt, Homo sapiens
uuaaauucaaguuua

SEQ ID NO: 1532217 - RNA, 21 nt, Homo sapiens
uuaaucucugcugaaacucag

SEQ ID NO: 1532218 - RNA, 14 nt, Homo sapiens
uuagaauacaguuu

SEQ ID NO: 1532219 - RNA, 12 nt, Homo sapiens
uuagaugcaguu

SEQ ID NO: 1532220 - RNA, 23 nt, Homo sapiens
uuagguggugguagagaagcaag

SEQ ID NO: 1532221 - RNA, 22 nt, Homo sapiens
uuaguagagacgagguuucacu

SEQ ID NO: 1532222 - RNA, 21 nt, Homo sapiens
uuaucuauagcuaaguacaca

SEQ ID NO: 1532223 - RNA, 16 nt, Homo sapiens
uucaaguuuaguuuga

SEQ ID NO: 1532224 - RNA, 21 nt, Homo sapiens
uucagucucuauaccaauaaa

SEQ ID NO: 1532225 - RNA, 23 nt, Homo sapiens
uucagucucuauaccaauaaagu

SEQ ID NO: 1532226 - RNA, 16 nt, Homo sapiens
uucaucuggauuccag

SEQ ID NO: 1532227 - RNA, 14 nt, Homo sapiens
uucaugcauggaaa

SEQ ID NO: 1532228 - RNA, 14 nt, Homo sapiens
uuccaagcaaguau

SEQ ID NO: 1532229 - RNA, 20 nt, Homo sapiens
uuccuccaagcuauucaauu

SEQ ID NO: 1532230 - RNA, 16 nt, Homo sapiens
uucuauacccacccag

SEQ ID NO: 1532231 - RNA, 17 nt, Homo sapiens
uucuauacccacccaga

SEQ ID NO: 1532232 - RNA, 18 nt, Homo sapiens
uucuauacccacccagaa

SEQ ID NO: 1532233 - RNA, 20 nt, Homo sapiens
uucucaacuccaaacugacu

SEQ ID NO: 1532234 - RNA, 16 nt, Homo sapiens
uucucguuuucacagg

SEQ ID NO: 1532235 - RNA, 16 nt, Homo sapiens
uucucuaaacauuuca

SEQ ID NO: 1532236 - RNA, 19 nt, Homo sapiens
uugaauaaauguaucugaa

SEQ ID NO: 1532237 - RNA, 22 nt, Homo sapiens
uugacaugggacauuugcucau

SEQ ID NO: 1532238 - RNA, 13 nt, Homo sapiens
uugagacagaguc

SEQ ID NO: 1532239 - RNA, 14 nt, Homo sapiens
uugaggacacugau

SEQ ID NO: 1532240 - RNA, 19 nt, Homo sapiens
uugaguagaguugaucaaa

SEQ ID NO: 1532241 - RNA, 11 nt, Homo sapiens
uugcaaacacc

SEQ ID NO: 1532242 - RNA, 19 nt, Homo sapiens
uugccaggcuggagugcag

SEQ ID NO: 1532243 - RNA, 20 nt, Homo sapiens
uugccaggcuggagugcagu

SEQ ID NO: 1532244 - RNA, 13 nt, Homo sapiens
uugcuaagcauuc

SEQ ID NO: 1532245 - RNA, 12 nt, Homo sapiens
uuggaaagcagc

SEQ ID NO: 1532246 - RNA, 14 nt, Homo sapiens
uuggcuucccaaag

SEQ ID NO: 1532247 - RNA, 12 nt, Homo sapiens
uugucacaggac

SEQ ID NO: 1532248 - RNA, 15 nt, Homo sapiens
uugucugagacagaa

SEQ ID NO: 1532249 - RNA, 16 nt, Homo sapiens
uuuaaaagaaugauua

SEQ ID NO: 1532250 - RNA, 23 nt, Homo sapiens
uuuaagaaauaaauuuauuucaa

SEQ ID NO: 1532251 - RNA, 15 nt, Homo sapiens
uuucaaaauucucau

SEQ ID NO: 1532252 - RNA, 15 nt, Homo sapiens
uuucaccauguuggc

SEQ ID NO: 1532253 - RNA, 21 nt, Homo sapiens
uuucccucucucauacccucc

SEQ ID NO: 1532254 - RNA, 14 nt, Homo sapiens
uuugaaaucccauc

SEQ ID NO: 1532255 - RNA, 10 nt, Homo sapiens
uuugagacag

SEQ ID NO: 1532256 - RNA, 22 nt, Homo sapiens
uuugcccugcccucucccaaaa

SEQ ID NO: 1532257 - RNA, 22 nt, Homo sapiens
uuugccuucucuaaacauuuca

SEQ ID NO: 1532258 - RNA, 23 nt, Homo sapiens
uuugucugagacagaaucucagu

SEQ ID NO: 1532259 - RNA, 20 nt, Homo sapiens
uuuuaaauguauacuauagu

SEQ ID NO: 1532260 - RNA, 22 nt, Homo sapiens
gcaguggcgcgaucucagcuca

SEQ ID NO: 1532261 - RNA, 17 nt, Homo sapiens
gcaguggcgugaucuca

SEQ ID NO: 1532262 - RNA, 18 nt, Homo sapiens
gcaguggcgugaucucag

SEQ ID NO: 1532263 - RNA, 21 nt, Homo sapiens
gcaguggcgugaucucagcuc

SEQ ID NO: 1532264 - RNA, 16 nt, Homo sapiens
gcaguucugaagaaga

SEQ ID NO: 1532265 - RNA, 19 nt, Homo sapiens
gcauaagcuuaugcuuaaa

SEQ ID NO: 1532266 - RNA, 18 nt, Homo sapiens
gcauggauggguccucac

SEQ ID NO: 1532267 - RNA, 13 nt, Homo sapiens
gccagaccaugga

SEQ ID NO: 1532268 - RNA, 18 nt, Homo sapiens
gccagaccauggacacua

SEQ ID NO: 1532269 - RNA, 22 nt, Homo sapiens
gccagauuuuccugaaaacccu

SEQ ID NO: 1532270 - RNA, 19 nt, Homo sapiens
gccaggcuggagugcagug

SEQ ID NO: 1532271 - RNA, 20 nt, Homo sapiens
gccaggcuggagugcagugg

SEQ ID NO: 1532272 - RNA, 17 nt, Homo sapiens
gccagugccagcaccug

SEQ ID NO: 1532273 - RNA, 16 nt, Homo sapiens
gcccaugugcaccugc

SEQ ID NO: 1532274 - RNA, 16 nt, Homo sapiens
gcccugccaugcucuc

SEQ ID NO: 1532275 - RNA, 15 nt, Homo sapiens
gcccugcccugccac

SEQ ID NO: 1532276 - RNA, 16 nt, Homo sapiens
gccuauuguugaauaa

SEQ ID NO: 1532277 - RNA, 17 nt, Homo sapiens
gccuauuguugaauaaa

SEQ ID NO: 1532278 - RNA, 19 nt, Homo sapiens
gccuccaacccuagcaaaa

SEQ ID NO: 1532279 - RNA, 21 nt, Homo sapiens
gccucccaaagugcugggauu

SEQ ID NO: 1532280 - RNA, 14 nt, Homo sapiens
gccucccaagcacc

SEQ ID NO: 1532281 - RNA, 15 nt, Homo sapiens
gccucccauguucaa

SEQ ID NO: 1532282 - RNA, 20 nt, Homo sapiens
gcgagcacugugagcaccug

SEQ ID NO: 1532283 - RNA, 15 nt, Homo sapiens
gcgaggccuauuguu

SEQ ID NO: 1532284 - RNA, 18 nt, Homo sapiens
gcgaggccuauuguugaa

SEQ ID NO: 1532285 - RNA, 16 nt, Homo sapiens
gcgagugcucauuuca

SEQ ID NO: 1532286 - RNA, 14 nt, Homo sapiens
gcgaucucagcuca

SEQ ID NO: 1532287 - RNA, 17 nt, Homo sapiens
gcgcgaucucagcucac

SEQ ID NO: 1532288 - RNA, 14 nt, Homo sapiens
gcgcgcgugcacac

SEQ ID NO: 1532289 - RNA, 12 nt, Homo sapiens
gcggccacugcg

SEQ ID NO: 1532290 - RNA, 13 nt, Homo sapiens
gcggccucuugcu

SEQ ID NO: 1532291 - RNA, 15 nt, Homo sapiens
gcucuaaaugucaau

SEQ ID NO: 1532292 - RNA, 22 nt, Homo sapiens
gcucuugcucagugaagaggaa

SEQ ID NO: 1532293 - RNA, 12 nt, Homo sapiens
gcugaugcaguu

SEQ ID NO: 1532294 - RNA, 19 nt, Homo sapiens
gcugcugagaaucuagccu

SEQ ID NO: 1532295 - RNA, 23 nt, Homo sapiens
gcuggaaaaguauguuagugcaa

SEQ ID NO: 1532296 - RNA, 14 nt, Homo sapiens
gcuggagugcagug

SEQ ID NO: 1532297 - RNA, 23 nt, Homo sapiens
gcuuuguauucaaaaauuaucua

SEQ ID NO: 1532298 - RNA, 19 nt, Homo sapiens
ggaaaaugccuccauggca

SEQ ID NO: 1532299 - RNA, 17 nt, Homo sapiens
ggaaaccuuccacccag

SEQ ID NO: 1532300 - RNA, 20 nt, Homo sapiens
ggaauuacgugcucuguggg

SEQ ID NO: 1532301 - RNA, 23 nt, Homo sapiens
ggacagcccuucuuuccacagaa

SEQ ID NO: 1532302 - RNA, 19 nt, Homo sapiens
ggagaaggaaggcuccauc

SEQ ID NO: 1532303 - RNA, 19 nt, Homo sapiens
ggaucaguuaacuauugca

SEQ ID NO: 1532304 - RNA, 12 nt, Homo sapiens
ggaucugaggga

SEQ ID NO: 1532305 - RNA, 15 nt, Homo sapiens
ggcagcaacaauaaa

SEQ ID NO: 1532306 - RNA, 12 nt, Homo sapiens
ggcagcaauuua

SEQ ID NO: 1532307 - RNA, 16 nt, Homo sapiens
ggcauacagacugggg

SEQ ID NO: 1532308 - RNA, 18 nt, Homo sapiens
ggccagugccagcaccug

SEQ ID NO: 1532309 - RNA, 22 nt, Homo sapiens
ggcgcuugcaccacuuccgucc

SEQ ID NO: 1532310 - RNA, 13 nt, Homo sapiens
ggcgugggcgcuu

SEQ ID NO: 1532311 - RNA, 22 nt, Homo sapiens
ggcuaccucaagacucaccuca

SEQ ID NO: 1532312 - RNA, 19 nt, Homo sapiens
ggcuaugcgggggugccua

SEQ ID NO: 1532313 - RNA, 14 nt, Homo sapiens
ggcuggagugcagu

SEQ ID NO: 1532314 - RNA, 14 nt, Homo sapiens
gggaaaacauucca

SEQ ID NO: 1532315 - RNA, 19 nt, Homo sapiens
gggaauugaggacacugau

SEQ ID NO: 1532316 - RNA, 12 nt, Homo sapiens
gggagacuggaa

SEQ ID NO: 1532317 - RNA, 16 nt, Homo sapiens
gggccuguaaucccag

SEQ ID NO: 1532318 - RNA, 13 nt, Homo sapiens
ggggcagagccag

SEQ ID NO: 1532319 - RNA, 14 nt, Homo sapiens
ggggcuacugugac

SEQ ID NO: 1532320 - RNA, 15 nt, Homo sapiens
ggggcugaugcaguu

SEQ ID NO: 1532321 - RNA, 21 nt, Homo sapiens
ggucacguuuggugcuucuca

SEQ ID NO: 1532322 - RNA, 16 nt, Homo sapiens
ggucccucugcagucu

SEQ ID NO: 1532323 - RNA, 18 nt, Homo sapiens
gguggcauacagacuggg

SEQ ID NO: 1532324 - RNA, 19 nt, Homo sapiens
gguuagggaaaacauucca

SEQ ID NO: 1532325 - RNA, 23 nt, Homo sapiens
guaagaaaauaucacuugucaau

SEQ ID NO: 1532326 - RNA, 17 nt, Homo sapiens
guacacaauaagcaaaa

SEQ ID NO: 1532327 - RNA, 17 nt, Homo sapiens
guagagaagcaaguaaa

SEQ ID NO: 1532328 - RNA, 21 nt, Homo sapiens
guaggcuuuguauucaaaaau

SEQ ID NO: 1532329 - RNA, 14 nt, Homo sapiens
guauacuauaguac

SEQ ID NO: 1532330 - RNA, 16 nt, Homo sapiens
guauacuauaguacca

SEQ ID NO: 1532331 - RNA, 23 nt, Homo sapiens
guauguuagugcaaauugucaca

SEQ ID NO: 1532332 - RNA, 18 nt, Homo sapiens
gucaaaaauuaaaccgga

SEQ ID NO: 1532333 - RNA, 18 nt, Homo sapiens
gucaauaaaauccauaca

SEQ ID NO: 1532334 - RNA, 12 nt, Homo sapiens
gucaccagagac

SEQ ID NO: 1532335 - RNA, 17 nt, Homo sapiens
gucagccauaucuccau

SEQ ID NO: 1532336 - RNA, 22 nt, Homo sapiens
gucaggauucuucaaggagaau

SEQ ID NO: 1532337 - RNA, 19 nt, Homo sapiens
guccaggucuaccaaaaau

SEQ ID NO: 1532338 - RNA, 19 nt, Homo sapiens
guccugggauuacaggugu

SEQ ID NO: 1532339 - RNA, 14 nt, Homo sapiens
gucucuauaccaau

SEQ ID NO: 1532340 - RNA, 14 nt, Homo sapiens
gucugucccaaaga

SEQ ID NO: 1532341 - RNA, 15 nt, Homo sapiens
gugacccugcucuca

SEQ ID NO: 1532342 - RNA, 16 nt, Homo sapiens
gugcgcgaugugacag

SEQ ID NO: 1532343 - RNA, 13 nt, Homo sapiens
gugcuuaaccaaa

SEQ ID NO: 1532344 - RNA, 12 nt, Homo sapiens
guggacaccugc

SEQ ID NO: 1532345 - RNA, 14 nt, Homo sapiens
guggcaucaucuca

SEQ ID NO: 1532346 - RNA, 20 nt, Homo sapiens
guggcaucaucucagcucac

SEQ ID NO: 1532347 - RNA, 23 nt, Homo sapiens
guuaagcaaaaugcuucugcaca

SEQ ID NO: 1532348 - RNA, 14 nt, Homo sapiens
guuccaguaccgcc

SEQ ID NO: 1532349 - RNA, 19 nt, Homo sapiens
guugaauaaauguaucuga

SEQ ID NO: 1532350 - RNA, 20 nt, Homo sapiens
guugaauaaauguaucugaa

SEQ ID NO: 1532351 - RNA, 14 nt, Homo sapiens
guuggagugcagug

SEQ ID NO: 1532352 - RNA, 20 nt, Homo sapiens
guuggcuagacuagucucaa

SEQ ID NO: 1532353 - RNA, 14 nt, Homo sapiens
guuguagaagacaa

SEQ ID NO: 1532354 - RNA, 18 nt, Homo sapiens
uaaaaaauagcagcuuua

SEQ ID NO: 1532355 - RNA, 16 nt, Homo sapiens
uaaaaauaaacauguu

SEQ ID NO: 1532356 - RNA, 11 nt, Homo sapiens
uaaaaauggaa

SEQ ID NO: 1532357 - RNA, 18 nt, Homo sapiens
uaaaaucaaaugugcauc

SEQ ID NO: 1532358 - RNA, 17 nt, Homo sapiens
uaaacauguuuccacua

SEQ ID NO: 1532359 - RNA, 13 nt, Homo sapiens
uaaagcugcugag

SEQ ID NO: 1532360 - RNA, 20 nt, Homo sapiens
uaaaugauagacaauugagg

SEQ ID NO: 1532361 - RNA, 18 nt, Homo sapiens
uaaauguauacuauagua

SEQ ID NO: 1532362 - RNA, 16 nt, Homo sapiens
uaaauguuaugacuau

SEQ ID NO: 1532363 - RNA, 21 nt, Homo sapiens
uaaauuuugaaaacugugcaa

SEQ ID NO: 1532364 - RNA, 15 nt, Homo sapiens
uaacaaugcuguauu

SEQ ID NO: 1532365 - RNA, 16 nt, Homo sapiens
uaacacucaccaucag

SEQ ID NO: 1532366 - RNA, 12 nt, Homo sapiens
uaacuuacauuc

SEQ ID NO: 1532367 - RNA, 12 nt, Homo sapiens
uaagaagacugc

SEQ ID NO: 1532368 - RNA, 18 nt, Homo sapiens
uaagaagacugcauuaua

SEQ ID NO: 1532369 - RNA, 19 nt, Homo sapiens
aaggccacugcuacaucuc

SEQ ID NO: 1532370 - RNA, 16 nt, Homo sapiens
aaggccugguguuucu

SEQ ID NO: 1532371 - RNA, 13 nt, Homo sapiens
aaggcuccaucuc

SEQ ID NO: 1532372 - RNA, 16 nt, Homo sapiens
aaggggaggaaccaga

SEQ ID NO: 1532373 - RNA, 13 nt, Homo sapiens
aagguacacuggu

SEQ ID NO: 1532374 - RNA, 23 nt, Homo sapiens
aagguuuugaaaucccaucaggu

SEQ ID NO: 1532375 - RNA, 16 nt, Homo sapiens
aagugacccugcucuc

SEQ ID NO: 1532376 - RNA, 19 nt, Homo sapiens
aagugaucaaacuacauau

SEQ ID NO: 1532377 - RNA, 23 nt, Homo sapiens
aagugcuggcauuacagguguga

SEQ ID NO: 1532378 - RNA, 14 nt, Homo sapiens
aauaaacauguuuc

SEQ ID NO: 1532379 - RNA, 14 nt, Homo sapiens
aauaaagugacccu

SEQ ID NO: 1532380 - RNA, 21 nt, Homo sapiens
aauaaagugacccugcucuca

SEQ ID NO: 1532381 - RNA, 20 nt, Homo sapiens
aauaaauuuauuucaauauu

SEQ ID NO: 1532382 - RNA, 20 nt, Homo sapiens
aauaacgucuuuuuauaucu

SEQ ID NO: 1532383 - RNA, 16 nt, Homo sapiens
aauaaugaauacauuu

SEQ ID NO: 1532384 - RNA, 17 nt, Homo sapiens
aauaaugaauacauuuc

SEQ ID NO: 1532385 - RNA, 17 nt, Homo sapiens
aauaauuaguaagcuag

SEQ ID NO: 1532386 - RNA, 12 nt, Homo sapiens
aauacaugucua

SEQ ID NO: 1532387 - RNA, 19 nt, Homo sapiens
aauccucccacuucagccu

SEQ ID NO: 1532388 - RNA, 23 nt, Homo sapiens
aaucgauucugcagcaccggccu

SEQ ID NO: 1532389 - RNA, 15 nt, Homo sapiens
aaucucaauauuuca

SEQ ID NO: 1532390 - RNA, 16 nt, Homo sapiens
aaugaauacugggaau

SEQ ID NO: 1532391 - RNA, 18 nt, Homo sapiens
aaugagagacacacugaa

SEQ ID NO: 1532392 - RNA, 15 nt, Homo sapiens
aaugauaacuggaaa

SEQ ID NO: 1532393 - RNA, 13 nt, Homo sapiens
aauggaaguccau

SEQ ID NO: 1532394 - RNA, 19 nt, Homo sapiens
aauggaggggcagagccag

SEQ ID NO: 1532395 - RNA, 15 nt, Homo sapiens
aauggguuacuugau

SEQ ID NO: 1532396 - RNA, 13 nt, Homo sapiens
aauguuuaaucuc

SEQ ID NO: 1532397 - RNA, 18 nt, Homo sapiens
aauucuuuaaaauuacaa

SEQ ID NO: 1532398 - RNA, 22 nt, Homo sapiens
aauuuuaguucuuacugcuuaa

SEQ ID NO: 1532399 - RNA, 19 nt, Homo sapiens
acaaaaaaaaaauuugcca

SEQ ID NO: 1532400 - RNA, 21 nt, Homo sapiens
acaacuucaguccaacuguca

SEQ ID NO: 1532401 - RNA, 22 nt, Homo sapiens
acaagaccaucuacauacacag

SEQ ID NO: 1532402 - RNA, 14 nt, Homo sapiens
acaaggaugaauua

SEQ ID NO: 1532403 - RNA, 18 nt, Homo sapiens
acaauaaauagacacgca

SEQ ID NO: 1532404 - RNA, 13 nt, Homo sapiens
acaaugcuguauu

SEQ ID NO: 1532405 - RNA, 17 nt, Homo sapiens
acacacaugaaguccaa

SEQ ID NO: 1532406 - RNA, 19 nt, Homo sapiens
acacaugaaguccaagcau

SEQ ID NO: 1532407 - RNA, 13 nt, Homo sapiens
acacccagcaaua

SEQ ID NO: 1532408 - RNA, 17 nt, Homo sapiens
acacucucuucucugcu

SEQ ID NO: 1532409 - RNA, 21 nt, Homo sapiens
acacugggacuugcaaaaagg

SEQ ID NO: 1532410 - RNA, 18 nt, Homo sapiens
acagcaugccuucaaauc

SEQ ID NO: 1532411 - RNA, 22 nt, Homo sapiens
acaggacagcccuucuuuccac

SEQ ID NO: 1532412 - RNA, 19 nt, Homo sapiens
acaucagcaaacaggauca

SEQ ID NO: 1532413 - RNA, 18 nt, Homo sapiens
acauccagcagauuucca

SEQ ID NO: 1532414 - RNA, 15 nt, Homo sapiens
acauuuuuugggcag

SEQ ID NO: 1532415 - RNA, 14 nt, Homo sapiens
accaaaaaucucaa

SEQ ID NO: 1532416 - RNA, 13 nt, Homo sapiens
accaaaucacuga

SEQ ID NO: 1532417 - RNA, 22 nt, Homo sapiens
accaagguuuugaaaucccauc

SEQ ID NO: 1532418 - RNA, 20 nt, Homo sapiens
accaauaaagugacccugcu

SEQ ID NO: 1532419 - RNA, 15 nt, Homo sapiens
accaaucaugaauua

SEQ ID NO: 1532420 - RNA, 21 nt, Homo sapiens
accacaggaaccacaagacug

SEQ ID NO: 1532421 - RNA, 15 nt, Homo sapiens
accagagacuuuagg

SEQ ID NO: 1532422 - RNA, 16 nt, Homo sapiens
accccagccauccagg

SEQ ID NO: 1532423 - RNA, 13 nt, Homo sapiens
acccuagcaaaag

SEQ ID NO: 1532424 - RNA, 13 nt, Homo sapiens
accgcgaggccua

SEQ ID NO: 1532425 - RNA, 23 nt, Homo sapiens
accgcgaggccuauuguugaaua

SEQ ID NO: 1532426 - RNA, 19 nt, Homo sapiens
accugccccccagccuuca

SEQ ID NO: 1532427 - RNA, 22 nt, Homo sapiens
acuaagugauuuguaugucuau

SEQ ID NO: 1532428 - RNA, 11 nt, Homo sapiens
aaaaacuacuu

SEQ ID NO: 1532429 - RNA, 16 nt, Homo sapiens
aaaagaaugauuauga

SEQ ID NO: 1532430 - RNA, 15 nt, Homo sapiens
aaaaucaaaugugca

SEQ ID NO: 1532431 - RNA, 14 nt, Homo sapiens
aaaccaaaucacug

SEQ ID NO: 1532432 - RNA, 12 nt, Homo sapiens
aaacuacuucuu

SEQ ID NO: 1532433 - RNA, 14 nt, Homo sapiens
aaagagaacuucca

SEQ ID NO: 1532434 - RNA, 18 nt, Homo sapiens
aaagcccauucauuccau

SEQ ID NO: 1532435 - RNA, 17 nt, Homo sapiens
aaagcuauauaagacaa

SEQ ID NO: 1532436 - RNA, 21 nt, Homo sapiens
aaagggaaggugacugaaggc

SEQ ID NO: 1532437 - RNA, 13 nt, Homo sapiens
aaauaaacauguu

SEQ ID NO: 1532438 - RNA, 14 nt, Homo sapiens
aaauagcagcuuua

SEQ ID NO: 1532439 - RNA, 15 nt, Homo sapiens
aaaucaaaugugcau

SEQ ID NO: 1532440 - RNA, 18 nt, Homo sapiens
aaaugaguaaacccagcu

SEQ ID NO: 1532441 - RNA, 15 nt, Homo sapiens
aaaugauagacaauu

SEQ ID NO: 1532442 - RNA, 16 nt, Homo sapiens
aaaugccuccauggca

SEQ ID NO: 1532443 - RNA, 23 nt, Homo sapiens
aaauuaaaccggaccaucucucc

SEQ ID NO: 1532444 - RNA, 13 nt, Homo sapiens
aaauuguguuucc

SEQ ID NO: 1532445 - RNA, 22 nt, Homo sapiens
aaauuuuaguucuuacugcuua

SEQ ID NO: 1532446 - RNA, 15 nt, Homo sapiens
aacaaauaauuuaga

SEQ ID NO: 1532447 - RNA, 20 nt, Homo sapiens
aaccaagguuuugaaauccc

SEQ ID NO: 1532448 - RNA, 17 nt, Homo sapiens
aaccaggggccaugaau

SEQ ID NO: 1532449 - RNA, 13 nt, Homo sapiens
aaccuuccaccca

SEQ ID NO: 1532450 - RNA, 15 nt, Homo sapiens
aaccuuccacccagu

SEQ ID NO: 1532451 - RNA, 12 nt, Homo sapiens
aacuacuucuua

SEQ ID NO: 1532452 - RNA, 20 nt, Homo sapiens
aacucucugguuuacuucaa

SEQ ID NO: 1532453 - RNA, 21 nt, Homo sapiens
aacucucugguuuacuucaaa

SEQ ID NO: 1532454 - RNA, 19 nt, Homo sapiens
aacuugaggacacaugucc

SEQ ID NO: 1532455 - RNA, 15 nt, Homo sapiens
aagaagagaucagga

SEQ ID NO: 1532456 - RNA, 15 nt, Homo sapiens
aagaccccaucucaa

SEQ ID NO: 1532457 - RNA, 14 nt, Homo sapiens
aagagaucaggaag

SEQ ID NO: 1532458 - RNA, 12 nt, Homo sapiens
aagagucaucca

SEQ ID NO: 1532459 - RNA, 13 nt, Homo sapiens
aagcaccaaucau

SEQ ID NO: 1532460 - RNA, 14 nt, Homo sapiens
aagcccauucauuc

SEQ ID NO: 1532461 - RNA, 20 nt, Homo sapiens
aagccccauccaacacugga

SEQ ID NO: 1532462 - RNA, 17 nt, Homo sapiens
aagcuggagugcagugg

SEQ ID NO: 1532463 - RNA, 19 nt, Homo sapiens
aagcuuaugcuuaaauuca

SEQ ID NO: 1532464 - RNA, 19 nt, Homo sapiens
aaggaaagaaaacaucuuu

SEQ ID NO: 1532465 - RNA, 15 nt, Homo sapiens
aaggacaucagcaaa

SEQ ID NO: 1532466 - RNA, 15 nt, Homo sapiens
ccuacccuaaccaag

SEQ ID NO: 1532467 - RNA, 22 nt, Homo sapiens
ccuaggcuaccucaagacucac

SEQ ID NO: 1532468 - RNA, 17 nt, Homo sapiens
ccucaagacucaccuca

SEQ ID NO: 1532469 - RNA, 20 nt, Homo sapiens
ccucaugcugugugacucaa

SEQ ID NO: 1532470 - RNA, 13 nt, Homo sapiens
ccuccacauuucc

SEQ ID NO: 1532471 - RNA, 18 nt, Homo sapiens
ccuccaggguggcagcaa

SEQ ID NO: 1532472 - RNA, 14 nt, Homo sapiens
ccucugcagucucu

SEQ ID NO: 1532473 - RNA, 15 nt, Homo sapiens
ccucugcagucucua

SEQ ID NO: 1532474 - RNA, 19 nt, Homo sapiens
ccucuuccuucccugcugu

SEQ ID NO: 1532475 - RNA, 17 nt, Homo sapiens
ccuggggcgagcacugu

SEQ ID NO: 1532476 - RNA, 14 nt, Homo sapiens
ccuuaacugcaucc

SEQ ID NO: 1532477 - RNA, 13 nt, Homo sapiens
ccuuaagagucau

SEQ ID NO: 1532478 - RNA, 20 nt, Homo sapiens
ccuuacagaacuacuucuua

SEQ ID NO: 1532479 - RNA, 19 nt, Homo sapiens
ccuuguuucaaaauucuca

SEQ ID NO: 1532480 - RNA, 20 nt, Homo sapiens
ccuuguuucaaaauucucau

SEQ ID NO: 1532481 - RNA, 17 nt, Homo sapiens
cgaagugcugagauuac

SEQ ID NO: 1532482 - RNA, 16 nt, Homo sapiens
cgaggccuauuguuga

SEQ ID NO: 1532483 - RNA, 17 nt, Homo sapiens
cgaggccuauuguugaa

SEQ ID NO: 1532484 - RNA, 18 nt, Homo sapiens
cgaggccuauuguugaau

SEQ ID NO: 1532485 - RNA, 19 nt, Homo sapiens
cgcugaagcgccuccccca

SEQ ID NO: 1532486 - RNA, 22 nt, Homo sapiens
cgcuugcaccacuuccguccca

SEQ ID NO: 1532487 - RNA, 18 nt, Homo sapiens
cggaagcccuugccugaa

SEQ ID NO: 1532488 - RNA, 14 nt, Homo sapiens
cggaggccagagag

SEQ ID NO: 1532489 - RNA, 23 nt, Homo sapiens
cggccuggggcgagcacugugag

SEQ ID NO: 1532490 - RNA, 12 nt, Homo sapiens
cuaaacauuuca

SEQ ID NO: 1532491 - RNA, 18 nt, Homo sapiens
cuaaaugaguaaacccag

SEQ ID NO: 1532492 - RNA, 14 nt, Homo sapiens
cuaaaugucaauca

SEQ ID NO: 1532493 - RNA, 17 nt, Homo sapiens
cuaaguccaguguuucu

SEQ ID NO: 1532494 - RNA, 22 nt, Homo sapiens
cuaccucaagacucaccucauc

SEQ ID NO: 1532495 - RNA, 20 nt, Homo sapiens
cuacugcucuccuccaccuc

SEQ ID NO: 1532496 - RNA, 17 nt, Homo sapiens
cuaguugaucagcuuau

SEQ ID NO: 1532497 - RNA, 22 nt, Homo sapiens
cuaugcgggggugccuaaggag

SEQ ID NO: 1532498 - RNA, 16 nt, Homo sapiens
cuauucaacacacaca

SEQ ID NO: 1532499 - RNA, 20 nt, Homo sapiens
cuauucaacacacacaugcu

SEQ ID NO: 1532500 - RNA, 19 nt, Homo sapiens
cucaaacuccugaccucaa

SEQ ID NO: 1532501 - RNA, 19 nt, Homo sapiens
cuccaacccuagcaaaagu

SEQ ID NO: 1532502 - RNA, 19 nt, Homo sapiens
cuccaggguggcagcaaca

SEQ ID NO: 1532503 - RNA, 15 nt, Homo sapiens
cuccaucuccagugg

SEQ ID NO: 1532504 - RNA, 21 nt, Homo sapiens
cucccaaaaaacuacuucuuu

SEQ ID NO: 1532505 - RNA, 14 nt, Homo sapiens
cuccgcaacagcca

SEQ ID NO: 1532506 - RNA, 16 nt, Homo sapiens
cuccgcaacagccaag

SEQ ID NO: 1532507 - RNA, 17 nt, Homo sapiens
cuccgugcuuaaccaaa

SEQ ID NO: 1532508 - RNA, 20 nt, Homo sapiens
cuccuaagcuggagugcagu

SEQ ID NO: 1532509 - RNA, 23 nt, Homo sapiens
cuccuccaggguggcagcaacaa

SEQ ID NO: 1532510 - RNA, 13 nt, Homo sapiens
cucuaacauuucc

SEQ ID NO: 1532511 - RNA, 14 nt, Homo sapiens
cucucucaaagugc

SEQ ID NO: 1532512 - RNA, 20 nt, Homo sapiens
cucugcagucucuauaccaa

SEQ ID NO: 1532513 - RNA, 19 nt, Homo sapiens
cucuucagucucuauacca

SEQ ID NO: 1532514 - RNA, 20 nt, Homo sapiens
cucuucagucucuauaccaa

SEQ ID NO: 1532515 - RNA, 17 nt, Homo sapiens
cugaccuugugauccac

SEQ ID NO: 1532516 - RNA, 17 nt, Homo sapiens
cugcagucucuauacca

SEQ ID NO: 1532517 - RNA, 14 nt, Homo sapiens
cugccucagccucc

SEQ ID NO: 1532518 - RNA, 14 nt, Homo sapiens
cugcuuaauucaaa

SEQ ID NO: 1532519 - RNA, 14 nt, Homo sapiens
cuggagugcagugg

SEQ ID NO: 1532520 - RNA, 18 nt, Homo sapiens
cuggcauuacagguguga

SEQ ID NO: 1532521 - RNA, 22 nt, Homo sapiens
cuggcauuacaggugugagcca

SEQ ID NO: 1532522 - RNA, 21 nt, Homo sapiens
cugggaacaacuucaguccaa

SEQ ID NO: 1532523 - RNA, 15 nt, Homo sapiens
cugggaaucaagaca

SEQ ID NO: 1532524 - RNA, 23 nt, Homo sapiens
cugggauuaacagguaugaacca

SEQ ID NO: 1532525 - RNA, 15 nt, Homo sapiens
cugggauuacaggug

SEQ ID NO: 1532526 - RNA, 18 nt, Homo sapiens
cugggcaagggaccugcu

SEQ ID NO: 1532527 - RNA, 17 nt, Homo sapiens
cugggcggccucuugcu

SEQ ID NO: 1532528 - RNA, 14 nt, Homo sapiens
cugguuuacuucaa

SEQ ID NO: 1532529 - RNA, 12 nt, Homo sapiens
cugucccaaaga

SEQ ID NO: 1532530 - RNA, 22 nt, Homo sapiens
cugugcacgcgcgcgugcacac

SEQ ID NO: 1532531 - RNA, 16 nt, Homo sapiens
cuguggaacauaaaaa

SEQ ID NO: 1532532 - RNA, 15 nt, Homo sapiens
cuuaaauuuuaguuc

SEQ ID NO: 1532533 - RNA, 12 nt, Homo sapiens
cuuaaccaaaga

SEQ ID NO: 1532534 - RNA, 14 nt, Homo sapiens
cuuaauauguucuu

SEQ ID NO: 1532535 - RNA, 14 nt, Homo sapiens
cuuaauucaaauaa

SEQ ID NO: 1532536 - RNA, 16 nt, Homo sapiens
cuuacagaacuacuuc

SEQ ID NO: 1532537 - RNA, 14 nt, Homo sapiens
cuucagucucuaua

SEQ ID NO: 1532538 - RNA, 18 nt, Homo sapiens
cuucagucucuauaccaa

SEQ ID NO: 1532539 - RNA, 19 nt, Homo sapiens
cuucagucucuauaccaau

SEQ ID NO: 1532540 - RNA, 21 nt, Homo sapiens
cuucagucucuauaccaauaa

SEQ ID NO: 1532541 - RNA, 21 nt, Homo sapiens
cuucccaaaguccugggauua

SEQ ID NO: 1532542 - RNA, 19 nt, Homo sapiens
cuuccugaacaaccagcug

SEQ ID NO: 1532543 - RNA, 19 nt, Homo sapiens
cuucucagauuucugagga

SEQ ID NO: 1532544 - RNA, 13 nt, Homo sapiens
cuucugcacacaa

SEQ ID NO: 1532545 - RNA, 19 nt, Homo sapiens
cuucuuaggguuaugauua

SEQ ID NO: 1532546 - RNA, 18 nt, Homo sapiens
cuugaccucgugauccac

SEQ ID NO: 1532547 - RNA, 18 nt, Homo sapiens
gaaagaugaucauuugua

SEQ ID NO: 1532548 - RNA, 23 nt, Homo sapiens
gaaagguacuucaaauccuugaa

SEQ ID NO: 1532549 - RNA, 14 nt, Homo sapiens
gaaaucccaucagg

SEQ ID NO: 1532550 - RNA, 17 nt, Homo sapiens
gaaauuaugugacauuu

SEQ ID NO: 1532551 - RNA, 20 nt, Homo sapiens
gaacauaaaaaggacaucag

SEQ ID NO: 1532552 - RNA, 18 nt, Homo sapiens
gaagaaguugauaugccu

SEQ ID NO: 1532553 - RNA, 17 nt, Homo sapiens
gaagcaccaaucaugaa

SEQ ID NO: 1532554 - RNA, 21 nt, Homo sapiens
gaauaaauguaucugaauauc

SEQ ID NO: 1532555 - RNA, 21 nt, Homo sapiens
gaauacaguuuugaguagagu

SEQ ID NO: 1532556 - RNA, 15 nt, Homo sapiens
gaaugagagacacac

SEQ ID NO: 1532557 - RNA, 15 nt, Homo sapiens
gaauuacgugcucug

SEQ ID NO: 1532558 - RNA, 18 nt, Homo sapiens
gaauugugcaaccaucac

SEQ ID NO: 1532559 - RNA, 17 nt, Homo sapiens
gacaaguggggacugca

SEQ ID NO: 1532560 - RNA, 20 nt, Homo sapiens
gacagucaccucauggaauu

SEQ ID NO: 1532561 - RNA, 19 nt, Homo sapiens
gacauuugcucauggaauu

SEQ ID NO: 1532562 - RNA, 19 nt, Homo sapiens
gaccaccucucaauauuca

SEQ ID NO: 1532563 - RNA, 15 nt, Homo sapiens
gaccaucuacauaca

SEQ ID NO: 1532564 - RNA, 13 nt, Homo sapiens
gaccuauuuccag

SEQ ID NO: 1532565 - RNA, 15 nt, Homo sapiens
gacuauguaaacuac

SEQ ID NO: 1532566 - RNA, 21 nt, Homo sapiens
gagaaugagagacacacugaa

SEQ ID NO: 1532567 - RNA, 22 nt, Homo sapiens
gagccaccacauccagccuaac

SEQ ID NO: 1532568 - RNA, 20 nt, Homo sapiens
gaggccuauuguugaauaaa

SEQ ID NO: 1532569 - RNA, 19 nt, Homo sapiens
gagucauccagcucuugcu

SEQ ID NO: 1532570 - RNA, 14 nt, Homo sapiens
gagugaggagccca

SEQ ID NO: 1532571 - RNA, 21 nt, Homo sapiens
gagugcaguggcaucaucuca

SEQ ID NO: 1532572 - RNA, 16 nt, Homo sapiens
gaucaaacuacauauu

SEQ ID NO: 1532573 - RNA, 18 nt, Homo sapiens
gaucggcggccacugcgc

SEQ ID NO: 1532574 - RNA, 13 nt, Homo sapiens
gaucucagcucac

SEQ ID NO: 1532575 - RNA, 23 nt, Homo sapiens
gaucucagcucacugcaaccucc

SEQ ID NO: 1532576 - RNA, 14 nt, Homo sapiens
gaucuugguucacu

SEQ ID NO: 1532577 - RNA, 22 nt, Homo sapiens
gaugcaguucugaagaagaugg

SEQ ID NO: 1532578 - RNA, 14 nt, Homo sapiens
augauaacuggaaa

SEQ ID NO: 1532579 - RNA, 18 nt, Homo sapiens
augcagaaagcaucccuc

SEQ ID NO: 1532580 - RNA, 11 nt, Homo sapiens
augcucuccaa

SEQ ID NO: 1532581 - RNA, 17 nt, Homo sapiens
augcucuccaaaccacu

SEQ ID NO: 1532582 - RNA, 22 nt, Homo sapiens
auggaggccagugccagcaccu

SEQ ID NO: 1532583 - RNA, 14 nt, Homo sapiens
auggccuuguuuca

SEQ ID NO: 1532584 - RNA, 18 nt, Homo sapiens
auguaccguaggcuuugu

SEQ ID NO: 1532585 - RNA, 12 nt, Homo sapiens
auguuagugcaa

SEQ ID NO: 1532586 - RNA, 10 nt, Homo sapiens
auguucaagc

SEQ ID NO: 1532587 - RNA, 23 nt, Homo sapiens
auguucuuuuaaaugauugaauu

SEQ ID NO: 1532588 - RNA, 17 nt, Homo sapiens
auguugacaugggacau

SEQ ID NO: 1532589 - RNA, 21 nt, Homo sapiens
auguuggcuagacuagucuca

SEQ ID NO: 1532590 - RNA, 20 nt, Homo sapiens
auuaaaccggaccaucucuc

SEQ ID NO: 1532591 - RNA, 23 nt, Homo sapiens
auuagcagucccuccacauuucc

SEQ ID NO: 1532592 - RNA, 16 nt, Homo sapiens
auuauuuuugagacag

SEQ ID NO: 1532593 - RNA, 20 nt, Homo sapiens
auuauuuuugagacagaguc

SEQ ID NO: 1532594 - RNA, 15 nt, Homo sapiens
auucaaguuuaguuu

SEQ ID NO: 1532595 - RNA, 21 nt, Homo sapiens
auucaauaaagcugcugagaa

SEQ ID NO: 1532596 - RNA, 10 nt, Homo sapiens
auucauucca

SEQ ID NO: 1532597 - RNA, 22 nt, Homo sapiens
auuccauucuggaagugacuuu

SEQ ID NO: 1532598 - RNA, 22 nt, Homo sapiens
auucuuauuauuuuugagacag

SEQ ID NO: 1532599 - RNA, 21 nt, Homo sapiens
auugaauuauauguucagauu

SEQ ID NO: 1532600 - RNA, 20 nt, Homo sapiens
auugagaaaaauauauacua

SEQ ID NO: 1532601 - RNA, 15 nt, Homo sapiens
auugguuucuaggca

SEQ ID NO: 1532602 - RNA, 21 nt, Homo sapiens
auugugugaaagguacuucaa

SEQ ID NO: 1532603 - RNA, 22 nt, Homo sapiens
auuucaauauuagcaagacagc

SEQ ID NO: 1532604 - RNA, 18 nt, Homo sapiens
auuuccagaaauacaauu

SEQ ID NO: 1532605 - RNA, 20 nt, Homo sapiens
auuuccuuacagaacuacuu

SEQ ID NO: 1532606 - RNA, 14 nt, Homo sapiens
auuugcucauggaa

SEQ ID NO: 1532607 - RNA, 16 nt, Homo sapiens
caaaaaacuacuucuu

SEQ ID NO: 1532608 - RNA, 22 nt, Homo sapiens
caaaaaaucucaauucuucccu

SEQ ID NO: 1532609 - RNA, 14 nt, Homo sapiens
caaaaauuaucuau

SEQ ID NO: 1532610 - RNA, 23 nt, Homo sapiens
caaaaugcuucugcacacaaaac

SEQ ID NO: 1532611 - RNA, 12 nt, Homo sapiens
caaaauucucau

SEQ ID NO: 1532612 - RNA, 17 nt, Homo sapiens
caaacuccugaccucaa

SEQ ID NO: 1532613 - RNA, 17 nt, Homo sapiens
caaaguccugggauuac

SEQ ID NO: 1532614 - RNA, 13 nt, Homo sapiens
caacaucuaguga

SEQ ID NO: 1532615 - RNA, 22 nt, Homo sapiens
caagacagcaugccuucaaauc

SEQ ID NO: 1532616 - RNA, 17 nt, Homo sapiens
caaggccugguguuucu

SEQ ID NO: 1532617 - RNA, 22 nt, Homo sapiens
caauaaagugacccugcucuca

SEQ ID NO: 1532618 - RNA, 17 nt, Homo sapiens
caauaaagugacccugu

SEQ ID NO: 1532619 - RNA, 19 nt, Homo sapiens
cacaggaaccacaagacug

SEQ ID NO: 1532620 - RNA, 23 nt, Homo sapiens
caccacuuccgucccauccuugc

SEQ ID NO: 1532621 - RNA, 20 nt, Homo sapiens
cacccaggcuggacugcaau

SEQ ID NO: 1532622 - RNA, 13 nt, Homo sapiens
caccucauccuua

SEQ ID NO: 1532623 - RNA, 21 nt, Homo sapiens
cacgcugaaggcuuacuucag

SEQ ID NO: 1532624 - RNA, 12 nt, Homo sapiens
cacuagccugug

SEQ ID NO: 1532625 - RNA, 16 nt, Homo sapiens
cacuagccugugcacg

SEQ ID NO: 1532626 - RNA, 19 nt, Homo sapiens
cacugccuucucaacucca

SEQ ID NO: 1532627 - RNA, 14 nt, Homo sapiens
cacugcuccagugg

SEQ ID NO: 1532628 - RNA, 17 nt, Homo sapiens
cacugggacuugcaaaa

SEQ ID NO: 1532629 - RNA, 12 nt, Homo sapiens
cagaacuacuuc

SEQ ID NO: 1532630 - RNA, 23 nt, Homo sapiens
cagaaggacacuagccugugcac

SEQ ID NO: 1532631 - RNA, 12 nt, Homo sapiens
cagauaaucaca

SEQ ID NO: 1532632 - RNA, 14 nt, Homo sapiens
cagcccaugugcac

SEQ ID NO: 1532633 - RNA, 20 nt, Homo sapiens
cagccucccaaguagcugag

SEQ ID NO: 1532634 - RNA, 19 nt, Homo sapiens
cagccucucgaagugcuga

SEQ ID NO: 1532635 - RNA, 19 nt, Homo sapiens
cagccucuuagaugcaguu

SEQ ID NO: 1532636 - RNA, 21 nt, Homo sapiens
cagccuggccaacauaguggg

SEQ ID NO: 1532637 - RNA, 18 nt, Homo sapiens
cagcucucaguugcagcc

SEQ ID NO: 1532638 - RNA, 20 nt, Homo sapiens
cagcugaggccuugccuuga

SEQ ID NO: 1532639 - RNA, 19 nt, Homo sapiens
caggaagaucccccagaaa

SEQ ID NO: 1532640 - RNA, 16 nt, Homo sapiens
caggcuggagugcagu

SEQ ID NO: 1532641 - RNA, 18 nt, Homo sapiens
caggcuggagugcagugg

SEQ ID NO: 1532642 - RNA, 21 nt, Homo sapiens
caggucuaccaaaaaucucaa

SEQ ID NO: 1532643 - RNA, 15 nt, Homo sapiens
caguaaaauaauaau

SEQ ID NO: 1532644 - RNA, 12 nt, Homo sapiens
caguaaaaucaa

SEQ ID NO: 1532645 - RNA, 18 nt, Homo sapiens
caguaaaaucaaaugugc

SEQ ID NO: 1532646 - RNA, 20 nt, Homo sapiens
caguaaaaucaaaugugcau

SEQ ID NO: 1532647 - RNA, 19 nt, Homo sapiens
caguaucucuucagucucu

SEQ ID NO: 1532648 - RNA, 22 nt, Homo sapiens
caguaucucuucagucucuaua

SEQ ID NO: 1532649 - RNA, 16 nt, Homo sapiens
cagucucuauaccaau

SEQ ID NO: 1532650 - RNA, 18 nt, Homo sapiens
cagucucuauaccaauaa

SEQ ID NO: 1532651 - RNA, 16 nt, Homo sapiens
cagugcugaauuuccc

SEQ ID NO: 1532652 - RNA, 17 nt, Homo sapiens
caguggcgcgaucucag

SEQ ID NO: 1532653 - RNA, 17 nt, Homo sapiens
caguggcgugaucucag

SEQ ID NO: 1532654 - RNA, 16 nt, Homo sapiens
caguucaaagcaggau

SEQ ID NO: 1532655 - RNA, 17 nt, Homo sapiens
cauaggcgcaggugcac

SEQ ID NO: 1532656 - RNA, 18 nt, Homo sapiens
cauauauaacaaugcugu

SEQ ID NO: 1532657 - RNA, 23 nt, Homo sapiens
caucaggucaccgcgaggccuau

SEQ ID NO: 1532658 - RNA, 15 nt, Homo sapiens
cauccaacacuggau

SEQ ID NO: 1532659 - RNA, 16 nt, Homo sapiens
cauccuucaucuggau

SEQ ID NO: 1532660 - RNA, 20 nt, Homo sapiens
caugauguuuagaaacacaa

SEQ ID NO: 1532661 - RNA, 15 nt, Homo sapiens
caugcgagugcucau

SEQ ID NO: 1532662 - RNA, 22 nt, Homo sapiens
caugcugugugacucaaaccaa

SEQ ID NO: 1532663 - RNA, 12 nt, Homo sapiens
cauggaaauucc

SEQ ID NO: 1532664 - RNA, 14 nt, Homo sapiens
cauggcccugccau

SEQ ID NO: 1532665 - RNA, 22 nt, Homo sapiens
cauguucaagcgauucuccugc

SEQ ID NO: 1532666 - RNA, 22 nt, Homo sapiens
cauuccauccuugagucaaaaa

SEQ ID NO: 1532667 - RNA, 12 nt, Homo sapiens
cauuucauauaa

SEQ ID NO: 1532668 - RNA, 21 nt, Homo sapiens
cauuucuucucguuuucacag

SEQ ID NO: 1532669 - RNA, 19 nt, Homo sapiens
cauuuuuugggcagcaauu

SEQ ID NO: 1532670 - RNA, 15 nt, Homo sapiens
ccaaaaaacuacuuc

SEQ ID NO: 1532671 - RNA, 23 nt, Homo sapiens
ccaacgcgccucgccggaucuga

SEQ ID NO: 1532672 - RNA, 20 nt, Homo sapiens
ccaaguuccuuggccaugca

SEQ ID NO: 1532673 - RNA, 22 nt, Homo sapiens
ccaauaaagugacccugcucuc

SEQ ID NO: 1532674 - RNA, 12 nt, Homo sapiens
ccacauccagcc

SEQ ID NO: 1532675 - RNA, 14 nt, Homo sapiens
ccacugccuuugac

SEQ ID NO: 1532676 - RNA, 15 nt, Homo sapiens
ccacuuuuugcagcu

SEQ ID NO: 1532677 - RNA, 18 nt, Homo sapiens
ccagaaagugacaagcuc

SEQ ID NO: 1532678 - RNA, 20 nt, Homo sapiens
ccagagcacugcuccagugg

SEQ ID NO: 1532679 - RNA, 19 nt, Homo sapiens
ccagcacagccucuuagau

SEQ ID NO: 1532680 - RNA, 12 nt, Homo sapiens
ccagcaccugcc

SEQ ID NO: 1532681 - RNA, 15 nt, Homo sapiens
ccaggcuggagugca

SEQ ID NO: 1532682 - RNA, 22 nt, Homo sapiens
ccaguaaaaucaaaugugcauc

SEQ ID NO: 1532683 - RNA, 23 nt, Homo sapiens
ccaguaucucuucagucucuaua

SEQ ID NO: 1532684 - RNA, 17 nt, Homo sapiens
ccaucaaggguacacug

SEQ ID NO: 1532685 - RNA, 18 nt, Homo sapiens
ccaucagaaacacccuca

SEQ ID NO: 1532686 - RNA, 23 nt, Homo sapiens
ccaucaggucaccgcgaggccua

SEQ ID NO: 1532687 - RNA, 15 nt, Homo sapiens
ccauccaacacugga

SEQ ID NO: 1532688 - RNA, 13 nt, Homo sapiens
ccauucauuccau

SEQ ID NO: 1532689 - RNA, 14 nt, Homo sapiens
cccacagcuguaug

SEQ ID NO: 1532690 - RNA, 18 nt, Homo sapiens
cccagaaugagacaucca

SEQ ID NO: 1532691 - RNA, 13 nt, Homo sapiens
cccagcaauagag

SEQ ID NO: 1532692 - RNA, 21 nt, Homo sapiens
cccaguaucucuucagucucu

SEQ ID NO: 1532693 - RNA, 22 nt, Homo sapiens
cccaguaucucuucagucucua

SEQ ID NO: 1532694 - RNA, 23 nt, Homo sapiens
cccccaguaaaaucaaaugugca

SEQ ID NO: 1532695 - RNA, 18 nt, Homo sapiens
cccuacccccaguaaaau

SEQ ID NO: 1532696 - RNA, 21 nt, Homo sapiens
cccucaugcugugugacucaa

SEQ ID NO: 1532697 - RNA, 19 nt, Homo sapiens
cccugcauugcugagucaa

SEQ ID NO: 1532698 - RNA, 20 nt, Homo sapiens
cccuggaaaccuuccaccca

SEQ ID NO: 1532699 - RNA, 17 nt, Homo sapiens
cccuggucccucugcag

SEQ ID NO: 1532700 - RNA, 14 nt, Homo sapiens
cccuugaugaagaa

SEQ ID NO: 1532701 - RNA, 23 nt, Homo sapiens
ccgcauccgggguucaagccauu

SEQ ID NO: 1532702 - RNA, 19 nt, Homo sapiens
accaucucuccaacucaac

SEQ ID NO: 1532703 - RNA, 15 nt, Homo sapiens
accauggacacuaca

SEQ ID NO: 1532704 - RNA, 19 nt, Homo sapiens
acccagguuggagugcagu

SEQ ID NO: 1532705 - RNA, 20 nt, Homo sapiens
acccagguuggagugcagug

SEQ ID NO: 1532706 - RNA, 12 nt, Homo sapiens
acccucaugcug

SEQ ID NO: 1532707 - RNA, 14 nt, Homo sapiens
accucuccagccuc

SEQ ID NO: 1532708 - RNA, 20 nt, Homo sapiens
accugccucccuucaugcau

SEQ ID NO: 1532709 - RNA, 14 nt, Homo sapiens
accugcuucuauua

SEQ ID NO: 1532710 - RNA, 22 nt, Homo sapiens
acgccucgguggcauacagacu

SEQ ID NO: 1532711 - RNA, 16 nt, Homo sapiens
acgcgcgcgugcacac

SEQ ID NO: 1532712 - RNA, 18 nt, Homo sapiens
acgcugaaggcuuacuuc

SEQ ID NO: 1532713 - RNA, 20 nt, Homo sapiens
acggagucucacucugucac

SEQ ID NO: 1532714 - RNA, 16 nt, Homo sapiens
acgugcgcgaugugac

SEQ ID NO: 1532715 - RNA, 12 nt, Homo sapiens
acuacaaccucc

SEQ ID NO: 1532716 - RNA, 16 nt, Homo sapiens
acuacuucucuuguua

SEQ ID NO: 1532717 - RNA, 16 nt, Homo sapiens
acuagccugugcacgc

SEQ ID NO: 1532718 - RNA, 13 nt, Homo sapiens
acuauaccuuauc

SEQ ID NO: 1532719 - RNA, 22 nt, Homo sapiens
acucagccuggcugauuaucac

SEQ ID NO: 1532720 - RNA, 18 nt, Homo sapiens
acucucugguuuacuuca

SEQ ID NO: 1532721 - RNA, 20 nt, Homo sapiens
acucucugguuuacuucaaa

SEQ ID NO: 1532722 - RNA, 20 nt, Homo sapiens
acucuuaagaagacugcauu

SEQ ID NO: 1532723 - RNA, 22 nt, Homo sapiens
acucuucaaggucugcuuuuca

SEQ ID NO: 1532724 - RNA, 16 nt, Homo sapiens
acugaaagaugaucau

SEQ ID NO: 1532725 - RNA, 22 nt, Homo sapiens
acugcagcuaacuuaucaucac

SEQ ID NO: 1532726 - RNA, 15 nt, Homo sapiens
acugcuuaauucaaa

SEQ ID NO: 1532727 - RNA, 18 nt, Homo sapiens
acugcuuaauucaaauaa

SEQ ID NO: 1532728 - RNA, 13 nt, Homo sapiens
acugggacuugca

SEQ ID NO: 1532729 - RNA, 20 nt, Homo sapiens
acuggucccaagguguaaag

SEQ ID NO: 1532730 - RNA, 18 nt, Homo sapiens
acuuauaguacaugauaa

SEQ ID NO: 1532731 - RNA, 17 nt, Homo sapiens
agaaagugacaagcuca

SEQ ID NO: 1532732 - RNA, 21 nt, Homo sapiens
agaaauacaauuuuagauauc

SEQ ID NO: 1532733 - RNA, 23 nt, Homo sapiens
agaaauacaauuuuagauaucau

SEQ ID NO: 1532734 - RNA, 23 nt, Homo sapiens
agaacggaagaagagaucaggaa

SEQ ID NO: 1532735 - RNA, 13 nt, Homo sapiens
agaacuacuucuu

SEQ ID NO: 1532736 - RNA, 19 nt, Homo sapiens
agaagaaacuggggcuccu

SEQ ID NO: 1532737 - RNA, 16 nt, Homo sapiens
agaagacaccaccauu

SEQ ID NO: 1532738 - RNA, 13 nt, Homo sapiens
agaaggaaggcag

SEQ ID NO: 1532739 - RNA, 18 nt, Homo sapiens
agaaggaaggcuccaucu

SEQ ID NO: 1532740 - RNA, 15 nt, Homo sapiens
agaagucaacgccuc

SEQ ID NO: 1532741 - RNA, 22 nt, Homo sapiens
agaaucucagucugucacccag

SEQ ID NO: 1532742 - RNA, 18 nt, Homo sapiens
agaauugugcaaccauca

SEQ ID NO: 1532743 - RNA, 14 nt, Homo sapiens
agacagaaucucag

SEQ ID NO: 1532744 - RNA, 21 nt, Homo sapiens
agaccaucuacauacacagug

SEQ ID NO: 1532745 - RNA, 19 nt, Homo sapiens
agacgugcgcgaugugaca

SEQ ID NO: 1532746 - RNA, 18 nt, Homo sapiens
agacuaauucuaaugugg

SEQ ID NO: 1532747 - RNA, 12 nt, Homo sapiens
agacucaccuca

SEQ ID NO: 1532748 - RNA, 17 nt, Homo sapiens
agacuggggacccugga

SEQ ID NO: 1532749 - RNA, 18 nt, Homo sapiens
agagcugauggagaagga

SEQ ID NO: 1532750 - RNA, 15 nt, Homo sapiens
agaguuuagcuggaa

SEQ ID NO: 1532751 - RNA, 16 nt, Homo sapiens
agaguuuagcuggaaa

SEQ ID NO: 1532752 - RNA, 14 nt, Homo sapiens
agauuuuccugaaa

SEQ ID NO: 1532753 - RNA, 21 nt, Homo sapiens
agauuuuccugaaaacccuug

SEQ ID NO: 1532754 - RNA, 17 nt, Homo sapiens
agcaaaaugcuucugca

SEQ ID NO: 1532755 - RNA, 13 nt, Homo sapiens
agcaacugugcaa

SEQ ID NO: 1532756 - RNA, 18 nt, Homo sapiens
agcaagaccccaucucaa

SEQ ID NO: 1532757 - RNA, 18 nt, Homo sapiens
agcacugcuccagugggg

SEQ ID NO: 1532758 - RNA, 17 nt, Homo sapiens
agcauaagcuuaugcuu

SEQ ID NO: 1532759 - RNA, 14 nt, Homo sapiens
agcccaugugcacc

SEQ ID NO: 1532760 - RNA, 22 nt, Homo sapiens
agccccuggucccucugcaguc

SEQ ID NO: 1532761 - RNA, 23 nt, Homo sapiens
agccccuggucccucugcagucu

SEQ ID NO: 1532762 - RNA, 14 nt, Homo sapiens
agccucagccuccc

SEQ ID NO: 1532763 - RNA, 19 nt, Homo sapiens
agccucucgaagugcugag

SEQ ID NO: 1532764 - RNA, 12 nt, Homo sapiens
agccugccuccc

SEQ ID NO: 1532765 - RNA, 21 nt, Homo sapiens
agccuuggggcugaugcaguu

SEQ ID NO: 1532766 - RNA, 20 nt, Homo sapiens
agcguuuuuuaaauguauac

SEQ ID NO: 1532767 - RNA, 23 nt, Homo sapiens
agcuagcaaauaguaaucuguaa

SEQ ID NO: 1532768 - RNA, 15 nt, Homo sapiens
agcucucaguugcag

SEQ ID NO: 1532769 - RNA, 15 nt, Homo sapiens
agcugauggccuugu

SEQ ID NO: 1532770 - RNA, 22 nt, Homo sapiens
agcugauggccuuguuucaaaa

SEQ ID NO: 1532771 - RNA, 14 nt, Homo sapiens
agcuggagugcagu

SEQ ID NO: 1532772 - RNA, 15 nt, Homo sapiens
agcuuucucuaguuc

SEQ ID NO: 1532773 - RNA, 13 nt, Homo sapiens
aggaaaaugccuc

SEQ ID NO: 1532774 - RNA, 15 nt, Homo sapiens
aggaaggaggaccca

SEQ ID NO: 1532775 - RNA, 22 nt, Homo sapiens
aggaaguugacuuauaguacau

SEQ ID NO: 1532776 - RNA, 14 nt, Homo sapiens
aggacaucagcaaa

SEQ ID NO: 1532777 - RNA, 12 nt, Homo sapiens
aggauggucucc

SEQ ID NO: 1532778 - RNA, 18 nt, Homo sapiens
aggaugguucccuugaug

SEQ ID NO: 1532779 - RNA, 18 nt, Homo sapiens
aggcaguucaaagcagga

SEQ ID NO: 1532780 - RNA, 14 nt, Homo sapiens
aggccuauuguuga

SEQ ID NO: 1532781 - RNA, 16 nt, Homo sapiens
aggcgcaggugcacag

SEQ ID NO: 1532782 - RNA, 12 nt, Homo sapiens
aggcuuacuuca

SEQ ID NO: 1532783 - RNA, 17 nt, Homo sapiens
agggggugggauuccac

SEQ ID NO: 1532784 - RNA, 22 nt, Homo sapiens
aggucaccgcgaggccuauugu

SEQ ID NO: 1532785 - RNA, 15 nt, Homo sapiens
aggugacugaaggcu

SEQ ID NO: 1532786 - RNA, 14 nt, Homo sapiens
aguaaaaucaaaug

SEQ ID NO: 1532787 - RNA, 22 nt, Homo sapiens
aguaaacccagcugugagacaa

SEQ ID NO: 1532788 - RNA, 23 nt, Homo sapiens
aguaaaggcugcugcuacaaugu

SEQ ID NO: 1532789 - RNA, 17 nt, Homo sapiens
aguaacacucaccauca

SEQ ID NO: 1532790 - RNA, 22 nt, Homo sapiens
aguacaugauaaaugauagaca

SEQ ID NO: 1532791 - RNA, 18 nt, Homo sapiens
aguagagacggguuucac

SEQ ID NO: 1532792 - RNA, 18 nt, Homo sapiens
aguaggggcuacugugac

SEQ ID NO: 1532793 - RNA, 18 nt, Homo sapiens
aguaucucuucagucucu

SEQ ID NO: 1532794 - RNA, 20 nt, Homo sapiens
aguaucucuucagucucuau

SEQ ID NO: 1532795 - RNA, 21 nt, Homo sapiens
aguaucucuucagucucuaua

SEQ ID NO: 1532796 - RNA, 23 nt, Homo sapiens
aguauguuagugcaaauugucac

SEQ ID NO: 1532797 - RNA, 14 nt, Homo sapiens
agucaccucaugga

SEQ ID NO: 1532798 - RNA, 17 nt, Homo sapiens
agucccuccacauuucc

SEQ ID NO: 1532799 - RNA, 14 nt, Homo sapiens
agucucuauaccaa

SEQ ID NO: 1532800 - RNA, 21 nt, Homo sapiens
agucucugaggggcuaccagg

SEQ ID NO: 1532801 - RNA, 21 nt, Homo sapiens
agugcaguggcgcgaucucag

SEQ ID NO: 1532802 - RNA, 21 nt, Homo sapiens
agugcaguggcgugaucucag

SEQ ID NO: 1532803 - RNA, 15 nt, Homo sapiens
agugcuucuccagcc

SEQ ID NO: 1532804 - RNA, 20 nt, Homo sapiens
aguggcaucaucucagcuca

SEQ ID NO: 1532805 - RNA, 15 nt, Homo sapiens
aguggcgugaucuca

SEQ ID NO: 1532806 - RNA, 20 nt, Homo sapiens
aguguuggagaagaacugaa

SEQ ID NO: 1532807 - RNA, 19 nt, Homo sapiens
aguuuauuugaaccaauaa

SEQ ID NO: 1532808 - RNA, 15 nt, Homo sapiens
auaaucuuucacagg

SEQ ID NO: 1532809 - RNA, 22 nt, Homo sapiens
auaaugaauacauuuccaaaau

SEQ ID NO: 1532810 - RNA, 16 nt, Homo sapiens
auaccaauaaagugac

SEQ ID NO: 1532811 - RNA, 13 nt, Homo sapiens
auagaaagcuaua

SEQ ID NO: 1532812 - RNA, 15 nt, Homo sapiens
auagcagcuuuagcc

SEQ ID NO: 1532813 - RNA, 17 nt, Homo sapiens
auagcagcuuuagccaa

SEQ ID NO: 1532814 - RNA, 18 nt, Homo sapiens
auauaauucuuaugccau

SEQ ID NO: 1532815 - RNA, 23 nt, Homo sapiens
auauguguaugcacaguaaaaau

SEQ ID NO: 1532816 - RNA, 11 nt, Homo sapiens
aucaucucagc

SEQ ID NO: 1532817 - RNA, 14 nt, Homo sapiens
aucaucucagcuca

SEQ ID NO: 1532818 - RNA, 22 nt, Homo sapiens
auccagcucuugcucagugaag

SEQ ID NO: 1532819 - RNA, 12 nt, Homo sapiens
aucccagcauuu

SEQ ID NO: 1532820 - RNA, 15 nt, Homo sapiens
aucccaucaggucac

SEQ ID NO: 1532821 - RNA, 19 nt, Homo sapiens
aucuauagcuaaguacaca

SEQ ID NO: 1532822 - RNA, 11 nt, Homo sapiens
aucucagcuca

SEQ ID NO: 1532823 - RNA, 17 nt, Homo sapiens
aucucagcucacugcaa

SEQ ID NO: 1532824 - RNA, 16 nt, Homo sapiens
aucucuucagucucua

SEQ ID NO: 1532825 - RNA, 17 nt, Homo sapiens
aucucuucagucucuau

SEQ ID NO: 1532826 - RNA, 15 nt, Homo sapiens
aucuuauuuaggaag

SEQ ID NO: 1532827 - RNA, 15 nt, Homo sapiens
aaaaauagcagcuuu

SEQ ID NO: 1532828 - RNA, 17 nt, Homo sapiens
aaaacaaggaugaauua

SEQ ID NO: 1532829 - RNA, 16 nt, Homo sapiens
aaaacuaagaaacuua

SEQ ID NO: 1532830 - RNA, 18 nt, Homo sapiens
aaaagcccauucauucca

SEQ ID NO: 1532831 - RNA, 15 nt, Homo sapiens
aaaauauauacuaaa

SEQ ID NO: 1532832 - RNA, 16 nt, Homo sapiens
aaaaucaaaugugcau

SEQ ID NO: 1532833 - RNA, 16 nt, Homo sapiens
aaaauccauacauuug

SEQ ID NO: 1532834 - RNA, 18 nt, Homo sapiens
aaaaugcuucugcacaca

SEQ ID NO: 1532835 - RNA, 23 nt, Homo sapiens
aaaauucucauuuuucauuucuu

SEQ ID NO: 1532836 - RNA, 16 nt, Homo sapiens
aaacauuccauccuug

SEQ ID NO: 1532837 - RNA, 14 nt, Homo sapiens
aaagaggaagcaaa

SEQ ID NO: 1532838 - RNA, 21 nt, Homo sapiens
aaagcugauggccuuguuuca

SEQ ID NO: 1532839 - RNA, 16 nt, Homo sapiens
aaaggacaucagcaaa

SEQ ID NO: 1532840 - RNA, 14 nt, Homo sapiens
aaauaaugaauaca

SEQ ID NO: 1532841 - RNA, 14 nt, Homo sapiens
aaaucaaaugugca

SEQ ID NO: 1532842 - RNA, 22 nt, Homo sapiens
aaaucaggguuaguauugucca

SEQ ID NO: 1532843 - RNA, 16 nt, Homo sapiens
aaaucccaucagguca

SEQ ID NO: 1532844 - RNA, 16 nt, Homo sapiens
aaaucucaauucuucc

SEQ ID NO: 1532845 - RNA, 15 nt, Homo sapiens
aaauggguuacuuga

SEQ ID NO: 1532846 - RNA, 17 nt, Homo sapiens
aaauguauacuauagua

SEQ ID NO: 1532847 - RNA, 16 nt, Homo sapiens
aaauuaugugacauuu

SEQ ID NO: 1532848 - RNA, 20 nt, Homo sapiens
aaauucucauuuuucauuuc

SEQ ID NO: 1532849 - RNA, 24 nt, Homo sapiens
aaccaagguuuugaaaucccauca

SEQ ID NO: 1532850 - RNA, 17 nt, Homo sapiens
aaccaucaccagaauua

SEQ ID NO: 1532851 - RNA, 14 nt, Homo sapiens
aaccucugccuccc

SEQ ID NO: 1532852 - RNA, 20 nt, Homo sapiens
aacuauugcauuuauaugua

SEQ ID NO: 1532853 - RNA, 20 nt, Homo sapiens
aacucaaccuggacacucuc

SEQ ID NO: 1532854 - RNA, 21 nt, Homo sapiens
aacucaaccuggacacucucu

SEQ ID NO: 1532855 - RNA, 14 nt, Homo sapiens
aacuuaucaucaca

SEQ ID NO: 1532856 - RNA, 20 nt, Homo sapiens
aacuucaguccaacugucaa

SEQ ID NO: 1532857 - RNA, 22 nt, Homo sapiens
aacuucccuuaagagucaucca

SEQ ID NO: 1532858 - RNA, 23 nt, Homo sapiens
aacuugaggacacauguccagug

SEQ ID NO: 1532859 - RNA, 20 nt, Homo sapiens
aagaaacuggggcuccucca

SEQ ID NO: 1532860 - RNA, 23 nt, Homo sapiens
aagaacugaaaucauacuucuua

SEQ ID NO: 1532861 - RNA, 16 nt, Homo sapiens
aagaaugauuaugaau

SEQ ID NO: 1532862 - RNA, 12 nt, Homo sapiens
aagacaccacca

SEQ ID NO: 1532863 - RNA, 14 nt, Homo sapiens
aagacuauaccuua

SEQ ID NO: 1532864 - RNA, 20 nt, Homo sapiens
aagcaauccucccacuucag

SEQ ID NO: 1532865 - RNA, 17 nt, Homo sapiens
aagcaucccucacccau

SEQ ID NO: 1532866 - RNA, 18 nt, Homo sapiens
aagccagauuuuccugaa

SEQ ID NO: 1532867 - RNA, 18 nt, Homo sapiens
aagcccauucauuccauu

SEQ ID NO: 1532868 - RNA, 22 nt, Homo sapiens
aagccuuggggcugaugcaguu

SEQ ID NO: 1532869 - RNA, 21 nt, Homo sapiens
aagcugauggccuuguuucaa

SEQ ID NO: 1532870 - RNA, 20 nt, Homo sapiens
aagcuggagugcaguggcau

SEQ ID NO: 1532871 - RNA, 13 nt, Homo sapiens
aagcuuaugcuua

SEQ ID NO: 1532872 - RNA, 18 nt, Homo sapiens
aaggaaggcuccaucucc

SEQ ID NO: 1532873 - RNA, 17 nt, Homo sapiens
aagugacccugcucuca

SEQ ID NO: 1532874 - RNA, 18 nt, Homo sapiens
aagugcugagauuacaca

SEQ ID NO: 1532875 - RNA, 22 nt, Homo sapiens
aaguugacuuauaguacaugau

SEQ ID NO: 1532876 - RNA, 20 nt, Homo sapiens
aauaaagugacccuguucuc

SEQ ID NO: 1532877 - RNA, 13 nt, Homo sapiens
aauaaauguaucu

SEQ ID NO: 1532878 - RNA, 16 nt, Homo sapiens
aauaaauguaucugaa

SEQ ID NO: 1532879 - RNA, 19 nt, Homo sapiens
aauaauuaguaagcuagca

SEQ ID NO: 1532880 - RNA, 14 nt, Homo sapiens
aauauuucagauaa

SEQ ID NO: 1532881 - RNA, 15 nt, Homo sapiens
aaucaaaugugcauc

SEQ ID NO: 1532882 - RNA, 14 nt, Homo sapiens
aaucaaucuguaaa

SEQ ID NO: 1532883 - RNA, 21 nt, Homo sapiens
aaucaaucuguaaaacuaaga

SEQ ID NO: 1532884 - RNA, 15 nt, Homo sapiens
aaucccaucagguca

SEQ ID NO: 1532885 - RNA, 19 nt, Homo sapiens
aaucgauucugcagcaccg

SEQ ID NO: 1532886 - RNA, 14 nt, Homo sapiens
aauguuaugacuau

SEQ ID NO: 1532887 - RNA, 17 nt, Homo sapiens
aauguuaugacuaugua

SEQ ID NO: 1532888 - RNA, 18 nt, Homo sapiens
aauguuaugacuauguaa

SEQ ID NO: 1532889 - RNA, 15 nt, Homo sapiens
aauuaaaccggacca

SEQ ID NO: 1532890 - RNA, 20 nt, Homo sapiens
aauucucauuuuucauuucu

SEQ ID NO: 1532891 - RNA, 15 nt, Homo sapiens
aauugaggacacuga

SEQ ID NO: 1532892 - RNA, 17 nt, Homo sapiens
aauugaggacacugaua

SEQ ID NO: 1532893 - RNA, 13 nt, Homo sapiens
acaaaauguucac

SEQ ID NO: 1532894 - RNA, 15 nt, Homo sapiens
acaagagggacaagu

SEQ ID NO: 1532895 - RNA, 14 nt, Homo sapiens
acaauaguucugug

SEQ ID NO: 1532896 - RNA, 16 nt, Homo sapiens
acaauaguucuguggg

SEQ ID NO: 1532897 - RNA, 15 nt, Homo sapiens
acacaaaacucucug

SEQ ID NO: 1532898 - RNA, 20 nt, Homo sapiens
acacacgugagcaacugugc

SEQ ID NO: 1532899 - RNA, 23 nt, Homo sapiens
acacagcccugcuucugacauaa

SEQ ID NO: 1532900 - RNA, 12 nt, Homo sapiens
acagaacuacuu

SEQ ID NO: 1532901 - RNA, 17 nt, Homo sapiens
acaucagcaaacaggau

SEQ ID NO: 1532902 - RNA, 15 nt, Homo sapiens
acaugggacauuugc

SEQ ID NO: 1532903 - RNA, 23 nt, Homo sapiens
acauuuuuugggcagcaauuuaa

SEQ ID NO: 1532904 - RNA, 21 nt, Homo sapiens
accaagguuuugaaaucccau

SEQ ID NO: 1532905 - RNA, 23 nt, Homo sapiens
accaauaaagugacccuguucuc

SEQ ID NO: 1532906 - RNA, 13 nt, Homo sapiens
accaaucaugaau

SEQ ID NO: 1532907 - RNA, 17 nt, Homo sapiens
accacuuuuugcagcuu

SEQ ID NO: 1532908 - RNA, 22 nt, Homo sapiens
accaguaaaggcugcugcuaca

SEQ ID NO: 1532909 - RNA, 15 nt, Homo sapiens
uacugugaccaugga

SEQ ID NO: 1532910 - RNA, 16 nt, Homo sapiens
uagaacugauccagca

SEQ ID NO: 1532911 - RNA, 12 nt, Homo sapiens
uagagaagcaag

SEQ ID NO: 1532912 - RNA, 23 nt, Homo sapiens
uagccaagugcagggccuguaau

SEQ ID NO: 1532913 - RNA, 18 nt, Homo sapiens
uaggaaagaggaagcaaa

SEQ ID NO: 1532914 - RNA, 14 nt, Homo sapiens
uagucaccagagac

SEQ ID NO: 1532915 - RNA, 17 nt, Homo sapiens
uauagcuaaguacacaa

SEQ ID NO: 1532916 - RNA, 14 nt, Homo sapiens
uauaguacaugaua

SEQ ID NO: 1532917 - RNA, 17 nt, Homo sapiens
uauauauguguaugcac

SEQ ID NO: 1532918 - RNA, 22 nt, Homo sapiens
uaucaugcaaauuucaugacca

SEQ ID NO: 1532919 - RNA, 20 nt, Homo sapiens
uaucuauagcuaaguacaca

SEQ ID NO: 1532920 - RNA, 15 nt, Homo sapiens
uaucucuucagucuc

SEQ ID NO: 1532921 - RNA, 16 nt, Homo sapiens
uaucucuucagucucu

SEQ ID NO: 1532922 - RNA, 14 nt, Homo sapiens
uaugaacuugagga

SEQ ID NO: 1532923 - RNA, 20 nt, Homo sapiens
uaugugacauuuuacauuaa

SEQ ID NO: 1532924 - RNA, 22 nt, Homo sapiens
uauuagcaagacagcaugccuu

SEQ ID NO: 1532925 - RNA, 17 nt, Homo sapiens
uauucaauaaagcugcu

SEQ ID NO: 1532926 - RNA, 18 nt, Homo sapiens
uauugcauuuauauguac

SEQ ID NO: 1532927 - RNA, 21 nt, Homo sapiens
uauuucaauauuagcaagaca

SEQ ID NO: 1532928 - RNA, 14 nt, Homo sapiens
ucaaaaucaauuaa

SEQ ID NO: 1532929 - RNA, 23 nt, Homo sapiens
ucaaaauucucauuuuucauuuc

SEQ ID NO: 1532930 - RNA, 19 nt, Homo sapiens
ucaaaccaaaucacugaac

SEQ ID NO: 1532931 - RNA, 17 nt, Homo sapiens
ucaaacuccugaccuca

SEQ ID NO: 1532932 - RNA, 15 nt, Homo sapiens
ucaaaucaaucugua

SEQ ID NO: 1532933 - RNA, 12 nt, Homo sapiens
ucaaaugugcau

SEQ ID NO: 1532934 - RNA, 15 nt, Homo sapiens
ucaacaucuagugag

SEQ ID NO: 1532935 - RNA, 14 nt, Homo sapiens
ucaagaacacagcc

SEQ ID NO: 1532936 - RNA, 18 nt, Homo sapiens
ucaaucuguaaaacuaag

SEQ ID NO: 1532937 - RNA, 19 nt, Homo sapiens
ucacccagguuggagugca

SEQ ID NO: 1532938 - RNA, 20 nt, Homo sapiens
ucacccagguuggagugcag

SEQ ID NO: 1532939 - RNA, 23 nt, Homo sapiens
ucaccgcgaggccuauuguugaa

SEQ ID NO: 1532940 - RNA, 15 nt, Homo sapiens
ucacugaacuuugcu

SEQ ID NO: 1532941 - RNA, 14 nt, Homo sapiens
ucacugcaaccucu

SEQ ID NO: 1532942 - RNA, 21 nt, Homo sapiens
ucagaaacacccucacacugg

SEQ ID NO: 1532943 - RNA, 18 nt, Homo sapiens
ucagccuggcugauuauc

SEQ ID NO: 1532944 - RNA, 14 nt, Homo sapiens
ucagcucacugcaa

SEQ ID NO: 1532945 - RNA, 16 nt, Homo sapiens
ucaguuaacuauugca

SEQ ID NO: 1532946 - RNA, 16 nt, Homo sapiens
ucaucacacaacucag

SEQ ID NO: 1532947 - RNA, 19 nt, Homo sapiens
ucaugcauggaaauucccu

SEQ ID NO: 1532948 - RNA, 17 nt, Homo sapiens
ucauggaauuggagcuc

SEQ ID NO: 1532949 - RNA, 16 nt, Homo sapiens
ucauuccauucuggaa

SEQ ID NO: 1532950 - RNA, 14 nt, Homo sapiens
uccacagcugccuc

SEQ ID NO: 1532951 - RNA, 20 nt, Homo sapiens
uccaccucgcagguucaagc

SEQ ID NO: 1532952 - RNA, 14 nt, Homo sapiens
uccagaaagugaca

SEQ ID NO: 1532953 - RNA, 17 nt, Homo sapiens
ucccaaaagcccauuca

SEQ ID NO: 1532954 - RNA, 22 nt, Homo sapiens
ucccaaaagcccauucauucca

SEQ ID NO: 1532955 - RNA, 23 nt, Homo sapiens
ucccaaaagcccauucauuccau

SEQ ID NO: 1532956 - RNA, 20 nt, Homo sapiens
ucccaaagugcugggauuaa

SEQ ID NO: 1532957 - RNA, 20 nt, Homo sapiens
ucccaagcaccugggauuac

SEQ ID NO: 1532958 - RNA, 13 nt, Homo sapiens
ucccaucagguca

SEQ ID NO: 1532959 - RNA, 18 nt, Homo sapiens
ucccuggaaaccuuccac

SEQ ID NO: 1532960 - RNA, 21 nt, Homo sapiens
ucccuucaucuggaaccauca

SEQ ID NO: 1532961 - RNA, 17 nt, Homo sapiens
ucccuucaugcauggaa

SEQ ID NO: 1532962 - RNA, 21 nt, Homo sapiens
uccuaacugaaagaugaucau

SEQ ID NO: 1532963 - RNA, 23 nt, Homo sapiens
uccuaagcuggagugcaguggca

SEQ ID NO: 1532964 - RNA, 20 nt, Homo sapiens
uccuauucaacacacacaug

SEQ ID NO: 1532965 - RNA, 21 nt, Homo sapiens
uccucuccccaugauguuuag

SEQ ID NO: 1532966 - RNA, 16 nt, Homo sapiens
uccuggcaauagucaa

SEQ ID NO: 1532967 - RNA, 13 nt, Homo sapiens
uccuuaccgcaca

SEQ ID NO: 1532968 - RNA, 17 nt, Homo sapiens
ucggagcggcgucccuu

SEQ ID NO: 1532969 - RNA, 13 nt, Homo sapiens
ucuaaacauuuca

SEQ ID NO: 1532970 - RNA, 16 nt, Homo sapiens
ucuauaccaauaaagu

SEQ ID NO: 1532971 - RNA, 20 nt, Homo sapiens
ucucaaacuccugaccucaa

SEQ ID NO: 1532972 - RNA, 23 nt, Homo sapiens
ucucaacuccaaacugacucuua

SEQ ID NO: 1532973 - RNA, 12 nt, Homo sapiens
ucucagcucacu

SEQ ID NO: 1532974 - RNA, 13 nt, Homo sapiens
ucucagcucacua

SEQ ID NO: 1532975 - RNA, 20 nt, Homo sapiens
ucucagcucacuacaaccuc

SEQ ID NO: 1532976 - RNA, 22 nt, Homo sapiens
ucuccaggggccacaagaccau

SEQ ID NO: 1532977 - RNA, 18 nt, Homo sapiens
ucucccaaaaaacuacuu

SEQ ID NO: 1532978 - RNA, 20 nt, Homo sapiens
ucuccuaagcuggagugcag

SEQ ID NO: 1532979 - RNA, 21 nt, Homo sapiens
ucuccuaagcuggagugcagu

SEQ ID NO: 1532980 - RNA, 20 nt, Homo sapiens
ucucgaacuccugaccccaa

SEQ ID NO: 1532981 - RNA, 23 nt, Homo sapiens
ucucuucagucucuauaccaaua

SEQ ID NO: 1532982 - RNA, 17 nt, Homo sapiens
ucugagacagaaucuca

SEQ ID NO: 1532983 - RNA, 18 nt, Homo sapiens
ucugagacagaaucucag

SEQ ID NO: 1532984 - RNA, 16 nt, Homo sapiens
ucugguuuacuucaaa

SEQ ID NO: 1532985 - RNA, 19 nt, Homo sapiens
ucuucaauaguuuuaccua

SEQ ID NO: 1532986 - RNA, 20 nt, Homo sapiens
ucuucccuaucuuugccacc

SEQ ID NO: 1532987 - RNA, 16 nt, Homo sapiens
ugaaaucccaucaggu

SEQ ID NO: 1532988 - RNA, 15 nt, Homo sapiens
ugaaggcuuacuuca

SEQ ID NO: 1532989 - RNA, 16 nt, Homo sapiens
ugaaggcuuacuucag

SEQ ID NO: 1532990 - RNA, 17 nt, Homo sapiens
ugaauaaauguaucuga

SEQ ID NO: 1532991 - RNA, 19 nt, Homo sapiens
ugaauaaauguaucugaau

SEQ ID NO: 1532992 - RNA, 13 nt, Homo sapiens
ugaauacugggaa

SEQ ID NO: 1532993 - RNA, 18 nt, Homo sapiens
ugaauuauauguucagau

SEQ ID NO: 1532994 - RNA, 16 nt, Homo sapiens
ugacccuccaccgcag

SEQ ID NO: 1532995 - RNA, 13 nt, Homo sapiens
ugacccugcucuc

SEQ ID NO: 1532996 - RNA, 14 nt, Homo sapiens
ugacccugcucuca

SEQ ID NO: 1532997 - RNA, 14 nt, Homo sapiens
ugaccuauuuccag

SEQ ID NO: 1532998 - RNA, 20 nt, Homo sapiens
ugaccucaagugaucugccc

SEQ ID NO: 1532999 - RNA, 17 nt, Homo sapiens
ugaccugccucccuuca

SEQ ID NO: 1533000 - RNA, 15 nt, Homo sapiens
ugacuuauaguacau

SEQ ID NO: 1533001 - RNA, 17 nt, Homo sapiens
ugagacagaaucucagu

SEQ ID NO: 1533002 - RNA, 15 nt, Homo sapiens
ugagagacacacuga

SEQ ID NO: 1533003 - RNA, 19 nt, Homo sapiens
ugagagacacacugaagaa

SEQ ID NO: 1533004 - RNA, 18 nt, Homo sapiens
ugagucaaaaaaucucaa

SEQ ID NO: 1533005 - RNA, 13 nt, Homo sapiens
ugcaaccucugcc

SEQ ID NO: 1533006 - RNA, 19 nt, Homo sapiens
ugcaaggccugguguuucu

SEQ ID NO: 1533007 - RNA, 18 nt, Homo sapiens
ugcacagggggaggccau

SEQ ID NO: 1533008 - RNA, 23 nt, Homo sapiens
ugcacagggggaggccauaaaga

SEQ ID NO: 1533009 - RNA, 16 nt, Homo sapiens
ugcacaguaaaaaugg

SEQ ID NO: 1533010 - RNA, 16 nt, Homo sapiens
ugcagcuaacuuauca

SEQ ID NO: 1533011 - RNA, 22 nt, Homo sapiens
ugcaguaggggcuacugugacc

SEQ ID NO: 1533012 - RNA, 19 nt, Homo sapiens
ugcaguggcgcgaucucag

SEQ ID NO: 1533013 - RNA, 20 nt, Homo sapiens
ugcaguggcgcgaucucagc

SEQ ID NO: 1533014 - RNA, 20 nt, Homo sapiens
ugcaguggcgugaucucagc

SEQ ID NO: 1533015 - RNA, 18 nt, Homo sapiens
ugccacccucaugcugug

SEQ ID NO: 1533016 - RNA, 15 nt, Homo sapiens
ugccaccugucuguc

SEQ ID NO: 1533017 - RNA, 21 nt, Homo sapiens
ugcccgccucgaccucucuca

SEQ ID NO: 1533018 - RNA, 17 nt, Homo sapiens
ugcccucucccaaaaaa

SEQ ID NO: 1533019 - RNA, 15 nt, Homo sapiens
ugcugugugacucaa

SEQ ID NO: 1533020 - RNA, 15 nt, Homo sapiens
ugcuucugcacacaa

SEQ ID NO: 1533021 - RNA, 21 nt, Homo sapiens
uggaaaccuuccacccagugc

SEQ ID NO: 1533022 - RNA, 20 nt, Homo sapiens
uggaaauucccuucaucugg

SEQ ID NO: 1533023 - RNA, 14 nt, Homo sapiens
uggaauuggagcuc

SEQ ID NO: 1533024 - RNA, 21 nt, Homo sapiens
uggacacuacacccagcaaua

SEQ ID NO: 1533025 - RNA, 13 nt, Homo sapiens
uggacugcaauga

SEQ ID NO: 1533026 - RNA, 21 nt, Homo sapiens
uggaggggcagagccaggaag

SEQ ID NO: 1533027 - RNA, 11 nt, Homo sapiens
uggagugcagu

SEQ ID NO: 1533028 - RNA, 12 nt, Homo sapiens
uggagugcagug

SEQ ID NO: 1533029 - RNA, 13 nt, Homo sapiens
uggagugcagugg

SEQ ID NO: 1533030 - RNA, 14 nt, Homo sapiens
uggcaauagucaaa

SEQ ID NO: 1533031 - RNA, 13 nt, Homo sapiens
uggcagaagucaa

SEQ ID NO: 1533032 - RNA, 15 nt, Homo sapiens
uggcagcaacaauaa

SEQ ID NO: 1533033 - RNA, 19 nt, Homo sapiens
uggcgcgaucucagcucac

SEQ ID NO: 1533034 - RNA, 20 nt, Homo sapiens
cagcuuuucccaaaagccca

SEQ ID NO: 1533035 - RNA, 14 nt, Homo sapiens
caggcuagauguau

SEQ ID NO: 1533036 - RNA, 17 nt, Homo sapiens
caggcuggagugcagug

SEQ ID NO: 1533037 - RNA, 18 nt, Homo sapiens
cagggccuguaaucccag

SEQ ID NO: 1533038 - RNA, 16 nt, Homo sapiens
cagguuggagugcagu

SEQ ID NO: 1533039 - RNA, 17 nt, Homo sapiens
cagguuggagugcagug

SEQ ID NO: 1533040 - RNA, 18 nt, Homo sapiens
cagguuggagugcagugg

SEQ ID NO: 1533041 - RNA, 15 nt, Homo sapiens
caguaaaaucaaaug

SEQ ID NO: 1533042 - RNA, 21 nt, Homo sapiens
caguaaaaucaaaugugcauc

SEQ ID NO: 1533043 - RNA, 14 nt, Homo sapiens
caguaucucuucag

SEQ ID NO: 1533044 - RNA, 18 nt, Homo sapiens
cagugccagcaccugccc

SEQ ID NO: 1533045 - RNA, 17 nt, Homo sapiens
cagugcugaauuucccu

SEQ ID NO: 1533046 - RNA, 16 nt, Homo sapiens
caguggcgcgaucuca

SEQ ID NO: 1533047 - RNA, 20 nt, Homo sapiens
caguggcgugaucucagcuc

SEQ ID NO: 1533048 - RNA, 19 nt, Homo sapiens
caguuagggcuccuauuca

SEQ ID NO: 1533049 - RNA, 18 nt, Homo sapiens
cauaggcgcaggugcaca

SEQ ID NO: 1533050 - RNA, 19 nt, Homo sapiens
cauaggcgcaggugcacag

SEQ ID NO: 1533051 - RNA, 21 nt, Homo sapiens
cauauauauauagcagcuuua

SEQ ID NO: 1533052 - RNA, 12 nt, Homo sapiens
cauccaacacug

SEQ ID NO: 1533053 - RNA, 13 nt, Homo sapiens
cauccaacacugg

SEQ ID NO: 1533054 - RNA, 13 nt, Homo sapiens
cauccuucaucug

SEQ ID NO: 1533055 - RNA, 19 nt, Homo sapiens
cauccuugagucaaaaaau

SEQ ID NO: 1533056 - RNA, 14 nt, Homo sapiens
caucuacauacaca

SEQ ID NO: 1533057 - RNA, 16 nt, Homo sapiens
cauggaauuggagcuc

SEQ ID NO: 1533058 - RNA, 15 nt, Homo sapiens
cauggcagaagucaa

SEQ ID NO: 1533059 - RNA, 19 nt, Homo sapiens
cauucauuccauucuggaa

SEQ ID NO: 1533060 - RNA, 16 nt, Homo sapiens
cauuccauucuggaag

SEQ ID NO: 1533061 - RNA, 21 nt, Homo sapiens
cauuguauauauguguaugca

SEQ ID NO: 1533062 - RNA, 18 nt, Homo sapiens
cauuucuuuucuuucuug

SEQ ID NO: 1533063 - RNA, 14 nt, Homo sapiens
cauuugcucaugga

SEQ ID NO: 1533064 - RNA, 22 nt, Homo sapiens
ccaaaagcccauucauuccauu

SEQ ID NO: 1533065 - RNA, 13 nt, Homo sapiens
ccaaaauggucuc

SEQ ID NO: 1533066 - RNA, 20 nt, Homo sapiens
ccaagguuuugaaaucccau

SEQ ID NO: 1533067 - RNA, 14 nt, Homo sapiens
ccaaucaugaauua

SEQ ID NO: 1533068 - RNA, 15 nt, Homo sapiens
ccacccagugcugaa

SEQ ID NO: 1533069 - RNA, 24 nt, Homo sapiens
ccacccucaugcugugugacucaa

SEQ ID NO: 1533070 - RNA, 10 nt, Homo sapiens
ccaccucuca

SEQ ID NO: 1533071 - RNA, 20 nt, Homo sapiens
ccagagcggcuucaccugcg

SEQ ID NO: 1533072 - RNA, 23 nt, Homo sapiens
ccagccacggggacucagcccuu

SEQ ID NO: 1533073 - RNA, 16 nt, Homo sapiens
ccagcccuguccccua

SEQ ID NO: 1533074 - RNA, 17 nt, Homo sapiens
ccaggcuggacugcaau

SEQ ID NO: 1533075 - RNA, 20 nt, Homo sapiens
ccaggcuggacugcaaugac

SEQ ID NO: 1533076 - RNA, 17 nt, Homo sapiens
ccaggcuggagugcagu

SEQ ID NO: 1533077 - RNA, 20 nt, Homo sapiens
ccaguaaaaucaaaugugca

SEQ ID NO: 1533078 - RNA, 20 nt, Homo sapiens
ccaguaucucuucagucucu

SEQ ID NO: 1533079 - RNA, 12 nt, Homo sapiens
ccauacauuugu

SEQ ID NO: 1533080 - RNA, 18 nt, Homo sapiens
ccaucaggucaccgcgag

SEQ ID NO: 1533081 - RNA, 15 nt, Homo sapiens
ccauccuugagucaa

SEQ ID NO: 1533082 - RNA, 18 nt, Homo sapiens
ccauggacacuacaccca

SEQ ID NO: 1533083 - RNA, 17 nt, Homo sapiens
cccaaaagcccauucau

SEQ ID NO: 1533084 - RNA, 16 nt, Homo sapiens
cccaaguuauccaccu

SEQ ID NO: 1533085 - RNA, 21 nt, Homo sapiens
cccagaaugagacauccagca

SEQ ID NO: 1533086 - RNA, 13 nt, Homo sapiens
cccaguaaaauca

SEQ ID NO: 1533087 - RNA, 21 nt, Homo sapiens
cccaguaaaaucaaaugugca

SEQ ID NO: 1533088 - RNA, 14 nt, Homo sapiens
cccauucauuccau

SEQ ID NO: 1533089 - RNA, 21 nt, Homo sapiens
cccauuuuuaaaauacauugu

SEQ ID NO: 1533090 - RNA, 17 nt, Homo sapiens
ccccauccaacacugga

SEQ ID NO: 1533091 - RNA, 12 nt, Homo sapiens
cccuaaccaagu

SEQ ID NO: 1533092 - RNA, 19 nt, Homo sapiens
cccuacccccaguaaaauc

SEQ ID NO: 1533093 - RNA, 20 nt, Homo sapiens
cccuacccccaguaaaauca

SEQ ID NO: 1533094 - RNA, 12 nt, Homo sapiens
cccucacccauc

SEQ ID NO: 1533095 - RNA, 12 nt, Homo sapiens
cccucugcaguc

SEQ ID NO: 1533096 - RNA, 13 nt, Homo sapiens
cccucugcagucu

SEQ ID NO: 1533097 - RNA, 15 nt, Homo sapiens
cccucugcagucucu

SEQ ID NO: 1533098 - RNA, 17 nt, Homo sapiens
cccucugcagucucuau

SEQ ID NO: 1533099 - RNA, 18 nt, Homo sapiens
cccucugcagucucuaua

SEQ ID NO: 1533100 - RNA, 17 nt, Homo sapiens
cccugcccucucccaaa

SEQ ID NO: 1533101 - RNA, 19 nt, Homo sapiens
cccuggucccucugcaguc

SEQ ID NO: 1533102 - RNA, 17 nt, Homo sapiens
cccuuaagagucaucca

SEQ ID NO: 1533103 - RNA, 18 nt, Homo sapiens
cccuucuauacccaccca

SEQ ID NO: 1533104 - RNA, 16 nt, Homo sapiens
ccgugcuuaaccaaag

SEQ ID NO: 1533105 - RNA, 21 nt, Homo sapiens
ccuaacugaaagaugaucauu

SEQ ID NO: 1533106 - RNA, 13 nt, Homo sapiens
ccuagcaaaagug

SEQ ID NO: 1533107 - RNA, 15 nt, Homo sapiens
ccuaggcuaccucaa

SEQ ID NO: 1533108 - RNA, 23 nt, Homo sapiens
ccuauuguugaauaaauguaucu

SEQ ID NO: 1533109 - RNA, 22 nt, Homo sapiens
ccuauuuccugaacucagcuga

SEQ ID NO: 1533110 - RNA, 18 nt, Homo sapiens
ccucaacuccgugcuuaa

SEQ ID NO: 1533111 - RNA, 19 nt, Homo sapiens
ccucacacugggacuugca

SEQ ID NO: 1533112 - RNA, 20 nt, Homo sapiens
ccucauggaauuggagcucg

SEQ ID NO: 1533113 - RNA, 19 nt, Homo sapiens
ccuccauggcagaagucaa

SEQ ID NO: 1533114 - RNA, 16 nt, Homo sapiens
ccuggucccucugcag

SEQ ID NO: 1533115 - RNA, 22 nt, Homo sapiens
ccugugcacgcgcgcgugcaca

SEQ ID NO: 1533116 - RNA, 18 nt, Homo sapiens
ccuuacagaacuacuucu

SEQ ID NO: 1533117 - RNA, 14 nt, Homo sapiens
ccuucaucuggaac

SEQ ID NO: 1533118 - RNA, 21 nt, Homo sapiens
ccuugagucaaaaaaucucaa

SEQ ID NO: 1533119 - RNA, 11 nt, Homo sapiens
ccuugaugaag

SEQ ID NO: 1533120 - RNA, 12 nt, Homo sapiens
ccuuguuucaaa

SEQ ID NO: 1533121 - RNA, 14 nt, Homo sapiens
ccuuguuucaaaau

SEQ ID NO: 1533122 - RNA, 15 nt, Homo sapiens
ccuuuuuuucccaaa

SEQ ID NO: 1533123 - RNA, 20 nt, Homo sapiens
cgaggccuauuguugaauaa

SEQ ID NO: 1533124 - RNA, 18 nt, Homo sapiens
cgcaguugcaaacaccug

SEQ ID NO: 1533125 - RNA, 16 nt, Homo sapiens
cgcuaccucuccagcc

SEQ ID NO: 1533126 - RNA, 19 nt, Homo sapiens
cggaagcccuugccugaaa

SEQ ID NO: 1533127 - RNA, 23 nt, Homo sapiens
cgugcaguaggggcuacugugac

SEQ ID NO: 1533128 - RNA, 22 nt, Homo sapiens
cgugcucugugggucuccccca

SEQ ID NO: 1533129 - RNA, 21 nt, Homo sapiens
cuaaaugaguaaacccagcug

SEQ ID NO: 1533130 - RNA, 12 nt, Homo sapiens
cuaacauuuccu

SEQ ID NO: 1533131 - RNA, 17 nt, Homo sapiens
cuaacuuaucaucacac

SEQ ID NO: 1533132 - RNA, 17 nt, Homo sapiens
cuaagcuggagugcagu

SEQ ID NO: 1533133 - RNA, 16 nt, Homo sapiens
cuaaggagccuggaaa

SEQ ID NO: 1533134 - RNA, 15 nt, Homo sapiens
cuacacccagcaaua

SEQ ID NO: 1533135 - RNA, 18 nt, Homo sapiens
cuacccccaguaaaauca

SEQ ID NO: 1533136 - RNA, 14 nt, Homo sapiens
cuacccuaaccaag

SEQ ID NO: 1533137 - RNA, 16 nt, Homo sapiens
cuaccucaagacucac

SEQ ID NO: 1533138 - RNA, 24 nt, Homo sapiens
cuagcaaauaguaaucuguaagca

SEQ ID NO: 1533139 - RNA, 13 nt, Homo sapiens
cuagccugugcac

SEQ ID NO: 1533140 - RNA, 14 nt, Homo sapiens
cuaggcuaccucaa

SEQ ID NO: 1533141 - RNA, 20 nt, Homo sapiens
cuaggcuaccucaagacuca

SEQ ID NO: 1533142 - RNA, 15 nt, Homo sapiens
cuagucaccagagac

SEQ ID NO: 1533143 - RNA, 17 nt, Homo sapiens
cuauaccaauaaaguga

SEQ ID NO: 1533144 - RNA, 19 nt, Homo sapiens
cuauaccaauaaagugacc

SEQ ID NO: 1533145 - RNA, 21 nt, Homo sapiens
cuauuguugaauaaauguauc

SEQ ID NO: 1533146 - RNA, 13 nt, Homo sapiens
cucaagacucacc

SEQ ID NO: 1533147 - RNA, 12 nt, Homo sapiens
cucaauucuucc

SEQ ID NO: 1533148 - RNA, 20 nt, Homo sapiens
cucacacugggacuugcaaa

SEQ ID NO: 1533149 - RNA, 14 nt, Homo sapiens
cucacgcagacaca

SEQ ID NO: 1533150 - RNA, 18 nt, Homo sapiens
cucagccucccaaagugc

SEQ ID NO: 1533151 - RNA, 18 nt, Homo sapiens
cucauccucuccacagcu

SEQ ID NO: 1533152 - RNA, 17 nt, Homo sapiens
cucauccuuaccgcaca

SEQ ID NO: 1533153 - RNA, 19 nt, Homo sapiens
cucaugcugugugacucaa

SEQ ID NO: 1533154 - RNA, 15 nt, Homo sapiens
cuccaacucaacuca

SEQ ID NO: 1533155 - RNA, 17 nt, Homo sapiens
cuccagccucagcucuc

SEQ ID NO: 1533156 - RNA, 12 nt, Homo sapiens
cuccaucuccag

SEQ ID NO: 1533157 - RNA, 15 nt, Homo sapiens
cuccauugugccuaa

SEQ ID NO: 1533158 - RNA, 17 nt, Homo sapiens
uauuauuuuugagacag

SEQ ID NO: 1533159 - RNA, 23 nt, Homo sapiens
uauuguugaauaaauguaucuga

SEQ ID NO: 1533160 - RNA, 23 nt, Homo sapiens
uauuuaaauaaagucucucugac

SEQ ID NO: 1533161 - RNA, 14 nt, Homo sapiens
ucaaaugugcaucc

SEQ ID NO: 1533162 - RNA, 15 nt, Homo sapiens
ucaacucaaccugga

SEQ ID NO: 1533163 - RNA, 16 nt, Homo sapiens
ucaacuccgugcuuaa

SEQ ID NO: 1533164 - RNA, 24 nt, Homo sapiens
ucaacuccgugcuuaaccaaagaa

SEQ ID NO: 1533165 - RNA, 15 nt, Homo sapiens
ucaagacucaccuca

SEQ ID NO: 1533166 - RNA, 12 nt, Homo sapiens
ucaccucaugga

SEQ ID NO: 1533167 - RNA, 21 nt, Homo sapiens
ucacguuuggugcuucucaga

SEQ ID NO: 1533168 - RNA, 16 nt, Homo sapiens
ucagaaacacccucac

SEQ ID NO: 1533169 - RNA, 19 nt, Homo sapiens
ucagcucucaguugcagcc

SEQ ID NO: 1533170 - RNA, 22 nt, Homo sapiens
ucaggucaccgcgaggccuauu

SEQ ID NO: 1533171 - RNA, 19 nt, Homo sapiens
ucagucucuauaccaauaa

SEQ ID NO: 1533172 - RNA, 12 nt, Homo sapiens
ucaucucagcuc

SEQ ID NO: 1533173 - RNA, 15 nt, Homo sapiens
ucaucucagcucacu

SEQ ID NO: 1533174 - RNA, 16 nt, Homo sapiens
ucaucucagcucacug

SEQ ID NO: 1533175 - RNA, 21 nt, Homo sapiens
ucauugacuuccugaacaacc

SEQ ID NO: 1533176 - RNA, 18 nt, Homo sapiens
uccaacuaucucauuucc

SEQ ID NO: 1533177 - RNA, 18 nt, Homo sapiens
uccaccgcagaaggaagg

SEQ ID NO: 1533178 - RNA, 13 nt, Homo sapiens
uccagccuucuac

SEQ ID NO: 1533179 - RNA, 23 nt, Homo sapiens
uccagccuucuacugcucuccuc

SEQ ID NO: 1533180 - RNA, 22 nt, Homo sapiens
uccagugggaggugagaccacc

SEQ ID NO: 1533181 - RNA, 21 nt, Homo sapiens
uccauaggcgcaggugcacag

SEQ ID NO: 1533182 - RNA, 17 nt, Homo sapiens
ucccaaaguccugggau

SEQ ID NO: 1533183 - RNA, 18 nt, Homo sapiens
ucccagguucaagugcuu

SEQ ID NO: 1533184 - RNA, 11 nt, Homo sapiens
ucccaucaggu

SEQ ID NO: 1533185 - RNA, 19 nt, Homo sapiens
uccccaacaagauugcuua

SEQ ID NO: 1533186 - RNA, 21 nt, Homo sapiens
uccccuacccccaguaaaauc

SEQ ID NO: 1533187 - RNA, 13 nt, Homo sapiens
ucccucaaccuca

SEQ ID NO: 1533188 - RNA, 14 nt, Homo sapiens
ucccuccacauuuc

SEQ ID NO: 1533189 - RNA, 19 nt, Homo sapiens
uccuaagcuggagugcagu

SEQ ID NO: 1533190 - RNA, 20 nt, Homo sapiens
uccuaagcuggagugcagug

SEQ ID NO: 1533191 - RNA, 15 nt, Homo sapiens
uccucaagaacacag

SEQ ID NO: 1533192 - RNA, 22 nt, Homo sapiens
uccucacgcagacacacccaca

SEQ ID NO: 1533193 - RNA, 16 nt, Homo sapiens
uccugaacucagcuga

SEQ ID NO: 1533194 - RNA, 19 nt, Homo sapiens
uccugggauuacaggugug

SEQ ID NO: 1533195 - RNA, 19 nt, Homo sapiens
uccuugaagauuuaccacu

SEQ ID NO: 1533196 - RNA, 12 nt, Homo sapiens
ucggcaucuucu

SEQ ID NO: 1533197 - RNA, 12 nt, Homo sapiens
ucuaacauuucc

SEQ ID NO: 1533198 - RNA, 13 nt, Homo sapiens
ucuaggcaguuca

SEQ ID NO: 1533199 - RNA, 14 nt, Homo sapiens
ucucaauucuuccc

SEQ ID NO: 1533200 - RNA, 15 nt, Homo sapiens
ucucaauucuucccu

SEQ ID NO: 1533201 - RNA, 20 nt, Homo sapiens
ucucagcucacugcaaccuc

SEQ ID NO: 1533202 - RNA, 21 nt, Homo sapiens
ucucagcucacugcaaccucu

SEQ ID NO: 1533203 - RNA, 18 nt, Homo sapiens
ucuccauggcccugccau

SEQ ID NO: 1533204 - RNA, 20 nt, Homo sapiens
ucucgaagugcugagauuac

SEQ ID NO: 1533205 - RNA, 14 nt, Homo sapiens
ucucuaacauuucc

SEQ ID NO: 1533206 - RNA, 17 nt, Homo sapiens
ucucuucagucucuaua

SEQ ID NO: 1533207 - RNA, 13 nt, Homo sapiens
ucugcagucucua

SEQ ID NO: 1533208 - RNA, 18 nt, Homo sapiens
ucugcagucucuauacca

SEQ ID NO: 1533209 - RNA, 20 nt, Homo sapiens
ucugcagucucuauaccaau

SEQ ID NO: 1533210 - RNA, 16 nt, Homo sapiens
ucugucacccagguug

SEQ ID NO: 1533211 - RNA, 22 nt, Homo sapiens
ucuuagaugcaguucugaagaa

SEQ ID NO: 1533212 - RNA, 19 nt, Homo sapiens
ucuuaugccauauaauuca

SEQ ID NO: 1533213 - RNA, 13 nt, Homo sapiens
ucuucagucucua

SEQ ID NO: 1533214 - RNA, 15 nt, Homo sapiens
ucuucagucucuaua

SEQ ID NO: 1533215 - RNA, 16 nt, Homo sapiens
ugaaaaacaaaauggg

SEQ ID NO: 1533216 - RNA, 22 nt, Homo sapiens
ugaaaacugugcaauguauuaa

SEQ ID NO: 1533217 - RNA, 23 nt, Homo sapiens
ugaaggcugucaggauucuucaa

SEQ ID NO: 1533218 - RNA, 18 nt, Homo sapiens
ugaauaaauguaucugaa

SEQ ID NO: 1533219 - RNA, 13 nt, Homo sapiens
ugaauacauuucc

SEQ ID NO: 1533220 - RNA, 13 nt, Homo sapiens
ugacccuguucuc

SEQ ID NO: 1533221 - RNA, 18 nt, Homo sapiens
ugacugaaggcugucagg

SEQ ID NO: 1533222 - RNA, 20 nt, Homo sapiens
ugagacagagucuuacucug

SEQ ID NO: 1533223 - RNA, 16 nt, Homo sapiens
ugagagacacacugaa

SEQ ID NO: 1533224 - RNA, 12 nt, Homo sapiens
ugaggacacuga

SEQ ID NO: 1533225 - RNA, 13 nt, Homo sapiens
ugaggacacugau

SEQ ID NO: 1533226 - RNA, 16 nt, Homo sapiens
ugaggggcuaccagga

SEQ ID NO: 1533227 - RNA, 18 nt, Homo sapiens
ugaggggcuaccaggaaa

SEQ ID NO: 1533228 - RNA, 17 nt, Homo sapiens
ugaguagaguugaucaa

SEQ ID NO: 1533229 - RNA, 17 nt, Homo sapiens
ugauaugggucuugaua

SEQ ID NO: 1533230 - RNA, 11 nt, Homo sapiens
ugaucucagcu

SEQ ID NO: 1533231 - RNA, 22 nt, Homo sapiens
ugauggcccuaaguuaagcaaa

SEQ ID NO: 1533232 - RNA, 19 nt, Homo sapiens
ugcagcaccggccucggga

SEQ ID NO: 1533233 - RNA, 17 nt, Homo sapiens
ugcagucucuauaccaa

SEQ ID NO: 1533234 - RNA, 19 nt, Homo sapiens
ugcagucucuauaccaaua

SEQ ID NO: 1533235 - RNA, 21 nt, Homo sapiens
ugcagucucuauaccaauaaa

SEQ ID NO: 1533236 - RNA, 19 nt, Homo sapiens
ugcaguggcaucaucucag

SEQ ID NO: 1533237 - RNA, 20 nt, Homo sapiens
ugcaguggcaucaucucagc

SEQ ID NO: 1533238 - RNA, 23 nt, Homo sapiens
ugcaguggcgcgaucucagcuca

SEQ ID NO: 1533239 - RNA, 15 nt, Homo sapiens
ugcauggaaauuccc

SEQ ID NO: 1533240 - RNA, 18 nt, Homo sapiens
ugccaccuccugccucag

SEQ ID NO: 1533241 - RNA, 18 nt, Homo sapiens
ugccaggcuggagugcag

SEQ ID NO: 1533242 - RNA, 20 nt, Homo sapiens
ugccaggcuggagugcagug

SEQ ID NO: 1533243 - RNA, 22 nt, Homo sapiens
ugccaugugcuaguaauuggaa

SEQ ID NO: 1533244 - RNA, 14 nt, Homo sapiens
ugccucagccuccc

SEQ ID NO: 1533245 - RNA, 18 nt, Homo sapiens
ugccucccagguucaagu

SEQ ID NO: 1533246 - RNA, 19 nt, Homo sapiens
ugccucccuucaugcaugg

SEQ ID NO: 1533247 - RNA, 20 nt, Homo sapiens
ugccuucaaaucaaucugua

SEQ ID NO: 1533248 - RNA, 20 nt, Homo sapiens
ugccuucucuaaacauuuca

SEQ ID NO: 1533249 - RNA, 21 nt, Homo sapiens
ugccuugaaggggcagcugug

SEQ ID NO: 1533250 - RNA, 23 nt, Homo sapiens
ugcuaguaauuggaaaggcagcu

SEQ ID NO: 1533251 - RNA, 18 nt, Homo sapiens
ugcucuccuccaccucaa

SEQ ID NO: 1533252 - RNA, 14 nt, Homo sapiens
ugcugccugccugg

SEQ ID NO: 1533253 - RNA, 12 nt, Homo sapiens
ugcuuaauucaa

SEQ ID NO: 1533254 - RNA, 19 nt, Homo sapiens
ugcuuuugggagacuggaa

SEQ ID NO: 1533255 - RNA, 23 nt, Homo sapiens
uggcacuaguauuucuaugaaau

SEQ ID NO: 1533256 - RNA, 15 nt, Homo sapiens
uggcaucaucucagc

SEQ ID NO: 1533257 - RNA, 16 nt, Homo sapiens
uggcaucaucucagcu

SEQ ID NO: 1533258 - RNA, 13 nt, Homo sapiens
uggccaugcagaa

SEQ ID NO: 1533259 - RNA, 20 nt, Homo sapiens
uggccuaggcuaccucaaga

SEQ ID NO: 1533260 - RNA, 14 nt, Homo sapiens
uggccuuguuucaa

SEQ ID NO: 1533261 - RNA, 21 nt, Homo sapiens
uggccuuguuucaaaauucuc

SEQ ID NO: 1533262 - RNA, 16 nt, Homo sapiens
uggcugggaacaacuu

SEQ ID NO: 1533263 - RNA, 21 nt, Homo sapiens
uggucccucugcagucucuau

SEQ ID NO: 1533264 - RNA, 14 nt, Homo sapiens
ugguucacugcaac

SEQ ID NO: 1533265 - RNA, 13 nt, Homo sapiens
uguaaagcuuuaa

SEQ ID NO: 1533266 - RNA, 14 nt, Homo sapiens
uguaucugaauauc

SEQ ID NO: 1533267 - RNA, 23 nt, Homo sapiens
ugucacccagguuggagugcagu

SEQ ID NO: 1533268 - RNA, 17 nt, Homo sapiens
ugucagcccaugugcac

SEQ ID NO: 1533269 - RNA, 14 nt, Homo sapiens
uguccccuaccccc

SEQ ID NO: 1533270 - RNA, 23 nt, Homo sapiens
ugugcacgcgcgcgugcacacac

SEQ ID NO: 1533271 - RNA, 23 nt, Homo sapiens
uguggguagacacacaugaaguc

SEQ ID NO: 1533272 - RNA, 18 nt, Homo sapiens
uguugaauaaauguaucu

SEQ ID NO: 1533273 - RNA, 16 nt, Homo sapiens
uguugacaugggacau

SEQ ID NO: 1533274 - RNA, 18 nt, Homo sapiens
uguugcccacagcuguau

SEQ ID NO: 1533275 - RNA, 17 nt, Homo sapiens
uuaaaauaaugaauaca

SEQ ID NO: 1533276 - RNA, 19 nt, Homo sapiens
uuaaauuuugaaaacugug

SEQ ID NO: 1533277 - RNA, 16 nt, Homo sapiens
uuaaauuuuuuuuaca

SEQ ID NO: 1533278 - RNA, 19 nt, Homo sapiens
uuaacuguuguagaagaca

SEQ ID NO: 1533279 - RNA, 12 nt, Homo sapiens
uuacaacuaagu

SEQ ID NO: 1533280 - RNA, 22 nt, Homo sapiens
uuacaaugaucaccgacugaaa

SEQ ID NO: 1533281 - RNA, 13 nt, Homo sapiens
aaaaaacuacuuc

SEQ ID NO: 1533282 - RNA, 21 nt, Homo sapiens
aaaaauggaaacuauauugac

SEQ ID NO: 1533283 - RNA, 14 nt, Homo sapiens
aaaaauuaucuaua

SEQ ID NO: 1533284 - RNA, 19 nt, Homo sapiens
aaaacaucuuuaaggggag

SEQ ID NO: 1533285 - RNA, 11 nt, Homo sapiens
aaaacuacuuc

SEQ ID NO: 1533286 - RNA, 21 nt, Homo sapiens
aaaacucucugguuuacuuca

SEQ ID NO: 1533287 - RNA, 13 nt, Homo sapiens
aaaacugggacag

SEQ ID NO: 1533288 - RNA, 20 nt, Homo sapiens
aaaagaaugauuaugaauua

SEQ ID NO: 1533289 - RNA, 17 nt, Homo sapiens
aaaagcccauucauucc

SEQ ID NO: 1533290 - RNA, 12 nt, Homo sapiens
aaaauaucacuu

SEQ ID NO: 1533291 - RNA, 18 nt, Homo sapiens
aaaauaucacuugucaau

SEQ ID NO: 1533292 - RNA, 13 nt, Homo sapiens
aaaaucaaaugug

SEQ ID NO: 1533293 - RNA, 19 nt, Homo sapiens
aaaaucucaauucuucccu

SEQ ID NO: 1533294 - RNA, 16 nt, Homo sapiens
aaaaugccuccauggc

SEQ ID NO: 1533295 - RNA, 21 nt, Homo sapiens
aaaauggucacguuuggugcu

SEQ ID NO: 1533296 - RNA, 20 nt, Homo sapiens
aaaauuaaaccggaccaucu

SEQ ID NO: 1533297 - RNA, 11 nt, Homo sapiens
aaaauucucau

SEQ ID NO: 1533298 - RNA, 11 nt, Homo sapiens
aaacauuccau

SEQ ID NO: 1533299 - RNA, 18 nt, Homo sapiens
aaaccacuuuuugcagcu

SEQ ID NO: 1533300 - RNA, 17 nt, Homo sapiens
aaacggaggccagagag

SEQ ID NO: 1533301 - RNA, 13 nt, Homo sapiens
aaacuacuucuuu

SEQ ID NO: 1533302 - RNA, 20 nt, Homo sapiens
aaacucucugguuuacuuca

SEQ ID NO: 1533303 - RNA, 15 nt, Homo sapiens
aaagcccauucauuc

SEQ ID NO: 1533304 - RNA, 22 nt, Homo sapiens
aaagcugauggccuuguuucaa

SEQ ID NO: 1533305 - RNA, 22 nt, Homo sapiens
aaagcugcugagaaucuagccu

SEQ ID NO: 1533306 - RNA, 22 nt, Homo sapiens
aaaggacaucagcaaacaggau

SEQ ID NO: 1533307 - RNA, 12 nt, Homo sapiens
aaaggacuguaa

SEQ ID NO: 1533308 - RNA, 19 nt, Homo sapiens
aaauaguaaucuguaagca

SEQ ID NO: 1533309 - RNA, 17 nt, Homo sapiens
aaaugcuucugcacaca

SEQ ID NO: 1533310 - RNA, 17 nt, Homo sapiens
aaauggcuuccuggcaa

SEQ ID NO: 1533311 - RNA, 21 nt, Homo sapiens
aaauggucacguuuggugcuu

SEQ ID NO: 1533312 - RNA, 14 nt, Homo sapiens
aaauguauacuaua

SEQ ID NO: 1533313 - RNA, 15 nt, Homo sapiens
aaauguaucugaaua

SEQ ID NO: 1533314 - RNA, 18 nt, Homo sapiens
aaauguuaugacuaugua

SEQ ID NO: 1533315 - RNA, 17 nt, Homo sapiens
aaauucccuucaucugg

SEQ ID NO: 1533316 - RNA, 15 nt, Homo sapiens
aacaacuucagucca

SEQ ID NO: 1533317 - RNA, 13 nt, Homo sapiens
aacaaggaugaau

SEQ ID NO: 1533318 - RNA, 22 nt, Homo sapiens
aaccaagguuuugaaaucccau

SEQ ID NO: 1533319 - RNA, 20 nt, Homo sapiens
aaccuccaccucgcagguuc

SEQ ID NO: 1533320 - RNA, 17 nt, Homo sapiens
aaccuggacacucucuu

SEQ ID NO: 1533321 - RNA, 17 nt, Homo sapiens
aacgaaucgauucugca

SEQ ID NO: 1533322 - RNA, 16 nt, Homo sapiens
aacgucuuuuuauauc

SEQ ID NO: 1533323 - RNA, 20 nt, Homo sapiens
aacuacaguuagggcuccua

SEQ ID NO: 1533324 - RNA, 11 nt, Homo sapiens
aacuacuucuu

SEQ ID NO: 1533325 - RNA, 17 nt, Homo sapiens
aacuacuucuuacuucu

SEQ ID NO: 1533326 - RNA, 15 nt, Homo sapiens
aacucaaccuggaca

SEQ ID NO: 1533327 - RNA, 20 nt, Homo sapiens
aacuccgugcuuaaccaaag

SEQ ID NO: 1533328 - RNA, 13 nt, Homo sapiens
aacugucaaccua

SEQ ID NO: 1533329 - RNA, 19 nt, Homo sapiens
aacuuccagauccuggaaa

SEQ ID NO: 1533330 - RNA, 19 nt, Homo sapiens
aacuuguccuuccucaaga

SEQ ID NO: 1533331 - RNA, 16 nt, Homo sapiens
aagaagagaucaggaa

SEQ ID NO: 1533332 - RNA, 13 nt, Homo sapiens
aagacucaccuca

SEQ ID NO: 1533333 - RNA, 19 nt, Homo sapiens
aagagaacuuccagauccu

SEQ ID NO: 1533334 - RNA, 21 nt, Homo sapiens
aagaugguaccaccagucuga

SEQ ID NO: 1533335 - RNA, 14 nt, Homo sapiens
aagcaaaaugcuuc

SEQ ID NO: 1533336 - RNA, 17 nt, Homo sapiens
aagcgauucuccugccu

SEQ ID NO: 1533337 - RNA, 16 nt, Homo sapiens
aagcuauauaagacaa

SEQ ID NO: 1533338 - RNA, 21 nt, Homo sapiens
aagcugcugagaaucuagccu

SEQ ID NO: 1533339 - RNA, 14 nt, Homo sapiens
caugggacauuugc

SEQ ID NO: 1533340 - RNA, 15 nt, Homo sapiens
cauuacaggugugag

SEQ ID NO: 1533341 - RNA, 15 nt, Homo sapiens
cauuccaacuaucuc

SEQ ID NO: 1533342 - RNA, 22 nt, Homo sapiens
cauugcuuuugggagacuggaa

SEQ ID NO: 1533343 - RNA, 23 nt, Homo sapiens
cauugcuuuugggagacuggaaa

SEQ ID NO: 1533344 - RNA, 16 nt, Homo sapiens
cauuugcucauggaau

SEQ ID NO: 1533345 - RNA, 23 nt, Homo sapiens
ccaaaauggucucuaacauuucc

SEQ ID NO: 1533346 - RNA, 17 nt, Homo sapiens
ccaaacugacucuuaag

SEQ ID NO: 1533347 - RNA, 19 nt, Homo sapiens
ccaagagccugagugacag

SEQ ID NO: 1533348 - RNA, 14 nt, Homo sapiens
ccaauaaagugacc

SEQ ID NO: 1533349 - RNA, 15 nt, Homo sapiens
ccacaggaaccacaa

SEQ ID NO: 1533350 - RNA, 15 nt, Homo sapiens
ccacccucaugcugu

SEQ ID NO: 1533351 - RNA, 16 nt, Homo sapiens
ccacuauugugcuguc

SEQ ID NO: 1533352 - RNA, 18 nt, Homo sapiens
ccaggcuggagugcagug

SEQ ID NO: 1533353 - RNA, 16 nt, Homo sapiens
ccagguuggagugcag

SEQ ID NO: 1533354 - RNA, 17 nt, Homo sapiens
ccagguuggagugcagu

SEQ ID NO: 1533355 - RNA, 18 nt, Homo sapiens
ccagguuggagugcagug

SEQ ID NO: 1533356 - RNA, 19 nt, Homo sapiens
ccaguaaaaucaaaugugc

SEQ ID NO: 1533357 - RNA, 15 nt, Homo sapiens
ccagugccagcaccu

SEQ ID NO: 1533358 - RNA, 13 nt, Homo sapiens
ccaucaggucacc

SEQ ID NO: 1533359 - RNA, 22 nt, Homo sapiens
ccauggacacuacacccagcaa

SEQ ID NO: 1533360 - RNA, 21 nt, Homo sapiens
ccauggaggccagugccagca

SEQ ID NO: 1533361 - RNA, 15 nt, Homo sapiens
ccaugugcaccugcc

SEQ ID NO: 1533362 - RNA, 16 nt, Homo sapiens
ccauuuuuaaaauaca

SEQ ID NO: 1533363 - RNA, 22 nt, Homo sapiens
cccaaaagcccauucauuccau

SEQ ID NO: 1533364 - RNA, 18 nt, Homo sapiens
cccaacaagauugcuuaa

SEQ ID NO: 1533365 - RNA, 15 nt, Homo sapiens
cccagccuucacuga

SEQ ID NO: 1533366 - RNA, 17 nt, Homo sapiens
cccaggcuggacugcaa

SEQ ID NO: 1533367 - RNA, 18 nt, Homo sapiens
cccagguuggagugcagu

SEQ ID NO: 1533368 - RNA, 23 nt, Homo sapiens
cccaguaaaaucaaaugugcauc

SEQ ID NO: 1533369 - RNA, 20 nt, Homo sapiens
cccaguaucucuucagucuc

SEQ ID NO: 1533370 - RNA, 13 nt, Homo sapiens
cccaucucaaaaa

SEQ ID NO: 1533371 - RNA, 14 nt, Homo sapiens
ccccagccauccag

SEQ ID NO: 1533372 - RNA, 21 nt, Homo sapiens
ccccaguaucucuucagucuc

SEQ ID NO: 1533373 - RNA, 15 nt, Homo sapiens
cccgucgugcuuccu

SEQ ID NO: 1533374 - RNA, 14 nt, Homo sapiens
cccuccacauuucc

SEQ ID NO: 1533375 - RNA, 21 nt, Homo sapiens
cccugccaugcucuccaaacc

SEQ ID NO: 1533376 - RNA, 18 nt, Homo sapiens
cccuggucccucugcagu

SEQ ID NO: 1533377 - RNA, 17 nt, Homo sapiens
cccugucucuacaaaaa

SEQ ID NO: 1533378 - RNA, 17 nt, Homo sapiens
cccuuaacugcauccag

SEQ ID NO: 1533379 - RNA, 18 nt, Homo sapiens
cccuuaacugcauccagc

SEQ ID NO: 1533380 - RNA, 16 nt, Homo sapiens
cccuucaugcauggaa

SEQ ID NO: 1533381 - RNA, 17 nt, Homo sapiens
ccuaagcuggagugcag

SEQ ID NO: 1533382 - RNA, 18 nt, Homo sapiens
ccuaagcuggagugcagu

SEQ ID NO: 1533383 - RNA, 19 nt, Homo sapiens
ccuaagcuggagugcagug

SEQ ID NO: 1533384 - RNA, 19 nt, Homo sapiens
ccuacccccaguaaaauca

SEQ ID NO: 1533385 - RNA, 19 nt, Homo sapiens
ccuacuagucaccagagac

SEQ ID NO: 1533386 - RNA, 15 nt, Homo sapiens
ccucaauguccccaa

SEQ ID NO: 1533387 - RNA, 14 nt, Homo sapiens
ccucacccauccua

SEQ ID NO: 1533388 - RNA, 19 nt, Homo sapiens
ccucauccucuccacagcu

SEQ ID NO: 1533389 - RNA, 12 nt, Homo sapiens
ccucauggaauu

SEQ ID NO: 1533390 - RNA, 12 nt, Homo sapiens
ccuccaccucaa

SEQ ID NO: 1533391 - RNA, 20 nt, Homo sapiens
ccuccaggguggcagcaaca

SEQ ID NO: 1533392 - RNA, 17 nt, Homo sapiens
ccucccuucaugcaugg

SEQ ID NO: 1533393 - RNA, 20 nt, Homo sapiens
ccucgggaagccccauccaa

SEQ ID NO: 1533394 - RNA, 22 nt, Homo sapiens
ccucucccaaaaaacuacuucu

SEQ ID NO: 1533395 - RNA, 17 nt, Homo sapiens
ccucugcagucucuaua

SEQ ID NO: 1533396 - RNA, 21 nt, Homo sapiens
ccugcguguccccgugcagua

SEQ ID NO: 1533397 - RNA, 18 nt, Homo sapiens
ccuggucccucugcaguc

SEQ ID NO: 1533398 - RNA, 12 nt, Homo sapiens
ccugguguuucu

SEQ ID NO: 1533399 - RNA, 21 nt, Homo sapiens
ccuguccccuacccccaguaa

SEQ ID NO: 1533400 - RNA, 22 nt, Homo sapiens
ccuuaaaauaaugaauacauuu

SEQ ID NO: 1533401 - RNA, 19 nt, Homo sapiens
ccuuaagagucauccagcu

SEQ ID NO: 1533402 - RNA, 13 nt, Homo sapiens
ccuugagucaaaa

SEQ ID NO: 1533403 - RNA, 13 nt, Homo sapiens
cgaacuccugacc

SEQ ID NO: 1533404 - RNA, 13 nt, Homo sapiens
cgagcacugugag

SEQ ID NO: 1533405 - RNA, 14 nt, Homo sapiens
cgagcacugugagc

SEQ ID NO: 1533406 - RNA, 15 nt, Homo sapiens
cgagcacugugagca

SEQ ID NO: 1533407 - RNA, 16 nt, Homo sapiens
cgagugcucauuucag

SEQ ID NO: 1533408 - RNA, 15 nt, Homo sapiens
cgcacggcagccaca

SEQ ID NO: 1533409 - RNA, 20 nt, Homo sapiens
cgcagacacacccacagaag

SEQ ID NO: 1533410 - RNA, 12 nt, Homo sapiens
cgcccucggggc

SEQ ID NO: 1533411 - RNA, 11 nt, Homo sapiens
cgcgaucucag

SEQ ID NO: 1533412 - RNA, 22 nt, Homo sapiens
cggccuggggcgagcacuguga

SEQ ID NO: 1533413 - RNA, 16 nt, Homo sapiens
cggucucauuucuucu

SEQ ID NO: 1533414 - RNA, 22 nt, Homo sapiens
cuacagaagaaacuggggcucc

SEQ ID NO: 1533415 - RNA, 18 nt, Homo sapiens
cuagaguuuagcuggaaa

SEQ ID NO: 1533416 - RNA, 12 nt, Homo sapiens
cuauaccaauaa

SEQ ID NO: 1533417 - RNA, 18 nt, Homo sapiens
cuauaccaauaaagugac

SEQ ID NO: 1533418 - RNA, 14 nt, Homo sapiens
cuauauaagacaag

SEQ ID NO: 1533419 - RNA, 23 nt, Homo sapiens
cucacgcagacacacccacagaa

SEQ ID NO: 1533420 - RNA, 16 nt, Homo sapiens
cucagcucacugcaac

SEQ ID NO: 1533421 - RNA, 17 nt, Homo sapiens
cuccaacccuagcaaaa

SEQ ID NO: 1533422 - RNA, 12 nt, Homo sapiens
cuccacauuucc

SEQ ID NO: 1533423 - RNA, 23 nt, Homo sapiens
cuccaggguggcagcaacaauaa

SEQ ID NO: 1533424 - RNA, 19 nt, Homo sapiens
cucccaagcaccugggauu

SEQ ID NO: 1533425 - RNA, 20 nt, Homo sapiens
cucccaagcaccugggauua

SEQ ID NO: 1533426 - RNA, 19 nt, Homo sapiens
cucccaaguagcugagacu

SEQ ID NO: 1533427 - RNA, 15 nt, Homo sapiens
cuccgcaacagccaa

SEQ ID NO: 1533428 - RNA, 17 nt, Homo sapiens
cucgccggaucugaggg

SEQ ID NO: 1533429 - RNA, 15 nt, Homo sapiens
cucguggaacaguua

SEQ ID NO: 1533430 - RNA, 15 nt, Homo sapiens
cucugcagucucuau

SEQ ID NO: 1533431 - RNA, 19 nt, Homo sapiens
cucugcagucucuauacca

SEQ ID NO: 1533432 - RNA, 23 nt, Homo sapiens
cucugcagucucuauaccaauaa

SEQ ID NO: 1533433 - RNA, 22 nt, Homo sapiens
cucuucagucucuauaccaaua

SEQ ID NO: 1533434 - RNA, 17 nt, Homo sapiens
cugaaaucauacuucuu

SEQ ID NO: 1533435 - RNA, 21 nt, Homo sapiens
cugacuguuuccaucaagggu

SEQ ID NO: 1533436 - RNA, 18 nt, Homo sapiens
cugauggccuuguuucaa

SEQ ID NO: 1533437 - RNA, 13 nt, Homo sapiens
cugcagucucuau

SEQ ID NO: 1533438 - RNA, 14 nt, Homo sapiens
cugcagucucuaua

SEQ ID NO: 1533439 - RNA, 22 nt, Homo sapiens
cugcauuauauuuauuacugua

SEQ ID NO: 1533440 - RNA, 14 nt, Homo sapiens
cuggaaaagggaag

SEQ ID NO: 1533441 - RNA, 12 nt, Homo sapiens
cuggagugcagu

SEQ ID NO: 1533442 - RNA, 20 nt, Homo sapiens
cuggagugcaguggcgcgau

SEQ ID NO: 1533443 - RNA, 17 nt, Homo sapiens
cuggcauuacaggugug

SEQ ID NO: 1533444 - RNA, 14 nt, Homo sapiens
cuggcugauuauca

SEQ ID NO: 1533445 - RNA, 13 nt, Homo sapiens
cugggaauggagg

SEQ ID NO: 1533446 - RNA, 22 nt, Homo sapiens
cugggauuacaagcaugaguca

SEQ ID NO: 1533447 - RNA, 18 nt, Homo sapiens
cugggauuacagguguga

SEQ ID NO: 1533448 - RNA, 24 nt, Homo sapiens
cuguaagaaaauaucacuugucaa

SEQ ID NO: 1533449 - RNA, 15 nt, Homo sapiens
cuguccccuaccccc

SEQ ID NO: 1533450 - RNA, 13 nt, Homo sapiens
cugucuacacuaa

SEQ ID NO: 1533451 - RNA, 14 nt, Homo sapiens
cugugugacucaaa

SEQ ID NO: 1533452 - RNA, 23 nt, Homo sapiens
cuuaaaauaaugaauacauuucc

SEQ ID NO: 1533453 - RNA, 13 nt, Homo sapiens
cuuagaugcaguu

SEQ ID NO: 1533454 - RNA, 14 nt, Homo sapiens
cuuaugccauauaa

SEQ ID NO: 1533455 - RNA, 19 nt, Homo sapiens
cuucaaaucaaucuguaaa

SEQ ID NO: 1533456 - RNA, 12 nt, Homo sapiens
cuucacugacag

SEQ ID NO: 1533457 - RNA, 17 nt, Homo sapiens
cuucagucucuauacca

SEQ ID NO: 1533458 - RNA, 14 nt, Homo sapiens
cuucggcaucuucu

SEQ ID NO: 1533459 - RNA, 18 nt, Homo sapiens
cuucugaauaaagcaauu

SEQ ID NO: 1533460 - RNA, 13 nt, Homo sapiens
cuugccacacccc

SEQ ID NO: 1533461 - RNA, 16 nt, Homo sapiens
cuugguucacugcaac

SEQ ID NO: 1533462 - RNA, 20 nt, Homo sapiens
cuuugcugagccuguaaaau

SEQ ID NO: 1533463 - RNA, 13 nt, Homo sapiens
gaaaacauuccau

SEQ ID NO: 1533464 - RNA, 15 nt, Homo sapiens
gaaaacugugcaaug

SEQ ID NO: 1533465 - RNA, 17 nt, Homo sapiens
aguucaccagacucuau

SEQ ID NO: 1533466 - RNA, 16 nt, Homo sapiens
aguucauaauguggug

SEQ ID NO: 1533467 - RNA, 20 nt, Homo sapiens
aguucuuacugcuuaauuca

SEQ ID NO: 1533468 - RNA, 22 nt, Homo sapiens
auaaagaucaaacaugcaugga

SEQ ID NO: 1533469 - RNA, 14 nt, Homo sapiens
auaaagugacccug

SEQ ID NO: 1533470 - RNA, 19 nt, Homo sapiens
auaaagugacccuguucuc

SEQ ID NO: 1533471 - RNA, 19 nt, Homo sapiens
auaagcaaaaacaaaaaga

SEQ ID NO: 1533472 - RNA, 14 nt, Homo sapiens
auacauguaauucu

SEQ ID NO: 1533473 - RNA, 15 nt, Homo sapiens
auacauguaauucua

SEQ ID NO: 1533474 - RNA, 15 nt, Homo sapiens
auacauuuccaaaau

SEQ ID NO: 1533475 - RNA, 18 nt, Homo sapiens
auagcuaaguacacaaua

SEQ ID NO: 1533476 - RNA, 20 nt, Homo sapiens
auauaaaauguuuaaucucu

SEQ ID NO: 1533477 - RNA, 15 nt, Homo sapiens
auauguucagauuau

SEQ ID NO: 1533478 - RNA, 18 nt, Homo sapiens
auauucaauaaagcugcu

SEQ ID NO: 1533479 - RNA, 23 nt, Homo sapiens
auauuguuugcuaagcauuccaa

SEQ ID NO: 1533480 - RNA, 15 nt, Homo sapiens
aucaggucaccgcga

SEQ ID NO: 1533481 - RNA, 20 nt, Homo sapiens
auccagcucuugcucaguga

SEQ ID NO: 1533482 - RNA, 21 nt, Homo sapiens
auccaggccggcuugccacac

SEQ ID NO: 1533483 - RNA, 22 nt, Homo sapiens
auccauaggcgcaggugcacag

SEQ ID NO: 1533484 - RNA, 15 nt, Homo sapiens
auccuucaucuggau

SEQ ID NO: 1533485 - RNA, 15 nt, Homo sapiens
aucuacauacacagu

SEQ ID NO: 1533486 - RNA, 23 nt, Homo sapiens
aucuacauacacaguggccaagc

SEQ ID NO: 1533487 - RNA, 14 nt, Homo sapiens
aucucaauucuucc

SEQ ID NO: 1533488 - RNA, 19 nt, Homo sapiens
aucucauuuccaagcaagu

SEQ ID NO: 1533489 - RNA, 13 nt, Homo sapiens
aucuccaguggga

SEQ ID NO: 1533490 - RNA, 13 nt, Homo sapiens
aucucuucagucu

SEQ ID NO: 1533491 - RNA, 22 nt, Homo sapiens
aucucuucagucucuauaccaa

SEQ ID NO: 1533492 - RNA, 15 nt, Homo sapiens
aucuuucacagggga

SEQ ID NO: 1533493 - RNA, 16 nt, Homo sapiens
augaaguccaagcauu

SEQ ID NO: 1533494 - RNA, 18 nt, Homo sapiens
augagacauccagcagau

SEQ ID NO: 1533495 - RNA, 15 nt, Homo sapiens
augcaaauuucauga

SEQ ID NO: 1533496 - RNA, 18 nt, Homo sapiens
augcauggaaauucccuu

SEQ ID NO: 1533497 - RNA, 20 nt, Homo sapiens
augccuuuucccaacuccag

SEQ ID NO: 1533498 - RNA, 18 nt, Homo sapiens
augcgagugcucauuuca

SEQ ID NO: 1533499 - RNA, 16 nt, Homo sapiens
auggaagggcaaguuu

SEQ ID NO: 1533500 - RNA, 22 nt, Homo sapiens
auggcacuaguauuucuaugaa

SEQ ID NO: 1533501 - RNA, 20 nt, Homo sapiens
auggguuagggaaaacauuc

SEQ ID NO: 1533502 - RNA, 22 nt, Homo sapiens
auggguuagggaaaacauucca

SEQ ID NO: 1533503 - RNA, 14 nt, Homo sapiens
auguaucugaauau

SEQ ID NO: 1533504 - RNA, 22 nt, Homo sapiens
auguggaccuuagaauacaguu

SEQ ID NO: 1533505 - RNA, 15 nt, Homo sapiens
auguuaugacuaugu

SEQ ID NO: 1533506 - RNA, 22 nt, Homo sapiens
auuaaaccggaccaucucucca

SEQ ID NO: 1533507 - RNA, 16 nt, Homo sapiens
auuagaauaccacagg

SEQ ID NO: 1533508 - RNA, 15 nt, Homo sapiens
auuauaccucaaugu

SEQ ID NO: 1533509 - RNA, 14 nt, Homo sapiens
auuauauguucaga

SEQ ID NO: 1533510 - RNA, 20 nt, Homo sapiens
acuacaguuagggcuccuau

SEQ ID NO: 1533511 - RNA, 15 nt, Homo sapiens
acuacauauuguaaa

SEQ ID NO: 1533512 - RNA, 22 nt, Homo sapiens
acuauauuguuugcuaagcauu

SEQ ID NO: 1533513 - RNA, 21 nt, Homo sapiens
acucagccuggcugauuauca

SEQ ID NO: 1533514 - RNA, 14 nt, Homo sapiens
acucuuucuuucaa

SEQ ID NO: 1533515 - RNA, 18 nt, Homo sapiens
acugcagcuaacuuauca

SEQ ID NO: 1533516 - RNA, 17 nt, Homo sapiens
acugcuacaaucaaggc

SEQ ID NO: 1533517 - RNA, 13 nt, Homo sapiens
acugcuccagugg

SEQ ID NO: 1533518 - RNA, 14 nt, Homo sapiens
acugggaaucaaga

SEQ ID NO: 1533519 - RNA, 15 nt, Homo sapiens
acuuauaguacauga

SEQ ID NO: 1533520 - RNA, 14 nt, Homo sapiens
agaaacacccucac

SEQ ID NO: 1533521 - RNA, 12 nt, Homo sapiens
agaaacauuugg

SEQ ID NO: 1533522 - RNA, 13 nt, Homo sapiens
agaagaacugaaa

SEQ ID NO: 1533523 - RNA, 22 nt, Homo sapiens
agaaggacacuagccugugcac

SEQ ID NO: 1533524 - RNA, 21 nt, Homo sapiens
agaaugaauacugggaaucaa

SEQ ID NO: 1533525 - RNA, 15 nt, Homo sapiens
agaaugagacaucca

SEQ ID NO: 1533526 - RNA, 19 nt, Homo sapiens
agacaagagggacaagugg

SEQ ID NO: 1533527 - RNA, 15 nt, Homo sapiens
agacagaaucucagu

SEQ ID NO: 1533528 - RNA, 22 nt, Homo sapiens
agacauuuuaaaaaauggucac

SEQ ID NO: 1533529 - RNA, 18 nt, Homo sapiens
agaccaucuacauacaca

SEQ ID NO: 1533530 - RNA, 15 nt, Homo sapiens
agacgagguuucacu

SEQ ID NO: 1533531 - RNA, 13 nt, Homo sapiens
agacuagucucaa

SEQ ID NO: 1533532 - RNA, 18 nt, Homo sapiens
agagaagcaaguaaaaag

SEQ ID NO: 1533533 - RNA, 17 nt, Homo sapiens
agaguuuagcuggaaaa

SEQ ID NO: 1533534 - RNA, 13 nt, Homo sapiens
agauaaucacaau

SEQ ID NO: 1533535 - RNA, 17 nt, Homo sapiens
agauaggccaugggcac

SEQ ID NO: 1533536 - RNA, 13 nt, Homo sapiens
agauccuggaaau

SEQ ID NO: 1533537 - RNA, 10 nt, Homo sapiens
agaugcaguu

SEQ ID NO: 1533538 - RNA, 18 nt, Homo sapiens
agcaaauaguaaucugua

SEQ ID NO: 1533539 - RNA, 15 nt, Homo sapiens
agcaccggccucggg

SEQ ID NO: 1533540 - RNA, 16 nt, Homo sapiens
agcacugcuccagugg

SEQ ID NO: 1533541 - RNA, 22 nt, Homo sapiens
agcagcuuuagccaagugcagg

SEQ ID NO: 1533542 - RNA, 15 nt, Homo sapiens
agcaucccucaccca

SEQ ID NO: 1533543 - RNA, 16 nt, Homo sapiens
agcaugccuucaaauc

SEQ ID NO: 1533544 - RNA, 17 nt, Homo sapiens
agccaccacauccagcc

SEQ ID NO: 1533545 - RNA, 15 nt, Homo sapiens
agcccauucauucca

SEQ ID NO: 1533546 - RNA, 16 nt, Homo sapiens
agcccauucauuccau

SEQ ID NO: 1533547 - RNA, 17 nt, Homo sapiens
agcccccaguaucucuu

SEQ ID NO: 1533548 - RNA, 18 nt, Homo sapiens
agcccccaguaucucuuc

SEQ ID NO: 1533549 - RNA, 19 nt, Homo sapiens
agcccuguccccuaccccc

SEQ ID NO: 1533550 - RNA, 21 nt, Homo sapiens
agcccuucuauacccacccag

SEQ ID NO: 1533551 - RNA, 17 nt, Homo sapiens
agcucacuacaaccucc

SEQ ID NO: 1533552 - RNA, 17 nt, Homo sapiens
agcucacugcaaccucu

SEQ ID NO: 1533553 - RNA, 17 nt, Homo sapiens
agcucucaguugcagcc

SEQ ID NO: 1533554 - RNA, 17 nt, Homo sapiens
agcuggagaugaggcca

SEQ ID NO: 1533555 - RNA, 21 nt, Homo sapiens
agcuguggccuaggcuaccuc

SEQ ID NO: 1533556 - RNA, 14 nt, Homo sapiens
aggacccaggacag

SEQ ID NO: 1533557 - RNA, 17 nt, Homo sapiens
aggaucauuugagccca

SEQ ID NO: 1533558 - RNA, 14 nt, Homo sapiens
aggccagugccagc

SEQ ID NO: 1533559 - RNA, 15 nt, Homo sapiens
aggcuggacugcaau

SEQ ID NO: 1533560 - RNA, 15 nt, Homo sapiens
aggcuggagugcagu

SEQ ID NO: 1533561 - RNA, 16 nt, Homo sapiens
aggcuggagugcagug

SEQ ID NO: 1533562 - RNA, 21 nt, Homo sapiens
aggugacugaaggcugucagg

SEQ ID NO: 1533563 - RNA, 10 nt, Homo sapiens
agguucaagc

SEQ ID NO: 1533564 - RNA, 20 nt, Homo sapiens
agguuggagugcaguggcgu

SEQ ID NO: 1533565 - RNA, 18 nt, Homo sapiens
aguaaucuguaagcauaa

SEQ ID NO: 1533566 - RNA, 19 nt, Homo sapiens
aguagagacggguuucacc

SEQ ID NO: 1533567 - RNA, 23 nt, Homo sapiens
aguagcguuuuuuaaauguauac

SEQ ID NO: 1533568 - RNA, 17 nt, Homo sapiens
aguaggggcuacuguga

SEQ ID NO: 1533569 - RNA, 16 nt, Homo sapiens
agucaacgccucggug

SEQ ID NO: 1533570 - RNA, 15 nt, Homo sapiens
agucaccucauggaa

SEQ ID NO: 1533571 - RNA, 17 nt, Homo sapiens
agucucuauaccaauaa

SEQ ID NO: 1533572 - RNA, 23 nt, Homo sapiens
agucucuauaccaauaaagugac

SEQ ID NO: 1533573 - RNA, 17 nt, Homo sapiens
agugacccugcucucac

SEQ ID NO: 1533574 - RNA, 19 nt, Homo sapiens
agugaucaaacuacauauu

SEQ ID NO: 1533575 - RNA, 22 nt, Homo sapiens
agugcaguggcaucaucucagc

SEQ ID NO: 1533576 - RNA, 20 nt, Homo sapiens
agugcaguggcgcgaucuca

SEQ ID NO: 1533577 - RNA, 22 nt, Homo sapiens
agugcaguggcgcgaucucagc

SEQ ID NO: 1533578 - RNA, 23 nt, Homo sapiens
agugcaguggcgcgaucucagcu

SEQ ID NO: 1533579 - RNA, 22 nt, Homo sapiens
agugcaguggcgugaucucagc

SEQ ID NO: 1533580 - RNA, 15 nt, Homo sapiens
aguggcaucaucuca

SEQ ID NO: 1533581 - RNA, 16 nt, Homo sapiens
aguuuuauaugcuucu

SEQ ID NO: 1533582 - RNA, 21 nt, Homo sapiens
auaaaauguuuaaucucugcu

SEQ ID NO: 1533583 - RNA, 15 nt, Homo sapiens
auaaagucucucuga

SEQ ID NO: 1533584 - RNA, 15 nt, Homo sapiens
auaaauguaucugaa

SEQ ID NO: 1533585 - RNA, 17 nt, Homo sapiens
auaaauguaucugaaua

SEQ ID NO: 1533586 - RNA, 17 nt, Homo sapiens
auacugggaaucaagac

SEQ ID NO: 1533587 - RNA, 19 nt, Homo sapiens
auagcuaaguacacaauaa

SEQ ID NO: 1533588 - RNA, 18 nt, Homo sapiens
auaggcgcaggugcacag

SEQ ID NO: 1533589 - RNA, 15 nt, Homo sapiens
auaucaugcaaauuu

SEQ ID NO: 1533590 - RNA, 16 nt, Homo sapiens
auauuguaaagcccau

SEQ ID NO: 1533591 - RNA, 14 nt, Homo sapiens
aucaguuaacuauu

SEQ ID NO: 1533592 - RNA, 13 nt, Homo sapiens
aucaucucagcuc

SEQ ID NO: 1533593 - RNA, 13 nt, Homo sapiens
auccaacacugga

SEQ ID NO: 1533594 - RNA, 19 nt, Homo sapiens
auccaacacuggaugguca

SEQ ID NO: 1533595 - RNA, 14 nt, Homo sapiens
auccauacauuugu

SEQ ID NO: 1533596 - RNA, 23 nt, Homo sapiens
auccauaggcgcaggugcacagg

SEQ ID NO: 1533597 - RNA, 18 nt, Homo sapiens
aucuaaauguauucugca

SEQ ID NO: 1533598 - RNA, 18 nt, Homo sapiens
aucuauagcuaaguacac

SEQ ID NO: 1533599 - RNA, 22 nt, Homo sapiens
aucuauagcuaaguacacaaua

SEQ ID NO: 1533600 - RNA, 14 nt, Homo sapiens
aucuggaaccauca

SEQ ID NO: 1533601 - RNA, 17 nt, Homo sapiens
aucuucuuuggggcccu

SEQ ID NO: 1533602 - RNA, 16 nt, Homo sapiens
augagagacacacuga

SEQ ID NO: 1533603 - RNA, 17 nt, Homo sapiens
augcauggaaauucccu

SEQ ID NO: 1533604 - RNA, 15 nt, Homo sapiens
augcuucugcacaca

SEQ ID NO: 1533605 - RNA, 17 nt, Homo sapiens
auggaaauucccuucau

SEQ ID NO: 1533606 - RNA, 23 nt, Homo sapiens
auggcacuaguauuucuaugaaa

SEQ ID NO: 1533607 - RNA, 23 nt, Homo sapiens
auggguuagggaaaacauuccau

SEQ ID NO: 1533608 - RNA, 14 nt, Homo sapiens
auguaauucuacca

SEQ ID NO: 1533609 - RNA, 23 nt, Homo sapiens
auuaauaacgucuuuuuauaucu

SEQ ID NO: 1533610 - RNA, 16 nt, Homo sapiens
auucaaaaauuaucua

SEQ ID NO: 1533611 - RNA, 19 nt, Homo sapiens
auucaaaaauuaucuauag

SEQ ID NO: 1533612 - RNA, 17 nt, Homo sapiens
auucaacacacacaugc

SEQ ID NO: 1533613 - RNA, 14 nt, Homo sapiens
auucccagccagca

SEQ ID NO: 1533614 - RNA, 23 nt, Homo sapiens
auucccuucaucuggaaccauca

SEQ ID NO: 1533615 - RNA, 18 nt, Homo sapiens
auucuccugccucagccu

SEQ ID NO: 1533616 - RNA, 20 nt, Homo sapiens
auugaccuauuuccagaaau

SEQ ID NO: 1533617 - RNA, 15 nt, Homo sapiens
auuggaaaggcagcu

SEQ ID NO: 1533618 - RNA, 13 nt, Homo sapiens
auuugcucaugga

SEQ ID NO: 1533619 - RNA, 16 nt, Homo sapiens
auuugcucauggaauu

SEQ ID NO: 1533620 - RNA, 13 nt, Homo sapiens
auuuuccugaaaa

SEQ ID NO: 1533621 - RNA, 18 nt, Homo sapiens
auuuuuugggcagcaauu

SEQ ID NO: 1533622 - RNA, 13 nt, Homo sapiens
auuuuuuuuacau

SEQ ID NO: 1533623 - RNA, 21 nt, Homo sapiens
caaaaaaaaaauuugccaaga

SEQ ID NO: 1533624 - RNA, 15 nt, Homo sapiens
caaaagcccauucau

SEQ ID NO: 1533625 - RNA, 20 nt, Homo sapiens
caaaagcccauucauuccau

SEQ ID NO: 1533626 - RNA, 17 nt, Homo sapiens
caaaaugcuucugcaca

SEQ ID NO: 1533627 - RNA, 14 nt, Homo sapiens
caaaauguucacaa

SEQ ID NO: 1533628 - RNA, 17 nt, Homo sapiens
caaauaguaaucuguaa

SEQ ID NO: 1533629 - RNA, 13 nt, Homo sapiens
caaaucaaucugu

SEQ ID NO: 1533630 - RNA, 14 nt, Homo sapiens
caaccucugccucc

SEQ ID NO: 1533631 - RNA, 20 nt, Homo sapiens
caagacaagacuauaccuua

SEQ ID NO: 1533632 - RNA, 18 nt, Homo sapiens
caagaccaucuacauaca

SEQ ID NO: 1533633 - RNA, 17 nt, Homo sapiens
caagcauuuagauguau

SEQ ID NO: 1533634 - RNA, 20 nt, Homo sapiens
uaagcauaagcuuaugcuua

SEQ ID NO: 1533635 - RNA, 19 nt, Homo sapiens
uaaguacacaauaagcaaa

SEQ ID NO: 1533636 - RNA, 12 nt, Homo sapiens
uaaucuacuuuc

SEQ ID NO: 1533637 - RNA, 16 nt, Homo sapiens
uaaucuguaagcauaa

SEQ ID NO: 1533638 - RNA, 21 nt, Homo sapiens
uaaucuguaagcauaagcuua

SEQ ID NO: 1533639 - RNA, 17 nt, Homo sapiens
uaaucuuucacagggga

SEQ ID NO: 1533640 - RNA, 16 nt, Homo sapiens
uaaugaauacauuucc

SEQ ID NO: 1533641 - RNA, 17 nt, Homo sapiens
uacaaccuccgccuccc

SEQ ID NO: 1533642 - RNA, 19 nt, Homo sapiens
uacaacuaagugauuugua

SEQ ID NO: 1533643 - RNA, 19 nt, Homo sapiens
uacaaucaaggccacugcu

SEQ ID NO: 1533644 - RNA, 21 nt, Homo sapiens
uacauuuuuugggcagcaauu

SEQ ID NO: 1533645 - RNA, 23 nt, Homo sapiens
uacauuuuuugggcagcaauuua

SEQ ID NO: 1533646 - RNA, 24 nt, Homo sapiens
uacauuuuuugggcagcaauuuaa

SEQ ID NO: 1533647 - RNA, 22 nt, Homo sapiens
uaccaaaaaucucaauauuuca

SEQ ID NO: 1533648 - RNA, 20 nt, Homo sapiens
uaccaauaaagugacccugu

SEQ ID NO: 1533649 - RNA, 15 nt, Homo sapiens
uaccgcccucggggc

SEQ ID NO: 1533650 - RNA, 16 nt, Homo sapiens
gauggccuuguuucaa

SEQ ID NO: 1533651 - RNA, 17 nt, Homo sapiens
gaugggguuucaccaug

SEQ ID NO: 1533652 - RNA, 22 nt, Homo sapiens
gaugggguuucaccauguuggc

SEQ ID NO: 1533653 - RNA, 16 nt, Homo sapiens
gaugugacagcccuga

SEQ ID NO: 1533654 - RNA, 20 nt, Homo sapiens
gauuuuuuucccaauugaga

SEQ ID NO: 1533655 - RNA, 18 nt, Homo sapiens
gcaaguuuccaucaucua

SEQ ID NO: 1533656 - RNA, 18 nt, Homo sapiens
gcacagggggaggccaua

SEQ ID NO: 1533657 - RNA, 12 nt, Homo sapiens
gcaccugggauu

SEQ ID NO: 1533658 - RNA, 14 nt, Homo sapiens
gcacugcuccagug

SEQ ID NO: 1533659 - RNA, 14 nt, Homo sapiens
gcagagccaggaag

SEQ ID NO: 1533660 - RNA, 16 nt, Homo sapiens
gcagucucuauaccaa

SEQ ID NO: 1533661 - RNA, 18 nt, Homo sapiens
gcagucucuauaccaaua

SEQ ID NO: 1533662 - RNA, 17 nt, Homo sapiens
gcaguggcgcgaucuca

SEQ ID NO: 1533663 - RNA, 12 nt, Homo sapiens
aaaaacuacuuc

SEQ ID NO: 1533664 - RNA, 11 nt, Homo sapiens
aaaacauucca

SEQ ID NO: 1533665 - RNA, 12 nt, Homo sapiens
aaaacauuccau

SEQ ID NO: 1533666 - RNA, 11 nt, Homo sapiens
aaaacucucug

SEQ ID NO: 1533667 - RNA, 15 nt, Homo sapiens
aaaagaaaagaaaau

SEQ ID NO: 1533668 - RNA, 19 nt, Homo sapiens
aaaagcccauucauuccau

SEQ ID NO: 1533669 - RNA, 23 nt, Homo sapiens
aaaagcgcucccccgucgugcuu

SEQ ID NO: 1533670 - RNA, 13 nt, Homo sapiens
aaaauacauugua

SEQ ID NO: 1533671 - RNA, 16 nt, Homo sapiens
aaaauggucucuaaca

SEQ ID NO: 1533672 - RNA, 12 nt, Homo sapiens
aaaauguucaca

SEQ ID NO: 1533673 - RNA, 22 nt, Homo sapiens
aaaauucucauuuuucauuucu

SEQ ID NO: 1533674 - RNA, 20 nt, Homo sapiens
aaacaaaauggguuacuuga

SEQ ID NO: 1533675 - RNA, 19 nt, Homo sapiens
aaacacccucacacuggga

SEQ ID NO: 1533676 - RNA, 13 nt, Homo sapiens
aaacucagugcaa

SEQ ID NO: 1533677 - RNA, 16 nt, Homo sapiens
aaacuccugaccucaa

SEQ ID NO: 1533678 - RNA, 17 nt, Homo sapiens
aaagaaguaacuacagu

SEQ ID NO: 1533679 - RNA, 14 nt, Homo sapiens
aaagugacccugcu

SEQ ID NO: 1533680 - RNA, 18 nt, Homo sapiens
aaagugacccugcucuca

SEQ ID NO: 1533681 - RNA, 19 nt, Homo sapiens
aaagugacccugcucucac

SEQ ID NO: 1533682 - RNA, 14 nt, Homo sapiens
aaagugacccuguu

SEQ ID NO: 1533683 - RNA, 16 nt, Homo sapiens
aaauaauuuuaucucu

SEQ ID NO: 1533684 - RNA, 15 nt, Homo sapiens
aaauauauacuaaac

SEQ ID NO: 1533685 - RNA, 18 nt, Homo sapiens
aaauaugccccauucaac

SEQ ID NO: 1533686 - RNA, 13 nt, Homo sapiens
aaaucaaaugugc

SEQ ID NO: 1533687 - RNA, 23 nt, Homo sapiens
aaaucaaucuguaaaacuaagaa

SEQ ID NO: 1533688 - RNA, 17 nt, Homo sapiens
aaaucccaucaggucac

SEQ ID NO: 1533689 - RNA, 14 nt, Homo sapiens
aaaugcuucugcac

SEQ ID NO: 1533690 - RNA, 15 nt, Homo sapiens
aaaugcuucugcaca

SEQ ID NO: 1533691 - RNA, 21 nt, Homo sapiens
aaauggucucuaacauuuccu

SEQ ID NO: 1533692 - RNA, 15 nt, Homo sapiens
aaauguauacuauag

SEQ ID NO: 1533693 - RNA, 14 nt, Homo sapiens
aaauguuaugacua

SEQ ID NO: 1533694 - RNA, 20 nt, Homo sapiens
aaauuaaaccggaccaucuc

SEQ ID NO: 1533695 - RNA, 13 nt, Homo sapiens
aaauuaugugaca

SEQ ID NO: 1533696 - RNA, 14 nt, Homo sapiens
aaauuaugugacau

SEQ ID NO: 1533697 - RNA, 19 nt, Homo sapiens
cucccaaaaaacuacuucu

SEQ ID NO: 1533698 - RNA, 20 nt, Homo sapiens
cucccaaagugcugggauua

SEQ ID NO: 1533699 - RNA, 22 nt, Homo sapiens
cuccuccaggguggcagcaaca

SEQ ID NO: 1533700 - RNA, 20 nt, Homo sapiens
cucgggaagccccauccaac

SEQ ID NO: 1533701 - RNA, 15 nt, Homo sapiens
cucgugggacaguca

SEQ ID NO: 1533702 - RNA, 15 nt, Homo sapiens
cucuaaacauuucau

SEQ ID NO: 1533703 - RNA, 20 nt, Homo sapiens
cucucaguugcagcccugcu

SEQ ID NO: 1533704 - RNA, 18 nt, Homo sapiens
cucucugguuuacuucaa

SEQ ID NO: 1533705 - RNA, 16 nt, Homo sapiens
cucugcagucucuaua

SEQ ID NO: 1533706 - RNA, 15 nt, Homo sapiens
cucugucuccuaagc

SEQ ID NO: 1533707 - RNA, 23 nt, Homo sapiens
cucuuagaugcaguucugaagaa

SEQ ID NO: 1533708 - RNA, 22 nt, Homo sapiens
cugaaaucauacuucuuagggu

SEQ ID NO: 1533709 - RNA, 19 nt, Homo sapiens
cugaccccaaguuauccac

SEQ ID NO: 1533710 - RNA, 14 nt, Homo sapiens
cugaccucaaguga

SEQ ID NO: 1533711 - RNA, 15 nt, Homo sapiens
cugaccuugugaucc

SEQ ID NO: 1533712 - RNA, 9 nt, Homo sapiens
cugagacag

SEQ ID NO: 1533713 - RNA, 19 nt, Homo sapiens
cugaggggcuaccaggaaa

SEQ ID NO: 1533714 - RNA, 19 nt, Homo sapiens
cugagucucugaggggcua

SEQ ID NO: 1533715 - RNA, 18 nt, Homo sapiens
cugcaugcgagugcucau

SEQ ID NO: 1533716 - RNA, 13 nt, Homo sapiens
cugcauugcugag

SEQ ID NO: 1533717 - RNA, 12 nt, Homo sapiens
cuggacugcaau

SEQ ID NO: 1533718 - RNA, 13 nt, Homo sapiens
cuggagugcagug

SEQ ID NO: 1533719 - RNA, 16 nt, Homo sapiens
cuggauggucaucucg

SEQ ID NO: 1533720 - RNA, 15 nt, Homo sapiens
cuggcauuacaggug

SEQ ID NO: 1533721 - RNA, 22 nt, Homo sapiens
cugggaacaacuucaguccaac

SEQ ID NO: 1533722 - RNA, 16 nt, Homo sapiens
cugggaaucaagacaa

SEQ ID NO: 1533723 - RNA, 22 nt, Homo sapiens
cugggacuauaggcaugcgcca

SEQ ID NO: 1533724 - RNA, 15 nt, Homo sapiens
cuggucccucugcag

SEQ ID NO: 1533725 - RNA, 16 nt, Homo sapiens
cugucugucccaaaga

SEQ ID NO: 1533726 - RNA, 14 nt, Homo sapiens
cugucugucugucu

SEQ ID NO: 1533727 - RNA, 14 nt, Homo sapiens
cuguggaacauaaa

SEQ ID NO: 1533728 - RNA, 18 nt, Homo sapiens
cuguggaacauaaaaagg

SEQ ID NO: 1533729 - RNA, 22 nt, Homo sapiens
cuguggguagacacacaugaag

SEQ ID NO: 1533730 - RNA, 17 nt, Homo sapiens
cuguuguagaagacaaa

SEQ ID NO: 1533731 - RNA, 17 nt, Homo sapiens
cuuacagaacuacuucu

SEQ ID NO: 1533732 - RNA, 18 nt, Homo sapiens
cuuacugcuuaauucaaa

SEQ ID NO: 1533733 - RNA, 18 nt, Homo sapiens
cuuaugcuuaaauucaag

SEQ ID NO: 1533734 - RNA, 18 nt, Homo sapiens
cuucaaaucaaucuguaa

SEQ ID NO: 1533735 - RNA, 11 nt, Homo sapiens
cuucaccugcg

SEQ ID NO: 1533736 - RNA, 10 nt, Homo sapiens
cuucacugac

SEQ ID NO: 1533737 - RNA, 18 nt, Homo sapiens
cuucaguccaacugucaa

SEQ ID NO: 1533738 - RNA, 17 nt, Homo sapiens
cuucaucuggauuccag

SEQ ID NO: 1533739 - RNA, 14 nt, Homo sapiens
cuucaugcauggaa

SEQ ID NO: 1533740 - RNA, 20 nt, Homo sapiens
cuuccaacccgccggucuca

SEQ ID NO: 1533741 - RNA, 20 nt, Homo sapiens
cuucccaaaguccugggauu

SEQ ID NO: 1533742 - RNA, 19 nt, Homo sapiens
cuucuauacccacccagaa

SEQ ID NO: 1533743 - RNA, 20 nt, Homo sapiens
cuucucagauuucugaggaa

SEQ ID NO: 1533744 - RNA, 14 nt, Homo sapiens
cuucugcacacaaa

SEQ ID NO: 1533745 - RNA, 20 nt, Homo sapiens
cuugcaccacuuccguccca

SEQ ID NO: 1533746 - RNA, 18 nt, Homo sapiens
cuuggggcugaugcaguu

SEQ ID NO: 1533747 - RNA, 18 nt, Homo sapiens
cuuguuucaaaauucuca

SEQ ID NO: 1533748 - RNA, 12 nt, Homo sapiens
gaaaccuuccac

SEQ ID NO: 1533749 - RNA, 16 nt, Homo sapiens
gaaacucagugcaaaa

SEQ ID NO: 1533750 - RNA, 20 nt, Homo sapiens
gaagaagaugguaccaccag

SEQ ID NO: 1533751 - RNA, 23 nt, Homo sapiens
gaagcccuugccugaaagcaaga

SEQ ID NO: 1533752 - RNA, 23 nt, Homo sapiens
gaagccuuggggcugaugcaguu

SEQ ID NO: 1533753 - RNA, 17 nt, Homo sapiens
gaaggacacuagccugu

SEQ ID NO: 1533754 - RNA, 21 nt, Homo sapiens
gaaggacacuagccugugcac

SEQ ID NO: 1533755 - RNA, 14 nt, Homo sapiens
gaauacauuuccaa

SEQ ID NO: 1533756 - RNA, 16 nt, Homo sapiens
gaaugaauacugggaa

SEQ ID NO: 1533757 - RNA, 17 nt, Homo sapiens
gaaugaauacugggaau

SEQ ID NO: 1533758 - RNA, 18 nt, Homo sapiens
gacacuagccugugcacg

SEQ ID NO: 1533759 - RNA, 21 nt, Homo sapiens
gacacuagccugugcacgcgc

SEQ ID NO: 1533760 - RNA, 22 nt, Homo sapiens
gaccaccucucaauauucaaua

SEQ ID NO: 1533761 - RNA, 13 nt, Homo sapiens
gacccugcucuca

SEQ ID NO: 1533762 - RNA, 14 nt, Homo sapiens
gacccugcucucac

SEQ ID NO: 1533763 - RNA, 19 nt, Homo sapiens
gaccucucucaaagugcug

SEQ ID NO: 1533764 - RNA, 15 nt, Homo sapiens
gacgagguuucacug

SEQ ID NO: 1533765 - RNA, 22 nt, Homo sapiens
gacucugggcugucagcccaug

SEQ ID NO: 1533766 - RNA, 14 nt, Homo sapiens
gacuugcaaaaagg

SEQ ID NO: 1533767 - RNA, 14 nt, Homo sapiens
gagaaggaaggcuc

SEQ ID NO: 1533768 - RNA, 21 nt, Homo sapiens
gagaugggguuucaccauguu

SEQ ID NO: 1533769 - RNA, 11 nt, Homo sapiens
gagcacuguga

SEQ ID NO: 1533770 - RNA, 17 nt, Homo sapiens
gaggcugaggcacuggc

SEQ ID NO: 1533771 - RNA, 11 nt, Homo sapiens
gagugcagugg

SEQ ID NO: 1533772 - RNA, 16 nt, Homo sapiens
gagugcaguggcgcga

SEQ ID NO: 1533773 - RNA, 16 nt, Homo sapiens
gauaaaugauagacaa

SEQ ID NO: 1533774 - RNA, 13 nt, Homo sapiens
gauacauguaauu

SEQ ID NO: 1533775 - RNA, 16 nt, Homo sapiens
gauacauguaauucua

SEQ ID NO: 1533776 - RNA, 22 nt, Homo sapiens
gauauuaaccaggggccaugaa

SEQ ID NO: 1533777 - RNA, 17 nt, Homo sapiens
gcaaaagugcaagaugg

SEQ ID NO: 1533778 - RNA, 18 nt, Homo sapiens
gcaaccucugccucccag

SEQ ID NO: 1533779 - RNA, 23 nt, Homo sapiens
gcacagccucuuagaugcaguuc

SEQ ID NO: 1533780 - RNA, 17 nt, Homo sapiens
gcacaguaaaaauggaa

SEQ ID NO: 1533781 - RNA, 18 nt, Homo sapiens
gcacaucaaaauaugccc

SEQ ID NO: 1533782 - RNA, 21 nt, Homo sapiens
gcacauuuaaggcgccauugc

SEQ ID NO: 1533783 - RNA, 15 nt, Homo sapiens
gcaccggccucggga

SEQ ID NO: 1533784 - RNA, 19 nt, Homo sapiens
gcacuaguauuucuaugaa

SEQ ID NO: 1533785 - RNA, 16 nt, Homo sapiens
gcagagccaggaagau

SEQ ID NO: 1533786 - RNA, 19 nt, Homo sapiens
gcaguaggggcuacuguga

SEQ ID NO: 1533787 - RNA, 20 nt, Homo sapiens
gcaguaggggcuacugugac

SEQ ID NO: 1533788 - RNA, 17 nt, Homo sapiens
gcagucucuauaccaau

SEQ ID NO: 1533789 - RNA, 17 nt, Homo sapiens
gcaguggcaucaucuca

SEQ ID NO: 1533790 - RNA, 19 nt, Homo sapiens
gccagcaccugcccagugg

SEQ ID NO: 1533791 - RNA, 16 nt, Homo sapiens
gccaggcuggagugca

SEQ ID NO: 1533792 - RNA, 18 nt, Homo sapiens
gccaggcuggagugcagu

SEQ ID NO: 1533793 - RNA, 18 nt, Homo sapiens
gccaugggcacugugggu

SEQ ID NO: 1533794 - RNA, 17 nt, Homo sapiens
gcccaugugcaccugcc

SEQ ID NO: 1533795 - RNA, 20 nt, Homo sapiens
gcccccaguaucucuucagu

SEQ ID NO: 1533796 - RNA, 14 nt, Homo sapiens
gcccugccaugcuc

SEQ ID NO: 1533797 - RNA, 23 nt, Homo sapiens
gcccuguccccuacccccaguaa

SEQ ID NO: 1533798 - RNA, 14 nt, Homo sapiens
gccuauuguugaau

SEQ ID NO: 1533799 - RNA, 17 nt, Homo sapiens
gccucccaaagugcugg

SEQ ID NO: 1533800 - RNA, 17 nt, Homo sapiens
gccucccuucaugcaug

SEQ ID NO: 1533801 - RNA, 21 nt, Homo sapiens
gccuggggcgagcacugugag

SEQ ID NO: 1533802 - RNA, 21 nt, Homo sapiens
gccuuguuucaaaauucucau

SEQ ID NO: 1533803 - RNA, 19 nt, Homo sapiens
gccuuucuccgcaacagcc

SEQ ID NO: 1533804 - RNA, 13 nt, Homo sapiens
gcgagcacuguga

SEQ ID NO: 1533805 - RNA, 13 nt, Homo sapiens
gcgaucucagcuc

SEQ ID NO: 1533806 - RNA, 15 nt, Homo sapiens
gcggcgucccuucca

SEQ ID NO: 1533807 - RNA, 17 nt, Homo sapiens
gcggcuucaccugcgug

SEQ ID NO: 1533808 - RNA, 19 nt, Homo sapiens
gcuacagaagaaacugggg

SEQ ID NO: 1533809 - RNA, 12 nt, Homo sapiens
gcuaccaggaaa

SEQ ID NO: 1533810 - RNA, 14 nt, Homo sapiens
gcuacgaccugguc

SEQ ID NO: 1533811 - RNA, 16 nt, Homo sapiens
gcucacuacaaccucc

SEQ ID NO: 1533812 - RNA, 18 nt, Homo sapiens
gcuccaucuccaguggga

SEQ ID NO: 1533813 - RNA, 22 nt, Homo sapiens
gcucggagcggcgucccuucca

SEQ ID NO: 1533814 - RNA, 13 nt, Homo sapiens
gcugaugcaguug

SEQ ID NO: 1533815 - RNA, 19 nt, Homo sapiens
gcugccccuggugcacugg

SEQ ID NO: 1533816 - RNA, 18 nt, Homo sapiens
gcugcugagaaucuagcc

SEQ ID NO: 1533817 - RNA, 22 nt, Homo sapiens
gcugcuuccuggcugggaacaa

SEQ ID NO: 1533818 - RNA, 13 nt, Homo sapiens
gcuggagugcagu

SEQ ID NO: 1533819 - RNA, 15 nt, Homo sapiens
gcuggagugcagugg

SEQ ID NO: 1533820 - RNA, 14 nt, Homo sapiens
gcuggccgcggugg

SEQ ID NO: 1533821 - RNA, 21 nt, Homo sapiens
caagguuuugaaaucccauca

SEQ ID NO: 1533822 - RNA, 16 nt, Homo sapiens
caaguaaaaaggcuaa

SEQ ID NO: 1533823 - RNA, 17 nt, Homo sapiens
caaguaacugggauuac

SEQ ID NO: 1533824 - RNA, 15 nt, Homo sapiens
caauaagcaaaaaca

SEQ ID NO: 1533825 - RNA, 17 nt, Homo sapiens
caaucaaggccacugcu

SEQ ID NO: 1533826 - RNA, 19 nt, Homo sapiens
caaucuguaaaacuaagaa

SEQ ID NO: 1533827 - RNA, 17 nt, Homo sapiens
cacaagaccaucuacau

SEQ ID NO: 1533828 - RNA, 12 nt, Homo sapiens
cacacaccacca

SEQ ID NO: 1533829 - RNA, 20 nt, Homo sapiens
cacauuucccccuagccugc

SEQ ID NO: 1533830 - RNA, 16 nt, Homo sapiens
caccacgccuggcuaa

SEQ ID NO: 1533831 - RNA, 12 nt, Homo sapiens
caccagucugac

SEQ ID NO: 1533832 - RNA, 12 nt, Homo sapiens
cacccagcaaua

SEQ ID NO: 1533833 - RNA, 23 nt, Homo sapiens
caccgcgaggccuauuguugaau

SEQ ID NO: 1533834 - RNA, 17 nt, Homo sapiens
cacuacacccagcaaua

SEQ ID NO: 1533835 - RNA, 14 nt, Homo sapiens
cacucuuucuuuca

SEQ ID NO: 1533836 - RNA, 15 nt, Homo sapiens
cacugugagcaccug

SEQ ID NO: 1533837 - RNA, 22 nt, Homo sapiens
cagaaagugacaagcucacaga

SEQ ID NO: 1533838 - RNA, 14 nt, Homo sapiens
cagaacuacuucuu

SEQ ID NO: 1533839 - RNA, 14 nt, Homo sapiens
cagacacacccaca

SEQ ID NO: 1533840 - RNA, 18 nt, Homo sapiens
cagacacacccacagaag

SEQ ID NO: 1533841 - RNA, 17 nt, Homo sapiens
cagcaccggccucggga

SEQ ID NO: 1533842 - RNA, 13 nt, Homo sapiens
cagcagauuucca

SEQ ID NO: 1533843 - RNA, 17 nt, Homo sapiens
cagcuaacuuaucauca

SEQ ID NO: 1533844 - RNA, 18 nt, Homo sapiens
caggaaagagaacuucca

SEQ ID NO: 1533845 - RNA, 20 nt, Homo sapiens
caggaaagagaacuuccaga

SEQ ID NO: 1533846 - RNA, 15 nt, Homo sapiens
caggcuggagugcag

SEQ ID NO: 1533847 - RNA, 20 nt, Homo sapiens
caggugugagccacggugcc

SEQ ID NO: 1533848 - RNA, 15 nt, Homo sapiens
caguaaaaauggaaa

SEQ ID NO: 1533849 - RNA, 22 nt, Homo sapiens
caguaaaaauggaaacuauauu

SEQ ID NO: 1533850 - RNA, 18 nt, Homo sapiens
caguaaaggcugcugcua

SEQ ID NO: 1533851 - RNA, 15 nt, Homo sapiens
caguaucucuucagu

SEQ ID NO: 1533852 - RNA, 16 nt, Homo sapiens
cagucaccucauggaa

SEQ ID NO: 1533853 - RNA, 23 nt, Homo sapiens
cagucucuauaccaauaaaguga

SEQ ID NO: 1533854 - RNA, 16 nt, Homo sapiens
caguggcaucaucuca

SEQ ID NO: 1533855 - RNA, 20 nt, Homo sapiens
caguggcgcgaucucagcuc

SEQ ID NO: 1533856 - RNA, 16 nt, Homo sapiens
caguggcgugaucuca

SEQ ID NO: 1533857 - RNA, 16 nt, Homo sapiens
caguuaacuauugcau

SEQ ID NO: 1533858 - RNA, 19 nt, Homo sapiens
caguuaacuauugcauuua

SEQ ID NO: 1533859 - RNA, 20 nt, Homo sapiens
caguuaccucugccucagaa

SEQ ID NO: 1533860 - RNA, 13 nt, Homo sapiens
caguucugaagaa

SEQ ID NO: 1533861 - RNA, 12 nt, Homo sapiens
cauacagacugg

SEQ ID NO: 1533862 - RNA, 17 nt, Homo sapiens
cauauaaauggaauuac

SEQ ID NO: 1533863 - RNA, 18 nt, Homo sapiens
cauauauauacauauaua

SEQ ID NO: 1533864 - RNA, 20 nt, Homo sapiens
caucaaggguacacugccuu

SEQ ID NO: 1533865 - RNA, 16 nt, Homo sapiens
caucacacaacucagc

SEQ ID NO: 1533866 - RNA, 12 nt, Homo sapiens
caucagcaaaca

SEQ ID NO: 1533867 - RNA, 11 nt, Homo sapiens
caucaucucag

SEQ ID NO: 1533868 - RNA, 23 nt, Homo sapiens
cauccuaaaugaguaaacccagc

SEQ ID NO: 1533869 - RNA, 12 nt, Homo sapiens
caucuccagugg

SEQ ID NO: 1533870 - RNA, 10 nt, Homo sapiens
caucuuuaag

SEQ ID NO: 1533871 - RNA, 16 nt, Homo sapiens
caugauaaaugauaga

SEQ ID NO: 1533872 - RNA, 23 nt, Homo sapiens
caugccuucaaaucaaucuguaa

SEQ ID NO: 1533873 - RNA, 23 nt, Homo sapiens
cauggaaauucccuucaucugga

SEQ ID NO: 1533874 - RNA, 14 nt, Homo sapiens
cauggaggccagug

SEQ ID NO: 1533875 - RNA, 13 nt, Homo sapiens
caugugcaccugc

SEQ ID NO: 1533876 - RNA, 14 nt, Homo sapiens
caugugcaccugcc

SEQ ID NO: 1533877 - RNA, 12 nt, Homo sapiens
cauucauuccau

SEQ ID NO: 1533878 - RNA, 18 nt, Homo sapiens
cauucauuccauucugga

SEQ ID NO: 1533879 - RNA, 18 nt, Homo sapiens
cauugugccuaaguccag

SEQ ID NO: 1533880 - RNA, 20 nt, Homo sapiens
ccaaaagcccauucauucca

SEQ ID NO: 1533881 - RNA, 22 nt, Homo sapiens
ccaagagccugagugacagagc

SEQ ID NO: 1533882 - RNA, 19 nt, Homo sapiens
ccaagguuuugaaauccca

SEQ ID NO: 1533883 - RNA, 13 nt, Homo sapiens
ccaauaaagugac

SEQ ID NO: 1533884 - RNA, 23 nt, Homo sapiens
ccaauaaagugacccugcucuca

SEQ ID NO: 1533885 - RNA, 14 nt, Homo sapiens
ccacaagaccaucu

SEQ ID NO: 1533886 - RNA, 16 nt, Homo sapiens
ccaggcuggagugcag

SEQ ID NO: 1533887 - RNA, 15 nt, Homo sapiens
ccaggggccaugaau

SEQ ID NO: 1533888 - RNA, 19 nt, Homo sapiens
ccagguuggagugcagugg

SEQ ID NO: 1533889 - RNA, 13 nt, Homo sapiens
ccaguaaaaucaa

SEQ ID NO: 1533890 - RNA, 21 nt, Homo sapiens
ccaguaucucuucagucucua

SEQ ID NO: 1533891 - RNA, 16 nt, Homo sapiens
ccauccuugagucaaa

SEQ ID NO: 1533892 - RNA, 13 nt, Homo sapiens
ccaucuccagugg

SEQ ID NO: 1533893 - RNA, 23 nt, Homo sapiens
ccauguuggcuagacuagucuca

SEQ ID NO: 1533894 - RNA, 22 nt, Homo sapiens
ccauucuggaagugacuuuggc

SEQ ID NO: 1533895 - RNA, 16 nt, Homo sapiens
cccaaaaaacuacuuc

SEQ ID NO: 1533896 - RNA, 19 nt, Homo sapiens
cccagaaaagaaagcuaca

SEQ ID NO: 1533897 - RNA, 14 nt, Homo sapiens
cccagcaauagaga

SEQ ID NO: 1533898 - RNA, 18 nt, Homo sapiens
cccagccauccagggggc

SEQ ID NO: 1533899 - RNA, 20 nt, Homo sapiens
cccaggcuggacugcaauga

SEQ ID NO: 1533900 - RNA, 19 nt, Homo sapiens
cccagguuggagugcagug

SEQ ID NO: 1533901 - RNA, 22 nt, Homo sapiens
cccaguaaaaucaaaugugcau

SEQ ID NO: 1533902 - RNA, 23 nt, Homo sapiens
ccccaguaaaaucaaaugugcau

SEQ ID NO: 1533903 - RNA, 24 nt, Homo sapiens
cccccaguaaaaucaaaugugcau

SEQ ID NO: 1533904 - RNA, 19 nt, Homo sapiens
ccccuacccccaguaaaau

SEQ ID NO: 1533905 - RNA, 21 nt, Homo sapiens
cccuaggacuuauucccgcug

SEQ ID NO: 1533906 - RNA, 22 nt, Homo sapiens
cccucugcagucucuauaccaa

SEQ ID NO: 1533907 - RNA, 20 nt, Homo sapiens
cccuucuauacccacccaga

SEQ ID NO: 1533908 - RNA, 16 nt, Homo sapiens
ccgcaacagccaagug

SEQ ID NO: 1533909 - RNA, 21 nt, Homo sapiens
ccgcugcuuccuggcugggaa

SEQ ID NO: 1533910 - RNA, 12 nt, Homo sapiens
ccuagaacuucc

SEQ ID NO: 1533911 - RNA, 14 nt, Homo sapiens
ccuaucuuugccac

SEQ ID NO: 1533912 - RNA, 23 nt, Homo sapiens
ccucacacugggacuugcaaaaa

SEQ ID NO: 1533913 - RNA, 23 nt, Homo sapiens
ccucagaaaacaaggaugaauua

SEQ ID NO: 1533914 - RNA, 11 nt, Homo sapiens
ccucugcaguc

SEQ ID NO: 1533915 - RNA, 14 nt, Homo sapiens
ccucugucuccuaa

SEQ ID NO: 1533916 - RNA, 21 nt, Homo sapiens
ccucuuagaugcaguucugaa

SEQ ID NO: 1533917 - RNA, 23 nt, Homo sapiens
ccugagucccaucccugcgugau

SEQ ID NO: 1533918 - RNA, 18 nt, Homo sapiens
ccugcauugcugagucaa

SEQ ID NO: 1533919 - RNA, 15 nt, Homo sapiens
ccuggaaaucagggu

SEQ ID NO: 1533920 - RNA, 15 nt, Homo sapiens
ccuggaagagggcaa

SEQ ID NO: 1533921 - RNA, 19 nt, Homo sapiens
ccuggggcgagcacuguga

SEQ ID NO: 1533922 - RNA, 20 nt, Homo sapiens
ccuggggcgagcacugugag

SEQ ID NO: 1533923 - RNA, 20 nt, Homo sapiens
ccuggucccucugcagucuc

SEQ ID NO: 1533924 - RNA, 21 nt, Homo sapiens
ccuggucccucugcagucucu

SEQ ID NO: 1533925 - RNA, 19 nt, Homo sapiens
ccuuggggcugaugcaguu

SEQ ID NO: 1533926 - RNA, 11 nt, Homo sapiens
ccuuguuucaa

SEQ ID NO: 1533927 - RNA, 18 nt, Homo sapiens
cgagcgcuaccucuccag

SEQ ID NO: 1533928 - RNA, 12 nt, Homo sapiens
cgaucucagcuc

SEQ ID NO: 1533929 - RNA, 13 nt, Homo sapiens
cgaucucagcuca

SEQ ID NO: 1533930 - RNA, 20 nt, Homo sapiens
cgccuccaacccuagcaaaa

SEQ ID NO: 1533931 - RNA, 13 nt, Homo sapiens
cgcgcccagccuu

SEQ ID NO: 1533932 - RNA, 22 nt, Homo sapiens
cgcugcagcuguguguccuucu

SEQ ID NO: 1533933 - RNA, 14 nt, Homo sapiens
cggcuucaccugcg

SEQ ID NO: 1533934 - RNA, 14 nt, Homo sapiens
cgugaucucagcuc

SEQ ID NO: 1533935 - RNA, 12 nt, Homo sapiens
cuaaauguauuc

SEQ ID NO: 1533936 - RNA, 16 nt, Homo sapiens
cuaagcuggagugcag

SEQ ID NO: 1533937 - RNA, 18 nt, Homo sapiens
cuaagcuggagugcagug

SEQ ID NO: 1533938 - RNA, 15 nt, Homo sapiens
cuaaguacacaauaa

SEQ ID NO: 1533939 - RNA, 14 nt, Homo sapiens
cuacauacacagug

SEQ ID NO: 1533940 - RNA, 12 nt, Homo sapiens
cuaccucuccag

SEQ ID NO: 1533941 - RNA, 18 nt, Homo sapiens
cuagugagcagucaggaa

SEQ ID NO: 1533942 - RNA, 22 nt, Homo sapiens
cuauacccacccagaaugagac

SEQ ID NO: 1533943 - RNA, 17 nt, Homo sapiens
cuauaccuuauccauag

SEQ ID NO: 1533944 - RNA, 20 nt, Homo sapiens
cuauagcuaaguacacaaua

SEQ ID NO: 1533945 - RNA, 18 nt, Homo sapiens
auuaugaauuacauuugu

SEQ ID NO: 1533946 - RNA, 21 nt, Homo sapiens
auucaauucuuuuaacuguug

SEQ ID NO: 1533947 - RNA, 12 nt, Homo sapiens
auucauuccauu

SEQ ID NO: 1533948 - RNA, 23 nt, Homo sapiens
auuccagagcacugcuccagugg

SEQ ID NO: 1533949 - RNA, 14 nt, Homo sapiens
auugaggacacuga

SEQ ID NO: 1533950 - RNA, 15 nt, Homo sapiens
auugcauuuauaugu

SEQ ID NO: 1533951 - RNA, 23 nt, Homo sapiens
auuguugaauaaauguaucugaa

SEQ ID NO: 1533952 - RNA, 22 nt, Homo sapiens
auuuaaauguuaugacuaugua

SEQ ID NO: 1533953 - RNA, 23 nt, Homo sapiens
auuuauauaaaauguuuaaucuc

SEQ ID NO: 1533954 - RNA, 19 nt, Homo sapiens
auuuugaaaacugugcaau

SEQ ID NO: 1533955 - RNA, 19 nt, Homo sapiens
caaaaaaaaaauuugccaa

SEQ ID NO: 1533956 - RNA, 13 nt, Homo sapiens
caaaaaacuacuu

SEQ ID NO: 1533957 - RNA, 15 nt, Homo sapiens
caaaaaacuacuucu

SEQ ID NO: 1533958 - RNA, 23 nt, Homo sapiens
caaaacucucugguuuacuucaa

SEQ ID NO: 1533959 - RNA, 19 nt, Homo sapiens
caaaagcccauucauucca

SEQ ID NO: 1533960 - RNA, 21 nt, Homo sapiens
caaaagcccauucauuccauu

SEQ ID NO: 1533961 - RNA, 14 nt, Homo sapiens
caaaagugcaagau

SEQ ID NO: 1533962 - RNA, 13 nt, Homo sapiens
caaaaucaauuaa

SEQ ID NO: 1533963 - RNA, 23 nt, Homo sapiens
caaaauucucauuuuucauuucu

SEQ ID NO: 1533964 - RNA, 13 nt, Homo sapiens
caaacuccugacc

SEQ ID NO: 1533965 - RNA, 21 nt, Homo sapiens
caaacuccugaccucaaguga

SEQ ID NO: 1533966 - RNA, 22 nt, Homo sapiens
caaccucauccucuccacagcu

SEQ ID NO: 1533967 - RNA, 16 nt, Homo sapiens
caagacuauaccuuau

SEQ ID NO: 1533968 - RNA, 17 nt, Homo sapiens
caagcaccugggauuac

SEQ ID NO: 1533969 - RNA, 16 nt, Homo sapiens
caagcauuuagaugua

SEQ ID NO: 1533970 - RNA, 23 nt, Homo sapiens
caaguaaaaaggcuaaauggaag

SEQ ID NO: 1533971 - RNA, 20 nt, Homo sapiens
caagugcuucuccagccuca

SEQ ID NO: 1533972 - RNA, 23 nt, Homo sapiens
caauaaagugacccugcucucac

SEQ ID NO: 1533973 - RNA, 19 nt, Homo sapiens
caaugaucaccgacugaaa

SEQ ID NO: 1533974 - RNA, 23 nt, Homo sapiens
caauugagaaaaauauauacuaa

SEQ ID NO: 1533975 - RNA, 17 nt, Homo sapiens
caauuuuagauaucaug

SEQ ID NO: 1533976 - RNA, 13 nt, Homo sapiens
cacaagaccaucu

SEQ ID NO: 1533977 - RNA, 19 nt, Homo sapiens
cacacccacagaaggacac

SEQ ID NO: 1533978 - RNA, 12 nt, Homo sapiens
cacacugaagaa

SEQ ID NO: 1533979 - RNA, 13 nt, Homo sapiens
caccauguuggcc

SEQ ID NO: 1533980 - RNA, 13 nt, Homo sapiens
cacccagcaauag

SEQ ID NO: 1533981 - RNA, 20 nt, Homo sapiens
cacccagguuggagugcagu

SEQ ID NO: 1533982 - RNA, 22 nt, Homo sapiens
caccugcguguccccgugcagu

SEQ ID NO: 1533983 - RNA, 13 nt, Homo sapiens
cacgcugaaggcu

SEQ ID NO: 1533984 - RNA, 15 nt, Homo sapiens
cacgcugaaggcuua

SEQ ID NO: 1533985 - RNA, 10 nt, Homo sapiens
cacugaagaa

SEQ ID NO: 1533986 - RNA, 23 nt, Homo sapiens
cacugcgcccuuaacugcaucca

SEQ ID NO: 1533987 - RNA, 18 nt, Homo sapiens
cacugggacuugcaaaaa

SEQ ID NO: 1533988 - RNA, 11 nt, Homo sapiens
cacuugucaau

SEQ ID NO: 1533989 - RNA, 16 nt, Homo sapiens
cagaaagcaucccuca

SEQ ID NO: 1533990 - RNA, 21 nt, Homo sapiens
cagaaagcaucccucacccau

SEQ ID NO: 1533991 - RNA, 20 nt, Homo sapiens
cagagcaagaccccaucuca

SEQ ID NO: 1533992 - RNA, 19 nt, Homo sapiens
cagagucuuccucugucuc

SEQ ID NO: 1533993 - RNA, 15 nt, Homo sapiens
cagcaugccuucaaa

SEQ ID NO: 1533994 - RNA, 19 nt, Homo sapiens
cagcaugccuucaaaucaa

SEQ ID NO: 1533995 - RNA, 20 nt, Homo sapiens
cagcaugccuucaaaucaau

SEQ ID NO: 1533996 - RNA, 17 nt, Homo sapiens
cagccacggggacucag

SEQ ID NO: 1533997 - RNA, 19 nt, Homo sapiens
cagccacggggacucagcc

SEQ ID NO: 1533998 - RNA, 15 nt, Homo sapiens
cagcccaugugcacc

SEQ ID NO: 1533999 - RNA, 20 nt, Homo sapiens
cagcccaugugcaccugccc

SEQ ID NO: 1534000 - RNA, 19 nt, Homo sapiens
cagcccuggcaacugcuaa

SEQ ID NO: 1534001 - RNA, 17 nt, Homo sapiens
cagccucagcucucagu

SEQ ID NO: 1534002 - RNA, 18 nt, Homo sapiens
cagccuggaagagggcaa

SEQ ID NO: 1534003 - RNA, 23 nt, Homo sapiens
cagcuguggccuaggcuaccuca

SEQ ID NO: 1534004 - RNA, 15 nt, Homo sapiens
caggaagagaaggag

SEQ ID NO: 1534005 - RNA, 22 nt, Homo sapiens
cagggccuguaaucccagcauu

SEQ ID NO: 1534006 - RNA, 22 nt, Homo sapiens
cagguucaagugcuucuccagc

SEQ ID NO: 1534007 - RNA, 19 nt, Homo sapiens
caguaggggcuacugugac

SEQ ID NO: 1534008 - RNA, 18 nt, Homo sapiens
caguaucucuucagucuc

SEQ ID NO: 1534009 - RNA, 15 nt, Homo sapiens
cagucaccucaugga

SEQ ID NO: 1534010 - RNA, 15 nt, Homo sapiens
cagugccagcaccug

SEQ ID NO: 1534011 - RNA, 16 nt, Homo sapiens
cagugccagcaccugc

SEQ ID NO: 1534012 - RNA, 17 nt, Homo sapiens
cagugccagcaccugcc

SEQ ID NO: 1534013 - RNA, 15 nt, Homo sapiens
caguggcaucaucuc

SEQ ID NO: 1534014 - RNA, 17 nt, Homo sapiens
caguggcaucaucucag

SEQ ID NO: 1534015 - RNA, 21 nt, Homo sapiens
caguggcgcgaucucagcuca

SEQ ID NO: 1534016 - RNA, 21 nt, Homo sapiens
caguggcgugaucucagcuca

SEQ ID NO: 1534017 - RNA, 12 nt, Homo sapiens
cauaaagaucaa

SEQ ID NO: 1534018 - RNA, 16 nt, Homo sapiens
cauaaauguugacaug

SEQ ID NO: 1534019 - RNA, 18 nt, Homo sapiens
caucuggaaccaucagaa

SEQ ID NO: 1534020 - RNA, 21 nt, Homo sapiens
caugcauggauggguccucac

SEQ ID NO: 1534021 - RNA, 12 nt, Homo sapiens
caugcucuccaa

SEQ ID NO: 1534022 - RNA, 15 nt, Homo sapiens
cauggaaauucccuu

SEQ ID NO: 1534023 - RNA, 20 nt, Homo sapiens
cauggcagaagucaacgccu

SEQ ID NO: 1534024 - RNA, 14 nt, Homo sapiens
aagcuggagugcag

SEQ ID NO: 1534025 - RNA, 15 nt, Homo sapiens
aagcuggagugcagu

SEQ ID NO: 1534026 - RNA, 16 nt, Homo sapiens
aagcuggagugcagug

SEQ ID NO: 1534027 - RNA, 20 nt, Homo sapiens
aagcuuaugcuuaaauucaa

SEQ ID NO: 1534028 - RNA, 21 nt, Homo sapiens
aaggacacuagccugugcacg

SEQ ID NO: 1534029 - RNA, 20 nt, Homo sapiens
aagguuggaggaucauuuga

SEQ ID NO: 1534030 - RNA, 17 nt, Homo sapiens
aagguuuugaaauccca

SEQ ID NO: 1534031 - RNA, 15 nt, Homo sapiens
aaguccaguguuucu

SEQ ID NO: 1534032 - RNA, 13 nt, Homo sapiens
aagugacccuguu

SEQ ID NO: 1534033 - RNA, 16 nt, Homo sapiens
aagugacccuguucuc

SEQ ID NO: 1534034 - RNA, 17 nt, Homo sapiens
aagugcuucuccagccu

SEQ ID NO: 1534035 - RNA, 20 nt, Homo sapiens
aagugcuucuccagccucag

SEQ ID NO: 1534036 - RNA, 21 nt, Homo sapiens
aauaaagcugcugagaaucua

SEQ ID NO: 1534037 - RNA, 17 nt, Homo sapiens
aauaaauguaucugaau

SEQ ID NO: 1534038 - RNA, 20 nt, Homo sapiens
aauaaauguaucugaauauc

SEQ ID NO: 1534039 - RNA, 16 nt, Homo sapiens
aauaaauuguguuucc

SEQ ID NO: 1534040 - RNA, 12 nt, Homo sapiens
aauaauaauuag

SEQ ID NO: 1534041 - RNA, 21 nt, Homo sapiens
aauacaugucuagaacugauc

SEQ ID NO: 1534042 - RNA, 12 nt, Homo sapiens
aauaguaaucug

SEQ ID NO: 1534043 - RNA, 20 nt, Homo sapiens
aauauguucuuuuaaaugau

SEQ ID NO: 1534044 - RNA, 21 nt, Homo sapiens
aauauugacuuuuuauggcac

SEQ ID NO: 1534045 - RNA, 14 nt, Homo sapiens
aaucaaaugugcau

SEQ ID NO: 1534046 - RNA, 15 nt, Homo sapiens
aauccucccacuuca

SEQ ID NO: 1534047 - RNA, 17 nt, Homo sapiens
aaugagagacacacuga

SEQ ID NO: 1534048 - RNA, 21 nt, Homo sapiens
aaugagagacacacugaagaa

SEQ ID NO: 1534049 - RNA, 12 nt, Homo sapiens
aauguaucugaa

SEQ ID NO: 1534050 - RNA, 15 nt, Homo sapiens
aauguaucugaauau

SEQ ID NO: 1534051 - RNA, 14 nt, Homo sapiens
aauuaucuauagcu

SEQ ID NO: 1534052 - RNA, 20 nt, Homo sapiens
acaauauauuuaguuguaaa

SEQ ID NO: 1534053 - RNA, 16 nt, Homo sapiens
acaaucaaggccacug

SEQ ID NO: 1534054 - RNA, 17 nt, Homo sapiens
acacauguccaguggga

SEQ ID NO: 1534055 - RNA, 15 nt, Homo sapiens
acacccacagaagga

SEQ ID NO: 1534056 - RNA, 17 nt, Homo sapiens
acacccagcaauagaga

SEQ ID NO: 1534057 - RNA, 17 nt, Homo sapiens
acacuagccugugcacg

SEQ ID NO: 1534058 - RNA, 22 nt, Homo sapiens
acacugaagaagcaccaaucau

SEQ ID NO: 1534059 - RNA, 15 nt, Homo sapiens
acacuggauggucau

SEQ ID NO: 1534060 - RNA, 13 nt, Homo sapiens
acagaacuacuuc

SEQ ID NO: 1534061 - RNA, 13 nt, Homo sapiens
acagaaucucagu

SEQ ID NO: 1534062 - RNA, 21 nt, Homo sapiens
acagagcaagaccccaucuca

SEQ ID NO: 1534063 - RNA, 16 nt, Homo sapiens
acagcaugccuucaaa

SEQ ID NO: 1534064 - RNA, 22 nt, Homo sapiens
acaguuaccucugccucagaaa

SEQ ID NO: 1534065 - RNA, 14 nt, Homo sapiens
acauuuuacauuaa

SEQ ID NO: 1534066 - RNA, 15 nt, Homo sapiens
acauuuuacauuaaa

SEQ ID NO: 1534067 - RNA, 14 nt, Homo sapiens
accaaaucacugaa

SEQ ID NO: 1534068 - RNA, 21 nt, Homo sapiens
accaaguuccuuggccaugca

SEQ ID NO: 1534069 - RNA, 20 nt, Homo sapiens
accaauaaagugacccuguu

SEQ ID NO: 1534070 - RNA, 22 nt, Homo sapiens
accauguuggcuagacuagucu

SEQ ID NO: 1534071 - RNA, 12 nt, Homo sapiens
acccagcaauag

SEQ ID NO: 1534072 - RNA, 19 nt, Homo sapiens
acccccaguaaaaucaaau

SEQ ID NO: 1534073 - RNA, 14 nt, Homo sapiens
acccucaugcugug

SEQ ID NO: 1534074 - RNA, 13 nt, Homo sapiens
accucauggaauu

SEQ ID NO: 1534075 - RNA, 12 nt, Homo sapiens
accugagcauga

SEQ ID NO: 1534076 - RNA, 13 nt, Homo sapiens
accuuagaauaca

SEQ ID NO: 1534077 - RNA, 14 nt, Homo sapiens
acuauugcauuuau

SEQ ID NO: 1534078 - RNA, 12 nt, Homo sapiens
acucaaaccaaa

SEQ ID NO: 1534079 - RNA, 23 nt, Homo sapiens
acucuauaaauaaaaccugacag

SEQ ID NO: 1534080 - RNA, 13 nt, Homo sapiens
acucuuucuuuca

SEQ ID NO: 1534081 - RNA, 13 nt, Homo sapiens
acugaacuuugcu

SEQ ID NO: 1534082 - RNA, 12 nt, Homo sapiens
acugcaaccucc

SEQ ID NO: 1534083 - RNA, 12 nt, Homo sapiens
acugcaaccucu

SEQ ID NO: 1534084 - RNA, 20 nt, Homo sapiens
acugcucuccuccaccucaa

SEQ ID NO: 1534085 - RNA, 12 nt, Homo sapiens
acuguguuggcc

SEQ ID NO: 1534086 - RNA, 23 nt, Homo sapiens
acuugaggacacauguccagugg

SEQ ID NO: 1534087 - RNA, 17 nt, Homo sapiens
agaaaaauauauacuaa

SEQ ID NO: 1534088 - RNA, 20 nt, Homo sapiens
agaaaaauauauacuaaaca

SEQ ID NO: 1534089 - RNA, 17 nt, Homo sapiens
agaaacacaacuauauu

SEQ ID NO: 1534090 - RNA, 13 nt, Homo sapiens
agaaagcuacaga

SEQ ID NO: 1534091 - RNA, 18 nt, Homo sapiens
agaaagcugauggccuug

SEQ ID NO: 1534092 - RNA, 12 nt, Homo sapiens
agaaagugacaa

SEQ ID NO: 1534093 - RNA, 11 nt, Homo sapiens
agaacuacuuc

SEQ ID NO: 1534094 - RNA, 18 nt, Homo sapiens
agaagaugguaccaccag

SEQ ID NO: 1534095 - RNA, 14 nt, Homo sapiens
agaagcaccaauca

SEQ ID NO: 1534096 - RNA, 13 nt, Homo sapiens
agaaucucagucu

SEQ ID NO: 1534097 - RNA, 17 nt, Homo sapiens
agaaugauuaugaauua

SEQ ID NO: 1534098 - RNA, 22 nt, Homo sapiens
agacacacaugaaguccaagca

SEQ ID NO: 1534099 - RNA, 13 nt, Homo sapiens
agaccaccucuca

SEQ ID NO: 1534100 - RNA, 21 nt, Homo sapiens
agacgagguuucacuguguug

SEQ ID NO: 1534101 - RNA, 15 nt, Homo sapiens
agagaacuuccagau

SEQ ID NO: 1534102 - RNA, 20 nt, Homo sapiens
agagaucaggaagagaagga

SEQ ID NO: 1534103 - RNA, 17 nt, Homo sapiens
agagcaagaccccaucu

SEQ ID NO: 1534104 - RNA, 14 nt, Homo sapiens
agaggaaaaugccu

SEQ ID NO: 1534105 - RNA, 22 nt, Homo sapiens
agauguauguacuucaugcugu

SEQ ID NO: 1534106 - RNA, 22 nt, Homo sapiens
agcaacaauaaauagacacgca

SEQ ID NO: 1534107 - RNA, 14 nt, Homo sapiens
agcacgcugaaggc

SEQ ID NO: 1534108 - RNA, 11 nt, Homo sapiens
agcacugugag

SEQ ID NO: 1534109 - RNA, 23 nt, Homo sapiens
agcagagcugauggagaaggaag

SEQ ID NO: 1534110 - RNA, 13 nt, Homo sapiens
agccaagugcagg

SEQ ID NO: 1534111 - RNA, 11 nt, Homo sapiens
agccauccagg

SEQ ID NO: 1534112 - RNA, 16 nt, Homo sapiens
agccccauccaacacu

SEQ ID NO: 1534113 - RNA, 18 nt, Homo sapiens
agcccuguccccuacccc

SEQ ID NO: 1534114 - RNA, 16 nt, Homo sapiens
agcccuucuauaccca

SEQ ID NO: 1534115 - RNA, 14 nt, Homo sapiens
agccucagcucuca

SEQ ID NO: 1534116 - RNA, 19 nt, Homo sapiens
agccucccaaguagcugag

SEQ ID NO: 1534117 - RNA, 19 nt, Homo sapiens
agccucuuagaugcaguuc

SEQ ID NO: 1534118 - RNA, 15 nt, Homo sapiens
agcugaggccuugcc

SEQ ID NO: 1534119 - RNA, 19 nt, Homo sapiens
agcuuauugucuagugaaa

SEQ ID NO: 1534120 - RNA, 17 nt, Homo sapiens
agcuuucucuaguucaa

SEQ ID NO: 1534121 - RNA, 15 nt, Homo sapiens
aggaaagcgccucca

SEQ ID NO: 1534122 - RNA, 18 nt, Homo sapiens
aggaaccagagugcugaa

SEQ ID NO: 1534123 - RNA, 20 nt, Homo sapiens
aggagaaugaauacugggaa

SEQ ID NO: 1534124 - RNA, 14 nt, Homo sapiens
aggagcccuucuau

SEQ ID NO: 1534125 - RNA, 17 nt, Homo sapiens
aggaucaguuaacuauu

SEQ ID NO: 1534126 - RNA, 22 nt, Homo sapiens
aggcaacuggaaaauacauguc

SEQ ID NO: 1534127 - RNA, 22 nt, Homo sapiens
aggccagugccagcaccugccc

SEQ ID NO: 1534128 - RNA, 13 nt, Homo sapiens
aggcuaccucaag

SEQ ID NO: 1534129 - RNA, 18 nt, Homo sapiens
aggcuccaucuccagugg

SEQ ID NO: 1534130 - RNA, 23 nt, Homo sapiens
aggcugucaggauucuucaagga

SEQ ID NO: 1534131 - RNA, 14 nt, Homo sapiens
aggggcuacuguga

SEQ ID NO: 1534132 - RNA, 14 nt, Homo sapiens
aggguuaugauuaa

SEQ ID NO: 1534133 - RNA, 15 nt, Homo sapiens
aggugagaccaccuc

SEQ ID NO: 1534134 - RNA, 11 nt, Homo sapiens
aggugcacagg

SEQ ID NO: 1534135 - RNA, 19 nt, Homo sapiens
aguaaaaucaaaugugcau

SEQ ID NO: 1534136 - RNA, 17 nt, Homo sapiens
aguaaaggcugcugcua

SEQ ID NO: 1534137 - RNA, 19 nt, Homo sapiens
aguacaugauaaaugauag

SEQ ID NO: 1534138 - RNA, 19 nt, Homo sapiens
aguagagacgagguuucac

SEQ ID NO: 1534139 - RNA, 23 nt, Homo sapiens
aguaucucuucagucucuauacc

SEQ ID NO: 1534140 - RNA, 14 nt, Homo sapiens
aguccaacugucaa

SEQ ID NO: 1534141 - RNA, 12 nt, Homo sapiens
aguccugggauu

SEQ ID NO: 1534142 - RNA, 15 nt, Homo sapiens
agucucuauaccaau

SEQ ID NO: 1534143 - RNA, 20 nt, Homo sapiens
agugacagagcaagacccca

SEQ ID NO: 1534144 - RNA, 20 nt, Homo sapiens
agugcaguggcaucaucuca

SEQ ID NO: 1534145 - RNA, 21 nt, Homo sapiens
agugcaguggcaucaucucag

SEQ ID NO: 1534146 - RNA, 20 nt, Homo sapiens
aguggagaugggguuucacc

SEQ ID NO: 1534147 - RNA, 17 nt, Homo sapiens
aguggcaucaucucagc

SEQ ID NO: 1534148 - RNA, 18 nt, Homo sapiens
aguggcaucaucucagcu

SEQ ID NO: 1534149 - RNA, 16 nt, Homo sapiens
aguggcgcgaucucag

SEQ ID NO: 1534150 - RNA, 20 nt, Homo sapiens
aguggcgcgaucucagcuca

SEQ ID NO: 1534151 - RNA, 23 nt, Homo sapiens
aauaacaucucuuucaucuagcu

SEQ ID NO: 1534152 - RNA, 13 nt, Homo sapiens
aauaaccaaaaaa

SEQ ID NO: 1534153 - RNA, 13 nt, Homo sapiens
aauaaugauuuaa

SEQ ID NO: 1534154 - RNA, 15 nt, Homo sapiens
aauaauuauguuuac

SEQ ID NO: 1534155 - RNA, 15 nt, Homo sapiens
aauaauucuaugaga

SEQ ID NO: 1534156 - RNA, 19 nt, Homo sapiens
aauacaauuaaagcuguua

SEQ ID NO: 1534157 - RNA, 23 nt, Homo sapiens
aauacccacugccagacaugcca

SEQ ID NO: 1534158 - RNA, 23 nt, Homo sapiens
aauaguaaaggaaagcaguguug

SEQ ID NO: 1534159 - RNA, 14 nt, Homo sapiens
aauaguaaaugcuu

SEQ ID NO: 1534160 - RNA, 15 nt, Homo sapiens
aauauauuuuaucuu

SEQ ID NO: 1534161 - RNA, 19 nt, Homo sapiens
aauaugaggggacugcaug

SEQ ID NO: 1534162 - RNA, 22 nt, Homo sapiens
aauaugaggggacugcaugcaa

SEQ ID NO: 1534163 - RNA, 15 nt, Homo sapiens
aauauggacaucugg

SEQ ID NO: 1534164 - RNA, 15 nt, Homo sapiens
aauauuauuugcuaa

SEQ ID NO: 1534165 - RNA, 22 nt, Homo sapiens
aauauuuuaaacuacugauuga

SEQ ID NO: 1534166 - RNA, 17 nt, Homo sapiens
aauauuuuuuucuagcu

SEQ ID NO: 1534167 - RNA, 21 nt, Homo sapiens
aauauuuuuuucuagcuauaa

SEQ ID NO: 1534168 - RNA, 17 nt, Homo sapiens
aaucaauguucacgcaa

SEQ ID NO: 1534169 - RNA, 20 nt, Homo sapiens
aaucaccuaauuaauuucag

SEQ ID NO: 1534170 - RNA, 19 nt, Homo sapiens
aaucacgagaucuuccuuc

SEQ ID NO: 1534171 - RNA, 17 nt, Homo sapiens
aaucagcauucucacuc

SEQ ID NO: 1534172 - RNA, 11 nt, Homo sapiens
aaucaguuugc

SEQ ID NO: 1534173 - RNA, 22 nt, Homo sapiens
aaucauuuauuuacaugugauu

SEQ ID NO: 1534174 - RNA, 17 nt, Homo sapiens
aauccaagcugcucauu

SEQ ID NO: 1534175 - RNA, 20 nt, Homo sapiens
aauccaagcugcucauuuca

SEQ ID NO: 1534176 - RNA, 21 nt, Homo sapiens
accuccuccuccaguucugau

SEQ ID NO: 1534177 - RNA, 12 nt, Homo sapiens
accucggcugug

SEQ ID NO: 1534178 - RNA, 16 nt, Homo sapiens
accucucaacuuacau

SEQ ID NO: 1534179 - RNA, 15 nt, Homo sapiens
accugcacuuggccu

SEQ ID NO: 1534180 - RNA, 15 nt, Homo sapiens
accugcagggagcag

SEQ ID NO: 1534181 - RNA, 20 nt, Homo sapiens
accugcagggagcagcacgc

SEQ ID NO: 1534182 - RNA, 15 nt, Homo sapiens
accuguaauagccuc

SEQ ID NO: 1534183 - RNA, 16 nt, Homo sapiens
accuguaauagccuca

SEQ ID NO: 1534184 - RNA, 22 nt, Homo sapiens
accuguauugucugacuucuca

SEQ ID NO: 1534185 - RNA, 15 nt, Homo sapiens
accuuaccagauuuu

SEQ ID NO: 1534186 - RNA, 21 nt, Homo sapiens
accuuucaggaaaguaucucu

SEQ ID NO: 1534187 - RNA, 17 nt, Homo sapiens
acgauaugcaaguucau

SEQ ID NO: 1534188 - RNA, 19 nt, Homo sapiens
acgccccccggccugaugg

SEQ ID NO: 1534189 - RNA, 23 nt, Homo sapiens
acgccccccggccugauggccag

SEQ ID NO: 1534190 - RNA, 16 nt, Homo sapiens
acgcgcucugcaugcu

SEQ ID NO: 1534191 - RNA, 16 nt, Homo sapiens
acgcucauuguagaaa

SEQ ID NO: 1534192 - RNA, 18 nt, Homo sapiens
acgcuuuucccaccucuu

SEQ ID NO: 1534193 - RNA, 18 nt, Homo sapiens
acggaucagaugucuaua

SEQ ID NO: 1534194 - RNA, 15 nt, Homo sapiens
acgucacagcaguac

SEQ ID NO: 1534195 - RNA, 13 nt, Homo sapiens
acgugacuuucaa

SEQ ID NO: 1534196 - RNA, 20 nt, Homo sapiens
acgugcacacaccugcacac

SEQ ID NO: 1534197 - RNA, 21 nt, Homo sapiens
acuaaaccauugugcauucua

SEQ ID NO: 1534198 - RNA, 21 nt, Homo sapiens
acuacaaacauggggagccau

SEQ ID NO: 1534199 - RNA, 20 nt, Homo sapiens
acuaccccagaacgcaugca

SEQ ID NO: 1534200 - RNA, 20 nt, Homo sapiens
acuaccccaggaugcaugca

SEQ ID NO: 1534201 - RNA, 23 nt, Homo sapiens
acuaccccaggaugcaugcaggg

SEQ ID NO: 1534202 - RNA, 16 nt, Homo sapiens
acuacgacuggcaucu

SEQ ID NO: 1534203 - RNA, 22 nt, Homo sapiens
acuacucagcauggaaacaaga

SEQ ID NO: 1534204 - RNA, 18 nt, Homo sapiens
acuagaacacaaauccaa

SEQ ID NO: 1534205 - RNA, 22 nt, Homo sapiens
acuagaaccuucuaauccaugu

SEQ ID NO: 1534206 - RNA, 11 nt, Homo sapiens
acuagaucucc

SEQ ID NO: 1534207 - RNA, 14 nt, Homo sapiens
acuaggagcacugu

SEQ ID NO: 1534208 - RNA, 18 nt, Homo sapiens
acucaccuugcucugcca

SEQ ID NO: 1534209 - RNA, 17 nt, Homo sapiens
acucaguauauagccuu

SEQ ID NO: 1534210 - RNA, 21 nt, Homo sapiens
acucaucugucaccaagccuu

SEQ ID NO: 1534211 - RNA, 19 nt, Homo sapiens
acuccacuccccucaucca

SEQ ID NO: 1534212 - RNA, 16 nt, Homo sapiens
acucccucucuugccg

SEQ ID NO: 1534213 - RNA, 15 nt, Homo sapiens
acuccuucuccccaa

SEQ ID NO: 1534214 - RNA, 18 nt, Homo sapiens
acucucuucuuacuguau

SEQ ID NO: 1534215 - RNA, 17 nt, Homo sapiens
acucugcugaggccaga

SEQ ID NO: 1534216 - RNA, 17 nt, Homo sapiens
acugaaagguagacuuu

SEQ ID NO: 1534217 - RNA, 13 nt, Homo sapiens
acugagccaaaaa

SEQ ID NO: 1534218 - RNA, 17 nt, Homo sapiens
acugaugcccuuuggaa

SEQ ID NO: 1534219 - RNA, 14 nt, Homo sapiens
acugaugugugcaa

SEQ ID NO: 1534220 - RNA, 20 nt, Homo sapiens
acugcaaauacuuccaaaga

SEQ ID NO: 1534221 - RNA, 15 nt, Homo sapiens
acugcaacacuggau

SEQ ID NO: 1534222 - RNA, 17 nt, Homo sapiens
acugcaugcaagcucag

SEQ ID NO: 1534223 - RNA, 17 nt, Homo sapiens
acugcaugcacuucuua

SEQ ID NO: 1534224 - RNA, 18 nt, Homo sapiens
acugcaugcacuucuuac

SEQ ID NO: 1534225 - RNA, 19 nt, Homo sapiens
acugccuggaaagcccuuc

SEQ ID NO: 1534226 - RNA, 23 nt, Homo sapiens
acugcguaggagagaacagggau

SEQ ID NO: 1534227 - RNA, 22 nt, Homo sapiens
acuggaaaugagcccaagcaca

SEQ ID NO: 1534228 - RNA, 17 nt, Homo sapiens
acuggccuagagccuca

SEQ ID NO: 1534229 - RNA, 9 nt, Homo sapiens
acuggucca

SEQ ID NO: 1534230 - RNA, 20 nt, Homo sapiens
acuguaguaauuguuacaau

SEQ ID NO: 1534231 - RNA, 12 nt, Homo sapiens
acugucucaaga

SEQ ID NO: 1534232 - RNA, 14 nt, Homo sapiens
acugucucucauga

SEQ ID NO: 1534233 - RNA, 15 nt, Homo sapiens
acugucucucaugaa

SEQ ID NO: 1534234 - RNA, 13 nt, Homo sapiens
acugucuuaguca

SEQ ID NO: 1534235 - RNA, 20 nt, Homo sapiens
acugugaacuuggggaacaa

SEQ ID NO: 1534236 - RNA, 23 nt, Homo sapiens
acuuagaaauugcauuuccugac

SEQ ID NO: 1534237 - RNA, 15 nt, Homo sapiens
acuuauuucauaaac

SEQ ID NO: 1534238 - RNA, 19 nt, Homo sapiens
acuuauuucauaaacaacu

SEQ ID NO: 1534239 - RNA, 13 nt, Homo sapiens
acuuccucaugaa

SEQ ID NO: 1534240 - RNA, 16 nt, Homo sapiens
acuuccucaugaaucu

SEQ ID NO: 1534241 - RNA, 13 nt, Homo sapiens
acuucgacuguga

SEQ ID NO: 1534242 - RNA, 14 nt, Homo sapiens
acuucucuagacau

SEQ ID NO: 1534243 - RNA, 15 nt, Homo sapiens
acuucuucauucucu

SEQ ID NO: 1534244 - RNA, 24 nt, Homo sapiens
acuugacaagucaggagacacugu

SEQ ID NO: 1534245 - RNA, 20 nt, Homo sapiens
acuuggauaggagcuuccag

SEQ ID NO: 1534246 - RNA, 23 nt, Homo sapiens
acuuuagggcuaaccaguucucu

SEQ ID NO: 1534247 - RNA, 18 nt, Homo sapiens
acuuuauguuacuacaug

SEQ ID NO: 1534248 - RNA, 23 nt, Homo sapiens
acuuuauguuacuacaugcacuu

SEQ ID NO: 1534249 - RNA, 12 nt, Homo sapiens
acuuugcugauu

SEQ ID NO: 1534250 - RNA, 15 nt, Homo sapiens
acuuugguaaugugu

SEQ ID NO: 1534251 - RNA, 16 nt, Homo sapiens
acuuuguccgguggaa

SEQ ID NO: 1534252 - RNA, 19 nt, Homo sapiens
acuuuuagcgguuugcaaa

SEQ ID NO: 1534253 - RNA, 15 nt, Homo sapiens
acuuuucugcugaua

SEQ ID NO: 1534254 - RNA, 16 nt, Homo sapiens
agaaaagugggccagu

SEQ ID NO: 1534255 - RNA, 11 nt, Homo sapiens
agaaaccucac

SEQ ID NO: 1534256 - RNA, 20 nt, Homo sapiens
agaaacgagauuugccaaaa

SEQ ID NO: 1534257 - RNA, 23 nt, Homo sapiens
agaaacuccuggaucccuuucac

SEQ ID NO: 1534258 - RNA, 13 nt, Homo sapiens
agaaacugugguc

SEQ ID NO: 1534259 - RNA, 15 nt, Homo sapiens
agaaaguacaaccac

SEQ ID NO: 1534260 - RNA, 15 nt, Homo sapiens
agaaagugagcagug

SEQ ID NO: 1534261 - RNA, 17 nt, Homo sapiens
agaaauaaaauauggac

SEQ ID NO: 1534262 - RNA, 15 nt, Homo sapiens
agaaaucaaguuaau

SEQ ID NO: 1534263 - RNA, 22 nt, Homo sapiens
agaaauugcauuuccugacaga

SEQ ID NO: 1534264 - RNA, 23 nt, Homo sapiens
agaacaaaccucuauauguugcu

SEQ ID NO: 1534265 - RNA, 18 nt, Homo sapiens
agaacccuuggagccaau

SEQ ID NO: 1534266 - RNA, 16 nt, Homo sapiens
agaacucaugugauuu

SEQ ID NO: 1534267 - RNA, 15 nt, Homo sapiens
agaacuugucccuca

SEQ ID NO: 1534268 - RNA, 13 nt, Homo sapiens
agaagacuggaag

SEQ ID NO: 1534269 - RNA, 12 nt, Homo sapiens
agaagagggaga

SEQ ID NO: 1534270 - RNA, 13 nt, Homo sapiens
agaagcagcauca

SEQ ID NO: 1534271 - RNA, 22 nt, Homo sapiens
agaagcccccaccuucccucca

SEQ ID NO: 1534272 - RNA, 15 nt, Homo sapiens
agaaggaauggugcu

SEQ ID NO: 1534273 - RNA, 18 nt, Homo sapiens
agaagugggagugggaga

SEQ ID NO: 1534274 - RNA, 21 nt, Homo sapiens
agaaguggggcagcagcagug

SEQ ID NO: 1534275 - RNA, 12 nt, Homo sapiens
agaauacuguau

SEQ ID NO: 1534276 - RNA, 21 nt, Homo sapiens
agaauaucaggaugccuuaaa

SEQ ID NO: 1534277 - RNA, 14 nt, Homo sapiens
agaauauuguuaaa

SEQ ID NO: 1534278 - RNA, 23 nt, Homo sapiens
agaaucacuugacuuugccacau

SEQ ID NO: 1534279 - RNA, 15 nt, Homo sapiens
agaaucucagcacuu

SEQ ID NO: 1534280 - RNA, 17 nt, Homo sapiens
agaaugccuaggccagc

SEQ ID NO: 1534281 - RNA, 20 nt, Homo sapiens
agaauggaagccuccaccug

SEQ ID NO: 1534282 - RNA, 13 nt, Homo sapiens
agaauggugggcu

SEQ ID NO: 1534283 - RNA, 19 nt, Homo sapiens
agacaaauguaacacacac

SEQ ID NO: 1534284 - RNA, 14 nt, Homo sapiens
agacacuauguagu

SEQ ID NO: 1534285 - RNA, 18 nt, Homo sapiens
gcacgcuggcuugugauc

SEQ ID NO: 1534286 - RNA, 22 nt, Homo sapiens
gcacugaaggcuuucagggccu

SEQ ID NO: 1534287 - RNA, 22 nt, Homo sapiens
gcacugcaaauacuuccaaaga

SEQ ID NO: 1534288 - RNA, 14 nt, Homo sapiens
gcagaaauugaccu

SEQ ID NO: 1534289 - RNA, 18 nt, Homo sapiens
gcagaccugggacuuuag

SEQ ID NO: 1534290 - RNA, 20 nt, Homo sapiens
gcagacuagcuaauuagcuc

SEQ ID NO: 1534291 - RNA, 18 nt, Homo sapiens
gcagauugguucaugccu

SEQ ID NO: 1534292 - RNA, 20 nt, Homo sapiens
gcagauugguucaugccugg

SEQ ID NO: 1534293 - RNA, 22 nt, Homo sapiens
gcagccugcagaccacacucug

SEQ ID NO: 1534294 - RNA, 13 nt, Homo sapiens
gcagcuagacacc

SEQ ID NO: 1534295 - RNA, 16 nt, Homo sapiens
gcagcuucaggugagc

SEQ ID NO: 1534296 - RNA, 21 nt, Homo sapiens
gcaggcccuccgcgggggaca

SEQ ID NO: 1534297 - RNA, 18 nt, Homo sapiens
gcaggcgguauccagagg

SEQ ID NO: 1534298 - RNA, 20 nt, Homo sapiens
gcagggcagccugugggaga

SEQ ID NO: 1534299 - RNA, 23 nt, Homo sapiens
gcaggggcgguccagaggaggug

SEQ ID NO: 1534300 - RNA, 22 nt, Homo sapiens
gcaggugaccuucugggaaaug

SEQ ID NO: 1534301 - RNA, 15 nt, Homo sapiens
gcagucagcacagag

SEQ ID NO: 1534302 - RNA, 15 nt, Homo sapiens
gcagugacuuuagaa

SEQ ID NO: 1534303 - RNA, 21 nt, Homo sapiens
gcagugacuuuagaaacaaau

SEQ ID NO: 1534304 - RNA, 21 nt, Homo sapiens
gcaguuugcuuuguaugcacu

SEQ ID NO: 1534305 - RNA, 20 nt, Homo sapiens
gcauaaaugugguacaagca

SEQ ID NO: 1534306 - RNA, 15 nt, Homo sapiens
gcauaaccgcacaga

SEQ ID NO: 1534307 - RNA, 12 nt, Homo sapiens
gcauacauucuu

SEQ ID NO: 1534308 - RNA, 20 nt, Homo sapiens
gcaucauuuucaccuccauu

SEQ ID NO: 1534309 - RNA, 22 nt, Homo sapiens
gcaucauuuucaccuccauuuc

SEQ ID NO: 1534310 - RNA, 19 nt, Homo sapiens
gcauccaaggggccuggaa

SEQ ID NO: 1534311 - RNA, 14 nt, Homo sapiens
gcaucuccaggaag

SEQ ID NO: 1534312 - RNA, 15 nt, Homo sapiens
gcaucugccaggaca

SEQ ID NO: 1534313 - RNA, 20 nt, Homo sapiens
gcaucuuccccaacgaaaag

SEQ ID NO: 1534314 - RNA, 12 nt, Homo sapiens
gcaugagccagc

SEQ ID NO: 1534315 - RNA, 17 nt, Homo sapiens
gcaugagccagcucugu

SEQ ID NO: 1534316 - RNA, 18 nt, Homo sapiens
gcaugauugugaccucca

SEQ ID NO: 1534317 - RNA, 13 nt, Homo sapiens
gcaugcaagcuca

SEQ ID NO: 1534318 - RNA, 21 nt, Homo sapiens
gcaugcagggcccccacagga

SEQ ID NO: 1534319 - RNA, 21 nt, Homo sapiens
gcaugccggugaucccuagcu

SEQ ID NO: 1534320 - RNA, 14 nt, Homo sapiens
gcauggaguauuau

SEQ ID NO: 1534321 - RNA, 14 nt, Homo sapiens
gcauuaaaaaugca

SEQ ID NO: 1534322 - RNA, 17 nt, Homo sapiens
gcauuaaauuuuagcaa

SEQ ID NO: 1534323 - RNA, 23 nt, Homo sapiens
gcauucuagagugcauauauuua

SEQ ID NO: 1534324 - RNA, 20 nt, Homo sapiens
gcauucugggguggggcuug

SEQ ID NO: 1534325 - RNA, 18 nt, Homo sapiens
gcauuuuucuacugcucu

SEQ ID NO: 1534326 - RNA, 12 nt, Homo sapiens
gccaagugcagg

SEQ ID NO: 1534327 - RNA, 19 nt, Homo sapiens
gccacaauaagccacuggu

SEQ ID NO: 1534328 - RNA, 12 nt, Homo sapiens
gccacacuguca

SEQ ID NO: 1534329 - RNA, 17 nt, Homo sapiens
gccagaagggggccaug

SEQ ID NO: 1534330 - RNA, 18 nt, Homo sapiens
gccagaggcucuaaugua

SEQ ID NO: 1534331 - RNA, 15 nt, Homo sapiens
gccagauuaggccug

SEQ ID NO: 1534332 - RNA, 17 nt, Homo sapiens
gccagcaauaauugaca

SEQ ID NO: 1534333 - RNA, 13 nt, Homo sapiens
gccaggacacugc

SEQ ID NO: 1534334 - RNA, 17 nt, Homo sapiens
gccaggacacugccuug

SEQ ID NO: 1534335 - RNA, 15 nt, Homo sapiens
gccaggccucaggga

SEQ ID NO: 1534336 - RNA, 18 nt, Homo sapiens
gccaggccucagggacca

SEQ ID NO: 1534337 - RNA, 22 nt, Homo sapiens
gccaggccucagggaccaagga

SEQ ID NO: 1534338 - RNA, 17 nt, Homo sapiens
gccagugacuccaggag

SEQ ID NO: 1534339 - RNA, 19 nt, Homo sapiens
gccaugaggccucagugga

SEQ ID NO: 1534340 - RNA, 16 nt, Homo sapiens
gccaugauguggagug

SEQ ID NO: 1534341 - RNA, 17 nt, Homo sapiens
gccaugauuuuggccac

SEQ ID NO: 1534342 - RNA, 19 nt, Homo sapiens
gccauggacucuacacugu

SEQ ID NO: 1534343 - RNA, 19 nt, Homo sapiens
gcccaggcuggagugcagu

SEQ ID NO: 1534344 - RNA, 20 nt, Homo sapiens
gcccauucuaaacuccuuuc

SEQ ID NO: 1534345 - RNA, 16 nt, Homo sapiens
gccccaaaaccacagc

SEQ ID NO: 1534346 - RNA, 15 nt, Homo sapiens
gcugggagagccaag

SEQ ID NO: 1534347 - RNA, 21 nt, Homo sapiens
gcuggguuugggcaguggaga

SEQ ID NO: 1534348 - RNA, 10 nt, Homo sapiens
gcuggugggg

SEQ ID NO: 1534349 - RNA, 14 nt, Homo sapiens
gcuguacacugcac

SEQ ID NO: 1534350 - RNA, 20 nt, Homo sapiens
gcuguaccuggugcccugug

SEQ ID NO: 1534351 - RNA, 15 nt, Homo sapiens
gcuguagacaucugu

SEQ ID NO: 1534352 - RNA, 23 nt, Homo sapiens
gcuguauuuucuuuuauaucugu

SEQ ID NO: 1534353 - RNA, 21 nt, Homo sapiens
gcuguucuucuguucugcaga

SEQ ID NO: 1534354 - RNA, 21 nt, Homo sapiens
gcuuacaguaggagugagaaa

SEQ ID NO: 1534355 - RNA, 14 nt, Homo sapiens
gcuuaguaucucau

SEQ ID NO: 1534356 - RNA, 16 nt, Homo sapiens
gcuuauauuguucacu

SEQ ID NO: 1534357 - RNA, 14 nt, Homo sapiens
gcuucaaccuugag

SEQ ID NO: 1534358 - RNA, 12 nt, Homo sapiens
gcuucagaauug

SEQ ID NO: 1534359 - RNA, 17 nt, Homo sapiens
gcuucaguacuugugaa

SEQ ID NO: 1534360 - RNA, 22 nt, Homo sapiens
gcuuccggcugagcugugccag

SEQ ID NO: 1534361 - RNA, 17 nt, Homo sapiens
gcuuccuucauuuccuc

SEQ ID NO: 1534362 - RNA, 13 nt, Homo sapiens
gcuucugccuaag

SEQ ID NO: 1534363 - RNA, 21 nt, Homo sapiens
gcuuguucuuccucuuaccug

SEQ ID NO: 1534364 - RNA, 18 nt, Homo sapiens
gcuuuacauggguucaau

SEQ ID NO: 1534365 - RNA, 16 nt, Homo sapiens
gcuuucccaggcagcu

SEQ ID NO: 1534366 - RNA, 14 nt, Homo sapiens
gcuuugccacugaa

SEQ ID NO: 1534367 - RNA, 20 nt, Homo sapiens
gcuuuggagacgccucccca

SEQ ID NO: 1534368 - RNA, 13 nt, Homo sapiens
gcuuuucugcaau

SEQ ID NO: 1534369 - RNA, 21 nt, Homo sapiens
ggaaacaagaugaaauuccau

SEQ ID NO: 1534370 - RNA, 14 nt, Homo sapiens
ggaaacaauaucaa

SEQ ID NO: 1534371 - RNA, 19 nt, Homo sapiens
ggaacugucucucaugaac

SEQ ID NO: 1534372 - RNA, 22 nt, Homo sapiens
ggaagaggccgcugcagggugg

SEQ ID NO: 1534373 - RNA, 13 nt, Homo sapiens
ggaaggagccagc

SEQ ID NO: 1534374 - RNA, 19 nt, Homo sapiens
ggaaggaugacuugacaag

SEQ ID NO: 1534375 - RNA, 20 nt, Homo sapiens
ggaagugugcugaggugggc

SEQ ID NO: 1534376 - RNA, 21 nt, Homo sapiens
ggaaugauaauggaaacuguc

SEQ ID NO: 1534377 - RNA, 21 nt, Homo sapiens
ggacagaucaauggcgcagug

SEQ ID NO: 1534378 - RNA, 17 nt, Homo sapiens
ggacagucuggaggucc

SEQ ID NO: 1534379 - RNA, 19 nt, Homo sapiens
ggacagucuggagguccca

SEQ ID NO: 1534380 - RNA, 16 nt, Homo sapiens
ggacucuacacuguga

SEQ ID NO: 1534381 - RNA, 16 nt, Homo sapiens
ggacugguccaggcau

SEQ ID NO: 1534382 - RNA, 17 nt, Homo sapiens
ggagacacuguucccaa

SEQ ID NO: 1534383 - RNA, 16 nt, Homo sapiens
ggagaggagcgggacc

SEQ ID NO: 1534384 - RNA, 13 nt, Homo sapiens
ggagaggccauga

SEQ ID NO: 1534385 - RNA, 14 nt, Homo sapiens
ggagccacaggcag

SEQ ID NO: 1534386 - RNA, 14 nt, Homo sapiens
ggagcugcuuccag

SEQ ID NO: 1534387 - RNA, 18 nt, Homo sapiens
ggaggaaugcucccccau

SEQ ID NO: 1534388 - RNA, 22 nt, Homo sapiens
ggauauaggucagugaggccca

SEQ ID NO: 1534389 - RNA, 13 nt, Homo sapiens
ggaucccuuucac

SEQ ID NO: 1534390 - RNA, 18 nt, Homo sapiens
ggauuuuaaaugcuguau

SEQ ID NO: 1534391 - RNA, 15 nt, Homo sapiens
ggcaaccuguugaau

SEQ ID NO: 1534392 - RNA, 13 nt, Homo sapiens
ggcaaggccuuug

SEQ ID NO: 1534393 - RNA, 23 nt, Homo sapiens
ggcaauuuuuacacaaaccugaa

SEQ ID NO: 1534394 - RNA, 14 nt, Homo sapiens
ggcagccucagagg

SEQ ID NO: 1534395 - RNA, 17 nt, Homo sapiens
ggcauacucuccaggau

SEQ ID NO: 1534396 - RNA, 20 nt, Homo sapiens
ggcauaucuuguuguucagu

SEQ ID NO: 1534397 - RNA, 16 nt, Homo sapiens
ggcaugaaggugucau

SEQ ID NO: 1534398 - RNA, 21 nt, Homo sapiens
ggccaagccugccccggccac

SEQ ID NO: 1534399 - RNA, 19 nt, Homo sapiens
ggccacaugagucccagug

SEQ ID NO: 1534400 - RNA, 14 nt, Homo sapiens
ggccagaggugaac

SEQ ID NO: 1534401 - RNA, 22 nt, Homo sapiens
ggccagccccucccaccacagc

SEQ ID NO: 1534402 - RNA, 13 nt, Homo sapiens
ggccagguggcca

SEQ ID NO: 1534403 - RNA, 17 nt, Homo sapiens
ggccaugagcuccagac

SEQ ID NO: 1534404 - RNA, 13 nt, Homo sapiens
ggccauggcaauu

SEQ ID NO: 1534405 - RNA, 20 nt, Homo sapiens
ggcccagggaaucagggagc

SEQ ID NO: 1534406 - RNA, 19 nt, Homo sapiens
ggcccccacccaccuggau

SEQ ID NO: 1534407 - RNA, 17 nt, Homo sapiens
ggccccucacuggcugg

SEQ ID NO: 1534408 - RNA, 19 nt, Homo sapiens
ggcccgacagccuggcaca

SEQ ID NO: 1534409 - RNA, 14 nt, Homo sapiens
ggccgccuguccuu

SEQ ID NO: 1534410 - RNA, 15 nt, Homo sapiens
uacugaaauacauau

SEQ ID NO: 1534411 - RNA, 14 nt, Homo sapiens
uacugcaugcacuu

SEQ ID NO: 1534412 - RNA, 20 nt, Homo sapiens
uacuggauuuaacuaccuuu

SEQ ID NO: 1534413 - RNA, 16 nt, Homo sapiens
uacuggggaucagagu

SEQ ID NO: 1534414 - RNA, 22 nt, Homo sapiens
uacuuuagguaguagaaucuca

SEQ ID NO: 1534415 - RNA, 22 nt, Homo sapiens
uacuuuauggcagacauugugc

SEQ ID NO: 1534416 - RNA, 19 nt, Homo sapiens
uacuuuccugauguugaua

SEQ ID NO: 1534417 - RNA, 20 nt, Homo sapiens
uagaaaaguuauguagaaaa

SEQ ID NO: 1534418 - RNA, 19 nt, Homo sapiens
uagaacugucccacaaaau

SEQ ID NO: 1534419 - RNA, 20 nt, Homo sapiens
uagaaucagccuagggguca

SEQ ID NO: 1534420 - RNA, 23 nt, Homo sapiens
uagaauggaagccuccaccugca

SEQ ID NO: 1534421 - RNA, 23 nt, Homo sapiens
uagaauguuacuuuggaaugacu

SEQ ID NO: 1534422 - RNA, 18 nt, Homo sapiens
uagacuguaaaagauuca

SEQ ID NO: 1534423 - RNA, 22 nt, Homo sapiens
uagacuuuuaacuucaccuuaa

SEQ ID NO: 1534424 - RNA, 20 nt, Homo sapiens
uagagaaaauggaacauuaa

SEQ ID NO: 1534425 - RNA, 12 nt, Homo sapiens
uagagaggacag

SEQ ID NO: 1534426 - RNA, 22 nt, Homo sapiens
uagagugcccuuaaaauaauga

SEQ ID NO: 1534427 - RNA, 16 nt, Homo sapiens
uagauauccuuggcac

SEQ ID NO: 1534428 - RNA, 16 nt, Homo sapiens
uagauuaccaugaaga

SEQ ID NO: 1534429 - RNA, 15 nt, Homo sapiens
uagauugauucaccc

SEQ ID NO: 1534430 - RNA, 16 nt, Homo sapiens
uagcaaagauaucuca

SEQ ID NO: 1534431 - RNA, 12 nt, Homo sapiens
uagcacuuuaua

SEQ ID NO: 1534432 - RNA, 18 nt, Homo sapiens
uagccugcauaucauuca

SEQ ID NO: 1534433 - RNA, 22 nt, Homo sapiens
uagcuaaaaccuuccaugucaa

SEQ ID NO: 1534434 - RNA, 17 nt, Homo sapiens
uagcuaauuuaggaguu

SEQ ID NO: 1534435 - RNA, 14 nt, Homo sapiens
uagcucgugugcuu

SEQ ID NO: 1534436 - RNA, 16 nt, Homo sapiens
uagcucgugugcuuag

SEQ ID NO: 1534437 - RNA, 17 nt, Homo sapiens
uagcuuugucacuguuu

SEQ ID NO: 1534438 - RNA, 14 nt, Homo sapiens
uagcuuuuauucau

SEQ ID NO: 1534439 - RNA, 14 nt, Homo sapiens
uaggaacccggcau

SEQ ID NO: 1534440 - RNA, 22 nt, Homo sapiens
uaggaaccucgaagcuguucuc

SEQ ID NO: 1534441 - RNA, 17 nt, Homo sapiens
uaggagagaacagggau

SEQ ID NO: 1534442 - RNA, 16 nt, Homo sapiens
uaggauauacuguaug

SEQ ID NO: 1534443 - RNA, 20 nt, Homo sapiens
uaggcaauggugaacuguca

SEQ ID NO: 1534444 - RNA, 15 nt, Homo sapiens
uaguacuucuucugu

SEQ ID NO: 1534445 - RNA, 18 nt, Homo sapiens
uaguaucagagaugucca

SEQ ID NO: 1534446 - RNA, 20 nt, Homo sapiens
uaguauuccagaccugaaga

SEQ ID NO: 1534447 - RNA, 22 nt, Homo sapiens
uagucaacugcuguuuuauguc

SEQ ID NO: 1534448 - RNA, 18 nt, Homo sapiens
uagucaaucaaacaggga

SEQ ID NO: 1534449 - RNA, 14 nt, Homo sapiens
uagucacauaucaa

SEQ ID NO: 1534450 - RNA, 18 nt, Homo sapiens
uagucuguuagauuuuau

SEQ ID NO: 1534451 - RNA, 20 nt, Homo sapiens
uagugacuaaaccauugugc

SEQ ID NO: 1534452 - RNA, 17 nt, Homo sapiens
uaguuccugugcacagc

SEQ ID NO: 1534453 - RNA, 14 nt, Homo sapiens
uaguugaacaagau

SEQ ID NO: 1534454 - RNA, 20 nt, Homo sapiens
uaguugauauguaacaguug

SEQ ID NO: 1534455 - RNA, 11 nt, Homo sapiens
uaguugcaaag

SEQ ID NO: 1534456 - RNA, 13 nt, Homo sapiens
uauaaaacagugu

SEQ ID NO: 1534457 - RNA, 19 nt, Homo sapiens
uauaaaucgcauuaaugaa

SEQ ID NO: 1534458 - RNA, 18 nt, Homo sapiens
uauacauguauagugagu

SEQ ID NO: 1534459 - RNA, 22 nt, Homo sapiens
uauacccccccaugcagucuaa

SEQ ID NO: 1534460 - RNA, 16 nt, Homo sapiens
uauacuugaauauuau

SEQ ID NO: 1534461 - RNA, 21 nt, Homo sapiens
uauauacccccccaugcaguc

SEQ ID NO: 1534462 - RNA, 20 nt, Homo sapiens
uauauccagauggcaugugu

SEQ ID NO: 1534463 - RNA, 16 nt, Homo sapiens
uauaugaaaacuaagu

SEQ ID NO: 1534464 - RNA, 14 nt, Homo sapiens
uaucaguuacacau

SEQ ID NO: 1534465 - RNA, 22 nt, Homo sapiens
uaucauguguuucuguguagua

SEQ ID NO: 1534466 - RNA, 14 nt, Homo sapiens
uaucauucacccaa

SEQ ID NO: 1534467 - RNA, 19 nt, Homo sapiens
uauccagaggguugugauu

SEQ ID NO: 1534468 - RNA, 13 nt, Homo sapiens
uaucccaucucac

SEQ ID NO: 1534469 - RNA, 21 nt, Homo sapiens
uauccccggacgcaugcaggg

SEQ ID NO: 1534470 - RNA, 22 nt, Homo sapiens
uauccuuuuaucucacaaauaa

SEQ ID NO: 1534471 - RNA, 21 nt, Homo sapiens
uaucgaguuccggaaagccuu

SEQ ID NO: 1534472 - RNA, 13 nt, Homo sapiens
uaucuaugcauuu

SEQ ID NO: 1534473 - RNA, 20 nt, Homo sapiens
uaucucacaaauaaguaaua

SEQ ID NO: 1534474 - RNA, 13 nt, Homo sapiens
uaucugugcuuug

SEQ ID NO: 1534475 - RNA, 16 nt, Homo sapiens
uaucuguuugcuucua

SEQ ID NO: 1534476 - RNA, 21 nt, Homo sapiens
uaucuucguuaguaaucugua

SEQ ID NO: 1534477 - RNA, 23 nt, Homo sapiens
uaugaccauaaaauuagacauac

SEQ ID NO: 1534478 - RNA, 15 nt, Homo sapiens
uaugagauacuuugc

SEQ ID NO: 1534479 - RNA, 14 nt, Homo sapiens
uaugcuaugauuaa

SEQ ID NO: 1534480 - RNA, 14 nt, Homo sapiens
uauguaguaugcua

SEQ ID NO: 1534481 - RNA, 21 nt, Homo sapiens
uaugugaauugaagucaucau

SEQ ID NO: 1534482 - RNA, 17 nt, Homo sapiens
uaugugaauuuugccau

SEQ ID NO: 1534483 - RNA, 17 nt, Homo sapiens
uaugugcagcuuuccag

SEQ ID NO: 1534484 - RNA, 17 nt, Homo sapiens
uauguuacuacaugcac

SEQ ID NO: 1534485 - RNA, 18 nt, Homo sapiens
uauguuacuacaugcacu

SEQ ID NO: 1534486 - RNA, 19 nt, Homo sapiens
uauguuacuacaugcacuu

SEQ ID NO: 1534487 - RNA, 20 nt, Homo sapiens
uauguuuagugugauuguga

SEQ ID NO: 1534488 - RNA, 12 nt, Homo sapiens
uauuacugaugu

SEQ ID NO: 1534489 - RNA, 23 nt, Homo sapiens
uauucaaagagaaaacaucucau

SEQ ID NO: 1534490 - RNA, 20 nt, Homo sapiens
uauucaggaccccaucugcu

SEQ ID NO: 1534491 - RNA, 21 nt, Homo sapiens
uauucccaugguagacuguga

SEQ ID NO: 1534492 - RNA, 15 nt, Homo sapiens
uauuccuaugcugca

SEQ ID NO: 1534493 - RNA, 14 nt, Homo sapiens
uauucuggugucua

SEQ ID NO: 1534494 - RNA, 17 nt, Homo sapiens
uauugagcagaauucau

SEQ ID NO: 1534495 - RNA, 14 nt, Homo sapiens
uauuguauguaccu

SEQ ID NO: 1534496 - RNA, 17 nt, Homo sapiens
uauuucaaccgcuugcc

SEQ ID NO: 1534497 - RNA, 21 nt, Homo sapiens
uauuucaaccgcuugccauau

SEQ ID NO: 1534498 - RNA, 20 nt, Homo sapiens
uauuuuaaacuacugauuga

SEQ ID NO: 1534499 - RNA, 23 nt, Homo sapiens
uauuuuguaugaaauauauguga

SEQ ID NO: 1534500 - RNA, 19 nt, Homo sapiens
uauuuuuuacuacauaauu

SEQ ID NO: 1534501 - RNA, 21 nt, Homo sapiens
ucaaaaacauggccacaucca

SEQ ID NO: 1534502 - RNA, 14 nt, Homo sapiens
ucaaaauacuucuu

SEQ ID NO: 1534503 - RNA, 18 nt, Homo sapiens
ucaaagagaaaacaucuc

SEQ ID NO: 1534504 - RNA, 19 nt, Homo sapiens
ucaaagagggagugcauuu

SEQ ID NO: 1534505 - RNA, 17 nt, Homo sapiens
ucaaaugcuacucagua

SEQ ID NO: 1534506 - RNA, 17 nt, Homo sapiens
ucaacagugaacagcuu

SEQ ID NO: 1534507 - RNA, 20 nt, Homo sapiens
ucaacccugugaucuauacc

SEQ ID NO: 1534508 - RNA, 15 nt, Homo sapiens
ucaaccuacagugga

SEQ ID NO: 1534509 - RNA, 18 nt, Homo sapiens
ucaacuuuuccuuugaau

SEQ ID NO: 1534510 - RNA, 14 nt, Homo sapiens
ucaagaaugcagua

SEQ ID NO: 1534511 - RNA, 18 nt, Homo sapiens
ucaagacuuccucaugaa

SEQ ID NO: 1534512 - RNA, 17 nt, Homo sapiens
ucaagauucccacuccc

SEQ ID NO: 1534513 - RNA, 14 nt, Homo sapiens
ucaagccaggagac

SEQ ID NO: 1534514 - RNA, 15 nt, Homo sapiens
ucaagugcaauccau

SEQ ID NO: 1534515 - RNA, 18 nt, Homo sapiens
ucaaucuuaacaaaagug

SEQ ID NO: 1534516 - RNA, 22 nt, Homo sapiens
ucaauugcaugaguauuugcua

SEQ ID NO: 1534517 - RNA, 22 nt, Homo sapiens
ucacaaauaaguaauaucuuuc

SEQ ID NO: 1534518 - RNA, 15 nt, Homo sapiens
ucacaacacaaucaa

SEQ ID NO: 1534519 - RNA, 19 nt, Homo sapiens
ucacaauaaaagaaacugu

SEQ ID NO: 1534520 - RNA, 13 nt, Homo sapiens
ucacagaugggca

SEQ ID NO: 1534521 - RNA, 14 nt, Homo sapiens
ucacagaugggcaa

SEQ ID NO: 1534522 - RNA, 21 nt, Homo sapiens
ucacagcaguacuugcucaau

SEQ ID NO: 1534523 - RNA, 18 nt, Homo sapiens
ucaccaagccacugauac

SEQ ID NO: 1534524 - RNA, 16 nt, Homo sapiens
ucaccuggcuucccag

SEQ ID NO: 1534525 - RNA, 14 nt, Homo sapiens
ucacuccacucccc

SEQ ID NO: 1534526 - RNA, 16 nt, Homo sapiens
ucacuguucaugaaua

SEQ ID NO: 1534527 - RNA, 14 nt, Homo sapiens
ucacuuauuucaua

SEQ ID NO: 1534528 - RNA, 14 nt, Homo sapiens
ucacuucgaugacu

SEQ ID NO: 1534529 - RNA, 16 nt, Homo sapiens
ucacuugacuuugcca

SEQ ID NO: 1534530 - RNA, 18 nt, Homo sapiens
ucacuuguuuguguuuga

SEQ ID NO: 1534531 - RNA, 16 nt, Homo sapiens
ucagaaaauccugaca

SEQ ID NO: 1534532 - RNA, 20 nt, Homo sapiens
ucagacaaauguaacacaca

SEQ ID NO: 1534533 - RNA, 15 nt, Homo sapiens
ucagagccaccccua

SEQ ID NO: 1534534 - RNA, 21 nt, Homo sapiens
ucagcaugauguguuguguau

SEQ ID NO: 1534535 - RNA, 18 nt, Homo sapiens
ucagcauucucacuccua

SEQ ID NO: 1534536 - RNA, 20 nt, Homo sapiens
ucagccccacuccacaguua

SEQ ID NO: 1534537 - RNA, 21 nt, Homo sapiens
ucagcuagauuuguguccaca

SEQ ID NO: 1534538 - RNA, 13 nt, Homo sapiens
ucagcuuugccuu

SEQ ID NO: 1534539 - RNA, 13 nt, Homo sapiens
ucaggagaaggcc

SEQ ID NO: 1534540 - RNA, 19 nt, Homo sapiens
ucaggagagaguugaaccu

SEQ ID NO: 1534541 - RNA, 14 nt, Homo sapiens
ucaguaagaucaag

SEQ ID NO: 1534542 - RNA, 13 nt, Homo sapiens
ggccgucuucacu

SEQ ID NO: 1534543 - RNA, 23 nt, Homo sapiens
ggccucaccuggcuucccaggac

SEQ ID NO: 1534544 - RNA, 15 nt, Homo sapiens
ggccucagggaccaa

SEQ ID NO: 1534545 - RNA, 14 nt, Homo sapiens
ggccuggggcugcc

SEQ ID NO: 1534546 - RNA, 15 nt, Homo sapiens
ggccugguccaugau

SEQ ID NO: 1534547 - RNA, 20 nt, Homo sapiens
ggccuguccaccugugcugc

SEQ ID NO: 1534548 - RNA, 18 nt, Homo sapiens
ggccuucuccacagggac

SEQ ID NO: 1534549 - RNA, 20 nt, Homo sapiens
ggcucagccucaaaugcagu

SEQ ID NO: 1534550 - RNA, 19 nt, Homo sapiens
ggcucuaauguacaauaaa

SEQ ID NO: 1534551 - RNA, 13 nt, Homo sapiens
ggcugcugcacug

SEQ ID NO: 1534552 - RNA, 15 nt, Homo sapiens
ggcuguacacugcac

SEQ ID NO: 1534553 - RNA, 12 nt, Homo sapiens
ggcuuccaagaa

SEQ ID NO: 1534554 - RNA, 15 nt, Homo sapiens
ggcuuccuucauuuc

SEQ ID NO: 1534555 - RNA, 16 nt, Homo sapiens
ggcuuggaagggcgcu

SEQ ID NO: 1534556 - RNA, 17 nt, Homo sapiens
ggcuuuaagcgaggcag

SEQ ID NO: 1534557 - RNA, 17 nt, Homo sapiens
ggcuuuccucagcaccu

SEQ ID NO: 1534558 - RNA, 20 nt, Homo sapiens
ggcuuuccucagcaccuggg

SEQ ID NO: 1534559 - RNA, 14 nt, Homo sapiens
gggaaagccaguga

SEQ ID NO: 1534560 - RNA, 22 nt, Homo sapiens
gggaacaaggguggcaucccag

SEQ ID NO: 1534561 - RNA, 13 nt, Homo sapiens
gggaccgccagau

SEQ ID NO: 1534562 - RNA, 13 nt, Homo sapiens
gggacuuggauag

SEQ ID NO: 1534563 - RNA, 15 nt, Homo sapiens
gggagaaaagccaga

SEQ ID NO: 1534564 - RNA, 13 nt, Homo sapiens
gggagcugagggg

SEQ ID NO: 1534565 - RNA, 17 nt, Homo sapiens
gggaggccaagugcagg

SEQ ID NO: 1534566 - RNA, 14 nt, Homo sapiens
gggagucagggagc

SEQ ID NO: 1534567 - RNA, 18 nt, Homo sapiens
gggagugauuuuggccac

SEQ ID NO: 1534568 - RNA, 13 nt, Homo sapiens
gggagugggagag

SEQ ID NO: 1534569 - RNA, 15 nt, Homo sapiens
gggaguguugucaca

SEQ ID NO: 1534570 - RNA, 23 nt, Homo sapiens
gggaucagaguucccaagaaagg

SEQ ID NO: 1534571 - RNA, 16 nt, Homo sapiens
gggauuuuucauucuu

SEQ ID NO: 1534572 - RNA, 21 nt, Homo sapiens
gggcaccaagaccccaaaggg

SEQ ID NO: 1534573 - RNA, 21 nt, Homo sapiens
gggcaggggcugcauccucag

SEQ ID NO: 1534574 - RNA, 15 nt, Homo sapiens
gggcuuacacgugga

SEQ ID NO: 1534575 - RNA, 20 nt, Homo sapiens
gggcuucucgccccucagug

SEQ ID NO: 1534576 - RNA, 13 nt, Homo sapiens
ggggcucccugug

SEQ ID NO: 1534577 - RNA, 13 nt, Homo sapiens
gggggcaagagcu

SEQ ID NO: 1534578 - RNA, 18 nt, Homo sapiens
ggguggcaggugaccuuc

SEQ ID NO: 1534579 - RNA, 19 nt, Homo sapiens
ggguguuaaggcagugacu

SEQ ID NO: 1534580 - RNA, 18 nt, Homo sapiens
gguaacauagaugccugg

SEQ ID NO: 1534581 - RNA, 18 nt, Homo sapiens
gguagagagaaacagcuu

SEQ ID NO: 1534582 - RNA, 23 nt, Homo sapiens
gguaguagaaucucagcacuuug

SEQ ID NO: 1534583 - RNA, 14 nt, Homo sapiens
ggucagugugccac

SEQ ID NO: 1534584 - RNA, 16 nt, Homo sapiens
ggucaucccggggcca

SEQ ID NO: 1534585 - RNA, 22 nt, Homo sapiens
ggucuccaccccucaagccagg

SEQ ID NO: 1534586 - RNA, 18 nt, Homo sapiens
ggugaggcgugggaucca

SEQ ID NO: 1534587 - RNA, 13 nt, Homo sapiens
ggugagguccugu

SEQ ID NO: 1534588 - RNA, 15 nt, Homo sapiens
ggugcccagucuuga

SEQ ID NO: 1534589 - RNA, 22 nt, Homo sapiens
ggugcgaucuuggcucacugca

SEQ ID NO: 1534590 - RNA, 12 nt, Homo sapiens
gguggaaggccu

SEQ ID NO: 1534591 - RNA, 15 nt, Homo sapiens
gguggggcuuggaag

SEQ ID NO: 1534592 - RNA, 18 nt, Homo sapiens
gguguaauuccucccuaa

SEQ ID NO: 1534593 - RNA, 22 nt, Homo sapiens
ggugucauacagauuugcaaag

SEQ ID NO: 1534594 - RNA, 13 nt, Homo sapiens
ggugucuguaauc

SEQ ID NO: 1534595 - RNA, 17 nt, Homo sapiens
gguuaaagaaaggcaga

SEQ ID NO: 1534596 - RNA, 15 nt, Homo sapiens
gguuaagaauguaua

SEQ ID NO: 1534597 - RNA, 15 nt, Homo sapiens
gguuccagacagggu

SEQ ID NO: 1534598 - RNA, 14 nt, Homo sapiens
gguucccccaggac

SEQ ID NO: 1534599 - RNA, 21 nt, Homo sapiens
guaaacaauaaaaguguccau

SEQ ID NO: 1534600 - RNA, 16 nt, Homo sapiens
guaaagaaagcuguaa

SEQ ID NO: 1534601 - RNA, 21 nt, Homo sapiens
guaacccuuuucaugauuuca

SEQ ID NO: 1534602 - RNA, 16 nt, Homo sapiens
guaacucaucugucac

SEQ ID NO: 1534603 - RNA, 12 nt, Homo sapiens
guaaucucugau

SEQ ID NO: 1534604 - RNA, 15 nt, Homo sapiens
guaauuuugcaaaac

SEQ ID NO: 1534605 - RNA, 20 nt, Homo sapiens
guacguuaauuaaacaaauu

SEQ ID NO: 1534606 - RNA, 12 nt, Homo sapiens
guacuaccccag

SEQ ID NO: 1534607 - RNA, 15 nt, Homo sapiens
guacuaccccaggac

SEQ ID NO: 1534608 - RNA, 18 nt, Homo sapiens
guagaaucucagcacuuu

SEQ ID NO: 1534609 - RNA, 18 nt, Homo sapiens
ugccuuuccagugcugcu

SEQ ID NO: 1534610 - RNA, 15 nt, Homo sapiens
ugcguaaaucaacuu

SEQ ID NO: 1534611 - RNA, 15 nt, Homo sapiens
ugcgucccacugagu

SEQ ID NO: 1534612 - RNA, 16 nt, Homo sapiens
ugcuacucuaguauuc

SEQ ID NO: 1534613 - RNA, 16 nt, Homo sapiens
ugcucccuagccagag

SEQ ID NO: 1534614 - RNA, 20 nt, Homo sapiens
ugcucccuagccagaggcuc

SEQ ID NO: 1534615 - RNA, 17 nt, Homo sapiens
ugcuccucugccugugc

SEQ ID NO: 1534616 - RNA, 18 nt, Homo sapiens
ugcucuguuuugcaugga

SEQ ID NO: 1534617 - RNA, 19 nt, Homo sapiens
ugcugacagauguuccauc

SEQ ID NO: 1534618 - RNA, 16 nt, Homo sapiens
ugcuguaaaagugaau

SEQ ID NO: 1534619 - RNA, 13 nt, Homo sapiens
ugcuguuucuaca

SEQ ID NO: 1534620 - RNA, 18 nt, Homo sapiens
ugcuuaguaucucaucaa

SEQ ID NO: 1534621 - RNA, 15 nt, Homo sapiens
ugcuucaggauacca

SEQ ID NO: 1534622 - RNA, 16 nt, Homo sapiens
ugcuucaguacuugug

SEQ ID NO: 1534623 - RNA, 13 nt, Homo sapiens
uggaaacugucaa

SEQ ID NO: 1534624 - RNA, 20 nt, Homo sapiens
uggaaauaacugagcacuuu

SEQ ID NO: 1534625 - RNA, 19 nt, Homo sapiens
uggaaauccuguuacuuaa

SEQ ID NO: 1534626 - RNA, 18 nt, Homo sapiens
uggaacucagcugucugu

SEQ ID NO: 1534627 - RNA, 23 nt, Homo sapiens
uggaagagagaaagcauauugac

SEQ ID NO: 1534628 - RNA, 13 nt, Homo sapiens
uggacgcaugcag

SEQ ID NO: 1534629 - RNA, 19 nt, Homo sapiens
uggacuauccucuuuggaa

SEQ ID NO: 1534630 - RNA, 13 nt, Homo sapiens
uggaggugaugaa

SEQ ID NO: 1534631 - RNA, 15 nt, Homo sapiens
uggaguccuguucuc

SEQ ID NO: 1534632 - RNA, 14 nt, Homo sapiens
uggaucaaguauua

SEQ ID NO: 1534633 - RNA, 23 nt, Homo sapiens
uggaugugguuuaauuguuuguc

SEQ ID NO: 1534634 - RNA, 22 nt, Homo sapiens
uggcagcaacaaaggauuugaa

SEQ ID NO: 1534635 - RNA, 15 nt, Homo sapiens
uggcagcugucucaa

SEQ ID NO: 1534636 - RNA, 21 nt, Homo sapiens
uggcagguggccagggcucca

SEQ ID NO: 1534637 - RNA, 17 nt, Homo sapiens
uggcagugagaugucag

SEQ ID NO: 1534638 - RNA, 16 nt, Homo sapiens
uggcaucccaguggcc

SEQ ID NO: 1534639 - RNA, 14 nt, Homo sapiens
uggcaucuaucugg

SEQ ID NO: 1534640 - RNA, 19 nt, Homo sapiens
uggccacauccaacauuuc

SEQ ID NO: 1534641 - RNA, 12 nt, Homo sapiens
uggccacucugc

SEQ ID NO: 1534642 - RNA, 14 nt, Homo sapiens
uggccccaaauguu

SEQ ID NO: 1534643 - RNA, 19 nt, Homo sapiens
uggcccucuuugaaagggc

SEQ ID NO: 1534644 - RNA, 12 nt, Homo sapiens
uggcccuguuaa

SEQ ID NO: 1534645 - RNA, 23 nt, Homo sapiens
uggccucagcaucucauaacuca

SEQ ID NO: 1534646 - RNA, 23 nt, Homo sapiens
uggccuguguggugccacccugc

SEQ ID NO: 1534647 - RNA, 17 nt, Homo sapiens
uggcuagucacauauca

SEQ ID NO: 1534648 - RNA, 12 nt, Homo sapiens
uggcuagucaua

SEQ ID NO: 1534649 - RNA, 16 nt, Homo sapiens
uggcuagucauaaccu

SEQ ID NO: 1534650 - RNA, 13 nt, Homo sapiens
uggcucacagcca

SEQ ID NO: 1534651 - RNA, 16 nt, Homo sapiens
uggcucgggacuucaa

SEQ ID NO: 1534652 - RNA, 15 nt, Homo sapiens
uggcugcaagugguu

SEQ ID NO: 1534653 - RNA, 14 nt, Homo sapiens
uggcugccuuagaa

SEQ ID NO: 1534654 - RNA, 11 nt, Homo sapiens
ugggaugcuac

SEQ ID NO: 1534655 - RNA, 19 nt, Homo sapiens
ugggcagcuggcucugaau

SEQ ID NO: 1534656 - RNA, 16 nt, Homo sapiens
ugggccaagccagggu

SEQ ID NO: 1534657 - RNA, 18 nt, Homo sapiens
ugggccaagccaggguuc

SEQ ID NO: 1534658 - RNA, 20 nt, Homo sapiens
ugggccaagccaggguucca

SEQ ID NO: 1534659 - RNA, 17 nt, Homo sapiens
ugggcccgaggguccca

SEQ ID NO: 1534660 - RNA, 23 nt, Homo sapiens
ugggcccugguucccccaggacc

SEQ ID NO: 1534661 - RNA, 20 nt, Homo sapiens
ugggcucuggguucgggaag

SEQ ID NO: 1534662 - RNA, 18 nt, Homo sapiens
uggggagggagguguuua

SEQ ID NO: 1534663 - RNA, 19 nt, Homo sapiens
uggggagggagguguuuaa

SEQ ID NO: 1534664 - RNA, 22 nt, Homo sapiens
uggggccacacguuugccaaau

SEQ ID NO: 1534665 - RNA, 16 nt, Homo sapiens
ucaguagugccuguga

SEQ ID NO: 1534666 - RNA, 17 nt, Homo sapiens
ucagugaagcccaggag

SEQ ID NO: 1534667 - RNA, 15 nt, Homo sapiens
ucaguuucacauauu

SEQ ID NO: 1534668 - RNA, 19 nt, Homo sapiens
ucaguuucacauauuugua

SEQ ID NO: 1534669 - RNA, 12 nt, Homo sapiens
ucaguuugcuaa

SEQ ID NO: 1534670 - RNA, 14 nt, Homo sapiens
ucauaaaaauaacc

SEQ ID NO: 1534671 - RNA, 19 nt, Homo sapiens
ucauaauuuaaaaagucaa

SEQ ID NO: 1534672 - RNA, 15 nt, Homo sapiens
ucauacagauuugca

SEQ ID NO: 1534673 - RNA, 23 nt, Homo sapiens
ucauacucuguguaaucucugau

SEQ ID NO: 1534674 - RNA, 15 nt, Homo sapiens
ucauaggaagacaca

SEQ ID NO: 1534675 - RNA, 15 nt, Homo sapiens
ucauccuccacugaa

SEQ ID NO: 1534676 - RNA, 11 nt, Homo sapiens
ucaugauuuca

SEQ ID NO: 1534677 - RNA, 15 nt, Homo sapiens
ucauggcagucccaa

SEQ ID NO: 1534678 - RNA, 13 nt, Homo sapiens
ucauguucuugca

SEQ ID NO: 1534679 - RNA, 22 nt, Homo sapiens
ucauugaagacccucaaugcca

SEQ ID NO: 1534680 - RNA, 18 nt, Homo sapiens
ucauugggccauguuuaa

SEQ ID NO: 1534681 - RNA, 17 nt, Homo sapiens
ucauuuauaaaaccauc

SEQ ID NO: 1534682 - RNA, 20 nt, Homo sapiens
ucauuuauuuacaugugauu

SEQ ID NO: 1534683 - RNA, 19 nt, Homo sapiens
uccaagcugcucauuucac

SEQ ID NO: 1534684 - RNA, 21 nt, Homo sapiens
uccaaggcaaauguccaagca

SEQ ID NO: 1534685 - RNA, 14 nt, Homo sapiens
uccaaggguuuuca

SEQ ID NO: 1534686 - RNA, 18 nt, Homo sapiens
uccaaugugcccagucau

SEQ ID NO: 1534687 - RNA, 15 nt, Homo sapiens
uccacaaauguccuc

SEQ ID NO: 1534688 - RNA, 15 nt, Homo sapiens
uccacacaggcccau

SEQ ID NO: 1534689 - RNA, 17 nt, Homo sapiens
uccacaguuaggccaag

SEQ ID NO: 1534690 - RNA, 22 nt, Homo sapiens
uccacuaggugcccagucuuga

SEQ ID NO: 1534691 - RNA, 11 nt, Homo sapiens
uccacuuagaa

SEQ ID NO: 1534692 - RNA, 15 nt, Homo sapiens
uccagaacugucuua

SEQ ID NO: 1534693 - RNA, 16 nt, Homo sapiens
uccagaggguugugau

SEQ ID NO: 1534694 - RNA, 19 nt, Homo sapiens
uccagaguaggugggucuu

SEQ ID NO: 1534695 - RNA, 21 nt, Homo sapiens
uccagaguaggugggucuugg

SEQ ID NO: 1534696 - RNA, 22 nt, Homo sapiens
uccagccacuuauuuccaugga

SEQ ID NO: 1534697 - RNA, 18 nt, Homo sapiens
uccagcuaagccugauga

SEQ ID NO: 1534698 - RNA, 14 nt, Homo sapiens
uccaguucugauga

SEQ ID NO: 1534699 - RNA, 15 nt, Homo sapiens
uccaguucugaugag

SEQ ID NO: 1534700 - RNA, 12 nt, Homo sapiens
uccauauaguuu

SEQ ID NO: 1534701 - RNA, 18 nt, Homo sapiens
uccaugaaaaacagcaga

SEQ ID NO: 1534702 - RNA, 12 nt, Homo sapiens
uccaugugaaau

SEQ ID NO: 1534703 - RNA, 16 nt, Homo sapiens
ucccacaggcccuucc

SEQ ID NO: 1534704 - RNA, 12 nt, Homo sapiens
ucccaccacagc

SEQ ID NO: 1534705 - RNA, 21 nt, Homo sapiens
ucccacugccccugcaccugc

SEQ ID NO: 1534706 - RNA, 15 nt, Homo sapiens
ucccagcccacucau

SEQ ID NO: 1534707 - RNA, 17 nt, Homo sapiens
ucccaggacgcagggag

SEQ ID NO: 1534708 - RNA, 18 nt, Homo sapiens
ucccaugguagacuguga

SEQ ID NO: 1534709 - RNA, 16 nt, Homo sapiens
uccccaacgaaaagca

SEQ ID NO: 1534710 - RNA, 21 nt, Homo sapiens
uccccaauccaacccaugcau

SEQ ID NO: 1534711 - RNA, 13 nt, Homo sapiens
uccccauggugca

SEQ ID NO: 1534712 - RNA, 21 nt, Homo sapiens
uccccucauccacuaggugcc

SEQ ID NO: 1534713 - RNA, 18 nt, Homo sapiens
uccccuccccucacuucu

SEQ ID NO: 1534714 - RNA, 22 nt, Homo sapiens
ucccgaacacgcacagaaggaa

SEQ ID NO: 1534715 - RNA, 14 nt, Homo sapiens
ucccgcaugcugcc

SEQ ID NO: 1534716 - RNA, 20 nt, Homo sapiens
ucccuagccagaggcucuaa

SEQ ID NO: 1534717 - RNA, 11 nt, Homo sapiens
ucccuccacuc

SEQ ID NO: 1534718 - RNA, 23 nt, Homo sapiens
ucccuccagccaauaggcagcuu

SEQ ID NO: 1534719 - RNA, 17 nt, Homo sapiens
ucccucucucuggaaag

SEQ ID NO: 1534720 - RNA, 16 nt, Homo sapiens
ucccugcaaacauggg

SEQ ID NO: 1534721 - RNA, 19 nt, Homo sapiens
ucccuggaaauaacugagc

SEQ ID NO: 1534722 - RNA, 18 nt, Homo sapiens
ucccuggcauuguuucca

SEQ ID NO: 1534723 - RNA, 16 nt, Homo sapiens
ucccuguucuuugaag

SEQ ID NO: 1534724 - RNA, 20 nt, Homo sapiens
ucccuuuaucauguguuucu

SEQ ID NO: 1534725 - RNA, 20 nt, Homo sapiens
ucccuuuuuaaacaaauggc

SEQ ID NO: 1534726 - RNA, 18 nt, Homo sapiens
accuccccuccuugccuc

SEQ ID NO: 1534727 - RNA, 17 nt, Homo sapiens
accucucacacuggcuc

SEQ ID NO: 1534728 - RNA, 11 nt, Homo sapiens
accucuuguuu

SEQ ID NO: 1534729 - RNA, 21 nt, Homo sapiens
accuguauugucugacuucuc

SEQ ID NO: 1534730 - RNA, 11 nt, Homo sapiens
accugugauga

SEQ ID NO: 1534731 - RNA, 15 nt, Homo sapiens
accuuaaaauuagca

SEQ ID NO: 1534732 - RNA, 13 nt, Homo sapiens
accuuccauguca

SEQ ID NO: 1534733 - RNA, 23 nt, Homo sapiens
accuuccugggcagcccagagag

SEQ ID NO: 1534734 - RNA, 15 nt, Homo sapiens
accuugagacagcuu

SEQ ID NO: 1534735 - RNA, 14 nt, Homo sapiens
accuugcucugcca

SEQ ID NO: 1534736 - RNA, 14 nt, Homo sapiens
acgaagaccccagg

SEQ ID NO: 1534737 - RNA, 16 nt, Homo sapiens
acgcaaauacaugccu

SEQ ID NO: 1534738 - RNA, 13 nt, Homo sapiens
acgccuccccaau

SEQ ID NO: 1534739 - RNA, 12 nt, Homo sapiens
acggcacugugg

SEQ ID NO: 1534740 - RNA, 20 nt, Homo sapiens
acgguggcucacgccuguaa

SEQ ID NO: 1534741 - RNA, 19 nt, Homo sapiens
acgugaauagcgcccucaa

SEQ ID NO: 1534742 - RNA, 17 nt, Homo sapiens
acgugcacacaccugca

SEQ ID NO: 1534743 - RNA, 19 nt, Homo sapiens
acguguuuuuguaucuuua

SEQ ID NO: 1534744 - RNA, 15 nt, Homo sapiens
acuaaaccauugugc

SEQ ID NO: 1534745 - RNA, 19 nt, Homo sapiens
acuaaaccauugugcauuc

SEQ ID NO: 1534746 - RNA, 21 nt, Homo sapiens
acuacaugcacuuggcugcau

SEQ ID NO: 1534747 - RNA, 20 nt, Homo sapiens
acuaccccaggacgcaugca

SEQ ID NO: 1534748 - RNA, 15 nt, Homo sapiens
acuauaaacauuaaa

SEQ ID NO: 1534749 - RNA, 19 nt, Homo sapiens
acuaugcaccuauaaauac

SEQ ID NO: 1534750 - RNA, 23 nt, Homo sapiens
acucagccuuaagaaagcuauau

SEQ ID NO: 1534751 - RNA, 16 nt, Homo sapiens
acucaugugauuuacc

SEQ ID NO: 1534752 - RNA, 20 nt, Homo sapiens
acucauuugcuuugucuccc

SEQ ID NO: 1534753 - RNA, 13 nt, Homo sapiens
acucccugcuuag

SEQ ID NO: 1534754 - RNA, 14 nt, Homo sapiens
acucuacacuguga

SEQ ID NO: 1534755 - RNA, 18 nt, Homo sapiens
acucugacuguaaaauac

SEQ ID NO: 1534756 - RNA, 14 nt, Homo sapiens
acucuggcagccuc

SEQ ID NO: 1534757 - RNA, 20 nt, Homo sapiens
acucuguguaaucucugauu

SEQ ID NO: 1534758 - RNA, 15 nt, Homo sapiens
acucuguuccuggcu

SEQ ID NO: 1534759 - RNA, 21 nt, Homo sapiens
acucuucugagcaccuacuua

SEQ ID NO: 1534760 - RNA, 22 nt, Homo sapiens
acucuucugagcaccuacuuac

SEQ ID NO: 1534761 - RNA, 14 nt, Homo sapiens
acugaaggcuuuca

SEQ ID NO: 1534762 - RNA, 13 nt, Homo sapiens
acugagcacuuug

SEQ ID NO: 1534763 - RNA, 14 nt, Homo sapiens
acugagcacuuuga

SEQ ID NO: 1534764 - RNA, 16 nt, Homo sapiens
acugauuaacucaguc

SEQ ID NO: 1534765 - RNA, 20 nt, Homo sapiens
acugcacacaugguuuccaa

SEQ ID NO: 1534766 - RNA, 20 nt, Homo sapiens
acugcagucaccccugucug

SEQ ID NO: 1534767 - RNA, 13 nt, Homo sapiens
acugccccugcac

SEQ ID NO: 1534768 - RNA, 16 nt, Homo sapiens
acuggcccaccccucu

SEQ ID NO: 1534769 - RNA, 13 nt, Homo sapiens
acugguccaggca

SEQ ID NO: 1534770 - RNA, 14 nt, Homo sapiens
acuguaaaauacau

SEQ ID NO: 1534771 - RNA, 14 nt, Homo sapiens
acuguaucuaaaaa

SEQ ID NO: 1534772 - RNA, 21 nt, Homo sapiens
acugugucccucucucuggaa

SEQ ID NO: 1534773 - RNA, 21 nt, Homo sapiens
acuguuaaauaaggccucauc

SEQ ID NO: 1534774 - RNA, 22 nt, Homo sapiens
acuuagaaauugcauuuccuga

SEQ ID NO: 1534775 - RNA, 13 nt, Homo sapiens
acuuaugcugcug

SEQ ID NO: 1534776 - RNA, 21 nt, Homo sapiens
acuuauuucagguuaaauuaa

SEQ ID NO: 1534777 - RNA, 16 nt, Homo sapiens
acuuauuuccauggau

SEQ ID NO: 1534778 - RNA, 16 nt, Homo sapiens
acuucaaaauauugag

SEQ ID NO: 1534779 - RNA, 22 nt, Homo sapiens
acuucaguggugagacuguauc

SEQ ID NO: 1534780 - RNA, 17 nt, Homo sapiens
acuucaugccagcuaua

SEQ ID NO: 1534781 - RNA, 23 nt, Homo sapiens
acuucugaagggccccuugcaaa

SEQ ID NO: 1534782 - RNA, 17 nt, Homo sapiens
acuucugaccacacuuc

SEQ ID NO: 1534783 - RNA, 20 nt, Homo sapiens
acuucuguguugugauuccc

SEQ ID NO: 1534784 - RNA, 15 nt, Homo sapiens
acuugcaagucccau

SEQ ID NO: 1534785 - RNA, 17 nt, Homo sapiens
acuugcaugcagcagcu

SEQ ID NO: 1534786 - RNA, 22 nt, Homo sapiens
acuugcaugcagcagcuuuuga

SEQ ID NO: 1534787 - RNA, 17 nt, Homo sapiens
acuugugaaacacagcu

SEQ ID NO: 1534788 - RNA, 13 nt, Homo sapiens
acuuuaccaugcu

SEQ ID NO: 1534789 - RNA, 15 nt, Homo sapiens
acuuuaccucucugu

SEQ ID NO: 1534790 - RNA, 22 nt, Homo sapiens
acuuuagguaguagaaucucag

SEQ ID NO: 1534791 - RNA, 20 nt, Homo sapiens
acuuuauguuacuacaugca

SEQ ID NO: 1534792 - RNA, 18 nt, Homo sapiens
acuuucauucccuuucau

SEQ ID NO: 1534793 - RNA, 15 nt, Homo sapiens
acuuugccacuggau

SEQ ID NO: 1534794 - RNA, 15 nt, Homo sapiens
acuuuggaucaggaa

SEQ ID NO: 1534795 - RNA, 13 nt, Homo sapiens
agaaaaaccaaug

SEQ ID NO: 1534796 - RNA, 16 nt, Homo sapiens
agaaaaguauuuccaa

SEQ ID NO: 1534797 - RNA, 18 nt, Homo sapiens
agaaaagugggccagugu

SEQ ID NO: 1534798 - RNA, 20 nt, Homo sapiens
agaaacccccucauggaucu

SEQ ID NO: 1534799 - RNA, 16 nt, Homo sapiens
agaaagauucaauuaa

SEQ ID NO: 1534800 - RNA, 22 nt, Homo sapiens
agaaagguaaacaaacaaauaa

SEQ ID NO: 1534801 - RNA, 23 nt, Homo sapiens
agaaagugagcaguguuagcuua

SEQ ID NO: 1534802 - RNA, 18 nt, Homo sapiens
agaaauaaaauauggacu

SEQ ID NO: 1534803 - RNA, 15 nt, Homo sapiens
agaaauaauacccug

SEQ ID NO: 1534804 - RNA, 13 nt, Homo sapiens
agaaauccuagug

SEQ ID NO: 1534805 - RNA, 19 nt, Homo sapiens
agaaauuaugaaaguuaau

SEQ ID NO: 1534806 - RNA, 19 nt, Homo sapiens
agaacagggaugcuaucuc

SEQ ID NO: 1534807 - RNA, 20 nt, Homo sapiens
agaacauggacuacacacaa

SEQ ID NO: 1534808 - RNA, 12 nt, Homo sapiens
agaaccaaagca

SEQ ID NO: 1534809 - RNA, 21 nt, Homo sapiens
agaaccugaaagggcauuuug

SEQ ID NO: 1534810 - RNA, 14 nt, Homo sapiens
agaacgcaugcagg

SEQ ID NO: 1534811 - RNA, 21 nt, Homo sapiens
agaacuucguacccuuugcac

SEQ ID NO: 1534812 - RNA, 16 nt, Homo sapiens
agaacuugucccucag

SEQ ID NO: 1534813 - RNA, 14 nt, Homo sapiens
agaagacacguguu

SEQ ID NO: 1534814 - RNA, 20 nt, Homo sapiens
agaaggaaaugugggguaga

SEQ ID NO: 1534815 - RNA, 18 nt, Homo sapiens
agaauacaguaagcugcu

SEQ ID NO: 1534816 - RNA, 12 nt, Homo sapiens
agaaucaagucu

SEQ ID NO: 1534817 - RNA, 14 nt, Homo sapiens
agaaucaagucugu

SEQ ID NO: 1534818 - RNA, 21 nt, Homo sapiens
agaaucaccuaauuaauuuca

SEQ ID NO: 1534819 - RNA, 17 nt, Homo sapiens
agaaucacuugacuuug

SEQ ID NO: 1534820 - RNA, 21 nt, Homo sapiens
agaaucacuugacuuugccac

SEQ ID NO: 1534821 - RNA, 16 nt, Homo sapiens
agaaucucagcacuuu

SEQ ID NO: 1534822 - RNA, 15 nt, Homo sapiens
agaaucuugaggaac

SEQ ID NO: 1534823 - RNA, 11 nt, Homo sapiens
agaaugcagua

SEQ ID NO: 1534824 - RNA, 21 nt, Homo sapiens
agaauggggcuuccauggugg

SEQ ID NO: 1534825 - RNA, 16 nt, Homo sapiens
agaauggugggcucca

SEQ ID NO: 1534826 - RNA, 21 nt, Homo sapiens
agaauguuacuuuggaaugac

SEQ ID NO: 1534827 - RNA, 18 nt, Homo sapiens
agaauuuuaauauugcca

SEQ ID NO: 1534828 - RNA, 15 nt, Homo sapiens
agacaaaacuagaga

SEQ ID NO: 1534829 - RNA, 19 nt, Homo sapiens
agacaaaauugaugaucca

SEQ ID NO: 1534830 - RNA, 22 nt, Homo sapiens
agacaagaaauccuaguggccu

SEQ ID NO: 1534831 - RNA, 13 nt, Homo sapiens
agacauaccucuc

SEQ ID NO: 1534832 - RNA, 19 nt, Homo sapiens
agacauaccucucaacuua

SEQ ID NO: 1534833 - RNA, 22 nt, Homo sapiens
agacauugugcuagugcuuuua

SEQ ID NO: 1534834 - RNA, 15 nt, Homo sapiens
agacccucaaugcca

SEQ ID NO: 1534835 - RNA, 12 nt, Homo sapiens
agacccucagac

SEQ ID NO: 1534836 - RNA, 14 nt, Homo sapiens
agaccgaaucucac

SEQ ID NO: 1534837 - RNA, 12 nt, Homo sapiens
agaccuuggcau

SEQ ID NO: 1534838 - RNA, 21 nt, Homo sapiens
agacuaugugucaugauuuca

SEQ ID NO: 1534839 - RNA, 18 nt, Homo sapiens
agacucacuaaauccuuu

SEQ ID NO: 1534840 - RNA, 15 nt, Homo sapiens
agacucacuguggga

SEQ ID NO: 1534841 - RNA, 13 nt, Homo sapiens
agacugaauuuaa

SEQ ID NO: 1534842 - RNA, 16 nt, Homo sapiens
agacuggauacugccc

SEQ ID NO: 1534843 - RNA, 21 nt, Homo sapiens
agacuggguuccucuccaagc

SEQ ID NO: 1534844 - RNA, 11 nt, Homo sapiens
agacuguaaau

SEQ ID NO: 1534845 - RNA, 18 nt, Homo sapiens
agacuuagccccaugagu

SEQ ID NO: 1534846 - RNA, 22 nt, Homo sapiens
agacuugaugaauaaacacuuu

SEQ ID NO: 1534847 - RNA, 12 nt, Homo sapiens
agagaaaggagg

SEQ ID NO: 1534848 - RNA, 18 nt, Homo sapiens
agagaaauaaaacuccuu

SEQ ID NO: 1534849 - RNA, 20 nt, Homo sapiens
agagaaccaugaaaacaaug

SEQ ID NO: 1534850 - RNA, 19 nt, Homo sapiens
agagacccccgugccaaau

SEQ ID NO: 1534851 - RNA, 18 nt, Homo sapiens
agagagaaacagcuugau

SEQ ID NO: 1534852 - RNA, 16 nt, Homo sapiens
agagagauauaucuga

SEQ ID NO: 1534853 - RNA, 15 nt, Homo sapiens
agagaguauggugcu

SEQ ID NO: 1534854 - RNA, 13 nt, Homo sapiens
agagaguggcucc

SEQ ID NO: 1534855 - RNA, 23 nt, Homo sapiens
agagaucuaaucccuucaaggaa

SEQ ID NO: 1534856 - RNA, 17 nt, Homo sapiens
agagauuagcaugaaag

SEQ ID NO: 1534857 - RNA, 18 nt, Homo sapiens
auucaggcuugcauuaaa

SEQ ID NO: 1534858 - RNA, 20 nt, Homo sapiens
auucaguuucuaaaauugag

SEQ ID NO: 1534859 - RNA, 15 nt, Homo sapiens
auucauaaaaauaac

SEQ ID NO: 1534860 - RNA, 22 nt, Homo sapiens
auucauucccuucucucagccu

SEQ ID NO: 1534861 - RNA, 16 nt, Homo sapiens
auucauuuugcaacuu

SEQ ID NO: 1534862 - RNA, 22 nt, Homo sapiens
auucguccuuagaauacuguau

SEQ ID NO: 1534863 - RNA, 18 nt, Homo sapiens
auucuagagugcauauau

SEQ ID NO: 1534864 - RNA, 21 nt, Homo sapiens
auucuauuucaacuucaggaa

SEQ ID NO: 1534865 - RNA, 15 nt, Homo sapiens
auucucaguuuaaaa

SEQ ID NO: 1534866 - RNA, 21 nt, Homo sapiens
auucuucaagaucccauuuga

SEQ ID NO: 1534867 - RNA, 20 nt, Homo sapiens
auugacaagcacgcacacac

SEQ ID NO: 1534868 - RNA, 19 nt, Homo sapiens
auugagcagaauucauuca

SEQ ID NO: 1534869 - RNA, 13 nt, Homo sapiens
auugaugauccau

SEQ ID NO: 1534870 - RNA, 21 nt, Homo sapiens
auugcaaaagguuaagccaua

SEQ ID NO: 1534871 - RNA, 17 nt, Homo sapiens
auugcccuuuaacaaga

SEQ ID NO: 1534872 - RNA, 22 nt, Homo sapiens
auugcugccuaaagaaacucag

SEQ ID NO: 1534873 - RNA, 23 nt, Homo sapiens
auuguauaaaacaguguuuccag

SEQ ID NO: 1534874 - RNA, 22 nt, Homo sapiens
auugugguuuauugaaugugau

SEQ ID NO: 1534875 - RNA, 15 nt, Homo sapiens
auuguucacuucuuu

SEQ ID NO: 1534876 - RNA, 14 nt, Homo sapiens
auuuacaugugauu

SEQ ID NO: 1534877 - RNA, 14 nt, Homo sapiens
auuuaugagcucuu

SEQ ID NO: 1534878 - RNA, 15 nt, Homo sapiens
auuuaugagcucuuc

SEQ ID NO: 1534879 - RNA, 15 nt, Homo sapiens
auuuauuuuguauga

SEQ ID NO: 1534880 - RNA, 15 nt, Homo sapiens
auuucaucuuuccaa

SEQ ID NO: 1534881 - RNA, 13 nt, Homo sapiens
auuucccuaaaaa

SEQ ID NO: 1534882 - RNA, 19 nt, Homo sapiens
auuuccuccgucaccucag

SEQ ID NO: 1534883 - RNA, 22 nt, Homo sapiens
auuucucccuucaauccuguca

SEQ ID NO: 1534884 - RNA, 18 nt, Homo sapiens
auuugagugucuuugacu

SEQ ID NO: 1534885 - RNA, 15 nt, Homo sapiens
auuugcauacauucu

SEQ ID NO: 1534886 - RNA, 20 nt, Homo sapiens
auuugggggacuuacaugau

SEQ ID NO: 1534887 - RNA, 19 nt, Homo sapiens
auuugugugaaaaugugac

SEQ ID NO: 1534888 - RNA, 15 nt, Homo sapiens
auuuuaaacuacuga

SEQ ID NO: 1534889 - RNA, 14 nt, Homo sapiens
auuuuaauuauaau

SEQ ID NO: 1534890 - RNA, 16 nt, Homo sapiens
auuuuacuuugugcaa

SEQ ID NO: 1534891 - RNA, 13 nt, Homo sapiens
auuuuagacuuuu

SEQ ID NO: 1534892 - RNA, 20 nt, Homo sapiens
auuuuaucuugguaguacau

SEQ ID NO: 1534893 - RNA, 16 nt, Homo sapiens
auuuuauuucucucag

SEQ ID NO: 1534894 - RNA, 19 nt, Homo sapiens
auuuuauuuuuaucccauc

SEQ ID NO: 1534895 - RNA, 16 nt, Homo sapiens
auuuucaagcaaauau

SEQ ID NO: 1534896 - RNA, 13 nt, Homo sapiens
auuuucaccucca

SEQ ID NO: 1534897 - RNA, 22 nt, Homo sapiens
auuuucucucacugaugcccuu

SEQ ID NO: 1534898 - RNA, 15 nt, Homo sapiens
auuuuggacguguga

SEQ ID NO: 1534899 - RNA, 16 nt, Homo sapiens
auuuuggacgugugag

SEQ ID NO: 1534900 - RNA, 18 nt, Homo sapiens
auuuuggccacacuguca

SEQ ID NO: 1534901 - RNA, 23 nt, Homo sapiens
auuuugucugcuuaguaucucau

SEQ ID NO: 1534902 - RNA, 14 nt, Homo sapiens
auuuuucuguuacc

SEQ ID NO: 1534903 - RNA, 13 nt, Homo sapiens
auuuuuggaagag

SEQ ID NO: 1534904 - RNA, 21 nt, Homo sapiens
auuuuuuuuuuuuuccuguca

SEQ ID NO: 1534905 - RNA, 23 nt, Homo sapiens
caaaaaagccccagcccauuccu

SEQ ID NO: 1534906 - RNA, 14 nt, Homo sapiens
caaaaauauuccau

SEQ ID NO: 1534907 - RNA, 13 nt, Homo sapiens
caaaaaucaucaa

SEQ ID NO: 1534908 - RNA, 12 nt, Homo sapiens
caaaacauaucu

SEQ ID NO: 1534909 - RNA, 13 nt, Homo sapiens
caaaacauaucuu

SEQ ID NO: 1534910 - RNA, 15 nt, Homo sapiens
caaaagggacacaua

SEQ ID NO: 1534911 - RNA, 17 nt, Homo sapiens
caaaagguuaagccaua

SEQ ID NO: 1534912 - RNA, 18 nt, Homo sapiens
caaacaaaaugaugggaa

SEQ ID NO: 1534913 - RNA, 15 nt, Homo sapiens
caaacaaacaaaaac

SEQ ID NO: 1534914 - RNA, 16 nt, Homo sapiens
caaacacacagacucu

SEQ ID NO: 1534915 - RNA, 20 nt, Homo sapiens
caaacccauuuccagcuccu

SEQ ID NO: 1534916 - RNA, 18 nt, Homo sapiens
caaaggcuuucuuuccaa

SEQ ID NO: 1534917 - RNA, 20 nt, Homo sapiens
caaaguuuuaaaccuguuaa

SEQ ID NO: 1534918 - RNA, 14 nt, Homo sapiens
caaauacaugccuu

SEQ ID NO: 1534919 - RNA, 16 nt, Homo sapiens
caaauaucuugaaagg

SEQ ID NO: 1534920 - RNA, 17 nt, Homo sapiens
caaaugauuuacacuga

SEQ ID NO: 1534921 - RNA, 11 nt, Homo sapiens
caaaugcauga

SEQ ID NO: 1534922 - RNA, 20 nt, Homo sapiens
caaaugcaugauauuguaug

SEQ ID NO: 1534923 - RNA, 17 nt, Homo sapiens
caaaugcuacucaguau

SEQ ID NO: 1534924 - RNA, 13 nt, Homo sapiens
caaauguccaagc

SEQ ID NO: 1534925 - RNA, 20 nt, Homo sapiens
caaauuauauuugugugaaa

SEQ ID NO: 1534926 - RNA, 16 nt, Homo sapiens
caaauuauucuaguca

SEQ ID NO: 1534927 - RNA, 17 nt, Homo sapiens
caacagcugugugugcc

SEQ ID NO: 1534928 - RNA, 17 nt, Homo sapiens
caacaugguuaccucug

SEQ ID NO: 1534929 - RNA, 17 nt, Homo sapiens
caaccauagaacugucc

SEQ ID NO: 1534930 - RNA, 14 nt, Homo sapiens
caacccugugaucu

SEQ ID NO: 1534931 - RNA, 17 nt, Homo sapiens
caaccuaggagcagugg

SEQ ID NO: 1534932 - RNA, 19 nt, Homo sapiens
caaccucggggagugccac

SEQ ID NO: 1534933 - RNA, 21 nt, Homo sapiens
caaccucggggagugccacuu

SEQ ID NO: 1534934 - RNA, 14 nt, Homo sapiens
caaccugugaugag

SEQ ID NO: 1534935 - RNA, 15 nt, Homo sapiens
caaccuugugugagu

SEQ ID NO: 1534936 - RNA, 18 nt, Homo sapiens
caacucacgggugcauga

SEQ ID NO: 1534937 - RNA, 14 nt, Homo sapiens
caacuccaggguua

SEQ ID NO: 1534938 - RNA, 23 nt, Homo sapiens
caacuguuuuugaagaagggaaa

SEQ ID NO: 1534939 - RNA, 21 nt, Homo sapiens
caacuugaaauuauaucugug

SEQ ID NO: 1534940 - RNA, 16 nt, Homo sapiens
caacuugucacaaagu

SEQ ID NO: 1534941 - RNA, 13 nt, Homo sapiens
caacuuuccagac

SEQ ID NO: 1534942 - RNA, 20 nt, Homo sapiens
caagaagugggagugggaga

SEQ ID NO: 1534943 - RNA, 23 nt, Homo sapiens
caagaauagaugcugacuguacu

SEQ ID NO: 1534944 - RNA, 13 nt, Homo sapiens
caagaaugcagua

SEQ ID NO: 1534945 - RNA, 15 nt, Homo sapiens
caagaccccaaaggg

SEQ ID NO: 1534946 - RNA, 22 nt, Homo sapiens
caagauacacucaagcaugaag

SEQ ID NO: 1534947 - RNA, 17 nt, Homo sapiens
caagauccugucuugcu

SEQ ID NO: 1534948 - RNA, 15 nt, Homo sapiens
caagcagagugcaca

SEQ ID NO: 1534949 - RNA, 18 nt, Homo sapiens
caagccuggcccagugag

SEQ ID NO: 1534950 - RNA, 20 nt, Homo sapiens
caagccuuggaccaaaugga

SEQ ID NO: 1534951 - RNA, 19 nt, Homo sapiens
caagcucacccugcuccua

SEQ ID NO: 1534952 - RNA, 15 nt, Homo sapiens
caaggccccagagac

SEQ ID NO: 1534953 - RNA, 15 nt, Homo sapiens
caagggacugggggu

SEQ ID NO: 1534954 - RNA, 12 nt, Homo sapiens
caagguuuacau

SEQ ID NO: 1534955 - RNA, 23 nt, Homo sapiens
caagugguuaagaauguauauca

SEQ ID NO: 1534956 - RNA, 19 nt, Homo sapiens
caauaaaaguguccauuga

SEQ ID NO: 1534957 - RNA, 14 nt, Homo sapiens
caauaaagcaaugu

SEQ ID NO: 1534958 - RNA, 18 nt, Homo sapiens
caauaaagcaauguggua

SEQ ID NO: 1534959 - RNA, 19 nt, Homo sapiens
caauaaagcaaugugguag

SEQ ID NO: 1534960 - RNA, 19 nt, Homo sapiens
caauaauucuaugagauag

SEQ ID NO: 1534961 - RNA, 15 nt, Homo sapiens
caauaauuguggaga

SEQ ID NO: 1534962 - RNA, 13 nt, Homo sapiens
caauacccacugc

SEQ ID NO: 1534963 - RNA, 13 nt, Homo sapiens
caauagcauccaa

SEQ ID NO: 1534964 - RNA, 18 nt, Homo sapiens
caauauguaacaugucua

SEQ ID NO: 1534965 - RNA, 17 nt, Homo sapiens
caauauuccuaugcugc

SEQ ID NO: 1534966 - RNA, 12 nt, Homo sapiens
caaugauucaua

SEQ ID NO: 1534967 - RNA, 15 nt, Homo sapiens
caaugccugccugaa

SEQ ID NO: 1534968 - RNA, 20 nt, Homo sapiens
caaugccugccugaacaaag

SEQ ID NO: 1534969 - RNA, 16 nt, Homo sapiens
caauuucaaaaugcau

SEQ ID NO: 1534970 - RNA, 21 nt, Homo sapiens
caauuucaaaaugcaugugau

SEQ ID NO: 1534971 - RNA, 14 nt, Homo sapiens
caauuuucuauuua

SEQ ID NO: 1534972 - RNA, 17 nt, Homo sapiens
cacaaccuccuccucca

SEQ ID NO: 1534973 - RNA, 20 nt, Homo sapiens
cacaaccuccuccuccaguu

SEQ ID NO: 1534974 - RNA, 16 nt, Homo sapiens
cacaacggcagugaag

SEQ ID NO: 1534975 - RNA, 17 nt, Homo sapiens
cacaacuuuucugcuac

SEQ ID NO: 1534976 - RNA, 14 nt, Homo sapiens
cacaagacagcaga

SEQ ID NO: 1534977 - RNA, 14 nt, Homo sapiens
cacaaguauuacac

SEQ ID NO: 1534978 - RNA, 21 nt, Homo sapiens
cacaaguauugcccuuuaaca

SEQ ID NO: 1534979 - RNA, 19 nt, Homo sapiens
cacaauaauuuucuaccug

SEQ ID NO: 1534980 - RNA, 18 nt, Homo sapiens
cacaauacagugguauaa

SEQ ID NO: 1534981 - RNA, 18 nt, Homo sapiens
cacacugcccucugccac

SEQ ID NO: 1534982 - RNA, 16 nt, Homo sapiens
cacacuggcuccagac

SEQ ID NO: 1534983 - RNA, 21 nt, Homo sapiens
cacagaggauggcuuccccau

SEQ ID NO: 1534984 - RNA, 24 nt, Homo sapiens
cacagcuaugaaggcuguacacug

SEQ ID NO: 1534985 - RNA, 19 nt, Homo sapiens
cacaggagcguguacuacc

SEQ ID NO: 1534986 - RNA, 23 nt, Homo sapiens
cacaggagcguguacuaccccag

SEQ ID NO: 1534987 - RNA, 20 nt, Homo sapiens
cauagaacugucccacaaaa

SEQ ID NO: 1534988 - RNA, 18 nt, Homo sapiens
cauagucuuuguuuacau

SEQ ID NO: 1534989 - RNA, 24 nt, Homo sapiens
cauauauaauuuuauugcuggaau

SEQ ID NO: 1534990 - RNA, 14 nt, Homo sapiens
cauauauuguuauu

SEQ ID NO: 1534991 - RNA, 18 nt, Homo sapiens
caucauggcuaucugugg

SEQ ID NO: 1534992 - RNA, 15 nt, Homo sapiens
caucauuuucaccuc

SEQ ID NO: 1534993 - RNA, 18 nt, Homo sapiens
caucgcagggcucaugau

SEQ ID NO: 1534994 - RNA, 19 nt, Homo sapiens
caucuaagucaguuucaca

SEQ ID NO: 1534995 - RNA, 20 nt, Homo sapiens
caucuagaggcuuccuucau

SEQ ID NO: 1534996 - RNA, 14 nt, Homo sapiens
caucuagcuccaua

SEQ ID NO: 1534997 - RNA, 16 nt, Homo sapiens
caucuagucucagugc

SEQ ID NO: 1534998 - RNA, 14 nt, Homo sapiens
caucugauugugau

SEQ ID NO: 1534999 - RNA, 22 nt, Homo sapiens
caucuggagcugaagcguuacu

SEQ ID NO: 1535000 - RNA, 23 nt, Homo sapiens
caugaguauuugcuaauguugau

SEQ ID NO: 1535001 - RNA, 15 nt, Homo sapiens
caugagucccagugg

SEQ ID NO: 1535002 - RNA, 14 nt, Homo sapiens
caugaguucaaaua

SEQ ID NO: 1535003 - RNA, 17 nt, Homo sapiens
caugaguuuaugggaau

SEQ ID NO: 1535004 - RNA, 17 nt, Homo sapiens
caugauugugaccucca

SEQ ID NO: 1535005 - RNA, 19 nt, Homo sapiens
caugauuuuuuacaaauua

SEQ ID NO: 1535006 - RNA, 18 nt, Homo sapiens
caugcauuacugcaugca

SEQ ID NO: 1535007 - RNA, 16 nt, Homo sapiens
caugccuuuccagugc

SEQ ID NO: 1535008 - RNA, 20 nt, Homo sapiens
caugccuuuccagugcugcu

SEQ ID NO: 1535009 - RNA, 14 nt, Homo sapiens
caugcucaaugaaa

SEQ ID NO: 1535010 - RNA, 22 nt, Homo sapiens
caugcuggcucccagggccaug

SEQ ID NO: 1535011 - RNA, 22 nt, Homo sapiens
cauggaacucagcugucugugg

SEQ ID NO: 1535012 - RNA, 19 nt, Homo sapiens
cauggcuccucaccaccga

SEQ ID NO: 1535013 - RNA, 23 nt, Homo sapiens
caugggcaccucugcuguauuga

SEQ ID NO: 1535014 - RNA, 22 nt, Homo sapiens
caugggcauggccguugccucu

SEQ ID NO: 1535015 - RNA, 12 nt, Homo sapiens
cauggugcagug

SEQ ID NO: 1535016 - RNA, 14 nt, Homo sapiens
cauguaucuaugca

SEQ ID NO: 1535017 - RNA, 14 nt, Homo sapiens
cauguauguggaag

SEQ ID NO: 1535018 - RNA, 16 nt, Homo sapiens
cauguccuauuacuga

SEQ ID NO: 1535019 - RNA, 21 nt, Homo sapiens
caugugauuggcagcuucaaa

SEQ ID NO: 1535020 - RNA, 19 nt, Homo sapiens
cauguggaaaacucacaga

SEQ ID NO: 1535021 - RNA, 19 nt, Homo sapiens
cauguggcuaaaugccuaa

SEQ ID NO: 1535022 - RNA, 22 nt, Homo sapiens
cauguggcuaaaugccuaauaa

SEQ ID NO: 1535023 - RNA, 15 nt, Homo sapiens
cauguguugcaaauu

SEQ ID NO: 1535024 - RNA, 14 nt, Homo sapiens
cauuaaaaaugcau

SEQ ID NO: 1535025 - RNA, 19 nt, Homo sapiens
cauuaauccacauguuuca

SEQ ID NO: 1535026 - RNA, 20 nt, Homo sapiens
cauuauccuuuuaucucaca

SEQ ID NO: 1535027 - RNA, 17 nt, Homo sapiens
cauuauuucaaccgcuu

SEQ ID NO: 1535028 - RNA, 20 nt, Homo sapiens
cauucccagaauuugcugca

SEQ ID NO: 1535029 - RNA, 21 nt, Homo sapiens
cauucccagaauuugcugcau

SEQ ID NO: 1535030 - RNA, 20 nt, Homo sapiens
cauucuccagggguuuacag

SEQ ID NO: 1535031 - RNA, 18 nt, Homo sapiens
cauuguagaaaagcuaua

SEQ ID NO: 1535032 - RNA, 19 nt, Homo sapiens
cauuguaucuucauacaaa

SEQ ID NO: 1535033 - RNA, 17 nt, Homo sapiens
cauuuaaauugacuuca

SEQ ID NO: 1535034 - RNA, 15 nt, Homo sapiens
cauuuauaaaaccau

SEQ ID NO: 1535035 - RNA, 22 nt, Homo sapiens
cauuuccucaggcaauuccuuu

SEQ ID NO: 1535036 - RNA, 17 nt, Homo sapiens
cauuucuugauguugcu

SEQ ID NO: 1535037 - RNA, 18 nt, Homo sapiens
cauuucuugguaugauca

SEQ ID NO: 1535038 - RNA, 19 nt, Homo sapiens
cauuugaauuuuuuaguga

SEQ ID NO: 1535039 - RNA, 14 nt, Homo sapiens
cauuugagugucuu

SEQ ID NO: 1535040 - RNA, 14 nt, Homo sapiens
cauuuguuccacag

SEQ ID NO: 1535041 - RNA, 18 nt, Homo sapiens
cauuuuucuacugcucuu

SEQ ID NO: 1535042 - RNA, 18 nt, Homo sapiens
ccaaaaccacagcccugu

SEQ ID NO: 1535043 - RNA, 22 nt, Homo sapiens
ccaaacuguaguaauuguuaca

SEQ ID NO: 1535044 - RNA, 13 nt, Homo sapiens
ccaaagacuacac

SEQ ID NO: 1535045 - RNA, 12 nt, Homo sapiens
ccaaagggccca

SEQ ID NO: 1535046 - RNA, 14 nt, Homo sapiens
ccaaaguuauccag

SEQ ID NO: 1535047 - RNA, 21 nt, Homo sapiens
ccaaauaaaacuugagcccac

SEQ ID NO: 1535048 - RNA, 15 nt, Homo sapiens
ccaacuccaggguua

SEQ ID NO: 1535049 - RNA, 21 nt, Homo sapiens
ccaacugagccaaaaacaaua

SEQ ID NO: 1535050 - RNA, 18 nt, Homo sapiens
ccaacuugucacuugcca

SEQ ID NO: 1535051 - RNA, 21 nt, Homo sapiens
ccaagagaugcagugccagga

SEQ ID NO: 1535052 - RNA, 23 nt, Homo sapiens
ccaagcacacaugcauggcauuu

SEQ ID NO: 1535053 - RNA, 15 nt, Homo sapiens
ccaaggaaaauggac

SEQ ID NO: 1535054 - RNA, 16 nt, Homo sapiens
ccaaggggucugcucc

SEQ ID NO: 1535055 - RNA, 22 nt, Homo sapiens
ccaaguuuugaaaggcuuuccu

SEQ ID NO: 1535056 - RNA, 19 nt, Homo sapiens
ccaauccuuuauagcuuug

SEQ ID NO: 1535057 - RNA, 13 nt, Homo sapiens
ccaaugauucaua

SEQ ID NO: 1535058 - RNA, 21 nt, Homo sapiens
ccacaaggcugaaaagugcuu

SEQ ID NO: 1535059 - RNA, 23 nt, Homo sapiens
ccacaaguauugcccuuuaacaa

SEQ ID NO: 1535060 - RNA, 20 nt, Homo sapiens
ccacacuaccaguuucacac

SEQ ID NO: 1535061 - RNA, 14 nt, Homo sapiens
ccacagaagacacg

SEQ ID NO: 1535062 - RNA, 12 nt, Homo sapiens
ccacauguuuca

SEQ ID NO: 1535063 - RNA, 12 nt, Homo sapiens
ccaccagaugag

SEQ ID NO: 1535064 - RNA, 14 nt, Homo sapiens
ccacccauaccagc

SEQ ID NO: 1535065 - RNA, 15 nt, Homo sapiens
ccaccucaggggaga

SEQ ID NO: 1535066 - RNA, 14 nt, Homo sapiens
ccacgacauggcug

SEQ ID NO: 1535067 - RNA, 18 nt, Homo sapiens
ccacgugacuuucaacaa

SEQ ID NO: 1535068 - RNA, 17 nt, Homo sapiens
ccacugccagacaugcc

SEQ ID NO: 1535069 - RNA, 18 nt, Homo sapiens
ccacugccagacaugcca

SEQ ID NO: 1535070 - RNA, 20 nt, Homo sapiens
ccacugccccugcaccugcu

SEQ ID NO: 1535071 - RNA, 19 nt, Homo sapiens
ccacuuaugcugcugugaa

SEQ ID NO: 1535072 - RNA, 17 nt, Homo sapiens
ccacuucuucauucucu

SEQ ID NO: 1535073 - RNA, 17 nt, Homo sapiens
ccacuuugguaaugugu

SEQ ID NO: 1535074 - RNA, 17 nt, Homo sapiens
ccagaagggggccauga

SEQ ID NO: 1535075 - RNA, 14 nt, Homo sapiens
ccagacaugcugcc

SEQ ID NO: 1535076 - RNA, 19 nt, Homo sapiens
ccagagcuuuacagugcca

SEQ ID NO: 1535077 - RNA, 14 nt, Homo sapiens
ccagaggcucuaau

SEQ ID NO: 1535078 - RNA, 21 nt, Homo sapiens
ccagaggcucuaauguacaau

SEQ ID NO: 1535079 - RNA, 17 nt, Homo sapiens
ccagaggguugugauuu

SEQ ID NO: 1535080 - RNA, 14 nt, Homo sapiens
ccagaugacacaua

SEQ ID NO: 1535081 - RNA, 16 nt, Homo sapiens
ccagccgcaaauccau

SEQ ID NO: 1535082 - RNA, 14 nt, Homo sapiens
ccagcggaugcugc

SEQ ID NO: 1535083 - RNA, 18 nt, Homo sapiens
ccagcuggcucugcagca

SEQ ID NO: 1535084 - RNA, 13 nt, Homo sapiens
ccaggacagcauu

SEQ ID NO: 1535085 - RNA, 12 nt, Homo sapiens
ccaggcaauggc

SEQ ID NO: 1535086 - RNA, 20 nt, Homo sapiens
ccaggcaggcugugcgcuga

SEQ ID NO: 1535087 - RNA, 19 nt, Homo sapiens
ccagggcugggcacuccuc

SEQ ID NO: 1535088 - RNA, 15 nt, Homo sapiens
ccaggguuccagaca

SEQ ID NO: 1535089 - RNA, 19 nt, Homo sapiens
ccaggguuccagacagggu

SEQ ID NO: 1535090 - RNA, 21 nt, Homo sapiens
ccaggguuccagacagggugg

SEQ ID NO: 1535091 - RNA, 16 nt, Homo sapiens
ccagucccucagccac

SEQ ID NO: 1535092 - RNA, 16 nt, Homo sapiens
ccagugacacaacuca

SEQ ID NO: 1535093 - RNA, 15 nt, Homo sapiens
ccaguggaaccaaaa

SEQ ID NO: 1535094 - RNA, 17 nt, Homo sapiens
ccaguguaugucuugua

SEQ ID NO: 1535095 - RNA, 15 nt, Homo sapiens
ccaguuaacuguuaa

SEQ ID NO: 1535096 - RNA, 14 nt, Homo sapiens
ccaguucugaugag

SEQ ID NO: 1535097 - RNA, 14 nt, Homo sapiens
ccauaauugcaagg

SEQ ID NO: 1535098 - RNA, 20 nt, Homo sapiens
ccauauuaaaucuuccucau

SEQ ID NO: 1535099 - RNA, 15 nt, Homo sapiens
ccaucuguuugauac

SEQ ID NO: 1535100 - RNA, 16 nt, Homo sapiens
ccaucuguuugauaca

SEQ ID NO: 1535101 - RNA, 23 nt, Homo sapiens
ccaucuguuugauacaguauuau

SEQ ID NO: 1535102 - RNA, 17 nt, Homo sapiens
ccaugagaaaagggaag

SEQ ID NO: 1535103 - RNA, 16 nt, Homo sapiens
ccaugaucacuuauca

SEQ ID NO: 1535104 - RNA, 20 nt, Homo sapiens
ccaugcaggcagccugcaga

SEQ ID NO: 1535105 - RNA, 16 nt, Homo sapiens
ccaugcccucccugcu

SEQ ID NO: 1535106 - RNA, 18 nt, Homo sapiens
ccaugcccucccugcugc

SEQ ID NO: 1535107 - RNA, 20 nt, Homo sapiens
ccaugcccucccugcugcca

SEQ ID NO: 1535108 - RNA, 13 nt, Homo sapiens
ccaugcucaauga

SEQ ID NO: 1535109 - RNA, 22 nt, Homo sapiens
ccauggaagcuggcaggagaca

SEQ ID NO: 1535110 - RNA, 17 nt, Homo sapiens
ccauggaccugcacuug

SEQ ID NO: 1535111 - RNA, 22 nt, Homo sapiens
ccauggcuccucaccaccgaga

SEQ ID NO: 1535112 - RNA, 20 nt, Homo sapiens
ccaugggggcuccagacauu

SEQ ID NO: 1535113 - RNA, 13 nt, Homo sapiens
ccauggugcagug

SEQ ID NO: 1535114 - RNA, 16 nt, Homo sapiens
ccaugugcugcugugg

SEQ ID NO: 1535115 - RNA, 12 nt, Homo sapiens
ccauguguuuca

SEQ ID NO: 1535116 - RNA, 14 nt, Homo sapiens
ccauugugcauucu

SEQ ID NO: 1535117 - RNA, 17 nt, Homo sapiens
ugcccccuacccggcuc

SEQ ID NO: 1535118 - RNA, 23 nt, Homo sapiens
ugccuauuuaugaauaaauauua

SEQ ID NO: 1535119 - RNA, 16 nt, Homo sapiens
ugccuguauuuccaac

SEQ ID NO: 1535120 - RNA, 21 nt, Homo sapiens
ugccuguggugagguccuguc

SEQ ID NO: 1535121 - RNA, 16 nt, Homo sapiens
ugccuuuuaccuucag

SEQ ID NO: 1535122 - RNA, 24 nt, Homo sapiens
ugcuaauuaaaaaguuaaucuuca

SEQ ID NO: 1535123 - RNA, 22 nt, Homo sapiens
ugcuacuucaguaaugucuaua

SEQ ID NO: 1535124 - RNA, 22 nt, Homo sapiens
ugcuaucucgcuagccauauau

SEQ ID NO: 1535125 - RNA, 17 nt, Homo sapiens
ugcuccaguguuuucuu

SEQ ID NO: 1535126 - RNA, 15 nt, Homo sapiens
ugcucccuagccaga

SEQ ID NO: 1535127 - RNA, 17 nt, Homo sapiens
ugcucggccgucuucac

SEQ ID NO: 1535128 - RNA, 17 nt, Homo sapiens
ugcugaggagcucaggg

SEQ ID NO: 1535129 - RNA, 19 nt, Homo sapiens
ugcuggcucccagggccau

SEQ ID NO: 1535130 - RNA, 17 nt, Homo sapiens
ugcuguaugucauuaaa

SEQ ID NO: 1535131 - RNA, 17 nt, Homo sapiens
ugcuguauugauaucac

SEQ ID NO: 1535132 - RNA, 14 nt, Homo sapiens
ugcuuaguaucuca

SEQ ID NO: 1535133 - RNA, 15 nt, Homo sapiens
ugcuuaguaucucau

SEQ ID NO: 1535134 - RNA, 20 nt, Homo sapiens
ugcuuagugucccuuaccug

SEQ ID NO: 1535135 - RNA, 18 nt, Homo sapiens
ugcuucaggauaccauau

SEQ ID NO: 1535136 - RNA, 15 nt, Homo sapiens
ugcuucugcccaccc

SEQ ID NO: 1535137 - RNA, 23 nt, Homo sapiens
ugcuuugcuggaguccuguucuc

SEQ ID NO: 1535138 - RNA, 15 nt, Homo sapiens
ugcuuuuccaucuaa

SEQ ID NO: 1535139 - RNA, 17 nt, Homo sapiens
ugcuuuucuaaucugca

SEQ ID NO: 1535140 - RNA, 19 nt, Homo sapiens
ugcuuuuugcuuguguaca

SEQ ID NO: 1535141 - RNA, 23 nt, Homo sapiens
uggaaaaaagagaaaaaccaaug

SEQ ID NO: 1535142 - RNA, 20 nt, Homo sapiens
uggaaaaaugccaucaaaug

SEQ ID NO: 1535143 - RNA, 15 nt, Homo sapiens
uggaaagagaaccau

SEQ ID NO: 1535144 - RNA, 19 nt, Homo sapiens
uggaaauaaaauacuucua

SEQ ID NO: 1535145 - RNA, 23 nt, Homo sapiens
uggaaauaaaguuauuacucuga

SEQ ID NO: 1535146 - RNA, 22 nt, Homo sapiens
uggaaauaacugagcacuuuga

SEQ ID NO: 1535147 - RNA, 17 nt, Homo sapiens
uggaaccaaaacccauc

SEQ ID NO: 1535148 - RNA, 15 nt, Homo sapiens
uggaacugucucuca

SEQ ID NO: 1535149 - RNA, 18 nt, Homo sapiens
uggaacugucucucauga

SEQ ID NO: 1535150 - RNA, 20 nt, Homo sapiens
uggaagaggcaccuguccca

SEQ ID NO: 1535151 - RNA, 15 nt, Homo sapiens
uggaagcacaugugu

SEQ ID NO: 1535152 - RNA, 18 nt, Homo sapiens
uggaagccuccaccugca

SEQ ID NO: 1535153 - RNA, 18 nt, Homo sapiens
uggaaggccuucuuucua

SEQ ID NO: 1535154 - RNA, 15 nt, Homo sapiens
uggacgcaugcaggg

SEQ ID NO: 1535155 - RNA, 11 nt, Homo sapiens
uggacuuccaa

SEQ ID NO: 1535156 - RNA, 16 nt, Homo sapiens
uggagacgccucccca

SEQ ID NO: 1535157 - RNA, 16 nt, Homo sapiens
uggagcaugagccagc

SEQ ID NO: 1535158 - RNA, 14 nt, Homo sapiens
uggagcugcuucca

SEQ ID NO: 1535159 - RNA, 16 nt, Homo sapiens
uggaggcgagccagau

SEQ ID NO: 1535160 - RNA, 18 nt, Homo sapiens
uggaguagauauuaauua

SEQ ID NO: 1535161 - RNA, 19 nt, Homo sapiens
uggcacaugauaugaguca

SEQ ID NO: 1535162 - RNA, 19 nt, Homo sapiens
uggcaggugugggcuccca

SEQ ID NO: 1535163 - RNA, 17 nt, Homo sapiens
uggcaucuuaggguagg

SEQ ID NO: 1535164 - RNA, 15 nt, Homo sapiens
uggcauuuguuccac

SEQ ID NO: 1535165 - RNA, 21 nt, Homo sapiens
uggccaagccugccccggcca

SEQ ID NO: 1535166 - RNA, 19 nt, Homo sapiens
uggccagaagggggccaug

SEQ ID NO: 1535167 - RNA, 22 nt, Homo sapiens
uggccaggccucagggaccaag

SEQ ID NO: 1535168 - RNA, 21 nt, Homo sapiens
uggccauuuaacuagcacuuu

SEQ ID NO: 1535169 - RNA, 18 nt, Homo sapiens
uggcccucgcucugccuc

SEQ ID NO: 1535170 - RNA, 15 nt, Homo sapiens
uggcgcacccggcag

SEQ ID NO: 1535171 - RNA, 16 nt, Homo sapiens
uggcgucugucuucaa

SEQ ID NO: 1535172 - RNA, 21 nt, Homo sapiens
uggcucagcuccuucaugaga

SEQ ID NO: 1535173 - RNA, 16 nt, Homo sapiens
uggcucccaggguccu

SEQ ID NO: 1535174 - RNA, 14 nt, Homo sapiens
uggcuuugugcuua

SEQ ID NO: 1535175 - RNA, 16 nt, Homo sapiens
uggcuuugugcuuguu

SEQ ID NO: 1535176 - RNA, 20 nt, Homo sapiens
ugggaagaaagauucaauua

SEQ ID NO: 1535177 - RNA, 16 nt, Homo sapiens
ugggacacagagaccc

SEQ ID NO: 1535178 - RNA, 23 nt, Homo sapiens
ugggagaaccucguugacaugca

SEQ ID NO: 1535179 - RNA, 23 nt, Homo sapiens
uggggagaggagugggaaauuga

SEQ ID NO: 1535180 - RNA, 20 nt, Homo sapiens
uggggagccauaagggacau

SEQ ID NO: 1535181 - RNA, 16 nt, Homo sapiens
uggggagggacacaga

SEQ ID NO: 1535182 - RNA, 23 nt, Homo sapiens
ugggggccucuuuaccauagcuu

SEQ ID NO: 1535183 - RNA, 19 nt, Homo sapiens
ugggucaccuuccugggca

SEQ ID NO: 1535184 - RNA, 15 nt, Homo sapiens
ugggucagcuugaau

SEQ ID NO: 1535185 - RNA, 15 nt, Homo sapiens
ugggugggacacaga

SEQ ID NO: 1535186 - RNA, 17 nt, Homo sapiens
uggguuccagacagagu

SEQ ID NO: 1535187 - RNA, 16 nt, Homo sapiens
ugguaacugcacacau

SEQ ID NO: 1535188 - RNA, 13 nt, Homo sapiens
ugguaacuuuauu

SEQ ID NO: 1535189 - RNA, 19 nt, Homo sapiens
ugguaaucuuuucugaggu

SEQ ID NO: 1535190 - RNA, 12 nt, Homo sapiens
ugguaucucuuu

SEQ ID NO: 1535191 - RNA, 23 nt, Homo sapiens
ugguauucaacuaauacaugguu

SEQ ID NO: 1535192 - RNA, 16 nt, Homo sapiens
ugguccugcacugucc

SEQ ID NO: 1535193 - RNA, 19 nt, Homo sapiens
uggugagguugugcugccu

SEQ ID NO: 1535194 - RNA, 12 nt, Homo sapiens
uggugcagugaa

SEQ ID NO: 1535195 - RNA, 22 nt, Homo sapiens
ugguguuuagaaugucaguuga

SEQ ID NO: 1535196 - RNA, 12 nt, Homo sapiens
ugguuaccucug

SEQ ID NO: 1535197 - RNA, 12 nt, Homo sapiens
ugguucaugccu

SEQ ID NO: 1535198 - RNA, 23 nt, Homo sapiens
ugguuguugcaguucagacaaau

SEQ ID NO: 1535199 - RNA, 14 nt, Homo sapiens
ugguuuaaagucac

SEQ ID NO: 1535200 - RNA, 17 nt, Homo sapiens
ugguuuuaaaaaagcau

SEQ ID NO: 1535201 - RNA, 19 nt, Homo sapiens
ugguuuugcaugucugcau

SEQ ID NO: 1535202 - RNA, 20 nt, Homo sapiens
uguaaauggaagcacugcca

SEQ ID NO: 1535203 - RNA, 14 nt, Homo sapiens
uguaauauacaguu

SEQ ID NO: 1535204 - RNA, 18 nt, Homo sapiens
uguaauuccucccuaaga

SEQ ID NO: 1535205 - RNA, 13 nt, Homo sapiens
uguacaauaaagc

SEQ ID NO: 1535206 - RNA, 20 nt, Homo sapiens
uguagcauuucuugauguug

SEQ ID NO: 1535207 - RNA, 22 nt, Homo sapiens
uguagcauuucuugauguugcu

SEQ ID NO: 1535208 - RNA, 18 nt, Homo sapiens
uguauaucguuaucacug

SEQ ID NO: 1535209 - RNA, 11 nt, Homo sapiens
uguauccucca

SEQ ID NO: 1535210 - RNA, 18 nt, Homo sapiens
uguaucuuuaaagacuug

SEQ ID NO: 1535211 - RNA, 15 nt, Homo sapiens
uguaugugaaagugu

SEQ ID NO: 1535212 - RNA, 23 nt, Homo sapiens
ugucaaccuugugugagugugac

SEQ ID NO: 1535213 - RNA, 17 nt, Homo sapiens
ugucaguguagaucaac

SEQ ID NO: 1535214 - RNA, 17 nt, Homo sapiens
uguccaacaacuccagg

SEQ ID NO: 1535215 - RNA, 14 nt, Homo sapiens
uguccacaaauguc

SEQ ID NO: 1535216 - RNA, 14 nt, Homo sapiens
uguccacacaagac

SEQ ID NO: 1535217 - RNA, 19 nt, Homo sapiens
uguccgacucuucugagca

SEQ ID NO: 1535218 - RNA, 18 nt, Homo sapiens
ugucuaguuugcauacuu

SEQ ID NO: 1535219 - RNA, 16 nt, Homo sapiens
ugucucaaaccuccaa

SEQ ID NO: 1535220 - RNA, 15 nt, Homo sapiens
ugucugacuucucag

SEQ ID NO: 1535221 - RNA, 22 nt, Homo sapiens
ugucugcaugaaggucuaccug

SEQ ID NO: 1535222 - RNA, 18 nt, Homo sapiens
ugucuguuaaaugaacuu

SEQ ID NO: 1535223 - RNA, 16 nt, Homo sapiens
ugucuuagucauacca

SEQ ID NO: 1535224 - RNA, 13 nt, Homo sapiens
ugucuuucuccaa

SEQ ID NO: 1535225 - RNA, 15 nt, Homo sapiens
ugugaccgggguccu

SEQ ID NO: 1535226 - RNA, 19 nt, Homo sapiens
ugugacggggguuggggug

SEQ ID NO: 1535227 - RNA, 14 nt, Homo sapiens
ugugagcaggguga

SEQ ID NO: 1535228 - RNA, 15 nt, Homo sapiens
ugugagcagucucag

SEQ ID NO: 1535229 - RNA, 14 nt, Homo sapiens
ugugauugugauuc

SEQ ID NO: 1535230 - RNA, 21 nt, Homo sapiens
ugugcaaauccccuccccaaa

SEQ ID NO: 1535231 - RNA, 15 nt, Homo sapiens
ugugcagcuuuccag

SEQ ID NO: 1535232 - RNA, 15 nt, Homo sapiens
ugugccucagccucc

SEQ ID NO: 1535233 - RNA, 22 nt, Homo sapiens
ugugcgcugacaaccaccgcuc

SEQ ID NO: 1535234 - RNA, 17 nt, Homo sapiens
ugugcuggugggggccu

SEQ ID NO: 1535235 - RNA, 17 nt, Homo sapiens
ugugcuuugccacugaa

SEQ ID NO: 1535236 - RNA, 15 nt, Homo sapiens
uguggaaaacucaca

SEQ ID NO: 1535237 - RNA, 17 nt, Homo sapiens
uguggaaaacucacaga

SEQ ID NO: 1535238 - RNA, 15 nt, Homo sapiens
uguggauucuauauu

SEQ ID NO: 1535239 - RNA, 14 nt, Homo sapiens
uguggcagcugucu

SEQ ID NO: 1535240 - RNA, 16 nt, Homo sapiens
uguggcuaaaugccua

SEQ ID NO: 1535241 - RNA, 13 nt, Homo sapiens
ugugguacaagca

SEQ ID NO: 1535242 - RNA, 16 nt, Homo sapiens
ugugguacaagcauuc

SEQ ID NO: 1535243 - RNA, 14 nt, Homo sapiens
ugugguuagaaaag

SEQ ID NO: 1535244 - RNA, 17 nt, Homo sapiens
uguguacaaacccagau

SEQ ID NO: 1535245 - RNA, 22 nt, Homo sapiens
uguguccuaaaugcaaagcaca

SEQ ID NO: 1535246 - RNA, 18 nt, Homo sapiens
uguguuuauaauuguuau

SEQ ID NO: 1535247 - RNA, 15 nt, Homo sapiens
agacaggguggggcu

SEQ ID NO: 1535248 - RNA, 22 nt, Homo sapiens
agacauaccucucaacuuacau

SEQ ID NO: 1535249 - RNA, 16 nt, Homo sapiens
agacaucuagucucag

SEQ ID NO: 1535250 - RNA, 15 nt, Homo sapiens
agacaugaaauugag

SEQ ID NO: 1535251 - RNA, 15 nt, Homo sapiens
agaccagcuucuagc

SEQ ID NO: 1535252 - RNA, 20 nt, Homo sapiens
agaccccuacccuuucccaa

SEQ ID NO: 1535253 - RNA, 13 nt, Homo sapiens
agacccucagacc

SEQ ID NO: 1535254 - RNA, 20 nt, Homo sapiens
agacccugccaacuuuccag

SEQ ID NO: 1535255 - RNA, 15 nt, Homo sapiens
agacgcagauuucag

SEQ ID NO: 1535256 - RNA, 23 nt, Homo sapiens
agacucaaagagggagugcauuu

SEQ ID NO: 1535257 - RNA, 17 nt, Homo sapiens
agacucacugugggaag

SEQ ID NO: 1535258 - RNA, 19 nt, Homo sapiens
agacugucucaagagggca

SEQ ID NO: 1535259 - RNA, 16 nt, Homo sapiens
agacugugauguaucu

SEQ ID NO: 1535260 - RNA, 16 nt, Homo sapiens
agagaaaaaccaauga

SEQ ID NO: 1535261 - RNA, 14 nt, Homo sapiens
agagagaaacagcu

SEQ ID NO: 1535262 - RNA, 16 nt, Homo sapiens
agagagaguucucaca

SEQ ID NO: 1535263 - RNA, 14 nt, Homo sapiens
agagaguggaagaa

SEQ ID NO: 1535264 - RNA, 13 nt, Homo sapiens
agagcagaaccaa

SEQ ID NO: 1535265 - RNA, 15 nt, Homo sapiens
agagcagaaccaaag

SEQ ID NO: 1535266 - RNA, 16 nt, Homo sapiens
ccagaagcuccgugag

SEQ ID NO: 1535267 - RNA, 18 nt, Homo sapiens
ccagaauuugcugcauuu

SEQ ID NO: 1535268 - RNA, 23 nt, Homo sapiens
ccagacagcaacggggaggccaa

SEQ ID NO: 1535269 - RNA, 11 nt, Homo sapiens
ccagaccccau

SEQ ID NO: 1535270 - RNA, 20 nt, Homo sapiens
ccagagccuauggaaagggu

SEQ ID NO: 1535271 - RNA, 18 nt, Homo sapiens
ccagcaugcugagauuac

SEQ ID NO: 1535272 - RNA, 17 nt, Homo sapiens
ccagccucagugcagcc

SEQ ID NO: 1535273 - RNA, 16 nt, Homo sapiens
ccagcggaugcugcca

SEQ ID NO: 1535274 - RNA, 20 nt, Homo sapiens
ccagcucaggcuacugccac

SEQ ID NO: 1535275 - RNA, 19 nt, Homo sapiens
ccagcuccuaguagcuuuc

SEQ ID NO: 1535276 - RNA, 16 nt, Homo sapiens
ccagcuggcucugcag

SEQ ID NO: 1535277 - RNA, 18 nt, Homo sapiens
ccagcuuaugagcucaaa

SEQ ID NO: 1535278 - RNA, 14 nt, Homo sapiens
ccaggacacugccu

SEQ ID NO: 1535279 - RNA, 19 nt, Homo sapiens
ccaggacgcagggagaccc

SEQ ID NO: 1535280 - RNA, 14 nt, Homo sapiens
ccaggacgcaugca

SEQ ID NO: 1535281 - RNA, 14 nt, Homo sapiens
ccaggaugcaugca

SEQ ID NO: 1535282 - RNA, 15 nt, Homo sapiens
ccaggccucagggac

SEQ ID NO: 1535283 - RNA, 17 nt, Homo sapiens
ccaggcuggagugcagu

SEQ ID NO: 1535284 - RNA, 22 nt, Homo sapiens
ccagugcuacacguuggaguau

SEQ ID NO: 1535285 - RNA, 20 nt, Homo sapiens
ccaguguccccaggggcaca

SEQ ID NO: 1535286 - RNA, 21 nt, Homo sapiens
ccaguguccccaggggcacac

SEQ ID NO: 1535287 - RNA, 13 nt, Homo sapiens
ccauagaaacuga

SEQ ID NO: 1535288 - RNA, 16 nt, Homo sapiens
ccaucacacauguuca

SEQ ID NO: 1535289 - RNA, 22 nt, Homo sapiens
ccauccaauggauugugcaaau

SEQ ID NO: 1535290 - RNA, 10 nt, Homo sapiens
ccaucugauu

SEQ ID NO: 1535291 - RNA, 12 nt, Homo sapiens
ccaucugcugag

SEQ ID NO: 1535292 - RNA, 21 nt, Homo sapiens
ccaucuguuugauacaguauu

SEQ ID NO: 1535293 - RNA, 17 nt, Homo sapiens
ccaugcagaucuagcca

SEQ ID NO: 1535294 - RNA, 11 nt, Homo sapiens
ccaugcucaau

SEQ ID NO: 1535295 - RNA, 20 nt, Homo sapiens
ccauggcuccucaccaccga

SEQ ID NO: 1535296 - RNA, 21 nt, Homo sapiens
ccaugguagacugugacacag

SEQ ID NO: 1535297 - RNA, 19 nt, Homo sapiens
ccauggugcagugaagaaa

SEQ ID NO: 1535298 - RNA, 16 nt, Homo sapiens
ccauggugguuucaga

SEQ ID NO: 1535299 - RNA, 21 nt, Homo sapiens
ccauguuuaaguguacuggau

SEQ ID NO: 1535300 - RNA, 17 nt, Homo sapiens
ccauuagcccacugccu

SEQ ID NO: 1535301 - RNA, 12 nt, Homo sapiens
ccauugugcauu

SEQ ID NO: 1535302 - RNA, 16 nt, Homo sapiens
ccauuugugauacuuc

SEQ ID NO: 1535303 - RNA, 14 nt, Homo sapiens
cccaaaccaggggg

SEQ ID NO: 1535304 - RNA, 18 nt, Homo sapiens
cccaccauaaugugaaua

SEQ ID NO: 1535305 - RNA, 18 nt, Homo sapiens
cccaccccgccucugggc

SEQ ID NO: 1535306 - RNA, 16 nt, Homo sapiens
cccagaacgcaugcag

SEQ ID NO: 1535307 - RNA, 16 nt, Homo sapiens
cccagaauuugcugca

SEQ ID NO: 1535308 - RNA, 15 nt, Homo sapiens
cccagagaagccuca

SEQ ID NO: 1535309 - RNA, 20 nt, Homo sapiens
cccagagcuuuacagugcca

SEQ ID NO: 1535310 - RNA, 22 nt, Homo sapiens
cccagccugcucccuagccaga

SEQ ID NO: 1535311 - RNA, 14 nt, Homo sapiens
cccaggacacugcc

SEQ ID NO: 1535312 - RNA, 16 nt, Homo sapiens
cccaggacgcaugcag

SEQ ID NO: 1535313 - RNA, 17 nt, Homo sapiens
cccaggacgcaugcagg

SEQ ID NO: 1535314 - RNA, 12 nt, Homo sapiens
cccaggaugcau

SEQ ID NO: 1535315 - RNA, 19 nt, Homo sapiens
cccagggaacuaaagggug

SEQ ID NO: 1535316 - RNA, 22 nt, Homo sapiens
cccaguggaaccaaaacccauc

SEQ ID NO: 1535317 - RNA, 14 nt, Homo sapiens
cccaguggccucaa

SEQ ID NO: 1535318 - RNA, 21 nt, Homo sapiens
cccauccaauggauugugcaa

SEQ ID NO: 1535319 - RNA, 18 nt, Homo sapiens
cccaugguagacugugac

SEQ ID NO: 1535320 - RNA, 19 nt, Homo sapiens
cccauuagcccacugccug

SEQ ID NO: 1535321 - RNA, 20 nt, Homo sapiens
ccccacaacacaccuugccc

SEQ ID NO: 1535322 - RNA, 21 nt, Homo sapiens
ccccacccacccucugguccu

SEQ ID NO: 1535323 - RNA, 10 nt, Homo sapiens
ccccagagac

SEQ ID NO: 1535324 - RNA, 22 nt, Homo sapiens
ccccagagcuuuacagugccac

SEQ ID NO: 1535325 - RNA, 15 nt, Homo sapiens
ccccagcccugugga

SEQ ID NO: 1535326 - RNA, 14 nt, Homo sapiens
ccccagccugcucc

SEQ ID NO: 1535327 - RNA, 23 nt, Homo sapiens
ccccagccugcucccuagccaga

SEQ ID NO: 1535328 - RNA, 20 nt, Homo sapiens
cccccacaggagcauguccu

SEQ ID NO: 1535329 - RNA, 20 nt, Homo sapiens
cccccacaggagcguguccu

SEQ ID NO: 1535330 - RNA, 14 nt, Homo sapiens
cccccgugccaaau

SEQ ID NO: 1535331 - RNA, 19 nt, Homo sapiens
ccccuggaacugucucuca

SEQ ID NO: 1535332 - RNA, 17 nt, Homo sapiens
ccccuggacauauuccc

SEQ ID NO: 1535333 - RNA, 21 nt, Homo sapiens
ccccuggggggcacagccaga

SEQ ID NO: 1535334 - RNA, 20 nt, Homo sapiens
cccgcugcgcugcccugcaa

SEQ ID NO: 1535335 - RNA, 21 nt, Homo sapiens
cccgugccacgcgcucugcau

SEQ ID NO: 1535336 - RNA, 14 nt, Homo sapiens
cccuaaaaauucca

SEQ ID NO: 1535337 - RNA, 22 nt, Homo sapiens
cccuaaauguggacaucaugaa

SEQ ID NO: 1535338 - RNA, 20 nt, Homo sapiens
cccucaccugggcaccuggg

SEQ ID NO: 1535339 - RNA, 23 nt, Homo sapiens
cccucagccacgccucucucagc

SEQ ID NO: 1535340 - RNA, 23 nt, Homo sapiens
cccucuuucagggguccuaagcc

SEQ ID NO: 1535341 - RNA, 16 nt, Homo sapiens
cccugaggguuuccac

SEQ ID NO: 1535342 - RNA, 12 nt, Homo sapiens
cccugcacacac

SEQ ID NO: 1535343 - RNA, 19 nt, Homo sapiens
cccuggugucccugccugg

SEQ ID NO: 1535344 - RNA, 18 nt, Homo sapiens
cccuuaggaauauacaua

SEQ ID NO: 1535345 - RNA, 19 nt, Homo sapiens
cccuuuaucauguguuucu

SEQ ID NO: 1535346 - RNA, 19 nt, Homo sapiens
cccuuucaugauuugcaac

SEQ ID NO: 1535347 - RNA, 14 nt, Homo sapiens
cccuuuccccauaa

SEQ ID NO: 1535348 - RNA, 14 nt, Homo sapiens
ccgcccaccugggc

SEQ ID NO: 1535349 - RNA, 18 nt, Homo sapiens
ccgcugggagaaaagcca

SEQ ID NO: 1535350 - RNA, 20 nt, Homo sapiens
ccgcuggugcccaccagcug

SEQ ID NO: 1535351 - RNA, 13 nt, Homo sapiens
ccggaaagccuuc

SEQ ID NO: 1535352 - RNA, 18 nt, Homo sapiens
ccggaaagccuuccucaa

SEQ ID NO: 1535353 - RNA, 21 nt, Homo sapiens
ccggaaagccuuccucaagau

SEQ ID NO: 1535354 - RNA, 19 nt, Homo sapiens
ccggaugacacaaauacca

SEQ ID NO: 1535355 - RNA, 19 nt, Homo sapiens
ccggcugagcugugccagc

SEQ ID NO: 1535356 - RNA, 15 nt, Homo sapiens
ccgguggaaggccuu

SEQ ID NO: 1535357 - RNA, 21 nt, Homo sapiens
ccgguguccuguuccugccac

SEQ ID NO: 1535358 - RNA, 21 nt, Homo sapiens
ccguagacucacggcugcacc

SEQ ID NO: 1535359 - RNA, 13 nt, Homo sapiens
ccgugaggucaca

SEQ ID NO: 1535360 - RNA, 12 nt, Homo sapiens
ccgugggccaug

SEQ ID NO: 1535361 - RNA, 21 nt, Homo sapiens
ccguuggcaccucugugccac

SEQ ID NO: 1535362 - RNA, 17 nt, Homo sapiens
ccuaaagaaaacaaaca

SEQ ID NO: 1535363 - RNA, 12 nt, Homo sapiens
ccuaacaagccu

SEQ ID NO: 1535364 - RNA, 11 nt, Homo sapiens
ccuaagucaac

SEQ ID NO: 1535365 - RNA, 14 nt, Homo sapiens
ccuaauaaacaauu

SEQ ID NO: 1535366 - RNA, 15 nt, Homo sapiens
ccuaauguggcagcu

SEQ ID NO: 1535367 - RNA, 14 nt, Homo sapiens
ccuaauuaauuuca

SEQ ID NO: 1535368 - RNA, 17 nt, Homo sapiens
ccuacuuacaugcauua

SEQ ID NO: 1535369 - RNA, 16 nt, Homo sapiens
ccuagccagaggcucu

SEQ ID NO: 1535370 - RNA, 18 nt, Homo sapiens
ccuagccagaggcucuaa

SEQ ID NO: 1535371 - RNA, 22 nt, Homo sapiens
ccuaguccccagccugcucccu

SEQ ID NO: 1535372 - RNA, 14 nt, Homo sapiens
ccuaucaucaguua

SEQ ID NO: 1535373 - RNA, 16 nt, Homo sapiens
ccuauggaaagggugu

SEQ ID NO: 1535374 - RNA, 16 nt, Homo sapiens
ccuauucuauugcagu

SEQ ID NO: 1535375 - RNA, 16 nt, Homo sapiens
ccuauuuuuggaagag

SEQ ID NO: 1535376 - RNA, 21 nt, Homo sapiens
ccucaacaagaagaauuugaa

SEQ ID NO: 1535377 - RNA, 14 nt, Homo sapiens
ccucaccuucccua

SEQ ID NO: 1535378 - RNA, 19 nt, Homo sapiens
ccucacuggugcauuuaaa

SEQ ID NO: 1535379 - RNA, 15 nt, Homo sapiens
ccucagguuugccug

SEQ ID NO: 1535380 - RNA, 23 nt, Homo sapiens
ccucagucuuugggggauucaaa

SEQ ID NO: 1535381 - RNA, 21 nt, Homo sapiens
ccucauauacuugaauauuau

SEQ ID NO: 1535382 - RNA, 19 nt, Homo sapiens
ccuccagccaauaggcagc

SEQ ID NO: 1535383 - RNA, 13 nt, Homo sapiens
ccuccagccacuu

SEQ ID NO: 1535384 - RNA, 20 nt, Homo sapiens
ccuccagcccucucacugug

SEQ ID NO: 1535385 - RNA, 16 nt, Homo sapiens
ccucccauuugcagac

SEQ ID NO: 1535386 - RNA, 21 nt, Homo sapiens
ccuccccaauuccccagggaa

SEQ ID NO: 1535387 - RNA, 16 nt, Homo sapiens
ccucccccugccagag

SEQ ID NO: 1535388 - RNA, 18 nt, Homo sapiens
ccuccuggcucacagcca

SEQ ID NO: 1535389 - RNA, 12 nt, Homo sapiens
ccucuccaagcu

SEQ ID NO: 1535390 - RNA, 19 nt, Homo sapiens
ccucucucucccuccacuc

SEQ ID NO: 1535391 - RNA, 19 nt, Homo sapiens
ccucugaucaaagcaccuu

SEQ ID NO: 1535392 - RNA, 23 nt, Homo sapiens
ccucugaucaaagcaccuugaau

SEQ ID NO: 1535393 - RNA, 17 nt, Homo sapiens
ccucugcugcuuuccaa

SEQ ID NO: 1535394 - RNA, 20 nt, Homo sapiens
ccucuucccuucaacaugaa

SEQ ID NO: 1535395 - RNA, 14 nt, Homo sapiens
ccucuuuaccauag

SEQ ID NO: 1535396 - RNA, 23 nt, Homo sapiens
cuucccaaccuccccugguccug

SEQ ID NO: 1535397 - RNA, 21 nt, Homo sapiens
cuucccaugucuuucuccaaa

SEQ ID NO: 1535398 - RNA, 16 nt, Homo sapiens
cuuccccaacgaaaag

SEQ ID NO: 1535399 - RNA, 21 nt, Homo sapiens
cuuccccauugccuucugggg

SEQ ID NO: 1535400 - RNA, 14 nt, Homo sapiens
cuucccuaguucuu

SEQ ID NO: 1535401 - RNA, 14 nt, Homo sapiens
cuuccucuuaccug

SEQ ID NO: 1535402 - RNA, 15 nt, Homo sapiens
cuuccuguccagaga

SEQ ID NO: 1535403 - RNA, 16 nt, Homo sapiens
cuuccuguccagagag

SEQ ID NO: 1535404 - RNA, 14 nt, Homo sapiens
cuucuccacuggau

SEQ ID NO: 1535405 - RNA, 17 nt, Homo sapiens
cuucucgccccucagug

SEQ ID NO: 1535406 - RNA, 13 nt, Homo sapiens
cuucugaccacac

SEQ ID NO: 1535407 - RNA, 16 nt, Homo sapiens
cuucuguucugcagac

SEQ ID NO: 1535408 - RNA, 21 nt, Homo sapiens
cuucuuacaauaauucuauga

SEQ ID NO: 1535409 - RNA, 13 nt, Homo sapiens
cuucuucuugacc

SEQ ID NO: 1535410 - RNA, 19 nt, Homo sapiens
cuucuuuacuaacacuggc

SEQ ID NO: 1535411 - RNA, 16 nt, Homo sapiens
cuucuuuuaaaccauu

SEQ ID NO: 1535412 - RNA, 14 nt, Homo sapiens
cuugacuuugccac

SEQ ID NO: 1535413 - RNA, 14 nt, Homo sapiens
cuugauuuuagccu

SEQ ID NO: 1535414 - RNA, 14 nt, Homo sapiens
cuugcaagucccau

SEQ ID NO: 1535415 - RNA, 14 nt, Homo sapiens
cuugcccaugcaca

SEQ ID NO: 1535416 - RNA, 12 nt, Homo sapiens
cuugcuuucaca

SEQ ID NO: 1535417 - RNA, 22 nt, Homo sapiens
cuuggcgagauuugggggugcu

SEQ ID NO: 1535418 - RNA, 19 nt, Homo sapiens
cuugggaguguugucacac

SEQ ID NO: 1535419 - RNA, 15 nt, Homo sapiens
cuuggguaauuaaaa

SEQ ID NO: 1535420 - RNA, 23 nt, Homo sapiens
cuugguguguucguggagccaca

SEQ ID NO: 1535421 - RNA, 17 nt, Homo sapiens
cuuuaaagacuugauga

SEQ ID NO: 1535422 - RNA, 16 nt, Homo sapiens
cuuuaccaugcucaau

SEQ ID NO: 1535423 - RNA, 16 nt, Homo sapiens
cuuuagguauuacaca

SEQ ID NO: 1535424 - RNA, 14 nt, Homo sapiens
cuuuauagcuuugg

SEQ ID NO: 1535425 - RNA, 19 nt, Homo sapiens
cuuuauguuacuacaugca

SEQ ID NO: 1535426 - RNA, 14 nt, Homo sapiens
cuuucacuaugucc

SEQ ID NO: 1535427 - RNA, 14 nt, Homo sapiens
cuuucaguuugucc

SEQ ID NO: 1535428 - RNA, 16 nt, Homo sapiens
cuuucauucccuuuca

SEQ ID NO: 1535429 - RNA, 22 nt, Homo sapiens
cuuuccagaacuaccaaaauga

SEQ ID NO: 1535430 - RNA, 18 nt, Homo sapiens
cuuuccucagcaccuggg

SEQ ID NO: 1535431 - RNA, 15 nt, Homo sapiens
cuuucugaaauucac

SEQ ID NO: 1535432 - RNA, 15 nt, Homo sapiens
cuuugacacuuuuca

SEQ ID NO: 1535433 - RNA, 22 nt, Homo sapiens
cuuugacacuuuucauaucauu

SEQ ID NO: 1535434 - RNA, 18 nt, Homo sapiens
cuuugcuggaguccuguu

SEQ ID NO: 1535435 - RNA, 18 nt, Homo sapiens
cuuugcuuguccugcuca

SEQ ID NO: 1535436 - RNA, 19 nt, Homo sapiens
cuuuggaugggucacuugu

SEQ ID NO: 1535437 - RNA, 22 nt, Homo sapiens
cuuuggcacacccucucugucc

SEQ ID NO: 1535438 - RNA, 19 nt, Homo sapiens
cuuuguauacaaguacugg

SEQ ID NO: 1535439 - RNA, 17 nt, Homo sapiens
cuuuguaugcacuuugu

SEQ ID NO: 1535440 - RNA, 13 nt, Homo sapiens
cuuugugcaauau

SEQ ID NO: 1535441 - RNA, 21 nt, Homo sapiens
cuuuuauguguugaugacuca

SEQ ID NO: 1535442 - RNA, 20 nt, Homo sapiens
cuuuuauucauuagcuguga

SEQ ID NO: 1535443 - RNA, 19 nt, Homo sapiens
cuuuuauucuaacuuuuau

SEQ ID NO: 1535444 - RNA, 14 nt, Homo sapiens
cuuuucuccaugag

SEQ ID NO: 1535445 - RNA, 15 nt, Homo sapiens
cuuuuggagcugaga

SEQ ID NO: 1535446 - RNA, 16 nt, Homo sapiens
cuuuugucauguggcu

SEQ ID NO: 1535447 - RNA, 15 nt, Homo sapiens
cuuuuguucauggga

SEQ ID NO: 1535448 - RNA, 20 nt, Homo sapiens
cuuuuuaguguuuugcaagg

SEQ ID NO: 1535449 - RNA, 12 nt, Homo sapiens
gaaaaacuauua

SEQ ID NO: 1535450 - RNA, 21 nt, Homo sapiens
gaaaaauuguagagugcccau

SEQ ID NO: 1535451 - RNA, 16 nt, Homo sapiens
gaaaacaugucuguga

SEQ ID NO: 1535452 - RNA, 22 nt, Homo sapiens
gaaaaccucauuuaccauaaaa

SEQ ID NO: 1535453 - RNA, 18 nt, Homo sapiens
gaaaagaaaaaaaauaau

SEQ ID NO: 1535454 - RNA, 16 nt, Homo sapiens
gaaaagcucacuucaa

SEQ ID NO: 1535455 - RNA, 22 nt, Homo sapiens
gaaaaggcacgcuggcuuguga

SEQ ID NO: 1535456 - RNA, 16 nt, Homo sapiens
gaaaaggugauuguca

SEQ ID NO: 1535457 - RNA, 22 nt, Homo sapiens
gaaaaguauuuccaacuuguca

SEQ ID NO: 1535458 - RNA, 17 nt, Homo sapiens
gaaaaguuauguagaaa

SEQ ID NO: 1535459 - RNA, 17 nt, Homo sapiens
gaaaauaaauacauaaa

SEQ ID NO: 1535460 - RNA, 21 nt, Homo sapiens
gaaaauaguggcaggacuguc

SEQ ID NO: 1535461 - RNA, 15 nt, Homo sapiens
gaaaauuaugagucu

SEQ ID NO: 1535462 - RNA, 17 nt, Homo sapiens
gaaacaauuucuguguc

SEQ ID NO: 1535463 - RNA, 16 nt, Homo sapiens
gaaacagccucuccaa

SEQ ID NO: 1535464 - RNA, 19 nt, Homo sapiens
gaaacauuuggaagcccca

SEQ ID NO: 1535465 - RNA, 19 nt, Homo sapiens
gaaaccuaaggcaacauuu

SEQ ID NO: 1535466 - RNA, 19 nt, Homo sapiens
gaaacugacuugcugugac

SEQ ID NO: 1535467 - RNA, 19 nt, Homo sapiens
gaaagacaguaaagaccau

SEQ ID NO: 1535468 - RNA, 19 nt, Homo sapiens
gaaagaguaaaaccaaagg

SEQ ID NO: 1535469 - RNA, 15 nt, Homo sapiens
gaaagaguugcagua

SEQ ID NO: 1535470 - RNA, 19 nt, Homo sapiens
gaaagaguugccauaauga

SEQ ID NO: 1535471 - RNA, 20 nt, Homo sapiens
gaaagugagcaguguuagcu

SEQ ID NO: 1535472 - RNA, 20 nt, Homo sapiens
gaaauccuaguggccuccca

SEQ ID NO: 1535473 - RNA, 13 nt, Homo sapiens
gaaauguuuccag

SEQ ID NO: 1535474 - RNA, 17 nt, Homo sapiens
gaaauuauaucuguggu

SEQ ID NO: 1535475 - RNA, 14 nt, Homo sapiens
gaaauucacaaagu

SEQ ID NO: 1535476 - RNA, 16 nt, Homo sapiens
gaaauucacaaaguua

SEQ ID NO: 1535477 - RNA, 20 nt, Homo sapiens
gaaauuuuuuuccagaauug

SEQ ID NO: 1535478 - RNA, 14 nt, Homo sapiens
gaacaaugaaugcu

SEQ ID NO: 1535479 - RNA, 20 nt, Homo sapiens
gaacaggaggaacuggucca

SEQ ID NO: 1535480 - RNA, 18 nt, Homo sapiens
gaaccaacgggucugugg

SEQ ID NO: 1535481 - RNA, 13 nt, Homo sapiens
gaaccauggaccu

SEQ ID NO: 1535482 - RNA, 22 nt, Homo sapiens
gaacccuuggagccaauggaga

SEQ ID NO: 1535483 - RNA, 17 nt, Homo sapiens
gaaccucccuuucccca

SEQ ID NO: 1535484 - RNA, 14 nt, Homo sapiens
gaacgcaugcaggg

SEQ ID NO: 1535485 - RNA, 12 nt, Homo sapiens
gaacuagccaug

SEQ ID NO: 1535486 - RNA, 19 nt, Homo sapiens
gaacucagcugucuguggc

SEQ ID NO: 1535487 - RNA, 14 nt, Homo sapiens
gaacucaugugauu

SEQ ID NO: 1535488 - RNA, 15 nt, Homo sapiens
gaacugcaacacugg

SEQ ID NO: 1535489 - RNA, 13 nt, Homo sapiens
gaacugcugcugg

SEQ ID NO: 1535490 - RNA, 18 nt, Homo sapiens
gaacuguaaauaugucac

SEQ ID NO: 1535491 - RNA, 23 nt, Homo sapiens
gaacuuaauuaccuaagagccac

SEQ ID NO: 1535492 - RNA, 14 nt, Homo sapiens
gaagaacucaccag

SEQ ID NO: 1535493 - RNA, 20 nt, Homo sapiens
gaagaacuugucccucaggc

SEQ ID NO: 1535494 - RNA, 22 nt, Homo sapiens
gaagacaaauaguguggaguga

SEQ ID NO: 1535495 - RNA, 16 nt, Homo sapiens
gaagagagauauaucu

SEQ ID NO: 1535496 - RNA, 18 nt, Homo sapiens
gaagagaguauggugcug

SEQ ID NO: 1535497 - RNA, 16 nt, Homo sapiens
gaagcagccuccacuu

SEQ ID NO: 1535498 - RNA, 22 nt, Homo sapiens
gaagccaagucagcuuugccuu

SEQ ID NO: 1535499 - RNA, 17 nt, Homo sapiens
gaaggaaggagccagcu

SEQ ID NO: 1535500 - RNA, 15 nt, Homo sapiens
gaaggcccagccugu

SEQ ID NO: 1535501 - RNA, 15 nt, Homo sapiens
gaagggacuggucca

SEQ ID NO: 1535502 - RNA, 15 nt, Homo sapiens
gaaggucucaugccu

SEQ ID NO: 1535503 - RNA, 17 nt, Homo sapiens
gaagugggagugggaga

SEQ ID NO: 1535504 - RNA, 18 nt, Homo sapiens
gaagugguaggaaagccu

SEQ ID NO: 1535505 - RNA, 22 nt, Homo sapiens
gaauaaaacuuuucugcugaua

SEQ ID NO: 1535506 - RNA, 12 nt, Homo sapiens
gaauaaagccac

SEQ ID NO: 1535507 - RNA, 19 nt, Homo sapiens
gaauaaugacguauuguga

SEQ ID NO: 1535508 - RNA, 11 nt, Homo sapiens
gaauacuguau

SEQ ID NO: 1535509 - RNA, 24 nt, Homo sapiens
gaauacuguauuguuacagcugaa

SEQ ID NO: 1535510 - RNA, 18 nt, Homo sapiens
gaauaucaggaugccuua

SEQ ID NO: 1535511 - RNA, 13 nt, Homo sapiens
gaauauuguuaaa

SEQ ID NO: 1535512 - RNA, 14 nt, Homo sapiens
gaaucacuugacuu

SEQ ID NO: 1535513 - RNA, 20 nt, Homo sapiens
gaauccccgugcucacagua

SEQ ID NO: 1535514 - RNA, 14 nt, Homo sapiens
gaaugaauccauua

SEQ ID NO: 1535515 - RNA, 20 nt, Homo sapiens
gaaugauaauggaaacuguc

SEQ ID NO: 1535516 - RNA, 12 nt, Homo sapiens
gaauguauauca

SEQ ID NO: 1535517 - RNA, 13 nt, Homo sapiens
gaauugaagucau

SEQ ID NO: 1535518 - RNA, 23 nt, Homo sapiens
gaauuuuuuuuuuuaagcucaaa

SEQ ID NO: 1535519 - RNA, 16 nt, Homo sapiens
gacaaccgaugcucca

SEQ ID NO: 1535520 - RNA, 22 nt, Homo sapiens
gacaagaaauccuaguggccuc

SEQ ID NO: 1535521 - RNA, 17 nt, Homo sapiens
gacaaggccccagagac

SEQ ID NO: 1535522 - RNA, 19 nt, Homo sapiens
gacaauuucaaaaugcaug

SEQ ID NO: 1535523 - RNA, 23 nt, Homo sapiens
gacacagaggacggcuuccccau

SEQ ID NO: 1535524 - RNA, 15 nt, Homo sapiens
gacacggccaugacc

SEQ ID NO: 1535525 - RNA, 16 nt, Homo sapiens
gacagacacugcugaa

SEQ ID NO: 1535526 - RNA, 20 nt, Homo sapiens
gcuuguuuaagguucuugcu

SEQ ID NO: 1535527 - RNA, 17 nt, Homo sapiens
gcuuguuucuauacugu

SEQ ID NO: 1535528 - RNA, 14 nt, Homo sapiens
gcuuguuuguucua

SEQ ID NO: 1535529 - RNA, 18 nt, Homo sapiens
gcuuuacagugccacgac

SEQ ID NO: 1535530 - RNA, 12 nt, Homo sapiens
gcuuuccuccca

SEQ ID NO: 1535531 - RNA, 20 nt, Homo sapiens
gcuuucuuaacuauccuaac

SEQ ID NO: 1535532 - RNA, 17 nt, Homo sapiens
gcuuucuuuccaauccu

SEQ ID NO: 1535533 - RNA, 14 nt, Homo sapiens
gcuuuggugccugg

SEQ ID NO: 1535534 - RNA, 17 nt, Homo sapiens
gcuuuuccauucugggu

SEQ ID NO: 1535535 - RNA, 15 nt, Homo sapiens
gcuuuuguacguuaa

SEQ ID NO: 1535536 - RNA, 18 nt, Homo sapiens
ggaaaaaggcuucuccac

SEQ ID NO: 1535537 - RNA, 13 nt, Homo sapiens
ggaaagccaguga

SEQ ID NO: 1535538 - RNA, 15 nt, Homo sapiens
ggaaagccucacuga

SEQ ID NO: 1535539 - RNA, 16 nt, Homo sapiens
ggaaaggagaguacuu

SEQ ID NO: 1535540 - RNA, 19 nt, Homo sapiens
ggaaauggcuugaagccaa

SEQ ID NO: 1535541 - RNA, 15 nt, Homo sapiens
ggaaauuauuggaaa

SEQ ID NO: 1535542 - RNA, 14 nt, Homo sapiens
ggaacaaaucucuc

SEQ ID NO: 1535543 - RNA, 15 nt, Homo sapiens
ggaacugguccaggc

SEQ ID NO: 1535544 - RNA, 17 nt, Homo sapiens
ggaagcaccagccucag

SEQ ID NO: 1535545 - RNA, 15 nt, Homo sapiens
ggaaggaagagcaag

SEQ ID NO: 1535546 - RNA, 17 nt, Homo sapiens
ggacagacccagggugg

SEQ ID NO: 1535547 - RNA, 22 nt, Homo sapiens
ggacagaucaauggcgcagugc

SEQ ID NO: 1535548 - RNA, 18 nt, Homo sapiens
ggacagcggguaaaaaga

SEQ ID NO: 1535549 - RNA, 12 nt, Homo sapiens
ggacgcaugcag

SEQ ID NO: 1535550 - RNA, 17 nt, Homo sapiens
ggacuauuucuggcacu

SEQ ID NO: 1535551 - RNA, 13 nt, Homo sapiens
ggagaacuugaac

SEQ ID NO: 1535552 - RNA, 17 nt, Homo sapiens
ggagacaaaacuagaga

SEQ ID NO: 1535553 - RNA, 16 nt, Homo sapiens
ggagacugucucaaga

SEQ ID NO: 1535554 - RNA, 14 nt, Homo sapiens
ggagaguacuuugg

SEQ ID NO: 1535555 - RNA, 10 nt, Homo sapiens
ggagccacuc

SEQ ID NO: 1535556 - RNA, 19 nt, Homo sapiens
ggagcccugggguuuccac

SEQ ID NO: 1535557 - RNA, 17 nt, Homo sapiens
ggagcguguacuacccc

SEQ ID NO: 1535558 - RNA, 12 nt, Homo sapiens
ggaguccagacc

SEQ ID NO: 1535559 - RNA, 24 nt, Homo sapiens
ggagugauuuuggccacacuguca

SEQ ID NO: 1535560 - RNA, 19 nt, Homo sapiens
ggauaauaacuagaucucc

SEQ ID NO: 1535561 - RNA, 17 nt, Homo sapiens
ggauacagaaugaaucc

SEQ ID NO: 1535562 - RNA, 20 nt, Homo sapiens
ggauacugcccggggcagcu

SEQ ID NO: 1535563 - RNA, 13 nt, Homo sapiens
ggauggaaaggga

SEQ ID NO: 1535564 - RNA, 21 nt, Homo sapiens
ggauucuaaauuaugugaauu

SEQ ID NO: 1535565 - RNA, 20 nt, Homo sapiens
ggcacaaauuguacauuuga

SEQ ID NO: 1535566 - RNA, 21 nt, Homo sapiens
ggcacacccucucuguccaau

SEQ ID NO: 1535567 - RNA, 14 nt, Homo sapiens
ggcagaaccugaaa

SEQ ID NO: 1535568 - RNA, 16 nt, Homo sapiens
ggcagaauggugggcu

SEQ ID NO: 1535569 - RNA, 19 nt, Homo sapiens
ggcagaauggugggcucca

SEQ ID NO: 1535570 - RNA, 22 nt, Homo sapiens
ggcagccccuccccauggugca

SEQ ID NO: 1535571 - RNA, 21 nt, Homo sapiens
ggcagcugucucaaaccucca

SEQ ID NO: 1535572 - RNA, 14 nt, Homo sapiens
ggcagcuucgugug

SEQ ID NO: 1535573 - RNA, 12 nt, Homo sapiens
ggcagcuuucuu

SEQ ID NO: 1535574 - RNA, 19 nt, Homo sapiens
ggcaugaaggugucauaca

SEQ ID NO: 1535575 - RNA, 18 nt, Homo sapiens
ggcauggccagguggcca

SEQ ID NO: 1535576 - RNA, 19 nt, Homo sapiens
ggcauuagcuaaaaccuuc

SEQ ID NO: 1535577 - RNA, 19 nt, Homo sapiens
ggccagaagggggccauga

SEQ ID NO: 1535578 - RNA, 22 nt, Homo sapiens
ggccagggcucuggcagguggc

SEQ ID NO: 1535579 - RNA, 20 nt, Homo sapiens
ggccagggucucgucaggag

SEQ ID NO: 1535580 - RNA, 13 nt, Homo sapiens
ggcccaauucugc

SEQ ID NO: 1535581 - RNA, 18 nt, Homo sapiens
ggcccaauucugccacuu

SEQ ID NO: 1535582 - RNA, 14 nt, Homo sapiens
ggcccccacaggag

SEQ ID NO: 1535583 - RNA, 14 nt, Homo sapiens
ggccccuugcaaag

SEQ ID NO: 1535584 - RNA, 22 nt, Homo sapiens
ggcccuguuaaggcauccacuu

SEQ ID NO: 1535585 - RNA, 23 nt, Homo sapiens
ggcccuuccucuccacugccuuc

SEQ ID NO: 1535586 - RNA, 13 nt, Homo sapiens
ggccucagggacc

SEQ ID NO: 1535587 - RNA, 17 nt, Homo sapiens
ggccuucuccacaggga

SEQ ID NO: 1535588 - RNA, 19 nt, Homo sapiens
ggcggucaauaauugugga

SEQ ID NO: 1535589 - RNA, 15 nt, Homo sapiens
ggcgucugucuucaa

SEQ ID NO: 1535590 - RNA, 14 nt, Homo sapiens
ggcgugacuucaga

SEQ ID NO: 1535591 - RNA, 14 nt, Homo sapiens
ggcucccacugccc

SEQ ID NO: 1535592 - RNA, 15 nt, Homo sapiens
ggcucccagggccau

SEQ ID NO: 1535593 - RNA, 17 nt, Homo sapiens
ggcucccagggccauga

SEQ ID NO: 1535594 - RNA, 15 nt, Homo sapiens
ggcucuaauguacaa

SEQ ID NO: 1535595 - RNA, 21 nt, Homo sapiens
ggcucuaauguacaauaaagc

SEQ ID NO: 1535596 - RNA, 11 nt, Homo sapiens
ggcucucucac

SEQ ID NO: 1535597 - RNA, 20 nt, Homo sapiens
ggcugccgugcacggggcca

SEQ ID NO: 1535598 - RNA, 12 nt, Homo sapiens
ggcuggcuuccu

SEQ ID NO: 1535599 - RNA, 18 nt, Homo sapiens
ggcuguacgucugguguu

SEQ ID NO: 1535600 - RNA, 20 nt, Homo sapiens
ggcugucagucguguugcuu

SEQ ID NO: 1535601 - RNA, 17 nt, Homo sapiens
ggcuucagccccugggg

SEQ ID NO: 1535602 - RNA, 14 nt, Homo sapiens
ggcuucccaugucu

SEQ ID NO: 1535603 - RNA, 18 nt, Homo sapiens
ggcuuuccucagcaccug

SEQ ID NO: 1535604 - RNA, 22 nt, Homo sapiens
gggacacggccucuggggagac

SEQ ID NO: 1535605 - RNA, 14 nt, Homo sapiens
gggacuuacaugau

SEQ ID NO: 1535606 - RNA, 17 nt, Homo sapiens
gggagacccugggagag

SEQ ID NO: 1535607 - RNA, 23 nt, Homo sapiens
gggagaccgaguguggagcugcu

SEQ ID NO: 1535608 - RNA, 22 nt, Homo sapiens
gggagacuuaggccagagguga

SEQ ID NO: 1535609 - RNA, 21 nt, Homo sapiens
gggagauccgcccugggcucu

SEQ ID NO: 1535610 - RNA, 21 nt, Homo sapiens
gggagaucuuggggugcagca

SEQ ID NO: 1535611 - RNA, 13 nt, Homo sapiens
gggaugcuugccu

SEQ ID NO: 1535612 - RNA, 22 nt, Homo sapiens
gggcacuggccuagagccucac

SEQ ID NO: 1535613 - RNA, 13 nt, Homo sapiens
gggcacugguggc

SEQ ID NO: 1535614 - RNA, 18 nt, Homo sapiens
gggcagccugugggagaa

SEQ ID NO: 1535615 - RNA, 13 nt, Homo sapiens
gggcaggguucua

SEQ ID NO: 1535616 - RNA, 21 nt, Homo sapiens
gggccaaauucccaaccugcu

SEQ ID NO: 1535617 - RNA, 15 nt, Homo sapiens
gggcccccacaggag

SEQ ID NO: 1535618 - RNA, 15 nt, Homo sapiens
gggccuucauugucu

SEQ ID NO: 1535619 - RNA, 14 nt, Homo sapiens
gggcugagacugga

SEQ ID NO: 1535620 - RNA, 16 nt, Homo sapiens
ggggacugcaugcaag

SEQ ID NO: 1535621 - RNA, 22 nt, Homo sapiens
ggggaggccaagugcaggcugg

SEQ ID NO: 1535622 - RNA, 21 nt, Homo sapiens
ggggaugucuugagauguauu

SEQ ID NO: 1535623 - RNA, 14 nt, Homo sapiens
ggggcacagccaga

SEQ ID NO: 1535624 - RNA, 21 nt, Homo sapiens
ggggcagggccguagacucac

SEQ ID NO: 1535625 - RNA, 14 nt, Homo sapiens
gggugucugcuaaa

SEQ ID NO: 1535626 - RNA, 19 nt, Homo sapiens
ggguuuucaccuuagcaac

SEQ ID NO: 1535627 - RNA, 14 nt, Homo sapiens
gguaaguuggcuca

SEQ ID NO: 1535628 - RNA, 23 nt, Homo sapiens
gguauaguuuugucacaauuaua

SEQ ID NO: 1535629 - RNA, 23 nt, Homo sapiens
ggucaccuuccugggcagcccag

SEQ ID NO: 1535630 - RNA, 22 nt, Homo sapiens
gguccacuuugguaauguguca

SEQ ID NO: 1535631 - RNA, 18 nt, Homo sapiens
ggucccgaauggagucca

SEQ ID NO: 1535632 - RNA, 21 nt, Homo sapiens
ggucccgagcccccuguccuu

SEQ ID NO: 1535633 - RNA, 15 nt, Homo sapiens
gguccuucugacccc

SEQ ID NO: 1535634 - RNA, 21 nt, Homo sapiens
ggucucgucaggaggugccug

SEQ ID NO: 1535635 - RNA, 18 nt, Homo sapiens
ggugaaggcccagccugu

SEQ ID NO: 1535636 - RNA, 13 nt, Homo sapiens
ggugagggugaca

SEQ ID NO: 1535637 - RNA, 18 nt, Homo sapiens
gguggcaugaguugaaga

SEQ ID NO: 1535638 - RNA, 21 nt, Homo sapiens
ggugggccuuccaugggcaug

SEQ ID NO: 1535639 - RNA, 11 nt, Homo sapiens
gguggggcuua

SEQ ID NO: 1535640 - RNA, 20 nt, Homo sapiens
gguguguucguggagccaca

SEQ ID NO: 1535641 - RNA, 13 nt, Homo sapiens
gguguucuuccca

SEQ ID NO: 1535642 - RNA, 15 nt, Homo sapiens
gguguuuucagaaag

SEQ ID NO: 1535643 - RNA, 21 nt, Homo sapiens
gguuggaaagaguugccauaa

SEQ ID NO: 1535644 - RNA, 17 nt, Homo sapiens
gguuguugcaguucaga

SEQ ID NO: 1535645 - RNA, 18 nt, Homo sapiens
guaaaacuaaauguugcg

SEQ ID NO: 1535646 - RNA, 11 nt, Homo sapiens
guaaaugugau

SEQ ID NO: 1535647 - RNA, 19 nt, Homo sapiens
guaagcugcucuauuguag

SEQ ID NO: 1535648 - RNA, 17 nt, Homo sapiens
guacaauaaagcaaugu

SEQ ID NO: 1535649 - RNA, 21 nt, Homo sapiens
guacaauaaagcaauguggua

SEQ ID NO: 1535650 - RNA, 19 nt, Homo sapiens
guacauguggaaaacucac

SEQ ID NO: 1535651 - RNA, 15 nt, Homo sapiens
guacuaccccagaac

SEQ ID NO: 1535652 - RNA, 20 nt, Homo sapiens
guacuauuauccccauuucu

SEQ ID NO: 1535653 - RNA, 23 nt, Homo sapiens
guacuugcucaauaaaggucaua

SEQ ID NO: 1535654 - RNA, 18 nt, Homo sapiens
guagcagagucauuguua

SEQ ID NO: 1535655 - RNA, 18 nt, Homo sapiens
guagcauuucuugauguu

SEQ ID NO: 1535656 - RNA, 21 nt, Homo sapiens
ucuucaggguguuaaggcagu

SEQ ID NO: 1535657 - RNA, 19 nt, Homo sapiens
ucuucccacuuugccacug

SEQ ID NO: 1535658 - RNA, 20 nt, Homo sapiens
ucuucccuuaggcaauggug

SEQ ID NO: 1535659 - RNA, 16 nt, Homo sapiens
ucuucuuuuaaaccau

SEQ ID NO: 1535660 - RNA, 14 nt, Homo sapiens
ucuugcacauggau

SEQ ID NO: 1535661 - RNA, 19 nt, Homo sapiens
ucuugccccccaccccagc

SEQ ID NO: 1535662 - RNA, 19 nt, Homo sapiens
ucuuguguuuuugucuuau

SEQ ID NO: 1535663 - RNA, 22 nt, Homo sapiens
ucuuguuguggaggcugaaaag

SEQ ID NO: 1535664 - RNA, 22 nt, Homo sapiens
ucuuguuuuuuuuuuccacuua

SEQ ID NO: 1535665 - RNA, 16 nt, Homo sapiens
ucuuuacuaacacugg

SEQ ID NO: 1535666 - RNA, 14 nt, Homo sapiens
ucuuuauaaaccau

SEQ ID NO: 1535667 - RNA, 12 nt, Homo sapiens
ucuuuccaaucc

SEQ ID NO: 1535668 - RNA, 16 nt, Homo sapiens
ucuuuguauauuucua

SEQ ID NO: 1535669 - RNA, 14 nt, Homo sapiens
ugaaaaacagcaga

SEQ ID NO: 1535670 - RNA, 21 nt, Homo sapiens
ugaaaaauaguguguccaugc

SEQ ID NO: 1535671 - RNA, 13 nt, Homo sapiens
ugaaaagugcuuu

SEQ ID NO: 1535672 - RNA, 15 nt, Homo sapiens
ugaaacacagucaug

SEQ ID NO: 1535673 - RNA, 14 nt, Homo sapiens
ugaaacauuuggaa

SEQ ID NO: 1535674 - RNA, 14 nt, Homo sapiens
ugaaacugacuugc

SEQ ID NO: 1535675 - RNA, 17 nt, Homo sapiens
ugaaagaggcauuccca

SEQ ID NO: 1535676 - RNA, 13 nt, Homo sapiens
ugaaaguguaaaa

SEQ ID NO: 1535677 - RNA, 15 nt, Homo sapiens
ugaaauuauaucugu

SEQ ID NO: 1535678 - RNA, 14 nt, Homo sapiens
ugaaauuuacaguu

SEQ ID NO: 1535679 - RNA, 20 nt, Homo sapiens
ugaaccucaagcugcaucua

SEQ ID NO: 1535680 - RNA, 15 nt, Homo sapiens
ugaacugcaacacug

SEQ ID NO: 1535681 - RNA, 17 nt, Homo sapiens
ugaacugcaacacugga

SEQ ID NO: 1535682 - RNA, 17 nt, Homo sapiens
ugaagaacucaugugau

SEQ ID NO: 1535683 - RNA, 16 nt, Homo sapiens
ugaagaaucuacuuaa

SEQ ID NO: 1535684 - RNA, 19 nt, Homo sapiens
ugaagauucaggcuugcau

SEQ ID NO: 1535685 - RNA, 16 nt, Homo sapiens
ugaaggauugugaacu

SEQ ID NO: 1535686 - RNA, 18 nt, Homo sapiens
ugaagugaugauggauga

SEQ ID NO: 1535687 - RNA, 15 nt, Homo sapiens
ugaauauuauacuuc

SEQ ID NO: 1535688 - RNA, 21 nt, Homo sapiens
ugaauccucucucuguguuac

SEQ ID NO: 1535689 - RNA, 14 nt, Homo sapiens
ugaaugccagucca

SEQ ID NO: 1535690 - RNA, 21 nt, Homo sapiens
ugaaugccaguccagaugugc

SEQ ID NO: 1535691 - RNA, 17 nt, Homo sapiens
ugacaaggccccagaga

SEQ ID NO: 1535692 - RNA, 12 nt, Homo sapiens
ugacacaacuca

SEQ ID NO: 1535693 - RNA, 20 nt, Homo sapiens
ugacacggccaugaccacuu

SEQ ID NO: 1535694 - RNA, 16 nt, Homo sapiens
ugaccacuuguagucc

SEQ ID NO: 1535695 - RNA, 20 nt, Homo sapiens
ugaccccacuuaugcugcug

SEQ ID NO: 1535696 - RNA, 16 nt, Homo sapiens
ugaccuuuagguauua

SEQ ID NO: 1535697 - RNA, 19 nt, Homo sapiens
ugacucuuuauugucugua

SEQ ID NO: 1535698 - RNA, 12 nt, Homo sapiens
ugacugguggaa

SEQ ID NO: 1535699 - RNA, 22 nt, Homo sapiens
ugacuguugcuguaaaagugaa

SEQ ID NO: 1535700 - RNA, 14 nt, Homo sapiens
ugagaaaacuguga

SEQ ID NO: 1535701 - RNA, 16 nt, Homo sapiens
ugagaaaagcuuugaa

SEQ ID NO: 1535702 - RNA, 12 nt, Homo sapiens
ugagaaagacaa

SEQ ID NO: 1535703 - RNA, 23 nt, Homo sapiens
ugagaaauuuuuuuccagaauug

SEQ ID NO: 1535704 - RNA, 21 nt, Homo sapiens
ugagaaucgaccucacuguca

SEQ ID NO: 1535705 - RNA, 13 nt, Homo sapiens
ugagauacuuugc

SEQ ID NO: 1535706 - RNA, 14 nt, Homo sapiens
ugagcaccuacuua

SEQ ID NO: 1535707 - RNA, 21 nt, Homo sapiens
ugagcuauaauguuucccuca

SEQ ID NO: 1535708 - RNA, 21 nt, Homo sapiens
ugagcucuucauguuucagga

SEQ ID NO: 1535709 - RNA, 20 nt, Homo sapiens
ugaggcggggagcaugaaga

SEQ ID NO: 1535710 - RNA, 17 nt, Homo sapiens
ugagggaaaacauaaua

SEQ ID NO: 1535711 - RNA, 13 nt, Homo sapiens
ugagggcccuucc

SEQ ID NO: 1535712 - RNA, 24 nt, Homo sapiens
ugagguuaaggggaucuaaaagga

SEQ ID NO: 1535713 - RNA, 22 nt, Homo sapiens
ugagucucuaugaucuuggcac

SEQ ID NO: 1535714 - RNA, 14 nt, Homo sapiens
ugauacaguauuau

SEQ ID NO: 1535715 - RNA, 16 nt, Homo sapiens
ugauagaauaaagccu

SEQ ID NO: 1535716 - RNA, 19 nt, Homo sapiens
ugauaugagucacugccuu

SEQ ID NO: 1535717 - RNA, 22 nt, Homo sapiens
ugauauucaaucuuaacaaaag

SEQ ID NO: 1535718 - RNA, 15 nt, Homo sapiens
ugaugaaaaccaccc

SEQ ID NO: 1535719 - RNA, 14 nt, Homo sapiens
ugaugaauuacuuc

SEQ ID NO: 1535720 - RNA, 15 nt, Homo sapiens
ugauuaacucagucc

SEQ ID NO: 1535721 - RNA, 13 nt, Homo sapiens
ugauucuaaaggg

SEQ ID NO: 1535722 - RNA, 16 nt, Homo sapiens
ugauucuccucuccca

SEQ ID NO: 1535723 - RNA, 12 nt, Homo sapiens
ugauugugaaac

SEQ ID NO: 1535724 - RNA, 21 nt, Homo sapiens
ugauuguuuaauuguagguca

SEQ ID NO: 1535725 - RNA, 14 nt, Homo sapiens
ugcaaaacauaucu

SEQ ID NO: 1535726 - RNA, 19 nt, Homo sapiens
ugcaaaagguuaagccaua

SEQ ID NO: 1535727 - RNA, 14 nt, Homo sapiens
ugcaaagcauuuga

SEQ ID NO: 1535728 - RNA, 17 nt, Homo sapiens
ugcaaauccccucccca

SEQ ID NO: 1535729 - RNA, 20 nt, Homo sapiens
ugcaaccacugcaauaucuu

SEQ ID NO: 1535730 - RNA, 15 nt, Homo sapiens
ugcaagucccaugau

SEQ ID NO: 1535731 - RNA, 12 nt, Homo sapiens
ugcacacaccug

SEQ ID NO: 1535732 - RNA, 22 nt, Homo sapiens
ugcacccuggauuugcauacau

SEQ ID NO: 1535733 - RNA, 21 nt, Homo sapiens
ugcacugcccuccgcccuucc

SEQ ID NO: 1535734 - RNA, 17 nt, Homo sapiens
ugcagaaauugaccuga

SEQ ID NO: 1535735 - RNA, 21 nt, Homo sapiens
ugcagaauacaguaagcugcu

SEQ ID NO: 1535736 - RNA, 17 nt, Homo sapiens
ugcagacucacuguggg

SEQ ID NO: 1535737 - RNA, 17 nt, Homo sapiens
ugcaggguccccaagga

SEQ ID NO: 1535738 - RNA, 17 nt, Homo sapiens
ugcaguuuuuguuuaca

SEQ ID NO: 1535739 - RNA, 22 nt, Homo sapiens
ugcauaaauauuagcaaagcau

SEQ ID NO: 1535740 - RNA, 17 nt, Homo sapiens
ugcauaaccgcacagac

SEQ ID NO: 1535741 - RNA, 14 nt, Homo sapiens
ugcauaagccucag

SEQ ID NO: 1535742 - RNA, 20 nt, Homo sapiens
ugccaaaaacuaaaauucaa

SEQ ID NO: 1535743 - RNA, 23 nt, Homo sapiens
ugccacauggagcuugacuucau

SEQ ID NO: 1535744 - RNA, 17 nt, Homo sapiens
ugccaggggcagugaag

SEQ ID NO: 1535745 - RNA, 20 nt, Homo sapiens
ugcccagacucaaggccucc

SEQ ID NO: 1535746 - RNA, 19 nt, Homo sapiens
ugccccagagaagccucag

SEQ ID NO: 1535747 - RNA, 18 nt, Homo sapiens
ugcccccuucucccacac

SEQ ID NO: 1535748 - RNA, 15 nt, Homo sapiens
ugcccugcucuucag

SEQ ID NO: 1535749 - RNA, 19 nt, Homo sapiens
ugcccuuaaaauaaugauu

SEQ ID NO: 1535750 - RNA, 21 nt, Homo sapiens
ugcccuucuuccauucccaga

SEQ ID NO: 1535751 - RNA, 23 nt, Homo sapiens
ugccguucgcugagucccagcaa

SEQ ID NO: 1535752 - RNA, 13 nt, Homo sapiens
ugccuagggccug

SEQ ID NO: 1535753 - RNA, 14 nt, Homo sapiens
ugccuauaaaggaa

SEQ ID NO: 1535754 - RNA, 23 nt, Homo sapiens
ugccucccuggcagcacaggaaa

SEQ ID NO: 1535755 - RNA, 18 nt, Homo sapiens
ugccugucccucucaggc

SEQ ID NO: 1535756 - RNA, 21 nt, Homo sapiens
ugccuuuuaguuccugugcac

SEQ ID NO: 1535757 - RNA, 17 nt, Homo sapiens
ugcgacaccaccaacag

SEQ ID NO: 1535758 - RNA, 12 nt, Homo sapiens
ugcgauggugcu

SEQ ID NO: 1535759 - RNA, 21 nt, Homo sapiens
ugcguaggagagaacagggau

SEQ ID NO: 1535760 - RNA, 21 nt, Homo sapiens
ugcguuuuagaguaugcaaga

SEQ ID NO: 1535761 - RNA, 19 nt, Homo sapiens
ugcuaauccaggacagcau

SEQ ID NO: 1535762 - RNA, 20 nt, Homo sapiens
ugcuaucucgcuagccauau

SEQ ID NO: 1535763 - RNA, 20 nt, Homo sapiens
ugcucaauaaaggucauauu

SEQ ID NO: 1535764 - RNA, 14 nt, Homo sapiens
ugcuccaggcuucc

SEQ ID NO: 1535765 - RNA, 15 nt, Homo sapiens
ugcuccuaccuauca

SEQ ID NO: 1535766 - RNA, 19 nt, Homo sapiens
ugcuccucugccugugccc

SEQ ID NO: 1535767 - RNA, 14 nt, Homo sapiens
ugcucucugcucac

SEQ ID NO: 1535768 - RNA, 14 nt, Homo sapiens
ugcucuuuaccuug

SEQ ID NO: 1535769 - RNA, 20 nt, Homo sapiens
ugcugaguauguuaagcucu

SEQ ID NO: 1535770 - RNA, 23 nt, Homo sapiens
ugcugauuuuuuuucugauaaau

SEQ ID NO: 1535771 - RNA, 13 nt, Homo sapiens
ugcugcacugccc

SEQ ID NO: 1535772 - RNA, 14 nt, Homo sapiens
ugcuggcugccuua

SEQ ID NO: 1535773 - RNA, 12 nt, Homo sapiens
ugcuuuccaaca

SEQ ID NO: 1535774 - RNA, 17 nt, Homo sapiens
ugcuuuuggagcugaga

SEQ ID NO: 1535775 - RNA, 17 nt, Homo sapiens
uggaacugcugccauga

SEQ ID NO: 1535776 - RNA, 21 nt, Homo sapiens
uggaagaggaauccagugaau

SEQ ID NO: 1535777 - RNA, 17 nt, Homo sapiens
uggaagaggcaccuguc

SEQ ID NO: 1535778 - RNA, 13 nt, Homo sapiens
uggaccaaaugga

SEQ ID NO: 1535779 - RNA, 18 nt, Homo sapiens
uggacucuacacugugaa

SEQ ID NO: 1535780 - RNA, 14 nt, Homo sapiens
uggacuuccaaucu

SEQ ID NO: 1535781 - RNA, 17 nt, Homo sapiens
uggagagagaguucuca

SEQ ID NO: 1535782 - RNA, 16 nt, Homo sapiens
uggaguccuguucuca

SEQ ID NO: 1535783 - RNA, 18 nt, Homo sapiens
uggagugcaguggugcga

SEQ ID NO: 1535784 - RNA, 21 nt, Homo sapiens
uggauacagaaugaaucccau

SEQ ID NO: 1535785 - RNA, 19 nt, Homo sapiens
uggauuuagagacuguaaa

SEQ ID NO: 1535786 - RNA, 19 nt, Homo sapiens
uggauuuucuuucuaugua

SEQ ID NO: 1535787 - RNA, 19 nt, Homo sapiens
uggcaauaaggaucuuccc

SEQ ID NO: 1535788 - RNA, 16 nt, Homo sapiens
uggcagccgugccuuc

SEQ ID NO: 1535789 - RNA, 16 nt, Homo sapiens
uggcagugagauguca

SEQ ID NO: 1535790 - RNA, 14 nt, Homo sapiens
uggccacacuguca

SEQ ID NO: 1535791 - RNA, 24 nt, Homo sapiens
uggccccuucacuucugaccacac

SEQ ID NO: 1535792 - RNA, 15 nt, Homo sapiens
uggcccucuuugaaa

SEQ ID NO: 1535793 - RNA, 16 nt, Homo sapiens
uggcccuucacugucc

SEQ ID NO: 1535794 - RNA, 14 nt, Homo sapiens
uggccgucgcugug

SEQ ID NO: 1535795 - RNA, 16 nt, Homo sapiens
uggcuagucacauauc

SEQ ID NO: 1535796 - RNA, 14 nt, Homo sapiens
uggcucagccucaa

SEQ ID NO: 1535797 - RNA, 21 nt, Homo sapiens
uggcuggguuugggcagugga

SEQ ID NO: 1535798 - RNA, 19 nt, Homo sapiens
ugggaagaaagauucaauu

SEQ ID NO: 1535799 - RNA, 21 nt, Homo sapiens
ugggaagggaucccuuuguau

SEQ ID NO: 1535800 - RNA, 13 nt, Homo sapiens
ugggagcacagcu

SEQ ID NO: 1535801 - RNA, 15 nt, Homo sapiens
ugggcaaggccuuug

SEQ ID NO: 1535802 - RNA, 21 nt, Homo sapiens
ugggcaccuggggagugggac

SEQ ID NO: 1535803 - RNA, 13 nt, Homo sapiens
ugggcccuaggca

SEQ ID NO: 1535804 - RNA, 16 nt, Homo sapiens
ugggcgaagcuaaaag

SEQ ID NO: 1535805 - RNA, 21 nt, Homo sapiens
uggggcaguuccccuucuuac

SEQ ID NO: 1535806 - RNA, 22 nt, Homo sapiens
ugggggcaccaagaccccaaag

SEQ ID NO: 1535807 - RNA, 16 nt, Homo sapiens
ugggggcuugcaagua

SEQ ID NO: 1535808 - RNA, 15 nt, Homo sapiens
uggggugggccucug

SEQ ID NO: 1535809 - RNA, 22 nt, Homo sapiens
ugggguuucucuuuuccacuga

SEQ ID NO: 1535810 - RNA, 12 nt, Homo sapiens
ugggucaacucc

SEQ ID NO: 1535811 - RNA, 12 nt, Homo sapiens
ugguaacugcac

SEQ ID NO: 1535812 - RNA, 14 nt, Homo sapiens
ugguagacugugac

SEQ ID NO: 1535813 - RNA, 15 nt, Homo sapiens
uggugcccaccagcu

SEQ ID NO: 1535814 - RNA, 13 nt, Homo sapiens
uggugccuggaaa

SEQ ID NO: 1535815 - RNA, 22 nt, Homo sapiens
ugguggggccauacccaugugu

SEQ ID NO: 1535816 - RNA, 17 nt, Homo sapiens
ugguuuauugaauguga

SEQ ID NO: 1535817 - RNA, 14 nt, Homo sapiens
ugguuuuugagcca

SEQ ID NO: 1535818 - RNA, 15 nt, Homo sapiens
uguaaauaugucacu

SEQ ID NO: 1535819 - RNA, 16 nt, Homo sapiens
uguaaauuuaacugca

SEQ ID NO: 1535820 - RNA, 22 nt, Homo sapiens
uguaaucccagcaugcugagau

SEQ ID NO: 1535821 - RNA, 23 nt, Homo sapiens
uguacaauaaagcaaugugguag

SEQ ID NO: 1535822 - RNA, 19 nt, Homo sapiens
uguacaguuauacauaccu

SEQ ID NO: 1535823 - RNA, 20 nt, Homo sapiens
uguacaguuauacauaccuc

SEQ ID NO: 1535824 - RNA, 21 nt, Homo sapiens
uguacauguggaaaacucaca

SEQ ID NO: 1535825 - RNA, 17 nt, Homo sapiens
uguacauuugagugucu

SEQ ID NO: 1535826 - RNA, 13 nt, Homo sapiens
uguacuaccccag

SEQ ID NO: 1535827 - RNA, 14 nt, Homo sapiens
uguacuaccccagg

SEQ ID NO: 1535828 - RNA, 14 nt, Homo sapiens
uguagcaacccagg

SEQ ID NO: 1535829 - RNA, 15 nt, Homo sapiens
uguagcauuucuuga

SEQ ID NO: 1535830 - RNA, 13 nt, Homo sapiens
uguauaacaagcc

SEQ ID NO: 1535831 - RNA, 16 nt, Homo sapiens
uguauacaaacaggug

SEQ ID NO: 1535832 - RNA, 15 nt, Homo sapiens
uguaucuaugcauuu

SEQ ID NO: 1535833 - RNA, 23 nt, Homo sapiens
ugucaagauucagcuaguggcca

SEQ ID NO: 1535834 - RNA, 15 nt, Homo sapiens
ugucacuguuucacu

SEQ ID NO: 1535835 - RNA, 16 nt, Homo sapiens
ugucacuugccaguca

SEQ ID NO: 1535836 - RNA, 17 nt, Homo sapiens
ugucagucguguugcuu

SEQ ID NO: 1535837 - RNA, 19 nt, Homo sapiens
uguccacaaauguccucag

SEQ ID NO: 1535838 - RNA, 17 nt, Homo sapiens
uguccaccugugcugcu

SEQ ID NO: 1535839 - RNA, 19 nt, Homo sapiens
ugucccaguuaacuguuaa

SEQ ID NO: 1535840 - RNA, 22 nt, Homo sapiens
ugucccugccccgccccccaga

SEQ ID NO: 1535841 - RNA, 16 nt, Homo sapiens
uguccguccucuuccc

SEQ ID NO: 1535842 - RNA, 13 nt, Homo sapiens
uguccuaaaugca

SEQ ID NO: 1535843 - RNA, 18 nt, Homo sapiens
uguccucaaaaggaauaa

SEQ ID NO: 1535844 - RNA, 19 nt, Homo sapiens
ugucuaauaaacacagauu

SEQ ID NO: 1535845 - RNA, 16 nt, Homo sapiens
ugucuacugcuuggau

SEQ ID NO: 1535846 - RNA, 22 nt, Homo sapiens
ugucucaaaccuccaaaagccc

SEQ ID NO: 1535847 - RNA, 13 nt, Homo sapiens
ugucugaaggauu

SEQ ID NO: 1535848 - RNA, 21 nt, Homo sapiens
ugucugauucuaugccuguau

SEQ ID NO: 1535849 - RNA, 12 nt, Homo sapiens
ugucuugcugag

SEQ ID NO: 1535850 - RNA, 18 nt, Homo sapiens
ugugaauugaagucauca

SEQ ID NO: 1535851 - RNA, 14 nt, Homo sapiens
ugugaauuuugcca

SEQ ID NO: 1535852 - RNA, 20 nt, Homo sapiens
ugugacaugaacccauccaa

SEQ ID NO: 1535853 - RNA, 16 nt, Homo sapiens
ugugaucuauaccacc

SEQ ID NO: 1535854 - RNA, 22 nt, Homo sapiens
ugugauuuuucugcacuaauau

SEQ ID NO: 1535855 - RNA, 17 nt, Homo sapiens
ugugcagugauguggug

SEQ ID NO: 1535856 - RNA, 18 nt, Homo sapiens
uguggcuucccaugucuu

SEQ ID NO: 1535857 - RNA, 20 nt, Homo sapiens
ugugggaaugcggcaagaag

SEQ ID NO: 1535858 - RNA, 15 nt, Homo sapiens
ugugggcagcuggcu

SEQ ID NO: 1535859 - RNA, 13 nt, Homo sapiens
ugugggucaggga

SEQ ID NO: 1535860 - RNA, 14 nt, Homo sapiens
ugugugaccccaaa

SEQ ID NO: 1535861 - RNA, 14 nt, Homo sapiens
ugugugcagugaug

SEQ ID NO: 1535862 - RNA, 20 nt, Homo sapiens
uguuaaauaaggccucaucc

SEQ ID NO: 1535863 - RNA, 22 nt, Homo sapiens
uguuauuuuguauaaaugggaa

SEQ ID NO: 1535864 - RNA, 14 nt, Homo sapiens
uguucccacucccu

SEQ ID NO: 1535865 - RNA, 19 nt, Homo sapiens
uguucuugcagucaucaga

SEQ ID NO: 1535866 - RNA, 14 nt, Homo sapiens
uguugcuauuuccu

SEQ ID NO: 1535867 - RNA, 19 nt, Homo sapiens
uguuuagaaugucaguuga

SEQ ID NO: 1535868 - RNA, 20 nt, Homo sapiens
uguuuccagagugcuuauaa

SEQ ID NO: 1535869 - RNA, 12 nt, Homo sapiens
uguuuccaguga

SEQ ID NO: 1535870 - RNA, 17 nt, Homo sapiens
uguuugauacaguauua

SEQ ID NO: 1535871 - RNA, 21 nt, Homo sapiens
uguuuuccccaauuauccucc

SEQ ID NO: 1535872 - RNA, 12 nt, Homo sapiens
uuaaaaauaugu

SEQ ID NO: 1535873 - RNA, 15 nt, Homo sapiens
uuaaaauaguuuucu

SEQ ID NO: 1535874 - RNA, 20 nt, Homo sapiens
uuaaaugaacuugauagcua

SEQ ID NO: 1535875 - RNA, 14 nt, Homo sapiens
uuaacaauugccag

SEQ ID NO: 1535876 - RNA, 24 nt, Homo sapiens
uuaaccuuucaggaaaguaucucu

SEQ ID NO: 1535877 - RNA, 16 nt, Homo sapiens
uuaacuuuaccaugcu

SEQ ID NO: 1535878 - RNA, 22 nt, Homo sapiens
uuaacuuuaccaugcucaauga

SEQ ID NO: 1535879 - RNA, 21 nt, Homo sapiens
uuaagaaagcuauauaugaau

SEQ ID NO: 1535880 - RNA, 22 nt, Homo sapiens
uuaagaauguauaucaggguuu

SEQ ID NO: 1535881 - RNA, 12 nt, Homo sapiens
uuaagaauucca

SEQ ID NO: 1535882 - RNA, 13 nt, Homo sapiens
uuaagcacaagca

SEQ ID NO: 1535883 - RNA, 19 nt, Homo sapiens
uuaagccauaugacaauuu

SEQ ID NO: 1535884 - RNA, 20 nt, Homo sapiens
uuaaguacugaaauacauau

SEQ ID NO: 1535885 - RNA, 13 nt, Homo sapiens
uuaauagccauuu

SEQ ID NO: 1535886 - RNA, 12 nt, Homo sapiens
uuaauauacugc

SEQ ID NO: 1535887 - RNA, 22 nt, Homo sapiens
uuacacauguaucuaugcauuu

SEQ ID NO: 1535888 - RNA, 22 nt, Homo sapiens
uuacagguguacuauggcugua

SEQ ID NO: 1535889 - RNA, 14 nt, Homo sapiens
uuacaugaguucaa

SEQ ID NO: 1535890 - RNA, 20 nt, Homo sapiens
uuacaugaguucaaauacuu

SEQ ID NO: 1535891 - RNA, 13 nt, Homo sapiens
uuacaugcauuac

SEQ ID NO: 1535892 - RNA, 17 nt, Homo sapiens
uuacaugugauugugau

SEQ ID NO: 1535893 - RNA, 14 nt, Homo sapiens
uuacccaaugcagu

SEQ ID NO: 1535894 - RNA, 18 nt, Homo sapiens
uuaccucacuggugcauu

SEQ ID NO: 1535895 - RNA, 13 nt, Homo sapiens
uuacuaaacauuu

SEQ ID NO: 1535896 - RNA, 15 nt, Homo sapiens
uuacuacaugcacuu

SEQ ID NO: 1535897 - RNA, 15 nt, Homo sapiens
uuacugauuaacuca

SEQ ID NO: 1535898 - RNA, 17 nt, Homo sapiens
uuagaauggggcuucca

SEQ ID NO: 1535899 - RNA, 19 nt, Homo sapiens
uuagaauguugaaacugac

SEQ ID NO: 1535900 - RNA, 20 nt, Homo sapiens
uuagacaaccauagaacugu

SEQ ID NO: 1535901 - RNA, 14 nt, Homo sapiens
uuagacauaccucu

SEQ ID NO: 1535902 - RNA, 23 nt, Homo sapiens
uuagacuuuuaacuucaccuuaa

SEQ ID NO: 1535903 - RNA, 23 nt, Homo sapiens
uuagagggacagccaaaaguaag

SEQ ID NO: 1535904 - RNA, 15 nt, Homo sapiens
uuagauucacuuuga

SEQ ID NO: 1535905 - RNA, 17 nt, Homo sapiens
uuagcaugaaagguaau

SEQ ID NO: 1535906 - RNA, 20 nt, Homo sapiens
uuagcauuuucugcaucucc

SEQ ID NO: 1535907 - RNA, 12 nt, Homo sapiens
uuagccccauga

SEQ ID NO: 1535908 - RNA, 12 nt, Homo sapiens
uuagcuauuacu

SEQ ID NO: 1535909 - RNA, 16 nt, Homo sapiens
uuagcuuuucugcaau

SEQ ID NO: 1535910 - RNA, 21 nt, Homo sapiens
uuaggcaauggugaacuguca

SEQ ID NO: 1535911 - RNA, 15 nt, Homo sapiens
uuaguaucucaucaa

SEQ ID NO: 1535912 - RNA, 18 nt, Homo sapiens
uuagucauaccauccauc

SEQ ID NO: 1535913 - RNA, 18 nt, Homo sapiens
uuaguuccugugcacagc

SEQ ID NO: 1535914 - RNA, 22 nt, Homo sapiens
uuauaggcacuugcuacuucag

SEQ ID NO: 1535915 - RNA, 17 nt, Homo sapiens
uuauccuccuucacucc

SEQ ID NO: 1535916 - RNA, 22 nt, Homo sapiens
uuaugauauaauaaauauauau

SEQ ID NO: 1535917 - RNA, 23 nt, Homo sapiens
ccauuauuucaaccgcuugccau

SEQ ID NO: 1535918 - RNA, 12 nt, Homo sapiens
ccauuugcagac

SEQ ID NO: 1535919 - RNA, 14 nt, Homo sapiens
cccaaaacaaagua

SEQ ID NO: 1535920 - RNA, 22 nt, Homo sapiens
cccaaccuccccugguccugca

SEQ ID NO: 1535921 - RNA, 21 nt, Homo sapiens
cccaaggaaaauggacauauu

SEQ ID NO: 1535922 - RNA, 15 nt, Homo sapiens
cccaaggcgugcagg

SEQ ID NO: 1535923 - RNA, 16 nt, Homo sapiens
cccaagguggucuugg

SEQ ID NO: 1535924 - RNA, 16 nt, Homo sapiens
cccacaaguauugccc

SEQ ID NO: 1535925 - RNA, 20 nt, Homo sapiens
cccacaggagcauguccuau

SEQ ID NO: 1535926 - RNA, 23 nt, Homo sapiens
cccacaggagcguguacuacccc

SEQ ID NO: 1535927 - RNA, 23 nt, Homo sapiens
cccacccuucgcaguuacugguu

SEQ ID NO: 1535928 - RNA, 20 nt, Homo sapiens
cccaccugggcccuaggcau

SEQ ID NO: 1535929 - RNA, 19 nt, Homo sapiens
cccacuggagcguguacua

SEQ ID NO: 1535930 - RNA, 23 nt, Homo sapiens
cccacuggagcguguacuacccc

SEQ ID NO: 1535931 - RNA, 14 nt, Homo sapiens
cccagaagguugug

SEQ ID NO: 1535932 - RNA, 15 nt, Homo sapiens
cccagcccauuccuc

SEQ ID NO: 1535933 - RNA, 22 nt, Homo sapiens
cccagccuguggccucagcauc

SEQ ID NO: 1535934 - RNA, 14 nt, Homo sapiens
cccaggaggaccug

SEQ ID NO: 1535935 - RNA, 16 nt, Homo sapiens
cccaggcuggaugcug

SEQ ID NO: 1535936 - RNA, 23 nt, Homo sapiens
cccagggaaucagggagcacugg

SEQ ID NO: 1535937 - RNA, 18 nt, Homo sapiens
cccagggagaggccauga

SEQ ID NO: 1535938 - RNA, 19 nt, Homo sapiens
cccaguuucuugagaucug

SEQ ID NO: 1535939 - RNA, 18 nt, Homo sapiens
ccccacaggagcguguac

SEQ ID NO: 1535940 - RNA, 18 nt, Homo sapiens
ccccacuggagcguguac

SEQ ID NO: 1535941 - RNA, 22 nt, Homo sapiens
ccccagccugcucccuagccag

SEQ ID NO: 1535942 - RNA, 19 nt, Homo sapiens
ccccauucuauaaauucaa

SEQ ID NO: 1535943 - RNA, 22 nt, Homo sapiens
cccccacccaccuggauucccu

SEQ ID NO: 1535944 - RNA, 19 nt, Homo sapiens
ccccuccuugccgcuggga

SEQ ID NO: 1535945 - RNA, 16 nt, Homo sapiens
ccccugccccagagaa

SEQ ID NO: 1535946 - RNA, 14 nt, Homo sapiens
ccccuggcuuuuca

SEQ ID NO: 1535947 - RNA, 19 nt, Homo sapiens
cccgagaaggaauggugcu

SEQ ID NO: 1535948 - RNA, 14 nt, Homo sapiens
cccggggucuccac

SEQ ID NO: 1535949 - RNA, 12 nt, Homo sapiens
cccgugccaaau

SEQ ID NO: 1535950 - RNA, 19 nt, Homo sapiens
cccuaagucaacuuagcau

SEQ ID NO: 1535951 - RNA, 13 nt, Homo sapiens
cccucagacuggg

SEQ ID NO: 1535952 - RNA, 20 nt, Homo sapiens
cccucauuacugccaacagu

SEQ ID NO: 1535953 - RNA, 15 nt, Homo sapiens
cccucccugcugcca

SEQ ID NO: 1535954 - RNA, 12 nt, Homo sapiens
cccucggagccu

SEQ ID NO: 1535955 - RNA, 20 nt, Homo sapiens
cccucugcuaugucugugau

SEQ ID NO: 1535956 - RNA, 17 nt, Homo sapiens
cccucugcugcuuucca

SEQ ID NO: 1535957 - RNA, 22 nt, Homo sapiens
cccugauuuauucuggugucua

SEQ ID NO: 1535958 - RNA, 23 nt, Homo sapiens
cccugccccgccccccagagcca

SEQ ID NO: 1535959 - RNA, 22 nt, Homo sapiens
cccuggauuugcauacauucuu

SEQ ID NO: 1535960 - RNA, 21 nt, Homo sapiens
cccugggacguggcuagucau

SEQ ID NO: 1535961 - RNA, 18 nt, Homo sapiens
cccuggggggcacagcca

SEQ ID NO: 1535962 - RNA, 14 nt, Homo sapiens
cccuguucuuugaa

SEQ ID NO: 1535963 - RNA, 19 nt, Homo sapiens
cccuucaaugcaaaauaca

SEQ ID NO: 1535964 - RNA, 15 nt, Homo sapiens
cccuucagcauccuc

SEQ ID NO: 1535965 - RNA, 12 nt, Homo sapiens
cccuuugcacac

SEQ ID NO: 1535966 - RNA, 12 nt, Homo sapiens
ccgaauauugag

SEQ ID NO: 1535967 - RNA, 20 nt, Homo sapiens
ccgagcugggggccaugagc

SEQ ID NO: 1535968 - RNA, 23 nt, Homo sapiens
ccgagcugggggccaugagcucc

SEQ ID NO: 1535969 - RNA, 15 nt, Homo sapiens
ccgcugaccuugcac

SEQ ID NO: 1535970 - RNA, 14 nt, Homo sapiens
ccgcugcagggugg

SEQ ID NO: 1535971 - RNA, 20 nt, Homo sapiens
ccggcugagcugugccagcu

SEQ ID NO: 1535972 - RNA, 19 nt, Homo sapiens
ccgucaaaagagucuuaau

SEQ ID NO: 1535973 - RNA, 14 nt, Homo sapiens
ccuaaacucugaaa

SEQ ID NO: 1535974 - RNA, 21 nt, Homo sapiens
ccuaaauguggacaucaugaa

SEQ ID NO: 1535975 - RNA, 14 nt, Homo sapiens
ccuaacaagccuug

SEQ ID NO: 1535976 - RNA, 19 nt, Homo sapiens
ccuaagucaacuuagcauu

SEQ ID NO: 1535977 - RNA, 23 nt, Homo sapiens
ccuaauagacuuagccccaugag

SEQ ID NO: 1535978 - RNA, 22 nt, Homo sapiens
ccuaauguggcagcugucucaa

SEQ ID NO: 1535979 - RNA, 20 nt, Homo sapiens
ccuagaauggaagccuccac

SEQ ID NO: 1535980 - RNA, 14 nt, Homo sapiens
ccuagaauguuuca

SEQ ID NO: 1535981 - RNA, 18 nt, Homo sapiens
ccuauaccccucaucaca

SEQ ID NO: 1535982 - RNA, 15 nt, Homo sapiens
ccucaaaaagauuuc

SEQ ID NO: 1535983 - RNA, 19 nt, Homo sapiens
ccucaacccugugaucuau

SEQ ID NO: 1535984 - RNA, 20 nt, Homo sapiens
ccucaccuggcuucccagga

SEQ ID NO: 1535985 - RNA, 20 nt, Homo sapiens
ccucacuggugcauuuaaaa

SEQ ID NO: 1535986 - RNA, 19 nt, Homo sapiens
ccucaguuuuuccuaguca

SEQ ID NO: 1535987 - RNA, 17 nt, Homo sapiens
ccucauccuccacugaa

SEQ ID NO: 1535988 - RNA, 21 nt, Homo sapiens
ccucauuacugccaacaguuu

SEQ ID NO: 1535989 - RNA, 20 nt, Homo sapiens
ccuccaaaagcccugaguuu

SEQ ID NO: 1535990 - RNA, 19 nt, Homo sapiens
ccuccaagugaaugaguuu

SEQ ID NO: 1535991 - RNA, 21 nt, Homo sapiens
ccuccaccccaguccccggga

SEQ ID NO: 1535992 - RNA, 10 nt, Homo sapiens
ccuccagacc

SEQ ID NO: 1535993 - RNA, 15 nt, Homo sapiens
ccucccaagcacuuc

SEQ ID NO: 1535994 - RNA, 21 nt, Homo sapiens
ccucccuguccccugagguua

SEQ ID NO: 1535995 - RNA, 22 nt, Homo sapiens
cucauggaucugcauaaccgca

SEQ ID NO: 1535996 - RNA, 16 nt, Homo sapiens
cucauuagaauuacca

SEQ ID NO: 1535997 - RNA, 13 nt, Homo sapiens
cucauuguagaaa

SEQ ID NO: 1535998 - RNA, 22 nt, Homo sapiens
cuccaaaguuuuaaaccuguua

SEQ ID NO: 1535999 - RNA, 19 nt, Homo sapiens
cuccaaggcaaauguccaa

SEQ ID NO: 1536000 - RNA, 20 nt, Homo sapiens
cuccacaguuaggccaagaa

SEQ ID NO: 1536001 - RNA, 12 nt, Homo sapiens
cuccaccugcag

SEQ ID NO: 1536002 - RNA, 20 nt, Homo sapiens
cuccagaacaaaccucuaua

SEQ ID NO: 1536003 - RNA, 19 nt, Homo sapiens
cucccaaauaaacuccuua

SEQ ID NO: 1536004 - RNA, 16 nt, Homo sapiens
cucccaagcacuucaa

SEQ ID NO: 1536005 - RNA, 18 nt, Homo sapiens
cucccaaguuuugaaagg

SEQ ID NO: 1536006 - RNA, 23 nt, Homo sapiens
cucccagcucuagacaacccugc

SEQ ID NO: 1536007 - RNA, 14 nt, Homo sapiens
cuccccauggugca

SEQ ID NO: 1536008 - RNA, 20 nt, Homo sapiens
cucccgaacacgcacagaag

SEQ ID NO: 1536009 - RNA, 14 nt, Homo sapiens
cucccuagccagag

SEQ ID NO: 1536010 - RNA, 21 nt, Homo sapiens
cucccuggccuguucuguuuu

SEQ ID NO: 1536011 - RNA, 23 nt, Homo sapiens
cucccuucaacuguauaccgugu

SEQ ID NO: 1536012 - RNA, 17 nt, Homo sapiens
cuccgcccuucccugac

SEQ ID NO: 1536013 - RNA, 16 nt, Homo sapiens
cuccgcuaaggcuucc

SEQ ID NO: 1536014 - RNA, 18 nt, Homo sapiens
cuccuaaauuuccagggg

SEQ ID NO: 1536015 - RNA, 16 nt, Homo sapiens
cuccucccaagcacuu

SEQ ID NO: 1536016 - RNA, 19 nt, Homo sapiens
cuccucccaagcacuucaa

SEQ ID NO: 1536017 - RNA, 17 nt, Homo sapiens
cuccugaaucccuuuca

SEQ ID NO: 1536018 - RNA, 17 nt, Homo sapiens
cuccuggaucccuuuca

SEQ ID NO: 1536019 - RNA, 20 nt, Homo sapiens
cuccuucacucccugucaua

SEQ ID NO: 1536020 - RNA, 23 nt, Homo sapiens
cuccuugaguuuuccugcugcga

SEQ ID NO: 1536021 - RNA, 15 nt, Homo sapiens
cucgcuucauaggca

SEQ ID NO: 1536022 - RNA, 20 nt, Homo sapiens
cucgguauaguuuugucaca

SEQ ID NO: 1536023 - RNA, 16 nt, Homo sapiens
cucuaaaauucuaguc

SEQ ID NO: 1536024 - RNA, 15 nt, Homo sapiens
cucuauauauacaug

SEQ ID NO: 1536025 - RNA, 17 nt, Homo sapiens
cucuauuuuuuacuaca

SEQ ID NO: 1536026 - RNA, 16 nt, Homo sapiens
cucuccuuguucugau

SEQ ID NO: 1536027 - RNA, 12 nt, Homo sapiens
cucucucugugu

SEQ ID NO: 1536028 - RNA, 19 nt, Homo sapiens
cucugaacugcaacacugg

SEQ ID NO: 1536029 - RNA, 23 nt, Homo sapiens
cucugacuguaaaauacauggua

SEQ ID NO: 1536030 - RNA, 17 nt, Homo sapiens
cucugaucaaagcaccu

SEQ ID NO: 1536031 - RNA, 16 nt, Homo sapiens
cucugcaguugaucuc

SEQ ID NO: 1536032 - RNA, 21 nt, Homo sapiens
cucugcuguauugauaucacu

SEQ ID NO: 1536033 - RNA, 16 nt, Homo sapiens
cucuggucugggugcc

SEQ ID NO: 1536034 - RNA, 15 nt, Homo sapiens
cucuuaccuguaaua

SEQ ID NO: 1536035 - RNA, 17 nt, Homo sapiens
cucuuuuuagauguagc

SEQ ID NO: 1536036 - RNA, 13 nt, Homo sapiens
cugaaaauucaac

SEQ ID NO: 1536037 - RNA, 15 nt, Homo sapiens
cugaaauacauauga

SEQ ID NO: 1536038 - RNA, 17 nt, Homo sapiens
cugaaauuggaagacuu

SEQ ID NO: 1536039 - RNA, 18 nt, Homo sapiens
cugaagaaucacaauaau

SEQ ID NO: 1536040 - RNA, 18 nt, Homo sapiens
cugacagaaggacucagg

SEQ ID NO: 1536041 - RNA, 16 nt, Homo sapiens
cugacuguugcuguaa

SEQ ID NO: 1536042 - RNA, 17 nt, Homo sapiens
cugacuguugcuguaaa

SEQ ID NO: 1536043 - RNA, 18 nt, Homo sapiens
cugagacaugacuaggaa

SEQ ID NO: 1536044 - RNA, 19 nt, Homo sapiens
cugagcaccgaauauugag

SEQ ID NO: 1536045 - RNA, 20 nt, Homo sapiens
cugaguagucauuuugccca

SEQ ID NO: 1536046 - RNA, 21 nt, Homo sapiens
cugaguagucauuuugcccau

SEQ ID NO: 1536047 - RNA, 16 nt, Homo sapiens
cugaguuccugcaugc

SEQ ID NO: 1536048 - RNA, 18 nt, Homo sapiens
cugauuuaaacuucuuaa

SEQ ID NO: 1536049 - RNA, 23 nt, Homo sapiens
cugauuugggcugaauguaugua

SEQ ID NO: 1536050 - RNA, 20 nt, Homo sapiens
cugcaaauacuuccaaagag

SEQ ID NO: 1536051 - RNA, 15 nt, Homo sapiens
uugcuguuuacuuga

SEQ ID NO: 1536052 - RNA, 21 nt, Homo sapiens
uugcuuguguacaaacccaga

SEQ ID NO: 1536053 - RNA, 14 nt, Homo sapiens
uuggaauacuugaa

SEQ ID NO: 1536054 - RNA, 16 nt, Homo sapiens
uuggaccugcaguugg

SEQ ID NO: 1536055 - RNA, 18 nt, Homo sapiens
uugggaaaugcugauuua

SEQ ID NO: 1536056 - RNA, 14 nt, Homo sapiens
uuggguuccagaca

SEQ ID NO: 1536057 - RNA, 15 nt, Homo sapiens
uuggguuccagacag

SEQ ID NO: 1536058 - RNA, 13 nt, Homo sapiens
uugguguucuucc

SEQ ID NO: 1536059 - RNA, 23 nt, Homo sapiens
uugguuaaaggaaguuuguucac

SEQ ID NO: 1536060 - RNA, 16 nt, Homo sapiens
uuguaaauugucucaa

SEQ ID NO: 1536061 - RNA, 21 nt, Homo sapiens
uuguagugguauagaguacug

SEQ ID NO: 1536062 - RNA, 18 nt, Homo sapiens
uuguauccuccauuguau

SEQ ID NO: 1536063 - RNA, 21 nt, Homo sapiens
uuguaucuuuaaagacuugau

SEQ ID NO: 1536064 - RNA, 21 nt, Homo sapiens
uuguauuuuacuuugugcaau

SEQ ID NO: 1536065 - RNA, 13 nt, Homo sapiens
uugucaccaugau

SEQ ID NO: 1536066 - RNA, 22 nt, Homo sapiens
uugucaguguagaucaacucau

SEQ ID NO: 1536067 - RNA, 16 nt, Homo sapiens
uugugugaaaauguga

SEQ ID NO: 1536068 - RNA, 19 nt, Homo sapiens
uugugugugugugcaguga

SEQ ID NO: 1536069 - RNA, 18 nt, Homo sapiens
uuguuagugauuugcuau

SEQ ID NO: 1536070 - RNA, 18 nt, Homo sapiens
uuguuauuuuugucucga

SEQ ID NO: 1536071 - RNA, 16 nt, Homo sapiens
uuguugacacggccau

SEQ ID NO: 1536072 - RNA, 18 nt, Homo sapiens
uuguugcuguuguucaga

SEQ ID NO: 1536073 - RNA, 12 nt, Homo sapiens
uuguuguucaga

SEQ ID NO: 1536074 - RNA, 21 nt, Homo sapiens
uuuaaaaaaauaacaucugaa

SEQ ID NO: 1536075 - RNA, 21 nt, Homo sapiens
uuuaaaaaauaacauauucuu

SEQ ID NO: 1536076 - RNA, 12 nt, Homo sapiens
uuuaaagucaca

SEQ ID NO: 1536077 - RNA, 18 nt, Homo sapiens
uuuaaauggcuacuuugg

SEQ ID NO: 1536078 - RNA, 17 nt, Homo sapiens
uuuaacuuuaccaugcu

SEQ ID NO: 1536079 - RNA, 20 nt, Homo sapiens
uuuacacauguaucuaugca

SEQ ID NO: 1536080 - RNA, 12 nt, Homo sapiens
uuuacacugacu

SEQ ID NO: 1536081 - RNA, 20 nt, Homo sapiens
uuuaccaaucaacagcaugu

SEQ ID NO: 1536082 - RNA, 19 nt, Homo sapiens
uuuacugucuguaagagaa

SEQ ID NO: 1536083 - RNA, 17 nt, Homo sapiens
uuuacuuugugcaauau

SEQ ID NO: 1536084 - RNA, 16 nt, Homo sapiens
uuuagaaaugauuuca

SEQ ID NO: 1536085 - RNA, 15 nt, Homo sapiens
uuuagagacuguaaa

SEQ ID NO: 1536086 - RNA, 16 nt, Homo sapiens
uuuagcuauuacugga

SEQ ID NO: 1536087 - RNA, 15 nt, Homo sapiens
uuuaugaaguuaaca

SEQ ID NO: 1536088 - RNA, 22 nt, Homo sapiens
uuuauggcagacauugugcuag

SEQ ID NO: 1536089 - RNA, 15 nt, Homo sapiens
uuuauucccccaaag

SEQ ID NO: 1536090 - RNA, 21 nt, Homo sapiens
uuucaccccaucccuccuuaa

SEQ ID NO: 1536091 - RNA, 21 nt, Homo sapiens
uuuccaacaaacuuacuguca

SEQ ID NO: 1536092 - RNA, 22 nt, Homo sapiens
uuuccaacuugucacuugccag

SEQ ID NO: 1536093 - RNA, 22 nt, Homo sapiens
uuuccagcuccuaguagcuuuc

SEQ ID NO: 1536094 - RNA, 18 nt, Homo sapiens
uuuccaggggccucccaa

SEQ ID NO: 1536095 - RNA, 14 nt, Homo sapiens
uuuccagugcugcu

SEQ ID NO: 1536096 - RNA, 13 nt, Homo sapiens
uuuccauucuggg

SEQ ID NO: 1536097 - RNA, 20 nt, Homo sapiens
uuucuacuuuuuguauaaag

SEQ ID NO: 1536098 - RNA, 22 nt, Homo sapiens
uuucuucagagagcuaaauuac

SEQ ID NO: 1536099 - RNA, 15 nt, Homo sapiens
uuucuuuagucuuua

SEQ ID NO: 1536100 - RNA, 20 nt, Homo sapiens
uuugaauguugaauguuuga

SEQ ID NO: 1536101 - RNA, 20 nt, Homo sapiens
uuugaauuuuuuagugacua

SEQ ID NO: 1536102 - RNA, 21 nt, Homo sapiens
uuugaauuuuuuagugacuaa

SEQ ID NO: 1536103 - RNA, 14 nt, Homo sapiens
uuugacuguuucca

SEQ ID NO: 1536104 - RNA, 12 nt, Homo sapiens
uuugauaccagu

SEQ ID NO: 1536105 - RNA, 17 nt, Homo sapiens
uuugcauacauucuuca

SEQ ID NO: 1536106 - RNA, 12 nt, Homo sapiens
uuugccaaaaac

SEQ ID NO: 1536107 - RNA, 20 nt, Homo sapiens
uuugccucugcacgugcaca

SEQ ID NO: 1536108 - RNA, 18 nt, Homo sapiens
uuuggcucgggacuucaa

SEQ ID NO: 1536109 - RNA, 20 nt, Homo sapiens
uuugggggauucaaaugcau

SEQ ID NO: 1536110 - RNA, 23 nt, Homo sapiens
uuugggggugcuaauccaggaca

SEQ ID NO: 1536111 - RNA, 12 nt, Homo sapiens
uuuguaaccaua

SEQ ID NO: 1536112 - RNA, 16 nt, Homo sapiens
uuuguaaccauaugau

SEQ ID NO: 1536113 - RNA, 21 nt, Homo sapiens
uuuguuaggaagggugagaau

SEQ ID NO: 1536114 - RNA, 15 nt, Homo sapiens
uuuguuggagccacu

SEQ ID NO: 1536115 - RNA, 16 nt, Homo sapiens
uuuuaaacaaauggcu

SEQ ID NO: 1536116 - RNA, 12 nt, Homo sapiens
uuuuagaguaug

SEQ ID NO: 1536117 - RNA, 12 nt, Homo sapiens
uuuuaucucaca

SEQ ID NO: 1536118 - RNA, 16 nt, Homo sapiens
uuuuaucucacaaaua

SEQ ID NO: 1536119 - RNA, 13 nt, Homo sapiens
uuuuaugucuaaa

SEQ ID NO: 1536120 - RNA, 15 nt, Homo sapiens
uuuucauuauugguu

SEQ ID NO: 1536121 - RNA, 15 nt, Homo sapiens
uuuucugcaucucca

SEQ ID NO: 1536122 - RNA, 19 nt, Homo sapiens
uuuugaaaagcucacuuca

SEQ ID NO: 1536123 - RNA, 22 nt, Homo sapiens
uuuugucacaauuauagauuag

SEQ ID NO: 1536124 - RNA, 20 nt, Homo sapiens
uuuuuaaaagcccuuuccaa

SEQ ID NO: 1536125 - RNA, 18 nt, Homo sapiens
uuuuuaacuuuaccaugc

SEQ ID NO: 1536126 - RNA, 21 nt, Homo sapiens
uuuuuacacauguaucuaugc

SEQ ID NO: 1536127 - RNA, 23 nt, Homo sapiens
aaacuagauucauggcuuuaaca

SEQ ID NO: 1536128 - RNA, 11 nt, Homo sapiens
aaacugcauuu

SEQ ID NO: 1536129 - RNA, 19 nt, Homo sapiens
aaagaaccccccuccccaa

SEQ ID NO: 1536130 - RNA, 16 nt, Homo sapiens
aaagaagacuggaagc

SEQ ID NO: 1536131 - RNA, 18 nt, Homo sapiens
aaagacaccuacugagug

SEQ ID NO: 1536132 - RNA, 17 nt, Homo sapiens
aaagacaguaaagacca

SEQ ID NO: 1536133 - RNA, 15 nt, Homo sapiens
aaagacuacacuguu

SEQ ID NO: 1536134 - RNA, 16 nt, Homo sapiens
aaagacuugaugaaua

SEQ ID NO: 1536135 - RNA, 16 nt, Homo sapiens
aaagagggagugcauu

SEQ ID NO: 1536136 - RNA, 12 nt, Homo sapiens
aaagauaagugu

SEQ ID NO: 1536137 - RNA, 12 nt, Homo sapiens
aaagcacuguuu

SEQ ID NO: 1536138 - RNA, 19 nt, Homo sapiens
aaagccuugugaucacuuu

SEQ ID NO: 1536139 - RNA, 14 nt, Homo sapiens
aaagcucacuucaa

SEQ ID NO: 1536140 - RNA, 20 nt, Homo sapiens
aaagcuuuggugccuggaaa

SEQ ID NO: 1536141 - RNA, 13 nt, Homo sapiens
aaaggaacuggaa

SEQ ID NO: 1536142 - RNA, 22 nt, Homo sapiens
aaaggaagucucugggcccaga

SEQ ID NO: 1536143 - RNA, 15 nt, Homo sapiens
aaaguuauugugaua

SEQ ID NO: 1536144 - RNA, 23 nt, Homo sapiens
aaauaaggccucauccuccacug

SEQ ID NO: 1536145 - RNA, 11 nt, Homo sapiens
aaauacuucuu

SEQ ID NO: 1536146 - RNA, 15 nt, Homo sapiens
aaauaguguguccau

SEQ ID NO: 1536147 - RNA, 20 nt, Homo sapiens
aaauauauacccccccaugc

SEQ ID NO: 1536148 - RNA, 22 nt, Homo sapiens
aaauauauacccccccaugcag

SEQ ID NO: 1536149 - RNA, 18 nt, Homo sapiens
aaauaugauucuccucuc

SEQ ID NO: 1536150 - RNA, 15 nt, Homo sapiens
aaauauggacuucca

SEQ ID NO: 1536151 - RNA, 13 nt, Homo sapiens
aaauaugucacua

SEQ ID NO: 1536152 - RNA, 20 nt, Homo sapiens
aaauaugucacuagagaaau

SEQ ID NO: 1536153 - RNA, 22 nt, Homo sapiens
cugcaauacauuaaaauaacua

SEQ ID NO: 1536154 - RNA, 12 nt, Homo sapiens
cugcacacaccu

SEQ ID NO: 1536155 - RNA, 16 nt, Homo sapiens
cugcacacaccugcac

SEQ ID NO: 1536156 - RNA, 14 nt, Homo sapiens
cugcagaaccaguc

SEQ ID NO: 1536157 - RNA, 19 nt, Homo sapiens
cugcagacucacuguggga

SEQ ID NO: 1536158 - RNA, 18 nt, Homo sapiens
cugcaggguccccaagga

SEQ ID NO: 1536159 - RNA, 18 nt, Homo sapiens
cugccagccgcuggugcc

SEQ ID NO: 1536160 - RNA, 15 nt, Homo sapiens
cugccaggacacugc

SEQ ID NO: 1536161 - RNA, 19 nt, Homo sapiens
cugccaggggcagugaagu

SEQ ID NO: 1536162 - RNA, 20 nt, Homo sapiens
cugcccacccccugcuggug

SEQ ID NO: 1536163 - RNA, 12 nt, Homo sapiens
cugccccagaga

SEQ ID NO: 1536164 - RNA, 18 nt, Homo sapiens
cugccuccccaacccugc

SEQ ID NO: 1536165 - RNA, 15 nt, Homo sapiens
cugccugaacaaagg

SEQ ID NO: 1536166 - RNA, 14 nt, Homo sapiens
cugccuguggugag

SEQ ID NO: 1536167 - RNA, 19 nt, Homo sapiens
cugccuucugucucuugca

SEQ ID NO: 1536168 - RNA, 14 nt, Homo sapiens
cugcgauggugcug

SEQ ID NO: 1536169 - RNA, 22 nt, Homo sapiens
cugcguaggagagaacagggau

SEQ ID NO: 1536170 - RNA, 12 nt, Homo sapiens
cugcuccaugca

SEQ ID NO: 1536171 - RNA, 22 nt, Homo sapiens
cugcuccaugcagaucuagcca

SEQ ID NO: 1536172 - RNA, 21 nt, Homo sapiens
cugcuggcucccuuacuuuac

SEQ ID NO: 1536173 - RNA, 16 nt, Homo sapiens
cugcuguuuuauguca

SEQ ID NO: 1536174 - RNA, 22 nt, Homo sapiens
cugcuuagugucccuuaccugg

SEQ ID NO: 1536175 - RNA, 16 nt, Homo sapiens
cuggaacugucucuca

SEQ ID NO: 1536176 - RNA, 20 nt, Homo sapiens
cuggagaacuagagaaggac

SEQ ID NO: 1536177 - RNA, 17 nt, Homo sapiens
cuggagcaugagccagc

SEQ ID NO: 1536178 - RNA, 18 nt, Homo sapiens
cuggagcugaagcguuac

SEQ ID NO: 1536179 - RNA, 13 nt, Homo sapiens
cuggagugcagug

SEQ ID NO: 1536180 - RNA, 20 nt, Homo sapiens
cuggagugcaguggugcgau

SEQ ID NO: 1536181 - RNA, 18 nt, Homo sapiens
cuggauuugcauacauuc

SEQ ID NO: 1536182 - RNA, 20 nt, Homo sapiens
cuggauuugcauacauucuu

SEQ ID NO: 1536183 - RNA, 20 nt, Homo sapiens
cuggcaggagacacuggucu

SEQ ID NO: 1536184 - RNA, 21 nt, Homo sapiens
cuggccauuuaacuagcacuu

SEQ ID NO: 1536185 - RNA, 19 nt, Homo sapiens
cuggcccuguugugggggu

SEQ ID NO: 1536186 - RNA, 15 nt, Homo sapiens
cuggccgcugcaguc

SEQ ID NO: 1536187 - RNA, 13 nt, Homo sapiens
cuggccgcuggga

SEQ ID NO: 1536188 - RNA, 14 nt, Homo sapiens
cuggcucagccuca

SEQ ID NO: 1536189 - RNA, 18 nt, Homo sapiens
cuggcucccagggccaug

SEQ ID NO: 1536190 - RNA, 17 nt, Homo sapiens
cuggcuuuacauggguu

SEQ ID NO: 1536191 - RNA, 16 nt, Homo sapiens
cugggagaaaagccag

SEQ ID NO: 1536192 - RNA, 13 nt, Homo sapiens
cugggcacuccuc

SEQ ID NO: 1536193 - RNA, 12 nt, Homo sapiens
cugguccaugau

SEQ ID NO: 1536194 - RNA, 21 nt, Homo sapiens
cuggugggggccucuuuacca

SEQ ID NO: 1536195 - RNA, 19 nt, Homo sapiens
cuggugucuaauaaacaca

SEQ ID NO: 1536196 - RNA, 21 nt, Homo sapiens
cugguucccccaggacccuga

SEQ ID NO: 1536197 - RNA, 20 nt, Homo sapiens
cuguaagauuuuauuuucaa

SEQ ID NO: 1536198 - RNA, 15 nt, Homo sapiens
cuguaauauuuacaa

SEQ ID NO: 1536199 - RNA, 17 nt, Homo sapiens
cuguaaucccagcaugc

SEQ ID NO: 1536200 - RNA, 16 nt, Homo sapiens
cuguaauuuuguagua

SEQ ID NO: 1536201 - RNA, 17 nt, Homo sapiens
cuguaguaaauggcaau

SEQ ID NO: 1536202 - RNA, 20 nt, Homo sapiens
cuguaguaauuguuacaauu

SEQ ID NO: 1536203 - RNA, 22 nt, Homo sapiens
cuguauaauacuuuguauacaa

SEQ ID NO: 1536204 - RNA, 15 nt, Homo sapiens
cuguauacaaacagg

SEQ ID NO: 1536205 - RNA, 18 nt, Homo sapiens
cugucauacuuuguuagg

SEQ ID NO: 1536206 - RNA, 23 nt, Homo sapiens
cuguccacugggccauuguggug

SEQ ID NO: 1536207 - RNA, 17 nt, Homo sapiens
cuguccuacaauaucau

SEQ ID NO: 1536208 - RNA, 23 nt, Homo sapiens
cuguccuugucgcugugcccugg

SEQ ID NO: 1536209 - RNA, 18 nt, Homo sapiens
cugucucucaugaaccuc

SEQ ID NO: 1536210 - RNA, 19 nt, Homo sapiens
cugucucucaugaaccuca

SEQ ID NO: 1536211 - RNA, 17 nt, Homo sapiens
cugucuuagucauacca

SEQ ID NO: 1536212 - RNA, 21 nt, Homo sapiens
cugucuuagucauaccaucca

SEQ ID NO: 1536213 - RNA, 16 nt, Homo sapiens
cugucuugcugaggga

SEQ ID NO: 1536214 - RNA, 16 nt, Homo sapiens
cugugaauaaagccac

SEQ ID NO: 1536215 - RNA, 19 nt, Homo sapiens
cuguggcucuacaacugag

SEQ ID NO: 1536216 - RNA, 20 nt, Homo sapiens
cugugggucagugugccacc

SEQ ID NO: 1536217 - RNA, 19 nt, Homo sapiens
cugugugugcccgugguga

SEQ ID NO: 1536218 - RNA, 15 nt, Homo sapiens
cuguuccugccacau

SEQ ID NO: 1536219 - RNA, 20 nt, Homo sapiens
cuguucuaauggauuauaau

SEQ ID NO: 1536220 - RNA, 18 nt, Homo sapiens
cuguuugauacaguauua

SEQ ID NO: 1536221 - RNA, 17 nt, Homo sapiens
cuguuuugcauggagua

SEQ ID NO: 1536222 - RNA, 17 nt, Homo sapiens
cuguuuuuguaguggua

SEQ ID NO: 1536223 - RNA, 13 nt, Homo sapiens
cuuaaaaauuuau

SEQ ID NO: 1536224 - RNA, 16 nt, Homo sapiens
cuuaacuauccuaaca

SEQ ID NO: 1536225 - RNA, 22 nt, Homo sapiens
cuuaacuauccuaacaagccuu

SEQ ID NO: 1536226 - RNA, 19 nt, Homo sapiens
uucacuguccauuccaaau

SEQ ID NO: 1536227 - RNA, 23 nt, Homo sapiens
uucagccauucacaacacaauca

SEQ ID NO: 1536228 - RNA, 18 nt, Homo sapiens
uucaggaaugggccaagc

SEQ ID NO: 1536229 - RNA, 16 nt, Homo sapiens
uucagguauauaccuc

SEQ ID NO: 1536230 - RNA, 12 nt, Homo sapiens
uucagguggaac

SEQ ID NO: 1536231 - RNA, 19 nt, Homo sapiens
uucagguggaacaggagga

SEQ ID NO: 1536232 - RNA, 14 nt, Homo sapiens
uucaguaaacacca

SEQ ID NO: 1536233 - RNA, 15 nt, Homo sapiens
uucaguacuugugaa

SEQ ID NO: 1536234 - RNA, 21 nt, Homo sapiens
uucauaaaaauaaccaaaaaa

SEQ ID NO: 1536235 - RNA, 16 nt, Homo sapiens
uucauagcauccugau

SEQ ID NO: 1536236 - RNA, 22 nt, Homo sapiens
uucauccaacgugaagauacca

SEQ ID NO: 1536237 - RNA, 16 nt, Homo sapiens
uucaugauuugcaacu

SEQ ID NO: 1536238 - RNA, 15 nt, Homo sapiens
uucauucccuuucau

SEQ ID NO: 1536239 - RNA, 18 nt, Homo sapiens
uucauucccuuucaugau

SEQ ID NO: 1536240 - RNA, 17 nt, Homo sapiens
uuccaaagagucaucau

SEQ ID NO: 1536241 - RNA, 21 nt, Homo sapiens
uuccaaagguuucaacuguaa

SEQ ID NO: 1536242 - RNA, 17 nt, Homo sapiens
uuccaaguuuauugccc

SEQ ID NO: 1536243 - RNA, 18 nt, Homo sapiens
uuccaaguuuauugcccu

SEQ ID NO: 1536244 - RNA, 20 nt, Homo sapiens
uuccagcuaagccugaugau

SEQ ID NO: 1536245 - RNA, 17 nt, Homo sapiens
uuccaugucaagauuca

SEQ ID NO: 1536246 - RNA, 15 nt, Homo sapiens
uuccauuugcaacag

SEQ ID NO: 1536247 - RNA, 20 nt, Homo sapiens
uuccccaucgccuucugggg

SEQ ID NO: 1536248 - RNA, 17 nt, Homo sapiens
uucccccagcccugugg

SEQ ID NO: 1536249 - RNA, 11 nt, Homo sapiens
uuccccggagc

SEQ ID NO: 1536250 - RNA, 19 nt, Homo sapiens
uuccccgugggccauggca

SEQ ID NO: 1536251 - RNA, 22 nt, Homo sapiens
uuccccucuacuccaugcacau

SEQ ID NO: 1536252 - RNA, 21 nt, Homo sapiens
uucccguggcuuugugcuuau

SEQ ID NO: 1536253 - RNA, 15 nt, Homo sapiens
uucccugacacuguc

SEQ ID NO: 1536254 - RNA, 15 nt, Homo sapiens
uucccuguucuuuga

SEQ ID NO: 1536255 - RNA, 15 nt, Homo sapiens
uucccuucaaugcaa

SEQ ID NO: 1536256 - RNA, 17 nt, Homo sapiens
uuccuaaacucugaaau

SEQ ID NO: 1536257 - RNA, 18 nt, Homo sapiens
uuccuagucauaauguca

SEQ ID NO: 1536258 - RNA, 20 nt, Homo sapiens
uuccuccgucaccucagaga

SEQ ID NO: 1536259 - RNA, 18 nt, Homo sapiens
uuccucuuucacuucuua

SEQ ID NO: 1536260 - RNA, 14 nt, Homo sapiens
uuccuguccagaga

SEQ ID NO: 1536261 - RNA, 23 nt, Homo sapiens
uucgaagaauuggcagaagcagu

SEQ ID NO: 1536262 - RNA, 15 nt, Homo sapiens
uucgcugagucccag

SEQ ID NO: 1536263 - RNA, 20 nt, Homo sapiens
uucguccuuagaauacugua

SEQ ID NO: 1536264 - RNA, 20 nt, Homo sapiens
uucuaaaacauucuuuaaca

SEQ ID NO: 1536265 - RNA, 12 nt, Homo sapiens
uucuagcuauaa

SEQ ID NO: 1536266 - RNA, 16 nt, Homo sapiens
uucuauguagaacugu

SEQ ID NO: 1536267 - RNA, 20 nt, Homo sapiens
uucuauuagcuuacugauua

SEQ ID NO: 1536268 - RNA, 20 nt, Homo sapiens
uucucacuccuaccugguaa

SEQ ID NO: 1536269 - RNA, 23 nt, Homo sapiens
uucucaguaaauauuaaccugaa

SEQ ID NO: 1536270 - RNA, 13 nt, Homo sapiens
uucucaucauuau

SEQ ID NO: 1536271 - RNA, 21 nt, Homo sapiens
uucuccaccugaagugaugau

SEQ ID NO: 1536272 - RNA, 16 nt, Homo sapiens
uucucucugugcuggu

SEQ ID NO: 1536273 - RNA, 23 nt, Homo sapiens
uucugaauucauaaaaauaacca

SEQ ID NO: 1536274 - RNA, 13 nt, Homo sapiens
uucugaguagcau

SEQ ID NO: 1536275 - RNA, 17 nt, Homo sapiens
uucugaguagcauauau

SEQ ID NO: 1536276 - RNA, 18 nt, Homo sapiens
uucugggucagcuugaau

SEQ ID NO: 1536277 - RNA, 22 nt, Homo sapiens
uucuggugucuaauaaacacag

SEQ ID NO: 1536278 - RNA, 12 nt, Homo sapiens
uucuguggcuca

SEQ ID NO: 1536279 - RNA, 22 nt, Homo sapiens
uucuuacaauaauucuaugaga

SEQ ID NO: 1536280 - RNA, 13 nt, Homo sapiens
uucuuacuguauu

SEQ ID NO: 1536281 - RNA, 15 nt, Homo sapiens
uucuucaagauccca

SEQ ID NO: 1536282 - RNA, 13 nt, Homo sapiens
uucuuccaucuga

SEQ ID NO: 1536283 - RNA, 21 nt, Homo sapiens
uucuuccuuuuguauccucca

SEQ ID NO: 1536284 - RNA, 13 nt, Homo sapiens
uucuucuuuaggc

SEQ ID NO: 1536285 - RNA, 23 nt, Homo sapiens
uucuuuaacauacaucuaaguca

SEQ ID NO: 1536286 - RNA, 18 nt, Homo sapiens
uugaaaagcucacuucaa

SEQ ID NO: 1536287 - RNA, 14 nt, Homo sapiens
uugaaccuaaacau

SEQ ID NO: 1536288 - RNA, 13 nt, Homo sapiens
uugaagaacucau

SEQ ID NO: 1536289 - RNA, 15 nt, Homo sapiens
uugaagucaucauaa

SEQ ID NO: 1536290 - RNA, 12 nt, Homo sapiens
uugaaugugauu

SEQ ID NO: 1536291 - RNA, 17 nt, Homo sapiens
uugacacggccaugacc

SEQ ID NO: 1536292 - RNA, 18 nt, Homo sapiens
uugagaauacacuaucaa

SEQ ID NO: 1536293 - RNA, 21 nt, Homo sapiens
uugaucccuaaagaaaacaaa

SEQ ID NO: 1536294 - RNA, 18 nt, Homo sapiens
uugaugcuguuucuacau

SEQ ID NO: 1536295 - RNA, 13 nt, Homo sapiens
uugauucucaugc

SEQ ID NO: 1536296 - RNA, 21 nt, Homo sapiens
uugcaaauuauucuagucaac

SEQ ID NO: 1536297 - RNA, 14 nt, Homo sapiens
uugcaacacacaga

SEQ ID NO: 1536298 - RNA, 16 nt, Homo sapiens
uugcacccaugccaua

SEQ ID NO: 1536299 - RNA, 13 nt, Homo sapiens
uugcauacauucu

SEQ ID NO: 1536300 - RNA, 15 nt, Homo sapiens
uugccgcugggagag

SEQ ID NO: 1536301 - RNA, 21 nt, Homo sapiens
uugccugaaguuggagugagu

SEQ ID NO: 1536302 - RNA, 12 nt, Homo sapiens
uugcuaacauau

SEQ ID NO: 1536303 - RNA, 22 nt, Homo sapiens
uugcuauaauguauaaugggaa

SEQ ID NO: 1536304 - RNA, 16 nt, Homo sapiens
uugcugccuucugucu

SEQ ID NO: 1536305 - RNA, 20 nt, Homo sapiens
cugaguagcauauauaauuu

SEQ ID NO: 1536306 - RNA, 22 nt, Homo sapiens
cugagucugugaauaaagccac

SEQ ID NO: 1536307 - RNA, 15 nt, Homo sapiens
cugagugaaguccag

SEQ ID NO: 1536308 - RNA, 13 nt, Homo sapiens
cugauauuggugu

SEQ ID NO: 1536309 - RNA, 23 nt, Homo sapiens
cugauuucucuucagcuuugaaa

SEQ ID NO: 1536310 - RNA, 14 nt, Homo sapiens
cugauuugcaaaug

SEQ ID NO: 1536311 - RNA, 13 nt, Homo sapiens
cugcaacacugga

SEQ ID NO: 1536312 - RNA, 14 nt, Homo sapiens
cugcaauacauuaa

SEQ ID NO: 1536313 - RNA, 16 nt, Homo sapiens
cugcaccugcagggag

SEQ ID NO: 1536314 - RNA, 18 nt, Homo sapiens
cugcaccugcagggagca

SEQ ID NO: 1536315 - RNA, 14 nt, Homo sapiens
cugcacgugcacac

SEQ ID NO: 1536316 - RNA, 15 nt, Homo sapiens
cugcaggaaucaaaa

SEQ ID NO: 1536317 - RNA, 16 nt, Homo sapiens
cugcaguuagcacaga

SEQ ID NO: 1536318 - RNA, 15 nt, Homo sapiens
cugcauaaauguggu

SEQ ID NO: 1536319 - RNA, 23 nt, Homo sapiens
cugcaugcacuucuuacaauaau

SEQ ID NO: 1536320 - RNA, 22 nt, Homo sapiens
cugccaaccagcuuguccaaca

SEQ ID NO: 1536321 - RNA, 13 nt, Homo sapiens
cugccugugguga

SEQ ID NO: 1536322 - RNA, 21 nt, Homo sapiens
cugccuugccaugucuuguuc

SEQ ID NO: 1536323 - RNA, 16 nt, Homo sapiens
cugcgauggugcugca

SEQ ID NO: 1536324 - RNA, 17 nt, Homo sapiens
cugcgcugugcuggucu

SEQ ID NO: 1536325 - RNA, 15 nt, Homo sapiens
cugcucccuagccag

SEQ ID NO: 1536326 - RNA, 15 nt, Homo sapiens
cugcugcacugcccu

SEQ ID NO: 1536327 - RNA, 17 nt, Homo sapiens
cugcugcagucagcaca

SEQ ID NO: 1536328 - RNA, 14 nt, Homo sapiens
cugcugcuggucac

SEQ ID NO: 1536329 - RNA, 14 nt, Homo sapiens
cugcuuaguaucuc

SEQ ID NO: 1536330 - RNA, 20 nt, Homo sapiens
cuggaaaggaggaaggagcc

SEQ ID NO: 1536331 - RNA, 20 nt, Homo sapiens
cuggaaauaacugagcacuu

SEQ ID NO: 1536332 - RNA, 20 nt, Homo sapiens
cuggaacugucucucaugaa

SEQ ID NO: 1536333 - RNA, 19 nt, Homo sapiens
cuggaauaagaagcaaaua

SEQ ID NO: 1536334 - RNA, 23 nt, Homo sapiens
cuggaauaagaagcaaauaaaua

SEQ ID NO: 1536335 - RNA, 13 nt, Homo sapiens
cuggaaucaaaua

SEQ ID NO: 1536336 - RNA, 15 nt, Homo sapiens
cuggagcaugagcca

SEQ ID NO: 1536337 - RNA, 21 nt, Homo sapiens
cuggagcguguacuaccccag

SEQ ID NO: 1536338 - RNA, 17 nt, Homo sapiens
cuggagcugaagcguua

SEQ ID NO: 1536339 - RNA, 23 nt, Homo sapiens
cuggagcuggcgucugucuucaa

SEQ ID NO: 1536340 - RNA, 17 nt, Homo sapiens
cuggaguccuguucuca

SEQ ID NO: 1536341 - RNA, 21 nt, Homo sapiens
cuggaucaagggguucccacu

SEQ ID NO: 1536342 - RNA, 13 nt, Homo sapiens
cuggaucaguaaa

SEQ ID NO: 1536343 - RNA, 20 nt, Homo sapiens
cuggaucucuuaagacagca

SEQ ID NO: 1536344 - RNA, 19 nt, Homo sapiens
cuggcagccgugccuucag

SEQ ID NO: 1536345 - RNA, 23 nt, Homo sapiens
cuggcagggcaggcagagcucag

SEQ ID NO: 1536346 - RNA, 16 nt, Homo sapiens
cuggccccuagaauca

SEQ ID NO: 1536347 - RNA, 16 nt, Homo sapiens
cuggcucagccucaaa

SEQ ID NO: 1536348 - RNA, 20 nt, Homo sapiens
cuggcucccagggccaugaa

SEQ ID NO: 1536349 - RNA, 21 nt, Homo sapiens
cuggcucccagggccaugaac

SEQ ID NO: 1536350 - RNA, 15 nt, Homo sapiens
cuggcugcugcaguc

SEQ ID NO: 1536351 - RNA, 14 nt, Homo sapiens
cuggcuugugaucu

SEQ ID NO: 1536352 - RNA, 22 nt, Homo sapiens
cugggagugauaugauguguag

SEQ ID NO: 1536353 - RNA, 14 nt, Homo sapiens
cugggccauugugg

SEQ ID NO: 1536354 - RNA, 13 nt, Homo sapiens
cugggcccagaag

SEQ ID NO: 1536355 - RNA, 17 nt, Homo sapiens
cuggggacggagcacug

SEQ ID NO: 1536356 - RNA, 12 nt, Homo sapiens
cugggggccaug

SEQ ID NO: 1536357 - RNA, 19 nt, Homo sapiens
cuggguuugggcaguggag

SEQ ID NO: 1536358 - RNA, 20 nt, Homo sapiens
cugguaauuuaagauuccag

SEQ ID NO: 1536359 - RNA, 13 nt, Homo sapiens
cuggucacuucaa

SEQ ID NO: 1536360 - RNA, 17 nt, Homo sapiens
cugguuccuuaaguggc

SEQ ID NO: 1536361 - RNA, 17 nt, Homo sapiens
cugguucuguacaugug

SEQ ID NO: 1536362 - RNA, 19 nt, Homo sapiens
cugguucuguacaugugga

SEQ ID NO: 1536363 - RNA, 15 nt, Homo sapiens
cuguaaauaugucac

SEQ ID NO: 1536364 - RNA, 22 nt, Homo sapiens
cuguaaauaugucacuagagaa

SEQ ID NO: 1536365 - RNA, 22 nt, Homo sapiens
cuguaauagccucaccuucccu

SEQ ID NO: 1536366 - RNA, 20 nt, Homo sapiens
cuguaauauuuacaauguau

SEQ ID NO: 1536367 - RNA, 16 nt, Homo sapiens
cuguauauuuguauga

SEQ ID NO: 1536368 - RNA, 12 nt, Homo sapiens
cugucaacauuu

SEQ ID NO: 1536369 - RNA, 17 nt, Homo sapiens
cugucagucguguugcu

SEQ ID NO: 1536370 - RNA, 15 nt, Homo sapiens
cugucauacuuuguu

SEQ ID NO: 1536371 - RNA, 19 nt, Homo sapiens
cuguccaccugugcugcug

SEQ ID NO: 1536372 - RNA, 12 nt, Homo sapiens
cuguccagagag

SEQ ID NO: 1536373 - RNA, 16 nt, Homo sapiens
cuguccuacaauauca

SEQ ID NO: 1536374 - RNA, 17 nt, Homo sapiens
cugucucucaugaaccu

SEQ ID NO: 1536375 - RNA, 20 nt, Homo sapiens
cugucucucaugaaccucaa

SEQ ID NO: 1536376 - RNA, 17 nt, Homo sapiens
cugugaauaaagccaca

SEQ ID NO: 1536377 - RNA, 19 nt, Homo sapiens
cugugaccgggguccugag

SEQ ID NO: 1536378 - RNA, 19 nt, Homo sapiens
cugugaucuauaccaccuu

SEQ ID NO: 1536379 - RNA, 23 nt, Homo sapiens
cugugaugucaguagugccugug

SEQ ID NO: 1536380 - RNA, 21 nt, Homo sapiens
cugugcguuuuagaguaugca

SEQ ID NO: 1536381 - RNA, 13 nt, Homo sapiens
cuguguccccgcg

SEQ ID NO: 1536382 - RNA, 22 nt, Homo sapiens
cuguucucagagcuccacagaa

SEQ ID NO: 1536383 - RNA, 20 nt, Homo sapiens
cuguuuugcauggaguauua

SEQ ID NO: 1536384 - RNA, 14 nt, Homo sapiens
cuuaaaauuagcau

SEQ ID NO: 1536385 - RNA, 14 nt, Homo sapiens
cuuaacuauccuaa

SEQ ID NO: 1536386 - RNA, 21 nt, Homo sapiens
cuuaagagauuggaucaagua

SEQ ID NO: 1536387 - RNA, 21 nt, Homo sapiens
cuuaaggggacccacaaguau

SEQ ID NO: 1536388 - RNA, 16 nt, Homo sapiens
cuuaauuaaauaucaa

SEQ ID NO: 1536389 - RNA, 17 nt, Homo sapiens
cuuacaacuccugcauc

SEQ ID NO: 1536390 - RNA, 18 nt, Homo sapiens
cuuagaaauugcauuucc

SEQ ID NO: 1536391 - RNA, 14 nt, Homo sapiens
cuuagauugccacu

SEQ ID NO: 1536392 - RNA, 22 nt, Homo sapiens
cuuagcugccccuucugaggau

SEQ ID NO: 1536393 - RNA, 17 nt, Homo sapiens
cuuagcuuagcuuucug

SEQ ID NO: 1536394 - RNA, 22 nt, Homo sapiens
cuuagcuuuucugcaauucaac

SEQ ID NO: 1536395 - RNA, 13 nt, Homo sapiens
cuuaguaucucau

SEQ ID NO: 1536396 - RNA, 22 nt, Homo sapiens
cuuaguaucucaucaacaaaga

SEQ ID NO: 1536397 - RNA, 17 nt, Homo sapiens
cuuagucacuuauuuca

SEQ ID NO: 1536398 - RNA, 16 nt, Homo sapiens
cuuaucauaaauucaa

SEQ ID NO: 1536399 - RNA, 18 nt, Homo sapiens
cuuaugagauacuuugca

SEQ ID NO: 1536400 - RNA, 16 nt, Homo sapiens
cuuauuuaaauuuuca

SEQ ID NO: 1536401 - RNA, 17 nt, Homo sapiens
cuucacuuaaaaucaaa

SEQ ID NO: 1536402 - RNA, 13 nt, Homo sapiens
cuucauaggcaga

SEQ ID NO: 1536403 - RNA, 21 nt, Homo sapiens
cuucauggaacucagcugucu

SEQ ID NO: 1536404 - RNA, 18 nt, Homo sapiens
cuuccaucugauugugau

SEQ ID NO: 1536405 - RNA, 21 nt, Homo sapiens
cuuccccaucgccuucugggg

SEQ ID NO: 1536406 - RNA, 14 nt, Homo sapiens
cuuccucaugaauc

SEQ ID NO: 1536407 - RNA, 15 nt, Homo sapiens
cuuccucuccacugc

SEQ ID NO: 1536408 - RNA, 20 nt, Homo sapiens
cuuccugggcagcccagaga

SEQ ID NO: 1536409 - RNA, 13 nt, Homo sapiens
cuucgacugugac

SEQ ID NO: 1536410 - RNA, 13 nt, Homo sapiens
cuucguggagcuc

SEQ ID NO: 1536411 - RNA, 15 nt, Homo sapiens
cuucuccacagggac

SEQ ID NO: 1536412 - RNA, 18 nt, Homo sapiens
cuucuccccuccaaguga

SEQ ID NO: 1536413 - RNA, 15 nt, Homo sapiens
cuucugaggaugcug

SEQ ID NO: 1536414 - RNA, 16 nt, Homo sapiens
cuucugaggaugcuga

SEQ ID NO: 1536415 - RNA, 17 nt, Homo sapiens
cuugaacaaagucucug

SEQ ID NO: 1536416 - RNA, 16 nt, Homo sapiens
cuugaagaauauuguu

SEQ ID NO: 1536417 - RNA, 20 nt, Homo sapiens
cuugacccauguucucaaua

SEQ ID NO: 1536418 - RNA, 21 nt, Homo sapiens
cuugaggaccuccaccuggga

SEQ ID NO: 1536419 - RNA, 19 nt, Homo sapiens
cuugaugaauaaacacuuu

SEQ ID NO: 1536420 - RNA, 20 nt, Homo sapiens
cuugaugaauaaacacuuuu

SEQ ID NO: 1536421 - RNA, 19 nt, Homo sapiens
cuugauguugcuuagucac

SEQ ID NO: 1536422 - RNA, 12 nt, Homo sapiens
cuuggacaccau

SEQ ID NO: 1536423 - RNA, 13 nt, Homo sapiens
cuuggaugugguu

SEQ ID NO: 1536424 - RNA, 14 nt, Homo sapiens
cuuggaugugguuu

SEQ ID NO: 1536425 - RNA, 20 nt, Homo sapiens
cuugggaccaaaacugccua

SEQ ID NO: 1536426 - RNA, 15 nt, Homo sapiens
cuugucacaaaguga

SEQ ID NO: 1536427 - RNA, 19 nt, Homo sapiens
cuugugaaacacagcuguu

SEQ ID NO: 1536428 - RNA, 12 nt, Homo sapiens
cuuguguacaaa

SEQ ID NO: 1536429 - RNA, 19 nt, Homo sapiens
cuuguugcccucugcaguu

SEQ ID NO: 1536430 - RNA, 14 nt, Homo sapiens
cuuuaacaagacuu

SEQ ID NO: 1536431 - RNA, 17 nt, Homo sapiens
cuuuaacaagacuucaa

SEQ ID NO: 1536432 - RNA, 13 nt, Homo sapiens
cuuuauagcuuug

SEQ ID NO: 1536433 - RNA, 16 nt, Homo sapiens
cuuuauguuacuacau

SEQ ID NO: 1536434 - RNA, 16 nt, Homo sapiens
cuuuauucacaguauc

SEQ ID NO: 1536435 - RNA, 20 nt, Homo sapiens
gaggaagugcacuggcccuc

SEQ ID NO: 1536436 - RNA, 13 nt, Homo sapiens
gaggaaugcuccc

SEQ ID NO: 1536437 - RNA, 15 nt, Homo sapiens
gaggacagcuucccc

SEQ ID NO: 1536438 - RNA, 23 nt, Homo sapiens
gaggacucccugcuuagcucugu

SEQ ID NO: 1536439 - RNA, 13 nt, Homo sapiens
gaggacuccuuaa

SEQ ID NO: 1536440 - RNA, 21 nt, Homo sapiens
gaggcagaauggugggcucca

SEQ ID NO: 1536441 - RNA, 22 nt, Homo sapiens
gaggccgcugcaggguggcauc

SEQ ID NO: 1536442 - RNA, 23 nt, Homo sapiens
gaggccugaaauguuuccaggca

SEQ ID NO: 1536443 - RNA, 13 nt, Homo sapiens
gagggagguguuu

SEQ ID NO: 1536444 - RNA, 17 nt, Homo sapiens
gagggcaggguucuaga

SEQ ID NO: 1536445 - RNA, 17 nt, Homo sapiens
gaggggacugcaugcaa

SEQ ID NO: 1536446 - RNA, 15 nt, Homo sapiens
gagguugugcugccu

SEQ ID NO: 1536447 - RNA, 13 nt, Homo sapiens
gagucacugccug

SEQ ID NO: 1536448 - RNA, 13 nt, Homo sapiens
gaguccuguucuc

SEQ ID NO: 1536449 - RNA, 18 nt, Homo sapiens
gagucucuucuccacugg

SEQ ID NO: 1536450 - RNA, 13 nt, Homo sapiens
gaguggaucugga

SEQ ID NO: 1536451 - RNA, 17 nt, Homo sapiens
gaguuccggaaagccuu

SEQ ID NO: 1536452 - RNA, 19 nt, Homo sapiens
gaguuccggaaagccuucc

SEQ ID NO: 1536453 - RNA, 19 nt, Homo sapiens
gaguuuaugggaaugccuu

SEQ ID NO: 1536454 - RNA, 23 nt, Homo sapiens
gaguuuccagcuaagccugauga

SEQ ID NO: 1536455 - RNA, 19 nt, Homo sapiens
gauaaaaagaaaguuuaua

SEQ ID NO: 1536456 - RNA, 21 nt, Homo sapiens
gauaaauuugacuguuauuug

SEQ ID NO: 1536457 - RNA, 12 nt, Homo sapiens
gauacacuguau

SEQ ID NO: 1536458 - RNA, 16 nt, Homo sapiens
gauacagaaugaaucc

SEQ ID NO: 1536459 - RNA, 11 nt, Homo sapiens
gauacaguauu

SEQ ID NO: 1536460 - RNA, 14 nt, Homo sapiens
gauaggagcuucca

SEQ ID NO: 1536461 - RNA, 20 nt, Homo sapiens
gauauaugacuuuuucucag

SEQ ID NO: 1536462 - RNA, 21 nt, Homo sapiens
gauauucaaucuuaacaaaag

SEQ ID NO: 1536463 - RNA, 19 nt, Homo sapiens
gauauucuaagaaauaucu

SEQ ID NO: 1536464 - RNA, 20 nt, Homo sapiens
gauauuguauguaccuggga

SEQ ID NO: 1536465 - RNA, 19 nt, Homo sapiens
gauccccgacaguggcucu

SEQ ID NO: 1536466 - RNA, 19 nt, Homo sapiens
gaucccuagcugugaccuc

SEQ ID NO: 1536467 - RNA, 19 nt, Homo sapiens
gaucuuggggugcagcacu

SEQ ID NO: 1536468 - RNA, 18 nt, Homo sapiens
gaugaccaaucucuguga

SEQ ID NO: 1536469 - RNA, 21 nt, Homo sapiens
gaugauuuccgucaugcuccc

SEQ ID NO: 1536470 - RNA, 13 nt, Homo sapiens
gaugcaugcaggg

SEQ ID NO: 1536471 - RNA, 19 nt, Homo sapiens
gaugcuacucuaguauucc

SEQ ID NO: 1536472 - RNA, 23 nt, Homo sapiens
gaugcugccaggggcagugaagu

SEQ ID NO: 1536473 - RNA, 17 nt, Homo sapiens
gauggagucagguuugg

SEQ ID NO: 1536474 - RNA, 22 nt, Homo sapiens
gauggcucccugggcuggcaug

SEQ ID NO: 1536475 - RNA, 15 nt, Homo sapiens
gaugugaguugcaca

SEQ ID NO: 1536476 - RNA, 16 nt, Homo sapiens
gauguuuaaucaagag

SEQ ID NO: 1536477 - RNA, 15 nt, Homo sapiens
gauguuuguuuucaa

SEQ ID NO: 1536478 - RNA, 20 nt, Homo sapiens
gauuaaauuuaauauacugc

SEQ ID NO: 1536479 - RNA, 20 nt, Homo sapiens
gauuaacccuauuaaucuau

SEQ ID NO: 1536480 - RNA, 14 nt, Homo sapiens
gauucaaaugcaug

SEQ ID NO: 1536481 - RNA, 21 nt, Homo sapiens
gauucaagacucaauguggaa

SEQ ID NO: 1536482 - RNA, 14 nt, Homo sapiens
gauucauuuuaaca

SEQ ID NO: 1536483 - RNA, 15 nt, Homo sapiens
gauuccccuggacau

SEQ ID NO: 1536484 - RNA, 17 nt, Homo sapiens
gauucuaaauguucaug

SEQ ID NO: 1536485 - RNA, 23 nt, Homo sapiens
gauugaagcuaaaauaaaccaga

SEQ ID NO: 1536486 - RNA, 18 nt, Homo sapiens
gauuggguaucaaaauga

SEQ ID NO: 1536487 - RNA, 19 nt, Homo sapiens
gauugucaccaugaucacu

SEQ ID NO: 1536488 - RNA, 18 nt, Homo sapiens
gauuuauucuggugucua

SEQ ID NO: 1536489 - RNA, 17 nt, Homo sapiens
gauuuauuuuguaugaa

SEQ ID NO: 1536490 - RNA, 19 nt, Homo sapiens
gauuuuggccacacuguca

SEQ ID NO: 1536491 - RNA, 12 nt, Homo sapiens
gauuuuuacaca

SEQ ID NO: 1536492 - RNA, 21 nt, Homo sapiens
gauuuuuacacauguaucuau

SEQ ID NO: 1536493 - RNA, 17 nt, Homo sapiens
gauuuuucugcacuaau

SEQ ID NO: 1536494 - RNA, 15 nt, Homo sapiens
gcaaaacauugcugc

SEQ ID NO: 1536495 - RNA, 15 nt, Homo sapiens
gcaaagaaucaacag

SEQ ID NO: 1536496 - RNA, 17 nt, Homo sapiens
gcaaaguaccaacugag

SEQ ID NO: 1536497 - RNA, 13 nt, Homo sapiens
gcaaauaucuuga

SEQ ID NO: 1536498 - RNA, 20 nt, Homo sapiens
gcaaguauguuuuagcaugu

SEQ ID NO: 1536499 - RNA, 19 nt, Homo sapiens
gcaagucccaugauuucuu

SEQ ID NO: 1536500 - RNA, 22 nt, Homo sapiens
gcacaauauuccuaugcugcaa

SEQ ID NO: 1536501 - RNA, 17 nt, Homo sapiens
gcacacaugguuuccaa

SEQ ID NO: 1536502 - RNA, 20 nt, Homo sapiens
gcacacaugguuuccaaggg

SEQ ID NO: 1536503 - RNA, 16 nt, Homo sapiens
gcacagcuaugaaggc

SEQ ID NO: 1536504 - RNA, 16 nt, Homo sapiens
gcacauccaggcaaug

SEQ ID NO: 1536505 - RNA, 18 nt, Homo sapiens
gcaccaagaccccaaagg

SEQ ID NO: 1536506 - RNA, 18 nt, Homo sapiens
gcacccaugccauagaaa

SEQ ID NO: 1536507 - RNA, 20 nt, Homo sapiens
gcacccuggauuugcauaca

SEQ ID NO: 1536508 - RNA, 18 nt, Homo sapiens
gcaccuacuuacaugcau

SEQ ID NO: 1536509 - RNA, 15 nt, Homo sapiens
gcacgaauggaagag

SEQ ID NO: 1536510 - RNA, 15 nt, Homo sapiens
gcacgcaagccucag

SEQ ID NO: 1536511 - RNA, 20 nt, Homo sapiens
gcacuuuaucuugggaccaa

SEQ ID NO: 1536512 - RNA, 13 nt, Homo sapiens
gcagaaccaaagc

SEQ ID NO: 1536513 - RNA, 18 nt, Homo sapiens
gcagaaggccuugccuug

SEQ ID NO: 1536514 - RNA, 17 nt, Homo sapiens
gcagacucacuguggga

SEQ ID NO: 1536515 - RNA, 19 nt, Homo sapiens
gcagcagcuuuugacuguu

SEQ ID NO: 1536516 - RNA, 13 nt, Homo sapiens
gcagcccagagag

SEQ ID NO: 1536517 - RNA, 21 nt, Homo sapiens
gcagccccuccccauggugca

SEQ ID NO: 1536518 - RNA, 17 nt, Homo sapiens
gcagccugcagacucac

SEQ ID NO: 1536519 - RNA, 19 nt, Homo sapiens
gcagcuucgugugcagcua

SEQ ID NO: 1536520 - RNA, 14 nt, Homo sapiens
gcagcuuuccaguu

SEQ ID NO: 1536521 - RNA, 16 nt, Homo sapiens
gcaggaagucccugag

SEQ ID NO: 1536522 - RNA, 20 nt, Homo sapiens
gcaggccuuuuugagccaau

SEQ ID NO: 1536523 - RNA, 17 nt, Homo sapiens
gcagggcccccacagga

SEQ ID NO: 1536524 - RNA, 14 nt, Homo sapiens
gcaggguucuagaa

SEQ ID NO: 1536525 - RNA, 14 nt, Homo sapiens
gcaguacuugcuca

SEQ ID NO: 1536526 - RNA, 19 nt, Homo sapiens
gcaguggcagcaacaaagg

SEQ ID NO: 1536527 - RNA, 14 nt, Homo sapiens
gcaguugaucucca

SEQ ID NO: 1536528 - RNA, 17 nt, Homo sapiens
gcaguuguuauauucau

SEQ ID NO: 1536529 - RNA, 12 nt, Homo sapiens
gcaucuaucugg

SEQ ID NO: 1536530 - RNA, 17 nt, Homo sapiens
gcaucuggcuaaggcau

SEQ ID NO: 1536531 - RNA, 14 nt, Homo sapiens
gcaugagccagcuc

SEQ ID NO: 1536532 - RNA, 22 nt, Homo sapiens
gcaugcacuucuuacaauaauu

SEQ ID NO: 1536533 - RNA, 16 nt, Homo sapiens
gcauucuagagugcau

SEQ ID NO: 1536534 - RNA, 18 nt, Homo sapiens
gcauuucuucacgcaccu

SEQ ID NO: 1536535 - RNA, 15 nt, Homo sapiens
gccaauaggcagcuu

SEQ ID NO: 1536536 - RNA, 13 nt, Homo sapiens
gccacugccagcu

SEQ ID NO: 1536537 - RNA, 19 nt, Homo sapiens
gccagaaaacauaugcauu

SEQ ID NO: 1536538 - RNA, 20 nt, Homo sapiens
gccagaggcucuaauguaca

SEQ ID NO: 1536539 - RNA, 21 nt, Homo sapiens
gccagaggcucuaauguacaa

SEQ ID NO: 1536540 - RNA, 23 nt, Homo sapiens
gccagaggcucuaauguacaaua

SEQ ID NO: 1536541 - RNA, 20 nt, Homo sapiens
gccagagggccccucacugg

SEQ ID NO: 1536542 - RNA, 17 nt, Homo sapiens
gccagauggggccucug

SEQ ID NO: 1536543 - RNA, 19 nt, Homo sapiens
gccaggcucccacugcccc

SEQ ID NO: 1536544 - RNA, 18 nt, Homo sapiens
gccagggucucgucagga

SEQ ID NO: 1536545 - RNA, 12 nt, Homo sapiens
gccagguggcca

SEQ ID NO: 1536546 - RNA, 15 nt, Homo sapiens
gccagugugggaaug

SEQ ID NO: 1536547 - RNA, 20 nt, Homo sapiens
gccauauucuguaguauuuu

SEQ ID NO: 1536548 - RNA, 24 nt, Homo sapiens
gccaugauuuuggccacuuugcag

SEQ ID NO: 1536549 - RNA, 15 nt, Homo sapiens
gccaugugcugugca

SEQ ID NO: 1536550 - RNA, 22 nt, Homo sapiens
gcccaccucuuguuuuccccuu

SEQ ID NO: 1536551 - RNA, 20 nt, Homo sapiens
gcccagacucaaggccucca

SEQ ID NO: 1536552 - RNA, 20 nt, Homo sapiens
gcccagaggggcggggccag

SEQ ID NO: 1536553 - RNA, 23 nt, Homo sapiens
gcccaggguucccccagcccugu

SEQ ID NO: 1536554 - RNA, 11 nt, Homo sapiens
gccccagagac

SEQ ID NO: 1536555 - RNA, 18 nt, Homo sapiens
gccccagcgagucuggag

SEQ ID NO: 1536556 - RNA, 22 nt, Homo sapiens
gcccccacaggagcguguacua

SEQ ID NO: 1536557 - RNA, 12 nt, Homo sapiens
gcccccaccagc

SEQ ID NO: 1536558 - RNA, 22 nt, Homo sapiens
gcccccacuggagcguguacua

SEQ ID NO: 1536559 - RNA, 16 nt, Homo sapiens
gccccgccccccagag

SEQ ID NO: 1536560 - RNA, 18 nt, Homo sapiens
gccccgccgugucugugg

SEQ ID NO: 1536561 - RNA, 18 nt, Homo sapiens
gcccgacagccuggcaca

SEQ ID NO: 1536562 - RNA, 15 nt, Homo sapiens
gcccuccgcccuucc

SEQ ID NO: 1536563 - RNA, 14 nt, Homo sapiens
gcccucugcugcuu

SEQ ID NO: 1536564 - RNA, 13 nt, Homo sapiens
gccgcugggagag

SEQ ID NO: 1536565 - RNA, 16 nt, Homo sapiens
gggccaggagaaagaa

SEQ ID NO: 1536566 - RNA, 17 nt, Homo sapiens
gggccuuugcagcgucu

SEQ ID NO: 1536567 - RNA, 15 nt, Homo sapiens
gggcgaggacgugaa

SEQ ID NO: 1536568 - RNA, 14 nt, Homo sapiens
ggggaggccaagug

SEQ ID NO: 1536569 - RNA, 17 nt, Homo sapiens
ggggcagcgcagccucc

SEQ ID NO: 1536570 - RNA, 19 nt, Homo sapiens
ggggcgggaaagccaguga

SEQ ID NO: 1536571 - RNA, 19 nt, Homo sapiens
gggguccugguaugucuca

SEQ ID NO: 1536572 - RNA, 20 nt, Homo sapiens
ggggugguuuuugagccaug

SEQ ID NO: 1536573 - RNA, 23 nt, Homo sapiens
ggguaccuaguccccagccugcu

SEQ ID NO: 1536574 - RNA, 13 nt, Homo sapiens
ggguccccaagga

SEQ ID NO: 1536575 - RNA, 18 nt, Homo sapiens
gggugguuuuugagccau

SEQ ID NO: 1536576 - RNA, 20 nt, Homo sapiens
ggguucguggaaagggugcu

SEQ ID NO: 1536577 - RNA, 19 nt, Homo sapiens
gguaucugcugccucugaa

SEQ ID NO: 1536578 - RNA, 18 nt, Homo sapiens
ggucccagcggaugcugc

SEQ ID NO: 1536579 - RNA, 21 nt, Homo sapiens
ggucccuucccccugcuccau

SEQ ID NO: 1536580 - RNA, 14 nt, Homo sapiens
gguccugcacuguc

SEQ ID NO: 1536581 - RNA, 22 nt, Homo sapiens
ggucgucuuuugaaaagcucac

SEQ ID NO: 1536582 - RNA, 13 nt, Homo sapiens
ggugcaugccuuc

SEQ ID NO: 1536583 - RNA, 21 nt, Homo sapiens
ggugccugugaccgggguccu

SEQ ID NO: 1536584 - RNA, 14 nt, Homo sapiens
gguggucuuggaga

SEQ ID NO: 1536585 - RNA, 22 nt, Homo sapiens
ggugguuuuugagccaugcgug

SEQ ID NO: 1536586 - RNA, 18 nt, Homo sapiens
gguguccuguuccugcca

SEQ ID NO: 1536587 - RNA, 21 nt, Homo sapiens
gguguccuguuccugccacau

SEQ ID NO: 1536588 - RNA, 16 nt, Homo sapiens
ggugugggucagggag

SEQ ID NO: 1536589 - RNA, 11 nt, Homo sapiens
gguuaccucug

SEQ ID NO: 1536590 - RNA, 18 nt, Homo sapiens
gguuggcugggcccagaa

SEQ ID NO: 1536591 - RNA, 21 nt, Homo sapiens
gguuggcugggcccagaaggu

SEQ ID NO: 1536592 - RNA, 13 nt, Homo sapiens
gguuuagaaucaa

SEQ ID NO: 1536593 - RNA, 22 nt, Homo sapiens
gguuucuaacccacccucacga

SEQ ID NO: 1536594 - RNA, 16 nt, Homo sapiens
gguuuuucuguucccu

SEQ ID NO: 1536595 - RNA, 21 nt, Homo sapiens
guaaaauagaauguuacuuug

SEQ ID NO: 1536596 - RNA, 20 nt, Homo sapiens
guaacacacacacacauaca

SEQ ID NO: 1536597 - RNA, 17 nt, Homo sapiens
guaacauagaugccugg

SEQ ID NO: 1536598 - RNA, 11 nt, Homo sapiens
guaacuguccu

SEQ ID NO: 1536599 - RNA, 18 nt, Homo sapiens
guaaggacuugugccucu

SEQ ID NO: 1536600 - RNA, 23 nt, Homo sapiens
guaaggacuugugccucuuggga

SEQ ID NO: 1536601 - RNA, 23 nt, Homo sapiens
guaauagggcuucugccuaagcc

SEQ ID NO: 1536602 - RNA, 17 nt, Homo sapiens
guaaugugucaaagaga

SEQ ID NO: 1536603 - RNA, 17 nt, Homo sapiens
guaauuccucccuaaga

SEQ ID NO: 1536604 - RNA, 14 nt, Homo sapiens
guaauuguuacaau

SEQ ID NO: 1536605 - RNA, 15 nt, Homo sapiens
guacaagcauucugu

SEQ ID NO: 1536606 - RNA, 19 nt, Homo sapiens
guacaauaaagcaaugugg

SEQ ID NO: 1536607 - RNA, 13 nt, Homo sapiens
guacuaccccaga

SEQ ID NO: 1536608 - RNA, 20 nt, Homo sapiens
guacuugugaaacacagcug

SEQ ID NO: 1536609 - RNA, 16 nt, Homo sapiens
guagcaacccaggugu

SEQ ID NO: 1536610 - RNA, 12 nt, Homo sapiens
guagcacugaaa

SEQ ID NO: 1536611 - RNA, 13 nt, Homo sapiens
guagggaugccuu

SEQ ID NO: 1536612 - RNA, 15 nt, Homo sapiens
guagggugaggcgug

SEQ ID NO: 1536613 - RNA, 17 nt, Homo sapiens
guaguagcucgugugcu

SEQ ID NO: 1536614 - RNA, 15 nt, Homo sapiens
guagucauuuugccc

SEQ ID NO: 1536615 - RNA, 16 nt, Homo sapiens
guagucauuuugccca

SEQ ID NO: 1536616 - RNA, 21 nt, Homo sapiens
guauaacaagccaaacauucu

SEQ ID NO: 1536617 - RNA, 21 nt, Homo sapiens
guauauuucuaguauggcaca

SEQ ID NO: 1536618 - RNA, 21 nt, Homo sapiens
guaucaaaaugaaugccaguc

SEQ ID NO: 1536619 - RNA, 14 nt, Homo sapiens
guaucuaugcauuu

SEQ ID NO: 1536620 - RNA, 21 nt, Homo sapiens
guaucucgaagucuuccauca

SEQ ID NO: 1536621 - RNA, 21 nt, Homo sapiens
guauuuauauuagagugcccu

SEQ ID NO: 1536622 - RNA, 22 nt, Homo sapiens
gucaacauuuguuagaaccagu

SEQ ID NO: 1536623 - RNA, 18 nt, Homo sapiens
gucacuugccagucacuc

SEQ ID NO: 1536624 - RNA, 18 nt, Homo sapiens
gucaguagugccugugau

SEQ ID NO: 1536625 - RNA, 15 nt, Homo sapiens
gucauaccauccauc

SEQ ID NO: 1536626 - RNA, 15 nt, Homo sapiens
gucaucccggggcca

SEQ ID NO: 1536627 - RNA, 14 nt, Homo sapiens
gucauuucauuucc

SEQ ID NO: 1536628 - RNA, 12 nt, Homo sapiens
guccaggccagg

SEQ ID NO: 1536629 - RNA, 22 nt, Homo sapiens
guccaucugucuguccuacccg

SEQ ID NO: 1536630 - RNA, 13 nt, Homo sapiens
gucccucucaggc

SEQ ID NO: 1536631 - RNA, 16 nt, Homo sapiens
gucccucucucuggaa

SEQ ID NO: 1536632 - RNA, 15 nt, Homo sapiens
guccuaagcccacaa

SEQ ID NO: 1536633 - RNA, 20 nt, Homo sapiens
guccugggggcugcugcacu

SEQ ID NO: 1536634 - RNA, 19 nt, Homo sapiens
guccuuagaauacuguauu

SEQ ID NO: 1536635 - RNA, 15 nt, Homo sapiens
guccuugucgcugug

SEQ ID NO: 1536636 - RNA, 22 nt, Homo sapiens
gucucaaaccuccaaaagcccu

SEQ ID NO: 1536637 - RNA, 21 nt, Homo sapiens
gucucucaugaaccucaagcu

SEQ ID NO: 1536638 - RNA, 17 nt, Homo sapiens
gucugcuuaguaucuca

SEQ ID NO: 1536639 - RNA, 20 nt, Homo sapiens
gucugcuuaguaucucauca

SEQ ID NO: 1536640 - RNA, 22 nt, Homo sapiens
gucugugaaagucuccuguauc

SEQ ID NO: 1536641 - RNA, 22 nt, Homo sapiens
gucuuaauauauauauccagau

SEQ ID NO: 1536642 - RNA, 22 nt, Homo sapiens
gucuucaagccuggcccaguga

SEQ ID NO: 1536643 - RNA, 21 nt, Homo sapiens
gucuuccuccuaaauuuccag

SEQ ID NO: 1536644 - RNA, 21 nt, Homo sapiens
gucuuggauugguaccagagc

SEQ ID NO: 1536645 - RNA, 20 nt, Homo sapiens
gucuuuggcuucagaauugu

SEQ ID NO: 1536646 - RNA, 22 nt, Homo sapiens
gucuuuuaaugauacugucuaa

SEQ ID NO: 1536647 - RNA, 13 nt, Homo sapiens
gugaaaaugugac

SEQ ID NO: 1536648 - RNA, 23 nt, Homo sapiens
gugaaauuuacaguuacugccua

SEQ ID NO: 1536649 - RNA, 23 nt, Homo sapiens
gugaagcauucuccccaguguau

SEQ ID NO: 1536650 - RNA, 12 nt, Homo sapiens
gugaucuauacc

SEQ ID NO: 1536651 - RNA, 15 nt, Homo sapiens
gugauuuacgcucau

SEQ ID NO: 1536652 - RNA, 22 nt, Homo sapiens
gugauuuuggccacacugucaa

SEQ ID NO: 1536653 - RNA, 12 nt, Homo sapiens
gugcacacaccu

SEQ ID NO: 1536654 - RNA, 14 nt, Homo sapiens
gugcacacaccugc

SEQ ID NO: 1536655 - RNA, 14 nt, Homo sapiens
gugcacggggccag

SEQ ID NO: 1536656 - RNA, 14 nt, Homo sapiens
gugcuuguucuucc

SEQ ID NO: 1536657 - RNA, 18 nt, Homo sapiens
guggaaaaaaaaagaaua

SEQ ID NO: 1536658 - RNA, 15 nt, Homo sapiens
guggaaaacucacag

SEQ ID NO: 1536659 - RNA, 20 nt, Homo sapiens
gugguuuauugaaugugauu

SEQ ID NO: 1536660 - RNA, 19 nt, Homo sapiens
guguaucgcugccuugcca

SEQ ID NO: 1536661 - RNA, 20 nt, Homo sapiens
gugucauauauggggggcca

SEQ ID NO: 1536662 - RNA, 18 nt, Homo sapiens
gugucaugauuucaauga

SEQ ID NO: 1536663 - RNA, 14 nt, Homo sapiens
guguggaguggagg

SEQ ID NO: 1536664 - RNA, 20 nt, Homo sapiens
gugugguauucaacuaauac

SEQ ID NO: 1536665 - RNA, 12 nt, Homo sapiens
guguucuuccca

SEQ ID NO: 1536666 - RNA, 12 nt, Homo sapiens
guguuguucaua

SEQ ID NO: 1536667 - RNA, 20 nt, Homo sapiens
guguuugguucuggggcccc

SEQ ID NO: 1536668 - RNA, 16 nt, Homo sapiens
guguuuugcaagggaa

SEQ ID NO: 1536669 - RNA, 13 nt, Homo sapiens
guuaaaugaacuu

SEQ ID NO: 1536670 - RNA, 14 nt, Homo sapiens
guuaagccauauga

SEQ ID NO: 1536671 - RNA, 20 nt, Homo sapiens
guuaauaaagugcacugcca

SEQ ID NO: 1536672 - RNA, 15 nt, Homo sapiens
guuaauguacuuuca

SEQ ID NO: 1536673 - RNA, 15 nt, Homo sapiens
guuauagaaacugau

SEQ ID NO: 1536674 - RNA, 14 nt, Homo sapiens
guuauaguugauau

SEQ ID NO: 1536675 - RNA, 17 nt, Homo sapiens
guucaaucaaacuuuca

SEQ ID NO: 1536676 - RNA, 17 nt, Homo sapiens
guucacgcaacuugaaa

SEQ ID NO: 1536677 - RNA, 17 nt, Homo sapiens
guucacucuacuuagca

SEQ ID NO: 1536678 - RNA, 18 nt, Homo sapiens
guuccacauauauuucca

SEQ ID NO: 1536679 - RNA, 17 nt, Homo sapiens
guuccaugaagacaaau

SEQ ID NO: 1536680 - RNA, 13 nt, Homo sapiens
guuccccuggaaa

SEQ ID NO: 1536681 - RNA, 20 nt, Homo sapiens
guucucaauacccacugcca

SEQ ID NO: 1536682 - RNA, 23 nt, Homo sapiens
guucucaauacccacugccagac

SEQ ID NO: 1536683 - RNA, 19 nt, Homo sapiens
guucuucuguucugcagac

SEQ ID NO: 1536684 - RNA, 15 nt, Homo sapiens
guugaagaaggcaaa

SEQ ID NO: 1536685 - RNA, 13 nt, Homo sapiens
guugauguugaua

SEQ ID NO: 1536686 - RNA, 21 nt, Homo sapiens
guuggcucacaucauguaaua

SEQ ID NO: 1536687 - RNA, 15 nt, Homo sapiens
guuggguuccagaca

SEQ ID NO: 1536688 - RNA, 10 nt, Homo sapiens
guuguucaua

SEQ ID NO: 1536689 - RNA, 18 nt, Homo sapiens
guuuagaaucaagucugu

SEQ ID NO: 1536690 - RNA, 20 nt, Homo sapiens
guuuagaaucaagucuguga

SEQ ID NO: 1536691 - RNA, 17 nt, Homo sapiens
guuuagugugauuguga

SEQ ID NO: 1536692 - RNA, 16 nt, Homo sapiens
guuuauaauuguuaua

SEQ ID NO: 1536693 - RNA, 16 nt, Homo sapiens
guuuauugaaugugau

SEQ ID NO: 1536694 - RNA, 18 nt, Homo sapiens
guuuccaaguuuauugcc

SEQ ID NO: 1536695 - RNA, 20 nt, Homo sapiens
uagaggauuaguaagaucuc

SEQ ID NO: 1536696 - RNA, 14 nt, Homo sapiens
uagaggcuauuccu

SEQ ID NO: 1536697 - RNA, 19 nt, Homo sapiens
uagauauucauacuuucca

SEQ ID NO: 1536698 - RNA, 17 nt, Homo sapiens
uagaugcugacuguacu

SEQ ID NO: 1536699 - RNA, 11 nt, Homo sapiens
uagaugggcau

SEQ ID NO: 1536700 - RNA, 17 nt, Homo sapiens
uagcaagaagauucuaa

SEQ ID NO: 1536701 - RNA, 12 nt, Homo sapiens
uagccaaagagg

SEQ ID NO: 1536702 - RNA, 23 nt, Homo sapiens
uagccagaggcucuaauguacaa

SEQ ID NO: 1536703 - RNA, 16 nt, Homo sapiens
uagccagugaaaaacu

SEQ ID NO: 1536704 - RNA, 14 nt, Homo sapiens
uagccucaccuucc

SEQ ID NO: 1536705 - RNA, 15 nt, Homo sapiens
uagcgcccaagcuca

SEQ ID NO: 1536706 - RNA, 23 nt, Homo sapiens
uagcuggagagagaguucucaca

SEQ ID NO: 1536707 - RNA, 13 nt, Homo sapiens
uagcuuaguucuc

SEQ ID NO: 1536708 - RNA, 13 nt, Homo sapiens
uaggagcuuccag

SEQ ID NO: 1536709 - RNA, 12 nt, Homo sapiens
uaggcauacucu

SEQ ID NO: 1536710 - RNA, 19 nt, Homo sapiens
uaggcauacucuccaggau

SEQ ID NO: 1536711 - RNA, 22 nt, Homo sapiens
uagggaugccuuucuaguccua

SEQ ID NO: 1536712 - RNA, 19 nt, Homo sapiens
uaguaacacauaaaguaaa

SEQ ID NO: 1536713 - RNA, 18 nt, Homo sapiens
uaguagcagagucauugu

SEQ ID NO: 1536714 - RNA, 21 nt, Homo sapiens
uagucaaucaaacagggacac

SEQ ID NO: 1536715 - RNA, 13 nt, Homo sapiens
uagucacauauca

SEQ ID NO: 1536716 - RNA, 18 nt, Homo sapiens
uagugacccggaggccac

SEQ ID NO: 1536717 - RNA, 18 nt, Homo sapiens
uaguuaaauuggcuuguu

SEQ ID NO: 1536718 - RNA, 21 nt, Homo sapiens
uauacauagucuuuguuuaca

SEQ ID NO: 1536719 - RNA, 17 nt, Homo sapiens
uauacauguauagugag

SEQ ID NO: 1536720 - RNA, 14 nt, Homo sapiens
uauaguuuugucac

SEQ ID NO: 1536721 - RNA, 18 nt, Homo sapiens
uauauaauuuuauugcug

SEQ ID NO: 1536722 - RNA, 16 nt, Homo sapiens
uauauauacauguaua

SEQ ID NO: 1536723 - RNA, 17 nt, Homo sapiens
uauauaugaaaacuaag

SEQ ID NO: 1536724 - RNA, 16 nt, Homo sapiens
uauauuccagguuuaa

SEQ ID NO: 1536725 - RNA, 22 nt, Homo sapiens
uauauuuccacuucuucauucu

SEQ ID NO: 1536726 - RNA, 21 nt, Homo sapiens
uauauuuucugaguagcauau

SEQ ID NO: 1536727 - RNA, 12 nt, Homo sapiens
uaucaccaaaaa

SEQ ID NO: 1536728 - RNA, 15 nt, Homo sapiens
uaucagaguauguca

SEQ ID NO: 1536729 - RNA, 15 nt, Homo sapiens
uaucaggaugccuua

SEQ ID NO: 1536730 - RNA, 20 nt, Homo sapiens
uaucaggguuuaacaauagg

SEQ ID NO: 1536731 - RNA, 22 nt, Homo sapiens
uaucauuaaccuuaucauaaau

SEQ ID NO: 1536732 - RNA, 15 nt, Homo sapiens
uaucgcugccuugcc

SEQ ID NO: 1536733 - RNA, 12 nt, Homo sapiens
uaucuaugcauu

SEQ ID NO: 1536734 - RNA, 18 nt, Homo sapiens
uaucuuacuuuccucuga

SEQ ID NO: 1536735 - RNA, 19 nt, Homo sapiens
uaugaaggcuguacacugc

SEQ ID NO: 1536736 - RNA, 17 nt, Homo sapiens
uaugaccuaaauccauu

SEQ ID NO: 1536737 - RNA, 22 nt, Homo sapiens
uaugacucaccuugcucugcca

SEQ ID NO: 1536738 - RNA, 23 nt, Homo sapiens
uaugagucucuaugaucuuggca

SEQ ID NO: 1536739 - RNA, 13 nt, Homo sapiens
uaugauuagcuuu

SEQ ID NO: 1536740 - RNA, 16 nt, Homo sapiens
uaugcuguaucugugc

SEQ ID NO: 1536741 - RNA, 19 nt, Homo sapiens
uaugcuuauauuguucacu

SEQ ID NO: 1536742 - RNA, 13 nt, Homo sapiens
uauggaaagggug

SEQ ID NO: 1536743 - RNA, 12 nt, Homo sapiens
uauggacuucca

SEQ ID NO: 1536744 - RNA, 19 nt, Homo sapiens
uauggcagacauugugcua

SEQ ID NO: 1536745 - RNA, 13 nt, Homo sapiens
uauggggggccaa

SEQ ID NO: 1536746 - RNA, 19 nt, Homo sapiens
uaugguagaaaaauuucac

SEQ ID NO: 1536747 - RNA, 16 nt, Homo sapiens
uauguagaacuguuca

SEQ ID NO: 1536748 - RNA, 15 nt, Homo sapiens
uauguauaacaagcc

SEQ ID NO: 1536749 - RNA, 21 nt, Homo sapiens
uauguauaacaagccaaacau

SEQ ID NO: 1536750 - RNA, 13 nt, Homo sapiens
uauguccaugaaa

SEQ ID NO: 1536751 - RNA, 13 nt, Homo sapiens
uauuaaccugaau

SEQ ID NO: 1536752 - RNA, 12 nt, Homo sapiens
uauuacacauca

SEQ ID NO: 1536753 - RNA, 16 nt, Homo sapiens
uauuacugaugugugc

SEQ ID NO: 1536754 - RNA, 15 nt, Homo sapiens
uauuauaucauuaac

SEQ ID NO: 1536755 - RNA, 13 nt, Homo sapiens
uauucaacuaaua

SEQ ID NO: 1536756 - RNA, 14 nt, Homo sapiens
uauucccccaaagc

SEQ ID NO: 1536757 - RNA, 23 nt, Homo sapiens
uauucuaacuuuuauuuuuauca

SEQ ID NO: 1536758 - RNA, 21 nt, Homo sapiens
uauucuaagaaauaucuguga

SEQ ID NO: 1536759 - RNA, 23 nt, Homo sapiens
uauucuuuuuggaaauaaaauac

SEQ ID NO: 1536760 - RNA, 21 nt, Homo sapiens
uauugcccuuuaacaagacuu

SEQ ID NO: 1536761 - RNA, 22 nt, Homo sapiens
uauugguuuuaaaaaagcauua

SEQ ID NO: 1536762 - RNA, 14 nt, Homo sapiens
uauuuaauuagcca

SEQ ID NO: 1536763 - RNA, 15 nt, Homo sapiens
uauuuacaugugauu

SEQ ID NO: 1536764 - RNA, 15 nt, Homo sapiens
uauuuccaacaaacu

SEQ ID NO: 1536765 - RNA, 23 nt, Homo sapiens
uauuucuaaaacauuaauugagg

SEQ ID NO: 1536766 - RNA, 21 nt, Homo sapiens
uauuucuaucugcaaauaguu

SEQ ID NO: 1536767 - RNA, 15 nt, Homo sapiens
uauuuucaagcaaau

SEQ ID NO: 1536768 - RNA, 11 nt, Homo sapiens
ucaaaaaucau

SEQ ID NO: 1536769 - RNA, 12 nt, Homo sapiens
ucaaaauacuuc

SEQ ID NO: 1536770 - RNA, 14 nt, Homo sapiens
ucaaaauaguucua

SEQ ID NO: 1536771 - RNA, 19 nt, Homo sapiens
ucaaacagggacacuacaa

SEQ ID NO: 1536772 - RNA, 18 nt, Homo sapiens
ucaaagaaucaccuaauu

SEQ ID NO: 1536773 - RNA, 22 nt, Homo sapiens
ucaaagagggagugcauuuaug

SEQ ID NO: 1536774 - RNA, 13 nt, Homo sapiens
ucaaaguguuuaa

SEQ ID NO: 1536775 - RNA, 20 nt, Homo sapiens
ucaaaguguuuaauuguaua

SEQ ID NO: 1536776 - RNA, 23 nt, Homo sapiens
ucaaauugucuuuugucaugugg

SEQ ID NO: 1536777 - RNA, 22 nt, Homo sapiens
ucaacauuuguuagaaccaguc

SEQ ID NO: 1536778 - RNA, 15 nt, Homo sapiens
ucaaccugugaugag

SEQ ID NO: 1536779 - RNA, 23 nt, Homo sapiens
ucaacuucaggaaagcagcaguu

SEQ ID NO: 1536780 - RNA, 17 nt, Homo sapiens
ucaagaucccauuugaa

SEQ ID NO: 1536781 - RNA, 18 nt, Homo sapiens
ucaagauccugucuugcu

SEQ ID NO: 1536782 - RNA, 19 nt, Homo sapiens
ucaaggaagugauaacacu

SEQ ID NO: 1536783 - RNA, 16 nt, Homo sapiens
ucaauacccacugcca

SEQ ID NO: 1536784 - RNA, 22 nt, Homo sapiens
ucaauacuuuuguguauucugu

SEQ ID NO: 1536785 - RNA, 16 nt, Homo sapiens
ucaaucaaacuuucag

SEQ ID NO: 1536786 - RNA, 15 nt, Homo sapiens
ucaaugcuagcacaa

SEQ ID NO: 1536787 - RNA, 18 nt, Homo sapiens
ucacaacacaaucaaaag

SEQ ID NO: 1536788 - RNA, 13 nt, Homo sapiens
ucaccaugaucac

SEQ ID NO: 1536789 - RNA, 13 nt, Homo sapiens
ucacccaaaacaa

SEQ ID NO: 1536790 - RNA, 13 nt, Homo sapiens
ucacccuccucau

SEQ ID NO: 1536791 - RNA, 17 nt, Homo sapiens
ucacuguccauuccaaa

SEQ ID NO: 1536792 - RNA, 20 nt, Homo sapiens
ucacuuauuucauaaacaac

SEQ ID NO: 1536793 - RNA, 14 nt, Homo sapiens
ucacuucucccacc

SEQ ID NO: 1536794 - RNA, 15 nt, Homo sapiens
ucagaaaauuucuca

SEQ ID NO: 1536795 - RNA, 18 nt, Homo sapiens
ucagaaguuucuucuuua

SEQ ID NO: 1536796 - RNA, 21 nt, Homo sapiens
ucagacaguggaugagacaca

SEQ ID NO: 1536797 - RNA, 16 nt, Homo sapiens
ucagaccuuugucuga

SEQ ID NO: 1536798 - RNA, 13 nt, Homo sapiens
ucagagacauaca

SEQ ID NO: 1536799 - RNA, 20 nt, Homo sapiens
ucagagagcuaaauuacaau

SEQ ID NO: 1536800 - RNA, 19 nt, Homo sapiens
ucagauuuuuaaaagcccu

SEQ ID NO: 1536801 - RNA, 16 nt, Homo sapiens
ucagcaccaugggccu

SEQ ID NO: 1536802 - RNA, 16 nt, Homo sapiens
ucagcaccugggaccc

SEQ ID NO: 1536803 - RNA, 23 nt, Homo sapiens
ucagcaugauguguuguguauaa

SEQ ID NO: 1536804 - RNA, 20 nt, Homo sapiens
ucaggaagccuccugcugag

SEQ ID NO: 1536805 - RNA, 21 nt, Homo sapiens
ucaggaagccuccugcugagu

SEQ ID NO: 1536806 - RNA, 19 nt, Homo sapiens
ucaggaccccaucugcuga

SEQ ID NO: 1536807 - RNA, 14 nt, Homo sapiens
ucaggaggagacag

SEQ ID NO: 1536808 - RNA, 16 nt, Homo sapiens
ucaggcuugcauuaaa

SEQ ID NO: 1536809 - RNA, 12 nt, Homo sapiens
ucagggaccaag

SEQ ID NO: 1536810 - RNA, 14 nt, Homo sapiens
ucagggaccaagga

SEQ ID NO: 1536811 - RNA, 18 nt, Homo sapiens
ucaggguguuaaggcagu

SEQ ID NO: 1536812 - RNA, 23 nt, Homo sapiens
ucaguacuugugaaacacagcug

SEQ ID NO: 1536813 - RNA, 18 nt, Homo sapiens
ucaguagugccugugauc

SEQ ID NO: 1536814 - RNA, 21 nt, Homo sapiens
ucagugaagcccaggaggacc

SEQ ID NO: 1536815 - RNA, 21 nt, Homo sapiens
ucauaacaauguaugugaaag

SEQ ID NO: 1536816 - RNA, 16 nt, Homo sapiens
ucauaaccuuaccaga

SEQ ID NO: 1536817 - RNA, 14 nt, Homo sapiens
ucauaccauccauc

SEQ ID NO: 1536818 - RNA, 23 nt, Homo sapiens
ucauaccauccaucccuggugaa

SEQ ID NO: 1536819 - RNA, 12 nt, Homo sapiens
ucauacuuucca

SEQ ID NO: 1536820 - RNA, 16 nt, Homo sapiens
ucauccagaacugucu

SEQ ID NO: 1536821 - RNA, 22 nt, Homo sapiens
ucaucucuucuuuuaaaccauu

SEQ ID NO: 1536822 - RNA, 23 nt, Homo sapiens
ucaugauuucaaugauuguuuaa

SEQ ID NO: 1536823 - RNA, 16 nt, Homo sapiens
ucaugauuugcaacuu

SEQ ID NO: 1536824 - RNA, 20 nt, Homo sapiens
ucauguucuugcagucauca

SEQ ID NO: 1536825 - RNA, 20 nt, Homo sapiens
uuuucugcuaccugguuuuc

SEQ ID NO: 1536826 - RNA, 13 nt, Homo sapiens
uuuucugcuguaa

SEQ ID NO: 1536827 - RNA, 20 nt, Homo sapiens
uuuugagaauacacuaucaa

SEQ ID NO: 1536828 - RNA, 17 nt, Homo sapiens
uuuugcaaaacauaucu

SEQ ID NO: 1536829 - RNA, 15 nt, Homo sapiens
uuuuuaagacucaau

SEQ ID NO: 1536830 - RNA, 13 nt, Homo sapiens
uuuuuucugauaa

SEQ ID NO: 1536831 - RNA, 15 nt, Homo sapiens
cuuuccaaauugaug

SEQ ID NO: 1536832 - RNA, 15 nt, Homo sapiens
cuuuccucccaaagg

SEQ ID NO: 1536833 - RNA, 14 nt, Homo sapiens
cuuuccugggucug

SEQ ID NO: 1536834 - RNA, 15 nt, Homo sapiens
cuuucuaaagacagg

SEQ ID NO: 1536835 - RNA, 15 nt, Homo sapiens
cuuucugucugugaa

SEQ ID NO: 1536836 - RNA, 21 nt, Homo sapiens
cuuugaaguggcaccuaauaa

SEQ ID NO: 1536837 - RNA, 20 nt, Homo sapiens
cuuugaccucaaccugugau

SEQ ID NO: 1536838 - RNA, 19 nt, Homo sapiens
cuuugccacauccauugac

SEQ ID NO: 1536839 - RNA, 21 nt, Homo sapiens
cuuugcuggaguccuguucuc

SEQ ID NO: 1536840 - RNA, 15 nt, Homo sapiens
cuuuggaucaggaaa

SEQ ID NO: 1536841 - RNA, 21 nt, Homo sapiens
cuuuggcuuaauuccaaucau

SEQ ID NO: 1536842 - RNA, 16 nt, Homo sapiens
cuuugguaauguguca

SEQ ID NO: 1536843 - RNA, 19 nt, Homo sapiens
cuuugguuucugucuguaa

SEQ ID NO: 1536844 - RNA, 16 nt, Homo sapiens
cuuugugugauugaau

SEQ ID NO: 1536845 - RNA, 23 nt, Homo sapiens
cuuuguuuacaugaguucaaaua

SEQ ID NO: 1536846 - RNA, 21 nt, Homo sapiens
cuuuuaucucacaaauaagua

SEQ ID NO: 1536847 - RNA, 17 nt, Homo sapiens
cuuuuauucauuagcug

SEQ ID NO: 1536848 - RNA, 17 nt, Homo sapiens
cuuuucaaacacacaca

SEQ ID NO: 1536849 - RNA, 16 nt, Homo sapiens
cuuuuccuggacacuu

SEQ ID NO: 1536850 - RNA, 18 nt, Homo sapiens
cugcaugcacuucuuaca

SEQ ID NO: 1536851 - RNA, 21 nt, Homo sapiens
cugccccccuucccaccccua

SEQ ID NO: 1536852 - RNA, 19 nt, Homo sapiens
cugccuaaauccacucugc

SEQ ID NO: 1536853 - RNA, 19 nt, Homo sapiens
cugccuccccaacccugcc

SEQ ID NO: 1536854 - RNA, 22 nt, Homo sapiens
cugccuucuccccuccaaguga

SEQ ID NO: 1536855 - RNA, 16 nt, Homo sapiens
cugccuuggacaccau

SEQ ID NO: 1536856 - RNA, 14 nt, Homo sapiens
cugccuuuuaguuc

SEQ ID NO: 1536857 - RNA, 13 nt, Homo sapiens
cugcuccaugcag

SEQ ID NO: 1536858 - RNA, 14 nt, Homo sapiens
cugcuccaugcaga

SEQ ID NO: 1536859 - RNA, 18 nt, Homo sapiens
cugcucccggcucugagg

SEQ ID NO: 1536860 - RNA, 18 nt, Homo sapiens
cugcucggccgucuucac

SEQ ID NO: 1536861 - RNA, 21 nt, Homo sapiens
cugcuuagugucccuuaccug

SEQ ID NO: 1536862 - RNA, 23 nt, Homo sapiens
cuggaagaggaauccagugaaug

SEQ ID NO: 1536863 - RNA, 14 nt, Homo sapiens
cuggagcaugagcc

SEQ ID NO: 1536864 - RNA, 15 nt, Homo sapiens
cuggaggccucugca

SEQ ID NO: 1536865 - RNA, 15 nt, Homo sapiens
aaaauggaacauuaa

SEQ ID NO: 1536866 - RNA, 19 nt, Homo sapiens
aaacaaaacuugcaugcag

SEQ ID NO: 1536867 - RNA, 11 nt, Homo sapiens
aaacaaauggc

SEQ ID NO: 1536868 - RNA, 22 nt, Homo sapiens
aaacaaauucaagaaugcagua

SEQ ID NO: 1536869 - RNA, 13 nt, Homo sapiens
aaacacagauuau

SEQ ID NO: 1536870 - RNA, 19 nt, Homo sapiens
aaacagaacggguucuccc

SEQ ID NO: 1536871 - RNA, 14 nt, Homo sapiens
aaacagcagguugu

SEQ ID NO: 1536872 - RNA, 16 nt, Homo sapiens
aaacagcuugaugcug

SEQ ID NO: 1536873 - RNA, 21 nt, Homo sapiens
aaacaguugcacagcaucuca

SEQ ID NO: 1536874 - RNA, 14 nt, Homo sapiens
aaacauaauaucuu

SEQ ID NO: 1536875 - RNA, 13 nt, Homo sapiens
aaacauacguucu

SEQ ID NO: 1536876 - RNA, 18 nt, Homo sapiens
aaacauggccacauccaa

SEQ ID NO: 1536877 - RNA, 21 nt, Homo sapiens
aaacauuaaaagaagacugga

SEQ ID NO: 1536878 - RNA, 15 nt, Homo sapiens
aaacauucuuuaaca

SEQ ID NO: 1536879 - RNA, 18 nt, Homo sapiens
aaacauucuuuaacauac

SEQ ID NO: 1536880 - RNA, 18 nt, Homo sapiens
aaaccaucaaaaauauuc

SEQ ID NO: 1536881 - RNA, 19 nt, Homo sapiens
aaaccauugugcauucuag

SEQ ID NO: 1536882 - RNA, 15 nt, Homo sapiens
aaacgagauuugcca

SEQ ID NO: 1536883 - RNA, 13 nt, Homo sapiens
aaacugaagccca

SEQ ID NO: 1536884 - RNA, 16 nt, Homo sapiens
aaagaaaaguauuucc

SEQ ID NO: 1536885 - RNA, 16 nt, Homo sapiens
aaagacuacacuguug

SEQ ID NO: 1536886 - RNA, 17 nt, Homo sapiens
aaagagaaaaaccaaug

SEQ ID NO: 1536887 - RNA, 19 nt, Homo sapiens
aaagaggaggagaguugaa

SEQ ID NO: 1536888 - RNA, 20 nt, Homo sapiens
aaagauugauuaaugaacua

SEQ ID NO: 1536889 - RNA, 19 nt, Homo sapiens
aaagauugcuauaauguau

SEQ ID NO: 1536890 - RNA, 21 nt, Homo sapiens
aaagauugcuauaauguauaa

SEQ ID NO: 1536891 - RNA, 20 nt, Homo sapiens
aaagcacuguuuaacuggga

SEQ ID NO: 1536892 - RNA, 15 nt, Homo sapiens
aaagccaaguguccu

SEQ ID NO: 1536893 - RNA, 18 nt, Homo sapiens
aaagcuauauaugaauaa

SEQ ID NO: 1536894 - RNA, 17 nt, Homo sapiens
aaaguaaaugcuaccuc

SEQ ID NO: 1536895 - RNA, 23 nt, Homo sapiens
aaaguaauagggcuucugccuaa

SEQ ID NO: 1536896 - RNA, 18 nt, Homo sapiens
aaaguaucucuacuuucc

SEQ ID NO: 1536897 - RNA, 15 nt, Homo sapiens
aaaguuaaacgugau

SEQ ID NO: 1536898 - RNA, 14 nt, Homo sapiens
aaaguuauugugau

SEQ ID NO: 1536899 - RNA, 18 nt, Homo sapiens
aaaguuuucugcuguaaa

SEQ ID NO: 1536900 - RNA, 16 nt, Homo sapiens
aaaguuuuuacagugu

SEQ ID NO: 1536901 - RNA, 14 nt, Homo sapiens
aaauaaaaauauuc

SEQ ID NO: 1536902 - RNA, 18 nt, Homo sapiens
aaauaaaacaauguuaac

SEQ ID NO: 1536903 - RNA, 15 nt, Homo sapiens
aaauaaaccagacuc

SEQ ID NO: 1536904 - RNA, 23 nt, Homo sapiens
aaauaaguaauaucuuucaguua

SEQ ID NO: 1536905 - RNA, 12 nt, Homo sapiens
aaauaaugauuu

SEQ ID NO: 1536906 - RNA, 12 nt, Homo sapiens
aaauacauauga

SEQ ID NO: 1536907 - RNA, 14 nt, Homo sapiens
aaauagcaucugcu

SEQ ID NO: 1536908 - RNA, 23 nt, Homo sapiens
aaauauuuaugaccucaacaaag

SEQ ID NO: 1536909 - RNA, 15 nt, Homo sapiens
aaaucaguuauguca

SEQ ID NO: 1536910 - RNA, 15 nt, Homo sapiens
aaauccccuccccaa

SEQ ID NO: 1536911 - RNA, 16 nt, Homo sapiens
aaauccuguuacuuaa

SEQ ID NO: 1536912 - RNA, 16 nt, Homo sapiens
aaaucuaaaucuucag

SEQ ID NO: 1536913 - RNA, 16 nt, Homo sapiens
aaaugaaagucaguuu

SEQ ID NO: 1536914 - RNA, 18 nt, Homo sapiens
aaaugcagcuucagguga

SEQ ID NO: 1536915 - RNA, 13 nt, Homo sapiens
aaaugcuacucag

SEQ ID NO: 1536916 - RNA, 21 nt, Homo sapiens
aaauuagggcucuaauuuccu

SEQ ID NO: 1536917 - RNA, 19 nt, Homo sapiens
aaauuaugugaauuuugcc

SEQ ID NO: 1536918 - RNA, 15 nt, Homo sapiens
aaauugccugacgaa

SEQ ID NO: 1536919 - RNA, 12 nt, Homo sapiens
aaauuggaagac

SEQ ID NO: 1536920 - RNA, 15 nt, Homo sapiens
aaauuguacauuuga

SEQ ID NO: 1536921 - RNA, 17 nt, Homo sapiens
aaauuuacccaaugcag

SEQ ID NO: 1536922 - RNA, 23 nt, Homo sapiens
aaauuuccaggggccucccaagg

SEQ ID NO: 1536923 - RNA, 19 nt, Homo sapiens
aacaaaaacuguugcuauu

SEQ ID NO: 1536924 - RNA, 12 nt, Homo sapiens
aacaaaacuugc

SEQ ID NO: 1536925 - RNA, 22 nt, Homo sapiens
aacaaacacuuagcaucccaca

SEQ ID NO: 1536926 - RNA, 15 nt, Homo sapiens
aacaaacuuacuguc

SEQ ID NO: 1536927 - RNA, 15 nt, Homo sapiens
aacaaagcauuugac

SEQ ID NO: 1536928 - RNA, 12 nt, Homo sapiens
aacaaaguaaua

SEQ ID NO: 1536929 - RNA, 19 nt, Homo sapiens
aacaacuuaauguucugaa

SEQ ID NO: 1536930 - RNA, 21 nt, Homo sapiens
aacaacuugucuauuaccugu

SEQ ID NO: 1536931 - RNA, 17 nt, Homo sapiens
aacaccguccaacauuc

SEQ ID NO: 1536932 - RNA, 18 nt, Homo sapiens
aacagggaugcuaucucg

SEQ ID NO: 1536933 - RNA, 19 nt, Homo sapiens
aacagggcaucuccaggaa

SEQ ID NO: 1536934 - RNA, 14 nt, Homo sapiens
aacaucucuuucau

SEQ ID NO: 1536935 - RNA, 17 nt, Homo sapiens
aacaugggcaaagggag

SEQ ID NO: 1536936 - RNA, 16 nt, Homo sapiens
aacaugguuaccucug

SEQ ID NO: 1536937 - RNA, 19 nt, Homo sapiens
aacaugguuaccucugcau

SEQ ID NO: 1536938 - RNA, 13 nt, Homo sapiens
aacauuuguuaga

SEQ ID NO: 1536939 - RNA, 12 nt, Homo sapiens
aaccaaugauuc

SEQ ID NO: 1536940 - RNA, 17 nt, Homo sapiens
aaccagagccauggacu

SEQ ID NO: 1536941 - RNA, 21 nt, Homo sapiens
aaccaugaaaacaaugccuca

SEQ ID NO: 1536942 - RNA, 17 nt, Homo sapiens
aaccauugugcauucua

SEQ ID NO: 1536943 - RNA, 22 nt, Homo sapiens
aaccccgagaaggaauggugcu

SEQ ID NO: 1536944 - RNA, 19 nt, Homo sapiens
aacccuguuuuauugaguu

SEQ ID NO: 1536945 - RNA, 18 nt, Homo sapiens
aacccuuaaacaguugca

SEQ ID NO: 1536946 - RNA, 22 nt, Homo sapiens
aaccgaugcuccagccaacccc

SEQ ID NO: 1536947 - RNA, 14 nt, Homo sapiens
aaccgcuugccaua

SEQ ID NO: 1536948 - RNA, 20 nt, Homo sapiens
aaccgcuugccauauuccga

SEQ ID NO: 1536949 - RNA, 14 nt, Homo sapiens
aaccuaaacauaga

SEQ ID NO: 1536950 - RNA, 20 nt, Homo sapiens
aaccucgaagcuguucucug

SEQ ID NO: 1536951 - RNA, 18 nt, Homo sapiens
aaccucggggagugccac

SEQ ID NO: 1536952 - RNA, 18 nt, Homo sapiens
aaccuugugugaguguga

SEQ ID NO: 1536953 - RNA, 13 nt, Homo sapiens
aacggcacugugg

SEQ ID NO: 1536954 - RNA, 23 nt, Homo sapiens
aacuaagcaaguauauuuauuuc

SEQ ID NO: 1536955 - RNA, 17 nt, Homo sapiens
aacuaaguucucuaucu

SEQ ID NO: 1536956 - RNA, 13 nt, Homo sapiens
aacucagcugucu

SEQ ID NO: 1536957 - RNA, 18 nt, Homo sapiens
aacugaaagguagacuuu

SEQ ID NO: 1536958 - RNA, 14 nt, Homo sapiens
aacugagccaaaaa

SEQ ID NO: 1536959 - RNA, 15 nt, Homo sapiens
aacugcaacacugga

SEQ ID NO: 1536960 - RNA, 13 nt, Homo sapiens
aacugguccaggc

SEQ ID NO: 1536961 - RNA, 12 nt, Homo sapiens
aacugucucuca

SEQ ID NO: 1536962 - RNA, 19 nt, Homo sapiens
aacuguuguguccaauccc

SEQ ID NO: 1536963 - RNA, 13 nt, Homo sapiens
aacuuacauaugu

SEQ ID NO: 1536964 - RNA, 15 nt, Homo sapiens
aacuuacauaugucu

SEQ ID NO: 1536965 - RNA, 22 nt, Homo sapiens
aacuucaggaaagcagcaguuu

SEQ ID NO: 1536966 - RNA, 17 nt, Homo sapiens
aacuucuuaacuggcaa

SEQ ID NO: 1536967 - RNA, 14 nt, Homo sapiens
aacuuggugccuaa

SEQ ID NO: 1536968 - RNA, 16 nt, Homo sapiens
aacuuggugccuaaug

SEQ ID NO: 1536969 - RNA, 17 nt, Homo sapiens
aacuuuuauuuuuauca

SEQ ID NO: 1536970 - RNA, 19 nt, Homo sapiens
aacuuuuccuggacacuuu

SEQ ID NO: 1536971 - RNA, 15 nt, Homo sapiens
aacuuuuuauucuca

SEQ ID NO: 1536972 - RNA, 15 nt, Homo sapiens
aagaaagauugcuau

SEQ ID NO: 1536973 - RNA, 16 nt, Homo sapiens
aagaaagauugcuaua

SEQ ID NO: 1536974 - RNA, 21 nt, Homo sapiens
aagaaagcuauauaugaauaa

SEQ ID NO: 1536975 - RNA, 18 nt, Homo sapiens
aagaaauaauacccugcc

SEQ ID NO: 1536976 - RNA, 15 nt, Homo sapiens
aagaacucaugugau

SEQ ID NO: 1536977 - RNA, 11 nt, Homo sapiens
aagaagacugg

SEQ ID NO: 1536978 - RNA, 20 nt, Homo sapiens
aagaauuuuaauauugccau

SEQ ID NO: 1536979 - RNA, 21 nt, Homo sapiens
aagaauuuuaauauugccaua

SEQ ID NO: 1536980 - RNA, 20 nt, Homo sapiens
aagacaauuuuaauguuuac

SEQ ID NO: 1536981 - RNA, 15 nt, Homo sapiens
aagacuacacuguug

SEQ ID NO: 1536982 - RNA, 15 nt, Homo sapiens
aagaggaagugcacu

SEQ ID NO: 1536983 - RNA, 22 nt, Homo sapiens
aagagucuuaauauauauaucc

SEQ ID NO: 1536984 - RNA, 12 nt, Homo sapiens
aagauugcuaua

SEQ ID NO: 1536985 - RNA, 15 nt, Homo sapiens
aagauuuuaugugcu

SEQ ID NO: 1536986 - RNA, 22 nt, Homo sapiens
aagcaaauauuuaugaccucaa

SEQ ID NO: 1536987 - RNA, 12 nt, Homo sapiens
aagcaauguggu

SEQ ID NO: 1536988 - RNA, 12 nt, Homo sapiens
aagcacaugugu

SEQ ID NO: 1536989 - RNA, 21 nt, Homo sapiens
aagcauuauccuuuuaucuca

SEQ ID NO: 1536990 - RNA, 23 nt, Homo sapiens
aagcauuauccuuuuaucucaca

SEQ ID NO: 1536991 - RNA, 20 nt, Homo sapiens
aagccagacagcaacgggga

SEQ ID NO: 1536992 - RNA, 19 nt, Homo sapiens
aagccagcugcaggaauca

SEQ ID NO: 1536993 - RNA, 12 nt, Homo sapiens
aagccaggguuc

SEQ ID NO: 1536994 - RNA, 15 nt, Homo sapiens
aagccagugacucca

SEQ ID NO: 1536995 - RNA, 20 nt, Homo sapiens
aagccucucuggcacuuuga

SEQ ID NO: 1536996 - RNA, 17 nt, Homo sapiens
acuguccuacaauauca

SEQ ID NO: 1536997 - RNA, 15 nt, Homo sapiens
acuguggccucagga

SEQ ID NO: 1536998 - RNA, 16 nt, Homo sapiens
acuguuuuguuuguua

SEQ ID NO: 1536999 - RNA, 15 nt, Homo sapiens
acuuaagcacaagca

SEQ ID NO: 1537000 - RNA, 13 nt, Homo sapiens
acuuaauuaccua

SEQ ID NO: 1537001 - RNA, 21 nt, Homo sapiens
acuuaauuaccuaagagccac

SEQ ID NO: 1537002 - RNA, 17 nt, Homo sapiens
acuuagcaugucccuac

SEQ ID NO: 1537003 - RNA, 22 nt, Homo sapiens
acuuagcauuuucugcaucucc

SEQ ID NO: 1537004 - RNA, 19 nt, Homo sapiens
acuucaaaggaacuggaau

SEQ ID NO: 1537005 - RNA, 16 nt, Homo sapiens
acuucguacccuuugc

SEQ ID NO: 1537006 - RNA, 19 nt, Homo sapiens
acuucuuuacuaacacugg

SEQ ID NO: 1537007 - RNA, 20 nt, Homo sapiens
acuucuuuauucacaguauc

SEQ ID NO: 1537008 - RNA, 16 nt, Homo sapiens
acuugacaagucagga

SEQ ID NO: 1537009 - RNA, 13 nt, Homo sapiens
acuugacuuugcc

SEQ ID NO: 1537010 - RNA, 20 nt, Homo sapiens
acuugaugaauaaacacuuu

SEQ ID NO: 1537011 - RNA, 14 nt, Homo sapiens
acuugcaaguccca

SEQ ID NO: 1537012 - RNA, 18 nt, Homo sapiens
acuugcaagucccaugau

SEQ ID NO: 1537013 - RNA, 19 nt, Homo sapiens
acuugcccugaccaugcau

SEQ ID NO: 1537014 - RNA, 20 nt, Homo sapiens
acuuggcaguagaaauccag

SEQ ID NO: 1537015 - RNA, 20 nt, Homo sapiens
acuugugccucuugggagac

SEQ ID NO: 1537016 - RNA, 16 nt, Homo sapiens
acuuuaccaugcucaa

SEQ ID NO: 1537017 - RNA, 21 nt, Homo sapiens
acuuugaauuuuuuuuauguc

SEQ ID NO: 1537018 - RNA, 16 nt, Homo sapiens
acuuugugcaauauga

SEQ ID NO: 1537019 - RNA, 15 nt, Homo sapiens
acuuuuaccacuugc

SEQ ID NO: 1537020 - RNA, 20 nt, Homo sapiens
acuuuuaugagaacaaugga

SEQ ID NO: 1537021 - RNA, 19 nt, Homo sapiens
acuuuuccuggacacuuua

SEQ ID NO: 1537022 - RNA, 14 nt, Homo sapiens
acuuuuccuuugaa

SEQ ID NO: 1537023 - RNA, 15 nt, Homo sapiens
agaaaaaacaccacc

SEQ ID NO: 1537024 - RNA, 14 nt, Homo sapiens
agaaaacaugacuu

SEQ ID NO: 1537025 - RNA, 13 nt, Homo sapiens
agaaaagccagau

SEQ ID NO: 1537026 - RNA, 22 nt, Homo sapiens
agaaaaguauuuccaacuuguc

SEQ ID NO: 1537027 - RNA, 12 nt, Homo sapiens
agaaagaaggcu

SEQ ID NO: 1537028 - RNA, 16 nt, Homo sapiens
agaaauuuuaucucuu

SEQ ID NO: 1537029 - RNA, 21 nt, Homo sapiens
agaaauuuuuuuccagaauug

SEQ ID NO: 1537030 - RNA, 16 nt, Homo sapiens
agaacauggacuacac

SEQ ID NO: 1537031 - RNA, 23 nt, Homo sapiens
agaagaagcuccugaaucccuuu

SEQ ID NO: 1537032 - RNA, 15 nt, Homo sapiens
agaagacacagggga

SEQ ID NO: 1537033 - RNA, 13 nt, Homo sapiens
agaagacacgugu

SEQ ID NO: 1537034 - RNA, 15 nt, Homo sapiens
agaagacuggaucaa

SEQ ID NO: 1537035 - RNA, 16 nt, Homo sapiens
agaagcaguugcaaua

SEQ ID NO: 1537036 - RNA, 23 nt, Homo sapiens
agaagcuccugaaucccuuucag

SEQ ID NO: 1537037 - RNA, 15 nt, Homo sapiens
agaaggagaggcucu

SEQ ID NO: 1537038 - RNA, 16 nt, Homo sapiens
agaagguugugaugaa

SEQ ID NO: 1537039 - RNA, 19 nt, Homo sapiens
agaagguugugaugaagaa

SEQ ID NO: 1537040 - RNA, 14 nt, Homo sapiens
agaaucaacaguga

SEQ ID NO: 1537041 - RNA, 17 nt, Homo sapiens
agaaucaacagugaaca

SEQ ID NO: 1537042 - RNA, 20 nt, Homo sapiens
agaaucacuugacuuugcca

SEQ ID NO: 1537043 - RNA, 23 nt, Homo sapiens
agaauuaccauuuguuaauauca

SEQ ID NO: 1537044 - RNA, 20 nt, Homo sapiens
agacaccaauggauccuugu

SEQ ID NO: 1537045 - RNA, 15 nt, Homo sapiens
agacacccaguggaa

SEQ ID NO: 1537046 - RNA, 21 nt, Homo sapiens
agacacccaguggaaccaaaa

SEQ ID NO: 1537047 - RNA, 15 nt, Homo sapiens
agacacuggucucag

SEQ ID NO: 1537048 - RNA, 21 nt, Homo sapiens
agacaguugguuuugcauguc

SEQ ID NO: 1537049 - RNA, 16 nt, Homo sapiens
agacauugacaagcac

SEQ ID NO: 1537050 - RNA, 19 nt, Homo sapiens
agaccuucugaagaucuca

SEQ ID NO: 1537051 - RNA, 14 nt, Homo sapiens
agacgccuccccaa

SEQ ID NO: 1537052 - RNA, 11 nt, Homo sapiens
agacgggaccg

SEQ ID NO: 1537053 - RNA, 12 nt, Homo sapiens
agacucacugug

SEQ ID NO: 1537054 - RNA, 13 nt, Homo sapiens
agacucacugugg

SEQ ID NO: 1537055 - RNA, 18 nt, Homo sapiens
agacugcaggguccccaa

SEQ ID NO: 1537056 - RNA, 19 nt, Homo sapiens
agacuguuuucagaccuuu

SEQ ID NO: 1537057 - RNA, 22 nt, Homo sapiens
agacuuccucaugaaucucuca

SEQ ID NO: 1537058 - RNA, 19 nt, Homo sapiens
agacuuuuaacuucaccuu

SEQ ID NO: 1537059 - RNA, 20 nt, Homo sapiens
agacuuuuagcgguuugcaa

SEQ ID NO: 1537060 - RNA, 15 nt, Homo sapiens
agagaaaaaccaaug

SEQ ID NO: 1537061 - RNA, 21 nt, Homo sapiens
agagaaauaaaauauggacuu

SEQ ID NO: 1537062 - RNA, 13 nt, Homo sapiens
agagaacagggau

SEQ ID NO: 1537063 - RNA, 22 nt, Homo sapiens
agagaaccaugaaaacaaugcc

SEQ ID NO: 1537064 - RNA, 14 nt, Homo sapiens
agagaauucacuuu

SEQ ID NO: 1537065 - RNA, 14 nt, Homo sapiens
agagagaagugccc

SEQ ID NO: 1537066 - RNA, 17 nt, Homo sapiens
agagagauauaucugaa

SEQ ID NO: 1537067 - RNA, 15 nt, Homo sapiens
agagagcggcuuccc

SEQ ID NO: 1537068 - RNA, 15 nt, Homo sapiens
agagauauaucugaa

SEQ ID NO: 1537069 - RNA, 16 nt, Homo sapiens
agagauucuugugccu

SEQ ID NO: 1537070 - RNA, 20 nt, Homo sapiens
agagccuauggaaagggugu

SEQ ID NO: 1537071 - RNA, 15 nt, Homo sapiens
agaggacagcuuccc

SEQ ID NO: 1537072 - RNA, 14 nt, Homo sapiens
agaggacuccuuaa

SEQ ID NO: 1537073 - RNA, 19 nt, Homo sapiens
agaggccgcugcagggugg

SEQ ID NO: 1537074 - RNA, 21 nt, Homo sapiens
agaggcuauuccuaggccuca

SEQ ID NO: 1537075 - RNA, 18 nt, Homo sapiens
agaggcucuaauguacaa

SEQ ID NO: 1537076 - RNA, 16 nt, Homo sapiens
agagggacagugggcu

SEQ ID NO: 1537077 - RNA, 14 nt, Homo sapiens
agagggagggagca

SEQ ID NO: 1537078 - RNA, 19 nt, Homo sapiens
agagggccccucacuggcu

SEQ ID NO: 1537079 - RNA, 13 nt, Homo sapiens
agaguaugucagu

SEQ ID NO: 1537080 - RNA, 15 nt, Homo sapiens
agagucauuguuaca

SEQ ID NO: 1537081 - RNA, 14 nt, Homo sapiens
agauaaauguccau

SEQ ID NO: 1537082 - RNA, 19 nt, Homo sapiens
agauaggauauacuguaug

SEQ ID NO: 1537083 - RNA, 18 nt, Homo sapiens
agauagguacuauuaucc

SEQ ID NO: 1537084 - RNA, 15 nt, Homo sapiens
agauaucucaucucu

SEQ ID NO: 1537085 - RNA, 18 nt, Homo sapiens
agaucaauggcgcagugc

SEQ ID NO: 1537086 - RNA, 21 nt, Homo sapiens
agaucucuuucuaaagacagg

SEQ ID NO: 1537087 - RNA, 14 nt, Homo sapiens
agaugaaauuccau

SEQ ID NO: 1537088 - RNA, 16 nt, Homo sapiens
agaugaaauuccauuu

SEQ ID NO: 1537089 - RNA, 20 nt, Homo sapiens
agaugcugacuguacuccuc

SEQ ID NO: 1537090 - RNA, 14 nt, Homo sapiens
agaugggacaauua

SEQ ID NO: 1537091 - RNA, 21 nt, Homo sapiens
agauguuuguuuucaaaauac

SEQ ID NO: 1537092 - RNA, 16 nt, Homo sapiens
agauuaacaacacugc

SEQ ID NO: 1537093 - RNA, 13 nt, Homo sapiens
agauucccacucc

SEQ ID NO: 1537094 - RNA, 21 nt, Homo sapiens
agauugauuaaugaacuauug

SEQ ID NO: 1537095 - RNA, 14 nt, Homo sapiens
agauuuuaugugcu

SEQ ID NO: 1537096 - RNA, 20 nt, Homo sapiens
agauuuucauguucuugcag

SEQ ID NO: 1537097 - RNA, 20 nt, Homo sapiens
agauuuuuacacauguaucu

SEQ ID NO: 1537098 - RNA, 22 nt, Homo sapiens
agcaaaguuuucagauuguaaa

SEQ ID NO: 1537099 - RNA, 15 nt, Homo sapiens
agcaagcucacuugc

SEQ ID NO: 1537100 - RNA, 20 nt, Homo sapiens
agcaauaauugacaaacuuu

SEQ ID NO: 1537101 - RNA, 12 nt, Homo sapiens
agcaauauguca

SEQ ID NO: 1537102 - RNA, 14 nt, Homo sapiens
agcaauuaaagaca

SEQ ID NO: 1537103 - RNA, 19 nt, Homo sapiens
agcacaagcagagugcaca

SEQ ID NO: 1537104 - RNA, 23 nt, Homo sapiens
agcacagaggauggcuuccccau

SEQ ID NO: 1537105 - RNA, 19 nt, Homo sapiens
agcacauugcccugagggg

SEQ ID NO: 1537106 - RNA, 19 nt, Homo sapiens
agcaccuacuuacaugcau

SEQ ID NO: 1537107 - RNA, 10 nt, Homo sapiens
agcacuucaa

SEQ ID NO: 1537108 - RNA, 19 nt, Homo sapiens
agcacuuuguuucauauuc

SEQ ID NO: 1537109 - RNA, 22 nt, Homo sapiens
agcacuuuguuucauauucuca

SEQ ID NO: 1537110 - RNA, 16 nt, Homo sapiens
agcagaagaacagaau

SEQ ID NO: 1537111 - RNA, 16 nt, Homo sapiens
agcagaaggccuugcc

SEQ ID NO: 1537112 - RNA, 20 nt, Homo sapiens
agcagaauucauucauacuu

SEQ ID NO: 1537113 - RNA, 22 nt, Homo sapiens
agcagagcccucaugugacaug

SEQ ID NO: 1537114 - RNA, 21 nt, Homo sapiens
agcagaggaaaauaguggcag

SEQ ID NO: 1537115 - RNA, 16 nt, Homo sapiens
agcagguaggaggcaa

SEQ ID NO: 1537116 - RNA, 14 nt, Homo sapiens
agcagguugcuuca

SEQ ID NO: 1537117 - RNA, 15 nt, Homo sapiens
agcagucucagcuca

SEQ ID NO: 1537118 - RNA, 14 nt, Homo sapiens
agcaucaaagcacu

SEQ ID NO: 1537119 - RNA, 12 nt, Homo sapiens
agcaucaaccua

SEQ ID NO: 1537120 - RNA, 13 nt, Homo sapiens
agcauuucuugau

SEQ ID NO: 1537121 - RNA, 17 nt, Homo sapiens
agcauuuucugcaucuc

SEQ ID NO: 1537122 - RNA, 15 nt, Homo sapiens
agccaaccccugugg

SEQ ID NO: 1537123 - RNA, 17 nt, Homo sapiens
agccaagucagcuuugc

SEQ ID NO: 1537124 - RNA, 16 nt, Homo sapiens
agccaauaggcagcuu

SEQ ID NO: 1537125 - RNA, 17 nt, Homo sapiens
agccacaauaagccacu

SEQ ID NO: 1537126 - RNA, 15 nt, Homo sapiens
agccagaggcucuaa

SEQ ID NO: 1537127 - RNA, 18 nt, Homo sapiens
caaacaaaaacuguugcu

SEQ ID NO: 1537128 - RNA, 12 nt, Homo sapiens
caaacaaacaaa

SEQ ID NO: 1537129 - RNA, 21 nt, Homo sapiens
caaacagauguuuguuuucaa

SEQ ID NO: 1537130 - RNA, 19 nt, Homo sapiens
caaacccagauugaagcua

SEQ ID NO: 1537131 - RNA, 22 nt, Homo sapiens
caaacuuuuccuggacacuuua

SEQ ID NO: 1537132 - RNA, 17 nt, Homo sapiens
caaagaaucaacaguga

SEQ ID NO: 1537133 - RNA, 18 nt, Homo sapiens
caaagaaucaacagugaa

SEQ ID NO: 1537134 - RNA, 23 nt, Homo sapiens
caaagacgguagagagaaacagc

SEQ ID NO: 1537135 - RNA, 16 nt, Homo sapiens
caaagagaugaggaaa

SEQ ID NO: 1537136 - RNA, 22 nt, Homo sapiens
caaagcaugccaauuucucuua

SEQ ID NO: 1537137 - RNA, 14 nt, Homo sapiens
caaagcauuugacu

SEQ ID NO: 1537138 - RNA, 24 nt, Homo sapiens
caaaggaggcuuacaacuccugca

SEQ ID NO: 1537139 - RNA, 21 nt, Homo sapiens
caaaggcuuucuuuccaaucc

SEQ ID NO: 1537140 - RNA, 11 nt, Homo sapiens
caaaguaauag

SEQ ID NO: 1537141 - RNA, 16 nt, Homo sapiens
caaaguuaaacgugau

SEQ ID NO: 1537142 - RNA, 15 nt, Homo sapiens
caaauaaauaucauc

SEQ ID NO: 1537143 - RNA, 17 nt, Homo sapiens
caaauaaguaauaucuu

SEQ ID NO: 1537144 - RNA, 18 nt, Homo sapiens
caaauaaguuacccucaa

SEQ ID NO: 1537145 - RNA, 22 nt, Homo sapiens
caaauagggcaaagaaucaaca

SEQ ID NO: 1537146 - RNA, 16 nt, Homo sapiens
caaauccccuccccaa

SEQ ID NO: 1537147 - RNA, 22 nt, Homo sapiens
caaaugauuuacacugacuguu

SEQ ID NO: 1537148 - RNA, 22 nt, Homo sapiens
caaaugcaugauauuguaugua

SEQ ID NO: 1537149 - RNA, 15 nt, Homo sapiens
caaauuauucuaguc

SEQ ID NO: 1537150 - RNA, 15 nt, Homo sapiens
caacacaccuugccc

SEQ ID NO: 1537151 - RNA, 16 nt, Homo sapiens
caacauuauccugugu

SEQ ID NO: 1537152 - RNA, 21 nt, Homo sapiens
caacauuugcuuuuugcuugu

SEQ ID NO: 1537153 - RNA, 16 nt, Homo sapiens
caacccugugaucuau

SEQ ID NO: 1537154 - RNA, 22 nt, Homo sapiens
caaccuccccugguccugcacu

SEQ ID NO: 1537155 - RNA, 13 nt, Homo sapiens
caacgaaaagcac

SEQ ID NO: 1537156 - RNA, 14 nt, Homo sapiens
caacgggucugugg

SEQ ID NO: 1537157 - RNA, 14 nt, Homo sapiens
caacuaauacaugg

SEQ ID NO: 1537158 - RNA, 12 nt, Homo sapiens
caacuagccauc

SEQ ID NO: 1537159 - RNA, 14 nt, Homo sapiens
caacuccaaggcaa

SEQ ID NO: 1537160 - RNA, 21 nt, Homo sapiens
caacuccaaggcaaaugucca

SEQ ID NO: 1537161 - RNA, 16 nt, Homo sapiens
caacuguauaccgugu

SEQ ID NO: 1537162 - RNA, 17 nt, Homo sapiens
caagaaggaauugacuu

SEQ ID NO: 1537163 - RNA, 15 nt, Homo sapiens
caagacacccagugg

SEQ ID NO: 1537164 - RNA, 12 nt, Homo sapiens
caagacuucaaa

SEQ ID NO: 1537165 - RNA, 18 nt, Homo sapiens
caagaugaaauuccauuu

SEQ ID NO: 1537166 - RNA, 13 nt, Homo sapiens
caagcaucagcaa

SEQ ID NO: 1537167 - RNA, 13 nt, Homo sapiens
caagccaggguuc

SEQ ID NO: 1537168 - RNA, 18 nt, Homo sapiens
caagccaggguuccagac

SEQ ID NO: 1537169 - RNA, 23 nt, Homo sapiens
caagcuuagaagccaccauguau

SEQ ID NO: 1537170 - RNA, 16 nt, Homo sapiens
caaggaaaauggacau

SEQ ID NO: 1537171 - RNA, 16 nt, Homo sapiens
caaguaacaauaugau

SEQ ID NO: 1537172 - RNA, 18 nt, Homo sapiens
caaguguuucuguuucaa

SEQ ID NO: 1537173 - RNA, 16 nt, Homo sapiens
caauaaaagaaacugu

SEQ ID NO: 1537174 - RNA, 20 nt, Homo sapiens
caauaaaagaaacugugguc

SEQ ID NO: 1537175 - RNA, 17 nt, Homo sapiens
caauaaacgaaacacag

SEQ ID NO: 1537176 - RNA, 20 nt, Homo sapiens
caauaaacgaaacacagaac

SEQ ID NO: 1537177 - RNA, 13 nt, Homo sapiens
caauaaagcaaug

SEQ ID NO: 1537178 - RNA, 15 nt, Homo sapiens
caauaaagcaaugug

SEQ ID NO: 1537179 - RNA, 20 nt, Homo sapiens
caauaugaggggacugcaug

SEQ ID NO: 1537180 - RNA, 18 nt, Homo sapiens
caaucuuaacaaaaguga

SEQ ID NO: 1537181 - RNA, 10 nt, Homo sapiens
caauguuuca

SEQ ID NO: 1537182 - RNA, 13 nt, Homo sapiens
cacaacacaauca

SEQ ID NO: 1537183 - RNA, 19 nt, Homo sapiens
cacaagacagcagagccau

SEQ ID NO: 1537184 - RNA, 17 nt, Homo sapiens
cacaagcagagugcaca

SEQ ID NO: 1537185 - RNA, 20 nt, Homo sapiens
cacaagcagagugcacagcu

SEQ ID NO: 1537186 - RNA, 22 nt, Homo sapiens
cacaauaaaagaaacugugguc

SEQ ID NO: 1537187 - RNA, 19 nt, Homo sapiens
cacaauaagccacugguau

SEQ ID NO: 1537188 - RNA, 14 nt, Homo sapiens
cacaauucuguccc

SEQ ID NO: 1537189 - RNA, 17 nt, Homo sapiens
cacacuacgcagaagag

SEQ ID NO: 1537190 - RNA, 20 nt, Homo sapiens
cacacucucuucuuacugua

SEQ ID NO: 1537191 - RNA, 12 nt, Homo sapiens
cacacugggacu

SEQ ID NO: 1537192 - RNA, 18 nt, Homo sapiens
cacagaggcaguggcagc

SEQ ID NO: 1537193 - RNA, 20 nt, Homo sapiens
cacagaugggcaaggccuuu

SEQ ID NO: 1537194 - RNA, 21 nt, Homo sapiens
cacagcuaugaaggcuguaca

SEQ ID NO: 1537195 - RNA, 15 nt, Homo sapiens
cacagugcaucucag

SEQ ID NO: 1537196 - RNA, 13 nt, Homo sapiens
cacaguuugcaau

SEQ ID NO: 1537197 - RNA, 16 nt, Homo sapiens
cacaguuugcaaucuu

SEQ ID NO: 1537198 - RNA, 15 nt, Homo sapiens
cacauaguguuugua

SEQ ID NO: 1537199 - RNA, 20 nt, Homo sapiens
cacauuagagggacagccaa

SEQ ID NO: 1537200 - RNA, 22 nt, Homo sapiens
caccaagagccucccugccguu

SEQ ID NO: 1537201 - RNA, 18 nt, Homo sapiens
cacccaguggaaccaaaa

SEQ ID NO: 1537202 - RNA, 15 nt, Homo sapiens
cacccauaccagcua

SEQ ID NO: 1537203 - RNA, 21 nt, Homo sapiens
cacccauaccagcuagaauca

SEQ ID NO: 1537204 - RNA, 19 nt, Homo sapiens
cacccaugccauagaaacu

SEQ ID NO: 1537205 - RNA, 15 nt, Homo sapiens
caccgccagcaauaa

SEQ ID NO: 1537206 - RNA, 16 nt, Homo sapiens
caccuaugucauuuca

SEQ ID NO: 1537207 - RNA, 21 nt, Homo sapiens
caccuucccuaguucuuugca

SEQ ID NO: 1537208 - RNA, 16 nt, Homo sapiens
cacgccacaacuccag

SEQ ID NO: 1537209 - RNA, 21 nt, Homo sapiens
cacgccugguucuguacaugu

SEQ ID NO: 1537210 - RNA, 20 nt, Homo sapiens
cacggccucuggggagaccg

SEQ ID NO: 1537211 - RNA, 14 nt, Homo sapiens
cacuacauucugaa

SEQ ID NO: 1537212 - RNA, 15 nt, Homo sapiens
cacucuguuugcuca

SEQ ID NO: 1537213 - RNA, 17 nt, Homo sapiens
cacuggcuuuacauggg

SEQ ID NO: 1537214 - RNA, 22 nt, Homo sapiens
cacuuaaggggggaugucuuga

SEQ ID NO: 1537215 - RNA, 20 nt, Homo sapiens
cacuucuuacaauaauucua

SEQ ID NO: 1537216 - RNA, 21 nt, Homo sapiens
cacuucuuacaauaauucuau

SEQ ID NO: 1537217 - RNA, 19 nt, Homo sapiens
cacuugcaagucccaugau

SEQ ID NO: 1537218 - RNA, 16 nt, Homo sapiens
cacuuugguaaugugu

SEQ ID NO: 1537219 - RNA, 22 nt, Homo sapiens
cagaaaacauaugcauuaugaa

SEQ ID NO: 1537220 - RNA, 16 nt, Homo sapiens
cagaacgcaugcaggg

SEQ ID NO: 1537221 - RNA, 19 nt, Homo sapiens
cagaacuucguacccuuug

SEQ ID NO: 1537222 - RNA, 20 nt, Homo sapiens
cagaagagaaaguacaacca

SEQ ID NO: 1537223 - RNA, 18 nt, Homo sapiens
cagaagcaguugcaauaa

SEQ ID NO: 1537224 - RNA, 19 nt, Homo sapiens
cagaauacaguaagcugcu

SEQ ID NO: 1537225 - RNA, 14 nt, Homo sapiens
cagaaucuuuaaag

SEQ ID NO: 1537226 - RNA, 20 nt, Homo sapiens
cagacacuauguagucuguu

SEQ ID NO: 1537227 - RNA, 17 nt, Homo sapiens
cagacaugcugcccacc

SEQ ID NO: 1537228 - RNA, 13 nt, Homo sapiens
cagaccuuugucu

SEQ ID NO: 1537229 - RNA, 14 nt, Homo sapiens
cagacucacugugg

SEQ ID NO: 1537230 - RNA, 16 nt, Homo sapiens
cagacuucgcuauucc

SEQ ID NO: 1537231 - RNA, 18 nt, Homo sapiens
cagagacccccgugccaa

SEQ ID NO: 1537232 - RNA, 16 nt, Homo sapiens
cagagcagaaccaaag

SEQ ID NO: 1537233 - RNA, 15 nt, Homo sapiens
cagagcucaccaggc

SEQ ID NO: 1537234 - RNA, 21 nt, Homo sapiens
cagagcucagcacagccucac

SEQ ID NO: 1537235 - RNA, 16 nt, Homo sapiens
cagaggacagcuuccc

SEQ ID NO: 1537236 - RNA, 17 nt, Homo sapiens
cagaggcucuaauguac

SEQ ID NO: 1537237 - RNA, 18 nt, Homo sapiens
cagaggcucuaauguaca

SEQ ID NO: 1537238 - RNA, 20 nt, Homo sapiens
cagaggcucuaauguacaau

SEQ ID NO: 1537239 - RNA, 22 nt, Homo sapiens
cagaggcucuaauguacaauaa

SEQ ID NO: 1537240 - RNA, 17 nt, Homo sapiens
cagaggggcggggccag

SEQ ID NO: 1537241 - RNA, 16 nt, Homo sapiens
cagagggucccuaggu

SEQ ID NO: 1537242 - RNA, 17 nt, Homo sapiens
cagauguuuguuuucaa

SEQ ID NO: 1537243 - RNA, 19 nt, Homo sapiens
cagauuuuuacacauguau

SEQ ID NO: 1537244 - RNA, 14 nt, Homo sapiens
cagcacauugcccu

SEQ ID NO: 1537245 - RNA, 16 nt, Homo sapiens
cagcacuuuguuucau

SEQ ID NO: 1537246 - RNA, 21 nt, Homo sapiens
cagcagagccuggaagacacc

SEQ ID NO: 1537247 - RNA, 21 nt, Homo sapiens
cagcagguucucuccugugag

SEQ ID NO: 1537248 - RNA, 17 nt, Homo sapiens
cagcaucugccaggaca

SEQ ID NO: 1537249 - RNA, 20 nt, Homo sapiens
cagccacuuauuuccaugga

SEQ ID NO: 1537250 - RNA, 12 nt, Homo sapiens
cagcccugugga

SEQ ID NO: 1537251 - RNA, 21 nt, Homo sapiens
cagccggagucacugccugga

SEQ ID NO: 1537252 - RNA, 14 nt, Homo sapiens
cagccggcugcaag

SEQ ID NO: 1537253 - RNA, 14 nt, Homo sapiens
cagccuaccagaga

SEQ ID NO: 1537254 - RNA, 21 nt, Homo sapiens
cagccuccacucccugucuga

SEQ ID NO: 1537255 - RNA, 18 nt, Homo sapiens
cagccugcagacucacug

SEQ ID NO: 1537256 - RNA, 20 nt, Homo sapiens
cagccugugggagaagggac

SEQ ID NO: 1537257 - RNA, 13 nt, Homo sapiens
auauuccuaugcu

SEQ ID NO: 1537258 - RNA, 18 nt, Homo sapiens
auauugagcaauauguca

SEQ ID NO: 1537259 - RNA, 22 nt, Homo sapiens
auauuuaaaaaaaaacauucaa

SEQ ID NO: 1537260 - RNA, 18 nt, Homo sapiens
auauuuucugaguagcau

SEQ ID NO: 1537261 - RNA, 19 nt, Homo sapiens
aucaaaaauauuccaucca

SEQ ID NO: 1537262 - RNA, 17 nt, Homo sapiens
aucaaaucagucuugga

SEQ ID NO: 1537263 - RNA, 16 nt, Homo sapiens
aucaaccuaggagcag

SEQ ID NO: 1537264 - RNA, 22 nt, Homo sapiens
aucaagucugugaaagucuccu

SEQ ID NO: 1537265 - RNA, 22 nt, Homo sapiens
aucacacucucuucuuacugua

SEQ ID NO: 1537266 - RNA, 18 nt, Homo sapiens
aucaccaaaaaaucuaua

SEQ ID NO: 1537267 - RNA, 16 nt, Homo sapiens
agggagacugacccau

SEQ ID NO: 1537268 - RNA, 15 nt, Homo sapiens
agggagaggccauga

SEQ ID NO: 1537269 - RNA, 22 nt, Homo sapiens
agggagaucuuggggugcagca

SEQ ID NO: 1537270 - RNA, 16 nt, Homo sapiens
agggaggccugagggg

SEQ ID NO: 1537271 - RNA, 16 nt, Homo sapiens
agggcagaggugauca

SEQ ID NO: 1537272 - RNA, 17 nt, Homo sapiens
agggcaggguucuagaa

SEQ ID NO: 1537273 - RNA, 15 nt, Homo sapiens
agggcaucuccagga

SEQ ID NO: 1537274 - RNA, 17 nt, Homo sapiens
agggcauggccaggugg

SEQ ID NO: 1537275 - RNA, 21 nt, Homo sapiens
agggcuucugccuaagccucu

SEQ ID NO: 1537276 - RNA, 19 nt, Homo sapiens
aggggaagugugcugaggu

SEQ ID NO: 1537277 - RNA, 21 nt, Homo sapiens
aggggagacuuaggccagagg

SEQ ID NO: 1537278 - RNA, 20 nt, Homo sapiens
aggggcugucucccaaugaa

SEQ ID NO: 1537279 - RNA, 15 nt, Homo sapiens
aggggucagcagggg

SEQ ID NO: 1537280 - RNA, 16 nt, Homo sapiens
aggggucagggaccaa

SEQ ID NO: 1537281 - RNA, 12 nt, Homo sapiens
aauccacucugc

SEQ ID NO: 1537282 - RNA, 15 nt, Homo sapiens
aauccaugugcugcu

SEQ ID NO: 1537283 - RNA, 23 nt, Homo sapiens
aauccaugugcugcuguggcauc

SEQ ID NO: 1537284 - RNA, 22 nt, Homo sapiens
aauccccccagggcugggcacu

SEQ ID NO: 1537285 - RNA, 17 nt, Homo sapiens
aauccugacaaaaggga

SEQ ID NO: 1537286 - RNA, 17 nt, Homo sapiens
aauccuuuauagcuuug

SEQ ID NO: 1537287 - RNA, 15 nt, Homo sapiens
aaucugcaguggcuc

SEQ ID NO: 1537288 - RNA, 18 nt, Homo sapiens
aaugacauugaacugaau

SEQ ID NO: 1537289 - RNA, 19 nt, Homo sapiens
aaugauucauaacaaugua

SEQ ID NO: 1537290 - RNA, 13 nt, Homo sapiens
aaugcaugugauu

SEQ ID NO: 1537291 - RNA, 21 nt, Homo sapiens
aaugcugauuuaaacuucuua

SEQ ID NO: 1537292 - RNA, 19 nt, Homo sapiens
aauggauccuugucaguug

SEQ ID NO: 1537293 - RNA, 20 nt, Homo sapiens
aauguagcuucagucauuaa

SEQ ID NO: 1537294 - RNA, 13 nt, Homo sapiens
aauguaugugaaa

SEQ ID NO: 1537295 - RNA, 18 nt, Homo sapiens
aauguccaagcaucagca

SEQ ID NO: 1537296 - RNA, 21 nt, Homo sapiens
aaugugggcagauuuggcuca

SEQ ID NO: 1537297 - RNA, 18 nt, Homo sapiens
aauguuaauggucaaugc

SEQ ID NO: 1537298 - RNA, 17 nt, Homo sapiens
aauguuucccucaagaa

SEQ ID NO: 1537299 - RNA, 21 nt, Homo sapiens
aauuaaaccaaggagucugau

SEQ ID NO: 1537300 - RNA, 15 nt, Homo sapiens
aauuaaagcuguuau

SEQ ID NO: 1537301 - RNA, 20 nt, Homo sapiens
aauuaaugaguuuuauccaa

SEQ ID NO: 1537302 - RNA, 21 nt, Homo sapiens
aauuagauaaauguccauucu

SEQ ID NO: 1537303 - RNA, 20 nt, Homo sapiens
aauuauguuuuaauuccaag

SEQ ID NO: 1537304 - RNA, 14 nt, Homo sapiens
aauuauucuaguca

SEQ ID NO: 1537305 - RNA, 21 nt, Homo sapiens
aauucaaagaaucaccuaauu

SEQ ID NO: 1537306 - RNA, 22 nt, Homo sapiens
aauucauaaaaauaaccaaaaa

SEQ ID NO: 1537307 - RNA, 14 nt, Homo sapiens
aauucuaugagaua

SEQ ID NO: 1537308 - RNA, 21 nt, Homo sapiens
aauugaccuuuagguauuaca

SEQ ID NO: 1537309 - RNA, 14 nt, Homo sapiens
aauuggacaauuau

SEQ ID NO: 1537310 - RNA, 19 nt, Homo sapiens
aauuuaauauacugcauau

SEQ ID NO: 1537311 - RNA, 21 nt, Homo sapiens
aauuuauuuccaauguuucaa

SEQ ID NO: 1537312 - RNA, 19 nt, Homo sapiens
aauuucaaaaugcauguga

SEQ ID NO: 1537313 - RNA, 13 nt, Homo sapiens
aauuuuaucucuu

SEQ ID NO: 1537314 - RNA, 21 nt, Homo sapiens
aauuuuuuuccagaauugaga

SEQ ID NO: 1537315 - RNA, 17 nt, Homo sapiens
acaaacaggugcuaaca

SEQ ID NO: 1537316 - RNA, 16 nt, Homo sapiens
acaaagaagaaccauc

SEQ ID NO: 1537317 - RNA, 19 nt, Homo sapiens
acaaaugauuuacacugac

SEQ ID NO: 1537318 - RNA, 18 nt, Homo sapiens
acaacuugucuauuaccu

SEQ ID NO: 1537319 - RNA, 21 nt, Homo sapiens
acaacuuucacuauaauguga

SEQ ID NO: 1537320 - RNA, 15 nt, Homo sapiens
acaagaagugggagu

SEQ ID NO: 1537321 - RNA, 20 nt, Homo sapiens
acaaggcugaaaagugcuuu

SEQ ID NO: 1537322 - RNA, 16 nt, Homo sapiens
acaaguauuacacauc

SEQ ID NO: 1537323 - RNA, 18 nt, Homo sapiens
acaauaaacgaaacacag

SEQ ID NO: 1537324 - RNA, 17 nt, Homo sapiens
acaauaaagcaaugugg

SEQ ID NO: 1537325 - RNA, 18 nt, Homo sapiens
acaauaauuuucuaccug

SEQ ID NO: 1537326 - RNA, 20 nt, Homo sapiens
acaauggcuggguuugggca

SEQ ID NO: 1537327 - RNA, 14 nt, Homo sapiens
acaauucugucccu

SEQ ID NO: 1537328 - RNA, 18 nt, Homo sapiens
acaauuucaaaaugcaug

SEQ ID NO: 1537329 - RNA, 14 nt, Homo sapiens
acacaacucaucca

SEQ ID NO: 1537330 - RNA, 21 nt, Homo sapiens
acacaauacagugguauaaac

SEQ ID NO: 1537331 - RNA, 17 nt, Homo sapiens
acacacagccugugcuu

SEQ ID NO: 1537332 - RNA, 11 nt, Homo sapiens
acacaccugca

SEQ ID NO: 1537333 - RNA, 14 nt, Homo sapiens
acacaccugcacac

SEQ ID NO: 1537334 - RNA, 13 nt, Homo sapiens
acacacucuucaa

SEQ ID NO: 1537335 - RNA, 22 nt, Homo sapiens
acacagaggacagcuuccccau

SEQ ID NO: 1537336 - RNA, 18 nt, Homo sapiens
acacaggcccaugcccuc

SEQ ID NO: 1537337 - RNA, 19 nt, Homo sapiens
acacauaguguuuguaaca

SEQ ID NO: 1537338 - RNA, 20 nt, Homo sapiens
acacauaguguuuguaacac

SEQ ID NO: 1537339 - RNA, 18 nt, Homo sapiens
acacaugcucaucccaaa

SEQ ID NO: 1537340 - RNA, 15 nt, Homo sapiens
acacaugguuuccaa

SEQ ID NO: 1537341 - RNA, 16 nt, Homo sapiens
acacauguaucuaugc

SEQ ID NO: 1537342 - RNA, 14 nt, Homo sapiens
acaccccugcacac

SEQ ID NO: 1537343 - RNA, 14 nt, Homo sapiens
acacgccacaacuc

SEQ ID NO: 1537344 - RNA, 18 nt, Homo sapiens
acacgccacaacuccagu

SEQ ID NO: 1537345 - RNA, 16 nt, Homo sapiens
acacucaguccuucca

SEQ ID NO: 1537346 - RNA, 20 nt, Homo sapiens
acacucucuucuuacuguau

SEQ ID NO: 1537347 - RNA, 20 nt, Homo sapiens
acacugccuuggguggacca

SEQ ID NO: 1537348 - RNA, 17 nt, Homo sapiens
acacuuagcaucccaca

SEQ ID NO: 1537349 - RNA, 22 nt, Homo sapiens
acacuuaucugucucuucuaca

SEQ ID NO: 1537350 - RNA, 16 nt, Homo sapiens
acagaaaagaaauuag

SEQ ID NO: 1537351 - RNA, 20 nt, Homo sapiens
acagaggauggcuuccccau

SEQ ID NO: 1537352 - RNA, 17 nt, Homo sapiens
acagagggacagugggc

SEQ ID NO: 1537353 - RNA, 19 nt, Homo sapiens
acagaucuugagcaaggca

SEQ ID NO: 1537354 - RNA, 23 nt, Homo sapiens
acagcauaggguccacuuuggua

SEQ ID NO: 1537355 - RNA, 17 nt, Homo sapiens
acagcugaaagauugau

SEQ ID NO: 1537356 - RNA, 22 nt, Homo sapiens
acagcuucacuuaaaaucaaau

SEQ ID NO: 1537357 - RNA, 14 nt, Homo sapiens
acaggaauucuccc

SEQ ID NO: 1537358 - RNA, 17 nt, Homo sapiens
acaggagcguguacuac

SEQ ID NO: 1537359 - RNA, 16 nt, Homo sapiens
acaggagcguguccua

SEQ ID NO: 1537360 - RNA, 21 nt, Homo sapiens
acaggaggaacugguccaggc

SEQ ID NO: 1537361 - RNA, 16 nt, Homo sapiens
acaggcccuuccucuc

SEQ ID NO: 1537362 - RNA, 21 nt, Homo sapiens
acaggcccuuccucuccacug

SEQ ID NO: 1537363 - RNA, 22 nt, Homo sapiens
acaggcccuuccucuccacugc

SEQ ID NO: 1537364 - RNA, 15 nt, Homo sapiens
acaggcguucucagc

SEQ ID NO: 1537365 - RNA, 15 nt, Homo sapiens
acagugggggcacca

SEQ ID NO: 1537366 - RNA, 18 nt, Homo sapiens
acaguugcacagcaucuc

SEQ ID NO: 1537367 - RNA, 19 nt, Homo sapiens
acaguugcacagcaucuca

SEQ ID NO: 1537368 - RNA, 16 nt, Homo sapiens
acaguugguuuugcau

SEQ ID NO: 1537369 - RNA, 14 nt, Homo sapiens
acauacacacacac

SEQ ID NO: 1537370 - RNA, 15 nt, Homo sapiens
acauacaucuaaguc

SEQ ID NO: 1537371 - RNA, 19 nt, Homo sapiens
acauaguguuuguaacacc

SEQ ID NO: 1537372 - RNA, 19 nt, Homo sapiens
acauccaggcaauggccua

SEQ ID NO: 1537373 - RNA, 16 nt, Homo sapiens
acaugagucccagugg

SEQ ID NO: 1537374 - RNA, 22 nt, Homo sapiens
acaugcacaguuugcaaucuua

SEQ ID NO: 1537375 - RNA, 22 nt, Homo sapiens
acaugcucaucccaaaagcuag

SEQ ID NO: 1537376 - RNA, 23 nt, Homo sapiens
acauggagcuugacuucaugcca

SEQ ID NO: 1537377 - RNA, 23 nt, Homo sapiens
acaugucuuuggcuucagaauug

SEQ ID NO: 1537378 - RNA, 16 nt, Homo sapiens
acaugugauugugauu

SEQ ID NO: 1537379 - RNA, 16 nt, Homo sapiens
accaaaugacaaguca

SEQ ID NO: 1537380 - RNA, 12 nt, Homo sapiens
accaacugagcc

SEQ ID NO: 1537381 - RNA, 14 nt, Homo sapiens
accaaucucuguga

SEQ ID NO: 1537382 - RNA, 22 nt, Homo sapiens
accacaaggcugaaaagugcuu

SEQ ID NO: 1537383 - RNA, 20 nt, Homo sapiens
accacauuugcuagagggag

SEQ ID NO: 1537384 - RNA, 21 nt, Homo sapiens
accacgggcgaggacgugaag

SEQ ID NO: 1537385 - RNA, 21 nt, Homo sapiens
accacuaucuuuuguucuacc

SEQ ID NO: 1537386 - RNA, 19 nt, Homo sapiens
accagaauggggacaucuu

SEQ ID NO: 1537387 - RNA, 17 nt, Homo sapiens
accagagcacagauuca

SEQ ID NO: 1537388 - RNA, 16 nt, Homo sapiens
accaggcuuccaagaa

SEQ ID NO: 1537389 - RNA, 22 nt, Homo sapiens
accauagcgcccaagcucagcu

SEQ ID NO: 1537390 - RNA, 13 nt, Homo sapiens
accauauacagcu

SEQ ID NO: 1537391 - RNA, 15 nt, Homo sapiens
accauccccuccuag

SEQ ID NO: 1537392 - RNA, 15 nt, Homo sapiens
accaugaaaacaaug

SEQ ID NO: 1537393 - RNA, 22 nt, Homo sapiens
acccaaguuuauuauaucauua

SEQ ID NO: 1537394 - RNA, 18 nt, Homo sapiens
acccaucgugguauguga

SEQ ID NO: 1537395 - RNA, 20 nt, Homo sapiens
acccaucgugguaugugaau

SEQ ID NO: 1537396 - RNA, 21 nt, Homo sapiens
acccauguucucaauacccac

SEQ ID NO: 1537397 - RNA, 17 nt, Homo sapiens
accccacuuaugcugcu

SEQ ID NO: 1537398 - RNA, 15 nt, Homo sapiens
accccucaccuugca

SEQ ID NO: 1537399 - RNA, 17 nt, Homo sapiens
acccuccuaucaccucc

SEQ ID NO: 1537400 - RNA, 22 nt, Homo sapiens
acccucugcuaugucugugaug

SEQ ID NO: 1537401 - RNA, 17 nt, Homo sapiens
acccugcaaaggacugu

SEQ ID NO: 1537402 - RNA, 18 nt, Homo sapiens
acccuggauuugcauaca

SEQ ID NO: 1537403 - RNA, 22 nt, Homo sapiens
acccuguuuuauugaguucuga

SEQ ID NO: 1537404 - RNA, 18 nt, Homo sapiens
acccuuaaacaguugcac

SEQ ID NO: 1537405 - RNA, 14 nt, Homo sapiens
acccuucgcaguua

SEQ ID NO: 1537406 - RNA, 16 nt, Homo sapiens
accgagucucuucucc

SEQ ID NO: 1537407 - RNA, 15 nt, Homo sapiens
accggacgcaugcag

SEQ ID NO: 1537408 - RNA, 20 nt, Homo sapiens
accucaggggagacuuaggc

SEQ ID NO: 1537409 - RNA, 16 nt, Homo sapiens
accuccagaggugaug

SEQ ID NO: 1537410 - RNA, 22 nt, Homo sapiens
agagccauggacucuacacugu

SEQ ID NO: 1537411 - RNA, 21 nt, Homo sapiens
agagcggcuuccccauugccu

SEQ ID NO: 1537412 - RNA, 16 nt, Homo sapiens
agagcuccacagaaga

SEQ ID NO: 1537413 - RNA, 16 nt, Homo sapiens
agagcuuuacagugcc

SEQ ID NO: 1537414 - RNA, 18 nt, Homo sapiens
agagcuuuacagugccac

SEQ ID NO: 1537415 - RNA, 13 nt, Homo sapiens
agaggaagccacg

SEQ ID NO: 1537416 - RNA, 16 nt, Homo sapiens
agaggcaccuguccca

SEQ ID NO: 1537417 - RNA, 19 nt, Homo sapiens
agaggcucuaauguacaau

SEQ ID NO: 1537418 - RNA, 15 nt, Homo sapiens
agaggcuuccuucau

SEQ ID NO: 1537419 - RNA, 20 nt, Homo sapiens
agaggcuuccuucauuuccu

SEQ ID NO: 1537420 - RNA, 16 nt, Homo sapiens
agaggggcggggccag

SEQ ID NO: 1537421 - RNA, 14 nt, Homo sapiens
agagugcccauggg

SEQ ID NO: 1537422 - RNA, 15 nt, Homo sapiens
agaguguuuaacuga

SEQ ID NO: 1537423 - RNA, 19 nt, Homo sapiens
agaguguuuuuucugucau

SEQ ID NO: 1537424 - RNA, 16 nt, Homo sapiens
agaucuuggggugcag

SEQ ID NO: 1537425 - RNA, 16 nt, Homo sapiens
agauggcauguguuua

SEQ ID NO: 1537426 - RNA, 16 nt, Homo sapiens
agaugguaaucuuuuc

SEQ ID NO: 1537427 - RNA, 15 nt, Homo sapiens
agauguauuaugcaa

SEQ ID NO: 1537428 - RNA, 19 nt, Homo sapiens
agauguuccauccuguaca

SEQ ID NO: 1537429 - RNA, 15 nt, Homo sapiens
agauuugccaaaaac

SEQ ID NO: 1537430 - RNA, 19 nt, Homo sapiens
agauuuucauguucuugca

SEQ ID NO: 1537431 - RNA, 13 nt, Homo sapiens
agcaaugugguag

SEQ ID NO: 1537432 - RNA, 16 nt, Homo sapiens
agcacaagaaguggga

SEQ ID NO: 1537433 - RNA, 19 nt, Homo sapiens
agcacagauucaagugcaa

SEQ ID NO: 1537434 - RNA, 17 nt, Homo sapiens
agcacauugcccugagg

SEQ ID NO: 1537435 - RNA, 18 nt, Homo sapiens
agcaccuacuuacaugca

SEQ ID NO: 1537436 - RNA, 16 nt, Homo sapiens
agcaccuugaauggaa

SEQ ID NO: 1537437 - RNA, 20 nt, Homo sapiens
agcacugccauuagacugaa

SEQ ID NO: 1537438 - RNA, 15 nt, Homo sapiens
agcacuucaaaggaa

SEQ ID NO: 1537439 - RNA, 18 nt, Homo sapiens
agcagagugcacagcugu

SEQ ID NO: 1537440 - RNA, 19 nt, Homo sapiens
agcagcacaauucuguccc

SEQ ID NO: 1537441 - RNA, 10 nt, Homo sapiens
agcaggguga

SEQ ID NO: 1537442 - RNA, 23 nt, Homo sapiens
agcaguguuggggguagcggcau

SEQ ID NO: 1537443 - RNA, 16 nt, Homo sapiens
agcauccucaguuccu

SEQ ID NO: 1537444 - RNA, 22 nt, Homo sapiens
agcaucugccaggacacugccu

SEQ ID NO: 1537445 - RNA, 20 nt, Homo sapiens
agcaugagccagcucugucc

SEQ ID NO: 1537446 - RNA, 19 nt, Homo sapiens
agcauuucuugauguugcu

SEQ ID NO: 1537447 - RNA, 22 nt, Homo sapiens
agccaauaggcagcuuucuuaa

SEQ ID NO: 1537448 - RNA, 18 nt, Homo sapiens
agccaccaaggcugccug

SEQ ID NO: 1537449 - RNA, 15 nt, Homo sapiens
agccacccugccaug

SEQ ID NO: 1537450 - RNA, 21 nt, Homo sapiens
agccacgccugcgauggugcu

SEQ ID NO: 1537451 - RNA, 19 nt, Homo sapiens
agccagugacuccaggaga

SEQ ID NO: 1537452 - RNA, 20 nt, Homo sapiens
agccauggacucuacacugu

SEQ ID NO: 1537453 - RNA, 20 nt, Homo sapiens
agcccauuccucccauucaa

SEQ ID NO: 1537454 - RNA, 16 nt, Homo sapiens
agcccucucacugugu

SEQ ID NO: 1537455 - RNA, 17 nt, Homo sapiens
agcccugggguuuccac

SEQ ID NO: 1537456 - RNA, 13 nt, Homo sapiens
agccgagcucucc

SEQ ID NO: 1537457 - RNA, 17 nt, Homo sapiens
agccggagucacugccu

SEQ ID NO: 1537458 - RNA, 17 nt, Homo sapiens
agccgucagccugugaa

SEQ ID NO: 1537459 - RNA, 18 nt, Homo sapiens
agccuagccugcauauca

SEQ ID NO: 1537460 - RNA, 15 nt, Homo sapiens
agccuauggcaucuu

SEQ ID NO: 1537461 - RNA, 16 nt, Homo sapiens
agccucaaaugcagua

SEQ ID NO: 1537462 - RNA, 23 nt, Homo sapiens
agccuccacuuuggaucaggaaa

SEQ ID NO: 1537463 - RNA, 13 nt, Homo sapiens
agccucuccaagg

SEQ ID NO: 1537464 - RNA, 22 nt, Homo sapiens
agccucucccuccagccaauag

SEQ ID NO: 1537465 - RNA, 20 nt, Homo sapiens
agccugcucccuagccagag

SEQ ID NO: 1537466 - RNA, 23 nt, Homo sapiens
agccuguguuagugucuguccau

SEQ ID NO: 1537467 - RNA, 20 nt, Homo sapiens
agccuucucuguucauuucc

SEQ ID NO: 1537468 - RNA, 22 nt, Homo sapiens
agccuucucuguucauuuccuc

SEQ ID NO: 1537469 - RNA, 13 nt, Homo sapiens
agccuugugauca

SEQ ID NO: 1537470 - RNA, 13 nt, Homo sapiens
agcgacuucugaa

SEQ ID NO: 1537471 - RNA, 17 nt, Homo sapiens
agcguguacuaccccag

SEQ ID NO: 1537472 - RNA, 15 nt, Homo sapiens
agcuaauuagcucuc

SEQ ID NO: 1537473 - RNA, 14 nt, Homo sapiens
agcuauuacuggau

SEQ ID NO: 1537474 - RNA, 21 nt, Homo sapiens
agcuccauaauugcaagggaa

SEQ ID NO: 1537475 - RNA, 17 nt, Homo sapiens
agcuccuaguagcuuuc

SEQ ID NO: 1537476 - RNA, 22 nt, Homo sapiens
agcucucugagccagucccuca

SEQ ID NO: 1537477 - RNA, 16 nt, Homo sapiens
agcugaaagauugauu

SEQ ID NO: 1537478 - RNA, 22 nt, Homo sapiens
agcugaaagauugauuaaugaa

SEQ ID NO: 1537479 - RNA, 20 nt, Homo sapiens
agcugaagcguuacuacagc

SEQ ID NO: 1537480 - RNA, 20 nt, Homo sapiens
agcuggagagagaguucuca

SEQ ID NO: 1537481 - RNA, 22 nt, Homo sapiens
agcuggggccccugcaaccucg

SEQ ID NO: 1537482 - RNA, 17 nt, Homo sapiens
agcugggggccaugagc

SEQ ID NO: 1537483 - RNA, 20 nt, Homo sapiens
agcugggggccaugagcucc

SEQ ID NO: 1537484 - RNA, 11 nt, Homo sapiens
agcugugauuu

SEQ ID NO: 1537485 - RNA, 13 nt, Homo sapiens
agcuuacugauua

SEQ ID NO: 1537486 - RNA, 17 nt, Homo sapiens
agcuugacuucaugcca

SEQ ID NO: 1537487 - RNA, 19 nt, Homo sapiens
aggaaaaguuauugugaua

SEQ ID NO: 1537488 - RNA, 16 nt, Homo sapiens
aggaaacucaccugcu

SEQ ID NO: 1537489 - RNA, 21 nt, Homo sapiens
aggaaagccucacugauauau

SEQ ID NO: 1537490 - RNA, 20 nt, Homo sapiens
aggaaccucgaagcuguucu

SEQ ID NO: 1537491 - RNA, 14 nt, Homo sapiens
aggaagccacugcc

SEQ ID NO: 1537492 - RNA, 20 nt, Homo sapiens
aggaagggacugguccaggc

SEQ ID NO: 1537493 - RNA, 16 nt, Homo sapiens
aggaauauacauaguc

SEQ ID NO: 1537494 - RNA, 13 nt, Homo sapiens
aggacuccuuaaa

SEQ ID NO: 1537495 - RNA, 22 nt, Homo sapiens
aggacuugugccucuugggaga

SEQ ID NO: 1537496 - RNA, 14 nt, Homo sapiens
aggagacacuguuc

SEQ ID NO: 1537497 - RNA, 16 nt, Homo sapiens
aggagagaacagggau

SEQ ID NO: 1537498 - RNA, 14 nt, Homo sapiens
aggaggguggcacu

SEQ ID NO: 1537499 - RNA, 14 nt, Homo sapiens
aggaguuuugagaa

SEQ ID NO: 1537500 - RNA, 18 nt, Homo sapiens
aggaugauaaaagcacuu

SEQ ID NO: 1537501 - RNA, 14 nt, Homo sapiens
aggaugcaugcagg

SEQ ID NO: 1537502 - RNA, 15 nt, Homo sapiens
aggaugcaugcaggg

SEQ ID NO: 1537503 - RNA, 15 nt, Homo sapiens
aggauuuaccaaaua

SEQ ID NO: 1537504 - RNA, 16 nt, Homo sapiens
aggcaaauaucuugaa

SEQ ID NO: 1537505 - RNA, 15 nt, Homo sapiens
aggcagaaugguggg

SEQ ID NO: 1537506 - RNA, 17 nt, Homo sapiens
aggcagaauggugggcu

SEQ ID NO: 1537507 - RNA, 16 nt, Homo sapiens
aggcagaggacagauc

SEQ ID NO: 1537508 - RNA, 20 nt, Homo sapiens
aggccacccagggaccacgg

SEQ ID NO: 1537509 - RNA, 23 nt, Homo sapiens
aggccagaaaacauaugcauuau

SEQ ID NO: 1537510 - RNA, 16 nt, Homo sapiens
aggcccaagcugccug

SEQ ID NO: 1537511 - RNA, 20 nt, Homo sapiens
aggccccuuuggaccugcag

SEQ ID NO: 1537512 - RNA, 22 nt, Homo sapiens
aggcccuuccucuccacugccu

SEQ ID NO: 1537513 - RNA, 23 nt, Homo sapiens
aggcccuuccucuccacugccuu

SEQ ID NO: 1537514 - RNA, 16 nt, Homo sapiens
aggcucuaauguacaa

SEQ ID NO: 1537515 - RNA, 12 nt, Homo sapiens
aggcucuucucc

SEQ ID NO: 1537516 - RNA, 12 nt, Homo sapiens
aggcuuacaacu

SEQ ID NO: 1537517 - RNA, 13 nt, Homo sapiens
aggcuuccuucau

SEQ ID NO: 1537518 - RNA, 18 nt, Homo sapiens
aggcuuggggaugcccuu

SEQ ID NO: 1537519 - RNA, 17 nt, Homo sapiens
agggaauucucuuggcu

SEQ ID NO: 1537520 - RNA, 17 nt, Homo sapiens
agggacaagcauguuga

SEQ ID NO: 1537521 - RNA, 18 nt, Homo sapiens
agggaccaaggaccccuc

SEQ ID NO: 1537522 - RNA, 22 nt, Homo sapiens
agggacugguccaggcaugggu

SEQ ID NO: 1537523 - RNA, 16 nt, Homo sapiens
caguuauacauaccuc

SEQ ID NO: 1537524 - RNA, 12 nt, Homo sapiens
caguucugauga

SEQ ID NO: 1537525 - RNA, 19 nt, Homo sapiens
caguugaccuuugccaaac

SEQ ID NO: 1537526 - RNA, 22 nt, Homo sapiens
caguuguaacauucuauuucaa

SEQ ID NO: 1537527 - RNA, 15 nt, Homo sapiens
caguuguuauauuca

SEQ ID NO: 1537528 - RNA, 13 nt, Homo sapiens
caguuugugcaag

SEQ ID NO: 1537529 - RNA, 17 nt, Homo sapiens
cauaaaucugucugauu

SEQ ID NO: 1537530 - RNA, 14 nt, Homo sapiens
cauaaaucuuccaa

SEQ ID NO: 1537531 - RNA, 21 nt, Homo sapiens
cauaaaugugguacaagcauu

SEQ ID NO: 1537532 - RNA, 18 nt, Homo sapiens
cauaaccgcacagacauu

SEQ ID NO: 1537533 - RNA, 20 nt, Homo sapiens
cauaagcuuuuucucugaac

SEQ ID NO: 1537534 - RNA, 16 nt, Homo sapiens
cauaaugucauacgaa

SEQ ID NO: 1537535 - RNA, 16 nt, Homo sapiens
cauaauugcaagggaa

SEQ ID NO: 1537536 - RNA, 15 nt, Homo sapiens
cauacagauuugcaa

SEQ ID NO: 1537537 - RNA, 21 nt, Homo sapiens
cauaguuugaauucaugccuc

SEQ ID NO: 1537538 - RNA, 21 nt, Homo sapiens
cauauacuuuggggacuugua

SEQ ID NO: 1537539 - RNA, 18 nt, Homo sapiens
cauauauuuccacuucuu

SEQ ID NO: 1537540 - RNA, 13 nt, Homo sapiens
cauaugucuucaa

SEQ ID NO: 1537541 - RNA, 15 nt, Homo sapiens
cauauuaaucccucg

SEQ ID NO: 1537542 - RNA, 14 nt, Homo sapiens
caucaaagcacugu

SEQ ID NO: 1537543 - RNA, 14 nt, Homo sapiens
caucaaaguguuua

SEQ ID NO: 1537544 - RNA, 21 nt, Homo sapiens
caucaacaaagaaauauuauu

SEQ ID NO: 1537545 - RNA, 17 nt, Homo sapiens
caucaaccuaggagcag

SEQ ID NO: 1537546 - RNA, 17 nt, Homo sapiens
caucaauugcaugagua

SEQ ID NO: 1537547 - RNA, 16 nt, Homo sapiens
caucaguuaggauuag

SEQ ID NO: 1537548 - RNA, 21 nt, Homo sapiens
caucgguucaggaggagacag

SEQ ID NO: 1537549 - RNA, 23 nt, Homo sapiens
caucguugcaaccacugcaauau

SEQ ID NO: 1537550 - RNA, 14 nt, Homo sapiens
caucuaucugguga

SEQ ID NO: 1537551 - RNA, 15 nt, Homo sapiens
caucucaucaugucu

SEQ ID NO: 1537552 - RNA, 16 nt, Homo sapiens
caucugcugagcucug

SEQ ID NO: 1537553 - RNA, 18 nt, Homo sapiens
caucugucuguccuaccc

SEQ ID NO: 1537554 - RNA, 14 nt, Homo sapiens
caugaaucucucaa

SEQ ID NO: 1537555 - RNA, 23 nt, Homo sapiens
caugacuucuuuacuaacacugg

SEQ ID NO: 1537556 - RNA, 13 nt, Homo sapiens
caugagccagcuc

SEQ ID NO: 1537557 - RNA, 15 nt, Homo sapiens
caugauuugcaacuu

SEQ ID NO: 1537558 - RNA, 15 nt, Homo sapiens
caugauuuuuuacaa

SEQ ID NO: 1537559 - RNA, 18 nt, Homo sapiens
caugcagacccucagacc

SEQ ID NO: 1537560 - RNA, 20 nt, Homo sapiens
caugcauggccucccagcca

SEQ ID NO: 1537561 - RNA, 21 nt, Homo sapiens
caugcuggcucccagggccau

SEQ ID NO: 1537562 - RNA, 13 nt, Homo sapiens
cauggaccugcac

SEQ ID NO: 1537563 - RNA, 23 nt, Homo sapiens
cauggagcuugacuucaugccag

SEQ ID NO: 1537564 - RNA, 17 nt, Homo sapiens
cauggguucaauuggac

SEQ ID NO: 1537565 - RNA, 17 nt, Homo sapiens
caugguagacugugaca

SEQ ID NO: 1537566 - RNA, 22 nt, Homo sapiens
caugguagacugugacacagcu

SEQ ID NO: 1537567 - RNA, 17 nt, Homo sapiens
caugguuuaaagucaca

SEQ ID NO: 1537568 - RNA, 18 nt, Homo sapiens
caugguuuagggugauca

SEQ ID NO: 1537569 - RNA, 13 nt, Homo sapiens
cauguaccugaaa

SEQ ID NO: 1537570 - RNA, 15 nt, Homo sapiens
cauguaucuaugcau

SEQ ID NO: 1537571 - RNA, 17 nt, Homo sapiens
cauguaucuaugcauuu

SEQ ID NO: 1537572 - RNA, 20 nt, Homo sapiens
caugucugugaacuugaugu

SEQ ID NO: 1537573 - RNA, 15 nt, Homo sapiens
cauguggaaaacuca

SEQ ID NO: 1537574 - RNA, 22 nt, Homo sapiens
cauguguugccuggaagcacau

SEQ ID NO: 1537575 - RNA, 16 nt, Homo sapiens
cauguguuuacuuuau

SEQ ID NO: 1537576 - RNA, 23 nt, Homo sapiens
cauguuucccgcuccaagagaau

SEQ ID NO: 1537577 - RNA, 17 nt, Homo sapiens
cauuaaaaaugcauaua

SEQ ID NO: 1537578 - RNA, 23 nt, Homo sapiens
cauuaaaaaugcauauacuuuaa

SEQ ID NO: 1537579 - RNA, 20 nt, Homo sapiens
cauuaaagugcacugugucc

SEQ ID NO: 1537580 - RNA, 17 nt, Homo sapiens
cauuaaguaaacaauaa

SEQ ID NO: 1537581 - RNA, 19 nt, Homo sapiens
cauuaauuuaaaugauuua

SEQ ID NO: 1537582 - RNA, 21 nt, Homo sapiens
cauuacugcaugcacuucuua

SEQ ID NO: 1537583 - RNA, 16 nt, Homo sapiens
cauuaggaacagagua

SEQ ID NO: 1537584 - RNA, 21 nt, Homo sapiens
cauuauagauuuucauguucu

SEQ ID NO: 1537585 - RNA, 15 nt, Homo sapiens
cauuauuacuuuucc

SEQ ID NO: 1537586 - RNA, 17 nt, Homo sapiens
cauucacaacacaauca

SEQ ID NO: 1537587 - RNA, 22 nt, Homo sapiens
cauugauugguaguucgaagaa

SEQ ID NO: 1537588 - RNA, 22 nt, Homo sapiens
cauuguauuuuacuuugugcaa

SEQ ID NO: 1537589 - RNA, 20 nt, Homo sapiens
cauuguuacagguguacuau

SEQ ID NO: 1537590 - RNA, 13 nt, Homo sapiens
cauuguuuccacc

SEQ ID NO: 1537591 - RNA, 13 nt, Homo sapiens
cauuuagauuuug

SEQ ID NO: 1537592 - RNA, 16 nt, Homo sapiens
cauuucacuauucugu

SEQ ID NO: 1537593 - RNA, 23 nt, Homo sapiens
cauuuccuccgucaccucagaga

SEQ ID NO: 1537594 - RNA, 13 nt, Homo sapiens
cauuucuugaugu

SEQ ID NO: 1537595 - RNA, 16 nt, Homo sapiens
cauuugugcguaugca

SEQ ID NO: 1537596 - RNA, 17 nt, Homo sapiens
cauuuuaacaucugaga

SEQ ID NO: 1537597 - RNA, 13 nt, Homo sapiens
cauuuucaccucc

SEQ ID NO: 1537598 - RNA, 15 nt, Homo sapiens
cauuuuucuacugcu

SEQ ID NO: 1537599 - RNA, 18 nt, Homo sapiens
ccaaaaacuaaaauucaa

SEQ ID NO: 1537600 - RNA, 15 nt, Homo sapiens
ccaaaaguacuuacc

SEQ ID NO: 1537601 - RNA, 20 nt, Homo sapiens
ccaaacaacagucuucauuu

SEQ ID NO: 1537602 - RNA, 17 nt, Homo sapiens
ccaaagagaaaagauua

SEQ ID NO: 1537603 - RNA, 19 nt, Homo sapiens
ccaaagguuucaacuguaa

SEQ ID NO: 1537604 - RNA, 13 nt, Homo sapiens
aauuaagcuuaaa

SEQ ID NO: 1537605 - RNA, 13 nt, Homo sapiens
aauuacagaagaa

SEQ ID NO: 1537606 - RNA, 12 nt, Homo sapiens
aauuacuucuuc

SEQ ID NO: 1537607 - RNA, 17 nt, Homo sapiens
aauuagacauaccucuc

SEQ ID NO: 1537608 - RNA, 14 nt, Homo sapiens
aauuagacuaagug

SEQ ID NO: 1537609 - RNA, 21 nt, Homo sapiens
aauuagccagugaaaaacuau

SEQ ID NO: 1537610 - RNA, 12 nt, Homo sapiens
aauuauccuccu

SEQ ID NO: 1537611 - RNA, 15 nt, Homo sapiens
aauuaugagucucua

SEQ ID NO: 1537612 - RNA, 22 nt, Homo sapiens
aauucuguuuauguucuugcag

SEQ ID NO: 1537613 - RNA, 23 nt, Homo sapiens
aauugaagagagauauaucugaa

SEQ ID NO: 1537614 - RNA, 19 nt, Homo sapiens
aauugcagaagaaacuccu

SEQ ID NO: 1537615 - RNA, 15 nt, Homo sapiens
aauuuaacugcauau

SEQ ID NO: 1537616 - RNA, 15 nt, Homo sapiens
aauuucaaaaugcau

SEQ ID NO: 1537617 - RNA, 17 nt, Homo sapiens
aauuucaaaaugcaugu

SEQ ID NO: 1537618 - RNA, 16 nt, Homo sapiens
aauuucugccauuuca

SEQ ID NO: 1537619 - RNA, 20 nt, Homo sapiens
aauuucuggacuauccucuu

SEQ ID NO: 1537620 - RNA, 15 nt, Homo sapiens
aauuucuuacuaaac

SEQ ID NO: 1537621 - RNA, 20 nt, Homo sapiens
aauuuuaauguuuacaacaa

SEQ ID NO: 1537622 - RNA, 21 nt, Homo sapiens
aauuuuguaguaguugaugac

SEQ ID NO: 1537623 - RNA, 16 nt, Homo sapiens
aauuuuuuccuaccau

SEQ ID NO: 1537624 - RNA, 11 nt, Homo sapiens
acaaaagugaa

SEQ ID NO: 1537625 - RNA, 22 nt, Homo sapiens
acaaaauugcugaggagcucag

SEQ ID NO: 1537626 - RNA, 19 nt, Homo sapiens
acaaacacuuagcauccca

SEQ ID NO: 1537627 - RNA, 14 nt, Homo sapiens
acaaagaaauauua

SEQ ID NO: 1537628 - RNA, 17 nt, Homo sapiens
acaaauaaguaauaucu

SEQ ID NO: 1537629 - RNA, 22 nt, Homo sapiens
acaaauggcuuguucagucacu

SEQ ID NO: 1537630 - RNA, 13 nt, Homo sapiens
acaaauguaacac

SEQ ID NO: 1537631 - RNA, 14 nt, Homo sapiens
acaacacaaucaaa

SEQ ID NO: 1537632 - RNA, 21 nt, Homo sapiens
acaaccacauuucuggccauu

SEQ ID NO: 1537633 - RNA, 23 nt, Homo sapiens
acaaccuccuccuccaguucuga

SEQ ID NO: 1537634 - RNA, 13 nt, Homo sapiens
acaagacagcaga

SEQ ID NO: 1537635 - RNA, 17 nt, Homo sapiens
acaagugcucaguucca

SEQ ID NO: 1537636 - RNA, 16 nt, Homo sapiens
acaauaaagcaaugug

SEQ ID NO: 1537637 - RNA, 23 nt, Homo sapiens
acaauggcuggguuugggcagug

SEQ ID NO: 1537638 - RNA, 23 nt, Homo sapiens
acaauguaugugaaaguguaaaa

SEQ ID NO: 1537639 - RNA, 19 nt, Homo sapiens
acaauuucaaaaugcaugu

SEQ ID NO: 1537640 - RNA, 15 nt, Homo sapiens
acacaagacagcaga

SEQ ID NO: 1537641 - RNA, 18 nt, Homo sapiens
acacaauuggaagucuaa

SEQ ID NO: 1537642 - RNA, 15 nt, Homo sapiens
acacacacucuucaa

SEQ ID NO: 1537643 - RNA, 17 nt, Homo sapiens
acacacagagacacauc

SEQ ID NO: 1537644 - RNA, 13 nt, Homo sapiens
acacaccugcaca

SEQ ID NO: 1537645 - RNA, 19 nt, Homo sapiens
acacacgcaaauacaugcc

SEQ ID NO: 1537646 - RNA, 19 nt, Homo sapiens
acacagacucugugagauu

SEQ ID NO: 1537647 - RNA, 13 nt, Homo sapiens
acacauacacaca

SEQ ID NO: 1537648 - RNA, 14 nt, Homo sapiens
acacaugcauggca

SEQ ID NO: 1537649 - RNA, 19 nt, Homo sapiens
acacaugguuuccaagggu

SEQ ID NO: 1537650 - RNA, 17 nt, Homo sapiens
acaccagggaugguacu

SEQ ID NO: 1537651 - RNA, 17 nt, Homo sapiens
acaccuaugucauuuca

SEQ ID NO: 1537652 - RNA, 18 nt, Homo sapiens
acacgaacaaaccaagga

SEQ ID NO: 1537653 - RNA, 15 nt, Homo sapiens
acacgggcucaagga

SEQ ID NO: 1537654 - RNA, 17 nt, Homo sapiens
acacguuuagaaaugau

SEQ ID NO: 1537655 - RNA, 20 nt, Homo sapiens
acacugcacgaauggaagag

SEQ ID NO: 1537656 - RNA, 17 nt, Homo sapiens
acacugccuuugcugcc

SEQ ID NO: 1537657 - RNA, 19 nt, Homo sapiens
acagaaggaaggagccagc

SEQ ID NO: 1537658 - RNA, 20 nt, Homo sapiens
acagaaggaaggagccagcu

SEQ ID NO: 1537659 - RNA, 17 nt, Homo sapiens
acagaguauauauguac

SEQ ID NO: 1537660 - RNA, 19 nt, Homo sapiens
acagaugggcaaggccuuu

SEQ ID NO: 1537661 - RNA, 23 nt, Homo sapiens
acagauguuuguuuucaaaauac

SEQ ID NO: 1537662 - RNA, 16 nt, Homo sapiens
acagcauaaagcacau

SEQ ID NO: 1537663 - RNA, 23 nt, Homo sapiens
acagcaucugccaggacacugcc

SEQ ID NO: 1537664 - RNA, 14 nt, Homo sapiens
acagccguuugaau

SEQ ID NO: 1537665 - RNA, 14 nt, Homo sapiens
acagccuggcacag

SEQ ID NO: 1537666 - RNA, 13 nt, Homo sapiens
acaggacauucac

SEQ ID NO: 1537667 - RNA, 21 nt, Homo sapiens
acaggagcguguacuacccca

SEQ ID NO: 1537668 - RNA, 14 nt, Homo sapiens
acaggcguucucag

SEQ ID NO: 1537669 - RNA, 15 nt, Homo sapiens
acagggcauggccag

SEQ ID NO: 1537670 - RNA, 18 nt, Homo sapiens
acagucaaaauguuugau

SEQ ID NO: 1537671 - RNA, 20 nt, Homo sapiens
acagucaaaauguuugauau

SEQ ID NO: 1537672 - RNA, 20 nt, Homo sapiens
acagucaggaagccuccugc

SEQ ID NO: 1537673 - RNA, 23 nt, Homo sapiens
acaguugcacagcaucucagcuc

SEQ ID NO: 1537674 - RNA, 17 nt, Homo sapiens
acaguuggaacaguaau

SEQ ID NO: 1537675 - RNA, 23 nt, Homo sapiens
acaguugguuuugcaugucugca

SEQ ID NO: 1537676 - RNA, 16 nt, Homo sapiens
acauaugcauuaugaa

SEQ ID NO: 1537677 - RNA, 23 nt, Homo sapiens
acauauucccaugguagacugug

SEQ ID NO: 1537678 - RNA, 13 nt, Homo sapiens
acaucauguaaua

SEQ ID NO: 1537679 - RNA, 18 nt, Homo sapiens
acauccaggcaauggccu

SEQ ID NO: 1537680 - RNA, 13 nt, Homo sapiens
acaugaacccauc

SEQ ID NO: 1537681 - RNA, 16 nt, Homo sapiens
acaugaguucaaauac

SEQ ID NO: 1537682 - RNA, 19 nt, Homo sapiens
acaugcacuuggcugcaua

SEQ ID NO: 1537683 - RNA, 15 nt, Homo sapiens
acaugcggcugccca

SEQ ID NO: 1537684 - RNA, 15 nt, Homo sapiens
acauguccuauuacu

SEQ ID NO: 1537685 - RNA, 14 nt, Homo sapiens
acaugugauuguga

SEQ ID NO: 1537686 - RNA, 15 nt, Homo sapiens
acaugugauugugau

SEQ ID NO: 1537687 - RNA, 20 nt, Homo sapiens
acauuaaaauaacuaagcaa

SEQ ID NO: 1537688 - RNA, 19 nt, Homo sapiens
acauuaauugaggcuuaca

SEQ ID NO: 1537689 - RNA, 23 nt, Homo sapiens
acauuauagauuuucauguucuu

SEQ ID NO: 1537690 - RNA, 20 nt, Homo sapiens
acauuaugagagacugcuca

SEQ ID NO: 1537691 - RNA, 23 nt, Homo sapiens
acauuugcuuuuugcuuguguac

SEQ ID NO: 1537692 - RNA, 15 nt, Homo sapiens
accaacccucagagc

SEQ ID NO: 1537693 - RNA, 19 nt, Homo sapiens
accaacuaugcguaaauca

SEQ ID NO: 1537694 - RNA, 17 nt, Homo sapiens
accaaugauucauaaca

SEQ ID NO: 1537695 - RNA, 21 nt, Homo sapiens
accacacacacccuuccccac

SEQ ID NO: 1537696 - RNA, 21 nt, Homo sapiens
accaccuggauggaucugcuc

SEQ ID NO: 1537697 - RNA, 13 nt, Homo sapiens
accaccuucaaua

SEQ ID NO: 1537698 - RNA, 21 nt, Homo sapiens
accacuuuccccgugggccau

SEQ ID NO: 1537699 - RNA, 21 nt, Homo sapiens
accagauuuuuacacauguau

SEQ ID NO: 1537700 - RNA, 21 nt, Homo sapiens
accagcuuguccaacaacucc

SEQ ID NO: 1537701 - RNA, 22 nt, Homo sapiens
accagggggaagcaccagccuc

SEQ ID NO: 1537702 - RNA, 21 nt, Homo sapiens
accauaagcuuuuucucugaa

SEQ ID NO: 1537703 - RNA, 12 nt, Homo sapiens
accaucucaggc

SEQ ID NO: 1537704 - RNA, 22 nt, Homo sapiens
accaugaagaugccauugacaa

SEQ ID NO: 1537705 - RNA, 16 nt, Homo sapiens
accaugcucaaugaaa

SEQ ID NO: 1537706 - RNA, 13 nt, Homo sapiens
accauugugcauu

SEQ ID NO: 1537707 - RNA, 21 nt, Homo sapiens
acccaacagagaccagcuucu

SEQ ID NO: 1537708 - RNA, 14 nt, Homo sapiens
acccacaggacauu

SEQ ID NO: 1537709 - RNA, 21 nt, Homo sapiens
acccacccucugguccuucug

SEQ ID NO: 1537710 - RNA, 18 nt, Homo sapiens
acccaccuggauucccug

SEQ ID NO: 1537711 - RNA, 22 nt, Homo sapiens
acccaguaacucaucugucacc

SEQ ID NO: 1537712 - RNA, 18 nt, Homo sapiens
acccaguggaaccaaaac

SEQ ID NO: 1537713 - RNA, 18 nt, Homo sapiens
accccgccucugggcuca

SEQ ID NO: 1537714 - RNA, 18 nt, Homo sapiens
accccuccaugauuccaa

SEQ ID NO: 1537715 - RNA, 19 nt, Homo sapiens
acccgugccacgcgcucug

SEQ ID NO: 1537716 - RNA, 21 nt, Homo sapiens
acccguggagaugggaugcuu

SEQ ID NO: 1537717 - RNA, 17 nt, Homo sapiens
acccguucaacuuuucc

SEQ ID NO: 1537718 - RNA, 15 nt, Homo sapiens
acccuaggucuccac

SEQ ID NO: 1537719 - RNA, 23 nt, Homo sapiens
acccuccccauuaguauccuguu

SEQ ID NO: 1537720 - RNA, 16 nt, Homo sapiens
acccugaggguuucca

SEQ ID NO: 1537721 - RNA, 16 nt, Homo sapiens
acccugccaacuuucc

SEQ ID NO: 1537722 - RNA, 21 nt, Homo sapiens
acccuuaaacaguugcacagc

SEQ ID NO: 1537723 - RNA, 22 nt, Homo sapiens
acccuucugucuguaagauuuu

SEQ ID NO: 1537724 - RNA, 19 nt, Homo sapiens
acccuuggagccaauggag

SEQ ID NO: 1537725 - RNA, 21 nt, Homo sapiens
accgguguccuguuccugcca

SEQ ID NO: 1537726 - RNA, 14 nt, Homo sapiens
accgugggcacuga

SEQ ID NO: 1537727 - RNA, 15 nt, Homo sapiens
accguugauguugau

SEQ ID NO: 1537728 - RNA, 22 nt, Homo sapiens
accuaaacauagaaauugccug

SEQ ID NO: 1537729 - RNA, 22 nt, Homo sapiens
accuaaagaauaugaauggauu

SEQ ID NO: 1537730 - RNA, 14 nt, Homo sapiens
accuacuuacaugc

SEQ ID NO: 1537731 - RNA, 13 nt, Homo sapiens
accucaacaaaga

SEQ ID NO: 1537732 - RNA, 18 nt, Homo sapiens
accucaccccauugauug

SEQ ID NO: 1537733 - RNA, 23 nt, Homo sapiens
aucaauguucacgcaacuugaaa

SEQ ID NO: 1537734 - RNA, 16 nt, Homo sapiens
aucaauugcaugagua

SEQ ID NO: 1537735 - RNA, 17 nt, Homo sapiens
aucacuugacuuugcca

SEQ ID NO: 1537736 - RNA, 19 nt, Homo sapiens
aucacuugacuuugccaca

SEQ ID NO: 1537737 - RNA, 18 nt, Homo sapiens
aucagacugcuuugagaa

SEQ ID NO: 1537738 - RNA, 18 nt, Homo sapiens
aucaguuuguuguucaga

SEQ ID NO: 1537739 - RNA, 22 nt, Homo sapiens
auccaagaccuuacaaccacau

SEQ ID NO: 1537740 - RNA, 12 nt, Homo sapiens
auccaauggauu

SEQ ID NO: 1537741 - RNA, 17 nt, Homo sapiens
auccaauggauugugca

SEQ ID NO: 1537742 - RNA, 20 nt, Homo sapiens
auccacuacauucugaaggc

SEQ ID NO: 1537743 - RNA, 18 nt, Homo sapiens
auccagaggguugugauu

SEQ ID NO: 1537744 - RNA, 19 nt, Homo sapiens
auccagaggguugugauuu

SEQ ID NO: 1537745 - RNA, 12 nt, Homo sapiens
auccaggacagc

SEQ ID NO: 1537746 - RNA, 17 nt, Homo sapiens
auccaugcggccggccu

SEQ ID NO: 1537747 - RNA, 21 nt, Homo sapiens
auccaugugcugcuguggcau

SEQ ID NO: 1537748 - RNA, 15 nt, Homo sapiens
aucccaguggccuca

SEQ ID NO: 1537749 - RNA, 13 nt, Homo sapiens
aucccgggagcag

SEQ ID NO: 1537750 - RNA, 15 nt, Homo sapiens
aucccuggggaugug

SEQ ID NO: 1537751 - RNA, 16 nt, Homo sapiens
auccugcaaugggaga

SEQ ID NO: 1537752 - RNA, 12 nt, Homo sapiens
auccuguuacuu

SEQ ID NO: 1537753 - RNA, 16 nt, Homo sapiens
auccuguuaggggaaa

SEQ ID NO: 1537754 - RNA, 16 nt, Homo sapiens
aucgcugccuugccau

SEQ ID NO: 1537755 - RNA, 21 nt, Homo sapiens
aucguucugggucagcuugaa

SEQ ID NO: 1537756 - RNA, 23 nt, Homo sapiens
aucuaacgcuuuaaauggcuacu

SEQ ID NO: 1537757 - RNA, 21 nt, Homo sapiens
aucuacuagaaccuucuaauc

SEQ ID NO: 1537758 - RNA, 19 nt, Homo sapiens
aucuauuucauaccaugga

SEQ ID NO: 1537759 - RNA, 13 nt, Homo sapiens
aucucacaaauaa

SEQ ID NO: 1537760 - RNA, 17 nt, Homo sapiens
aucucacucuguugccc

SEQ ID NO: 1537761 - RNA, 19 nt, Homo sapiens
aucucacucuguugcccag

SEQ ID NO: 1537762 - RNA, 18 nt, Homo sapiens
aucucgaagucuuccauc

SEQ ID NO: 1537763 - RNA, 19 nt, Homo sapiens
aucucuucuuuuaaaccau

SEQ ID NO: 1537764 - RNA, 20 nt, Homo sapiens
aucucuuucaucuagcucca

SEQ ID NO: 1537765 - RNA, 18 nt, Homo sapiens
aucugagaaaagcuuuga

SEQ ID NO: 1537766 - RNA, 15 nt, Homo sapiens
aucugcauaaccgca

SEQ ID NO: 1537767 - RNA, 20 nt, Homo sapiens
aucuguaugggucauucuca

SEQ ID NO: 1537768 - RNA, 18 nt, Homo sapiens
aucuguuugauacaguau

SEQ ID NO: 1537769 - RNA, 15 nt, Homo sapiens
augaaaccacuggaa

SEQ ID NO: 1537770 - RNA, 13 nt, Homo sapiens
augaaagaggcau

SEQ ID NO: 1537771 - RNA, 17 nt, Homo sapiens
augaaagguaaucugaa

SEQ ID NO: 1537772 - RNA, 13 nt, Homo sapiens
augaacacuggcu

SEQ ID NO: 1537773 - RNA, 18 nt, Homo sapiens
augaacccauccaaugga

SEQ ID NO: 1537774 - RNA, 14 nt, Homo sapiens
augaagacaaauag

SEQ ID NO: 1537775 - RNA, 17 nt, Homo sapiens
augaagcaaacacacag

SEQ ID NO: 1537776 - RNA, 23 nt, Homo sapiens
augaaggugucauacagauuugc

SEQ ID NO: 1537777 - RNA, 17 nt, Homo sapiens
augaauaaacacuuuuu

SEQ ID NO: 1537778 - RNA, 21 nt, Homo sapiens
augaauaaauauuacaaauuc

SEQ ID NO: 1537779 - RNA, 19 nt, Homo sapiens
augaaucccauaauugaca

SEQ ID NO: 1537780 - RNA, 17 nt, Homo sapiens
augaaugacauugaacu

SEQ ID NO: 1537781 - RNA, 21 nt, Homo sapiens
augacucaccuugcucugcca

SEQ ID NO: 1537782 - RNA, 22 nt, Homo sapiens
augacuucuuuacuaacacugg

SEQ ID NO: 1537783 - RNA, 14 nt, Homo sapiens
augagaaaagggaa

SEQ ID NO: 1537784 - RNA, 17 nt, Homo sapiens
augagagaagagaguau

SEQ ID NO: 1537785 - RNA, 13 nt, Homo sapiens
augagccagcucu

SEQ ID NO: 1537786 - RNA, 22 nt, Homo sapiens
augagguuggaaagaguugcca

SEQ ID NO: 1537787 - RNA, 21 nt, Homo sapiens
augaguuugccauguugagca

SEQ ID NO: 1537788 - RNA, 17 nt, Homo sapiens
augauaaaagcacuuac

SEQ ID NO: 1537789 - RNA, 15 nt, Homo sapiens
augauaaauuugacu

SEQ ID NO: 1537790 - RNA, 20 nt, Homo sapiens
augauaaauuugacuguuau

SEQ ID NO: 1537791 - RNA, 19 nt, Homo sapiens
augauacuugguccuuaaa

SEQ ID NO: 1537792 - RNA, 12 nt, Homo sapiens
augaucuuggca

SEQ ID NO: 1537793 - RNA, 16 nt, Homo sapiens
augauuagcuuuguca

SEQ ID NO: 1537794 - RNA, 22 nt, Homo sapiens
augauucauuuuaacaucugag

SEQ ID NO: 1537795 - RNA, 17 nt, Homo sapiens
augauuuccgucaugcu

SEQ ID NO: 1537796 - RNA, 21 nt, Homo sapiens
augauuuuuaacauuaugaga

SEQ ID NO: 1537797 - RNA, 14 nt, Homo sapiens
augauuuuuuacaa

SEQ ID NO: 1537798 - RNA, 20 nt, Homo sapiens
augcacuuggcugcauaaau

SEQ ID NO: 1537799 - RNA, 19 nt, Homo sapiens
augcagcuucaggugagcc

SEQ ID NO: 1537800 - RNA, 19 nt, Homo sapiens
augcagggcccccacagga

SEQ ID NO: 1537801 - RNA, 20 nt, Homo sapiens
augcaugauauuguauguac

SEQ ID NO: 1537802 - RNA, 17 nt, Homo sapiens
augccaauuucucuuaa

SEQ ID NO: 1537803 - RNA, 13 nt, Homo sapiens
augccagcuauaa

SEQ ID NO: 1537804 - RNA, 18 nt, Homo sapiens
augccauuccgaccuuca

SEQ ID NO: 1537805 - RNA, 10 nt, Homo sapiens
augcccuccc

SEQ ID NO: 1537806 - RNA, 22 nt, Homo sapiens
augccuuucuaguccuauucua

SEQ ID NO: 1537807 - RNA, 16 nt, Homo sapiens
augcuacucuaguauu

SEQ ID NO: 1537808 - RNA, 20 nt, Homo sapiens
augcugccaaccagcuuguc

SEQ ID NO: 1537809 - RNA, 14 nt, Homo sapiens
augcuggucauccu

SEQ ID NO: 1537810 - RNA, 20 nt, Homo sapiens
augcuggucauccugggcau

SEQ ID NO: 1537811 - RNA, 17 nt, Homo sapiens
augcuugguuguugcag

SEQ ID NO: 1537812 - RNA, 14 nt, Homo sapiens
augcuuuucuaauc

SEQ ID NO: 1537813 - RNA, 17 nt, Homo sapiens
auggaagccuccaccug

SEQ ID NO: 1537814 - RNA, 18 nt, Homo sapiens
auggaagggccuucucca

SEQ ID NO: 1537815 - RNA, 15 nt, Homo sapiens
auggaucugcuccau

SEQ ID NO: 1537816 - RNA, 15 nt, Homo sapiens
auggccaggccucag

SEQ ID NO: 1537817 - RNA, 22 nt, Homo sapiens
auggccaggccucagggaccaa

SEQ ID NO: 1537818 - RNA, 22 nt, Homo sapiens
auggccauagcuuuuauucauu

SEQ ID NO: 1537819 - RNA, 14 nt, Homo sapiens
augggagaaccucg

SEQ ID NO: 1537820 - RNA, 14 nt, Homo sapiens
augguaacugcaca

SEQ ID NO: 1537821 - RNA, 16 nt, Homo sapiens
auggucacagagagac

SEQ ID NO: 1537822 - RNA, 14 nt, Homo sapiens
auggugcuuggcag

SEQ ID NO: 1537823 - RNA, 22 nt, Homo sapiens
auguacccagccuaccagagau

SEQ ID NO: 1537824 - RNA, 15 nt, Homo sapiens
auguaguaugcuaug

SEQ ID NO: 1537825 - RNA, 15 nt, Homo sapiens
auguauaucaggguu

SEQ ID NO: 1537826 - RNA, 12 nt, Homo sapiens
auguauuaugca

SEQ ID NO: 1537827 - RNA, 20 nt, Homo sapiens
auguauuggauacgcuccag

SEQ ID NO: 1537828 - RNA, 17 nt, Homo sapiens
augucauuucauuuccu

SEQ ID NO: 1537829 - RNA, 12 nt, Homo sapiens
auguccaugaaa

SEQ ID NO: 1537830 - RNA, 19 nt, Homo sapiens
augucuaaaguuagggcau

SEQ ID NO: 1537831 - RNA, 20 nt, Homo sapiens
augucugaaguuugccccag

SEQ ID NO: 1537832 - RNA, 11 nt, Homo sapiens
augucugugau

SEQ ID NO: 1537833 - RNA, 14 nt, Homo sapiens
augugaauuuugcc

SEQ ID NO: 1537834 - RNA, 21 nt, Homo sapiens
augugagcaugaaacuaugca

SEQ ID NO: 1537835 - RNA, 14 nt, Homo sapiens
augugccuagacac

SEQ ID NO: 1537836 - RNA, 19 nt, Homo sapiens
auguggaaaacucacagau

SEQ ID NO: 1537837 - RNA, 21 nt, Homo sapiens
auguguguuucuguccuguaa

SEQ ID NO: 1537838 - RNA, 11 nt, Homo sapiens
auguguugccu

SEQ ID NO: 1537839 - RNA, 12 nt, Homo sapiens
auguguuuacuu

SEQ ID NO: 1537840 - RNA, 16 nt, Homo sapiens
auguguuucaggugga

SEQ ID NO: 1537841 - RNA, 22 nt, Homo sapiens
auguuauacaaccuucauuuaa

SEQ ID NO: 1537842 - RNA, 17 nt, Homo sapiens
auguuauaggcacuugc

SEQ ID NO: 1537843 - RNA, 19 nt, Homo sapiens
auguuuaccucacuggugc

SEQ ID NO: 1537844 - RNA, 16 nt, Homo sapiens
auguuuagugugauug

SEQ ID NO: 1537845 - RNA, 21 nt, Homo sapiens
auguuucaggagagaguugaa

SEQ ID NO: 1537846 - RNA, 17 nt, Homo sapiens
auuaaacaaauuccuuc

SEQ ID NO: 1537847 - RNA, 22 nt, Homo sapiens
auuaaccuuaucauaaauucaa

SEQ ID NO: 1537848 - RNA, 12 nt, Homo sapiens
auuaagcuuaaa

SEQ ID NO: 1537849 - RNA, 19 nt, Homo sapiens
auuaaugaguuuuauccaa

SEQ ID NO: 1537850 - RNA, 20 nt, Homo sapiens
auuacaauggccagcccaga

SEQ ID NO: 1537851 - RNA, 18 nt, Homo sapiens
auuacacgccacaacucc

SEQ ID NO: 1537852 - RNA, 14 nt, Homo sapiens
auuacauagacugu

SEQ ID NO: 1537853 - RNA, 18 nt, Homo sapiens
auuacugcaugcacuucu

SEQ ID NO: 1537854 - RNA, 16 nt, Homo sapiens
auuagacauaccucuc

SEQ ID NO: 1537855 - RNA, 13 nt, Homo sapiens
auuauguauaaca

SEQ ID NO: 1537856 - RNA, 16 nt, Homo sapiens
auuauuaaaucagaau

SEQ ID NO: 1537857 - RNA, 12 nt, Homo sapiens
auuauuguugca

SEQ ID NO: 1537858 - RNA, 21 nt, Homo sapiens
auuauuucaaccgcuugccau

SEQ ID NO: 1537859 - RNA, 16 nt, Homo sapiens
auucaaaauaguucua

SEQ ID NO: 1537860 - RNA, 12 nt, Homo sapiens
auucaaaugcau

SEQ ID NO: 1537861 - RNA, 14 nt, Homo sapiens
auucaaaugcauga

SEQ ID NO: 1537862 - RNA, 14 nt, Homo sapiens
auucaacauuugcu

SEQ ID NO: 1537863 - RNA, 17 nt, Homo sapiens
auucacaacacaaucaa

SEQ ID NO: 1537864 - RNA, 10 nt, Homo sapiens
ccuguucuca

SEQ ID NO: 1537865 - RNA, 20 nt, Homo sapiens
ccuguucuuugaaguggcac

SEQ ID NO: 1537866 - RNA, 17 nt, Homo sapiens
ccuuagaauacuguauu

SEQ ID NO: 1537867 - RNA, 16 nt, Homo sapiens
ccuuagacaccuauca

SEQ ID NO: 1537868 - RNA, 18 nt, Homo sapiens
ccuucacuucugaccaca

SEQ ID NO: 1537869 - RNA, 12 nt, Homo sapiens
ccuucaugauga

SEQ ID NO: 1537870 - RNA, 20 nt, Homo sapiens
ccuuccaggcguagggccag

SEQ ID NO: 1537871 - RNA, 16 nt, Homo sapiens
ccuucuccacagggac

SEQ ID NO: 1537872 - RNA, 16 nt, Homo sapiens
ccuucugucucuugca

SEQ ID NO: 1537873 - RNA, 14 nt, Homo sapiens
ccuugccaugucuu

SEQ ID NO: 1537874 - RNA, 14 nt, Homo sapiens
ccuugcucugccau

SEQ ID NO: 1537875 - RNA, 16 nt, Homo sapiens
ccuugggaugggcaca

SEQ ID NO: 1537876 - RNA, 16 nt, Homo sapiens
ccuuguuaaaauccaa

SEQ ID NO: 1537877 - RNA, 14 nt, Homo sapiens
ccuuuucaugauuu

SEQ ID NO: 1537878 - RNA, 15 nt, Homo sapiens
cgaagggaucagccc

SEQ ID NO: 1537879 - RNA, 17 nt, Homo sapiens
cgaguuccggaaagccu

SEQ ID NO: 1537880 - RNA, 18 nt, Homo sapiens
cgcauuuucuaccugaaa

SEQ ID NO: 1537881 - RNA, 14 nt, Homo sapiens
cgccagauggggcc

SEQ ID NO: 1537882 - RNA, 16 nt, Homo sapiens
cgccuggcagaacuga

SEQ ID NO: 1537883 - RNA, 23 nt, Homo sapiens
cgccugguucuguacauguggaa

SEQ ID NO: 1537884 - RNA, 19 nt, Homo sapiens
cgcugggagaaaagccaga

SEQ ID NO: 1537885 - RNA, 19 nt, Homo sapiens
cgcuggugcccaccagcug

SEQ ID NO: 1537886 - RNA, 15 nt, Homo sapiens
cggaaguggccugag

SEQ ID NO: 1537887 - RNA, 15 nt, Homo sapiens
cggaugacacaaaua

SEQ ID NO: 1537888 - RNA, 23 nt, Homo sapiens
cggccgaggccugcgcccugaca

SEQ ID NO: 1537889 - RNA, 15 nt, Homo sapiens
cggccggccuggggc

SEQ ID NO: 1537890 - RNA, 15 nt, Homo sapiens
cggcuccuucaagcu

SEQ ID NO: 1537891 - RNA, 15 nt, Homo sapiens
cggcucguuccccca

SEQ ID NO: 1537892 - RNA, 14 nt, Homo sapiens
cggcugcaccugca

SEQ ID NO: 1537893 - RNA, 23 nt, Homo sapiens
cggcuuggcuagucacauaucaa

SEQ ID NO: 1537894 - RNA, 14 nt, Homo sapiens
cguaguaacacaua

SEQ ID NO: 1537895 - RNA, 18 nt, Homo sapiens
cguccuuagaauacugua

SEQ ID NO: 1537896 - RNA, 21 nt, Homo sapiens
cguuugaauauauuuuaucuu

SEQ ID NO: 1537897 - RNA, 18 nt, Homo sapiens
cuaaaauacucaccaaaa

SEQ ID NO: 1537898 - RNA, 19 nt, Homo sapiens
cuaaaccauugugcauucu

SEQ ID NO: 1537899 - RNA, 17 nt, Homo sapiens
cuaaagcuaaacaaaac

SEQ ID NO: 1537900 - RNA, 19 nt, Homo sapiens
cuaagaccuuggcauccuu

SEQ ID NO: 1537901 - RNA, 19 nt, Homo sapiens
cuaagccguuggcaccucu

SEQ ID NO: 1537902 - RNA, 17 nt, Homo sapiens
cuaaucagcauucucac

SEQ ID NO: 1537903 - RNA, 22 nt, Homo sapiens
cuaauccugaagggaagcccau

SEQ ID NO: 1537904 - RNA, 13 nt, Homo sapiens
cuaaucugcagug

SEQ ID NO: 1537905 - RNA, 19 nt, Homo sapiens
cuaauguacaauaaagcaa

SEQ ID NO: 1537906 - RNA, 18 nt, Homo sapiens
cuaauguggcagcugucu

SEQ ID NO: 1537907 - RNA, 20 nt, Homo sapiens
cuaauguggcagcugucuca

SEQ ID NO: 1537908 - RNA, 16 nt, Homo sapiens
cuacauucugaaggcc

SEQ ID NO: 1537909 - RNA, 17 nt, Homo sapiens
cuaccauuauggcuuug

SEQ ID NO: 1537910 - RNA, 16 nt, Homo sapiens
cuacuuacaugcauua

SEQ ID NO: 1537911 - RNA, 21 nt, Homo sapiens
cuacuuugguuucugucugua

SEQ ID NO: 1537912 - RNA, 22 nt, Homo sapiens
cuagaaggaugaacaguucucc

SEQ ID NO: 1537913 - RNA, 23 nt, Homo sapiens
cuagagaaauaaaauauggacuu

SEQ ID NO: 1537914 - RNA, 22 nt, Homo sapiens
cuagaggcuuccuucauuuccu

SEQ ID NO: 1537915 - RNA, 14 nt, Homo sapiens
cuagagugcauaua

SEQ ID NO: 1537916 - RNA, 19 nt, Homo sapiens
cuagccagaggcucuaaug

SEQ ID NO: 1537917 - RNA, 17 nt, Homo sapiens
cuagcuccauaauugca

SEQ ID NO: 1537918 - RNA, 13 nt, Homo sapiens
cuaggagcacugu

SEQ ID NO: 1537919 - RNA, 12 nt, Homo sapiens
cuaguagcuuuc

SEQ ID NO: 1537920 - RNA, 23 nt, Homo sapiens
cuaguagcuuuccucccaaaggc

SEQ ID NO: 1537921 - RNA, 15 nt, Homo sapiens
cuagucacauaucaa

SEQ ID NO: 1537922 - RNA, 14 nt, Homo sapiens
cuauaaaaugaaua

SEQ ID NO: 1537923 - RNA, 15 nt, Homo sapiens
cuauaccaccuucaa

SEQ ID NO: 1537924 - RNA, 18 nt, Homo sapiens
cuauacugguuauaguug

SEQ ID NO: 1537925 - RNA, 13 nt, Homo sapiens
cuaucauauauua

SEQ ID NO: 1537926 - RNA, 22 nt, Homo sapiens
cuaugaaggcuguacacugcac

SEQ ID NO: 1537927 - RNA, 18 nt, Homo sapiens
cuaugccuguauuuccaa

SEQ ID NO: 1537928 - RNA, 17 nt, Homo sapiens
cuaugcugcaauacauu

SEQ ID NO: 1537929 - RNA, 19 nt, Homo sapiens
cuaugucauuucauuuccu

SEQ ID NO: 1537930 - RNA, 19 nt, Homo sapiens
cuauuaccuguuaguauua

SEQ ID NO: 1537931 - RNA, 18 nt, Homo sapiens
cuauucccaggcagggag

SEQ ID NO: 1537932 - RNA, 16 nt, Homo sapiens
cuauuuuggacgugug

SEQ ID NO: 1537933 - RNA, 17 nt, Homo sapiens
cuauuuuggacguguga

SEQ ID NO: 1537934 - RNA, 14 nt, Homo sapiens
cucaaaugcaguau

SEQ ID NO: 1537935 - RNA, 18 nt, Homo sapiens
cucaaaugcuacucagua

SEQ ID NO: 1537936 - RNA, 17 nt, Homo sapiens
cucaaccuacaguggag

SEQ ID NO: 1537937 - RNA, 14 nt, Homo sapiens
cucacccagccugg

SEQ ID NO: 1537938 - RNA, 20 nt, Homo sapiens
cucaccuucccuaguucuuu

SEQ ID NO: 1537939 - RNA, 13 nt, Homo sapiens
cucacugauauau

SEQ ID NO: 1537940 - RNA, 21 nt, Homo sapiens
cucacuugcuuuaguuguuaa

SEQ ID NO: 1537941 - RNA, 14 nt, Homo sapiens
cucagagacauaca

SEQ ID NO: 1537942 - RNA, 23 nt, Homo sapiens
cucagagcuccacagaagacacg

SEQ ID NO: 1537943 - RNA, 23 nt, Homo sapiens
cucagccacacccaggcacuuaa

SEQ ID NO: 1537944 - RNA, 15 nt, Homo sapiens
cucagcucaucuuca

SEQ ID NO: 1537945 - RNA, 19 nt, Homo sapiens
cucauucuuuucagcuugu

SEQ ID NO: 1537946 - RNA, 14 nt, Homo sapiens
cucauuguagaaaa

SEQ ID NO: 1537947 - RNA, 22 nt, Homo sapiens
cucauuguagaaaagcuauaaa

SEQ ID NO: 1537948 - RNA, 16 nt, Homo sapiens
cucauuuagcauugaa

SEQ ID NO: 1537949 - RNA, 20 nt, Homo sapiens
cuccaaaguuuuaaaccugu

SEQ ID NO: 1537950 - RNA, 22 nt, Homo sapiens
cuccaaggcaaauguccaagca

SEQ ID NO: 1537951 - RNA, 16 nt, Homo sapiens
cuccaccucaggggag

SEQ ID NO: 1537952 - RNA, 17 nt, Homo sapiens
cuccagaacaaaccucu

SEQ ID NO: 1537953 - RNA, 15 nt, Homo sapiens
cuccaguucugauga

SEQ ID NO: 1537954 - RNA, 18 nt, Homo sapiens
cucccacaucccccgugu

SEQ ID NO: 1537955 - RNA, 13 nt, Homo sapiens
cucccagacugca

SEQ ID NO: 1537956 - RNA, 14 nt, Homo sapiens
cucccaggguccug

SEQ ID NO: 1537957 - RNA, 21 nt, Homo sapiens
cuccccaauccaacccaugca

SEQ ID NO: 1537958 - RNA, 16 nt, Homo sapiens
cuccccagccaggugc

SEQ ID NO: 1537959 - RNA, 16 nt, Homo sapiens
cuccccugguccugca

SEQ ID NO: 1537960 - RNA, 16 nt, Homo sapiens
cucccuccagccaaua

SEQ ID NO: 1537961 - RNA, 22 nt, Homo sapiens
cucccuggacucuguggggcca

SEQ ID NO: 1537962 - RNA, 14 nt, Homo sapiens
cuccgucaccucag

SEQ ID NO: 1537963 - RNA, 18 nt, Homo sapiens
cuccgugagccucagcca

SEQ ID NO: 1537964 - RNA, 16 nt, Homo sapiens
cuccuguugcaaugac

SEQ ID NO: 1537965 - RNA, 15 nt, Homo sapiens
cuccuucaagcugcu

SEQ ID NO: 1537966 - RNA, 23 nt, Homo sapiens
cucuaauguacaauaaagcaaug

SEQ ID NO: 1537967 - RNA, 18 nt, Homo sapiens
cucucacccccacacugg

SEQ ID NO: 1537968 - RNA, 15 nt, Homo sapiens
cucuccugaggagca

SEQ ID NO: 1537969 - RNA, 16 nt, Homo sapiens
cucugaaccagagaaa

SEQ ID NO: 1537970 - RNA, 19 nt, Homo sapiens
cucugcuaugucugugaug

SEQ ID NO: 1537971 - RNA, 15 nt, Homo sapiens
cucugcuccacagaa

SEQ ID NO: 1537972 - RNA, 17 nt, Homo sapiens
cucugcuggauucuaaa

SEQ ID NO: 1537973 - RNA, 14 nt, Homo sapiens
cucuggucacuuca

SEQ ID NO: 1537974 - RNA, 23 nt, Homo sapiens
cucuguguuacccaguaacucau

SEQ ID NO: 1537975 - RNA, 14 nt, Homo sapiens
cucuguucauuucc

SEQ ID NO: 1537976 - RNA, 23 nt, Homo sapiens
cucuguuuugcauggaguauuau

SEQ ID NO: 1537977 - RNA, 14 nt, Homo sapiens
cucuucuccacugg

SEQ ID NO: 1537978 - RNA, 21 nt, Homo sapiens
cucuugcccagccggcugcaa

SEQ ID NO: 1537979 - RNA, 13 nt, Homo sapiens
cucuuuaugacug

SEQ ID NO: 1537980 - RNA, 12 nt, Homo sapiens
cucuuucaucua

SEQ ID NO: 1537981 - RNA, 15 nt, Homo sapiens
cugaaaacuggaaua

SEQ ID NO: 1537982 - RNA, 21 nt, Homo sapiens
cugaaaagaaaugcuaaugua

SEQ ID NO: 1537983 - RNA, 20 nt, Homo sapiens
cugaaagauugauuaaugaa

SEQ ID NO: 1537984 - RNA, 17 nt, Homo sapiens
cugaacugcaacacugg

SEQ ID NO: 1537985 - RNA, 13 nt, Homo sapiens
cugaaggcuuuca

SEQ ID NO: 1537986 - RNA, 12 nt, Homo sapiens
cugaagugaaua

SEQ ID NO: 1537987 - RNA, 15 nt, Homo sapiens
cugaaucccuuucag

SEQ ID NO: 1537988 - RNA, 20 nt, Homo sapiens
cugacccauucacauuuuaa

SEQ ID NO: 1537989 - RNA, 14 nt, Homo sapiens
cugagaagccucau

SEQ ID NO: 1537990 - RNA, 19 nt, Homo sapiens
cugagaggagcguguccua

SEQ ID NO: 1537991 - RNA, 12 nt, Homo sapiens
cugaggaugcug

SEQ ID NO: 1537992 - RNA, 23 nt, Homo sapiens
cugaggcuggggcuuuugugcca

SEQ ID NO: 1537993 - RNA, 18 nt, Homo sapiens
cugagggacuuggcagua

SEQ ID NO: 1537994 - RNA, 13 nt, Homo sapiens
uguuaccuucaca

SEQ ID NO: 1537995 - RNA, 22 nt, Homo sapiens
uguuauuuguugagacuaucaa

SEQ ID NO: 1537996 - RNA, 22 nt, Homo sapiens
uguucagaagaaagauugcuau

SEQ ID NO: 1537997 - RNA, 15 nt, Homo sapiens
uguucuuagcugaac

SEQ ID NO: 1537998 - RNA, 18 nt, Homo sapiens
uguucuuccucuuaccug

SEQ ID NO: 1537999 - RNA, 15 nt, Homo sapiens
uguugacacggccau

SEQ ID NO: 1538000 - RNA, 16 nt, Homo sapiens
uguugcaaugacacau

SEQ ID NO: 1538001 - RNA, 15 nt, Homo sapiens
uguuguguccaaucc

SEQ ID NO: 1538002 - RNA, 16 nt, Homo sapiens
uguugugucuugcuau

SEQ ID NO: 1538003 - RNA, 14 nt, Homo sapiens
uguuuacuuuaugu

SEQ ID NO: 1538004 - RNA, 17 nt, Homo sapiens
uguuucccgcuccaaga

SEQ ID NO: 1538005 - RNA, 18 nt, Homo sapiens
uguuugccuuuaggcagg

SEQ ID NO: 1538006 - RNA, 22 nt, Homo sapiens
uguuuucagaccuuugucugaa

SEQ ID NO: 1538007 - RNA, 22 nt, Homo sapiens
uguuuuccccaauuauccuccu

SEQ ID NO: 1538008 - RNA, 19 nt, Homo sapiens
uguuuuuuuuuuccacuua

SEQ ID NO: 1538009 - RNA, 15 nt, Homo sapiens
uuaaaaaaauaacau

SEQ ID NO: 1538010 - RNA, 17 nt, Homo sapiens
uuaaaagaagacuggaa

SEQ ID NO: 1538011 - RNA, 22 nt, Homo sapiens
uuaaaauaacuaagcaaguaua

SEQ ID NO: 1538012 - RNA, 21 nt, Homo sapiens
uuaaaauggacuuuuguucau

SEQ ID NO: 1538013 - RNA, 16 nt, Homo sapiens
uuaaaauuagugagau

SEQ ID NO: 1538014 - RNA, 13 nt, Homo sapiens
uuaaacagggcau

SEQ ID NO: 1538015 - RNA, 17 nt, Homo sapiens
uuaaacaguugcacagc

SEQ ID NO: 1538016 - RNA, 19 nt, Homo sapiens
uuaaacuucuuaacuggca

SEQ ID NO: 1538017 - RNA, 14 nt, Homo sapiens
uuaaauacuacaaa

SEQ ID NO: 1538018 - RNA, 16 nt, Homo sapiens
uuaaaugaacuugaua

SEQ ID NO: 1538019 - RNA, 19 nt, Homo sapiens
uuaaaugcuguaugucauu

SEQ ID NO: 1538020 - RNA, 20 nt, Homo sapiens
uuaaauuugggggacuuaca

SEQ ID NO: 1538021 - RNA, 21 nt, Homo sapiens
uuaaccugaauuauuccaacu

SEQ ID NO: 1538022 - RNA, 17 nt, Homo sapiens
uuaacuuuaccaugcuc

SEQ ID NO: 1538023 - RNA, 16 nt, Homo sapiens
uuaagccauaugacaa

SEQ ID NO: 1538024 - RNA, 12 nt, Homo sapiens
uuaagcucaaaa

SEQ ID NO: 1538025 - RNA, 19 nt, Homo sapiens
uuaauauacugcauauccu

SEQ ID NO: 1538026 - RNA, 18 nt, Homo sapiens
uuaaucucuaaaauucua

SEQ ID NO: 1538027 - RNA, 14 nt, Homo sapiens
uuaaugaaauacca

SEQ ID NO: 1538028 - RNA, 12 nt, Homo sapiens
uuaauggugccu

SEQ ID NO: 1538029 - RNA, 17 nt, Homo sapiens
uuaauugaggcuuacag

SEQ ID NO: 1538030 - RNA, 15 nt, Homo sapiens
uuacaugauucauuu

SEQ ID NO: 1538031 - RNA, 18 nt, Homo sapiens
uuacuuugugcaauauga

SEQ ID NO: 1538032 - RNA, 15 nt, Homo sapiens
uuagaaauugcauuu

SEQ ID NO: 1538033 - RNA, 15 nt, Homo sapiens
uuagagacuguaaau

SEQ ID NO: 1538034 - RNA, 16 nt, Homo sapiens
uuagauguagcacuga

SEQ ID NO: 1538035 - RNA, 13 nt, Homo sapiens
uuagauugccacu

SEQ ID NO: 1538036 - RNA, 21 nt, Homo sapiens
uuagcauuuucugcaucucca

SEQ ID NO: 1538037 - RNA, 15 nt, Homo sapiens
uuagcccacugccug

SEQ ID NO: 1538038 - RNA, 21 nt, Homo sapiens
uuagccccaugaguuugccau

SEQ ID NO: 1538039 - RNA, 13 nt, Homo sapiens
uuagcugaacaau

SEQ ID NO: 1538040 - RNA, 16 nt, Homo sapiens
uuagcugaacaaugaa

SEQ ID NO: 1538041 - RNA, 15 nt, Homo sapiens
uuagcuuaguucucu

SEQ ID NO: 1538042 - RNA, 18 nt, Homo sapiens
uuaggauuuaccaaauag

SEQ ID NO: 1538043 - RNA, 22 nt, Homo sapiens
uuaggcaauggugaacugucau

SEQ ID NO: 1538044 - RNA, 12 nt, Homo sapiens
uuaggcauuaaa

SEQ ID NO: 1538045 - RNA, 13 nt, Homo sapiens
uuaguaucucauc

SEQ ID NO: 1538046 - RNA, 22 nt, Homo sapiens
uuaguauuauuguugcauuaaa

SEQ ID NO: 1538047 - RNA, 16 nt, Homo sapiens
uuagugugauugugaa

SEQ ID NO: 1538048 - RNA, 20 nt, Homo sapiens
uuaguuucagcugaccagaa

SEQ ID NO: 1538049 - RNA, 21 nt, Homo sapiens
uuauaaagauugguaguuauc

SEQ ID NO: 1538050 - RNA, 23 nt, Homo sapiens
uuauaggaaaaguuauugugaua

SEQ ID NO: 1538051 - RNA, 18 nt, Homo sapiens
uuauauaugaaaacuaag

SEQ ID NO: 1538052 - RNA, 19 nt, Homo sapiens
uuauaucagacugcuuuga

SEQ ID NO: 1538053 - RNA, 22 nt, Homo sapiens
uuauauugaacuguaaauaugu

SEQ ID NO: 1538054 - RNA, 15 nt, Homo sapiens
uuaucauaaauucaa

SEQ ID NO: 1538055 - RNA, 18 nt, Homo sapiens
uuauccuuaagaauucca

SEQ ID NO: 1538056 - RNA, 21 nt, Homo sapiens
uuaucuagcaagaagauucua

SEQ ID NO: 1538057 - RNA, 17 nt, Homo sapiens
uuaucugucucuucuac

SEQ ID NO: 1538058 - RNA, 20 nt, Homo sapiens
uuaugaaguuaacagucuca

SEQ ID NO: 1538059 - RNA, 22 nt, Homo sapiens
uuaugagcucuucauguuucag

SEQ ID NO: 1538060 - RNA, 23 nt, Homo sapiens
uuaugagucucuaugaucuuggc

SEQ ID NO: 1538061 - RNA, 18 nt, Homo sapiens
uuaugugaauuuugccau

SEQ ID NO: 1538062 - RNA, 22 nt, Homo sapiens
uuauuaaauguagcuucaguca

SEQ ID NO: 1538063 - RNA, 16 nt, Homo sapiens
uuauuguugcauuaaa

SEQ ID NO: 1538064 - RNA, 15 nt, Homo sapiens
uuauuuccauggauu

SEQ ID NO: 1538065 - RNA, 13 nt, Homo sapiens
uuauuucuagcaa

SEQ ID NO: 1538066 - RNA, 23 nt, Homo sapiens
uuauuuuuaucaguuacacauga

SEQ ID NO: 1538067 - RNA, 14 nt, Homo sapiens
uucaaaaauuucac

SEQ ID NO: 1538068 - RNA, 12 nt, Homo sapiens
uucaaaauacuu

SEQ ID NO: 1538069 - RNA, 12 nt, Homo sapiens
uucaaaaugcau

SEQ ID NO: 1538070 - RNA, 13 nt, Homo sapiens
uucaaaugcauga

SEQ ID NO: 1538071 - RNA, 19 nt, Homo sapiens
uucaacaugguuaccucug

SEQ ID NO: 1538072 - RNA, 18 nt, Homo sapiens
uucaaccacauuugcuag

SEQ ID NO: 1538073 - RNA, 21 nt, Homo sapiens
uucaagccuggcccagugaga

SEQ ID NO: 1538074 - RNA, 23 nt, Homo sapiens
uucaaguuuuuuucaaaguccaa

SEQ ID NO: 1538075 - RNA, 21 nt, Homo sapiens
uucaaucuuaacaaaagugaa

SEQ ID NO: 1538076 - RNA, 17 nt, Homo sapiens
uucacaacacaaucaaa

SEQ ID NO: 1538077 - RNA, 17 nt, Homo sapiens
uucaccaagccacugau

SEQ ID NO: 1538078 - RNA, 16 nt, Homo sapiens
uucaccaggaagaagg

SEQ ID NO: 1538079 - RNA, 15 nt, Homo sapiens
uucacuauaauguga

SEQ ID NO: 1538080 - RNA, 16 nt, Homo sapiens
uucagaaacaaagcau

SEQ ID NO: 1538081 - RNA, 14 nt, Homo sapiens
uucagacucucucc

SEQ ID NO: 1538082 - RNA, 13 nt, Homo sapiens
uucagcucuacag

SEQ ID NO: 1538083 - RNA, 16 nt, Homo sapiens
uucaggcuugcauuaa

SEQ ID NO: 1538084 - RNA, 17 nt, Homo sapiens
uucauuauugguuuuaa

SEQ ID NO: 1538085 - RNA, 21 nt, Homo sapiens
uuccaacauuauccuguguga

SEQ ID NO: 1538086 - RNA, 16 nt, Homo sapiens
uuccaaguuuauugcc

SEQ ID NO: 1538087 - RNA, 22 nt, Homo sapiens
uuccaauaauugacugguggaa

SEQ ID NO: 1538088 - RNA, 23 nt, Homo sapiens
uuccacuuagaaauugcauuucc

SEQ ID NO: 1538089 - RNA, 19 nt, Homo sapiens
uuccaucuguuugauacag

SEQ ID NO: 1538090 - RNA, 18 nt, Homo sapiens
uuccauggauuccccugg

SEQ ID NO: 1538091 - RNA, 24 nt, Homo sapiens
uucccacucccucucuugccgaca

SEQ ID NO: 1538092 - RNA, 16 nt, Homo sapiens
uucccacuuugccacu

SEQ ID NO: 1538093 - RNA, 13 nt, Homo sapiens
uuccccacucccg

SEQ ID NO: 1538094 - RNA, 21 nt, Homo sapiens
uuccccugcucacucuuccac

SEQ ID NO: 1538095 - RNA, 21 nt, Homo sapiens
uucccugagucccaccauagc

SEQ ID NO: 1538096 - RNA, 11 nt, Homo sapiens
uucccuggaag

SEQ ID NO: 1538097 - RNA, 18 nt, Homo sapiens
uucccuucaacaugaaaa

SEQ ID NO: 1538098 - RNA, 15 nt, Homo sapiens
uuccggaaagccuuc

SEQ ID NO: 1538099 - RNA, 15 nt, Homo sapiens
uuccuaggccucagg

SEQ ID NO: 1538100 - RNA, 18 nt, Homo sapiens
uuccuaugcugcaauaca

SEQ ID NO: 1538101 - RNA, 16 nt, Homo sapiens
uuccuggacacuuuac

SEQ ID NO: 1538102 - RNA, 15 nt, Homo sapiens
uuccuuggcccagca

SEQ ID NO: 1538103 - RNA, 23 nt, Homo sapiens
uucgauacaccgggccuggagaa

SEQ ID NO: 1538104 - RNA, 16 nt, Homo sapiens
uucuaauccaugugcu

SEQ ID NO: 1538105 - RNA, 17 nt, Homo sapiens
uucuaccuggucucucc

SEQ ID NO: 1538106 - RNA, 19 nt, Homo sapiens
uucuacucuucaaccucua

SEQ ID NO: 1538107 - RNA, 15 nt, Homo sapiens
uucuagagugcauau

SEQ ID NO: 1538108 - RNA, 16 nt, Homo sapiens
uucuagauuaccauga

SEQ ID NO: 1538109 - RNA, 14 nt, Homo sapiens
uucuagucucugau

SEQ ID NO: 1538110 - RNA, 21 nt, Homo sapiens
uucuauuagcuuacugauuaa

SEQ ID NO: 1538111 - RNA, 22 nt, Homo sapiens
uucucaguaaauauuaaccuga

SEQ ID NO: 1538112 - RNA, 21 nt, Homo sapiens
uucucauuuagcauugaaaua

SEQ ID NO: 1538113 - RNA, 22 nt, Homo sapiens
uucuccagggguuuacagugaa

SEQ ID NO: 1538114 - RNA, 15 nt, Homo sapiens
uucuccuguugcaau

SEQ ID NO: 1538115 - RNA, 16 nt, Homo sapiens
uucucuaggaaagugc

SEQ ID NO: 1538116 - RNA, 16 nt, Homo sapiens
uucuguacauguggaa

SEQ ID NO: 1538117 - RNA, 12 nt, Homo sapiens
uucuguccugua

SEQ ID NO: 1538118 - RNA, 12 nt, Homo sapiens
uucuuacuguau

SEQ ID NO: 1538119 - RNA, 18 nt, Homo sapiens
uucuuccucuuaccugua

SEQ ID NO: 1538120 - RNA, 17 nt, Homo sapiens
uucuugcagucaucaga

SEQ ID NO: 1538121 - RNA, 18 nt, Homo sapiens
uucuuuuucugucuugua

SEQ ID NO: 1538122 - RNA, 21 nt, Homo sapiens
uugaaagaaaaguauuuccaa

SEQ ID NO: 1538123 - RNA, 19 nt, Homo sapiens
uugaaauuauaucuguggu

SEQ ID NO: 1538124 - RNA, 18 nt, Homo sapiens
auuccucccauucaagau

SEQ ID NO: 1538125 - RNA, 21 nt, Homo sapiens
auucuaaaagauaaguguguu

SEQ ID NO: 1538126 - RNA, 16 nt, Homo sapiens
auucuaagauuguaca

SEQ ID NO: 1538127 - RNA, 18 nt, Homo sapiens
auucuaauuagauuaacc

SEQ ID NO: 1538128 - RNA, 14 nt, Homo sapiens
auucuauaaauuca

SEQ ID NO: 1538129 - RNA, 14 nt, Homo sapiens
auucucaccugaau

SEQ ID NO: 1538130 - RNA, 21 nt, Homo sapiens
cagcuccuuagacaccuauca

SEQ ID NO: 1538131 - RNA, 14 nt, Homo sapiens
cagcugccagagaa

SEQ ID NO: 1538132 - RNA, 15 nt, Homo sapiens
cagcuggcucugcag

SEQ ID NO: 1538133 - RNA, 23 nt, Homo sapiens
cagcugugugugcccguggugag

SEQ ID NO: 1538134 - RNA, 15 nt, Homo sapiens
cagcuucaaaacaga

SEQ ID NO: 1538135 - RNA, 17 nt, Homo sapiens
caggaaaguaucucuac

SEQ ID NO: 1538136 - RNA, 14 nt, Homo sapiens
caggagaaagaagg

SEQ ID NO: 1538137 - RNA, 16 nt, Homo sapiens
caggccacccagggac

SEQ ID NO: 1538138 - RNA, 23 nt, Homo sapiens
caggcugccccaccccuccauga

SEQ ID NO: 1538139 - RNA, 14 nt, Homo sapiens
caggggcagugaag

SEQ ID NO: 1538140 - RNA, 23 nt, Homo sapiens
cagggggguuggguuccagacag

SEQ ID NO: 1538141 - RNA, 19 nt, Homo sapiens
cagguucucuccugugagc

SEQ ID NO: 1538142 - RNA, 19 nt, Homo sapiens
cagucaaaauguuugauau

SEQ ID NO: 1538143 - RNA, 14 nt, Homo sapiens
cagucccucagcca

SEQ ID NO: 1538144 - RNA, 15 nt, Homo sapiens
cagucuggugcccag

SEQ ID NO: 1538145 - RNA, 13 nt, Homo sapiens
cagucuuggaaua

SEQ ID NO: 1538146 - RNA, 17 nt, Homo sapiens
cagucuuuuguccugca

SEQ ID NO: 1538147 - RNA, 16 nt, Homo sapiens
cagugccacgacaugg

SEQ ID NO: 1538148 - RNA, 14 nt, Homo sapiens
caguggaaccaaaa

SEQ ID NO: 1538149 - RNA, 23 nt, Homo sapiens
caguggccuacaaaucaguaauu

SEQ ID NO: 1538150 - RNA, 18 nt, Homo sapiens
caguggugagacuguauc

SEQ ID NO: 1538151 - RNA, 18 nt, Homo sapiens
caguggugcgaucuuggc

SEQ ID NO: 1538152 - RNA, 17 nt, Homo sapiens
caguguagaucaacuca

SEQ ID NO: 1538153 - RNA, 20 nt, Homo sapiens
caguguuagcuuaguucucu

SEQ ID NO: 1538154 - RNA, 15 nt, Homo sapiens
caguguugccuccuc

SEQ ID NO: 1538155 - RNA, 16 nt, Homo sapiens
caguguuuccagugac

SEQ ID NO: 1538156 - RNA, 20 nt, Homo sapiens
caguguuuccagugacacaa

SEQ ID NO: 1538157 - RNA, 17 nt, Homo sapiens
caguuauagaaaaucua

SEQ ID NO: 1538158 - RNA, 14 nt, Homo sapiens
caguucaaucaaac

SEQ ID NO: 1538159 - RNA, 17 nt, Homo sapiens
caguugcaauaaacuca

SEQ ID NO: 1538160 - RNA, 15 nt, Homo sapiens
caguugguuuugcau

SEQ ID NO: 1538161 - RNA, 15 nt, Homo sapiens
caguuucacauauuu

SEQ ID NO: 1538162 - RNA, 15 nt, Homo sapiens
caguuugcaaucuua

SEQ ID NO: 1538163 - RNA, 20 nt, Homo sapiens
cauaaaugugguacaagcau

SEQ ID NO: 1538164 - RNA, 17 nt, Homo sapiens
cauaauuuaaaaaguca

SEQ ID NO: 1538165 - RNA, 16 nt, Homo sapiens
cauacguucuuuucaa

SEQ ID NO: 1538166 - RNA, 22 nt, Homo sapiens
cauacucuguguaaucucugau

SEQ ID NO: 1538167 - RNA, 12 nt, Homo sapiens
cauauacuuuaa

SEQ ID NO: 1538168 - RNA, 17 nt, Homo sapiens
cauauauuuccacuucu

SEQ ID NO: 1538169 - RNA, 22 nt, Homo sapiens
cauaucuuguuguucaguuugg

SEQ ID NO: 1538170 - RNA, 23 nt, Homo sapiens
cauaugacaauuucaaaaugcau

SEQ ID NO: 1538171 - RNA, 23 nt, Homo sapiens
cauaugauaaauuugacuguuau

SEQ ID NO: 1538172 - RNA, 15 nt, Homo sapiens
caucacacauguuca

SEQ ID NO: 1538173 - RNA, 13 nt, Homo sapiens
caucagcagugau

SEQ ID NO: 1538174 - RNA, 22 nt, Homo sapiens
caucauaaaaggugacccuucu

SEQ ID NO: 1538175 - RNA, 15 nt, Homo sapiens
caucauuauuacaua

SEQ ID NO: 1538176 - RNA, 20 nt, Homo sapiens
cauccaucccuggugaaaga

SEQ ID NO: 1538177 - RNA, 23 nt, Homo sapiens
cauccugauuauugaauguuaua

SEQ ID NO: 1538178 - RNA, 19 nt, Homo sapiens
caucuagaggcuuccuuca

SEQ ID NO: 1538179 - RNA, 16 nt, Homo sapiens
caucuagcuccauaau

SEQ ID NO: 1538180 - RNA, 20 nt, Homo sapiens
caucuggagcugaagcguua

SEQ ID NO: 1538181 - RNA, 18 nt, Homo sapiens
caucugucugucccaguu

SEQ ID NO: 1538182 - RNA, 24 nt, Homo sapiens
caucuuauuugucaguguagauca

SEQ ID NO: 1538183 - RNA, 20 nt, Homo sapiens
caugaaccucaagcugcauc

SEQ ID NO: 1538184 - RNA, 21 nt, Homo sapiens
caugaaggugucauacagauu

SEQ ID NO: 1538185 - RNA, 20 nt, Homo sapiens
caugaauuaagaacugacac

SEQ ID NO: 1538186 - RNA, 22 nt, Homo sapiens
caugagucucacuagcacaugg

SEQ ID NO: 1538187 - RNA, 16 nt, Homo sapiens
caugauauuguaugua

SEQ ID NO: 1538188 - RNA, 19 nt, Homo sapiens
caugauggagucagguuug

SEQ ID NO: 1538189 - RNA, 22 nt, Homo sapiens
caugcacugcaaauacuuccaa

SEQ ID NO: 1538190 - RNA, 19 nt, Homo sapiens
caugcacuuggcugcauaa

SEQ ID NO: 1538191 - RNA, 15 nt, Homo sapiens
caugcagaaauugac

SEQ ID NO: 1538192 - RNA, 16 nt, Homo sapiens
caugcauuacugcaug

SEQ ID NO: 1538193 - RNA, 21 nt, Homo sapiens
caugcauuacugcaugcacuu

SEQ ID NO: 1538194 - RNA, 21 nt, Homo sapiens
caugcauuuuaccaucacaca

SEQ ID NO: 1538195 - RNA, 23 nt, Homo sapiens
cauggauuggauuucaguucaau

SEQ ID NO: 1538196 - RNA, 16 nt, Homo sapiens
cauggcauuuguucca

SEQ ID NO: 1538197 - RNA, 21 nt, Homo sapiens
cauggccagguggccacucca

SEQ ID NO: 1538198 - RNA, 19 nt, Homo sapiens
cauggggugggccucuggu

SEQ ID NO: 1538199 - RNA, 16 nt, Homo sapiens
caugguagacugugac

SEQ ID NO: 1538200 - RNA, 13 nt, Homo sapiens
caugguaucucuu

SEQ ID NO: 1538201 - RNA, 16 nt, Homo sapiens
caugucuuguucagaa

SEQ ID NO: 1538202 - RNA, 22 nt, Homo sapiens
caugugacaugaacccauccaa

SEQ ID NO: 1538203 - RNA, 15 nt, Homo sapiens
caugugauugugauu

SEQ ID NO: 1538204 - RNA, 16 nt, Homo sapiens
caugugccugaaggcu

SEQ ID NO: 1538205 - RNA, 17 nt, Homo sapiens
cauguggcuaaaugccu

SEQ ID NO: 1538206 - RNA, 17 nt, Homo sapiens
cauguguugccuggaag

SEQ ID NO: 1538207 - RNA, 19 nt, Homo sapiens
cauguguuucuguguagua

SEQ ID NO: 1538208 - RNA, 15 nt, Homo sapiens
cauuaaaagacuguu

SEQ ID NO: 1538209 - RNA, 15 nt, Homo sapiens
cauuacugcaugcac

SEQ ID NO: 1538210 - RNA, 17 nt, Homo sapiens
cauuacugcaugcacuu

SEQ ID NO: 1538211 - RNA, 12 nt, Homo sapiens
cauuacugccaa

SEQ ID NO: 1538212 - RNA, 20 nt, Homo sapiens
cauuagagggacagccaaaa

SEQ ID NO: 1538213 - RNA, 18 nt, Homo sapiens
cauuaggaacagaguaua

SEQ ID NO: 1538214 - RNA, 23 nt, Homo sapiens
cauuauuucaaccgcuugccaua

SEQ ID NO: 1538215 - RNA, 18 nt, Homo sapiens
cauuccaaauagcccaca

SEQ ID NO: 1538216 - RNA, 22 nt, Homo sapiens
cauucguccuuagaauacugua

SEQ ID NO: 1538217 - RNA, 20 nt, Homo sapiens
cauucugaaggccuuguuaa

SEQ ID NO: 1538218 - RNA, 16 nt, Homo sapiens
cauucugucuugaagg

SEQ ID NO: 1538219 - RNA, 14 nt, Homo sapiens
cauugguaucugau

SEQ ID NO: 1538220 - RNA, 18 nt, Homo sapiens
cauuuaaaaagguuuaaa

SEQ ID NO: 1538221 - RNA, 17 nt, Homo sapiens
cauuuauuuacauguga

SEQ ID NO: 1538222 - RNA, 12 nt, Homo sapiens
cauuucaugucc

SEQ ID NO: 1538223 - RNA, 19 nt, Homo sapiens
cauuuccugacagaaggac

SEQ ID NO: 1538224 - RNA, 18 nt, Homo sapiens
cauuuucucccuuaggaa

SEQ ID NO: 1538225 - RNA, 15 nt, Homo sapiens
cauuuuguuauagaa

SEQ ID NO: 1538226 - RNA, 20 nt, Homo sapiens
cauuuuuuuuuuaucagagu

SEQ ID NO: 1538227 - RNA, 14 nt, Homo sapiens
ccaaauacauucca

SEQ ID NO: 1538228 - RNA, 19 nt, Homo sapiens
ccaaauagcccacacgugc

SEQ ID NO: 1538229 - RNA, 20 nt, Homo sapiens
ccaaauugaugggugggcua

SEQ ID NO: 1538230 - RNA, 23 nt, Homo sapiens
ccaacgaaaagcacauccaggca

SEQ ID NO: 1538231 - RNA, 20 nt, Homo sapiens
ccaagaggaaaauauugaca

SEQ ID NO: 1538232 - RNA, 20 nt, Homo sapiens
ccaagccuuggggauucuuc

SEQ ID NO: 1538233 - RNA, 15 nt, Homo sapiens
ccaaucaacagcaug

SEQ ID NO: 1538234 - RNA, 15 nt, Homo sapiens
ccaaugcucuuuuca

SEQ ID NO: 1538235 - RNA, 12 nt, Homo sapiens
ccacaaaugucc

SEQ ID NO: 1538236 - RNA, 12 nt, Homo sapiens
ccacaacuccag

SEQ ID NO: 1538237 - RNA, 17 nt, Homo sapiens
ccacacuaccaguuuca

SEQ ID NO: 1538238 - RNA, 12 nt, Homo sapiens
ccacacugggac

SEQ ID NO: 1538239 - RNA, 13 nt, Homo sapiens
ccacacugggacu

SEQ ID NO: 1538240 - RNA, 21 nt, Homo sapiens
ccacacuuccuguccagagag

SEQ ID NO: 1538241 - RNA, 14 nt, Homo sapiens
ccacagcccuguca

SEQ ID NO: 1538242 - RNA, 17 nt, Homo sapiens
ccacaggagcauguccu

SEQ ID NO: 1538243 - RNA, 17 nt, Homo sapiens
ccacaggagcguguccu

SEQ ID NO: 1538244 - RNA, 22 nt, Homo sapiens
ccacauauauuuccacuucuuc

SEQ ID NO: 1538245 - RNA, 18 nt, Homo sapiens
ccacauucuggcuccacc

SEQ ID NO: 1538246 - RNA, 14 nt, Homo sapiens
ccacccauaucaug

SEQ ID NO: 1538247 - RNA, 17 nt, Homo sapiens
ccaccccuaaagagaua

SEQ ID NO: 1538248 - RNA, 23 nt, Homo sapiens
ccaccgguguccuguuccugcca

SEQ ID NO: 1538249 - RNA, 19 nt, Homo sapiens
ccaccuggauggaucugcu

SEQ ID NO: 1538250 - RNA, 18 nt, Homo sapiens
ccaccugggcccuaggca

SEQ ID NO: 1538251 - RNA, 14 nt, Homo sapiens
ccaccugugcugcu

SEQ ID NO: 1538252 - RNA, 14 nt, Homo sapiens
ccacggccacugca

SEQ ID NO: 1538253 - RNA, 14 nt, Homo sapiens
ccacuacauucuga

SEQ ID NO: 1538254 - RNA, 14 nt, Homo sapiens
ccacugagucucau

SEQ ID NO: 1538255 - RNA, 11 nt, Homo sapiens
ccacuguaaau

SEQ ID NO: 1538256 - RNA, 14 nt, Homo sapiens
ccacuuaugcugcu

SEQ ID NO: 1538257 - RNA, 13 nt, Homo sapiens
ccacuucacaguu

SEQ ID NO: 1538258 - RNA, 17 nt, Homo sapiens
ccacuucgggagaagaa

SEQ ID NO: 1538259 - RNA, 23 nt, Homo sapiens
ccacuuuccccgugggccauggc

SEQ ID NO: 1538260 - RNA, 17 nt, Homo sapiens
gacagacacugcugaac

SEQ ID NO: 1538261 - RNA, 19 nt, Homo sapiens
gacagagggacagugggcu

SEQ ID NO: 1538262 - RNA, 23 nt, Homo sapiens
gacaggaauucucccuggcauug

SEQ ID NO: 1538263 - RNA, 19 nt, Homo sapiens
gacauaaaucuuccaaagu

SEQ ID NO: 1538264 - RNA, 16 nt, Homo sapiens
gacaucuagucucagu

SEQ ID NO: 1538265 - RNA, 20 nt, Homo sapiens
gaccccucaccuugcaacac

SEQ ID NO: 1538266 - RNA, 23 nt, Homo sapiens
gaccuccaccugggagaugcugg

SEQ ID NO: 1538267 - RNA, 17 nt, Homo sapiens
gaccuccaggaagggac

SEQ ID NO: 1538268 - RNA, 18 nt, Homo sapiens
gaccuggggggggcaaga

SEQ ID NO: 1538269 - RNA, 22 nt, Homo sapiens
gaccuucucuuaggacaguaaa

SEQ ID NO: 1538270 - RNA, 14 nt, Homo sapiens
gaccuuugucugaa

SEQ ID NO: 1538271 - RNA, 14 nt, Homo sapiens
gacgcaugcagggc

SEQ ID NO: 1538272 - RNA, 20 nt, Homo sapiens
gacucaaagagggagugcau

SEQ ID NO: 1538273 - RNA, 22 nt, Homo sapiens
gacucaauguggaaaaaauauu

SEQ ID NO: 1538274 - RNA, 15 nt, Homo sapiens
gacucugccuuccag

SEQ ID NO: 1538275 - RNA, 15 nt, Homo sapiens
gacuucucuagacau

SEQ ID NO: 1538276 - RNA, 20 nt, Homo sapiens
gacuucuuuacuaacacugg

SEQ ID NO: 1538277 - RNA, 12 nt, Homo sapiens
gacuuggcagua

SEQ ID NO: 1538278 - RNA, 13 nt, Homo sapiens
gacuuugcugauu

SEQ ID NO: 1538279 - RNA, 13 nt, Homo sapiens
gagaaaagccaga

SEQ ID NO: 1538280 - RNA, 23 nt, Homo sapiens
gagaaccucguugacaugcacag

SEQ ID NO: 1538281 - RNA, 20 nt, Homo sapiens
gagaagagaguauggugcug

SEQ ID NO: 1538282 - RNA, 21 nt, Homo sapiens
gagaagugccccugcugccuc

SEQ ID NO: 1538283 - RNA, 11 nt, Homo sapiens
gagacacaucu

SEQ ID NO: 1538284 - RNA, 15 nt, Homo sapiens
gagacagucaggaag

SEQ ID NO: 1538285 - RNA, 18 nt, Homo sapiens
gagacaguugguuuugca

SEQ ID NO: 1538286 - RNA, 21 nt, Homo sapiens
gagacauacaccuaugucauu

SEQ ID NO: 1538287 - RNA, 21 nt, Homo sapiens
gagaccaacuacgacuggcau

SEQ ID NO: 1538288 - RNA, 14 nt, Homo sapiens
gagacuauguguca

SEQ ID NO: 1538289 - RNA, 17 nt, Homo sapiens
gagacuggauacugccc

SEQ ID NO: 1538290 - RNA, 15 nt, Homo sapiens
gagacuuaggccaga

SEQ ID NO: 1538291 - RNA, 18 nt, Homo sapiens
gagagcccucugcugcuu

SEQ ID NO: 1538292 - RNA, 15 nt, Homo sapiens
gagaugcagugccag

SEQ ID NO: 1538293 - RNA, 18 nt, Homo sapiens
gagauucuugugccucag

SEQ ID NO: 1538294 - RNA, 23 nt, Homo sapiens
gagauugcucuggggcuugcuau

SEQ ID NO: 1538295 - RNA, 16 nt, Homo sapiens
gagauuggcuuugccu

SEQ ID NO: 1538296 - RNA, 16 nt, Homo sapiens
gagauuugccaaaaac

SEQ ID NO: 1538297 - RNA, 18 nt, Homo sapiens
gagcaguugaccuuugcc

SEQ ID NO: 1538298 - RNA, 20 nt, Homo sapiens
gagcaugaagauaaauccaa

SEQ ID NO: 1538299 - RNA, 15 nt, Homo sapiens
gagcaugagccagcu

SEQ ID NO: 1538300 - RNA, 16 nt, Homo sapiens
gagccagggcuguccu

SEQ ID NO: 1538301 - RNA, 14 nt, Homo sapiens
gagcccccuguccu

SEQ ID NO: 1538302 - RNA, 20 nt, Homo sapiens
gagccuuaguuucagcugac

SEQ ID NO: 1538303 - RNA, 23 nt, Homo sapiens
gagccuuuccagaacuaccaaaa

SEQ ID NO: 1538304 - RNA, 19 nt, Homo sapiens
gagcgccccucccuaguga

SEQ ID NO: 1538305 - RNA, 14 nt, Homo sapiens
gagcguguacuacc

SEQ ID NO: 1538306 - RNA, 11 nt, Homo sapiens
gagcucaccag

SEQ ID NO: 1538307 - RNA, 14 nt, Homo sapiens
gagcugggggccau

SEQ ID NO: 1538308 - RNA, 16 nt, Homo sapiens
gagcugggggccauga

SEQ ID NO: 1538309 - RNA, 18 nt, Homo sapiens
gagcuugacuucaugcca

SEQ ID NO: 1538310 - RNA, 13 nt, Homo sapiens
gagcuuggccaga

SEQ ID NO: 1538311 - RNA, 17 nt, Homo sapiens
gaggaaaauaguggcag

SEQ ID NO: 1538312 - RNA, 16 nt, Homo sapiens
gaggaacugguccagg

SEQ ID NO: 1538313 - RNA, 22 nt, Homo sapiens
gaggaagggacugguccaggca

SEQ ID NO: 1538314 - RNA, 15 nt, Homo sapiens
gaggaggauccgggc

SEQ ID NO: 1538315 - RNA, 19 nt, Homo sapiens
gaggagggggcccggcugg

SEQ ID NO: 1538316 - RNA, 20 nt, Homo sapiens
gaggcaaccuguugaauuua

SEQ ID NO: 1538317 - RNA, 14 nt, Homo sapiens
gaggcagaggacag

SEQ ID NO: 1538318 - RNA, 16 nt, Homo sapiens
gaggcaguggcagcaa

SEQ ID NO: 1538319 - RNA, 20 nt, Homo sapiens
gaggcauucccagaauuugc

SEQ ID NO: 1538320 - RNA, 19 nt, Homo sapiens
gaggcgugggauccagaga

SEQ ID NO: 1538321 - RNA, 17 nt, Homo sapiens
gagggacuuugcugauu

SEQ ID NO: 1538322 - RNA, 15 nt, Homo sapiens
gaggggcggggccag

SEQ ID NO: 1538323 - RNA, 16 nt, Homo sapiens
gaggggcggggccagg

SEQ ID NO: 1538324 - RNA, 12 nt, Homo sapiens
gaggguuuccac

SEQ ID NO: 1538325 - RNA, 13 nt, Homo sapiens
gaguaaaaccaaa

SEQ ID NO: 1538326 - RNA, 13 nt, Homo sapiens
gaguagauugauu

SEQ ID NO: 1538327 - RNA, 23 nt, Homo sapiens
gaguauggauugaaggauuguga

SEQ ID NO: 1538328 - RNA, 13 nt, Homo sapiens
gaguauggugcug

SEQ ID NO: 1538329 - RNA, 22 nt, Homo sapiens
gaguauggugcuggguccuuaa

SEQ ID NO: 1538330 - RNA, 17 nt, Homo sapiens
gagucucuucuccacug

SEQ ID NO: 1538331 - RNA, 22 nt, Homo sapiens
gagucuuaauauauauauccag

SEQ ID NO: 1538332 - RNA, 18 nt, Homo sapiens
gaguuccggaaagccuuc

SEQ ID NO: 1538333 - RNA, 20 nt, Homo sapiens
gaguuguuuaaacagucaaa

SEQ ID NO: 1538334 - RNA, 20 nt, Homo sapiens
gaguuuccagcuaagccuga

SEQ ID NO: 1538335 - RNA, 21 nt, Homo sapiens
gauaaagugccuauaaaggaa

SEQ ID NO: 1538336 - RNA, 20 nt, Homo sapiens
gauaaaucaguuaugucaau

SEQ ID NO: 1538337 - RNA, 13 nt, Homo sapiens
gauaaauguccau

SEQ ID NO: 1538338 - RNA, 11 nt, Homo sapiens
gauaaugccuu

SEQ ID NO: 1538339 - RNA, 13 nt, Homo sapiens
gauacaguauuau

SEQ ID NO: 1538340 - RNA, 22 nt, Homo sapiens
gauaccauuuuauauuucauca

SEQ ID NO: 1538341 - RNA, 14 nt, Homo sapiens
gauagauaaugccu

SEQ ID NO: 1538342 - RNA, 19 nt, Homo sapiens
gauagauauccuuggcaca

SEQ ID NO: 1538343 - RNA, 20 nt, Homo sapiens
gauagaucuuggcccuguua

SEQ ID NO: 1538344 - RNA, 15 nt, Homo sapiens
gaucaacucauguua

SEQ ID NO: 1538345 - RNA, 14 nt, Homo sapiens
gaucaagcuccauc

SEQ ID NO: 1538346 - RNA, 18 nt, Homo sapiens
gaucauugguaucugaua

SEQ ID NO: 1538347 - RNA, 21 nt, Homo sapiens
gaucccuaaagaaaacaaaca

SEQ ID NO: 1538348 - RNA, 17 nt, Homo sapiens
gauccucaaaaaucauc

SEQ ID NO: 1538349 - RNA, 18 nt, Homo sapiens
gauccugucuugcugagg

SEQ ID NO: 1538350 - RNA, 21 nt, Homo sapiens
gaucuaaaaggaggacaggga

SEQ ID NO: 1538351 - RNA, 15 nt, Homo sapiens
gaucuauaccaccuu

SEQ ID NO: 1538352 - RNA, 19 nt, Homo sapiens
gaucuugagcaaggcaaga

SEQ ID NO: 1538353 - RNA, 18 nt, Homo sapiens
gaucuuuuugcagacuag

SEQ ID NO: 1538354 - RNA, 21 nt, Homo sapiens
gaugcugccaggggcagugaa

SEQ ID NO: 1538355 - RNA, 15 nt, Homo sapiens
gaugcuggucauccu

SEQ ID NO: 1538356 - RNA, 18 nt, Homo sapiens
gaugggaguaagagcaaa

SEQ ID NO: 1538357 - RNA, 16 nt, Homo sapiens
gaugggaucauuauuu

SEQ ID NO: 1538358 - RNA, 19 nt, Homo sapiens
gaugggguugggcucugcg

SEQ ID NO: 1538359 - RNA, 15 nt, Homo sapiens
gauguauuaugcaaa

SEQ ID NO: 1538360 - RNA, 13 nt, Homo sapiens
gaugugacaggaa

SEQ ID NO: 1538361 - RNA, 16 nt, Homo sapiens
gaugugccuagacacg

SEQ ID NO: 1538362 - RNA, 21 nt, Homo sapiens
gauguggauggaggugaugaa

SEQ ID NO: 1538363 - RNA, 19 nt, Homo sapiens
gauguggugggagcacagc

SEQ ID NO: 1538364 - RNA, 18 nt, Homo sapiens
gauucaucaucccuuaau

SEQ ID NO: 1538365 - RNA, 20 nt, Homo sapiens
gauucauuuuaacaucugag

SEQ ID NO: 1538366 - RNA, 19 nt, Homo sapiens
gauucccuguucuuugaag

SEQ ID NO: 1538367 - RNA, 16 nt, Homo sapiens
gauucuuccaucugau

SEQ ID NO: 1538368 - RNA, 16 nt, Homo sapiens
gauugauuaaugaacu

SEQ ID NO: 1538369 - RNA, 15 nt, Homo sapiens
gauugguucaugccu

SEQ ID NO: 1538370 - RNA, 21 nt, Homo sapiens
gauuuacgcucauuguagaaa

SEQ ID NO: 1538371 - RNA, 14 nt, Homo sapiens
gauuuccauuugca

SEQ ID NO: 1538372 - RNA, 17 nt, Homo sapiens
gauuugcaacuuuagaa

SEQ ID NO: 1538373 - RNA, 14 nt, Homo sapiens
gauuugccaaaaac

SEQ ID NO: 1538374 - RNA, 23 nt, Homo sapiens
gauuuguauuuauauuagagugc

SEQ ID NO: 1538375 - RNA, 15 nt, Homo sapiens
gauuuuaaaugcugu

SEQ ID NO: 1538376 - RNA, 20 nt, Homo sapiens
gauuuuauuuucaagcaaau

SEQ ID NO: 1538377 - RNA, 14 nt, Homo sapiens
gcaaauaaauauca

SEQ ID NO: 1538378 - RNA, 19 nt, Homo sapiens
gcaaccucggggagugcca

SEQ ID NO: 1538379 - RNA, 16 nt, Homo sapiens
gcaacggggaggccaa

SEQ ID NO: 1538380 - RNA, 19 nt, Homo sapiens
gcaagaagugggauucagg

SEQ ID NO: 1538381 - RNA, 18 nt, Homo sapiens
gcaagggaaugaauccau

SEQ ID NO: 1538382 - RNA, 17 nt, Homo sapiens
gcaauaaacucagucaa

SEQ ID NO: 1538383 - RNA, 13 nt, Homo sapiens
gcaauaauugaca

SEQ ID NO: 1538384 - RNA, 15 nt, Homo sapiens
gcaauaauugacaaa

SEQ ID NO: 1538385 - RNA, 15 nt, Homo sapiens
gcaaucuaugacuca

SEQ ID NO: 1538386 - RNA, 16 nt, Homo sapiens
gcacaccccugcacac

SEQ ID NO: 1538387 - RNA, 18 nt, Homo sapiens
gcacacccucucugucca

SEQ ID NO: 1538388 - RNA, 19 nt, Homo sapiens
gcacagagagcggcuuccc

SEQ ID NO: 1538389 - RNA, 20 nt, Homo sapiens
gcacagaggauggcuucccc

SEQ ID NO: 1538390 - RNA, 23 nt, Homo sapiens
uaauaaagaaauaauacccugcc

SEQ ID NO: 1538391 - RNA, 16 nt, Homo sapiens
uaauaucuuucaguua

SEQ ID NO: 1538392 - RNA, 20 nt, Homo sapiens
uaaucucuaaaauucuaguc

SEQ ID NO: 1538393 - RNA, 17 nt, Homo sapiens
uaaucugaaacacaguc

SEQ ID NO: 1538394 - RNA, 14 nt, Homo sapiens
uaauggaaacuguc

SEQ ID NO: 1538395 - RNA, 21 nt, Homo sapiens
uaauuaaaaaguuaaucuuca

SEQ ID NO: 1538396 - RNA, 15 nt, Homo sapiens
uaauugcaagggaag

SEQ ID NO: 1538397 - RNA, 19 nt, Homo sapiens
uaauuguauaaaacagugu

SEQ ID NO: 1538398 - RNA, 17 nt, Homo sapiens
uaauuucuuacuaaaca

SEQ ID NO: 1538399 - RNA, 15 nt, Homo sapiens
uacaauaaagcaaug

SEQ ID NO: 1538400 - RNA, 20 nt, Homo sapiens
uacaauaauucuaugagaua

SEQ ID NO: 1538401 - RNA, 13 nt, Homo sapiens
uacacaugaucau

SEQ ID NO: 1538402 - RNA, 18 nt, Homo sapiens
uacacucaagcaugaaga

SEQ ID NO: 1538403 - RNA, 18 nt, Homo sapiens
uacagauuuaguuuacca

SEQ ID NO: 1538404 - RNA, 16 nt, Homo sapiens
uacauaaaaaagggac

SEQ ID NO: 1538405 - RNA, 13 nt, Homo sapiens
uacauaacuaaua

SEQ ID NO: 1538406 - RNA, 15 nt, Homo sapiens
uacaugccuuuccag

SEQ ID NO: 1538407 - RNA, 14 nt, Homo sapiens
uacauggguucaau

SEQ ID NO: 1538408 - RNA, 16 nt, Homo sapiens
uacaugugauugugau

SEQ ID NO: 1538409 - RNA, 23 nt, Homo sapiens
uacaugugauugugauucaucau

SEQ ID NO: 1538410 - RNA, 22 nt, Homo sapiens
uaccaccaagaggaaaauauug

SEQ ID NO: 1538411 - RNA, 17 nt, Homo sapiens
uacccaaugcaguuugg

SEQ ID NO: 1538412 - RNA, 18 nt, Homo sapiens
uaccccagaacgcaugca

SEQ ID NO: 1538413 - RNA, 20 nt, Homo sapiens
uaccucugaucaaagcaccu

SEQ ID NO: 1538414 - RNA, 17 nt, Homo sapiens
uaccuguaauagccuca

SEQ ID NO: 1538415 - RNA, 14 nt, Homo sapiens
uacgcucucugucu

SEQ ID NO: 1538416 - RNA, 12 nt, Homo sapiens
uacuaaauauga

SEQ ID NO: 1538417 - RNA, 12 nt, Homo sapiens
uacuaccccaga

SEQ ID NO: 1538418 - RNA, 20 nt, Homo sapiens
uacuaccccagaacgcaugc

SEQ ID NO: 1538419 - RNA, 22 nt, Homo sapiens
uacuaccccaggaugcaugcag

SEQ ID NO: 1538420 - RNA, 21 nt, Homo sapiens
uacucacccagggacuccagu

SEQ ID NO: 1538421 - RNA, 14 nt, Homo sapiens
uacugauuaacuca

SEQ ID NO: 1538422 - RNA, 21 nt, Homo sapiens
uacuguaugccggcuccuuca

SEQ ID NO: 1538423 - RNA, 12 nt, Homo sapiens
uacuguccuguu

SEQ ID NO: 1538424 - RNA, 16 nt, Homo sapiens
uacuucuuuuucauua

SEQ ID NO: 1538425 - RNA, 22 nt, Homo sapiens
uagaaacugaggccauuauuuc

SEQ ID NO: 1538426 - RNA, 16 nt, Homo sapiens
uagaacuccaguacuc

SEQ ID NO: 1538427 - RNA, 17 nt, Homo sapiens
uagaaucaagucuguga

SEQ ID NO: 1538428 - RNA, 18 nt, Homo sapiens
uagaaucaagucugugaa

SEQ ID NO: 1538429 - RNA, 17 nt, Homo sapiens
uagaauggggcuuccau

SEQ ID NO: 1538430 - RNA, 18 nt, Homo sapiens
uagaauguuucauuugca

SEQ ID NO: 1538431 - RNA, 20 nt, Homo sapiens
uagacaucccccuccuugcc

SEQ ID NO: 1538432 - RNA, 17 nt, Homo sapiens
uagacuuagccccauga

SEQ ID NO: 1538433 - RNA, 13 nt, Homo sapiens
uagagacuguaaa

SEQ ID NO: 1538434 - RNA, 14 nt, Homo sapiens
uagagacuguaaau

SEQ ID NO: 1538435 - RNA, 12 nt, Homo sapiens
uagagugcauau

SEQ ID NO: 1538436 - RNA, 13 nt, Homo sapiens
uagaucuccugua

SEQ ID NO: 1538437 - RNA, 14 nt, Homo sapiens
uagauuaacccuau

SEQ ID NO: 1538438 - RNA, 21 nt, Homo sapiens
uagcaaagauaucucaucucu

SEQ ID NO: 1538439 - RNA, 18 nt, Homo sapiens
uagcacuuuauaagccaa

SEQ ID NO: 1538440 - RNA, 13 nt, Homo sapiens
uagcccacugccu

SEQ ID NO: 1538441 - RNA, 13 nt, Homo sapiens
uagcucgugugcu

SEQ ID NO: 1538442 - RNA, 22 nt, Homo sapiens
uagcuggagagagaguucucac

SEQ ID NO: 1538443 - RNA, 16 nt, Homo sapiens
uagcuuacugauuaac

SEQ ID NO: 1538444 - RNA, 21 nt, Homo sapiens
uaggaaaaguuauugugauaa

SEQ ID NO: 1538445 - RNA, 20 nt, Homo sapiens
uaggaaagugccugcuuuua

SEQ ID NO: 1538446 - RNA, 16 nt, Homo sapiens
uagggcucuaauuucc

SEQ ID NO: 1538447 - RNA, 21 nt, Homo sapiens
uagguaaguuggcucacauca

SEQ ID NO: 1538448 - RNA, 20 nt, Homo sapiens
uagguuaauaggaggacaga

SEQ ID NO: 1538449 - RNA, 20 nt, Homo sapiens
uaguccccagccugcucccu

SEQ ID NO: 1538450 - RNA, 16 nt, Homo sapiens
uagugucccuuaccug

SEQ ID NO: 1538451 - RNA, 19 nt, Homo sapiens
uaguguuuugcaagggaau

SEQ ID NO: 1538452 - RNA, 19 nt, Homo sapiens
uaguuaauuguggcuuuau

SEQ ID NO: 1538453 - RNA, 14 nt, Homo sapiens
uauaaaacaguguu

SEQ ID NO: 1538454 - RNA, 20 nt, Homo sapiens
uauaauuuuauugcuggaau

SEQ ID NO: 1538455 - RNA, 22 nt, Homo sapiens
uauaucuguaaauuuaacugca

SEQ ID NO: 1538456 - RNA, 17 nt, Homo sapiens
uauaucuguggucuuca

SEQ ID NO: 1538457 - RNA, 17 nt, Homo sapiens
uauauuuccacuucuuc

SEQ ID NO: 1538458 - RNA, 22 nt, Homo sapiens
uauauuugugugaaaaugugac

SEQ ID NO: 1538459 - RNA, 23 nt, Homo sapiens
uauauuuuaucuugguaguacau

SEQ ID NO: 1538460 - RNA, 18 nt, Homo sapiens
uaucaaaaugaaugccag

SEQ ID NO: 1538461 - RNA, 15 nt, Homo sapiens
uaucauuaaccuuau

SEQ ID NO: 1538462 - RNA, 22 nt, Homo sapiens
uauccaagaccuuacaaccaca

SEQ ID NO: 1538463 - RNA, 18 nt, Homo sapiens
uauccacuacauucugaa

SEQ ID NO: 1538464 - RNA, 15 nt, Homo sapiens
uauccuauacugguu

SEQ ID NO: 1538465 - RNA, 22 nt, Homo sapiens
uauccuggugucuaguuugcau

SEQ ID NO: 1538466 - RNA, 20 nt, Homo sapiens
uaugaauaaauauuacaaau

SEQ ID NO: 1538467 - RNA, 20 nt, Homo sapiens
uaugaggggacugcaugcaa

SEQ ID NO: 1538468 - RNA, 20 nt, Homo sapiens
uaugagucucuaugaucuug

SEQ ID NO: 1538469 - RNA, 20 nt, Homo sapiens
uaugauaaauuugacuguua

SEQ ID NO: 1538470 - RNA, 20 nt, Homo sapiens
uaugauggguguuuuuagca

SEQ ID NO: 1538471 - RNA, 17 nt, Homo sapiens
uaugccggcuccuucaa

SEQ ID NO: 1538472 - RNA, 21 nt, Homo sapiens
uaugcguaaaucaacuuguca

SEQ ID NO: 1538473 - RNA, 22 nt, Homo sapiens
uauggaaauccuguuacuuaaa

SEQ ID NO: 1538474 - RNA, 17 nt, Homo sapiens
uauggauugaaggauug

SEQ ID NO: 1538475 - RNA, 20 nt, Homo sapiens
uauggauugaaggauuguga

SEQ ID NO: 1538476 - RNA, 16 nt, Homo sapiens
uauguaguaugcuaug

SEQ ID NO: 1538477 - RNA, 18 nt, Homo sapiens
uauguauaacaagccaaa

SEQ ID NO: 1538478 - RNA, 15 nt, Homo sapiens
uaugucaguccaaua

SEQ ID NO: 1538479 - RNA, 14 nt, Homo sapiens
uauuauguccugug

SEQ ID NO: 1538480 - RNA, 18 nt, Homo sapiens
uauuauuguugcauuaaa

SEQ ID NO: 1538481 - RNA, 15 nt, Homo sapiens
uauucacaguaucug

SEQ ID NO: 1538482 - RNA, 18 nt, Homo sapiens
uauucauuagcugugauu

SEQ ID NO: 1538483 - RNA, 14 nt, Homo sapiens
uauuccuaugcugc

SEQ ID NO: 1538484 - RNA, 22 nt, Homo sapiens
uauugaacuguaaauaugucac

SEQ ID NO: 1538485 - RNA, 20 nt, Homo sapiens
uauugcccuuuaacaagacu

SEQ ID NO: 1538486 - RNA, 17 nt, Homo sapiens
uauugcugaaugcaaga

SEQ ID NO: 1538487 - RNA, 22 nt, Homo sapiens
uauuguuaaaaccuuacuuaaa

SEQ ID NO: 1538488 - RNA, 21 nt, Homo sapiens
uauuuaaaaaaaaacauucaa

SEQ ID NO: 1538489 - RNA, 16 nt, Homo sapiens
uauuucagacacuaug

SEQ ID NO: 1538490 - RNA, 14 nt, Homo sapiens
uauuucauaaacaa

SEQ ID NO: 1538491 - RNA, 16 nt, Homo sapiens
uauuuuggacguguga

SEQ ID NO: 1538492 - RNA, 17 nt, Homo sapiens
uauuuuuccucuuucac

SEQ ID NO: 1538493 - RNA, 15 nt, Homo sapiens
ucaaacagaaaagaa

SEQ ID NO: 1538494 - RNA, 20 nt, Homo sapiens
ucaaacagggacacuacaaa

SEQ ID NO: 1538495 - RNA, 18 nt, Homo sapiens
ucaaaccuccaaaagccc

SEQ ID NO: 1538496 - RNA, 21 nt, Homo sapiens
ucaaagagggagugcauuuau

SEQ ID NO: 1538497 - RNA, 14 nt, Homo sapiens
ucaaagcacuguuu

SEQ ID NO: 1538498 - RNA, 21 nt, Homo sapiens
ucaaaguccaacuacagccaa

SEQ ID NO: 1538499 - RNA, 21 nt, Homo sapiens
ucaaaugaauaaugccuuugu

SEQ ID NO: 1538500 - RNA, 14 nt, Homo sapiens
ucaaaugaguuuaa

SEQ ID NO: 1538501 - RNA, 14 nt, Homo sapiens
ucaaaugcaugaua

SEQ ID NO: 1538502 - RNA, 15 nt, Homo sapiens
ucaaccgcuugccau

SEQ ID NO: 1538503 - RNA, 16 nt, Homo sapiens
ucaaccgcuugccaua

SEQ ID NO: 1538504 - RNA, 17 nt, Homo sapiens
ucaaccgcuugccauau

SEQ ID NO: 1538505 - RNA, 14 nt, Homo sapiens
ucaacuucaggaaa

SEQ ID NO: 1538506 - RNA, 20 nt, Homo sapiens
ucaagagggggcaagucaca

SEQ ID NO: 1538507 - RNA, 12 nt, Homo sapiens
ucaagccaggag

SEQ ID NO: 1538508 - RNA, 15 nt, Homo sapiens
ucaaucaaacaggga

SEQ ID NO: 1538509 - RNA, 21 nt, Homo sapiens
ucacaaagugagaaauuauga

SEQ ID NO: 1538510 - RNA, 12 nt, Homo sapiens
ucacauguccua

SEQ ID NO: 1538511 - RNA, 17 nt, Homo sapiens
ucaccaccgagacaguu

SEQ ID NO: 1538512 - RNA, 22 nt, Homo sapiens
ucaccaggaagaaggcccggga

SEQ ID NO: 1538513 - RNA, 15 nt, Homo sapiens
ucacccccacacugg

SEQ ID NO: 1538514 - RNA, 17 nt, Homo sapiens
ucaccuaauuaauuuca

SEQ ID NO: 1538515 - RNA, 18 nt, Homo sapiens
ucaccuggcuucccagga

SEQ ID NO: 1538516 - RNA, 17 nt, Homo sapiens
ucaccuugcucugccau

SEQ ID NO: 1538517 - RNA, 18 nt, Homo sapiens
ucacggcugcaccugcag

SEQ ID NO: 1538518 - RNA, 23 nt, Homo sapiens
ucacgugucuuuagaacuccagu

SEQ ID NO: 1538519 - RNA, 19 nt, Homo sapiens
ucacuucgaugacuggaua

SEQ ID NO: 1538520 - RNA, 16 nt, Homo sapiens
uuauggcagacauugu

SEQ ID NO: 1538521 - RNA, 18 nt, Homo sapiens
uuauguguugaugacuca

SEQ ID NO: 1538522 - RNA, 17 nt, Homo sapiens
uuauucauuagcuguga

SEQ ID NO: 1538523 - RNA, 12 nt, Homo sapiens
uuauucuaguca

SEQ ID NO: 1538524 - RNA, 19 nt, Homo sapiens
uuauugcuggaaucuacua

SEQ ID NO: 1538525 - RNA, 16 nt, Homo sapiens
uuauuuacaugugauu

SEQ ID NO: 1538526 - RNA, 13 nt, Homo sapiens
uuauuuccaugga

SEQ ID NO: 1538527 - RNA, 14 nt, Homo sapiens
uuauuuccauggau

SEQ ID NO: 1538528 - RNA, 14 nt, Homo sapiens
uucaaaaugcaugu

SEQ ID NO: 1538529 - RNA, 17 nt, Homo sapiens
uucaaaaugcaugugau

SEQ ID NO: 1538530 - RNA, 15 nt, Homo sapiens
uucaagacucaaugu

SEQ ID NO: 1538531 - RNA, 20 nt, Homo sapiens
uucaagccuggcccagugag

SEQ ID NO: 1538532 - RNA, 19 nt, Homo sapiens
uucacccaaaacaaaguaa

SEQ ID NO: 1538533 - RNA, 14 nt, Homo sapiens
uucagaaagggcag

SEQ ID NO: 1538534 - RNA, 13 nt, Homo sapiens
uucagagauguac

SEQ ID NO: 1538535 - RNA, 19 nt, Homo sapiens
uucaguaaacaccaugaag

SEQ ID NO: 1538536 - RNA, 14 nt, Homo sapiens
uucaguacuuguga

SEQ ID NO: 1538537 - RNA, 23 nt, Homo sapiens
uucaguacuugugaaacacagcu

SEQ ID NO: 1538538 - RNA, 14 nt, Homo sapiens
uucauauucucaga

SEQ ID NO: 1538539 - RNA, 20 nt, Homo sapiens
uucauauucucagaugggcu

SEQ ID NO: 1538540 - RNA, 20 nt, Homo sapiens
uucauggcuuuaacaguaau

SEQ ID NO: 1538541 - RNA, 18 nt, Homo sapiens
uucauuuuaacaucugag

SEQ ID NO: 1538542 - RNA, 14 nt, Homo sapiens
uucauuuugcaacu

SEQ ID NO: 1538543 - RNA, 14 nt, Homo sapiens
uuccaacacacaau

SEQ ID NO: 1538544 - RNA, 21 nt, Homo sapiens
uuccaacuugucacuugccag

SEQ ID NO: 1538545 - RNA, 16 nt, Homo sapiens
uuccaagccugggcca

SEQ ID NO: 1538546 - RNA, 10 nt, Homo sapiens
uuccagacag

SEQ ID NO: 1538547 - RNA, 13 nt, Homo sapiens
uuccagugcugcu

SEQ ID NO: 1538548 - RNA, 23 nt, Homo sapiens
uuccaugucugaaguuugcccca

SEQ ID NO: 1538549 - RNA, 22 nt, Homo sapiens
uuccauuuguagguagugagac

SEQ ID NO: 1538550 - RNA, 15 nt, Homo sapiens
uucccacuuugccac

SEQ ID NO: 1538551 - RNA, 19 nt, Homo sapiens
uucccucuggcacuccaga

SEQ ID NO: 1538552 - RNA, 17 nt, Homo sapiens
uuccggaaagccuuccu

SEQ ID NO: 1538553 - RNA, 22 nt, Homo sapiens
uuccuaugcugcaauacauuaa

SEQ ID NO: 1538554 - RNA, 19 nt, Homo sapiens
uuccucaugaaucucucaa

SEQ ID NO: 1538555 - RNA, 13 nt, Homo sapiens
uuccucccauuca

SEQ ID NO: 1538556 - RNA, 21 nt, Homo sapiens
uuccuccuaaauuuccagggg

SEQ ID NO: 1538557 - RNA, 16 nt, Homo sapiens
uuccucuuaccuguaa

SEQ ID NO: 1538558 - RNA, 15 nt, Homo sapiens
uuccugauguugaua

SEQ ID NO: 1538559 - RNA, 15 nt, Homo sapiens
uuccuguccagagag

SEQ ID NO: 1538560 - RNA, 14 nt, Homo sapiens
uuccuuuaauccca

SEQ ID NO: 1538561 - RNA, 12 nt, Homo sapiens
uucgccaugugc

SEQ ID NO: 1538562 - RNA, 21 nt, Homo sapiens
uucguccuuagaauacuguau

SEQ ID NO: 1538563 - RNA, 16 nt, Homo sapiens
uucuaagaaauaucug

SEQ ID NO: 1538564 - RNA, 19 nt, Homo sapiens
uucuaagaaauaucuguga

SEQ ID NO: 1538565 - RNA, 16 nt, Homo sapiens
uucuaauuggcaugaa

SEQ ID NO: 1538566 - RNA, 11 nt, Homo sapiens
uucuauacugu

SEQ ID NO: 1538567 - RNA, 16 nt, Homo sapiens
uucucaaucuauguga

SEQ ID NO: 1538568 - RNA, 16 nt, Homo sapiens
uucucaugcacugcaa

SEQ ID NO: 1538569 - RNA, 11 nt, Homo sapiens
uucuccacugg

SEQ ID NO: 1538570 - RNA, 17 nt, Homo sapiens
uucucuuuucaaacaca

SEQ ID NO: 1538571 - RNA, 14 nt, Homo sapiens
uucugaagaucuca

SEQ ID NO: 1538572 - RNA, 23 nt, Homo sapiens
uucugaccccacuuaugcugcug

SEQ ID NO: 1538573 - RNA, 22 nt, Homo sapiens
uucugauuugaagguauaaccu

SEQ ID NO: 1538574 - RNA, 13 nt, Homo sapiens
uucugcaauucaa

SEQ ID NO: 1538575 - RNA, 13 nt, Homo sapiens
uucugccuaagcc

SEQ ID NO: 1538576 - RNA, 20 nt, Homo sapiens
uucuggacccguucaacuuu

SEQ ID NO: 1538577 - RNA, 20 nt, Homo sapiens
uucuguaauauuuacaaugu

SEQ ID NO: 1538578 - RNA, 14 nt, Homo sapiens
uucuuccaucugau

SEQ ID NO: 1538579 - RNA, 16 nt, Homo sapiens
uucuucccuuaggcaa

SEQ ID NO: 1538580 - RNA, 21 nt, Homo sapiens
uucuuggaucuuuuugcagac

SEQ ID NO: 1538581 - RNA, 17 nt, Homo sapiens
uucuuugcauucguccu

SEQ ID NO: 1538582 - RNA, 15 nt, Homo sapiens
uucuuuuaaaccauu

SEQ ID NO: 1538583 - RNA, 16 nt, Homo sapiens
uucuuuuaaaccauuu

SEQ ID NO: 1538584 - RNA, 16 nt, Homo sapiens
uugaaacugcauuugu

SEQ ID NO: 1538585 - RNA, 14 nt, Homo sapiens
uugacuucaugcca

SEQ ID NO: 1538586 - RNA, 17 nt, Homo sapiens
uugacuucgacugugac

SEQ ID NO: 1538587 - RNA, 14 nt, Homo sapiens
uugagcgacaucuc

SEQ ID NO: 1538588 - RNA, 17 nt, Homo sapiens
uugaugcuguuucuaca

SEQ ID NO: 1538589 - RNA, 14 nt, Homo sapiens
uugauuaaaacauu

SEQ ID NO: 1538590 - RNA, 14 nt, Homo sapiens
uugauuaaugaacu

SEQ ID NO: 1538591 - RNA, 21 nt, Homo sapiens
uugcaaccacugcaauaucuu

SEQ ID NO: 1538592 - RNA, 16 nt, Homo sapiens
uugcacagcaucucag

SEQ ID NO: 1538593 - RNA, 18 nt, Homo sapiens
uugcauuaaaaaugcaua

SEQ ID NO: 1538594 - RNA, 18 nt, Homo sapiens
uugccaugucuuguucag

SEQ ID NO: 1538595 - RNA, 23 nt, Homo sapiens
uugcuaacauauuuaaagucuug

SEQ ID NO: 1538596 - RNA, 23 nt, Homo sapiens
uugcugcccuggcuauggucaca

SEQ ID NO: 1538597 - RNA, 17 nt, Homo sapiens
uugcuucaagaaugugu

SEQ ID NO: 1538598 - RNA, 15 nt, Homo sapiens
uuggaagccccauaa

SEQ ID NO: 1538599 - RNA, 16 nt, Homo sapiens
uuggacauuuucuuca

SEQ ID NO: 1538600 - RNA, 13 nt, Homo sapiens
uuggaccaaaugg

SEQ ID NO: 1538601 - RNA, 13 nt, Homo sapiens
uuggcaugaaggu

SEQ ID NO: 1538602 - RNA, 13 nt, Homo sapiens
uuggccacacugu

SEQ ID NO: 1538603 - RNA, 23 nt, Homo sapiens
uuggccagaagggggccaugagg

SEQ ID NO: 1538604 - RNA, 20 nt, Homo sapiens
uuggcuaucuacugagacau

SEQ ID NO: 1538605 - RNA, 20 nt, Homo sapiens
uuggcucacaucauguaaua

SEQ ID NO: 1538606 - RNA, 22 nt, Homo sapiens
uuggcugcauaaaugugguaca

SEQ ID NO: 1538607 - RNA, 15 nt, Homo sapiens
uuggcuuaauuccaa

SEQ ID NO: 1538608 - RNA, 15 nt, Homo sapiens
uuguacauauggaaa

SEQ ID NO: 1538609 - RNA, 13 nt, Homo sapiens
uuguacucuugcu

SEQ ID NO: 1538610 - RNA, 14 nt, Homo sapiens
uugucaccaugauc

SEQ ID NO: 1538611 - RNA, 14 nt, Homo sapiens
uugucuggcugugg

SEQ ID NO: 1538612 - RNA, 19 nt, Homo sapiens
uuguuaaaaccuuacuuaa

SEQ ID NO: 1538613 - RNA, 15 nt, Homo sapiens
uuguuaauucuuccu

SEQ ID NO: 1538614 - RNA, 20 nt, Homo sapiens
uuguuacagguguacuaugg

SEQ ID NO: 1538615 - RNA, 15 nt, Homo sapiens
uuguugcaguucaga

SEQ ID NO: 1538616 - RNA, 19 nt, Homo sapiens
uuuaaaaaaaaacauucaa

SEQ ID NO: 1538617 - RNA, 15 nt, Homo sapiens
uuuaaaaaauaacau

SEQ ID NO: 1538618 - RNA, 14 nt, Homo sapiens
uuuaacuucaccuu

SEQ ID NO: 1538619 - RNA, 14 nt, Homo sapiens
uuuacaugaguuca

SEQ ID NO: 1538620 - RNA, 13 nt, Homo sapiens
uuuacaugugauu

SEQ ID NO: 1538621 - RNA, 18 nt, Homo sapiens
uuuacccaaugcaguuug

SEQ ID NO: 1538622 - RNA, 13 nt, Homo sapiens
uuuacuaacacug

SEQ ID NO: 1538623 - RNA, 23 nt, Homo sapiens
uuuagaacauggacuacacacaa

SEQ ID NO: 1538624 - RNA, 20 nt, Homo sapiens
uuuagaaucaagucugugaa

SEQ ID NO: 1538625 - RNA, 22 nt, Homo sapiens
uuuagacuuuuaacuucaccuu

SEQ ID NO: 1538626 - RNA, 13 nt, Homo sapiens
uuuagcguguaaa

SEQ ID NO: 1538627 - RNA, 12 nt, Homo sapiens
uuuaguccucac

SEQ ID NO: 1538628 - RNA, 23 nt, Homo sapiens
uuuagugacuaaaccauugugca

SEQ ID NO: 1538629 - RNA, 18 nt, Homo sapiens
uuuaguguuuugcaaggg

SEQ ID NO: 1538630 - RNA, 17 nt, Homo sapiens
uuuauaaaagacaugaa

SEQ ID NO: 1538631 - RNA, 23 nt, Homo sapiens
uuuaucagagucaugaugaauca

SEQ ID NO: 1538632 - RNA, 14 nt, Homo sapiens
uuuaugagcucuuc

SEQ ID NO: 1538633 - RNA, 15 nt, Homo sapiens
uuuauuucaauguaa

SEQ ID NO: 1538634 - RNA, 15 nt, Homo sapiens
uuucaaaaugcaugu

SEQ ID NO: 1538635 - RNA, 18 nt, Homo sapiens
uuucaaccgcuugccaua

SEQ ID NO: 1538636 - RNA, 16 nt, Homo sapiens
uuucacuauaauguga

SEQ ID NO: 1538637 - RNA, 16 nt, Homo sapiens
uuucaguucaaucaaa

SEQ ID NO: 1538638 - RNA, 21 nt, Homo sapiens
uuuccaaagguuucaacugua

SEQ ID NO: 1538639 - RNA, 18 nt, Homo sapiens
uuuccaaauacauuccag

SEQ ID NO: 1538640 - RNA, 14 nt, Homo sapiens
uuuccaacacacaa

SEQ ID NO: 1538641 - RNA, 20 nt, Homo sapiens
uuuccacuucuucauucucu

SEQ ID NO: 1538642 - RNA, 12 nt, Homo sapiens
uuuccagaauug

SEQ ID NO: 1538643 - RNA, 19 nt, Homo sapiens
uuuccagugacacaacuca

SEQ ID NO: 1538644 - RNA, 14 nt, Homo sapiens
uuuccauucugggu

SEQ ID NO: 1538645 - RNA, 11 nt, Homo sapiens
uuuccauuugc

SEQ ID NO: 1538646 - RNA, 18 nt, Homo sapiens
uuucccgcuccaagagaa

SEQ ID NO: 1538647 - RNA, 20 nt, Homo sapiens
uuuccugccuuuuaguuccu

SEQ ID NO: 1538648 - RNA, 18 nt, Homo sapiens
uuucuaauuggcaugaag

SEQ ID NO: 1538649 - RNA, 22 nt, Homo sapiens
uuucuccuuuuuuaugaugaca

SEQ ID NO: 1538650 - RNA, 18 nt, Homo sapiens
uuucugcuguaaagaaag

SEQ ID NO: 1538651 - RNA, 15 nt, Homo sapiens
uuaacggcacugugg

SEQ ID NO: 1538652 - RNA, 22 nt, Homo sapiens
uuaaucucuaaaauucuagucu

SEQ ID NO: 1538653 - RNA, 15 nt, Homo sapiens
uuaaugaaauaccaa

SEQ ID NO: 1538654 - RNA, 15 nt, Homo sapiens
uuaauggugccuuca

SEQ ID NO: 1538655 - RNA, 20 nt, Homo sapiens
uuaauuaagucaccuguaua

SEQ ID NO: 1538656 - RNA, 14 nt, Homo sapiens
uuacaacuccugca

SEQ ID NO: 1538657 - RNA, 23 nt, Homo sapiens
uuacaauaaaauuuugcaugugc

SEQ ID NO: 1538658 - RNA, 19 nt, Homo sapiens
uuacaauguaucaacauau

SEQ ID NO: 1538659 - RNA, 12 nt, Homo sapiens
uuacacauguau

SEQ ID NO: 1538660 - RNA, 12 nt, Homo sapiens
uuacaugauuca

SEQ ID NO: 1538661 - RNA, 14 nt, Homo sapiens
uuacaugauucauu

SEQ ID NO: 1538662 - RNA, 22 nt, Homo sapiens
uuacaugcauuacugcaugcac

SEQ ID NO: 1538663 - RNA, 12 nt, Homo sapiens
uuacaugugauu

SEQ ID NO: 1538664 - RNA, 16 nt, Homo sapiens
uuaccgugggcacuga

SEQ ID NO: 1538665 - RNA, 12 nt, Homo sapiens
uuacuacaugca

SEQ ID NO: 1538666 - RNA, 23 nt, Homo sapiens
uuacuauagcaaaguaguacuuc

SEQ ID NO: 1538667 - RNA, 16 nt, Homo sapiens
uuacugaugugugcaa

SEQ ID NO: 1538668 - RNA, 16 nt, Homo sapiens
uuacuuuauguuacua

SEQ ID NO: 1538669 - RNA, 14 nt, Homo sapiens
uuacuuugugcaau

SEQ ID NO: 1538670 - RNA, 23 nt, Homo sapiens
uuagaaaagacugaccuugaugu

SEQ ID NO: 1538671 - RNA, 23 nt, Homo sapiens
uuagaaauaaaccuuaauauuuc

SEQ ID NO: 1538672 - RNA, 21 nt, Homo sapiens
uuagaaguucgaaaacucagc

SEQ ID NO: 1538673 - RNA, 17 nt, Homo sapiens
uuagaauuaccauuugu

SEQ ID NO: 1538674 - RNA, 14 nt, Homo sapiens
uuagacaccuauca

SEQ ID NO: 1538675 - RNA, 17 nt, Homo sapiens
uuagacaccuaucagag

SEQ ID NO: 1538676 - RNA, 15 nt, Homo sapiens
uuagacauaccucuc

SEQ ID NO: 1538677 - RNA, 20 nt, Homo sapiens
uuagauauucauacuuucca

SEQ ID NO: 1538678 - RNA, 19 nt, Homo sapiens
uuagauuuuaaaacuucau

SEQ ID NO: 1538679 - RNA, 18 nt, Homo sapiens
uuagcaaagcaugccaau

SEQ ID NO: 1538680 - RNA, 16 nt, Homo sapiens
uuagcuuacugauuaa

SEQ ID NO: 1538681 - RNA, 20 nt, Homo sapiens
uuaguauuauuguugcauua

SEQ ID NO: 1538682 - RNA, 15 nt, Homo sapiens
uuauaucagaguaug

SEQ ID NO: 1538683 - RNA, 14 nt, Homo sapiens
uuaucaauaguucc

SEQ ID NO: 1538684 - RNA, 16 nt, Homo sapiens
uuauccugugugauua

SEQ ID NO: 1538685 - RNA, 12 nt, Homo sapiens
uuaugacuguuu

SEQ ID NO: 1538686 - RNA, 11 nt, Homo sapiens
uuaugcugcug

SEQ ID NO: 1538687 - RNA, 13 nt, Homo sapiens
uuauuccaacucc

SEQ ID NO: 1538688 - RNA, 15 nt, Homo sapiens
uuauugaaugugauu

SEQ ID NO: 1538689 - RNA, 20 nt, Homo sapiens
uuauugaauguuauaucauc

SEQ ID NO: 1538690 - RNA, 19 nt, Homo sapiens
uuauugggcaagugauuga

SEQ ID NO: 1538691 - RNA, 20 nt, Homo sapiens
uuauuuacaugugauuguga

SEQ ID NO: 1538692 - RNA, 14 nt, Homo sapiens
uuauuuauauauga

SEQ ID NO: 1538693 - RNA, 14 nt, Homo sapiens
uucaaagucucaau

SEQ ID NO: 1538694 - RNA, 16 nt, Homo sapiens
uucaaccuugagacag

SEQ ID NO: 1538695 - RNA, 21 nt, Homo sapiens
uucaacuaauacaugguuuaa

SEQ ID NO: 1538696 - RNA, 15 nt, Homo sapiens
uucaagaaugcagua

SEQ ID NO: 1538697 - RNA, 16 nt, Homo sapiens
uucaagagauucuugu

SEQ ID NO: 1538698 - RNA, 17 nt, Homo sapiens
uucaaggaagugauaac

SEQ ID NO: 1538699 - RNA, 20 nt, Homo sapiens
uucaaucuuaacaaaaguga

SEQ ID NO: 1538700 - RNA, 21 nt, Homo sapiens
uucacaaauauaguugaacaa

SEQ ID NO: 1538701 - RNA, 21 nt, Homo sapiens
uucacauauuuguagcuagaa

SEQ ID NO: 1538702 - RNA, 22 nt, Homo sapiens
uucaccaguuuccaaguuuauu

SEQ ID NO: 1538703 - RNA, 17 nt, Homo sapiens
uucacucccugucauag

SEQ ID NO: 1538704 - RNA, 17 nt, Homo sapiens
uucacuguccauuccaa

SEQ ID NO: 1538705 - RNA, 14 nt, Homo sapiens
cuuucaugauuugc

SEQ ID NO: 1538706 - RNA, 23 nt, Homo sapiens
cuuuccagacuucgcuauuccca

SEQ ID NO: 1538707 - RNA, 17 nt, Homo sapiens
cuuuccccgugggccau

SEQ ID NO: 1538708 - RNA, 15 nt, Homo sapiens
cuuucccgaugcgug

SEQ ID NO: 1538709 - RNA, 17 nt, Homo sapiens
cuuuccugauguugaua

SEQ ID NO: 1538710 - RNA, 17 nt, Homo sapiens
cuuuccuuucauccuca

SEQ ID NO: 1538711 - RNA, 20 nt, Homo sapiens
cuuucuuugagaaagacaau

SEQ ID NO: 1538712 - RNA, 14 nt, Homo sapiens
cuuugaaguggcac

SEQ ID NO: 1538713 - RNA, 15 nt, Homo sapiens
cuuugaaguggcacc

SEQ ID NO: 1538714 - RNA, 15 nt, Homo sapiens
cuuugcugauuuccc

SEQ ID NO: 1538715 - RNA, 17 nt, Homo sapiens
cuuuggcuucagaauug

SEQ ID NO: 1538716 - RNA, 21 nt, Homo sapiens
cuuugggggauucaaaugcau

SEQ ID NO: 1538717 - RNA, 23 nt, Homo sapiens
cuuugggggauucaaaugcauga

SEQ ID NO: 1538718 - RNA, 14 nt, Homo sapiens
cuuuguuuacauga

SEQ ID NO: 1538719 - RNA, 15 nt, Homo sapiens
cuuuguuuacaugag

SEQ ID NO: 1538720 - RNA, 19 nt, Homo sapiens
cuuuguuuacaugaguuca

SEQ ID NO: 1538721 - RNA, 21 nt, Homo sapiens
cuuuguuucauauucucagau

SEQ ID NO: 1538722 - RNA, 17 nt, Homo sapiens
cuuuuaacuucaccuua

SEQ ID NO: 1538723 - RNA, 14 nt, Homo sapiens
cuuuuaucucacaa

SEQ ID NO: 1538724 - RNA, 15 nt, Homo sapiens
cuuuuaucucacaaa

SEQ ID NO: 1538725 - RNA, 23 nt, Homo sapiens
cuuuucacugcuggcugccuuag

SEQ ID NO: 1538726 - RNA, 15 nt, Homo sapiens
cuuuucuccaugagu

SEQ ID NO: 1538727 - RNA, 22 nt, Homo sapiens
cuuuugugccaggagugggugg

SEQ ID NO: 1538728 - RNA, 17 nt, Homo sapiens
cuuuuuacaauguauca

SEQ ID NO: 1538729 - RNA, 17 nt, Homo sapiens
cuuuuuuaaaugaagaa

SEQ ID NO: 1538730 - RNA, 19 nt, Homo sapiens
cuuuuuuaagacucaauca

SEQ ID NO: 1538731 - RNA, 22 nt, Homo sapiens
cuuuuuuuugagaauacacuau

SEQ ID NO: 1538732 - RNA, 18 nt, Homo sapiens
gaaaaaaaauaauagaaa

SEQ ID NO: 1538733 - RNA, 17 nt, Homo sapiens
gaaaacaaaaaacaaaa

SEQ ID NO: 1538734 - RNA, 15 nt, Homo sapiens
gaaaacaaacaaaca

SEQ ID NO: 1538735 - RNA, 12 nt, Homo sapiens
gaaaacauaugc

SEQ ID NO: 1538736 - RNA, 15 nt, Homo sapiens
gaaaacauaugcauu

SEQ ID NO: 1538737 - RNA, 23 nt, Homo sapiens
gaaaacgauuuaauuuauucuaa

SEQ ID NO: 1538738 - RNA, 17 nt, Homo sapiens
gaaaacuaaguucucua

SEQ ID NO: 1538739 - RNA, 15 nt, Homo sapiens
gaaaaguauuuccaa

SEQ ID NO: 1538740 - RNA, 13 nt, Homo sapiens
gaaaauaaauaca

SEQ ID NO: 1538741 - RNA, 23 nt, Homo sapiens
gaaaauaguggcaggacuguccc

SEQ ID NO: 1538742 - RNA, 22 nt, Homo sapiens
gaaaauccugacaaaagggaca

SEQ ID NO: 1538743 - RNA, 18 nt, Homo sapiens
gaaacacacaggccauuu

SEQ ID NO: 1538744 - RNA, 12 nt, Homo sapiens
gaaacccgggga

SEQ ID NO: 1538745 - RNA, 22 nt, Homo sapiens
gaaacccuguuuuauugaguuc

SEQ ID NO: 1538746 - RNA, 12 nt, Homo sapiens
gaaagacaguaa

SEQ ID NO: 1538747 - RNA, 15 nt, Homo sapiens
gaaagauugcuauaa

SEQ ID NO: 1538748 - RNA, 21 nt, Homo sapiens
gaaagauuuuaugugcuugaa

SEQ ID NO: 1538749 - RNA, 23 nt, Homo sapiens
gaaagcaucuauucccaaagaac

SEQ ID NO: 1538750 - RNA, 22 nt, Homo sapiens
gaaaggguucagggcaugggga

SEQ ID NO: 1538751 - RNA, 14 nt, Homo sapiens
gaaagguaaucuga

SEQ ID NO: 1538752 - RNA, 18 nt, Homo sapiens
gaaaguuuauaucuugau

SEQ ID NO: 1538753 - RNA, 22 nt, Homo sapiens
gaaauuaugaaaguuaauuuga

SEQ ID NO: 1538754 - RNA, 14 nt, Homo sapiens
gaaauuauuggaaa

SEQ ID NO: 1538755 - RNA, 21 nt, Homo sapiens
gaacagaauaucaggaugccu

SEQ ID NO: 1538756 - RNA, 21 nt, Homo sapiens
gaaccagagccauggacucua

SEQ ID NO: 1538757 - RNA, 13 nt, Homo sapiens
gaaccuuuccucu

SEQ ID NO: 1538758 - RNA, 15 nt, Homo sapiens
gaacuagagaaggac

SEQ ID NO: 1538759 - RNA, 14 nt, Homo sapiens
gaagaaaacaugac

SEQ ID NO: 1538760 - RNA, 18 nt, Homo sapiens
gaagaaagauugcuauaa

SEQ ID NO: 1538761 - RNA, 21 nt, Homo sapiens
gaagaaccgauacacuuggca

SEQ ID NO: 1538762 - RNA, 15 nt, Homo sapiens
gaagaaggcaaccca

SEQ ID NO: 1538763 - RNA, 23 nt, Homo sapiens
gaagacacgcccgacucucucca

SEQ ID NO: 1538764 - RNA, 20 nt, Homo sapiens
gaagaccuucugaagaucuc

SEQ ID NO: 1538765 - RNA, 12 nt, Homo sapiens
gaagacuggaag

SEQ ID NO: 1538766 - RNA, 17 nt, Homo sapiens
gaagagaguauggugcu

SEQ ID NO: 1538767 - RNA, 18 nt, Homo sapiens
gaagaggaauccagugaa

SEQ ID NO: 1538768 - RNA, 18 nt, Homo sapiens
gaagauguaagaagcuaa

SEQ ID NO: 1538769 - RNA, 14 nt, Homo sapiens
gaagcaaggccagc

SEQ ID NO: 1538770 - RNA, 22 nt, Homo sapiens
gaagcaguugcaauaaacucag

SEQ ID NO: 1538771 - RNA, 18 nt, Homo sapiens
gaagcaucaaagcacugu

SEQ ID NO: 1538772 - RNA, 15 nt, Homo sapiens
gaagcauucucccca

SEQ ID NO: 1538773 - RNA, 19 nt, Homo sapiens
gaagcuccgugagccucag

SEQ ID NO: 1538774 - RNA, 16 nt, Homo sapiens
gaaggcagcuagacac

SEQ ID NO: 1538775 - RNA, 17 nt, Homo sapiens
gaagggacugguccagg

SEQ ID NO: 1538776 - RNA, 22 nt, Homo sapiens
gaagggccuucuccacagggac

SEQ ID NO: 1538777 - RNA, 22 nt, Homo sapiens
uggggcuuccauggugguuuca

SEQ ID NO: 1538778 - RNA, 19 nt, Homo sapiens
ugggggauucaaaugcaug

SEQ ID NO: 1538779 - RNA, 21 nt, Homo sapiens
ugggggcauccuugaggaccu

SEQ ID NO: 1538780 - RNA, 17 nt, Homo sapiens
ugggggccaugagcucc

SEQ ID NO: 1538781 - RNA, 15 nt, Homo sapiens
uggggggcacagcca

SEQ ID NO: 1538782 - RNA, 18 nt, Homo sapiens
uggggggcacagccagaa

SEQ ID NO: 1538783 - RNA, 16 nt, Homo sapiens
ugggguuccccuggaa

SEQ ID NO: 1538784 - RNA, 15 nt, Homo sapiens
ugggucauucucacc

SEQ ID NO: 1538785 - RNA, 15 nt, Homo sapiens
uggguuccagacaga

SEQ ID NO: 1538786 - RNA, 15 nt, Homo sapiens
uggguuuacucugug

SEQ ID NO: 1538787 - RNA, 17 nt, Homo sapiens
ugguaguucgaagaauu

SEQ ID NO: 1538788 - RNA, 15 nt, Homo sapiens
ugguaugcacugguu

SEQ ID NO: 1538789 - RNA, 19 nt, Homo sapiens
uggucccagcggaugcugc

SEQ ID NO: 1538790 - RNA, 18 nt, Homo sapiens
ugguguaugacaguuaga

SEQ ID NO: 1538791 - RNA, 20 nt, Homo sapiens
ugguuuauugaaugugauuu

SEQ ID NO: 1538792 - RNA, 17 nt, Homo sapiens
uguaaaauagaauguua

SEQ ID NO: 1538793 - RNA, 19 nt, Homo sapiens
uguaaaauagaauguuacu

SEQ ID NO: 1538794 - RNA, 18 nt, Homo sapiens
uguaaauuuaacugcaua

SEQ ID NO: 1538795 - RNA, 17 nt, Homo sapiens
uguaacuguuacaguaa

SEQ ID NO: 1538796 - RNA, 19 nt, Homo sapiens
uguaauauuuacaauguau

SEQ ID NO: 1538797 - RNA, 14 nt, Homo sapiens
uguacaauaaagca

SEQ ID NO: 1538798 - RNA, 13 nt, Homo sapiens
uguacauguggaa

SEQ ID NO: 1538799 - RNA, 19 nt, Homo sapiens
uguaccuuucugacaauaa

SEQ ID NO: 1538800 - RNA, 23 nt, Homo sapiens
uguacuggauuuaacuaccuuug

SEQ ID NO: 1538801 - RNA, 11 nt, Homo sapiens
uguacuuucau

SEQ ID NO: 1538802 - RNA, 18 nt, Homo sapiens
uguagauaguaugcacua

SEQ ID NO: 1538803 - RNA, 21 nt, Homo sapiens
uguaggacuaaauaaugaucu

SEQ ID NO: 1538804 - RNA, 15 nt, Homo sapiens
uguauaauacuuugu

SEQ ID NO: 1538805 - RNA, 17 nt, Homo sapiens
uguauacaaacaggugc

SEQ ID NO: 1538806 - RNA, 23 nt, Homo sapiens
uguaucuaaaaaauaacugugca

SEQ ID NO: 1538807 - RNA, 14 nt, Homo sapiens
ugucacaccugaaa

SEQ ID NO: 1538808 - RNA, 15 nt, Homo sapiens
ugucaccaugaucac

SEQ ID NO: 1538809 - RNA, 20 nt, Homo sapiens
ugucacuguuucacuacuca

SEQ ID NO: 1538810 - RNA, 18 nt, Homo sapiens
ugucagcuguagaaaggu

SEQ ID NO: 1538811 - RNA, 12 nt, Homo sapiens
ugucagugcagc

SEQ ID NO: 1538812 - RNA, 20 nt, Homo sapiens
uguccacacuaccaguuuca

SEQ ID NO: 1538813 - RNA, 16 nt, Homo sapiens
ugucccagaaaaagca

SEQ ID NO: 1538814 - RNA, 16 nt, Homo sapiens
uguccugcaucaucuu

SEQ ID NO: 1538815 - RNA, 20 nt, Homo sapiens
uguccuucccacggccacug

SEQ ID NO: 1538816 - RNA, 21 nt, Homo sapiens
uguccuucccacggccacugc

SEQ ID NO: 1538817 - RNA, 15 nt, Homo sapiens
ugucuuuggcuucag

SEQ ID NO: 1538818 - RNA, 15 nt, Homo sapiens
ugugaaacacagcug

SEQ ID NO: 1538819 - RNA, 18 nt, Homo sapiens
ugugacaggaauucuccc

SEQ ID NO: 1538820 - RNA, 21 nt, Homo sapiens
ugugaguugcacagcuaugaa

SEQ ID NO: 1538821 - RNA, 21 nt, Homo sapiens
ugugaucuauaccaccuucaa

SEQ ID NO: 1538822 - RNA, 19 nt, Homo sapiens
ugugggaaugcggcaagaa

SEQ ID NO: 1538823 - RNA, 20 nt, Homo sapiens
uguggucugcugccucagga

SEQ ID NO: 1538824 - RNA, 23 nt, Homo sapiens
uguguaucaguguuuaugugcua

SEQ ID NO: 1538825 - RNA, 21 nt, Homo sapiens
uguguauucuguggauucuau

SEQ ID NO: 1538826 - RNA, 15 nt, Homo sapiens
uguguuucaggugga

SEQ ID NO: 1538827 - RNA, 12 nt, Homo sapiens
uguguuugcaaa

SEQ ID NO: 1538828 - RNA, 14 nt, Homo sapiens
uguuaauaucacuc

SEQ ID NO: 1538829 - RNA, 12 nt, Homo sapiens
uguuagugauuu

SEQ ID NO: 1538830 - RNA, 16 nt, Homo sapiens
uguuagugucugucca

SEQ ID NO: 1538831 - RNA, 19 nt, Homo sapiens
uguuauaucaucaauacuu

SEQ ID NO: 1538832 - RNA, 12 nt, Homo sapiens
uguucauuuccu

SEQ ID NO: 1538833 - RNA, 23 nt, Homo sapiens
uguucccacucccucucuugccg

SEQ ID NO: 1538834 - RNA, 14 nt, Homo sapiens
uguuccugccacau

SEQ ID NO: 1538835 - RNA, 23 nt, Homo sapiens
uguucugaauaauuucuuacuaa

SEQ ID NO: 1538836 - RNA, 21 nt, Homo sapiens
uguucuuagcugaacaaugaa

SEQ ID NO: 1538837 - RNA, 19 nt, Homo sapiens
uguugaagaacucauguga

SEQ ID NO: 1538838 - RNA, 22 nt, Homo sapiens
uguugccuccucccauccagcg

SEQ ID NO: 1538839 - RNA, 16 nt, Homo sapiens
uguuggaaggggguca

SEQ ID NO: 1538840 - RNA, 16 nt, Homo sapiens
uguugucacaccugaa

SEQ ID NO: 1538841 - RNA, 19 nt, Homo sapiens
uguuguucauagucaauca

SEQ ID NO: 1538842 - RNA, 12 nt, Homo sapiens
uguuuacaugag

SEQ ID NO: 1538843 - RNA, 19 nt, Homo sapiens
uguuuacaugaguucaaau

SEQ ID NO: 1538844 - RNA, 14 nt, Homo sapiens
uguuuccagugaca

SEQ ID NO: 1538845 - RNA, 12 nt, Homo sapiens
uguuucuauacu

SEQ ID NO: 1538846 - RNA, 16 nt, Homo sapiens
uguuugauacaguauu

SEQ ID NO: 1538847 - RNA, 14 nt, Homo sapiens
uuaaaaaauaacau

SEQ ID NO: 1538848 - RNA, 15 nt, Homo sapiens
uuaaaaaauaacaua

SEQ ID NO: 1538849 - RNA, 15 nt, Homo sapiens
uuaaaauaacuaagc

SEQ ID NO: 1538850 - RNA, 13 nt, Homo sapiens
uuaaagcuguuau

SEQ ID NO: 1538851 - RNA, 20 nt, Homo sapiens
uuaaaguaaaaacaauucaa

SEQ ID NO: 1538852 - RNA, 15 nt, Homo sapiens
uuaacaagacuucaa

SEQ ID NO: 1538853 - RNA, 19 nt, Homo sapiens
uuaacaauugccagggaaa

SEQ ID NO: 1538854 - RNA, 16 nt, Homo sapiens
aaauauugacaaguuu

SEQ ID NO: 1538855 - RNA, 18 nt, Homo sapiens
aaauauuuuaaacuacug

SEQ ID NO: 1538856 - RNA, 16 nt, Homo sapiens
aaaucauuuauuuaca

SEQ ID NO: 1538857 - RNA, 22 nt, Homo sapiens
aaauccauacccccugccccag

SEQ ID NO: 1538858 - RNA, 16 nt, Homo sapiens
aaauccccuccccaaa

SEQ ID NO: 1538859 - RNA, 19 nt, Homo sapiens
aaauccugacaaaagggac

SEQ ID NO: 1538860 - RNA, 12 nt, Homo sapiens
aaaucuagaaga

SEQ ID NO: 1538861 - RNA, 12 nt, Homo sapiens
aaaucuauuuca

SEQ ID NO: 1538862 - RNA, 18 nt, Homo sapiens
aaaugcacauuugucacu

SEQ ID NO: 1538863 - RNA, 19 nt, Homo sapiens
aaauggcuuguucagucac

SEQ ID NO: 1538864 - RNA, 16 nt, Homo sapiens
aaauuacaauugucau

SEQ ID NO: 1538865 - RNA, 14 nt, Homo sapiens
aaauuacagaagaa

SEQ ID NO: 1538866 - RNA, 20 nt, Homo sapiens
aaauuauguuuuaauuccaa

SEQ ID NO: 1538867 - RNA, 23 nt, Homo sapiens
aaauucuguuuauguucuugcag

SEQ ID NO: 1538868 - RNA, 23 nt, Homo sapiens
aaauugagucauuuuauauauga

SEQ ID NO: 1538869 - RNA, 24 nt, Homo sapiens
aaauugucuuuugucauguggcua

SEQ ID NO: 1538870 - RNA, 15 nt, Homo sapiens
aaauuuaacugcaua

SEQ ID NO: 1538871 - RNA, 19 nt, Homo sapiens
aaauuuaauauacugcaua

SEQ ID NO: 1538872 - RNA, 21 nt, Homo sapiens
aacaaauggcuuguucaguca

SEQ ID NO: 1538873 - RNA, 23 nt, Homo sapiens
aacaacuugucuauuaccuguua

SEQ ID NO: 1538874 - RNA, 22 nt, Homo sapiens
aacaauguaugugaaaguguaa

SEQ ID NO: 1538875 - RNA, 14 nt, Homo sapiens
aacaauucaaguga

SEQ ID NO: 1538876 - RNA, 17 nt, Homo sapiens
aacacaagccacgccug

SEQ ID NO: 1538877 - RNA, 13 nt, Homo sapiens
aacacaccuugcc

SEQ ID NO: 1538878 - RNA, 12 nt, Homo sapiens
aacaccaugaag

SEQ ID NO: 1538879 - RNA, 17 nt, Homo sapiens
aacauggccacauccaa

SEQ ID NO: 1538880 - RNA, 13 nt, Homo sapiens
aacauuuucucaa

SEQ ID NO: 1538881 - RNA, 20 nt, Homo sapiens
aacauuuuguuauugggcaa

SEQ ID NO: 1538882 - RNA, 19 nt, Homo sapiens
aaccaugaaaacaaugccu

SEQ ID NO: 1538883 - RNA, 12 nt, Homo sapiens
aacccaagagag

SEQ ID NO: 1538884 - RNA, 15 nt, Homo sapiens
aacccagauugaagc

SEQ ID NO: 1538885 - RNA, 21 nt, Homo sapiens
aacccugagggacuuggcagu

SEQ ID NO: 1538886 - RNA, 17 nt, Homo sapiens
aacccugccccugcccc

SEQ ID NO: 1538887 - RNA, 19 nt, Homo sapiens
aaccgcuugccauauuccg

SEQ ID NO: 1538888 - RNA, 17 nt, Homo sapiens
aaccucaagcugcaucu

SEQ ID NO: 1538889 - RNA, 19 nt, Homo sapiens
aaccuccccugguccugca

SEQ ID NO: 1538890 - RNA, 17 nt, Homo sapiens
aaccugugaugagggga

SEQ ID NO: 1538891 - RNA, 21 nt, Homo sapiens
aacgauccuucaaagucucaa

SEQ ID NO: 1538892 - RNA, 13 nt, Homo sapiens
aacuaaauguugc

SEQ ID NO: 1538893 - RNA, 22 nt, Homo sapiens
aacuaagguacggugagacucu

SEQ ID NO: 1538894 - RNA, 18 nt, Homo sapiens
aacuauguuuagugugau

SEQ ID NO: 1538895 - RNA, 12 nt, Homo sapiens
aacucaccaggg

SEQ ID NO: 1538896 - RNA, 15 nt, Homo sapiens
aacucaucugucacc

SEQ ID NO: 1538897 - RNA, 13 nt, Homo sapiens
aacuccaguguuc

SEQ ID NO: 1538898 - RNA, 14 nt, Homo sapiens
aacucugacuguaa

SEQ ID NO: 1538899 - RNA, 12 nt, Homo sapiens
aacugaagccca

SEQ ID NO: 1538900 - RNA, 13 nt, Homo sapiens
aacugagcacuuu

SEQ ID NO: 1538901 - RNA, 19 nt, Homo sapiens
aacugaggccauuauuuca

SEQ ID NO: 1538902 - RNA, 20 nt, Homo sapiens
aacugaguuagaauguugaa

SEQ ID NO: 1538903 - RNA, 17 nt, Homo sapiens
aacuguaaaauacuucu

SEQ ID NO: 1538904 - RNA, 14 nt, Homo sapiens
aacuucaccuuaaa

SEQ ID NO: 1538905 - RNA, 19 nt, Homo sapiens
aacuugauguuccugggau

SEQ ID NO: 1538906 - RNA, 17 nt, Homo sapiens
aacuuggagauuuugcu

SEQ ID NO: 1538907 - RNA, 17 nt, Homo sapiens
aacuugucacuugccag

SEQ ID NO: 1538908 - RNA, 20 nt, Homo sapiens
aacuuuuccuggacacuuua

SEQ ID NO: 1538909 - RNA, 18 nt, Homo sapiens
aacuuuucugcugauaag

SEQ ID NO: 1538910 - RNA, 12 nt, Homo sapiens
aacuuuuuauuc

SEQ ID NO: 1538911 - RNA, 16 nt, Homo sapiens
aacuuuuuauucucag

SEQ ID NO: 1538912 - RNA, 18 nt, Homo sapiens
aagaaagcuauauaugaa

SEQ ID NO: 1538913 - RNA, 20 nt, Homo sapiens
aagaauuggcagaagcaguu

SEQ ID NO: 1538914 - RNA, 17 nt, Homo sapiens
aagaauuuuaauauugc

SEQ ID NO: 1538915 - RNA, 21 nt, Homo sapiens
aagacaauuuuaauguuuaca

SEQ ID NO: 1538916 - RNA, 18 nt, Homo sapiens
aagacaguaaagaccauu

SEQ ID NO: 1538917 - RNA, 20 nt, Homo sapiens
aagacccucaaugccaagaa

SEQ ID NO: 1538918 - RNA, 20 nt, Homo sapiens
aagaccuucugaagaucuca

SEQ ID NO: 1538919 - RNA, 14 nt, Homo sapiens
aagacuugaugaau

SEQ ID NO: 1538920 - RNA, 18 nt, Homo sapiens
aagagaccacccauauca

SEQ ID NO: 1538921 - RNA, 21 nt, Homo sapiens
aagagcgcuccucugccuugg

SEQ ID NO: 1538922 - RNA, 19 nt, Homo sapiens
aagagggggcaagucacau

SEQ ID NO: 1538923 - RNA, 13 nt, Homo sapiens
aagaucaagcucc

SEQ ID NO: 1538924 - RNA, 17 nt, Homo sapiens
aagauugauuaaugaac

SEQ ID NO: 1538925 - RNA, 19 nt, Homo sapiens
aagcaaacacacagacucu

SEQ ID NO: 1538926 - RNA, 12 nt, Homo sapiens
aagcacaagcag

SEQ ID NO: 1538927 - RNA, 20 nt, Homo sapiens
aagcacaagcagagugcaca

SEQ ID NO: 1538928 - RNA, 14 nt, Homo sapiens
aagcacacaugcau

SEQ ID NO: 1538929 - RNA, 13 nt, Homo sapiens
aagcagccuccac

SEQ ID NO: 1538930 - RNA, 20 nt, Homo sapiens
aagcauuugacuuucugucu

SEQ ID NO: 1538931 - RNA, 21 nt, Homo sapiens
aagccaagucagcuuugccuu

SEQ ID NO: 1538932 - RNA, 18 nt, Homo sapiens
aagccaggguuccagaca

SEQ ID NO: 1538933 - RNA, 13 nt, Homo sapiens
aagccauaugaca

SEQ ID NO: 1538934 - RNA, 14 nt, Homo sapiens
aagccguuggcacc

SEQ ID NO: 1538935 - RNA, 15 nt, Homo sapiens
aagccuccugcugag

SEQ ID NO: 1538936 - RNA, 17 nt, Homo sapiens
aagccuggcccagugag

SEQ ID NO: 1538937 - RNA, 17 nt, Homo sapiens
aagccugguggcaauaa

SEQ ID NO: 1538938 - RNA, 23 nt, Homo sapiens
aagcuaaaaugaaaaauagugug

SEQ ID NO: 1538939 - RNA, 19 nt, Homo sapiens
aagcucuuuaugacuguuu

SEQ ID NO: 1538940 - RNA, 19 nt, Homo sapiens
aagcugguuaaaguggaug

SEQ ID NO: 1538941 - RNA, 12 nt, Homo sapiens
aagcuuugaacc

SEQ ID NO: 1538942 - RNA, 19 nt, Homo sapiens
aaggaagauguaagaagcu

SEQ ID NO: 1538943 - RNA, 13 nt, Homo sapiens
aaggaaggaugaa

SEQ ID NO: 1538944 - RNA, 15 nt, Homo sapiens
aaggagccuauggca

SEQ ID NO: 1538945 - RNA, 16 nt, Homo sapiens
aaggcaucauuuucac

SEQ ID NO: 1538946 - RNA, 24 nt, Homo sapiens
aaggcauccacuucacaguucuga

SEQ ID NO: 1538947 - RNA, 21 nt, Homo sapiens
aaggcuucuccacaaccuccu

SEQ ID NO: 1538948 - RNA, 17 nt, Homo sapiens
aagggacugguccaggc

SEQ ID NO: 1538949 - RNA, 16 nt, Homo sapiens
aaggguucagggcaug

SEQ ID NO: 1538950 - RNA, 18 nt, Homo sapiens
aagguuaagccauaugac

SEQ ID NO: 1538951 - RNA, 15 nt, Homo sapiens
aaguaauaucuuuca

SEQ ID NO: 1538952 - RNA, 19 nt, Homo sapiens
aaguacugaaauacauaug

SEQ ID NO: 1538953 - RNA, 16 nt, Homo sapiens
aaguaggacuaucaca

SEQ ID NO: 1538954 - RNA, 18 nt, Homo sapiens
aaguauugcccuuuaaca

SEQ ID NO: 1538955 - RNA, 12 nt, Homo sapiens
aaguauuuccaa

SEQ ID NO: 1538956 - RNA, 13 nt, Homo sapiens
ccuccgacuucuc

SEQ ID NO: 1538957 - RNA, 16 nt, Homo sapiens
ccuccuggguuuacuc

SEQ ID NO: 1538958 - RNA, 20 nt, Homo sapiens
ccucggggcaggaagucccu

SEQ ID NO: 1538959 - RNA, 12 nt, Homo sapiens
ccucucucuaua

SEQ ID NO: 1538960 - RNA, 14 nt, Homo sapiens
ccucucuugccgac

SEQ ID NO: 1538961 - RNA, 16 nt, Homo sapiens
ccucugcacgugcaca

SEQ ID NO: 1538962 - RNA, 24 nt, Homo sapiens
ccucugcacgugcacacaccugca

SEQ ID NO: 1538963 - RNA, 15 nt, Homo sapiens
ccucuggucacuuca

SEQ ID NO: 1538964 - RNA, 23 nt, Homo sapiens
ccugaaacagccucuccaagggu

SEQ ID NO: 1538965 - RNA, 19 nt, Homo sapiens
ccugaagcaacacugccag

SEQ ID NO: 1538966 - RNA, 13 nt, Homo sapiens
ccugaagugaccc

SEQ ID NO: 1538967 - RNA, 15 nt, Homo sapiens
ccugaccaugcauuu

SEQ ID NO: 1538968 - RNA, 15 nt, Homo sapiens
ccugagaagagucga

SEQ ID NO: 1538969 - RNA, 23 nt, Homo sapiens
ccugagaaugccuaggccagcuc

SEQ ID NO: 1538970 - RNA, 19 nt, Homo sapiens
ccugagaggagcguguccu

SEQ ID NO: 1538971 - RNA, 20 nt, Homo sapiens
ccugagaggagcguguccua

SEQ ID NO: 1538972 - RNA, 12 nt, Homo sapiens
ccugaguuucaa

SEQ ID NO: 1538973 - RNA, 16 nt, Homo sapiens
ccugcaggguaggggg

SEQ ID NO: 1538974 - RNA, 15 nt, Homo sapiens
ccugccugugaguga

SEQ ID NO: 1538975 - RNA, 22 nt, Homo sapiens
ccugcuacaguagcugugggga

SEQ ID NO: 1538976 - RNA, 17 nt, Homo sapiens
ccugcuccuaccuauca

SEQ ID NO: 1538977 - RNA, 16 nt, Homo sapiens
ccuggacauauuccca

SEQ ID NO: 1538978 - RNA, 14 nt, Homo sapiens
ccuggauuugcaua

SEQ ID NO: 1538979 - RNA, 21 nt, Homo sapiens
ccuggauuugcauacauucuu

SEQ ID NO: 1538980 - RNA, 19 nt, Homo sapiens
ccuggcccuccucugguca

SEQ ID NO: 1538981 - RNA, 13 nt, Homo sapiens
ccuggcucuguca

SEQ ID NO: 1538982 - RNA, 22 nt, Homo sapiens
ccugggucaccuuccugggcag

SEQ ID NO: 1538983 - RNA, 15 nt, Homo sapiens
ccuggugaaagagua

SEQ ID NO: 1538984 - RNA, 13 nt, Homo sapiens
ccuggugcccugg

SEQ ID NO: 1538985 - RNA, 17 nt, Homo sapiens
ccugguuuucauuauuu

SEQ ID NO: 1538986 - RNA, 21 nt, Homo sapiens
ccuguauugucugacuucuca

SEQ ID NO: 1538987 - RNA, 12 nt, Homo sapiens
ccugugaucgug

SEQ ID NO: 1538988 - RNA, 13 nt, Homo sapiens
ccugugucagggc

SEQ ID NO: 1538989 - RNA, 10 nt, Homo sapiens
ccuguuaaau

SEQ ID NO: 1538990 - RNA, 14 nt, Homo sapiens
ccuguuccugccac

SEQ ID NO: 1538991 - RNA, 15 nt, Homo sapiens
ccuuaagaaagcuau

SEQ ID NO: 1538992 - RNA, 13 nt, Homo sapiens
ccuucacuucuga

SEQ ID NO: 1538993 - RNA, 17 nt, Homo sapiens
ccuucgauauaugacuu

SEQ ID NO: 1538994 - RNA, 16 nt, Homo sapiens
ccuucuaauccaugug

SEQ ID NO: 1538995 - RNA, 17 nt, Homo sapiens
ccuucuccacagggaca

SEQ ID NO: 1538996 - RNA, 16 nt, Homo sapiens
ccuucucccacacugc

SEQ ID NO: 1538997 - RNA, 18 nt, Homo sapiens
ccuucucccacacugcua

SEQ ID NO: 1538998 - RNA, 21 nt, Homo sapiens
ccuucuggcugcugcagucag

SEQ ID NO: 1538999 - RNA, 14 nt, Homo sapiens
ccuucuguggcuca

SEQ ID NO: 1539000 - RNA, 21 nt, Homo sapiens
ccuugcauuuuagcuaauuua

SEQ ID NO: 1539001 - RNA, 15 nt, Homo sapiens
ccuugcucugccauc

SEQ ID NO: 1539002 - RNA, 20 nt, Homo sapiens
ccuuggcgcgcagcccggga

SEQ ID NO: 1539003 - RNA, 17 nt, Homo sapiens
ccuugggaugggcacag

SEQ ID NO: 1539004 - RNA, 19 nt, Homo sapiens
ccuuguugacacggccaug

SEQ ID NO: 1539005 - RNA, 15 nt, Homo sapiens
ccuuucaugauuugc

SEQ ID NO: 1539006 - RNA, 13 nt, Homo sapiens
ccuuuccugcaaa

SEQ ID NO: 1539007 - RNA, 21 nt, Homo sapiens
ccuuuguaaccacaacuuuca

SEQ ID NO: 1539008 - RNA, 15 nt, Homo sapiens
ccuuuuggauuuaga

SEQ ID NO: 1539009 - RNA, 22 nt, Homo sapiens
cgaagaccuucugaagaucuca

SEQ ID NO: 1539010 - RNA, 17 nt, Homo sapiens
aagucaacuuagcauuu

SEQ ID NO: 1539011 - RNA, 14 nt, Homo sapiens
aaguccagcucucc

SEQ ID NO: 1539012 - RNA, 12 nt, Homo sapiens
aaguccagugac

SEQ ID NO: 1539013 - RNA, 13 nt, Homo sapiens
aagucuuacuguu

SEQ ID NO: 1539014 - RNA, 13 nt, Homo sapiens
aaguguacuggau

SEQ ID NO: 1539015 - RNA, 15 nt, Homo sapiens
aaguguacuggauuu

SEQ ID NO: 1539016 - RNA, 15 nt, Homo sapiens
aaguuauugugauaa

SEQ ID NO: 1539017 - RNA, 17 nt, Homo sapiens
aaguucauccaacguga

SEQ ID NO: 1539018 - RNA, 16 nt, Homo sapiens
aaguucucaucauuau

SEQ ID NO: 1539019 - RNA, 21 nt, Homo sapiens
aaguuuuauaaaagacaugaa

SEQ ID NO: 1539020 - RNA, 19 nt, Homo sapiens
aaguuuugccuauccuaag

SEQ ID NO: 1539021 - RNA, 14 nt, Homo sapiens
aauaaacucaguca

SEQ ID NO: 1539022 - RNA, 22 nt, Homo sapiens
aauaaagccuugugaucacuuu

SEQ ID NO: 1539023 - RNA, 19 nt, Homo sapiens
aauaaaguuauuacucuga

SEQ ID NO: 1539024 - RNA, 22 nt, Homo sapiens
aauaacuaagcaaguauauuua

SEQ ID NO: 1539025 - RNA, 19 nt, Homo sapiens
aauaacuagaucuccugua

SEQ ID NO: 1539026 - RNA, 17 nt, Homo sapiens
aauaacugagcacuuug

SEQ ID NO: 1539027 - RNA, 20 nt, Homo sapiens
aauaacugagcacuuugaau

SEQ ID NO: 1539028 - RNA, 14 nt, Homo sapiens
aauaauuguggaga

SEQ ID NO: 1539029 - RNA, 17 nt, Homo sapiens
aauacauaaaaaaggga

SEQ ID NO: 1539030 - RNA, 18 nt, Homo sapiens
aauacauaaaaaagggac

SEQ ID NO: 1539031 - RNA, 14 nt, Homo sapiens
aauacaugguuuaa

SEQ ID NO: 1539032 - RNA, 19 nt, Homo sapiens
aauacuuccaaagagucau

SEQ ID NO: 1539033 - RNA, 24 nt, Homo sapiens
aauacuuuugggauguuaccuuca

SEQ ID NO: 1539034 - RNA, 16 nt, Homo sapiens
aauaggaacagcugaa

SEQ ID NO: 1539035 - RNA, 20 nt, Homo sapiens
aauaucugugaaauaucauc

SEQ ID NO: 1539036 - RNA, 14 nt, Homo sapiens
aauauggacuucca

SEQ ID NO: 1539037 - RNA, 17 nt, Homo sapiens
aauauuacaaauucuaa

SEQ ID NO: 1539038 - RNA, 16 nt, Homo sapiens
aauauuauacuucuuu

SEQ ID NO: 1539039 - RNA, 19 nt, Homo sapiens
aauauugccauauucugua

SEQ ID NO: 1539040 - RNA, 17 nt, Homo sapiens
aauauuuaaacuucuug

SEQ ID NO: 1539041 - RNA, 15 nt, Homo sapiens
aaucaaacagggaca

SEQ ID NO: 1539042 - RNA, 12 nt, Homo sapiens
aaucaacaguga

SEQ ID NO: 1539043 - RNA, 18 nt, Homo sapiens
aaucacacucucuucuua

SEQ ID NO: 1539044 - RNA, 17 nt, Homo sapiens
aauccaggacagcauua

SEQ ID NO: 1539045 - RNA, 13 nt, Homo sapiens
aauccauuuucua

SEQ ID NO: 1539046 - RNA, 17 nt, Homo sapiens
aaucgaccucacuguca

SEQ ID NO: 1539047 - RNA, 15 nt, Homo sapiens
aaucuaaaucuucag

SEQ ID NO: 1539048 - RNA, 17 nt, Homo sapiens
aaucugauuggacauuu

SEQ ID NO: 1539049 - RNA, 19 nt, Homo sapiens
aaugauacuugguccuuaa

SEQ ID NO: 1539050 - RNA, 22 nt, Homo sapiens
aaugauuucaaaaugauauuca

SEQ ID NO: 1539051 - RNA, 16 nt, Homo sapiens
aaugcauauacuuuaa

SEQ ID NO: 1539052 - RNA, 21 nt, Homo sapiens
aaugcuagcacaauauuccua

SEQ ID NO: 1539053 - RNA, 20 nt, Homo sapiens
aauggccuaaacuucagagg

SEQ ID NO: 1539054 - RNA, 12 nt, Homo sapiens
aauggcuauuaa

SEQ ID NO: 1539055 - RNA, 19 nt, Homo sapiens
aaugggaaauguuuggcca

SEQ ID NO: 1539056 - RNA, 14 nt, Homo sapiens
aauggggcuuccau

SEQ ID NO: 1539057 - RNA, 13 nt, Homo sapiens
aauggucaaugcu

SEQ ID NO: 1539058 - RNA, 23 nt, Homo sapiens
aauguaacacacacacacauaca

SEQ ID NO: 1539059 - RNA, 17 nt, Homo sapiens
aauguacaauaaagcaa

SEQ ID NO: 1539060 - RNA, 20 nt, Homo sapiens
aauguacaauaaagcaaugu

SEQ ID NO: 1539061 - RNA, 18 nt, Homo sapiens
aauguacccagccuacca

SEQ ID NO: 1539062 - RNA, 14 nt, Homo sapiens
aaugucuauauuau

SEQ ID NO: 1539063 - RNA, 17 nt, Homo sapiens
aauguugaaacugacuu

SEQ ID NO: 1539064 - RNA, 22 nt, Homo sapiens
aauguuucccucaagaacaaac

SEQ ID NO: 1539065 - RNA, 18 nt, Homo sapiens
aauuaaaaaauaguugca

SEQ ID NO: 1539066 - RNA, 19 nt, Homo sapiens
aauuaaaaaguuaaucuuc

SEQ ID NO: 1539067 - RNA, 19 nt, Homo sapiens
aauuacagaagaagcuccu

SEQ ID NO: 1539068 - RNA, 14 nt, Homo sapiens
aauuauaaucucuu

SEQ ID NO: 1539069 - RNA, 21 nt, Homo sapiens
aauucauaaaaauaaccaaaa

SEQ ID NO: 1539070 - RNA, 19 nt, Homo sapiens
aauucauagcauccugauu

SEQ ID NO: 1539071 - RNA, 15 nt, Homo sapiens
aauuccaaucauugu

SEQ ID NO: 1539072 - RNA, 20 nt, Homo sapiens
aauucuagauuaccaugaag

SEQ ID NO: 1539073 - RNA, 16 nt, Homo sapiens
aauucuagucucugau

SEQ ID NO: 1539074 - RNA, 19 nt, Homo sapiens
aauucuccuguugcaauga

SEQ ID NO: 1539075 - RNA, 22 nt, Homo sapiens
aauugauuuuuaaacagcaggu

SEQ ID NO: 1539076 - RNA, 12 nt, Homo sapiens
aauugcauuucc

SEQ ID NO: 1539077 - RNA, 18 nt, Homo sapiens
aauugguuaaucacuuaa

SEQ ID NO: 1539078 - RNA, 21 nt, Homo sapiens
aauugucauuuauaaaaccau

SEQ ID NO: 1539079 - RNA, 22 nt, Homo sapiens
aauugugguuuauugaauguga

SEQ ID NO: 1539080 - RNA, 22 nt, Homo sapiens
aauuguuuuucugaaaguauca

SEQ ID NO: 1539081 - RNA, 12 nt, Homo sapiens
aauuucucuuaa

SEQ ID NO: 1539082 - RNA, 18 nt, Homo sapiens
aauuugggggacuuacau

SEQ ID NO: 1539083 - RNA, 21 nt, Homo sapiens
aauuugggggacuuacaugau

SEQ ID NO: 1539084 - RNA, 18 nt, Homo sapiens
aauuuuauugcuggaauc

SEQ ID NO: 1539085 - RNA, 21 nt, Homo sapiens
acaaaauauuucuaagcuuau

SEQ ID NO: 1539086 - RNA, 19 nt, Homo sapiens
acaaauggcuuguucaguc

SEQ ID NO: 1539087 - RNA, 12 nt, Homo sapiens
acaaauucuaaa

SEQ ID NO: 1539088 - RNA, 19 nt, Homo sapiens
acaaauuuuuuucuuguuu

SEQ ID NO: 1539089 - RNA, 17 nt, Homo sapiens
acaacuguuuuugaaga

SEQ ID NO: 1539090 - RNA, 19 nt, Homo sapiens
acaacuugucuauuaccug

SEQ ID NO: 1539091 - RNA, 13 nt, Homo sapiens
acaagacuucaaa

SEQ ID NO: 1539092 - RNA, 13 nt, Homo sapiens
acaagauuguaaa

SEQ ID NO: 1539093 - RNA, 22 nt, Homo sapiens
acaagcauucugucuugaaggg

SEQ ID NO: 1539094 - RNA, 16 nt, Homo sapiens
acaagccuuggaccaa

SEQ ID NO: 1539095 - RNA, 21 nt, Homo sapiens
acaagguguuucucuguaaaa

SEQ ID NO: 1539096 - RNA, 16 nt, Homo sapiens
acaauaaaauuuugca

SEQ ID NO: 1539097 - RNA, 14 nt, Homo sapiens
acaauaaagcaaug

SEQ ID NO: 1539098 - RNA, 13 nt, Homo sapiens
acaauaagccacu

SEQ ID NO: 1539099 - RNA, 16 nt, Homo sapiens
acaauacagugguaua

SEQ ID NO: 1539100 - RNA, 13 nt, Homo sapiens
acacaaauccaac

SEQ ID NO: 1539101 - RNA, 20 nt, Homo sapiens
acacaagacagcagagccau

SEQ ID NO: 1539102 - RNA, 12 nt, Homo sapiens
acacacaauuaa

SEQ ID NO: 1539103 - RNA, 11 nt, Homo sapiens
acacacacagg

SEQ ID NO: 1539104 - RNA, 14 nt, Homo sapiens
acacaccuugccca

SEQ ID NO: 1539105 - RNA, 13 nt, Homo sapiens
acacagcuguucu

SEQ ID NO: 1539106 - RNA, 19 nt, Homo sapiens
acacccaguggaaccaaaa

SEQ ID NO: 1539107 - RNA, 13 nt, Homo sapiens
acacccuucccca

SEQ ID NO: 1539108 - RNA, 15 nt, Homo sapiens
acaccuaugucauuu

SEQ ID NO: 1539109 - RNA, 18 nt, Homo sapiens
acaccuaugucauuucau

SEQ ID NO: 1539110 - RNA, 20 nt, Homo sapiens
acaccugaaaauuaugaguc

SEQ ID NO: 1539111 - RNA, 15 nt, Homo sapiens
acacguuugccaaau

SEQ ID NO: 1539112 - RNA, 19 nt, Homo sapiens
acacucaguccuuccacac

SEQ ID NO: 1539113 - RNA, 19 nt, Homo sapiens
acacugacuguugcuguaa

SEQ ID NO: 1539114 - RNA, 19 nt, Homo sapiens
acacugcuaggugggccag

SEQ ID NO: 1539115 - RNA, 20 nt, Homo sapiens
acacuuccacccccagcucc

SEQ ID NO: 1539116 - RNA, 19 nt, Homo sapiens
acagaaacgagauuugcca

SEQ ID NO: 1539117 - RNA, 21 nt, Homo sapiens
acagaaccaacgggucugugg

SEQ ID NO: 1539118 - RNA, 17 nt, Homo sapiens
acagaaugaaucccaua

SEQ ID NO: 1539119 - RNA, 20 nt, Homo sapiens
acagagagcggcuuccccau

SEQ ID NO: 1539120 - RNA, 20 nt, Homo sapiens
acagaggacggcuuccccau

SEQ ID NO: 1539121 - RNA, 14 nt, Homo sapiens
acagcauaaagcac

SEQ ID NO: 1539122 - RNA, 18 nt, Homo sapiens
acagccuggcacagggca

SEQ ID NO: 1539123 - RNA, 14 nt, Homo sapiens
acagcuaugaaggc

SEQ ID NO: 1539124 - RNA, 20 nt, Homo sapiens
acagcuaugaaggcuguaca

SEQ ID NO: 1539125 - RNA, 15 nt, Homo sapiens
acaggagcauguccu

SEQ ID NO: 1539126 - RNA, 15 nt, Homo sapiens
acaggagcguguacu

SEQ ID NO: 1539127 - RNA, 22 nt, Homo sapiens
acaggagcguguacuaccccag

SEQ ID NO: 1539128 - RNA, 15 nt, Homo sapiens
acaggagcguguccu

SEQ ID NO: 1539129 - RNA, 12 nt, Homo sapiens
acaguaauguca

SEQ ID NO: 1539130 - RNA, 15 nt, Homo sapiens
acaguggcucuccaa

SEQ ID NO: 1539131 - RNA, 16 nt, Homo sapiens
acaguguuuccaguga

SEQ ID NO: 1539132 - RNA, 22 nt, Homo sapiens
acaguuaaaggcaacccugagg

SEQ ID NO: 1539133 - RNA, 16 nt, Homo sapiens
acaguucuacagaaaa

SEQ ID NO: 1539134 - RNA, 17 nt, Homo sapiens
acaguugcacagcaucu

SEQ ID NO: 1539135 - RNA, 15 nt, Homo sapiens
acauaaaaaagggac

SEQ ID NO: 1539136 - RNA, 21 nt, Homo sapiens
acauacaccuaugucauuuca

SEQ ID NO: 1539137 - RNA, 22 nt, Homo sapiens
acauacaccuaugucauuucau

SEQ ID NO: 1539138 - RNA, 23 nt, Homo sapiens
acauaccucucaacuuacauaug

SEQ ID NO: 1539139 - RNA, 22 nt, Homo sapiens
acauaccucucucuauauauac

SEQ ID NO: 1539140 - RNA, 19 nt, Homo sapiens
acaucuagucucagugcua

SEQ ID NO: 1539141 - RNA, 17 nt, Homo sapiens
acaucucaucaugucua

SEQ ID NO: 1539142 - RNA, 16 nt, Homo sapiens
acaucucuuucaucua

SEQ ID NO: 1539143 - RNA, 21 nt, Homo sapiens
acaugcacuuggcugcauaaa

SEQ ID NO: 1539144 - RNA, 22 nt, Homo sapiens
acauggacuacacacaauacag

SEQ ID NO: 1539145 - RNA, 18 nt, Homo sapiens
acaugguaucucuuucuc

SEQ ID NO: 1539146 - RNA, 11 nt, Homo sapiens
acaugugauug

SEQ ID NO: 1539147 - RNA, 14 nt, Homo sapiens
acauuauccugugu

SEQ ID NO: 1539148 - RNA, 19 nt, Homo sapiens
accaacaggcguucucagc

SEQ ID NO: 1539149 - RNA, 16 nt, Homo sapiens
accaacucucucugcc

SEQ ID NO: 1539150 - RNA, 19 nt, Homo sapiens
accaagaccccaaagggcc

SEQ ID NO: 1539151 - RNA, 17 nt, Homo sapiens
accacgugacuuucaac

SEQ ID NO: 1539152 - RNA, 22 nt, Homo sapiens
accacuuuccccgugggccaug

SEQ ID NO: 1539153 - RNA, 20 nt, Homo sapiens
accagagaaaugaaagucag

SEQ ID NO: 1539154 - RNA, 14 nt, Homo sapiens
accagagcaccuca

SEQ ID NO: 1539155 - RNA, 22 nt, Homo sapiens
accauaaaauaaauaaucucau

SEQ ID NO: 1539156 - RNA, 18 nt, Homo sapiens
accaucaaaaauauucca

SEQ ID NO: 1539157 - RNA, 20 nt, Homo sapiens
accaucucaggccaccugcc

SEQ ID NO: 1539158 - RNA, 11 nt, Homo sapiens
accaugaucac

SEQ ID NO: 1539159 - RNA, 17 nt, Homo sapiens
acccaagagaguggaag

SEQ ID NO: 1539160 - RNA, 13 nt, Homo sapiens
acccacugccaga

SEQ ID NO: 1539161 - RNA, 19 nt, Homo sapiens
acccacugccagacaugcc

SEQ ID NO: 1539162 - RNA, 21 nt, Homo sapiens
acccagauugaagcuaaaaua

SEQ ID NO: 1539163 - RNA, 17 nt, Homo sapiens
acccaguggaaccaaaa

SEQ ID NO: 1539164 - RNA, 13 nt, Homo sapiens
acccaugccauag

SEQ ID NO: 1539165 - RNA, 20 nt, Homo sapiens
accccaggacgcaugcaggg

SEQ ID NO: 1539166 - RNA, 20 nt, Homo sapiens
acccccuccuccagcaauag

SEQ ID NO: 1539167 - RNA, 13 nt, Homo sapiens
accccucuuccca

SEQ ID NO: 1539168 - RNA, 15 nt, Homo sapiens
acccuaaauguggac

SEQ ID NO: 1539169 - RNA, 23 nt, Homo sapiens
acccuaauguggcagcugucuca

SEQ ID NO: 1539170 - RNA, 18 nt, Homo sapiens
acccucaaugccaagaaa

SEQ ID NO: 1539171 - RNA, 19 nt, Homo sapiens
acccucugcuaugucugug

SEQ ID NO: 1539172 - RNA, 17 nt, Homo sapiens
acccugaggguuuccac

SEQ ID NO: 1539173 - RNA, 13 nt, Homo sapiens
agacccagggugg

SEQ ID NO: 1539174 - RNA, 21 nt, Homo sapiens
agaccccuacccuuucccaaa

SEQ ID NO: 1539175 - RNA, 14 nt, Homo sapiens
agacugugauguau

SEQ ID NO: 1539176 - RNA, 17 nt, Homo sapiens
agacuuacuuacuccca

SEQ ID NO: 1539177 - RNA, 14 nt, Homo sapiens
agacuuaggccaga

SEQ ID NO: 1539178 - RNA, 16 nt, Homo sapiens
agagacccccgugcca

SEQ ID NO: 1539179 - RNA, 17 nt, Homo sapiens
agagacgaagaccccag

SEQ ID NO: 1539180 - RNA, 22 nt, Homo sapiens
agagagacccugccaacuuucc

SEQ ID NO: 1539181 - RNA, 14 nt, Homo sapiens
agagaguucucaca

SEQ ID NO: 1539182 - RNA, 12 nt, Homo sapiens
agagaugcagug

SEQ ID NO: 1539183 - RNA, 21 nt, Homo sapiens
agagcauucugggguggggcu

SEQ ID NO: 1539184 - RNA, 19 nt, Homo sapiens
agagccagggcuguccuua

SEQ ID NO: 1539185 - RNA, 17 nt, Homo sapiens
agagccuagaggcucac

SEQ ID NO: 1539186 - RNA, 23 nt, Homo sapiens
agagcuuuacagugccacgacau

SEQ ID NO: 1539187 - RNA, 15 nt, Homo sapiens
agaggaagugcacug

SEQ ID NO: 1539188 - RNA, 17 nt, Homo sapiens
agaggaauccagugaau

SEQ ID NO: 1539189 - RNA, 21 nt, Homo sapiens
agaggacagaucaauggcgca

SEQ ID NO: 1539190 - RNA, 15 nt, Homo sapiens
agaggacggcuuccc

SEQ ID NO: 1539191 - RNA, 15 nt, Homo sapiens
agaggagcgggaccu

SEQ ID NO: 1539192 - RNA, 20 nt, Homo sapiens
agaggagcguguccuauccc

SEQ ID NO: 1539193 - RNA, 15 nt, Homo sapiens
agaggauggcuuccc

SEQ ID NO: 1539194 - RNA, 16 nt, Homo sapiens
agaggcaaccuguuga

SEQ ID NO: 1539195 - RNA, 11 nt, Homo sapiens
agaggcccaag

SEQ ID NO: 1539196 - RNA, 13 nt, Homo sapiens
agagggagugcau

SEQ ID NO: 1539197 - RNA, 12 nt, Homo sapiens
agaguacuuugg

SEQ ID NO: 1539198 - RNA, 13 nt, Homo sapiens
agaguauggauug

SEQ ID NO: 1539199 - RNA, 15 nt, Homo sapiens
agagugcucaaccua

SEQ ID NO: 1539200 - RNA, 20 nt, Homo sapiens
agaguguggaaaaaaaaaga

SEQ ID NO: 1539201 - RNA, 12 nt, Homo sapiens
agaguugaaccu

SEQ ID NO: 1539202 - RNA, 14 nt, Homo sapiens
agauaguaugcacu

SEQ ID NO: 1539203 - RNA, 17 nt, Homo sapiens
agauauucauacuuucc

SEQ ID NO: 1539204 - RNA, 18 nt, Homo sapiens
agauccuccuuccaggcc

SEQ ID NO: 1539205 - RNA, 19 nt, Homo sapiens
agaugaaauuccauuugua

SEQ ID NO: 1539206 - RNA, 15 nt, Homo sapiens
agaugggacaauuag

SEQ ID NO: 1539207 - RNA, 18 nt, Homo sapiens
agaugggaugcuugccua

SEQ ID NO: 1539208 - RNA, 17 nt, Homo sapiens
agauguaccauguuaaa

SEQ ID NO: 1539209 - RNA, 15 nt, Homo sapiens
agaugugccuagaca

SEQ ID NO: 1539210 - RNA, 11 nt, Homo sapiens
agauugccacu

SEQ ID NO: 1539211 - RNA, 19 nt, Homo sapiens
agauugguaguuaucugag

SEQ ID NO: 1539212 - RNA, 15 nt, Homo sapiens
agauuguaaagguag

SEQ ID NO: 1539213 - RNA, 21 nt, Homo sapiens
agauuucccuaaaaauuccac

SEQ ID NO: 1539214 - RNA, 17 nt, Homo sapiens
agauuuuaaaacuucau

SEQ ID NO: 1539215 - RNA, 20 nt, Homo sapiens
agauuuuauuuucaagcaaa

SEQ ID NO: 1539216 - RNA, 23 nt, Homo sapiens
agauuuucauguucuugcaguca

SEQ ID NO: 1539217 - RNA, 17 nt, Homo sapiens
agcaaaaaauaaugaca

SEQ ID NO: 1539218 - RNA, 20 nt, Homo sapiens
agcaaagcaugccaauuucu

SEQ ID NO: 1539219 - RNA, 15 nt, Homo sapiens
agcaaaguaguacuu

SEQ ID NO: 1539220 - RNA, 17 nt, Homo sapiens
agcaaauaaauaucauc

SEQ ID NO: 1539221 - RNA, 19 nt, Homo sapiens
agcaaauauuuaugaccuc

SEQ ID NO: 1539222 - RNA, 23 nt, Homo sapiens
agcaacaugaauuaagaacugac

SEQ ID NO: 1539223 - RNA, 20 nt, Homo sapiens
agcaagcaccugggugugcu

SEQ ID NO: 1539224 - RNA, 15 nt, Homo sapiens
agcacagcuuuccug

SEQ ID NO: 1539225 - RNA, 20 nt, Homo sapiens
agcacaggauuaggacugaa

SEQ ID NO: 1539226 - RNA, 11 nt, Homo sapiens
agcacaugugu

SEQ ID NO: 1539227 - RNA, 17 nt, Homo sapiens
agcaccuacuuacaugc

SEQ ID NO: 1539228 - RNA, 22 nt, Homo sapiens
agcacuucaaaggaacuggaau

SEQ ID NO: 1539229 - RNA, 17 nt, Homo sapiens
agcagagugcacagcug

SEQ ID NO: 1539230 - RNA, 18 nt, Homo sapiens
agcagcacgccaacccca

SEQ ID NO: 1539231 - RNA, 19 nt, Homo sapiens
agcagcacgccaaccccag

SEQ ID NO: 1539232 - RNA, 17 nt, Homo sapiens
agcaugaagauaaaucc

SEQ ID NO: 1539233 - RNA, 19 nt, Homo sapiens
agcaugaagauaaauccaa

SEQ ID NO: 1539234 - RNA, 14 nt, Homo sapiens
agcaugauugugac

SEQ ID NO: 1539235 - RNA, 16 nt, Homo sapiens
agcauguugauucuag

SEQ ID NO: 1539236 - RNA, 16 nt, Homo sapiens
agcauucugucuugaa

SEQ ID NO: 1539237 - RNA, 18 nt, Homo sapiens
agcauuuucugcaucucc

SEQ ID NO: 1539238 - RNA, 16 nt, Homo sapiens
agccaaccccugugga

SEQ ID NO: 1539239 - RNA, 19 nt, Homo sapiens
agccaaggccuaugccacc

SEQ ID NO: 1539240 - RNA, 19 nt, Homo sapiens
agccaauaggcagcuuucu

SEQ ID NO: 1539241 - RNA, 19 nt, Homo sapiens
agccaccauguauguggaa

SEQ ID NO: 1539242 - RNA, 20 nt, Homo sapiens
agccaccccucagacugggu

SEQ ID NO: 1539243 - RNA, 14 nt, Homo sapiens
agccacccugccau

SEQ ID NO: 1539244 - RNA, 16 nt, Homo sapiens
agccacccugccaugg

SEQ ID NO: 1539245 - RNA, 16 nt, Homo sapiens
agccagaggcucuaau

SEQ ID NO: 1539246 - RNA, 23 nt, Homo sapiens
agccagcagggcgggccaggaga

SEQ ID NO: 1539247 - RNA, 14 nt, Homo sapiens
agccagucccucag

SEQ ID NO: 1539248 - RNA, 17 nt, Homo sapiens
agcccaggacacugccu

SEQ ID NO: 1539249 - RNA, 21 nt, Homo sapiens
agccccagggcccugcucagg

SEQ ID NO: 1539250 - RNA, 15 nt, Homo sapiens
agcccccuguccuuc

SEQ ID NO: 1539251 - RNA, 22 nt, Homo sapiens
agcccugaguuucaaguauccu

SEQ ID NO: 1539252 - RNA, 16 nt, Homo sapiens
agccguuggcaccucu

SEQ ID NO: 1539253 - RNA, 15 nt, Homo sapiens
agccuagaggaggaa

SEQ ID NO: 1539254 - RNA, 20 nt, Homo sapiens
agccucaugggagucaggga

SEQ ID NO: 1539255 - RNA, 21 nt, Homo sapiens
agccucuccaaggguuuucac

SEQ ID NO: 1539256 - RNA, 16 nt, Homo sapiens
agccugcagacucacu

SEQ ID NO: 1539257 - RNA, 20 nt, Homo sapiens
agccugcagacucacugugg

SEQ ID NO: 1539258 - RNA, 14 nt, Homo sapiens
agccuggaggacaa

SEQ ID NO: 1539259 - RNA, 14 nt, Homo sapiens
agccugggccacug

SEQ ID NO: 1539260 - RNA, 22 nt, Homo sapiens
agccuguguuagugucugucca

SEQ ID NO: 1539261 - RNA, 19 nt, Homo sapiens
agccuuaagucuuacuguu

SEQ ID NO: 1539262 - RNA, 19 nt, Homo sapiens
agccuuggggauucuucca

SEQ ID NO: 1539263 - RNA, 15 nt, Homo sapiens
agcguguacuacccc

SEQ ID NO: 1539264 - RNA, 19 nt, Homo sapiens
agcuaaaaccuuccauguc

SEQ ID NO: 1539265 - RNA, 13 nt, Homo sapiens
agcuaacacuggc

SEQ ID NO: 1539266 - RNA, 15 nt, Homo sapiens
agcuaagccugauga

SEQ ID NO: 1539267 - RNA, 20 nt, Homo sapiens
agcuaaggaggccguucagc

SEQ ID NO: 1539268 - RNA, 18 nt, Homo sapiens
agcuaugaaggcuguaca

SEQ ID NO: 1539269 - RNA, 16 nt, Homo sapiens
agcuccauaauugcaa

SEQ ID NO: 1539270 - RNA, 19 nt, Homo sapiens
agcuccauaauugcaaggg

SEQ ID NO: 1539271 - RNA, 19 nt, Homo sapiens
agcucccaggacgcaggga

SEQ ID NO: 1539272 - RNA, 13 nt, Homo sapiens
agcugaagcguua

SEQ ID NO: 1539273 - RNA, 18 nt, Homo sapiens
agcugcaguuagcacaga

SEQ ID NO: 1539274 - RNA, 16 nt, Homo sapiens
agcugcucauuucacu

SEQ ID NO: 1539275 - RNA, 16 nt, Homo sapiens
agcugcugacucacuu

SEQ ID NO: 1539276 - RNA, 14 nt, Homo sapiens
agcugcuucugccc

SEQ ID NO: 1539277 - RNA, 18 nt, Homo sapiens
agcugucucaaaccucca

SEQ ID NO: 1539278 - RNA, 15 nt, Homo sapiens
agcuucagaugguga

SEQ ID NO: 1539279 - RNA, 18 nt, Homo sapiens
agcuucuagcagcuaagg

SEQ ID NO: 1539280 - RNA, 12 nt, Homo sapiens
agcuuuucugca

SEQ ID NO: 1539281 - RNA, 20 nt, Homo sapiens
aggaaaaucuuaaaauucuu

SEQ ID NO: 1539282 - RNA, 13 nt, Homo sapiens
aggaacuggucca

SEQ ID NO: 1539283 - RNA, 14 nt, Homo sapiens
aggaacugguccag

SEQ ID NO: 1539284 - RNA, 12 nt, Homo sapiens
aggaagaaggcc

SEQ ID NO: 1539285 - RNA, 16 nt, Homo sapiens
aggaagccacugccag

SEQ ID NO: 1539286 - RNA, 15 nt, Homo sapiens
aggaagggacugguc

SEQ ID NO: 1539287 - RNA, 17 nt, Homo sapiens
aggaagggacuggucca

SEQ ID NO: 1539288 - RNA, 21 nt, Homo sapiens
aggaagggacugguccaggca

SEQ ID NO: 1539289 - RNA, 14 nt, Homo sapiens
aggaauccagugaa

SEQ ID NO: 1539290 - RNA, 13 nt, Homo sapiens
aggacgcaugcag

SEQ ID NO: 1539291 - RNA, 16 nt, Homo sapiens
aggagcuaaacaugcu

SEQ ID NO: 1539292 - RNA, 14 nt, Homo sapiens
aggaggaacugguc

SEQ ID NO: 1539293 - RNA, 20 nt, Homo sapiens
aggaggaacugguccaggcc

SEQ ID NO: 1539294 - RNA, 22 nt, Homo sapiens
aggaggagaaaucucacuuuuc

SEQ ID NO: 1539295 - RNA, 15 nt, Homo sapiens
aggaggugccugaga

SEQ ID NO: 1539296 - RNA, 13 nt, Homo sapiens
aggaguucuaaca

SEQ ID NO: 1539297 - RNA, 22 nt, Homo sapiens
aggaucuucccacuuugccacu

SEQ ID NO: 1539298 - RNA, 17 nt, Homo sapiens
aggauuuuaaaugcugu

SEQ ID NO: 1539299 - RNA, 20 nt, Homo sapiens
aggcaauggugaacugucau

SEQ ID NO: 1539300 - RNA, 12 nt, Homo sapiens
aggcaguggcuu

SEQ ID NO: 1539301 - RNA, 16 nt, Homo sapiens
aggccagaggugaaca

SEQ ID NO: 1539302 - RNA, 14 nt, Homo sapiens
aggcccacauugcc

SEQ ID NO: 1539303 - RNA, 20 nt, Homo sapiens
aggccgggcacgguggcuca

SEQ ID NO: 1539304 - RNA, 18 nt, Homo sapiens
aggccuaugccaccugca

SEQ ID NO: 1539305 - RNA, 13 nt, Homo sapiens
aggccucagggac

SEQ ID NO: 1539306 - RNA, 15 nt, Homo sapiens
acccuggauuugcau

SEQ ID NO: 1539307 - RNA, 17 nt, Homo sapiens
acccugggucaccuucc

SEQ ID NO: 1539308 - RNA, 15 nt, Homo sapiens
accuacuuacaugca

SEQ ID NO: 1539309 - RNA, 18 nt, Homo sapiens
accuacuuacaugcauua

SEQ ID NO: 1539310 - RNA, 12 nt, Homo sapiens
accuaggagcag

SEQ ID NO: 1539311 - RNA, 17 nt, Homo sapiens
accuaugugugugcuuu

SEQ ID NO: 1539312 - RNA, 17 nt, Homo sapiens
accucguugacaugcac

SEQ ID NO: 1539313 - RNA, 21 nt, Homo sapiens
accucuccccuggaacugucu

SEQ ID NO: 1539314 - RNA, 15 nt, Homo sapiens
accucugaucaaagc

SEQ ID NO: 1539315 - RNA, 19 nt, Homo sapiens
accucugaucaaagcaccu

SEQ ID NO: 1539316 - RNA, 14 nt, Homo sapiens
accucuuagcuuuu

SEQ ID NO: 1539317 - RNA, 18 nt, Homo sapiens
accugauuuccauuugca

SEQ ID NO: 1539318 - RNA, 22 nt, Homo sapiens
accuggcuucccaggacccugg

SEQ ID NO: 1539319 - RNA, 15 nt, Homo sapiens
accugggcccuaggc

SEQ ID NO: 1539320 - RNA, 21 nt, Homo sapiens
accuucaguaaacaccaugaa

SEQ ID NO: 1539321 - RNA, 14 nt, Homo sapiens
accuuccaugucaa

SEQ ID NO: 1539322 - RNA, 23 nt, Homo sapiens
accuucuaauccaugugcugcug

SEQ ID NO: 1539323 - RNA, 17 nt, Homo sapiens
accuucugaagaucuca

SEQ ID NO: 1539324 - RNA, 20 nt, Homo sapiens
accuucuguggcucacagaa

SEQ ID NO: 1539325 - RNA, 11 nt, Homo sapiens
accuugcccau

SEQ ID NO: 1539326 - RNA, 18 nt, Homo sapiens
acgaaacacagaacucag

SEQ ID NO: 1539327 - RNA, 19 nt, Homo sapiens
acgcaagccucagccacuc

SEQ ID NO: 1539328 - RNA, 20 nt, Homo sapiens
acgcacacacacacacagga

SEQ ID NO: 1539329 - RNA, 20 nt, Homo sapiens
acgcagccugcagacucacu

SEQ ID NO: 1539330 - RNA, 22 nt, Homo sapiens
acgcagccugcagacucacugu

SEQ ID NO: 1539331 - RNA, 12 nt, Homo sapiens
acgcaugcaggg

SEQ ID NO: 1539332 - RNA, 15 nt, Homo sapiens
acgcugucuccagac

SEQ ID NO: 1539333 - RNA, 12 nt, Homo sapiens
acggccacugca

SEQ ID NO: 1539334 - RNA, 23 nt, Homo sapiens
acggccugagaggagcguguccu

SEQ ID NO: 1539335 - RNA, 16 nt, Homo sapiens
acggcugcaccugcag

SEQ ID NO: 1539336 - RNA, 20 nt, Homo sapiens
acgguuucuuuguuacuuua

SEQ ID NO: 1539337 - RNA, 14 nt, Homo sapiens
acgugucaaugugu

SEQ ID NO: 1539338 - RNA, 15 nt, Homo sapiens
acguuaagugaugaa

SEQ ID NO: 1539339 - RNA, 13 nt, Homo sapiens
acguuugccaaau

SEQ ID NO: 1539340 - RNA, 14 nt, Homo sapiens
acuaaacauuuugu

SEQ ID NO: 1539341 - RNA, 12 nt, Homo sapiens
acuaacacuggc

SEQ ID NO: 1539342 - RNA, 13 nt, Homo sapiens
acuaacacuggcu

SEQ ID NO: 1539343 - RNA, 19 nt, Homo sapiens
acuacagccaaauugcaga

SEQ ID NO: 1539344 - RNA, 23 nt, Homo sapiens
acuacagccaaauugcagaagaa

SEQ ID NO: 1539345 - RNA, 13 nt, Homo sapiens
acuacaugcacuu

SEQ ID NO: 1539346 - RNA, 21 nt, Homo sapiens
acuaccuuuggcuuaauucca

SEQ ID NO: 1539347 - RNA, 14 nt, Homo sapiens
acuacgacuggcau

SEQ ID NO: 1539348 - RNA, 20 nt, Homo sapiens
acuaguuagauucacuuuga

SEQ ID NO: 1539349 - RNA, 16 nt, Homo sapiens
acuauccucuuuggaa

SEQ ID NO: 1539350 - RNA, 15 nt, Homo sapiens
acuauguagucuguu

SEQ ID NO: 1539351 - RNA, 20 nt, Homo sapiens
acuauguuuagugugauugu

SEQ ID NO: 1539352 - RNA, 18 nt, Homo sapiens
acucaaggccuccagcca

SEQ ID NO: 1539353 - RNA, 14 nt, Homo sapiens
acucaccaaaauau

SEQ ID NO: 1539354 - RNA, 17 nt, Homo sapiens
acucaccccuucuaauc

SEQ ID NO: 1539355 - RNA, 20 nt, Homo sapiens
acucagaucaaaaaugggca

SEQ ID NO: 1539356 - RNA, 22 nt, Homo sapiens
acucagccuuaagaaagcuaua

SEQ ID NO: 1539357 - RNA, 14 nt, Homo sapiens
acucccauuuuccc

SEQ ID NO: 1539358 - RNA, 22 nt, Homo sapiens
acuccuuuccugcaaacccauu

SEQ ID NO: 1539359 - RNA, 18 nt, Homo sapiens
acucuucuuguaaaucac

SEQ ID NO: 1539360 - RNA, 23 nt, Homo sapiens
acugaaggcuuucagggccucca

SEQ ID NO: 1539361 - RNA, 19 nt, Homo sapiens
acugacuccaaccauucaa

SEQ ID NO: 1539362 - RNA, 16 nt, Homo sapiens
acugcaugcaagcuca

SEQ ID NO: 1539363 - RNA, 15 nt, Homo sapiens
acugcaugcacuucu

SEQ ID NO: 1539364 - RNA, 22 nt, Homo sapiens
acugcugcgcugugcuggucuc

SEQ ID NO: 1539365 - RNA, 21 nt, Homo sapiens
acugcuuugagaaaucucauc

SEQ ID NO: 1539366 - RNA, 21 nt, Homo sapiens
acuggagcguguacuacccca

SEQ ID NO: 1539367 - RNA, 20 nt, Homo sapiens
acuggaucucuuaagacagc

SEQ ID NO: 1539368 - RNA, 16 nt, Homo sapiens
acuggcaacaguugga

SEQ ID NO: 1539369 - RNA, 17 nt, Homo sapiens
acugggcuggcugccuu

SEQ ID NO: 1539370 - RNA, 20 nt, Homo sapiens
acuggguuccucuccaagcu

SEQ ID NO: 1539371 - RNA, 20 nt, Homo sapiens
acugguugguguucuuccca

SEQ ID NO: 1539372 - RNA, 16 nt, Homo sapiens
acuguaaaagauucau

SEQ ID NO: 1539373 - RNA, 18 nt, Homo sapiens
acuguauauuuguaugau

SEQ ID NO: 1539374 - RNA, 15 nt, Homo sapiens
acuguccauuccaaa

SEQ ID NO: 1539375 - RNA, 14 nt, Homo sapiens
acugugacacagcu

SEQ ID NO: 1539376 - RNA, 20 nt, Homo sapiens
acugugcguuuuagaguaug

SEQ ID NO: 1539377 - RNA, 22 nt, Homo sapiens
acuguuaaauaaggccucaucc

SEQ ID NO: 1539378 - RNA, 13 nt, Homo sapiens
acuguucaugaau

SEQ ID NO: 1539379 - RNA, 11 nt, Homo sapiens
acuuacaugau

SEQ ID NO: 1539380 - RNA, 14 nt, Homo sapiens
acuuacaugauuca

SEQ ID NO: 1539381 - RNA, 14 nt, Homo sapiens
acuuacaugcauua

SEQ ID NO: 1539382 - RNA, 20 nt, Homo sapiens
acuuacccuaaaacaugugu

SEQ ID NO: 1539383 - RNA, 14 nt, Homo sapiens
acuuaucaguuugc

SEQ ID NO: 1539384 - RNA, 14 nt, Homo sapiens
acuucagacucucu

SEQ ID NO: 1539385 - RNA, 16 nt, Homo sapiens
acuuccuguccagaga

SEQ ID NO: 1539386 - RNA, 19 nt, Homo sapiens
acuucguguccgacucuuc

SEQ ID NO: 1539387 - RNA, 21 nt, Homo sapiens
acuucuuaacuggcaacaguu

SEQ ID NO: 1539388 - RNA, 24 nt, Homo sapiens
acuucuuacaauaauucuaugaga

SEQ ID NO: 1539389 - RNA, 23 nt, Homo sapiens
acuucuucuguaauauuuacaau

SEQ ID NO: 1539390 - RNA, 20 nt, Homo sapiens
acuucuuuacuaacacuggc

SEQ ID NO: 1539391 - RNA, 19 nt, Homo sapiens
acuucuuuauucacaguau

SEQ ID NO: 1539392 - RNA, 15 nt, Homo sapiens
acuugaaaaccucau

SEQ ID NO: 1539393 - RNA, 14 nt, Homo sapiens
acuugacuuugcca

SEQ ID NO: 1539394 - RNA, 15 nt, Homo sapiens
acuugacuuugccac

SEQ ID NO: 1539395 - RNA, 20 nt, Homo sapiens
acuugcucaauaaaggucau

SEQ ID NO: 1539396 - RNA, 20 nt, Homo sapiens
acuugggacggaaguggccu

SEQ ID NO: 1539397 - RNA, 17 nt, Homo sapiens
acuuguagggaugccuu

SEQ ID NO: 1539398 - RNA, 12 nt, Homo sapiens
acuuuaccaugc

SEQ ID NO: 1539399 - RNA, 17 nt, Homo sapiens
acuuuaccaugcucaau

SEQ ID NO: 1539400 - RNA, 22 nt, Homo sapiens
acuuuccccgugggccauggca

SEQ ID NO: 1539401 - RNA, 14 nt, Homo sapiens
acuuugugcaauau

SEQ ID NO: 1539402 - RNA, 19 nt, Homo sapiens
acuuuguuucauauucuca

SEQ ID NO: 1539403 - RNA, 20 nt, Homo sapiens
acuuuuuauucucaguuuaa

SEQ ID NO: 1539404 - RNA, 17 nt, Homo sapiens
agaaaauaaauacauaa

SEQ ID NO: 1539405 - RNA, 19 nt, Homo sapiens
agaaacugaggccauuauu

SEQ ID NO: 1539406 - RNA, 23 nt, Homo sapiens
agaaacugaggccauuauuucaa

SEQ ID NO: 1539407 - RNA, 18 nt, Homo sapiens
agaaagauuuuaugugcu

SEQ ID NO: 1539408 - RNA, 17 nt, Homo sapiens
agaaauaauacccugcc

SEQ ID NO: 1539409 - RNA, 16 nt, Homo sapiens
agaaauccuacagcau

SEQ ID NO: 1539410 - RNA, 21 nt, Homo sapiens
agaaauuuuaucucuucuucc

SEQ ID NO: 1539411 - RNA, 13 nt, Homo sapiens
agaacgcaugcag

SEQ ID NO: 1539412 - RNA, 13 nt, Homo sapiens
agaacugagcucc

SEQ ID NO: 1539413 - RNA, 13 nt, Homo sapiens
agaacuguucauu

SEQ ID NO: 1539414 - RNA, 17 nt, Homo sapiens
agaacuguucauuucca

SEQ ID NO: 1539415 - RNA, 23 nt, Homo sapiens
agaagaaacuccuggaucccuuu

SEQ ID NO: 1539416 - RNA, 18 nt, Homo sapiens
agaagagaguauggugcu

SEQ ID NO: 1539417 - RNA, 13 nt, Homo sapiens
agaaggcaaccca

SEQ ID NO: 1539418 - RNA, 13 nt, Homo sapiens
agaagggggccau

SEQ ID NO: 1539419 - RNA, 17 nt, Homo sapiens
agaagggggccaugagg

SEQ ID NO: 1539420 - RNA, 12 nt, Homo sapiens
agaagguggucu

SEQ ID NO: 1539421 - RNA, 15 nt, Homo sapiens
agaagguugugauga

SEQ ID NO: 1539422 - RNA, 20 nt, Homo sapiens
agaauaaagccuugugauca

SEQ ID NO: 1539423 - RNA, 14 nt, Homo sapiens
agaauacacuauca

SEQ ID NO: 1539424 - RNA, 15 nt, Homo sapiens
agaaucaagucugug

SEQ ID NO: 1539425 - RNA, 21 nt, Homo sapiens
agaauccccgaaaccuccuau

SEQ ID NO: 1539426 - RNA, 18 nt, Homo sapiens
agaaucgaccucacuguc

SEQ ID NO: 1539427 - RNA, 16 nt, Homo sapiens
agaauggaagccucca

SEQ ID NO: 1539428 - RNA, 15 nt, Homo sapiens
agaaugucaguugau

SEQ ID NO: 1539429 - RNA, 23 nt, Homo sapiens
agaauuagauuuuaaaacuucau

SEQ ID NO: 1539430 - RNA, 19 nt, Homo sapiens
agaauucacuuuaccuuca

SEQ ID NO: 1539431 - RNA, 17 nt, Homo sapiens
agacaaaauugaugauc

SEQ ID NO: 1539432 - RNA, 13 nt, Homo sapiens
agacaaauugauc

SEQ ID NO: 1539433 - RNA, 22 nt, Homo sapiens
agacaacccugcaaaggacugu

SEQ ID NO: 1539434 - RNA, 14 nt, Homo sapiens
agacacgaaauugg

SEQ ID NO: 1539435 - RNA, 17 nt, Homo sapiens
agacacuguucccaaag

SEQ ID NO: 1539436 - RNA, 14 nt, Homo sapiens
agacaguaaagacc

SEQ ID NO: 1539437 - RNA, 23 nt, Homo sapiens
agacaugaaauugagucauuuua

SEQ ID NO: 1539438 - RNA, 17 nt, Homo sapiens
cacacccccuuuccauc

SEQ ID NO: 1539439 - RNA, 17 nt, Homo sapiens
cacaccugcacaccccu

SEQ ID NO: 1539440 - RNA, 16 nt, Homo sapiens
cacaccugcacaccgu

SEQ ID NO: 1539441 - RNA, 20 nt, Homo sapiens
cacaccuugcccaugcacaa

SEQ ID NO: 1539442 - RNA, 14 nt, Homo sapiens
cacagaacucagcc

SEQ ID NO: 1539443 - RNA, 22 nt, Homo sapiens
cacagaaggaaggagccagcuc

SEQ ID NO: 1539444 - RNA, 13 nt, Homo sapiens
cacagaggcagug

SEQ ID NO: 1539445 - RNA, 14 nt, Homo sapiens
cacagcuaugaagg

SEQ ID NO: 1539446 - RNA, 22 nt, Homo sapiens
cacagucuggugcccagacuca

SEQ ID NO: 1539447 - RNA, 13 nt, Homo sapiens
cacagugcaucuc

SEQ ID NO: 1539448 - RNA, 16 nt, Homo sapiens
cacauaguguuuguaa

SEQ ID NO: 1539449 - RNA, 14 nt, Homo sapiens
cacauauauuucca

SEQ ID NO: 1539450 - RNA, 22 nt, Homo sapiens
cacaucuggagcugaagcguua

SEQ ID NO: 1539451 - RNA, 19 nt, Homo sapiens
cacauguaucuaugcauuu

SEQ ID NO: 1539452 - RNA, 13 nt, Homo sapiens
caccaugaucacu

SEQ ID NO: 1539453 - RNA, 13 nt, Homo sapiens
cacccaggcacuu

SEQ ID NO: 1539454 - RNA, 23 nt, Homo sapiens
cacccucugcuaugucugugaug

SEQ ID NO: 1539455 - RNA, 17 nt, Homo sapiens
cacccuggauuugcaua

SEQ ID NO: 1539456 - RNA, 16 nt, Homo sapiens
caccgagaggaaaaag

SEQ ID NO: 1539457 - RNA, 22 nt, Homo sapiens
caccgagaggaaaaaggcuucu

SEQ ID NO: 1539458 - RNA, 16 nt, Homo sapiens
caccgaggaguccagu

SEQ ID NO: 1539459 - RNA, 23 nt, Homo sapiens
caccgguguccuguuccugccac

SEQ ID NO: 1539460 - RNA, 18 nt, Homo sapiens
caccuaauaaagaaauaa

SEQ ID NO: 1539461 - RNA, 18 nt, Homo sapiens
caccuacuuacaugcauu

SEQ ID NO: 1539462 - RNA, 17 nt, Homo sapiens
caccuaugucauuucau

SEQ ID NO: 1539463 - RNA, 22 nt, Homo sapiens
caccuggauggaucugcuccau

SEQ ID NO: 1539464 - RNA, 15 nt, Homo sapiens
caccuggauucccug

SEQ ID NO: 1539465 - RNA, 16 nt, Homo sapiens
caccuuaaaauuagca

SEQ ID NO: 1539466 - RNA, 16 nt, Homo sapiens
cacgaucguuaugcug

SEQ ID NO: 1539467 - RNA, 19 nt, Homo sapiens
cacgccacaacuccagugu

SEQ ID NO: 1539468 - RNA, 23 nt, Homo sapiens
cacgccacaacuccaguguuccc

SEQ ID NO: 1539469 - RNA, 18 nt, Homo sapiens
cacgccugcgauggugcu

SEQ ID NO: 1539470 - RNA, 13 nt, Homo sapiens
cacgggugcauga

SEQ ID NO: 1539471 - RNA, 13 nt, Homo sapiens
cacgugcacacac

SEQ ID NO: 1539472 - RNA, 19 nt, Homo sapiens
cacuccagaacaaaccucu

SEQ ID NO: 1539473 - RNA, 16 nt, Homo sapiens
cacugaguagucauuu

SEQ ID NO: 1539474 - RNA, 16 nt, Homo sapiens
cacuggagcguguacu

SEQ ID NO: 1539475 - RNA, 17 nt, Homo sapiens
cacuggcccucuuugaa

SEQ ID NO: 1539476 - RNA, 21 nt, Homo sapiens
cacugugucccucucucugga

SEQ ID NO: 1539477 - RNA, 21 nt, Homo sapiens
cacuucgaugacuggauacag

SEQ ID NO: 1539478 - RNA, 15 nt, Homo sapiens
cacuugacuuugcca

SEQ ID NO: 1539479 - RNA, 20 nt, Homo sapiens
cacuuuaccuucagcaguua

SEQ ID NO: 1539480 - RNA, 21 nt, Homo sapiens
cacuuuccccgugggccaugg

SEQ ID NO: 1539481 - RNA, 16 nt, Homo sapiens
cacuuucugaaauuca

SEQ ID NO: 1539482 - RNA, 14 nt, Homo sapiens
cacuuuucauauca

SEQ ID NO: 1539483 - RNA, 17 nt, Homo sapiens
cagaaacugaacuggcc

SEQ ID NO: 1539484 - RNA, 23 nt, Homo sapiens
cagaaagcaucuauucccaaaga

SEQ ID NO: 1539485 - RNA, 20 nt, Homo sapiens
cagaagaaagauugcuauaa

SEQ ID NO: 1539486 - RNA, 21 nt, Homo sapiens
cagaagcuccgugagccucag

SEQ ID NO: 1539487 - RNA, 15 nt, Homo sapiens
cagacaaauguaaca

SEQ ID NO: 1539488 - RNA, 12 nt, Homo sapiens
cagacauugugc

SEQ ID NO: 1539489 - RNA, 14 nt, Homo sapiens
cagacccagggugg

SEQ ID NO: 1539490 - RNA, 19 nt, Homo sapiens
cagacucaaggccuccagc

SEQ ID NO: 1539491 - RNA, 13 nt, Homo sapiens
cagacucacugug

SEQ ID NO: 1539492 - RNA, 15 nt, Homo sapiens
cagacucacuguggg

SEQ ID NO: 1539493 - RNA, 16 nt, Homo sapiens
cagacucacuguggga

SEQ ID NO: 1539494 - RNA, 20 nt, Homo sapiens
cagagacauacaccuauguc

SEQ ID NO: 1539495 - RNA, 22 nt, Homo sapiens
cagagacauacaccuaugucau

SEQ ID NO: 1539496 - RNA, 22 nt, Homo sapiens
cagagcgccccucccuagugac

SEQ ID NO: 1539497 - RNA, 20 nt, Homo sapiens
cagagcucagcacagccuca

SEQ ID NO: 1539498 - RNA, 20 nt, Homo sapiens
cagagcuccacagaagacac

SEQ ID NO: 1539499 - RNA, 19 nt, Homo sapiens
cagagcuuuacagugccac

SEQ ID NO: 1539500 - RNA, 22 nt, Homo sapiens
cagagcuuuacagugccacgac

SEQ ID NO: 1539501 - RNA, 18 nt, Homo sapiens
cagaggccuggugcccug

SEQ ID NO: 1539502 - RNA, 19 nt, Homo sapiens
cagaggcucuaauguacaa

SEQ ID NO: 1539503 - RNA, 14 nt, Homo sapiens
cagaggguugugau

SEQ ID NO: 1539504 - RNA, 19 nt, Homo sapiens
cagauauuaaauaacagug

SEQ ID NO: 1539505 - RNA, 21 nt, Homo sapiens
cagauuugcaaaguuuaaugg

SEQ ID NO: 1539506 - RNA, 20 nt, Homo sapiens
cagcaacggggaggccaagu

SEQ ID NO: 1539507 - RNA, 16 nt, Homo sapiens
cagcaauaauugacaa

SEQ ID NO: 1539508 - RNA, 22 nt, Homo sapiens
cagcacuaaacuuggugcuuau

SEQ ID NO: 1539509 - RNA, 17 nt, Homo sapiens
cagcaguuuucuuuuaa

SEQ ID NO: 1539510 - RNA, 16 nt, Homo sapiens
cagcauaaagcacauu

SEQ ID NO: 1539511 - RNA, 23 nt, Homo sapiens
cagcaucugccaggacacugccu

SEQ ID NO: 1539512 - RNA, 17 nt, Homo sapiens
cagcauggaaacaagau

SEQ ID NO: 1539513 - RNA, 15 nt, Homo sapiens
cagccaaaaguaagu

SEQ ID NO: 1539514 - RNA, 19 nt, Homo sapiens
cagccacacccaggcacuu

SEQ ID NO: 1539515 - RNA, 16 nt, Homo sapiens
cagccaccaccuggau

SEQ ID NO: 1539516 - RNA, 17 nt, Homo sapiens
cagcccacauccauucc

SEQ ID NO: 1539517 - RNA, 23 nt, Homo sapiens
cagccccccaguguccccagggg

SEQ ID NO: 1539518 - RNA, 13 nt, Homo sapiens
cagccggggagcu

SEQ ID NO: 1539519 - RNA, 21 nt, Homo sapiens
cagccugcagacucacugugg

SEQ ID NO: 1539520 - RNA, 16 nt, Homo sapiens
cagccuguaacugucc

SEQ ID NO: 1539521 - RNA, 17 nt, Homo sapiens
cagcuaagccugaugau

SEQ ID NO: 1539522 - RNA, 16 nt, Homo sapiens
cagcucccagcccacu

SEQ ID NO: 1539523 - RNA, 17 nt, Homo sapiens
cagcuccuuucccugga

SEQ ID NO: 1539524 - RNA, 18 nt, Homo sapiens
cagcugccagagaagcau

SEQ ID NO: 1539525 - RNA, 17 nt, Homo sapiens
cagcuucaggugagcca

SEQ ID NO: 1539526 - RNA, 14 nt, Homo sapiens
caggaaauaguguu

SEQ ID NO: 1539527 - RNA, 14 nt, Homo sapiens
caggaaauucuguu

SEQ ID NO: 1539528 - RNA, 21 nt, Homo sapiens
caggaaggcggggcuucaacc

SEQ ID NO: 1539529 - RNA, 14 nt, Homo sapiens
caggagagcccucu

SEQ ID NO: 1539530 - RNA, 19 nt, Homo sapiens
caggagaggagcgggaccu

SEQ ID NO: 1539531 - RNA, 17 nt, Homo sapiens
caggaggaacuggucca

SEQ ID NO: 1539532 - RNA, 14 nt, Homo sapiens
caggauaccauaua

SEQ ID NO: 1539533 - RNA, 18 nt, Homo sapiens
caggauguguggcucauu

SEQ ID NO: 1539534 - RNA, 15 nt, Homo sapiens
caggccacccaggga

SEQ ID NO: 1539535 - RNA, 18 nt, Homo sapiens
caggccaggagacuguua

SEQ ID NO: 1539536 - RNA, 14 nt, Homo sapiens
caggccaggccuca

SEQ ID NO: 1539537 - RNA, 20 nt, Homo sapiens
caggccccuuuggaccugca

SEQ ID NO: 1539538 - RNA, 21 nt, Homo sapiens
caggcccuuccucuccacugc

SEQ ID NO: 1539539 - RNA, 14 nt, Homo sapiens
caggccucagggac

SEQ ID NO: 1539540 - RNA, 17 nt, Homo sapiens
caggccuuuuugagcca

SEQ ID NO: 1539541 - RNA, 17 nt, Homo sapiens
cagggaccaagauguca

SEQ ID NO: 1539542 - RNA, 13 nt, Homo sapiens
cagggaccaagga

SEQ ID NO: 1539543 - RNA, 16 nt, Homo sapiens
cagggaccaaggagau

SEQ ID NO: 1539544 - RNA, 22 nt, Homo sapiens
cagggagcccugggguuuccac

SEQ ID NO: 1539545 - RNA, 14 nt, Homo sapiens
cagggcaaucaaug

SEQ ID NO: 1539546 - RNA, 18 nt, Homo sapiens
cagggcccccacaggagc

SEQ ID NO: 1539547 - RNA, 15 nt, Homo sapiens
cagggccuccagccc

SEQ ID NO: 1539548 - RNA, 17 nt, Homo sapiens
caggggcugcauccuca

SEQ ID NO: 1539549 - RNA, 18 nt, Homo sapiens
caggggcugcauccucag

SEQ ID NO: 1539550 - RNA, 18 nt, Homo sapiens
cagggggaagcaccagcc

SEQ ID NO: 1539551 - RNA, 22 nt, Homo sapiens
caggguguuaaggcagugacuu

SEQ ID NO: 1539552 - RNA, 14 nt, Homo sapiens
caggugugggcucc

SEQ ID NO: 1539553 - RNA, 22 nt, Homo sapiens
cagguugugugugugugcagug

SEQ ID NO: 1539554 - RNA, 17 nt, Homo sapiens
caguaacucaucuguca

SEQ ID NO: 1539555 - RNA, 23 nt, Homo sapiens
caguaagaucaagcuccaucuua

SEQ ID NO: 1539556 - RNA, 20 nt, Homo sapiens
caguaagcugcucuauugua

SEQ ID NO: 1539557 - RNA, 19 nt, Homo sapiens
caguaaucaguuugcuaac

SEQ ID NO: 1539558 - RNA, 21 nt, Homo sapiens
caguacuugugaaacacagcu

SEQ ID NO: 1539559 - RNA, 20 nt, Homo sapiens
cagucuggugcccagacuca

SEQ ID NO: 1539560 - RNA, 12 nt, Homo sapiens
cagucuuggaau

SEQ ID NO: 1539561 - RNA, 18 nt, Homo sapiens
cagugauugaaguaucug

SEQ ID NO: 1539562 - RNA, 18 nt, Homo sapiens
cagugccacgacauggcu

SEQ ID NO: 1539563 - RNA, 13 nt, Homo sapiens
cagugccucuggu

SEQ ID NO: 1539564 - RNA, 20 nt, Homo sapiens
caguggagaggggacuugga

SEQ ID NO: 1539565 - RNA, 15 nt, Homo sapiens
caguguuuccaguga

SEQ ID NO: 1539566 - RNA, 18 nt, Homo sapiens
caguguuuccagugacac

SEQ ID NO: 1539567 - RNA, 14 nt, Homo sapiens
caguuaaaggcaac

SEQ ID NO: 1539568 - RNA, 21 nt, Homo sapiens
caguuaauuuauuauuuuguu

SEQ ID NO: 1539569 - RNA, 21 nt, Homo sapiens
auucauuuuaacaucugagaa

SEQ ID NO: 1539570 - RNA, 16 nt, Homo sapiens
auuccaaucauuguua

SEQ ID NO: 1539571 - RNA, 22 nt, Homo sapiens
auuccaaucauuguuaaaguaa

SEQ ID NO: 1539572 - RNA, 22 nt, Homo sapiens
auucccaugguagacugugaca

SEQ ID NO: 1539573 - RNA, 15 nt, Homo sapiens
auucuaaaagauaag

SEQ ID NO: 1539574 - RNA, 20 nt, Homo sapiens
auucuagucucugauuugca

SEQ ID NO: 1539575 - RNA, 20 nt, Homo sapiens
auucuaugccuguauuucca

SEQ ID NO: 1539576 - RNA, 18 nt, Homo sapiens
auucugaaggccuuguua

SEQ ID NO: 1539577 - RNA, 20 nt, Homo sapiens
auucugaaggccuuguuaaa

SEQ ID NO: 1539578 - RNA, 20 nt, Homo sapiens
auugaacuguaaauauguca

SEQ ID NO: 1539579 - RNA, 15 nt, Homo sapiens
auugaagacccucaa

SEQ ID NO: 1539580 - RNA, 17 nt, Homo sapiens
auugaaggauugugaac

SEQ ID NO: 1539581 - RNA, 19 nt, Homo sapiens
auugaaucugauuggacau

SEQ ID NO: 1539582 - RNA, 13 nt, Homo sapiens
auugaaugugauu

SEQ ID NO: 1539583 - RNA, 15 nt, Homo sapiens
auugacaagguguuu

SEQ ID NO: 1539584 - RNA, 16 nt, Homo sapiens
auugauuaaugaacua

SEQ ID NO: 1539585 - RNA, 12 nt, Homo sapiens
auugcccaugau

SEQ ID NO: 1539586 - RNA, 16 nt, Homo sapiens
auugcugaaugcaaga

SEQ ID NO: 1539587 - RNA, 17 nt, Homo sapiens
auuggcaggugugggcu

SEQ ID NO: 1539588 - RNA, 14 nt, Homo sapiens
auugguucaugccu

SEQ ID NO: 1539589 - RNA, 17 nt, Homo sapiens
auuguauaaaacagugu

SEQ ID NO: 1539590 - RNA, 14 nt, Homo sapiens
auugucaccaugau

SEQ ID NO: 1539591 - RNA, 14 nt, Homo sapiens
auugucucaaagac

SEQ ID NO: 1539592 - RNA, 20 nt, Homo sapiens
auugucuccuugguuauauu

SEQ ID NO: 1539593 - RNA, 18 nt, Homo sapiens
auuguggugugagcuuca

SEQ ID NO: 1539594 - RNA, 20 nt, Homo sapiens
auuguuaaaaccuuacuuaa

SEQ ID NO: 1539595 - RNA, 17 nt, Homo sapiens
auuguuaauucuuccua

SEQ ID NO: 1539596 - RNA, 21 nt, Homo sapiens
auuguuacagguguacuaugg

SEQ ID NO: 1539597 - RNA, 21 nt, Homo sapiens
auuguucuuuuuuaagacuca

SEQ ID NO: 1539598 - RNA, 22 nt, Homo sapiens
auuuaaagucuugaauguugaa

SEQ ID NO: 1539599 - RNA, 14 nt, Homo sapiens
auuuaacugcauau

SEQ ID NO: 1539600 - RNA, 16 nt, Homo sapiens
auuuaauauacugcau

SEQ ID NO: 1539601 - RNA, 23 nt, Homo sapiens
auuuacaagaagaacucaccagg

SEQ ID NO: 1539602 - RNA, 17 nt, Homo sapiens
auuuacaguuacugccu

SEQ ID NO: 1539603 - RNA, 13 nt, Homo sapiens
auuuaccaaauag

SEQ ID NO: 1539604 - RNA, 21 nt, Homo sapiens
auuuaugaauaaauauuacaa

SEQ ID NO: 1539605 - RNA, 16 nt, Homo sapiens
auuuauuuacauguga

SEQ ID NO: 1539606 - RNA, 20 nt, Homo sapiens
auuucaaccgcuugccauau

SEQ ID NO: 1539607 - RNA, 13 nt, Homo sapiens
auuucaacuucag

SEQ ID NO: 1539608 - RNA, 13 nt, Homo sapiens
auuucaaugauug

SEQ ID NO: 1539609 - RNA, 23 nt, Homo sapiens
auuucagguuaaauuaaaccaag

SEQ ID NO: 1539610 - RNA, 23 nt, Homo sapiens
auuucaguucaaucaaacuuuca

SEQ ID NO: 1539611 - RNA, 14 nt, Homo sapiens
auuuccacuucuuc

SEQ ID NO: 1539612 - RNA, 11 nt, Homo sapiens
auuuccagggg

SEQ ID NO: 1539613 - RNA, 23 nt, Homo sapiens
auuuccaggggccucccaaggaa

SEQ ID NO: 1539614 - RNA, 13 nt, Homo sapiens
auuuccugacaga

SEQ ID NO: 1539615 - RNA, 16 nt, Homo sapiens
auuucuaucugcaaau

SEQ ID NO: 1539616 - RNA, 16 nt, Homo sapiens
auuucuucacgcaccu

SEQ ID NO: 1539617 - RNA, 19 nt, Homo sapiens
auuugcacccaugccauag

SEQ ID NO: 1539618 - RNA, 16 nt, Homo sapiens
auuugcauacauucuu

SEQ ID NO: 1539619 - RNA, 13 nt, Homo sapiens
auuugccaaaaac

SEQ ID NO: 1539620 - RNA, 22 nt, Homo sapiens
auuugcuagagggagggagcag

SEQ ID NO: 1539621 - RNA, 20 nt, Homo sapiens
auuuuaaaaaauaacauauu

SEQ ID NO: 1539622 - RNA, 23 nt, Homo sapiens
auuuuauaguguguugugcuuuc

SEQ ID NO: 1539623 - RNA, 14 nt, Homo sapiens
auuuucaagcaaau

SEQ ID NO: 1539624 - RNA, 22 nt, Homo sapiens
auuuucauguucuugcagucau

SEQ ID NO: 1539625 - RNA, 15 nt, Homo sapiens
auuuucugcaucucc

SEQ ID NO: 1539626 - RNA, 19 nt, Homo sapiens
auuuugauaccagugagca

SEQ ID NO: 1539627 - RNA, 16 nt, Homo sapiens
auuuuguaaaauguau

SEQ ID NO: 1539628 - RNA, 16 nt, Homo sapiens
auuuuuacacauguau

SEQ ID NO: 1539629 - RNA, 22 nt, Homo sapiens
auuuuuccucuuucacuucuua

SEQ ID NO: 1539630 - RNA, 21 nt, Homo sapiens
auuuuuuuuuuuaagcucaaa

SEQ ID NO: 1539631 - RNA, 19 nt, Homo sapiens
caaaaaaugugagcuauaa

SEQ ID NO: 1539632 - RNA, 16 nt, Homo sapiens
caaaaaugggcagcca

SEQ ID NO: 1539633 - RNA, 12 nt, Homo sapiens
caaaacccaucg

SEQ ID NO: 1539634 - RNA, 18 nt, Homo sapiens
caaaagguuaagccauau

SEQ ID NO: 1539635 - RNA, 13 nt, Homo sapiens
caaaauacuucuu

SEQ ID NO: 1539636 - RNA, 19 nt, Homo sapiens
caaaauugaugauccauua

SEQ ID NO: 1539637 - RNA, 16 nt, Homo sapiens
caaacaggugcuaaca

SEQ ID NO: 1539638 - RNA, 18 nt, Homo sapiens
caaacccacccauaccag

SEQ ID NO: 1539639 - RNA, 21 nt, Homo sapiens
caaacuagauucauggcuuua

SEQ ID NO: 1539640 - RNA, 14 nt, Homo sapiens
caaagaagaaccau

SEQ ID NO: 1539641 - RNA, 16 nt, Homo sapiens
caaagaagaaccaucu

SEQ ID NO: 1539642 - RNA, 15 nt, Homo sapiens
caaagcaccuugaau

SEQ ID NO: 1539643 - RNA, 18 nt, Homo sapiens
caaaggacaaaaauauaa

SEQ ID NO: 1539644 - RNA, 23 nt, Homo sapiens
caaaguuaaacgugaugugcuca

SEQ ID NO: 1539645 - RNA, 18 nt, Homo sapiens
caaauaccagagcacaga

SEQ ID NO: 1539646 - RNA, 13 nt, Homo sapiens
caaauaguuucaa

SEQ ID NO: 1539647 - RNA, 23 nt, Homo sapiens
caaauccauacccccugccccag

SEQ ID NO: 1539648 - RNA, 14 nt, Homo sapiens
caaaugcagcuuca

SEQ ID NO: 1539649 - RNA, 18 nt, Homo sapiens
caaauuucaucuuuccaa

SEQ ID NO: 1539650 - RNA, 21 nt, Homo sapiens
caacaaagcagaagacuccuc

SEQ ID NO: 1539651 - RNA, 16 nt, Homo sapiens
caacacaccuugccca

SEQ ID NO: 1539652 - RNA, 18 nt, Homo sapiens
caacacucaguccuucca

SEQ ID NO: 1539653 - RNA, 18 nt, Homo sapiens
caacauuccuuguuugua

SEQ ID NO: 1539654 - RNA, 20 nt, Homo sapiens
caacccaaaugguggccauu

SEQ ID NO: 1539655 - RNA, 22 nt, Homo sapiens
caacccugugaucuauaccacc

SEQ ID NO: 1539656 - RNA, 23 nt, Homo sapiens
caacccugugaucuauaccaccu

SEQ ID NO: 1539657 - RNA, 16 nt, Homo sapiens
caaccgcuugccauau

SEQ ID NO: 1539658 - RNA, 23 nt, Homo sapiens
caaccuccccugguccugcacug

SEQ ID NO: 1539659 - RNA, 15 nt, Homo sapiens
caacgaaaagcacau

SEQ ID NO: 1539660 - RNA, 15 nt, Homo sapiens
caacuaauacauggu

SEQ ID NO: 1539661 - RNA, 20 nt, Homo sapiens
caacuaauacaugguuuaaa

SEQ ID NO: 1539662 - RNA, 22 nt, Homo sapiens
caacuccaggguuaaagaaagg

SEQ ID NO: 1539663 - RNA, 22 nt, Homo sapiens
caacuugaaauuauaucugugg

SEQ ID NO: 1539664 - RNA, 18 nt, Homo sapiens
caacuuuuccuuugaauc

SEQ ID NO: 1539665 - RNA, 20 nt, Homo sapiens
caagaagugggauucaggaa

SEQ ID NO: 1539666 - RNA, 21 nt, Homo sapiens
caagaagugggauucaggaau

SEQ ID NO: 1539667 - RNA, 23 nt, Homo sapiens
caagacacccaguggaaccaaaa

SEQ ID NO: 1539668 - RNA, 14 nt, Homo sapiens
caagacuuccucau

SEQ ID NO: 1539669 - RNA, 21 nt, Homo sapiens
caagauccugucuugcugagg

SEQ ID NO: 1539670 - RNA, 22 nt, Homo sapiens
caagauccugucuugcugaggg

SEQ ID NO: 1539671 - RNA, 13 nt, Homo sapiens
caagauucagcua

SEQ ID NO: 1539672 - RNA, 13 nt, Homo sapiens
caagcacuucaaa

SEQ ID NO: 1539673 - RNA, 17 nt, Homo sapiens
caagcugccugccugag

SEQ ID NO: 1539674 - RNA, 9 nt, Homo sapiens
caagggaau

SEQ ID NO: 1539675 - RNA, 12 nt, Homo sapiens
caaggguuuuca

SEQ ID NO: 1539676 - RNA, 15 nt, Homo sapiens
caaguacuugagaau

SEQ ID NO: 1539677 - RNA, 22 nt, Homo sapiens
caaguauauuuauuucuagcaa

SEQ ID NO: 1539678 - RNA, 13 nt, Homo sapiens
caagucccaugau

SEQ ID NO: 1539679 - RNA, 13 nt, Homo sapiens
caagucugugaaa

SEQ ID NO: 1539680 - RNA, 20 nt, Homo sapiens
caaguuuaaaggcuguguca

SEQ ID NO: 1539681 - RNA, 15 nt, Homo sapiens
caauaaacucaguca

SEQ ID NO: 1539682 - RNA, 17 nt, Homo sapiens
caauaaagcaauguggu

SEQ ID NO: 1539683 - RNA, 16 nt, Homo sapiens
caauacccacugccag

SEQ ID NO: 1539684 - RNA, 20 nt, Homo sapiens
caauaggcagcuuucuuaac

SEQ ID NO: 1539685 - RNA, 22 nt, Homo sapiens
caauaugaggggacugcaugca

SEQ ID NO: 1539686 - RNA, 19 nt, Homo sapiens
caaugaaauauuugcuuau

SEQ ID NO: 1539687 - RNA, 13 nt, Homo sapiens
caaugacacauag

SEQ ID NO: 1539688 - RNA, 10 nt, Homo sapiens
caaugauuca

SEQ ID NO: 1539689 - RNA, 17 nt, Homo sapiens
caauggugaacugucau

SEQ ID NO: 1539690 - RNA, 19 nt, Homo sapiens
caauucuccuguugcaaug

SEQ ID NO: 1539691 - RNA, 18 nt, Homo sapiens
caauuucaaaaugcaugu

SEQ ID NO: 1539692 - RNA, 23 nt, Homo sapiens
caauuuuaaaaaauaacauauuc

SEQ ID NO: 1539693 - RNA, 14 nt, Homo sapiens
cacaaauauaguug

SEQ ID NO: 1539694 - RNA, 22 nt, Homo sapiens
cacaagaagugggagugggaga

SEQ ID NO: 1539695 - RNA, 15 nt, Homo sapiens
cacaaguacuugaga

SEQ ID NO: 1539696 - RNA, 13 nt, Homo sapiens
cacaauauuccua

SEQ ID NO: 1539697 - RNA, 17 nt, Homo sapiens
cacaauauuccuaugcu

SEQ ID NO: 1539698 - RNA, 21 nt, Homo sapiens
cacaauuaacuccguuuccaa

SEQ ID NO: 1539699 - RNA, 12 nt, Homo sapiens
cacacacacucu

SEQ ID NO: 1539700 - RNA, 21 nt, Homo sapiens
cacacaggccuggcccagcca

SEQ ID NO: 1539701 - RNA, 13 nt, Homo sapiens
auauguugcugaa

SEQ ID NO: 1539702 - RNA, 20 nt, Homo sapiens
auauuauaucagacugcuuu

SEQ ID NO: 1539703 - RNA, 12 nt, Homo sapiens
auauucccaugg

SEQ ID NO: 1539704 - RNA, 21 nt, Homo sapiens
auauuuaauaggauaaauuaa

SEQ ID NO: 1539705 - RNA, 14 nt, Homo sapiens
auauuuacaaugua

SEQ ID NO: 1539706 - RNA, 13 nt, Homo sapiens
auauuuccacuuc

SEQ ID NO: 1539707 - RNA, 20 nt, Homo sapiens
auauuucucauuuagcauug

SEQ ID NO: 1539708 - RNA, 15 nt, Homo sapiens
aucaaagcaccuuga

SEQ ID NO: 1539709 - RNA, 21 nt, Homo sapiens
aucaagucccgaggcagcaac

SEQ ID NO: 1539710 - RNA, 14 nt, Homo sapiens
aucaagucugugaa

SEQ ID NO: 1539711 - RNA, 18 nt, Homo sapiens
aucaauggcgcagugccu

SEQ ID NO: 1539712 - RNA, 23 nt, Homo sapiens
aucacaagaaaaaggaagccacu

SEQ ID NO: 1539713 - RNA, 14 nt, Homo sapiens
aucagaguauguca

SEQ ID NO: 1539714 - RNA, 17 nt, Homo sapiens
aucagcauucaaaauag

SEQ ID NO: 1539715 - RNA, 14 nt, Homo sapiens
aucaggaugccuua

SEQ ID NO: 1539716 - RNA, 19 nt, Homo sapiens
aucaguaaaauuauacugu

SEQ ID NO: 1539717 - RNA, 21 nt, Homo sapiens
aucagucuuggaauacuugaa

SEQ ID NO: 1539718 - RNA, 15 nt, Homo sapiens
aucagugaugggagu

SEQ ID NO: 1539719 - RNA, 20 nt, Homo sapiens
aucaguuugcuaauguuucc

SEQ ID NO: 1539720 - RNA, 19 nt, Homo sapiens
aucauauuuaccugugaau

SEQ ID NO: 1539721 - RNA, 21 nt, Homo sapiens
aucaucuuagcuuagcuuucu

SEQ ID NO: 1539722 - RNA, 22 nt, Homo sapiens
aucauuauuacauagacuguga

SEQ ID NO: 1539723 - RNA, 20 nt, Homo sapiens
aucauuucuugguaugauca

SEQ ID NO: 1539724 - RNA, 15 nt, Homo sapiens
auccacuucacaguu

SEQ ID NO: 1539725 - RNA, 16 nt, Homo sapiens
auccagagagaagcac

SEQ ID NO: 1539726 - RNA, 21 nt, Homo sapiens
aucccagcaugcugagauuac

SEQ ID NO: 1539727 - RNA, 14 nt, Homo sapiens
aucccccuccuugc

SEQ ID NO: 1539728 - RNA, 16 nt, Homo sapiens
auccuaacaagccuug

SEQ ID NO: 1539729 - RNA, 16 nt, Homo sapiens
auccuuuauagcuuug

SEQ ID NO: 1539730 - RNA, 22 nt, Homo sapiens
aucgaggaaccagagccaugga

SEQ ID NO: 1539731 - RNA, 20 nt, Homo sapiens
aucgcugccuugccaugucu

SEQ ID NO: 1539732 - RNA, 19 nt, Homo sapiens
aucuaaucccuucaaggaa

SEQ ID NO: 1539733 - RNA, 12 nt, Homo sapiens
aucuauaccacc

SEQ ID NO: 1539734 - RNA, 20 nt, Homo sapiens
aucuauggauuggguaucaa

SEQ ID NO: 1539735 - RNA, 19 nt, Homo sapiens
aucucaggccaccugcccc

SEQ ID NO: 1539736 - RNA, 16 nt, Homo sapiens
aucucaucccuagucu

SEQ ID NO: 1539737 - RNA, 20 nt, Homo sapiens
aucuccacuuggcauuagcu

SEQ ID NO: 1539738 - RNA, 17 nt, Homo sapiens
aucucuucuuauacaga

SEQ ID NO: 1539739 - RNA, 21 nt, Homo sapiens
aucucuucuuauacagauaaa

SEQ ID NO: 1539740 - RNA, 17 nt, Homo sapiens
aucugaaacacagucau

SEQ ID NO: 1539741 - RNA, 19 nt, Homo sapiens
aucugagaaaagcuuugaa

SEQ ID NO: 1539742 - RNA, 13 nt, Homo sapiens
aucugagcuuaaa

SEQ ID NO: 1539743 - RNA, 20 nt, Homo sapiens
aucugccaggacacugccuu

SEQ ID NO: 1539744 - RNA, 16 nt, Homo sapiens
aucugcugccaugaga

SEQ ID NO: 1539745 - RNA, 14 nt, Homo sapiens
aucuguaaauuuaa

SEQ ID NO: 1539746 - RNA, 22 nt, Homo sapiens
aucuguaaauuuaacugcauau

SEQ ID NO: 1539747 - RNA, 18 nt, Homo sapiens
aucuguauaauacuuugu

SEQ ID NO: 1539748 - RNA, 16 nt, Homo sapiens
aucugucucuucuaca

SEQ ID NO: 1539749 - RNA, 20 nt, Homo sapiens
aucuguuugauacaguauua

SEQ ID NO: 1539750 - RNA, 17 nt, Homo sapiens
aucuuaaaagcuaucuu

SEQ ID NO: 1539751 - RNA, 17 nt, Homo sapiens
aucuuuaaagacuugau

SEQ ID NO: 1539752 - RNA, 23 nt, Homo sapiens
augaaaaauaguguguccaugca

SEQ ID NO: 1539753 - RNA, 17 nt, Homo sapiens
augaaauuccauuugua

SEQ ID NO: 1539754 - RNA, 15 nt, Homo sapiens
augaaggucuaccug

SEQ ID NO: 1539755 - RNA, 22 nt, Homo sapiens
augacaguuagagaugcugauu

SEQ ID NO: 1539756 - RNA, 15 nt, Homo sapiens
augacauugaacuga

SEQ ID NO: 1539757 - RNA, 21 nt, Homo sapiens
augacuucuuuacuaacacug

SEQ ID NO: 1539758 - RNA, 14 nt, Homo sapiens
augagaucagguca

SEQ ID NO: 1539759 - RNA, 10 nt, Homo sapiens
augagccagc

SEQ ID NO: 1539760 - RNA, 11 nt, Homo sapiens
augagcucaaa

SEQ ID NO: 1539761 - RNA, 14 nt, Homo sapiens
augagcuccagacc

SEQ ID NO: 1539762 - RNA, 21 nt, Homo sapiens
augaggcacgccugccuucuc

SEQ ID NO: 1539763 - RNA, 13 nt, Homo sapiens
augauaaaagcac

SEQ ID NO: 1539764 - RNA, 19 nt, Homo sapiens
augauaaauuugacuguua

SEQ ID NO: 1539765 - RNA, 18 nt, Homo sapiens
augauacuugguccuuaa

SEQ ID NO: 1539766 - RNA, 14 nt, Homo sapiens
augauucauaacaa

SEQ ID NO: 1539767 - RNA, 16 nt, Homo sapiens
augauugugaccucca

SEQ ID NO: 1539768 - RNA, 13 nt, Homo sapiens
augauuucagaaa

SEQ ID NO: 1539769 - RNA, 14 nt, Homo sapiens
augauuugcaacuu

SEQ ID NO: 1539770 - RNA, 16 nt, Homo sapiens
augauuuuggccacuu

SEQ ID NO: 1539771 - RNA, 17 nt, Homo sapiens
augcaagcucagggugc

SEQ ID NO: 1539772 - RNA, 15 nt, Homo sapiens
augcacugcaaauac

SEQ ID NO: 1539773 - RNA, 19 nt, Homo sapiens
augcacuuggcugcauaaa

SEQ ID NO: 1539774 - RNA, 21 nt, Homo sapiens
augcaggcaugcuggcuccca

SEQ ID NO: 1539775 - RNA, 22 nt, Homo sapiens
augcauggcauuuguuccacag

SEQ ID NO: 1539776 - RNA, 12 nt, Homo sapiens
augcaugugauu

SEQ ID NO: 1539777 - RNA, 15 nt, Homo sapiens
augccuuuccagugc

SEQ ID NO: 1539778 - RNA, 18 nt, Homo sapiens
augcucuuuucacagcua

SEQ ID NO: 1539779 - RNA, 20 nt, Homo sapiens
augcuggcucccagggccau

SEQ ID NO: 1539780 - RNA, 20 nt, Homo sapiens
augcuuauaagcaacaugaa

SEQ ID NO: 1539781 - RNA, 18 nt, Homo sapiens
augcuucaguacuuguga

SEQ ID NO: 1539782 - RNA, 21 nt, Homo sapiens
auggaagaggcaccuguccca

SEQ ID NO: 1539783 - RNA, 14 nt, Homo sapiens
auggauccuuguca

SEQ ID NO: 1539784 - RNA, 13 nt, Homo sapiens
auggaucugcaua

SEQ ID NO: 1539785 - RNA, 18 nt, Homo sapiens
auggcacaugauaugagu

SEQ ID NO: 1539786 - RNA, 21 nt, Homo sapiens
auggcagugagaugucagaca

SEQ ID NO: 1539787 - RNA, 18 nt, Homo sapiens
auggccaggccucaggga

SEQ ID NO: 1539788 - RNA, 17 nt, Homo sapiens
auggcuuguucagucac

SEQ ID NO: 1539789 - RNA, 21 nt, Homo sapiens
augggccaagccaggguucca

SEQ ID NO: 1539790 - RNA, 16 nt, Homo sapiens
augggucauucucacc

SEQ ID NO: 1539791 - RNA, 18 nt, Homo sapiens
auguacaauaaagcaaug

SEQ ID NO: 1539792 - RNA, 20 nt, Homo sapiens
auguacaauaaagcaaugug

SEQ ID NO: 1539793 - RNA, 23 nt, Homo sapiens
auguacaauaaagcaauguggua

SEQ ID NO: 1539794 - RNA, 15 nt, Homo sapiens
augucauaaagugag

SEQ ID NO: 1539795 - RNA, 12 nt, Homo sapiens
auguccuauuac

SEQ ID NO: 1539796 - RNA, 18 nt, Homo sapiens
augucuaaaauugucagu

SEQ ID NO: 1539797 - RNA, 19 nt, Homo sapiens
augugaauaugccagugac

SEQ ID NO: 1539798 - RNA, 16 nt, Homo sapiens
augugauuuuucugca

SEQ ID NO: 1539799 - RNA, 12 nt, Homo sapiens
augugcuauuaa

SEQ ID NO: 1539800 - RNA, 22 nt, Homo sapiens
augugcuugaagauucaggcuu

SEQ ID NO: 1539801 - RNA, 18 nt, Homo sapiens
auguggcagcugucucaa

SEQ ID NO: 1539802 - RNA, 18 nt, Homo sapiens
auguggugggagcacagc

SEQ ID NO: 1539803 - RNA, 23 nt, Homo sapiens
auguguuucagguggaacaggag

SEQ ID NO: 1539804 - RNA, 18 nt, Homo sapiens
auguuacuacaugcacuu

SEQ ID NO: 1539805 - RNA, 22 nt, Homo sapiens
auguugauucuagguugaaaau

SEQ ID NO: 1539806 - RNA, 23 nt, Homo sapiens
auguuucuaaguaauaugcuuau

SEQ ID NO: 1539807 - RNA, 20 nt, Homo sapiens
auuaaaccaaggagucugau

SEQ ID NO: 1539808 - RNA, 13 nt, Homo sapiens
auuaaagcuguua

SEQ ID NO: 1539809 - RNA, 15 nt, Homo sapiens
auuaaagugcacugu

SEQ ID NO: 1539810 - RNA, 16 nt, Homo sapiens
auuaaaucuuccucau

SEQ ID NO: 1539811 - RNA, 12 nt, Homo sapiens
auuaaauuuacu

SEQ ID NO: 1539812 - RNA, 22 nt, Homo sapiens
auuaaauuuuaauguaaaauuc

SEQ ID NO: 1539813 - RNA, 19 nt, Homo sapiens
auuaauauuuguuuaguuc

SEQ ID NO: 1539814 - RNA, 18 nt, Homo sapiens
auuacauagacugugaug

SEQ ID NO: 1539815 - RNA, 13 nt, Homo sapiens
auuacugcaugca

SEQ ID NO: 1539816 - RNA, 15 nt, Homo sapiens
auuacugcaugcacu

SEQ ID NO: 1539817 - RNA, 16 nt, Homo sapiens
auuacugcaugcacuu

SEQ ID NO: 1539818 - RNA, 20 nt, Homo sapiens
auuacugcaugcacuucuua

SEQ ID NO: 1539819 - RNA, 18 nt, Homo sapiens
auuagaucaaaagucuac

SEQ ID NO: 1539820 - RNA, 16 nt, Homo sapiens
auuagcccacugccug

SEQ ID NO: 1539821 - RNA, 21 nt, Homo sapiens
auuagcccacugccuggaaag

SEQ ID NO: 1539822 - RNA, 17 nt, Homo sapiens
auuagcuuacugauuaa

SEQ ID NO: 1539823 - RNA, 19 nt, Homo sapiens
auuagcuuugucacuguuu

SEQ ID NO: 1539824 - RNA, 18 nt, Homo sapiens
auuaugagagacugcuca

SEQ ID NO: 1539825 - RNA, 19 nt, Homo sapiens
auuauguuuuaauuccaag

SEQ ID NO: 1539826 - RNA, 22 nt, Homo sapiens
auucaaagaaucaccuaauuaa

SEQ ID NO: 1539827 - RNA, 13 nt, Homo sapiens
auucaaaugcaug

SEQ ID NO: 1539828 - RNA, 22 nt, Homo sapiens
auucaaucuuaacaaaagugaa

SEQ ID NO: 1539829 - RNA, 13 nt, Homo sapiens
auucacaguaucu

SEQ ID NO: 1539830 - RNA, 21 nt, Homo sapiens
auucacauuuuaacauaggca

SEQ ID NO: 1539831 - RNA, 18 nt, Homo sapiens
auucauuagcugugauuu

SEQ ID NO: 1539832 - RNA, 18 nt, Homo sapiens
auucauuuuaacaucuga

SEQ ID NO: 1539833 - RNA, 20 nt, Homo sapiens
aggccucagggaccaaggag

SEQ ID NO: 1539834 - RNA, 14 nt, Homo sapiens
aggccucaguggac

SEQ ID NO: 1539835 - RNA, 23 nt, Homo sapiens
aggccuccagccacuuauuucca

SEQ ID NO: 1539836 - RNA, 19 nt, Homo sapiens
aggccugaaauguuuccag

SEQ ID NO: 1539837 - RNA, 21 nt, Homo sapiens
aggcgccccuucccccuccaa

SEQ ID NO: 1539838 - RNA, 15 nt, Homo sapiens
aggcguagggccagg

SEQ ID NO: 1539839 - RNA, 15 nt, Homo sapiens
aggcucuaauguaca

SEQ ID NO: 1539840 - RNA, 18 nt, Homo sapiens
aggcucuaauguacaaua

SEQ ID NO: 1539841 - RNA, 19 nt, Homo sapiens
aggcucuaauguacaauaa

SEQ ID NO: 1539842 - RNA, 22 nt, Homo sapiens
aggcucuaauguacaauaaagc

SEQ ID NO: 1539843 - RNA, 16 nt, Homo sapiens
aggcuguacacugcac

SEQ ID NO: 1539844 - RNA, 17 nt, Homo sapiens
aggcuuccuucauuucc

SEQ ID NO: 1539845 - RNA, 17 nt, Homo sapiens
aggcuuuccucagcacc

SEQ ID NO: 1539846 - RNA, 17 nt, Homo sapiens
agggaaauucacacugu

SEQ ID NO: 1539847 - RNA, 18 nt, Homo sapiens
agggaaauucacacugug

SEQ ID NO: 1539848 - RNA, 16 nt, Homo sapiens
agggaaucagggagca

SEQ ID NO: 1539849 - RNA, 19 nt, Homo sapiens
agggaauugaggucugcuc

SEQ ID NO: 1539850 - RNA, 11 nt, Homo sapiens
agggaccaagg

SEQ ID NO: 1539851 - RNA, 16 nt, Homo sapiens
agggacuccaguucac

SEQ ID NO: 1539852 - RNA, 14 nt, Homo sapiens
agggagcaccagau

SEQ ID NO: 1539853 - RNA, 18 nt, Homo sapiens
agggagggaaacccgggg

SEQ ID NO: 1539854 - RNA, 19 nt, Homo sapiens
agggcgcugagggcagggu

SEQ ID NO: 1539855 - RNA, 14 nt, Homo sapiens
aggggaagugugcu

SEQ ID NO: 1539856 - RNA, 19 nt, Homo sapiens
aggggccucagguuugccu

SEQ ID NO: 1539857 - RNA, 12 nt, Homo sapiens
aggggccuggaa

SEQ ID NO: 1539858 - RNA, 21 nt, Homo sapiens
agggggcgaagggaucagccc

SEQ ID NO: 1539859 - RNA, 17 nt, Homo sapiens
aggggguuugggggcuu

SEQ ID NO: 1539860 - RNA, 23 nt, Homo sapiens
agggucuuccuccuaaauuucca

SEQ ID NO: 1539861 - RNA, 19 nt, Homo sapiens
aggguuaaagaaaggcaga

SEQ ID NO: 1539862 - RNA, 15 nt, Homo sapiens
aggguucagggcaug

SEQ ID NO: 1539863 - RNA, 17 nt, Homo sapiens
aggguuccagacagggu

SEQ ID NO: 1539864 - RNA, 17 nt, Homo sapiens
agguaaacaaacaaaua

SEQ ID NO: 1539865 - RNA, 16 nt, Homo sapiens
agguaaguuggcucac

SEQ ID NO: 1539866 - RNA, 17 nt, Homo sapiens
agguaguagaaucucag

SEQ ID NO: 1539867 - RNA, 15 nt, Homo sapiens
aggucaucccggggc

SEQ ID NO: 1539868 - RNA, 20 nt, Homo sapiens
aggucuaccugaaaauucaa

SEQ ID NO: 1539869 - RNA, 12 nt, Homo sapiens
aggugagccaag

SEQ ID NO: 1539870 - RNA, 18 nt, Homo sapiens
aggugaugguaacugcac

SEQ ID NO: 1539871 - RNA, 19 nt, Homo sapiens
aggugaugguaacugcaca

SEQ ID NO: 1539872 - RNA, 23 nt, Homo sapiens
aggugauugucaccaugaucacu

SEQ ID NO: 1539873 - RNA, 19 nt, Homo sapiens
agguggcccuucacugucc

SEQ ID NO: 1539874 - RNA, 16 nt, Homo sapiens
aggugugggcucccac

SEQ ID NO: 1539875 - RNA, 18 nt, Homo sapiens
agguugucugaagucacu

SEQ ID NO: 1539876 - RNA, 19 nt, Homo sapiens
agguuucacuguucaugaa

SEQ ID NO: 1539877 - RNA, 14 nt, Homo sapiens
aguaaaaacaauuc

SEQ ID NO: 1539878 - RNA, 13 nt, Homo sapiens
aguaaaaccaaag

SEQ ID NO: 1539879 - RNA, 15 nt, Homo sapiens
aguaaaauuacagaa

SEQ ID NO: 1539880 - RNA, 16 nt, Homo sapiens
aguaagcugcucuauu

SEQ ID NO: 1539881 - RNA, 21 nt, Homo sapiens
aguaauagggcuucugccuaa

SEQ ID NO: 1539882 - RNA, 19 nt, Homo sapiens
aguaaucuguauaauacuu

SEQ ID NO: 1539883 - RNA, 15 nt, Homo sapiens
aguacuagagauauu

SEQ ID NO: 1539884 - RNA, 17 nt, Homo sapiens
aguacugaaauacauau

SEQ ID NO: 1539885 - RNA, 21 nt, Homo sapiens
aguacuugugaaacacagcug

SEQ ID NO: 1539886 - RNA, 22 nt, Homo sapiens
aguacuuugguuucugagcacc

SEQ ID NO: 1539887 - RNA, 17 nt, Homo sapiens
aguagaaucucagcacu

SEQ ID NO: 1539888 - RNA, 17 nt, Homo sapiens
aguaguacuucuucugu

SEQ ID NO: 1539889 - RNA, 14 nt, Homo sapiens
aguaucaccaaaaa

SEQ ID NO: 1539890 - RNA, 16 nt, Homo sapiens
aguaucucuacuuucc

SEQ ID NO: 1539891 - RNA, 17 nt, Homo sapiens
aguaucucuacuuuccu

SEQ ID NO: 1539892 - RNA, 16 nt, Homo sapiens
aguaugcuaugauuaa

SEQ ID NO: 1539893 - RNA, 20 nt, Homo sapiens
aguauggugcuggguccuua

SEQ ID NO: 1539894 - RNA, 20 nt, Homo sapiens
aguauuccagaccugaagaa

SEQ ID NO: 1539895 - RNA, 14 nt, Homo sapiens
agucaagugugccu

SEQ ID NO: 1539896 - RNA, 12 nt, Homo sapiens
agucagcacaga

SEQ ID NO: 1539897 - RNA, 23 nt, Homo sapiens
agucccuccgacuucucuagaca

SEQ ID NO: 1539898 - RNA, 22 nt, Homo sapiens
aguccuagaauguuucauuugc

SEQ ID NO: 1539899 - RNA, 13 nt, Homo sapiens
aguccuguucuca

SEQ ID NO: 1539900 - RNA, 14 nt, Homo sapiens
agucuauugcaguu

SEQ ID NO: 1539901 - RNA, 12 nt, Homo sapiens
agucucuaugau

SEQ ID NO: 1539902 - RNA, 17 nt, Homo sapiens
agucuuuagcuauuacu

SEQ ID NO: 1539903 - RNA, 20 nt, Homo sapiens
agugacuaaaccauugugca

SEQ ID NO: 1539904 - RNA, 16 nt, Homo sapiens
agugauaacacuggag

SEQ ID NO: 1539905 - RNA, 12 nt, Homo sapiens
agugaugggagu

SEQ ID NO: 1539906 - RNA, 15 nt, Homo sapiens
agugcacagcugucc

SEQ ID NO: 1539907 - RNA, 21 nt, Homo sapiens
agugcauuuaugagcucuuca

SEQ ID NO: 1539908 - RNA, 23 nt, Homo sapiens
aguggcauggcuccagucugcug

SEQ ID NO: 1539909 - RNA, 21 nt, Homo sapiens
aguggccaagagaugcagugc

SEQ ID NO: 1539910 - RNA, 14 nt, Homo sapiens
aguggccugagaag

SEQ ID NO: 1539911 - RNA, 19 nt, Homo sapiens
agugggugggacacagaga

SEQ ID NO: 1539912 - RNA, 16 nt, Homo sapiens
aguggugagacuguau

SEQ ID NO: 1539913 - RNA, 14 nt, Homo sapiens
agugugauugugaa

SEQ ID NO: 1539914 - RNA, 16 nt, Homo sapiens
agugugauugugaacu

SEQ ID NO: 1539915 - RNA, 14 nt, Homo sapiens
agugugccugcuau

SEQ ID NO: 1539916 - RNA, 12 nt, Homo sapiens
aguguuagcuua

SEQ ID NO: 1539917 - RNA, 14 nt, Homo sapiens
aguguuuccaguga

SEQ ID NO: 1539918 - RNA, 17 nt, Homo sapiens
aguguuuuuucugucau

SEQ ID NO: 1539919 - RNA, 13 nt, Homo sapiens
aguucuuccugua

SEQ ID NO: 1539920 - RNA, 21 nt, Homo sapiens
aguugaugaccaaucucugug

SEQ ID NO: 1539921 - RNA, 20 nt, Homo sapiens
aguugcaauaaacucaguca

SEQ ID NO: 1539922 - RNA, 22 nt, Homo sapiens
aguuuccagcuaagccugauga

SEQ ID NO: 1539923 - RNA, 22 nt, Homo sapiens
aguuucuugagaucugcugaca

SEQ ID NO: 1539924 - RNA, 15 nt, Homo sapiens
aguuuucuaaauguu

SEQ ID NO: 1539925 - RNA, 20 nt, Homo sapiens
auaaaauauggacuuccaau

SEQ ID NO: 1539926 - RNA, 22 nt, Homo sapiens
auaaacaacuuaauguucugaa

SEQ ID NO: 1539927 - RNA, 15 nt, Homo sapiens
auaaagugccuauaa

SEQ ID NO: 1539928 - RNA, 18 nt, Homo sapiens
auaaaguuauuacucuga

SEQ ID NO: 1539929 - RNA, 11 nt, Homo sapiens
auaaauccaac

SEQ ID NO: 1539930 - RNA, 15 nt, Homo sapiens
auaaauuauuuaacu

SEQ ID NO: 1539931 - RNA, 21 nt, Homo sapiens
auaaauuauuuaacuaauuaa

SEQ ID NO: 1539932 - RNA, 18 nt, Homo sapiens
auaacaagccaaacauuc

SEQ ID NO: 1539933 - RNA, 19 nt, Homo sapiens
auaacaagccaaacauucu

SEQ ID NO: 1539934 - RNA, 19 nt, Homo sapiens
auaacaucucuuucaucua

SEQ ID NO: 1539935 - RNA, 19 nt, Homo sapiens
auaaccuucaugaugaauu

SEQ ID NO: 1539936 - RNA, 23 nt, Homo sapiens
auaaccuucaugaugaauuacuu

SEQ ID NO: 1539937 - RNA, 14 nt, Homo sapiens
auaacuagaucucc

SEQ ID NO: 1539938 - RNA, 14 nt, Homo sapiens
auaaguaauaucuu

SEQ ID NO: 1539939 - RNA, 19 nt, Homo sapiens
auaauaaacaacauugucu

SEQ ID NO: 1539940 - RNA, 13 nt, Homo sapiens
auaauugacaaac

SEQ ID NO: 1539941 - RNA, 23 nt, Homo sapiens
auaauuuucuaccuggucucucc

SEQ ID NO: 1539942 - RNA, 14 nt, Homo sapiens
auacaccuauguca

SEQ ID NO: 1539943 - RNA, 17 nt, Homo sapiens
auacagaaaaaccacau

SEQ ID NO: 1539944 - RNA, 14 nt, Homo sapiens
auaccauccauccc

SEQ ID NO: 1539945 - RNA, 19 nt, Homo sapiens
auacuacaaauuaguguca

SEQ ID NO: 1539946 - RNA, 14 nt, Homo sapiens
auacucaccaaaau

SEQ ID NO: 1539947 - RNA, 22 nt, Homo sapiens
auacuguaugccggcuccuuca

SEQ ID NO: 1539948 - RNA, 18 nt, Homo sapiens
auacuuccaaagagucau

SEQ ID NO: 1539949 - RNA, 16 nt, Homo sapiens
auacuucuaccaacau

SEQ ID NO: 1539950 - RNA, 22 nt, Homo sapiens
auacuucuuuauucacaguauc

SEQ ID NO: 1539951 - RNA, 12 nt, Homo sapiens
auagaacugucc

SEQ ID NO: 1539952 - RNA, 20 nt, Homo sapiens
auagaacugucccacaaaau

SEQ ID NO: 1539953 - RNA, 13 nt, Homo sapiens
auaggcagcuuuc

SEQ ID NO: 1539954 - RNA, 14 nt, Homo sapiens
auaguaaaacuaaa

SEQ ID NO: 1539955 - RNA, 14 nt, Homo sapiens
auaucagaguaugu

SEQ ID NO: 1539956 - RNA, 16 nt, Homo sapiens
auauccagauggcaug

SEQ ID NO: 1539957 - RNA, 17 nt, Homo sapiens
auauccagauggcaugu

SEQ ID NO: 1539958 - RNA, 23 nt, Homo sapiens
auauccagauggcauguguuuac

SEQ ID NO: 1539959 - RNA, 21 nt, Homo sapiens
auauccugccuuuuaccuuca

SEQ ID NO: 1539960 - RNA, 17 nt, Homo sapiens
auaucuguggucuucaa

SEQ ID NO: 1539961 - RNA, 17 nt, Homo sapiens
auaugacuuuuucucag

SEQ ID NO: 1539962 - RNA, 14 nt, Homo sapiens
auaugcauuaugaa

SEQ ID NO: 1539963 - RNA, 14 nt, Homo sapiens
auauggacuuccaa

SEQ ID NO: 1539964 - RNA, 22 nt, Homo sapiens
auaugugaaaggauaugaaucu

SEQ ID NO: 1539965 - RNA, 11 nt, Homo sapiens
uucacaguauc

SEQ ID NO: 1539966 - RNA, 14 nt, Homo sapiens
uucacgcaacuuga

SEQ ID NO: 1539967 - RNA, 18 nt, Homo sapiens
uucagauggugaagcauu

SEQ ID NO: 1539968 - RNA, 13 nt, Homo sapiens
uucagcaauuaaa

SEQ ID NO: 1539969 - RNA, 21 nt, Homo sapiens
uucaguuuguccacacaagac

SEQ ID NO: 1539970 - RNA, 21 nt, Homo sapiens
uucaugccagcuauaaucucc

SEQ ID NO: 1539971 - RNA, 15 nt, Homo sapiens
uucauucccucccca

SEQ ID NO: 1539972 - RNA, 20 nt, Homo sapiens
uucauuuuaacaucugagaa

SEQ ID NO: 1539973 - RNA, 13 nt, Homo sapiens
uuccaaaguuuug

SEQ ID NO: 1539974 - RNA, 13 nt, Homo sapiens
uuccacugacagg

SEQ ID NO: 1539975 - RNA, 20 nt, Homo sapiens
uuccagaacuaccaaaauga

SEQ ID NO: 1539976 - RNA, 20 nt, Homo sapiens
uuccagacaggguggggcuu

SEQ ID NO: 1539977 - RNA, 21 nt, Homo sapiens
uuccaucugauugugauguga

SEQ ID NO: 1539978 - RNA, 12 nt, Homo sapiens
uuccaugguggu

SEQ ID NO: 1539979 - RNA, 18 nt, Homo sapiens
uuccaugucugaaguuug

SEQ ID NO: 1539980 - RNA, 14 nt, Homo sapiens
uuccauuugcaaca

SEQ ID NO: 1539981 - RNA, 13 nt, Homo sapiens
uuccauuuguagg

SEQ ID NO: 1539982 - RNA, 19 nt, Homo sapiens
uucccagacagcaguguga

SEQ ID NO: 1539983 - RNA, 20 nt, Homo sapiens
uuccccauugccuucugggg

SEQ ID NO: 1539984 - RNA, 16 nt, Homo sapiens
uuccccgugggccaug

SEQ ID NO: 1539985 - RNA, 22 nt, Homo sapiens
uucccuccucgggcuucucgcc

SEQ ID NO: 1539986 - RNA, 22 nt, Homo sapiens
uuccucaagauccugucuugcu

SEQ ID NO: 1539987 - RNA, 23 nt, Homo sapiens
uuccucccaaaggcuuucuuucc

SEQ ID NO: 1539988 - RNA, 13 nt, Homo sapiens
uuccucuuaccug

SEQ ID NO: 1539989 - RNA, 19 nt, Homo sapiens
uuccugggcagcccagaga

SEQ ID NO: 1539990 - RNA, 14 nt, Homo sapiens
uuccugugcacagc

SEQ ID NO: 1539991 - RNA, 16 nt, Homo sapiens
uuccuguuugauguga

SEQ ID NO: 1539992 - RNA, 22 nt, Homo sapiens
uucuaaaggggacagaucuuga

SEQ ID NO: 1539993 - RNA, 15 nt, Homo sapiens
uucuaauccaugugc

SEQ ID NO: 1539994 - RNA, 22 nt, Homo sapiens
uucuauuucaacuucaggaaag

SEQ ID NO: 1539995 - RNA, 20 nt, Homo sapiens
uucucagcgcaacagcugug

SEQ ID NO: 1539996 - RNA, 20 nt, Homo sapiens
uucucaguaaauauuaaccu

SEQ ID NO: 1539997 - RNA, 17 nt, Homo sapiens
uucucauuuagcauuga

SEQ ID NO: 1539998 - RNA, 21 nt, Homo sapiens
uucuccagggguuuacaguga

SEQ ID NO: 1539999 - RNA, 22 nt, Homo sapiens
uucuccuguugcaaugacacau

SEQ ID NO: 1540000 - RNA, 12 nt, Homo sapiens
uucucuagacau

SEQ ID NO: 1540001 - RNA, 21 nt, Homo sapiens
uucucuagacaucuagucuca

SEQ ID NO: 1540002 - RNA, 13 nt, Homo sapiens
uucucucacugau

SEQ ID NO: 1540003 - RNA, 15 nt, Homo sapiens
uucugaaauucacaa

SEQ ID NO: 1540004 - RNA, 13 nt, Homo sapiens
uucugaauucaua

SEQ ID NO: 1540005 - RNA, 23 nt, Homo sapiens
uucugagcaccuacuuacaugca

SEQ ID NO: 1540006 - RNA, 16 nt, Homo sapiens
uucugauuucucuuca

SEQ ID NO: 1540007 - RNA, 21 nt, Homo sapiens
uucuguccuguaacuguuaca

SEQ ID NO: 1540008 - RNA, 14 nt, Homo sapiens
uucuguggauucua

SEQ ID NO: 1540009 - RNA, 14 nt, Homo sapiens
uucuuguaucugga

SEQ ID NO: 1540010 - RNA, 11 nt, Homo sapiens
uugaacaaagu

SEQ ID NO: 1540011 - RNA, 19 nt, Homo sapiens
uugaagacccucaaugcca

SEQ ID NO: 1540012 - RNA, 15 nt, Homo sapiens
uugacacggccauga

SEQ ID NO: 1540013 - RNA, 20 nt, Homo sapiens
uugacuuugccacauccauu

SEQ ID NO: 1540014 - RNA, 11 nt, Homo sapiens
uugagccaugc

SEQ ID NO: 1540015 - RNA, 15 nt, Homo sapiens
uugcaaagcauuuga

SEQ ID NO: 1540016 - RNA, 18 nt, Homo sapiens
uugcaaauuauucuaguc

SEQ ID NO: 1540017 - RNA, 20 nt, Homo sapiens
uugcaaauuauucuagucaa

SEQ ID NO: 1540018 - RNA, 18 nt, Homo sapiens
uugcaaucuuauguugau

SEQ ID NO: 1540019 - RNA, 15 nt, Homo sapiens
uugcacagcaucuca

SEQ ID NO: 1540020 - RNA, 17 nt, Homo sapiens
uugcaugaguauuugcu

SEQ ID NO: 1540021 - RNA, 11 nt, Homo sapiens
uugccaaaaac

SEQ ID NO: 1540022 - RNA, 21 nt, Homo sapiens
uugccauauuaaaucuuccuc

SEQ ID NO: 1540023 - RNA, 21 nt, Homo sapiens
uugcccugaggggccugccac

SEQ ID NO: 1540024 - RNA, 14 nt, Homo sapiens
uugccgcauauuau

SEQ ID NO: 1540025 - RNA, 15 nt, Homo sapiens
uugccucucugccag

SEQ ID NO: 1540026 - RNA, 16 nt, Homo sapiens
uugccuggaagcacau

SEQ ID NO: 1540027 - RNA, 22 nt, Homo sapiens
uugcucacccaggaccucuggg

SEQ ID NO: 1540028 - RNA, 13 nt, Homo sapiens
uuggaagucuaag

SEQ ID NO: 1540029 - RNA, 19 nt, Homo sapiens
uuggaauacuugaaaaccu

SEQ ID NO: 1540030 - RNA, 20 nt, Homo sapiens
uuggagaggagguguggagu

SEQ ID NO: 1540031 - RNA, 21 nt, Homo sapiens
uuggauaauaacuagaucucc

SEQ ID NO: 1540032 - RNA, 17 nt, Homo sapiens
uuggcagaagcaguugc

SEQ ID NO: 1540033 - RNA, 13 nt, Homo sapiens
uuggcagcuucaa

SEQ ID NO: 1540034 - RNA, 19 nt, Homo sapiens
cuuuuccuggacacuuuac

SEQ ID NO: 1540035 - RNA, 18 nt, Homo sapiens
cuuuuggagcugagauca

SEQ ID NO: 1540036 - RNA, 22 nt, Homo sapiens
gaaaaaccaaugauucauaaca

SEQ ID NO: 1540037 - RNA, 13 nt, Homo sapiens
gaaaaaggcuucu

SEQ ID NO: 1540038 - RNA, 18 nt, Homo sapiens
gaaaaauaguguguccau

SEQ ID NO: 1540039 - RNA, 12 nt, Homo sapiens
gaaaacaugacu

SEQ ID NO: 1540040 - RNA, 13 nt, Homo sapiens
gaaaacaugacuu

SEQ ID NO: 1540041 - RNA, 16 nt, Homo sapiens
gaaaacaugacuuuau

SEQ ID NO: 1540042 - RNA, 15 nt, Homo sapiens
gaaaagccagaugac

SEQ ID NO: 1540043 - RNA, 16 nt, Homo sapiens
gaaaaggcacgcuggc

SEQ ID NO: 1540044 - RNA, 12 nt, Homo sapiens
gaaaagugcuuu

SEQ ID NO: 1540045 - RNA, 15 nt, Homo sapiens
gaaacaaagcauuug

SEQ ID NO: 1540046 - RNA, 23 nt, Homo sapiens
gaaacaacacucaguccuuccac

SEQ ID NO: 1540047 - RNA, 16 nt, Homo sapiens
gaaacacagaacucag

SEQ ID NO: 1540048 - RNA, 21 nt, Homo sapiens
gaaacugaggccauuauuuca

SEQ ID NO: 1540049 - RNA, 15 nt, Homo sapiens
gaaagagaaccauga

SEQ ID NO: 1540050 - RNA, 14 nt, Homo sapiens
gaaauaaaacaaug

SEQ ID NO: 1540051 - RNA, 17 nt, Homo sapiens
gaaaucaaguuaaugua

SEQ ID NO: 1540052 - RNA, 14 nt, Homo sapiens
gaaaucuauuucau

SEQ ID NO: 1540053 - RNA, 12 nt, Homo sapiens
gaaaugcugauu

SEQ ID NO: 1540054 - RNA, 21 nt, Homo sapiens
gaaaugcugauuuaaacuucu

SEQ ID NO: 1540055 - RNA, 16 nt, Homo sapiens
gaaauuggaagacuug

SEQ ID NO: 1540056 - RNA, 21 nt, Homo sapiens
gaaauuuuuuuccagaauuga

SEQ ID NO: 1540057 - RNA, 17 nt, Homo sapiens
gaacaaauaugauucuc

SEQ ID NO: 1540058 - RNA, 22 nt, Homo sapiens
gaacagggaugcuaucucgcua

SEQ ID NO: 1540059 - RNA, 15 nt, Homo sapiens
gaacgcaugcagggc

SEQ ID NO: 1540060 - RNA, 13 nt, Homo sapiens
gaacuaccaaaau

SEQ ID NO: 1540061 - RNA, 14 nt, Homo sapiens
gaacugcaacacug

SEQ ID NO: 1540062 - RNA, 16 nt, Homo sapiens
gaacugcaacacugga

SEQ ID NO: 1540063 - RNA, 17 nt, Homo sapiens
gaacugguccaggccag

SEQ ID NO: 1540064 - RNA, 13 nt, Homo sapiens
gaacugucccaca

SEQ ID NO: 1540065 - RNA, 19 nt, Homo sapiens
gaacuugauguuccuggga

SEQ ID NO: 1540066 - RNA, 15 nt, Homo sapiens
gaagaaaacaugacu

SEQ ID NO: 1540067 - RNA, 17 nt, Homo sapiens
gaagaaucacaauaauu

SEQ ID NO: 1540068 - RNA, 12 nt, Homo sapiens
gaagaccccagg

SEQ ID NO: 1540069 - RNA, 21 nt, Homo sapiens
gaagaccuucugaagaucuca

SEQ ID NO: 1540070 - RNA, 17 nt, Homo sapiens
gaagacuucaaaauauu

SEQ ID NO: 1540071 - RNA, 14 nt, Homo sapiens
gaagauaccauaag

SEQ ID NO: 1540072 - RNA, 12 nt, Homo sapiens
gaagcaccagcc

SEQ ID NO: 1540073 - RNA, 13 nt, Homo sapiens
gaagcacugccau

SEQ ID NO: 1540074 - RNA, 21 nt, Homo sapiens
gaagcuaaaauaaaccagacu

SEQ ID NO: 1540075 - RNA, 14 nt, Homo sapiens
gaaggaauggugcu

SEQ ID NO: 1540076 - RNA, 12 nt, Homo sapiens
gaaggagccagc

SEQ ID NO: 1540077 - RNA, 17 nt, Homo sapiens
gaaggccuucuuucuag

SEQ ID NO: 1540078 - RNA, 14 nt, Homo sapiens
gaaggcucugggau

SEQ ID NO: 1540079 - RNA, 19 nt, Homo sapiens
gaaggcucugggaucuccc

SEQ ID NO: 1540080 - RNA, 22 nt, Homo sapiens
gaaggcucuguuccacauauau

SEQ ID NO: 1540081 - RNA, 21 nt, Homo sapiens
gaaggucccgaauggagucca

SEQ ID NO: 1540082 - RNA, 18 nt, Homo sapiens
gaaguuaacagucucauu

SEQ ID NO: 1540083 - RNA, 15 nt, Homo sapiens
gaauagaugcugacu

SEQ ID NO: 1540084 - RNA, 14 nt, Homo sapiens
gaauauacauaguc

SEQ ID NO: 1540085 - RNA, 15 nt, Homo sapiens
gaauauccuauacug

SEQ ID NO: 1540086 - RNA, 16 nt, Homo sapiens
gaaucaaaaauugaag

SEQ ID NO: 1540087 - RNA, 19 nt, Homo sapiens
gaaucacuugacuuugcca

SEQ ID NO: 1540088 - RNA, 22 nt, Homo sapiens
gaaucaguccuagaauguuuca

SEQ ID NO: 1540089 - RNA, 14 nt, Homo sapiens
gaauccagugaaug

SEQ ID NO: 1540090 - RNA, 14 nt, Homo sapiens
gaaucucagcacuu

SEQ ID NO: 1540091 - RNA, 19 nt, Homo sapiens
gaaucuccugaccacuugu

SEQ ID NO: 1540092 - RNA, 23 nt, Homo sapiens
gaaucuugaggaacggaucagau

SEQ ID NO: 1540093 - RNA, 15 nt, Homo sapiens
gaaugacauugaacu

SEQ ID NO: 1540094 - RNA, 17 nt, Homo sapiens
gaaugaguuuccagcua

SEQ ID NO: 1540095 - RNA, 22 nt, Homo sapiens
gaaugaguuuccagcuaagccu

SEQ ID NO: 1540096 - RNA, 18 nt, Homo sapiens
gaauguugaauguuugaa

SEQ ID NO: 1540097 - RNA, 10 nt, Homo sapiens
gaauuuugcc

SEQ ID NO: 1540098 - RNA, 20 nt, Homo sapiens
gacaaauaaguuacccucaa

SEQ ID NO: 1540099 - RNA, 15 nt, Homo sapiens
gacaagcauguugau

SEQ ID NO: 1540100 - RNA, 23 nt, Homo sapiens
gacacagaggacagcuuccccau

SEQ ID NO: 1540101 - RNA, 21 nt, Homo sapiens
gacacagaggacggcuucccc

SEQ ID NO: 1540102 - RNA, 15 nt, Homo sapiens
gacacauaguguuug

SEQ ID NO: 1540103 - RNA, 14 nt, Homo sapiens
gacacuacaaacau

SEQ ID NO: 1540104 - RNA, 15 nt, Homo sapiens
gacacuauguagucu

SEQ ID NO: 1540105 - RNA, 18 nt, Homo sapiens
gacacugcugaaccuuuc

SEQ ID NO: 1540106 - RNA, 10 nt, Homo sapiens
gacacugucu

SEQ ID NO: 1540107 - RNA, 22 nt, Homo sapiens
gacagcauuacacgccacaacu

SEQ ID NO: 1540108 - RNA, 15 nt, Homo sapiens
gacaguaaagaccau

SEQ ID NO: 1540109 - RNA, 20 nt, Homo sapiens
gacaguuagagaugcugauu

SEQ ID NO: 1540110 - RNA, 18 nt, Homo sapiens
gacauacaccuaugucau

SEQ ID NO: 1540111 - RNA, 23 nt, Homo sapiens
gacauacaccuaugucauuucau

SEQ ID NO: 1540112 - RNA, 20 nt, Homo sapiens
gacaucccccuccuugccgc

SEQ ID NO: 1540113 - RNA, 16 nt, Homo sapiens
gacaugcggcugccca

SEQ ID NO: 1540114 - RNA, 20 nt, Homo sapiens
gacaugcuaaccucucugaa

SEQ ID NO: 1540115 - RNA, 19 nt, Homo sapiens
gaccaaauggaaauaaagc

SEQ ID NO: 1540116 - RNA, 23 nt, Homo sapiens
gaccacaaggcugaaaagugcuu

SEQ ID NO: 1540117 - RNA, 17 nt, Homo sapiens
gaccagagcaccucagc

SEQ ID NO: 1540118 - RNA, 23 nt, Homo sapiens
gacccacaaguauugcccuuuaa

SEQ ID NO: 1540119 - RNA, 19 nt, Homo sapiens
gaccccacuuaugcugcug

SEQ ID NO: 1540120 - RNA, 19 nt, Homo sapiens
gacccggagcuaacacugg

SEQ ID NO: 1540121 - RNA, 18 nt, Homo sapiens
gacccucggggcaggaag

SEQ ID NO: 1540122 - RNA, 14 nt, Homo sapiens
gacccuggagcuag

SEQ ID NO: 1540123 - RNA, 16 nt, Homo sapiens
gaccgaaucucacucu

SEQ ID NO: 1540124 - RNA, 21 nt, Homo sapiens
gaccgggccgcuagaugggca

SEQ ID NO: 1540125 - RNA, 21 nt, Homo sapiens
gaccuccucccaagcacuuca

SEQ ID NO: 1540126 - RNA, 13 nt, Homo sapiens
gacgcaugcaggg

SEQ ID NO: 1540127 - RNA, 15 nt, Homo sapiens
gacucaauguggaaa

SEQ ID NO: 1540128 - RNA, 19 nt, Homo sapiens
gacucaccuugcucugcca

SEQ ID NO: 1540129 - RNA, 14 nt, Homo sapiens
gacuguacuccucc

SEQ ID NO: 1540130 - RNA, 13 nt, Homo sapiens
gacuuaggccaga

SEQ ID NO: 1540131 - RNA, 23 nt, Homo sapiens
gacuugaugaauaaacacuuuuu

SEQ ID NO: 1540132 - RNA, 12 nt, Homo sapiens
gagaacagggau

SEQ ID NO: 1540133 - RNA, 16 nt, Homo sapiens
gagaagccucauggga

SEQ ID NO: 1540134 - RNA, 20 nt, Homo sapiens
gagaaucgaccucacuguca

SEQ ID NO: 1540135 - RNA, 18 nt, Homo sapiens
gagaaugccuaggccagc

SEQ ID NO: 1540136 - RNA, 19 nt, Homo sapiens
gagacauacaccuauguca

SEQ ID NO: 1540137 - RNA, 18 nt, Homo sapiens
gagacccccgugccaaau

SEQ ID NO: 1540138 - RNA, 13 nt, Homo sapiens
gagacgggaccgg

SEQ ID NO: 1540139 - RNA, 11 nt, Homo sapiens
gagacuguaaa

SEQ ID NO: 1540140 - RNA, 14 nt, Homo sapiens
gagagaacagggau

SEQ ID NO: 1540141 - RNA, 16 nt, Homo sapiens
gagagaacagggaugc

SEQ ID NO: 1540142 - RNA, 21 nt, Homo sapiens
gagagaacagggaugcuaucu

SEQ ID NO: 1540143 - RNA, 15 nt, Homo sapiens
acaccugcacacccc

SEQ ID NO: 1540144 - RNA, 16 nt, Homo sapiens
acaccugcacaccguc

SEQ ID NO: 1540145 - RNA, 14 nt, Homo sapiens
acacuaccaguuuc

SEQ ID NO: 1540146 - RNA, 20 nt, Homo sapiens
acacugcuaggugggccagc

SEQ ID NO: 1540147 - RNA, 17 nt, Homo sapiens
acagaccucggcugugu

SEQ ID NO: 1540148 - RNA, 15 nt, Homo sapiens
acagacucugugaga

SEQ ID NO: 1540149 - RNA, 17 nt, Homo sapiens
acagaguggaucuggag

SEQ ID NO: 1540150 - RNA, 21 nt, Homo sapiens
acagcagaguaaaauuacaga

SEQ ID NO: 1540151 - RNA, 23 nt, Homo sapiens
acagcauuacacgccacaacucc

SEQ ID NO: 1540152 - RNA, 13 nt, Homo sapiens
acagcuuccccau

SEQ ID NO: 1540153 - RNA, 16 nt, Homo sapiens
acagggacacagucug

SEQ ID NO: 1540154 - RNA, 14 nt, Homo sapiens
acagucauguguca

SEQ ID NO: 1540155 - RNA, 19 nt, Homo sapiens
acagugccacgacauggcu

SEQ ID NO: 1540156 - RNA, 18 nt, Homo sapiens
acaguuauacauaccucu

SEQ ID NO: 1540157 - RNA, 19 nt, Homo sapiens
acauagucuuuguuuacau

SEQ ID NO: 1540158 - RNA, 21 nt, Homo sapiens
acauagucuuuguuuacauga

SEQ ID NO: 1540159 - RNA, 17 nt, Homo sapiens
acauccauugacugacc

SEQ ID NO: 1540160 - RNA, 19 nt, Homo sapiens
acaucuguccuacacuuga

SEQ ID NO: 1540161 - RNA, 19 nt, Homo sapiens
acaugaacccauccaaugg

SEQ ID NO: 1540162 - RNA, 13 nt, Homo sapiens
acaugacuaggaa

SEQ ID NO: 1540163 - RNA, 19 nt, Homo sapiens
acaugaguucaaauacuuu

SEQ ID NO: 1540164 - RNA, 21 nt, Homo sapiens
acaugcauggcauuuguucca

SEQ ID NO: 1540165 - RNA, 17 nt, Homo sapiens
acaugcauuacugcaug

SEQ ID NO: 1540166 - RNA, 22 nt, Homo sapiens
acaugcauuacugcaugcacuu

SEQ ID NO: 1540167 - RNA, 16 nt, Homo sapiens
acauggacuacacaca

SEQ ID NO: 1540168 - RNA, 15 nt, Homo sapiens
acaugguuaccucug

SEQ ID NO: 1540169 - RNA, 14 nt, Homo sapiens
acauguccuauuac

SEQ ID NO: 1540170 - RNA, 21 nt, Homo sapiens
accaaggaccccucaccuugc

SEQ ID NO: 1540171 - RNA, 20 nt, Homo sapiens
accauaaaaauccuucucac

SEQ ID NO: 1540172 - RNA, 17 nt, Homo sapiens
accauauacagcucaga

SEQ ID NO: 1540173 - RNA, 19 nt, Homo sapiens
accauuauggcuuugugcu

SEQ ID NO: 1540174 - RNA, 22 nt, Homo sapiens
accauuauggcuuugugcuugu

SEQ ID NO: 1540175 - RNA, 15 nt, Homo sapiens
accauugugcauucu

SEQ ID NO: 1540176 - RNA, 16 nt, Homo sapiens
accauugugcauucua

SEQ ID NO: 1540177 - RNA, 17 nt, Homo sapiens
accauugugcauucuag

SEQ ID NO: 1540178 - RNA, 19 nt, Homo sapiens
acccaaaugguggccauug

SEQ ID NO: 1540179 - RNA, 21 nt, Homo sapiens
acccacaaguauugcccuuua

SEQ ID NO: 1540180 - RNA, 15 nt, Homo sapiens
acccacugccagaca

SEQ ID NO: 1540181 - RNA, 14 nt, Homo sapiens
acccaggguggucu

SEQ ID NO: 1540182 - RNA, 19 nt, Homo sapiens
acccaguaacucaucuguc

SEQ ID NO: 1540183 - RNA, 15 nt, Homo sapiens
acccaugccauagaa

SEQ ID NO: 1540184 - RNA, 20 nt, Homo sapiens
accccagaacgcaugcaggg

SEQ ID NO: 1540185 - RNA, 20 nt, Homo sapiens
accccaggaugcaugcaggg

SEQ ID NO: 1540186 - RNA, 21 nt, Homo sapiens
acccccagcaacccuccuauc

SEQ ID NO: 1540187 - RNA, 18 nt, Homo sapiens
accccuucccgcccuccc

SEQ ID NO: 1540188 - RNA, 16 nt, Homo sapiens
acccggaucuccaggc

SEQ ID NO: 1540189 - RNA, 16 nt, Homo sapiens
acccuaaaacaugugu

SEQ ID NO: 1540190 - RNA, 15 nt, Homo sapiens
acccuaauguggcag

SEQ ID NO: 1540191 - RNA, 15 nt, Homo sapiens
acccuaucaucaguu

SEQ ID NO: 1540192 - RNA, 17 nt, Homo sapiens
acccucacgaggugucu

SEQ ID NO: 1540193 - RNA, 23 nt, Homo sapiens
acccuguuuguugugucuugcua

SEQ ID NO: 1540194 - RNA, 19 nt, Homo sapiens
acccuucugucuguaagau

SEQ ID NO: 1540195 - RNA, 21 nt, Homo sapiens
accgagucucuucuccacugg

SEQ ID NO: 1540196 - RNA, 23 nt, Homo sapiens
accgauuugcacccaugccauag

SEQ ID NO: 1540197 - RNA, 14 nt, Homo sapiens
accgcuugccauau

SEQ ID NO: 1540198 - RNA, 19 nt, Homo sapiens
accuaguccccagccugcu

SEQ ID NO: 1540199 - RNA, 23 nt, Homo sapiens
accuaugugugugcuuugccacu

SEQ ID NO: 1540200 - RNA, 13 nt, Homo sapiens
accucaaccugug

SEQ ID NO: 1540201 - RNA, 15 nt, Homo sapiens
accucaagcugcauc

SEQ ID NO: 1540202 - RNA, 21 nt, Homo sapiens
accucauuuaccauaaaaauc

SEQ ID NO: 1540203 - RNA, 17 nt, Homo sapiens
accuccaaaagcccuga

SEQ ID NO: 1540204 - RNA, 19 nt, Homo sapiens
accuccccugguccugcac

SEQ ID NO: 1540205 - RNA, 24 nt, Homo sapiens
accuccccugguccugcacugucc

SEQ ID NO: 1540206 - RNA, 20 nt, Homo sapiens
accuccucccaagcacuuca

SEQ ID NO: 1540207 - RNA, 16 nt, Homo sapiens
accuccuccuccaguu

SEQ ID NO: 1540208 - RNA, 22 nt, Homo sapiens
accuccuccuccaguucugaug

SEQ ID NO: 1540209 - RNA, 17 nt, Homo sapiens
accucggggagugccac

SEQ ID NO: 1540210 - RNA, 13 nt, Homo sapiens
accucuauauguu

SEQ ID NO: 1540211 - RNA, 21 nt, Homo sapiens
accucucugaacugcaacacu

SEQ ID NO: 1540212 - RNA, 23 nt, Homo sapiens
accucucugaacugcaacacugg

SEQ ID NO: 1540213 - RNA, 22 nt, Homo sapiens
accucuuuggauguuuucccca

SEQ ID NO: 1540214 - RNA, 23 nt, Homo sapiens
accucuuuggauguuuuccccaa

SEQ ID NO: 1540215 - RNA, 16 nt, Homo sapiens
accugauuuccauuug

SEQ ID NO: 1540216 - RNA, 23 nt, Homo sapiens
accugggugugcuccaggcuucc

SEQ ID NO: 1540217 - RNA, 13 nt, Homo sapiens
accugugcugcug

SEQ ID NO: 1540218 - RNA, 19 nt, Homo sapiens
accuuacuuaaagcuuguu

SEQ ID NO: 1540219 - RNA, 20 nt, Homo sapiens
accuuccaugucaagauuca

SEQ ID NO: 1540220 - RNA, 18 nt, Homo sapiens
accuuccugggcagccca

SEQ ID NO: 1540221 - RNA, 13 nt, Homo sapiens
accuucuaaucca

SEQ ID NO: 1540222 - RNA, 14 nt, Homo sapiens
accuuggcauccuu

SEQ ID NO: 1540223 - RNA, 21 nt, Homo sapiens
accuuucaugugccugaaggc

SEQ ID NO: 1540224 - RNA, 22 nt, Homo sapiens
accuuuuauguguugaugacuc

SEQ ID NO: 1540225 - RNA, 23 nt, Homo sapiens
accuuuugggaaaugcugauuua

SEQ ID NO: 1540226 - RNA, 20 nt, Homo sapiens
acgauguuaaaacaaauuaa

SEQ ID NO: 1540227 - RNA, 20 nt, Homo sapiens
acgcacacacacgcaaauac

SEQ ID NO: 1540228 - RNA, 18 nt, Homo sapiens
acgcagccugcagacuca

SEQ ID NO: 1540229 - RNA, 23 nt, Homo sapiens
acgcagccugcagacucacugug

SEQ ID NO: 1540230 - RNA, 12 nt, Homo sapiens
acgccuccccaa

SEQ ID NO: 1540231 - RNA, 13 nt, Homo sapiens
acgcucucugucu

SEQ ID NO: 1540232 - RNA, 13 nt, Homo sapiens
acggcucuaggug

SEQ ID NO: 1540233 - RNA, 13 nt, Homo sapiens
acggcuuccccau

SEQ ID NO: 1540234 - RNA, 18 nt, Homo sapiens
acgugcucucugcuggau

SEQ ID NO: 1540235 - RNA, 12 nt, Homo sapiens
acgugugaggau

SEQ ID NO: 1540236 - RNA, 16 nt, Homo sapiens
acuaaaccauugugca

SEQ ID NO: 1540237 - RNA, 22 nt, Homo sapiens
acuaaagggugugggucaggga

SEQ ID NO: 1540238 - RNA, 11 nt, Homo sapiens
acuacaugcac

SEQ ID NO: 1540239 - RNA, 22 nt, Homo sapiens
acuaccacuuauuucuaaaucc

SEQ ID NO: 1540240 - RNA, 23 nt, Homo sapiens
acuaccccaggacgcaugcaggg

SEQ ID NO: 1540241 - RNA, 19 nt, Homo sapiens
acuaucgguucaaguugau

SEQ ID NO: 1540242 - RNA, 23 nt, Homo sapiens
acuauuaacaacuugucuauuac

SEQ ID NO: 1540243 - RNA, 21 nt, Homo sapiens
acucaaagagggagugcauuu

SEQ ID NO: 1540244 - RNA, 11 nt, Homo sapiens
acucacugugg

SEQ ID NO: 1540245 - RNA, 12 nt, Homo sapiens
acucacuguggg

SEQ ID NO: 1540246 - RNA, 14 nt, Homo sapiens
acucacugugggaa

SEQ ID NO: 1540247 - RNA, 14 nt, Homo sapiens
acucaucugucacc

SEQ ID NO: 1540248 - RNA, 16 nt, Homo sapiens
acuccaucugcugcca

SEQ ID NO: 1540249 - RNA, 18 nt, Homo sapiens
acucccugucauaguuac

SEQ ID NO: 1540250 - RNA, 17 nt, Homo sapiens
acuccguuuccaaauac

SEQ ID NO: 1540251 - RNA, 23 nt, Homo sapiens
acucggaauucccugaagcaaca

SEQ ID NO: 1540252 - RNA, 14 nt, Homo sapiens
acucuaguauucca

SEQ ID NO: 1540253 - RNA, 17 nt, Homo sapiens
acucucuccaucagaag

SEQ ID NO: 1540254 - RNA, 17 nt, Homo sapiens
acugaacgauccuucaa

SEQ ID NO: 1540255 - RNA, 20 nt, Homo sapiens
acugaauuuuuugucuguua

SEQ ID NO: 1540256 - RNA, 20 nt, Homo sapiens
acugacccauucacauuuua

SEQ ID NO: 1540257 - RNA, 18 nt, Homo sapiens
acugagccaaaaacaaua

SEQ ID NO: 1540258 - RNA, 19 nt, Homo sapiens
acugagggcaugagucuca

SEQ ID NO: 1540259 - RNA, 18 nt, Homo sapiens
acugaguuagaauguuga

SEQ ID NO: 1540260 - RNA, 14 nt, Homo sapiens
acugcaaaacaaga

SEQ ID NO: 1540261 - RNA, 14 nt, Homo sapiens
acugcaacacugga

SEQ ID NO: 1540262 - RNA, 18 nt, Homo sapiens
acugcacagugcaucuca

SEQ ID NO: 1540263 - RNA, 19 nt, Homo sapiens
acugcacagugcaucucag

SEQ ID NO: 1540264 - RNA, 19 nt, Homo sapiens
acugcacccuggauuugca

SEQ ID NO: 1540265 - RNA, 22 nt, Homo sapiens
acugcacccuggauuugcauac

SEQ ID NO: 1540266 - RNA, 21 nt, Homo sapiens
acuggaauaagaagcaaauaa

SEQ ID NO: 1540267 - RNA, 22 nt, Homo sapiens
acugguccaggccaggccucau

SEQ ID NO: 1540268 - RNA, 15 nt, Homo sapiens
acuggugcauuuaaa

SEQ ID NO: 1540269 - RNA, 13 nt, Homo sapiens
acuguacuccucc

SEQ ID NO: 1540270 - RNA, 21 nt, Homo sapiens
acuguauauuuguaugauauu

SEQ ID NO: 1540271 - RNA, 14 nt, Homo sapiens
acugucccacaaaa

SEQ ID NO: 1540272 - RNA, 19 nt, Homo sapiens
agucugugaauaaagccac

SEQ ID NO: 1540273 - RNA, 14 nt, Homo sapiens
agucuuaauauaua

SEQ ID NO: 1540274 - RNA, 17 nt, Homo sapiens
agucuuuguuuacauga

SEQ ID NO: 1540275 - RNA, 18 nt, Homo sapiens
agucuuuguuuacaugag

SEQ ID NO: 1540276 - RNA, 16 nt, Homo sapiens
agugaaguccagugac

SEQ ID NO: 1540277 - RNA, 22 nt, Homo sapiens
agugagacaaaauugaugaucc

SEQ ID NO: 1540278 - RNA, 17 nt, Homo sapiens
agugauaugauguguag

SEQ ID NO: 1540279 - RNA, 15 nt, Homo sapiens
agugaugugguggga

SEQ ID NO: 1540280 - RNA, 23 nt, Homo sapiens
agugcaguggugcgaucuuggcu

SEQ ID NO: 1540281 - RNA, 14 nt, Homo sapiens
agugcaucucagcc

SEQ ID NO: 1540282 - RNA, 19 nt, Homo sapiens
agugccucuggucugggug

SEQ ID NO: 1540283 - RNA, 17 nt, Homo sapiens
aguggugcgaucuuggc

SEQ ID NO: 1540284 - RNA, 16 nt, Homo sapiens
aguuaagucuaucugg

SEQ ID NO: 1540285 - RNA, 22 nt, Homo sapiens
aguuagaaaggguucagggcau

SEQ ID NO: 1540286 - RNA, 13 nt, Homo sapiens
aguuagauucacu

SEQ ID NO: 1540287 - RNA, 20 nt, Homo sapiens
aguuccauuuaaauugacuu

SEQ ID NO: 1540288 - RNA, 16 nt, Homo sapiens
aguuccggaaagccuu

SEQ ID NO: 1540289 - RNA, 17 nt, Homo sapiens
aguuccggaaagccuuc

SEQ ID NO: 1540290 - RNA, 16 nt, Homo sapiens
aguuccugugcacagc

SEQ ID NO: 1540291 - RNA, 11 nt, Homo sapiens
aguucugauga

SEQ ID NO: 1540292 - RNA, 11 nt, Homo sapiens
aguugcacagc

SEQ ID NO: 1540293 - RNA, 22 nt, Homo sapiens
aguugcacagcaucucagcuca

SEQ ID NO: 1540294 - RNA, 15 nt, Homo sapiens
aguuguuauauucau

SEQ ID NO: 1540295 - RNA, 20 nt, Homo sapiens
aguuuaggacccaagguggu

SEQ ID NO: 1540296 - RNA, 12 nt, Homo sapiens
aguuucacauau

SEQ ID NO: 1540297 - RNA, 19 nt, Homo sapiens
aguuuccaaguuuauugcc

SEQ ID NO: 1540298 - RNA, 21 nt, Homo sapiens
aguuuccaaguuuauugcccu

SEQ ID NO: 1540299 - RNA, 19 nt, Homo sapiens
aguuugcuuuguaugcacu

SEQ ID NO: 1540300 - RNA, 14 nt, Homo sapiens
aguuuugucacaau

SEQ ID NO: 1540301 - RNA, 17 nt, Homo sapiens
aguuuugucacaauuau

SEQ ID NO: 1540302 - RNA, 22 nt, Homo sapiens
auaaaaacugcccauuguaacu

SEQ ID NO: 1540303 - RNA, 22 nt, Homo sapiens
auaaaacaguguuuccagugac

SEQ ID NO: 1540304 - RNA, 20 nt, Homo sapiens
auaaaacuuuucugcugaua

SEQ ID NO: 1540305 - RNA, 13 nt, Homo sapiens
auaaaagcacuua

SEQ ID NO: 1540306 - RNA, 16 nt, Homo sapiens
auaaaagcacuuacuu

SEQ ID NO: 1540307 - RNA, 18 nt, Homo sapiens
auaaaaugaauacaauua

SEQ ID NO: 1540308 - RNA, 16 nt, Homo sapiens
auaaacaacauugucu

SEQ ID NO: 1540309 - RNA, 11 nt, Homo sapiens
auaaacacaga

SEQ ID NO: 1540310 - RNA, 14 nt, Homo sapiens
auaaaccagacuca

SEQ ID NO: 1540311 - RNA, 14 nt, Homo sapiens
auaaacucagucaa

SEQ ID NO: 1540312 - RNA, 19 nt, Homo sapiens
auaaacuuuuuauucucag

SEQ ID NO: 1540313 - RNA, 15 nt, Homo sapiens
auaaagaaauaauac

SEQ ID NO: 1540314 - RNA, 14 nt, Homo sapiens
auaaagcaaugugg

SEQ ID NO: 1540315 - RNA, 14 nt, Homo sapiens
auaaauaguauuuc

SEQ ID NO: 1540316 - RNA, 15 nt, Homo sapiens
auaaaucaguuaugu

SEQ ID NO: 1540317 - RNA, 22 nt, Homo sapiens
auaaauuggugauaaguggaaa

SEQ ID NO: 1540318 - RNA, 20 nt, Homo sapiens
auaaccuucaugaugaauua

SEQ ID NO: 1540319 - RNA, 17 nt, Homo sapiens
auaacugagcacuuuga

SEQ ID NO: 1540320 - RNA, 23 nt, Homo sapiens
auaaggccucauccuccacugaa

SEQ ID NO: 1540321 - RNA, 21 nt, Homo sapiens
auaaugugaauaugccaguga

SEQ ID NO: 1540322 - RNA, 15 nt, Homo sapiens
auaauugacaugggc

SEQ ID NO: 1540323 - RNA, 16 nt, Homo sapiens
auaauugacuggugga

SEQ ID NO: 1540324 - RNA, 17 nt, Homo sapiens
auaauugacugguggaa

SEQ ID NO: 1540325 - RNA, 19 nt, Homo sapiens
auacaaacaggugcuaaca

SEQ ID NO: 1540326 - RNA, 18 nt, Homo sapiens
auacaguaagcugcucua

SEQ ID NO: 1540327 - RNA, 22 nt, Homo sapiens
auacauaaaaaagggacaagca

SEQ ID NO: 1540328 - RNA, 14 nt, Homo sapiens
auacaugaugauuu

SEQ ID NO: 1540329 - RNA, 17 nt, Homo sapiens
auaccaccuucaauauc

SEQ ID NO: 1540330 - RNA, 18 nt, Homo sapiens
auaccagcuuaugagcuc

SEQ ID NO: 1540331 - RNA, 17 nt, Homo sapiens
auaccauauacagcuca

SEQ ID NO: 1540332 - RNA, 18 nt, Homo sapiens
auacccacugccagacau

SEQ ID NO: 1540333 - RNA, 13 nt, Homo sapiens
auaccuccauguu

SEQ ID NO: 1540334 - RNA, 22 nt, Homo sapiens
auaccucucaacuuacauaugu

SEQ ID NO: 1540335 - RNA, 18 nt, Homo sapiens
auacucuguguaaucucu

SEQ ID NO: 1540336 - RNA, 21 nt, Homo sapiens
auacugacuccaaccauucaa

SEQ ID NO: 1540337 - RNA, 21 nt, Homo sapiens
auacuucuuuauucacaguau

SEQ ID NO: 1540338 - RNA, 17 nt, Homo sapiens
auacuuuguauacaagu

SEQ ID NO: 1540339 - RNA, 12 nt, Homo sapiens
auagaaacugau

SEQ ID NO: 1540340 - RNA, 17 nt, Homo sapiens
auagacuuagccccaug

SEQ ID NO: 1540341 - RNA, 19 nt, Homo sapiens
auagacuuagccccaugag

SEQ ID NO: 1540342 - RNA, 13 nt, Homo sapiens
auagaguacugca

SEQ ID NO: 1540343 - RNA, 21 nt, Homo sapiens
auagauauccuuggcacaucc

SEQ ID NO: 1540344 - RNA, 18 nt, Homo sapiens
auagcccgaagucucaug

SEQ ID NO: 1540345 - RNA, 22 nt, Homo sapiens
auagccgugugagcagucucag

SEQ ID NO: 1540346 - RNA, 14 nt, Homo sapiens
auagucaaucaaac

SEQ ID NO: 1540347 - RNA, 17 nt, Homo sapiens
auaguugauauguaaca

SEQ ID NO: 1540348 - RNA, 22 nt, Homo sapiens
auauacagcucagaaguuucuu

SEQ ID NO: 1540349 - RNA, 22 nt, Homo sapiens
auauacauagucuuuguuuaca

SEQ ID NO: 1540350 - RNA, 16 nt, Homo sapiens
auauauggggggccaa

SEQ ID NO: 1540351 - RNA, 15 nt, Homo sapiens
auauauuuccacuuc

SEQ ID NO: 1540352 - RNA, 23 nt, Homo sapiens
auauauuuccacuucuucauucu

SEQ ID NO: 1540353 - RNA, 19 nt, Homo sapiens
auaugaggggacugcaugc

SEQ ID NO: 1540354 - RNA, 18 nt, Homo sapiens
auaugccagugacugcug

SEQ ID NO: 1540355 - RNA, 19 nt, Homo sapiens
auauggacuuccaaucuac

SEQ ID NO: 1540356 - RNA, 14 nt, Homo sapiens
auauguaacauguc

SEQ ID NO: 1540357 - RNA, 15 nt, Homo sapiens
auauuccagguuuaa

SEQ ID NO: 1540358 - RNA, 17 nt, Homo sapiens
auauucuguaguauuuu

SEQ ID NO: 1540359 - RNA, 20 nt, Homo sapiens
auauugagaucagcauucaa

SEQ ID NO: 1540360 - RNA, 21 nt, Homo sapiens
auauugagcagaauucauuca

SEQ ID NO: 1540361 - RNA, 18 nt, Homo sapiens
auauuuaaagucuugaau

SEQ ID NO: 1540362 - RNA, 21 nt, Homo sapiens
auauuuaggcaugagcucuug

SEQ ID NO: 1540363 - RNA, 12 nt, Homo sapiens
aucaaacagaaa

SEQ ID NO: 1540364 - RNA, 15 nt, Homo sapiens
aucaacucauguuaa

SEQ ID NO: 1540365 - RNA, 17 nt, Homo sapiens
aucaagggccuacuuua

SEQ ID NO: 1540366 - RNA, 19 nt, Homo sapiens
aucaccugcgugucccauc

SEQ ID NO: 1540367 - RNA, 13 nt, Homo sapiens
aucacuuaucagu

SEQ ID NO: 1540368 - RNA, 20 nt, Homo sapiens
aucagaaaauccugacaaaa

SEQ ID NO: 1540369 - RNA, 15 nt, Homo sapiens
aucagaaacaauuuc

SEQ ID NO: 1540370 - RNA, 14 nt, Homo sapiens
aucagcagugauug

SEQ ID NO: 1540371 - RNA, 19 nt, Homo sapiens
aucaguuacacaugaucau

SEQ ID NO: 1540372 - RNA, 20 nt, Homo sapiens
aucaguuugcuaacauauuu

SEQ ID NO: 1540373 - RNA, 18 nt, Homo sapiens
aucauccugccuucaugg

SEQ ID NO: 1540374 - RNA, 15 nt, Homo sapiens
aucauggcuaucugu

SEQ ID NO: 1540375 - RNA, 18 nt, Homo sapiens
aucauguguuucugugua

SEQ ID NO: 1540376 - RNA, 13 nt, Homo sapiens
aucauuauuucau

SEQ ID NO: 1540377 - RNA, 21 nt, Homo sapiens
auccaagaccuuacaaccaca

SEQ ID NO: 1540378 - RNA, 16 nt, Homo sapiens
auccagaggugaggga

SEQ ID NO: 1540379 - RNA, 20 nt, Homo sapiens
auccaugugcugcuguggca

SEQ ID NO: 1540380 - RNA, 18 nt, Homo sapiens
aucccuagucuauugcag

SEQ ID NO: 1540381 - RNA, 17 nt, Homo sapiens
auccguaccaucgguca

SEQ ID NO: 1540382 - RNA, 13 nt, Homo sapiens
auccucucucugu

SEQ ID NO: 1540383 - RNA, 23 nt, Homo sapiens
auccugauuauugaauguuauau

SEQ ID NO: 1540384 - RNA, 20 nt, Homo sapiens
auccuguacaagugcucagu

SEQ ID NO: 1540385 - RNA, 13 nt, Homo sapiens
auccuuuuaucuc

SEQ ID NO: 1540386 - RNA, 18 nt, Homo sapiens
aucgcugccuugccaugu

SEQ ID NO: 1540387 - RNA, 19 nt, Homo sapiens
aucuagaagagucuauugu

SEQ ID NO: 1540388 - RNA, 23 nt, Homo sapiens
aucuagaggcuuccuucauuucc

SEQ ID NO: 1540389 - RNA, 23 nt, Homo sapiens
aucuagcuccauaauugcaaggg

SEQ ID NO: 1540390 - RNA, 13 nt, Homo sapiens
aucuauaccaccu

SEQ ID NO: 1540391 - RNA, 14 nt, Homo sapiens
aucuauaccaccuu

SEQ ID NO: 1540392 - RNA, 14 nt, Homo sapiens
aucuauuucauacc

SEQ ID NO: 1540393 - RNA, 21 nt, Homo sapiens
aucucacuuuucuccaugagu

SEQ ID NO: 1540394 - RNA, 18 nt, Homo sapiens
aucucaggccaccugccc

SEQ ID NO: 1540395 - RNA, 18 nt, Homo sapiens
aucucugauuaaauuuaa

SEQ ID NO: 1540396 - RNA, 15 nt, Homo sapiens
aucucuggagugugu

SEQ ID NO: 1540397 - RNA, 15 nt, Homo sapiens
aucucuucuuccuuu

SEQ ID NO: 1540398 - RNA, 14 nt, Homo sapiens
aucugagcuuaaac

SEQ ID NO: 1540399 - RNA, 14 nt, Homo sapiens
aucugauaucuguu

SEQ ID NO: 1540400 - RNA, 20 nt, Homo sapiens
aucugcauaaccgcacagac

SEQ ID NO: 1540401 - RNA, 16 nt, Homo sapiens
aucuguggucuucaaa

SEQ ID NO: 1540402 - RNA, 16 nt, Homo sapiens
ucauuagcugugauuu

SEQ ID NO: 1540403 - RNA, 12 nt, Homo sapiens
ucauucuuuaua

SEQ ID NO: 1540404 - RNA, 13 nt, Homo sapiens
ucauuuaccauaa

SEQ ID NO: 1540405 - RNA, 13 nt, Homo sapiens
ucauuuagcauug

SEQ ID NO: 1540406 - RNA, 18 nt, Homo sapiens
ucauuuuaacaucugaga

SEQ ID NO: 1540407 - RNA, 19 nt, Homo sapiens
ucauuuuaacaucugagaa

SEQ ID NO: 1540408 - RNA, 14 nt, Homo sapiens
ucauuuucaccucc

SEQ ID NO: 1540409 - RNA, 14 nt, Homo sapiens
ucauuuugcaacuu

SEQ ID NO: 1540410 - RNA, 12 nt, Homo sapiens
uccaacuuguca

SEQ ID NO: 1540411 - RNA, 23 nt, Homo sapiens
uccaagccucucuggcacuuuga

SEQ ID NO: 1540412 - RNA, 15 nt, Homo sapiens
uccaaggcaaauguc

SEQ ID NO: 1540413 - RNA, 19 nt, Homo sapiens
uccaagugaaugaguuucc

SEQ ID NO: 1540414 - RNA, 18 nt, Homo sapiens
uccacaaauguccucaga

SEQ ID NO: 1540415 - RNA, 22 nt, Homo sapiens
uccacaaccuccuccuccaguu

SEQ ID NO: 1540416 - RNA, 11 nt, Homo sapiens
uccaccugcag

SEQ ID NO: 1540417 - RNA, 16 nt, Homo sapiens
uccaccugugcugcug

SEQ ID NO: 1540418 - RNA, 12 nt, Homo sapiens
uccacuguaaau

SEQ ID NO: 1540419 - RNA, 16 nt, Homo sapiens
uccagaggugauggua

SEQ ID NO: 1540420 - RNA, 22 nt, Homo sapiens
uccagaugugccuagacacgaa

SEQ ID NO: 1540421 - RNA, 16 nt, Homo sapiens
uccauaauugcaaggg

SEQ ID NO: 1540422 - RNA, 23 nt, Homo sapiens
uccauacccccugccccagagaa

SEQ ID NO: 1540423 - RNA, 21 nt, Homo sapiens
uccauccccauguguuucagg

SEQ ID NO: 1540424 - RNA, 14 nt, Homo sapiens
uccaucugucuguc

SEQ ID NO: 1540425 - RNA, 19 nt, Homo sapiens
uccauguagaagagggaga

SEQ ID NO: 1540426 - RNA, 22 nt, Homo sapiens
ucccaaaugcagcuucagguga

SEQ ID NO: 1540427 - RNA, 12 nt, Homo sapiens
ucccaauuuccc

SEQ ID NO: 1540428 - RNA, 20 nt, Homo sapiens
ucccaccacagcagguguca

SEQ ID NO: 1540429 - RNA, 21 nt, Homo sapiens
ucccacggccacugcagucac

SEQ ID NO: 1540430 - RNA, 18 nt, Homo sapiens
ucccagacagcaguguga

SEQ ID NO: 1540431 - RNA, 16 nt, Homo sapiens
ucccaguuaacuguua

SEQ ID NO: 1540432 - RNA, 13 nt, Homo sapiens
ucccaugauuucu

SEQ ID NO: 1540433 - RNA, 13 nt, Homo sapiens
uccccaacgaaaa

SEQ ID NO: 1540434 - RNA, 19 nt, Homo sapiens
uccccaacgaaaagcacau

SEQ ID NO: 1540435 - RNA, 18 nt, Homo sapiens
uccccagccugcucccua

SEQ ID NO: 1540436 - RNA, 19 nt, Homo sapiens
uccccagccugcucccuag

SEQ ID NO: 1540437 - RNA, 20 nt, Homo sapiens
uccccauuaguauccuguua

SEQ ID NO: 1540438 - RNA, 13 nt, Homo sapiens
uccccauugccuu

SEQ ID NO: 1540439 - RNA, 13 nt, Homo sapiens
ucccccuuucucc

SEQ ID NO: 1540440 - RNA, 14 nt, Homo sapiens
uccccuccaaguga

SEQ ID NO: 1540441 - RNA, 13 nt, Homo sapiens
uccccuccagacc

SEQ ID NO: 1540442 - RNA, 21 nt, Homo sapiens
uccccugccuuccuuuaaucc

SEQ ID NO: 1540443 - RNA, 14 nt, Homo sapiens
uccccuggacauau

SEQ ID NO: 1540444 - RNA, 15 nt, Homo sapiens
uccccuggacauauu

SEQ ID NO: 1540445 - RNA, 15 nt, Homo sapiens
uccccugguccugca

SEQ ID NO: 1540446 - RNA, 13 nt, Homo sapiens
ucccuagccagag

SEQ ID NO: 1540447 - RNA, 23 nt, Homo sapiens
ucccuagccagaggcucuaaugu

SEQ ID NO: 1540448 - RNA, 21 nt, Homo sapiens
ucccucaggcuuguugcccuc

SEQ ID NO: 1540449 - RNA, 22 nt, Homo sapiens
ucccugagaagccucaugggag

SEQ ID NO: 1540450 - RNA, 16 nt, Homo sapiens
uccgucaccucagaga

SEQ ID NO: 1540451 - RNA, 16 nt, Homo sapiens
uccguuuccaaauaca

SEQ ID NO: 1540452 - RNA, 14 nt, Homo sapiens
uccuaaauuuccag

SEQ ID NO: 1540453 - RNA, 14 nt, Homo sapiens
uccuacaauaucau

SEQ ID NO: 1540454 - RNA, 15 nt, Homo sapiens
uccuacagcauaaag

SEQ ID NO: 1540455 - RNA, 14 nt, Homo sapiens
uccuaguagcuuuc

SEQ ID NO: 1540456 - RNA, 20 nt, Homo sapiens
uccuauccccggacgcaugc

SEQ ID NO: 1540457 - RNA, 21 nt, Homo sapiens
uccuauccccggacgcaugca

SEQ ID NO: 1540458 - RNA, 20 nt, Homo sapiens
uccuaucccuggacgcaugc

SEQ ID NO: 1540459 - RNA, 17 nt, Homo sapiens
uccuaugcugcaauaca

SEQ ID NO: 1540460 - RNA, 17 nt, Homo sapiens
uccuauucuauugcagu

SEQ ID NO: 1540461 - RNA, 22 nt, Homo sapiens
uccucaagauccugucuugcug

SEQ ID NO: 1540462 - RNA, 15 nt, Homo sapiens
uccucaguuccugca

SEQ ID NO: 1540463 - RNA, 19 nt, Homo sapiens
uccuccgucaccucagaga

SEQ ID NO: 1540464 - RNA, 13 nt, Homo sapiens
uccucuccaagcu

SEQ ID NO: 1540465 - RNA, 16 nt, Homo sapiens
uccugacaaaagggac

SEQ ID NO: 1540466 - RNA, 19 nt, Homo sapiens
uccugacagaaggacucag

SEQ ID NO: 1540467 - RNA, 22 nt, Homo sapiens
uccugcaaacccauuuccagcu

SEQ ID NO: 1540468 - RNA, 15 nt, Homo sapiens
uccugccuucaugga

SEQ ID NO: 1540469 - RNA, 16 nt, Homo sapiens
uccugccuucauggaa

SEQ ID NO: 1540470 - RNA, 23 nt, Homo sapiens
uccugcuugguuuagcugugcag

SEQ ID NO: 1540471 - RNA, 17 nt, Homo sapiens
uccuuaaaaaauaugcu

SEQ ID NO: 1540472 - RNA, 16 nt, Homo sapiens
uccuucaagcugcuga

SEQ ID NO: 1540473 - RNA, 12 nt, Homo sapiens
uccuucauuucc

SEQ ID NO: 1540474 - RNA, 15 nt, Homo sapiens
uccuugaaaccagcu

SEQ ID NO: 1540475 - RNA, 17 nt, Homo sapiens
uccuugccgcugggaga

SEQ ID NO: 1540476 - RNA, 15 nt, Homo sapiens
uccuuucauccucag

SEQ ID NO: 1540477 - RNA, 13 nt, Homo sapiens
ucgauauaugacu

SEQ ID NO: 1540478 - RNA, 19 nt, Homo sapiens
ucgcauuaaugaaauacca

SEQ ID NO: 1540479 - RNA, 17 nt, Homo sapiens
ucgcuauucccaggcag

SEQ ID NO: 1540480 - RNA, 17 nt, Homo sapiens
ucggaggcuugggaccg

SEQ ID NO: 1540481 - RNA, 16 nt, Homo sapiens
ucguugacaugcacag

SEQ ID NO: 1540482 - RNA, 14 nt, Homo sapiens
ucuaaaaaauaacu

SEQ ID NO: 1540483 - RNA, 13 nt, Homo sapiens
ucuaaaggggaca

SEQ ID NO: 1540484 - RNA, 15 nt, Homo sapiens
ucuaacccacccuca

SEQ ID NO: 1540485 - RNA, 20 nt, Homo sapiens
ucuaauaaacacagauuauu

SEQ ID NO: 1540486 - RNA, 14 nt, Homo sapiens
ucuaauccaugugc

SEQ ID NO: 1540487 - RNA, 20 nt, Homo sapiens
ucuaaucccuucaaggaagu

SEQ ID NO: 1540488 - RNA, 15 nt, Homo sapiens
ucuaauuggcaugaa

SEQ ID NO: 1540489 - RNA, 17 nt, Homo sapiens
ucuacuccaugcacaua

SEQ ID NO: 1540490 - RNA, 17 nt, Homo sapiens
ucuacugagacaugacu

SEQ ID NO: 1540491 - RNA, 13 nt, Homo sapiens
ucuaggaaagugc

SEQ ID NO: 1540492 - RNA, 20 nt, Homo sapiens
ucuauaaauucaacacuuau

SEQ ID NO: 1540493 - RNA, 16 nt, Homo sapiens
ucuauaccaccuucaa

SEQ ID NO: 1540494 - RNA, 14 nt, Homo sapiens
ucuauauuucauau

SEQ ID NO: 1540495 - RNA, 14 nt, Homo sapiens
ucuaugaucuuggc

SEQ ID NO: 1540496 - RNA, 13 nt, Homo sapiens
ucuaugccuguau

SEQ ID NO: 1540497 - RNA, 15 nt, Homo sapiens
ucuaugguguaugac

SEQ ID NO: 1540498 - RNA, 17 nt, Homo sapiens
ucucaacuuacauaugu

SEQ ID NO: 1540499 - RNA, 19 nt, Homo sapiens
ucucaauacccacugccag

SEQ ID NO: 1540500 - RNA, 16 nt, Homo sapiens
ucucacgauaugcaag

SEQ ID NO: 1540501 - RNA, 17 nt, Homo sapiens
ucucacuaaaauggaua

SEQ ID NO: 1540502 - RNA, 17 nt, Homo sapiens
ucucacuagcacaugga

SEQ ID NO: 1540503 - RNA, 17 nt, Homo sapiens
ucucacugaugcccuuu

SEQ ID NO: 1540504 - RNA, 20 nt, Homo sapiens
ucucacuuuucuccaugagu

SEQ ID NO: 1540505 - RNA, 15 nt, Homo sapiens
ucucaugaaccucaa

SEQ ID NO: 1540506 - RNA, 20 nt, Homo sapiens
ucucauuccucuguccccga

SEQ ID NO: 1540507 - RNA, 10 nt, Homo sapiens
ucuccaccuc

SEQ ID NO: 1540508 - RNA, 19 nt, Homo sapiens
ucuccccaguguaugucuu

SEQ ID NO: 1540509 - RNA, 20 nt, Homo sapiens
ucucgucaggaggugccuga

SEQ ID NO: 1540510 - RNA, 20 nt, Homo sapiens
ucucuagacaucuagucuca

SEQ ID NO: 1540511 - RNA, 12 nt, Homo sapiens
ucucuaucuuag

SEQ ID NO: 1540512 - RNA, 23 nt, Homo sapiens
ucucucagcccaggucuccuggg

SEQ ID NO: 1540513 - RNA, 14 nt, Homo sapiens
ucucucaugaaccu

SEQ ID NO: 1540514 - RNA, 15 nt, Homo sapiens
ucucugaacugcaac

SEQ ID NO: 1540515 - RNA, 20 nt, Homo sapiens
ucucugaacugcaacacugg

SEQ ID NO: 1540516 - RNA, 12 nt, Homo sapiens
ucucugugcugg

SEQ ID NO: 1540517 - RNA, 19 nt, Homo sapiens
ucucuguguuacccaguaa

SEQ ID NO: 1540518 - RNA, 16 nt, Homo sapiens
ucucuuaggacaguaa

SEQ ID NO: 1540519 - RNA, 24 nt, Homo sapiens
ucugaaaauauuuuuuucuagcua

SEQ ID NO: 1540520 - RNA, 13 nt, Homo sapiens
ucugaaacacagu

SEQ ID NO: 1540521 - RNA, 13 nt, Homo sapiens
ucugagcaguugu

SEQ ID NO: 1540522 - RNA, 23 nt, Homo sapiens
ucugcauaaauauuagcaaagca

SEQ ID NO: 1540523 - RNA, 19 nt, Homo sapiens
ucugcauaaccgcacagac

SEQ ID NO: 1540524 - RNA, 18 nt, Homo sapiens
ucugcaugcuccucugcc

SEQ ID NO: 1540525 - RNA, 20 nt, Homo sapiens
ucugcccccaaaagugucaa

SEQ ID NO: 1540526 - RNA, 22 nt, Homo sapiens
ucugccgugagagcccaaucac

SEQ ID NO: 1540527 - RNA, 14 nt, Homo sapiens
ucuggagcugaagc

SEQ ID NO: 1540528 - RNA, 17 nt, Homo sapiens
ucuggauucaaauuuau

SEQ ID NO: 1540529 - RNA, 14 nt, Homo sapiens
ucugggcccagaac

SEQ ID NO: 1540530 - RNA, 13 nt, Homo sapiens
ucuggucacuuca

SEQ ID NO: 1540531 - RNA, 21 nt, Homo sapiens
ucuguaaauuuaacugcauau

SEQ ID NO: 1540532 - RNA, 14 nt, Homo sapiens
ucuguaagagaauu

SEQ ID NO: 1540533 - RNA, 12 nt, Homo sapiens
aaaaaccaauga

SEQ ID NO: 1540534 - RNA, 18 nt, Homo sapiens
aaaaaccucuuagcuuuu

SEQ ID NO: 1540535 - RNA, 13 nt, Homo sapiens
aaaaagcaucaug

SEQ ID NO: 1540536 - RNA, 12 nt, Homo sapiens
aaaaagguuuaa

SEQ ID NO: 1540537 - RNA, 22 nt, Homo sapiens
aaaaauaaucaagugcauuucu

SEQ ID NO: 1540538 - RNA, 18 nt, Homo sapiens
aaaaauauucuccaugga

SEQ ID NO: 1540539 - RNA, 14 nt, Homo sapiens
aaaaaugugagcua

SEQ ID NO: 1540540 - RNA, 14 nt, Homo sapiens
aaaacaguguuucc

SEQ ID NO: 1540541 - RNA, 10 nt, Homo sapiens
aaaaccaaag

SEQ ID NO: 1540542 - RNA, 10 nt, Homo sapiens
aaaaccaaug

SEQ ID NO: 1540543 - RNA, 13 nt, Homo sapiens
aaaacuguugcua

SEQ ID NO: 1540544 - RNA, 13 nt, Homo sapiens
aaaagaaacugug

SEQ ID NO: 1540545 - RNA, 13 nt, Homo sapiens
aaaagaugccguu

SEQ ID NO: 1540546 - RNA, 13 nt, Homo sapiens
aaaauacuucuuu

SEQ ID NO: 1540547 - RNA, 19 nt, Homo sapiens
aaaauagaauguuacuuug

SEQ ID NO: 1540548 - RNA, 12 nt, Homo sapiens
aaaauaguagca

SEQ ID NO: 1540549 - RNA, 18 nt, Homo sapiens
aaaauaguguguccaugc

SEQ ID NO: 1540550 - RNA, 22 nt, Homo sapiens
aaaauauuucuaagcuuauuuc

SEQ ID NO: 1540551 - RNA, 20 nt, Homo sapiens
aaaaucaguuuguuguucag

SEQ ID NO: 1540552 - RNA, 17 nt, Homo sapiens
aaaaugaauacaauuaa

SEQ ID NO: 1540553 - RNA, 11 nt, Homo sapiens
aaaauggacau

SEQ ID NO: 1540554 - RNA, 14 nt, Homo sapiens
aaacaaaaacuguu

SEQ ID NO: 1540555 - RNA, 20 nt, Homo sapiens
aaacacagaacucagccuua

SEQ ID NO: 1540556 - RNA, 19 nt, Homo sapiens
aaacagauguuuguuuuca

SEQ ID NO: 1540557 - RNA, 14 nt, Homo sapiens
aaacagcuugaugc

SEQ ID NO: 1540558 - RNA, 11 nt, Homo sapiens
aaacagucaaa

SEQ ID NO: 1540559 - RNA, 14 nt, Homo sapiens
aaacauaugcauua

SEQ ID NO: 1540560 - RNA, 23 nt, Homo sapiens
aaacaugggguuggcugggccca

SEQ ID NO: 1540561 - RNA, 15 nt, Homo sapiens
aaaccacagcccugu

SEQ ID NO: 1540562 - RNA, 20 nt, Homo sapiens
aaaccaucaaaaauauucca

SEQ ID NO: 1540563 - RNA, 21 nt, Homo sapiens
aaacccagauugaagcuaaaa

SEQ ID NO: 1540564 - RNA, 23 nt, Homo sapiens
ccaaaugacaagucacacccucc

SEQ ID NO: 1540565 - RNA, 18 nt, Homo sapiens
ccaacaacuccaggaaaa

SEQ ID NO: 1540566 - RNA, 15 nt, Homo sapiens
ccaaccugcucauuu

SEQ ID NO: 1540567 - RNA, 20 nt, Homo sapiens
ccaagaccuuacaaccacau

SEQ ID NO: 1540568 - RNA, 21 nt, Homo sapiens
ccaagccaggguuccagacag

SEQ ID NO: 1540569 - RNA, 17 nt, Homo sapiens
ccaagcugcucauuuca

SEQ ID NO: 1540570 - RNA, 16 nt, Homo sapiens
ccaagugaaugaguuu

SEQ ID NO: 1540571 - RNA, 23 nt, Homo sapiens
ccaagugaaugaguuuccagcua

SEQ ID NO: 1540572 - RNA, 11 nt, Homo sapiens
ccaaguguccu

SEQ ID NO: 1540573 - RNA, 19 nt, Homo sapiens
ccaaucccaccaacccuca

SEQ ID NO: 1540574 - RNA, 20 nt, Homo sapiens
ccaaugaagcaaacacacag

SEQ ID NO: 1540575 - RNA, 11 nt, Homo sapiens
ccaauguuuca

SEQ ID NO: 1540576 - RNA, 15 nt, Homo sapiens
ccacacguuugccaa

SEQ ID NO: 1540577 - RNA, 16 nt, Homo sapiens
ccacaggagcguguac

SEQ ID NO: 1540578 - RNA, 22 nt, Homo sapiens
ccaccuggauggaucugcucca

SEQ ID NO: 1540579 - RNA, 15 nt, Homo sapiens
ccacggccacugcag

SEQ ID NO: 1540580 - RNA, 16 nt, Homo sapiens
ccacggcucuaggugg

SEQ ID NO: 1540581 - RNA, 21 nt, Homo sapiens
ccacguguccccagagcuuua

SEQ ID NO: 1540582 - RNA, 13 nt, Homo sapiens
ccacuccacaguu

SEQ ID NO: 1540583 - RNA, 14 nt, Homo sapiens
ccacugaagaguau

SEQ ID NO: 1540584 - RNA, 15 nt, Homo sapiens
ccacugacaggcuuu

SEQ ID NO: 1540585 - RNA, 12 nt, Homo sapiens
ccacugccagac

SEQ ID NO: 1540586 - RNA, 21 nt, Homo sapiens
ccacuuuccccgugggccaug

SEQ ID NO: 1540587 - RNA, 22 nt, Homo sapiens
ccagaacaaaccucuauauguu

SEQ ID NO: 1540588 - RNA, 21 nt, Homo sapiens
ccagacacacagccugugcuu

SEQ ID NO: 1540589 - RNA, 13 nt, Homo sapiens
ccagacaugccac

SEQ ID NO: 1540590 - RNA, 19 nt, Homo sapiens
ccagagagacccugccaac

SEQ ID NO: 1540591 - RNA, 15 nt, Homo sapiens
ccagagccauggacu

SEQ ID NO: 1540592 - RNA, 13 nt, Homo sapiens
ccagagcuuuaca

SEQ ID NO: 1540593 - RNA, 22 nt, Homo sapiens
ccagaggcucuaauguacaaua

SEQ ID NO: 1540594 - RNA, 17 nt, Homo sapiens
ccagaggggcggggcca

SEQ ID NO: 1540595 - RNA, 15 nt, Homo sapiens
ccagagugcuuauaa

SEQ ID NO: 1540596 - RNA, 15 nt, Homo sapiens
ccagccugcucccua

SEQ ID NO: 1540597 - RNA, 20 nt, Homo sapiens
ccagccugcucccuagccag

SEQ ID NO: 1540598 - RNA, 19 nt, Homo sapiens
ccagcugcaggaaucaaaa

SEQ ID NO: 1540599 - RNA, 21 nt, Homo sapiens
ccagcuuaugagcucaaagua

SEQ ID NO: 1540600 - RNA, 13 nt, Homo sapiens
ccaggacacugcc

SEQ ID NO: 1540601 - RNA, 12 nt, Homo sapiens
ccaggaugcaug

SEQ ID NO: 1540602 - RNA, 16 nt, Homo sapiens
ccaggcagcugcaguu

SEQ ID NO: 1540603 - RNA, 11 nt, Homo sapiens
ccagggccaug

SEQ ID NO: 1540604 - RNA, 15 nt, Homo sapiens
ccaggggcagugaag

SEQ ID NO: 1540605 - RNA, 14 nt, Homo sapiens
ccaggguuccagac

SEQ ID NO: 1540606 - RNA, 12 nt, Homo sapiens
ccagucccucag

SEQ ID NO: 1540607 - RNA, 17 nt, Homo sapiens
ccagucccucagccacu

SEQ ID NO: 1540608 - RNA, 17 nt, Homo sapiens
ccagugacacaacucau

SEQ ID NO: 1540609 - RNA, 23 nt, Homo sapiens
ccauaaaauuagacauaccucuc

SEQ ID NO: 1540610 - RNA, 11 nt, Homo sapiens
ccauaccagcu

SEQ ID NO: 1540611 - RNA, 20 nt, Homo sapiens
ccauccaauggauugugcaa

SEQ ID NO: 1540612 - RNA, 14 nt, Homo sapiens
ccauccauauacuu

SEQ ID NO: 1540613 - RNA, 17 nt, Homo sapiens
ccaugaaaaacagcaga

SEQ ID NO: 1540614 - RNA, 18 nt, Homo sapiens
ccaugguagacugugaca

SEQ ID NO: 1540615 - RNA, 22 nt, Homo sapiens
ccauuauucuauuuuagacuuu

SEQ ID NO: 1540616 - RNA, 12 nt, Homo sapiens
cgagcuggccga

SEQ ID NO: 1540617 - RNA, 13 nt, Homo sapiens
cgagucuggagac

SEQ ID NO: 1540618 - RNA, 19 nt, Homo sapiens
cgaguuccggaaagccuuc

SEQ ID NO: 1540619 - RNA, 15 nt, Homo sapiens
cgauggugcugcacc

SEQ ID NO: 1540620 - RNA, 14 nt, Homo sapiens
cgccaugugcugug

SEQ ID NO: 1540621 - RNA, 16 nt, Homo sapiens
cgccucucucagccca

SEQ ID NO: 1540622 - RNA, 16 nt, Homo sapiens
cgcgcacacacacucu

SEQ ID NO: 1540623 - RNA, 16 nt, Homo sapiens
cgcuccucugccuugg

SEQ ID NO: 1540624 - RNA, 17 nt, Homo sapiens
cgcugagggcaggguuc

SEQ ID NO: 1540625 - RNA, 16 nt, Homo sapiens
cgcugcagucagcaca

SEQ ID NO: 1540626 - RNA, 20 nt, Homo sapiens
cgcugggagaaaagccagau

SEQ ID NO: 1540627 - RNA, 14 nt, Homo sapiens
cgcuucauaggcag

SEQ ID NO: 1540628 - RNA, 16 nt, Homo sapiens
cggacgccccccggcc

SEQ ID NO: 1540629 - RNA, 20 nt, Homo sapiens
cggccacucuguuugcucac

SEQ ID NO: 1540630 - RNA, 20 nt, Homo sapiens
cguacccuuugcacacaggg

SEQ ID NO: 1540631 - RNA, 21 nt, Homo sapiens
cguauuuuggggaacuguugu

SEQ ID NO: 1540632 - RNA, 18 nt, Homo sapiens
cgucccacugagucucau

SEQ ID NO: 1540633 - RNA, 20 nt, Homo sapiens
cgugcacacaccugcacacc

SEQ ID NO: 1540634 - RNA, 14 nt, Homo sapiens
cgugguaugugaau

SEQ ID NO: 1540635 - RNA, 14 nt, Homo sapiens
cgugugaggaugug

SEQ ID NO: 1540636 - RNA, 15 nt, Homo sapiens
cguugacaugcacag

SEQ ID NO: 1540637 - RNA, 21 nt, Homo sapiens
cuaaaaccuuccaugucaaga

SEQ ID NO: 1540638 - RNA, 15 nt, Homo sapiens
cuaaaccauugugca

SEQ ID NO: 1540639 - RNA, 15 nt, Homo sapiens
cuaaacuguuuucau

SEQ ID NO: 1540640 - RNA, 13 nt, Homo sapiens
cuaacacauuucg

SEQ ID NO: 1540641 - RNA, 15 nt, Homo sapiens
cuaagguacggugag

SEQ ID NO: 1540642 - RNA, 13 nt, Homo sapiens
cuaauaaacaauu

SEQ ID NO: 1540643 - RNA, 22 nt, Homo sapiens
cuaauaaagaaauaauacccug

SEQ ID NO: 1540644 - RNA, 22 nt, Homo sapiens
cuaaucagcauucucacuccua

SEQ ID NO: 1540645 - RNA, 13 nt, Homo sapiens
cuaauccaugugc

SEQ ID NO: 1540646 - RNA, 13 nt, Homo sapiens
cuaauguacaaua

SEQ ID NO: 1540647 - RNA, 20 nt, Homo sapiens
cuaauguacaauaaagcaau

SEQ ID NO: 1540648 - RNA, 21 nt, Homo sapiens
cuaauguacaauaaagcaaug

SEQ ID NO: 1540649 - RNA, 22 nt, Homo sapiens
cuaauguacaauaaagcaaugu

SEQ ID NO: 1540650 - RNA, 23 nt, Homo sapiens
cuaauuaaaaaguuaaucuucau

SEQ ID NO: 1540651 - RNA, 17 nt, Homo sapiens
cuacugagacaugacua

SEQ ID NO: 1540652 - RNA, 20 nt, Homo sapiens
cuagaggcuauuccuaggcc

SEQ ID NO: 1540653 - RNA, 21 nt, Homo sapiens
cuagaggcuuccuucauuucc

SEQ ID NO: 1540654 - RNA, 21 nt, Homo sapiens
cuagauucauggcuuuaacag

SEQ ID NO: 1540655 - RNA, 16 nt, Homo sapiens
cuagccagaggcucua

SEQ ID NO: 1540656 - RNA, 17 nt, Homo sapiens
cuagccagaggcucuaa

SEQ ID NO: 1540657 - RNA, 15 nt, Homo sapiens
cuagcugugaccucu

SEQ ID NO: 1540658 - RNA, 18 nt, Homo sapiens
cuaggugcccagucuuga

SEQ ID NO: 1540659 - RNA, 22 nt, Homo sapiens
cuaggugggucaacuccaaggc

SEQ ID NO: 1540660 - RNA, 14 nt, Homo sapiens
cuagucacauauca

SEQ ID NO: 1540661 - RNA, 22 nt, Homo sapiens
cuaguccccagccugcucccua

SEQ ID NO: 1540662 - RNA, 15 nt, Homo sapiens
cuaucuuaggaguaa

SEQ ID NO: 1540663 - RNA, 17 nt, Homo sapiens
cuaucuuuuguucuacc

SEQ ID NO: 1540664 - RNA, 13 nt, Homo sapiens
cuaugaucuuggc

SEQ ID NO: 1540665 - RNA, 13 nt, Homo sapiens
cuauuccuaggcc

SEQ ID NO: 1540666 - RNA, 13 nt, Homo sapiens
cuauucuauugca

SEQ ID NO: 1540667 - RNA, 20 nt, Homo sapiens
cucaaaaaucaucaaagugu

SEQ ID NO: 1540668 - RNA, 22 nt, Homo sapiens
cucaaagagggagugcauuuau

SEQ ID NO: 1540669 - RNA, 22 nt, Homo sapiens
cucaacaaagaagaaccaucuu

SEQ ID NO: 1540670 - RNA, 17 nt, Homo sapiens
cucaacccugugaucua

SEQ ID NO: 1540671 - RNA, 16 nt, Homo sapiens
cucaacuuacauaugu

SEQ ID NO: 1540672 - RNA, 22 nt, Homo sapiens
cucaacuuacauaugucuucaa

SEQ ID NO: 1540673 - RNA, 12 nt, Homo sapiens
cucaagauccug

SEQ ID NO: 1540674 - RNA, 18 nt, Homo sapiens
cucaauaaaggucauauu

SEQ ID NO: 1540675 - RNA, 22 nt, Homo sapiens
cucaauaaaggucauauuggaa

SEQ ID NO: 1540676 - RNA, 14 nt, Homo sapiens
cucaauacccacug

SEQ ID NO: 1540677 - RNA, 22 nt, Homo sapiens
cucacgggugcaugaaaccacu

SEQ ID NO: 1540678 - RNA, 13 nt, Homo sapiens
cucacuagcacau

SEQ ID NO: 1540679 - RNA, 16 nt, Homo sapiens
cucacuggugcauuua

SEQ ID NO: 1540680 - RNA, 18 nt, Homo sapiens
cucagagcuccacagaag

SEQ ID NO: 1540681 - RNA, 19 nt, Homo sapiens
cucagagcuccacagaaga

SEQ ID NO: 1540682 - RNA, 21 nt, Homo sapiens
cucagccacacccaggcacuu

SEQ ID NO: 1540683 - RNA, 15 nt, Homo sapiens
cucagccaccccuca

SEQ ID NO: 1540684 - RNA, 16 nt, Homo sapiens
cucaggagaaggccug

SEQ ID NO: 1540685 - RNA, 12 nt, Homo sapiens
cucagggaccaa

SEQ ID NO: 1540686 - RNA, 13 nt, Homo sapiens
cucagggaccaag

SEQ ID NO: 1540687 - RNA, 16 nt, Homo sapiens
cucaggugcgugccac

SEQ ID NO: 1540688 - RNA, 14 nt, Homo sapiens
cucagucaaaugua

SEQ ID NO: 1540689 - RNA, 16 nt, Homo sapiens
cucaguuccugcagca

SEQ ID NO: 1540690 - RNA, 22 nt, Homo sapiens
cucaucacacgucacaaugucc

SEQ ID NO: 1540691 - RNA, 14 nt, Homo sapiens
cucaugaaccucaa

SEQ ID NO: 1540692 - RNA, 22 nt, Homo sapiens
cuuaagaaagcuauauaugaau

SEQ ID NO: 1540693 - RNA, 22 nt, Homo sapiens
cuuaauguucugaauaauuucu

SEQ ID NO: 1540694 - RNA, 15 nt, Homo sapiens
cuuagaauacuguau

SEQ ID NO: 1540695 - RNA, 16 nt, Homo sapiens
cuuagaauacuguauu

SEQ ID NO: 1540696 - RNA, 13 nt, Homo sapiens
cuuagcauguccc

SEQ ID NO: 1540697 - RNA, 14 nt, Homo sapiens
cuuagccccaugag

SEQ ID NO: 1540698 - RNA, 20 nt, Homo sapiens
cuuagcguucuguuucacca

SEQ ID NO: 1540699 - RNA, 14 nt, Homo sapiens
cuuagucauaccau

SEQ ID NO: 1540700 - RNA, 17 nt, Homo sapiens
cuuauauacuaauauca

SEQ ID NO: 1540701 - RNA, 17 nt, Homo sapiens
cuuauuucuaacuauua

SEQ ID NO: 1540702 - RNA, 17 nt, Homo sapiens
cuucaaaaucagugaug

SEQ ID NO: 1540703 - RNA, 21 nt, Homo sapiens
cuucaaagucucaaugaaaua

SEQ ID NO: 1540704 - RNA, 18 nt, Homo sapiens
cuucaaaguuuucugcug

SEQ ID NO: 1540705 - RNA, 21 nt, Homo sapiens
cuucaagccuggcccagugag

SEQ ID NO: 1540706 - RNA, 17 nt, Homo sapiens
cuucagcuuugaaaagg

SEQ ID NO: 1540707 - RNA, 18 nt, Homo sapiens
cuucaggcaccacagaua

SEQ ID NO: 1540708 - RNA, 21 nt, Homo sapiens
cuucaguggugagacuguauc

SEQ ID NO: 1540709 - RNA, 17 nt, Homo sapiens
cuuccaaagagucauca

SEQ ID NO: 1540710 - RNA, 15 nt, Homo sapiens
cuucccugacacugu

SEQ ID NO: 1540711 - RNA, 23 nt, Homo sapiens
cuuccuuaccgugggcacugaag

SEQ ID NO: 1540712 - RNA, 18 nt, Homo sapiens
cuuccuuuuguauccucc

SEQ ID NO: 1540713 - RNA, 23 nt, Homo sapiens
cuucgauacaccgggccuggaga

SEQ ID NO: 1540714 - RNA, 13 nt, Homo sapiens
cuucgaugacugg

SEQ ID NO: 1540715 - RNA, 22 nt, Homo sapiens
cuucgugugcagcuagagcuuu

SEQ ID NO: 1540716 - RNA, 16 nt, Homo sapiens
cuucuaauccaugugc

SEQ ID NO: 1540717 - RNA, 16 nt, Homo sapiens
cuucuacaauuguggu

SEQ ID NO: 1540718 - RNA, 17 nt, Homo sapiens
cuucuccacaaccuccu

SEQ ID NO: 1540719 - RNA, 23 nt, Homo sapiens
cuucuccacaaccuccuccucca

SEQ ID NO: 1540720 - RNA, 14 nt, Homo sapiens
cuucuccacaggga

SEQ ID NO: 1540721 - RNA, 17 nt, Homo sapiens
cuucuccccuccagacc

SEQ ID NO: 1540722 - RNA, 13 nt, Homo sapiens
cuucucuagacau

SEQ ID NO: 1540723 - RNA, 14 nt, Homo sapiens
cuucugaagaucuc

SEQ ID NO: 1540724 - RNA, 19 nt, Homo sapiens
cuucugaagaucucagaua

SEQ ID NO: 1540725 - RNA, 21 nt, Homo sapiens
cuucugagcaccuacuuacau

SEQ ID NO: 1540726 - RNA, 22 nt, Homo sapiens
cuucugauuucucuucagcuuu

SEQ ID NO: 1540727 - RNA, 13 nt, Homo sapiens
cuucuuacuguau

SEQ ID NO: 1540728 - RNA, 15 nt, Homo sapiens
cuucuuccauuccca

SEQ ID NO: 1540729 - RNA, 17 nt, Homo sapiens
cuucuuuaggcauuaaa

SEQ ID NO: 1540730 - RNA, 16 nt, Homo sapiens
cuugaaauuauaucug

SEQ ID NO: 1540731 - RNA, 15 nt, Homo sapiens
cuugacuuugccaca

SEQ ID NO: 1540732 - RNA, 19 nt, Homo sapiens
cuugagauguauuaugcaa

SEQ ID NO: 1540733 - RNA, 12 nt, Homo sapiens
cuugaugaauaa

SEQ ID NO: 1540734 - RNA, 16 nt, Homo sapiens
cuugauucuaaagggg

SEQ ID NO: 1540735 - RNA, 19 nt, Homo sapiens
cuugcaacacacagacaca

SEQ ID NO: 1540736 - RNA, 15 nt, Homo sapiens
cuuggaccaaaugga

SEQ ID NO: 1540737 - RNA, 21 nt, Homo sapiens
cuuggauaggagcuuccagau

SEQ ID NO: 1540738 - RNA, 20 nt, Homo sapiens
cuuggccagaagggggccau

SEQ ID NO: 1540739 - RNA, 21 nt, Homo sapiens
cuuggccagaagggggccaug

SEQ ID NO: 1540740 - RNA, 18 nt, Homo sapiens
cuuggcuagucacauauc

SEQ ID NO: 1540741 - RNA, 22 nt, Homo sapiens
cuugguggccgggggugggggc

SEQ ID NO: 1540742 - RNA, 14 nt, Homo sapiens
cuugucacuugcca

SEQ ID NO: 1540743 - RNA, 22 nt, Homo sapiens
cuuguguuguuuucucugauca

SEQ ID NO: 1540744 - RNA, 22 nt, Homo sapiens
cuuguugacacggccaugacca

SEQ ID NO: 1540745 - RNA, 23 nt, Homo sapiens
cuuguuuguguuugaauugauuu

SEQ ID NO: 1540746 - RNA, 14 nt, Homo sapiens
cuuuacagugccac

SEQ ID NO: 1540747 - RNA, 15 nt, Homo sapiens
cuuuacuaacacugg

SEQ ID NO: 1540748 - RNA, 19 nt, Homo sapiens
cuuuaugaaguuaacaguc

SEQ ID NO: 1540749 - RNA, 13 nt, Homo sapiens
cuuucauccucag

SEQ ID NO: 1540750 - RNA, 14 nt, Homo sapiens
aaaaaaaugauacu

SEQ ID NO: 1540751 - RNA, 12 nt, Homo sapiens
aaaaaauaugcu

SEQ ID NO: 1540752 - RNA, 22 nt, Homo sapiens
aaaaagggacaagcauguugau

SEQ ID NO: 1540753 - RNA, 13 nt, Homo sapiens
aaaaauaacugug

SEQ ID NO: 1540754 - RNA, 11 nt, Homo sapiens
aaaacauaucu

SEQ ID NO: 1540755 - RNA, 11 nt, Homo sapiens
aaaacauaugc

SEQ ID NO: 1540756 - RNA, 12 nt, Homo sapiens
aaaacauaugca

SEQ ID NO: 1540757 - RNA, 22 nt, Homo sapiens
aaaacauaugcauuaugaaguu

SEQ ID NO: 1540758 - RNA, 17 nt, Homo sapiens
aaaacauugcugccuaa

SEQ ID NO: 1540759 - RNA, 11 nt, Homo sapiens
aaaaccaauga

SEQ ID NO: 1540760 - RNA, 19 nt, Homo sapiens
aaaaccucauuuaccauaa

SEQ ID NO: 1540761 - RNA, 14 nt, Homo sapiens
aaaaccuuacuuaa

SEQ ID NO: 1540762 - RNA, 18 nt, Homo sapiens
aaaagcccuuuccaaagg

SEQ ID NO: 1540763 - RNA, 20 nt, Homo sapiens
aaaagugcuuugcuggaguc

SEQ ID NO: 1540764 - RNA, 12 nt, Homo sapiens
aaaagugggcca

SEQ ID NO: 1540765 - RNA, 13 nt, Homo sapiens
aaaagugggccag

SEQ ID NO: 1540766 - RNA, 12 nt, Homo sapiens
aaaaguguccau

SEQ ID NO: 1540767 - RNA, 12 nt, Homo sapiens
aaaauacaugau

SEQ ID NO: 1540768 - RNA, 20 nt, Homo sapiens
aaaauauggacuuccaaucu

SEQ ID NO: 1540769 - RNA, 13 nt, Homo sapiens
aaaaucaucaaag

SEQ ID NO: 1540770 - RNA, 22 nt, Homo sapiens
aaaaugauauucaaucuuaaca

SEQ ID NO: 1540771 - RNA, 18 nt, Homo sapiens
aaaaugcauauacuuuaa

SEQ ID NO: 1540772 - RNA, 18 nt, Homo sapiens
cuccuguggcggugcagu

SEQ ID NO: 1540773 - RNA, 17 nt, Homo sapiens
cuccuugaaaccagcuc

SEQ ID NO: 1540774 - RNA, 14 nt, Homo sapiens
cuccuuuccugcaa

SEQ ID NO: 1540775 - RNA, 16 nt, Homo sapiens
cucggggagugccacu

SEQ ID NO: 1540776 - RNA, 15 nt, Homo sapiens
cucuaauguacaaua

SEQ ID NO: 1540777 - RNA, 16 nt, Homo sapiens
cucuaauguacaauaa

SEQ ID NO: 1540778 - RNA, 22 nt, Homo sapiens
cucuaauguacaauaaagcaau

SEQ ID NO: 1540779 - RNA, 17 nt, Homo sapiens
cucuagacaucuagucu

SEQ ID NO: 1540780 - RNA, 13 nt, Homo sapiens
cucucacacuggc

SEQ ID NO: 1540781 - RNA, 14 nt, Homo sapiens
cucucagccuccac

SEQ ID NO: 1540782 - RNA, 15 nt, Homo sapiens
cucucugaacugcaa

SEQ ID NO: 1540783 - RNA, 13 nt, Homo sapiens
cucugaaaucagc

SEQ ID NO: 1540784 - RNA, 20 nt, Homo sapiens
cucugagugaaguccaguga

SEQ ID NO: 1540785 - RNA, 22 nt, Homo sapiens
cucugccagccgcuggugccca

SEQ ID NO: 1540786 - RNA, 14 nt, Homo sapiens
cucuggcacuuuga

SEQ ID NO: 1540787 - RNA, 15 nt, Homo sapiens
cucuguucauuuccu

SEQ ID NO: 1540788 - RNA, 14 nt, Homo sapiens
cucuguuuacccuc

SEQ ID NO: 1540789 - RNA, 15 nt, Homo sapiens
cucuuacaaaacucu

SEQ ID NO: 1540790 - RNA, 20 nt, Homo sapiens
cucuugggcugagacuggau

SEQ ID NO: 1540791 - RNA, 19 nt, Homo sapiens
cucuuucaucuagcuccau

SEQ ID NO: 1540792 - RNA, 15 nt, Homo sapiens
cugaaaagugcuuug

SEQ ID NO: 1540793 - RNA, 21 nt, Homo sapiens
cugaaagacaguaaagaccau

SEQ ID NO: 1540794 - RNA, 15 nt, Homo sapiens
cugaaauguuuccag

SEQ ID NO: 1540795 - RNA, 12 nt, Homo sapiens
cugaaccagaga

SEQ ID NO: 1540796 - RNA, 18 nt, Homo sapiens
cugaacugcaacacugga

SEQ ID NO: 1540797 - RNA, 16 nt, Homo sapiens
cugaagugaccccagc

SEQ ID NO: 1540798 - RNA, 21 nt, Homo sapiens
cugaagugaccccagcuccag

SEQ ID NO: 1540799 - RNA, 15 nt, Homo sapiens
cugacaaaagggaca

SEQ ID NO: 1540800 - RNA, 11 nt, Homo sapiens
cugacacuguc

SEQ ID NO: 1540801 - RNA, 12 nt, Homo sapiens
cugacacugucu

SEQ ID NO: 1540802 - RNA, 21 nt, Homo sapiens
cugaccccacuuaugcugcug

SEQ ID NO: 1540803 - RNA, 16 nt, Homo sapiens
cugacuguacuccucc

SEQ ID NO: 1540804 - RNA, 16 nt, Homo sapiens
cugagaucacucgcuu

SEQ ID NO: 1540805 - RNA, 17 nt, Homo sapiens
cugagcaccuacuuaca

SEQ ID NO: 1540806 - RNA, 21 nt, Homo sapiens
cugagcaccuacuuacaugca

SEQ ID NO: 1540807 - RNA, 22 nt, Homo sapiens
cugaguauucauuuugcaacuu

SEQ ID NO: 1540808 - RNA, 21 nt, Homo sapiens
cugagucugugaauaaagcca

SEQ ID NO: 1540809 - RNA, 19 nt, Homo sapiens
cugagugagaagauaaaaa

SEQ ID NO: 1540810 - RNA, 15 nt, Homo sapiens
cugaucaaagcaccu

SEQ ID NO: 1540811 - RNA, 19 nt, Homo sapiens
cugauuugcaaaugcacau

SEQ ID NO: 1540812 - RNA, 15 nt, Homo sapiens
cugcacacaccugca

SEQ ID NO: 1540813 - RNA, 17 nt, Homo sapiens
cugcacagugcaucuca

SEQ ID NO: 1540814 - RNA, 18 nt, Homo sapiens
cugcacagugcaucucag

SEQ ID NO: 1540815 - RNA, 12 nt, Homo sapiens
cugcaccugcag

SEQ ID NO: 1540816 - RNA, 14 nt, Homo sapiens
cugcacuaauauaa

SEQ ID NO: 1540817 - RNA, 18 nt, Homo sapiens
cugcagcucccagaagcu

SEQ ID NO: 1540818 - RNA, 14 nt, Homo sapiens
cugcaggaaucaaa

SEQ ID NO: 1540819 - RNA, 12 nt, Homo sapiens
cugcaucuccac

SEQ ID NO: 1540820 - RNA, 15 nt, Homo sapiens
cugccagacaugcca

SEQ ID NO: 1540821 - RNA, 11 nt, Homo sapiens
cugccagagaa

SEQ ID NO: 1540822 - RNA, 19 nt, Homo sapiens
cugccagaggccuggugcc

SEQ ID NO: 1540823 - RNA, 19 nt, Homo sapiens
cugccagccgcuggugccc

SEQ ID NO: 1540824 - RNA, 18 nt, Homo sapiens
cugcccauuguaacuuau

SEQ ID NO: 1540825 - RNA, 21 nt, Homo sapiens
cugcccgugaggagggggaga

SEQ ID NO: 1540826 - RNA, 16 nt, Homo sapiens
cugcccuucagcaucc

SEQ ID NO: 1540827 - RNA, 20 nt, Homo sapiens
cugccuguggugagguccug

SEQ ID NO: 1540828 - RNA, 13 nt, Homo sapiens
cugccuugccaug

SEQ ID NO: 1540829 - RNA, 14 nt, Homo sapiens
cugcgaugcaaugc

SEQ ID NO: 1540830 - RNA, 13 nt, Homo sapiens
cugcgauggugcu

SEQ ID NO: 1540831 - RNA, 19 nt, Homo sapiens
cugcuaugucugugauguc

SEQ ID NO: 1540832 - RNA, 14 nt, Homo sapiens
cugcucccuagcca

SEQ ID NO: 1540833 - RNA, 20 nt, Homo sapiens
cugcucuagaggcccaagcu

SEQ ID NO: 1540834 - RNA, 17 nt, Homo sapiens
cugcuguggcaucagga

SEQ ID NO: 1540835 - RNA, 13 nt, Homo sapiens
cugcuucucagcg

SEQ ID NO: 1540836 - RNA, 18 nt, Homo sapiens
cugcuuugagaaaucuca

SEQ ID NO: 1540837 - RNA, 21 nt, Homo sapiens
cuggaaauaacugagcacuuu

SEQ ID NO: 1540838 - RNA, 14 nt, Homo sapiens
cuggaaaugagccc

SEQ ID NO: 1540839 - RNA, 19 nt, Homo sapiens
cuggacucuguggggccac

SEQ ID NO: 1540840 - RNA, 17 nt, Homo sapiens
cuggagugugugggggu

SEQ ID NO: 1540841 - RNA, 22 nt, Homo sapiens
cuggccauuuaacuagcacuuu

SEQ ID NO: 1540842 - RNA, 22 nt, Homo sapiens
cuggccuauuuuggacguguga

SEQ ID NO: 1540843 - RNA, 22 nt, Homo sapiens
cuggcuuuacauggguucaauu

SEQ ID NO: 1540844 - RNA, 23 nt, Homo sapiens
cuggcuuuacauggguucaauug

SEQ ID NO: 1540845 - RNA, 14 nt, Homo sapiens
cugggcacuccucc

SEQ ID NO: 1540846 - RNA, 14 nt, Homo sapiens
cugggcccuaggca

SEQ ID NO: 1540847 - RNA, 15 nt, Homo sapiens
cugggcccuaggcau

SEQ ID NO: 1540848 - RNA, 16 nt, Homo sapiens
cugggcccuaggcaua

SEQ ID NO: 1540849 - RNA, 13 nt, Homo sapiens
cugggcucugggu

SEQ ID NO: 1540850 - RNA, 21 nt, Homo sapiens
cuggucacccccacccccggg

SEQ ID NO: 1540851 - RNA, 17 nt, Homo sapiens
cugguccugcacugucc

SEQ ID NO: 1540852 - RNA, 21 nt, Homo sapiens
cuggugucuaauaaacacaga

SEQ ID NO: 1540853 - RNA, 20 nt, Homo sapiens
cugguucuguacauguggaa

SEQ ID NO: 1540854 - RNA, 14 nt, Homo sapiens
cuguaaaagauuca

SEQ ID NO: 1540855 - RNA, 15 nt, Homo sapiens
cuguaaaauacaugg

SEQ ID NO: 1540856 - RNA, 16 nt, Homo sapiens
cuguaaauaugucacu

SEQ ID NO: 1540857 - RNA, 13 nt, Homo sapiens
cuguacacugcac

SEQ ID NO: 1540858 - RNA, 21 nt, Homo sapiens
cuguauaauacuuuguauaca

SEQ ID NO: 1540859 - RNA, 16 nt, Homo sapiens
cugucaccaagccuug

SEQ ID NO: 1540860 - RNA, 21 nt, Homo sapiens
cugucacuaaauggcagugag

SEQ ID NO: 1540861 - RNA, 15 nt, Homo sapiens
cugucagucguguug

SEQ ID NO: 1540862 - RNA, 20 nt, Homo sapiens
cuguccccgagccgagcucu

SEQ ID NO: 1540863 - RNA, 21 nt, Homo sapiens
cuguccuggaucugcucuaga

SEQ ID NO: 1540864 - RNA, 17 nt, Homo sapiens
cugucuugcugagggag

SEQ ID NO: 1540865 - RNA, 15 nt, Homo sapiens
cugugaaauaucauc

SEQ ID NO: 1540866 - RNA, 14 nt, Homo sapiens
cugugaucuauacc

SEQ ID NO: 1540867 - RNA, 18 nt, Homo sapiens
cugugcgagaacacaagc

SEQ ID NO: 1540868 - RNA, 14 nt, Homo sapiens
cuguggccauuugu

SEQ ID NO: 1540869 - RNA, 16 nt, Homo sapiens
cuguggcggugcagug

SEQ ID NO: 1540870 - RNA, 21 nt, Homo sapiens
cuguggucuucaaauugucuu

SEQ ID NO: 1540871 - RNA, 24 nt, Homo sapiens
cuguguuacccaguaacucaucug

SEQ ID NO: 1540872 - RNA, 21 nt, Homo sapiens
cuguguugugauuccccggag

SEQ ID NO: 1540873 - RNA, 12 nt, Homo sapiens
cuguuaguauua

SEQ ID NO: 1540874 - RNA, 18 nt, Homo sapiens
cuguuauuuaauuagcca

SEQ ID NO: 1540875 - RNA, 11 nt, Homo sapiens
cuguuccugcc

SEQ ID NO: 1540876 - RNA, 19 nt, Homo sapiens
cuguuugauacaguauuau

SEQ ID NO: 1540877 - RNA, 24 nt, Homo sapiens
cuguuuuugaagaagggaaauuca

SEQ ID NO: 1540878 - RNA, 15 nt, Homo sapiens
cuguuuuuuccugag

SEQ ID NO: 1540879 - RNA, 23 nt, Homo sapiens
cuuaaggggacccacaaguauug

SEQ ID NO: 1540880 - RNA, 19 nt, Homo sapiens
cuuaauauuucuucaaaua

SEQ ID NO: 1540881 - RNA, 20 nt, Homo sapiens
cuuaauuaccuaagagccac

SEQ ID NO: 1540882 - RNA, 22 nt, Homo sapiens
cuuacaauaauucuaugagaua

SEQ ID NO: 1540883 - RNA, 15 nt, Homo sapiens
cuuacaugcauuacu

SEQ ID NO: 1540884 - RNA, 17 nt, Homo sapiens
cuuaccgugggcacuga

SEQ ID NO: 1540885 - RNA, 17 nt, Homo sapiens
cuuagcugaacaaugaa

SEQ ID NO: 1540886 - RNA, 16 nt, Homo sapiens
cuuaguaauagaucac

SEQ ID NO: 1540887 - RNA, 18 nt, Homo sapiens
cuuauaacaaaaaagccc

SEQ ID NO: 1540888 - RNA, 18 nt, Homo sapiens
cuuauaauauacauaacu

SEQ ID NO: 1540889 - RNA, 18 nt, Homo sapiens
cuuauauuguucacuucu

SEQ ID NO: 1540890 - RNA, 19 nt, Homo sapiens
cuuauauuguucacuucuu

SEQ ID NO: 1540891 - RNA, 23 nt, Homo sapiens
cuucaaauugucuuuugucaugu

SEQ ID NO: 1540892 - RNA, 20 nt, Homo sapiens
cuucaacaugguuaccucug

SEQ ID NO: 1540893 - RNA, 18 nt, Homo sapiens
cuucaagaucccauuuga

SEQ ID NO: 1540894 - RNA, 19 nt, Homo sapiens
cuucaagaucccauuugaa

SEQ ID NO: 1540895 - RNA, 19 nt, Homo sapiens
cuucaaggaagugauaaca

SEQ ID NO: 1540896 - RNA, 17 nt, Homo sapiens
cuucaaugcaaaauaca

SEQ ID NO: 1540897 - RNA, 17 nt, Homo sapiens
cuucagaauuguuuuua

SEQ ID NO: 1540898 - RNA, 18 nt, Homo sapiens
cuucauggaacucagcug

SEQ ID NO: 1540899 - RNA, 23 nt, Homo sapiens
cuuccaaauauuagccaaagagg

SEQ ID NO: 1540900 - RNA, 11 nt, Homo sapiens
cuuccauguca

SEQ ID NO: 1540901 - RNA, 19 nt, Homo sapiens
cuuccaugucaagauucag

SEQ ID NO: 1540902 - RNA, 21 nt, Homo sapiens
guaguagaaucucagcacuuu

SEQ ID NO: 1540903 - RNA, 21 nt, Homo sapiens
guauaaccuucaugaugaauu

SEQ ID NO: 1540904 - RNA, 15 nt, Homo sapiens
guauaauacuuugua

SEQ ID NO: 1540905 - RNA, 17 nt, Homo sapiens
guauaguuuugucacaa

SEQ ID NO: 1540906 - RNA, 22 nt, Homo sapiens
guauccuuguugacacggccau

SEQ ID NO: 1540907 - RNA, 15 nt, Homo sapiens
guaucucuacuuucc

SEQ ID NO: 1540908 - RNA, 18 nt, Homo sapiens
guauugucugacuucuca

SEQ ID NO: 1540909 - RNA, 18 nt, Homo sapiens
guauuuccaacuugucac

SEQ ID NO: 1540910 - RNA, 22 nt, Homo sapiens
guauuugcuaauguugauugaa

SEQ ID NO: 1540911 - RNA, 18 nt, Homo sapiens
guauuuuuccucuuucac

SEQ ID NO: 1540912 - RNA, 14 nt, Homo sapiens
guauuuuucuuugu

SEQ ID NO: 1540913 - RNA, 21 nt, Homo sapiens
gucaagagggggcaagucaca

SEQ ID NO: 1540914 - RNA, 15 nt, Homo sapiens
gucaccaucucaggc

SEQ ID NO: 1540915 - RNA, 17 nt, Homo sapiens
gucaccucagagacaua

SEQ ID NO: 1540916 - RNA, 19 nt, Homo sapiens
gucacuccguuuugcaaaa

SEQ ID NO: 1540917 - RNA, 23 nt, Homo sapiens
gucagcagggggguuggguucca

SEQ ID NO: 1540918 - RNA, 14 nt, Homo sapiens
gucaggagccagca

SEQ ID NO: 1540919 - RNA, 20 nt, Homo sapiens
guccaacaacuccaggaaaa

SEQ ID NO: 1540920 - RNA, 22 nt, Homo sapiens
guccaacauuccuuguuuguaa

SEQ ID NO: 1540921 - RNA, 12 nt, Homo sapiens
guccauuccaaa

SEQ ID NO: 1540922 - RNA, 17 nt, Homo sapiens
gucccaguuaacuguua

SEQ ID NO: 1540923 - RNA, 21 nt, Homo sapiens
gucccugagaagccucauggg

SEQ ID NO: 1540924 - RNA, 13 nt, Homo sapiens
gucccuuaccugg

SEQ ID NO: 1540925 - RNA, 12 nt, Homo sapiens
guccugcacugu

SEQ ID NO: 1540926 - RNA, 14 nt, Homo sapiens
guccuggggugguu

SEQ ID NO: 1540927 - RNA, 15 nt, Homo sapiens
guccuguuccugcca

SEQ ID NO: 1540928 - RNA, 12 nt, Homo sapiens
guccuguucuca

SEQ ID NO: 1540929 - RNA, 14 nt, Homo sapiens
gucuaaagcuaaac

SEQ ID NO: 1540930 - RNA, 19 nt, Homo sapiens
gucucaagagggcacuggu

SEQ ID NO: 1540931 - RNA, 17 nt, Homo sapiens
gucucugauuugcaaau

SEQ ID NO: 1540932 - RNA, 20 nt, Homo sapiens
gucugcucggccgucuucac

SEQ ID NO: 1540933 - RNA, 14 nt, Homo sapiens
gucugucugcacug

SEQ ID NO: 1540934 - RNA, 19 nt, Homo sapiens
gugacacaacucauccaga

SEQ ID NO: 1540935 - RNA, 16 nt, Homo sapiens
gugacagcugagcacc

SEQ ID NO: 1540936 - RNA, 16 nt, Homo sapiens
gugacaucaguggcau

SEQ ID NO: 1540937 - RNA, 14 nt, Homo sapiens
gugaccgggguccu

SEQ ID NO: 1540938 - RNA, 12 nt, Homo sapiens
gugagacucuga

SEQ ID NO: 1540939 - RNA, 23 nt, Homo sapiens
gugagcuauaauguuucccucaa

SEQ ID NO: 1540940 - RNA, 22 nt, Homo sapiens
gugaguggggaggagacucagg

SEQ ID NO: 1540941 - RNA, 20 nt, Homo sapiens
gugauguggugggagcacag

SEQ ID NO: 1540942 - RNA, 13 nt, Homo sapiens
gugcacggggcca

SEQ ID NO: 1540943 - RNA, 21 nt, Homo sapiens
gugcaguugcuguuuacuuga

SEQ ID NO: 1540944 - RNA, 16 nt, Homo sapiens
gugcauuuaugagcuc

SEQ ID NO: 1540945 - RNA, 17 nt, Homo sapiens
gugcauuuaugagcucu

SEQ ID NO: 1540946 - RNA, 18 nt, Homo sapiens
gugccagcugcuucugcc

SEQ ID NO: 1540947 - RNA, 16 nt, Homo sapiens
gugcccaugggguaga

SEQ ID NO: 1540948 - RNA, 16 nt, Homo sapiens
gugccucuugggagac

SEQ ID NO: 1540949 - RNA, 19 nt, Homo sapiens
gugccuucauuugggaugc

SEQ ID NO: 1540950 - RNA, 21 nt, Homo sapiens
gugcugcuguggcaucaggaa

SEQ ID NO: 1540951 - RNA, 15 nt, Homo sapiens
gugcuuguucuuccu

SEQ ID NO: 1540952 - RNA, 23 nt, Homo sapiens
gugcuuguucuuccucuuaccug

SEQ ID NO: 1540953 - RNA, 12 nt, Homo sapiens
guggagggguca

SEQ ID NO: 1540954 - RNA, 23 nt, Homo sapiens
guggcagcugucucaaaccucca

SEQ ID NO: 1540955 - RNA, 18 nt, Homo sapiens
guggcuucccgcucagcc

SEQ ID NO: 1540956 - RNA, 16 nt, Homo sapiens
gugggagggacuuugc

SEQ ID NO: 1540957 - RNA, 14 nt, Homo sapiens
guguccccugccug

SEQ ID NO: 1540958 - RNA, 17 nt, Homo sapiens
gugucuaguuugcauac

SEQ ID NO: 1540959 - RNA, 19 nt, Homo sapiens
guguuacccaguaacucau

SEQ ID NO: 1540960 - RNA, 14 nt, Homo sapiens
guguuuugcaaggg

SEQ ID NO: 1540961 - RNA, 17 nt, Homo sapiens
guuaauggucaaugcua

SEQ ID NO: 1540962 - RNA, 14 nt, Homo sapiens
guuacuacaugcac

SEQ ID NO: 1540963 - RNA, 23 nt, Homo sapiens
guuagcacagaggauggcuuccc

SEQ ID NO: 1540964 - RNA, 19 nt, Homo sapiens
guuauagaaacugauauau

SEQ ID NO: 1540965 - RNA, 19 nt, Homo sapiens
guucaacuuuuccuuugaa

SEQ ID NO: 1540966 - RNA, 14 nt, Homo sapiens
guuccaugucugaa

SEQ ID NO: 1540967 - RNA, 16 nt, Homo sapiens
guugaguuugcuguau

SEQ ID NO: 1540968 - RNA, 15 nt, Homo sapiens
guugauguugauaaa

SEQ ID NO: 1540969 - RNA, 17 nt, Homo sapiens
guugcacagcaucucag

SEQ ID NO: 1540970 - RNA, 20 nt, Homo sapiens
guugcauuaaaaaugcauau

SEQ ID NO: 1540971 - RNA, 15 nt, Homo sapiens
guugcugaaacacac

SEQ ID NO: 1540972 - RNA, 17 nt, Homo sapiens
guugucaaaacuccacu

SEQ ID NO: 1540973 - RNA, 21 nt, Homo sapiens
guugucuaaagcuaaacaaaa

SEQ ID NO: 1540974 - RNA, 21 nt, Homo sapiens
guugucugaagucacugcaca

SEQ ID NO: 1540975 - RNA, 14 nt, Homo sapiens
guuuaaacagucaa

SEQ ID NO: 1540976 - RNA, 21 nt, Homo sapiens
guuuaccucacuggugcauuu

SEQ ID NO: 1540977 - RNA, 15 nt, Homo sapiens
guuucauauucucag

SEQ ID NO: 1540978 - RNA, 22 nt, Homo sapiens
guuuccagcuaagccugaugau

SEQ ID NO: 1540979 - RNA, 14 nt, Homo sapiens
guuuccagugacac

SEQ ID NO: 1540980 - RNA, 15 nt, Homo sapiens
guuuccagugacaca

SEQ ID NO: 1540981 - RNA, 20 nt, Homo sapiens
guuucuaaguaauaugcuua

SEQ ID NO: 1540982 - RNA, 17 nt, Homo sapiens
guuugcaaaaaaaaaga

SEQ ID NO: 1540983 - RNA, 14 nt, Homo sapiens
guuuggcgggccaa

SEQ ID NO: 1540984 - RNA, 17 nt, Homo sapiens
guuugggugucugcuaa

SEQ ID NO: 1540985 - RNA, 18 nt, Homo sapiens
guuuuagaguaugcaaga

SEQ ID NO: 1540986 - RNA, 23 nt, Homo sapiens
guuuucucugaucacaacuuuuc

SEQ ID NO: 1540987 - RNA, 17 nt, Homo sapiens
guuuugcaugucugcau

SEQ ID NO: 1540988 - RNA, 12 nt, Homo sapiens
uaaaaaguugca

SEQ ID NO: 1540989 - RNA, 12 nt, Homo sapiens
uaaaacaugugu

SEQ ID NO: 1540990 - RNA, 18 nt, Homo sapiens
uaaaaccuuccaugucaa

SEQ ID NO: 1540991 - RNA, 23 nt, Homo sapiens
uaaaacuucugauuucucuucag

SEQ ID NO: 1540992 - RNA, 19 nt, Homo sapiens
uaaaacuuuucugcugaua

SEQ ID NO: 1540993 - RNA, 16 nt, Homo sapiens
uaaaagacuguuuuca

SEQ ID NO: 1540994 - RNA, 14 nt, Homo sapiens
uaaaauaaaccaga

SEQ ID NO: 1540995 - RNA, 12 nt, Homo sapiens
uaaaauacucac

SEQ ID NO: 1540996 - RNA, 17 nt, Homo sapiens
uaaaauauggacuucca

SEQ ID NO: 1540997 - RNA, 23 nt, Homo sapiens
uaaaauguauuauguccugugag

SEQ ID NO: 1540998 - RNA, 17 nt, Homo sapiens
uaaaauuauacugugug

SEQ ID NO: 1540999 - RNA, 13 nt, Homo sapiens
uaaacacagauua

SEQ ID NO: 1541000 - RNA, 13 nt, Homo sapiens
uaaaccauaaaau

SEQ ID NO: 1541001 - RNA, 14 nt, Homo sapiens
uaaacucacuagaa

SEQ ID NO: 1541002 - RNA, 23 nt, Homo sapiens
uaaagcuuguuuguucuaguuag

SEQ ID NO: 1541003 - RNA, 17 nt, Homo sapiens
uaaaguuagggcauuuu

SEQ ID NO: 1541004 - RNA, 22 nt, Homo sapiens
uaaauaaagaagaaaauaaccu

SEQ ID NO: 1541005 - RNA, 20 nt, Homo sapiens
uaaauaucauccugccuuca

SEQ ID NO: 1541006 - RNA, 22 nt, Homo sapiens
uaaauauuaaccugaauuauuc

SEQ ID NO: 1541007 - RNA, 13 nt, Homo sapiens
uaaauauuacaaa

SEQ ID NO: 1541008 - RNA, 15 nt, Homo sapiens
uaaauccaacucuga

SEQ ID NO: 1541009 - RNA, 21 nt, Homo sapiens
uaaaucugucugauucuaugc

SEQ ID NO: 1541010 - RNA, 22 nt, Homo sapiens
uaaaugugguacaagcauucug

SEQ ID NO: 1541011 - RNA, 16 nt, Homo sapiens
uaaauucaaaccuaag

SEQ ID NO: 1541012 - RNA, 20 nt, Homo sapiens
uaaauuugggggacuuacau

SEQ ID NO: 1541013 - RNA, 22 nt, Homo sapiens
uaaauuugggggacuuacauga

SEQ ID NO: 1541014 - RNA, 15 nt, Homo sapiens
uaacaagccaaacau

SEQ ID NO: 1541015 - RNA, 18 nt, Homo sapiens
uaacaagccuuggaccaa

SEQ ID NO: 1541016 - RNA, 16 nt, Homo sapiens
uaacaaugccuauugu

SEQ ID NO: 1541017 - RNA, 17 nt, Homo sapiens
uaacacuggagugguaa

SEQ ID NO: 1541018 - RNA, 21 nt, Homo sapiens
uaacccuuuucaugauuucaa

SEQ ID NO: 1541019 - RNA, 14 nt, Homo sapiens
uaacggcacugugg

SEQ ID NO: 1541020 - RNA, 21 nt, Homo sapiens
uaacugcacacaugguuucca

SEQ ID NO: 1541021 - RNA, 22 nt, Homo sapiens
uaacugcacacaugguuuccaa

SEQ ID NO: 1541022 - RNA, 22 nt, Homo sapiens
uaagcccacaaucaugccuccc

SEQ ID NO: 1541023 - RNA, 15 nt, Homo sapiens
uaaggaacaaaucuc

SEQ ID NO: 1541024 - RNA, 23 nt, Homo sapiens
uaaggaucuucccacuuugccac

SEQ ID NO: 1541025 - RNA, 20 nt, Homo sapiens
uaaggcaucauuuucaccuc

SEQ ID NO: 1541026 - RNA, 19 nt, Homo sapiens
uaaggucugacaucagagg

SEQ ID NO: 1541027 - RNA, 15 nt, Homo sapiens
uaaguaauaugcuua

SEQ ID NO: 1541028 - RNA, 22 nt, Homo sapiens
uaaguacugaaauacauaugau

SEQ ID NO: 1541029 - RNA, 16 nt, Homo sapiens
uaagucaccuguauaa

SEQ ID NO: 1541030 - RNA, 16 nt, Homo sapiens
uaaguccagcucuccc

SEQ ID NO: 1541031 - RNA, 16 nt, Homo sapiens
uaaguggcugugauua

SEQ ID NO: 1541032 - RNA, 12 nt, Homo sapiens
uuucuguucccu

SEQ ID NO: 1541033 - RNA, 19 nt, Homo sapiens
uuucuuaacuauccuaaca

SEQ ID NO: 1541034 - RNA, 14 nt, Homo sapiens
uuucuuacauuagc

SEQ ID NO: 1541035 - RNA, 22 nt, Homo sapiens
uuugacugaauguuuuauggaa

SEQ ID NO: 1541036 - RNA, 11 nt, Homo sapiens
uuugagccaug

SEQ ID NO: 1541037 - RNA, 19 nt, Homo sapiens
uuugagugucuuugacuug

SEQ ID NO: 1541038 - RNA, 22 nt, Homo sapiens
uuugcuuguguacaaacccaga

SEQ ID NO: 1541039 - RNA, 19 nt, Homo sapiens
uuuggaagaggacuccuua

SEQ ID NO: 1541040 - RNA, 20 nt, Homo sapiens
uuugggggugcuaauccagg

SEQ ID NO: 1541041 - RNA, 20 nt, Homo sapiens
uuuguaacaccguccaacau

SEQ ID NO: 1541042 - RNA, 17 nt, Homo sapiens
uuuguauuuuuccucuu

SEQ ID NO: 1541043 - RNA, 18 nt, Homo sapiens
uuuguuaaguucaccgua

SEQ ID NO: 1541044 - RNA, 15 nt, Homo sapiens
uuuguuagaaccagu

SEQ ID NO: 1541045 - RNA, 17 nt, Homo sapiens
uuuguugagacuaucaa

SEQ ID NO: 1541046 - RNA, 18 nt, Homo sapiens
uuuuaacuucaccuuaaa

SEQ ID NO: 1541047 - RNA, 20 nt, Homo sapiens
uuuuaccuuucaugugccug

SEQ ID NO: 1541048 - RNA, 20 nt, Homo sapiens
uuuuacuccccuugagcuga

SEQ ID NO: 1541049 - RNA, 15 nt, Homo sapiens
uuuucaagacuuccu

SEQ ID NO: 1541050 - RNA, 13 nt, Homo sapiens
uuuuccacuuaga

SEQ ID NO: 1541051 - RNA, 15 nt, Homo sapiens
uuuucugaauucaua

SEQ ID NO: 1541052 - RNA, 15 nt, Homo sapiens
uuuugcucugcucug

SEQ ID NO: 1541053 - RNA, 21 nt, Homo sapiens
uuuuguaugaaauauauguga

SEQ ID NO: 1541054 - RNA, 21 nt, Homo sapiens
uuuugucugcuuaguaucuca

SEQ ID NO: 1541055 - RNA, 22 nt, Homo sapiens
uuuugucugcuuaguaucucau

SEQ ID NO: 1541056 - RNA, 15 nt, Homo sapiens
uuuuguuauugggca

SEQ ID NO: 1541057 - RNA, 14 nt, Homo sapiens
uuuuuaagcucaaa

SEQ ID NO: 1541058 - RNA, 13 nt, Homo sapiens
aacccugggacgu

SEQ ID NO: 1541059 - RNA, 14 nt, Homo sapiens
aacccugugaucua

SEQ ID NO: 1541060 - RNA, 23 nt, Homo sapiens
aacccuguuuuauugaguucuga

SEQ ID NO: 1541061 - RNA, 17 nt, Homo sapiens
aaccuccuccuccaguu

SEQ ID NO: 1541062 - RNA, 14 nt, Homo sapiens
aaccugaaagggca

SEQ ID NO: 1541063 - RNA, 17 nt, Homo sapiens
aaccugaaagggcauuu

SEQ ID NO: 1541064 - RNA, 16 nt, Homo sapiens
aaccugaauuauucca

SEQ ID NO: 1541065 - RNA, 17 nt, Homo sapiens
aaccuucuaauccaugu

SEQ ID NO: 1541066 - RNA, 21 nt, Homo sapiens
aacgggucugugggacuggcc

SEQ ID NO: 1541067 - RNA, 21 nt, Homo sapiens
aacuagcacuuuauaagccaa

SEQ ID NO: 1541068 - RNA, 16 nt, Homo sapiens
aacuauccuaacaagc

SEQ ID NO: 1541069 - RNA, 13 nt, Homo sapiens
aacucagccuuaa

SEQ ID NO: 1541070 - RNA, 15 nt, Homo sapiens
aacucaguccugaca

SEQ ID NO: 1541071 - RNA, 13 nt, Homo sapiens
aacuccaggguua

SEQ ID NO: 1541072 - RNA, 20 nt, Homo sapiens
aacuccaucugcugccauga

SEQ ID NO: 1541073 - RNA, 18 nt, Homo sapiens
aacuccccuuguacucuu

SEQ ID NO: 1541074 - RNA, 10 nt, Homo sapiens
aacugcauuu

SEQ ID NO: 1541075 - RNA, 18 nt, Homo sapiens
aacuguaaauaugucacu

SEQ ID NO: 1541076 - RNA, 12 nt, Homo sapiens
aacuuaauguuc

SEQ ID NO: 1541077 - RNA, 15 nt, Homo sapiens
aacuuaauuaccuaa

SEQ ID NO: 1541078 - RNA, 19 nt, Homo sapiens
aacuucugauuucucuuca

SEQ ID NO: 1541079 - RNA, 12 nt, Homo sapiens
aacuucuuguug

SEQ ID NO: 1541080 - RNA, 17 nt, Homo sapiens
aacuuuaccaugcucaa

SEQ ID NO: 1541081 - RNA, 19 nt, Homo sapiens
aagaaaagugggccagugu

SEQ ID NO: 1541082 - RNA, 19 nt, Homo sapiens
aagaaagcuauauaugaau

SEQ ID NO: 1541083 - RNA, 20 nt, Homo sapiens
aagaaauuagggcucuaauu

SEQ ID NO: 1541084 - RNA, 23 nt, Homo sapiens
aagaacaaacacuuagcauccca

SEQ ID NO: 1541085 - RNA, 16 nt, Homo sapiens
aagaacuugucccuca

SEQ ID NO: 1541086 - RNA, 14 nt, Homo sapiens
aagaaggcaaccca

SEQ ID NO: 1541087 - RNA, 14 nt, Homo sapiens
aagaaucaccuaau

SEQ ID NO: 1541088 - RNA, 17 nt, Homo sapiens
aagacaauuuuaauguu

SEQ ID NO: 1541089 - RNA, 23 nt, Homo sapiens
aagacaauuuuaauguuuacaac

SEQ ID NO: 1541090 - RNA, 19 nt, Homo sapiens
aagaccuucugaagaucuc

SEQ ID NO: 1541091 - RNA, 18 nt, Homo sapiens
aagacugaccuugauguc

SEQ ID NO: 1541092 - RNA, 20 nt, Homo sapiens
aagagaccacccauaucaug

SEQ ID NO: 1541093 - RNA, 21 nt, Homo sapiens
aagagaguggaagaacugcaa

SEQ ID NO: 1541094 - RNA, 14 nt, Homo sapiens
aagaggcauuccca

SEQ ID NO: 1541095 - RNA, 20 nt, Homo sapiens
aagaggcauucccagaauuu

SEQ ID NO: 1541096 - RNA, 18 nt, Homo sapiens
aagaguaaaaccaaaggu

SEQ ID NO: 1541097 - RNA, 19 nt, Homo sapiens
aagauccugucuugcugag

SEQ ID NO: 1541098 - RNA, 19 nt, Homo sapiens
aagauugauuaaugaacua

SEQ ID NO: 1541099 - RNA, 23 nt, Homo sapiens
aagcaaauauuuaugaccucaac

SEQ ID NO: 1541100 - RNA, 12 nt, Homo sapiens
aagcaagcucac

SEQ ID NO: 1541101 - RNA, 13 nt, Homo sapiens
aagcaaggccagc

SEQ ID NO: 1541102 - RNA, 19 nt, Homo sapiens
aagcaucaaagcacuguuu

SEQ ID NO: 1541103 - RNA, 17 nt, Homo sapiens
aagcauuauccuuuuau

SEQ ID NO: 1541104 - RNA, 18 nt, Homo sapiens
aagcauucuccccagugu

SEQ ID NO: 1541105 - RNA, 14 nt, Homo sapiens
aagccaaguguccu

SEQ ID NO: 1541106 - RNA, 20 nt, Homo sapiens
aagcccgauccacauugcau

SEQ ID NO: 1541107 - RNA, 15 nt, Homo sapiens
aagccuuccucaaga

SEQ ID NO: 1541108 - RNA, 14 nt, Homo sapiens
aagcuauauaugaa

SEQ ID NO: 1541109 - RNA, 17 nt, Homo sapiens
aagcucagggugcuccc

SEQ ID NO: 1541110 - RNA, 17 nt, Homo sapiens
aagcuggcaggagacac

SEQ ID NO: 1541111 - RNA, 22 nt, Homo sapiens
aaggacugccgaccgaggcugg

SEQ ID NO: 1541112 - RNA, 13 nt, Homo sapiens
aaggagccagcuc

SEQ ID NO: 1541113 - RNA, 14 nt, Homo sapiens
aaggagccagcucc

SEQ ID NO: 1541114 - RNA, 18 nt, Homo sapiens
aaggaugaacaguucucc

SEQ ID NO: 1541115 - RNA, 20 nt, Homo sapiens
aaggcaacauuuccgaagac

SEQ ID NO: 1541116 - RNA, 15 nt, Homo sapiens
aaggcagcuagacac

SEQ ID NO: 1541117 - RNA, 23 nt, Homo sapiens
aaggcaucauuuucaccuccauu

SEQ ID NO: 1541118 - RNA, 12 nt, Homo sapiens
aaggcauccacu

SEQ ID NO: 1541119 - RNA, 17 nt, Homo sapiens
aaggccccaagguuuac

SEQ ID NO: 1541120 - RNA, 12 nt, Homo sapiens
aaggcuguguca

SEQ ID NO: 1541121 - RNA, 22 nt, Homo sapiens
aagggcaacucacgggugcaug

SEQ ID NO: 1541122 - RNA, 16 nt, Homo sapiens
aagggcaggugcuuca

SEQ ID NO: 1541123 - RNA, 17 nt, Homo sapiens
aagggugcccaccucuu

SEQ ID NO: 1541124 - RNA, 22 nt, Homo sapiens
aaggucccgaauggaguccaga

SEQ ID NO: 1541125 - RNA, 21 nt, Homo sapiens
aaggucuaccugaaaauucaa

SEQ ID NO: 1541126 - RNA, 16 nt, Homo sapiens
aagguuucacuguuca

SEQ ID NO: 1541127 - RNA, 18 nt, Homo sapiens
aagguuucacuguucaug

SEQ ID NO: 1541128 - RNA, 20 nt, Homo sapiens
aagguuucacuguucaugaa

SEQ ID NO: 1541129 - RNA, 15 nt, Homo sapiens
aaguacuacagcaaa

SEQ ID NO: 1541130 - RNA, 19 nt, Homo sapiens
aaguauuuccaacuuguca

SEQ ID NO: 1541131 - RNA, 23 nt, Homo sapiens
aagucacugcacagugcaucuca

SEQ ID NO: 1541132 - RNA, 16 nt, Homo sapiens
aagucuccuguaucau

SEQ ID NO: 1541133 - RNA, 19 nt, Homo sapiens
aagugguaggaaagccuca

SEQ ID NO: 1541134 - RNA, 16 nt, Homo sapiens
aaguuaaucuucaugg

SEQ ID NO: 1541135 - RNA, 19 nt, Homo sapiens
aaguugucuuacacuucuc

SEQ ID NO: 1541136 - RNA, 23 nt, Homo sapiens
aaguuucuucuuuaggcauuaaa

SEQ ID NO: 1541137 - RNA, 15 nt, Homo sapiens
aaguuuucugcugua

SEQ ID NO: 1541138 - RNA, 20 nt, Homo sapiens
aauaaaauauggacuuccaa

SEQ ID NO: 1541139 - RNA, 17 nt, Homo sapiens
aauaaacaacauugucu

SEQ ID NO: 1541140 - RNA, 17 nt, Homo sapiens
aauaaacgaaacacaga

SEQ ID NO: 1541141 - RNA, 17 nt, Homo sapiens
aauaaauaaaaauauuc

SEQ ID NO: 1541142 - RNA, 23 nt, Homo sapiens
aauaaauuggugauaaguggaaa

SEQ ID NO: 1541143 - RNA, 21 nt, Homo sapiens
aauaacaucucuuucaucuag

SEQ ID NO: 1541144 - RNA, 16 nt, Homo sapiens
aauaaggaucuuccca

SEQ ID NO: 1541145 - RNA, 19 nt, Homo sapiens
aauaaggccucauccucca

SEQ ID NO: 1541146 - RNA, 13 nt, Homo sapiens
aauaaguaauauc

SEQ ID NO: 1541147 - RNA, 23 nt, Homo sapiens
aauaaguuuuuuuaaaguguuau

SEQ ID NO: 1541148 - RNA, 14 nt, Homo sapiens
aauaaugaucuucc

SEQ ID NO: 1541149 - RNA, 19 nt, Homo sapiens
aauacagcugagcuaugua

SEQ ID NO: 1541150 - RNA, 18 nt, Homo sapiens
aauacaugaugauuucag

SEQ ID NO: 1541151 - RNA, 12 nt, Homo sapiens
aauacaugccuu

SEQ ID NO: 1541152 - RNA, 16 nt, Homo sapiens
aauacaugccuuucca

SEQ ID NO: 1541153 - RNA, 23 nt, Homo sapiens
aauacauuaaaauaacuaagcaa

SEQ ID NO: 1541154 - RNA, 14 nt, Homo sapiens
aauacucaccaaaa

SEQ ID NO: 1541155 - RNA, 17 nt, Homo sapiens
aauaguguguccaugca

SEQ ID NO: 1541156 - RNA, 16 nt, Homo sapiens
aauauacugcauaucc

SEQ ID NO: 1541157 - RNA, 12 nt, Homo sapiens
aauaucuuucag

SEQ ID NO: 1541158 - RNA, 22 nt, Homo sapiens
aauaugcuuauauuguucacuu

SEQ ID NO: 1541159 - RNA, 15 nt, Homo sapiens
aauauggacuuccaa

SEQ ID NO: 1541160 - RNA, 18 nt, Homo sapiens
aauauuccuaugcugcaa

SEQ ID NO: 1541161 - RNA, 21 nt, Homo sapiens
aauauuccuaugcugcaauac

SEQ ID NO: 1541162 - RNA, 19 nt, Homo sapiens
aauauuuuaaacuacugau

SEQ ID NO: 1541163 - RNA, 17 nt, Homo sapiens
aaucaacagcaugucua

SEQ ID NO: 1541164 - RNA, 15 nt, Homo sapiens
aaucaagucugugaa

SEQ ID NO: 1541165 - RNA, 23 nt, Homo sapiens
aaucacacucucuucuuacugua

SEQ ID NO: 1541166 - RNA, 21 nt, Homo sapiens
aaucagaaucuuuaaagagga

SEQ ID NO: 1541167 - RNA, 14 nt, Homo sapiens
aaucagcauucuca

SEQ ID NO: 1541168 - RNA, 22 nt, Homo sapiens
aaucagucuuggaauacuugaa

SEQ ID NO: 1541169 - RNA, 23 nt, Homo sapiens
aaucauuuauuuacaugugauug

SEQ ID NO: 1541170 - RNA, 22 nt, Homo sapiens
aaucccagcaugcugagauuac

SEQ ID NO: 1541171 - RNA, 22 nt, Homo sapiens
aauccuacagcauaaagcacau

SEQ ID NO: 1541172 - RNA, 17 nt, Homo sapiens
aauccuucucacuaaaa

SEQ ID NO: 1541173 - RNA, 20 nt, Homo sapiens
aaucuauuuugucugauauu

SEQ ID NO: 1541174 - RNA, 18 nt, Homo sapiens
aaucuuuagaauaguuaa

SEQ ID NO: 1541175 - RNA, 15 nt, Homo sapiens
aaugaauacaauuaa

SEQ ID NO: 1541176 - RNA, 19 nt, Homo sapiens
aaugaauuuuuuccuacca

SEQ ID NO: 1541177 - RNA, 12 nt, Homo sapiens
aaugacuauaaa

SEQ ID NO: 1541178 - RNA, 17 nt, Homo sapiens
aauggcgcagugccucu

SEQ ID NO: 1541179 - RNA, 19 nt, Homo sapiens
aauguacaauaaagcaaug

SEQ ID NO: 1541180 - RNA, 23 nt, Homo sapiens
aauguaucuuauuuauauaugaa

SEQ ID NO: 1541181 - RNA, 13 nt, Homo sapiens
aauguccauucuu

SEQ ID NO: 1541182 - RNA, 19 nt, Homo sapiens
aaugugaauaugccaguga

SEQ ID NO: 1541183 - RNA, 15 nt, Homo sapiens
aaugugguacaagca

SEQ ID NO: 1541184 - RNA, 22 nt, Homo sapiens
aauguugaagaacucaugugau

SEQ ID NO: 1541185 - RNA, 23 nt, Homo sapiens
aauuaaacuguuaacuuauucaa

SEQ ID NO: 1541186 - RNA, 22 nt, Homo sapiens
aauuaacuccguuuccaaauac

SEQ ID NO: 1541187 - RNA, 16 nt, Homo sapiens
aggauuuaccaaauag

SEQ ID NO: 1541188 - RNA, 22 nt, Homo sapiens
aggcaauggugaacugucauua

SEQ ID NO: 1541189 - RNA, 16 nt, Homo sapiens
aggcagcuagacacca

SEQ ID NO: 1541190 - RNA, 15 nt, Homo sapiens
aggcauccacuucac

SEQ ID NO: 1541191 - RNA, 20 nt, Homo sapiens
aggcccaugcccuccguccu

SEQ ID NO: 1541192 - RNA, 12 nt, Homo sapiens
aggccucaggga

SEQ ID NO: 1541193 - RNA, 20 nt, Homo sapiens
aggcuauuccuaggccucag

SEQ ID NO: 1541194 - RNA, 15 nt, Homo sapiens
aggcucacaacuguu

SEQ ID NO: 1541195 - RNA, 12 nt, Homo sapiens
aggcucuaaugu

SEQ ID NO: 1541196 - RNA, 14 nt, Homo sapiens
aggcucuaauguac

SEQ ID NO: 1541197 - RNA, 17 nt, Homo sapiens
aggcucuaauguacaau

SEQ ID NO: 1541198 - RNA, 16 nt, Homo sapiens
aggcucuguuccacau

SEQ ID NO: 1541199 - RNA, 18 nt, Homo sapiens
aggcugaaaagugcuuug

SEQ ID NO: 1541200 - RNA, 23 nt, Homo sapiens
aggcugagucagccccacuccac

SEQ ID NO: 1541201 - RNA, 14 nt, Homo sapiens
aggcuggagcuggc

SEQ ID NO: 1541202 - RNA, 14 nt, Homo sapiens
aggcuggaugcugg

SEQ ID NO: 1541203 - RNA, 20 nt, Homo sapiens
agggaagcagagccuggggu

SEQ ID NO: 1541204 - RNA, 13 nt, Homo sapiens
agggacagcgggu

SEQ ID NO: 1541205 - RNA, 16 nt, Homo sapiens
agggcaucuccaggaa

SEQ ID NO: 1541206 - RNA, 20 nt, Homo sapiens
agggggccaugaggccucag

SEQ ID NO: 1541207 - RNA, 14 nt, Homo sapiens
agggggcccggcug

SEQ ID NO: 1541208 - RNA, 16 nt, Homo sapiens
agggugcugcuucccu

SEQ ID NO: 1541209 - RNA, 21 nt, Homo sapiens
aggguuuucaccuuagcaaca

SEQ ID NO: 1541210 - RNA, 21 nt, Homo sapiens
aggucuccugggcaucuggcc

SEQ ID NO: 1541211 - RNA, 12 nt, Homo sapiens
aggugcuggcau

SEQ ID NO: 1541212 - RNA, 23 nt, Homo sapiens
agguggggcgggaaagccaguga

SEQ ID NO: 1541213 - RNA, 16 nt, Homo sapiens
agguuauuaugauuag

SEQ ID NO: 1541214 - RNA, 20 nt, Homo sapiens
agguuauuaugauuagcuuu

SEQ ID NO: 1541215 - RNA, 16 nt, Homo sapiens
agguugaaaauguuau

SEQ ID NO: 1541216 - RNA, 12 nt, Homo sapiens
aguaaagaccau

SEQ ID NO: 1541217 - RNA, 19 nt, Homo sapiens
aguaauagcgccucuuuua

SEQ ID NO: 1541218 - RNA, 15 nt, Homo sapiens
aguaauaucuuucag

SEQ ID NO: 1541219 - RNA, 15 nt, Homo sapiens
aguaccaaugcucuu

SEQ ID NO: 1541220 - RNA, 15 nt, Homo sapiens
aguacuugugaaaca

SEQ ID NO: 1541221 - RNA, 14 nt, Homo sapiens
aguagaaucucagc

SEQ ID NO: 1541222 - RNA, 17 nt, Homo sapiens
aguagcucgugugcuua

SEQ ID NO: 1541223 - RNA, 15 nt, Homo sapiens
agucaaaagaacucu

SEQ ID NO: 1541224 - RNA, 12 nt, Homo sapiens
agucacauauca

SEQ ID NO: 1541225 - RNA, 15 nt, Homo sapiens
agucagcacagagag

SEQ ID NO: 1541226 - RNA, 14 nt, Homo sapiens
agucaugaugaauc

SEQ ID NO: 1541227 - RNA, 20 nt, Homo sapiens
aguccccagccugcucccua

SEQ ID NO: 1541228 - RNA, 12 nt, Homo sapiens
aguccuguucuc

SEQ ID NO: 1541229 - RNA, 16 nt, Homo sapiens
agugaaaaacuauuaa

SEQ ID NO: 1541230 - RNA, 16 nt, Homo sapiens
agugagaaauuaugaa

SEQ ID NO: 1541231 - RNA, 12 nt, Homo sapiens
agugcacagcug

SEQ ID NO: 1541232 - RNA, 14 nt, Homo sapiens
agugcacagcuguc

SEQ ID NO: 1541233 - RNA, 21 nt, Homo sapiens
agugcaggcuggcaccgccuu

SEQ ID NO: 1541234 - RNA, 19 nt, Homo sapiens
agugguauagaguacugca

SEQ ID NO: 1541235 - RNA, 20 nt, Homo sapiens
agugguguuuagaaugucag

SEQ ID NO: 1541236 - RNA, 21 nt, Homo sapiens
agugguguuuagaaugucagu

SEQ ID NO: 1541237 - RNA, 17 nt, Homo sapiens
aguguacuggauuuaac

SEQ ID NO: 1541238 - RNA, 17 nt, Homo sapiens
aguguagaucaacucau

SEQ ID NO: 1541239 - RNA, 17 nt, Homo sapiens
aguguuuaugugcuauu

SEQ ID NO: 1541240 - RNA, 15 nt, Homo sapiens
aguguuuugcaaggg

SEQ ID NO: 1541241 - RNA, 17 nt, Homo sapiens
aguguuuugcaagggaa

SEQ ID NO: 1541242 - RNA, 16 nt, Homo sapiens
aguguuuuuucuguca

SEQ ID NO: 1541243 - RNA, 16 nt, Homo sapiens
aguuaaauuggcuugu

SEQ ID NO: 1541244 - RNA, 15 nt, Homo sapiens
aguuacuguccuguu

SEQ ID NO: 1541245 - RNA, 22 nt, Homo sapiens
aguuaucugagcuuaaacauuu

SEQ ID NO: 1541246 - RNA, 18 nt, Homo sapiens
aguuccccucuacuccau

SEQ ID NO: 1541247 - RNA, 16 nt, Homo sapiens
aguugcacauuaggaa

SEQ ID NO: 1541248 - RNA, 22 nt, Homo sapiens
aguuuaaaaaaauaacaucuga

SEQ ID NO: 1541249 - RNA, 22 nt, Homo sapiens
aguuuaggacccaagguggucu

SEQ ID NO: 1541250 - RNA, 18 nt, Homo sapiens
aguuucaaaugaguuuaa

SEQ ID NO: 1541251 - RNA, 19 nt, Homo sapiens
aguuucuucuuuaggcauu

SEQ ID NO: 1541252 - RNA, 22 nt, Homo sapiens
aguuucuucuuuaggcauuaaa

SEQ ID NO: 1541253 - RNA, 22 nt, Homo sapiens
aguuuugaaaggcuuuccucag

SEQ ID NO: 1541254 - RNA, 23 nt, Homo sapiens
aguuuuucagguauauaccucca

SEQ ID NO: 1541255 - RNA, 14 nt, Homo sapiens
auaaaaguguccau

SEQ ID NO: 1541256 - RNA, 15 nt, Homo sapiens
auaaaccauaaaaua

SEQ ID NO: 1541257 - RNA, 19 nt, Homo sapiens
auaaacucagucaaaugua

SEQ ID NO: 1541258 - RNA, 15 nt, Homo sapiens
auaaagcaauguggu

SEQ ID NO: 1541259 - RNA, 17 nt, Homo sapiens
auaaagcaaugugguag

SEQ ID NO: 1541260 - RNA, 15 nt, Homo sapiens
auaaaggucauauug

SEQ ID NO: 1541261 - RNA, 15 nt, Homo sapiens
auaaauauuagcaaa

SEQ ID NO: 1541262 - RNA, 16 nt, Homo sapiens
auaaaucuuccaaagu

SEQ ID NO: 1541263 - RNA, 18 nt, Homo sapiens
auaaauggugagaauuaa

SEQ ID NO: 1541264 - RNA, 18 nt, Homo sapiens
auaaaugugguacaagca

SEQ ID NO: 1541265 - RNA, 13 nt, Homo sapiens
auaacaagccaaa

SEQ ID NO: 1541266 - RNA, 22 nt, Homo sapiens
auaaggaucuucccacuuugcc

SEQ ID NO: 1541267 - RNA, 15 nt, Homo sapiens
auaaguguguuugca

SEQ ID NO: 1541268 - RNA, 16 nt, Homo sapiens
auaaguguguuugcaa

SEQ ID NO: 1541269 - RNA, 18 nt, Homo sapiens
auaaugaaaauuaugaua

SEQ ID NO: 1541270 - RNA, 18 nt, Homo sapiens
auaaugacaggcauccaa

SEQ ID NO: 1541271 - RNA, 21 nt, Homo sapiens
auaaugugggcagauuuggcu

SEQ ID NO: 1541272 - RNA, 14 nt, Homo sapiens
auaauucuaugaga

SEQ ID NO: 1541273 - RNA, 16 nt, Homo sapiens
auaauugcaagggaag

SEQ ID NO: 1541274 - RNA, 21 nt, Homo sapiens
auaauuuucuaccuggucucu

SEQ ID NO: 1541275 - RNA, 17 nt, Homo sapiens
auacaaccuucauuuaa

SEQ ID NO: 1541276 - RNA, 14 nt, Homo sapiens
auacaauuaaagcu

SEQ ID NO: 1541277 - RNA, 14 nt, Homo sapiens
auacagaaugaauc

SEQ ID NO: 1541278 - RNA, 12 nt, Homo sapiens
auacaguauuau

SEQ ID NO: 1541279 - RNA, 21 nt, Homo sapiens
auacauuuggcuccacuguaa

SEQ ID NO: 1541280 - RNA, 13 nt, Homo sapiens
auaccaccuucaa

SEQ ID NO: 1541281 - RNA, 23 nt, Homo sapiens
auaccagcuagaaucacuugacu

SEQ ID NO: 1541282 - RNA, 14 nt, Homo sapiens
auacccacugccag

SEQ ID NO: 1541283 - RNA, 20 nt, Homo sapiens
auacccagugucuaccuuca

SEQ ID NO: 1541284 - RNA, 17 nt, Homo sapiens
auaccuccauguuucua

SEQ ID NO: 1541285 - RNA, 13 nt, Homo sapiens
auacuucuuuuua

SEQ ID NO: 1541286 - RNA, 20 nt, Homo sapiens
auacuucuuuuucauuauug

SEQ ID NO: 1541287 - RNA, 18 nt, Homo sapiens
auacuuuggggacuugua

SEQ ID NO: 1541288 - RNA, 15 nt, Homo sapiens
auagcuuaagaagua

SEQ ID NO: 1541289 - RNA, 13 nt, Homo sapiens
auaggagccacaa

SEQ ID NO: 1541290 - RNA, 12 nt, Homo sapiens
auaggaggacag

SEQ ID NO: 1541291 - RNA, 18 nt, Homo sapiens
auaggaggacagaaccaa

SEQ ID NO: 1541292 - RNA, 14 nt, Homo sapiens
auaguaaaugcuuu

SEQ ID NO: 1541293 - RNA, 13 nt, Homo sapiens
auaguauuucaga

SEQ ID NO: 1541294 - RNA, 12 nt, Homo sapiens
auauacauaacu

SEQ ID NO: 1541295 - RNA, 13 nt, Homo sapiens
auauacugcauau

SEQ ID NO: 1541296 - RNA, 13 nt, Homo sapiens
auauauauuuauc

SEQ ID NO: 1541297 - RNA, 18 nt, Homo sapiens
auauaugacuuuuucuca

SEQ ID NO: 1541298 - RNA, 22 nt, Homo sapiens
auauauuuccacuucuucauuc

SEQ ID NO: 1541299 - RNA, 18 nt, Homo sapiens
auaucagaguaugucagu

SEQ ID NO: 1541300 - RNA, 21 nt, Homo sapiens
auaucauccugccuucaugga

SEQ ID NO: 1541301 - RNA, 19 nt, Homo sapiens
auaucaugcacacaauuag

SEQ ID NO: 1541302 - RNA, 13 nt, Homo sapiens
auaucucaucucu

SEQ ID NO: 1541303 - RNA, 17 nt, Homo sapiens
auaucuugaaagggguu

SEQ ID NO: 1541304 - RNA, 17 nt, Homo sapiens
auaugaaaacuaaguuc

SEQ ID NO: 1541305 - RNA, 13 nt, Homo sapiens
auaugagucacug

SEQ ID NO: 1541306 - RNA, 13 nt, Homo sapiens
auaugccagugac

SEQ ID NO: 1541307 - RNA, 15 nt, Homo sapiens
auaugucacuagaga

SEQ ID NO: 1541308 - RNA, 18 nt, Homo sapiens
auauuauuugcuaauuaa

SEQ ID NO: 1541309 - RNA, 21 nt, Homo sapiens
auauucagagauguaccaugu

SEQ ID NO: 1541310 - RNA, 20 nt, Homo sapiens
auauugagcaauaugucagu

SEQ ID NO: 1541311 - RNA, 20 nt, Homo sapiens
auauuuaggcaugagcucuu

SEQ ID NO: 1541312 - RNA, 22 nt, Homo sapiens
auauuuaugaccucaacaaaga

SEQ ID NO: 1541313 - RNA, 20 nt, Homo sapiens
auauuugugugaaaauguga

SEQ ID NO: 1541314 - RNA, 22 nt, Homo sapiens
auauuuuaucuugguaguacau

SEQ ID NO: 1541315 - RNA, 17 nt, Homo sapiens
auauuuuuuuaacuuua

SEQ ID NO: 1541316 - RNA, 17 nt, Homo sapiens
aucaagcuccaucuuau

SEQ ID NO: 1541317 - RNA, 23 nt, Homo sapiens
aucaauggcgcagugccucuggu

SEQ ID NO: 1541318 - RNA, 15 nt, Homo sapiens
ccauugugcauucua

SEQ ID NO: 1541319 - RNA, 13 nt, Homo sapiens
ccauuuguaaugu

SEQ ID NO: 1541320 - RNA, 17 nt, Homo sapiens
ccauuugugauacuucc

SEQ ID NO: 1541321 - RNA, 14 nt, Homo sapiens
cccaacgaaaagca

SEQ ID NO: 1541322 - RNA, 22 nt, Homo sapiens
cccaaggaaaauggacauauuc

SEQ ID NO: 1541323 - RNA, 19 nt, Homo sapiens
cccaaggaagaacaaauau

SEQ ID NO: 1541324 - RNA, 22 nt, Homo sapiens
cccacagagguggaacuuaauu

SEQ ID NO: 1541325 - RNA, 19 nt, Homo sapiens
cccacaggagcguguacua

SEQ ID NO: 1541326 - RNA, 22 nt, Homo sapiens
cccacaggagcguguacuaccc

SEQ ID NO: 1541327 - RNA, 15 nt, Homo sapiens
cccacauccauucca

SEQ ID NO: 1541328 - RNA, 18 nt, Homo sapiens
cccacugccagacaugcc

SEQ ID NO: 1541329 - RNA, 16 nt, Homo sapiens
cccacuuaugcugcug

SEQ ID NO: 1541330 - RNA, 19 nt, Homo sapiens
cccacuuaugcugcuguga

SEQ ID NO: 1541331 - RNA, 17 nt, Homo sapiens
cccagaacgcaugcagg

SEQ ID NO: 1541332 - RNA, 20 nt, Homo sapiens
cccagcgacuucugaagggc

SEQ ID NO: 1541333 - RNA, 22 nt, Homo sapiens
cccaggaagucauccugcaaug

SEQ ID NO: 1541334 - RNA, 16 nt, Homo sapiens
cccagggagaggccau

SEQ ID NO: 1541335 - RNA, 19 nt, Homo sapiens
cccaggggcacuguguucu

SEQ ID NO: 1541336 - RNA, 19 nt, Homo sapiens
cccaugguagacugugaca

SEQ ID NO: 1541337 - RNA, 13 nt, Homo sapiens
cccauuucuguaa

SEQ ID NO: 1541338 - RNA, 18 nt, Homo sapiens
cccauuuguaauguaucu

SEQ ID NO: 1541339 - RNA, 11 nt, Homo sapiens
ccccaccagca

SEQ ID NO: 1541340 - RNA, 23 nt, Homo sapiens
ccccaccuucccuccaccugcuu

SEQ ID NO: 1541341 - RNA, 20 nt, Homo sapiens
ccccagagcuuuacagugcc

SEQ ID NO: 1541342 - RNA, 21 nt, Homo sapiens
ccccagccugcucccuagcca

SEQ ID NO: 1541343 - RNA, 22 nt, Homo sapiens
cccccuuuccaucuguuugaua

SEQ ID NO: 1541344 - RNA, 22 nt, Homo sapiens
ccccgagcugggggccaugagc

SEQ ID NO: 1541345 - RNA, 19 nt, Homo sapiens
ccccucgcuucauaggcag

SEQ ID NO: 1541346 - RNA, 18 nt, Homo sapiens
ccccugguccugcacugu

SEQ ID NO: 1541347 - RNA, 17 nt, Homo sapiens
ccccuugcaaaguaaua

SEQ ID NO: 1541348 - RNA, 13 nt, Homo sapiens
cccgacagccugg

SEQ ID NO: 1541349 - RNA, 19 nt, Homo sapiens
cccgagcugggggccauga

SEQ ID NO: 1541350 - RNA, 20 nt, Homo sapiens
cccggggcauggacagggcc

SEQ ID NO: 1541351 - RNA, 20 nt, Homo sapiens
cccgugccacgcgcucugca

SEQ ID NO: 1541352 - RNA, 23 nt, Homo sapiens
cccgugccacgcgcucugcaugc

SEQ ID NO: 1541353 - RNA, 16 nt, Homo sapiens
cccucuacuccaugca

SEQ ID NO: 1541354 - RNA, 18 nt, Homo sapiens
cccucuggcacuccagaa

SEQ ID NO: 1541355 - RNA, 12 nt, Homo sapiens
cccugacacugu

SEQ ID NO: 1541356 - RNA, 22 nt, Homo sapiens
cccugagggacuuggcaguaga

SEQ ID NO: 1541357 - RNA, 23 nt, Homo sapiens
cccugagggacuuggcaguagaa

SEQ ID NO: 1541358 - RNA, 14 nt, Homo sapiens
cccugccauggagg

SEQ ID NO: 1541359 - RNA, 18 nt, Homo sapiens
cccugcucacucuuccac

SEQ ID NO: 1541360 - RNA, 23 nt, Homo sapiens
cccuggaaauaacugagcacuuu

SEQ ID NO: 1541361 - RNA, 23 nt, Homo sapiens
cccuggaagaggaauccagugaa

SEQ ID NO: 1541362 - RNA, 15 nt, Homo sapiens
cccuggauuugcaua

SEQ ID NO: 1541363 - RNA, 16 nt, Homo sapiens
cccugguccugcacug

SEQ ID NO: 1541364 - RNA, 17 nt, Homo sapiens
cccugguccugcacugu

SEQ ID NO: 1541365 - RNA, 20 nt, Homo sapiens
cccugugaucuauaccaccu

SEQ ID NO: 1541366 - RNA, 21 nt, Homo sapiens
cccuguucuuugaaguggcac

SEQ ID NO: 1541367 - RNA, 20 nt, Homo sapiens
cccuucaaugcaaaauacau

SEQ ID NO: 1541368 - RNA, 16 nt, Homo sapiens
cccuuggagccaaugg

SEQ ID NO: 1541369 - RNA, 18 nt, Homo sapiens
ccgacaaccgaugcucca

SEQ ID NO: 1541370 - RNA, 15 nt, Homo sapiens
ccgagccgagcucuc

SEQ ID NO: 1541371 - RNA, 23 nt, Homo sapiens
ccgaggaguccaguuugugcaag

SEQ ID NO: 1541372 - RNA, 20 nt, Homo sapiens
ccgagucucuucuccacugg

SEQ ID NO: 1541373 - RNA, 13 nt, Homo sapiens
ccgcuugccauau

SEQ ID NO: 1541374 - RNA, 21 nt, Homo sapiens
ccggccacucuguuugcucac

SEQ ID NO: 1541375 - RNA, 21 nt, Homo sapiens
ccguggugagguugugcugcc

SEQ ID NO: 1541376 - RNA, 13 nt, Homo sapiens
ccguucaacuuuu

SEQ ID NO: 1541377 - RNA, 17 nt, Homo sapiens
ccguugccucucugcca

SEQ ID NO: 1541378 - RNA, 23 nt, Homo sapiens
ccguuguguggguuuacucugug

SEQ ID NO: 1541379 - RNA, 14 nt, Homo sapiens
ccguuuccaaauac

SEQ ID NO: 1541380 - RNA, 12 nt, Homo sapiens
ccuaagagccac

SEQ ID NO: 1541381 - RNA, 17 nt, Homo sapiens
ccuagccugcauaucau

SEQ ID NO: 1541382 - RNA, 16 nt, Homo sapiens
ccuagcugugaccucu

SEQ ID NO: 1541383 - RNA, 20 nt, Homo sapiens
ccuaggugggucaacuccaa

SEQ ID NO: 1541384 - RNA, 13 nt, Homo sapiens
ccuaguagcuuuc

SEQ ID NO: 1541385 - RNA, 21 nt, Homo sapiens
ccuaguagcuuuccucccaaa

SEQ ID NO: 1541386 - RNA, 18 nt, Homo sapiens
ccuauuuuggacguguga

SEQ ID NO: 1541387 - RNA, 19 nt, Homo sapiens
ccucaaaaaucaucaaagu

SEQ ID NO: 1541388 - RNA, 14 nt, Homo sapiens
ccucaacaagaaga

SEQ ID NO: 1541389 - RNA, 16 nt, Homo sapiens
ccucaaccugugauga

SEQ ID NO: 1541390 - RNA, 18 nt, Homo sapiens
ccucaagccaggagaccc

SEQ ID NO: 1541391 - RNA, 14 nt, Homo sapiens
ccucaccaccgaga

SEQ ID NO: 1541392 - RNA, 13 nt, Homo sapiens
ccucacuccacuc

SEQ ID NO: 1541393 - RNA, 18 nt, Homo sapiens
ccucacuggugcauuuaa

SEQ ID NO: 1541394 - RNA, 17 nt, Homo sapiens
ccucagcaccugggacc

SEQ ID NO: 1541395 - RNA, 14 nt, Homo sapiens
ccucagccacugaa

SEQ ID NO: 1541396 - RNA, 13 nt, Homo sapiens
ccucagggaccaa

SEQ ID NO: 1541397 - RNA, 17 nt, Homo sapiens
ccucagggaccaaggag

SEQ ID NO: 1541398 - RNA, 14 nt, Homo sapiens
ccucaguuccugca

SEQ ID NO: 1541399 - RNA, 15 nt, Homo sapiens
ccucauauacuugaa

SEQ ID NO: 1541400 - RNA, 19 nt, Homo sapiens
ccucauccacuaggugccc

SEQ ID NO: 1541401 - RNA, 17 nt, Homo sapiens
ccucauuuauacuauua

SEQ ID NO: 1541402 - RNA, 13 nt, Homo sapiens
ccuccaaaagccc

SEQ ID NO: 1541403 - RNA, 14 nt, Homo sapiens
ccuccaaaagcccu

SEQ ID NO: 1541404 - RNA, 14 nt, Homo sapiens
ccuccccauggugc

SEQ ID NO: 1541405 - RNA, 21 nt, Homo sapiens
ccuccugaccccaccuagaau

SEQ ID NO: 1541406 - RNA, 12 nt, Homo sapiens
ccuccugcugag

SEQ ID NO: 1541407 - RNA, 23 nt, Homo sapiens
ccuccuggguuuacuccuugagu

SEQ ID NO: 1541408 - RNA, 13 nt, Homo sapiens
ccucucacacugg

SEQ ID NO: 1541409 - RNA, 22 nt, Homo sapiens
ccucucugaacugcaacacugg

SEQ ID NO: 1541410 - RNA, 13 nt, Homo sapiens
ccucucugccagc

SEQ ID NO: 1541411 - RNA, 21 nt, Homo sapiens
ccucucuggcacuuugaguua

SEQ ID NO: 1541412 - RNA, 17 nt, Homo sapiens
ccucucuguuuacccuc

SEQ ID NO: 1541413 - RNA, 17 nt, Homo sapiens
ccucugcacgugcacac

SEQ ID NO: 1541414 - RNA, 17 nt, Homo sapiens
ccucugcauaaauauua

SEQ ID NO: 1541415 - RNA, 16 nt, Homo sapiens
ccucuuucacuucuua

SEQ ID NO: 1541416 - RNA, 20 nt, Homo sapiens
ccugaaacuuacacacaaaa

SEQ ID NO: 1541417 - RNA, 12 nt, Homo sapiens
ccugaaaggaag

SEQ ID NO: 1541418 - RNA, 12 nt, Homo sapiens
ccugaagugaug

SEQ ID NO: 1541419 - RNA, 18 nt, Homo sapiens
ccugaaguuggagugagu

SEQ ID NO: 1541420 - RNA, 22 nt, Homo sapiens
ccugacuguccuacaauaucau

SEQ ID NO: 1541421 - RNA, 23 nt, Homo sapiens
ccugauggccaggccucagggac

SEQ ID NO: 1541422 - RNA, 20 nt, Homo sapiens
ccugauuuccauuugcaaca

SEQ ID NO: 1541423 - RNA, 14 nt, Homo sapiens
ccugcagggagcag

SEQ ID NO: 1541424 - RNA, 23 nt, Homo sapiens
ccugccagaggccuggugcccug

SEQ ID NO: 1541425 - RNA, 13 nt, Homo sapiens
ccugccccagaga

SEQ ID NO: 1541426 - RNA, 20 nt, Homo sapiens
ccugcccccacucagcauuu

SEQ ID NO: 1541427 - RNA, 17 nt, Homo sapiens
ccugcccccgcucugcc

SEQ ID NO: 1541428 - RNA, 16 nt, Homo sapiens
ccugcucccuagccag

SEQ ID NO: 1541429 - RNA, 22 nt, Homo sapiens
ccugcucccuagccagaggcuc

SEQ ID NO: 1541430 - RNA, 22 nt, Homo sapiens
ccuggaaauaacugagcacuuu

SEQ ID NO: 1541431 - RNA, 21 nt, Homo sapiens
ccuggaacugucucucaugaa

SEQ ID NO: 1541432 - RNA, 23 nt, Homo sapiens
ccuggauuugcauacauucuuca

SEQ ID NO: 1541433 - RNA, 21 nt, Homo sapiens
ccuggauuuucuuucuaugua

SEQ ID NO: 1541434 - RNA, 20 nt, Homo sapiens
ccuggcagaacugagcuccu

SEQ ID NO: 1541435 - RNA, 17 nt, Homo sapiens
ccuggcagcacaggaaa

SEQ ID NO: 1541436 - RNA, 18 nt, Homo sapiens
ccugggaaauuugccgau

SEQ ID NO: 1541437 - RNA, 21 nt, Homo sapiens
ccugggcaucuggcccugcug

SEQ ID NO: 1541438 - RNA, 17 nt, Homo sapiens
ccugggggcugcugcac

SEQ ID NO: 1541439 - RNA, 20 nt, Homo sapiens
ccugggggcugcugcacugc

SEQ ID NO: 1541440 - RNA, 14 nt, Homo sapiens
ccugggguuuccac

SEQ ID NO: 1541441 - RNA, 14 nt, Homo sapiens
ccugguccaugaug

SEQ ID NO: 1541442 - RNA, 17 nt, Homo sapiens
ccugguccugcacuguc

SEQ ID NO: 1541443 - RNA, 21 nt, Homo sapiens
ccugugagcuccccaauccaa

SEQ ID NO: 1541444 - RNA, 22 nt, Homo sapiens
ccuguggcccucgcucugccuc

SEQ ID NO: 1541445 - RNA, 23 nt, Homo sapiens
ccuguuaaggcauccacuucaca

SEQ ID NO: 1541446 - RNA, 15 nt, Homo sapiens
ccuguuccugccaca

SEQ ID NO: 1541447 - RNA, 20 nt, Homo sapiens
uugaacuguaaauaugucac

SEQ ID NO: 1541448 - RNA, 23 nt, Homo sapiens
uugaagcuaaaauaaaccagacu

SEQ ID NO: 1541449 - RNA, 20 nt, Homo sapiens
uugaagggcaggugcuucag

SEQ ID NO: 1541450 - RNA, 15 nt, Homo sapiens
uugaauuacagggaa

SEQ ID NO: 1541451 - RNA, 14 nt, Homo sapiens
uugacacggccaug

SEQ ID NO: 1541452 - RNA, 22 nt, Homo sapiens
uugacacuuuucauaucauuuc

SEQ ID NO: 1541453 - RNA, 18 nt, Homo sapiens
uugaccucaaccugugau

SEQ ID NO: 1541454 - RNA, 13 nt, Homo sapiens
uugacuuugccac

SEQ ID NO: 1541455 - RNA, 15 nt, Homo sapiens
uugaguuuuucaggu

SEQ ID NO: 1541456 - RNA, 11 nt, Homo sapiens
uugauaccagu

SEQ ID NO: 1541457 - RNA, 19 nt, Homo sapiens
uugauaucacuaauaaagu

SEQ ID NO: 1541458 - RNA, 16 nt, Homo sapiens
uugauuaaaacauuau

SEQ ID NO: 1541459 - RNA, 12 nt, Homo sapiens
uugcaaaguaau

SEQ ID NO: 1541460 - RNA, 21 nt, Homo sapiens
uugcacaaguacuugagaaua

SEQ ID NO: 1541461 - RNA, 22 nt, Homo sapiens
uugcauuaaaaaugcauauacu

SEQ ID NO: 1541462 - RNA, 16 nt, Homo sapiens
uugccagucacuccgu

SEQ ID NO: 1541463 - RNA, 21 nt, Homo sapiens
uugcccaggcuggagugcagu

SEQ ID NO: 1541464 - RNA, 20 nt, Homo sapiens
uugcugagccagagucaaaa

SEQ ID NO: 1541465 - RNA, 20 nt, Homo sapiens
uuggaagaggacuccuuaaa

SEQ ID NO: 1541466 - RNA, 18 nt, Homo sapiens
uuggcaugaaggugucau

SEQ ID NO: 1541467 - RNA, 23 nt, Homo sapiens
uuggcccccgagcugggggccau

SEQ ID NO: 1541468 - RNA, 16 nt, Homo sapiens
uuggcucacugcaacu

SEQ ID NO: 1541469 - RNA, 17 nt, Homo sapiens
uuggcuccacuguaaau

SEQ ID NO: 1541470 - RNA, 13 nt, Homo sapiens
uuggguuccagac

SEQ ID NO: 1541471 - RNA, 19 nt, Homo sapiens
uuguaauuuugcaaaacau

SEQ ID NO: 1541472 - RNA, 22 nt, Homo sapiens
uuguaucuuuaaagacuugaug

SEQ ID NO: 1541473 - RNA, 12 nt, Homo sapiens
uugucacaauua

SEQ ID NO: 1541474 - RNA, 13 nt, Homo sapiens
uugucauuuauaa

SEQ ID NO: 1541475 - RNA, 19 nt, Homo sapiens
uugucuaaagcuaaacaaa

SEQ ID NO: 1541476 - RNA, 21 nt, Homo sapiens
uugucuguuaaaugaacuuga

SEQ ID NO: 1541477 - RNA, 16 nt, Homo sapiens
uugugggggugucaca

SEQ ID NO: 1541478 - RNA, 12 nt, Homo sapiens
uuguucugauaa

SEQ ID NO: 1541479 - RNA, 12 nt, Homo sapiens
uuguugcaguuc

SEQ ID NO: 1541480 - RNA, 14 nt, Homo sapiens
uuguugcaguucag

SEQ ID NO: 1541481 - RNA, 20 nt, Homo sapiens
uuuaaaacuaguuagauuca

SEQ ID NO: 1541482 - RNA, 21 nt, Homo sapiens
uuuaaacuacugauugaaugu

SEQ ID NO: 1541483 - RNA, 15 nt, Homo sapiens
uuuaacaucugagaa

SEQ ID NO: 1541484 - RNA, 16 nt, Homo sapiens
uuuaacuuuaccaugc

SEQ ID NO: 1541485 - RNA, 15 nt, Homo sapiens
uuuaagaauugccag

SEQ ID NO: 1541486 - RNA, 17 nt, Homo sapiens
uuuaagaguagauugau

SEQ ID NO: 1541487 - RNA, 11 nt, Homo sapiens
uuuaagcucaa

SEQ ID NO: 1541488 - RNA, 17 nt, Homo sapiens
uuuaauguuuacaacaa

SEQ ID NO: 1541489 - RNA, 17 nt, Homo sapiens
uuuaauuuaugauauaa

SEQ ID NO: 1541490 - RNA, 18 nt, Homo sapiens
uuuaauuuugacacugaa

SEQ ID NO: 1541491 - RNA, 18 nt, Homo sapiens
uuuacaugaguucaaaua

SEQ ID NO: 1541492 - RNA, 16 nt, Homo sapiens
uuuacauggguucaau

SEQ ID NO: 1541493 - RNA, 20 nt, Homo sapiens
uuuagcgguuugcaaacaaa

SEQ ID NO: 1541494 - RNA, 22 nt, Homo sapiens
uuuagguaguagaaucucagca

SEQ ID NO: 1541495 - RNA, 20 nt, Homo sapiens
uuuauaccccuuuggcacac

SEQ ID NO: 1541496 - RNA, 12 nt, Homo sapiens
uuuauauaugaa

SEQ ID NO: 1541497 - RNA, 13 nt, Homo sapiens
uuuauauaugaag

SEQ ID NO: 1541498 - RNA, 15 nt, Homo sapiens
uuuauauugaacugu

SEQ ID NO: 1541499 - RNA, 22 nt, Homo sapiens
uuuaucucacaaauaaguaaua

SEQ ID NO: 1541500 - RNA, 20 nt, Homo sapiens
uuuauggcagacauugugcu

SEQ ID NO: 1541501 - RNA, 17 nt, Homo sapiens
uuuauucacaguaucug

SEQ ID NO: 1541502 - RNA, 15 nt, Homo sapiens
uuuauucacuugugu

SEQ ID NO: 1541503 - RNA, 19 nt, Homo sapiens
uuuauucauuagcugugau

SEQ ID NO: 1541504 - RNA, 16 nt, Homo sapiens
uuuauucccccaaagc

SEQ ID NO: 1541505 - RNA, 23 nt, Homo sapiens
uuuauuuaaggggaauuaacaau

SEQ ID NO: 1541506 - RNA, 18 nt, Homo sapiens
uuuauuuccaauguuuca

SEQ ID NO: 1541507 - RNA, 15 nt, Homo sapiens
uuucauauucucaga

SEQ ID NO: 1541508 - RNA, 22 nt, Homo sapiens
uuuccaagggucuuccuccuaa

SEQ ID NO: 1541509 - RNA, 10 nt, Homo sapiens
uuuccaccuu

SEQ ID NO: 1541510 - RNA, 22 nt, Homo sapiens
uuuccauauaguuuguuuucuu

SEQ ID NO: 1541511 - RNA, 13 nt, Homo sapiens
uuucuccaugagu

SEQ ID NO: 1541512 - RNA, 19 nt, Homo sapiens
uuucucuguggccauuugu

SEQ ID NO: 1541513 - RNA, 18 nt, Homo sapiens
uuucugccuucuccugca

SEQ ID NO: 1541514 - RNA, 18 nt, Homo sapiens
uuugaaaggcuuuccuca

SEQ ID NO: 1541515 - RNA, 20 nt, Homo sapiens
uuugacuuucugucugugga

SEQ ID NO: 1541516 - RNA, 16 nt, Homo sapiens
uuugauacaguauuau

SEQ ID NO: 1541517 - RNA, 17 nt, Homo sapiens
uuugcauggaguauuau

SEQ ID NO: 1541518 - RNA, 20 nt, Homo sapiens
uuugggauguuaccuucaca

SEQ ID NO: 1541519 - RNA, 19 nt, Homo sapiens
uuuggggacuuguagggau

SEQ ID NO: 1541520 - RNA, 22 nt, Homo sapiens
uuugggggacuuacaugauuca

SEQ ID NO: 1541521 - RNA, 13 nt, Homo sapiens
uuugggggauuca

SEQ ID NO: 1541522 - RNA, 19 nt, Homo sapiens
uuuguaguguuauugccag

SEQ ID NO: 1541523 - RNA, 12 nt, Homo sapiens
uuugucacugaa

SEQ ID NO: 1541524 - RNA, 23 nt, Homo sapiens
uuugucaguguagaucaacucau

SEQ ID NO: 1541525 - RNA, 22 nt, Homo sapiens
uuuguccacacaagacagcaga

SEQ ID NO: 1541526 - RNA, 13 nt, Homo sapiens
uuugugugauuga

SEQ ID NO: 1541527 - RNA, 19 nt, Homo sapiens
uuuguugugucuugcuaua

SEQ ID NO: 1541528 - RNA, 17 nt, Homo sapiens
uuuuaaaaaguugcaca

SEQ ID NO: 1541529 - RNA, 14 nt, Homo sapiens
uuuuaaacuacuga

SEQ ID NO: 1541530 - RNA, 22 nt, Homo sapiens
uuuuaaauuuucucucacugau

SEQ ID NO: 1541531 - RNA, 13 nt, Homo sapiens
uuuuaacaucuga

SEQ ID NO: 1541532 - RNA, 18 nt, Homo sapiens
uuuuagcgguuugcaaac

SEQ ID NO: 1541533 - RNA, 21 nt, Homo sapiens
uuuucacugcuggcugccuua

SEQ ID NO: 1541534 - RNA, 12 nt, Homo sapiens
uuuucugauuug

SEQ ID NO: 1541535 - RNA, 22 nt, Homo sapiens
gaaguccagugacccuggagcu

SEQ ID NO: 1541536 - RNA, 17 nt, Homo sapiens
gaaguggcaccuaauaa

SEQ ID NO: 1541537 - RNA, 13 nt, Homo sapiens
gaauaaagccaca

SEQ ID NO: 1541538 - RNA, 20 nt, Homo sapiens
gaauaauuauguuuaccuca

SEQ ID NO: 1541539 - RNA, 12 nt, Homo sapiens
gaauacaguaag

SEQ ID NO: 1541540 - RNA, 15 nt, Homo sapiens
gaauaugaauggauu

SEQ ID NO: 1541541 - RNA, 15 nt, Homo sapiens
gaauauuauacuucu

SEQ ID NO: 1541542 - RNA, 11 nt, Homo sapiens
gaaugugauuu

SEQ ID NO: 1541543 - RNA, 14 nt, Homo sapiens
gacaaaauugcuga

SEQ ID NO: 1541544 - RNA, 16 nt, Homo sapiens
gacaagcauguugauu

SEQ ID NO: 1541545 - RNA, 22 nt, Homo sapiens
gacaaguuuaaaggcuguguca

SEQ ID NO: 1541546 - RNA, 20 nt, Homo sapiens
gacaauuagauaaaugucca

SEQ ID NO: 1541547 - RNA, 11 nt, Homo sapiens
gacacaacuca

SEQ ID NO: 1541548 - RNA, 20 nt, Homo sapiens
gacacagaggacggcuuccc

SEQ ID NO: 1541549 - RNA, 12 nt, Homo sapiens
gacagcuucccc

SEQ ID NO: 1541550 - RNA, 19 nt, Homo sapiens
gacagucuggaggucccag

SEQ ID NO: 1541551 - RNA, 19 nt, Homo sapiens
gacaucccccuccuugccg

SEQ ID NO: 1541552 - RNA, 21 nt, Homo sapiens
gacaugaaauugagucauuuu

SEQ ID NO: 1541553 - RNA, 16 nt, Homo sapiens
gacaugcugcccaccc

SEQ ID NO: 1541554 - RNA, 13 nt, Homo sapiens
gacauugaacuga

SEQ ID NO: 1541555 - RNA, 23 nt, Homo sapiens
gaccacacuuccuguccagagag

SEQ ID NO: 1541556 - RNA, 21 nt, Homo sapiens
gaccacagcagggauugggau

SEQ ID NO: 1541557 - RNA, 17 nt, Homo sapiens
gacccauguucucaaua

SEQ ID NO: 1541558 - RNA, 23 nt, Homo sapiens
gacccuaaauguggacaucauga

SEQ ID NO: 1541559 - RNA, 15 nt, Homo sapiens
gacccucaaugccaa

SEQ ID NO: 1541560 - RNA, 18 nt, Homo sapiens
gacccugaggguuuccac

SEQ ID NO: 1541561 - RNA, 14 nt, Homo sapiens
gaccucaacaaaga

SEQ ID NO: 1541562 - RNA, 20 nt, Homo sapiens
gaccuccucccaagcacuuc

SEQ ID NO: 1541563 - RNA, 20 nt, Homo sapiens
gacgguagagagaaacagcu

SEQ ID NO: 1541564 - RNA, 16 nt, Homo sapiens
gacuaaaccauugugc

SEQ ID NO: 1541565 - RNA, 19 nt, Homo sapiens
gacuagaacacaaauccaa

SEQ ID NO: 1541566 - RNA, 13 nt, Homo sapiens
gacucacuguggg

SEQ ID NO: 1541567 - RNA, 19 nt, Homo sapiens
gacuccaggagaggagcgg

SEQ ID NO: 1541568 - RNA, 21 nt, Homo sapiens
gacucucacgauaugcaaguu

SEQ ID NO: 1541569 - RNA, 16 nt, Homo sapiens
gacucuguggggccac

SEQ ID NO: 1541570 - RNA, 13 nt, Homo sapiens
gacugagcuugau

SEQ ID NO: 1541571 - RNA, 18 nt, Homo sapiens
gacuguccuacaauauca

SEQ ID NO: 1541572 - RNA, 15 nt, Homo sapiens
gacugugacacagcu

SEQ ID NO: 1541573 - RNA, 13 nt, Homo sapiens
gacuucagacucu

SEQ ID NO: 1541574 - RNA, 23 nt, Homo sapiens
gacuucugaagggccccuugcaa

SEQ ID NO: 1541575 - RNA, 21 nt, Homo sapiens
gacuucuuuacuaacacuggc

SEQ ID NO: 1541576 - RNA, 12 nt, Homo sapiens
gacuugaugaau

SEQ ID NO: 1541577 - RNA, 16 nt, Homo sapiens
gacuuugccacaucca

SEQ ID NO: 1541578 - RNA, 14 nt, Homo sapiens
gagaaaagccagau

SEQ ID NO: 1541579 - RNA, 16 nt, Homo sapiens
gagaacagggaugcua

SEQ ID NO: 1541580 - RNA, 12 nt, Homo sapiens
gagaagccucau

SEQ ID NO: 1541581 - RNA, 17 nt, Homo sapiens
gagaaugccuaggccag

SEQ ID NO: 1541582 - RNA, 23 nt, Homo sapiens
gagacaagaaauccuaguggccu

SEQ ID NO: 1541583 - RNA, 21 nt, Homo sapiens
gagacuaugugucaugauuuc

SEQ ID NO: 1541584 - RNA, 21 nt, Homo sapiens
gagacugucucaagagggcac

SEQ ID NO: 1541585 - RNA, 14 nt, Homo sapiens
gagaggaagccacg

SEQ ID NO: 1541586 - RNA, 13 nt, Homo sapiens
gagaguucucaca

SEQ ID NO: 1541587 - RNA, 22 nt, Homo sapiens
gagauugcucuggggcuugcua

SEQ ID NO: 1541588 - RNA, 20 nt, Homo sapiens
gagccucgccccuccagugu

SEQ ID NO: 1541589 - RNA, 21 nt, Homo sapiens
gagccucgccccuccaguguu

SEQ ID NO: 1541590 - RNA, 13 nt, Homo sapiens
gagcuccacagaa

SEQ ID NO: 1541591 - RNA, 17 nt, Homo sapiens
gagcugaggacucucac

SEQ ID NO: 1541592 - RNA, 11 nt, Homo sapiens
gagcuugacuu

SEQ ID NO: 1541593 - RNA, 18 nt, Homo sapiens
gagcuuuacagugccacg

SEQ ID NO: 1541594 - RNA, 23 nt, Homo sapiens
gaggaaaauaguggcaggacugu

SEQ ID NO: 1541595 - RNA, 21 nt, Homo sapiens
gaggaacggaucagaugucua

SEQ ID NO: 1541596 - RNA, 15 nt, Homo sapiens
gaggacagaaccaac

SEQ ID NO: 1541597 - RNA, 21 nt, Homo sapiens
gaggacagggagggaacagac

SEQ ID NO: 1541598 - RNA, 18 nt, Homo sapiens
gaggacgugaagccuccc

SEQ ID NO: 1541599 - RNA, 18 nt, Homo sapiens
gaggacucucacgauaug

SEQ ID NO: 1541600 - RNA, 22 nt, Homo sapiens
gaggagcgggaccuguggcucu

SEQ ID NO: 1541601 - RNA, 15 nt, Homo sapiens
gaggcaguggcagca

SEQ ID NO: 1541602 - RNA, 21 nt, Homo sapiens
gaggcucuaauguacaauaaa

SEQ ID NO: 1541603 - RNA, 15 nt, Homo sapiens
gaggcucuaauucuc

SEQ ID NO: 1541604 - RNA, 18 nt, Homo sapiens
gagggcagaggugaucac

SEQ ID NO: 1541605 - RNA, 20 nt, Homo sapiens
gaggggagaggaagcacaag

SEQ ID NO: 1541606 - RNA, 18 nt, Homo sapiens
gagggugcagggaccaag

SEQ ID NO: 1541607 - RNA, 21 nt, Homo sapiens
gagguguuuaacggcacugug

SEQ ID NO: 1541608 - RNA, 15 nt, Homo sapiens
gagucagccccacuc

SEQ ID NO: 1541609 - RNA, 13 nt, Homo sapiens
gagucaugaugaa

SEQ ID NO: 1541610 - RNA, 22 nt, Homo sapiens
gagugauuuuggccacacuguc

SEQ ID NO: 1541611 - RNA, 23 nt, Homo sapiens
gagugauuuuggccacacuguca

SEQ ID NO: 1541612 - RNA, 13 nt, Homo sapiens
gagugcacagcug

SEQ ID NO: 1541613 - RNA, 19 nt, Homo sapiens
gaguuguuuaaacagucaa

SEQ ID NO: 1541614 - RNA, 21 nt, Homo sapiens
gauaaaucaguuaugucaauu

SEQ ID NO: 1541615 - RNA, 18 nt, Homo sapiens
gauaaauucuuucuuuga

SEQ ID NO: 1541616 - RNA, 18 nt, Homo sapiens
gauaaauuugacuguuau

SEQ ID NO: 1541617 - RNA, 20 nt, Homo sapiens
gauaagccugaaacagccuc

SEQ ID NO: 1541618 - RNA, 22 nt, Homo sapiens
gauagaauaaagccuugugauc

SEQ ID NO: 1541619 - RNA, 15 nt, Homo sapiens
gauagauaaugccuu

SEQ ID NO: 1541620 - RNA, 14 nt, Homo sapiens
gauaucucaucucu

SEQ ID NO: 1541621 - RNA, 16 nt, Homo sapiens
gauauucauacuuucc

SEQ ID NO: 1541622 - RNA, 22 nt, Homo sapiens
gaucaugguuuagggugaucag

SEQ ID NO: 1541623 - RNA, 18 nt, Homo sapiens
gaucuaaaaggaggacag

SEQ ID NO: 1541624 - RNA, 12 nt, Homo sapiens
gaucugcagcuc

SEQ ID NO: 1541625 - RNA, 18 nt, Homo sapiens
gaucugcagcucccagaa

SEQ ID NO: 1541626 - RNA, 17 nt, Homo sapiens
gaucuuggggugcagca

SEQ ID NO: 1541627 - RNA, 20 nt, Homo sapiens
gaucuuggggugcagcacuu

SEQ ID NO: 1541628 - RNA, 19 nt, Homo sapiens
gaugaaaaccacccuauca

SEQ ID NO: 1541629 - RNA, 22 nt, Homo sapiens
gaugcuggucauccugggcaug

SEQ ID NO: 1541630 - RNA, 22 nt, Homo sapiens
gaugggucacuuguccucaguu

SEQ ID NO: 1541631 - RNA, 20 nt, Homo sapiens
gauggguuuuguuaggggug

SEQ ID NO: 1541632 - RNA, 23 nt, Homo sapiens
gauguagguuauuaugauuagcu

SEQ ID NO: 1541633 - RNA, 14 nt, Homo sapiens
gaugucaagcuggc

SEQ ID NO: 1541634 - RNA, 13 nt, Homo sapiens
gauuagcuuuguc

SEQ ID NO: 1541635 - RNA, 23 nt, Homo sapiens
gauuaucgacaucuuugaagcug

SEQ ID NO: 1541636 - RNA, 16 nt, Homo sapiens
gauucaaaugcaugau

SEQ ID NO: 1541637 - RNA, 17 nt, Homo sapiens
gauucauggcuuuaaca

SEQ ID NO: 1541638 - RNA, 17 nt, Homo sapiens
gauuccccuggacauau

SEQ ID NO: 1541639 - RNA, 16 nt, Homo sapiens
gauucuaaaacauucu

SEQ ID NO: 1541640 - RNA, 18 nt, Homo sapiens
gauucuaaaggggacaga

SEQ ID NO: 1541641 - RNA, 18 nt, Homo sapiens
gauucuaaauuaugugaa

SEQ ID NO: 1541642 - RNA, 23 nt, Homo sapiens
gauucuagguugaaaauguuaua

SEQ ID NO: 1541643 - RNA, 17 nt, Homo sapiens
gauugaaggauugugaa

SEQ ID NO: 1541644 - RNA, 22 nt, Homo sapiens
gauugguaccagagccuaugga

SEQ ID NO: 1541645 - RNA, 19 nt, Homo sapiens
gauugugaccuccagaggu

SEQ ID NO: 1541646 - RNA, 14 nt, Homo sapiens
gauuuaagcauuuu

SEQ ID NO: 1541647 - RNA, 20 nt, Homo sapiens
gauuuccauuugcaacagga

SEQ ID NO: 1541648 - RNA, 13 nt, Homo sapiens
gauuugcaacuuu

SEQ ID NO: 1541649 - RNA, 20 nt, Homo sapiens
gauuugcacccaugccauag

SEQ ID NO: 1541650 - RNA, 13 nt, Homo sapiens
gauuuuuacacau

SEQ ID NO: 1541651 - RNA, 18 nt, Homo sapiens
gcaaaagguuaagccaua

SEQ ID NO: 1541652 - RNA, 12 nt, Homo sapiens
gcaaaguaauag

SEQ ID NO: 1541653 - RNA, 15 nt, Homo sapiens
gcaaaguaguacuuc

SEQ ID NO: 1541654 - RNA, 20 nt, Homo sapiens
gcaaccucggggagugccac

SEQ ID NO: 1541655 - RNA, 16 nt, Homo sapiens
gcaagcaccugggugu

SEQ ID NO: 1541656 - RNA, 14 nt, Homo sapiens
gcaagucccaugau

SEQ ID NO: 1541657 - RNA, 18 nt, Homo sapiens
gcaagucccaugauuucu

SEQ ID NO: 1541658 - RNA, 17 nt, Homo sapiens
gcaauggugaacuguca

SEQ ID NO: 1541659 - RNA, 15 nt, Homo sapiens
gcacaaauuguacau

SEQ ID NO: 1541660 - RNA, 15 nt, Homo sapiens
gcacacaccugcaca

SEQ ID NO: 1541661 - RNA, 14 nt, Homo sapiens
gcacagcaucucag

SEQ ID NO: 1541662 - RNA, 12 nt, Homo sapiens
gcacagccagaa

SEQ ID NO: 1541663 - RNA, 15 nt, Homo sapiens
gcacauccaggcaau

SEQ ID NO: 1541664 - RNA, 17 nt, Homo sapiens
gcaccuacuuacaugca

SEQ ID NO: 1541665 - RNA, 17 nt, Homo sapiens
guguuuugcaagggaau

SEQ ID NO: 1541666 - RNA, 15 nt, Homo sapiens
guuaauggucaaugc

SEQ ID NO: 1541667 - RNA, 23 nt, Homo sapiens
guuaauggucaaugcuagcacaa

SEQ ID NO: 1541668 - RNA, 16 nt, Homo sapiens
guuagauucacuuuga

SEQ ID NO: 1541669 - RNA, 22 nt, Homo sapiens
guucaggaggagacagucagga

SEQ ID NO: 1541670 - RNA, 21 nt, Homo sapiens
guuccacauauauuuccacuu

SEQ ID NO: 1541671 - RNA, 21 nt, Homo sapiens
guucccacucccucucuugcc

SEQ ID NO: 1541672 - RNA, 22 nt, Homo sapiens
guucccacucccucucuugccg

SEQ ID NO: 1541673 - RNA, 19 nt, Homo sapiens
guucccagcaaaguuuuca

SEQ ID NO: 1541674 - RNA, 19 nt, Homo sapiens
guuccuggcucagccucaa

SEQ ID NO: 1541675 - RNA, 21 nt, Homo sapiens
guucucagagcuccacagaag

SEQ ID NO: 1541676 - RNA, 14 nt, Homo sapiens
guucugauaaugaa

SEQ ID NO: 1541677 - RNA, 19 nt, Homo sapiens
guucuuagcugaacaauga

SEQ ID NO: 1541678 - RNA, 12 nt, Homo sapiens
guugaguuugcu

SEQ ID NO: 1541679 - RNA, 19 nt, Homo sapiens
guugauaaaaagaaaguuu

SEQ ID NO: 1541680 - RNA, 16 nt, Homo sapiens
guugcacagcaucuca

SEQ ID NO: 1541681 - RNA, 19 nt, Homo sapiens
guuggcucacaucauguaa

SEQ ID NO: 1541682 - RNA, 15 nt, Homo sapiens
guugucacaccugaa

SEQ ID NO: 1541683 - RNA, 17 nt, Homo sapiens
guugugucuugcuauac

SEQ ID NO: 1541684 - RNA, 22 nt, Homo sapiens
guuuaaaaaucaguuuguuguu

SEQ ID NO: 1541685 - RNA, 22 nt, Homo sapiens
guuuaacugggagugauaugau

SEQ ID NO: 1541686 - RNA, 15 nt, Homo sapiens
guuuaagguucuugc

SEQ ID NO: 1541687 - RNA, 18 nt, Homo sapiens
guuuagugugauugugaa

SEQ ID NO: 1541688 - RNA, 14 nt, Homo sapiens
guuuauccuuaaga

SEQ ID NO: 1541689 - RNA, 22 nt, Homo sapiens
guuucaacuguaaaauacuucu

SEQ ID NO: 1541690 - RNA, 13 nt, Homo sapiens
guuucacauauuu

SEQ ID NO: 1541691 - RNA, 14 nt, Homo sapiens
guuucacuguucau

SEQ ID NO: 1541692 - RNA, 14 nt, Homo sapiens
guuucugucuguaa

SEQ ID NO: 1541693 - RNA, 17 nt, Homo sapiens
guuugaauuacagggaa

SEQ ID NO: 1541694 - RNA, 19 nt, Homo sapiens
guuugauucugaguauuca

SEQ ID NO: 1541695 - RNA, 20 nt, Homo sapiens
guuugcaaucuuauguugau

SEQ ID NO: 1541696 - RNA, 16 nt, Homo sapiens
guuugccucugcacgu

SEQ ID NO: 1541697 - RNA, 13 nt, Homo sapiens
guuuguguuugaa

SEQ ID NO: 1541698 - RNA, 20 nt, Homo sapiens
guuuguuuucaaaauacuuc

SEQ ID NO: 1541699 - RNA, 22 nt, Homo sapiens
guuuucuuuuucugucuuguag

SEQ ID NO: 1541700 - RNA, 23 nt, Homo sapiens
guuuuuuuuuuccacuuagaaau

SEQ ID NO: 1541701 - RNA, 23 nt, Homo sapiens
uaaaaagaaagugagcaguguua

SEQ ID NO: 1541702 - RNA, 13 nt, Homo sapiens
uaaaaagguuuaa

SEQ ID NO: 1541703 - RNA, 17 nt, Homo sapiens
uaaaaaguuaaucuuca

SEQ ID NO: 1541704 - RNA, 23 nt, Homo sapiens
uaaaacauuauagauuuucaugu

SEQ ID NO: 1541705 - RNA, 22 nt, Homo sapiens
uaaaaccaucaaaaauauucca

SEQ ID NO: 1541706 - RNA, 14 nt, Homo sapiens
uaaaaccuuacuua

SEQ ID NO: 1541707 - RNA, 22 nt, Homo sapiens
uaaaaccuuacuuaaagcuugu

SEQ ID NO: 1541708 - RNA, 16 nt, Homo sapiens
uaaaagaaacuguggu

SEQ ID NO: 1541709 - RNA, 22 nt, Homo sapiens
uaaaagauaaguguguuugcaa

SEQ ID NO: 1541710 - RNA, 16 nt, Homo sapiens
uaaaagcccuuuccaa

SEQ ID NO: 1541711 - RNA, 13 nt, Homo sapiens
uaaaagcuaucuu

SEQ ID NO: 1541712 - RNA, 20 nt, Homo sapiens
uaaaauccaagcugcucauu

SEQ ID NO: 1541713 - RNA, 17 nt, Homo sapiens
uaaaauuuugcaugugc

SEQ ID NO: 1541714 - RNA, 20 nt, Homo sapiens
uaaacaauaaaaguguccau

SEQ ID NO: 1541715 - RNA, 21 nt, Homo sapiens
uaaacaauaaaaguguccauu

SEQ ID NO: 1541716 - RNA, 18 nt, Homo sapiens
uaaacaguugcacagcau

SEQ ID NO: 1541717 - RNA, 15 nt, Homo sapiens
uaaaccagacucacu

SEQ ID NO: 1541718 - RNA, 19 nt, Homo sapiens
uaaaccauugugcauucua

SEQ ID NO: 1541719 - RNA, 16 nt, Homo sapiens
uaaagaggcgucuugu

SEQ ID NO: 1541720 - RNA, 15 nt, Homo sapiens
uaaagcaauguggua

SEQ ID NO: 1541721 - RNA, 14 nt, Homo sapiens
uaaaggcuguguca

SEQ ID NO: 1541722 - RNA, 11 nt, Homo sapiens
uaaagguuuau

SEQ ID NO: 1541723 - RNA, 16 nt, Homo sapiens
uaaaguuccaugaaga

SEQ ID NO: 1541724 - RNA, 15 nt, Homo sapiens
uaaauaacagugugu

SEQ ID NO: 1541725 - RNA, 16 nt, Homo sapiens
uaaauauauauuuauc

SEQ ID NO: 1541726 - RNA, 23 nt, Homo sapiens
uaaaucgcauuaaugaaauacca

SEQ ID NO: 1541727 - RNA, 15 nt, Homo sapiens
uaaaucuuccaaagu

SEQ ID NO: 1541728 - RNA, 19 nt, Homo sapiens
uaaaugaggggccucaggu

SEQ ID NO: 1541729 - RNA, 16 nt, Homo sapiens
uaaauggugagaauua

SEQ ID NO: 1541730 - RNA, 11 nt, Homo sapiens
uaaaugugauu

SEQ ID NO: 1541731 - RNA, 12 nt, Homo sapiens
uaaauguuaaag

SEQ ID NO: 1541732 - RNA, 19 nt, Homo sapiens
uaaauuaaugaguuuuauc

SEQ ID NO: 1541733 - RNA, 16 nt, Homo sapiens
uaaauuuaacugcaua

SEQ ID NO: 1541734 - RNA, 19 nt, Homo sapiens
uaacaagccuuggaccaaa

SEQ ID NO: 1541735 - RNA, 17 nt, Homo sapiens
uaacaauagguauuucu

SEQ ID NO: 1541736 - RNA, 17 nt, Homo sapiens
uaaccugaauuauucca

SEQ ID NO: 1541737 - RNA, 12 nt, Homo sapiens
uaacggcacugu

SEQ ID NO: 1541738 - RNA, 15 nt, Homo sapiens
uaacuccguuuccaa

SEQ ID NO: 1541739 - RNA, 13 nt, Homo sapiens
uaacuguuacagu

SEQ ID NO: 1541740 - RNA, 19 nt, Homo sapiens
uaacuuuaccaugcucaau

SEQ ID NO: 1541741 - RNA, 22 nt, Homo sapiens
uaagaccuccucccaagcacuu

SEQ ID NO: 1541742 - RNA, 17 nt, Homo sapiens
uaagaguagauugauuc

SEQ ID NO: 1541743 - RNA, 18 nt, Homo sapiens
uaagaguagauugauuca

SEQ ID NO: 1541744 - RNA, 16 nt, Homo sapiens
uaagcaacaugaauua

SEQ ID NO: 1541745 - RNA, 22 nt, Homo sapiens
uaagccugaaacagccucucca

SEQ ID NO: 1541746 - RNA, 22 nt, Homo sapiens
uaaggcauccacuucacaguuc

SEQ ID NO: 1541747 - RNA, 13 nt, Homo sapiens
uaagucuaucugg

SEQ ID NO: 1541748 - RNA, 20 nt, Homo sapiens
uaauaaaaaucaugcuuaua

SEQ ID NO: 1541749 - RNA, 13 nt, Homo sapiens
uaauauacauaac

SEQ ID NO: 1541750 - RNA, 21 nt, Homo sapiens
uaauaugcuuauauuguucac

SEQ ID NO: 1541751 - RNA, 21 nt, Homo sapiens
uaauauuucuucaaauaucuc

SEQ ID NO: 1541752 - RNA, 17 nt, Homo sapiens
uaauccaggacagcauu

SEQ ID NO: 1541753 - RNA, 18 nt, Homo sapiens
uaauccaggacagcauua

SEQ ID NO: 1541754 - RNA, 12 nt, Homo sapiens
uaauccaugugc

SEQ ID NO: 1541755 - RNA, 18 nt, Homo sapiens
uaaucccaauuuccccug

SEQ ID NO: 1541756 - RNA, 11 nt, Homo sapiens
uaaugauacug

SEQ ID NO: 1541757 - RNA, 13 nt, Homo sapiens
uaaugccacggca

SEQ ID NO: 1541758 - RNA, 16 nt, Homo sapiens
uaauguaaaauucaua

SEQ ID NO: 1541759 - RNA, 14 nt, Homo sapiens
uaauguacaauaaa

SEQ ID NO: 1541760 - RNA, 21 nt, Homo sapiens
uaauguacaauaaagcaaugu

SEQ ID NO: 1541761 - RNA, 16 nt, Homo sapiens
uaauguauaaugggaa

SEQ ID NO: 1541762 - RNA, 20 nt, Homo sapiens
uaauguggcagcugucucaa

SEQ ID NO: 1541763 - RNA, 18 nt, Homo sapiens
uaauguuccaugucugaa

SEQ ID NO: 1541764 - RNA, 15 nt, Homo sapiens
uaauuggcaugaagg

SEQ ID NO: 1541765 - RNA, 19 nt, Homo sapiens
uaauuguuacaauuuucua

SEQ ID NO: 1541766 - RNA, 21 nt, Homo sapiens
uacaauaaagcaaugugguag

SEQ ID NO: 1541767 - RNA, 16 nt, Homo sapiens
uacacaaaccugaaaa

SEQ ID NO: 1541768 - RNA, 21 nt, Homo sapiens
uacacauguaucuaugcauuu

SEQ ID NO: 1541769 - RNA, 23 nt, Homo sapiens
uacacccaauuuuaaaaaauaac

SEQ ID NO: 1541770 - RNA, 16 nt, Homo sapiens
uacacguggaggaaug

SEQ ID NO: 1541771 - RNA, 19 nt, Homo sapiens
uacagaaugaaucccauaa

SEQ ID NO: 1541772 - RNA, 21 nt, Homo sapiens
uacaguguaucucgaagucuu

SEQ ID NO: 1541773 - RNA, 13 nt, Homo sapiens
uacauagucuuug

SEQ ID NO: 1541774 - RNA, 20 nt, Homo sapiens
uacauauggaaauccuguua

SEQ ID NO: 1541775 - RNA, 20 nt, Homo sapiens
uacaugcauuacugcaugca

SEQ ID NO: 1541776 - RNA, 20 nt, Homo sapiens
uacaugccuuuccagugcug

SEQ ID NO: 1541777 - RNA, 17 nt, Homo sapiens
uacaugguuuaaaguca

SEQ ID NO: 1541778 - RNA, 12 nt, Homo sapiens
uacauucuucaa

SEQ ID NO: 1541779 - RNA, 13 nt, Homo sapiens
uacauucuucaag

SEQ ID NO: 1541780 - RNA, 21 nt, Homo sapiens
uacauuuggcuccacuguaaa

SEQ ID NO: 1541781 - RNA, 23 nt, Homo sapiens
uaccaacugagccaaaaacaaua

SEQ ID NO: 1541782 - RNA, 15 nt, Homo sapiens
uaccagagcacagau

SEQ ID NO: 1541783 - RNA, 18 nt, Homo sapiens
uaccccaggaugcaugca

SEQ ID NO: 1541784 - RNA, 18 nt, Homo sapiens
uacccccugccccagaga

SEQ ID NO: 1541785 - RNA, 23 nt, Homo sapiens
uaccuaugugugugcuuugccac

SEQ ID NO: 1541786 - RNA, 23 nt, Homo sapiens
uaccuccauguuucuaaguaaua

SEQ ID NO: 1541787 - RNA, 15 nt, Homo sapiens
uaccugaaaauucaa

SEQ ID NO: 1541788 - RNA, 18 nt, Homo sapiens
uaccugaaaauucaacau

SEQ ID NO: 1541789 - RNA, 23 nt, Homo sapiens
uaccuguuaguauuauuguugca

SEQ ID NO: 1541790 - RNA, 12 nt, Homo sapiens
uacuaacacugg

SEQ ID NO: 1541791 - RNA, 14 nt, Homo sapiens
uacuacaugcacuu

SEQ ID NO: 1541792 - RNA, 22 nt, Homo sapiens
uacuaccccagaacgcaugcag

SEQ ID NO: 1541793 - RNA, 12 nt, Homo sapiens
uacuaccccagg

SEQ ID NO: 1541794 - RNA, 22 nt, Homo sapiens
uacuaccccaggacgcaugcag

SEQ ID NO: 1541795 - RNA, 16 nt, Homo sapiens
uacuccaugcacauag

SEQ ID NO: 1541796 - RNA, 18 nt, Homo sapiens
gccccaggggcacugugu

SEQ ID NO: 1541797 - RNA, 21 nt, Homo sapiens
gccccaugaguuugccauguu

SEQ ID NO: 1541798 - RNA, 14 nt, Homo sapiens
gcccccaccagcag

SEQ ID NO: 1541799 - RNA, 17 nt, Homo sapiens
gcccccagcugcuccuc

SEQ ID NO: 1541800 - RNA, 14 nt, Homo sapiens
gccccccuucccac

SEQ ID NO: 1541801 - RNA, 20 nt, Homo sapiens
gccccucagugguuuccucg

SEQ ID NO: 1541802 - RNA, 20 nt, Homo sapiens
gccccucucuguuuacccuc

SEQ ID NO: 1541803 - RNA, 22 nt, Homo sapiens
gccccuucugaggaugcugaga

SEQ ID NO: 1541804 - RNA, 16 nt, Homo sapiens
gcccggggcagcugcc

SEQ ID NO: 1541805 - RNA, 18 nt, Homo sapiens
gcccuaggaggagaacuu

SEQ ID NO: 1541806 - RNA, 18 nt, Homo sapiens
gcccucaacccugugauc

SEQ ID NO: 1541807 - RNA, 17 nt, Homo sapiens
gcccucccccugccaga

SEQ ID NO: 1541808 - RNA, 16 nt, Homo sapiens
gcccucccucccucca

SEQ ID NO: 1541809 - RNA, 14 nt, Homo sapiens
gcccugaccaugca

SEQ ID NO: 1541810 - RNA, 16 nt, Homo sapiens
gcccugggguuuccac

SEQ ID NO: 1541811 - RNA, 15 nt, Homo sapiens
gcccuggugcugcca

SEQ ID NO: 1541812 - RNA, 16 nt, Homo sapiens
gcccuucccugacacu

SEQ ID NO: 1541813 - RNA, 18 nt, Homo sapiens
gcccuuccucuccacugc

SEQ ID NO: 1541814 - RNA, 22 nt, Homo sapiens
gccguuagggaaauccaacucc

SEQ ID NO: 1541815 - RNA, 16 nt, Homo sapiens
gccuccccaacccugc

SEQ ID NO: 1541816 - RNA, 10 nt, Homo sapiens
gccucugggc

SEQ ID NO: 1541817 - RNA, 18 nt, Homo sapiens
gccugaaggcuauccacu

SEQ ID NO: 1541818 - RNA, 13 nt, Homo sapiens
gccugauggccag

SEQ ID NO: 1541819 - RNA, 16 nt, Homo sapiens
gccugcucccuagcca

SEQ ID NO: 1541820 - RNA, 21 nt, Homo sapiens
gccuggaaagcccuucggaga

SEQ ID NO: 1541821 - RNA, 20 nt, Homo sapiens
gccuggcagccgugccuuca

SEQ ID NO: 1541822 - RNA, 19 nt, Homo sapiens
gccugugaucguguguugc

SEQ ID NO: 1541823 - RNA, 13 nt, Homo sapiens
gccuuccuggguu

SEQ ID NO: 1541824 - RNA, 18 nt, Homo sapiens
gccuucucuguucauuuc

SEQ ID NO: 1541825 - RNA, 14 nt, Homo sapiens
gccuugccaugucu

SEQ ID NO: 1541826 - RNA, 15 nt, Homo sapiens
gccuuugcugccuuc

SEQ ID NO: 1541827 - RNA, 13 nt, Homo sapiens
gcgaggacgugaa

SEQ ID NO: 1541828 - RNA, 17 nt, Homo sapiens
gcgggccaaggacugcc

SEQ ID NO: 1541829 - RNA, 17 nt, Homo sapiens
gcuaaccucucugaacu

SEQ ID NO: 1541830 - RNA, 15 nt, Homo sapiens
gcuaagccugaugau

SEQ ID NO: 1541831 - RNA, 13 nt, Homo sapiens
gcuaaggcuuccg

SEQ ID NO: 1541832 - RNA, 12 nt, Homo sapiens
gcuaauguuucc

SEQ ID NO: 1541833 - RNA, 23 nt, Homo sapiens
gcuacacguuggaguauaccuau

SEQ ID NO: 1541834 - RNA, 15 nt, Homo sapiens
gcuagucacauauca

SEQ ID NO: 1541835 - RNA, 22 nt, Homo sapiens
gcucaaaguacuacagcaaagc

SEQ ID NO: 1541836 - RNA, 16 nt, Homo sapiens
gcucacgugucuuuag

SEQ ID NO: 1541837 - RNA, 21 nt, Homo sapiens
gcuccaagagaauucacuuua

SEQ ID NO: 1541838 - RNA, 13 nt, Homo sapiens
gcuccacuguaaa

SEQ ID NO: 1541839 - RNA, 16 nt, Homo sapiens
gcuccagacacacagc

SEQ ID NO: 1541840 - RNA, 21 nt, Homo sapiens
gcuccauaauugcaagggaag

SEQ ID NO: 1541841 - RNA, 17 nt, Homo sapiens
gcucccagggccaugaa

SEQ ID NO: 1541842 - RNA, 22 nt, Homo sapiens
gcuccccaauccaacccaugca

SEQ ID NO: 1541843 - RNA, 13 nt, Homo sapiens
gcucccuagccag

SEQ ID NO: 1541844 - RNA, 16 nt, Homo sapiens
gcuccuaguagcuuuc

SEQ ID NO: 1541845 - RNA, 17 nt, Homo sapiens
gcucguucccccagggg

SEQ ID NO: 1541846 - RNA, 15 nt, Homo sapiens
gcucuaauguacaau

SEQ ID NO: 1541847 - RNA, 19 nt, Homo sapiens
gcucugagcaguuguuaua

SEQ ID NO: 1541848 - RNA, 20 nt, Homo sapiens
gcucugagcaguuguuauau

SEQ ID NO: 1541849 - RNA, 18 nt, Homo sapiens
gcugacuguacuccuccc

SEQ ID NO: 1541850 - RNA, 12 nt, Homo sapiens
gcugaggccaga

SEQ ID NO: 1541851 - RNA, 14 nt, Homo sapiens
gcugcaggaaucaa

SEQ ID NO: 1541852 - RNA, 16 nt, Homo sapiens
gcugcaggaaucaaaa

SEQ ID NO: 1541853 - RNA, 17 nt, Homo sapiens
gcugcagucagcacaga

SEQ ID NO: 1541854 - RNA, 19 nt, Homo sapiens
gcugccaggggcagugaag

SEQ ID NO: 1541855 - RNA, 19 nt, Homo sapiens
gcugccccccauuucugua

SEQ ID NO: 1541856 - RNA, 19 nt, Homo sapiens
gcugcccuucuucuugacc

SEQ ID NO: 1541857 - RNA, 14 nt, Homo sapiens
gcugcucuauugua

SEQ ID NO: 1541858 - RNA, 13 nt, Homo sapiens
gcugcugcacugc

SEQ ID NO: 1541859 - RNA, 22 nt, Homo sapiens
gcugcugcagucagcacagaga

SEQ ID NO: 1541860 - RNA, 18 nt, Homo sapiens
gcuggagcaugagccagc

SEQ ID NO: 1541861 - RNA, 22 nt, Homo sapiens
gcuggaguccuguucucagagc

SEQ ID NO: 1541862 - RNA, 19 nt, Homo sapiens
gcuggcaccgccuucucua

SEQ ID NO: 1541863 - RNA, 17 nt, Homo sapiens
gcuggccagcugugcga

SEQ ID NO: 1541864 - RNA, 14 nt, Homo sapiens
gcugggagagccaa

SEQ ID NO: 1541865 - RNA, 23 nt, Homo sapiens
guagacaucccccuccuugccgc

SEQ ID NO: 1541866 - RNA, 15 nt, Homo sapiens
guagauauuaauuaa

SEQ ID NO: 1541867 - RNA, 20 nt, Homo sapiens
guagaucaacucauguuaau

SEQ ID NO: 1541868 - RNA, 16 nt, Homo sapiens
guaggggaagugugcu

SEQ ID NO: 1541869 - RNA, 16 nt, Homo sapiens
guaggugggucuugga

SEQ ID NO: 1541870 - RNA, 22 nt, Homo sapiens
guauaacaagccaaacauucuu

SEQ ID NO: 1541871 - RNA, 19 nt, Homo sapiens
guauauuuauuucuagcaa

SEQ ID NO: 1541872 - RNA, 16 nt, Homo sapiens
guauccagaggugagg

SEQ ID NO: 1541873 - RNA, 11 nt, Homo sapiens
guauggugcug

SEQ ID NO: 1541874 - RNA, 18 nt, Homo sapiens
guauuaugcaaaguacca

SEQ ID NO: 1541875 - RNA, 19 nt, Homo sapiens
guauucaacuaauacaugg

SEQ ID NO: 1541876 - RNA, 18 nt, Homo sapiens
gucaaccuugugugagug

SEQ ID NO: 1541877 - RNA, 22 nt, Homo sapiens
gucaagagggggcaagucacau

SEQ ID NO: 1541878 - RNA, 21 nt, Homo sapiens
gucacaauaaaagaaacugug

SEQ ID NO: 1541879 - RNA, 18 nt, Homo sapiens
gucacagagagacacggg

SEQ ID NO: 1541880 - RNA, 20 nt, Homo sapiens
gucacagcaguacuugcuca

SEQ ID NO: 1541881 - RNA, 11 nt, Homo sapiens
gucaccuuccu

SEQ ID NO: 1541882 - RNA, 23 nt, Homo sapiens
gucacuagagaaauaaaauaugg

SEQ ID NO: 1541883 - RNA, 19 nt, Homo sapiens
gucagcagggccacugagu

SEQ ID NO: 1541884 - RNA, 19 nt, Homo sapiens
gucaggaggugccugagag

SEQ ID NO: 1541885 - RNA, 13 nt, Homo sapiens
gucauaaugucau

SEQ ID NO: 1541886 - RNA, 18 nt, Homo sapiens
gucauacgaaccuaaaga

SEQ ID NO: 1541887 - RNA, 13 nt, Homo sapiens
gucauucucaccu

SEQ ID NO: 1541888 - RNA, 11 nt, Homo sapiens
guccauuccaa

SEQ ID NO: 1541889 - RNA, 20 nt, Homo sapiens
gucccagugggaggcgcgag

SEQ ID NO: 1541890 - RNA, 15 nt, Homo sapiens
guccccagagcuuua

SEQ ID NO: 1541891 - RNA, 20 nt, Homo sapiens
guccccagccugcucccuag

SEQ ID NO: 1541892 - RNA, 22 nt, Homo sapiens
guccccagccugcucccuagcc

SEQ ID NO: 1541893 - RNA, 13 nt, Homo sapiens
gucccugcagggc

SEQ ID NO: 1541894 - RNA, 14 nt, Homo sapiens
gucgcugugcccug

SEQ ID NO: 1541895 - RNA, 13 nt, Homo sapiens
gucuaaagcuaaa

SEQ ID NO: 1541896 - RNA, 22 nt, Homo sapiens
gucucaaagaccacgugacuuu

SEQ ID NO: 1541897 - RNA, 19 nt, Homo sapiens
gucucauggcagucccaaa

SEQ ID NO: 1541898 - RNA, 19 nt, Homo sapiens
gucuccaccucaggggaga

SEQ ID NO: 1541899 - RNA, 12 nt, Homo sapiens
gucugucuucaa

SEQ ID NO: 1541900 - RNA, 14 nt, Homo sapiens
gugaauuuugccau

SEQ ID NO: 1541901 - RNA, 19 nt, Homo sapiens
gugacaaggccccagagac

SEQ ID NO: 1541902 - RNA, 23 nt, Homo sapiens
gugacaugaacccauccaaugga

SEQ ID NO: 1541903 - RNA, 18 nt, Homo sapiens
gugacaugcggcugccca

SEQ ID NO: 1541904 - RNA, 13 nt, Homo sapiens
gugagcaggguga

SEQ ID NO: 1541905 - RNA, 20 nt, Homo sapiens
gugaggucaucccggggcca

SEQ ID NO: 1541906 - RNA, 16 nt, Homo sapiens
gugauaacacuggagu

SEQ ID NO: 1541907 - RNA, 22 nt, Homo sapiens
gugaucccuagcugugaccucu

SEQ ID NO: 1541908 - RNA, 16 nt, Homo sapiens
gugauugucaccauga

SEQ ID NO: 1541909 - RNA, 17 nt, Homo sapiens
gugauugucaccaugau

SEQ ID NO: 1541910 - RNA, 23 nt, Homo sapiens
gugauuuuucugcacuaauauaa

SEQ ID NO: 1541911 - RNA, 15 nt, Homo sapiens
gugcagugauguggu

SEQ ID NO: 1541912 - RNA, 17 nt, Homo sapiens
gugcccagucaugacau

SEQ ID NO: 1541913 - RNA, 12 nt, Homo sapiens
gugccugugauc

SEQ ID NO: 1541914 - RNA, 22 nt, Homo sapiens
gugcuaauccaggacagcauua

SEQ ID NO: 1541915 - RNA, 14 nt, Homo sapiens
guggcaucaggaaa

SEQ ID NO: 1541916 - RNA, 21 nt, Homo sapiens
guggcaucccaguggccucaa

SEQ ID NO: 1541917 - RNA, 22 nt, Homo sapiens
guggcccucucuuaaugccacg

SEQ ID NO: 1541918 - RNA, 15 nt, Homo sapiens
guggcccuucacugu

SEQ ID NO: 1541919 - RNA, 17 nt, Homo sapiens
guggcuaaaugccuaau

SEQ ID NO: 1541920 - RNA, 20 nt, Homo sapiens
guggcuuucauuucuuauua

SEQ ID NO: 1541921 - RNA, 11 nt, Homo sapiens
gugggccaugg

SEQ ID NO: 1541922 - RNA, 19 nt, Homo sapiens
gugggggccucuuuaccau

SEQ ID NO: 1541923 - RNA, 18 nt, Homo sapiens
guggucugcugccucagg

SEQ ID NO: 1541924 - RNA, 17 nt, Homo sapiens
gugguuuuugagccaug

SEQ ID NO: 1541925 - RNA, 17 nt, Homo sapiens
guguaauuccucccuaa

SEQ ID NO: 1541926 - RNA, 22 nt, Homo sapiens
guguacuaccccaggaugcaug

SEQ ID NO: 1541927 - RNA, 14 nt, Homo sapiens
guguggcuuggaac

SEQ ID NO: 1541928 - RNA, 13 nt, Homo sapiens
guguguccaugca

SEQ ID NO: 1541929 - RNA, 21 nt, Homo sapiens
guguugaugacucacucauaa

SEQ ID NO: 1541930 - RNA, 12 nt, Homo sapiens
guguugcaaauu

SEQ ID NO: 1541931 - RNA, 22 nt, Homo sapiens
uccgacaaccgaugcuccagcc

SEQ ID NO: 1541932 - RNA, 19 nt, Homo sapiens
uccggaaagccuuccucaa

SEQ ID NO: 1541933 - RNA, 20 nt, Homo sapiens
uccggaaagccuuccucaag

SEQ ID NO: 1541934 - RNA, 14 nt, Homo sapiens
uccgugagccucag

SEQ ID NO: 1541935 - RNA, 18 nt, Homo sapiens
uccuaguagcuuuccucc

SEQ ID NO: 1541936 - RNA, 15 nt, Homo sapiens
uccucaaaaaucauc

SEQ ID NO: 1541937 - RNA, 20 nt, Homo sapiens
uccucauuuauacuauuauu

SEQ ID NO: 1541938 - RNA, 18 nt, Homo sapiens
uccuccaguucugaugag

SEQ ID NO: 1541939 - RNA, 12 nt, Homo sapiens
uccucccauuca

SEQ ID NO: 1541940 - RNA, 14 nt, Homo sapiens
uccuccuucacucc

SEQ ID NO: 1541941 - RNA, 16 nt, Homo sapiens
uccucuccacugccuu

SEQ ID NO: 1541942 - RNA, 12 nt, Homo sapiens
uccucuuaccug

SEQ ID NO: 1541943 - RNA, 12 nt, Homo sapiens
uccucuucccug

SEQ ID NO: 1541944 - RNA, 11 nt, Homo sapiens
uccucuuucac

SEQ ID NO: 1541945 - RNA, 17 nt, Homo sapiens
uccugacaaaagggaca

SEQ ID NO: 1541946 - RNA, 13 nt, Homo sapiens
uccugcacugucc

SEQ ID NO: 1541947 - RNA, 13 nt, Homo sapiens
uccugcaucccuc

SEQ ID NO: 1541948 - RNA, 20 nt, Homo sapiens
uccugggggcugcugcacug

SEQ ID NO: 1541949 - RNA, 13 nt, Homo sapiens
uccuguuacuuaa

SEQ ID NO: 1541950 - RNA, 22 nt, Homo sapiens
uccuguucucagagcuccacag

SEQ ID NO: 1541951 - RNA, 15 nt, Homo sapiens
uccuguuugauguga

SEQ ID NO: 1541952 - RNA, 20 nt, Homo sapiens
uccuuaccgugggcacugaa

SEQ ID NO: 1541953 - RNA, 17 nt, Homo sapiens
uccuuagaauacuguau

SEQ ID NO: 1541954 - RNA, 20 nt, Homo sapiens
uccuugaggaccuccaccug

SEQ ID NO: 1541955 - RNA, 20 nt, Homo sapiens
ucggggcaggaagucccuga

SEQ ID NO: 1541956 - RNA, 13 nt, Homo sapiens
ucuaaaacauucu

SEQ ID NO: 1541957 - RNA, 13 nt, Homo sapiens
ucuaaaucauaua

SEQ ID NO: 1541958 - RNA, 13 nt, Homo sapiens
ucuaacgcuuuaa

SEQ ID NO: 1541959 - RNA, 13 nt, Homo sapiens
ucuaauguacaau

SEQ ID NO: 1541960 - RNA, 14 nt, Homo sapiens
ucuaauguacaaua

SEQ ID NO: 1541961 - RNA, 16 nt, Homo sapiens
ucuaccuggucucucc

SEQ ID NO: 1541962 - RNA, 18 nt, Homo sapiens
ucuacugagacaugacua

SEQ ID NO: 1541963 - RNA, 21 nt, Homo sapiens
ucuacugcuuggauccauaca

SEQ ID NO: 1541964 - RNA, 20 nt, Homo sapiens
ucuaguauuccagaccugaa

SEQ ID NO: 1541965 - RNA, 14 nt, Homo sapiens
ucuauauaguguau

SEQ ID NO: 1541966 - RNA, 21 nt, Homo sapiens
ucuauauuauauaaauaguau

SEQ ID NO: 1541967 - RNA, 21 nt, Homo sapiens
ucuauauugcugaaugcaaga

SEQ ID NO: 1541968 - RNA, 15 nt, Homo sapiens
ucuauuucaacuuca

SEQ ID NO: 1541969 - RNA, 17 nt, Homo sapiens
ucucaaaccuccaaaag

SEQ ID NO: 1541970 - RNA, 16 nt, Homo sapiens
ucucaacuuacauaug

SEQ ID NO: 1541971 - RNA, 17 nt, Homo sapiens
ucucacaaauaaguaau

SEQ ID NO: 1541972 - RNA, 19 nt, Homo sapiens
ucucacaaauaaguaauau

SEQ ID NO: 1541973 - RNA, 11 nt, Homo sapiens
ucucacugugu

SEQ ID NO: 1541974 - RNA, 12 nt, Homo sapiens
ucucagcacuuu

SEQ ID NO: 1541975 - RNA, 18 nt, Homo sapiens
ucucaggugcgugccaca

SEQ ID NO: 1541976 - RNA, 15 nt, Homo sapiens
ucucaugcuccuuaa

SEQ ID NO: 1541977 - RNA, 21 nt, Homo sapiens
ucuccagggguuuacagugaa

SEQ ID NO: 1541978 - RNA, 23 nt, Homo sapiens
ucucuaaaauucuagucucugau

SEQ ID NO: 1541979 - RNA, 16 nt, Homo sapiens
ucucugaaccagagaa

SEQ ID NO: 1541980 - RNA, 14 nt, Homo sapiens
ucucugaacugcaa

SEQ ID NO: 1541981 - RNA, 17 nt, Homo sapiens
ucucugaucacaacuuu

SEQ ID NO: 1541982 - RNA, 11 nt, Homo sapiens
ucucuguaaaa

SEQ ID NO: 1541983 - RNA, 19 nt, Homo sapiens
ucucuucuacaauuguggu

SEQ ID NO: 1541984 - RNA, 19 nt, Homo sapiens
ucucuugccgacaagggca

SEQ ID NO: 1541985 - RNA, 13 nt, Homo sapiens
ucugaagaucuca

SEQ ID NO: 1541986 - RNA, 20 nt, Homo sapiens
ucugaagggccccuugcaaa

SEQ ID NO: 1541987 - RNA, 23 nt, Homo sapiens
ucugacuguaaaauacaugguau

SEQ ID NO: 1541988 - RNA, 19 nt, Homo sapiens
ucugagaaaagcuuugaac

SEQ ID NO: 1541989 - RNA, 21 nt, Homo sapiens
ucugagccagucccucagcca

SEQ ID NO: 1541990 - RNA, 23 nt, Homo sapiens
ucugagcccugcccucacuccac

SEQ ID NO: 1541991 - RNA, 15 nt, Homo sapiens
ucugagcuuaaacau

SEQ ID NO: 1541992 - RNA, 17 nt, Homo sapiens
ucugaguagcauauaua

SEQ ID NO: 1541993 - RNA, 23 nt, Homo sapiens
ucugcaagauucugugggcagcu

SEQ ID NO: 1541994 - RNA, 12 nt, Homo sapiens
ucugccuuccag

SEQ ID NO: 1541995 - RNA, 15 nt, Homo sapiens
ucugcuggauucuaa

SEQ ID NO: 1541996 - RNA, 20 nt, Homo sapiens
ucugcuggauucuaaauuau

SEQ ID NO: 1541997 - RNA, 21 nt, Homo sapiens
ucuggacuauccucuuuggaa

SEQ ID NO: 1541998 - RNA, 16 nt, Homo sapiens
ucuggagucugaagga

SEQ ID NO: 1541999 - RNA, 21 nt, Homo sapiens
ucuggcacuugcaagucccau

SEQ ID NO: 1542000 - RNA, 23 nt, Homo sapiens
ucuggcacuugcaagucccauga

SEQ ID NO: 1542001 - RNA, 14 nt, Homo sapiens
ucugggguggggcu

SEQ ID NO: 1542002 - RNA, 20 nt, Homo sapiens
ucugucccaguuaacuguua

SEQ ID NO: 1542003 - RNA, 18 nt, Homo sapiens
ucuguuaaaugaacuuga

SEQ ID NO: 1542004 - RNA, 18 nt, Homo sapiens
ucuguuugauacaguauu

SEQ ID NO: 1542005 - RNA, 23 nt, Homo sapiens
ucuuaaguacugaaauacauaug

SEQ ID NO: 1542006 - RNA, 21 nt, Homo sapiens
ucuuacaauaauucuaugaga

SEQ ID NO: 1542007 - RNA, 18 nt, Homo sapiens
ucuuagcugaacaaugaa

SEQ ID NO: 1542008 - RNA, 14 nt, Homo sapiens
ucuuauuuuagaca

SEQ ID NO: 1542009 - RNA, 21 nt, Homo sapiens
ucuucaagaucccauuugaau

SEQ ID NO: 1542010 - RNA, 14 nt, Homo sapiens
ucuucauggccaua

SEQ ID NO: 1542011 - RNA, 18 nt, Homo sapiens
ucuucauguuucaggaga

SEQ ID NO: 1542012 - RNA, 14 nt, Homo sapiens
ucuuccucuuaccu

SEQ ID NO: 1542013 - RNA, 13 nt, Homo sapiens
ucuucuccacugg

SEQ ID NO: 1542014 - RNA, 13 nt, Homo sapiens
ucuucuuacugua

SEQ ID NO: 1542015 - RNA, 14 nt, Homo sapiens
ucuucuuacuguau

SEQ ID NO: 1542016 - RNA, 13 nt, Homo sapiens
ucuugaauguuga

SEQ ID NO: 1542017 - RNA, 22 nt, Homo sapiens
ucuugagauguauuaugcaaag

SEQ ID NO: 1542018 - RNA, 23 nt, Homo sapiens
ucuugcacuggccuucugaugaa

SEQ ID NO: 1542019 - RNA, 17 nt, Homo sapiens
ucuugcagucaucagaa

SEQ ID NO: 1542020 - RNA, 22 nt, Homo sapiens
ucuuguguuguuuucucugauc

SEQ ID NO: 1542021 - RNA, 18 nt, Homo sapiens
ucuuuaacauacaucuaa

SEQ ID NO: 1542022 - RNA, 18 nt, Homo sapiens
ucuuuacuaacacuggcu

SEQ ID NO: 1542023 - RNA, 14 nt, Homo sapiens
ucuuuaugacuguu

SEQ ID NO: 1542024 - RNA, 16 nt, Homo sapiens
ucuuuauucacaguau

SEQ ID NO: 1542025 - RNA, 21 nt, Homo sapiens
ucuuucuauguagaacuguuc

SEQ ID NO: 1542026 - RNA, 14 nt, Homo sapiens
ucuuugaaagggcu

SEQ ID NO: 1542027 - RNA, 18 nt, Homo sapiens
ucuuuggcuucagaauug

SEQ ID NO: 1542028 - RNA, 20 nt, Homo sapiens
ucuuuguauauuucuaguau

SEQ ID NO: 1542029 - RNA, 18 nt, Homo sapiens
ucuuuguuuacaugaguu

SEQ ID NO: 1542030 - RNA, 13 nt, Homo sapiens
ugaaaaacagcag

SEQ ID NO: 1542031 - RNA, 12 nt, Homo sapiens
ugaaaaggugau

SEQ ID NO: 1542032 - RNA, 12 nt, Homo sapiens
ugaaaaugugac

SEQ ID NO: 1542033 - RNA, 18 nt, Homo sapiens
ugaaaauuaugagucucu

SEQ ID NO: 1542034 - RNA, 16 nt, Homo sapiens
ugaaacacacaggcca

SEQ ID NO: 1542035 - RNA, 13 nt, Homo sapiens
ugaaacacagcug

SEQ ID NO: 1542036 - RNA, 20 nt, Homo sapiens
ugaaagauugauuaaugaac

SEQ ID NO: 1542037 - RNA, 21 nt, Homo sapiens
ugaaaggauaugaaucugaga

SEQ ID NO: 1542038 - RNA, 16 nt, Homo sapiens
ugaaagggguugugaa

SEQ ID NO: 1542039 - RNA, 18 nt, Homo sapiens
ugaaagucuccuguauca

SEQ ID NO: 1542040 - RNA, 14 nt, Homo sapiens
ugaaauacauauga

SEQ ID NO: 1542041 - RNA, 18 nt, Homo sapiens
ugaaauuggaagacuugg

SEQ ID NO: 1542042 - RNA, 18 nt, Homo sapiens
ugaacaagauuucccuaa

SEQ ID NO: 1542043 - RNA, 17 nt, Homo sapiens
ugaacccauccaaugga

SEQ ID NO: 1542044 - RNA, 16 nt, Homo sapiens
ugaacugcaacacugg

SEQ ID NO: 1542045 - RNA, 19 nt, Homo sapiens
ugaacuguaaauaugucac

SEQ ID NO: 1542046 - RNA, 23 nt, Homo sapiens
ugaagacccucaaugccaagaaa

SEQ ID NO: 1542047 - RNA, 14 nt, Homo sapiens
ugaagagagauaua

SEQ ID NO: 1542048 - RNA, 12 nt, Homo sapiens
ugaagaucucag

SEQ ID NO: 1542049 - RNA, 23 nt, Homo sapiens
ugaagcaaacacacagacucugu

SEQ ID NO: 1542050 - RNA, 14 nt, Homo sapiens
ugaaggauugugaa

SEQ ID NO: 1542051 - RNA, 13 nt, Homo sapiens
ugaaggcuguaca

SEQ ID NO: 1542052 - RNA, 22 nt, Homo sapiens
ugaaucccuuucaguuugucca

SEQ ID NO: 1542053 - RNA, 21 nt, Homo sapiens
ugaauguuuuauggaauugaa

SEQ ID NO: 1542054 - RNA, 14 nt, Homo sapiens
ugacacaacucauc

SEQ ID NO: 1542055 - RNA, 14 nt, Homo sapiens
ugacacggccauga

SEQ ID NO: 1542056 - RNA, 11 nt, Homo sapiens
ugacacugucu

SEQ ID NO: 1542057 - RNA, 22 nt, Homo sapiens
ugacaggaauucucccuggcau

SEQ ID NO: 1542058 - RNA, 15 nt, Homo sapiens
ugacaucaguggcau

SEQ ID NO: 1542059 - RNA, 17 nt, Homo sapiens
ugacaucgguucaggag

SEQ ID NO: 1542060 - RNA, 19 nt, Homo sapiens
ugacuaaaccauugugcau

SEQ ID NO: 1542061 - RNA, 19 nt, Homo sapiens
ugacuguccuacaauauca

SEQ ID NO: 1542062 - RNA, 21 nt, Homo sapiens
ugacuucuuuacuaacacugg

SEQ ID NO: 1542063 - RNA, 16 nt, Homo sapiens
ugagaccgaaucucac

SEQ ID NO: 1542064 - RNA, 18 nt, Homo sapiens
ugagaggagcguguccua

SEQ ID NO: 1542065 - RNA, 23 nt, Homo sapiens
ugagcaccuacuuacaugcauua

SEQ ID NO: 1542066 - RNA, 14 nt, Homo sapiens
ugagcucaaaguac

SEQ ID NO: 1542067 - RNA, 23 nt, Homo sapiens
ugagcuuggccagaagggggcca

SEQ ID NO: 1542068 - RNA, 22 nt, Homo sapiens
ugaggggaaaccuucacccagc

SEQ ID NO: 1542069 - RNA, 19 nt, Homo sapiens
ugaguauucauuuugcaac

SEQ ID NO: 1542070 - RNA, 14 nt, Homo sapiens
ugaguucaaauacu

SEQ ID NO: 1542071 - RNA, 20 nt, Homo sapiens
ugaguuguuuaaacagucaa

SEQ ID NO: 1542072 - RNA, 21 nt, Homo sapiens
ugaguuuaaaaaaauaacauc

SEQ ID NO: 1542073 - RNA, 15 nt, Homo sapiens
ugauaaaagcacuua

SEQ ID NO: 1542074 - RNA, 20 nt, Homo sapiens
ugauaaauuugacuguuauu

SEQ ID NO: 1542075 - RNA, 17 nt, Homo sapiens
ugaucccuagcugugac

SEQ ID NO: 1542076 - RNA, 17 nt, Homo sapiens
ugauggagucagguuug

SEQ ID NO: 1542077 - RNA, 19 nt, Homo sapiens
ugaugguaacugcacacau

SEQ ID NO: 1542078 - RNA, 12 nt, Homo sapiens
ugaugugcucau

SEQ ID NO: 1542079 - RNA, 18 nt, Homo sapiens
ugaugugcucaucagaaa

SEQ ID NO: 1542080 - RNA, 15 nt, Homo sapiens
ugauuaaaacauuau

SEQ ID NO: 1542081 - RNA, 20 nt, Homo sapiens
ugauucgcccaaagccagac

SEQ ID NO: 1542082 - RNA, 17 nt, Homo sapiens
ugauucuaugccuguau

SEQ ID NO: 1542083 - RNA, 19 nt, Homo sapiens
ugauugaaaauaguaaaug

SEQ ID NO: 1542084 - RNA, 13 nt, Homo sapiens
ugauugaaguauc

SEQ ID NO: 1542085 - RNA, 21 nt, Homo sapiens
ugauuggacauuuucuucaga

SEQ ID NO: 1542086 - RNA, 14 nt, Homo sapiens
ugauugucaccaug

SEQ ID NO: 1542087 - RNA, 19 nt, Homo sapiens
ugauuuauucuggugucua

SEQ ID NO: 1542088 - RNA, 15 nt, Homo sapiens
ugauuuccauuugca

SEQ ID NO: 1542089 - RNA, 13 nt, Homo sapiens
ugauuugcaacuu

SEQ ID NO: 1542090 - RNA, 18 nt, Homo sapiens
ugcaaaccgugaggucac

SEQ ID NO: 1542091 - RNA, 15 nt, Homo sapiens
ugcaaagcauuugag

SEQ ID NO: 1542092 - RNA, 12 nt, Homo sapiens
ugcaaaguaaua

SEQ ID NO: 1542093 - RNA, 22 nt, Homo sapiens
ugcaaauggcuaccguuuuaca

SEQ ID NO: 1542094 - RNA, 21 nt, Homo sapiens
ugcaaccucggggagugccac

SEQ ID NO: 1542095 - RNA, 18 nt, Homo sapiens
ugcaauaaacucagucaa

SEQ ID NO: 1542096 - RNA, 18 nt, Homo sapiens
ugcaauaugaggggacug

SEQ ID NO: 1542097 - RNA, 14 nt, Homo sapiens
ugcacaaacuccau

SEQ ID NO: 1542098 - RNA, 13 nt, Homo sapiens
ugcacacaccugc

SEQ ID NO: 1542099 - RNA, 14 nt, Homo sapiens
ugcacagcaucuca

SEQ ID NO: 1542100 - RNA, 22 nt, Homo sapiens
ugcacaguuugcaaucuuaugu

SEQ ID NO: 1542101 - RNA, 18 nt, Homo sapiens
ugcacauuugucacugaa

SEQ ID NO: 1542102 - RNA, 23 nt, Homo sapiens
ugcaccccuggugucccugccug

SEQ ID NO: 1542103 - RNA, 14 nt, Homo sapiens
ugcacccgugccac

SEQ ID NO: 1542104 - RNA, 13 nt, Homo sapiens
ugcacggggccag

SEQ ID NO: 1542105 - RNA, 15 nt, Homo sapiens
ugcagacucacugug

SEQ ID NO: 1542106 - RNA, 16 nt, Homo sapiens
ugcagacucacugugg

SEQ ID NO: 1542107 - RNA, 13 nt, Homo sapiens
ugcagcagagccu

SEQ ID NO: 1542108 - RNA, 14 nt, Homo sapiens
ugcagcagagccug

SEQ ID NO: 1542109 - RNA, 13 nt, Homo sapiens
ugcaggaagggaa

SEQ ID NO: 1542110 - RNA, 17 nt, Homo sapiens
ugcaggcagaaccugaa

SEQ ID NO: 1542111 - RNA, 18 nt, Homo sapiens
ugcagggcccccacugga

SEQ ID NO: 1542112 - RNA, 16 nt, Homo sapiens
ugcaguggguucucca

SEQ ID NO: 1542113 - RNA, 20 nt, Homo sapiens
ugcauaaccgcacagacauu

SEQ ID NO: 1542114 - RNA, 17 nt, Homo sapiens
ugcaugaaaccacugga

SEQ ID NO: 1542115 - RNA, 16 nt, Homo sapiens
ugcaugcacuucuuac

SEQ ID NO: 1542116 - RNA, 14 nt, Homo sapiens
ugcauggcauuugu

SEQ ID NO: 1542117 - RNA, 16 nt, Homo sapiens
ugcaugugauuggcag

SEQ ID NO: 1542118 - RNA, 17 nt, Homo sapiens
ugcauuacugcaugcac

SEQ ID NO: 1542119 - RNA, 15 nt, Homo sapiens
ugccacugacaggaa

SEQ ID NO: 1542120 - RNA, 18 nt, Homo sapiens
ugccagcuauaaucuccc

SEQ ID NO: 1542121 - RNA, 17 nt, Homo sapiens
ugccauauucuguagua

SEQ ID NO: 1542122 - RNA, 17 nt, Homo sapiens
ugccaugucuuguucag

SEQ ID NO: 1542123 - RNA, 16 nt, Homo sapiens
ugccauuccgaccuuc

SEQ ID NO: 1542124 - RNA, 17 nt, Homo sapiens
ugcccaccccgccucug

SEQ ID NO: 1542125 - RNA, 24 nt, Homo sapiens
ugcccauuagcccacugccuggaa

SEQ ID NO: 1542126 - RNA, 22 nt, Homo sapiens
ugcccauuguaacuuauuucag

SEQ ID NO: 1542127 - RNA, 14 nt, Homo sapiens
ugccccagugcuac

SEQ ID NO: 1542128 - RNA, 15 nt, Homo sapiens
ugccccgucaccauc

SEQ ID NO: 1542129 - RNA, 13 nt, Homo sapiens
ugcccguggugag

SEQ ID NO: 1542130 - RNA, 18 nt, Homo sapiens
ugcccuccguccuggcag

SEQ ID NO: 1542131 - RNA, 21 nt, Homo sapiens
ugcccuuuaacaagacuucaa

SEQ ID NO: 1542132 - RNA, 14 nt, Homo sapiens
ugccuauuuaugaa

SEQ ID NO: 1542133 - RNA, 13 nt, Homo sapiens
ugccuguggugag

SEQ ID NO: 1542134 - RNA, 23 nt, Homo sapiens
ugccuuccacgcugucuccagac

SEQ ID NO: 1542135 - RNA, 19 nt, Homo sapiens
ugccuuggguggaccaggc

SEQ ID NO: 1542136 - RNA, 16 nt, Homo sapiens
ccugaaauguuuccag

SEQ ID NO: 1542137 - RNA, 19 nt, Homo sapiens
ccugaagugaccccagcuc

SEQ ID NO: 1542138 - RNA, 15 nt, Homo sapiens
ccugacaaaagggac

SEQ ID NO: 1542139 - RNA, 16 nt, Homo sapiens
ccugacacugucugcu

SEQ ID NO: 1542140 - RNA, 20 nt, Homo sapiens
ccugacuguccuacaauauc

SEQ ID NO: 1542141 - RNA, 18 nt, Homo sapiens
ccugagaagccucauggg

SEQ ID NO: 1542142 - RNA, 15 nt, Homo sapiens
ccugaggguuuccac

SEQ ID NO: 1542143 - RNA, 19 nt, Homo sapiens
ccugaguuucaaguauccu

SEQ ID NO: 1542144 - RNA, 22 nt, Homo sapiens
ccugcaaccucggggagugcca

SEQ ID NO: 1542145 - RNA, 17 nt, Homo sapiens
ccugcagacucacugug

SEQ ID NO: 1542146 - RNA, 14 nt, Homo sapiens
ccugccccagagaa

SEQ ID NO: 1542147 - RNA, 17 nt, Homo sapiens
ccugccccggccacucu

SEQ ID NO: 1542148 - RNA, 20 nt, Homo sapiens
ccugcucagaugcuggucau

SEQ ID NO: 1542149 - RNA, 17 nt, Homo sapiens
ccugcucccuagccaga

SEQ ID NO: 1542150 - RNA, 17 nt, Homo sapiens
ccuggaacugucucuca

SEQ ID NO: 1542151 - RNA, 19 nt, Homo sapiens
ccuggcagaacugagcucc

SEQ ID NO: 1542152 - RNA, 20 nt, Homo sapiens
ccuggcccuccucuggucac

SEQ ID NO: 1542153 - RNA, 15 nt, Homo sapiens
ccuggcucacagcca

SEQ ID NO: 1542154 - RNA, 23 nt, Homo sapiens
ccuggcuuagcguucuguuucac

SEQ ID NO: 1542155 - RNA, 15 nt, Homo sapiens
ccugggccacuggca

SEQ ID NO: 1542156 - RNA, 16 nt, Homo sapiens
ccugggcccuaggcau

SEQ ID NO: 1542157 - RNA, 17 nt, Homo sapiens
ccuggggggcacagcca

SEQ ID NO: 1542158 - RNA, 14 nt, Homo sapiens
ccuguguggugcca

SEQ ID NO: 1542159 - RNA, 14 nt, Homo sapiens
ccuguucacucuac

SEQ ID NO: 1542160 - RNA, 23 nt, Homo sapiens
ccuucaaggaagugauaacacug

SEQ ID NO: 1542161 - RNA, 23 nt, Homo sapiens
ccuucaaugcaaaauacaugaug

SEQ ID NO: 1542162 - RNA, 22 nt, Homo sapiens
ccuucaccaagcuuagaagcca

SEQ ID NO: 1542163 - RNA, 23 nt, Homo sapiens
ccuucauuuccuccgucaccuca

SEQ ID NO: 1542164 - RNA, 23 nt, Homo sapiens
ccuuccucaagauccugucuugc

SEQ ID NO: 1542165 - RNA, 22 nt, Homo sapiens
ccuuccugggcagcccagagag

SEQ ID NO: 1542166 - RNA, 15 nt, Homo sapiens
ccuucuccugcauug

SEQ ID NO: 1542167 - RNA, 17 nt, Homo sapiens
ccuucugaggaugcuga

SEQ ID NO: 1542168 - RNA, 19 nt, Homo sapiens
ccuucuuccauucccagac

SEQ ID NO: 1542169 - RNA, 16 nt, Homo sapiens
ccuuggggauucuucc

SEQ ID NO: 1542170 - RNA, 18 nt, Homo sapiens
ccuuguucugauaaugaa

SEQ ID NO: 1542171 - RNA, 19 nt, Homo sapiens
ccuuucaccccucuuccca

SEQ ID NO: 1542172 - RNA, 20 nt, Homo sapiens
ccuuucugacaauaaauaau

SEQ ID NO: 1542173 - RNA, 15 nt, Homo sapiens
ccuuucuuacauuag

SEQ ID NO: 1542174 - RNA, 14 nt, Homo sapiens
ccuuuuauguguug

SEQ ID NO: 1542175 - RNA, 19 nt, Homo sapiens
cgaaacacagaacucagcc

SEQ ID NO: 1542176 - RNA, 14 nt, Homo sapiens
cgagucucuucucc

SEQ ID NO: 1542177 - RNA, 19 nt, Homo sapiens
cgagucucuucuccacugg

SEQ ID NO: 1542178 - RNA, 11 nt, Homo sapiens
cgauguuaaac

SEQ ID NO: 1542179 - RNA, 20 nt, Homo sapiens
cgcaaauacaugccuuucca

SEQ ID NO: 1542180 - RNA, 18 nt, Homo sapiens
cgccccccggccugaugg

SEQ ID NO: 1542181 - RNA, 19 nt, Homo sapiens
cgccgugucuuguguugcu

SEQ ID NO: 1542182 - RNA, 21 nt, Homo sapiens
cgcgagccaugauguggagug

SEQ ID NO: 1542183 - RNA, 17 nt, Homo sapiens
cgcuggccucuuccucc

SEQ ID NO: 1542184 - RNA, 18 nt, Homo sapiens
cgcugggagaaaagccag

SEQ ID NO: 1542185 - RNA, 12 nt, Homo sapiens
cggaaagccuuc

SEQ ID NO: 1542186 - RNA, 14 nt, Homo sapiens
cggagcacugugca

SEQ ID NO: 1542187 - RNA, 15 nt, Homo sapiens
cggaggccacaugag

SEQ ID NO: 1542188 - RNA, 14 nt, Homo sapiens
cggccugauggcca

SEQ ID NO: 1542189 - RNA, 18 nt, Homo sapiens
cggcuccuucaagcugcu

SEQ ID NO: 1542190 - RNA, 19 nt, Homo sapiens
cguccuuagaauacuguau

SEQ ID NO: 1542191 - RNA, 15 nt, Homo sapiens
cgugcacggggccag

SEQ ID NO: 1542192 - RNA, 19 nt, Homo sapiens
cgugccaaauccugggcau

SEQ ID NO: 1542193 - RNA, 19 nt, Homo sapiens
cguguguagauaguaugca

SEQ ID NO: 1542194 - RNA, 19 nt, Homo sapiens
cguucagcugugacgaagg

SEQ ID NO: 1542195 - RNA, 18 nt, Homo sapiens
cuaaaaccuuccauguca

SEQ ID NO: 1542196 - RNA, 18 nt, Homo sapiens
cuaaacuccuuuccugca

SEQ ID NO: 1542197 - RNA, 22 nt, Homo sapiens
cuaaauuaugugaauuuugcca

SEQ ID NO: 1542198 - RNA, 15 nt, Homo sapiens
cuaaauuuccagggg

SEQ ID NO: 1542199 - RNA, 11 nt, Homo sapiens
cuaacacuggc

SEQ ID NO: 1542200 - RNA, 23 nt, Homo sapiens
cuaagaccuccucccaagcacuu

SEQ ID NO: 1542201 - RNA, 11 nt, Homo sapiens
cuaaggcuucc

SEQ ID NO: 1542202 - RNA, 17 nt, Homo sapiens
cuaagucaguuucacau

SEQ ID NO: 1542203 - RNA, 17 nt, Homo sapiens
cuaaguguuuucaaaua

SEQ ID NO: 1542204 - RNA, 17 nt, Homo sapiens
cuaauaaagaaauaaua

SEQ ID NO: 1542205 - RNA, 22 nt, Homo sapiens
cuaauagacuuagccccaugag

SEQ ID NO: 1542206 - RNA, 15 nt, Homo sapiens
cuaauguacaauaaa

SEQ ID NO: 1542207 - RNA, 17 nt, Homo sapiens
cuaauuggcaugaaggu

SEQ ID NO: 1542208 - RNA, 20 nt, Homo sapiens
cuacagcaaagccuagccug

SEQ ID NO: 1542209 - RNA, 21 nt, Homo sapiens
cuacccacaggacauucacca

SEQ ID NO: 1542210 - RNA, 22 nt, Homo sapiens
cuacccgcccgcguccaacccc

SEQ ID NO: 1542211 - RNA, 23 nt, Homo sapiens
cuaccgagucucuucuccacugg

SEQ ID NO: 1542212 - RNA, 15 nt, Homo sapiens
cuacugagacaugac

SEQ ID NO: 1542213 - RNA, 14 nt, Homo sapiens
cuagaaucacuuga

SEQ ID NO: 1542214 - RNA, 19 nt, Homo sapiens
cuagacugggcuggcugcc

SEQ ID NO: 1542215 - RNA, 19 nt, Homo sapiens
cuagagaaggacccggagg

SEQ ID NO: 1542216 - RNA, 17 nt, Homo sapiens
cuagaugggcauggggu

SEQ ID NO: 1542217 - RNA, 23 nt, Homo sapiens
cuagccugcauaucauucaccca

SEQ ID NO: 1542218 - RNA, 13 nt, Homo sapiens
cuagcuauaacaa

SEQ ID NO: 1542219 - RNA, 22 nt, Homo sapiens
cuaguagcuuuccucccaaagg

SEQ ID NO: 1542220 - RNA, 23 nt, Homo sapiens
cuaguccccagccugcucccuag

SEQ ID NO: 1542221 - RNA, 15 nt, Homo sapiens
cuauaauguuucccu

SEQ ID NO: 1542222 - RNA, 15 nt, Homo sapiens
cuauccucuuuggaa

SEQ ID NO: 1542223 - RNA, 20 nt, Homo sapiens
cuaucuacugagacaugacu

SEQ ID NO: 1542224 - RNA, 13 nt, Homo sapiens
cuaucugcaaaua

SEQ ID NO: 1542225 - RNA, 14 nt, Homo sapiens
cuaugcugcaauac

SEQ ID NO: 1542226 - RNA, 15 nt, Homo sapiens
cuauggcaucuuccc

SEQ ID NO: 1542227 - RNA, 12 nt, Homo sapiens
cuaugucuguga

SEQ ID NO: 1542228 - RNA, 19 nt, Homo sapiens
cuauuacugaugugugcaa

SEQ ID NO: 1542229 - RNA, 16 nt, Homo sapiens
cuauuuuaaugaauga

SEQ ID NO: 1542230 - RNA, 20 nt, Homo sapiens
cucaaaccuccaaaagcccu

SEQ ID NO: 1542231 - RNA, 19 nt, Homo sapiens
cucaacaaagaagaaccau

SEQ ID NO: 1542232 - RNA, 18 nt, Homo sapiens
cucaacccugugaucuau

SEQ ID NO: 1542233 - RNA, 17 nt, Homo sapiens
cucacaacuguuuuuga

SEQ ID NO: 1542234 - RNA, 15 nt, Homo sapiens
cucacagaugggcaa

SEQ ID NO: 1542235 - RNA, 16 nt, Homo sapiens
cucacaucauguaaua

SEQ ID NO: 1542236 - RNA, 18 nt, Homo sapiens
cucaccaaaauauaguua

SEQ ID NO: 1542237 - RNA, 17 nt, Homo sapiens
cucaccuugcucugcca

SEQ ID NO: 1542238 - RNA, 15 nt, Homo sapiens
cucacuggugcauuu

SEQ ID NO: 1542239 - RNA, 20 nt, Homo sapiens
cucacugguuuucaauacca

SEQ ID NO: 1542240 - RNA, 19 nt, Homo sapiens
cucacuuuucuccaugagu

SEQ ID NO: 1542241 - RNA, 23 nt, Homo sapiens
cucagcaccugggacccaacaga

SEQ ID NO: 1542242 - RNA, 12 nt, Homo sapiens
cucagcacuuug

SEQ ID NO: 1542243 - RNA, 14 nt, Homo sapiens
cucagcagccucag

SEQ ID NO: 1542244 - RNA, 20 nt, Homo sapiens
cucagccacacccaggcacu

SEQ ID NO: 1542245 - RNA, 14 nt, Homo sapiens
cucaucaacaaaga

SEQ ID NO: 1542246 - RNA, 12 nt, Homo sapiens
cucaucagaaac

SEQ ID NO: 1542247 - RNA, 14 nt, Homo sapiens
cucaucccaaaagc

SEQ ID NO: 1542248 - RNA, 16 nt, Homo sapiens
cucauggaucugcaua

SEQ ID NO: 1542249 - RNA, 12 nt, Homo sapiens
cuccacuguaaa

SEQ ID NO: 1542250 - RNA, 13 nt, Homo sapiens
cuccacuuggcau

SEQ ID NO: 1542251 - RNA, 16 nt, Homo sapiens
cuccaggauuguccac

SEQ ID NO: 1542252 - RNA, 14 nt, Homo sapiens
cuccauaauugcaa

SEQ ID NO: 1542253 - RNA, 13 nt, Homo sapiens
cucccaagcacuu

SEQ ID NO: 1542254 - RNA, 14 nt, Homo sapiens
cucccaagcacuuc

SEQ ID NO: 1542255 - RNA, 13 nt, Homo sapiens
cucccagggccau

SEQ ID NO: 1542256 - RNA, 16 nt, Homo sapiens
cucccagggccaugaa

SEQ ID NO: 1542257 - RNA, 20 nt, Homo sapiens
cuccccauggugcagugaag

SEQ ID NO: 1542258 - RNA, 18 nt, Homo sapiens
cuccccuuguacucuugc

SEQ ID NO: 1542259 - RNA, 12 nt, Homo sapiens
cucccuagccag

SEQ ID NO: 1542260 - RNA, 17 nt, Homo sapiens
cucccuccucagucuuu

SEQ ID NO: 1542261 - RNA, 14 nt, Homo sapiens
cuccuaaauuucca

SEQ ID NO: 1542262 - RNA, 13 nt, Homo sapiens
cuccuaccuauca

SEQ ID NO: 1542263 - RNA, 20 nt, Homo sapiens
cuccucccaagcacuucaaa

SEQ ID NO: 1542264 - RNA, 22 nt, Homo sapiens
cuccuccccuccccucacuucu

SEQ ID NO: 1542265 - RNA, 18 nt, Homo sapiens
cuccuggcucacagccac

SEQ ID NO: 1542266 - RNA, 18 nt, Homo sapiens
gcacauuugucacugaau

SEQ ID NO: 1542267 - RNA, 22 nt, Homo sapiens
gcacccucugcuaugucuguga

SEQ ID NO: 1542268 - RNA, 18 nt, Homo sapiens
gcacccuggauuugcaua

SEQ ID NO: 1542269 - RNA, 19 nt, Homo sapiens
gcacuucguggaugaccuc

SEQ ID NO: 1542270 - RNA, 15 nt, Homo sapiens
gcacuugcuacuuca

SEQ ID NO: 1542271 - RNA, 14 nt, Homo sapiens
gcacuuuguuucau

SEQ ID NO: 1542272 - RNA, 12 nt, Homo sapiens
gcagaaccaaag

SEQ ID NO: 1542273 - RNA, 13 nt, Homo sapiens
gcagaagaacaga

SEQ ID NO: 1542274 - RNA, 19 nt, Homo sapiens
gcagaaggugaaauggagg

SEQ ID NO: 1542275 - RNA, 20 nt, Homo sapiens
gcagagauugggggggcuug

SEQ ID NO: 1542276 - RNA, 21 nt, Homo sapiens
gcagagcccucaugugacaug

SEQ ID NO: 1542277 - RNA, 16 nt, Homo sapiens
gcagccggagucacug

SEQ ID NO: 1542278 - RNA, 12 nt, Homo sapiens
gcagcuagacac

SEQ ID NO: 1542279 - RNA, 23 nt, Homo sapiens
gcaggggcugggcagaggggaga

SEQ ID NO: 1542280 - RNA, 12 nt, Homo sapiens
gcagggugaccc

SEQ ID NO: 1542281 - RNA, 21 nt, Homo sapiens
gcaggugcuucaggauaccau

SEQ ID NO: 1542282 - RNA, 19 nt, Homo sapiens
gcagugccaggaacccuua

SEQ ID NO: 1542283 - RNA, 24 nt, Homo sapiens
gcaguggagaggggacuuggauag

SEQ ID NO: 1542284 - RNA, 15 nt, Homo sapiens
gcaguuagcacagag

SEQ ID NO: 1542285 - RNA, 17 nt, Homo sapiens
gcauaaauauuagcaaa

SEQ ID NO: 1542286 - RNA, 21 nt, Homo sapiens
gcauauuauaucagacugcuu

SEQ ID NO: 1542287 - RNA, 21 nt, Homo sapiens
gcaucugccaggacacugccu

SEQ ID NO: 1542288 - RNA, 22 nt, Homo sapiens
gcaucuuccccaacgaaaagca

SEQ ID NO: 1542289 - RNA, 17 nt, Homo sapiens
gcaugaaaccacuggaa

SEQ ID NO: 1542290 - RNA, 22 nt, Homo sapiens
gcaugcuggcucccagggccau

SEQ ID NO: 1542291 - RNA, 14 nt, Homo sapiens
gcauggggugggcc

SEQ ID NO: 1542292 - RNA, 18 nt, Homo sapiens
gcauuaaaaaugcauaua

SEQ ID NO: 1542293 - RNA, 17 nt, Homo sapiens
gcauucuagagugcaua

SEQ ID NO: 1542294 - RNA, 16 nt, Homo sapiens
gcauuuaaaauggacu

SEQ ID NO: 1542295 - RNA, 18 nt, Homo sapiens
gccaauggagacugucuc

SEQ ID NO: 1542296 - RNA, 18 nt, Homo sapiens
gccacacguuugccaaau

SEQ ID NO: 1542297 - RNA, 17 nt, Homo sapiens
gccacauccaacauuuc

SEQ ID NO: 1542298 - RNA, 19 nt, Homo sapiens
gccacauggagcuugacuu

SEQ ID NO: 1542299 - RNA, 19 nt, Homo sapiens
gccacccggaucuccaggc

SEQ ID NO: 1542300 - RNA, 14 nt, Homo sapiens
gccacccucugcag

SEQ ID NO: 1542301 - RNA, 18 nt, Homo sapiens
gccaccucucacacuggc

SEQ ID NO: 1542302 - RNA, 14 nt, Homo sapiens
gccagaaaacauau

SEQ ID NO: 1542303 - RNA, 21 nt, Homo sapiens
gccagaggccuggugcccugg

SEQ ID NO: 1542304 - RNA, 22 nt, Homo sapiens
gccagaggcucuaauguacaau

SEQ ID NO: 1542305 - RNA, 15 nt, Homo sapiens
gccaggacacugccu

SEQ ID NO: 1542306 - RNA, 19 nt, Homo sapiens
gccaggccucagggaccaa

SEQ ID NO: 1542307 - RNA, 18 nt, Homo sapiens
gccaggcucccacugccc

SEQ ID NO: 1542308 - RNA, 13 nt, Homo sapiens
gccagggaaacca

SEQ ID NO: 1542309 - RNA, 15 nt, Homo sapiens
gccaggggcagugaa

SEQ ID NO: 1542310 - RNA, 22 nt, Homo sapiens
gccagucacuccguuuugcaaa

SEQ ID NO: 1542311 - RNA, 19 nt, Homo sapiens
gccauaugacaauuucaaa

SEQ ID NO: 1542312 - RNA, 22 nt, Homo sapiens
gccaugacuaggguccucaggc

SEQ ID NO: 1542313 - RNA, 23 nt, Homo sapiens
gccaugagaaaagggaagccgcc

SEQ ID NO: 1542314 - RNA, 22 nt, Homo sapiens
gccauggaggcgccuuccuggg

SEQ ID NO: 1542315 - RNA, 13 nt, Homo sapiens
gccauuugugaua

SEQ ID NO: 1542316 - RNA, 14 nt, Homo sapiens
gcccaagaauagau

SEQ ID NO: 1542317 - RNA, 14 nt, Homo sapiens
gcccaaucacugcc

SEQ ID NO: 1542318 - RNA, 17 nt, Homo sapiens
gcccaauucugccacuu

SEQ ID NO: 1542319 - RNA, 16 nt, Homo sapiens
gcccacccccugcugg

SEQ ID NO: 1542320 - RNA, 16 nt, Homo sapiens
gcccagcagcggccca

SEQ ID NO: 1542321 - RNA, 18 nt, Homo sapiens
gcccagccagcagguucu

SEQ ID NO: 1542322 - RNA, 18 nt, Homo sapiens
gcccaggacacugccuuu

SEQ ID NO: 1542323 - RNA, 19 nt, Homo sapiens
gcccaggacacugccuuug

SEQ ID NO: 1542324 - RNA, 20 nt, Homo sapiens
gcccaggcuggagugcagug

SEQ ID NO: 1542325 - RNA, 18 nt, Homo sapiens
gcccagggagaggccaug

SEQ ID NO: 1542326 - RNA, 13 nt, Homo sapiens
gccccccggccug

SEQ ID NO: 1542327 - RNA, 17 nt, Homo sapiens
gccccccucauuacugc

SEQ ID NO: 1542328 - RNA, 20 nt, Homo sapiens
gcccccgagcugggggccau

SEQ ID NO: 1542329 - RNA, 21 nt, Homo sapiens
gcccccgagcugggggccaug

SEQ ID NO: 1542330 - RNA, 17 nt, Homo sapiens
gcccccucucuuacccc

SEQ ID NO: 1542331 - RNA, 20 nt, Homo sapiens
gcccccuucucccacacugc

SEQ ID NO: 1542332 - RNA, 22 nt, Homo sapiens
gccccuccccauggugcaguga

SEQ ID NO: 1542333 - RNA, 17 nt, Homo sapiens
gcccgagggucccaagg

SEQ ID NO: 1542334 - RNA, 15 nt, Homo sapiens
gcccucacuccacuc

SEQ ID NO: 1542335 - RNA, 19 nt, Homo sapiens
gcccucugcugcuuuccaa

SEQ ID NO: 1542336 - RNA, 21 nt, Homo sapiens
gcccugcgaccacagcaggga

SEQ ID NO: 1542337 - RNA, 21 nt, Homo sapiens
gcccuucacuguccauuccaa

SEQ ID NO: 1542338 - RNA, 20 nt, Homo sapiens
gcccuucccugacacugucu

SEQ ID NO: 1542339 - RNA, 12 nt, Homo sapiens
gccgcugggaga

SEQ ID NO: 1542340 - RNA, 22 nt, Homo sapiens
gccgcugggagaaaagccagau

SEQ ID NO: 1542341 - RNA, 16 nt, Homo sapiens
gccuaggggucaggga

SEQ ID NO: 1542342 - RNA, 17 nt, Homo sapiens
gccucagggaccaagga

SEQ ID NO: 1542343 - RNA, 12 nt, Homo sapiens
gccucaugaaca

SEQ ID NO: 1542344 - RNA, 22 nt, Homo sapiens
gccuccccuggggcuggcagcu

SEQ ID NO: 1542345 - RNA, 17 nt, Homo sapiens
gccucccgcaugcugcc

SEQ ID NO: 1542346 - RNA, 19 nt, Homo sapiens
gccuccucccauccagcgu

SEQ ID NO: 1542347 - RNA, 20 nt, Homo sapiens
gccuccugcugaguggucca

SEQ ID NO: 1542348 - RNA, 18 nt, Homo sapiens
gccugacgaacuccuuga

SEQ ID NO: 1542349 - RNA, 17 nt, Homo sapiens
gccugagggcgagggga

SEQ ID NO: 1542350 - RNA, 23 nt, Homo sapiens
gccugaugauggaagggccuucu

SEQ ID NO: 1542351 - RNA, 14 nt, Homo sapiens
gccuguccuggauc

SEQ ID NO: 1542352 - RNA, 18 nt, Homo sapiens
gccugugcuuuuggagcu

SEQ ID NO: 1542353 - RNA, 22 nt, Homo sapiens
gccuucucuguucauuuccuca

SEQ ID NO: 1542354 - RNA, 21 nt, Homo sapiens
gccuuucuaguccuauucuau

SEQ ID NO: 1542355 - RNA, 16 nt, Homo sapiens
gcgagucuggagacca

SEQ ID NO: 1542356 - RNA, 20 nt, Homo sapiens
gcguaggagagaacagggau

SEQ ID NO: 1542357 - RNA, 20 nt, Homo sapiens
gcgucccugagggcccuucc

SEQ ID NO: 1542358 - RNA, 16 nt, Homo sapiens
gcguguacuaccccag

SEQ ID NO: 1542359 - RNA, 17 nt, Homo sapiens
gcguguacuaccccaga

SEQ ID NO: 1542360 - RNA, 20 nt, Homo sapiens
gcuaaaauaaaccagacuca

SEQ ID NO: 1542361 - RNA, 22 nt, Homo sapiens
gcuaaaaugaaaaauagugugu

SEQ ID NO: 1542362 - RNA, 20 nt, Homo sapiens
gcuagaauauccuauacugg

SEQ ID NO: 1542363 - RNA, 19 nt, Homo sapiens
gcuauacagaaaaaccaca

SEQ ID NO: 1542364 - RNA, 17 nt, Homo sapiens
gcuaucucgcuagccau

SEQ ID NO: 1542365 - RNA, 13 nt, Homo sapiens
gcucacucuucca

SEQ ID NO: 1542366 - RNA, 19 nt, Homo sapiens
gcucagagcagaaccaaag

SEQ ID NO: 1542367 - RNA, 13 nt, Homo sapiens
gcucagggugcuc

SEQ ID NO: 1542368 - RNA, 14 nt, Homo sapiens
gcuccaggcuuccu

SEQ ID NO: 1542369 - RNA, 21 nt, Homo sapiens
gcuccaugcagaucuagccag

SEQ ID NO: 1542370 - RNA, 19 nt, Homo sapiens
gcuccugaaucccuuucag

SEQ ID NO: 1542371 - RNA, 16 nt, Homo sapiens
gcucgugugcuuagaa

SEQ ID NO: 1542372 - RNA, 14 nt, Homo sapiens
gcucuguuccacau

SEQ ID NO: 1542373 - RNA, 16 nt, Homo sapiens
gcucuucaccaggaag

SEQ ID NO: 1542374 - RNA, 14 nt, Homo sapiens
gcucuucagcacca

SEQ ID NO: 1542375 - RNA, 14 nt, Homo sapiens
gcugaaaagugcuu

SEQ ID NO: 1542376 - RNA, 15 nt, Homo sapiens
gcugagaguggggcu

SEQ ID NO: 1542377 - RNA, 15 nt, Homo sapiens
gcugcaauacauuaa

SEQ ID NO: 1542378 - RNA, 13 nt, Homo sapiens
gcugcacugcccu

SEQ ID NO: 1542379 - RNA, 17 nt, Homo sapiens
gcugcccccuacccggc

SEQ ID NO: 1542380 - RNA, 22 nt, Homo sapiens
gcugccucaggaaucuccugac

SEQ ID NO: 1542381 - RNA, 15 nt, Homo sapiens
gcugcugcacugccc

SEQ ID NO: 1542382 - RNA, 18 nt, Homo sapiens
gcuggcgucugucuucaa

SEQ ID NO: 1542383 - RNA, 17 nt, Homo sapiens
gcugggagaaaagccag

SEQ ID NO: 1542384 - RNA, 17 nt, Homo sapiens
gcugggucccgggugcc

SEQ ID NO: 1542385 - RNA, 18 nt, Homo sapiens
gcuggguuugggcagugg

SEQ ID NO: 1542386 - RNA, 14 nt, Homo sapiens
gcuggucucuaggc

SEQ ID NO: 1542387 - RNA, 15 nt, Homo sapiens
gcuguauacaaacag

SEQ ID NO: 1542388 - RNA, 17 nt, Homo sapiens
gcugugcacccgugcca

SEQ ID NO: 1542389 - RNA, 19 nt, Homo sapiens
gcuguuauuuaauuagcca

SEQ ID NO: 1542390 - RNA, 16 nt, Homo sapiens
gcuucaggauaccaua

SEQ ID NO: 1542391 - RNA, 20 nt, Homo sapiens
gcuucccaugucuuucucca

SEQ ID NO: 1542392 - RNA, 18 nt, Homo sapiens
gcuuccuucauuuccucc

SEQ ID NO: 1542393 - RNA, 22 nt, Homo sapiens
gcuuccuucauuuccuccguca

SEQ ID NO: 1542394 - RNA, 22 nt, Homo sapiens
gcuuguucuuccucuuaccugu

SEQ ID NO: 1542395 - RNA, 18 nt, Homo sapiens
ucacuuuucuccaugagu

SEQ ID NO: 1542396 - RNA, 21 nt, Homo sapiens
ucagaaacaaagcauuugacu

SEQ ID NO: 1542397 - RNA, 15 nt, Homo sapiens
ucagcacagccucac

SEQ ID NO: 1542398 - RNA, 15 nt, Homo sapiens
ucagcaccugggacc

SEQ ID NO: 1542399 - RNA, 21 nt, Homo sapiens
ucagcauucaaaauaguucua

SEQ ID NO: 1542400 - RNA, 23 nt, Homo sapiens
ucagcccugcccuucagcauccu

SEQ ID NO: 1542401 - RNA, 13 nt, Homo sapiens
ucagccuccacuc

SEQ ID NO: 1542402 - RNA, 13 nt, Homo sapiens
ucagccugugaac

SEQ ID NO: 1542403 - RNA, 16 nt, Homo sapiens
ucagcucaucuucacu

SEQ ID NO: 1542404 - RNA, 19 nt, Homo sapiens
ucaggaaaggaagauguaa

SEQ ID NO: 1542405 - RNA, 20 nt, Homo sapiens
ucaggaaugggccaagccag

SEQ ID NO: 1542406 - RNA, 13 nt, Homo sapiens
ucaggauaccaua

SEQ ID NO: 1542407 - RNA, 15 nt, Homo sapiens
ucaggauaccauaua

SEQ ID NO: 1542408 - RNA, 19 nt, Homo sapiens
ucagggugcucccuccuca

SEQ ID NO: 1542409 - RNA, 17 nt, Homo sapiens
ucaguccaauaaauuau

SEQ ID NO: 1542410 - RNA, 16 nt, Homo sapiens
ucaguggugagacugu

SEQ ID NO: 1542411 - RNA, 20 nt, Homo sapiens
ucauaaaaauaaccaaaaaa

SEQ ID NO: 1542412 - RNA, 14 nt, Homo sapiens
ucaucuagcuccau

SEQ ID NO: 1542413 - RNA, 13 nt, Homo sapiens
ucaugaaccucaa

SEQ ID NO: 1542414 - RNA, 17 nt, Homo sapiens
ucaugugauuuacccuu

SEQ ID NO: 1542415 - RNA, 17 nt, Homo sapiens
ucauugaagacccucaa

SEQ ID NO: 1542416 - RNA, 18 nt, Homo sapiens
ucauuucuuauuaaccaa

SEQ ID NO: 1542417 - RNA, 21 nt, Homo sapiens
ucauuucuucucucugugcug

SEQ ID NO: 1542418 - RNA, 17 nt, Homo sapiens
ucauuuuaacaucugag

SEQ ID NO: 1542419 - RNA, 13 nt, Homo sapiens
ucauuuucaccuc

SEQ ID NO: 1542420 - RNA, 19 nt, Homo sapiens
ucauuuuguuauagaaacu

SEQ ID NO: 1542421 - RNA, 16 nt, Homo sapiens
uccaaacuagauucau

SEQ ID NO: 1542422 - RNA, 21 nt, Homo sapiens
uccaaaguuuuaaaccuguua

SEQ ID NO: 1542423 - RNA, 22 nt, Homo sapiens
uccaagugaaugaguuuccagc

SEQ ID NO: 1542424 - RNA, 19 nt, Homo sapiens
uccacaguuaggccaagaa

SEQ ID NO: 1542425 - RNA, 19 nt, Homo sapiens
uccagaacugucuuaguca

SEQ ID NO: 1542426 - RNA, 16 nt, Homo sapiens
uccagaccccuacccu

SEQ ID NO: 1542427 - RNA, 14 nt, Homo sapiens
uccagagagaagca

SEQ ID NO: 1542428 - RNA, 15 nt, Homo sapiens
uccagagaguggcuc

SEQ ID NO: 1542429 - RNA, 16 nt, Homo sapiens
uccagaggugagggag

SEQ ID NO: 1542430 - RNA, 19 nt, Homo sapiens
uccagaugugccuagacac

SEQ ID NO: 1542431 - RNA, 19 nt, Homo sapiens
uccagcccucucacugugu

SEQ ID NO: 1542432 - RNA, 21 nt, Homo sapiens
uccaggccccaaaaccacagc

SEQ ID NO: 1542433 - RNA, 12 nt, Homo sapiens
uccaugauucca

SEQ ID NO: 1542434 - RNA, 14 nt, Homo sapiens
ucccaaaugcagcu

SEQ ID NO: 1542435 - RNA, 23 nt, Homo sapiens
ucccaccugcagagccagugucc

SEQ ID NO: 1542436 - RNA, 19 nt, Homo sapiens
ucccagacagcagugugag

SEQ ID NO: 1542437 - RNA, 18 nt, Homo sapiens
ucccagcaugcugagauu

SEQ ID NO: 1542438 - RNA, 19 nt, Homo sapiens
ucccagcaugcugagauua

SEQ ID NO: 1542439 - RNA, 13 nt, Homo sapiens
ucccagggccaug

SEQ ID NO: 1542440 - RNA, 21 nt, Homo sapiens
ucccaugguagacugugacac

SEQ ID NO: 1542441 - RNA, 22 nt, Homo sapiens
ucccauuuguaauguaucuuau

SEQ ID NO: 1542442 - RNA, 14 nt, Homo sapiens
uccccaauuauccu

SEQ ID NO: 1542443 - RNA, 13 nt, Homo sapiens
uccccacugccug

SEQ ID NO: 1542444 - RNA, 22 nt, Homo sapiens
uccccagagcuuuacagugcca

SEQ ID NO: 1542445 - RNA, 23 nt, Homo sapiens
uccccagagcuuuacagugccac

SEQ ID NO: 1542446 - RNA, 22 nt, Homo sapiens
uccccggaccggacgcaugcag

SEQ ID NO: 1542447 - RNA, 19 nt, Homo sapiens
uccccgugggccauggcaa

SEQ ID NO: 1542448 - RNA, 22 nt, Homo sapiens
uccccucacuucucccaccugc

SEQ ID NO: 1542449 - RNA, 22 nt, Homo sapiens
ucccguuguguggguuuacucu

SEQ ID NO: 1542450 - RNA, 14 nt, Homo sapiens
ucccugacacuguc

SEQ ID NO: 1542451 - RNA, 13 nt, Homo sapiens
ucccugcugccag

SEQ ID NO: 1542452 - RNA, 23 nt, Homo sapiens
ucccuggaaauaacugagcacuu

SEQ ID NO: 1542453 - RNA, 13 nt, Homo sapiens
ucccugugucagg

SEQ ID NO: 1542454 - RNA, 15 nt, Homo sapiens
uccgguggaaggccu

SEQ ID NO: 1542455 - RNA, 16 nt, Homo sapiens
uccuacacuugagaug

SEQ ID NO: 1542456 - RNA, 19 nt, Homo sapiens
uccuaggggccgagggaaa

SEQ ID NO: 1542457 - RNA, 22 nt, Homo sapiens
uccuauccccggacgcaugcag

SEQ ID NO: 1542458 - RNA, 21 nt, Homo sapiens
uccuaucccuggacgcaugca

SEQ ID NO: 1542459 - RNA, 22 nt, Homo sapiens
uccuaucccuggacgcaugcag

SEQ ID NO: 1542460 - RNA, 12 nt, Homo sapiens
uccuaugcugca

SEQ ID NO: 1542461 - RNA, 14 nt, Homo sapiens
uccuauuacugaug

SEQ ID NO: 1542462 - RNA, 20 nt, Homo sapiens
uccucagucuuugggggauu

SEQ ID NO: 1542463 - RNA, 16 nt, Homo sapiens
uccucaguuuuuccua

SEQ ID NO: 1542464 - RNA, 18 nt, Homo sapiens
uccucauauacuugaaua

SEQ ID NO: 1542465 - RNA, 22 nt, Homo sapiens
uccucauauacuugaauauuau

SEQ ID NO: 1542466 - RNA, 15 nt, Homo sapiens
uccuccgucaccuca

SEQ ID NO: 1542467 - RNA, 23 nt, Homo sapiens
uccucuuaccuguaauagccuca

SEQ ID NO: 1542468 - RNA, 15 nt, Homo sapiens
uccugucuugcugag

SEQ ID NO: 1542469 - RNA, 16 nt, Homo sapiens
uccuguuccugccaca

SEQ ID NO: 1542470 - RNA, 16 nt, Homo sapiens
uccuuaccgugggcac

SEQ ID NO: 1542471 - RNA, 19 nt, Homo sapiens
uccuuaccgugggcacuga

SEQ ID NO: 1542472 - RNA, 15 nt, Homo sapiens
uccuuucacaaccuu

SEQ ID NO: 1542473 - RNA, 20 nt, Homo sapiens
uccuuuuaucucacaaauaa

SEQ ID NO: 1542474 - RNA, 16 nt, Homo sapiens
uccuuuuguauccucc

SEQ ID NO: 1542475 - RNA, 13 nt, Homo sapiens
ucgaagcucagcc

SEQ ID NO: 1542476 - RNA, 22 nt, Homo sapiens
ucgauauaugacuuuuucucag

SEQ ID NO: 1542477 - RNA, 13 nt, Homo sapiens
ucgccaugugcug

SEQ ID NO: 1542478 - RNA, 14 nt, Homo sapiens
ucgcugagucccag

SEQ ID NO: 1542479 - RNA, 17 nt, Homo sapiens
ucggaauucccugaguc

SEQ ID NO: 1542480 - RNA, 16 nt, Homo sapiens
ucggggagugccacuu

SEQ ID NO: 1542481 - RNA, 19 nt, Homo sapiens
ucguccuuagaauacugua

SEQ ID NO: 1542482 - RNA, 20 nt, Homo sapiens
ucguccuuagaauacuguau

SEQ ID NO: 1542483 - RNA, 17 nt, Homo sapiens
ucuaaaggggacagauc

SEQ ID NO: 1542484 - RNA, 16 nt, Homo sapiens
ucuaacccacccucac

SEQ ID NO: 1542485 - RNA, 19 nt, Homo sapiens
ucuaacuuuugugugaaau

SEQ ID NO: 1542486 - RNA, 18 nt, Homo sapiens
ucuaagcuuauuucuaac

SEQ ID NO: 1542487 - RNA, 17 nt, Homo sapiens
ucuaauaaacacagauu

SEQ ID NO: 1542488 - RNA, 21 nt, Homo sapiens
ucuaauguacaauaaagcaau

SEQ ID NO: 1542489 - RNA, 22 nt, Homo sapiens
ucuacuagaaccuucuaaucca

SEQ ID NO: 1542490 - RNA, 20 nt, Homo sapiens
ucuacuuuccugauguugau

SEQ ID NO: 1542491 - RNA, 13 nt, Homo sapiens
ucuauaccaccuu

SEQ ID NO: 1542492 - RNA, 12 nt, Homo sapiens
ucuaugacucac

SEQ ID NO: 1542493 - RNA, 21 nt, Homo sapiens
ucuauuaccuguuaguauuau

SEQ ID NO: 1542494 - RNA, 21 nt, Homo sapiens
ucucacugaugcccuuuggaa

SEQ ID NO: 1542495 - RNA, 21 nt, Homo sapiens
ucucagcucaucuucacugca

SEQ ID NO: 1542496 - RNA, 18 nt, Homo sapiens
ucuccaaguaaagccacg

SEQ ID NO: 1542497 - RNA, 13 nt, Homo sapiens
ucuccacagggac

SEQ ID NO: 1542498 - RNA, 18 nt, Homo sapiens
ucuccaggauuguccaca

SEQ ID NO: 1542499 - RNA, 22 nt, Homo sapiens
ucuccccaguguaugucuugua

SEQ ID NO: 1542500 - RNA, 17 nt, Homo sapiens
ucucuaaaauucuaguc

SEQ ID NO: 1542501 - RNA, 17 nt, Homo sapiens
ucucuacuuuccugaug

SEQ ID NO: 1542502 - RNA, 18 nt, Homo sapiens
ucucuccuuguucugaua

SEQ ID NO: 1542503 - RNA, 20 nt, Homo sapiens
ucucugucaugugcagauga

SEQ ID NO: 1542504 - RNA, 16 nt, Homo sapiens
ucucugucuggcugua

SEQ ID NO: 1542505 - RNA, 16 nt, Homo sapiens
ucucuguuuacccucc

SEQ ID NO: 1542506 - RNA, 13 nt, Homo sapiens
ucucuucuuccuu

SEQ ID NO: 1542507 - RNA, 15 nt, Homo sapiens
ucugaaggcugaguc

SEQ ID NO: 1542508 - RNA, 19 nt, Homo sapiens
ucugagcaccuacuuacau

SEQ ID NO: 1542509 - RNA, 24 nt, Homo sapiens
ucugagcaccuacuuacaugcauu

SEQ ID NO: 1542510 - RNA, 20 nt, Homo sapiens
ucugauaaugaaaauuauga

SEQ ID NO: 1542511 - RNA, 23 nt, Homo sapiens
ucugcugccaugagaaaagggaa

SEQ ID NO: 1542512 - RNA, 16 nt, Homo sapiens
ucugcuggauucuaaa

SEQ ID NO: 1542513 - RNA, 23 nt, Homo sapiens
ucuguccaucugucuguccuacc

SEQ ID NO: 1542514 - RNA, 21 nt, Homo sapiens
ucuguccccgagccgagcucu

SEQ ID NO: 1542515 - RNA, 15 nt, Homo sapiens
ucugugaaauaucau

SEQ ID NO: 1542516 - RNA, 22 nt, Homo sapiens
ucuguguaguagcucgugugcu

SEQ ID NO: 1542517 - RNA, 19 nt, Homo sapiens
ucuguuugauacaguauua

SEQ ID NO: 1542518 - RNA, 20 nt, Homo sapiens
ucuguuuugcauggaguauu

SEQ ID NO: 1542519 - RNA, 13 nt, Homo sapiens
ucuguuuugccug

SEQ ID NO: 1542520 - RNA, 15 nt, Homo sapiens
ucuuacauuagcagu

SEQ ID NO: 1542521 - RNA, 22 nt, Homo sapiens
ucuuauggaggagaguguuuaa

SEQ ID NO: 1542522 - RNA, 17 nt, Homo sapiens
ucuuauucuugugcacu

SEQ ID NO: 1542523 - RNA, 16 nt, Homo sapiens
ucuuauuuauauauga

SEQ ID NO: 1542524 - RNA, 19 nt, Homo sapiens
aaaaaauaaucaagugcau

SEQ ID NO: 1542525 - RNA, 19 nt, Homo sapiens
aaaaacuauuaacaacuug

SEQ ID NO: 1542526 - RNA, 21 nt, Homo sapiens
aaaaagccccagcccauuccu

SEQ ID NO: 1542527 - RNA, 17 nt, Homo sapiens
aaaaaguuaaucuucau

SEQ ID NO: 1542528 - RNA, 14 nt, Homo sapiens
aaaaauaacaucug

SEQ ID NO: 1542529 - RNA, 20 nt, Homo sapiens
aaaaauaaccaaaaaaugug

SEQ ID NO: 1542530 - RNA, 20 nt, Homo sapiens
aaaaauaguguguccaugca

SEQ ID NO: 1542531 - RNA, 23 nt, Homo sapiens
aaaaauucuagauuaccaugaag

SEQ ID NO: 1542532 - RNA, 23 nt, Homo sapiens
aaaacaaauucaagaaugcagua

SEQ ID NO: 1542533 - RNA, 19 nt, Homo sapiens
aaaacauucuuuaacauac

SEQ ID NO: 1542534 - RNA, 12 nt, Homo sapiens
aaaacuccacuc

SEQ ID NO: 1542535 - RNA, 21 nt, Homo sapiens
aaaagauguugugucuugugu

SEQ ID NO: 1542536 - RNA, 22 nt, Homo sapiens
aaaagguggcccuucacugucc

SEQ ID NO: 1542537 - RNA, 16 nt, Homo sapiens
aaaaguuauugugaua

SEQ ID NO: 1542538 - RNA, 19 nt, Homo sapiens
aaaauacaugguaucucuu

SEQ ID NO: 1542539 - RNA, 22 nt, Homo sapiens
aaaauaguugcaaagcauuuga

SEQ ID NO: 1542540 - RNA, 17 nt, Homo sapiens
aaaauauggacuuccaa

SEQ ID NO: 1542541 - RNA, 18 nt, Homo sapiens
aaaauauggacuuccaau

SEQ ID NO: 1542542 - RNA, 23 nt, Homo sapiens
aaaaucaugcuuauaagcaacau

SEQ ID NO: 1542543 - RNA, 22 nt, Homo sapiens
aaaauccaagcugcucauuuca

SEQ ID NO: 1542544 - RNA, 19 nt, Homo sapiens
aaaaugauuuuuaacauua

SEQ ID NO: 1542545 - RNA, 11 nt, Homo sapiens
aaaaugcaugu

SEQ ID NO: 1542546 - RNA, 14 nt, Homo sapiens
aaaauggacauauu

SEQ ID NO: 1542547 - RNA, 20 nt, Homo sapiens
aaaauucuugggaguguugu

SEQ ID NO: 1542548 - RNA, 14 nt, Homo sapiens
aaacaauucaaaga

SEQ ID NO: 1542549 - RNA, 23 nt, Homo sapiens
aaacacagcugcuuucuucuuac

SEQ ID NO: 1542550 - RNA, 16 nt, Homo sapiens
aaacagggcaucucca

SEQ ID NO: 1542551 - RNA, 12 nt, Homo sapiens
aaacaggugcua

SEQ ID NO: 1542552 - RNA, 19 nt, Homo sapiens
aaacauaauaucuugaaga

SEQ ID NO: 1542553 - RNA, 14 nt, Homo sapiens
aaacauaucuugag

SEQ ID NO: 1542554 - RNA, 13 nt, Homo sapiens
aaacaugcccuca

SEQ ID NO: 1542555 - RNA, 19 nt, Homo sapiens
aaaccaagccguggcuucc

SEQ ID NO: 1542556 - RNA, 13 nt, Homo sapiens
aaaccaaugauuc

SEQ ID NO: 1542557 - RNA, 14 nt, Homo sapiens
aaaccagacucacu

SEQ ID NO: 1542558 - RNA, 22 nt, Homo sapiens
aaaccucuauauguugcugaaa

SEQ ID NO: 1542559 - RNA, 14 nt, Homo sapiens
aaaccuuccauguc

SEQ ID NO: 1542560 - RNA, 19 nt, Homo sapiens
aaagaacucuucuuguaaa

SEQ ID NO: 1542561 - RNA, 19 nt, Homo sapiens
aaagaaucaacagugaaca

SEQ ID NO: 1542562 - RNA, 14 nt, Homo sapiens
aaagacuguuuuca

SEQ ID NO: 1542563 - RNA, 22 nt, Homo sapiens
aaagaguugcaguaaaguucca

SEQ ID NO: 1542564 - RNA, 16 nt, Homo sapiens
aaagaugccguuuaaa

SEQ ID NO: 1542565 - RNA, 16 nt, Homo sapiens
aaagcaaugugguagu

SEQ ID NO: 1542566 - RNA, 12 nt, Homo sapiens
aaagccagugac

SEQ ID NO: 1542567 - RNA, 22 nt, Homo sapiens
aaagccccagcccauuccuccc

SEQ ID NO: 1542568 - RNA, 11 nt, Homo sapiens
aaagccuuccu

SEQ ID NO: 1542569 - RNA, 14 nt, Homo sapiens
aaagccuuccucaa

SEQ ID NO: 1542570 - RNA, 14 nt, Homo sapiens
aaagcuuugaaccc

SEQ ID NO: 1542571 - RNA, 15 nt, Homo sapiens
aaaggaggacaggga

SEQ ID NO: 1542572 - RNA, 19 nt, Homo sapiens
aaaggggacagaucuugag

SEQ ID NO: 1542573 - RNA, 14 nt, Homo sapiens
aaagguuaagccau

SEQ ID NO: 1542574 - RNA, 23 nt, Homo sapiens
aaaguuaccuggaaucaaauaaa

SEQ ID NO: 1542575 - RNA, 13 nt, Homo sapiens
aaauaaagcuuuu

SEQ ID NO: 1542576 - RNA, 18 nt, Homo sapiens
aaauaacugagcacuuug

SEQ ID NO: 1542577 - RNA, 21 nt, Homo sapiens
aaauacaugccuuuccagugc

SEQ ID NO: 1542578 - RNA, 12 nt, Homo sapiens
aaauaugcucuc

SEQ ID NO: 1542579 - RNA, 17 nt, Homo sapiens
aaauaugucacuagaga

SEQ ID NO: 1542580 - RNA, 18 nt, Homo sapiens
aaauaugucacuagagaa

SEQ ID NO: 1542581 - RNA, 15 nt, Homo sapiens
aaauauuauuugcua

SEQ ID NO: 1542582 - RNA, 20 nt, Homo sapiens
aaaucauauuuaccugugaa

SEQ ID NO: 1542583 - RNA, 13 nt, Homo sapiens
aaaucaucaaagu

SEQ ID NO: 1542584 - RNA, 17 nt, Homo sapiens
aaaucgcauuaaugaaa

SEQ ID NO: 1542585 - RNA, 22 nt, Homo sapiens
aaaucucacuuuucuccaugag

SEQ ID NO: 1542586 - RNA, 23 nt, Homo sapiens
aaaucucacuuuucuccaugagu

SEQ ID NO: 1542587 - RNA, 16 nt, Homo sapiens
aaaugaauaaugccuu

SEQ ID NO: 1542588 - RNA, 17 nt, Homo sapiens
aaaugcaaagcacaccu

SEQ ID NO: 1542589 - RNA, 13 nt, Homo sapiens
aaauggaacauua

SEQ ID NO: 1542590 - RNA, 17 nt, Homo sapiens
aaauguuauaggcacuu

SEQ ID NO: 1542591 - RNA, 12 nt, Homo sapiens
aaauguuugaua

SEQ ID NO: 1542592 - RNA, 18 nt, Homo sapiens
aaauguuuggccaugcuu

SEQ ID NO: 1542593 - RNA, 13 nt, Homo sapiens
aaauuaagcuuaa

SEQ ID NO: 1542594 - RNA, 14 nt, Homo sapiens
aaauuaagcuuaaa

SEQ ID NO: 1542595 - RNA, 15 nt, Homo sapiens
aaauuaugauaagga

SEQ ID NO: 1542596 - RNA, 21 nt, Homo sapiens
aaauuauguuuuaauuccaag

SEQ ID NO: 1542597 - RNA, 14 nt, Homo sapiens
aaauucuagucucu

SEQ ID NO: 1542598 - RNA, 20 nt, Homo sapiens
aaauugaguucuuccuguaa

SEQ ID NO: 1542599 - RNA, 18 nt, Homo sapiens
aaauugaugauccauuaa

SEQ ID NO: 1542600 - RNA, 17 nt, Homo sapiens
aaauuguuuuucugaaa

SEQ ID NO: 1542601 - RNA, 20 nt, Homo sapiens
aaauuuacaguuacugccua

SEQ ID NO: 1542602 - RNA, 22 nt, Homo sapiens
aaauuugggggacuuacaugau

SEQ ID NO: 1542603 - RNA, 19 nt, Homo sapiens
aaauuuucucucacugaug

SEQ ID NO: 1542604 - RNA, 19 nt, Homo sapiens
aacaauaaaaguguccauu

SEQ ID NO: 1542605 - RNA, 16 nt, Homo sapiens
aacaauuucugugucc

SEQ ID NO: 1542606 - RNA, 13 nt, Homo sapiens
aacacaaauccaa

SEQ ID NO: 1542607 - RNA, 19 nt, Homo sapiens
aacacacuuaucugucucu

SEQ ID NO: 1542608 - RNA, 16 nt, Homo sapiens
aacacagaacucagcc

SEQ ID NO: 1542609 - RNA, 16 nt, Homo sapiens
aacaccaccaaaugac

SEQ ID NO: 1542610 - RNA, 13 nt, Homo sapiens
aacacuuauuuuc

SEQ ID NO: 1542611 - RNA, 13 nt, Homo sapiens
aacauaucuugag

SEQ ID NO: 1542612 - RNA, 20 nt, Homo sapiens
aacauaugcauuaugaaguu

SEQ ID NO: 1542613 - RNA, 19 nt, Homo sapiens
aacauuaugagagacugcu

SEQ ID NO: 1542614 - RNA, 21 nt, Homo sapiens
aacauucuauuucaacuucag

SEQ ID NO: 1542615 - RNA, 19 nt, Homo sapiens
aacauuugggagacugagc

SEQ ID NO: 1542616 - RNA, 16 nt, Homo sapiens
aaccaacgggucugug

SEQ ID NO: 1542617 - RNA, 9 nt, Homo sapiens
aaccaauga

SEQ ID NO: 1542618 - RNA, 19 nt, Homo sapiens
aaccacccuaucaucaguu

SEQ ID NO: 1542619 - RNA, 21 nt, Homo sapiens
aaccagggggaagcaccagcc

SEQ ID NO: 1542620 - RNA, 12 nt, Homo sapiens
agagccuggaag

SEQ ID NO: 1542621 - RNA, 14 nt, Homo sapiens
agagcucaggagaa

SEQ ID NO: 1542622 - RNA, 20 nt, Homo sapiens
agagcuccacagaagacacg

SEQ ID NO: 1542623 - RNA, 15 nt, Homo sapiens
agagcucccaggacg

SEQ ID NO: 1542624 - RNA, 19 nt, Homo sapiens
agagcuuuacagugccacg

SEQ ID NO: 1542625 - RNA, 20 nt, Homo sapiens
agaggaaaaaggcuucucca

SEQ ID NO: 1542626 - RNA, 22 nt, Homo sapiens
agaggaauccagugaauguucc

SEQ ID NO: 1542627 - RNA, 17 nt, Homo sapiens
agaggacaguuuaggac

SEQ ID NO: 1542628 - RNA, 19 nt, Homo sapiens
agaggagcguguccuaucc

SEQ ID NO: 1542629 - RNA, 21 nt, Homo sapiens
agaggagugggaaauugauua

SEQ ID NO: 1542630 - RNA, 17 nt, Homo sapiens
agaggaucggaggcuug

SEQ ID NO: 1542631 - RNA, 16 nt, Homo sapiens
agaggcccaagcugcc

SEQ ID NO: 1542632 - RNA, 20 nt, Homo sapiens
agaggcucuaauguacaaua

SEQ ID NO: 1542633 - RNA, 19 nt, Homo sapiens
agaggcuuccuucauuucc

SEQ ID NO: 1542634 - RNA, 17 nt, Homo sapiens
agaggggcggggccagg

SEQ ID NO: 1542635 - RNA, 18 nt, Homo sapiens
agagggggcgaagggauc

SEQ ID NO: 1542636 - RNA, 20 nt, Homo sapiens
agagguggaacuuaauuacc

SEQ ID NO: 1542637 - RNA, 17 nt, Homo sapiens
agaguagauugauucac

SEQ ID NO: 1542638 - RNA, 16 nt, Homo sapiens
agagucuuaauauaua

SEQ ID NO: 1542639 - RNA, 12 nt, Homo sapiens
agagugcauaua

SEQ ID NO: 1542640 - RNA, 18 nt, Homo sapiens
agaguguuuuuucuguca

SEQ ID NO: 1542641 - RNA, 12 nt, Homo sapiens
agauaaauccaa

SEQ ID NO: 1542642 - RNA, 16 nt, Homo sapiens
agauaaauguccauuc

SEQ ID NO: 1542643 - RNA, 18 nt, Homo sapiens
agauauucauacuuucca

SEQ ID NO: 1542644 - RNA, 24 nt, Homo sapiens
agaucagcauucaaaauaguucua

SEQ ID NO: 1542645 - RNA, 15 nt, Homo sapiens
agauccugucuugcu

SEQ ID NO: 1542646 - RNA, 21 nt, Homo sapiens
agauccugucuugcugaggga

SEQ ID NO: 1542647 - RNA, 17 nt, Homo sapiens
agaucuaaucccuucaa

SEQ ID NO: 1542648 - RNA, 18 nt, Homo sapiens
agaucuuggcccuguuaa

SEQ ID NO: 1542649 - RNA, 14 nt, Homo sapiens
agauguagcacuga

SEQ ID NO: 1542650 - RNA, 16 nt, Homo sapiens
agaugugccuagacac

SEQ ID NO: 1542651 - RNA, 23 nt, Homo sapiens
agauguuuguuuucaaaauacuu

SEQ ID NO: 1542652 - RNA, 22 nt, Homo sapiens
agauucaauuaaguuauuaaca

SEQ ID NO: 1542653 - RNA, 19 nt, Homo sapiens
agauucaggcuugcauuaa

SEQ ID NO: 1542654 - RNA, 17 nt, Homo sapiens
agauugauuaaugaacu

SEQ ID NO: 1542655 - RNA, 18 nt, Homo sapiens
agauugauuaaugaacua

SEQ ID NO: 1542656 - RNA, 23 nt, Homo sapiens
agauugcucuggggcuugcuauu

SEQ ID NO: 1542657 - RNA, 19 nt, Homo sapiens
agcaagcucacuugcuuua

SEQ ID NO: 1542658 - RNA, 20 nt, Homo sapiens
agcaaguauauuuauuucua

SEQ ID NO: 1542659 - RNA, 23 nt, Homo sapiens
agcacaaggagugcccgccuuga

SEQ ID NO: 1542660 - RNA, 20 nt, Homo sapiens
agcacagauucaagugcaau

SEQ ID NO: 1542661 - RNA, 13 nt, Homo sapiens
agcacagccucac

SEQ ID NO: 1542662 - RNA, 20 nt, Homo sapiens
agcaccuacuuacaugcauu

SEQ ID NO: 1542663 - RNA, 21 nt, Homo sapiens
agcaccuacuuacaugcauua

SEQ ID NO: 1542664 - RNA, 13 nt, Homo sapiens
agcagaaccaaag

SEQ ID NO: 1542665 - RNA, 11 nt, Homo sapiens
agcagccucag

SEQ ID NO: 1542666 - RNA, 18 nt, Homo sapiens
agcagccucaggcccaau

SEQ ID NO: 1542667 - RNA, 20 nt, Homo sapiens
agcaggaaggucucaugccu

SEQ ID NO: 1542668 - RNA, 15 nt, Homo sapiens
agcaguguuagcuua

SEQ ID NO: 1542669 - RNA, 22 nt, Homo sapiens
agcaguuugcuuuguaugcacu

SEQ ID NO: 1542670 - RNA, 15 nt, Homo sapiens
agcaucaaccuagga

SEQ ID NO: 1542671 - RNA, 14 nt, Homo sapiens
agcaucagcaagac

SEQ ID NO: 1542672 - RNA, 22 nt, Homo sapiens
agcaucucagcucaucuucacu

SEQ ID NO: 1542673 - RNA, 21 nt, Homo sapiens
agcaucugccaggacacugcc

SEQ ID NO: 1542674 - RNA, 14 nt, Homo sapiens
agcaugagccagcu

SEQ ID NO: 1542675 - RNA, 22 nt, Homo sapiens
agcauguguuaaucuuaaugua

SEQ ID NO: 1542676 - RNA, 17 nt, Homo sapiens
agccaaaaguaagugga

SEQ ID NO: 1542677 - RNA, 23 nt, Homo sapiens
agccaagucagcuuugccuucca

SEQ ID NO: 1542678 - RNA, 19 nt, Homo sapiens
agccacuuauuuccaugga

SEQ ID NO: 1542679 - RNA, 19 nt, Homo sapiens
agccagaggcucuaaugua

SEQ ID NO: 1542680 - RNA, 23 nt, Homo sapiens
agccagaggcucuaauguacaau

SEQ ID NO: 1542681 - RNA, 18 nt, Homo sapiens
agccaggguuccagacag

SEQ ID NO: 1542682 - RNA, 20 nt, Homo sapiens
agccauauauuuucugagua

SEQ ID NO: 1542683 - RNA, 15 nt, Homo sapiens
agccauaugacaauu

SEQ ID NO: 1542684 - RNA, 18 nt, Homo sapiens
agccaucugcgacaccac

SEQ ID NO: 1542685 - RNA, 15 nt, Homo sapiens
agccauucacaacac

SEQ ID NO: 1542686 - RNA, 19 nt, Homo sapiens
agcccacugccuggaaagc

SEQ ID NO: 1542687 - RNA, 15 nt, Homo sapiens
agcccucucacugug

SEQ ID NO: 1542688 - RNA, 21 nt, Homo sapiens
agccgcuggugcccaccagcu

SEQ ID NO: 1542689 - RNA, 11 nt, Homo sapiens
agccuauggca

SEQ ID NO: 1542690 - RNA, 19 nt, Homo sapiens
agccugcguggccuggggc

SEQ ID NO: 1542691 - RNA, 12 nt, Homo sapiens
agccugcucccu

SEQ ID NO: 1542692 - RNA, 17 nt, Homo sapiens
agccugcucccuagcca

SEQ ID NO: 1542693 - RNA, 21 nt, Homo sapiens
agccuggcacagggcaguggg

SEQ ID NO: 1542694 - RNA, 18 nt, Homo sapiens
agccugguggcaauaagg

SEQ ID NO: 1542695 - RNA, 15 nt, Homo sapiens
agccuuccucaagau

SEQ ID NO: 1542696 - RNA, 18 nt, Homo sapiens
agccuuggaccaaaugga

SEQ ID NO: 1542697 - RNA, 19 nt, Homo sapiens
agccuuuuauuaacauaua

SEQ ID NO: 1542698 - RNA, 14 nt, Homo sapiens
agcggcuuccccau

SEQ ID NO: 1542699 - RNA, 18 nt, Homo sapiens
agcgucuuuuuaaccuca

SEQ ID NO: 1542700 - RNA, 16 nt, Homo sapiens
agcguguacuacccca

SEQ ID NO: 1542701 - RNA, 21 nt, Homo sapiens
agcuaaaaccuuccaugucaa

SEQ ID NO: 1542702 - RNA, 16 nt, Homo sapiens
agcuaaacaugcugcc

SEQ ID NO: 1542703 - RNA, 16 nt, Homo sapiens
agcuaagccugaugau

SEQ ID NO: 1542704 - RNA, 12 nt, Homo sapiens
agcuaugaaggc

SEQ ID NO: 1542705 - RNA, 22 nt, Homo sapiens
agcuaugaaggcuguacacugc

SEQ ID NO: 1542706 - RNA, 23 nt, Homo sapiens
agcucaaaguacuacagcaaagc

SEQ ID NO: 1542707 - RNA, 18 nt, Homo sapiens
agcucaggcccuggugag

SEQ ID NO: 1542708 - RNA, 12 nt, Homo sapiens
agcuccacagaa

SEQ ID NO: 1542709 - RNA, 15 nt, Homo sapiens
agcucccagaacuuc

SEQ ID NO: 1542710 - RNA, 17 nt, Homo sapiens
agcucuccugggccagg

SEQ ID NO: 1542711 - RNA, 17 nt, Homo sapiens
agcucugugggagacca

SEQ ID NO: 1542712 - RNA, 21 nt, Homo sapiens
agcugaagcguuacuacagca

SEQ ID NO: 1542713 - RNA, 15 nt, Homo sapiens
agcugagauggaacc

SEQ ID NO: 1542714 - RNA, 19 nt, Homo sapiens
agcugccccuucugaggau

SEQ ID NO: 1542715 - RNA, 15 nt, Homo sapiens
agcuggcaggagggu

SEQ ID NO: 1542716 - RNA, 22 nt, Homo sapiens
agcugucucaaaccuccaaaag

SEQ ID NO: 1542717 - RNA, 22 nt, Homo sapiens
agcugugugugcccguggugag

SEQ ID NO: 1542718 - RNA, 23 nt, Homo sapiens
agcuuauuuguauuuuuccucuu

SEQ ID NO: 1542719 - RNA, 13 nt, Homo sapiens
agcuucaaaacag

SEQ ID NO: 1542720 - RNA, 24 nt, Homo sapiens
agcuuggccagaagggggccauga

SEQ ID NO: 1542721 - RNA, 23 nt, Homo sapiens
agcuuguccaacaacuccaggaa

SEQ ID NO: 1542722 - RNA, 15 nt, Homo sapiens
agcuuuacagugcca

SEQ ID NO: 1542723 - RNA, 16 nt, Homo sapiens
agcuuuacagugccac

SEQ ID NO: 1542724 - RNA, 16 nt, Homo sapiens
aggaaaauauugacaa

SEQ ID NO: 1542725 - RNA, 20 nt, Homo sapiens
aggaaaauauugacaaguuu

SEQ ID NO: 1542726 - RNA, 20 nt, Homo sapiens
aggaacugguccaggccagg

SEQ ID NO: 1542727 - RNA, 16 nt, Homo sapiens
aggaagcaaggccagc

SEQ ID NO: 1542728 - RNA, 15 nt, Homo sapiens
aggaagccacgugcu

SEQ ID NO: 1542729 - RNA, 23 nt, Homo sapiens
aggaaggaugaauaaguuuuauu

SEQ ID NO: 1542730 - RNA, 20 nt, Homo sapiens
aggaagggaagagcauguaa

SEQ ID NO: 1542731 - RNA, 20 nt, Homo sapiens
aggaagggaccccacuggaa

SEQ ID NO: 1542732 - RNA, 18 nt, Homo sapiens
aggaagggacugguccag

SEQ ID NO: 1542733 - RNA, 17 nt, Homo sapiens
aggaaucaaaaauugaa

SEQ ID NO: 1542734 - RNA, 13 nt, Homo sapiens
aggaauggugcuu

SEQ ID NO: 1542735 - RNA, 12 nt, Homo sapiens
aggacagcauua

SEQ ID NO: 1542736 - RNA, 13 nt, Homo sapiens
aggaccucugggg

SEQ ID NO: 1542737 - RNA, 15 nt, Homo sapiens
aggacucccugcuua

SEQ ID NO: 1542738 - RNA, 10 nt, Homo sapiens
aggagaagac

SEQ ID NO: 1542739 - RNA, 21 nt, Homo sapiens
aggagccuauggcaucuuccc

SEQ ID NO: 1542740 - RNA, 18 nt, Homo sapiens
aggagcgggaccuguggc

SEQ ID NO: 1542741 - RNA, 13 nt, Homo sapiens
aggagcguguacu

SEQ ID NO: 1542742 - RNA, 13 nt, Homo sapiens
aggagcguguccu

SEQ ID NO: 1542743 - RNA, 22 nt, Homo sapiens
aggaggaccuggggggggcaag

SEQ ID NO: 1542744 - RNA, 20 nt, Homo sapiens
aggaggcuuacaacuccugc

SEQ ID NO: 1542745 - RNA, 22 nt, Homo sapiens
aggaguccaguuugugcaagac

SEQ ID NO: 1542746 - RNA, 20 nt, Homo sapiens
aggaucuucccacuuugcca

SEQ ID NO: 1542747 - RNA, 13 nt, Homo sapiens
aggaugaacaguu

SEQ ID NO: 1542748 - RNA, 21 nt, Homo sapiens
aggaugauaaaagcacuuacu

SEQ ID NO: 1542749 - RNA, 17 nt, Homo sapiens
cacaggagcguguccua

SEQ ID NO: 1542750 - RNA, 13 nt, Homo sapiens
cacagggacacag

SEQ ID NO: 1542751 - RNA, 13 nt, Homo sapiens
cacaggggagcag

SEQ ID NO: 1542752 - RNA, 15 nt, Homo sapiens
cacagucauguguca

SEQ ID NO: 1542753 - RNA, 16 nt, Homo sapiens
cacaugguuuccaagg

SEQ ID NO: 1542754 - RNA, 15 nt, Homo sapiens
cacauguaucuaugc

SEQ ID NO: 1542755 - RNA, 16 nt, Homo sapiens
caccaagccacugaua

SEQ ID NO: 1542756 - RNA, 14 nt, Homo sapiens
caccauguaugugg

SEQ ID NO: 1542757 - RNA, 14 nt, Homo sapiens
cacccaccuggauu

SEQ ID NO: 1542758 - RNA, 13 nt, Homo sapiens
cacccaugccaua

SEQ ID NO: 1542759 - RNA, 14 nt, Homo sapiens
cacccaugccauag

SEQ ID NO: 1542760 - RNA, 15 nt, Homo sapiens
caccccuaaagagau

SEQ ID NO: 1542761 - RNA, 15 nt, Homo sapiens
cacccuaucaucagu

SEQ ID NO: 1542762 - RNA, 14 nt, Homo sapiens
caccgagacaguug

SEQ ID NO: 1542763 - RNA, 17 nt, Homo sapiens
caccuacuuacaugcau

SEQ ID NO: 1542764 - RNA, 18 nt, Homo sapiens
caccucugugccaccucu

SEQ ID NO: 1542765 - RNA, 14 nt, Homo sapiens
caccugugcugcug

SEQ ID NO: 1542766 - RNA, 19 nt, Homo sapiens
caccuugcccaugcacaag

SEQ ID NO: 1542767 - RNA, 22 nt, Homo sapiens
cacgauaugcaaguucauccaa

SEQ ID NO: 1542768 - RNA, 18 nt, Homo sapiens
cacgccacaacuccagug

SEQ ID NO: 1542769 - RNA, 16 nt, Homo sapiens
cacgccuguaauccca

SEQ ID NO: 1542770 - RNA, 16 nt, Homo sapiens
cacguauguuauacaa

SEQ ID NO: 1542771 - RNA, 20 nt, Homo sapiens
cacguguccccagagcuuua

SEQ ID NO: 1542772 - RNA, 14 nt, Homo sapiens
cacguuugccaaau

SEQ ID NO: 1542773 - RNA, 18 nt, Homo sapiens
cacucuccugaggagcag

SEQ ID NO: 1542774 - RNA, 20 nt, Homo sapiens
cacucucuucuuacuguauu

SEQ ID NO: 1542775 - RNA, 13 nt, Homo sapiens
cacucuguuccug

SEQ ID NO: 1542776 - RNA, 23 nt, Homo sapiens
cacugaguagucauuuugcccau

SEQ ID NO: 1542777 - RNA, 18 nt, Homo sapiens
cacugaugcccuuuggaa

SEQ ID NO: 1542778 - RNA, 20 nt, Homo sapiens
cacugcacagugcaucucag

SEQ ID NO: 1542779 - RNA, 20 nt, Homo sapiens
cacugcugaaccuuuccucu

SEQ ID NO: 1542780 - RNA, 18 nt, Homo sapiens
cacuggaggccucugcaa

SEQ ID NO: 1542781 - RNA, 13 nt, Homo sapiens
cacugguuuucaa

SEQ ID NO: 1542782 - RNA, 14 nt, Homo sapiens
cacuguccauucca

SEQ ID NO: 1542783 - RNA, 15 nt, Homo sapiens
cacuuauuuccaugg

SEQ ID NO: 1542784 - RNA, 16 nt, Homo sapiens
cacuuauuuccaugga

SEQ ID NO: 1542785 - RNA, 17 nt, Homo sapiens
cacuuccuguccagaga

SEQ ID NO: 1542786 - RNA, 18 nt, Homo sapiens
cacuugacuuugccacau

SEQ ID NO: 1542787 - RNA, 21 nt, Homo sapiens
cacuuugcagaccugggacuu

SEQ ID NO: 1542788 - RNA, 16 nt, Homo sapiens
cacuuugccacuggau

SEQ ID NO: 1542789 - RNA, 13 nt, Homo sapiens
cacuuuguuucau

SEQ ID NO: 1542790 - RNA, 16 nt, Homo sapiens
cacuuuucauaucauu

SEQ ID NO: 1542791 - RNA, 16 nt, Homo sapiens
cagaaaacauaugcau

SEQ ID NO: 1542792 - RNA, 23 nt, Homo sapiens
cagaaauugaccugauuuccauu

SEQ ID NO: 1542793 - RNA, 13 nt, Homo sapiens
cagaaccaaagca

SEQ ID NO: 1542794 - RNA, 17 nt, Homo sapiens
cagaacucagccuuaag

SEQ ID NO: 1542795 - RNA, 14 nt, Homo sapiens
cagaacugucuuag

SEQ ID NO: 1542796 - RNA, 13 nt, Homo sapiens
cagaaggacucag

SEQ ID NO: 1542797 - RNA, 18 nt, Homo sapiens
cagaagggggccaugagg

SEQ ID NO: 1542798 - RNA, 15 nt, Homo sapiens
cagaaguggcaggag

SEQ ID NO: 1542799 - RNA, 19 nt, Homo sapiens
cagaaucaaaucugagccu

SEQ ID NO: 1542800 - RNA, 16 nt, Homo sapiens
cagaccucggcugugu

SEQ ID NO: 1542801 - RNA, 15 nt, Homo sapiens
cagagacccccgugc

SEQ ID NO: 1542802 - RNA, 18 nt, Homo sapiens
cagagagacccugccaac

SEQ ID NO: 1542803 - RNA, 22 nt, Homo sapiens
cagagagagaagugccccugcu

SEQ ID NO: 1542804 - RNA, 14 nt, Homo sapiens
cagagcagaaccaa

SEQ ID NO: 1542805 - RNA, 11 nt, Homo sapiens
cagagcuccac

SEQ ID NO: 1542806 - RNA, 17 nt, Homo sapiens
cagagcuuuacagugcc

SEQ ID NO: 1542807 - RNA, 23 nt, Homo sapiens
cagagcuuuacagugccacgaca

SEQ ID NO: 1542808 - RNA, 17 nt, Homo sapiens
cagagucaaaagaacuc

SEQ ID NO: 1542809 - RNA, 15 nt, Homo sapiens
cagauggggccucug

SEQ ID NO: 1542810 - RNA, 17 nt, Homo sapiens
cagauugcggugugaga

SEQ ID NO: 1542811 - RNA, 17 nt, Homo sapiens
cagcaacccuccuauca

SEQ ID NO: 1542812 - RNA, 14 nt, Homo sapiens
cagcaauagcaucc

SEQ ID NO: 1542813 - RNA, 18 nt, Homo sapiens
cagcaaugccugccugaa

SEQ ID NO: 1542814 - RNA, 21 nt, Homo sapiens
cagcacaauuaugugugaagc

SEQ ID NO: 1542815 - RNA, 23 nt, Homo sapiens
cagcacccaugccccacucugcu

SEQ ID NO: 1542816 - RNA, 18 nt, Homo sapiens
cagcacuuuguuucauau

SEQ ID NO: 1542817 - RNA, 18 nt, Homo sapiens
cagcagggccacugagua

SEQ ID NO: 1542818 - RNA, 22 nt, Homo sapiens
cagcagguugugugugugugca

SEQ ID NO: 1542819 - RNA, 18 nt, Homo sapiens
cagcaucugccaggacac

SEQ ID NO: 1542820 - RNA, 15 nt, Homo sapiens
cagcaugauguguug

SEQ ID NO: 1542821 - RNA, 17 nt, Homo sapiens
cagcauucucacuccua

SEQ ID NO: 1542822 - RNA, 16 nt, Homo sapiens
cagccacuuauuucca

SEQ ID NO: 1542823 - RNA, 20 nt, Homo sapiens
cagcccauuccucccauuca

SEQ ID NO: 1542824 - RNA, 19 nt, Homo sapiens
cagccccacuccacaguua

SEQ ID NO: 1542825 - RNA, 17 nt, Homo sapiens
cagccugcagacucacu

SEQ ID NO: 1542826 - RNA, 11 nt, Homo sapiens
cagcuagacac

SEQ ID NO: 1542827 - RNA, 16 nt, Homo sapiens
cagcugcuucugccca

SEQ ID NO: 1542828 - RNA, 20 nt, Homo sapiens
cagcuguccacugggccauu

SEQ ID NO: 1542829 - RNA, 14 nt, Homo sapiens
cagcuuaugagcuc

SEQ ID NO: 1542830 - RNA, 19 nt, Homo sapiens
caggaaccauggaccugca

SEQ ID NO: 1542831 - RNA, 16 nt, Homo sapiens
caggaagggaccccac

SEQ ID NO: 1542832 - RNA, 16 nt, Homo sapiens
caggaagucaggagcc

SEQ ID NO: 1542833 - RNA, 13 nt, Homo sapiens
caggacagcauua

SEQ ID NO: 1542834 - RNA, 18 nt, Homo sapiens
caggacauucaccaagcc

SEQ ID NO: 1542835 - RNA, 18 nt, Homo sapiens
caggagcauguccuaucc

SEQ ID NO: 1542836 - RNA, 15 nt, Homo sapiens
caggagcguguccua

SEQ ID NO: 1542837 - RNA, 18 nt, Homo sapiens
caggagcguguccuaucc

SEQ ID NO: 1542838 - RNA, 19 nt, Homo sapiens
caggagcguguccuauccc

SEQ ID NO: 1542839 - RNA, 19 nt, Homo sapiens
caggauaccauauacagcu

SEQ ID NO: 1542840 - RNA, 17 nt, Homo sapiens
caggaugaacuagccau

SEQ ID NO: 1542841 - RNA, 16 nt, Homo sapiens
caggcagcugcaguua

SEQ ID NO: 1542842 - RNA, 17 nt, Homo sapiens
caggcaguucccagaaa

SEQ ID NO: 1542843 - RNA, 13 nt, Homo sapiens
caggccaccugcc

SEQ ID NO: 1542844 - RNA, 22 nt, Homo sapiens
caggcccaauucugccacuucu

SEQ ID NO: 1542845 - RNA, 18 nt, Homo sapiens
caggcccuuccucuccac

SEQ ID NO: 1542846 - RNA, 17 nt, Homo sapiens
caggcucccacugcccc

SEQ ID NO: 1542847 - RNA, 14 nt, Homo sapiens
caggcuugcauuaa

SEQ ID NO: 1542848 - RNA, 20 nt, Homo sapiens
cagggaaucagggagcacug

SEQ ID NO: 1542849 - RNA, 17 nt, Homo sapiens
cagggccccugaaguga

SEQ ID NO: 1542850 - RNA, 21 nt, Homo sapiens
cagggcucaugauuuuuuaca

SEQ ID NO: 1542851 - RNA, 17 nt, Homo sapiens
cagggggaagcaccagc

SEQ ID NO: 1542852 - RNA, 22 nt, Homo sapiens
cagggugcucccuccucagucu

SEQ ID NO: 1542853 - RNA, 17 nt, Homo sapiens
caggguguuaaggcagu

SEQ ID NO: 1542854 - RNA, 18 nt, Homo sapiens
caggguuggggugguuuu

SEQ ID NO: 1542855 - RNA, 19 nt, Homo sapiens
cagguggccagggcuccac

SEQ ID NO: 1542856 - RNA, 20 nt, Homo sapiens
caggugugagccacccugcc

SEQ ID NO: 1542857 - RNA, 21 nt, Homo sapiens
cagguugugugugugugcagu

SEQ ID NO: 1542858 - RNA, 23 nt, Homo sapiens
cagguugugugugugugcaguga

SEQ ID NO: 1542859 - RNA, 19 nt, Homo sapiens
caguaaauauuaaccugaa

SEQ ID NO: 1542860 - RNA, 16 nt, Homo sapiens
caguacuugugaaaca

SEQ ID NO: 1542861 - RNA, 17 nt, Homo sapiens
caguagugccugugauc

SEQ ID NO: 1542862 - RNA, 21 nt, Homo sapiens
cagucacuuguuuguguuuga

SEQ ID NO: 1542863 - RNA, 19 nt, Homo sapiens
cagucccucccuccuggcu

SEQ ID NO: 1542864 - RNA, 21 nt, Homo sapiens
cagucccucugagugaagucc

SEQ ID NO: 1542865 - RNA, 15 nt, Homo sapiens
cagugacacaacuca

SEQ ID NO: 1542866 - RNA, 19 nt, Homo sapiens
cagugacacaacucaucca

SEQ ID NO: 1542867 - RNA, 17 nt, Homo sapiens
cagugacccuggagcua

SEQ ID NO: 1542868 - RNA, 17 nt, Homo sapiens
cagugacuuuagaaaca

SEQ ID NO: 1542869 - RNA, 22 nt, Homo sapiens
cagugggcccuggcucugucac

SEQ ID NO: 1542870 - RNA, 13 nt, Homo sapiens
caguguuagcuua

SEQ ID NO: 1542871 - RNA, 13 nt, Homo sapiens
caguucugaugag

SEQ ID NO: 1542872 - RNA, 16 nt, Homo sapiens
caguuugccucugcac

SEQ ID NO: 1542873 - RNA, 20 nt, Homo sapiens
caguuugcuuuguaugcacu

SEQ ID NO: 1542874 - RNA, 18 nt, Homo sapiens
caguuuguccacacaaga

SEQ ID NO: 1542875 - RNA, 14 nt, Homo sapiens
cauaaaaaagggac

SEQ ID NO: 1542876 - RNA, 19 nt, Homo sapiens
cauaaaacuucugauuucu

SEQ ID NO: 1542877 - RNA, 13 nt, Homo sapiens
cauaaaucugucu

SEQ ID NO: 1542878 - RNA, 23 nt, Homo sapiens
cauaaugugaauaugccagugac

SEQ ID NO: 1542879 - RNA, 21 nt, Homo sapiens
cauacaccuaugucauuucau

SEQ ID NO: 1542880 - RNA, 11 nt, Homo sapiens
ucugucuucaa

SEQ ID NO: 1542881 - RNA, 23 nt, Homo sapiens
ucugugaaagucuccuguaucau

SEQ ID NO: 1542882 - RNA, 17 nt, Homo sapiens
ucuguguaaucucugau

SEQ ID NO: 1542883 - RNA, 15 nt, Homo sapiens
ucuguuaaaugaacu

SEQ ID NO: 1542884 - RNA, 19 nt, Homo sapiens
ucuguucauuuccucaaaa

SEQ ID NO: 1542885 - RNA, 12 nt, Homo sapiens
ucuguuccacau

SEQ ID NO: 1542886 - RNA, 15 nt, Homo sapiens
ucuguuccacauaua

SEQ ID NO: 1542887 - RNA, 14 nt, Homo sapiens
ucuguuucaaggaa

SEQ ID NO: 1542888 - RNA, 13 nt, Homo sapiens
ucuuaacuauccu

SEQ ID NO: 1542889 - RNA, 14 nt, Homo sapiens
ucuuauacagauaa

SEQ ID NO: 1542890 - RNA, 22 nt, Homo sapiens
ucuuauuuaaauuuucagaaag

SEQ ID NO: 1542891 - RNA, 20 nt, Homo sapiens
ucuuauuuuagacaaccaua

SEQ ID NO: 1542892 - RNA, 11 nt, Homo sapiens
ucuucauggcc

SEQ ID NO: 1542893 - RNA, 18 nt, Homo sapiens
ucuuccagugauguugaa

SEQ ID NO: 1542894 - RNA, 13 nt, Homo sapiens
ucuuccaucugau

SEQ ID NO: 1542895 - RNA, 16 nt, Homo sapiens
ucuucccacuuugcca

SEQ ID NO: 1542896 - RNA, 19 nt, Homo sapiens
ucuuccuauuuuaaugaau

SEQ ID NO: 1542897 - RNA, 15 nt, Homo sapiens
ucuuccucuuaccug

SEQ ID NO: 1542898 - RNA, 14 nt, Homo sapiens
ucuucuccacugga

SEQ ID NO: 1542899 - RNA, 16 nt, Homo sapiens
ucuucugagcaccuac

SEQ ID NO: 1542900 - RNA, 21 nt, Homo sapiens
ucuugaagggcaggugcuuca

SEQ ID NO: 1542901 - RNA, 20 nt, Homo sapiens
ucuugagauguauuaugcaa

SEQ ID NO: 1542902 - RNA, 16 nt, Homo sapiens
ucuuggaauacuugaa

SEQ ID NO: 1542903 - RNA, 13 nt, Homo sapiens
ucuuggauuggua

SEQ ID NO: 1542904 - RNA, 18 nt, Homo sapiens
ucuuggggugcagcacuu

SEQ ID NO: 1542905 - RNA, 24 nt, Homo sapiens
ucuuuaccuugcauuuuagcuaau

SEQ ID NO: 1542906 - RNA, 18 nt, Homo sapiens
ucuuuagcuauuacugga

SEQ ID NO: 1542907 - RNA, 15 nt, Homo sapiens
ucuuuucagcuuguu

SEQ ID NO: 1542908 - RNA, 12 nt, Homo sapiens
ucuuuuuacaau

SEQ ID NO: 1542909 - RNA, 21 nt, Homo sapiens
ugaaaaacuauuaacaacuug

SEQ ID NO: 1542910 - RNA, 22 nt, Homo sapiens
ugaaaaauaguguguccaugca

SEQ ID NO: 1542911 - RNA, 20 nt, Homo sapiens
ugaaaaccacccuaucauca

SEQ ID NO: 1542912 - RNA, 14 nt, Homo sapiens
ugaaacacagucau

SEQ ID NO: 1542913 - RNA, 14 nt, Homo sapiens
ugaaaccacuggaa

SEQ ID NO: 1542914 - RNA, 21 nt, Homo sapiens
ugaaacugacuugcugugacu

SEQ ID NO: 1542915 - RNA, 19 nt, Homo sapiens
ugaaagaguaaaaccaaag

SEQ ID NO: 1542916 - RNA, 14 nt, Homo sapiens
ugaaagguaaucug

SEQ ID NO: 1542917 - RNA, 13 nt, Homo sapiens
ugaaauaucauca

SEQ ID NO: 1542918 - RNA, 14 nt, Homo sapiens
ugaaaucagccuug

SEQ ID NO: 1542919 - RNA, 13 nt, Homo sapiens
ugaaauucacaaa

SEQ ID NO: 1542920 - RNA, 18 nt, Homo sapiens
ugaacuguaaauauguca

SEQ ID NO: 1542921 - RNA, 20 nt, Homo sapiens
ugaagaagaaaacaugucug

SEQ ID NO: 1542922 - RNA, 16 nt, Homo sapiens
ugaagaauauuguuaa

SEQ ID NO: 1542923 - RNA, 17 nt, Homo sapiens
ugaagcguuacuacagc

SEQ ID NO: 1542924 - RNA, 19 nt, Homo sapiens
ugaagggccccuugcaaag

SEQ ID NO: 1542925 - RNA, 11 nt, Homo sapiens
ugaaguggcac

SEQ ID NO: 1542926 - RNA, 18 nt, Homo sapiens
ugaauaaagccacauaac

SEQ ID NO: 1542927 - RNA, 16 nt, Homo sapiens
ugaauagcgcccucaa

SEQ ID NO: 1542928 - RNA, 16 nt, Homo sapiens
ugaauauuauacuucu

SEQ ID NO: 1542929 - RNA, 17 nt, Homo sapiens
ugaauauuauacuucuu

SEQ ID NO: 1542930 - RNA, 18 nt, Homo sapiens
ugaauccucucucugugu

SEQ ID NO: 1542931 - RNA, 22 nt, Homo sapiens
ugaaugccaguccagaugugcc

SEQ ID NO: 1542932 - RNA, 11 nt, Homo sapiens
ugaaugugauu

SEQ ID NO: 1542933 - RNA, 16 nt, Homo sapiens
ugaauguuaaugguca

SEQ ID NO: 1542934 - RNA, 21 nt, Homo sapiens
ugaauuaagaacugacacaaa

SEQ ID NO: 1542935 - RNA, 13 nt, Homo sapiens
ugaauuuugccau

SEQ ID NO: 1542936 - RNA, 23 nt, Homo sapiens
ugacaagguguuucucuguaaaa

SEQ ID NO: 1542937 - RNA, 18 nt, Homo sapiens
ugacacaacucauccaga

SEQ ID NO: 1542938 - RNA, 21 nt, Homo sapiens
ugacacagcugagcuggccua

SEQ ID NO: 1542939 - RNA, 20 nt, Homo sapiens
ugacaugcacaguuugcaau

SEQ ID NO: 1542940 - RNA, 20 nt, Homo sapiens
ugaccauaaaauuagacaua

SEQ ID NO: 1542941 - RNA, 19 nt, Homo sapiens
ugacccuggagcccggcag

SEQ ID NO: 1542942 - RNA, 14 nt, Homo sapiens
ugaccucaacaaag

SEQ ID NO: 1542943 - RNA, 19 nt, Homo sapiens
ugaccugauuuccauuugc

SEQ ID NO: 1542944 - RNA, 20 nt, Homo sapiens
ugacuaaaccauugugcauu

SEQ ID NO: 1542945 - RNA, 22 nt, Homo sapiens
ugacuucuuuacuaacacuggc

SEQ ID NO: 1542946 - RNA, 23 nt, Homo sapiens
ugacuucuuuacuaacacuggcu

SEQ ID NO: 1542947 - RNA, 20 nt, Homo sapiens
ugagaugauuuccaagccuc

SEQ ID NO: 1542948 - RNA, 14 nt, Homo sapiens
ugagauguguauca

SEQ ID NO: 1542949 - RNA, 18 nt, Homo sapiens
ugagcaauaugucaguca

SEQ ID NO: 1542950 - RNA, 19 nt, Homo sapiens
ugagcaguuguuauauuca

SEQ ID NO: 1542951 - RNA, 14 nt, Homo sapiens
ugagccaaaaacaa

SEQ ID NO: 1542952 - RNA, 22 nt, Homo sapiens
ugagccuuuuauuaacauauau

SEQ ID NO: 1542953 - RNA, 16 nt, Homo sapiens
ugagcucaaaguacua

SEQ ID NO: 1542954 - RNA, 14 nt, Homo sapiens
ugagcuugauucua

SEQ ID NO: 1542955 - RNA, 20 nt, Homo sapiens
ugaggucaucccggggccau

SEQ ID NO: 1542956 - RNA, 15 nt, Homo sapiens
ugagguuaaggggau

SEQ ID NO: 1542957 - RNA, 15 nt, Homo sapiens
ugagguugugcugcc

SEQ ID NO: 1542958 - RNA, 19 nt, Homo sapiens
ugaguugcacagcuaugaa

SEQ ID NO: 1542959 - RNA, 22 nt, Homo sapiens
ugaguugcacagcuaugaaggc

SEQ ID NO: 1542960 - RNA, 14 nt, Homo sapiens
ugauaaauuugacu

SEQ ID NO: 1542961 - RNA, 16 nt, Homo sapiens
ugaucaaagcaccuug

SEQ ID NO: 1542962 - RNA, 21 nt, Homo sapiens
ugauccauuaaguaaacaaua

SEQ ID NO: 1542963 - RNA, 20 nt, Homo sapiens
ugaucgauguuaaacgucac

SEQ ID NO: 1542964 - RNA, 16 nt, Homo sapiens
ugaucuauaccaccuu

SEQ ID NO: 1542965 - RNA, 16 nt, Homo sapiens
ugaucuuggcacaaau

SEQ ID NO: 1542966 - RNA, 10 nt, Homo sapiens
ugaugaauaa

SEQ ID NO: 1542967 - RNA, 15 nt, Homo sapiens
ugaugugaguugcac

SEQ ID NO: 1542968 - RNA, 17 nt, Homo sapiens
ugauucucaugcacugc

SEQ ID NO: 1542969 - RNA, 20 nt, Homo sapiens
ugauugaaucugauuggaca

SEQ ID NO: 1542970 - RNA, 17 nt, Homo sapiens
ugauugcaggaagggaa

SEQ ID NO: 1542971 - RNA, 12 nt, Homo sapiens
ugauugugaacu

SEQ ID NO: 1542972 - RNA, 16 nt, Homo sapiens
ugauuuccauuugcaa

SEQ ID NO: 1542973 - RNA, 19 nt, Homo sapiens
ugcaaaagguggcccuuca

SEQ ID NO: 1542974 - RNA, 19 nt, Homo sapiens
ugcaacaggaagacacugg

SEQ ID NO: 1542975 - RNA, 11 nt, Homo sapiens
ugcaagggaau

SEQ ID NO: 1542976 - RNA, 13 nt, Homo sapiens
ugcaagucccaug

SEQ ID NO: 1542977 - RNA, 17 nt, Homo sapiens
ugcacacaccugcacac

SEQ ID NO: 1542978 - RNA, 15 nt, Homo sapiens
ugcacagcaucucag

SEQ ID NO: 1542979 - RNA, 15 nt, Homo sapiens
ugcacagcuaugaag

SEQ ID NO: 1542980 - RNA, 15 nt, Homo sapiens
ugcacaguuugcaau

SEQ ID NO: 1542981 - RNA, 22 nt, Homo sapiens
ugcacauuagagggacagccaa

SEQ ID NO: 1542982 - RNA, 24 nt, Homo sapiens
ugcacauuagagggacagccaaaa

SEQ ID NO: 1542983 - RNA, 15 nt, Homo sapiens
ugcagaccugggacu

SEQ ID NO: 1542984 - RNA, 14 nt, Homo sapiens
ugcaggguaggggg

SEQ ID NO: 1542985 - RNA, 15 nt, Homo sapiens
ugcaggguccccaag

SEQ ID NO: 1542986 - RNA, 21 nt, Homo sapiens
ugcaguaaaguuccaugaaga

SEQ ID NO: 1542987 - RNA, 21 nt, Homo sapiens
ugcauaaaugugguacaagca

SEQ ID NO: 1542988 - RNA, 18 nt, Homo sapiens
ugcauaaccgcacagaca

SEQ ID NO: 1542989 - RNA, 16 nt, Homo sapiens
ugcauacauucuucaa

SEQ ID NO: 1542990 - RNA, 14 nt, Homo sapiens
ugcaucuccacuug

SEQ ID NO: 1542991 - RNA, 15 nt, Homo sapiens
ugcauggaguauuau

SEQ ID NO: 1542992 - RNA, 20 nt, Homo sapiens
ugcauuacugcaugcacuuc

SEQ ID NO: 1542993 - RNA, 15 nt, Homo sapiens
ugcauucguccuuag

SEQ ID NO: 1542994 - RNA, 21 nt, Homo sapiens
ugcauuucuucacgcaccucg

SEQ ID NO: 1542995 - RNA, 17 nt, Homo sapiens
ugccaaauccugggcau

SEQ ID NO: 1542996 - RNA, 22 nt, Homo sapiens
ugccacauggagcuugacuuca

SEQ ID NO: 1542997 - RNA, 18 nt, Homo sapiens
ugccaccucucacacugg

SEQ ID NO: 1542998 - RNA, 17 nt, Homo sapiens
ugccacggcagccaccc

SEQ ID NO: 1542999 - RNA, 19 nt, Homo sapiens
ugccacugcuuucauugaa

SEQ ID NO: 1543000 - RNA, 16 nt, Homo sapiens
ugccaggacacugccu

SEQ ID NO: 1543001 - RNA, 17 nt, Homo sapiens
ugccaggacacugccuu

SEQ ID NO: 1543002 - RNA, 15 nt, Homo sapiens
ugccaggggcaguga

SEQ ID NO: 1543003 - RNA, 21 nt, Homo sapiens
ugccauaguuugaauucaugc

SEQ ID NO: 1543004 - RNA, 20 nt, Homo sapiens
ugccaucagccccugcugcu

SEQ ID NO: 1543005 - RNA, 21 nt, Homo sapiens
ugccauuagacugaauuuaac

SEQ ID NO: 1543006 - RNA, 12 nt, Homo sapiens
ugcccaccagcu

SEQ ID NO: 1543007 - RNA, 21 nt, Homo sapiens
ugcccaccccgccucugggcu

SEQ ID NO: 1543008 - RNA, 20 nt, Homo sapiens
ugcccaggcuggagugcagu

SEQ ID NO: 1543009 - RNA, 19 nt, Homo sapiens
ugcccauauuaaaaagcca

SEQ ID NO: 1543010 - RNA, 14 nt, Homo sapiens
auucuggugucuaa

SEQ ID NO: 1543011 - RNA, 16 nt, Homo sapiens
auucuucaagauccca

SEQ ID NO: 1543012 - RNA, 22 nt, Homo sapiens
auucuuugaccucaaccuguga

SEQ ID NO: 1543013 - RNA, 23 nt, Homo sapiens
auugaacuguaaauaugucacua

SEQ ID NO: 1543014 - RNA, 20 nt, Homo sapiens
auugaagacccucaaugcca

SEQ ID NO: 1543015 - RNA, 16 nt, Homo sapiens
auugaaggauugugaa

SEQ ID NO: 1543016 - RNA, 18 nt, Homo sapiens
auugaauguuaaugguca

SEQ ID NO: 1543017 - RNA, 15 nt, Homo sapiens
auugaccuuuaggua

SEQ ID NO: 1543018 - RNA, 21 nt, Homo sapiens
auugacuuuuuuugagcgaca

SEQ ID NO: 1543019 - RNA, 18 nt, Homo sapiens
auugagaucagcauucaa

SEQ ID NO: 1543020 - RNA, 23 nt, Homo sapiens
auugagccuuuuauuaacauaua

SEQ ID NO: 1543021 - RNA, 15 nt, Homo sapiens
auugauuaaugaacu

SEQ ID NO: 1543022 - RNA, 22 nt, Homo sapiens
auugauuaaugaacuauuguua

SEQ ID NO: 1543023 - RNA, 13 nt, Homo sapiens
auuggcagaagca

SEQ ID NO: 1543024 - RNA, 20 nt, Homo sapiens
auuggcagcuucaaaacaga

SEQ ID NO: 1543025 - RNA, 13 nt, Homo sapiens
auugucaccauga

SEQ ID NO: 1543026 - RNA, 23 nt, Homo sapiens
auugugguuuauugaaugugauu

SEQ ID NO: 1543027 - RNA, 18 nt, Homo sapiens
auuguuacagguguacua

SEQ ID NO: 1543028 - RNA, 14 nt, Homo sapiens
auuguugcauuaaa

SEQ ID NO: 1543029 - RNA, 19 nt, Homo sapiens
auuuaaaaaaaaacauuca

SEQ ID NO: 1543030 - RNA, 15 nt, Homo sapiens
auuuaaacuucuuaa

SEQ ID NO: 1543031 - RNA, 14 nt, Homo sapiens
auuuacacugacug

SEQ ID NO: 1543032 - RNA, 23 nt, Homo sapiens
auuuagauauucauacuuuccaa

SEQ ID NO: 1543033 - RNA, 14 nt, Homo sapiens
auuuauuucuagca

SEQ ID NO: 1543034 - RNA, 19 nt, Homo sapiens
auuucaaccgcuugccaua

SEQ ID NO: 1543035 - RNA, 15 nt, Homo sapiens
auuucauaaacaacu

SEQ ID NO: 1543036 - RNA, 15 nt, Homo sapiens
auuuccuuaaagcaa

SEQ ID NO: 1543037 - RNA, 15 nt, Homo sapiens
auuucucacacucua

SEQ ID NO: 1543038 - RNA, 22 nt, Homo sapiens
auuucucacacucuaacuguau

SEQ ID NO: 1543039 - RNA, 21 nt, Homo sapiens
auuucuuuuuuaaaugaagaa

SEQ ID NO: 1543040 - RNA, 16 nt, Homo sapiens
auuugugauacuuccu

SEQ ID NO: 1543041 - RNA, 14 nt, Homo sapiens
auuuuaaaugcugu

SEQ ID NO: 1543042 - RNA, 18 nt, Homo sapiens
auuuuaacauaggcaaga

SEQ ID NO: 1543043 - RNA, 18 nt, Homo sapiens
auuuuaauguaaaauuca

SEQ ID NO: 1543044 - RNA, 17 nt, Homo sapiens
auuuuaucucuucuucc

SEQ ID NO: 1543045 - RNA, 13 nt, Homo sapiens
auuuuauuucaau

SEQ ID NO: 1543046 - RNA, 22 nt, Homo sapiens
auuuucccuucgauauaugacu

SEQ ID NO: 1543047 - RNA, 20 nt, Homo sapiens
auuuucugcaucuccacuug

SEQ ID NO: 1543048 - RNA, 16 nt, Homo sapiens
auuuuggccacacugu

SEQ ID NO: 1543049 - RNA, 12 nt, Homo sapiens
auuuuucugcac

SEQ ID NO: 1543050 - RNA, 16 nt, Homo sapiens
auuuuuuacuacauaa

SEQ ID NO: 1543051 - RNA, 12 nt, Homo sapiens
caaaagguuaag

SEQ ID NO: 1543052 - RNA, 11 nt, Homo sapiens
caaaauacuuc

SEQ ID NO: 1543053 - RNA, 22 nt, Homo sapiens
caaaauaguucuauuucuaucu

SEQ ID NO: 1543054 - RNA, 20 nt, Homo sapiens
caaaaugaaugccaguccag

SEQ ID NO: 1543055 - RNA, 16 nt, Homo sapiens
caaaaugauauucaau

SEQ ID NO: 1543056 - RNA, 15 nt, Homo sapiens
caaacaaaaacuguu

SEQ ID NO: 1543057 - RNA, 17 nt, Homo sapiens
caaaccuccaaaagccc

SEQ ID NO: 1543058 - RNA, 19 nt, Homo sapiens
caaacuccauucuccaggg

SEQ ID NO: 1543059 - RNA, 13 nt, Homo sapiens
caaaggacaguac

SEQ ID NO: 1543060 - RNA, 22 nt, Homo sapiens
caaaggccguuagggaaaucca

SEQ ID NO: 1543061 - RNA, 16 nt, Homo sapiens
caaagucucaaugaaa

SEQ ID NO: 1543062 - RNA, 15 nt, Homo sapiens
caaauaaguuacccu

SEQ ID NO: 1543063 - RNA, 17 nt, Homo sapiens
caaauagcccacacgug

SEQ ID NO: 1543064 - RNA, 20 nt, Homo sapiens
caaauggcuaccguuuuaca

SEQ ID NO: 1543065 - RNA, 19 nt, Homo sapiens
caaauggcuuguucaguca

SEQ ID NO: 1543066 - RNA, 21 nt, Homo sapiens
caaauuauguuuuaauuccaa

SEQ ID NO: 1543067 - RNA, 16 nt, Homo sapiens
caacagugaacagcuu

SEQ ID NO: 1543068 - RNA, 14 nt, Homo sapiens
caacccugccccug

SEQ ID NO: 1543069 - RNA, 19 nt, Homo sapiens
caaccuccccugguccugc

SEQ ID NO: 1543070 - RNA, 20 nt, Homo sapiens
caaccuguugaauuuacucu

SEQ ID NO: 1543071 - RNA, 15 nt, Homo sapiens
caaccuuuuaugugu

SEQ ID NO: 1543072 - RNA, 14 nt, Homo sapiens
caacgaaaagcaca

SEQ ID NO: 1543073 - RNA, 13 nt, Homo sapiens
caacugagccaaa

SEQ ID NO: 1543074 - RNA, 13 nt, Homo sapiens
caacuuacauaug

SEQ ID NO: 1543075 - RNA, 19 nt, Homo sapiens
caacuugaaauuauaucug

SEQ ID NO: 1543076 - RNA, 12 nt, Homo sapiens
caagacagcaga

SEQ ID NO: 1543077 - RNA, 14 nt, Homo sapiens
caagaccccaaagg

SEQ ID NO: 1543078 - RNA, 19 nt, Homo sapiens
caagacuuccucaugaauc

SEQ ID NO: 1543079 - RNA, 15 nt, Homo sapiens
caagaucccauuuga

SEQ ID NO: 1543080 - RNA, 22 nt, Homo sapiens
caagcacgcacacacacgcaaa

SEQ ID NO: 1543081 - RNA, 16 nt, Homo sapiens
caagcuuagaagccac

SEQ ID NO: 1543082 - RNA, 14 nt, Homo sapiens
caaggaaaauggac

SEQ ID NO: 1543083 - RNA, 15 nt, Homo sapiens
caaggaaaauggaca

SEQ ID NO: 1543084 - RNA, 21 nt, Homo sapiens
caaggccuaugccaccugcag

SEQ ID NO: 1543085 - RNA, 17 nt, Homo sapiens
caaggggucugcuccug

SEQ ID NO: 1543086 - RNA, 18 nt, Homo sapiens
caauaaacgaaacacaga

SEQ ID NO: 1543087 - RNA, 17 nt, Homo sapiens
caauaaacucagucaaa

SEQ ID NO: 1543088 - RNA, 14 nt, Homo sapiens
caauagguauuucu

SEQ ID NO: 1543089 - RNA, 18 nt, Homo sapiens
caauccuuuauagcuuug

SEQ ID NO: 1543090 - RNA, 16 nt, Homo sapiens
caaugauucauaacaa

SEQ ID NO: 1543091 - RNA, 18 nt, Homo sapiens
caaugccugccugaacaa

SEQ ID NO: 1543092 - RNA, 16 nt, Homo sapiens
caauggagacugucuc

SEQ ID NO: 1543093 - RNA, 14 nt, Homo sapiens
caauggcuggguuu

SEQ ID NO: 1543094 - RNA, 22 nt, Homo sapiens
caauuaacuccguuuccaaaua

SEQ ID NO: 1543095 - RNA, 18 nt, Homo sapiens
caauuagauaaaugucca

SEQ ID NO: 1543096 - RNA, 15 nt, Homo sapiens
caauuggacaauuau

SEQ ID NO: 1543097 - RNA, 21 nt, Homo sapiens
caauugucauuuauaaaacca

SEQ ID NO: 1543098 - RNA, 12 nt, Homo sapiens
cacaaauuguac

SEQ ID NO: 1543099 - RNA, 16 nt, Homo sapiens
cacaacuccaguguuc

SEQ ID NO: 1543100 - RNA, 19 nt, Homo sapiens
cacaauaaaagacauccac

SEQ ID NO: 1543101 - RNA, 14 nt, Homo sapiens
cacacacacacaua

SEQ ID NO: 1543102 - RNA, 21 nt, Homo sapiens
cacacucucuucuuacuguau

SEQ ID NO: 1543103 - RNA, 18 nt, Homo sapiens
cacacugugcguuuuaga

SEQ ID NO: 1543104 - RNA, 14 nt, Homo sapiens
cacacuuccugucc

SEQ ID NO: 1543105 - RNA, 13 nt, Homo sapiens
cacagagaccccc

SEQ ID NO: 1543106 - RNA, 15 nt, Homo sapiens
cacagcaguacuugc

SEQ ID NO: 1543107 - RNA, 22 nt, Homo sapiens
cacagcaguacuugcucaauaa

SEQ ID NO: 1543108 - RNA, 11 nt, Homo sapiens
cacagccagaa

SEQ ID NO: 1543109 - RNA, 13 nt, Homo sapiens
cacagcuaugaag

SEQ ID NO: 1543110 - RNA, 15 nt, Homo sapiens
cacagcuaugaaggc

SEQ ID NO: 1543111 - RNA, 16 nt, Homo sapiens
cacaggagcguguacu

SEQ ID NO: 1543112 - RNA, 17 nt, Homo sapiens
cacaggagcguguacua

SEQ ID NO: 1543113 - RNA, 14 nt, Homo sapiens
cacagggacacagu

SEQ ID NO: 1543114 - RNA, 12 nt, Homo sapiens
cacaguuugcaa

SEQ ID NO: 1543115 - RNA, 15 nt, Homo sapiens
cacauccaacauuuc

SEQ ID NO: 1543116 - RNA, 22 nt, Homo sapiens
cacaugcauggcauuuguucca

SEQ ID NO: 1543117 - RNA, 21 nt, Homo sapiens
cacauguccuauuacugaugu

SEQ ID NO: 1543118 - RNA, 19 nt, Homo sapiens
cacauuuuaacauaggcaa

SEQ ID NO: 1543119 - RNA, 17 nt, Homo sapiens
caccaacucucucugcc

SEQ ID NO: 1543120 - RNA, 19 nt, Homo sapiens
caccaagcuuagaagccac

SEQ ID NO: 1543121 - RNA, 13 nt, Homo sapiens
caccaaggcugcc

SEQ ID NO: 1543122 - RNA, 19 nt, Homo sapiens
caccagccucagugcagcc

SEQ ID NO: 1543123 - RNA, 19 nt, Homo sapiens
cacccaccuggauucccug

SEQ ID NO: 1543124 - RNA, 13 nt, Homo sapiens
cacccauaucaug

SEQ ID NO: 1543125 - RNA, 14 nt, Homo sapiens
caccccucaagcca

SEQ ID NO: 1543126 - RNA, 22 nt, Homo sapiens
caccccuccaugauuccaaggg

SEQ ID NO: 1543127 - RNA, 16 nt, Homo sapiens
caccguaguaacacau

SEQ ID NO: 1543128 - RNA, 20 nt, Homo sapiens
caccucagagacauacaccu

SEQ ID NO: 1543129 - RNA, 21 nt, Homo sapiens
caccuguauaauguuuuguaa

SEQ ID NO: 1543130 - RNA, 15 nt, Homo sapiens
cacgcaaauacaugc

SEQ ID NO: 1543131 - RNA, 19 nt, Homo sapiens
cacgccugguucuguacau

SEQ ID NO: 1543132 - RNA, 22 nt, Homo sapiens
cacgccugguucuguacaugug

SEQ ID NO: 1543133 - RNA, 18 nt, Homo sapiens
cacgugcacacaccugca

SEQ ID NO: 1543134 - RNA, 19 nt, Homo sapiens
cacguggaggaaugcuccc

SEQ ID NO: 1543135 - RNA, 20 nt, Homo sapiens
cacguguuuuuguaucuuua

SEQ ID NO: 1543136 - RNA, 18 nt, Homo sapiens
cacuaaaaggaagacagu

SEQ ID NO: 1543137 - RNA, 15 nt, Homo sapiens
agggugucuguaauc

SEQ ID NO: 1543138 - RNA, 22 nt, Homo sapiens
agguaguagaaucucagcacuu

SEQ ID NO: 1543139 - RNA, 23 nt, Homo sapiens
agguaguagaaucucagcacuuu

SEQ ID NO: 1543140 - RNA, 15 nt, Homo sapiens
agguauauaccucca

SEQ ID NO: 1543141 - RNA, 13 nt, Homo sapiens
aggucucaugccu

SEQ ID NO: 1543142 - RNA, 21 nt, Homo sapiens
aggucuccaccccucaagcca

SEQ ID NO: 1543143 - RNA, 23 nt, Homo sapiens
aggucuccaccccucaagccagg

SEQ ID NO: 1543144 - RNA, 15 nt, Homo sapiens
agguggccacuccag

SEQ ID NO: 1543145 - RNA, 18 nt, Homo sapiens
agguggcccuucacuguc

SEQ ID NO: 1543146 - RNA, 13 nt, Homo sapiens
aggugucucucac

SEQ ID NO: 1543147 - RNA, 21 nt, Homo sapiens
agguuauuaugauuagcuuug

SEQ ID NO: 1543148 - RNA, 14 nt, Homo sapiens
agguugaaaauguu

SEQ ID NO: 1543149 - RNA, 23 nt, Homo sapiens
agguugucugaagucacugcaca

SEQ ID NO: 1543150 - RNA, 15 nt, Homo sapiens
aguaaaugcuaccuc

SEQ ID NO: 1543151 - RNA, 18 nt, Homo sapiens
aguaacucaucugucacc

SEQ ID NO: 1543152 - RNA, 17 nt, Homo sapiens
aguacaaccacuaucuu

SEQ ID NO: 1543153 - RNA, 12 nt, Homo sapiens
aguagcauauau

SEQ ID NO: 1543154 - RNA, 19 nt, Homo sapiens
aguagcuguggggagcugg

SEQ ID NO: 1543155 - RNA, 22 nt, Homo sapiens
aguaguagacuguaaaagauuc

SEQ ID NO: 1543156 - RNA, 14 nt, Homo sapiens
aguauauagccuua

SEQ ID NO: 1543157 - RNA, 20 nt, Homo sapiens
aguauuauuguugcauuaaa

SEQ ID NO: 1543158 - RNA, 23 nt, Homo sapiens
agucacugcacagugcaucucag

SEQ ID NO: 1543159 - RNA, 20 nt, Homo sapiens
agucagacuuacuuacuccc

SEQ ID NO: 1543160 - RNA, 17 nt, Homo sapiens
aguccagaugugccuag

SEQ ID NO: 1543161 - RNA, 11 nt, Homo sapiens
aguccagugac

SEQ ID NO: 1543162 - RNA, 15 nt, Homo sapiens
aguccauugcaaaag

SEQ ID NO: 1543163 - RNA, 18 nt, Homo sapiens
agucucauuacagauuua

SEQ ID NO: 1543164 - RNA, 14 nt, Homo sapiens
agucucuaugaucu

SEQ ID NO: 1543165 - RNA, 18 nt, Homo sapiens
agucucuaugaucuuggc

SEQ ID NO: 1543166 - RNA, 20 nt, Homo sapiens
agucugugaauaaagccaca

SEQ ID NO: 1543167 - RNA, 15 nt, Homo sapiens
agugacaugcggcug

SEQ ID NO: 1543168 - RNA, 21 nt, Homo sapiens
agugaccaggcucacaacugu

SEQ ID NO: 1543169 - RNA, 19 nt, Homo sapiens
agugaccccagcuccaggc

SEQ ID NO: 1543170 - RNA, 20 nt, Homo sapiens
agugaccccagcuccaggca

SEQ ID NO: 1543171 - RNA, 20 nt, Homo sapiens
agugacuuuagaaacaaauu

SEQ ID NO: 1543172 - RNA, 17 nt, Homo sapiens
agugagaaaacugugac

SEQ ID NO: 1543173 - RNA, 20 nt, Homo sapiens
agugagaugucagacaaauu

SEQ ID NO: 1543174 - RNA, 22 nt, Homo sapiens
agugauuuuggccacacuguca

SEQ ID NO: 1543175 - RNA, 23 nt, Homo sapiens
agugauuuuggccacacugucaa

SEQ ID NO: 1543176 - RNA, 16 nt, Homo sapiens
agugcacagcugucca

SEQ ID NO: 1543177 - RNA, 13 nt, Homo sapiens
agugccugugauc

SEQ ID NO: 1543178 - RNA, 18 nt, Homo sapiens
aguggcaccuaauaaaga

SEQ ID NO: 1543179 - RNA, 18 nt, Homo sapiens
aguggcagcaacaaagga

SEQ ID NO: 1543180 - RNA, 20 nt, Homo sapiens
aguggugcgaucuuggcuca

SEQ ID NO: 1543181 - RNA, 15 nt, Homo sapiens
agugucccuuaccug

SEQ ID NO: 1543182 - RNA, 13 nt, Homo sapiens
aguuaaucuucau

SEQ ID NO: 1543183 - RNA, 12 nt, Homo sapiens
aguucaaauacu

SEQ ID NO: 1543184 - RNA, 21 nt, Homo sapiens
aguucacaggccagaaaacau

SEQ ID NO: 1543185 - RNA, 18 nt, Homo sapiens
aguucuauuucuaucugc

SEQ ID NO: 1543186 - RNA, 21 nt, Homo sapiens
aguucucuuuugauguagguu

SEQ ID NO: 1543187 - RNA, 16 nt, Homo sapiens
aguucugaaaacuguu

SEQ ID NO: 1543188 - RNA, 12 nt, Homo sapiens
aguucugaugag

SEQ ID NO: 1543189 - RNA, 16 nt, Homo sapiens
aguugcaaagcauuug

SEQ ID NO: 1543190 - RNA, 12 nt, Homo sapiens
aguugcaauaaa

SEQ ID NO: 1543191 - RNA, 17 nt, Homo sapiens
aguugcacagcaucuca

SEQ ID NO: 1543192 - RNA, 20 nt, Homo sapiens
aguuuaaaaaucaguuuguu

SEQ ID NO: 1543193 - RNA, 23 nt, Homo sapiens
aguuuccagcuaagccugaugau

SEQ ID NO: 1543194 - RNA, 22 nt, Homo sapiens
aguuugcaaucuuauguugauc

SEQ ID NO: 1543195 - RNA, 17 nt, Homo sapiens
aguuugcuuuguaugca

SEQ ID NO: 1543196 - RNA, 18 nt, Homo sapiens
aguuugggugucugcuaa

SEQ ID NO: 1543197 - RNA, 17 nt, Homo sapiens
aguuugugcaagacacc

SEQ ID NO: 1543198 - RNA, 15 nt, Homo sapiens
aguuuguuguucaga

SEQ ID NO: 1543199 - RNA, 22 nt, Homo sapiens
aguuuguuguucagaagaaaga

SEQ ID NO: 1543200 - RNA, 14 nt, Homo sapiens
aguuuuuccuaguc

SEQ ID NO: 1543201 - RNA, 21 nt, Homo sapiens
auaaaaccaucaaaaauauuc

SEQ ID NO: 1543202 - RNA, 15 nt, Homo sapiens
auaaaagacaugaaa

SEQ ID NO: 1543203 - RNA, 17 nt, Homo sapiens
auaaaagcacuuacuuc

SEQ ID NO: 1543204 - RNA, 13 nt, Homo sapiens
auaaaauuuugca

SEQ ID NO: 1543205 - RNA, 21 nt, Homo sapiens
auaaacaacuuaauguucuga

SEQ ID NO: 1543206 - RNA, 15 nt, Homo sapiens
auaaacacagauuau

SEQ ID NO: 1543207 - RNA, 16 nt, Homo sapiens
auaaagaaauaauacc

SEQ ID NO: 1543208 - RNA, 17 nt, Homo sapiens
auaaagaagaaaauaac

SEQ ID NO: 1543209 - RNA, 23 nt, Homo sapiens
auaaagccuugugaucacuuucu

SEQ ID NO: 1543210 - RNA, 21 nt, Homo sapiens
auaaauaaagaagaaaauaac

SEQ ID NO: 1543211 - RNA, 16 nt, Homo sapiens
auaaauccaacucuga

SEQ ID NO: 1543212 - RNA, 21 nt, Homo sapiens
auaaauuggugauaaguggaa

SEQ ID NO: 1543213 - RNA, 14 nt, Homo sapiens
auaaccgcacagac

SEQ ID NO: 1543214 - RNA, 23 nt, Homo sapiens
auaacuaauacagcugagcuaug

SEQ ID NO: 1543215 - RNA, 15 nt, Homo sapiens
auaacugagcacuuu

SEQ ID NO: 1543216 - RNA, 13 nt, Homo sapiens
auaagaagcaaau

SEQ ID NO: 1543217 - RNA, 22 nt, Homo sapiens
auaaggaguugccgcauauuau

SEQ ID NO: 1543218 - RNA, 15 nt, Homo sapiens
auaauugacaaacuu

SEQ ID NO: 1543219 - RNA, 15 nt, Homo sapiens
auaauuggaguagau

SEQ ID NO: 1543220 - RNA, 17 nt, Homo sapiens
auaauuuagauauucau

SEQ ID NO: 1543221 - RNA, 18 nt, Homo sapiens
auacaauuaaagcuguua

SEQ ID NO: 1543222 - RNA, 14 nt, Homo sapiens
auacacacacacac

SEQ ID NO: 1543223 - RNA, 23 nt, Homo sapiens
auacacuguaucuaaaaaauaac

SEQ ID NO: 1543224 - RNA, 20 nt, Homo sapiens
auacaugccuuuccagugcu

SEQ ID NO: 1543225 - RNA, 16 nt, Homo sapiens
auacauucuucaagau

SEQ ID NO: 1543226 - RNA, 22 nt, Homo sapiens
auacauuuggcuccacuguaaa

SEQ ID NO: 1543227 - RNA, 21 nt, Homo sapiens
auaccauuuuauauuucauca

SEQ ID NO: 1543228 - RNA, 14 nt, Homo sapiens
auacuaaauaugaa

SEQ ID NO: 1543229 - RNA, 18 nt, Homo sapiens
auacugguuauaguugau

SEQ ID NO: 1543230 - RNA, 19 nt, Homo sapiens
auacuucuuuuucauuauu

SEQ ID NO: 1543231 - RNA, 12 nt, Homo sapiens
auagaaacugag

SEQ ID NO: 1543232 - RNA, 14 nt, Homo sapiens
auagauuagaucaa

SEQ ID NO: 1543233 - RNA, 22 nt, Homo sapiens
auagauuuucauguucuugcag

SEQ ID NO: 1543234 - RNA, 18 nt, Homo sapiens
auagccucaccuucccua

SEQ ID NO: 1543235 - RNA, 17 nt, Homo sapiens
auagcuuaagaaguauc

SEQ ID NO: 1543236 - RNA, 15 nt, Homo sapiens
auaggauauacugua

SEQ ID NO: 1543237 - RNA, 17 nt, Homo sapiens
auaggauauacuguaug

SEQ ID NO: 1543238 - RNA, 17 nt, Homo sapiens
auagggcuucugccuaa

SEQ ID NO: 1543239 - RNA, 14 nt, Homo sapiens
auaguguguccaug

SEQ ID NO: 1543240 - RNA, 18 nt, Homo sapiens
auauauuuccacuucuuc

SEQ ID NO: 1543241 - RNA, 23 nt, Homo sapiens
auaucauucacccaaaacaaagu

SEQ ID NO: 1543242 - RNA, 15 nt, Homo sapiens
auaucccgggagcag

SEQ ID NO: 1543243 - RNA, 17 nt, Homo sapiens
auauccuuggcacaucc

SEQ ID NO: 1543244 - RNA, 15 nt, Homo sapiens
auaucuguggucuuc

SEQ ID NO: 1543245 - RNA, 20 nt, Homo sapiens
auaucuugaagaauauuguu

SEQ ID NO: 1543246 - RNA, 21 nt, Homo sapiens
auaugauaaauuugacuguua

SEQ ID NO: 1543247 - RNA, 16 nt, Homo sapiens
auauggaaauccuguu

SEQ ID NO: 1543248 - RNA, 15 nt, Homo sapiens
auauggacuuccaau

SEQ ID NO: 1543249 - RNA, 19 nt, Homo sapiens
auauguacaguuauacaua

SEQ ID NO: 1543250 - RNA, 19 nt, Homo sapiens
auauuagccaaagaggcau

SEQ ID NO: 1543251 - RNA, 23 nt, Homo sapiens
auauuauauaaauaguauuucag

SEQ ID NO: 1543252 - RNA, 18 nt, Homo sapiens
auauuccauccauauacu

SEQ ID NO: 1543253 - RNA, 22 nt, Homo sapiens
auauucccaugguagacuguga

SEQ ID NO: 1543254 - RNA, 21 nt, Homo sapiens
aucaccuccccuccuugccuc

SEQ ID NO: 1543255 - RNA, 15 nt, Homo sapiens
aucagaguaugucag

SEQ ID NO: 1543256 - RNA, 12 nt, Homo sapiens
auccaacgugaa

SEQ ID NO: 1543257 - RNA, 20 nt, Homo sapiens
auccauacaaaacuaucggu

SEQ ID NO: 1543258 - RNA, 14 nt, Homo sapiens
auccaugugcugcu

SEQ ID NO: 1543259 - RNA, 23 nt, Homo sapiens
auccaugugcugcuguggcauca

SEQ ID NO: 1543260 - RNA, 21 nt, Homo sapiens
auccuccuucacucccuguca

SEQ ID NO: 1543261 - RNA, 17 nt, Homo sapiens
auccugacaaaagggac

SEQ ID NO: 1543262 - RNA, 21 nt, Homo sapiens
auccuuguugacacggccaug

SEQ ID NO: 1543263 - RNA, 13 nt, Homo sapiens
aucuaaaucuuca

SEQ ID NO: 1543264 - RNA, 18 nt, Homo sapiens
aucuacugagacaugacu

SEQ ID NO: 1543265 - RNA, 18 nt, Homo sapiens
aucuagaggcuuccuuca

SEQ ID NO: 1543266 - RNA, 20 nt, Homo sapiens
aucuagcaagaagauucuaa

SEQ ID NO: 1543267 - RNA, 12 nt, Homo sapiens
aucuauggauug

SEQ ID NO: 1543268 - RNA, 21 nt, Homo sapiens
aucuauuuaucugucugagcc

SEQ ID NO: 1543269 - RNA, 19 nt, Homo sapiens
aucucuaaaauucuagucu

SEQ ID NO: 1543270 - RNA, 14 nt, Homo sapiens
aucucuacuuuccu

SEQ ID NO: 1543271 - RNA, 22 nt, Homo sapiens
aucugagcuuaaacauuuucuc

SEQ ID NO: 1543272 - RNA, 18 nt, Homo sapiens
aucugcaaauaguuucaa

SEQ ID NO: 1543273 - RNA, 16 nt, Homo sapiens
aucuggcccugcugcc

SEQ ID NO: 1543274 - RNA, 22 nt, Homo sapiens
aucuguaugggucauucucacc

SEQ ID NO: 1543275 - RNA, 13 nt, Homo sapiens
aucugucuguccu

SEQ ID NO: 1543276 - RNA, 18 nt, Homo sapiens
aucugucuguccuacccg

SEQ ID NO: 1543277 - RNA, 12 nt, Homo sapiens
aucuuaauguau

SEQ ID NO: 1543278 - RNA, 14 nt, Homo sapiens
aucuuaauguauau

SEQ ID NO: 1543279 - RNA, 15 nt, Homo sapiens
aucuuaggauuuacc

SEQ ID NO: 1543280 - RNA, 24 nt, Homo sapiens
aucuuauuugucaguguagaucaa

SEQ ID NO: 1543281 - RNA, 17 nt, Homo sapiens
aucuucccacuuugcca

SEQ ID NO: 1543282 - RNA, 18 nt, Homo sapiens
aucuuccccaacgaaaag

SEQ ID NO: 1543283 - RNA, 14 nt, Homo sapiens
augaaaccacugga

SEQ ID NO: 1543284 - RNA, 13 nt, Homo sapiens
augaaacuaugca

SEQ ID NO: 1543285 - RNA, 17 nt, Homo sapiens
augaaagaggcauuccc

SEQ ID NO: 1543286 - RNA, 14 nt, Homo sapiens
augaacccauccaa

SEQ ID NO: 1543287 - RNA, 15 nt, Homo sapiens
augaacuauuguuaa

SEQ ID NO: 1543288 - RNA, 20 nt, Homo sapiens
augaaggcuguacacugcac

SEQ ID NO: 1543289 - RNA, 19 nt, Homo sapiens
augaaggucuaccugaaaa

SEQ ID NO: 1543290 - RNA, 15 nt, Homo sapiens
augaauaaacacuuu

SEQ ID NO: 1543291 - RNA, 13 nt, Homo sapiens
augaauacaauua

SEQ ID NO: 1543292 - RNA, 16 nt, Homo sapiens
augaccauaaaauuag

SEQ ID NO: 1543293 - RNA, 14 nt, Homo sapiens
augacuugacaagu

SEQ ID NO: 1543294 - RNA, 13 nt, Homo sapiens
augagcuccagac

SEQ ID NO: 1543295 - RNA, 17 nt, Homo sapiens
augaguucaaauacuuu

SEQ ID NO: 1543296 - RNA, 15 nt, Homo sapiens
augauaaaagcacuu

SEQ ID NO: 1543297 - RNA, 17 nt, Homo sapiens
augauacuugguccuua

SEQ ID NO: 1543298 - RNA, 21 nt, Homo sapiens
augcagcagcuuuugacuguu

SEQ ID NO: 1543299 - RNA, 14 nt, Homo sapiens
augcauuacugcau

SEQ ID NO: 1543300 - RNA, 23 nt, Homo sapiens
augccaauuucucuuaaguacug

SEQ ID NO: 1543301 - RNA, 22 nt, Homo sapiens
augccuaauaaacaauucaagu

SEQ ID NO: 1543302 - RNA, 21 nt, Homo sapiens
augccugagaaugccuaggcc

SEQ ID NO: 1543303 - RNA, 12 nt, Homo sapiens
augccuuuccag

SEQ ID NO: 1543304 - RNA, 20 nt, Homo sapiens
augcugauuuaaacuucuua

SEQ ID NO: 1543305 - RNA, 16 nt, Homo sapiens
augcugcaauacauua

SEQ ID NO: 1543306 - RNA, 19 nt, Homo sapiens
augcugggacccucggggc

SEQ ID NO: 1543307 - RNA, 23 nt, Homo sapiens
augcuuauauuguucacuucuuu

SEQ ID NO: 1543308 - RNA, 21 nt, Homo sapiens
auggagcuugacuucaugcca

SEQ ID NO: 1543309 - RNA, 20 nt, Homo sapiens
auggccacauccaacauuuc

SEQ ID NO: 1543310 - RNA, 19 nt, Homo sapiens
auggccaggccucagggac

SEQ ID NO: 1543311 - RNA, 21 nt, Homo sapiens
auggcuacuuugguuucuguc

SEQ ID NO: 1543312 - RNA, 19 nt, Homo sapiens
augggagaguuucuuuaca

SEQ ID NO: 1543313 - RNA, 16 nt, Homo sapiens
augggaugcuugccua

SEQ ID NO: 1543314 - RNA, 16 nt, Homo sapiens
augguagacugugaca

SEQ ID NO: 1543315 - RNA, 16 nt, Homo sapiens
auggucaaugcuagca

SEQ ID NO: 1543316 - RNA, 19 nt, Homo sapiens
auggucaaugcuagcacaa

SEQ ID NO: 1543317 - RNA, 20 nt, Homo sapiens
auggucaaugcuagcacaau

SEQ ID NO: 1543318 - RNA, 22 nt, Homo sapiens
auggucccagcggaugcugcca

SEQ ID NO: 1543319 - RNA, 15 nt, Homo sapiens
auggugaacugucau

SEQ ID NO: 1543320 - RNA, 18 nt, Homo sapiens
auggugcuggguccuuaa

SEQ ID NO: 1543321 - RNA, 13 nt, Homo sapiens
auggugggcucca

SEQ ID NO: 1543322 - RNA, 17 nt, Homo sapiens
augguuuaaagucacag

SEQ ID NO: 1543323 - RNA, 17 nt, Homo sapiens
auguacaauaaagcaau

SEQ ID NO: 1543324 - RNA, 20 nt, Homo sapiens
auguaccguugauguugaua

SEQ ID NO: 1543325 - RNA, 19 nt, Homo sapiens
auguagcuucagucauuaa

SEQ ID NO: 1543326 - RNA, 19 nt, Homo sapiens
auguauaaugggaaauguu

SEQ ID NO: 1543327 - RNA, 13 nt, Homo sapiens
auguauuaugcaa

SEQ ID NO: 1543328 - RNA, 14 nt, Homo sapiens
auguauuaugcaaa

SEQ ID NO: 1543329 - RNA, 19 nt, Homo sapiens
auguauuuguaguguuauu

SEQ ID NO: 1543330 - RNA, 16 nt, Homo sapiens
augucaagauucagcu

SEQ ID NO: 1543331 - RNA, 17 nt, Homo sapiens
augucaagauucagcua

SEQ ID NO: 1543332 - RNA, 14 nt, Homo sapiens
augucaauugucag

SEQ ID NO: 1543333 - RNA, 16 nt, Homo sapiens
augugaauuuugccau

SEQ ID NO: 1543334 - RNA, 19 nt, Homo sapiens
augugauuggcagcuucaa

SEQ ID NO: 1543335 - RNA, 12 nt, Homo sapiens
auguggcagcug

SEQ ID NO: 1543336 - RNA, 23 nt, Homo sapiens
augugggguugucaaaacuccac

SEQ ID NO: 1543337 - RNA, 14 nt, Homo sapiens
augugugugcuuug

SEQ ID NO: 1543338 - RNA, 20 nt, Homo sapiens
auguguugccuggaagcaca

SEQ ID NO: 1543339 - RNA, 18 nt, Homo sapiens
auguuaagcucuuuauga

SEQ ID NO: 1543340 - RNA, 18 nt, Homo sapiens
auguuaccuucacauguc

SEQ ID NO: 1543341 - RNA, 16 nt, Homo sapiens
auguuacuacaugcac

SEQ ID NO: 1543342 - RNA, 17 nt, Homo sapiens
auguuccauccuguaca

SEQ ID NO: 1543343 - RNA, 23 nt, Homo sapiens
auguugaagaacucaugugauuu

SEQ ID NO: 1543344 - RNA, 15 nt, Homo sapiens
auguuucagagcuca

SEQ ID NO: 1543345 - RNA, 20 nt, Homo sapiens
auguuucagagcucaccagg

SEQ ID NO: 1543346 - RNA, 17 nt, Homo sapiens
auuaaaaaugcauauac

SEQ ID NO: 1543347 - RNA, 18 nt, Homo sapiens
auuaaaauaacuaagcaa

SEQ ID NO: 1543348 - RNA, 21 nt, Homo sapiens
auuaaaggggcugucucccaa

SEQ ID NO: 1543349 - RNA, 12 nt, Homo sapiens
auuaacaauuaa

SEQ ID NO: 1543350 - RNA, 20 nt, Homo sapiens
auuaaccugaauuauuccaa

SEQ ID NO: 1543351 - RNA, 14 nt, Homo sapiens
auuaaucucuaaaa

SEQ ID NO: 1543352 - RNA, 17 nt, Homo sapiens
auuaaucucuaaaauuc

SEQ ID NO: 1543353 - RNA, 12 nt, Homo sapiens
auuaaugaacua

SEQ ID NO: 1543354 - RNA, 20 nt, Homo sapiens
auuaauuaagucaccuguau

SEQ ID NO: 1543355 - RNA, 16 nt, Homo sapiens
auuacugaugugugca

SEQ ID NO: 1543356 - RNA, 18 nt, Homo sapiens
auuacugaugugugcaac

SEQ ID NO: 1543357 - RNA, 21 nt, Homo sapiens
auuagauuuuaaaacuucauc

SEQ ID NO: 1543358 - RNA, 12 nt, Homo sapiens
auuagcugugau

SEQ ID NO: 1543359 - RNA, 14 nt, Homo sapiens
auuaguauccuguu

SEQ ID NO: 1543360 - RNA, 19 nt, Homo sapiens
auuauagauuuucauguuc

SEQ ID NO: 1543361 - RNA, 23 nt, Homo sapiens
auuauauuugugugaaaauguga

SEQ ID NO: 1543362 - RNA, 19 nt, Homo sapiens
auuaugauuagcuuuguca

SEQ ID NO: 1543363 - RNA, 19 nt, Homo sapiens
auuauggcuuugugcuugu

SEQ ID NO: 1543364 - RNA, 13 nt, Homo sapiens
auuauguccugug

SEQ ID NO: 1543365 - RNA, 17 nt, Homo sapiens
auuauuguugcauuaaa

SEQ ID NO: 1543366 - RNA, 13 nt, Homo sapiens
auuauuuguuacg

SEQ ID NO: 1543367 - RNA, 22 nt, Homo sapiens
auucaaaccuaaguugcuggac

SEQ ID NO: 1543368 - RNA, 17 nt, Homo sapiens
auucaaagaaucaccua

SEQ ID NO: 1543369 - RNA, 15 nt, Homo sapiens
auucacuuuaccuuc

SEQ ID NO: 1543370 - RNA, 11 nt, Homo sapiens
auucauaacaa

SEQ ID NO: 1543371 - RNA, 16 nt, Homo sapiens
auucauuagcugugau

SEQ ID NO: 1543372 - RNA, 14 nt, Homo sapiens
auucauuuugcaac

SEQ ID NO: 1543373 - RNA, 17 nt, Homo sapiens
auucauuuugcaacuug

SEQ ID NO: 1543374 - RNA, 22 nt, Homo sapiens
auuccuaugcugcaauacauua

SEQ ID NO: 1543375 - RNA, 15 nt, Homo sapiens
auuccucccauucaa

SEQ ID NO: 1543376 - RNA, 18 nt, Homo sapiens
cacuaaauccuuuccaau

SEQ ID NO: 1543377 - RNA, 22 nt, Homo sapiens
cacuccacaguuaggccaagaa

SEQ ID NO: 1543378 - RNA, 15 nt, Homo sapiens
cacuccccucaucca

SEQ ID NO: 1543379 - RNA, 16 nt, Homo sapiens
cacuccguuuugcaaa

SEQ ID NO: 1543380 - RNA, 16 nt, Homo sapiens
cacucuaacuguauau

SEQ ID NO: 1543381 - RNA, 24 nt, Homo sapiens
cacugccccugcaccugcuucuca

SEQ ID NO: 1543382 - RNA, 16 nt, Homo sapiens
cacuguccauuccaaa

SEQ ID NO: 1543383 - RNA, 21 nt, Homo sapiens
cacugucccggagcucaggcc

SEQ ID NO: 1543384 - RNA, 12 nt, Homo sapiens
cacugugcagcc

SEQ ID NO: 1543385 - RNA, 22 nt, Homo sapiens
cacuguuuaacugggagugaua

SEQ ID NO: 1543386 - RNA, 19 nt, Homo sapiens
cacuuaucaguuugcuaau

SEQ ID NO: 1543387 - RNA, 15 nt, Homo sapiens
cacuucaaacaugcc

SEQ ID NO: 1543388 - RNA, 9 nt, Homo sapiens
cacuucuua

SEQ ID NO: 1543389 - RNA, 16 nt, Homo sapiens
cacuugacuuugccac

SEQ ID NO: 1543390 - RNA, 17 nt, Homo sapiens
cacuuucugaaauucac

SEQ ID NO: 1543391 - RNA, 18 nt, Homo sapiens
cacuuuguuucauauucu

SEQ ID NO: 1543392 - RNA, 16 nt, Homo sapiens
cacuuuuuuucuauau

SEQ ID NO: 1543393 - RNA, 15 nt, Homo sapiens
cagaacucagccuua

SEQ ID NO: 1543394 - RNA, 11 nt, Homo sapiens
cagaagugugu

SEQ ID NO: 1543395 - RNA, 19 nt, Homo sapiens
cagaaguuucuucuuuagg

SEQ ID NO: 1543396 - RNA, 17 nt, Homo sapiens
cagaauggggacaucuu

SEQ ID NO: 1543397 - RNA, 18 nt, Homo sapiens
cagaauggggacaucuug

SEQ ID NO: 1543398 - RNA, 21 nt, Homo sapiens
cagaauggugggcuccagagu

SEQ ID NO: 1543399 - RNA, 16 nt, Homo sapiens
cagaggacggcuuccc

SEQ ID NO: 1543400 - RNA, 16 nt, Homo sapiens
cagaggauggcuuccc

SEQ ID NO: 1543401 - RNA, 14 nt, Homo sapiens
cagaggcucuaaug

SEQ ID NO: 1543402 - RNA, 20 nt, Homo sapiens
cagaguaaaauuacagaaga

SEQ ID NO: 1543403 - RNA, 18 nt, Homo sapiens
cagagugcacagcugucc

SEQ ID NO: 1543404 - RNA, 23 nt, Homo sapiens
cagauguuuguuuucaaaauacu

SEQ ID NO: 1543405 - RNA, 16 nt, Homo sapiens
cagauucaagugcaau

SEQ ID NO: 1543406 - RNA, 15 nt, Homo sapiens
cagcaauggcagauu

SEQ ID NO: 1543407 - RNA, 14 nt, Homo sapiens
cagcacagccucac

SEQ ID NO: 1543408 - RNA, 18 nt, Homo sapiens
cagcaccaugggccuucu

SEQ ID NO: 1543409 - RNA, 18 nt, Homo sapiens
cagcacuuaaacugccuc

SEQ ID NO: 1543410 - RNA, 20 nt, Homo sapiens
cagcagagccuggaagacac

SEQ ID NO: 1543411 - RNA, 23 nt, Homo sapiens
cagcagggccacugaguagucau

SEQ ID NO: 1543412 - RNA, 19 nt, Homo sapiens
cagcagugugagggugcag

SEQ ID NO: 1543413 - RNA, 18 nt, Homo sapiens
cagcauccucaguuccug

SEQ ID NO: 1543414 - RNA, 17 nt, Homo sapiens
cagcaugcugagauuac

SEQ ID NO: 1543415 - RNA, 22 nt, Homo sapiens
cagcauuacacgccacaacucc

SEQ ID NO: 1543416 - RNA, 20 nt, Homo sapiens
cagccaccccucagacuggg

SEQ ID NO: 1543417 - RNA, 11 nt, Homo sapiens
cagcccauucc

SEQ ID NO: 1543418 - RNA, 19 nt, Homo sapiens
cagccccuccccauggugc

SEQ ID NO: 1543419 - RNA, 12 nt, Homo sapiens
cagccucccacc

SEQ ID NO: 1543420 - RNA, 14 nt, Homo sapiens
cagccugcucccua

SEQ ID NO: 1543421 - RNA, 23 nt, Homo sapiens
cagccugcucccuagccagaggc

SEQ ID NO: 1543422 - RNA, 12 nt, Homo sapiens
cagcggaugcug

SEQ ID NO: 1543423 - RNA, 16 nt, Homo sapiens
cagcuaagccugauga

SEQ ID NO: 1543424 - RNA, 13 nt, Homo sapiens
cagcuaugaaggc

SEQ ID NO: 1543425 - RNA, 12 nt, Homo sapiens
cagcuccuagua

SEQ ID NO: 1543426 - RNA, 20 nt, Homo sapiens
cagcucugucccaggauggu

SEQ ID NO: 1543427 - RNA, 22 nt, Homo sapiens
cagcugaaagauugauuaauga

SEQ ID NO: 1543428 - RNA, 14 nt, Homo sapiens
cagcuggcucugca

SEQ ID NO: 1543429 - RNA, 16 nt, Homo sapiens
cagcugucuguggcuu

SEQ ID NO: 1543430 - RNA, 12 nt, Homo sapiens
caggacacugcc

SEQ ID NO: 1543431 - RNA, 14 nt, Homo sapiens
caggaccaggagcc

SEQ ID NO: 1543432 - RNA, 19 nt, Homo sapiens
caggagcauguccuauccc

SEQ ID NO: 1543433 - RNA, 16 nt, Homo sapiens
caggagccagcagggc

SEQ ID NO: 1543434 - RNA, 19 nt, Homo sapiens
caggagcguguacuacccc

SEQ ID NO: 1543435 - RNA, 21 nt, Homo sapiens
caggagcguguacuaccccag

SEQ ID NO: 1543436 - RNA, 14 nt, Homo sapiens
caggcagagcucag

SEQ ID NO: 1543437 - RNA, 18 nt, Homo sapiens
caggccagaaaacauaug

SEQ ID NO: 1543438 - RNA, 19 nt, Homo sapiens
caggccaggagacuguuaa

SEQ ID NO: 1543439 - RNA, 21 nt, Homo sapiens
caggccaggagacuguuaaag

SEQ ID NO: 1543440 - RNA, 18 nt, Homo sapiens
caggcccaauucugccac

SEQ ID NO: 1543441 - RNA, 21 nt, Homo sapiens
caggccccuuuggaccugcag

SEQ ID NO: 1543442 - RNA, 14 nt, Homo sapiens
caggcccuggugag

SEQ ID NO: 1543443 - RNA, 13 nt, Homo sapiens
caggccucaggga

SEQ ID NO: 1543444 - RNA, 18 nt, Homo sapiens
caggccuuuuugagccaa

SEQ ID NO: 1543445 - RNA, 13 nt, Homo sapiens
caggcucuucucc

SEQ ID NO: 1543446 - RNA, 16 nt, Homo sapiens
caggcuggagugcagu

SEQ ID NO: 1543447 - RNA, 15 nt, Homo sapiens
caggcuugcauuaaa

SEQ ID NO: 1543448 - RNA, 14 nt, Homo sapiens
cagggccacugagu

SEQ ID NO: 1543449 - RNA, 13 nt, Homo sapiens
caggggcugcauc

SEQ ID NO: 1543450 - RNA, 21 nt, Homo sapiens
caggguuagcucacgugucuu

SEQ ID NO: 1543451 - RNA, 17 nt, Homo sapiens
cagguauauaccuccau

SEQ ID NO: 1543452 - RNA, 12 nt, Homo sapiens
caggugagccaa

SEQ ID NO: 1543453 - RNA, 17 nt, Homo sapiens
caggugcgugccacauc

SEQ ID NO: 1543454 - RNA, 13 nt, Homo sapiens
caggugcuucagg

SEQ ID NO: 1543455 - RNA, 21 nt, Homo sapiens
caguaaagaccauuuaguccu

SEQ ID NO: 1543456 - RNA, 22 nt, Homo sapiens
caguaaagaccauuuaguccuc

SEQ ID NO: 1543457 - RNA, 21 nt, Homo sapiens
cagucccucccuccuggcuca

SEQ ID NO: 1543458 - RNA, 14 nt, Homo sapiens
caguccuuccacac

SEQ ID NO: 1543459 - RNA, 20 nt, Homo sapiens
cagugguauuguuucuguca

SEQ ID NO: 1543460 - RNA, 21 nt, Homo sapiens
cagugguauuguuucugucaa

SEQ ID NO: 1543461 - RNA, 16 nt, Homo sapiens
caguggugagacugua

SEQ ID NO: 1543462 - RNA, 17 nt, Homo sapiens
caguguuuccagugaca

SEQ ID NO: 1543463 - RNA, 13 nt, Homo sapiens
caguucaaucaaa

SEQ ID NO: 1543464 - RNA, 18 nt, Homo sapiens
caguugcacagcaucuca

SEQ ID NO: 1543465 - RNA, 14 nt, Homo sapiens
caguugguuuugca

SEQ ID NO: 1543466 - RNA, 15 nt, Homo sapiens
caguuuuuccuaguc

SEQ ID NO: 1543467 - RNA, 17 nt, Homo sapiens
cauaaaaauaaccaaaa

SEQ ID NO: 1543468 - RNA, 14 nt, Homo sapiens
cauaaaacuucuga

SEQ ID NO: 1543469 - RNA, 21 nt, Homo sapiens
cauaaacaacuuaauguucug

SEQ ID NO: 1543470 - RNA, 17 nt, Homo sapiens
cauaaauuauuucuaaa

SEQ ID NO: 1543471 - RNA, 18 nt, Homo sapiens
cauaaauuauuucuaaaa

SEQ ID NO: 1543472 - RNA, 14 nt, Homo sapiens
cauaaccgcacaga

SEQ ID NO: 1543473 - RNA, 20 nt, Homo sapiens
cauacaccuaugucauuuca

SEQ ID NO: 1543474 - RNA, 22 nt, Homo sapiens
cauacaucuaagucaguuucac

SEQ ID NO: 1543475 - RNA, 23 nt, Homo sapiens
cauacgaaccuaaagaauaugaa

SEQ ID NO: 1543476 - RNA, 19 nt, Homo sapiens
cauacuuaaaaauuuauua

SEQ ID NO: 1543477 - RNA, 12 nt, Homo sapiens
cauacuuuguua

SEQ ID NO: 1543478 - RNA, 21 nt, Homo sapiens
cauagucuuuguuuacaugag

SEQ ID NO: 1543479 - RNA, 15 nt, Homo sapiens
cauaugacaauuuca

SEQ ID NO: 1543480 - RNA, 13 nt, Homo sapiens
cauauggaaaucc

SEQ ID NO: 1543481 - RNA, 20 nt, Homo sapiens
cauauuauaucagacugcuu

SEQ ID NO: 1543482 - RNA, 16 nt, Homo sapiens
cauauuuaaagucuug

SEQ ID NO: 1543483 - RNA, 16 nt, Homo sapiens
caucacguauguuaua

SEQ ID NO: 1543484 - RNA, 23 nt, Homo sapiens
caucaucccuuaauuaaauauca

SEQ ID NO: 1543485 - RNA, 19 nt, Homo sapiens
caucaugggggauuuuuca

SEQ ID NO: 1543486 - RNA, 21 nt, Homo sapiens
cauccaauggauugugcaaau

SEQ ID NO: 1543487 - RNA, 17 nt, Homo sapiens
cauccacuucacaguuc

SEQ ID NO: 1543488 - RNA, 14 nt, Homo sapiens
caucccggggccau

SEQ ID NO: 1543489 - RNA, 20 nt, Homo sapiens
caucuaagucaguuucacau

SEQ ID NO: 1543490 - RNA, 20 nt, Homo sapiens
caucuacagaccugcggcuu

SEQ ID NO: 1543491 - RNA, 21 nt, Homo sapiens
caucuagcuccauaauugcaa

SEQ ID NO: 1543492 - RNA, 21 nt, Homo sapiens
caucugaaaagaaaugcuaau

SEQ ID NO: 1543493 - RNA, 13 nt, Homo sapiens
caucugauuguga

SEQ ID NO: 1543494 - RNA, 19 nt, Homo sapiens
caucuguuugauacaguau

SEQ ID NO: 1543495 - RNA, 23 nt, Homo sapiens
caucuuuuguuaaguucaccgua

SEQ ID NO: 1543496 - RNA, 22 nt, Homo sapiens
caugaaccucaagcugcaucua

SEQ ID NO: 1543497 - RNA, 17 nt, Homo sapiens
caugaagauaaauccaa

SEQ ID NO: 1543498 - RNA, 19 nt, Homo sapiens
caugaaggucuaccugaaa

SEQ ID NO: 1543499 - RNA, 17 nt, Homo sapiens
caugaaucucucaauua

SEQ ID NO: 1543500 - RNA, 15 nt, Homo sapiens
caugaccacuuuccc

SEQ ID NO: 1543501 - RNA, 21 nt, Homo sapiens
caugacucuuuauugucugua

SEQ ID NO: 1543502 - RNA, 18 nt, Homo sapiens
caugaguucaaauacuuu

SEQ ID NO: 1543503 - RNA, 15 nt, Homo sapiens
caugaugaauuacuu

SEQ ID NO: 1543504 - RNA, 19 nt, Homo sapiens
caugcacaguuugcaaucu

SEQ ID NO: 1543505 - RNA, 13 nt, Homo sapiens
caugcacuucuua

SEQ ID NO: 1543506 - RNA, 20 nt, Homo sapiens
caugcacuuggcugcauaaa

SEQ ID NO: 1543507 - RNA, 18 nt, Homo sapiens
caugccccacucugcuga

SEQ ID NO: 1543508 - RNA, 23 nt, Homo sapiens
gagcuuggccagaagggggccau

SEQ ID NO: 1543509 - RNA, 15 nt, Homo sapiens
gaggaaacucaccug

SEQ ID NO: 1543510 - RNA, 15 nt, Homo sapiens
gaggacggcuucccc

SEQ ID NO: 1543511 - RNA, 17 nt, Homo sapiens
gaggacgugaagccucc

SEQ ID NO: 1543512 - RNA, 18 nt, Homo sapiens
gaggagggggcccggcug

SEQ ID NO: 1543513 - RNA, 15 nt, Homo sapiens
gaggcagaauggugg

SEQ ID NO: 1543514 - RNA, 13 nt, Homo sapiens
gaggcaguggcag

SEQ ID NO: 1543515 - RNA, 15 nt, Homo sapiens
gaggcuugggaccgc

SEQ ID NO: 1543516 - RNA, 11 nt, Homo sapiens
gagggucccaa

SEQ ID NO: 1543517 - RNA, 17 nt, Homo sapiens
gagggugcagggaccaa

SEQ ID NO: 1543518 - RNA, 15 nt, Homo sapiens
gaggugaacauucau

SEQ ID NO: 1543519 - RNA, 19 nt, Homo sapiens
gaguauguuaagcucuuua

SEQ ID NO: 1543520 - RNA, 12 nt, Homo sapiens
gagucaucaugg

SEQ ID NO: 1543521 - RNA, 14 nt, Homo sapiens
gagucauuguuaca

SEQ ID NO: 1543522 - RNA, 21 nt, Homo sapiens
gagugauuuuggccacacugu

SEQ ID NO: 1543523 - RNA, 23 nt, Homo sapiens
gagugcuuauaauauacauaacu

SEQ ID NO: 1543524 - RNA, 20 nt, Homo sapiens
gaguguggcuuaguaauaga

SEQ ID NO: 1543525 - RNA, 17 nt, Homo sapiens
gauaaauuugacuguua

SEQ ID NO: 1543526 - RNA, 15 nt, Homo sapiens
gauacgcuccaguac

SEQ ID NO: 1543527 - RNA, 21 nt, Homo sapiens
gauauaggucagugaggccca

SEQ ID NO: 1543528 - RNA, 19 nt, Homo sapiens
gauauaugacuuuuucuca

SEQ ID NO: 1543529 - RNA, 23 nt, Homo sapiens
gauauauuuuccagggcaaucaa

SEQ ID NO: 1543530 - RNA, 17 nt, Homo sapiens
gauauucaaucuuaaca

SEQ ID NO: 1543531 - RNA, 14 nt, Homo sapiens
gaucagaugucuau

SEQ ID NO: 1543532 - RNA, 20 nt, Homo sapiens
gauccauuaaguaaacaaua

SEQ ID NO: 1543533 - RNA, 13 nt, Homo sapiens
gaucccuagcugu

SEQ ID NO: 1543534 - RNA, 12 nt, Homo sapiens
gaucugcauaac

SEQ ID NO: 1543535 - RNA, 12 nt, Homo sapiens
gaucugcuccau

SEQ ID NO: 1543536 - RNA, 14 nt, Homo sapiens
gaugcaugcagggc

SEQ ID NO: 1543537 - RNA, 22 nt, Homo sapiens
gaugcuaucucgcuagccauau

SEQ ID NO: 1543538 - RNA, 18 nt, Homo sapiens
gaugguaacugcacacau

SEQ ID NO: 1543539 - RNA, 16 nt, Homo sapiens
gauguaccauguuaaa

SEQ ID NO: 1543540 - RNA, 15 nt, Homo sapiens
gaugugacaggaauu

SEQ ID NO: 1543541 - RNA, 15 nt, Homo sapiens
gaugugccuagacac

SEQ ID NO: 1543542 - RNA, 19 nt, Homo sapiens
gauguugauaauaguaaug

SEQ ID NO: 1543543 - RNA, 20 nt, Homo sapiens
gauuaauuuguguagauugu

SEQ ID NO: 1543544 - RNA, 18 nt, Homo sapiens
gauucaggaaugggccaa

SEQ ID NO: 1543545 - RNA, 22 nt, Homo sapiens
gauucagggccccugaagugac

SEQ ID NO: 1543546 - RNA, 12 nt, Homo sapiens
gauuccagagag

SEQ ID NO: 1543547 - RNA, 17 nt, Homo sapiens
gauucuaaaacauucuu

SEQ ID NO: 1543548 - RNA, 22 nt, Homo sapiens
gauuggcaggugugggcuccca

SEQ ID NO: 1543549 - RNA, 17 nt, Homo sapiens
gauugguucaugccugg

SEQ ID NO: 1543550 - RNA, 22 nt, Homo sapiens
gcaaagccuagccugcauauca

SEQ ID NO: 1543551 - RNA, 21 nt, Homo sapiens
gcaaaguaccaacugagccaa

SEQ ID NO: 1543552 - RNA, 20 nt, Homo sapiens
gcaaauguccaagcaucagc

SEQ ID NO: 1543553 - RNA, 22 nt, Homo sapiens
gcaagugauugaaaauaguaaa

SEQ ID NO: 1543554 - RNA, 18 nt, Homo sapiens
gcaauaaggaucuuccca

SEQ ID NO: 1543555 - RNA, 15 nt, Homo sapiens
gcaauagucaaaaac

SEQ ID NO: 1543556 - RNA, 12 nt, Homo sapiens
gcacaaguauua

SEQ ID NO: 1543557 - RNA, 23 nt, Homo sapiens
gcacaccccugcacacaccugca

SEQ ID NO: 1543558 - RNA, 19 nt, Homo sapiens
gcacagaggauggcuuccc

SEQ ID NO: 1543559 - RNA, 23 nt, Homo sapiens
gcacauuagagggacagccaaaa

SEQ ID NO: 1543560 - RNA, 20 nt, Homo sapiens
gcaccuacuuacaugcauua

SEQ ID NO: 1543561 - RNA, 17 nt, Homo sapiens
gcaccugcagggagcag

SEQ ID NO: 1543562 - RNA, 19 nt, Homo sapiens
gcacgugcacacaccugca

SEQ ID NO: 1543563 - RNA, 13 nt, Homo sapiens
gcacugcccuccg

SEQ ID NO: 1543564 - RNA, 16 nt, Homo sapiens
gcagacucacuguggg

SEQ ID NO: 1543565 - RNA, 16 nt, Homo sapiens
gcagagugcacagcug

SEQ ID NO: 1543566 - RNA, 14 nt, Homo sapiens
gcagccacccugcc

SEQ ID NO: 1543567 - RNA, 23 nt, Homo sapiens
gcagccucaggcccaauucugcc

SEQ ID NO: 1543568 - RNA, 22 nt, Homo sapiens
gcagccugugggagaagggaca

SEQ ID NO: 1543569 - RNA, 15 nt, Homo sapiens
gcagcugccagagaa

SEQ ID NO: 1543570 - RNA, 18 nt, Homo sapiens
gcaggaagucccugagaa

SEQ ID NO: 1543571 - RNA, 11 nt, Homo sapiens
gcagggaccaa

SEQ ID NO: 1543572 - RNA, 20 nt, Homo sapiens
gcaguaaaguuccaugaaga

SEQ ID NO: 1543573 - RNA, 21 nt, Homo sapiens
gcaguggagaggggacuugga

SEQ ID NO: 1543574 - RNA, 22 nt, Homo sapiens
gcauccacuucacaguucugaa

SEQ ID NO: 1543575 - RNA, 20 nt, Homo sapiens
gcaucuaucuggugauuucu

SEQ ID NO: 1543576 - RNA, 14 nt, Homo sapiens
gcaugaaagguaau

SEQ ID NO: 1543577 - RNA, 20 nt, Homo sapiens
gcaugauauuguauguaccu

SEQ ID NO: 1543578 - RNA, 20 nt, Homo sapiens
gcauuacacgccacaacucc

SEQ ID NO: 1543579 - RNA, 20 nt, Homo sapiens
gcauuuuacugucuguaaga

SEQ ID NO: 1543580 - RNA, 17 nt, Homo sapiens
gcauuuucugcaucucc

SEQ ID NO: 1543581 - RNA, 18 nt, Homo sapiens
gcauuuucugcaucucca

SEQ ID NO: 1543582 - RNA, 18 nt, Homo sapiens
gccaaggggucugcuccu

SEQ ID NO: 1543583 - RNA, 18 nt, Homo sapiens
gccacauccaacauuucc

SEQ ID NO: 1543584 - RNA, 14 nt, Homo sapiens
gccacgacauggcu

SEQ ID NO: 1543585 - RNA, 20 nt, Homo sapiens
gccacgccugcgauggugcu

SEQ ID NO: 1543586 - RNA, 22 nt, Homo sapiens
gccacgcgcucugcaugcuccu

SEQ ID NO: 1543587 - RNA, 14 nt, Homo sapiens
gccacuaggcccug

SEQ ID NO: 1543588 - RNA, 20 nt, Homo sapiens
gccacuccagaccccuggcu

SEQ ID NO: 1543589 - RNA, 16 nt, Homo sapiens
gccagaagggggccau

SEQ ID NO: 1543590 - RNA, 13 nt, Homo sapiens
gccagacaugcca

SEQ ID NO: 1543591 - RNA, 22 nt, Homo sapiens
gccagacgugcuccugcugacc

SEQ ID NO: 1543592 - RNA, 15 nt, Homo sapiens
gccagaggcucuaau

SEQ ID NO: 1543593 - RNA, 17 nt, Homo sapiens
gccagcagggcgggcca

SEQ ID NO: 1543594 - RNA, 13 nt, Homo sapiens
gccagucccucag

SEQ ID NO: 1543595 - RNA, 23 nt, Homo sapiens
gccauuauuucaaccgcuugcca

SEQ ID NO: 1543596 - RNA, 23 nt, Homo sapiens
gcccaugcccuccguccuggcag

SEQ ID NO: 1543597 - RNA, 20 nt, Homo sapiens
gcccauuccucccauucaag

SEQ ID NO: 1543598 - RNA, 19 nt, Homo sapiens
gccccuugcaaaguaauag

SEQ ID NO: 1543599 - RNA, 23 nt, Homo sapiens
gcccuaggaggagaacuugaaca

SEQ ID NO: 1543600 - RNA, 14 nt, Homo sapiens
gcccugucagugca

SEQ ID NO: 1543601 - RNA, 21 nt, Homo sapiens
gcccuuucaccccucuuccca

SEQ ID NO: 1543602 - RNA, 23 nt, Homo sapiens
gccgcugugcuguugucugccgu

SEQ ID NO: 1543603 - RNA, 19 nt, Homo sapiens
gccgugccuucagcucuac

SEQ ID NO: 1543604 - RNA, 13 nt, Homo sapiens
gccuauggcaucu

SEQ ID NO: 1543605 - RNA, 14 nt, Homo sapiens
gccucagggaccaa

SEQ ID NO: 1543606 - RNA, 15 nt, Homo sapiens
gccucagggaccaag

SEQ ID NO: 1543607 - RNA, 20 nt, Homo sapiens
gccucccaaggaaaauggac

SEQ ID NO: 1543608 - RNA, 14 nt, Homo sapiens
gccucccagccacc

SEQ ID NO: 1543609 - RNA, 18 nt, Homo sapiens
gccugagaaugccuaggc

SEQ ID NO: 1543610 - RNA, 11 nt, Homo sapiens
gccugauggcc

SEQ ID NO: 1543611 - RNA, 14 nt, Homo sapiens
gccugcagacucac

SEQ ID NO: 1543612 - RNA, 15 nt, Homo sapiens
gccugcagacucacu

SEQ ID NO: 1543613 - RNA, 15 nt, Homo sapiens
gccugcgauggugcu

SEQ ID NO: 1543614 - RNA, 19 nt, Homo sapiens
gccugcucccuagccagag

SEQ ID NO: 1543615 - RNA, 21 nt, Homo sapiens
gccuggcagaacugagcuccu

SEQ ID NO: 1543616 - RNA, 13 nt, Homo sapiens
gccuggcccuccu

SEQ ID NO: 1543617 - RNA, 17 nt, Homo sapiens
gccuuaagaaagcuaua

SEQ ID NO: 1543618 - RNA, 23 nt, Homo sapiens
gccuucauggaacucagcugucu

SEQ ID NO: 1543619 - RNA, 22 nt, Homo sapiens
gccuucuccacagggacacagu

SEQ ID NO: 1543620 - RNA, 23 nt, Homo sapiens
gccuucuccacagggacacaguc

SEQ ID NO: 1543621 - RNA, 13 nt, Homo sapiens
gccuuggaccaaa

SEQ ID NO: 1543622 - RNA, 22 nt, Homo sapiens
gccuuggggauucuuccaucug

SEQ ID NO: 1543623 - RNA, 18 nt, Homo sapiens
gccuuuccagaacuacca

SEQ ID NO: 1543624 - RNA, 12 nt, Homo sapiens
gcgcugugcugg

SEQ ID NO: 1543625 - RNA, 16 nt, Homo sapiens
gcggggagcaugaaga

SEQ ID NO: 1543626 - RNA, 22 nt, Homo sapiens
gcggguaaaaagagaaggcaag

SEQ ID NO: 1543627 - RNA, 13 nt, Homo sapiens
gcgguauccagag

SEQ ID NO: 1543628 - RNA, 18 nt, Homo sapiens
gcguguacuaccccagga

SEQ ID NO: 1543629 - RNA, 16 nt, Homo sapiens
gcuaaaauaaaccaga

SEQ ID NO: 1543630 - RNA, 12 nt, Homo sapiens
gcuaaccucucu

SEQ ID NO: 1543631 - RNA, 14 nt, Homo sapiens
gcuaagccugauga

SEQ ID NO: 1543632 - RNA, 20 nt, Homo sapiens
gcuaauccaggacagcauua

SEQ ID NO: 1543633 - RNA, 13 nt, Homo sapiens
gcuaauuagcucu

SEQ ID NO: 1543634 - RNA, 12 nt, Homo sapiens
gcuagaugggca

SEQ ID NO: 1543635 - RNA, 20 nt, Homo sapiens
gcuaugauuaaauuuacuua

SEQ ID NO: 1543636 - RNA, 14 nt, Homo sapiens
gcucacagccacca

SEQ ID NO: 1543637 - RNA, 13 nt, Homo sapiens
gcucagaugcugg

SEQ ID NO: 1543638 - RNA, 14 nt, Homo sapiens
gcuccaagagaauu

SEQ ID NO: 1543639 - RNA, 17 nt, Homo sapiens
gcuccaggcuuccugcc

SEQ ID NO: 1543640 - RNA, 15 nt, Homo sapiens
cauggaucugcauaa

SEQ ID NO: 1543641 - RNA, 19 nt, Homo sapiens
cauggcaauuuuuacacaa

SEQ ID NO: 1543642 - RNA, 21 nt, Homo sapiens
cauggccacauccaacauuuc

SEQ ID NO: 1543643 - RNA, 23 nt, Homo sapiens
cauggccguugccucucugccag

SEQ ID NO: 1543644 - RNA, 14 nt, Homo sapiens
caugguagacugug

SEQ ID NO: 1543645 - RNA, 15 nt, Homo sapiens
cauggugcagugaag

SEQ ID NO: 1543646 - RNA, 20 nt, Homo sapiens
cauguaccugaaacauuugg

SEQ ID NO: 1543647 - RNA, 23 nt, Homo sapiens
caugucuacugcuuggauccaua

SEQ ID NO: 1543648 - RNA, 18 nt, Homo sapiens
caugugcugcuguggcau

SEQ ID NO: 1543649 - RNA, 20 nt, Homo sapiens
cauguggaaaacucacagau

SEQ ID NO: 1543650 - RNA, 14 nt, Homo sapiens
cauuaaaagacugu

SEQ ID NO: 1543651 - RNA, 16 nt, Homo sapiens
cauuaaagugcacugu

SEQ ID NO: 1543652 - RNA, 19 nt, Homo sapiens
cauuacacgccacaacucc

SEQ ID NO: 1543653 - RNA, 13 nt, Homo sapiens
cauuacugcaugc

SEQ ID NO: 1543654 - RNA, 18 nt, Homo sapiens
cauuauccugugugauua

SEQ ID NO: 1543655 - RNA, 22 nt, Homo sapiens
cauuauccuuuuaucucacaaa

SEQ ID NO: 1543656 - RNA, 18 nt, Homo sapiens
cauucaaaaacauggcca

SEQ ID NO: 1543657 - RNA, 15 nt, Homo sapiens
cauucaaaauaguuc

SEQ ID NO: 1543658 - RNA, 13 nt, Homo sapiens
cauucccuuucau

SEQ ID NO: 1543659 - RNA, 14 nt, Homo sapiens
cauucccuuucaug

SEQ ID NO: 1543660 - RNA, 23 nt, Homo sapiens
cauucguccuuagaauacuguau

SEQ ID NO: 1543661 - RNA, 23 nt, Homo sapiens
cauucuuuucagcuuguuucuau

SEQ ID NO: 1543662 - RNA, 16 nt, Homo sapiens
cauugaaauaauaaua

SEQ ID NO: 1543663 - RNA, 12 nt, Homo sapiens
cauugauuggua

SEQ ID NO: 1543664 - RNA, 15 nt, Homo sapiens
cauugucugucugca

SEQ ID NO: 1543665 - RNA, 23 nt, Homo sapiens
cauuuagauuuugauaccaguga

SEQ ID NO: 1543666 - RNA, 19 nt, Homo sapiens
cauuuauuuacaugugauu

SEQ ID NO: 1543667 - RNA, 20 nt, Homo sapiens
cauuucauugagggaaaaca

SEQ ID NO: 1543668 - RNA, 17 nt, Homo sapiens
cauuuccgaagaccuuc

SEQ ID NO: 1543669 - RNA, 15 nt, Homo sapiens
cauuuccucaggcaa

SEQ ID NO: 1543670 - RNA, 13 nt, Homo sapiens
cauuucuguaacc

SEQ ID NO: 1543671 - RNA, 22 nt, Homo sapiens
cauuucuucucucugugcuggu

SEQ ID NO: 1543672 - RNA, 17 nt, Homo sapiens
cauuugacuuucugucu

SEQ ID NO: 1543673 - RNA, 18 nt, Homo sapiens
cauuuuaacaucugagaa

SEQ ID NO: 1543674 - RNA, 15 nt, Homo sapiens
cauuuuacugucugu

SEQ ID NO: 1543675 - RNA, 12 nt, Homo sapiens
cauuuucaccuc

SEQ ID NO: 1543676 - RNA, 16 nt, Homo sapiens
cauuuucugcaucucc

SEQ ID NO: 1543677 - RNA, 20 nt, Homo sapiens
ccaaagaaccccaggcaaua

SEQ ID NO: 1543678 - RNA, 16 nt, Homo sapiens
ccaaagacuacacugu

SEQ ID NO: 1543679 - RNA, 18 nt, Homo sapiens
ccaaagacuacacuguug

SEQ ID NO: 1543680 - RNA, 22 nt, Homo sapiens
ccaaagcaugauugugaccucc

SEQ ID NO: 1543681 - RNA, 16 nt, Homo sapiens
ccaaauaaaacuugag

SEQ ID NO: 1543682 - RNA, 20 nt, Homo sapiens
ccaacauuccuuguuuguaa

SEQ ID NO: 1543683 - RNA, 16 nt, Homo sapiens
ccaacgaaaagcacau

SEQ ID NO: 1543684 - RNA, 20 nt, Homo sapiens
ccaagaggaaccucugauuu

SEQ ID NO: 1543685 - RNA, 15 nt, Homo sapiens
ccaagcacacaugca

SEQ ID NO: 1543686 - RNA, 19 nt, Homo sapiens
ccaagccacugauaccauu

SEQ ID NO: 1543687 - RNA, 14 nt, Homo sapiens
ccaagccaggguuc

SEQ ID NO: 1543688 - RNA, 14 nt, Homo sapiens
ccaaggcgugcagg

SEQ ID NO: 1543689 - RNA, 14 nt, Homo sapiens
ccaagggucuuccu

SEQ ID NO: 1543690 - RNA, 14 nt, Homo sapiens
ccaauuucucuuaa

SEQ ID NO: 1543691 - RNA, 21 nt, Homo sapiens
ccacaauaagccacugguauc

SEQ ID NO: 1543692 - RNA, 14 nt, Homo sapiens
ccacacguuugcca

SEQ ID NO: 1543693 - RNA, 18 nt, Homo sapiens
ccacaggagcguguccua

SEQ ID NO: 1543694 - RNA, 15 nt, Homo sapiens
ccacauauauuucca

SEQ ID NO: 1543695 - RNA, 12 nt, Homo sapiens
ccacccuaucau

SEQ ID NO: 1543696 - RNA, 16 nt, Homo sapiens
ccaccuggauucccug

SEQ ID NO: 1543697 - RNA, 17 nt, Homo sapiens
ccaccugugcugcugca

SEQ ID NO: 1543698 - RNA, 14 nt, Homo sapiens
ccacugccagacau

SEQ ID NO: 1543699 - RNA, 20 nt, Homo sapiens
ccacugggccauuguggugu

SEQ ID NO: 1543700 - RNA, 19 nt, Homo sapiens
ccacuuagaaauugcauuu

SEQ ID NO: 1543701 - RNA, 17 nt, Homo sapiens
ccacuuauuuccaugga

SEQ ID NO: 1543702 - RNA, 15 nt, Homo sapiens
ccagagaguggcucc

SEQ ID NO: 1543703 - RNA, 23 nt, Homo sapiens
ccagagcuuuacagugccacgac

SEQ ID NO: 1543704 - RNA, 17 nt, Homo sapiens
ccagaggaggugcccgg

SEQ ID NO: 1543705 - RNA, 18 nt, Homo sapiens
ccagaggcucuaauguac

SEQ ID NO: 1543706 - RNA, 23 nt, Homo sapiens
ccagaggcucuaauguacaauaa

SEQ ID NO: 1543707 - RNA, 21 nt, Homo sapiens
ccagagggccccucacuggcu

SEQ ID NO: 1543708 - RNA, 19 nt, Homo sapiens
ccagcgagucuggagacca

SEQ ID NO: 1543709 - RNA, 18 nt, Homo sapiens
ccagcucugucccaggau

SEQ ID NO: 1543710 - RNA, 16 nt, Homo sapiens
ccaggacgcaugcagg

SEQ ID NO: 1543711 - RNA, 17 nt, Homo sapiens
ccaggagaaagaaggcu

SEQ ID NO: 1543712 - RNA, 15 nt, Homo sapiens
ccaggcagcuggcua

SEQ ID NO: 1543713 - RNA, 14 nt, Homo sapiens
ccaggccucaggga

SEQ ID NO: 1543714 - RNA, 20 nt, Homo sapiens
ccaggcuggagugcaguggu

SEQ ID NO: 1543715 - RNA, 15 nt, Homo sapiens
ccaggcuuccaagaa

SEQ ID NO: 1543716 - RNA, 24 nt, Homo sapiens
ccagggcucuggcagguggccagg

SEQ ID NO: 1543717 - RNA, 20 nt, Homo sapiens
ccagggcugggcacuccucc

SEQ ID NO: 1543718 - RNA, 17 nt, Homo sapiens
ccaguacauaaggaguu

SEQ ID NO: 1543719 - RNA, 18 nt, Homo sapiens
ccagugaaaaacuauuaa

SEQ ID NO: 1543720 - RNA, 11 nt, Homo sapiens
ccagugacaca

SEQ ID NO: 1543721 - RNA, 23 nt, Homo sapiens
ccaguguauuuucuguguuguuc

SEQ ID NO: 1543722 - RNA, 12 nt, Homo sapiens
ccaguuaacugu

SEQ ID NO: 1543723 - RNA, 12 nt, Homo sapiens
ccauaauuguuc

SEQ ID NO: 1543724 - RNA, 16 nt, Homo sapiens
ccauagaaacugaggc

SEQ ID NO: 1543725 - RNA, 17 nt, Homo sapiens
ccaucugcugccaugag

SEQ ID NO: 1543726 - RNA, 21 nt, Homo sapiens
ccaugaggccucaguggacuu

SEQ ID NO: 1543727 - RNA, 15 nt, Homo sapiens
ccaugauauaacuuu

SEQ ID NO: 1543728 - RNA, 19 nt, Homo sapiens
ccaugccccacucugcuga

SEQ ID NO: 1543729 - RNA, 14 nt, Homo sapiens
ccauggaccugcac

SEQ ID NO: 1543730 - RNA, 15 nt, Homo sapiens
ccaugguagacugug

SEQ ID NO: 1543731 - RNA, 16 nt, Homo sapiens
ccaugugcugugcacc

SEQ ID NO: 1543732 - RNA, 12 nt, Homo sapiens
ccauuaaguaaa

SEQ ID NO: 1543733 - RNA, 12 nt, Homo sapiens
ccauugcaaaag

SEQ ID NO: 1543734 - RNA, 22 nt, Homo sapiens
ccauugcaaaagguuaagccau

SEQ ID NO: 1543735 - RNA, 23 nt, Homo sapiens
ccauugcaaaagguuaagccaua

SEQ ID NO: 1543736 - RNA, 14 nt, Homo sapiens
ccauuugugauacu

SEQ ID NO: 1543737 - RNA, 18 nt, Homo sapiens
cccaacgaaaagcacauc

SEQ ID NO: 1543738 - RNA, 20 nt, Homo sapiens
cccaauuuuaaaaaauaaca

SEQ ID NO: 1543739 - RNA, 12 nt, Homo sapiens
cccacaaaauau

SEQ ID NO: 1543740 - RNA, 20 nt, Homo sapiens
cccacaggagcguguccuau

SEQ ID NO: 1543741 - RNA, 18 nt, Homo sapiens
cccaccaacucucucugc

SEQ ID NO: 1543742 - RNA, 12 nt, Homo sapiens
cccacuuugcca

SEQ ID NO: 1543743 - RNA, 13 nt, Homo sapiens
cccacuuugccac

SEQ ID NO: 1543744 - RNA, 18 nt, Homo sapiens
cccagcaugcugagauua

SEQ ID NO: 1543745 - RNA, 14 nt, Homo sapiens
cccagcggaugcug

SEQ ID NO: 1543746 - RNA, 13 nt, Homo sapiens
cccaggaugcaug

SEQ ID NO: 1543747 - RNA, 17 nt, Homo sapiens
cccaggcuggagugcag

SEQ ID NO: 1543748 - RNA, 19 nt, Homo sapiens
cccaguaacucaucuguca

SEQ ID NO: 1543749 - RNA, 19 nt, Homo sapiens
cccaguguaugucuuguau

SEQ ID NO: 1543750 - RNA, 22 nt, Homo sapiens
cccaguguggacucuggacugg

SEQ ID NO: 1543751 - RNA, 21 nt, Homo sapiens
cccaugguagacugugacaca

SEQ ID NO: 1543752 - RNA, 18 nt, Homo sapiens
cccauuagcccacugccu

SEQ ID NO: 1543753 - RNA, 17 nt, Homo sapiens
ccccaaaagugucaagg

SEQ ID NO: 1543754 - RNA, 20 nt, Homo sapiens
ccccacacaggccuggccca

SEQ ID NO: 1543755 - RNA, 17 nt, Homo sapiens
ccccacaggagcauguc

SEQ ID NO: 1543756 - RNA, 24 nt, Homo sapiens
ccccagagcuuuacagugccacga

SEQ ID NO: 1543757 - RNA, 20 nt, Homo sapiens
ccccauaaugugggcagauu

SEQ ID NO: 1543758 - RNA, 14 nt, Homo sapiens
cccccuucguggag

SEQ ID NO: 1543759 - RNA, 19 nt, Homo sapiens
ccccgugggccauggcaau

SEQ ID NO: 1543760 - RNA, 16 nt, Homo sapiens
ccccuaagucaacuua

SEQ ID NO: 1543761 - RNA, 17 nt, Homo sapiens
ccccucagugguuuccu

SEQ ID NO: 1543762 - RNA, 17 nt, Homo sapiens
ccccucauggaucugca

SEQ ID NO: 1543763 - RNA, 20 nt, Homo sapiens
cccgauccccgacaguggcu

SEQ ID NO: 1543764 - RNA, 17 nt, Homo sapiens
cccggagcuaacacugg

SEQ ID NO: 1543765 - RNA, 22 nt, Homo sapiens
cccguggugagguugugcugcc

SEQ ID NO: 1543766 - RNA, 14 nt, Homo sapiens
cccuaaaacaugug

SEQ ID NO: 1543767 - RNA, 13 nt, Homo sapiens
cccuacccggcuc

SEQ ID NO: 1543768 - RNA, 13 nt, Homo sapiens
cccuagcaguuug

SEQ ID NO: 1543769 - RNA, 22 nt, Homo sapiens
cccuagcaguuugccucugcac

SEQ ID NO: 1543770 - RNA, 17 nt, Homo sapiens
cccuagccagaggcucu

SEQ ID NO: 1543771 - RNA, 13 nt, Homo sapiens
cccuccaauccca

SEQ ID NO: 1543772 - RNA, 23 nt, Homo sapiens
uggcccuguugugggggugucac

SEQ ID NO: 1543773 - RNA, 21 nt, Homo sapiens
uggccuauuuuggacguguga

SEQ ID NO: 1543774 - RNA, 12 nt, Homo sapiens
uggccucaggag

SEQ ID NO: 1543775 - RNA, 11 nt, Homo sapiens
uggcucugcag

SEQ ID NO: 1543776 - RNA, 15 nt, Homo sapiens
uggcugggcccagaa

SEQ ID NO: 1543777 - RNA, 17 nt, Homo sapiens
ugggagaaaagccagau

SEQ ID NO: 1543778 - RNA, 18 nt, Homo sapiens
ugggagaugcugggaccc

SEQ ID NO: 1543779 - RNA, 21 nt, Homo sapiens
ugggaguaagagcaaauuuca

SEQ ID NO: 1543780 - RNA, 16 nt, Homo sapiens
ugggcaggaccucaga

SEQ ID NO: 1543781 - RNA, 22 nt, Homo sapiens
ugggccagggucucgucaggag

SEQ ID NO: 1543782 - RNA, 17 nt, Homo sapiens
ugggcuagauaggauau

SEQ ID NO: 1543783 - RNA, 16 nt, Homo sapiens
ugggcugagacuggau

SEQ ID NO: 1543784 - RNA, 12 nt, Homo sapiens
ugggggauuuca

SEQ ID NO: 1543785 - RNA, 18 nt, Homo sapiens
ugggggcugcugcacugc

SEQ ID NO: 1543786 - RNA, 17 nt, Homo sapiens
ugggguagagaggacag

SEQ ID NO: 1543787 - RNA, 17 nt, Homo sapiens
ugggguuccccuggaaa

SEQ ID NO: 1543788 - RNA, 14 nt, Homo sapiens
ugggugucugcuaa

SEQ ID NO: 1543789 - RNA, 15 nt, Homo sapiens
ugguagacugugaca

SEQ ID NO: 1543790 - RNA, 16 nt, Homo sapiens
ugguccacauucugcu

SEQ ID NO: 1543791 - RNA, 18 nt, Homo sapiens
uggucccagcggaugcug

SEQ ID NO: 1543792 - RNA, 14 nt, Homo sapiens
ugguccugcacugu

SEQ ID NO: 1543793 - RNA, 22 nt, Homo sapiens
ugguccuuaaaaaauaugcucu

SEQ ID NO: 1543794 - RNA, 22 nt, Homo sapiens
uggugagaaucgaccucacugu

SEQ ID NO: 1543795 - RNA, 15 nt, Homo sapiens
uggugcgaucuuggc

SEQ ID NO: 1543796 - RNA, 14 nt, Homo sapiens
uggugcuggguccu

SEQ ID NO: 1543797 - RNA, 20 nt, Homo sapiens
ugguuuuaaaaaagcauuau

SEQ ID NO: 1543798 - RNA, 17 nt, Homo sapiens
uguaaaauucauagcau

SEQ ID NO: 1543799 - RNA, 13 nt, Homo sapiens
uguaaucccagca

SEQ ID NO: 1543800 - RNA, 18 nt, Homo sapiens
uguacaauaaagcaaugu

SEQ ID NO: 1543801 - RNA, 20 nt, Homo sapiens
uguacaauaaagcaaugugg

SEQ ID NO: 1543802 - RNA, 11 nt, Homo sapiens
uguacuacccc

SEQ ID NO: 1543803 - RNA, 20 nt, Homo sapiens
uguauaauuggaguagauau

SEQ ID NO: 1543804 - RNA, 13 nt, Homo sapiens
uguaucuaugcau

SEQ ID NO: 1543805 - RNA, 12 nt, Homo sapiens
uguaugcacuuu

SEQ ID NO: 1543806 - RNA, 20 nt, Homo sapiens
uguauuuuacuuugugcaau

SEQ ID NO: 1543807 - RNA, 16 nt, Homo sapiens
ugucaaggggcccuag

SEQ ID NO: 1543808 - RNA, 19 nt, Homo sapiens
ugucaugauuucaaugauu

SEQ ID NO: 1543809 - RNA, 18 nt, Homo sapiens
uguccaccugugcugcug

SEQ ID NO: 1543810 - RNA, 13 nt, Homo sapiens
uguccauuccaaa

SEQ ID NO: 1543811 - RNA, 15 nt, Homo sapiens
uguccuaaaugcaaa

SEQ ID NO: 1543812 - RNA, 14 nt, Homo sapiens
uguccuacaauauc

SEQ ID NO: 1543813 - RNA, 16 nt, Homo sapiens
uguccuacaauaucau

SEQ ID NO: 1543814 - RNA, 16 nt, Homo sapiens
uguccuguuccugcca

SEQ ID NO: 1543815 - RNA, 17 nt, Homo sapiens
uguccuguuccugccac

SEQ ID NO: 1543816 - RNA, 22 nt, Homo sapiens
ugucuaagaauaaugacguauu

SEQ ID NO: 1543817 - RNA, 13 nt, Homo sapiens
ugucucucaugaa

SEQ ID NO: 1543818 - RNA, 13 nt, Homo sapiens
ugucugauucuau

SEQ ID NO: 1543819 - RNA, 23 nt, Homo sapiens
ugucugucccaguuaacuguuaa

SEQ ID NO: 1543820 - RNA, 15 nt, Homo sapiens
ugucugugaugucag

SEQ ID NO: 1543821 - RNA, 22 nt, Homo sapiens
ugucuuugacuugguuaaagga

SEQ ID NO: 1543822 - RNA, 16 nt, Homo sapiens
ugugaaauaucaucac

SEQ ID NO: 1543823 - RNA, 16 nt, Homo sapiens
ugugagcagucucagc

SEQ ID NO: 1543824 - RNA, 20 nt, Homo sapiens
ugugagcuucagauggugaa

SEQ ID NO: 1543825 - RNA, 12 nt, Homo sapiens
ugugaucuauac

SEQ ID NO: 1543826 - RNA, 18 nt, Homo sapiens
ugugaucuauaccaccuu

SEQ ID NO: 1543827 - RNA, 22 nt, Homo sapiens
ugugauuggcagcuucaaaaca

SEQ ID NO: 1543828 - RNA, 19 nt, Homo sapiens
ugugcuaaguugucuuaca

SEQ ID NO: 1543829 - RNA, 15 nt, Homo sapiens
ugugcugccuguggu

SEQ ID NO: 1543830 - RNA, 23 nt, Homo sapiens
ugugcugccuguggugagguccu

SEQ ID NO: 1543831 - RNA, 14 nt, Homo sapiens
uguggccucagcau

SEQ ID NO: 1543832 - RNA, 16 nt, Homo sapiens
uguggccuuggucuaa

SEQ ID NO: 1543833 - RNA, 15 nt, Homo sapiens
uguggcuuaguaaua

SEQ ID NO: 1543834 - RNA, 15 nt, Homo sapiens
ugugugaaaauguga

SEQ ID NO: 1543835 - RNA, 22 nt, Homo sapiens
ugugugcuuugccacugaagua

SEQ ID NO: 1543836 - RNA, 17 nt, Homo sapiens
ugugugguauucaacua

SEQ ID NO: 1543837 - RNA, 23 nt, Homo sapiens
uguuaauggucaaugcuagcaca

SEQ ID NO: 1543838 - RNA, 14 nt, Homo sapiens
uguuaccuucacau

SEQ ID NO: 1543839 - RNA, 14 nt, Homo sapiens
uguuacuacaugca

SEQ ID NO: 1543840 - RNA, 19 nt, Homo sapiens
uguuaggaagggugagaau

SEQ ID NO: 1543841 - RNA, 20 nt, Homo sapiens
uguucucagagcuccacaga

SEQ ID NO: 1543842 - RNA, 23 nt, Homo sapiens
uguugauaauaguaaugguucua

SEQ ID NO: 1543843 - RNA, 20 nt, Homo sapiens
uguugauucuagguugaaaa

SEQ ID NO: 1543844 - RNA, 18 nt, Homo sapiens
uguugccuggaagcacau

SEQ ID NO: 1543845 - RNA, 17 nt, Homo sapiens
uguuuacaugaguucaa

SEQ ID NO: 1543846 - RNA, 16 nt, Homo sapiens
uguuuugcaagggaau

SEQ ID NO: 1543847 - RNA, 17 nt, Homo sapiens
uguuuugcauggaguau

SEQ ID NO: 1543848 - RNA, 17 nt, Homo sapiens
uuaaaaaaaaacauuca

SEQ ID NO: 1543849 - RNA, 18 nt, Homo sapiens
uuaaaaaaaaacauucaa

SEQ ID NO: 1543850 - RNA, 14 nt, Homo sapiens
uuaaaaaaauaaca

SEQ ID NO: 1543851 - RNA, 16 nt, Homo sapiens
uuaaaaaucaguuugu

SEQ ID NO: 1543852 - RNA, 18 nt, Homo sapiens
uuaaaaugauuuuuaaca

SEQ ID NO: 1543853 - RNA, 15 nt, Homo sapiens
uuaaacuacugauug

SEQ ID NO: 1543854 - RNA, 21 nt, Homo sapiens
uuaaaugcuguaugucauuaa

SEQ ID NO: 1543855 - RNA, 20 nt, Homo sapiens
uuaacuccguuuccaaauac

SEQ ID NO: 1543856 - RNA, 19 nt, Homo sapiens
uuaagcccuacgaugggau

SEQ ID NO: 1543857 - RNA, 16 nt, Homo sapiens
uuaagucaccuguaua

SEQ ID NO: 1543858 - RNA, 14 nt, Homo sapiens
uuaauaaauguaua

SEQ ID NO: 1543859 - RNA, 22 nt, Homo sapiens
uuaauggucaaugcuagcacaa

SEQ ID NO: 1543860 - RNA, 18 nt, Homo sapiens
uuaauggugccuucauuu

SEQ ID NO: 1543861 - RNA, 14 nt, Homo sapiens
uuaauguacuuuca

SEQ ID NO: 1543862 - RNA, 15 nt, Homo sapiens
uuaauguacuuucau

SEQ ID NO: 1543863 - RNA, 18 nt, Homo sapiens
uuaauuaaacaaauuccu

SEQ ID NO: 1543864 - RNA, 20 nt, Homo sapiens
uuacaauaauucuaugagau

SEQ ID NO: 1543865 - RNA, 21 nt, Homo sapiens
uuacagaagaagcuccugaau

SEQ ID NO: 1543866 - RNA, 12 nt, Homo sapiens
uuacagugccac

SEQ ID NO: 1543867 - RNA, 13 nt, Homo sapiens
uuacaugauucau

SEQ ID NO: 1543868 - RNA, 12 nt, Homo sapiens
uuacaugcauua

SEQ ID NO: 1543869 - RNA, 14 nt, Homo sapiens
uuaccaugcucaau

SEQ ID NO: 1543870 - RNA, 17 nt, Homo sapiens
uuaccaugcucaaugaa

SEQ ID NO: 1543871 - RNA, 18 nt, Homo sapiens
uuaccucugcauaaauau

SEQ ID NO: 1543872 - RNA, 22 nt, Homo sapiens
uuaccuguaauagccucaccuu

SEQ ID NO: 1543873 - RNA, 13 nt, Homo sapiens
uuacuaacacugg

SEQ ID NO: 1543874 - RNA, 16 nt, Homo sapiens
uuagaaaugauuucaa

SEQ ID NO: 1543875 - RNA, 20 nt, Homo sapiens
uuagaaugucaguugaucag

SEQ ID NO: 1543876 - RNA, 22 nt, Homo sapiens
uuagauuaacccuauuaaucua

SEQ ID NO: 1543877 - RNA, 12 nt, Homo sapiens
uuagcaaagcau

SEQ ID NO: 1543878 - RNA, 23 nt, Homo sapiens
uuagcacagaggauggcuucccc

SEQ ID NO: 1543879 - RNA, 16 nt, Homo sapiens
uuagucauaccaucca

SEQ ID NO: 1543880 - RNA, 14 nt, Homo sapiens
uuaguccucaccuu

SEQ ID NO: 1543881 - RNA, 15 nt, Homo sapiens
uuagugucuguccau

SEQ ID NO: 1543882 - RNA, 15 nt, Homo sapiens
uuauacuucuuuauu

SEQ ID NO: 1543883 - RNA, 19 nt, Homo sapiens
uuauauaugaaaacuaagu

SEQ ID NO: 1543884 - RNA, 17 nt, Homo sapiens
uuauaucagacugcuuu

SEQ ID NO: 1543885 - RNA, 18 nt, Homo sapiens
uuauaucuguggucuuca

SEQ ID NO: 1543886 - RNA, 11 nt, Homo sapiens
uuaucaugugu

SEQ ID NO: 1543887 - RNA, 21 nt, Homo sapiens
uuauccagaggguugugauuu

SEQ ID NO: 1543888 - RNA, 16 nt, Homo sapiens
uuauccuuuuaucuca

SEQ ID NO: 1543889 - RNA, 15 nt, Homo sapiens
uuaucuuaucuagca

SEQ ID NO: 1543890 - RNA, 18 nt, Homo sapiens
uuaugaccucaacaaaga

SEQ ID NO: 1543891 - RNA, 22 nt, Homo sapiens
uuaugacuguuuuuguaguggu

SEQ ID NO: 1543892 - RNA, 20 nt, Homo sapiens
uuauuaacauauauuguuau

SEQ ID NO: 1543893 - RNA, 13 nt, Homo sapiens
uuauuaugauuag

SEQ ID NO: 1543894 - RNA, 15 nt, Homo sapiens
uuauucccccaaagc

SEQ ID NO: 1543895 - RNA, 14 nt, Homo sapiens
uuauugaaugugau

SEQ ID NO: 1543896 - RNA, 13 nt, Homo sapiens
uuauuguauauau

SEQ ID NO: 1543897 - RNA, 14 nt, Homo sapiens
uuauuguugcauua

SEQ ID NO: 1543898 - RNA, 19 nt, Homo sapiens
uucaaaacagaacggguuc

SEQ ID NO: 1543899 - RNA, 14 nt, Homo sapiens
uucaaauacuuuug

SEQ ID NO: 1543900 - RNA, 11 nt, Homo sapiens
uucaaaugcau

SEQ ID NO: 1543901 - RNA, 15 nt, Homo sapiens
uucaacuucaggaaa

SEQ ID NO: 1543902 - RNA, 14 nt, Homo sapiens
uucaagacuuccuc

SEQ ID NO: 1543903 - RNA, 20 nt, Homo sapiens
uucaagugcaauccauguau

SEQ ID NO: 1543904 - RNA, 17 nt, Homo sapiens
uucaaucaaacuuucag

SEQ ID NO: 1543905 - RNA, 23 nt, Homo sapiens
ugaaucaguccuagaauguuuca

SEQ ID NO: 1543906 - RNA, 15 nt, Homo sapiens
ugaaugacauugaac

SEQ ID NO: 1543907 - RNA, 18 nt, Homo sapiens
ugaauugaagucaucaua

SEQ ID NO: 1543908 - RNA, 14 nt, Homo sapiens
ugaauuuugccaua

SEQ ID NO: 1543909 - RNA, 14 nt, Homo sapiens
ugacacugucugcu

SEQ ID NO: 1543910 - RNA, 17 nt, Homo sapiens
ugacaggaaaguggaug

SEQ ID NO: 1543911 - RNA, 16 nt, Homo sapiens
ugacaggcuuucccag

SEQ ID NO: 1543912 - RNA, 16 nt, Homo sapiens
ugacaucaguggcaug

SEQ ID NO: 1543913 - RNA, 17 nt, Homo sapiens
ugaccagagcaccucag

SEQ ID NO: 1543914 - RNA, 21 nt, Homo sapiens
ugaccuugaugucuugagagc

SEQ ID NO: 1543915 - RNA, 23 nt, Homo sapiens
ugacgugaguggggaggagacuc

SEQ ID NO: 1543916 - RNA, 20 nt, Homo sapiens
ugacucaccuugcucugcca

SEQ ID NO: 1543917 - RNA, 19 nt, Homo sapiens
ugacucacucauaaagguu

SEQ ID NO: 1543918 - RNA, 12 nt, Homo sapiens
ugacuguuuaca

SEQ ID NO: 1543919 - RNA, 14 nt, Homo sapiens
ugacuuaugugcag

SEQ ID NO: 1543920 - RNA, 13 nt, Homo sapiens
ugacuucaugcca

SEQ ID NO: 1543921 - RNA, 21 nt, Homo sapiens
ugacuuugccacauccauuga

SEQ ID NO: 1543922 - RNA, 17 nt, Homo sapiens
ugagaaaagcuuugaac

SEQ ID NO: 1543923 - RNA, 19 nt, Homo sapiens
ugagaaaagcuuugaaccc

SEQ ID NO: 1543924 - RNA, 15 nt, Homo sapiens
ugagaaaucucaucc

SEQ ID NO: 1543925 - RNA, 23 nt, Homo sapiens
ugagaagauaaaaacugcccauu

SEQ ID NO: 1543926 - RNA, 20 nt, Homo sapiens
ugagaaucgaccucacuguc

SEQ ID NO: 1543927 - RNA, 22 nt, Homo sapiens
ugagacagcuucgguuucuaac

SEQ ID NO: 1543928 - RNA, 20 nt, Homo sapiens
ugagagcccaaucacugccu

SEQ ID NO: 1543929 - RNA, 15 nt, Homo sapiens
ugagauccucaaaaa

SEQ ID NO: 1543930 - RNA, 20 nt, Homo sapiens
ugagauccucaaaaaucauc

SEQ ID NO: 1543931 - RNA, 13 nt, Homo sapiens
ugagauuacaggu

SEQ ID NO: 1543932 - RNA, 18 nt, Homo sapiens
ugagcaaacugaagccca

SEQ ID NO: 1543933 - RNA, 12 nt, Homo sapiens
ugagcaggguga

SEQ ID NO: 1543934 - RNA, 12 nt, Homo sapiens
ugagccaaagag

SEQ ID NO: 1543935 - RNA, 19 nt, Homo sapiens
ugagccagucccucagcca

SEQ ID NO: 1543936 - RNA, 21 nt, Homo sapiens
ugagcggccgccuguccuugg

SEQ ID NO: 1543937 - RNA, 15 nt, Homo sapiens
ugaggacaauccccc

SEQ ID NO: 1543938 - RNA, 19 nt, Homo sapiens
ugaggacauaaaucuucca

SEQ ID NO: 1543939 - RNA, 16 nt, Homo sapiens
ugaggcgugggaucca

SEQ ID NO: 1543940 - RNA, 14 nt, Homo sapiens
ugagggcaggguuc

SEQ ID NO: 1543941 - RNA, 13 nt, Homo sapiens
ugaggggacugca

SEQ ID NO: 1543942 - RNA, 19 nt, Homo sapiens
ugaggucaucccggggcca

SEQ ID NO: 1543943 - RNA, 21 nt, Homo sapiens
ugaguauucauuuugcaacuu

SEQ ID NO: 1543944 - RNA, 22 nt, Homo sapiens
ugaguuugcuguauacaaacag

SEQ ID NO: 1543945 - RNA, 15 nt, Homo sapiens
ugauaaggaugauaa

SEQ ID NO: 1543946 - RNA, 19 nt, Homo sapiens
ugauaauggaaacugucaa

SEQ ID NO: 1543947 - RNA, 15 nt, Homo sapiens
ugauacuuccucaua

SEQ ID NO: 1543948 - RNA, 12 nt, Homo sapiens
ugauacuugguc

SEQ ID NO: 1543949 - RNA, 14 nt, Homo sapiens
ugauauauuuucca

SEQ ID NO: 1543950 - RNA, 17 nt, Homo sapiens
ugaugaauaaacacuuu

SEQ ID NO: 1543951 - RNA, 13 nt, Homo sapiens
ugaugauccauua

SEQ ID NO: 1543952 - RNA, 15 nt, Homo sapiens
ugaugcccuuuggaa

SEQ ID NO: 1543953 - RNA, 20 nt, Homo sapiens
ugauggccaggccucaggga

SEQ ID NO: 1543954 - RNA, 21 nt, Homo sapiens
ugauggccaggccucagggac

SEQ ID NO: 1543955 - RNA, 23 nt, Homo sapiens
ugauggccaggccucagggacca

SEQ ID NO: 1543956 - RNA, 14 nt, Homo sapiens
ugauuacagcauag

SEQ ID NO: 1543957 - RNA, 15 nt, Homo sapiens
ugauucuaaagggga

SEQ ID NO: 1543958 - RNA, 19 nt, Homo sapiens
ugauuggacauuuucuuca

SEQ ID NO: 1543959 - RNA, 15 nt, Homo sapiens
ugauugucaccauga

SEQ ID NO: 1543960 - RNA, 11 nt, Homo sapiens
ugauuugcaac

SEQ ID NO: 1543961 - RNA, 17 nt, Homo sapiens
ugcaaaacauaucuuga

SEQ ID NO: 1543962 - RNA, 17 nt, Homo sapiens
ugcaaacaaaaugaugg

SEQ ID NO: 1543963 - RNA, 15 nt, Homo sapiens
ugcaaauacuuccaa

SEQ ID NO: 1543964 - RNA, 16 nt, Homo sapiens
ugcaacuucuaccucc

SEQ ID NO: 1543965 - RNA, 23 nt, Homo sapiens
ugcaaucuuauguugaucgaugu

SEQ ID NO: 1543966 - RNA, 14 nt, Homo sapiens
ugcacacaccugca

SEQ ID NO: 1543967 - RNA, 15 nt, Homo sapiens
ugcacacaccugcac

SEQ ID NO: 1543968 - RNA, 14 nt, Homo sapiens
ugcagcucccagaa

SEQ ID NO: 1543969 - RNA, 14 nt, Homo sapiens
ugcagggaccaaga

SEQ ID NO: 1543970 - RNA, 20 nt, Homo sapiens
ugcaguggugcgaucuuggc

SEQ ID NO: 1543971 - RNA, 18 nt, Homo sapiens
ugcauaaaugugguacaa

SEQ ID NO: 1543972 - RNA, 17 nt, Homo sapiens
ugcaugcacuucuuaca

SEQ ID NO: 1543973 - RNA, 21 nt, Homo sapiens
ugcauggcauuuguuccacag

SEQ ID NO: 1543974 - RNA, 15 nt, Homo sapiens
ugcauuaaaaaugca

SEQ ID NO: 1543975 - RNA, 21 nt, Homo sapiens
ugcauuaaaaaugcauauacu

SEQ ID NO: 1543976 - RNA, 21 nt, Homo sapiens
ugcauuugugcguaugcagug

SEQ ID NO: 1543977 - RNA, 21 nt, Homo sapiens
ugccaaaaacuaaaauucaac

SEQ ID NO: 1543978 - RNA, 13 nt, Homo sapiens
ugccaacuuucca

SEQ ID NO: 1543979 - RNA, 11 nt, Homo sapiens
ugccacuggau

SEQ ID NO: 1543980 - RNA, 21 nt, Homo sapiens
ugccaggagugggugggacac

SEQ ID NO: 1543981 - RNA, 22 nt, Homo sapiens
ugccagucacuccguuuugcaa

SEQ ID NO: 1543982 - RNA, 20 nt, Homo sapiens
ugccccguccacggcucuag

SEQ ID NO: 1543983 - RNA, 22 nt, Homo sapiens
ugcccggggcagcugccagaga

SEQ ID NO: 1543984 - RNA, 23 nt, Homo sapiens
ugcccggggcagcugccagagaa

SEQ ID NO: 1543985 - RNA, 15 nt, Homo sapiens
ugcccuagcaguuug

SEQ ID NO: 1543986 - RNA, 20 nt, Homo sapiens
ugcccuucagcauccucagu

SEQ ID NO: 1543987 - RNA, 17 nt, Homo sapiens
ugcccuucuuccauucc

SEQ ID NO: 1543988 - RNA, 21 nt, Homo sapiens
ugccgauuuccuaagcuguug

SEQ ID NO: 1543989 - RNA, 12 nt, Homo sapiens
ugccucaggaau

SEQ ID NO: 1543990 - RNA, 22 nt, Homo sapiens
ugccucccuggcagcacaggaa

SEQ ID NO: 1543991 - RNA, 17 nt, Homo sapiens
ugccucugcacgugcac

SEQ ID NO: 1543992 - RNA, 15 nt, Homo sapiens
ugccuggaguuggaa

SEQ ID NO: 1543993 - RNA, 15 nt, Homo sapiens
ugccuguauuuccaa

SEQ ID NO: 1543994 - RNA, 16 nt, Homo sapiens
ugccuugccaugucuu

SEQ ID NO: 1543995 - RNA, 19 nt, Homo sapiens
ugcggugugagauggugcc

SEQ ID NO: 1543996 - RNA, 15 nt, Homo sapiens
ugcggugugucucca

SEQ ID NO: 1543997 - RNA, 22 nt, Homo sapiens
ugcguaggagagaacagggaug

SEQ ID NO: 1543998 - RNA, 15 nt, Homo sapiens
ugcuauaauguauaa

SEQ ID NO: 1543999 - RNA, 22 nt, Homo sapiens
ugcucacccaggaccucugggg

SEQ ID NO: 1544000 - RNA, 14 nt, Homo sapiens
ugcucagauucuaa

SEQ ID NO: 1544001 - RNA, 17 nt, Homo sapiens
ugcucauuucacuauuc

SEQ ID NO: 1544002 - RNA, 12 nt, Homo sapiens
ugcuccaugcag

SEQ ID NO: 1544003 - RNA, 21 nt, Homo sapiens
ugcucccuagccagaggcucu

SEQ ID NO: 1544004 - RNA, 18 nt, Homo sapiens
ugcucuggggcuugcuau

SEQ ID NO: 1544005 - RNA, 11 nt, Homo sapiens
ugcugcacugc

SEQ ID NO: 1544006 - RNA, 21 nt, Homo sapiens
ugcugccaggcucccacugcc

SEQ ID NO: 1544007 - RNA, 20 nt, Homo sapiens
ugcuggaguccuguucucag

SEQ ID NO: 1544008 - RNA, 15 nt, Homo sapiens
ugcuguuuacuugaa

SEQ ID NO: 1544009 - RNA, 21 nt, Homo sapiens
ugcuuauaagcaacaugaauu

SEQ ID NO: 1544010 - RNA, 17 nt, Homo sapiens
ugcuucaggauaccaua

SEQ ID NO: 1544011 - RNA, 19 nt, Homo sapiens
ugcuucaggauaccauaua

SEQ ID NO: 1544012 - RNA, 17 nt, Homo sapiens
ugcuucaguacuuguga

SEQ ID NO: 1544013 - RNA, 17 nt, Homo sapiens
ugcuuugagaaaucuca

SEQ ID NO: 1544014 - RNA, 17 nt, Homo sapiens
ugcuuuguaugcacuuu

SEQ ID NO: 1544015 - RNA, 14 nt, Homo sapiens
uggaaauaaagcuu

SEQ ID NO: 1544016 - RNA, 18 nt, Homo sapiens
uggaaauccuguuacuua

SEQ ID NO: 1544017 - RNA, 18 nt, Homo sapiens
uggaagaggcaccugucc

SEQ ID NO: 1544018 - RNA, 12 nt, Homo sapiens
uggaagcacugc

SEQ ID NO: 1544019 - RNA, 18 nt, Homo sapiens
uggaagggccuucuccac

SEQ ID NO: 1544020 - RNA, 21 nt, Homo sapiens
uggaauacuugaaaaccucau

SEQ ID NO: 1544021 - RNA, 13 nt, Homo sapiens
uggacuacacaca

SEQ ID NO: 1544022 - RNA, 18 nt, Homo sapiens
uggacucuguggggccac

SEQ ID NO: 1544023 - RNA, 18 nt, Homo sapiens
uggacuuuccacccccuc

SEQ ID NO: 1544024 - RNA, 17 nt, Homo sapiens
uggagagaugggacaau

SEQ ID NO: 1544025 - RNA, 20 nt, Homo sapiens
uggagcguguacuaccccag

SEQ ID NO: 1544026 - RNA, 15 nt, Homo sapiens
uggaggaaaccacaa

SEQ ID NO: 1544027 - RNA, 15 nt, Homo sapiens
uggaggccucugcaa

SEQ ID NO: 1544028 - RNA, 17 nt, Homo sapiens
uggaguccuguucucag

SEQ ID NO: 1544029 - RNA, 23 nt, Homo sapiens
uggaguccuguucucagagcucc

SEQ ID NO: 1544030 - RNA, 20 nt, Homo sapiens
uggauaauaacuagaucucc

SEQ ID NO: 1544031 - RNA, 20 nt, Homo sapiens
uggauuugcauacauucuuc

SEQ ID NO: 1544032 - RNA, 21 nt, Homo sapiens
uggcacuugcaagucccauga

SEQ ID NO: 1544033 - RNA, 17 nt, Homo sapiens
uggcagccgugccuuca

SEQ ID NO: 1544034 - RNA, 22 nt, Homo sapiens
uggccagaagggggccaugagg

SEQ ID NO: 1544035 - RNA, 23 nt, Homo sapiens
uggcccccgagcugggggccaug

SEQ ID NO: 1544036 - RNA, 15 nt, Homo sapiens
uggccccuucacuuc

SEQ ID NO: 1544037 - RNA, 12 nt, Homo sapiens
uccccagugugg

SEQ ID NO: 1544038 - RNA, 15 nt, Homo sapiens
uccccgugggccaug

SEQ ID NO: 1544039 - RNA, 23 nt, Homo sapiens
uccccuccuugccuccuguguaa

SEQ ID NO: 1544040 - RNA, 20 nt, Homo sapiens
uccccuggaacugucucuca

SEQ ID NO: 1544041 - RNA, 20 nt, Homo sapiens
uccccugguccugcacuguc

SEQ ID NO: 1544042 - RNA, 15 nt, Homo sapiens
ucccuaaaaauucca

SEQ ID NO: 1544043 - RNA, 17 nt, Homo sapiens
ucccucccauuugcaga

SEQ ID NO: 1544044 - RNA, 14 nt, Homo sapiens
ucccucucuugccg

SEQ ID NO: 1544045 - RNA, 15 nt, Homo sapiens
ucccuggaagaggaa

SEQ ID NO: 1544046 - RNA, 14 nt, Homo sapiens
ucccuuaggaauau

SEQ ID NO: 1544047 - RNA, 22 nt, Homo sapiens
ucccuuaggaauauacauaguc

SEQ ID NO: 1544048 - RNA, 19 nt, Homo sapiens
ucccuucgauauaugacuu

SEQ ID NO: 1544049 - RNA, 17 nt, Homo sapiens
ucccuuuaucauguguu

SEQ ID NO: 1544050 - RNA, 14 nt, Homo sapiens
ucccuuuccccaua

SEQ ID NO: 1544051 - RNA, 20 nt, Homo sapiens
uccgacuucucuagacaucu

SEQ ID NO: 1544052 - RNA, 14 nt, Homo sapiens
uccgucaccucaga

SEQ ID NO: 1544053 - RNA, 23 nt, Homo sapiens
uccgucaccucagagacauacac

SEQ ID NO: 1544054 - RNA, 21 nt, Homo sapiens
uccuaugagagaagagaguau

SEQ ID NO: 1544055 - RNA, 15 nt, Homo sapiens
uccuaugcugcaaua

SEQ ID NO: 1544056 - RNA, 18 nt, Homo sapiens
uccuauuacugaugugug

SEQ ID NO: 1544057 - RNA, 17 nt, Homo sapiens
uccucaagauccugucu

SEQ ID NO: 1544058 - RNA, 14 nt, Homo sapiens
uccuccagcaauag

SEQ ID NO: 1544059 - RNA, 13 nt, Homo sapiens
uccucuccacugc

SEQ ID NO: 1544060 - RNA, 18 nt, Homo sapiens
uccucuccacugccuucg

SEQ ID NO: 1544061 - RNA, 18 nt, Homo sapiens
uccucuuucacuucuuau

SEQ ID NO: 1544062 - RNA, 13 nt, Homo sapiens
uccugaggagcag

SEQ ID NO: 1544063 - RNA, 11 nt, Homo sapiens
uccugcacugu

SEQ ID NO: 1544064 - RNA, 21 nt, Homo sapiens
uccugggggcugcugcacugc

SEQ ID NO: 1544065 - RNA, 11 nt, Homo sapiens
uccuguucuca

SEQ ID NO: 1544066 - RNA, 24 nt, Homo sapiens
uccuguugcaaugacacauaggaa

SEQ ID NO: 1544067 - RNA, 21 nt, Homo sapiens
uccuguuugaugugacaggaa

SEQ ID NO: 1544068 - RNA, 16 nt, Homo sapiens
uccuuaaacagggcau

SEQ ID NO: 1544069 - RNA, 18 nt, Homo sapiens
uccuuagaauacuguauu

SEQ ID NO: 1544070 - RNA, 19 nt, Homo sapiens
uccuucacucccugucaua

SEQ ID NO: 1544071 - RNA, 13 nt, Homo sapiens
uccuuuaauccca

SEQ ID NO: 1544072 - RNA, 18 nt, Homo sapiens
ucgaagcuguucucugcu

SEQ ID NO: 1544073 - RNA, 18 nt, Homo sapiens
ucgacugugaccuguggg

SEQ ID NO: 1544074 - RNA, 22 nt, Homo sapiens
ucgccccuccaguguugccucc

SEQ ID NO: 1544075 - RNA, 16 nt, Homo sapiens
ucggaguugggggucc

SEQ ID NO: 1544076 - RNA, 14 nt, Homo sapiens
ucggccgucuucac

SEQ ID NO: 1544077 - RNA, 17 nt, Homo sapiens
ucgggacuucaaaauca

SEQ ID NO: 1544078 - RNA, 23 nt, Homo sapiens
ucuaaauuaugugaauuuugcca

SEQ ID NO: 1544079 - RNA, 16 nt, Homo sapiens
ucuaauccaugugcug

SEQ ID NO: 1544080 - RNA, 21 nt, Homo sapiens
ucuaauccaugugcugcugug

SEQ ID NO: 1544081 - RNA, 16 nt, Homo sapiens
ucuacuccaugcacau

SEQ ID NO: 1544082 - RNA, 23 nt, Homo sapiens
ucuagaaggaugaacaguucucc

SEQ ID NO: 1544083 - RNA, 22 nt, Homo sapiens
ucuaguccuauucuauugcagu

SEQ ID NO: 1544084 - RNA, 18 nt, Homo sapiens
ucuagucucugauuugca

SEQ ID NO: 1544085 - RNA, 13 nt, Homo sapiens
ucuauaaauucaa

SEQ ID NO: 1544086 - RNA, 21 nt, Homo sapiens
ucuaugagauagguacuauua

SEQ ID NO: 1544087 - RNA, 22 nt, Homo sapiens
ucuaugagauagguacuauuau

SEQ ID NO: 1544088 - RNA, 18 nt, Homo sapiens
ucuauguagaacuguuca

SEQ ID NO: 1544089 - RNA, 16 nt, Homo sapiens
ucuauuucaacuucag

SEQ ID NO: 1544090 - RNA, 22 nt, Homo sapiens
ucucaaaguuuuuacaguguau

SEQ ID NO: 1544091 - RNA, 15 nt, Homo sapiens
ucucacuaaaaugga

SEQ ID NO: 1544092 - RNA, 18 nt, Homo sapiens
ucucagagcuccacagaa

SEQ ID NO: 1544093 - RNA, 13 nt, Homo sapiens
ucucagcacuuug

SEQ ID NO: 1544094 - RNA, 18 nt, Homo sapiens
ucucagcgcaacagcugu

SEQ ID NO: 1544095 - RNA, 17 nt, Homo sapiens
ucucagugcuagcuuau

SEQ ID NO: 1544096 - RNA, 23 nt, Homo sapiens
ucucaucaacaaagaaauauuau

SEQ ID NO: 1544097 - RNA, 14 nt, Homo sapiens
ucucauuacagauu

SEQ ID NO: 1544098 - RNA, 20 nt, Homo sapiens
ucuccaccccucaagccagg

SEQ ID NO: 1544099 - RNA, 16 nt, Homo sapiens
ucuccccuccaaguga

SEQ ID NO: 1544100 - RNA, 20 nt, Homo sapiens
ucucccuggcauuguuucca

SEQ ID NO: 1544101 - RNA, 17 nt, Homo sapiens
ucucgcuagccauauau

SEQ ID NO: 1544102 - RNA, 14 nt, Homo sapiens
ucucuagacaucua

SEQ ID NO: 1544103 - RNA, 13 nt, Homo sapiens
ucucuaugaucuu

SEQ ID NO: 1544104 - RNA, 21 nt, Homo sapiens
ucucuguggccauuugugaua

SEQ ID NO: 1544105 - RNA, 17 nt, Homo sapiens
ucucuuuuccacugaca

SEQ ID NO: 1544106 - RNA, 18 nt, Homo sapiens
ucugaacugcaacacugg

SEQ ID NO: 1544107 - RNA, 15 nt, Homo sapiens
ucugaagucacugca

SEQ ID NO: 1544108 - RNA, 17 nt, Homo sapiens
ucugaagucacugcaca

SEQ ID NO: 1544109 - RNA, 12 nt, Homo sapiens
ucugagcaccua

SEQ ID NO: 1544110 - RNA, 14 nt, Homo sapiens
ucugaggaugcuga

SEQ ID NO: 1544111 - RNA, 18 nt, Homo sapiens
ucugaguuccugcaugcc

SEQ ID NO: 1544112 - RNA, 17 nt, Homo sapiens
ucugaucaaagcaccuu

SEQ ID NO: 1544113 - RNA, 18 nt, Homo sapiens
ucugcaaauaguuucaaa

SEQ ID NO: 1544114 - RNA, 19 nt, Homo sapiens
ucugcaucuccacuuggca

SEQ ID NO: 1544115 - RNA, 13 nt, Homo sapiens
ucugccauuucau

SEQ ID NO: 1544116 - RNA, 22 nt, Homo sapiens
ucugcgucccacugagucucau

SEQ ID NO: 1544117 - RNA, 17 nt, Homo sapiens
ucugcuaugucugugau

SEQ ID NO: 1544118 - RNA, 13 nt, Homo sapiens
ucugcuccaugca

SEQ ID NO: 1544119 - RNA, 14 nt, Homo sapiens
ucugcuccaugcag

SEQ ID NO: 1544120 - RNA, 13 nt, Homo sapiens
ucugcugagcucu

SEQ ID NO: 1544121 - RNA, 15 nt, Homo sapiens
ucugcugcuuuccaa

SEQ ID NO: 1544122 - RNA, 16 nt, Homo sapiens
ucuggagaccaggacu

SEQ ID NO: 1544123 - RNA, 18 nt, Homo sapiens
ucuggagugugugggggu

SEQ ID NO: 1544124 - RNA, 20 nt, Homo sapiens
ucuggcccuguugugggggu

SEQ ID NO: 1544125 - RNA, 21 nt, Homo sapiens
ucuggcccuguugugggggug

SEQ ID NO: 1544126 - RNA, 18 nt, Homo sapiens
ucuggcuacgacuuggga

SEQ ID NO: 1544127 - RNA, 14 nt, Homo sapiens
ucuggucacuucaa

SEQ ID NO: 1544128 - RNA, 16 nt, Homo sapiens
ucugucaccaagccuu

SEQ ID NO: 1544129 - RNA, 15 nt, Homo sapiens
ucuuaaaauucuugg

SEQ ID NO: 1544130 - RNA, 14 nt, Homo sapiens
ucuuaacuauccua

SEQ ID NO: 1544131 - RNA, 16 nt, Homo sapiens
ucuuaaugccacggca

SEQ ID NO: 1544132 - RNA, 19 nt, Homo sapiens
ucuuacaauaauucuauga

SEQ ID NO: 1544133 - RNA, 22 nt, Homo sapiens
ucuuacaauaauucuaugagau

SEQ ID NO: 1544134 - RNA, 14 nt, Homo sapiens
ucuucaacaugguu

SEQ ID NO: 1544135 - RNA, 21 nt, Homo sapiens
ucuucaagccuggcccaguga

SEQ ID NO: 1544136 - RNA, 20 nt, Homo sapiens
ucuucaccaggaagaaggcc

SEQ ID NO: 1544137 - RNA, 21 nt, Homo sapiens
ucuucagagagcuaaauuaca

SEQ ID NO: 1544138 - RNA, 13 nt, Homo sapiens
ucuucagcuuuga

SEQ ID NO: 1544139 - RNA, 22 nt, Homo sapiens
ucuucaggguguuaaggcagug

SEQ ID NO: 1544140 - RNA, 19 nt, Homo sapiens
ucuuccaucugauugugau

SEQ ID NO: 1544141 - RNA, 17 nt, Homo sapiens
ucuucccacuuugccac

SEQ ID NO: 1544142 - RNA, 15 nt, Homo sapiens
ucuucugagcaccua

SEQ ID NO: 1544143 - RNA, 24 nt, Homo sapiens
ucuucuguaauauuuacaauguau

SEQ ID NO: 1544144 - RNA, 14 nt, Homo sapiens
ucuugaagaauauu

SEQ ID NO: 1544145 - RNA, 22 nt, Homo sapiens
ucuugaauguugaagaacucau

SEQ ID NO: 1544146 - RNA, 23 nt, Homo sapiens
ucuuggagaggagguguggagug

SEQ ID NO: 1544147 - RNA, 17 nt, Homo sapiens
ucuuuaaagacuugaug

SEQ ID NO: 1544148 - RNA, 14 nt, Homo sapiens
ucuuuaacauacau

SEQ ID NO: 1544149 - RNA, 14 nt, Homo sapiens
ucuuuaccuugcau

SEQ ID NO: 1544150 - RNA, 19 nt, Homo sapiens
ucuuuguuuacaugaguuc

SEQ ID NO: 1544151 - RNA, 14 nt, Homo sapiens
ucuuuuaaaccauu

SEQ ID NO: 1544152 - RNA, 19 nt, Homo sapiens
ucuuuugaaagaugguaau

SEQ ID NO: 1544153 - RNA, 20 nt, Homo sapiens
ugaaaaggugauugucacca

SEQ ID NO: 1544154 - RNA, 17 nt, Homo sapiens
ugaaaggcuuuccucag

SEQ ID NO: 1544155 - RNA, 12 nt, Homo sapiens
ugaaauaucauc

SEQ ID NO: 1544156 - RNA, 15 nt, Homo sapiens
ugaaauauuugcuua

SEQ ID NO: 1544157 - RNA, 18 nt, Homo sapiens
ugaaauguuuccaggcau

SEQ ID NO: 1544158 - RNA, 13 nt, Homo sapiens
ugaaauugaguca

SEQ ID NO: 1544159 - RNA, 23 nt, Homo sapiens
ugaacauuaauccacauguuuca

SEQ ID NO: 1544160 - RNA, 18 nt, Homo sapiens
ugaaccuaaacauagaaa

SEQ ID NO: 1544161 - RNA, 20 nt, Homo sapiens
ugaagaacucaugugauuua

SEQ ID NO: 1544162 - RNA, 13 nt, Homo sapiens
ugaagagguguuu

SEQ ID NO: 1544163 - RNA, 22 nt, Homo sapiens
ugaagccagcugcaggaaucaa

SEQ ID NO: 1544164 - RNA, 14 nt, Homo sapiens
ugaaguccagugac

SEQ ID NO: 1544165 - RNA, 20 nt, Homo sapiens
ugaaguuugccccagugcua

SEQ ID NO: 1544166 - RNA, 15 nt, Homo sapiens
ugaauaaagccacau

SEQ ID NO: 1544167 - RNA, 15 nt, Homo sapiens
ugaauaaguuuuauu

SEQ ID NO: 1544168 - RNA, 21 nt, Homo sapiens
ugaauagcgcccucaacccug

SEQ ID NO: 1544169 - RNA, 12 nt, Homo sapiens
uaucucaucucu

SEQ ID NO: 1544170 - RNA, 19 nt, Homo sapiens
uaucucgcuagccauauau

SEQ ID NO: 1544171 - RNA, 22 nt, Homo sapiens
uaucuuaggauuuaccaaauag

SEQ ID NO: 1544172 - RNA, 22 nt, Homo sapiens
uaucuuuaaagacuugaugaau

SEQ ID NO: 1544173 - RNA, 22 nt, Homo sapiens
uaugaaggcuguacacugcacg

SEQ ID NO: 1544174 - RNA, 21 nt, Homo sapiens
uaugacaauuucaaaaugcau

SEQ ID NO: 1544175 - RNA, 22 nt, Homo sapiens
uaugacaauuucaaaaugcaug

SEQ ID NO: 1544176 - RNA, 14 nt, Homo sapiens
uaugaccauaaaau

SEQ ID NO: 1544177 - RNA, 21 nt, Homo sapiens
uaugacuguuuuuguaguggu

SEQ ID NO: 1544178 - RNA, 22 nt, Homo sapiens
uaugacuguuuuuguaguggua

SEQ ID NO: 1544179 - RNA, 21 nt, Homo sapiens
uaugauucuccucucccaaau

SEQ ID NO: 1544180 - RNA, 22 nt, Homo sapiens
uauguaccguugauguugauaa

SEQ ID NO: 1544181 - RNA, 13 nt, Homo sapiens
uaugucauacucu

SEQ ID NO: 1544182 - RNA, 18 nt, Homo sapiens
uaugugaauuuugccaua

SEQ ID NO: 1544183 - RNA, 17 nt, Homo sapiens
uauguuuuaauuccaag

SEQ ID NO: 1544184 - RNA, 23 nt, Homo sapiens
uauguuuuaauuccaaguguuuc

SEQ ID NO: 1544185 - RNA, 15 nt, Homo sapiens
uauucauuuugcaac

SEQ ID NO: 1544186 - RNA, 14 nt, Homo sapiens
uauugaacuguaaa

SEQ ID NO: 1544187 - RNA, 23 nt, Homo sapiens
uauugguuuuaaaaaagcauuau

SEQ ID NO: 1544188 - RNA, 18 nt, Homo sapiens
uauuuaaggggaauuaac

SEQ ID NO: 1544189 - RNA, 17 nt, Homo sapiens
uauuuaggcaugagcuc

SEQ ID NO: 1544190 - RNA, 13 nt, Homo sapiens
uauuucaauguaa

SEQ ID NO: 1544191 - RNA, 15 nt, Homo sapiens
uauuucauaaacaac

SEQ ID NO: 1544192 - RNA, 15 nt, Homo sapiens
uauuucauaccaugg

SEQ ID NO: 1544193 - RNA, 12 nt, Homo sapiens
uauuuccacuuc

SEQ ID NO: 1544194 - RNA, 20 nt, Homo sapiens
uauuucuaagcuuauuucua

SEQ ID NO: 1544195 - RNA, 19 nt, Homo sapiens
uauuuguccaaacuguugg

SEQ ID NO: 1544196 - RNA, 15 nt, Homo sapiens
ucaaaagagucuuaa

SEQ ID NO: 1544197 - RNA, 17 nt, Homo sapiens
ucaaaguacuacagcaa

SEQ ID NO: 1544198 - RNA, 21 nt, Homo sapiens
ucaaauaaaucuaaaucuuca

SEQ ID NO: 1544199 - RNA, 16 nt, Homo sapiens
ucaaaucugagccuua

SEQ ID NO: 1544200 - RNA, 23 nt, Homo sapiens
ucaaauuuauuuccaauguuuca

SEQ ID NO: 1544201 - RNA, 18 nt, Homo sapiens
ucaacaugguuaccucug

SEQ ID NO: 1544202 - RNA, 14 nt, Homo sapiens
ucaacccugugauc

SEQ ID NO: 1544203 - RNA, 16 nt, Homo sapiens
ucaacccugugaucua

SEQ ID NO: 1544204 - RNA, 15 nt, Homo sapiens
ucaacuuacauaugu

SEQ ID NO: 1544205 - RNA, 19 nt, Homo sapiens
ucaacuugucacaaaguga

SEQ ID NO: 1544206 - RNA, 13 nt, Homo sapiens
ucaagauccuguc

SEQ ID NO: 1544207 - RNA, 21 nt, Homo sapiens
ucaagauccugucuugcugag

SEQ ID NO: 1544208 - RNA, 17 nt, Homo sapiens
ucaauaccaccaagagg

SEQ ID NO: 1544209 - RNA, 13 nt, Homo sapiens
ucaaucaaacagg

SEQ ID NO: 1544210 - RNA, 16 nt, Homo sapiens
ucaaugcuagcacaau

SEQ ID NO: 1544211 - RNA, 18 nt, Homo sapiens
ucacaaaguuaaacguga

SEQ ID NO: 1544212 - RNA, 23 nt, Homo sapiens
ucacaaauaaguaauaucuuuca

SEQ ID NO: 1544213 - RNA, 20 nt, Homo sapiens
ucacaacacaaucaaaagau

SEQ ID NO: 1544214 - RNA, 22 nt, Homo sapiens
ucacaagaaaaaggaagccacu

SEQ ID NO: 1544215 - RNA, 22 nt, Homo sapiens
ucacaauuauagauuagaucaa

SEQ ID NO: 1544216 - RNA, 23 nt, Homo sapiens
ucacacucucuucuuacuguauu

SEQ ID NO: 1544217 - RNA, 20 nt, Homo sapiens
ucacagcaguacuugcucaa

SEQ ID NO: 1544218 - RNA, 22 nt, Homo sapiens
ucacauguccuauuacugaugu

SEQ ID NO: 1544219 - RNA, 21 nt, Homo sapiens
ucaccucagagacauacaccu

SEQ ID NO: 1544220 - RNA, 20 nt, Homo sapiens
ucaccuuaaaauuagcaucu

SEQ ID NO: 1544221 - RNA, 18 nt, Homo sapiens
ucacgaggugucucucac

SEQ ID NO: 1544222 - RNA, 19 nt, Homo sapiens
ucacgcaacuugaaauuau

SEQ ID NO: 1544223 - RNA, 17 nt, Homo sapiens
ucacggcugcaccugca

SEQ ID NO: 1544224 - RNA, 18 nt, Homo sapiens
ucacuaaauccuuuccaa

SEQ ID NO: 1544225 - RNA, 18 nt, Homo sapiens
ucacugauauauuuucca

SEQ ID NO: 1544226 - RNA, 23 nt, Homo sapiens
ucacugcacccuggauuugcaua

SEQ ID NO: 1544227 - RNA, 18 nt, Homo sapiens
ucacugcuggcugccuua

SEQ ID NO: 1544228 - RNA, 15 nt, Homo sapiens
ucagaaacaaagcau

SEQ ID NO: 1544229 - RNA, 17 nt, Homo sapiens
ucagacaaauucauucc

SEQ ID NO: 1544230 - RNA, 23 nt, Homo sapiens
ucagaccuuugucugaaggauuu

SEQ ID NO: 1544231 - RNA, 16 nt, Homo sapiens
ucagacuuacuuacuc

SEQ ID NO: 1544232 - RNA, 23 nt, Homo sapiens
ucagagacauacaccuaugucau

SEQ ID NO: 1544233 - RNA, 15 nt, Homo sapiens
ucagauggugaagca

SEQ ID NO: 1544234 - RNA, 18 nt, Homo sapiens
ucagcaagacaaugacac

SEQ ID NO: 1544235 - RNA, 18 nt, Homo sapiens
ucagcacuuuguuucaua

SEQ ID NO: 1544236 - RNA, 21 nt, Homo sapiens
ucagccacgccucucucagcc

SEQ ID NO: 1544237 - RNA, 15 nt, Homo sapiens
ucagccccucuugcc

SEQ ID NO: 1544238 - RNA, 23 nt, Homo sapiens
ucaggcaguggcccagggaauca

SEQ ID NO: 1544239 - RNA, 19 nt, Homo sapiens
ucagguuaaauuaaaccaa

SEQ ID NO: 1544240 - RNA, 23 nt, Homo sapiens
ucagguuugggguucguggaaag

SEQ ID NO: 1544241 - RNA, 20 nt, Homo sapiens
ucaguaaaauuauacugugu

SEQ ID NO: 1544242 - RNA, 20 nt, Homo sapiens
ucaguaaauauuaaccugaa

SEQ ID NO: 1544243 - RNA, 15 nt, Homo sapiens
ucaguccuuccacac

SEQ ID NO: 1544244 - RNA, 21 nt, Homo sapiens
ucagucuuugggggauucaaa

SEQ ID NO: 1544245 - RNA, 23 nt, Homo sapiens
ucaguuguaacauucuauuucaa

SEQ ID NO: 1544246 - RNA, 24 nt, Homo sapiens
ucauacaaaggacaguacacacuu

SEQ ID NO: 1544247 - RNA, 21 nt, Homo sapiens
ucaucaacaaagaaauauuau

SEQ ID NO: 1544248 - RNA, 15 nt, Homo sapiens
ucaucagaaacaauu

SEQ ID NO: 1544249 - RNA, 13 nt, Homo sapiens
ucauccaacguga

SEQ ID NO: 1544250 - RNA, 19 nt, Homo sapiens
ucauccugccuucauggaa

SEQ ID NO: 1544251 - RNA, 19 nt, Homo sapiens
ucaucugucugucccaguu

SEQ ID NO: 1544252 - RNA, 15 nt, Homo sapiens
ucaucuucacugcac

SEQ ID NO: 1544253 - RNA, 12 nt, Homo sapiens
ucauggaacuca

SEQ ID NO: 1544254 - RNA, 23 nt, Homo sapiens
ucauggccauagcuuuuauucau

SEQ ID NO: 1544255 - RNA, 22 nt, Homo sapiens
ucauuacagauuuaguuuacca

SEQ ID NO: 1544256 - RNA, 13 nt, Homo sapiens
ucauuagcuguga

SEQ ID NO: 1544257 - RNA, 14 nt, Homo sapiens
ucauuagcugugau

SEQ ID NO: 1544258 - RNA, 21 nt, Homo sapiens
ucauuuccuccgucaccucag

SEQ ID NO: 1544259 - RNA, 22 nt, Homo sapiens
ucauuuccuccgucaccucaga

SEQ ID NO: 1544260 - RNA, 16 nt, Homo sapiens
ucauuuucaccuccau

SEQ ID NO: 1544261 - RNA, 21 nt, Homo sapiens
ucauuuuuuuuuuaucagagu

SEQ ID NO: 1544262 - RNA, 19 nt, Homo sapiens
uccaaagguuucaacugua

SEQ ID NO: 1544263 - RNA, 14 nt, Homo sapiens
uccaaaguuaucca

SEQ ID NO: 1544264 - RNA, 21 nt, Homo sapiens
uccaaauagcccacacgugcu

SEQ ID NO: 1544265 - RNA, 17 nt, Homo sapiens
uccaacaaacuuacugu

SEQ ID NO: 1544266 - RNA, 13 nt, Homo sapiens
uccaacccaugca

SEQ ID NO: 1544267 - RNA, 18 nt, Homo sapiens
uccaacucugacuguaaa

SEQ ID NO: 1544268 - RNA, 22 nt, Homo sapiens
uccaaggguuuucaccuuagca

SEQ ID NO: 1544269 - RNA, 20 nt, Homo sapiens
uccaauccuuuauagcuuug

SEQ ID NO: 1544270 - RNA, 18 nt, Homo sapiens
uccaccugugcugcugca

SEQ ID NO: 1544271 - RNA, 13 nt, Homo sapiens
uccacuccuccca

SEQ ID NO: 1544272 - RNA, 20 nt, Homo sapiens
uccacuuagaaauugcauuu

SEQ ID NO: 1544273 - RNA, 17 nt, Homo sapiens
uccagaacuaccaaaau

SEQ ID NO: 1544274 - RNA, 21 nt, Homo sapiens
uccagaacugucuuagucaua

SEQ ID NO: 1544275 - RNA, 16 nt, Homo sapiens
uccagacccccagcaa

SEQ ID NO: 1544276 - RNA, 18 nt, Homo sapiens
uccagaggguugugauuu

SEQ ID NO: 1544277 - RNA, 23 nt, Homo sapiens
uccagaggugaugguaacugcac

SEQ ID NO: 1544278 - RNA, 16 nt, Homo sapiens
uccagauggcaugugu

SEQ ID NO: 1544279 - RNA, 17 nt, Homo sapiens
uccagccacuuauuucc

SEQ ID NO: 1544280 - RNA, 14 nt, Homo sapiens
uccaggccccaaaa

SEQ ID NO: 1544281 - RNA, 19 nt, Homo sapiens
uccaggcuuccugcccuag

SEQ ID NO: 1544282 - RNA, 18 nt, Homo sapiens
uccaggguuaaagaaagg

SEQ ID NO: 1544283 - RNA, 21 nt, Homo sapiens
uccagugacacaacucaucca

SEQ ID NO: 1544284 - RNA, 20 nt, Homo sapiens
uccaguguugccuccuccca

SEQ ID NO: 1544285 - RNA, 13 nt, Homo sapiens
uccauaauugcaa

SEQ ID NO: 1544286 - RNA, 16 nt, Homo sapiens
uccaugaaaaacagca

SEQ ID NO: 1544287 - RNA, 23 nt, Homo sapiens
uccaugcagaucuagccaggccu

SEQ ID NO: 1544288 - RNA, 15 nt, Homo sapiens
uccaugucugaaguu

SEQ ID NO: 1544289 - RNA, 16 nt, Homo sapiens
ucccaaaggcuuucuu

SEQ ID NO: 1544290 - RNA, 23 nt, Homo sapiens
ucccaaccuccccugguccugca

SEQ ID NO: 1544291 - RNA, 20 nt, Homo sapiens
ucccaagcacuucaaaggaa

SEQ ID NO: 1544292 - RNA, 17 nt, Homo sapiens
ucccaaggaaaauggac

SEQ ID NO: 1544293 - RNA, 20 nt, Homo sapiens
ucccagcaugcugagauuac

SEQ ID NO: 1544294 - RNA, 17 nt, Homo sapiens
ucccaguuaacuguuaa

SEQ ID NO: 1544295 - RNA, 17 nt, Homo sapiens
ucccaugguagacugug

SEQ ID NO: 1544296 - RNA, 17 nt, Homo sapiens
ucccauucaagauuccc

SEQ ID NO: 1544297 - RNA, 18 nt, Homo sapiens
uccccaaacccacccaua

SEQ ID NO: 1544298 - RNA, 13 nt, Homo sapiens
uccccagccugcu

SEQ ID NO: 1544299 - RNA, 12 nt, Homo sapiens
uaaaaaugcaua

SEQ ID NO: 1544300 - RNA, 23 nt, Homo sapiens
uaaaacaguguuuccagugacac

SEQ ID NO: 1544301 - RNA, 16 nt, Homo sapiens
uaaaacguuaucucau

SEQ ID NO: 1544302 - RNA, 19 nt, Homo sapiens
uaaaagacaugaaauugag

SEQ ID NO: 1544303 - RNA, 13 nt, Homo sapiens
uaaaagaugccgu

SEQ ID NO: 1544304 - RNA, 23 nt, Homo sapiens
uaaaagaugccguuuaaaagcau

SEQ ID NO: 1544305 - RNA, 20 nt, Homo sapiens
uaaaagcaugauugggaaaa

SEQ ID NO: 1544306 - RNA, 16 nt, Homo sapiens
uaaaaguguccauuga

SEQ ID NO: 1544307 - RNA, 13 nt, Homo sapiens
uaaaauuagugag

SEQ ID NO: 1544308 - RNA, 16 nt, Homo sapiens
uaaaauucauagcauc

SEQ ID NO: 1544309 - RNA, 15 nt, Homo sapiens
uaaaauucuagucuc

SEQ ID NO: 1544310 - RNA, 22 nt, Homo sapiens
uaaacaguugcacagcaucuca

SEQ ID NO: 1544311 - RNA, 16 nt, Homo sapiens
uaaaccauugugcauu

SEQ ID NO: 1544312 - RNA, 18 nt, Homo sapiens
uaaaccauugugcauucu

SEQ ID NO: 1544313 - RNA, 15 nt, Homo sapiens
uaaacgucacagcag

SEQ ID NO: 1544314 - RNA, 18 nt, Homo sapiens
uaaacucagucaaaugua

SEQ ID NO: 1544315 - RNA, 14 nt, Homo sapiens
uaaagaaaggcaga

SEQ ID NO: 1544316 - RNA, 17 nt, Homo sapiens
uaaagcaaugugguagu

SEQ ID NO: 1544317 - RNA, 16 nt, Homo sapiens
uaaagccuugugauca

SEQ ID NO: 1544318 - RNA, 15 nt, Homo sapiens
uaaagugcacugcca

SEQ ID NO: 1544319 - RNA, 22 nt, Homo sapiens
uaaauauuagcaaagcaugcca

SEQ ID NO: 1544320 - RNA, 21 nt, Homo sapiens
uaaauccaacucugacuguaa

SEQ ID NO: 1544321 - RNA, 15 nt, Homo sapiens
uaaauccauuuucua

SEQ ID NO: 1544322 - RNA, 13 nt, Homo sapiens
uaaaugccuaaua

SEQ ID NO: 1544323 - RNA, 20 nt, Homo sapiens
uaaauuggugauaaguggaa

SEQ ID NO: 1544324 - RNA, 16 nt, Homo sapiens
uaaauuugacuguuau

SEQ ID NO: 1544325 - RNA, 15 nt, Homo sapiens
uaacaagacuucaaa

SEQ ID NO: 1544326 - RNA, 21 nt, Homo sapiens
uaacaauguaugugaaagugu

SEQ ID NO: 1544327 - RNA, 15 nt, Homo sapiens
uaacauauauuguua

SEQ ID NO: 1544328 - RNA, 19 nt, Homo sapiens
uaacaucucuuucaucuag

SEQ ID NO: 1544329 - RNA, 22 nt, Homo sapiens
uaacaucucuuucaucuagcuc

SEQ ID NO: 1544330 - RNA, 19 nt, Homo sapiens
uaaccucucugaacugcaa

SEQ ID NO: 1544331 - RNA, 21 nt, Homo sapiens
uaaccucucugaacugcaaca

SEQ ID NO: 1544332 - RNA, 12 nt, Homo sapiens
uaaccugaauua

SEQ ID NO: 1544333 - RNA, 13 nt, Homo sapiens
uaacuagaucucc

SEQ ID NO: 1544334 - RNA, 16 nt, Homo sapiens
uaacucaucugucacc

SEQ ID NO: 1544335 - RNA, 16 nt, Homo sapiens
uaacugagcacuuuga

SEQ ID NO: 1544336 - RNA, 22 nt, Homo sapiens
uaacuguccguaguaucagaga

SEQ ID NO: 1544337 - RNA, 13 nt, Homo sapiens
uaacuuuaccaug

SEQ ID NO: 1544338 - RNA, 15 nt, Homo sapiens
uaacuuuaccaugcu

SEQ ID NO: 1544339 - RNA, 22 nt, Homo sapiens
uaagaaacccccucauggaucu

SEQ ID NO: 1544340 - RNA, 13 nt, Homo sapiens
uaagaaauaucug

SEQ ID NO: 1544341 - RNA, 15 nt, Homo sapiens
uaagaauguauauca

SEQ ID NO: 1544342 - RNA, 16 nt, Homo sapiens
uaagaggacgccuuca

SEQ ID NO: 1544343 - RNA, 14 nt, Homo sapiens
uaagauuuugccug

SEQ ID NO: 1544344 - RNA, 22 nt, Homo sapiens
uaagccauaugacaauuucaaa

SEQ ID NO: 1544345 - RNA, 13 nt, Homo sapiens
uaagccugaugau

SEQ ID NO: 1544346 - RNA, 18 nt, Homo sapiens
uaaggggaauuaacaauu

SEQ ID NO: 1544347 - RNA, 16 nt, Homo sapiens
uaaguauuccuuggcc

SEQ ID NO: 1544348 - RNA, 22 nt, Homo sapiens
uaaguguuguauguaccguuga

SEQ ID NO: 1544349 - RNA, 15 nt, Homo sapiens
uaauaaacacagauu

SEQ ID NO: 1544350 - RNA, 16 nt, Homo sapiens
uaauaacuagaucucc

SEQ ID NO: 1544351 - RNA, 14 nt, Homo sapiens
uaauaggaggacag

SEQ ID NO: 1544352 - RNA, 21 nt, Homo sapiens
uaaucccagcaugcugagauu

SEQ ID NO: 1544353 - RNA, 19 nt, Homo sapiens
uaaucugaaacacagucau

SEQ ID NO: 1544354 - RNA, 13 nt, Homo sapiens
uaaugaaugacau

SEQ ID NO: 1544355 - RNA, 18 nt, Homo sapiens
uaauggucaaugcuagca

SEQ ID NO: 1544356 - RNA, 19 nt, Homo sapiens
uaauguuuacaacaauaaa

SEQ ID NO: 1544357 - RNA, 13 nt, Homo sapiens
uaauuagauuaac

SEQ ID NO: 1544358 - RNA, 18 nt, Homo sapiens
uaauuagcucucgccuca

SEQ ID NO: 1544359 - RNA, 19 nt, Homo sapiens
uaauuaggguccacgccca

SEQ ID NO: 1544360 - RNA, 15 nt, Homo sapiens
uaauucuaugagaua

SEQ ID NO: 1544361 - RNA, 23 nt, Homo sapiens
uaauuggcaugaaggugucauac

SEQ ID NO: 1544362 - RNA, 13 nt, Homo sapiens
uaauuuuguagua

SEQ ID NO: 1544363 - RNA, 23 nt, Homo sapiens
uacaaauuauguuuuaauuccaa

SEQ ID NO: 1544364 - RNA, 16 nt, Homo sapiens
uacaauaaagcaaugu

SEQ ID NO: 1544365 - RNA, 19 nt, Homo sapiens
uacaauaauucuaugagau

SEQ ID NO: 1544366 - RNA, 13 nt, Homo sapiens
uacaauugucauu

SEQ ID NO: 1544367 - RNA, 14 nt, Homo sapiens
uacacauguaucua

SEQ ID NO: 1544368 - RNA, 19 nt, Homo sapiens
uacacauguaucuaugcau

SEQ ID NO: 1544369 - RNA, 15 nt, Homo sapiens
uacaccuaugucauu

SEQ ID NO: 1544370 - RNA, 16 nt, Homo sapiens
uacaccuaugucauuu

SEQ ID NO: 1544371 - RNA, 15 nt, Homo sapiens
uacagccaaauugca

SEQ ID NO: 1544372 - RNA, 17 nt, Homo sapiens
uacaugcauuacugcau

SEQ ID NO: 1544373 - RNA, 20 nt, Homo sapiens
uaccauagcuuaagaaguau

SEQ ID NO: 1544374 - RNA, 17 nt, Homo sapiens
uacccagccuaccagag

SEQ ID NO: 1544375 - RNA, 18 nt, Homo sapiens
uaccccaggacgcaugca

SEQ ID NO: 1544376 - RNA, 15 nt, Homo sapiens
uacccuuucccaaac

SEQ ID NO: 1544377 - RNA, 13 nt, Homo sapiens
uaccugaaaggaa

SEQ ID NO: 1544378 - RNA, 16 nt, Homo sapiens
uaccuguuaguauuau

SEQ ID NO: 1544379 - RNA, 20 nt, Homo sapiens
uacggaaggcucugggaucu

SEQ ID NO: 1544380 - RNA, 13 nt, Homo sapiens
uacuaacacuggc

SEQ ID NO: 1544381 - RNA, 21 nt, Homo sapiens
uacuaccccagaacgcaugca

SEQ ID NO: 1544382 - RNA, 15 nt, Homo sapiens
uacucccauuuuccc

SEQ ID NO: 1544383 - RNA, 17 nt, Homo sapiens
uacugaaauacauauga

SEQ ID NO: 1544384 - RNA, 20 nt, Homo sapiens
uacugagacaugacuaggaa

SEQ ID NO: 1544385 - RNA, 15 nt, Homo sapiens
uacugcaugcacuuc

SEQ ID NO: 1544386 - RNA, 13 nt, Homo sapiens
uacuuacaugcau

SEQ ID NO: 1544387 - RNA, 12 nt, Homo sapiens
uacuucuuuauu

SEQ ID NO: 1544388 - RNA, 20 nt, Homo sapiens
uacuugugaaacacagcugu

SEQ ID NO: 1544389 - RNA, 21 nt, Homo sapiens
uacuugugaaacacagcuguu

SEQ ID NO: 1544390 - RNA, 22 nt, Homo sapiens
uacuuugguuucugucuguaag

SEQ ID NO: 1544391 - RNA, 19 nt, Homo sapiens
uagaaaaguuauguagaaa

SEQ ID NO: 1544392 - RNA, 18 nt, Homo sapiens
uagaacauggacuacaca

SEQ ID NO: 1544393 - RNA, 16 nt, Homo sapiens
uagaagagucuauugu

SEQ ID NO: 1544394 - RNA, 16 nt, Homo sapiens
uagaauggggcuucca

SEQ ID NO: 1544395 - RNA, 21 nt, Homo sapiens
uagacuuuuaacuucaccuua

SEQ ID NO: 1544396 - RNA, 16 nt, Homo sapiens
uagagaaaauggaaca

SEQ ID NO: 1544397 - RNA, 16 nt, Homo sapiens
uagauaaauguccauu

SEQ ID NO: 1544398 - RNA, 23 nt, Homo sapiens
uagauugauucacccuacccaca

SEQ ID NO: 1544399 - RNA, 13 nt, Homo sapiens
uagcauauauaau

SEQ ID NO: 1544400 - RNA, 21 nt, Homo sapiens
uagcauccaaggggccuggaa

SEQ ID NO: 1544401 - RNA, 19 nt, Homo sapiens
uagcauuuucugcaucucc

SEQ ID NO: 1544402 - RNA, 20 nt, Homo sapiens
uagcauuuucugcaucucca

SEQ ID NO: 1544403 - RNA, 17 nt, Homo sapiens
uagccagaggcucuaau

SEQ ID NO: 1544404 - RNA, 19 nt, Homo sapiens
uagccagaggcucuaaugu

SEQ ID NO: 1544405 - RNA, 13 nt, Homo sapiens
uagcccugcauuu

SEQ ID NO: 1544406 - RNA, 21 nt, Homo sapiens
uagccuucucuguucauuucc

SEQ ID NO: 1544407 - RNA, 15 nt, Homo sapiens
uagcgccucuuuuau

SEQ ID NO: 1544408 - RNA, 22 nt, Homo sapiens
uagcuagaauauccuauacugg

SEQ ID NO: 1544409 - RNA, 14 nt, Homo sapiens
uagcuauaacaacu

SEQ ID NO: 1544410 - RNA, 17 nt, Homo sapiens
uaggauuuaccaaauag

SEQ ID NO: 1544411 - RNA, 22 nt, Homo sapiens
uaggcauuaaauuuuagcaaag

SEQ ID NO: 1544412 - RNA, 20 nt, Homo sapiens
uaggccagaggugaacauuc

SEQ ID NO: 1544413 - RNA, 13 nt, Homo sapiens
uaggccucaggcc

SEQ ID NO: 1544414 - RNA, 22 nt, Homo sapiens
uagggcaaagaaucaacaguga

SEQ ID NO: 1544415 - RNA, 23 nt, Homo sapiens
uagguaguagaaucucagcacuu

SEQ ID NO: 1544416 - RNA, 18 nt, Homo sapiens
uaguccuauucuauugca

SEQ ID NO: 1544417 - RNA, 22 nt, Homo sapiens
uagugguauagaguacugcaga

SEQ ID NO: 1544418 - RNA, 14 nt, Homo sapiens
uaguuagaaagggu

SEQ ID NO: 1544419 - RNA, 18 nt, Homo sapiens
uaguuagauucacuuuga

SEQ ID NO: 1544420 - RNA, 14 nt, Homo sapiens
uaguucuauuucua

SEQ ID NO: 1544421 - RNA, 20 nt, Homo sapiens
uauaaacuuuuuauucucag

SEQ ID NO: 1544422 - RNA, 16 nt, Homo sapiens
uauaaucucuucuuau

SEQ ID NO: 1544423 - RNA, 13 nt, Homo sapiens
uauacaaacaggu

SEQ ID NO: 1544424 - RNA, 14 nt, Homo sapiens
uauacaaacaggug

SEQ ID NO: 1544425 - RNA, 21 nt, Homo sapiens
uauaggaaaaguuauugugau

SEQ ID NO: 1544426 - RNA, 14 nt, Homo sapiens
uauauggggggcca

SEQ ID NO: 1544427 - RNA, 15 nt, Homo sapiens
uauauggggggccaa

SEQ ID NO: 1544428 - RNA, 16 nt, Homo sapiens
uauauguacaguuaua

SEQ ID NO: 1544429 - RNA, 13 nt, Homo sapiens
uauauuuugccug

SEQ ID NO: 1544430 - RNA, 18 nt, Homo sapiens
uaucagagucaugaugaa

SEQ ID NO: 1544431 - RNA, 20 nt, Homo sapiens
uaucauccugccuucaugga

SEQ ID NO: 1544432 - RNA, 15 nt, Homo sapiens
gguccugcacugucc

SEQ ID NO: 1544433 - RNA, 21 nt, Homo sapiens
gguccugggggcugcugcacu

SEQ ID NO: 1544434 - RNA, 17 nt, Homo sapiens
ggugcuaauccaggaca

SEQ ID NO: 1544435 - RNA, 12 nt, Homo sapiens
ggugcuucagga

SEQ ID NO: 1544436 - RNA, 16 nt, Homo sapiens
gguggccagggcucca

SEQ ID NO: 1544437 - RNA, 14 nt, Homo sapiens
ggugggugugagca

SEQ ID NO: 1544438 - RNA, 15 nt, Homo sapiens
ggugugagcuucaga

SEQ ID NO: 1544439 - RNA, 14 nt, Homo sapiens
gguguggcuuggaa

SEQ ID NO: 1544440 - RNA, 14 nt, Homo sapiens
gguguucuucccaa

SEQ ID NO: 1544441 - RNA, 14 nt, Homo sapiens
gguuggguuccaga

SEQ ID NO: 1544442 - RNA, 18 nt, Homo sapiens
gguuuauugaaugugauu

SEQ ID NO: 1544443 - RNA, 14 nt, Homo sapiens
gguuuucauuauuu

SEQ ID NO: 1544444 - RNA, 12 nt, Homo sapiens
guaaaaccaaag

SEQ ID NO: 1544445 - RNA, 13 nt, Homo sapiens
guaaaauacuucu

SEQ ID NO: 1544446 - RNA, 16 nt, Homo sapiens
guaaccacaacuuuca

SEQ ID NO: 1544447 - RNA, 23 nt, Homo sapiens
guaacugcacacaugguuuccaa

SEQ ID NO: 1544448 - RNA, 21 nt, Homo sapiens
guaagaauuuuaauauugcca

SEQ ID NO: 1544449 - RNA, 22 nt, Homo sapiens
guaagaauuuuaauauugccau

SEQ ID NO: 1544450 - RNA, 19 nt, Homo sapiens
guaaucuguauaauacuuu

SEQ ID NO: 1544451 - RNA, 15 nt, Homo sapiens
guaauuguuacaauu

SEQ ID NO: 1544452 - RNA, 16 nt, Homo sapiens
guacaauaaagcaaug

SEQ ID NO: 1544453 - RNA, 18 nt, Homo sapiens
guacaauaaagcaaugug

SEQ ID NO: 1544454 - RNA, 17 nt, Homo sapiens
guacaguuauacauacc

SEQ ID NO: 1544455 - RNA, 21 nt, Homo sapiens
guacauauggaaauccuguua

SEQ ID NO: 1544456 - RNA, 15 nt, Homo sapiens
guaccuuucugacaa

SEQ ID NO: 1544457 - RNA, 19 nt, Homo sapiens
guacgucugguguucucaa

SEQ ID NO: 1544458 - RNA, 13 nt, Homo sapiens
guacuaccccagg

SEQ ID NO: 1544459 - RNA, 20 nt, Homo sapiens
guacuguuuuguuuguuaau

SEQ ID NO: 1544460 - RNA, 12 nt, Homo sapiens
guagaaucucag

SEQ ID NO: 1544461 - RNA, 18 nt, Homo sapiens
guaggggaagugugcuga

SEQ ID NO: 1544462 - RNA, 18 nt, Homo sapiens
guagguaaguuggcucac

SEQ ID NO: 1544463 - RNA, 20 nt, Homo sapiens
guagguuauuaugauuagcu

SEQ ID NO: 1544464 - RNA, 16 nt, Homo sapiens
guauagaguacugcag

SEQ ID NO: 1544465 - RNA, 10 nt, Homo sapiens
guauccucca

SEQ ID NO: 1544466 - RNA, 16 nt, Homo sapiens
guaucucuacuuuccu

SEQ ID NO: 1544467 - RNA, 13 nt, Homo sapiens
guauugauaucac

SEQ ID NO: 1544468 - RNA, 13 nt, Homo sapiens
guauuugggauau

SEQ ID NO: 1544469 - RNA, 21 nt, Homo sapiens
guauuuuacuuugugcaauau

SEQ ID NO: 1544470 - RNA, 23 nt, Homo sapiens
guauuuuacuuugugcaauauga

SEQ ID NO: 1544471 - RNA, 21 nt, Homo sapiens
gucaagugugccugcuaucca

SEQ ID NO: 1544472 - RNA, 14 nt, Homo sapiens
gucaccaugaucac

SEQ ID NO: 1544473 - RNA, 13 nt, Homo sapiens
gucaccucagaga

SEQ ID NO: 1544474 - RNA, 13 nt, Homo sapiens
gucagcacagaga

SEQ ID NO: 1544475 - RNA, 11 nt, Homo sapiens
gucagugcagc

SEQ ID NO: 1544476 - RNA, 19 nt, Homo sapiens
gucauauauggggggccaa

SEQ ID NO: 1544477 - RNA, 16 nt, Homo sapiens
gucaucccggggccau

SEQ ID NO: 1544478 - RNA, 13 nt, Homo sapiens
gucaugauuucaa

SEQ ID NO: 1544479 - RNA, 12 nt, Homo sapiens
guccaaacuguu

SEQ ID NO: 1544480 - RNA, 17 nt, Homo sapiens
guccaccugugcugcug

SEQ ID NO: 1544481 - RNA, 14 nt, Homo sapiens
guccagaccugggc

SEQ ID NO: 1544482 - RNA, 21 nt, Homo sapiens
gucccagcggaugcugccagg

SEQ ID NO: 1544483 - RNA, 14 nt, Homo sapiens
guccccagccugcu

SEQ ID NO: 1544484 - RNA, 18 nt, Homo sapiens
gucccccuucguggagcu

SEQ ID NO: 1544485 - RNA, 19 nt, Homo sapiens
gucccucaggcuuguugcc

SEQ ID NO: 1544486 - RNA, 12 nt, Homo sapiens
gucccuuaccug

SEQ ID NO: 1544487 - RNA, 22 nt, Homo sapiens
guccgacucuucugagcaccua

SEQ ID NO: 1544488 - RNA, 15 nt, Homo sapiens
guccugacuguccua

SEQ ID NO: 1544489 - RNA, 14 nt, Homo sapiens
guccugcacugucc

SEQ ID NO: 1544490 - RNA, 21 nt, Homo sapiens
guccugggggcugcugcacug

SEQ ID NO: 1544491 - RNA, 24 nt, Homo sapiens
guccuuuuucuucccuuaggcaau

SEQ ID NO: 1544492 - RNA, 16 nt, Homo sapiens
gucuaauaaacacaga

SEQ ID NO: 1544493 - RNA, 18 nt, Homo sapiens
gucucuaugaucuuggca

SEQ ID NO: 1544494 - RNA, 21 nt, Homo sapiens
gucucucacccccacacuggg

SEQ ID NO: 1544495 - RNA, 22 nt, Homo sapiens
gucugaaggagaggagugcgcu

SEQ ID NO: 1544496 - RNA, 17 nt, Homo sapiens
gucuguaagagaauucu

SEQ ID NO: 1544497 - RNA, 17 nt, Homo sapiens
gucuuagucauaccauc

SEQ ID NO: 1544498 - RNA, 22 nt, Homo sapiens
gucuuauucuugugcacuuuau

SEQ ID NO: 1544499 - RNA, 22 nt, Homo sapiens
gucuucaacaugguuaccucug

SEQ ID NO: 1544500 - RNA, 21 nt, Homo sapiens
gugaaagaguaaaaccaaagg

SEQ ID NO: 1544501 - RNA, 20 nt, Homo sapiens
gugaaagucuccuguaucau

SEQ ID NO: 1544502 - RNA, 14 nt, Homo sapiens
gugaccacuuucaa

SEQ ID NO: 1544503 - RNA, 13 nt, Homo sapiens
gugacuccaggag

SEQ ID NO: 1544504 - RNA, 20 nt, Homo sapiens
gugagugacaucgguucagg

SEQ ID NO: 1544505 - RNA, 17 nt, Homo sapiens
gugaguugcacagcuau

SEQ ID NO: 1544506 - RNA, 20 nt, Homo sapiens
gugaucuauaccaccuucaa

SEQ ID NO: 1544507 - RNA, 12 nt, Homo sapiens
gugauuuuggcc

SEQ ID NO: 1544508 - RNA, 15 nt, Homo sapiens
gugcacggggccagc

SEQ ID NO: 1544509 - RNA, 16 nt, Homo sapiens
gugcagcuuuccaguu

SEQ ID NO: 1544510 - RNA, 22 nt, Homo sapiens
gugcauuuaaaauggacuuuug

SEQ ID NO: 1544511 - RNA, 18 nt, Homo sapiens
gugcauuuaugagcucuu

SEQ ID NO: 1544512 - RNA, 16 nt, Homo sapiens
gugccuaauguuccau

SEQ ID NO: 1544513 - RNA, 19 nt, Homo sapiens
gugcuccugcugaccuucu

SEQ ID NO: 1544514 - RNA, 16 nt, Homo sapiens
guggagcugcuuccag

SEQ ID NO: 1544515 - RNA, 23 nt, Homo sapiens
guggcagcaacaaaggauuugaa

SEQ ID NO: 1544516 - RNA, 21 nt, Homo sapiens
guggccucaacccucccucag

SEQ ID NO: 1544517 - RNA, 17 nt, Homo sapiens
guggccucagcaucuca

SEQ ID NO: 1544518 - RNA, 21 nt, Homo sapiens
gugggaagaacuugucccuca

SEQ ID NO: 1544519 - RNA, 19 nt, Homo sapiens
gugggagcacagcuuuccu

SEQ ID NO: 1544520 - RNA, 19 nt, Homo sapiens
gugguaggaaagccucacu

SEQ ID NO: 1544521 - RNA, 21 nt, Homo sapiens
guguccuguuuuuauucccuu

SEQ ID NO: 1544522 - RNA, 17 nt, Homo sapiens
gugucuaauaaacacag

SEQ ID NO: 1544523 - RNA, 19 nt, Homo sapiens
gugucuaguuugcauacuu

SEQ ID NO: 1544524 - RNA, 13 nt, Homo sapiens
gugugaagcugaa

SEQ ID NO: 1544525 - RNA, 16 nt, Homo sapiens
gugugacaucaguggc

SEQ ID NO: 1544526 - RNA, 22 nt, Homo sapiens
guguggcuuggaacauuuggga

SEQ ID NO: 1544527 - RNA, 16 nt, Homo sapiens
gugugggggucuggga

SEQ ID NO: 1544528 - RNA, 22 nt, Homo sapiens
guguguaucgcugccuugccau

SEQ ID NO: 1544529 - RNA, 13 nt, Homo sapiens
gugugugcaguga

SEQ ID NO: 1544530 - RNA, 23 nt, Homo sapiens
guguuacccaguaacucaucugu

SEQ ID NO: 1544531 - RNA, 23 nt, Homo sapiens
guguuucuguccuguaacuguua

SEQ ID NO: 1544532 - RNA, 23 nt, Homo sapiens
guguuugaauugauuuuuaaaca

SEQ ID NO: 1544533 - RNA, 22 nt, Homo sapiens
guuaaagcuuuggugccuggaa

SEQ ID NO: 1544534 - RNA, 14 nt, Homo sapiens
guuaaaugaacuug

SEQ ID NO: 1544535 - RNA, 19 nt, Homo sapiens
guuaaggcagugacuuuag

SEQ ID NO: 1544536 - RNA, 21 nt, Homo sapiens
guuacugguugguguucuucc

SEQ ID NO: 1544537 - RNA, 13 nt, Homo sapiens
guuagcaggaaau

SEQ ID NO: 1544538 - RNA, 22 nt, Homo sapiens
guucaaagaaccccccucccca

SEQ ID NO: 1544539 - RNA, 18 nt, Homo sapiens
guucaauuggacaauuau

SEQ ID NO: 1544540 - RNA, 23 nt, Homo sapiens
guucagaagaaagauugcuauaa

SEQ ID NO: 1544541 - RNA, 21 nt, Homo sapiens
guuccugcagcagagccugga

SEQ ID NO: 1544542 - RNA, 19 nt, Homo sapiens
guuccuguuugaugugaca

SEQ ID NO: 1544543 - RNA, 13 nt, Homo sapiens
guucuuagcugaa

SEQ ID NO: 1544544 - RNA, 17 nt, Homo sapiens
guucuuccucuuaccug

SEQ ID NO: 1544545 - RNA, 18 nt, Homo sapiens
guuuaacugaguuagaau

SEQ ID NO: 1544546 - RNA, 16 nt, Homo sapiens
guuuaagguucuugcu

SEQ ID NO: 1544547 - RNA, 20 nt, Homo sapiens
guuuaauuguaggucaauga

SEQ ID NO: 1544548 - RNA, 20 nt, Homo sapiens
guuuaccucacuggugcauu

SEQ ID NO: 1544549 - RNA, 21 nt, Homo sapiens
guuuagaaucaagucugugaa

SEQ ID NO: 1544550 - RNA, 17 nt, Homo sapiens
guuuauugaaugugauu

SEQ ID NO: 1544551 - RNA, 15 nt, Homo sapiens
guuucuaacuuggag

SEQ ID NO: 1544552 - RNA, 13 nt, Homo sapiens
guuucuauacugu

SEQ ID NO: 1544553 - RNA, 14 nt, Homo sapiens
guuucuguccugua

SEQ ID NO: 1544554 - RNA, 22 nt, Homo sapiens
guuugccaaauuuuccuuccug

SEQ ID NO: 1544555 - RNA, 16 nt, Homo sapiens
guuuucagauuguaaa

SEQ ID NO: 1544556 - RNA, 15 nt, Homo sapiens
guuuugcaagggaau

SEQ ID NO: 1544557 - RNA, 21 nt, Homo sapiens
guuuugugcggugugucucca

SEQ ID NO: 1544558 - RNA, 18 nt, Homo sapiens
guuuugugugguauucaa

SEQ ID NO: 1544559 - RNA, 13 nt, Homo sapiens
guuuuugagccau

SEQ ID NO: 1544560 - RNA, 19 nt, Homo sapiens
uaaaaacugcccauuguaa

SEQ ID NO: 1544561 - RNA, 17 nt, Homo sapiens
uaaaaauaaccaaaaaa

SEQ ID NO: 1544562 - RNA, 16 nt, Homo sapiens
uaaaaauaugugagca

SEQ ID NO: 1544563 - RNA, 22 nt, Homo sapiens
uaaaaaucaguuuguuguucag

SEQ ID NO: 1544564 - RNA, 23 nt, Homo sapiens
gcuccccaauccaacccaugcau

SEQ ID NO: 1544565 - RNA, 20 nt, Homo sapiens
gcuccuaguagcuuuccucc

SEQ ID NO: 1544566 - RNA, 14 nt, Homo sapiens
gcuccugcugaccu

SEQ ID NO: 1544567 - RNA, 14 nt, Homo sapiens
gcucuaauguacaa

SEQ ID NO: 1544568 - RNA, 23 nt, Homo sapiens
gcucuaauguacaauaaagcaau

SEQ ID NO: 1544569 - RNA, 15 nt, Homo sapiens
gcugaaaagugcuuu

SEQ ID NO: 1544570 - RNA, 19 nt, Homo sapiens
gcugacagauguuccaucc

SEQ ID NO: 1544571 - RNA, 14 nt, Homo sapiens
gcugaggccagagg

SEQ ID NO: 1544572 - RNA, 22 nt, Homo sapiens
gcugaggugggccuuccauggg

SEQ ID NO: 1544573 - RNA, 19 nt, Homo sapiens
gcugauuuuuuuucugaua

SEQ ID NO: 1544574 - RNA, 21 nt, Homo sapiens
gcugccccaccccuccaugau

SEQ ID NO: 1544575 - RNA, 23 nt, Homo sapiens
gcugccccuucugaggaugcuga

SEQ ID NO: 1544576 - RNA, 13 nt, Homo sapiens
gcugccuguggug

SEQ ID NO: 1544577 - RNA, 15 nt, Homo sapiens
gcugccuguggugag

SEQ ID NO: 1544578 - RNA, 18 nt, Homo sapiens
gcuggaguccuguucuca

SEQ ID NO: 1544579 - RNA, 21 nt, Homo sapiens
gcuggugggggcauccuugag

SEQ ID NO: 1544580 - RNA, 14 nt, Homo sapiens
gcuguaugucauua

SEQ ID NO: 1544581 - RNA, 21 nt, Homo sapiens
gcuuaaaaaagaaagauuuua

SEQ ID NO: 1544582 - RNA, 23 nt, Homo sapiens
gcuucaaaacagaacggguucuc

SEQ ID NO: 1544583 - RNA, 12 nt, Homo sapiens
gcuucacuuaaa

SEQ ID NO: 1544584 - RNA, 13 nt, Homo sapiens
gcuugaagauuca

SEQ ID NO: 1544585 - RNA, 11 nt, Homo sapiens
gcuugccauau

SEQ ID NO: 1544586 - RNA, 19 nt, Homo sapiens
gcuuguguacaaacccaga

SEQ ID NO: 1544587 - RNA, 23 nt, Homo sapiens
gcuuugugcuuguucuuccucuu

SEQ ID NO: 1544588 - RNA, 19 nt, Homo sapiens
gcuuuuccauucugggugu

SEQ ID NO: 1544589 - RNA, 20 nt, Homo sapiens
gcuuuucuaaucugcagugg

SEQ ID NO: 1544590 - RNA, 19 nt, Homo sapiens
ggaaacuguuguguccaau

SEQ ID NO: 1544591 - RNA, 22 nt, Homo sapiens
ggaaagggugcugcuucccucu

SEQ ID NO: 1544592 - RNA, 21 nt, Homo sapiens
ggaaaguaucucuacuuuccu

SEQ ID NO: 1544593 - RNA, 18 nt, Homo sapiens
ggaagggaccccacugga

SEQ ID NO: 1544594 - RNA, 15 nt, Homo sapiens
ggaaguuuguucacu

SEQ ID NO: 1544595 - RNA, 22 nt, Homo sapiens
ggacaauuagauaaauguccau

SEQ ID NO: 1544596 - RNA, 19 nt, Homo sapiens
ggacacauaguguuuguaa

SEQ ID NO: 1544597 - RNA, 18 nt, Homo sapiens
ggacacugccuuugcugc

SEQ ID NO: 1544598 - RNA, 20 nt, Homo sapiens
ggacagugggcuaugccacu

SEQ ID NO: 1544599 - RNA, 13 nt, Homo sapiens
ggaccaaauggaa

SEQ ID NO: 1544600 - RNA, 18 nt, Homo sapiens
ggaccggacgcaugcagg

SEQ ID NO: 1544601 - RNA, 19 nt, Homo sapiens
ggaccuccaccugggagau

SEQ ID NO: 1544602 - RNA, 18 nt, Homo sapiens
ggacuaggagcacuguag

SEQ ID NO: 1544603 - RNA, 23 nt, Homo sapiens
ggacucagguugucugaagucac

SEQ ID NO: 1544604 - RNA, 20 nt, Homo sapiens
ggacugguccaggcaugggu

SEQ ID NO: 1544605 - RNA, 15 nt, Homo sapiens
ggagaaaagccagau

SEQ ID NO: 1544606 - RNA, 13 nt, Homo sapiens
ggagaacuagaga

SEQ ID NO: 1544607 - RNA, 14 nt, Homo sapiens
ggagaacuagagaa

SEQ ID NO: 1544608 - RNA, 20 nt, Homo sapiens
ggagaagaaggcaacccaaa

SEQ ID NO: 1544609 - RNA, 18 nt, Homo sapiens
ggagacacuggucucaga

SEQ ID NO: 1544610 - RNA, 21 nt, Homo sapiens
ggagacagucaggaagccucc

SEQ ID NO: 1544611 - RNA, 22 nt, Homo sapiens
ggagagaaugagagagugugga

SEQ ID NO: 1544612 - RNA, 20 nt, Homo sapiens
ggagaucuuggggugcagca

SEQ ID NO: 1544613 - RNA, 14 nt, Homo sapiens
ggagaugggaugcu

SEQ ID NO: 1544614 - RNA, 11 nt, Homo sapiens
ggagcaguuga

SEQ ID NO: 1544615 - RNA, 10 nt, Homo sapiens
ggagccagcu

SEQ ID NO: 1544616 - RNA, 23 nt, Homo sapiens
ggagccauaagggacaugucuuu

SEQ ID NO: 1544617 - RNA, 17 nt, Homo sapiens
ggagcucagggcuggau

SEQ ID NO: 1544618 - RNA, 18 nt, Homo sapiens
ggagcugugggagugauu

SEQ ID NO: 1544619 - RNA, 17 nt, Homo sapiens
ggaggaaggagccuaug

SEQ ID NO: 1544620 - RNA, 18 nt, Homo sapiens
ggaggccguucagcugug

SEQ ID NO: 1544621 - RNA, 13 nt, Homo sapiens
ggaggcgagccag

SEQ ID NO: 1544622 - RNA, 12 nt, Homo sapiens
ggagucacugcc

SEQ ID NO: 1544623 - RNA, 15 nt, Homo sapiens
ggaguccuguucuca

SEQ ID NO: 1544624 - RNA, 18 nt, Homo sapiens
ggauaauaacuagaucuc

SEQ ID NO: 1544625 - RNA, 17 nt, Homo sapiens
ggauaggagcuuccaga

SEQ ID NO: 1544626 - RNA, 16 nt, Homo sapiens
ggauauaggucaguga

SEQ ID NO: 1544627 - RNA, 19 nt, Homo sapiens
ggaucuucccacuuugcca

SEQ ID NO: 1544628 - RNA, 20 nt, Homo sapiens
ggaucuucccacuuugccac

SEQ ID NO: 1544629 - RNA, 16 nt, Homo sapiens
ggaugaauaaguuuua

SEQ ID NO: 1544630 - RNA, 17 nt, Homo sapiens
ggaugaauugccugucc

SEQ ID NO: 1544631 - RNA, 17 nt, Homo sapiens
ggauucuuccaucugau

SEQ ID NO: 1544632 - RNA, 15 nt, Homo sapiens
ggauuuaccaaauag

SEQ ID NO: 1544633 - RNA, 22 nt, Homo sapiens
ggcaaaggauccagauagccua

SEQ ID NO: 1544634 - RNA, 18 nt, Homo sapiens
ggcaauggugaacuguca

SEQ ID NO: 1544635 - RNA, 13 nt, Homo sapiens
ggcacagccagaa

SEQ ID NO: 1544636 - RNA, 20 nt, Homo sapiens
ggcacaugauaugagucacu

SEQ ID NO: 1544637 - RNA, 14 nt, Homo sapiens
ggcacuguggccuu

SEQ ID NO: 1544638 - RNA, 14 nt, Homo sapiens
ggcaggaagucccu

SEQ ID NO: 1544639 - RNA, 17 nt, Homo sapiens
ggcaggaggguggcacu

SEQ ID NO: 1544640 - RNA, 16 nt, Homo sapiens
ggcagugaaguguuua

SEQ ID NO: 1544641 - RNA, 14 nt, Homo sapiens
ggcaucuccaggaa

SEQ ID NO: 1544642 - RNA, 23 nt, Homo sapiens
ggcaugcuggcucccagggccau

SEQ ID NO: 1544643 - RNA, 19 nt, Homo sapiens
ggccaagccugccccggcc

SEQ ID NO: 1544644 - RNA, 20 nt, Homo sapiens
ggcccagaggggcggggcca

SEQ ID NO: 1544645 - RNA, 15 nt, Homo sapiens
ggcccuucacugucc

SEQ ID NO: 1544646 - RNA, 23 nt, Homo sapiens
ggcccuuucaccccucuucccac

SEQ ID NO: 1544647 - RNA, 19 nt, Homo sapiens
ggccuccagcccucucacu

SEQ ID NO: 1544648 - RNA, 13 nt, Homo sapiens
ggccucccagcca

SEQ ID NO: 1544649 - RNA, 24 nt, Homo sapiens
ggccuccccuggggcuggcagcuu

SEQ ID NO: 1544650 - RNA, 22 nt, Homo sapiens
ggccuguccaccugugcugcug

SEQ ID NO: 1544651 - RNA, 19 nt, Homo sapiens
ggccuuuggcuuggcgaga

SEQ ID NO: 1544652 - RNA, 17 nt, Homo sapiens
ggcgggaaagccaguga

SEQ ID NO: 1544653 - RNA, 12 nt, Homo sapiens
ggcuagucauaa

SEQ ID NO: 1544654 - RNA, 14 nt, Homo sapiens
ggcucagccucaaa

SEQ ID NO: 1544655 - RNA, 22 nt, Homo sapiens
ggcucagcuccuucaugagauc

SEQ ID NO: 1544656 - RNA, 20 nt, Homo sapiens
ggcucaugauuuuuuacaaa

SEQ ID NO: 1544657 - RNA, 14 nt, Homo sapiens
ggcuccacuguaaa

SEQ ID NO: 1544658 - RNA, 22 nt, Homo sapiens
ggcucccacugccccugcaccu

SEQ ID NO: 1544659 - RNA, 17 nt, Homo sapiens
ggcucuaauguacaaua

SEQ ID NO: 1544660 - RNA, 17 nt, Homo sapiens
ggcugaaaagugcuuug

SEQ ID NO: 1544661 - RNA, 16 nt, Homo sapiens
ggcugcugcacugccc

SEQ ID NO: 1544662 - RNA, 16 nt, Homo sapiens
ggcuuagaauggggcu

SEQ ID NO: 1544663 - RNA, 17 nt, Homo sapiens
ggcuuccuucauuuccu

SEQ ID NO: 1544664 - RNA, 21 nt, Homo sapiens
ggcuugggguagagaggacag

SEQ ID NO: 1544665 - RNA, 23 nt, Homo sapiens
ggcuuguugcccucugcaguuga

SEQ ID NO: 1544666 - RNA, 20 nt, Homo sapiens
ggcuuuacauggguucaauu

SEQ ID NO: 1544667 - RNA, 23 nt, Homo sapiens
ggcuuuacauggguucaauugga

SEQ ID NO: 1544668 - RNA, 23 nt, Homo sapiens
ggcuuuggacuccuuguuugccu

SEQ ID NO: 1544669 - RNA, 13 nt, Homo sapiens
gggaaagccagug

SEQ ID NO: 1544670 - RNA, 17 nt, Homo sapiens
gggaauugaggucugcu

SEQ ID NO: 1544671 - RNA, 16 nt, Homo sapiens
gggacuccaguucaca

SEQ ID NO: 1544672 - RNA, 15 nt, Homo sapiens
gggacugcaugcaag

SEQ ID NO: 1544673 - RNA, 20 nt, Homo sapiens
gggacugcaugcaagcucag

SEQ ID NO: 1544674 - RNA, 14 nt, Homo sapiens
gggacuuggcagua

SEQ ID NO: 1544675 - RNA, 23 nt, Homo sapiens
gggagagccaaggccuaugccac

SEQ ID NO: 1544676 - RNA, 20 nt, Homo sapiens
gggagauuggcuuugccuuu

SEQ ID NO: 1544677 - RNA, 21 nt, Homo sapiens
gggaucuaaaaggaggacagg

SEQ ID NO: 1544678 - RNA, 15 nt, Homo sapiens
gggcugcccuggugc

SEQ ID NO: 1544679 - RNA, 13 nt, Homo sapiens
ggggagaauggcu

SEQ ID NO: 1544680 - RNA, 15 nt, Homo sapiens
ggggagaauggcucu

SEQ ID NO: 1544681 - RNA, 10 nt, Homo sapiens
ggggggcccg

SEQ ID NO: 1544682 - RNA, 18 nt, Homo sapiens
gggguuggguuccagaca

SEQ ID NO: 1544683 - RNA, 22 nt, Homo sapiens
gggugcuaauccaggacagcau

SEQ ID NO: 1544684 - RNA, 17 nt, Homo sapiens
ggguggaggcuaagccu

SEQ ID NO: 1544685 - RNA, 18 nt, Homo sapiens
ggguuagcucacgugucu

SEQ ID NO: 1544686 - RNA, 14 nt, Homo sapiens
ggguuccagacagg

SEQ ID NO: 1544687 - RNA, 12 nt, Homo sapiens
ggguugggcucu

SEQ ID NO: 1544688 - RNA, 14 nt, Homo sapiens
gguagacugugaca

SEQ ID NO: 1544689 - RNA, 21 nt, Homo sapiens
ggucacuucaaacaugcccuc

SEQ ID NO: 1544690 - RNA, 21 nt, Homo sapiens
ggucagcuugaauguccccau

SEQ ID NO: 1544691 - RNA, 13 nt, Homo sapiens
ggucauucucacc

SEQ ID NO: 1544692 - RNA, 17 nt, Homo sapiens
ggucccagacaugcugc

SEQ ID NO: 1544693 - RNA, 21 nt, Homo sapiens
ggucccgaauggaguccagac

SEQ ID NO: 1544694 - RNA, 12 nt, Homo sapiens
gguccugcacug

SEQ ID NO: 1544695 - RNA, 19 nt, Homo sapiens
cccuccagccaauaggcag

SEQ ID NO: 1544696 - RNA, 15 nt, Homo sapiens
cccuccgacuucucu

SEQ ID NO: 1544697 - RNA, 14 nt, Homo sapiens
cccucucacugugu

SEQ ID NO: 1544698 - RNA, 13 nt, Homo sapiens
cccugcaaccucg

SEQ ID NO: 1544699 - RNA, 19 nt, Homo sapiens
cccugcucacucuuccaca

SEQ ID NO: 1544700 - RNA, 17 nt, Homo sapiens
cccugcucuucagcacc

SEQ ID NO: 1544701 - RNA, 15 nt, Homo sapiens
cccugggguuuccac

SEQ ID NO: 1544702 - RNA, 14 nt, Homo sapiens
cccugugaucuaua

SEQ ID NO: 1544703 - RNA, 21 nt, Homo sapiens
cccugugaucuauaccaccuu

SEQ ID NO: 1544704 - RNA, 22 nt, Homo sapiens
cccuucaaccauuccccauggg

SEQ ID NO: 1544705 - RNA, 20 nt, Homo sapiens
cccuucacuguccauuccaa

SEQ ID NO: 1544706 - RNA, 18 nt, Homo sapiens
cccuucuucuugacccau

SEQ ID NO: 1544707 - RNA, 20 nt, Homo sapiens
cccuuggggcucccuguguc

SEQ ID NO: 1544708 - RNA, 18 nt, Homo sapiens
ccgagaaggaauggugcu

SEQ ID NO: 1544709 - RNA, 17 nt, Homo sapiens
ccgagccgagcucuccu

SEQ ID NO: 1544710 - RNA, 15 nt, Homo sapiens
ccgagucucuucucc

SEQ ID NO: 1544711 - RNA, 18 nt, Homo sapiens
ccgcucugaggcaacccc

SEQ ID NO: 1544712 - RNA, 20 nt, Homo sapiens
ccgcugggagaaaagccaga

SEQ ID NO: 1544713 - RNA, 12 nt, Homo sapiens
ccggccugaugg

SEQ ID NO: 1544714 - RNA, 23 nt, Homo sapiens
ccggcuuggcuagucacauauca

SEQ ID NO: 1544715 - RNA, 16 nt, Homo sapiens
ccgucaaaagagucuu

SEQ ID NO: 1544716 - RNA, 22 nt, Homo sapiens
ccgucaccucagagacauacac

SEQ ID NO: 1544717 - RNA, 11 nt, Homo sapiens
ccgugccuuca

SEQ ID NO: 1544718 - RNA, 17 nt, Homo sapiens
ccguggcuuugugcuua

SEQ ID NO: 1544719 - RNA, 18 nt, Homo sapiens
ccguucgcugagucccag

SEQ ID NO: 1544720 - RNA, 18 nt, Homo sapiens
ccuagggccugguccaug

SEQ ID NO: 1544721 - RNA, 17 nt, Homo sapiens
ccuauaccccucaucac

SEQ ID NO: 1544722 - RNA, 14 nt, Homo sapiens
ccuaugcugcaaua

SEQ ID NO: 1544723 - RNA, 20 nt, Homo sapiens
ccuaugcugcaauacauuaa

SEQ ID NO: 1544724 - RNA, 14 nt, Homo sapiens
ccuauggaaagggu

SEQ ID NO: 1544725 - RNA, 14 nt, Homo sapiens
ccuaugucauuuca

SEQ ID NO: 1544726 - RNA, 16 nt, Homo sapiens
ccucaaaugcaguauu

SEQ ID NO: 1544727 - RNA, 17 nt, Homo sapiens
ccucaaaugcaguauuu

SEQ ID NO: 1544728 - RNA, 19 nt, Homo sapiens
ccucaacaaagaagaacca

SEQ ID NO: 1544729 - RNA, 21 nt, Homo sapiens
ccucaacaaagaagaaccauc

SEQ ID NO: 1544730 - RNA, 15 nt, Homo sapiens
ccucacugauauauu

SEQ ID NO: 1544731 - RNA, 20 nt, Homo sapiens
ccucagcaccugggacccaa

SEQ ID NO: 1544732 - RNA, 21 nt, Homo sapiens
ccucaggcccaauucugccac

SEQ ID NO: 1544733 - RNA, 12 nt, Homo sapiens
ccucagggacca

SEQ ID NO: 1544734 - RNA, 20 nt, Homo sapiens
ccucauauacuugaauauua

SEQ ID NO: 1544735 - RNA, 14 nt, Homo sapiens
ccucauuuaccaua

SEQ ID NO: 1544736 - RNA, 15 nt, Homo sapiens
ccuccaugauuccaa

SEQ ID NO: 1544737 - RNA, 22 nt, Homo sapiens
ccucccaagcacuucaaaggaa

SEQ ID NO: 1544738 - RNA, 20 nt, Homo sapiens
ccuccccaaggaagaacaaa

SEQ ID NO: 1544739 - RNA, 15 nt, Homo sapiens
ccuccuaaauuucca

SEQ ID NO: 1544740 - RNA, 12 nt, Homo sapiens
ccucucuugccg

SEQ ID NO: 1544741 - RNA, 23 nt, Homo sapiens
ccucugcuguauugauaucacua

SEQ ID NO: 1544742 - RNA, 13 nt, Homo sapiens
ccucuuaccugua

SEQ ID NO: 1544743 - RNA, 17 nt, Homo sapiens
ccugaaaauuaugaguc

SEQ ID NO: 1544744 - RNA, 18 nt, Homo sapiens
ccugacagaaggacucag

SEQ ID NO: 1544745 - RNA, 16 nt, Homo sapiens
ccugacgaacuccuug

SEQ ID NO: 1544746 - RNA, 18 nt, Homo sapiens
ccugacgaacuccuugau

SEQ ID NO: 1544747 - RNA, 12 nt, Homo sapiens
ccugauggccag

SEQ ID NO: 1544748 - RNA, 19 nt, Homo sapiens
ccugcacacaccugcacac

SEQ ID NO: 1544749 - RNA, 16 nt, Homo sapiens
ccugcagggagcagca

SEQ ID NO: 1544750 - RNA, 16 nt, Homo sapiens
ccugcaucaucuugaa

SEQ ID NO: 1544751 - RNA, 21 nt, Homo sapiens
ccugccagaggccuggugccc

SEQ ID NO: 1544752 - RNA, 21 nt, Homo sapiens
ccugcgaccacagcagggauu

SEQ ID NO: 1544753 - RNA, 17 nt, Homo sapiens
ccugcgauggugcugca

SEQ ID NO: 1544754 - RNA, 16 nt, Homo sapiens
ccugcucacucuucca

SEQ ID NO: 1544755 - RNA, 14 nt, Homo sapiens
ccugcuggugccca

SEQ ID NO: 1544756 - RNA, 22 nt, Homo sapiens
ccugcuuagugucccuuaccug

SEQ ID NO: 1544757 - RNA, 14 nt, Homo sapiens
ccuggaaggcagcu

SEQ ID NO: 1544758 - RNA, 16 nt, Homo sapiens
ccuggcucagccucaa

SEQ ID NO: 1544759 - RNA, 13 nt, Homo sapiens
ccugguccaugau

SEQ ID NO: 1544760 - RNA, 18 nt, Homo sapiens
ccugugaucuauaccacc

SEQ ID NO: 1544761 - RNA, 23 nt, Homo sapiens
ccugugaucuauaccaccuucaa

SEQ ID NO: 1544762 - RNA, 21 nt, Homo sapiens
ccugugcccgcugcgcugccc

SEQ ID NO: 1544763 - RNA, 23 nt, Homo sapiens
ccugugcuuuuggagcugagauc

SEQ ID NO: 1544764 - RNA, 18 nt, Homo sapiens
ccuguggcggugcagugg

SEQ ID NO: 1544765 - RNA, 16 nt, Homo sapiens
ccugugucagggcaca

SEQ ID NO: 1544766 - RNA, 15 nt, Homo sapiens
ccuguuaaggcaucc

SEQ ID NO: 1544767 - RNA, 20 nt, Homo sapiens
ccuguuaggggaaaauagua

SEQ ID NO: 1544768 - RNA, 19 nt, Homo sapiens
ccuguucugugucugcugu

SEQ ID NO: 1544769 - RNA, 21 nt, Homo sapiens
ccuguucuguuuugccugaag

SEQ ID NO: 1544770 - RNA, 17 nt, Homo sapiens
ccuguugaauuuacucu

SEQ ID NO: 1544771 - RNA, 23 nt, Homo sapiens
ccuuaagaaagcuauauaugaau

SEQ ID NO: 1544772 - RNA, 16 nt, Homo sapiens
ccuuagaauacuguau

SEQ ID NO: 1544773 - RNA, 16 nt, Homo sapiens
ccuuaucauaaauuca

SEQ ID NO: 1544774 - RNA, 18 nt, Homo sapiens
ccuucaaugcaaaauaca

SEQ ID NO: 1544775 - RNA, 21 nt, Homo sapiens
ccuucaugaugaauuacuucu

SEQ ID NO: 1544776 - RNA, 18 nt, Homo sapiens
ccuucauuuucuaauucu

SEQ ID NO: 1544777 - RNA, 15 nt, Homo sapiens
ccuucccucuaagcc

SEQ ID NO: 1544778 - RNA, 20 nt, Homo sapiens
ccuucccugacacugucugc

SEQ ID NO: 1544779 - RNA, 21 nt, Homo sapiens
ccuuccugggcagcccagaga

SEQ ID NO: 1544780 - RNA, 16 nt, Homo sapiens
ccuucugaagaucuca

SEQ ID NO: 1544781 - RNA, 14 nt, Homo sapiens
ccuucugaccccac

SEQ ID NO: 1544782 - RNA, 21 nt, Homo sapiens
ccuucuggccgcugcagucag

SEQ ID NO: 1544783 - RNA, 11 nt, Homo sapiens
ccuuggaccaa

SEQ ID NO: 1544784 - RNA, 20 nt, Homo sapiens
ccuuguuugccuuuaggcag

SEQ ID NO: 1544785 - RNA, 14 nt, Homo sapiens
ccuuuauagcuuug

SEQ ID NO: 1544786 - RNA, 21 nt, Homo sapiens
ccuuuggcuaucuacugagac

SEQ ID NO: 1544787 - RNA, 22 nt, Homo sapiens
cgaauggaagaggcaccugucc

SEQ ID NO: 1544788 - RNA, 15 nt, Homo sapiens
cgagccgagcucucc

SEQ ID NO: 1544789 - RNA, 19 nt, Homo sapiens
cgagcugggggccaugagc

SEQ ID NO: 1544790 - RNA, 18 nt, Homo sapiens
cgaguuccggaaagccuu

SEQ ID NO: 1544791 - RNA, 18 nt, Homo sapiens
cgauccuuguagacgcac

SEQ ID NO: 1544792 - RNA, 18 nt, Homo sapiens
cgaucuuagauugccacu

SEQ ID NO: 1544793 - RNA, 11 nt, Homo sapiens
cgaucuuggcu

SEQ ID NO: 1544794 - RNA, 17 nt, Homo sapiens
cgaugggaucauuauuu

SEQ ID NO: 1544795 - RNA, 15 nt, Homo sapiens
cgcagcccgggagau

SEQ ID NO: 1544796 - RNA, 24 nt, Homo sapiens
cgccaugugcugugcacccgugcc

SEQ ID NO: 1544797 - RNA, 18 nt, Homo sapiens
cgcuaaggcuuccggcug

SEQ ID NO: 1544798 - RNA, 14 nt, Homo sapiens
cgcugccuugccau

SEQ ID NO: 1544799 - RNA, 18 nt, Homo sapiens
cgcuguguccccgcgggc

SEQ ID NO: 1544800 - RNA, 12 nt, Homo sapiens
cgcuuuuguacg

SEQ ID NO: 1544801 - RNA, 11 nt, Homo sapiens
cggaaagccuu

SEQ ID NO: 1544802 - RNA, 17 nt, Homo sapiens
cggaaagccuuccucaa

SEQ ID NO: 1544803 - RNA, 13 nt, Homo sapiens
cggcaagaaggaa

SEQ ID NO: 1544804 - RNA, 16 nt, Homo sapiens
cgggaaagccagugac

SEQ ID NO: 1544805 - RNA, 21 nt, Homo sapiens
cgggccuggagaacuagagaa

SEQ ID NO: 1544806 - RNA, 17 nt, Homo sapiens
cguaaaucaacuuguca

SEQ ID NO: 1544807 - RNA, 23 nt, Homo sapiens
cgucuuuugaaaagcucacuuca

SEQ ID NO: 1544808 - RNA, 22 nt, Homo sapiens
cgugagccucagccaccccuca

SEQ ID NO: 1544809 - RNA, 17 nt, Homo sapiens
cgugcacacaccugcac

SEQ ID NO: 1544810 - RNA, 16 nt, Homo sapiens
cguggaaagggugcug

SEQ ID NO: 1544811 - RNA, 14 nt, Homo sapiens
cguggaugaccucc

SEQ ID NO: 1544812 - RNA, 15 nt, Homo sapiens
cgugggauccagaga

SEQ ID NO: 1544813 - RNA, 20 nt, Homo sapiens
cguggugagguugugcugcc

SEQ ID NO: 1544814 - RNA, 19 nt, Homo sapiens
cguguauucaggaccccau

SEQ ID NO: 1544815 - RNA, 14 nt, Homo sapiens
cguguccgacucuu

SEQ ID NO: 1544816 - RNA, 15 nt, Homo sapiens
cgugugagcagucuc

SEQ ID NO: 1544817 - RNA, 16 nt, Homo sapiens
cguguuuuuguaucuu

SEQ ID NO: 1544818 - RNA, 13 nt, Homo sapiens
cguucagcuguga

SEQ ID NO: 1544819 - RNA, 16 nt, Homo sapiens
cguugccucucugcca

SEQ ID NO: 1544820 - RNA, 15 nt, Homo sapiens
cuaaaauucuagucu

SEQ ID NO: 1544821 - RNA, 20 nt, Homo sapiens
cuaaaccauugugcauucua

SEQ ID NO: 1544822 - RNA, 23 nt, Homo sapiens
cuaaagaaacucagcagccucag

SEQ ID NO: 1544823 - RNA, 15 nt, Homo sapiens
cuaaaucuucagcau

SEQ ID NO: 1544824 - RNA, 15 nt, Homo sapiens
cuaaauggcagugag

SEQ ID NO: 1544825 - RNA, 11 nt, Homo sapiens
cuaaauuucca

SEQ ID NO: 1544826 - RNA, 20 nt, Homo sapiens
cuaacaagccuuggaccaaa

SEQ ID NO: 1544827 - RNA, 19 nt, Homo sapiens
aaagugagaaauuaugaaa

SEQ ID NO: 1544828 - RNA, 14 nt, Homo sapiens
aaaguuuugccuau

SEQ ID NO: 1544829 - RNA, 20 nt, Homo sapiens
aaauaaaauauggacuucca

SEQ ID NO: 1544830 - RNA, 11 nt, Homo sapiens
aaauacuucua

SEQ ID NO: 1544831 - RNA, 19 nt, Homo sapiens
aaauacuucuuuuucauua

SEQ ID NO: 1544832 - RNA, 23 nt, Homo sapiens
aaauagcaucugcucuucucuua

SEQ ID NO: 1544833 - RNA, 22 nt, Homo sapiens
aaauaugauucuccucucccaa

SEQ ID NO: 1544834 - RNA, 17 nt, Homo sapiens
aaauauggacuuccaau

SEQ ID NO: 1544835 - RNA, 22 nt, Homo sapiens
aaauauuuaaaaaaaaacauuc

SEQ ID NO: 1544836 - RNA, 17 nt, Homo sapiens
aaauauuuaugaccuca

SEQ ID NO: 1544837 - RNA, 16 nt, Homo sapiens
aaaucuucagcaugau

SEQ ID NO: 1544838 - RNA, 15 nt, Homo sapiens
aaaugcuaccucuga

SEQ ID NO: 1544839 - RNA, 17 nt, Homo sapiens
aaauggcuuguucaguc

SEQ ID NO: 1544840 - RNA, 17 nt, Homo sapiens
aaauguggacaucauga

SEQ ID NO: 1544841 - RNA, 18 nt, Homo sapiens
aaauguuaacaaugccua

SEQ ID NO: 1544842 - RNA, 15 nt, Homo sapiens
aaauuacaauuguca

SEQ ID NO: 1544843 - RNA, 18 nt, Homo sapiens
aaauuauucuagucaacu

SEQ ID NO: 1544844 - RNA, 13 nt, Homo sapiens
aaauucacaaagu

SEQ ID NO: 1544845 - RNA, 18 nt, Homo sapiens
aaauuccauuuguaggua

SEQ ID NO: 1544846 - RNA, 18 nt, Homo sapiens
aaauuccuguugucugac

SEQ ID NO: 1544847 - RNA, 19 nt, Homo sapiens
aaauugauuaaaggggcug

SEQ ID NO: 1544848 - RNA, 14 nt, Homo sapiens
aaauugcagaagaa

SEQ ID NO: 1544849 - RNA, 14 nt, Homo sapiens
aaauuugacuguua

SEQ ID NO: 1544850 - RNA, 21 nt, Homo sapiens
aaauuugggggacuuacauga

SEQ ID NO: 1544851 - RNA, 21 nt, Homo sapiens
aaauuuuaauguaaaauucau

SEQ ID NO: 1544852 - RNA, 14 nt, Homo sapiens
aaauuuuuuuccag

SEQ ID NO: 1544853 - RNA, 15 nt, Homo sapiens
aacaaaaacuguugc

SEQ ID NO: 1544854 - RNA, 19 nt, Homo sapiens
aacaaaugauuuacacuga

SEQ ID NO: 1544855 - RNA, 22 nt, Homo sapiens
aacaauaaacgaaacacagaac

SEQ ID NO: 1544856 - RNA, 20 nt, Homo sapiens
aacacagaacucagccuuaa

SEQ ID NO: 1544857 - RNA, 23 nt, Homo sapiens
aacagaaacgagauuugccaaaa

SEQ ID NO: 1544858 - RNA, 18 nt, Homo sapiens
aacaguguuuccagugac

SEQ ID NO: 1544859 - RNA, 17 nt, Homo sapiens
aacauauucuugcuuuc

SEQ ID NO: 1544860 - RNA, 20 nt, Homo sapiens
aacauauuuaaagucuugaa

SEQ ID NO: 1544861 - RNA, 22 nt, Homo sapiens
aacauggacuacacacaauaca

SEQ ID NO: 1544862 - RNA, 14 nt, Homo sapiens
aacauugcugccua

SEQ ID NO: 1544863 - RNA, 18 nt, Homo sapiens
aacauuuggaagccccau

SEQ ID NO: 1544864 - RNA, 12 nt, Homo sapiens
aaccaguucucu

SEQ ID NO: 1544865 - RNA, 16 nt, Homo sapiens
aaccauugugcauucu

SEQ ID NO: 1544866 - RNA, 15 nt, Homo sapiens
aaccccccuccccaa

SEQ ID NO: 1544867 - RNA, 12 nt, Homo sapiens
aacccugugauc

SEQ ID NO: 1544868 - RNA, 15 nt, Homo sapiens
aacccugugaucuau

SEQ ID NO: 1544869 - RNA, 20 nt, Homo sapiens
aacccugugaucuauaccac

SEQ ID NO: 1544870 - RNA, 23 nt, Homo sapiens
aacccugugaucuauaccaccuu

SEQ ID NO: 1544871 - RNA, 18 nt, Homo sapiens
aaccuaggagcagugggc

SEQ ID NO: 1544872 - RNA, 15 nt, Homo sapiens
aaccucaagcugcau

SEQ ID NO: 1544873 - RNA, 14 nt, Homo sapiens
aaccucacugcccu

SEQ ID NO: 1544874 - RNA, 14 nt, Homo sapiens
aaccucauuuacca

SEQ ID NO: 1544875 - RNA, 12 nt, Homo sapiens
aaccugugauga

SEQ ID NO: 1544876 - RNA, 15 nt, Homo sapiens
aaccuucacccagca

SEQ ID NO: 1544877 - RNA, 21 nt, Homo sapiens
aacgaaacacagaacucagcc

SEQ ID NO: 1544878 - RNA, 13 nt, Homo sapiens
aacgcaugcaggg

SEQ ID NO: 1544879 - RNA, 23 nt, Homo sapiens
aacguuaucucauugcaaaaaua

SEQ ID NO: 1544880 - RNA, 16 nt, Homo sapiens
aacuauuguuaauucu

SEQ ID NO: 1544881 - RNA, 19 nt, Homo sapiens
aacucagcaauggcagauu

SEQ ID NO: 1544882 - RNA, 23 nt, Homo sapiens
aacucagccuuaagaaagcuaua

SEQ ID NO: 1544883 - RNA, 18 nt, Homo sapiens
aacuccaggaaaacuguu

SEQ ID NO: 1544884 - RNA, 20 nt, Homo sapiens
aacuccuggaucccuuucac

SEQ ID NO: 1544885 - RNA, 21 nt, Homo sapiens
aacucuucuuguaaaucacuu

SEQ ID NO: 1544886 - RNA, 14 nt, Homo sapiens
aacugaagcccaca

SEQ ID NO: 1544887 - RNA, 16 nt, Homo sapiens
aacugagcacuuugaa

SEQ ID NO: 1544888 - RNA, 17 nt, Homo sapiens
aacugguccaggccagg

SEQ ID NO: 1544889 - RNA, 18 nt, Homo sapiens
aacuguaaaauacuucuu

SEQ ID NO: 1544890 - RNA, 19 nt, Homo sapiens
aacuguaaaauacuucuuu

SEQ ID NO: 1544891 - RNA, 19 nt, Homo sapiens
aacuguaguaauuguuaca

SEQ ID NO: 1544892 - RNA, 22 nt, Homo sapiens
aacugucucucaugaaccucaa

SEQ ID NO: 1544893 - RNA, 15 nt, Homo sapiens
aacugucuuagucau

SEQ ID NO: 1544894 - RNA, 22 nt, Homo sapiens
aacuguuuuugaagaagggaaa

SEQ ID NO: 1544895 - RNA, 23 nt, Homo sapiens
aacuuaauuaccuaagagccaca

SEQ ID NO: 1544896 - RNA, 14 nt, Homo sapiens
aacuucaucugucu

SEQ ID NO: 1544897 - RNA, 15 nt, Homo sapiens
aacuucaugcugucu

SEQ ID NO: 1544898 - RNA, 21 nt, Homo sapiens
aacuuggugccuaauguucca

SEQ ID NO: 1544899 - RNA, 18 nt, Homo sapiens
aacuugucacaaagugag

SEQ ID NO: 1544900 - RNA, 20 nt, Homo sapiens
aacuuuauuuaaaaugauuu

SEQ ID NO: 1544901 - RNA, 23 nt, Homo sapiens
aacuuuuauuuuuaucaguuaca

SEQ ID NO: 1544902 - RNA, 21 nt, Homo sapiens
aagaaagcuguaauauauagu

SEQ ID NO: 1544903 - RNA, 15 nt, Homo sapiens
aagaagaaccaucuu

SEQ ID NO: 1544904 - RNA, 21 nt, Homo sapiens
aagacaaauugaucagugcuu

SEQ ID NO: 1544905 - RNA, 22 nt, Homo sapiens
aagacacgcccgacucucucca

SEQ ID NO: 1544906 - RNA, 23 nt, Homo sapiens
aagacacgcccgacucucuccau

SEQ ID NO: 1544907 - RNA, 21 nt, Homo sapiens
aagacacguguuuuuguaucu

SEQ ID NO: 1544908 - RNA, 20 nt, Homo sapiens
aagacuuccucaugaaucuc

SEQ ID NO: 1544909 - RNA, 15 nt, Homo sapiens
aagacuugaugaaua

SEQ ID NO: 1544910 - RNA, 12 nt, Homo sapiens
aagagaaggcaa

SEQ ID NO: 1544911 - RNA, 18 nt, Homo sapiens
aagaggcauucagcaauu

SEQ ID NO: 1544912 - RNA, 20 nt, Homo sapiens
aagagguagagaaaauggaa

SEQ ID NO: 1544913 - RNA, 16 nt, Homo sapiens
aagaguaaaaccaaag

SEQ ID NO: 1544914 - RNA, 13 nt, Homo sapiens
aagauaaauccaa

SEQ ID NO: 1544915 - RNA, 20 nt, Homo sapiens
aagauaaguguguuugcaaa

SEQ ID NO: 1544916 - RNA, 20 nt, Homo sapiens
aagaucaagcuccaucuuau

SEQ ID NO: 1544917 - RNA, 16 nt, Homo sapiens
aagauccugucuugcu

SEQ ID NO: 1544918 - RNA, 13 nt, Homo sapiens
aagauucaauuaa

SEQ ID NO: 1544919 - RNA, 11 nt, Homo sapiens
aagcaaugugg

SEQ ID NO: 1544920 - RNA, 21 nt, Homo sapiens
aagcaggaaggucucaugccu

SEQ ID NO: 1544921 - RNA, 20 nt, Homo sapiens
aagcaucuauucccaaagaa

SEQ ID NO: 1544922 - RNA, 15 nt, Homo sapiens
aagccuccaccugca

SEQ ID NO: 1544923 - RNA, 16 nt, Homo sapiens
aagccuccaccugcag

SEQ ID NO: 1544924 - RNA, 19 nt, Homo sapiens
aagccuuggaccaaaugga

SEQ ID NO: 1544925 - RNA, 12 nt, Homo sapiens
aagcuccugaau

SEQ ID NO: 1544926 - RNA, 23 nt, Homo sapiens
aagcuggggccccugcaaccucg

SEQ ID NO: 1544927 - RNA, 14 nt, Homo sapiens
aaggaaagcagugu

SEQ ID NO: 1544928 - RNA, 19 nt, Homo sapiens
aaggagacaaaacuagaga

SEQ ID NO: 1544929 - RNA, 14 nt, Homo sapiens
aaggauugugaacu

SEQ ID NO: 1544930 - RNA, 21 nt, Homo sapiens
aaggccuuguuaaaauccaag

SEQ ID NO: 1544931 - RNA, 18 nt, Homo sapiens
aagggacugguccaggca

SEQ ID NO: 1544932 - RNA, 17 nt, Homo sapiens
aagggcauuuuggcucc

SEQ ID NO: 1544933 - RNA, 16 nt, Homo sapiens
aaggggcugucuccca

SEQ ID NO: 1544934 - RNA, 20 nt, Homo sapiens
aaggggcugucucccaauga

SEQ ID NO: 1544935 - RNA, 12 nt, Homo sapiens
aaggguuagaca

SEQ ID NO: 1544936 - RNA, 15 nt, Homo sapiens
aagguucuugcugcc

SEQ ID NO: 1544937 - RNA, 13 nt, Homo sapiens
aagguugugauga

SEQ ID NO: 1544938 - RNA, 19 nt, Homo sapiens
aaguaauagggcuucugcc

SEQ ID NO: 1544939 - RNA, 14 nt, Homo sapiens
aaguaauaucuuuc

SEQ ID NO: 1544940 - RNA, 20 nt, Homo sapiens
aaguauuuccaacuugucac

SEQ ID NO: 1544941 - RNA, 15 nt, Homo sapiens
aagucaccuguauaa

SEQ ID NO: 1544942 - RNA, 13 nt, Homo sapiens
aagucacugcaca

SEQ ID NO: 1544943 - RNA, 19 nt, Homo sapiens
aagucccugagaagccuca

SEQ ID NO: 1544944 - RNA, 13 nt, Homo sapiens
aagucuaugcuua

SEQ ID NO: 1544945 - RNA, 15 nt, Homo sapiens
aagucuccuguauca

SEQ ID NO: 1544946 - RNA, 14 nt, Homo sapiens
aagucucuggguca

SEQ ID NO: 1544947 - RNA, 20 nt, Homo sapiens
aagugagcaguguuagcuua

SEQ ID NO: 1544948 - RNA, 17 nt, Homo sapiens
aagugcaauccauguau

SEQ ID NO: 1544949 - RNA, 15 nt, Homo sapiens
aagugcacugugucc

SEQ ID NO: 1544950 - RNA, 11 nt, Homo sapiens
aagugccccug

SEQ ID NO: 1544951 - RNA, 13 nt, Homo sapiens
aaguggcaccuaa

SEQ ID NO: 1544952 - RNA, 22 nt, Homo sapiens
aaguuauccagaggguugugau

SEQ ID NO: 1544953 - RNA, 22 nt, Homo sapiens
aaguucaccguaguaacacaua

SEQ ID NO: 1544954 - RNA, 19 nt, Homo sapiens
aaguuuauaucuugauuau

SEQ ID NO: 1544955 - RNA, 18 nt, Homo sapiens
aaguuugccccagugcua

SEQ ID NO: 1544956 - RNA, 18 nt, Homo sapiens
aauaaagcaaugugguag

SEQ ID NO: 1544957 - RNA, 22 nt, Homo sapiens
aauaaauuauuuaacuaauuaa

SEQ ID NO: 1544958 - RNA, 13 nt, Homo sapiens
aauaacagugugu

SEQ ID NO: 1544959 - RNA, 17 nt, Homo sapiens
aaaaaauaacaucucuu

SEQ ID NO: 1544960 - RNA, 16 nt, Homo sapiens
aaaaacaccuaaguga

SEQ ID NO: 1544961 - RNA, 11 nt, Homo sapiens
aaaaacauuca

SEQ ID NO: 1544962 - RNA, 11 nt, Homo sapiens
aaaaaccaaug

SEQ ID NO: 1544963 - RNA, 16 nt, Homo sapiens
aaaaacuguugcuauu

SEQ ID NO: 1544964 - RNA, 16 nt, Homo sapiens
aaaaaguaaaugugau

SEQ ID NO: 1544965 - RNA, 15 nt, Homo sapiens
aaaaaguugcacauu

SEQ ID NO: 1544966 - RNA, 12 nt, Homo sapiens
aaaaauauguga

SEQ ID NO: 1544967 - RNA, 20 nt, Homo sapiens
aaaaaucaucaaaguguuua

SEQ ID NO: 1544968 - RNA, 16 nt, Homo sapiens
aaaaaugcauauacuu

SEQ ID NO: 1544969 - RNA, 13 nt, Homo sapiens
aaaacaugacuuu

SEQ ID NO: 1544970 - RNA, 21 nt, Homo sapiens
aaaacauuguccccaaugaau

SEQ ID NO: 1544971 - RNA, 17 nt, Homo sapiens
aaaaccuuccaugucaa

SEQ ID NO: 1544972 - RNA, 17 nt, Homo sapiens
aaaacugcccauuguaa

SEQ ID NO: 1544973 - RNA, 11 nt, Homo sapiens
aaaacugccua

SEQ ID NO: 1544974 - RNA, 24 nt, Homo sapiens
aaaacuugcaugcagcagcuuuug

SEQ ID NO: 1544975 - RNA, 23 nt, Homo sapiens
aaaagcauuauccuuuuaucuca

SEQ ID NO: 1544976 - RNA, 16 nt, Homo sapiens
aaaaggugauugucac

SEQ ID NO: 1544977 - RNA, 16 nt, Homo sapiens
aaaagguuaagccaua

SEQ ID NO: 1544978 - RNA, 14 nt, Homo sapiens
aaaaguauuuccaa

SEQ ID NO: 1544979 - RNA, 16 nt, Homo sapiens
aaaaguuauguagaaa

SEQ ID NO: 1544980 - RNA, 21 nt, Homo sapiens
aaaauaguaaaugcuuugugu

SEQ ID NO: 1544981 - RNA, 16 nt, Homo sapiens
aaaauauggacuucca

SEQ ID NO: 1544982 - RNA, 17 nt, Homo sapiens
aaaaugugguaacuuua

SEQ ID NO: 1544983 - RNA, 13 nt, Homo sapiens
aaacaaauuccuu

SEQ ID NO: 1544984 - RNA, 19 nt, Homo sapiens
aaacaagaugaaauuccau

SEQ ID NO: 1544985 - RNA, 15 nt, Homo sapiens
aaacagccucuccaa

SEQ ID NO: 1544986 - RNA, 15 nt, Homo sapiens
aaacaggugcuaaca

SEQ ID NO: 1544987 - RNA, 22 nt, Homo sapiens
aaacaguguuuccagugacaca

SEQ ID NO: 1544988 - RNA, 14 nt, Homo sapiens
aaaccaaugauuca

SEQ ID NO: 1544989 - RNA, 23 nt, Homo sapiens
aaacccauuuccagcuccuagua

SEQ ID NO: 1544990 - RNA, 12 nt, Homo sapiens
aaaccuuacuua

SEQ ID NO: 1544991 - RNA, 14 nt, Homo sapiens
aaaccuuacuuaaa

SEQ ID NO: 1544992 - RNA, 22 nt, Homo sapiens
aaaccuuccaugucaagauuca

SEQ ID NO: 1544993 - RNA, 20 nt, Homo sapiens
aaacgucacagcaguacuug

SEQ ID NO: 1544994 - RNA, 17 nt, Homo sapiens
aaacuuuucugcugaua

SEQ ID NO: 1544995 - RNA, 14 nt, Homo sapiens
aaagaagacuggaa

SEQ ID NO: 1544996 - RNA, 13 nt, Homo sapiens
aaagaggcauuca

SEQ ID NO: 1544997 - RNA, 19 nt, Homo sapiens
aaagaguaaaaccaaaggu

SEQ ID NO: 1544998 - RNA, 17 nt, Homo sapiens
aaagcaagcaccugggu

SEQ ID NO: 1544999 - RNA, 21 nt, Homo sapiens
aaagcaucuauucccaaagaa

SEQ ID NO: 1545000 - RNA, 14 nt, Homo sapiens
aaagcaugccaauu

SEQ ID NO: 1545001 - RNA, 11 nt, Homo sapiens
aaagcauuauc

SEQ ID NO: 1545002 - RNA, 21 nt, Homo sapiens
aaagcuaaacaaaacuugcau

SEQ ID NO: 1545003 - RNA, 22 nt, Homo sapiens
aaagcuagaggagauugcucug

SEQ ID NO: 1545004 - RNA, 18 nt, Homo sapiens
aaagcuaucuucauguaa

SEQ ID NO: 1545005 - RNA, 13 nt, Homo sapiens
aaagcucacuuca

SEQ ID NO: 1545006 - RNA, 13 nt, Homo sapiens
aaaggaagaugua

SEQ ID NO: 1545007 - RNA, 15 nt, Homo sapiens
aaaggaauauaccac

SEQ ID NO: 1545008 - RNA, 14 nt, Homo sapiens
aaaggacaaaaaua

SEQ ID NO: 1545009 - RNA, 16 nt, Homo sapiens
aaaggacaaaaauaua

SEQ ID NO: 1545010 - RNA, 19 nt, Homo sapiens
aaagguaaucugaaacaca

SEQ ID NO: 1545011 - RNA, 13 nt, Homo sapiens
aaagguaggugca

SEQ ID NO: 1545012 - RNA, 15 nt, Homo sapiens
aaagguuaagccaua

SEQ ID NO: 1545013 - RNA, 22 nt, Homo sapiens
aaaguaaguggagcauuuggaa

SEQ ID NO: 1545014 - RNA, 14 nt, Homo sapiens
uuggcgggccaagg

SEQ ID NO: 1545015 - RNA, 15 nt, Homo sapiens
uugggccccagggaa

SEQ ID NO: 1545016 - RNA, 13 nt, Homo sapiens
uugggcucugcgu

SEQ ID NO: 1545017 - RNA, 13 nt, Homo sapiens
uugggggauucaa

SEQ ID NO: 1545018 - RNA, 19 nt, Homo sapiens
uuguaugaaauauauguga

SEQ ID NO: 1545019 - RNA, 21 nt, Homo sapiens
uugucaaaacuccacucagca

SEQ ID NO: 1545020 - RNA, 22 nt, Homo sapiens
uugucauguggcuaaaugccua

SEQ ID NO: 1545021 - RNA, 22 nt, Homo sapiens
uugucuguuaaaugaacuugau

SEQ ID NO: 1545022 - RNA, 17 nt, Homo sapiens
uugugcugccuguggug

SEQ ID NO: 1545023 - RNA, 20 nt, Homo sapiens
uugugguuuauugaauguga

SEQ ID NO: 1545024 - RNA, 16 nt, Homo sapiens
uuguucagaagacaca

SEQ ID NO: 1545025 - RNA, 19 nt, Homo sapiens
uuguugcaguucagacaaa

SEQ ID NO: 1545026 - RNA, 12 nt, Homo sapiens
uuguugucuaaa

SEQ ID NO: 1545027 - RNA, 16 nt, Homo sapiens
uuuaaaaaaauaacau

SEQ ID NO: 1545028 - RNA, 19 nt, Homo sapiens
uuuaaaaaagcauuauccu

SEQ ID NO: 1545029 - RNA, 14 nt, Homo sapiens
uuuaaaagcaugau

SEQ ID NO: 1545030 - RNA, 13 nt, Homo sapiens
uuuaaaugauuua

SEQ ID NO: 1545031 - RNA, 11 nt, Homo sapiens
uuuaacauuau

SEQ ID NO: 1545032 - RNA, 14 nt, Homo sapiens
uuuaacggcacugu

SEQ ID NO: 1545033 - RNA, 20 nt, Homo sapiens
uuuaagaguagauugauuca

SEQ ID NO: 1545034 - RNA, 22 nt, Homo sapiens
uuuaauuauaaucucuucuuau

SEQ ID NO: 1545035 - RNA, 18 nt, Homo sapiens
uuuacaauaaaauuuugc

SEQ ID NO: 1545036 - RNA, 14 nt, Homo sapiens
uuuacagugccacg

SEQ ID NO: 1545037 - RNA, 22 nt, Homo sapiens
uuuaccauaaaaauccuucuca

SEQ ID NO: 1545038 - RNA, 16 nt, Homo sapiens
uuuaccuugcauuuua

SEQ ID NO: 1545039 - RNA, 18 nt, Homo sapiens
uuuagaaucaagucugug

SEQ ID NO: 1545040 - RNA, 15 nt, Homo sapiens
uuuagaguaugcaag

SEQ ID NO: 1545041 - RNA, 22 nt, Homo sapiens
uuuagaguaugcaagaagaaua

SEQ ID NO: 1545042 - RNA, 13 nt, Homo sapiens
uuuaggcauuaaa

SEQ ID NO: 1545043 - RNA, 13 nt, Homo sapiens
uuuagggugauca

SEQ ID NO: 1545044 - RNA, 14 nt, Homo sapiens
uuuaggucauccaa

SEQ ID NO: 1545045 - RNA, 22 nt, Homo sapiens
uuuauaccagcuuaugagcuca

SEQ ID NO: 1545046 - RNA, 19 nt, Homo sapiens
uuuauguguugaugacuca

SEQ ID NO: 1545047 - RNA, 21 nt, Homo sapiens
uuuauucauuagcugugauuu

SEQ ID NO: 1545048 - RNA, 18 nt, Homo sapiens
uuucaaaaugcaugugau

SEQ ID NO: 1545049 - RNA, 19 nt, Homo sapiens
uuucacaaauauaguugaa

SEQ ID NO: 1545050 - RNA, 15 nt, Homo sapiens
uuucacuguucauga

SEQ ID NO: 1545051 - RNA, 21 nt, Homo sapiens
uuucagaaacaaagcauuuga

SEQ ID NO: 1545052 - RNA, 23 nt, Homo sapiens
uuucagaaacaaagcauuugacu

SEQ ID NO: 1545053 - RNA, 13 nt, Homo sapiens
uuucagguggaac

SEQ ID NO: 1545054 - RNA, 16 nt, Homo sapiens
uuucaugauuugcaac

SEQ ID NO: 1545055 - RNA, 17 nt, Homo sapiens
uuuccaagggucuuccu

SEQ ID NO: 1545056 - RNA, 22 nt, Homo sapiens
uuuccaauccuuuauagcuuug

SEQ ID NO: 1545057 - RNA, 22 nt, Homo sapiens
uuuccccuuuuaaaaacucaga

SEQ ID NO: 1545058 - RNA, 16 nt, Homo sapiens
uuuccugauguugaua

SEQ ID NO: 1545059 - RNA, 16 nt, Homo sapiens
uuucuaaauguuucuu

SEQ ID NO: 1545060 - RNA, 13 nt, Homo sapiens
uuucuagcaaaca

SEQ ID NO: 1545061 - RNA, 19 nt, Homo sapiens
uuucuauauuauugcccau

SEQ ID NO: 1545062 - RNA, 18 nt, Homo sapiens
uuucucauuuagcauuga

SEQ ID NO: 1545063 - RNA, 19 nt, Homo sapiens
uuugaagguauaaccuuca

SEQ ID NO: 1545064 - RNA, 16 nt, Homo sapiens
uuugcacccaugccau

SEQ ID NO: 1545065 - RNA, 17 nt, Homo sapiens
uuugcaugucugcauga

SEQ ID NO: 1545066 - RNA, 12 nt, Homo sapiens
uuugccacugaa

SEQ ID NO: 1545067 - RNA, 12 nt, Homo sapiens
uuugccacugga

SEQ ID NO: 1545068 - RNA, 11 nt, Homo sapiens
uuugggagacu

SEQ ID NO: 1545069 - RNA, 18 nt, Homo sapiens
uuugguuuugugugguau

SEQ ID NO: 1545070 - RNA, 17 nt, Homo sapiens
uuugucaguguagauca

SEQ ID NO: 1545071 - RNA, 19 nt, Homo sapiens
uuuguucacuucgaugacu

SEQ ID NO: 1545072 - RNA, 19 nt, Homo sapiens
uuuuaacaaaugauuuaca

SEQ ID NO: 1545073 - RNA, 21 nt, Homo sapiens
uuuuaaugauacugucuaaga

SEQ ID NO: 1545074 - RNA, 21 nt, Homo sapiens
uuuuaccaucacacauguuca

SEQ ID NO: 1545075 - RNA, 13 nt, Homo sapiens
uuuuaugugcuug

SEQ ID NO: 1545076 - RNA, 19 nt, Homo sapiens
uuuuauguguugaugacuc

SEQ ID NO: 1545077 - RNA, 10 nt, Homo sapiens
uuuucacugc

SEQ ID NO: 1545078 - RNA, 20 nt, Homo sapiens
cuggaguuggaaaagaaaca

SEQ ID NO: 1545079 - RNA, 14 nt, Homo sapiens
cuggauuugcauac

SEQ ID NO: 1545080 - RNA, 19 nt, Homo sapiens
cuggauuugcauacauucu

SEQ ID NO: 1545081 - RNA, 22 nt, Homo sapiens
cuggauuugcauacauucuuca

SEQ ID NO: 1545082 - RNA, 23 nt, Homo sapiens
cuggccuauuuuggacgugugag

SEQ ID NO: 1545083 - RNA, 13 nt, Homo sapiens
cuggcucacagcc

SEQ ID NO: 1545084 - RNA, 15 nt, Homo sapiens
cuggcucacagccac

SEQ ID NO: 1545085 - RNA, 19 nt, Homo sapiens
cuggcucugucacuaaaug

SEQ ID NO: 1545086 - RNA, 22 nt, Homo sapiens
cuggcugcccuucuucuugacc

SEQ ID NO: 1545087 - RNA, 16 nt, Homo sapiens
cuggcuggacuggagg

SEQ ID NO: 1545088 - RNA, 14 nt, Homo sapiens
cugggccacuggca

SEQ ID NO: 1545089 - RNA, 13 nt, Homo sapiens
cugggcccuaggc

SEQ ID NO: 1545090 - RNA, 19 nt, Homo sapiens
cuggggcuuuugugccagg

SEQ ID NO: 1545091 - RNA, 14 nt, Homo sapiens
cugggggccaugag

SEQ ID NO: 1545092 - RNA, 17 nt, Homo sapiens
cuggggugggugugagc

SEQ ID NO: 1545093 - RNA, 20 nt, Homo sapiens
cugggucaccuuccugggca

SEQ ID NO: 1545094 - RNA, 13 nt, Homo sapiens
cuggguccuuaaa

SEQ ID NO: 1545095 - RNA, 15 nt, Homo sapiens
cugguccugcacugu

SEQ ID NO: 1545096 - RNA, 20 nt, Homo sapiens
cugguccuucugaccccacu

SEQ ID NO: 1545097 - RNA, 15 nt, Homo sapiens
cuggugcccaccagc

SEQ ID NO: 1545098 - RNA, 19 nt, Homo sapiens
cugguggcccgacagccug

SEQ ID NO: 1545099 - RNA, 15 nt, Homo sapiens
cugguuaugagccga

SEQ ID NO: 1545100 - RNA, 17 nt, Homo sapiens
cuguaaaauacuucuuu

SEQ ID NO: 1545101 - RNA, 17 nt, Homo sapiens
cuguaccuggugcccug

SEQ ID NO: 1545102 - RNA, 15 nt, Homo sapiens
cugucaccaagccuu

SEQ ID NO: 1545103 - RNA, 19 nt, Homo sapiens
cugucagucguguugcuua

SEQ ID NO: 1545104 - RNA, 17 nt, Homo sapiens
cuguccacugggccauu

SEQ ID NO: 1545105 - RNA, 22 nt, Homo sapiens
cugucccggagcucaggcccug

SEQ ID NO: 1545106 - RNA, 19 nt, Homo sapiens
cuguccguaguaucagaga

SEQ ID NO: 1545107 - RNA, 18 nt, Homo sapiens
cuguccuucccacggcca

SEQ ID NO: 1545108 - RNA, 20 nt, Homo sapiens
cugucucaaaccuccaaaag

SEQ ID NO: 1545109 - RNA, 15 nt, Homo sapiens
cugucucucaugaac

SEQ ID NO: 1545110 - RNA, 15 nt, Homo sapiens
cugugaauaaagcca

SEQ ID NO: 1545111 - RNA, 14 nt, Homo sapiens
cuguggauucuaua

SEQ ID NO: 1545112 - RNA, 17 nt, Homo sapiens
cuguggccucagcaucu

SEQ ID NO: 1545113 - RNA, 19 nt, Homo sapiens
cuguggcuucccaugucuu

SEQ ID NO: 1545114 - RNA, 18 nt, Homo sapiens
cuguggugagguccuguc

SEQ ID NO: 1545115 - RNA, 13 nt, Homo sapiens
cugugugacauca

SEQ ID NO: 1545116 - RNA, 15 nt, Homo sapiens
cuguuaaaugaacuu

SEQ ID NO: 1545117 - RNA, 14 nt, Homo sapiens
cuguuacaguaaug

SEQ ID NO: 1545118 - RNA, 22 nt, Homo sapiens
cuguuggaagggggucacuuaa

SEQ ID NO: 1545119 - RNA, 21 nt, Homo sapiens
cuguuuccagagugcuuauaa

SEQ ID NO: 1545120 - RNA, 13 nt, Homo sapiens
cuguuugcucacc

SEQ ID NO: 1545121 - RNA, 21 nt, Homo sapiens
cuguuuugcauggaguauuau

SEQ ID NO: 1545122 - RNA, 23 nt, Homo sapiens
cuuaaagcuuguuuguucuaguu

SEQ ID NO: 1545123 - RNA, 14 nt, Homo sapiens
cuuaacaaaaguga

SEQ ID NO: 1545124 - RNA, 22 nt, Homo sapiens
cuuaaguacugaaauacauaug

SEQ ID NO: 1545125 - RNA, 11 nt, Homo sapiens
cuuaauuaccu

SEQ ID NO: 1545126 - RNA, 14 nt, Homo sapiens
cuuacaugauucau

SEQ ID NO: 1545127 - RNA, 13 nt, Homo sapiens
cuuacaugcauua

SEQ ID NO: 1545128 - RNA, 20 nt, Homo sapiens
cuuacuuuaccucucuguca

SEQ ID NO: 1545129 - RNA, 14 nt, Homo sapiens
cuuagaauacugua

SEQ ID NO: 1545130 - RNA, 17 nt, Homo sapiens
cuuagcuuuucugcaau

SEQ ID NO: 1545131 - RNA, 19 nt, Homo sapiens
cuuaggauuuaccaaauag

SEQ ID NO: 1545132 - RNA, 15 nt, Homo sapiens
cuuauauuguucacu

SEQ ID NO: 1545133 - RNA, 23 nt, Homo sapiens
cuuaucuuaggauuuaccaaaua

SEQ ID NO: 1545134 - RNA, 17 nt, Homo sapiens
cuuaugagauacuuugc

SEQ ID NO: 1545135 - RNA, 15 nt, Homo sapiens
cuuauuucauaaaca

SEQ ID NO: 1545136 - RNA, 14 nt, Homo sapiens
cuuauuuccaugga

SEQ ID NO: 1545137 - RNA, 13 nt, Homo sapiens
cuucaaaacagaa

SEQ ID NO: 1545138 - RNA, 15 nt, Homo sapiens
cuucaaaauauugag

SEQ ID NO: 1545139 - RNA, 22 nt, Homo sapiens
cuucaaaguuuucugcuguaaa

SEQ ID NO: 1545140 - RNA, 19 nt, Homo sapiens
cuucaacaugguuaccucu

SEQ ID NO: 1545141 - RNA, 20 nt, Homo sapiens
cuucaagccuggcccaguga

SEQ ID NO: 1545142 - RNA, 24 nt, Homo sapiens
cuucagauggugaagcauucuccc

SEQ ID NO: 1545143 - RNA, 18 nt, Homo sapiens
cuucagcaugauguguug

SEQ ID NO: 1545144 - RNA, 14 nt, Homo sapiens
cuucauggaacuca

SEQ ID NO: 1545145 - RNA, 16 nt, Homo sapiens
cuucauguaaauugac

SEQ ID NO: 1545146 - RNA, 21 nt, Homo sapiens
cuuccacgcugucuccagacc

SEQ ID NO: 1545147 - RNA, 18 nt, Homo sapiens
cuuccaucagcagugauu

SEQ ID NO: 1545148 - RNA, 12 nt, Homo sapiens
cuuccauggugg

SEQ ID NO: 1545149 - RNA, 13 nt, Homo sapiens
cuuccaugguggu

SEQ ID NO: 1545150 - RNA, 17 nt, Homo sapiens
cuucccacuuugccacu

SEQ ID NO: 1545151 - RNA, 19 nt, Homo sapiens
cuucccacuuugccacugg

SEQ ID NO: 1545152 - RNA, 16 nt, Homo sapiens
cuucccuaguucuuug

SEQ ID NO: 1545153 - RNA, 16 nt, Homo sapiens
cuucccugacacuguc

SEQ ID NO: 1545154 - RNA, 14 nt, Homo sapiens
cuuccuguccagag

SEQ ID NO: 1545155 - RNA, 23 nt, Homo sapiens
cuucuccacagggacacagucug

SEQ ID NO: 1545156 - RNA, 15 nt, Homo sapiens
cuucucccacacugc

SEQ ID NO: 1545157 - RNA, 17 nt, Homo sapiens
cuucuccccuccaagug

SEQ ID NO: 1545158 - RNA, 21 nt, Homo sapiens
cuucucuguucauuuccucaa

SEQ ID NO: 1545159 - RNA, 11 nt, Homo sapiens
cuucugccuaa

SEQ ID NO: 1545160 - RNA, 17 nt, Homo sapiens
cuucugccuaagccucu

SEQ ID NO: 1545161 - RNA, 15 nt, Homo sapiens
cuucuggcugucagu

SEQ ID NO: 1545162 - RNA, 18 nt, Homo sapiens
cuucuuuacuaacacugg

SEQ ID NO: 1545163 - RNA, 21 nt, Homo sapiens
cuugaauguccccauucuaua

SEQ ID NO: 1545164 - RNA, 17 nt, Homo sapiens
cuugacccauguucuca

SEQ ID NO: 1545165 - RNA, 18 nt, Homo sapiens
cuugacuucaugccagcu

SEQ ID NO: 1545166 - RNA, 16 nt, Homo sapiens
cuugagcaaggcaaga

SEQ ID NO: 1545167 - RNA, 23 nt, Homo sapiens
cuugaguuguuuaaacagucaaa

SEQ ID NO: 1545168 - RNA, 16 nt, Homo sapiens
cuugaguuuuccugcu

SEQ ID NO: 1545169 - RNA, 17 nt, Homo sapiens
cuugcacaaacuccauc

SEQ ID NO: 1545170 - RNA, 19 nt, Homo sapiens
cuugcugccccacaacaca

SEQ ID NO: 1545171 - RNA, 13 nt, Homo sapiens
cuuggaccaaaug

SEQ ID NO: 1545172 - RNA, 13 nt, Homo sapiens
cuuggcacauccg

SEQ ID NO: 1545173 - RNA, 12 nt, Homo sapiens
cuuggccagaag

SEQ ID NO: 1545174 - RNA, 22 nt, Homo sapiens
cuuggccagaagggggccauga

SEQ ID NO: 1545175 - RNA, 19 nt, Homo sapiens
cuuggcuagucacauauca

SEQ ID NO: 1545176 - RNA, 15 nt, Homo sapiens
cuugucacuugccag

SEQ ID NO: 1545177 - RNA, 16 nt, Homo sapiens
cuugucacuugccagu

SEQ ID NO: 1545178 - RNA, 18 nt, Homo sapiens
cuuguguacaaacccaga

SEQ ID NO: 1545179 - RNA, 22 nt, Homo sapiens
cuuguucuuccucuuaccugua

SEQ ID NO: 1545180 - RNA, 15 nt, Homo sapiens
cuuuaaagacuugau

SEQ ID NO: 1545181 - RNA, 22 nt, Homo sapiens
cuuuaacaagacuucaaaguuu

SEQ ID NO: 1545182 - RNA, 15 nt, Homo sapiens
cuuuacagugccacg

SEQ ID NO: 1545183 - RNA, 12 nt, Homo sapiens
cuuuaccaugcu

SEQ ID NO: 1545184 - RNA, 16 nt, Homo sapiens
cuuuacuaacacuggc

SEQ ID NO: 1545185 - RNA, 14 nt, Homo sapiens
cuuuaggcauuaaa

SEQ ID NO: 1545186 - RNA, 20 nt, Homo sapiens
cuuuaucaagggccuacuuu

SEQ ID NO: 1545187 - RNA, 22 nt, Homo sapiens
cuuuaucaagggccuacuuuau

SEQ ID NO: 1545188 - RNA, 20 nt, Homo sapiens
cuuuauguuacuacaugcac

SEQ ID NO: 1545189 - RNA, 14 nt, Homo sapiens
cuuucaacaauggg

SEQ ID NO: 1545190 - RNA, 19 nt, Homo sapiens
cuuucacuauguccaugaa

SEQ ID NO: 1545191 - RNA, 12 nt, Homo sapiens
gagagacugcuc

SEQ ID NO: 1545192 - RNA, 21 nt, Homo sapiens
gagagccaaggccuaugccac

SEQ ID NO: 1545193 - RNA, 14 nt, Homo sapiens
gagagcggcuuccc

SEQ ID NO: 1545194 - RNA, 19 nt, Homo sapiens
gagaggagagaaugagaga

SEQ ID NO: 1545195 - RNA, 18 nt, Homo sapiens
gagaggagcguguccuau

SEQ ID NO: 1545196 - RNA, 13 nt, Homo sapiens
gagauacuuugca

SEQ ID NO: 1545197 - RNA, 17 nt, Homo sapiens
gagauagguacuauuau

SEQ ID NO: 1545198 - RNA, 12 nt, Homo sapiens
gagaugauuucc

SEQ ID NO: 1545199 - RNA, 19 nt, Homo sapiens
gagaugggaugcuugccua

SEQ ID NO: 1545200 - RNA, 11 nt, Homo sapiens
gagauuugcca

SEQ ID NO: 1545201 - RNA, 22 nt, Homo sapiens
gagcaccuacuuacaugcauua

SEQ ID NO: 1545202 - RNA, 17 nt, Homo sapiens
gagcaggguuagcucac

SEQ ID NO: 1545203 - RNA, 14 nt, Homo sapiens
gagcauacccagug

SEQ ID NO: 1545204 - RNA, 16 nt, Homo sapiens
gagcaugaagauaaau

SEQ ID NO: 1545205 - RNA, 17 nt, Homo sapiens
gagccaccccuaaagag

SEQ ID NO: 1545206 - RNA, 16 nt, Homo sapiens
gagccacucuguuccu

SEQ ID NO: 1545207 - RNA, 15 nt, Homo sapiens
gagccagucccucag

SEQ ID NO: 1545208 - RNA, 16 nt, Homo sapiens
gagccagucccucagc

SEQ ID NO: 1545209 - RNA, 15 nt, Homo sapiens
gagcccaagcacaca

SEQ ID NO: 1545210 - RNA, 15 nt, Homo sapiens
gagccgagcucuccu

SEQ ID NO: 1545211 - RNA, 18 nt, Homo sapiens
gagccuguguuagugucu

SEQ ID NO: 1545212 - RNA, 13 nt, Homo sapiens
gagcggcuucccc

SEQ ID NO: 1545213 - RNA, 16 nt, Homo sapiens
gagcguguacuacccc

SEQ ID NO: 1545214 - RNA, 13 nt, Homo sapiens
gagcucagggcug

SEQ ID NO: 1545215 - RNA, 13 nt, Homo sapiens
gagcugggggcca

SEQ ID NO: 1545216 - RNA, 17 nt, Homo sapiens
cuaagcaaguauauuua

SEQ ID NO: 1545217 - RNA, 14 nt, Homo sapiens
cuaagccugaugau

SEQ ID NO: 1545218 - RNA, 16 nt, Homo sapiens
cuaaucagcauucuca

SEQ ID NO: 1545219 - RNA, 22 nt, Homo sapiens
cuaauuaaaaaguuaaucuuca

SEQ ID NO: 1545220 - RNA, 15 nt, Homo sapiens
cuaauucucuuuuca

SEQ ID NO: 1545221 - RNA, 19 nt, Homo sapiens
cuaauuggcaugaaggugu

SEQ ID NO: 1545222 - RNA, 12 nt, Homo sapiens
cuacaugcacuu

SEQ ID NO: 1545223 - RNA, 19 nt, Homo sapiens
cuaccuggucucuccuugu

SEQ ID NO: 1545224 - RNA, 17 nt, Homo sapiens
cuacuggggaucagagu

SEQ ID NO: 1545225 - RNA, 21 nt, Homo sapiens
cuacuuuauggcagacauugu

SEQ ID NO: 1545226 - RNA, 17 nt, Homo sapiens
cuagaacacaaauccaa

SEQ ID NO: 1545227 - RNA, 23 nt, Homo sapiens
cuagaaccuucuaauccaugugc

SEQ ID NO: 1545228 - RNA, 12 nt, Homo sapiens
cuagagacucaa

SEQ ID NO: 1545229 - RNA, 12 nt, Homo sapiens
cuagagccucac

SEQ ID NO: 1545230 - RNA, 20 nt, Homo sapiens
cuagauuaccaugaagaaca

SEQ ID NO: 1545231 - RNA, 23 nt, Homo sapiens
cuaggugggucaacuccaaggca

SEQ ID NO: 1545232 - RNA, 20 nt, Homo sapiens
cuagguugaaaauguuauag

SEQ ID NO: 1545233 - RNA, 13 nt, Homo sapiens
cuagucauaaccu

SEQ ID NO: 1545234 - RNA, 15 nt, Homo sapiens
cuagucauaaccuua

SEQ ID NO: 1545235 - RNA, 23 nt, Homo sapiens
cuauaaaggaaacacguuuagaa

SEQ ID NO: 1545236 - RNA, 19 nt, Homo sapiens
cuauaccaccuucaauauc

SEQ ID NO: 1545237 - RNA, 15 nt, Homo sapiens
cuauauguugcugaa

SEQ ID NO: 1545238 - RNA, 23 nt, Homo sapiens
cuauauuauauaaauaguauuuc

SEQ ID NO: 1545239 - RNA, 19 nt, Homo sapiens
cuauccagccgcaaaucca

SEQ ID NO: 1545240 - RNA, 20 nt, Homo sapiens
cuauccagccgcaaauccau

SEQ ID NO: 1545241 - RNA, 21 nt, Homo sapiens
cuauccccggacgcaugcagg

SEQ ID NO: 1545242 - RNA, 21 nt, Homo sapiens
cuaucccuggacgcaugcagg

SEQ ID NO: 1545243 - RNA, 16 nt, Homo sapiens
cuaucugguauuaaau

SEQ ID NO: 1545244 - RNA, 18 nt, Homo sapiens
cuaugucauuucauuucc

SEQ ID NO: 1545245 - RNA, 21 nt, Homo sapiens
cuauuucuggcacuugcaagu

SEQ ID NO: 1545246 - RNA, 21 nt, Homo sapiens
cuauuuuuuacuacauaauua

SEQ ID NO: 1545247 - RNA, 19 nt, Homo sapiens
cucaaaccuccaaaagccc

SEQ ID NO: 1545248 - RNA, 15 nt, Homo sapiens
cucaagauccugucu

SEQ ID NO: 1545249 - RNA, 19 nt, Homo sapiens
cucaagauccugucuugcu

SEQ ID NO: 1545250 - RNA, 22 nt, Homo sapiens
cucaagcaugaagauaaacaca

SEQ ID NO: 1545251 - RNA, 18 nt, Homo sapiens
cucaaugcuuuucuagca

SEQ ID NO: 1545252 - RNA, 18 nt, Homo sapiens
cucaccaggguuuaguuu

SEQ ID NO: 1545253 - RNA, 17 nt, Homo sapiens
cucaccugcuggccccu

SEQ ID NO: 1545254 - RNA, 15 nt, Homo sapiens
cucacugguuuucaa

SEQ ID NO: 1545255 - RNA, 10 nt, Homo sapiens
cucacugugu

SEQ ID NO: 1545256 - RNA, 14 nt, Homo sapiens
cucagcaauggcag

SEQ ID NO: 1545257 - RNA, 19 nt, Homo sapiens
cucagccucaaaugcagua

SEQ ID NO: 1545258 - RNA, 15 nt, Homo sapiens
cucagggaccaagga

SEQ ID NO: 1545259 - RNA, 12 nt, Homo sapiens
cucagugcagcc

SEQ ID NO: 1545260 - RNA, 20 nt, Homo sapiens
cucaguggacuuuccacccc

SEQ ID NO: 1545261 - RNA, 17 nt, Homo sapiens
cucaguuccugcagcag

SEQ ID NO: 1545262 - RNA, 22 nt, Homo sapiens
cucaucaacaaagaaauauuau

SEQ ID NO: 1545263 - RNA, 12 nt, Homo sapiens
cucauccagaac

SEQ ID NO: 1545264 - RNA, 16 nt, Homo sapiens
cucauccuccacugaa

SEQ ID NO: 1545265 - RNA, 16 nt, Homo sapiens
cucauggcagucccaa

SEQ ID NO: 1545266 - RNA, 17 nt, Homo sapiens
cuccaaggcaaaugucc

SEQ ID NO: 1545267 - RNA, 12 nt, Homo sapiens
cuccacuccucc

SEQ ID NO: 1545268 - RNA, 16 nt, Homo sapiens
cuccacugccuucgau

SEQ ID NO: 1545269 - RNA, 16 nt, Homo sapiens
cuccagaacaaaccuc

SEQ ID NO: 1545270 - RNA, 12 nt, Homo sapiens
cuccaggcuucc

SEQ ID NO: 1545271 - RNA, 16 nt, Homo sapiens
cuccaguucugaugag

SEQ ID NO: 1545272 - RNA, 20 nt, Homo sapiens
cuccauaauugcaagggaag

SEQ ID NO: 1545273 - RNA, 15 nt, Homo sapiens
cucccagggccauga

SEQ ID NO: 1545274 - RNA, 23 nt, Homo sapiens
cuccccagaggugaccacuuuca

SEQ ID NO: 1545275 - RNA, 18 nt, Homo sapiens
cuccccuccagaccccua

SEQ ID NO: 1545276 - RNA, 17 nt, Homo sapiens
cucccuagccagaggcu

SEQ ID NO: 1545277 - RNA, 22 nt, Homo sapiens
cucccuagccagaggcucuaau

SEQ ID NO: 1545278 - RNA, 18 nt, Homo sapiens
cucccucucuugccgaca

SEQ ID NO: 1545279 - RNA, 17 nt, Homo sapiens
cucccuuuuuaaacaaa

SEQ ID NO: 1545280 - RNA, 21 nt, Homo sapiens
cucgaaauaauuuuuuaguua

SEQ ID NO: 1545281 - RNA, 17 nt, Homo sapiens
cucgcuucauaggcaga

SEQ ID NO: 1545282 - RNA, 20 nt, Homo sapiens
cucgugguuagcaagauaca

SEQ ID NO: 1545283 - RNA, 14 nt, Homo sapiens
cucuacacugugaa

SEQ ID NO: 1545284 - RNA, 13 nt, Homo sapiens
cucuagacaucua

SEQ ID NO: 1545285 - RNA, 23 nt, Homo sapiens
cucuagacaucuagucucagugc

SEQ ID NO: 1545286 - RNA, 17 nt, Homo sapiens
cucuaugaucuuggcac

SEQ ID NO: 1545287 - RNA, 15 nt, Homo sapiens
cucuauuuagcauga

SEQ ID NO: 1545288 - RNA, 12 nt, Homo sapiens
cucucaacuuac

SEQ ID NO: 1545289 - RNA, 21 nt, Homo sapiens
cucucaggcaugccuguguga

SEQ ID NO: 1545290 - RNA, 13 nt, Homo sapiens
cucucccaaauaa

SEQ ID NO: 1545291 - RNA, 21 nt, Homo sapiens
cucuggcuacgacuugggacg

SEQ ID NO: 1545292 - RNA, 14 nt, Homo sapiens
cucugggcucacac

SEQ ID NO: 1545293 - RNA, 19 nt, Homo sapiens
cucugguccuucugacccc

SEQ ID NO: 1545294 - RNA, 21 nt, Homo sapiens
cucugguccuucugaccccac

SEQ ID NO: 1545295 - RNA, 20 nt, Homo sapiens
cucuuaaguacugaaauaca

SEQ ID NO: 1545296 - RNA, 23 nt, Homo sapiens
cucuucugagcaccuacuuacau

SEQ ID NO: 1545297 - RNA, 15 nt, Homo sapiens
cucuucuuacuguau

SEQ ID NO: 1545298 - RNA, 21 nt, Homo sapiens
cucuuuaccauagcuuaagaa

SEQ ID NO: 1545299 - RNA, 23 nt, Homo sapiens
cucuuuggaaagagaaccaugaa

SEQ ID NO: 1545300 - RNA, 20 nt, Homo sapiens
cucuuuuuagauguagcacu

SEQ ID NO: 1545301 - RNA, 21 nt, Homo sapiens
cugaaaagauguugugucuug

SEQ ID NO: 1545302 - RNA, 22 nt, Homo sapiens
cugaaacauuuggaagccccau

SEQ ID NO: 1545303 - RNA, 16 nt, Homo sapiens
cugaacugcaacacug

SEQ ID NO: 1545304 - RNA, 18 nt, Homo sapiens
cugaagcguuacuacagc

SEQ ID NO: 1545305 - RNA, 17 nt, Homo sapiens
cugacaaauuuuaauua

SEQ ID NO: 1545306 - RNA, 22 nt, Homo sapiens
cugacccuaaauguggacauca

SEQ ID NO: 1545307 - RNA, 17 nt, Homo sapiens
cugaccuugcacaaacu

SEQ ID NO: 1545308 - RNA, 14 nt, Homo sapiens
cugacgaacuccuu

SEQ ID NO: 1545309 - RNA, 16 nt, Homo sapiens
cugagcaccuacuuac

SEQ ID NO: 1545310 - RNA, 22 nt, Homo sapiens
cugagcaccuacuuacaugcau

SEQ ID NO: 1545311 - RNA, 22 nt, Homo sapiens
cugagcaguuguuauauucauu

SEQ ID NO: 1545312 - RNA, 15 nt, Homo sapiens
cugagggcaggguuc

SEQ ID NO: 1545313 - RNA, 14 nt, Homo sapiens
cugaggguuuccac

SEQ ID NO: 1545314 - RNA, 18 nt, Homo sapiens
cugagucccagcaauucu

SEQ ID NO: 1545315 - RNA, 14 nt, Homo sapiens
cugagugguccaca

SEQ ID NO: 1545316 - RNA, 19 nt, Homo sapiens
cugauaaugaaaauuauga

SEQ ID NO: 1545317 - RNA, 21 nt, Homo sapiens
cugauagauauccuuggcaca

SEQ ID NO: 1545318 - RNA, 22 nt, Homo sapiens
cugauagauauccuuggcacau

SEQ ID NO: 1545319 - RNA, 22 nt, Homo sapiens
cugauggccaggccucagggac

SEQ ID NO: 1545320 - RNA, 22 nt, Homo sapiens
cugauuuaaacuucuuaacugg

SEQ ID NO: 1545321 - RNA, 19 nt, Homo sapiens
cugcaaauacuuccaaaga

SEQ ID NO: 1545322 - RNA, 22 nt, Homo sapiens
cugcaaccucggggagugccac

SEQ ID NO: 1545323 - RNA, 18 nt, Homo sapiens
cugcaccccugguguccc

SEQ ID NO: 1545324 - RNA, 22 nt, Homo sapiens
cugcacccuggauuugcauaca

SEQ ID NO: 1545325 - RNA, 21 nt, Homo sapiens
cugcacgugcacacaccugca

SEQ ID NO: 1545326 - RNA, 14 nt, Homo sapiens
cugcagacucacug

SEQ ID NO: 1545327 - RNA, 18 nt, Homo sapiens
cugcagacucacuguggg

SEQ ID NO: 1545328 - RNA, 18 nt, Homo sapiens
cugcagcagagccuggaa

SEQ ID NO: 1545329 - RNA, 16 nt, Homo sapiens
cugcagucagcacaga

SEQ ID NO: 1545330 - RNA, 12 nt, Homo sapiens
cugcaucccucc

SEQ ID NO: 1545331 - RNA, 20 nt, Homo sapiens
cugcaucuccacuuggcauu

SEQ ID NO: 1545332 - RNA, 14 nt, Homo sapiens
cuuuccaauccuuu

SEQ ID NO: 1545333 - RNA, 22 nt, Homo sapiens
cuuucuuacauuagcaguuugc

SEQ ID NO: 1545334 - RNA, 20 nt, Homo sapiens
cuuugaaguggcaccuaaua

SEQ ID NO: 1545335 - RNA, 13 nt, Homo sapiens
cuuugccacugaa

SEQ ID NO: 1545336 - RNA, 14 nt, Homo sapiens
cuuuggaccugcag

SEQ ID NO: 1545337 - RNA, 16 nt, Homo sapiens
cuuuggcuuaauucca

SEQ ID NO: 1545338 - RNA, 22 nt, Homo sapiens
cuuugguaaugugucaaagaga

SEQ ID NO: 1545339 - RNA, 15 nt, Homo sapiens
cuuuguaugcacuuu

SEQ ID NO: 1545340 - RNA, 16 nt, Homo sapiens
cuuuuaacuucaccuu

SEQ ID NO: 1545341 - RNA, 16 nt, Homo sapiens
cuuuuauucuaacuuu

SEQ ID NO: 1545342 - RNA, 22 nt, Homo sapiens
cuuuucaagacuuccucaugaa

SEQ ID NO: 1545343 - RNA, 15 nt, Homo sapiens
cuuuucugcaauuca

SEQ ID NO: 1545344 - RNA, 22 nt, Homo sapiens
cuuuugggauguuaccuucaca

SEQ ID NO: 1545345 - RNA, 23 nt, Homo sapiens
cuuuugggauguuaccuucacau

SEQ ID NO: 1545346 - RNA, 13 nt, Homo sapiens
gaaaaaccaauga

SEQ ID NO: 1545347 - RNA, 15 nt, Homo sapiens
gaaaaaccaaugauu

SEQ ID NO: 1545348 - RNA, 14 nt, Homo sapiens
gaaaaaugccauca

SEQ ID NO: 1545349 - RNA, 15 nt, Homo sapiens
gaaaacaucucauca

SEQ ID NO: 1545350 - RNA, 15 nt, Homo sapiens
gaaaagacugaccuu

SEQ ID NO: 1545351 - RNA, 12 nt, Homo sapiens
gaaaagccagau

SEQ ID NO: 1545352 - RNA, 13 nt, Homo sapiens
gaaacacagucau

SEQ ID NO: 1545353 - RNA, 17 nt, Homo sapiens
gaaacagcuugaugcug

SEQ ID NO: 1545354 - RNA, 17 nt, Homo sapiens
gaaacauacguucuuuu

SEQ ID NO: 1545355 - RNA, 19 nt, Homo sapiens
gaaaccagccaacccaagu

SEQ ID NO: 1545356 - RNA, 21 nt, Homo sapiens
gaaagauugauuaaugaacua

SEQ ID NO: 1545357 - RNA, 14 nt, Homo sapiens
gaaagauugcuaua

SEQ ID NO: 1545358 - RNA, 22 nt, Homo sapiens
gaaagauuuuaugugcuugaag

SEQ ID NO: 1545359 - RNA, 16 nt, Homo sapiens
gaaagccagugacucc

SEQ ID NO: 1545360 - RNA, 14 nt, Homo sapiens
gaaagccucacuga

SEQ ID NO: 1545361 - RNA, 15 nt, Homo sapiens
gaaagccuuccucaa

SEQ ID NO: 1545362 - RNA, 12 nt, Homo sapiens
gaaagcuauaua

SEQ ID NO: 1545363 - RNA, 19 nt, Homo sapiens
gaaaggaggaaggagccua

SEQ ID NO: 1545364 - RNA, 18 nt, Homo sapiens
gaaaguaucaccaaaaaa

SEQ ID NO: 1545365 - RNA, 18 nt, Homo sapiens
gaaagucuccuguaucau

SEQ ID NO: 1545366 - RNA, 22 nt, Homo sapiens
gaaauaaaauauggacuuccaa

SEQ ID NO: 1545367 - RNA, 12 nt, Homo sapiens
gaaauacauaug

SEQ ID NO: 1545368 - RNA, 13 nt, Homo sapiens
gaaauacauauga

SEQ ID NO: 1545369 - RNA, 18 nt, Homo sapiens
gaaaucagccuugcacaa

SEQ ID NO: 1545370 - RNA, 20 nt, Homo sapiens
gaaauccaacuccaggguua

SEQ ID NO: 1545371 - RNA, 19 nt, Homo sapiens
gaaaucuauuucauaccau

SEQ ID NO: 1545372 - RNA, 15 nt, Homo sapiens
gaaauuagggcucua

SEQ ID NO: 1545373 - RNA, 18 nt, Homo sapiens
gaaauuauaucugugguc

SEQ ID NO: 1545374 - RNA, 19 nt, Homo sapiens
gaaauugcauuuccugaca

SEQ ID NO: 1545375 - RNA, 21 nt, Homo sapiens
gaaauuuuaucucuucuuccu

SEQ ID NO: 1545376 - RNA, 17 nt, Homo sapiens
gaacauuaaauagcaaa

SEQ ID NO: 1545377 - RNA, 22 nt, Homo sapiens
gaacauuaauccacauguuuca

SEQ ID NO: 1545378 - RNA, 23 nt, Homo sapiens
gaacccugggacguggcuaguca

SEQ ID NO: 1545379 - RNA, 18 nt, Homo sapiens
gaaccucguugacaugca

SEQ ID NO: 1545380 - RNA, 15 nt, Homo sapiens
gaacuccaguacuca

SEQ ID NO: 1545381 - RNA, 19 nt, Homo sapiens
gaacuccaguacucaccca

SEQ ID NO: 1545382 - RNA, 18 nt, Homo sapiens
gaacugguccaggccagg

SEQ ID NO: 1545383 - RNA, 20 nt, Homo sapiens
gaacuguaaauaugucacua

SEQ ID NO: 1545384 - RNA, 21 nt, Homo sapiens
gaacuugauguuccugggaug

SEQ ID NO: 1545385 - RNA, 22 nt, Homo sapiens
gaacuuuguccgguggaaggcc

SEQ ID NO: 1545386 - RNA, 14 nt, Homo sapiens
gaagaacugcaaaa

SEQ ID NO: 1545387 - RNA, 16 nt, Homo sapiens
gaagaacuugucccuc

SEQ ID NO: 1545388 - RNA, 23 nt, Homo sapiens
gaagaauuggcagaagcaguugc

SEQ ID NO: 1545389 - RNA, 17 nt, Homo sapiens
gaagcaaauaaauauca

SEQ ID NO: 1545390 - RNA, 16 nt, Homo sapiens
gaagccacugccagcu

SEQ ID NO: 1545391 - RNA, 21 nt, Homo sapiens
gaaggcagcuagacaccaaug

SEQ ID NO: 1545392 - RNA, 12 nt, Homo sapiens
gaaggcuuucag

SEQ ID NO: 1545393 - RNA, 16 nt, Homo sapiens
gaagggccccuugcaa

SEQ ID NO: 1545394 - RNA, 23 nt, Homo sapiens
gaagggccuucuccacagggaca

SEQ ID NO: 1545395 - RNA, 12 nt, Homo sapiens
gaaggugucaua

SEQ ID NO: 1545396 - RNA, 21 nt, Homo sapiens
gaagguuggaacugcugccau

SEQ ID NO: 1545397 - RNA, 15 nt, Homo sapiens
gaagguugugaugaa

SEQ ID NO: 1545398 - RNA, 16 nt, Homo sapiens
gaagucacugcacagu

SEQ ID NO: 1545399 - RNA, 15 nt, Homo sapiens
gaaguggcaccuaau

SEQ ID NO: 1545400 - RNA, 23 nt, Homo sapiens
gaagugguguuuagaaugucagu

SEQ ID NO: 1545401 - RNA, 13 nt, Homo sapiens
gaauaagaagcaa

SEQ ID NO: 1545402 - RNA, 22 nt, Homo sapiens
gaauacaguaagcugcucuauu

SEQ ID NO: 1545403 - RNA, 16 nt, Homo sapiens
gaaucaagucugugaa

SEQ ID NO: 1545404 - RNA, 13 nt, Homo sapiens
gaaugacauugaa

SEQ ID NO: 1545405 - RNA, 14 nt, Homo sapiens
gaaugcggcaagaa

SEQ ID NO: 1545406 - RNA, 10 nt, Homo sapiens
gaauggugcu

SEQ ID NO: 1545407 - RNA, 13 nt, Homo sapiens
gaauguucugcug

SEQ ID NO: 1545408 - RNA, 15 nt, Homo sapiens
gaauugccagucuuu

SEQ ID NO: 1545409 - RNA, 22 nt, Homo sapiens
gaauuuuuuuuuuuaagcucaa

SEQ ID NO: 1545410 - RNA, 13 nt, Homo sapiens
gacaaaauugcug

SEQ ID NO: 1545411 - RNA, 21 nt, Homo sapiens
gacaauuagauaaauguccau

SEQ ID NO: 1545412 - RNA, 17 nt, Homo sapiens
gacaauuucaaaaugca

SEQ ID NO: 1545413 - RNA, 20 nt, Homo sapiens
gacacccaguggaaccaaaa

SEQ ID NO: 1545414 - RNA, 19 nt, Homo sapiens
gacagacccaggguggucu

SEQ ID NO: 1545415 - RNA, 17 nt, Homo sapiens
gacagaucaauggcgca

SEQ ID NO: 1545416 - RNA, 20 nt, Homo sapiens
gacagaucaauggcgcagug

SEQ ID NO: 1545417 - RNA, 13 nt, Homo sapiens
gacagccaaaagu

SEQ ID NO: 1545418 - RNA, 13 nt, Homo sapiens
gacagccuggcac

SEQ ID NO: 1545419 - RNA, 12 nt, Homo sapiens
gacauaccucuc

SEQ ID NO: 1545420 - RNA, 15 nt, Homo sapiens
gacaugacuaggaag

SEQ ID NO: 1545421 - RNA, 22 nt, Homo sapiens
gaccacgggcgaggacgugaag

SEQ ID NO: 1545422 - RNA, 22 nt, Homo sapiens
gaccacuuuccccgugggccau

SEQ ID NO: 1545423 - RNA, 23 nt, Homo sapiens
gaccacuuuccccgugggccaug

SEQ ID NO: 1545424 - RNA, 19 nt, Homo sapiens
gaccccauccagccagggg

SEQ ID NO: 1545425 - RNA, 16 nt, Homo sapiens
gacccccgugccaaau

SEQ ID NO: 1545426 - RNA, 20 nt, Homo sapiens
gacccggaggggccuggcag

SEQ ID NO: 1545427 - RNA, 21 nt, Homo sapiens
gacccugggagagugagguca

SEQ ID NO: 1545428 - RNA, 21 nt, Homo sapiens
gaccuggauaauuauaucaga

SEQ ID NO: 1545429 - RNA, 14 nt, Homo sapiens
gacggaaguggccu

SEQ ID NO: 1545430 - RNA, 21 nt, Homo sapiens
gacgggaccgggccgcuagau

SEQ ID NO: 1545431 - RNA, 15 nt, Homo sapiens
gacgugugaggaugu

SEQ ID NO: 1545432 - RNA, 15 nt, Homo sapiens
gacuaggagcacugu

SEQ ID NO: 1545433 - RNA, 12 nt, Homo sapiens
gacucacugugg

SEQ ID NO: 1545434 - RNA, 21 nt, Homo sapiens
gacugguggaaggaaaacaaa

SEQ ID NO: 1545435 - RNA, 22 nt, Homo sapiens
gacuguuuccagagugcuuaua

SEQ ID NO: 1545436 - RNA, 21 nt, Homo sapiens
gacuucagacucucuccucuc

SEQ ID NO: 1545437 - RNA, 12 nt, Homo sapiens
gacuuugccaca

SEQ ID NO: 1545438 - RNA, 17 nt, Homo sapiens
gagaaauaaaauaugga

SEQ ID NO: 1545439 - RNA, 21 nt, Homo sapiens
gagaacacaagccacgccugc

SEQ ID NO: 1545440 - RNA, 14 nt, Homo sapiens
gagaagccucaguc

SEQ ID NO: 1545441 - RNA, 13 nt, Homo sapiens
gagaagguggucu

SEQ ID NO: 1545442 - RNA, 19 nt, Homo sapiens
gagacaagaaauccuagug

SEQ ID NO: 1545443 - RNA, 15 nt, Homo sapiens
gagacauacaccuau

SEQ ID NO: 1545444 - RNA, 21 nt, Homo sapiens
gagaccagcuucuagcagcua

SEQ ID NO: 1545445 - RNA, 14 nt, Homo sapiens
gagacuuaggccag

SEQ ID NO: 1545446 - RNA, 15 nt, Homo sapiens
gagagaguucucaca

SEQ ID NO: 1545447 - RNA, 15 nt, Homo sapiens
gagagaucuaauccc

SEQ ID NO: 1545448 - RNA, 15 nt, Homo sapiens
gagagcggcuucccc

SEQ ID NO: 1545449 - RNA, 23 nt, Homo sapiens
gagagcuaaauuacaauugucau

SEQ ID NO: 1545450 - RNA, 16 nt, Homo sapiens
gagaguggcuccuccc

SEQ ID NO: 1545451 - RNA, 21 nt, Homo sapiens
gagaguguggaaaaaaaaaga

SEQ ID NO: 1545452 - RNA, 12 nt, Homo sapiens
gagaugcugauu

SEQ ID NO: 1545453 - RNA, 11 nt, Homo sapiens
gagauggacca

SEQ ID NO: 1545454 - RNA, 22 nt, Homo sapiens
gagauggguugaguuugcugua

SEQ ID NO: 1545455 - RNA, 17 nt, Homo sapiens
gagauguauuaugcaaa

SEQ ID NO: 1545456 - RNA, 20 nt, Homo sapiens
gagcccccuguccuucccac

SEQ ID NO: 1545457 - RNA, 16 nt, Homo sapiens
gagcccggcagugcac

SEQ ID NO: 1545458 - RNA, 15 nt, Homo sapiens
gagccuggaagacac

SEQ ID NO: 1545459 - RNA, 20 nt, Homo sapiens
gagccuggaagacacccuaa

SEQ ID NO: 1545460 - RNA, 18 nt, Homo sapiens
gagcucuccugggccagg

SEQ ID NO: 1545461 - RNA, 13 nt, Homo sapiens
gagcuugacuuca

SEQ ID NO: 1545462 - RNA, 18 nt, Homo sapiens
gccgcuucgccaugugcu

SEQ ID NO: 1545463 - RNA, 16 nt, Homo sapiens
gccguucagcugugac

SEQ ID NO: 1545464 - RNA, 17 nt, Homo sapiens
gccuaaagaaacucagc

SEQ ID NO: 1545465 - RNA, 20 nt, Homo sapiens
gccuaggggucagggaccaa

SEQ ID NO: 1545466 - RNA, 17 nt, Homo sapiens
gccuaugccaccugcag

SEQ ID NO: 1545467 - RNA, 19 nt, Homo sapiens
gccucaggccuggcccuuu

SEQ ID NO: 1545468 - RNA, 18 nt, Homo sapiens
gccucauccuccacugaa

SEQ ID NO: 1545469 - RNA, 16 nt, Homo sapiens
gccuccagcccucuca

SEQ ID NO: 1545470 - RNA, 15 nt, Homo sapiens
gccucccagccaccc

SEQ ID NO: 1545471 - RNA, 22 nt, Homo sapiens
gccucuuccucccucccugcag

SEQ ID NO: 1545472 - RNA, 15 nt, Homo sapiens
gccugaugauggaag

SEQ ID NO: 1545473 - RNA, 21 nt, Homo sapiens
gccugcgcccugacaugcuaa

SEQ ID NO: 1545474 - RNA, 23 nt, Homo sapiens
gccugcucccuagccagaggcuc

SEQ ID NO: 1545475 - RNA, 17 nt, Homo sapiens
gccugcuuuuaggucau

SEQ ID NO: 1545476 - RNA, 19 nt, Homo sapiens
gccuggccccaaauguucu

SEQ ID NO: 1545477 - RNA, 22 nt, Homo sapiens
gccuuccacgcugucuccagac

SEQ ID NO: 1545478 - RNA, 15 nt, Homo sapiens
gccuucuaccugcag

SEQ ID NO: 1545479 - RNA, 16 nt, Homo sapiens
gccuucuccacaggga

SEQ ID NO: 1545480 - RNA, 20 nt, Homo sapiens
gccuucuccccuccaaguga

SEQ ID NO: 1545481 - RNA, 15 nt, Homo sapiens
gccuugccaugucuu

SEQ ID NO: 1545482 - RNA, 13 nt, Homo sapiens
gccuugugaucac

SEQ ID NO: 1545483 - RNA, 18 nt, Homo sapiens
gcgcccaagcucagcuua

SEQ ID NO: 1545484 - RNA, 22 nt, Homo sapiens
gcgcgagccaugauguggagug

SEQ ID NO: 1545485 - RNA, 15 nt, Homo sapiens
gcggccgccuguccu

SEQ ID NO: 1545486 - RNA, 13 nt, Homo sapiens
gcguagggccagg

SEQ ID NO: 1545487 - RNA, 14 nt, Homo sapiens
gcguguacuacccc

SEQ ID NO: 1545488 - RNA, 21 nt, Homo sapiens
gcuaaagaggaagugcacugg

SEQ ID NO: 1545489 - RNA, 18 nt, Homo sapiens
gcuacgguucccugccua

SEQ ID NO: 1545490 - RNA, 15 nt, Homo sapiens
gcuacucuaguauuc

SEQ ID NO: 1545491 - RNA, 21 nt, Homo sapiens
gcuauaauguauaaugggaaa

SEQ ID NO: 1545492 - RNA, 15 nt, Homo sapiens
gcuaugucugugaug

SEQ ID NO: 1545493 - RNA, 16 nt, Homo sapiens
gcuaugucugugaugu

SEQ ID NO: 1545494 - RNA, 19 nt, Homo sapiens
gcucaaaguacuacagcaa

SEQ ID NO: 1545495 - RNA, 20 nt, Homo sapiens
gcucaaaguacuacagcaaa

SEQ ID NO: 1545496 - RNA, 22 nt, Homo sapiens
gcucaaccuacaguggagggag

SEQ ID NO: 1545497 - RNA, 20 nt, Homo sapiens
gcucagcccaccccccucau

SEQ ID NO: 1545498 - RNA, 20 nt, Homo sapiens
gcucauuucacuauucuguu

SEQ ID NO: 1545499 - RNA, 14 nt, Homo sapiens
gcucccagggccau

SEQ ID NO: 1545500 - RNA, 20 nt, Homo sapiens
gcucccuagccagaggcucu

SEQ ID NO: 1545501 - RNA, 17 nt, Homo sapiens
gcucuaauguacaauaa

SEQ ID NO: 1545502 - RNA, 20 nt, Homo sapiens
gcucuuacccacacuacgca

SEQ ID NO: 1545503 - RNA, 18 nt, Homo sapiens
gcucuuggggccagccua

SEQ ID NO: 1545504 - RNA, 15 nt, Homo sapiens
gcugaaagacaguaa

SEQ ID NO: 1545505 - RNA, 20 nt, Homo sapiens
gcugauuuccccucuucccu

SEQ ID NO: 1545506 - RNA, 16 nt, Homo sapiens
gcugcucccuuuauca

SEQ ID NO: 1545507 - RNA, 19 nt, Homo sapiens
gcugcucccuuuaucaugu

SEQ ID NO: 1545508 - RNA, 14 nt, Homo sapiens
gcugcugcacugcc

SEQ ID NO: 1545509 - RNA, 20 nt, Homo sapiens
gcuggagugcaguggugcga

SEQ ID NO: 1545510 - RNA, 23 nt, Homo sapiens
gcuggcagcuucgugugcagcua

SEQ ID NO: 1545511 - RNA, 15 nt, Homo sapiens
gcuggcaggagacac

SEQ ID NO: 1545512 - RNA, 15 nt, Homo sapiens
gcuguauugauauca

SEQ ID NO: 1545513 - RNA, 17 nt, Homo sapiens
gcugugccagcugcuuc

SEQ ID NO: 1545514 - RNA, 15 nt, Homo sapiens
gcuuagaauggggcu

SEQ ID NO: 1545515 - RNA, 15 nt, Homo sapiens
gcuucaaaacagaac

SEQ ID NO: 1545516 - RNA, 13 nt, Homo sapiens
gcuucuagcagcu

SEQ ID NO: 1545517 - RNA, 23 nt, Homo sapiens
gcuucucuuuuuagauguagcac

SEQ ID NO: 1545518 - RNA, 11 nt, Homo sapiens
gcuugaugcug

SEQ ID NO: 1545519 - RNA, 14 nt, Homo sapiens
gcuuuacagugcca

SEQ ID NO: 1545520 - RNA, 15 nt, Homo sapiens
gcuuuacagugccac

SEQ ID NO: 1545521 - RNA, 16 nt, Homo sapiens
gcuuuccucccaaagg

SEQ ID NO: 1545522 - RNA, 17 nt, Homo sapiens
gcuuuccucccaaaggc

SEQ ID NO: 1545523 - RNA, 16 nt, Homo sapiens
gcuuucugucugugaa

SEQ ID NO: 1545524 - RNA, 17 nt, Homo sapiens
gcuuugccacugaagua

SEQ ID NO: 1545525 - RNA, 20 nt, Homo sapiens
gcuuuggcucgggacuucaa

SEQ ID NO: 1545526 - RNA, 19 nt, Homo sapiens
ggaaagccucacugauaua

SEQ ID NO: 1545527 - RNA, 16 nt, Homo sapiens
ggaaagccuuccucaa

SEQ ID NO: 1545528 - RNA, 18 nt, Homo sapiens
ggaagaacuugucccuca

SEQ ID NO: 1545529 - RNA, 16 nt, Homo sapiens
ggaagcacugccauua

SEQ ID NO: 1545530 - RNA, 17 nt, Homo sapiens
ggaagccuccugcugag

SEQ ID NO: 1545531 - RNA, 19 nt, Homo sapiens
ggaaguuauguuguucaaa

SEQ ID NO: 1545532 - RNA, 16 nt, Homo sapiens
ggaauaagaagcaaau

SEQ ID NO: 1545533 - RNA, 18 nt, Homo sapiens
ggaaugggccaagccagg

SEQ ID NO: 1545534 - RNA, 18 nt, Homo sapiens
ggacagguggaggcgagc

SEQ ID NO: 1545535 - RNA, 16 nt, Homo sapiens
ggaccaggagccaggu

SEQ ID NO: 1545536 - RNA, 17 nt, Homo sapiens
ggaccccaucugcugag

SEQ ID NO: 1545537 - RNA, 19 nt, Homo sapiens
ggacuauccucuuuggaaa

SEQ ID NO: 1545538 - RNA, 14 nt, Homo sapiens
ggacugguccaggc

SEQ ID NO: 1545539 - RNA, 18 nt, Homo sapiens
ggacuguggccucaggag

SEQ ID NO: 1545540 - RNA, 13 nt, Homo sapiens
ggacuuguaggga

SEQ ID NO: 1545541 - RNA, 23 nt, Homo sapiens
ggagaaccucguugacaugcaca

SEQ ID NO: 1545542 - RNA, 22 nt, Homo sapiens
ggagagccaaggccuaugccac

SEQ ID NO: 1545543 - RNA, 20 nt, Homo sapiens
ggagccagcucccagcccac

SEQ ID NO: 1545544 - RNA, 16 nt, Homo sapiens
ggagccauaagggaca

SEQ ID NO: 1545545 - RNA, 22 nt, Homo sapiens
ggagcccugggguuuccacaca

SEQ ID NO: 1545546 - RNA, 22 nt, Homo sapiens
ggagccuguguuagugucuguc

SEQ ID NO: 1545547 - RNA, 15 nt, Homo sapiens
ggagcuaacacuggc

SEQ ID NO: 1545548 - RNA, 14 nt, Homo sapiens
ggaguaggcuguau

SEQ ID NO: 1545549 - RNA, 17 nt, Homo sapiens
ggaguccuguucucaga

SEQ ID NO: 1545550 - RNA, 17 nt, Homo sapiens
ggaucucuuaagacagc

SEQ ID NO: 1545551 - RNA, 13 nt, Homo sapiens
ggaucugcagcuc

SEQ ID NO: 1545552 - RNA, 23 nt, Homo sapiens
ggauguggcuuaugagauacuuu

SEQ ID NO: 1545553 - RNA, 12 nt, Homo sapiens
ggauuaaucucu

SEQ ID NO: 1545554 - RNA, 20 nt, Homo sapiens
ggcaacucacgggugcauga

SEQ ID NO: 1545555 - RNA, 14 nt, Homo sapiens
ggcagacauugugc

SEQ ID NO: 1545556 - RNA, 13 nt, Homo sapiens
ggcagcacaggaa

SEQ ID NO: 1545557 - RNA, 20 nt, Homo sapiens
ggcagcuucgugugcagcua

SEQ ID NO: 1545558 - RNA, 14 nt, Homo sapiens
ggcauuguuuccac

SEQ ID NO: 1545559 - RNA, 16 nt, Homo sapiens
ggccaagagaugcagu

SEQ ID NO: 1545560 - RNA, 17 nt, Homo sapiens
ggccacuggcaucucug

SEQ ID NO: 1545561 - RNA, 18 nt, Homo sapiens
ggccagagcucccaggac

SEQ ID NO: 1545562 - RNA, 19 nt, Homo sapiens
ggccauuugugauacuucc

SEQ ID NO: 1545563 - RNA, 13 nt, Homo sapiens
ggcccccacagga

SEQ ID NO: 1545564 - RNA, 22 nt, Homo sapiens
ggcccuuucaccccucuuccca

SEQ ID NO: 1545565 - RNA, 13 nt, Homo sapiens
ggccuaguggcuu

SEQ ID NO: 1545566 - RNA, 13 nt, Homo sapiens
ggccucagguuug

SEQ ID NO: 1545567 - RNA, 15 nt, Homo sapiens
ggccuggcccagcca

SEQ ID NO: 1545568 - RNA, 23 nt, Homo sapiens
ggcuacgugaauagcgcccucaa

SEQ ID NO: 1545569 - RNA, 19 nt, Homo sapiens
ggcucacaucauguaauag

SEQ ID NO: 1545570 - RNA, 21 nt, Homo sapiens
ggcucagccucaaaugcagua

SEQ ID NO: 1545571 - RNA, 20 nt, Homo sapiens
ggcucccagggccaugaacu

SEQ ID NO: 1545572 - RNA, 13 nt, Homo sapiens
ggcuccucaccac

SEQ ID NO: 1545573 - RNA, 20 nt, Homo sapiens
ggcuccucaccaccgagaca

SEQ ID NO: 1545574 - RNA, 15 nt, Homo sapiens
ggcucgggacuucaa

SEQ ID NO: 1545575 - RNA, 24 nt, Homo sapiens
ggcucugcgucccacugagucuca

SEQ ID NO: 1545576 - RNA, 22 nt, Homo sapiens
ggcugccgugcacggggccagc

SEQ ID NO: 1545577 - RNA, 13 nt, Homo sapiens
ggcuuccggcuga

SEQ ID NO: 1545578 - RNA, 16 nt, Homo sapiens
ggcuuccggcugagcu

SEQ ID NO: 1545579 - RNA, 15 nt, Homo sapiens
ggcuuguucagucac

SEQ ID NO: 1545580 - RNA, 23 nt, Homo sapiens
gggaaauggcuugaagccaaguc

SEQ ID NO: 1545581 - RNA, 17 nt, Homo sapiens
gggaaauucacacugug

SEQ ID NO: 1545582 - RNA, 23 nt, Homo sapiens
gggaaggucccgaauggagucca

SEQ ID NO: 1545583 - RNA, 22 nt, Homo sapiens
gggagaaccucguugacaugca

SEQ ID NO: 1545584 - RNA, 21 nt, Homo sapiens
gggagaagaaggcaacccaaa

SEQ ID NO: 1545585 - RNA, 13 nt, Homo sapiens
gggagacugagcu

SEQ ID NO: 1545586 - RNA, 11 nt, Homo sapiens
gggagugccac

SEQ ID NO: 1545587 - RNA, 12 nt, Homo sapiens
gggagugccacu

SEQ ID NO: 1545588 - RNA, 13 nt, Homo sapiens
gggaucauuauuu

SEQ ID NO: 1545589 - RNA, 14 nt, Homo sapiens
gggcacagccagaa

SEQ ID NO: 1545590 - RNA, 23 nt, Homo sapiens
gggccaagccaggguuccagaca

SEQ ID NO: 1545591 - RNA, 13 nt, Homo sapiens
gggccacuggcau

SEQ ID NO: 1545592 - RNA, 23 nt, Homo sapiens
guuucccgcuccaagagaauuca

SEQ ID NO: 1545593 - RNA, 16 nt, Homo sapiens
guuugcuaauguuucc

SEQ ID NO: 1545594 - RNA, 20 nt, Homo sapiens
guuuuauugaaaauguggua

SEQ ID NO: 1545595 - RNA, 14 nt, Homo sapiens
guuuucugcuguaa

SEQ ID NO: 1545596 - RNA, 19 nt, Homo sapiens
guuuugcauggaguauuau

SEQ ID NO: 1545597 - RNA, 14 nt, Homo sapiens
guuuugugugguau

SEQ ID NO: 1545598 - RNA, 22 nt, Homo sapiens
guuuuucagguauauaccucca

SEQ ID NO: 1545599 - RNA, 22 nt, Homo sapiens
guuuuugaagaagggaaauuca

SEQ ID NO: 1545600 - RNA, 12 nt, Homo sapiens
uaaaaaagcauu

SEQ ID NO: 1545601 - RNA, 18 nt, Homo sapiens
uaaaaaagcauuauccuu

SEQ ID NO: 1545602 - RNA, 17 nt, Homo sapiens
uaaaaaauaacugugca

SEQ ID NO: 1545603 - RNA, 18 nt, Homo sapiens
uaaaaaguuaaucuucau

SEQ ID NO: 1545604 - RNA, 11 nt, Homo sapiens
uaaaaccaaag

SEQ ID NO: 1545605 - RNA, 12 nt, Homo sapiens
uaaaaccaaagg

SEQ ID NO: 1545606 - RNA, 17 nt, Homo sapiens
uaaaacuucugauuucu

SEQ ID NO: 1545607 - RNA, 14 nt, Homo sapiens
uaaaagauucauuu

SEQ ID NO: 1545608 - RNA, 12 nt, Homo sapiens
uaaaagugucca

SEQ ID NO: 1545609 - RNA, 17 nt, Homo sapiens
uaaaaguguccauugaa

SEQ ID NO: 1545610 - RNA, 18 nt, Homo sapiens
uaaaauaaaccagacuca

SEQ ID NO: 1545611 - RNA, 15 nt, Homo sapiens
uaaaauaacuaagca

SEQ ID NO: 1545612 - RNA, 17 nt, Homo sapiens
uaaaauaacuaagcaag

SEQ ID NO: 1545613 - RNA, 18 nt, Homo sapiens
uaaaauaacuaagcaagu

SEQ ID NO: 1545614 - RNA, 13 nt, Homo sapiens
uaaaauauggacu

SEQ ID NO: 1545615 - RNA, 18 nt, Homo sapiens
uaaaauauggacuuccaa

SEQ ID NO: 1545616 - RNA, 14 nt, Homo sapiens
uaaaauucuuggga

SEQ ID NO: 1545617 - RNA, 12 nt, Homo sapiens
uaaaauugucag

SEQ ID NO: 1545618 - RNA, 12 nt, Homo sapiens
uaaaauuuugca

SEQ ID NO: 1545619 - RNA, 13 nt, Homo sapiens
uaaacaaauuccu

SEQ ID NO: 1545620 - RNA, 23 nt, Homo sapiens
uaaacaguugcacagcaucucag

SEQ ID NO: 1545621 - RNA, 15 nt, Homo sapiens
uaaaccauugugcau

SEQ ID NO: 1545622 - RNA, 17 nt, Homo sapiens
uaaacgucacagcagua

SEQ ID NO: 1545623 - RNA, 16 nt, Homo sapiens
uaaacgugaugugcuc

SEQ ID NO: 1545624 - RNA, 17 nt, Homo sapiens
uaaacgugaugugcuca

SEQ ID NO: 1545625 - RNA, 13 nt, Homo sapiens
uaaacuacugauu

SEQ ID NO: 1545626 - RNA, 23 nt, Homo sapiens
uaaacuguuuucauguguugcaa

SEQ ID NO: 1545627 - RNA, 20 nt, Homo sapiens
uaaagaaauaauacccugcc

SEQ ID NO: 1545628 - RNA, 16 nt, Homo sapiens
uaaagacuugaugaau

SEQ ID NO: 1545629 - RNA, 20 nt, Homo sapiens
uaaaggggcugucucccaau

SEQ ID NO: 1545630 - RNA, 19 nt, Homo sapiens
uaaagguuucacuguucau

SEQ ID NO: 1545631 - RNA, 20 nt, Homo sapiens
uaaagugagaaaacugugac

SEQ ID NO: 1545632 - RNA, 21 nt, Homo sapiens
uaaauaaagaagaaaauaacc

SEQ ID NO: 1545633 - RNA, 20 nt, Homo sapiens
uaaauauauauauauuucuc

SEQ ID NO: 1545634 - RNA, 11 nt, Homo sapiens
uaaaugaacuu

SEQ ID NO: 1545635 - RNA, 16 nt, Homo sapiens
uaaaugcuguauguca

SEQ ID NO: 1545636 - RNA, 14 nt, Homo sapiens
uaaauguccauucu

SEQ ID NO: 1545637 - RNA, 19 nt, Homo sapiens
uaaaugugauuuacgcuca

SEQ ID NO: 1545638 - RNA, 17 nt, Homo sapiens
uaaaugugguacaagca

SEQ ID NO: 1545639 - RNA, 17 nt, Homo sapiens
uaaauucaaaccuaagu

SEQ ID NO: 1545640 - RNA, 16 nt, Homo sapiens
uaaauugucucaaaga

SEQ ID NO: 1545641 - RNA, 17 nt, Homo sapiens
uaaauuuaauauacugc

SEQ ID NO: 1545642 - RNA, 20 nt, Homo sapiens
uaaauuuaauauacugcaua

SEQ ID NO: 1545643 - RNA, 23 nt, Homo sapiens
uaaauuugggggacuuacaugau

SEQ ID NO: 1545644 - RNA, 20 nt, Homo sapiens
uaacacacacacacauacac

SEQ ID NO: 1545645 - RNA, 17 nt, Homo sapiens
uaacaugggcaaaggga

SEQ ID NO: 1545646 - RNA, 17 nt, Homo sapiens
uaacaugucuaaaguua

SEQ ID NO: 1545647 - RNA, 23 nt, Homo sapiens
uaaccuuucaggaaaguaucucu

SEQ ID NO: 1545648 - RNA, 13 nt, Homo sapiens
uaacggcacugug

SEQ ID NO: 1545649 - RNA, 20 nt, Homo sapiens
uaagaagcaaauaaauauca

SEQ ID NO: 1545650 - RNA, 12 nt, Homo sapiens
uaagaauguaua

SEQ ID NO: 1545651 - RNA, 20 nt, Homo sapiens
uaagaccuuggcauccuucc

SEQ ID NO: 1545652 - RNA, 23 nt, Homo sapiens
uaagccucucccuccagccaaua

SEQ ID NO: 1545653 - RNA, 17 nt, Homo sapiens
uaagcucuuuaugacug

SEQ ID NO: 1545654 - RNA, 23 nt, Homo sapiens
uaaguucaccguaguaacacaua

SEQ ID NO: 1545655 - RNA, 13 nt, Homo sapiens
uaaguugucuuac

SEQ ID NO: 1545656 - RNA, 13 nt, Homo sapiens
uaauaaagugcac

SEQ ID NO: 1545657 - RNA, 23 nt, Homo sapiens
uaaucccuucaaggaagugauaa

SEQ ID NO: 1545658 - RNA, 15 nt, Homo sapiens
uaaucuucauggcca

SEQ ID NO: 1545659 - RNA, 18 nt, Homo sapiens
uaaugacguauugugaaa

SEQ ID NO: 1545660 - RNA, 16 nt, Homo sapiens
uaauggaaacugucaa

SEQ ID NO: 1545661 - RNA, 20 nt, Homo sapiens
uaauguacaauaaagcaaug

SEQ ID NO: 1545662 - RNA, 23 nt, Homo sapiens
uaauguacaauaaagcaaugugg

SEQ ID NO: 1545663 - RNA, 20 nt, Homo sapiens
uaauguuuuguaauuuugca

SEQ ID NO: 1545664 - RNA, 17 nt, Homo sapiens
uaauuauguuuaccuca

SEQ ID NO: 1545665 - RNA, 16 nt, Homo sapiens
uaauuggcaugaaggu

SEQ ID NO: 1545666 - RNA, 22 nt, Homo sapiens
uacaaacaggugcuaacacugu

SEQ ID NO: 1545667 - RNA, 21 nt, Homo sapiens
uacaacugaguccuuaaacag

SEQ ID NO: 1545668 - RNA, 19 nt, Homo sapiens
uacaagcauucugucuuga

SEQ ID NO: 1545669 - RNA, 20 nt, Homo sapiens
uacaaggccccaagguuuac

SEQ ID NO: 1545670 - RNA, 18 nt, Homo sapiens
uacaauaaagcaaugugg

SEQ ID NO: 1545671 - RNA, 12 nt, Homo sapiens
uacaauguauca

SEQ ID NO: 1545672 - RNA, 18 nt, Homo sapiens
uacaauguaucaacauau

SEQ ID NO: 1545673 - RNA, 18 nt, Homo sapiens
uacacauguaucuaugca

SEQ ID NO: 1545674 - RNA, 20 nt, Homo sapiens
uacacauguaucuaugcauu

SEQ ID NO: 1545675 - RNA, 18 nt, Homo sapiens
uacaccuaugucauuuca

SEQ ID NO: 1545676 - RNA, 21 nt, Homo sapiens
uacacguuggaguauaccuau

SEQ ID NO: 1545677 - RNA, 17 nt, Homo sapiens
uacacugugaacuuggg

SEQ ID NO: 1545678 - RNA, 22 nt, Homo sapiens
uacagcgcauuuucuaccugaa

SEQ ID NO: 1545679 - RNA, 22 nt, Homo sapiens
uacagcuaaucagcauucucac

SEQ ID NO: 1545680 - RNA, 11 nt, Homo sapiens
uacagugccac

SEQ ID NO: 1545681 - RNA, 13 nt, Homo sapiens
uacagugccacga

SEQ ID NO: 1545682 - RNA, 16 nt, Homo sapiens
uacagugccacgacau

SEQ ID NO: 1545683 - RNA, 22 nt, Homo sapiens
uacauaauuaaauuuuaaugua

SEQ ID NO: 1545684 - RNA, 13 nt, Homo sapiens
uacaucuaaguca

SEQ ID NO: 1545685 - RNA, 20 nt, Homo sapiens
uacaugaugauuucagaaac

SEQ ID NO: 1545686 - RNA, 14 nt, Homo sapiens
uacaugcauuacug

SEQ ID NO: 1545687 - RNA, 23 nt, Homo sapiens
uacaugcauuacugcaugcacuu

SEQ ID NO: 1545688 - RNA, 21 nt, Homo sapiens
uacaugccuuuccagugcugc

SEQ ID NO: 1545689 - RNA, 11 nt, Homo sapiens
uacaugugauu

SEQ ID NO: 1545690 - RNA, 21 nt, Homo sapiens
uacauguggaaaacucacaga

SEQ ID NO: 1545691 - RNA, 24 nt, Homo sapiens
uacauuaaaauaacuaagcaagua

SEQ ID NO: 1545692 - RNA, 22 nt, Homo sapiens
uaccauaagcuuuuucucugaa

SEQ ID NO: 1545693 - RNA, 17 nt, Homo sapiens
uaccauauacagcucag

SEQ ID NO: 1545694 - RNA, 21 nt, Homo sapiens
uacgcucauuguagaaaagcu

SEQ ID NO: 1545695 - RNA, 14 nt, Homo sapiens
uacguucuuuucaa

SEQ ID NO: 1545696 - RNA, 20 nt, Homo sapiens
uacuaccccaggacgcaugc

SEQ ID NO: 1545697 - RNA, 21 nt, Homo sapiens
uacuaccccaggacgcaugca

SEQ ID NO: 1545698 - RNA, 21 nt, Homo sapiens
uacuaccccaggaugcaugca

SEQ ID NO: 1545699 - RNA, 22 nt, Homo sapiens
uacugaugugugcaaccuuuua

SEQ ID NO: 1545700 - RNA, 15 nt, Homo sapiens
uacuguauuguuaca

SEQ ID NO: 1545701 - RNA, 16 nt, Homo sapiens
uacuuacaugcauuac

SEQ ID NO: 1545702 - RNA, 21 nt, Homo sapiens
uacuucuguguugugauuccc

SEQ ID NO: 1545703 - RNA, 15 nt, Homo sapiens
uacuugaaaaccuca

SEQ ID NO: 1545704 - RNA, 19 nt, Homo sapiens
uacuugagaauaaaugagc

SEQ ID NO: 1545705 - RNA, 18 nt, Homo sapiens
uacuugugaaacacagcu

SEQ ID NO: 1545706 - RNA, 21 nt, Homo sapiens
uacuuuauguuacuacaugca

SEQ ID NO: 1545707 - RNA, 23 nt, Homo sapiens
uacuuuccaacauuauccugugu

SEQ ID NO: 1545708 - RNA, 23 nt, Homo sapiens
uagaaagaaauuguuuuucugaa

SEQ ID NO: 1545709 - RNA, 18 nt, Homo sapiens
uagaaauuuuaucucuuc

SEQ ID NO: 1545710 - RNA, 23 nt, Homo sapiens
uagaagccaccauguauguggaa

SEQ ID NO: 1545711 - RNA, 13 nt, Homo sapiens
uagaauacuguau

SEQ ID NO: 1545712 - RNA, 14 nt, Homo sapiens
uagaauacuguauu

SEQ ID NO: 1545713 - RNA, 18 nt, Homo sapiens
uagaauauccuauacugg

SEQ ID NO: 1545714 - RNA, 19 nt, Homo sapiens
uagaaucaagucugugaaa

SEQ ID NO: 1545715 - RNA, 23 nt, Homo sapiens
uagaauggggcuuccaugguggu

SEQ ID NO: 1545716 - RNA, 14 nt, Homo sapiens
uagacauaccucuc

SEQ ID NO: 1545717 - RNA, 22 nt, Homo sapiens
uagacucacggcugcaccugca

SEQ ID NO: 1545718 - RNA, 14 nt, Homo sapiens
uagagacucaaaga

SEQ ID NO: 1545719 - RNA, 15 nt, Homo sapiens
uagagagaaacagcu

SEQ ID NO: 1545720 - RNA, 16 nt, Homo sapiens
uagagagaaacagcuu

SEQ ID NO: 1545721 - RNA, 16 nt, Homo sapiens
aagccugaaacagccu

SEQ ID NO: 1545722 - RNA, 12 nt, Homo sapiens
aagccugaugau

SEQ ID NO: 1545723 - RNA, 20 nt, Homo sapiens
aagccuuggggauucuucca

SEQ ID NO: 1545724 - RNA, 15 nt, Homo sapiens
aagcucagcuuagaa

SEQ ID NO: 1545725 - RNA, 21 nt, Homo sapiens
aagcuccaucuuauuugucag

SEQ ID NO: 1545726 - RNA, 15 nt, Homo sapiens
aaggaaggagccagc

SEQ ID NO: 1545727 - RNA, 18 nt, Homo sapiens
aaggagugcccgccuuga

SEQ ID NO: 1545728 - RNA, 22 nt, Homo sapiens
aaggaucuucccacuuugccac

SEQ ID NO: 1545729 - RNA, 18 nt, Homo sapiens
aaggauggaaagggaaug

SEQ ID NO: 1545730 - RNA, 19 nt, Homo sapiens
aaggauuuuaaaugcugua

SEQ ID NO: 1545731 - RNA, 22 nt, Homo sapiens
aaggcaacccaaaugguggcca

SEQ ID NO: 1545732 - RNA, 19 nt, Homo sapiens
aaggcaucauuuucaccuc

SEQ ID NO: 1545733 - RNA, 22 nt, Homo sapiens
aaggcccagccuguaacugucc

SEQ ID NO: 1545734 - RNA, 18 nt, Homo sapiens
aaggccucauccuccacu

SEQ ID NO: 1545735 - RNA, 12 nt, Homo sapiens
aaggcugcagga

SEQ ID NO: 1545736 - RNA, 14 nt, Homo sapiens
aaggcuuucagggc

SEQ ID NO: 1545737 - RNA, 17 nt, Homo sapiens
aagggaagagcauguaa

SEQ ID NO: 1545738 - RNA, 20 nt, Homo sapiens
aagggaagccgccuuugcaa

SEQ ID NO: 1545739 - RNA, 19 nt, Homo sapiens
aagggacuaggagcacugu

SEQ ID NO: 1545740 - RNA, 15 nt, Homo sapiens
aagggacugguccag

SEQ ID NO: 1545741 - RNA, 22 nt, Homo sapiens
aagggcgcugagggcaggguuc

SEQ ID NO: 1545742 - RNA, 14 nt, Homo sapiens
aaggggccuggaag

SEQ ID NO: 1545743 - RNA, 12 nt, Homo sapiens
aagggucuuccu

SEQ ID NO: 1545744 - RNA, 16 nt, Homo sapiens
aagggugcccaccucu

SEQ ID NO: 1545745 - RNA, 18 nt, Homo sapiens
aagggugugggucaggga

SEQ ID NO: 1545746 - RNA, 20 nt, Homo sapiens
aagguggcccuucacugucc

SEQ ID NO: 1545747 - RNA, 16 nt, Homo sapiens
aaggugucauacagau

SEQ ID NO: 1545748 - RNA, 15 nt, Homo sapiens
aagguuaagccauau

SEQ ID NO: 1545749 - RNA, 14 nt, Homo sapiens
aagguugauucuca

SEQ ID NO: 1545750 - RNA, 16 nt, Homo sapiens
aaguaccaacugagcc

SEQ ID NO: 1545751 - RNA, 13 nt, Homo sapiens
aaguauuuccaac

SEQ ID NO: 1545752 - RNA, 15 nt, Homo sapiens
aagucaucauaaaag

SEQ ID NO: 1545753 - RNA, 21 nt, Homo sapiens
aagucccagggagcucugcau

SEQ ID NO: 1545754 - RNA, 16 nt, Homo sapiens
aagucccgaggcagca

SEQ ID NO: 1545755 - RNA, 19 nt, Homo sapiens
aagucucauggcaguccca

SEQ ID NO: 1545756 - RNA, 15 nt, Homo sapiens
aagugagcaguguua

SEQ ID NO: 1545757 - RNA, 17 nt, Homo sapiens
aaguggcaccuaauaaa

SEQ ID NO: 1545758 - RNA, 17 nt, Homo sapiens
aagugggagugggagag

SEQ ID NO: 1545759 - RNA, 18 nt, Homo sapiens
aagugguaggaaagccuc

SEQ ID NO: 1545760 - RNA, 14 nt, Homo sapiens
aaguguguuugcaa

SEQ ID NO: 1545761 - RNA, 14 nt, Homo sapiens
aauaaaauuuugca

SEQ ID NO: 1545762 - RNA, 15 nt, Homo sapiens
aauaaagcaaugugg

SEQ ID NO: 1545763 - RNA, 14 nt, Homo sapiens
aauaaauaaucuca

SEQ ID NO: 1545764 - RNA, 19 nt, Homo sapiens
aauaaccguaaagguuuau

SEQ ID NO: 1545765 - RNA, 15 nt, Homo sapiens
aauaaucaagugcau

SEQ ID NO: 1545766 - RNA, 12 nt, Homo sapiens
aauaaugaucuu

SEQ ID NO: 1545767 - RNA, 19 nt, Homo sapiens
aauacauaaaaaagggaca

SEQ ID NO: 1545768 - RNA, 13 nt, Homo sapiens
aauacccacugcc

SEQ ID NO: 1545769 - RNA, 15 nt, Homo sapiens
aauagcgccucuuuu

SEQ ID NO: 1545770 - RNA, 16 nt, Homo sapiens
aauauauauaauacuu

SEQ ID NO: 1545771 - RNA, 15 nt, Homo sapiens
aauaucacucauuaa

SEQ ID NO: 1545772 - RNA, 16 nt, Homo sapiens
aauaucaggaugccuu

SEQ ID NO: 1545773 - RNA, 15 nt, Homo sapiens
aauaucgaguuccgg

SEQ ID NO: 1545774 - RNA, 14 nt, Homo sapiens
aauaugccagugac

SEQ ID NO: 1545775 - RNA, 14 nt, Homo sapiens
aauauuauacuucu

SEQ ID NO: 1545776 - RNA, 17 nt, Homo sapiens
aauauuauuugcuaauu

SEQ ID NO: 1545777 - RNA, 10 nt, Homo sapiens
aauauugcca

SEQ ID NO: 1545778 - RNA, 19 nt, Homo sapiens
aauauuucuucaaauaucu

SEQ ID NO: 1545779 - RNA, 21 nt, Homo sapiens
aaucaacuugucacaaaguga

SEQ ID NO: 1545780 - RNA, 23 nt, Homo sapiens
aaucaagucugugaaagucuccu

SEQ ID NO: 1545781 - RNA, 12 nt, Homo sapiens
aaucaauguuca

SEQ ID NO: 1545782 - RNA, 21 nt, Homo sapiens
aauccaugugcugcuguggca

SEQ ID NO: 1545783 - RNA, 20 nt, Homo sapiens
aaucccagcaugcugagauu

SEQ ID NO: 1545784 - RNA, 17 nt, Homo sapiens
aaucuauuucauaccau

SEQ ID NO: 1545785 - RNA, 14 nt, Homo sapiens
aaucucagcacuuu

SEQ ID NO: 1545786 - RNA, 14 nt, Homo sapiens
aaugaauacaauua

SEQ ID NO: 1545787 - RNA, 15 nt, Homo sapiens
aaugaaugacauuga

SEQ ID NO: 1545788 - RNA, 15 nt, Homo sapiens
aaugagagagugugg

SEQ ID NO: 1545789 - RNA, 18 nt, Homo sapiens
aaugagagaguguggaaa

SEQ ID NO: 1545790 - RNA, 14 nt, Homo sapiens
aaugaucuuccaaa

SEQ ID NO: 1545791 - RNA, 21 nt, Homo sapiens
aaugcaaaauacaugaugauu

SEQ ID NO: 1545792 - RNA, 17 nt, Homo sapiens
aaugcuagcacaauauu

SEQ ID NO: 1545793 - RNA, 20 nt, Homo sapiens
aaugcuguaccuuucugaca

SEQ ID NO: 1545794 - RNA, 19 nt, Homo sapiens
aaugcuguaugucauuaaa

SEQ ID NO: 1545795 - RNA, 23 nt, Homo sapiens
aaugcuuuucuaaucugcagugg

SEQ ID NO: 1545796 - RNA, 17 nt, Homo sapiens
aauggcuuguucaguca

SEQ ID NO: 1545797 - RNA, 16 nt, Homo sapiens
aauguacaauaaagca

SEQ ID NO: 1545798 - RNA, 18 nt, Homo sapiens
aauguacaauaaagcaau

SEQ ID NO: 1545799 - RNA, 15 nt, Homo sapiens
aauguauaaugggaa

SEQ ID NO: 1545800 - RNA, 17 nt, Homo sapiens
aauguaucaacauauuu

SEQ ID NO: 1545801 - RNA, 18 nt, Homo sapiens
aauguccauucuuuauca

SEQ ID NO: 1545802 - RNA, 16 nt, Homo sapiens
aaugugaaauguaacu

SEQ ID NO: 1545803 - RNA, 13 nt, Homo sapiens
aauguuauaucau

SEQ ID NO: 1545804 - RNA, 21 nt, Homo sapiens
aauguuccaugucugaaguuu

SEQ ID NO: 1545805 - RNA, 19 nt, Homo sapiens
aauuaaaaaauaguugcaa

SEQ ID NO: 1545806 - RNA, 21 nt, Homo sapiens
aauuaaaaaguuaaucuucau

SEQ ID NO: 1545807 - RNA, 19 nt, Homo sapiens
aauuaaacaaauuccuucc

SEQ ID NO: 1545808 - RNA, 14 nt, Homo sapiens
aauuaaccuuucag

SEQ ID NO: 1545809 - RNA, 19 nt, Homo sapiens
aauuagacauaccucucaa

SEQ ID NO: 1545810 - RNA, 16 nt, Homo sapiens
aauuagauccauuaau

SEQ ID NO: 1545811 - RNA, 15 nt, Homo sapiens
aauuauagauuagau

SEQ ID NO: 1545812 - RNA, 18 nt, Homo sapiens
aauuauuuaacuaauuaa

SEQ ID NO: 1545813 - RNA, 21 nt, Homo sapiens
aauuccaccaggauuaaucuc

SEQ ID NO: 1545814 - RNA, 15 nt, Homo sapiens
aauucuaugagauag

SEQ ID NO: 1545815 - RNA, 23 nt, Homo sapiens
aauucugucccugucccugcccc

SEQ ID NO: 1545816 - RNA, 16 nt, Homo sapiens
aauugaugauccauua

SEQ ID NO: 1545817 - RNA, 13 nt, Homo sapiens
aauugcugaggag

SEQ ID NO: 1545818 - RNA, 16 nt, Homo sapiens
aauugucuuuugucau

SEQ ID NO: 1545819 - RNA, 20 nt, Homo sapiens
aauugucuuuugucaugugg

SEQ ID NO: 1545820 - RNA, 17 nt, Homo sapiens
aauuuaauauacugcau

SEQ ID NO: 1545821 - RNA, 21 nt, Homo sapiens
aauuuccuuaaagcaagcuca

SEQ ID NO: 1545822 - RNA, 17 nt, Homo sapiens
aauuuuaucucuucuuc

SEQ ID NO: 1545823 - RNA, 23 nt, Homo sapiens
aauuuucucucacugaugcccuu

SEQ ID NO: 1545824 - RNA, 21 nt, Homo sapiens
aauuuuuacacaaaccugaaa

SEQ ID NO: 1545825 - RNA, 15 nt, Homo sapiens
acaaaaacuaaaaac

SEQ ID NO: 1545826 - RNA, 19 nt, Homo sapiens
acaaagcauuugacuuucu

SEQ ID NO: 1545827 - RNA, 18 nt, Homo sapiens
acaaauaaguuacccuca

SEQ ID NO: 1545828 - RNA, 21 nt, Homo sapiens
acaaauccaacgcuuuuccca

SEQ ID NO: 1545829 - RNA, 20 nt, Homo sapiens
acaaauggcuuguucaguca

SEQ ID NO: 1545830 - RNA, 15 nt, Homo sapiens
acaaauguaacacac

SEQ ID NO: 1545831 - RNA, 15 nt, Homo sapiens
acaaauucauucccu

SEQ ID NO: 1545832 - RNA, 17 nt, Homo sapiens
acaaauuguacauuuga

SEQ ID NO: 1545833 - RNA, 13 nt, Homo sapiens
acaacucauccag

SEQ ID NO: 1545834 - RNA, 21 nt, Homo sapiens
acaagaugaaauuccauuugu

SEQ ID NO: 1545835 - RNA, 19 nt, Homo sapiens
acaagcccaggacacugcc

SEQ ID NO: 1545836 - RNA, 21 nt, Homo sapiens
acaauaaaagaaacugugguc

SEQ ID NO: 1545837 - RNA, 17 nt, Homo sapiens
acaauaaaaguguccau

SEQ ID NO: 1545838 - RNA, 13 nt, Homo sapiens
acaauaaagcaau

SEQ ID NO: 1545839 - RNA, 16 nt, Homo sapiens
acaauaauucuaugag

SEQ ID NO: 1545840 - RNA, 20 nt, Homo sapiens
acaauaucauuuuccuggga

SEQ ID NO: 1545841 - RNA, 21 nt, Homo sapiens
acaauuagauaaauguccauu

SEQ ID NO: 1545842 - RNA, 13 nt, Homo sapiens
acaauucuguccc

SEQ ID NO: 1545843 - RNA, 20 nt, Homo sapiens
acaauuucaaaaugcaugug

SEQ ID NO: 1545844 - RNA, 22 nt, Homo sapiens
acacaaaacguuaagugaugaa

SEQ ID NO: 1545845 - RNA, 12 nt, Homo sapiens
acacaaucaaaa

SEQ ID NO: 1545846 - RNA, 22 nt, Homo sapiens
acacagaggacggcuuccccau

SEQ ID NO: 1545847 - RNA, 14 nt, Homo sapiens
acacagucaugugu

SEQ ID NO: 1545848 - RNA, 16 nt, Homo sapiens
acacauaaaucugucu

SEQ ID NO: 1545849 - RNA, 18 nt, Homo sapiens
acacauaguguuuguaac

SEQ ID NO: 1545850 - RNA, 20 nt, Homo sapiens
acacauguaucuaugcauuu

SEQ ID NO: 1545851 - RNA, 18 nt, Homo sapiens
acaccaugaagaugccau

SEQ ID NO: 1545852 - RNA, 18 nt, Homo sapiens
agccagaggcucuaaugu

SEQ ID NO: 1545853 - RNA, 10 nt, Homo sapiens
agccagugac

SEQ ID NO: 1545854 - RNA, 16 nt, Homo sapiens
agcccaggacacugcc

SEQ ID NO: 1545855 - RNA, 14 nt, Homo sapiens
agccccacuccaca

SEQ ID NO: 1545856 - RNA, 22 nt, Homo sapiens
agccccagggcccugcucaggc

SEQ ID NO: 1545857 - RNA, 19 nt, Homo sapiens
agcccccaccuucccucca

SEQ ID NO: 1545858 - RNA, 16 nt, Homo sapiens
agccccgccgugucug

SEQ ID NO: 1545859 - RNA, 20 nt, Homo sapiens
agcccucugcugcuuuccaa

SEQ ID NO: 1545860 - RNA, 12 nt, Homo sapiens
agcccugcauuu

SEQ ID NO: 1545861 - RNA, 14 nt, Homo sapiens
agccgcaaauccau

SEQ ID NO: 1545862 - RNA, 21 nt, Homo sapiens
agccuaggggucagggaccaa

SEQ ID NO: 1545863 - RNA, 13 nt, Homo sapiens
agccucagccacc

SEQ ID NO: 1545864 - RNA, 15 nt, Homo sapiens
agccugaugauggaa

SEQ ID NO: 1545865 - RNA, 18 nt, Homo sapiens
agccugcagacucacugu

SEQ ID NO: 1545866 - RNA, 14 nt, Homo sapiens
agccugcucccuag

SEQ ID NO: 1545867 - RNA, 18 nt, Homo sapiens
agccugcucccuagccag

SEQ ID NO: 1545868 - RNA, 16 nt, Homo sapiens
agccugggccacuggc

SEQ ID NO: 1545869 - RNA, 14 nt, Homo sapiens
agccugugggagaa

SEQ ID NO: 1545870 - RNA, 13 nt, Homo sapiens
agccuuuccagaa

SEQ ID NO: 1545871 - RNA, 14 nt, Homo sapiens
agcggguaaaaaga

SEQ ID NO: 1545872 - RNA, 20 nt, Homo sapiens
agcuaaaaccuuccauguca

SEQ ID NO: 1545873 - RNA, 19 nt, Homo sapiens
agcuagaaucacuugacuu

SEQ ID NO: 1545874 - RNA, 18 nt, Homo sapiens
agcuagagcuuuaccuga

SEQ ID NO: 1545875 - RNA, 18 nt, Homo sapiens
agcuauaacaacucuauu

SEQ ID NO: 1545876 - RNA, 17 nt, Homo sapiens
agcuaugcuguaucugu

SEQ ID NO: 1545877 - RNA, 15 nt, Homo sapiens
agcucagcccacccc

SEQ ID NO: 1545878 - RNA, 18 nt, Homo sapiens
agcuccacagaagacacg

SEQ ID NO: 1545879 - RNA, 17 nt, Homo sapiens
agcugaacaaugaaugc

SEQ ID NO: 1545880 - RNA, 13 nt, Homo sapiens
agcugcucauuuc

SEQ ID NO: 1545881 - RNA, 22 nt, Homo sapiens
agcugcuucugcccaccccgcc

SEQ ID NO: 1545882 - RNA, 14 nt, Homo sapiens
agcuggcgucuguc

SEQ ID NO: 1545883 - RNA, 20 nt, Homo sapiens
agcuguaauauauaguaaaa

SEQ ID NO: 1545884 - RNA, 21 nt, Homo sapiens
agcuucacuuaaaaucaaauu

SEQ ID NO: 1545885 - RNA, 18 nt, Homo sapiens
agcuuguuucuauacugu

SEQ ID NO: 1545886 - RNA, 20 nt, Homo sapiens
aggaaaaguuauugugauaa

SEQ ID NO: 1545887 - RNA, 22 nt, Homo sapiens
aggaaacuguuguguccaaucc

SEQ ID NO: 1545888 - RNA, 17 nt, Homo sapiens
aggaaauaagacuuuua

SEQ ID NO: 1545889 - RNA, 14 nt, Homo sapiens
aggaacagaguaua

SEQ ID NO: 1545890 - RNA, 21 nt, Homo sapiens
aggaacccuuaaacaguugca

SEQ ID NO: 1545891 - RNA, 17 nt, Homo sapiens
aggaagcagccuccacu

SEQ ID NO: 1545892 - RNA, 19 nt, Homo sapiens
aggaaggucucaugccuga

SEQ ID NO: 1545893 - RNA, 15 nt, Homo sapiens
aggaagugauaacac

SEQ ID NO: 1545894 - RNA, 21 nt, Homo sapiens
aggaagugauaacacuggagu

SEQ ID NO: 1545895 - RNA, 17 nt, Homo sapiens
aggaauauacauagucu

SEQ ID NO: 1545896 - RNA, 13 nt, Homo sapiens
aggaauccaguga

SEQ ID NO: 1545897 - RNA, 15 nt, Homo sapiens
aggaauccagugaau

SEQ ID NO: 1545898 - RNA, 22 nt, Homo sapiens
aggacaguacacacuuggguaa

SEQ ID NO: 1545899 - RNA, 13 nt, Homo sapiens
aggacauucacca

SEQ ID NO: 1545900 - RNA, 22 nt, Homo sapiens
aggaccaggagccagguguccu

SEQ ID NO: 1545901 - RNA, 14 nt, Homo sapiens
aggacgcaugcagg

SEQ ID NO: 1545902 - RNA, 15 nt, Homo sapiens
aggacgcaugcaggg

SEQ ID NO: 1545903 - RNA, 23 nt, Homo sapiens
aggacuaaauaaugaucuuccaa

SEQ ID NO: 1545904 - RNA, 12 nt, Homo sapiens
aggacuccuuaa

SEQ ID NO: 1545905 - RNA, 13 nt, Homo sapiens
aggagaguguuua

SEQ ID NO: 1545906 - RNA, 18 nt, Homo sapiens
aggagcguguacuacccc

SEQ ID NO: 1545907 - RNA, 20 nt, Homo sapiens
aggagcguguacuaccccag

SEQ ID NO: 1545908 - RNA, 16 nt, Homo sapiens
aggaggaacuggucca

SEQ ID NO: 1545909 - RNA, 23 nt, Homo sapiens
aggaggaaggagccuauggcauc

SEQ ID NO: 1545910 - RNA, 20 nt, Homo sapiens
aggaggaagggacuggucca

SEQ ID NO: 1545911 - RNA, 13 nt, Homo sapiens
aggaggacaggga

SEQ ID NO: 1545912 - RNA, 16 nt, Homo sapiens
aggagucugauugcag

SEQ ID NO: 1545913 - RNA, 13 nt, Homo sapiens
aggaugcaugcag

SEQ ID NO: 1545914 - RNA, 21 nt, Homo sapiens
aggauggcguguccccugccu

SEQ ID NO: 1545915 - RNA, 23 nt, Homo sapiens
aggauggucccagcggaugcugc

SEQ ID NO: 1545916 - RNA, 17 nt, Homo sapiens
aggcaaaggcuuguaaa

SEQ ID NO: 1545917 - RNA, 14 nt, Homo sapiens
aggcaagcuggcag

SEQ ID NO: 1545918 - RNA, 16 nt, Homo sapiens
aggcaagcuggcagga

SEQ ID NO: 1545919 - RNA, 15 nt, Homo sapiens
aggcaauggccuaaa

SEQ ID NO: 1545920 - RNA, 13 nt, Homo sapiens
aggcaauggugaa

SEQ ID NO: 1545921 - RNA, 21 nt, Homo sapiens
aggcacgcuggcuugugaucu

SEQ ID NO: 1545922 - RNA, 13 nt, Homo sapiens
aggcagagcucag

SEQ ID NO: 1545923 - RNA, 20 nt, Homo sapiens
aggcagggagggaaacccgg

SEQ ID NO: 1545924 - RNA, 13 nt, Homo sapiens
aggcaucauuuuc

SEQ ID NO: 1545925 - RNA, 22 nt, Homo sapiens
aggcauuaaauuuuagcaaaga

SEQ ID NO: 1545926 - RNA, 18 nt, Homo sapiens
aggccagcuccuuagaca

SEQ ID NO: 1545927 - RNA, 15 nt, Homo sapiens
aggcucccacugccc

SEQ ID NO: 1545928 - RNA, 22 nt, Homo sapiens
aggcuuccggcugagcugugcc

SEQ ID NO: 1545929 - RNA, 19 nt, Homo sapiens
agggaagccgccuuugcaa

SEQ ID NO: 1545930 - RNA, 15 nt, Homo sapiens
agggacaagcauguu

SEQ ID NO: 1545931 - RNA, 14 nt, Homo sapiens
agggacagccaaaa

SEQ ID NO: 1545932 - RNA, 16 nt, Homo sapiens
agggacuuugcugauu

SEQ ID NO: 1545933 - RNA, 17 nt, Homo sapiens
agggagacccugggaga

SEQ ID NO: 1545934 - RNA, 19 nt, Homo sapiens
agggagaucuuggggugca

SEQ ID NO: 1545935 - RNA, 21 nt, Homo sapiens
agggaggaaucgaggaaccag

SEQ ID NO: 1545936 - RNA, 12 nt, Homo sapiens
agggagggagca

SEQ ID NO: 1545937 - RNA, 15 nt, Homo sapiens
agggcccccacagga

SEQ ID NO: 1545938 - RNA, 14 nt, Homo sapiens
agggcccugcucag

SEQ ID NO: 1545939 - RNA, 20 nt, Homo sapiens
agggccuucuccacagggac

SEQ ID NO: 1545940 - RNA, 21 nt, Homo sapiens
aggggacugcaugcaagcuca

SEQ ID NO: 1545941 - RNA, 19 nt, Homo sapiens
aggggagagaagguggucu

SEQ ID NO: 1545942 - RNA, 22 nt, Homo sapiens
aggggaucuaaaaggaggacag

SEQ ID NO: 1545943 - RNA, 13 nt, Homo sapiens
aggggcagugaag

SEQ ID NO: 1545944 - RNA, 22 nt, Homo sapiens
aggggugagccccgccgugucu

SEQ ID NO: 1545945 - RNA, 19 nt, Homo sapiens
aggguaggggaagugugcu

SEQ ID NO: 1545946 - RNA, 21 nt, Homo sapiens
agggucccccuucguggagcu

SEQ ID NO: 1545947 - RNA, 16 nt, Homo sapiens
agggugcagggaccaa

SEQ ID NO: 1545948 - RNA, 18 nt, Homo sapiens
agggugugggucagggag

SEQ ID NO: 1545949 - RNA, 22 nt, Homo sapiens
aggguuacccugggcacuggcc

SEQ ID NO: 1545950 - RNA, 18 nt, Homo sapiens
agguaacauagaugccug

SEQ ID NO: 1545951 - RNA, 20 nt, Homo sapiens
aggucccagacaugcugccc

SEQ ID NO: 1545952 - RNA, 17 nt, Homo sapiens
aggucuccaccccucaa

SEQ ID NO: 1545953 - RNA, 22 nt, Homo sapiens
aggucugcucggccgucuucac

SEQ ID NO: 1545954 - RNA, 21 nt, Homo sapiens
aggucuuauucuugugcacuu

SEQ ID NO: 1545955 - RNA, 16 nt, Homo sapiens
agguggaguaggugaa

SEQ ID NO: 1545956 - RNA, 22 nt, Homo sapiens
aggugggucaacuccaaggcaa

SEQ ID NO: 1545957 - RNA, 21 nt, Homo sapiens
agguugucugaagucacugca

SEQ ID NO: 1545958 - RNA, 20 nt, Homo sapiens
agguugugcugccuguggug

SEQ ID NO: 1545959 - RNA, 19 nt, Homo sapiens
aguaaaauuauacugugug

SEQ ID NO: 1545960 - RNA, 12 nt, Homo sapiens
aguaaacaauaa

SEQ ID NO: 1545961 - RNA, 12 nt, Homo sapiens
aguaaagccacg

SEQ ID NO: 1545962 - RNA, 17 nt, Homo sapiens
aguaacucaucugucac

SEQ ID NO: 1545963 - RNA, 21 nt, Homo sapiens
aguaauaucuuucaguuauua

SEQ ID NO: 1545964 - RNA, 21 nt, Homo sapiens
aguacauaaggaguugccgca

SEQ ID NO: 1545965 - RNA, 15 nt, Homo sapiens
aguaccaacugagcc

SEQ ID NO: 1545966 - RNA, 19 nt, Homo sapiens
aguacuuacccuaaaacau

SEQ ID NO: 1545967 - RNA, 16 nt, Homo sapiens
aguagcuuuccuccca

SEQ ID NO: 1545968 - RNA, 13 nt, Homo sapiens
aguaggugggucu

SEQ ID NO: 1545969 - RNA, 23 nt, Homo sapiens
aguaguacuucuucuguaauauu

SEQ ID NO: 1545970 - RNA, 16 nt, Homo sapiens
aguagugccugugauc

SEQ ID NO: 1545971 - RNA, 20 nt, Homo sapiens
aguauauagccuuaagucuu

SEQ ID NO: 1545972 - RNA, 23 nt, Homo sapiens
aguauggauugaaggauugugaa

SEQ ID NO: 1545973 - RNA, 17 nt, Homo sapiens
aguauguuaagcucuuu

SEQ ID NO: 1545974 - RNA, 15 nt, Homo sapiens
aguauuacacaucag

SEQ ID NO: 1545975 - RNA, 16 nt, Homo sapiens
aguauuacacaucaga

SEQ ID NO: 1545976 - RNA, 14 nt, Homo sapiens
agucacugcacagu

SEQ ID NO: 1545977 - RNA, 14 nt, Homo sapiens
agucaggagccagc

SEQ ID NO: 1545978 - RNA, 14 nt, Homo sapiens
agucauaccaucca

SEQ ID NO: 1545979 - RNA, 13 nt, Homo sapiens
agucccucagcca

SEQ ID NO: 1545980 - RNA, 17 nt, Homo sapiens
aguccuauucuauugca

SEQ ID NO: 1545981 - RNA, 23 nt, Homo sapiens
agucuauugucuccuugguuaua

SEQ ID NO: 1545982 - RNA, 14 nt, Homo sapiens
aucuguuugauaca

SEQ ID NO: 1545983 - RNA, 19 nt, Homo sapiens
aucuguuugauacaguauu

SEQ ID NO: 1545984 - RNA, 17 nt, Homo sapiens
aucuuaggauuuaccaa

SEQ ID NO: 1545985 - RNA, 21 nt, Homo sapiens
aucuuaggauuuaccaaauag

SEQ ID NO: 1545986 - RNA, 13 nt, Homo sapiens
aucuuauguugau

SEQ ID NO: 1545987 - RNA, 23 nt, Homo sapiens
aucuuccccaacgaaaagcacau

SEQ ID NO: 1545988 - RNA, 13 nt, Homo sapiens
aucuugggaccaa

SEQ ID NO: 1545989 - RNA, 15 nt, Homo sapiens
aucuuggggugcagc

SEQ ID NO: 1545990 - RNA, 22 nt, Homo sapiens
aucuuguggucugcugccucag

SEQ ID NO: 1545991 - RNA, 15 nt, Homo sapiens
augaaaaacagcaga

SEQ ID NO: 1545992 - RNA, 20 nt, Homo sapiens
augaaaaccacccuaucauc

SEQ ID NO: 1545993 - RNA, 20 nt, Homo sapiens
augaaauugagucauuuuau

SEQ ID NO: 1545994 - RNA, 19 nt, Homo sapiens
augaacacuggcugcaagu

SEQ ID NO: 1545995 - RNA, 20 nt, Homo sapiens
augaacccauccaauggauu

SEQ ID NO: 1545996 - RNA, 14 nt, Homo sapiens
augaaggcuguaca

SEQ ID NO: 1545997 - RNA, 18 nt, Homo sapiens
augaauaaguuuuauuga

SEQ ID NO: 1545998 - RNA, 23 nt, Homo sapiens
augacuucuuuacuaacacuggc

SEQ ID NO: 1545999 - RNA, 20 nt, Homo sapiens
augacuuuaucauuuuguua

SEQ ID NO: 1546000 - RNA, 12 nt, Homo sapiens
augagccagcuc

SEQ ID NO: 1546001 - RNA, 14 nt, Homo sapiens
augaggggccucag

SEQ ID NO: 1546002 - RNA, 15 nt, Homo sapiens
augauguguagggcu

SEQ ID NO: 1546003 - RNA, 13 nt, Homo sapiens
augauuagcuuug

SEQ ID NO: 1546004 - RNA, 19 nt, Homo sapiens
augauucuccucucccaaa

SEQ ID NO: 1546005 - RNA, 15 nt, Homo sapiens
augcacuauauacau

SEQ ID NO: 1546006 - RNA, 19 nt, Homo sapiens
augcacuucuuacaauaau

SEQ ID NO: 1546007 - RNA, 15 nt, Homo sapiens
augcauauacuuuaa

SEQ ID NO: 1546008 - RNA, 15 nt, Homo sapiens
augccggugaucccu

SEQ ID NO: 1546009 - RNA, 23 nt, Homo sapiens
augcuaucucgcuagccauauau

SEQ ID NO: 1546010 - RNA, 19 nt, Homo sapiens
augcuaugauuaaauuuac

SEQ ID NO: 1546011 - RNA, 21 nt, Homo sapiens
augcucaaugaaaaggugauu

SEQ ID NO: 1546012 - RNA, 13 nt, Homo sapiens
augcugacuguac

SEQ ID NO: 1546013 - RNA, 15 nt, Homo sapiens
augcugccaaccagc

SEQ ID NO: 1546014 - RNA, 19 nt, Homo sapiens
augcuggucauccugggca

SEQ ID NO: 1546015 - RNA, 18 nt, Homo sapiens
augcuguaugucauuaaa

SEQ ID NO: 1546016 - RNA, 16 nt, Homo sapiens
augcuuauaagcaaca

SEQ ID NO: 1546017 - RNA, 20 nt, Homo sapiens
auggaaauccuguuacuuaa

SEQ ID NO: 1546018 - RNA, 16 nt, Homo sapiens
auggaagggccuucuc

SEQ ID NO: 1546019 - RNA, 21 nt, Homo sapiens
auggacauauucuuuuuggaa

SEQ ID NO: 1546020 - RNA, 19 nt, Homo sapiens
auggcagacauugugcuag

SEQ ID NO: 1546021 - RNA, 15 nt, Homo sapiens
auggcagucccaaag

SEQ ID NO: 1546022 - RNA, 18 nt, Homo sapiens
auggcuaccguuuuacaa

SEQ ID NO: 1546023 - RNA, 18 nt, Homo sapiens
auggcuuccccauugccu

SEQ ID NO: 1546024 - RNA, 15 nt, Homo sapiens
augggccaagccagg

SEQ ID NO: 1546025 - RNA, 15 nt, Homo sapiens
augguagacugugac

SEQ ID NO: 1546026 - RNA, 21 nt, Homo sapiens
augguuuccaagggucuuccu

SEQ ID NO: 1546027 - RNA, 16 nt, Homo sapiens
auguaucuaugcauuu

SEQ ID NO: 1546028 - RNA, 14 nt, Homo sapiens
augucagucacuaa

SEQ ID NO: 1546029 - RNA, 14 nt, Homo sapiens
augucuacugcuug

SEQ ID NO: 1546030 - RNA, 17 nt, Homo sapiens
augugaauugaagucau

SEQ ID NO: 1546031 - RNA, 22 nt, Homo sapiens
augugaguugcacagcuaugaa

SEQ ID NO: 1546032 - RNA, 15 nt, Homo sapiens
auguggaaaacucac

SEQ ID NO: 1546033 - RNA, 14 nt, Homo sapiens
auguuaccuucaca

SEQ ID NO: 1546034 - RNA, 17 nt, Homo sapiens
auguuaccuucacaugu

SEQ ID NO: 1546035 - RNA, 12 nt, Homo sapiens
auguuacuuugg

SEQ ID NO: 1546036 - RNA, 22 nt, Homo sapiens
auguucucaauacccacugcca

SEQ ID NO: 1546037 - RNA, 16 nt, Homo sapiens
auguuuuaauuccaag

SEQ ID NO: 1546038 - RNA, 14 nt, Homo sapiens
auuaaaagacuguu

SEQ ID NO: 1546039 - RNA, 17 nt, Homo sapiens
auuaaagugcacugugu

SEQ ID NO: 1546040 - RNA, 15 nt, Homo sapiens
auuaaaucuuccuca

SEQ ID NO: 1546041 - RNA, 14 nt, Homo sapiens
auuaacccuauuaa

SEQ ID NO: 1546042 - RNA, 21 nt, Homo sapiens
auuaagaaacccccucaugga

SEQ ID NO: 1546043 - RNA, 14 nt, Homo sapiens
auuacaauugucau

SEQ ID NO: 1546044 - RNA, 13 nt, Homo sapiens
auuacagguguga

SEQ ID NO: 1546045 - RNA, 20 nt, Homo sapiens
auuacauagacugugaugua

SEQ ID NO: 1546046 - RNA, 14 nt, Homo sapiens
auuaccauuuguua

SEQ ID NO: 1546047 - RNA, 16 nt, Homo sapiens
auuaccuguuaguauu

SEQ ID NO: 1546048 - RNA, 14 nt, Homo sapiens
auuacuaaauugac

SEQ ID NO: 1546049 - RNA, 15 nt, Homo sapiens
auuacuggaucucuu

SEQ ID NO: 1546050 - RNA, 23 nt, Homo sapiens
auuagcuaaaaccuuccauguca

SEQ ID NO: 1546051 - RNA, 13 nt, Homo sapiens
auuagcugugauu

SEQ ID NO: 1546052 - RNA, 24 nt, Homo sapiens
auuagcuuugucacuguuucacua

SEQ ID NO: 1546053 - RNA, 18 nt, Homo sapiens
auuaugagucucuaugau

SEQ ID NO: 1546054 - RNA, 16 nt, Homo sapiens
auuaugauuagcuuug

SEQ ID NO: 1546055 - RNA, 19 nt, Homo sapiens
auuaugugaauuuugccau

SEQ ID NO: 1546056 - RNA, 16 nt, Homo sapiens
auuauuuacaagaaga

SEQ ID NO: 1546057 - RNA, 21 nt, Homo sapiens
auuauuuuugcucugcucugu

SEQ ID NO: 1546058 - RNA, 13 nt, Homo sapiens
auucaagauuccc

SEQ ID NO: 1546059 - RNA, 22 nt, Homo sapiens
auucauaaaaauaaccaaaaaa

SEQ ID NO: 1546060 - RNA, 17 nt, Homo sapiens
auuccagaccugaagaa

SEQ ID NO: 1546061 - RNA, 20 nt, Homo sapiens
auucccaugguagacuguga

SEQ ID NO: 1546062 - RNA, 16 nt, Homo sapiens
auuccuaugcugcaau

SEQ ID NO: 1546063 - RNA, 14 nt, Homo sapiens
auucuaaaacauuc

SEQ ID NO: 1546064 - RNA, 14 nt, Homo sapiens
auucuaaaggggac

SEQ ID NO: 1546065 - RNA, 23 nt, Homo sapiens
auucuaaauuaugugaauuuugc

SEQ ID NO: 1546066 - RNA, 15 nt, Homo sapiens
auucuagauuaccau

SEQ ID NO: 1546067 - RNA, 16 nt, Homo sapiens
auucuagucucugauu

SEQ ID NO: 1546068 - RNA, 14 nt, Homo sapiens
auucucacuccuac

SEQ ID NO: 1546069 - RNA, 14 nt, Homo sapiens
auucugaguauuca

SEQ ID NO: 1546070 - RNA, 21 nt, Homo sapiens
auucugaguauucauuuugca

SEQ ID NO: 1546071 - RNA, 18 nt, Homo sapiens
auucuguggauucuauau

SEQ ID NO: 1546072 - RNA, 22 nt, Homo sapiens
auugaagcuaaaauaaaccaga

SEQ ID NO: 1546073 - RNA, 14 nt, Homo sapiens
auugaaugugauuu

SEQ ID NO: 1546074 - RNA, 18 nt, Homo sapiens
auugauuuuuaaacagca

SEQ ID NO: 1546075 - RNA, 20 nt, Homo sapiens
auugauuuuuaaacagcagg

SEQ ID NO: 1546076 - RNA, 14 nt, Homo sapiens
auuggcaugaaggu

SEQ ID NO: 1546077 - RNA, 18 nt, Homo sapiens
auuguagaaaagcuauaa

SEQ ID NO: 1546078 - RNA, 16 nt, Homo sapiens
auuguccccaaugaau

SEQ ID NO: 1546079 - RNA, 13 nt, Homo sapiens
auuuaaacuucuu

SEQ ID NO: 1546080 - RNA, 14 nt, Homo sapiens
auuuaaacuucuua

SEQ ID NO: 1546081 - RNA, 15 nt, Homo sapiens
auuuaacuagcacuu

SEQ ID NO: 1546082 - RNA, 12 nt, Homo sapiens
auuuaacugcau

SEQ ID NO: 1546083 - RNA, 17 nt, Homo sapiens
auuuaacugcauauaga

SEQ ID NO: 1546084 - RNA, 19 nt, Homo sapiens
auuuacaugugauugugau

SEQ ID NO: 1546085 - RNA, 13 nt, Homo sapiens
auuuaugaccuca

SEQ ID NO: 1546086 - RNA, 18 nt, Homo sapiens
auuuauuuacaugugauu

SEQ ID NO: 1546087 - RNA, 15 nt, Homo sapiens
auuuauuucuagcaa

SEQ ID NO: 1546088 - RNA, 16 nt, Homo sapiens
auuucaguucaaucaa

SEQ ID NO: 1546089 - RNA, 15 nt, Homo sapiens
auuucauaccaugga

SEQ ID NO: 1546090 - RNA, 21 nt, Homo sapiens
auuuccacuucuucauucucu

SEQ ID NO: 1546091 - RNA, 11 nt, Homo sapiens
auuuccaugga

SEQ ID NO: 1546092 - RNA, 21 nt, Homo sapiens
auuuccugacagaaggacuca

SEQ ID NO: 1546093 - RNA, 16 nt, Homo sapiens
auuucuaaaacauuaa

SEQ ID NO: 1546094 - RNA, 20 nt, Homo sapiens
auuucucccagcucuagaca

SEQ ID NO: 1546095 - RNA, 20 nt, Homo sapiens
auuucuuugauugugaaaca

SEQ ID NO: 1546096 - RNA, 16 nt, Homo sapiens
auuugcaaaugcacau

SEQ ID NO: 1546097 - RNA, 17 nt, Homo sapiens
auuugggcugaauguau

SEQ ID NO: 1546098 - RNA, 17 nt, Homo sapiens
auuugugauacuuccuc

SEQ ID NO: 1546099 - RNA, 16 nt, Homo sapiens
auuuguuaauaucacu

SEQ ID NO: 1546100 - RNA, 17 nt, Homo sapiens
auuuuaacaucugagaa

SEQ ID NO: 1546101 - RNA, 21 nt, Homo sapiens
auuuuagcaaagauaucucau

SEQ ID NO: 1546102 - RNA, 17 nt, Homo sapiens
auuuuauaccagcuuau

SEQ ID NO: 1546103 - RNA, 14 nt, Homo sapiens
auuuuauauaugaa

SEQ ID NO: 1546104 - RNA, 19 nt, Homo sapiens
auuuuauugcuggaaucua

SEQ ID NO: 1546105 - RNA, 16 nt, Homo sapiens
auuuucugcaucucca

SEQ ID NO: 1546106 - RNA, 18 nt, Homo sapiens
auuuuguauaaaugggaa

SEQ ID NO: 1546107 - RNA, 14 nt, Homo sapiens
auuuuuaccuuuca

SEQ ID NO: 1546108 - RNA, 23 nt, Homo sapiens
auuuuuggaagaggacuccuuaa

SEQ ID NO: 1546109 - RNA, 22 nt, Homo sapiens
caaaaauugaagagagauauau

SEQ ID NO: 1546110 - RNA, 23 nt, Homo sapiens
caaaagguggcccuucacugucc

SEQ ID NO: 1546111 - RNA, 20 nt, Homo sapiens
caaaaucagugaugggagua

SEQ ID NO: 1546112 - RNA, 16 nt, Homo sapiens
caaaauugaugaucca

SEQ ID NO: 1546113 - RNA, 13 nt, Homo sapiens
agggaaaaaccag

SEQ ID NO: 1546114 - RNA, 19 nt, Homo sapiens
agggaaguaguccuuggca

SEQ ID NO: 1546115 - RNA, 12 nt, Homo sapiens
agggacaagcca

SEQ ID NO: 1546116 - RNA, 19 nt, Homo sapiens
agggagaaguugagcaggu

SEQ ID NO: 1546117 - RNA, 15 nt, Homo sapiens
agggcaucauccuca

SEQ ID NO: 1546118 - RNA, 14 nt, Homo sapiens
agggcaugauuaac

SEQ ID NO: 1546119 - RNA, 20 nt, Homo sapiens
agggcauucuuucccaguga

SEQ ID NO: 1546120 - RNA, 12 nt, Homo sapiens
agggccgugccc

SEQ ID NO: 1546121 - RNA, 14 nt, Homo sapiens
agggcuacagucuc

SEQ ID NO: 1546122 - RNA, 13 nt, Homo sapiens
aggggcacagggu

SEQ ID NO: 1546123 - RNA, 15 nt, Homo sapiens
agguagggacuggag

SEQ ID NO: 1546124 - RNA, 23 nt, Homo sapiens
aguaaaaauaaauaaaacagcag

SEQ ID NO: 1546125 - RNA, 16 nt, Homo sapiens
aguaaguagaugccug

SEQ ID NO: 1546126 - RNA, 17 nt, Homo sapiens
aguaaguagaugccugu

SEQ ID NO: 1546127 - RNA, 17 nt, Homo sapiens
aguagccucugggaucu

SEQ ID NO: 1546128 - RNA, 9 nt, Homo sapiens
aguaguccu

SEQ ID NO: 1546129 - RNA, 17 nt, Homo sapiens
aguaguccuuggcauag

SEQ ID NO: 1546130 - RNA, 20 nt, Homo sapiens
aguaguccuuggcauagaca

SEQ ID NO: 1546131 - RNA, 14 nt, Homo sapiens
aguaugaaguauaa

SEQ ID NO: 1546132 - RNA, 19 nt, Homo sapiens
aguauuuuuauccaugaca

SEQ ID NO: 1546133 - RNA, 19 nt, Homo sapiens
agucccaaugguccugacu

SEQ ID NO: 1546134 - RNA, 22 nt, Homo sapiens
aguccuuucuuuugaaaugcca

SEQ ID NO: 1546135 - RNA, 18 nt, Homo sapiens
agucugaaccaauagaaa

SEQ ID NO: 1546136 - RNA, 13 nt, Homo sapiens
agucuuuccuuag

SEQ ID NO: 1546137 - RNA, 19 nt, Homo sapiens
agugagaaggcaaccaaag

SEQ ID NO: 1546138 - RNA, 16 nt, Homo sapiens
agugccacucauuccu

SEQ ID NO: 1546139 - RNA, 15 nt, Homo sapiens
agugcuguccaugcu

SEQ ID NO: 1546140 - RNA, 15 nt, Homo sapiens
agugcuucagaguuu

SEQ ID NO: 1546141 - RNA, 17 nt, Homo sapiens
agugcuuguuccucuca

SEQ ID NO: 1546142 - RNA, 15 nt, Homo sapiens
agugggggaucacag

SEQ ID NO: 1546143 - RNA, 20 nt, Homo sapiens
agugguuguuuugucaugaa

SEQ ID NO: 1546144 - RNA, 12 nt, Homo sapiens
aguguacaugaa

SEQ ID NO: 1546145 - RNA, 17 nt, Homo sapiens
aguguucaguguugaca

SEQ ID NO: 1546146 - RNA, 20 nt, Homo sapiens
aguguucaguguugacauag

SEQ ID NO: 1546147 - RNA, 17 nt, Homo sapiens
aguguugacauagccuu

SEQ ID NO: 1546148 - RNA, 14 nt, Homo sapiens
aguuaagugucauu

SEQ ID NO: 1546149 - RNA, 20 nt, Homo sapiens
aguucacagccuagaagaag

SEQ ID NO: 1546150 - RNA, 21 nt, Homo sapiens
aguuccucauuagcauuuugc

SEQ ID NO: 1546151 - RNA, 17 nt, Homo sapiens
aguucucugccaaagcu

SEQ ID NO: 1546152 - RNA, 22 nt, Homo sapiens
aguucucugccaaagcuugugg

SEQ ID NO: 1546153 - RNA, 16 nt, Homo sapiens
aguugcuuuuauugca

SEQ ID NO: 1546154 - RNA, 22 nt, Homo sapiens
aguuucuuuuuuaauagaauau

SEQ ID NO: 1546155 - RNA, 19 nt, Homo sapiens
aguuugagaccaaccuggg

SEQ ID NO: 1546156 - RNA, 14 nt, Homo sapiens
aguuuuugcugaag

SEQ ID NO: 1546157 - RNA, 13 nt, Homo sapiens
auaaaacuaugug

SEQ ID NO: 1546158 - RNA, 14 nt, Homo sapiens
auaaaaguacugaa

SEQ ID NO: 1546159 - RNA, 23 nt, Homo sapiens
auaaaauauuuuugaaaggcaug

SEQ ID NO: 1546160 - RNA, 18 nt, Homo sapiens
auaaauaaaacagcagca

SEQ ID NO: 1546161 - RNA, 13 nt, Homo sapiens
auaagaucacuga

SEQ ID NO: 1546162 - RNA, 17 nt, Homo sapiens
auaaguguucaguguug

SEQ ID NO: 1546163 - RNA, 15 nt, Homo sapiens
auaauaggaauucaa

SEQ ID NO: 1546164 - RNA, 19 nt, Homo sapiens
auaauuugucuuaguugau

SEQ ID NO: 1546165 - RNA, 13 nt, Homo sapiens
auacaacauguag

SEQ ID NO: 1546166 - RNA, 16 nt, Homo sapiens
auacaguaucucaggg

SEQ ID NO: 1546167 - RNA, 14 nt, Homo sapiens
auacaucuguggac

SEQ ID NO: 1546168 - RNA, 18 nt, Homo sapiens
auagaggugaugcugcua

SEQ ID NO: 1546169 - RNA, 23 nt, Homo sapiens
auagggcaugauuaacaaagcaa

SEQ ID NO: 1546170 - RNA, 21 nt, Homo sapiens
auaguagaaagacaucugccu

SEQ ID NO: 1546171 - RNA, 12 nt, Homo sapiens
auaguguccaaa

SEQ ID NO: 1546172 - RNA, 15 nt, Homo sapiens
auauaaaguguaaua

SEQ ID NO: 1546173 - RNA, 14 nt, Homo sapiens
auaugaaguguuag

SEQ ID NO: 1546174 - RNA, 12 nt, Homo sapiens
auauuaucauaa

SEQ ID NO: 1546175 - RNA, 14 nt, Homo sapiens
auauuaucauaaca

SEQ ID NO: 1546176 - RNA, 12 nt, Homo sapiens
aucacaguggga

SEQ ID NO: 1546177 - RNA, 11 nt, Homo sapiens
aucaccagaca

SEQ ID NO: 1546178 - RNA, 16 nt, Homo sapiens
aucagcacagcucucc

SEQ ID NO: 1546179 - RNA, 17 nt, Homo sapiens
aucagccugcuccagcu

SEQ ID NO: 1546180 - RNA, 18 nt, Homo sapiens
aucauauugaauguuucc

SEQ ID NO: 1546181 - RNA, 22 nt, Homo sapiens
aucauauuggugcugagugcua

SEQ ID NO: 1546182 - RNA, 20 nt, Homo sapiens
aucauucagcgcaugcaccu

SEQ ID NO: 1546183 - RNA, 15 nt, Homo sapiens
auccccucucugugg

SEQ ID NO: 1546184 - RNA, 14 nt, Homo sapiens
auccuagcacuuug

SEQ ID NO: 1546185 - RNA, 15 nt, Homo sapiens
auccuagcacuuugg

SEQ ID NO: 1546186 - RNA, 14 nt, Homo sapiens
auccuaggcauuug

SEQ ID NO: 1546187 - RNA, 20 nt, Homo sapiens
aucuaucggaagaacaugaa

SEQ ID NO: 1546188 - RNA, 11 nt, Homo sapiens
aucugccaaca

SEQ ID NO: 1546189 - RNA, 23 nt, Homo sapiens
aucugguaaaagcaccauuguga

SEQ ID NO: 1546190 - RNA, 18 nt, Homo sapiens
aucugugcacacuaagaa

SEQ ID NO: 1546191 - RNA, 14 nt, Homo sapiens
aucuuuugugagau

SEQ ID NO: 1546192 - RNA, 19 nt, Homo sapiens
aucuuuuuuuuaggcaaaa

SEQ ID NO: 1546193 - RNA, 23 nt, Homo sapiens
augaaaacucauuacuuuuccau

SEQ ID NO: 1546194 - RNA, 21 nt, Homo sapiens
augaaauaaaagaaacaaaug

SEQ ID NO: 1546195 - RNA, 22 nt, Homo sapiens
augaaauaaaagcacacugcuu

SEQ ID NO: 1546196 - RNA, 14 nt, Homo sapiens
augaaggacacucu

SEQ ID NO: 1546197 - RNA, 21 nt, Homo sapiens
augagccagcccaagggcauc

SEQ ID NO: 1546198 - RNA, 15 nt, Homo sapiens
augauuaacaaagca

SEQ ID NO: 1546199 - RNA, 23 nt, Homo sapiens
augcagagggugggguacuggag

SEQ ID NO: 1546200 - RNA, 17 nt, Homo sapiens
augccagcuuaucucag

SEQ ID NO: 1546201 - RNA, 19 nt, Homo sapiens
augccagcuuaucucaggg

SEQ ID NO: 1546202 - RNA, 20 nt, Homo sapiens
augcuccauuuuuaaccacu

SEQ ID NO: 1546203 - RNA, 22 nt, Homo sapiens
augcuucuacugugacacuuau

SEQ ID NO: 1546204 - RNA, 21 nt, Homo sapiens
auggagcccaguuggaaaauu

SEQ ID NO: 1546205 - RNA, 17 nt, Homo sapiens
auggcugcgcaccaucu

SEQ ID NO: 1546206 - RNA, 18 nt, Homo sapiens
augggcagggaaggaauc

SEQ ID NO: 1546207 - RNA, 17 nt, Homo sapiens
augggcaugaauggaga

SEQ ID NO: 1546208 - RNA, 19 nt, Homo sapiens
auguauauuuucagugggu

SEQ ID NO: 1546209 - RNA, 15 nt, Homo sapiens
augucaggguucugc

SEQ ID NO: 1546210 - RNA, 16 nt, Homo sapiens
augugaaaagauccca

SEQ ID NO: 1546211 - RNA, 13 nt, Homo sapiens
augugaagccaga

SEQ ID NO: 1546212 - RNA, 19 nt, Homo sapiens
augugaaggacaugagacu

SEQ ID NO: 1546213 - RNA, 16 nt, Homo sapiens
auguggcccaagucau

SEQ ID NO: 1546214 - RNA, 23 nt, Homo sapiens
augugggcugggggaagaugccc

SEQ ID NO: 1546215 - RNA, 19 nt, Homo sapiens
auguguugcuuuggauaca

SEQ ID NO: 1546216 - RNA, 13 nt, Homo sapiens
auguuggucaaaa

SEQ ID NO: 1546217 - RNA, 13 nt, Homo sapiens
auguuguguuguu

SEQ ID NO: 1546218 - RNA, 20 nt, Homo sapiens
auguuucacauaaaaccuca

SEQ ID NO: 1546219 - RNA, 14 nt, Homo sapiens
auuaaaugugagca

SEQ ID NO: 1546220 - RNA, 16 nt, Homo sapiens
auuaaaugugagcaaa

SEQ ID NO: 1546221 - RNA, 18 nt, Homo sapiens
auuacccaaauauaacca

SEQ ID NO: 1546222 - RNA, 16 nt, Homo sapiens
auuagaaaggacugua

SEQ ID NO: 1546223 - RNA, 18 nt, Homo sapiens
auuauaauuaguuccuca

SEQ ID NO: 1546224 - RNA, 16 nt, Homo sapiens
auuauacguacauaca

SEQ ID NO: 1546225 - RNA, 22 nt, Homo sapiens
auucauucugagcccccuuccu

SEQ ID NO: 1546226 - RNA, 21 nt, Homo sapiens
auuccauuaauaacugaauaa

SEQ ID NO: 1546227 - RNA, 12 nt, Homo sapiens
auuccauugccu

SEQ ID NO: 1546228 - RNA, 16 nt, Homo sapiens
auuccccacccugaaa

SEQ ID NO: 1546229 - RNA, 20 nt, Homo sapiens
auuccuacagcacuacuggg

SEQ ID NO: 1546230 - RNA, 21 nt, Homo sapiens
auuccuuaaaugaacuacugc

SEQ ID NO: 1546231 - RNA, 17 nt, Homo sapiens
auucgcugugucagcau

SEQ ID NO: 1546232 - RNA, 11 nt, Homo sapiens
cucaccucucu

SEQ ID NO: 1546233 - RNA, 12 nt, Homo sapiens
cucacuuuggac

SEQ ID NO: 1546234 - RNA, 13 nt, Homo sapiens
cucagcagcaucg

SEQ ID NO: 1546235 - RNA, 17 nt, Homo sapiens
cucagcucccugacccc

SEQ ID NO: 1546236 - RNA, 16 nt, Homo sapiens
cucagguagauuuugu

SEQ ID NO: 1546237 - RNA, 22 nt, Homo sapiens
cucagucaugcacucacaaaga

SEQ ID NO: 1546238 - RNA, 23 nt, Homo sapiens
cucaugccacagugguacucugu

SEQ ID NO: 1546239 - RNA, 13 nt, Homo sapiens
cucauuccuguag

SEQ ID NO: 1546240 - RNA, 18 nt, Homo sapiens
cucauuccuguagucaaa

SEQ ID NO: 1546241 - RNA, 17 nt, Homo sapiens
cuccaggcaucacugau

SEQ ID NO: 1546242 - RNA, 17 nt, Homo sapiens
cuccaggcauuuauuca

SEQ ID NO: 1546243 - RNA, 15 nt, Homo sapiens
cuccaggcugagggc

SEQ ID NO: 1546244 - RNA, 18 nt, Homo sapiens
cuccagugcuguccaugc

SEQ ID NO: 1546245 - RNA, 17 nt, Homo sapiens
cuccauacuucuuucac

SEQ ID NO: 1546246 - RNA, 12 nt, Homo sapiens
cucccacacaca

SEQ ID NO: 1546247 - RNA, 16 nt, Homo sapiens
cucccagcuccuuuca

SEQ ID NO: 1546248 - RNA, 13 nt, Homo sapiens
cuccccauuccua

SEQ ID NO: 1546249 - RNA, 19 nt, Homo sapiens
cuccuggcccuucuauuua

SEQ ID NO: 1546250 - RNA, 14 nt, Homo sapiens
cucuacaaaaagca

SEQ ID NO: 1546251 - RNA, 22 nt, Homo sapiens
cucuacccucuuagaaaaacca

SEQ ID NO: 1546252 - RNA, 16 nt, Homo sapiens
cucugggaucugccaa

SEQ ID NO: 1546253 - RNA, 16 nt, Homo sapiens
cucugugauuaccucu

SEQ ID NO: 1546254 - RNA, 17 nt, Homo sapiens
cucugugucugcucuca

SEQ ID NO: 1546255 - RNA, 16 nt, Homo sapiens
cucuuaaacuugugaa

SEQ ID NO: 1546256 - RNA, 18 nt, Homo sapiens
cucuuuguucucagcucc

SEQ ID NO: 1546257 - RNA, 19 nt, Homo sapiens
cugaaacgagaagugcccu

SEQ ID NO: 1546258 - RNA, 23 nt, Homo sapiens
cugaaccucuucaagagcaucug

SEQ ID NO: 1546259 - RNA, 21 nt, Homo sapiens
cugaagaaaccuucagauuug

SEQ ID NO: 1546260 - RNA, 11 nt, Homo sapiens
cugaagauauu

SEQ ID NO: 1546261 - RNA, 17 nt, Homo sapiens
cugaauccauauuucaa

SEQ ID NO: 1546262 - RNA, 12 nt, Homo sapiens
cugaggugggag

SEQ ID NO: 1546263 - RNA, 20 nt, Homo sapiens
cugauaugcaaguaagaaau

SEQ ID NO: 1546264 - RNA, 20 nt, Homo sapiens
cugauuuacaggacuucucu

SEQ ID NO: 1546265 - RNA, 20 nt, Homo sapiens
cugcaagagggggcauugau

SEQ ID NO: 1546266 - RNA, 14 nt, Homo sapiens
cugcacuccagccu

SEQ ID NO: 1546267 - RNA, 22 nt, Homo sapiens
cugcauucauucugagcccccu

SEQ ID NO: 1546268 - RNA, 21 nt, Homo sapiens
cugcauuuuacacaugugcug

SEQ ID NO: 1546269 - RNA, 20 nt, Homo sapiens
cugccuccaacccagcaguu

SEQ ID NO: 1546270 - RNA, 13 nt, Homo sapiens
cugcgcaccaucu

SEQ ID NO: 1546271 - RNA, 12 nt, Homo sapiens
cuggaaauggac

SEQ ID NO: 1546272 - RNA, 21 nt, Homo sapiens
cuggacccccagcuuugccca

SEQ ID NO: 1546273 - RNA, 22 nt, Homo sapiens
cuggagcugcuaagcuaaagaa

SEQ ID NO: 1546274 - RNA, 18 nt, Homo sapiens
cuggaguccacacuugaa

SEQ ID NO: 1546275 - RNA, 13 nt, Homo sapiens
cuggauucauucu

SEQ ID NO: 1546276 - RNA, 12 nt, Homo sapiens
cuggucaccucc

SEQ ID NO: 1546277 - RNA, 16 nt, Homo sapiens
cuguaauaaagcucuu

SEQ ID NO: 1546278 - RNA, 21 nt, Homo sapiens
cuguauucccccaucuagcca

SEQ ID NO: 1546279 - RNA, 16 nt, Homo sapiens
cuguccccucagcucc

SEQ ID NO: 1546280 - RNA, 16 nt, Homo sapiens
cugucuugaugacugc

SEQ ID NO: 1546281 - RNA, 14 nt, Homo sapiens
cugugauuaccucu

SEQ ID NO: 1546282 - RNA, 14 nt, Homo sapiens
cugugcagucauca

SEQ ID NO: 1546283 - RNA, 18 nt, Homo sapiens
cuguggaugauaaaacac

SEQ ID NO: 1546284 - RNA, 24 nt, Homo sapiens
cuguguguuugggaagguggguga

SEQ ID NO: 1546285 - RNA, 20 nt, Homo sapiens
cuguuuguuuuuguacauuu

SEQ ID NO: 1546286 - RNA, 15 nt, Homo sapiens
cuuaagcacaauuaa

SEQ ID NO: 1546287 - RNA, 23 nt, Homo sapiens
cuuaaugguaggucaaguaauaa

SEQ ID NO: 1546288 - RNA, 14 nt, Homo sapiens
cuuaaugucuguca

SEQ ID NO: 1546289 - RNA, 21 nt, Homo sapiens
cuuaccugaauaauuacuaca

SEQ ID NO: 1546290 - RNA, 14 nt, Homo sapiens
cuuacuugcacugu

SEQ ID NO: 1546291 - RNA, 13 nt, Homo sapiens
cuuagaaugccau

SEQ ID NO: 1546292 - RNA, 21 nt, Homo sapiens
cuuagguauauaauaacuuug

SEQ ID NO: 1546293 - RNA, 17 nt, Homo sapiens
cuuagguuggcaaaaag

SEQ ID NO: 1546294 - RNA, 18 nt, Homo sapiens
cuuagugcuucagaguuu

SEQ ID NO: 1546295 - RNA, 14 nt, Homo sapiens
cuucaaaucagaag

SEQ ID NO: 1546296 - RNA, 18 nt, Homo sapiens
cuucaaauuggucugaaa

SEQ ID NO: 1546297 - RNA, 21 nt, Homo sapiens
cuucaagagcaucuggaacaa

SEQ ID NO: 1546298 - RNA, 19 nt, Homo sapiens
cuucagaguuuguguguau

SEQ ID NO: 1546299 - RNA, 20 nt, Homo sapiens
cuucauagauuaugcuuuaa

SEQ ID NO: 1546300 - RNA, 22 nt, Homo sapiens
cuucauucgagaugaguuucug

SEQ ID NO: 1546301 - RNA, 17 nt, Homo sapiens
cuuccucagcaggccaa

SEQ ID NO: 1546302 - RNA, 20 nt, Homo sapiens
cuuccucccugucucugcau

SEQ ID NO: 1546303 - RNA, 21 nt, Homo sapiens
cuucuaccccaccugaccucu

SEQ ID NO: 1546304 - RNA, 14 nt, Homo sapiens
cuucuacugugaca

SEQ ID NO: 1546305 - RNA, 20 nt, Homo sapiens
cuucuagacacuccuugaaa

SEQ ID NO: 1546306 - RNA, 21 nt, Homo sapiens
cuucucuucuuuauugcacua

SEQ ID NO: 1546307 - RNA, 16 nt, Homo sapiens
cuucuuuauugcacua

SEQ ID NO: 1546308 - RNA, 12 nt, Homo sapiens
cuugaaaucuga

SEQ ID NO: 1546309 - RNA, 16 nt, Homo sapiens
cuugaggcaacucauc

SEQ ID NO: 1546310 - RNA, 14 nt, Homo sapiens
cuugaugacugcug

SEQ ID NO: 1546311 - RNA, 18 nt, Homo sapiens
cuugcaccugagccuguu

SEQ ID NO: 1546312 - RNA, 13 nt, Homo sapiens
cuugcacuguuac

SEQ ID NO: 1546313 - RNA, 18 nt, Homo sapiens
cuugcuuuuugcugugua

SEQ ID NO: 1546314 - RNA, 22 nt, Homo sapiens
cuuucaauugcagaugccaaaa

SEQ ID NO: 1546315 - RNA, 16 nt, Homo sapiens
cuuucauuuugccuga

SEQ ID NO: 1546316 - RNA, 13 nt, Homo sapiens
cuuucccagugag

SEQ ID NO: 1546317 - RNA, 20 nt, Homo sapiens
cuuuccucucuuuguucuca

SEQ ID NO: 1546318 - RNA, 15 nt, Homo sapiens
cuuucucagccacaa

SEQ ID NO: 1546319 - RNA, 14 nt, Homo sapiens
cuuucucugccugg

SEQ ID NO: 1546320 - RNA, 19 nt, Homo sapiens
cuuucugcuaucaaagagg

SEQ ID NO: 1546321 - RNA, 11 nt, Homo sapiens
cuuucuucccu

SEQ ID NO: 1546322 - RNA, 13 nt, Homo sapiens
cuuuggacacuca

SEQ ID NO: 1546323 - RNA, 21 nt, Homo sapiens
cuuuguuuguugucagcugaa

SEQ ID NO: 1546324 - RNA, 14 nt, Homo sapiens
cuuuugaaaugcca

SEQ ID NO: 1546325 - RNA, 16 nt, Homo sapiens
gaaaaaaaaauacuua

SEQ ID NO: 1546326 - RNA, 23 nt, Homo sapiens
gaaaagaacacuagagucuguca

SEQ ID NO: 1546327 - RNA, 16 nt, Homo sapiens
gaaaaggguuucuuga

SEQ ID NO: 1546328 - RNA, 14 nt, Homo sapiens
gaaaaguagacaau

SEQ ID NO: 1546329 - RNA, 23 nt, Homo sapiens
gaaaauacauucuuaaacuaguu

SEQ ID NO: 1546330 - RNA, 15 nt, Homo sapiens
gaaaauggaugacaa

SEQ ID NO: 1546331 - RNA, 15 nt, Homo sapiens
gaaacaaaugaaaua

SEQ ID NO: 1546332 - RNA, 14 nt, Homo sapiens
gaaacaugugcccc

SEQ ID NO: 1546333 - RNA, 15 nt, Homo sapiens
gaaacaugugccccu

SEQ ID NO: 1546334 - RNA, 15 nt, Homo sapiens
gaaaccagagucaaa

SEQ ID NO: 1546335 - RNA, 13 nt, Homo sapiens
gaaagaaugcauu

SEQ ID NO: 1546336 - RNA, 14 nt, Homo sapiens
gaaagaaugcauuc

SEQ ID NO: 1546337 - RNA, 23 nt, Homo sapiens
gaaagaaugcauuccagaacaaa

SEQ ID NO: 1546338 - RNA, 20 nt, Homo sapiens
gaaagaugacaaaagaaaau

SEQ ID NO: 1546339 - RNA, 21 nt, Homo sapiens
gaaaggcuguggaagggccaa

SEQ ID NO: 1546340 - RNA, 13 nt, Homo sapiens
gaaauaauuacuu

SEQ ID NO: 1546341 - RNA, 14 nt, Homo sapiens
gaaauaauuacuuu

SEQ ID NO: 1546342 - RNA, 22 nt, Homo sapiens
gaaaugccacgugccauugucu

SEQ ID NO: 1546343 - RNA, 12 nt, Homo sapiens
gaaccaauagaa

SEQ ID NO: 1546344 - RNA, 19 nt, Homo sapiens
gaaccgagguguugccagu

SEQ ID NO: 1546345 - RNA, 16 nt, Homo sapiens
gaacucagugccacac

SEQ ID NO: 1546346 - RNA, 16 nt, Homo sapiens
gaacuguucacacugc

SEQ ID NO: 1546347 - RNA, 20 nt, Homo sapiens
gaagaaaauggaugacaaag

SEQ ID NO: 1546348 - RNA, 23 nt, Homo sapiens
gaagauauuacuacuuaccauuu

SEQ ID NO: 1546349 - RNA, 21 nt, Homo sapiens
gaagcuggcccucagcucccu

SEQ ID NO: 1546350 - RNA, 14 nt, Homo sapiens
gaaggggaugggaa

SEQ ID NO: 1546351 - RNA, 14 nt, Homo sapiens
uaaaauaguuuaga

SEQ ID NO: 1546352 - RNA, 15 nt, Homo sapiens
uaaaauggauagaaa

SEQ ID NO: 1546353 - RNA, 23 nt, Homo sapiens
uaaacaaugaugcccugcuccag

SEQ ID NO: 1546354 - RNA, 17 nt, Homo sapiens
uaaacccauaaguuuaa

SEQ ID NO: 1546355 - RNA, 17 nt, Homo sapiens
uaaagacccaacuugcc

SEQ ID NO: 1546356 - RNA, 20 nt, Homo sapiens
uaaagacccaacuugccaaa

SEQ ID NO: 1546357 - RNA, 17 nt, Homo sapiens
uaaagggagaaaugcca

SEQ ID NO: 1546358 - RNA, 18 nt, Homo sapiens
uaaagggagaaaugccag

SEQ ID NO: 1546359 - RNA, 20 nt, Homo sapiens
uaaauauuguguugugcagc

SEQ ID NO: 1546360 - RNA, 21 nt, Homo sapiens
uaaaucuuucuuuugauucuu

SEQ ID NO: 1546361 - RNA, 12 nt, Homo sapiens
uaaaugcauuag

SEQ ID NO: 1546362 - RNA, 12 nt, Homo sapiens
uaaaugugaaug

SEQ ID NO: 1546363 - RNA, 14 nt, Homo sapiens
uaaauucucaguca

SEQ ID NO: 1546364 - RNA, 14 nt, Homo sapiens
uaacaccaugauua

SEQ ID NO: 1546365 - RNA, 17 nt, Homo sapiens
uaacacuauacucuaaa

SEQ ID NO: 1546366 - RNA, 21 nt, Homo sapiens
uaaccuucuggcuuccuucuc

SEQ ID NO: 1546367 - RNA, 16 nt, Homo sapiens
uaacuaaaugcucaua

SEQ ID NO: 1546368 - RNA, 22 nt, Homo sapiens
uaacuguauuuuugaagacuau

SEQ ID NO: 1546369 - RNA, 16 nt, Homo sapiens
uaacuucuacauucaa

SEQ ID NO: 1546370 - RNA, 17 nt, Homo sapiens
uaacuuugaagccauaa

SEQ ID NO: 1546371 - RNA, 22 nt, Homo sapiens
uaagauaaaggguauugccuug

SEQ ID NO: 1546372 - RNA, 17 nt, Homo sapiens
uaagcauggauuuuccc

SEQ ID NO: 1546373 - RNA, 19 nt, Homo sapiens
uaagugaauuuaugagauu

SEQ ID NO: 1546374 - RNA, 19 nt, Homo sapiens
uaaguguucaguguugaca

SEQ ID NO: 1546375 - RNA, 20 nt, Homo sapiens
uaaguuugaaacuaacucau

SEQ ID NO: 1546376 - RNA, 20 nt, Homo sapiens
uaauaacuuugaagccauaa

SEQ ID NO: 1546377 - RNA, 22 nt, Homo sapiens
uaauagccuaauacaacaugua

SEQ ID NO: 1546378 - RNA, 14 nt, Homo sapiens
uaauauggcuguau

SEQ ID NO: 1546379 - RNA, 22 nt, Homo sapiens
uaaucagcaauauugccugugc

SEQ ID NO: 1546380 - RNA, 19 nt, Homo sapiens
uaaugaaggaguucacugu

SEQ ID NO: 1546381 - RNA, 17 nt, Homo sapiens
uaaugcccuauguguau

SEQ ID NO: 1546382 - RNA, 14 nt, Homo sapiens
uaauuaguuccuca

SEQ ID NO: 1546383 - RNA, 17 nt, Homo sapiens
uaauuccuacagcacua

SEQ ID NO: 1546384 - RNA, 18 nt, Homo sapiens
uaauuugaaaacauaauc

SEQ ID NO: 1546385 - RNA, 11 nt, Homo sapiens
uacaaaacugc

SEQ ID NO: 1546386 - RNA, 16 nt, Homo sapiens
uacaaagcgugcacaa

SEQ ID NO: 1546387 - RNA, 12 nt, Homo sapiens
uacaacauguag

SEQ ID NO: 1546388 - RNA, 20 nt, Homo sapiens
uacaagcuuaaagcuugauu

SEQ ID NO: 1546389 - RNA, 18 nt, Homo sapiens
uacacaaggggcaaauga

SEQ ID NO: 1546390 - RNA, 14 nt, Homo sapiens
uacauacaaauucu

SEQ ID NO: 1546391 - RNA, 16 nt, Homo sapiens
uacauccugaguguga

SEQ ID NO: 1546392 - RNA, 22 nt, Homo sapiens
uaccccacacacaguccaacuc

SEQ ID NO: 1546393 - RNA, 16 nt, Homo sapiens
uacgugaaaugcucaa

SEQ ID NO: 1546394 - RNA, 20 nt, Homo sapiens
uacuccuggagcacuguaaa

SEQ ID NO: 1546395 - RNA, 18 nt, Homo sapiens
uacucuaaaauggacauu

SEQ ID NO: 1546396 - RNA, 19 nt, Homo sapiens
uacucuaaaauggacauuu

SEQ ID NO: 1546397 - RNA, 23 nt, Homo sapiens
uacugcagcuuuguuuguuguca

SEQ ID NO: 1546398 - RNA, 18 nt, Homo sapiens
uacuggaguuagaucucu

SEQ ID NO: 1546399 - RNA, 15 nt, Homo sapiens
uacuuagaaugccau

SEQ ID NO: 1546400 - RNA, 12 nt, Homo sapiens
uacuugugcacu

SEQ ID NO: 1546401 - RNA, 13 nt, Homo sapiens
uagaaaaaccacc

SEQ ID NO: 1546402 - RNA, 17 nt, Homo sapiens
uagaagcaaagauuuca

SEQ ID NO: 1546403 - RNA, 15 nt, Homo sapiens
uagaauauacugucu

SEQ ID NO: 1546404 - RNA, 18 nt, Homo sapiens
uagaauauacugucuugu

SEQ ID NO: 1546405 - RNA, 16 nt, Homo sapiens
uagacacuuuaccucu

SEQ ID NO: 1546406 - RNA, 16 nt, Homo sapiens
uagacuccucuuccca

SEQ ID NO: 1546407 - RNA, 17 nt, Homo sapiens
uagauauguuaagcaug

SEQ ID NO: 1546408 - RNA, 19 nt, Homo sapiens
uagauguauaaaucuuucu

SEQ ID NO: 1546409 - RNA, 21 nt, Homo sapiens
uagauucagcucccacacaca

SEQ ID NO: 1546410 - RNA, 16 nt, Homo sapiens
uagccuaauacaacau

SEQ ID NO: 1546411 - RNA, 19 nt, Homo sapiens
uagcuugauugcucagaga

SEQ ID NO: 1546412 - RNA, 17 nt, Homo sapiens
uagcuuguuccacugca

SEQ ID NO: 1546413 - RNA, 14 nt, Homo sapiens
uaggaaaaugccau

SEQ ID NO: 1546414 - RNA, 15 nt, Homo sapiens
uaggaauucuuugca

SEQ ID NO: 1546415 - RNA, 17 nt, Homo sapiens
uaggaauucuuugcauu

SEQ ID NO: 1546416 - RNA, 21 nt, Homo sapiens
uaggagacugguuaggacaaa

SEQ ID NO: 1546417 - RNA, 22 nt, Homo sapiens
uaggcaaaaccuugugacucag

SEQ ID NO: 1546418 - RNA, 15 nt, Homo sapiens
uaggcauuugcugaa

SEQ ID NO: 1546419 - RNA, 14 nt, Homo sapiens
uagggaaaaaccag

SEQ ID NO: 1546420 - RNA, 14 nt, Homo sapiens
uagggagaaaccaa

SEQ ID NO: 1546421 - RNA, 16 nt, Homo sapiens
uaguaacauagacaaa

SEQ ID NO: 1546422 - RNA, 19 nt, Homo sapiens
uaguauuuuuauccaugac

SEQ ID NO: 1546423 - RNA, 23 nt, Homo sapiens
uagucccacagggaaauguguau

SEQ ID NO: 1546424 - RNA, 17 nt, Homo sapiens
uaguuuuuacaaaacug

SEQ ID NO: 1546425 - RNA, 15 nt, Homo sapiens
uauaagguaauguag

SEQ ID NO: 1546426 - RNA, 19 nt, Homo sapiens
uauaaguguucaguguuga

SEQ ID NO: 1546427 - RNA, 12 nt, Homo sapiens
uauacauuugau

SEQ ID NO: 1546428 - RNA, 15 nt, Homo sapiens
uauauccucuggaaa

SEQ ID NO: 1546429 - RNA, 20 nt, Homo sapiens
uauauuuugugcuaucagac

SEQ ID NO: 1546430 - RNA, 20 nt, Homo sapiens
uaucagacuguaggauuuga

SEQ ID NO: 1546431 - RNA, 20 nt, Homo sapiens
uaucauggaauuuccauuga

SEQ ID NO: 1546432 - RNA, 18 nt, Homo sapiens
uauccauuacgugcauuu

SEQ ID NO: 1546433 - RNA, 14 nt, Homo sapiens
uaucuagcauuuau

SEQ ID NO: 1546434 - RNA, 14 nt, Homo sapiens
uauguaaucucacc

SEQ ID NO: 1546435 - RNA, 23 nt, Homo sapiens
uauguagccuuagagcaucucug

SEQ ID NO: 1546436 - RNA, 14 nt, Homo sapiens
uaugugaagacaga

SEQ ID NO: 1546437 - RNA, 15 nt, Homo sapiens
uauguguugccaaag

SEQ ID NO: 1546438 - RNA, 17 nt, Homo sapiens
uauuaaagcuccauugg

SEQ ID NO: 1546439 - RNA, 15 nt, Homo sapiens
uauuaauaaagcauu

SEQ ID NO: 1546440 - RNA, 16 nt, Homo sapiens
uauuaauaaagcauuc

SEQ ID NO: 1546441 - RNA, 14 nt, Homo sapiens
uauuacuugugcac

SEQ ID NO: 1546442 - RNA, 19 nt, Homo sapiens
uauucaaguaacacuuuaa

SEQ ID NO: 1546443 - RNA, 21 nt, Homo sapiens
uauucuugagggacaaugcca

SEQ ID NO: 1546444 - RNA, 19 nt, Homo sapiens
uauugaaaguugcuuuuau

SEQ ID NO: 1546445 - RNA, 10 nt, Homo sapiens
uauugcacua

SEQ ID NO: 1546446 - RNA, 21 nt, Homo sapiens
uauuuaaauaaaaucauauug

SEQ ID NO: 1546447 - RNA, 16 nt, Homo sapiens
uauuuaccagaccaca

SEQ ID NO: 1546448 - RNA, 22 nt, Homo sapiens
uauuuagaucuagaaacagauc

SEQ ID NO: 1546449 - RNA, 16 nt, Homo sapiens
uauuuauaucauauau

SEQ ID NO: 1546450 - RNA, 15 nt, Homo sapiens
uauuuaucugcaagg

SEQ ID NO: 1546451 - RNA, 16 nt, Homo sapiens
uauuucaaaacacauc

SEQ ID NO: 1546452 - RNA, 15 nt, Homo sapiens
uauuuucuauuuucc

SEQ ID NO: 1546453 - RNA, 16 nt, Homo sapiens
uauuuuugaagacuau

SEQ ID NO: 1546454 - RNA, 20 nt, Homo sapiens
ucaaaaacaaccugaaagag

SEQ ID NO: 1546455 - RNA, 18 nt, Homo sapiens
ucaaaugauacagucagg

SEQ ID NO: 1546456 - RNA, 16 nt, Homo sapiens
ucaacaccucugcaca

SEQ ID NO: 1546457 - RNA, 21 nt, Homo sapiens
ucaacucacccccuacacaca

SEQ ID NO: 1546458 - RNA, 19 nt, Homo sapiens
ucaagugucaccuccuucc

SEQ ID NO: 1546459 - RNA, 17 nt, Homo sapiens
ucaauugcagaugccaa

SEQ ID NO: 1546460 - RNA, 20 nt, Homo sapiens
ucaauuuggcaaaacaaaau

SEQ ID NO: 1546461 - RNA, 16 nt, Homo sapiens
ucacaaguagccucug

SEQ ID NO: 1546462 - RNA, 18 nt, Homo sapiens
ucacaguugacaaaaagc

SEQ ID NO: 1546463 - RNA, 15 nt, Homo sapiens
ucacgaacuguucac

SEQ ID NO: 1546464 - RNA, 17 nt, Homo sapiens
ucacuaauacuaauuca

SEQ ID NO: 1546465 - RNA, 18 nt, Homo sapiens
ucacuggggcaugagauu

SEQ ID NO: 1546466 - RNA, 18 nt, Homo sapiens
ucagagggcguguuguuu

SEQ ID NO: 1546467 - RNA, 17 nt, Homo sapiens
ucagaguuuguguguau

SEQ ID NO: 1546468 - RNA, 15 nt, Homo sapiens
ucagauuuguguuau

SEQ ID NO: 1546469 - RNA, 18 nt, Homo sapiens
agaaucugugcagucauc

SEQ ID NO: 1546470 - RNA, 13 nt, Homo sapiens
agacacuguugca

SEQ ID NO: 1546471 - RNA, 20 nt, Homo sapiens
agaccaccuucccuuccuca

SEQ ID NO: 1546472 - RNA, 14 nt, Homo sapiens
agacccacagcccu

SEQ ID NO: 1546473 - RNA, 21 nt, Homo sapiens
agaccucuccuuccuacccuc

SEQ ID NO: 1546474 - RNA, 14 nt, Homo sapiens
agacgccaccauuc

SEQ ID NO: 1546475 - RNA, 19 nt, Homo sapiens
agacugacacuacuaaagc

SEQ ID NO: 1546476 - RNA, 13 nt, Homo sapiens
agacugccagugg

SEQ ID NO: 1546477 - RNA, 19 nt, Homo sapiens
agacuguggaaccaaagcu

SEQ ID NO: 1546478 - RNA, 13 nt, Homo sapiens
agagaaggggcag

SEQ ID NO: 1546479 - RNA, 22 nt, Homo sapiens
agagacucgcucacucccaugu

SEQ ID NO: 1546480 - RNA, 18 nt, Homo sapiens
agagccaccagggcacug

SEQ ID NO: 1546481 - RNA, 12 nt, Homo sapiens
agaggcuuccaa

SEQ ID NO: 1546482 - RNA, 14 nt, Homo sapiens
agaggguguuugca

SEQ ID NO: 1546483 - RNA, 12 nt, Homo sapiens
agagucacaagu

SEQ ID NO: 1546484 - RNA, 23 nt, Homo sapiens
agauaagacuuguuucuuucugu

SEQ ID NO: 1546485 - RNA, 16 nt, Homo sapiens
agauaccgagaaugau

SEQ ID NO: 1546486 - RNA, 16 nt, Homo sapiens
agauauguuaagcaug

SEQ ID NO: 1546487 - RNA, 21 nt, Homo sapiens
agaucagccugggcaauguga

SEQ ID NO: 1546488 - RNA, 21 nt, Homo sapiens
agauccuggaaacagcagugu

SEQ ID NO: 1546489 - RNA, 23 nt, Homo sapiens
agauccuggaaacagcaguguau

SEQ ID NO: 1546490 - RNA, 12 nt, Homo sapiens
agauucagcucc

SEQ ID NO: 1546491 - RNA, 14 nt, Homo sapiens
agauuucaguagaa

SEQ ID NO: 1546492 - RNA, 22 nt, Homo sapiens
agcaaacaaauaaaaugaaaua

SEQ ID NO: 1546493 - RNA, 23 nt, Homo sapiens
agcacagcucuccuccuccaucu

SEQ ID NO: 1546494 - RNA, 10 nt, Homo sapiens
agcaccucau

SEQ ID NO: 1546495 - RNA, 16 nt, Homo sapiens
agcaggaggugccuga

SEQ ID NO: 1546496 - RNA, 23 nt, Homo sapiens
agcaggucuuugggaagcuccca

SEQ ID NO: 1546497 - RNA, 16 nt, Homo sapiens
agcaucucugccucca

SEQ ID NO: 1546498 - RNA, 23 nt, Homo sapiens
agccauguguuggggagacauca

SEQ ID NO: 1546499 - RNA, 19 nt, Homo sapiens
agccauuucggaagacacc

SEQ ID NO: 1546500 - RNA, 19 nt, Homo sapiens
agcccaagggcaucauccu

SEQ ID NO: 1546501 - RNA, 19 nt, Homo sapiens
agcccaccccucaacaccu

SEQ ID NO: 1546502 - RNA, 13 nt, Homo sapiens
agccccagcaccu

SEQ ID NO: 1546503 - RNA, 16 nt, Homo sapiens
agccccagcaccucau

SEQ ID NO: 1546504 - RNA, 15 nt, Homo sapiens
agcccugagcuuucu

SEQ ID NO: 1546505 - RNA, 19 nt, Homo sapiens
agcccugggacagggcaaa

SEQ ID NO: 1546506 - RNA, 16 nt, Homo sapiens
agccuaccaauguaga

SEQ ID NO: 1546507 - RNA, 17 nt, Homo sapiens
agccuccugcccagucc

SEQ ID NO: 1546508 - RNA, 17 nt, Homo sapiens
agccugcuccagcuguu

SEQ ID NO: 1546509 - RNA, 14 nt, Homo sapiens
agccuggacccugu

SEQ ID NO: 1546510 - RNA, 16 nt, Homo sapiens
agcgauggcagugaga

SEQ ID NO: 1546511 - RNA, 17 nt, Homo sapiens
agcuagacugugucuga

SEQ ID NO: 1546512 - RNA, 14 nt, Homo sapiens
agcucccccugucc

SEQ ID NO: 1546513 - RNA, 20 nt, Homo sapiens
agcucuuacacuacauuaga

SEQ ID NO: 1546514 - RNA, 23 nt, Homo sapiens
agcugguuguacccucuccaggc

SEQ ID NO: 1546515 - RNA, 14 nt, Homo sapiens
agcuugauugcuca

SEQ ID NO: 1546516 - RNA, 17 nt, Homo sapiens
aggaaugugaagccaga

SEQ ID NO: 1546517 - RNA, 19 nt, Homo sapiens
aggaauucaauuuggcaaa

SEQ ID NO: 1546518 - RNA, 15 nt, Homo sapiens
aggacaucaaaaaca

SEQ ID NO: 1546519 - RNA, 19 nt, Homo sapiens
aggagacugguuaggacaa

SEQ ID NO: 1546520 - RNA, 13 nt, Homo sapiens
aggagccaugaca

SEQ ID NO: 1546521 - RNA, 12 nt, Homo sapiens
aggagguucugg

SEQ ID NO: 1546522 - RNA, 20 nt, Homo sapiens
ugcugcaaacccaugaagcu

SEQ ID NO: 1546523 - RNA, 22 nt, Homo sapiens
ugcuucacucaugcaaacugcu

SEQ ID NO: 1546524 - RNA, 13 nt, Homo sapiens
ugcuucagaguuu

SEQ ID NO: 1546525 - RNA, 23 nt, Homo sapiens
uggaaccaaagcuggcccaguug

SEQ ID NO: 1546526 - RNA, 15 nt, Homo sapiens
uggaauuacugccuu

SEQ ID NO: 1546527 - RNA, 15 nt, Homo sapiens
uggacagacacuguu

SEQ ID NO: 1546528 - RNA, 21 nt, Homo sapiens
uggacagacacuguugcaaag

SEQ ID NO: 1546529 - RNA, 15 nt, Homo sapiens
uggacauuuguucca

SEQ ID NO: 1546530 - RNA, 17 nt, Homo sapiens
uggacccccagcuuugc

SEQ ID NO: 1546531 - RNA, 19 nt, Homo sapiens
uggagaacucagugccaca

SEQ ID NO: 1546532 - RNA, 15 nt, Homo sapiens
uggagaccucuccuu

SEQ ID NO: 1546533 - RNA, 12 nt, Homo sapiens
uggaucagaggu

SEQ ID NO: 1546534 - RNA, 20 nt, Homo sapiens
uggauucuggauucacagac

SEQ ID NO: 1546535 - RNA, 15 nt, Homo sapiens
uggcauaggccugua

SEQ ID NO: 1546536 - RNA, 18 nt, Homo sapiens
uggccaggagccaugaca

SEQ ID NO: 1546537 - RNA, 13 nt, Homo sapiens
uggcccacgcacu

SEQ ID NO: 1546538 - RNA, 16 nt, Homo sapiens
uggcccacgcacuucg

SEQ ID NO: 1546539 - RNA, 13 nt, Homo sapiens
uggcccacugcau

SEQ ID NO: 1546540 - RNA, 20 nt, Homo sapiens
uggcccaguuguccaugaca

SEQ ID NO: 1546541 - RNA, 15 nt, Homo sapiens
uggccugacugguug

SEQ ID NO: 1546542 - RNA, 16 nt, Homo sapiens
uggcugcuuugacaag

SEQ ID NO: 1546543 - RNA, 11 nt, Homo sapiens
ugggacagggc

SEQ ID NO: 1546544 - RNA, 13 nt, Homo sapiens
ugggacagggcaa

SEQ ID NO: 1546545 - RNA, 16 nt, Homo sapiens
ugggaggccaaggugg

SEQ ID NO: 1546546 - RNA, 14 nt, Homo sapiens
ugggcaaugugaua

SEQ ID NO: 1546547 - RNA, 17 nt, Homo sapiens
ugggcagugagugccau

SEQ ID NO: 1546548 - RNA, 22 nt, Homo sapiens
ugggcauuaagucaguggcuuu

SEQ ID NO: 1546549 - RNA, 14 nt, Homo sapiens
ugggccacugugaa

SEQ ID NO: 1546550 - RNA, 18 nt, Homo sapiens
uggggaagagguuuuauu

SEQ ID NO: 1546551 - RNA, 23 nt, Homo sapiens
ugguaacacaaauuuucaccugc

SEQ ID NO: 1546552 - RNA, 15 nt, Homo sapiens
uggucccucuguguc

SEQ ID NO: 1546553 - RNA, 18 nt, Homo sapiens
uggucccucugugucugc

SEQ ID NO: 1546554 - RNA, 22 nt, Homo sapiens
uggucccucugugucugcucuc

SEQ ID NO: 1546555 - RNA, 15 nt, Homo sapiens
ugguggccagcagca

SEQ ID NO: 1546556 - RNA, 15 nt, Homo sapiens
ugguugagguuucaa

SEQ ID NO: 1546557 - RNA, 11 nt, Homo sapiens
uguaaacugga

SEQ ID NO: 1546558 - RNA, 18 nt, Homo sapiens
uguaaugccaauaugaca

SEQ ID NO: 1546559 - RNA, 23 nt, Homo sapiens
uguagaaugucuugguguuauca

SEQ ID NO: 1546560 - RNA, 10 nt, Homo sapiens
uguagagugg

SEQ ID NO: 1546561 - RNA, 15 nt, Homo sapiens
uguauauauauucuc

SEQ ID NO: 1546562 - RNA, 19 nt, Homo sapiens
ugcugcuugaggcaacuca

SEQ ID NO: 1546563 - RNA, 20 nt, Homo sapiens
ugcuguccgugcuugcuggu

SEQ ID NO: 1546564 - RNA, 13 nt, Homo sapiens
ugcuuacaaaguc

SEQ ID NO: 1546565 - RNA, 23 nt, Homo sapiens
ugcuucagaguuuguguguauuu

SEQ ID NO: 1546566 - RNA, 14 nt, Homo sapiens
ugcuucuacuguga

SEQ ID NO: 1546567 - RNA, 22 nt, Homo sapiens
ugcuucucuucuuuauugcacu

SEQ ID NO: 1546568 - RNA, 23 nt, Homo sapiens
ugcuucucuucuuuauugcacua

SEQ ID NO: 1546569 - RNA, 18 nt, Homo sapiens
ugcuuuugaaaaacaacu

SEQ ID NO: 1546570 - RNA, 14 nt, Homo sapiens
uggaacaacagaug

SEQ ID NO: 1546571 - RNA, 17 nt, Homo sapiens
uggaauccaucugucuc

SEQ ID NO: 1546572 - RNA, 15 nt, Homo sapiens
uggaaugaauacagc

SEQ ID NO: 1546573 - RNA, 16 nt, Homo sapiens
uggaauguuacaucug

SEQ ID NO: 1546574 - RNA, 13 nt, Homo sapiens
uggacagacacug

SEQ ID NO: 1546575 - RNA, 14 nt, Homo sapiens
uggacugucugauc

SEQ ID NO: 1546576 - RNA, 12 nt, Homo sapiens
uggagagcugcu

SEQ ID NO: 1546577 - RNA, 16 nt, Homo sapiens
uggagcaaauguccua

SEQ ID NO: 1546578 - RNA, 14 nt, Homo sapiens
uggaggccuaccuc

SEQ ID NO: 1546579 - RNA, 17 nt, Homo sapiens
uggaucagaggucaucc

SEQ ID NO: 1546580 - RNA, 14 nt, Homo sapiens
uggauuauuuagau

SEQ ID NO: 1546581 - RNA, 16 nt, Homo sapiens
uggcaggcuacucugc

SEQ ID NO: 1546582 - RNA, 18 nt, Homo sapiens
uggccaauagucauaugu

SEQ ID NO: 1546583 - RNA, 20 nt, Homo sapiens
uggcucccaagccacauuca

SEQ ID NO: 1546584 - RNA, 17 nt, Homo sapiens
uggcugcguacuccacu

SEQ ID NO: 1546585 - RNA, 14 nt, Homo sapiens
ugggaauacaucug

SEQ ID NO: 1546586 - RNA, 21 nt, Homo sapiens
ugggacagacggaaaugaaau

SEQ ID NO: 1546587 - RNA, 15 nt, Homo sapiens
ugggauggauuucca

SEQ ID NO: 1546588 - RNA, 19 nt, Homo sapiens
ugggcauuucacgaacugu

SEQ ID NO: 1546589 - RNA, 20 nt, Homo sapiens
ugggcauuucacgaacuguu

SEQ ID NO: 1546590 - RNA, 16 nt, Homo sapiens
uggggauaugauuuaa

SEQ ID NO: 1546591 - RNA, 19 nt, Homo sapiens
ugggugucauuucauucca

SEQ ID NO: 1546592 - RNA, 21 nt, Homo sapiens
uggucaaguuuuucucucaaa

SEQ ID NO: 1546593 - RNA, 16 nt, Homo sapiens
uggucgucaugcuguc

SEQ ID NO: 1546594 - RNA, 20 nt, Homo sapiens
ugguucgugccaugcccuua

SEQ ID NO: 1546595 - RNA, 22 nt, Homo sapiens
ugguuguagugggaagucccgc

SEQ ID NO: 1546596 - RNA, 16 nt, Homo sapiens
uguaagacucauuccc

SEQ ID NO: 1546597 - RNA, 18 nt, Homo sapiens
uguaaugucagacuuugc

SEQ ID NO: 1546598 - RNA, 19 nt, Homo sapiens
uguaaugucagacuuugcu

SEQ ID NO: 1546599 - RNA, 23 nt, Homo sapiens
uguagaucagggauagcgcuguu

SEQ ID NO: 1546600 - RNA, 18 nt, Homo sapiens
uguaucagagggcuuuga

SEQ ID NO: 1546601 - RNA, 19 nt, Homo sapiens
uguccggucccugucccag

SEQ ID NO: 1546602 - RNA, 16 nt, Homo sapiens
ugucgggaauuuuccc

SEQ ID NO: 1546603 - RNA, 13 nt, Homo sapiens
ugucuaccucuga

SEQ ID NO: 1546604 - RNA, 22 nt, Homo sapiens
ugucuggcaggcuacucugccc

SEQ ID NO: 1546605 - RNA, 23 nt, Homo sapiens
ugugaaugaugauccuaggcauu

SEQ ID NO: 1546606 - RNA, 23 nt, Homo sapiens
ugugaauguuuagugugcugcug

SEQ ID NO: 1546607 - RNA, 14 nt, Homo sapiens
ugugaggguggugg

SEQ ID NO: 1546608 - RNA, 18 nt, Homo sapiens
ugugaggguggugggugg

SEQ ID NO: 1546609 - RNA, 17 nt, Homo sapiens
ugugccugaagucccag

SEQ ID NO: 1546610 - RNA, 18 nt, Homo sapiens
uguggaugauaaaacaca

SEQ ID NO: 1546611 - RNA, 18 nt, Homo sapiens
ugugggugaagugccugc

SEQ ID NO: 1546612 - RNA, 12 nt, Homo sapiens
uguguaaucuaa

SEQ ID NO: 1546613 - RNA, 17 nt, Homo sapiens
uguguaaucuaaguaua

SEQ ID NO: 1546614 - RNA, 12 nt, Homo sapiens
ugugucagcaua

SEQ ID NO: 1546615 - RNA, 15 nt, Homo sapiens
uguguccugcaguuc

SEQ ID NO: 1546616 - RNA, 13 nt, Homo sapiens
uguuaauuuagag

SEQ ID NO: 1546617 - RNA, 22 nt, Homo sapiens
uguuacauuauuccaaugauac

SEQ ID NO: 1546618 - RNA, 15 nt, Homo sapiens
uguuacugucuucag

SEQ ID NO: 1546619 - RNA, 19 nt, Homo sapiens
uguuagauagaauuuccaa

SEQ ID NO: 1546620 - RNA, 17 nt, Homo sapiens
uguuagugguuacccag

SEQ ID NO: 1546621 - RNA, 19 nt, Homo sapiens
uguucaguguugacauagc

SEQ ID NO: 1546622 - RNA, 14 nt, Homo sapiens
uguucccacucagc

SEQ ID NO: 1546623 - RNA, 15 nt, Homo sapiens
uguuccccccauaga

SEQ ID NO: 1546624 - RNA, 17 nt, Homo sapiens
uguugugcagcauuaaa

SEQ ID NO: 1546625 - RNA, 23 nt, Homo sapiens
uguuuaccauagaaagaugacaa

SEQ ID NO: 1546626 - RNA, 14 nt, Homo sapiens
uguuuucucuugag

SEQ ID NO: 1546627 - RNA, 19 nt, Homo sapiens
uuaaaagugacauuugucu

SEQ ID NO: 1546628 - RNA, 14 nt, Homo sapiens
uuaaagaaagaaug

SEQ ID NO: 1546629 - RNA, 16 nt, Homo sapiens
uuaacuaaaugcucau

SEQ ID NO: 1546630 - RNA, 18 nt, Homo sapiens
uuaagcauggauuuuccc

SEQ ID NO: 1546631 - RNA, 17 nt, Homo sapiens
uuaagugcuucacauuu

SEQ ID NO: 1546632 - RNA, 22 nt, Homo sapiens
uuaaguuugaaacuaacucaua

SEQ ID NO: 1546633 - RNA, 16 nt, Homo sapiens
uuaauaaagcauucuu

SEQ ID NO: 1546634 - RNA, 20 nt, Homo sapiens
uuaauuauaccccaugauac

SEQ ID NO: 1546635 - RNA, 16 nt, Homo sapiens
uuacaaaacugcuuug

SEQ ID NO: 1546636 - RNA, 14 nt, Homo sapiens
uuacacaugugcug

SEQ ID NO: 1546637 - RNA, 16 nt, Homo sapiens
uuacacaugugcugau

SEQ ID NO: 1546638 - RNA, 22 nt, Homo sapiens
uuaccauagaaagaugacaaaa

SEQ ID NO: 1546639 - RNA, 21 nt, Homo sapiens
uuacccaaauauaaccauuua

SEQ ID NO: 1546640 - RNA, 18 nt, Homo sapiens
auaugugaagacagagca

SEQ ID NO: 1546641 - RNA, 21 nt, Homo sapiens
auauuaaggaagacaauguga

SEQ ID NO: 1546642 - RNA, 13 nt, Homo sapiens
auauucaaguaac

SEQ ID NO: 1546643 - RNA, 17 nt, Homo sapiens
auauuuaccagaccaca

SEQ ID NO: 1546644 - RNA, 23 nt, Homo sapiens
auauuuucuggguuaaaacccca

SEQ ID NO: 1546645 - RNA, 17 nt, Homo sapiens
aucaacuaggggaggag

SEQ ID NO: 1546646 - RNA, 22 nt, Homo sapiens
aucaggggauguacaucucucc

SEQ ID NO: 1546647 - RNA, 13 nt, Homo sapiens
auccauuccucuu

SEQ ID NO: 1546648 - RNA, 16 nt, Homo sapiens
auccauuccucuuacu

SEQ ID NO: 1546649 - RNA, 23 nt, Homo sapiens
auccucuggaaaaggcuuucaug

SEQ ID NO: 1546650 - RNA, 18 nt, Homo sapiens
auccugagugugaugaac

SEQ ID NO: 1546651 - RNA, 23 nt, Homo sapiens
aucgcucguguguucuauccaaa

SEQ ID NO: 1546652 - RNA, 13 nt, Homo sapiens
aucuagcauuuau

SEQ ID NO: 1546653 - RNA, 20 nt, Homo sapiens
aucucugugauuaccucuca

SEQ ID NO: 1546654 - RNA, 18 nt, Homo sapiens
aucugauuagaaguauaa

SEQ ID NO: 1546655 - RNA, 16 nt, Homo sapiens
aucugccgcuuugucu

SEQ ID NO: 1546656 - RNA, 18 nt, Homo sapiens
aucugucuuucaucuccc

SEQ ID NO: 1546657 - RNA, 20 nt, Homo sapiens
augaaaaaaaguacauguau

SEQ ID NO: 1546658 - RNA, 23 nt, Homo sapiens
augaaaagucguuuuccaaacug

SEQ ID NO: 1546659 - RNA, 20 nt, Homo sapiens
augaaggagugcgugccugc

SEQ ID NO: 1546660 - RNA, 11 nt, Homo sapiens
augaauucuua

SEQ ID NO: 1546661 - RNA, 14 nt, Homo sapiens
augacaucagcaau

SEQ ID NO: 1546662 - RNA, 19 nt, Homo sapiens
augacaucagcaauacaga

SEQ ID NO: 1546663 - RNA, 17 nt, Homo sapiens
augacugugaacugggc

SEQ ID NO: 1546664 - RNA, 20 nt, Homo sapiens
augagccuggcaagaaugug

SEQ ID NO: 1546665 - RNA, 22 nt, Homo sapiens
augaggggaggggggcacaugc

SEQ ID NO: 1546666 - RNA, 18 nt, Homo sapiens
augaguugcuggaaaauc

SEQ ID NO: 1546667 - RNA, 22 nt, Homo sapiens
augauccuaggcauuugcugaa

SEQ ID NO: 1546668 - RNA, 20 nt, Homo sapiens
augaugcccugcuccaggga

SEQ ID NO: 1546669 - RNA, 22 nt, Homo sapiens
augaugccgaacauuaggaauu

SEQ ID NO: 1546670 - RNA, 16 nt, Homo sapiens
augccagcuuaucuca

SEQ ID NO: 1546671 - RNA, 18 nt, Homo sapiens
augccagcuuaucucagg

SEQ ID NO: 1546672 - RNA, 14 nt, Homo sapiens
augcuuacaaaguc

SEQ ID NO: 1546673 - RNA, 15 nt, Homo sapiens
augcuucuacuguga

SEQ ID NO: 1546674 - RNA, 20 nt, Homo sapiens
augcuuugagaccagaagaa

SEQ ID NO: 1546675 - RNA, 14 nt, Homo sapiens
auggagaggaagaa

SEQ ID NO: 1546676 - RNA, 14 nt, Homo sapiens
auggcauugaacug

SEQ ID NO: 1546677 - RNA, 23 nt, Homo sapiens
auggcauugaacugguucaugaa

SEQ ID NO: 1546678 - RNA, 15 nt, Homo sapiens
augggggcaagaaga

SEQ ID NO: 1546679 - RNA, 19 nt, Homo sapiens
augucucuuggaaauguua

SEQ ID NO: 1546680 - RNA, 15 nt, Homo sapiens
auguguucaaugaaa

SEQ ID NO: 1546681 - RNA, 16 nt, Homo sapiens
auguguugcuuuggau

SEQ ID NO: 1546682 - RNA, 19 nt, Homo sapiens
auguguuuuucuccagugc

SEQ ID NO: 1546683 - RNA, 20 nt, Homo sapiens
auguuaagcauggauuuucc

SEQ ID NO: 1546684 - RNA, 20 nt, Homo sapiens
auguucaauagaacaugcaa

SEQ ID NO: 1546685 - RNA, 19 nt, Homo sapiens
auguuccucugucaaugaa

SEQ ID NO: 1546686 - RNA, 21 nt, Homo sapiens
auguuggacagacacuguugc

SEQ ID NO: 1546687 - RNA, 13 nt, Homo sapiens
auuaaagccuuaa

SEQ ID NO: 1546688 - RNA, 14 nt, Homo sapiens
auuaauaaagcauu

SEQ ID NO: 1546689 - RNA, 15 nt, Homo sapiens
auuaauaaagcauuc

SEQ ID NO: 1546690 - RNA, 21 nt, Homo sapiens
auuaauaaagcauucuuuaac

SEQ ID NO: 1546691 - RNA, 23 nt, Homo sapiens
auuagaagaaaauggaugacaaa

SEQ ID NO: 1546692 - RNA, 18 nt, Homo sapiens
auuagcauuuugcuaaau

SEQ ID NO: 1546693 - RNA, 23 nt, Homo sapiens
auuagccaagugugguagagugu

SEQ ID NO: 1546694 - RNA, 17 nt, Homo sapiens
auuauacguacauacac

SEQ ID NO: 1546695 - RNA, 23 nt, Homo sapiens
auuauuugggagggaaaagggaa

SEQ ID NO: 1546696 - RNA, 17 nt, Homo sapiens
auucaaggcuuaucucu

SEQ ID NO: 1546697 - RNA, 14 nt, Homo sapiens
auucagcucugcaa

SEQ ID NO: 1546698 - RNA, 17 nt, Homo sapiens
auucagcucugcaagaa

SEQ ID NO: 1546699 - RNA, 12 nt, Homo sapiens
auucauucucau

SEQ ID NO: 1546700 - RNA, 18 nt, Homo sapiens
auucccccaucuagccau

SEQ ID NO: 1546701 - RNA, 21 nt, Homo sapiens
auuccuacaauuucuaugugg

SEQ ID NO: 1546702 - RNA, 14 nt, Homo sapiens
auuccuuacuugca

SEQ ID NO: 1546703 - RNA, 16 nt, Homo sapiens
auugaaaccauugugg

SEQ ID NO: 1546704 - RNA, 16 nt, Homo sapiens
auugaaauaguuucca

SEQ ID NO: 1546705 - RNA, 21 nt, Homo sapiens
auugaauguuuccaaccugga

SEQ ID NO: 1546706 - RNA, 17 nt, Homo sapiens
auugcaguuucauguau

SEQ ID NO: 1546707 - RNA, 16 nt, Homo sapiens
auugcugauaugcaag

SEQ ID NO: 1546708 - RNA, 17 nt, Homo sapiens
auuuaaagaaagaaugc

SEQ ID NO: 1546709 - RNA, 23 nt, Homo sapiens
auuuaagccaucaucagcuuaau

SEQ ID NO: 1546710 - RNA, 18 nt, Homo sapiens
auuuaauuaaagccuuaa

SEQ ID NO: 1546711 - RNA, 14 nt, Homo sapiens
auuucaugugaauc

SEQ ID NO: 1546712 - RNA, 18 nt, Homo sapiens
auuucauuccauugccua

SEQ ID NO: 1546713 - RNA, 21 nt, Homo sapiens
auuucuuagugcuucagaguu

SEQ ID NO: 1546714 - RNA, 20 nt, Homo sapiens
auuugaaaacauaaucugca

SEQ ID NO: 1546715 - RNA, 20 nt, Homo sapiens
auuugggagggaaaagggaa

SEQ ID NO: 1546716 - RNA, 15 nt, Homo sapiens
auuuguagauuuacu

SEQ ID NO: 1546717 - RNA, 21 nt, Homo sapiens
auuuguauuaauaaagcauuc

SEQ ID NO: 1546718 - RNA, 15 nt, Homo sapiens
auuuuaaauucucag

SEQ ID NO: 1546719 - RNA, 21 nt, Homo sapiens
auuuucaauuuggagcauuaa

SEQ ID NO: 1546720 - RNA, 14 nt, Homo sapiens
auuuuuaaucagca

SEQ ID NO: 1546721 - RNA, 22 nt, Homo sapiens
caaaaaaagcaucucacugcaa

SEQ ID NO: 1546722 - RNA, 18 nt, Homo sapiens
caaaauaaucuauauuaa

SEQ ID NO: 1546723 - RNA, 23 nt, Homo sapiens
caaaauguaaugucagacuuugc

SEQ ID NO: 1546724 - RNA, 19 nt, Homo sapiens
caaaaugugaggguggugg

SEQ ID NO: 1546725 - RNA, 16 nt, Homo sapiens
caaaauuguuuaccau

SEQ ID NO: 1546726 - RNA, 19 nt, Homo sapiens
caaaauuguuuaccauaga

SEQ ID NO: 1546727 - RNA, 23 nt, Homo sapiens
caaagccuccuccagccgccaug

SEQ ID NO: 1546728 - RNA, 15 nt, Homo sapiens
caaagucaacuucca

SEQ ID NO: 1546729 - RNA, 20 nt, Homo sapiens
caaauauugguuaguauuua

SEQ ID NO: 1546730 - RNA, 19 nt, Homo sapiens
caaaucauuauguuuccua

SEQ ID NO: 1546731 - RNA, 17 nt, Homo sapiens
caaauuuagaaagcuua

SEQ ID NO: 1546732 - RNA, 12 nt, Homo sapiens
caacaaaaggga

SEQ ID NO: 1546733 - RNA, 15 nt, Homo sapiens
caacaagcaagaucu

SEQ ID NO: 1546734 - RNA, 23 nt, Homo sapiens
caacagauggcugcgcaccaucu

SEQ ID NO: 1546735 - RNA, 15 nt, Homo sapiens
caacaucuuacuugu

SEQ ID NO: 1546736 - RNA, 14 nt, Homo sapiens
caacgacugccgug

SEQ ID NO: 1546737 - RNA, 15 nt, Homo sapiens
caacuugccaaaaug

SEQ ID NO: 1546738 - RNA, 21 nt, Homo sapiens
caacuugccaaaauguuggcu

SEQ ID NO: 1546739 - RNA, 17 nt, Homo sapiens
caagaaaguauuuggua

SEQ ID NO: 1546740 - RNA, 20 nt, Homo sapiens
caagagcaggaggugccuga

SEQ ID NO: 1546741 - RNA, 15 nt, Homo sapiens
caagcauuacuuuaa

SEQ ID NO: 1546742 - RNA, 19 nt, Homo sapiens
caagcauuacuuuaaccuc

SEQ ID NO: 1546743 - RNA, 22 nt, Homo sapiens
caaggagcaacagcgauggcag

SEQ ID NO: 1546744 - RNA, 13 nt, Homo sapiens
caagucauuccua

SEQ ID NO: 1546745 - RNA, 14 nt, Homo sapiens
caagugcugucuug

SEQ ID NO: 1546746 - RNA, 14 nt, Homo sapiens
caagugucaccucc

SEQ ID NO: 1546747 - RNA, 21 nt, Homo sapiens
caaugauacccaacaguuuau

SEQ ID NO: 1546748 - RNA, 20 nt, Homo sapiens
caauucucaaaagaaaaggc

SEQ ID NO: 1546749 - RNA, 15 nt, Homo sapiens
caauugcagaugcca

SEQ ID NO: 1546750 - RNA, 16 nt, Homo sapiens
caauugcagaugccaa

SEQ ID NO: 1546751 - RNA, 23 nt, Homo sapiens
cacagcucuccuccuccaucuca

SEQ ID NO: 1546752 - RNA, 21 nt, Homo sapiens
cacauaggaaaaugccaugaa

SEQ ID NO: 1546753 - RNA, 15 nt, Homo sapiens
cacauaggcuggugg

SEQ ID NO: 1546754 - RNA, 13 nt, Homo sapiens
caccagcagccug

SEQ ID NO: 1546755 - RNA, 16 nt, Homo sapiens
caccaucucugugauc

SEQ ID NO: 1546756 - RNA, 20 nt, Homo sapiens
cacccugucucaguaccucc

SEQ ID NO: 1546757 - RNA, 19 nt, Homo sapiens
caccucugcacaagcugca

SEQ ID NO: 1546758 - RNA, 23 nt, Homo sapiens
caccugcucuucuaccauuugaa

SEQ ID NO: 1546759 - RNA, 19 nt, Homo sapiens
cacgacugcccggcagggu

SEQ ID NO: 1546760 - RNA, 20 nt, Homo sapiens
cacgacuguuguacaagcuc

SEQ ID NO: 1546761 - RNA, 22 nt, Homo sapiens
cacgccacuggaguccacacuu

SEQ ID NO: 1546762 - RNA, 21 nt, Homo sapiens
cacgcuucaaggauauacugc

SEQ ID NO: 1546763 - RNA, 22 nt, Homo sapiens
cacugauucccucucccaccca

SEQ ID NO: 1546764 - RNA, 14 nt, Homo sapiens
cacuggaguccaca

SEQ ID NO: 1546765 - RNA, 13 nt, Homo sapiens
cacuguugcaaag

SEQ ID NO: 1546766 - RNA, 20 nt, Homo sapiens
cacuuagacacuuuaccucu

SEQ ID NO: 1546767 - RNA, 14 nt, Homo sapiens
cacuuaguaguuuu

SEQ ID NO: 1546768 - RNA, 16 nt, Homo sapiens
cacuuuaaaaccaguu

SEQ ID NO: 1546769 - RNA, 23 nt, Homo sapiens
cacuuuaaaaccaguuacccaaa

SEQ ID NO: 1546770 - RNA, 13 nt, Homo sapiens
cacuuuaccucuu

SEQ ID NO: 1546771 - RNA, 20 nt, Homo sapiens
cagaaauaguugucugugcu

SEQ ID NO: 1546772 - RNA, 21 nt, Homo sapiens
cagaaccuuggcgguuuauag

SEQ ID NO: 1546773 - RNA, 16 nt, Homo sapiens
cagaaguuugagauca

SEQ ID NO: 1546774 - RNA, 17 nt, Homo sapiens
cagaauuugcucgcuac

SEQ ID NO: 1546775 - RNA, 15 nt, Homo sapiens
cagaccagaccccaa

SEQ ID NO: 1546776 - RNA, 21 nt, Homo sapiens
cagaccagaccccaaaccagc

SEQ ID NO: 1546777 - RNA, 21 nt, Homo sapiens
cagacuacuucuuccccagau

SEQ ID NO: 1546778 - RNA, 16 nt, Homo sapiens
cagacuuugcugcauu

SEQ ID NO: 1546779 - RNA, 17 nt, Homo sapiens
cagagcagaucagucuu

SEQ ID NO: 1546780 - RNA, 14 nt, Homo sapiens
cagagccaccaggg

SEQ ID NO: 1546781 - RNA, 17 nt, Homo sapiens
cagagccccucaugcca

SEQ ID NO: 1546782 - RNA, 15 nt, Homo sapiens
cagaggaugcugaag

SEQ ID NO: 1546783 - RNA, 21 nt, Homo sapiens
cagaggaugcugaaguacagu

SEQ ID NO: 1546784 - RNA, 13 nt, Homo sapiens
cagagucacaagu

SEQ ID NO: 1546785 - RNA, 18 nt, Homo sapiens
cagaguuuguguguauuu

SEQ ID NO: 1546786 - RNA, 20 nt, Homo sapiens
cagaugccaaaaaagaugcc

SEQ ID NO: 1546787 - RNA, 12 nt, Homo sapiens
cagcacugccag

SEQ ID NO: 1546788 - RNA, 13 nt, Homo sapiens
cagcagaugccaa

SEQ ID NO: 1546789 - RNA, 20 nt, Homo sapiens
cagcagggcuggucaccucc

SEQ ID NO: 1546790 - RNA, 17 nt, Homo sapiens
cagcagucuaguucuuu

SEQ ID NO: 1546791 - RNA, 21 nt, Homo sapiens
cagcauuaaaaaaaaucaaaa

SEQ ID NO: 1546792 - RNA, 17 nt, Homo sapiens
cagccccaauccagaga

SEQ ID NO: 1546793 - RNA, 15 nt, Homo sapiens
cagccugcuccagcu

SEQ ID NO: 1546794 - RNA, 19 nt, Homo sapiens
cagccugggugacagagca

SEQ ID NO: 1546795 - RNA, 20 nt, Homo sapiens
cagccugggugacagagcaa

SEQ ID NO: 1546796 - RNA, 14 nt, Homo sapiens
cagcuccuuucaug

SEQ ID NO: 1546797 - RNA, 17 nt, Homo sapiens
cagcucucucuccugga

SEQ ID NO: 1546798 - RNA, 14 nt, Homo sapiens
caggagccaugaca

SEQ ID NO: 1546799 - RNA, 18 nt, Homo sapiens
caguauuuuccagccuua

SEQ ID NO: 1546800 - RNA, 21 nt, Homo sapiens
cagucacuuaacuuacaugac

SEQ ID NO: 1546801 - RNA, 16 nt, Homo sapiens
cagucaugcacucaca

SEQ ID NO: 1546802 - RNA, 19 nt, Homo sapiens
cagugcuucaacgauguga

SEQ ID NO: 1546803 - RNA, 15 nt, Homo sapiens
caguguugacauagc

SEQ ID NO: 1546804 - RNA, 17 nt, Homo sapiens
cauaaagucaucaaagu

SEQ ID NO: 1546805 - RNA, 23 nt, Homo sapiens
aaccagcccuugagucugucaca

SEQ ID NO: 1546806 - RNA, 22 nt, Homo sapiens
aaccauugucuuguucugugau

SEQ ID NO: 1546807 - RNA, 18 nt, Homo sapiens
aacccggugcaucuggca

SEQ ID NO: 1546808 - RNA, 21 nt, Homo sapiens
aacccugcuguuucauuguua

SEQ ID NO: 1546809 - RNA, 16 nt, Homo sapiens
aacgaugugacugcca

SEQ ID NO: 1546810 - RNA, 23 nt, Homo sapiens
aacuaaaguugaaaauacauucu

SEQ ID NO: 1546811 - RNA, 19 nt, Homo sapiens
aacuagggaagauaauauu

SEQ ID NO: 1546812 - RNA, 20 nt, Homo sapiens
aacucaacugggcucugucc

SEQ ID NO: 1546813 - RNA, 14 nt, Homo sapiens
aacucuuaaaaccc

SEQ ID NO: 1546814 - RNA, 17 nt, Homo sapiens
aacugcuuuauuuuccc

SEQ ID NO: 1546815 - RNA, 14 nt, Homo sapiens
aacuguacauguga

SEQ ID NO: 1546816 - RNA, 23 nt, Homo sapiens
aacuguauuucaguauuuuccag

SEQ ID NO: 1546817 - RNA, 16 nt, Homo sapiens
aacuuagacuccucuu

SEQ ID NO: 1546818 - RNA, 15 nt, Homo sapiens
aacuucuacauucaa

SEQ ID NO: 1546819 - RNA, 20 nt, Homo sapiens
aacuuuguuuagcccaaaac

SEQ ID NO: 1546820 - RNA, 14 nt, Homo sapiens
aagaaagaaugcau

SEQ ID NO: 1546821 - RNA, 17 nt, Homo sapiens
aagaaauaaugccucca

SEQ ID NO: 1546822 - RNA, 14 nt, Homo sapiens
aagaacaugaaucu

SEQ ID NO: 1546823 - RNA, 21 nt, Homo sapiens
aagaacugaauccauauuuca

SEQ ID NO: 1546824 - RNA, 21 nt, Homo sapiens
aagaauguagucagacugaca

SEQ ID NO: 1546825 - RNA, 14 nt, Homo sapiens
aagacagagcagau

SEQ ID NO: 1546826 - RNA, 15 nt, Homo sapiens
aagacaugcuugggu

SEQ ID NO: 1546827 - RNA, 11 nt, Homo sapiens
aagaccaccuu

SEQ ID NO: 1546828 - RNA, 14 nt, Homo sapiens
aagacccaacuugc

SEQ ID NO: 1546829 - RNA, 19 nt, Homo sapiens
aagagaaaaaauauuuucc

SEQ ID NO: 1546830 - RNA, 16 nt, Homo sapiens
aagagaaccauaucaa

SEQ ID NO: 1546831 - RNA, 18 nt, Homo sapiens
aagaggcuuuugggccaa

SEQ ID NO: 1546832 - RNA, 15 nt, Homo sapiens
aagagggacagagcc

SEQ ID NO: 1546833 - RNA, 15 nt, Homo sapiens
aagauuuggaaaauu

SEQ ID NO: 1546834 - RNA, 20 nt, Homo sapiens
aagcauaaaaauuagccaag

SEQ ID NO: 1546835 - RNA, 13 nt, Homo sapiens
aagcauucuuuaa

SEQ ID NO: 1546836 - RNA, 19 nt, Homo sapiens
aagccuuaagcacaauuaa

SEQ ID NO: 1546837 - RNA, 17 nt, Homo sapiens
aagcgaauguguacaaa

SEQ ID NO: 1546838 - RNA, 14 nt, Homo sapiens
aagcuaaucugccu

SEQ ID NO: 1546839 - RNA, 20 nt, Homo sapiens
aagcucaggaggcgaauaaa

SEQ ID NO: 1546840 - RNA, 20 nt, Homo sapiens
aaggccacggccuugugucu

SEQ ID NO: 1546841 - RNA, 18 nt, Homo sapiens
aaggcugugcaggcacau

SEQ ID NO: 1546842 - RNA, 16 nt, Homo sapiens
aagggcaucauccuca

SEQ ID NO: 1546843 - RNA, 18 nt, Homo sapiens
aaggguggaaaaaugccc

SEQ ID NO: 1546844 - RNA, 15 nt, Homo sapiens
aagguucacucucaa

SEQ ID NO: 1546845 - RNA, 12 nt, Homo sapiens
aaguacauguau

SEQ ID NO: 1546846 - RNA, 15 nt, Homo sapiens
aaguacuuuaccuga

SEQ ID NO: 1546847 - RNA, 12 nt, Homo sapiens
aaguauuugaaa

SEQ ID NO: 1546848 - RNA, 17 nt, Homo sapiens
aagucaguggcuuugca

SEQ ID NO: 1546849 - RNA, 20 nt, Homo sapiens
aagucuccagucaccuacaa

SEQ ID NO: 1546850 - RNA, 22 nt, Homo sapiens
aagugagacccugucucaaaaa

SEQ ID NO: 1546851 - RNA, 12 nt, Homo sapiens
aaguuugaacuu

SEQ ID NO: 1546852 - RNA, 16 nt, Homo sapiens
aauaaaaguacugaag

SEQ ID NO: 1546853 - RNA, 19 nt, Homo sapiens
aauaaagcauucuuuaaca

SEQ ID NO: 1546854 - RNA, 20 nt, Homo sapiens
aauaaaugguuucucauuaa

SEQ ID NO: 1546855 - RNA, 20 nt, Homo sapiens
aauaauacaguaucucaggg

SEQ ID NO: 1546856 - RNA, 13 nt, Homo sapiens
aauacaacaugua

SEQ ID NO: 1546857 - RNA, 22 nt, Homo sapiens
aauauauauaguuagauuccaa

SEQ ID NO: 1546858 - RNA, 20 nt, Homo sapiens
aauaugcgggacaugaugcu

SEQ ID NO: 1546859 - RNA, 15 nt, Homo sapiens
aauauucagauauaa

SEQ ID NO: 1546860 - RNA, 23 nt, Homo sapiens
aauccagucccaaugguccugac

SEQ ID NO: 1546861 - RNA, 21 nt, Homo sapiens
aaugaaaaaaaguacauguau

SEQ ID NO: 1546862 - RNA, 16 nt, Homo sapiens
aaugaauuucauguga

SEQ ID NO: 1546863 - RNA, 19 nt, Homo sapiens
aaugagaaggagucagaaa

SEQ ID NO: 1546864 - RNA, 20 nt, Homo sapiens
aaugauugguuaaaauguga

SEQ ID NO: 1546865 - RNA, 23 nt, Homo sapiens
aaugauugguuaaaaugugauuu

SEQ ID NO: 1546866 - RNA, 14 nt, Homo sapiens
aaugguauggccaa

SEQ ID NO: 1546867 - RNA, 19 nt, Homo sapiens
aauguagcccucuccaaau

SEQ ID NO: 1546868 - RNA, 22 nt, Homo sapiens
aaugugauuuuucuucagguaa

SEQ ID NO: 1546869 - RNA, 12 nt, Homo sapiens
aauguguacaaa

SEQ ID NO: 1546870 - RNA, 23 nt, Homo sapiens
aauguuuccaaccuggaguauaa

SEQ ID NO: 1546871 - RNA, 14 nt, Homo sapiens
aauuaaagccuuaa

SEQ ID NO: 1546872 - RNA, 20 nt, Homo sapiens
aauuaaagccuuaagcacaa

SEQ ID NO: 1546873 - RNA, 21 nt, Homo sapiens
aauuaaagccuuaagcacaau

SEQ ID NO: 1546874 - RNA, 21 nt, Homo sapiens
aauuaaauaaacuguuuucaa

SEQ ID NO: 1546875 - RNA, 17 nt, Homo sapiens
aauuaaaugugagcaaa

SEQ ID NO: 1546876 - RNA, 17 nt, Homo sapiens
aauuagaagaaaaugga

SEQ ID NO: 1546877 - RNA, 21 nt, Homo sapiens
aauuaguuccucauuagcauu

SEQ ID NO: 1546878 - RNA, 16 nt, Homo sapiens
aauuaugcacuaaaua

SEQ ID NO: 1546879 - RNA, 21 nt, Homo sapiens
aauucagcauguguucauucu

SEQ ID NO: 1546880 - RNA, 23 nt, Homo sapiens
aauugcuuuugaaaaacaacugc

SEQ ID NO: 1546881 - RNA, 13 nt, Homo sapiens
aauuguacaagca

SEQ ID NO: 1546882 - RNA, 18 nt, Homo sapiens
aauuguuuaccauagaaa

SEQ ID NO: 1546883 - RNA, 16 nt, Homo sapiens
acaaacaaacauuguu

SEQ ID NO: 1546884 - RNA, 15 nt, Homo sapiens
acaacagauggcugc

SEQ ID NO: 1546885 - RNA, 16 nt, Homo sapiens
acaacugcauaaccuu

SEQ ID NO: 1546886 - RNA, 15 nt, Homo sapiens
acaaucagcagucua

SEQ ID NO: 1546887 - RNA, 13 nt, Homo sapiens
acaaugugaaaag

SEQ ID NO: 1546888 - RNA, 13 nt, Homo sapiens
acacaacuuugca

SEQ ID NO: 1546889 - RNA, 15 nt, Homo sapiens
acacaacuuugcaaa

SEQ ID NO: 1546890 - RNA, 21 nt, Homo sapiens
acacacaguccaacucuucca

SEQ ID NO: 1546891 - RNA, 10 nt, Homo sapiens
acacaugugc

SEQ ID NO: 1546892 - RNA, 12 nt, Homo sapiens
acacaugugcug

SEQ ID NO: 1546893 - RNA, 16 nt, Homo sapiens
acaccuuuucuauuua

SEQ ID NO: 1546894 - RNA, 21 nt, Homo sapiens
acaccuuuucuauuuaccucc

SEQ ID NO: 1546895 - RNA, 22 nt, Homo sapiens
acaccuuuucuauuuaccuccu

SEQ ID NO: 1546896 - RNA, 15 nt, Homo sapiens
acagacacuguugca

SEQ ID NO: 1546897 - RNA, 20 nt, Homo sapiens
acagacagggagaaguugag

SEQ ID NO: 1546898 - RNA, 20 nt, Homo sapiens
acagagaaauccuaaaagag

SEQ ID NO: 1546899 - RNA, 18 nt, Homo sapiens
acagagcagaucagucuu

SEQ ID NO: 1546900 - RNA, 21 nt, Homo sapiens
acagaugugaaggacaugaga

SEQ ID NO: 1546901 - RNA, 15 nt, Homo sapiens
acagcagaugccaaa

SEQ ID NO: 1546902 - RNA, 20 nt, Homo sapiens
acagcagcagcaaacaaaua

SEQ ID NO: 1546903 - RNA, 14 nt, Homo sapiens
acaguaucucaggg

SEQ ID NO: 1546904 - RNA, 19 nt, Homo sapiens
acagugcucgaccuugaua

SEQ ID NO: 1546905 - RNA, 22 nt, Homo sapiens
acaguugaaaaacagcugaggg

SEQ ID NO: 1546906 - RNA, 20 nt, Homo sapiens
acauacaaauauauguauau

SEQ ID NO: 1546907 - RNA, 21 nt, Homo sapiens
acauaggaaaaugccaugaaa

SEQ ID NO: 1546908 - RNA, 21 nt, Homo sapiens
acaucagcuuucuaauguucu

SEQ ID NO: 1546909 - RNA, 17 nt, Homo sapiens
acauccugagugugaug

SEQ ID NO: 1546910 - RNA, 20 nt, Homo sapiens
acaucuguggacaagacaug

SEQ ID NO: 1546911 - RNA, 19 nt, Homo sapiens
acauuaaacaaugaucaca

SEQ ID NO: 1546912 - RNA, 16 nt, Homo sapiens
acauugcugauaugca

SEQ ID NO: 1546913 - RNA, 13 nt, Homo sapiens
accaauguucucu

SEQ ID NO: 1546914 - RNA, 24 nt, Homo sapiens
accaugauuaaccacuucagcuga

SEQ ID NO: 1546915 - RNA, 15 nt, Homo sapiens
accauguauguggua

SEQ ID NO: 1546916 - RNA, 17 nt, Homo sapiens
acccaacuugccaaaau

SEQ ID NO: 1546917 - RNA, 19 nt, Homo sapiens
acccaauauuuaccagacc

SEQ ID NO: 1546918 - RNA, 15 nt, Homo sapiens
acccaccucugccac

SEQ ID NO: 1546919 - RNA, 13 nt, Homo sapiens
acccaugaagcug

SEQ ID NO: 1546920 - RNA, 20 nt, Homo sapiens
accccaccugaccucugcaa

SEQ ID NO: 1546921 - RNA, 16 nt, Homo sapiens
accccucaacaccucu

SEQ ID NO: 1546922 - RNA, 18 nt, Homo sapiens
accgagguguugccagug

SEQ ID NO: 1546923 - RNA, 19 nt, Homo sapiens
aggagaacguuugguacaa

SEQ ID NO: 1546924 - RNA, 15 nt, Homo sapiens
aggagcaacagcgau

SEQ ID NO: 1546925 - RNA, 18 nt, Homo sapiens
aggaguuugagaccaacc

SEQ ID NO: 1546926 - RNA, 17 nt, Homo sapiens
aggaucagcacugccag

SEQ ID NO: 1546927 - RNA, 14 nt, Homo sapiens
aggaucuguacaau

SEQ ID NO: 1546928 - RNA, 21 nt, Homo sapiens
aggaugaaagugaccauguuu

SEQ ID NO: 1546929 - RNA, 15 nt, Homo sapiens
aggccucugccccaa

SEQ ID NO: 1546930 - RNA, 11 nt, Homo sapiens
aggcucagucu

SEQ ID NO: 1546931 - RNA, 11 nt, Homo sapiens
aggcuuucaug

SEQ ID NO: 1546932 - RNA, 15 nt, Homo sapiens
agggacaaugccaau

SEQ ID NO: 1546933 - RNA, 15 nt, Homo sapiens
agggauagcgcuguu

SEQ ID NO: 1546934 - RNA, 17 nt, Homo sapiens
aggggaggagagagggu

SEQ ID NO: 1546935 - RNA, 18 nt, Homo sapiens
agggucuccaguguuccc

SEQ ID NO: 1546936 - RNA, 21 nt, Homo sapiens
aggguuuggauuuuaacuuuu

SEQ ID NO: 1546937 - RNA, 15 nt, Homo sapiens
agguaacacuacaga

SEQ ID NO: 1546938 - RNA, 23 nt, Homo sapiens
aggucaugaaggacacucugcag

SEQ ID NO: 1546939 - RNA, 17 nt, Homo sapiens
aggucccuccucagacc

SEQ ID NO: 1546940 - RNA, 22 nt, Homo sapiens
aggugaacagcaggaugcccug

SEQ ID NO: 1546941 - RNA, 22 nt, Homo sapiens
aggugagaccucaaaucacugc

SEQ ID NO: 1546942 - RNA, 16 nt, Homo sapiens
aggugcaaacaaacaa

SEQ ID NO: 1546943 - RNA, 13 nt, Homo sapiens
agguuagaaugau

SEQ ID NO: 1546944 - RNA, 17 nt, Homo sapiens
agguucgggauucccug

SEQ ID NO: 1546945 - RNA, 11 nt, Homo sapiens
aguacugaaga

SEQ ID NO: 1546946 - RNA, 19 nt, Homo sapiens
aguacuuccuggacaagau

SEQ ID NO: 1546947 - RNA, 13 nt, Homo sapiens
aguagaauuuuag

SEQ ID NO: 1546948 - RNA, 14 nt, Homo sapiens
aguagaugccuguu

SEQ ID NO: 1546949 - RNA, 20 nt, Homo sapiens
aguauaaaucuaugauauau

SEQ ID NO: 1546950 - RNA, 20 nt, Homo sapiens
aguauguccuucagcugacu

SEQ ID NO: 1546951 - RNA, 21 nt, Homo sapiens
aguauuuaacuacaucugccu

SEQ ID NO: 1546952 - RNA, 14 nt, Homo sapiens
agucagacugacac

SEQ ID NO: 1546953 - RNA, 16 nt, Homo sapiens
agucaguggcuuugca

SEQ ID NO: 1546954 - RNA, 16 nt, Homo sapiens
aguccaaaugugauca

SEQ ID NO: 1546955 - RNA, 16 nt, Homo sapiens
agucugucacacucuc

SEQ ID NO: 1546956 - RNA, 20 nt, Homo sapiens
agugaaacguaauuguacaa

SEQ ID NO: 1546957 - RNA, 18 nt, Homo sapiens
agugacugcaagcauuuu

SEQ ID NO: 1546958 - RNA, 21 nt, Homo sapiens
agugccugcugggugccaggu

SEQ ID NO: 1546959 - RNA, 18 nt, Homo sapiens
agugcuguccaugcuucu

SEQ ID NO: 1546960 - RNA, 21 nt, Homo sapiens
agugcuguccaugcuucucau

SEQ ID NO: 1546961 - RNA, 21 nt, Homo sapiens
agugcuucaacgaugugacug

SEQ ID NO: 1546962 - RNA, 19 nt, Homo sapiens
agugggugaauaauacagu

SEQ ID NO: 1546963 - RNA, 13 nt, Homo sapiens
agugguuacccag

SEQ ID NO: 1546964 - RNA, 21 nt, Homo sapiens
aguguauauuuuugguggugg

SEQ ID NO: 1546965 - RNA, 14 nt, Homo sapiens
aguguugacauagc

SEQ ID NO: 1546966 - RNA, 18 nt, Homo sapiens
aguuaaaaucacauuuua

SEQ ID NO: 1546967 - RNA, 19 nt, Homo sapiens
aguuaaaaucacauuuuaa

SEQ ID NO: 1546968 - RNA, 22 nt, Homo sapiens
aguuccuauaccuuacugacac

SEQ ID NO: 1546969 - RNA, 15 nt, Homo sapiens
aguugauucagcucu

SEQ ID NO: 1546970 - RNA, 20 nt, Homo sapiens
aguuggcccuucugcccuua

SEQ ID NO: 1546971 - RNA, 14 nt, Homo sapiens
aguuguccaugaca

SEQ ID NO: 1546972 - RNA, 21 nt, Homo sapiens
aguuugcuuauguaaucucac

SEQ ID NO: 1546973 - RNA, 16 nt, Homo sapiens
auaaaaaugcaacgcu

SEQ ID NO: 1546974 - RNA, 18 nt, Homo sapiens
auaaagaaacuuuugaaa

SEQ ID NO: 1546975 - RNA, 11 nt, Homo sapiens
auaaagcauuc

SEQ ID NO: 1546976 - RNA, 13 nt, Homo sapiens
auaaagcauucuu

SEQ ID NO: 1546977 - RNA, 16 nt, Homo sapiens
auaaagcauucuuuaa

SEQ ID NO: 1546978 - RNA, 19 nt, Homo sapiens
auaaauagaaagaguucua

SEQ ID NO: 1546979 - RNA, 15 nt, Homo sapiens
auaagucuacauuaa

SEQ ID NO: 1546980 - RNA, 14 nt, Homo sapiens
auaaguguucagug

SEQ ID NO: 1546981 - RNA, 21 nt, Homo sapiens
auaaguguucaguguugacau

SEQ ID NO: 1546982 - RNA, 17 nt, Homo sapiens
auaauacaguaucucag

SEQ ID NO: 1546983 - RNA, 23 nt, Homo sapiens
auaauauuaaggaagacaaugug

SEQ ID NO: 1546984 - RNA, 18 nt, Homo sapiens
auaauuccuacagcacua

SEQ ID NO: 1546985 - RNA, 15 nt, Homo sapiens
auacaguaucucagg

SEQ ID NO: 1546986 - RNA, 14 nt, Homo sapiens
auacauacauacaa

SEQ ID NO: 1546987 - RNA, 17 nt, Homo sapiens
auagaaagaugacaaaa

SEQ ID NO: 1546988 - RNA, 21 nt, Homo sapiens
auagcauggggccccuggccc

SEQ ID NO: 1546989 - RNA, 21 nt, Homo sapiens
auagccuaauacaacauguag

SEQ ID NO: 1546990 - RNA, 14 nt, Homo sapiens
auaguuagauucca

SEQ ID NO: 1546991 - RNA, 13 nt, Homo sapiens
auaguugucugug

SEQ ID NO: 1546992 - RNA, 14 nt, Homo sapiens
auauauaccacuuu

SEQ ID NO: 1546993 - RNA, 23 nt, Homo sapiens
auaucauggaauuuccauugaca

SEQ ID NO: 1546994 - RNA, 17 nt, Homo sapiens
auauucaaguaacacuu

SEQ ID NO: 1546995 - RNA, 18 nt, Homo sapiens
auauuuauaucauauaua

SEQ ID NO: 1546996 - RNA, 21 nt, Homo sapiens
auauuuuuggugguggugggu

SEQ ID NO: 1546997 - RNA, 12 nt, Homo sapiens
aucagacuguag

SEQ ID NO: 1546998 - RNA, 21 nt, Homo sapiens
aucagccugggcaaugugaua

SEQ ID NO: 1546999 - RNA, 23 nt, Homo sapiens
aucagucuuugucaaugcucuaa

SEQ ID NO: 1547000 - RNA, 13 nt, Homo sapiens
aucaugucuguau

SEQ ID NO: 1547001 - RNA, 21 nt, Homo sapiens
auccacuucaggagcccuacu

SEQ ID NO: 1547002 - RNA, 21 nt, Homo sapiens
auccccaccccagcuguuacc

SEQ ID NO: 1547003 - RNA, 20 nt, Homo sapiens
auccuaaaagagaucugggc

SEQ ID NO: 1547004 - RNA, 15 nt, Homo sapiens
auccuaggcauuugc

SEQ ID NO: 1547005 - RNA, 18 nt, Homo sapiens
aucuagugcuagauguau

SEQ ID NO: 1547006 - RNA, 11 nt, Homo sapiens
aucuguacaau

SEQ ID NO: 1547007 - RNA, 12 nt, Homo sapiens
aucugucuuuca

SEQ ID NO: 1547008 - RNA, 14 nt, Homo sapiens
aucugugcagucau

SEQ ID NO: 1547009 - RNA, 20 nt, Homo sapiens
aucugugcagucaucaacaa

SEQ ID NO: 1547010 - RNA, 14 nt, Homo sapiens
aucuucuauucuag

SEQ ID NO: 1547011 - RNA, 23 nt, Homo sapiens
aucuuuguguaaucuaaguauau

SEQ ID NO: 1547012 - RNA, 20 nt, Homo sapiens
aucuuuguuuaaaugccaaa

SEQ ID NO: 1547013 - RNA, 14 nt, Homo sapiens
augaacgugccuga

SEQ ID NO: 1547014 - RNA, 13 nt, Homo sapiens
augagcaaccugg

SEQ ID NO: 1547015 - RNA, 16 nt, Homo sapiens
augaguuucugaggau

SEQ ID NO: 1547016 - RNA, 22 nt, Homo sapiens
augcagagggugggguacugga

SEQ ID NO: 1547017 - RNA, 17 nt, Homo sapiens
augcauuuucuucagaa

SEQ ID NO: 1547018 - RNA, 16 nt, Homo sapiens
augccacgugccauug

SEQ ID NO: 1547019 - RNA, 16 nt, Homo sapiens
augcccgcacaguaau

SEQ ID NO: 1547020 - RNA, 20 nt, Homo sapiens
augcccuauggccuaugugc

SEQ ID NO: 1547021 - RNA, 15 nt, Homo sapiens
auggaaaggacagug

SEQ ID NO: 1547022 - RNA, 20 nt, Homo sapiens
auggaacuuagacuccucuu

SEQ ID NO: 1547023 - RNA, 17 nt, Homo sapiens
auggagcaaaacaaagc

SEQ ID NO: 1547024 - RNA, 15 nt, Homo sapiens
auggaguguuugaaa

SEQ ID NO: 1547025 - RNA, 14 nt, Homo sapiens
auggauuuccagcc

SEQ ID NO: 1547026 - RNA, 22 nt, Homo sapiens
auguacgauaaaguaacaguau

SEQ ID NO: 1547027 - RNA, 15 nt, Homo sapiens
auguauuaauacuua

SEQ ID NO: 1547028 - RNA, 15 nt, Homo sapiens
augucagacuuugcu

SEQ ID NO: 1547029 - RNA, 16 nt, Homo sapiens
augucucuuggaaaug

SEQ ID NO: 1547030 - RNA, 21 nt, Homo sapiens
augucugucagaagacacuaa

SEQ ID NO: 1547031 - RNA, 22 nt, Homo sapiens
augugauaaaaccccaucucua

SEQ ID NO: 1547032 - RNA, 15 nt, Homo sapiens
augugcgaagcaaga

SEQ ID NO: 1547033 - RNA, 13 nt, Homo sapiens
auguggucuuaug

SEQ ID NO: 1547034 - RNA, 18 nt, Homo sapiens
auguuucucccauaggcu

SEQ ID NO: 1547035 - RNA, 16 nt, Homo sapiens
auuaaccacuucagcu

SEQ ID NO: 1547036 - RNA, 16 nt, Homo sapiens
auuaauaaagcauucu

SEQ ID NO: 1547037 - RNA, 19 nt, Homo sapiens
auuaauguuucuucuccaa

SEQ ID NO: 1547038 - RNA, 23 nt, Homo sapiens
auuacuacuuaccauuugcuacu

SEQ ID NO: 1547039 - RNA, 18 nt, Homo sapiens
auuacugccuuacuguac

SEQ ID NO: 1547040 - RNA, 16 nt, Homo sapiens
auuacuugugcacuua

SEQ ID NO: 1547041 - RNA, 19 nt, Homo sapiens
cuucggggaccagcccaca

SEQ ID NO: 1547042 - RNA, 16 nt, Homo sapiens
cuucguuagaccgcuc

SEQ ID NO: 1547043 - RNA, 16 nt, Homo sapiens
cuucucuuuaugucaa

SEQ ID NO: 1547044 - RNA, 12 nt, Homo sapiens
cuugauugcuca

SEQ ID NO: 1547045 - RNA, 11 nt, Homo sapiens
cuugcacuguc

SEQ ID NO: 1547046 - RNA, 16 nt, Homo sapiens
cuugccucuuucucca

SEQ ID NO: 1547047 - RNA, 17 nt, Homo sapiens
cuugcuuuuugcugugu

SEQ ID NO: 1547048 - RNA, 21 nt, Homo sapiens
cuuggaaauguuaagaaagaa

SEQ ID NO: 1547049 - RNA, 12 nt, Homo sapiens
cuuggagcugcc

SEQ ID NO: 1547050 - RNA, 15 nt, Homo sapiens
cuuguguguuuugag

SEQ ID NO: 1547051 - RNA, 13 nt, Homo sapiens
cuuuauugcacua

SEQ ID NO: 1547052 - RNA, 18 nt, Homo sapiens
cuuuauugcacuaggaau

SEQ ID NO: 1547053 - RNA, 19 nt, Homo sapiens
cuuucaauugcagaugcca

SEQ ID NO: 1547054 - RNA, 14 nt, Homo sapiens
cuuucacuacucaa

SEQ ID NO: 1547055 - RNA, 19 nt, Homo sapiens
cuuuccucucuuuguucuc

SEQ ID NO: 1547056 - RNA, 13 nt, Homo sapiens
cuuucugugcaug

SEQ ID NO: 1547057 - RNA, 15 nt, Homo sapiens
cuuugaaaacauaca

SEQ ID NO: 1547058 - RNA, 21 nt, Homo sapiens
cuuugcauuccuuacuugcac

SEQ ID NO: 1547059 - RNA, 16 nt, Homo sapiens
cuuugcccaacaccag

SEQ ID NO: 1547060 - RNA, 20 nt, Homo sapiens
cuuugcugcauuuuacacau

SEQ ID NO: 1547061 - RNA, 12 nt, Homo sapiens
cuuuucuaugga

SEQ ID NO: 1547062 - RNA, 15 nt, Homo sapiens
cuuuugaaaugccac

SEQ ID NO: 1547063 - RNA, 16 nt, Homo sapiens
cuuuugaaaugccacg

SEQ ID NO: 1547064 - RNA, 12 nt, Homo sapiens
gaaaaacagagg

SEQ ID NO: 1547065 - RNA, 14 nt, Homo sapiens
gaaaaaggaaaaau

SEQ ID NO: 1547066 - RNA, 18 nt, Homo sapiens
gaaaaauguagacucuga

SEQ ID NO: 1547067 - RNA, 15 nt, Homo sapiens
gaaaagaaaccagag

SEQ ID NO: 1547068 - RNA, 21 nt, Homo sapiens
gaaaagaaaccagagucaaau

SEQ ID NO: 1547069 - RNA, 16 nt, Homo sapiens
gaaaagacuuaccuga

SEQ ID NO: 1547070 - RNA, 13 nt, Homo sapiens
gaaaaggcuuuca

SEQ ID NO: 1547071 - RNA, 22 nt, Homo sapiens
gaaaaguagacaaucauuguuu

SEQ ID NO: 1547072 - RNA, 15 nt, Homo sapiens
gaaaaucaaugcuuu

SEQ ID NO: 1547073 - RNA, 23 nt, Homo sapiens
gaaaccuucagauuuguguuaua

SEQ ID NO: 1547074 - RNA, 18 nt, Homo sapiens
gaaacgagaagugcccuu

SEQ ID NO: 1547075 - RNA, 14 nt, Homo sapiens
gaaagaugacaaaa

SEQ ID NO: 1547076 - RNA, 13 nt, Homo sapiens
gaaaggccaauaa

SEQ ID NO: 1547077 - RNA, 15 nt, Homo sapiens
gaaagugaccauguu

SEQ ID NO: 1547078 - RNA, 12 nt, Homo sapiens
gaaauacuuuug

SEQ ID NO: 1547079 - RNA, 18 nt, Homo sapiens
gaaauguuuguccuugca

SEQ ID NO: 1547080 - RNA, 12 nt, Homo sapiens
gaaccauaucaa

SEQ ID NO: 1547081 - RNA, 12 nt, Homo sapiens
gaacuguucaca

SEQ ID NO: 1547082 - RNA, 21 nt, Homo sapiens
gaacuugcuauggaaaggaca

SEQ ID NO: 1547083 - RNA, 20 nt, Homo sapiens
gaagcaaagauuucaguaga

SEQ ID NO: 1547084 - RNA, 19 nt, Homo sapiens
gaaggaauccugguggaag

SEQ ID NO: 1547085 - RNA, 18 nt, Homo sapiens
gaaggagugcgugccugc

SEQ ID NO: 1547086 - RNA, 14 nt, Homo sapiens
gaaggaguucacug

SEQ ID NO: 1547087 - RNA, 18 nt, Homo sapiens
gaauaauacaguaucuca

SEQ ID NO: 1547088 - RNA, 19 nt, Homo sapiens
gaaugggcaugaauggaga

SEQ ID NO: 1547089 - RNA, 20 nt, Homo sapiens
gaauuauaauuaguuccuca

SEQ ID NO: 1547090 - RNA, 19 nt, Homo sapiens
gaauuggcauaauuugucu

SEQ ID NO: 1547091 - RNA, 14 nt, Homo sapiens
gacaaugccaauag

SEQ ID NO: 1547092 - RNA, 15 nt, Homo sapiens
gaccccaaaccagcc

SEQ ID NO: 1547093 - RNA, 22 nt, Homo sapiens
gaccccuuucccccaccccaga

SEQ ID NO: 1547094 - RNA, 16 nt, Homo sapiens
gacccuggaaauggac

SEQ ID NO: 1547095 - RNA, 16 nt, Homo sapiens
gacccuuuguugaaaa

SEQ ID NO: 1547096 - RNA, 13 nt, Homo sapiens
gacuaauguugga

SEQ ID NO: 1547097 - RNA, 14 nt, Homo sapiens
gacugacacuacua

SEQ ID NO: 1547098 - RNA, 17 nt, Homo sapiens
gacuguaggauuugaag

SEQ ID NO: 1547099 - RNA, 17 nt, Homo sapiens
gacugugcccaguacuu

SEQ ID NO: 1547100 - RNA, 15 nt, Homo sapiens
gagaacauggccaau

SEQ ID NO: 1547101 - RNA, 22 nt, Homo sapiens
gagaaggaacugauacaucuga

SEQ ID NO: 1547102 - RNA, 12 nt, Homo sapiens
gagaagugcccu

SEQ ID NO: 1547103 - RNA, 14 nt, Homo sapiens
gagacccacagccc

SEQ ID NO: 1547104 - RNA, 21 nt, Homo sapiens
gagaggaucuaggaugggaga

SEQ ID NO: 1547105 - RNA, 15 nt, Homo sapiens
gagauuggauuugcu

SEQ ID NO: 1547106 - RNA, 23 nt, Homo sapiens
gagcaacagcgauggcagugaga

SEQ ID NO: 1547107 - RNA, 12 nt, Homo sapiens
gagcagcaucua

SEQ ID NO: 1547108 - RNA, 22 nt, Homo sapiens
gagcauaauaaauuauauuaaa

SEQ ID NO: 1547109 - RNA, 18 nt, Homo sapiens
gagccaccagggcacugu

SEQ ID NO: 1547110 - RNA, 18 nt, Homo sapiens
gagcccagagaagcugga

SEQ ID NO: 1547111 - RNA, 21 nt, Homo sapiens
gagccgagauugcaccacugc

SEQ ID NO: 1547112 - RNA, 12 nt, Homo sapiens
gagccuguccaa

SEQ ID NO: 1547113 - RNA, 21 nt, Homo sapiens
gagcuguguccugcaguuccc

SEQ ID NO: 1547114 - RNA, 21 nt, Homo sapiens
gaggacuacuuuccagaauuu

SEQ ID NO: 1547115 - RNA, 14 nt, Homo sapiens
gaggaucagcacug

SEQ ID NO: 1547116 - RNA, 22 nt, Homo sapiens
gaggaucagcacugccagugga

SEQ ID NO: 1547117 - RNA, 20 nt, Homo sapiens
gaggcaggaggaucacuuga

SEQ ID NO: 1547118 - RNA, 16 nt, Homo sapiens
gagggaggcaucugca

SEQ ID NO: 1547119 - RNA, 21 nt, Homo sapiens
gaggguuuccuucggggacca

SEQ ID NO: 1547120 - RNA, 23 nt, Homo sapiens
gaguaaugauguaacagugcaag

SEQ ID NO: 1547121 - RNA, 12 nt, Homo sapiens
gagucugucaca

SEQ ID NO: 1547122 - RNA, 19 nt, Homo sapiens
gaguuacuuagaaugccau

SEQ ID NO: 1547123 - RNA, 15 nt, Homo sapiens
gauauauaccacuuu

SEQ ID NO: 1547124 - RNA, 15 nt, Homo sapiens
gauauauuuauauca

SEQ ID NO: 1547125 - RNA, 16 nt, Homo sapiens
gauauauuuauaucau

SEQ ID NO: 1547126 - RNA, 19 nt, Homo sapiens
gaucauagguauuucaaaa

SEQ ID NO: 1547127 - RNA, 19 nt, Homo sapiens
gauccuguuccucaacaag

SEQ ID NO: 1547128 - RNA, 15 nt, Homo sapiens
gaucgacgugaucaa

SEQ ID NO: 1547129 - RNA, 18 nt, Homo sapiens
gaucucgggacucagauu

SEQ ID NO: 1547130 - RNA, 15 nt, Homo sapiens
gaucuguacuuugug

SEQ ID NO: 1547131 - RNA, 20 nt, Homo sapiens
gaugaggggaggggggcaca

SEQ ID NO: 1547132 - RNA, 20 nt, Homo sapiens
gaugccaaaaaagaugccaa

SEQ ID NO: 1547133 - RNA, 15 nt, Homo sapiens
gaugcccucaacuca

SEQ ID NO: 1547134 - RNA, 10 nt, Homo sapiens
gauggcccaa

SEQ ID NO: 1547135 - RNA, 16 nt, Homo sapiens
gaugggcgucacuacu

SEQ ID NO: 1547136 - RNA, 14 nt, Homo sapiens
gaugugacugccau

SEQ ID NO: 1547137 - RNA, 21 nt, Homo sapiens
gauugacugugcccaguacuu

SEQ ID NO: 1547138 - RNA, 18 nt, Homo sapiens
gauugagaagggacaagc

SEQ ID NO: 1547139 - RNA, 19 nt, Homo sapiens
gauuugaggacugaagcug

SEQ ID NO: 1547140 - RNA, 13 nt, Homo sapiens
gauuuguguuaua

SEQ ID NO: 1547141 - RNA, 16 nt, Homo sapiens
gauuuuaaaaagggua

SEQ ID NO: 1547142 - RNA, 17 nt, Homo sapiens
gauuuuauuuaaacuau

SEQ ID NO: 1547143 - RNA, 22 nt, Homo sapiens
gcaaaaccuugugacucagugu

SEQ ID NO: 1547144 - RNA, 16 nt, Homo sapiens
gcaaacccaugaagcu

SEQ ID NO: 1547145 - RNA, 20 nt, Homo sapiens
gcaagaucugcucgcugaga

SEQ ID NO: 1547146 - RNA, 18 nt, Homo sapiens
gcaauuuucgaacauucu

SEQ ID NO: 1547147 - RNA, 21 nt, Homo sapiens
gcacaauuaauuaaaagugaa

SEQ ID NO: 1547148 - RNA, 22 nt, Homo sapiens
gcacaauuaauuaaaagugaaa

SEQ ID NO: 1547149 - RNA, 18 nt, Homo sapiens
gcacauagcucaaucaca

SEQ ID NO: 1547150 - RNA, 20 nt, Homo sapiens
gcaccacugcacuccagccu

SEQ ID NO: 1547151 - RNA, 18 nt, Homo sapiens
gcaccccugccuccugcc

SEQ ID NO: 1547152 - RNA, 17 nt, Homo sapiens
gcaccucaugcagaggg

SEQ ID NO: 1547153 - RNA, 18 nt, Homo sapiens
gcacuagagaaugcacag

SEQ ID NO: 1547154 - RNA, 9 nt, Homo sapiens
gcacuguuu

SEQ ID NO: 1547155 - RNA, 21 nt, Homo sapiens
gcagaaaaugaacugcuuugg

SEQ ID NO: 1547156 - RNA, 23 nt, Homo sapiens
gcagagccaccagggcacugucu

SEQ ID NO: 1547157 - RNA, 23 nt, Homo sapiens
gcagcaaacaaauaaaaugaaau

SEQ ID NO: 1547158 - RNA, 20 nt, Homo sapiens
gcagcauuaaaaaaaaucaa

SEQ ID NO: 1547159 - RNA, 21 nt, Homo sapiens
gcagcuaccacgggucugcca

SEQ ID NO: 1547160 - RNA, 23 nt, Homo sapiens
ugaguuucugaggaucagcacug

SEQ ID NO: 1547161 - RNA, 22 nt, Homo sapiens
ugaucacaucuaaagcuuuauc

SEQ ID NO: 1547162 - RNA, 21 nt, Homo sapiens
ugaucuuuguuuaaaugccaa

SEQ ID NO: 1547163 - RNA, 16 nt, Homo sapiens
ugaugcaggcacuuau

SEQ ID NO: 1547164 - RNA, 17 nt, Homo sapiens
ugauguuucacauaaaa

SEQ ID NO: 1547165 - RNA, 21 nt, Homo sapiens
ugauuaccagucugauuauac

SEQ ID NO: 1547166 - RNA, 20 nt, Homo sapiens
ugauuucuugugauguauuc

SEQ ID NO: 1547167 - RNA, 17 nt, Homo sapiens
ugcaaacucuauaaaga

SEQ ID NO: 1547168 - RNA, 15 nt, Homo sapiens
ugcaaacugcuuuau

SEQ ID NO: 1547169 - RNA, 17 nt, Homo sapiens
ugcaaggagcaacagcg

SEQ ID NO: 1547170 - RNA, 15 nt, Homo sapiens
ugcaagucacauaaa

SEQ ID NO: 1547171 - RNA, 12 nt, Homo sapiens
ugcacacuaaga

SEQ ID NO: 1547172 - RNA, 16 nt, Homo sapiens
ugcacuccagccuggg

SEQ ID NO: 1547173 - RNA, 12 nt, Homo sapiens
ugcagagcaaug

SEQ ID NO: 1547174 - RNA, 23 nt, Homo sapiens
ugcagcaacucccacgacuguug

SEQ ID NO: 1547175 - RNA, 21 nt, Homo sapiens
ugcagcauuaaaaaaaaucaa

SEQ ID NO: 1547176 - RNA, 23 nt, Homo sapiens
ugcagcuugugcugagccugccc

SEQ ID NO: 1547177 - RNA, 16 nt, Homo sapiens
ugcaguguuaguauuc

SEQ ID NO: 1547178 - RNA, 21 nt, Homo sapiens
ugcauaacagcagaugccaaa

SEQ ID NO: 1547179 - RNA, 14 nt, Homo sapiens
ugcauaaccuuuac

SEQ ID NO: 1547180 - RNA, 20 nt, Homo sapiens
ugcauuccuuacuugcacug

SEQ ID NO: 1547181 - RNA, 18 nt, Homo sapiens
ugccaagaaaguauuugg

SEQ ID NO: 1547182 - RNA, 19 nt, Homo sapiens
ugccagcuuaucucagggg

SEQ ID NO: 1547183 - RNA, 23 nt, Homo sapiens
ugccaugccagcuuaucucaggg

SEQ ID NO: 1547184 - RNA, 18 nt, Homo sapiens
ugcccaggucccuccuca

SEQ ID NO: 1547185 - RNA, 19 nt, Homo sapiens
ugcccaggucccuccucag

SEQ ID NO: 1547186 - RNA, 22 nt, Homo sapiens
ugcccguaaaaccugagccauu

SEQ ID NO: 1547187 - RNA, 22 nt, Homo sapiens
ugcccuuaccccacacacaguc

SEQ ID NO: 1547188 - RNA, 17 nt, Homo sapiens
ugccuccaacccagcag

SEQ ID NO: 1547189 - RNA, 13 nt, Homo sapiens
ugccugauuagau

SEQ ID NO: 1547190 - RNA, 21 nt, Homo sapiens
ugccuguuuugagaccagaag

SEQ ID NO: 1547191 - RNA, 20 nt, Homo sapiens
ugcgcuguggacacugagaa

SEQ ID NO: 1547192 - RNA, 13 nt, Homo sapiens
ugcuaaaugugaa

SEQ ID NO: 1547193 - RNA, 22 nt, Homo sapiens
ugcuaagcuaaagaaacugcuu

SEQ ID NO: 1547194 - RNA, 23 nt, Homo sapiens
ugcuaagcuaaagaaacugcuua

SEQ ID NO: 1547195 - RNA, 21 nt, Homo sapiens
ugcuaauggaauuacugccuu

SEQ ID NO: 1547196 - RNA, 17 nt, Homo sapiens
ugcuacccucauuucac

SEQ ID NO: 1547197 - RNA, 18 nt, Homo sapiens
ugcuaccugcaccucugg

SEQ ID NO: 1547198 - RNA, 21 nt, Homo sapiens
ugcuaugcuaaaccuccugcc

SEQ ID NO: 1547199 - RNA, 11 nt, Homo sapiens
ugcucauguau

SEQ ID NO: 1547200 - RNA, 21 nt, Homo sapiens
ugcucuguaggagcuacccuu

SEQ ID NO: 1547201 - RNA, 18 nt, Homo sapiens
ugcugcuguucuguguac

SEQ ID NO: 1547202 - RNA, 23 nt, Homo sapiens
ugcuuaguauucuugagggacaa

SEQ ID NO: 1547203 - RNA, 20 nt, Homo sapiens
ugcuucagaguuugugugua

SEQ ID NO: 1547204 - RNA, 21 nt, Homo sapiens
ugcuucucuucuuuauugcac

SEQ ID NO: 1547205 - RNA, 21 nt, Homo sapiens
ugcuugagcuuucugugcaug

SEQ ID NO: 1547206 - RNA, 22 nt, Homo sapiens
ugcuugagcuuucugugcaugu

SEQ ID NO: 1547207 - RNA, 14 nt, Homo sapiens
ugcuugcuggugcc

SEQ ID NO: 1547208 - RNA, 22 nt, Homo sapiens
ugcuuuauuuucccuacuugca

SEQ ID NO: 1547209 - RNA, 15 nt, Homo sapiens
ugcuuugacaaggca

SEQ ID NO: 1547210 - RNA, 14 nt, Homo sapiens
uggaaaccaagcaa

SEQ ID NO: 1547211 - RNA, 14 nt, Homo sapiens
uggacacugagaac

SEQ ID NO: 1547212 - RNA, 20 nt, Homo sapiens
uggacagacacuguugcaaa

SEQ ID NO: 1547213 - RNA, 16 nt, Homo sapiens
uggagcaaaacaaagc

SEQ ID NO: 1547214 - RNA, 22 nt, Homo sapiens
uggaggaacacagagaaauccu

SEQ ID NO: 1547215 - RNA, 15 nt, Homo sapiens
uggaguuagaucucu

SEQ ID NO: 1547216 - RNA, 20 nt, Homo sapiens
uggauucaggugcuggagaa

SEQ ID NO: 1547217 - RNA, 12 nt, Homo sapiens
uggcaccagcag

SEQ ID NO: 1547218 - RNA, 14 nt, Homo sapiens
uggcaugggacaga

SEQ ID NO: 1547219 - RNA, 16 nt, Homo sapiens
uggccaauagucauau

SEQ ID NO: 1547220 - RNA, 14 nt, Homo sapiens
uggcccuucugccc

SEQ ID NO: 1547221 - RNA, 19 nt, Homo sapiens
uggcugagccuggcuggag

SEQ ID NO: 1547222 - RNA, 15 nt, Homo sapiens
uggcuuuuugucaaa

SEQ ID NO: 1547223 - RNA, 16 nt, Homo sapiens
ugggaggaugaaggag

SEQ ID NO: 1547224 - RNA, 21 nt, Homo sapiens
ugggaggaugaaggagugcgu

SEQ ID NO: 1547225 - RNA, 17 nt, Homo sapiens
ugggagggaaaagggaa

SEQ ID NO: 1547226 - RNA, 13 nt, Homo sapiens
ugggaucugccaa

SEQ ID NO: 1547227 - RNA, 22 nt, Homo sapiens
ugggaugcggggcagagccacc

SEQ ID NO: 1547228 - RNA, 21 nt, Homo sapiens
ugggccagccccagcaccuca

SEQ ID NO: 1547229 - RNA, 14 nt, Homo sapiens
ugggcccuagagga

SEQ ID NO: 1547230 - RNA, 22 nt, Homo sapiens
ugggggaucacagccucugaaa

SEQ ID NO: 1547231 - RNA, 23 nt, Homo sapiens
ugggguacuggaguuagaucucu

SEQ ID NO: 1547232 - RNA, 20 nt, Homo sapiens
ugggugaauaauacaguauc

SEQ ID NO: 1547233 - RNA, 19 nt, Homo sapiens
uggucuaccaaucugggaa

SEQ ID NO: 1547234 - RNA, 12 nt, Homo sapiens
ugguuaaaucau

SEQ ID NO: 1547235 - RNA, 22 nt, Homo sapiens
ugguuuuuaaaaaacugcugac

SEQ ID NO: 1547236 - RNA, 14 nt, Homo sapiens
uguaaaugcauuag

SEQ ID NO: 1547237 - RNA, 13 nt, Homo sapiens
uguagaucaggga

SEQ ID NO: 1547238 - RNA, 20 nt, Homo sapiens
uguagcccucuccaaaucaa

SEQ ID NO: 1547239 - RNA, 15 nt, Homo sapiens
uguauuaauaaagca

SEQ ID NO: 1547240 - RNA, 24 nt, Homo sapiens
ugucaaaauuguuuaccauagaaa

SEQ ID NO: 1547241 - RNA, 20 nt, Homo sapiens
ugucagacuuugcugcauuu

SEQ ID NO: 1547242 - RNA, 16 nt, Homo sapiens
ugucauuucauuccau

SEQ ID NO: 1547243 - RNA, 13 nt, Homo sapiens
uguccgucccgcu

SEQ ID NO: 1547244 - RNA, 17 nt, Homo sapiens
uguccugauggcccaaa

SEQ ID NO: 1547245 - RNA, 16 nt, Homo sapiens
uguccugcaguuccca

SEQ ID NO: 1547246 - RNA, 12 nt, Homo sapiens
ugugacugccau

SEQ ID NO: 1547247 - RNA, 17 nt, Homo sapiens
ugugacugccaucaucu

SEQ ID NO: 1547248 - RNA, 13 nt, Homo sapiens
ugugauaaaaccc

SEQ ID NO: 1547249 - RNA, 13 nt, Homo sapiens
ugugauuaccucu

SEQ ID NO: 1547250 - RNA, 15 nt, Homo sapiens
ugugcauauguuaaa

SEQ ID NO: 1547251 - RNA, 18 nt, Homo sapiens
ugugcccaguacuuccug

SEQ ID NO: 1547252 - RNA, 21 nt, Homo sapiens
uguguacauaaagucaucaaa

SEQ ID NO: 1547253 - RNA, 10 nt, Homo sapiens
ugugugcaug

SEQ ID NO: 1547254 - RNA, 22 nt, Homo sapiens
uguguggagaacucagugccac

SEQ ID NO: 1547255 - RNA, 12 nt, Homo sapiens
ugugugucugua

SEQ ID NO: 1547256 - RNA, 13 nt, Homo sapiens
uguucaagcuuuu

SEQ ID NO: 1547257 - RNA, 13 nt, Homo sapiens
uguucacacugca

SEQ ID NO: 1547258 - RNA, 21 nt, Homo sapiens
uguucaguguugacauagccu

SEQ ID NO: 1547259 - RNA, 14 nt, Homo sapiens
uguucuaaguauuu

SEQ ID NO: 1547260 - RNA, 12 nt, Homo sapiens
uguucuguguac

SEQ ID NO: 1547261 - RNA, 12 nt, Homo sapiens
uguugacauagc

SEQ ID NO: 1547262 - RNA, 13 nt, Homo sapiens
uguugacauagcc

SEQ ID NO: 1547263 - RNA, 21 nt, Homo sapiens
uguuuacagggagccuccugc

SEQ ID NO: 1547264 - RNA, 18 nt, Homo sapiens
uguuuagcccaaaaccaa

SEQ ID NO: 1547265 - RNA, 22 nt, Homo sapiens
uguuuauacacaacuuugcaaa

SEQ ID NO: 1547266 - RNA, 19 nt, Homo sapiens
uguuugggaagguggguga

SEQ ID NO: 1547267 - RNA, 16 nt, Homo sapiens
uuaaaaaaaaauuccc

SEQ ID NO: 1547268 - RNA, 24 nt, Homo sapiens
uuaaaacuaaaaaggaccagagaa

SEQ ID NO: 1547269 - RNA, 18 nt, Homo sapiens
uuaaaugaacuacugcua

SEQ ID NO: 1547270 - RNA, 16 nt, Homo sapiens
uuaacuuauugcauaa

SEQ ID NO: 1547271 - RNA, 20 nt, Homo sapiens
uuaagccuguaauuauguaa

SEQ ID NO: 1547272 - RNA, 20 nt, Homo sapiens
uuaauaaagcauucuuuaac

SEQ ID NO: 1547273 - RNA, 22 nt, Homo sapiens
uuaauaaagcauucuuuaacag

SEQ ID NO: 1547274 - RNA, 14 nt, Homo sapiens
uuaauauaaaccca

SEQ ID NO: 1547275 - RNA, 15 nt, Homo sapiens
uuaauuaaagccuua

SEQ ID NO: 1547276 - RNA, 21 nt, Homo sapiens
uuacaaaacugcuuugugcau

SEQ ID NO: 1547277 - RNA, 23 nt, Homo sapiens
uuacuguacauacaaauucuacu

SEQ ID NO: 1547278 - RNA, 18 nt, Homo sapiens
aaguacagucccagcaca

SEQ ID NO: 1547279 - RNA, 16 nt, Homo sapiens
aaguacuuuaccugaa

SEQ ID NO: 1547280 - RNA, 23 nt, Homo sapiens
aaguagccucugggaucugccaa

SEQ ID NO: 1547281 - RNA, 18 nt, Homo sapiens
aagucacauaaaaaugca

SEQ ID NO: 1547282 - RNA, 23 nt, Homo sapiens
aagugaaggacauagagguauau

SEQ ID NO: 1547283 - RNA, 14 nt, Homo sapiens
aaguguaauagauu

SEQ ID NO: 1547284 - RNA, 13 nt, Homo sapiens
aaguguacaugaa

SEQ ID NO: 1547285 - RNA, 17 nt, Homo sapiens
aaguucaacuuccagaa

SEQ ID NO: 1547286 - RNA, 22 nt, Homo sapiens
aaguucuucuccaauccuauca

SEQ ID NO: 1547287 - RNA, 13 nt, Homo sapiens
aaguuugagauca

SEQ ID NO: 1547288 - RNA, 18 nt, Homo sapiens
aauaaaaauguucuuaca

SEQ ID NO: 1547289 - RNA, 20 nt, Homo sapiens
aauaaauauuguguugugca

SEQ ID NO: 1547290 - RNA, 20 nt, Homo sapiens
aauaaguauccaguacuuua

SEQ ID NO: 1547291 - RNA, 21 nt, Homo sapiens
aauacagacuacuucuucccc

SEQ ID NO: 1547292 - RNA, 14 nt, Homo sapiens
aauaggcauuugau

SEQ ID NO: 1547293 - RNA, 20 nt, Homo sapiens
aauauauguauauauauucu

SEQ ID NO: 1547294 - RNA, 22 nt, Homo sapiens
aauauccuguaauaaagcucuu

SEQ ID NO: 1547295 - RNA, 14 nt, Homo sapiens
aauaugacacagcu

SEQ ID NO: 1547296 - RNA, 11 nt, Homo sapiens
aauccaugcuu

SEQ ID NO: 1547297 - RNA, 24 nt, Homo sapiens
aaucuuuuguuuuaauauaagaau

SEQ ID NO: 1547298 - RNA, 15 nt, Homo sapiens
aaugaaauaaaagca

SEQ ID NO: 1547299 - RNA, 16 nt, Homo sapiens
aaugaacuacugcuau

SEQ ID NO: 1547300 - RNA, 15 nt, Homo sapiens
aaugagccuguccaa

SEQ ID NO: 1547301 - RNA, 19 nt, Homo sapiens
aaugaugauccuaggcauu

SEQ ID NO: 1547302 - RNA, 20 nt, Homo sapiens
aaugcacgcgugcauaugcu

SEQ ID NO: 1547303 - RNA, 20 nt, Homo sapiens
aaugcauuccagaacaaauu

SEQ ID NO: 1547304 - RNA, 12 nt, Homo sapiens
aaugccaugaaa

SEQ ID NO: 1547305 - RNA, 16 nt, Homo sapiens
aaugcugagcugaaga

SEQ ID NO: 1547306 - RNA, 16 nt, Homo sapiens
aauguauuuuucuaca

SEQ ID NO: 1547307 - RNA, 16 nt, Homo sapiens
aaugucaggguucugc

SEQ ID NO: 1547308 - RNA, 21 nt, Homo sapiens
aauguuggacagacacuguug

SEQ ID NO: 1547309 - RNA, 14 nt, Homo sapiens
aauguugggagaaa

SEQ ID NO: 1547310 - RNA, 15 nt, Homo sapiens
aauuaaaaacuuuaa

SEQ ID NO: 1547311 - RNA, 13 nt, Homo sapiens
aauuaaagccuua

SEQ ID NO: 1547312 - RNA, 14 nt, Homo sapiens
aauuacugccuuac

SEQ ID NO: 1547313 - RNA, 18 nt, Homo sapiens
aauuacugccuuacugua

SEQ ID NO: 1547314 - RNA, 22 nt, Homo sapiens
aauuacugccuuacuguacaua

SEQ ID NO: 1547315 - RNA, 18 nt, Homo sapiens
aauuauacguacauacac

SEQ ID NO: 1547316 - RNA, 21 nt, Homo sapiens
aauuauuuauuacuugugcac

SEQ ID NO: 1547317 - RNA, 14 nt, Homo sapiens
aauucaauuuggca

SEQ ID NO: 1547318 - RNA, 15 nt, Homo sapiens
aauucauaccucccu

SEQ ID NO: 1547319 - RNA, 12 nt, Homo sapiens
aauuccuaguca

SEQ ID NO: 1547320 - RNA, 16 nt, Homo sapiens
aauuccuagucacaau

SEQ ID NO: 1547321 - RNA, 20 nt, Homo sapiens
aauucucagucaugcacuca

SEQ ID NO: 1547322 - RNA, 20 nt, Homo sapiens
aauucucucaagacuucucc

SEQ ID NO: 1547323 - RNA, 17 nt, Homo sapiens
aauuggaacaaagugaa

SEQ ID NO: 1547324 - RNA, 22 nt, Homo sapiens
aauuguuuauacacaacuuugc

SEQ ID NO: 1547325 - RNA, 16 nt, Homo sapiens
aauuuagaaagcuuaa

SEQ ID NO: 1547326 - RNA, 13 nt, Homo sapiens
aauuugggcagcu

SEQ ID NO: 1547327 - RNA, 14 nt, Homo sapiens
aauuuuuccaugaa

SEQ ID NO: 1547328 - RNA, 20 nt, Homo sapiens
acaaaacugcuuugugcaua

SEQ ID NO: 1547329 - RNA, 15 nt, Homo sapiens
acaaagcacuagaga

SEQ ID NO: 1547330 - RNA, 22 nt, Homo sapiens
acaaaugaaauaaauauugugu

SEQ ID NO: 1547331 - RNA, 12 nt, Homo sapiens
acaacuuugcaa

SEQ ID NO: 1547332 - RNA, 19 nt, Homo sapiens
acaagcuuacuuccauugc

SEQ ID NO: 1547333 - RNA, 18 nt, Homo sapiens
acaaguagccucugggau

SEQ ID NO: 1547334 - RNA, 18 nt, Homo sapiens
acaaugaugccgaacauu

SEQ ID NO: 1547335 - RNA, 11 nt, Homo sapiens
acaaugccaau

SEQ ID NO: 1547336 - RNA, 17 nt, Homo sapiens
acacaggaguccuuucu

SEQ ID NO: 1547337 - RNA, 14 nt, Homo sapiens
acacaguccaacuc

SEQ ID NO: 1547338 - RNA, 22 nt, Homo sapiens
acacaugugcugauguuuacaa

SEQ ID NO: 1547339 - RNA, 17 nt, Homo sapiens
acacauucuuaacacau

SEQ ID NO: 1547340 - RNA, 21 nt, Homo sapiens
acacauucuuaacacaugucc

SEQ ID NO: 1547341 - RNA, 17 nt, Homo sapiens
acaccaugauuaaccac

SEQ ID NO: 1547342 - RNA, 16 nt, Homo sapiens
acacccgcacugccca

SEQ ID NO: 1547343 - RNA, 16 nt, Homo sapiens
acaccuuagucuuucc

SEQ ID NO: 1547344 - RNA, 16 nt, Homo sapiens
acacucaaaagcuggg

SEQ ID NO: 1547345 - RNA, 16 nt, Homo sapiens
acacugcagagacuaa

SEQ ID NO: 1547346 - RNA, 13 nt, Homo sapiens
acacuuuaccucu

SEQ ID NO: 1547347 - RNA, 20 nt, Homo sapiens
acagaauuuuaaagagcaua

SEQ ID NO: 1547348 - RNA, 23 nt, Homo sapiens
acagacaccuuuucuauuuaccu

SEQ ID NO: 1547349 - RNA, 21 nt, Homo sapiens
acagcagcagcaaacaaauaa

SEQ ID NO: 1547350 - RNA, 18 nt, Homo sapiens
acagccucugaaaaccaa

SEQ ID NO: 1547351 - RNA, 20 nt, Homo sapiens
acagcucuccuccuccaucu

SEQ ID NO: 1547352 - RNA, 13 nt, Homo sapiens
acaggaaaccacu

SEQ ID NO: 1547353 - RNA, 12 nt, Homo sapiens
acaguaucucag

SEQ ID NO: 1547354 - RNA, 20 nt, Homo sapiens
acagucucugagaaguacuu

SEQ ID NO: 1547355 - RNA, 10 nt, Homo sapiens
acagugcaag

SEQ ID NO: 1547356 - RNA, 14 nt, Homo sapiens
acagugugggaggc

SEQ ID NO: 1547357 - RNA, 16 nt, Homo sapiens
acauacauacauacaa

SEQ ID NO: 1547358 - RNA, 16 nt, Homo sapiens
acauagaaacauacac

SEQ ID NO: 1547359 - RNA, 17 nt, Homo sapiens
acauaggaaaaugccau

SEQ ID NO: 1547360 - RNA, 23 nt, Homo sapiens
acauaggaaaaugccaugaaaau

SEQ ID NO: 1547361 - RNA, 10 nt, Homo sapiens
acaucugccu

SEQ ID NO: 1547362 - RNA, 19 nt, Homo sapiens
acaucugucuuucaucucc

SEQ ID NO: 1547363 - RNA, 15 nt, Homo sapiens
acaugagacuaagag

SEQ ID NO: 1547364 - RNA, 21 nt, Homo sapiens
acaugcugagucucccaaggc

SEQ ID NO: 1547365 - RNA, 20 nt, Homo sapiens
acauguuauuuaaccugagu

SEQ ID NO: 1547366 - RNA, 11 nt, Homo sapiens
accaaccuggg

SEQ ID NO: 1547367 - RNA, 14 nt, Homo sapiens
accacuuaucacau

SEQ ID NO: 1547368 - RNA, 14 nt, Homo sapiens
accacuucagcuga

SEQ ID NO: 1547369 - RNA, 13 nt, Homo sapiens
accagcuacccug

SEQ ID NO: 1547370 - RNA, 18 nt, Homo sapiens
accaggacuacagcuuuc

SEQ ID NO: 1547371 - RNA, 14 nt, Homo sapiens
accaucucugugau

SEQ ID NO: 1547372 - RNA, 20 nt, Homo sapiens
accaugauuaaccacuucag

SEQ ID NO: 1547373 - RNA, 15 nt, Homo sapiens
acccaacuugccaaa

SEQ ID NO: 1547374 - RNA, 16 nt, Homo sapiens
acccacagcccugaaa

SEQ ID NO: 1547375 - RNA, 14 nt, Homo sapiens
acccaccccagugc

SEQ ID NO: 1547376 - RNA, 15 nt, Homo sapiens
acccagccauguguu

SEQ ID NO: 1547377 - RNA, 16 nt, Homo sapiens
acccaguuagcucuca

SEQ ID NO: 1547378 - RNA, 15 nt, Homo sapiens
acccauaaguaauau

SEQ ID NO: 1547379 - RNA, 21 nt, Homo sapiens
accccaccugaccucugcaag

SEQ ID NO: 1547380 - RNA, 12 nt, Homo sapiens
accccagaguug

SEQ ID NO: 1547381 - RNA, 20 nt, Homo sapiens
acccccaaauuuaauuaaag

SEQ ID NO: 1547382 - RNA, 15 nt, Homo sapiens
acccugcgauuuugc

SEQ ID NO: 1547383 - RNA, 18 nt, Homo sapiens
acccuguagggugccauu

SEQ ID NO: 1547384 - RNA, 20 nt, Homo sapiens
accgaguuugcuaaauugag

SEQ ID NO: 1547385 - RNA, 17 nt, Homo sapiens
accuauccgcccugcag

SEQ ID NO: 1547386 - RNA, 20 nt, Homo sapiens
accucaggugagaagcagag

SEQ ID NO: 1547387 - RNA, 20 nt, Homo sapiens
accucgcucgaugacuguga

SEQ ID NO: 1547388 - RNA, 15 nt, Homo sapiens
accucugcacaagcu

SEQ ID NO: 1547389 - RNA, 23 nt, Homo sapiens
accugcgcuguggacacugagaa

SEQ ID NO: 1547390 - RNA, 19 nt, Homo sapiens
accuucccuuccucagcag

SEQ ID NO: 1547391 - RNA, 20 nt, Homo sapiens
accuuuucuauuuaccuccu

SEQ ID NO: 1547392 - RNA, 18 nt, Homo sapiens
acgacuguuguacaagcu

SEQ ID NO: 1547393 - RNA, 14 nt, Homo sapiens
acgggcucagcaaa

SEQ ID NO: 1547394 - RNA, 21 nt, Homo sapiens
acgggucugccaugcucugga

SEQ ID NO: 1547395 - RNA, 17 nt, Homo sapiens
acguaauuguacaagca

SEQ ID NO: 1547396 - RNA, 21 nt, Homo sapiens
acguaauuguacaagcaguua

SEQ ID NO: 1547397 - RNA, 13 nt, Homo sapiens
acuuuaccugaaa

SEQ ID NO: 1547398 - RNA, 22 nt, Homo sapiens
acuuuaccugaaagacaguaug

SEQ ID NO: 1547399 - RNA, 15 nt, Homo sapiens
acuuugaagccauaa

SEQ ID NO: 1547400 - RNA, 20 nt, Homo sapiens
agaaaccaagagaaguuuug

SEQ ID NO: 1547401 - RNA, 16 nt, Homo sapiens
agaaacugaagccgug

SEQ ID NO: 1547402 - RNA, 14 nt, Homo sapiens
agaaagaaugcauu

SEQ ID NO: 1547403 - RNA, 19 nt, Homo sapiens
agaaagaaugcauuccaga

SEQ ID NO: 1547404 - RNA, 16 nt, Homo sapiens
agaaagaugacaaaag

SEQ ID NO: 1547405 - RNA, 12 nt, Homo sapiens
agaaaguauuug

SEQ ID NO: 1547406 - RNA, 21 nt, Homo sapiens
agaaauagaggugaugcugcu

SEQ ID NO: 1547407 - RNA, 20 nt, Homo sapiens
agaaccaaaaguuuuccuga

SEQ ID NO: 1547408 - RNA, 16 nt, Homo sapiens
agaacuacgcacagcu

SEQ ID NO: 1547409 - RNA, 16 nt, Homo sapiens
agaagcacggcugugg

SEQ ID NO: 1547410 - RNA, 19 nt, Homo sapiens
agaaguacuuuaccugaaa

SEQ ID NO: 1547411 - RNA, 20 nt, Homo sapiens
agaaguauaaggugcucuga

SEQ ID NO: 1547412 - RNA, 22 nt, Homo sapiens
agaaugaucaucuguaaucuga

SEQ ID NO: 1547413 - RNA, 18 nt, Homo sapiens
agaaugcauuccagaaca

SEQ ID NO: 1547414 - RNA, 18 nt, Homo sapiens
agaauggaccaaccacuu

SEQ ID NO: 1547415 - RNA, 20 nt, Homo sapiens
agaauguucuccuaaaagac

SEQ ID NO: 1547416 - RNA, 18 nt, Homo sapiens
agacaaaccugggcaaug

SEQ ID NO: 1547417 - RNA, 22 nt, Homo sapiens
agacaaugugaaaagaaaaaug

SEQ ID NO: 1547418 - RNA, 16 nt, Homo sapiens
agacacuuuaccucuu

SEQ ID NO: 1547419 - RNA, 16 nt, Homo sapiens
agacagagcagaucag

SEQ ID NO: 1547420 - RNA, 17 nt, Homo sapiens
agacccaacuugccaaa

SEQ ID NO: 1547421 - RNA, 15 nt, Homo sapiens
agacccacagcccug

SEQ ID NO: 1547422 - RNA, 17 nt, Homo sapiens
agacccacagcccugaa

SEQ ID NO: 1547423 - RNA, 22 nt, Homo sapiens
agacuauuuuucuaugacuuag

SEQ ID NO: 1547424 - RNA, 21 nt, Homo sapiens
agaguacgugaaaugcucaag

SEQ ID NO: 1547425 - RNA, 19 nt, Homo sapiens
agaguagguacuccauaaa

SEQ ID NO: 1547426 - RNA, 21 nt, Homo sapiens
agaguugggaugcggggcaga

SEQ ID NO: 1547427 - RNA, 18 nt, Homo sapiens
agauaagucuacauuaaa

SEQ ID NO: 1547428 - RNA, 21 nt, Homo sapiens
agaucacgcuccccgccuguu

SEQ ID NO: 1547429 - RNA, 18 nt, Homo sapiens
agaucugcucgcugagaa

SEQ ID NO: 1547430 - RNA, 21 nt, Homo sapiens
agaugggcgucacuacugcua

SEQ ID NO: 1547431 - RNA, 22 nt, Homo sapiens
agauuucuuaaugucugucaga

SEQ ID NO: 1547432 - RNA, 12 nt, Homo sapiens
agcaaacaaaua

SEQ ID NO: 1547433 - RNA, 23 nt, Homo sapiens
agcaacagcgauggcagugagaa

SEQ ID NO: 1547434 - RNA, 15 nt, Homo sapiens
agcaaccuuucccuu

SEQ ID NO: 1547435 - RNA, 22 nt, Homo sapiens
agcaagaucugcucgcugagaa

SEQ ID NO: 1547436 - RNA, 12 nt, Homo sapiens
agcacaagaagc

SEQ ID NO: 1547437 - RNA, 21 nt, Homo sapiens
agcacauuuccucucuaucuu

SEQ ID NO: 1547438 - RNA, 22 nt, Homo sapiens
agcacuacugggugucauuuca

SEQ ID NO: 1547439 - RNA, 20 nt, Homo sapiens
agcaggcugacuaugugccg

SEQ ID NO: 1547440 - RNA, 23 nt, Homo sapiens
agcaucuaguuucccuggugccc

SEQ ID NO: 1547441 - RNA, 14 nt, Homo sapiens
agcauucuuuaaca

SEQ ID NO: 1547442 - RNA, 20 nt, Homo sapiens
agccacuagcccacucccca

SEQ ID NO: 1547443 - RNA, 17 nt, Homo sapiens
agccauugauucuucag

SEQ ID NO: 1547444 - RNA, 20 nt, Homo sapiens
agcccaacagacaccaucuu

SEQ ID NO: 1547445 - RNA, 18 nt, Homo sapiens
agcccacagcacaccaag

SEQ ID NO: 1547446 - RNA, 18 nt, Homo sapiens
agcccccacccaguuccu

SEQ ID NO: 1547447 - RNA, 12 nt, Homo sapiens
agcccucugugg

SEQ ID NO: 1547448 - RNA, 20 nt, Homo sapiens
agcccugucccugcccucag

SEQ ID NO: 1547449 - RNA, 22 nt, Homo sapiens
agcccugucccugcccucaggc

SEQ ID NO: 1547450 - RNA, 16 nt, Homo sapiens
agcccuucuaccccac

SEQ ID NO: 1547451 - RNA, 20 nt, Homo sapiens
agccgagauugcaccacugc

SEQ ID NO: 1547452 - RNA, 18 nt, Homo sapiens
agccucugggaucugcca

SEQ ID NO: 1547453 - RNA, 15 nt, Homo sapiens
agccuggcuggagag

SEQ ID NO: 1547454 - RNA, 18 nt, Homo sapiens
agccuuaagcacaauuaa

SEQ ID NO: 1547455 - RNA, 17 nt, Homo sapiens
agccuuagagcaucucu

SEQ ID NO: 1547456 - RNA, 21 nt, Homo sapiens
agcucccacacccaccucugc

SEQ ID NO: 1547457 - RNA, 20 nt, Homo sapiens
agcucuccuccuccaucuca

SEQ ID NO: 1547458 - RNA, 21 nt, Homo sapiens
agcugauuccagaacaaauca

SEQ ID NO: 1547459 - RNA, 20 nt, Homo sapiens
agcugcccugaggguuuccu

SEQ ID NO: 1547460 - RNA, 13 nt, Homo sapiens
agcugccgugccu

SEQ ID NO: 1547461 - RNA, 20 nt, Homo sapiens
agcuguguccugcaguuccc

SEQ ID NO: 1547462 - RNA, 21 nt, Homo sapiens
agcuuaaggcggccuacagaa

SEQ ID NO: 1547463 - RNA, 12 nt, Homo sapiens
agcuuaucucag

SEQ ID NO: 1547464 - RNA, 16 nt, Homo sapiens
agcuucuagacacucc

SEQ ID NO: 1547465 - RNA, 19 nt, Homo sapiens
agcuuucugcuaucaaaga

SEQ ID NO: 1547466 - RNA, 18 nt, Homo sapiens
aggaaaaaaggccacaaa

SEQ ID NO: 1547467 - RNA, 20 nt, Homo sapiens
aggaaaaugccaugaaaauu

SEQ ID NO: 1547468 - RNA, 15 nt, Homo sapiens
aggaagacaauguga

SEQ ID NO: 1547469 - RNA, 17 nt, Homo sapiens
aggaagaugggggcaag

SEQ ID NO: 1547470 - RNA, 17 nt, Homo sapiens
guguugccagugcuaag

SEQ ID NO: 1547471 - RNA, 17 nt, Homo sapiens
guguugugcagcauuaa

SEQ ID NO: 1547472 - RNA, 22 nt, Homo sapiens
guuauuaguccaaaugugauca

SEQ ID NO: 1547473 - RNA, 12 nt, Homo sapiens
guucucugccaa

SEQ ID NO: 1547474 - RNA, 17 nt, Homo sapiens
guugaaaaauguugcuc

SEQ ID NO: 1547475 - RNA, 22 nt, Homo sapiens
guugaaaaauguugcucuggga

SEQ ID NO: 1547476 - RNA, 14 nt, Homo sapiens
guuggaaauauuca

SEQ ID NO: 1547477 - RNA, 16 nt, Homo sapiens
guuggacagacacugu

SEQ ID NO: 1547478 - RNA, 20 nt, Homo sapiens
guuuauacacaacuuugcaa

SEQ ID NO: 1547479 - RNA, 22 nt, Homo sapiens
guuuauacacaacuuugcaaau

SEQ ID NO: 1547480 - RNA, 19 nt, Homo sapiens
guuucccuggugcccuucc

SEQ ID NO: 1547481 - RNA, 21 nt, Homo sapiens
guuucuugacaauggggucag

SEQ ID NO: 1547482 - RNA, 18 nt, Homo sapiens
guuuuauggagaccucuc

SEQ ID NO: 1547483 - RNA, 15 nt, Homo sapiens
guuuugagaccagaa

SEQ ID NO: 1547484 - RNA, 18 nt, Homo sapiens
guuuuguaccaacacaca

SEQ ID NO: 1547485 - RNA, 19 nt, Homo sapiens
guuuuuaaaaaacugcuga

SEQ ID NO: 1547486 - RNA, 17 nt, Homo sapiens
guuuuuguuuuuuucca

SEQ ID NO: 1547487 - RNA, 23 nt, Homo sapiens
uaaaaaggaccagagaauucuua

SEQ ID NO: 1547488 - RNA, 23 nt, Homo sapiens
uaaaaugugauuuuucuucaggu

SEQ ID NO: 1547489 - RNA, 17 nt, Homo sapiens
uaaaauugcaguuucau

SEQ ID NO: 1547490 - RNA, 14 nt, Homo sapiens
uaaacuguacaugu

SEQ ID NO: 1547491 - RNA, 23 nt, Homo sapiens
uaaacuuguguauugagucuuaa

SEQ ID NO: 1547492 - RNA, 20 nt, Homo sapiens
uaaagaaagaaugcauucca

SEQ ID NO: 1547493 - RNA, 21 nt, Homo sapiens
uaaagauauggagaauugcug

SEQ ID NO: 1547494 - RNA, 16 nt, Homo sapiens
uaaagcuugauuugau

SEQ ID NO: 1547495 - RNA, 12 nt, Homo sapiens
uaaagcuuuauc

SEQ ID NO: 1547496 - RNA, 21 nt, Homo sapiens
uaaagcuuuaucuuuguguaa

SEQ ID NO: 1547497 - RNA, 22 nt, Homo sapiens
uaaaguauguccuucagcugac

SEQ ID NO: 1547498 - RNA, 16 nt, Homo sapiens
uaaagucccuauagua

SEQ ID NO: 1547499 - RNA, 22 nt, Homo sapiens
uaaauaaaacagcagcagcaaa

SEQ ID NO: 1547500 - RNA, 12 nt, Homo sapiens
uaaaugcucaua

SEQ ID NO: 1547501 - RNA, 21 nt, Homo sapiens
uaaaugugaaugaugauccua

SEQ ID NO: 1547502 - RNA, 13 nt, Homo sapiens
uaaaugugagcaa

SEQ ID NO: 1547503 - RNA, 16 nt, Homo sapiens
uaacagcagaugccaa

SEQ ID NO: 1547504 - RNA, 14 nt, Homo sapiens
uaacaguaugucag

SEQ ID NO: 1547505 - RNA, 17 nt, Homo sapiens
uaacuaaaugcucauac

SEQ ID NO: 1547506 - RNA, 23 nt, Homo sapiens
uaacuguauuucaguauuuucca

SEQ ID NO: 1547507 - RNA, 22 nt, Homo sapiens
uaacuuauugcauaacagcaga

SEQ ID NO: 1547508 - RNA, 18 nt, Homo sapiens
uaagaaauaaugccucca

SEQ ID NO: 1547509 - RNA, 19 nt, Homo sapiens
uaagaccaccuucccuucc

SEQ ID NO: 1547510 - RNA, 14 nt, Homo sapiens
uaagacucauuccc

SEQ ID NO: 1547511 - RNA, 22 nt, Homo sapiens
uaaggcaacccccgguauauca

SEQ ID NO: 1547512 - RNA, 17 nt, Homo sapiens
uaagguaauucauggca

SEQ ID NO: 1547513 - RNA, 14 nt, Homo sapiens
uaagucuacauuaa

SEQ ID NO: 1547514 - RNA, 17 nt, Homo sapiens
uaaguguucaguguuga

SEQ ID NO: 1547515 - RNA, 20 nt, Homo sapiens
uaaguuuuuguaaaaggaaa

SEQ ID NO: 1547516 - RNA, 13 nt, Homo sapiens
uaauaacuuugaa

SEQ ID NO: 1547517 - RNA, 23 nt, Homo sapiens
uaauaggaauucaauuuggcaaa

SEQ ID NO: 1547518 - RNA, 18 nt, Homo sapiens
uaaucuccucugcucauu

SEQ ID NO: 1547519 - RNA, 23 nt, Homo sapiens
uaauguuggacagacacuguugc

SEQ ID NO: 1547520 - RNA, 15 nt, Homo sapiens
uaauuaaagccuuaa

SEQ ID NO: 1547521 - RNA, 21 nt, Homo sapiens
uaauuaaagccuuaagcacaa

SEQ ID NO: 1547522 - RNA, 16 nt, Homo sapiens
uaauucauggcauuga

SEQ ID NO: 1547523 - RNA, 20 nt, Homo sapiens
uaauuuauuauacaccuuag

SEQ ID NO: 1547524 - RNA, 22 nt, Homo sapiens
uacaaaacugcuuugugcauau

SEQ ID NO: 1547525 - RNA, 18 nt, Homo sapiens
uacaaucagcagucuagu

SEQ ID NO: 1547526 - RNA, 15 nt, Homo sapiens
uacacaacuuugcaa

SEQ ID NO: 1547527 - RNA, 23 nt, Homo sapiens
uacacuaagcgaauguguacaaa

SEQ ID NO: 1547528 - RNA, 13 nt, Homo sapiens
uacacuacuccug

SEQ ID NO: 1547529 - RNA, 23 nt, Homo sapiens
uacagauggagcaaauguccuaa

SEQ ID NO: 1547530 - RNA, 15 nt, Homo sapiens
uacauacaaauucua

SEQ ID NO: 1547531 - RNA, 18 nt, Homo sapiens
uacccugcgauuuugccu

SEQ ID NO: 1547532 - RNA, 14 nt, Homo sapiens
uaccucuucaguau

SEQ ID NO: 1547533 - RNA, 13 nt, Homo sapiens
uaccugcaccucu

SEQ ID NO: 1547534 - RNA, 21 nt, Homo sapiens
uacgauggaggccuaccucuc

SEQ ID NO: 1547535 - RNA, 11 nt, Homo sapiens
uacgugcauuu

SEQ ID NO: 1547536 - RNA, 19 nt, Homo sapiens
uacuccugaggaugcuacu

SEQ ID NO: 1547537 - RNA, 17 nt, Homo sapiens
uacucuaaagcuucuau

SEQ ID NO: 1547538 - RNA, 13 nt, Homo sapiens
uacugaagggaac

SEQ ID NO: 1547539 - RNA, 17 nt, Homo sapiens
uacugggugucauuuca

SEQ ID NO: 1547540 - RNA, 23 nt, Homo sapiens
uacugggugucauuucauuccau

SEQ ID NO: 1547541 - RNA, 14 nt, Homo sapiens
uacuugcacuguua

SEQ ID NO: 1547542 - RNA, 18 nt, Homo sapiens
uacuuuaauauaaaccca

SEQ ID NO: 1547543 - RNA, 23 nt, Homo sapiens
uagaaaaggguuucuugacaaug

SEQ ID NO: 1547544 - RNA, 21 nt, Homo sapiens
uagaaaguugcuaacugggaa

SEQ ID NO: 1547545 - RNA, 21 nt, Homo sapiens
uagaaauaagcccaacagaca

SEQ ID NO: 1547546 - RNA, 22 nt, Homo sapiens
uagaagcacggcuguggguggu

SEQ ID NO: 1547547 - RNA, 22 nt, Homo sapiens
uagcagcagggagggcuucugc

SEQ ID NO: 1547548 - RNA, 15 nt, Homo sapiens
uagccaaguguggua

SEQ ID NO: 1547549 - RNA, 14 nt, Homo sapiens
uagcccaauggaga

SEQ ID NO: 1547550 - RNA, 22 nt, Homo sapiens
uagccugccucuucucuacucu

SEQ ID NO: 1547551 - RNA, 17 nt, Homo sapiens
uaggaauuguuuauaca

SEQ ID NO: 1547552 - RNA, 20 nt, Homo sapiens
uaggaugggagagcuagaaa

SEQ ID NO: 1547553 - RNA, 17 nt, Homo sapiens
uaggaugucucuuggaa

SEQ ID NO: 1547554 - RNA, 21 nt, Homo sapiens
uaggcauuugcugaauacaga

SEQ ID NO: 1547555 - RNA, 22 nt, Homo sapiens
uaggccuggggacggcuuuuac

SEQ ID NO: 1547556 - RNA, 13 nt, Homo sapiens
uagggacuggagg

SEQ ID NO: 1547557 - RNA, 21 nt, Homo sapiens
uagggcaugauuaacaaagca

SEQ ID NO: 1547558 - RNA, 22 nt, Homo sapiens
uagggcaugauuaacaaagcaa

SEQ ID NO: 1547559 - RNA, 14 nt, Homo sapiens
uaggucaugaagga

SEQ ID NO: 1547560 - RNA, 17 nt, Homo sapiens
uaguaguuauuuguaua

SEQ ID NO: 1547561 - RNA, 20 nt, Homo sapiens
uaguauuuaacgaagccuag

SEQ ID NO: 1547562 - RNA, 18 nt, Homo sapiens
uagucauucuaacugcac

SEQ ID NO: 1547563 - RNA, 19 nt, Homo sapiens
uaguuaaaaaaaaauuccc

SEQ ID NO: 1547564 - RNA, 14 nt, Homo sapiens
uauaauauaccaau

SEQ ID NO: 1547565 - RNA, 19 nt, Homo sapiens
uauaccaugugugcuaaua

SEQ ID NO: 1547566 - RNA, 16 nt, Homo sapiens
uauagcaguguucucu

SEQ ID NO: 1547567 - RNA, 11 nt, Homo sapiens
uauauguauau

SEQ ID NO: 1547568 - RNA, 17 nt, Homo sapiens
uauauuuuugguggugg

SEQ ID NO: 1547569 - RNA, 15 nt, Homo sapiens
uaucaaaaaguauua

SEQ ID NO: 1547570 - RNA, 15 nt, Homo sapiens
uaucaggguauucca

SEQ ID NO: 1547571 - RNA, 18 nt, Homo sapiens
uauccaauaggcauuuga

SEQ ID NO: 1547572 - RNA, 16 nt, Homo sapiens
uauggagaauugcuga

SEQ ID NO: 1547573 - RNA, 18 nt, Homo sapiens
uaugugagaaaucagaau

SEQ ID NO: 1547574 - RNA, 13 nt, Homo sapiens
uauguguauagua

SEQ ID NO: 1547575 - RNA, 15 nt, Homo sapiens
uauguguuacauuau

SEQ ID NO: 1547576 - RNA, 18 nt, Homo sapiens
uauguuuccuaacuguga

SEQ ID NO: 1547577 - RNA, 20 nt, Homo sapiens
uauuaaggaagacaauguga

SEQ ID NO: 1547578 - RNA, 19 nt, Homo sapiens
uauuaugaaaucauaguau

SEQ ID NO: 1547579 - RNA, 23 nt, Homo sapiens
uauucuuaagggaacuuccacau

SEQ ID NO: 1547580 - RNA, 13 nt, Homo sapiens
uauugcauaacag

SEQ ID NO: 1547581 - RNA, 15 nt, Homo sapiens
uauugcauaacagca

SEQ ID NO: 1547582 - RNA, 11 nt, Homo sapiens
uauugccuugg

SEQ ID NO: 1547583 - RNA, 17 nt, Homo sapiens
uauuguguauguagccu

SEQ ID NO: 1547584 - RNA, 17 nt, Homo sapiens
uauuuaaacaacagcuc

SEQ ID NO: 1547585 - RNA, 19 nt, Homo sapiens
uauuuauauaucauaguau

SEQ ID NO: 1547586 - RNA, 21 nt, Homo sapiens
uauuucaaaacacaucuuucc

SEQ ID NO: 1547587 - RNA, 21 nt, Homo sapiens
uauuugggagggaaaagggaa

SEQ ID NO: 1547588 - RNA, 15 nt, Homo sapiens
cucugagaaguacuu

SEQ ID NO: 1547589 - RNA, 22 nt, Homo sapiens
cucugcacaagcugcacccuca

SEQ ID NO: 1547590 - RNA, 17 nt, Homo sapiens
cucugugauuaccucuc

SEQ ID NO: 1547591 - RNA, 15 nt, Homo sapiens
cucugugucugcucu

SEQ ID NO: 1547592 - RNA, 19 nt, Homo sapiens
cucuuaaaucauuugguua

SEQ ID NO: 1547593 - RNA, 22 nt, Homo sapiens
cucuucuuuauugcacuaggaa

SEQ ID NO: 1547594 - RNA, 21 nt, Homo sapiens
cucuugagccugggaggucaa

SEQ ID NO: 1547595 - RNA, 21 nt, Homo sapiens
cugaaacgagaagugcccuua

SEQ ID NO: 1547596 - RNA, 13 nt, Homo sapiens
cugaagaaaccuu

SEQ ID NO: 1547597 - RNA, 13 nt, Homo sapiens
cugaagccguguu

SEQ ID NO: 1547598 - RNA, 21 nt, Homo sapiens
cugacugguugucagaaugga

SEQ ID NO: 1547599 - RNA, 21 nt, Homo sapiens
cugagaaguacuuuaccugaa

SEQ ID NO: 1547600 - RNA, 20 nt, Homo sapiens
cugaggaucagcacugccag

SEQ ID NO: 1547601 - RNA, 23 nt, Homo sapiens
cugaggguuuccuucggggacca

SEQ ID NO: 1547602 - RNA, 20 nt, Homo sapiens
cugaggugggaggaucucuu

SEQ ID NO: 1547603 - RNA, 18 nt, Homo sapiens
cugaguauaguauuuaac

SEQ ID NO: 1547604 - RNA, 14 nt, Homo sapiens
cugagugugaugaa

SEQ ID NO: 1547605 - RNA, 21 nt, Homo sapiens
cugaguuugcuguuugcaauu

SEQ ID NO: 1547606 - RNA, 14 nt, Homo sapiens
cugauugacugugc

SEQ ID NO: 1547607 - RNA, 16 nt, Homo sapiens
cugauuuucuggaaug

SEQ ID NO: 1547608 - RNA, 16 nt, Homo sapiens
cugcaaacccaugaag

SEQ ID NO: 1547609 - RNA, 21 nt, Homo sapiens
cugcagcuuuguuuguuguca

SEQ ID NO: 1547610 - RNA, 23 nt, Homo sapiens
cugcauuagagcccauuucaauu

SEQ ID NO: 1547611 - RNA, 14 nt, Homo sapiens
cugcauuuuacaca

SEQ ID NO: 1547612 - RNA, 18 nt, Homo sapiens
cugccauuucugagauca

SEQ ID NO: 1547613 - RNA, 18 nt, Homo sapiens
cugcccuugucugagaug

SEQ ID NO: 1547614 - RNA, 17 nt, Homo sapiens
cugcguacuccacuggu

SEQ ID NO: 1547615 - RNA, 22 nt, Homo sapiens
cugcuaaagggagaaaugccag

SEQ ID NO: 1547616 - RNA, 12 nt, Homo sapiens
cugcuccagcug

SEQ ID NO: 1547617 - RNA, 14 nt, Homo sapiens
cugcugauuuucug

SEQ ID NO: 1547618 - RNA, 21 nt, Homo sapiens
cugcuugagcuuucugugcau

SEQ ID NO: 1547619 - RNA, 20 nt, Homo sapiens
cuggaaacagcaguguauau

SEQ ID NO: 1547620 - RNA, 17 nt, Homo sapiens
cuggaagccugccgaaa

SEQ ID NO: 1547621 - RNA, 13 nt, Homo sapiens
cuggagcacugua

SEQ ID NO: 1547622 - RNA, 20 nt, Homo sapiens
cuggaggagcaagggggcca

SEQ ID NO: 1547623 - RNA, 15 nt, Homo sapiens
cuggcaagaaugugu

SEQ ID NO: 1547624 - RNA, 22 nt, Homo sapiens
cuggcccuucuauuuauuugac

SEQ ID NO: 1547625 - RNA, 14 nt, Homo sapiens
cugggcauuucacg

SEQ ID NO: 1547626 - RNA, 22 nt, Homo sapiens
cugguggaagucuuggguguua

SEQ ID NO: 1547627 - RNA, 20 nt, Homo sapiens
cugguucgugccaugcccuu

SEQ ID NO: 1547628 - RNA, 21 nt, Homo sapiens
cuguaauccuagcacuuuggg

SEQ ID NO: 1547629 - RNA, 15 nt, Homo sapiens
cuguccagccgugug

SEQ ID NO: 1547630 - RNA, 17 nt, Homo sapiens
cugucuccuuucucagc

SEQ ID NO: 1547631 - RNA, 22 nt, Homo sapiens
cugucuuuggauaauaggaauu

SEQ ID NO: 1547632 - RNA, 16 nt, Homo sapiens
cuguucacacugcaga

SEQ ID NO: 1547633 - RNA, 15 nt, Homo sapiens
cuguucuguguacau

SEQ ID NO: 1547634 - RNA, 23 nt, Homo sapiens
cuuaaaccgccaaggcuggggga

SEQ ID NO: 1547635 - RNA, 21 nt, Homo sapiens
cuuacacuacauuagaacacu

SEQ ID NO: 1547636 - RNA, 20 nt, Homo sapiens
cuuaccccacacacagucca

SEQ ID NO: 1547637 - RNA, 15 nt, Homo sapiens
cuuacuguacauaca

SEQ ID NO: 1547638 - RNA, 13 nt, Homo sapiens
cuuagacacuuua

SEQ ID NO: 1547639 - RNA, 22 nt, Homo sapiens
cuuaguaaaaagcccuauguga

SEQ ID NO: 1547640 - RNA, 18 nt, Homo sapiens
cuuaguaguuuuuacaaa

SEQ ID NO: 1547641 - RNA, 15 nt, Homo sapiens
cuucaagagcaucug

SEQ ID NO: 1547642 - RNA, 18 nt, Homo sapiens
cuucagaguuugugugua

SEQ ID NO: 1547643 - RNA, 16 nt, Homo sapiens
cuucagauuuguguua

SEQ ID NO: 1547644 - RNA, 19 nt, Homo sapiens
cuucagguaacacuacaga

SEQ ID NO: 1547645 - RNA, 20 nt, Homo sapiens
cuuccuaaugcccuaugugu

SEQ ID NO: 1547646 - RNA, 14 nt, Homo sapiens
cuucucuucuuuau

SEQ ID NO: 1547647 - RNA, 16 nt, Homo sapiens
cuucugcgcuguuguu

SEQ ID NO: 1547648 - RNA, 14 nt, Homo sapiens
cuucuuuauugcac

SEQ ID NO: 1547649 - RNA, 22 nt, Homo sapiens
cuugagaggguggaauauccaa

SEQ ID NO: 1547650 - RNA, 19 nt, Homo sapiens
cuuggcaaauuccuaguca

SEQ ID NO: 1547651 - RNA, 21 nt, Homo sapiens
cuugugaauguuuagugugcu

SEQ ID NO: 1547652 - RNA, 15 nt, Homo sapiens
cuuuaucuuugugua

SEQ ID NO: 1547653 - RNA, 12 nt, Homo sapiens
cuuuauugcacu

SEQ ID NO: 1547654 - RNA, 13 nt, Homo sapiens
cuuucaugcucca

SEQ ID NO: 1547655 - RNA, 22 nt, Homo sapiens
cuuucccagaaaaaaaaaaacu

SEQ ID NO: 1547656 - RNA, 20 nt, Homo sapiens
cuuucuucccuacaguugaa

SEQ ID NO: 1547657 - RNA, 18 nt, Homo sapiens
cuuucuuuugaaaugcca

SEQ ID NO: 1547658 - RNA, 13 nt, Homo sapiens
cuuugauucuccu

SEQ ID NO: 1547659 - RNA, 14 nt, Homo sapiens
cuuugcauagcuuu

SEQ ID NO: 1547660 - RNA, 19 nt, Homo sapiens
cuuugcauagcuuucacaa

SEQ ID NO: 1547661 - RNA, 17 nt, Homo sapiens
cuuugcugcauuuuaca

SEQ ID NO: 1547662 - RNA, 17 nt, Homo sapiens
cuuuggaaaccaagcaa

SEQ ID NO: 1547663 - RNA, 22 nt, Homo sapiens
ccauuguggccgccaugagcaa

SEQ ID NO: 1547664 - RNA, 17 nt, Homo sapiens
ccauuucugagaucaaa

SEQ ID NO: 1547665 - RNA, 13 nt, Homo sapiens
cccaacuugccaa

SEQ ID NO: 1547666 - RNA, 17 nt, Homo sapiens
cccaaggagguggcugu

SEQ ID NO: 1547667 - RNA, 22 nt, Homo sapiens
cccaagggcaucauccucagca

SEQ ID NO: 1547668 - RNA, 20 nt, Homo sapiens
cccacacccaccucugccac

SEQ ID NO: 1547669 - RNA, 16 nt, Homo sapiens
cccaccauagggcaug

SEQ ID NO: 1547670 - RNA, 15 nt, Homo sapiens
cccagagguggcccu

SEQ ID NO: 1547671 - RNA, 22 nt, Homo sapiens
cccagagucacaaguagccucu

SEQ ID NO: 1547672 - RNA, 20 nt, Homo sapiens
cccagaugccugggugcaaa

SEQ ID NO: 1547673 - RNA, 13 nt, Homo sapiens
cccagcaccucau

SEQ ID NO: 1547674 - RNA, 16 nt, Homo sapiens
cccagcaguucucugc

SEQ ID NO: 1547675 - RNA, 19 nt, Homo sapiens
cccagcaguucucugccaa

SEQ ID NO: 1547676 - RNA, 21 nt, Homo sapiens
cccagcuccuuucaugcucca

SEQ ID NO: 1547677 - RNA, 23 nt, Homo sapiens
cccaggccucugccccaagagca

SEQ ID NO: 1547678 - RNA, 19 nt, Homo sapiens
cccaguacuuccuggacaa

SEQ ID NO: 1547679 - RNA, 16 nt, Homo sapiens
cccaguuagcucucaa

SEQ ID NO: 1547680 - RNA, 21 nt, Homo sapiens
ccccaaauuuaauuaaagccu

SEQ ID NO: 1547681 - RNA, 14 nt, Homo sapiens
ccccagcccaaguc

SEQ ID NO: 1547682 - RNA, 19 nt, Homo sapiens
ccccagcucccccaggcag

SEQ ID NO: 1547683 - RNA, 23 nt, Homo sapiens
ccccagcuuugcccaacaccagc

SEQ ID NO: 1547684 - RNA, 18 nt, Homo sapiens
ccccguggagcuggccaa

SEQ ID NO: 1547685 - RNA, 18 nt, Homo sapiens
cccgccacccugucucag

SEQ ID NO: 1547686 - RNA, 20 nt, Homo sapiens
cccuaaagacuaacuugaaa

SEQ ID NO: 1547687 - RNA, 13 nt, Homo sapiens
cccuacacacaca

SEQ ID NO: 1547688 - RNA, 18 nt, Homo sapiens
cccuccacccacuaggug

SEQ ID NO: 1547689 - RNA, 14 nt, Homo sapiens
cccuccacuucucc

SEQ ID NO: 1547690 - RNA, 16 nt, Homo sapiens
cccucucuguggcucc

SEQ ID NO: 1547691 - RNA, 14 nt, Homo sapiens
cccuguagggugcc

SEQ ID NO: 1547692 - RNA, 14 nt, Homo sapiens
cccugucucaaaaa

SEQ ID NO: 1547693 - RNA, 12 nt, Homo sapiens
cccuugcugcaa

SEQ ID NO: 1547694 - RNA, 15 nt, Homo sapiens
cccuuucuugcacug

SEQ ID NO: 1547695 - RNA, 19 nt, Homo sapiens
ccggugcagggccuggcau

SEQ ID NO: 1547696 - RNA, 17 nt, Homo sapiens
ccuaauacaacauguag

SEQ ID NO: 1547697 - RNA, 23 nt, Homo sapiens
ccuaaugaaggaguucacuguaa

SEQ ID NO: 1547698 - RNA, 18 nt, Homo sapiens
ccuacagcacuacugggu

SEQ ID NO: 1547699 - RNA, 19 nt, Homo sapiens
ccuacagcacuacugggug

SEQ ID NO: 1547700 - RNA, 17 nt, Homo sapiens
ccuaggcauuugcugaa

SEQ ID NO: 1547701 - RNA, 21 nt, Homo sapiens
ccuaguuccauucuuggucaa

SEQ ID NO: 1547702 - RNA, 14 nt, Homo sapiens
ccuaucacugauag

SEQ ID NO: 1547703 - RNA, 19 nt, Homo sapiens
ccuauuuuuguaaacugga

SEQ ID NO: 1547704 - RNA, 17 nt, Homo sapiens
ccucaggcaggugggau

SEQ ID NO: 1547705 - RNA, 19 nt, Homo sapiens
ccucccugucucugcaucu

SEQ ID NO: 1547706 - RNA, 23 nt, Homo sapiens
ccuccugugccucccuuuucucc

SEQ ID NO: 1547707 - RNA, 14 nt, Homo sapiens
ccucucacuuucag

SEQ ID NO: 1547708 - RNA, 20 nt, Homo sapiens
ccucucagaagguaggggaa

SEQ ID NO: 1547709 - RNA, 16 nt, Homo sapiens
ccucucccuaggagaa

SEQ ID NO: 1547710 - RNA, 14 nt, Homo sapiens
ccucugaacccccu

SEQ ID NO: 1547711 - RNA, 17 nt, Homo sapiens
ccucugggaucugccaa

SEQ ID NO: 1547712 - RNA, 14 nt, Homo sapiens
ccugaccucugcaa

SEQ ID NO: 1547713 - RNA, 23 nt, Homo sapiens
ccugauuagaugacucucagucc

SEQ ID NO: 1547714 - RNA, 23 nt, Homo sapiens
ccugcccaguuggaggagacugg

SEQ ID NO: 1547715 - RNA, 20 nt, Homo sapiens
ccuggaaacagcaguguaua

SEQ ID NO: 1547716 - RNA, 13 nt, Homo sapiens
ccuggaaauggac

SEQ ID NO: 1547717 - RNA, 21 nt, Homo sapiens
ccuggaugaucacuaauacua

SEQ ID NO: 1547718 - RNA, 14 nt, Homo sapiens
ccugggcaauguga

SEQ ID NO: 1547719 - RNA, 15 nt, Homo sapiens
ccugggcaaugugau

SEQ ID NO: 1547720 - RNA, 15 nt, Homo sapiens
ccuguccaauuucug

SEQ ID NO: 1547721 - RNA, 18 nt, Homo sapiens
ccuuacuugcacuguuac

SEQ ID NO: 1547722 - RNA, 13 nt, Homo sapiens
ccuuagagcaucu

SEQ ID NO: 1547723 - RNA, 17 nt, Homo sapiens
ccuuagagcaucucugc

SEQ ID NO: 1547724 - RNA, 13 nt, Homo sapiens
ccuuagucuuucc

SEQ ID NO: 1547725 - RNA, 19 nt, Homo sapiens
ccuucuauuuauuugacug

SEQ ID NO: 1547726 - RNA, 21 nt, Homo sapiens
ccuugcugcaaacccaugaag

SEQ ID NO: 1547727 - RNA, 20 nt, Homo sapiens
ccuuggauagauucagcucc

SEQ ID NO: 1547728 - RNA, 19 nt, Homo sapiens
ccuuguguguuuugagagu

SEQ ID NO: 1547729 - RNA, 17 nt, Homo sapiens
ccuuuaggauguuuucc

SEQ ID NO: 1547730 - RNA, 20 nt, Homo sapiens
ccuuuucuauuuaccuccua

SEQ ID NO: 1547731 - RNA, 19 nt, Homo sapiens
ccuuuuuauucagcuagaa

SEQ ID NO: 1547732 - RNA, 19 nt, Homo sapiens
cgaaacccggugcaucugg

SEQ ID NO: 1547733 - RNA, 12 nt, Homo sapiens
cgaugacuguga

SEQ ID NO: 1547734 - RNA, 23 nt, Homo sapiens
cgcacauagcucaaucacacugg

SEQ ID NO: 1547735 - RNA, 15 nt, Homo sapiens
cgcacugcccagguc

SEQ ID NO: 1547736 - RNA, 15 nt, Homo sapiens
cggcgaagaggaccc

SEQ ID NO: 1547737 - RNA, 23 nt, Homo sapiens
cgggaggauugagaagggacaag

SEQ ID NO: 1547738 - RNA, 13 nt, Homo sapiens
uauuuguauuaau

SEQ ID NO: 1547739 - RNA, 16 nt, Homo sapiens
uauuuucuauuuuccc

SEQ ID NO: 1547740 - RNA, 16 nt, Homo sapiens
uauuuuuauccaugac

SEQ ID NO: 1547741 - RNA, 22 nt, Homo sapiens
ucaaaauuguuuaccauagaaa

SEQ ID NO: 1547742 - RNA, 15 nt, Homo sapiens
ucaaagacacacagg

SEQ ID NO: 1547743 - RNA, 22 nt, Homo sapiens
ucaaaugauacagucaggacac

SEQ ID NO: 1547744 - RNA, 16 nt, Homo sapiens
ucaacgaugugacugc

SEQ ID NO: 1547745 - RNA, 15 nt, Homo sapiens
ucaacuucccaguga

SEQ ID NO: 1547746 - RNA, 18 nt, Homo sapiens
ucaagagcaucuggaaca

SEQ ID NO: 1547747 - RNA, 18 nt, Homo sapiens
ucaauugcagaugccaaa

SEQ ID NO: 1547748 - RNA, 16 nt, Homo sapiens
ucacauaaaaaugcaa

SEQ ID NO: 1547749 - RNA, 23 nt, Homo sapiens
ucacauuuguauguguguagacu

SEQ ID NO: 1547750 - RNA, 21 nt, Homo sapiens
ucaccccagcccccacagccc

SEQ ID NO: 1547751 - RNA, 23 nt, Homo sapiens
ucacccccuacacacacaugaga

SEQ ID NO: 1547752 - RNA, 20 nt, Homo sapiens
ucacgaacuguucacacugc

SEQ ID NO: 1547753 - RNA, 22 nt, Homo sapiens
ucacugaagaaaccuucagauu

SEQ ID NO: 1547754 - RNA, 20 nt, Homo sapiens
ucacugcaagucacauaaaa

SEQ ID NO: 1547755 - RNA, 13 nt, Homo sapiens
ucacuucucuuaa

SEQ ID NO: 1547756 - RNA, 15 nt, Homo sapiens
ucagacuuugcugca

SEQ ID NO: 1547757 - RNA, 15 nt, Homo sapiens
ucagaggagccaaua

SEQ ID NO: 1547758 - RNA, 21 nt, Homo sapiens
ucagaguuuguguguauuugu

SEQ ID NO: 1547759 - RNA, 11 nt, Homo sapiens
ucagcacugcc

SEQ ID NO: 1547760 - RNA, 22 nt, Homo sapiens
ucagcagucuaguucuuuucau

SEQ ID NO: 1547761 - RNA, 12 nt, Homo sapiens
ucagcccagaag

SEQ ID NO: 1547762 - RNA, 16 nt, Homo sapiens
ucagguaacacuacag

SEQ ID NO: 1547763 - RNA, 15 nt, Homo sapiens
ucaguggcuuugcau

SEQ ID NO: 1547764 - RNA, 15 nt, Homo sapiens
ucaguguugacauag

SEQ ID NO: 1547765 - RNA, 20 nt, Homo sapiens
ucaguguugacauagccuuu

SEQ ID NO: 1547766 - RNA, 19 nt, Homo sapiens
ucaguuuuuuuuuuuccag

SEQ ID NO: 1547767 - RNA, 13 nt, Homo sapiens
ucauuauguuucc

SEQ ID NO: 1547768 - RNA, 18 nt, Homo sapiens
ucauucuaacugcacuuu

SEQ ID NO: 1547769 - RNA, 14 nt, Homo sapiens
ucauuucauuccau

SEQ ID NO: 1547770 - RNA, 23 nt, Homo sapiens
ucauuuggaaugaauacagcauu

SEQ ID NO: 1547771 - RNA, 18 nt, Homo sapiens
uccaaagugccacucauu

SEQ ID NO: 1547772 - RNA, 18 nt, Homo sapiens
uccaacgaguaccagcug

SEQ ID NO: 1547773 - RNA, 20 nt, Homo sapiens
uccaacucuuccaccucugg

SEQ ID NO: 1547774 - RNA, 13 nt, Homo sapiens
uccaagcccguuc

SEQ ID NO: 1547775 - RNA, 13 nt, Homo sapiens
uccaauauuucug

SEQ ID NO: 1547776 - RNA, 22 nt, Homo sapiens
uccaaugauacccaacaguuua

SEQ ID NO: 1547777 - RNA, 14 nt, Homo sapiens
uccacauuauacau

SEQ ID NO: 1547778 - RNA, 13 nt, Homo sapiens
uccagguggacaa

SEQ ID NO: 1547779 - RNA, 13 nt, Homo sapiens
uccagugcuucaa

SEQ ID NO: 1547780 - RNA, 23 nt, Homo sapiens
aaaaccaccaccaucaccagaca

SEQ ID NO: 1547781 - RNA, 18 nt, Homo sapiens
aaaacugacaucagauuu

SEQ ID NO: 1547782 - RNA, 23 nt, Homo sapiens
aaaacuuuucuaauacucuaccc

SEQ ID NO: 1547783 - RNA, 13 nt, Homo sapiens
aaaagcugggcag

SEQ ID NO: 1547784 - RNA, 23 nt, Homo sapiens
aaaaggguuucuugacaaugggg

SEQ ID NO: 1547785 - RNA, 12 nt, Homo sapiens
aaaaguacugaa

SEQ ID NO: 1547786 - RNA, 18 nt, Homo sapiens
aaaagucguuuuccaaac

SEQ ID NO: 1547787 - RNA, 20 nt, Homo sapiens
aaaaugagaaucugugcagu

SEQ ID NO: 1547788 - RNA, 13 nt, Homo sapiens
aaaaugccaugaa

SEQ ID NO: 1547789 - RNA, 14 nt, Homo sapiens
aaaaugccaugaaa

SEQ ID NO: 1547790 - RNA, 20 nt, Homo sapiens
aaaauguugcucugggagac

SEQ ID NO: 1547791 - RNA, 20 nt, Homo sapiens
aaaauugaaaacacuaacaa

SEQ ID NO: 1547792 - RNA, 18 nt, Homo sapiens
aaaauuguuuaccauaga

SEQ ID NO: 1547793 - RNA, 14 nt, Homo sapiens
aaacaaaugaaaua

SEQ ID NO: 1547794 - RNA, 20 nt, Homo sapiens
aaacauagaaagacaugggc

SEQ ID NO: 1547795 - RNA, 21 nt, Homo sapiens
aaacccauaaguuuaacugua

SEQ ID NO: 1547796 - RNA, 16 nt, Homo sapiens
aaacugcuuugugcau

SEQ ID NO: 1547797 - RNA, 20 nt, Homo sapiens
aaacuugugaaugcuucuca

SEQ ID NO: 1547798 - RNA, 21 nt, Homo sapiens
aaacuugugaaugcuucucac

SEQ ID NO: 1547799 - RNA, 20 nt, Homo sapiens
aaacuuuucuaauacucuac

SEQ ID NO: 1547800 - RNA, 15 nt, Homo sapiens
aaagaccuucucccu

SEQ ID NO: 1547801 - RNA, 15 nt, Homo sapiens
aaagcauucuuuaac

SEQ ID NO: 1547802 - RNA, 17 nt, Homo sapiens
aaagccaccuuguuaca

SEQ ID NO: 1547803 - RNA, 19 nt, Homo sapiens
aaagggagaacauggccaa

SEQ ID NO: 1547804 - RNA, 17 nt, Homo sapiens
aaagguagggacuggag

SEQ ID NO: 1547805 - RNA, 14 nt, Homo sapiens
aaaguguacaugaa

SEQ ID NO: 1547806 - RNA, 21 nt, Homo sapiens
aaauaaaacagcagcagcaaa

SEQ ID NO: 1547807 - RNA, 19 nt, Homo sapiens
aaauauuaauauccuguaa

SEQ ID NO: 1547808 - RNA, 22 nt, Homo sapiens
aaaucaaaaacuuuucauuuca

SEQ ID NO: 1547809 - RNA, 16 nt, Homo sapiens
aaaugaacuacugcua

SEQ ID NO: 1547810 - RNA, 13 nt, Homo sapiens
aaauggaugacaa

SEQ ID NO: 1547811 - RNA, 17 nt, Homo sapiens
aaauuuagaaagcuuaa

SEQ ID NO: 1547812 - RNA, 13 nt, Homo sapiens
aaauuuucaccug

SEQ ID NO: 1547813 - RNA, 14 nt, Homo sapiens
aacaaacauuguuu

SEQ ID NO: 1547814 - RNA, 20 nt, Homo sapiens
aacaaagugaaggacauaga

SEQ ID NO: 1547815 - RNA, 21 nt, Homo sapiens
aacagcuccauacuucuuuca

SEQ ID NO: 1547816 - RNA, 15 nt, Homo sapiens
aaccaaagugcagga

SEQ ID NO: 1547817 - RNA, 20 nt, Homo sapiens
aaccagaccaaccgccugca

SEQ ID NO: 1547818 - RNA, 17 nt, Homo sapiens
auuagccaaguguggua

SEQ ID NO: 1547819 - RNA, 17 nt, Homo sapiens
auuaggaauuguuuaua

SEQ ID NO: 1547820 - RNA, 21 nt, Homo sapiens
auuauaaaauugaaaacacua

SEQ ID NO: 1547821 - RNA, 13 nt, Homo sapiens
auuauacauuuga

SEQ ID NO: 1547822 - RNA, 23 nt, Homo sapiens
auuauuuacuauuacgugcuauu

SEQ ID NO: 1547823 - RNA, 16 nt, Homo sapiens
auucaauuuggcaaaa

SEQ ID NO: 1547824 - RNA, 23 nt, Homo sapiens
auucacuggggcaugagauuuug

SEQ ID NO: 1547825 - RNA, 14 nt, Homo sapiens
auucauucugagcc

SEQ ID NO: 1547826 - RNA, 17 nt, Homo sapiens
auuccuuacuugcacug

SEQ ID NO: 1547827 - RNA, 18 nt, Homo sapiens
auucugaaauacuuuuga

SEQ ID NO: 1547828 - RNA, 22 nt, Homo sapiens
auucuugagggacaaugccaau

SEQ ID NO: 1547829 - RNA, 16 nt, Homo sapiens
auugccuagcucuuuu

SEQ ID NO: 1547830 - RNA, 14 nt, Homo sapiens
auuuaaacaacagc

SEQ ID NO: 1547831 - RNA, 15 nt, Homo sapiens
auuuaaacaacagcu

SEQ ID NO: 1547832 - RNA, 21 nt, Homo sapiens
auuuaagccaucaucagcuua

SEQ ID NO: 1547833 - RNA, 17 nt, Homo sapiens
auuuacaggacuucucu

SEQ ID NO: 1547834 - RNA, 20 nt, Homo sapiens
auuuacuauuacgugcuauu

SEQ ID NO: 1547835 - RNA, 16 nt, Homo sapiens
auuuagccauuaccca

SEQ ID NO: 1547836 - RNA, 17 nt, Homo sapiens
auuucacgaacuguuca

SEQ ID NO: 1547837 - RNA, 13 nt, Homo sapiens
auuucaugugaau

SEQ ID NO: 1547838 - RNA, 14 nt, Homo sapiens
auuucugcuuucuu

SEQ ID NO: 1547839 - RNA, 15 nt, Homo sapiens
auuugauuuugccca

SEQ ID NO: 1547840 - RNA, 17 nt, Homo sapiens
auuuguauuaauaaagc

SEQ ID NO: 1547841 - RNA, 17 nt, Homo sapiens
auuuuauuaggauuacc

SEQ ID NO: 1547842 - RNA, 14 nt, Homo sapiens
auuuuauucccaag

SEQ ID NO: 1547843 - RNA, 22 nt, Homo sapiens
auuuucuuuuauuaucaguuaa

SEQ ID NO: 1547844 - RNA, 19 nt, Homo sapiens
auuuugcuaaaugugaaug

SEQ ID NO: 1547845 - RNA, 11 nt, Homo sapiens
caaaacaaagc

SEQ ID NO: 1547846 - RNA, 18 nt, Homo sapiens
caaaacugcuuugugcau

SEQ ID NO: 1547847 - RNA, 20 nt, Homo sapiens
caaaagaggcuuuugggcca

SEQ ID NO: 1547848 - RNA, 22 nt, Homo sapiens
caaaaucugauuagaaguauaa

SEQ ID NO: 1547849 - RNA, 21 nt, Homo sapiens
caaagcacuagagaaugcaca

SEQ ID NO: 1547850 - RNA, 19 nt, Homo sapiens
caaaggaaaaagcacaaga

SEQ ID NO: 1547851 - RNA, 17 nt, Homo sapiens
caaagguagggacugga

SEQ ID NO: 1547852 - RNA, 14 nt, Homo sapiens
caaagugaaggaca

SEQ ID NO: 1547853 - RNA, 18 nt, Homo sapiens
caaagugggguacaguaa

SEQ ID NO: 1547854 - RNA, 16 nt, Homo sapiens
caaauaaaaugaaaua

SEQ ID NO: 1547855 - RNA, 15 nt, Homo sapiens
caaaugaaauaaaua

SEQ ID NO: 1547856 - RNA, 14 nt, Homo sapiens
caaaugcccagcuu

SEQ ID NO: 1547857 - RNA, 11 nt, Homo sapiens
caaauguccua

SEQ ID NO: 1547858 - RNA, 23 nt, Homo sapiens
caaauuauuuauuacuugugcac

SEQ ID NO: 1547859 - RNA, 14 nt, Homo sapiens
caaauuguuuacau

SEQ ID NO: 1547860 - RNA, 20 nt, Homo sapiens
caaauuuaauuaaagccuua

SEQ ID NO: 1547861 - RNA, 22 nt, Homo sapiens
caaauuuaauuaaagccuuaag

SEQ ID NO: 1547862 - RNA, 22 nt, Homo sapiens
caacaccucugcacaagcugca

SEQ ID NO: 1547863 - RNA, 18 nt, Homo sapiens
caaccagaccaaccgccu

SEQ ID NO: 1547864 - RNA, 15 nt, Homo sapiens
caaccgccugcagga

SEQ ID NO: 1547865 - RNA, 15 nt, Homo sapiens
caacgacugccguga

SEQ ID NO: 1547866 - RNA, 16 nt, Homo sapiens
caagcaagaucugcuc

SEQ ID NO: 1547867 - RNA, 15 nt, Homo sapiens
caagcauuuuuccau

SEQ ID NO: 1547868 - RNA, 21 nt, Homo sapiens
caagguauaccucaguuccac

SEQ ID NO: 1547869 - RNA, 15 nt, Homo sapiens
caaguaacacuuuaa

SEQ ID NO: 1547870 - RNA, 12 nt, Homo sapiens
caaguacuucau

SEQ ID NO: 1547871 - RNA, 16 nt, Homo sapiens
caaguaugaaguauaa

SEQ ID NO: 1547872 - RNA, 18 nt, Homo sapiens
caagucaagugaaaaagg

SEQ ID NO: 1547873 - RNA, 15 nt, Homo sapiens
caaucagcagucuag

SEQ ID NO: 1547874 - RNA, 18 nt, Homo sapiens
caaucuauuuguuuuuaa

SEQ ID NO: 1547875 - RNA, 22 nt, Homo sapiens
caaugaaaaaaaguacauguau

SEQ ID NO: 1547876 - RNA, 14 nt, Homo sapiens
caauuucuaugugg

SEQ ID NO: 1547877 - RNA, 12 nt, Homo sapiens
caauuuuuccau

SEQ ID NO: 1547878 - RNA, 12 nt, Homo sapiens
cacaagucuccu

SEQ ID NO: 1547879 - RNA, 17 nt, Homo sapiens
cacacccaccucugcca

SEQ ID NO: 1547880 - RNA, 21 nt, Homo sapiens
cacacuugaauuugggcagcu

SEQ ID NO: 1547881 - RNA, 15 nt, Homo sapiens
cacagaugugaagga

SEQ ID NO: 1547882 - RNA, 15 nt, Homo sapiens
cacauagcucaauca

SEQ ID NO: 1547883 - RNA, 20 nt, Homo sapiens
cacauaggaaaaugccauga

SEQ ID NO: 1547884 - RNA, 13 nt, Homo sapiens
cacaugcugaguc

SEQ ID NO: 1547885 - RNA, 16 nt, Homo sapiens
caccagggcacugucu

SEQ ID NO: 1547886 - RNA, 14 nt, Homo sapiens
caccauugugaagc

SEQ ID NO: 1547887 - RNA, 16 nt, Homo sapiens
cacccaccucugccac

SEQ ID NO: 1547888 - RNA, 17 nt, Homo sapiens
cacccccaauuccuuga

SEQ ID NO: 1547889 - RNA, 15 nt, Homo sapiens
cacccugaaagcccu

SEQ ID NO: 1547890 - RNA, 22 nt, Homo sapiens
caccucuggauucuggauucac

SEQ ID NO: 1547891 - RNA, 15 nt, Homo sapiens
caccugcgcugugga

SEQ ID NO: 1547892 - RNA, 13 nt, Homo sapiens
cacgaacuguuca

SEQ ID NO: 1547893 - RNA, 19 nt, Homo sapiens
cacuacugggugucauuuc

SEQ ID NO: 1547894 - RNA, 12 nt, Homo sapiens
cacuagcccacu

SEQ ID NO: 1547895 - RNA, 15 nt, Homo sapiens
cacuggucugucuuu

SEQ ID NO: 1547896 - RNA, 19 nt, Homo sapiens
cacuuaguaguuuuuacaa

SEQ ID NO: 1547897 - RNA, 12 nt, Homo sapiens
cacuuuaccucu

SEQ ID NO: 1547898 - RNA, 16 nt, Homo sapiens
cagaaauaguugucug

SEQ ID NO: 1547899 - RNA, 17 nt, Homo sapiens
cagaaauaguugucugu

SEQ ID NO: 1547900 - RNA, 18 nt, Homo sapiens
cagaacaaauuguuuaca

SEQ ID NO: 1547901 - RNA, 17 nt, Homo sapiens
cagaagaaaauucuccu

SEQ ID NO: 1547902 - RNA, 21 nt, Homo sapiens
cagaauuauccauuacgugca

SEQ ID NO: 1547903 - RNA, 15 nt, Homo sapiens
cagaccccaaaccag

SEQ ID NO: 1547904 - RNA, 17 nt, Homo sapiens
cagaccccaaaccagcc

SEQ ID NO: 1547905 - RNA, 20 nt, Homo sapiens
cagacuguggaaccaaagcu

SEQ ID NO: 1547906 - RNA, 18 nt, Homo sapiens
cagagaagcgcuguugcc

SEQ ID NO: 1547907 - RNA, 13 nt, Homo sapiens
cagagcagaucag

SEQ ID NO: 1547908 - RNA, 23 nt, Homo sapiens
cagaggagccaauaaaccuguaa

SEQ ID NO: 1547909 - RNA, 20 nt, Homo sapiens
cagagggcguguuguuuuac

SEQ ID NO: 1547910 - RNA, 22 nt, Homo sapiens
cagagggugggguacuggaguu

SEQ ID NO: 1547911 - RNA, 15 nt, Homo sapiens
cagaggucaucccuu

SEQ ID NO: 1547912 - RNA, 14 nt, Homo sapiens
cagaguacgugaaa

SEQ ID NO: 1547913 - RNA, 16 nt, Homo sapiens
cagagucaaauuugaa

SEQ ID NO: 1547914 - RNA, 12 nt, Homo sapiens
cagauacuuggg

SEQ ID NO: 1547915 - RNA, 23 nt, Homo sapiens
cagauccuggaaacagcagugua

SEQ ID NO: 1547916 - RNA, 21 nt, Homo sapiens
cagaugccaaaaaagaugcca

SEQ ID NO: 1547917 - RNA, 15 nt, Homo sapiens
cagauguuuaaugaa

SEQ ID NO: 1547918 - RNA, 23 nt, Homo sapiens
cagcaaacaaauaaaaugaaaua

SEQ ID NO: 1547919 - RNA, 14 nt, Homo sapiens
cagcaauauugccu

SEQ ID NO: 1547920 - RNA, 14 nt, Homo sapiens
cagcacugccagug

SEQ ID NO: 1547921 - RNA, 15 nt, Homo sapiens
cagcagcugauucca

SEQ ID NO: 1547922 - RNA, 17 nt, Homo sapiens
cagcagcugauuccaga

SEQ ID NO: 1547923 - RNA, 21 nt, Homo sapiens
cagcaguucucugccaaagcu

SEQ ID NO: 1547924 - RNA, 21 nt, Homo sapiens
cagccauagcuugauugcuca

SEQ ID NO: 1547925 - RNA, 15 nt, Homo sapiens
cagcccccacagccc

SEQ ID NO: 1547926 - RNA, 19 nt, Homo sapiens
cagcccuugagucugucac

SEQ ID NO: 1547927 - RNA, 22 nt, Homo sapiens
cagccucugaaaaccaauguuc

SEQ ID NO: 1547928 - RNA, 18 nt, Homo sapiens
cagcgauggcagugagaa

SEQ ID NO: 1547929 - RNA, 24 nt, Homo sapiens
cagcugacuuuucuguccgagcuu

SEQ ID NO: 1547930 - RNA, 18 nt, Homo sapiens
caggagcccuacugaagg

SEQ ID NO: 1547931 - RNA, 16 nt, Homo sapiens
caggaggugccugaaa

SEQ ID NO: 1547932 - RNA, 19 nt, Homo sapiens
caggccaaacauggccaga

SEQ ID NO: 1547933 - RNA, 14 nt, Homo sapiens
caggccaugugguu

SEQ ID NO: 1547934 - RNA, 14 nt, Homo sapiens
cagggaaaugugua

SEQ ID NO: 1547935 - RNA, 15 nt, Homo sapiens
cagggccuggcauag

SEQ ID NO: 1547936 - RNA, 16 nt, Homo sapiens
cagguggacaaaguca

SEQ ID NO: 1547937 - RNA, 17 nt, Homo sapiens
gucaguacgagcugcuc

SEQ ID NO: 1547938 - RNA, 18 nt, Homo sapiens
gucaucaacaaaagggag

SEQ ID NO: 1547939 - RNA, 17 nt, Homo sapiens
gucaugaaggacacucu

SEQ ID NO: 1547940 - RNA, 14 nt, Homo sapiens
gucauuacuucuga

SEQ ID NO: 1547941 - RNA, 21 nt, Homo sapiens
gucauuucauuccauugccua

SEQ ID NO: 1547942 - RNA, 17 nt, Homo sapiens
gucccaaugguccugac

SEQ ID NO: 1547943 - RNA, 20 nt, Homo sapiens
gucccuguaugucuaccucu

SEQ ID NO: 1547944 - RNA, 13 nt, Homo sapiens
guccgagcuuuga

SEQ ID NO: 1547945 - RNA, 16 nt, Homo sapiens
gucuccuucacaucag

SEQ ID NO: 1547946 - RNA, 20 nt, Homo sapiens
gucuguauccccagugcccg

SEQ ID NO: 1547947 - RNA, 16 nt, Homo sapiens
gucuugaugacugcug

SEQ ID NO: 1547948 - RNA, 14 nt, Homo sapiens
gugacaucauucag

SEQ ID NO: 1547949 - RNA, 19 nt, Homo sapiens
gugagcguguccacagagu

SEQ ID NO: 1547950 - RNA, 13 nt, Homo sapiens
gugauuaccucuc

SEQ ID NO: 1547951 - RNA, 12 nt, Homo sapiens
gugcagcauuaa

SEQ ID NO: 1547952 - RNA, 17 nt, Homo sapiens
gugcaucuggcacgugg

SEQ ID NO: 1547953 - RNA, 13 nt, Homo sapiens
gugcccuugcccu

SEQ ID NO: 1547954 - RNA, 18 nt, Homo sapiens
gugccucuuuucaguagu

SEQ ID NO: 1547955 - RNA, 20 nt, Homo sapiens
gugccugguucgugccaugc

SEQ ID NO: 1547956 - RNA, 16 nt, Homo sapiens
gugcucgaccuugaua

SEQ ID NO: 1547957 - RNA, 14 nt, Homo sapiens
gugcucugaagugu

SEQ ID NO: 1547958 - RNA, 16 nt, Homo sapiens
gugcuugcuggugccu

SEQ ID NO: 1547959 - RNA, 21 nt, Homo sapiens
guggguggccagcgcgaugaa

SEQ ID NO: 1547960 - RNA, 22 nt, Homo sapiens
guggucccucugugucugcucu

SEQ ID NO: 1547961 - RNA, 15 nt, Homo sapiens
gugguuguuuuguca

SEQ ID NO: 1547962 - RNA, 11 nt, Homo sapiens
gugucaccucc

SEQ ID NO: 1547963 - RNA, 21 nt, Homo sapiens
guguucaguguugacauagcc

SEQ ID NO: 1547964 - RNA, 15 nt, Homo sapiens
guguugacauagccu

SEQ ID NO: 1547965 - RNA, 13 nt, Homo sapiens
guuaagcauggau

SEQ ID NO: 1547966 - RNA, 17 nt, Homo sapiens
guuaagugucauuucuu

SEQ ID NO: 1547967 - RNA, 17 nt, Homo sapiens
guuacuuagaaugccau

SEQ ID NO: 1547968 - RNA, 16 nt, Homo sapiens
guuccagguggacaaa

SEQ ID NO: 1547969 - RNA, 15 nt, Homo sapiens
guuccucuuugcccu

SEQ ID NO: 1547970 - RNA, 20 nt, Homo sapiens
guucugguuuuuaaccauug

SEQ ID NO: 1547971 - RNA, 20 nt, Homo sapiens
guugucagaauggaauccau

SEQ ID NO: 1547972 - RNA, 13 nt, Homo sapiens
guuuaaaugccaa

SEQ ID NO: 1547973 - RNA, 16 nt, Homo sapiens
guuugcaauuuuucca

SEQ ID NO: 1547974 - RNA, 14 nt, Homo sapiens
guuuuacugcagcu

SEQ ID NO: 1547975 - RNA, 16 nt, Homo sapiens
uaaaacccaagugccu

SEQ ID NO: 1547976 - RNA, 17 nt, Homo sapiens
uaaaaccugagccauug

SEQ ID NO: 1547977 - RNA, 22 nt, Homo sapiens
uaaaagcaccauugugaagcag

SEQ ID NO: 1547978 - RNA, 19 nt, Homo sapiens
uaaagaaagaaugcauucc

SEQ ID NO: 1547979 - RNA, 10 nt, Homo sapiens
uaaagauaug

SEQ ID NO: 1547980 - RNA, 18 nt, Homo sapiens
uaaaguaacaguauguca

SEQ ID NO: 1547981 - RNA, 14 nt, Homo sapiens
uaaaguauguccuu

SEQ ID NO: 1547982 - RNA, 15 nt, Homo sapiens
uaaauaccauugugu

SEQ ID NO: 1547983 - RNA, 14 nt, Homo sapiens
uaaaugaacuacug

SEQ ID NO: 1547984 - RNA, 14 nt, Homo sapiens
uaaaugugagcaaa

SEQ ID NO: 1547985 - RNA, 22 nt, Homo sapiens
uaaccucgcucgaugacuguga

SEQ ID NO: 1547986 - RNA, 13 nt, Homo sapiens
uaacucauagauu

SEQ ID NO: 1547987 - RNA, 21 nt, Homo sapiens
uaacuguauuuuugaagacua

SEQ ID NO: 1547988 - RNA, 20 nt, Homo sapiens
uaacuuauugcauaacagca

SEQ ID NO: 1547989 - RNA, 14 nt, Homo sapiens
uaagaaaugggacu

SEQ ID NO: 1547990 - RNA, 15 nt, Homo sapiens
uaagguaauguaggg

SEQ ID NO: 1547991 - RNA, 16 nt, Homo sapiens
uaaguguucaguguug

SEQ ID NO: 1547992 - RNA, 16 nt, Homo sapiens
uaaguuuuuguaaaag

SEQ ID NO: 1547993 - RNA, 17 nt, Homo sapiens
uaauaaagcauucuuua

SEQ ID NO: 1547994 - RNA, 18 nt, Homo sapiens
uaauaaagcauucuuuaa

SEQ ID NO: 1547995 - RNA, 21 nt, Homo sapiens
uaauaauagaaaaauacucau

SEQ ID NO: 1547996 - RNA, 20 nt, Homo sapiens
uaauagggagaaaccaagag

SEQ ID NO: 1547997 - RNA, 23 nt, Homo sapiens
uaauauccuguaauaaagcucuu

SEQ ID NO: 1547998 - RNA, 18 nt, Homo sapiens
uaaugauggaacuuagac

SEQ ID NO: 1547999 - RNA, 21 nt, Homo sapiens
uaaugucugucagaagacacu

SEQ ID NO: 1548000 - RNA, 17 nt, Homo sapiens
uaauuuauuauacaccu

SEQ ID NO: 1548001 - RNA, 20 nt, Homo sapiens
uacaaaacugcuuugugcau

SEQ ID NO: 1548002 - RNA, 14 nt, Homo sapiens
uacacaacuuugca

SEQ ID NO: 1548003 - RNA, 22 nt, Homo sapiens
uacacaugugcugauguuuaca

SEQ ID NO: 1548004 - RNA, 19 nt, Homo sapiens
uacauaaguuccuauaccu

SEQ ID NO: 1548005 - RNA, 22 nt, Homo sapiens
uacaucugucuuucaucuccca

SEQ ID NO: 1548006 - RNA, 23 nt, Homo sapiens
uacauucuugguuguuaauuuag

SEQ ID NO: 1548007 - RNA, 20 nt, Homo sapiens
uaccauagaaagaugacaaa

SEQ ID NO: 1548008 - RNA, 17 nt, Homo sapiens
uaccauuuuucauucac

SEQ ID NO: 1548009 - RNA, 22 nt, Homo sapiens
uacccccuucugggcaucuguu

SEQ ID NO: 1548010 - RNA, 20 nt, Homo sapiens
uacccucuccaggcauuuau

SEQ ID NO: 1548011 - RNA, 20 nt, Homo sapiens
uaccuagagcaggcacuuga

SEQ ID NO: 1548012 - RNA, 17 nt, Homo sapiens
uaccugaaagacaguau

SEQ ID NO: 1548013 - RNA, 13 nt, Homo sapiens
uacgccaggggaa

SEQ ID NO: 1548014 - RNA, 21 nt, Homo sapiens
uacgugcauuuaaacucugcc

SEQ ID NO: 1548015 - RNA, 22 nt, Homo sapiens
uacuccuggagcacuguaaaaa

SEQ ID NO: 1548016 - RNA, 23 nt, Homo sapiens
uacugacacauugcugauaugca

SEQ ID NO: 1548017 - RNA, 11 nt, Homo sapiens
uacugcuaccc

SEQ ID NO: 1548018 - RNA, 17 nt, Homo sapiens
uacuuccccagaugccu

SEQ ID NO: 1548019 - RNA, 16 nt, Homo sapiens
uacuugcacuguuacu

SEQ ID NO: 1548020 - RNA, 16 nt, Homo sapiens
uacuuuuuguauuuag

SEQ ID NO: 1548021 - RNA, 13 nt, Homo sapiens
uagaaagaugaca

SEQ ID NO: 1548022 - RNA, 15 nt, Homo sapiens
uagaaagaugacaaa

SEQ ID NO: 1548023 - RNA, 12 nt, Homo sapiens
uagaaauaagcc

SEQ ID NO: 1548024 - RNA, 16 nt, Homo sapiens
uagaacacugcauuag

SEQ ID NO: 1548025 - RNA, 21 nt, Homo sapiens
uagaaguauaaggugcucuga

SEQ ID NO: 1548026 - RNA, 12 nt, Homo sapiens
uagaaugccaua

SEQ ID NO: 1548027 - RNA, 11 nt, Homo sapiens
uagacuguaac

SEQ ID NO: 1548028 - RNA, 22 nt, Homo sapiens
uagacugugucugaaucauguc

SEQ ID NO: 1548029 - RNA, 19 nt, Homo sapiens
uagagaauacacauauaaa

SEQ ID NO: 1548030 - RNA, 12 nt, Homo sapiens
uagaucuagaaa

SEQ ID NO: 1548031 - RNA, 23 nt, Homo sapiens
uagauuuuagacccuauugcugc

SEQ ID NO: 1548032 - RNA, 21 nt, Homo sapiens
uagcacgggauucaugcagug

SEQ ID NO: 1548033 - RNA, 20 nt, Homo sapiens
uagccacggaaacauagaaa

SEQ ID NO: 1548034 - RNA, 20 nt, Homo sapiens
uagccuaauacaacauguag

SEQ ID NO: 1548035 - RNA, 20 nt, Homo sapiens
uagccucugggaucugccaa

SEQ ID NO: 1548036 - RNA, 19 nt, Homo sapiens
uagcugaguuuaacaugug

SEQ ID NO: 1548037 - RNA, 15 nt, Homo sapiens
uagggcuacagucuc

SEQ ID NO: 1548038 - RNA, 19 nt, Homo sapiens
uaggggagggguugccaca

SEQ ID NO: 1548039 - RNA, 20 nt, Homo sapiens
uagguaaaauaaaagacuau

SEQ ID NO: 1548040 - RNA, 13 nt, Homo sapiens
uaggucaugaagg

SEQ ID NO: 1548041 - RNA, 14 nt, Homo sapiens
uaguaacauagaca

SEQ ID NO: 1548042 - RNA, 21 nt, Homo sapiens
uaguauucuugagggacaaug

SEQ ID NO: 1548043 - RNA, 19 nt, Homo sapiens
uagucagacugacacuacu

SEQ ID NO: 1548044 - RNA, 15 nt, Homo sapiens
uagugagcagcaucu

SEQ ID NO: 1548045 - RNA, 16 nt, Homo sapiens
uagugcuucagaguuu

SEQ ID NO: 1548046 - RNA, 14 nt, Homo sapiens
uagugguuacccag

SEQ ID NO: 1548047 - RNA, 14 nt, Homo sapiens
uagugucagccaug

SEQ ID NO: 1548048 - RNA, 18 nt, Homo sapiens
uaguuauaaaacuaugug

SEQ ID NO: 1548049 - RNA, 23 nt, Homo sapiens
uauaaaacuauguguucaaugaa

SEQ ID NO: 1548050 - RNA, 14 nt, Homo sapiens
uauaagaucacuga

SEQ ID NO: 1548051 - RNA, 21 nt, Homo sapiens
uauaauaacuuugaagccaua

SEQ ID NO: 1548052 - RNA, 23 nt, Homo sapiens
uauacaccuuagucuuuccuuag

SEQ ID NO: 1548053 - RNA, 18 nt, Homo sapiens
uauacauuugauguauug

SEQ ID NO: 1548054 - RNA, 16 nt, Homo sapiens
uauacucuaaaaugga

SEQ ID NO: 1548055 - RNA, 15 nt, Homo sapiens
ucauuccauugccua

SEQ ID NO: 1548056 - RNA, 19 nt, Homo sapiens
ucauucccuagaucuuucu

SEQ ID NO: 1548057 - RNA, 21 nt, Homo sapiens
uccacagaguuuguaguaaau

SEQ ID NO: 1548058 - RNA, 20 nt, Homo sapiens
uccacugcaaauaaagccuu

SEQ ID NO: 1548059 - RNA, 22 nt, Homo sapiens
uccagaacaaauuguuuacaua

SEQ ID NO: 1548060 - RNA, 23 nt, Homo sapiens
uccagaacaaauuguuuacauaa

SEQ ID NO: 1548061 - RNA, 19 nt, Homo sapiens
uccagcccugggacagggc

SEQ ID NO: 1548062 - RNA, 19 nt, Homo sapiens
uccagcuucuagccaugua

SEQ ID NO: 1548063 - RNA, 19 nt, Homo sapiens
uccauaaaagguguguuga

SEQ ID NO: 1548064 - RNA, 16 nt, Homo sapiens
uccauuacgugcauuu

SEQ ID NO: 1548065 - RNA, 18 nt, Homo sapiens
uccauuacgugcauuuaa

SEQ ID NO: 1548066 - RNA, 21 nt, Homo sapiens
ucccacacccaccucugccac

SEQ ID NO: 1548067 - RNA, 23 nt, Homo sapiens
ucccagcacauuuccucucuauc

SEQ ID NO: 1548068 - RNA, 18 nt, Homo sapiens
ucccaggaccccauccuc

SEQ ID NO: 1548069 - RNA, 9 nt, Homo sapiens
ucccagugc

SEQ ID NO: 1548070 - RNA, 18 nt, Homo sapiens
ucccccagagccccucau

SEQ ID NO: 1548071 - RNA, 14 nt, Homo sapiens
uccccggacacucg

SEQ ID NO: 1548072 - RNA, 12 nt, Homo sapiens
ucccugggaugg

SEQ ID NO: 1548073 - RNA, 15 nt, Homo sapiens
ucccuggugcccuuc

SEQ ID NO: 1548074 - RNA, 13 nt, Homo sapiens
ucccuugaaauuu

SEQ ID NO: 1548075 - RNA, 13 nt, Homo sapiens
ucccuuucuuccc

SEQ ID NO: 1548076 - RNA, 23 nt, Homo sapiens
uccuaaaagagaucugggcauua

SEQ ID NO: 1548077 - RNA, 19 nt, Homo sapiens
uccuacagcacuacugggu

SEQ ID NO: 1548078 - RNA, 20 nt, Homo sapiens
uccuacccuccugcacuguu

SEQ ID NO: 1548079 - RNA, 13 nt, Homo sapiens
uccuagcacuuug

SEQ ID NO: 1548080 - RNA, 23 nt, Homo sapiens
uccuaggucaugaaggacacucu

SEQ ID NO: 1548081 - RNA, 13 nt, Homo sapiens
uccucccugucuc

SEQ ID NO: 1548082 - RNA, 18 nt, Homo sapiens
uccucucguccuuggaua

SEQ ID NO: 1548083 - RNA, 13 nt, Homo sapiens
uccugcaguuccc

SEQ ID NO: 1548084 - RNA, 19 nt, Homo sapiens
uccuggagcacuguaaaaa

SEQ ID NO: 1548085 - RNA, 13 nt, Homo sapiens
uccuuacuugcac

SEQ ID NO: 1548086 - RNA, 15 nt, Homo sapiens
uccuuacuugcacug

SEQ ID NO: 1548087 - RNA, 10 nt, Homo sapiens
uccuuggcau

SEQ ID NO: 1548088 - RNA, 21 nt, Homo sapiens
ucgauccaaauugugcuucuc

SEQ ID NO: 1548089 - RNA, 11 nt, Homo sapiens
ucgggaaaauu

SEQ ID NO: 1548090 - RNA, 20 nt, Homo sapiens
ucuauaaguguucaguguug

SEQ ID NO: 1548091 - RNA, 17 nt, Homo sapiens
ucuaugagcaugccaag

SEQ ID NO: 1548092 - RNA, 23 nt, Homo sapiens
ucuauuuaccuccuaauggcaug

SEQ ID NO: 1548093 - RNA, 16 nt, Homo sapiens
ucuauuuauuugacug

SEQ ID NO: 1548094 - RNA, 18 nt, Homo sapiens
ucucaaaugauacaguca

SEQ ID NO: 1548095 - RNA, 15 nt, Homo sapiens
ucuccuucacaucag

SEQ ID NO: 1548096 - RNA, 23 nt, Homo sapiens
ucucuauaaguguucaguguuga

SEQ ID NO: 1548097 - RNA, 16 nt, Homo sapiens
ucucucucucuuuuuc

SEQ ID NO: 1548098 - RNA, 13 nt, Homo sapiens
ucucucuucucca

SEQ ID NO: 1548099 - RNA, 12 nt, Homo sapiens
ucugaaaaccaa

SEQ ID NO: 1548100 - RNA, 19 nt, Homo sapiens
ucugcccaccccagcauca

SEQ ID NO: 1548101 - RNA, 17 nt, Homo sapiens
ucugcucucauccauuc

SEQ ID NO: 1548102 - RNA, 17 nt, Homo sapiens
ucugcuguacauuauua

SEQ ID NO: 1548103 - RNA, 23 nt, Homo sapiens
ucuggaggagcaagggggccaca

SEQ ID NO: 1548104 - RNA, 15 nt, Homo sapiens
ucuggcacguggcca

SEQ ID NO: 1548105 - RNA, 17 nt, Homo sapiens
ucugguuugagcaauuu

SEQ ID NO: 1548106 - RNA, 17 nt, Homo sapiens
ucugucagaagacacua

SEQ ID NO: 1548107 - RNA, 15 nt, Homo sapiens
ucuguuucccaagcu

SEQ ID NO: 1548108 - RNA, 21 nt, Homo sapiens
ucuuacaaccaagaacauuau

SEQ ID NO: 1548109 - RNA, 16 nt, Homo sapiens
ucuuagaaaaaccacc

SEQ ID NO: 1548110 - RNA, 20 nt, Homo sapiens
ucuuccuuacccugcgauuu

SEQ ID NO: 1548111 - RNA, 17 nt, Homo sapiens
ucuucuuuauugcacua

SEQ ID NO: 1548112 - RNA, 15 nt, Homo sapiens
ucuucuuuuacugga

SEQ ID NO: 1548113 - RNA, 14 nt, Homo sapiens
ucuuuauugcacua

SEQ ID NO: 1548114 - RNA, 21 nt, Homo sapiens
ucuuugucaaugcucuaacaa

SEQ ID NO: 1548115 - RNA, 17 nt, Homo sapiens
ugaaaaaaaguacaugu

SEQ ID NO: 1548116 - RNA, 19 nt, Homo sapiens
ugaaaaaaaguacauguau

SEQ ID NO: 1548117 - RNA, 13 nt, Homo sapiens
ugaaaacauacac

SEQ ID NO: 1548118 - RNA, 21 nt, Homo sapiens
ugaaaagaaaaccacagcagg

SEQ ID NO: 1548119 - RNA, 18 nt, Homo sapiens
ugaaaauaauuguuccaa

SEQ ID NO: 1548120 - RNA, 21 nt, Homo sapiens
ugaacagcaggaugcccuguu

SEQ ID NO: 1548121 - RNA, 14 nt, Homo sapiens
ugaacgugccugac

SEQ ID NO: 1548122 - RNA, 17 nt, Homo sapiens
ugaagauauuacuacuu

SEQ ID NO: 1548123 - RNA, 13 nt, Homo sapiens
ugaaggacacucu

SEQ ID NO: 1548124 - RNA, 15 nt, Homo sapiens
ugaagucaaaccuua

SEQ ID NO: 1548125 - RNA, 19 nt, Homo sapiens
ugaagucccagauacuugg

SEQ ID NO: 1548126 - RNA, 16 nt, Homo sapiens
ugaaguguccuaaaua

SEQ ID NO: 1548127 - RNA, 22 nt, Homo sapiens
ugaauaauacaguaucucaggg

SEQ ID NO: 1548128 - RNA, 19 nt, Homo sapiens
ugaauacagcauuuagcuu

SEQ ID NO: 1548129 - RNA, 15 nt, Homo sapiens
ugaaucaugucugua

SEQ ID NO: 1548130 - RNA, 14 nt, Homo sapiens
ugacauagccuuug

SEQ ID NO: 1548131 - RNA, 15 nt, Homo sapiens
ugacauagccuuugu

SEQ ID NO: 1548132 - RNA, 15 nt, Homo sapiens
ugaccucccaccuau

SEQ ID NO: 1548133 - RNA, 16 nt, Homo sapiens
ugacguuguugucauu

SEQ ID NO: 1548134 - RNA, 22 nt, Homo sapiens
ugacguuguugucauuguccag

SEQ ID NO: 1548135 - RNA, 14 nt, Homo sapiens
ugagaagggacaag

SEQ ID NO: 1548136 - RNA, 23 nt, Homo sapiens
ugagaagggacaagccaccuuga

SEQ ID NO: 1548137 - RNA, 19 nt, Homo sapiens
ugagaaguacuuuaccuga

SEQ ID NO: 1548138 - RNA, 22 nt, Homo sapiens
ugagaaucugugcagucaucaa

SEQ ID NO: 1548139 - RNA, 14 nt, Homo sapiens
ugagaccucaaauc

SEQ ID NO: 1548140 - RNA, 18 nt, Homo sapiens
ugagaguuccucuuugcc

SEQ ID NO: 1548141 - RNA, 13 nt, Homo sapiens
ugagcagguauca

SEQ ID NO: 1548142 - RNA, 16 nt, Homo sapiens
ugaguaggaugucucu

SEQ ID NO: 1548143 - RNA, 15 nt, Homo sapiens
ugagugggugaauaa

SEQ ID NO: 1548144 - RNA, 12 nt, Homo sapiens
ugaguuacuuag

SEQ ID NO: 1548145 - RNA, 21 nt, Homo sapiens
ugaucacaucuaaagcuuuau

SEQ ID NO: 1548146 - RNA, 20 nt, Homo sapiens
ugaucuuuguuuaaaugcca

SEQ ID NO: 1548147 - RNA, 13 nt, Homo sapiens
ugaugccaagaaa

SEQ ID NO: 1548148 - RNA, 13 nt, Homo sapiens
ugauuccagaaca

SEQ ID NO: 1548149 - RNA, 16 nt, Homo sapiens
ugcaggaccucaggug

SEQ ID NO: 1548150 - RNA, 16 nt, Homo sapiens
ugcaguuucauguaug

SEQ ID NO: 1548151 - RNA, 15 nt, Homo sapiens
ugcauagcuuucaca

SEQ ID NO: 1548152 - RNA, 20 nt, Homo sapiens
ugcauuaaaggagaucuucc

SEQ ID NO: 1548153 - RNA, 14 nt, Homo sapiens
ugcauuccagaaca

SEQ ID NO: 1548154 - RNA, 18 nt, Homo sapiens
ugcauuccuuacuugcac

SEQ ID NO: 1548155 - RNA, 19 nt, Homo sapiens
ugcauuccuuacuugcacu

SEQ ID NO: 1548156 - RNA, 18 nt, Homo sapiens
ugccagaaaaaaauaacu

SEQ ID NO: 1548157 - RNA, 12 nt, Homo sapiens
ugccaugaaaau

SEQ ID NO: 1548158 - RNA, 15 nt, Homo sapiens
ugccaugccagcuua

SEQ ID NO: 1548159 - RNA, 17 nt, Homo sapiens
ugccauugucuuuccuc

SEQ ID NO: 1548160 - RNA, 18 nt, Homo sapiens
ugcccggcaggguccuag

SEQ ID NO: 1548161 - RNA, 16 nt, Homo sapiens
ugccgaacauuaggaa

SEQ ID NO: 1548162 - RNA, 22 nt, Homo sapiens
ugccguguccaagggccgugcc

SEQ ID NO: 1548163 - RNA, 21 nt, Homo sapiens
ugccucaucacgccacuggag

SEQ ID NO: 1548164 - RNA, 15 nt, Homo sapiens
ugccuccugccuccc

SEQ ID NO: 1548165 - RNA, 13 nt, Homo sapiens
ugccugguuuuau

SEQ ID NO: 1548166 - RNA, 15 nt, Homo sapiens
ugccuguguccugau

SEQ ID NO: 1548167 - RNA, 19 nt, Homo sapiens
ugccuuccuccuuauccua

SEQ ID NO: 1548168 - RNA, 11 nt, Homo sapiens
ugcgugccugc

SEQ ID NO: 1548169 - RNA, 17 nt, Homo sapiens
ugcucauguauauuuag

SEQ ID NO: 1548170 - RNA, 16 nt, Homo sapiens
ugcuccuggcccuucu

SEQ ID NO: 1548171 - RNA, 13 nt, Homo sapiens
ugcucgcugagaa

SEQ ID NO: 1548172 - RNA, 23 nt, Homo sapiens
ugcucugggagacuuacugcauu

SEQ ID NO: 1548173 - RNA, 15 nt, Homo sapiens
ugcugauguuuacaa

SEQ ID NO: 1548174 - RNA, 17 nt, Homo sapiens
ugcugcaaacccaugaa

SEQ ID NO: 1548175 - RNA, 23 nt, Homo sapiens
guuucccaagcuagacugugucu

SEQ ID NO: 1548176 - RNA, 21 nt, Homo sapiens
guuugggguggggaagggaag

SEQ ID NO: 1548177 - RNA, 12 nt, Homo sapiens
guuuuuuuccaa

SEQ ID NO: 1548178 - RNA, 18 nt, Homo sapiens
uaaaacccaagugccuua

SEQ ID NO: 1548179 - RNA, 15 nt, Homo sapiens
uaaaaccugagccau

SEQ ID NO: 1548180 - RNA, 19 nt, Homo sapiens
uaaaagagaucugggcauu

SEQ ID NO: 1548181 - RNA, 17 nt, Homo sapiens
uaaaagcaccauuguga

SEQ ID NO: 1548182 - RNA, 16 nt, Homo sapiens
uaaaauaaaagacuau

SEQ ID NO: 1548183 - RNA, 13 nt, Homo sapiens
uaaacuaguuuaa

SEQ ID NO: 1548184 - RNA, 19 nt, Homo sapiens
uaaagacccaacuugccaa

SEQ ID NO: 1548185 - RNA, 21 nt, Homo sapiens
uaaaugacuauuguaaugcca

SEQ ID NO: 1548186 - RNA, 19 nt, Homo sapiens
uaacaccaugauuaaccac

SEQ ID NO: 1548187 - RNA, 21 nt, Homo sapiens
uaacacuauacucuaaaaugg

SEQ ID NO: 1548188 - RNA, 23 nt, Homo sapiens
uaaccucgcucgaugacugugaa

SEQ ID NO: 1548189 - RNA, 15 nt, Homo sapiens
uaaccuuuacacucc

SEQ ID NO: 1548190 - RNA, 15 nt, Homo sapiens
uaacuacaucugccu

SEQ ID NO: 1548191 - RNA, 16 nt, Homo sapiens
uaacuuauugcauaac

SEQ ID NO: 1548192 - RNA, 23 nt, Homo sapiens
uaagaccaccuucccuuccucag

SEQ ID NO: 1548193 - RNA, 18 nt, Homo sapiens
uaagcuucuagacacucc

SEQ ID NO: 1548194 - RNA, 14 nt, Homo sapiens
uaauaaagcauucu

SEQ ID NO: 1548195 - RNA, 17 nt, Homo sapiens
uaauauaaaguguaaua

SEQ ID NO: 1548196 - RNA, 18 nt, Homo sapiens
uaaucagcaauauugccu

SEQ ID NO: 1548197 - RNA, 13 nt, Homo sapiens
uaaucaugcucau

SEQ ID NO: 1548198 - RNA, 14 nt, Homo sapiens
uaaucaugcucaug

SEQ ID NO: 1548199 - RNA, 18 nt, Homo sapiens
uaaugccaauaugacaca

SEQ ID NO: 1548200 - RNA, 17 nt, Homo sapiens
uaauguaauaauagaaa

SEQ ID NO: 1548201 - RNA, 20 nt, Homo sapiens
uaauuaugaguuugcuuaug

SEQ ID NO: 1548202 - RNA, 13 nt, Homo sapiens
uaauucauggcau

SEQ ID NO: 1548203 - RNA, 13 nt, Homo sapiens
uaauugaucagau

SEQ ID NO: 1548204 - RNA, 21 nt, Homo sapiens
uacaaaacugcuuugugcaua

SEQ ID NO: 1548205 - RNA, 17 nt, Homo sapiens
uacacaacuuugcaaau

SEQ ID NO: 1548206 - RNA, 18 nt, Homo sapiens
uacacauaugugcuucuc

SEQ ID NO: 1548207 - RNA, 17 nt, Homo sapiens
uacaccuuagucuuucc

SEQ ID NO: 1548208 - RNA, 21 nt, Homo sapiens
uacagggagccuccugcccag

SEQ ID NO: 1548209 - RNA, 16 nt, Homo sapiens
uacaguaucucagggc

SEQ ID NO: 1548210 - RNA, 21 nt, Homo sapiens
uacaguuuauuuucuguguaa

SEQ ID NO: 1548211 - RNA, 17 nt, Homo sapiens
uacauacauacauacaa

SEQ ID NO: 1548212 - RNA, 16 nt, Homo sapiens
uaccacgggucugcca

SEQ ID NO: 1548213 - RNA, 14 nt, Homo sapiens
uaccaugugugcua

SEQ ID NO: 1548214 - RNA, 21 nt, Homo sapiens
uaccauuugcuacuguacaua

SEQ ID NO: 1548215 - RNA, 17 nt, Homo sapiens
uaccuucucccaggccu

SEQ ID NO: 1548216 - RNA, 20 nt, Homo sapiens
uacgacccuuuugagccuag

SEQ ID NO: 1548217 - RNA, 18 nt, Homo sapiens
uacggggaaaaugcauuu

SEQ ID NO: 1548218 - RNA, 22 nt, Homo sapiens
uacucugcccaccccagcauca

SEQ ID NO: 1548219 - RNA, 15 nt, Homo sapiens
uacuguacauacaaa

SEQ ID NO: 1548220 - RNA, 16 nt, Homo sapiens
uacuuaccauuugcua

SEQ ID NO: 1548221 - RNA, 15 nt, Homo sapiens
uacuugugcacuuag

SEQ ID NO: 1548222 - RNA, 12 nt, Homo sapiens
uagaaaaaccac

SEQ ID NO: 1548223 - RNA, 16 nt, Homo sapiens
uagaaaccccucugua

SEQ ID NO: 1548224 - RNA, 16 nt, Homo sapiens
uagaaaggacuguaaa

SEQ ID NO: 1548225 - RNA, 14 nt, Homo sapiens
uagaaauuccccac

SEQ ID NO: 1548226 - RNA, 17 nt, Homo sapiens
uagaacacugcauuaga

SEQ ID NO: 1548227 - RNA, 17 nt, Homo sapiens
uagacacuuuaccucuu

SEQ ID NO: 1548228 - RNA, 20 nt, Homo sapiens
uagaguagguacuccauaaa

SEQ ID NO: 1548229 - RNA, 22 nt, Homo sapiens
uagauaauuuauuauacaccuu

SEQ ID NO: 1548230 - RNA, 14 nt, Homo sapiens
uagcccaaaaccaa

SEQ ID NO: 1548231 - RNA, 19 nt, Homo sapiens
uagccucugggaucugcca

SEQ ID NO: 1548232 - RNA, 15 nt, Homo sapiens
uagcuugauugcuca

SEQ ID NO: 1548233 - RNA, 20 nt, Homo sapiens
uaggaauucaauuuggcaaa

SEQ ID NO: 1548234 - RNA, 14 nt, Homo sapiens
uaggcauuugcuga

SEQ ID NO: 1548235 - RNA, 22 nt, Homo sapiens
uaggguuauuaguccaaaugug

SEQ ID NO: 1548236 - RNA, 17 nt, Homo sapiens
uaggugagcuauaguga

SEQ ID NO: 1548237 - RNA, 20 nt, Homo sapiens
uaguagaaagacaucugccu

SEQ ID NO: 1548238 - RNA, 22 nt, Homo sapiens
uaguauuuaacuacaucugccu

SEQ ID NO: 1548239 - RNA, 20 nt, Homo sapiens
uagucauaugugaagacaga

SEQ ID NO: 1548240 - RNA, 19 nt, Homo sapiens
uagugguuggauguaguca

SEQ ID NO: 1548241 - RNA, 18 nt, Homo sapiens
uaguguccaaauucucac

SEQ ID NO: 1548242 - RNA, 21 nt, Homo sapiens
uauaaguguucaguguugaca

SEQ ID NO: 1548243 - RNA, 18 nt, Homo sapiens
uauacacaacuuugcaaa

SEQ ID NO: 1548244 - RNA, 13 nt, Homo sapiens
uauacaccuuagu

SEQ ID NO: 1548245 - RNA, 23 nt, Homo sapiens
uauaccugccuuuuaaguuugaa

SEQ ID NO: 1548246 - RNA, 18 nt, Homo sapiens
uauauuuuuggugguggu

SEQ ID NO: 1548247 - RNA, 16 nt, Homo sapiens
uaucaaaaaguauuaa

SEQ ID NO: 1548248 - RNA, 23 nt, Homo sapiens
uauccuguaauaaagcucuuuaa

SEQ ID NO: 1548249 - RNA, 17 nt, Homo sapiens
uaugagaaaaauauuca

SEQ ID NO: 1548250 - RNA, 14 nt, Homo sapiens
uaugcagaauguuu

SEQ ID NO: 1548251 - RNA, 22 nt, Homo sapiens
uauguaaucucaccucaccugg

SEQ ID NO: 1548252 - RNA, 15 nt, Homo sapiens
uauguguucaaugaa

SEQ ID NO: 1548253 - RNA, 17 nt, Homo sapiens
uauguuuccuaacugug

SEQ ID NO: 1548254 - RNA, 22 nt, Homo sapiens
uauuaauaaagcauucuuuaac

SEQ ID NO: 1548255 - RNA, 19 nt, Homo sapiens
uauuagaaaggacuguaaa

SEQ ID NO: 1548256 - RNA, 21 nt, Homo sapiens
uauucagauauaaaacaguuu

SEQ ID NO: 1548257 - RNA, 23 nt, Homo sapiens
uauucagauauaaaacaguuuug

SEQ ID NO: 1548258 - RNA, 23 nt, Homo sapiens
uauugcacuaggaauucuuugca

SEQ ID NO: 1548259 - RNA, 15 nt, Homo sapiens
uauuuaaacaacagc

SEQ ID NO: 1548260 - RNA, 16 nt, Homo sapiens
uauuuaaacaacagcu

SEQ ID NO: 1548261 - RNA, 17 nt, Homo sapiens
uauuuaccagaccacaa

SEQ ID NO: 1548262 - RNA, 14 nt, Homo sapiens
uauuuucuguguaa

SEQ ID NO: 1548263 - RNA, 22 nt, Homo sapiens
ucaaaauaaaaauuaaauguga

SEQ ID NO: 1548264 - RNA, 18 nt, Homo sapiens
ucaaacccuccacuucuc

SEQ ID NO: 1548265 - RNA, 12 nt, Homo sapiens
ucaaaucacugc

SEQ ID NO: 1548266 - RNA, 14 nt, Homo sapiens
ucaacaaaagggag

SEQ ID NO: 1548267 - RNA, 18 nt, Homo sapiens
ucaacgaugugacugcca

SEQ ID NO: 1548268 - RNA, 16 nt, Homo sapiens
ucaaggauauacugca

SEQ ID NO: 1548269 - RNA, 16 nt, Homo sapiens
ucaaggcugcagugag

SEQ ID NO: 1548270 - RNA, 22 nt, Homo sapiens
ucaauuuggcaaaacaaaaugu

SEQ ID NO: 1548271 - RNA, 17 nt, Homo sapiens
ucacaaguagccucugg

SEQ ID NO: 1548272 - RNA, 13 nt, Homo sapiens
ucacacucucuug

SEQ ID NO: 1548273 - RNA, 15 nt, Homo sapiens
ucacaggcagcucug

SEQ ID NO: 1548274 - RNA, 17 nt, Homo sapiens
ucacaucuaaagcuuua

SEQ ID NO: 1548275 - RNA, 23 nt, Homo sapiens
ucacgaacuguucacacugcaga

SEQ ID NO: 1548276 - RNA, 14 nt, Homo sapiens
ucacuaauacuaau

SEQ ID NO: 1548277 - RNA, 13 nt, Homo sapiens
ucacugcauucau

SEQ ID NO: 1548278 - RNA, 12 nt, Homo sapiens
ucagacuuugcu

SEQ ID NO: 1548279 - RNA, 19 nt, Homo sapiens
ucagcaaaagaugcuucuc

SEQ ID NO: 1548280 - RNA, 21 nt, Homo sapiens
ucagcaauauugccugugcuu

SEQ ID NO: 1548281 - RNA, 12 nt, Homo sapiens
ucagcagcaucg

SEQ ID NO: 1548282 - RNA, 22 nt, Homo sapiens
ucagcgugguuuuuauguguau

SEQ ID NO: 1548283 - RNA, 22 nt, Homo sapiens
ucagcuugcuuagauguuccaa

SEQ ID NO: 1548284 - RNA, 22 nt, Homo sapiens
ucaguaaaaauaaauaaaacag

SEQ ID NO: 1548285 - RNA, 19 nt, Homo sapiens
ucaguagugagcagcaucu

SEQ ID NO: 1548286 - RNA, 16 nt, Homo sapiens
ucagucaugcacucac

SEQ ID NO: 1548287 - RNA, 23 nt, Homo sapiens
ucauaagccuaccaauguagaca

SEQ ID NO: 1548288 - RNA, 15 nt, Homo sapiens
ucauaugaccauuga

SEQ ID NO: 1548289 - RNA, 15 nt, Homo sapiens
ucauauugaauguuu

SEQ ID NO: 1548290 - RNA, 18 nt, Homo sapiens
ucaugcaaacugcuuuau

SEQ ID NO: 1548291 - RNA, 17 nt, Homo sapiens
ucauuagcauuuugcua

SEQ ID NO: 1548292 - RNA, 21 nt, Homo sapiens
ucauucagcgcaugcaccuuc

SEQ ID NO: 1548293 - RNA, 19 nt, Homo sapiens
gcuggguauuggaaaugga

SEQ ID NO: 1548294 - RNA, 20 nt, Homo sapiens
gcuucaaggauauacugcag

SEQ ID NO: 1548295 - RNA, 12 nt, Homo sapiens
gcuucagaguuu

SEQ ID NO: 1548296 - RNA, 14 nt, Homo sapiens
gcuucuacugugac

SEQ ID NO: 1548297 - RNA, 15 nt, Homo sapiens
gcuucuacugugaca

SEQ ID NO: 1548298 - RNA, 22 nt, Homo sapiens
gcuucucuucuuuauugcacua

SEQ ID NO: 1548299 - RNA, 11 nt, Homo sapiens
gcuucugccau

SEQ ID NO: 1548300 - RNA, 16 nt, Homo sapiens
gcuuguuccacugcaa

SEQ ID NO: 1548301 - RNA, 17 nt, Homo sapiens
ggaaaggacaguguggg

SEQ ID NO: 1548302 - RNA, 22 nt, Homo sapiens
ggaaccgagguguugccagugc

SEQ ID NO: 1548303 - RNA, 17 nt, Homo sapiens
ggaaggaggaauguggg

SEQ ID NO: 1548304 - RNA, 17 nt, Homo sapiens
ggaagguucuacgccag

SEQ ID NO: 1548305 - RNA, 15 nt, Homo sapiens
ggaaguucaacuucc

SEQ ID NO: 1548306 - RNA, 18 nt, Homo sapiens
ggaaugaauacagcauuu

SEQ ID NO: 1548307 - RNA, 20 nt, Homo sapiens
ggacccuguagggugccauu

SEQ ID NO: 1548308 - RNA, 14 nt, Homo sapiens
ggaccuuggcgcuu

SEQ ID NO: 1548309 - RNA, 14 nt, Homo sapiens
ggacuacagcuuuc

SEQ ID NO: 1548310 - RNA, 17 nt, Homo sapiens
ggagaaggagugccaua

SEQ ID NO: 1548311 - RNA, 21 nt, Homo sapiens
ggagcugccgugccugugucc

SEQ ID NO: 1548312 - RNA, 21 nt, Homo sapiens
ggaggacccuggaaauggacu

SEQ ID NO: 1548313 - RNA, 13 nt, Homo sapiens
ggaggcaucugca

SEQ ID NO: 1548314 - RNA, 11 nt, Homo sapiens
ggaggggcccc

SEQ ID NO: 1548315 - RNA, 17 nt, Homo sapiens
ggauaauaggaauucaa

SEQ ID NO: 1548316 - RNA, 15 nt, Homo sapiens
ggauauacugcagcu

SEQ ID NO: 1548317 - RNA, 21 nt, Homo sapiens
ggauauacugcagcuuuacug

SEQ ID NO: 1548318 - RNA, 20 nt, Homo sapiens
ggcagagccaccagggcacu

SEQ ID NO: 1548319 - RNA, 14 nt, Homo sapiens
ggcaggaucaaaga

SEQ ID NO: 1548320 - RNA, 22 nt, Homo sapiens
ggcaggaucaaagacacacagg

SEQ ID NO: 1548321 - RNA, 21 nt, Homo sapiens
ggcagugagaaggcaaccaaa

SEQ ID NO: 1548322 - RNA, 22 nt, Homo sapiens
ggcagugagugccaugcuuuuu

SEQ ID NO: 1548323 - RNA, 17 nt, Homo sapiens
ggcccuuucuugcacug

SEQ ID NO: 1548324 - RNA, 19 nt, Homo sapiens
ggccgggcgcgguggcuca

SEQ ID NO: 1548325 - RNA, 21 nt, Homo sapiens
ggcuaauggaguguuugaaaa

SEQ ID NO: 1548326 - RNA, 19 nt, Homo sapiens
ggcucagcagggcugguca

SEQ ID NO: 1548327 - RNA, 20 nt, Homo sapiens
ggcucccaagccacauucau

SEQ ID NO: 1548328 - RNA, 19 nt, Homo sapiens
ggcugguauuuaucugcaa

SEQ ID NO: 1548329 - RNA, 17 nt, Homo sapiens
ggcuguggguggugauu

SEQ ID NO: 1548330 - RNA, 14 nt, Homo sapiens
ggcuuucaugauuu

SEQ ID NO: 1548331 - RNA, 16 nt, Homo sapiens
gggaagaugcccucaa

SEQ ID NO: 1548332 - RNA, 11 nt, Homo sapiens
gggacuggggg

SEQ ID NO: 1548333 - RNA, 20 nt, Homo sapiens
gggagagcccugucccugcc

SEQ ID NO: 1548334 - RNA, 19 nt, Homo sapiens
gggauucccuggugggccu

SEQ ID NO: 1548335 - RNA, 16 nt, Homo sapiens
gggcaaacaacugaac

SEQ ID NO: 1548336 - RNA, 12 nt, Homo sapiens
gggcacugucug

SEQ ID NO: 1548337 - RNA, 15 nt, Homo sapiens
gggcaucauccucag

SEQ ID NO: 1548338 - RNA, 17 nt, Homo sapiens
gggccaauuuacuggcc

SEQ ID NO: 1548339 - RNA, 15 nt, Homo sapiens
gggcuauugggcccu

SEQ ID NO: 1548340 - RNA, 12 nt, Homo sapiens
gggcucagcaaa

SEQ ID NO: 1548341 - RNA, 17 nt, Homo sapiens
ggguggugcugggucau

SEQ ID NO: 1548342 - RNA, 13 nt, Homo sapiens
gguaaaauguauu

SEQ ID NO: 1548343 - RNA, 23 nt, Homo sapiens
ggucauccgggaggacaaccaga

SEQ ID NO: 1548344 - RNA, 16 nt, Homo sapiens
gguccuacuccuggag

SEQ ID NO: 1548345 - RNA, 18 nt, Homo sapiens
ggucuucuuuuacuggac

SEQ ID NO: 1548346 - RNA, 19 nt, Homo sapiens
ggugcugagugcuaugugu

SEQ ID NO: 1548347 - RNA, 19 nt, Homo sapiens
ggugcugggaauacaucug

SEQ ID NO: 1548348 - RNA, 22 nt, Homo sapiens
gguucaugcuucuacugugaca

SEQ ID NO: 1548349 - RNA, 12 nt, Homo sapiens
gguuucauucug

SEQ ID NO: 1548350 - RNA, 15 nt, Homo sapiens
gguuuuacugcagcu

SEQ ID NO: 1548351 - RNA, 12 nt, Homo sapiens
guaacacuacag

SEQ ID NO: 1548352 - RNA, 19 nt, Homo sapiens
guaacuuguuuuuauugca

SEQ ID NO: 1548353 - RNA, 15 nt, Homo sapiens
guaaucuaaguauau

SEQ ID NO: 1548354 - RNA, 13 nt, Homo sapiens
guaauuauguaac

SEQ ID NO: 1548355 - RNA, 18 nt, Homo sapiens
guacccccuucugggcau

SEQ ID NO: 1548356 - RNA, 22 nt, Homo sapiens
guacgauggaggccuaccucuc

SEQ ID NO: 1548357 - RNA, 14 nt, Homo sapiens
guacuuuaccugaa

SEQ ID NO: 1548358 - RNA, 12 nt, Homo sapiens
guaggaugucuc

SEQ ID NO: 1548359 - RNA, 23 nt, Homo sapiens
guauaguagaaagacaucugccu

SEQ ID NO: 1548360 - RNA, 20 nt, Homo sapiens
guauguguguagacuguaac

SEQ ID NO: 1548361 - RNA, 22 nt, Homo sapiens
guauuaauaaagcauucuuuaa

SEQ ID NO: 1548362 - RNA, 21 nt, Homo sapiens
guauucccccaucuagccauu

SEQ ID NO: 1548363 - RNA, 22 nt, Homo sapiens
guauucuugagggacaaugcca

SEQ ID NO: 1548364 - RNA, 14 nt, Homo sapiens
guauuuaaacaaca

SEQ ID NO: 1548365 - RNA, 21 nt, Homo sapiens
guauuuguauuaauaaagcau

SEQ ID NO: 1548366 - RNA, 16 nt, Homo sapiens
gucaguggcuuugcau

SEQ ID NO: 1548367 - RNA, 17 nt, Homo sapiens
gucauaugugaagacag

SEQ ID NO: 1548368 - RNA, 19 nt, Homo sapiens
guccaugugguucuucaaa

SEQ ID NO: 1548369 - RNA, 21 nt, Homo sapiens
gucccaaguuggaaauauuca

SEQ ID NO: 1548370 - RNA, 20 nt, Homo sapiens
guccuaggucaugaaggaca

SEQ ID NO: 1548371 - RNA, 14 nt, Homo sapiens
guccuugcaccuga

SEQ ID NO: 1548372 - RNA, 21 nt, Homo sapiens
gucucucucucuuuuucuuuu

SEQ ID NO: 1548373 - RNA, 19 nt, Homo sapiens
gucugaagccugcaggucc

SEQ ID NO: 1548374 - RNA, 14 nt, Homo sapiens
gucugccaugcucu

SEQ ID NO: 1548375 - RNA, 14 nt, Homo sapiens
gucugcgugacuau

SEQ ID NO: 1548376 - RNA, 14 nt, Homo sapiens
gucuuguucuguga

SEQ ID NO: 1548377 - RNA, 13 nt, Homo sapiens
gucuuucaucucc

SEQ ID NO: 1548378 - RNA, 23 nt, Homo sapiens
gugaaucccuuuaggauguuuuc

SEQ ID NO: 1548379 - RNA, 20 nt, Homo sapiens
gugaauuuuuaaucagcaau

SEQ ID NO: 1548380 - RNA, 13 nt, Homo sapiens
gugagauguaauu

SEQ ID NO: 1548381 - RNA, 22 nt, Homo sapiens
gugaguuuuacucuuaaaucau

SEQ ID NO: 1548382 - RNA, 19 nt, Homo sapiens
gugaucaacuguucagggu

SEQ ID NO: 1548383 - RNA, 16 nt, Homo sapiens
gugaugaacgugccug

SEQ ID NO: 1548384 - RNA, 17 nt, Homo sapiens
gugauuuucauugcugg

SEQ ID NO: 1548385 - RNA, 18 nt, Homo sapiens
gugcagcccuuccucccu

SEQ ID NO: 1548386 - RNA, 16 nt, Homo sapiens
gugcaugugccgaggu

SEQ ID NO: 1548387 - RNA, 18 nt, Homo sapiens
gugccauuuggaguucac

SEQ ID NO: 1548388 - RNA, 19 nt, Homo sapiens
gugccugguucgugccaug

SEQ ID NO: 1548389 - RNA, 15 nt, Homo sapiens
gugcugauguuuaca

SEQ ID NO: 1548390 - RNA, 22 nt, Homo sapiens
gugcuucagaguuuguguguau

SEQ ID NO: 1548391 - RNA, 21 nt, Homo sapiens
gugcuucucuucuuuauugca

SEQ ID NO: 1548392 - RNA, 20 nt, Homo sapiens
guggccaggagccaugacag

SEQ ID NO: 1548393 - RNA, 19 nt, Homo sapiens
guguagaggguguuugcag

SEQ ID NO: 1548394 - RNA, 14 nt, Homo sapiens
guguauuguguaug

SEQ ID NO: 1548395 - RNA, 15 nt, Homo sapiens
gugugcugcuguucu

SEQ ID NO: 1548396 - RNA, 19 nt, Homo sapiens
gugugggggaagcaccaua

SEQ ID NO: 1548397 - RNA, 17 nt, Homo sapiens
guguucaguguugacau

SEQ ID NO: 1548398 - RNA, 22 nt, Homo sapiens
guguugcuuuggauacacacau

SEQ ID NO: 1548399 - RNA, 14 nt, Homo sapiens
guuacugucuucag

SEQ ID NO: 1548400 - RNA, 21 nt, Homo sapiens
guuagugucagccaugggaaa

SEQ ID NO: 1548401 - RNA, 16 nt, Homo sapiens
guucacacugcagaga

SEQ ID NO: 1548402 - RNA, 16 nt, Homo sapiens
guucgauuuaagccau

SEQ ID NO: 1548403 - RNA, 13 nt, Homo sapiens
guucuauccaaac

SEQ ID NO: 1548404 - RNA, 15 nt, Homo sapiens
guucuauccaaacau

SEQ ID NO: 1548405 - RNA, 21 nt, Homo sapiens
guucuuauauaagaucacuga

SEQ ID NO: 1548406 - RNA, 15 nt, Homo sapiens
guugacauagccuuu

SEQ ID NO: 1548407 - RNA, 19 nt, Homo sapiens
guugauucagcucugcaag

SEQ ID NO: 1548408 - RNA, 15 nt, Homo sapiens
guuggacagacacug

SEQ ID NO: 1548409 - RNA, 17 nt, Homo sapiens
guuggacagacacuguu

SEQ ID NO: 1548410 - RNA, 13 nt, Homo sapiens
guugugcagcauu

SEQ ID NO: 1548411 - RNA, 21 nt, Homo sapiens
guuucccaagcuagacugugu

SEQ ID NO: 1548412 - RNA, 18 nt, Homo sapiens
gacuuugcugcauuuuac

SEQ ID NO: 1548413 - RNA, 16 nt, Homo sapiens
gacuuuuauuaugggu

SEQ ID NO: 1548414 - RNA, 17 nt, Homo sapiens
gagaaaagaaaccagag

SEQ ID NO: 1548415 - RNA, 22 nt, Homo sapiens
gagaaaagaaaccagagucaaa

SEQ ID NO: 1548416 - RNA, 12 nt, Homo sapiens
gagaaaugccag

SEQ ID NO: 1548417 - RNA, 18 nt, Homo sapiens
gagaaguacuuuaccuga

SEQ ID NO: 1548418 - RNA, 18 nt, Homo sapiens
gagacucgcucacuccca

SEQ ID NO: 1548419 - RNA, 21 nt, Homo sapiens
gagagcccccacccaguuccu

SEQ ID NO: 1548420 - RNA, 16 nt, Homo sapiens
gagagguuugcaucca

SEQ ID NO: 1548421 - RNA, 20 nt, Homo sapiens
gagaguuccucuuugcccug

SEQ ID NO: 1548422 - RNA, 20 nt, Homo sapiens
gagaugcugguaauggccau

SEQ ID NO: 1548423 - RNA, 22 nt, Homo sapiens
gagcauaucaaaaaguauuaaa

SEQ ID NO: 1548424 - RNA, 23 nt, Homo sapiens
gagcaucucugccuccaacccag

SEQ ID NO: 1548425 - RNA, 16 nt, Homo sapiens
gagccuggcaagaaug

SEQ ID NO: 1548426 - RNA, 17 nt, Homo sapiens
gaggaagaugaagacca

SEQ ID NO: 1548427 - RNA, 13 nt, Homo sapiens
gaggccuaccucu

SEQ ID NO: 1548428 - RNA, 15 nt, Homo sapiens
gagguagaggaaaau

SEQ ID NO: 1548429 - RNA, 22 nt, Homo sapiens
gagguuagcccaauggagaaau

SEQ ID NO: 1548430 - RNA, 13 nt, Homo sapiens
gagugccaugcuu

SEQ ID NO: 1548431 - RNA, 13 nt, Homo sapiens
gagugugaugaac

SEQ ID NO: 1548432 - RNA, 15 nt, Homo sapiens
gaguuuaacaugugu

SEQ ID NO: 1548433 - RNA, 20 nt, Homo sapiens
gaguuuguguguauuuguau

SEQ ID NO: 1548434 - RNA, 20 nt, Homo sapiens
gauaauuuauuauacaccuu

SEQ ID NO: 1548435 - RNA, 23 nt, Homo sapiens
gauagcauggggccccuggccca

SEQ ID NO: 1548436 - RNA, 16 nt, Homo sapiens
gauauuaucauaacau

SEQ ID NO: 1548437 - RNA, 23 nt, Homo sapiens
gaucacagccucugaaaaccaau

SEQ ID NO: 1548438 - RNA, 21 nt, Homo sapiens
gaucagaugcugaauugagaa

SEQ ID NO: 1548439 - RNA, 18 nt, Homo sapiens
gaucauagguauuucaaa

SEQ ID NO: 1548440 - RNA, 21 nt, Homo sapiens
gaugacaaaagaaaauuuucc

SEQ ID NO: 1548441 - RNA, 13 nt, Homo sapiens
gaugauaaaacac

SEQ ID NO: 1548442 - RNA, 17 nt, Homo sapiens
gaugccaaaaacaaaaa

SEQ ID NO: 1548443 - RNA, 13 nt, Homo sapiens
gauggauuuccag

SEQ ID NO: 1548444 - RNA, 18 nt, Homo sapiens
gauucaggugcuggagaa

SEQ ID NO: 1548445 - RNA, 18 nt, Homo sapiens
gcaaacaaauaaaaugaa

SEQ ID NO: 1548446 - RNA, 20 nt, Homo sapiens
gcaaacaaauaaaaugaaau

SEQ ID NO: 1548447 - RNA, 14 nt, Homo sapiens
gcaaacugcuuuau

SEQ ID NO: 1548448 - RNA, 20 nt, Homo sapiens
gcaacaucuuacuuguccuu

SEQ ID NO: 1548449 - RNA, 16 nt, Homo sapiens
gcaagcauuuuuccau

SEQ ID NO: 1548450 - RNA, 19 nt, Homo sapiens
gcaauguggggagacccca

SEQ ID NO: 1548451 - RNA, 13 nt, Homo sapiens
gcaauuuuuccau

SEQ ID NO: 1548452 - RNA, 24 nt, Homo sapiens
gcacacuaagaaaugggacucuga

SEQ ID NO: 1548453 - RNA, 20 nt, Homo sapiens
gcacguggccaggagccaug

SEQ ID NO: 1548454 - RNA, 22 nt, Homo sapiens
gcacguggccaggagccaugac

SEQ ID NO: 1548455 - RNA, 18 nt, Homo sapiens
gcacuacugggugucauu

SEQ ID NO: 1548456 - RNA, 22 nt, Homo sapiens
gcacuacugggugucauuucau

SEQ ID NO: 1548457 - RNA, 22 nt, Homo sapiens
gcacugcccaggucccuccuca

SEQ ID NO: 1548458 - RNA, 22 nt, Homo sapiens
gcacuuaguaguuuuuacaaaa

SEQ ID NO: 1548459 - RNA, 21 nt, Homo sapiens
gcacuugccugcugcuuggag

SEQ ID NO: 1548460 - RNA, 16 nt, Homo sapiens
gcagagccaccagggc

SEQ ID NO: 1548461 - RNA, 17 nt, Homo sapiens
gcagaugccaaaaaaga

SEQ ID NO: 1548462 - RNA, 13 nt, Homo sapiens
gcagcagcaaaca

SEQ ID NO: 1548463 - RNA, 22 nt, Homo sapiens
gcagcagggagggcuucugcca

SEQ ID NO: 1548464 - RNA, 13 nt, Homo sapiens
gcagcugauucca

SEQ ID NO: 1548465 - RNA, 17 nt, Homo sapiens
gcaggaagauagcuuga

SEQ ID NO: 1548466 - RNA, 14 nt, Homo sapiens
gcaggaggugccug

SEQ ID NO: 1548467 - RNA, 14 nt, Homo sapiens
gcaggagguucugg

SEQ ID NO: 1548468 - RNA, 17 nt, Homo sapiens
gcaggaucaaagacaca

SEQ ID NO: 1548469 - RNA, 13 nt, Homo sapiens
gcaggaugcuaau

SEQ ID NO: 1548470 - RNA, 18 nt, Homo sapiens
gcagugagugccaugcuu

SEQ ID NO: 1548471 - RNA, 19 nt, Homo sapiens
gcaguucucugccaaagcu

SEQ ID NO: 1548472 - RNA, 14 nt, Homo sapiens
gcauaaccuuuaca

SEQ ID NO: 1548473 - RNA, 13 nt, Homo sapiens
gcauagcuuucac

SEQ ID NO: 1548474 - RNA, 23 nt, Homo sapiens
gcauaugcuacacauaugugcuu

SEQ ID NO: 1548475 - RNA, 22 nt, Homo sapiens
gcaucacugauucccucuccca

SEQ ID NO: 1548476 - RNA, 13 nt, Homo sapiens
gcaucugcauggg

SEQ ID NO: 1548477 - RNA, 18 nt, Homo sapiens
gcaugauuaacaaagcaa

SEQ ID NO: 1548478 - RNA, 15 nt, Homo sapiens
gcauuccagaacaaa

SEQ ID NO: 1548479 - RNA, 23 nt, Homo sapiens
gcauuccuuacuugcacuguuac

SEQ ID NO: 1548480 - RNA, 14 nt, Homo sapiens
gcauuuagagcuuu

SEQ ID NO: 1548481 - RNA, 21 nt, Homo sapiens
gccacauucaugggaaacccu

SEQ ID NO: 1548482 - RNA, 16 nt, Homo sapiens
gccacucauuccugua

SEQ ID NO: 1548483 - RNA, 21 nt, Homo sapiens
gccacuggaguccacacuuga

SEQ ID NO: 1548484 - RNA, 22 nt, Homo sapiens
gccacuuagacacuuuaccucu

SEQ ID NO: 1548485 - RNA, 17 nt, Homo sapiens
gccagcuuaucucaggg

SEQ ID NO: 1548486 - RNA, 14 nt, Homo sapiens
gccauagcuugauu

SEQ ID NO: 1548487 - RNA, 19 nt, Homo sapiens
gccauagcuugauugcuca

SEQ ID NO: 1548488 - RNA, 18 nt, Homo sapiens
gccauuucggaagacacc

SEQ ID NO: 1548489 - RNA, 20 nt, Homo sapiens
gcccagaagaaaauucuccu

SEQ ID NO: 1548490 - RNA, 21 nt, Homo sapiens
gcccagaguugcugugccgug

SEQ ID NO: 1548491 - RNA, 18 nt, Homo sapiens
gcccccucccugcuccca

SEQ ID NO: 1548492 - RNA, 16 nt, Homo sapiens
gccccugagcccagag

SEQ ID NO: 1548493 - RNA, 15 nt, Homo sapiens
gccccugccaaggcc

SEQ ID NO: 1548494 - RNA, 20 nt, Homo sapiens
gcccugggacagggcaaaca

SEQ ID NO: 1548495 - RNA, 19 nt, Homo sapiens
gcccuuaccccacacacag

SEQ ID NO: 1548496 - RNA, 15 nt, Homo sapiens
gcccuuggagcugcc

SEQ ID NO: 1548497 - RNA, 21 nt, Homo sapiens
gccgagauugcaccacugcac

SEQ ID NO: 1548498 - RNA, 14 nt, Homo sapiens
gccgccaugagcaa

SEQ ID NO: 1548499 - RNA, 15 nt, Homo sapiens
gccgccaugagcaac

SEQ ID NO: 1548500 - RNA, 18 nt, Homo sapiens
gccgcuuugucuguccag

SEQ ID NO: 1548501 - RNA, 21 nt, Homo sapiens
gccguacucuuuggggcagcu

SEQ ID NO: 1548502 - RNA, 17 nt, Homo sapiens
gccuaauacaacaugua

SEQ ID NO: 1548503 - RNA, 11 nt, Homo sapiens
gccuaccucuc

SEQ ID NO: 1548504 - RNA, 12 nt, Homo sapiens
gccuaccucucg

SEQ ID NO: 1548505 - RNA, 20 nt, Homo sapiens
gccuaccucucguuucugcc

SEQ ID NO: 1548506 - RNA, 16 nt, Homo sapiens
gccucugggaucugcc

SEQ ID NO: 1548507 - RNA, 17 nt, Homo sapiens
gccugcuacgaacgcuc

SEQ ID NO: 1548508 - RNA, 18 nt, Homo sapiens
gccuggcaacaucuuacu

SEQ ID NO: 1548509 - RNA, 19 nt, Homo sapiens
gccuggcauagaguaggua

SEQ ID NO: 1548510 - RNA, 17 nt, Homo sapiens
gccuggggucugacaau

SEQ ID NO: 1548511 - RNA, 16 nt, Homo sapiens
gccuggucguuuucaa

SEQ ID NO: 1548512 - RNA, 13 nt, Homo sapiens
gccugguguggug

SEQ ID NO: 1548513 - RNA, 12 nt, Homo sapiens
gccuuacuguac

SEQ ID NO: 1548514 - RNA, 13 nt, Homo sapiens
gcgcacuuaccug

SEQ ID NO: 1548515 - RNA, 14 nt, Homo sapiens
gcgcgguggcucac

SEQ ID NO: 1548516 - RNA, 15 nt, Homo sapiens
gcuaagcugcccuga

SEQ ID NO: 1548517 - RNA, 17 nt, Homo sapiens
gcucaaggcugugcagg

SEQ ID NO: 1548518 - RNA, 22 nt, Homo sapiens
gcucagcaaaagaugcuucuca

SEQ ID NO: 1548519 - RNA, 12 nt, Homo sapiens
gcucagccacag

SEQ ID NO: 1548520 - RNA, 17 nt, Homo sapiens
gcucccacacccaccuc

SEQ ID NO: 1548521 - RNA, 18 nt, Homo sapiens
gcucugaaguguccuaaa

SEQ ID NO: 1548522 - RNA, 18 nt, Homo sapiens
gcucugugggaggaugaa

SEQ ID NO: 1548523 - RNA, 23 nt, Homo sapiens
gcugagggugagugggugaauaa

SEQ ID NO: 1548524 - RNA, 14 nt, Homo sapiens
gcugauguuuacaa

SEQ ID NO: 1548525 - RNA, 15 nt, Homo sapiens
gcugauguuuacaau

SEQ ID NO: 1548526 - RNA, 22 nt, Homo sapiens
gcugauuucccuuuuuucuucc

SEQ ID NO: 1548527 - RNA, 18 nt, Homo sapiens
gcugcaaacccaugaagc

SEQ ID NO: 1548528 - RNA, 15 nt, Homo sapiens
gcugcaaggagcaac

SEQ ID NO: 1548529 - RNA, 18 nt, Homo sapiens
gcugcucuaagaagggaa

SEQ ID NO: 1548530 - RNA, 13 nt, Homo sapiens
cugcacuuuggaa

SEQ ID NO: 1548531 - RNA, 22 nt, Homo sapiens
cugcacuuuggaaaccaagcaa

SEQ ID NO: 1548532 - RNA, 18 nt, Homo sapiens
cugcagcuuuacugccuu

SEQ ID NO: 1548533 - RNA, 18 nt, Homo sapiens
cugcaguuuuugacuuca

SEQ ID NO: 1548534 - RNA, 18 nt, Homo sapiens
cugcauaaccuuuacacu

SEQ ID NO: 1548535 - RNA, 15 nt, Homo sapiens
cugccaugccagcuu

SEQ ID NO: 1548536 - RNA, 18 nt, Homo sapiens
cugcccaccccagcauca

SEQ ID NO: 1548537 - RNA, 19 nt, Homo sapiens
cugccgcuuugucugucca

SEQ ID NO: 1548538 - RNA, 15 nt, Homo sapiens
cugccuccugccucc

SEQ ID NO: 1548539 - RNA, 19 nt, Homo sapiens
cugcuacccagaaccuuuu

SEQ ID NO: 1548540 - RNA, 19 nt, Homo sapiens
cugcuaugcuaaaccuccu

SEQ ID NO: 1548541 - RNA, 18 nt, Homo sapiens
cugcuguucuguguacau

SEQ ID NO: 1548542 - RNA, 15 nt, Homo sapiens
cuggaaacagcagug

SEQ ID NO: 1548543 - RNA, 13 nt, Homo sapiens
cuggaaauggacu

SEQ ID NO: 1548544 - RNA, 15 nt, Homo sapiens
cugggcuugucugua

SEQ ID NO: 1548545 - RNA, 21 nt, Homo sapiens
cuggggugggagggaggcauc

SEQ ID NO: 1548546 - RNA, 22 nt, Homo sapiens
cugguaaaagcaccauugugaa

SEQ ID NO: 1548547 - RNA, 19 nt, Homo sapiens
cuguaauauggcuguauca

SEQ ID NO: 1548548 - RNA, 16 nt, Homo sapiens
cuguagaucagggaua

SEQ ID NO: 1548549 - RNA, 24 nt, Homo sapiens
cugucucccuccccaaauggcugc

SEQ ID NO: 1548550 - RNA, 18 nt, Homo sapiens
cugucugaucagggugga

SEQ ID NO: 1548551 - RNA, 19 nt, Homo sapiens
cugugcccaguacuuccug

SEQ ID NO: 1548552 - RNA, 14 nt, Homo sapiens
cugugccgugucca

SEQ ID NO: 1548553 - RNA, 13 nt, Homo sapiens
cugugggugguga

SEQ ID NO: 1548554 - RNA, 17 nt, Homo sapiens
cuguucagcugguugag

SEQ ID NO: 1548555 - RNA, 20 nt, Homo sapiens
cuguugcaaagguagggacu

SEQ ID NO: 1548556 - RNA, 18 nt, Homo sapiens
cuguuuguuuuuguacau

SEQ ID NO: 1548557 - RNA, 13 nt, Homo sapiens
cuuaaaauaguuu

SEQ ID NO: 1548558 - RNA, 15 nt, Homo sapiens
cuuacuuaggugugg

SEQ ID NO: 1548559 - RNA, 20 nt, Homo sapiens
cuuagaaaaggguuucuuga

SEQ ID NO: 1548560 - RNA, 23 nt, Homo sapiens
cuuaguaaaaagcccuaugugaa

SEQ ID NO: 1548561 - RNA, 12 nt, Homo sapiens
cuuaguaaaauu

SEQ ID NO: 1548562 - RNA, 19 nt, Homo sapiens
cuucaagagcaucuggaac

SEQ ID NO: 1548563 - RNA, 20 nt, Homo sapiens
cuucaaggauauacugcagc

SEQ ID NO: 1548564 - RNA, 15 nt, Homo sapiens
cuucacucaugcaaa

SEQ ID NO: 1548565 - RNA, 20 nt, Homo sapiens
cuucagaacuuucugcaguu

SEQ ID NO: 1548566 - RNA, 16 nt, Homo sapiens
cuucagcuugcuuaga

SEQ ID NO: 1548567 - RNA, 18 nt, Homo sapiens
cuucuauuuauuugacug

SEQ ID NO: 1548568 - RNA, 16 nt, Homo sapiens
cuucucaucuugugaa

SEQ ID NO: 1548569 - RNA, 17 nt, Homo sapiens
cuucuccaauucugaaa

SEQ ID NO: 1548570 - RNA, 21 nt, Homo sapiens
cuucuccagccuggaccccca

SEQ ID NO: 1548571 - RNA, 15 nt, Homo sapiens
cuucucgcaacugaa

SEQ ID NO: 1548572 - RNA, 10 nt, Homo sapiens
cuucugccau

SEQ ID NO: 1548573 - RNA, 23 nt, Homo sapiens
cuucugcccuuaccccacacaca

SEQ ID NO: 1548574 - RNA, 16 nt, Homo sapiens
cuugaaaagaaaacca

SEQ ID NO: 1548575 - RNA, 16 nt, Homo sapiens
cuugagggacaaugcc

SEQ ID NO: 1548576 - RNA, 19 nt, Homo sapiens
cuugcugcaaacccaugaa

SEQ ID NO: 1548577 - RNA, 16 nt, Homo sapiens
cuuggccuaggucucc

SEQ ID NO: 1548578 - RNA, 15 nt, Homo sapiens
cuuguccaugugguu

SEQ ID NO: 1548579 - RNA, 15 nt, Homo sapiens
cuuuaaaagucauua

SEQ ID NO: 1548580 - RNA, 18 nt, Homo sapiens
cuuuauccuaguuccauu

SEQ ID NO: 1548581 - RNA, 19 nt, Homo sapiens
cuuucaguaaaaauaaaua

SEQ ID NO: 1548582 - RNA, 21 nt, Homo sapiens
cuuucccccaccccagaguug

SEQ ID NO: 1548583 - RNA, 21 nt, Homo sapiens
cuuuccugucugcacaaguga

SEQ ID NO: 1548584 - RNA, 18 nt, Homo sapiens
cuuucugcuaucaaagag

SEQ ID NO: 1548585 - RNA, 18 nt, Homo sapiens
cuuucuugcacuguccag

SEQ ID NO: 1548586 - RNA, 18 nt, Homo sapiens
cuuugcauagcuuucaca

SEQ ID NO: 1548587 - RNA, 19 nt, Homo sapiens
cuuugcugcauuuuacaca

SEQ ID NO: 1548588 - RNA, 17 nt, Homo sapiens
cuuuggauaauaggaau

SEQ ID NO: 1548589 - RNA, 19 nt, Homo sapiens
cuuuggauacacacauagu

SEQ ID NO: 1548590 - RNA, 22 nt, Homo sapiens
cuuugggaagcucccacaccca

SEQ ID NO: 1548591 - RNA, 14 nt, Homo sapiens
cuuuguacccccca

SEQ ID NO: 1548592 - RNA, 14 nt, Homo sapiens
cuuugucuguccag

SEQ ID NO: 1548593 - RNA, 16 nt, Homo sapiens
cuuuguuuaaaugcca

SEQ ID NO: 1548594 - RNA, 17 nt, Homo sapiens
cuuuguuuaaaugccaa

SEQ ID NO: 1548595 - RNA, 21 nt, Homo sapiens
cuuuucuguccgagcuuugaa

SEQ ID NO: 1548596 - RNA, 16 nt, Homo sapiens
cuuuucuuuuucuccc

SEQ ID NO: 1548597 - RNA, 23 nt, Homo sapiens
cuuuugaaaugccacgugccauu

SEQ ID NO: 1548598 - RNA, 14 nt, Homo sapiens
gaaaaauguugcuc

SEQ ID NO: 1548599 - RNA, 16 nt, Homo sapiens
gaaaacauacacugag

SEQ ID NO: 1548600 - RNA, 23 nt, Homo sapiens
gaaaacugacaucagauuucuua

SEQ ID NO: 1548601 - RNA, 17 nt, Homo sapiens
gaaaauaauuguuccaa

SEQ ID NO: 1548602 - RNA, 17 nt, Homo sapiens
gaaaauaugauguuuca

SEQ ID NO: 1548603 - RNA, 21 nt, Homo sapiens
gaaaaucaaugcuuuaucuga

SEQ ID NO: 1548604 - RNA, 15 nt, Homo sapiens
gaaaaugaacugcuu

SEQ ID NO: 1548605 - RNA, 16 nt, Homo sapiens
gaaaaugaacugcuuu

SEQ ID NO: 1548606 - RNA, 16 nt, Homo sapiens
gaaaaugaauggacaa

SEQ ID NO: 1548607 - RNA, 22 nt, Homo sapiens
gaaaauggaugacaaagaaaau

SEQ ID NO: 1548608 - RNA, 22 nt, Homo sapiens
gaaaauucucucaagacuucuc

SEQ ID NO: 1548609 - RNA, 14 nt, Homo sapiens
gaaacaaaugaaau

SEQ ID NO: 1548610 - RNA, 19 nt, Homo sapiens
gaaacauagaaacauacac

SEQ ID NO: 1548611 - RNA, 22 nt, Homo sapiens
gaaaccagagucaaauuugaaa

SEQ ID NO: 1548612 - RNA, 17 nt, Homo sapiens
gaaacgagaagugcccu

SEQ ID NO: 1548613 - RNA, 19 nt, Homo sapiens
gaaagaaaaaaaaauacuu

SEQ ID NO: 1548614 - RNA, 19 nt, Homo sapiens
gaaagaaugcauuccagaa

SEQ ID NO: 1548615 - RNA, 20 nt, Homo sapiens
gaaagacaggaguuuaucua

SEQ ID NO: 1548616 - RNA, 18 nt, Homo sapiens
gaaauaaauauuguguug

SEQ ID NO: 1548617 - RNA, 15 nt, Homo sapiens
gaaauggaugcaaag

SEQ ID NO: 1548618 - RNA, 21 nt, Homo sapiens
gaaauggaugcaaaguacaau

SEQ ID NO: 1548619 - RNA, 20 nt, Homo sapiens
gaaauggccaggauccucuc

SEQ ID NO: 1548620 - RNA, 19 nt, Homo sapiens
gaaauguuuguccuugcac

SEQ ID NO: 1548621 - RNA, 20 nt, Homo sapiens
gaaauuauacguacauacac

SEQ ID NO: 1548622 - RNA, 17 nt, Homo sapiens
gaacagcaggaugcccu

SEQ ID NO: 1548623 - RNA, 16 nt, Homo sapiens
gaagaaaaacuagaca

SEQ ID NO: 1548624 - RNA, 13 nt, Homo sapiens
gaagacaauguga

SEQ ID NO: 1548625 - RNA, 18 nt, Homo sapiens
gaagacacuaauuccuua

SEQ ID NO: 1548626 - RNA, 16 nt, Homo sapiens
gaagauguucaauaga

SEQ ID NO: 1548627 - RNA, 22 nt, Homo sapiens
gaagccugcccuugucugagau

SEQ ID NO: 1548628 - RNA, 21 nt, Homo sapiens
gaagcucccacacccaccucu

SEQ ID NO: 1548629 - RNA, 20 nt, Homo sapiens
gaaggcucguuuggcuuuau

SEQ ID NO: 1548630 - RNA, 16 nt, Homo sapiens
gaagggccaauggaga

SEQ ID NO: 1548631 - RNA, 20 nt, Homo sapiens
gaaguacuuuaccugaaaga

SEQ ID NO: 1548632 - RNA, 14 nt, Homo sapiens
gaauaauuauuuca

SEQ ID NO: 1548633 - RNA, 15 nt, Homo sapiens
gaauucacgccucuc

SEQ ID NO: 1548634 - RNA, 20 nt, Homo sapiens
gaauuugggcagcuaccacg

SEQ ID NO: 1548635 - RNA, 13 nt, Homo sapiens
gacacuuuaccuc

SEQ ID NO: 1548636 - RNA, 15 nt, Homo sapiens
gacacuuuaccucuu

SEQ ID NO: 1548637 - RNA, 16 nt, Homo sapiens
gacaugagacuaagag

SEQ ID NO: 1548638 - RNA, 14 nt, Homo sapiens
gacccuauugcugc

SEQ ID NO: 1548639 - RNA, 14 nt, Homo sapiens
gaccucugcaagag

SEQ ID NO: 1548640 - RNA, 23 nt, Homo sapiens
gacgguuucuccccggacacucg

SEQ ID NO: 1548641 - RNA, 19 nt, Homo sapiens
gacuacauccugaguguga

SEQ ID NO: 1548642 - RNA, 20 nt, Homo sapiens
gacuacauccugagugugau

SEQ ID NO: 1548643 - RNA, 17 nt, Homo sapiens
gacucuuuggacacuca

SEQ ID NO: 1548644 - RNA, 20 nt, Homo sapiens
gacugcugauuuucuggaau

SEQ ID NO: 1548645 - RNA, 17 nt, Homo sapiens
gacugguuaggacaaaa

SEQ ID NO: 1548646 - RNA, 11 nt, Homo sapiens
gacuguaaaau

SEQ ID NO: 1548647 - RNA, 18 nt, Homo sapiens
gacuguggaaccaaagcu

SEQ ID NO: 1548648 - RNA, 18 nt, Homo sapiens
ccgggacugggggcggga

SEQ ID NO: 1548649 - RNA, 17 nt, Homo sapiens
ccuaaacuguacaugug

SEQ ID NO: 1548650 - RNA, 19 nt, Homo sapiens
ccuaaagacuaacuugaaa

SEQ ID NO: 1548651 - RNA, 11 nt, Homo sapiens
ccuaacuguga

SEQ ID NO: 1548652 - RNA, 22 nt, Homo sapiens
ccucauuucaccugcgcugugg

SEQ ID NO: 1548653 - RNA, 18 nt, Homo sapiens
ccuccccaaauggcugcu

SEQ ID NO: 1548654 - RNA, 21 nt, Homo sapiens
ccucccugucucugcaucuga

SEQ ID NO: 1548655 - RNA, 14 nt, Homo sapiens
ccucugaaaaccaa

SEQ ID NO: 1548656 - RNA, 9 nt, Homo sapiens
ccucuggag

SEQ ID NO: 1548657 - RNA, 16 nt, Homo sapiens
ccucugggaucugcca

SEQ ID NO: 1548658 - RNA, 21 nt, Homo sapiens
ccucuucucuacucuagggaa

SEQ ID NO: 1548659 - RNA, 21 nt, Homo sapiens
ccucuuucuccagcagcugau

SEQ ID NO: 1548660 - RNA, 18 nt, Homo sapiens
ccugaaacaugugccccu

SEQ ID NO: 1548661 - RNA, 13 nt, Homo sapiens
ccugacugguugu

SEQ ID NO: 1548662 - RNA, 22 nt, Homo sapiens
ccugacuucuggaaucuuugag

SEQ ID NO: 1548663 - RNA, 12 nt, Homo sapiens
ccugacuuugac

SEQ ID NO: 1548664 - RNA, 12 nt, Homo sapiens
ccugagccauug

SEQ ID NO: 1548665 - RNA, 22 nt, Homo sapiens
ccugagguuagcccaauggaga

SEQ ID NO: 1548666 - RNA, 17 nt, Homo sapiens
ccugauccauagugcua

SEQ ID NO: 1548667 - RNA, 14 nt, Homo sapiens
ccugcgauuuugcc

SEQ ID NO: 1548668 - RNA, 21 nt, Homo sapiens
ccugcucuucuaccauuugaa

SEQ ID NO: 1548669 - RNA, 15 nt, Homo sapiens
ccugcuguccguccc

SEQ ID NO: 1548670 - RNA, 22 nt, Homo sapiens
ccugcuuuccuaucuagcauuu

SEQ ID NO: 1548671 - RNA, 12 nt, Homo sapiens
ccuggaaaccac

SEQ ID NO: 1548672 - RNA, 13 nt, Homo sapiens
ccuggaaaccaca

SEQ ID NO: 1548673 - RNA, 17 nt, Homo sapiens
ccuggaaaccacagucc

SEQ ID NO: 1548674 - RNA, 17 nt, Homo sapiens
ccuggguaacuagggaa

SEQ ID NO: 1548675 - RNA, 22 nt, Homo sapiens
ccugggugacagagcaagugag

SEQ ID NO: 1548676 - RNA, 18 nt, Homo sapiens
ccuguaugucuaccucug

SEQ ID NO: 1548677 - RNA, 17 nt, Homo sapiens
ccuguccccucagcucc

SEQ ID NO: 1548678 - RNA, 20 nt, Homo sapiens
ccuguucccacucagcagug

SEQ ID NO: 1548679 - RNA, 18 nt, Homo sapiens
ccuuaaggaucaccccag

SEQ ID NO: 1548680 - RNA, 14 nt, Homo sapiens
ccuuacucaccucu

SEQ ID NO: 1548681 - RNA, 14 nt, Homo sapiens
ccuugagucuguca

SEQ ID NO: 1548682 - RNA, 18 nt, Homo sapiens
ccuuucccccaccccaga

SEQ ID NO: 1548683 - RNA, 21 nt, Homo sapiens
ccuuucucagccacaaaauaa

SEQ ID NO: 1548684 - RNA, 14 nt, Homo sapiens
ccuuucuugcacug

SEQ ID NO: 1548685 - RNA, 21 nt, Homo sapiens
ccuuugaaaccugcucuguag

SEQ ID NO: 1548686 - RNA, 19 nt, Homo sapiens
ccuuugggccaauuuacug

SEQ ID NO: 1548687 - RNA, 22 nt, Homo sapiens
ccuuuguugaaaaauguugcuc

SEQ ID NO: 1548688 - RNA, 15 nt, Homo sapiens
ccuuuuaaguuugaa

SEQ ID NO: 1548689 - RNA, 18 nt, Homo sapiens
ccuuuucuauuuaccucc

SEQ ID NO: 1548690 - RNA, 12 nt, Homo sapiens
cgagaaccaguu

SEQ ID NO: 1548691 - RNA, 13 nt, Homo sapiens
cgaguaccagcug

SEQ ID NO: 1548692 - RNA, 19 nt, Homo sapiens
cgauggaggccuaccucuc

SEQ ID NO: 1548693 - RNA, 15 nt, Homo sapiens
cgaugugacugccau

SEQ ID NO: 1548694 - RNA, 12 nt, Homo sapiens
cgcccccugaaa

SEQ ID NO: 1548695 - RNA, 23 nt, Homo sapiens
cgccguguguucaacgacugccg

SEQ ID NO: 1548696 - RNA, 16 nt, Homo sapiens
cggacccaucuuugcu

SEQ ID NO: 1548697 - RNA, 15 nt, Homo sapiens
cggcuguggguggug

SEQ ID NO: 1548698 - RNA, 22 nt, Homo sapiens
cgggcaugagucuguuucccaa

SEQ ID NO: 1548699 - RNA, 16 nt, Homo sapiens
cguaagaccaccuucc

SEQ ID NO: 1548700 - RNA, 23 nt, Homo sapiens
cgugccugcuacgaacgcuccaa

SEQ ID NO: 1548701 - RNA, 19 nt, Homo sapiens
cgugcugcaugccuggucu

SEQ ID NO: 1548702 - RNA, 15 nt, Homo sapiens
cgugugacuacuccc

SEQ ID NO: 1548703 - RNA, 17 nt, Homo sapiens
cguuaagauaaagggua

SEQ ID NO: 1548704 - RNA, 23 nt, Homo sapiens
cguugugccugguucgugccaug

SEQ ID NO: 1548705 - RNA, 22 nt, Homo sapiens
cuaacuugaaaagaaaaccaca

SEQ ID NO: 1548706 - RNA, 23 nt, Homo sapiens
cuaagcgaauguguacaaagugu

SEQ ID NO: 1548707 - RNA, 16 nt, Homo sapiens
cuaauacaacauguag

SEQ ID NO: 1548708 - RNA, 17 nt, Homo sapiens
cuacaauuucuaugugg

SEQ ID NO: 1548709 - RNA, 12 nt, Homo sapiens
cuacaucugccu

SEQ ID NO: 1548710 - RNA, 21 nt, Homo sapiens
cuacccuuuuccuuugugguu

SEQ ID NO: 1548711 - RNA, 21 nt, Homo sapiens
cuacuuuaauauaaacccaua

SEQ ID NO: 1548712 - RNA, 23 nt, Homo sapiens
cuagggcccuuucuugcacuguc

SEQ ID NO: 1548713 - RNA, 15 nt, Homo sapiens
cuaggucaugaagga

SEQ ID NO: 1548714 - RNA, 20 nt, Homo sapiens
cuaguucuuuucauuuggaa

SEQ ID NO: 1548715 - RNA, 16 nt, Homo sapiens
cuauaaaauauaguuu

SEQ ID NO: 1548716 - RNA, 15 nt, Homo sapiens
cuauggccuaugugc

SEQ ID NO: 1548717 - RNA, 19 nt, Homo sapiens
cucaaacucuuaaaaccca

SEQ ID NO: 1548718 - RNA, 22 nt, Homo sapiens
cucaaaucacugcauucauucu

SEQ ID NO: 1548719 - RNA, 16 nt, Homo sapiens
cucaaggcugugcagg

SEQ ID NO: 1548720 - RNA, 21 nt, Homo sapiens
cucaaggcugugcaggcacau

SEQ ID NO: 1548721 - RNA, 22 nt, Homo sapiens
cucagaagguaggggaagggcg

SEQ ID NO: 1548722 - RNA, 18 nt, Homo sapiens
cucagaccuccagcccug

SEQ ID NO: 1548723 - RNA, 13 nt, Homo sapiens
cucagcaaaagau

SEQ ID NO: 1548724 - RNA, 18 nt, Homo sapiens
cucagcagggcuggucac

SEQ ID NO: 1548725 - RNA, 18 nt, Homo sapiens
cucagccacagccugaca

SEQ ID NO: 1548726 - RNA, 22 nt, Homo sapiens
cucaucuuagguuggcaaaaag

SEQ ID NO: 1548727 - RNA, 17 nt, Homo sapiens
cuccccgccuguucccc

SEQ ID NO: 1548728 - RNA, 12 nt, Homo sapiens
cuccccuguauu

SEQ ID NO: 1548729 - RNA, 15 nt, Homo sapiens
cucccuccccaaaug

SEQ ID NO: 1548730 - RNA, 17 nt, Homo sapiens
cuccuaauggcauggag

SEQ ID NO: 1548731 - RNA, 21 nt, Homo sapiens
cuccuagacacuccccacggg

SEQ ID NO: 1548732 - RNA, 16 nt, Homo sapiens
cuccucguccauuuua

SEQ ID NO: 1548733 - RNA, 21 nt, Homo sapiens
cuccugauaaaacaacagcuc

SEQ ID NO: 1548734 - RNA, 15 nt, Homo sapiens
cuccugauguuuuuc

SEQ ID NO: 1548735 - RNA, 15 nt, Homo sapiens
cuccuggagcacugu

SEQ ID NO: 1548736 - RNA, 13 nt, Homo sapiens
cuccuucauuuca

SEQ ID NO: 1548737 - RNA, 19 nt, Homo sapiens
cucgcucgaugacugugaa

SEQ ID NO: 1548738 - RNA, 15 nt, Homo sapiens
cucguauuuuguccc

SEQ ID NO: 1548739 - RNA, 14 nt, Homo sapiens
cucuaaguuuagaa

SEQ ID NO: 1548740 - RNA, 13 nt, Homo sapiens
cucuacaaaaagc

SEQ ID NO: 1548741 - RNA, 21 nt, Homo sapiens
cucuacucuagggaaaaacca

SEQ ID NO: 1548742 - RNA, 15 nt, Homo sapiens
cucucaauaugcuua

SEQ ID NO: 1548743 - RNA, 17 nt, Homo sapiens
cucugaaguguccuaaa

SEQ ID NO: 1548744 - RNA, 13 nt, Homo sapiens
cucugcacaagcu

SEQ ID NO: 1548745 - RNA, 14 nt, Homo sapiens
cucuggaggagcaa

SEQ ID NO: 1548746 - RNA, 14 nt, Homo sapiens
cucuguggguggga

SEQ ID NO: 1548747 - RNA, 16 nt, Homo sapiens
cucuuagaaaaaccac

SEQ ID NO: 1548748 - RNA, 16 nt, Homo sapiens
cucuuaguaacauaga

SEQ ID NO: 1548749 - RNA, 20 nt, Homo sapiens
cucuucccagagucacaagu

SEQ ID NO: 1548750 - RNA, 15 nt, Homo sapiens
cucuucuuuauugca

SEQ ID NO: 1548751 - RNA, 17 nt, Homo sapiens
cucuucuuuauugcacu

SEQ ID NO: 1548752 - RNA, 21 nt, Homo sapiens
cucuuucaauugcagaugcca

SEQ ID NO: 1548753 - RNA, 22 nt, Homo sapiens
cucuuucaauugcagaugccaa

SEQ ID NO: 1548754 - RNA, 18 nt, Homo sapiens
cugaaacaugugccccug

SEQ ID NO: 1548755 - RNA, 23 nt, Homo sapiens
cugaaacaugugccccugccaag

SEQ ID NO: 1548756 - RNA, 22 nt, Homo sapiens
cugaaggcucguuuggcuuuau

SEQ ID NO: 1548757 - RNA, 21 nt, Homo sapiens
cugaaguguccuaaauauuaa

SEQ ID NO: 1548758 - RNA, 16 nt, Homo sapiens
cugacuaugugccgag

SEQ ID NO: 1548759 - RNA, 20 nt, Homo sapiens
cugacuggauucauucucau

SEQ ID NO: 1548760 - RNA, 20 nt, Homo sapiens
cugacuuccgucccacugaa

SEQ ID NO: 1548761 - RNA, 22 nt, Homo sapiens
cugaggcaggaagauagcuuga

SEQ ID NO: 1548762 - RNA, 19 nt, Homo sapiens
cugaggcagugcuagucaa

SEQ ID NO: 1548763 - RNA, 15 nt, Homo sapiens
cugagugcuaugugu

SEQ ID NO: 1548764 - RNA, 18 nt, Homo sapiens
cugagugggggaucacag

SEQ ID NO: 1548765 - RNA, 13 nt, Homo sapiens
cugauuccagaac

SEQ ID NO: 1548766 - RNA, 18 nt, Homo sapiens
cauaaguuccuauaccuu

SEQ ID NO: 1548767 - RNA, 16 nt, Homo sapiens
cauaaguuuaacugua

SEQ ID NO: 1548768 - RNA, 19 nt, Homo sapiens
cauaauuccuacagcacua

SEQ ID NO: 1548769 - RNA, 20 nt, Homo sapiens
cauacaaauucuacuuuaau

SEQ ID NO: 1548770 - RNA, 14 nt, Homo sapiens
cauacauacauaca

SEQ ID NO: 1548771 - RNA, 16 nt, Homo sapiens
cauagcuugauugcuc

SEQ ID NO: 1548772 - RNA, 17 nt, Homo sapiens
cauaggaaaaugccaug

SEQ ID NO: 1548773 - RNA, 19 nt, Homo sapiens
cauaucuuagguauauaau

SEQ ID NO: 1548774 - RNA, 18 nt, Homo sapiens
cauccugagugugaugaa

SEQ ID NO: 1548775 - RNA, 17 nt, Homo sapiens
caucucagacuguggaa

SEQ ID NO: 1548776 - RNA, 22 nt, Homo sapiens
caucuugugaaauggccaggau

SEQ ID NO: 1548777 - RNA, 18 nt, Homo sapiens
caugaauucuuaugcuua

SEQ ID NO: 1548778 - RNA, 17 nt, Homo sapiens
caugcuucuacugugac

SEQ ID NO: 1548779 - RNA, 14 nt, Homo sapiens
cauguuugacgugg

SEQ ID NO: 1548780 - RNA, 21 nt, Homo sapiens
cauuacuuuaaccucccucaa

SEQ ID NO: 1548781 - RNA, 14 nt, Homo sapiens
cauuauacauuuga

SEQ ID NO: 1548782 - RNA, 15 nt, Homo sapiens
cauuauacauuugau

SEQ ID NO: 1548783 - RNA, 21 nt, Homo sapiens
cauuccuuacuugcacuguua

SEQ ID NO: 1548784 - RNA, 16 nt, Homo sapiens
cauucugcauugagaa

SEQ ID NO: 1548785 - RNA, 20 nt, Homo sapiens
cauugauucuucagaacuuu

SEQ ID NO: 1548786 - RNA, 16 nt, Homo sapiens
cauuucugagaucaaa

SEQ ID NO: 1548787 - RNA, 22 nt, Homo sapiens
ccaaaaucugauuagaaguaua

SEQ ID NO: 1548788 - RNA, 14 nt, Homo sapiens
ccaaacugacucaa

SEQ ID NO: 1548789 - RNA, 18 nt, Homo sapiens
ccaaaggaaaaagcacaa

SEQ ID NO: 1548790 - RNA, 21 nt, Homo sapiens
ccaaauuuaauuaaagccuua

SEQ ID NO: 1548791 - RNA, 22 nt, Homo sapiens
ccaaccuggaguauaauauuca

SEQ ID NO: 1548792 - RNA, 21 nt, Homo sapiens
ccaagagcaggaggugccuga

SEQ ID NO: 1548793 - RNA, 12 nt, Homo sapiens
ccaaggugggag

SEQ ID NO: 1548794 - RNA, 14 nt, Homo sapiens
ccaauuuacuggcc

SEQ ID NO: 1548795 - RNA, 21 nt, Homo sapiens
ccaauuucugcuguacauuau

SEQ ID NO: 1548796 - RNA, 18 nt, Homo sapiens
ccacaaccgaccagaugc

SEQ ID NO: 1548797 - RNA, 20 nt, Homo sapiens
ccacacacaguccaacucuu

SEQ ID NO: 1548798 - RNA, 23 nt, Homo sapiens
ccacacccaccucugccacucuu

SEQ ID NO: 1548799 - RNA, 17 nt, Homo sapiens
ccacagugguacucugu

SEQ ID NO: 1548800 - RNA, 18 nt, Homo sapiens
ccaccaccaucaccagac

SEQ ID NO: 1548801 - RNA, 15 nt, Homo sapiens
ccaccaucaccagac

SEQ ID NO: 1548802 - RNA, 19 nt, Homo sapiens
ccacgugccauugucuuuc

SEQ ID NO: 1548803 - RNA, 17 nt, Homo sapiens
ccacuuucguaucauaa

SEQ ID NO: 1548804 - RNA, 17 nt, Homo sapiens
ccagagucaaauuugaa

SEQ ID NO: 1548805 - RNA, 19 nt, Homo sapiens
ccagaguugcugugccgug

SEQ ID NO: 1548806 - RNA, 22 nt, Homo sapiens
ccagauccuggaaacagcagug

SEQ ID NO: 1548807 - RNA, 15 nt, Homo sapiens
ccagcaguucucugc

SEQ ID NO: 1548808 - RNA, 17 nt, Homo sapiens
ccagcaguucucugcca

SEQ ID NO: 1548809 - RNA, 21 nt, Homo sapiens
ccagccccagcaccucaugca

SEQ ID NO: 1548810 - RNA, 19 nt, Homo sapiens
ccagccuuauguguuacau

SEQ ID NO: 1548811 - RNA, 20 nt, Homo sapiens
ccaucucugugauuaccucu

SEQ ID NO: 1548812 - RNA, 21 nt, Homo sapiens
ccaucucugugauuaccucuc

SEQ ID NO: 1548813 - RNA, 17 nt, Homo sapiens
ccaucugugugcaacua

SEQ ID NO: 1548814 - RNA, 15 nt, Homo sapiens
ccaucuuuugugaga

SEQ ID NO: 1548815 - RNA, 22 nt, Homo sapiens
ccaucuuuugugagauguaauu

SEQ ID NO: 1548816 - RNA, 23 nt, Homo sapiens
ccaucuuuugugagauguaauug

SEQ ID NO: 1548817 - RNA, 16 nt, Homo sapiens
cccacacacacacccg

SEQ ID NO: 1548818 - RNA, 18 nt, Homo sapiens
cccaccugaccucugcaa

SEQ ID NO: 1548819 - RNA, 21 nt, Homo sapiens
cccacgacugcccggcagggu

SEQ ID NO: 1548820 - RNA, 22 nt, Homo sapiens
cccacugaguuugcuguuugca

SEQ ID NO: 1548821 - RNA, 22 nt, Homo sapiens
cccagaaccuuuuuauagguug

SEQ ID NO: 1548822 - RNA, 11 nt, Homo sapiens
ccccacacccc

SEQ ID NO: 1548823 - RNA, 18 nt, Homo sapiens
ccccucaacaccucugca

SEQ ID NO: 1548824 - RNA, 22 nt, Homo sapiens
ccccuguagagugggagcugag

SEQ ID NO: 1548825 - RNA, 12 nt, Homo sapiens
cccguugugccu

SEQ ID NO: 1548826 - RNA, 21 nt, Homo sapiens
cccuauugcugcuugaggcaa

SEQ ID NO: 1548827 - RNA, 23 nt, Homo sapiens
cccucaacaccucugcacaagcu

SEQ ID NO: 1548828 - RNA, 19 nt, Homo sapiens
cccucuguagccacuagua

SEQ ID NO: 1548829 - RNA, 18 nt, Homo sapiens
cccugagcuuucugcuau

SEQ ID NO: 1548830 - RNA, 18 nt, Homo sapiens
cccuuaaggaucacccca

SEQ ID NO: 1548831 - RNA, 17 nt, Homo sapiens
cccuugcugcaaaccca

SEQ ID NO: 1548832 - RNA, 14 nt, Homo sapiens
cccuuggagcugcc

SEQ ID NO: 1548833 - RNA, 19 nt, Homo sapiens
ccgaauauauuacugauuu

SEQ ID NO: 1548834 - RNA, 16 nt, Homo sapiens
ccgaccucugacugau

SEQ ID NO: 1548835 - RNA, 22 nt, Homo sapiens
ccgagcuuugaaaauucagugg

SEQ ID NO: 1548836 - RNA, 20 nt, Homo sapiens
ccgaggaaugugaagccaga

SEQ ID NO: 1548837 - RNA, 22 nt, Homo sapiens
aaaacaacagcucgauccaaau

SEQ ID NO: 1548838 - RNA, 22 nt, Homo sapiens
aaaacaauuugcauaauacuaa

SEQ ID NO: 1548839 - RNA, 14 nt, Homo sapiens
aaaaccugagccau

SEQ ID NO: 1548840 - RNA, 21 nt, Homo sapiens
aaaacuauguguucaaugaaa

SEQ ID NO: 1548841 - RNA, 15 nt, Homo sapiens
aaaacugacaucaga

SEQ ID NO: 1548842 - RNA, 21 nt, Homo sapiens
aaaacuuuucauuucagauuu

SEQ ID NO: 1548843 - RNA, 23 nt, Homo sapiens
aaaagaugcuucucacugccaug

SEQ ID NO: 1548844 - RNA, 18 nt, Homo sapiens
aaaaggaaaaccaucucu

SEQ ID NO: 1548845 - RNA, 16 nt, Homo sapiens
aaaaguuaagugucau

SEQ ID NO: 1548846 - RNA, 20 nt, Homo sapiens
aaaaguuaagugucauuucu

SEQ ID NO: 1548847 - RNA, 20 nt, Homo sapiens
aaacaaaaaaagcaucucac

SEQ ID NO: 1548848 - RNA, 12 nt, Homo sapiens
aaacaacagcuc

SEQ ID NO: 1548849 - RNA, 19 nt, Homo sapiens
aaacagcagcagcaaacaa

SEQ ID NO: 1548850 - RNA, 14 nt, Homo sapiens
aaaccagagucaaa

SEQ ID NO: 1548851 - RNA, 15 nt, Homo sapiens
aaaccaucucuguga

SEQ ID NO: 1548852 - RNA, 23 nt, Homo sapiens
aaaccugguugcagcacauucac

SEQ ID NO: 1548853 - RNA, 16 nt, Homo sapiens
aaacucugccagaaaa

SEQ ID NO: 1548854 - RNA, 18 nt, Homo sapiens
aaacugcuuuauuuuccc

SEQ ID NO: 1548855 - RNA, 18 nt, Homo sapiens
aaagagaucugggcauua

SEQ ID NO: 1548856 - RNA, 15 nt, Homo sapiens
aaagcaccauuguga

SEQ ID NO: 1548857 - RNA, 23 nt, Homo sapiens
aaagcaucucacugcaagucaca

SEQ ID NO: 1548858 - RNA, 15 nt, Homo sapiens
aaagccuuaagcaca

SEQ ID NO: 1548859 - RNA, 13 nt, Homo sapiens
aaagcuggcccag

SEQ ID NO: 1548860 - RNA, 16 nt, Homo sapiens
aaaggaaaaagcacaa

SEQ ID NO: 1548861 - RNA, 19 nt, Homo sapiens
aaagggaaguaguccuugg

SEQ ID NO: 1548862 - RNA, 16 nt, Homo sapiens
aaagguucacucucaa

SEQ ID NO: 1548863 - RNA, 13 nt, Homo sapiens
aaaguacauguau

SEQ ID NO: 1548864 - RNA, 14 nt, Homo sapiens
aaagugacauuugu

SEQ ID NO: 1548865 - RNA, 21 nt, Homo sapiens
aaaguugcuuuuauugcacca

SEQ ID NO: 1548866 - RNA, 16 nt, Homo sapiens
aaauaaaacagcagca

SEQ ID NO: 1548867 - RNA, 14 nt, Homo sapiens
aaauaaaagaaaca

SEQ ID NO: 1548868 - RNA, 16 nt, Homo sapiens
aaauauucaaguaaca

SEQ ID NO: 1548869 - RNA, 23 nt, Homo sapiens
aaauauuguguugugcagcauua

SEQ ID NO: 1548870 - RNA, 19 nt, Homo sapiens
aaaucaaugcuuuaucuga

SEQ ID NO: 1548871 - RNA, 14 nt, Homo sapiens
aaaugacuauugua

SEQ ID NO: 1548872 - RNA, 19 nt, Homo sapiens
aaaugauauauaccacuuu

SEQ ID NO: 1548873 - RNA, 23 nt, Homo sapiens
aaaugcccagcuuaaaggggcua

SEQ ID NO: 1548874 - RNA, 22 nt, Homo sapiens
aaauuauuuauuacuugugcac

SEQ ID NO: 1548875 - RNA, 23 nt, Homo sapiens
aaauucuacucuaaagcuucuau

SEQ ID NO: 1548876 - RNA, 15 nt, Homo sapiens
aaauucuacuuuaau

SEQ ID NO: 1548877 - RNA, 23 nt, Homo sapiens
aaauucucagucaugcacucaca

SEQ ID NO: 1548878 - RNA, 21 nt, Homo sapiens
aaauucuguuuuucuaggccu

SEQ ID NO: 1548879 - RNA, 22 nt, Homo sapiens
aaauugcuuuugaaaaacaacu

SEQ ID NO: 1548880 - RNA, 18 nt, Homo sapiens
aaauuguuuaccauagaa

SEQ ID NO: 1548881 - RNA, 12 nt, Homo sapiens
aacaaaagggag

SEQ ID NO: 1548882 - RNA, 15 nt, Homo sapiens
aacaaauuguuuaca

SEQ ID NO: 1548883 - RNA, 21 nt, Homo sapiens
aacaacugcauaaccuuuaca

SEQ ID NO: 1548884 - RNA, 18 nt, Homo sapiens
aacacuagagucugucau

SEQ ID NO: 1548885 - RNA, 16 nt, Homo sapiens
aacagaucuugaaauc

SEQ ID NO: 1548886 - RNA, 13 nt, Homo sapiens
aacagccugagcc

SEQ ID NO: 1548887 - RNA, 17 nt, Homo sapiens
aacagcucgauccaaau

SEQ ID NO: 1548888 - RNA, 19 nt, Homo sapiens
aacauacacugagcugcuu

SEQ ID NO: 1548889 - RNA, 22 nt, Homo sapiens
aaccacuucagcugacuuuucu

SEQ ID NO: 1548890 - RNA, 12 nt, Homo sapiens
aaccaucucugu

SEQ ID NO: 1548891 - RNA, 15 nt, Homo sapiens
aacccagcaguucuc

SEQ ID NO: 1548892 - RNA, 18 nt, Homo sapiens
aacccguugggucccuug

SEQ ID NO: 1548893 - RNA, 20 nt, Homo sapiens
aaccgagguguugccagugc

SEQ ID NO: 1548894 - RNA, 22 nt, Homo sapiens
aaccucgcucgaugacugugaa

SEQ ID NO: 1548895 - RNA, 16 nt, Homo sapiens
aaccugaguauaguau

SEQ ID NO: 1548896 - RNA, 23 nt, Homo sapiens
aacguaauuguacaagcaguuaa

SEQ ID NO: 1548897 - RNA, 17 nt, Homo sapiens
aacgugccugacuuuga

SEQ ID NO: 1548898 - RNA, 22 nt, Homo sapiens
aacuaguugucugaauugagaa

SEQ ID NO: 1548899 - RNA, 12 nt, Homo sapiens
aacuauguguuc

SEQ ID NO: 1548900 - RNA, 18 nt, Homo sapiens
aacuauguguucaaugaa

SEQ ID NO: 1548901 - RNA, 18 nt, Homo sapiens
aacucauuacuuuuccau

SEQ ID NO: 1548902 - RNA, 16 nt, Homo sapiens
aacugacucuguuauu

SEQ ID NO: 1548903 - RNA, 15 nt, Homo sapiens
aacugcuuugugcau

SEQ ID NO: 1548904 - RNA, 16 nt, Homo sapiens
aacugcuuugugcaua

SEQ ID NO: 1548905 - RNA, 18 nt, Homo sapiens
aacuggaauuaaaaggau

SEQ ID NO: 1548906 - RNA, 16 nt, Homo sapiens
aacuggagugguuuga

SEQ ID NO: 1548907 - RNA, 14 nt, Homo sapiens
aacugggcauuuca

SEQ ID NO: 1548908 - RNA, 20 nt, Homo sapiens
aacuugaaaagaaaaccaca

SEQ ID NO: 1548909 - RNA, 12 nt, Homo sapiens
aacuugggccac

SEQ ID NO: 1548910 - RNA, 23 nt, Homo sapiens
aacuuuguuuagcccaaaaccaa

SEQ ID NO: 1548911 - RNA, 15 nt, Homo sapiens
aagaaaaacuagaca

SEQ ID NO: 1548912 - RNA, 15 nt, Homo sapiens
aagaaauaaugccuc

SEQ ID NO: 1548913 - RNA, 16 nt, Homo sapiens
aagaagcuuuaauauu

SEQ ID NO: 1548914 - RNA, 15 nt, Homo sapiens
aagaauguagucaga

SEQ ID NO: 1548915 - RNA, 18 nt, Homo sapiens
aagaauguguuuaaacuu

SEQ ID NO: 1548916 - RNA, 17 nt, Homo sapiens
aagacagagcagaucag

SEQ ID NO: 1548917 - RNA, 15 nt, Homo sapiens
aagacuaacuugaaa

SEQ ID NO: 1548918 - RNA, 18 nt, Homo sapiens
aagagaucugggcauuaa

SEQ ID NO: 1548919 - RNA, 21 nt, Homo sapiens
aagagcaggaggugccugaaa

SEQ ID NO: 1548920 - RNA, 20 nt, Homo sapiens
aagaugcuucucacugccau

SEQ ID NO: 1548921 - RNA, 22 nt, Homo sapiens
aagaugcuucucacugccaugc

SEQ ID NO: 1548922 - RNA, 16 nt, Homo sapiens
aagcacggcugugggu

SEQ ID NO: 1548923 - RNA, 14 nt, Homo sapiens
aagcauuuuuccau

SEQ ID NO: 1548924 - RNA, 15 nt, Homo sapiens
aagccuaccaaugua

SEQ ID NO: 1548925 - RNA, 17 nt, Homo sapiens
aaggaagacaaugugaa

SEQ ID NO: 1548926 - RNA, 15 nt, Homo sapiens
aaggaagauuugacg

SEQ ID NO: 1548927 - RNA, 19 nt, Homo sapiens
aaggacaugagacuaagag

SEQ ID NO: 1548928 - RNA, 13 nt, Homo sapiens
aagggaacuucca

SEQ ID NO: 1548929 - RNA, 16 nt, Homo sapiens
aaggucccuuguuucc

SEQ ID NO: 1548930 - RNA, 17 nt, Homo sapiens
aaggucccuuguuucca

SEQ ID NO: 1548931 - RNA, 14 nt, Homo sapiens
uugaaacugaaugu

SEQ ID NO: 1548932 - RNA, 18 nt, Homo sapiens
uugaaaugccacgugcca

SEQ ID NO: 1548933 - RNA, 13 nt, Homo sapiens
uugaaccauguau

SEQ ID NO: 1548934 - RNA, 14 nt, Homo sapiens
uugaaguaugguug

SEQ ID NO: 1548935 - RNA, 11 nt, Homo sapiens
uugacauagcc

SEQ ID NO: 1548936 - RNA, 14 nt, Homo sapiens
uugaccguagggga

SEQ ID NO: 1548937 - RNA, 14 nt, Homo sapiens
uugagaaaagagug

SEQ ID NO: 1548938 - RNA, 13 nt, Homo sapiens
uugagaagggaca

SEQ ID NO: 1548939 - RNA, 23 nt, Homo sapiens
uugagaguauauuauguauuuau

SEQ ID NO: 1548940 - RNA, 20 nt, Homo sapiens
uugaguccagaaguuugaga

SEQ ID NO: 1548941 - RNA, 20 nt, Homo sapiens
uugauacaucaucgggaaaa

SEQ ID NO: 1548942 - RNA, 18 nt, Homo sapiens
uugcaggaccucagguga

SEQ ID NO: 1548943 - RNA, 20 nt, Homo sapiens
uugcaggaccucaggugaga

SEQ ID NO: 1548944 - RNA, 22 nt, Homo sapiens
uugcauuccuuacuugcacugu

SEQ ID NO: 1548945 - RNA, 18 nt, Homo sapiens
uugcccugaggcucaguc

SEQ ID NO: 1548946 - RNA, 15 nt, Homo sapiens
uugcccuuggagcug

SEQ ID NO: 1548947 - RNA, 17 nt, Homo sapiens
uugcuuauguaaucuca

SEQ ID NO: 1548948 - RNA, 17 nt, Homo sapiens
uuggacagacacuguug

SEQ ID NO: 1548949 - RNA, 16 nt, Homo sapiens
uuggcccuucugcccu

SEQ ID NO: 1548950 - RNA, 21 nt, Homo sapiens
uugggaugcggggcagagcca

SEQ ID NO: 1548951 - RNA, 20 nt, Homo sapiens
uugggucccuugcugcaaac

SEQ ID NO: 1548952 - RNA, 13 nt, Homo sapiens
uuguuuacauaag

SEQ ID NO: 1548953 - RNA, 21 nt, Homo sapiens
uuguuuuuaagcuucuagaca

SEQ ID NO: 1548954 - RNA, 17 nt, Homo sapiens
uuuaaagaaagaaugca

SEQ ID NO: 1548955 - RNA, 19 nt, Homo sapiens
uuuaauuaaaaacuuuaaa

SEQ ID NO: 1548956 - RNA, 17 nt, Homo sapiens
uuuauuuaaacuauuca

SEQ ID NO: 1548957 - RNA, 13 nt, Homo sapiens
uuucauagauuug

SEQ ID NO: 1548958 - RNA, 15 nt, Homo sapiens
uuucaugcuccauuu

SEQ ID NO: 1548959 - RNA, 22 nt, Homo sapiens
uuucauuuggaaugaauacagc

SEQ ID NO: 1548960 - RNA, 21 nt, Homo sapiens
uuucuuuucuauggagcaaaa

SEQ ID NO: 1548961 - RNA, 15 nt, Homo sapiens
uuugaaacugaaugu

SEQ ID NO: 1548962 - RNA, 12 nt, Homo sapiens
uuugaaguagga

SEQ ID NO: 1548963 - RNA, 17 nt, Homo sapiens
uuugagguaaagauaug

SEQ ID NO: 1548964 - RNA, 18 nt, Homo sapiens
uuugauaugaaguguuag

SEQ ID NO: 1548965 - RNA, 18 nt, Homo sapiens
uuugaucuuuguuuaaau

SEQ ID NO: 1548966 - RNA, 21 nt, Homo sapiens
uuugcauuccuuacuugcacu

SEQ ID NO: 1548967 - RNA, 19 nt, Homo sapiens
uuugcccugaggcucaguc

SEQ ID NO: 1548968 - RNA, 14 nt, Homo sapiens
uuuggaaaccaagc

SEQ ID NO: 1548969 - RNA, 18 nt, Homo sapiens
uuuggcuugcuguuuacu

SEQ ID NO: 1548970 - RNA, 19 nt, Homo sapiens
uuuguauuaauaaagcauu

SEQ ID NO: 1548971 - RNA, 20 nt, Homo sapiens
uuuuagaaaccccucuguag

SEQ ID NO: 1548972 - RNA, 22 nt, Homo sapiens
uuuuccacauaggaaaaugcca

SEQ ID NO: 1548973 - RNA, 13 nt, Homo sapiens
uuuucgaacauuc

SEQ ID NO: 1548974 - RNA, 22 nt, Homo sapiens
uuuucuucagguaacacuacag

SEQ ID NO: 1548975 - RNA, 13 nt, Homo sapiens
uuuucuugguguu

SEQ ID NO: 1548976 - RNA, 24 nt, Homo sapiens
uuuugaaaaaguguacaugaagaa

SEQ ID NO: 1548977 - RNA, 14 nt, Homo sapiens
uuuugagaguauau

SEQ ID NO: 1548978 - RNA, 18 nt, Homo sapiens
uuuuuaaaaaacugcuga

SEQ ID NO: 1548979 - RNA, 16 nt, Homo sapiens
uuuuuguaaacuggaa

SEQ ID NO: 1548980 - RNA, 13 nt, Homo sapiens
uuagaaagcuuaa

SEQ ID NO: 1548981 - RNA, 16 nt, Homo sapiens
uuagaagaaaauggau

SEQ ID NO: 1548982 - RNA, 19 nt, Homo sapiens
uuagaagaaaauggaugac

SEQ ID NO: 1548983 - RNA, 17 nt, Homo sapiens
uuagauauguuaagcau

SEQ ID NO: 1548984 - RNA, 21 nt, Homo sapiens
uuaucaguuaaaaucacauuu

SEQ ID NO: 1548985 - RNA, 21 nt, Homo sapiens
uuaucugcaagguuguaguca

SEQ ID NO: 1548986 - RNA, 14 nt, Homo sapiens
uuauuacuugugca

SEQ ID NO: 1548987 - RNA, 18 nt, Homo sapiens
uuauuauggguauguguu

SEQ ID NO: 1548988 - RNA, 22 nt, Homo sapiens
uuauuugggagggaaaagggaa

SEQ ID NO: 1548989 - RNA, 13 nt, Homo sapiens
uucaacgauguga

SEQ ID NO: 1548990 - RNA, 15 nt, Homo sapiens
uucaacgaugugacu

SEQ ID NO: 1548991 - RNA, 18 nt, Homo sapiens
uucaaugaaauaaaagca

SEQ ID NO: 1548992 - RNA, 17 nt, Homo sapiens
uucagccauagcuugau

SEQ ID NO: 1548993 - RNA, 20 nt, Homo sapiens
uucaguagaauuuuaguccu

SEQ ID NO: 1548994 - RNA, 20 nt, Homo sapiens
uucaguagugagcagcaucu

SEQ ID NO: 1548995 - RNA, 13 nt, Homo sapiens
uucauuucagcau

SEQ ID NO: 1548996 - RNA, 20 nt, Homo sapiens
uuccaaauuuagaaagcuua

SEQ ID NO: 1548997 - RNA, 20 nt, Homo sapiens
uuccagguggacaaagucaa

SEQ ID NO: 1548998 - RNA, 16 nt, Homo sapiens
uuccauugccuagcuc

SEQ ID NO: 1548999 - RNA, 20 nt, Homo sapiens
uucccaagcucuagugggaa

SEQ ID NO: 1549000 - RNA, 17 nt, Homo sapiens
uucccuacaguugaaaa

SEQ ID NO: 1549001 - RNA, 16 nt, Homo sapiens
uuccucagcaggccaa

SEQ ID NO: 1549002 - RNA, 12 nt, Homo sapiens
uucuaaguauuu

SEQ ID NO: 1549003 - RNA, 15 nt, Homo sapiens
uucuaccauuugaau

SEQ ID NO: 1549004 - RNA, 22 nt, Homo sapiens
uucuacuuuaauauaaacccau

SEQ ID NO: 1549005 - RNA, 13 nt, Homo sapiens
uucuagacacucc

SEQ ID NO: 1549006 - RNA, 16 nt, Homo sapiens
uucuauuuaccuccua

SEQ ID NO: 1549007 - RNA, 17 nt, Homo sapiens
uucucucuuaguaacau

SEQ ID NO: 1549008 - RNA, 15 nt, Homo sapiens
uucucucuucuccac

SEQ ID NO: 1549009 - RNA, 11 nt, Homo sapiens
uucucugccaa

SEQ ID NO: 1549010 - RNA, 11 nt, Homo sapiens
uucugagauca

SEQ ID NO: 1549011 - RNA, 19 nt, Homo sapiens
uucuuacccucucuuucaa

SEQ ID NO: 1549012 - RNA, 20 nt, Homo sapiens
uucuuagugcuucagaguuu

SEQ ID NO: 1549013 - RNA, 19 nt, Homo sapiens
uucuuuauugcacuaggaa

SEQ ID NO: 1549014 - RNA, 16 nt, Homo sapiens
uucuuugauucuccuu

SEQ ID NO: 1549015 - RNA, 18 nt, Homo sapiens
uucuuuuauuaucaguua

SEQ ID NO: 1549016 - RNA, 18 nt, Homo sapiens
uugaaaaacaacugcaua

SEQ ID NO: 1549017 - RNA, 18 nt, Homo sapiens
uugaaaagaaaaccacag

SEQ ID NO: 1549018 - RNA, 15 nt, Homo sapiens
uugaaaucugaaugc

SEQ ID NO: 1549019 - RNA, 17 nt, Homo sapiens
uugaaaugccacgugcc

SEQ ID NO: 1549020 - RNA, 16 nt, Homo sapiens
uccauugccuagcucu

SEQ ID NO: 1549021 - RNA, 17 nt, Homo sapiens
ucccaagccacauucau

SEQ ID NO: 1549022 - RNA, 22 nt, Homo sapiens
ucccaagcuagacugugucuga

SEQ ID NO: 1549023 - RNA, 16 nt, Homo sapiens
ucccacgacuguugua

SEQ ID NO: 1549024 - RNA, 17 nt, Homo sapiens
ucccacucagcagugag

SEQ ID NO: 1549025 - RNA, 21 nt, Homo sapiens
ucccaucccguaagaccaccu

SEQ ID NO: 1549026 - RNA, 22 nt, Homo sapiens
uccccagcucccccaggcagaa

SEQ ID NO: 1549027 - RNA, 15 nt, Homo sapiens
ucccccaaccccagc

SEQ ID NO: 1549028 - RNA, 17 nt, Homo sapiens
ucccccagcagccuggg

SEQ ID NO: 1549029 - RNA, 18 nt, Homo sapiens
ucccccaucuagccauuu

SEQ ID NO: 1549030 - RNA, 15 nt, Homo sapiens
ucccugucucugcau

SEQ ID NO: 1549031 - RNA, 21 nt, Homo sapiens
uccuaauggcauggagacucu

SEQ ID NO: 1549032 - RNA, 22 nt, Homo sapiens
uccuaauggcauggagacucug

SEQ ID NO: 1549033 - RNA, 18 nt, Homo sapiens
uccuacaguacaaucagc

SEQ ID NO: 1549034 - RNA, 18 nt, Homo sapiens
uccuaggcauuugcugaa

SEQ ID NO: 1549035 - RNA, 14 nt, Homo sapiens
uccucuuugcccug

SEQ ID NO: 1549036 - RNA, 20 nt, Homo sapiens
uccuuaaaugaacuacugcu

SEQ ID NO: 1549037 - RNA, 12 nt, Homo sapiens
uccuuacuugca

SEQ ID NO: 1549038 - RNA, 19 nt, Homo sapiens
uccuugauacuaaaaguuc

SEQ ID NO: 1549039 - RNA, 21 nt, Homo sapiens
ucgagccacaaccgaccagau

SEQ ID NO: 1549040 - RNA, 17 nt, Homo sapiens
ucgcucgaugacuguga

SEQ ID NO: 1549041 - RNA, 17 nt, Homo sapiens
ucggcuucuuggaccuu

SEQ ID NO: 1549042 - RNA, 14 nt, Homo sapiens
ucgggacucagauu

SEQ ID NO: 1549043 - RNA, 22 nt, Homo sapiens
ucggggaccagcccacagcaca

SEQ ID NO: 1549044 - RNA, 13 nt, Homo sapiens
ucuaaguauuuga

SEQ ID NO: 1549045 - RNA, 14 nt, Homo sapiens
ucuacgccagggga

SEQ ID NO: 1549046 - RNA, 15 nt, Homo sapiens
ucuagaaacagaucu

SEQ ID NO: 1549047 - RNA, 20 nt, Homo sapiens
ucuaguucuuuucauuugga

SEQ ID NO: 1549048 - RNA, 23 nt, Homo sapiens
ucuauaaguguucaguguugaca

SEQ ID NO: 1549049 - RNA, 13 nt, Homo sapiens
ucuauuuaccucc

SEQ ID NO: 1549050 - RNA, 19 nt, Homo sapiens
ucucaaaugauacagucag

SEQ ID NO: 1549051 - RNA, 18 nt, Homo sapiens
ucucaaguuaucagggua

SEQ ID NO: 1549052 - RNA, 13 nt, Homo sapiens
ucucacugcaagu

SEQ ID NO: 1549053 - RNA, 14 nt, Homo sapiens
ucucacuuuggacu

SEQ ID NO: 1549054 - RNA, 17 nt, Homo sapiens
ucucagaagguagggga

SEQ ID NO: 1549055 - RNA, 14 nt, Homo sapiens
ucucagcccagaag

SEQ ID NO: 1549056 - RNA, 17 nt, Homo sapiens
ucucccaggccucugcc

SEQ ID NO: 1549057 - RNA, 12 nt, Homo sapiens
ucuccccagaau

SEQ ID NO: 1549058 - RNA, 14 nt, Homo sapiens
ucuccuucugaaag

SEQ ID NO: 1549059 - RNA, 16 nt, Homo sapiens
ucucugcccccauuga

SEQ ID NO: 1549060 - RNA, 18 nt, Homo sapiens
ucucugugauuaccucuc

SEQ ID NO: 1549061 - RNA, 23 nt, Homo sapiens
ucugaaggcucguuuggcuuuau

SEQ ID NO: 1549062 - RNA, 17 nt, Homo sapiens
ucugagaugcugguaau

SEQ ID NO: 1549063 - RNA, 21 nt, Homo sapiens
ucugaggaucagcacugccag

SEQ ID NO: 1549064 - RNA, 20 nt, Homo sapiens
ucugccuggcaacaucuuac

SEQ ID NO: 1549065 - RNA, 21 nt, Homo sapiens
ucugcuguacauuauuaaaag

SEQ ID NO: 1549066 - RNA, 18 nt, Homo sapiens
ucuggcaggcuacucugc

SEQ ID NO: 1549067 - RNA, 20 nt, Homo sapiens
ucugggaagcugagggcaaa

SEQ ID NO: 1549068 - RNA, 19 nt, Homo sapiens
ucugugcagucaucaacaa

SEQ ID NO: 1549069 - RNA, 20 nt, Homo sapiens
ucuuagugcuucagaguuug

SEQ ID NO: 1549070 - RNA, 13 nt, Homo sapiens
ucuuccccagaua

SEQ ID NO: 1549071 - RNA, 16 nt, Homo sapiens
ucuucuaccauuugaa

SEQ ID NO: 1549072 - RNA, 17 nt, Homo sapiens
ucuugaaaucugaaugc

SEQ ID NO: 1549073 - RNA, 15 nt, Homo sapiens
ucuugcacuguccag

SEQ ID NO: 1549074 - RNA, 21 nt, Homo sapiens
ucuuuaccccugcugaccucc

SEQ ID NO: 1549075 - RNA, 21 nt, Homo sapiens
ucuuucaauugcagaugccaa

SEQ ID NO: 1549076 - RNA, 19 nt, Homo sapiens
ucuuucuccagcagcugau

SEQ ID NO: 1549077 - RNA, 22 nt, Homo sapiens
ucuuugcucauggcaacaguua

SEQ ID NO: 1549078 - RNA, 23 nt, Homo sapiens
ucuuugugcaguguuaguauuca

SEQ ID NO: 1549079 - RNA, 18 nt, Homo sapiens
ugaaaaaguguacaugaa

SEQ ID NO: 1549080 - RNA, 16 nt, Homo sapiens
ugaaaacaaacuucuc

SEQ ID NO: 1549081 - RNA, 17 nt, Homo sapiens
ugaaaacaaacuucucg

SEQ ID NO: 1549082 - RNA, 15 nt, Homo sapiens
ugaaaauuguagggu

SEQ ID NO: 1549083 - RNA, 15 nt, Homo sapiens
ugaaauaaaagcaca

SEQ ID NO: 1549084 - RNA, 20 nt, Homo sapiens
ugaaauaaaagcacacugcu

SEQ ID NO: 1549085 - RNA, 22 nt, Homo sapiens
ugaaauaaaagcacacugcuua

SEQ ID NO: 1549086 - RNA, 19 nt, Homo sapiens
ugaagacagagcagaucag

SEQ ID NO: 1549087 - RNA, 16 nt, Homo sapiens
ugaaggacaugagacu

SEQ ID NO: 1549088 - RNA, 15 nt, Homo sapiens
ugaaguacaguccca

SEQ ID NO: 1549089 - RNA, 13 nt, Homo sapiens
ugaaucccuuuag

SEQ ID NO: 1549090 - RNA, 13 nt, Homo sapiens
ugaauguuuccaa

SEQ ID NO: 1549091 - RNA, 15 nt, Homo sapiens
ugaauucuuaugcuu

SEQ ID NO: 1549092 - RNA, 14 nt, Homo sapiens
ugacacuuaucuca

SEQ ID NO: 1549093 - RNA, 19 nt, Homo sapiens
ugacaggccugaagauauu

SEQ ID NO: 1549094 - RNA, 18 nt, Homo sapiens
ugacaucagcaauacaga

SEQ ID NO: 1549095 - RNA, 15 nt, Homo sapiens
ugacugguugucaga

SEQ ID NO: 1549096 - RNA, 20 nt, Homo sapiens
ugacuucauagauuaugcuu

SEQ ID NO: 1549097 - RNA, 19 nt, Homo sapiens
acgugcuauuuuacauauc

SEQ ID NO: 1549098 - RNA, 17 nt, Homo sapiens
acuaggaauucuuugca

SEQ ID NO: 1549099 - RNA, 20 nt, Homo sapiens
acuaggugaacagcaggaug

SEQ ID NO: 1549100 - RNA, 17 nt, Homo sapiens
acuauacucuaaaaugg

SEQ ID NO: 1549101 - RNA, 17 nt, Homo sapiens
acuauguguucaaugaa

SEQ ID NO: 1549102 - RNA, 16 nt, Homo sapiens
acuauuacgugcuauu

SEQ ID NO: 1549103 - RNA, 21 nt, Homo sapiens
acucacacggacacucaaaag

SEQ ID NO: 1549104 - RNA, 15 nt, Homo sapiens
acucaccucucucua

SEQ ID NO: 1549105 - RNA, 15 nt, Homo sapiens
acucuuaacacuaag

SEQ ID NO: 1549106 - RNA, 19 nt, Homo sapiens
acugaagggaacagccuga

SEQ ID NO: 1549107 - RNA, 19 nt, Homo sapiens
acugaauguuuauuccuug

SEQ ID NO: 1549108 - RNA, 23 nt, Homo sapiens
acugcacuuuggaaaccaagcaa

SEQ ID NO: 1549109 - RNA, 13 nt, Homo sapiens
acugcagcuuugu

SEQ ID NO: 1549110 - RNA, 16 nt, Homo sapiens
acugggugucauuuca

SEQ ID NO: 1549111 - RNA, 10 nt, Homo sapiens
acuguaaaau

SEQ ID NO: 1549112 - RNA, 20 nt, Homo sapiens
acugugacacuuaucucacu

SEQ ID NO: 1549113 - RNA, 22 nt, Homo sapiens
acuuagguaaaauaaaagacua

SEQ ID NO: 1549114 - RNA, 16 nt, Homo sapiens
acuuagguguggggga

SEQ ID NO: 1549115 - RNA, 13 nt, Homo sapiens
acuuccacauuau

SEQ ID NO: 1549116 - RNA, 10 nt, Homo sapiens
acuugcacug

SEQ ID NO: 1549117 - RNA, 20 nt, Homo sapiens
acuugggccacugugaagag

SEQ ID NO: 1549118 - RNA, 12 nt, Homo sapiens
acuuuaaaacca

SEQ ID NO: 1549119 - RNA, 18 nt, Homo sapiens
acuuuaaagauaagucua

SEQ ID NO: 1549120 - RNA, 12 nt, Homo sapiens
acuuuaccucuu

SEQ ID NO: 1549121 - RNA, 23 nt, Homo sapiens
acuuucccagaaaaaaaaaaacu

SEQ ID NO: 1549122 - RNA, 16 nt, Homo sapiens
acuuugcugcauuuua

SEQ ID NO: 1549123 - RNA, 23 nt, Homo sapiens
acuuuguaccccccaaccccuga

SEQ ID NO: 1549124 - RNA, 22 nt, Homo sapiens
acuuuguuuagcccaaaaccaa

SEQ ID NO: 1549125 - RNA, 16 nt, Homo sapiens
agaaaaaaaaauacuu

SEQ ID NO: 1549126 - RNA, 11 nt, Homo sapiens
agaaacaaaug

SEQ ID NO: 1549127 - RNA, 16 nt, Homo sapiens
agaaaccagagucaaa

SEQ ID NO: 1549128 - RNA, 22 nt, Homo sapiens
agaaagaugacaaaagaaaauu

SEQ ID NO: 1549129 - RNA, 12 nt, Homo sapiens
agaaauaagccc

SEQ ID NO: 1549130 - RNA, 11 nt, Homo sapiens
agaaaugccag

SEQ ID NO: 1549131 - RNA, 20 nt, Homo sapiens
agaaggcaaccaaagugcag

SEQ ID NO: 1549132 - RNA, 18 nt, Homo sapiens
agaaggcaggaucaaaga

SEQ ID NO: 1549133 - RNA, 13 nt, Homo sapiens
agaagguagggga

SEQ ID NO: 1549134 - RNA, 14 nt, Homo sapiens
agaagugcccuuaa

SEQ ID NO: 1549135 - RNA, 18 nt, Homo sapiens
agaaguuuuuuacuuugg

SEQ ID NO: 1549136 - RNA, 23 nt, Homo sapiens
agaauaaaugguuucucauuaaa

SEQ ID NO: 1549137 - RNA, 17 nt, Homo sapiens
agaauuugcucgcuaca

SEQ ID NO: 1549138 - RNA, 15 nt, Homo sapiens
agacacgcucuucua

SEQ ID NO: 1549139 - RNA, 15 nt, Homo sapiens
agaccaccuucccuu

SEQ ID NO: 1549140 - RNA, 18 nt, Homo sapiens
agacccacagcccugaaa

SEQ ID NO: 1549141 - RNA, 21 nt, Homo sapiens
agaccuccagcccugggacag

SEQ ID NO: 1549142 - RNA, 14 nt, Homo sapiens
agacucccuugcuu

SEQ ID NO: 1549143 - RNA, 14 nt, Homo sapiens
agacuuugcuguua

SEQ ID NO: 1549144 - RNA, 15 nt, Homo sapiens
agagaaaagaaacca

SEQ ID NO: 1549145 - RNA, 19 nt, Homo sapiens
agagaaugcacagauauac

SEQ ID NO: 1549146 - RNA, 19 nt, Homo sapiens
agagacucgcucacuccca

SEQ ID NO: 1549147 - RNA, 21 nt, Homo sapiens
agagcaucuggaacaacagau

SEQ ID NO: 1549148 - RNA, 21 nt, Homo sapiens
agagccaccagggcacugucu

SEQ ID NO: 1549149 - RNA, 20 nt, Homo sapiens
agaggaaggaaacauagaaa

SEQ ID NO: 1549150 - RNA, 19 nt, Homo sapiens
agagggugggguacuggag

SEQ ID NO: 1549151 - RNA, 23 nt, Homo sapiens
agaguuggggagaaacugaagcc

SEQ ID NO: 1549152 - RNA, 19 nt, Homo sapiens
agaguuguuguuugccaag

SEQ ID NO: 1549153 - RNA, 17 nt, Homo sapiens
agauaauuuauuauaca

SEQ ID NO: 1549154 - RNA, 23 nt, Homo sapiens
agaugaagaccaggacuacagcu

SEQ ID NO: 1549155 - RNA, 15 nt, Homo sapiens
agaugccaaaaaaga

SEQ ID NO: 1549156 - RNA, 16 nt, Homo sapiens
agaugcccucaacuca

SEQ ID NO: 1549157 - RNA, 20 nt, Homo sapiens
agaugccugggugcaaagaa

SEQ ID NO: 1549158 - RNA, 23 nt, Homo sapiens
agaugggcgucacuacugcuacc

SEQ ID NO: 1549159 - RNA, 15 nt, Homo sapiens
agauuaucaguagaa

SEQ ID NO: 1549160 - RNA, 22 nt, Homo sapiens
agcacaauuaauuaaaagugaa

SEQ ID NO: 1549161 - RNA, 22 nt, Homo sapiens
agcacagaugugaaggacauga

SEQ ID NO: 1549162 - RNA, 17 nt, Homo sapiens
agcacagcucuccuccu

SEQ ID NO: 1549163 - RNA, 16 nt, Homo sapiens
agcaccauaacuuugu

SEQ ID NO: 1549164 - RNA, 20 nt, Homo sapiens
agcacggcugugggugguga

SEQ ID NO: 1549165 - RNA, 20 nt, Homo sapiens
agcacuagagaaugcacaga

SEQ ID NO: 1549166 - RNA, 15 nt, Homo sapiens
agcacugccagugga

SEQ ID NO: 1549167 - RNA, 12 nt, Homo sapiens
agcacuguaaaa

SEQ ID NO: 1549168 - RNA, 13 nt, Homo sapiens
agcaggccaaaca

SEQ ID NO: 1549169 - RNA, 17 nt, Homo sapiens
agcaguguucucucuga

SEQ ID NO: 1549170 - RNA, 14 nt, Homo sapiens
agcaguucucugcc

SEQ ID NO: 1549171 - RNA, 16 nt, Homo sapiens
agcaucuaguuucccu

SEQ ID NO: 1549172 - RNA, 20 nt, Homo sapiens
agcauuuugcuaaaugugaa

SEQ ID NO: 1549173 - RNA, 12 nt, Homo sapiens
agccacaccgcu

SEQ ID NO: 1549174 - RNA, 21 nt, Homo sapiens
agccacagccugacacagugc

SEQ ID NO: 1549175 - RNA, 17 nt, Homo sapiens
agccauuaaaugaauau

SEQ ID NO: 1549176 - RNA, 12 nt, Homo sapiens
agcccuauguga

SEQ ID NO: 1549177 - RNA, 20 nt, Homo sapiens
agcccuugagucugucacac

SEQ ID NO: 1549178 - RNA, 23 nt, Homo sapiens
agcccuugagucugucacacucu

SEQ ID NO: 1549179 - RNA, 19 nt, Homo sapiens
agccuaauacaacauguag

SEQ ID NO: 1549180 - RNA, 20 nt, Homo sapiens
agccuggcuggagagcugcu

SEQ ID NO: 1549181 - RNA, 15 nt, Homo sapiens
agccugggcaaugug

SEQ ID NO: 1549182 - RNA, 20 nt, Homo sapiens
agccuguucccacucagcag

SEQ ID NO: 1549183 - RNA, 22 nt, Homo sapiens
agccuuagagcaucucugccuc

SEQ ID NO: 1549184 - RNA, 11 nt, Homo sapiens
agccuuugugc

SEQ ID NO: 1549185 - RNA, 22 nt, Homo sapiens
agccuuuuaagcuucauuagcu

SEQ ID NO: 1549186 - RNA, 19 nt, Homo sapiens
agcgaauguguacaaagug

SEQ ID NO: 1549187 - RNA, 15 nt, Homo sapiens
agcgagaacuacgca

SEQ ID NO: 1549188 - RNA, 13 nt, Homo sapiens
agcuaaucugccu

SEQ ID NO: 1549189 - RNA, 19 nt, Homo sapiens
agcuccuuucaugcuccau

SEQ ID NO: 1549190 - RNA, 15 nt, Homo sapiens
agcucuccuccucca

SEQ ID NO: 1549191 - RNA, 13 nt, Homo sapiens
agcugaaccuggg

SEQ ID NO: 1549192 - RNA, 16 nt, Homo sapiens
agcugauuccagaaca

SEQ ID NO: 1549193 - RNA, 16 nt, Homo sapiens
agcuugugaauguuua

SEQ ID NO: 1549194 - RNA, 17 nt, Homo sapiens
agcuuucuaauguucua

SEQ ID NO: 1549195 - RNA, 14 nt, Homo sapiens
agcuuucugugcau

SEQ ID NO: 1549196 - RNA, 16 nt, Homo sapiens
agcuuugaaaauucag

SEQ ID NO: 1549197 - RNA, 15 nt, Homo sapiens
aggaaaaacaaacua

SEQ ID NO: 1549198 - RNA, 20 nt, Homo sapiens
aggaagccucccacgacugc

SEQ ID NO: 1549199 - RNA, 21 nt, Homo sapiens
aggaaugugggcugggggaag

SEQ ID NO: 1549200 - RNA, 15 nt, Homo sapiens
aggaauucuuugcau

SEQ ID NO: 1549201 - RNA, 14 nt, Homo sapiens
aggacuacuuucca

SEQ ID NO: 1549202 - RNA, 20 nt, Homo sapiens
aggagagcuagcagcaggga

SEQ ID NO: 1549203 - RNA, 18 nt, Homo sapiens
aggagaggggcacagggu

SEQ ID NO: 1549204 - RNA, 13 nt, Homo sapiens
aggagcuacccuu

SEQ ID NO: 1549205 - RNA, 17 nt, Homo sapiens
aggagucagaaacuguu

SEQ ID NO: 1549206 - RNA, 13 nt, Homo sapiens
aggagugccauac

SEQ ID NO: 1549207 - RNA, 20 nt, Homo sapiens
aggagugcgugccugcuacg

SEQ ID NO: 1549208 - RNA, 18 nt, Homo sapiens
aggauauacugcagcuuu

SEQ ID NO: 1549209 - RNA, 18 nt, Homo sapiens
aggauugagaagggacaa

SEQ ID NO: 1549210 - RNA, 13 nt, Homo sapiens
aggcaacugcauu

SEQ ID NO: 1549211 - RNA, 13 nt, Homo sapiens
aggccccaaagga

SEQ ID NO: 1549212 - RNA, 13 nt, Homo sapiens
aggccuaccucuc

SEQ ID NO: 1549213 - RNA, 18 nt, Homo sapiens
aggcgauugaaaccauug

SEQ ID NO: 1549214 - RNA, 11 nt, Homo sapiens
aggcugagggc

SEQ ID NO: 1549215 - RNA, 18 nt, Homo sapiens
aggcuguguuuacaugga

SEQ ID NO: 1549216 - RNA, 22 nt, Homo sapiens
ccaaagcuggcccaguugucca

SEQ ID NO: 1549217 - RNA, 17 nt, Homo sapiens
ccaaaggaaaaagcaca

SEQ ID NO: 1549218 - RNA, 18 nt, Homo sapiens
ccaaagugcaggacauca

SEQ ID NO: 1549219 - RNA, 23 nt, Homo sapiens
ccaaauuuaauuaaagccuuaag

SEQ ID NO: 1549220 - RNA, 18 nt, Homo sapiens
ccaaauuuagaaagcuua

SEQ ID NO: 1549221 - RNA, 15 nt, Homo sapiens
ccaacuugccaaaau

SEQ ID NO: 1549222 - RNA, 16 nt, Homo sapiens
ccaagcuagacugugu

SEQ ID NO: 1549223 - RNA, 20 nt, Homo sapiens
ccaaggccggagacccacag

SEQ ID NO: 1549224 - RNA, 15 nt, Homo sapiens
ccaauaaaccuguaa

SEQ ID NO: 1549225 - RNA, 17 nt, Homo sapiens
ccaauauuuaccagacc

SEQ ID NO: 1549226 - RNA, 19 nt, Homo sapiens
ccacauuauacauuugaug

SEQ ID NO: 1549227 - RNA, 16 nt, Homo sapiens
ccaccagggcacuguc

SEQ ID NO: 1549228 - RNA, 21 nt, Homo sapiens
ccaccauuccuggaaaccaca

SEQ ID NO: 1549229 - RNA, 22 nt, Homo sapiens
ccaccccagcaucagcacagcu

SEQ ID NO: 1549230 - RNA, 18 nt, Homo sapiens
ccaccugaccucugcaag

SEQ ID NO: 1549231 - RNA, 20 nt, Homo sapiens
ccacugcaaauaaagccuuu

SEQ ID NO: 1549232 - RNA, 22 nt, Homo sapiens
ccagaagaaaauucuccugaua

SEQ ID NO: 1549233 - RNA, 14 nt, Homo sapiens
ccagagaauucuua

SEQ ID NO: 1549234 - RNA, 22 nt, Homo sapiens
ccagcaccuauugaauuaccau

SEQ ID NO: 1549235 - RNA, 16 nt, Homo sapiens
ccagcaccucaugcag

SEQ ID NO: 1549236 - RNA, 15 nt, Homo sapiens
ccagccccagcaccu

SEQ ID NO: 1549237 - RNA, 20 nt, Homo sapiens
ccagccugggugacagagca

SEQ ID NO: 1549238 - RNA, 18 nt, Homo sapiens
ccagcgugugacuacucc

SEQ ID NO: 1549239 - RNA, 15 nt, Homo sapiens
ccagcuagugccaaa

SEQ ID NO: 1549240 - RNA, 12 nt, Homo sapiens
ccaggaccccau

SEQ ID NO: 1549241 - RNA, 20 nt, Homo sapiens
ccaggcaucacugauucccu

SEQ ID NO: 1549242 - RNA, 14 nt, Homo sapiens
ccaggggaggugua

SEQ ID NO: 1549243 - RNA, 16 nt, Homo sapiens
ccaggucccuccucag

SEQ ID NO: 1549244 - RNA, 21 nt, Homo sapiens
ccaguggagacggaaucugcc

SEQ ID NO: 1549245 - RNA, 22 nt, Homo sapiens
ccaguggagacggaaucugccg

SEQ ID NO: 1549246 - RNA, 15 nt, Homo sapiens
ccauaaaaggugugu

SEQ ID NO: 1549247 - RNA, 23 nt, Homo sapiens
ccauaaguaauauuuaaagauua

SEQ ID NO: 1549248 - RNA, 20 nt, Homo sapiens
ccaugcuucacucaugcaaa

SEQ ID NO: 1549249 - RNA, 17 nt, Homo sapiens
ccauggacccaauauuu

SEQ ID NO: 1549250 - RNA, 15 nt, Homo sapiens
ccauuacgugcauuu

SEQ ID NO: 1549251 - RNA, 16 nt, Homo sapiens
ccauugauucuucaga

SEQ ID NO: 1549252 - RNA, 21 nt, Homo sapiens
ccauugauucuucagaacuuu

SEQ ID NO: 1549253 - RNA, 17 nt, Homo sapiens
ccauugccuagcucuuu

SEQ ID NO: 1549254 - RNA, 13 nt, Homo sapiens
ccauugugaagca

SEQ ID NO: 1549255 - RNA, 12 nt, Homo sapiens
cccaacuugcca

SEQ ID NO: 1549256 - RNA, 17 nt, Homo sapiens
cccaauauuuaccagac

SEQ ID NO: 1549257 - RNA, 19 nt, Homo sapiens
cccagcaccucaugcagag

SEQ ID NO: 1549258 - RNA, 23 nt, Homo sapiens
cccaggcugguauuuaucugcaa

SEQ ID NO: 1549259 - RNA, 22 nt, Homo sapiens
cccaggucccuccucagaccuc

SEQ ID NO: 1549260 - RNA, 22 nt, Homo sapiens
cccaggugguuauggagagggu

SEQ ID NO: 1549261 - RNA, 23 nt, Homo sapiens
ccccaagagcaggaggugccuga

SEQ ID NO: 1549262 - RNA, 15 nt, Homo sapiens
ccccaauccaugcuu

SEQ ID NO: 1549263 - RNA, 12 nt, Homo sapiens
ccccacccaguu

SEQ ID NO: 1549264 - RNA, 15 nt, Homo sapiens
ccccaggucugggaa

SEQ ID NO: 1549265 - RNA, 23 nt, Homo sapiens
cccccuuccuguccccaggggag

SEQ ID NO: 1549266 - RNA, 18 nt, Homo sapiens
cccucaacaccucugcac

SEQ ID NO: 1549267 - RNA, 14 nt, Homo sapiens
cccuccacccacua

SEQ ID NO: 1549268 - RNA, 15 nt, Homo sapiens
cccucucccacccaa

SEQ ID NO: 1549269 - RNA, 16 nt, Homo sapiens
cccugaggcucagucu

SEQ ID NO: 1549270 - RNA, 13 nt, Homo sapiens
cccuggaaaugga

SEQ ID NO: 1549271 - RNA, 21 nt, Homo sapiens
cccuggaauaaauuucgcaau

SEQ ID NO: 1549272 - RNA, 12 nt, Homo sapiens
cccuggugggcc

SEQ ID NO: 1549273 - RNA, 12 nt, Homo sapiens
cccuguagggug

SEQ ID NO: 1549274 - RNA, 14 nt, Homo sapiens
cccuucuauuuauu

SEQ ID NO: 1549275 - RNA, 22 nt, Homo sapiens
ccgaauucuaugagcaugccaa

SEQ ID NO: 1549276 - RNA, 14 nt, Homo sapiens
ccggaagaaccaga

SEQ ID NO: 1549277 - RNA, 13 nt, Homo sapiens
ccggaggaaccga

SEQ ID NO: 1549278 - RNA, 23 nt, Homo sapiens
ccuacaguugaaaaacagcugag

SEQ ID NO: 1549279 - RNA, 14 nt, Homo sapiens
ccuaggucaugaag

SEQ ID NO: 1549280 - RNA, 14 nt, Homo sapiens
ccucaggcaggugg

SEQ ID NO: 1549281 - RNA, 13 nt, Homo sapiens
ccucauuagcauu

SEQ ID NO: 1549282 - RNA, 19 nt, Homo sapiens
ccucauuagcauuuugcua

SEQ ID NO: 1549283 - RNA, 20 nt, Homo sapiens
ccucauuagcauuuugcuaa

SEQ ID NO: 1549284 - RNA, 17 nt, Homo sapiens
ccucuuagaaaaaccac

SEQ ID NO: 1549285 - RNA, 18 nt, Homo sapiens
ccugaguucugacacugu

SEQ ID NO: 1549286 - RNA, 15 nt, Homo sapiens
ccugcugaccuccca

SEQ ID NO: 1549287 - RNA, 16 nt, Homo sapiens
ccugggacagggcaaa

SEQ ID NO: 1549288 - RNA, 13 nt, Homo sapiens
ccuggugcccuuc

SEQ ID NO: 1549289 - RNA, 20 nt, Homo sapiens
ccuguaauaaagcucuuuaa

SEQ ID NO: 1549290 - RNA, 12 nt, Homo sapiens
ccuuaagcacaa

SEQ ID NO: 1549291 - RNA, 13 nt, Homo sapiens
ccuuccucagcag

SEQ ID NO: 1549292 - RNA, 13 nt, Homo sapiens
ccuucucuccuuc

SEQ ID NO: 1549293 - RNA, 16 nt, Homo sapiens
ccuugcccuuggagcu

SEQ ID NO: 1549294 - RNA, 22 nt, Homo sapiens
ccuuuccaaaugcccagcuuaa

SEQ ID NO: 1549295 - RNA, 20 nt, Homo sapiens
ccuuucccagguaauuuaaa

SEQ ID NO: 1549296 - RNA, 18 nt, Homo sapiens
ccuuucuuuugaaaugcc

SEQ ID NO: 1549297 - RNA, 13 nt, Homo sapiens
ccuuuuuauaggu

SEQ ID NO: 1549298 - RNA, 15 nt, Homo sapiens
cgaacauucuuugcc

SEQ ID NO: 1549299 - RNA, 13 nt, Homo sapiens
cgaacuguucaca

SEQ ID NO: 1549300 - RNA, 20 nt, Homo sapiens
cgaacuguucacacugcaga

SEQ ID NO: 1549301 - RNA, 15 nt, Homo sapiens
cgagaugaguuucug

SEQ ID NO: 1549302 - RNA, 16 nt, Homo sapiens
cgaucaggaccugcuu

SEQ ID NO: 1549303 - RNA, 20 nt, Homo sapiens
cgcuggguauuggaaaugga

SEQ ID NO: 1549304 - RNA, 18 nt, Homo sapiens
cgcugugucagcauagaa

SEQ ID NO: 1549305 - RNA, 22 nt, Homo sapiens
cgcuuucauguuacuguugcag

SEQ ID NO: 1549306 - RNA, 14 nt, Homo sapiens
cggaagaacaugaa

SEQ ID NO: 1549307 - RNA, 21 nt, Homo sapiens
cgguuucuccccggacacucg

SEQ ID NO: 1549308 - RNA, 19 nt, Homo sapiens
cguacccagccauguguug

SEQ ID NO: 1549309 - RNA, 16 nt, Homo sapiens
cgucacuacugcuacc

SEQ ID NO: 1549310 - RNA, 12 nt, Homo sapiens
cgugccauuguc

SEQ ID NO: 1549311 - RNA, 13 nt, Homo sapiens
cgugccugcuacg

SEQ ID NO: 1549312 - RNA, 15 nt, Homo sapiens
cgugccuguguccug

SEQ ID NO: 1549313 - RNA, 19 nt, Homo sapiens
cguuucugcccagcccucu

SEQ ID NO: 1549314 - RNA, 10 nt, Homo sapiens
cuaaacugua

SEQ ID NO: 1549315 - RNA, 18 nt, Homo sapiens
cuaaagacuaacuugaaa

SEQ ID NO: 1549316 - RNA, 22 nt, Homo sapiens
cuaaaugugaaugaugauccua

SEQ ID NO: 1549317 - RNA, 23 nt, Homo sapiens
cuaaccuuugggccaauuuacug

SEQ ID NO: 1549318 - RNA, 15 nt, Homo sapiens
cuaacuugaaaagaa

SEQ ID NO: 1549319 - RNA, 22 nt, Homo sapiens
cuaagcgaauguguacaaagug

SEQ ID NO: 1549320 - RNA, 22 nt, Homo sapiens
cuaaguacccuugggguggugc

SEQ ID NO: 1549321 - RNA, 17 nt, Homo sapiens
cuacagcacuacugggu

SEQ ID NO: 1549322 - RNA, 16 nt, Homo sapiens
cuacaguacaaucagc

SEQ ID NO: 1549323 - RNA, 18 nt, Homo sapiens
cuaccauuugaauuugug

SEQ ID NO: 1549324 - RNA, 19 nt, Homo sapiens
cuacugggugucauuucau

SEQ ID NO: 1549325 - RNA, 23 nt, Homo sapiens
cuacugggugucauuucauucca

SEQ ID NO: 1549326 - RNA, 22 nt, Homo sapiens
cuagggcccuuucuugcacugu

SEQ ID NO: 1549327 - RNA, 19 nt, Homo sapiens
cuaguaaguaauuaugcac

SEQ ID NO: 1549328 - RNA, 16 nt, Homo sapiens
cuauaaguguucagug

SEQ ID NO: 1549329 - RNA, 16 nt, Homo sapiens
cuauaccuuacugaca

SEQ ID NO: 1549330 - RNA, 15 nt, Homo sapiens
cuauacucuaaaaug

SEQ ID NO: 1549331 - RNA, 17 nt, Homo sapiens
cuaugugugcuuauaca

SEQ ID NO: 1549332 - RNA, 12 nt, Homo sapiens
cuauuuaccucc

SEQ ID NO: 1549333 - RNA, 22 nt, Homo sapiens
cucacacggacacucaaaagcu

SEQ ID NO: 1549334 - RNA, 20 nt, Homo sapiens
gaagguucuacgccagggga

SEQ ID NO: 1549335 - RNA, 12 nt, Homo sapiens
gaagucuugggu

SEQ ID NO: 1549336 - RNA, 17 nt, Homo sapiens
gaaguuuuuuacuuugg

SEQ ID NO: 1549337 - RNA, 14 nt, Homo sapiens
gaauauuacuccua

SEQ ID NO: 1549338 - RNA, 20 nt, Homo sapiens
gaaugcaagugaacuuggga

SEQ ID NO: 1549339 - RNA, 14 nt, Homo sapiens
gaaugugaagccag

SEQ ID NO: 1549340 - RNA, 23 nt, Homo sapiens
gaaugugaagccagaucucggga

SEQ ID NO: 1549341 - RNA, 14 nt, Homo sapiens
gaauucaauuuggc

SEQ ID NO: 1549342 - RNA, 13 nt, Homo sapiens
gaauucuuugcau

SEQ ID NO: 1549343 - RNA, 13 nt, Homo sapiens
gaauuuuaguccu

SEQ ID NO: 1549344 - RNA, 20 nt, Homo sapiens
gacaaagucaacuuccacau

SEQ ID NO: 1549345 - RNA, 12 nt, Homo sapiens
gacaaugccaau

SEQ ID NO: 1549346 - RNA, 13 nt, Homo sapiens
gacaaugccaaua

SEQ ID NO: 1549347 - RNA, 21 nt, Homo sapiens
gacacucacacggacacucaa

SEQ ID NO: 1549348 - RNA, 17 nt, Homo sapiens
gacacuccccacgggaa

SEQ ID NO: 1549349 - RNA, 14 nt, Homo sapiens
gacacuguugcaaa

SEQ ID NO: 1549350 - RNA, 15 nt, Homo sapiens
gacagacggaaauga

SEQ ID NO: 1549351 - RNA, 15 nt, Homo sapiens
gacagagcaagugag

SEQ ID NO: 1549352 - RNA, 19 nt, Homo sapiens
gacaguauguaugccuucg

SEQ ID NO: 1549353 - RNA, 11 nt, Homo sapiens
gacaucugccu

SEQ ID NO: 1549354 - RNA, 23 nt, Homo sapiens
gacccacggagcccuuaugacau

SEQ ID NO: 1549355 - RNA, 22 nt, Homo sapiens
gacuuguuucuuucugucucuc

SEQ ID NO: 1549356 - RNA, 16 nt, Homo sapiens
gagaaggagugccaua

SEQ ID NO: 1549357 - RNA, 14 nt, Homo sapiens
gagaagugcccuua

SEQ ID NO: 1549358 - RNA, 22 nt, Homo sapiens
gagacaaaccugggcaaugugg

SEQ ID NO: 1549359 - RNA, 15 nt, Homo sapiens
gagaccaggagggag

SEQ ID NO: 1549360 - RNA, 23 nt, Homo sapiens
gagagagcccccacccaguuccu

SEQ ID NO: 1549361 - RNA, 18 nt, Homo sapiens
gagaguauauuauguauu

SEQ ID NO: 1549362 - RNA, 17 nt, Homo sapiens
gagaguuccucuuugcc

SEQ ID NO: 1549363 - RNA, 18 nt, Homo sapiens
gagcaagugagacccugu

SEQ ID NO: 1549364 - RNA, 13 nt, Homo sapiens
gagcaucucugcc

SEQ ID NO: 1549365 - RNA, 21 nt, Homo sapiens
gagcccauuucaauucucaaa

SEQ ID NO: 1549366 - RNA, 20 nt, Homo sapiens
gagcccccugagagugucag

SEQ ID NO: 1549367 - RNA, 22 nt, Homo sapiens
gagccuggcuggagagcugcua

SEQ ID NO: 1549368 - RNA, 23 nt, Homo sapiens
gagcugguggggaggagccugga

SEQ ID NO: 1549369 - RNA, 14 nt, Homo sapiens
gagcuuucugcuau

SEQ ID NO: 1549370 - RNA, 13 nt, Homo sapiens
gaggaagggccga

SEQ ID NO: 1549371 - RNA, 15 nt, Homo sapiens
gaggacuacuuucca

SEQ ID NO: 1549372 - RNA, 14 nt, Homo sapiens
gaggagacugggca

SEQ ID NO: 1549373 - RNA, 20 nt, Homo sapiens
gaggcaggaagauagcuuga

SEQ ID NO: 1549374 - RNA, 15 nt, Homo sapiens
gaggccucgacccac

SEQ ID NO: 1549375 - RNA, 14 nt, Homo sapiens
gaggcuaacccuga

SEQ ID NO: 1549376 - RNA, 17 nt, Homo sapiens
gagggaaggggacagau

SEQ ID NO: 1549377 - RNA, 19 nt, Homo sapiens
gagguucugggccucugaa

SEQ ID NO: 1549378 - RNA, 14 nt, Homo sapiens
gaguauaauauuca

SEQ ID NO: 1549379 - RNA, 17 nt, Homo sapiens
gagucacaguugacaaa

SEQ ID NO: 1549380 - RNA, 17 nt, Homo sapiens
gagucugucacacucuc

SEQ ID NO: 1549381 - RNA, 19 nt, Homo sapiens
gaguguuugaaaacugaca

SEQ ID NO: 1549382 - RNA, 21 nt, Homo sapiens
gaguugauucagcucugcaag

SEQ ID NO: 1549383 - RNA, 19 nt, Homo sapiens
gauaauucugaucaaucau

SEQ ID NO: 1549384 - RNA, 19 nt, Homo sapiens
gauacaucaucgggaaaaa

SEQ ID NO: 1549385 - RNA, 17 nt, Homo sapiens
gauauacugcagcuuua

SEQ ID NO: 1549386 - RNA, 17 nt, Homo sapiens
gauauauaccacuuucc

SEQ ID NO: 1549387 - RNA, 18 nt, Homo sapiens
gauaugcaaguaagaaau

SEQ ID NO: 1549388 - RNA, 14 nt, Homo sapiens
gauauguuaagcau

SEQ ID NO: 1549389 - RNA, 19 nt, Homo sapiens
gaucagccugggcaaugug

SEQ ID NO: 1549390 - RNA, 20 nt, Homo sapiens
gauccauagugcuaccugca

SEQ ID NO: 1549391 - RNA, 16 nt, Homo sapiens
gaucugcucgcugaga

SEQ ID NO: 1549392 - RNA, 17 nt, Homo sapiens
gaucuuucuauuccaaa

SEQ ID NO: 1549393 - RNA, 12 nt, Homo sapiens
gaugacaaagaa

SEQ ID NO: 1549394 - RNA, 11 nt, Homo sapiens
gaugacuguga

SEQ ID NO: 1549395 - RNA, 16 nt, Homo sapiens
gaugccagggacccac

SEQ ID NO: 1549396 - RNA, 14 nt, Homo sapiens
gauggcagugagaa

SEQ ID NO: 1549397 - RNA, 18 nt, Homo sapiens
gauuaccagucugauuau

SEQ ID NO: 1549398 - RNA, 22 nt, Homo sapiens
gauuauugcuucuuuccuugca

SEQ ID NO: 1549399 - RNA, 21 nt, Homo sapiens
gauucauucucauaauuccua

SEQ ID NO: 1549400 - RNA, 21 nt, Homo sapiens
gauuuagaagcaaagauuuca

SEQ ID NO: 1549401 - RNA, 16 nt, Homo sapiens
gcaacaucuuacuugu

SEQ ID NO: 1549402 - RNA, 14 nt, Homo sapiens
gcaaguaaggcuuu

SEQ ID NO: 1549403 - RNA, 15 nt, Homo sapiens
gcacagcugccgcgu

SEQ ID NO: 1549404 - RNA, 17 nt, Homo sapiens
gcacagggucucuacca

SEQ ID NO: 1549405 - RNA, 19 nt, Homo sapiens
gcaccucaugcagagggug

SEQ ID NO: 1549406 - RNA, 21 nt, Homo sapiens
gcacuaggaauucuuugcauu

SEQ ID NO: 1549407 - RNA, 14 nt, Homo sapiens
gcagcaacucccac

SEQ ID NO: 1549408 - RNA, 18 nt, Homo sapiens
gcagccuggggucugaca

SEQ ID NO: 1549409 - RNA, 12 nt, Homo sapiens
gcaggaccucag

SEQ ID NO: 1549410 - RNA, 12 nt, Homo sapiens
gcaggaugcccu

SEQ ID NO: 1549411 - RNA, 15 nt, Homo sapiens
gcaggcuacucugcc

SEQ ID NO: 1549412 - RNA, 18 nt, Homo sapiens
gcagggaaggaauccugg

SEQ ID NO: 1549413 - RNA, 19 nt, Homo sapiens
gcauagaguagguacucca

SEQ ID NO: 1549414 - RNA, 15 nt, Homo sapiens
gcaucagcacagcuc

SEQ ID NO: 1549415 - RNA, 19 nt, Homo sapiens
gcaucucugccuccaaccc

SEQ ID NO: 1549416 - RNA, 16 nt, Homo sapiens
gcaucuggaacaacag

SEQ ID NO: 1549417 - RNA, 18 nt, Homo sapiens
gcaugagucuguuuccca

SEQ ID NO: 1549418 - RNA, 23 nt, Homo sapiens
gcaugagucuguuucccaagcua

SEQ ID NO: 1549419 - RNA, 22 nt, Homo sapiens
gcaugcccuauggccuaugugc

SEQ ID NO: 1549420 - RNA, 18 nt, Homo sapiens
gcauuccuuacuugcacu

SEQ ID NO: 1549421 - RNA, 16 nt, Homo sapiens
gcauuugauuuugccc

SEQ ID NO: 1549422 - RNA, 17 nt, Homo sapiens
gccaaagcuggcuuuuu

SEQ ID NO: 1549423 - RNA, 22 nt, Homo sapiens
gccaaagcuggcuuuuugucaa

SEQ ID NO: 1549424 - RNA, 17 nt, Homo sapiens
gccaagcuaaucugccu

SEQ ID NO: 1549425 - RNA, 15 nt, Homo sapiens
gccaauagucauaug

SEQ ID NO: 1549426 - RNA, 17 nt, Homo sapiens
gccacggccuugugucu

SEQ ID NO: 1549427 - RNA, 16 nt, Homo sapiens
gccacuuagacacuuu

SEQ ID NO: 1549428 - RNA, 23 nt, Homo sapiens
gccacuuagacacuuuaccucuu

SEQ ID NO: 1549429 - RNA, 20 nt, Homo sapiens
gccagcagcagcuacaacau

SEQ ID NO: 1549430 - RNA, 18 nt, Homo sapiens
gccaucaucagcuuaauu

SEQ ID NO: 1549431 - RNA, 12 nt, Homo sapiens
gccaugcccuua

SEQ ID NO: 1549432 - RNA, 12 nt, Homo sapiens
gcccaauggaga

SEQ ID NO: 1549433 - RNA, 20 nt, Homo sapiens
gcccaguuggaggagacugg

SEQ ID NO: 1549434 - RNA, 18 nt, Homo sapiens
gcccaguuguccaugaca

SEQ ID NO: 1549435 - RNA, 23 nt, Homo sapiens
gccccaacucaagugucaccucc

SEQ ID NO: 1549436 - RNA, 19 nt, Homo sapiens
gcccugaggcucagucucu

SEQ ID NO: 1549437 - RNA, 13 nt, Homo sapiens
gcccuucuacccc

SEQ ID NO: 1549438 - RNA, 20 nt, Homo sapiens
gccgugauuuucauugcugg

SEQ ID NO: 1549439 - RNA, 16 nt, Homo sapiens
gccguguuuuuggccc

SEQ ID NO: 1549440 - RNA, 16 nt, Homo sapiens
gccuccugcccagucc

SEQ ID NO: 1549441 - RNA, 15 nt, Homo sapiens
gccucugaacccccu

SEQ ID NO: 1549442 - RNA, 17 nt, Homo sapiens
gccucugggaucugcca

SEQ ID NO: 1549443 - RNA, 20 nt, Homo sapiens
gccugaagauauuacuacuu

SEQ ID NO: 1549444 - RNA, 15 nt, Homo sapiens
gccugggugcaaaga

SEQ ID NO: 1549445 - RNA, 20 nt, Homo sapiens
gccuucauaagccuaccaau

SEQ ID NO: 1549446 - RNA, 13 nt, Homo sapiens
gcgcaccaucucu

SEQ ID NO: 1549447 - RNA, 23 nt, Homo sapiens
gcgguuuauagguaaugauggaa

SEQ ID NO: 1549448 - RNA, 12 nt, Homo sapiens
gcgucacuacug

SEQ ID NO: 1549449 - RNA, 13 nt, Homo sapiens
gcuaauucauacc

SEQ ID NO: 1549450 - RNA, 16 nt, Homo sapiens
gcuaccugcaccucug

SEQ ID NO: 1549451 - RNA, 15 nt, Homo sapiens
gcuagaaauaagccc

SEQ ID NO: 1549452 - RNA, 19 nt, Homo sapiens
gcuauauuuuuaaagaagg

SEQ ID NO: 1549453 - RNA, 19 nt, Homo sapiens
uugcuucuuuuucuuaccc

SEQ ID NO: 1549454 - RNA, 22 nt, Homo sapiens
uugcuuuugaaaaacaacugca

SEQ ID NO: 1549455 - RNA, 11 nt, Homo sapiens
uuggagcugcc

SEQ ID NO: 1549456 - RNA, 16 nt, Homo sapiens
uuggcugcguacucca

SEQ ID NO: 1549457 - RNA, 24 nt, Homo sapiens
uuggcugcguacuccacuggucug

SEQ ID NO: 1549458 - RNA, 15 nt, Homo sapiens
uuggggagacaucaa

SEQ ID NO: 1549459 - RNA, 23 nt, Homo sapiens
uuguggaggagggagagcccugu

SEQ ID NO: 1549460 - RNA, 18 nt, Homo sapiens
uuguguugugcagcauua

SEQ ID NO: 1549461 - RNA, 23 nt, Homo sapiens
uuguuuaccauagaaagaugaca

SEQ ID NO: 1549462 - RNA, 13 nt, Homo sapiens
uuguuucuuucug

SEQ ID NO: 1549463 - RNA, 14 nt, Homo sapiens
uuuaaaaaggguaa

SEQ ID NO: 1549464 - RNA, 13 nt, Homo sapiens
uuuaaaagucauu

SEQ ID NO: 1549465 - RNA, 14 nt, Homo sapiens
uuuaaacuauucag

SEQ ID NO: 1549466 - RNA, 17 nt, Homo sapiens
uuuaaagagcauaauaa

SEQ ID NO: 1549467 - RNA, 19 nt, Homo sapiens
uuuaaagauaagucuacau

SEQ ID NO: 1549468 - RNA, 16 nt, Homo sapiens
uuuaagugcuucacau

SEQ ID NO: 1549469 - RNA, 17 nt, Homo sapiens
uuuaauaaaaguacuga

SEQ ID NO: 1549470 - RNA, 14 nt, Homo sapiens
uuuagaaagcuuaa

SEQ ID NO: 1549471 - RNA, 17 nt, Homo sapiens
uuuagagcguuugguua

SEQ ID NO: 1549472 - RNA, 20 nt, Homo sapiens
uuuauccuaguuccauucuu

SEQ ID NO: 1549473 - RNA, 19 nt, Homo sapiens
uuuauggagaccucuccuu

SEQ ID NO: 1549474 - RNA, 17 nt, Homo sapiens
uuuauuaggauuaccca

SEQ ID NO: 1549475 - RNA, 15 nt, Homo sapiens
uuuauuauacaccuu

SEQ ID NO: 1549476 - RNA, 12 nt, Homo sapiens
uuucaaaacaca

SEQ ID NO: 1549477 - RNA, 15 nt, Homo sapiens
uuucaaaacacaucu

SEQ ID NO: 1549478 - RNA, 19 nt, Homo sapiens
uuucauguauguauauaau

SEQ ID NO: 1549479 - RNA, 11 nt, Homo sapiens
uuucauuccau

SEQ ID NO: 1549480 - RNA, 15 nt, Homo sapiens
uuucuggaauggaaa

SEQ ID NO: 1549481 - RNA, 17 nt, Homo sapiens
uuugaaacugaauguuu

SEQ ID NO: 1549482 - RNA, 14 nt, Homo sapiens
uuugaggucuacau

SEQ ID NO: 1549483 - RNA, 22 nt, Homo sapiens
uuugaugccaagaaaguauuug

SEQ ID NO: 1549484 - RNA, 19 nt, Homo sapiens
uuuggagcauuaacuaaau

SEQ ID NO: 1549485 - RNA, 17 nt, Homo sapiens
uuuguaguuuuugcuga

SEQ ID NO: 1549486 - RNA, 21 nt, Homo sapiens
uuuuaaaaaaaucccauuuaa

SEQ ID NO: 1549487 - RNA, 13 nt, Homo sapiens
uuuuaaauguguu

SEQ ID NO: 1549488 - RNA, 22 nt, Homo sapiens
uuuuacaaaacugcuuugugca

SEQ ID NO: 1549489 - RNA, 15 nt, Homo sapiens
uuuuacuuugguuua

SEQ ID NO: 1549490 - RNA, 19 nt, Homo sapiens
uuuuagacccuauugcugc

SEQ ID NO: 1549491 - RNA, 14 nt, Homo sapiens
aaucacugcauuca

SEQ ID NO: 1549492 - RNA, 16 nt, Homo sapiens
aaucaugcucauguau

SEQ ID NO: 1549493 - RNA, 17 nt, Homo sapiens
aaucaugcucauguaua

SEQ ID NO: 1549494 - RNA, 14 nt, Homo sapiens
aauccauauuucaa

SEQ ID NO: 1549495 - RNA, 22 nt, Homo sapiens
aauccuaaaagagaucugggca

SEQ ID NO: 1549496 - RNA, 16 nt, Homo sapiens
aaugaaauugucaaaa

SEQ ID NO: 1549497 - RNA, 21 nt, Homo sapiens
aaugacuauuguaaugccaau

SEQ ID NO: 1549498 - RNA, 15 nt, Homo sapiens
aaugagccuggcaag

SEQ ID NO: 1549499 - RNA, 22 nt, Homo sapiens
aaugaucacaucuaaagcuuua

SEQ ID NO: 1549500 - RNA, 14 nt, Homo sapiens
aaugcauuccagaa

SEQ ID NO: 1549501 - RNA, 15 nt, Homo sapiens
aauggaugacaaaga

SEQ ID NO: 1549502 - RNA, 19 nt, Homo sapiens
aaugucagacuuugcugca

SEQ ID NO: 1549503 - RNA, 16 nt, Homo sapiens
aauguugcucugggag

SEQ ID NO: 1549504 - RNA, 20 nt, Homo sapiens
aauguuggacagacacuguu

SEQ ID NO: 1549505 - RNA, 19 nt, Homo sapiens
aauguuuaagauaaacaga

SEQ ID NO: 1549506 - RNA, 16 nt, Homo sapiens
aauuaaacuaguuuaa

SEQ ID NO: 1549507 - RNA, 22 nt, Homo sapiens
aauuacguucuuacaagcuuaa

SEQ ID NO: 1549508 - RNA, 21 nt, Homo sapiens
aauuauccauuacgugcauuu

SEQ ID NO: 1549509 - RNA, 20 nt, Homo sapiens
aauuauuuauuacuugugca

SEQ ID NO: 1549510 - RNA, 20 nt, Homo sapiens
aauuuccaaaauaaucuaua

SEQ ID NO: 1549511 - RNA, 14 nt, Homo sapiens
aauuucuggaagaa

SEQ ID NO: 1549512 - RNA, 21 nt, Homo sapiens
acaaaaaauuugagaaagccu

SEQ ID NO: 1549513 - RNA, 24 nt, Homo sapiens
acaaaggagagcuagcagcaggga

SEQ ID NO: 1549514 - RNA, 14 nt, Homo sapiens
acaagguauaccuc

SEQ ID NO: 1549515 - RNA, 14 nt, Homo sapiens
acaaugccaauagg

SEQ ID NO: 1549516 - RNA, 20 nt, Homo sapiens
acacaaacgggcucagcaaa

SEQ ID NO: 1549517 - RNA, 14 nt, Homo sapiens
acacaacuuugcaa

SEQ ID NO: 1549518 - RNA, 20 nt, Homo sapiens
acacaguccaacucuuccac

SEQ ID NO: 1549519 - RNA, 21 nt, Homo sapiens
acacaugugcugauguuuaca

SEQ ID NO: 1549520 - RNA, 20 nt, Homo sapiens
acacauucuuaacacauguc

SEQ ID NO: 1549521 - RNA, 13 nt, Homo sapiens
acacauugcugau

SEQ ID NO: 1549522 - RNA, 20 nt, Homo sapiens
acaccucccccugcugcugc

SEQ ID NO: 1549523 - RNA, 22 nt, Homo sapiens
acacuaagcgaauguguacaaa

SEQ ID NO: 1549524 - RNA, 18 nt, Homo sapiens
acacucgccuacuaagua

SEQ ID NO: 1549525 - RNA, 17 nt, Homo sapiens
acacucucuugggccag

SEQ ID NO: 1549526 - RNA, 22 nt, Homo sapiens
acacuuuaaaaccaguuaccca

SEQ ID NO: 1549527 - RNA, 23 nt, Homo sapiens
acagacaccaucuuuugugagau

SEQ ID NO: 1549528 - RNA, 16 nt, Homo sapiens
acagacacuguugcaa

SEQ ID NO: 1549529 - RNA, 17 nt, Homo sapiens
acagacacuguugcaaa

SEQ ID NO: 1549530 - RNA, 18 nt, Homo sapiens
acagcaggaugcccuguu

SEQ ID NO: 1549531 - RNA, 22 nt, Homo sapiens
acagcucuccuccuccaucuca

SEQ ID NO: 1549532 - RNA, 15 nt, Homo sapiens
acaggaaaccacuua

SEQ ID NO: 1549533 - RNA, 14 nt, Homo sapiens
acaggcagcucuga

SEQ ID NO: 1549534 - RNA, 17 nt, Homo sapiens
acaggcagcucugagcc

SEQ ID NO: 1549535 - RNA, 18 nt, Homo sapiens
acagggaaauguguaucu

SEQ ID NO: 1549536 - RNA, 14 nt, Homo sapiens
acagucucuugucc

SEQ ID NO: 1549537 - RNA, 17 nt, Homo sapiens
acagugguacucugugu

SEQ ID NO: 1549538 - RNA, 20 nt, Homo sapiens
acaguuuauuuucuguguaa

SEQ ID NO: 1549539 - RNA, 14 nt, Homo sapiens
acauaaguuccuau

SEQ ID NO: 1549540 - RNA, 22 nt, Homo sapiens
acauagcucaaucacacuggaa

SEQ ID NO: 1549541 - RNA, 15 nt, Homo sapiens
acaucugucuuucau

SEQ ID NO: 1549542 - RNA, 17 nt, Homo sapiens
acauggccaauagucau

SEQ ID NO: 1549543 - RNA, 15 nt, Homo sapiens
acauuauacauuuga

SEQ ID NO: 1549544 - RNA, 13 nt, Homo sapiens
acauugcugauau

SEQ ID NO: 1549545 - RNA, 15 nt, Homo sapiens
accaccaccaucacc

SEQ ID NO: 1549546 - RNA, 12 nt, Homo sapiens
aggauuaaugaa

SEQ ID NO: 1549547 - RNA, 20 nt, Homo sapiens
aggcaggaggaucacuugag

SEQ ID NO: 1549548 - RNA, 14 nt, Homo sapiens
aggcuacucugccc

SEQ ID NO: 1549549 - RNA, 16 nt, Homo sapiens
aggcucagaggagcca

SEQ ID NO: 1549550 - RNA, 20 nt, Homo sapiens
agggcaugauuaacaaagca

SEQ ID NO: 1549551 - RNA, 17 nt, Homo sapiens
aggggagggguugccac

SEQ ID NO: 1549552 - RNA, 20 nt, Homo sapiens
agggugggguacuggaguua

SEQ ID NO: 1549553 - RNA, 12 nt, Homo sapiens
agguaggggaag

SEQ ID NO: 1549554 - RNA, 15 nt, Homo sapiens
aggucccuguauguc

SEQ ID NO: 1549555 - RNA, 12 nt, Homo sapiens
aggucucugugg

SEQ ID NO: 1549556 - RNA, 22 nt, Homo sapiens
agguggcccggaagaaccagaa

SEQ ID NO: 1549557 - RNA, 20 nt, Homo sapiens
aggugggaggaucucuugag

SEQ ID NO: 1549558 - RNA, 20 nt, Homo sapiens
aggugggaggauugcuugag

SEQ ID NO: 1549559 - RNA, 15 nt, Homo sapiens
agguguguugaauug

SEQ ID NO: 1549560 - RNA, 14 nt, Homo sapiens
agguuggcaaaaag

SEQ ID NO: 1549561 - RNA, 19 nt, Homo sapiens
aguaacaggaaaccacuua

SEQ ID NO: 1549562 - RNA, 15 nt, Homo sapiens
aguaauuaugcacua

SEQ ID NO: 1549563 - RNA, 21 nt, Homo sapiens
aguagccucugggaucugcca

SEQ ID NO: 1549564 - RNA, 16 nt, Homo sapiens
aguaggacuuuccuaa

SEQ ID NO: 1549565 - RNA, 21 nt, Homo sapiens
agucacuuaacuuacaugacu

SEQ ID NO: 1549566 - RNA, 21 nt, Homo sapiens
agucagacugacacuacuaaa

SEQ ID NO: 1549567 - RNA, 19 nt, Homo sapiens
agucaguggcuuugcauag

SEQ ID NO: 1549568 - RNA, 16 nt, Homo sapiens
agucccuauaguauau

SEQ ID NO: 1549569 - RNA, 16 nt, Homo sapiens
agucuccuagacacuc

SEQ ID NO: 1549570 - RNA, 12 nt, Homo sapiens
agucugucacac

SEQ ID NO: 1549571 - RNA, 12 nt, Homo sapiens
agugacauuugu

SEQ ID NO: 1549572 - RNA, 23 nt, Homo sapiens
agugagaacuaggugugcaagaa

SEQ ID NO: 1549573 - RNA, 23 nt, Homo sapiens
agugagaguuccucuuugcccug

SEQ ID NO: 1549574 - RNA, 16 nt, Homo sapiens
agugcagccccucuca

SEQ ID NO: 1549575 - RNA, 15 nt, Homo sapiens
agugccauaccuucu

SEQ ID NO: 1549576 - RNA, 20 nt, Homo sapiens
agugcuguccaugcuucuca

SEQ ID NO: 1549577 - RNA, 22 nt, Homo sapiens
agugcuuguuccucucaucucc

SEQ ID NO: 1549578 - RNA, 13 nt, Homo sapiens
agugggugaauaa

SEQ ID NO: 1549579 - RNA, 15 nt, Homo sapiens
agugguacucugugu

SEQ ID NO: 1549580 - RNA, 19 nt, Homo sapiens
agugguuuuugcucuaggg

SEQ ID NO: 1549581 - RNA, 14 nt, Homo sapiens
agugucagccaugg

SEQ ID NO: 1549582 - RNA, 22 nt, Homo sapiens
agugugcugcuguucuguguac

SEQ ID NO: 1549583 - RNA, 13 nt, Homo sapiens
aguguugacauag

SEQ ID NO: 1549584 - RNA, 15 nt, Homo sapiens
aguguugacauagcc

SEQ ID NO: 1549585 - RNA, 18 nt, Homo sapiens
aguguugacauagccuuu

SEQ ID NO: 1549586 - RNA, 14 nt, Homo sapiens
aguugauucagcuc

SEQ ID NO: 1549587 - RNA, 17 nt, Homo sapiens
aguuggcccuucugccc

SEQ ID NO: 1549588 - RNA, 23 nt, Homo sapiens
aguuuaaggguggaaaaaugccc

SEQ ID NO: 1549589 - RNA, 15 nt, Homo sapiens
aguuucccuggugcc

SEQ ID NO: 1549590 - RNA, 17 nt, Homo sapiens
aguuuguagguaaaaug

SEQ ID NO: 1549591 - RNA, 23 nt, Homo sapiens
aguuuguguguauuuguauuaau

SEQ ID NO: 1549592 - RNA, 14 nt, Homo sapiens
aguuuuucucucaa

SEQ ID NO: 1549593 - RNA, 17 nt, Homo sapiens
auaaaaccccaucucua

SEQ ID NO: 1549594 - RNA, 14 nt, Homo sapiens
auaaaacucuccuu

SEQ ID NO: 1549595 - RNA, 23 nt, Homo sapiens
auaaaauugcaguuucauguaug

SEQ ID NO: 1549596 - RNA, 17 nt, Homo sapiens
auaacuuugaagccaua

SEQ ID NO: 1549597 - RNA, 20 nt, Homo sapiens
auaacuuuguuuagcccaaa

SEQ ID NO: 1549598 - RNA, 14 nt, Homo sapiens
auaagaucacugaa

SEQ ID NO: 1549599 - RNA, 16 nt, Homo sapiens
auaauacaguaucuca

SEQ ID NO: 1549600 - RNA, 19 nt, Homo sapiens
auaauuauuucagauuccu

SEQ ID NO: 1549601 - RNA, 22 nt, Homo sapiens
auacagcccugacgcaaugaaa

SEQ ID NO: 1549602 - RNA, 13 nt, Homo sapiens
auacauacauaca

SEQ ID NO: 1549603 - RNA, 23 nt, Homo sapiens
auaccagcaggagguucugggcc

SEQ ID NO: 1549604 - RNA, 14 nt, Homo sapiens
auagaaacauacac

SEQ ID NO: 1549605 - RNA, 16 nt, Homo sapiens
auagaauuuccaauau

SEQ ID NO: 1549606 - RNA, 19 nt, Homo sapiens
auaggcauuugauuuugcc

SEQ ID NO: 1549607 - RNA, 21 nt, Homo sapiens
auagggcaugauuaacaaagc

SEQ ID NO: 1549608 - RNA, 18 nt, Homo sapiens
auauaagaaugagccugu

SEQ ID NO: 1549609 - RNA, 23 nt, Homo sapiens
auauacugcagcuuuacugccuu

SEQ ID NO: 1549610 - RNA, 17 nt, Homo sapiens
auaucaaaaaguauuaa

SEQ ID NO: 1549611 - RNA, 22 nt, Homo sapiens
auaugcagaacguauuuagcca

SEQ ID NO: 1549612 - RNA, 17 nt, Homo sapiens
aacccagcaguucucug

SEQ ID NO: 1549613 - RNA, 20 nt, Homo sapiens
aacccagcaguucucugcca

SEQ ID NO: 1549614 - RNA, 16 nt, Homo sapiens
aaccccaucucuacaa

SEQ ID NO: 1549615 - RNA, 19 nt, Homo sapiens
aacccggugcaucuggcac

SEQ ID NO: 1549616 - RNA, 16 nt, Homo sapiens
aacccuccacuucucc

SEQ ID NO: 1549617 - RNA, 21 nt, Homo sapiens
aaccucgcucgaugacuguga

SEQ ID NO: 1549618 - RNA, 18 nt, Homo sapiens
aaccuggaguauaauauu

SEQ ID NO: 1549619 - RNA, 20 nt, Homo sapiens
aaccuggguaacuagggaag

SEQ ID NO: 1549620 - RNA, 23 nt, Homo sapiens
aacgcuacggggaaaaugcauuu

SEQ ID NO: 1549621 - RNA, 14 nt, Homo sapiens
aacuacaucugccu

SEQ ID NO: 1549622 - RNA, 20 nt, Homo sapiens
aacucaaacucuuaaaaccc

SEQ ID NO: 1549623 - RNA, 13 nt, Homo sapiens
aacugauacaucu

SEQ ID NO: 1549624 - RNA, 14 nt, Homo sapiens
aacugcuuugugca

SEQ ID NO: 1549625 - RNA, 14 nt, Homo sapiens
aacuucuacauuca

SEQ ID NO: 1549626 - RNA, 20 nt, Homo sapiens
aacuucucgcaacugaagga

SEQ ID NO: 1549627 - RNA, 16 nt, Homo sapiens
aagaaaauggaugaca

SEQ ID NO: 1549628 - RNA, 22 nt, Homo sapiens
aagaaaccuucagauuuguguu

SEQ ID NO: 1549629 - RNA, 15 nt, Homo sapiens
aagaagcucucuccu

SEQ ID NO: 1549630 - RNA, 13 nt, Homo sapiens
aagacaucugccu

SEQ ID NO: 1549631 - RNA, 21 nt, Homo sapiens
aagacucauucccuagaucuu

SEQ ID NO: 1549632 - RNA, 17 nt, Homo sapiens
aagacuuaccugaauaa

SEQ ID NO: 1549633 - RNA, 11 nt, Homo sapiens
aagaugcccuc

SEQ ID NO: 1549634 - RNA, 15 nt, Homo sapiens
aagccgugauuuuca

SEQ ID NO: 1549635 - RNA, 21 nt, Homo sapiens
aagccugcccuugucugagau

SEQ ID NO: 1549636 - RNA, 21 nt, Homo sapiens
aagccugccgaaaacaggagc

SEQ ID NO: 1549637 - RNA, 22 nt, Homo sapiens
aagcgcuguugcccgcccucca

SEQ ID NO: 1549638 - RNA, 20 nt, Homo sapiens
aagcucccacacccaccucu

SEQ ID NO: 1549639 - RNA, 16 nt, Homo sapiens
aagcuuuaucuuugug

SEQ ID NO: 1549640 - RNA, 22 nt, Homo sapiens
aaggaaaaccaucucugugauu

SEQ ID NO: 1549641 - RNA, 20 nt, Homo sapiens
aaggagugcgugccugcuac

SEQ ID NO: 1549642 - RNA, 20 nt, Homo sapiens
aaggaucaccccagccccca

SEQ ID NO: 1549643 - RNA, 23 nt, Homo sapiens
aaggauuauauguauuaauacuu

SEQ ID NO: 1549644 - RNA, 18 nt, Homo sapiens
aaggcucaaggcugugca

SEQ ID NO: 1549645 - RNA, 15 nt, Homo sapiens
aagggagaaaugcca

SEQ ID NO: 1549646 - RNA, 13 nt, Homo sapiens
aagucuccaguca

SEQ ID NO: 1549647 - RNA, 19 nt, Homo sapiens
aagugagacccugucucaa

SEQ ID NO: 1549648 - RNA, 20 nt, Homo sapiens
aagugagacccugucucaaa

SEQ ID NO: 1549649 - RNA, 15 nt, Homo sapiens
aagugucaccuccuu

SEQ ID NO: 1549650 - RNA, 13 nt, Homo sapiens
aaguguucagugu

SEQ ID NO: 1549651 - RNA, 18 nt, Homo sapiens
aaguguucaguguugaca

SEQ ID NO: 1549652 - RNA, 22 nt, Homo sapiens
aaguguucaguguugacauagc

SEQ ID NO: 1549653 - RNA, 17 nt, Homo sapiens
aaguuccuauaccuuac

SEQ ID NO: 1549654 - RNA, 13 nt, Homo sapiens
aauaaagcauucu

SEQ ID NO: 1549655 - RNA, 15 nt, Homo sapiens
aauaaauuucgcaau

SEQ ID NO: 1549656 - RNA, 15 nt, Homo sapiens
aauaagcccaacaga

SEQ ID NO: 1549657 - RNA, 20 nt, Homo sapiens
accauuccuggaaaccacag

SEQ ID NO: 1549658 - RNA, 13 nt, Homo sapiens
acccaacuugcca

SEQ ID NO: 1549659 - RNA, 23 nt, Homo sapiens
acccacgugacaccaccgaauau

SEQ ID NO: 1549660 - RNA, 14 nt, Homo sapiens
acccagcaguucuc

SEQ ID NO: 1549661 - RNA, 20 nt, Homo sapiens
accccagcccccacagcccu

SEQ ID NO: 1549662 - RNA, 22 nt, Homo sapiens
accccagugcuuguuccucuca

SEQ ID NO: 1549663 - RNA, 15 nt, Homo sapiens
acccccuccacaaag

SEQ ID NO: 1549664 - RNA, 15 nt, Homo sapiens
acccccuuuucccuu

SEQ ID NO: 1549665 - RNA, 19 nt, Homo sapiens
acccucuuagaaaaaccac

SEQ ID NO: 1549666 - RNA, 15 nt, Homo sapiens
acccuggaaauggac

SEQ ID NO: 1549667 - RNA, 15 nt, Homo sapiens
accucaaaucacugc

SEQ ID NO: 1549668 - RNA, 21 nt, Homo sapiens
accucaguuccacgguugcua

SEQ ID NO: 1549669 - RNA, 22 nt, Homo sapiens
accuggaugaucacuaauacua

SEQ ID NO: 1549670 - RNA, 21 nt, Homo sapiens
accuucagauuuguguuauaa

SEQ ID NO: 1549671 - RNA, 16 nt, Homo sapiens
acgaugugacugccau

SEQ ID NO: 1549672 - RNA, 20 nt, Homo sapiens
acgccguccagauucuccuu

SEQ ID NO: 1549673 - RNA, 22 nt, Homo sapiens
acgcuguaauauggcuguauca

SEQ ID NO: 1549674 - RNA, 17 nt, Homo sapiens
acggacacucaaaagcu

SEQ ID NO: 1549675 - RNA, 20 nt, Homo sapiens
acgggauggagacacggggc

SEQ ID NO: 1549676 - RNA, 23 nt, Homo sapiens
acgguuucuccccggacacucgc

SEQ ID NO: 1549677 - RNA, 14 nt, Homo sapiens
acgugccauugucu

SEQ ID NO: 1549678 - RNA, 21 nt, Homo sapiens
acguggccaggagccaugaca

SEQ ID NO: 1549679 - RNA, 20 nt, Homo sapiens
acuaaagcucccagcuccuu

SEQ ID NO: 1549680 - RNA, 24 nt, Homo sapiens
acuaaaugcucauacacaguuaaa

SEQ ID NO: 1549681 - RNA, 15 nt, Homo sapiens
acuacuccugaggau

SEQ ID NO: 1549682 - RNA, 14 nt, Homo sapiens
acuauguguucaau

SEQ ID NO: 1549683 - RNA, 11 nt, Homo sapiens
acucagcagug

SEQ ID NO: 1549684 - RNA, 17 nt, Homo sapiens
acuccacuggucugucu

SEQ ID NO: 1549685 - RNA, 18 nt, Homo sapiens
acucucuauaaguguuca

SEQ ID NO: 1549686 - RNA, 21 nt, Homo sapiens
acucugaacuggagcugcuaa

SEQ ID NO: 1549687 - RNA, 22 nt, Homo sapiens
acugcauaaccuuuacacuccu

SEQ ID NO: 1549688 - RNA, 15 nt, Homo sapiens
acugccaugccagcu

SEQ ID NO: 1549689 - RNA, 17 nt, Homo sapiens
acugccgugacaucauu

SEQ ID NO: 1549690 - RNA, 17 nt, Homo sapiens
acuggaguuagaucucu

SEQ ID NO: 1549691 - RNA, 20 nt, Homo sapiens
acugugaacugggcauuuca

SEQ ID NO: 1549692 - RNA, 17 nt, Homo sapiens
acuguuguacaagcuca

SEQ ID NO: 1549693 - RNA, 14 nt, Homo sapiens
acuuagaaugccau

SEQ ID NO: 1549694 - RNA, 19 nt, Homo sapiens
acuuagacacuuuaccucu

SEQ ID NO: 1549695 - RNA, 15 nt, Homo sapiens
acuuagacuccucuu

SEQ ID NO: 1549696 - RNA, 14 nt, Homo sapiens
acuuaucacaugga

SEQ ID NO: 1549697 - RNA, 20 nt, Homo sapiens
acuucgcgcaccuucucacc

SEQ ID NO: 1549698 - RNA, 14 nt, Homo sapiens
acuucuacauucaa

SEQ ID NO: 1549699 - RNA, 19 nt, Homo sapiens
acuugaaaagaaaaccaca

SEQ ID NO: 1549700 - RNA, 13 nt, Homo sapiens
acuugcacuguua

SEQ ID NO: 1549701 - RNA, 11 nt, Homo sapiens
acuugugcacu

SEQ ID NO: 1549702 - RNA, 16 nt, Homo sapiens
ugccagcuuaucucag

SEQ ID NO: 1549703 - RNA, 20 nt, Homo sapiens
ugccagcuuaucucaggggu

SEQ ID NO: 1549704 - RNA, 13 nt, Homo sapiens
ugcccuuacccca

SEQ ID NO: 1549705 - RNA, 21 nt, Homo sapiens
ugcccuuggagcugccgugcc

SEQ ID NO: 1549706 - RNA, 16 nt, Homo sapiens
ugcccuugucugagau

SEQ ID NO: 1549707 - RNA, 19 nt, Homo sapiens
ugccgaaaacaggagcaaa

SEQ ID NO: 1549708 - RNA, 19 nt, Homo sapiens
ugccugguuuuauuuauau

SEQ ID NO: 1549709 - RNA, 13 nt, Homo sapiens
ugccuuacuguac

SEQ ID NO: 1549710 - RNA, 14 nt, Homo sapiens
ugcuaagcuaaaga

SEQ ID NO: 1549711 - RNA, 17 nt, Homo sapiens
ugcuaccugcaccucug

SEQ ID NO: 1549712 - RNA, 13 nt, Homo sapiens
ugcucauguauau

SEQ ID NO: 1549713 - RNA, 16 nt, Homo sapiens
ugcuccaggcaucacu

SEQ ID NO: 1549714 - RNA, 20 nt, Homo sapiens
ugcucgcuacacuacuccug

SEQ ID NO: 1549715 - RNA, 13 nt, Homo sapiens
ugcugcaagucau

SEQ ID NO: 1549716 - RNA, 17 nt, Homo sapiens
ugcugggugccaggugc

SEQ ID NO: 1549717 - RNA, 17 nt, Homo sapiens
ugcuguccaugcuucuc

SEQ ID NO: 1549718 - RNA, 15 nt, Homo sapiens
ugcuguccgugcuug

SEQ ID NO: 1549719 - RNA, 15 nt, Homo sapiens
ugcuucagaguuugu

SEQ ID NO: 1549720 - RNA, 16 nt, Homo sapiens
ugcuucuccccagaau

SEQ ID NO: 1549721 - RNA, 16 nt, Homo sapiens
ugcuugagcucaggag

SEQ ID NO: 1549722 - RNA, 11 nt, Homo sapiens
uggaagccugc

SEQ ID NO: 1549723 - RNA, 14 nt, Homo sapiens
uggacagacacugu

SEQ ID NO: 1549724 - RNA, 17 nt, Homo sapiens
uggacagacacuguugc

SEQ ID NO: 1549725 - RNA, 18 nt, Homo sapiens
uggacagacacuguugca

SEQ ID NO: 1549726 - RNA, 16 nt, Homo sapiens
uggacuacauccugag

SEQ ID NO: 1549727 - RNA, 16 nt, Homo sapiens
uggaggccuaccucuc

SEQ ID NO: 1549728 - RNA, 16 nt, Homo sapiens
uggaguauaauauuca

SEQ ID NO: 1549729 - RNA, 17 nt, Homo sapiens
uggauucauucucauaa

SEQ ID NO: 1549730 - RNA, 23 nt, Homo sapiens
uggcaacaucagcuuucuaaugu

SEQ ID NO: 1549731 - RNA, 23 nt, Homo sapiens
uggcauagagaauacacauauaa

SEQ ID NO: 1549732 - RNA, 17 nt, Homo sapiens
ugggacagggcaaacaa

SEQ ID NO: 1549733 - RNA, 16 nt, Homo sapiens
ugggacaguggaugcc

SEQ ID NO: 1549734 - RNA, 23 nt, Homo sapiens
uggggaaggagaaggagugccau

SEQ ID NO: 1549735 - RNA, 17 nt, Homo sapiens
uggggcaggcugcuuca

SEQ ID NO: 1549736 - RNA, 21 nt, Homo sapiens
uggggcucagccacagccuga

SEQ ID NO: 1549737 - RNA, 18 nt, Homo sapiens
uggguauguguugccaaa

SEQ ID NO: 1549738 - RNA, 20 nt, Homo sapiens
ugggugacagagcaagugag

SEQ ID NO: 1549739 - RNA, 23 nt, Homo sapiens
uggguugcaggaccucaggugag

SEQ ID NO: 1549740 - RNA, 23 nt, Homo sapiens
uggucauccgggaggacaaccag

SEQ ID NO: 1549741 - RNA, 20 nt, Homo sapiens
uggucguuuucaacagaauu

SEQ ID NO: 1549742 - RNA, 12 nt, Homo sapiens
uggugcccuucc

SEQ ID NO: 1549743 - RNA, 12 nt, Homo sapiens
ugguuaaaguau

SEQ ID NO: 1549744 - RNA, 14 nt, Homo sapiens
uguaacagugcaag

SEQ ID NO: 1549745 - RNA, 15 nt, Homo sapiens
uguaagacucauucc

SEQ ID NO: 1549746 - RNA, 15 nt, Homo sapiens
uguagaaauguuuca

SEQ ID NO: 1549747 - RNA, 16 nt, Homo sapiens
uguauauauauucuca

SEQ ID NO: 1549748 - RNA, 19 nt, Homo sapiens
uguauuaauaaagcauucu

SEQ ID NO: 1549749 - RNA, 18 nt, Homo sapiens
ugucaaaauuguuuacca

SEQ ID NO: 1549750 - RNA, 16 nt, Homo sapiens
ugucagaagacacuaa

SEQ ID NO: 1549751 - RNA, 19 nt, Homo sapiens
ugucauuucauuccauugc

SEQ ID NO: 1549752 - RNA, 22 nt, Homo sapiens
uguccccggcggggugccugcu

SEQ ID NO: 1549753 - RNA, 15 nt, Homo sapiens
ugucucugcaucuga

SEQ ID NO: 1549754 - RNA, 11 nt, Homo sapiens
ugucugagaug

SEQ ID NO: 1549755 - RNA, 17 nt, Homo sapiens
ugugaaggacaugagac

SEQ ID NO: 1549756 - RNA, 18 nt, Homo sapiens
ugugaugaacgugccuga

SEQ ID NO: 1549757 - RNA, 23 nt, Homo sapiens
ugugcacuuaguaguuuuuacaa

SEQ ID NO: 1549758 - RNA, 14 nt, Homo sapiens
ugugcagcauuaaa

SEQ ID NO: 1549759 - RNA, 22 nt, Homo sapiens
uguguauuuguauuaauaaagc

SEQ ID NO: 1549760 - RNA, 13 nt, Homo sapiens
uguguugccaaag

SEQ ID NO: 1549761 - RNA, 22 nt, Homo sapiens
uguuagccacggaaacauagaa

SEQ ID NO: 1549762 - RNA, 17 nt, Homo sapiens
uguucaguguugacaua

SEQ ID NO: 1549763 - RNA, 20 nt, Homo sapiens
uguucaguguugacauagcc

SEQ ID NO: 1549764 - RNA, 20 nt, Homo sapiens
uguuccacugcaaauaaagc

SEQ ID NO: 1549765 - RNA, 18 nt, Homo sapiens
uguuuaccuucagccaua

SEQ ID NO: 1549766 - RNA, 22 nt, Homo sapiens
uguuucccaagcuagacugugu

SEQ ID NO: 1549767 - RNA, 17 nt, Homo sapiens
uguuuccuaacugugau

SEQ ID NO: 1549768 - RNA, 19 nt, Homo sapiens
uguuugauaugaaguguua

SEQ ID NO: 1549769 - RNA, 13 nt, Homo sapiens
uguuuuuuuccaa

SEQ ID NO: 1549770 - RNA, 11 nt, Homo sapiens
uuaaaaucaca

SEQ ID NO: 1549771 - RNA, 21 nt, Homo sapiens
uuaaacaaaauuucacaguuc

SEQ ID NO: 1549772 - RNA, 14 nt, Homo sapiens
uuaaacaacagcuc

SEQ ID NO: 1549773 - RNA, 12 nt, Homo sapiens
uuaaagaaagaa

SEQ ID NO: 1549774 - RNA, 14 nt, Homo sapiens
uuaaagaaccaaaa

SEQ ID NO: 1549775 - RNA, 15 nt, Homo sapiens
uuaaaguauguccuu

SEQ ID NO: 1549776 - RNA, 17 nt, Homo sapiens
uuaaauaaacuguuuuc

SEQ ID NO: 1549777 - RNA, 24 nt, Homo sapiens
uuaaaucagccguguaaccaugga

SEQ ID NO: 1549778 - RNA, 14 nt, Homo sapiens
uuaauaaagcauuc

SEQ ID NO: 1549779 - RNA, 16 nt, Homo sapiens
uuacaagguguccuca

SEQ ID NO: 1549780 - RNA, 14 nt, Homo sapiens
uuacauaaguuccu

SEQ ID NO: 1549781 - RNA, 19 nt, Homo sapiens
uuagaaaaaccaccaccau

SEQ ID NO: 1549782 - RNA, 18 nt, Homo sapiens
uuagacacuuuaccucuu

SEQ ID NO: 1549783 - RNA, 13 nt, Homo sapiens
uuagagaauguuc

SEQ ID NO: 1549784 - RNA, 15 nt, Homo sapiens
uuagcccaaaaccaa

SEQ ID NO: 1549785 - RNA, 19 nt, Homo sapiens
uuagugguuacccaguuag

SEQ ID NO: 1549786 - RNA, 20 nt, Homo sapiens
uuauaaacaaacaaacauug

SEQ ID NO: 1549787 - RNA, 20 nt, Homo sapiens
uuauacacaacuuugcaaau

SEQ ID NO: 1549788 - RNA, 18 nt, Homo sapiens
uuauauuuugugcuauca

SEQ ID NO: 1549789 - RNA, 20 nt, Homo sapiens
uuauuuaaccugaguauagu

SEQ ID NO: 1549790 - RNA, 18 nt, Homo sapiens
uucaacaaauguggguga

SEQ ID NO: 1549791 - RNA, 22 nt, Homo sapiens
uucaacgacugccgugacauca

SEQ ID NO: 1549792 - RNA, 18 nt, Homo sapiens
uucacauaaaaccucauu

SEQ ID NO: 1549793 - RNA, 18 nt, Homo sapiens
uucacaucagaagcagua

SEQ ID NO: 1549794 - RNA, 17 nt, Homo sapiens
uucacgaacuguucaca

SEQ ID NO: 1549795 - RNA, 21 nt, Homo sapiens
uucagugucgggaauuuuccc

SEQ ID NO: 1549796 - RNA, 14 nt, Homo sapiens
uucaguguugacau

SEQ ID NO: 1549797 - RNA, 16 nt, Homo sapiens
uucauaagguaauuca

SEQ ID NO: 1549798 - RNA, 21 nt, Homo sapiens
uucauaagguaauucauggca

SEQ ID NO: 1549799 - RNA, 14 nt, Homo sapiens
uuccaugaaguuug

SEQ ID NO: 1549800 - RNA, 18 nt, Homo sapiens
uucccccaucuagccauu

SEQ ID NO: 1549801 - RNA, 16 nt, Homo sapiens
uucccccgcuaauuca

SEQ ID NO: 1549802 - RNA, 16 nt, Homo sapiens
uucccuggaggucucu

SEQ ID NO: 1549803 - RNA, 15 nt, Homo sapiens
uuccucaacaagcaa

SEQ ID NO: 1549804 - RNA, 14 nt, Homo sapiens
uuccuccuuauccu

SEQ ID NO: 1549805 - RNA, 15 nt, Homo sapiens
uuccucuuacugggg

SEQ ID NO: 1549806 - RNA, 17 nt, Homo sapiens
uuccuguccccagggga

SEQ ID NO: 1549807 - RNA, 17 nt, Homo sapiens
uuccuuaccauaccacu

SEQ ID NO: 1549808 - RNA, 12 nt, Homo sapiens
uucuauuuuccc

SEQ ID NO: 1549809 - RNA, 23 nt, Homo sapiens
uucucauaauuccuacagcacua

SEQ ID NO: 1549810 - RNA, 17 nt, Homo sapiens
uucuccccggacacucg

SEQ ID NO: 1549811 - RNA, 19 nt, Homo sapiens
uucucuucuuuauugcacu

SEQ ID NO: 1549812 - RNA, 20 nt, Homo sapiens
uucugagugaguuuuacucu

SEQ ID NO: 1549813 - RNA, 22 nt, Homo sapiens
uucuggaaucuuugagaccaag

SEQ ID NO: 1549814 - RNA, 22 nt, Homo sapiens
uucuguagcuuguucccugucu

SEQ ID NO: 1549815 - RNA, 20 nt, Homo sapiens
uucuguccgagcuuugaaaa

SEQ ID NO: 1549816 - RNA, 16 nt, Homo sapiens
uucuucccuacaguug

SEQ ID NO: 1549817 - RNA, 16 nt, Homo sapiens
uugaaaaaguguacau

SEQ ID NO: 1549818 - RNA, 13 nt, Homo sapiens
uugaaaacauaca

SEQ ID NO: 1549819 - RNA, 14 nt, Homo sapiens
uugaaaacauacac

SEQ ID NO: 1549820 - RNA, 15 nt, Homo sapiens
cagguuggugggggc

SEQ ID NO: 1549821 - RNA, 14 nt, Homo sapiens
caguagaaagagug

SEQ ID NO: 1549822 - RNA, 18 nt, Homo sapiens
caguagugagcagcaucu

SEQ ID NO: 1549823 - RNA, 19 nt, Homo sapiens
caguguuccccccauagag

SEQ ID NO: 1549824 - RNA, 17 nt, Homo sapiens
caguguugacauagccu

SEQ ID NO: 1549825 - RNA, 23 nt, Homo sapiens
caguguugacauagccuuugugc

SEQ ID NO: 1549826 - RNA, 21 nt, Homo sapiens
cauaagccuaccaauguagac

SEQ ID NO: 1549827 - RNA, 17 nt, Homo sapiens
cauagcuugauugcuca

SEQ ID NO: 1549828 - RNA, 13 nt, Homo sapiens
cauagcuuucaca

SEQ ID NO: 1549829 - RNA, 20 nt, Homo sapiens
cauaggaaaaugccaugaaa

SEQ ID NO: 1549830 - RNA, 16 nt, Homo sapiens
cauaugcagaacguau

SEQ ID NO: 1549831 - RNA, 21 nt, Homo sapiens
cauauuggugcugagugcuau

SEQ ID NO: 1549832 - RNA, 21 nt, Homo sapiens
caucaaagugggguacaguaa

SEQ ID NO: 1549833 - RNA, 17 nt, Homo sapiens
caucacugauucccucu

SEQ ID NO: 1549834 - RNA, 13 nt, Homo sapiens
caucagcacagcu

SEQ ID NO: 1549835 - RNA, 22 nt, Homo sapiens
caucccuuccuccucuccugga

SEQ ID NO: 1549836 - RNA, 17 nt, Homo sapiens
cauccugagugugauga

SEQ ID NO: 1549837 - RNA, 19 nt, Homo sapiens
caucucugugauuaccucu

SEQ ID NO: 1549838 - RNA, 14 nt, Homo sapiens
caucuuccaacuca

SEQ ID NO: 1549839 - RNA, 14 nt, Homo sapiens
caucuugugaaaug

SEQ ID NO: 1549840 - RNA, 18 nt, Homo sapiens
caugaaggacacucugca

SEQ ID NO: 1549841 - RNA, 12 nt, Homo sapiens
caugaauggaga

SEQ ID NO: 1549842 - RNA, 16 nt, Homo sapiens
caugcacucacaaaga

SEQ ID NO: 1549843 - RNA, 22 nt, Homo sapiens
caugcuucuacugugacacuua

SEQ ID NO: 1549844 - RNA, 15 nt, Homo sapiens
cauggccaauaguca

SEQ ID NO: 1549845 - RNA, 18 nt, Homo sapiens
cauguauguauauaauca

SEQ ID NO: 1549846 - RNA, 18 nt, Homo sapiens
caugugcugauguuuaca

SEQ ID NO: 1549847 - RNA, 21 nt, Homo sapiens
cauguuugucugugugcugua

SEQ ID NO: 1549848 - RNA, 15 nt, Homo sapiens
cauuacgugcauuua

SEQ ID NO: 1549849 - RNA, 17 nt, Homo sapiens
cauuccuuacuugcacu

SEQ ID NO: 1549850 - RNA, 13 nt, Homo sapiens
cauugccuagcuc

SEQ ID NO: 1549851 - RNA, 22 nt, Homo sapiens
cauuguggccgccaugagcaac

SEQ ID NO: 1549852 - RNA, 20 nt, Homo sapiens
cauuuaaagaaagaaugcau

SEQ ID NO: 1549853 - RNA, 23 nt, Homo sapiens
cauuuagcuuguuccacugcaaa

SEQ ID NO: 1549854 - RNA, 15 nt, Homo sapiens
cauuucacgaacugu

SEQ ID NO: 1549855 - RNA, 18 nt, Homo sapiens
cauuuuaagugcuucaca

SEQ ID NO: 1549856 - RNA, 21 nt, Homo sapiens
cauuuuauuagaaaggacugu

SEQ ID NO: 1549857 - RNA, 14 nt, Homo sapiens
cauuuucuucagaa

SEQ ID NO: 1549858 - RNA, 18 nt, Homo sapiens
ccaaaaaagaugccaaca

SEQ ID NO: 1549859 - RNA, 13 nt, Homo sapiens
ccaaaauaaucua

SEQ ID NO: 1549860 - RNA, 13 nt, Homo sapiens
ccaaauauaacca

SEQ ID NO: 1549861 - RNA, 23 nt, Homo sapiens
ccaaauuagggcaauuggaacaa

SEQ ID NO: 1549862 - RNA, 15 nt, Homo sapiens
ccaaauuuaauuaaa

SEQ ID NO: 1549863 - RNA, 14 nt, Homo sapiens
ccaacccagcaguu

SEQ ID NO: 1549864 - RNA, 18 nt, Homo sapiens
ccaacccagcaguucucu

SEQ ID NO: 1549865 - RNA, 17 nt, Homo sapiens
ccaacuugccaaaaugu

SEQ ID NO: 1549866 - RNA, 14 nt, Homo sapiens
ccaagccacauuca

SEQ ID NO: 1549867 - RNA, 21 nt, Homo sapiens
ccaauauuuaccagaccacaa

SEQ ID NO: 1549868 - RNA, 16 nt, Homo sapiens
ccacaaccgaccagau

SEQ ID NO: 1549869 - RNA, 23 nt, Homo sapiens
ccacauaggaaaaugccaugaaa

SEQ ID NO: 1549870 - RNA, 11 nt, Homo sapiens
ccacccaguuc

SEQ ID NO: 1549871 - RNA, 20 nt, Homo sapiens
ccacgacuguuguacaagcu

SEQ ID NO: 1549872 - RNA, 19 nt, Homo sapiens
ccacugugaagagaaccau

SEQ ID NO: 1549873 - RNA, 13 nt, Homo sapiens
ccagaugccaggg

SEQ ID NO: 1549874 - RNA, 12 nt, Homo sapiens
ccagcaccucau

SEQ ID NO: 1549875 - RNA, 18 nt, Homo sapiens
ccagcaguucucugccaa

SEQ ID NO: 1549876 - RNA, 22 nt, Homo sapiens
ccagcccggggcaggugcagcc

SEQ ID NO: 1549877 - RNA, 19 nt, Homo sapiens
ccagcccuugagucuguca

SEQ ID NO: 1549878 - RNA, 20 nt, Homo sapiens
ccagcuccuuucaugcucca

SEQ ID NO: 1549879 - RNA, 21 nt, Homo sapiens
ccagcugggaccuaaugcugg

SEQ ID NO: 1549880 - RNA, 14 nt, Homo sapiens
ccagcuuaucucag

SEQ ID NO: 1549881 - RNA, 14 nt, Homo sapiens
ccagcuuugcccaa

SEQ ID NO: 1549882 - RNA, 15 nt, Homo sapiens
ccagcuuugcccaac

SEQ ID NO: 1549883 - RNA, 23 nt, Homo sapiens
ccaggcugguauuuaucugcaag

SEQ ID NO: 1549884 - RNA, 13 nt, Homo sapiens
ccaguauaaucuc

SEQ ID NO: 1549885 - RNA, 21 nt, Homo sapiens
ccagugcuaagcugcccugag

SEQ ID NO: 1549886 - RNA, 20 nt, Homo sapiens
ccagugcuguccaugcuucu

SEQ ID NO: 1549887 - RNA, 22 nt, Homo sapiens
ccaguuggcccuucugcccuua

SEQ ID NO: 1549888 - RNA, 14 nt, Homo sapiens
ccaucaccagacag

SEQ ID NO: 1549889 - RNA, 21 nt, Homo sapiens
ccaucccguaagaccaccuuc

SEQ ID NO: 1549890 - RNA, 14 nt, Homo sapiens
ccaucuagccauuu

SEQ ID NO: 1549891 - RNA, 19 nt, Homo sapiens
ccaucucuacaaaaagcau

SEQ ID NO: 1549892 - RNA, 22 nt, Homo sapiens
ccaucucugugauuaccucuca

SEQ ID NO: 1549893 - RNA, 13 nt, Homo sapiens
ccauugucuuucc

SEQ ID NO: 1549894 - RNA, 16 nt, Homo sapiens
cccaaauggcugcuuu

SEQ ID NO: 1549895 - RNA, 17 nt, Homo sapiens
cccaaauggcugcuuug

SEQ ID NO: 1549896 - RNA, 14 nt, Homo sapiens
cccaauccaugcuu

SEQ ID NO: 1549897 - RNA, 21 nt, Homo sapiens
cccagauagcuggcugggugg

SEQ ID NO: 1549898 - RNA, 13 nt, Homo sapiens
cccaucucuacaa

SEQ ID NO: 1549899 - RNA, 19 nt, Homo sapiens
ccccaccugaccucugcaa

SEQ ID NO: 1549900 - RNA, 17 nt, Homo sapiens
ccccagaguugggaugc

SEQ ID NO: 1549901 - RNA, 17 nt, Homo sapiens
cccccgaacggcauucu

SEQ ID NO: 1549902 - RNA, 18 nt, Homo sapiens
cccccgaacggcauucuc

SEQ ID NO: 1549903 - RNA, 19 nt, Homo sapiens
cccgaauucuaugagcaug

SEQ ID NO: 1549904 - RNA, 14 nt, Homo sapiens
cccggcggggugcc

SEQ ID NO: 1549905 - RNA, 21 nt, Homo sapiens
cccucaggcuccccagugcuc

SEQ ID NO: 1549906 - RNA, 18 nt, Homo sapiens
cccucuccaaaucaagga

SEQ ID NO: 1549907 - RNA, 19 nt, Homo sapiens
cccucuccaggcauuuauu

SEQ ID NO: 1549908 - RNA, 20 nt, Homo sapiens
cccugggcagugagugccau

SEQ ID NO: 1549909 - RNA, 18 nt, Homo sapiens
cccugucucugcaucuga

SEQ ID NO: 1549910 - RNA, 17 nt, Homo sapiens
cccuuaccccacacaca

SEQ ID NO: 1549911 - RNA, 19 nt, Homo sapiens
ccgcacugcccaggucccu

SEQ ID NO: 1549912 - RNA, 18 nt, Homo sapiens
ccgcagugggaagugaau

SEQ ID NO: 1549913 - RNA, 12 nt, Homo sapiens
ccgcugccccug

SEQ ID NO: 1549914 - RNA, 20 nt, Homo sapiens
ccggggcaggugcagcccuu

SEQ ID NO: 1549915 - RNA, 13 nt, Homo sapiens
ccuaauacaacau

SEQ ID NO: 1549916 - RNA, 11 nt, Homo sapiens
ccuaccucucg

SEQ ID NO: 1549917 - RNA, 20 nt, Homo sapiens
ccuagcacuuugggaggcca

SEQ ID NO: 1549918 - RNA, 16 nt, Homo sapiens
ccuagccccacccaga

SEQ ID NO: 1549919 - RNA, 15 nt, Homo sapiens
ccuaggcauuugcug

SEQ ID NO: 1549920 - RNA, 20 nt, Homo sapiens
ccucaaaucacugcauucau

SEQ ID NO: 1549921 - RNA, 13 nt, Homo sapiens
ccucaacaagcaa

SEQ ID NO: 1549922 - RNA, 19 nt, Homo sapiens
ccucaacaagcaagaucug

SEQ ID NO: 1549923 - RNA, 15 nt, Homo sapiens
ccuccaggcugaggg

SEQ ID NO: 1549924 - RNA, 14 nt, Homo sapiens
ccuccccaaauggc

SEQ ID NO: 1549925 - RNA, 23 nt, Homo sapiens
ccucccuccugauguuuuuccca

SEQ ID NO: 1549926 - RNA, 23 nt, Homo sapiens
ccuccuccagccgccaugcuccu

SEQ ID NO: 1549927 - RNA, 12 nt, Homo sapiens
ccucucuacuuc

SEQ ID NO: 1549928 - RNA, 20 nt, Homo sapiens
ccucucuuuguucucagcuc

SEQ ID NO: 1549929 - RNA, 15 nt, Homo sapiens
ccucugggaucugcc

SEQ ID NO: 1549930 - RNA, 22 nt, Homo sapiens
ccucugucaaugaaaaaaagua

SEQ ID NO: 1549931 - RNA, 20 nt, Homo sapiens
ccugaaacgagaagugcccu

SEQ ID NO: 1549932 - RNA, 15 nt, Homo sapiens
ccugaaagacaguau

SEQ ID NO: 1549933 - RNA, 22 nt, Homo sapiens
ccugacugguugucagaaugga

SEQ ID NO: 1549934 - RNA, 15 nt, Homo sapiens
ccugacuucuggaau

SEQ ID NO: 1549935 - RNA, 21 nt, Homo sapiens
ccugcugggugccaggugcug

SEQ ID NO: 1549936 - RNA, 12 nt, Homo sapiens
ccuggcaagaau

SEQ ID NO: 1549937 - RNA, 20 nt, Homo sapiens
ccuggcccacugcaucguuu

SEQ ID NO: 1549938 - RNA, 23 nt, Homo sapiens
uauaguauuuaacgaagccuaga

SEQ ID NO: 1549939 - RNA, 19 nt, Homo sapiens
uauccaauaggcauuugau

SEQ ID NO: 1549940 - RNA, 16 nt, Homo sapiens
uauccuaguuccauuc

SEQ ID NO: 1549941 - RNA, 15 nt, Homo sapiens
uaugacaucagcaau

SEQ ID NO: 1549942 - RNA, 14 nt, Homo sapiens
uaugagcaugccaa

SEQ ID NO: 1549943 - RNA, 17 nt, Homo sapiens
uauuaauaaagcauucu

SEQ ID NO: 1549944 - RNA, 23 nt, Homo sapiens
uauuaauaaagcauucuuuaaca

SEQ ID NO: 1549945 - RNA, 21 nt, Homo sapiens
uauuagaaaggacuguaaaau

SEQ ID NO: 1549946 - RNA, 16 nt, Homo sapiens
uauucaaguaacacuu

SEQ ID NO: 1549947 - RNA, 20 nt, Homo sapiens
uauucccccaucuagccauu

SEQ ID NO: 1549948 - RNA, 14 nt, Homo sapiens
uauuuaaacaacag

SEQ ID NO: 1549949 - RNA, 13 nt, Homo sapiens
uauuuaccagacc

SEQ ID NO: 1549950 - RNA, 18 nt, Homo sapiens
uauuuauuacuugugcac

SEQ ID NO: 1549951 - RNA, 21 nt, Homo sapiens
uauuuguauuaauaaagcauu

SEQ ID NO: 1549952 - RNA, 22 nt, Homo sapiens
ucaaagugggguacaguaaaga

SEQ ID NO: 1549953 - RNA, 23 nt, Homo sapiens
ucaaauuuugaugccaagaaagu

SEQ ID NO: 1549954 - RNA, 18 nt, Homo sapiens
ucaagaaggaagauuuga

SEQ ID NO: 1549955 - RNA, 15 nt, Homo sapiens
ucaaggcugcaguga

SEQ ID NO: 1549956 - RNA, 21 nt, Homo sapiens
ucaaguuuuucucucaaauga

SEQ ID NO: 1549957 - RNA, 23 nt, Homo sapiens
ucaaugaaaaaaaguacauguau

SEQ ID NO: 1549958 - RNA, 15 nt, Homo sapiens
ucaaugcucuaacaa

SEQ ID NO: 1549959 - RNA, 14 nt, Homo sapiens
ucacagccucugaa

SEQ ID NO: 1549960 - RNA, 21 nt, Homo sapiens
ucacauuuuaagugcuucaca

SEQ ID NO: 1549961 - RNA, 23 nt, Homo sapiens
ucacauuuuaagugcuucacauu

SEQ ID NO: 1549962 - RNA, 21 nt, Homo sapiens
ucacucaugcaaacugcuuua

SEQ ID NO: 1549963 - RNA, 19 nt, Homo sapiens
ucagaagcaguauauucua

SEQ ID NO: 1549964 - RNA, 22 nt, Homo sapiens
ucagaguuuguguguauuugua

SEQ ID NO: 1549965 - RNA, 22 nt, Homo sapiens
ucagauuggaauguuacaucug

SEQ ID NO: 1549966 - RNA, 19 nt, Homo sapiens
ucagcaggccaaacauggc

SEQ ID NO: 1549967 - RNA, 15 nt, Homo sapiens
ucagcugaaccuggg

SEQ ID NO: 1549968 - RNA, 14 nt, Homo sapiens
ucaguauuuuccag

SEQ ID NO: 1549969 - RNA, 16 nt, Homo sapiens
ucaguggcuuugcaua

SEQ ID NO: 1549970 - RNA, 14 nt, Homo sapiens
ucaguguugacaua

SEQ ID NO: 1549971 - RNA, 17 nt, Homo sapiens
ucaguguugacauagcc

SEQ ID NO: 1549972 - RNA, 20 nt, Homo sapiens
ucauaauuccuacagcacua

SEQ ID NO: 1549973 - RNA, 14 nt, Homo sapiens
ucauuaucuaauga

SEQ ID NO: 1549974 - RNA, 12 nt, Homo sapiens
ucauuucauucc

SEQ ID NO: 1549975 - RNA, 16 nt, Homo sapiens
uccaaaugcccagcuu

SEQ ID NO: 1549976 - RNA, 18 nt, Homo sapiens
uccaacucuuccaccucu

SEQ ID NO: 1549977 - RNA, 17 nt, Homo sapiens
uccaauauuggagcaua

SEQ ID NO: 1549978 - RNA, 18 nt, Homo sapiens
uccacauuauacauuuga

SEQ ID NO: 1549979 - RNA, 19 nt, Homo sapiens
uccacauuauacauuugau

SEQ ID NO: 1549980 - RNA, 19 nt, Homo sapiens
uccacucccaagccacuag

SEQ ID NO: 1549981 - RNA, 21 nt, Homo sapiens
uccagaguuguuguuugccaa

SEQ ID NO: 1549982 - RNA, 22 nt, Homo sapiens
uccagcccugggacagggcaaa

SEQ ID NO: 1549983 - RNA, 21 nt, Homo sapiens
uccaguuauaagcguauuuag

SEQ ID NO: 1549984 - RNA, 15 nt, Homo sapiens
uccauaaaaggugug

SEQ ID NO: 1549985 - RNA, 18 nt, Homo sapiens
ucccaagcuagacugugu

SEQ ID NO: 1549986 - RNA, 20 nt, Homo sapiens
ucccacgacuguuguacaag

SEQ ID NO: 1549987 - RNA, 20 nt, Homo sapiens
ucccagcaccuauugaauua

SEQ ID NO: 1549988 - RNA, 17 nt, Homo sapiens
ucccagguaauuuaaau

SEQ ID NO: 1549989 - RNA, 20 nt, Homo sapiens
uccccagcucccccaggcag

SEQ ID NO: 1549990 - RNA, 14 nt, Homo sapiens
ucccccugcugcug

SEQ ID NO: 1549991 - RNA, 16 nt, Homo sapiens
ucccgccucccgccac

SEQ ID NO: 1549992 - RNA, 17 nt, Homo sapiens
ucccucugugucugcuc

SEQ ID NO: 1549993 - RNA, 19 nt, Homo sapiens
ucccucugugucugcucuc

SEQ ID NO: 1549994 - RNA, 23 nt, Homo sapiens
ucccuguaugucuaccucugacu

SEQ ID NO: 1549995 - RNA, 21 nt, Homo sapiens
uccuaagcuucaaaucagaag

SEQ ID NO: 1549996 - RNA, 23 nt, Homo sapiens
uccuacuccuggagcacuguaaa

SEQ ID NO: 1549997 - RNA, 17 nt, Homo sapiens
uccuaggucaugaagga

SEQ ID NO: 1549998 - RNA, 13 nt, Homo sapiens
uccuauaccuuac

SEQ ID NO: 1549999 - RNA, 23 nt, Homo sapiens
uccuaucacugauaguguccaaa

SEQ ID NO: 1550000 - RNA, 21 nt, Homo sapiens
uccucauuagcauuuugcuaa

SEQ ID NO: 1550001 - RNA, 17 nt, Homo sapiens
uccugauguuuuuccca

SEQ ID NO: 1550002 - RNA, 18 nt, Homo sapiens
uccuggaaacagcagugu

SEQ ID NO: 1550003 - RNA, 14 nt, Homo sapiens
uccuggagcacugu

SEQ ID NO: 1550004 - RNA, 22 nt, Homo sapiens
uccuugaacccaggccaugugg

SEQ ID NO: 1550005 - RNA, 19 nt, Homo sapiens
uccuugcaccugagccugu

SEQ ID NO: 1550006 - RNA, 22 nt, Homo sapiens
uccuuucuuuugaaaugccacg

SEQ ID NO: 1550007 - RNA, 21 nt, Homo sapiens
ucuaacagcuccauacuucuu

SEQ ID NO: 1550008 - RNA, 12 nt, Homo sapiens
ucuacugugaca

SEQ ID NO: 1550009 - RNA, 19 nt, Homo sapiens
ucuauaaguguucaguguu

SEQ ID NO: 1550010 - RNA, 21 nt, Homo sapiens
ucucaauaugcuuacaaaguc

SEQ ID NO: 1550011 - RNA, 23 nt, Homo sapiens
ucucagucaugcacucacaaaga

SEQ ID NO: 1550012 - RNA, 14 nt, Homo sapiens
ucucauaauuccua

SEQ ID NO: 1550013 - RNA, 15 nt, Homo sapiens
ucucauccauuccuc

SEQ ID NO: 1550014 - RNA, 22 nt, Homo sapiens
ucuccacacggagcuccuggca

SEQ ID NO: 1550015 - RNA, 18 nt, Homo sapiens
ucucccuccccaaauggc

SEQ ID NO: 1550016 - RNA, 23 nt, Homo sapiens
ucuccuuugaaaccugcucugua

SEQ ID NO: 1550017 - RNA, 18 nt, Homo sapiens
ucucuacuuccccagaug

SEQ ID NO: 1550018 - RNA, 15 nt, Homo sapiens
ucucugcaucugacu

SEQ ID NO: 1550019 - RNA, 17 nt, Homo sapiens
ucucuuucaauugcaga

SEQ ID NO: 1550020 - RNA, 15 nt, Homo sapiens
ucugaaccucuucaa

SEQ ID NO: 1550021 - RNA, 17 nt, Homo sapiens
ucugccuggcaacaucu

SEQ ID NO: 1550022 - RNA, 20 nt, Homo sapiens
ucuuaaugucugucagaaga

SEQ ID NO: 1550023 - RNA, 22 nt, Homo sapiens
ucuuacacaaggggcaaaugaa

SEQ ID NO: 1550024 - RNA, 14 nt, Homo sapiens
ucuuacacuacauu

SEQ ID NO: 1550025 - RNA, 23 nt, Homo sapiens
ucuuaguaaaaagcccuauguga

SEQ ID NO: 1550026 - RNA, 16 nt, Homo sapiens
ucuucuuuauugcacu

SEQ ID NO: 1550027 - RNA, 14 nt, Homo sapiens
ucuuguucugugau

SEQ ID NO: 1550028 - RNA, 19 nt, Homo sapiens
ucuuugagaccaaguucca

SEQ ID NO: 1550029 - RNA, 17 nt, Homo sapiens
ucuuugucaaugcucua

SEQ ID NO: 1550030 - RNA, 15 nt, Homo sapiens
ucuuuugaaaugcca

SEQ ID NO: 1550031 - RNA, 17 nt, Homo sapiens
ugaaaacauaaucugca

SEQ ID NO: 1550032 - RNA, 12 nt, Homo sapiens
ugaaaacugaca

SEQ ID NO: 1550033 - RNA, 18 nt, Homo sapiens
ugaaaacugacaucagau

SEQ ID NO: 1550034 - RNA, 16 nt, Homo sapiens
ugaaaguugcuuuuau

SEQ ID NO: 1550035 - RNA, 17 nt, Homo sapiens
ugaaaguugcuuuuauu

SEQ ID NO: 1550036 - RNA, 17 nt, Homo sapiens
ugaaaugcucaagaaug

SEQ ID NO: 1550037 - RNA, 15 nt, Homo sapiens
ugaaauggccaggau

SEQ ID NO: 1550038 - RNA, 17 nt, Homo sapiens
ugaacuggagcugcuaa

SEQ ID NO: 1550039 - RNA, 15 nt, Homo sapiens
ugaacugggcauuuc

SEQ ID NO: 1550040 - RNA, 13 nt, Homo sapiens
ugaaguacagucc

SEQ ID NO: 1550041 - RNA, 16 nt, Homo sapiens
ugaaguuugaacuuca

SEQ ID NO: 1550042 - RNA, 13 nt, Homo sapiens
ugaauaauacagu

SEQ ID NO: 1550043 - RNA, 21 nt, Homo sapiens
ugaauacagcauuuagcuugu

SEQ ID NO: 1550044 - RNA, 15 nt, Homo sapiens
ugaauauuacuccua

SEQ ID NO: 1550045 - RNA, 14 nt, Homo sapiens
ugacaaaagaaaau

SEQ ID NO: 1550046 - RNA, 20 nt, Homo sapiens
ugacaaaagaaaauuuucca

SEQ ID NO: 1550047 - RNA, 14 nt, Homo sapiens
ugaccucugcaaga

SEQ ID NO: 1550048 - RNA, 23 nt, Homo sapiens
ugacuucauagauuaugcuuuaa

SEQ ID NO: 1550049 - RNA, 19 nt, Homo sapiens
ugagaccucaaaucacugc

SEQ ID NO: 1550050 - RNA, 16 nt, Homo sapiens
ugagccauugauucuu

SEQ ID NO: 1550051 - RNA, 17 nt, Homo sapiens
ugagcuuucugugcaug

SEQ ID NO: 1550052 - RNA, 13 nt, Homo sapiens
ugagggacaaugc

SEQ ID NO: 1550053 - RNA, 17 nt, Homo sapiens
ugaggucccuguauguc

SEQ ID NO: 1550054 - RNA, 17 nt, Homo sapiens
ugagugccaugcuuuuu

SEQ ID NO: 1550055 - RNA, 15 nt, Homo sapiens
auaauuaguuccuca

SEQ ID NO: 1550056 - RNA, 16 nt, Homo sapiens
auacaaauucuacuuu

SEQ ID NO: 1550057 - RNA, 15 nt, Homo sapiens
auacacaacuuugca

SEQ ID NO: 1550058 - RNA, 20 nt, Homo sapiens
auacacaagagggacuguau

SEQ ID NO: 1550059 - RNA, 14 nt, Homo sapiens
auacaguaucucag

SEQ ID NO: 1550060 - RNA, 20 nt, Homo sapiens
auacaucuguggacaagaca

SEQ ID NO: 1550061 - RNA, 14 nt, Homo sapiens
auacguacauacac

SEQ ID NO: 1550062 - RNA, 15 nt, Homo sapiens
auacguacauacaca

SEQ ID NO: 1550063 - RNA, 23 nt, Homo sapiens
auagaauauacugucuugucuca

SEQ ID NO: 1550064 - RNA, 18 nt, Homo sapiens
auaggcauuugauuuugc

SEQ ID NO: 1550065 - RNA, 22 nt, Homo sapiens
auaguauuuaacgaagccuaga

SEQ ID NO: 1550066 - RNA, 22 nt, Homo sapiens
auauaagaaugagccuguccaa

SEQ ID NO: 1550067 - RNA, 22 nt, Homo sapiens
auaucaauuaauuugaaaacau

SEQ ID NO: 1550068 - RNA, 20 nt, Homo sapiens
auauucagauauaaaacagu

SEQ ID NO: 1550069 - RNA, 20 nt, Homo sapiens
auauugaaaguugcuuuuau

SEQ ID NO: 1550070 - RNA, 18 nt, Homo sapiens
auauuguguugugcagca

SEQ ID NO: 1550071 - RNA, 16 nt, Homo sapiens
auauuugucauaugcu

SEQ ID NO: 1550072 - RNA, 16 nt, Homo sapiens
aucaaaaacaaccuga

SEQ ID NO: 1550073 - RNA, 16 nt, Homo sapiens
aucacagccucugaaa

SEQ ID NO: 1550074 - RNA, 19 nt, Homo sapiens
aucacaucuaaagcuuuau

SEQ ID NO: 1550075 - RNA, 18 nt, Homo sapiens
aucacauuuuaagugcuu

SEQ ID NO: 1550076 - RNA, 21 nt, Homo sapiens
aucacugauucccucucccac

SEQ ID NO: 1550077 - RNA, 14 nt, Homo sapiens
aucagcacugccag

SEQ ID NO: 1550078 - RNA, 15 nt, Homo sapiens
aucauaguauaugau

SEQ ID NO: 1550079 - RNA, 15 nt, Homo sapiens
auccauuacgugcau

SEQ ID NO: 1550080 - RNA, 16 nt, Homo sapiens
aucccuuaccucggug

SEQ ID NO: 1550081 - RNA, 13 nt, Homo sapiens
auccgggaggaca

SEQ ID NO: 1550082 - RNA, 19 nt, Homo sapiens
auccuacaguacaaucagc

SEQ ID NO: 1550083 - RNA, 19 nt, Homo sapiens
auccugagugugaugaacg

SEQ ID NO: 1550084 - RNA, 18 nt, Homo sapiens
aucuacuuuuuguauuua

SEQ ID NO: 1550085 - RNA, 19 nt, Homo sapiens
aucuaguuucccuggugcc

SEQ ID NO: 1550086 - RNA, 15 nt, Homo sapiens
aucucacuguuuuau

SEQ ID NO: 1550087 - RNA, 19 nt, Homo sapiens
aucucugugauuaccucuc

SEQ ID NO: 1550088 - RNA, 13 nt, Homo sapiens
aucuguacuuugu

SEQ ID NO: 1550089 - RNA, 15 nt, Homo sapiens
aucuguacuuugugu

SEQ ID NO: 1550090 - RNA, 18 nt, Homo sapiens
aucuuuguuuaaaugcca

SEQ ID NO: 1550091 - RNA, 19 nt, Homo sapiens
aucuuuguuuaaaugccaa

SEQ ID NO: 1550092 - RNA, 15 nt, Homo sapiens
augaaauugucaaaa

SEQ ID NO: 1550093 - RNA, 14 nt, Homo sapiens
augaauacagcauu

SEQ ID NO: 1550094 - RNA, 11 nt, Homo sapiens
augacugugaa

SEQ ID NO: 1550095 - RNA, 21 nt, Homo sapiens
augaguuacuuagaaugccau

SEQ ID NO: 1550096 - RNA, 16 nt, Homo sapiens
augcaaacugcuuuau

SEQ ID NO: 1550097 - RNA, 14 nt, Homo sapiens
augcaacgcuguaa

SEQ ID NO: 1550098 - RNA, 17 nt, Homo sapiens
augccaagaaaguauuu

SEQ ID NO: 1550099 - RNA, 13 nt, Homo sapiens
augcccuaugugu

SEQ ID NO: 1550100 - RNA, 17 nt, Homo sapiens
auggaggccuaccucuc

SEQ ID NO: 1550101 - RNA, 19 nt, Homo sapiens
augggacucugaacuggag

SEQ ID NO: 1550102 - RNA, 15 nt, Homo sapiens
augggagagcuagaa

SEQ ID NO: 1550103 - RNA, 18 nt, Homo sapiens
augguaggucaaguaaua

SEQ ID NO: 1550104 - RNA, 15 nt, Homo sapiens
augguuuggaaaaua

SEQ ID NO: 1550105 - RNA, 20 nt, Homo sapiens
auguaaauaaauuguaauau

SEQ ID NO: 1550106 - RNA, 16 nt, Homo sapiens
auguaaucucaccuca

SEQ ID NO: 1550107 - RNA, 21 nt, Homo sapiens
auguauuuauauuuugugcua

SEQ ID NO: 1550108 - RNA, 13 nt, Homo sapiens
augucuaccucug

SEQ ID NO: 1550109 - RNA, 14 nt, Homo sapiens
augucuaccucuga

SEQ ID NO: 1550110 - RNA, 14 nt, Homo sapiens
augugaaggacaug

SEQ ID NO: 1550111 - RNA, 18 nt, Homo sapiens
augugacugccaucaucu

SEQ ID NO: 1550112 - RNA, 20 nt, Homo sapiens
auguguuuuucuccagugcu

SEQ ID NO: 1550113 - RNA, 15 nt, Homo sapiens
auguuucauacagcu

SEQ ID NO: 1550114 - RNA, 18 nt, Homo sapiens
auuaaaagugacauuugu

SEQ ID NO: 1550115 - RNA, 13 nt, Homo sapiens
auuacugccuuac

SEQ ID NO: 1550116 - RNA, 19 nt, Homo sapiens
auuaucaaugggauaugau

SEQ ID NO: 1550117 - RNA, 19 nt, Homo sapiens
auuauggguauguguugcc

SEQ ID NO: 1550118 - RNA, 20 nt, Homo sapiens
auuauguuuccuaacuguga

SEQ ID NO: 1550119 - RNA, 23 nt, Homo sapiens
auuccagaacaaaucauuauguu

SEQ ID NO: 1550120 - RNA, 15 nt, Homo sapiens
auuccaggagauugg

SEQ ID NO: 1550121 - RNA, 22 nt, Homo sapiens
auucccuaaagacuaacuugaa

SEQ ID NO: 1550122 - RNA, 22 nt, Homo sapiens
auuccuuacuugcacuguuacu

SEQ ID NO: 1550123 - RNA, 20 nt, Homo sapiens
auucuugagggacaaugcca

SEQ ID NO: 1550124 - RNA, 16 nt, Homo sapiens
auucuuucccagugag

SEQ ID NO: 1550125 - RNA, 14 nt, Homo sapiens
auugaaaauaugau

SEQ ID NO: 1550126 - RNA, 16 nt, Homo sapiens
auugagaagggacaag

SEQ ID NO: 1550127 - RNA, 12 nt, Homo sapiens
auugcauuugcu

SEQ ID NO: 1550128 - RNA, 17 nt, Homo sapiens
auugcucagagaaauau

SEQ ID NO: 1550129 - RNA, 13 nt, Homo sapiens
auuggaaauggau

SEQ ID NO: 1550130 - RNA, 14 nt, Homo sapiens
cuuuggauacacac

SEQ ID NO: 1550131 - RNA, 13 nt, Homo sapiens
cuuuguggaccaa

SEQ ID NO: 1550132 - RNA, 21 nt, Homo sapiens
cuuuguuuagcccaaaaccaa

SEQ ID NO: 1550133 - RNA, 16 nt, Homo sapiens
cuuuucauuuggaaug

SEQ ID NO: 1550134 - RNA, 18 nt, Homo sapiens
cuuuucuauggagcaaaa

SEQ ID NO: 1550135 - RNA, 19 nt, Homo sapiens
cuuuucuguacuuccugag

SEQ ID NO: 1550136 - RNA, 17 nt, Homo sapiens
cuuuugaaaaacaacug

SEQ ID NO: 1550137 - RNA, 17 nt, Homo sapiens
gaaaaaaaguacaugua

SEQ ID NO: 1550138 - RNA, 19 nt, Homo sapiens
gaaaaaccaccaccaucac

SEQ ID NO: 1550139 - RNA, 11 nt, Homo sapiens
gaaaacauaca

SEQ ID NO: 1550140 - RNA, 20 nt, Homo sapiens
gaaaagaaaccagagucaaa

SEQ ID NO: 1550141 - RNA, 18 nt, Homo sapiens
gaaaaggguuucuugaca

SEQ ID NO: 1550142 - RNA, 13 nt, Homo sapiens
gaaaaugccauga

SEQ ID NO: 1550143 - RNA, 14 nt, Homo sapiens
gaaaaugccaugaa

SEQ ID NO: 1550144 - RNA, 17 nt, Homo sapiens
gaaaaugccaugaaaau

SEQ ID NO: 1550145 - RNA, 20 nt, Homo sapiens
gaaaauuuuccacauaggaa

SEQ ID NO: 1550146 - RNA, 18 nt, Homo sapiens
gaaagacuuaugucuugg

SEQ ID NO: 1550147 - RNA, 18 nt, Homo sapiens
gaaaguauagauggccaa

SEQ ID NO: 1550148 - RNA, 16 nt, Homo sapiens
gaaaguugcuuuuauu

SEQ ID NO: 1550149 - RNA, 21 nt, Homo sapiens
gaaauaaagaaaauucucuca

SEQ ID NO: 1550150 - RNA, 18 nt, Homo sapiens
gaaauaagcccaacagac

SEQ ID NO: 1550151 - RNA, 21 nt, Homo sapiens
gaaauaaguauccaguacuuu

SEQ ID NO: 1550152 - RNA, 13 nt, Homo sapiens
gaaauaaugccuc

SEQ ID NO: 1550153 - RNA, 13 nt, Homo sapiens
gaaaugagccagc

SEQ ID NO: 1550154 - RNA, 19 nt, Homo sapiens
gaaauuauuagauugccaa

SEQ ID NO: 1550155 - RNA, 20 nt, Homo sapiens
gaacaaaucauuauguuucc

SEQ ID NO: 1550156 - RNA, 21 nt, Homo sapiens
gaacauggccaauagucauau

SEQ ID NO: 1550157 - RNA, 19 nt, Homo sapiens
gaagacacuaauuccuuaa

SEQ ID NO: 1550158 - RNA, 23 nt, Homo sapiens
gaagagccuugcggaagguucua

SEQ ID NO: 1550159 - RNA, 13 nt, Homo sapiens
gaaggacaugaga

SEQ ID NO: 1550160 - RNA, 16 nt, Homo sapiens
gaagggccgaggaaug

SEQ ID NO: 1550161 - RNA, 16 nt, Homo sapiens
gaaugugaagccagau

SEQ ID NO: 1550162 - RNA, 19 nt, Homo sapiens
gaauuagaagaaaauggau

SEQ ID NO: 1550163 - RNA, 21 nt, Homo sapiens
gacaccuuuucuauuuaccuc

SEQ ID NO: 1550164 - RNA, 16 nt, Homo sapiens
gacacuguugcaaagg

SEQ ID NO: 1550165 - RNA, 19 nt, Homo sapiens
gacagggcaaacaacugaa

SEQ ID NO: 1550166 - RNA, 13 nt, Homo sapiens
gacauagccuuug

SEQ ID NO: 1550167 - RNA, 17 nt, Homo sapiens
gaccaaccgccugcagg

SEQ ID NO: 1550168 - RNA, 22 nt, Homo sapiens
gaccagaccccaaaccagcccu

SEQ ID NO: 1550169 - RNA, 23 nt, Homo sapiens
gaccccuuucccccaccccagag

SEQ ID NO: 1550170 - RNA, 15 nt, Homo sapiens
gaccgucuuuacccc

SEQ ID NO: 1550171 - RNA, 14 nt, Homo sapiens
gaccuuccuuccac

SEQ ID NO: 1550172 - RNA, 23 nt, Homo sapiens
gaccuuuauccagcuagugccaa

SEQ ID NO: 1550173 - RNA, 16 nt, Homo sapiens
caauuauugauauaua

SEQ ID NO: 1550174 - RNA, 23 nt, Homo sapiens
cacacaugagagagagcccccac

SEQ ID NO: 1550175 - RNA, 19 nt, Homo sapiens
cacagaguuuguaguaaau

SEQ ID NO: 1550176 - RNA, 22 nt, Homo sapiens
cacagccugacacagugcucga

SEQ ID NO: 1550177 - RNA, 23 nt, Homo sapiens
cacauaaaaaugcaacgcuguaa

SEQ ID NO: 1550178 - RNA, 18 nt, Homo sapiens
cacaucagaagcaguaua

SEQ ID NO: 1550179 - RNA, 18 nt, Homo sapiens
cacaucuaaagcuuuauc

SEQ ID NO: 1550180 - RNA, 20 nt, Homo sapiens
cacaugcugagucucccaag

SEQ ID NO: 1550181 - RNA, 18 nt, Homo sapiens
cacauugcugauaugcaa

SEQ ID NO: 1550182 - RNA, 20 nt, Homo sapiens
cacauuuuaagugcuucaca

SEQ ID NO: 1550183 - RNA, 18 nt, Homo sapiens
caccaucaccagacaggu

SEQ ID NO: 1550184 - RNA, 22 nt, Homo sapiens
caccaucuuuugugagauguaa

SEQ ID NO: 1550185 - RNA, 23 nt, Homo sapiens
caccauuccuggaaaccacaguc

SEQ ID NO: 1550186 - RNA, 13 nt, Homo sapiens
caccucugcacaa

SEQ ID NO: 1550187 - RNA, 16 nt, Homo sapiens
caccugaccucugcaa

SEQ ID NO: 1550188 - RNA, 17 nt, Homo sapiens
caccugaccucugcaag

SEQ ID NO: 1550189 - RNA, 20 nt, Homo sapiens
cacgcuucaaggauauacug

SEQ ID NO: 1550190 - RNA, 21 nt, Homo sapiens
cacuacugggugucauuucau

SEQ ID NO: 1550191 - RNA, 17 nt, Homo sapiens
cacucgccuacuaagua

SEQ ID NO: 1550192 - RNA, 12 nt, Homo sapiens
cacucugcaggg

SEQ ID NO: 1550193 - RNA, 18 nt, Homo sapiens
cacuguaagacucauucc

SEQ ID NO: 1550194 - RNA, 23 nt, Homo sapiens
cacugugaagagaaccauaucaa

SEQ ID NO: 1550195 - RNA, 16 nt, Homo sapiens
cacuuagacacuuuac

SEQ ID NO: 1550196 - RNA, 22 nt, Homo sapiens
cagaagaaaagacuuaccugaa

SEQ ID NO: 1550197 - RNA, 18 nt, Homo sapiens
cagaggaaaaacagagga

SEQ ID NO: 1550198 - RNA, 12 nt, Homo sapiens
cagaguuugugu

SEQ ID NO: 1550199 - RNA, 18 nt, Homo sapiens
cagaugugaaggacauga

SEQ ID NO: 1550200 - RNA, 14 nt, Homo sapiens
cagauuuguguuau

SEQ ID NO: 1550201 - RNA, 15 nt, Homo sapiens
cagcagcaaacaaau

SEQ ID NO: 1550202 - RNA, 11 nt, Homo sapiens
cagcagcaucg

SEQ ID NO: 1550203 - RNA, 18 nt, Homo sapiens
cagccugggcaaugugau

SEQ ID NO: 1550204 - RNA, 21 nt, Homo sapiens
cagcgagaacuacgcacagcu

SEQ ID NO: 1550205 - RNA, 15 nt, Homo sapiens
cagcgauggcaguga

SEQ ID NO: 1550206 - RNA, 19 nt, Homo sapiens
cagcuagaaauaagcccaa

SEQ ID NO: 1550207 - RNA, 17 nt, Homo sapiens
cagcugauugacugugc

SEQ ID NO: 1550208 - RNA, 13 nt, Homo sapiens
cagcuuaucucag

SEQ ID NO: 1550209 - RNA, 22 nt, Homo sapiens
cagcuuaucucaggggugugcg

SEQ ID NO: 1550210 - RNA, 23 nt, Homo sapiens
cagcuuuguuuguugucagcuga

SEQ ID NO: 1550211 - RNA, 21 nt, Homo sapiens
caggagcccuacugaagggaa

SEQ ID NO: 1550212 - RNA, 15 nt, Homo sapiens
caggaucuguacaau

SEQ ID NO: 1550213 - RNA, 23 nt, Homo sapiens
caggaucuguacaauaauaauua

SEQ ID NO: 1550214 - RNA, 16 nt, Homo sapiens
caggcuccccagugcu

SEQ ID NO: 1550215 - RNA, 20 nt, Homo sapiens
caggcugguauuuaucugca

SEQ ID NO: 1550216 - RNA, 21 nt, Homo sapiens
caggcugguauuuaucugcaa

SEQ ID NO: 1550217 - RNA, 20 nt, Homo sapiens
cagguaaacacauaaaugaa

SEQ ID NO: 1550218 - RNA, 14 nt, Homo sapiens
caggucccuccuca

SEQ ID NO: 1550219 - RNA, 17 nt, Homo sapiens
caggucucugugggugg

SEQ ID NO: 1550220 - RNA, 15 nt, Homo sapiens
cagucccagcacauu

SEQ ID NO: 1550221 - RNA, 21 nt, Homo sapiens
cagugagaguuccucuuugcc

SEQ ID NO: 1550222 - RNA, 14 nt, Homo sapiens
caguggcuuugcau

SEQ ID NO: 1550223 - RNA, 20 nt, Homo sapiens
caguggucuccuucacauca

SEQ ID NO: 1550224 - RNA, 20 nt, Homo sapiens
caguguauuuuaaauucuca

SEQ ID NO: 1550225 - RNA, 16 nt, Homo sapiens
caguguugacauagcc

SEQ ID NO: 1550226 - RNA, 14 nt, Homo sapiens
caguuagcucucaa

SEQ ID NO: 1550227 - RNA, 16 nt, Homo sapiens
caguucucugccaaag

SEQ ID NO: 1550228 - RNA, 17 nt, Homo sapiens
caguuuuugacuucaua

SEQ ID NO: 1550229 - RNA, 14 nt, Homo sapiens
cauaaacaaugaug

SEQ ID NO: 1550230 - RNA, 16 nt, Homo sapiens
cauagaaagaugacaa

SEQ ID NO: 1550231 - RNA, 16 nt, Homo sapiens
cauagagaauacacau

SEQ ID NO: 1550232 - RNA, 20 nt, Homo sapiens
cauagagaauacacauauaa

SEQ ID NO: 1550233 - RNA, 22 nt, Homo sapiens
cauagaguagguacuccauaaa

SEQ ID NO: 1550234 - RNA, 13 nt, Homo sapiens
cauaucaaaaagu

SEQ ID NO: 1550235 - RNA, 16 nt, Homo sapiens
cauaugugaagacaga

SEQ ID NO: 1550236 - RNA, 15 nt, Homo sapiens
caucaaaaacaaccu

SEQ ID NO: 1550237 - RNA, 13 nt, Homo sapiens
caucucuacaaaa

SEQ ID NO: 1550238 - RNA, 12 nt, Homo sapiens
caugaaggacac

SEQ ID NO: 1550239 - RNA, 19 nt, Homo sapiens
caugaaggacacucugcag

SEQ ID NO: 1550240 - RNA, 23 nt, Homo sapiens
caugcaaacugcuuuauuuuccc

SEQ ID NO: 1550241 - RNA, 16 nt, Homo sapiens
caugccuggucuuucc

SEQ ID NO: 1550242 - RNA, 22 nt, Homo sapiens
caugcuccuggcccacugcauc

SEQ ID NO: 1550243 - RNA, 16 nt, Homo sapiens
caugcuucuacuguga

SEQ ID NO: 1550244 - RNA, 16 nt, Homo sapiens
cauggagacucugaga

SEQ ID NO: 1550245 - RNA, 15 nt, Homo sapiens
cauggcauugaacug

SEQ ID NO: 1550246 - RNA, 22 nt, Homo sapiens
caugguucauuuucugaugccc

SEQ ID NO: 1550247 - RNA, 13 nt, Homo sapiens
cauguauguggua

SEQ ID NO: 1550248 - RNA, 19 nt, Homo sapiens
cauguuggugcugccuugc

SEQ ID NO: 1550249 - RNA, 21 nt, Homo sapiens
cauuaaacucuaaagauuagg

SEQ ID NO: 1550250 - RNA, 19 nt, Homo sapiens
cauuccauugccuagcucu

SEQ ID NO: 1550251 - RNA, 17 nt, Homo sapiens
cauuccuguagucaaaa

SEQ ID NO: 1550252 - RNA, 23 nt, Homo sapiens
cauuccuguagucaaaaucuggu

SEQ ID NO: 1550253 - RNA, 15 nt, Homo sapiens
cauuccuuacuugca

SEQ ID NO: 1550254 - RNA, 18 nt, Homo sapiens
cauuccuuacuugcacug

SEQ ID NO: 1550255 - RNA, 19 nt, Homo sapiens
cauuggguuguagccaaag

SEQ ID NO: 1550256 - RNA, 19 nt, Homo sapiens
cauuuaaagaaagaaugca

SEQ ID NO: 1550257 - RNA, 22 nt, Homo sapiens
cauuuagcuuguuccacugcaa

SEQ ID NO: 1550258 - RNA, 22 nt, Homo sapiens
cauuuauagcacgucuccuuga

SEQ ID NO: 1550259 - RNA, 19 nt, Homo sapiens
cauuuauuucucuggcaaa

SEQ ID NO: 1550260 - RNA, 18 nt, Homo sapiens
cauuucacgaacuguuca

SEQ ID NO: 1550261 - RNA, 13 nt, Homo sapiens
cauuucauuccau

SEQ ID NO: 1550262 - RNA, 20 nt, Homo sapiens
cauuucugagaucaaaacgg

SEQ ID NO: 1550263 - RNA, 16 nt, Homo sapiens
ccaaaauguacuuaaa

SEQ ID NO: 1550264 - RNA, 22 nt, Homo sapiens
ccaaacauggccagacucccuu

SEQ ID NO: 1550265 - RNA, 20 nt, Homo sapiens
ccaaagugccacucauuccu

SEQ ID NO: 1550266 - RNA, 15 nt, Homo sapiens
ccaaauggcugcuuu

SEQ ID NO: 1550267 - RNA, 20 nt, Homo sapiens
ccaaauuuaauuaaagccuu

SEQ ID NO: 1550268 - RNA, 20 nt, Homo sapiens
ccaaauuuagaaagcuuaag

SEQ ID NO: 1550269 - RNA, 14 nt, Homo sapiens
ccaagccacuagcc

SEQ ID NO: 1550270 - RNA, 20 nt, Homo sapiens
ccaagcuagacugugucuga

SEQ ID NO: 1550271 - RNA, 17 nt, Homo sapiens
ccaauaggcauuugauu

SEQ ID NO: 1550272 - RNA, 13 nt, Homo sapiens
ccaauagucauau

SEQ ID NO: 1550273 - RNA, 16 nt, Homo sapiens
ccaauauuuaccagac

SEQ ID NO: 1550274 - RNA, 15 nt, Homo sapiens
ccaaugguccugacu

SEQ ID NO: 1550275 - RNA, 14 nt, Homo sapiens
ccaauucugaaaua

SEQ ID NO: 1550276 - RNA, 14 nt, Homo sapiens
ccacaaaaguuccc

SEQ ID NO: 1550277 - RNA, 23 nt, Homo sapiens
ccacauccccaccccagcuguua

SEQ ID NO: 1550278 - RNA, 13 nt, Homo sapiens
ccacccaguuccu

SEQ ID NO: 1550279 - RNA, 20 nt, Homo sapiens
ccaccuugaccguaggggaa

SEQ ID NO: 1550280 - RNA, 14 nt, Homo sapiens
ccacuccccaguug

SEQ ID NO: 1550281 - RNA, 21 nt, Homo sapiens
ccacuuagacacuuuaccucu

SEQ ID NO: 1550282 - RNA, 19 nt, Homo sapiens
ccagaaaaaaaaaaacuua

SEQ ID NO: 1550283 - RNA, 21 nt, Homo sapiens
ccagaccccaaaccagcccuu

SEQ ID NO: 1550284 - RNA, 16 nt, Homo sapiens
ccagcagcugauucca

SEQ ID NO: 1550285 - RNA, 18 nt, Homo sapiens
ccagcccaagggcaucau

SEQ ID NO: 1550286 - RNA, 17 nt, Homo sapiens
ccagcuagugccaaaua

SEQ ID NO: 1550287 - RNA, 12 nt, Homo sapiens
ccaucaccagac

SEQ ID NO: 1550288 - RNA, 23 nt, Homo sapiens
ccaugaagcuggcccucagcucc

SEQ ID NO: 1550289 - RNA, 15 nt, Homo sapiens
ccaugugugcuaaua

SEQ ID NO: 1550290 - RNA, 14 nt, Homo sapiens
gccuggacccugug

SEQ ID NO: 1550291 - RNA, 23 nt, Homo sapiens
gccuggggucugacaauaccucg

SEQ ID NO: 1550292 - RNA, 14 nt, Homo sapiens
gccuucauaagccu

SEQ ID NO: 1550293 - RNA, 20 nt, Homo sapiens
gcgaaacccggugcaucugg

SEQ ID NO: 1550294 - RNA, 13 nt, Homo sapiens
gcgaagaggaccc

SEQ ID NO: 1550295 - RNA, 15 nt, Homo sapiens
gcgauggcagugaga

SEQ ID NO: 1550296 - RNA, 22 nt, Homo sapiens
gcgcuggguauuggaaauggau

SEQ ID NO: 1550297 - RNA, 20 nt, Homo sapiens
gcggccuacagaaaaaggaa

SEQ ID NO: 1550298 - RNA, 22 nt, Homo sapiens
gcuaaagaaacugcuuacaguu

SEQ ID NO: 1550299 - RNA, 12 nt, Homo sapiens
gcuaaucugccu

SEQ ID NO: 1550300 - RNA, 20 nt, Homo sapiens
gcuaauggaauuacugccuu

SEQ ID NO: 1550301 - RNA, 17 nt, Homo sapiens
gcuacagucucuugucc

SEQ ID NO: 1550302 - RNA, 20 nt, Homo sapiens
gcuagaaauaagcccaacag

SEQ ID NO: 1550303 - RNA, 16 nt, Homo sapiens
gcuagacugugucuga

SEQ ID NO: 1550304 - RNA, 18 nt, Homo sapiens
gcuauuuuacauauccca

SEQ ID NO: 1550305 - RNA, 23 nt, Homo sapiens
gcucccacacccaccucugccac

SEQ ID NO: 1550306 - RNA, 13 nt, Homo sapiens
gcucccccugucc

SEQ ID NO: 1550307 - RNA, 19 nt, Homo sapiens
gcucgcuacacuacuccug

SEQ ID NO: 1550308 - RNA, 16 nt, Homo sapiens
gcucuagaaaguauag

SEQ ID NO: 1550309 - RNA, 21 nt, Homo sapiens
gcucuagggcccuuucuugca

SEQ ID NO: 1550310 - RNA, 21 nt, Homo sapiens
gcucugagccgcgcuuucccc

SEQ ID NO: 1550311 - RNA, 16 nt, Homo sapiens
gcugagggagaccccc

SEQ ID NO: 1550312 - RNA, 23 nt, Homo sapiens
gcugagggccucucuacuucccc

SEQ ID NO: 1550313 - RNA, 12 nt, Homo sapiens
gcugauuucccu

SEQ ID NO: 1550314 - RNA, 21 nt, Homo sapiens
gcugcaaacccaugaagcugg

SEQ ID NO: 1550315 - RNA, 17 nt, Homo sapiens
gcugcuuggagugcccc

SEQ ID NO: 1550316 - RNA, 16 nt, Homo sapiens
gcuguggacacugaga

SEQ ID NO: 1550317 - RNA, 15 nt, Homo sapiens
gcuuaaagcuugauu

SEQ ID NO: 1550318 - RNA, 20 nt, Homo sapiens
gcuuaaaggggcuagaguga

SEQ ID NO: 1550319 - RNA, 21 nt, Homo sapiens
gcuucaaggauauacugcagc

SEQ ID NO: 1550320 - RNA, 15 nt, Homo sapiens
gcuucuagccaugua

SEQ ID NO: 1550321 - RNA, 13 nt, Homo sapiens
gcuuuacugccuu

SEQ ID NO: 1550322 - RNA, 16 nt, Homo sapiens
gcuuugaaaacauaca

SEQ ID NO: 1550323 - RNA, 20 nt, Homo sapiens
gcuuuugaaaaacaacugca

SEQ ID NO: 1550324 - RNA, 13 nt, Homo sapiens
ggaaaaccaucuc

SEQ ID NO: 1550325 - RNA, 11 nt, Homo sapiens
ggaaaccacag

SEQ ID NO: 1550326 - RNA, 19 nt, Homo sapiens
ggaaauguuuguccuugca

SEQ ID NO: 1550327 - RNA, 15 nt, Homo sapiens
ggaagacaaugugaa

SEQ ID NO: 1550328 - RNA, 19 nt, Homo sapiens
ggaaggucccuuguuucca

SEQ ID NO: 1550329 - RNA, 19 nt, Homo sapiens
ggaaugaauacagcauuua

SEQ ID NO: 1550330 - RNA, 20 nt, Homo sapiens
ggacccccagcuuugcccaa

SEQ ID NO: 1550331 - RNA, 13 nt, Homo sapiens
ggagaaaugccag

SEQ ID NO: 1550332 - RNA, 16 nt, Homo sapiens
ggagacggaaucugcc

SEQ ID NO: 1550333 - RNA, 19 nt, Homo sapiens
auucuuaagggaacuucca

SEQ ID NO: 1550334 - RNA, 23 nt, Homo sapiens
auugaacgcacauagcucaauca

SEQ ID NO: 1550335 - RNA, 22 nt, Homo sapiens
auugcacuaggaauucuuugca

SEQ ID NO: 1550336 - RNA, 21 nt, Homo sapiens
auugcauaacagcagaugcca

SEQ ID NO: 1550337 - RNA, 16 nt, Homo sapiens
auugcauuugcuguug

SEQ ID NO: 1550338 - RNA, 19 nt, Homo sapiens
auugucuuguucugugaug

SEQ ID NO: 1550339 - RNA, 19 nt, Homo sapiens
auuguguugugcagcauua

SEQ ID NO: 1550340 - RNA, 14 nt, Homo sapiens
auuguuuaccauag

SEQ ID NO: 1550341 - RNA, 14 nt, Homo sapiens
auuuaaacucugcc

SEQ ID NO: 1550342 - RNA, 22 nt, Homo sapiens
auuuacugcucuagaaaguaua

SEQ ID NO: 1550343 - RNA, 17 nt, Homo sapiens
auuuaucgcaacaugaa

SEQ ID NO: 1550344 - RNA, 13 nt, Homo sapiens
auuucaaaacaca

SEQ ID NO: 1550345 - RNA, 18 nt, Homo sapiens
auuugacguuguugucau

SEQ ID NO: 1550346 - RNA, 14 nt, Homo sapiens
auuuggucagcaua

SEQ ID NO: 1550347 - RNA, 17 nt, Homo sapiens
auuuucuuuacagguau

SEQ ID NO: 1550348 - RNA, 19 nt, Homo sapiens
auuuuguuuuugucuuaaa

SEQ ID NO: 1550349 - RNA, 13 nt, Homo sapiens
caaaaaauuugag

SEQ ID NO: 1550350 - RNA, 18 nt, Homo sapiens
caaaaacuuuucauuuca

SEQ ID NO: 1550351 - RNA, 19 nt, Homo sapiens
caaaacugcuuugugcaua

SEQ ID NO: 1550352 - RNA, 17 nt, Homo sapiens
caaaagaaaauuuucca

SEQ ID NO: 1550353 - RNA, 11 nt, Homo sapiens
caaaugaaaua

SEQ ID NO: 1550354 - RNA, 19 nt, Homo sapiens
caaauuuagaaagcuuaag

SEQ ID NO: 1550355 - RNA, 22 nt, Homo sapiens
caacccagcaguucucugccaa

SEQ ID NO: 1550356 - RNA, 23 nt, Homo sapiens
caacgaugugacugccaucaucu

SEQ ID NO: 1550357 - RNA, 22 nt, Homo sapiens
caacucacccccuacacacaca

SEQ ID NO: 1550358 - RNA, 20 nt, Homo sapiens
caacugaacuugcuauggaa

SEQ ID NO: 1550359 - RNA, 13 nt, Homo sapiens
caacuuugcaaau

SEQ ID NO: 1550360 - RNA, 18 nt, Homo sapiens
caagaagaauugacugau

SEQ ID NO: 1550361 - RNA, 15 nt, Homo sapiens
caagcuaaucugccu

SEQ ID NO: 1550362 - RNA, 15 nt, Homo sapiens
caagcuagacugugu

SEQ ID NO: 1550363 - RNA, 16 nt, Homo sapiens
caaggauauacugcag

SEQ ID NO: 1550364 - RNA, 19 nt, Homo sapiens
caagugucaccuccuuccc

SEQ ID NO: 1550365 - RNA, 15 nt, Homo sapiens
caauaggcauuugau

SEQ ID NO: 1550366 - RNA, 17 nt, Homo sapiens
caauaugacacagcuug

SEQ ID NO: 1550367 - RNA, 19 nt, Homo sapiens
caauauugccugugcuucu

SEQ ID NO: 1550368 - RNA, 18 nt, Homo sapiens
caaugcuggcuuucuccc

SEQ ID NO: 1550369 - RNA, 17 nt, Homo sapiens
caauuucugcuguacau

SEQ ID NO: 1550370 - RNA, 14 nt, Homo sapiens
cacacauaguuucu

SEQ ID NO: 1550371 - RNA, 15 nt, Homo sapiens
cacaggaguccuuuc

SEQ ID NO: 1550372 - RNA, 16 nt, Homo sapiens
cacaucuaaagcuuua

SEQ ID NO: 1550373 - RNA, 16 nt, Homo sapiens
cacaugcugagucucc

SEQ ID NO: 1550374 - RNA, 20 nt, Homo sapiens
cacaugugcugauguuuaca

SEQ ID NO: 1550375 - RNA, 23 nt, Homo sapiens
cacauucuuaacacauguccuug

SEQ ID NO: 1550376 - RNA, 19 nt, Homo sapiens
cacauuuuaagugcuucac

SEQ ID NO: 1550377 - RNA, 22 nt, Homo sapiens
cacccugggcagugagugccau

SEQ ID NO: 1550378 - RNA, 14 nt, Homo sapiens
caccuauugaauua

SEQ ID NO: 1550379 - RNA, 16 nt, Homo sapiens
caccucugcacaagcu

SEQ ID NO: 1550380 - RNA, 18 nt, Homo sapiens
cacgugccauugucuuuc

SEQ ID NO: 1550381 - RNA, 22 nt, Homo sapiens
cacuacuccugaggaugcuacu

SEQ ID NO: 1550382 - RNA, 19 nt, Homo sapiens
cacuaggaauucuuugcau

SEQ ID NO: 1550383 - RNA, 21 nt, Homo sapiens
cacucacacggacacucaaaa

SEQ ID NO: 1550384 - RNA, 15 nt, Homo sapiens
cacuccccacgggaa

SEQ ID NO: 1550385 - RNA, 15 nt, Homo sapiens
cacucugcaggguga

SEQ ID NO: 1550386 - RNA, 18 nt, Homo sapiens
cacugcaagucacauaaa

SEQ ID NO: 1550387 - RNA, 18 nt, Homo sapiens
cacuggaaauguuugucc

SEQ ID NO: 1550388 - RNA, 22 nt, Homo sapiens
cacuggaaauguuuguccuugc

SEQ ID NO: 1550389 - RNA, 19 nt, Homo sapiens
cagaaaaaaauaacuauuu

SEQ ID NO: 1550390 - RNA, 15 nt, Homo sapiens
cagaaauuauuggua

SEQ ID NO: 1550391 - RNA, 20 nt, Homo sapiens
cagaacaaauuguuuacaua

SEQ ID NO: 1550392 - RNA, 17 nt, Homo sapiens
cagaacguauuuagcca

SEQ ID NO: 1550393 - RNA, 21 nt, Homo sapiens
cagaaguuugagaucagccug

SEQ ID NO: 1550394 - RNA, 22 nt, Homo sapiens
cagaauguuuuuaaaauaugag

SEQ ID NO: 1550395 - RNA, 16 nt, Homo sapiens
cagaauuuuaaagagc

SEQ ID NO: 1550396 - RNA, 19 nt, Homo sapiens
cagaccagaccccaaacca

SEQ ID NO: 1550397 - RNA, 17 nt, Homo sapiens
cagacggaaaugaaauu

SEQ ID NO: 1550398 - RNA, 16 nt, Homo sapiens
cagacuguaggauuug

SEQ ID NO: 1550399 - RNA, 18 nt, Homo sapiens
cagacuguaggauuugaa

SEQ ID NO: 1550400 - RNA, 13 nt, Homo sapiens
cagagcaagugag

SEQ ID NO: 1550401 - RNA, 20 nt, Homo sapiens
cagagcugggggcugaggga

SEQ ID NO: 1550402 - RNA, 16 nt, Homo sapiens
cagaugccaaaaaaga

SEQ ID NO: 1550403 - RNA, 11 nt, Homo sapiens
cagcaccucau

SEQ ID NO: 1550404 - RNA, 18 nt, Homo sapiens
cagccccaauccagagaa

SEQ ID NO: 1550405 - RNA, 17 nt, Homo sapiens
cagccccagcaccucau

SEQ ID NO: 1550406 - RNA, 20 nt, Homo sapiens
cagcuaccacgggucugcca

SEQ ID NO: 1550407 - RNA, 19 nt, Homo sapiens
cagcuccuuucaugcucca

SEQ ID NO: 1550408 - RNA, 11 nt, Homo sapiens
cagcucugcaa

SEQ ID NO: 1550409 - RNA, 15 nt, Homo sapiens
cagcucugcaagaau

SEQ ID NO: 1550410 - RNA, 15 nt, Homo sapiens
cagcugauuccagaa

SEQ ID NO: 1550411 - RNA, 14 nt, Homo sapiens
caggaaaccacuua

SEQ ID NO: 1550412 - RNA, 14 nt, Homo sapiens
caggacuacagcuu

SEQ ID NO: 1550413 - RNA, 12 nt, Homo sapiens
caggaugcuaau

SEQ ID NO: 1550414 - RNA, 13 nt, Homo sapiens
caggcuacucugc

SEQ ID NO: 1550415 - RNA, 13 nt, Homo sapiens
cagggcacugucu

SEQ ID NO: 1550416 - RNA, 17 nt, Homo sapiens
cagggcuggucaccucc

SEQ ID NO: 1550417 - RNA, 21 nt, Homo sapiens
caggggagguguauuguguau

SEQ ID NO: 1550418 - RNA, 11 nt, Homo sapiens
caggugcagcc

SEQ ID NO: 1550419 - RNA, 15 nt, Homo sapiens
caguaaaaauaaaua

SEQ ID NO: 1550420 - RNA, 13 nt, Homo sapiens
cagucccagcaca

SEQ ID NO: 1550421 - RNA, 18 nt, Homo sapiens
caguguugacauagccuu

SEQ ID NO: 1550422 - RNA, 19 nt, Homo sapiens
caguguugacauagccuuu

SEQ ID NO: 1550423 - RNA, 15 nt, Homo sapiens
caguugacaaaaagc

SEQ ID NO: 1550424 - RNA, 15 nt, Homo sapiens
caguuguccaugaca

SEQ ID NO: 1550425 - RNA, 18 nt, Homo sapiens
caguuuuuuuuuuuccag

SEQ ID NO: 1550426 - RNA, 19 nt, Homo sapiens
cauaaaauugcaguuucau

SEQ ID NO: 1550427 - RNA, 11 nt, Homo sapiens
cauaagccuac

SEQ ID NO: 1550428 - RNA, 16 nt, Homo sapiens
cauagaaacauacaca

SEQ ID NO: 1550429 - RNA, 15 nt, Homo sapiens
cauagauugcaaaua

SEQ ID NO: 1550430 - RNA, 22 nt, Homo sapiens
cauagggcaugauuaacaaagc

SEQ ID NO: 1550431 - RNA, 18 nt, Homo sapiens
cauaucuuagguauauaa

SEQ ID NO: 1550432 - RNA, 14 nt, Homo sapiens
cauccauuccucuu

SEQ ID NO: 1550433 - RNA, 19 nt, Homo sapiens
cauccgggaggacaaccag

SEQ ID NO: 1550434 - RNA, 13 nt, Homo sapiens
caucucagacugu

SEQ ID NO: 1550435 - RNA, 17 nt, Homo sapiens
caucugggucuacucaa

SEQ ID NO: 1550436 - RNA, 18 nt, Homo sapiens
caucuguggacaagacau

SEQ ID NO: 1550437 - RNA, 18 nt, Homo sapiens
caugauuaacaaagcaac

SEQ ID NO: 1550438 - RNA, 16 nt, Homo sapiens
cauggccaauagucau

SEQ ID NO: 1550439 - RNA, 17 nt, Homo sapiens
caugggucuucuuuuac

SEQ ID NO: 1550440 - RNA, 15 nt, Homo sapiens
caugugugcuaauau

SEQ ID NO: 1550441 - RNA, 16 nt, Homo sapiens
cauuacccacgugaca

SEQ ID NO: 1550442 - RNA, 19 nt, Homo sapiens
cauuagaacacugcauuag

SEQ ID NO: 1550443 - RNA, 20 nt, Homo sapiens
cauucuuggucaaguuuuuc

SEQ ID NO: 1550444 - RNA, 21 nt, Homo sapiens
cauuggggggaccgucuuuac

SEQ ID NO: 1550445 - RNA, 18 nt, Homo sapiens
cauuuaaaaaaaaucccu

SEQ ID NO: 1550446 - RNA, 21 nt, Homo sapiens
cauuuaaagaaagaaugcauu

SEQ ID NO: 1550447 - RNA, 20 nt, Homo sapiens
cauuucacgaacuguucaca

SEQ ID NO: 1550448 - RNA, 13 nt, Homo sapiens
cauuuggaaugaa

SEQ ID NO: 1550449 - RNA, 19 nt, Homo sapiens
cauuuggaaugaauacagc

SEQ ID NO: 1550450 - RNA, 14 nt, Homo sapiens
cauuuucaauuugg

SEQ ID NO: 1550451 - RNA, 14 nt, Homo sapiens
cauuuuuaaccacu

SEQ ID NO: 1550452 - RNA, 17 nt, Homo sapiens
gcuaugcuaaaccuccu

SEQ ID NO: 1550453 - RNA, 10 nt, Homo sapiens
gcucuagccc

SEQ ID NO: 1550454 - RNA, 18 nt, Homo sapiens
gcucucauccauuccucu

SEQ ID NO: 1550455 - RNA, 18 nt, Homo sapiens
gcucuucuaccauuugaa

SEQ ID NO: 1550456 - RNA, 19 nt, Homo sapiens
gcucuucuaccauuugaau

SEQ ID NO: 1550457 - RNA, 17 nt, Homo sapiens
gcugauuccagaacaaa

SEQ ID NO: 1550458 - RNA, 23 nt, Homo sapiens
gcugcuaaagggagaaaugccag

SEQ ID NO: 1550459 - RNA, 12 nt, Homo sapiens
gcugcuuugaca

SEQ ID NO: 1550460 - RNA, 18 nt, Homo sapiens
gcuggcccaguuguccau

SEQ ID NO: 1550461 - RNA, 14 nt, Homo sapiens
gcuggccugacugg

SEQ ID NO: 1550462 - RNA, 21 nt, Homo sapiens
gcugguauuuaucugcaaggu

SEQ ID NO: 1550463 - RNA, 17 nt, Homo sapiens
gcugguugagguuucaa

SEQ ID NO: 1550464 - RNA, 22 nt, Homo sapiens
gcuuccuugguucaugcuucua

SEQ ID NO: 1550465 - RNA, 15 nt, Homo sapiens
gcuucuagacacucc

SEQ ID NO: 1550466 - RNA, 21 nt, Homo sapiens
gcuucucuucuuuauugcacu

SEQ ID NO: 1550467 - RNA, 20 nt, Homo sapiens
gcuucuuggaccuuggcgcu

SEQ ID NO: 1550468 - RNA, 22 nt, Homo sapiens
gcuugcuggugccucuuuucag

SEQ ID NO: 1550469 - RNA, 14 nt, Homo sapiens
gcuuggagugcccc

SEQ ID NO: 1550470 - RNA, 15 nt, Homo sapiens
gcuuuuugcugugua

SEQ ID NO: 1550471 - RNA, 15 nt, Homo sapiens
ggaaaaugccaugaa

SEQ ID NO: 1550472 - RNA, 12 nt, Homo sapiens
ggaaacauagaa

SEQ ID NO: 1550473 - RNA, 16 nt, Homo sapiens
ggaaccaaagcuggcc

SEQ ID NO: 1550474 - RNA, 23 nt, Homo sapiens
ggaacuuagacuccucuucccag

SEQ ID NO: 1550475 - RNA, 15 nt, Homo sapiens
ggaagaugcccucaa

SEQ ID NO: 1550476 - RNA, 20 nt, Homo sapiens
ggaaggagaaggagugccau

SEQ ID NO: 1550477 - RNA, 22 nt, Homo sapiens
ggaaggagaggagaggggcaca

SEQ ID NO: 1550478 - RNA, 17 nt, Homo sapiens
ggacccuggaaauggac

SEQ ID NO: 1550479 - RNA, 22 nt, Homo sapiens
ggacgcugccgggagacugcca

SEQ ID NO: 1550480 - RNA, 18 nt, Homo sapiens
ggagaacucagugccaca

SEQ ID NO: 1550481 - RNA, 15 nt, Homo sapiens
ggagcaaaacaaagc

SEQ ID NO: 1550482 - RNA, 15 nt, Homo sapiens
ggagcccuacugaag

SEQ ID NO: 1550483 - RNA, 15 nt, Homo sapiens
ggaggccuaccucuc

SEQ ID NO: 1550484 - RNA, 19 nt, Homo sapiens
ggagucagaaacuguuucu

SEQ ID NO: 1550485 - RNA, 16 nt, Homo sapiens
ggauugccacuaagua

SEQ ID NO: 1550486 - RNA, 23 nt, Homo sapiens
ggcaaaacaaaauguaaugucag

SEQ ID NO: 1550487 - RNA, 12 nt, Homo sapiens
ggcaaaugaauu

SEQ ID NO: 1550488 - RNA, 14 nt, Homo sapiens
ggcaagaagaucac

SEQ ID NO: 1550489 - RNA, 17 nt, Homo sapiens
ggcacuuuuauuuucau

SEQ ID NO: 1550490 - RNA, 15 nt, Homo sapiens
ggcagugagugccau

SEQ ID NO: 1550491 - RNA, 19 nt, Homo sapiens
ggccagccccagcaccuca

SEQ ID NO: 1550492 - RNA, 19 nt, Homo sapiens
ggcccaguuguccaugaca

SEQ ID NO: 1550493 - RNA, 14 nt, Homo sapiens
ggccccuggcccag

SEQ ID NO: 1550494 - RNA, 18 nt, Homo sapiens
ggcccgcaagagggacag

SEQ ID NO: 1550495 - RNA, 20 nt, Homo sapiens
ggccgcugccccugaguucu

SEQ ID NO: 1550496 - RNA, 17 nt, Homo sapiens
ggccuggucguuuucaa

SEQ ID NO: 1550497 - RNA, 22 nt, Homo sapiens
gggaaaaggaugauggaaaaau

SEQ ID NO: 1550498 - RNA, 14 nt, Homo sapiens
ggggcacaugcuga

SEQ ID NO: 1550499 - RNA, 15 nt, Homo sapiens
ggguauguguugcca

SEQ ID NO: 1550500 - RNA, 18 nt, Homo sapiens
ggguggagggaaggugag

SEQ ID NO: 1550501 - RNA, 18 nt, Homo sapiens
gguaauauaaaguguaau

SEQ ID NO: 1550502 - RNA, 21 nt, Homo sapiens
ggugcaucuggcacguggcca

SEQ ID NO: 1550503 - RNA, 19 nt, Homo sapiens
guaaaagcaccauugugaa

SEQ ID NO: 1550504 - RNA, 15 nt, Homo sapiens
guaaagaggcuucca

SEQ ID NO: 1550505 - RNA, 13 nt, Homo sapiens
guaaccauaucac

SEQ ID NO: 1550506 - RNA, 14 nt, Homo sapiens
guaaucuaaguaua

SEQ ID NO: 1550507 - RNA, 15 nt, Homo sapiens
guaaugccaauauga

SEQ ID NO: 1550508 - RNA, 14 nt, Homo sapiens
guaccccccaaccc

SEQ ID NO: 1550509 - RNA, 18 nt, Homo sapiens
guagaaagacaucugccu

SEQ ID NO: 1550510 - RNA, 19 nt, Homo sapiens
guaucuauuuauauaucau

SEQ ID NO: 1550511 - RNA, 18 nt, Homo sapiens
guauguguguagacugua

SEQ ID NO: 1550512 - RNA, 15 nt, Homo sapiens
guauuggaaauggau

SEQ ID NO: 1550513 - RNA, 20 nt, Homo sapiens
guauuuaacuacaucugccu

SEQ ID NO: 1550514 - RNA, 22 nt, Homo sapiens
gucaaaauuguuuaccauagaa

SEQ ID NO: 1550515 - RNA, 22 nt, Homo sapiens
gucagacuuugcugcauuuuac

SEQ ID NO: 1550516 - RNA, 19 nt, Homo sapiens
gucaguggcuuugcauagc

SEQ ID NO: 1550517 - RNA, 17 nt, Homo sapiens
gucauucuaacugcacu

SEQ ID NO: 1550518 - RNA, 14 nt, Homo sapiens
gucauuucauucca

SEQ ID NO: 1550519 - RNA, 14 nt, Homo sapiens
guccaacucuucca

SEQ ID NO: 1550520 - RNA, 22 nt, Homo sapiens
guccacagaguuuguaguaaau

SEQ ID NO: 1550521 - RNA, 12 nt, Homo sapiens
gucccccaaccc

SEQ ID NO: 1550522 - RNA, 17 nt, Homo sapiens
guccuuggaaguuucau

SEQ ID NO: 1550523 - RNA, 22 nt, Homo sapiens
guccuuggauagauucagcucc

SEQ ID NO: 1550524 - RNA, 23 nt, Homo sapiens
gucuaguucuuuucauuuggaau

SEQ ID NO: 1550525 - RNA, 14 nt, Homo sapiens
gucucaguaccucc

SEQ ID NO: 1550526 - RNA, 14 nt, Homo sapiens
gucucucucguauu

SEQ ID NO: 1550527 - RNA, 17 nt, Homo sapiens
gucuugaugacugcuga

SEQ ID NO: 1550528 - RNA, 22 nt, Homo sapiens
gucuuuggauaauaggaauuca

SEQ ID NO: 1550529 - RNA, 12 nt, Homo sapiens
gugaaugcuucu

SEQ ID NO: 1550530 - RNA, 13 nt, Homo sapiens
gugcagcauuaaa

SEQ ID NO: 1550531 - RNA, 14 nt, Homo sapiens
gugccacucauucc

SEQ ID NO: 1550532 - RNA, 23 nt, Homo sapiens
gugcccaguacuuccuggacaag

SEQ ID NO: 1550533 - RNA, 11 nt, Homo sapiens
gugcgugccug

SEQ ID NO: 1550534 - RNA, 22 nt, Homo sapiens
gugcugucuugaugacugcuga

SEQ ID NO: 1550535 - RNA, 15 nt, Homo sapiens
gugcuugcuggugcc

SEQ ID NO: 1550536 - RNA, 14 nt, Homo sapiens
guggcuuugcauag

SEQ ID NO: 1550537 - RNA, 16 nt, Homo sapiens
gugguggccagcagca

SEQ ID NO: 1550538 - RNA, 20 nt, Homo sapiens
guguauauuuuugguggugg

SEQ ID NO: 1550539 - RNA, 17 nt, Homo sapiens
guguguauuuguauuaa

SEQ ID NO: 1550540 - RNA, 17 nt, Homo sapiens
guguguucuauccaaac

SEQ ID NO: 1550541 - RNA, 11 nt, Homo sapiens
guguucagugu

SEQ ID NO: 1550542 - RNA, 19 nt, Homo sapiens
guuaaccaggaagugcuua

SEQ ID NO: 1550543 - RNA, 21 nt, Homo sapiens
guuaauuauaccccaugauac

SEQ ID NO: 1550544 - RNA, 23 nt, Homo sapiens
guuacaaauuuuuuaauuuccaa

SEQ ID NO: 1550545 - RNA, 15 nt, Homo sapiens
guuaccaaguaugaa

SEQ ID NO: 1550546 - RNA, 22 nt, Homo sapiens
guuauaaaacuauguguucaau

SEQ ID NO: 1550547 - RNA, 19 nt, Homo sapiens
guucaugcuucuacuguga

SEQ ID NO: 1550548 - RNA, 19 nt, Homo sapiens
guucauucugcauugagaa

SEQ ID NO: 1550549 - RNA, 21 nt, Homo sapiens
guucccacucagcagugagag

SEQ ID NO: 1550550 - RNA, 15 nt, Homo sapiens
guucccucugccugg

SEQ ID NO: 1550551 - RNA, 21 nt, Homo sapiens
guucucucuuaguaacauaga

SEQ ID NO: 1550552 - RNA, 13 nt, Homo sapiens
guucugacacugu

SEQ ID NO: 1550553 - RNA, 16 nt, Homo sapiens
guugacauagccuuug

SEQ ID NO: 1550554 - RNA, 19 nt, Homo sapiens
guugcaggaccucagguga

SEQ ID NO: 1550555 - RNA, 22 nt, Homo sapiens
guuggacagacacuguugcaaa

SEQ ID NO: 1550556 - RNA, 15 nt, Homo sapiens
guuguacaagcucag

SEQ ID NO: 1550557 - RNA, 15 nt, Homo sapiens
guuuaaaugccaaaa

SEQ ID NO: 1550558 - RNA, 16 nt, Homo sapiens
guuuaccuucagccau

SEQ ID NO: 1550559 - RNA, 21 nt, Homo sapiens
guuuaccuucagccauagcuu

SEQ ID NO: 1550560 - RNA, 18 nt, Homo sapiens
guuuagcccaaaaccaag

SEQ ID NO: 1550561 - RNA, 18 nt, Homo sapiens
guuucugaggaucagcac

SEQ ID NO: 1550562 - RNA, 21 nt, Homo sapiens
guuugccaagcuaaucugccu

SEQ ID NO: 1550563 - RNA, 15 nt, Homo sapiens
guuugcuguuugcaa

SEQ ID NO: 1550564 - RNA, 18 nt, Homo sapiens
guuuguccuugcaccuga

SEQ ID NO: 1550565 - RNA, 15 nt, Homo sapiens
guuuuguaccaacac

SEQ ID NO: 1550566 - RNA, 19 nt, Homo sapiens
uaaaaauuaaaugugagca

SEQ ID NO: 1550567 - RNA, 13 nt, Homo sapiens
uaaaacagcagca

SEQ ID NO: 1550568 - RNA, 21 nt, Homo sapiens
uaaaagcaccauugugaagca

SEQ ID NO: 1550569 - RNA, 21 nt, Homo sapiens
uaaaagugaaacguaauugua

SEQ ID NO: 1550570 - RNA, 12 nt, Homo sapiens
aaaaaaaauccc

SEQ ID NO: 1550571 - RNA, 19 nt, Homo sapiens
aaaaaccacccacaaagaa

SEQ ID NO: 1550572 - RNA, 15 nt, Homo sapiens
aaaaaucccuuaccu

SEQ ID NO: 1550573 - RNA, 22 nt, Homo sapiens
aaaaaugcccauuuuugcuaau

SEQ ID NO: 1550574 - RNA, 18 nt, Homo sapiens
aaaaauguucuuacacaa

SEQ ID NO: 1550575 - RNA, 16 nt, Homo sapiens
aaaaauucccuaaaga

SEQ ID NO: 1550576 - RNA, 19 nt, Homo sapiens
aaaacaaaaaaagcaucuc

SEQ ID NO: 1550577 - RNA, 18 nt, Homo sapiens
aaaacaaaauguaauguc

SEQ ID NO: 1550578 - RNA, 15 nt, Homo sapiens
aaaacacaucuuucc

SEQ ID NO: 1550579 - RNA, 23 nt, Homo sapiens
aaaacaguuuugucagucuuucu

SEQ ID NO: 1550580 - RNA, 24 nt, Homo sapiens
aaaaccaauguucucucuucucca

SEQ ID NO: 1550581 - RNA, 17 nt, Homo sapiens
aaaaccagcgugugacu

SEQ ID NO: 1550582 - RNA, 20 nt, Homo sapiens
aaaacucauuacuuuuccau

SEQ ID NO: 1550583 - RNA, 18 nt, Homo sapiens
aaaacugcuuugugcaua

SEQ ID NO: 1550584 - RNA, 18 nt, Homo sapiens
aaaacuuuucuaauacuc

SEQ ID NO: 1550585 - RNA, 19 nt, Homo sapiens
aaaagaaaugaaauugaca

SEQ ID NO: 1550586 - RNA, 15 nt, Homo sapiens
aaaagaauggaccaa

SEQ ID NO: 1550587 - RNA, 14 nt, Homo sapiens
aaaagggagaacau

SEQ ID NO: 1550588 - RNA, 14 nt, Homo sapiens
aaaaguacauguau

SEQ ID NO: 1550589 - RNA, 14 nt, Homo sapiens
aaaauaaaaauuaa

SEQ ID NO: 1550590 - RNA, 12 nt, Homo sapiens
aaaauaaucuau

SEQ ID NO: 1550591 - RNA, 14 nt, Homo sapiens
aaaauagaauccaa

SEQ ID NO: 1550592 - RNA, 15 nt, Homo sapiens
aaaauguucuuacac

SEQ ID NO: 1550593 - RNA, 23 nt, Homo sapiens
aaaauucccuaaagacuaacuug

SEQ ID NO: 1550594 - RNA, 21 nt, Homo sapiens
aaaauugcaguuucauguaug

SEQ ID NO: 1550595 - RNA, 23 nt, Homo sapiens
aaacauguauuuauguaaugaag

SEQ ID NO: 1550596 - RNA, 23 nt, Homo sapiens
aaaccagcccuugagucugucac

SEQ ID NO: 1550597 - RNA, 23 nt, Homo sapiens
aaaccaucucugugauuaccucu

SEQ ID NO: 1550598 - RNA, 12 nt, Homo sapiens
aaaccauugugg

SEQ ID NO: 1550599 - RNA, 16 nt, Homo sapiens
aaacuauguguucaau

SEQ ID NO: 1550600 - RNA, 19 nt, Homo sapiens
aaacuauguguucaaugaa

SEQ ID NO: 1550601 - RNA, 18 nt, Homo sapiens
aaagaaaauuuuccacau

SEQ ID NO: 1550602 - RNA, 19 nt, Homo sapiens
aaagacccaacuugccaaa

SEQ ID NO: 1550603 - RNA, 21 nt, Homo sapiens
aaaggaaaaccaucucuguga

SEQ ID NO: 1550604 - RNA, 17 nt, Homo sapiens
aaagggagaaaugccag

SEQ ID NO: 1550605 - RNA, 13 nt, Homo sapiens
aaagguguguuga

SEQ ID NO: 1550606 - RNA, 21 nt, Homo sapiens
aaaguauagauggccaaagga

SEQ ID NO: 1550607 - RNA, 15 nt, Homo sapiens
aaagucaacuuccac

SEQ ID NO: 1550608 - RNA, 13 nt, Homo sapiens
aaaguguacauga

SEQ ID NO: 1550609 - RNA, 14 nt, Homo sapiens
aaauaaaaauuaaa

SEQ ID NO: 1550610 - RNA, 17 nt, Homo sapiens
aaauaaucuauauuaaa

SEQ ID NO: 1550611 - RNA, 17 nt, Homo sapiens
aaauaguugucugugcu

SEQ ID NO: 1550612 - RNA, 11 nt, Homo sapiens
aaaucaaggau

SEQ ID NO: 1550613 - RNA, 20 nt, Homo sapiens
aaaucugauuagaaguauaa

SEQ ID NO: 1550614 - RNA, 15 nt, Homo sapiens
aaaugaacuacugcu

SEQ ID NO: 1550615 - RNA, 22 nt, Homo sapiens
aaaugagaaucugugcagucau

SEQ ID NO: 1550616 - RNA, 14 nt, Homo sapiens
aaaugauacaguca

SEQ ID NO: 1550617 - RNA, 16 nt, Homo sapiens
aaauggaugacaaaga

SEQ ID NO: 1550618 - RNA, 17 nt, Homo sapiens
aaauggcugcuuugaca

SEQ ID NO: 1550619 - RNA, 18 nt, Homo sapiens
aaaugugagggugguggg

SEQ ID NO: 1550620 - RNA, 23 nt, Homo sapiens
aaauuauuuauuacuugugcacu

SEQ ID NO: 1550621 - RNA, 19 nt, Homo sapiens
aaauucucagucaugcacu

SEQ ID NO: 1550622 - RNA, 20 nt, Homo sapiens
aaauuuaauuaaagccuuaa

SEQ ID NO: 1550623 - RNA, 18 nt, Homo sapiens
aacaaaaaaagcaucuca

SEQ ID NO: 1550624 - RNA, 19 nt, Homo sapiens
aacaauuugcauaauacua

SEQ ID NO: 1550625 - RNA, 13 nt, Homo sapiens
aacaccucugcac

SEQ ID NO: 1550626 - RNA, 22 nt, Homo sapiens
aacagcguguucuaaguauuug

SEQ ID NO: 1550627 - RNA, 22 nt, Homo sapiens
aacauuaggaauuguuuauaca

SEQ ID NO: 1550628 - RNA, 14 nt, Homo sapiens
aaccacuucagcug

SEQ ID NO: 1550629 - RNA, 22 nt, Homo sapiens
aaccaucucugugauuaccucu

SEQ ID NO: 1550630 - RNA, 23 nt, Homo sapiens
aaccaucucugugauuaccucuc

SEQ ID NO: 1550631 - RNA, 16 nt, Homo sapiens
aacccagcaguucucu

SEQ ID NO: 1550632 - RNA, 21 nt, Homo sapiens
aacccagcaguucucugccaa

SEQ ID NO: 1550633 - RNA, 12 nt, Homo sapiens
aaccucauucuc

SEQ ID NO: 1550634 - RNA, 12 nt, Homo sapiens
aaccuuuacacu

SEQ ID NO: 1550635 - RNA, 14 nt, Homo sapiens
aaccuuugggccaa

SEQ ID NO: 1550636 - RNA, 20 nt, Homo sapiens
aacgacugccgugacaucau

SEQ ID NO: 1550637 - RNA, 16 nt, Homo sapiens
aacucaaacucuuaaa

SEQ ID NO: 1550638 - RNA, 19 nt, Homo sapiens
aacucacccccuacacaca

SEQ ID NO: 1550639 - RNA, 15 nt, Homo sapiens
aacucuuccaccucu

SEQ ID NO: 1550640 - RNA, 19 nt, Homo sapiens
aacucuuccaccucugggg

SEQ ID NO: 1550641 - RNA, 15 nt, Homo sapiens
aacugguucaugaaa

SEQ ID NO: 1550642 - RNA, 21 nt, Homo sapiens
aacuuauugcauaacagcaga

SEQ ID NO: 1550643 - RNA, 23 nt, Homo sapiens
aacuuccacauuauacauuugau

SEQ ID NO: 1550644 - RNA, 23 nt, Homo sapiens
aacuuguuuuuauugcauuugcu

SEQ ID NO: 1550645 - RNA, 17 nt, Homo sapiens
aacuuucugcaguuuuu

SEQ ID NO: 1550646 - RNA, 18 nt, Homo sapiens
aacuuuuagguuguuacc

SEQ ID NO: 1550647 - RNA, 14 nt, Homo sapiens
aagaaauaaugccu

SEQ ID NO: 1550648 - RNA, 22 nt, Homo sapiens
aagaauagccuauugucuuuca

SEQ ID NO: 1550649 - RNA, 18 nt, Homo sapiens
aagaaugagccuguccaa

SEQ ID NO: 1550650 - RNA, 21 nt, Homo sapiens
aagagguuuuaaaaaaauccc

SEQ ID NO: 1550651 - RNA, 24 nt, Homo sapiens
aagaguucuauggagacuuugcug

SEQ ID NO: 1550652 - RNA, 22 nt, Homo sapiens
aagauauggagaauugcugaag

SEQ ID NO: 1550653 - RNA, 17 nt, Homo sapiens
aagaugcccucaacuca

SEQ ID NO: 1550654 - RNA, 18 nt, Homo sapiens
aagcaaauuucauuaucu

SEQ ID NO: 1550655 - RNA, 13 nt, Homo sapiens
aagcagaugagga

SEQ ID NO: 1550656 - RNA, 19 nt, Homo sapiens
aagcaggacuaaaugucua

SEQ ID NO: 1550657 - RNA, 10 nt, Homo sapiens
aagcauucuu

SEQ ID NO: 1550658 - RNA, 15 nt, Homo sapiens
aagcauucuuuaaca

SEQ ID NO: 1550659 - RNA, 21 nt, Homo sapiens
aagcucccagcuccuuucaug

SEQ ID NO: 1550660 - RNA, 14 nt, Homo sapiens
aagcugauuucccu

SEQ ID NO: 1550661 - RNA, 21 nt, Homo sapiens
aagcuggauuauuuagaucua

SEQ ID NO: 1550662 - RNA, 17 nt, Homo sapiens
aagcuuuaucuuugugu

SEQ ID NO: 1550663 - RNA, 17 nt, Homo sapiens
aaggaaaaccagugggu

SEQ ID NO: 1550664 - RNA, 16 nt, Homo sapiens
aaggaauccuggugga

SEQ ID NO: 1550665 - RNA, 17 nt, Homo sapiens
aaggagaaggagugcca

SEQ ID NO: 1550666 - RNA, 19 nt, Homo sapiens
aaggagugcgugccugcua

SEQ ID NO: 1550667 - RNA, 18 nt, Homo sapiens
aagucaguggcuuugcau

SEQ ID NO: 1550668 - RNA, 23 nt, Homo sapiens
aagucccgcgaaacccggugcau

SEQ ID NO: 1550669 - RNA, 17 nt, Homo sapiens
aagugccacucauuccu

SEQ ID NO: 1550670 - RNA, 17 nt, Homo sapiens
aagugcuucacauuugu

SEQ ID NO: 1550671 - RNA, 14 nt, Homo sapiens
aaguucaacuucca

SEQ ID NO: 1550672 - RNA, 13 nt, Homo sapiens
aaguuucacccaa

SEQ ID NO: 1550673 - RNA, 23 nt, Homo sapiens
aauaaaaauguucuuacacaagg

SEQ ID NO: 1550674 - RNA, 24 nt, Homo sapiens
aauaaauaaaacagcagcagcaaa

SEQ ID NO: 1550675 - RNA, 14 nt, Homo sapiens
aauaaaucgaucca

SEQ ID NO: 1550676 - RNA, 13 nt, Homo sapiens
aauaauuauuuca

SEQ ID NO: 1550677 - RNA, 15 nt, Homo sapiens
aauaauuguuccaaa

SEQ ID NO: 1550678 - RNA, 14 nt, Homo sapiens
aauacaacauguag

SEQ ID NO: 1550679 - RNA, 18 nt, Homo sapiens
aauauucaaguaacacuu

SEQ ID NO: 1550680 - RNA, 21 nt, Homo sapiens
aaucaaaaacuuuucauuuca

SEQ ID NO: 1550681 - RNA, 23 nt, Homo sapiens
aaucacccaccauagggcaugau

SEQ ID NO: 1550682 - RNA, 14 nt, Homo sapiens
aaucacucuguccu

SEQ ID NO: 1550683 - RNA, 13 nt, Homo sapiens
uuuuccuuaccau

SEQ ID NO: 1550684 - RNA, 23 nt, Homo sapiens
uuuugaaaaaguguacaugaaga

SEQ ID NO: 1550685 - RNA, 23 nt, Homo sapiens
uuuuuaauaaaaguacugaagac

SEQ ID NO: 1550686 - RNA, 13 nt, Homo sapiens
accaccuucccuu

SEQ ID NO: 1550687 - RNA, 17 nt, Homo sapiens
accagagucaaauuuga

SEQ ID NO: 1550688 - RNA, 18 nt, Homo sapiens
accagcaggagguucugg

SEQ ID NO: 1550689 - RNA, 19 nt, Homo sapiens
accauagggcaugauuaac

SEQ ID NO: 1550690 - RNA, 21 nt, Homo sapiens
accaucucugugauuaccucu

SEQ ID NO: 1550691 - RNA, 23 nt, Homo sapiens
accaucucugugauuaccucuca

SEQ ID NO: 1550692 - RNA, 23 nt, Homo sapiens
accaugauuaaccacuucagcug

SEQ ID NO: 1550693 - RNA, 21 nt, Homo sapiens
accauuuaaagaaagaaugca

SEQ ID NO: 1550694 - RNA, 14 nt, Homo sapiens
acccaccucugcca

SEQ ID NO: 1550695 - RNA, 17 nt, Homo sapiens
acccaguuagcucucaa

SEQ ID NO: 1550696 - RNA, 20 nt, Homo sapiens
acccauaaguuuaacuguau

SEQ ID NO: 1550697 - RNA, 16 nt, Homo sapiens
acccugcgauuuugcc

SEQ ID NO: 1550698 - RNA, 21 nt, Homo sapiens
accgagguguugccagugcua

SEQ ID NO: 1550699 - RNA, 22 nt, Homo sapiens
accucgcucgaugacugugaac

SEQ ID NO: 1550700 - RNA, 15 nt, Homo sapiens
accugaccucugcaa

SEQ ID NO: 1550701 - RNA, 16 nt, Homo sapiens
accugaccucugcaag

SEQ ID NO: 1550702 - RNA, 20 nt, Homo sapiens
accugcgcuguggacacuga

SEQ ID NO: 1550703 - RNA, 17 nt, Homo sapiens
accuugcaaacucuaua

SEQ ID NO: 1550704 - RNA, 17 nt, Homo sapiens
acgggaaacucaaggag

SEQ ID NO: 1550705 - RNA, 15 nt, Homo sapiens
acgugaaaugcucaa

SEQ ID NO: 1550706 - RNA, 23 nt, Homo sapiens
acuaauguuggacagacacuguu

SEQ ID NO: 1550707 - RNA, 17 nt, Homo sapiens
acuacagaguacgugaa

SEQ ID NO: 1550708 - RNA, 13 nt, Homo sapiens
acuacaucugccu

SEQ ID NO: 1550709 - RNA, 12 nt, Homo sapiens
acuacugcuauu

SEQ ID NO: 1550710 - RNA, 23 nt, Homo sapiens
acucacacggacacucaaaagcu

SEQ ID NO: 1550711 - RNA, 23 nt, Homo sapiens
acucagcagugagaguuccucuu

SEQ ID NO: 1550712 - RNA, 18 nt, Homo sapiens
acucuagggaaaaaccag

SEQ ID NO: 1550713 - RNA, 22 nt, Homo sapiens
acucucuauaaguguucagugu

SEQ ID NO: 1550714 - RNA, 23 nt, Homo sapiens
acucucuauaaguguucaguguu

SEQ ID NO: 1550715 - RNA, 13 nt, Homo sapiens
acucugcagggug

SEQ ID NO: 1550716 - RNA, 22 nt, Homo sapiens
acucugugugagcguguccaca

SEQ ID NO: 1550717 - RNA, 18 nt, Homo sapiens
acugaacuugcuauggaa

SEQ ID NO: 1550718 - RNA, 23 nt, Homo sapiens
acugacacauugcugauaugcaa

SEQ ID NO: 1550719 - RNA, 13 nt, Homo sapiens
acugacucuguua

SEQ ID NO: 1550720 - RNA, 14 nt, Homo sapiens
acugcaagcauuuu

SEQ ID NO: 1550721 - RNA, 17 nt, Homo sapiens
acugcaagucacauaaa

SEQ ID NO: 1550722 - RNA, 20 nt, Homo sapiens
acugcacuccagccugggug

SEQ ID NO: 1550723 - RNA, 22 nt, Homo sapiens
acugcaucguuucaucuuccaa

SEQ ID NO: 1550724 - RNA, 16 nt, Homo sapiens
acuggaguuagaucuc

SEQ ID NO: 1550725 - RNA, 16 nt, Homo sapiens
acuggauucauucuca

SEQ ID NO: 1550726 - RNA, 19 nt, Homo sapiens
acuguauuuuugaagacua

SEQ ID NO: 1550727 - RNA, 17 nt, Homo sapiens
acugugucugaaucaug

SEQ ID NO: 1550728 - RNA, 18 nt, Homo sapiens
acuuaguaguuuuuacaa

SEQ ID NO: 1550729 - RNA, 16 nt, Homo sapiens
acuuccuggacaagau

SEQ ID NO: 1550730 - RNA, 17 nt, Homo sapiens
acuucuuucacuacuca

SEQ ID NO: 1550731 - RNA, 12 nt, Homo sapiens
acuugcacuguu

SEQ ID NO: 1550732 - RNA, 19 nt, Homo sapiens
acuuuaaagauaagucuac

SEQ ID NO: 1550733 - RNA, 17 nt, Homo sapiens
acuuuaccugaaagaca

SEQ ID NO: 1550734 - RNA, 19 nt, Homo sapiens
acuuugcugcauuuuacac

SEQ ID NO: 1550735 - RNA, 20 nt, Homo sapiens
agaaaauggaugacaaagaa

SEQ ID NO: 1550736 - RNA, 12 nt, Homo sapiens
agaaaauuuucc

SEQ ID NO: 1550737 - RNA, 14 nt, Homo sapiens
agaaagaugacaaa

SEQ ID NO: 1550738 - RNA, 19 nt, Homo sapiens
agaaagccuucauaagccu

SEQ ID NO: 1550739 - RNA, 20 nt, Homo sapiens
agaaagccuucauaagccua

SEQ ID NO: 1550740 - RNA, 12 nt, Homo sapiens
agaaagcuuaag

SEQ ID NO: 1550741 - RNA, 16 nt, Homo sapiens
agaaaggacuguaaaa

SEQ ID NO: 1550742 - RNA, 17 nt, Homo sapiens
agaacaaauuguuuaca

SEQ ID NO: 1550743 - RNA, 16 nt, Homo sapiens
agaacguauuuagcca

SEQ ID NO: 1550744 - RNA, 16 nt, Homo sapiens
agaagcagaaacuggc

SEQ ID NO: 1550745 - RNA, 20 nt, Homo sapiens
agaagggaacccccaaauuu

SEQ ID NO: 1550746 - RNA, 16 nt, Homo sapiens
agaaguauaaggugcu

SEQ ID NO: 1550747 - RNA, 19 nt, Homo sapiens
agaauaugcgggacaugau

SEQ ID NO: 1550748 - RNA, 11 nt, Homo sapiens
agaaucugugc

SEQ ID NO: 1550749 - RNA, 15 nt, Homo sapiens
uguauguagccuuag

SEQ ID NO: 1550750 - RNA, 14 nt, Homo sapiens
ugucaugugucuca

SEQ ID NO: 1550751 - RNA, 16 nt, Homo sapiens
ugugaacugggcauuu

SEQ ID NO: 1550752 - RNA, 18 nt, Homo sapiens
ugugaacugggcauuuca

SEQ ID NO: 1550753 - RNA, 17 nt, Homo sapiens
ugugaagccagaucucg

SEQ ID NO: 1550754 - RNA, 20 nt, Homo sapiens
ugugaaggacaugagacuaa

SEQ ID NO: 1550755 - RNA, 13 nt, Homo sapiens
ugugaggguggug

SEQ ID NO: 1550756 - RNA, 14 nt, Homo sapiens
ugugauuaccucuc

SEQ ID NO: 1550757 - RNA, 17 nt, Homo sapiens
ugugcacuuaguaguuu

SEQ ID NO: 1550758 - RNA, 19 nt, Homo sapiens
ugugccugguucgugccau

SEQ ID NO: 1550759 - RNA, 17 nt, Homo sapiens
uguggaugauaaaacac

SEQ ID NO: 1550760 - RNA, 13 nt, Homo sapiens
uguguacaaagug

SEQ ID NO: 1550761 - RNA, 18 nt, Homo sapiens
uguguagacuguaacuuu

SEQ ID NO: 1550762 - RNA, 18 nt, Homo sapiens
uguuaugguaaccauucu

SEQ ID NO: 1550763 - RNA, 16 nt, Homo sapiens
uguucaguguugacau

SEQ ID NO: 1550764 - RNA, 22 nt, Homo sapiens
uguucaguguugacauagccuu

SEQ ID NO: 1550765 - RNA, 23 nt, Homo sapiens
uguucaguguugacauagccuuu

SEQ ID NO: 1550766 - RNA, 15 nt, Homo sapiens
uguucuaaguauuug

SEQ ID NO: 1550767 - RNA, 16 nt, Homo sapiens
uguugaaaaauguugc

SEQ ID NO: 1550768 - RNA, 17 nt, Homo sapiens
uguugacauagccuuug

SEQ ID NO: 1550769 - RNA, 15 nt, Homo sapiens
uuaaaagucauuauu

SEQ ID NO: 1550770 - RNA, 16 nt, Homo sapiens
uuaaagaaagaaugca

SEQ ID NO: 1550771 - RNA, 17 nt, Homo sapiens
uuaaagacccaacuugc

SEQ ID NO: 1550772 - RNA, 21 nt, Homo sapiens
uuaaagacccaacuugccaaa

SEQ ID NO: 1550773 - RNA, 19 nt, Homo sapiens
uuaaaugaacuacugcuau

SEQ ID NO: 1550774 - RNA, 12 nt, Homo sapiens
uuaacaaagcaa

SEQ ID NO: 1550775 - RNA, 19 nt, Homo sapiens
uuaacuguauuucaguauu

SEQ ID NO: 1550776 - RNA, 18 nt, Homo sapiens
uuaacuuauugcauaaca

SEQ ID NO: 1550777 - RNA, 16 nt, Homo sapiens
uuaacuucuacauuca

SEQ ID NO: 1550778 - RNA, 16 nt, Homo sapiens
uuaauaaaaguacuga

SEQ ID NO: 1550779 - RNA, 23 nt, Homo sapiens
uuaauuugaaaacauaaucugca

SEQ ID NO: 1550780 - RNA, 21 nt, Homo sapiens
uuacacuccucguccauuuua

SEQ ID NO: 1550781 - RNA, 21 nt, Homo sapiens
uuacgugcauuuaaacucugc

SEQ ID NO: 1550782 - RNA, 15 nt, Homo sapiens
uuacuguacauacaa

SEQ ID NO: 1550783 - RNA, 13 nt, Homo sapiens
uuagaaaaaccac

SEQ ID NO: 1550784 - RNA, 16 nt, Homo sapiens
uuagaaccccagguga

SEQ ID NO: 1550785 - RNA, 18 nt, Homo sapiens
uuagaagaaaauggauga

SEQ ID NO: 1550786 - RNA, 15 nt, Homo sapiens
uuagaccgcucucuu

SEQ ID NO: 1550787 - RNA, 15 nt, Homo sapiens
uuagcauuuugcuaa

SEQ ID NO: 1550788 - RNA, 15 nt, Homo sapiens
uuagcuuguuccacu

SEQ ID NO: 1550789 - RNA, 17 nt, Homo sapiens
uuaguaacauagacaaa

SEQ ID NO: 1550790 - RNA, 18 nt, Homo sapiens
uuaguauuuaacuacauc

SEQ ID NO: 1550791 - RNA, 21 nt, Homo sapiens
uuaguuaaaaaaaaauucccu

SEQ ID NO: 1550792 - RNA, 13 nt, Homo sapiens
uuauacauuugau

SEQ ID NO: 1550793 - RNA, 15 nt, Homo sapiens
uuauacguacauaca

SEQ ID NO: 1550794 - RNA, 13 nt, Homo sapiens
uuaucucaggggu

SEQ ID NO: 1550795 - RNA, 13 nt, Homo sapiens
uuauguaaucuca

SEQ ID NO: 1550796 - RNA, 13 nt, Homo sapiens
uuauugcauaaca

SEQ ID NO: 1550797 - RNA, 16 nt, Homo sapiens
uucaauagaacaugca

SEQ ID NO: 1550798 - RNA, 12 nt, Homo sapiens
uucaaugaaaua

SEQ ID NO: 1550799 - RNA, 15 nt, Homo sapiens
uucaauuuggcaaaa

SEQ ID NO: 1550800 - RNA, 15 nt, Homo sapiens
uucacgaacuguuca

SEQ ID NO: 1550801 - RNA, 16 nt, Homo sapiens
uucagaguggacuaca

SEQ ID NO: 1550802 - RNA, 17 nt, Homo sapiens
uucagcucccacacaca

SEQ ID NO: 1550803 - RNA, 14 nt, Homo sapiens
uucagcucugcaag

SEQ ID NO: 1550804 - RNA, 15 nt, Homo sapiens
uucagcugguugagg

SEQ ID NO: 1550805 - RNA, 20 nt, Homo sapiens
uucaggugcuggagaaucug

SEQ ID NO: 1550806 - RNA, 20 nt, Homo sapiens
uucauagugucaagaaggaa

SEQ ID NO: 1550807 - RNA, 23 nt, Homo sapiens
uucauggauucaggugcuggaga

SEQ ID NO: 1550808 - RNA, 22 nt, Homo sapiens
uucaugugaaucccuuuaggau

SEQ ID NO: 1550809 - RNA, 18 nt, Homo sapiens
uuccucauuagcauuuug

SEQ ID NO: 1550810 - RNA, 23 nt, Homo sapiens
uuccucauuagcauuuugcuaaa

SEQ ID NO: 1550811 - RNA, 12 nt, Homo sapiens
uuccucugucaa

SEQ ID NO: 1550812 - RNA, 17 nt, Homo sapiens
uucgugccaugcccuua

SEQ ID NO: 1550813 - RNA, 19 nt, Homo sapiens
uucuauaaaugacuauugu

SEQ ID NO: 1550814 - RNA, 12 nt, Homo sapiens
uucuaugagcau

SEQ ID NO: 1550815 - RNA, 22 nt, Homo sapiens
uucucuugagaggguggaauau

SEQ ID NO: 1550816 - RNA, 17 nt, Homo sapiens
uucucuuucuuaguccc

SEQ ID NO: 1550817 - RNA, 12 nt, Homo sapiens
uugaaaacacua

SEQ ID NO: 1550818 - RNA, 20 nt, Homo sapiens
uugaaaacugacaucagauu

SEQ ID NO: 1550819 - RNA, 17 nt, Homo sapiens
uugaaaauaauuguucc

SEQ ID NO: 1550820 - RNA, 22 nt, Homo sapiens
uugaacuucauaagguaauuca

SEQ ID NO: 1550821 - RNA, 19 nt, Homo sapiens
uugaaguaggacuuuccua

SEQ ID NO: 1550822 - RNA, 19 nt, Homo sapiens
uugagaagggacaagccac

SEQ ID NO: 1550823 - RNA, 20 nt, Homo sapiens
uugagcucaggaguuugaga

SEQ ID NO: 1550824 - RNA, 14 nt, Homo sapiens
uugagucugucaca

SEQ ID NO: 1550825 - RNA, 14 nt, Homo sapiens
uugcaccacugcac

SEQ ID NO: 1550826 - RNA, 13 nt, Homo sapiens
uugcacuguuacu

SEQ ID NO: 1550827 - RNA, 15 nt, Homo sapiens
uugcagaugccaaaa

SEQ ID NO: 1550828 - RNA, 15 nt, Homo sapiens
uugcuguuugcaauu

SEQ ID NO: 1550829 - RNA, 21 nt, Homo sapiens
aaaaauagccugccucuucuc

SEQ ID NO: 1550830 - RNA, 16 nt, Homo sapiens
aaaaccaucucuguga

SEQ ID NO: 1550831 - RNA, 18 nt, Homo sapiens
aaaaccaucucugugauu

SEQ ID NO: 1550832 - RNA, 23 nt, Homo sapiens
aaaaccccaucucuacaaaaagc

SEQ ID NO: 1550833 - RNA, 18 nt, Homo sapiens
aaaagcaucucacugcaa

SEQ ID NO: 1550834 - RNA, 18 nt, Homo sapiens
aaaaggcuuugggccugg

SEQ ID NO: 1550835 - RNA, 20 nt, Homo sapiens
aaaagggagaacauggccaa

SEQ ID NO: 1550836 - RNA, 17 nt, Homo sapiens
aaaaggguuucuugaca

SEQ ID NO: 1550837 - RNA, 21 nt, Homo sapiens
aaaaguucccucucacuuuca

SEQ ID NO: 1550838 - RNA, 14 nt, Homo sapiens
aaaauaaaagacua

SEQ ID NO: 1550839 - RNA, 14 nt, Homo sapiens
aaaauaauuguucc

SEQ ID NO: 1550840 - RNA, 14 nt, Homo sapiens
aaaauaguuuagau

SEQ ID NO: 1550841 - RNA, 19 nt, Homo sapiens
aaaaucagccugcuccagc

SEQ ID NO: 1550842 - RNA, 16 nt, Homo sapiens
aaaaucauauugagaa

SEQ ID NO: 1550843 - RNA, 19 nt, Homo sapiens
aaaaugaguaggaugucuc

SEQ ID NO: 1550844 - RNA, 14 nt, Homo sapiens
aaaaugcaacgcug

SEQ ID NO: 1550845 - RNA, 17 nt, Homo sapiens
aaaaugcaacgcuguaa

SEQ ID NO: 1550846 - RNA, 20 nt, Homo sapiens
aaaaugugaggguggugggu

SEQ ID NO: 1550847 - RNA, 11 nt, Homo sapiens
aaaauguuggc

SEQ ID NO: 1550848 - RNA, 18 nt, Homo sapiens
aaaauucccuaaagacua

SEQ ID NO: 1550849 - RNA, 19 nt, Homo sapiens
aaacaaauaaaaugaaaua

SEQ ID NO: 1550850 - RNA, 20 nt, Homo sapiens
aaacaacagcucgauccaaa

SEQ ID NO: 1550851 - RNA, 22 nt, Homo sapiens
aaacaagcuuacuuccauugca

SEQ ID NO: 1550852 - RNA, 14 nt, Homo sapiens
aaacagcugagggu

SEQ ID NO: 1550853 - RNA, 17 nt, Homo sapiens
aaacaugugccccugcc

SEQ ID NO: 1550854 - RNA, 19 nt, Homo sapiens
aaaccuugugacucagugu

SEQ ID NO: 1550855 - RNA, 19 nt, Homo sapiens
aaacucauuacuuuuccau

SEQ ID NO: 1550856 - RNA, 15 nt, Homo sapiens
aaacugaagccgugu

SEQ ID NO: 1550857 - RNA, 17 nt, Homo sapiens
aaacugcuuugugcaua

SEQ ID NO: 1550858 - RNA, 14 nt, Homo sapiens
aaagacuaacuuga

SEQ ID NO: 1550859 - RNA, 13 nt, Homo sapiens
aaagaugacaaaa

SEQ ID NO: 1550860 - RNA, 15 nt, Homo sapiens
aaagaugacaaaaga

SEQ ID NO: 1550861 - RNA, 20 nt, Homo sapiens
aaagcaaauuucauuaucua

SEQ ID NO: 1550862 - RNA, 10 nt, Homo sapiens
aaagcauucu

SEQ ID NO: 1550863 - RNA, 13 nt, Homo sapiens
aaagggaaguagu

SEQ ID NO: 1550864 - RNA, 16 nt, Homo sapiens
aaagucguuuuccaaa

SEQ ID NO: 1550865 - RNA, 23 nt, Homo sapiens
aaauaguugucugugcuuccuug

SEQ ID NO: 1550866 - RNA, 15 nt, Homo sapiens
aaauauauauaaaga

SEQ ID NO: 1550867 - RNA, 12 nt, Homo sapiens
aaaucacugcau

SEQ ID NO: 1550868 - RNA, 16 nt, Homo sapiens
aaaucuuuuguuuuaa

SEQ ID NO: 1550869 - RNA, 14 nt, Homo sapiens
aaaugaauacgaac

SEQ ID NO: 1550870 - RNA, 14 nt, Homo sapiens
aaaugaauguuguc

SEQ ID NO: 1550871 - RNA, 22 nt, Homo sapiens
aaauuacguucuuacaagcuua

SEQ ID NO: 1550872 - RNA, 21 nt, Homo sapiens
aaauuuaauuaaagccuuaag

SEQ ID NO: 1550873 - RNA, 18 nt, Homo sapiens
aacaaauaaaaugaaaua

SEQ ID NO: 1550874 - RNA, 13 nt, Homo sapiens
aacaaaugaaaua

SEQ ID NO: 1550875 - RNA, 20 nt, Homo sapiens
aacacaaacgggcucagcaa

SEQ ID NO: 1550876 - RNA, 16 nt, Homo sapiens
aacaggaaaccacuua

SEQ ID NO: 1550877 - RNA, 19 nt, Homo sapiens
aaccacuugccucuuucuc

SEQ ID NO: 1550878 - RNA, 23 nt, Homo sapiens
aaccagaccaaccgccugcagga

SEQ ID NO: 1550879 - RNA, 14 nt, Homo sapiens
aaccaguuacccaa

SEQ ID NO: 1550880 - RNA, 15 nt, Homo sapiens
ugacuuugacuuccc

SEQ ID NO: 1550881 - RNA, 12 nt, Homo sapiens
ugagaaagccuu

SEQ ID NO: 1550882 - RNA, 20 nt, Homo sapiens
ugagaaagccuucauaagcc

SEQ ID NO: 1550883 - RNA, 18 nt, Homo sapiens
ugagaaggagucagaaac

SEQ ID NO: 1550884 - RNA, 23 nt, Homo sapiens
ugagaaggcaaccaaagugcagg

SEQ ID NO: 1550885 - RNA, 15 nt, Homo sapiens
ugagaccaaccuggg

SEQ ID NO: 1550886 - RNA, 23 nt, Homo sapiens
ugagccuggcuggagagcugcua

SEQ ID NO: 1550887 - RNA, 11 nt, Homo sapiens
ugagggacaau

SEQ ID NO: 1550888 - RNA, 16 nt, Homo sapiens
ugagggacaaugccaa

SEQ ID NO: 1550889 - RNA, 20 nt, Homo sapiens
ugaggguggugggugggaug

SEQ ID NO: 1550890 - RNA, 13 nt, Homo sapiens
ugagucugucaca

SEQ ID NO: 1550891 - RNA, 20 nt, Homo sapiens
ugaguuacuuagaaugccau

SEQ ID NO: 1550892 - RNA, 14 nt, Homo sapiens
ugauaacuacugac

SEQ ID NO: 1550893 - RNA, 13 nt, Homo sapiens
ugauacaucaucg

SEQ ID NO: 1550894 - RNA, 19 nt, Homo sapiens
ugauacccaacaguuuauu

SEQ ID NO: 1550895 - RNA, 19 nt, Homo sapiens
ugauccuaggcauuugcug

SEQ ID NO: 1550896 - RNA, 14 nt, Homo sapiens
ugaucuguacuuug

SEQ ID NO: 1550897 - RNA, 22 nt, Homo sapiens
ugauggaacuuagacuccucuu

SEQ ID NO: 1550898 - RNA, 16 nt, Homo sapiens
ugauuaccucucaauc

SEQ ID NO: 1550899 - RNA, 22 nt, Homo sapiens
ugcaagaauugaagcaggacua

SEQ ID NO: 1550900 - RNA, 14 nt, Homo sapiens
ugcaccacugcacu

SEQ ID NO: 1550901 - RNA, 12 nt, Homo sapiens
ugcacuguccag

SEQ ID NO: 1550902 - RNA, 18 nt, Homo sapiens
ugcagaaggcaggaucaa

SEQ ID NO: 1550903 - RNA, 15 nt, Homo sapiens
ugcagggccuggcau

SEQ ID NO: 1550904 - RNA, 19 nt, Homo sapiens
ugcaucguuucaucuucca

SEQ ID NO: 1550905 - RNA, 22 nt, Homo sapiens
ugccaacacacguccacuccca

SEQ ID NO: 1550906 - RNA, 19 nt, Homo sapiens
ugccacagugguacucugu

SEQ ID NO: 1550907 - RNA, 13 nt, Homo sapiens
ugccaugcuuuuu

SEQ ID NO: 1550908 - RNA, 18 nt, Homo sapiens
ugccgaacauuaggaauu

SEQ ID NO: 1550909 - RNA, 23 nt, Homo sapiens
ugccuccaacccagcaguucucu

SEQ ID NO: 1550910 - RNA, 10 nt, Homo sapiens
ugccuggcaa

SEQ ID NO: 1550911 - RNA, 21 nt, Homo sapiens
ugcgcuguggacacugagaac

SEQ ID NO: 1550912 - RNA, 18 nt, Homo sapiens
ugcggccuuuggcuucac

SEQ ID NO: 1550913 - RNA, 20 nt, Homo sapiens
ugcuaaagggagaaaugcca

SEQ ID NO: 1550914 - RNA, 22 nt, Homo sapiens
ugcuacacauaugugcuucuca

SEQ ID NO: 1550915 - RNA, 18 nt, Homo sapiens
ugcucauguauauuuagu

SEQ ID NO: 1550916 - RNA, 14 nt, Homo sapiens
ugcucgcugagaaa

SEQ ID NO: 1550917 - RNA, 19 nt, Homo sapiens
ugcucugguuugagcaauu

SEQ ID NO: 1550918 - RNA, 16 nt, Homo sapiens
ugcugaaguacagucc

SEQ ID NO: 1550919 - RNA, 12 nt, Homo sapiens
ugcugcauaaaa

SEQ ID NO: 1550920 - RNA, 11 nt, Homo sapiens
ugcugcuguuc

SEQ ID NO: 1550921 - RNA, 15 nt, Homo sapiens
uugaauuaccauaga

SEQ ID NO: 1550922 - RNA, 14 nt, Homo sapiens
uugacauagccuuu

SEQ ID NO: 1550923 - RNA, 22 nt, Homo sapiens
uugacuucauagauuaugcuuu

SEQ ID NO: 1550924 - RNA, 22 nt, Homo sapiens
uugcaaauauugguuaguauuu

SEQ ID NO: 1550925 - RNA, 19 nt, Homo sapiens
uugcaauuuuuccaugaag

SEQ ID NO: 1550926 - RNA, 22 nt, Homo sapiens
uugcacuguccagcugguugua

SEQ ID NO: 1550927 - RNA, 21 nt, Homo sapiens
uugcccugaggcucagucucu

SEQ ID NO: 1550928 - RNA, 11 nt, Homo sapiens
uugcuacugua

SEQ ID NO: 1550929 - RNA, 21 nt, Homo sapiens
uugcuauggaaaggacagugu

SEQ ID NO: 1550930 - RNA, 21 nt, Homo sapiens
uugcugcaaacccaugaagcu

SEQ ID NO: 1550931 - RNA, 14 nt, Homo sapiens
uugcuguuuacucc

SEQ ID NO: 1550932 - RNA, 23 nt, Homo sapiens
uugcuuccugauuaccagucuga

SEQ ID NO: 1550933 - RNA, 12 nt, Homo sapiens
uuggaaauggau

SEQ ID NO: 1550934 - RNA, 21 nt, Homo sapiens
uuggacagacacuguugcaaa

SEQ ID NO: 1550935 - RNA, 23 nt, Homo sapiens
uugggccagccccagcaccucau

SEQ ID NO: 1550936 - RNA, 21 nt, Homo sapiens
uugguacaaucgacauccuag

SEQ ID NO: 1550937 - RNA, 17 nt, Homo sapiens
uugucuuguucugugau

SEQ ID NO: 1550938 - RNA, 19 nt, Homo sapiens
uuguguggagaacucagug

SEQ ID NO: 1550939 - RNA, 19 nt, Homo sapiens
uuguguguauuuguauuaa

SEQ ID NO: 1550940 - RNA, 14 nt, Homo sapiens
uuguuccacugcaa

SEQ ID NO: 1550941 - RNA, 18 nt, Homo sapiens
uuguuuuuaagcuucuag

SEQ ID NO: 1550942 - RNA, 15 nt, Homo sapiens
uuuaagugacauaau

SEQ ID NO: 1550943 - RNA, 20 nt, Homo sapiens
uuuaaucagcaauauugccu

SEQ ID NO: 1550944 - RNA, 21 nt, Homo sapiens
uuuaccuucagccauagcuug

SEQ ID NO: 1550945 - RNA, 19 nt, Homo sapiens
uuuagauguuuaccuucag

SEQ ID NO: 1550946 - RNA, 13 nt, Homo sapiens
uuucacgaacugu

SEQ ID NO: 1550947 - RNA, 16 nt, Homo sapiens
uuuccuaacugugauu

SEQ ID NO: 1550948 - RNA, 13 nt, Homo sapiens
uuucgaacauucu

SEQ ID NO: 1550949 - RNA, 23 nt, Homo sapiens
uuucuauuuaccuccuaauggca

SEQ ID NO: 1550950 - RNA, 13 nt, Homo sapiens
uuucuccagugcu

SEQ ID NO: 1550951 - RNA, 15 nt, Homo sapiens
uuugaaaacauacac

SEQ ID NO: 1550952 - RNA, 15 nt, Homo sapiens
uuugaaaacugacau

SEQ ID NO: 1550953 - RNA, 13 nt, Homo sapiens
uuugcucauggca

SEQ ID NO: 1550954 - RNA, 20 nt, Homo sapiens
uuuggauaauaggaauucaa

SEQ ID NO: 1550955 - RNA, 19 nt, Homo sapiens
uuugggagggaaaagggaa

SEQ ID NO: 1550956 - RNA, 20 nt, Homo sapiens
uuuuaaaguaaacuugugua

SEQ ID NO: 1550957 - RNA, 23 nt, Homo sapiens
uuuuaaauguguugcuuuggaua

SEQ ID NO: 1550958 - RNA, 20 nt, Homo sapiens
uuuuaggcaaaaccuuguga

SEQ ID NO: 1550959 - RNA, 16 nt, Homo sapiens
uuuuccacauaggaaa

SEQ ID NO: 1550960 - RNA, 15 nt, Homo sapiens
aauaaucuauauuaa

SEQ ID NO: 1550961 - RNA, 14 nt, Homo sapiens
aauacaguaucuca

SEQ ID NO: 1550962 - RNA, 17 nt, Homo sapiens
aauacaguaucucaggg

SEQ ID NO: 1550963 - RNA, 20 nt, Homo sapiens
aauagaggugaugcugcuaa

SEQ ID NO: 1550964 - RNA, 21 nt, Homo sapiens
aauagccuaauacaacaugua

SEQ ID NO: 1550965 - RNA, 12 nt, Homo sapiens
aauagggagaaa

SEQ ID NO: 1550966 - RNA, 15 nt, Homo sapiens
aauagucauauguga

SEQ ID NO: 1550967 - RNA, 16 nt, Homo sapiens
aauauaaaguguaaua

SEQ ID NO: 1550968 - RNA, 20 nt, Homo sapiens
aauauacuuuuuuuguuaua

SEQ ID NO: 1550969 - RNA, 19 nt, Homo sapiens
aauauauauaaagaauaua

SEQ ID NO: 1550970 - RNA, 22 nt, Homo sapiens
aauauuguguugugcagcauua

SEQ ID NO: 1550971 - RNA, 14 nt, Homo sapiens
aauauuuaccagac

SEQ ID NO: 1550972 - RNA, 18 nt, Homo sapiens
aaucaaaauaaaaauuaa

SEQ ID NO: 1550973 - RNA, 18 nt, Homo sapiens
aaucacauuuuaagugcu

SEQ ID NO: 1550974 - RNA, 22 nt, Homo sapiens
aaucaugcucauguauauuuag

SEQ ID NO: 1550975 - RNA, 15 nt, Homo sapiens
aaucauuauguuucc

SEQ ID NO: 1550976 - RNA, 19 nt, Homo sapiens
aauccagagaagcgcuguu

SEQ ID NO: 1550977 - RNA, 13 nt, Homo sapiens
aauccaucugucu

SEQ ID NO: 1550978 - RNA, 17 nt, Homo sapiens
aaucgacauccuagccc

SEQ ID NO: 1550979 - RNA, 20 nt, Homo sapiens
aaucugccgcuuugucuguc

SEQ ID NO: 1550980 - RNA, 23 nt, Homo sapiens
aaucugccgcuuugucuguccag

SEQ ID NO: 1550981 - RNA, 18 nt, Homo sapiens
aaucugguaaaagcacca

SEQ ID NO: 1550982 - RNA, 15 nt, Homo sapiens
aaugagaaucugugc

SEQ ID NO: 1550983 - RNA, 19 nt, Homo sapiens
aaugccaauaugacacagc

SEQ ID NO: 1550984 - RNA, 18 nt, Homo sapiens
aaugcccauuuuugcuaa

SEQ ID NO: 1550985 - RNA, 21 nt, Homo sapiens
aauggcauggagacucugaga

SEQ ID NO: 1550986 - RNA, 20 nt, Homo sapiens
aaugguaggucaaguaauaa

SEQ ID NO: 1550987 - RNA, 16 nt, Homo sapiens
aaugugaggguggugg

SEQ ID NO: 1550988 - RNA, 21 nt, Homo sapiens
aauuauauuaaagaaccaaaa

SEQ ID NO: 1550989 - RNA, 19 nt, Homo sapiens
aauuauccauuacgugcau

SEQ ID NO: 1550990 - RNA, 22 nt, Homo sapiens
aauuauccauuacgugcauuua

SEQ ID NO: 1550991 - RNA, 23 nt, Homo sapiens
aauuauccauuacgugcauuuaa

SEQ ID NO: 1550992 - RNA, 16 nt, Homo sapiens
aauucaauuuggcaaa

SEQ ID NO: 1550993 - RNA, 23 nt, Homo sapiens
aauucucaaaagaaaaggcaaaa

SEQ ID NO: 1550994 - RNA, 14 nt, Homo sapiens
aauuuacuggccac

SEQ ID NO: 1550995 - RNA, 19 nt, Homo sapiens
aauuuauuauacaccuuag

SEQ ID NO: 1550996 - RNA, 22 nt, Homo sapiens
aauuugaaaacauaaucugcaa

SEQ ID NO: 1550997 - RNA, 11 nt, Homo sapiens
aauuuuuccau

SEQ ID NO: 1550998 - RNA, 19 nt, Homo sapiens
acaaaacugcuuugugcau

SEQ ID NO: 1550999 - RNA, 19 nt, Homo sapiens
acaaaccugggcaaugugg

SEQ ID NO: 1551000 - RNA, 16 nt, Homo sapiens
acaaagucaacuucca

SEQ ID NO: 1551001 - RNA, 20 nt, Homo sapiens
acaaccagaccaaccgccug

SEQ ID NO: 1551002 - RNA, 15 nt, Homo sapiens
acaacugcauaaccu

SEQ ID NO: 1551003 - RNA, 16 nt, Homo sapiens
acaagcugcacccuca

SEQ ID NO: 1551004 - RNA, 15 nt, Homo sapiens
acaagcuuacuucca

SEQ ID NO: 1551005 - RNA, 20 nt, Homo sapiens
acaaucauuguuuugaauau

SEQ ID NO: 1551006 - RNA, 13 nt, Homo sapiens
acaauuaauuaaa

SEQ ID NO: 1551007 - RNA, 13 nt, Homo sapiens
acacaguccaacu

SEQ ID NO: 1551008 - RNA, 12 nt, Homo sapiens
acacccaccucu

SEQ ID NO: 1551009 - RNA, 17 nt, Homo sapiens
acacccaccucugccac

SEQ ID NO: 1551010 - RNA, 19 nt, Homo sapiens
acaccucccccugcugcug

SEQ ID NO: 1551011 - RNA, 17 nt, Homo sapiens
acacuacuccugaggau

SEQ ID NO: 1551012 - RNA, 19 nt, Homo sapiens
acacucgccuacuaaguac

SEQ ID NO: 1551013 - RNA, 13 nt, Homo sapiens
acagacggaaaug

SEQ ID NO: 1551014 - RNA, 14 nt, Homo sapiens
acagaguacgugaa

SEQ ID NO: 1551015 - RNA, 23 nt, Homo sapiens
acagaguacgugaaaugcucaag

SEQ ID NO: 1551016 - RNA, 20 nt, Homo sapiens
acagcacagaugugaaggac

SEQ ID NO: 1551017 - RNA, 16 nt, Homo sapiens
acagcacuacugggug

SEQ ID NO: 1551018 - RNA, 20 nt, Homo sapiens
acagcuauuaaaauguaacu

SEQ ID NO: 1551019 - RNA, 16 nt, Homo sapiens
acaggcagcucugagc

SEQ ID NO: 1551020 - RNA, 18 nt, Homo sapiens
acauagaaacauacacaa

SEQ ID NO: 1551021 - RNA, 19 nt, Homo sapiens
acauagacaaaaaauuuga

SEQ ID NO: 1551022 - RNA, 18 nt, Homo sapiens
acauaggaaaaugccaug

SEQ ID NO: 1551023 - RNA, 14 nt, Homo sapiens
acaucuuuccuguc

SEQ ID NO: 1551024 - RNA, 17 nt, Homo sapiens
acauucuugguuguuaa

SEQ ID NO: 1551025 - RNA, 21 nt, Homo sapiens
accaaagugcaggacaucaaa

SEQ ID NO: 1551026 - RNA, 15 nt, Homo sapiens
accaagugcugucuu

SEQ ID NO: 1551027 - RNA, 16 nt, Homo sapiens
accacaaaacuuuucu

SEQ ID NO: 1551028 - RNA, 18 nt, Homo sapiens
accagaccccaaaccagc

SEQ ID NO: 1551029 - RNA, 18 nt, Homo sapiens
accagcgugugacuacuc

SEQ ID NO: 1551030 - RNA, 19 nt, Homo sapiens
accauagaaagaugacaaa

SEQ ID NO: 1551031 - RNA, 19 nt, Homo sapiens
accaucucugugauuaccu

SEQ ID NO: 1551032 - RNA, 22 nt, Homo sapiens
accaucucugugauuaccucuc

SEQ ID NO: 1551033 - RNA, 19 nt, Homo sapiens
ucagcaauacagacuacuu

SEQ ID NO: 1551034 - RNA, 16 nt, Homo sapiens
ucagcaauauugccug

SEQ ID NO: 1551035 - RNA, 12 nt, Homo sapiens
ucaggaccugcu

SEQ ID NO: 1551036 - RNA, 19 nt, Homo sapiens
ucaguacgagcugcucuaa

SEQ ID NO: 1551037 - RNA, 19 nt, Homo sapiens
ucaguauuuuccagccuua

SEQ ID NO: 1551038 - RNA, 21 nt, Homo sapiens
ucagucaugcacucacaaaga

SEQ ID NO: 1551039 - RNA, 16 nt, Homo sapiens
ucaguccccauggcac

SEQ ID NO: 1551040 - RNA, 13 nt, Homo sapiens
ucaguguugacau

SEQ ID NO: 1551041 - RNA, 21 nt, Homo sapiens
ucaguguugacauagccuuug

SEQ ID NO: 1551042 - RNA, 20 nt, Homo sapiens
ucauacaaagcgugcacaag

SEQ ID NO: 1551043 - RNA, 21 nt, Homo sapiens
ucauaugcagaacguauuuag

SEQ ID NO: 1551044 - RNA, 12 nt, Homo sapiens
ucauauugagaa

SEQ ID NO: 1551045 - RNA, 14 nt, Homo sapiens
ucaucucccagauc

SEQ ID NO: 1551046 - RNA, 16 nt, Homo sapiens
ucaugaaggacacucu

SEQ ID NO: 1551047 - RNA, 16 nt, Homo sapiens
ucaugauuuggcaugg

SEQ ID NO: 1551048 - RNA, 23 nt, Homo sapiens
ucaugcagagggugggguacugg

SEQ ID NO: 1551049 - RNA, 21 nt, Homo sapiens
ucaugccacagugguacucug

SEQ ID NO: 1551050 - RNA, 22 nt, Homo sapiens
ucaugccacagugguacucugu

SEQ ID NO: 1551051 - RNA, 15 nt, Homo sapiens
ucaugcucauguaua

SEQ ID NO: 1551052 - RNA, 17 nt, Homo sapiens
ucauucucauaauuccu

SEQ ID NO: 1551053 - RNA, 15 nt, Homo sapiens
uccaauaggcauuug

SEQ ID NO: 1551054 - RNA, 17 nt, Homo sapiens
uccaauaggcauuugau

SEQ ID NO: 1551055 - RNA, 20 nt, Homo sapiens
uccaauauucgcugugucag

SEQ ID NO: 1551056 - RNA, 23 nt, Homo sapiens
uccaguuauaagcguauuuagac

SEQ ID NO: 1551057 - RNA, 22 nt, Homo sapiens
uccaugaaguuugaacuucaua

SEQ ID NO: 1551058 - RNA, 21 nt, Homo sapiens
uccauuuuuaaccacuugccu

SEQ ID NO: 1551059 - RNA, 18 nt, Homo sapiens
ucccaaauauuacaacaa

SEQ ID NO: 1551060 - RNA, 20 nt, Homo sapiens
ucccaagcuagacugugucu

SEQ ID NO: 1551061 - RNA, 16 nt, Homo sapiens
ucccacacccaccucu

SEQ ID NO: 1551062 - RNA, 15 nt, Homo sapiens
ucccacgacuguugu

SEQ ID NO: 1551063 - RNA, 21 nt, Homo sapiens
ucccagcuccuuucaugcucc

SEQ ID NO: 1551064 - RNA, 22 nt, Homo sapiens
ucccaggccucugccccaagag

SEQ ID NO: 1551065 - RNA, 18 nt, Homo sapiens
uccccaaauggcugcuuu

SEQ ID NO: 1551066 - RNA, 18 nt, Homo sapiens
uccccaccccagcuguua

SEQ ID NO: 1551067 - RNA, 16 nt, Homo sapiens
uccccacccccaauuc

SEQ ID NO: 1551068 - RNA, 18 nt, Homo sapiens
uccccaguuggcccuucu

SEQ ID NO: 1551069 - RNA, 16 nt, Homo sapiens
ucccccaccccagagu

SEQ ID NO: 1551070 - RNA, 16 nt, Homo sapiens
ucccccuuucucugcc

SEQ ID NO: 1551071 - RNA, 18 nt, Homo sapiens
ucccucugugucugcucu

SEQ ID NO: 1551072 - RNA, 18 nt, Homo sapiens
ucccuguaugucuaccuc

SEQ ID NO: 1551073 - RNA, 19 nt, Homo sapiens
ucccuucuuugcuucuuuu

SEQ ID NO: 1551074 - RNA, 21 nt, Homo sapiens
ucccuucuuugcuucuuuuuc

SEQ ID NO: 1551075 - RNA, 19 nt, Homo sapiens
ucccuuggucccauuagcu

SEQ ID NO: 1551076 - RNA, 23 nt, Homo sapiens
uccgggaggacaaccagaccaac

SEQ ID NO: 1551077 - RNA, 15 nt, Homo sapiens
uccuaacugugauuu

SEQ ID NO: 1551078 - RNA, 14 nt, Homo sapiens
uccuauaccuuacu

SEQ ID NO: 1551079 - RNA, 14 nt, Homo sapiens
uccugcauguuaau

SEQ ID NO: 1551080 - RNA, 23 nt, Homo sapiens
ucgaugacugugaacugggcauu

SEQ ID NO: 1551081 - RNA, 13 nt, Homo sapiens
ucuaccauuugaa

SEQ ID NO: 1551082 - RNA, 16 nt, Homo sapiens
ucuaccauuugaauuu

SEQ ID NO: 1551083 - RNA, 16 nt, Homo sapiens
ucuagggaaaaaccag

SEQ ID NO: 1551084 - RNA, 17 nt, Homo sapiens
ucuauaaguguucagug

SEQ ID NO: 1551085 - RNA, 13 nt, Homo sapiens
ucuauaccugccu

SEQ ID NO: 1551086 - RNA, 20 nt, Homo sapiens
ucuaugacuuagguaaaaua

SEQ ID NO: 1551087 - RNA, 18 nt, Homo sapiens
ucucagacuguggaacca

SEQ ID NO: 1551088 - RNA, 14 nt, Homo sapiens
ucuccuagacacuc

SEQ ID NO: 1551089 - RNA, 22 nt, Homo sapiens
ucucguuucugcccagcccucu

SEQ ID NO: 1551090 - RNA, 14 nt, Homo sapiens
ucucucuucuccac

SEQ ID NO: 1551091 - RNA, 13 nt, Homo sapiens
ucucugcaucuga

SEQ ID NO: 1551092 - RNA, 21 nt, Homo sapiens
ucucuggggcaggcugcuuca

SEQ ID NO: 1551093 - RNA, 21 nt, Homo sapiens
ucugaaguguccuaaauauua

SEQ ID NO: 1551094 - RNA, 20 nt, Homo sapiens
ucugaaucaugucuguaucc

SEQ ID NO: 1551095 - RNA, 20 nt, Homo sapiens
ucugaggaucagcacugcca

SEQ ID NO: 1551096 - RNA, 19 nt, Homo sapiens
ucugcagggugaagcacca

SEQ ID NO: 1551097 - RNA, 19 nt, Homo sapiens
ucugccacucuuaacacua

SEQ ID NO: 1551098 - RNA, 14 nt, Homo sapiens
ucugccaugcucug

SEQ ID NO: 1551099 - RNA, 14 nt, Homo sapiens
ucuguaauguaggc

SEQ ID NO: 1551100 - RNA, 10 nt, Homo sapiens
ucuguacaau

SEQ ID NO: 1551101 - RNA, 19 nt, Homo sapiens
ucuguagcuuguucccugu

SEQ ID NO: 1551102 - RNA, 22 nt, Homo sapiens
ucuguccagccgugugugcaug

SEQ ID NO: 1551103 - RNA, 15 nt, Homo sapiens
ucugugauuaccucu

SEQ ID NO: 1551104 - RNA, 19 nt, Homo sapiens
ucuuagugcuucagaguuu

SEQ ID NO: 1551105 - RNA, 13 nt, Homo sapiens
ucuucucuacucu

SEQ ID NO: 1551106 - RNA, 14 nt, Homo sapiens
ucuucucuacucua

SEQ ID NO: 1551107 - RNA, 20 nt, Homo sapiens
ucuugagggacaaugccaau

SEQ ID NO: 1551108 - RNA, 20 nt, Homo sapiens
ucuuucaauugcagaugcca

SEQ ID NO: 1551109 - RNA, 16 nt, Homo sapiens
ucuuugcucauggcaa

SEQ ID NO: 1551110 - RNA, 12 nt, Homo sapiens
ugaaaacauaca

SEQ ID NO: 1551111 - RNA, 22 nt, Homo sapiens
ugaaaauaauuguuccaaauga

SEQ ID NO: 1551112 - RNA, 15 nt, Homo sapiens
ugaaaauaugauguu

SEQ ID NO: 1551113 - RNA, 22 nt, Homo sapiens
ugaaacguaauuguacaagcag

SEQ ID NO: 1551114 - RNA, 18 nt, Homo sapiens
ugaaaugccacgugccau

SEQ ID NO: 1551115 - RNA, 18 nt, Homo sapiens
ugaagauauuacuacuua

SEQ ID NO: 1551116 - RNA, 16 nt, Homo sapiens
ugaauaauacaguauc

SEQ ID NO: 1551117 - RNA, 20 nt, Homo sapiens
ugaauaauacaguaucucag

SEQ ID NO: 1551118 - RNA, 14 nt, Homo sapiens
ugaauauuacuccu

SEQ ID NO: 1551119 - RNA, 12 nt, Homo sapiens
ugaaugcuucuc

SEQ ID NO: 1551120 - RNA, 17 nt, Homo sapiens
ugacacauugcugauau

SEQ ID NO: 1551121 - RNA, 21 nt, Homo sapiens
ugacaucauucagcgcaugca

SEQ ID NO: 1551122 - RNA, 15 nt, Homo sapiens
ugacgaaagagucau

SEQ ID NO: 1551123 - RNA, 16 nt, Homo sapiens
ugagacccugucucaa

SEQ ID NO: 1551124 - RNA, 22 nt, Homo sapiens
ugagcagguaucaacuagggga

SEQ ID NO: 1551125 - RNA, 19 nt, Homo sapiens
ugagcugaagaaauuauac

SEQ ID NO: 1551126 - RNA, 19 nt, Homo sapiens
ugaggacugaagcuggggc

SEQ ID NO: 1551127 - RNA, 17 nt, Homo sapiens
ugagguagaggaaaauc

SEQ ID NO: 1551128 - RNA, 19 nt, Homo sapiens
ugaguauggcuaucuauac

SEQ ID NO: 1551129 - RNA, 18 nt, Homo sapiens
ugaguuugcuguuugcaa

SEQ ID NO: 1551130 - RNA, 12 nt, Homo sapiens
ugaucaacuguu

SEQ ID NO: 1551131 - RNA, 15 nt, Homo sapiens
ugaugcaggcacuua

SEQ ID NO: 1551132 - RNA, 23 nt, Homo sapiens
ugauuauugcuucuuuccuugca

SEQ ID NO: 1551133 - RNA, 14 nt, Homo sapiens
ugauuuaaaucagc

SEQ ID NO: 1551134 - RNA, 16 nt, Homo sapiens
ugcaaacugcuuuauu

SEQ ID NO: 1551135 - RNA, 21 nt, Homo sapiens
ugcaaauauugguuaguauuu

SEQ ID NO: 1551136 - RNA, 16 nt, Homo sapiens
ugcaagucacauaaaa

SEQ ID NO: 1551137 - RNA, 13 nt, Homo sapiens
ugcacacuaagaa

SEQ ID NO: 1551138 - RNA, 16 nt, Homo sapiens
ugcaccugagccuguu

SEQ ID NO: 1551139 - RNA, 15 nt, Homo sapiens
ugcagaacguauuua

SEQ ID NO: 1551140 - RNA, 22 nt, Homo sapiens
ugcagagggugggguacuggag

SEQ ID NO: 1551141 - RNA, 23 nt, Homo sapiens
ugcaggacaucaaaaacaaccug

SEQ ID NO: 1551142 - RNA, 21 nt, Homo sapiens
ugcagggugaagcaccaggga

SEQ ID NO: 1551143 - RNA, 15 nt, Homo sapiens
ugcaguuucauguau

SEQ ID NO: 1551144 - RNA, 12 nt, Homo sapiens
ugcauuccagaa

SEQ ID NO: 1551145 - RNA, 13 nt, Homo sapiens
ugcauuccagaac

SEQ ID NO: 1551146 - RNA, 16 nt, Homo sapiens
ugcauuccagaacaaa

SEQ ID NO: 1551147 - RNA, 22 nt, Homo sapiens
ugcauuccuuacuugcacuguu

SEQ ID NO: 1551148 - RNA, 20 nt, Homo sapiens
ugccaacagacacuacauua

SEQ ID NO: 1551149 - RNA, 16 nt, Homo sapiens
ugccaagaaaguauuu

SEQ ID NO: 1551150 - RNA, 14 nt, Homo sapiens
ugccacucauuccu

SEQ ID NO: 1551151 - RNA, 13 nt, Homo sapiens
accucccaccuau

SEQ ID NO: 1551152 - RNA, 13 nt, Homo sapiens
accuccuucccca

SEQ ID NO: 1551153 - RNA, 15 nt, Homo sapiens
accugcgcuguggac

SEQ ID NO: 1551154 - RNA, 21 nt, Homo sapiens
accugguugcagcacauucac

SEQ ID NO: 1551155 - RNA, 24 nt, Homo sapiens
accuuacugacacauugcugauau

SEQ ID NO: 1551156 - RNA, 19 nt, Homo sapiens
accuucagauuuguguuau

SEQ ID NO: 1551157 - RNA, 21 nt, Homo sapiens
accuugcaaacucuauaaaga

SEQ ID NO: 1551158 - RNA, 19 nt, Homo sapiens
accuuuucuauuuaccucc

SEQ ID NO: 1551159 - RNA, 12 nt, Homo sapiens
acgaacuguuca

SEQ ID NO: 1551160 - RNA, 16 nt, Homo sapiens
acgccuguaauccuag

SEQ ID NO: 1551161 - RNA, 13 nt, Homo sapiens
acggaaucugccg

SEQ ID NO: 1551162 - RNA, 12 nt, Homo sapiens
acggacacucaa

SEQ ID NO: 1551163 - RNA, 22 nt, Homo sapiens
acgguuucuccccggacacucg

SEQ ID NO: 1551164 - RNA, 20 nt, Homo sapiens
acgguuuuaaauguguugcu

SEQ ID NO: 1551165 - RNA, 19 nt, Homo sapiens
acgugcauuuaaacucugc

SEQ ID NO: 1551166 - RNA, 19 nt, Homo sapiens
acuacuccugaggaugcua

SEQ ID NO: 1551167 - RNA, 16 nt, Homo sapiens
acuauucagaggaaaa

SEQ ID NO: 1551168 - RNA, 15 nt, Homo sapiens
acuauuguaaugcca

SEQ ID NO: 1551169 - RNA, 21 nt, Homo sapiens
acuauuguaaugccaauauga

SEQ ID NO: 1551170 - RNA, 23 nt, Homo sapiens
acuauuguaaugccaauaugaca

SEQ ID NO: 1551171 - RNA, 20 nt, Homo sapiens
acucccaagccacuagccca

SEQ ID NO: 1551172 - RNA, 17 nt, Homo sapiens
acuccuggagcacugua

SEQ ID NO: 1551173 - RNA, 19 nt, Homo sapiens
acucuaaaaauagaaucca

SEQ ID NO: 1551174 - RNA, 14 nt, Homo sapiens
acugacacuacuaa

SEQ ID NO: 1551175 - RNA, 14 nt, Homo sapiens
acugacucuguuau

SEQ ID NO: 1551176 - RNA, 21 nt, Homo sapiens
acugacuggauucauucucau

SEQ ID NO: 1551177 - RNA, 17 nt, Homo sapiens
acugauucccucuccca

SEQ ID NO: 1551178 - RNA, 10 nt, Homo sapiens
acugccagug

SEQ ID NO: 1551179 - RNA, 17 nt, Homo sapiens
acugcuucucuuugugc

SEQ ID NO: 1551180 - RNA, 19 nt, Homo sapiens
acuggaggaacacagagaa

SEQ ID NO: 1551181 - RNA, 17 nt, Homo sapiens
acuggauucauucucau

SEQ ID NO: 1551182 - RNA, 22 nt, Homo sapiens
acugugaagagaaccauaucaa

SEQ ID NO: 1551183 - RNA, 17 nt, Homo sapiens
acuguucacacugcaga

SEQ ID NO: 1551184 - RNA, 16 nt, Homo sapiens
acuguuguacaagcuc

SEQ ID NO: 1551185 - RNA, 22 nt, Homo sapiens
acuuccacauuauacauuugau

SEQ ID NO: 1551186 - RNA, 13 nt, Homo sapiens
acuugauuccuug

SEQ ID NO: 1551187 - RNA, 13 nt, Homo sapiens
acuuuucauuuca

SEQ ID NO: 1551188 - RNA, 11 nt, Homo sapiens
agaaaaaccac

SEQ ID NO: 1551189 - RNA, 16 nt, Homo sapiens
agaaaauucuccugau

SEQ ID NO: 1551190 - RNA, 12 nt, Homo sapiens
agaaacugaagc

SEQ ID NO: 1551191 - RNA, 22 nt, Homo sapiens
agaaagaaugcauuccagaaca

SEQ ID NO: 1551192 - RNA, 17 nt, Homo sapiens
agaaagauuuggaaaau

SEQ ID NO: 1551193 - RNA, 15 nt, Homo sapiens
agaaagccuucauaa

SEQ ID NO: 1551194 - RNA, 15 nt, Homo sapiens
agaacaaacaccucc

SEQ ID NO: 1551195 - RNA, 19 nt, Homo sapiens
agaagugcagccccucuca

SEQ ID NO: 1551196 - RNA, 23 nt, Homo sapiens
agaauaugcgggacaugaugcua

SEQ ID NO: 1551197 - RNA, 20 nt, Homo sapiens
agaauguagucagacugaca

SEQ ID NO: 1551198 - RNA, 21 nt, Homo sapiens
agaauuauaauuaguuccuca

SEQ ID NO: 1551199 - RNA, 13 nt, Homo sapiens
agaauuuuagucc

SEQ ID NO: 1551200 - RNA, 23 nt, Homo sapiens
agacaccuuuucuauuuaccucc

SEQ ID NO: 1551201 - RNA, 15 nt, Homo sapiens
agacacuuuaccucu

SEQ ID NO: 1551202 - RNA, 20 nt, Homo sapiens
agacagagcagaucagucuu

SEQ ID NO: 1551203 - RNA, 12 nt, Homo sapiens
agacaucugccu

SEQ ID NO: 1551204 - RNA, 21 nt, Homo sapiens
agaccagaccccaaaccagcc

SEQ ID NO: 1551205 - RNA, 17 nt, Homo sapiens
agaccucaaaucacugc

SEQ ID NO: 1551206 - RNA, 15 nt, Homo sapiens
agaccuccagcccug

SEQ ID NO: 1551207 - RNA, 23 nt, Homo sapiens
agacgucguacccagccaugugu

SEQ ID NO: 1551208 - RNA, 19 nt, Homo sapiens
agacuauuuucuauuuucc

SEQ ID NO: 1551209 - RNA, 23 nt, Homo sapiens
agacucauucccuagaucuuucu

SEQ ID NO: 1551210 - RNA, 23 nt, Homo sapiens
agacucccuugcuuuuugcugug

SEQ ID NO: 1551211 - RNA, 15 nt, Homo sapiens
agacuccucuuccca

SEQ ID NO: 1551212 - RNA, 18 nt, Homo sapiens
agacugggcaccccugcc

SEQ ID NO: 1551213 - RNA, 16 nt, Homo sapiens
agacugguuaggacaa

SEQ ID NO: 1551214 - RNA, 20 nt, Homo sapiens
agagagaaguucauacaaag

SEQ ID NO: 1551215 - RNA, 13 nt, Homo sapiens
agagcaucucugc

SEQ ID NO: 1551216 - RNA, 16 nt, Homo sapiens
agagccccucaugcca

SEQ ID NO: 1551217 - RNA, 22 nt, Homo sapiens
agagcugggggcugagggagac

SEQ ID NO: 1551218 - RNA, 15 nt, Homo sapiens
agagguggcccuccc

SEQ ID NO: 1551219 - RNA, 23 nt, Homo sapiens
agagucacaaguagccucuggga

SEQ ID NO: 1551220 - RNA, 20 nt, Homo sapiens
agaguugggaugcggggcag

SEQ ID NO: 1551221 - RNA, 13 nt, Homo sapiens
agaucacugaaga

SEQ ID NO: 1551222 - RNA, 20 nt, Homo sapiens
agaucagggauagcgcuguu

SEQ ID NO: 1551223 - RNA, 18 nt, Homo sapiens
agauccuggaaacagcag

SEQ ID NO: 1551224 - RNA, 20 nt, Homo sapiens
agaugccaaaaaagaugcca

SEQ ID NO: 1551225 - RNA, 18 nt, Homo sapiens
agauguauaaaucuuucu

SEQ ID NO: 1551226 - RNA, 22 nt, Homo sapiens
agauuaggcugaggcagugcua

SEQ ID NO: 1551227 - RNA, 21 nt, Homo sapiens
agauuauagcucccaaaagaa

SEQ ID NO: 1551228 - RNA, 17 nt, Homo sapiens
agcaaaacaaagcugau

SEQ ID NO: 1551229 - RNA, 18 nt, Homo sapiens
agcaauacagacuacuuc

SEQ ID NO: 1551230 - RNA, 19 nt, Homo sapiens
agcaaugcccguaaugcuu

SEQ ID NO: 1551231 - RNA, 13 nt, Homo sapiens
agcagaaccuugg

SEQ ID NO: 1551232 - RNA, 19 nt, Homo sapiens
agcagggcuggucaccucc

SEQ ID NO: 1551233 - RNA, 20 nt, Homo sapiens
agcaguucucugccaaagcu

SEQ ID NO: 1551234 - RNA, 15 nt, Homo sapiens
agcaucagcacagcu

SEQ ID NO: 1551235 - RNA, 15 nt, Homo sapiens
agcaucucacugcaa

SEQ ID NO: 1551236 - RNA, 22 nt, Homo sapiens
agcaugccaaggcucuguggga

SEQ ID NO: 1551237 - RNA, 14 nt, Homo sapiens
agccacagccugac

SEQ ID NO: 1551238 - RNA, 21 nt, Homo sapiens
agccaccuugaccguagggga

SEQ ID NO: 1551239 - RNA, 18 nt, Homo sapiens
agccaugggaaaugagcc

SEQ ID NO: 1551240 - RNA, 22 nt, Homo sapiens
agcccaagggcaucauccucag

SEQ ID NO: 1551241 - RNA, 13 nt, Homo sapiens
agcccaccccuca

SEQ ID NO: 1551242 - RNA, 14 nt, Homo sapiens
agccccucaugcca

SEQ ID NO: 1551243 - RNA, 16 nt, Homo sapiens
agcccggagaggaccc

SEQ ID NO: 1551244 - RNA, 13 nt, Homo sapiens
agcccuucuaccc

SEQ ID NO: 1551245 - RNA, 19 nt, Homo sapiens
agcccuugagucugucaca

SEQ ID NO: 1551246 - RNA, 16 nt, Homo sapiens
agccucugaaaaccaa

SEQ ID NO: 1551247 - RNA, 19 nt, Homo sapiens
agccucugggaucugccaa

SEQ ID NO: 1551248 - RNA, 22 nt, Homo sapiens
agccuggcuggagagcugcuau

SEQ ID NO: 1551249 - RNA, 17 nt, Homo sapiens
agccuguucccacucag

SEQ ID NO: 1551250 - RNA, 13 nt, Homo sapiens
agcgcgaugaacg

SEQ ID NO: 1551251 - RNA, 23 nt, Homo sapiens
agcggcuggcagcccaccccuca

SEQ ID NO: 1551252 - RNA, 16 nt, Homo sapiens
agcgugggcucagcag

SEQ ID NO: 1551253 - RNA, 16 nt, Homo sapiens
agcgugugacuacucc

SEQ ID NO: 1551254 - RNA, 22 nt, Homo sapiens
agcuaccacgggucugccaugc

SEQ ID NO: 1551255 - RNA, 13 nt, Homo sapiens
agcuagacugugu

SEQ ID NO: 1551256 - RNA, 14 nt, Homo sapiens
agcuccauacuucu

SEQ ID NO: 1551257 - RNA, 18 nt, Homo sapiens
agcugaguuuaacaugug

SEQ ID NO: 1551258 - RNA, 13 nt, Homo sapiens
agcugcacccuca

SEQ ID NO: 1551259 - RNA, 22 nt, Homo sapiens
agcuggccaaccccgagaacca

SEQ ID NO: 1551260 - RNA, 23 nt, Homo sapiens
agcuggcccaguuguccaugaca

SEQ ID NO: 1551261 - RNA, 16 nt, Homo sapiens
agcugggggcugaggg

SEQ ID NO: 1551262 - RNA, 13 nt, Homo sapiens
agcuguucagcug

SEQ ID NO: 1551263 - RNA, 15 nt, Homo sapiens
agcuuacuuccauug

SEQ ID NO: 1551264 - RNA, 14 nt, Homo sapiens
agcuuaucucaggg

SEQ ID NO: 1551265 - RNA, 15 nt, Homo sapiens
agcuugagcucagaa

SEQ ID NO: 1551266 - RNA, 21 nt, Homo sapiens
aggaaaaccaucucugugauu

SEQ ID NO: 1551267 - RNA, 13 nt, Homo sapiens
aggaaacauagaa

SEQ ID NO: 1551268 - RNA, 19 nt, Homo sapiens
aggaaccgagguguugcca

SEQ ID NO: 1551269 - RNA, 18 nt, Homo sapiens
ccuggguaacuagggaag

SEQ ID NO: 1551270 - RNA, 20 nt, Homo sapiens
ccuguaauuaaacuaguuua

SEQ ID NO: 1551271 - RNA, 16 nt, Homo sapiens
ccuguccccucagcuc

SEQ ID NO: 1551272 - RNA, 16 nt, Homo sapiens
ccuuacucaccucucu

SEQ ID NO: 1551273 - RNA, 14 nt, Homo sapiens
ccuuacuugcacug

SEQ ID NO: 1551274 - RNA, 19 nt, Homo sapiens
ccuuggggcucagccacag

SEQ ID NO: 1551275 - RNA, 14 nt, Homo sapiens
ccuugggguggugc

SEQ ID NO: 1551276 - RNA, 20 nt, Homo sapiens
cgagauugcaccacugcacu

SEQ ID NO: 1551277 - RNA, 19 nt, Homo sapiens
cgagguguugccagugcua

SEQ ID NO: 1551278 - RNA, 17 nt, Homo sapiens
cgcucgaugacugugaa

SEQ ID NO: 1551279 - RNA, 23 nt, Homo sapiens
cgcugccgaguccgggccggggc

SEQ ID NO: 1551280 - RNA, 13 nt, Homo sapiens
cggcugugggugg

SEQ ID NO: 1551281 - RNA, 14 nt, Homo sapiens
cggggcaggugcag

SEQ ID NO: 1551282 - RNA, 21 nt, Homo sapiens
cguaggggagggguugccaca

SEQ ID NO: 1551283 - RNA, 16 nt, Homo sapiens
cguauaaugcuuucug

SEQ ID NO: 1551284 - RNA, 23 nt, Homo sapiens
cgugguggccagcagcagcuaca

SEQ ID NO: 1551285 - RNA, 13 nt, Homo sapiens
cuaaagcuuuauc

SEQ ID NO: 1551286 - RNA, 19 nt, Homo sapiens
cuaaagggagaaaugccag

SEQ ID NO: 1551287 - RNA, 21 nt, Homo sapiens
cuaacuugaaaagaaaaccac

SEQ ID NO: 1551288 - RNA, 13 nt, Homo sapiens
cuaagcugcccug

SEQ ID NO: 1551289 - RNA, 17 nt, Homo sapiens
cuacagaguacgugaaa

SEQ ID NO: 1551290 - RNA, 18 nt, Homo sapiens
cuaccacgggucugccau

SEQ ID NO: 1551291 - RNA, 23 nt, Homo sapiens
cuaccccaccugaccucugcaag

SEQ ID NO: 1551292 - RNA, 12 nt, Homo sapiens
cuaccucugacu

SEQ ID NO: 1551293 - RNA, 20 nt, Homo sapiens
cuacucuagggaaaaaccag

SEQ ID NO: 1551294 - RNA, 20 nt, Homo sapiens
cuacuuuaauauaaacccau

SEQ ID NO: 1551295 - RNA, 12 nt, Homo sapiens
cuagacacuccu

SEQ ID NO: 1551296 - RNA, 20 nt, Homo sapiens
cuagcacuuugggaggccaa

SEQ ID NO: 1551297 - RNA, 13 nt, Homo sapiens
cuauaaguguuca

SEQ ID NO: 1551298 - RNA, 19 nt, Homo sapiens
cuauaaguguucaguguug

SEQ ID NO: 1551299 - RNA, 21 nt, Homo sapiens
cuaugauauauuuauaucaua

SEQ ID NO: 1551300 - RNA, 22 nt, Homo sapiens
cuaugauauauuuauaucauau

SEQ ID NO: 1551301 - RNA, 15 nt, Homo sapiens
cuauggagcaaaaca

SEQ ID NO: 1551302 - RNA, 15 nt, Homo sapiens
cuauuguaaugccaa

SEQ ID NO: 1551303 - RNA, 13 nt, Homo sapiens
cuauuuauuugac

SEQ ID NO: 1551304 - RNA, 16 nt, Homo sapiens
cuauuugggcucugaa

SEQ ID NO: 1551305 - RNA, 23 nt, Homo sapiens
cuauuuuuuaauaaaaguacuga

SEQ ID NO: 1551306 - RNA, 21 nt, Homo sapiens
cucaaaagcugggcagguugg

SEQ ID NO: 1551307 - RNA, 19 nt, Homo sapiens
cucaaguuuuuguuuugua

SEQ ID NO: 1551308 - RNA, 17 nt, Homo sapiens
cucacccccuacacaca

SEQ ID NO: 1551309 - RNA, 12 nt, Homo sapiens
cucacgccugua

SEQ ID NO: 1551310 - RNA, 12 nt, Homo sapiens
cucagaccucca

SEQ ID NO: 1551311 - RNA, 22 nt, Homo sapiens
cucagacuguggaaccaaagcu

SEQ ID NO: 1551312 - RNA, 22 nt, Homo sapiens
cucagauuggaauguuacaucu

SEQ ID NO: 1551313 - RNA, 14 nt, Homo sapiens
cucaguaccucccc

SEQ ID NO: 1551314 - RNA, 10 nt, Homo sapiens
cucauaauag

SEQ ID NO: 1551315 - RNA, 19 nt, Homo sapiens
cuccacuggucugucuuug

SEQ ID NO: 1551316 - RNA, 19 nt, Homo sapiens
cuccagaccagaccccaaa

SEQ ID NO: 1551317 - RNA, 18 nt, Homo sapiens
cucccaagccacauucau

SEQ ID NO: 1551318 - RNA, 19 nt, Homo sapiens
cucccaagccacuagccca

SEQ ID NO: 1551319 - RNA, 16 nt, Homo sapiens
cuccugcacuguuuaa

SEQ ID NO: 1551320 - RNA, 21 nt, Homo sapiens
cuccugccucccaauaccagc

SEQ ID NO: 1551321 - RNA, 14 nt, Homo sapiens
cuccuucacaucag

SEQ ID NO: 1551322 - RNA, 21 nt, Homo sapiens
cuccuuccuacccuccugcac

SEQ ID NO: 1551323 - RNA, 15 nt, Homo sapiens
cuccuuucaugcucc

SEQ ID NO: 1551324 - RNA, 18 nt, Homo sapiens
cuccuuugaaaccugcuc

SEQ ID NO: 1551325 - RNA, 15 nt, Homo sapiens
cucgaugacugugaa

SEQ ID NO: 1551326 - RNA, 12 nt, Homo sapiens
cucuacaaaaag

SEQ ID NO: 1551327 - RNA, 14 nt, Homo sapiens
cucuacucuaggga

SEQ ID NO: 1551328 - RNA, 16 nt, Homo sapiens
cucucaagacuucucc

SEQ ID NO: 1551329 - RNA, 18 nt, Homo sapiens
cucucccacccaaggaga

SEQ ID NO: 1551330 - RNA, 18 nt, Homo sapiens
cucucuauaaguguucag

SEQ ID NO: 1551331 - RNA, 21 nt, Homo sapiens
cucucuauaaguguucagugu

SEQ ID NO: 1551332 - RNA, 23 nt, Homo sapiens
cucucuauaaguguucaguguug

SEQ ID NO: 1551333 - RNA, 14 nt, Homo sapiens
cucucuguggcucc

SEQ ID NO: 1551334 - RNA, 14 nt, Homo sapiens
cucugccacucuua

SEQ ID NO: 1551335 - RNA, 14 nt, Homo sapiens
cucuuaaaucauuu

SEQ ID NO: 1551336 - RNA, 15 nt, Homo sapiens
cucuuacaaccaaga

SEQ ID NO: 1551337 - RNA, 23 nt, Homo sapiens
cucuucuccaccucccacaaagg

SEQ ID NO: 1551338 - RNA, 11 nt, Homo sapiens
cugaaaaccaa

SEQ ID NO: 1551339 - RNA, 19 nt, Homo sapiens
cugaaaaccaauguucucu

SEQ ID NO: 1551340 - RNA, 17 nt, Homo sapiens
cugaaacaugugccccu

SEQ ID NO: 1551341 - RNA, 19 nt, Homo sapiens
cugaaaguccugcuuuccu

SEQ ID NO: 1551342 - RNA, 22 nt, Homo sapiens
cugaacuggagcugcuaagcua

SEQ ID NO: 1551343 - RNA, 15 nt, Homo sapiens
cugaaucaugucugu

SEQ ID NO: 1551344 - RNA, 18 nt, Homo sapiens
cugacacagugcucgacc

SEQ ID NO: 1551345 - RNA, 16 nt, Homo sapiens
cugacacuacuaaagc

SEQ ID NO: 1551346 - RNA, 14 nt, Homo sapiens
cugacgaaagaguc

SEQ ID NO: 1551347 - RNA, 22 nt, Homo sapiens
cugagaaauuauuagauugcca

SEQ ID NO: 1551348 - RNA, 19 nt, Homo sapiens
cugagccauugauucuuca

SEQ ID NO: 1551349 - RNA, 23 nt, Homo sapiens
cugagccgaacauguuauuuaac

SEQ ID NO: 1551350 - RNA, 19 nt, Homo sapiens
cugauuccagaacaaauca

SEQ ID NO: 1551351 - RNA, 12 nt, Homo sapiens
cugcaagcauuu

SEQ ID NO: 1551352 - RNA, 16 nt, Homo sapiens
cugcaagucacauaaa

SEQ ID NO: 1551353 - RNA, 15 nt, Homo sapiens
cugcagguccgggga

SEQ ID NO: 1551354 - RNA, 23 nt, Homo sapiens
cugcccagucccccaaccccagc

SEQ ID NO: 1551355 - RNA, 23 nt, Homo sapiens
cugcccguaaaaccugagccauu

SEQ ID NO: 1551356 - RNA, 17 nt, Homo sapiens
cugcccuugucugagau

SEQ ID NO: 1551357 - RNA, 23 nt, Homo sapiens
cugccgggagacugccaguggag

SEQ ID NO: 1551358 - RNA, 15 nt, Homo sapiens
cugccuuacuguaca

SEQ ID NO: 1551359 - RNA, 13 nt, Homo sapiens
cugcuucuccagc

SEQ ID NO: 1551360 - RNA, 15 nt, Homo sapiens
cuggaggaacacaga

SEQ ID NO: 1551361 - RNA, 14 nt, Homo sapiens
cuggcaacaucuua

SEQ ID NO: 1551362 - RNA, 17 nt, Homo sapiens
cuggggaagagguuuua

SEQ ID NO: 1551363 - RNA, 17 nt, Homo sapiens
cugguaaaagcaccauu

SEQ ID NO: 1551364 - RNA, 18 nt, Homo sapiens
cugguauuuaucugcaag

SEQ ID NO: 1551365 - RNA, 15 nt, Homo sapiens
cuguagggugccauu

SEQ ID NO: 1551366 - RNA, 18 nt, Homo sapiens
cuguccuaggucaugaag

SEQ ID NO: 1551367 - RNA, 23 nt, Homo sapiens
cugucugaucaggguggagggaa

SEQ ID NO: 1551368 - RNA, 15 nt, Homo sapiens
cugucuuucaucucc

SEQ ID NO: 1551369 - RNA, 16 nt, Homo sapiens
cugugacacuuaucuc

SEQ ID NO: 1551370 - RNA, 13 nt, Homo sapiens
cugugcacacuaa

SEQ ID NO: 1551371 - RNA, 21 nt, Homo sapiens
cuguggaagggccaauggaga

SEQ ID NO: 1551372 - RNA, 23 nt, Homo sapiens
cugugugagcguguccacagagu

SEQ ID NO: 1551373 - RNA, 18 nt, Homo sapiens
cuguuccucaacaagcaa

SEQ ID NO: 1551374 - RNA, 13 nt, Homo sapiens
cuuaaagcuugau

SEQ ID NO: 1551375 - RNA, 16 nt, Homo sapiens
cuuaaaugaacuacug

SEQ ID NO: 1551376 - RNA, 17 nt, Homo sapiens
cuuacccucucuuucaa

SEQ ID NO: 1551377 - RNA, 21 nt, Homo sapiens
cuuacuggggccuggggcucu

SEQ ID NO: 1551378 - RNA, 14 nt, Homo sapiens
cuuagaaaaaccac

SEQ ID NO: 1551379 - RNA, 23 nt, Homo sapiens
cuuaguaguuuuuacaaaacugc

SEQ ID NO: 1551380 - RNA, 19 nt, Homo sapiens
cuuaugauuuuauuacaga

SEQ ID NO: 1551381 - RNA, 17 nt, Homo sapiens
cuuauguguuacauuau

SEQ ID NO: 1551382 - RNA, 17 nt, Homo sapiens
cuuauuuuuaugugguc

SEQ ID NO: 1551383 - RNA, 19 nt, Homo sapiens
cuucacauuuguaugugug

SEQ ID NO: 1551384 - RNA, 22 nt, Homo sapiens
cuucauaagguaauucauggca

SEQ ID NO: 1551385 - RNA, 21 nt, Homo sapiens
cuuccaacucaaacucuuaaa

SEQ ID NO: 1551386 - RNA, 20 nt, Homo sapiens
cuuccugaguggccagggaa

SEQ ID NO: 1551387 - RNA, 20 nt, Homo sapiens
gcagcugauuccagaacaaa

SEQ ID NO: 1551388 - RNA, 15 nt, Homo sapiens
gcaggaggugccuga

SEQ ID NO: 1551389 - RNA, 23 nt, Homo sapiens
gcaguauccaauaggcauuugau

SEQ ID NO: 1551390 - RNA, 15 nt, Homo sapiens
gcaguucucugccaa

SEQ ID NO: 1551391 - RNA, 20 nt, Homo sapiens
gcaguuucauguauguauau

SEQ ID NO: 1551392 - RNA, 17 nt, Homo sapiens
gcaugccuggucuuucc

SEQ ID NO: 1551393 - RNA, 19 nt, Homo sapiens
gcauuccuuacuugcacug

SEQ ID NO: 1551394 - RNA, 20 nt, Homo sapiens
gcauuucacgaacuguucac

SEQ ID NO: 1551395 - RNA, 18 nt, Homo sapiens
gcauuuucuucagaauua

SEQ ID NO: 1551396 - RNA, 21 nt, Homo sapiens
gccaacacacguccacuccca

SEQ ID NO: 1551397 - RNA, 18 nt, Homo sapiens
gccaccagggcacugucu

SEQ ID NO: 1551398 - RNA, 12 nt, Homo sapiens
gccacuaaguac

SEQ ID NO: 1551399 - RNA, 18 nt, Homo sapiens
gccacuaaguacagcuga

SEQ ID NO: 1551400 - RNA, 18 nt, Homo sapiens
gccacuagcccacucccc

SEQ ID NO: 1551401 - RNA, 17 nt, Homo sapiens
gccaggauccucuccuu

SEQ ID NO: 1551402 - RNA, 16 nt, Homo sapiens
gccauaccuucuccca

SEQ ID NO: 1551403 - RNA, 17 nt, Homo sapiens
gccauauaugcuguauu

SEQ ID NO: 1551404 - RNA, 20 nt, Homo sapiens
gcccaauggagaaaugaagc

SEQ ID NO: 1551405 - RNA, 24 nt, Homo sapiens
gcccaggucccuccucagaccucc

SEQ ID NO: 1551406 - RNA, 16 nt, Homo sapiens
gccccagcccaagucc

SEQ ID NO: 1551407 - RNA, 23 nt, Homo sapiens
gccccugaguucugacacugugu

SEQ ID NO: 1551408 - RNA, 11 nt, Homo sapiens
gcccuaugugu

SEQ ID NO: 1551409 - RNA, 23 nt, Homo sapiens
gcccucaggcuccccagugcucc

SEQ ID NO: 1551410 - RNA, 13 nt, Homo sapiens
gcccuugcccuug

SEQ ID NO: 1551411 - RNA, 14 nt, Homo sapiens
gccgggacuggggg

SEQ ID NO: 1551412 - RNA, 18 nt, Homo sapiens
gccucugggaucugccaa

SEQ ID NO: 1551413 - RNA, 13 nt, Homo sapiens
gccugggugcaaa

SEQ ID NO: 1551414 - RNA, 15 nt, Homo sapiens
gccuggugugguggc

SEQ ID NO: 1551415 - RNA, 20 nt, Homo sapiens
gcgcauagcacgggauucau

SEQ ID NO: 1551416 - RNA, 22 nt, Homo sapiens
gcgcuuugagaggcugaggcag

SEQ ID NO: 1551417 - RNA, 13 nt, Homo sapiens
gcggcuggcagcc

SEQ ID NO: 1551418 - RNA, 21 nt, Homo sapiens
gcuaaucugccugguuuuauu

SEQ ID NO: 1551419 - RNA, 18 nt, Homo sapiens
gcuacccuuuuccuuugu

SEQ ID NO: 1551420 - RNA, 13 nt, Homo sapiens
gcuagugccaaau

SEQ ID NO: 1551421 - RNA, 23 nt, Homo sapiens
gcuaucagacuguaggauuugaa

SEQ ID NO: 1551422 - RNA, 15 nt, Homo sapiens
gcucaaucacacugg

SEQ ID NO: 1551423 - RNA, 18 nt, Homo sapiens
gcuccaggcaucacugau

SEQ ID NO: 1551424 - RNA, 19 nt, Homo sapiens
gcucccacacccaccucug

SEQ ID NO: 1551425 - RNA, 16 nt, Homo sapiens
gcucgcuacacuacuc

SEQ ID NO: 1551426 - RNA, 17 nt, Homo sapiens
gcucguuuggcuuuaua

SEQ ID NO: 1551427 - RNA, 15 nt, Homo sapiens
gcucuggaggagcaa

SEQ ID NO: 1551428 - RNA, 17 nt, Homo sapiens
gcugagggagacccccc

SEQ ID NO: 1551429 - RNA, 16 nt, Homo sapiens
gcugagugcuaugugu

SEQ ID NO: 1551430 - RNA, 15 nt, Homo sapiens
gcugauuccagaaca

SEQ ID NO: 1551431 - RNA, 15 nt, Homo sapiens
gcugcauuuuacaca

SEQ ID NO: 1551432 - RNA, 18 nt, Homo sapiens
gcugcauuuuacacaugu

SEQ ID NO: 1551433 - RNA, 18 nt, Homo sapiens
gcugccgugccugugucc

SEQ ID NO: 1551434 - RNA, 12 nt, Homo sapiens
gcugcugcugcc

SEQ ID NO: 1551435 - RNA, 14 nt, Homo sapiens
gcugcuuugacaag

SEQ ID NO: 1551436 - RNA, 14 nt, Homo sapiens
gcuggagagcugcu

SEQ ID NO: 1551437 - RNA, 19 nt, Homo sapiens
gcugguauuuaucugcaag

SEQ ID NO: 1551438 - RNA, 17 nt, Homo sapiens
gcuguggacacugagaa

SEQ ID NO: 1551439 - RNA, 13 nt, Homo sapiens
gcuucacauuugu

SEQ ID NO: 1551440 - RNA, 22 nt, Homo sapiens
gcuucucacugccaugccagcu

SEQ ID NO: 1551441 - RNA, 23 nt, Homo sapiens
gcuucucuucuuuauugcacuag

SEQ ID NO: 1551442 - RNA, 15 nt, Homo sapiens
gcuucuuggaccuug

SEQ ID NO: 1551443 - RNA, 15 nt, Homo sapiens
gcuuuaaaagucauu

SEQ ID NO: 1551444 - RNA, 15 nt, Homo sapiens
gcuuugaaaauucag

SEQ ID NO: 1551445 - RNA, 13 nt, Homo sapiens
ggaagaugcccuc

SEQ ID NO: 1551446 - RNA, 22 nt, Homo sapiens
ggaagccucccacgacugcccg

SEQ ID NO: 1551447 - RNA, 14 nt, Homo sapiens
ggacagacacuguu

SEQ ID NO: 1551448 - RNA, 20 nt, Homo sapiens
ggacagacggaaaugaaauu

SEQ ID NO: 1551449 - RNA, 14 nt, Homo sapiens
ggacgcugccggga

SEQ ID NO: 1551450 - RNA, 17 nt, Homo sapiens
ggagacggaaucugccg

SEQ ID NO: 1551451 - RNA, 11 nt, Homo sapiens
ggagaggaccc

SEQ ID NO: 1551452 - RNA, 17 nt, Homo sapiens
ggaucuuuuggaccugg

SEQ ID NO: 1551453 - RNA, 18 nt, Homo sapiens
ggcaaacuuuucuuucuu

SEQ ID NO: 1551454 - RNA, 21 nt, Homo sapiens
ggcacauaggcugguggccuu

SEQ ID NO: 1551455 - RNA, 14 nt, Homo sapiens
ggcaugguggccca

SEQ ID NO: 1551456 - RNA, 21 nt, Homo sapiens
ggccacaaaaguucccucuca

SEQ ID NO: 1551457 - RNA, 17 nt, Homo sapiens
ggccagccccagcaccu

SEQ ID NO: 1551458 - RNA, 20 nt, Homo sapiens
ggccagccccagcaccucau

SEQ ID NO: 1551459 - RNA, 16 nt, Homo sapiens
ggccagcgcgaugaac

SEQ ID NO: 1551460 - RNA, 16 nt, Homo sapiens
ggcuccgcaugguuca

SEQ ID NO: 1551461 - RNA, 17 nt, Homo sapiens
ggcugcaaggagcaaca

SEQ ID NO: 1551462 - RNA, 21 nt, Homo sapiens
gggaagaugcccucaacucac

SEQ ID NO: 1551463 - RNA, 14 nt, Homo sapiens
gggagaaaugccag

SEQ ID NO: 1551464 - RNA, 20 nt, Homo sapiens
gggagacaucaaaaccaccc

SEQ ID NO: 1551465 - RNA, 16 nt, Homo sapiens
gggagacugccagugg

SEQ ID NO: 1551466 - RNA, 20 nt, Homo sapiens
gggaggucaaggcugcagug

SEQ ID NO: 1551467 - RNA, 12 nt, Homo sapiens
gggaucugccaa

SEQ ID NO: 1551468 - RNA, 12 nt, Homo sapiens
gggaugggccac

SEQ ID NO: 1551469 - RNA, 21 nt, Homo sapiens
gggccagccccagcaccucau

SEQ ID NO: 1551470 - RNA, 18 nt, Homo sapiens
gggccuguagaucaggga

SEQ ID NO: 1551471 - RNA, 17 nt, Homo sapiens
ggggccggaggaaccga

SEQ ID NO: 1551472 - RNA, 19 nt, Homo sapiens
gggugacagagcaagugag

SEQ ID NO: 1551473 - RNA, 16 nt, Homo sapiens
gggugggguacuggag

SEQ ID NO: 1551474 - RNA, 19 nt, Homo sapiens
gguaaaagcaccauuguga

SEQ ID NO: 1551475 - RNA, 13 nt, Homo sapiens
gguaaauguggug

SEQ ID NO: 1551476 - RNA, 21 nt, Homo sapiens
gguauucuuaagggaacuucc

SEQ ID NO: 1551477 - RNA, 23 nt, Homo sapiens
gguauuucaaaacacaucuuucc

SEQ ID NO: 1551478 - RNA, 13 nt, Homo sapiens
ggucccucugugu

SEQ ID NO: 1551479 - RNA, 23 nt, Homo sapiens
ggugaacagcaggaugcccuguu

SEQ ID NO: 1551480 - RNA, 14 nt, Homo sapiens
ggugaagugccugc

SEQ ID NO: 1551481 - RNA, 15 nt, Homo sapiens
ggugggguacuggag

SEQ ID NO: 1551482 - RNA, 18 nt, Homo sapiens
guaaaaagcccuauguga

SEQ ID NO: 1551483 - RNA, 12 nt, Homo sapiens
guaaaaccugag

SEQ ID NO: 1551484 - RNA, 15 nt, Homo sapiens
guaaacuaaggauaa

SEQ ID NO: 1551485 - RNA, 21 nt, Homo sapiens
guaacuuuuuuucaguucaua

SEQ ID NO: 1551486 - RNA, 16 nt, Homo sapiens
guaagaccaccuuccc

SEQ ID NO: 1551487 - RNA, 14 nt, Homo sapiens
guaagacucauucc

SEQ ID NO: 1551488 - RNA, 15 nt, Homo sapiens
guaagacucauuccc

SEQ ID NO: 1551489 - RNA, 16 nt, Homo sapiens
guaauuguacaagcag

SEQ ID NO: 1551490 - RNA, 23 nt, Homo sapiens
guacacuucgcgcaccuucucac

SEQ ID NO: 1551491 - RNA, 10 nt, Homo sapiens
guacauguau

SEQ ID NO: 1551492 - RNA, 20 nt, Homo sapiens
guacgauggaggccuaccuc

SEQ ID NO: 1551493 - RNA, 14 nt, Homo sapiens
guagaaugucuugg

SEQ ID NO: 1551494 - RNA, 20 nt, Homo sapiens
guagccucugggaucugcca

SEQ ID NO: 1551495 - RNA, 22 nt, Homo sapiens
guagccuuagagcaucucugcc

SEQ ID NO: 1551496 - RNA, 17 nt, Homo sapiens
guaggaugucucuugga

SEQ ID NO: 1551497 - RNA, 21 nt, Homo sapiens
guagucagacugacacuacua

SEQ ID NO: 1551498 - RNA, 21 nt, Homo sapiens
guauaaauuaaauaaacuguu

SEQ ID NO: 1551499 - RNA, 22 nt, Homo sapiens
guauaucauggaauuuccauug

SEQ ID NO: 1551500 - RNA, 14 nt, Homo sapiens
guaugucuaccucu

SEQ ID NO: 1551501 - RNA, 17 nt, Homo sapiens
guauuuuuauccaugac

SEQ ID NO: 1551502 - RNA, 14 nt, Homo sapiens
gucacacucucuug

SEQ ID NO: 1551503 - RNA, 22 nt, Homo sapiens
gucacauguuggugcugccuug

SEQ ID NO: 1551504 - RNA, 13 nt, Homo sapiens
gucagacuuugcu

SEQ ID NO: 1551505 - RNA, 18 nt, Homo sapiens
uuacuuuugaaccaugua

SEQ ID NO: 1551506 - RNA, 23 nt, Homo sapiens
uuagagcccauuucaauucucaa

SEQ ID NO: 1551507 - RNA, 20 nt, Homo sapiens
uuaggcaggaucuguacaau

SEQ ID NO: 1551508 - RNA, 18 nt, Homo sapiens
uuaguaguuuuuacaaaa

SEQ ID NO: 1551509 - RNA, 22 nt, Homo sapiens
uuaguaguuuuuacaaaacugc

SEQ ID NO: 1551510 - RNA, 11 nt, Homo sapiens
uuaugagauuu

SEQ ID NO: 1551511 - RNA, 15 nt, Homo sapiens
uuaugguaaccauuc

SEQ ID NO: 1551512 - RNA, 14 nt, Homo sapiens
uuauguaaucucac

SEQ ID NO: 1551513 - RNA, 21 nt, Homo sapiens
uuauguguaguugucucucuu

SEQ ID NO: 1551514 - RNA, 14 nt, Homo sapiens
uuauuauacaccuu

SEQ ID NO: 1551515 - RNA, 14 nt, Homo sapiens
uucaacgacugccg

SEQ ID NO: 1551516 - RNA, 19 nt, Homo sapiens
uucaacgaugugacugcca

SEQ ID NO: 1551517 - RNA, 15 nt, Homo sapiens
uucaauucucaaaag

SEQ ID NO: 1551518 - RNA, 16 nt, Homo sapiens
uucaauugcagaugcc

SEQ ID NO: 1551519 - RNA, 21 nt, Homo sapiens
uucacgaacuguucacacugc

SEQ ID NO: 1551520 - RNA, 20 nt, Homo sapiens
uucacuggggcaugagauuu

SEQ ID NO: 1551521 - RNA, 18 nt, Homo sapiens
uucacuguaagacucauu

SEQ ID NO: 1551522 - RNA, 22 nt, Homo sapiens
uucagagggcguguuguuuuac

SEQ ID NO: 1551523 - RNA, 22 nt, Homo sapiens
uucagcaguaacaggaaaccac

SEQ ID NO: 1551524 - RNA, 21 nt, Homo sapiens
uucagcugacuccaguauaau

SEQ ID NO: 1551525 - RNA, 15 nt, Homo sapiens
uucagguaacacuac

SEQ ID NO: 1551526 - RNA, 13 nt, Homo sapiens
uucaguguugaca

SEQ ID NO: 1551527 - RNA, 18 nt, Homo sapiens
uucaugcuucuacuguga

SEQ ID NO: 1551528 - RNA, 20 nt, Homo sapiens
uuccacauaggaaaaugcca

SEQ ID NO: 1551529 - RNA, 22 nt, Homo sapiens
uuccacauaggaaaaugccaug

SEQ ID NO: 1551530 - RNA, 22 nt, Homo sapiens
uucccuacaguugaaaaacagc

SEQ ID NO: 1551531 - RNA, 14 nt, Homo sapiens
uuccuaacugugau

SEQ ID NO: 1551532 - RNA, 20 nt, Homo sapiens
uuccuacagcacuacugggu

SEQ ID NO: 1551533 - RNA, 22 nt, Homo sapiens
uuccuuaaaugaacuacugcua

SEQ ID NO: 1551534 - RNA, 13 nt, Homo sapiens
uuccuuacuugca

SEQ ID NO: 1551535 - RNA, 17 nt, Homo sapiens
uuccuuacuugcacugu

SEQ ID NO: 1551536 - RNA, 11 nt, Homo sapiens
uucgcuugcuu

SEQ ID NO: 1551537 - RNA, 17 nt, Homo sapiens
uucucagccacaaaaua

SEQ ID NO: 1551538 - RNA, 21 nt, Homo sapiens
uucucucaaaugauacaguca

SEQ ID NO: 1551539 - RNA, 20 nt, Homo sapiens
uucuggaaucuuugagacca

SEQ ID NO: 1551540 - RNA, 19 nt, Homo sapiens
uucuucagguaacacuaca

SEQ ID NO: 1551541 - RNA, 21 nt, Homo sapiens
uugaaaaacuuuuagguuguu

SEQ ID NO: 1551542 - RNA, 13 nt, Homo sapiens
uugaaaacacuaa

SEQ ID NO: 1551543 - RNA, 17 nt, Homo sapiens
uugaaaccugcucugua

SEQ ID NO: 1551544 - RNA, 12 nt, Homo sapiens
uugaacugguuc

SEQ ID NO: 1551545 - RNA, 18 nt, Homo sapiens
uugaacugguucaugaaa

SEQ ID NO: 1551546 - RNA, 15 nt, Homo sapiens
uugaauauuacuccu

SEQ ID NO: 1551547 - RNA, 17 nt, Homo sapiens
uugagaaagccuucaua

SEQ ID NO: 1551548 - RNA, 21 nt, Homo sapiens
uugcaaauauugguuaguauu

SEQ ID NO: 1551549 - RNA, 16 nt, Homo sapiens
uugcauuugcuguugu

SEQ ID NO: 1551550 - RNA, 20 nt, Homo sapiens
uugcugcaaacccaugaagc

SEQ ID NO: 1551551 - RNA, 14 nt, Homo sapiens
uugcuuauugcuua

SEQ ID NO: 1551552 - RNA, 20 nt, Homo sapiens
uugcuuccugauuaccaguc

SEQ ID NO: 1551553 - RNA, 20 nt, Homo sapiens
uugcuuuggauacacacaua

SEQ ID NO: 1551554 - RNA, 15 nt, Homo sapiens
uuggacagacacugu

SEQ ID NO: 1551555 - RNA, 17 nt, Homo sapiens
uuguaguucuuaguccc

SEQ ID NO: 1551556 - RNA, 11 nt, Homo sapiens
uugucaugaau

SEQ ID NO: 1551557 - RNA, 13 nt, Homo sapiens
uuguuuauacaca

SEQ ID NO: 1551558 - RNA, 22 nt, Homo sapiens
uuguuuauacacaacuuugcaa

SEQ ID NO: 1551559 - RNA, 17 nt, Homo sapiens
uuuaaauucucagucau

SEQ ID NO: 1551560 - RNA, 16 nt, Homo sapiens
uuuaagauaaacagaa

SEQ ID NO: 1551561 - RNA, 22 nt, Homo sapiens
uuuaagccaucaucagcuuaau

SEQ ID NO: 1551562 - RNA, 20 nt, Homo sapiens
uuuaccauagaaagaugaca

SEQ ID NO: 1551563 - RNA, 14 nt, Homo sapiens
uuuagaagcaaaga

SEQ ID NO: 1551564 - RNA, 16 nt, Homo sapiens
uuuaguuacguauaau

SEQ ID NO: 1551565 - RNA, 15 nt, Homo sapiens
uuucacauaaaaccu

SEQ ID NO: 1551566 - RNA, 11 nt, Homo sapiens
uuucaguucau

SEQ ID NO: 1551567 - RNA, 12 nt, Homo sapiens
uuucauugcugg

SEQ ID NO: 1551568 - RNA, 15 nt, Homo sapiens
uuucuauaccugucu

SEQ ID NO: 1551569 - RNA, 18 nt, Homo sapiens
uuucuucagaauuaucca

SEQ ID NO: 1551570 - RNA, 16 nt, Homo sapiens
uuugaaaacauaaucu

SEQ ID NO: 1551571 - RNA, 19 nt, Homo sapiens
uuugcuaaaugugaaugau

SEQ ID NO: 1551572 - RNA, 21 nt, Homo sapiens
uuugcuaaaugugaaugauga

SEQ ID NO: 1551573 - RNA, 21 nt, Homo sapiens
uuugggaagcucccacaccca

SEQ ID NO: 1551574 - RNA, 14 nt, Homo sapiens
uuuggggcugcgaa

SEQ ID NO: 1551575 - RNA, 10 nt, Homo sapiens
uuuguaaaag

SEQ ID NO: 1551576 - RNA, 21 nt, Homo sapiens
uuuuaaagacccaacuugcca

SEQ ID NO: 1551577 - RNA, 22 nt, Homo sapiens
uuuuaaagacccaacuugccaa

SEQ ID NO: 1551578 - RNA, 22 nt, Homo sapiens
uuuuaaguuugaaacuaacuca

SEQ ID NO: 1551579 - RNA, 14 nt, Homo sapiens
uuuuccugccaggc

SEQ ID NO: 1551580 - RNA, 17 nt, Homo sapiens
uuuucuauuuaccuccu

SEQ ID NO: 1551581 - RNA, 20 nt, Homo sapiens
uuuuuaaaugggagcaacau

SEQ ID NO: 1551582 - RNA, 16 nt, Homo sapiens
uuuuucauggcaacau

SEQ ID NO: 1551583 - RNA, 17 nt, Homo sapiens
aggaaguucaacuucca

SEQ ID NO: 1551584 - RNA, 12 nt, Homo sapiens
aggagacugggc

SEQ ID NO: 1551585 - RNA, 21 nt, Homo sapiens
aggagacugguuaggacaaaa

SEQ ID NO: 1551586 - RNA, 20 nt, Homo sapiens
aggagcaacagcgauggcag

SEQ ID NO: 1551587 - RNA, 11 nt, Homo sapiens
aggagccauga

SEQ ID NO: 1551588 - RNA, 20 nt, Homo sapiens
aggagcccccugagaguguc

SEQ ID NO: 1551589 - RNA, 16 nt, Homo sapiens
aggagguggcuguuaa

SEQ ID NO: 1551590 - RNA, 22 nt, Homo sapiens
aggauuauauguauuaauacuu

SEQ ID NO: 1551591 - RNA, 15 nt, Homo sapiens
aggcagcucugagcc

SEQ ID NO: 1551592 - RNA, 21 nt, Homo sapiens
aggcucugugggaggaugaag

SEQ ID NO: 1551593 - RNA, 20 nt, Homo sapiens
agggaaguaguccuuggcau

SEQ ID NO: 1551594 - RNA, 18 nt, Homo sapiens
agggauagcgcuguugau

SEQ ID NO: 1551595 - RNA, 18 nt, Homo sapiens
agggcaucauccucagca

SEQ ID NO: 1551596 - RNA, 14 nt, Homo sapiens
agggccaauggaga

SEQ ID NO: 1551597 - RNA, 13 nt, Homo sapiens
agguauaccucag

SEQ ID NO: 1551598 - RNA, 18 nt, Homo sapiens
agguauaccucaguucca

SEQ ID NO: 1551599 - RNA, 14 nt, Homo sapiens
aguaacacuuuaaa

SEQ ID NO: 1551600 - RNA, 17 nt, Homo sapiens
aguaacaggaaaccacu

SEQ ID NO: 1551601 - RNA, 21 nt, Homo sapiens
aguauuuaacgaagccuagaa

SEQ ID NO: 1551602 - RNA, 12 nt, Homo sapiens
agucaucaaagu

SEQ ID NO: 1551603 - RNA, 21 nt, Homo sapiens
aguccaacucuuccaccucug

SEQ ID NO: 1551604 - RNA, 18 nt, Homo sapiens
agucuuugucaaugcucu

SEQ ID NO: 1551605 - RNA, 12 nt, Homo sapiens
agugacagucac

SEQ ID NO: 1551606 - RNA, 22 nt, Homo sapiens
agugacauaauuguccaguuau

SEQ ID NO: 1551607 - RNA, 13 nt, Homo sapiens
agugagacccugu

SEQ ID NO: 1551608 - RNA, 16 nt, Homo sapiens
agugagugccaugcuu

SEQ ID NO: 1551609 - RNA, 15 nt, Homo sapiens
agugcuaagcugccc

SEQ ID NO: 1551610 - RNA, 17 nt, Homo sapiens
agugcuucagaguuugu

SEQ ID NO: 1551611 - RNA, 21 nt, Homo sapiens
aguggcuuugcauagcuuuca

SEQ ID NO: 1551612 - RNA, 20 nt, Homo sapiens
agugggagcugaguggggga

SEQ ID NO: 1551613 - RNA, 12 nt, Homo sapiens
agugucaccucc

SEQ ID NO: 1551614 - RNA, 13 nt, Homo sapiens
aguguuaucauau

SEQ ID NO: 1551615 - RNA, 16 nt, Homo sapiens
aguguugacauagccu

SEQ ID NO: 1551616 - RNA, 13 nt, Homo sapiens
aguucucugccaa

SEQ ID NO: 1551617 - RNA, 16 nt, Homo sapiens
aguucugacacugugu

SEQ ID NO: 1551618 - RNA, 23 nt, Homo sapiens
aguugggaugcggggcagagcca

SEQ ID NO: 1551619 - RNA, 22 nt, Homo sapiens
aguuucugaggaucagcacugc

SEQ ID NO: 1551620 - RNA, 22 nt, Homo sapiens
aguuuguguguauuuguauuaa

SEQ ID NO: 1551621 - RNA, 17 nt, Homo sapiens
aguuuuuuuuuuuccag

SEQ ID NO: 1551622 - RNA, 12 nt, Homo sapiens
auaaagccuuuu

SEQ ID NO: 1551623 - RNA, 23 nt, Homo sapiens
auaaauaaaacagcagcagcaaa

SEQ ID NO: 1551624 - RNA, 22 nt, Homo sapiens
auaaauauuguguugugcagca

SEQ ID NO: 1551625 - RNA, 16 nt, Homo sapiens
auaaggugcucugaag

SEQ ID NO: 1551626 - RNA, 19 nt, Homo sapiens
auaaucaugcucauguaua

SEQ ID NO: 1551627 - RNA, 13 nt, Homo sapiens
ggagaggggcaca

SEQ ID NO: 1551628 - RNA, 12 nt, Homo sapiens
ggagccaugaca

SEQ ID NO: 1551629 - RNA, 15 nt, Homo sapiens
ggagguggcuguuaa

SEQ ID NO: 1551630 - RNA, 20 nt, Homo sapiens
ggauaucaauuaauuugaaa

SEQ ID NO: 1551631 - RNA, 13 nt, Homo sapiens
ggauccucuccuu

SEQ ID NO: 1551632 - RNA, 14 nt, Homo sapiens
ggaugauaacuacu

SEQ ID NO: 1551633 - RNA, 13 nt, Homo sapiens
ggcaaaugaauuu

SEQ ID NO: 1551634 - RNA, 14 nt, Homo sapiens
ggcacaugcugagu

SEQ ID NO: 1551635 - RNA, 22 nt, Homo sapiens
ggcagagcugggggcugaggga

SEQ ID NO: 1551636 - RNA, 16 nt, Homo sapiens
ggcaggcuacucugcc

SEQ ID NO: 1551637 - RNA, 19 nt, Homo sapiens
ggcauucucgguacuucug

SEQ ID NO: 1551638 - RNA, 22 nt, Homo sapiens
ggcauuucacgaacuguucaca

SEQ ID NO: 1551639 - RNA, 13 nt, Homo sapiens
ggccugggcgggg

SEQ ID NO: 1551640 - RNA, 20 nt, Homo sapiens
ggcuacucugcccaccccag

SEQ ID NO: 1551641 - RNA, 16 nt, Homo sapiens
ggcucaaggcugugca

SEQ ID NO: 1551642 - RNA, 14 nt, Homo sapiens
ggcuggguggcacc

SEQ ID NO: 1551643 - RNA, 15 nt, Homo sapiens
ggcuuuaaaagucau

SEQ ID NO: 1551644 - RNA, 20 nt, Homo sapiens
gggaaacccugcuguuucau

SEQ ID NO: 1551645 - RNA, 23 nt, Homo sapiens
gggaagaugcccucaacucaccc

SEQ ID NO: 1551646 - RNA, 22 nt, Homo sapiens
gggaagcucccacacccaccuc

SEQ ID NO: 1551647 - RNA, 19 nt, Homo sapiens
gggaauacaucuguggaca

SEQ ID NO: 1551648 - RNA, 16 nt, Homo sapiens
gggauagcgcuguuga

SEQ ID NO: 1551649 - RNA, 22 nt, Homo sapiens
gggcaaaugaauuucaugugaa

SEQ ID NO: 1551650 - RNA, 23 nt, Homo sapiens
gggccaaaaugugaggguggugg

SEQ ID NO: 1551651 - RNA, 23 nt, Homo sapiens
gggcccuuucuugcacuguccag

SEQ ID NO: 1551652 - RNA, 18 nt, Homo sapiens
gggccucgacgucccuug

SEQ ID NO: 1551653 - RNA, 15 nt, Homo sapiens
gggcuggucaccucc

SEQ ID NO: 1551654 - RNA, 14 nt, Homo sapiens
gggcuucaggucuc

SEQ ID NO: 1551655 - RNA, 18 nt, Homo sapiens
ggggagaagacaaaugaa

SEQ ID NO: 1551656 - RNA, 18 nt, Homo sapiens
ggguuucuugacaauggg

SEQ ID NO: 1551657 - RNA, 20 nt, Homo sapiens
gguaauauaaaguguaauag

SEQ ID NO: 1551658 - RNA, 20 nt, Homo sapiens
gguucaugcuucuacuguga

SEQ ID NO: 1551659 - RNA, 17 nt, Homo sapiens
guaaaaccugagccauu

SEQ ID NO: 1551660 - RNA, 14 nt, Homo sapiens
guaacauagacaaa

SEQ ID NO: 1551661 - RNA, 13 nt, Homo sapiens
guaacuuacuuag

SEQ ID NO: 1551662 - RNA, 14 nt, Homo sapiens
guacaagcaguuaa

SEQ ID NO: 1551663 - RNA, 20 nt, Homo sapiens
guagccaaagguucacucuc

SEQ ID NO: 1551664 - RNA, 19 nt, Homo sapiens
guagccucugggaucugcc

SEQ ID NO: 1551665 - RNA, 19 nt, Homo sapiens
guagccuuagagcaucucu

SEQ ID NO: 1551666 - RNA, 17 nt, Homo sapiens
guagguaccauggccau

SEQ ID NO: 1551667 - RNA, 20 nt, Homo sapiens
guauccaauaggcauuugau

SEQ ID NO: 1551668 - RNA, 16 nt, Homo sapiens
guaugcagaauguuuu

SEQ ID NO: 1551669 - RNA, 18 nt, Homo sapiens
guauuaauaaagcauucu

SEQ ID NO: 1551670 - RNA, 16 nt, Homo sapiens
guauuggaaauggaug

SEQ ID NO: 1551671 - RNA, 20 nt, Homo sapiens
guauuuuguuuuugucuuaa

SEQ ID NO: 1551672 - RNA, 20 nt, Homo sapiens
gucaccuccuuccccagcuc

SEQ ID NO: 1551673 - RNA, 18 nt, Homo sapiens
guccaacucuuccaccuc

SEQ ID NO: 1551674 - RNA, 18 nt, Homo sapiens
gucccuccucagaccucc

SEQ ID NO: 1551675 - RNA, 17 nt, Homo sapiens
guccuaggucaugaagg

SEQ ID NO: 1551676 - RNA, 16 nt, Homo sapiens
guccugauggcccaaa

SEQ ID NO: 1551677 - RNA, 23 nt, Homo sapiens
guccuugaacccaggccaugugg

SEQ ID NO: 1551678 - RNA, 12 nt, Homo sapiens
guccuuucuuuu

SEQ ID NO: 1551679 - RNA, 22 nt, Homo sapiens
guccuuucuuuugaaaugccac

SEQ ID NO: 1551680 - RNA, 14 nt, Homo sapiens
gucugaauugagaa

SEQ ID NO: 1551681 - RNA, 17 nt, Homo sapiens
gucuugacgggagcauu

SEQ ID NO: 1551682 - RNA, 11 nt, Homo sapiens
gucuuguucug

SEQ ID NO: 1551683 - RNA, 17 nt, Homo sapiens
gucuuguucugugauga

SEQ ID NO: 1551684 - RNA, 13 nt, Homo sapiens
gugagaaggcaac

SEQ ID NO: 1551685 - RNA, 12 nt, Homo sapiens
gugcaucuggca

SEQ ID NO: 1551686 - RNA, 21 nt, Homo sapiens
gugccaugcccuuacacgugc

SEQ ID NO: 1551687 - RNA, 24 nt, Homo sapiens
gugccucuuuucaguagugagcag

SEQ ID NO: 1551688 - RNA, 20 nt, Homo sapiens
guggacaaagucaacuucca

SEQ ID NO: 1551689 - RNA, 22 nt, Homo sapiens
guggcuuugcauagcuuucaca

SEQ ID NO: 1551690 - RNA, 21 nt, Homo sapiens
gugggaaggucccuuguuucc

SEQ ID NO: 1551691 - RNA, 13 nt, Homo sapiens
gugggugggaugg

SEQ ID NO: 1551692 - RNA, 11 nt, Homo sapiens
gugggugguga

SEQ ID NO: 1551693 - RNA, 19 nt, Homo sapiens
guggguuugggguggggaa

SEQ ID NO: 1551694 - RNA, 13 nt, Homo sapiens
gugguauguauau

SEQ ID NO: 1551695 - RNA, 19 nt, Homo sapiens
gugucauuggggggaccgu

SEQ ID NO: 1551696 - RNA, 15 nt, Homo sapiens
gugucauuucauucc

SEQ ID NO: 1551697 - RNA, 16 nt, Homo sapiens
gugucauuucuuuuag

SEQ ID NO: 1551698 - RNA, 18 nt, Homo sapiens
gugucugcucucauccau

SEQ ID NO: 1551699 - RNA, 19 nt, Homo sapiens
gugucuggcaggcuacucu

SEQ ID NO: 1551700 - RNA, 23 nt, Homo sapiens
gugucuggcaggcuacucugccc

SEQ ID NO: 1551701 - RNA, 14 nt, Homo sapiens
gugugugcaugugc

SEQ ID NO: 1551702 - RNA, 14 nt, Homo sapiens
guguucaguguuga

SEQ ID NO: 1551703 - RNA, 13 nt, Homo sapiens
auuguacaagcag

SEQ ID NO: 1551704 - RNA, 21 nt, Homo sapiens
auuguuccaaaugaauguugu

SEQ ID NO: 1551705 - RNA, 19 nt, Homo sapiens
auuuaaagaaagaaugcau

SEQ ID NO: 1551706 - RNA, 13 nt, Homo sapiens
auuuaucugcaag

SEQ ID NO: 1551707 - RNA, 19 nt, Homo sapiens
auuucaugugaaucccuuu

SEQ ID NO: 1551708 - RNA, 18 nt, Homo sapiens
auuucuuaaugucuguca

SEQ ID NO: 1551709 - RNA, 20 nt, Homo sapiens
auuugaaaacaaacuucucg

SEQ ID NO: 1551710 - RNA, 16 nt, Homo sapiens
auuugcugaauacaga

SEQ ID NO: 1551711 - RNA, 22 nt, Homo sapiens
auuuggaguucacagccuagaa

SEQ ID NO: 1551712 - RNA, 16 nt, Homo sapiens
auuuggcuugcuguuu

SEQ ID NO: 1551713 - RNA, 14 nt, Homo sapiens
auuuuagauauuau

SEQ ID NO: 1551714 - RNA, 19 nt, Homo sapiens
auuuuauucccaagcucua

SEQ ID NO: 1551715 - RNA, 19 nt, Homo sapiens
auuuucccuacuugcagcg

SEQ ID NO: 1551716 - RNA, 15 nt, Homo sapiens
auuuucuggaaugga

SEQ ID NO: 1551717 - RNA, 21 nt, Homo sapiens
auuuuguuuuugucuuaaaaa

SEQ ID NO: 1551718 - RNA, 22 nt, Homo sapiens
auuuuucauggcaacaucagcu

SEQ ID NO: 1551719 - RNA, 19 nt, Homo sapiens
auuuuugugaaaaugucaa

SEQ ID NO: 1551720 - RNA, 18 nt, Homo sapiens
auuuuuuuuaaaucaaaa

SEQ ID NO: 1551721 - RNA, 16 nt, Homo sapiens
caaaaaaagaaaaaga

SEQ ID NO: 1551722 - RNA, 17 nt, Homo sapiens
caaaauaaagaauagca

SEQ ID NO: 1551723 - RNA, 14 nt, Homo sapiens
caaaauguacuuaa

SEQ ID NO: 1551724 - RNA, 15 nt, Homo sapiens
caaaauuguuuacca

SEQ ID NO: 1551725 - RNA, 16 nt, Homo sapiens
caaacauuguuuuauu

SEQ ID NO: 1551726 - RNA, 18 nt, Homo sapiens
caaaccagcccuugaguc

SEQ ID NO: 1551727 - RNA, 23 nt, Homo sapiens
caaaccagcccuugagucuguca

SEQ ID NO: 1551728 - RNA, 13 nt, Homo sapiens
caaaucacugcau

SEQ ID NO: 1551729 - RNA, 21 nt, Homo sapiens
caacccagcaguucucugcca

SEQ ID NO: 1551730 - RNA, 22 nt, Homo sapiens
caacucaagugucaccuccuuc

SEQ ID NO: 1551731 - RNA, 13 nt, Homo sapiens
caacucaucuuag

SEQ ID NO: 1551732 - RNA, 15 nt, Homo sapiens
caacugcauaaccuu

SEQ ID NO: 1551733 - RNA, 23 nt, Homo sapiens
caagaacauuaucuuaguggaag

SEQ ID NO: 1551734 - RNA, 20 nt, Homo sapiens
caagacucuuuggacacuca

SEQ ID NO: 1551735 - RNA, 13 nt, Homo sapiens
caagcauuacuuu

SEQ ID NO: 1551736 - RNA, 14 nt, Homo sapiens
caagccuuacucac

SEQ ID NO: 1551737 - RNA, 18 nt, Homo sapiens
caagcuuaaagcuugauu

SEQ ID NO: 1551738 - RNA, 22 nt, Homo sapiens
caaggccggagacccacagccc

SEQ ID NO: 1551739 - RNA, 14 nt, Homo sapiens
caaggcugcaguga

SEQ ID NO: 1551740 - RNA, 15 nt, Homo sapiens
caaggcugcagugag

SEQ ID NO: 1551741 - RNA, 19 nt, Homo sapiens
caaggcugggggaagaagc

SEQ ID NO: 1551742 - RNA, 17 nt, Homo sapiens
caagggcaucauccuca

SEQ ID NO: 1551743 - RNA, 15 nt, Homo sapiens
caagugccuuagcaa

SEQ ID NO: 1551744 - RNA, 15 nt, Homo sapiens
caagugucaccuccu

SEQ ID NO: 1551745 - RNA, 22 nt, Homo sapiens
caaguuggaaauauucaugcuu

SEQ ID NO: 1551746 - RNA, 12 nt, Homo sapiens
caaugaugcccu

SEQ ID NO: 1551747 - RNA, 12 nt, Homo sapiens
cgggauucccug

SEQ ID NO: 1551748 - RNA, 23 nt, Homo sapiens
cgguggcucccaagccacauuca

SEQ ID NO: 1551749 - RNA, 17 nt, Homo sapiens
cguaauuguacaagcag

SEQ ID NO: 1551750 - RNA, 16 nt, Homo sapiens
cuaaagcuucuauaaa

SEQ ID NO: 1551751 - RNA, 18 nt, Homo sapiens
cuaaagggagaaaugcca

SEQ ID NO: 1551752 - RNA, 13 nt, Homo sapiens
cuaagaagggaac

SEQ ID NO: 1551753 - RNA, 14 nt, Homo sapiens
cuaauacuaauuca

SEQ ID NO: 1551754 - RNA, 22 nt, Homo sapiens
cuaauggaguguuugaaaacug

SEQ ID NO: 1551755 - RNA, 21 nt, Homo sapiens
cuaauguuggacagacacugu

SEQ ID NO: 1551756 - RNA, 16 nt, Homo sapiens
cuacagaaaaaggaaa

SEQ ID NO: 1551757 - RNA, 14 nt, Homo sapiens
cuaccaauguagac

SEQ ID NO: 1551758 - RNA, 13 nt, Homo sapiens
cuacccuguguau

SEQ ID NO: 1551759 - RNA, 19 nt, Homo sapiens
cuacggggaaaaugcauuu

SEQ ID NO: 1551760 - RNA, 21 nt, Homo sapiens
cuacuccuggagcacuguaaa

SEQ ID NO: 1551761 - RNA, 20 nt, Homo sapiens
cuagaaauaagcccaacaga

SEQ ID NO: 1551762 - RNA, 16 nt, Homo sapiens
cuagacugugucugaa

SEQ ID NO: 1551763 - RNA, 22 nt, Homo sapiens
cuagaggacacuaggagacugg

SEQ ID NO: 1551764 - RNA, 17 nt, Homo sapiens
cuaggcauuugcugaau

SEQ ID NO: 1551765 - RNA, 22 nt, Homo sapiens
cuaguaaguaauuaugcacuaa

SEQ ID NO: 1551766 - RNA, 23 nt, Homo sapiens
cuauaaguguucaguguugacau

SEQ ID NO: 1551767 - RNA, 14 nt, Homo sapiens
cuaucuagcauuua

SEQ ID NO: 1551768 - RNA, 14 nt, Homo sapiens
cuauuccaaagugc

SEQ ID NO: 1551769 - RNA, 16 nt, Homo sapiens
cuauuggcuuacugaa

SEQ ID NO: 1551770 - RNA, 16 nt, Homo sapiens
cuauuuauauaucaua

SEQ ID NO: 1551771 - RNA, 17 nt, Homo sapiens
cuauuuauauaucauag

SEQ ID NO: 1551772 - RNA, 12 nt, Homo sapiens
cucaacaagcaa

SEQ ID NO: 1551773 - RNA, 20 nt, Homo sapiens
cucaacaagcaagaucugcu

SEQ ID NO: 1551774 - RNA, 18 nt, Homo sapiens
cucaagugucaccuccuu

SEQ ID NO: 1551775 - RNA, 18 nt, Homo sapiens
cucaggaguuugagacca

SEQ ID NO: 1551776 - RNA, 15 nt, Homo sapiens
cucagucaugcacuc

SEQ ID NO: 1551777 - RNA, 15 nt, Homo sapiens
cucauagauugcaaa

SEQ ID NO: 1551778 - RNA, 21 nt, Homo sapiens
cucaugccacagugguacucu

SEQ ID NO: 1551779 - RNA, 17 nt, Homo sapiens
cuccacccacuagguga

SEQ ID NO: 1551780 - RNA, 22 nt, Homo sapiens
cuccacuggucugucuuuggau

SEQ ID NO: 1551781 - RNA, 21 nt, Homo sapiens
cuccagcccugggacagggca

SEQ ID NO: 1551782 - RNA, 14 nt, Homo sapiens
cucccacaaaggag

SEQ ID NO: 1551783 - RNA, 23 nt, Homo sapiens
cucccaucccguaagaccaccuu

SEQ ID NO: 1551784 - RNA, 22 nt, Homo sapiens
cucccugucucugcaucugacu

SEQ ID NO: 1551785 - RNA, 21 nt, Homo sapiens
cucccuugcuuuuugcugugu

SEQ ID NO: 1551786 - RNA, 16 nt, Homo sapiens
cuccuggcccacugca

SEQ ID NO: 1551787 - RNA, 15 nt, Homo sapiens
cucuauaaguguuca

SEQ ID NO: 1551788 - RNA, 20 nt, Homo sapiens
cucucuuuguucucagcucc

SEQ ID NO: 1551789 - RNA, 13 nt, Homo sapiens
cucugaaaaccaa

SEQ ID NO: 1551790 - RNA, 22 nt, Homo sapiens
gacuaagagaaaccuugcaaac

SEQ ID NO: 1551791 - RNA, 22 nt, Homo sapiens
gacugugaacugggcauuucac

SEQ ID NO: 1551792 - RNA, 23 nt, Homo sapiens
gagaaaaaauauuuuccugccag

SEQ ID NO: 1551793 - RNA, 20 nt, Homo sapiens
gagaaaaugaauggacaaag

SEQ ID NO: 1551794 - RNA, 13 nt, Homo sapiens
gagaagcuggaag

SEQ ID NO: 1551795 - RNA, 11 nt, Homo sapiens
gagaagggaca

SEQ ID NO: 1551796 - RNA, 19 nt, Homo sapiens
gagaaguugagcagguauc

SEQ ID NO: 1551797 - RNA, 17 nt, Homo sapiens
gagacugguuaggacaa

SEQ ID NO: 1551798 - RNA, 21 nt, Homo sapiens
gagaguuccucuuugcccuga

SEQ ID NO: 1551799 - RNA, 14 nt, Homo sapiens
gagcaacauaucag

SEQ ID NO: 1551800 - RNA, 12 nt, Homo sapiens
gagcacuguaaa

SEQ ID NO: 1551801 - RNA, 21 nt, Homo sapiens
gagcauuggccccugagccca

SEQ ID NO: 1551802 - RNA, 20 nt, Homo sapiens
gagccaccagggcacugucu

SEQ ID NO: 1551803 - RNA, 18 nt, Homo sapiens
gagccccucaugccacag

SEQ ID NO: 1551804 - RNA, 13 nt, Homo sapiens
gagcccugucccu

SEQ ID NO: 1551805 - RNA, 14 nt, Homo sapiens
gagcccuuaugaca

SEQ ID NO: 1551806 - RNA, 15 nt, Homo sapiens
gaggaacacagagaa

SEQ ID NO: 1551807 - RNA, 23 nt, Homo sapiens
gaggagccuggagagaaggggca

SEQ ID NO: 1551808 - RNA, 19 nt, Homo sapiens
gaggauugcuugagcucag

SEQ ID NO: 1551809 - RNA, 19 nt, Homo sapiens
gaggcuaacccugauccau

SEQ ID NO: 1551810 - RNA, 20 nt, Homo sapiens
gaggucaaggcugcagugag

SEQ ID NO: 1551811 - RNA, 17 nt, Homo sapiens
gaguagguacuccauaa

SEQ ID NO: 1551812 - RNA, 18 nt, Homo sapiens
gauauuacuacuuaccau

SEQ ID NO: 1551813 - RNA, 15 nt, Homo sapiens
gaucagcacugccag

SEQ ID NO: 1551814 - RNA, 20 nt, Homo sapiens
gaucagccugggcaauguga

SEQ ID NO: 1551815 - RNA, 20 nt, Homo sapiens
gaucuuuguuuaaaugccaa

SEQ ID NO: 1551816 - RNA, 15 nt, Homo sapiens
gaugaacgugccuga

SEQ ID NO: 1551817 - RNA, 21 nt, Homo sapiens
gaugaagaccaggacuacagc

SEQ ID NO: 1551818 - RNA, 16 nt, Homo sapiens
gaugauaaaacacaaa

SEQ ID NO: 1551819 - RNA, 20 nt, Homo sapiens
gauggagcaggucuuuggga

SEQ ID NO: 1551820 - RNA, 18 nt, Homo sapiens
gauggaggccuaccucuc

SEQ ID NO: 1551821 - RNA, 22 nt, Homo sapiens
gaugggccaccgccgacuuugu

SEQ ID NO: 1551822 - RNA, 17 nt, Homo sapiens
gauuagaugacucucag

SEQ ID NO: 1551823 - RNA, 23 nt, Homo sapiens
gauuauugcuucuuuccuugcau

SEQ ID NO: 1551824 - RNA, 19 nt, Homo sapiens
gauucagcucccacacaca

SEQ ID NO: 1551825 - RNA, 15 nt, Homo sapiens
gauugaggacuacuu

SEQ ID NO: 1551826 - RNA, 22 nt, Homo sapiens
gcaaacaaacaagcuuacuucc

SEQ ID NO: 1551827 - RNA, 15 nt, Homo sapiens
gcaaauaaagccuuu

SEQ ID NO: 1551828 - RNA, 23 nt, Homo sapiens
gcaaauccagucccaaugguccu

SEQ ID NO: 1551829 - RNA, 19 nt, Homo sapiens
gcaaccaaagugcaggaca

SEQ ID NO: 1551830 - RNA, 20 nt, Homo sapiens
gcaagucauugagugacuuu

SEQ ID NO: 1551831 - RNA, 17 nt, Homo sapiens
gcaagugaacuugggag

SEQ ID NO: 1551832 - RNA, 17 nt, Homo sapiens
gcaagugagacccuguc

SEQ ID NO: 1551833 - RNA, 17 nt, Homo sapiens
gcaauacagacuacuuc

SEQ ID NO: 1551834 - RNA, 22 nt, Homo sapiens
gcaauacagacuacuucuuccc

SEQ ID NO: 1551835 - RNA, 17 nt, Homo sapiens
gcaauuuucgaacauuc

SEQ ID NO: 1551836 - RNA, 23 nt, Homo sapiens
gcacaauuaauuaaaagugaaac

SEQ ID NO: 1551837 - RNA, 18 nt, Homo sapiens
gcacauuuccucucuauc

SEQ ID NO: 1551838 - RNA, 20 nt, Homo sapiens
gcacuguccagcugguugua

SEQ ID NO: 1551839 - RNA, 19 nt, Homo sapiens
gcagaacguauuuagccau

SEQ ID NO: 1551840 - RNA, 12 nt, Homo sapiens
gcagagccacca

SEQ ID NO: 1551841 - RNA, 18 nt, Homo sapiens
gcagauguuuaaugaagu

SEQ ID NO: 1551842 - RNA, 19 nt, Homo sapiens
gcagccuggggucugacaa

SEQ ID NO: 1551843 - RNA, 18 nt, Homo sapiens
gcaggacuaaaugucuag

SEQ ID NO: 1551844 - RNA, 23 nt, Homo sapiens
gcagguuggugggggccucggug

SEQ ID NO: 1551845 - RNA, 18 nt, Homo sapiens
gcauaucaaaaaguauua

SEQ ID NO: 1551846 - RNA, 23 nt, Homo sapiens
gcaucacugauucccucucccac

SEQ ID NO: 1551847 - RNA, 15 nt, Homo sapiens
gcauuugauuuugcc

SEQ ID NO: 1551848 - RNA, 15 nt, Homo sapiens
gccagcgcgaugaac

SEQ ID NO: 1551849 - RNA, 19 nt, Homo sapiens
gccagcuuaucucaggggu

SEQ ID NO: 1551850 - RNA, 14 nt, Homo sapiens
gccaggagcccugg

SEQ ID NO: 1551851 - RNA, 20 nt, Homo sapiens
gccaggauccucuccuuuga

SEQ ID NO: 1551852 - RNA, 18 nt, Homo sapiens
gccaggcaugguggccca

SEQ ID NO: 1551853 - RNA, 21 nt, Homo sapiens
gccagugcuaagcugcccuga

SEQ ID NO: 1551854 - RNA, 21 nt, Homo sapiens
gccaucugugcacacuaagaa

SEQ ID NO: 1551855 - RNA, 21 nt, Homo sapiens
gcccaaaugucaggguucugc

SEQ ID NO: 1551856 - RNA, 15 nt, Homo sapiens
gccccuggcccagag

SEQ ID NO: 1551857 - RNA, 18 nt, Homo sapiens
gcccugggacagggcaaa

SEQ ID NO: 1551858 - RNA, 14 nt, Homo sapiens
gcccuugucugaga

SEQ ID NO: 1551859 - RNA, 17 nt, Homo sapiens
gcccuugucugagaugc

SEQ ID NO: 1551860 - RNA, 20 nt, Homo sapiens
gcccuugucugagaugcugg

SEQ ID NO: 1551861 - RNA, 18 nt, Homo sapiens
gccgaaaacaggagcaaa

SEQ ID NO: 1551862 - RNA, 23 nt, Homo sapiens
gccugccgaaaacaggagcaaau

SEQ ID NO: 1551863 - RNA, 14 nt, Homo sapiens
gccugccucuucuc

SEQ ID NO: 1551864 - RNA, 20 nt, Homo sapiens
ugccaagggggugacuggaa

SEQ ID NO: 1551865 - RNA, 16 nt, Homo sapiens
ugccaccggaggucac

SEQ ID NO: 1551866 - RNA, 18 nt, Homo sapiens
ugccucagccaguggcac

SEQ ID NO: 1551867 - RNA, 20 nt, Homo sapiens
ugccucagccaguggcacag

SEQ ID NO: 1551868 - RNA, 13 nt, Homo sapiens
ugccuccagcauu

SEQ ID NO: 1551869 - RNA, 16 nt, Homo sapiens
ugccugaacuccagag

SEQ ID NO: 1551870 - RNA, 21 nt, Homo sapiens
ugccuguuaaggaaacuuuau

SEQ ID NO: 1551871 - RNA, 21 nt, Homo sapiens
ugcuccucaccccuguaggga

SEQ ID NO: 1551872 - RNA, 18 nt, Homo sapiens
ugcucuccuccaccucaa

SEQ ID NO: 1551873 - RNA, 22 nt, Homo sapiens
ugcuuaaaagguuaaauuucaa

SEQ ID NO: 1551874 - RNA, 14 nt, Homo sapiens
ugcuuggauuuuga

SEQ ID NO: 1551875 - RNA, 16 nt, Homo sapiens
uggacaauggacugua

SEQ ID NO: 1551876 - RNA, 19 nt, Homo sapiens
uggacaauggacuguacaa

SEQ ID NO: 1551877 - RNA, 16 nt, Homo sapiens
uggacuguaacugacu

SEQ ID NO: 1551878 - RNA, 21 nt, Homo sapiens
uggauaugacccacacugcca

SEQ ID NO: 1551879 - RNA, 16 nt, Homo sapiens
uggaucagagcauuua

SEQ ID NO: 1551880 - RNA, 17 nt, Homo sapiens
uggauuugccugugcca

SEQ ID NO: 1551881 - RNA, 16 nt, Homo sapiens
uggcacaggagacucc

SEQ ID NO: 1551882 - RNA, 18 nt, Homo sapiens
uggcagaaugaaaaucag

SEQ ID NO: 1551883 - RNA, 14 nt, Homo sapiens
ugggcagaaagugg

SEQ ID NO: 1551884 - RNA, 22 nt, Homo sapiens
ugggcagacugaaccaguccag

SEQ ID NO: 1551885 - RNA, 12 nt, Homo sapiens
ugggcaggguga

SEQ ID NO: 1551886 - RNA, 19 nt, Homo sapiens
ugggcugccugcuguguua

SEQ ID NO: 1551887 - RNA, 20 nt, Homo sapiens
uggggaaaauggccaugcag

SEQ ID NO: 1551888 - RNA, 22 nt, Homo sapiens
ugggggaaugcaccuccccaaa

SEQ ID NO: 1551889 - RNA, 18 nt, Homo sapiens
ugggggagggaagaccag

SEQ ID NO: 1551890 - RNA, 13 nt, Homo sapiens
ugguacuacugua

SEQ ID NO: 1551891 - RNA, 15 nt, Homo sapiens
uguaaacacauguuc

SEQ ID NO: 1551892 - RNA, 16 nt, Homo sapiens
uguaaacuacaaagua

SEQ ID NO: 1551893 - RNA, 14 nt, Homo sapiens
uguaagauuuucca

SEQ ID NO: 1551894 - RNA, 19 nt, Homo sapiens
uguaauauuucuucaaaua

SEQ ID NO: 1551895 - RNA, 18 nt, Homo sapiens
uguacaaaauaacucucc

SEQ ID NO: 1551896 - RNA, 20 nt, Homo sapiens
uguacaauaaguuacuugaa

SEQ ID NO: 1551897 - RNA, 18 nt, Homo sapiens
uguacaaugguuuauucc

SEQ ID NO: 1551898 - RNA, 13 nt, Homo sapiens
uguacaccaaggu

SEQ ID NO: 1551899 - RNA, 19 nt, Homo sapiens
uguacgcugcugcaggaca

SEQ ID NO: 1551900 - RNA, 23 nt, Homo sapiens
ugucccuuucuuggccaguuauc

SEQ ID NO: 1551901 - RNA, 18 nt, Homo sapiens
uguccggcccagugccac

SEQ ID NO: 1551902 - RNA, 18 nt, Homo sapiens
uguccuuuuucacuuuga

SEQ ID NO: 1551903 - RNA, 20 nt, Homo sapiens
uguccuuuuucacuuugaaa

SEQ ID NO: 1551904 - RNA, 15 nt, Homo sapiens
ugucgggacaugguu

SEQ ID NO: 1551905 - RNA, 18 nt, Homo sapiens
ugucuauuaucacauuaa

SEQ ID NO: 1551906 - RNA, 22 nt, Homo sapiens
ugucuauugucaagaugcuaca

SEQ ID NO: 1551907 - RNA, 13 nt, Homo sapiens
ugucugccaaaca

SEQ ID NO: 1551908 - RNA, 21 nt, Homo sapiens
ugugaacccuugugccucuca

SEQ ID NO: 1551909 - RNA, 17 nt, Homo sapiens
ugugaguguaaguguga

SEQ ID NO: 1551910 - RNA, 13 nt, Homo sapiens
uguggacugugau

SEQ ID NO: 1551911 - RNA, 14 nt, Homo sapiens
ugugggcugugagu

SEQ ID NO: 1551912 - RNA, 16 nt, Homo sapiens
uguguauguuugcaca

SEQ ID NO: 1551913 - RNA, 14 nt, Homo sapiens
uguguggacuguga

SEQ ID NO: 1551914 - RNA, 18 nt, Homo sapiens
uguguguauguuugcaca

SEQ ID NO: 1551915 - RNA, 18 nt, Homo sapiens
uguguuuuuaacauguca

SEQ ID NO: 1551916 - RNA, 19 nt, Homo sapiens
uguuacugucugacuacaa

SEQ ID NO: 1551917 - RNA, 14 nt, Homo sapiens
uguucugugccugc

SEQ ID NO: 1551918 - RNA, 21 nt, Homo sapiens
uguuucgcauuaagcacacac

SEQ ID NO: 1551919 - RNA, 14 nt, Homo sapiens
uguuugcauaaagu

SEQ ID NO: 1551920 - RNA, 22 nt, Homo sapiens
uuaaaauaaugaacacuacaga

SEQ ID NO: 1551921 - RNA, 20 nt, Homo sapiens
uuaaacuguguggacuguga

SEQ ID NO: 1551922 - RNA, 11 nt, Homo sapiens
uuaaacuuaaa

SEQ ID NO: 1551923 - RNA, 20 nt, Homo sapiens
uuaaaggaacagagugagag

SEQ ID NO: 1551924 - RNA, 16 nt, Homo sapiens
uuaaaugaccaaagau

SEQ ID NO: 1551925 - RNA, 16 nt, Homo sapiens
uuaaauggacaaugga

SEQ ID NO: 1551926 - RNA, 14 nt, Homo sapiens
uuaagcagaacaaa

SEQ ID NO: 1551927 - RNA, 20 nt, Homo sapiens
uuaauauuuuuccacuuaaa

SEQ ID NO: 1551928 - RNA, 15 nt, Homo sapiens
uuaaugagacaugaa

SEQ ID NO: 1551929 - RNA, 12 nt, Homo sapiens
uuacaaacagac

SEQ ID NO: 1551930 - RNA, 12 nt, Homo sapiens
uuacagaauuau

SEQ ID NO: 1551931 - RNA, 16 nt, Homo sapiens
uuacuuuucacacugu

SEQ ID NO: 1551932 - RNA, 20 nt, Homo sapiens
uuaguaaugcucugaccaag

SEQ ID NO: 1551933 - RNA, 14 nt, Homo sapiens
uuauaacagaauua

SEQ ID NO: 1551934 - RNA, 22 nt, Homo sapiens
uuauaacagaauuaaaguagau

SEQ ID NO: 1551935 - RNA, 14 nt, Homo sapiens
uuauauaauucuga

SEQ ID NO: 1551936 - RNA, 22 nt, Homo sapiens
uucaaacugcugcauacuuuga

SEQ ID NO: 1551937 - RNA, 13 nt, Homo sapiens
uucaaaguuaaaa

SEQ ID NO: 1551938 - RNA, 22 nt, Homo sapiens
uucaaaucacauggaacuuuag

SEQ ID NO: 1551939 - RNA, 12 nt, Homo sapiens
uucaaaugaaac

SEQ ID NO: 1551940 - RNA, 20 nt, Homo sapiens
uucaagcaaaaugcuuacag

SEQ ID NO: 1551941 - RNA, 19 nt, Homo sapiens
uucacaguaauaugguucc

SEQ ID NO: 1551942 - RNA, 14 nt, Homo sapiens
uucagaagacacug

SEQ ID NO: 1551943 - RNA, 16 nt, Homo sapiens
uucagcccuaacauag

SEQ ID NO: 1551944 - RNA, 19 nt, Homo sapiens
uucagcuucuaugcauuaa

SEQ ID NO: 1551945 - RNA, 21 nt, Homo sapiens
uucaguucagauaauuggcaa

SEQ ID NO: 1551946 - RNA, 14 nt, Homo sapiens
uucccgaugaacaa

SEQ ID NO: 1551947 - RNA, 21 nt, Homo sapiens
uucccugaggaaugaaaaagg

SEQ ID NO: 1551948 - RNA, 13 nt, Homo sapiens
uuccuugccuuaa

SEQ ID NO: 1551949 - RNA, 15 nt, Homo sapiens
uucgugacaacaugc

SEQ ID NO: 1551950 - RNA, 19 nt, Homo sapiens
uucuaauaacugcaguguu

SEQ ID NO: 1551951 - RNA, 14 nt, Homo sapiens
uaaaaguaaauuca

SEQ ID NO: 1551952 - RNA, 19 nt, Homo sapiens
uaaaaguaaauucauguaa

SEQ ID NO: 1551953 - RNA, 13 nt, Homo sapiens
uaaaauucuguca

SEQ ID NO: 1551954 - RNA, 22 nt, Homo sapiens
uaaacacauguucugugccugc

SEQ ID NO: 1551955 - RNA, 15 nt, Homo sapiens
uaaacuacaaaguaa

SEQ ID NO: 1551956 - RNA, 17 nt, Homo sapiens
uaaauaaaaguacaguu

SEQ ID NO: 1551957 - RNA, 15 nt, Homo sapiens
uaaauccgacuugaa

SEQ ID NO: 1551958 - RNA, 18 nt, Homo sapiens
uaaauuuuauaacagaau

SEQ ID NO: 1551959 - RNA, 21 nt, Homo sapiens
uaaauuuuauaacagaauuaa

SEQ ID NO: 1551960 - RNA, 18 nt, Homo sapiens
uaagaagagacugggaag

SEQ ID NO: 1551961 - RNA, 20 nt, Homo sapiens
uaagauauucagaaguauau

SEQ ID NO: 1551962 - RNA, 18 nt, Homo sapiens
uaaggacaagacacugag

SEQ ID NO: 1551963 - RNA, 13 nt, Homo sapiens
uaaguguucucau

SEQ ID NO: 1551964 - RNA, 16 nt, Homo sapiens
uaauaacugcaguguu

SEQ ID NO: 1551965 - RNA, 17 nt, Homo sapiens
uaauauccaagacuuag

SEQ ID NO: 1551966 - RNA, 21 nt, Homo sapiens
uaaucagauugacagcauaua

SEQ ID NO: 1551967 - RNA, 12 nt, Homo sapiens
uaauuauugcuu

SEQ ID NO: 1551968 - RNA, 22 nt, Homo sapiens
uacaacaugcaucaugcucaug

SEQ ID NO: 1551969 - RNA, 19 nt, Homo sapiens
uacaauaaguuacuugaaa

SEQ ID NO: 1551970 - RNA, 18 nt, Homo sapiens
uacacugauacacuugaa

SEQ ID NO: 1551971 - RNA, 21 nt, Homo sapiens
uacagauagaaaauaugauau

SEQ ID NO: 1551972 - RNA, 20 nt, Homo sapiens
uacaggcaguuaggugcuga

SEQ ID NO: 1551973 - RNA, 20 nt, Homo sapiens
uacaguucugggguacaugu

SEQ ID NO: 1551974 - RNA, 20 nt, Homo sapiens
uacauauuugucuauuguca

SEQ ID NO: 1551975 - RNA, 18 nt, Homo sapiens
uacaucagaaguuugcau

SEQ ID NO: 1551976 - RNA, 21 nt, Homo sapiens
uacccuuuggccccacuuuga

SEQ ID NO: 1551977 - RNA, 22 nt, Homo sapiens
uacccuuuggccccacuuugaa

SEQ ID NO: 1551978 - RNA, 22 nt, Homo sapiens
uacuacuguaagagacaugaau

SEQ ID NO: 1551979 - RNA, 13 nt, Homo sapiens
uacucaacccauu

SEQ ID NO: 1551980 - RNA, 12 nt, Homo sapiens
uacuguacuuaa

SEQ ID NO: 1551981 - RNA, 23 nt, Homo sapiens
uacuguuuugggccuccaugccc

SEQ ID NO: 1551982 - RNA, 19 nt, Homo sapiens
uacuuaagagugcugugua

SEQ ID NO: 1551983 - RNA, 12 nt, Homo sapiens
uacuuugugcau

SEQ ID NO: 1551984 - RNA, 17 nt, Homo sapiens
uacuuuucacacugucu

SEQ ID NO: 1551985 - RNA, 17 nt, Homo sapiens
uagacagguguuacuua

SEQ ID NO: 1551986 - RNA, 20 nt, Homo sapiens
uagccuaaaugauggugcuu

SEQ ID NO: 1551987 - RNA, 16 nt, Homo sapiens
uagcugacuacaaauu

SEQ ID NO: 1551988 - RNA, 14 nt, Homo sapiens
uaggcuacaguguc

SEQ ID NO: 1551989 - RNA, 13 nt, Homo sapiens
uaguaaugcucug

SEQ ID NO: 1551990 - RNA, 17 nt, Homo sapiens
uaguaaugcucugacca

SEQ ID NO: 1551991 - RNA, 14 nt, Homo sapiens
uauaauucugaaau

SEQ ID NO: 1551992 - RNA, 14 nt, Homo sapiens
uauagaaguagcaa

SEQ ID NO: 1551993 - RNA, 18 nt, Homo sapiens
uauaguuccuugccuuaa

SEQ ID NO: 1551994 - RNA, 18 nt, Homo sapiens
uauauuuguaaacuacaa

SEQ ID NO: 1551995 - RNA, 16 nt, Homo sapiens
uaucacgccuacuuaa

SEQ ID NO: 1551996 - RNA, 21 nt, Homo sapiens
uaucaucggaguugacaguga

SEQ ID NO: 1551997 - RNA, 21 nt, Homo sapiens
uaugaacagcugugucugcca

SEQ ID NO: 1551998 - RNA, 15 nt, Homo sapiens
uaugacccacacugc

SEQ ID NO: 1551999 - RNA, 20 nt, Homo sapiens
uaugcuuucccugaggaaug

SEQ ID NO: 1552000 - RNA, 20 nt, Homo sapiens
uauucccaaguaugccuuaa

SEQ ID NO: 1552001 - RNA, 23 nt, Homo sapiens
uauuuuguauauuuguaaacuac

SEQ ID NO: 1552002 - RNA, 14 nt, Homo sapiens
ucaaaucucuucca

SEQ ID NO: 1552003 - RNA, 15 nt, Homo sapiens
ucaaaucucuuccac

SEQ ID NO: 1552004 - RNA, 17 nt, Homo sapiens
ucaagacuuagcuccug

SEQ ID NO: 1552005 - RNA, 20 nt, Homo sapiens
ucaaguucccaacugaguca

SEQ ID NO: 1552006 - RNA, 23 nt, Homo sapiens
ucaaucuguccguucacaugugu

SEQ ID NO: 1552007 - RNA, 19 nt, Homo sapiens
ucaauucccugaaaaacua

SEQ ID NO: 1552008 - RNA, 17 nt, Homo sapiens
ucacaacauuuacuuaa

SEQ ID NO: 1552009 - RNA, 20 nt, Homo sapiens
ucacaacauuuacuuaacag

SEQ ID NO: 1552010 - RNA, 14 nt, Homo sapiens
ucacagcugaagaa

SEQ ID NO: 1552011 - RNA, 14 nt, Homo sapiens
ucaccgugagcagc

SEQ ID NO: 1552012 - RNA, 16 nt, Homo sapiens
ucaggauacucuguca

SEQ ID NO: 1552013 - RNA, 16 nt, Homo sapiens
ucaguugcauucauua

SEQ ID NO: 1552014 - RNA, 22 nt, Homo sapiens
ucaugaagaaaacugauucucu

SEQ ID NO: 1552015 - RNA, 16 nt, Homo sapiens
ucaugguacuacccca

SEQ ID NO: 1552016 - RNA, 15 nt, Homo sapiens
ucauguuccucaaaa

SEQ ID NO: 1552017 - RNA, 22 nt, Homo sapiens
ucauuauucuuuuucaguuuua

SEQ ID NO: 1552018 - RNA, 13 nt, Homo sapiens
ucauuugaacaac

SEQ ID NO: 1552019 - RNA, 21 nt, Homo sapiens
uccaccucugauuacauguau

SEQ ID NO: 1552020 - RNA, 22 nt, Homo sapiens
uccacguuuuuggaaaauguau

SEQ ID NO: 1552021 - RNA, 16 nt, Homo sapiens
uccagccaguacagua

SEQ ID NO: 1552022 - RNA, 13 nt, Homo sapiens
uccagccuucuac

SEQ ID NO: 1552023 - RNA, 23 nt, Homo sapiens
uccagccuucuacugcucuccuc

SEQ ID NO: 1552024 - RNA, 17 nt, Homo sapiens
uccaucagcuguaagaa

SEQ ID NO: 1552025 - RNA, 19 nt, Homo sapiens
ucccagacaguggauauga

SEQ ID NO: 1552026 - RNA, 18 nt, Homo sapiens
ucccuacccuaaccaagu

SEQ ID NO: 1552027 - RNA, 18 nt, Homo sapiens
ucccuggaaaccuuccac

SEQ ID NO: 1552028 - RNA, 22 nt, Homo sapiens
uccugaaggaaaauaaacugac

SEQ ID NO: 1552029 - RNA, 21 nt, Homo sapiens
uccugcaggaaauauaaacuu

SEQ ID NO: 1552030 - RNA, 14 nt, Homo sapiens
uccuggucugugaa

SEQ ID NO: 1552031 - RNA, 15 nt, Homo sapiens
uccuucaaucuucau

SEQ ID NO: 1552032 - RNA, 19 nt, Homo sapiens
uccuugccugaacuccaga

SEQ ID NO: 1552033 - RNA, 14 nt, Homo sapiens
uccuuuuucacuuu

SEQ ID NO: 1552034 - RNA, 17 nt, Homo sapiens
ucgcauuaagcacacac

SEQ ID NO: 1552035 - RNA, 16 nt, Homo sapiens
ucgggaaauuuacaca

SEQ ID NO: 1552036 - RNA, 13 nt, Homo sapiens
ucgugacaacaug

SEQ ID NO: 1552037 - RNA, 23 nt, Homo sapiens
ccucuuaagaucugacugccaaa

SEQ ID NO: 1552038 - RNA, 18 nt, Homo sapiens
ccucuugcucagagcuag

SEQ ID NO: 1552039 - RNA, 19 nt, Homo sapiens
ccugaacuccagagguguc

SEQ ID NO: 1552040 - RNA, 19 nt, Homo sapiens
ccugaggaggaggacacag

SEQ ID NO: 1552041 - RNA, 16 nt, Homo sapiens
ccuggagccagggcag

SEQ ID NO: 1552042 - RNA, 18 nt, Homo sapiens
ccuggccaacauggcaaa

SEQ ID NO: 1552043 - RNA, 21 nt, Homo sapiens
ccuuggaagggcguucuaggu

SEQ ID NO: 1552044 - RNA, 21 nt, Homo sapiens
ccuuggagaggagaguggcag

SEQ ID NO: 1552045 - RNA, 16 nt, Homo sapiens
ccuuuuucacuuugaa

SEQ ID NO: 1552046 - RNA, 15 nt, Homo sapiens
cgcagggccaugcag

SEQ ID NO: 1552047 - RNA, 17 nt, Homo sapiens
cggaguugacagugaaa

SEQ ID NO: 1552048 - RNA, 13 nt, Homo sapiens
cgggccagggugg

SEQ ID NO: 1552049 - RNA, 17 nt, Homo sapiens
cgggucucaacuuuaag

SEQ ID NO: 1552050 - RNA, 13 nt, Homo sapiens
cggguguguacac

SEQ ID NO: 1552051 - RNA, 17 nt, Homo sapiens
cgugagcagcuuuggaa

SEQ ID NO: 1552052 - RNA, 21 nt, Homo sapiens
cuaaaauaauuuuauuaugca

SEQ ID NO: 1552053 - RNA, 17 nt, Homo sapiens
cuaacgacuucagggca

SEQ ID NO: 1552054 - RNA, 17 nt, Homo sapiens
cuaagauaauuuacuua

SEQ ID NO: 1552055 - RNA, 17 nt, Homo sapiens
cuaagugacaguaucac

SEQ ID NO: 1552056 - RNA, 20 nt, Homo sapiens
cuacaacaugcaucaugcuc

SEQ ID NO: 1552057 - RNA, 15 nt, Homo sapiens
cuacggguaggucua

SEQ ID NO: 1552058 - RNA, 17 nt, Homo sapiens
cuauaauaaaacuaaac

SEQ ID NO: 1552059 - RNA, 18 nt, Homo sapiens
cuaugcauuaagaguaaa

SEQ ID NO: 1552060 - RNA, 20 nt, Homo sapiens
cuccagcuugggcaacagag

SEQ ID NO: 1552061 - RNA, 14 nt, Homo sapiens
cuccaggaaugccu

SEQ ID NO: 1552062 - RNA, 16 nt, Homo sapiens
cuccaguaacagccua

SEQ ID NO: 1552063 - RNA, 17 nt, Homo sapiens
cuccgugcuuaaccaaa

SEQ ID NO: 1552064 - RNA, 16 nt, Homo sapiens
cucuacagacuucucc

SEQ ID NO: 1552065 - RNA, 14 nt, Homo sapiens
cucucagaacauac

SEQ ID NO: 1552066 - RNA, 18 nt, Homo sapiens
cucucaguucuacacuga

SEQ ID NO: 1552067 - RNA, 17 nt, Homo sapiens
cucugacgcuugugaca

SEQ ID NO: 1552068 - RNA, 21 nt, Homo sapiens
cucugacgcuugugacagugc

SEQ ID NO: 1552069 - RNA, 18 nt, Homo sapiens
cucuguaguuacauuuag

SEQ ID NO: 1552070 - RNA, 10 nt, Homo sapiens
cucuguccac

SEQ ID NO: 1552071 - RNA, 22 nt, Homo sapiens
cucuucugaauaaagcaauuag

SEQ ID NO: 1552072 - RNA, 20 nt, Homo sapiens
cucuugagggagcuuagcca

SEQ ID NO: 1552073 - RNA, 14 nt, Homo sapiens
cugaagaaaaugag

SEQ ID NO: 1552074 - RNA, 13 nt, Homo sapiens
cugacuacaaauu

SEQ ID NO: 1552075 - RNA, 19 nt, Homo sapiens
cugaggaggaggacacagc

SEQ ID NO: 1552076 - RNA, 20 nt, Homo sapiens
cugaggaggaggacacagca

SEQ ID NO: 1552077 - RNA, 15 nt, Homo sapiens
cugaugauacaugca

SEQ ID NO: 1552078 - RNA, 17 nt, Homo sapiens
cugauucucuaugacau

SEQ ID NO: 1552079 - RNA, 15 nt, Homo sapiens
cugcacacaggacag

SEQ ID NO: 1552080 - RNA, 22 nt, Homo sapiens
cugcauggagaaggguucugcc

SEQ ID NO: 1552081 - RNA, 21 nt, Homo sapiens
cugcccagaccccucuggcca

SEQ ID NO: 1552082 - RNA, 20 nt, Homo sapiens
cugccucagccaguggcaca

SEQ ID NO: 1552083 - RNA, 16 nt, Homo sapiens
cugcucagcagagccu

SEQ ID NO: 1552084 - RNA, 15 nt, Homo sapiens
cugcugcaggacauu

SEQ ID NO: 1552085 - RNA, 17 nt, Homo sapiens
cugcugcaggacauuaa

SEQ ID NO: 1552086 - RNA, 21 nt, Homo sapiens
cugcugccucccuggggacca

SEQ ID NO: 1552087 - RNA, 22 nt, Homo sapiens
cuggcagguaggucggcacuug

SEQ ID NO: 1552088 - RNA, 14 nt, Homo sapiens
cuggcucucagaag

SEQ ID NO: 1552089 - RNA, 22 nt, Homo sapiens
cugggauuucucccucucagug

SEQ ID NO: 1552090 - RNA, 20 nt, Homo sapiens
cuguacaauaaguuacuuga

SEQ ID NO: 1552091 - RNA, 21 nt, Homo sapiens
cuguacaauaaguuacuugaa

SEQ ID NO: 1552092 - RNA, 22 nt, Homo sapiens
cuguacaauaaguuacuugaaa

SEQ ID NO: 1552093 - RNA, 20 nt, Homo sapiens
cugugaaauucacaguaaua

SEQ ID NO: 1552094 - RNA, 21 nt, Homo sapiens
cugugguuucagaugugcaau

SEQ ID NO: 1552095 - RNA, 23 nt, Homo sapiens
cuguguaacuguaaaacauugaa

SEQ ID NO: 1552096 - RNA, 22 nt, Homo sapiens
cuguguggacugugaugccaca

SEQ ID NO: 1552097 - RNA, 23 nt, Homo sapiens
cuguguggacugugaugccacac

SEQ ID NO: 1552098 - RNA, 19 nt, Homo sapiens
cuuaaaagguuaaauuuca

SEQ ID NO: 1552099 - RNA, 12 nt, Homo sapiens
cuuaaccaaaga

SEQ ID NO: 1552100 - RNA, 12 nt, Homo sapiens
cuuacagaauua

SEQ ID NO: 1552101 - RNA, 16 nt, Homo sapiens
cuucaagagcugagaa

SEQ ID NO: 1552102 - RNA, 16 nt, Homo sapiens
cuucagaagacacugc

SEQ ID NO: 1552103 - RNA, 23 nt, Homo sapiens
cuucagaagacacugcaaaggcg

SEQ ID NO: 1552104 - RNA, 23 nt, Homo sapiens
cuucagagacuucguaauuaaag

SEQ ID NO: 1552105 - RNA, 21 nt, Homo sapiens
cuucagggcagggcucugaua

SEQ ID NO: 1552106 - RNA, 19 nt, Homo sapiens
cuucuauacccacccagaa

SEQ ID NO: 1552107 - RNA, 18 nt, Homo sapiens
cuucucuacagacuucuc

SEQ ID NO: 1552108 - RNA, 23 nt, Homo sapiens
cuucuggagauggauccuuccau

SEQ ID NO: 1552109 - RNA, 14 nt, Homo sapiens
cuucuucagaagac

SEQ ID NO: 1552110 - RNA, 15 nt, Homo sapiens
cuugcauguacuuga

SEQ ID NO: 1552111 - RNA, 22 nt, Homo sapiens
cuuggggaaaauggccaugcag

SEQ ID NO: 1552112 - RNA, 21 nt, Homo sapiens
cuugugugugggcugugagug

SEQ ID NO: 1552113 - RNA, 14 nt, Homo sapiens
cuuucaaugcaguu

SEQ ID NO: 1552114 - RNA, 19 nt, Homo sapiens
cuuuuuuaggcuacagugu

SEQ ID NO: 1552115 - RNA, 21 nt, Homo sapiens
gaaaacugauucucuaugaca

SEQ ID NO: 1552116 - RNA, 23 nt, Homo sapiens
gaaaaucuauauuugucuuccga

SEQ ID NO: 1552117 - RNA, 22 nt, Homo sapiens
gaaaaugagcacacccuucaca

SEQ ID NO: 1552118 - RNA, 15 nt, Homo sapiens
gaaaggaaguauaaa

SEQ ID NO: 1552119 - RNA, 15 nt, Homo sapiens
gaaauagacaguaua

SEQ ID NO: 1552120 - RNA, 21 nt, Homo sapiens
gaacaaauguguuuuucuaua

SEQ ID NO: 1552121 - RNA, 21 nt, Homo sapiens
gaacacccgacuccucaaaag

SEQ ID NO: 1552122 - RNA, 22 nt, Homo sapiens
gaacagauggggucugugacug

SEQ ID NO: 1552123 - RNA, 18 nt, Homo sapiens
gaacagguaguauuacac

SEQ ID NO: 1552124 - RNA, 14 nt, Homo sapiens
gaagacucaguaug

SEQ ID NO: 1552125 - RNA, 11 nt, Homo sapiens
gaaguuugcau

SEQ ID NO: 1552126 - RNA, 16 nt, Homo sapiens
gaauauuccuggacuu

SEQ ID NO: 1552127 - RNA, 15 nt, Homo sapiens
gaauccaaaagacaa

SEQ ID NO: 1552128 - RNA, 19 nt, Homo sapiens
gaauggggggcgggccagg

SEQ ID NO: 1552129 - RNA, 15 nt, Homo sapiens
gaauucccuugaauu

SEQ ID NO: 1552130 - RNA, 16 nt, Homo sapiens
gacaagacacugagga

SEQ ID NO: 1552131 - RNA, 14 nt, Homo sapiens
gacaauggacugua

SEQ ID NO: 1552132 - RNA, 20 nt, Homo sapiens
gacacugaggagauacugaa

SEQ ID NO: 1552133 - RNA, 23 nt, Homo sapiens
gacagugaaacaaauuuacauca

SEQ ID NO: 1552134 - RNA, 17 nt, Homo sapiens
gacagugccucuuccag

SEQ ID NO: 1552135 - RNA, 17 nt, Homo sapiens
gacgguaaguguucuca

SEQ ID NO: 1552136 - RNA, 20 nt, Homo sapiens
gacgguaaguguucucauga

SEQ ID NO: 1552137 - RNA, 21 nt, Homo sapiens
gacuagaaaaucugaguuuua

SEQ ID NO: 1552138 - RNA, 13 nt, Homo sapiens
gacuccaucucaa

SEQ ID NO: 1552139 - RNA, 13 nt, Homo sapiens
gacuccucaaaag

SEQ ID NO: 1552140 - RNA, 15 nt, Homo sapiens
gacuccucaaaagca

SEQ ID NO: 1552141 - RNA, 16 nt, Homo sapiens
gagaauccauccaaag

SEQ ID NO: 1552142 - RNA, 23 nt, Homo sapiens
gagaaucccacauuagcuuguua

SEQ ID NO: 1552143 - RNA, 17 nt, Homo sapiens
gagagaggcugccucag

SEQ ID NO: 1552144 - RNA, 19 nt, Homo sapiens
gagauacugaacauuuugc

SEQ ID NO: 1552145 - RNA, 22 nt, Homo sapiens
gagaucacgucacugcacucca

SEQ ID NO: 1552146 - RNA, 16 nt, Homo sapiens
gagcacagaaggaaua

SEQ ID NO: 1552147 - RNA, 19 nt, Homo sapiens
gagcagcuuuggaaacagg

SEQ ID NO: 1552148 - RNA, 20 nt, Homo sapiens
gagcccgcagggccaugcag

SEQ ID NO: 1552149 - RNA, 14 nt, Homo sapiens
gagcuagcccaguc

SEQ ID NO: 1552150 - RNA, 14 nt, Homo sapiens
gagcuugcuccaga

SEQ ID NO: 1552151 - RNA, 23 nt, Homo sapiens
gagcuugcuccagauucugaugc

SEQ ID NO: 1552152 - RNA, 21 nt, Homo sapiens
gaggaaagggaaggcuggcag

SEQ ID NO: 1552153 - RNA, 15 nt, Homo sapiens
gaggcuuuacagugu

SEQ ID NO: 1552154 - RNA, 22 nt, Homo sapiens
gauaccuguaguggaacuaaaa

SEQ ID NO: 1552155 - RNA, 17 nt, Homo sapiens
gaucaaauugugcagua

SEQ ID NO: 1552156 - RNA, 21 nt, Homo sapiens
gaucagccccgccugucacaa

SEQ ID NO: 1552157 - RNA, 20 nt, Homo sapiens
gaucucagcagugaaguaua

SEQ ID NO: 1552158 - RNA, 18 nt, Homo sapiens
gaucucugggaguuauag

SEQ ID NO: 1552159 - RNA, 17 nt, Homo sapiens
gaugcaauauaagcaua

SEQ ID NO: 1552160 - RNA, 18 nt, Homo sapiens
gaugcaauauaagcauaa

SEQ ID NO: 1552161 - RNA, 23 nt, Homo sapiens
gauggaggggugguccugacuca

SEQ ID NO: 1552162 - RNA, 16 nt, Homo sapiens
gauucaaauugcugcu

SEQ ID NO: 1552163 - RNA, 16 nt, Homo sapiens
gauugacagcauauag

SEQ ID NO: 1552164 - RNA, 13 nt, Homo sapiens
gauuucaggauac

SEQ ID NO: 1552165 - RNA, 13 nt, Homo sapiens
gauuugccugugc

SEQ ID NO: 1552166 - RNA, 18 nt, Homo sapiens
gcaacuucuagcauauag

SEQ ID NO: 1552167 - RNA, 15 nt, Homo sapiens
gcacacacaaaccua

SEQ ID NO: 1552168 - RNA, 20 nt, Homo sapiens
gcaccucggggacaccagag

SEQ ID NO: 1552169 - RNA, 20 nt, Homo sapiens
gcagagccucguuucugcuu

SEQ ID NO: 1552170 - RNA, 17 nt, Homo sapiens
gcagguaggucggcacu

SEQ ID NO: 1552171 - RNA, 13 nt, Homo sapiens
gcagugaaguaua

SEQ ID NO: 1552172 - RNA, 16 nt, Homo sapiens
gcauauggugcuuaaa

SEQ ID NO: 1552173 - RNA, 21 nt, Homo sapiens
gcauauuuauugcauugcugg

SEQ ID NO: 1552174 - RNA, 23 nt, Homo sapiens
gcaucauuuaacugaacugugaa

SEQ ID NO: 1552175 - RNA, 14 nt, Homo sapiens
gcaugaccugugac

SEQ ID NO: 1552176 - RNA, 20 nt, Homo sapiens
gcaugagagaauuguaucau

SEQ ID NO: 1552177 - RNA, 18 nt, Homo sapiens
gcaugucucaauaguaaa

SEQ ID NO: 1552178 - RNA, 13 nt, Homo sapiens
gcaugugaucucc

SEQ ID NO: 1552179 - RNA, 10 nt, Homo sapiens
gcauugcugg

SEQ ID NO: 1552180 - RNA, 16 nt, Homo sapiens
gccaagggggugacug

SEQ ID NO: 1552181 - RNA, 20 nt, Homo sapiens
gccaagggggugacuggaag

SEQ ID NO: 1552182 - RNA, 18 nt, Homo sapiens
gccacacccagcggcccc

SEQ ID NO: 1552183 - RNA, 14 nt, Homo sapiens
gccaggaccauggc

SEQ ID NO: 1552184 - RNA, 22 nt, Homo sapiens
gccauaagaggugaucucuggg

SEQ ID NO: 1552185 - RNA, 21 nt, Homo sapiens
gccaugcagaccucaugccca

SEQ ID NO: 1552186 - RNA, 19 nt, Homo sapiens
gccauggugacauugugga

SEQ ID NO: 1552187 - RNA, 20 nt, Homo sapiens
gcccagcagggccucaaagu

SEQ ID NO: 1552188 - RNA, 21 nt, Homo sapiens
gcccgucauguuccucaaaag

SEQ ID NO: 1552189 - RNA, 21 nt, Homo sapiens
gcccgugcccccgccugccac

SEQ ID NO: 1552190 - RNA, 16 nt, Homo sapiens
gccucccuggggacca

SEQ ID NO: 1552191 - RNA, 22 nt, Homo sapiens
gccuccucccugggcagaaagu

SEQ ID NO: 1552192 - RNA, 16 nt, Homo sapiens
gccucugguugccucc

SEQ ID NO: 1552193 - RNA, 18 nt, Homo sapiens
gccugggcuguggacaga

SEQ ID NO: 1552194 - RNA, 22 nt, Homo sapiens
gccuguaaucccagcacuuugg

SEQ ID NO: 1552195 - RNA, 14 nt, Homo sapiens
gccuuaagcagaac

SEQ ID NO: 1552196 - RNA, 17 nt, Homo sapiens
gccuuauuaauauccaa

SEQ ID NO: 1552197 - RNA, 15 nt, Homo sapiens
gccuugauaauacuu

SEQ ID NO: 1552198 - RNA, 17 nt, Homo sapiens
gccuugauaauacuuga

SEQ ID NO: 1552199 - RNA, 19 nt, Homo sapiens
gccuugcauguacuugaag

SEQ ID NO: 1552200 - RNA, 17 nt, Homo sapiens
gcgcaaaggugccucau

SEQ ID NO: 1552201 - RNA, 18 nt, Homo sapiens
gcggccauaagaggugau

SEQ ID NO: 1552202 - RNA, 23 nt, Homo sapiens
gcuaaugacgacaccuagcucua

SEQ ID NO: 1552203 - RNA, 24 nt, Homo sapiens
gcuacagugucucgaugccauaau

SEQ ID NO: 1552204 - RNA, 17 nt, Homo sapiens
gcucuccuccaccucaa

SEQ ID NO: 1552205 - RNA, 21 nt, Homo sapiens
gcucucugacgcuugugacag

SEQ ID NO: 1552206 - RNA, 23 nt, Homo sapiens
gcugacaugaagcuguuguguga

SEQ ID NO: 1552207 - RNA, 23 nt, Homo sapiens
gcugggaacaugacccagccuga

SEQ ID NO: 1552208 - RNA, 14 nt, Homo sapiens
gcugggcaggguga

SEQ ID NO: 1552209 - RNA, 17 nt, Homo sapiens
gcuuaagugagcagaac

SEQ ID NO: 1552210 - RNA, 15 nt, Homo sapiens
gcuucaaaugcaaau

SEQ ID NO: 1552211 - RNA, 20 nt, Homo sapiens
gcuugucuuaaaauaaugaa

SEQ ID NO: 1552212 - RNA, 15 nt, Homo sapiens
gcuuucagcacucac

SEQ ID NO: 1552213 - RNA, 15 nt, Homo sapiens
gcuuuuuguuugcau

SEQ ID NO: 1552214 - RNA, 21 nt, Homo sapiens
ggaaaaaaauaguaaagccaa

SEQ ID NO: 1552215 - RNA, 24 nt, Homo sapiens
ggaaaauaaacugacacuuauuaa

SEQ ID NO: 1552216 - RNA, 18 nt, Homo sapiens
ggaagccagugggguccc

SEQ ID NO: 1552217 - RNA, 16 nt, Homo sapiens
ggacaauggacuguac

SEQ ID NO: 1552218 - RNA, 20 nt, Homo sapiens
ggaggcggagguugcaauga

SEQ ID NO: 1552219 - RNA, 13 nt, Homo sapiens
ggaguugccugac

SEQ ID NO: 1552220 - RNA, 19 nt, Homo sapiens
ggcaacagagcaagacucc

SEQ ID NO: 1552221 - RNA, 17 nt, Homo sapiens
ggcacauugcccauggc

SEQ ID NO: 1552222 - RNA, 13 nt, Homo sapiens
ggcaccaacucca

SEQ ID NO: 1552223 - RNA, 22 nt, Homo sapiens
ggcaggaaucuauccauugaac

SEQ ID NO: 1552224 - RNA, 23 nt, Homo sapiens
ggcagguaggucggcacuuggac

SEQ ID NO: 1552225 - RNA, 16 nt, Homo sapiens
ggcauaggccugggug

SEQ ID NO: 1552226 - RNA, 11 nt, Homo sapiens
ggccagggugg

SEQ ID NO: 1552227 - RNA, 17 nt, Homo sapiens
ggccaugccacccuguu

SEQ ID NO: 1552228 - RNA, 20 nt, Homo sapiens
ggcggagguugcaaugagcc

SEQ ID NO: 1552229 - RNA, 19 nt, Homo sapiens
ggcuuaagugagcagaaca

SEQ ID NO: 1552230 - RNA, 15 nt, Homo sapiens
gggaagagugcauuu

SEQ ID NO: 1552231 - RNA, 20 nt, Homo sapiens
gggaggcggagguugcaaug

SEQ ID NO: 1552232 - RNA, 13 nt, Homo sapiens
gggguccaucccc

SEQ ID NO: 1552233 - RNA, 20 nt, Homo sapiens
gggucuuguuucacauuugu

SEQ ID NO: 1552234 - RNA, 23 nt, Homo sapiens
ggguuuuuguucuggaagccaua

SEQ ID NO: 1552235 - RNA, 14 nt, Homo sapiens
gguaggucggcacu

SEQ ID NO: 1552236 - RNA, 12 nt, Homo sapiens
ggucacaugaug

SEQ ID NO: 1552237 - RNA, 19 nt, Homo sapiens
ggugauuaccggcauuuua

SEQ ID NO: 1552238 - RNA, 14 nt, Homo sapiens
gguuucuucaagag

SEQ ID NO: 1552239 - RNA, 23 nt, Homo sapiens
guaaacacauguucugugccugc

SEQ ID NO: 1552240 - RNA, 15 nt, Homo sapiens
aaaaacuaauugagc

SEQ ID NO: 1552241 - RNA, 15 nt, Homo sapiens
aaaaacuagagcaca

SEQ ID NO: 1552242 - RNA, 22 nt, Homo sapiens
aaaaacuuccuucaaucuucau

SEQ ID NO: 1552243 - RNA, 14 nt, Homo sapiens
aaaaagauccaggg

SEQ ID NO: 1552244 - RNA, 22 nt, Homo sapiens
aaaaauauaaaguacaucucua

SEQ ID NO: 1552245 - RNA, 21 nt, Homo sapiens
aaaaauguguuccauugccau

SEQ ID NO: 1552246 - RNA, 13 nt, Homo sapiens
aaaacaaauucau

SEQ ID NO: 1552247 - RNA, 16 nt, Homo sapiens
aaaacauaauguauca

SEQ ID NO: 1552248 - RNA, 21 nt, Homo sapiens
aaaaccccaucuuuacuaaaa

SEQ ID NO: 1552249 - RNA, 21 nt, Homo sapiens
aaaacugauucucuaugacau

SEQ ID NO: 1552250 - RNA, 12 nt, Homo sapiens
aaaacuuaucac

SEQ ID NO: 1552251 - RNA, 20 nt, Homo sapiens
aaaauaaacauuuuguccac

SEQ ID NO: 1552252 - RNA, 19 nt, Homo sapiens
aaaauauuuuuaaauggac

SEQ ID NO: 1552253 - RNA, 22 nt, Homo sapiens
aaaaucuauauuugucuuccga

SEQ ID NO: 1552254 - RNA, 18 nt, Homo sapiens
aaaauuccucuuacugua

SEQ ID NO: 1552255 - RNA, 19 nt, Homo sapiens
aaaauuuuaaugcauuguu

SEQ ID NO: 1552256 - RNA, 22 nt, Homo sapiens
aaacauguuuaaauagccuaaa

SEQ ID NO: 1552257 - RNA, 19 nt, Homo sapiens
aaaccccaucuuuacuaaa

SEQ ID NO: 1552258 - RNA, 21 nt, Homo sapiens
aaagaauuuuuuugucuuuca

SEQ ID NO: 1552259 - RNA, 20 nt, Homo sapiens
aaagauaacaagaucuuuca

SEQ ID NO: 1552260 - RNA, 17 nt, Homo sapiens
aaaguaaauucauguaa

SEQ ID NO: 1552261 - RNA, 21 nt, Homo sapiens
aaaguuaaaacggaugucucc

SEQ ID NO: 1552262 - RNA, 15 nt, Homo sapiens
aaaguuacaaacaga

SEQ ID NO: 1552263 - RNA, 20 nt, Homo sapiens
aaaguuuacauuguccugua

SEQ ID NO: 1552264 - RNA, 20 nt, Homo sapiens
aaauaauuuuauuaugcaac

SEQ ID NO: 1552265 - RNA, 16 nt, Homo sapiens
aaauaccaacuguaca

SEQ ID NO: 1552266 - RNA, 12 nt, Homo sapiens
aaauagauguaa

SEQ ID NO: 1552267 - RNA, 13 nt, Homo sapiens
aaaucucuuccac

SEQ ID NO: 1552268 - RNA, 18 nt, Homo sapiens
aaaucuguguaacuguaa

SEQ ID NO: 1552269 - RNA, 13 nt, Homo sapiens
aaaugaccaaaga

SEQ ID NO: 1552270 - RNA, 14 nt, Homo sapiens
aaaugaccaaagau

SEQ ID NO: 1552271 - RNA, 19 nt, Homo sapiens
aaauguguuccauugccau

SEQ ID NO: 1552272 - RNA, 19 nt, Homo sapiens
aaauuauugcuguauguaa

SEQ ID NO: 1552273 - RNA, 13 nt, Homo sapiens
aaauuuaagcaaa

SEQ ID NO: 1552274 - RNA, 16 nt, Homo sapiens
aacacugcagcccucu

SEQ ID NO: 1552275 - RNA, 21 nt, Homo sapiens
aacagauggggucugugacug

SEQ ID NO: 1552276 - RNA, 23 nt, Homo sapiens
aacagauggggucugugacugga

SEQ ID NO: 1552277 - RNA, 18 nt, Homo sapiens
aacauaauguaucaugaa

SEQ ID NO: 1552278 - RNA, 17 nt, Homo sapiens
aacccagagguggaugu

SEQ ID NO: 1552279 - RNA, 17 nt, Homo sapiens
aacccccaguucaagac

SEQ ID NO: 1552280 - RNA, 13 nt, Homo sapiens
agcauauggugcu

SEQ ID NO: 1552281 - RNA, 18 nt, Homo sapiens
agccacccaagccugcug

SEQ ID NO: 1552282 - RNA, 18 nt, Homo sapiens
agccagggcagaggaaug

SEQ ID NO: 1552283 - RNA, 12 nt, Homo sapiens
agccaguggcac

SEQ ID NO: 1552284 - RNA, 16 nt, Homo sapiens
agcccuucuauaccca

SEQ ID NO: 1552285 - RNA, 19 nt, Homo sapiens
agccuugcauguacuugaa

SEQ ID NO: 1552286 - RNA, 20 nt, Homo sapiens
agccuugcauguacuugaag

SEQ ID NO: 1552287 - RNA, 17 nt, Homo sapiens
agccuugcugggccagg

SEQ ID NO: 1552288 - RNA, 15 nt, Homo sapiens
agcuacugacauucc

SEQ ID NO: 1552289 - RNA, 19 nt, Homo sapiens
agcucucugacgcuuguga

SEQ ID NO: 1552290 - RNA, 15 nt, Homo sapiens
agcugcacaugacua

SEQ ID NO: 1552291 - RNA, 17 nt, Homo sapiens
agcuguugugugagguu

SEQ ID NO: 1552292 - RNA, 22 nt, Homo sapiens
agcuuagccaaugugggagcag

SEQ ID NO: 1552293 - RNA, 18 nt, Homo sapiens
agcuuuaaaaccacagcu

SEQ ID NO: 1552294 - RNA, 16 nt, Homo sapiens
agcuuuuuguuugcau

SEQ ID NO: 1552295 - RNA, 22 nt, Homo sapiens
agcuuuuuguuugcaucauuua

SEQ ID NO: 1552296 - RNA, 19 nt, Homo sapiens
aggaaaaaugaggaaucca

SEQ ID NO: 1552297 - RNA, 17 nt, Homo sapiens
aggaaaauaaacugaca

SEQ ID NO: 1552298 - RNA, 19 nt, Homo sapiens
aggaauccaaaagacaaaa

SEQ ID NO: 1552299 - RNA, 17 nt, Homo sapiens
aggaauccccaacaugc

SEQ ID NO: 1552300 - RNA, 13 nt, Homo sapiens
aggaauguagggc

SEQ ID NO: 1552301 - RNA, 12 nt, Homo sapiens
aggacacagcac

SEQ ID NO: 1552302 - RNA, 21 nt, Homo sapiens
aggagccuacuucuagcugua

SEQ ID NO: 1552303 - RNA, 19 nt, Homo sapiens
aggcauaggccugggugcu

SEQ ID NO: 1552304 - RNA, 18 nt, Homo sapiens
aggcaucugccucuggaa

SEQ ID NO: 1552305 - RNA, 16 nt, Homo sapiens
aggcaugguggcucau

SEQ ID NO: 1552306 - RNA, 17 nt, Homo sapiens
aggcugcuagauguagg

SEQ ID NO: 1552307 - RNA, 14 nt, Homo sapiens
agggaaggagccca

SEQ ID NO: 1552308 - RNA, 15 nt, Homo sapiens
agggacaaacucacu

SEQ ID NO: 1552309 - RNA, 13 nt, Homo sapiens
agggagcacuuua

SEQ ID NO: 1552310 - RNA, 16 nt, Homo sapiens
agggcagggcucugau

SEQ ID NO: 1552311 - RNA, 18 nt, Homo sapiens
agggcaucuccugugcau

SEQ ID NO: 1552312 - RNA, 12 nt, Homo sapiens
agggggugacug

SEQ ID NO: 1552313 - RNA, 19 nt, Homo sapiens
agguaucuguuuaacauuu

SEQ ID NO: 1552314 - RNA, 12 nt, Homo sapiens
aggucggcacuu

SEQ ID NO: 1552315 - RNA, 16 nt, Homo sapiens
agguuaaauuucaagc

SEQ ID NO: 1552316 - RNA, 17 nt, Homo sapiens
aguacaucucuacuaaa

SEQ ID NO: 1552317 - RNA, 18 nt, Homo sapiens
aguauauggcauaugaau

SEQ ID NO: 1552318 - RNA, 12 nt, Homo sapiens
aguaugccuuaa

SEQ ID NO: 1552319 - RNA, 17 nt, Homo sapiens
aguaugccuuaagcaga

SEQ ID NO: 1552320 - RNA, 18 nt, Homo sapiens
aguaugccuuaagcagaa

SEQ ID NO: 1552321 - RNA, 23 nt, Homo sapiens
aguauugaaauguuugcauaaag

SEQ ID NO: 1552322 - RNA, 17 nt, Homo sapiens
aguauuuuuuaaggcaa

SEQ ID NO: 1552323 - RNA, 13 nt, Homo sapiens
agucagacacgau

SEQ ID NO: 1552324 - RNA, 22 nt, Homo sapiens
agucccgggucucaacuuuaag

SEQ ID NO: 1552325 - RNA, 22 nt, Homo sapiens
aguccuuuugaauuaaacucga

SEQ ID NO: 1552326 - RNA, 19 nt, Homo sapiens
agugacagcuuucugggau

SEQ ID NO: 1552327 - RNA, 19 nt, Homo sapiens
aguggaacuaaaauucugu

SEQ ID NO: 1552328 - RNA, 19 nt, Homo sapiens
aguggcaggugggcugccu

SEQ ID NO: 1552329 - RNA, 20 nt, Homo sapiens
aguggcaggugggcugccug

SEQ ID NO: 1552330 - RNA, 14 nt, Homo sapiens
aguggccaugccac

SEQ ID NO: 1552331 - RNA, 20 nt, Homo sapiens
aguggccaugccacccuguu

SEQ ID NO: 1552332 - RNA, 21 nt, Homo sapiens
aguuaaugaaauaaaauuuga

SEQ ID NO: 1552333 - RNA, 17 nt, Homo sapiens
aguuacuauugcucaua

SEQ ID NO: 1552334 - RNA, 13 nt, Homo sapiens
aguuaggugcuga

SEQ ID NO: 1552335 - RNA, 16 nt, Homo sapiens
aguucagagucuucag

SEQ ID NO: 1552336 - RNA, 16 nt, Homo sapiens
aguuccuugccuuaau

SEQ ID NO: 1552337 - RNA, 22 nt, Homo sapiens
aguugagagggugcaguccaga

SEQ ID NO: 1552338 - RNA, 13 nt, Homo sapiens
auaaaaugugauu

SEQ ID NO: 1552339 - RNA, 18 nt, Homo sapiens
auaaacugacuaaacuua

SEQ ID NO: 1552340 - RNA, 20 nt, Homo sapiens
auaaacugacuaaacuuaca

SEQ ID NO: 1552341 - RNA, 14 nt, Homo sapiens
auaaacuuaaaaua

SEQ ID NO: 1552342 - RNA, 17 nt, Homo sapiens
auaaauucagauauauu

SEQ ID NO: 1552343 - RNA, 21 nt, Homo sapiens
auaaauuucaauuagauuuaa

SEQ ID NO: 1552344 - RNA, 20 nt, Homo sapiens
auaacaagaucuuucaggaa

SEQ ID NO: 1552345 - RNA, 12 nt, Homo sapiens
auaacagaauua

SEQ ID NO: 1552346 - RNA, 12 nt, Homo sapiens
auaaccaaagag

SEQ ID NO: 1552347 - RNA, 23 nt, Homo sapiens
auaauauggaucagagcauuuau

SEQ ID NO: 1552348 - RNA, 14 nt, Homo sapiens
auacaacacugaua

SEQ ID NO: 1552349 - RNA, 21 nt, Homo sapiens
auaccaacuguacaaaauaac

SEQ ID NO: 1552350 - RNA, 21 nt, Homo sapiens
auacuagauuccacagggaaa

SEQ ID NO: 1552351 - RNA, 15 nt, Homo sapiens
auagaaguagcaaaa

SEQ ID NO: 1552352 - RNA, 17 nt, Homo sapiens
auagcuacaguguaaua

SEQ ID NO: 1552353 - RNA, 19 nt, Homo sapiens
auauaauucccaagcuuuu

SEQ ID NO: 1552354 - RNA, 18 nt, Homo sapiens
auaucaaaucuaccacug

SEQ ID NO: 1552355 - RNA, 18 nt, Homo sapiens
auauccagccaguacagu

SEQ ID NO: 1552356 - RNA, 15 nt, Homo sapiens
auauuuauagcaauc

SEQ ID NO: 1552357 - RNA, 18 nt, Homo sapiens
aucaaagaacagaugggg

SEQ ID NO: 1552358 - RNA, 22 nt, Homo sapiens
aucagcaacuucuagcauauag

SEQ ID NO: 1552359 - RNA, 16 nt, Homo sapiens
aucagcaucaaguaug

SEQ ID NO: 1552360 - RNA, 16 nt, Homo sapiens
aucaucggaguugaca

SEQ ID NO: 1552361 - RNA, 13 nt, Homo sapiens
auccaaaagacaa

SEQ ID NO: 1552362 - RNA, 23 nt, Homo sapiens
auccaagacuuagagcugggaau

SEQ ID NO: 1552363 - RNA, 21 nt, Homo sapiens
auccauguuaguuuuuacuuu

SEQ ID NO: 1552364 - RNA, 18 nt, Homo sapiens
auccauugaacuaaaaua

SEQ ID NO: 1552365 - RNA, 22 nt, Homo sapiens
aucccgccucuucuucuucaga

SEQ ID NO: 1552366 - RNA, 19 nt, Homo sapiens
aucuccugugcauggguga

SEQ ID NO: 1552367 - RNA, 15 nt, Homo sapiens
aucucuacuaaaaau

SEQ ID NO: 1552368 - RNA, 20 nt, Homo sapiens
aucuguccguucacaugugu

SEQ ID NO: 1552369 - RNA, 16 nt, Homo sapiens
aucuuaaaacaaauuc

SEQ ID NO: 1552370 - RNA, 17 nt, Homo sapiens
aucuucuaucauuccaa

SEQ ID NO: 1552371 - RNA, 17 nt, Homo sapiens
augaaaaauguguucca

SEQ ID NO: 1552372 - RNA, 21 nt, Homo sapiens
augaaaauuuauuuuuaguga

SEQ ID NO: 1552373 - RNA, 12 nt, Homo sapiens
augaaugaaacu

SEQ ID NO: 1552374 - RNA, 12 nt, Homo sapiens
augaccaaagau

SEQ ID NO: 1552375 - RNA, 19 nt, Homo sapiens
augagauguuaaauacuuu

SEQ ID NO: 1552376 - RNA, 18 nt, Homo sapiens
augauucaaauugcugcu

SEQ ID NO: 1552377 - RNA, 19 nt, Homo sapiens
augauucaaauugcugcuu

SEQ ID NO: 1552378 - RNA, 14 nt, Homo sapiens
augcaucaugcuca

SEQ ID NO: 1552379 - RNA, 13 nt, Homo sapiens
augccauaaucag

SEQ ID NO: 1552380 - RNA, 20 nt, Homo sapiens
augcugggcucaucuucuag

SEQ ID NO: 1552381 - RNA, 22 nt, Homo sapiens
auggacaauggacuguacaaua

SEQ ID NO: 1552382 - RNA, 14 nt, Homo sapiens
auggauccuuccau

SEQ ID NO: 1552383 - RNA, 23 nt, Homo sapiens
auggcaaaaccccaucuuuacua

SEQ ID NO: 1552384 - RNA, 16 nt, Homo sapiens
auggcauuuggucuca

SEQ ID NO: 1552385 - RNA, 19 nt, Homo sapiens
auggcauuuggucucaggc

SEQ ID NO: 1552386 - RNA, 12 nt, Homo sapiens
auggccaugcag

SEQ ID NO: 1552387 - RNA, 17 nt, Homo sapiens
auguaaauaaaauugag

SEQ ID NO: 1552388 - RNA, 21 nt, Homo sapiens
augucccuuucuuggccaguu

SEQ ID NO: 1552389 - RNA, 16 nt, Homo sapiens
auguuacugaccagca

SEQ ID NO: 1552390 - RNA, 18 nt, Homo sapiens
auguuuaaauagccuaaa

SEQ ID NO: 1552391 - RNA, 18 nt, Homo sapiens
auuaauauccaagacuua

SEQ ID NO: 1552392 - RNA, 21 nt, Homo sapiens
auuacuguuuugggccuccau

SEQ ID NO: 1552393 - RNA, 22 nt, Homo sapiens
auuagcuuguuaguaaugcucu

SEQ ID NO: 1552394 - RNA, 15 nt, Homo sapiens
auuaggaaguguaac

SEQ ID NO: 1552395 - RNA, 21 nt, Homo sapiens
auuauagaauucuguacuuga

SEQ ID NO: 1552396 - RNA, 16 nt, Homo sapiens
auucaaaucacaugga

SEQ ID NO: 1552397 - RNA, 15 nt, Homo sapiens
auucaaauugcugcu

SEQ ID NO: 1552398 - RNA, 16 nt, Homo sapiens
auucaaauugcugcuu

SEQ ID NO: 1552399 - RNA, 16 nt, Homo sapiens
auucagcacacacaaa

SEQ ID NO: 1552400 - RNA, 16 nt, Homo sapiens
ccauggugacauugug

SEQ ID NO: 1552401 - RNA, 16 nt, Homo sapiens
cccaaguaugccuuaa

SEQ ID NO: 1552402 - RNA, 12 nt, Homo sapiens
cccacggcaccu

SEQ ID NO: 1552403 - RNA, 12 nt, Homo sapiens
cccacuuugaag

SEQ ID NO: 1552404 - RNA, 15 nt, Homo sapiens
cccagccugaaagau

SEQ ID NO: 1552405 - RNA, 16 nt, Homo sapiens
cccagcucuggaugaa

SEQ ID NO: 1552406 - RNA, 17 nt, Homo sapiens
cccaggcaaacuugcac

SEQ ID NO: 1552407 - RNA, 24 nt, Homo sapiens
cccagggcacuacauaauugcugu

SEQ ID NO: 1552408 - RNA, 16 nt, Homo sapiens
ccccaacaugcacuga

SEQ ID NO: 1552409 - RNA, 12 nt, Homo sapiens
ccccacuuugaa

SEQ ID NO: 1552410 - RNA, 17 nt, Homo sapiens
cccgcagggccaugcag

SEQ ID NO: 1552411 - RNA, 22 nt, Homo sapiens
cccuaugaaaaauguguuccau

SEQ ID NO: 1552412 - RNA, 12 nt, Homo sapiens
cccucacccauc

SEQ ID NO: 1552413 - RNA, 17 nt, Homo sapiens
cccugacuucuggagau

SEQ ID NO: 1552414 - RNA, 17 nt, Homo sapiens
cccugcacaggcacaca

SEQ ID NO: 1552415 - RNA, 23 nt, Homo sapiens
cccugccuguuaaggaaacuuua

SEQ ID NO: 1552416 - RNA, 23 nt, Homo sapiens
cccuuggagagagaggcugccuc

SEQ ID NO: 1552417 - RNA, 17 nt, Homo sapiens
cccuugucgugggaugg

SEQ ID NO: 1552418 - RNA, 17 nt, Homo sapiens
ccgacuccucaaaagca

SEQ ID NO: 1552419 - RNA, 14 nt, Homo sapiens
ccgcaugugaucuc

SEQ ID NO: 1552420 - RNA, 23 nt, Homo sapiens
ccgggcaccaacuccauguuugg

SEQ ID NO: 1552421 - RNA, 16 nt, Homo sapiens
ccgugcuuaaccaaag

SEQ ID NO: 1552422 - RNA, 22 nt, Homo sapiens
ccucaaaguuggggcaggcugg

SEQ ID NO: 1552423 - RNA, 17 nt, Homo sapiens
ccucaacugaaggggug

SEQ ID NO: 1552424 - RNA, 22 nt, Homo sapiens
ccucugucuaggacugcagugu

SEQ ID NO: 1552425 - RNA, 15 nt, Homo sapiens
ccugaaggcuucaau

SEQ ID NO: 1552426 - RNA, 19 nt, Homo sapiens
ccugaccugucaccgugag

SEQ ID NO: 1552427 - RNA, 20 nt, Homo sapiens
ccugaggaggaggacacagc

SEQ ID NO: 1552428 - RNA, 17 nt, Homo sapiens
ccugugaccagcacugu

SEQ ID NO: 1552429 - RNA, 16 nt, Homo sapiens
ccuuggcugacaugaa

SEQ ID NO: 1552430 - RNA, 18 nt, Homo sapiens
ccuuuggccccacuuuga

SEQ ID NO: 1552431 - RNA, 13 nt, Homo sapiens
ccuuuuucacuuu

SEQ ID NO: 1552432 - RNA, 21 nt, Homo sapiens
cgggcaccaacuccauguuug

SEQ ID NO: 1552433 - RNA, 22 nt, Homo sapiens
cgggucucaacuuuaagauaga

SEQ ID NO: 1552434 - RNA, 20 nt, Homo sapiens
cguaauuaaaggaacagagu

SEQ ID NO: 1552435 - RNA, 21 nt, Homo sapiens
cguuucauuuuuacaccaauu

SEQ ID NO: 1552436 - RNA, 13 nt, Homo sapiens
cuaaaauucuguc

SEQ ID NO: 1552437 - RNA, 17 nt, Homo sapiens
cuaaaauucugucaggg

SEQ ID NO: 1552438 - RNA, 14 nt, Homo sapiens
cuaaacuaacaaga

SEQ ID NO: 1552439 - RNA, 18 nt, Homo sapiens
cuaaauacaacacugaua

SEQ ID NO: 1552440 - RNA, 16 nt, Homo sapiens
cuacacugauacacuu

SEQ ID NO: 1552441 - RNA, 12 nt, Homo sapiens
cuaccacuguau

SEQ ID NO: 1552442 - RNA, 14 nt, Homo sapiens
cuacccuaaccaag

SEQ ID NO: 1552443 - RNA, 15 nt, Homo sapiens
cuacuucuagcugua

SEQ ID NO: 1552444 - RNA, 21 nt, Homo sapiens
cuauauaguuccuugccuuaa

SEQ ID NO: 1552445 - RNA, 13 nt, Homo sapiens
cuauauugguuua

SEQ ID NO: 1552446 - RNA, 21 nt, Homo sapiens
cuauuuucagagcaugauaca

SEQ ID NO: 1552447 - RNA, 22 nt, Homo sapiens
cuauuuucagagcaugauacaa

SEQ ID NO: 1552448 - RNA, 13 nt, Homo sapiens
cucaaaugaauuu

SEQ ID NO: 1552449 - RNA, 23 nt, Homo sapiens
cucaacauguuacugaccagcaa

SEQ ID NO: 1552450 - RNA, 12 nt, Homo sapiens
cucaacuuuaag

SEQ ID NO: 1552451 - RNA, 17 nt, Homo sapiens
cucaacuuuaagauaga

SEQ ID NO: 1552452 - RNA, 17 nt, Homo sapiens
cucagaacauacugauu

SEQ ID NO: 1552453 - RNA, 15 nt, Homo sapiens
cucaguaaaaguaaa

SEQ ID NO: 1552454 - RNA, 20 nt, Homo sapiens
cucaguucuacacugauaca

SEQ ID NO: 1552455 - RNA, 16 nt, Homo sapiens
cuccaucucaaaaaag

SEQ ID NO: 1552456 - RNA, 20 nt, Homo sapiens
cuccgugcuuaaccaaagaa

SEQ ID NO: 1552457 - RNA, 12 nt, Homo sapiens
cuccucaaaagc

SEQ ID NO: 1552458 - RNA, 14 nt, Homo sapiens
cuccuggucuguga

SEQ ID NO: 1552459 - RNA, 20 nt, Homo sapiens
cucuacucacagcugaagaa

SEQ ID NO: 1552460 - RNA, 22 nt, Homo sapiens
cucuggaccugucucuaccuaa

SEQ ID NO: 1552461 - RNA, 14 nt, Homo sapiens
cugaaccaguccag

SEQ ID NO: 1552462 - RNA, 22 nt, Homo sapiens
cugaacugugaacccuugugcc

SEQ ID NO: 1552463 - RNA, 14 nt, Homo sapiens
cugaaugcaauuuu

SEQ ID NO: 1552464 - RNA, 23 nt, Homo sapiens
cugacucaacauguuacugacca

SEQ ID NO: 1552465 - RNA, 22 nt, Homo sapiens
cugaggcccagugcauaugcaa

SEQ ID NO: 1552466 - RNA, 19 nt, Homo sapiens
cugcagcaggccacugggg

SEQ ID NO: 1552467 - RNA, 14 nt, Homo sapiens
cugcccugccugag

SEQ ID NO: 1552468 - RNA, 15 nt, Homo sapiens
cugccugcuguguua

SEQ ID NO: 1552469 - RNA, 15 nt, Homo sapiens
cugcuucaugggaaa

SEQ ID NO: 1552470 - RNA, 20 nt, Homo sapiens
cugcuucaugggaaaacaga

SEQ ID NO: 1552471 - RNA, 16 nt, Homo sapiens
cuggccuuuaagguca

SEQ ID NO: 1552472 - RNA, 15 nt, Homo sapiens
cuggguucuuuggaa

SEQ ID NO: 1552473 - RNA, 21 nt, Homo sapiens
cugguaaaaagauccagggau

SEQ ID NO: 1552474 - RNA, 19 nt, Homo sapiens
cugguugucauuuuugcag

SEQ ID NO: 1552475 - RNA, 22 nt, Homo sapiens
cuguauguaaacuguuacugaa

SEQ ID NO: 1552476 - RNA, 16 nt, Homo sapiens
cuguccguucacaugu

SEQ ID NO: 1552477 - RNA, 22 nt, Homo sapiens
cuguccguucacauguguggua

SEQ ID NO: 1552478 - RNA, 22 nt, Homo sapiens
cugucuauauauauagggagca

SEQ ID NO: 1552479 - RNA, 18 nt, Homo sapiens
cugugaaauucacaguaa

SEQ ID NO: 1552480 - RNA, 10 nt, Homo sapiens
cugugccuga

SEQ ID NO: 1552481 - RNA, 13 nt, Homo sapiens
cugugccugcuca

SEQ ID NO: 1552482 - RNA, 17 nt, Homo sapiens
cugugcgccuuguagaa

SEQ ID NO: 1552483 - RNA, 21 nt, Homo sapiens
cuguguggacugugaugccac

SEQ ID NO: 1552484 - RNA, 13 nt, Homo sapiens
cuguucugcugaa

SEQ ID NO: 1552485 - RNA, 14 nt, Homo sapiens
cuguuggauucaga

SEQ ID NO: 1552486 - RNA, 15 nt, Homo sapiens
cuuaaaacaaauuca

SEQ ID NO: 1552487 - RNA, 23 nt, Homo sapiens
cuuaaauaaaaauaaaaauucau

SEQ ID NO: 1552488 - RNA, 18 nt, Homo sapiens
cuuaucaacuaaugauuu

SEQ ID NO: 1552489 - RNA, 13 nt, Homo sapiens
cuucaaaugcaaa

SEQ ID NO: 1552490 - RNA, 12 nt, Homo sapiens
cuucagcccuaa

SEQ ID NO: 1552491 - RNA, 16 nt, Homo sapiens
cuuccagugaacauuc

SEQ ID NO: 1552492 - RNA, 13 nt, Homo sapiens
cuucuaaaagcca

SEQ ID NO: 1552493 - RNA, 23 nt, Homo sapiens
cuucuagaaucucguuucuccuc

SEQ ID NO: 1552494 - RNA, 14 nt, Homo sapiens
cuucuagcauauag

SEQ ID NO: 1552495 - RNA, 18 nt, Homo sapiens
cuucugaauaaagcaauu

SEQ ID NO: 1552496 - RNA, 14 nt, Homo sapiens
cuugaauauuccug

SEQ ID NO: 1552497 - RNA, 22 nt, Homo sapiens
cuugacugcuuuuaaaugacca

SEQ ID NO: 1552498 - RNA, 17 nt, Homo sapiens
cuugauaauacuugacc

SEQ ID NO: 1552499 - RNA, 21 nt, Homo sapiens
cuugcuaaaagauuauagaag

SEQ ID NO: 1552500 - RNA, 14 nt, Homo sapiens
cuuggagacuccug

SEQ ID NO: 1552501 - RNA, 23 nt, Homo sapiens
cuuggagagagaggcugccucag

SEQ ID NO: 1552502 - RNA, 15 nt, Homo sapiens
cuugggagaaaauca

SEQ ID NO: 1552503 - RNA, 23 nt, Homo sapiens
cuuuagaguagcaugagagaauu

SEQ ID NO: 1552504 - RNA, 17 nt, Homo sapiens
cuuuggccccacuuuga

SEQ ID NO: 1552505 - RNA, 11 nt, Homo sapiens
cuuugucacuu

SEQ ID NO: 1552506 - RNA, 16 nt, Homo sapiens
cuuugucacuugccac

SEQ ID NO: 1552507 - RNA, 13 nt, Homo sapiens
cuuuucacacugu

SEQ ID NO: 1552508 - RNA, 14 nt, Homo sapiens
cuuuuucacuuuga

SEQ ID NO: 1552509 - RNA, 19 nt, Homo sapiens
cuuuuuuaaaccaguuuaa

SEQ ID NO: 1552510 - RNA, 14 nt, Homo sapiens
gaaaauggccaugc

SEQ ID NO: 1552511 - RNA, 19 nt, Homo sapiens
gaaaauuggaacucuacuc

SEQ ID NO: 1552512 - RNA, 14 nt, Homo sapiens
gaaacauguugauu

SEQ ID NO: 1552513 - RNA, 21 nt, Homo sapiens
gaaacauuauuagcacuuccc

SEQ ID NO: 1552514 - RNA, 12 nt, Homo sapiens
gaaaccuuccac

SEQ ID NO: 1552515 - RNA, 22 nt, Homo sapiens
gaaagaauuccugcagcaguua

SEQ ID NO: 1552516 - RNA, 16 nt, Homo sapiens
gaaauagacaguauau

SEQ ID NO: 1552517 - RNA, 16 nt, Homo sapiens
gaaaucuuucucccuc

SEQ ID NO: 1552518 - RNA, 17 nt, Homo sapiens
gaaaucuuucucccuca

SEQ ID NO: 1552519 - RNA, 17 nt, Homo sapiens
gaaauuaagacuuuaug

SEQ ID NO: 1552520 - RNA, 15 nt, Homo sapiens
uugaccucugugacc

SEQ ID NO: 1552521 - RNA, 21 nt, Homo sapiens
uugagugacagcuuucuggga

SEQ ID NO: 1552522 - RNA, 12 nt, Homo sapiens
uugccacuuaac

SEQ ID NO: 1552523 - RNA, 15 nt, Homo sapiens
uugcuaaaagauuau

SEQ ID NO: 1552524 - RNA, 13 nt, Homo sapiens
uuggaaacagaga

SEQ ID NO: 1552525 - RNA, 22 nt, Homo sapiens
uuggagagagaggcugccucag

SEQ ID NO: 1552526 - RNA, 14 nt, Homo sapiens
uugggcucacuucu

SEQ ID NO: 1552527 - RNA, 21 nt, Homo sapiens
uuggggaaaauggccaugcag

SEQ ID NO: 1552528 - RNA, 20 nt, Homo sapiens
uuguccuuuuucacuuugaa

SEQ ID NO: 1552529 - RNA, 17 nt, Homo sapiens
uugucuuucaaugcagu

SEQ ID NO: 1552530 - RNA, 17 nt, Homo sapiens
uugugugugggcuguga

SEQ ID NO: 1552531 - RNA, 21 nt, Homo sapiens
uuguuucaaaugaaacuuuaa

SEQ ID NO: 1552532 - RNA, 14 nt, Homo sapiens
uuuaaaagauaaaa

SEQ ID NO: 1552533 - RNA, 12 nt, Homo sapiens
uuuaaacuuaau

SEQ ID NO: 1552534 - RNA, 14 nt, Homo sapiens
uuuaaauagccuaa

SEQ ID NO: 1552535 - RNA, 17 nt, Homo sapiens
uuuaacugaacugugaa

SEQ ID NO: 1552536 - RNA, 12 nt, Homo sapiens
uuuacaucagaa

SEQ ID NO: 1552537 - RNA, 13 nt, Homo sapiens
uuuacuucuuuag

SEQ ID NO: 1552538 - RNA, 16 nt, Homo sapiens
uuuauugcauugcugg

SEQ ID NO: 1552539 - RNA, 22 nt, Homo sapiens
uuucaaacugcugcauacuuug

SEQ ID NO: 1552540 - RNA, 21 nt, Homo sapiens
uuucagauaaauuucaauuag

SEQ ID NO: 1552541 - RNA, 16 nt, Homo sapiens
uuuccuuaaacugugu

SEQ ID NO: 1552542 - RNA, 13 nt, Homo sapiens
uuugaaaaacuaa

SEQ ID NO: 1552543 - RNA, 17 nt, Homo sapiens
uuuggacuguaacugac

SEQ ID NO: 1552544 - RNA, 19 nt, Homo sapiens
uuugguaaaaaugcugcuc

SEQ ID NO: 1552545 - RNA, 16 nt, Homo sapiens
uuuuauuaaacuuaaa

SEQ ID NO: 1552546 - RNA, 18 nt, Homo sapiens
uuuuuauuaugcauuaua

SEQ ID NO: 1552547 - RNA, 13 nt, Homo sapiens
aaaaacucacuua

SEQ ID NO: 1552548 - RNA, 14 nt, Homo sapiens
aaaaacuguacugu

SEQ ID NO: 1552549 - RNA, 12 nt, Homo sapiens
aaaaaugcugcu

SEQ ID NO: 1552550 - RNA, 20 nt, Homo sapiens
aaaaccccaucuuuacuaaa

SEQ ID NO: 1552551 - RNA, 16 nt, Homo sapiens
aaaagauaacaagauc

SEQ ID NO: 1552552 - RNA, 14 nt, Homo sapiens
aaaagauuauagaa

SEQ ID NO: 1552553 - RNA, 18 nt, Homo sapiens
aaaagggcagggcaucuc

SEQ ID NO: 1552554 - RNA, 18 nt, Homo sapiens
aaaaguaaauucauguaa

SEQ ID NO: 1552555 - RNA, 21 nt, Homo sapiens
aaaagugaucaauaaaaugug

SEQ ID NO: 1552556 - RNA, 19 nt, Homo sapiens
aaaaugaaagcaugucuca

SEQ ID NO: 1552557 - RNA, 22 nt, Homo sapiens
aaaauguguuccauugccauag

SEQ ID NO: 1552558 - RNA, 14 nt, Homo sapiens
aaaauuaugaccau

SEQ ID NO: 1552559 - RNA, 18 nt, Homo sapiens
aaacaaaaaucuguguaa

SEQ ID NO: 1552560 - RNA, 14 nt, Homo sapiens
aaacaagcguuuau

SEQ ID NO: 1552561 - RNA, 14 nt, Homo sapiens
aaacaaggaagcca

SEQ ID NO: 1552562 - RNA, 16 nt, Homo sapiens
aaacaaggaagccaaa

SEQ ID NO: 1552563 - RNA, 21 nt, Homo sapiens
aaacacacgagcaaacccaga

SEQ ID NO: 1552564 - RNA, 14 nt, Homo sapiens
aaacacuuacagaa

SEQ ID NO: 1552565 - RNA, 22 nt, Homo sapiens
aaacagaagcuuuuuguuugca

SEQ ID NO: 1552566 - RNA, 19 nt, Homo sapiens
aaacauguuuaaauagccu

SEQ ID NO: 1552567 - RNA, 20 nt, Homo sapiens
aaaccccaucuuuacuaaaa

SEQ ID NO: 1552568 - RNA, 21 nt, Homo sapiens
aaacuuuagaguagcaugaga

SEQ ID NO: 1552569 - RNA, 22 nt, Homo sapiens
aaagaauuggccaggcauggug

SEQ ID NO: 1552570 - RNA, 14 nt, Homo sapiens
aaagauacagggga

SEQ ID NO: 1552571 - RNA, 17 nt, Homo sapiens
aaagauuguuggaugaa

SEQ ID NO: 1552572 - RNA, 15 nt, Homo sapiens
aaagcacuacaauca

SEQ ID NO: 1552573 - RNA, 19 nt, Homo sapiens
aaagccauuauuaugaugu

SEQ ID NO: 1552574 - RNA, 14 nt, Homo sapiens
aaaguggccaugcc

SEQ ID NO: 1552575 - RNA, 12 nt, Homo sapiens
aaauacuauauu

SEQ ID NO: 1552576 - RNA, 11 nt, Homo sapiens
aaauagcagua

SEQ ID NO: 1552577 - RNA, 16 nt, Homo sapiens
aaauauuuccuuaaac

SEQ ID NO: 1552578 - RNA, 15 nt, Homo sapiens
aaaucauaguuuaaa

SEQ ID NO: 1552579 - RNA, 21 nt, Homo sapiens
aaaucauaguuuaaacugcau

SEQ ID NO: 1552580 - RNA, 15 nt, Homo sapiens
aaaucucuuccacau

SEQ ID NO: 1552581 - RNA, 12 nt, Homo sapiens
aaauuauauccg

SEQ ID NO: 1552582 - RNA, 17 nt, Homo sapiens
aaauucauaaccaaaga

SEQ ID NO: 1552583 - RNA, 13 nt, Homo sapiens
aaauugcugcuug

SEQ ID NO: 1552584 - RNA, 20 nt, Homo sapiens
aacacugcagcccucuccac

SEQ ID NO: 1552585 - RNA, 22 nt, Homo sapiens
aacagaagcuuuuuguuugcau

SEQ ID NO: 1552586 - RNA, 21 nt, Homo sapiens
aacagccuaucuuugugugac

SEQ ID NO: 1552587 - RNA, 20 nt, Homo sapiens
aacauuauuagcacuucccg

SEQ ID NO: 1552588 - RNA, 20 nt, Homo sapiens
aaaaaaauuuuaaguaucua

SEQ ID NO: 1552589 - RNA, 16 nt, Homo sapiens
aaaaauaaaaauucau

SEQ ID NO: 1552590 - RNA, 13 nt, Homo sapiens
aaaaaugcugcuc

SEQ ID NO: 1552591 - RNA, 15 nt, Homo sapiens
aaaaauguguuccau

SEQ ID NO: 1552592 - RNA, 14 nt, Homo sapiens
aaaaauuuacuuga

SEQ ID NO: 1552593 - RNA, 16 nt, Homo sapiens
aaaacuaaacuuucau

SEQ ID NO: 1552594 - RNA, 11 nt, Homo sapiens
aaaagauguau

SEQ ID NO: 1552595 - RNA, 20 nt, Homo sapiens
aaaagguuaaauauugucau

SEQ ID NO: 1552596 - RNA, 16 nt, Homo sapiens
aaaauaguaaagccaa

SEQ ID NO: 1552597 - RNA, 17 nt, Homo sapiens
aaaaugaggaauccaaa

SEQ ID NO: 1552598 - RNA, 11 nt, Homo sapiens
aaaaugcugcu

SEQ ID NO: 1552599 - RNA, 15 nt, Homo sapiens
aaaaugcugcucuca

SEQ ID NO: 1552600 - RNA, 18 nt, Homo sapiens
aaaauucauaaccaaaga

SEQ ID NO: 1552601 - RNA, 20 nt, Homo sapiens
aaaauucuauguuaauuaca

SEQ ID NO: 1552602 - RNA, 15 nt, Homo sapiens
aaacaaggaagccaa

SEQ ID NO: 1552603 - RNA, 17 nt, Homo sapiens
aaacacaagaggcuucc

SEQ ID NO: 1552604 - RNA, 23 nt, Homo sapiens
aaacacucuugaauagacuucca

SEQ ID NO: 1552605 - RNA, 17 nt, Homo sapiens
aaacacuuacagaauua

SEQ ID NO: 1552606 - RNA, 16 nt, Homo sapiens
aaacaggaccacaaaa

SEQ ID NO: 1552607 - RNA, 21 nt, Homo sapiens
aaacauguuuaaauagccuaa

SEQ ID NO: 1552608 - RNA, 16 nt, Homo sapiens
aaacuauugagccuug

SEQ ID NO: 1552609 - RNA, 18 nt, Homo sapiens
aaacugacuaaacuuaca

SEQ ID NO: 1552610 - RNA, 23 nt, Homo sapiens
aaacugauucucuaugacaugaa

SEQ ID NO: 1552611 - RNA, 15 nt, Homo sapiens
aaacuguuacugaaa

SEQ ID NO: 1552612 - RNA, 22 nt, Homo sapiens
aaacuuaucacgccuacuuaag

SEQ ID NO: 1552613 - RNA, 13 nt, Homo sapiens
aaagcacuacaau

SEQ ID NO: 1552614 - RNA, 13 nt, Homo sapiens
aaagcaugucuca

SEQ ID NO: 1552615 - RNA, 21 nt, Homo sapiens
aaaggagccuugauaauacuu

SEQ ID NO: 1552616 - RNA, 15 nt, Homo sapiens
aaaggcagcccucac

SEQ ID NO: 1552617 - RNA, 19 nt, Homo sapiens
aaaggugccucauagcaua

SEQ ID NO: 1552618 - RNA, 13 nt, Homo sapiens
aaaguaacugaau

SEQ ID NO: 1552619 - RNA, 19 nt, Homo sapiens
aaaguacaucucuacuaaa

SEQ ID NO: 1552620 - RNA, 21 nt, Homo sapiens
aaaguuuuuuauuaugcauua

SEQ ID NO: 1552621 - RNA, 23 nt, Homo sapiens
aaauaaaaauucauaaccaaaga

SEQ ID NO: 1552622 - RNA, 14 nt, Homo sapiens
aaauauauaugugu

SEQ ID NO: 1552623 - RNA, 16 nt, Homo sapiens
aaauauccagccagua

SEQ ID NO: 1552624 - RNA, 12 nt, Homo sapiens
aaauauugucau

SEQ ID NO: 1552625 - RNA, 15 nt, Homo sapiens
aaauccgacuugaau

SEQ ID NO: 1552626 - RNA, 19 nt, Homo sapiens
aaaucucuuccacaugggu

SEQ ID NO: 1552627 - RNA, 20 nt, Homo sapiens
aaaugccaagggggugacug

SEQ ID NO: 1552628 - RNA, 11 nt, Homo sapiens
aaaugcugcuc

SEQ ID NO: 1552629 - RNA, 16 nt, Homo sapiens
aaaugcuuuuagaaug

SEQ ID NO: 1552630 - RNA, 14 nt, Homo sapiens
aaauuaagacuuua

SEQ ID NO: 1552631 - RNA, 19 nt, Homo sapiens
aaauuagcugggcauggug

SEQ ID NO: 1552632 - RNA, 17 nt, Homo sapiens
aaauuaugaccauggua

SEQ ID NO: 1552633 - RNA, 14 nt, Homo sapiens
aaauuauuugucau

SEQ ID NO: 1552634 - RNA, 13 nt, Homo sapiens
aaauucauuauuc

SEQ ID NO: 1552635 - RNA, 22 nt, Homo sapiens
aaauuuacaucagaaguuugca

SEQ ID NO: 1552636 - RNA, 23 nt, Homo sapiens
aacaaaaaucuguguaacuguaa

SEQ ID NO: 1552637 - RNA, 22 nt, Homo sapiens
aacaacuaggcuucagcauauu

SEQ ID NO: 1552638 - RNA, 13 nt, Homo sapiens
aacaagcguuuau

SEQ ID NO: 1552639 - RNA, 20 nt, Homo sapiens
aacacacgagcaaacccaga

SEQ ID NO: 1552640 - RNA, 19 nt, Homo sapiens
aacacauguucugugccug

SEQ ID NO: 1552641 - RNA, 19 nt, Homo sapiens
aacacccgacuccucaaaa

SEQ ID NO: 1552642 - RNA, 20 nt, Homo sapiens
aacacccgacuccucaaaag

SEQ ID NO: 1552643 - RNA, 21 nt, Homo sapiens
aacagagcaagacuccaucuc

SEQ ID NO: 1552644 - RNA, 21 nt, Homo sapiens
aacagcguguaaacacauguu

SEQ ID NO: 1552645 - RNA, 23 nt, Homo sapiens
aacagcugaggucucuugaggga

SEQ ID NO: 1552646 - RNA, 18 nt, Homo sapiens
aacauaguuuaaguugau

SEQ ID NO: 1552647 - RNA, 14 nt, Homo sapiens
aaccaguuuaucca

SEQ ID NO: 1552648 - RNA, 19 nt, Homo sapiens
aacccagagguggauguua

SEQ ID NO: 1552649 - RNA, 16 nt, Homo sapiens
aacuagagcacagaag

SEQ ID NO: 1552650 - RNA, 17 nt, Homo sapiens
aacuaguaauacugucu

SEQ ID NO: 1552651 - RNA, 22 nt, Homo sapiens
aacuauugagccuugcauguac

SEQ ID NO: 1552652 - RNA, 14 nt, Homo sapiens
aacugaacugugaa

SEQ ID NO: 1552653 - RNA, 19 nt, Homo sapiens
aagaaaucuuucucccuca

SEQ ID NO: 1552654 - RNA, 19 nt, Homo sapiens
aagacucaguaugcuuucc

SEQ ID NO: 1552655 - RNA, 15 nt, Homo sapiens
aagacuccaucucaa

SEQ ID NO: 1552656 - RNA, 16 nt, Homo sapiens
aagacuuuauguaguu

SEQ ID NO: 1552657 - RNA, 18 nt, Homo sapiens
aagagcguagacaggugu

SEQ ID NO: 1552658 - RNA, 21 nt, Homo sapiens
aagaggcuucccuaguuuaca

SEQ ID NO: 1552659 - RNA, 18 nt, Homo sapiens
aagcugcacaugacuaca

SEQ ID NO: 1552660 - RNA, 22 nt, Homo sapiens
aagcuuuuggagggugauauaa

SEQ ID NO: 1552661 - RNA, 12 nt, Homo sapiens
aagggaauuugg

SEQ ID NO: 1552662 - RNA, 13 nt, Homo sapiens
aaggucucuggag

SEQ ID NO: 1552663 - RNA, 21 nt, Homo sapiens
aaguaugugguacuacuguaa

SEQ ID NO: 1552664 - RNA, 15 nt, Homo sapiens
aaguuaaugaaauaa

SEQ ID NO: 1552665 - RNA, 23 nt, Homo sapiens
aaguugcuuuuuuaggcuacagu

SEQ ID NO: 1552666 - RNA, 20 nt, Homo sapiens
aaguuuuuuauuaugcauua

SEQ ID NO: 1552667 - RNA, 19 nt, Homo sapiens
acacacgagcaaacccaga

SEQ ID NO: 1552668 - RNA, 16 nt, Homo sapiens
acacagcacaagggca

SEQ ID NO: 1552669 - RNA, 13 nt, Homo sapiens
acacauguucugu

SEQ ID NO: 1552670 - RNA, 17 nt, Homo sapiens
acacgagcaaacccaga

SEQ ID NO: 1552671 - RNA, 18 nt, Homo sapiens
acacgauugagaacugac

SEQ ID NO: 1552672 - RNA, 13 nt, Homo sapiens
acacugauacacu

SEQ ID NO: 1552673 - RNA, 19 nt, Homo sapiens
acacugggugcgucuccag

SEQ ID NO: 1552674 - RNA, 12 nt, Homo sapiens
acacugucuucc

SEQ ID NO: 1552675 - RNA, 16 nt, Homo sapiens
acagaaaccaagccau

SEQ ID NO: 1552676 - RNA, 16 nt, Homo sapiens
acagaccugugugugc

SEQ ID NO: 1552677 - RNA, 15 nt, Homo sapiens
acagugccugggaau

SEQ ID NO: 1552678 - RNA, 18 nt, Homo sapiens
acauagaugucccuuucu

SEQ ID NO: 1552679 - RNA, 17 nt, Homo sapiens
acaugcuaaugacgaca

SEQ ID NO: 1552680 - RNA, 18 nt, Homo sapiens
acauguuacugaccagca

SEQ ID NO: 1552681 - RNA, 14 nt, Homo sapiens
accaaacaaggaag

SEQ ID NO: 1552682 - RNA, 19 nt, Homo sapiens
accaaacaaggaagccaaa

SEQ ID NO: 1552683 - RNA, 15 nt, Homo sapiens
accaacuguacaaaa

SEQ ID NO: 1552684 - RNA, 15 nt, Homo sapiens
accaggauagcuuua

SEQ ID NO: 1552685 - RNA, 21 nt, Homo sapiens
accaguuuaaggaacuucuga

SEQ ID NO: 1552686 - RNA, 11 nt, Homo sapiens
acccacacugc

SEQ ID NO: 1552687 - RNA, 15 nt, Homo sapiens
acccagagguggaug

SEQ ID NO: 1552688 - RNA, 15 nt, Homo sapiens
acccauaaucugcuu

SEQ ID NO: 1552689 - RNA, 12 nt, Homo sapiens
accccucuggcc

SEQ ID NO: 1552690 - RNA, 15 nt, Homo sapiens
accgugaccaggaac

SEQ ID NO: 1552691 - RNA, 15 nt, Homo sapiens
accuauccugaagau

SEQ ID NO: 1552692 - RNA, 18 nt, Homo sapiens
accucugauuacauguau

SEQ ID NO: 1552693 - RNA, 23 nt, Homo sapiens
accucugugaccaacuguuggau

SEQ ID NO: 1552694 - RNA, 17 nt, Homo sapiens
accugggcaucuuagga

SEQ ID NO: 1552695 - RNA, 16 nt, Homo sapiens
accuguagucccagcu

SEQ ID NO: 1552696 - RNA, 16 nt, Homo sapiens
accugucucuaccuaa

SEQ ID NO: 1552697 - RNA, 23 nt, Homo sapiens
accuuggaagggcguucuaggua

SEQ ID NO: 1552698 - RNA, 16 nt, Homo sapiens
acgguaaguguucuca

SEQ ID NO: 1552699 - RNA, 12 nt, Homo sapiens
acuaaacuuuca

SEQ ID NO: 1552700 - RNA, 19 nt, Homo sapiens
acuacauuugugaacaaaa

SEQ ID NO: 1552701 - RNA, 21 nt, Homo sapiens
acuacuguaagagacaugaau

SEQ ID NO: 1552702 - RNA, 20 nt, Homo sapiens
acuauugagccuugcaugua

SEQ ID NO: 1552703 - RNA, 21 nt, Homo sapiens
acuccagcuugggcaacagag

SEQ ID NO: 1552704 - RNA, 22 nt, Homo sapiens
acuccucaaaagcaaaugagau

SEQ ID NO: 1552705 - RNA, 19 nt, Homo sapiens
acuccucaggcagcgugug

SEQ ID NO: 1552706 - RNA, 16 nt, Homo sapiens
acugauacacuugaag

SEQ ID NO: 1552707 - RNA, 22 nt, Homo sapiens
acugcuuuuaaaugaccaaaga

SEQ ID NO: 1552708 - RNA, 18 nt, Homo sapiens
acugggcugggccucgug

SEQ ID NO: 1552709 - RNA, 22 nt, Homo sapiens
acuguacaauaaguuacuugaa

SEQ ID NO: 1552710 - RNA, 20 nt, Homo sapiens
acugucaguguacacgucug

SEQ ID NO: 1552711 - RNA, 19 nt, Homo sapiens
acuuacaggcuaaaauuag

SEQ ID NO: 1552712 - RNA, 15 nt, Homo sapiens
acuugccacauggug

SEQ ID NO: 1552713 - RNA, 16 nt, Homo sapiens
acuuuaaaagacugaa

SEQ ID NO: 1552714 - RNA, 14 nt, Homo sapiens
acuuuaaacuuaau

SEQ ID NO: 1552715 - RNA, 22 nt, Homo sapiens
acuuucuguugccacaacccug

SEQ ID NO: 1552716 - RNA, 22 nt, Homo sapiens
agaaacaccccucugucuagga

SEQ ID NO: 1552717 - RNA, 13 nt, Homo sapiens
agaaaccaagcca

SEQ ID NO: 1552718 - RNA, 15 nt, Homo sapiens
agaaagcacuacaau

SEQ ID NO: 1552719 - RNA, 18 nt, Homo sapiens
agaaagcacuacaaucau

SEQ ID NO: 1552720 - RNA, 23 nt, Homo sapiens
agaaaucauaguuuaaacugcau

SEQ ID NO: 1552721 - RNA, 12 nt, Homo sapiens
agaacaaaugug

SEQ ID NO: 1552722 - RNA, 15 nt, Homo sapiens
agaagaaauagcaga

SEQ ID NO: 1552723 - RNA, 19 nt, Homo sapiens
agaauaaaaacuuccuuca

SEQ ID NO: 1552724 - RNA, 24 nt, Homo sapiens
agaauuaaguuuuaaauaaaccua

SEQ ID NO: 1552725 - RNA, 14 nt, Homo sapiens
agaauuguaucauu

SEQ ID NO: 1552726 - RNA, 23 nt, Homo sapiens
agacaaaaaucaaagaacagaug

SEQ ID NO: 1552727 - RNA, 12 nt, Homo sapiens
agacaucaucaa

SEQ ID NO: 1552728 - RNA, 14 nt, Homo sapiens
agacaugaaugcac

SEQ ID NO: 1552729 - RNA, 16 nt, Homo sapiens
agacaugaauggagac

SEQ ID NO: 1552730 - RNA, 18 nt, Homo sapiens
agacuggauucgugacaa

SEQ ID NO: 1552731 - RNA, 15 nt, Homo sapiens
agagaggcugccuca

SEQ ID NO: 1552732 - RNA, 15 nt, Homo sapiens
agagggugcagucca

SEQ ID NO: 1552733 - RNA, 20 nt, Homo sapiens
agagugagagacaucaucaa

SEQ ID NO: 1552734 - RNA, 16 nt, Homo sapiens
agauagcuacagugua

SEQ ID NO: 1552735 - RNA, 16 nt, Homo sapiens
agauguuauuacuguu

SEQ ID NO: 1552736 - RNA, 16 nt, Homo sapiens
agcaaaaaguauugaa

SEQ ID NO: 1552737 - RNA, 18 nt, Homo sapiens
agcaaacacuuacagaau

SEQ ID NO: 1552738 - RNA, 20 nt, Homo sapiens
agcaaugcaagcagccuagc

SEQ ID NO: 1552739 - RNA, 16 nt, Homo sapiens
agcacuuuaaacuuaa

SEQ ID NO: 1552740 - RNA, 15 nt, Homo sapiens
agcacuuugccaugc

SEQ ID NO: 1552741 - RNA, 12 nt, Homo sapiens
agcaggccacug

SEQ ID NO: 1552742 - RNA, 15 nt, Homo sapiens
agcagugaaguauaa

SEQ ID NO: 1552743 - RNA, 21 nt, Homo sapiens
agcaugauacaaauuccacag

SEQ ID NO: 1552744 - RNA, 21 nt, Homo sapiens
agcauuuauuuuggggaggaa

SEQ ID NO: 1552745 - RNA, 18 nt, Homo sapiens
agccccgccccguuguga

SEQ ID NO: 1552746 - RNA, 14 nt, Homo sapiens
agccccgccuguca

SEQ ID NO: 1552747 - RNA, 16 nt, Homo sapiens
agccccgccugucaca

SEQ ID NO: 1552748 - RNA, 21 nt, Homo sapiens
agcccuucuauacccacccag

SEQ ID NO: 1552749 - RNA, 16 nt, Homo sapiens
agccgcugcacaucac

SEQ ID NO: 1552750 - RNA, 14 nt, Homo sapiens
agccucuccaggaa

SEQ ID NO: 1552751 - RNA, 12 nt, Homo sapiens
acuguacugugu

SEQ ID NO: 1552752 - RNA, 18 nt, Homo sapiens
acuguguuucgcauuaag

SEQ ID NO: 1552753 - RNA, 18 nt, Homo sapiens
acuguuuugggccuccau

SEQ ID NO: 1552754 - RNA, 13 nt, Homo sapiens
acuuccacuuugu

SEQ ID NO: 1552755 - RNA, 16 nt, Homo sapiens
acuuccuguaauguac

SEQ ID NO: 1552756 - RNA, 18 nt, Homo sapiens
acuuccuucaaucuucau

SEQ ID NO: 1552757 - RNA, 15 nt, Homo sapiens
acuugaccucuguga

SEQ ID NO: 1552758 - RNA, 17 nt, Homo sapiens
acuuguaguccauuuaa

SEQ ID NO: 1552759 - RNA, 22 nt, Homo sapiens
acuugugugugggcugugagug

SEQ ID NO: 1552760 - RNA, 14 nt, Homo sapiens
acuuuacugggcuc

SEQ ID NO: 1552761 - RNA, 21 nt, Homo sapiens
agaaaauauuuuuaaauggac

SEQ ID NO: 1552762 - RNA, 19 nt, Homo sapiens
agaaagaauuggccaggca

SEQ ID NO: 1552763 - RNA, 23 nt, Homo sapiens
agaaaggucucuggagggacaaa

SEQ ID NO: 1552764 - RNA, 17 nt, Homo sapiens
agaaauagacaguauau

SEQ ID NO: 1552765 - RNA, 23 nt, Homo sapiens
agaaaugauucaaauugcugcuu

SEQ ID NO: 1552766 - RNA, 18 nt, Homo sapiens
agaaauggcgucugcucu

SEQ ID NO: 1552767 - RNA, 14 nt, Homo sapiens
agaacaaauguguu

SEQ ID NO: 1552768 - RNA, 13 nt, Homo sapiens
agaaguuugcauc

SEQ ID NO: 1552769 - RNA, 18 nt, Homo sapiens
agaauaaaaacuuccuuc

SEQ ID NO: 1552770 - RNA, 23 nt, Homo sapiens
agaauccauccaaaguucccuau

SEQ ID NO: 1552771 - RNA, 18 nt, Homo sapiens
agaaucucuugaaccugg

SEQ ID NO: 1552772 - RNA, 12 nt, Homo sapiens
agaauucaguau

SEQ ID NO: 1552773 - RNA, 22 nt, Homo sapiens
agacacgauugagaacugacaa

SEQ ID NO: 1552774 - RNA, 14 nt, Homo sapiens
agacuccaucucaa

SEQ ID NO: 1552775 - RNA, 18 nt, Homo sapiens
agacuguugccacuuaac

SEQ ID NO: 1552776 - RNA, 20 nt, Homo sapiens
agagaauccauccaaaguuc

SEQ ID NO: 1552777 - RNA, 22 nt, Homo sapiens
agagaauuguaucauuugaaca

SEQ ID NO: 1552778 - RNA, 12 nt, Homo sapiens
agagacaugaau

SEQ ID NO: 1552779 - RNA, 17 nt, Homo sapiens
agagcccgcagggccau

SEQ ID NO: 1552780 - RNA, 14 nt, Homo sapiens
agaggcugccucag

SEQ ID NO: 1552781 - RNA, 19 nt, Homo sapiens
agaguggucuuucuggaga

SEQ ID NO: 1552782 - RNA, 20 nt, Homo sapiens
agauacaggggaucauguua

SEQ ID NO: 1552783 - RNA, 18 nt, Homo sapiens
agauauucagaaguauau

SEQ ID NO: 1552784 - RNA, 17 nt, Homo sapiens
agaucacgucacugcac

SEQ ID NO: 1552785 - RNA, 17 nt, Homo sapiens
agaucuuucaggaaaga

SEQ ID NO: 1552786 - RNA, 19 nt, Homo sapiens
agcaaggcuuugguuucca

SEQ ID NO: 1552787 - RNA, 15 nt, Homo sapiens
agcaucccucaccca

SEQ ID NO: 1552788 - RNA, 20 nt, Homo sapiens
agcaugucucaauaguaaaa

SEQ ID NO: 1552789 - RNA, 19 nt, Homo sapiens
agccacccguggggugcug

SEQ ID NO: 1552790 - RNA, 15 nt, Homo sapiens
agccagaaagcacua

SEQ ID NO: 1552791 - RNA, 18 nt, Homo sapiens
agccauuauuaugauguu

SEQ ID NO: 1552792 - RNA, 20 nt, Homo sapiens
agccgguggugcccgugccc

SEQ ID NO: 1552793 - RNA, 21 nt, Homo sapiens
agccucguuggagagcagcag

SEQ ID NO: 1552794 - RNA, 20 nt, Homo sapiens
agccucguuucugcuuucag

SEQ ID NO: 1552795 - RNA, 17 nt, Homo sapiens
agccuugauaauacuug

SEQ ID NO: 1552796 - RNA, 19 nt, Homo sapiens
agccuugauaauacuugac

SEQ ID NO: 1552797 - RNA, 22 nt, Homo sapiens
agcggccccccgcacagccacc

SEQ ID NO: 1552798 - RNA, 18 nt, Homo sapiens
agcuacggguaggucuau

SEQ ID NO: 1552799 - RNA, 22 nt, Homo sapiens
agcucaccuugagauaacaauc

SEQ ID NO: 1552800 - RNA, 21 nt, Homo sapiens
agcuggauagacuugggaugg

SEQ ID NO: 1552801 - RNA, 17 nt, Homo sapiens
agcuugacugcuuuuaa

SEQ ID NO: 1552802 - RNA, 12 nt, Homo sapiens
agcuuugucacu

SEQ ID NO: 1552803 - RNA, 15 nt, Homo sapiens
aggaaaagauguaug

SEQ ID NO: 1552804 - RNA, 22 nt, Homo sapiens
aggaagaaauucagguacagaa

SEQ ID NO: 1552805 - RNA, 15 nt, Homo sapiens
aggaagaaugaaacu

SEQ ID NO: 1552806 - RNA, 12 nt, Homo sapiens
aggaagccaaag

SEQ ID NO: 1552807 - RNA, 15 nt, Homo sapiens
aggacaagacacuga

SEQ ID NO: 1552808 - RNA, 13 nt, Homo sapiens
aggagaguggcag

SEQ ID NO: 1552809 - RNA, 13 nt, Homo sapiens
aggagauacugaa

SEQ ID NO: 1552810 - RNA, 14 nt, Homo sapiens
aggagcccuucuau

SEQ ID NO: 1552811 - RNA, 17 nt, Homo sapiens
aggcaggagaaucucuu

SEQ ID NO: 1552812 - RNA, 20 nt, Homo sapiens
agggaagagugcauuuuccc

SEQ ID NO: 1552813 - RNA, 21 nt, Homo sapiens
agggaaggagcccagccagaa

SEQ ID NO: 1552814 - RNA, 14 nt, Homo sapiens
agggagagccagcu

SEQ ID NO: 1552815 - RNA, 19 nt, Homo sapiens
agggauugaggaguugccu

SEQ ID NO: 1552816 - RNA, 14 nt, Homo sapiens
agggcagaggaaug

SEQ ID NO: 1552817 - RNA, 23 nt, Homo sapiens
agggcagggcaucuccugugcau

SEQ ID NO: 1552818 - RNA, 15 nt, Homo sapiens
agggguuucuucaag

SEQ ID NO: 1552819 - RNA, 18 nt, Homo sapiens
agggugacugaugauaca

SEQ ID NO: 1552820 - RNA, 14 nt, Homo sapiens
agggugcaguccag

SEQ ID NO: 1552821 - RNA, 13 nt, Homo sapiens
aggucaaacacaa

SEQ ID NO: 1552822 - RNA, 15 nt, Homo sapiens
aggucggcacuugga

SEQ ID NO: 1552823 - RNA, 18 nt, Homo sapiens
aggugucgggacaugguu

SEQ ID NO: 1552824 - RNA, 14 nt, Homo sapiens
agguuagaaaggca

SEQ ID NO: 1552825 - RNA, 18 nt, Homo sapiens
aguaagagcuggugucug

SEQ ID NO: 1552826 - RNA, 12 nt, Homo sapiens
aguacaucucua

SEQ ID NO: 1552827 - RNA, 15 nt, Homo sapiens
aguacaucucuacua

SEQ ID NO: 1552828 - RNA, 21 nt, Homo sapiens
aguauauuuauagucacaaga

SEQ ID NO: 1552829 - RNA, 19 nt, Homo sapiens
aguauguuuguacaguaug

SEQ ID NO: 1552830 - RNA, 20 nt, Homo sapiens
agucacuguucgucacucaa

SEQ ID NO: 1552831 - RNA, 18 nt, Homo sapiens
agucaucuccaucagcug

SEQ ID NO: 1552832 - RNA, 23 nt, Homo sapiens
aguccagguggugaauuuuccaa

SEQ ID NO: 1552833 - RNA, 21 nt, Homo sapiens
agugacagcuuucugggaugu

SEQ ID NO: 1552834 - RNA, 12 nt, Homo sapiens
agugcauaugca

SEQ ID NO: 1552835 - RNA, 20 nt, Homo sapiens
aguguccccuuauacagugg

SEQ ID NO: 1552836 - RNA, 15 nt, Homo sapiens
aguuccuugccuuaa

SEQ ID NO: 1552837 - RNA, 23 nt, Homo sapiens
aguugggggagggaagaccagaa

SEQ ID NO: 1552838 - RNA, 15 nt, Homo sapiens
aguuugaaaaacuaa

SEQ ID NO: 1552839 - RNA, 22 nt, Homo sapiens
aguuuuaccucuucucucucag

SEQ ID NO: 1552840 - RNA, 21 nt, Homo sapiens
aguuuuuuauuaugcauuaua

SEQ ID NO: 1552841 - RNA, 16 nt, Homo sapiens
auaaauuucaauuaga

SEQ ID NO: 1552842 - RNA, 13 nt, Homo sapiens
auaacagaauuaa

SEQ ID NO: 1552843 - RNA, 11 nt, Homo sapiens
auaaccaaaga

SEQ ID NO: 1552844 - RNA, 21 nt, Homo sapiens
auaauaaaacuaaacuuucau

SEQ ID NO: 1552845 - RNA, 17 nt, Homo sapiens
auagaaguagcaaaaag

SEQ ID NO: 1552846 - RNA, 21 nt, Homo sapiens
auagagauagcuacaguguaa

SEQ ID NO: 1552847 - RNA, 15 nt, Homo sapiens
auaggagugaauaca

SEQ ID NO: 1552848 - RNA, 14 nt, Homo sapiens
auaggucacuccug

SEQ ID NO: 1552849 - RNA, 19 nt, Homo sapiens
auaguuuaaguugauuaaa

SEQ ID NO: 1552850 - RNA, 19 nt, Homo sapiens
auauaguuccuugccuuaa

SEQ ID NO: 1552851 - RNA, 14 nt, Homo sapiens
auauccaagacuua

SEQ ID NO: 1552852 - RNA, 16 nt, Homo sapiens
auaugacccacacugc

SEQ ID NO: 1552853 - RNA, 19 nt, Homo sapiens
auauuuauagcaauccaug

SEQ ID NO: 1552854 - RNA, 11 nt, Homo sapiens
aucacaacauu

SEQ ID NO: 1552855 - RNA, 23 nt, Homo sapiens
aucacgucacugcacuccagcuu

SEQ ID NO: 1552856 - RNA, 14 nt, Homo sapiens
aucagagcauuuau

SEQ ID NO: 1552857 - RNA, 15 nt, Homo sapiens
aucagagggugacug

SEQ ID NO: 1552858 - RNA, 20 nt, Homo sapiens
aucauuuaacugaacuguga

SEQ ID NO: 1552859 - RNA, 18 nt, Homo sapiens
auccaccaagaacauaag

SEQ ID NO: 1552860 - RNA, 19 nt, Homo sapiens
auccaccaagaacauaaga

SEQ ID NO: 1552861 - RNA, 13 nt, Homo sapiens
aucccaacuuccu

SEQ ID NO: 1552862 - RNA, 20 nt, Homo sapiens
auccucacugggugggguga

SEQ ID NO: 1552863 - RNA, 19 nt, Homo sapiens
auccugaagaugugauaca

SEQ ID NO: 1552864 - RNA, 14 nt, Homo sapiens
aucuaccacuguau

SEQ ID NO: 1552865 - RNA, 23 nt, Homo sapiens
augaaaaauguguuccauugcca

SEQ ID NO: 1552866 - RNA, 19 nt, Homo sapiens
augaaacuauuuuaccuga

SEQ ID NO: 1552867 - RNA, 16 nt, Homo sapiens
augaaauuauuuguca

SEQ ID NO: 1552868 - RNA, 13 nt, Homo sapiens
augaacacuuuuu

SEQ ID NO: 1552869 - RNA, 12 nt, Homo sapiens
augaaugcacac

SEQ ID NO: 1552870 - RNA, 17 nt, Homo sapiens
augaauggagacuucua

SEQ ID NO: 1552871 - RNA, 23 nt, Homo sapiens
gacugcuuuuaaaugaccaaaga

SEQ ID NO: 1552872 - RNA, 16 nt, Homo sapiens
gacuuagagcugggaa

SEQ ID NO: 1552873 - RNA, 20 nt, Homo sapiens
gacuuggucugauuucagga

SEQ ID NO: 1552874 - RNA, 16 nt, Homo sapiens
gagaacugacaaagga

SEQ ID NO: 1552875 - RNA, 13 nt, Homo sapiens
gagaaucccacau

SEQ ID NO: 1552876 - RNA, 17 nt, Homo sapiens
gagagcagcaggugcug

SEQ ID NO: 1552877 - RNA, 18 nt, Homo sapiens
gagagggaagagugcauu

SEQ ID NO: 1552878 - RNA, 22 nt, Homo sapiens
gagaguggcaggugggcugccu

SEQ ID NO: 1552879 - RNA, 11 nt, Homo sapiens
gagaugcccau

SEQ ID NO: 1552880 - RNA, 16 nt, Homo sapiens
gagaugcccauucucu

SEQ ID NO: 1552881 - RNA, 13 nt, Homo sapiens
gagcaagacucca

SEQ ID NO: 1552882 - RNA, 21 nt, Homo sapiens
gagcaguucuguugcaugauu

SEQ ID NO: 1552883 - RNA, 19 nt, Homo sapiens
gagccuacuucuagcugua

SEQ ID NO: 1552884 - RNA, 14 nt, Homo sapiens
gagccuugcaugua

SEQ ID NO: 1552885 - RNA, 18 nt, Homo sapiens
gagccuugcugggccagg

SEQ ID NO: 1552886 - RNA, 17 nt, Homo sapiens
gagcuuugucacuugcc

SEQ ID NO: 1552887 - RNA, 15 nt, Homo sapiens
gaggagguuucugca

SEQ ID NO: 1552888 - RNA, 21 nt, Homo sapiens
gaggcccccuggugugucuga

SEQ ID NO: 1552889 - RNA, 18 nt, Homo sapiens
gagggaagaccagaauuc

SEQ ID NO: 1552890 - RNA, 23 nt, Homo sapiens
gagggacaaacucacucaguaaa

SEQ ID NO: 1552891 - RNA, 17 nt, Homo sapiens
gagguacaaaaguuacu

SEQ ID NO: 1552892 - RNA, 22 nt, Homo sapiens
gagguggauguuaugaacagcu

SEQ ID NO: 1552893 - RNA, 21 nt, Homo sapiens
gauagcuuuauaaagcaguua

SEQ ID NO: 1552894 - RNA, 16 nt, Homo sapiens
gauauucagaaguaua

SEQ ID NO: 1552895 - RNA, 18 nt, Homo sapiens
gaucaacauuuaugaccu

SEQ ID NO: 1552896 - RNA, 19 nt, Homo sapiens
gauguaaauaaaauugagu

SEQ ID NO: 1552897 - RNA, 19 nt, Homo sapiens
gauuccagcagugaaugcu

SEQ ID NO: 1552898 - RNA, 15 nt, Homo sapiens
gauugagaacugaca

SEQ ID NO: 1552899 - RNA, 13 nt, Homo sapiens
gcaaaaaguauug

SEQ ID NO: 1552900 - RNA, 21 nt, Homo sapiens
gcacacuagccucuccaggaa

SEQ ID NO: 1552901 - RNA, 13 nt, Homo sapiens
gcacagauggauu

SEQ ID NO: 1552902 - RNA, 17 nt, Homo sapiens
gcacaucacaacauuua

SEQ ID NO: 1552903 - RNA, 13 nt, Homo sapiens
gcacuuuaaacuu

SEQ ID NO: 1552904 - RNA, 19 nt, Homo sapiens
gcagacugaaccaguccag

SEQ ID NO: 1552905 - RNA, 22 nt, Homo sapiens
gcaggaggcccuugucguggga

SEQ ID NO: 1552906 - RNA, 14 nt, Homo sapiens
gcaggccacugggg

SEQ ID NO: 1552907 - RNA, 13 nt, Homo sapiens
gcaguacuuugug

SEQ ID NO: 1552908 - RNA, 14 nt, Homo sapiens
gcaguuaggugcug

SEQ ID NO: 1552909 - RNA, 19 nt, Homo sapiens
gcauacuuugacaaggaaa

SEQ ID NO: 1552910 - RNA, 12 nt, Homo sapiens
gcauauggugcu

SEQ ID NO: 1552911 - RNA, 22 nt, Homo sapiens
gcaucagugggaucccagacau

SEQ ID NO: 1552912 - RNA, 17 nt, Homo sapiens
gcaucauuuaacugaac

SEQ ID NO: 1552913 - RNA, 13 nt, Homo sapiens
gcaucuccugugc

SEQ ID NO: 1552914 - RNA, 20 nt, Homo sapiens
gcaugaccugugaccagcac

SEQ ID NO: 1552915 - RNA, 23 nt, Homo sapiens
gcaugaccugugaccagcacugu

SEQ ID NO: 1552916 - RNA, 13 nt, Homo sapiens
gcauguacuugaa

SEQ ID NO: 1552917 - RNA, 13 nt, Homo sapiens
gccaagguaggca

SEQ ID NO: 1552918 - RNA, 14 nt, Homo sapiens
gccacaacccuguu

SEQ ID NO: 1552919 - RNA, 20 nt, Homo sapiens
gccaccggaggucacuccac

SEQ ID NO: 1552920 - RNA, 18 nt, Homo sapiens
gccaggcaugguggcuca

SEQ ID NO: 1552921 - RNA, 14 nt, Homo sapiens
gccagggaaacaaa

SEQ ID NO: 1552922 - RNA, 20 nt, Homo sapiens
gcccccgccugccaccggag

SEQ ID NO: 1552923 - RNA, 16 nt, Homo sapiens
gccccgccugucacaa

SEQ ID NO: 1552924 - RNA, 18 nt, Homo sapiens
gcccggcgccgggcacca

SEQ ID NO: 1552925 - RNA, 20 nt, Homo sapiens
gcccgucauguuccucaaaa

SEQ ID NO: 1552926 - RNA, 14 nt, Homo sapiens
gccgacuuggagac

SEQ ID NO: 1552927 - RNA, 21 nt, Homo sapiens
gccgagaucacgucacugcac

SEQ ID NO: 1552928 - RNA, 19 nt, Homo sapiens
gccgggcaccaacuccaug

SEQ ID NO: 1552929 - RNA, 18 nt, Homo sapiens
gccuacuuaagagugcug

SEQ ID NO: 1552930 - RNA, 19 nt, Homo sapiens
gccuacuuaagagugcugu

SEQ ID NO: 1552931 - RNA, 16 nt, Homo sapiens
gccuccagucauggua

SEQ ID NO: 1552932 - RNA, 22 nt, Homo sapiens
gccucccuggggaccaggagcu

SEQ ID NO: 1552933 - RNA, 24 nt, Homo sapiens
gccucuuccagugaacauucccag

SEQ ID NO: 1552934 - RNA, 15 nt, Homo sapiens
gccugacuccugggu

SEQ ID NO: 1552935 - RNA, 22 nt, Homo sapiens
gccugaggaggaggacacagca

SEQ ID NO: 1552936 - RNA, 15 nt, Homo sapiens
gccuggauuccagca

SEQ ID NO: 1552937 - RNA, 17 nt, Homo sapiens
gcggagguugcaaugag

SEQ ID NO: 1552938 - RNA, 14 nt, Homo sapiens
gcguagacaggugu

SEQ ID NO: 1552939 - RNA, 18 nt, Homo sapiens
gcugggcaugguggcgca

SEQ ID NO: 1552940 - RNA, 16 nt, Homo sapiens
gcuguauguaaacugu

SEQ ID NO: 1552941 - RNA, 15 nt, Homo sapiens
gcuuuacugcaugaa

SEQ ID NO: 1552942 - RNA, 15 nt, Homo sapiens
ggaaaacagaccugu

SEQ ID NO: 1552943 - RNA, 22 nt, Homo sapiens
ggaacacccgacuccucaaaag

SEQ ID NO: 1552944 - RNA, 21 nt, Homo sapiens
ggaacaugacccagccugaaa

SEQ ID NO: 1552945 - RNA, 12 nt, Homo sapiens
ggaaguuuucag

SEQ ID NO: 1552946 - RNA, 20 nt, Homo sapiens
ggaaugcaccuccccaaagc

SEQ ID NO: 1552947 - RNA, 12 nt, Homo sapiens
ggaugagucaga

SEQ ID NO: 1552948 - RNA, 20 nt, Homo sapiens
ggcaggagaaucucuugaac

SEQ ID NO: 1552949 - RNA, 17 nt, Homo sapiens
ggcagggugagaagcua

SEQ ID NO: 1552950 - RNA, 22 nt, Homo sapiens
ggcagguaggucggcacuugga

SEQ ID NO: 1552951 - RNA, 16 nt, Homo sapiens
ggcaucuccugugcau

SEQ ID NO: 1552952 - RNA, 21 nt, Homo sapiens
ggcaucuccugugcaugggug

SEQ ID NO: 1552953 - RNA, 24 nt, Homo sapiens
ggccuguccacccugccaagacuc

SEQ ID NO: 1552954 - RNA, 13 nt, Homo sapiens
ggcgcagugcuuc

SEQ ID NO: 1552955 - RNA, 16 nt, Homo sapiens
ggcggcugugcaucag

SEQ ID NO: 1552956 - RNA, 12 nt, Homo sapiens
ggcucaggguug

SEQ ID NO: 1552957 - RNA, 13 nt, Homo sapiens
gggaaggagccca

SEQ ID NO: 1552958 - RNA, 16 nt, Homo sapiens
gggaaugcaccucccc

SEQ ID NO: 1552959 - RNA, 17 nt, Homo sapiens
gggcacuacauaauugc

SEQ ID NO: 1552960 - RNA, 18 nt, Homo sapiens
gggcagggugagaagcua

SEQ ID NO: 1552961 - RNA, 13 nt, Homo sapiens
gggccuccaugcc

SEQ ID NO: 1552962 - RNA, 23 nt, Homo sapiens
ggggcuccugaauaucagucacu

SEQ ID NO: 1552963 - RNA, 17 nt, Homo sapiens
ggguccugccgguggga

SEQ ID NO: 1552964 - RNA, 18 nt, Homo sapiens
gggucucgcagccugaag

SEQ ID NO: 1552965 - RNA, 17 nt, Homo sapiens
gguauguaguuacagaa

SEQ ID NO: 1552966 - RNA, 17 nt, Homo sapiens
ggucucgcagccugaag

SEQ ID NO: 1552967 - RNA, 21 nt, Homo sapiens
ggucugacaugaacacuuuuu

SEQ ID NO: 1552968 - RNA, 16 nt, Homo sapiens
ggucugauuucaggau

SEQ ID NO: 1552969 - RNA, 13 nt, Homo sapiens
ggucugugacugg

SEQ ID NO: 1552970 - RNA, 22 nt, Homo sapiens
ggugagaagcuagaugccccug

SEQ ID NO: 1552971 - RNA, 13 nt, Homo sapiens
ggugaggaccacu

SEQ ID NO: 1552972 - RNA, 12 nt, Homo sapiens
ggugcaguccag

SEQ ID NO: 1552973 - RNA, 22 nt, Homo sapiens
guaaaacauaauguaucaugaa

SEQ ID NO: 1552974 - RNA, 12 nt, Homo sapiens
guaaguacagaa

SEQ ID NO: 1552975 - RNA, 23 nt, Homo sapiens
guacaguucugggguacauguua

SEQ ID NO: 1552976 - RNA, 20 nt, Homo sapiens
guacgcugcugcaggacauu

SEQ ID NO: 1552977 - RNA, 20 nt, Homo sapiens
guagacagguguuacuuaca

SEQ ID NO: 1552978 - RNA, 15 nt, Homo sapiens
guagagucaucucca

SEQ ID NO: 1552979 - RNA, 20 nt, Homo sapiens
guauauuuguaaacuacaaa

SEQ ID NO: 1552980 - RNA, 21 nt, Homo sapiens
guaugccuuaagcagaacaaa

SEQ ID NO: 1552981 - RNA, 19 nt, Homo sapiens
guaugugguacuacuguaa

SEQ ID NO: 1552982 - RNA, 16 nt, Homo sapiens
gucacucaaaugaauu

SEQ ID NO: 1552983 - RNA, 13 nt, Homo sapiens
gucacuugccaca

SEQ ID NO: 1552984 - RNA, 18 nt, Homo sapiens
gucagacacgauugagaa

SEQ ID NO: 1552985 - RNA, 21 nt, Homo sapiens
gucaugacggggacagaguga

SEQ ID NO: 1552986 - RNA, 14 nt, Homo sapiens
gucauucauucaag

SEQ ID NO: 1552987 - RNA, 15 nt, Homo sapiens
gucuaggacugcagu

SEQ ID NO: 1552988 - RNA, 15 nt, Homo sapiens
gucuauuuucagagc

SEQ ID NO: 1552989 - RNA, 15 nt, Homo sapiens
gucucaguuucacuu

SEQ ID NO: 1552990 - RNA, 17 nt, Homo sapiens
gucucuaccuaaggaca

SEQ ID NO: 1552991 - RNA, 11 nt, Homo sapiens
ugaccaggaac

SEQ ID NO: 1552992 - RNA, 15 nt, Homo sapiens
ugacccagccugaaa

SEQ ID NO: 1552993 - RNA, 20 nt, Homo sapiens
ugacgcuugugacagugccu

SEQ ID NO: 1552994 - RNA, 13 nt, Homo sapiens
ugaggaauccaaa

SEQ ID NO: 1552995 - RNA, 15 nt, Homo sapiens
ugaggaauccaaaag

SEQ ID NO: 1552996 - RNA, 15 nt, Homo sapiens
ugaggaggaggacac

SEQ ID NO: 1552997 - RNA, 15 nt, Homo sapiens
ugaggcccagugcau

SEQ ID NO: 1552998 - RNA, 22 nt, Homo sapiens
ugagucagacacgauugagaac

SEQ ID NO: 1552999 - RNA, 18 nt, Homo sapiens
ugaguccaucuaacauca

SEQ ID NO: 1553000 - RNA, 15 nt, Homo sapiens
ugauacaaauuccac

SEQ ID NO: 1553001 - RNA, 14 nt, Homo sapiens
ugauauauugcugu

SEQ ID NO: 1553002 - RNA, 17 nt, Homo sapiens
ugaucaauaaaauguga

SEQ ID NO: 1553003 - RNA, 18 nt, Homo sapiens
ugauucaaauugcugcuu

SEQ ID NO: 1553004 - RNA, 15 nt, Homo sapiens
ugauucucuaugaca

SEQ ID NO: 1553005 - RNA, 16 nt, Homo sapiens
ugauuuagugaucaaa

SEQ ID NO: 1553006 - RNA, 15 nt, Homo sapiens
ugcaagugaacaaag

SEQ ID NO: 1553007 - RNA, 20 nt, Homo sapiens
ugcaagugaacaaagugaga

SEQ ID NO: 1553008 - RNA, 23 nt, Homo sapiens
ugcacugugguuucagaugugca

SEQ ID NO: 1553009 - RNA, 22 nt, Homo sapiens
ugcagacagucuguuaugcacu

SEQ ID NO: 1553010 - RNA, 23 nt, Homo sapiens
ugcaucauuuaacugaacuguga

SEQ ID NO: 1553011 - RNA, 15 nt, Homo sapiens
ugccucauagcauag

SEQ ID NO: 1553012 - RNA, 21 nt, Homo sapiens
ugcuuaaaagguuaaauuuca

SEQ ID NO: 1553013 - RNA, 15 nt, Homo sapiens
uggagaaggcauguu

SEQ ID NO: 1553014 - RNA, 18 nt, Homo sapiens
uggagaggagaguggcag

SEQ ID NO: 1553015 - RNA, 19 nt, Homo sapiens
uggauuuugaaauuuacug

SEQ ID NO: 1553016 - RNA, 17 nt, Homo sapiens
uggcaggaaucuaucca

SEQ ID NO: 1553017 - RNA, 18 nt, Homo sapiens
uggccauggugacauugu

SEQ ID NO: 1553018 - RNA, 14 nt, Homo sapiens
uggccccacuuuga

SEQ ID NO: 1553019 - RNA, 16 nt, Homo sapiens
uggccccacuuugaag

SEQ ID NO: 1553020 - RNA, 13 nt, Homo sapiens
uggcggccuuccg

SEQ ID NO: 1553021 - RNA, 21 nt, Homo sapiens
ugggaagauaggcucugcaca

SEQ ID NO: 1553022 - RNA, 23 nt, Homo sapiens
ugggauuucucccucucagugga

SEQ ID NO: 1553023 - RNA, 21 nt, Homo sapiens
uguaacugacugccuugcuaa

SEQ ID NO: 1553024 - RNA, 19 nt, Homo sapiens
uguaacuguaaaacauuga

SEQ ID NO: 1553025 - RNA, 19 nt, Homo sapiens
uguauuuuuuguaugcuua

SEQ ID NO: 1553026 - RNA, 19 nt, Homo sapiens
ugucacuugccacauggug

SEQ ID NO: 1553027 - RNA, 20 nt, Homo sapiens
ugucaugacggggacagagu

SEQ ID NO: 1553028 - RNA, 19 nt, Homo sapiens
uguccuuuuucacuuugaa

SEQ ID NO: 1553029 - RNA, 18 nt, Homo sapiens
ugucuaggacugcagugu

SEQ ID NO: 1553030 - RNA, 19 nt, Homo sapiens
ugucucgaugccauaauca

SEQ ID NO: 1553031 - RNA, 20 nt, Homo sapiens
ugugaaauucacaguaauau

SEQ ID NO: 1553032 - RNA, 19 nt, Homo sapiens
ugugagguucgcuuaucaa

SEQ ID NO: 1553033 - RNA, 19 nt, Homo sapiens
ugugaguaagagcuggugu

SEQ ID NO: 1553034 - RNA, 13 nt, Homo sapiens
uguggccccaaga

SEQ ID NO: 1553035 - RNA, 21 nt, Homo sapiens
ugugggucccgcacucugccc

SEQ ID NO: 1553036 - RNA, 17 nt, Homo sapiens
ugugguacuacuguaag

SEQ ID NO: 1553037 - RNA, 22 nt, Homo sapiens
uguguaacuguaaaacauugaa

SEQ ID NO: 1553038 - RNA, 14 nt, Homo sapiens
ugugucauuuauaa

SEQ ID NO: 1553039 - RNA, 19 nt, Homo sapiens
uguguguauguuugcacac

SEQ ID NO: 1553040 - RNA, 16 nt, Homo sapiens
uguucuggaagccaua

SEQ ID NO: 1553041 - RNA, 17 nt, Homo sapiens
uguuucaguucagauaa

SEQ ID NO: 1553042 - RNA, 20 nt, Homo sapiens
uuaaaaacuagagcacagaa

SEQ ID NO: 1553043 - RNA, 13 nt, Homo sapiens
uuaaauucugaau

SEQ ID NO: 1553044 - RNA, 15 nt, Homo sapiens
uuaacugaacuguga

SEQ ID NO: 1553045 - RNA, 19 nt, Homo sapiens
uuaaggaacuucugaagau

SEQ ID NO: 1553046 - RNA, 13 nt, Homo sapiens
uuaaguggcagaa

SEQ ID NO: 1553047 - RNA, 13 nt, Homo sapiens
uuaauaaauaugu

SEQ ID NO: 1553048 - RNA, 15 nt, Homo sapiens
uuaauauccaagacu

SEQ ID NO: 1553049 - RNA, 23 nt, Homo sapiens
uuaaugagauguuauuacuguuu

SEQ ID NO: 1553050 - RNA, 17 nt, Homo sapiens
uuaauuacaacugcuau

SEQ ID NO: 1553051 - RNA, 12 nt, Homo sapiens
uuacagaauucc

SEQ ID NO: 1553052 - RNA, 23 nt, Homo sapiens
uuacccuuuggccccacuuugaa

SEQ ID NO: 1553053 - RNA, 13 nt, Homo sapiens
uuacugucuauau

SEQ ID NO: 1553054 - RNA, 19 nt, Homo sapiens
uuacuguuuugggccucca

SEQ ID NO: 1553055 - RNA, 13 nt, Homo sapiens
uuagagcugggaa

SEQ ID NO: 1553056 - RNA, 21 nt, Homo sapiens
uuauaaacuuuagaguagcau

SEQ ID NO: 1553057 - RNA, 20 nt, Homo sapiens
uuauagaaguagcaaaaagu

SEQ ID NO: 1553058 - RNA, 14 nt, Homo sapiens
uuauauuucacuau

SEQ ID NO: 1553059 - RNA, 21 nt, Homo sapiens
uuaucuauuccugaaauuucu

SEQ ID NO: 1553060 - RNA, 16 nt, Homo sapiens
uucaagaaagaauucc

SEQ ID NO: 1553061 - RNA, 15 nt, Homo sapiens
uucagaagacacugc

SEQ ID NO: 1553062 - RNA, 17 nt, Homo sapiens
uucaggaaggucuucaa

SEQ ID NO: 1553063 - RNA, 14 nt, Homo sapiens
uucauaaccaaaga

SEQ ID NO: 1553064 - RNA, 23 nt, Homo sapiens
uucaugggaaaacagaccugugu

SEQ ID NO: 1553065 - RNA, 19 nt, Homo sapiens
uucauuaaaucaacuuuau

SEQ ID NO: 1553066 - RNA, 19 nt, Homo sapiens
uuccagugaacauucccag

SEQ ID NO: 1553067 - RNA, 17 nt, Homo sapiens
uucccaaguaugccuua

SEQ ID NO: 1553068 - RNA, 15 nt, Homo sapiens
uuccuuaaacugugu

SEQ ID NO: 1553069 - RNA, 16 nt, Homo sapiens
uuccuuaaacugugug

SEQ ID NO: 1553070 - RNA, 18 nt, Homo sapiens
uuccuuggccaugcagaa

SEQ ID NO: 1553071 - RNA, 17 nt, Homo sapiens
uucgcauuaagcacaca

SEQ ID NO: 1553072 - RNA, 17 nt, Homo sapiens
uucuauacccacccaga

SEQ ID NO: 1553073 - RNA, 15 nt, Homo sapiens
uucuaugcauuaaga

SEQ ID NO: 1553074 - RNA, 23 nt, Homo sapiens
uucuccagacccaccacaccgca

SEQ ID NO: 1553075 - RNA, 15 nt, Homo sapiens
uucugcccaugggaa

SEQ ID NO: 1553076 - RNA, 21 nt, Homo sapiens
uucugucagggguuucuucaa

SEQ ID NO: 1553077 - RNA, 19 nt, Homo sapiens
uucuucaagaaagaauucc

SEQ ID NO: 1553078 - RNA, 22 nt, Homo sapiens
uucuucuucagaagacacugca

SEQ ID NO: 1553079 - RNA, 23 nt, Homo sapiens
uugaacaacuaggcuucagcaua

SEQ ID NO: 1553080 - RNA, 23 nt, Homo sapiens
uugaauauuccuggacuuacaaa

SEQ ID NO: 1553081 - RNA, 14 nt, Homo sapiens
uugacagcauauag

SEQ ID NO: 1553082 - RNA, 14 nt, Homo sapiens
uugagaacugacaa

SEQ ID NO: 1553083 - RNA, 13 nt, Homo sapiens
uugauaccuguag

SEQ ID NO: 1553084 - RNA, 15 nt, Homo sapiens
uugcauguacuugaa

SEQ ID NO: 1553085 - RNA, 16 nt, Homo sapiens
uugccacaacccuguu

SEQ ID NO: 1553086 - RNA, 19 nt, Homo sapiens
uugcccccagauacauggu

SEQ ID NO: 1553087 - RNA, 16 nt, Homo sapiens
uugcuguucugcugaa

SEQ ID NO: 1553088 - RNA, 17 nt, Homo sapiens
uuguacaaugguuuauu

SEQ ID NO: 1553089 - RNA, 22 nt, Homo sapiens
uuguauauuuguaaacuacaaa

SEQ ID NO: 1553090 - RNA, 12 nt, Homo sapiens
uuuaaacugcau

SEQ ID NO: 1553091 - RNA, 14 nt, Homo sapiens
uuuacccucaggca

SEQ ID NO: 1553092 - RNA, 12 nt, Homo sapiens
uuucagcuaaag

SEQ ID NO: 1553093 - RNA, 17 nt, Homo sapiens
uuucugcauagagucuu

SEQ ID NO: 1553094 - RNA, 21 nt, Homo sapiens
uuugauaccuguaguggaacu

SEQ ID NO: 1553095 - RNA, 18 nt, Homo sapiens
uuugcacacuugugugug

SEQ ID NO: 1553096 - RNA, 22 nt, Homo sapiens
uuuguggccuuggcugacauga

SEQ ID NO: 1553097 - RNA, 13 nt, Homo sapiens
uuuucacuuugaa

SEQ ID NO: 1553098 - RNA, 13 nt, Homo sapiens
uuuucugaagaca

SEQ ID NO: 1553099 - RNA, 13 nt, Homo sapiens
uuuugucuuucaa

SEQ ID NO: 1553100 - RNA, 19 nt, Homo sapiens
aggagccuugcugggccag

SEQ ID NO: 1553101 - RNA, 13 nt, Homo sapiens
aggaggaggacac

SEQ ID NO: 1553102 - RNA, 17 nt, Homo sapiens
aggaguugccugacucc

SEQ ID NO: 1553103 - RNA, 12 nt, Homo sapiens
aggcacugucag

SEQ ID NO: 1553104 - RNA, 20 nt, Homo sapiens
aggcaucugccucuggaaaa

SEQ ID NO: 1553105 - RNA, 14 nt, Homo sapiens
aggccacuggggac

SEQ ID NO: 1553106 - RNA, 22 nt, Homo sapiens
aggcugccucagccaguggcac

SEQ ID NO: 1553107 - RNA, 15 nt, Homo sapiens
aggcuuuacagugua

SEQ ID NO: 1553108 - RNA, 22 nt, Homo sapiens
agggaauuuggcucaacuucag

SEQ ID NO: 1553109 - RNA, 16 nt, Homo sapiens
agggggugacuggaag

SEQ ID NO: 1553110 - RNA, 19 nt, Homo sapiens
aggggugguccugacucaa

SEQ ID NO: 1553111 - RNA, 18 nt, Homo sapiens
agguacagaaaacauguu

SEQ ID NO: 1553112 - RNA, 12 nt, Homo sapiens
aggucacuccug

SEQ ID NO: 1553113 - RNA, 13 nt, Homo sapiens
aggucaugggaag

SEQ ID NO: 1553114 - RNA, 18 nt, Homo sapiens
aggucuucaaucuuaaaa

SEQ ID NO: 1553115 - RNA, 19 nt, Homo sapiens
aggugcguguucagcagaa

SEQ ID NO: 1553116 - RNA, 17 nt, Homo sapiens
aggugcugaaugaagcu

SEQ ID NO: 1553117 - RNA, 22 nt, Homo sapiens
aggugggcugccugcuguguua

SEQ ID NO: 1553118 - RNA, 20 nt, Homo sapiens
aguaaaacauaauguaucau

SEQ ID NO: 1553119 - RNA, 14 nt, Homo sapiens
aguaaugcucugac

SEQ ID NO: 1553120 - RNA, 15 nt, Homo sapiens
aguacuuugugcauu

SEQ ID NO: 1553121 - RNA, 20 nt, Homo sapiens
aguaugugguacuacuguaa

SEQ ID NO: 1553122 - RNA, 17 nt, Homo sapiens
aguccaguaaagccuua

SEQ ID NO: 1553123 - RNA, 22 nt, Homo sapiens
agucuuuauguccauaagcuac

SEQ ID NO: 1553124 - RNA, 21 nt, Homo sapiens
agugauaaaucgggaaauuua

SEQ ID NO: 1553125 - RNA, 13 nt, Homo sapiens
agugccugggaau

SEQ ID NO: 1553126 - RNA, 14 nt, Homo sapiens
agugccugggaaug

SEQ ID NO: 1553127 - RNA, 18 nt, Homo sapiens
aguggaaauuaagacuuu

SEQ ID NO: 1553128 - RNA, 18 nt, Homo sapiens
aguggcacaggagacucc

SEQ ID NO: 1553129 - RNA, 23 nt, Homo sapiens
aguuaaugaaauaaaauuugaaa

SEQ ID NO: 1553130 - RNA, 16 nt, Homo sapiens
aguuacaaacagacca

SEQ ID NO: 1553131 - RNA, 16 nt, Homo sapiens
aguuacagaauuccua

SEQ ID NO: 1553132 - RNA, 21 nt, Homo sapiens
aguugagagggugcaguccag

SEQ ID NO: 1553133 - RNA, 22 nt, Homo sapiens
aguugauuaaaaaugcuuuuag

SEQ ID NO: 1553134 - RNA, 11 nt, Homo sapiens
aguugccugac

SEQ ID NO: 1553135 - RNA, 21 nt, Homo sapiens
aguuguuucagauaaauuuca

SEQ ID NO: 1553136 - RNA, 19 nt, Homo sapiens
aguuuacauuguccuguag

SEQ ID NO: 1553137 - RNA, 13 nt, Homo sapiens
aguuuuaccucuu

SEQ ID NO: 1553138 - RNA, 17 nt, Homo sapiens
auaaaauugaguucuca

SEQ ID NO: 1553139 - RNA, 16 nt, Homo sapiens
auaaguagaaagaauu

SEQ ID NO: 1553140 - RNA, 14 nt, Homo sapiens
auaaguuacuugaa

SEQ ID NO: 1553141 - RNA, 14 nt, Homo sapiens
auaccaacuguaca

SEQ ID NO: 1553142 - RNA, 17 nt, Homo sapiens
auacuuugacaaggaaa

SEQ ID NO: 1553143 - RNA, 15 nt, Homo sapiens
auaggccugggugcu

SEQ ID NO: 1553144 - RNA, 17 nt, Homo sapiens
auagugucugcugcugc

SEQ ID NO: 1553145 - RNA, 18 nt, Homo sapiens
auauaaaguacaucucua

SEQ ID NO: 1553146 - RNA, 17 nt, Homo sapiens
auauaccugguuuacuu

SEQ ID NO: 1553147 - RNA, 20 nt, Homo sapiens
auauauagggagcacuuuaa

SEQ ID NO: 1553148 - RNA, 16 nt, Homo sapiens
auaucagucacuguuc

SEQ ID NO: 1553149 - RNA, 16 nt, Homo sapiens
auauuuuuccacuuaa

SEQ ID NO: 1553150 - RNA, 17 nt, Homo sapiens
auauuuuuccacuuaaa

SEQ ID NO: 1553151 - RNA, 15 nt, Homo sapiens
aucaaaucucuucca

SEQ ID NO: 1553152 - RNA, 15 nt, Homo sapiens
aucaacuaaugauuu

SEQ ID NO: 1553153 - RNA, 22 nt, Homo sapiens
aucaagcuuuuaaaaacuagag

SEQ ID NO: 1553154 - RNA, 18 nt, Homo sapiens
aucaccuuguauucucuu

SEQ ID NO: 1553155 - RNA, 22 nt, Homo sapiens
aucacgucacugcacuccagcu

SEQ ID NO: 1553156 - RNA, 15 nt, Homo sapiens
aucagaaguuugcau

SEQ ID NO: 1553157 - RNA, 22 nt, Homo sapiens
aucaucggaguugacagugaaa

SEQ ID NO: 1553158 - RNA, 18 nt, Homo sapiens
auccaauccucacugggu

SEQ ID NO: 1553159 - RNA, 15 nt, Homo sapiens
auccauugaacuaaa

SEQ ID NO: 1553160 - RNA, 18 nt, Homo sapiens
aucccacauuagcuuguu

SEQ ID NO: 1553161 - RNA, 12 nt, Homo sapiens
auccgacuugaa

SEQ ID NO: 1553162 - RNA, 18 nt, Homo sapiens
aucggaguugacagugaa

SEQ ID NO: 1553163 - RNA, 13 nt, Homo sapiens
aucucuuccacau

SEQ ID NO: 1553164 - RNA, 22 nt, Homo sapiens
augaaaauuuuaaugcauuguu

SEQ ID NO: 1553165 - RNA, 12 nt, Homo sapiens
augaaacuaaga

SEQ ID NO: 1553166 - RNA, 17 nt, Homo sapiens
augaaauacugccuugg

SEQ ID NO: 1553167 - RNA, 16 nt, Homo sapiens
augaacacuacagaua

SEQ ID NO: 1553168 - RNA, 22 nt, Homo sapiens
augaauaccaggauagcuuuau

SEQ ID NO: 1553169 - RNA, 16 nt, Homo sapiens
augagcgccaccucuu

SEQ ID NO: 1553170 - RNA, 19 nt, Homo sapiens
augauuuagugaucaaauu

SEQ ID NO: 1553171 - RNA, 13 nt, Homo sapiens
augcaaauucauc

SEQ ID NO: 1553172 - RNA, 23 nt, Homo sapiens
augcaggagccuacuucuagcug

SEQ ID NO: 1553173 - RNA, 17 nt, Homo sapiens
augcauuauaucaaauc

SEQ ID NO: 1553174 - RNA, 18 nt, Homo sapiens
augcauuguuauaauuac

SEQ ID NO: 1553175 - RNA, 21 nt, Homo sapiens
augccaagggggugacuggaa

SEQ ID NO: 1553176 - RNA, 17 nt, Homo sapiens
augccacccuguuuuca

SEQ ID NO: 1553177 - RNA, 14 nt, Homo sapiens
auggagacuucuaa

SEQ ID NO: 1553178 - RNA, 13 nt, Homo sapiens
auggcgucugcuc

SEQ ID NO: 1553179 - RNA, 17 nt, Homo sapiens
auggcugggaacaugac

SEQ ID NO: 1553180 - RNA, 13 nt, Homo sapiens
auggggucuguga

SEQ ID NO: 1553181 - RNA, 12 nt, Homo sapiens
auguacuugaag

SEQ ID NO: 1553182 - RNA, 20 nt, Homo sapiens
auguaguuuuuauauguugu

SEQ ID NO: 1553183 - RNA, 21 nt, Homo sapiens
auguaguuuuuauauguugua

SEQ ID NO: 1553184 - RNA, 19 nt, Homo sapiens
auguguguguauguuugca

SEQ ID NO: 1553185 - RNA, 14 nt, Homo sapiens
auguuacugaccag

SEQ ID NO: 1553186 - RNA, 14 nt, Homo sapiens
auguuccucaaaag

SEQ ID NO: 1553187 - RNA, 18 nt, Homo sapiens
auguuugcacacuugugu

SEQ ID NO: 1553188 - RNA, 16 nt, Homo sapiens
auuaaagauaucaaua

SEQ ID NO: 1553189 - RNA, 18 nt, Homo sapiens
auuaagacuuuauguagu

SEQ ID NO: 1553190 - RNA, 12 nt, Homo sapiens
auuaauaugcaa

SEQ ID NO: 1553191 - RNA, 20 nt, Homo sapiens
auuaugcauuauaucaaauc

SEQ ID NO: 1553192 - RNA, 21 nt, Homo sapiens
auucaaaguuaaaagcaaaca

SEQ ID NO: 1553193 - RNA, 16 nt, Homo sapiens
auucauaaccaaagag

SEQ ID NO: 1553194 - RNA, 21 nt, Homo sapiens
auuccguuaggaauaacacug

SEQ ID NO: 1553195 - RNA, 19 nt, Homo sapiens
auuccuauuggaaacagag

SEQ ID NO: 1553196 - RNA, 19 nt, Homo sapiens
auucuuuuucaguuuuacc

SEQ ID NO: 1553197 - RNA, 23 nt, Homo sapiens
auugagccuugcauguacuugaa

SEQ ID NO: 1553198 - RNA, 18 nt, Homo sapiens
auuguguauugaugcaau

SEQ ID NO: 1553199 - RNA, 11 nt, Homo sapiens
auuuacuuaac

SEQ ID NO: 1553200 - RNA, 20 nt, Homo sapiens
auuuguagcucuggaccugu

SEQ ID NO: 1553201 - RNA, 13 nt, Homo sapiens
auuuuuaugcaga

SEQ ID NO: 1553202 - RNA, 22 nt, Homo sapiens
caaaaaucuguguaacuguaaa

SEQ ID NO: 1553203 - RNA, 23 nt, Homo sapiens
caaaaugccaagggggugacugg

SEQ ID NO: 1553204 - RNA, 16 nt, Homo sapiens
caaacacuuacagaau

SEQ ID NO: 1553205 - RNA, 20 nt, Homo sapiens
caaaccuacugcccacauuu

SEQ ID NO: 1553206 - RNA, 22 nt, Homo sapiens
caaagaagacucaguaugcuuu

SEQ ID NO: 1553207 - RNA, 22 nt, Homo sapiens
caaauaaaucauccucaugucc

SEQ ID NO: 1553208 - RNA, 20 nt, Homo sapiens
caaaucucuuccacaugggu

SEQ ID NO: 1553209 - RNA, 20 nt, Homo sapiens
caacauguuacugaccagca

SEQ ID NO: 1553210 - RNA, 17 nt, Homo sapiens
caacuucaguugagagg

SEQ ID NO: 1553211 - RNA, 13 nt, Homo sapiens
caagagcugagaa

SEQ ID NO: 1553212 - RNA, 13 nt, Homo sapiens
caagaucuuucag

SEQ ID NO: 1553213 - RNA, 15 nt, Homo sapiens
caagauuaaauaucc

SEQ ID NO: 1553214 - RNA, 17 nt, Homo sapiens
caagcaaaaugcuuaca

SEQ ID NO: 1553215 - RNA, 22 nt, Homo sapiens
caagccgagaugcccauucucu

SEQ ID NO: 1553216 - RNA, 17 nt, Homo sapiens
caaggaagccaaaguuu

SEQ ID NO: 1553217 - RNA, 14 nt, Homo sapiens
caaguaugccuuaa

SEQ ID NO: 1553218 - RNA, 21 nt, Homo sapiens
caaguauguuuguacaguaug

SEQ ID NO: 1553219 - RNA, 14 nt, Homo sapiens
caauaguaaaagau

SEQ ID NO: 1553220 - RNA, 20 nt, Homo sapiens
caaucuguccguucacaugu

SEQ ID NO: 1553221 - RNA, 18 nt, Homo sapiens
cacacugccagaagagaa

SEQ ID NO: 1553222 - RNA, 22 nt, Homo sapiens
cacacugggugcgucuccaguc

SEQ ID NO: 1553223 - RNA, 15 nt, Homo sapiens
cacacuugugugugg

SEQ ID NO: 1553224 - RNA, 19 nt, Homo sapiens
cacagaaggaauaagguca

SEQ ID NO: 1553225 - RNA, 22 nt, Homo sapiens
cacaguccaaccagaaacaccc

SEQ ID NO: 1553226 - RNA, 14 nt, Homo sapiens
cacauggaacuuua

SEQ ID NO: 1553227 - RNA, 16 nt, Homo sapiens
cacauuaaucucaaag

SEQ ID NO: 1553228 - RNA, 13 nt, Homo sapiens
cacauuagcuugu

SEQ ID NO: 1553229 - RNA, 22 nt, Homo sapiens
caccaggaauccccaacaugca

SEQ ID NO: 1553230 - RNA, 23 nt, Homo sapiens
caccauacuguuaagaguccuuu

SEQ ID NO: 1553231 - RNA, 16 nt, Homo sapiens
caccuauccugaagau

SEQ ID NO: 1553232 - RNA, 21 nt, Homo sapiens
caccuauccugaagaugugau

SEQ ID NO: 1553233 - RNA, 19 nt, Homo sapiens
caccucugauuacauguau

SEQ ID NO: 1553234 - RNA, 14 nt, Homo sapiens
cacgagcaaaccca

SEQ ID NO: 1553235 - RNA, 18 nt, Homo sapiens
cacgauugagaacugaca

SEQ ID NO: 1553236 - RNA, 13 nt, Homo sapiens
cacgccuacuuaa

SEQ ID NO: 1553237 - RNA, 23 nt, Homo sapiens
cacuacauaauugcuguucugcu

SEQ ID NO: 1553238 - RNA, 22 nt, Homo sapiens
cacucacucucccccuccucuu

SEQ ID NO: 1553239 - RNA, 20 nt, Homo sapiens
cacucuaauauaauauggau

SEQ ID NO: 1553240 - RNA, 18 nt, Homo sapiens
cacuguuaucaccuaucc

SEQ ID NO: 1553241 - RNA, 13 nt, Homo sapiens
cacuuacagaauu

SEQ ID NO: 1553242 - RNA, 15 nt, Homo sapiens
cacuuacagaauuau

SEQ ID NO: 1553243 - RNA, 20 nt, Homo sapiens
cacuugugugugggcuguga

SEQ ID NO: 1553244 - RNA, 18 nt, Homo sapiens
cagaaaguggccaugcca

SEQ ID NO: 1553245 - RNA, 14 nt, Homo sapiens
cagaaguuugcauc

SEQ ID NO: 1553246 - RNA, 17 nt, Homo sapiens
cagaauauaauucccaa

SEQ ID NO: 1553247 - RNA, 20 nt, Homo sapiens
cagacacgauugagaacuga

SEQ ID NO: 1553248 - RNA, 20 nt, Homo sapiens
cagaccugugugugccucca

SEQ ID NO: 1553249 - RNA, 14 nt, Homo sapiens
cagacuucuccaga

SEQ ID NO: 1553250 - RNA, 20 nt, Homo sapiens
cagagcaagacuccaucuca

SEQ ID NO: 1553251 - RNA, 19 nt, Homo sapiens
cagagucuucagagacuuc

SEQ ID NO: 1553252 - RNA, 19 nt, Homo sapiens
cagauggggucugugacug

SEQ ID NO: 1553253 - RNA, 17 nt, Homo sapiens
cagcacaagggcacauu

SEQ ID NO: 1553254 - RNA, 13 nt, Homo sapiens
cagcagauuucca

SEQ ID NO: 1553255 - RNA, 21 nt, Homo sapiens
cagcaugaccugugaccagca

SEQ ID NO: 1553256 - RNA, 15 nt, Homo sapiens
cagccaguacaguau

SEQ ID NO: 1553257 - RNA, 19 nt, Homo sapiens
cagccuggccaacauggca

SEQ ID NO: 1553258 - RNA, 22 nt, Homo sapiens
cagcuguaagaagagacuggga

SEQ ID NO: 1553259 - RNA, 23 nt, Homo sapiens
cagcuucaaaugcaaauucauca

SEQ ID NO: 1553260 - RNA, 23 nt, Homo sapiens
caggagaaguuaagaauugagca

SEQ ID NO: 1553261 - RNA, 19 nt, Homo sapiens
caggcaucugccucuggaa

SEQ ID NO: 1553262 - RNA, 13 nt, Homo sapiens
cagggcacuacau

SEQ ID NO: 1553263 - RNA, 17 nt, Homo sapiens
cagggcagggcucugau

SEQ ID NO: 1553264 - RNA, 13 nt, Homo sapiens
cagggccaugcag

SEQ ID NO: 1553265 - RNA, 19 nt, Homo sapiens
cagguaguauuacaccacc

SEQ ID NO: 1553266 - RNA, 16 nt, Homo sapiens
caguagagucaucucc

SEQ ID NO: 1553267 - RNA, 17 nt, Homo sapiens
caguauauuuauaguca

SEQ ID NO: 1553268 - RNA, 20 nt, Homo sapiens
caguauauuuauagucacaa

SEQ ID NO: 1553269 - RNA, 14 nt, Homo sapiens
cagucccuggagcu

SEQ ID NO: 1553270 - RNA, 18 nt, Homo sapiens
cagugaaacaaauuuaca

SEQ ID NO: 1553271 - RNA, 16 nt, Homo sapiens
cagugcugaauuuccc

SEQ ID NO: 1553272 - RNA, 17 nt, Homo sapiens
cagugcugaauuucccu

SEQ ID NO: 1553273 - RNA, 16 nt, Homo sapiens
cagugggaucccagac

SEQ ID NO: 1553274 - RNA, 18 nt, Homo sapiens
cagugucucgaugccaua

SEQ ID NO: 1553275 - RNA, 15 nt, Homo sapiens
caguucaagacuuag

SEQ ID NO: 1553276 - RNA, 12 nt, Homo sapiens
caguucagauaa

SEQ ID NO: 1553277 - RNA, 15 nt, Homo sapiens
caguugcauucauua

SEQ ID NO: 1553278 - RNA, 23 nt, Homo sapiens
caguuuaaggaacuucugaagau

SEQ ID NO: 1553279 - RNA, 23 nt, Homo sapiens
caguuuuaccucuucucucucag

SEQ ID NO: 1553280 - RNA, 13 nt, Homo sapiens
caguuuucuuggu

SEQ ID NO: 1553281 - RNA, 16 nt, Homo sapiens
cauaaagugucuauaa

SEQ ID NO: 1553282 - RNA, 14 nt, Homo sapiens
cauacucaagguga

SEQ ID NO: 1553283 - RNA, 16 nt, Homo sapiens
cauagcugacuacaaa

SEQ ID NO: 1553284 - RNA, 14 nt, Homo sapiens
cauccuugcugcag

SEQ ID NO: 1553285 - RNA, 13 nt, Homo sapiens
caucuucuagaau

SEQ ID NO: 1553286 - RNA, 13 nt, Homo sapiens
caugaaugcacac

SEQ ID NO: 1553287 - RNA, 13 nt, Homo sapiens
caugaauguauca

SEQ ID NO: 1553288 - RNA, 16 nt, Homo sapiens
caugacccagccugaa

SEQ ID NO: 1553289 - RNA, 21 nt, Homo sapiens
caugacccagccugaaagaua

SEQ ID NO: 1553290 - RNA, 18 nt, Homo sapiens
caugaccugugaccagca

SEQ ID NO: 1553291 - RNA, 23 nt, Homo sapiens
caugacuacauaguaaguacaga

SEQ ID NO: 1553292 - RNA, 12 nt, Homo sapiens
cauguacuugaa

SEQ ID NO: 1553293 - RNA, 14 nt, Homo sapiens
cauguucccagaaa

SEQ ID NO: 1553294 - RNA, 16 nt, Homo sapiens
cauguuccucaaaagc

SEQ ID NO: 1553295 - RNA, 20 nt, Homo sapiens
cauuccguuaggaauaacac

SEQ ID NO: 1553296 - RNA, 12 nt, Homo sapiens
cauuguauccuc

SEQ ID NO: 1553297 - RNA, 20 nt, Homo sapiens
cauuuaaaaggacugcugau

SEQ ID NO: 1553298 - RNA, 18 nt, Homo sapiens
cauuuaacugaacuguga

SEQ ID NO: 1553299 - RNA, 18 nt, Homo sapiens
cauuuauaacuucuguac

SEQ ID NO: 1553300 - RNA, 22 nt, Homo sapiens
cauuuuggaaguuuucaggacu

SEQ ID NO: 1553301 - RNA, 15 nt, Homo sapiens
ccaaaguaacugaau

SEQ ID NO: 1553302 - RNA, 19 nt, Homo sapiens
ccacagcugggcaggguga

SEQ ID NO: 1553303 - RNA, 19 nt, Homo sapiens
ucguuauagagagcaauuu

SEQ ID NO: 1553304 - RNA, 12 nt, Homo sapiens
ucuaaaagccau

SEQ ID NO: 1553305 - RNA, 21 nt, Homo sapiens
ucuauauaguuccuugccuua

SEQ ID NO: 1553306 - RNA, 16 nt, Homo sapiens
ucucaguggagccuua

SEQ ID NO: 1553307 - RNA, 15 nt, Homo sapiens
ucugaguuuuacacc

SEQ ID NO: 1553308 - RNA, 23 nt, Homo sapiens
ucugcgcuuggucuuucugugcu

SEQ ID NO: 1553309 - RNA, 23 nt, Homo sapiens
ucugggaguuauaggucauggga

SEQ ID NO: 1553310 - RNA, 16 nt, Homo sapiens
ucuucagaagacacug

SEQ ID NO: 1553311 - RNA, 19 nt, Homo sapiens
ucuuuaaaaacucacuuac

SEQ ID NO: 1553312 - RNA, 16 nt, Homo sapiens
ugaaacaaauuuacau

SEQ ID NO: 1553313 - RNA, 20 nt, Homo sapiens
ugaaacuauuuuaccugaac

SEQ ID NO: 1553314 - RNA, 17 nt, Homo sapiens
ugaaauucacaguaaua

SEQ ID NO: 1553315 - RNA, 14 nt, Homo sapiens
ugacagugccucuu

SEQ ID NO: 1553316 - RNA, 14 nt, Homo sapiens
ugaccugugaccag

SEQ ID NO: 1553317 - RNA, 19 nt, Homo sapiens
ugacucaacauguuacuga

SEQ ID NO: 1553318 - RNA, 13 nt, Homo sapiens
ugacugcuuuuaa

SEQ ID NO: 1553319 - RNA, 22 nt, Homo sapiens
ugacuggaaguuguggauauca

SEQ ID NO: 1553320 - RNA, 22 nt, Homo sapiens
ugagaaacauuauuagcacuuc

SEQ ID NO: 1553321 - RNA, 18 nt, Homo sapiens
ugagagaauaaaaacuuc

SEQ ID NO: 1553322 - RNA, 16 nt, Homo sapiens
ugaggucucuugaggg

SEQ ID NO: 1553323 - RNA, 15 nt, Homo sapiens
ugaguguaaguguga

SEQ ID NO: 1553324 - RNA, 21 nt, Homo sapiens
ugauaagcugcacaugacuac

SEQ ID NO: 1553325 - RNA, 19 nt, Homo sapiens
ugauuaaaaaugcuuuuag

SEQ ID NO: 1553326 - RNA, 16 nt, Homo sapiens
ugauucaaauugcugc

SEQ ID NO: 1553327 - RNA, 13 nt, Homo sapiens
ugauuucaggaua

SEQ ID NO: 1553328 - RNA, 22 nt, Homo sapiens
ugcaacugggucugacaugaac

SEQ ID NO: 1553329 - RNA, 16 nt, Homo sapiens
ugcaauauaagcauaa

SEQ ID NO: 1553330 - RNA, 20 nt, Homo sapiens
ugcacuccagcuugggcaac

SEQ ID NO: 1553331 - RNA, 23 nt, Homo sapiens
ugcagcuucuaacugguaaaaag

SEQ ID NO: 1553332 - RNA, 17 nt, Homo sapiens
ugcaguguggaguucac

SEQ ID NO: 1553333 - RNA, 19 nt, Homo sapiens
ugcauacuuugacaaggaa

SEQ ID NO: 1553334 - RNA, 14 nt, Homo sapiens
ugcauguacuugaa

SEQ ID NO: 1553335 - RNA, 16 nt, Homo sapiens
ugcauuauaucaaauc

SEQ ID NO: 1553336 - RNA, 21 nt, Homo sapiens
ugcauuuucccagauacuucc

SEQ ID NO: 1553337 - RNA, 18 nt, Homo sapiens
guaagagcuggugucuga

SEQ ID NO: 1553338 - RNA, 19 nt, Homo sapiens
guaagauuuuccauuguau

SEQ ID NO: 1553339 - RNA, 19 nt, Homo sapiens
guacaauaaguuacuugaa

SEQ ID NO: 1553340 - RNA, 21 nt, Homo sapiens
guacaguauguuuuacaugua

SEQ ID NO: 1553341 - RNA, 17 nt, Homo sapiens
guacaugguguuugugg

SEQ ID NO: 1553342 - RNA, 11 nt, Homo sapiens
guacuguguuu

SEQ ID NO: 1553343 - RNA, 18 nt, Homo sapiens
guauuccuuuuguguaca

SEQ ID NO: 1553344 - RNA, 11 nt, Homo sapiens
gucacuccugg

SEQ ID NO: 1553345 - RNA, 13 nt, Homo sapiens
gucauucauucaa

SEQ ID NO: 1553346 - RNA, 21 nt, Homo sapiens
guccuugugaguccaucuaac

SEQ ID NO: 1553347 - RNA, 15 nt, Homo sapiens
guccuuuuucacuuu

SEQ ID NO: 1553348 - RNA, 17 nt, Homo sapiens
gucuugguucuaaaggu

SEQ ID NO: 1553349 - RNA, 22 nt, Homo sapiens
gugcaguacuuugugcauucug

SEQ ID NO: 1553350 - RNA, 16 nt, Homo sapiens
gugggcaguguccacg

SEQ ID NO: 1553351 - RNA, 21 nt, Homo sapiens
gugggcgcaaaggugccucau

SEQ ID NO: 1553352 - RNA, 17 nt, Homo sapiens
gugucugccaaacacau

SEQ ID NO: 1553353 - RNA, 19 nt, Homo sapiens
guuaaaacggaugucucca

SEQ ID NO: 1553354 - RNA, 19 nt, Homo sapiens
guuaagaauugagcaguuc

SEQ ID NO: 1553355 - RNA, 18 nt, Homo sapiens
guuaauuacaacugcuau

SEQ ID NO: 1553356 - RNA, 16 nt, Homo sapiens
guuacagaauuccuac

SEQ ID NO: 1553357 - RNA, 15 nt, Homo sapiens
guuacugaccagcaa

SEQ ID NO: 1553358 - RNA, 19 nt, Homo sapiens
guucuugggagaaaaucaa

SEQ ID NO: 1553359 - RNA, 22 nt, Homo sapiens
guugccucccccgccuccaguc

SEQ ID NO: 1553360 - RNA, 15 nt, Homo sapiens
guuggagagcagcag

SEQ ID NO: 1553361 - RNA, 15 nt, Homo sapiens
guuuaaauagccuaa

SEQ ID NO: 1553362 - RNA, 17 nt, Homo sapiens
guuuaacauuuccucag

SEQ ID NO: 1553363 - RNA, 14 nt, Homo sapiens
guuucagaugugca

SEQ ID NO: 1553364 - RNA, 15 nt, Homo sapiens
guuuccguaguauau

SEQ ID NO: 1553365 - RNA, 19 nt, Homo sapiens
guuucuccucuuuccuccu

SEQ ID NO: 1553366 - RNA, 13 nt, Homo sapiens
guuuggggagcag

SEQ ID NO: 1553367 - RNA, 18 nt, Homo sapiens
guuuuaaauaaaccuaua

SEQ ID NO: 1553368 - RNA, 15 nt, Homo sapiens
guuuuuaacauguca

SEQ ID NO: 1553369 - RNA, 17 nt, Homo sapiens
guuuuucugaagacagu

SEQ ID NO: 1553370 - RNA, 16 nt, Homo sapiens
guuuuuuauuaugcau

SEQ ID NO: 1553371 - RNA, 20 nt, Homo sapiens
uaaaaauucauaaccaaaga

SEQ ID NO: 1553372 - RNA, 12 nt, Homo sapiens
ccacaugguguc

SEQ ID NO: 1553373 - RNA, 22 nt, Homo sapiens
ccaccuguuuucugaaacacac

SEQ ID NO: 1553374 - RNA, 14 nt, Homo sapiens
ccagacagcuugac

SEQ ID NO: 1553375 - RNA, 21 nt, Homo sapiens
ccagacagcuugacugcuuuu

SEQ ID NO: 1553376 - RNA, 19 nt, Homo sapiens
ccagacccaccacaccgca

SEQ ID NO: 1553377 - RNA, 22 nt, Homo sapiens
ccagauacauggugaugguuag

SEQ ID NO: 1553378 - RNA, 18 nt, Homo sapiens
ccagcauucagcacacac

SEQ ID NO: 1553379 - RNA, 14 nt, Homo sapiens
ccagggaaacaaag

SEQ ID NO: 1553380 - RNA, 15 nt, Homo sapiens
ccauaagaggugauc

SEQ ID NO: 1553381 - RNA, 18 nt, Homo sapiens
ccauuugcuaguucugcu

SEQ ID NO: 1553382 - RNA, 22 nt, Homo sapiens
cccacauuugggcucaggguug

SEQ ID NO: 1553383 - RNA, 19 nt, Homo sapiens
cccacggcaccucggggac

SEQ ID NO: 1553384 - RNA, 22 nt, Homo sapiens
cccacucccuggcucucagaag

SEQ ID NO: 1553385 - RNA, 10 nt, Homo sapiens
cccacuuuga

SEQ ID NO: 1553386 - RNA, 11 nt, Homo sapiens
cccacuuugaa

SEQ ID NO: 1553387 - RNA, 15 nt, Homo sapiens
cccagauacauggug

SEQ ID NO: 1553388 - RNA, 15 nt, Homo sapiens
cccagauacuuccca

SEQ ID NO: 1553389 - RNA, 21 nt, Homo sapiens
ccccaagaggggcgggcucag

SEQ ID NO: 1553390 - RNA, 13 nt, Homo sapiens
ccccgccuccagu

SEQ ID NO: 1553391 - RNA, 17 nt, Homo sapiens
ccccugcgggcgcgggc

SEQ ID NO: 1553392 - RNA, 14 nt, Homo sapiens
cccgccuccaguca

SEQ ID NO: 1553393 - RNA, 16 nt, Homo sapiens
cccgucauguuccuca

SEQ ID NO: 1553394 - RNA, 22 nt, Homo sapiens
cccgucauguuccucaaaagca

SEQ ID NO: 1553395 - RNA, 12 nt, Homo sapiens
cccuaaccaagu

SEQ ID NO: 1553396 - RNA, 18 nt, Homo sapiens
cccugaggaaugaaaaag

SEQ ID NO: 1553397 - RNA, 11 nt, Homo sapiens
cccugccugag

SEQ ID NO: 1553398 - RNA, 20 nt, Homo sapiens
cccuucuauacccacccaga

SEQ ID NO: 1553399 - RNA, 16 nt, Homo sapiens
ccgaugaacaaguuua

SEQ ID NO: 1553400 - RNA, 12 nt, Homo sapiens
ccuaaaugaugg

SEQ ID NO: 1553401 - RNA, 20 nt, Homo sapiens
ccuaaggacaagacacugag

SEQ ID NO: 1553402 - RNA, 15 nt, Homo sapiens
ccuacccuaaccaag

SEQ ID NO: 1553403 - RNA, 14 nt, Homo sapiens
ccuacugcccacau

SEQ ID NO: 1553404 - RNA, 18 nt, Homo sapiens
ccucaacuccgugcuuaa

SEQ ID NO: 1553405 - RNA, 12 nt, Homo sapiens
ccucacugggug

SEQ ID NO: 1553406 - RNA, 12 nt, Homo sapiens
ccuccaccucaa

SEQ ID NO: 1553407 - RNA, 12 nt, Homo sapiens
ccucccacaauu

SEQ ID NO: 1553408 - RNA, 14 nt, Homo sapiens
ccucugugaccaac

SEQ ID NO: 1553409 - RNA, 22 nt, Homo sapiens
uucuacuuccuguaauguacaa

SEQ ID NO: 1553410 - RNA, 16 nt, Homo sapiens
uucuauacccacccag

SEQ ID NO: 1553411 - RNA, 13 nt, Homo sapiens
uucugucuuccua

SEQ ID NO: 1553412 - RNA, 13 nt, Homo sapiens
uucuguugccaca

SEQ ID NO: 1553413 - RNA, 13 nt, Homo sapiens
uucuuuuauguga

SEQ ID NO: 1553414 - RNA, 18 nt, Homo sapiens
uucuuuuuugcccccaga

SEQ ID NO: 1553415 - RNA, 15 nt, Homo sapiens
uugauaauacuugac

SEQ ID NO: 1553416 - RNA, 23 nt, Homo sapiens
uugcccccagauacauggugaug

SEQ ID NO: 1553417 - RNA, 19 nt, Homo sapiens
uuggaaacauuuuugagau

SEQ ID NO: 1553418 - RNA, 19 nt, Homo sapiens
uuggaggcagggcugggaa

SEQ ID NO: 1553419 - RNA, 16 nt, Homo sapiens
uuggccccacuuugaa

SEQ ID NO: 1553420 - RNA, 18 nt, Homo sapiens
uugugaguggauaaucag

SEQ ID NO: 1553421 - RNA, 16 nt, Homo sapiens
uugugcuccaaacaaa

SEQ ID NO: 1553422 - RNA, 20 nt, Homo sapiens
uuguuuagauaugacauuua

SEQ ID NO: 1553423 - RNA, 13 nt, Homo sapiens
uuuaaaaacucac

SEQ ID NO: 1553424 - RNA, 17 nt, Homo sapiens
uuuaaggucaaacacaa

SEQ ID NO: 1553425 - RNA, 22 nt, Homo sapiens
uuuacaucagaaguuugcaucu

SEQ ID NO: 1553426 - RNA, 23 nt, Homo sapiens
uuuacauguauuuaaaguagcau

SEQ ID NO: 1553427 - RNA, 18 nt, Homo sapiens
uuuagauaugacauuuau

SEQ ID NO: 1553428 - RNA, 17 nt, Homo sapiens
uuuauuaugcaaccagu

SEQ ID NO: 1553429 - RNA, 21 nt, Homo sapiens
uuuauucccaaguaugccuua

SEQ ID NO: 1553430 - RNA, 22 nt, Homo sapiens
uuuauucccaaguaugccuuaa

SEQ ID NO: 1553431 - RNA, 17 nt, Homo sapiens
uuucagauaaauuucaa

SEQ ID NO: 1553432 - RNA, 18 nt, Homo sapiens
uuucuguagcaccagaga

SEQ ID NO: 1553433 - RNA, 16 nt, Homo sapiens
uuugaauuaaacucga

SEQ ID NO: 1553434 - RNA, 15 nt, Homo sapiens
uuuggcucaacuuca

SEQ ID NO: 1553435 - RNA, 15 nt, Homo sapiens
uuuggggagcagaga

SEQ ID NO: 1553436 - RNA, 19 nt, Homo sapiens
uuuguagcucuggaccugu

SEQ ID NO: 1553437 - RNA, 17 nt, Homo sapiens
uuugucuuucaaugcag

SEQ ID NO: 1553438 - RNA, 14 nt, Homo sapiens
uuuuaacaugucaa

SEQ ID NO: 1553439 - RNA, 20 nt, Homo sapiens
uuuuaugcagacagucuguu

SEQ ID NO: 1553440 - RNA, 22 nt, Homo sapiens
uuuuauggacaguaaguccagu

SEQ ID NO: 1553441 - RNA, 20 nt, Homo sapiens
uuuucuguagcaccagagaa

SEQ ID NO: 1553442 - RNA, 18 nt, Homo sapiens
auucccaagcuuuuggag

SEQ ID NO: 1553443 - RNA, 23 nt, Homo sapiens
auucgaaugacgguaaguguucu

SEQ ID NO: 1553444 - RNA, 23 nt, Homo sapiens
auucuucaagaaagaauuccugc

SEQ ID NO: 1553445 - RNA, 19 nt, Homo sapiens
auugaaauguuugcauaaa

SEQ ID NO: 1553446 - RNA, 12 nt, Homo sapiens
auugaaugaaac

SEQ ID NO: 1553447 - RNA, 18 nt, Homo sapiens
auugagccuugcauguac

SEQ ID NO: 1553448 - RNA, 13 nt, Homo sapiens
auuggcucagccc

SEQ ID NO: 1553449 - RNA, 20 nt, Homo sapiens
auuuaaaaggacugcugauu

SEQ ID NO: 1553450 - RNA, 18 nt, Homo sapiens
auuuaacugaacugugaa

SEQ ID NO: 1553451 - RNA, 19 nt, Homo sapiens
auuuaaugaauacuugcua

SEQ ID NO: 1553452 - RNA, 24 nt, Homo sapiens
auuuacuguuuuuuucuguagcac

SEQ ID NO: 1553453 - RNA, 22 nt, Homo sapiens
auuuagugaucaaauugugcag

SEQ ID NO: 1553454 - RNA, 14 nt, Homo sapiens
auuucuucaaauaa

SEQ ID NO: 1553455 - RNA, 17 nt, Homo sapiens
auuugucauucauucaa

SEQ ID NO: 1553456 - RNA, 13 nt, Homo sapiens
auuuuaaugcauu

SEQ ID NO: 1553457 - RNA, 18 nt, Homo sapiens
auuuuauaacagaauuaa

SEQ ID NO: 1553458 - RNA, 14 nt, Homo sapiens
auuuuuccacuuaa

SEQ ID NO: 1553459 - RNA, 18 nt, Homo sapiens
auuuuuuguaugcuuaaa

SEQ ID NO: 1553460 - RNA, 15 nt, Homo sapiens
caaaaguuacuauug

SEQ ID NO: 1553461 - RNA, 15 nt, Homo sapiens
caaaccuacugccca

SEQ ID NO: 1553462 - RNA, 22 nt, Homo sapiens
caaaguuaaaagcaaacacuua

SEQ ID NO: 1553463 - RNA, 16 nt, Homo sapiens
caaaucuaccacugua

SEQ ID NO: 1553464 - RNA, 18 nt, Homo sapiens
caaaucuaccacuguaug

SEQ ID NO: 1553465 - RNA, 14 nt, Homo sapiens
caaaucucuuccac

SEQ ID NO: 1553466 - RNA, 11 nt, Homo sapiens
caaaugaauuu

SEQ ID NO: 1553467 - RNA, 18 nt, Homo sapiens
caaaugcaaauucaucau

SEQ ID NO: 1553468 - RNA, 13 nt, Homo sapiens
caaauugcugcuu

SEQ ID NO: 1553469 - RNA, 16 nt, Homo sapiens
caacaugcacugaugu

SEQ ID NO: 1553470 - RNA, 16 nt, Homo sapiens
caacaugcgaccguga

SEQ ID NO: 1553471 - RNA, 17 nt, Homo sapiens
caacuaccuagacugga

SEQ ID NO: 1553472 - RNA, 19 nt, Homo sapiens
caacuccauguuugguguu

SEQ ID NO: 1553473 - RNA, 19 nt, Homo sapiens
caacugggucugacaugaa

SEQ ID NO: 1553474 - RNA, 18 nt, Homo sapiens
caacuguuggauucagaa

SEQ ID NO: 1553475 - RNA, 15 nt, Homo sapiens
caacuuuaagauaga

SEQ ID NO: 1553476 - RNA, 15 nt, Homo sapiens
caagaacauaguuua

SEQ ID NO: 1553477 - RNA, 18 nt, Homo sapiens
caaggcuuugguuuccaa

SEQ ID NO: 1553478 - RNA, 19 nt, Homo sapiens
caaucuuaaaacaaauuca

SEQ ID NO: 1553479 - RNA, 20 nt, Homo sapiens
caauucuaaauccgacuuga

SEQ ID NO: 1553480 - RNA, 21 nt, Homo sapiens
caauuugguaaaaaugcugcu

SEQ ID NO: 1553481 - RNA, 22 nt, Homo sapiens
caauuugguaaaaaugcugcuc

SEQ ID NO: 1553482 - RNA, 10 nt, Homo sapiens
cacacugucu

SEQ ID NO: 1553483 - RNA, 12 nt, Homo sapiens
cacauugcccau

SEQ ID NO: 1553484 - RNA, 15 nt, Homo sapiens
cacccagugcugaau

SEQ ID NO: 1553485 - RNA, 17 nt, Homo sapiens
cacccgacuccucaaaa

SEQ ID NO: 1553486 - RNA, 15 nt, Homo sapiens
caccgacaacaugcu

SEQ ID NO: 1553487 - RNA, 19 nt, Homo sapiens
cacuaaaguuacaaacaga

SEQ ID NO: 1553488 - RNA, 15 nt, Homo sapiens
cacugcacuccagcu

SEQ ID NO: 1553489 - RNA, 21 nt, Homo sapiens
cacuucuaauaacugcagugu

SEQ ID NO: 1553490 - RNA, 19 nt, Homo sapiens
cagaaaguggccaugccac

SEQ ID NO: 1553491 - RNA, 21 nt, Homo sapiens
cagaagcuuuuuguuugcauc

SEQ ID NO: 1553492 - RNA, 14 nt, Homo sapiens
cagaagguauuccu

SEQ ID NO: 1553493 - RNA, 13 nt, Homo sapiens
cagaaguuugcau

SEQ ID NO: 1553494 - RNA, 15 nt, Homo sapiens
cagacacgauugaga

SEQ ID NO: 1553495 - RNA, 22 nt, Homo sapiens
cagagccucguuucugcuuuca

SEQ ID NO: 1553496 - RNA, 13 nt, Homo sapiens
cagauaaauuuca

SEQ ID NO: 1553497 - RNA, 21 nt, Homo sapiens
cagauacuucccauuuuggaa

SEQ ID NO: 1553498 - RNA, 14 nt, Homo sapiens
cagccacccaagcc

SEQ ID NO: 1553499 - RNA, 17 nt, Homo sapiens
cagccccgccugucaca

SEQ ID NO: 1553500 - RNA, 23 nt, Homo sapiens
cagcucuggaugaaggcaaaaac

SEQ ID NO: 1553501 - RNA, 19 nt, Homo sapiens
cagcugaagaaaaugagca

SEQ ID NO: 1553502 - RNA, 22 nt, Homo sapiens
cagcugaagaaaaugagcacac

SEQ ID NO: 1553503 - RNA, 14 nt, Homo sapiens
cagcugggcagggu

SEQ ID NO: 1553504 - RNA, 13 nt, Homo sapiens
cagcuuucuggga

SEQ ID NO: 1553505 - RNA, 16 nt, Homo sapiens
cagcuuucugggaugu

SEQ ID NO: 1553506 - RNA, 23 nt, Homo sapiens
caggaaauauauaugugugugua

SEQ ID NO: 1553507 - RNA, 18 nt, Homo sapiens
caggaauccccaacaugc

SEQ ID NO: 1553508 - RNA, 18 nt, Homo sapiens
caggacugugccugaaca

SEQ ID NO: 1553509 - RNA, 22 nt, Homo sapiens
caggagccuacuucuagcugua

SEQ ID NO: 1553510 - RNA, 14 nt, Homo sapiens
caggcaaacuugca

SEQ ID NO: 1553511 - RNA, 17 nt, Homo sapiens
caggcaguuaggugcug

SEQ ID NO: 1553512 - RNA, 13 nt, Homo sapiens
cagggauggagau

SEQ ID NO: 1553513 - RNA, 14 nt, Homo sapiens
cagggccucaaagu

SEQ ID NO: 1553514 - RNA, 20 nt, Homo sapiens
cagguacagaaaacauguuu

SEQ ID NO: 1553515 - RNA, 16 nt, Homo sapiens
cagguguuacuuacag

SEQ ID NO: 1553516 - RNA, 16 nt, Homo sapiens
cagucaaguucagagu

SEQ ID NO: 1553517 - RNA, 19 nt, Homo sapiens
cagucaccgacaacaugcu

SEQ ID NO: 1553518 - RNA, 22 nt, Homo sapiens
caguccaaccagaaacaccccu

SEQ ID NO: 1553519 - RNA, 18 nt, Homo sapiens
cagucccuggagcugucc

SEQ ID NO: 1553520 - RNA, 22 nt, Homo sapiens
cagucucuucgaggcuuuacag

SEQ ID NO: 1553521 - RNA, 17 nt, Homo sapiens
cagugaaacaaauuuac

SEQ ID NO: 1553522 - RNA, 15 nt, Homo sapiens
cagugaacauuccca

SEQ ID NO: 1553523 - RNA, 13 nt, Homo sapiens
caguuaggugcug

SEQ ID NO: 1553524 - RNA, 14 nt, Homo sapiens
caguucaagacuua

SEQ ID NO: 1553525 - RNA, 14 nt, Homo sapiens
caguuuuaccucuu

SEQ ID NO: 1553526 - RNA, 17 nt, Homo sapiens
cauaaauaaaaguacag

SEQ ID NO: 1553527 - RNA, 18 nt, Homo sapiens
cauaaauaaaaguacagu

SEQ ID NO: 1553528 - RNA, 16 nt, Homo sapiens
cauaacaaugucucau

SEQ ID NO: 1553529 - RNA, 22 nt, Homo sapiens
cauaacaaugucucaugaugua

SEQ ID NO: 1553530 - RNA, 12 nt, Homo sapiens
cauaaccaaaga

SEQ ID NO: 1553531 - RNA, 21 nt, Homo sapiens
cauaagaauuuuuuauaagua

SEQ ID NO: 1553532 - RNA, 22 nt, Homo sapiens
cauaauugcuguucugcugaau

SEQ ID NO: 1553533 - RNA, 20 nt, Homo sapiens
cauagagauagcuacagugu

SEQ ID NO: 1553534 - RNA, 14 nt, Homo sapiens
cauagcauagccag

SEQ ID NO: 1553535 - RNA, 15 nt, Homo sapiens
cauaguaaguacaga

SEQ ID NO: 1553536 - RNA, 18 nt, Homo sapiens
cauaguuuaaacugcauu

SEQ ID NO: 1553537 - RNA, 12 nt, Homo sapiens
caucacaacauu

SEQ ID NO: 1553538 - RNA, 20 nt, Homo sapiens
cauccaaaguucccuaugaa

SEQ ID NO: 1553539 - RNA, 21 nt, Homo sapiens
caugagagaauuguaucauuu

SEQ ID NO: 1553540 - RNA, 13 nt, Homo sapiens
caugcacugaugu

SEQ ID NO: 1553541 - RNA, 19 nt, Homo sapiens
caugccacccuguuuucag

SEQ ID NO: 1553542 - RNA, 21 nt, Homo sapiens
caugcucauggggagggagca

SEQ ID NO: 1553543 - RNA, 15 nt, Homo sapiens
caugggaaaacagac

SEQ ID NO: 1553544 - RNA, 13 nt, Homo sapiens
cauggugacauug

SEQ ID NO: 1553545 - RNA, 15 nt, Homo sapiens
caugucucaauagua

SEQ ID NO: 1553546 - RNA, 14 nt, Homo sapiens
cauguuccucaaaa

SEQ ID NO: 1553547 - RNA, 13 nt, Homo sapiens
cauuauuagcacu

SEQ ID NO: 1553548 - RNA, 14 nt, Homo sapiens
cauuguugucaagg

SEQ ID NO: 1553549 - RNA, 21 nt, Homo sapiens
cauuuguagcucuggaccugu

SEQ ID NO: 1553550 - RNA, 20 nt, Homo sapiens
cauuuucucuguaguuacau

SEQ ID NO: 1553551 - RNA, 14 nt, Homo sapiens
ccaaacagcuuaaa

SEQ ID NO: 1553552 - RNA, 15 nt, Homo sapiens
ccaacaugcacugau

SEQ ID NO: 1553553 - RNA, 20 nt, Homo sapiens
ccaaguuccuuggccaugca

SEQ ID NO: 1553554 - RNA, 15 nt, Homo sapiens
ccacccagugcugaa

SEQ ID NO: 1553555 - RNA, 14 nt, Homo sapiens
ccacuccuguacac

SEQ ID NO: 1553556 - RNA, 22 nt, Homo sapiens
ccagaggugcccgcucuucccu

SEQ ID NO: 1553557 - RNA, 21 nt, Homo sapiens
ccagauacacuaaaguuacaa

SEQ ID NO: 1553558 - RNA, 15 nt, Homo sapiens
ccagauacaugguga

SEQ ID NO: 1553559 - RNA, 17 nt, Homo sapiens
ccagcuucaaaugcaaa

SEQ ID NO: 1553560 - RNA, 22 nt, Homo sapiens
ccauccagccgcugcacaucac

SEQ ID NO: 1553561 - RNA, 10 nt, Homo sapiens
ccaugccacc

SEQ ID NO: 1553562 - RNA, 18 nt, Homo sapiens
gaaauucagguacagaaa

SEQ ID NO: 1553563 - RNA, 16 nt, Homo sapiens
gaacuaaaauucuguc

SEQ ID NO: 1553564 - RNA, 22 nt, Homo sapiens
gaagccaaaguuuucaaacugc

SEQ ID NO: 1553565 - RNA, 23 nt, Homo sapiens
gaaggaugucccggguguguaca

SEQ ID NO: 1553566 - RNA, 14 nt, Homo sapiens
gaaguaaacugcag

SEQ ID NO: 1553567 - RNA, 17 nt, Homo sapiens
gaaguuaagaauugagc

SEQ ID NO: 1553568 - RNA, 13 nt, Homo sapiens
gaaguuugcaucu

SEQ ID NO: 1553569 - RNA, 14 nt, Homo sapiens
gaaguuugcaucuc

SEQ ID NO: 1553570 - RNA, 17 nt, Homo sapiens
gaaucaaaucucuucca

SEQ ID NO: 1553571 - RNA, 16 nt, Homo sapiens
gaauccccaacaugca

SEQ ID NO: 1553572 - RNA, 18 nt, Homo sapiens
gaaugugaauaguguuuc

SEQ ID NO: 1553573 - RNA, 17 nt, Homo sapiens
gacaaggaaaaucuaua

SEQ ID NO: 1553574 - RNA, 21 nt, Homo sapiens
gacagugccugggaauguauu

SEQ ID NO: 1553575 - RNA, 17 nt, Homo sapiens
gacauuguggacuguau

SEQ ID NO: 1553576 - RNA, 14 nt, Homo sapiens
gacauuuauucaaa

SEQ ID NO: 1553577 - RNA, 17 nt, Homo sapiens
gaccaccaccaggacug

SEQ ID NO: 1553578 - RNA, 17 nt, Homo sapiens
gaccugucucuaccuaa

SEQ ID NO: 1553579 - RNA, 15 nt, Homo sapiens
gacgcuugugacagu

SEQ ID NO: 1553580 - RNA, 15 nt, Homo sapiens
gacuaagcauugagc

SEQ ID NO: 1553581 - RNA, 20 nt, Homo sapiens
gacuccucuacucacagcug

SEQ ID NO: 1553582 - RNA, 11 nt, Homo sapiens
gacugugccug

SEQ ID NO: 1553583 - RNA, 16 nt, Homo sapiens
gacuguugccacuuaa

SEQ ID NO: 1553584 - RNA, 17 nt, Homo sapiens
gacuguugccacuuaac

SEQ ID NO: 1553585 - RNA, 17 nt, Homo sapiens
gacuuacaaaaugccaa

SEQ ID NO: 1553586 - RNA, 18 nt, Homo sapiens
gacuuacaaaaugccaag

SEQ ID NO: 1553587 - RNA, 21 nt, Homo sapiens
gagaaaauuggaacucuacuc

SEQ ID NO: 1553588 - RNA, 22 nt, Homo sapiens
gagaaaugaaaucgaauggaga

SEQ ID NO: 1553589 - RNA, 19 nt, Homo sapiens
gagaaguuaagaauugagc

SEQ ID NO: 1553590 - RNA, 18 nt, Homo sapiens
gagagaggcugccucagc

SEQ ID NO: 1553591 - RNA, 17 nt, Homo sapiens
gagaugcccauucucuu

SEQ ID NO: 1553592 - RNA, 13 nt, Homo sapiens
gagccgguggugc

SEQ ID NO: 1553593 - RNA, 20 nt, Homo sapiens
gaggacuuaguuugugaugu

SEQ ID NO: 1553594 - RNA, 19 nt, Homo sapiens
gaggcuucccuaguuuaca

SEQ ID NO: 1553595 - RNA, 15 nt, Homo sapiens
gagguuauaggucac

SEQ ID NO: 1553596 - RNA, 15 nt, Homo sapiens
gagugacagcuuucu

SEQ ID NO: 1553597 - RNA, 13 nt, Homo sapiens
gauacacuugaag

SEQ ID NO: 1553598 - RNA, 19 nt, Homo sapiens
gauaugacccacacugcca

SEQ ID NO: 1553599 - RNA, 18 nt, Homo sapiens
gaucaauaaaaugugauu

SEQ ID NO: 1553600 - RNA, 17 nt, Homo sapiens
gaugaaauuauuuguca

SEQ ID NO: 1553601 - RNA, 17 nt, Homo sapiens
gauggaggggugguccu

SEQ ID NO: 1553602 - RNA, 19 nt, Homo sapiens
gauggaggggugguccuga

SEQ ID NO: 1553603 - RNA, 13 nt, Homo sapiens
gauuauaaacuga

SEQ ID NO: 1553604 - RNA, 15 nt, Homo sapiens
gauucaaauugcugc

SEQ ID NO: 1553605 - RNA, 21 nt, Homo sapiens
gcaaacaaaauuguucuuggg

SEQ ID NO: 1553606 - RNA, 15 nt, Homo sapiens
gcaaaggugccucau

SEQ ID NO: 1553607 - RNA, 16 nt, Homo sapiens
gcaauauaagcauaaa

SEQ ID NO: 1553608 - RNA, 16 nt, Homo sapiens
gcaauguauagugucu

SEQ ID NO: 1553609 - RNA, 20 nt, Homo sapiens
gcacacuagccucuccagga

SEQ ID NO: 1553610 - RNA, 11 nt, Homo sapiens
gcacagccacc

SEQ ID NO: 1553611 - RNA, 14 nt, Homo sapiens
gcacauguacauau

SEQ ID NO: 1553612 - RNA, 14 nt, Homo sapiens
gcagaccucaugcc

SEQ ID NO: 1553613 - RNA, 15 nt, Homo sapiens
gcaggccacugggga

SEQ ID NO: 1553614 - RNA, 21 nt, Homo sapiens
gcauuuaaaaggacugcugau

SEQ ID NO: 1553615 - RNA, 16 nt, Homo sapiens
gcauuuuauuaaacuu

SEQ ID NO: 1553616 - RNA, 13 nt, Homo sapiens
gccaagacuccuc

SEQ ID NO: 1553617 - RNA, 17 nt, Homo sapiens
gccaagggggugacugg

SEQ ID NO: 1553618 - RNA, 20 nt, Homo sapiens
gccaagguaggcagaucacc

SEQ ID NO: 1553619 - RNA, 22 nt, Homo sapiens
gccacugccccccgaggcugcu

SEQ ID NO: 1553620 - RNA, 18 nt, Homo sapiens
gccagaaagcacuacaau

SEQ ID NO: 1553621 - RNA, 22 nt, Homo sapiens
gccagggugggaagagaagaaa

SEQ ID NO: 1553622 - RNA, 13 nt, Homo sapiens
gccaguacaguau

SEQ ID NO: 1553623 - RNA, 17 nt, Homo sapiens
gcccagucccuggagcu

SEQ ID NO: 1553624 - RNA, 16 nt, Homo sapiens
gcccagugcauaugca

SEQ ID NO: 1553625 - RNA, 19 nt, Homo sapiens
gcccagugcauaugcaaug

SEQ ID NO: 1553626 - RNA, 13 nt, Homo sapiens
gccccacuuugaa

SEQ ID NO: 1553627 - RNA, 20 nt, Homo sapiens
gcccuucuauacccacccag

SEQ ID NO: 1553628 - RNA, 18 nt, Homo sapiens
gccgacuuggagacuccu

SEQ ID NO: 1553629 - RNA, 15 nt, Homo sapiens
gccugcauggagaag

SEQ ID NO: 1553630 - RNA, 16 nt, Homo sapiens
gccugcauggagaagg

SEQ ID NO: 1553631 - RNA, 19 nt, Homo sapiens
gccugcuggcugcggcccc

SEQ ID NO: 1553632 - RNA, 18 nt, Homo sapiens
gccuucuacugcucuccu

SEQ ID NO: 1553633 - RNA, 16 nt, Homo sapiens
gccuuggcuagaguuu

SEQ ID NO: 1553634 - RNA, 22 nt, Homo sapiens
gcgggcucagagcuuugucacu

SEQ ID NO: 1553635 - RNA, 18 nt, Homo sapiens
gcuauaaacuuuacauau

SEQ ID NO: 1553636 - RNA, 16 nt, Homo sapiens
gcucagagcuuuguca

SEQ ID NO: 1553637 - RNA, 18 nt, Homo sapiens
gcucagagcuuugucacu

SEQ ID NO: 1553638 - RNA, 18 nt, Homo sapiens
gcuccagauucugaugca

SEQ ID NO: 1553639 - RNA, 19 nt, Homo sapiens
gcuggcccgucauguuccu

SEQ ID NO: 1553640 - RNA, 16 nt, Homo sapiens
gcugugcaucaguggg

SEQ ID NO: 1553641 - RNA, 19 nt, Homo sapiens
gcuuacagggcuaggcagu

SEQ ID NO: 1553642 - RNA, 17 nt, Homo sapiens
gcuuuuaaaugaccaaa

SEQ ID NO: 1553643 - RNA, 17 nt, Homo sapiens
ggaaaccuuccacccag

SEQ ID NO: 1553644 - RNA, 15 nt, Homo sapiens
ggaaauuaagacuuu

SEQ ID NO: 1553645 - RNA, 17 nt, Homo sapiens
ggaaauuaagacuuuau

SEQ ID NO: 1553646 - RNA, 22 nt, Homo sapiens
ggaagagcccgcagggccaugc

SEQ ID NO: 1553647 - RNA, 15 nt, Homo sapiens
ggaaguauaaaguaa

SEQ ID NO: 1553648 - RNA, 21 nt, Homo sapiens
ggaauuuggcucaacuucagu

SEQ ID NO: 1553649 - RNA, 14 nt, Homo sapiens
ggacaagacacuga

SEQ ID NO: 1553650 - RNA, 19 nt, Homo sapiens
ggacgagacccuacaggag

SEQ ID NO: 1553651 - RNA, 13 nt, Homo sapiens
ggacugugccuga

SEQ ID NO: 1553652 - RNA, 20 nt, Homo sapiens
ggagagagaggcugccucag

SEQ ID NO: 1553653 - RNA, 13 nt, Homo sapiens
ggagauacugaac

SEQ ID NO: 1553654 - RNA, 14 nt, Homo sapiens
ggagcuacugacau

SEQ ID NO: 1553655 - RNA, 21 nt, Homo sapiens
ggaugaaggcaaaaacuguac

SEQ ID NO: 1553656 - RNA, 21 nt, Homo sapiens
ggcaaaaacuguacuguguuu

SEQ ID NO: 1553657 - RNA, 16 nt, Homo sapiens
ggcacaggagacucca

SEQ ID NO: 1553658 - RNA, 10 nt, Homo sapiens
ggcagccacc

SEQ ID NO: 1553659 - RNA, 16 nt, Homo sapiens
ggcagccacccaagcc

SEQ ID NO: 1553660 - RNA, 19 nt, Homo sapiens
ggcccucuguccacaugug

SEQ ID NO: 1553661 - RNA, 17 nt, Homo sapiens
ggcuaaaauuaguuuua

SEQ ID NO: 1553662 - RNA, 21 nt, Homo sapiens
ggcuccugaauaucagucacu

SEQ ID NO: 1553663 - RNA, 18 nt, Homo sapiens
ggcugacaugaagcuguu

SEQ ID NO: 1553664 - RNA, 17 nt, Homo sapiens
ggcugccugcuguguua

SEQ ID NO: 1553665 - RNA, 20 nt, Homo sapiens
ggcuuuacaguguaaacugu

SEQ ID NO: 1553666 - RNA, 22 nt, Homo sapiens
gggauuucucccucucagugga

SEQ ID NO: 1553667 - RNA, 20 nt, Homo sapiens
gggcacuacauaauugcugu

SEQ ID NO: 1553668 - RNA, 11 nt, Homo sapiens
gggcaggguga

SEQ ID NO: 1553669 - RNA, 16 nt, Homo sapiens
gggcgggccagggugg

SEQ ID NO: 1553670 - RNA, 12 nt, Homo sapiens
gguaauauaccu

SEQ ID NO: 1553671 - RNA, 17 nt, Homo sapiens
gguaguauuacaccacc

SEQ ID NO: 1553672 - RNA, 20 nt, Homo sapiens
gguaucuguuuaacauuucc

SEQ ID NO: 1553673 - RNA, 13 nt, Homo sapiens
ggucuuucugugc

SEQ ID NO: 1553674 - RNA, 19 nt, Homo sapiens
ggugaagggagagccagcu

SEQ ID NO: 1553675 - RNA, 12 nt, Homo sapiens
gguucugcccug

SEQ ID NO: 1553676 - RNA, 15 nt, Homo sapiens
guaaaaaauauuaaa

SEQ ID NO: 1553677 - RNA, 17 nt, Homo sapiens
guaaugcucugaccaag

SEQ ID NO: 1553678 - RNA, 14 nt, Homo sapiens
guacaggcaguuag

SEQ ID NO: 1553679 - RNA, 21 nt, Homo sapiens
guacaguucugggguacaugu

SEQ ID NO: 1553680 - RNA, 19 nt, Homo sapiens
guagcucuggaccugucuc

SEQ ID NO: 1553681 - RNA, 17 nt, Homo sapiens
guaggucggcacuugga

SEQ ID NO: 1553682 - RNA, 15 nt, Homo sapiens
guccaaccagaaaca

SEQ ID NO: 1553683 - RNA, 16 nt, Homo sapiens
aauaaauauuuaauga

SEQ ID NO: 1553684 - RNA, 16 nt, Homo sapiens
aauaaguuacuugaaa

SEQ ID NO: 1553685 - RNA, 16 nt, Homo sapiens
aauaaugaacacuaca

SEQ ID NO: 1553686 - RNA, 17 nt, Homo sapiens
aauaucagucacuguuc

SEQ ID NO: 1553687 - RNA, 14 nt, Homo sapiens
aauauccaagacuu

SEQ ID NO: 1553688 - RNA, 19 nt, Homo sapiens
aaucauuucuagauuauaa

SEQ ID NO: 1553689 - RNA, 18 nt, Homo sapiens
aauccccaacaugcacug

SEQ ID NO: 1553690 - RNA, 18 nt, Homo sapiens
aaucuauauuugucuucc

SEQ ID NO: 1553691 - RNA, 21 nt, Homo sapiens
aaucuauccauugaacuaaaa

SEQ ID NO: 1553692 - RNA, 18 nt, Homo sapiens
aaucucguuucuccucuu

SEQ ID NO: 1553693 - RNA, 15 nt, Homo sapiens
aaucugaguuuuaca

SEQ ID NO: 1553694 - RNA, 20 nt, Homo sapiens
aaucuguccguucacaugug

SEQ ID NO: 1553695 - RNA, 21 nt, Homo sapiens
aaucuguccguucacaugugu

SEQ ID NO: 1553696 - RNA, 17 nt, Homo sapiens
aaucuguguaacuguaa

SEQ ID NO: 1553697 - RNA, 13 nt, Homo sapiens
aaugaaacuuuaa

SEQ ID NO: 1553698 - RNA, 14 nt, Homo sapiens
aaugaauuugcuaa

SEQ ID NO: 1553699 - RNA, 12 nt, Homo sapiens
aaugaccaaaga

SEQ ID NO: 1553700 - RNA, 12 nt, Homo sapiens
aaugacuuacag

SEQ ID NO: 1553701 - RNA, 17 nt, Homo sapiens
aaugagccgagaucacg

SEQ ID NO: 1553702 - RNA, 21 nt, Homo sapiens
aaugccaagggggugacugga

SEQ ID NO: 1553703 - RNA, 23 nt, Homo sapiens
aaugccaagggggugacuggaag

SEQ ID NO: 1553704 - RNA, 13 nt, Homo sapiens
aauggccaugcag

SEQ ID NO: 1553705 - RNA, 18 nt, Homo sapiens
aauggggggcgggccagg

SEQ ID NO: 1553706 - RNA, 22 nt, Homo sapiens
aauuaaaaauaccaacuguaca

SEQ ID NO: 1553707 - RNA, 11 nt, Homo sapiens
aauuaaaggaa

SEQ ID NO: 1553708 - RNA, 16 nt, Homo sapiens
aauucauaaccaaaga

SEQ ID NO: 1553709 - RNA, 16 nt, Homo sapiens
aauuccucuuacugua

SEQ ID NO: 1553710 - RNA, 18 nt, Homo sapiens
aauuguguauugaugcaa

SEQ ID NO: 1553711 - RNA, 18 nt, Homo sapiens
aauuuuaaugcauuguua

SEQ ID NO: 1553712 - RNA, 20 nt, Homo sapiens
aauuuuauaacagaauuaaa

SEQ ID NO: 1553713 - RNA, 22 nt, Homo sapiens
aauuuuccaagaacauaguuua

SEQ ID NO: 1553714 - RNA, 22 nt, Homo sapiens
acaaaauaacucuccaguaaca

SEQ ID NO: 1553715 - RNA, 17 nt, Homo sapiens
acaaacucacucaguaa

SEQ ID NO: 1553716 - RNA, 13 nt, Homo sapiens
acaaaggagccuu

SEQ ID NO: 1553717 - RNA, 21 nt, Homo sapiens
acaacacugauacuagauucc

SEQ ID NO: 1553718 - RNA, 21 nt, Homo sapiens
acaagaggcuucccuaguuua

SEQ ID NO: 1553719 - RNA, 19 nt, Homo sapiens
acaauuaaaccgcauguga

SEQ ID NO: 1553720 - RNA, 20 nt, Homo sapiens
agccugcuuugcuuuacugc

SEQ ID NO: 1553721 - RNA, 18 nt, Homo sapiens
agccuugauaauacuuga

SEQ ID NO: 1553722 - RNA, 14 nt, Homo sapiens
agcucuggaugaag

SEQ ID NO: 1553723 - RNA, 15 nt, Homo sapiens
agcucuggaugaagg

SEQ ID NO: 1553724 - RNA, 13 nt, Homo sapiens
agcugugucugcc

SEQ ID NO: 1553725 - RNA, 19 nt, Homo sapiens
agcuugggcaacagagcaa

SEQ ID NO: 1553726 - RNA, 22 nt, Homo sapiens
aggaaaaaugaggaauccaaaa

SEQ ID NO: 1553727 - RNA, 15 nt, Homo sapiens
aggaaauauaaacuu

SEQ ID NO: 1553728 - RNA, 18 nt, Homo sapiens
aggaaauauauaugugug

SEQ ID NO: 1553729 - RNA, 18 nt, Homo sapiens
aggaauccccaacaugca

SEQ ID NO: 1553730 - RNA, 18 nt, Homo sapiens
aggacaagacacugagga

SEQ ID NO: 1553731 - RNA, 13 nt, Homo sapiens
aggaccacuccug

SEQ ID NO: 1553732 - RNA, 16 nt, Homo sapiens
aggagcccagccagaa

SEQ ID NO: 1553733 - RNA, 16 nt, Homo sapiens
aggcagggcugggaag

SEQ ID NO: 1553734 - RNA, 20 nt, Homo sapiens
aggcccuugucgugggaugg

SEQ ID NO: 1553735 - RNA, 14 nt, Homo sapiens
aggcuuuacagugu

SEQ ID NO: 1553736 - RNA, 15 nt, Homo sapiens
agggagcgcucucuu

SEQ ID NO: 1553737 - RNA, 23 nt, Homo sapiens
agggcaagaaauggcgucugcuc

SEQ ID NO: 1553738 - RNA, 15 nt, Homo sapiens
agggcaagaucucag

SEQ ID NO: 1553739 - RNA, 19 nt, Homo sapiens
agggcugguguggcugcuc

SEQ ID NO: 1553740 - RNA, 18 nt, Homo sapiens
aggggagggcaggcuugg

SEQ ID NO: 1553741 - RNA, 22 nt, Homo sapiens
aggguauaaauuauauccguga

SEQ ID NO: 1553742 - RNA, 13 nt, Homo sapiens
agggugcagucca

SEQ ID NO: 1553743 - RNA, 15 nt, Homo sapiens
aggugaucucuggga

SEQ ID NO: 1553744 - RNA, 11 nt, Homo sapiens
aggugccucau

SEQ ID NO: 1553745 - RNA, 19 nt, Homo sapiens
aggugccucauagcauagc

SEQ ID NO: 1553746 - RNA, 18 nt, Homo sapiens
aguacaucucuacuaaaa

SEQ ID NO: 1553747 - RNA, 13 nt, Homo sapiens
aguaugccuuaag

SEQ ID NO: 1553748 - RNA, 14 nt, Homo sapiens
agucaguugcauuc

SEQ ID NO: 1553749 - RNA, 17 nt, Homo sapiens
aguccagacagcuugac

SEQ ID NO: 1553750 - RNA, 18 nt, Homo sapiens
aguccaucuaacaucaua

SEQ ID NO: 1553751 - RNA, 19 nt, Homo sapiens
aguggcacaggagacucca

SEQ ID NO: 1553752 - RNA, 15 nt, Homo sapiens
agugggaucccagac

SEQ ID NO: 1553753 - RNA, 20 nt, Homo sapiens
aguuuuucucuggccuuuaa

SEQ ID NO: 1553754 - RNA, 21 nt, Homo sapiens
auaaaaauucauaaccaaaga

SEQ ID NO: 1553755 - RNA, 17 nt, Homo sapiens
auaaaucucuccuauaa

SEQ ID NO: 1553756 - RNA, 23 nt, Homo sapiens
auaaauuuuauaacagaauuaaa

SEQ ID NO: 1553757 - RNA, 19 nt, Homo sapiens
aaccagaaacaccccucug

SEQ ID NO: 1553758 - RNA, 18 nt, Homo sapiens
aaccuacugcccacauuu

SEQ ID NO: 1553759 - RNA, 13 nt, Homo sapiens
aaccuuccaccca

SEQ ID NO: 1553760 - RNA, 23 nt, Homo sapiens
aaccuuggagaggagaguggcag

SEQ ID NO: 1553761 - RNA, 20 nt, Homo sapiens
aacuagagcacagaaggaau

SEQ ID NO: 1553762 - RNA, 11 nt, Homo sapiens
aacucacucag

SEQ ID NO: 1553763 - RNA, 20 nt, Homo sapiens
aacuccgugcuuaaccaaag

SEQ ID NO: 1553764 - RNA, 17 nt, Homo sapiens
aacucuacucaacccau

SEQ ID NO: 1553765 - RNA, 13 nt, Homo sapiens
aacugaacuguga

SEQ ID NO: 1553766 - RNA, 21 nt, Homo sapiens
aacugaaggggugcacccacc

SEQ ID NO: 1553767 - RNA, 18 nt, Homo sapiens
aacugacugccuugcuaa

SEQ ID NO: 1553768 - RNA, 23 nt, Homo sapiens
aacugugaacccuugugccucuc

SEQ ID NO: 1553769 - RNA, 13 nt, Homo sapiens
aacuucugaagau

SEQ ID NO: 1553770 - RNA, 16 nt, Homo sapiens
aacuucuguacaguaa

SEQ ID NO: 1553771 - RNA, 12 nt, Homo sapiens
aagaaaacugau

SEQ ID NO: 1553772 - RNA, 21 nt, Homo sapiens
aagaagacuguugccacuuaa

SEQ ID NO: 1553773 - RNA, 19 nt, Homo sapiens
aagacuguugccacuuaac

SEQ ID NO: 1553774 - RNA, 15 nt, Homo sapiens
aagagaagaaauagc

SEQ ID NO: 1553775 - RNA, 14 nt, Homo sapiens
aagagacugggaag

SEQ ID NO: 1553776 - RNA, 19 nt, Homo sapiens
aagauaacaagaucuuuca

SEQ ID NO: 1553777 - RNA, 23 nt, Homo sapiens
aagcaugucucaauaguaaaaga

SEQ ID NO: 1553778 - RNA, 19 nt, Homo sapiens
aagggagcgcucucuugau

SEQ ID NO: 1553779 - RNA, 21 nt, Homo sapiens
aaggguucugcccugccugag

SEQ ID NO: 1553780 - RNA, 19 nt, Homo sapiens
aagguauguaguuacagaa

SEQ ID NO: 1553781 - RNA, 14 nt, Homo sapiens
aagguuaaauuuca

SEQ ID NO: 1553782 - RNA, 11 nt, Homo sapiens
aaguacaucuc

SEQ ID NO: 1553783 - RNA, 20 nt, Homo sapiens
aaguagcaucccaucccaac

SEQ ID NO: 1553784 - RNA, 19 nt, Homo sapiens
aaguauaaucagcacuuug

SEQ ID NO: 1553785 - RNA, 13 nt, Homo sapiens
aaguaugccuuaa

SEQ ID NO: 1553786 - RNA, 14 nt, Homo sapiens
aaguaugccuuaag

SEQ ID NO: 1553787 - RNA, 19 nt, Homo sapiens
aagucaaagaagacucagu

SEQ ID NO: 1553788 - RNA, 12 nt, Homo sapiens
aagugagcagaa

SEQ ID NO: 1553789 - RNA, 15 nt, Homo sapiens
aaguguaaauccuuu

SEQ ID NO: 1553790 - RNA, 16 nt, Homo sapiens
aaguuguggauaucag

SEQ ID NO: 1553791 - RNA, 16 nt, Homo sapiens
aaguuucugucuuccu

SEQ ID NO: 1553792 - RNA, 18 nt, Homo sapiens
aauaaauauuuaaugaau

SEQ ID NO: 1553793 - RNA, 18 nt, Homo sapiens
aauagccuaaaugauggu

SEQ ID NO: 1553794 - RNA, 18 nt, Homo sapiens
aauauaaauuuaagcaaa

SEQ ID NO: 1553795 - RNA, 13 nt, Homo sapiens
aauauaagcauaa

SEQ ID NO: 1553796 - RNA, 20 nt, Homo sapiens
ccaugccacccuguuuucag

SEQ ID NO: 1553797 - RNA, 21 nt, Homo sapiens
cccaaguaugccuuaagcaga

SEQ ID NO: 1553798 - RNA, 15 nt, Homo sapiens
cccacuuugaagggc

SEQ ID NO: 1553799 - RNA, 21 nt, Homo sapiens
cccagaaugagacauccagca

SEQ ID NO: 1553800 - RNA, 24 nt, Homo sapiens
cccagacucuuuuuuugagugaca

SEQ ID NO: 1553801 - RNA, 15 nt, Homo sapiens
cccagagguggaugu

SEQ ID NO: 1553802 - RNA, 15 nt, Homo sapiens
cccagcagggccuca

SEQ ID NO: 1553803 - RNA, 23 nt, Homo sapiens
cccagcuucaaaugcaaauucau

SEQ ID NO: 1553804 - RNA, 17 nt, Homo sapiens
cccagggcacuacauaa

SEQ ID NO: 1553805 - RNA, 17 nt, Homo sapiens
ccccaacaugcacugau

SEQ ID NO: 1553806 - RNA, 19 nt, Homo sapiens
ccccagauacauggugaug

SEQ ID NO: 1553807 - RNA, 18 nt, Homo sapiens
cccccacgugacagugcc

SEQ ID NO: 1553808 - RNA, 16 nt, Homo sapiens
cccgacuccucaaaag

SEQ ID NO: 1553809 - RNA, 17 nt, Homo sapiens
cccggcgccgggcacca

SEQ ID NO: 1553810 - RNA, 23 nt, Homo sapiens
cccugccaagacuccucaggcag

SEQ ID NO: 1553811 - RNA, 20 nt, Homo sapiens
cccuggaaaccuuccaccca

SEQ ID NO: 1553812 - RNA, 14 nt, Homo sapiens
cccuuauacagugg

SEQ ID NO: 1553813 - RNA, 18 nt, Homo sapiens
cccuucuauacccaccca

SEQ ID NO: 1553814 - RNA, 22 nt, Homo sapiens
ccgacggugggcauuugugagg

SEQ ID NO: 1553815 - RNA, 21 nt, Homo sapiens
ccggaguucugcccaugggaa

SEQ ID NO: 1553816 - RNA, 13 nt, Homo sapiens
ccuaagaguggag

SEQ ID NO: 1553817 - RNA, 19 nt, Homo sapiens
ccuaaggacaagacacuga

SEQ ID NO: 1553818 - RNA, 14 nt, Homo sapiens
ccuauccugaagau

SEQ ID NO: 1553819 - RNA, 14 nt, Homo sapiens
ccucacccauccua

SEQ ID NO: 1553820 - RNA, 16 nt, Homo sapiens
ccucagccaguggcac

SEQ ID NO: 1553821 - RNA, 13 nt, Homo sapiens
ccucaugcccagc

SEQ ID NO: 1553822 - RNA, 15 nt, Homo sapiens
ccuccagcauuuaaa

SEQ ID NO: 1553823 - RNA, 20 nt, Homo sapiens
ccucuccaggaaugccuccu

SEQ ID NO: 1553824 - RNA, 20 nt, Homo sapiens
ccugaaggaaaauaaacuga

SEQ ID NO: 1553825 - RNA, 12 nt, Homo sapiens
ccugaccuguca

SEQ ID NO: 1553826 - RNA, 23 nt, Homo sapiens
ccugcgggcgcgggcagccaccc

SEQ ID NO: 1553827 - RNA, 21 nt, Homo sapiens
ccuuaagcagaacaaaugugu

SEQ ID NO: 1553828 - RNA, 15 nt, Homo sapiens
ccuuaauaaauaugu

SEQ ID NO: 1553829 - RNA, 14 nt, Homo sapiens
ccuugauaauacuu

SEQ ID NO: 1553830 - RNA, 12 nt, Homo sapiens
ccuugccuuaau

SEQ ID NO: 1553831 - RNA, 17 nt, Homo sapiens
ccuugcuaaaagauuau

SEQ ID NO: 1553832 - RNA, 19 nt, Homo sapiens
ccuuuggccccacuuugaa

SEQ ID NO: 1553833 - RNA, 15 nt, Homo sapiens
ccuuuuucacuuuga

SEQ ID NO: 1553834 - RNA, 16 nt, Homo sapiens
cgauugagaacugaca

SEQ ID NO: 1553835 - RNA, 15 nt, Homo sapiens
cguagacagguguua

SEQ ID NO: 1553836 - RNA, 14 nt, Homo sapiens
cgugacaacaugcg

SEQ ID NO: 1553837 - RNA, 12 nt, Homo sapiens
cuaaaagauuau

SEQ ID NO: 1553838 - RNA, 14 nt, Homo sapiens
cuacagauagaaaa

SEQ ID NO: 1553839 - RNA, 17 nt, Homo sapiens
cuacuuccuguaaugua

SEQ ID NO: 1553840 - RNA, 14 nt, Homo sapiens
cuagaaaaucugag

SEQ ID NO: 1553841 - RNA, 22 nt, Homo sapiens
cuauacccacccagaaugagac

SEQ ID NO: 1553842 - RNA, 14 nt, Homo sapiens
cuauuuucagagca

SEQ ID NO: 1553843 - RNA, 14 nt, Homo sapiens
cucaccuugagaua

SEQ ID NO: 1553844 - RNA, 18 nt, Homo sapiens
cucccugcacgcauuuuc

SEQ ID NO: 1553845 - RNA, 23 nt, Homo sapiens
cucucugacgcuugugacagugc

SEQ ID NO: 1553846 - RNA, 23 nt, Homo sapiens
cucuggccaggauggaggggugg

SEQ ID NO: 1553847 - RNA, 21 nt, Homo sapiens
cucugucuaggacugcagugu

SEQ ID NO: 1553848 - RNA, 14 nt, Homo sapiens
cucuuaagaucuga

SEQ ID NO: 1553849 - RNA, 18 nt, Homo sapiens
cucuuuccuccugcuuca

SEQ ID NO: 1553850 - RNA, 19 nt, Homo sapiens
cucuuuuuuugagugacag

SEQ ID NO: 1553851 - RNA, 16 nt, Homo sapiens
cugaaagauacagggg

SEQ ID NO: 1553852 - RNA, 19 nt, Homo sapiens
cugaaauguuuuuaaugua

SEQ ID NO: 1553853 - RNA, 17 nt, Homo sapiens
cugaagccuggauucca

SEQ ID NO: 1553854 - RNA, 19 nt, Homo sapiens
cugaauaucagucacuguu

SEQ ID NO: 1553855 - RNA, 13 nt, Homo sapiens
cugccaaacacau

SEQ ID NO: 1553856 - RNA, 14 nt, Homo sapiens
cugccaaacacauu

SEQ ID NO: 1553857 - RNA, 15 nt, Homo sapiens
cuggcggcugugcau

SEQ ID NO: 1553858 - RNA, 15 nt, Homo sapiens
cugguaaaaagaucc

SEQ ID NO: 1553859 - RNA, 21 nt, Homo sapiens
cuguagcaccagagaauccau

SEQ ID NO: 1553860 - RNA, 20 nt, Homo sapiens
cuguccacccugccaagacu

SEQ ID NO: 1553861 - RNA, 11 nt, Homo sapiens
cugucuaggac

SEQ ID NO: 1553862 - RNA, 13 nt, Homo sapiens
cugugaguguaag

SEQ ID NO: 1553863 - RNA, 14 nt, Homo sapiens
cuguggccccaaga

SEQ ID NO: 1553864 - RNA, 17 nt, Homo sapiens
cugugugugccuccagc

SEQ ID NO: 1553865 - RNA, 13 nt, Homo sapiens
cuguuuaacauuu

SEQ ID NO: 1553866 - RNA, 14 nt, Homo sapiens
cuguuuaacauuuc

SEQ ID NO: 1553867 - RNA, 22 nt, Homo sapiens
cuuaaaacaaauucauuauucu

SEQ ID NO: 1553868 - RNA, 23 nt, Homo sapiens
cuuaaacuguguggacugugaug

SEQ ID NO: 1553869 - RNA, 14 nt, Homo sapiens
cuuacagucccaga

SEQ ID NO: 1553870 - RNA, 16 nt, Homo sapiens
cuucaaucuuaaaaca

SEQ ID NO: 1553871 - RNA, 17 nt, Homo sapiens
cuucagaagacacugca

SEQ ID NO: 1553872 - RNA, 20 nt, Homo sapiens
cuucagaagacacugcaaag

SEQ ID NO: 1553873 - RNA, 20 nt, Homo sapiens
cuuccacaugggugcauuug

SEQ ID NO: 1553874 - RNA, 15 nt, Homo sapiens
cuugagauaacaauc

SEQ ID NO: 1553875 - RNA, 16 nt, Homo sapiens
cuugcauguacuugaa

SEQ ID NO: 1553876 - RNA, 22 nt, Homo sapiens
cuuucugggaugucacagucca

SEQ ID NO: 1553877 - RNA, 15 nt, Homo sapiens
cuuucuguugccaca

SEQ ID NO: 1553878 - RNA, 18 nt, Homo sapiens
cuuuggccccacuuugaa

SEQ ID NO: 1553879 - RNA, 18 nt, Homo sapiens
cuuuuaaaugaccaaaga

SEQ ID NO: 1553880 - RNA, 13 nt, Homo sapiens
cuuuuguguacag

SEQ ID NO: 1553881 - RNA, 19 nt, Homo sapiens
cuuuuuguuugcaucauuu

SEQ ID NO: 1553882 - RNA, 14 nt, Homo sapiens
gaaaaaugaggaau

SEQ ID NO: 1553883 - RNA, 22 nt, Homo sapiens
gaaaacugauucucuaugacau

SEQ ID NO: 1553884 - RNA, 16 nt, Homo sapiens
gaaaauggccaugcag

SEQ ID NO: 1553885 - RNA, 20 nt, Homo sapiens
gaaaauuggaacucuacuca

SEQ ID NO: 1553886 - RNA, 19 nt, Homo sapiens
gaaacuuuaaaagacugaa

SEQ ID NO: 1553887 - RNA, 14 nt, Homo sapiens
gaaaggucucugga

SEQ ID NO: 1553888 - RNA, 15 nt, Homo sapiens
gaaauaaaauuugaa

SEQ ID NO: 1553889 - RNA, 16 nt, Homo sapiens
gaaauaaguuguuuca

SEQ ID NO: 1553890 - RNA, 21 nt, Homo sapiens
gaaaucauaguuuaaacugca

SEQ ID NO: 1553891 - RNA, 22 nt, Homo sapiens
gaaaucuuucucccucaacuga

SEQ ID NO: 1553892 - RNA, 15 nt, Homo sapiens
gaaauuaagacuuua

SEQ ID NO: 1553893 - RNA, 22 nt, Homo sapiens
gaacaacuaggcuucagcauau

SEQ ID NO: 1553894 - RNA, 19 nt, Homo sapiens
gaacaugacccagccugaa

SEQ ID NO: 1553895 - RNA, 12 nt, Homo sapiens
gaagacacugca

SEQ ID NO: 1553896 - RNA, 19 nt, Homo sapiens
gaagagcguagacaggugu

SEQ ID NO: 1553897 - RNA, 17 nt, Homo sapiens
gaagccagugggguccc

SEQ ID NO: 1553898 - RNA, 17 nt, Homo sapiens
gaagggcguucuaggua

SEQ ID NO: 1553899 - RNA, 22 nt, Homo sapiens
gaagguauuccuuuuguguaca

SEQ ID NO: 1553900 - RNA, 16 nt, Homo sapiens
gaauaucagucacugu

SEQ ID NO: 1553901 - RNA, 18 nt, Homo sapiens
gaaucaaaucucuuccac

SEQ ID NO: 1553902 - RNA, 22 nt, Homo sapiens
gaaucuggcaggaaucuaucca

SEQ ID NO: 1553903 - RNA, 15 nt, Homo sapiens
gacaauggacuguac

SEQ ID NO: 1553904 - RNA, 20 nt, Homo sapiens
gacacgauugagaacugaca

SEQ ID NO: 1553905 - RNA, 23 nt, Homo sapiens
gacagaaaccaagccauuaauga

SEQ ID NO: 1553906 - RNA, 15 nt, Homo sapiens
gacagcuuucuggga

SEQ ID NO: 1553907 - RNA, 16 nt, Homo sapiens
gacagucuguuaugca

SEQ ID NO: 1553908 - RNA, 15 nt, Homo sapiens
gacagugccucuucc

SEQ ID NO: 1553909 - RNA, 14 nt, Homo sapiens
gacagugccuggga

SEQ ID NO: 1553910 - RNA, 12 nt, Homo sapiens
gacaucaucaag

SEQ ID NO: 1553911 - RNA, 20 nt, Homo sapiens
gaccaagccgagaugcccau

SEQ ID NO: 1553912 - RNA, 18 nt, Homo sapiens
gaccaugguauauuccua

SEQ ID NO: 1553913 - RNA, 13 nt, Homo sapiens
gacccacacugcc

SEQ ID NO: 1553914 - RNA, 12 nt, Homo sapiens
gaccucugugac

SEQ ID NO: 1553915 - RNA, 22 nt, Homo sapiens
gacucuuuuuuugagugacagc

SEQ ID NO: 1553916 - RNA, 15 nt, Homo sapiens
aaaaacuguacugug

SEQ ID NO: 1553917 - RNA, 17 nt, Homo sapiens
aaaacauaauguaucau

SEQ ID NO: 1553918 - RNA, 18 nt, Homo sapiens
aaaaccacagcugggcag

SEQ ID NO: 1553919 - RNA, 15 nt, Homo sapiens
aaaagacaaaaauca

SEQ ID NO: 1553920 - RNA, 20 nt, Homo sapiens
aaaagggcagggcaucuccu

SEQ ID NO: 1553921 - RNA, 19 nt, Homo sapiens
aaaagguuaaauauuguca

SEQ ID NO: 1553922 - RNA, 16 nt, Homo sapiens
aaaaucuguguaacug

SEQ ID NO: 1553923 - RNA, 19 nt, Homo sapiens
aaaauucauaaccaaagag

SEQ ID NO: 1553924 - RNA, 20 nt, Homo sapiens
aaaauuggaacucuacucaa

SEQ ID NO: 1553925 - RNA, 13 nt, Homo sapiens
aaacaaauucauu

SEQ ID NO: 1553926 - RNA, 13 nt, Homo sapiens
aaacacauuuacc

SEQ ID NO: 1553927 - RNA, 22 nt, Homo sapiens
aaaccacagcugggcaggguga

SEQ ID NO: 1553928 - RNA, 18 nt, Homo sapiens
aaacuaguaauacugucu

SEQ ID NO: 1553929 - RNA, 15 nt, Homo sapiens
aaacuauugagccuu

SEQ ID NO: 1553930 - RNA, 14 nt, Homo sapiens
aaacugucuugccc

SEQ ID NO: 1553931 - RNA, 17 nt, Homo sapiens
aaacuuuagaguagcau

SEQ ID NO: 1553932 - RNA, 22 nt, Homo sapiens
aaagaauuccugcagcaguuau

SEQ ID NO: 1553933 - RNA, 21 nt, Homo sapiens
aaagauuauagaaguagcaaa

SEQ ID NO: 1553934 - RNA, 22 nt, Homo sapiens
aaagcaaacacuuacagaauua

SEQ ID NO: 1553935 - RNA, 18 nt, Homo sapiens
aaagcccaaccuccugac

SEQ ID NO: 1553936 - RNA, 15 nt, Homo sapiens
aaaggagccuugaua

SEQ ID NO: 1553937 - RNA, 15 nt, Homo sapiens
aaaguuaaaagcaaa

SEQ ID NO: 1553938 - RNA, 18 nt, Homo sapiens
aaauacaacacugauacu

SEQ ID NO: 1553939 - RNA, 21 nt, Homo sapiens
aaauauccagccaguacagua

SEQ ID NO: 1553940 - RNA, 20 nt, Homo sapiens
aaauauugucauaggauuaa

SEQ ID NO: 1553941 - RNA, 20 nt, Homo sapiens
aaauauuuccuuaaacugug

SEQ ID NO: 1553942 - RNA, 23 nt, Homo sapiens
aaaucauaguuuaaacugcauua

SEQ ID NO: 1553943 - RNA, 17 nt, Homo sapiens
aaaucauccucaugucc

SEQ ID NO: 1553944 - RNA, 15 nt, Homo sapiens
aaaucuaccacugua

SEQ ID NO: 1553945 - RNA, 16 nt, Homo sapiens
aaaucuaccacuguau

SEQ ID NO: 1553946 - RNA, 22 nt, Homo sapiens
aaaugaaauacugccuuggcua

SEQ ID NO: 1553947 - RNA, 14 nt, Homo sapiens
aaaugaacauuuca

SEQ ID NO: 1553948 - RNA, 16 nt, Homo sapiens
aaaugcuuacagggcu

SEQ ID NO: 1553949 - RNA, 10 nt, Homo sapiens
aaaugcuuuu

SEQ ID NO: 1553950 - RNA, 22 nt, Homo sapiens
aaauguauuuugccucugggua

SEQ ID NO: 1553951 - RNA, 22 nt, Homo sapiens
aaauguguaauuuuguuuauau

SEQ ID NO: 1553952 - RNA, 18 nt, Homo sapiens
aaauuccucuuacuguaa

SEQ ID NO: 1553953 - RNA, 16 nt, Homo sapiens
aaauucugucaggggu

SEQ ID NO: 1553954 - RNA, 12 nt, Homo sapiens
aaauugcugcuu

SEQ ID NO: 1553955 - RNA, 12 nt, Homo sapiens
aacauagugucu

SEQ ID NO: 1553956 - RNA, 18 nt, Homo sapiens
aacauuuuguccaccuuu

SEQ ID NO: 1553957 - RNA, 12 nt, Homo sapiens
aaccaguccagg

SEQ ID NO: 1553958 - RNA, 17 nt, Homo sapiens
aacccuugugccucuca

SEQ ID NO: 1553959 - RNA, 20 nt, Homo sapiens
aaccuuccacccagugcuga

SEQ ID NO: 1553960 - RNA, 13 nt, Homo sapiens
aacugacugccuu

SEQ ID NO: 1553961 - RNA, 12 nt, Homo sapiens
aacugauucucu

SEQ ID NO: 1553962 - RNA, 20 nt, Homo sapiens
aacugauucucuaugacaug

SEQ ID NO: 1553963 - RNA, 15 nt, Homo sapiens
aacuguacuguguuu

SEQ ID NO: 1553964 - RNA, 17 nt, Homo sapiens
aacuguguggacuguga

SEQ ID NO: 1553965 - RNA, 20 nt, Homo sapiens
aacuugcacgacgccugcca

SEQ ID NO: 1553966 - RNA, 16 nt, Homo sapiens
aacuuuaucauaugcu

SEQ ID NO: 1553967 - RNA, 14 nt, Homo sapiens
aagaaagaauuccu

SEQ ID NO: 1553968 - RNA, 21 nt, Homo sapiens
aagaauuuuuuugucuuucaa

SEQ ID NO: 1553969 - RNA, 16 nt, Homo sapiens
aagagaagaaauagca

SEQ ID NO: 1553970 - RNA, 23 nt, Homo sapiens
aagauuuuccauuguauccucuu

SEQ ID NO: 1553971 - RNA, 16 nt, Homo sapiens
aagcaaaaugcuuaca

SEQ ID NO: 1553972 - RNA, 22 nt, Homo sapiens
aagcaaacacuuacagaauuau

SEQ ID NO: 1553973 - RNA, 19 nt, Homo sapiens
aagcuagaugccccugcag

SEQ ID NO: 1553974 - RNA, 22 nt, Homo sapiens
aagcuuuuuguuugcaucauuu

SEQ ID NO: 1553975 - RNA, 17 nt, Homo sapiens
aaggacaagacacugag

SEQ ID NO: 1553976 - RNA, 19 nt, Homo sapiens
aaggagcuacugacauucc

SEQ ID NO: 1553977 - RNA, 18 nt, Homo sapiens
aaggcauguucccagaaa

SEQ ID NO: 1553978 - RNA, 12 nt, Homo sapiens
aaggugccucau

SEQ ID NO: 1553979 - RNA, 13 nt, Homo sapiens
aaguaaugauuaa

SEQ ID NO: 1553980 - RNA, 16 nt, Homo sapiens
aaguacagaacaguaa

SEQ ID NO: 1553981 - RNA, 19 nt, Homo sapiens
aaguacaucucuacuaaaa

SEQ ID NO: 1553982 - RNA, 18 nt, Homo sapiens
aaguagauuuuaaaagau

SEQ ID NO: 1553983 - RNA, 13 nt, Homo sapiens
aaguauaaaguaa

SEQ ID NO: 1553984 - RNA, 22 nt, Homo sapiens
aaguauaaucagcacuuugcca

SEQ ID NO: 1553985 - RNA, 22 nt, Homo sapiens
aaguaugugguacuacuguaag

SEQ ID NO: 1553986 - RNA, 21 nt, Homo sapiens
ucccuggagaaggcauguucc

SEQ ID NO: 1553987 - RNA, 19 nt, Homo sapiens
uccuccugcuucaugggaa

SEQ ID NO: 1553988 - RNA, 22 nt, Homo sapiens
uccucuacucacagcugaagaa

SEQ ID NO: 1553989 - RNA, 15 nt, Homo sapiens
uccuuuuguguacag

SEQ ID NO: 1553990 - RNA, 12 nt, Homo sapiens
ucgcagccugaa

SEQ ID NO: 1553991 - RNA, 15 nt, Homo sapiens
ucuaaagguaccaaa

SEQ ID NO: 1553992 - RNA, 24 nt, Homo sapiens
ucuauauauauagggagcacuuua

SEQ ID NO: 1553993 - RNA, 19 nt, Homo sapiens
ucuauugucaagaugcuac

SEQ ID NO: 1553994 - RNA, 14 nt, Homo sapiens
ucucagaagguauu

SEQ ID NO: 1553995 - RNA, 17 nt, Homo sapiens
ucuccagacccaccaca

SEQ ID NO: 1553996 - RNA, 15 nt, Homo sapiens
ucugcccaugggaag

SEQ ID NO: 1553997 - RNA, 13 nt, Homo sapiens
ucugccucuggaa

SEQ ID NO: 1553998 - RNA, 19 nt, Homo sapiens
ucuggcaggaaucuaucca

SEQ ID NO: 1553999 - RNA, 14 nt, Homo sapiens
ucuuaaaacaaauu

SEQ ID NO: 1554000 - RNA, 21 nt, Homo sapiens
ucuucaagaaagaauuccugc

SEQ ID NO: 1554001 - RNA, 15 nt, Homo sapiens
ucuugugaguggaua

SEQ ID NO: 1554002 - RNA, 23 nt, Homo sapiens
ucuuuuugguagaugcugggcuc

SEQ ID NO: 1554003 - RNA, 20 nt, Homo sapiens
ugaaaaauguguuccauugc

SEQ ID NO: 1554004 - RNA, 23 nt, Homo sapiens
ugaaaauuuauuuuuagugauaa

SEQ ID NO: 1554005 - RNA, 11 nt, Homo sapiens
ugaaacuaaga

SEQ ID NO: 1554006 - RNA, 16 nt, Homo sapiens
ugaaaucgaauggaga

SEQ ID NO: 1554007 - RNA, 19 nt, Homo sapiens
ugaaauuauuugucauuca

SEQ ID NO: 1554008 - RNA, 11 nt, Homo sapiens
ugaacauuuca

SEQ ID NO: 1554009 - RNA, 22 nt, Homo sapiens
ugaauauuccuggacuuacaaa

SEQ ID NO: 1554010 - RNA, 20 nt, Homo sapiens
ugaauauuuauauuucacua

SEQ ID NO: 1554011 - RNA, 18 nt, Homo sapiens
ugaaucaaaucucuucca

SEQ ID NO: 1554012 - RNA, 16 nt, Homo sapiens
ugaccagcaacuuguc

SEQ ID NO: 1554013 - RNA, 17 nt, Homo sapiens
ugaccucugugaccaac

SEQ ID NO: 1554014 - RNA, 21 nt, Homo sapiens
ugaccugucaccgugagcagc

SEQ ID NO: 1554015 - RNA, 17 nt, Homo sapiens
ugaccugugaccagcac

SEQ ID NO: 1554016 - RNA, 18 nt, Homo sapiens
ugacgcuugugacagugc

SEQ ID NO: 1554017 - RNA, 22 nt, Homo sapiens
ugacugcuuuuaaaugaccaaa

SEQ ID NO: 1554018 - RNA, 17 nt, Homo sapiens
ugagauguuauuacugu

SEQ ID NO: 1554019 - RNA, 23 nt, Homo sapiens
ugaggaccacuccuguacacuga

SEQ ID NO: 1554020 - RNA, 19 nt, Homo sapiens
ugaggaggaggacacagca

SEQ ID NO: 1554021 - RNA, 21 nt, Homo sapiens
ugaggcccagugcauaugcaa

SEQ ID NO: 1554022 - RNA, 14 nt, Homo sapiens
ugauaauacuugac

SEQ ID NO: 1554023 - RNA, 15 nt, Homo sapiens
ugauuuagugaucaa

SEQ ID NO: 1554024 - RNA, 13 nt, Homo sapiens
ugcacacaggaca

SEQ ID NO: 1554025 - RNA, 14 nt, Homo sapiens
ugcacauguacaua

SEQ ID NO: 1554026 - RNA, 22 nt, Homo sapiens
ugcaguagagucaucuccauca

SEQ ID NO: 1554027 - RNA, 13 nt, Homo sapiens
ugcaguuuggccc

SEQ ID NO: 1554028 - RNA, 22 nt, Homo sapiens
ugccacauggugucucccaaca

SEQ ID NO: 1554029 - RNA, 15 nt, Homo sapiens
ugccucucaucuuua

SEQ ID NO: 1554030 - RNA, 22 nt, Homo sapiens
ugccuucagcccuaacauagug

SEQ ID NO: 1554031 - RNA, 13 nt, Homo sapiens
ugcucugaccaag

SEQ ID NO: 1554032 - RNA, 22 nt, Homo sapiens
ugcugaaucaaaucucuuccac

SEQ ID NO: 1554033 - RNA, 14 nt, Homo sapiens
ugcugaaugaagcu

SEQ ID NO: 1554034 - RNA, 15 nt, Homo sapiens
ugcugaggcccagug

SEQ ID NO: 1554035 - RNA, 17 nt, Homo sapiens
ugcugaggcccagugca

SEQ ID NO: 1554036 - RNA, 23 nt, Homo sapiens
ugcugaggcccagugcauaugca

SEQ ID NO: 1554037 - RNA, 14 nt, Homo sapiens
ugcuggagacacuc

SEQ ID NO: 1554038 - RNA, 21 nt, Homo sapiens
uggaaaccuuccacccagugc

SEQ ID NO: 1554039 - RNA, 14 nt, Homo sapiens
uggaacucuacuca

SEQ ID NO: 1554040 - RNA, 15 nt, Homo sapiens
uggaagggcguucua

SEQ ID NO: 1554041 - RNA, 16 nt, Homo sapiens
uggacuguacaauaag

SEQ ID NO: 1554042 - RNA, 18 nt, Homo sapiens
uggagaaggguucugccc

SEQ ID NO: 1554043 - RNA, 19 nt, Homo sapiens
uggagagcagcaggugcug

SEQ ID NO: 1554044 - RNA, 15 nt, Homo sapiens
uggauaugacccaca

SEQ ID NO: 1554045 - RNA, 13 nt, Homo sapiens
uggcacaggagac

SEQ ID NO: 1554046 - RNA, 20 nt, Homo sapiens
uggcuuaagugagcagaaca

SEQ ID NO: 1554047 - RNA, 18 nt, Homo sapiens
ugggcaacagagcaagac

SEQ ID NO: 1554048 - RNA, 23 nt, Homo sapiens
ugggcucacuucuaauaacugca

SEQ ID NO: 1554049 - RNA, 18 nt, Homo sapiens
uggggccaggaccauggc

SEQ ID NO: 1554050 - RNA, 19 nt, Homo sapiens
ugggggagggaagaccaga

SEQ ID NO: 1554051 - RNA, 23 nt, Homo sapiens
uggucacaugaugugcauagaga

SEQ ID NO: 1554052 - RNA, 20 nt, Homo sapiens
ugguccugacucaacauguu

SEQ ID NO: 1554053 - RNA, 14 nt, Homo sapiens
ugguguggcugcuc

SEQ ID NO: 1554054 - RNA, 16 nt, Homo sapiens
ugguguggucuacuaa

SEQ ID NO: 1554055 - RNA, 14 nt, Homo sapiens
uguaagagacauga

SEQ ID NO: 1554056 - RNA, 20 nt, Homo sapiens
uguagggccugcauggagaa

SEQ ID NO: 1554057 - RNA, 17 nt, Homo sapiens
uguaucauuugaacaac

SEQ ID NO: 1554058 - RNA, 18 nt, Homo sapiens
uguccauaagcuacgggu

SEQ ID NO: 1554059 - RNA, 17 nt, Homo sapiens
ugucucgaugccauaau

SEQ ID NO: 1554060 - RNA, 19 nt, Homo sapiens
ugucugacuacaacaugca

SEQ ID NO: 1554061 - RNA, 17 nt, Homo sapiens
ugucuuaucugcuauaa

SEQ ID NO: 1554062 - RNA, 12 nt, Homo sapiens
ugugcacaugua

SEQ ID NO: 1554063 - RNA, 15 nt, Homo sapiens
ugugcaucaguggga

SEQ ID NO: 1554064 - RNA, 19 nt, Homo sapiens
ugugccugcucagcagagc

SEQ ID NO: 1554065 - RNA, 14 nt, Homo sapiens
ugugugggcuguga

SEQ ID NO: 1554066 - RNA, 20 nt, Homo sapiens
uguguuuuuaacaugucaau

SEQ ID NO: 1554067 - RNA, 17 nt, Homo sapiens
uguuuaaauagccuaaa

SEQ ID NO: 1554068 - RNA, 17 nt, Homo sapiens
uguuugcaucauuuaac

SEQ ID NO: 1554069 - RNA, 20 nt, Homo sapiens
uguuugguguuugucugugu

SEQ ID NO: 1554070 - RNA, 23 nt, Homo sapiens
uuaaaaaaauuuuaaguaucuag

SEQ ID NO: 1554071 - RNA, 17 nt, Homo sapiens
uuaaaaauagcaguauu

SEQ ID NO: 1554072 - RNA, 11 nt, Homo sapiens
uuaaacuuaau

SEQ ID NO: 1554073 - RNA, 15 nt, Homo sapiens
uuaaaugaccaaaga

SEQ ID NO: 1554074 - RNA, 16 nt, Homo sapiens
uuaacugaacugugaa

SEQ ID NO: 1554075 - RNA, 23 nt, Homo sapiens
uuaagaucugacugccaaauaaa

SEQ ID NO: 1554076 - RNA, 13 nt, Homo sapiens
uuaagcacacaca

SEQ ID NO: 1554077 - RNA, 14 nt, Homo sapiens
uuaagucaaagaag

SEQ ID NO: 1554078 - RNA, 13 nt, Homo sapiens
uuaaguuaaugaa

SEQ ID NO: 1554079 - RNA, 16 nt, Homo sapiens
uuaauaaauucagaua

SEQ ID NO: 1554080 - RNA, 22 nt, Homo sapiens
uuacccuuuggccccacuuuga

SEQ ID NO: 1554081 - RNA, 14 nt, Homo sapiens
uuacugaccagcaa

SEQ ID NO: 1554082 - RNA, 17 nt, Homo sapiens
uuagcaacaacaugcua

SEQ ID NO: 1554083 - RNA, 11 nt, Homo sapiens
uuaggugcuga

SEQ ID NO: 1554084 - RNA, 23 nt, Homo sapiens
uuaucaucggaguugacagugaa

SEQ ID NO: 1554085 - RNA, 18 nt, Homo sapiens
uucaaaguuaaaagcaaa

SEQ ID NO: 1554086 - RNA, 19 nt, Homo sapiens
uucaagaaagaauuccugc

SEQ ID NO: 1554087 - RNA, 23 nt, Homo sapiens
uucaagcaaaaugcuuacagggc

SEQ ID NO: 1554088 - RNA, 16 nt, Homo sapiens
uucacauuuguauuaa

SEQ ID NO: 1554089 - RNA, 10 nt, Homo sapiens
uucacuuuga

SEQ ID NO: 1554090 - RNA, 19 nt, Homo sapiens
uucauguaauagcaaugca

SEQ ID NO: 1554091 - RNA, 22 nt, Homo sapiens
uuccagccuucuacugcucucc

SEQ ID NO: 1554092 - RNA, 18 nt, Homo sapiens
uucccaaguaugccuuaa

SEQ ID NO: 1554093 - RNA, 23 nt, Homo sapiens
uucccaaguaugccuuaagcaga

SEQ ID NO: 1554094 - RNA, 14 nt, Homo sapiens
uuccucuuacugua

SEQ ID NO: 1554095 - RNA, 16 nt, Homo sapiens
uuccuuggccaugcag

SEQ ID NO: 1554096 - RNA, 19 nt, Homo sapiens
uucuaaauccgacuugaau

SEQ ID NO: 1554097 - RNA, 21 nt, Homo sapiens
uucuaaauccgacuugaauau

SEQ ID NO: 1554098 - RNA, 18 nt, Homo sapiens
uucuauacccacccagaa

SEQ ID NO: 1554099 - RNA, 22 nt, Homo sapiens
uucuauauaguuccuugccuua

SEQ ID NO: 1554100 - RNA, 16 nt, Homo sapiens
uucucuaugacaugaa

SEQ ID NO: 1554101 - RNA, 20 nt, Homo sapiens
uucugcagcaugaccuguga

SEQ ID NO: 1554102 - RNA, 22 nt, Homo sapiens
uucuggucuggcggcugugcau

SEQ ID NO: 1554103 - RNA, 13 nt, Homo sapiens
uucuguacaguaa

SEQ ID NO: 1554104 - RNA, 15 nt, Homo sapiens
uugaaggauggauga

SEQ ID NO: 1554105 - RNA, 20 nt, Homo sapiens
uugaagggcaagaaauggcg

SEQ ID NO: 1554106 - RNA, 13 nt, Homo sapiens
cagaccucaugcc

SEQ ID NO: 1554107 - RNA, 17 nt, Homo sapiens
cagacugaaccagucca

SEQ ID NO: 1554108 - RNA, 22 nt, Homo sapiens
cagagacacuaacgacuucagg

SEQ ID NO: 1554109 - RNA, 19 nt, Homo sapiens
cagagugagggaaugguag

SEQ ID NO: 1554110 - RNA, 14 nt, Homo sapiens
cagauaauuggcaa

SEQ ID NO: 1554111 - RNA, 17 nt, Homo sapiens
cagauugacagcauaua

SEQ ID NO: 1554112 - RNA, 19 nt, Homo sapiens
cagcacucacgcaccggag

SEQ ID NO: 1554113 - RNA, 14 nt, Homo sapiens
cagcagugaaugcu

SEQ ID NO: 1554114 - RNA, 15 nt, Homo sapiens
cagccccgccuguca

SEQ ID NO: 1554115 - RNA, 16 nt, Homo sapiens
caggaaggucuucaau

SEQ ID NO: 1554116 - RNA, 15 nt, Homo sapiens
caggacugugccuga

SEQ ID NO: 1554117 - RNA, 17 nt, Homo sapiens
caggacuuggucugauu

SEQ ID NO: 1554118 - RNA, 21 nt, Homo sapiens
caggagaaguuaagaauugag

SEQ ID NO: 1554119 - RNA, 19 nt, Homo sapiens
caggagacuccaaggagcu

SEQ ID NO: 1554120 - RNA, 15 nt, Homo sapiens
caggauacucuguca

SEQ ID NO: 1554121 - RNA, 14 nt, Homo sapiens
caggccacugggga

SEQ ID NO: 1554122 - RNA, 17 nt, Homo sapiens
caggccacuggggacag

SEQ ID NO: 1554123 - RNA, 15 nt, Homo sapiens
cagggcacuacauaa

SEQ ID NO: 1554124 - RNA, 21 nt, Homo sapiens
cagguaggucggcacuuggac

SEQ ID NO: 1554125 - RNA, 20 nt, Homo sapiens
cagguguuacuuacaguccc

SEQ ID NO: 1554126 - RNA, 17 nt, Homo sapiens
cagucuguuaugcacug

SEQ ID NO: 1554127 - RNA, 23 nt, Homo sapiens
cagucuguuaugcacugugguuu

SEQ ID NO: 1554128 - RNA, 13 nt, Homo sapiens
cagugcauaugca

SEQ ID NO: 1554129 - RNA, 22 nt, Homo sapiens
cagugucucgaugccauaauca

SEQ ID NO: 1554130 - RNA, 18 nt, Homo sapiens
caguucuacacugauaca

SEQ ID NO: 1554131 - RNA, 13 nt, Homo sapiens
cauaaccaaagag

SEQ ID NO: 1554132 - RNA, 17 nt, Homo sapiens
cauaagaggugaucucu

SEQ ID NO: 1554133 - RNA, 21 nt, Homo sapiens
cauagagucuuuauguccaua

SEQ ID NO: 1554134 - RNA, 17 nt, Homo sapiens
cauaguuuaaacugcau

SEQ ID NO: 1554135 - RNA, 14 nt, Homo sapiens
caucagaaguuugc

SEQ ID NO: 1554136 - RNA, 16 nt, Homo sapiens
caucagaaguuugcau

SEQ ID NO: 1554137 - RNA, 13 nt, Homo sapiens
caucccuaccacu

SEQ ID NO: 1554138 - RNA, 18 nt, Homo sapiens
caucggaguugacaguga

SEQ ID NO: 1554139 - RNA, 13 nt, Homo sapiens
caucuugugagug

SEQ ID NO: 1554140 - RNA, 17 nt, Homo sapiens
caugaauguaucaggaa

SEQ ID NO: 1554141 - RNA, 13 nt, Homo sapiens
caugacggggaca

SEQ ID NO: 1554142 - RNA, 16 nt, Homo sapiens
caugauacaaauucca

SEQ ID NO: 1554143 - RNA, 15 nt, Homo sapiens
caugcugugugcugg

SEQ ID NO: 1554144 - RNA, 17 nt, Homo sapiens
caugucucaauaguaaa

SEQ ID NO: 1554145 - RNA, 18 nt, Homo sapiens
cauguuacugaccagcaa

SEQ ID NO: 1554146 - RNA, 23 nt, Homo sapiens
cauuaaugagauguuauuacugu

SEQ ID NO: 1554147 - RNA, 21 nt, Homo sapiens
cauugccauagcugacuacaa

SEQ ID NO: 1554148 - RNA, 17 nt, Homo sapiens
cauuguccuguagcuuu

SEQ ID NO: 1554149 - RNA, 17 nt, Homo sapiens
cauuuaacugaacugug

SEQ ID NO: 1554150 - RNA, 20 nt, Homo sapiens
cauuuauucaaaguuaaaag

SEQ ID NO: 1554151 - RNA, 18 nt, Homo sapiens
ccaaaguaacugaauuau

SEQ ID NO: 1554152 - RNA, 18 nt, Homo sapiens
ccaaaguuuucaaacugc

SEQ ID NO: 1554153 - RNA, 19 nt, Homo sapiens
ccaacuguuggauucagaa

SEQ ID NO: 1554154 - RNA, 14 nt, Homo sapiens
ccaagguaggcaga

SEQ ID NO: 1554155 - RNA, 15 nt, Homo sapiens
ccaaguaugccuuaa

SEQ ID NO: 1554156 - RNA, 22 nt, Homo sapiens
ccaauuugguaaaaaugcugcu

SEQ ID NO: 1554157 - RNA, 19 nt, Homo sapiens
ccacaugggugcauuugua

SEQ ID NO: 1554158 - RNA, 11 nt, Homo sapiens
ccacauggugu

SEQ ID NO: 1554159 - RNA, 19 nt, Homo sapiens
ccagacauuuguuucugua

SEQ ID NO: 1554160 - RNA, 18 nt, Homo sapiens
ccagcagggccucaaagu

SEQ ID NO: 1554161 - RNA, 22 nt, Homo sapiens
ccagcauucagcacacacaaac

SEQ ID NO: 1554162 - RNA, 19 nt, Homo sapiens
ccagccuggccaacauggc

SEQ ID NO: 1554163 - RNA, 20 nt, Homo sapiens
ccagccuggccaacauggca

SEQ ID NO: 1554164 - RNA, 21 nt, Homo sapiens
ccaguccccgaggagcugggc

SEQ ID NO: 1554165 - RNA, 19 nt, Homo sapiens
ccauaaauaaaaguacagu

SEQ ID NO: 1554166 - RNA, 23 nt, Homo sapiens
ccauaagaggugaucucugggag

SEQ ID NO: 1554167 - RNA, 17 nt, Homo sapiens
ccauauuugauaguaua

SEQ ID NO: 1554168 - RNA, 19 nt, Homo sapiens
ccauuuuggaaguuuucag

SEQ ID NO: 1554169 - RNA, 14 nt, Homo sapiens
cccaacaugcacug

SEQ ID NO: 1554170 - RNA, 15 nt, Homo sapiens
cccaaguaugccuua

SEQ ID NO: 1554171 - RNA, 18 nt, Homo sapiens
cccagaaugagacaucca

SEQ ID NO: 1554172 - RNA, 16 nt, Homo sapiens
cccagauacaugguga

SEQ ID NO: 1554173 - RNA, 11 nt, Homo sapiens
ccccacuuuga

SEQ ID NO: 1554174 - RNA, 14 nt, Homo sapiens
ccccagcucuggau

SEQ ID NO: 1554175 - RNA, 16 nt, Homo sapiens
ccccaggccuguccac

SEQ ID NO: 1554176 - RNA, 20 nt, Homo sapiens
ccccauuuccccgauguccc

SEQ ID NO: 1554177 - RNA, 17 nt, Homo sapiens
cccccaaauugccuuca

SEQ ID NO: 1554178 - RNA, 22 nt, Homo sapiens
cccgccucuucuucuucagaag

SEQ ID NO: 1554179 - RNA, 14 nt, Homo sapiens
cccgucauguuccu

SEQ ID NO: 1554180 - RNA, 20 nt, Homo sapiens
cccgucauguuccucaaaag

SEQ ID NO: 1554181 - RNA, 16 nt, Homo sapiens
cccucaacugaagggg

SEQ ID NO: 1554182 - RNA, 22 nt, Homo sapiens
cccugaaaaacuaguaauacug

SEQ ID NO: 1554183 - RNA, 15 nt, Homo sapiens
cccuugugccucuca

SEQ ID NO: 1554184 - RNA, 16 nt, Homo sapiens
ccgcagggccaugcag

SEQ ID NO: 1554185 - RNA, 20 nt, Homo sapiens
ccuaacuuuucuacguauaa

SEQ ID NO: 1554186 - RNA, 18 nt, Homo sapiens
ccuaguuuacaagucaga

SEQ ID NO: 1554187 - RNA, 23 nt, Homo sapiens
ccucccuggggaccaggagcuag

SEQ ID NO: 1554188 - RNA, 23 nt, Homo sapiens
ccuccugggcccacaacagcgug

SEQ ID NO: 1554189 - RNA, 19 nt, Homo sapiens
ccucucagaacauacugau

SEQ ID NO: 1554190 - RNA, 16 nt, Homo sapiens
ccugaaaaacuaguaa

SEQ ID NO: 1554191 - RNA, 14 nt, Homo sapiens
ccugaaagauacag

SEQ ID NO: 1554192 - RNA, 14 nt, Homo sapiens
ccugaacuccagag

SEQ ID NO: 1554193 - RNA, 11 nt, Homo sapiens
ccugaggaaug

SEQ ID NO: 1554194 - RNA, 19 nt, Homo sapiens
ccugggaauguauuauucu

SEQ ID NO: 1554195 - RNA, 15 nt, Homo sapiens
ccuguagucccagcu

SEQ ID NO: 1554196 - RNA, 14 nt, Homo sapiens
ccugugaccagcac

SEQ ID NO: 1554197 - RNA, 20 nt, Homo sapiens
ccuguggcggccuuccgggu

SEQ ID NO: 1554198 - RNA, 18 nt, Homo sapiens
ccuugcugggccagggaa

SEQ ID NO: 1554199 - RNA, 21 nt, Homo sapiens
ccuuuuagccuaguucaucca

SEQ ID NO: 1554200 - RNA, 21 nt, Homo sapiens
cgagaucacgucacugcacuc

SEQ ID NO: 1554201 - RNA, 18 nt, Homo sapiens
cgauugagaacugacaaa

SEQ ID NO: 1554202 - RNA, 22 nt, Homo sapiens
cgccccagggcacuacauaauu

SEQ ID NO: 1554203 - RNA, 17 nt, Homo sapiens
cgcuuaucaacuaauga

SEQ ID NO: 1554204 - RNA, 21 nt, Homo sapiens
cggaguucugcccaugggaag

SEQ ID NO: 1554205 - RNA, 15 nt, Homo sapiens
cggaguugacaguga

SEQ ID NO: 1554206 - RNA, 19 nt, Homo sapiens
cggguguguacaccaaggu

SEQ ID NO: 1554207 - RNA, 17 nt, Homo sapiens
cguuaggguuugagaga

SEQ ID NO: 1554208 - RNA, 23 nt, Homo sapiens
cguuggagagcagcaggugcugu

SEQ ID NO: 1554209 - RNA, 22 nt, Homo sapiens
cguuuguccuuuuucacuuuga

SEQ ID NO: 1554210 - RNA, 14 nt, Homo sapiens
cuaaaauucuguca

SEQ ID NO: 1554211 - RNA, 15 nt, Homo sapiens
cuaaaguuacaaaca

SEQ ID NO: 1554212 - RNA, 18 nt, Homo sapiens
cuaaaguuacaaacagac

SEQ ID NO: 1554213 - RNA, 20 nt, Homo sapiens
cuaaaguuacaaacagacca

SEQ ID NO: 1554214 - RNA, 14 nt, Homo sapiens
cuaacauagugucu

SEQ ID NO: 1554215 - RNA, 18 nt, Homo sapiens
cuaaggacaagacacuga

SEQ ID NO: 1554216 - RNA, 22 nt, Homo sapiens
cuaaugauuuagugaucaaauu

SEQ ID NO: 1554217 - RNA, 20 nt, Homo sapiens
cuacacugauacacuugaag

SEQ ID NO: 1554218 - RNA, 21 nt, Homo sapiens
cuacagugucucgaugccaua

SEQ ID NO: 1554219 - RNA, 18 nt, Homo sapiens
cuacucacagcugaagaa

SEQ ID NO: 1554220 - RNA, 20 nt, Homo sapiens
cuacugcucuccuccaccuc

SEQ ID NO: 1554221 - RNA, 20 nt, Homo sapiens
cuauauaguuccuugccuua

SEQ ID NO: 1554222 - RNA, 22 nt, Homo sapiens
cuaugaaaaauguguuccauug

SEQ ID NO: 1554223 - RNA, 20 nt, Homo sapiens
cucaaaugaauuugcuaaau

SEQ ID NO: 1554224 - RNA, 17 nt, Homo sapiens
cucaguucuacacugau

SEQ ID NO: 1554225 - RNA, 17 nt, Homo sapiens
cucaguuucacuuucac

SEQ ID NO: 1554226 - RNA, 15 nt, Homo sapiens
uggcucucagaaggu

SEQ ID NO: 1554227 - RNA, 15 nt, Homo sapiens
uggcugugaaauuca

SEQ ID NO: 1554228 - RNA, 20 nt, Homo sapiens
ugggaagagcguagacaggu

SEQ ID NO: 1554229 - RNA, 20 nt, Homo sapiens
ugggaauguauuauucugca

SEQ ID NO: 1554230 - RNA, 14 nt, Homo sapiens
ugggagaaaaucaa

SEQ ID NO: 1554231 - RNA, 21 nt, Homo sapiens
ugggaguuauaggucauggga

SEQ ID NO: 1554232 - RNA, 21 nt, Homo sapiens
ugggcaacagagcaagacucc

SEQ ID NO: 1554233 - RNA, 14 nt, Homo sapiens
ugggccuccaugcc

SEQ ID NO: 1554234 - RNA, 15 nt, Homo sapiens
ugggccuccaugccc

SEQ ID NO: 1554235 - RNA, 14 nt, Homo sapiens
ugguaaaaagaucc

SEQ ID NO: 1554236 - RNA, 18 nt, Homo sapiens
ugguacuaccccagccau

SEQ ID NO: 1554237 - RNA, 22 nt, Homo sapiens
ugguucaauuucagaaguaaug

SEQ ID NO: 1554238 - RNA, 19 nt, Homo sapiens
uguaaacuacaaaguaaaa

SEQ ID NO: 1554239 - RNA, 21 nt, Homo sapiens
uguaacccccaguucaagacu

SEQ ID NO: 1554240 - RNA, 13 nt, Homo sapiens
uguaacugucagu

SEQ ID NO: 1554241 - RNA, 20 nt, Homo sapiens
uguaagagacaugaauggag

SEQ ID NO: 1554242 - RNA, 18 nt, Homo sapiens
uguaagauuuuccauugu

SEQ ID NO: 1554243 - RNA, 23 nt, Homo sapiens
uguaauuuuaaauaaaagugauc

SEQ ID NO: 1554244 - RNA, 19 nt, Homo sapiens
uguacaauaaguuacuuga

SEQ ID NO: 1554245 - RNA, 19 nt, Homo sapiens
uguacaguguguaaagugu

SEQ ID NO: 1554246 - RNA, 20 nt, Homo sapiens
uguagcuuuaaaaccacagc

SEQ ID NO: 1554247 - RNA, 16 nt, Homo sapiens
uguauaacuaaacuaa

SEQ ID NO: 1554248 - RNA, 18 nt, Homo sapiens
ugucagggguuucuucaa

SEQ ID NO: 1554249 - RNA, 20 nt, Homo sapiens
ugucagggguuucuucaaga

SEQ ID NO: 1554250 - RNA, 23 nt, Homo sapiens
ugucauaggauuaagcaguuuaa

SEQ ID NO: 1554251 - RNA, 13 nt, Homo sapiens
ugucucuaccuaa

SEQ ID NO: 1554252 - RNA, 19 nt, Homo sapiens
ugugguuucagaugugcaa

SEQ ID NO: 1554253 - RNA, 12 nt, Homo sapiens
ugugugugccuc

SEQ ID NO: 1554254 - RNA, 13 nt, Homo sapiens
uguucugugccug

SEQ ID NO: 1554255 - RNA, 21 nt, Homo sapiens
uguuguguuuuuaacauguca

SEQ ID NO: 1554256 - RNA, 20 nt, Homo sapiens
uguuuaaauagccuaaauga

SEQ ID NO: 1554257 - RNA, 22 nt, Homo sapiens
uuaaaagguuaaauauugucau

SEQ ID NO: 1554258 - RNA, 16 nt, Homo sapiens
uuaaaauaaugaacac

SEQ ID NO: 1554259 - RNA, 21 nt, Homo sapiens
uuaaauauccagccaguacag

SEQ ID NO: 1554260 - RNA, 23 nt, Homo sapiens
uuaaaucaacuuuaucauaugcu

SEQ ID NO: 1554261 - RNA, 17 nt, Homo sapiens
uuaagugagcagaacag

SEQ ID NO: 1554262 - RNA, 13 nt, Homo sapiens
uuaauuauugcuu

SEQ ID NO: 1554263 - RNA, 15 nt, Homo sapiens
uuacaaaaugccaag

SEQ ID NO: 1554264 - RNA, 17 nt, Homo sapiens
uuagcucaccuugagau

SEQ ID NO: 1554265 - RNA, 19 nt, Homo sapiens
uuaggaaauacgugauuaa

SEQ ID NO: 1554266 - RNA, 21 nt, Homo sapiens
uuagugaucaaauugugcagu

SEQ ID NO: 1554267 - RNA, 21 nt, Homo sapiens
uuauaaauuuuauaacagaau

SEQ ID NO: 1554268 - RNA, 15 nt, Homo sapiens
uuauagaaguagcaa

SEQ ID NO: 1554269 - RNA, 16 nt, Homo sapiens
uuauagaaguagcaaa

SEQ ID NO: 1554270 - RNA, 20 nt, Homo sapiens
uuaucaccuauccugaagau

SEQ ID NO: 1554271 - RNA, 12 nt, Homo sapiens
uuaucauaugcu

SEQ ID NO: 1554272 - RNA, 21 nt, Homo sapiens
uuauccaccaagaacauaaga

SEQ ID NO: 1554273 - RNA, 22 nt, Homo sapiens
uuaugaccaugguauauuccua

SEQ ID NO: 1554274 - RNA, 13 nt, Homo sapiens
uuauuaacuaaga

SEQ ID NO: 1554275 - RNA, 21 nt, Homo sapiens
uuauuucaggaaggucuucaa

SEQ ID NO: 1554276 - RNA, 19 nt, Homo sapiens
uucagauauauuuuucaca

SEQ ID NO: 1554277 - RNA, 12 nt, Homo sapiens
uucagcacacac

SEQ ID NO: 1554278 - RNA, 15 nt, Homo sapiens
uucagcacacacaaa

SEQ ID NO: 1554279 - RNA, 18 nt, Homo sapiens
uucagggcagggcucuga

SEQ ID NO: 1554280 - RNA, 17 nt, Homo sapiens
uucaugggaaaacagac

SEQ ID NO: 1554281 - RNA, 21 nt, Homo sapiens
uucaugggaaaacagaccugu

SEQ ID NO: 1554282 - RNA, 13 nt, Homo sapiens
uuccagccuucua

SEQ ID NO: 1554283 - RNA, 13 nt, Homo sapiens
uuccauugccaua

SEQ ID NO: 1554284 - RNA, 23 nt, Homo sapiens
uucccaauuaggaaguguaacag

SEQ ID NO: 1554285 - RNA, 21 nt, Homo sapiens
uucuaaaagccauuauuauga

SEQ ID NO: 1554286 - RNA, 13 nt, Homo sapiens
uucugaaacacac

SEQ ID NO: 1554287 - RNA, 15 nt, Homo sapiens
uucuguagcaccaga

SEQ ID NO: 1554288 - RNA, 13 nt, Homo sapiens
uugagaacugaca

SEQ ID NO: 1554289 - RNA, 18 nt, Homo sapiens
uugagugacagcuuucug

SEQ ID NO: 1554290 - RNA, 14 nt, Homo sapiens
uugcauguacuuga

SEQ ID NO: 1554291 - RNA, 20 nt, Homo sapiens
uugccauagcugacuacaaa

SEQ ID NO: 1554292 - RNA, 23 nt, Homo sapiens
uugcuaaaagauuauagaaguag

SEQ ID NO: 1554293 - RNA, 20 nt, Homo sapiens
uugcuccagauucugaugca

SEQ ID NO: 1554294 - RNA, 21 nt, Homo sapiens
uuggagagcagcaggugcugu

SEQ ID NO: 1554295 - RNA, 14 nt, Homo sapiens
uugggcaacagagc

SEQ ID NO: 1554296 - RNA, 18 nt, Homo sapiens
uugguaaaaaugcugcuc

SEQ ID NO: 1554297 - RNA, 15 nt, Homo sapiens
uuguuggaugaaauu

SEQ ID NO: 1554298 - RNA, 17 nt, Homo sapiens
uuuaggcuacagugucu

SEQ ID NO: 1554299 - RNA, 13 nt, Homo sapiens
uuuaucauaugcu

SEQ ID NO: 1554300 - RNA, 21 nt, Homo sapiens
uuucccucucucauacccucc

SEQ ID NO: 1554301 - RNA, 21 nt, Homo sapiens
uuuccuccugcuucaugggaa

SEQ ID NO: 1554302 - RNA, 17 nt, Homo sapiens
uuucuguugccacaacc

SEQ ID NO: 1554303 - RNA, 17 nt, Homo sapiens
uuuggccccacuuugaa

SEQ ID NO: 1554304 - RNA, 22 nt, Homo sapiens
uuuguauauuuguaaacuacaa

SEQ ID NO: 1554305 - RNA, 20 nt, Homo sapiens
uuuguauuuugcauacucaa

SEQ ID NO: 1554306 - RNA, 23 nt, Homo sapiens
uuuguccaccucugauuacaugu

SEQ ID NO: 1554307 - RNA, 15 nt, Homo sapiens
uuuuauuaugcauua

SEQ ID NO: 1554308 - RNA, 17 nt, Homo sapiens
uuuucaguuuuaccucu

SEQ ID NO: 1554309 - RNA, 14 nt, Homo sapiens
uuuuguuugcauca

SEQ ID NO: 1554310 - RNA, 18 nt, Homo sapiens
uaagaguaaaauuccucu

SEQ ID NO: 1554311 - RNA, 19 nt, Homo sapiens
uaagauauucagaaguaua

SEQ ID NO: 1554312 - RNA, 13 nt, Homo sapiens
uaaguuacuugaa

SEQ ID NO: 1554313 - RNA, 22 nt, Homo sapiens
uaauacugucuuaucugcuaua

SEQ ID NO: 1554314 - RNA, 23 nt, Homo sapiens
uaauuuuguuuauauuuucccau

SEQ ID NO: 1554315 - RNA, 18 nt, Homo sapiens
uacagacuucuccagacc

SEQ ID NO: 1554316 - RNA, 21 nt, Homo sapiens
uaccuaaggacaagacacuga

SEQ ID NO: 1554317 - RNA, 16 nt, Homo sapiens
uacuaagugacaguau

SEQ ID NO: 1554318 - RNA, 20 nt, Homo sapiens
uacucaacccauuguuguca

SEQ ID NO: 1554319 - RNA, 13 nt, Homo sapiens
uacugaccagcaa

SEQ ID NO: 1554320 - RNA, 16 nt, Homo sapiens
uacugcucuccuccac

SEQ ID NO: 1554321 - RNA, 17 nt, Homo sapiens
uacuuucuguugccaca

SEQ ID NO: 1554322 - RNA, 15 nt, Homo sapiens
uacuuugugcauucu

SEQ ID NO: 1554323 - RNA, 18 nt, Homo sapiens
uagaauuaucaagcuuuu

SEQ ID NO: 1554324 - RNA, 17 nt, Homo sapiens
uagacagaaaccaagcc

SEQ ID NO: 1554325 - RNA, 17 nt, Homo sapiens
uagcucuaagagcaauu

SEQ ID NO: 1554326 - RNA, 17 nt, Homo sapiens
uagcuuuaaaaccacag

SEQ ID NO: 1554327 - RNA, 18 nt, Homo sapiens
uaggaaaaaaauaguaaa

SEQ ID NO: 1554328 - RNA, 12 nt, Homo sapiens
uaggcagaucac

SEQ ID NO: 1554329 - RNA, 12 nt, Homo sapiens
uaggcucugcac

SEQ ID NO: 1554330 - RNA, 13 nt, Homo sapiens
uaguauacuuugu

SEQ ID NO: 1554331 - RNA, 17 nt, Homo sapiens
uagucccagcuacuccg

SEQ ID NO: 1554332 - RNA, 20 nt, Homo sapiens
uauaaauuuuauaacagaau

SEQ ID NO: 1554333 - RNA, 14 nt, Homo sapiens
uauaacagaauuaa

SEQ ID NO: 1554334 - RNA, 18 nt, Homo sapiens
uauaacuucuguacagua

SEQ ID NO: 1554335 - RNA, 19 nt, Homo sapiens
uauaacuucuguacaguaa

SEQ ID NO: 1554336 - RNA, 15 nt, Homo sapiens
uauaggucacuccug

SEQ ID NO: 1554337 - RNA, 14 nt, Homo sapiens
uauaggucauggga

SEQ ID NO: 1554338 - RNA, 14 nt, Homo sapiens
uauagucacaagag

SEQ ID NO: 1554339 - RNA, 19 nt, Homo sapiens
uauauuuguaaacuacaaa

SEQ ID NO: 1554340 - RNA, 13 nt, Homo sapiens
uaucaagcuuuua

SEQ ID NO: 1554341 - RNA, 22 nt, Homo sapiens
uaucaucggaguugacagugaa

SEQ ID NO: 1554342 - RNA, 16 nt, Homo sapiens
uaucauuccaauucua

SEQ ID NO: 1554343 - RNA, 16 nt, Homo sapiens
uaugauauauugcugu

SEQ ID NO: 1554344 - RNA, 19 nt, Homo sapiens
uaugcaaccaguuuaucca

SEQ ID NO: 1554345 - RNA, 23 nt, Homo sapiens
uaugcauuaagaguaaaauuccu

SEQ ID NO: 1554346 - RNA, 15 nt, Homo sapiens
uaugcauuauaucaa

SEQ ID NO: 1554347 - RNA, 23 nt, Homo sapiens
uauuauuuuucgucucaauggua

SEQ ID NO: 1554348 - RNA, 17 nt, Homo sapiens
uauuucaggaaggucuu

SEQ ID NO: 1554349 - RNA, 15 nt, Homo sapiens
ucaaauugcugcuug

SEQ ID NO: 1554350 - RNA, 16 nt, Homo sapiens
ucaacuccgugcuuaa

SEQ ID NO: 1554351 - RNA, 21 nt, Homo sapiens
ucaacuccgugcuuaaccaaa

SEQ ID NO: 1554352 - RNA, 24 nt, Homo sapiens
ucaacuccgugcuuaaccaaagaa

SEQ ID NO: 1554353 - RNA, 11 nt, Homo sapiens
ucaaguaauaa

SEQ ID NO: 1554354 - RNA, 18 nt, Homo sapiens
ucaaguggagagaaauca

SEQ ID NO: 1554355 - RNA, 14 nt, Homo sapiens
ucaccgacaacaug

SEQ ID NO: 1554356 - RNA, 16 nt, Homo sapiens
ucaccgacaacaugcu

SEQ ID NO: 1554357 - RNA, 16 nt, Homo sapiens
ucaccucugaggacag

SEQ ID NO: 1554358 - RNA, 14 nt, Homo sapiens
ucacgccuacuuaa

SEQ ID NO: 1554359 - RNA, 18 nt, Homo sapiens
ucacucaaaugaauuugc

SEQ ID NO: 1554360 - RNA, 13 nt, Homo sapiens
ucacugcacucca

SEQ ID NO: 1554361 - RNA, 15 nt, Homo sapiens
ucagaaguuugcauc

SEQ ID NO: 1554362 - RNA, 20 nt, Homo sapiens
ucagaauaaauuauugcugu

SEQ ID NO: 1554363 - RNA, 16 nt, Homo sapiens
ucagauaggagugaau

SEQ ID NO: 1554364 - RNA, 20 nt, Homo sapiens
ucagcaacuucuagcauaua

SEQ ID NO: 1554365 - RNA, 13 nt, Homo sapiens
ucagccucccaca

SEQ ID NO: 1554366 - RNA, 21 nt, Homo sapiens
ucaggcagcaccacacugggu

SEQ ID NO: 1554367 - RNA, 20 nt, Homo sapiens
ucauaggauuaagcaguuua

SEQ ID NO: 1554368 - RNA, 15 nt, Homo sapiens
ucaucggaguugaca

SEQ ID NO: 1554369 - RNA, 19 nt, Homo sapiens
ucaucggaguugacaguga

SEQ ID NO: 1554370 - RNA, 14 nt, Homo sapiens
ucauguuccucaaa

SEQ ID NO: 1554371 - RNA, 21 nt, Homo sapiens
ucauuagcaacaacaugcuaa

SEQ ID NO: 1554372 - RNA, 20 nt, Homo sapiens
ucauuuaacugaacugugaa

SEQ ID NO: 1554373 - RNA, 16 nt, Homo sapiens
uccacccagugcugaa

SEQ ID NO: 1554374 - RNA, 17 nt, Homo sapiens
uccagccaguacaguau

SEQ ID NO: 1554375 - RNA, 19 nt, Homo sapiens
uccagccgcugcacaucac

SEQ ID NO: 1554376 - RNA, 19 nt, Homo sapiens
uccagcuugggcaacagag

SEQ ID NO: 1554377 - RNA, 15 nt, Homo sapiens
uccaucucaaaaaag

SEQ ID NO: 1554378 - RNA, 17 nt, Homo sapiens
ucccaaguaugccuuaa

SEQ ID NO: 1554379 - RNA, 16 nt, Homo sapiens
ucccagaaaggucucu

SEQ ID NO: 1554380 - RNA, 16 nt, Homo sapiens
ucccagauacacuaaa

SEQ ID NO: 1554381 - RNA, 21 nt, Homo sapiens
uccccuucccccaucccuacc

SEQ ID NO: 1554382 - RNA, 19 nt, Homo sapiens
ucccugaggaaugaaaaag

SEQ ID NO: 1554383 - RNA, 16 nt, Homo sapiens
uccuuuuucacuuuga

SEQ ID NO: 1554384 - RNA, 17 nt, Homo sapiens
uccuuuuucacuuugaa

SEQ ID NO: 1554385 - RNA, 22 nt, Homo sapiens
ucuaaagguaccaaacaaggaa

SEQ ID NO: 1554386 - RNA, 13 nt, Homo sapiens
ucucaguggagcc

SEQ ID NO: 1554387 - RNA, 13 nt, Homo sapiens
ucucccucucagu

SEQ ID NO: 1554388 - RNA, 17 nt, Homo sapiens
ucucuugauucugggau

SEQ ID NO: 1554389 - RNA, 21 nt, Homo sapiens
ucugcugaaucaaaucucuuc

SEQ ID NO: 1554390 - RNA, 22 nt, Homo sapiens
ucuggagggacaaacucacuca

SEQ ID NO: 1554391 - RNA, 14 nt, Homo sapiens
ucuggaugaaggca

SEQ ID NO: 1554392 - RNA, 12 nt, Homo sapiens
ucugucaggggu

SEQ ID NO: 1554393 - RNA, 12 nt, Homo sapiens
ucuucuggucug

SEQ ID NO: 1554394 - RNA, 17 nt, Homo sapiens
ucuugaauagacuucca

SEQ ID NO: 1554395 - RNA, 17 nt, Homo sapiens
ucuuucccaaucuucuu

SEQ ID NO: 1554396 - RNA, 13 nt, Homo sapiens
ucuuugugugaca

SEQ ID NO: 1554397 - RNA, 18 nt, Homo sapiens
ugaaacaaauuuacauca

SEQ ID NO: 1554398 - RNA, 11 nt, Homo sapiens
ugaacugugaa

SEQ ID NO: 1554399 - RNA, 16 nt, Homo sapiens
ugaauauuccuggacu

SEQ ID NO: 1554400 - RNA, 13 nt, Homo sapiens
ugacagcauauag

SEQ ID NO: 1554401 - RNA, 17 nt, Homo sapiens
ugacagugccugggaau

SEQ ID NO: 1554402 - RNA, 13 nt, Homo sapiens
ugacccacacugc

SEQ ID NO: 1554403 - RNA, 13 nt, Homo sapiens
ugaccucugugac

SEQ ID NO: 1554404 - RNA, 14 nt, Homo sapiens
ugagagaagggaau

SEQ ID NO: 1554405 - RNA, 20 nt, Homo sapiens
ugagccuugcauguacuuga

SEQ ID NO: 1554406 - RNA, 15 nt, Homo sapiens
ugaggaccacuccug

SEQ ID NO: 1554407 - RNA, 13 nt, Homo sapiens
ugaucucugggag

SEQ ID NO: 1554408 - RNA, 21 nt, Homo sapiens
ugcaaaggcgcagugcuucuc

SEQ ID NO: 1554409 - RNA, 15 nt, Homo sapiens
ugcacaucacaacau

SEQ ID NO: 1554410 - RNA, 14 nt, Homo sapiens
ugcacccaccuguu

SEQ ID NO: 1554411 - RNA, 14 nt, Homo sapiens
ugcauuauaucaaa

SEQ ID NO: 1554412 - RNA, 19 nt, Homo sapiens
ugcauuuucccagauacuu

SEQ ID NO: 1554413 - RNA, 20 nt, Homo sapiens
ugccaaacacauuuacccuu

SEQ ID NO: 1554414 - RNA, 13 nt, Homo sapiens
ugccaagacuccu

SEQ ID NO: 1554415 - RNA, 21 nt, Homo sapiens
ugccaagggggugacuggaag

SEQ ID NO: 1554416 - RNA, 18 nt, Homo sapiens
ugccauagcugacuacaa

SEQ ID NO: 1554417 - RNA, 15 nt, Homo sapiens
ugccaugcucagaaa

SEQ ID NO: 1554418 - RNA, 22 nt, Homo sapiens
ugccucccccgccuccagucau

SEQ ID NO: 1554419 - RNA, 23 nt, Homo sapiens
ugccuccucccugggcagaaagu

SEQ ID NO: 1554420 - RNA, 18 nt, Homo sapiens
ugccuugcuaaaagauua

SEQ ID NO: 1554421 - RNA, 17 nt, Homo sapiens
ugcgaccgugaccagga

SEQ ID NO: 1554422 - RNA, 18 nt, Homo sapiens
ugcuauaaacuuuacaua

SEQ ID NO: 1554423 - RNA, 14 nt, Homo sapiens
ugcucugaccaagc

SEQ ID NO: 1554424 - RNA, 22 nt, Homo sapiens
ugcugcauacuuugacaaggaa

SEQ ID NO: 1554425 - RNA, 14 nt, Homo sapiens
ugcuuucagcacuc

SEQ ID NO: 1554426 - RNA, 21 nt, Homo sapiens
ugcuuuuaaaugaccaaagau

SEQ ID NO: 1554427 - RNA, 14 nt, Homo sapiens
uggaaacaggacca

SEQ ID NO: 1554428 - RNA, 13 nt, Homo sapiens
uggacuuacaaaa

SEQ ID NO: 1554429 - RNA, 15 nt, Homo sapiens
uggauucgugacaac

SEQ ID NO: 1554430 - RNA, 13 nt, Homo sapiens
uggccaugcagaa

SEQ ID NO: 1554431 - RNA, 22 nt, Homo sapiens
uggcggcugugcaucaguggga

SEQ ID NO: 1554432 - RNA, 15 nt, Homo sapiens
gcaaaaugcuuacag

SEQ ID NO: 1554433 - RNA, 15 nt, Homo sapiens
gcaacagagcaagac

SEQ ID NO: 1554434 - RNA, 21 nt, Homo sapiens
gcaacagagcaagacuccauc

SEQ ID NO: 1554435 - RNA, 23 nt, Homo sapiens
gcaacugggucugacaugaacac

SEQ ID NO: 1554436 - RNA, 12 nt, Homo sapiens
gcacagccaccc

SEQ ID NO: 1554437 - RNA, 10 nt, Homo sapiens
gcacauguac

SEQ ID NO: 1554438 - RNA, 18 nt, Homo sapiens
gcagacugaaccagucca

SEQ ID NO: 1554439 - RNA, 20 nt, Homo sapiens
gcagauuuccagccuucuac

SEQ ID NO: 1554440 - RNA, 13 nt, Homo sapiens
gcagggcucugau

SEQ ID NO: 1554441 - RNA, 20 nt, Homo sapiens
gcaguaccaaaguaacugaa

SEQ ID NO: 1554442 - RNA, 20 nt, Homo sapiens
gcagugaaugcuagacagaa

SEQ ID NO: 1554443 - RNA, 15 nt, Homo sapiens
gcauucagcacacac

SEQ ID NO: 1554444 - RNA, 20 nt, Homo sapiens
gccaaaguuuucaaacugcu

SEQ ID NO: 1554445 - RNA, 12 nt, Homo sapiens
gccaagacuccu

SEQ ID NO: 1554446 - RNA, 15 nt, Homo sapiens
gccagggcagaggaa

SEQ ID NO: 1554447 - RNA, 14 nt, Homo sapiens
gccauaagagguga

SEQ ID NO: 1554448 - RNA, 21 nt, Homo sapiens
gccaugcaacgggauugaagg

SEQ ID NO: 1554449 - RNA, 22 nt, Homo sapiens
gccaugcagaccucaugcccag

SEQ ID NO: 1554450 - RNA, 14 nt, Homo sapiens
gccaugggguccau

SEQ ID NO: 1554451 - RNA, 12 nt, Homo sapiens
gccccacuuuga

SEQ ID NO: 1554452 - RNA, 17 nt, Homo sapiens
gcccccaccccucgggg

SEQ ID NO: 1554453 - RNA, 20 nt, Homo sapiens
gcccccagauacauggugau

SEQ ID NO: 1554454 - RNA, 12 nt, Homo sapiens
gccuccaugccc

SEQ ID NO: 1554455 - RNA, 15 nt, Homo sapiens
gccugcuuugcuuua

SEQ ID NO: 1554456 - RNA, 19 nt, Homo sapiens
gccuggauuccagcaguga

SEQ ID NO: 1554457 - RNA, 13 nt, Homo sapiens
gccuguaauccca

SEQ ID NO: 1554458 - RNA, 21 nt, Homo sapiens
gccuuaaguggcagaauauaa

SEQ ID NO: 1554459 - RNA, 17 nt, Homo sapiens
gccuugcauguacuuga

SEQ ID NO: 1554460 - RNA, 16 nt, Homo sapiens
gcuaaaauuaguuuua

SEQ ID NO: 1554461 - RNA, 16 nt, Homo sapiens
gcuagacagaaaccaa

SEQ ID NO: 1554462 - RNA, 12 nt, Homo sapiens
gcucacuucuaa

SEQ ID NO: 1554463 - RNA, 18 nt, Homo sapiens
gcuccugaauaucaguca

SEQ ID NO: 1554464 - RNA, 19 nt, Homo sapiens
gcucucagaagguauuccu

SEQ ID NO: 1554465 - RNA, 20 nt, Homo sapiens
gcugaauuucccucucucau

SEQ ID NO: 1554466 - RNA, 17 nt, Homo sapiens
gcugaggcccagugcau

SEQ ID NO: 1554467 - RNA, 21 nt, Homo sapiens
gcugcacaucacaacauuuac

SEQ ID NO: 1554468 - RNA, 19 nt, Homo sapiens
gcugccucccuggggacca

SEQ ID NO: 1554469 - RNA, 17 nt, Homo sapiens
gcugugcaucaguggga

SEQ ID NO: 1554470 - RNA, 14 nt, Homo sapiens
gcuguucugcugaa

SEQ ID NO: 1554471 - RNA, 14 nt, Homo sapiens
gcuuuaaaaccaca

SEQ ID NO: 1554472 - RNA, 16 nt, Homo sapiens
gcuuuuaaaugaccaa

SEQ ID NO: 1554473 - RNA, 16 nt, Homo sapiens
ggaaaauggccaugca

SEQ ID NO: 1554474 - RNA, 23 nt, Homo sapiens
ggaaacagaagcuuuuuguuugc

SEQ ID NO: 1554475 - RNA, 13 nt, Homo sapiens
ggaaggucuucaa

SEQ ID NO: 1554476 - RNA, 15 nt, Homo sapiens
ggaaguguaacagcu

SEQ ID NO: 1554477 - RNA, 14 nt, Homo sapiens
ggaaugcaccuccc

SEQ ID NO: 1554478 - RNA, 23 nt, Homo sapiens
ggagaaaauuggaacucuacuca

SEQ ID NO: 1554479 - RNA, 20 nt, Homo sapiens
ggagacuccuggucugugaa

SEQ ID NO: 1554480 - RNA, 14 nt, Homo sapiens
ggaggggugguccu

SEQ ID NO: 1554481 - RNA, 21 nt, Homo sapiens
ggauguuaugaacagcugugu

SEQ ID NO: 1554482 - RNA, 17 nt, Homo sapiens
ggauuugccugugccac

SEQ ID NO: 1554483 - RNA, 20 nt, Homo sapiens
ggcaacagagcaagacucca

SEQ ID NO: 1554484 - RNA, 18 nt, Homo sapiens
ggcagggugagaagcuag

SEQ ID NO: 1554485 - RNA, 22 nt, Homo sapiens
ggccagggugggaagagaagaa

SEQ ID NO: 1554486 - RNA, 17 nt, Homo sapiens
ggcccagugcauaugca

SEQ ID NO: 1554487 - RNA, 17 nt, Homo sapiens
ggcccugacuucuggag

SEQ ID NO: 1554488 - RNA, 20 nt, Homo sapiens
ggcuagaaaacaagcguuua

SEQ ID NO: 1554489 - RNA, 21 nt, Homo sapiens
ggcucaggguuggccauuugc

SEQ ID NO: 1554490 - RNA, 22 nt, Homo sapiens
gggcaccacccgcuuucuugcu

SEQ ID NO: 1554491 - RNA, 11 nt, Homo sapiens
gggcaucuccu

SEQ ID NO: 1554492 - RNA, 24 nt, Homo sapiens
gggccaugcagaccucaugcccag

SEQ ID NO: 1554493 - RNA, 16 nt, Homo sapiens
ggugacauuguggacu

SEQ ID NO: 1554494 - RNA, 15 nt, Homo sapiens
gguguuugucugugu

SEQ ID NO: 1554495 - RNA, 21 nt, Homo sapiens
gguucaauuucagaaguaaug

SEQ ID NO: 1554496 - RNA, 19 nt, Homo sapiens
gguuuauucccaaguaugc

SEQ ID NO: 1554497 - RNA, 21 nt, Homo sapiens
gguuuccaagucccgggucuc

SEQ ID NO: 1554498 - RNA, 15 nt, Homo sapiens
guaaaaaugcugcuc

SEQ ID NO: 1554499 - RNA, 18 nt, Homo sapiens
guaaaaaugcugcucuca

SEQ ID NO: 1554500 - RNA, 15 nt, Homo sapiens
guaaaacauaaugua

SEQ ID NO: 1554501 - RNA, 20 nt, Homo sapiens
guaaagccuuaaguggcaga

SEQ ID NO: 1554502 - RNA, 14 nt, Homo sapiens
guaaguguucucau

SEQ ID NO: 1554503 - RNA, 18 nt, Homo sapiens
guaauuaaaggaacagag

SEQ ID NO: 1554504 - RNA, 19 nt, Homo sapiens
guacaaugguuuauuccca

SEQ ID NO: 1554505 - RNA, 20 nt, Homo sapiens
guacaguauguuuuacaugu

SEQ ID NO: 1554506 - RNA, 18 nt, Homo sapiens
guagauuuuaaaagauaa

SEQ ID NO: 1554507 - RNA, 16 nt, Homo sapiens
guaguuacagaauucc

SEQ ID NO: 1554508 - RNA, 13 nt, Homo sapiens
guauaaacacucu

SEQ ID NO: 1554509 - RNA, 13 nt, Homo sapiens
guauagugucuau

SEQ ID NO: 1554510 - RNA, 18 nt, Homo sapiens
guauugaaauguuugcau

SEQ ID NO: 1554511 - RNA, 22 nt, Homo sapiens
gucaaguucccaacugagucau

SEQ ID NO: 1554512 - RNA, 17 nt, Homo sapiens
gucagggguuucuucaa

SEQ ID NO: 1554513 - RNA, 20 nt, Homo sapiens
gucaucuccaucagcuguaa

SEQ ID NO: 1554514 - RNA, 16 nt, Homo sapiens
gucccggguguguaca

SEQ ID NO: 1554515 - RNA, 18 nt, Homo sapiens
guccuuuuucacuuugaa

SEQ ID NO: 1554516 - RNA, 14 nt, Homo sapiens
gucgggacaugguu

SEQ ID NO: 1554517 - RNA, 15 nt, Homo sapiens
gucuauuuuguauau

SEQ ID NO: 1554518 - RNA, 15 nt, Homo sapiens
gucucgcagccugaa

SEQ ID NO: 1554519 - RNA, 20 nt, Homo sapiens
gucuuaucugcuauaaacuu

SEQ ID NO: 1554520 - RNA, 18 nt, Homo sapiens
gugacagcuuucugggau

SEQ ID NO: 1554521 - RNA, 14 nt, Homo sapiens
gugacagugccugg

SEQ ID NO: 1554522 - RNA, 22 nt, Homo sapiens
gugaccaacuguuggauucaga

SEQ ID NO: 1554523 - RNA, 11 nt, Homo sapiens
gugaccagcac

SEQ ID NO: 1554524 - RNA, 18 nt, Homo sapiens
gugaguaagagcuggugu

SEQ ID NO: 1554525 - RNA, 15 nt, Homo sapiens
gugcuggagacacuc

SEQ ID NO: 1554526 - RNA, 13 nt, Homo sapiens
gugcuuaaccaaa

SEQ ID NO: 1554527 - RNA, 12 nt, Homo sapiens
gugggcugugag

SEQ ID NO: 1554528 - RNA, 16 nt, Homo sapiens
gugguacuacuguaag

SEQ ID NO: 1554529 - RNA, 13 nt, Homo sapiens
guuaaugaaauaa

SEQ ID NO: 1554530 - RNA, 12 nt, Homo sapiens
guucagcagaac

SEQ ID NO: 1554531 - RNA, 13 nt, Homo sapiens
guucgcuuaucaa

SEQ ID NO: 1554532 - RNA, 18 nt, Homo sapiens
guugccugacuccugggu

SEQ ID NO: 1554533 - RNA, 17 nt, Homo sapiens
guuuguauuuugcauac

SEQ ID NO: 1554534 - RNA, 22 nt, Homo sapiens
guuuguccuuuuucacuuugaa

SEQ ID NO: 1554535 - RNA, 17 nt, Homo sapiens
guuuuaaaauacuauau

SEQ ID NO: 1554536 - RNA, 22 nt, Homo sapiens
uaaaaacuuccuucaaucuuca

SEQ ID NO: 1554537 - RNA, 19 nt, Homo sapiens
uaaaaaugcugcucucagc

SEQ ID NO: 1554538 - RNA, 19 nt, Homo sapiens
uaaaacauugaaugaaacu

SEQ ID NO: 1554539 - RNA, 13 nt, Homo sapiens
uaaaaguacaguu

SEQ ID NO: 1554540 - RNA, 22 nt, Homo sapiens
uaaaaguuuuuuauuaugcauu

SEQ ID NO: 1554541 - RNA, 23 nt, Homo sapiens
uaaaaguuuuuuauuaugcauua

SEQ ID NO: 1554542 - RNA, 23 nt, Homo sapiens
uaaaauacuauauuaaauucuga

SEQ ID NO: 1554543 - RNA, 20 nt, Homo sapiens
uaaaauuccucuuacuguaa

SEQ ID NO: 1554544 - RNA, 16 nt, Homo sapiens
uaaaauugaguucuca

SEQ ID NO: 1554545 - RNA, 13 nt, Homo sapiens
uaaaccaguuuaa

SEQ ID NO: 1554546 - RNA, 20 nt, Homo sapiens
uaaagcccaaccuccugacc

SEQ ID NO: 1554547 - RNA, 22 nt, Homo sapiens
uaaauaaaaauaaaaauucaua

SEQ ID NO: 1554548 - RNA, 14 nt, Homo sapiens
uaaaugaccaaaga

SEQ ID NO: 1554549 - RNA, 15 nt, Homo sapiens
uaacagaacagucac

SEQ ID NO: 1554550 - RNA, 21 nt, Homo sapiens
uaacccccaguucaagacuua

SEQ ID NO: 1554551 - RNA, 21 nt, Homo sapiens
uaacuguugcuggcagucuaa

SEQ ID NO: 1554552 - RNA, 15 nt, Homo sapiens
uaagagcaauucugg

SEQ ID NO: 1554553 - RNA, 20 nt, Homo sapiens
cucaugccuguaaucccagc

SEQ ID NO: 1554554 - RNA, 14 nt, Homo sapiens
cuccagauucugau

SEQ ID NO: 1554555 - RNA, 16 nt, Homo sapiens
cucccucucaguggag

SEQ ID NO: 1554556 - RNA, 15 nt, Homo sapiens
cucccuggggaccag

SEQ ID NO: 1554557 - RNA, 14 nt, Homo sapiens
cuccuguacacuga

SEQ ID NO: 1554558 - RNA, 14 nt, Homo sapiens
cucgcagccugaag

SEQ ID NO: 1554559 - RNA, 15 nt, Homo sapiens
cucucucauacccuc

SEQ ID NO: 1554560 - RNA, 20 nt, Homo sapiens
cucuggaugaaggcaaaaac

SEQ ID NO: 1554561 - RNA, 14 nt, Homo sapiens
cucuuuccuccugc

SEQ ID NO: 1554562 - RNA, 20 nt, Homo sapiens
cucuuucucccagcuucaaa

SEQ ID NO: 1554563 - RNA, 18 nt, Homo sapiens
cugaauuucccucucuca

SEQ ID NO: 1554564 - RNA, 18 nt, Homo sapiens
cugaggagauacugaaca

SEQ ID NO: 1554565 - RNA, 17 nt, Homo sapiens
cugaggcccagugcaua

SEQ ID NO: 1554566 - RNA, 21 nt, Homo sapiens
cugaggcccagugcauaugca

SEQ ID NO: 1554567 - RNA, 16 nt, Homo sapiens
cugaggucucuugagg

SEQ ID NO: 1554568 - RNA, 19 nt, Homo sapiens
cugcaaaggcgcagugcuu

SEQ ID NO: 1554569 - RNA, 21 nt, Homo sapiens
cugcacagauggauuugccug

SEQ ID NO: 1554570 - RNA, 14 nt, Homo sapiens
cugcaggaaauaua

SEQ ID NO: 1554571 - RNA, 16 nt, Homo sapiens
cugcauggagaagggu

SEQ ID NO: 1554572 - RNA, 15 nt, Homo sapiens
cugccaagacuccuc

SEQ ID NO: 1554573 - RNA, 13 nt, Homo sapiens
cugcuucauggga

SEQ ID NO: 1554574 - RNA, 22 nt, Homo sapiens
cugcuuggcaauaguuaaguca

SEQ ID NO: 1554575 - RNA, 19 nt, Homo sapiens
cugcuuuuaaaugaccaaa

SEQ ID NO: 1554576 - RNA, 15 nt, Homo sapiens
cuggauucgugacaa

SEQ ID NO: 1554577 - RNA, 18 nt, Homo sapiens
cugggaacaugacccagc

SEQ ID NO: 1554578 - RNA, 22 nt, Homo sapiens
cugggugggugggguacaggca

SEQ ID NO: 1554579 - RNA, 22 nt, Homo sapiens
cuggucugugaagagccggugg

SEQ ID NO: 1554580 - RNA, 16 nt, Homo sapiens
cuguaagagacaugaa

SEQ ID NO: 1554581 - RNA, 20 nt, Homo sapiens
cuguacaaaauaacucucca

SEQ ID NO: 1554582 - RNA, 20 nt, Homo sapiens
cuguccacauguggggacag

SEQ ID NO: 1554583 - RNA, 16 nt, Homo sapiens
cugugcaucaguggga

SEQ ID NO: 1554584 - RNA, 15 nt, Homo sapiens
cuguguggacuguga

SEQ ID NO: 1554585 - RNA, 19 nt, Homo sapiens
cuguuacugaaauugguau

SEQ ID NO: 1554586 - RNA, 22 nt, Homo sapiens
cuguucgucacucaaaugaauu

SEQ ID NO: 1554587 - RNA, 15 nt, Homo sapiens
cuguuuaacauuucc

SEQ ID NO: 1554588 - RNA, 19 nt, Homo sapiens
cuguuuaacauuuccucag

SEQ ID NO: 1554589 - RNA, 18 nt, Homo sapiens
cuguuuucugaaacacac

SEQ ID NO: 1554590 - RNA, 15 nt, Homo sapiens
cuuaagagugcugug

SEQ ID NO: 1554591 - RNA, 15 nt, Homo sapiens
cuuaucaacuaauga

SEQ ID NO: 1554592 - RNA, 21 nt, Homo sapiens
cuucaaaugcaaauucaucau

SEQ ID NO: 1554593 - RNA, 21 nt, Homo sapiens
cuucaaucuucauuuuggagg

SEQ ID NO: 1554594 - RNA, 19 nt, Homo sapiens
cuucgaggcuuuacagugu

SEQ ID NO: 1554595 - RNA, 15 nt, Homo sapiens
cuucuagaaucucgu

SEQ ID NO: 1554596 - RNA, 22 nt, Homo sapiens
cuugaaggauggaugagucaga

SEQ ID NO: 1554597 - RNA, 23 nt, Homo sapiens
cuugaaggauggaugagucagac

SEQ ID NO: 1554598 - RNA, 15 nt, Homo sapiens
cuugauaauacuuga

SEQ ID NO: 1554599 - RNA, 16 nt, Homo sapiens
cuugauaauacuugac

SEQ ID NO: 1554600 - RNA, 14 nt, Homo sapiens
cuuggcugacauga

SEQ ID NO: 1554601 - RNA, 22 nt, Homo sapiens
cuugguggcagaaugaaaauca

SEQ ID NO: 1554602 - RNA, 18 nt, Homo sapiens
cuugugugugggcuguga

SEQ ID NO: 1554603 - RNA, 19 nt, Homo sapiens
cuugugugugggcugugag

SEQ ID NO: 1554604 - RNA, 15 nt, Homo sapiens
cuuguuaguaaugcu

SEQ ID NO: 1554605 - RNA, 14 nt, Homo sapiens
cuuuaucauaugcu

SEQ ID NO: 1554606 - RNA, 14 nt, Homo sapiens
cuuuaucaucggag

SEQ ID NO: 1554607 - RNA, 20 nt, Homo sapiens
cuuuggaaacaggaccacaa

SEQ ID NO: 1554608 - RNA, 22 nt, Homo sapiens
cuuuuaaaaacuagagcacaga

SEQ ID NO: 1554609 - RNA, 15 nt, Homo sapiens
cuuuuucacuuugaa

SEQ ID NO: 1554610 - RNA, 14 nt, Homo sapiens
cuuuuuguuugcau

SEQ ID NO: 1554611 - RNA, 19 nt, Homo sapiens
gaaaaaauuagcugggcau

SEQ ID NO: 1554612 - RNA, 19 nt, Homo sapiens
gaaaaaugaggaauccaaa

SEQ ID NO: 1554613 - RNA, 16 nt, Homo sapiens
gaaaacaguggugauu

SEQ ID NO: 1554614 - RNA, 16 nt, Homo sapiens
gaaaacugauucucua

SEQ ID NO: 1554615 - RNA, 14 nt, Homo sapiens
gaaaauaaacugac

SEQ ID NO: 1554616 - RNA, 18 nt, Homo sapiens
gaaacaccccucugucua

SEQ ID NO: 1554617 - RNA, 21 nt, Homo sapiens
gaaacaccccucugucuagga

SEQ ID NO: 1554618 - RNA, 11 nt, Homo sapiens
gaaagcacuac

SEQ ID NO: 1554619 - RNA, 23 nt, Homo sapiens
gaaaguggccaugccacccuguu

SEQ ID NO: 1554620 - RNA, 22 nt, Homo sapiens
gaaauauauauguguguguaug

SEQ ID NO: 1554621 - RNA, 19 nt, Homo sapiens
gaacagcugugucugccaa

SEQ ID NO: 1554622 - RNA, 19 nt, Homo sapiens
gaagaaaucuuucucccuc

SEQ ID NO: 1554623 - RNA, 15 nt, Homo sapiens
gaagacacugcaaag

SEQ ID NO: 1554624 - RNA, 16 nt, Homo sapiens
gaagacucaguaugcu

SEQ ID NO: 1554625 - RNA, 23 nt, Homo sapiens
gaagagcccgcagggccaugcag

SEQ ID NO: 1554626 - RNA, 22 nt, Homo sapiens
gaagauuuguccaccucugauu

SEQ ID NO: 1554627 - RNA, 18 nt, Homo sapiens
gaagcuuuuuguuugcau

SEQ ID NO: 1554628 - RNA, 20 nt, Homo sapiens
gaagcuuuuuguuugcauca

SEQ ID NO: 1554629 - RNA, 13 nt, Homo sapiens
gaagggaauuugg

SEQ ID NO: 1554630 - RNA, 14 nt, Homo sapiens
gaauaucagucacu

SEQ ID NO: 1554631 - RNA, 21 nt, Homo sapiens
gaaucuauccauugaacuaaa

SEQ ID NO: 1554632 - RNA, 13 nt, Homo sapiens
gaaugaaacugau

SEQ ID NO: 1554633 - RNA, 24 nt, Homo sapiens
gaaugcacacuagccucuccagga

SEQ ID NO: 1554634 - RNA, 20 nt, Homo sapiens
gaauuuuugcuaugcuguaa

SEQ ID NO: 1554635 - RNA, 15 nt, Homo sapiens
gacacugcaaaggcg

SEQ ID NO: 1554636 - RNA, 17 nt, Homo sapiens
gacagaaaccaagccau

SEQ ID NO: 1554637 - RNA, 13 nt, Homo sapiens
gacaugaauggag

SEQ ID NO: 1554638 - RNA, 13 nt, Homo sapiens
gaccaccaccagg

SEQ ID NO: 1554639 - RNA, 12 nt, Homo sapiens
gaccacuccugu

SEQ ID NO: 1554640 - RNA, 13 nt, Homo sapiens
gacccagccugaa

SEQ ID NO: 1554641 - RNA, 16 nt, Homo sapiens
gacccuguccggccca

SEQ ID NO: 1554642 - RNA, 22 nt, Homo sapiens
gaccugugaccagcacugucuc

SEQ ID NO: 1554643 - RNA, 19 nt, Homo sapiens
gacuacaacaugcaucaug

SEQ ID NO: 1554644 - RNA, 20 nt, Homo sapiens
gacuacauuugugaacaaaa

SEQ ID NO: 1554645 - RNA, 16 nt, Homo sapiens
gacuccuggucuguga

SEQ ID NO: 1554646 - RNA, 14 nt, Homo sapiens
gacugaaccagucc

SEQ ID NO: 1554647 - RNA, 21 nt, Homo sapiens
gacuggauggaaacuuccugc

SEQ ID NO: 1554648 - RNA, 17 nt, Homo sapiens
gacuggauucgugacaa

SEQ ID NO: 1554649 - RNA, 15 nt, Homo sapiens
gacuuacaaaaugcc

SEQ ID NO: 1554650 - RNA, 14 nt, Homo sapiens
gacuuccacuuugu

SEQ ID NO: 1554651 - RNA, 15 nt, Homo sapiens
gacuuggagacuccu

SEQ ID NO: 1554652 - RNA, 19 nt, Homo sapiens
gagaaaugaauaauuuccc

SEQ ID NO: 1554653 - RNA, 22 nt, Homo sapiens
gagaccaaaauuuaaguuaacu

SEQ ID NO: 1554654 - RNA, 20 nt, Homo sapiens
gagaucacgucacugcacuc

SEQ ID NO: 1554655 - RNA, 13 nt, Homo sapiens
gagcagaacaggu

SEQ ID NO: 1554656 - RNA, 20 nt, Homo sapiens
gaggcggagguugcaaugag

SEQ ID NO: 1554657 - RNA, 15 nt, Homo sapiens
gagggugcaguccag

SEQ ID NO: 1554658 - RNA, 16 nt, Homo sapiens
gaggucucuugaggga

SEQ ID NO: 1554659 - RNA, 15 nt, Homo sapiens
gaggugucgggacau

SEQ ID NO: 1554660 - RNA, 21 nt, Homo sapiens
gagugggcugggcccucuguc

SEQ ID NO: 1554661 - RNA, 22 nt, Homo sapiens
gauaauacuugaccucugugac

SEQ ID NO: 1554662 - RNA, 18 nt, Homo sapiens
gauacacuugaaggacca

SEQ ID NO: 1554663 - RNA, 13 nt, Homo sapiens
gauagacuuggga

SEQ ID NO: 1554664 - RNA, 14 nt, Homo sapiens
gauagcuacagugu

SEQ ID NO: 1554665 - RNA, 17 nt, Homo sapiens
gauaugacccacacugc

SEQ ID NO: 1554666 - RNA, 22 nt, Homo sapiens
gaucaaauugugcaguacuuug

SEQ ID NO: 1554667 - RNA, 18 nt, Homo sapiens
gaucagccccgccuguca

SEQ ID NO: 1554668 - RNA, 20 nt, Homo sapiens
gauggcauuuggucucaggc

SEQ ID NO: 1554669 - RNA, 22 nt, Homo sapiens
gauuaagauauucagaaguaua

SEQ ID NO: 1554670 - RNA, 14 nt, Homo sapiens
gauuauaaacugac

SEQ ID NO: 1554671 - RNA, 20 nt, Homo sapiens
gauucgugacaacaugcgac

SEQ ID NO: 1554672 - RNA, 22 nt, Homo sapiens
gauuucaggauacucugucaga

SEQ ID NO: 1554673 - RNA, 11 nt, Homo sapiens
aagugugagua

SEQ ID NO: 1554674 - RNA, 21 nt, Homo sapiens
aaguugaggagguuucugcau

SEQ ID NO: 1554675 - RNA, 13 nt, Homo sapiens
aaguuuucaggac

SEQ ID NO: 1554676 - RNA, 22 nt, Homo sapiens
aauaaaaauucauaaccaaaga

SEQ ID NO: 1554677 - RNA, 19 nt, Homo sapiens
aauacuugaccucugugac

SEQ ID NO: 1554678 - RNA, 23 nt, Homo sapiens
aauaguaaaagauaacaagaucu

SEQ ID NO: 1554679 - RNA, 12 nt, Homo sapiens
aauaucagucac

SEQ ID NO: 1554680 - RNA, 12 nt, Homo sapiens
aauauccaagac

SEQ ID NO: 1554681 - RNA, 22 nt, Homo sapiens
aaucaaaucucuuccacauggg

SEQ ID NO: 1554682 - RNA, 19 nt, Homo sapiens
aauccauccaaaguucccu

SEQ ID NO: 1554683 - RNA, 15 nt, Homo sapiens
aaucuaccacuguau

SEQ ID NO: 1554684 - RNA, 13 nt, Homo sapiens
aaugaccaaagau

SEQ ID NO: 1554685 - RNA, 18 nt, Homo sapiens
aauggacaauggacugua

SEQ ID NO: 1554686 - RNA, 22 nt, Homo sapiens
aauggggggcgggccagggugg

SEQ ID NO: 1554687 - RNA, 17 nt, Homo sapiens
aauguauuugugcacau

SEQ ID NO: 1554688 - RNA, 14 nt, Homo sapiens
aauguuugcauaaa

SEQ ID NO: 1554689 - RNA, 14 nt, Homo sapiens
aauuaagacuuuau

SEQ ID NO: 1554690 - RNA, 17 nt, Homo sapiens
aauucauaaccaaagag

SEQ ID NO: 1554691 - RNA, 20 nt, Homo sapiens
aauucaucauugggcucacu

SEQ ID NO: 1554692 - RNA, 13 nt, Homo sapiens
aauucccuugaau

SEQ ID NO: 1554693 - RNA, 14 nt, Homo sapiens
aauucugggagaau

SEQ ID NO: 1554694 - RNA, 21 nt, Homo sapiens
aauugauucuuagacauugca

SEQ ID NO: 1554695 - RNA, 18 nt, Homo sapiens
aauuguucuugggagaaa

SEQ ID NO: 1554696 - RNA, 23 nt, Homo sapiens
aauuugcuaaauacaacacugau

SEQ ID NO: 1554697 - RNA, 20 nt, Homo sapiens
aauuugguaaaaaugcugcu

SEQ ID NO: 1554698 - RNA, 12 nt, Homo sapiens
acaaaaugccaa

SEQ ID NO: 1554699 - RNA, 17 nt, Homo sapiens
acaaaggagccuugaua

SEQ ID NO: 1554700 - RNA, 23 nt, Homo sapiens
acaaaggagccuugauaauacuu

SEQ ID NO: 1554701 - RNA, 14 nt, Homo sapiens
acaacauuuacuua

SEQ ID NO: 1554702 - RNA, 19 nt, Homo sapiens
acaacauuuacuuaacaga

SEQ ID NO: 1554703 - RNA, 19 nt, Homo sapiens
acaauggacuguacaauaa

SEQ ID NO: 1554704 - RNA, 21 nt, Homo sapiens
acacacaaaccuacugcccac

SEQ ID NO: 1554705 - RNA, 15 nt, Homo sapiens
acaccuguaguccca

SEQ ID NO: 1554706 - RNA, 14 nt, Homo sapiens
acacugucuucccg

SEQ ID NO: 1554707 - RNA, 16 nt, Homo sapiens
acacuuacagaauuau

SEQ ID NO: 1554708 - RNA, 20 nt, Homo sapiens
acagaagcuuuuuguuugca

SEQ ID NO: 1554709 - RNA, 15 nt, Homo sapiens
acagaaggauguccc

SEQ ID NO: 1554710 - RNA, 20 nt, Homo sapiens
acagagcaagacuccaucuc

SEQ ID NO: 1554711 - RNA, 20 nt, Homo sapiens
acagaggccgggguccaggc

SEQ ID NO: 1554712 - RNA, 21 nt, Homo sapiens
acagaguggucuuucuggaga

SEQ ID NO: 1554713 - RNA, 16 nt, Homo sapiens
acagauggauuugccu

SEQ ID NO: 1554714 - RNA, 20 nt, Homo sapiens
acagauggggucugugacug

SEQ ID NO: 1554715 - RNA, 18 nt, Homo sapiens
acaggcaguuaggugcug

SEQ ID NO: 1554716 - RNA, 17 nt, Homo sapiens
acagggcugguguggcu

SEQ ID NO: 1554717 - RNA, 20 nt, Homo sapiens
acagucaccgacaacaugcu

SEQ ID NO: 1554718 - RNA, 17 nt, Homo sapiens
acagucccagauacacu

SEQ ID NO: 1554719 - RNA, 19 nt, Homo sapiens
acagugccucuuccaguga

SEQ ID NO: 1554720 - RNA, 13 nt, Homo sapiens
acauaauguauca

SEQ ID NO: 1554721 - RNA, 16 nt, Homo sapiens
acaucacaacauuuac

SEQ ID NO: 1554722 - RNA, 17 nt, Homo sapiens
acaucagaaguuugcau

SEQ ID NO: 1554723 - RNA, 18 nt, Homo sapiens
acauccagcagauuucca

SEQ ID NO: 1554724 - RNA, 19 nt, Homo sapiens
acaugaacacuuuuuauca

SEQ ID NO: 1554725 - RNA, 22 nt, Homo sapiens
acaugaagcuguugugugaggu

SEQ ID NO: 1554726 - RNA, 14 nt, Homo sapiens
acauuuaugaccua

SEQ ID NO: 1554727 - RNA, 17 nt, Homo sapiens
acauuuccucagucaag

SEQ ID NO: 1554728 - RNA, 15 nt, Homo sapiens
accagaaacaccccu

SEQ ID NO: 1554729 - RNA, 17 nt, Homo sapiens
accaggagcuagcccag

SEQ ID NO: 1554730 - RNA, 21 nt, Homo sapiens
acccagaaugagacauccagc

SEQ ID NO: 1554731 - RNA, 18 nt, Homo sapiens
acccagugcugaauuucc

SEQ ID NO: 1554732 - RNA, 17 nt, Homo sapiens
acccgccgccucccacg

SEQ ID NO: 1554733 - RNA, 23 nt, Homo sapiens
acccuccggccagcgagugguca

SEQ ID NO: 1554734 - RNA, 18 nt, Homo sapiens
acccuguuuucagcuaaa

SEQ ID NO: 1554735 - RNA, 20 nt, Homo sapiens
acccuuuggccccacuuuga

SEQ ID NO: 1554736 - RNA, 21 nt, Homo sapiens
acccuuuggccccacuuugaa

SEQ ID NO: 1554737 - RNA, 12 nt, Homo sapiens
accucugaggac

SEQ ID NO: 1554738 - RNA, 14 nt, Homo sapiens
accuuccacccagu

SEQ ID NO: 1554739 - RNA, 15 nt, Homo sapiens
accuucuaaaagcca

SEQ ID NO: 1554740 - RNA, 13 nt, Homo sapiens
acgacuucagggc

SEQ ID NO: 1554741 - RNA, 23 nt, Homo sapiens
acgguaaguguucucaugaagca

SEQ ID NO: 1554742 - RNA, 14 nt, Homo sapiens
acggugggcauuug

SEQ ID NO: 1554743 - RNA, 15 nt, Homo sapiens
acuauuuugugcucc

SEQ ID NO: 1554744 - RNA, 19 nt, Homo sapiens
acuccgugcuuaaccaaag

SEQ ID NO: 1554745 - RNA, 17 nt, Homo sapiens
acugacugccuugcuaa

SEQ ID NO: 1554746 - RNA, 18 nt, Homo sapiens
acugacugccuugcuaaa

SEQ ID NO: 1554747 - RNA, 15 nt, Homo sapiens
acugauacacuugaa

SEQ ID NO: 1554748 - RNA, 12 nt, Homo sapiens
acugaugguuca

SEQ ID NO: 1554749 - RNA, 21 nt, Homo sapiens
acugauucucuaugacaugaa

SEQ ID NO: 1554750 - RNA, 14 nt, Homo sapiens
acuggccaugguga

SEQ ID NO: 1554751 - RNA, 20 nt, Homo sapiens
acugggugcgucuccaguca

SEQ ID NO: 1554752 - RNA, 21 nt, Homo sapiens
acugguaaaaagauccaggga

SEQ ID NO: 1554753 - RNA, 18 nt, Homo sapiens
acuguaacugacugccuu

SEQ ID NO: 1554754 - RNA, 14 nt, Homo sapiens
acugucugacuaca

SEQ ID NO: 1554755 - RNA, 19 nt, Homo sapiens
acuguguggacugugaugc

SEQ ID NO: 1554756 - RNA, 21 nt, Homo sapiens
acuguucgucacucaaaugaa

SEQ ID NO: 1554757 - RNA, 15 nt, Homo sapiens
acuucuagcauauag

SEQ ID NO: 1554758 - RNA, 20 nt, Homo sapiens
acuuuagaguagcaugagag

SEQ ID NO: 1554759 - RNA, 15 nt, Homo sapiens
acuuuaucauaugcu

SEQ ID NO: 1554760 - RNA, 22 nt, Homo sapiens
agaaaauuggaacucuacucaa

SEQ ID NO: 1554761 - RNA, 23 nt, Homo sapiens
agaaacaccccucugucuaggac

SEQ ID NO: 1554762 - RNA, 12 nt, Homo sapiens
agaaaugauuca

SEQ ID NO: 1554763 - RNA, 17 nt, Homo sapiens
agaacugacaaaggagc

SEQ ID NO: 1554764 - RNA, 14 nt, Homo sapiens
agaagagacuggga

SEQ ID NO: 1554765 - RNA, 20 nt, Homo sapiens
agaagcuuuuuguuugcauc

SEQ ID NO: 1554766 - RNA, 14 nt, Homo sapiens
agaaggcauguucc

SEQ ID NO: 1554767 - RNA, 19 nt, Homo sapiens
agaaucccacauuagcuug

SEQ ID NO: 1554768 - RNA, 15 nt, Homo sapiens
agaaugagacaucca

SEQ ID NO: 1554769 - RNA, 23 nt, Homo sapiens
agacucuuuuuuugagugacagc

SEQ ID NO: 1554770 - RNA, 16 nt, Homo sapiens
agacugaaccagucca

SEQ ID NO: 1554771 - RNA, 17 nt, Homo sapiens
agacuguugccacuuaa

SEQ ID NO: 1554772 - RNA, 15 nt, Homo sapiens
agacuucguaauuaa

SEQ ID NO: 1554773 - RNA, 13 nt, Homo sapiens
agagagcaauuug

SEQ ID NO: 1554774 - RNA, 19 nt, Homo sapiens
agagcaagacuccaucuca

SEQ ID NO: 1554775 - RNA, 20 nt, Homo sapiens
agagcaauuugucuggacua

SEQ ID NO: 1554776 - RNA, 17 nt, Homo sapiens
agagcaugauacaaauu

SEQ ID NO: 1554777 - RNA, 18 nt, Homo sapiens
agagccuauuuuggugag

SEQ ID NO: 1554778 - RNA, 16 nt, Homo sapiens
agagggugcaguccag

SEQ ID NO: 1554779 - RNA, 15 nt, Homo sapiens
agauaaaauguguaa

SEQ ID NO: 1554780 - RNA, 23 nt, Homo sapiens
agauaacaagaucuuucaggaaa

SEQ ID NO: 1554781 - RNA, 13 nt, Homo sapiens
agauaauuggcaa

SEQ ID NO: 1554782 - RNA, 22 nt, Homo sapiens
agauaauuggcaacugggugaa

SEQ ID NO: 1554783 - RNA, 17 nt, Homo sapiens
agauauucagaaguaua

SEQ ID NO: 1554784 - RNA, 20 nt, Homo sapiens
agaucuuucaggaaagacgg

SEQ ID NO: 1554785 - RNA, 15 nt, Homo sapiens
agaugaccuguggua

SEQ ID NO: 1554786 - RNA, 16 nt, Homo sapiens
agauuauaaacugacu

SEQ ID NO: 1554787 - RNA, 13 nt, Homo sapiens
agauuuuccauug

SEQ ID NO: 1554788 - RNA, 19 nt, Homo sapiens
agcaacuucuagcauauag

SEQ ID NO: 1554789 - RNA, 14 nt, Homo sapiens
agcacuuuaaacuu

SEQ ID NO: 1554790 - RNA, 15 nt, Homo sapiens
agcaggccacugggg

SEQ ID NO: 1554791 - RNA, 12 nt, Homo sapiens
agcaggugcugu

SEQ ID NO: 1554792 - RNA, 16 nt, Homo sapiens
agcauagccagcauuc

SEQ ID NO: 1554793 - RNA, 20 nt, Homo sapiens
guccaaccagaaacaccccu

SEQ ID NO: 1554794 - RNA, 13 nt, Homo sapiens
guccugccggugg

SEQ ID NO: 1554795 - RNA, 18 nt, Homo sapiens
gucuacuaaauaauacuu

SEQ ID NO: 1554796 - RNA, 18 nt, Homo sapiens
gucuccagucaucuguaa

SEQ ID NO: 1554797 - RNA, 18 nt, Homo sapiens
gucugacuacaacaugca

SEQ ID NO: 1554798 - RNA, 19 nt, Homo sapiens
gugaacauucccagcccag

SEQ ID NO: 1554799 - RNA, 18 nt, Homo sapiens
gugaagggagagccagcu

SEQ ID NO: 1554800 - RNA, 21 nt, Homo sapiens
gugaauaguguuucaaaggua

SEQ ID NO: 1554801 - RNA, 22 nt, Homo sapiens
gugaauuuuccaagaacauagu

SEQ ID NO: 1554802 - RNA, 13 nt, Homo sapiens
gugacaacaugcg

SEQ ID NO: 1554803 - RNA, 23 nt, Homo sapiens
gugacagcuuucugggaugucac

SEQ ID NO: 1554804 - RNA, 16 nt, Homo sapiens
gugagucuugguucua

SEQ ID NO: 1554805 - RNA, 22 nt, Homo sapiens
gugcugguguggucuacuaaau

SEQ ID NO: 1554806 - RNA, 21 nt, Homo sapiens
gugggagcagcgguuugggga

SEQ ID NO: 1554807 - RNA, 21 nt, Homo sapiens
gugggauggcauuuggucuca

SEQ ID NO: 1554808 - RNA, 19 nt, Homo sapiens
gugugggcugugaguguaa

SEQ ID NO: 1554809 - RNA, 22 nt, Homo sapiens
guguuccauugccauagcugac

SEQ ID NO: 1554810 - RNA, 22 nt, Homo sapiens
guguuucgcauuaagcacacac

SEQ ID NO: 1554811 - RNA, 17 nt, Homo sapiens
guguuuuuaacauguca

SEQ ID NO: 1554812 - RNA, 15 nt, Homo sapiens
guuaccaacuaccua

SEQ ID NO: 1554813 - RNA, 14 nt, Homo sapiens
guuacuugaaauaa

SEQ ID NO: 1554814 - RNA, 19 nt, Homo sapiens
guuagcauauggugcuuaa

SEQ ID NO: 1554815 - RNA, 15 nt, Homo sapiens
guuaguaaugcucug

SEQ ID NO: 1554816 - RNA, 12 nt, Homo sapiens
guuccucaaaag

SEQ ID NO: 1554817 - RNA, 13 nt, Homo sapiens
guucuacacugau

SEQ ID NO: 1554818 - RNA, 15 nt, Homo sapiens
guucugcccauggga

SEQ ID NO: 1554819 - RNA, 21 nt, Homo sapiens
guucugcugaaucaaaucucu

SEQ ID NO: 1554820 - RNA, 14 nt, Homo sapiens
guugaauaaaugaa

SEQ ID NO: 1554821 - RNA, 19 nt, Homo sapiens
guuuuuuauuaugcauuau

SEQ ID NO: 1554822 - RNA, 23 nt, Homo sapiens
uaaaaacuuccuucaaucuucau

SEQ ID NO: 1554823 - RNA, 22 nt, Homo sapiens
uaaaaagggcagggcaucuccu

SEQ ID NO: 1554824 - RNA, 14 nt, Homo sapiens
uaaaaaugcugcuc

SEQ ID NO: 1554825 - RNA, 13 nt, Homo sapiens
uaaaaauucauaa

SEQ ID NO: 1554826 - RNA, 22 nt, Homo sapiens
uaaaagguuaaauauugucaua

SEQ ID NO: 1554827 - RNA, 21 nt, Homo sapiens
uaaaaguuuuuuauuaugcau

SEQ ID NO: 1554828 - RNA, 16 nt, Homo sapiens
uaaaauaaugaacacu

SEQ ID NO: 1554829 - RNA, 20 nt, Homo sapiens
uaaaguaacccauaaucugc

SEQ ID NO: 1554830 - RNA, 23 nt, Homo sapiens
uaaauauccagccaguacaguau

SEQ ID NO: 1554831 - RNA, 14 nt, Homo sapiens
uaaauauugucaua

SEQ ID NO: 1554832 - RNA, 15 nt, Homo sapiens
uaaaugaccaaagau

SEQ ID NO: 1554833 - RNA, 21 nt, Homo sapiens
uaaaugaccaaagaugaccug

SEQ ID NO: 1554834 - RNA, 14 nt, Homo sapiens
uaaauggacaaugg

SEQ ID NO: 1554835 - RNA, 19 nt, Homo sapiens
uaacagaauuaaaguagau

SEQ ID NO: 1554836 - RNA, 15 nt, Homo sapiens
uaagagacaugaaug

SEQ ID NO: 1554837 - RNA, 17 nt, Homo sapiens
uaagaguaaaauuccuc

SEQ ID NO: 1554838 - RNA, 18 nt, Homo sapiens
uaaggaacuucugaagau

SEQ ID NO: 1554839 - RNA, 15 nt, Homo sapiens
uaaguguucucauga

SEQ ID NO: 1554840 - RNA, 19 nt, Homo sapiens
uaauaaaacuaaacuuuca

SEQ ID NO: 1554841 - RNA, 23 nt, Homo sapiens
uaauacuugaccucugugaccaa

SEQ ID NO: 1554842 - RNA, 20 nt, Homo sapiens
uaauauggaucagagcauuu

SEQ ID NO: 1554843 - RNA, 19 nt, Homo sapiens
uaauauuuuuccacuuaaa

SEQ ID NO: 1554844 - RNA, 16 nt, Homo sapiens
uaaugacuuacaggcu

SEQ ID NO: 1554845 - RNA, 16 nt, Homo sapiens
uaaugcucugaccaag

SEQ ID NO: 1554846 - RNA, 13 nt, Homo sapiens
uaauguacaauuu

SEQ ID NO: 1554847 - RNA, 17 nt, Homo sapiens
uaauugcuguucugcug

SEQ ID NO: 1554848 - RNA, 19 nt, Homo sapiens
uaauuguuuaaaaugccuc

SEQ ID NO: 1554849 - RNA, 17 nt, Homo sapiens
uacaauaaguuacuuga

SEQ ID NO: 1554850 - RNA, 16 nt, Homo sapiens
uacacuaaaguuacaa

SEQ ID NO: 1554851 - RNA, 15 nt, Homo sapiens
uacacugauacacuu

SEQ ID NO: 1554852 - RNA, 23 nt, Homo sapiens
uacauauggaaauguuacugucu

SEQ ID NO: 1554853 - RNA, 18 nt, Homo sapiens
uaccaaaguaacugaauu

SEQ ID NO: 1554854 - RNA, 13 nt, Homo sapiens
uacccuaaccaag

SEQ ID NO: 1554855 - RNA, 12 nt, Homo sapiens
uacuaccccagc

SEQ ID NO: 1554856 - RNA, 23 nt, Homo sapiens
uacuauauuaaauucugaaugca

SEQ ID NO: 1554857 - RNA, 18 nt, Homo sapiens
uacuguaagagacaugaa

SEQ ID NO: 1554858 - RNA, 16 nt, Homo sapiens
uacugucuuaucugcu

SEQ ID NO: 1554859 - RNA, 21 nt, Homo sapiens
uacuguguuucgcauuaagca

SEQ ID NO: 1554860 - RNA, 17 nt, Homo sapiens
uacuucuuuagcauuuu

SEQ ID NO: 1554861 - RNA, 20 nt, Homo sapiens
uacuugaccucugugaccaa

SEQ ID NO: 1554862 - RNA, 15 nt, Homo sapiens
uacuuuucacacugu

SEQ ID NO: 1554863 - RNA, 16 nt, Homo sapiens
uacuuuucacacuguc

SEQ ID NO: 1554864 - RNA, 16 nt, Homo sapiens
uagaagaagaggaaga

SEQ ID NO: 1554865 - RNA, 19 nt, Homo sapiens
uagaaguagcaaaaaguau

SEQ ID NO: 1554866 - RNA, 13 nt, Homo sapiens
uagaaugcaggag

SEQ ID NO: 1554867 - RNA, 20 nt, Homo sapiens
uagacagguguuacuuacag

SEQ ID NO: 1554868 - RNA, 20 nt, Homo sapiens
uagagauagcuacaguguaa

SEQ ID NO: 1554869 - RNA, 16 nt, Homo sapiens
uagccucuccaggaau

SEQ ID NO: 1554870 - RNA, 21 nt, Homo sapiens
uagcuguauuuuuuguaugcu

SEQ ID NO: 1554871 - RNA, 13 nt, Homo sapiens
uaggucggcacuu

SEQ ID NO: 1554872 - RNA, 23 nt, Homo sapiens
uaggugcugaaugaagcugccau

SEQ ID NO: 1554873 - RNA, 19 nt, Homo sapiens
uagucccagcuacuccgga

SEQ ID NO: 1554874 - RNA, 15 nt, Homo sapiens
uaguucauccaaucc

SEQ ID NO: 1554875 - RNA, 12 nt, Homo sapiens
uauaaacuuaaa

SEQ ID NO: 1554876 - RNA, 21 nt, Homo sapiens
uauaacagaauuaaaguagau

SEQ ID NO: 1554877 - RNA, 16 nt, Homo sapiens
uauauaugugugugua

SEQ ID NO: 1554878 - RNA, 14 nt, Homo sapiens
uaucaagcuuuuaa

SEQ ID NO: 1554879 - RNA, 19 nt, Homo sapiens
uaucaggguauaaauuaua

SEQ ID NO: 1554880 - RNA, 13 nt, Homo sapiens
uauccaagacuua

SEQ ID NO: 1554881 - RNA, 23 nt, Homo sapiens
uauccaagacuuagagcugggaa

SEQ ID NO: 1554882 - RNA, 13 nt, Homo sapiens
uauccaccaagaa

SEQ ID NO: 1554883 - RNA, 16 nt, Homo sapiens
uauccauugaacuaaa

SEQ ID NO: 1554884 - RNA, 18 nt, Homo sapiens
uaugauguuagaagaaga

SEQ ID NO: 1554885 - RNA, 23 nt, Homo sapiens
uauugagccuugcauguacuuga

SEQ ID NO: 1554886 - RNA, 15 nt, Homo sapiens
uauuuauagucacaa

SEQ ID NO: 1554887 - RNA, 23 nt, Homo sapiens
uauuucuucaaauaaaucucucc

SEQ ID NO: 1554888 - RNA, 23 nt, Homo sapiens
ucaaaaaagaaaaaagaaaagaa

SEQ ID NO: 1554889 - RNA, 14 nt, Homo sapiens
ucaaaugaauuugc

SEQ ID NO: 1554890 - RNA, 14 nt, Homo sapiens
ucaaauugcugcuu

SEQ ID NO: 1554891 - RNA, 14 nt, Homo sapiens
ucaacaacugcuac

SEQ ID NO: 1554892 - RNA, 20 nt, Homo sapiens
ucaacagaaacuaaaugaac

SEQ ID NO: 1554893 - RNA, 22 nt, Homo sapiens
ucaagcaaaaugcuuacagggc

SEQ ID NO: 1554894 - RNA, 22 nt, Homo sapiens
ucaagcuuuuaaaaacuagagc

SEQ ID NO: 1554895 - RNA, 16 nt, Homo sapiens
ucacccuguauguuag

SEQ ID NO: 1554896 - RNA, 15 nt, Homo sapiens
ucagaagacacugca

SEQ ID NO: 1554897 - RNA, 19 nt, Homo sapiens
ucagagcaugauacaaauu

SEQ ID NO: 1554898 - RNA, 16 nt, Homo sapiens
ucagcagugaaguaua

SEQ ID NO: 1554899 - RNA, 22 nt, Homo sapiens
ucagucacuguucgucacucaa

SEQ ID NO: 1554900 - RNA, 23 nt, Homo sapiens
ucaguugagagggugcaguccag

SEQ ID NO: 1554901 - RNA, 13 nt, Homo sapiens
ucauaaccaaaga

SEQ ID NO: 1554902 - RNA, 19 nt, Homo sapiens
ucaucuucuagaaucucgu

SEQ ID NO: 1554903 - RNA, 10 nt, Homo sapiens
ucaugaaauu

SEQ ID NO: 1554904 - RNA, 22 nt, Homo sapiens
uccaccuuuuaaguuaaugaaa

SEQ ID NO: 1554905 - RNA, 14 nt, Homo sapiens
uccagcagauuucc

SEQ ID NO: 1554906 - RNA, 22 nt, Homo sapiens
uccagcagugaaugcuagacag

SEQ ID NO: 1554907 - RNA, 14 nt, Homo sapiens
ucccaaguaugccu

SEQ ID NO: 1554908 - RNA, 18 nt, Homo sapiens
ucccagccucuugcucag

SEQ ID NO: 1554909 - RNA, 17 nt, Homo sapiens
ucccccgccuccaguca

SEQ ID NO: 1554910 - RNA, 20 nt, Homo sapiens
ucccuacccuaaccaaguuc

SEQ ID NO: 1554911 - RNA, 14 nt, Homo sapiens
ucccuaguuuacaa

SEQ ID NO: 1554912 - RNA, 20 nt, Homo sapiens
aauauuuccuuaaacugugu

SEQ ID NO: 1554913 - RNA, 18 nt, Homo sapiens
aauauuuuuccacuuaaa

SEQ ID NO: 1554914 - RNA, 21 nt, Homo sapiens
aaucagauugacagcauauag

SEQ ID NO: 1554915 - RNA, 21 nt, Homo sapiens
aaucauaguuuaaacugcauu

SEQ ID NO: 1554916 - RNA, 16 nt, Homo sapiens
aauccaaaagacaaaa

SEQ ID NO: 1554917 - RNA, 20 nt, Homo sapiens
aaucccacauuagcuuguua

SEQ ID NO: 1554918 - RNA, 16 nt, Homo sapiens
aaucgggaaauuuaca

SEQ ID NO: 1554919 - RNA, 15 nt, Homo sapiens
aaucuauccauugaa

SEQ ID NO: 1554920 - RNA, 22 nt, Homo sapiens
aaugaagacuacauuugugaac

SEQ ID NO: 1554921 - RNA, 23 nt, Homo sapiens
aaugauuaacaguuaugugguca

SEQ ID NO: 1554922 - RNA, 20 nt, Homo sapiens
aaugcaguuuuuuggaagaa

SEQ ID NO: 1554923 - RNA, 17 nt, Homo sapiens
aauggacuguacaauaa

SEQ ID NO: 1554924 - RNA, 22 nt, Homo sapiens
aauggagaauuaaaaauaccaa

SEQ ID NO: 1554925 - RNA, 21 nt, Homo sapiens
aauguauuugugcacauguac

SEQ ID NO: 1554926 - RNA, 13 nt, Homo sapiens
aauuaugaccaug

SEQ ID NO: 1554927 - RNA, 19 nt, Homo sapiens
aauuuuugcuaugcuguaa

SEQ ID NO: 1554928 - RNA, 22 nt, Homo sapiens
acaaaaaugaaagcaugucuca

SEQ ID NO: 1554929 - RNA, 16 nt, Homo sapiens
acaaaaugccaagggg

SEQ ID NO: 1554930 - RNA, 14 nt, Homo sapiens
acaaacucacucag

SEQ ID NO: 1554931 - RNA, 19 nt, Homo sapiens
acaacaugcgaccgugacc

SEQ ID NO: 1554932 - RNA, 15 nt, Homo sapiens
acaaggaagccaaag

SEQ ID NO: 1554933 - RNA, 12 nt, Homo sapiens
acacagcacaag

SEQ ID NO: 1554934 - RNA, 17 nt, Homo sapiens
acacagggcccggccac

SEQ ID NO: 1554935 - RNA, 17 nt, Homo sapiens
acacccgacuccucaaa

SEQ ID NO: 1554936 - RNA, 18 nt, Homo sapiens
acacugauacacuugaag

SEQ ID NO: 1554937 - RNA, 15 nt, Homo sapiens
acaggacagcgggaa

SEQ ID NO: 1554938 - RNA, 15 nt, Homo sapiens
acaguaucacucuaa

SEQ ID NO: 1554939 - RNA, 17 nt, Homo sapiens
acauaauguaucaugaa

SEQ ID NO: 1554940 - RNA, 21 nt, Homo sapiens
acaucaaguaugguaggggag

SEQ ID NO: 1554941 - RNA, 16 nt, Homo sapiens
acaucagaaguuugca

SEQ ID NO: 1554942 - RNA, 16 nt, Homo sapiens
acaugucaaucugucc

SEQ ID NO: 1554943 - RNA, 18 nt, Homo sapiens
acauguuuaaauagccua

SEQ ID NO: 1554944 - RNA, 20 nt, Homo sapiens
acauguuuaaauagccuaaa

SEQ ID NO: 1554945 - RNA, 15 nt, Homo sapiens
acauuauuagcacuu

SEQ ID NO: 1554946 - RNA, 21 nt, Homo sapiens
acauuguccuguagcuuuaaa

SEQ ID NO: 1554947 - RNA, 15 nt, Homo sapiens
acauuugggcucagg

SEQ ID NO: 1554948 - RNA, 13 nt, Homo sapiens
accaaacaaggaa

SEQ ID NO: 1554949 - RNA, 21 nt, Homo sapiens
accaaguuccuuggccaugca

SEQ ID NO: 1554950 - RNA, 13 nt, Homo sapiens
accagaauucccu

SEQ ID NO: 1554951 - RNA, 13 nt, Homo sapiens
accagcacugucu

SEQ ID NO: 1554952 - RNA, 17 nt, Homo sapiens
accccaucuuuacuaaa

SEQ ID NO: 1554953 - RNA, 21 nt, Homo sapiens
acccuguccggcccagugcca

SEQ ID NO: 1554954 - RNA, 22 nt, Homo sapiens
acccuguccggcccagugccac

SEQ ID NO: 1554955 - RNA, 17 nt, Homo sapiens
accugucucuaccuaag

SEQ ID NO: 1554956 - RNA, 14 nt, Homo sapiens
accugugaccagca

SEQ ID NO: 1554957 - RNA, 22 nt, Homo sapiens
acgccuacuuaagagugcugug

SEQ ID NO: 1554958 - RNA, 21 nt, Homo sapiens
acgcugcugcaggacauuaau

SEQ ID NO: 1554959 - RNA, 14 nt, Homo sapiens
acgucaagucuccu

SEQ ID NO: 1554960 - RNA, 14 nt, Homo sapiens
acuaaauaauacuu

SEQ ID NO: 1554961 - RNA, 16 nt, Homo sapiens
acuaaauaauacuuua

SEQ ID NO: 1554962 - RNA, 13 nt, Homo sapiens
acuaaaugaacau

SEQ ID NO: 1554963 - RNA, 15 nt, Homo sapiens
acuauuuuaccugaa

SEQ ID NO: 1554964 - RNA, 20 nt, Homo sapiens
acucaaaugaauuugcuaaa

SEQ ID NO: 1554965 - RNA, 19 nt, Homo sapiens
acucaacccauuguuguca

SEQ ID NO: 1554966 - RNA, 22 nt, Homo sapiens
acucacagcugaagaaaaugag

SEQ ID NO: 1554967 - RNA, 22 nt, Homo sapiens
acuccagcuugggcaacagagc

SEQ ID NO: 1554968 - RNA, 18 nt, Homo sapiens
acuccuccugcuccucac

SEQ ID NO: 1554969 - RNA, 19 nt, Homo sapiens
acucuugaauagacuucca

SEQ ID NO: 1554970 - RNA, 18 nt, Homo sapiens
acugaaccaguccaggug

SEQ ID NO: 1554971 - RNA, 12 nt, Homo sapiens
acugaacuguga

SEQ ID NO: 1554972 - RNA, 14 nt, Homo sapiens
acugaacugugaac

SEQ ID NO: 1554973 - RNA, 19 nt, Homo sapiens
acugacaaaggagccuuga

SEQ ID NO: 1554974 - RNA, 19 nt, Homo sapiens
acugcagcaggccacuggg

SEQ ID NO: 1554975 - RNA, 20 nt, Homo sapiens
acugcucuccuccaccucaa

SEQ ID NO: 1554976 - RNA, 17 nt, Homo sapiens
acugggucugacaugaa

SEQ ID NO: 1554977 - RNA, 20 nt, Homo sapiens
acugggugaaucuggcagga

SEQ ID NO: 1554978 - RNA, 17 nt, Homo sapiens
acuguaacugacugccu

SEQ ID NO: 1554979 - RNA, 16 nt, Homo sapiens
acuguguggacuguga

SEQ ID NO: 1554980 - RNA, 22 nt, Homo sapiens
acuuaguuugugauguaaggca

SEQ ID NO: 1554981 - RNA, 19 nt, Homo sapiens
acuuaucacgccuacuuaa

SEQ ID NO: 1554982 - RNA, 20 nt, Homo sapiens
acuuaucacgccuacuuaag

SEQ ID NO: 1554983 - RNA, 15 nt, Homo sapiens
acuuauuaacuaaga

SEQ ID NO: 1554984 - RNA, 20 nt, Homo sapiens
acuuccugcccucucuguac

SEQ ID NO: 1554985 - RNA, 14 nt, Homo sapiens
acuucuagcauaua

SEQ ID NO: 1554986 - RNA, 13 nt, Homo sapiens
acuucuagcugua

SEQ ID NO: 1554987 - RNA, 17 nt, Homo sapiens
acuucuguacaguaaga

SEQ ID NO: 1554988 - RNA, 22 nt, Homo sapiens
acuuuauguaguuuuuauaugu

SEQ ID NO: 1554989 - RNA, 13 nt, Homo sapiens
acuuugugcauuc

SEQ ID NO: 1554990 - RNA, 13 nt, Homo sapiens
acuuuuacugucu

SEQ ID NO: 1554991 - RNA, 14 nt, Homo sapiens
acuuuucacacugu

SEQ ID NO: 1554992 - RNA, 17 nt, Homo sapiens
agaaaucauaguuuaaa

SEQ ID NO: 1554993 - RNA, 19 nt, Homo sapiens
agaaaucuuucucccucaa

SEQ ID NO: 1554994 - RNA, 22 nt, Homo sapiens
agaaaugauucaaauugcugcu

SEQ ID NO: 1554995 - RNA, 13 nt, Homo sapiens
agaagacacugca

SEQ ID NO: 1554996 - RNA, 19 nt, Homo sapiens
agaagagaauucaguauuu

SEQ ID NO: 1554997 - RNA, 12 nt, Homo sapiens
agaaguuugcau

SEQ ID NO: 1554998 - RNA, 15 nt, Homo sapiens
agaaucccugccugu

SEQ ID NO: 1554999 - RNA, 13 nt, Homo sapiens
agaauuguaucau

SEQ ID NO: 1555000 - RNA, 16 nt, Homo sapiens
agacaugaaugcacac

SEQ ID NO: 1555001 - RNA, 17 nt, Homo sapiens
agacccaccacaccgca

SEQ ID NO: 1555002 - RNA, 16 nt, Homo sapiens
agacuacauuugugaa

SEQ ID NO: 1555003 - RNA, 13 nt, Homo sapiens
agacuugggaugg

SEQ ID NO: 1555004 - RNA, 17 nt, Homo sapiens
agagacaugaauggaga

SEQ ID NO: 1555005 - RNA, 13 nt, Homo sapiens
agagaggcugccu

SEQ ID NO: 1555006 - RNA, 16 nt, Homo sapiens
agagagguuuuucuga

SEQ ID NO: 1555007 - RNA, 20 nt, Homo sapiens
agagcaagacuccaucucaa

SEQ ID NO: 1555008 - RNA, 14 nt, Homo sapiens
agauaauuggcaac

SEQ ID NO: 1555009 - RNA, 15 nt, Homo sapiens
agauagcuacagugu

SEQ ID NO: 1555010 - RNA, 18 nt, Homo sapiens
agaucacgucacugcacu

SEQ ID NO: 1555011 - RNA, 15 nt, Homo sapiens
agaugcccauucucu

SEQ ID NO: 1555012 - RNA, 22 nt, Homo sapiens
agauuauagaaguagcaaaaag

SEQ ID NO: 1555013 - RNA, 16 nt, Homo sapiens
agauugacagcauaua

SEQ ID NO: 1555014 - RNA, 17 nt, Homo sapiens
agauugacagcauauag

SEQ ID NO: 1555015 - RNA, 21 nt, Homo sapiens
agcaaacgucuauuuuguaua

SEQ ID NO: 1555016 - RNA, 17 nt, Homo sapiens
agcacugucucaguuuc

SEQ ID NO: 1555017 - RNA, 18 nt, Homo sapiens
agcagaacaaauguguuu

SEQ ID NO: 1555018 - RNA, 20 nt, Homo sapiens
agcaugaccugugaccagca

SEQ ID NO: 1555019 - RNA, 14 nt, Homo sapiens
agcauugagcauaa

SEQ ID NO: 1555020 - RNA, 19 nt, Homo sapiens
agccauauuugauaguaua

SEQ ID NO: 1555021 - RNA, 22 nt, Homo sapiens
agcccuaacauagugucugcug

SEQ ID NO: 1555022 - RNA, 18 nt, Homo sapiens
agccuaaaugauggugcu

SEQ ID NO: 1555023 - RNA, 17 nt, Homo sapiens
agccuggauuccagcag

SEQ ID NO: 1555024 - RNA, 23 nt, Homo sapiens
agccuugcauguacuugaaggau

SEQ ID NO: 1555025 - RNA, 11 nt, Homo sapiens
agcuacagugu

SEQ ID NO: 1555026 - RNA, 17 nt, Homo sapiens
agcuccuguugucauga

SEQ ID NO: 1555027 - RNA, 17 nt, Homo sapiens
agcucuggaugaaggca

SEQ ID NO: 1555028 - RNA, 18 nt, Homo sapiens
agcuuuuggagggugaua

SEQ ID NO: 1555029 - RNA, 20 nt, Homo sapiens
aggacacagcacaagggcac

SEQ ID NO: 1555030 - RNA, 14 nt, Homo sapiens
aggagauacugaac

SEQ ID NO: 1555031 - RNA, 22 nt, Homo sapiens
aggagccuugauaauacuugac

SEQ ID NO: 1555032 - RNA, 14 nt, Homo sapiens
auaacucuccagua

SEQ ID NO: 1555033 - RNA, 14 nt, Homo sapiens
auaacugcaguguu

SEQ ID NO: 1555034 - RNA, 17 nt, Homo sapiens
auaagaggugaucucug

SEQ ID NO: 1555035 - RNA, 12 nt, Homo sapiens
auaauacuugac

SEQ ID NO: 1555036 - RNA, 13 nt, Homo sapiens
auaauacuugacc

SEQ ID NO: 1555037 - RNA, 14 nt, Homo sapiens
auacaaauuccaca

SEQ ID NO: 1555038 - RNA, 12 nt, Homo sapiens
auacacuugaag

SEQ ID NO: 1555039 - RNA, 18 nt, Homo sapiens
auaccaggauagcuuuau

SEQ ID NO: 1555040 - RNA, 14 nt, Homo sapiens
auagucacaagagc

SEQ ID NO: 1555041 - RNA, 16 nt, Homo sapiens
auaguuccuugccuua

SEQ ID NO: 1555042 - RNA, 20 nt, Homo sapiens
auaguuuaaacugcauuaua

SEQ ID NO: 1555043 - RNA, 20 nt, Homo sapiens
auaugcaauguauagugucu

SEQ ID NO: 1555044 - RNA, 16 nt, Homo sapiens
auauuuuuaaauggac

SEQ ID NO: 1555045 - RNA, 17 nt, Homo sapiens
aucaaaucucuuccaca

SEQ ID NO: 1555046 - RNA, 22 nt, Homo sapiens
aucaaaucucuuccacaugggu

SEQ ID NO: 1555047 - RNA, 22 nt, Homo sapiens
aucaaauugugcaguacuuugu

SEQ ID NO: 1555048 - RNA, 19 nt, Homo sapiens
aucacaacauuuacuuaac

SEQ ID NO: 1555049 - RNA, 21 nt, Homo sapiens
aucacgucacugcacuccagc

SEQ ID NO: 1555050 - RNA, 13 nt, Homo sapiens
aucagagcauuua

SEQ ID NO: 1555051 - RNA, 22 nt, Homo sapiens
aucauuagcaacaacaugcuaa

SEQ ID NO: 1555052 - RNA, 16 nt, Homo sapiens
aucccugccuguuaag

SEQ ID NO: 1555053 - RNA, 18 nt, Homo sapiens
aucuaccacuguaugagu

SEQ ID NO: 1555054 - RNA, 22 nt, Homo sapiens
aucucugggaguuauaggucau

SEQ ID NO: 1555055 - RNA, 16 nt, Homo sapiens
aucucuuccacauggg

SEQ ID NO: 1555056 - RNA, 21 nt, Homo sapiens
aucuguaagagcuugcuccag

SEQ ID NO: 1555057 - RNA, 18 nt, Homo sapiens
aucuuaaaacaaauucau

SEQ ID NO: 1555058 - RNA, 16 nt, Homo sapiens
aucuuguggggccagg

SEQ ID NO: 1555059 - RNA, 12 nt, Homo sapiens
aucuuucaggaa

SEQ ID NO: 1555060 - RNA, 18 nt, Homo sapiens
augagauguuauuacugu

SEQ ID NO: 1555061 - RNA, 14 nt, Homo sapiens
augaggaauccaaa

SEQ ID NO: 1555062 - RNA, 15 nt, Homo sapiens
augcacugauguugu

SEQ ID NO: 1555063 - RNA, 15 nt, Homo sapiens
augccuuaagcagaa

SEQ ID NO: 1555064 - RNA, 22 nt, Homo sapiens
augcuagacagaaaccaagcca

SEQ ID NO: 1555065 - RNA, 17 nt, Homo sapiens
augcuuucccugaggaa

SEQ ID NO: 1555066 - RNA, 23 nt, Homo sapiens
auggcauuuggucucaggcagca

SEQ ID NO: 1555067 - RNA, 19 nt, Homo sapiens
auggggucugugacuggau

SEQ ID NO: 1555068 - RNA, 13 nt, Homo sapiens
auggugcuuaaaa

SEQ ID NO: 1555069 - RNA, 17 nt, Homo sapiens
augugguacuacuguaa

SEQ ID NO: 1555070 - RNA, 21 nt, Homo sapiens
auguguuccauugccauagcu

SEQ ID NO: 1555071 - RNA, 16 nt, Homo sapiens
auguuuaaauagccua

SEQ ID NO: 1555072 - RNA, 19 nt, Homo sapiens
auuaagacuuuauguaguu

SEQ ID NO: 1555073 - RNA, 19 nt, Homo sapiens
auuaucacauuaaucucaa

SEQ ID NO: 1555074 - RNA, 14 nt, Homo sapiens
auucacaguaauau

SEQ ID NO: 1555075 - RNA, 21 nt, Homo sapiens
auucacaguaauaugguuccc

SEQ ID NO: 1555076 - RNA, 15 nt, Homo sapiens
auucauaaccaaaga

SEQ ID NO: 1555077 - RNA, 17 nt, Homo sapiens
auucgugacaacaugcg

SEQ ID NO: 1555078 - RNA, 14 nt, Homo sapiens
auucugaugcauac

SEQ ID NO: 1555079 - RNA, 18 nt, Homo sapiens
auugaggaguugccugac

SEQ ID NO: 1555080 - RNA, 23 nt, Homo sapiens
auugccauagcugacuacaaauu

SEQ ID NO: 1555081 - RNA, 22 nt, Homo sapiens
auugucauaggauuaagcaguu

SEQ ID NO: 1555082 - RNA, 17 nt, Homo sapiens
auugugcaguacuuugu

SEQ ID NO: 1555083 - RNA, 23 nt, Homo sapiens
auuuccuuaaacuguguggacug

SEQ ID NO: 1555084 - RNA, 15 nt, Homo sapiens
auuuuuccacuuaaa

SEQ ID NO: 1555085 - RNA, 15 nt, Homo sapiens
caaaaacuguacugu

SEQ ID NO: 1555086 - RNA, 19 nt, Homo sapiens
caaaaacuguacuguguuu

SEQ ID NO: 1555087 - RNA, 20 nt, Homo sapiens
caaaaaucuguguaacugua

SEQ ID NO: 1555088 - RNA, 23 nt, Homo sapiens
caaaacuuaucacgccuacuuaa

SEQ ID NO: 1555089 - RNA, 20 nt, Homo sapiens
caaagguauguaguuacaga

SEQ ID NO: 1555090 - RNA, 22 nt, Homo sapiens
caaaggugccucauagcauagc

SEQ ID NO: 1555091 - RNA, 14 nt, Homo sapiens
caaaugaaacuuua

SEQ ID NO: 1555092 - RNA, 17 nt, Homo sapiens
caacaugcgaccgugac

SEQ ID NO: 1555093 - RNA, 22 nt, Homo sapiens
caaccaguuuauccaccaagaa

SEQ ID NO: 1555094 - RNA, 18 nt, Homo sapiens
caagacacugaggagaua

SEQ ID NO: 1555095 - RNA, 16 nt, Homo sapiens
caagagcugagaaaca

SEQ ID NO: 1555096 - RNA, 16 nt, Homo sapiens
caagaucuuucaggaa

SEQ ID NO: 1555097 - RNA, 17 nt, Homo sapiens
caagaucuuucaggaaa

SEQ ID NO: 1555098 - RNA, 17 nt, Homo sapiens
caagggggugacuggaa

SEQ ID NO: 1555099 - RNA, 13 nt, Homo sapiens
caauauaagcaua

SEQ ID NO: 1555100 - RNA, 12 nt, Homo sapiens
caauggacugua

SEQ ID NO: 1555101 - RNA, 16 nt, Homo sapiens
cacaacccuguuuuau

SEQ ID NO: 1555102 - RNA, 14 nt, Homo sapiens
cacacgagcaaacc

SEQ ID NO: 1555103 - RNA, 14 nt, Homo sapiens
cacagaaggaauaa

SEQ ID NO: 1555104 - RNA, 18 nt, Homo sapiens
cacagcugggcaggguga

SEQ ID NO: 1555105 - RNA, 14 nt, Homo sapiens
cacauguacauaug

SEQ ID NO: 1555106 - RNA, 15 nt, Homo sapiens
cacauguggggacag

SEQ ID NO: 1555107 - RNA, 18 nt, Homo sapiens
cacccgccgccucccacg

SEQ ID NO: 1555108 - RNA, 19 nt, Homo sapiens
caccucaacuccgugcuua

SEQ ID NO: 1555109 - RNA, 14 nt, Homo sapiens
caccucugauuaca

SEQ ID NO: 1555110 - RNA, 15 nt, Homo sapiens
cacgccuacuuaaga

SEQ ID NO: 1555111 - RNA, 16 nt, Homo sapiens
cacucccuggcucuca

SEQ ID NO: 1555112 - RNA, 19 nt, Homo sapiens
cacugaggagauacugaac

SEQ ID NO: 1555113 - RNA, 15 nt, Homo sapiens
cacuuaaccauucca

SEQ ID NO: 1555114 - RNA, 14 nt, Homo sapiens
cacuuacagaauua

SEQ ID NO: 1555115 - RNA, 16 nt, Homo sapiens
cagaagacacugcaaa

SEQ ID NO: 1555116 - RNA, 15 nt, Homo sapiens
aaccuuccacccagu

SEQ ID NO: 1555117 - RNA, 21 nt, Homo sapiens
aacuaagaaaauucuauguua

SEQ ID NO: 1555118 - RNA, 14 nt, Homo sapiens
aacuaguaauacug

SEQ ID NO: 1555119 - RNA, 18 nt, Homo sapiens
aacuauugagccuugcau

SEQ ID NO: 1555120 - RNA, 23 nt, Homo sapiens
aacugacugccuugcuaaaagau

SEQ ID NO: 1555121 - RNA, 12 nt, Homo sapiens
aagaaaaugagc

SEQ ID NO: 1555122 - RNA, 20 nt, Homo sapiens
aagaaaucuuucucccucaa

SEQ ID NO: 1555123 - RNA, 18 nt, Homo sapiens
aagaagacucaguaugcu

SEQ ID NO: 1555124 - RNA, 15 nt, Homo sapiens
aagaagagacuggga

SEQ ID NO: 1555125 - RNA, 21 nt, Homo sapiens
aagaauuccugcagcaguuau

SEQ ID NO: 1555126 - RNA, 13 nt, Homo sapiens
aagaauuggccag

SEQ ID NO: 1555127 - RNA, 17 nt, Homo sapiens
aagaccagccuggccaa

SEQ ID NO: 1555128 - RNA, 15 nt, Homo sapiens
aagagcuugcuccag

SEQ ID NO: 1555129 - RNA, 22 nt, Homo sapiens
aagaggacuuaguuugugaugu

SEQ ID NO: 1555130 - RNA, 15 nt, Homo sapiens
aagauaauuuacuua

SEQ ID NO: 1555131 - RNA, 15 nt, Homo sapiens
aagaucaccuuguau

SEQ ID NO: 1555132 - RNA, 20 nt, Homo sapiens
aagaucauaacaaugucuca

SEQ ID NO: 1555133 - RNA, 20 nt, Homo sapiens
aagauuauagaaguagcaaa

SEQ ID NO: 1555134 - RNA, 18 nt, Homo sapiens
aagauuuguccaccucug

SEQ ID NO: 1555135 - RNA, 13 nt, Homo sapiens
aagcaaacacuua

SEQ ID NO: 1555136 - RNA, 17 nt, Homo sapiens
aagcaucccucacccau

SEQ ID NO: 1555137 - RNA, 23 nt, Homo sapiens
aagccuuaaguggcagaauauaa

SEQ ID NO: 1555138 - RNA, 23 nt, Homo sapiens
aaggaacagagugagagacauca

SEQ ID NO: 1555139 - RNA, 20 nt, Homo sapiens
aaggcuuugguuuccaaguc

SEQ ID NO: 1555140 - RNA, 14 nt, Homo sapiens
aagggggugacugg

SEQ ID NO: 1555141 - RNA, 16 nt, Homo sapiens
aaggugccucauagca

SEQ ID NO: 1555142 - RNA, 16 nt, Homo sapiens
aagguuguauguguca

SEQ ID NO: 1555143 - RNA, 18 nt, Homo sapiens
aaguaacugaauuauuuc

SEQ ID NO: 1555144 - RNA, 14 nt, Homo sapiens
aaguacaguuuucu

SEQ ID NO: 1555145 - RNA, 20 nt, Homo sapiens
aaguagcaaaaaguauugaa

SEQ ID NO: 1555146 - RNA, 19 nt, Homo sapiens
aaguaugccuuaagcagaa

SEQ ID NO: 1555147 - RNA, 14 nt, Homo sapiens
aaguggccaugcca

SEQ ID NO: 1555148 - RNA, 12 nt, Homo sapiens
aaguuacuugaa

SEQ ID NO: 1555149 - RNA, 22 nt, Homo sapiens
aaguucccuaugaaaaaugugu

SEQ ID NO: 1555150 - RNA, 13 nt, Homo sapiens
aaguuugcaucuc

SEQ ID NO: 1555151 - RNA, 19 nt, Homo sapiens
aaguuuuaaauaaaccuau

SEQ ID NO: 1555152 - RNA, 18 nt, Homo sapiens
aauaacucuccaguaaca

SEQ ID NO: 1555153 - RNA, 18 nt, Homo sapiens
aauaauuuuauuaugcaa

SEQ ID NO: 1555154 - RNA, 15 nt, Homo sapiens
aauacaacacugaua

SEQ ID NO: 1555155 - RNA, 23 nt, Homo sapiens
aaucagcaacuucuagcauauag

SEQ ID NO: 1555156 - RNA, 21 nt, Homo sapiens
aauccauccaaaguucccuau

SEQ ID NO: 1555157 - RNA, 21 nt, Homo sapiens
aaucuggcaggaaucuaucca

SEQ ID NO: 1555158 - RNA, 13 nt, Homo sapiens
aaugaagcugcca

SEQ ID NO: 1555159 - RNA, 23 nt, Homo sapiens
aaugcuagacagaaaccaagcca

SEQ ID NO: 1555160 - RNA, 11 nt, Homo sapiens
aaugcucugac

SEQ ID NO: 1555161 - RNA, 17 nt, Homo sapiens
aauuaaaggaacagagu

SEQ ID NO: 1555162 - RNA, 14 nt, Homo sapiens
aauuaucaagcuuu

SEQ ID NO: 1555163 - RNA, 18 nt, Homo sapiens
aauuauugcuguauguaa

SEQ ID NO: 1555164 - RNA, 14 nt, Homo sapiens
aauucccaagcuuu

SEQ ID NO: 1555165 - RNA, 15 nt, Homo sapiens
aauucccaagcuuuu

SEQ ID NO: 1555166 - RNA, 17 nt, Homo sapiens
aauuccugcagcaguua

SEQ ID NO: 1555167 - RNA, 17 nt, Homo sapiens
aauucugaaugcaauuu

SEQ ID NO: 1555168 - RNA, 16 nt, Homo sapiens
aauugugcaguacuuu

SEQ ID NO: 1555169 - RNA, 12 nt, Homo sapiens
aauuuacuugau

SEQ ID NO: 1555170 - RNA, 17 nt, Homo sapiens
aauuuuauaacagaauu

SEQ ID NO: 1555171 - RNA, 13 nt, Homo sapiens
acaaauuccacag

SEQ ID NO: 1555172 - RNA, 13 nt, Homo sapiens
acaaggaagccaa

SEQ ID NO: 1555173 - RNA, 17 nt, Homo sapiens
acaaggaagccaaaguu

SEQ ID NO: 1555174 - RNA, 13 nt, Homo sapiens
acaauggacugua

SEQ ID NO: 1555175 - RNA, 16 nt, Homo sapiens
acaauggacuguacaa

SEQ ID NO: 1555176 - RNA, 17 nt, Homo sapiens
acaaugguuuauuccca

SEQ ID NO: 1555177 - RNA, 16 nt, Homo sapiens
acacauuuacccuuug

SEQ ID NO: 1555178 - RNA, 16 nt, Homo sapiens
acacccgacuccucaa

SEQ ID NO: 1555179 - RNA, 18 nt, Homo sapiens
acaccuguagucccagcu

SEQ ID NO: 1555180 - RNA, 23 nt, Homo sapiens
acacuugugugugggcugugagu

SEQ ID NO: 1555181 - RNA, 21 nt, Homo sapiens
acagaagcuuuuuguuugcau

SEQ ID NO: 1555182 - RNA, 17 nt, Homo sapiens
acagacuucuccagacc

SEQ ID NO: 1555183 - RNA, 21 nt, Homo sapiens
acagagcaagacuccaucuca

SEQ ID NO: 1555184 - RNA, 19 nt, Homo sapiens
acagauggggucugugacu

SEQ ID NO: 1555185 - RNA, 17 nt, Homo sapiens
acagcguguaaacacau

SEQ ID NO: 1555186 - RNA, 22 nt, Homo sapiens
acagcugugucugccaaacaca

SEQ ID NO: 1555187 - RNA, 16 nt, Homo sapiens
acaggggaucauguua

SEQ ID NO: 1555188 - RNA, 17 nt, Homo sapiens
acaguaaguccaguaaa

SEQ ID NO: 1555189 - RNA, 14 nt, Homo sapiens
acagugccucuucc

SEQ ID NO: 1555190 - RNA, 21 nt, Homo sapiens
acauauggaaauguuacuguc

SEQ ID NO: 1555191 - RNA, 22 nt, Homo sapiens
acauauggaaauguuacugucu

SEQ ID NO: 1555192 - RNA, 21 nt, Homo sapiens
acaucagaaguuugcaucucg

SEQ ID NO: 1555193 - RNA, 15 nt, Homo sapiens
acaucuggcccugac

SEQ ID NO: 1555194 - RNA, 13 nt, Homo sapiens
acaugaaugcaca

SEQ ID NO: 1555195 - RNA, 12 nt, Homo sapiens
acaugacuacau

SEQ ID NO: 1555196 - RNA, 15 nt, Homo sapiens
acaugcgaccgugac

SEQ ID NO: 1555197 - RNA, 20 nt, Homo sapiens
acaugcgaccgugaccagga

SEQ ID NO: 1555198 - RNA, 14 nt, Homo sapiens
acauggaacuuuag

SEQ ID NO: 1555199 - RNA, 15 nt, Homo sapiens
acauguucugugccu

SEQ ID NO: 1555200 - RNA, 16 nt, Homo sapiens
acauuauuagcacuuc

SEQ ID NO: 1555201 - RNA, 13 nt, Homo sapiens
accaaaguaacug

SEQ ID NO: 1555202 - RNA, 17 nt, Homo sapiens
accaagaacauaagaau

SEQ ID NO: 1555203 - RNA, 18 nt, Homo sapiens
accaagaacauaagaauu

SEQ ID NO: 1555204 - RNA, 23 nt, Homo sapiens
accaauuugguaaaaaugcugcu

SEQ ID NO: 1555205 - RNA, 14 nt, Homo sapiens
accagaauucccuu

SEQ ID NO: 1555206 - RNA, 13 nt, Homo sapiens
accagagcugccg

SEQ ID NO: 1555207 - RNA, 19 nt, Homo sapiens
acccagaaugagacaucca

SEQ ID NO: 1555208 - RNA, 19 nt, Homo sapiens
accccaucuuuacuaaaaa

SEQ ID NO: 1555209 - RNA, 17 nt, Homo sapiens
accccuguuucuggcac

SEQ ID NO: 1555210 - RNA, 14 nt, Homo sapiens
acccuucacacugu

SEQ ID NO: 1555211 - RNA, 23 nt, Homo sapiens
accuccugaccugucaccgugag

SEQ ID NO: 1555212 - RNA, 14 nt, Homo sapiens
accucugauuacau

SEQ ID NO: 1555213 - RNA, 17 nt, Homo sapiens
accucugugaccaacug

SEQ ID NO: 1555214 - RNA, 17 nt, Homo sapiens
accuucuaaaagccauu

SEQ ID NO: 1555215 - RNA, 22 nt, Homo sapiens
accuuggagaggagaguggcag

SEQ ID NO: 1555216 - RNA, 14 nt, Homo sapiens
acgcuugugacagu

SEQ ID NO: 1555217 - RNA, 13 nt, Homo sapiens
acggcaccucggg

SEQ ID NO: 1555218 - RNA, 14 nt, Homo sapiens
acgucacugcacuc

SEQ ID NO: 1555219 - RNA, 23 nt, Homo sapiens
acguuuguccuuuuucacuuuga

SEQ ID NO: 1555220 - RNA, 20 nt, Homo sapiens
acuaaacuaacaagauuaaa

SEQ ID NO: 1555221 - RNA, 14 nt, Homo sapiens
acuacaacaugcau

SEQ ID NO: 1555222 - RNA, 16 nt, Homo sapiens
acuauugagccuugca

SEQ ID NO: 1555223 - RNA, 12 nt, Homo sapiens
acucaacauguu

SEQ ID NO: 1555224 - RNA, 23 nt, Homo sapiens
acucaacauguuacugaccagca

SEQ ID NO: 1555225 - RNA, 13 nt, Homo sapiens
acucaacccauug

SEQ ID NO: 1555226 - RNA, 21 nt, Homo sapiens
acucacucaguaaaacauaau

SEQ ID NO: 1555227 - RNA, 21 nt, Homo sapiens
acucacucucccccuccucuu

SEQ ID NO: 1555228 - RNA, 11 nt, Homo sapiens
acuccaaggag

SEQ ID NO: 1555229 - RNA, 17 nt, Homo sapiens
acucuacucaacccauu

SEQ ID NO: 1555230 - RNA, 15 nt, Homo sapiens
acugaaccaguccag

SEQ ID NO: 1555231 - RNA, 17 nt, Homo sapiens
acugagucaucuuguga

SEQ ID NO: 1555232 - RNA, 16 nt, Homo sapiens
acugcaugaaugaaac

SEQ ID NO: 1555233 - RNA, 21 nt, Homo sapiens
acugccccccgaggcugcuag

SEQ ID NO: 1555234 - RNA, 22 nt, Homo sapiens
acuggaucuucuaucauuccaa

SEQ ID NO: 1555235 - RNA, 17 nt, Homo sapiens
acugguaaaaagaucca

SEQ ID NO: 1555236 - RNA, 15 nt, Homo sapiens
augacauuuauucaa

SEQ ID NO: 1555237 - RNA, 14 nt, Homo sapiens
augacccacacugc

SEQ ID NO: 1555238 - RNA, 22 nt, Homo sapiens
augacgguaaguguucucauga

SEQ ID NO: 1555239 - RNA, 18 nt, Homo sapiens
augagacauccagcagau

SEQ ID NO: 1555240 - RNA, 18 nt, Homo sapiens
augcagaaagcaucccuc

SEQ ID NO: 1555241 - RNA, 19 nt, Homo sapiens
augcagaccucaugcccag

SEQ ID NO: 1555242 - RNA, 14 nt, Homo sapiens
augcuuucccugag

SEQ ID NO: 1555243 - RNA, 22 nt, Homo sapiens
augggcagacugaaccagucca

SEQ ID NO: 1555244 - RNA, 23 nt, Homo sapiens
augggcagacugaaccaguccag

SEQ ID NO: 1555245 - RNA, 22 nt, Homo sapiens
auggucaaguucccaacugagu

SEQ ID NO: 1555246 - RNA, 16 nt, Homo sapiens
augugguacuacugua

SEQ ID NO: 1555247 - RNA, 13 nt, Homo sapiens
auguuacugacca

SEQ ID NO: 1555248 - RNA, 21 nt, Homo sapiens
auguuguguuuuuaacauguc

SEQ ID NO: 1555249 - RNA, 22 nt, Homo sapiens
auguuguguuuuuaacauguca

SEQ ID NO: 1555250 - RNA, 12 nt, Homo sapiens
auguuugcacac

SEQ ID NO: 1555251 - RNA, 19 nt, Homo sapiens
auuagaaaauuuuauggac

SEQ ID NO: 1555252 - RNA, 18 nt, Homo sapiens
auuagcuuguuaguaaug

SEQ ID NO: 1555253 - RNA, 14 nt, Homo sapiens
auuaucaagcuuuu

SEQ ID NO: 1555254 - RNA, 20 nt, Homo sapiens
auuauuugucauucauucaa

SEQ ID NO: 1555255 - RNA, 14 nt, Homo sapiens
auucccaagcuuuu

SEQ ID NO: 1555256 - RNA, 20 nt, Homo sapiens
auuccuauuggaaacagaga

SEQ ID NO: 1555257 - RNA, 20 nt, Homo sapiens
auucuaaauccgacuugaau

SEQ ID NO: 1555258 - RNA, 18 nt, Homo sapiens
auugaaauguuugcauaa

SEQ ID NO: 1555259 - RNA, 15 nt, Homo sapiens
auugacagcauauag

SEQ ID NO: 1555260 - RNA, 14 nt, Homo sapiens
auugagaacugaca

SEQ ID NO: 1555261 - RNA, 22 nt, Homo sapiens
auugagccuugcauguacuuga

SEQ ID NO: 1555262 - RNA, 15 nt, Homo sapiens
auugaggaguugccu

SEQ ID NO: 1555263 - RNA, 16 nt, Homo sapiens
auuggaacucuacuca

SEQ ID NO: 1555264 - RNA, 15 nt, Homo sapiens
auugugcaguacuuu

SEQ ID NO: 1555265 - RNA, 19 nt, Homo sapiens
auuuacuuaacagaacagu

SEQ ID NO: 1555266 - RNA, 16 nt, Homo sapiens
auuuaugaccuaaguc

SEQ ID NO: 1555267 - RNA, 20 nt, Homo sapiens
auuugguaaaaaugcugcuc

SEQ ID NO: 1555268 - RNA, 16 nt, Homo sapiens
auuuuuuguaugcuua

SEQ ID NO: 1555269 - RNA, 21 nt, Homo sapiens
caaaaaugaaagcaugucuca

SEQ ID NO: 1555270 - RNA, 23 nt, Homo sapiens
caaaaaugaaagcaugucucaau

SEQ ID NO: 1555271 - RNA, 19 nt, Homo sapiens
caaagcggagaaacauguu

SEQ ID NO: 1555272 - RNA, 13 nt, Homo sapiens
caaaggagccuug

SEQ ID NO: 1555273 - RNA, 19 nt, Homo sapiens
caaaucuaccacuguauga

SEQ ID NO: 1555274 - RNA, 15 nt, Homo sapiens
caacaugcacugaug

SEQ ID NO: 1555275 - RNA, 21 nt, Homo sapiens
caacauggcaaaaccccaucu

SEQ ID NO: 1555276 - RNA, 21 nt, Homo sapiens
caagacuccaucucaaaaaag

SEQ ID NO: 1555277 - RNA, 19 nt, Homo sapiens
caagacuuagagcugggaa

SEQ ID NO: 1555278 - RNA, 21 nt, Homo sapiens
caaggcuuugguuuccaaguc

SEQ ID NO: 1555279 - RNA, 16 nt, Homo sapiens
caagggggugacugga

SEQ ID NO: 1555280 - RNA, 19 nt, Homo sapiens
caauuaaaccgcaugugau

SEQ ID NO: 1555281 - RNA, 17 nt, Homo sapiens
cacaacauuuacuuaac

SEQ ID NO: 1555282 - RNA, 15 nt, Homo sapiens
cacaugaugugcaua

SEQ ID NO: 1555283 - RNA, 23 nt, Homo sapiens
caccaggaauccccaacaugcac

SEQ ID NO: 1555284 - RNA, 16 nt, Homo sapiens
cacccgacuccucaaa

SEQ ID NO: 1555285 - RNA, 21 nt, Homo sapiens
cacccugccaagacuccucag

SEQ ID NO: 1555286 - RNA, 20 nt, Homo sapiens
caccuagcucuaagagcaau

SEQ ID NO: 1555287 - RNA, 19 nt, Homo sapiens
cacgcaccggaguucugcc

SEQ ID NO: 1555288 - RNA, 20 nt, Homo sapiens
cacgucacugcacuccagcu

SEQ ID NO: 1555289 - RNA, 22 nt, Homo sapiens
cacucuaauauaauauggauca

SEQ ID NO: 1555290 - RNA, 16 nt, Homo sapiens
cagaaagcaucccuca

SEQ ID NO: 1555291 - RNA, 21 nt, Homo sapiens
cagaaagcaucccucacccau

SEQ ID NO: 1555292 - RNA, 14 nt, Homo sapiens
cagaagacacugca

SEQ ID NO: 1555293 - RNA, 20 nt, Homo sapiens
cagaagcuuuuuguuugcau

SEQ ID NO: 1555294 - RNA, 17 nt, Homo sapiens
cagaaguuugcaucucg

SEQ ID NO: 1555295 - RNA, 12 nt, Homo sapiens
cagaauuaugaa

SEQ ID NO: 1555296 - RNA, 19 nt, Homo sapiens
cagaauuaugaagagguau

SEQ ID NO: 1555297 - RNA, 12 nt, Homo sapiens
cagaauucccuu

SEQ ID NO: 1555298 - RNA, 16 nt, Homo sapiens
cagagugagagacauc

SEQ ID NO: 1555299 - RNA, 19 nt, Homo sapiens
cagauacacuaaaguuaca

SEQ ID NO: 1555300 - RNA, 16 nt, Homo sapiens
cagauggggucuguga

SEQ ID NO: 1555301 - RNA, 20 nt, Homo sapiens
cagauggggucugugacugg

SEQ ID NO: 1555302 - RNA, 22 nt, Homo sapiens
cagccacccguggggugcugcc

SEQ ID NO: 1555303 - RNA, 22 nt, Homo sapiens
cagccugaaagauacaggggau

SEQ ID NO: 1555304 - RNA, 16 nt, Homo sapiens
cagcuucaaaugcaaa

SEQ ID NO: 1555305 - RNA, 19 nt, Homo sapiens
caggaacacccgacuccuc

SEQ ID NO: 1555306 - RNA, 19 nt, Homo sapiens
caggaauccccaacaugca

SEQ ID NO: 1555307 - RNA, 19 nt, Homo sapiens
caggcaguuaggugcugaa

SEQ ID NO: 1555308 - RNA, 24 nt, Homo sapiens
cagggaaaugggcagacugaacca

SEQ ID NO: 1555309 - RNA, 14 nt, Homo sapiens
cagggcacuacaua

SEQ ID NO: 1555310 - RNA, 23 nt, Homo sapiens
cagggcacuacauaauugcuguu

SEQ ID NO: 1555311 - RNA, 15 nt, Homo sapiens
caggggaucauguua

SEQ ID NO: 1555312 - RNA, 22 nt, Homo sapiens
cagguggugaauuuuccaagaa

SEQ ID NO: 1555313 - RNA, 21 nt, Homo sapiens
caguaccaaaguaacugaauu

SEQ ID NO: 1555314 - RNA, 22 nt, Homo sapiens
cagucccuggagcuguccuuca

SEQ ID NO: 1555315 - RNA, 14 nt, Homo sapiens
caguuaggugcuga

SEQ ID NO: 1555316 - RNA, 17 nt, Homo sapiens
caguucuacacugauac

SEQ ID NO: 1555317 - RNA, 21 nt, Homo sapiens
caguugagagggugcagucca

SEQ ID NO: 1555318 - RNA, 20 nt, Homo sapiens
caguuuuaccucuucucucu

SEQ ID NO: 1555319 - RNA, 17 nt, Homo sapiens
cauacuuugacaaggaa

SEQ ID NO: 1555320 - RNA, 19 nt, Homo sapiens
cauagcauagccagcauuc

SEQ ID NO: 1555321 - RNA, 15 nt, Homo sapiens
cauauagacuauaua

SEQ ID NO: 1555322 - RNA, 22 nt, Homo sapiens
caucaaguaugugguacuacug

SEQ ID NO: 1555323 - RNA, 22 nt, Homo sapiens
caucauuuaacugaacugugaa

SEQ ID NO: 1555324 - RNA, 23 nt, Homo sapiens
caucauuuaacugaacugugaac

SEQ ID NO: 1555325 - RNA, 21 nt, Homo sapiens
caugcugugugcuggagacac

SEQ ID NO: 1555326 - RNA, 13 nt, Homo sapiens
cauguacuugaag

SEQ ID NO: 1555327 - RNA, 15 nt, Homo sapiens
caugucagacuguac

SEQ ID NO: 1555328 - RNA, 17 nt, Homo sapiens
cauguuacugaccagca

SEQ ID NO: 1555329 - RNA, 16 nt, Homo sapiens
cauguuuaaauagccu

SEQ ID NO: 1555330 - RNA, 12 nt, Homo sapiens
cauuaagcacac

SEQ ID NO: 1555331 - RNA, 16 nt, Homo sapiens
cauuaauaaaguugcu

SEQ ID NO: 1555332 - RNA, 15 nt, Homo sapiens
cauuauuagcacuuc

SEQ ID NO: 1555333 - RNA, 18 nt, Homo sapiens
cauuguggacuguaucca

SEQ ID NO: 1555334 - RNA, 12 nt, Homo sapiens
cauuuacuuaac

SEQ ID NO: 1555335 - RNA, 23 nt, Homo sapiens
cauuuacuuaacagaacagucac

SEQ ID NO: 1555336 - RNA, 16 nt, Homo sapiens
cauuugcuaguucugc

SEQ ID NO: 1555337 - RNA, 11 nt, Homo sapiens
cauuuggucuc

SEQ ID NO: 1555338 - RNA, 14 nt, Homo sapiens
cauuuggucucagg

SEQ ID NO: 1555339 - RNA, 14 nt, Homo sapiens
ccaaccuccugacc

SEQ ID NO: 1555340 - RNA, 19 nt, Homo sapiens
ccaagggggugacuggaag

SEQ ID NO: 1555341 - RNA, 16 nt, Homo sapiens
ccaaguaugccuuaag

SEQ ID NO: 1555342 - RNA, 23 nt, Homo sapiens
ccaauucuaaauccgacuugaau

SEQ ID NO: 1555343 - RNA, 23 nt, Homo sapiens
ccaauuugguaaaaaugcugcuc

SEQ ID NO: 1555344 - RNA, 13 nt, Homo sapiens
ccaccaccaggac

SEQ ID NO: 1555345 - RNA, 17 nt, Homo sapiens
ccacccccgccaugcaa

SEQ ID NO: 1555346 - RNA, 14 nt, Homo sapiens
ccacuguaugagug

SEQ ID NO: 1555347 - RNA, 19 nt, Homo sapiens
ccagagguggauguuauga

SEQ ID NO: 1555348 - RNA, 22 nt, Homo sapiens
ccagaggugucgggacaugguu

SEQ ID NO: 1555349 - RNA, 14 nt, Homo sapiens
ccagccaguacagu

SEQ ID NO: 1555350 - RNA, 13 nt, Homo sapiens
ccaggaaugccuc

SEQ ID NO: 1555351 - RNA, 20 nt, Homo sapiens
ccagggugggaagagaagaa

SEQ ID NO: 1555352 - RNA, 15 nt, Homo sapiens
ccagguggugaauuu

SEQ ID NO: 1555353 - RNA, 14 nt, Homo sapiens
ccaguaaagccuua

SEQ ID NO: 1555354 - RNA, 18 nt, Homo sapiens
ccaucccuaccacugugg

SEQ ID NO: 1555355 - RNA, 22 nt, Homo sapiens
gugagcuggauagacuugggau

SEQ ID NO: 1555356 - RNA, 12 nt, Homo sapiens
guggacugugau

SEQ ID NO: 1555357 - RNA, 20 nt, Homo sapiens
guggauaugacccacacugc

SEQ ID NO: 1555358 - RNA, 20 nt, Homo sapiens
guguaacccccaguucaaga

SEQ ID NO: 1555359 - RNA, 24 nt, Homo sapiens
guguugauaagcugcacaugacua

SEQ ID NO: 1555360 - RNA, 16 nt, Homo sapiens
guguuuuuaacauguc

SEQ ID NO: 1555361 - RNA, 14 nt, Homo sapiens
guuaaauauuguca

SEQ ID NO: 1555362 - RNA, 23 nt, Homo sapiens
guuaagaguccuuuugaauuaaa

SEQ ID NO: 1555363 - RNA, 18 nt, Homo sapiens
guuauaauuacuaaugua

SEQ ID NO: 1555364 - RNA, 18 nt, Homo sapiens
guucaagacuuagcuccu

SEQ ID NO: 1555365 - RNA, 13 nt, Homo sapiens
guugcuauccugc

SEQ ID NO: 1555366 - RNA, 15 nt, Homo sapiens
guuuauguagucagu

SEQ ID NO: 1555367 - RNA, 21 nt, Homo sapiens
guuuguccuuuuucacuuuga

SEQ ID NO: 1555368 - RNA, 15 nt, Homo sapiens
uaaaaaugcugcucu

SEQ ID NO: 1555369 - RNA, 15 nt, Homo sapiens
uaaaauuaguuuuaa

SEQ ID NO: 1555370 - RNA, 19 nt, Homo sapiens
uaaacacauguucugugcc

SEQ ID NO: 1555371 - RNA, 19 nt, Homo sapiens
uaaaccgcaugugaucucc

SEQ ID NO: 1555372 - RNA, 15 nt, Homo sapiens
uaaaguacaucucua

SEQ ID NO: 1555373 - RNA, 21 nt, Homo sapiens
uaaauccuuuucccauaaaua

SEQ ID NO: 1555374 - RNA, 14 nt, Homo sapiens
uaaauuauugcugu

SEQ ID NO: 1555375 - RNA, 10 nt, Homo sapiens
uaacagaauu

SEQ ID NO: 1555376 - RNA, 14 nt, Homo sapiens
uaacgacuucaggg

SEQ ID NO: 1555377 - RNA, 15 nt, Homo sapiens
uaacugaacugugaa

SEQ ID NO: 1555378 - RNA, 19 nt, Homo sapiens
uaagaggugaucucuggga

SEQ ID NO: 1555379 - RNA, 14 nt, Homo sapiens
uaagauuuuccauu

SEQ ID NO: 1555380 - RNA, 15 nt, Homo sapiens
uaagcauaaaagauc

SEQ ID NO: 1555381 - RNA, 15 nt, Homo sapiens
uaaugagacaugaau

SEQ ID NO: 1555382 - RNA, 22 nt, Homo sapiens
uaauguauuugugcacauguac

SEQ ID NO: 1555383 - RNA, 21 nt, Homo sapiens
uaauuacuaauguacgcugcu

SEQ ID NO: 1555384 - RNA, 18 nt, Homo sapiens
uacacuaaaguuacaaac

SEQ ID NO: 1555385 - RNA, 14 nt, Homo sapiens
uacagggcuaggca

SEQ ID NO: 1555386 - RNA, 19 nt, Homo sapiens
uacaguauguuuuacaugu

SEQ ID NO: 1555387 - RNA, 19 nt, Homo sapiens
uacauaauugcuguucugc

SEQ ID NO: 1555388 - RNA, 17 nt, Homo sapiens
uacaucagaaguuugca

SEQ ID NO: 1555389 - RNA, 17 nt, Homo sapiens
uacaucucuacuaaaaa

SEQ ID NO: 1555390 - RNA, 11 nt, Homo sapiens
uacauguuaag

SEQ ID NO: 1555391 - RNA, 18 nt, Homo sapiens
uacauuugugaacaaaaa

SEQ ID NO: 1555392 - RNA, 14 nt, Homo sapiens
uaccaaacaaggaa

SEQ ID NO: 1555393 - RNA, 13 nt, Homo sapiens
uaccuaaggacaa

SEQ ID NO: 1555394 - RNA, 18 nt, Homo sapiens
uaccucuucucucucagu

SEQ ID NO: 1555395 - RNA, 14 nt, Homo sapiens
uaccugguuuacuu

SEQ ID NO: 1555396 - RNA, 16 nt, Homo sapiens
uacgcugcugcaggac

SEQ ID NO: 1555397 - RNA, 13 nt, Homo sapiens
uacuguacuuaau

SEQ ID NO: 1555398 - RNA, 23 nt, Homo sapiens
uacuugaaggauggaugagucag

SEQ ID NO: 1555399 - RNA, 14 nt, Homo sapiens
uagaaaaucugagu

SEQ ID NO: 1555400 - RNA, 22 nt, Homo sapiens
uagaaguagcaaaaaguauuga

SEQ ID NO: 1555401 - RNA, 19 nt, Homo sapiens
uagacagguguuacuuaca

SEQ ID NO: 1555402 - RNA, 18 nt, Homo sapiens
uagagauagcuacagugu

SEQ ID NO: 1555403 - RNA, 13 nt, Homo sapiens
uagagcugggaau

SEQ ID NO: 1555404 - RNA, 18 nt, Homo sapiens
uagagcugggaaucuuuu

SEQ ID NO: 1555405 - RNA, 14 nt, Homo sapiens
uagagucaucucca

SEQ ID NO: 1555406 - RNA, 14 nt, Homo sapiens
uagcuccuguuguc

SEQ ID NO: 1555407 - RNA, 17 nt, Homo sapiens
uagcucuggaccugucu

SEQ ID NO: 1555408 - RNA, 20 nt, Homo sapiens
uagcuuguuaguaaugcucu

SEQ ID NO: 1555409 - RNA, 18 nt, Homo sapiens
uagugucuauuaucacau

SEQ ID NO: 1555410 - RNA, 14 nt, Homo sapiens
uauaaauuauaucc

SEQ ID NO: 1555411 - RNA, 16 nt, Homo sapiens
uauaaauuuaagcaaa

SEQ ID NO: 1555412 - RNA, 21 nt, Homo sapiens
uauaaauuuuauaacagaauu

SEQ ID NO: 1555413 - RNA, 15 nt, Homo sapiens
uauacuguacuuaau

SEQ ID NO: 1555414 - RNA, 20 nt, Homo sapiens
uaucugcuauaaacuuuaca

SEQ ID NO: 1555415 - RNA, 17 nt, Homo sapiens
uaucuuugugugacaug

SEQ ID NO: 1555416 - RNA, 14 nt, Homo sapiens
uaugaccuaaguca

SEQ ID NO: 1555417 - RNA, 20 nt, Homo sapiens
uauggacaguaaguccagua

SEQ ID NO: 1555418 - RNA, 23 nt, Homo sapiens
uauugucauaggauuaagcaguu

SEQ ID NO: 1555419 - RNA, 11 nt, Homo sapiens
uauuugucauu

SEQ ID NO: 1555420 - RNA, 14 nt, Homo sapiens
ucaaagaagacuca

SEQ ID NO: 1555421 - RNA, 18 nt, Homo sapiens
ucaacccauuguugucaa

SEQ ID NO: 1555422 - RNA, 16 nt, Homo sapiens
ucaauaaaaugugauu

SEQ ID NO: 1555423 - RNA, 18 nt, Homo sapiens
ucagaaguuugcaucucg

SEQ ID NO: 1555424 - RNA, 18 nt, Homo sapiens
ucagauugacagcauaua

SEQ ID NO: 1555425 - RNA, 19 nt, Homo sapiens
ucaggaaaaaugaggaauc

SEQ ID NO: 1555426 - RNA, 21 nt, Homo sapiens
ucaggaaggucuucaaucuua

SEQ ID NO: 1555427 - RNA, 18 nt, Homo sapiens
ucagggcagggcucugau

SEQ ID NO: 1555428 - RNA, 21 nt, Homo sapiens
ucaguaaaacauaauguauca

SEQ ID NO: 1555429 - RNA, 16 nt, Homo sapiens
ucaguucuacacugau

SEQ ID NO: 1555430 - RNA, 16 nt, Homo sapiens
ucaguuucacuuucac

SEQ ID NO: 1555431 - RNA, 11 nt, Homo sapiens
ucauaaccaaa

SEQ ID NO: 1555432 - RNA, 14 nt, Homo sapiens
ucauaaccaaagag

SEQ ID NO: 1555433 - RNA, 18 nt, Homo sapiens
ucauucauucaaguaaua

SEQ ID NO: 1555434 - RNA, 12 nt, Homo sapiens
ucauuugaacaa

SEQ ID NO: 1555435 - RNA, 13 nt, Homo sapiens
uccaaaagacaaa

SEQ ID NO: 1555436 - RNA, 20 nt, Homo sapiens
uccagcuugggcaacagagc

SEQ ID NO: 1555437 - RNA, 14 nt, Homo sapiens
uccaugaauguauc

SEQ ID NO: 1555438 - RNA, 16 nt, Homo sapiens
ucccaaguaugccuua

SEQ ID NO: 1555439 - RNA, 15 nt, Homo sapiens
ucccacauuagcuug

SEQ ID NO: 1555440 - RNA, 12 nt, Homo sapiens
ucccagcccagc

SEQ ID NO: 1555441 - RNA, 15 nt, Homo sapiens
uccccaacaugcacu

SEQ ID NO: 1555442 - RNA, 16 nt, Homo sapiens
uccccucucagaacau

SEQ ID NO: 1555443 - RNA, 16 nt, Homo sapiens
ucccggguguguacac

SEQ ID NO: 1555444 - RNA, 16 nt, Homo sapiens
ucccuuucuuggccag

SEQ ID NO: 1555445 - RNA, 15 nt, Homo sapiens
uccgaucaacauuua

SEQ ID NO: 1555446 - RNA, 17 nt, Homo sapiens
uccggaggcugaggcag

SEQ ID NO: 1555447 - RNA, 18 nt, Homo sapiens
uccgugcuuaaccaaaga

SEQ ID NO: 1555448 - RNA, 20 nt, Homo sapiens
uccguucacaugugugguac

SEQ ID NO: 1555449 - RNA, 23 nt, Homo sapiens
ucuaaauccgacuugaauauucc

SEQ ID NO: 1555450 - RNA, 18 nt, Homo sapiens
ucuagauuauaaacugac

SEQ ID NO: 1555451 - RNA, 15 nt, Homo sapiens
ucuaggacugcagug

SEQ ID NO: 1555452 - RNA, 11 nt, Homo sapiens
ucuauguuaau

SEQ ID NO: 1555453 - RNA, 14 nt, Homo sapiens
ucucaauaguaaaa

SEQ ID NO: 1555454 - RNA, 23 nt, Homo sapiens
ucucccaacaugggagggaucag

SEQ ID NO: 1555455 - RNA, 22 nt, Homo sapiens
ucucccagcuucaaaugcaaau

SEQ ID NO: 1555456 - RNA, 16 nt, Homo sapiens
ucucucaguucuacac

SEQ ID NO: 1555457 - RNA, 18 nt, Homo sapiens
ucucugacgcuugugaca

SEQ ID NO: 1555458 - RNA, 16 nt, Homo sapiens
ucucuggagggacaaa

SEQ ID NO: 1555459 - RNA, 15 nt, Homo sapiens
ucugaagacagucuu

SEQ ID NO: 1555460 - RNA, 19 nt, Homo sapiens
ucugacgcuugugacagug

SEQ ID NO: 1555461 - RNA, 18 nt, Homo sapiens
ucugcccugccugaggag

SEQ ID NO: 1555462 - RNA, 14 nt, Homo sapiens
ucugcuauaaacuu

SEQ ID NO: 1555463 - RNA, 14 nt, Homo sapiens
ucuguuuaacauuu

SEQ ID NO: 1555464 - RNA, 12 nt, Homo sapiens
ucuucaagagcu

SEQ ID NO: 1555465 - RNA, 19 nt, Homo sapiens
ucuugggucccccacguga

SEQ ID NO: 1555466 - RNA, 18 nt, Homo sapiens
ucuuuauguccauaagcu

SEQ ID NO: 1555467 - RNA, 15 nt, Homo sapiens
ucuuugugugacaug

SEQ ID NO: 1555468 - RNA, 17 nt, Homo sapiens
ucuuuuuuugagugaca

SEQ ID NO: 1555469 - RNA, 17 nt, Homo sapiens
ugaaaaacuaauugagc

SEQ ID NO: 1555470 - RNA, 19 nt, Homo sapiens
ugaaacaaauuuacaucag

SEQ ID NO: 1555471 - RNA, 17 nt, Homo sapiens
ugaaauguuugcauaaa

SEQ ID NO: 1555472 - RNA, 23 nt, Homo sapiens
ugaacauuuugcaaaacuuauca

SEQ ID NO: 1555473 - RNA, 21 nt, Homo sapiens
ugaaggcaaaaacuguacugu

SEQ ID NO: 1555474 - RNA, 14 nt, Homo sapiens
ugaauacuugcuau

SEQ ID NO: 1555475 - RNA, 18 nt, Homo sapiens
ugaaugcacacuagccuc

SEQ ID NO: 1555476 - RNA, 15 nt, Homo sapiens
ugaucaggcacagug

SEQ ID NO: 1555477 - RNA, 15 nt, Homo sapiens
ugaucagguaacuuu

SEQ ID NO: 1555478 - RNA, 17 nt, Homo sapiens
ugaucagugggccucca

SEQ ID NO: 1555479 - RNA, 15 nt, Homo sapiens
ugauccuugcugaua

SEQ ID NO: 1555480 - RNA, 15 nt, Homo sapiens
ugaucuacuugccuc

SEQ ID NO: 1555481 - RNA, 22 nt, Homo sapiens
ugaucugcccccacuguccugu

SEQ ID NO: 1555482 - RNA, 12 nt, Homo sapiens
ugaucugggcau

SEQ ID NO: 1555483 - RNA, 19 nt, Homo sapiens
ugaucuuaauauauuugaa

SEQ ID NO: 1555484 - RNA, 19 nt, Homo sapiens
ugaucuuucucaaucuuga

SEQ ID NO: 1555485 - RNA, 20 nt, Homo sapiens
ugaucuuuguuuaaaugcca

SEQ ID NO: 1555486 - RNA, 20 nt, Homo sapiens
ugaugaauguacuaugucug

SEQ ID NO: 1555487 - RNA, 19 nt, Homo sapiens
ugaugacaggucagcagua

SEQ ID NO: 1555488 - RNA, 14 nt, Homo sapiens
ugaugacuuacuau

SEQ ID NO: 1555489 - RNA, 19 nt, Homo sapiens
ugaugagaauuguauguca

SEQ ID NO: 1555490 - RNA, 13 nt, Homo sapiens
ugaugaugcaguu

SEQ ID NO: 1555491 - RNA, 16 nt, Homo sapiens
ugaugcaagccagcuu

SEQ ID NO: 1555492 - RNA, 14 nt, Homo sapiens
ugaugcauugaccu

SEQ ID NO: 1555493 - RNA, 13 nt, Homo sapiens
ugaugccauguaa

SEQ ID NO: 1555494 - RNA, 22 nt, Homo sapiens
ugaugccuuuauaaaucuuucu

SEQ ID NO: 1555495 - RNA, 12 nt, Homo sapiens
ugaugcuagcca

SEQ ID NO: 1555496 - RNA, 13 nt, Homo sapiens
ugaugcucaaaau

SEQ ID NO: 1555497 - RNA, 23 nt, Homo sapiens
ugaugcucccuccccugcccugg

SEQ ID NO: 1555498 - RNA, 21 nt, Homo sapiens
ugaugcuggggacacagcauc

SEQ ID NO: 1555499 - RNA, 20 nt, Homo sapiens
ugaugcuguggagccuuagu

SEQ ID NO: 1555500 - RNA, 19 nt, Homo sapiens
ugaugcuuagauguuccag

SEQ ID NO: 1555501 - RNA, 18 nt, Homo sapiens
ugauggagaggacagagc

SEQ ID NO: 1555502 - RNA, 21 nt, Homo sapiens
ugauggaguuccuucuggugu

SEQ ID NO: 1555503 - RNA, 20 nt, Homo sapiens
ugaugggccacaacugucuu

SEQ ID NO: 1555504 - RNA, 22 nt, Homo sapiens
ugaugguauaaacaggagacag

SEQ ID NO: 1555505 - RNA, 22 nt, Homo sapiens
ugauguaaaaaugaaaagccaa

SEQ ID NO: 1555506 - RNA, 14 nt, Homo sapiens
ugauguacauuaca

SEQ ID NO: 1555507 - RNA, 19 nt, Homo sapiens
ugauguauuguugcuuuuu

SEQ ID NO: 1555508 - RNA, 19 nt, Homo sapiens
ugaugugaaacacuuugcc

SEQ ID NO: 1555509 - RNA, 20 nt, Homo sapiens
ugaugugaaacacuuugccu

SEQ ID NO: 1555510 - RNA, 13 nt, Homo sapiens
ugaugugggagcu

SEQ ID NO: 1555511 - RNA, 16 nt, Homo sapiens
ugauguguccucaggg

SEQ ID NO: 1555512 - RNA, 18 nt, Homo sapiens
ugauguguccucagggag

SEQ ID NO: 1555513 - RNA, 17 nt, Homo sapiens
ugauuaaaauucaggaa

SEQ ID NO: 1555514 - RNA, 21 nt, Homo sapiens
ugauuaccagucugauuauac

SEQ ID NO: 1555515 - RNA, 23 nt, Homo sapiens
ugauuauauggguauauauucau

SEQ ID NO: 1555516 - RNA, 16 nt, Homo sapiens
ugauuauauucacaga

SEQ ID NO: 1555517 - RNA, 21 nt, Homo sapiens
ugauuauccauauugagucaa

SEQ ID NO: 1555518 - RNA, 22 nt, Homo sapiens
ugauuaucucuuugaucuacuu

SEQ ID NO: 1555519 - RNA, 21 nt, Homo sapiens
ugauucagccaaaugcaggga

SEQ ID NO: 1555520 - RNA, 13 nt, Homo sapiens
ugauuccagaaca

SEQ ID NO: 1555521 - RNA, 14 nt, Homo sapiens
ugauuccauuuuaa

SEQ ID NO: 1555522 - RNA, 23 nt, Homo sapiens
ugauugagaagaggacauuggag

SEQ ID NO: 1555523 - RNA, 17 nt, Homo sapiens
ugauugcuuaccuacau

SEQ ID NO: 1555524 - RNA, 19 nt, Homo sapiens
ugauuggccacacacugag

SEQ ID NO: 1555525 - RNA, 21 nt, Homo sapiens
ugauuggccacacacugaguu

SEQ ID NO: 1555526 - RNA, 15 nt, Homo sapiens
ugauuguguagccau

SEQ ID NO: 1555527 - RNA, 18 nt, Homo sapiens
ugauuguugucaggccau

SEQ ID NO: 1555528 - RNA, 20 nt, Homo sapiens
ugauuuaccacuuaugcaua

SEQ ID NO: 1555529 - RNA, 15 nt, Homo sapiens
ugauuuaucuuucaa

SEQ ID NO: 1555530 - RNA, 15 nt, Homo sapiens
ugauuucacagugug

SEQ ID NO: 1555531 - RNA, 15 nt, Homo sapiens
ugauuucagacugca

SEQ ID NO: 1555532 - RNA, 17 nt, Homo sapiens
ugauuucagacugcaga

SEQ ID NO: 1555533 - RNA, 18 nt, Homo sapiens
ugauuucuuucuuugcac

SEQ ID NO: 1555534 - RNA, 21 nt, Homo sapiens
ugauuuuuucuuuugcuuuau

SEQ ID NO: 1555535 - RNA, 22 nt, Homo sapiens
ugcaaaaggacucucaggacca

SEQ ID NO: 1555536 - RNA, 16 nt, Homo sapiens
ugcaaaauguguuuca

SEQ ID NO: 1555537 - RNA, 22 nt, Homo sapiens
ugcaaacaguaacgugugcgca

SEQ ID NO: 1555538 - RNA, 14 nt, Homo sapiens
ugcaaacaucuuca

SEQ ID NO: 1555539 - RNA, 15 nt, Homo sapiens
ugcaaaccucaucuu

SEQ ID NO: 1555540 - RNA, 23 nt, Homo sapiens
ugcaaaccuuccugggaggacag

SEQ ID NO: 1555541 - RNA, 16 nt, Homo sapiens
ugcaaacugcuuuauu

SEQ ID NO: 1555542 - RNA, 20 nt, Homo sapiens
ugcaaaguacuguaagaaua

SEQ ID NO: 1555543 - RNA, 19 nt, Homo sapiens
ugcaaauacuguauauuca

SEQ ID NO: 1555544 - RNA, 21 nt, Homo sapiens
ugcaaauauugguuaguauuu

SEQ ID NO: 1555545 - RNA, 21 nt, Homo sapiens
ugcaacaauaaaguacuuuac

SEQ ID NO: 1555546 - RNA, 21 nt, Homo sapiens
ugcaacacuggucugcuguuc

SEQ ID NO: 1555547 - RNA, 19 nt, Homo sapiens
ugcaacaggcuugugcaac

SEQ ID NO: 1555548 - RNA, 13 nt, Homo sapiens
ugcaaccaggaac

SEQ ID NO: 1555549 - RNA, 17 nt, Homo sapiens
ugcaaccucugccuccc

SEQ ID NO: 1555550 - RNA, 20 nt, Homo sapiens
ugcaacucuuuuaagugccu

SEQ ID NO: 1555551 - RNA, 18 nt, Homo sapiens
ugcaacuggaguuccuua

SEQ ID NO: 1555552 - RNA, 22 nt, Homo sapiens
ugcaacugggucugacaugaac

SEQ ID NO: 1555553 - RNA, 16 nt, Homo sapiens
ugcaagaagcuuuauu

SEQ ID NO: 1555554 - RNA, 14 nt, Homo sapiens
ugcaagaaggauac

SEQ ID NO: 1555555 - RNA, 16 nt, Homo sapiens
ugcaagaaugaaauga

SEQ ID NO: 1555556 - RNA, 18 nt, Homo sapiens
ugcaagaguggacugaau

SEQ ID NO: 1555557 - RNA, 16 nt, Homo sapiens
ugcaagcacucggggu

SEQ ID NO: 1555558 - RNA, 19 nt, Homo sapiens
ugcaauaaaauuauuugca

SEQ ID NO: 1555559 - RNA, 19 nt, Homo sapiens
ugcaauauagagacugugu

SEQ ID NO: 1555560 - RNA, 17 nt, Homo sapiens
ugcaauccaaugcacug

SEQ ID NO: 1555561 - RNA, 16 nt, Homo sapiens
ugcaauccaggcuguu

SEQ ID NO: 1555562 - RNA, 12 nt, Homo sapiens
ugcaaucuucua

SEQ ID NO: 1555563 - RNA, 15 nt, Homo sapiens
ugcaaucuucuacuu

SEQ ID NO: 1555564 - RNA, 16 nt, Homo sapiens
ugcaauguaagcauac

SEQ ID NO: 1555565 - RNA, 13 nt, Homo sapiens
ugcaauguaguca

SEQ ID NO: 1555566 - RNA, 17 nt, Homo sapiens
ugcaaugugaucuaugu

SEQ ID NO: 1555567 - RNA, 14 nt, Homo sapiens
ugcaauguuuuaga

SEQ ID NO: 1555568 - RNA, 14 nt, Homo sapiens
ugcaauuccaagaa

SEQ ID NO: 1555569 - RNA, 12 nt, Homo sapiens
ugcaauuccacu

SEQ ID NO: 1555570 - RNA, 19 nt, Homo sapiens
ugcaauugacauaggcaau

SEQ ID NO: 1555571 - RNA, 21 nt, Homo sapiens
ugcaauuucauuuaaacuucu

SEQ ID NO: 1555572 - RNA, 21 nt, Homo sapiens
ugcacaccuuggaauucgcuu

SEQ ID NO: 1555573 - RNA, 13 nt, Homo sapiens
ugcacacuuugcc

SEQ ID NO: 1555574 - RNA, 14 nt, Homo sapiens
ugcacacuuugcca

SEQ ID NO: 1555575 - RNA, 19 nt, Homo sapiens
ugcacagccaacgagacac

SEQ ID NO: 1555576 - RNA, 18 nt, Homo sapiens
ugcacaucuacaugccau

SEQ ID NO: 1555577 - RNA, 12 nt, Homo sapiens
ugcaccacugca

SEQ ID NO: 1555578 - RNA, 17 nt, Homo sapiens
ugcaccagcgaagaauu

SEQ ID NO: 1555579 - RNA, 18 nt, Homo sapiens
ugcacccaucagcacucu

SEQ ID NO: 1555580 - RNA, 19 nt, Homo sapiens
ugcacccaucagcacucug

SEQ ID NO: 1555581 - RNA, 20 nt, Homo sapiens
ugcacccaucagcacucugu

SEQ ID NO: 1555582 - RNA, 21 nt, Homo sapiens
ugcacccaucagcacucugua

SEQ ID NO: 1555583 - RNA, 17 nt, Homo sapiens
ugcaccccagcauucca

SEQ ID NO: 1555584 - RNA, 21 nt, Homo sapiens
ugcaccuacgggggcaucuga

SEQ ID NO: 1555585 - RNA, 20 nt, Homo sapiens
ugcaccuaucucagccauag

SEQ ID NO: 1555586 - RNA, 16 nt, Homo sapiens
ugcaccuguaauccca

SEQ ID NO: 1555587 - RNA, 17 nt, Homo sapiens
ugcacgucaccaaguaa

SEQ ID NO: 1555588 - RNA, 14 nt, Homo sapiens
ugcacuaacagagu

SEQ ID NO: 1555589 - RNA, 20 nt, Homo sapiens
ugcacuccagccugagcgac

SEQ ID NO: 1555590 - RNA, 19 nt, Homo sapiens
ugcacuccagccugggcaa

SEQ ID NO: 1555591 - RNA, 15 nt, Homo sapiens
ugcacucccaccuga

SEQ ID NO: 1555592 - RNA, 14 nt, Homo sapiens
ugcacuggggccac

SEQ ID NO: 1555593 - RNA, 17 nt, Homo sapiens
ugcacuuauuugucaaa

SEQ ID NO: 1555594 - RNA, 14 nt, Homo sapiens
ugccucagcuuccc

SEQ ID NO: 1555595 - RNA, 20 nt, Homo sapiens
ugccucaggccaagggacca

SEQ ID NO: 1555596 - RNA, 16 nt, Homo sapiens
ugccucccagguucca

SEQ ID NO: 1555597 - RNA, 22 nt, Homo sapiens
ugccucccuggcagcacaggaa

SEQ ID NO: 1555598 - RNA, 16 nt, Homo sapiens
ugccucuccugggaca

SEQ ID NO: 1555599 - RNA, 12 nt, Homo sapiens
ugccucugcucc

SEQ ID NO: 1555600 - RNA, 16 nt, Homo sapiens
ugccugaacuccagag

SEQ ID NO: 1555601 - RNA, 13 nt, Homo sapiens
ugccugacauuug

SEQ ID NO: 1555602 - RNA, 23 nt, Homo sapiens
ugccugagaccaggguggccaca

SEQ ID NO: 1555603 - RNA, 18 nt, Homo sapiens
ugccugcuuacacccugc

SEQ ID NO: 1555604 - RNA, 17 nt, Homo sapiens
ugccugcuucuuuccag

SEQ ID NO: 1555605 - RNA, 16 nt, Homo sapiens
ugccuggacacuguac

SEQ ID NO: 1555606 - RNA, 13 nt, Homo sapiens
ugccuggagacau

SEQ ID NO: 1555607 - RNA, 23 nt, Homo sapiens
ugccugggagaguggaccugugc

SEQ ID NO: 1555608 - RNA, 17 nt, Homo sapiens
ugccugguccagugggg

SEQ ID NO: 1555609 - RNA, 13 nt, Homo sapiens
ugccugguuuuau

SEQ ID NO: 1555610 - RNA, 14 nt, Homo sapiens
ugccuguaauccca

SEQ ID NO: 1555611 - RNA, 15 nt, Homo sapiens
ugccuguagucucag

SEQ ID NO: 1555612 - RNA, 17 nt, Homo sapiens
ugccugugagcaugggg

SEQ ID NO: 1555613 - RNA, 18 nt, Homo sapiens
ugccugugccuuuugcca

SEQ ID NO: 1555614 - RNA, 13 nt, Homo sapiens
ugccugugcuaca

SEQ ID NO: 1555615 - RNA, 18 nt, Homo sapiens
ugccugugcuacaauuca

SEQ ID NO: 1555616 - RNA, 18 nt, Homo sapiens
ugccuuaaaaccaaagag

SEQ ID NO: 1555617 - RNA, 14 nt, Homo sapiens
ugccuuaguguccu

SEQ ID NO: 1555618 - RNA, 15 nt, Homo sapiens
ugccuucaccuccuc

SEQ ID NO: 1555619 - RNA, 16 nt, Homo sapiens
ugccuucacugggcca

SEQ ID NO: 1555620 - RNA, 13 nt, Homo sapiens
ugccuucucagga

SEQ ID NO: 1555621 - RNA, 15 nt, Homo sapiens
ugccuucucaggaaa

SEQ ID NO: 1555622 - RNA, 13 nt, Homo sapiens
ugccuucuccuau

SEQ ID NO: 1555623 - RNA, 21 nt, Homo sapiens
ugccuucuccuauuucuccaa

SEQ ID NO: 1555624 - RNA, 22 nt, Homo sapiens
ugccuuggaggaaaugugcuca

SEQ ID NO: 1555625 - RNA, 21 nt, Homo sapiens
ugccuuggaugagaagugucu

SEQ ID NO: 1555626 - RNA, 16 nt, Homo sapiens
ugccuuggugugcugu

SEQ ID NO: 1555627 - RNA, 16 nt, Homo sapiens
ugccuuugauguggau

SEQ ID NO: 1555628 - RNA, 13 nt, Homo sapiens
ugccuuuugcaac

SEQ ID NO: 1555629 - RNA, 22 nt, Homo sapiens
ugccuuuuuguuuguacugguu

SEQ ID NO: 1555630 - RNA, 14 nt, Homo sapiens
ugcgaacagcaaac

SEQ ID NO: 1555631 - RNA, 15 nt, Homo sapiens
ugcgaggacaucaaa

SEQ ID NO: 1555632 - RNA, 18 nt, Homo sapiens
ugcgagggaagcaauuga

SEQ ID NO: 1555633 - RNA, 18 nt, Homo sapiens
ugcgcaaugagacuacaa

SEQ ID NO: 1555634 - RNA, 16 nt, Homo sapiens
ugcgccaaucccgcca

SEQ ID NO: 1555635 - RNA, 22 nt, Homo sapiens
ugcgccuguacucccagcacuu

SEQ ID NO: 1555636 - RNA, 15 nt, Homo sapiens
ugcgcucccaccuca

SEQ ID NO: 1555637 - RNA, 20 nt, Homo sapiens
ugcgcuguggacacugagaa

SEQ ID NO: 1555638 - RNA, 21 nt, Homo sapiens
ugcgcuguggacacugagaac

SEQ ID NO: 1555639 - RNA, 23 nt, Homo sapiens
ugcgugggugugugcguguuugg

SEQ ID NO: 1555640 - RNA, 22 nt, Homo sapiens
ugcuaaacuguugggaaagcuc

SEQ ID NO: 1555641 - RNA, 20 nt, Homo sapiens
ugcuaaagggagaaaugcca

SEQ ID NO: 1555642 - RNA, 17 nt, Homo sapiens
ugcuaaggcuccuccuu

SEQ ID NO: 1555643 - RNA, 18 nt, Homo sapiens
ugcuacaaaaacacagca

SEQ ID NO: 1555644 - RNA, 17 nt, Homo sapiens
ugcuacauauaugcaau

SEQ ID NO: 1555645 - RNA, 14 nt, Homo sapiens
ugcuaccaucucau

SEQ ID NO: 1555646 - RNA, 22 nt, Homo sapiens
ugcuacugagucacacaaggga

SEQ ID NO: 1555647 - RNA, 12 nt, Homo sapiens
ugcuacugcacu

SEQ ID NO: 1555648 - RNA, 22 nt, Homo sapiens
ugcuacuucacugucaucuuca

SEQ ID NO: 1555649 - RNA, 19 nt, Homo sapiens
ugcuaggaugaagcccuaa

SEQ ID NO: 1555650 - RNA, 18 nt, Homo sapiens
ugcuaggggcuguugcau

SEQ ID NO: 1555651 - RNA, 14 nt, Homo sapiens
ugcuaguaccaaaa

SEQ ID NO: 1555652 - RNA, 15 nt, Homo sapiens
ugcuaguacuaguac

SEQ ID NO: 1555653 - RNA, 17 nt, Homo sapiens
ugcuaguacuaguacua

SEQ ID NO: 1555654 - RNA, 17 nt, Homo sapiens
ugcuagucacuggaaau

SEQ ID NO: 1555655 - RNA, 18 nt, Homo sapiens
ugcuauacugcauacuuu

SEQ ID NO: 1555656 - RNA, 11 nt, Homo sapiens
ugcuauauucc

SEQ ID NO: 1555657 - RNA, 12 nt, Homo sapiens
ugcuaucugggc

SEQ ID NO: 1555658 - RNA, 23 nt, Homo sapiens
ugcuaugguuuucuccaagagcu

SEQ ID NO: 1555659 - RNA, 17 nt, Homo sapiens
ugcuauuacuaguacua

SEQ ID NO: 1555660 - RNA, 21 nt, Homo sapiens
ugcuauuacuaguacuauuac

SEQ ID NO: 1555661 - RNA, 17 nt, Homo sapiens
ugcucaaaacacuucca

SEQ ID NO: 1555662 - RNA, 17 nt, Homo sapiens
ugcucaagauauggaag

SEQ ID NO: 1555663 - RNA, 17 nt, Homo sapiens
ugcucagacccaacagc

SEQ ID NO: 1555664 - RNA, 23 nt, Homo sapiens
ugcucagaccgagcgugugccac

SEQ ID NO: 1555665 - RNA, 19 nt, Homo sapiens
ugcucaggagccaccagca

SEQ ID NO: 1555666 - RNA, 19 nt, Homo sapiens
ugcucaguuggugcugcuu

SEQ ID NO: 1555667 - RNA, 16 nt, Homo sapiens
ugcucauauugugauu

SEQ ID NO: 1555668 - RNA, 11 nt, Homo sapiens
ugcucauguau

SEQ ID NO: 1555669 - RNA, 13 nt, Homo sapiens
ugcucauguauau

SEQ ID NO: 1555670 - RNA, 16 nt, Homo sapiens
ugcucauugaacuuua

SEQ ID NO: 1555671 - RNA, 17 nt, Homo sapiens
ugcucauugaacuuuaa

SEQ ID NO: 1555672 - RNA, 18 nt, Homo sapiens
ugcucauugaacuuuaag

SEQ ID NO: 1555673 - RNA, 13 nt, Homo sapiens
ugcuccaccuuca

SEQ ID NO: 1555674 - RNA, 17 nt, Homo sapiens
ugcuccaggaucuuuga

SEQ ID NO: 1555675 - RNA, 19 nt, Homo sapiens
ugcuccaggccugcauuac

SEQ ID NO: 1555676 - RNA, 11 nt, Homo sapiens
ugcuccaggga

SEQ ID NO: 1555677 - RNA, 20 nt, Homo sapiens
ugcucccucuccaagacagc

SEQ ID NO: 1555678 - RNA, 21 nt, Homo sapiens
ugcuccuaggacccgucucca

SEQ ID NO: 1555679 - RNA, 16 nt, Homo sapiens
ugcuccugauauaaca

SEQ ID NO: 1555680 - RNA, 20 nt, Homo sapiens
ugcucgcuacacuacuccug

SEQ ID NO: 1555681 - RNA, 16 nt, Homo sapiens
ugcucuaugucugccu

SEQ ID NO: 1555682 - RNA, 18 nt, Homo sapiens
ugcucuccaagucucagu

SEQ ID NO: 1555683 - RNA, 21 nt, Homo sapiens
ugcucucuucaauaaaccaca

SEQ ID NO: 1555684 - RNA, 16 nt, Homo sapiens
ugcucucuucucccca

SEQ ID NO: 1555685 - RNA, 13 nt, Homo sapiens
ugcucugagccac

SEQ ID NO: 1555686 - RNA, 19 nt, Homo sapiens
ugcucuguccccaaaggac

SEQ ID NO: 1555687 - RNA, 23 nt, Homo sapiens
ugcucugucccuauuauuugccc

SEQ ID NO: 1555688 - RNA, 15 nt, Homo sapiens
ugcugaaacaacaaa

SEQ ID NO: 1555689 - RNA, 21 nt, Homo sapiens
ugcugaauuuacaguaguuaa

SEQ ID NO: 1555690 - RNA, 21 nt, Homo sapiens
ugcugauaaauauaaccauca

SEQ ID NO: 1555691 - RNA, 21 nt, Homo sapiens
ugcugaugcuguuaaccaaag

SEQ ID NO: 1555692 - RNA, 22 nt, Homo sapiens
ugcugauguauuucaagucucu

SEQ ID NO: 1555693 - RNA, 15 nt, Homo sapiens
ugcugcacaaaagca

SEQ ID NO: 1555694 - RNA, 21 nt, Homo sapiens
ugcugcagggacagcccugac

SEQ ID NO: 1555695 - RNA, 17 nt, Homo sapiens
ugcugcccauguuucaa

SEQ ID NO: 1555696 - RNA, 16 nt, Homo sapiens
ugcuggaacacagggg

SEQ ID NO: 1555697 - RNA, 21 nt, Homo sapiens
ugcugggacuugaacaaagac

SEQ ID NO: 1555698 - RNA, 23 nt, Homo sapiens
ugcugggauuacaggcgugaucc

SEQ ID NO: 1555699 - RNA, 18 nt, Homo sapiens
ugcugggcucuccaccuc

SEQ ID NO: 1555700 - RNA, 23 nt, Homo sapiens
ugcuggguccauaucacacacau

SEQ ID NO: 1555701 - RNA, 13 nt, Homo sapiens
ugcuggugcauca

SEQ ID NO: 1555702 - RNA, 16 nt, Homo sapiens
ugcugucaacuuccca

SEQ ID NO: 1555703 - RNA, 20 nt, Homo sapiens
ugcuguccuguuucugucaa

SEQ ID NO: 1555704 - RNA, 17 nt, Homo sapiens
ugcuguccuuggguaga

SEQ ID NO: 1555705 - RNA, 15 nt, Homo sapiens
ugcuguguccucuag

SEQ ID NO: 1555706 - RNA, 22 nt, Homo sapiens
ugcuguuaaaauuaauauauca

SEQ ID NO: 1555707 - RNA, 18 nt, Homo sapiens
ugcuguuaccaaaucuca

SEQ ID NO: 1555708 - RNA, 14 nt, Homo sapiens
ugcuguucagugcc

SEQ ID NO: 1555709 - RNA, 15 nt, Homo sapiens
ugcuguuuacuugaa

SEQ ID NO: 1555710 - RNA, 12 nt, Homo sapiens
ugcuuaauucaa

SEQ ID NO: 1555711 - RNA, 19 nt, Homo sapiens
ugcuuaccuacauacgugu

SEQ ID NO: 1555712 - RNA, 19 nt, Homo sapiens
uggcaaaugccugacucag

SEQ ID NO: 1555713 - RNA, 22 nt, Homo sapiens
uggcaaggacuuuguacauuug

SEQ ID NO: 1555714 - RNA, 16 nt, Homo sapiens
uggcaauauccaaaua

SEQ ID NO: 1555715 - RNA, 23 nt, Homo sapiens
uggcaaucucagaugcaguuugg

SEQ ID NO: 1555716 - RNA, 21 nt, Homo sapiens
uggcaauuuccuggcccucca

SEQ ID NO: 1555717 - RNA, 20 nt, Homo sapiens
uggcacauguauacauaugu

SEQ ID NO: 1555718 - RNA, 14 nt, Homo sapiens
uggcacauugcccc

SEQ ID NO: 1555719 - RNA, 16 nt, Homo sapiens
uggcaccuucagacuu

SEQ ID NO: 1555720 - RNA, 22 nt, Homo sapiens
uggcagaaauacagucuuccac

SEQ ID NO: 1555721 - RNA, 20 nt, Homo sapiens
uggcagaagggaauugcuca

SEQ ID NO: 1555722 - RNA, 21 nt, Homo sapiens
uggcagaagggaauugcucag

SEQ ID NO: 1555723 - RNA, 17 nt, Homo sapiens
uggcagcuagugccuuu

SEQ ID NO: 1555724 - RNA, 16 nt, Homo sapiens
uggcaggacagcuccu

SEQ ID NO: 1555725 - RNA, 17 nt, Homo sapiens
uggcagggcgugaggaa

SEQ ID NO: 1555726 - RNA, 15 nt, Homo sapiens
uggcaguacuguugc

SEQ ID NO: 1555727 - RNA, 15 nt, Homo sapiens
uggcauaaccugucu

SEQ ID NO: 1555728 - RNA, 17 nt, Homo sapiens
uggcauaaccugucuca

SEQ ID NO: 1555729 - RNA, 21 nt, Homo sapiens
uggcauaaggaguuagaacca

SEQ ID NO: 1555730 - RNA, 19 nt, Homo sapiens
uggcauagcccauguuaag

SEQ ID NO: 1555731 - RNA, 16 nt, Homo sapiens
uggcaucuccauguag

SEQ ID NO: 1555732 - RNA, 14 nt, Homo sapiens
uggcaugggacaga

SEQ ID NO: 1555733 - RNA, 21 nt, Homo sapiens
uggcaugucauuugcacacaa

SEQ ID NO: 1555734 - RNA, 12 nt, Homo sapiens
uggccaagccua

SEQ ID NO: 1555735 - RNA, 15 nt, Homo sapiens
uggccaagccuauca

SEQ ID NO: 1555736 - RNA, 21 nt, Homo sapiens
uggccaccaguaugacaguau

SEQ ID NO: 1555737 - RNA, 23 nt, Homo sapiens
uggccacucagcuuccuacccac

SEQ ID NO: 1555738 - RNA, 20 nt, Homo sapiens
uggccacuggggugccuuca

SEQ ID NO: 1555739 - RNA, 15 nt, Homo sapiens
uggccagagccucug

SEQ ID NO: 1555740 - RNA, 18 nt, Homo sapiens
uggccagagccucuggcc

SEQ ID NO: 1555741 - RNA, 23 nt, Homo sapiens
uggccaggugccgacacugagcu

SEQ ID NO: 1555742 - RNA, 13 nt, Homo sapiens
uggccauauauca

SEQ ID NO: 1555743 - RNA, 14 nt, Homo sapiens
uggcccagagccau

SEQ ID NO: 1555744 - RNA, 12 nt, Homo sapiens
uggcccaggugc

SEQ ID NO: 1555745 - RNA, 19 nt, Homo sapiens
uggcccccuauuuugccau

SEQ ID NO: 1555746 - RNA, 16 nt, Homo sapiens
uggcccugcuuucuac

SEQ ID NO: 1555747 - RNA, 18 nt, Homo sapiens
uggccuauuucagcugcu

SEQ ID NO: 1555748 - RNA, 14 nt, Homo sapiens
uggccuccaaacac

SEQ ID NO: 1555749 - RNA, 18 nt, Homo sapiens
uggccucccaaucuugcc

SEQ ID NO: 1555750 - RNA, 15 nt, Homo sapiens
uggccuccuaugccu

SEQ ID NO: 1555751 - RNA, 16 nt, Homo sapiens
uggccucgcuguucuc

SEQ ID NO: 1555752 - RNA, 19 nt, Homo sapiens
uggccugcugggcucucca

SEQ ID NO: 1555753 - RNA, 19 nt, Homo sapiens
uggccugcugugauuccac

SEQ ID NO: 1555754 - RNA, 18 nt, Homo sapiens
uggccuggccauuuccaa

SEQ ID NO: 1555755 - RNA, 22 nt, Homo sapiens
uggccuggucccuguuuuccca

SEQ ID NO: 1555756 - RNA, 22 nt, Homo sapiens
uggccuguucuucuauggguug

SEQ ID NO: 1555757 - RNA, 22 nt, Homo sapiens
uggcguuacugcuugaccaaag

SEQ ID NO: 1555758 - RNA, 21 nt, Homo sapiens
uggcuaagcaaaaugugauau

SEQ ID NO: 1555759 - RNA, 16 nt, Homo sapiens
uggcuacugcacucuc

SEQ ID NO: 1555760 - RNA, 17 nt, Homo sapiens
uggcuaugaaaaugagc

SEQ ID NO: 1555761 - RNA, 21 nt, Homo sapiens
uggcuaugagaagccugauga

SEQ ID NO: 1555762 - RNA, 21 nt, Homo sapiens
uggcucaugccuguaaucuca

SEQ ID NO: 1555763 - RNA, 14 nt, Homo sapiens
uggcucugccucag

SEQ ID NO: 1555764 - RNA, 21 nt, Homo sapiens
uggcugggaauaagugccagg

SEQ ID NO: 1555765 - RNA, 13 nt, Homo sapiens
uggcugucccugu

SEQ ID NO: 1555766 - RNA, 12 nt, Homo sapiens
uggcuguggcau

SEQ ID NO: 1555767 - RNA, 12 nt, Homo sapiens
uggcuguuucau

SEQ ID NO: 1555768 - RNA, 17 nt, Homo sapiens
uggcuuaagccugugua

SEQ ID NO: 1555769 - RNA, 19 nt, Homo sapiens
uggcuuagagaggcuugaa

SEQ ID NO: 1555770 - RNA, 21 nt, Homo sapiens
uggcuucauacccacucccug

SEQ ID NO: 1555771 - RNA, 23 nt, Homo sapiens
uggcuucucgcugcgcagccucc

SEQ ID NO: 1555772 - RNA, 15 nt, Homo sapiens
uggcuucuuuacuua

SEQ ID NO: 1555773 - RNA, 22 nt, Homo sapiens
uggcuucuuuacuuaguucaag

SEQ ID NO: 1555774 - RNA, 13 nt, Homo sapiens
uggcuugaugucc

SEQ ID NO: 1555775 - RNA, 15 nt, Homo sapiens
uggcuuuaugugcaa

SEQ ID NO: 1555776 - RNA, 22 nt, Homo sapiens
uggcuuuggcacucucugccau

SEQ ID NO: 1555777 - RNA, 18 nt, Homo sapiens
ugggaaggaaacaaccau

SEQ ID NO: 1555778 - RNA, 23 nt, Homo sapiens
ugggaaugucucuuuggcgaccu

SEQ ID NO: 1555779 - RNA, 15 nt, Homo sapiens
ugggacgaaagcaca

SEQ ID NO: 1555780 - RNA, 18 nt, Homo sapiens
ugggacgggaugguucug

SEQ ID NO: 1555781 - RNA, 23 nt, Homo sapiens
ugggacucggagacuauggccuc

SEQ ID NO: 1555782 - RNA, 14 nt, Homo sapiens
ugggacugcuaaau

SEQ ID NO: 1555783 - RNA, 21 nt, Homo sapiens
ugggacugugccuggcucccu

SEQ ID NO: 1555784 - RNA, 18 nt, Homo sapiens
ugggagaaggacuaucaa

SEQ ID NO: 1555785 - RNA, 19 nt, Homo sapiens
ugggagaguaaaccuugaa

SEQ ID NO: 1555786 - RNA, 20 nt, Homo sapiens
ugggagaguaaaccuugaag

SEQ ID NO: 1555787 - RNA, 22 nt, Homo sapiens
ugggagauggaggcgggaaaau

SEQ ID NO: 1555788 - RNA, 19 nt, Homo sapiens
ugggagauguuagacucau

SEQ ID NO: 1555789 - RNA, 17 nt, Homo sapiens
ugggagcaguccaugca

SEQ ID NO: 1555790 - RNA, 23 nt, Homo sapiens
ugggagcugaaccacagaaauca

SEQ ID NO: 1555791 - RNA, 23 nt, Homo sapiens
ugggagggaggagggagugcugu

SEQ ID NO: 1555792 - RNA, 16 nt, Homo sapiens
ugggaguaacagggca

SEQ ID NO: 1555793 - RNA, 17 nt, Homo sapiens
ugggagucacacagugu

SEQ ID NO: 1555794 - RNA, 23 nt, Homo sapiens
ugggaguggggccuuugccagca

SEQ ID NO: 1555795 - RNA, 20 nt, Homo sapiens
ugggauagagaauguuccag

SEQ ID NO: 1555796 - RNA, 23 nt, Homo sapiens
ugggauauccuuucacucugcau

SEQ ID NO: 1555797 - RNA, 14 nt, Homo sapiens
ugggaucaauuugu

SEQ ID NO: 1555798 - RNA, 16 nt, Homo sapiens
ugggaucgcauugcau

SEQ ID NO: 1555799 - RNA, 19 nt, Homo sapiens
ugggauggugacuccugaa

SEQ ID NO: 1555800 - RNA, 19 nt, Homo sapiens
ugggauuacaggugugaac

SEQ ID NO: 1555801 - RNA, 18 nt, Homo sapiens
ugggcaacauaccaagac

SEQ ID NO: 1555802 - RNA, 21 nt, Homo sapiens
ugggcacugcacccuguuuaa

SEQ ID NO: 1555803 - RNA, 17 nt, Homo sapiens
ugggcacuggcggucaa

SEQ ID NO: 1555804 - RNA, 12 nt, Homo sapiens
ugggcaggugaa

SEQ ID NO: 1555805 - RNA, 18 nt, Homo sapiens
ugggcaucauagcaagac

SEQ ID NO: 1555806 - RNA, 22 nt, Homo sapiens
ugggcaucauagcaagaccuca

SEQ ID NO: 1555807 - RNA, 15 nt, Homo sapiens
ugggcaucuccgugu

SEQ ID NO: 1555808 - RNA, 17 nt, Homo sapiens
ugggccauguccaaaga

SEQ ID NO: 1555809 - RNA, 20 nt, Homo sapiens
ugggcggcuccuggugcuaa

SEQ ID NO: 1555810 - RNA, 19 nt, Homo sapiens
ugggcugaugcugggaccc

SEQ ID NO: 1555811 - RNA, 13 nt, Homo sapiens
ugggcuggagcuc

SEQ ID NO: 1555812 - RNA, 13 nt, Homo sapiens
ugggcuggcacag

SEQ ID NO: 1555813 - RNA, 15 nt, Homo sapiens
ugggcugucagcuuu

SEQ ID NO: 1555814 - RNA, 18 nt, Homo sapiens
uggggaagagguuuuauu

SEQ ID NO: 1555815 - RNA, 15 nt, Homo sapiens
uggggacacagcauc

SEQ ID NO: 1555816 - RNA, 16 nt, Homo sapiens
uggggaggagggggcc

SEQ ID NO: 1555817 - RNA, 16 nt, Homo sapiens
uggggcaaacagucua

SEQ ID NO: 1555818 - RNA, 22 nt, Homo sapiens
uggggcagacaauaaacccuca

SEQ ID NO: 1555819 - RNA, 21 nt, Homo sapiens
uggggcaguuccccuucuuac

SEQ ID NO: 1555820 - RNA, 20 nt, Homo sapiens
ugggggguuuucuugccuug

SEQ ID NO: 1555821 - RNA, 13 nt, Homo sapiens
ugggggucagggg

SEQ ID NO: 1555822 - RNA, 18 nt, Homo sapiens
ugggguaguuguguuuca

SEQ ID NO: 1555823 - RNA, 16 nt, Homo sapiens
uggggugggcacauug

SEQ ID NO: 1555824 - RNA, 19 nt, Homo sapiens
ugggguucgagacuccauc

SEQ ID NO: 1555825 - RNA, 17 nt, Homo sapiens
ugggguuugaagcugac

SEQ ID NO: 1555826 - RNA, 19 nt, Homo sapiens
uggguaagaagaaagcaaa

SEQ ID NO: 1555827 - RNA, 19 nt, Homo sapiens
ugggucacucauuaaugaa

SEQ ID NO: 1555828 - RNA, 14 nt, Homo sapiens
ugggucaguuguau

SEQ ID NO: 1555829 - RNA, 15 nt, Homo sapiens
uguaccugugcacgu

SEQ ID NO: 1555830 - RNA, 18 nt, Homo sapiens
uguacucaaguaccacca

SEQ ID NO: 1555831 - RNA, 21 nt, Homo sapiens
uguacucuuugcuaguaccaa

SEQ ID NO: 1555832 - RNA, 18 nt, Homo sapiens
uguacuugccuuauuaga

SEQ ID NO: 1555833 - RNA, 19 nt, Homo sapiens
uguagaaaaaaaaauucac

SEQ ID NO: 1555834 - RNA, 23 nt, Homo sapiens
uguagaaaaaaaaauucacauga

SEQ ID NO: 1555835 - RNA, 23 nt, Homo sapiens
uguagaaaaugaggaaaugccac

SEQ ID NO: 1555836 - RNA, 13 nt, Homo sapiens
uguagaaggccag

SEQ ID NO: 1555837 - RNA, 16 nt, Homo sapiens
uguagaauaaaugaag

SEQ ID NO: 1555838 - RNA, 20 nt, Homo sapiens
uguagaaucucuucaugcuu

SEQ ID NO: 1555839 - RNA, 22 nt, Homo sapiens
uguagagacgguguuuugccau

SEQ ID NO: 1555840 - RNA, 17 nt, Homo sapiens
uguagaugacaaccucc

SEQ ID NO: 1555841 - RNA, 20 nt, Homo sapiens
uguagauucagguaauacaa

SEQ ID NO: 1555842 - RNA, 13 nt, Homo sapiens
uguagcauauaaa

SEQ ID NO: 1555843 - RNA, 14 nt, Homo sapiens
uguagcuaguaaga

SEQ ID NO: 1555844 - RNA, 16 nt, Homo sapiens
uguaggugucugccuu

SEQ ID NO: 1555845 - RNA, 14 nt, Homo sapiens
uguaguaauugaca

SEQ ID NO: 1555846 - RNA, 13 nt, Homo sapiens
uguagugagccaa

SEQ ID NO: 1555847 - RNA, 18 nt, Homo sapiens
uguaguuguugguuuauu

SEQ ID NO: 1555848 - RNA, 14 nt, Homo sapiens
uguauaagaauuac

SEQ ID NO: 1555849 - RNA, 19 nt, Homo sapiens
uguauacuauaguaccagu

SEQ ID NO: 1555850 - RNA, 18 nt, Homo sapiens
uguauaucguuaucacug

SEQ ID NO: 1555851 - RNA, 21 nt, Homo sapiens
uguauauuuuguaguuaauau

SEQ ID NO: 1555852 - RNA, 16 nt, Homo sapiens
uguaucaaaugugaca

SEQ ID NO: 1555853 - RNA, 17 nt, Homo sapiens
uguaucaucuuugccaa

SEQ ID NO: 1555854 - RNA, 19 nt, Homo sapiens
uguaucaucuuugccaagu

SEQ ID NO: 1555855 - RNA, 13 nt, Homo sapiens
uguauccaaagga

SEQ ID NO: 1555856 - RNA, 13 nt, Homo sapiens
uguauccaugcac

SEQ ID NO: 1555857 - RNA, 19 nt, Homo sapiens
uguaucguaaccagccaga

SEQ ID NO: 1555858 - RNA, 19 nt, Homo sapiens
uguaucuauucuucugacc

SEQ ID NO: 1555859 - RNA, 16 nt, Homo sapiens
uguaugccaagugaga

SEQ ID NO: 1555860 - RNA, 14 nt, Homo sapiens
uguaugguuccaaa

SEQ ID NO: 1555861 - RNA, 11 nt, Homo sapiens
uguauguauag

SEQ ID NO: 1555862 - RNA, 19 nt, Homo sapiens
uguauuccucaugucauca

SEQ ID NO: 1555863 - RNA, 20 nt, Homo sapiens
uguauuuaccuucuaccucu

SEQ ID NO: 1555864 - RNA, 14 nt, Homo sapiens
uguauuuauuucau

SEQ ID NO: 1555865 - RNA, 18 nt, Homo sapiens
uguauuuuacaagucaaa

SEQ ID NO: 1555866 - RNA, 22 nt, Homo sapiens
uguauuuucuuacacuguguca

SEQ ID NO: 1555867 - RNA, 18 nt, Homo sapiens
ugucaaaauuguuuacca

SEQ ID NO: 1555868 - RNA, 14 nt, Homo sapiens
ugucaaagaagcuu

SEQ ID NO: 1555869 - RNA, 18 nt, Homo sapiens
ugucaaauaaacacugug

SEQ ID NO: 1555870 - RNA, 16 nt, Homo sapiens
ugucaaugacaguuuc

SEQ ID NO: 1555871 - RNA, 12 nt, Homo sapiens
ugucaaugcagg

SEQ ID NO: 1555872 - RNA, 20 nt, Homo sapiens
ugucacaccagccauacuua

SEQ ID NO: 1555873 - RNA, 20 nt, Homo sapiens
ugucacauaaaagucuguga

SEQ ID NO: 1555874 - RNA, 18 nt, Homo sapiens
ugucacauacaacuuuuu

SEQ ID NO: 1555875 - RNA, 22 nt, Homo sapiens
ugucaccaagcuaggugcuauu

SEQ ID NO: 1555876 - RNA, 15 nt, Homo sapiens
ugucaccaugaucac

SEQ ID NO: 1555877 - RNA, 20 nt, Homo sapiens
ugucaccggucagugccuuu

SEQ ID NO: 1555878 - RNA, 15 nt, Homo sapiens
ugucacuagucucac

SEQ ID NO: 1555879 - RNA, 17 nt, Homo sapiens
ugucacuagucucacca

SEQ ID NO: 1555880 - RNA, 16 nt, Homo sapiens
ugucacuggaugucaa

SEQ ID NO: 1555881 - RNA, 11 nt, Homo sapiens
ugucaguucuc

SEQ ID NO: 1555882 - RNA, 20 nt, Homo sapiens
ugucaguuuuguacauagca

SEQ ID NO: 1555883 - RNA, 15 nt, Homo sapiens
ugucauccaagccau

SEQ ID NO: 1555884 - RNA, 16 nt, Homo sapiens
ugucauuucauuccau

SEQ ID NO: 1555885 - RNA, 17 nt, Homo sapiens
uguccaaagaggcugcc

SEQ ID NO: 1555886 - RNA, 14 nt, Homo sapiens
uguccaacauggug

SEQ ID NO: 1555887 - RNA, 15 nt, Homo sapiens
uguccaauaugaaaa

SEQ ID NO: 1555888 - RNA, 19 nt, Homo sapiens
uguccaccaugcucucuca

SEQ ID NO: 1555889 - RNA, 13 nt, Homo sapiens
uguccacuucauu

SEQ ID NO: 1555890 - RNA, 19 nt, Homo sapiens
uguccaugaagcacugagc

SEQ ID NO: 1555891 - RNA, 15 nt, Homo sapiens
uguccauuugcaaau

SEQ ID NO: 1555892 - RNA, 22 nt, Homo sapiens
ugucccaaaccagacaccugga

SEQ ID NO: 1555893 - RNA, 22 nt, Homo sapiens
ugucccaggccgacccaaggga

SEQ ID NO: 1555894 - RNA, 17 nt, Homo sapiens
uguccccacugccccac

SEQ ID NO: 1555895 - RNA, 18 nt, Homo sapiens
uguccccagccuaccucu

SEQ ID NO: 1555896 - RNA, 15 nt, Homo sapiens
ugucccucauccaua

SEQ ID NO: 1555897 - RNA, 22 nt, Homo sapiens
ugucccucauccauagcaccuc

SEQ ID NO: 1555898 - RNA, 18 nt, Homo sapiens
uguccggcccagugccac

SEQ ID NO: 1555899 - RNA, 17 nt, Homo sapiens
uguccuaccacucuaau

SEQ ID NO: 1555900 - RNA, 23 nt, Homo sapiens
uguccucaggccugaacucacca

SEQ ID NO: 1555901 - RNA, 17 nt, Homo sapiens
uguccugcccuguggaa

SEQ ID NO: 1555902 - RNA, 12 nt, Homo sapiens
uguccugugagg

SEQ ID NO: 1555903 - RNA, 17 nt, Homo sapiens
uguccuugaaugccaua

SEQ ID NO: 1555904 - RNA, 12 nt, Homo sapiens
uguccuuucuca

SEQ ID NO: 1555905 - RNA, 19 nt, Homo sapiens
ugucgccaggcuagagugc

SEQ ID NO: 1555906 - RNA, 23 nt, Homo sapiens
ugucguuucccucccaacagagc

SEQ ID NO: 1555907 - RNA, 17 nt, Homo sapiens
ugucuaaaaugucagug

SEQ ID NO: 1555908 - RNA, 19 nt, Homo sapiens
ugucuagguuaaagcuaaa

SEQ ID NO: 1555909 - RNA, 22 nt, Homo sapiens
ugucuauaucauaacuauacuu

SEQ ID NO: 1555910 - RNA, 13 nt, Homo sapiens
ugucuauucuugu

SEQ ID NO: 1555911 - RNA, 19 nt, Homo sapiens
ugucuauuuaagugcaauu

SEQ ID NO: 1555912 - RNA, 18 nt, Homo sapiens
ugucucaacuacucagcu

SEQ ID NO: 1555913 - RNA, 21 nt, Homo sapiens
ugucucaacuacucagcucuc

SEQ ID NO: 1555914 - RNA, 21 nt, Homo sapiens
ugucucagaugaggagggaga

SEQ ID NO: 1555915 - RNA, 18 nt, Homo sapiens
ugucucaggcucaaguuu

SEQ ID NO: 1555916 - RNA, 16 nt, Homo sapiens
ugucucagucauugcu

SEQ ID NO: 1555917 - RNA, 23 nt, Homo sapiens
ugucucauccacauaagcacucc

SEQ ID NO: 1555918 - RNA, 15 nt, Homo sapiens
ugucucaucugugcu

SEQ ID NO: 1555919 - RNA, 21 nt, Homo sapiens
ugucucgaugcaaugaacacu

SEQ ID NO: 1555920 - RNA, 12 nt, Homo sapiens
ugucucugugag

SEQ ID NO: 1555921 - RNA, 15 nt, Homo sapiens
ugucugccuucacaa

SEQ ID NO: 1555922 - RNA, 14 nt, Homo sapiens
ugucugcuguagaa

SEQ ID NO: 1555923 - RNA, 17 nt, Homo sapiens
ugucugucaccagcuau

SEQ ID NO: 1555924 - RNA, 18 nt, Homo sapiens
ugucuuaguugaugagug

SEQ ID NO: 1555925 - RNA, 22 nt, Homo sapiens
ugucuugguguucaugaucucc

SEQ ID NO: 1555926 - RNA, 18 nt, Homo sapiens
ugugaaaauauacuugac

SEQ ID NO: 1555927 - RNA, 21 nt, Homo sapiens
ugugaaaauauacuugacucu

SEQ ID NO: 1555928 - RNA, 20 nt, Homo sapiens
ugugaaauaguccugaaguu

SEQ ID NO: 1555929 - RNA, 19 nt, Homo sapiens
ugugaacacaucagcuugc

SEQ ID NO: 1555930 - RNA, 15 nt, Homo sapiens
ugugaacacgugugu

SEQ ID NO: 1555931 - RNA, 21 nt, Homo sapiens
ugugaaccaacccccaucucc

SEQ ID NO: 1555932 - RNA, 17 nt, Homo sapiens
ugugaacucaccaaaca

SEQ ID NO: 1555933 - RNA, 20 nt, Homo sapiens
ugugaagaauuuagaucuua

SEQ ID NO: 1555934 - RNA, 16 nt, Homo sapiens
ugugaagcaaacucua

SEQ ID NO: 1555935 - RNA, 19 nt, Homo sapiens
ugugaaguuugcuuuguac

SEQ ID NO: 1555936 - RNA, 17 nt, Homo sapiens
ugugaauccaucuugcu

SEQ ID NO: 1555937 - RNA, 17 nt, Homo sapiens
ugugaauuaggcuguaa

SEQ ID NO: 1555938 - RNA, 13 nt, Homo sapiens
ugugacauacaua

SEQ ID NO: 1555939 - RNA, 22 nt, Homo sapiens
ugugacauacauauuaucucau

SEQ ID NO: 1555940 - RNA, 20 nt, Homo sapiens
ugugaccaaugucuugaugc

SEQ ID NO: 1555941 - RNA, 23 nt, Homo sapiens
ugugaccacaacaugaggccacu

SEQ ID NO: 1555942 - RNA, 15 nt, Homo sapiens
ugugacuauguucca

SEQ ID NO: 1555943 - RNA, 23 nt, Homo sapiens
ugugacuauucauggcuaccuca

SEQ ID NO: 1555944 - RNA, 20 nt, Homo sapiens
ugugacucccccucuuucac

SEQ ID NO: 1555945 - RNA, 23 nt, Homo sapiens
ugugacuucuauuuuaaagacaa

SEQ ID NO: 1555946 - RNA, 20 nt, Homo sapiens
ugugagcuacuggcccaaga

SEQ ID NO: 1555947 - RNA, 21 nt, Homo sapiens
gugcaucacggauggugcaug

SEQ ID NO: 1555948 - RNA, 19 nt, Homo sapiens
gugcauuuuuaaacuugaa

SEQ ID NO: 1555949 - RNA, 21 nt, Homo sapiens
gugccaaaauauaaucagaga

SEQ ID NO: 1555950 - RNA, 16 nt, Homo sapiens
gugccacuggaccuca

SEQ ID NO: 1555951 - RNA, 18 nt, Homo sapiens
gugccacuggaccucagu

SEQ ID NO: 1555952 - RNA, 19 nt, Homo sapiens
gugccagaggccagaccca

SEQ ID NO: 1555953 - RNA, 16 nt, Homo sapiens
gugccaggauggaaug

SEQ ID NO: 1555954 - RNA, 16 nt, Homo sapiens
gugccagugcacuccg

SEQ ID NO: 1555955 - RNA, 17 nt, Homo sapiens
gugccaguuauggcuau

SEQ ID NO: 1555956 - RNA, 13 nt, Homo sapiens
gugccaucagcuc

SEQ ID NO: 1555957 - RNA, 13 nt, Homo sapiens
gugccaugaucug

SEQ ID NO: 1555958 - RNA, 19 nt, Homo sapiens
gugccccaugccuguccag

SEQ ID NO: 1555959 - RNA, 18 nt, Homo sapiens
gugccccccuccuccagu

SEQ ID NO: 1555960 - RNA, 20 nt, Homo sapiens
gugccccugaugacgggaug

SEQ ID NO: 1555961 - RNA, 19 nt, Homo sapiens
gugccccugcucacugggc

SEQ ID NO: 1555962 - RNA, 19 nt, Homo sapiens
gugcccugcaucccucucc

SEQ ID NO: 1555963 - RNA, 15 nt, Homo sapiens
gugcccuuggugcga

SEQ ID NO: 1555964 - RNA, 17 nt, Homo sapiens
gugcccuuugggguccc

SEQ ID NO: 1555965 - RNA, 17 nt, Homo sapiens
gugccgauguugaacuu

SEQ ID NO: 1555966 - RNA, 18 nt, Homo sapiens
gugccuccccccagaccc

SEQ ID NO: 1555967 - RNA, 14 nt, Homo sapiens
gugccuccucaaac

SEQ ID NO: 1555968 - RNA, 21 nt, Homo sapiens
gugcgugaagaccaacaaagu

SEQ ID NO: 1555969 - RNA, 19 nt, Homo sapiens
gugcgugaaguaggcauau

SEQ ID NO: 1555970 - RNA, 13 nt, Homo sapiens
gugcuacaaaaac

SEQ ID NO: 1555971 - RNA, 13 nt, Homo sapiens
gugcuacaauuca

SEQ ID NO: 1555972 - RNA, 12 nt, Homo sapiens
gugcuacaugac

SEQ ID NO: 1555973 - RNA, 15 nt, Homo sapiens
gugcuaucacagggu

SEQ ID NO: 1555974 - RNA, 15 nt, Homo sapiens
gugcugaagcaaagu

SEQ ID NO: 1555975 - RNA, 17 nt, Homo sapiens
gugcugacuaagccgaa

SEQ ID NO: 1555976 - RNA, 18 nt, Homo sapiens
gugcugcagguggcagag

SEQ ID NO: 1555977 - RNA, 16 nt, Homo sapiens
gugcugccgagggcug

SEQ ID NO: 1555978 - RNA, 14 nt, Homo sapiens
gugcuggacacugu

SEQ ID NO: 1555979 - RNA, 18 nt, Homo sapiens
gugcugggauuacaggug

SEQ ID NO: 1555980 - RNA, 21 nt, Homo sapiens
gugcuguggagagaagcugau

SEQ ID NO: 1555981 - RNA, 15 nt, Homo sapiens
gugcuugagccagga

SEQ ID NO: 1555982 - RNA, 18 nt, Homo sapiens
gugcuugagugugugaac

SEQ ID NO: 1555983 - RNA, 12 nt, Homo sapiens
gugcuugaucua

SEQ ID NO: 1555984 - RNA, 14 nt, Homo sapiens
gugcuugggcucca

SEQ ID NO: 1555985 - RNA, 18 nt, Homo sapiens
gugcuuuaugugagauac

SEQ ID NO: 1555986 - RNA, 24 nt, Homo sapiens
gugcuuugugauaguucaguccca

SEQ ID NO: 1555987 - RNA, 17 nt, Homo sapiens
gugcuuuuugggaccau

SEQ ID NO: 1555988 - RNA, 21 nt, Homo sapiens
gugcuuuuugggaccaucacu

SEQ ID NO: 1555989 - RNA, 18 nt, Homo sapiens
guggaacccccaucucua

SEQ ID NO: 1555990 - RNA, 16 nt, Homo sapiens
guggacuucaucucaa

SEQ ID NO: 1555991 - RNA, 16 nt, Homo sapiens
guggauaacuuuacag

SEQ ID NO: 1555992 - RNA, 21 nt, Homo sapiens
guggauauuaaaaaucuguaa

SEQ ID NO: 1555993 - RNA, 21 nt, Homo sapiens
guggauccucaaacaacacug

SEQ ID NO: 1555994 - RNA, 19 nt, Homo sapiens
guggaugcaugugcgucac

SEQ ID NO: 1555995 - RNA, 13 nt, Homo sapiens
guggaugcugcug

SEQ ID NO: 1555996 - RNA, 18 nt, Homo sapiens
guggauuuuguagauguu

SEQ ID NO: 1555997 - RNA, 16 nt, Homo sapiens
guggcagauuuaguga

SEQ ID NO: 1555998 - RNA, 20 nt, Homo sapiens
guggcaugaucauagcucac

SEQ ID NO: 1555999 - RNA, 21 nt, Homo sapiens
guggcccccacccaguaccgc

SEQ ID NO: 1556000 - RNA, 14 nt, Homo sapiens
guggcccucuggau

SEQ ID NO: 1556001 - RNA, 19 nt, Homo sapiens
guggccucagcccucagaa

SEQ ID NO: 1556002 - RNA, 13 nt, Homo sapiens
guggcgugaucuc

SEQ ID NO: 1556003 - RNA, 14 nt, Homo sapiens
guggcucacaccug

SEQ ID NO: 1556004 - RNA, 22 nt, Homo sapiens
gugggaucauccagaggagcug

SEQ ID NO: 1556005 - RNA, 18 nt, Homo sapiens
gugggauccacacugaga

SEQ ID NO: 1556006 - RNA, 22 nt, Homo sapiens
gugggcgcuugcaccacuuccg

SEQ ID NO: 1556007 - RNA, 20 nt, Homo sapiens
gugggcggcuccuggugcua

SEQ ID NO: 1556008 - RNA, 20 nt, Homo sapiens
gugggcucccugacugggag

SEQ ID NO: 1556009 - RNA, 16 nt, Homo sapiens
guggggggaagcacau

SEQ ID NO: 1556010 - RNA, 21 nt, Homo sapiens
gugguagccaucaagcacuuc

SEQ ID NO: 1556011 - RNA, 18 nt, Homo sapiens
gugguaugaaaugucuga

SEQ ID NO: 1556012 - RNA, 13 nt, Homo sapiens
gugguauggggcu

SEQ ID NO: 1556013 - RNA, 21 nt, Homo sapiens
guggucauuuccuaugcaaau

SEQ ID NO: 1556014 - RNA, 17 nt, Homo sapiens
gugguccuuugggguga

SEQ ID NO: 1556015 - RNA, 22 nt, Homo sapiens
gugguuaggcagcaagcuuugg

SEQ ID NO: 1556016 - RNA, 17 nt, Homo sapiens
gugguuccucugcucac

SEQ ID NO: 1556017 - RNA, 22 nt, Homo sapiens
gugguuuuguuuguuucuuuga

SEQ ID NO: 1556018 - RNA, 19 nt, Homo sapiens
guguaaaauuaauguaaua

SEQ ID NO: 1556019 - RNA, 15 nt, Homo sapiens
guguaacagauauca

SEQ ID NO: 1556020 - RNA, 20 nt, Homo sapiens
guguaagaacaacuaccuga

SEQ ID NO: 1556021 - RNA, 22 nt, Homo sapiens
guguacacggaggucucuguaa

SEQ ID NO: 1556022 - RNA, 23 nt, Homo sapiens
guguacuucuucauccauagaca

SEQ ID NO: 1556023 - RNA, 19 nt, Homo sapiens
guguauuaaaccuuuccau

SEQ ID NO: 1556024 - RNA, 14 nt, Homo sapiens
guguauuaaucucu

SEQ ID NO: 1556025 - RNA, 21 nt, Homo sapiens
guguauucuuaaaaugcaaua

SEQ ID NO: 1556026 - RNA, 14 nt, Homo sapiens
guguauuucauuua

SEQ ID NO: 1556027 - RNA, 16 nt, Homo sapiens
gugucaagacauuucu

SEQ ID NO: 1556028 - RNA, 16 nt, Homo sapiens
gugucacagcuuugug

SEQ ID NO: 1556029 - RNA, 15 nt, Homo sapiens
gugucaccugugcuu

SEQ ID NO: 1556030 - RNA, 22 nt, Homo sapiens
guguccccuuccccugcugacc

SEQ ID NO: 1556031 - RNA, 14 nt, Homo sapiens
guguccucagggag

SEQ ID NO: 1556032 - RNA, 14 nt, Homo sapiens
guguccugcaccgg

SEQ ID NO: 1556033 - RNA, 18 nt, Homo sapiens
gugucucugaggacguca

SEQ ID NO: 1556034 - RNA, 22 nt, Homo sapiens
gugugaaccacuguguacugga

SEQ ID NO: 1556035 - RNA, 15 nt, Homo sapiens
gugugacccugggca

SEQ ID NO: 1556036 - RNA, 21 nt, Homo sapiens
gugugaucuuaauauauuuga

SEQ ID NO: 1556037 - RNA, 14 nt, Homo sapiens
gugugcaaguacga

SEQ ID NO: 1556038 - RNA, 16 nt, Homo sapiens
gugugcaccuauagcc

SEQ ID NO: 1556039 - RNA, 18 nt, Homo sapiens
gugugccaagaguucgau

SEQ ID NO: 1556040 - RNA, 23 nt, Homo sapiens
gugugccuauagucccacuacuu

SEQ ID NO: 1556041 - RNA, 19 nt, Homo sapiens
guguggggauuuucacuga

SEQ ID NO: 1556042 - RNA, 20 nt, Homo sapiens
gugugguauucaacuaauac

SEQ ID NO: 1556043 - RNA, 15 nt, Homo sapiens
gugugugacaauucu

SEQ ID NO: 1556044 - RNA, 20 nt, Homo sapiens
gugugugggcacguguggau

SEQ ID NO: 1556045 - RNA, 18 nt, Homo sapiens
guguguuuggaagacuau

SEQ ID NO: 1556046 - RNA, 19 nt, Homo sapiens
guguguuugugugcaugaa

SEQ ID NO: 1556047 - RNA, 14 nt, Homo sapiens
guguuaaaugugau

SEQ ID NO: 1556048 - RNA, 19 nt, Homo sapiens
guguuauuugugggguaca

SEQ ID NO: 1556049 - RNA, 15 nt, Homo sapiens
guguuccugaagcug

SEQ ID NO: 1556050 - RNA, 23 nt, Homo sapiens
guguucuucauuaccucagugag

SEQ ID NO: 1556051 - RNA, 17 nt, Homo sapiens
guguugugcagcauuaa

SEQ ID NO: 1556052 - RNA, 17 nt, Homo sapiens
guguuucugucucucca

SEQ ID NO: 1556053 - RNA, 15 nt, Homo sapiens
guguuugacuguaau

SEQ ID NO: 1556054 - RNA, 21 nt, Homo sapiens
guguuuggaaauaaacugugc

SEQ ID NO: 1556055 - RNA, 14 nt, Homo sapiens
guguuuguuggcaa

SEQ ID NO: 1556056 - RNA, 20 nt, Homo sapiens
guguuuuguaaaggauauca

SEQ ID NO: 1556057 - RNA, 14 nt, Homo sapiens
guguuuugucagac

SEQ ID NO: 1556058 - RNA, 23 nt, Homo sapiens
guuaaaauaaagcuuacauaguu

SEQ ID NO: 1556059 - RNA, 13 nt, Homo sapiens
guuaaaugaacuu

SEQ ID NO: 1556060 - RNA, 14 nt, Homo sapiens
guuaaaugaacuug

SEQ ID NO: 1556061 - RNA, 22 nt, Homo sapiens
guuaacuuuuguaccaaauagc

SEQ ID NO: 1556062 - RNA, 23 nt, Homo sapiens
guuaagcauuaccacucaggcau

SEQ ID NO: 1556063 - RNA, 21 nt, Homo sapiens
guuaaguauugugcacuguau

SEQ ID NO: 1556064 - RNA, 17 nt, Homo sapiens
guuaauauugugcaaac

SEQ ID NO: 1556065 - RNA, 12 nt, Homo sapiens
uaacauugcuga

SEQ ID NO: 1556066 - RNA, 17 nt, Homo sapiens
uaacauuuaaauuccac

SEQ ID NO: 1556067 - RNA, 21 nt, Homo sapiens
uaacauuuaaauuccacagau

SEQ ID NO: 1556068 - RNA, 17 nt, Homo sapiens
uaacauuucauuguaca

SEQ ID NO: 1556069 - RNA, 19 nt, Homo sapiens
uaaccagacacauacucau

SEQ ID NO: 1556070 - RNA, 12 nt, Homo sapiens
uaaccaguacuu

SEQ ID NO: 1556071 - RNA, 16 nt, Homo sapiens
uaaccaguauuuuugc

SEQ ID NO: 1556072 - RNA, 18 nt, Homo sapiens
uaaccaucugauaucuau

SEQ ID NO: 1556073 - RNA, 16 nt, Homo sapiens
uaaccccauucuuugc

SEQ ID NO: 1556074 - RNA, 16 nt, Homo sapiens
uaacccucccauggca

SEQ ID NO: 1556075 - RNA, 18 nt, Homo sapiens
uaaccgauaugcacuuga

SEQ ID NO: 1556076 - RNA, 22 nt, Homo sapiens
uaaccuaugauaauuauuuaca

SEQ ID NO: 1556077 - RNA, 23 nt, Homo sapiens
uaaccuccaacacagugcaucuc

SEQ ID NO: 1556078 - RNA, 18 nt, Homo sapiens
uaaccuugaaauggaaag

SEQ ID NO: 1556079 - RNA, 15 nt, Homo sapiens
uaaccuuuacacucc

SEQ ID NO: 1556080 - RNA, 23 nt, Homo sapiens
uaacgacccacucugcuucuugc

SEQ ID NO: 1556081 - RNA, 19 nt, Homo sapiens
uaacgacuucuccaucucc

SEQ ID NO: 1556082 - RNA, 16 nt, Homo sapiens
uaacuaaaugcucaua

SEQ ID NO: 1556083 - RNA, 17 nt, Homo sapiens
uaacuaaaugcucauac

SEQ ID NO: 1556084 - RNA, 17 nt, Homo sapiens
uaacuaauaaugcugga

SEQ ID NO: 1556085 - RNA, 19 nt, Homo sapiens
uaacuagacuaagaagauu

SEQ ID NO: 1556086 - RNA, 14 nt, Homo sapiens
uaacuauacuugau

SEQ ID NO: 1556087 - RNA, 18 nt, Homo sapiens
uaacuauuaguauuauua

SEQ ID NO: 1556088 - RNA, 20 nt, Homo sapiens
uaacuauuuuaaauauccau

SEQ ID NO: 1556089 - RNA, 21 nt, Homo sapiens
uaacucgaauucucacaagga

SEQ ID NO: 1556090 - RNA, 15 nt, Homo sapiens
uaacucuagaauuug

SEQ ID NO: 1556091 - RNA, 22 nt, Homo sapiens
uaacugaggacuguuugcaauu

SEQ ID NO: 1556092 - RNA, 21 nt, Homo sapiens
uaacugauuaccugccaauug

SEQ ID NO: 1556093 - RNA, 17 nt, Homo sapiens
uaacugauuucuauggc

SEQ ID NO: 1556094 - RNA, 14 nt, Homo sapiens
uaacugcauccagc

SEQ ID NO: 1556095 - RNA, 19 nt, Homo sapiens
uaacugcuucuuggagcuu

SEQ ID NO: 1556096 - RNA, 13 nt, Homo sapiens
uaacuuagaagga

SEQ ID NO: 1556097 - RNA, 13 nt, Homo sapiens
uaacuuuaccaug

SEQ ID NO: 1556098 - RNA, 15 nt, Homo sapiens
uaacuuuauggagua

SEQ ID NO: 1556099 - RNA, 17 nt, Homo sapiens
uaacuuucauaccacuu

SEQ ID NO: 1556100 - RNA, 22 nt, Homo sapiens
uaacuuucauaccacuugaauu

SEQ ID NO: 1556101 - RNA, 23 nt, Homo sapiens
uaacuuuugggcguaagaccaaa

SEQ ID NO: 1556102 - RNA, 15 nt, Homo sapiens
uaagaaaaaaagcac

SEQ ID NO: 1556103 - RNA, 17 nt, Homo sapiens
uaagaaacuagcagauu

SEQ ID NO: 1556104 - RNA, 13 nt, Homo sapiens
uaagaaagcacua

SEQ ID NO: 1556105 - RNA, 13 nt, Homo sapiens
uaagaaauaucug

SEQ ID NO: 1556106 - RNA, 23 nt, Homo sapiens
uaagaagcaauaacuauuuuucc

SEQ ID NO: 1556107 - RNA, 18 nt, Homo sapiens
uaagaagcggcauagcac

SEQ ID NO: 1556108 - RNA, 13 nt, Homo sapiens
uaagaagggaaaa

SEQ ID NO: 1556109 - RNA, 21 nt, Homo sapiens
uaagaagggugggaguggggc

SEQ ID NO: 1556110 - RNA, 17 nt, Homo sapiens
uaagaagugacucuugc

SEQ ID NO: 1556111 - RNA, 12 nt, Homo sapiens
uaagaaugaaua

SEQ ID NO: 1556112 - RNA, 17 nt, Homo sapiens
uaagaaugucuauuucc

SEQ ID NO: 1556113 - RNA, 14 nt, Homo sapiens
uaagacacauugac

SEQ ID NO: 1556114 - RNA, 21 nt, Homo sapiens
uaagacaugauuuccuugaau

SEQ ID NO: 1556115 - RNA, 20 nt, Homo sapiens
uaagagaaucaacauuucuc

SEQ ID NO: 1556116 - RNA, 16 nt, Homo sapiens
uaagagauuaagaaua

SEQ ID NO: 1556117 - RNA, 18 nt, Homo sapiens
uaagagcuuaagaaccau

SEQ ID NO: 1556118 - RNA, 17 nt, Homo sapiens
uaagaggcuuucuccag

SEQ ID NO: 1556119 - RNA, 19 nt, Homo sapiens
uaagauauucagaaguaua

SEQ ID NO: 1556120 - RNA, 22 nt, Homo sapiens
uaagauccagaaauacuuaaca

SEQ ID NO: 1556121 - RNA, 20 nt, Homo sapiens
uaagaugaaacaucauuuca

SEQ ID NO: 1556122 - RNA, 15 nt, Homo sapiens
uaagauguacauuua

SEQ ID NO: 1556123 - RNA, 16 nt, Homo sapiens
uaagauuaauuuucuc

SEQ ID NO: 1556124 - RNA, 16 nt, Homo sapiens
uaagauuccaaaaagc

SEQ ID NO: 1556125 - RNA, 19 nt, Homo sapiens
uaagauuccaaaaagcaca

SEQ ID NO: 1556126 - RNA, 21 nt, Homo sapiens
uaagauuccaaaaagcacaua

SEQ ID NO: 1556127 - RNA, 16 nt, Homo sapiens
uaagauucuugacuua

SEQ ID NO: 1556128 - RNA, 12 nt, Homo sapiens
uaagauuuaccc

SEQ ID NO: 1556129 - RNA, 20 nt, Homo sapiens
uaagcaguauauuaguauua

SEQ ID NO: 1556130 - RNA, 14 nt, Homo sapiens
uaagcauacuuugu

SEQ ID NO: 1556131 - RNA, 14 nt, Homo sapiens
uaagcccucaggag

SEQ ID NO: 1556132 - RNA, 16 nt, Homo sapiens
uaagccuuugacuuaa

SEQ ID NO: 1556133 - RNA, 15 nt, Homo sapiens
uaagcuacugccauc

SEQ ID NO: 1556134 - RNA, 22 nt, Homo sapiens
uaagcuguaaccgauaugcacu

SEQ ID NO: 1556135 - RNA, 20 nt, Homo sapiens
uaagcuguggcuggaauuga

SEQ ID NO: 1556136 - RNA, 15 nt, Homo sapiens
uaaggaacaaaucuc

SEQ ID NO: 1556137 - RNA, 20 nt, Homo sapiens
uaaggaaguaucagcacuag

SEQ ID NO: 1556138 - RNA, 16 nt, Homo sapiens
uaaggagaaaucuaua

SEQ ID NO: 1556139 - RNA, 20 nt, Homo sapiens
uaaggagaggagaaacugag

SEQ ID NO: 1556140 - RNA, 12 nt, Homo sapiens
uaagggcacuga

SEQ ID NO: 1556141 - RNA, 18 nt, Homo sapiens
uaagguacacuguuucca

SEQ ID NO: 1556142 - RNA, 19 nt, Homo sapiens
uaaggucuccaaaccagac

SEQ ID NO: 1556143 - RNA, 13 nt, Homo sapiens
uaagguucuugcu

SEQ ID NO: 1556144 - RNA, 20 nt, Homo sapiens
uaagguugucuacgggggca

SEQ ID NO: 1556145 - RNA, 15 nt, Homo sapiens
uaaguacacaauaag

SEQ ID NO: 1556146 - RNA, 19 nt, Homo sapiens
uaaguaucacacuguauau

SEQ ID NO: 1556147 - RNA, 23 nt, Homo sapiens
uaaguauuauauaaacugugcca

SEQ ID NO: 1556148 - RNA, 14 nt, Homo sapiens
uaaguauuuccaua

SEQ ID NO: 1556149 - RNA, 17 nt, Homo sapiens
uaagucaaccugccuga

SEQ ID NO: 1556150 - RNA, 22 nt, Homo sapiens
uaagucaaccugccugacauuu

SEQ ID NO: 1556151 - RNA, 22 nt, Homo sapiens
uaagucacauaggaaacuugaa

SEQ ID NO: 1556152 - RNA, 20 nt, Homo sapiens
uaagucauuccuccagugca

SEQ ID NO: 1556153 - RNA, 17 nt, Homo sapiens
uaagugaauacauuaac

SEQ ID NO: 1556154 - RNA, 19 nt, Homo sapiens
uaagugaauuuaugagauu

SEQ ID NO: 1556155 - RNA, 17 nt, Homo sapiens
uaagugcuaagugcuua

SEQ ID NO: 1556156 - RNA, 13 nt, Homo sapiens
uaagugcuucaca

SEQ ID NO: 1556157 - RNA, 19 nt, Homo sapiens
uaaguguccuccaucaauu

SEQ ID NO: 1556158 - RNA, 19 nt, Homo sapiens
uaaguuacacauuuuucag

SEQ ID NO: 1556159 - RNA, 14 nt, Homo sapiens
uaaguucagcacuu

SEQ ID NO: 1556160 - RNA, 17 nt, Homo sapiens
uaaguucagcacuuguc

SEQ ID NO: 1556161 - RNA, 15 nt, Homo sapiens
uaaguugagaacuua

SEQ ID NO: 1556162 - RNA, 17 nt, Homo sapiens
uaauaaaaggaguucag

SEQ ID NO: 1556163 - RNA, 15 nt, Homo sapiens
uaauaaacuacucuu

SEQ ID NO: 1556164 - RNA, 13 nt, Homo sapiens
uaauaaauacuca

SEQ ID NO: 1556165 - RNA, 17 nt, Homo sapiens
uaauaaauacucaguga

SEQ ID NO: 1556166 - RNA, 15 nt, Homo sapiens
uaauaaaucacuugc

SEQ ID NO: 1556167 - RNA, 17 nt, Homo sapiens
uaauaacuguguacugu

SEQ ID NO: 1556168 - RNA, 20 nt, Homo sapiens
uaauaaguaucacacuguau

SEQ ID NO: 1556169 - RNA, 14 nt, Homo sapiens
uaauaauacugucu

SEQ ID NO: 1556170 - RNA, 19 nt, Homo sapiens
uaauacauacuaaugaagu

SEQ ID NO: 1556171 - RNA, 14 nt, Homo sapiens
uaauacauauagca

SEQ ID NO: 1556172 - RNA, 14 nt, Homo sapiens
uaauacaucaaaga

SEQ ID NO: 1556173 - RNA, 18 nt, Homo sapiens
uaauacauuuauaaucua

SEQ ID NO: 1556174 - RNA, 16 nt, Homo sapiens
uaauagaaaugcauac

SEQ ID NO: 1556175 - RNA, 16 nt, Homo sapiens
uaauagucuuugccag

SEQ ID NO: 1556176 - RNA, 22 nt, Homo sapiens
uaauaguucuauccuuuugccu

SEQ ID NO: 1556177 - RNA, 22 nt, Homo sapiens
uaauauaaaaagcuuccaugau

SEQ ID NO: 1556178 - RNA, 21 nt, Homo sapiens
uaauauccuaaacaucauuca

SEQ ID NO: 1556179 - RNA, 22 nt, Homo sapiens
uaauaugaaaaucuccaucuca

SEQ ID NO: 1556180 - RNA, 23 nt, Homo sapiens
uaauaugaguaauacaucaaaga

SEQ ID NO: 1556181 - RNA, 17 nt, Homo sapiens
uaauaugauuauacaaa

SEQ ID NO: 1556182 - RNA, 13 nt, Homo sapiens
uaauaugcugcaa

SEQ ID NO: 1556183 - RNA, 11 nt, Homo sapiens
uuuggggcuca

SEQ ID NO: 1556184 - RNA, 19 nt, Homo sapiens
uuuggguucucuacaugca

SEQ ID NO: 1556185 - RNA, 22 nt, Homo sapiens
uuuggugacuguguaacuuucu

SEQ ID NO: 1556186 - RNA, 18 nt, Homo sapiens
uuugguuccuccacugga

SEQ ID NO: 1556187 - RNA, 13 nt, Homo sapiens
uuuguaaauuccc

SEQ ID NO: 1556188 - RNA, 15 nt, Homo sapiens
uuuguaaugcugcac

SEQ ID NO: 1556189 - RNA, 20 nt, Homo sapiens
uuuguaaugcugcacagaaa

SEQ ID NO: 1556190 - RNA, 15 nt, Homo sapiens
uuuguacaacccuga

SEQ ID NO: 1556191 - RNA, 14 nt, Homo sapiens
uuuguaccagugaa

SEQ ID NO: 1556192 - RNA, 22 nt, Homo sapiens
uuuguauauaggcuucucacgg

SEQ ID NO: 1556193 - RNA, 17 nt, Homo sapiens
uuuguaugacagugaag

SEQ ID NO: 1556194 - RNA, 19 nt, Homo sapiens
uuuguauuuuuaguagaga

SEQ ID NO: 1556195 - RNA, 22 nt, Homo sapiens
uuugucacaaauaaacauaaua

SEQ ID NO: 1556196 - RNA, 15 nt, Homo sapiens
uuuguccucucugug

SEQ ID NO: 1556197 - RNA, 13 nt, Homo sapiens
uuuguggccucag

SEQ ID NO: 1556198 - RNA, 13 nt, Homo sapiens
uuuguguguuuca

SEQ ID NO: 1556199 - RNA, 22 nt, Homo sapiens
uuuguuguuugauucagcaaaa

SEQ ID NO: 1556200 - RNA, 24 nt, Homo sapiens
uuuguuuaaacccaagugcugcac

SEQ ID NO: 1556201 - RNA, 16 nt, Homo sapiens
uuuguuugcaucugaa

SEQ ID NO: 1556202 - RNA, 14 nt, Homo sapiens
uuuuaaaagugcac

SEQ ID NO: 1556203 - RNA, 15 nt, Homo sapiens
uuuuaaaaugcauca

SEQ ID NO: 1556204 - RNA, 20 nt, Homo sapiens
uuuuaaacacuaaucacaaa

SEQ ID NO: 1556205 - RNA, 20 nt, Homo sapiens
uuuuaaaguaaacuugugua

SEQ ID NO: 1556206 - RNA, 14 nt, Homo sapiens
uuuuaaauccuaaa

SEQ ID NO: 1556207 - RNA, 20 nt, Homo sapiens
uuuuaaauguauacuauagu

SEQ ID NO: 1556208 - RNA, 18 nt, Homo sapiens
uuuuaaauuuuaugucau

SEQ ID NO: 1556209 - RNA, 14 nt, Homo sapiens
uuuuaacucuagaa

SEQ ID NO: 1556210 - RNA, 17 nt, Homo sapiens
uuuuaacugauuuaaca

SEQ ID NO: 1556211 - RNA, 13 nt, Homo sapiens
uuuuaacuuucua

SEQ ID NO: 1556212 - RNA, 21 nt, Homo sapiens
uuuuaauaacuuaucuauaaa

SEQ ID NO: 1556213 - RNA, 21 nt, Homo sapiens
uuuuaaucuuccauuccuuca

SEQ ID NO: 1556214 - RNA, 19 nt, Homo sapiens
uuuuaaugaagugcaauac

SEQ ID NO: 1556215 - RNA, 12 nt, Homo sapiens
uuuuacugucag

SEQ ID NO: 1556216 - RNA, 15 nt, Homo sapiens
uuuuacugugauuca

SEQ ID NO: 1556217 - RNA, 17 nt, Homo sapiens
uuuuacuucucuauaca

SEQ ID NO: 1556218 - RNA, 12 nt, Homo sapiens
uuuuacuuucag

SEQ ID NO: 1556219 - RNA, 22 nt, Homo sapiens
uuuuagaauuaaaaaagcauac

SEQ ID NO: 1556220 - RNA, 18 nt, Homo sapiens
uuuuaguuuguucuucag

SEQ ID NO: 1556221 - RNA, 20 nt, Homo sapiens
uuuuauaggcauaccuccua

SEQ ID NO: 1556222 - RNA, 16 nt, Homo sapiens
uuuuaucucacaaaua

SEQ ID NO: 1556223 - RNA, 19 nt, Homo sapiens
uuuuauguguugaugacuc

SEQ ID NO: 1556224 - RNA, 14 nt, Homo sapiens
uuuuauguucuugg

SEQ ID NO: 1556225 - RNA, 15 nt, Homo sapiens
uuuuauuaugcauua

SEQ ID NO: 1556226 - RNA, 15 nt, Homo sapiens
uuuucaaugucuaaa

SEQ ID NO: 1556227 - RNA, 19 nt, Homo sapiens
uuuucaauuugagauucua

SEQ ID NO: 1556228 - RNA, 17 nt, Homo sapiens
uuuucacagucacugau

SEQ ID NO: 1556229 - RNA, 18 nt, Homo sapiens
uuuucacuucuaccuaca

SEQ ID NO: 1556230 - RNA, 12 nt, Homo sapiens
uuuucacuugua

SEQ ID NO: 1556231 - RNA, 15 nt, Homo sapiens
uuuucagaccccagc

SEQ ID NO: 1556232 - RNA, 16 nt, Homo sapiens
uuuucagacugcaaua

SEQ ID NO: 1556233 - RNA, 19 nt, Homo sapiens
uuuucaucccguaucacag

SEQ ID NO: 1556234 - RNA, 15 nt, Homo sapiens
uuuucauucugccaa

SEQ ID NO: 1556235 - RNA, 18 nt, Homo sapiens
uuuuccagaagauuucac

SEQ ID NO: 1556236 - RNA, 18 nt, Homo sapiens
uuuuccccaaaccauaaa

SEQ ID NO: 1556237 - RNA, 18 nt, Homo sapiens
uuuuccuagcuguguuau

SEQ ID NO: 1556238 - RNA, 16 nt, Homo sapiens
uuuuccuaugcuauug

SEQ ID NO: 1556239 - RNA, 17 nt, Homo sapiens
uuuuccuauuuacaugu

SEQ ID NO: 1556240 - RNA, 21 nt, Homo sapiens
uuuucuaagaaagaaauugua

SEQ ID NO: 1556241 - RNA, 21 nt, Homo sapiens
uuuucucaaccugggacuucc

SEQ ID NO: 1556242 - RNA, 13 nt, Homo sapiens
uuuucugccaaga

SEQ ID NO: 1556243 - RNA, 15 nt, Homo sapiens
uuuucuguaauguaa

SEQ ID NO: 1556244 - RNA, 22 nt, Homo sapiens
uuuucuuacuagaccuguaacu

SEQ ID NO: 1556245 - RNA, 13 nt, Homo sapiens
uuuucuucauuca

SEQ ID NO: 1556246 - RNA, 13 nt, Homo sapiens
uuuugaaagaagc

SEQ ID NO: 1556247 - RNA, 13 nt, Homo sapiens
uuuugaaggcaaa

SEQ ID NO: 1556248 - RNA, 15 nt, Homo sapiens
uuuugaguaauucaa

SEQ ID NO: 1556249 - RNA, 22 nt, Homo sapiens
uuuugaugaaauaaaauaucaa

SEQ ID NO: 1556250 - RNA, 17 nt, Homo sapiens
uuuugcaaaacauaucu

SEQ ID NO: 1556251 - RNA, 18 nt, Homo sapiens
uuuugcacacuuugccau

SEQ ID NO: 1556252 - RNA, 11 nt, Homo sapiens
uuuugcacuga

SEQ ID NO: 1556253 - RNA, 17 nt, Homo sapiens
uuuugcagaaaucacaa

SEQ ID NO: 1556254 - RNA, 14 nt, Homo sapiens
uuuugcauugccaa

SEQ ID NO: 1556255 - RNA, 15 nt, Homo sapiens
uuuugcccuauauac

SEQ ID NO: 1556256 - RNA, 15 nt, Homo sapiens
uuuugcuacauucua

SEQ ID NO: 1556257 - RNA, 11 nt, Homo sapiens
uuuuggaugag

SEQ ID NO: 1556258 - RNA, 17 nt, Homo sapiens
uuuuguaagaaggcaau

SEQ ID NO: 1556259 - RNA, 21 nt, Homo sapiens
uuuuguaugaaauauauguga

SEQ ID NO: 1556260 - RNA, 13 nt, Homo sapiens
uuuuguaugccaa

SEQ ID NO: 1556261 - RNA, 13 nt, Homo sapiens
uuuugugauugcc

SEQ ID NO: 1556262 - RNA, 18 nt, Homo sapiens
uuuuuaaaaauaaaggaa

SEQ ID NO: 1556263 - RNA, 17 nt, Homo sapiens
uuuuuaaauuuuguaug

SEQ ID NO: 1556264 - RNA, 14 nt, Homo sapiens
uuuuuaaguguucu

SEQ ID NO: 1556265 - RNA, 15 nt, Homo sapiens
uuuuuaauagcacua

SEQ ID NO: 1556266 - RNA, 22 nt, Homo sapiens
uuuuuaauuaaaugaagccaag

SEQ ID NO: 1556267 - RNA, 18 nt, Homo sapiens
uuuuuauacaauggaaua

SEQ ID NO: 1556268 - RNA, 16 nt, Homo sapiens
uuuuuaucugcauaaa

SEQ ID NO: 1556269 - RNA, 13 nt, Homo sapiens
uuuuuaugaaaua

SEQ ID NO: 1556270 - RNA, 18 nt, Homo sapiens
uuuuuauuaugcauuaua

SEQ ID NO: 1556271 - RNA, 23 nt, Homo sapiens
uuuuucacuucuaccuacauauu

SEQ ID NO: 1556272 - RNA, 20 nt, Homo sapiens
uuuuuccaauuuuguugcau

SEQ ID NO: 1556273 - RNA, 16 nt, Homo sapiens
uuuuucccccaugaaa

SEQ ID NO: 1556274 - RNA, 14 nt, Homo sapiens
uuuuuccuaaaaga

SEQ ID NO: 1556275 - RNA, 15 nt, Homo sapiens
uuuuucuaaugagga

SEQ ID NO: 1556276 - RNA, 22 nt, Homo sapiens
uuuuucuccagaccccaugccu

SEQ ID NO: 1556277 - RNA, 22 nt, Homo sapiens
uuuuugcaacuauuuccaccuc

SEQ ID NO: 1556278 - RNA, 22 nt, Homo sapiens
uuuuuggaaaauaaaaagugcc

SEQ ID NO: 1556279 - RNA, 15 nt, Homo sapiens
uuuuuggaaagucag

SEQ ID NO: 1556280 - RNA, 18 nt, Homo sapiens
uuuuuggcauuccaccuc

SEQ ID NO: 1556281 - RNA, 18 nt, Homo sapiens
uuuuugggggaaggucag

SEQ ID NO: 1556282 - RNA, 16 nt, Homo sapiens
uuuuuguaaacuggaa

SEQ ID NO: 1556283 - RNA, 12 nt, Homo sapiens
uuuuugugucaa

SEQ ID NO: 1556284 - RNA, 18 nt, Homo sapiens
uuuuuguucaaagccagc

SEQ ID NO: 1556285 - RNA, 18 nt, Homo sapiens
uuuuuuaaaaaagcuuaa

SEQ ID NO: 1556286 - RNA, 21 nt, Homo sapiens
uuuuuucccccuaucaguuga

SEQ ID NO: 1556287 - RNA, 13 nt, Homo sapiens
uuucaauuacaaa

SEQ ID NO: 1556288 - RNA, 12 nt, Homo sapiens
uuucaauugcau

SEQ ID NO: 1556289 - RNA, 17 nt, Homo sapiens
uuucaccccacucugua

SEQ ID NO: 1556290 - RNA, 19 nt, Homo sapiens
uuucaccccacucuguaca

SEQ ID NO: 1556291 - RNA, 15 nt, Homo sapiens
uuucacccucaugaa

SEQ ID NO: 1556292 - RNA, 21 nt, Homo sapiens
uuucaccgggcaauccaagua

SEQ ID NO: 1556293 - RNA, 13 nt, Homo sapiens
uuucaccuguaaa

SEQ ID NO: 1556294 - RNA, 15 nt, Homo sapiens
uuucacucugucauc

SEQ ID NO: 1556295 - RNA, 13 nt, Homo sapiens
uuucagaaaacau

SEQ ID NO: 1556296 - RNA, 18 nt, Homo sapiens
uuucagguuccaaucaga

SEQ ID NO: 1556297 - RNA, 18 nt, Homo sapiens
uuucagugugagucagaa

SEQ ID NO: 1556298 - RNA, 15 nt, Homo sapiens
uuucauaguguucau

SEQ ID NO: 1556299 - RNA, 20 nt, Homo sapiens
uuucauauuuauggacauga

SEQ ID NO: 1556300 - RNA, 20 nt, Homo sapiens
uuucauccuauaagcuuaaa

SEQ ID NO: 1556301 - RNA, 15 nt, Homo sapiens
uuucauccuugacua

SEQ ID NO: 1556302 - RNA, 15 nt, Homo sapiens
uuucaucugcucucc

SEQ ID NO: 1556303 - RNA, 19 nt, Homo sapiens
uuucaucuuuugaagagca

SEQ ID NO: 1556304 - RNA, 14 nt, Homo sapiens
uuucaugauauaau

SEQ ID NO: 1556305 - RNA, 13 nt, Homo sapiens
uuucaugcaaaag

SEQ ID NO: 1556306 - RNA, 15 nt, Homo sapiens
uuucaugcagccuaa

SEQ ID NO: 1556307 - RNA, 17 nt, Homo sapiens
uuucaugcuuuccuaaa

SEQ ID NO: 1556308 - RNA, 19 nt, Homo sapiens
uuucauguauguauauaau

SEQ ID NO: 1556309 - RNA, 17 nt, Homo sapiens
uuucaugucuugucaua

SEQ ID NO: 1556310 - RNA, 11 nt, Homo sapiens
uuucauuccau

SEQ ID NO: 1556311 - RNA, 12 nt, Homo sapiens
uuucauuugcca

SEQ ID NO: 1556312 - RNA, 21 nt, Homo sapiens
uuucauuugguucauuaauuc

SEQ ID NO: 1556313 - RNA, 12 nt, Homo sapiens
uuuccaaaacau

SEQ ID NO: 1556314 - RNA, 16 nt, Homo sapiens
uuuccaaaacauuucu

SEQ ID NO: 1556315 - RNA, 14 nt, Homo sapiens
uuuccaaccggcuu

SEQ ID NO: 1556316 - RNA, 15 nt, Homo sapiens
uuuccacuccauugu

SEQ ID NO: 1556317 - RNA, 23 nt, Homo sapiens
uuuccaguguucuauuugcuuua

SEQ ID NO: 1556318 - RNA, 23 nt, Homo sapiens
uuuccaguuuauaagacuggaau

SEQ ID NO: 1556319 - RNA, 18 nt, Homo sapiens
uuuccauaaauuuggacu

SEQ ID NO: 1556320 - RNA, 15 nt, Homo sapiens
uuucccaacaccucu

SEQ ID NO: 1556321 - RNA, 17 nt, Homo sapiens
uuucccacgaggaaucu

SEQ ID NO: 1556322 - RNA, 13 nt, Homo sapiens
uuucccauugcca

SEQ ID NO: 1556323 - RNA, 14 nt, Homo sapiens
uuucccuacugaac

SEQ ID NO: 1556324 - RNA, 14 nt, Homo sapiens
uuuccuaagacauu

SEQ ID NO: 1556325 - RNA, 19 nt, Homo sapiens
uuuccuacaggcagucucu

SEQ ID NO: 1556326 - RNA, 15 nt, Homo sapiens
uuuccuaccuugugc

SEQ ID NO: 1556327 - RNA, 20 nt, Homo sapiens
uuuccuaccuugugcuuagc

SEQ ID NO: 1556328 - RNA, 22 nt, Homo sapiens
uuuccuaucauguuaaccucug

SEQ ID NO: 1556329 - RNA, 12 nt, Homo sapiens
uuuccucaaaaa

SEQ ID NO: 1556330 - RNA, 20 nt, Homo sapiens
uuuccucugugcaaagggaa

SEQ ID NO: 1556331 - RNA, 16 nt, Homo sapiens
uuuccugauaacauua

SEQ ID NO: 1556332 - RNA, 17 nt, Homo sapiens
uuuccuggucccucacc

SEQ ID NO: 1556333 - RNA, 12 nt, Homo sapiens
uuuccuguaaua

SEQ ID NO: 1556334 - RNA, 13 nt, Homo sapiens
uuuccugugacaa

SEQ ID NO: 1556335 - RNA, 22 nt, Homo sapiens
uugucaauaguauuaacuauua

SEQ ID NO: 1556336 - RNA, 13 nt, Homo sapiens
uugucaccaugau

SEQ ID NO: 1556337 - RNA, 20 nt, Homo sapiens
uugucaccucagcacugugg

SEQ ID NO: 1556338 - RNA, 21 nt, Homo sapiens
uugucagccaucguccuggga

SEQ ID NO: 1556339 - RNA, 20 nt, Homo sapiens
uugucagccuugcuacuuga

SEQ ID NO: 1556340 - RNA, 14 nt, Homo sapiens
uugucauccuuuga

SEQ ID NO: 1556341 - RNA, 21 nt, Homo sapiens
uugucggccccaccagugccu

SEQ ID NO: 1556342 - RNA, 15 nt, Homo sapiens
uugucuaccauuugu

SEQ ID NO: 1556343 - RNA, 16 nt, Homo sapiens
uugucuuacuguugca

SEQ ID NO: 1556344 - RNA, 20 nt, Homo sapiens
uugugaugauagcacugguu

SEQ ID NO: 1556345 - RNA, 12 nt, Homo sapiens
uugugauugccu

SEQ ID NO: 1556346 - RNA, 18 nt, Homo sapiens
uugugcaaaauauuugac

SEQ ID NO: 1556347 - RNA, 13 nt, Homo sapiens
uugugcaaacaug

SEQ ID NO: 1556348 - RNA, 19 nt, Homo sapiens
uugugcacauguacccuaa

SEQ ID NO: 1556349 - RNA, 16 nt, Homo sapiens
uugugcuuucaccaga

SEQ ID NO: 1556350 - RNA, 17 nt, Homo sapiens
uuguggguccaugcuaa

SEQ ID NO: 1556351 - RNA, 17 nt, Homo sapiens
uugugucuggcaguuua

SEQ ID NO: 1556352 - RNA, 16 nt, Homo sapiens
uugugugaaaauguga

SEQ ID NO: 1556353 - RNA, 17 nt, Homo sapiens
uuguguuaccuguagau

SEQ ID NO: 1556354 - RNA, 14 nt, Homo sapiens
uuguuaauacuaua

SEQ ID NO: 1556355 - RNA, 13 nt, Homo sapiens
uuguuagcacuag

SEQ ID NO: 1556356 - RNA, 17 nt, Homo sapiens
uuguuauuugaaaacau

SEQ ID NO: 1556357 - RNA, 23 nt, Homo sapiens
uuguucaacucccuucucggggu

SEQ ID NO: 1556358 - RNA, 21 nt, Homo sapiens
uuguuccuuccuuucuuuccg

SEQ ID NO: 1556359 - RNA, 22 nt, Homo sapiens
uuguucgccgcguggaauguga

SEQ ID NO: 1556360 - RNA, 12 nt, Homo sapiens
uuguucucagaa

SEQ ID NO: 1556361 - RNA, 16 nt, Homo sapiens
uuguugcugucaagau

SEQ ID NO: 1556362 - RNA, 23 nt, Homo sapiens
uuguuggagucaaaaagaaccac

SEQ ID NO: 1556363 - RNA, 16 nt, Homo sapiens
uuguuggucuguagca

SEQ ID NO: 1556364 - RNA, 17 nt, Homo sapiens
uuguuuaacauugcuga

SEQ ID NO: 1556365 - RNA, 15 nt, Homo sapiens
uuguuuagaaagaau

SEQ ID NO: 1556366 - RNA, 22 nt, Homo sapiens
uuguuugguuagugacugaugu

SEQ ID NO: 1556367 - RNA, 16 nt, Homo sapiens
uuguuuguggucuaua

SEQ ID NO: 1556368 - RNA, 13 nt, Homo sapiens
uuguuuuuugcca

SEQ ID NO: 1556369 - RNA, 19 nt, Homo sapiens
uuuaaaaaaagagcuaaga

SEQ ID NO: 1556370 - RNA, 14 nt, Homo sapiens
uuuaaaaaagcaaa

SEQ ID NO: 1556371 - RNA, 16 nt, Homo sapiens
uuuaaaacauucacac

SEQ ID NO: 1556372 - RNA, 14 nt, Homo sapiens
uuuaaaaucuguca

SEQ ID NO: 1556373 - RNA, 18 nt, Homo sapiens
uuuaaaguggcaaucuca

SEQ ID NO: 1556374 - RNA, 15 nt, Homo sapiens
uuuaaaguucugugu

SEQ ID NO: 1556375 - RNA, 16 nt, Homo sapiens
uuuaaauaucugaaca

SEQ ID NO: 1556376 - RNA, 13 nt, Homo sapiens
uuuaaaucaagga

SEQ ID NO: 1556377 - RNA, 12 nt, Homo sapiens
uuuaaaucugag

SEQ ID NO: 1556378 - RNA, 15 nt, Homo sapiens
uuuaaaucugugaug

SEQ ID NO: 1556379 - RNA, 22 nt, Homo sapiens
uuuaaauuacaauuuuaucugu

SEQ ID NO: 1556380 - RNA, 13 nt, Homo sapiens
uuuaaauuccaca

SEQ ID NO: 1556381 - RNA, 14 nt, Homo sapiens
uggggccgggaccc

SEQ ID NO: 1556382 - RNA, 15 nt, Homo sapiens
uggggccgggacccc

SEQ ID NO: 1556383 - RNA, 13 nt, Homo sapiens
uggggccucaggc

SEQ ID NO: 1556384 - RNA, 14 nt, Homo sapiens
uggggccucaggcu

SEQ ID NO: 1556385 - RNA, 15 nt, Homo sapiens
uggggcucucucuuc

SEQ ID NO: 1556386 - RNA, 14 nt, Homo sapiens
ugggggacacccgg

SEQ ID NO: 1556387 - RNA, 17 nt, Homo sapiens
ugggggguuuucuugcc

SEQ ID NO: 1556388 - RNA, 15 nt, Homo sapiens
ugggguaacaucugu

SEQ ID NO: 1556389 - RNA, 23 nt, Homo sapiens
uggggugucaauaaagcugugcu

SEQ ID NO: 1556390 - RNA, 16 nt, Homo sapiens
ugggguuucaccauau

SEQ ID NO: 1556391 - RNA, 18 nt, Homo sapiens
ugggguuucuggggucca

SEQ ID NO: 1556392 - RNA, 16 nt, Homo sapiens
uggguacaucaagucc

SEQ ID NO: 1556393 - RNA, 21 nt, Homo sapiens
uggguacugaaagccuuaggg

SEQ ID NO: 1556394 - RNA, 18 nt, Homo sapiens
ugggucacagagugagac

SEQ ID NO: 1556395 - RNA, 15 nt, Homo sapiens
uggguccaugcuaac

SEQ ID NO: 1556396 - RNA, 22 nt, Homo sapiens
uggguccucgcugcuggcugcu

SEQ ID NO: 1556397 - RNA, 22 nt, Homo sapiens
ugggugagagugagacucaguc

SEQ ID NO: 1556398 - RNA, 21 nt, Homo sapiens
uggguguuucaguuugaaaau

SEQ ID NO: 1556399 - RNA, 17 nt, Homo sapiens
uggguucucuacaugca

SEQ ID NO: 1556400 - RNA, 17 nt, Homo sapiens
uggguuggacaaccuca

SEQ ID NO: 1556401 - RNA, 21 nt, Homo sapiens
uggguuuaacaagcugucuac

SEQ ID NO: 1556402 - RNA, 22 nt, Homo sapiens
ugguaaaccagaucugucucca

SEQ ID NO: 1556403 - RNA, 13 nt, Homo sapiens
ugguacugugaug

SEQ ID NO: 1556404 - RNA, 23 nt, Homo sapiens
ugguacuuagaguuucuguuuga

SEQ ID NO: 1556405 - RNA, 14 nt, Homo sapiens
ugguacuuccucug

SEQ ID NO: 1556406 - RNA, 12 nt, Homo sapiens
ugguacuuugca

SEQ ID NO: 1556407 - RNA, 15 nt, Homo sapiens
ugguagaugacaaau

SEQ ID NO: 1556408 - RNA, 15 nt, Homo sapiens
ugguaggcauuuccu

SEQ ID NO: 1556409 - RNA, 12 nt, Homo sapiens
ugguaguguccc

SEQ ID NO: 1556410 - RNA, 22 nt, Homo sapiens
ugguauaaacguccuacuguau

SEQ ID NO: 1556411 - RNA, 20 nt, Homo sapiens
ugguaugcuggccagcaccc

SEQ ID NO: 1556412 - RNA, 18 nt, Homo sapiens
ugguauuauauaauucaa

SEQ ID NO: 1556413 - RNA, 18 nt, Homo sapiens
ugguauuuuccagcacuu

SEQ ID NO: 1556414 - RNA, 18 nt, Homo sapiens
uggucacagccuccucug

SEQ ID NO: 1556415 - RNA, 21 nt, Homo sapiens
uggucacccaacucaaggaca

SEQ ID NO: 1556416 - RNA, 14 nt, Homo sapiens
uggucacugcugag

SEQ ID NO: 1556417 - RNA, 15 nt, Homo sapiens
uggucaggagccucu

SEQ ID NO: 1556418 - RNA, 12 nt, Homo sapiens
ugguccaaaaau

SEQ ID NO: 1556419 - RNA, 20 nt, Homo sapiens
uggucccggggccagcacuu

SEQ ID NO: 1556420 - RNA, 21 nt, Homo sapiens
uggucccggggccagcacuuc

SEQ ID NO: 1556421 - RNA, 12 nt, Homo sapiens
ugguccuggaac

SEQ ID NO: 1556422 - RNA, 22 nt, Homo sapiens
uggucucaaacuccugaccuca

SEQ ID NO: 1556423 - RNA, 12 nt, Homo sapiens
uggucucagugu

SEQ ID NO: 1556424 - RNA, 15 nt, Homo sapiens
uggucuccaugcuca

SEQ ID NO: 1556425 - RNA, 21 nt, Homo sapiens
uggucugauggaacuguguau

SEQ ID NO: 1556426 - RNA, 18 nt, Homo sapiens
uggucuguuugcauuuga

SEQ ID NO: 1556427 - RNA, 16 nt, Homo sapiens
uggugaaaucccaucu

SEQ ID NO: 1556428 - RNA, 14 nt, Homo sapiens
uggugacaguccaa

SEQ ID NO: 1556429 - RNA, 19 nt, Homo sapiens
uggugauauuguguggucu

SEQ ID NO: 1556430 - RNA, 17 nt, Homo sapiens
uggugauugucauguaa

SEQ ID NO: 1556431 - RNA, 15 nt, Homo sapiens
uggugggcaaaaaca

SEQ ID NO: 1556432 - RNA, 17 nt, Homo sapiens
uggugggucuauguucc

SEQ ID NO: 1556433 - RNA, 20 nt, Homo sapiens
ugguguaaauauuagugcag

SEQ ID NO: 1556434 - RNA, 19 nt, Homo sapiens
uggugucagccccacagga

SEQ ID NO: 1556435 - RNA, 12 nt, Homo sapiens
uggugucauuua

SEQ ID NO: 1556436 - RNA, 16 nt, Homo sapiens
uggugucauuuaguaa

SEQ ID NO: 1556437 - RNA, 15 nt, Homo sapiens
ugguuacacuguuag

SEQ ID NO: 1556438 - RNA, 10 nt, Homo sapiens
ugguuaucau

SEQ ID NO: 1556439 - RNA, 18 nt, Homo sapiens
ugguuauccaauugcucu

SEQ ID NO: 1556440 - RNA, 17 nt, Homo sapiens
ugguuauggagucuugu

SEQ ID NO: 1556441 - RNA, 17 nt, Homo sapiens
ugguuaugugcauuauu

SEQ ID NO: 1556442 - RNA, 16 nt, Homo sapiens
ugguucaccugaauca

SEQ ID NO: 1556443 - RNA, 21 nt, Homo sapiens
ugguucaguacugucuaucaa

SEQ ID NO: 1556444 - RNA, 14 nt, Homo sapiens
ugguucaucccuuu

SEQ ID NO: 1556445 - RNA, 14 nt, Homo sapiens
ugguuccaaagaca

SEQ ID NO: 1556446 - RNA, 16 nt, Homo sapiens
ugguuccuguucacuc

SEQ ID NO: 1556447 - RNA, 17 nt, Homo sapiens
ugguuuauugaauguga

SEQ ID NO: 1556448 - RNA, 18 nt, Homo sapiens
ugguuucccaagagcuac

SEQ ID NO: 1556449 - RNA, 18 nt, Homo sapiens
ugguuuggggagacaggu

SEQ ID NO: 1556450 - RNA, 12 nt, Homo sapiens
ugguuuguucuc

SEQ ID NO: 1556451 - RNA, 20 nt, Homo sapiens
ugguuuuacagcuccuuuga

SEQ ID NO: 1556452 - RNA, 15 nt, Homo sapiens
ugguuuugcuucccc

SEQ ID NO: 1556453 - RNA, 14 nt, Homo sapiens
ugguuuuuccucau

SEQ ID NO: 1556454 - RNA, 22 nt, Homo sapiens
uguaaaauagugaauaaaguca

SEQ ID NO: 1556455 - RNA, 20 nt, Homo sapiens
uguaaaaugcaccaaucagc

SEQ ID NO: 1556456 - RNA, 22 nt, Homo sapiens
uguaaaauggaggccauugugu

SEQ ID NO: 1556457 - RNA, 15 nt, Homo sapiens
uguaaaauuauuuca

SEQ ID NO: 1556458 - RNA, 19 nt, Homo sapiens
uguaaacuguacuagucug

SEQ ID NO: 1556459 - RNA, 13 nt, Homo sapiens
uguaaauaugcaa

SEQ ID NO: 1556460 - RNA, 15 nt, Homo sapiens
uguaaauaugcaaau

SEQ ID NO: 1556461 - RNA, 16 nt, Homo sapiens
uguaaauauugcuaaa

SEQ ID NO: 1556462 - RNA, 13 nt, Homo sapiens
uguaaaugugcuu

SEQ ID NO: 1556463 - RNA, 20 nt, Homo sapiens
uguaaauguguuagcacuga

SEQ ID NO: 1556464 - RNA, 23 nt, Homo sapiens
uguaaauugcaaauaaaccacuu

SEQ ID NO: 1556465 - RNA, 14 nt, Homo sapiens
uguaacagugcaag

SEQ ID NO: 1556466 - RNA, 13 nt, Homo sapiens
uguaaccacugca

SEQ ID NO: 1556467 - RNA, 23 nt, Homo sapiens
uguaacucacccccaccaccaua

SEQ ID NO: 1556468 - RNA, 12 nt, Homo sapiens
uguaacuuucau

SEQ ID NO: 1556469 - RNA, 12 nt, Homo sapiens
uguaagaacaac

SEQ ID NO: 1556470 - RNA, 17 nt, Homo sapiens
uguaagaaguuucuuaa

SEQ ID NO: 1556471 - RNA, 20 nt, Homo sapiens
uguaagcaacuugcuucuaa

SEQ ID NO: 1556472 - RNA, 21 nt, Homo sapiens
uguaaggaguauaccaugaga

SEQ ID NO: 1556473 - RNA, 15 nt, Homo sapiens
uguaauaaagugaac

SEQ ID NO: 1556474 - RNA, 13 nt, Homo sapiens
uguaaucccagca

SEQ ID NO: 1556475 - RNA, 17 nt, Homo sapiens
uguaaucucacuacaca

SEQ ID NO: 1556476 - RNA, 14 nt, Homo sapiens
uguaaugagcaccu

SEQ ID NO: 1556477 - RNA, 20 nt, Homo sapiens
uguaauuaaaagcaaaucau

SEQ ID NO: 1556478 - RNA, 18 nt, Homo sapiens
uguaauuuaaaauuguga

SEQ ID NO: 1556479 - RNA, 16 nt, Homo sapiens
uguaauuucgccuuaa

SEQ ID NO: 1556480 - RNA, 20 nt, Homo sapiens
uguaauuuuguccucucugu

SEQ ID NO: 1556481 - RNA, 21 nt, Homo sapiens
uguacaaguauuacaaccaua

SEQ ID NO: 1556482 - RNA, 21 nt, Homo sapiens
uguacaauaaaaacauugccu

SEQ ID NO: 1556483 - RNA, 18 nt, Homo sapiens
uguacacuuucugucuca

SEQ ID NO: 1556484 - RNA, 15 nt, Homo sapiens
uguacagacauauuu

SEQ ID NO: 1556485 - RNA, 15 nt, Homo sapiens
uguacagagugcuuu

SEQ ID NO: 1556486 - RNA, 22 nt, Homo sapiens
uguacaguuuuuauugcuuguu

SEQ ID NO: 1556487 - RNA, 18 nt, Homo sapiens
uguacauaauucuugcua

SEQ ID NO: 1556488 - RNA, 15 nt, Homo sapiens
uguaccagugaauuu

SEQ ID NO: 1556489 - RNA, 14 nt, Homo sapiens
uguaccauuugccu

SEQ ID NO: 1556490 - RNA, 22 nt, Homo sapiens
uguacccuccuccccacacaga

SEQ ID NO: 1556491 - RNA, 13 nt, Homo sapiens
uguaccucagugg

SEQ ID NO: 1556492 - RNA, 15 nt, Homo sapiens
uguaccugacuucca

SEQ ID NO: 1556493 - RNA, 17 nt, Homo sapiens
uguagaauaaaugaaga

SEQ ID NO: 1556494 - RNA, 16 nt, Homo sapiens
uguagacaaaguacau

SEQ ID NO: 1556495 - RNA, 16 nt, Homo sapiens
uguagagagcagcauu

SEQ ID NO: 1556496 - RNA, 20 nt, Homo sapiens
uguagagagcagcauuccca

SEQ ID NO: 1556497 - RNA, 20 nt, Homo sapiens
uguagaugggggaacuguga

SEQ ID NO: 1556498 - RNA, 22 nt, Homo sapiens
uguagaugggggaacugugaau

SEQ ID NO: 1556499 - RNA, 12 nt, Homo sapiens
uguagcacuuac

SEQ ID NO: 1556500 - RNA, 15 nt, Homo sapiens
uguagcgcuuugaau

SEQ ID NO: 1556501 - RNA, 18 nt, Homo sapiens
uggcaaaaccaguagcuu

SEQ ID NO: 1556502 - RNA, 14 nt, Homo sapiens
uggcaacucaaggc

SEQ ID NO: 1556503 - RNA, 20 nt, Homo sapiens
uggcaacucaaggcugcuuc

SEQ ID NO: 1556504 - RNA, 15 nt, Homo sapiens
uggcaaggugacauu

SEQ ID NO: 1556505 - RNA, 14 nt, Homo sapiens
uggcaaugggacuc

SEQ ID NO: 1556506 - RNA, 16 nt, Homo sapiens
uggcacaugccuguaa

SEQ ID NO: 1556507 - RNA, 22 nt, Homo sapiens
uggcacauggguggacacggau

SEQ ID NO: 1556508 - RNA, 15 nt, Homo sapiens
uggcaccagaugcaa

SEQ ID NO: 1556509 - RNA, 14 nt, Homo sapiens
uggcacccagagaa

SEQ ID NO: 1556510 - RNA, 15 nt, Homo sapiens
uggcacguauugcug

SEQ ID NO: 1556511 - RNA, 14 nt, Homo sapiens
uggcacucucugcc

SEQ ID NO: 1556512 - RNA, 12 nt, Homo sapiens
uggcacuggcca

SEQ ID NO: 1556513 - RNA, 13 nt, Homo sapiens
uggcacuggccac

SEQ ID NO: 1556514 - RNA, 12 nt, Homo sapiens
uggcagacaucu

SEQ ID NO: 1556515 - RNA, 19 nt, Homo sapiens
uggcagaguuacaguucug

SEQ ID NO: 1556516 - RNA, 12 nt, Homo sapiens
uggcagaugucu

SEQ ID NO: 1556517 - RNA, 12 nt, Homo sapiens
uggcaggcccac

SEQ ID NO: 1556518 - RNA, 15 nt, Homo sapiens
uggcagggagcagua

SEQ ID NO: 1556519 - RNA, 15 nt, Homo sapiens
uggcagucacaucuc

SEQ ID NO: 1556520 - RNA, 19 nt, Homo sapiens
uggcauacugagaauauac

SEQ ID NO: 1556521 - RNA, 21 nt, Homo sapiens
uggcauaggccuuagcaguaa

SEQ ID NO: 1556522 - RNA, 16 nt, Homo sapiens
uggcaugucauuugca

SEQ ID NO: 1556523 - RNA, 23 nt, Homo sapiens
uggcauuuuauaggcauaccucc

SEQ ID NO: 1556524 - RNA, 21 nt, Homo sapiens
uggccaaugagaucauuguga

SEQ ID NO: 1556525 - RNA, 14 nt, Homo sapiens
uggccaauuucacc

SEQ ID NO: 1556526 - RNA, 14 nt, Homo sapiens
uggccacagacuga

SEQ ID NO: 1556527 - RNA, 15 nt, Homo sapiens
uggccaccaguauga

SEQ ID NO: 1556528 - RNA, 21 nt, Homo sapiens
uggccaccccuccccaguaca

SEQ ID NO: 1556529 - RNA, 19 nt, Homo sapiens
uggccagagccucuggccc

SEQ ID NO: 1556530 - RNA, 16 nt, Homo sapiens
uggccaucccugugag

SEQ ID NO: 1556531 - RNA, 23 nt, Homo sapiens
uggccauuacccccagcuuugag

SEQ ID NO: 1556532 - RNA, 18 nt, Homo sapiens
uggcccacauuuuccuua

SEQ ID NO: 1556533 - RNA, 15 nt, Homo sapiens
uggcccauaauguga

SEQ ID NO: 1556534 - RNA, 13 nt, Homo sapiens
uggcccuaaagga

SEQ ID NO: 1556535 - RNA, 14 nt, Homo sapiens
uggcccuaugcuuc

SEQ ID NO: 1556536 - RNA, 14 nt, Homo sapiens
uggccggcugguug

SEQ ID NO: 1556537 - RNA, 19 nt, Homo sapiens
uggccgggucccugagcuc

SEQ ID NO: 1556538 - RNA, 22 nt, Homo sapiens
uggccuauccgcugccagccuu

SEQ ID NO: 1556539 - RNA, 23 nt, Homo sapiens
uggccucacccaccccugcacag

SEQ ID NO: 1556540 - RNA, 16 nt, Homo sapiens
uggccucuucaggccu

SEQ ID NO: 1556541 - RNA, 13 nt, Homo sapiens
uggccugagacaa

SEQ ID NO: 1556542 - RNA, 23 nt, Homo sapiens
uggccugcugggcucuccaccuc

SEQ ID NO: 1556543 - RNA, 19 nt, Homo sapiens
uggccuuaagaacuguguc

SEQ ID NO: 1556544 - RNA, 19 nt, Homo sapiens
uggccuucauaucauccac

SEQ ID NO: 1556545 - RNA, 19 nt, Homo sapiens
uggccuucugaacuccaua

SEQ ID NO: 1556546 - RNA, 14 nt, Homo sapiens
uggccuuuaggaag

SEQ ID NO: 1556547 - RNA, 22 nt, Homo sapiens
uggcgccccuuccuaggucaug

SEQ ID NO: 1556548 - RNA, 14 nt, Homo sapiens
uggcguuacugcuu

SEQ ID NO: 1556549 - RNA, 15 nt, Homo sapiens
uggcguuacugcuug

SEQ ID NO: 1556550 - RNA, 16 nt, Homo sapiens
uggcuauaaucuuauc

SEQ ID NO: 1556551 - RNA, 21 nt, Homo sapiens
uggcuaugcaguacauuguau

SEQ ID NO: 1556552 - RNA, 18 nt, Homo sapiens
uggcucagugccaccuau

SEQ ID NO: 1556553 - RNA, 13 nt, Homo sapiens
uggcuccuaucug

SEQ ID NO: 1556554 - RNA, 19 nt, Homo sapiens
uggcucugagauacuaaua

SEQ ID NO: 1556555 - RNA, 16 nt, Homo sapiens
uggcucugccucagga

SEQ ID NO: 1556556 - RNA, 14 nt, Homo sapiens
uggcugccaaagag

SEQ ID NO: 1556557 - RNA, 19 nt, Homo sapiens
uggcugccagaaucuagag

SEQ ID NO: 1556558 - RNA, 13 nt, Homo sapiens
uggcugcccagga

SEQ ID NO: 1556559 - RNA, 18 nt, Homo sapiens
uggcuggcuccuagggga

SEQ ID NO: 1556560 - RNA, 18 nt, Homo sapiens
uggcuggcucuaccuucc

SEQ ID NO: 1556561 - RNA, 22 nt, Homo sapiens
uggcuguccuaccaucagcucu

SEQ ID NO: 1556562 - RNA, 17 nt, Homo sapiens
uggcuuaaaccagaacc

SEQ ID NO: 1556563 - RNA, 15 nt, Homo sapiens
uggcuuaagccugug

SEQ ID NO: 1556564 - RNA, 14 nt, Homo sapiens
uggcuuugcuguug

SEQ ID NO: 1556565 - RNA, 23 nt, Homo sapiens
uggcuuuuuauuaggcucaguga

SEQ ID NO: 1556566 - RNA, 14 nt, Homo sapiens
ugggaaagcauugu

SEQ ID NO: 1556567 - RNA, 12 nt, Homo sapiens
ugggaagugaag

SEQ ID NO: 1556568 - RNA, 15 nt, Homo sapiens
ugggaauaauugcuu

SEQ ID NO: 1556569 - RNA, 14 nt, Homo sapiens
ugggaaugacaaca

SEQ ID NO: 1556570 - RNA, 15 nt, Homo sapiens
ugggaaugucucuuu

SEQ ID NO: 1556571 - RNA, 20 nt, Homo sapiens
ugggaauugcgcucaggggc

SEQ ID NO: 1556572 - RNA, 22 nt, Homo sapiens
ugggacacuccgucugcuccaa

SEQ ID NO: 1556573 - RNA, 21 nt, Homo sapiens
ucccgccccgccccucccacg

SEQ ID NO: 1556574 - RNA, 22 nt, Homo sapiens
ucccgcccuuccaugugccuuu

SEQ ID NO: 1556575 - RNA, 18 nt, Homo sapiens
ucccggggccagcacuuc

SEQ ID NO: 1556576 - RNA, 18 nt, Homo sapiens
ucccuacccuaaccaagu

SEQ ID NO: 1556577 - RNA, 20 nt, Homo sapiens
ucccuaguagcugggauuac

SEQ ID NO: 1556578 - RNA, 10 nt, Homo sapiens
ucccuaucua

SEQ ID NO: 1556579 - RNA, 17 nt, Homo sapiens
ucccucagacccagcgg

SEQ ID NO: 1556580 - RNA, 15 nt, Homo sapiens
ucccucagacccagg

SEQ ID NO: 1556581 - RNA, 22 nt, Homo sapiens
ucccucagacucagagguccag

SEQ ID NO: 1556582 - RNA, 16 nt, Homo sapiens
ucccucaggcccagga

SEQ ID NO: 1556583 - RNA, 20 nt, Homo sapiens
ucccucaggucccuugguca

SEQ ID NO: 1556584 - RNA, 15 nt, Homo sapiens
ucccucaucuguccc

SEQ ID NO: 1556585 - RNA, 22 nt, Homo sapiens
ucccuccccagaaacagugugc

SEQ ID NO: 1556586 - RNA, 18 nt, Homo sapiens
ucccucgacauuuucucc

SEQ ID NO: 1556587 - RNA, 22 nt, Homo sapiens
ucccucucuuccccuucccuua

SEQ ID NO: 1556588 - RNA, 14 nt, Homo sapiens
ucccucuggcccug

SEQ ID NO: 1556589 - RNA, 19 nt, Homo sapiens
ucccucuggccggacagaa

SEQ ID NO: 1556590 - RNA, 23 nt, Homo sapiens
ucccugaaaauguuuuucugcca

SEQ ID NO: 1556591 - RNA, 20 nt, Homo sapiens
ucccugaagagaagggcagg

SEQ ID NO: 1556592 - RNA, 16 nt, Homo sapiens
ucccugagccuaucgu

SEQ ID NO: 1556593 - RNA, 14 nt, Homo sapiens
ucccugauggggga

SEQ ID NO: 1556594 - RNA, 18 nt, Homo sapiens
ucccugcacacacaugca

SEQ ID NO: 1556595 - RNA, 21 nt, Homo sapiens
ucccugcacacacaugcauac

SEQ ID NO: 1556596 - RNA, 17 nt, Homo sapiens
ucccuggaaccuucuag

SEQ ID NO: 1556597 - RNA, 14 nt, Homo sapiens
ucccuggagggcaa

SEQ ID NO: 1556598 - RNA, 18 nt, Homo sapiens
ucccuggccucccgccac

SEQ ID NO: 1556599 - RNA, 13 nt, Homo sapiens
ucccugggggccu

SEQ ID NO: 1556600 - RNA, 14 nt, Homo sapiens
ucccuguaaccucu

SEQ ID NO: 1556601 - RNA, 20 nt, Homo sapiens
ucccugucccucuagugccu

SEQ ID NO: 1556602 - RNA, 16 nt, Homo sapiens
ucccuguguucugggc

SEQ ID NO: 1556603 - RNA, 18 nt, Homo sapiens
ucccuguguucugggcug

SEQ ID NO: 1556604 - RNA, 11 nt, Homo sapiens
ucccuguucuc

SEQ ID NO: 1556605 - RNA, 14 nt, Homo sapiens
ucccuuaggaauau

SEQ ID NO: 1556606 - RNA, 20 nt, Homo sapiens
ucccuucuaccugccacuca

SEQ ID NO: 1556607 - RNA, 19 nt, Homo sapiens
ucccuucucuucacaguca

SEQ ID NO: 1556608 - RNA, 23 nt, Homo sapiens
ucccuugauggucucaagcuaug

SEQ ID NO: 1556609 - RNA, 13 nt, Homo sapiens
ucccuuggacauu

SEQ ID NO: 1556610 - RNA, 22 nt, Homo sapiens
ucccuugggcuggagaauuuag

SEQ ID NO: 1556611 - RNA, 14 nt, Homo sapiens
ucccuuuucccuua

SEQ ID NO: 1556612 - RNA, 14 nt, Homo sapiens
ucccuuuugcauug

SEQ ID NO: 1556613 - RNA, 19 nt, Homo sapiens
ucccuuuugcauugccaag

SEQ ID NO: 1556614 - RNA, 19 nt, Homo sapiens
ucccuuuuuauuugcagaa

SEQ ID NO: 1556615 - RNA, 15 nt, Homo sapiens
uccgaggccaguacc

SEQ ID NO: 1556616 - RNA, 20 nt, Homo sapiens
uccgaggcuccccgccucca

SEQ ID NO: 1556617 - RNA, 19 nt, Homo sapiens
uccgagggcccaacacugg

SEQ ID NO: 1556618 - RNA, 17 nt, Homo sapiens
uccgaugguaucugggu

SEQ ID NO: 1556619 - RNA, 15 nt, Homo sapiens
uccgcggaccgggga

SEQ ID NO: 1556620 - RNA, 20 nt, Homo sapiens
uccgcugucggcacauucag

SEQ ID NO: 1556621 - RNA, 19 nt, Homo sapiens
uccggccuccugucccuca

SEQ ID NO: 1556622 - RNA, 20 nt, Homo sapiens
uccgggaacagugcaugugc

SEQ ID NO: 1556623 - RNA, 22 nt, Homo sapiens
uccggggcauuugggcacugua

SEQ ID NO: 1556624 - RNA, 20 nt, Homo sapiens
uccggucagccaagugcaga

SEQ ID NO: 1556625 - RNA, 16 nt, Homo sapiens
uccguaguucccugaa

SEQ ID NO: 1556626 - RNA, 19 nt, Homo sapiens
uccguggucagagugccac

SEQ ID NO: 1556627 - RNA, 20 nt, Homo sapiens
uccguucacaugugugguac

SEQ ID NO: 1556628 - RNA, 24 nt, Homo sapiens
uccuaaagaaaaauaucuuggccu

SEQ ID NO: 1556629 - RNA, 21 nt, Homo sapiens
uccuaauaucaaaugcaguau

SEQ ID NO: 1556630 - RNA, 20 nt, Homo sapiens
uccuaaucauacaccagaag

SEQ ID NO: 1556631 - RNA, 23 nt, Homo sapiens
uccuaaucauacaccagaagaca

SEQ ID NO: 1556632 - RNA, 14 nt, Homo sapiens
uccuacaaggccua

SEQ ID NO: 1556633 - RNA, 17 nt, Homo sapiens
uccuacagccagcagca

SEQ ID NO: 1556634 - RNA, 22 nt, Homo sapiens
uccuaccagaaggaaagcacua

SEQ ID NO: 1556635 - RNA, 22 nt, Homo sapiens
uccuacccccugugccuuguca

SEQ ID NO: 1556636 - RNA, 21 nt, Homo sapiens
uccuagaagaaccaaauaccu

SEQ ID NO: 1556637 - RNA, 21 nt, Homo sapiens
uccuagagucuuaaagcauuu

SEQ ID NO: 1556638 - RNA, 16 nt, Homo sapiens
uccuagcaaguaagaa

SEQ ID NO: 1556639 - RNA, 12 nt, Homo sapiens
uccuagcacugc

SEQ ID NO: 1556640 - RNA, 18 nt, Homo sapiens
uccuagcugugugaauac

SEQ ID NO: 1556641 - RNA, 23 nt, Homo sapiens
uccuagugggccauuaaaaacua

SEQ ID NO: 1556642 - RNA, 14 nt, Homo sapiens
uccuauaccuuacu

SEQ ID NO: 1556643 - RNA, 13 nt, Homo sapiens
uccuaugcaauaa

SEQ ID NO: 1556644 - RNA, 13 nt, Homo sapiens
uccuaugcuauug

SEQ ID NO: 1556645 - RNA, 16 nt, Homo sapiens
uccuaugcuauugaca

SEQ ID NO: 1556646 - RNA, 18 nt, Homo sapiens
uccuaugcuauugacaau

SEQ ID NO: 1556647 - RNA, 14 nt, Homo sapiens
uccuauuacugaug

SEQ ID NO: 1556648 - RNA, 18 nt, Homo sapiens
uccuauuacugaugugug

SEQ ID NO: 1556649 - RNA, 17 nt, Homo sapiens
uccuauuccuucacaca

SEQ ID NO: 1556650 - RNA, 22 nt, Homo sapiens
uccuauucugaugaaucucaaa

SEQ ID NO: 1556651 - RNA, 20 nt, Homo sapiens
uccuauuucuccaaagccuu

SEQ ID NO: 1556652 - RNA, 22 nt, Homo sapiens
uccucaaagggagagagugcua

SEQ ID NO: 1556653 - RNA, 23 nt, Homo sapiens
uccucaaauacaugcacagucau

SEQ ID NO: 1556654 - RNA, 14 nt, Homo sapiens
uccucaauccagcu

SEQ ID NO: 1556655 - RNA, 13 nt, Homo sapiens
uccucacagugaa

SEQ ID NO: 1556656 - RNA, 20 nt, Homo sapiens
uccucaccucuggacuggcu

SEQ ID NO: 1556657 - RNA, 15 nt, Homo sapiens
uccucagcuguacaa

SEQ ID NO: 1556658 - RNA, 16 nt, Homo sapiens
ugcugaauaaaugauu

SEQ ID NO: 1556659 - RNA, 22 nt, Homo sapiens
ugcugacaaccauuaaagucag

SEQ ID NO: 1556660 - RNA, 22 nt, Homo sapiens
ugcugaguaacaggugccuucc

SEQ ID NO: 1556661 - RNA, 20 nt, Homo sapiens
ugcugaguccuuuccagggg

SEQ ID NO: 1556662 - RNA, 19 nt, Homo sapiens
ugcugauuauuuaugaccu

SEQ ID NO: 1556663 - RNA, 20 nt, Homo sapiens
ugcugcaacaaaauguagaa

SEQ ID NO: 1556664 - RNA, 13 nt, Homo sapiens
ugcugcaacaagc

SEQ ID NO: 1556665 - RNA, 23 nt, Homo sapiens
ugcugcacagaaauuuucaauuu

SEQ ID NO: 1556666 - RNA, 17 nt, Homo sapiens
ugcugcaccuggucaua

SEQ ID NO: 1556667 - RNA, 17 nt, Homo sapiens
ugcugcauauguuacaa

SEQ ID NO: 1556668 - RNA, 13 nt, Homo sapiens
ugcugcaucuccc

SEQ ID NO: 1556669 - RNA, 21 nt, Homo sapiens
ugcugcaucuccccucagauu

SEQ ID NO: 1556670 - RNA, 18 nt, Homo sapiens
ugcugccgcgcagugugg

SEQ ID NO: 1556671 - RNA, 18 nt, Homo sapiens
ugcugccuaauaaagaga

SEQ ID NO: 1556672 - RNA, 18 nt, Homo sapiens
ugcugccucucuuucaca

SEQ ID NO: 1556673 - RNA, 22 nt, Homo sapiens
ugcugccucucuuucacacaau

SEQ ID NO: 1556674 - RNA, 17 nt, Homo sapiens
ugcuggaaccugcaaaa

SEQ ID NO: 1556675 - RNA, 19 nt, Homo sapiens
ugcuggaaccugcaaaaaa

SEQ ID NO: 1556676 - RNA, 19 nt, Homo sapiens
ugcuggacuguuccaggcc

SEQ ID NO: 1556677 - RNA, 19 nt, Homo sapiens
ugcuggaugacuugagaug

SEQ ID NO: 1556678 - RNA, 14 nt, Homo sapiens
ugcuggcaguacug

SEQ ID NO: 1556679 - RNA, 15 nt, Homo sapiens
ugcuggcaguacugu

SEQ ID NO: 1556680 - RNA, 14 nt, Homo sapiens
ugcuggcucaggag

SEQ ID NO: 1556681 - RNA, 14 nt, Homo sapiens
ugcuggcugaagag

SEQ ID NO: 1556682 - RNA, 14 nt, Homo sapiens
ugcugggauuucca

SEQ ID NO: 1556683 - RNA, 23 nt, Homo sapiens
ugcuggucccggggccagcacuu

SEQ ID NO: 1556684 - RNA, 15 nt, Homo sapiens
ugcuggugcagcgua

SEQ ID NO: 1556685 - RNA, 17 nt, Homo sapiens
ugcugguugacaucaga

SEQ ID NO: 1556686 - RNA, 23 nt, Homo sapiens
ugcuguagaaaaaaaaauucaca

SEQ ID NO: 1556687 - RNA, 14 nt, Homo sapiens
ugcuguaugucucg

SEQ ID NO: 1556688 - RNA, 20 nt, Homo sapiens
ugcugugacuagaaccauaa

SEQ ID NO: 1556689 - RNA, 12 nt, Homo sapiens
ugcugugccuga

SEQ ID NO: 1556690 - RNA, 15 nt, Homo sapiens
ugcuguggagccuua

SEQ ID NO: 1556691 - RNA, 23 nt, Homo sapiens
ugcugugucuccucucagaguga

SEQ ID NO: 1556692 - RNA, 23 nt, Homo sapiens
ugcuuaaacccuuuagugcuuug

SEQ ID NO: 1556693 - RNA, 17 nt, Homo sapiens
ugcuuaccuacuuucuu

SEQ ID NO: 1556694 - RNA, 14 nt, Homo sapiens
ugcuuagaaauuca

SEQ ID NO: 1556695 - RNA, 17 nt, Homo sapiens
ugcuuagucccucaugc

SEQ ID NO: 1556696 - RNA, 22 nt, Homo sapiens
ugcuucacucaugcaaacugcu

SEQ ID NO: 1556697 - RNA, 14 nt, Homo sapiens
ugcuucaucugugg

SEQ ID NO: 1556698 - RNA, 13 nt, Homo sapiens
ugcuuccuccuca

SEQ ID NO: 1556699 - RNA, 21 nt, Homo sapiens
ugcuugacauaccuaccagua

SEQ ID NO: 1556700 - RNA, 14 nt, Homo sapiens
uccagagcugagau

SEQ ID NO: 1556701 - RNA, 18 nt, Homo sapiens
uccagaggaauaaaaagg

SEQ ID NO: 1556702 - RNA, 16 nt, Homo sapiens
uccagaguaagugaug

SEQ ID NO: 1556703 - RNA, 21 nt, Homo sapiens
uccagaguuguuguuugccaa

SEQ ID NO: 1556704 - RNA, 15 nt, Homo sapiens
uccagauucagggag

SEQ ID NO: 1556705 - RNA, 14 nt, Homo sapiens
uccagcaguacaau

SEQ ID NO: 1556706 - RNA, 21 nt, Homo sapiens
uccagcauugcuggacucuga

SEQ ID NO: 1556707 - RNA, 21 nt, Homo sapiens
uccagccacuugacuggcaca

SEQ ID NO: 1556708 - RNA, 19 nt, Homo sapiens
uccagccccuccucccuca

SEQ ID NO: 1556709 - RNA, 16 nt, Homo sapiens
uccagccugggggaca

SEQ ID NO: 1556710 - RNA, 21 nt, Homo sapiens
uccagcggcucacaaagaaua

SEQ ID NO: 1556711 - RNA, 14 nt, Homo sapiens
uccagcugauccag

SEQ ID NO: 1556712 - RNA, 17 nt, Homo sapiens
uccagcugcgacuuuua

SEQ ID NO: 1556713 - RNA, 15 nt, Homo sapiens
uccaggccugcauua

SEQ ID NO: 1556714 - RNA, 18 nt, Homo sapiens
uccagggaaacagccucu

SEQ ID NO: 1556715 - RNA, 22 nt, Homo sapiens
uccagggaugagccaaaccagc

SEQ ID NO: 1556716 - RNA, 23 nt, Homo sapiens
uccagggaugauucaagccauuc

SEQ ID NO: 1556717 - RNA, 13 nt, Homo sapiens
uccagguggacaa

SEQ ID NO: 1556718 - RNA, 22 nt, Homo sapiens
uccagucuuccugacacuuuaa

SEQ ID NO: 1556719 - RNA, 23 nt, Homo sapiens
uccagugggcugaugcugggacc

SEQ ID NO: 1556720 - RNA, 15 nt, Homo sapiens
uccaguuaaguaaua

SEQ ID NO: 1556721 - RNA, 21 nt, Homo sapiens
uccaguuauaagcguauuuag

SEQ ID NO: 1556722 - RNA, 23 nt, Homo sapiens
uccaguuauaagcguauuuagac

SEQ ID NO: 1556723 - RNA, 22 nt, Homo sapiens
uccaguuuuauaaaaaguggag

SEQ ID NO: 1556724 - RNA, 20 nt, Homo sapiens
uccauaaauuuggacugucu

SEQ ID NO: 1556725 - RNA, 15 nt, Homo sapiens
uccauacacuuuguu

SEQ ID NO: 1556726 - RNA, 15 nt, Homo sapiens
uccauaugucuauaa

SEQ ID NO: 1556727 - RNA, 12 nt, Homo sapiens
uccaucaccagc

SEQ ID NO: 1556728 - RNA, 18 nt, Homo sapiens
uccaucacguuagcuguc

SEQ ID NO: 1556729 - RNA, 17 nt, Homo sapiens
uccaucagaaaaccaaa

SEQ ID NO: 1556730 - RNA, 18 nt, Homo sapiens
uccaucagccuccauccu

SEQ ID NO: 1556731 - RNA, 16 nt, Homo sapiens
uccaucaucacuguaa

SEQ ID NO: 1556732 - RNA, 16 nt, Homo sapiens
uccauccuccaaaccu

SEQ ID NO: 1556733 - RNA, 18 nt, Homo sapiens
uccaucuagucacaaaga

SEQ ID NO: 1556734 - RNA, 21 nt, Homo sapiens
uccaucuguugacaaaugaca

SEQ ID NO: 1556735 - RNA, 22 nt, Homo sapiens
uccaugcaacuggaguuccuua

SEQ ID NO: 1556736 - RNA, 20 nt, Homo sapiens
uccaugcaccuaccuuagaa

SEQ ID NO: 1556737 - RNA, 20 nt, Homo sapiens
uccaugccucagaagugcau

SEQ ID NO: 1556738 - RNA, 14 nt, Homo sapiens
uccaugcuaagcaa

SEQ ID NO: 1556739 - RNA, 15 nt, Homo sapiens
uccaugcucuugacc

SEQ ID NO: 1556740 - RNA, 17 nt, Homo sapiens
uccauguaaauugcaaa

SEQ ID NO: 1556741 - RNA, 15 nt, Homo sapiens
uccauguccauaugc

SEQ ID NO: 1556742 - RNA, 17 nt, Homo sapiens
uccauguuggucaggcu

SEQ ID NO: 1556743 - RNA, 17 nt, Homo sapiens
uccauguuugcaccugu

SEQ ID NO: 1556744 - RNA, 16 nt, Homo sapiens
uccauuaaguacaugu

SEQ ID NO: 1556745 - RNA, 22 nt, Homo sapiens
uccauucacaagccuccuguac

SEQ ID NO: 1556746 - RNA, 19 nt, Homo sapiens
uccauucuguagacuuuug

SEQ ID NO: 1556747 - RNA, 20 nt, Homo sapiens
uccauuuaagacacauugac

SEQ ID NO: 1556748 - RNA, 18 nt, Homo sapiens
uccauuuccuaauguaua

SEQ ID NO: 1556749 - RNA, 17 nt, Homo sapiens
uccauuuucauucuguu

SEQ ID NO: 1556750 - RNA, 19 nt, Homo sapiens
ucccaaagugaacucucaa

SEQ ID NO: 1556751 - RNA, 15 nt, Homo sapiens
ucccaacacuuugag

SEQ ID NO: 1556752 - RNA, 16 nt, Homo sapiens
ucccaacacuuugaga

SEQ ID NO: 1556753 - RNA, 14 nt, Homo sapiens
ucccaacccauuca

SEQ ID NO: 1556754 - RNA, 22 nt, Homo sapiens
ucccaaccccaguggauucuca

SEQ ID NO: 1556755 - RNA, 18 nt, Homo sapiens
ucccaagauaaaugguac

SEQ ID NO: 1556756 - RNA, 16 nt, Homo sapiens
ucccaaguggugccua

SEQ ID NO: 1556757 - RNA, 15 nt, Homo sapiens
ucccaauagcacuuu

SEQ ID NO: 1556758 - RNA, 21 nt, Homo sapiens
ucccacacuccuauggucaca

SEQ ID NO: 1556759 - RNA, 16 nt, Homo sapiens
ucccacaugaggccau

SEQ ID NO: 1556760 - RNA, 15 nt, Homo sapiens
ucccaccccuaccuc

SEQ ID NO: 1556761 - RNA, 19 nt, Homo sapiens
ucccaccccuaccucuagu

SEQ ID NO: 1556762 - RNA, 21 nt, Homo sapiens
ucccaccccuaccucuaguaa

SEQ ID NO: 1556763 - RNA, 20 nt, Homo sapiens
ucccacgacuguuguacaag

SEQ ID NO: 1556764 - RNA, 14 nt, Homo sapiens
ucccacgaggaauc

SEQ ID NO: 1556765 - RNA, 15 nt, Homo sapiens
ucccacuacaucugg

SEQ ID NO: 1556766 - RNA, 15 nt, Homo sapiens
ucccacugcacucca

SEQ ID NO: 1556767 - RNA, 20 nt, Homo sapiens
ucccagaggagccaccaguu

SEQ ID NO: 1556768 - RNA, 20 nt, Homo sapiens
ucccagcaccuauugaauua

SEQ ID NO: 1556769 - RNA, 12 nt, Homo sapiens
ucccagcacuuu

SEQ ID NO: 1556770 - RNA, 15 nt, Homo sapiens
ucccagcccaucuga

SEQ ID NO: 1556771 - RNA, 20 nt, Homo sapiens
ucccagccccggcaagccac

SEQ ID NO: 1556772 - RNA, 21 nt, Homo sapiens
ucccagccccuccucccucag

SEQ ID NO: 1556773 - RNA, 15 nt, Homo sapiens
ucccagcuacuuggg

SEQ ID NO: 1556774 - RNA, 13 nt, Homo sapiens
ucccagcugugcu

SEQ ID NO: 1556775 - RNA, 22 nt, Homo sapiens
ucccaggccugccugcauggca

SEQ ID NO: 1556776 - RNA, 12 nt, Homo sapiens
ucccaggcuucc

SEQ ID NO: 1556777 - RNA, 18 nt, Homo sapiens
ucccaggggcagccacac

SEQ ID NO: 1556778 - RNA, 17 nt, Homo sapiens
ucccagguaauuuaaau

SEQ ID NO: 1556779 - RNA, 13 nt, Homo sapiens
ucccagugaucac

SEQ ID NO: 1556780 - RNA, 15 nt, Homo sapiens
ucccaguuucucaga

SEQ ID NO: 1556781 - RNA, 21 nt, Homo sapiens
ucccauaauugcuuugccaaa

SEQ ID NO: 1556782 - RNA, 12 nt, Homo sapiens
ucccaugaagcc

SEQ ID NO: 1556783 - RNA, 10 nt, Homo sapiens
ucccaugagc

SEQ ID NO: 1556784 - RNA, 16 nt, Homo sapiens
ucccaugcuggcugaa

SEQ ID NO: 1556785 - RNA, 17 nt, Homo sapiens
ucccauggcaccuucag

SEQ ID NO: 1556786 - RNA, 15 nt, Homo sapiens
ucauaggaagacaca

SEQ ID NO: 1556787 - RNA, 16 nt, Homo sapiens
ucauauaccagcaaua

SEQ ID NO: 1556788 - RNA, 20 nt, Homo sapiens
ucauauaccagcaauauauc

SEQ ID NO: 1556789 - RNA, 13 nt, Homo sapiens
ucauauauacugu

SEQ ID NO: 1556790 - RNA, 20 nt, Homo sapiens
ucauauuauuuuagugugua

SEQ ID NO: 1556791 - RNA, 10 nt, Homo sapiens
ucauauugau

SEQ ID NO: 1556792 - RNA, 21 nt, Homo sapiens
ucauauuucuaccugagugaa

SEQ ID NO: 1556793 - RNA, 17 nt, Homo sapiens
ucaucaaaaucugcaca

SEQ ID NO: 1556794 - RNA, 20 nt, Homo sapiens
ucaucaaaaucugcacaguc

SEQ ID NO: 1556795 - RNA, 14 nt, Homo sapiens
ucaucaaacauugg

SEQ ID NO: 1556796 - RNA, 19 nt, Homo sapiens
ucaucaacuaccauucuau

SEQ ID NO: 1556797 - RNA, 12 nt, Homo sapiens
ucaucaaugaau

SEQ ID NO: 1556798 - RNA, 12 nt, Homo sapiens
ucaucaaugcaa

SEQ ID NO: 1556799 - RNA, 13 nt, Homo sapiens
ucaucacuuugac

SEQ ID NO: 1556800 - RNA, 23 nt, Homo sapiens
ucaucaggugcauagcaagugaa

SEQ ID NO: 1556801 - RNA, 16 nt, Homo sapiens
ucaucaggugugcuca

SEQ ID NO: 1556802 - RNA, 19 nt, Homo sapiens
ucaucaguaaaguaccuuu

SEQ ID NO: 1556803 - RNA, 22 nt, Homo sapiens
ucaucaguaguucacauacaaa

SEQ ID NO: 1556804 - RNA, 16 nt, Homo sapiens
ucaucaugugugucca

SEQ ID NO: 1556805 - RNA, 14 nt, Homo sapiens
ucauccacucugcc

SEQ ID NO: 1556806 - RNA, 15 nt, Homo sapiens
ucauccccauuuaag

SEQ ID NO: 1556807 - RNA, 21 nt, Homo sapiens
ucaucccgagcaccuccacau

SEQ ID NO: 1556808 - RNA, 18 nt, Homo sapiens
ucaucccuuaauaaaaua

SEQ ID NO: 1556809 - RNA, 13 nt, Homo sapiens
ucauccuaacaau

SEQ ID NO: 1556810 - RNA, 19 nt, Homo sapiens
ucauccucaagcucagggc

SEQ ID NO: 1556811 - RNA, 17 nt, Homo sapiens
ucauccuccauugcucc

SEQ ID NO: 1556812 - RNA, 21 nt, Homo sapiens
ucauccugaacgugaccagug

SEQ ID NO: 1556813 - RNA, 14 nt, Homo sapiens
ucaucgacuuagcc

SEQ ID NO: 1556814 - RNA, 13 nt, Homo sapiens
ucaucucauucca

SEQ ID NO: 1556815 - RNA, 23 nt, Homo sapiens
ucaucuggcuggcauccucacaa

SEQ ID NO: 1556816 - RNA, 15 nt, Homo sapiens
ucaucuguaccucug

SEQ ID NO: 1556817 - RNA, 16 nt, Homo sapiens
ucaucuuugccaagua

SEQ ID NO: 1556818 - RNA, 14 nt, Homo sapiens
ucaugagcaaguga

SEQ ID NO: 1556819 - RNA, 16 nt, Homo sapiens
ucaugaguucugcuga

SEQ ID NO: 1556820 - RNA, 14 nt, Homo sapiens
ucaugaucaucaca

SEQ ID NO: 1556821 - RNA, 20 nt, Homo sapiens
ucaugauuucccuuguagaa

SEQ ID NO: 1556822 - RNA, 19 nt, Homo sapiens
ucaugcauguccuguaaag

SEQ ID NO: 1556823 - RNA, 16 nt, Homo sapiens
ucaugccagugccuua

SEQ ID NO: 1556824 - RNA, 23 nt, Homo sapiens
ucaugccuguaaucucagcacuu

SEQ ID NO: 1556825 - RNA, 15 nt, Homo sapiens
ucaugcucauguaua

SEQ ID NO: 1556826 - RNA, 17 nt, Homo sapiens
ucauggaggccaagaac

SEQ ID NO: 1556827 - RNA, 17 nt, Homo sapiens
ucauggauaacuacauu

SEQ ID NO: 1556828 - RNA, 16 nt, Homo sapiens
ucauggcuaccucaga

SEQ ID NO: 1556829 - RNA, 20 nt, Homo sapiens
ucaugggagggggcuugaag

SEQ ID NO: 1556830 - RNA, 21 nt, Homo sapiens
ucaugggguggacucuaacag

SEQ ID NO: 1556831 - RNA, 22 nt, Homo sapiens
ucaugguacauuuaucacugaa

SEQ ID NO: 1556832 - RNA, 18 nt, Homo sapiens
ucauguaccucugauuaa

SEQ ID NO: 1556833 - RNA, 23 nt, Homo sapiens
ucauguguguccacgacugucuc

SEQ ID NO: 1556834 - RNA, 20 nt, Homo sapiens
ucauuacaaaaaaacacgug

SEQ ID NO: 1556835 - RNA, 22 nt, Homo sapiens
ucauuagggcuuuugauuuaua

SEQ ID NO: 1556836 - RNA, 19 nt, Homo sapiens
ucauuaucucaaaacugca

SEQ ID NO: 1556837 - RNA, 20 nt, Homo sapiens
ucauuaucucaaaacugcac

SEQ ID NO: 1556838 - RNA, 15 nt, Homo sapiens
ucauuccuucacuca

SEQ ID NO: 1556839 - RNA, 13 nt, Homo sapiens
ucauucuacugaa

SEQ ID NO: 1556840 - RNA, 17 nt, Homo sapiens
ucauucucauaauuccu

SEQ ID NO: 1556841 - RNA, 15 nt, Homo sapiens
ucauucugccaaagu

SEQ ID NO: 1556842 - RNA, 18 nt, Homo sapiens
ucauucuguuagauacua

SEQ ID NO: 1556843 - RNA, 16 nt, Homo sapiens
ucauugagaaacuggg

SEQ ID NO: 1556844 - RNA, 23 nt, Homo sapiens
ucauugaugagcaagacauacuu

SEQ ID NO: 1556845 - RNA, 16 nt, Homo sapiens
ucauuguaugugguca

SEQ ID NO: 1556846 - RNA, 12 nt, Homo sapiens
ucauuucauucc

SEQ ID NO: 1556847 - RNA, 16 nt, Homo sapiens
ucauuucuuaucacau

SEQ ID NO: 1556848 - RNA, 14 nt, Homo sapiens
ucauuuuacuggua

SEQ ID NO: 1556849 - RNA, 15 nt, Homo sapiens
ucauuuuaguugccu

SEQ ID NO: 1556850 - RNA, 21 nt, Homo sapiens
ucauuuuuuuuuuaucagagu

SEQ ID NO: 1556851 - RNA, 9 nt, Homo sapiens
uccaaaaau

SEQ ID NO: 1556852 - RNA, 20 nt, Homo sapiens
uccaaaaauagcccugcaaa

SEQ ID NO: 1556853 - RNA, 16 nt, Homo sapiens
uccaaaaauagucaaa

SEQ ID NO: 1556854 - RNA, 14 nt, Homo sapiens
uccaaaacauuucu

SEQ ID NO: 1556855 - RNA, 17 nt, Homo sapiens
uccaaaaccuuccucuu

SEQ ID NO: 1556856 - RNA, 12 nt, Homo sapiens
uccaaaccagac

SEQ ID NO: 1556857 - RNA, 22 nt, Homo sapiens
uccaaaccuggccugagccucc

SEQ ID NO: 1556858 - RNA, 14 nt, Homo sapiens
uccaaagcuuuauu

SEQ ID NO: 1556859 - RNA, 17 nt, Homo sapiens
uccaaaggucugauguc

SEQ ID NO: 1556860 - RNA, 19 nt, Homo sapiens
uccaacauuucucacugaa

SEQ ID NO: 1556861 - RNA, 18 nt, Homo sapiens
uccaacgaguaccagcug

SEQ ID NO: 1556862 - RNA, 21 nt, Homo sapiens
uccaacuccuuucagccacau

SEQ ID NO: 1556863 - RNA, 15 nt, Homo sapiens
uccaagcacagagcc

SEQ ID NO: 1556864 - RNA, 14 nt, Homo sapiens
uccaagcauaccaa

SEQ ID NO: 1556865 - RNA, 22 nt, Homo sapiens
uccaagcauaccaacacgagca

SEQ ID NO: 1556866 - RNA, 18 nt, Homo sapiens
uccaagcauuucaugaaa

SEQ ID NO: 1556867 - RNA, 16 nt, Homo sapiens
uccaagccucaugucc

SEQ ID NO: 1556868 - RNA, 13 nt, Homo sapiens
uccaagcugcaug

SEQ ID NO: 1556869 - RNA, 20 nt, Homo sapiens
uccaaggaggggcuguaaaa

SEQ ID NO: 1556870 - RNA, 13 nt, Homo sapiens
uccaauauuucug

SEQ ID NO: 1556871 - RNA, 18 nt, Homo sapiens
uccaauccacuaacacuu

SEQ ID NO: 1556872 - RNA, 20 nt, Homo sapiens
uccaaugcacugauguguga

SEQ ID NO: 1556873 - RNA, 20 nt, Homo sapiens
uccaauugcucuuucacagg

SEQ ID NO: 1556874 - RNA, 22 nt, Homo sapiens
uccaauuuuaauuuaguaaaug

SEQ ID NO: 1556875 - RNA, 19 nt, Homo sapiens
uccaauuuuguugcaucau

SEQ ID NO: 1556876 - RNA, 19 nt, Homo sapiens
uccacaaagaaaauuccua

SEQ ID NO: 1556877 - RNA, 20 nt, Homo sapiens
uccacaagauucccagagac

SEQ ID NO: 1556878 - RNA, 13 nt, Homo sapiens
uccacaaggggau

SEQ ID NO: 1556879 - RNA, 12 nt, Homo sapiens
uccacaccaagc

SEQ ID NO: 1556880 - RNA, 22 nt, Homo sapiens
uccacacccacuuuguccauuu

SEQ ID NO: 1556881 - RNA, 17 nt, Homo sapiens
uccacacccucacugcu

SEQ ID NO: 1556882 - RNA, 17 nt, Homo sapiens
uccacaccugggcauuu

SEQ ID NO: 1556883 - RNA, 12 nt, Homo sapiens
uccacacugaga

SEQ ID NO: 1556884 - RNA, 17 nt, Homo sapiens
uccacagagauacacag

SEQ ID NO: 1556885 - RNA, 14 nt, Homo sapiens
uccacagauuauca

SEQ ID NO: 1556886 - RNA, 17 nt, Homo sapiens
uccaccaucaccucucu

SEQ ID NO: 1556887 - RNA, 16 nt, Homo sapiens
uccacccagugcugaa

SEQ ID NO: 1556888 - RNA, 19 nt, Homo sapiens
uccaccccagggucauaag

SEQ ID NO: 1556889 - RNA, 21 nt, Homo sapiens
uccaccuagagcuagaugugu

SEQ ID NO: 1556890 - RNA, 11 nt, Homo sapiens
uccaccucuac

SEQ ID NO: 1556891 - RNA, 16 nt, Homo sapiens
uccacgauucacucau

SEQ ID NO: 1556892 - RNA, 19 nt, Homo sapiens
uccacguucugcucaucau

SEQ ID NO: 1556893 - RNA, 23 nt, Homo sapiens
uccacucaugugacucuuuccaa

SEQ ID NO: 1556894 - RNA, 17 nt, Homo sapiens
uccacucuacccuccca

SEQ ID NO: 1556895 - RNA, 19 nt, Homo sapiens
uccacugauuggaccuuau

SEQ ID NO: 1556896 - RNA, 12 nt, Homo sapiens
uccacugucuca

SEQ ID NO: 1556897 - RNA, 15 nt, Homo sapiens
uccacugucuuucaa

SEQ ID NO: 1556898 - RNA, 22 nt, Homo sapiens
uccagaacaaauuguuuacaua

SEQ ID NO: 1556899 - RNA, 20 nt, Homo sapiens
uccagaaccaacugcauugg

SEQ ID NO: 1556900 - RNA, 21 nt, Homo sapiens
uccagaaguccuuauguuaag

SEQ ID NO: 1556901 - RNA, 18 nt, Homo sapiens
uccagagacaacagguaa

SEQ ID NO: 1556902 - RNA, 15 nt, Homo sapiens
uccagagauggucac

SEQ ID NO: 1556903 - RNA, 21 nt, Homo sapiens
uccagagcccaaggucaggga

SEQ ID NO: 1556904 - RNA, 22 nt, Homo sapiens
uccagagcccaaggucagggag

SEQ ID NO: 1556905 - RNA, 14 nt, Homo sapiens
ucagggaccugcug

SEQ ID NO: 1556906 - RNA, 22 nt, Homo sapiens
ucagggaccugcugcucaguaa

SEQ ID NO: 1556907 - RNA, 15 nt, Homo sapiens
ucagggagcauuuaa

SEQ ID NO: 1556908 - RNA, 19 nt, Homo sapiens
ucaggucccccccaggugc

SEQ ID NO: 1556909 - RNA, 14 nt, Homo sapiens
ucaggugugcucag

SEQ ID NO: 1556910 - RNA, 20 nt, Homo sapiens
ucaguaaaauuauacugugu

SEQ ID NO: 1556911 - RNA, 17 nt, Homo sapiens
ucaguaaguaucuggag

SEQ ID NO: 1556912 - RNA, 14 nt, Homo sapiens
ucaguaagucucau

SEQ ID NO: 1556913 - RNA, 22 nt, Homo sapiens
ucaguacccacucuggagcauu

SEQ ID NO: 1556914 - RNA, 14 nt, Homo sapiens
ucaguaccccaugg

SEQ ID NO: 1556915 - RNA, 17 nt, Homo sapiens
ucaguagaaagcuaaag

SEQ ID NO: 1556916 - RNA, 23 nt, Homo sapiens
ucaguaggcaucaguaugucacu

SEQ ID NO: 1556917 - RNA, 15 nt, Homo sapiens
ucaguaguucacaua

SEQ ID NO: 1556918 - RNA, 17 nt, Homo sapiens
ucaguauuauuucaaga

SEQ ID NO: 1556919 - RNA, 14 nt, Homo sapiens
ucagucaacauuua

SEQ ID NO: 1556920 - RNA, 21 nt, Homo sapiens
ucagucaucaggugugcucag

SEQ ID NO: 1556921 - RNA, 19 nt, Homo sapiens
ucagucucugaauacacag

SEQ ID NO: 1556922 - RNA, 21 nt, Homo sapiens
ucagucuguucacugcauuca

SEQ ID NO: 1556923 - RNA, 17 nt, Homo sapiens
ucagugaagucuagaau

SEQ ID NO: 1556924 - RNA, 20 nt, Homo sapiens
ucagugaccagugccuguga

SEQ ID NO: 1556925 - RNA, 22 nt, Homo sapiens
ucagugagguuaucuugcugca

SEQ ID NO: 1556926 - RNA, 11 nt, Homo sapiens
ucagugcuccu

SEQ ID NO: 1556927 - RNA, 17 nt, Homo sapiens
ucagugucugccuuuaa

SEQ ID NO: 1556928 - RNA, 21 nt, Homo sapiens
ucaguguucccaaagugaacu

SEQ ID NO: 1556929 - RNA, 22 nt, Homo sapiens
ucaguuaugauuuuuuuuucau

SEQ ID NO: 1556930 - RNA, 15 nt, Homo sapiens
ucaguuauuacaugu

SEQ ID NO: 1556931 - RNA, 14 nt, Homo sapiens
ucaguuggugcugc

SEQ ID NO: 1556932 - RNA, 16 nt, Homo sapiens
ucaguuggugcugcuu

SEQ ID NO: 1556933 - RNA, 17 nt, Homo sapiens
ucaguuucuaggcaccu

SEQ ID NO: 1556934 - RNA, 12 nt, Homo sapiens
ucauaaacacug

SEQ ID NO: 1556935 - RNA, 17 nt, Homo sapiens
ucauaaaucuucuuauu

SEQ ID NO: 1556936 - RNA, 20 nt, Homo sapiens
ucauacaaagcgugcacaag

SEQ ID NO: 1556937 - RNA, 23 nt, Homo sapiens
ucauacuuaacauuucauuguac

SEQ ID NO: 1556938 - RNA, 17 nt, Homo sapiens
uaaaauaacuaagcaag

SEQ ID NO: 1556939 - RNA, 15 nt, Homo sapiens
uaaaauaagcauuua

SEQ ID NO: 1556940 - RNA, 16 nt, Homo sapiens
uaaaauacacacucaa

SEQ ID NO: 1556941 - RNA, 13 nt, Homo sapiens
uaaaauagaaaca

SEQ ID NO: 1556942 - RNA, 23 nt, Homo sapiens
uaaaauaggacauacuccccaau

SEQ ID NO: 1556943 - RNA, 15 nt, Homo sapiens
uaaaauauuauugaa

SEQ ID NO: 1556944 - RNA, 19 nt, Homo sapiens
uaaaaucuggccaccccag

SEQ ID NO: 1556945 - RNA, 13 nt, Homo sapiens
uaaaaugaagcuu

SEQ ID NO: 1556946 - RNA, 21 nt, Homo sapiens
uaaaaugagggugcccagcuu

SEQ ID NO: 1556947 - RNA, 21 nt, Homo sapiens
uaaaaugauuguaguaaucug

SEQ ID NO: 1556948 - RNA, 11 nt, Homo sapiens
uaaaaugcacc

SEQ ID NO: 1556949 - RNA, 16 nt, Homo sapiens
uaaaaugcaccaauca

SEQ ID NO: 1556950 - RNA, 17 nt, Homo sapiens
uaaaaugcacccaucag

SEQ ID NO: 1556951 - RNA, 23 nt, Homo sapiens
uaaaaugcacccaucagugcucu

SEQ ID NO: 1556952 - RNA, 18 nt, Homo sapiens
uaaaaugcuucacuguac

SEQ ID NO: 1556953 - RNA, 18 nt, Homo sapiens
uaaaaugguuaugugcau

SEQ ID NO: 1556954 - RNA, 16 nt, Homo sapiens
uaaaauguaucugcau

SEQ ID NO: 1556955 - RNA, 18 nt, Homo sapiens
uaaaauuaaaaguuugaa

SEQ ID NO: 1556956 - RNA, 16 nt, Homo sapiens
uaaaauuaaauuugau

SEQ ID NO: 1556957 - RNA, 19 nt, Homo sapiens
uaaaauucagaugcuguua

SEQ ID NO: 1556958 - RNA, 16 nt, Homo sapiens
uaaaauuuugagauua

SEQ ID NO: 1556959 - RNA, 19 nt, Homo sapiens
uaaaauuuuuugacccaag

SEQ ID NO: 1556960 - RNA, 22 nt, Homo sapiens
uaaacacauagauucaccugua

SEQ ID NO: 1556961 - RNA, 16 nt, Homo sapiens
uaaacacuaaucacaa

SEQ ID NO: 1556962 - RNA, 17 nt, Homo sapiens
uaaacacuccacauucu

SEQ ID NO: 1556963 - RNA, 20 nt, Homo sapiens
uaaacagaacuccacugcaa

SEQ ID NO: 1556964 - RNA, 18 nt, Homo sapiens
uaaacagccucuuuuuga

SEQ ID NO: 1556965 - RNA, 20 nt, Homo sapiens
uaaacagguuuuuaguuugu

SEQ ID NO: 1556966 - RNA, 17 nt, Homo sapiens
uaaacagugaacuuguc

SEQ ID NO: 1556967 - RNA, 17 nt, Homo sapiens
uaaacauauuggaaugu

SEQ ID NO: 1556968 - RNA, 18 nt, Homo sapiens
uaaacaugucacaauaca

SEQ ID NO: 1556969 - RNA, 11 nt, Homo sapiens
uaaaccaaaaa

SEQ ID NO: 1556970 - RNA, 14 nt, Homo sapiens
uaaaccaacucuaa

SEQ ID NO: 1556971 - RNA, 17 nt, Homo sapiens
uaaacccauaaguuuaa

SEQ ID NO: 1556972 - RNA, 14 nt, Homo sapiens
uaaacccauacaau

SEQ ID NO: 1556973 - RNA, 14 nt, Homo sapiens
uaaacccuuaccaa

SEQ ID NO: 1556974 - RNA, 17 nt, Homo sapiens
uaaacccuuuagugcuu

SEQ ID NO: 1556975 - RNA, 19 nt, Homo sapiens
uaaaccgcaugugaucucc

SEQ ID NO: 1556976 - RNA, 19 nt, Homo sapiens
uaaaccuggaacaucucac

SEQ ID NO: 1556977 - RNA, 23 nt, Homo sapiens
uaaaccuggaaucuacaagccaa

SEQ ID NO: 1556978 - RNA, 14 nt, Homo sapiens
uaaacuacucuuug

SEQ ID NO: 1556979 - RNA, 13 nt, Homo sapiens
uaaacuacugauu

SEQ ID NO: 1556980 - RNA, 13 nt, Homo sapiens
uaaacuaguuuaa

SEQ ID NO: 1556981 - RNA, 20 nt, Homo sapiens
uaaacucauuuaacuaaagu

SEQ ID NO: 1556982 - RNA, 14 nt, Homo sapiens
uaaacucucuagcu

SEQ ID NO: 1556983 - RNA, 13 nt, Homo sapiens
uaaacucugucca

SEQ ID NO: 1556984 - RNA, 23 nt, Homo sapiens
uaaacugguauuuuaucuuugau

SEQ ID NO: 1556985 - RNA, 18 nt, Homo sapiens
uaaacuguggguuuuccu

SEQ ID NO: 1556986 - RNA, 20 nt, Homo sapiens
uaaacuuacuuaguguuaug

SEQ ID NO: 1556987 - RNA, 22 nt, Homo sapiens
uaaacuucaccuacauuaucuc

SEQ ID NO: 1556988 - RNA, 23 nt, Homo sapiens
uaaacuucaccuacauuaucuca

SEQ ID NO: 1556989 - RNA, 18 nt, Homo sapiens
uaaacuugacccaggugg

SEQ ID NO: 1556990 - RNA, 16 nt, Homo sapiens
uaaacuugccuguuca

SEQ ID NO: 1556991 - RNA, 20 nt, Homo sapiens
uaaacuuggaaccuuggaaa

SEQ ID NO: 1556992 - RNA, 15 nt, Homo sapiens
uaaacuuucucugca

SEQ ID NO: 1556993 - RNA, 21 nt, Homo sapiens
uaaacuuucucugcaaagacu

SEQ ID NO: 1556994 - RNA, 20 nt, Homo sapiens
uaaagacugguuuucugcca

SEQ ID NO: 1556995 - RNA, 21 nt, Homo sapiens
uaaagacugguuuucugccaa

SEQ ID NO: 1556996 - RNA, 20 nt, Homo sapiens
uaaagacuuuuaugugagau

SEQ ID NO: 1556997 - RNA, 17 nt, Homo sapiens
uaaagagcaauccugga

SEQ ID NO: 1556998 - RNA, 14 nt, Homo sapiens
uaaagagcuguuau

SEQ ID NO: 1556999 - RNA, 18 nt, Homo sapiens
uaaagagcuuugugauau

SEQ ID NO: 1557000 - RNA, 21 nt, Homo sapiens
uaaagauaacccuuauuccau

SEQ ID NO: 1557001 - RNA, 10 nt, Homo sapiens
uaaagauaug

SEQ ID NO: 1557002 - RNA, 13 nt, Homo sapiens
uaaagaugagaug

SEQ ID NO: 1557003 - RNA, 15 nt, Homo sapiens
uaaagauggcacuuu

SEQ ID NO: 1557004 - RNA, 13 nt, Homo sapiens
uaaagcagaggau

SEQ ID NO: 1557005 - RNA, 20 nt, Homo sapiens
uaaagccagucuuguucaca

SEQ ID NO: 1557006 - RNA, 20 nt, Homo sapiens
uaaagccuguggguuugguc

SEQ ID NO: 1557007 - RNA, 12 nt, Homo sapiens
uaaagcuuuauc

SEQ ID NO: 1557008 - RNA, 21 nt, Homo sapiens
uaaagcuuuaucuuuguguaa

SEQ ID NO: 1557009 - RNA, 15 nt, Homo sapiens
uaaaggaaaaucaca

SEQ ID NO: 1557010 - RNA, 19 nt, Homo sapiens
uaaaggaaaaucacaucuc

SEQ ID NO: 1557011 - RNA, 17 nt, Homo sapiens
uaaaggcagcugccucu

SEQ ID NO: 1557012 - RNA, 19 nt, Homo sapiens
uaaaggguggggcauugag

SEQ ID NO: 1557013 - RNA, 16 nt, Homo sapiens
uaaaguacaaccauag

SEQ ID NO: 1557014 - RNA, 22 nt, Homo sapiens
uaaaguauguccuucagcugac

SEQ ID NO: 1557015 - RNA, 23 nt, Homo sapiens
uaaaguauguuuucaauguuuca

SEQ ID NO: 1557016 - RNA, 15 nt, Homo sapiens
uaaaguauuccaccu

SEQ ID NO: 1557017 - RNA, 18 nt, Homo sapiens
uaaaguucaauugugaaa

SEQ ID NO: 1557018 - RNA, 19 nt, Homo sapiens
uaaaguuuucuaaauuuau

SEQ ID NO: 1557019 - RNA, 14 nt, Homo sapiens
uaaaguuuugcaac

SEQ ID NO: 1557020 - RNA, 20 nt, Homo sapiens
uaaaguuuugcaacaauaaa

SEQ ID NO: 1557021 - RNA, 23 nt, Homo sapiens
uaaauaaacacauagauucaccu

SEQ ID NO: 1557022 - RNA, 22 nt, Homo sapiens
uaaauaauacauuuauaaucua

SEQ ID NO: 1557023 - RNA, 17 nt, Homo sapiens
uaaauagaacaaccugc

SEQ ID NO: 1557024 - RNA, 18 nt, Homo sapiens
uaaauagaacaaccugca

SEQ ID NO: 1557025 - RNA, 22 nt, Homo sapiens
gcccaucacaggguugggccca

SEQ ID NO: 1557026 - RNA, 12 nt, Homo sapiens
gcccauccugcc

SEQ ID NO: 1557027 - RNA, 13 nt, Homo sapiens
gcccauggcauuu

SEQ ID NO: 1557028 - RNA, 20 nt, Homo sapiens
gcccauuggccgagcuccug

SEQ ID NO: 1557029 - RNA, 16 nt, Homo sapiens
gcccauuuacacuuuu

SEQ ID NO: 1557030 - RNA, 16 nt, Homo sapiens
gccccaacucuuuauc

SEQ ID NO: 1557031 - RNA, 13 nt, Homo sapiens
gcccccagcagag

SEQ ID NO: 1557032 - RNA, 14 nt, Homo sapiens
gcccccaucaccca

SEQ ID NO: 1557033 - RNA, 18 nt, Homo sapiens
gcccccauuguggucaca

SEQ ID NO: 1557034 - RNA, 16 nt, Homo sapiens
gccccgccugucacaa

SEQ ID NO: 1557035 - RNA, 20 nt, Homo sapiens
gccccuccccagacucucag

SEQ ID NO: 1557036 - RNA, 14 nt, Homo sapiens
gccccucucaccaa

SEQ ID NO: 1557037 - RNA, 18 nt, Homo sapiens
gccccugcucacugggcc

SEQ ID NO: 1557038 - RNA, 18 nt, Homo sapiens
gccccuggucaagugcug

SEQ ID NO: 1557039 - RNA, 17 nt, Homo sapiens
gcccgagccugaacuga

SEQ ID NO: 1557040 - RNA, 21 nt, Homo sapiens
gcccgagcgccugcguuccca

SEQ ID NO: 1557041 - RNA, 16 nt, Homo sapiens
gcccgggagcucagga

SEQ ID NO: 1557042 - RNA, 16 nt, Homo sapiens
gcccgucucuuucuca

SEQ ID NO: 1557043 - RNA, 21 nt, Homo sapiens
gcccuaccugauuggugcaac

SEQ ID NO: 1557044 - RNA, 19 nt, Homo sapiens
gcccuaggggagcaccgug

SEQ ID NO: 1557045 - RNA, 15 nt, Homo sapiens
gcccucagacauuua

SEQ ID NO: 1557046 - RNA, 16 nt, Homo sapiens
gcccucagacauuuau

SEQ ID NO: 1557047 - RNA, 15 nt, Homo sapiens
gcccuccacaccucu

SEQ ID NO: 1557048 - RNA, 21 nt, Homo sapiens
gcccuccccacaaugccagac

SEQ ID NO: 1557049 - RNA, 18 nt, Homo sapiens
gcccuccucugcacuccc

SEQ ID NO: 1557050 - RNA, 12 nt, Homo sapiens
gcccugaccaau

SEQ ID NO: 1557051 - RNA, 14 nt, Homo sapiens
gcccugacuccugg

SEQ ID NO: 1557052 - RNA, 20 nt, Homo sapiens
gcccugccccacccaacucc

SEQ ID NO: 1557053 - RNA, 16 nt, Homo sapiens
gcccuggaaacauaca

SEQ ID NO: 1557054 - RNA, 22 nt, Homo sapiens
gcccuggcaggcagguguuuau

SEQ ID NO: 1557055 - RNA, 23 nt, Homo sapiens
gcccugggcugggugcugggaag

SEQ ID NO: 1557056 - RNA, 23 nt, Homo sapiens
gcccuguccaaaagcgcccucac

SEQ ID NO: 1557057 - RNA, 12 nt, Homo sapiens
gcccuuuccucc

SEQ ID NO: 1557058 - RNA, 15 nt, Homo sapiens
gcccuuuccuuccag

SEQ ID NO: 1557059 - RNA, 16 nt, Homo sapiens
gcccuuuccuuccaga

SEQ ID NO: 1557060 - RNA, 14 nt, Homo sapiens
gccgacuuggagac

SEQ ID NO: 1557061 - RNA, 18 nt, Homo sapiens
gccgacuuggagacuccu

SEQ ID NO: 1557062 - RNA, 19 nt, Homo sapiens
gccgagccugcacuggggc

SEQ ID NO: 1557063 - RNA, 15 nt, Homo sapiens
gccgagugcacugca

SEQ ID NO: 1557064 - RNA, 22 nt, Homo sapiens
gccgauaucuucagaaaaccua

SEQ ID NO: 1557065 - RNA, 18 nt, Homo sapiens
gccgcaguuuggagucac

SEQ ID NO: 1557066 - RNA, 21 nt, Homo sapiens
gccgcaguuuggagucacugu

SEQ ID NO: 1557067 - RNA, 19 nt, Homo sapiens
gccgcauucccugagucac

SEQ ID NO: 1557068 - RNA, 16 nt, Homo sapiens
gccgggaccacccuga

SEQ ID NO: 1557069 - RNA, 16 nt, Homo sapiens
gccgggcaugguggca

SEQ ID NO: 1557070 - RNA, 16 nt, Homo sapiens
gccgggcugacugccc

SEQ ID NO: 1557071 - RNA, 14 nt, Homo sapiens
gccgguacacagcc

SEQ ID NO: 1557072 - RNA, 19 nt, Homo sapiens
gccggucagccacaccagg

SEQ ID NO: 1557073 - RNA, 21 nt, Homo sapiens
gccguccuggcgccuggcagu

SEQ ID NO: 1557074 - RNA, 17 nt, Homo sapiens
gccgucuccucccucag

SEQ ID NO: 1557075 - RNA, 21 nt, Homo sapiens
gccuaccucuccacaagggga

SEQ ID NO: 1557076 - RNA, 13 nt, Homo sapiens
gccuagauaugaa

SEQ ID NO: 1557077 - RNA, 22 nt, Homo sapiens
gccuagauaugaauauauggca

SEQ ID NO: 1557078 - RNA, 15 nt, Homo sapiens
gccuaucugaccaaa

SEQ ID NO: 1557079 - RNA, 16 nt, Homo sapiens
gccucaacacccuggg

SEQ ID NO: 1557080 - RNA, 21 nt, Homo sapiens
gccucacuggggcagacaaua

SEQ ID NO: 1557081 - RNA, 16 nt, Homo sapiens
gccuccaaaauauuaa

SEQ ID NO: 1557082 - RNA, 16 nt, Homo sapiens
gccuccagucauggua

SEQ ID NO: 1557083 - RNA, 15 nt, Homo sapiens
gccuccagugcaguc

SEQ ID NO: 1557084 - RNA, 13 nt, Homo sapiens
gccucccacaaga

SEQ ID NO: 1557085 - RNA, 14 nt, Homo sapiens
gccucccaccagag

SEQ ID NO: 1557086 - RNA, 20 nt, Homo sapiens
gccucccucaaaggaccugc

SEQ ID NO: 1557087 - RNA, 10 nt, Homo sapiens
gccuccucaa

SEQ ID NO: 1557088 - RNA, 20 nt, Homo sapiens
gccuccuccagaauggagcu

SEQ ID NO: 1557089 - RNA, 13 nt, Homo sapiens
gccuccuccucac

SEQ ID NO: 1557090 - RNA, 23 nt, Homo sapiens
gccuccuguguacugugucauaa

SEQ ID NO: 1557091 - RNA, 21 nt, Homo sapiens
gccuccuuuccccucccucag

SEQ ID NO: 1557092 - RNA, 18 nt, Homo sapiens
gccucgugccaugaucug

SEQ ID NO: 1557093 - RNA, 13 nt, Homo sapiens
gccucucccugcc

SEQ ID NO: 1557094 - RNA, 15 nt, Homo sapiens
gccucucccugccug

SEQ ID NO: 1557095 - RNA, 15 nt, Homo sapiens
gccucucuuucacac

SEQ ID NO: 1557096 - RNA, 21 nt, Homo sapiens
gccucuuccuguugugacugc

SEQ ID NO: 1557097 - RNA, 17 nt, Homo sapiens
gccugaaaugacauuuc

SEQ ID NO: 1557098 - RNA, 15 nt, Homo sapiens
gccugacucuucccu

SEQ ID NO: 1557099 - RNA, 23 nt, Homo sapiens
gccugagaacaccagagaccuca

SEQ ID NO: 1557100 - RNA, 20 nt, Homo sapiens
gccugagaggcaggcauaga

SEQ ID NO: 1557101 - RNA, 18 nt, Homo sapiens
gccugagaugcaggugau

SEQ ID NO: 1557102 - RNA, 13 nt, Homo sapiens
gccugaggcaauu

SEQ ID NO: 1557103 - RNA, 22 nt, Homo sapiens
gccugaggcaauuagacacuuu

SEQ ID NO: 1557104 - RNA, 21 nt, Homo sapiens
gccugaggucaggaguucaag

SEQ ID NO: 1557105 - RNA, 21 nt, Homo sapiens
gccugagguuugccagcauuu

SEQ ID NO: 1557106 - RNA, 17 nt, Homo sapiens
gccugauagaagugcau

SEQ ID NO: 1557107 - RNA, 15 nt, Homo sapiens
gccugcaaaccuucc

SEQ ID NO: 1557108 - RNA, 18 nt, Homo sapiens
gccugcaccaggggugca

SEQ ID NO: 1557109 - RNA, 14 nt, Homo sapiens
gccugcacuuugau

SEQ ID NO: 1557110 - RNA, 21 nt, Homo sapiens
gccugcaggagagagcagcac

SEQ ID NO: 1557111 - RNA, 23 nt, Homo sapiens
gccugccgcuguggaagcuuugu

SEQ ID NO: 1557112 - RNA, 19 nt, Homo sapiens
gccugcuggcugcggcccc

SEQ ID NO: 1557113 - RNA, 13 nt, Homo sapiens
gccugcugguuuu

SEQ ID NO: 1557114 - RNA, 15 nt, Homo sapiens
gccugcuuugcuuua

SEQ ID NO: 1557115 - RNA, 14 nt, Homo sapiens
gccuggagacauau

SEQ ID NO: 1557116 - RNA, 22 nt, Homo sapiens
gccuggaugcccccuguggaug

SEQ ID NO: 1557117 - RNA, 18 nt, Homo sapiens
gccuggccaacaugguga

SEQ ID NO: 1557118 - RNA, 20 nt, Homo sapiens
gccuggccaacauggugaaa

SEQ ID NO: 1557119 - RNA, 13 nt, Homo sapiens
gccuggguggaug

SEQ ID NO: 1557120 - RNA, 19 nt, Homo sapiens
guuccccugucugucccag

SEQ ID NO: 1557121 - RNA, 19 nt, Homo sapiens
guucccuugcagggguccc

SEQ ID NO: 1557122 - RNA, 21 nt, Homo sapiens
guuccgccucccggguucaca

SEQ ID NO: 1557123 - RNA, 19 nt, Homo sapiens
guuccugaaaauugcaaua

SEQ ID NO: 1557124 - RNA, 21 nt, Homo sapiens
guuccugugugacccugggca

SEQ ID NO: 1557125 - RNA, 21 nt, Homo sapiens
guuccuguucgguuccagaca

SEQ ID NO: 1557126 - RNA, 19 nt, Homo sapiens
guucgauguuagcguuuac

SEQ ID NO: 1557127 - RNA, 16 nt, Homo sapiens
guucgcucgugcagua

SEQ ID NO: 1557128 - RNA, 15 nt, Homo sapiens
guucuaaaugcaaua

SEQ ID NO: 1557129 - RNA, 18 nt, Homo sapiens
guucuaccaagaacugaa

SEQ ID NO: 1557130 - RNA, 11 nt, Homo sapiens
guucucaggcc

SEQ ID NO: 1557131 - RNA, 14 nt, Homo sapiens
guucucccaaagau

SEQ ID NO: 1557132 - RNA, 20 nt, Homo sapiens
guucucuaggccuucaggac

SEQ ID NO: 1557133 - RNA, 12 nt, Homo sapiens
guucucuguauu

SEQ ID NO: 1557134 - RNA, 15 nt, Homo sapiens
guucuguuucagagc

SEQ ID NO: 1557135 - RNA, 16 nt, Homo sapiens
guucuucauuaccuca

SEQ ID NO: 1557136 - RNA, 22 nt, Homo sapiens
guucuugguguuugacuguaau

SEQ ID NO: 1557137 - RNA, 16 nt, Homo sapiens
guucuuugaccagcac

SEQ ID NO: 1557138 - RNA, 23 nt, Homo sapiens
guucuuuggaaaguacacucugc

SEQ ID NO: 1557139 - RNA, 22 nt, Homo sapiens
guugaaaccaccgugaaccaga

SEQ ID NO: 1557140 - RNA, 13 nt, Homo sapiens
guugaaauggcau

SEQ ID NO: 1557141 - RNA, 18 nt, Homo sapiens
guugaaccauuauacuuu

SEQ ID NO: 1557142 - RNA, 18 nt, Homo sapiens
guugaagacagcuuccca

SEQ ID NO: 1557143 - RNA, 21 nt, Homo sapiens
guugacguuugcucauuuaag

SEQ ID NO: 1557144 - RNA, 21 nt, Homo sapiens
guugauauaauccuaccagaa

SEQ ID NO: 1557145 - RNA, 20 nt, Homo sapiens
guugauuguauaaaugcaau

SEQ ID NO: 1557146 - RNA, 21 nt, Homo sapiens
guugauuguauaaaugcaaua

SEQ ID NO: 1557147 - RNA, 14 nt, Homo sapiens
guugccacaucaca

SEQ ID NO: 1557148 - RNA, 19 nt, Homo sapiens
guugcccaagguugcacag

SEQ ID NO: 1557149 - RNA, 21 nt, Homo sapiens
gcaucaauuuucaaacaaccg

SEQ ID NO: 1557150 - RNA, 15 nt, Homo sapiens
gcaucagaaaacagg

SEQ ID NO: 1557151 - RNA, 22 nt, Homo sapiens
gcaucaugcauuacgcucggaa

SEQ ID NO: 1557152 - RNA, 23 nt, Homo sapiens
gcaucauuaauaccuaaacugua

SEQ ID NO: 1557153 - RNA, 21 nt, Homo sapiens
gcaucauuuccccaacagggc

SEQ ID NO: 1557154 - RNA, 20 nt, Homo sapiens
gcauccagagauucauuuuc

SEQ ID NO: 1557155 - RNA, 18 nt, Homo sapiens
gcaucggacaagaccccc

SEQ ID NO: 1557156 - RNA, 23 nt, Homo sapiens
gcaucgggagcacccagagcacc

SEQ ID NO: 1557157 - RNA, 12 nt, Homo sapiens
gcaucuacuuag

SEQ ID NO: 1557158 - RNA, 19 nt, Homo sapiens
gcaucuauaaugucagcuu

SEQ ID NO: 1557159 - RNA, 9 nt, Homo sapiens
gcaucuccc

SEQ ID NO: 1557160 - RNA, 14 nt, Homo sapiens
gcaucuccccucag

SEQ ID NO: 1557161 - RNA, 16 nt, Homo sapiens
gcaucucuucuucccu

SEQ ID NO: 1557162 - RNA, 16 nt, Homo sapiens
gcaucuucccgcugag

SEQ ID NO: 1557163 - RNA, 16 nt, Homo sapiens
gcaugacacuuccaaa

SEQ ID NO: 1557164 - RNA, 13 nt, Homo sapiens
gcaugauggugca

SEQ ID NO: 1557165 - RNA, 18 nt, Homo sapiens
gcaugauuaacaaagcaa

SEQ ID NO: 1557166 - RNA, 16 nt, Homo sapiens
gcaugcacacugagaa

SEQ ID NO: 1557167 - RNA, 19 nt, Homo sapiens
gcaugcauaccacaagaca

SEQ ID NO: 1557168 - RNA, 17 nt, Homo sapiens
gcauggaaacauggagg

SEQ ID NO: 1557169 - RNA, 22 nt, Homo sapiens
gcauggaggguuuuaaauggag

SEQ ID NO: 1557170 - RNA, 20 nt, Homo sapiens
gcaugggauggggaugaagu

SEQ ID NO: 1557171 - RNA, 16 nt, Homo sapiens
gcauguauaguuagaa

SEQ ID NO: 1557172 - RNA, 15 nt, Homo sapiens
gcaugucauuugcac

SEQ ID NO: 1557173 - RNA, 19 nt, Homo sapiens
gcaugucugccuaugcacu

SEQ ID NO: 1557174 - RNA, 17 nt, Homo sapiens
gcaugugugacuuucag

SEQ ID NO: 1557175 - RNA, 17 nt, Homo sapiens
gcauuaauagucccauu

SEQ ID NO: 1557176 - RNA, 16 nt, Homo sapiens
gcauuaauugugcugu

SEQ ID NO: 1557177 - RNA, 14 nt, Homo sapiens
gcauucacauuuag

SEQ ID NO: 1557178 - RNA, 15 nt, Homo sapiens
gcauuccagaacaaa

SEQ ID NO: 1557179 - RNA, 13 nt, Homo sapiens
gcauugccaagug

SEQ ID NO: 1557180 - RNA, 17 nt, Homo sapiens
gcauugcuggacucuga

SEQ ID NO: 1557181 - RNA, 17 nt, Homo sapiens
gcauuguaaaugugcuu

SEQ ID NO: 1557182 - RNA, 22 nt, Homo sapiens
gcauuugacugaagaugcagcu

SEQ ID NO: 1557183 - RNA, 17 nt, Homo sapiens
gcauuugaguuugcaaa

SEQ ID NO: 1557184 - RNA, 20 nt, Homo sapiens
gcauuugaugauagcagaca

SEQ ID NO: 1557185 - RNA, 13 nt, Homo sapiens
gccaaaauaccag

SEQ ID NO: 1557186 - RNA, 16 nt, Homo sapiens
gccaaaccugccuugc

SEQ ID NO: 1557187 - RNA, 19 nt, Homo sapiens
gccaaagaaaugaacauuc

SEQ ID NO: 1557188 - RNA, 13 nt, Homo sapiens
gccaaagauuuca

SEQ ID NO: 1557189 - RNA, 17 nt, Homo sapiens
gccaacacgccuggcua

SEQ ID NO: 1557190 - RNA, 18 nt, Homo sapiens
gccaacacuuaaucauuu

SEQ ID NO: 1557191 - RNA, 21 nt, Homo sapiens
gccaacauguggcuccuccca

SEQ ID NO: 1557192 - RNA, 15 nt, Homo sapiens
gccaagaacuugcaa

SEQ ID NO: 1557193 - RNA, 20 nt, Homo sapiens
gccaagaucgccccacugca

SEQ ID NO: 1557194 - RNA, 15 nt, Homo sapiens
gccaagcaggacagu

SEQ ID NO: 1557195 - RNA, 19 nt, Homo sapiens
gccaagcaggacagugcuu

SEQ ID NO: 1557196 - RNA, 11 nt, Homo sapiens
gccaagcccug

SEQ ID NO: 1557197 - RNA, 20 nt, Homo sapiens
gccaaggaggaaauguggaa

SEQ ID NO: 1557198 - RNA, 15 nt, Homo sapiens
gccaagucauagcca

SEQ ID NO: 1557199 - RNA, 13 nt, Homo sapiens
gccaagugugccc

SEQ ID NO: 1557200 - RNA, 15 nt, Homo sapiens
gccaaguugugacag

SEQ ID NO: 1557201 - RNA, 14 nt, Homo sapiens
gccaauagugucau

SEQ ID NO: 1557202 - RNA, 13 nt, Homo sapiens
gccaauauaacua

SEQ ID NO: 1557203 - RNA, 17 nt, Homo sapiens
gccaauauaacuaucuc

SEQ ID NO: 1557204 - RNA, 16 nt, Homo sapiens
gccaauguuaugccag

SEQ ID NO: 1557205 - RNA, 23 nt, Homo sapiens
gccacacccaggggaaggcccug

SEQ ID NO: 1557206 - RNA, 14 nt, Homo sapiens
gccacagggagcuc

SEQ ID NO: 1557207 - RNA, 15 nt, Homo sapiens
gccacagucacugga

SEQ ID NO: 1557208 - RNA, 16 nt, Homo sapiens
gccacagucacuggau

SEQ ID NO: 1557209 - RNA, 18 nt, Homo sapiens
gccaccaacuuacaaaaa

SEQ ID NO: 1557210 - RNA, 17 nt, Homo sapiens
gccaccccaaagcccuc

SEQ ID NO: 1557211 - RNA, 13 nt, Homo sapiens
gccaccucaccaa

SEQ ID NO: 1557212 - RNA, 16 nt, Homo sapiens
gccacuauuacuggga

SEQ ID NO: 1557213 - RNA, 14 nt, Homo sapiens
gccacucacacagc

SEQ ID NO: 1557214 - RNA, 22 nt, Homo sapiens
gccacugagaagugcacuuuaa

SEQ ID NO: 1557215 - RNA, 12 nt, Homo sapiens
gccacuucucac

SEQ ID NO: 1557216 - RNA, 19 nt, Homo sapiens
gccagaguggccuggccag

SEQ ID NO: 1557217 - RNA, 11 nt, Homo sapiens
gccagcacuuc

SEQ ID NO: 1557218 - RNA, 21 nt, Homo sapiens
gccagcagcacagucacccau

SEQ ID NO: 1557219 - RNA, 16 nt, Homo sapiens
gccagcagggcaucuu

SEQ ID NO: 1557220 - RNA, 17 nt, Homo sapiens
gccagcauuuucauuca

SEQ ID NO: 1557221 - RNA, 20 nt, Homo sapiens
gccagcugggagcacuggug

SEQ ID NO: 1557222 - RNA, 17 nt, Homo sapiens
gccagcugugcacuuuc

SEQ ID NO: 1557223 - RNA, 22 nt, Homo sapiens
gccagcuuacuagcacuuugag

SEQ ID NO: 1557224 - RNA, 11 nt, Homo sapiens
gccaggagcuc

SEQ ID NO: 1557225 - RNA, 17 nt, Homo sapiens
gccaggauccucuccuu

SEQ ID NO: 1557226 - RNA, 20 nt, Homo sapiens
gccaggauccucuccuuuga

SEQ ID NO: 1557227 - RNA, 15 nt, Homo sapiens
gccaggcacuuugag

SEQ ID NO: 1557228 - RNA, 16 nt, Homo sapiens
gccagggcuuccucaa

SEQ ID NO: 1557229 - RNA, 13 nt, Homo sapiens
gccaggggugcuc

SEQ ID NO: 1557230 - RNA, 15 nt, Homo sapiens
gccaggggugcuccu

SEQ ID NO: 1557231 - RNA, 14 nt, Homo sapiens
gccagggugacaga

SEQ ID NO: 1557232 - RNA, 10 nt, Homo sapiens
gccagugugu

SEQ ID NO: 1557233 - RNA, 16 nt, Homo sapiens
gccaguuuuaccagcg

SEQ ID NO: 1557234 - RNA, 16 nt, Homo sapiens
gccaguuuuacuguga

SEQ ID NO: 1557235 - RNA, 22 nt, Homo sapiens
gccauaaaaauaaaucaguuca

SEQ ID NO: 1557236 - RNA, 13 nt, Homo sapiens
gccauaaaacuua

SEQ ID NO: 1557237 - RNA, 17 nt, Homo sapiens
gccauaagaaagcacua

SEQ ID NO: 1557238 - RNA, 19 nt, Homo sapiens
gccauaauuacuaugucau

SEQ ID NO: 1557239 - RNA, 18 nt, Homo sapiens
gccauacugccuuugcag

SEQ ID NO: 1557240 - RNA, 19 nt, Homo sapiens
gccauaucuucaggccaug

SEQ ID NO: 1557241 - RNA, 17 nt, Homo sapiens
gccaucguccugggacu

SEQ ID NO: 1557242 - RNA, 15 nt, Homo sapiens
gccaucucuuccuca

SEQ ID NO: 1557243 - RNA, 23 nt, Homo sapiens
gccaugccuggagacauaucacu

SEQ ID NO: 1557244 - RNA, 17 nt, Homo sapiens
gccaugcuuugagucca

SEQ ID NO: 1557245 - RNA, 19 nt, Homo sapiens
gccauggguucaccagccc

SEQ ID NO: 1557246 - RNA, 17 nt, Homo sapiens
gcacacuggcucaccca

SEQ ID NO: 1557247 - RNA, 17 nt, Homo sapiens
gcacagaaauuuucaau

SEQ ID NO: 1557248 - RNA, 20 nt, Homo sapiens
gcacagccccuggagccuca

SEQ ID NO: 1557249 - RNA, 14 nt, Homo sapiens
gcacagucacccau

SEQ ID NO: 1557250 - RNA, 15 nt, Homo sapiens
gcacagucacuggcc

SEQ ID NO: 1557251 - RNA, 18 nt, Homo sapiens
gcacagucauacaaguca

SEQ ID NO: 1557252 - RNA, 16 nt, Homo sapiens
gcacauguacccuaaa

SEQ ID NO: 1557253 - RNA, 21 nt, Homo sapiens
gcaccaaccacagcaucggga

SEQ ID NO: 1557254 - RNA, 13 nt, Homo sapiens
gcaccaccagggc

SEQ ID NO: 1557255 - RNA, 14 nt, Homo sapiens
gcaccacccuaguc

SEQ ID NO: 1557256 - RNA, 23 nt, Homo sapiens
gcaccagagggauaaaaacaaua

SEQ ID NO: 1557257 - RNA, 12 nt, Homo sapiens
gcaccagccacc

SEQ ID NO: 1557258 - RNA, 21 nt, Homo sapiens
gcaccaucauuuaaugugaca

SEQ ID NO: 1557259 - RNA, 13 nt, Homo sapiens
gcaccccaugcca

SEQ ID NO: 1557260 - RNA, 13 nt, Homo sapiens
gcaccccuacuca

SEQ ID NO: 1557261 - RNA, 18 nt, Homo sapiens
gcacccugcccaccaaga

SEQ ID NO: 1557262 - RNA, 22 nt, Homo sapiens
gcacccugcccaccaagaagca

SEQ ID NO: 1557263 - RNA, 19 nt, Homo sapiens
gcaccuacacucaccugca

SEQ ID NO: 1557264 - RNA, 23 nt, Homo sapiens
gcaccuaugagauggccaugcuc

SEQ ID NO: 1557265 - RNA, 21 nt, Homo sapiens
gcaccuguagucccagcuacu

SEQ ID NO: 1557266 - RNA, 19 nt, Homo sapiens
gcacguggagauagugcca

SEQ ID NO: 1557267 - RNA, 21 nt, Homo sapiens
gcacuacauucauuuagcuaa

SEQ ID NO: 1557268 - RNA, 13 nt, Homo sapiens
gcacuacucugug

SEQ ID NO: 1557269 - RNA, 21 nt, Homo sapiens
gcacucacuccugacugcccg

SEQ ID NO: 1557270 - RNA, 17 nt, Homo sapiens
gcacucagggagcauuu

SEQ ID NO: 1557271 - RNA, 16 nt, Homo sapiens
gcacuccuacugaguu

SEQ ID NO: 1557272 - RNA, 16 nt, Homo sapiens
gcacucucugccauuc

SEQ ID NO: 1557273 - RNA, 20 nt, Homo sapiens
gcacugaagagagcauuugg

SEQ ID NO: 1557274 - RNA, 15 nt, Homo sapiens
gcacugcacccuguu

SEQ ID NO: 1557275 - RNA, 13 nt, Homo sapiens
gcacuggggccac

SEQ ID NO: 1557276 - RNA, 20 nt, Homo sapiens
gcacuguucccccugugcag

SEQ ID NO: 1557277 - RNA, 23 nt, Homo sapiens
gcacuuauaagaaagaucaaaga

SEQ ID NO: 1557278 - RNA, 21 nt, Homo sapiens
gcacuuggccugacucaggaa

SEQ ID NO: 1557279 - RNA, 21 nt, Homo sapiens
gcacuuucauccucaagcuca

SEQ ID NO: 1557280 - RNA, 22 nt, Homo sapiens
gcagaaaagaaaccggaccccc

SEQ ID NO: 1557281 - RNA, 17 nt, Homo sapiens
gcagaaaaucuaccaag

SEQ ID NO: 1557282 - RNA, 13 nt, Homo sapiens
gcagaaaugcaag

SEQ ID NO: 1557283 - RNA, 21 nt, Homo sapiens
gcagaacugaaaaauuacuua

SEQ ID NO: 1557284 - RNA, 12 nt, Homo sapiens
gcagaagcccug

SEQ ID NO: 1557285 - RNA, 17 nt, Homo sapiens
gcagaagcuggaggcac

SEQ ID NO: 1557286 - RNA, 18 nt, Homo sapiens
gcagaagcuggaggcaca

SEQ ID NO: 1557287 - RNA, 19 nt, Homo sapiens
gcagacaauaaacccucag

SEQ ID NO: 1557288 - RNA, 21 nt, Homo sapiens
gcagaccacugauaaaaccau

SEQ ID NO: 1557289 - RNA, 12 nt, Homo sapiens
gcagagugaaug

SEQ ID NO: 1557290 - RNA, 21 nt, Homo sapiens
gcagaguguuuaccuggugcu

SEQ ID NO: 1557291 - RNA, 23 nt, Homo sapiens
gcagauaacuuuuuugagucauu

SEQ ID NO: 1557292 - RNA, 16 nt, Homo sapiens
gcagauucaagagcca

SEQ ID NO: 1557293 - RNA, 17 nt, Homo sapiens
gcagauucaagagccag

SEQ ID NO: 1557294 - RNA, 20 nt, Homo sapiens
gcagauuuccagccuucuac

SEQ ID NO: 1557295 - RNA, 21 nt, Homo sapiens
gcagcaaaagaccaaaucuca

SEQ ID NO: 1557296 - RNA, 19 nt, Homo sapiens
gcagcacgccaacauggca

SEQ ID NO: 1557297 - RNA, 12 nt, Homo sapiens
gcagcacuguga

SEQ ID NO: 1557298 - RNA, 13 nt, Homo sapiens
gcagcagcaaaca

SEQ ID NO: 1557299 - RNA, 21 nt, Homo sapiens
gcagcaggcagcuucuacucc

SEQ ID NO: 1557300 - RNA, 15 nt, Homo sapiens
gcagcauuccaugac

SEQ ID NO: 1557301 - RNA, 12 nt, Homo sapiens
gcagccaccagc

SEQ ID NO: 1557302 - RNA, 13 nt, Homo sapiens
gcagccaccagcg

SEQ ID NO: 1557303 - RNA, 13 nt, Homo sapiens
gcagcccaugccc

SEQ ID NO: 1557304 - RNA, 14 nt, Homo sapiens
gcagccccugagag

SEQ ID NO: 1557305 - RNA, 19 nt, Homo sapiens
gcagccugagcaacucuug

SEQ ID NO: 1557306 - RNA, 13 nt, Homo sapiens
gcagccugugaag

SEQ ID NO: 1557307 - RNA, 21 nt, Homo sapiens
gcagccuuuacguucaucacc

SEQ ID NO: 1557308 - RNA, 23 nt, Homo sapiens
gcagcggugccucaacacccugg

SEQ ID NO: 1557309 - RNA, 15 nt, Homo sapiens
gcagcucacuacccu

SEQ ID NO: 1557310 - RNA, 14 nt, Homo sapiens
gcagcucaggauag

SEQ ID NO: 1557311 - RNA, 17 nt, Homo sapiens
gcagcugccucugcucc

SEQ ID NO: 1557312 - RNA, 19 nt, Homo sapiens
gcagcugucagaacacucc

SEQ ID NO: 1557313 - RNA, 18 nt, Homo sapiens
gcaggaaaugaaaauguc

SEQ ID NO: 1557314 - RNA, 15 nt, Homo sapiens
gcaggaagggagaac

SEQ ID NO: 1557315 - RNA, 16 nt, Homo sapiens
gcaggaccucaccaaa

SEQ ID NO: 1557316 - RNA, 18 nt, Homo sapiens
gcaggacggcaguacuca

SEQ ID NO: 1557317 - RNA, 13 nt, Homo sapiens
gcaggacugcaca

SEQ ID NO: 1557318 - RNA, 16 nt, Homo sapiens
gcaggagaagaacaag

SEQ ID NO: 1557319 - RNA, 14 nt, Homo sapiens
gcaggagaaucacu

SEQ ID NO: 1557320 - RNA, 18 nt, Homo sapiens
gcaggaucugucugugca

SEQ ID NO: 1557321 - RNA, 20 nt, Homo sapiens
gcaggaucugucugugcaca

SEQ ID NO: 1557322 - RNA, 18 nt, Homo sapiens
gcaggauguuggccacca

SEQ ID NO: 1557323 - RNA, 14 nt, Homo sapiens
gcaggcauuugcua

SEQ ID NO: 1557324 - RNA, 23 nt, Homo sapiens
gcaggcugggccauguccaaaga

SEQ ID NO: 1557325 - RNA, 20 nt, Homo sapiens
gcagggaaggaucccaugag

SEQ ID NO: 1557326 - RNA, 17 nt, Homo sapiens
gcagggacaaccaccag

SEQ ID NO: 1557327 - RNA, 18 nt, Homo sapiens
gcagggagccuucugcca

SEQ ID NO: 1557328 - RNA, 15 nt, Homo sapiens
gcagggccacuggaa

SEQ ID NO: 1557329 - RNA, 19 nt, Homo sapiens
gcagggcccacccauguca

SEQ ID NO: 1557330 - RNA, 20 nt, Homo sapiens
gcagggcgccaagucuggca

SEQ ID NO: 1557331 - RNA, 14 nt, Homo sapiens
gcagggcugcaggg

SEQ ID NO: 1557332 - RNA, 13 nt, Homo sapiens
gcaggggagacag

SEQ ID NO: 1557333 - RNA, 23 nt, Homo sapiens
gcaggggcggguggaucaccuga

SEQ ID NO: 1557334 - RNA, 16 nt, Homo sapiens
gcaggugaugccauua

SEQ ID NO: 1557335 - RNA, 13 nt, Homo sapiens
gcaggugcaguuu

SEQ ID NO: 1557336 - RNA, 13 nt, Homo sapiens
gcaguacuuugug

SEQ ID NO: 1557337 - RNA, 21 nt, Homo sapiens
gcaguauuggacaaagagcau

SEQ ID NO: 1557338 - RNA, 21 nt, Homo sapiens
gcaguauuguucguucugaua

SEQ ID NO: 1557339 - RNA, 12 nt, Homo sapiens
gcagucacugga

SEQ ID NO: 1557340 - RNA, 22 nt, Homo sapiens
gcagucugcucugcugcucuga

SEQ ID NO: 1557341 - RNA, 15 nt, Homo sapiens
gcagugagcugagau

SEQ ID NO: 1557342 - RNA, 20 nt, Homo sapiens
gcagugccaaaauauaauca

SEQ ID NO: 1557343 - RNA, 18 nt, Homo sapiens
gcagugcuaaagccugug

SEQ ID NO: 1557344 - RNA, 14 nt, Homo sapiens
gcagugcucaccca

SEQ ID NO: 1557345 - RNA, 20 nt, Homo sapiens
gcaguggacucagaaagcca

SEQ ID NO: 1557346 - RNA, 16 nt, Homo sapiens
gcaguggcucaugccu

SEQ ID NO: 1557347 - RNA, 14 nt, Homo sapiens
gcaguguuugcucc

SEQ ID NO: 1557348 - RNA, 20 nt, Homo sapiens
gcaguuacuggggucaccca

SEQ ID NO: 1557349 - RNA, 19 nt, Homo sapiens
gcaguuggacucucaggga

SEQ ID NO: 1557350 - RNA, 13 nt, Homo sapiens
gcaguuucugaca

SEQ ID NO: 1557351 - RNA, 16 nt, Homo sapiens
gcaguuugacuucuuu

SEQ ID NO: 1557352 - RNA, 18 nt, Homo sapiens
gcaguuuggagucacugu

SEQ ID NO: 1557353 - RNA, 13 nt, Homo sapiens
gcauaaccugucu

SEQ ID NO: 1557354 - RNA, 12 nt, Homo sapiens
gcauaacuuauu

SEQ ID NO: 1557355 - RNA, 20 nt, Homo sapiens
gcauaccaaauggcacuuuu

SEQ ID NO: 1557356 - RNA, 15 nt, Homo sapiens
gcauaccacaagaca

SEQ ID NO: 1557357 - RNA, 23 nt, Homo sapiens
gcauacgguaugauauugcagcu

SEQ ID NO: 1557358 - RNA, 19 nt, Homo sapiens
gcauagauugaucaaagug

SEQ ID NO: 1557359 - RNA, 21 nt, Homo sapiens
gcauagcacccguggugcaug

SEQ ID NO: 1557360 - RNA, 20 nt, Homo sapiens
gcauagcaguauauguuaau

SEQ ID NO: 1557361 - RNA, 20 nt, Homo sapiens
gcauaguauuccauggugua

SEQ ID NO: 1557362 - RNA, 21 nt, Homo sapiens
gcauauuuauugcauugcugg

SEQ ID NO: 1557363 - RNA, 18 nt, Homo sapiens
gcaucaauacaaccagcc

SEQ ID NO: 1557364 - RNA, 21 nt, Homo sapiens
gcaucaauacaaccagcccaa

SEQ ID NO: 1557365 - RNA, 17 nt, Homo sapiens
cuggggaauacuggcca

SEQ ID NO: 1557366 - RNA, 19 nt, Homo sapiens
cuggggagugguuaggcag

SEQ ID NO: 1557367 - RNA, 21 nt, Homo sapiens
cuggggaugucucucaugacc

SEQ ID NO: 1557368 - RNA, 19 nt, Homo sapiens
cuggggccuagcgaucucu

SEQ ID NO: 1557369 - RNA, 18 nt, Homo sapiens
cuggggggcaauuuugca

SEQ ID NO: 1557370 - RNA, 17 nt, Homo sapiens
cuggggugggcaguuuu

SEQ ID NO: 1557371 - RNA, 22 nt, Homo sapiens
cuggguaagaagaaagcaaaag

SEQ ID NO: 1557372 - RNA, 14 nt, Homo sapiens
cugggugaccucac

SEQ ID NO: 1557373 - RNA, 20 nt, Homo sapiens
cugggugauggaaacugcca

SEQ ID NO: 1557374 - RNA, 16 nt, Homo sapiens
cuggguggaagugugu

SEQ ID NO: 1557375 - RNA, 16 nt, Homo sapiens
cuggguggaugggcca

SEQ ID NO: 1557376 - RNA, 15 nt, Homo sapiens
cuggguguugaccac

SEQ ID NO: 1557377 - RNA, 21 nt, Homo sapiens
cuggguucaacucugcuccca

SEQ ID NO: 1557378 - RNA, 22 nt, Homo sapiens
cuggguuuuguauucucugagc

SEQ ID NO: 1557379 - RNA, 15 nt, Homo sapiens
cugguaauagcugua

SEQ ID NO: 1557380 - RNA, 17 nt, Homo sapiens
cugguacuuagaguuuc

SEQ ID NO: 1557381 - RNA, 16 nt, Homo sapiens
cugguauauccaaaag

SEQ ID NO: 1557382 - RNA, 19 nt, Homo sapiens
cugguauuuuaucuuugau

SEQ ID NO: 1557383 - RNA, 15 nt, Homo sapiens
cuggucccuugcagc

SEQ ID NO: 1557384 - RNA, 18 nt, Homo sapiens
cugguccuucccugaugg

SEQ ID NO: 1557385 - RNA, 15 nt, Homo sapiens
cuggucucaaacucc

SEQ ID NO: 1557386 - RNA, 22 nt, Homo sapiens
cuggucugugaagagccggugg

SEQ ID NO: 1557387 - RNA, 14 nt, Homo sapiens
cuggugacaggcca

SEQ ID NO: 1557388 - RNA, 12 nt, Homo sapiens
cuggugccauuu

SEQ ID NO: 1557389 - RNA, 15 nt, Homo sapiens
cugguggcacaggag

SEQ ID NO: 1557390 - RNA, 21 nt, Homo sapiens
cuggugugucauacugugcag

SEQ ID NO: 1557391 - RNA, 12 nt, Homo sapiens
cugguucuaacu

SEQ ID NO: 1557392 - RNA, 14 nt, Homo sapiens
cugguucuuagccc

SEQ ID NO: 1557393 - RNA, 17 nt, Homo sapiens
cugguuuucugccaaug

SEQ ID NO: 1557394 - RNA, 18 nt, Homo sapiens
cuguaaaaaauggagcuc

SEQ ID NO: 1557395 - RNA, 20 nt, Homo sapiens
cuguaaaaaauggagcucag

SEQ ID NO: 1557396 - RNA, 17 nt, Homo sapiens
cuguaaaaaucauggaa

SEQ ID NO: 1557397 - RNA, 22 nt, Homo sapiens
cuguaaaacgcaccaaucagca

SEQ ID NO: 1557398 - RNA, 13 nt, Homo sapiens
cuguaaaauccau

SEQ ID NO: 1557399 - RNA, 22 nt, Homo sapiens
cuguaaaaugcaccaaucagca

SEQ ID NO: 1557400 - RNA, 13 nt, Homo sapiens
cuguaaacauauu

SEQ ID NO: 1557401 - RNA, 21 nt, Homo sapiens
cuguaaagauguuuauuucag

SEQ ID NO: 1557402 - RNA, 22 nt, Homo sapiens
cuguaaaguucaauugugaaaa

SEQ ID NO: 1557403 - RNA, 23 nt, Homo sapiens
cuguaaauguuauuaaaauaucc

SEQ ID NO: 1557404 - RNA, 18 nt, Homo sapiens
cuguaaauugcagaauuc

SEQ ID NO: 1557405 - RNA, 13 nt, Homo sapiens
cuguaacagcauu

SEQ ID NO: 1557406 - RNA, 14 nt, Homo sapiens
cuguaaccucuuca

SEQ ID NO: 1557407 - RNA, 12 nt, Homo sapiens
cuguaacuacuu

SEQ ID NO: 1557408 - RNA, 15 nt, Homo sapiens
cuguaagauaauguu

SEQ ID NO: 1557409 - RNA, 15 nt, Homo sapiens
cuguaagccaaagaa

SEQ ID NO: 1557410 - RNA, 15 nt, Homo sapiens
cuguaauauuuacaa

SEQ ID NO: 1557411 - RNA, 17 nt, Homo sapiens
cuguaaucccagcacuu

SEQ ID NO: 1557412 - RNA, 21 nt, Homo sapiens
cuguaaucccagcacuuuggg

SEQ ID NO: 1557413 - RNA, 14 nt, Homo sapiens
cuguaaucccagcu

SEQ ID NO: 1557414 - RNA, 22 nt, Homo sapiens
cuguaaucccagcuacuccggg

SEQ ID NO: 1557415 - RNA, 19 nt, Homo sapiens
cuguaaucucagcacuuug

SEQ ID NO: 1557416 - RNA, 18 nt, Homo sapiens
cuguacauugugagcucu

SEQ ID NO: 1557417 - RNA, 15 nt, Homo sapiens
cuguaccaguuaauu

SEQ ID NO: 1557418 - RNA, 14 nt, Homo sapiens
cuguaccucagugg

SEQ ID NO: 1557419 - RNA, 19 nt, Homo sapiens
cuguacuaaggagcaugau

SEQ ID NO: 1557420 - RNA, 17 nt, Homo sapiens
cuguacucccagcacuu

SEQ ID NO: 1557421 - RNA, 22 nt, Homo sapiens
cuguagaccaccuaauaucaau

SEQ ID NO: 1557422 - RNA, 22 nt, Homo sapiens
cuguagagagcagcauucccag

SEQ ID NO: 1557423 - RNA, 18 nt, Homo sapiens
cuguagauucagguaaua

SEQ ID NO: 1557424 - RNA, 17 nt, Homo sapiens
cuguagccucagaugau

SEQ ID NO: 1557425 - RNA, 21 nt, Homo sapiens
cuguaggacuguuugugacug

SEQ ID NO: 1557426 - RNA, 19 nt, Homo sapiens
cuguagggcacccaaaacu

SEQ ID NO: 1557427 - RNA, 18 nt, Homo sapiens
cuguagucccagcuacuu

SEQ ID NO: 1557428 - RNA, 23 nt, Homo sapiens
cuguauaaacagaacuccacugc

SEQ ID NO: 1557429 - RNA, 23 nt, Homo sapiens
cuguauaauagagauaaguccau

SEQ ID NO: 1557430 - RNA, 18 nt, Homo sapiens
cuguaucaucuuugccaa

SEQ ID NO: 1557431 - RNA, 22 nt, Homo sapiens
cuguaucuugggggacagggcu

SEQ ID NO: 1557432 - RNA, 18 nt, Homo sapiens
cuguauguuuuuacugaa

SEQ ID NO: 1557433 - RNA, 15 nt, Homo sapiens
cuguauugucuauua

SEQ ID NO: 1557434 - RNA, 23 nt, Homo sapiens
cugucacaggcauauucccugca

SEQ ID NO: 1557435 - RNA, 15 nt, Homo sapiens
cugucauaugcagaa

SEQ ID NO: 1557436 - RNA, 13 nt, Homo sapiens
cugucaugguccu

SEQ ID NO: 1557437 - RNA, 19 nt, Homo sapiens
cugucauuccuaaaacacc

SEQ ID NO: 1557438 - RNA, 14 nt, Homo sapiens
cuguccaauaugaa

SEQ ID NO: 1557439 - RNA, 16 nt, Homo sapiens
cuguccaggagcuaau

SEQ ID NO: 1557440 - RNA, 23 nt, Homo sapiens
cugucccaccccuaccucuagua

SEQ ID NO: 1557441 - RNA, 21 nt, Homo sapiens
cuguccccaaaccuauggaag

SEQ ID NO: 1557442 - RNA, 21 nt, Homo sapiens
cuguccccuucucucaucucu

SEQ ID NO: 1557443 - RNA, 16 nt, Homo sapiens
cuguccguucacaugu

SEQ ID NO: 1557444 - RNA, 17 nt, Homo sapiens
cuguccuauuauauuca

SEQ ID NO: 1557445 - RNA, 18 nt, Homo sapiens
cuguccuggaggcacugg

SEQ ID NO: 1557446 - RNA, 22 nt, Homo sapiens
cugucgcaugagaacauuaaca

SEQ ID NO: 1557447 - RNA, 20 nt, Homo sapiens
cugucugaccuuccaaagac

SEQ ID NO: 1557448 - RNA, 23 nt, Homo sapiens
cugucugaguaagcccucaggag

SEQ ID NO: 1557449 - RNA, 23 nt, Homo sapiens
cugucugaguaguggccacuggg

SEQ ID NO: 1557450 - RNA, 17 nt, Homo sapiens
cugucuucuucauguca

SEQ ID NO: 1557451 - RNA, 18 nt, Homo sapiens
cugugaaauucacaguaa

SEQ ID NO: 1557452 - RNA, 16 nt, Homo sapiens
cugugaaccugggcac

SEQ ID NO: 1557453 - RNA, 14 nt, Homo sapiens
cugugaagccuuua

SEQ ID NO: 1557454 - RNA, 15 nt, Homo sapiens
cugugaauacuugaa

SEQ ID NO: 1557455 - RNA, 14 nt, Homo sapiens
cugugaaucugaaa

SEQ ID NO: 1557456 - RNA, 22 nt, Homo sapiens
cugugacauacauauuaucuca

SEQ ID NO: 1557457 - RNA, 16 nt, Homo sapiens
cugugacuagaaccau

SEQ ID NO: 1557458 - RNA, 17 nt, Homo sapiens
cugugauuagaucacau

SEQ ID NO: 1557459 - RNA, 16 nt, Homo sapiens
cugugauuuaugccaa

SEQ ID NO: 1557460 - RNA, 22 nt, Homo sapiens
cugugcauugguggcaucacag

SEQ ID NO: 1557461 - RNA, 20 nt, Homo sapiens
cugugccuuggugugcugua

SEQ ID NO: 1557462 - RNA, 21 nt, Homo sapiens
cugugccuuggugugcuguau

SEQ ID NO: 1557463 - RNA, 17 nt, Homo sapiens
cugugcggacagcccuu

SEQ ID NO: 1557464 - RNA, 20 nt, Homo sapiens
cugugcugggagaaauacuu

SEQ ID NO: 1557465 - RNA, 19 nt, Homo sapiens
cugugcuugggagccugug

SEQ ID NO: 1557466 - RNA, 13 nt, Homo sapiens
cugugcuuuucag

SEQ ID NO: 1557467 - RNA, 21 nt, Homo sapiens
cuucaagucccaucauagaaa

SEQ ID NO: 1557468 - RNA, 12 nt, Homo sapiens
cuucacaguacc

SEQ ID NO: 1557469 - RNA, 19 nt, Homo sapiens
cuucaccuacauuaucuca

SEQ ID NO: 1557470 - RNA, 19 nt, Homo sapiens
cuucacgauuaacugugaa

SEQ ID NO: 1557471 - RNA, 14 nt, Homo sapiens
cuucacgucccugg

SEQ ID NO: 1557472 - RNA, 20 nt, Homo sapiens
cuucacuagaguucuuugaa

SEQ ID NO: 1557473 - RNA, 18 nt, Homo sapiens
cuucacucugacaguauu

SEQ ID NO: 1557474 - RNA, 18 nt, Homo sapiens
cuucagaacugcccuugc

SEQ ID NO: 1557475 - RNA, 16 nt, Homo sapiens
cuucagauugaacuua

SEQ ID NO: 1557476 - RNA, 16 nt, Homo sapiens
cuucagauuugccuua

SEQ ID NO: 1557477 - RNA, 22 nt, Homo sapiens
cuucagcccucaccccugguuc

SEQ ID NO: 1557478 - RNA, 21 nt, Homo sapiens
cuucaggaaccucgaguacug

SEQ ID NO: 1557479 - RNA, 22 nt, Homo sapiens
cuucaggaaccucgaguacugu

SEQ ID NO: 1557480 - RNA, 23 nt, Homo sapiens
cuucaggccugcuagucacugga

SEQ ID NO: 1557481 - RNA, 14 nt, Homo sapiens
cuucagguggaaaa

SEQ ID NO: 1557482 - RNA, 16 nt, Homo sapiens
cuucagugggagaaaa

SEQ ID NO: 1557483 - RNA, 14 nt, Homo sapiens
cuucaguuaugauu

SEQ ID NO: 1557484 - RNA, 16 nt, Homo sapiens
cuucauccauagacac

SEQ ID NO: 1557485 - RNA, 16 nt, Homo sapiens
cuucaucugggacaaa

SEQ ID NO: 1557486 - RNA, 16 nt, Homo sapiens
cuucaugcccuucuga

SEQ ID NO: 1557487 - RNA, 15 nt, Homo sapiens
cuucaugggugguga

SEQ ID NO: 1557488 - RNA, 13 nt, Homo sapiens
cuucauuaccuca

SEQ ID NO: 1557489 - RNA, 14 nt, Homo sapiens
cuucauuaccucag

SEQ ID NO: 1557490 - RNA, 22 nt, Homo sapiens
cuucauucgagaugaguuucug

SEQ ID NO: 1557491 - RNA, 15 nt, Homo sapiens
cuucauucuuugcag

SEQ ID NO: 1557492 - RNA, 20 nt, Homo sapiens
cuucauuguuuggaccugca

SEQ ID NO: 1557493 - RNA, 14 nt, Homo sapiens
cuucauuucucugc

SEQ ID NO: 1557494 - RNA, 15 nt, Homo sapiens
cuucauuuuagucca

SEQ ID NO: 1557495 - RNA, 18 nt, Homo sapiens
cuucauuuuauauuuaaa

SEQ ID NO: 1557496 - RNA, 14 nt, Homo sapiens
cuuccaaacaggcu

SEQ ID NO: 1557497 - RNA, 20 nt, Homo sapiens
cuuccaacccgccggucuca

SEQ ID NO: 1557498 - RNA, 13 nt, Homo sapiens
cuuccacaaagaa

SEQ ID NO: 1557499 - RNA, 20 nt, Homo sapiens
cuuccagaugaggcccaaaa

SEQ ID NO: 1557500 - RNA, 17 nt, Homo sapiens
cuuccaguuugcuugau

SEQ ID NO: 1557501 - RNA, 18 nt, Homo sapiens
cuuccauacacagaggag

SEQ ID NO: 1557502 - RNA, 18 nt, Homo sapiens
cuuccaucuagucacaaa

SEQ ID NO: 1557503 - RNA, 19 nt, Homo sapiens
cuuccaugguacuguagca

SEQ ID NO: 1557504 - RNA, 21 nt, Homo sapiens
cuucccaaguagcugggauua

SEQ ID NO: 1557505 - RNA, 21 nt, Homo sapiens
cuucccacggcuccucgagau

SEQ ID NO: 1557506 - RNA, 19 nt, Homo sapiens
cuucccacucaccccggca

SEQ ID NO: 1557507 - RNA, 14 nt, Homo sapiens
cuucccauguccca

SEQ ID NO: 1557508 - RNA, 13 nt, Homo sapiens
cuuccccagagag

SEQ ID NO: 1557509 - RNA, 15 nt, Homo sapiens
cuuccccagguccuu

SEQ ID NO: 1557510 - RNA, 16 nt, Homo sapiens
cuuccccaucuucuaa

SEQ ID NO: 1557511 - RNA, 13 nt, Homo sapiens
cuuccccauggga

SEQ ID NO: 1557512 - RNA, 21 nt, Homo sapiens
cuucccucucugaugucccag

SEQ ID NO: 1557513 - RNA, 22 nt, Homo sapiens
cuuccgcugaggggucucggau

SEQ ID NO: 1557514 - RNA, 16 nt, Homo sapiens
cuuccgugagacacaa

SEQ ID NO: 1557515 - RNA, 20 nt, Homo sapiens
cuuccguggucagagugcca

SEQ ID NO: 1557516 - RNA, 12 nt, Homo sapiens
cuuccuacccug

SEQ ID NO: 1557517 - RNA, 16 nt, Homo sapiens
cuuccucaaauacaug

SEQ ID NO: 1557518 - RNA, 22 nt, Homo sapiens
cuuccucacagucccacugugc

SEQ ID NO: 1557519 - RNA, 16 nt, Homo sapiens
cuuccucccauuuccc

SEQ ID NO: 1557520 - RNA, 17 nt, Homo sapiens
cuuccucugauuuacau

SEQ ID NO: 1557521 - RNA, 17 nt, Homo sapiens
cuuccucuuccagcaac

SEQ ID NO: 1557522 - RNA, 15 nt, Homo sapiens
cuuccugacacuuua

SEQ ID NO: 1557523 - RNA, 20 nt, Homo sapiens
cuuccugaguggccagggaa

SEQ ID NO: 1557524 - RNA, 19 nt, Homo sapiens
cuuccuggaggugacacuu

SEQ ID NO: 1557525 - RNA, 13 nt, Homo sapiens
cuuccuggcacau

SEQ ID NO: 1557526 - RNA, 15 nt, Homo sapiens
cuuccuggcaucaua

SEQ ID NO: 1557527 - RNA, 21 nt, Homo sapiens
cuuccuggguccuguucccua

SEQ ID NO: 1557528 - RNA, 18 nt, Homo sapiens
cuuccugugcccugcaaa

SEQ ID NO: 1557529 - RNA, 22 nt, Homo sapiens
cuuccuguuucucguugucaca

SEQ ID NO: 1557530 - RNA, 22 nt, Homo sapiens
cuuccuucuuuaucuauagcaa

SEQ ID NO: 1557531 - RNA, 13 nt, Homo sapiens
cuucgaaaaucua

SEQ ID NO: 1557532 - RNA, 15 nt, Homo sapiens
cuucgaccacagcaa

SEQ ID NO: 1557533 - RNA, 15 nt, Homo sapiens
cuucgaggacaggaa

SEQ ID NO: 1557534 - RNA, 19 nt, Homo sapiens
cuucgaggcuuuacagugu

SEQ ID NO: 1557535 - RNA, 10 nt, Homo sapiens
cuucuaauau

SEQ ID NO: 1557536 - RNA, 17 nt, Homo sapiens
cuucuaccugccacuca

SEQ ID NO: 1557537 - RNA, 15 nt, Homo sapiens
cuucuagacagaguu

SEQ ID NO: 1557538 - RNA, 20 nt, Homo sapiens
cuucuaguucugccaggaga

SEQ ID NO: 1557539 - RNA, 19 nt, Homo sapiens
cuucuauacccacccagaa

SEQ ID NO: 1557540 - RNA, 14 nt, Homo sapiens
cuucuauguauuag

SEQ ID NO: 1557541 - RNA, 14 nt, Homo sapiens
cuucuauuaaucaa

SEQ ID NO: 1557542 - RNA, 18 nt, Homo sapiens
cuucucaccagcugcaaa

SEQ ID NO: 1557543 - RNA, 19 nt, Homo sapiens
cuucucagauuucugagga

SEQ ID NO: 1557544 - RNA, 12 nt, Homo sapiens
cuucucagucuu

SEQ ID NO: 1557545 - RNA, 17 nt, Homo sapiens
cuucucauaggugucca

SEQ ID NO: 1557546 - RNA, 21 nt, Homo sapiens
cuucuccagggaauucuuaca

SEQ ID NO: 1557547 - RNA, 17 nt, Homo sapiens
cuucuccgccagccucc

SEQ ID NO: 1557548 - RNA, 15 nt, Homo sapiens
cuucuccugccuaau

SEQ ID NO: 1557549 - RNA, 14 nt, Homo sapiens
cuucucuccagcug

SEQ ID NO: 1557550 - RNA, 23 nt, Homo sapiens
cuucucugcuaucuagaucugaa

SEQ ID NO: 1557551 - RNA, 13 nt, Homo sapiens
cuucucugcucca

SEQ ID NO: 1557552 - RNA, 18 nt, Homo sapiens
cuucucuucacagucaca

SEQ ID NO: 1557553 - RNA, 14 nt, Homo sapiens
cuucucuugacagu

SEQ ID NO: 1557554 - RNA, 13 nt, Homo sapiens
cuucugcuucuca

SEQ ID NO: 1557555 - RNA, 21 nt, Homo sapiens
cuucuguaguguauuaaucuc

SEQ ID NO: 1557556 - RNA, 21 nt, Homo sapiens
cuucuuagcacuguugagagg

SEQ ID NO: 1557557 - RNA, 16 nt, Homo sapiens
cuucuucaccauuugg

SEQ ID NO: 1557558 - RNA, 23 nt, Homo sapiens
cuucuucacuuacccauuagcca

SEQ ID NO: 1557559 - RNA, 19 nt, Homo sapiens
cuucuuggucucaguguca

SEQ ID NO: 1557560 - RNA, 19 nt, Homo sapiens
cuucuuguucugagauuca

SEQ ID NO: 1557561 - RNA, 14 nt, Homo sapiens
cuugaaacauuaua

SEQ ID NO: 1557562 - RNA, 21 nt, Homo sapiens
cuugaaaggaagagcuaauaa

SEQ ID NO: 1557563 - RNA, 13 nt, Homo sapiens
cuugaaaguuuuc

SEQ ID NO: 1557564 - RNA, 18 nt, Homo sapiens
cuugaaaguuuucuaaac

SEQ ID NO: 1557565 - RNA, 20 nt, Homo sapiens
cuugaacacaguauuuuccc

SEQ ID NO: 1557566 - RNA, 21 nt, Homo sapiens
cuugaacacaguauuuuccca

SEQ ID NO: 1557567 - RNA, 18 nt, Homo sapiens
cuugaagaauaaauucua

SEQ ID NO: 1557568 - RNA, 21 nt, Homo sapiens
cuugaagacaucgauauacau

SEQ ID NO: 1557569 - RNA, 15 nt, Homo sapiens
ccucagacccagcgg

SEQ ID NO: 1557570 - RNA, 24 nt, Homo sapiens
ccucagacccagcgguccaaugcc

SEQ ID NO: 1557571 - RNA, 22 nt, Homo sapiens
ccucagacccaggaguccagcc

SEQ ID NO: 1557572 - RNA, 17 nt, Homo sapiens
ccucagacguugccuga

SEQ ID NO: 1557573 - RNA, 14 nt, Homo sapiens
ccucagaugaucuc

SEQ ID NO: 1557574 - RNA, 13 nt, Homo sapiens
ccucagauuccac

SEQ ID NO: 1557575 - RNA, 13 nt, Homo sapiens
ccucagccagccu

SEQ ID NO: 1557576 - RNA, 11 nt, Homo sapiens
ccucagcuaug

SEQ ID NO: 1557577 - RNA, 17 nt, Homo sapiens
ccucagcuucuucacag

SEQ ID NO: 1557578 - RNA, 18 nt, Homo sapiens
ccucagggagcagggaag

SEQ ID NO: 1557579 - RNA, 16 nt, Homo sapiens
auauugcuuccugugu

SEQ ID NO: 1557580 - RNA, 19 nt, Homo sapiens
auauuggcauagaaaaaag

SEQ ID NO: 1557581 - RNA, 22 nt, Homo sapiens
auauuggcauagaaaaaaguag

SEQ ID NO: 1557582 - RNA, 22 nt, Homo sapiens
auauugucaccucagcacugug

SEQ ID NO: 1557583 - RNA, 16 nt, Homo sapiens
auauuuaagagauuaa

SEQ ID NO: 1557584 - RNA, 16 nt, Homo sapiens
auauuucaagugccua

SEQ ID NO: 1557585 - RNA, 17 nt, Homo sapiens
auauuucugaaaaccua

SEQ ID NO: 1557586 - RNA, 20 nt, Homo sapiens
auauuugaaauaguauacau

SEQ ID NO: 1557587 - RNA, 18 nt, Homo sapiens
auauuuucugcaauccaa

SEQ ID NO: 1557588 - RNA, 14 nt, Homo sapiens
auauuuucugugcc

SEQ ID NO: 1557589 - RNA, 20 nt, Homo sapiens
auauuuuucaucaaacauug

SEQ ID NO: 1557590 - RNA, 16 nt, Homo sapiens
auauuuuuccacuuaa

SEQ ID NO: 1557591 - RNA, 16 nt, Homo sapiens
aucaaaaacaaccuga

SEQ ID NO: 1557592 - RNA, 12 nt, Homo sapiens
aucaaaacagag

SEQ ID NO: 1557593 - RNA, 18 nt, Homo sapiens
aucaaaaggaggaauuuc

SEQ ID NO: 1557594 - RNA, 23 nt, Homo sapiens
aucaaacauuggauuuuuccuua

SEQ ID NO: 1557595 - RNA, 21 nt, Homo sapiens
aucaaacuagcugucacuuuu

SEQ ID NO: 1557596 - RNA, 16 nt, Homo sapiens
aucaaagaacugaaag

SEQ ID NO: 1557597 - RNA, 14 nt, Homo sapiens
aucaaaugauuuca

SEQ ID NO: 1557598 - RNA, 13 nt, Homo sapiens
aucaaauucaaua

SEQ ID NO: 1557599 - RNA, 13 nt, Homo sapiens
aucaacaugacug

SEQ ID NO: 1557600 - RNA, 14 nt, Homo sapiens
aucaacauuccagg

SEQ ID NO: 1557601 - RNA, 15 nt, Homo sapiens
aucaacuaaugauuu

SEQ ID NO: 1557602 - RNA, 13 nt, Homo sapiens
aucaacucugaaa

SEQ ID NO: 1557603 - RNA, 14 nt, Homo sapiens
aucaagagggauaa

SEQ ID NO: 1557604 - RNA, 18 nt, Homo sapiens
aucaagauauauguguau

SEQ ID NO: 1557605 - RNA, 12 nt, Homo sapiens
aucaagcacuuc

SEQ ID NO: 1557606 - RNA, 13 nt, Homo sapiens
aucaaggaugcuc

SEQ ID NO: 1557607 - RNA, 21 nt, Homo sapiens
aucaaggcaggagaugcagca

SEQ ID NO: 1557608 - RNA, 20 nt, Homo sapiens
aucaaguauuuuugacauuu

SEQ ID NO: 1557609 - RNA, 20 nt, Homo sapiens
aucaaguuguugacugugau

SEQ ID NO: 1557610 - RNA, 23 nt, Homo sapiens
aucaauaguugaauuagugagua

SEQ ID NO: 1557611 - RNA, 20 nt, Homo sapiens
aucaauguuuguccuguaua

SEQ ID NO: 1557612 - RNA, 21 nt, Homo sapiens
aucacacacauugcugugaac

SEQ ID NO: 1557613 - RNA, 17 nt, Homo sapiens
aucacaccugcccuaaa

SEQ ID NO: 1557614 - RNA, 17 nt, Homo sapiens
aucacagaccacaggaa

SEQ ID NO: 1557615 - RNA, 15 nt, Homo sapiens
aucacagucuacuga

SEQ ID NO: 1557616 - RNA, 18 nt, Homo sapiens
aucacauaaagaaauuca

SEQ ID NO: 1557617 - RNA, 19 nt, Homo sapiens
aucacauguuuucucugga

SEQ ID NO: 1557618 - RNA, 14 nt, Homo sapiens
aucaccaaggcuga

SEQ ID NO: 1557619 - RNA, 20 nt, Homo sapiens
aucaccgugggcucccugac

SEQ ID NO: 1557620 - RNA, 21 nt, Homo sapiens
aucacgacagauuuaaccucu

SEQ ID NO: 1557621 - RNA, 15 nt, Homo sapiens
aucacuccucuguca

SEQ ID NO: 1557622 - RNA, 16 nt, Homo sapiens
aucacugccaucacau

SEQ ID NO: 1557623 - RNA, 19 nt, Homo sapiens
aucacugccaucacaucac

SEQ ID NO: 1557624 - RNA, 16 nt, Homo sapiens
aucacuguaaagacaa

SEQ ID NO: 1557625 - RNA, 20 nt, Homo sapiens
aucacuuaaaggcacaaaua

SEQ ID NO: 1557626 - RNA, 16 nt, Homo sapiens
aucagaacuguuggca

SEQ ID NO: 1557627 - RNA, 17 nt, Homo sapiens
aucagaacuucaggugu

SEQ ID NO: 1557628 - RNA, 18 nt, Homo sapiens
aucagaauuuguguugaa

SEQ ID NO: 1557629 - RNA, 13 nt, Homo sapiens
aucagaccaugaa

SEQ ID NO: 1557630 - RNA, 20 nt, Homo sapiens
aucagacccaacccaugaag

SEQ ID NO: 1557631 - RNA, 14 nt, Homo sapiens
aucagagaaggaac

SEQ ID NO: 1557632 - RNA, 20 nt, Homo sapiens
aucagagaaggaacauaccc

SEQ ID NO: 1557633 - RNA, 21 nt, Homo sapiens
aucagauaaugccaccaaagg

SEQ ID NO: 1557634 - RNA, 18 nt, Homo sapiens
aucagaugcuuuccugca

SEQ ID NO: 1557635 - RNA, 14 nt, Homo sapiens
aucagcacugccag

SEQ ID NO: 1557636 - RNA, 15 nt, Homo sapiens
aucagcaucacccgg

SEQ ID NO: 1557637 - RNA, 22 nt, Homo sapiens
aucagcaucacccgggaacuuu

SEQ ID NO: 1557638 - RNA, 20 nt, Homo sapiens
aucagccacaccuuuuccag

SEQ ID NO: 1557639 - RNA, 21 nt, Homo sapiens
aucagccauaagaaagcacua

SEQ ID NO: 1557640 - RNA, 22 nt, Homo sapiens
aucagccauaagaaagcacuau

SEQ ID NO: 1557641 - RNA, 13 nt, Homo sapiens
aucagccuucaag

SEQ ID NO: 1557642 - RNA, 21 nt, Homo sapiens
aucaggacucugacgucucuu

SEQ ID NO: 1557643 - RNA, 21 nt, Homo sapiens
aucagggaaaaggaguaggga

SEQ ID NO: 1557644 - RNA, 22 nt, Homo sapiens
aucagggccaccauugucucaa

SEQ ID NO: 1557645 - RNA, 21 nt, Homo sapiens
aucaggugcaggucagacucu

SEQ ID NO: 1557646 - RNA, 18 nt, Homo sapiens
aucaggugugcucagggg

SEQ ID NO: 1557647 - RNA, 18 nt, Homo sapiens
aucaguaugucacucugg

SEQ ID NO: 1557648 - RNA, 15 nt, Homo sapiens
aucaguauuuucaca

SEQ ID NO: 1557649 - RNA, 23 nt, Homo sapiens
aucagucaacaacuuacacuuau

SEQ ID NO: 1557650 - RNA, 23 nt, Homo sapiens
aucagucauuucuucauguacag

SEQ ID NO: 1557651 - RNA, 18 nt, Homo sapiens
aucagugacucacuucca

SEQ ID NO: 1557652 - RNA, 12 nt, Homo sapiens
aucaguugguuu

SEQ ID NO: 1557653 - RNA, 13 nt, Homo sapiens
aucauaaagucag

SEQ ID NO: 1557654 - RNA, 18 nt, Homo sapiens
aucauaacuauacuugau

SEQ ID NO: 1557655 - RNA, 17 nt, Homo sapiens
aucauaauucagcacuu

SEQ ID NO: 1557656 - RNA, 18 nt, Homo sapiens
aucauaauucagcacuua

SEQ ID NO: 1557657 - RNA, 22 nt, Homo sapiens
aucauaauucagcacuuaacua

SEQ ID NO: 1557658 - RNA, 20 nt, Homo sapiens
aucauacaccagaagacaaa

SEQ ID NO: 1557659 - RNA, 20 nt, Homo sapiens
aucauacuaaacuucaccua

SEQ ID NO: 1557660 - RNA, 16 nt, Homo sapiens
aucauagacgagacag

SEQ ID NO: 1557661 - RNA, 13 nt, Homo sapiens
aucauagggauaa

SEQ ID NO: 1557662 - RNA, 16 nt, Homo sapiens
aucauauucauaugca

SEQ ID NO: 1557663 - RNA, 21 nt, Homo sapiens
aucaucaacaagauuuccuug

SEQ ID NO: 1557664 - RNA, 23 nt, Homo sapiens
aucaucaacuaccauucuauucc

SEQ ID NO: 1557665 - RNA, 16 nt, Homo sapiens
aucaucaucauucuca

SEQ ID NO: 1557666 - RNA, 18 nt, Homo sapiens
aucaucuccugccuuccu

SEQ ID NO: 1557667 - RNA, 14 nt, Homo sapiens
aucaucuuugccaa

SEQ ID NO: 1557668 - RNA, 17 nt, Homo sapiens
aucaucuuugccaagua

SEQ ID NO: 1557669 - RNA, 17 nt, Homo sapiens
aucaugaagcacaucaa

SEQ ID NO: 1557670 - RNA, 14 nt, Homo sapiens
aucaugauauagcu

SEQ ID NO: 1557671 - RNA, 16 nt, Homo sapiens
aucaugccauguugga

SEQ ID NO: 1557672 - RNA, 20 nt, Homo sapiens
aucauggaaauguauuuuag

SEQ ID NO: 1557673 - RNA, 23 nt, Homo sapiens
aucauggggaguaauaggaccag

SEQ ID NO: 1557674 - RNA, 15 nt, Homo sapiens
aucauguaugcaucc

SEQ ID NO: 1557675 - RNA, 23 nt, Homo sapiens
aucaugucaggccaucaaggagu

SEQ ID NO: 1557676 - RNA, 20 nt, Homo sapiens
aucauguggcccaacucucc

SEQ ID NO: 1557677 - RNA, 16 nt, Homo sapiens
aucauucaacucucca

SEQ ID NO: 1557678 - RNA, 16 nt, Homo sapiens
aucauugucagccuug

SEQ ID NO: 1557679 - RNA, 19 nt, Homo sapiens
auccaaaaagcucugaaaa

SEQ ID NO: 1557680 - RNA, 23 nt, Homo sapiens
auccaaaaauguguaagaacaac

SEQ ID NO: 1557681 - RNA, 17 nt, Homo sapiens
auccaagaagcaugcag

SEQ ID NO: 1557682 - RNA, 23 nt, Homo sapiens
auccaagcgaggucaacagagaa

SEQ ID NO: 1557683 - RNA, 19 nt, Homo sapiens
auccaauccacuaacacuu

SEQ ID NO: 1557684 - RNA, 17 nt, Homo sapiens
auccaaugcacugaugu

SEQ ID NO: 1557685 - RNA, 15 nt, Homo sapiens
auccacaacuuguac

SEQ ID NO: 1557686 - RNA, 16 nt, Homo sapiens
auccacaauagcugac

SEQ ID NO: 1557687 - RNA, 12 nt, Homo sapiens
auccacacugag

SEQ ID NO: 1557688 - RNA, 13 nt, Homo sapiens
auccacacugaga

SEQ ID NO: 1557689 - RNA, 14 nt, Homo sapiens
auccacaugggagc

SEQ ID NO: 1557690 - RNA, 23 nt, Homo sapiens
auccacccgggggagcccaguga

SEQ ID NO: 1557691 - RNA, 18 nt, Homo sapiens
auccagaugugugcaaug

SEQ ID NO: 1557692 - RNA, 17 nt, Homo sapiens
auccagcagcagcacuu

SEQ ID NO: 1557693 - RNA, 19 nt, Homo sapiens
auccagccucccacaagaa

SEQ ID NO: 1557694 - RNA, 16 nt, Homo sapiens
auccagcuuccuucug

SEQ ID NO: 1557695 - RNA, 17 nt, Homo sapiens
auccaggcaccaggacu

SEQ ID NO: 1557696 - RNA, 17 nt, Homo sapiens
auccaggcuguucucag

SEQ ID NO: 1557697 - RNA, 15 nt, Homo sapiens
acuugccacauggug

SEQ ID NO: 1557698 - RNA, 20 nt, Homo sapiens
acuugccucuuuuaccugcu

SEQ ID NO: 1557699 - RNA, 16 nt, Homo sapiens
acuugccugugcuaca

SEQ ID NO: 1557700 - RNA, 23 nt, Homo sapiens
acuuggaaccuuggaaaugacca

SEQ ID NO: 1557701 - RNA, 15 nt, Homo sapiens
acuuggaacuaggcu

SEQ ID NO: 1557702 - RNA, 15 nt, Homo sapiens
acuugguucugaaua

SEQ ID NO: 1557703 - RNA, 21 nt, Homo sapiens
acuugguuugugaauccaucu

SEQ ID NO: 1557704 - RNA, 22 nt, Homo sapiens
acuugguuuguuauaucaggga

SEQ ID NO: 1557705 - RNA, 14 nt, Homo sapiens
acuugucauaucac

SEQ ID NO: 1557706 - RNA, 19 nt, Homo sapiens
acuugucccgggacaccua

SEQ ID NO: 1557707 - RNA, 16 nt, Homo sapiens
acuugucucauuuuaa

SEQ ID NO: 1557708 - RNA, 14 nt, Homo sapiens
acuugucucuucau

SEQ ID NO: 1557709 - RNA, 19 nt, Homo sapiens
acuuguguuauauagccaa

SEQ ID NO: 1557710 - RNA, 14 nt, Homo sapiens
agugaacacucagu

SEQ ID NO: 1557711 - RNA, 17 nt, Homo sapiens
agugaacacucaguggc

SEQ ID NO: 1557712 - RNA, 23 nt, Homo sapiens
agugaauacauuaacggugcuaa

SEQ ID NO: 1557713 - RNA, 24 nt, Homo sapiens
agugacuucuggagaaagcucaug

SEQ ID NO: 1557714 - RNA, 17 nt, Homo sapiens
agugagaaaacugugac

SEQ ID NO: 1557715 - RNA, 18 nt, Homo sapiens
agugagacccugucucaa

SEQ ID NO: 1557716 - RNA, 17 nt, Homo sapiens
agugagacuccaucuca

SEQ ID NO: 1557717 - RNA, 22 nt, Homo sapiens
agugagccccuccccagccagc

SEQ ID NO: 1557718 - RNA, 17 nt, Homo sapiens
agugagccgagaucaug

SEQ ID NO: 1557719 - RNA, 19 nt, Homo sapiens
agugaggcucagauuaaau

SEQ ID NO: 1557720 - RNA, 19 nt, Homo sapiens
agugagucgagauugcacu

SEQ ID NO: 1557721 - RNA, 18 nt, Homo sapiens
agugaucuugagaaccuu

SEQ ID NO: 1557722 - RNA, 15 nt, Homo sapiens
agugauggaguuccu

SEQ ID NO: 1557723 - RNA, 15 nt, Homo sapiens
agugauucccaacuc

SEQ ID NO: 1557724 - RNA, 16 nt, Homo sapiens
agugauucccugcaca

SEQ ID NO: 1557725 - RNA, 16 nt, Homo sapiens
agugauuggcucugug

SEQ ID NO: 1557726 - RNA, 21 nt, Homo sapiens
agugcaauggcgcgaucucag

SEQ ID NO: 1557727 - RNA, 21 nt, Homo sapiens
agugcagagaaagaaagggaa

SEQ ID NO: 1557728 - RNA, 23 nt, Homo sapiens
agugcagcugcugugccugaugu

SEQ ID NO: 1557729 - RNA, 20 nt, Homo sapiens
agugcagcugugaccccggg

SEQ ID NO: 1557730 - RNA, 15 nt, Homo sapiens
agugcagggcaaaau

SEQ ID NO: 1557731 - RNA, 12 nt, Homo sapiens
agugcagggcug

SEQ ID NO: 1557732 - RNA, 17 nt, Homo sapiens
agugcaguccauuuccu

SEQ ID NO: 1557733 - RNA, 19 nt, Homo sapiens
agugcaguggcaugaucau

SEQ ID NO: 1557734 - RNA, 18 nt, Homo sapiens
agugcaguggugccauca

SEQ ID NO: 1557735 - RNA, 20 nt, Homo sapiens
agugcaguggugccaucacc

SEQ ID NO: 1557736 - RNA, 21 nt, Homo sapiens
agugccacuuaauguauguua

SEQ ID NO: 1557737 - RNA, 13 nt, Homo sapiens
agugccagguggc

SEQ ID NO: 1557738 - RNA, 17 nt, Homo sapiens
agugccgaggacaugca

SEQ ID NO: 1557739 - RNA, 16 nt, Homo sapiens
agugccuagacuguua

SEQ ID NO: 1557740 - RNA, 13 nt, Homo sapiens
agugccugcugaa

SEQ ID NO: 1557741 - RNA, 14 nt, Homo sapiens
agugccuucucuau

SEQ ID NO: 1557742 - RNA, 17 nt, Homo sapiens
agugcucucggcccaac

SEQ ID NO: 1557743 - RNA, 18 nt, Homo sapiens
agugcucuguaaaacaca

SEQ ID NO: 1557744 - RNA, 15 nt, Homo sapiens
agugcuguccaugcu

SEQ ID NO: 1557745 - RNA, 20 nt, Homo sapiens
agugcuguccaugcuucuca

SEQ ID NO: 1557746 - RNA, 21 nt, Homo sapiens
agugcuucaacgaugugacug

SEQ ID NO: 1557747 - RNA, 15 nt, Homo sapiens
agugcuugggcucca

SEQ ID NO: 1557748 - RNA, 19 nt, Homo sapiens
agugcuuuucagugauacu

SEQ ID NO: 1557749 - RNA, 14 nt, Homo sapiens
aguggaaaaacaca

SEQ ID NO: 1557750 - RNA, 23 nt, Homo sapiens
aguggaaugacugaaagauggga

SEQ ID NO: 1557751 - RNA, 18 nt, Homo sapiens
aguggacgugguaugaaa

SEQ ID NO: 1557752 - RNA, 14 nt, Homo sapiens
aguggccuggccag

SEQ ID NO: 1557753 - RNA, 19 nt, Homo sapiens
aguggccugugcuuuucag

SEQ ID NO: 1557754 - RNA, 20 nt, Homo sapiens
aguggcgcgaucucggcuca

SEQ ID NO: 1557755 - RNA, 23 nt, Homo sapiens
aguggcucacgccuguaauccca

SEQ ID NO: 1557756 - RNA, 20 nt, Homo sapiens
aguggcugauucugaacaau

SEQ ID NO: 1557757 - RNA, 18 nt, Homo sapiens
agugggccauuaaaaacu

SEQ ID NO: 1557758 - RNA, 23 nt, Homo sapiens
agugguacuaagcacagaaacuc

SEQ ID NO: 1557759 - RNA, 13 nt, Homo sapiens
agugguacuugau

SEQ ID NO: 1557760 - RNA, 13 nt, Homo sapiens
aguggugccauca

SEQ ID NO: 1557761 - RNA, 22 nt, Homo sapiens
aguggugccaucaccacggcuc

SEQ ID NO: 1557762 - RNA, 15 nt, Homo sapiens
aguggugugaucucg

SEQ ID NO: 1557763 - RNA, 21 nt, Homo sapiens
agugguuguccccguaccacc

SEQ ID NO: 1557764 - RNA, 21 nt, Homo sapiens
aguguaagauuuuguuugcau

SEQ ID NO: 1557765 - RNA, 19 nt, Homo sapiens
aguguccuuuccagagcaa

SEQ ID NO: 1557766 - RNA, 21 nt, Homo sapiens
agugucuguuccuggcaucua

SEQ ID NO: 1557767 - RNA, 15 nt, Homo sapiens
aguguggcuaaccaa

SEQ ID NO: 1557768 - RNA, 23 nt, Homo sapiens
aguguguaaaauuaauguaauaa

SEQ ID NO: 1557769 - RNA, 18 nt, Homo sapiens
aguguucacaaacuguga

SEQ ID NO: 1557770 - RNA, 18 nt, Homo sapiens
aguguucauugaugcugc

SEQ ID NO: 1557771 - RNA, 17 nt, Homo sapiens
aguguucugauuccuuc

SEQ ID NO: 1557772 - RNA, 12 nt, Homo sapiens
aguuaagacaug

SEQ ID NO: 1557773 - RNA, 23 nt, Homo sapiens
aguuaagcaaauuucauuucaca

SEQ ID NO: 1557774 - RNA, 13 nt, Homo sapiens
aguuaauccacug

SEQ ID NO: 1557775 - RNA, 18 nt, Homo sapiens
aguuacagccauaugcag

SEQ ID NO: 1557776 - RNA, 22 nt, Homo sapiens
aguuaccuuauaguuacugugu

SEQ ID NO: 1557777 - RNA, 17 nt, Homo sapiens
aguuacuggaugcagca

SEQ ID NO: 1557778 - RNA, 24 nt, Homo sapiens
aguuacuuuugacccaugugcaag

SEQ ID NO: 1557779 - RNA, 17 nt, Homo sapiens
aguuagaaacaccagcc

SEQ ID NO: 1557780 - RNA, 12 nt, Homo sapiens
aguuagcaucca

SEQ ID NO: 1557781 - RNA, 18 nt, Homo sapiens
aguucauaacagugccau

SEQ ID NO: 1557782 - RNA, 14 nt, Homo sapiens
aguucaucaccauu

SEQ ID NO: 1557783 - RNA, 18 nt, Homo sapiens
aguuccaccaugagcuca

SEQ ID NO: 1557784 - RNA, 15 nt, Homo sapiens
aguucccaggugaua

SEQ ID NO: 1557785 - RNA, 13 nt, Homo sapiens
aguucccuuggcc

SEQ ID NO: 1557786 - RNA, 20 nt, Homo sapiens
aguucccuuuuuauuugcag

SEQ ID NO: 1557787 - RNA, 14 nt, Homo sapiens
aguuccucuggguu

SEQ ID NO: 1557788 - RNA, 15 nt, Homo sapiens
aguucguauacuucg

SEQ ID NO: 1557789 - RNA, 16 nt, Homo sapiens
aguucuuguucuucag

SEQ ID NO: 1557790 - RNA, 14 nt, Homo sapiens
aguugauacuugaa

SEQ ID NO: 1557791 - RNA, 16 nt, Homo sapiens
aguugcaauguuuuag

SEQ ID NO: 1557792 - RNA, 14 nt, Homo sapiens
aguugcacauuaau

SEQ ID NO: 1557793 - RNA, 14 nt, Homo sapiens
aguugccacaucac

SEQ ID NO: 1557794 - RNA, 16 nt, Homo sapiens
aguugcuuuuauugca

SEQ ID NO: 1557795 - RNA, 16 nt, Homo sapiens
aguuggccaauuucac

SEQ ID NO: 1557796 - RNA, 18 nt, Homo sapiens
aguuggccaugaugucuu

SEQ ID NO: 1557797 - RNA, 12 nt, Homo sapiens
aguuggugcugc

SEQ ID NO: 1557798 - RNA, 14 nt, Homo sapiens
aguuggugcugcuu

SEQ ID NO: 1557799 - RNA, 14 nt, Homo sapiens
aguuguacaugaua

SEQ ID NO: 1557800 - RNA, 17 nt, Homo sapiens
aguuguauuucaaauau

SEQ ID NO: 1557801 - RNA, 14 nt, Homo sapiens
aguugucugucuga

SEQ ID NO: 1557802 - RNA, 15 nt, Homo sapiens
aguuguugacuguga

SEQ ID NO: 1557803 - RNA, 17 nt, Homo sapiens
aguuuaauuaugccuuu

SEQ ID NO: 1557804 - RNA, 20 nt, Homo sapiens
aguuuauaagacuggaauau

SEQ ID NO: 1557805 - RNA, 16 nt, Homo sapiens
aguuuaucaugaagcc

SEQ ID NO: 1557806 - RNA, 21 nt, Homo sapiens
aguuucauguacaagaugaag

SEQ ID NO: 1557807 - RNA, 15 nt, Homo sapiens
aguuucuggugccau

SEQ ID NO: 1557808 - RNA, 14 nt, Homo sapiens
aguuugacuucuuu

SEQ ID NO: 1557809 - RNA, 16 nt, Homo sapiens
aguuugcuugauauau

SEQ ID NO: 1557810 - RNA, 13 nt, Homo sapiens
aguuugggggcag

SEQ ID NO: 1557811 - RNA, 14 nt, Homo sapiens
aguuugggggcaga

SEQ ID NO: 1557812 - RNA, 16 nt, Homo sapiens
aguuuguauauauuau

SEQ ID NO: 1557813 - RNA, 20 nt, Homo sapiens
aguuuguuuuagaaccagcc

SEQ ID NO: 1557814 - RNA, 14 nt, Homo sapiens
aguuuuaacuguaa

SEQ ID NO: 1557815 - RNA, 15 nt, Homo sapiens
aguuuuacauuuuaa

SEQ ID NO: 1557816 - RNA, 21 nt, Homo sapiens
aguuuuguacauagcaaauaa

SEQ ID NO: 1557817 - RNA, 16 nt, Homo sapiens
aguuuuuaauuugaug

SEQ ID NO: 1557818 - RNA, 13 nt, Homo sapiens
aguuuuucagucu

SEQ ID NO: 1557819 - RNA, 21 nt, Homo sapiens
aguuuuucccucagugaaggc

SEQ ID NO: 1557820 - RNA, 17 nt, Homo sapiens
aguuuuuuuuuuuccag

SEQ ID NO: 1557821 - RNA, 17 nt, Homo sapiens
auaaaaaacacuaaaca

SEQ ID NO: 1557822 - RNA, 13 nt, Homo sapiens
auaaaaaacaguc

SEQ ID NO: 1557823 - RNA, 15 nt, Homo sapiens
auaaaaaagucucua

SEQ ID NO: 1557824 - RNA, 14 nt, Homo sapiens
auaaaaaaucugaa

SEQ ID NO: 1557825 - RNA, 20 nt, Homo sapiens
auaaaaauaaaucaguucau

SEQ ID NO: 1557826 - RNA, 20 nt, Homo sapiens
auaaaaaucauucuacugaa

SEQ ID NO: 1557827 - RNA, 18 nt, Homo sapiens
auaaaaauugacaaugau

SEQ ID NO: 1557828 - RNA, 19 nt, Homo sapiens
acugcugguugacaucaga

SEQ ID NO: 1557829 - RNA, 17 nt, Homo sapiens
acugcuucucuuugugc

SEQ ID NO: 1557830 - RNA, 14 nt, Homo sapiens
acugcuugaggaaa

SEQ ID NO: 1557831 - RNA, 18 nt, Homo sapiens
acugcuuucuguuccaaa

SEQ ID NO: 1557832 - RNA, 13 nt, Homo sapiens
acuggaaaacugc

SEQ ID NO: 1557833 - RNA, 21 nt, Homo sapiens
acuggaaaacugcuacuaucu

SEQ ID NO: 1557834 - RNA, 17 nt, Homo sapiens
acuggaaagagugccag

SEQ ID NO: 1557835 - RNA, 17 nt, Homo sapiens
acuggacccccuggaag

SEQ ID NO: 1557836 - RNA, 15 nt, Homo sapiens
acuggaguuccuuau

SEQ ID NO: 1557837 - RNA, 23 nt, Homo sapiens
acuggauagaaccaccauaguga

SEQ ID NO: 1557838 - RNA, 16 nt, Homo sapiens
acuggauagugggggu

SEQ ID NO: 1557839 - RNA, 16 nt, Homo sapiens
acuggaugucaaacag

SEQ ID NO: 1557840 - RNA, 17 nt, Homo sapiens
acuggauucauucucau

SEQ ID NO: 1557841 - RNA, 17 nt, Homo sapiens
acuggcguucaccuccc

SEQ ID NO: 1557842 - RNA, 17 nt, Homo sapiens
acuggcuuuugccugua

SEQ ID NO: 1557843 - RNA, 22 nt, Homo sapiens
acugggaaccuagcuacacuga

SEQ ID NO: 1557844 - RNA, 21 nt, Homo sapiens
acugggaugccugucuugagu

SEQ ID NO: 1557845 - RNA, 19 nt, Homo sapiens
acugggcgcaguuggucuu

SEQ ID NO: 1557846 - RNA, 18 nt, Homo sapiens
acuggggagucuuugugg

SEQ ID NO: 1557847 - RNA, 20 nt, Homo sapiens
acuggggagucuuuguggau

SEQ ID NO: 1557848 - RNA, 13 nt, Homo sapiens
acuggggccucag

SEQ ID NO: 1557849 - RNA, 16 nt, Homo sapiens
acugguauguguggau

SEQ ID NO: 1557850 - RNA, 12 nt, Homo sapiens
acugguccaaaa

SEQ ID NO: 1557851 - RNA, 11 nt, Homo sapiens
acuggugcucu

SEQ ID NO: 1557852 - RNA, 15 nt, Homo sapiens
acugguuuucugcca

SEQ ID NO: 1557853 - RNA, 13 nt, Homo sapiens
acuguaaagacaa

SEQ ID NO: 1557854 - RNA, 18 nt, Homo sapiens
acuguaaggugcuugcuc

SEQ ID NO: 1557855 - RNA, 23 nt, Homo sapiens
acuguagaaaugaugauguggaa

SEQ ID NO: 1557856 - RNA, 12 nt, Homo sapiens
acuguagccuca

SEQ ID NO: 1557857 - RNA, 18 nt, Homo sapiens
acuguauauuuguaugau

SEQ ID NO: 1557858 - RNA, 22 nt, Homo sapiens
acuguaugugugugugugaacc

SEQ ID NO: 1557859 - RNA, 19 nt, Homo sapiens
acuguauguuuuuacugaa

SEQ ID NO: 1557860 - RNA, 22 nt, Homo sapiens
acuguauugcuguaugguauau

SEQ ID NO: 1557861 - RNA, 19 nt, Homo sapiens
acuguauuuuacaagucaa

SEQ ID NO: 1557862 - RNA, 23 nt, Homo sapiens
acugucaagaagaggaaagggag

SEQ ID NO: 1557863 - RNA, 20 nt, Homo sapiens
acugucaguguacacgucug

SEQ ID NO: 1557864 - RNA, 14 nt, Homo sapiens
acugucaucuucaa

SEQ ID NO: 1557865 - RNA, 16 nt, Homo sapiens
acuguccaauaugaaa

SEQ ID NO: 1557866 - RNA, 20 nt, Homo sapiens
acugucuauuuaagugcaau

SEQ ID NO: 1557867 - RNA, 21 nt, Homo sapiens
acugucuucuucaugucauca

SEQ ID NO: 1557868 - RNA, 23 nt, Homo sapiens
acugugaaccaacccccaucucc

SEQ ID NO: 1557869 - RNA, 17 nt, Homo sapiens
acugugauggggucauc

SEQ ID NO: 1557870 - RNA, 13 nt, Homo sapiens
acugugggacuca

SEQ ID NO: 1557871 - RNA, 18 nt, Homo sapiens
acugugguauggcuaaua

SEQ ID NO: 1557872 - RNA, 16 nt, Homo sapiens
acuguguaacuuucuc

SEQ ID NO: 1557873 - RNA, 19 nt, Homo sapiens
acugugucuggcguucuca

SEQ ID NO: 1557874 - RNA, 18 nt, Homo sapiens
acugugugugaaucugcu

SEQ ID NO: 1557875 - RNA, 20 nt, Homo sapiens
acuguuaauaguacuauuaa

SEQ ID NO: 1557876 - RNA, 23 nt, Homo sapiens
acuguuacaacuuguauuuccaa

SEQ ID NO: 1557877 - RNA, 13 nt, Homo sapiens
acuguuacuuugg

SEQ ID NO: 1557878 - RNA, 20 nt, Homo sapiens
acuguuaguauuaacuauua

SEQ ID NO: 1557879 - RNA, 21 nt, Homo sapiens
acuguucuaccaagaacugaa

SEQ ID NO: 1557880 - RNA, 17 nt, Homo sapiens
acuguucuugacaauca

SEQ ID NO: 1557881 - RNA, 17 nt, Homo sapiens
acuguugaaaaagauaa

SEQ ID NO: 1557882 - RNA, 17 nt, Homo sapiens
acuguuguacaagcuca

SEQ ID NO: 1557883 - RNA, 19 nt, Homo sapiens
acuguuuaagcccagccaa

SEQ ID NO: 1557884 - RNA, 19 nt, Homo sapiens
acuguuugauauaccaaau

SEQ ID NO: 1557885 - RNA, 13 nt, Homo sapiens
acuguuuugauag

SEQ ID NO: 1557886 - RNA, 15 nt, Homo sapiens
acuuaaaaacucuau

SEQ ID NO: 1557887 - RNA, 17 nt, Homo sapiens
acuuaaaagaacaugua

SEQ ID NO: 1557888 - RNA, 14 nt, Homo sapiens
acuuaaauuccaaa

SEQ ID NO: 1557889 - RNA, 16 nt, Homo sapiens
acuuaaauuccucaac

SEQ ID NO: 1557890 - RNA, 19 nt, Homo sapiens
acuuaacgaaaauaguauu

SEQ ID NO: 1557891 - RNA, 21 nt, Homo sapiens
acuuaacgaaaauaguauuuc

SEQ ID NO: 1557892 - RNA, 13 nt, Homo sapiens
acuuaacuauuaa

SEQ ID NO: 1557893 - RNA, 17 nt, Homo sapiens
acuuaaggggcugggau

SEQ ID NO: 1557894 - RNA, 17 nt, Homo sapiens
acuuaauacaugcaaca

SEQ ID NO: 1557895 - RNA, 15 nt, Homo sapiens
acuuacaucaugugu

SEQ ID NO: 1557896 - RNA, 17 nt, Homo sapiens
acuuacuucucugcuau

SEQ ID NO: 1557897 - RNA, 19 nt, Homo sapiens
acuuagaugggcauggugg

SEQ ID NO: 1557898 - RNA, 13 nt, Homo sapiens
acuuagcaaaaag

SEQ ID NO: 1557899 - RNA, 18 nt, Homo sapiens
acuuagccuccucccaaa

SEQ ID NO: 1557900 - RNA, 23 nt, Homo sapiens
acuuaguccuuuaucauccuuaa

SEQ ID NO: 1557901 - RNA, 18 nt, Homo sapiens
acuuauaguacaugauaa

SEQ ID NO: 1557902 - RNA, 17 nt, Homo sapiens
acuuauugccaugugga

SEQ ID NO: 1557903 - RNA, 17 nt, Homo sapiens
acuuauuggaacucugc

SEQ ID NO: 1557904 - RNA, 13 nt, Homo sapiens
acuucaaauucaa

SEQ ID NO: 1557905 - RNA, 13 nt, Homo sapiens
acuucaagugcau

SEQ ID NO: 1557906 - RNA, 14 nt, Homo sapiens
acuucaccuacauu

SEQ ID NO: 1557907 - RNA, 20 nt, Homo sapiens
acuucaccuacauuaucuca

SEQ ID NO: 1557908 - RNA, 21 nt, Homo sapiens
acuucacgggcaaucaugagc

SEQ ID NO: 1557909 - RNA, 22 nt, Homo sapiens
acuucacgggcaaucaugagca

SEQ ID NO: 1557910 - RNA, 18 nt, Homo sapiens
acuucacuaaugaucaca

SEQ ID NO: 1557911 - RNA, 19 nt, Homo sapiens
acuucauucucgugaguca

SEQ ID NO: 1557912 - RNA, 23 nt, Homo sapiens
acuuccaagcuggcuuuucccau

SEQ ID NO: 1557913 - RNA, 20 nt, Homo sapiens
acuuccaggggaaccugcca

SEQ ID NO: 1557914 - RNA, 16 nt, Homo sapiens
acuuccuauuagugac

SEQ ID NO: 1557915 - RNA, 16 nt, Homo sapiens
acuuccucaugaaucu

SEQ ID NO: 1557916 - RNA, 14 nt, Homo sapiens
acuuccucugccac

SEQ ID NO: 1557917 - RNA, 23 nt, Homo sapiens
acuuccugugccuuuccuaucac

SEQ ID NO: 1557918 - RNA, 15 nt, Homo sapiens
acuucuaaaccaaaa

SEQ ID NO: 1557919 - RNA, 16 nt, Homo sapiens
acuucuaccuacauau

SEQ ID NO: 1557920 - RNA, 19 nt, Homo sapiens
acuucucaaguaacaugac

SEQ ID NO: 1557921 - RNA, 14 nt, Homo sapiens
acuucugcagcuau

SEQ ID NO: 1557922 - RNA, 19 nt, Homo sapiens
acuucuggagaaagcucau

SEQ ID NO: 1557923 - RNA, 13 nt, Homo sapiens
acuucuugaauau

SEQ ID NO: 1557924 - RNA, 19 nt, Homo sapiens
acuucuugcuucuuucuag

SEQ ID NO: 1557925 - RNA, 19 nt, Homo sapiens
acuugaaugcuaguuauac

SEQ ID NO: 1557926 - RNA, 16 nt, Homo sapiens
acuugacagacaaaga

SEQ ID NO: 1557927 - RNA, 14 nt, Homo sapiens
acuugacuggcaca

SEQ ID NO: 1557928 - RNA, 13 nt, Homo sapiens
acuugagaaaaua

SEQ ID NO: 1557929 - RNA, 20 nt, Homo sapiens
acuugagaaaauaucuugcu

SEQ ID NO: 1557930 - RNA, 17 nt, Homo sapiens
acuugcaauaccaaugu

SEQ ID NO: 1557931 - RNA, 19 nt, Homo sapiens
acuugcacagggauucuca

SEQ ID NO: 1557932 - RNA, 22 nt, Homo sapiens
caacacgagcaggcuacuguca

SEQ ID NO: 1557933 - RNA, 23 nt, Homo sapiens
caacacgagcaggcuacugucag

SEQ ID NO: 1557934 - RNA, 18 nt, Homo sapiens
caacagaaaccagaaaag

SEQ ID NO: 1557935 - RNA, 23 nt, Homo sapiens
caacagaaaccagaaaagcaaua

SEQ ID NO: 1557936 - RNA, 13 nt, Homo sapiens
caacagacuugaa

SEQ ID NO: 1557937 - RNA, 23 nt, Homo sapiens
caacagagaggaccaacauccag

SEQ ID NO: 1557938 - RNA, 16 nt, Homo sapiens
caacagagcacuugag

SEQ ID NO: 1557939 - RNA, 23 nt, Homo sapiens
caacagauggcugcgcaccaucu

SEQ ID NO: 1557940 - RNA, 14 nt, Homo sapiens
caacagcaaaggaa

SEQ ID NO: 1557941 - RNA, 17 nt, Homo sapiens
caacagcaaaucacgac

SEQ ID NO: 1557942 - RNA, 23 nt, Homo sapiens
caacagcaccuccccgcugggaa

SEQ ID NO: 1557943 - RNA, 12 nt, Homo sapiens
caacagcacuuu

SEQ ID NO: 1557944 - RNA, 16 nt, Homo sapiens
caacaggcuugugcaa

SEQ ID NO: 1557945 - RNA, 18 nt, Homo sapiens
caacagguaaaacagggc

SEQ ID NO: 1557946 - RNA, 14 nt, Homo sapiens
caacaguuaucaca

SEQ ID NO: 1557947 - RNA, 20 nt, Homo sapiens
caacauagugagacacuguc

SEQ ID NO: 1557948 - RNA, 16 nt, Homo sapiens
caacaucgcaauaguu

SEQ ID NO: 1557949 - RNA, 18 nt, Homo sapiens
caacauggcacauguaua

SEQ ID NO: 1557950 - RNA, 15 nt, Homo sapiens
caacauucauagucu

SEQ ID NO: 1557951 - RNA, 18 nt, Homo sapiens
caacauuuguuccaugag

SEQ ID NO: 1557952 - RNA, 13 nt, Homo sapiens
caaccaugcaaau

SEQ ID NO: 1557953 - RNA, 15 nt, Homo sapiens
caaccaugucauuuc

SEQ ID NO: 1557954 - RNA, 21 nt, Homo sapiens
caacccagaauguaaaaaaga

SEQ ID NO: 1557955 - RNA, 15 nt, Homo sapiens
caacccaugaaggcu

SEQ ID NO: 1557956 - RNA, 18 nt, Homo sapiens
caacccauucacuacagg

SEQ ID NO: 1557957 - RNA, 17 nt, Homo sapiens
caacccuacaguauaua

SEQ ID NO: 1557958 - RNA, 20 nt, Homo sapiens
caacccucagauuugaugau

SEQ ID NO: 1557959 - RNA, 18 nt, Homo sapiens
caaccgcgggggcuguga

SEQ ID NO: 1557960 - RNA, 16 nt, Homo sapiens
caaccuccaacaacga

SEQ ID NO: 1557961 - RNA, 18 nt, Homo sapiens
caaccugccugacauuug

SEQ ID NO: 1557962 - RNA, 18 nt, Homo sapiens
caaccuucaaguauccaa

SEQ ID NO: 1557963 - RNA, 14 nt, Homo sapiens
caacgacugccgug

SEQ ID NO: 1557964 - RNA, 15 nt, Homo sapiens
caacgacugccguga

SEQ ID NO: 1557965 - RNA, 15 nt, Homo sapiens
caacgcuuaaaggug

SEQ ID NO: 1557966 - RNA, 15 nt, Homo sapiens
caacuaauacauggu

SEQ ID NO: 1557967 - RNA, 16 nt, Homo sapiens
caacuauuaagauauc

SEQ ID NO: 1557968 - RNA, 17 nt, Homo sapiens
caacuauuaagauaucu

SEQ ID NO: 1557969 - RNA, 12 nt, Homo sapiens
caacuccuggaa

SEQ ID NO: 1557970 - RNA, 16 nt, Homo sapiens
caacucuccaauguuc

SEQ ID NO: 1557971 - RNA, 15 nt, Homo sapiens
caacucuuugagaaa

SEQ ID NO: 1557972 - RNA, 19 nt, Homo sapiens
caacugaagcuucaaaaag

SEQ ID NO: 1557973 - RNA, 12 nt, Homo sapiens
caacugaaggcu

SEQ ID NO: 1557974 - RNA, 14 nt, Homo sapiens
caacugacuuccaa

SEQ ID NO: 1557975 - RNA, 15 nt, Homo sapiens
caacugcgacuguga

SEQ ID NO: 1557976 - RNA, 22 nt, Homo sapiens
caacugucuuagacugcuagcu

SEQ ID NO: 1557977 - RNA, 23 nt, Homo sapiens
caacugucuuagacugcuagcuu

SEQ ID NO: 1557978 - RNA, 16 nt, Homo sapiens
caacugugugauuaaa

SEQ ID NO: 1557979 - RNA, 16 nt, Homo sapiens
caacuuacugucuucu

SEQ ID NO: 1557980 - RNA, 16 nt, Homo sapiens
caacuuccgcugaggg

SEQ ID NO: 1557981 - RNA, 14 nt, Homo sapiens
caacuugcuucuaa

SEQ ID NO: 1557982 - RNA, 21 nt, Homo sapiens
caacuuucuguuggauuccau

SEQ ID NO: 1557983 - RNA, 12 nt, Homo sapiens
caagaaaaucag

SEQ ID NO: 1557984 - RNA, 20 nt, Homo sapiens
caagaaaaucagguauuaau

SEQ ID NO: 1557985 - RNA, 16 nt, Homo sapiens
caagaaacgucuucua

SEQ ID NO: 1557986 - RNA, 16 nt, Homo sapiens
caagaaaucagccaua

SEQ ID NO: 1557987 - RNA, 13 nt, Homo sapiens
caagaacaauuca

SEQ ID NO: 1557988 - RNA, 14 nt, Homo sapiens
caagaacaauucaa

SEQ ID NO: 1557989 - RNA, 14 nt, Homo sapiens
caagaacugcaucu

SEQ ID NO: 1557990 - RNA, 13 nt, Homo sapiens
caagaagaaauca

SEQ ID NO: 1557991 - RNA, 18 nt, Homo sapiens
caagaagaggaaagggag

SEQ ID NO: 1557992 - RNA, 15 nt, Homo sapiens
caagaagcaugcaga

SEQ ID NO: 1557993 - RNA, 18 nt, Homo sapiens
caagaaguggcugccaaa

SEQ ID NO: 1557994 - RNA, 14 nt, Homo sapiens
caagacacagaaua

SEQ ID NO: 1557995 - RNA, 14 nt, Homo sapiens
caagacuuccucau

SEQ ID NO: 1557996 - RNA, 19 nt, Homo sapiens
caagacuuccucaugaauc

SEQ ID NO: 1557997 - RNA, 15 nt, Homo sapiens
caagacuuugcuaaa

SEQ ID NO: 1557998 - RNA, 19 nt, Homo sapiens
caagagaucuuucuuucca

SEQ ID NO: 1557999 - RNA, 13 nt, Homo sapiens
caagagcaugcac

SEQ ID NO: 1558000 - RNA, 12 nt, Homo sapiens
caagagggcaag

SEQ ID NO: 1558001 - RNA, 22 nt, Homo sapiens
caagaguacagaagcuuuagca

SEQ ID NO: 1558002 - RNA, 20 nt, Homo sapiens
caagaucgcaccacugcacu

SEQ ID NO: 1558003 - RNA, 19 nt, Homo sapiens
caagaugggacagcaacaa

SEQ ID NO: 1558004 - RNA, 14 nt, Homo sapiens
caagauuaugugac

SEQ ID NO: 1558005 - RNA, 15 nt, Homo sapiens
caagauuuaaccugc

SEQ ID NO: 1558006 - RNA, 20 nt, Homo sapiens
caagcaauucuccugccuca

SEQ ID NO: 1558007 - RNA, 23 nt, Homo sapiens
caagcagagcggguaaagugcaa

SEQ ID NO: 1558008 - RNA, 18 nt, Homo sapiens
caagcaggugaacuggga

SEQ ID NO: 1558009 - RNA, 17 nt, Homo sapiens
caagcagucaguuugca

SEQ ID NO: 1558010 - RNA, 11 nt, Homo sapiens
caagccacaag

SEQ ID NO: 1558011 - RNA, 14 nt, Homo sapiens
caagccauuccaaa

SEQ ID NO: 1558012 - RNA, 13 nt, Homo sapiens
caagcccugccca

SEQ ID NO: 1558013 - RNA, 15 nt, Homo sapiens
caagccucaugucca

SEQ ID NO: 1558014 - RNA, 18 nt, Homo sapiens
caagccucuaguguacca

SEQ ID NO: 1558015 - RNA, 18 nt, Homo sapiens
caagccugucuucagaga

SEQ ID NO: 1558016 - RNA, 23 nt, Homo sapiens
caagcgccgcugugaggcugcuu

SEQ ID NO: 1558017 - RNA, 14 nt, Homo sapiens
caagcguguucuca

SEQ ID NO: 1558018 - RNA, 19 nt, Homo sapiens
caagcucaacggcuccauc

SEQ ID NO: 1558019 - RNA, 16 nt, Homo sapiens
caagcuccaaauccaa

SEQ ID NO: 1558020 - RNA, 15 nt, Homo sapiens
caagcugcauggcaa

SEQ ID NO: 1558021 - RNA, 16 nt, Homo sapiens
caagcuguugaagucu

SEQ ID NO: 1558022 - RNA, 20 nt, Homo sapiens
caagcuuugguuuaugguuu

SEQ ID NO: 1558023 - RNA, 14 nt, Homo sapiens
caaggaaucauguc

SEQ ID NO: 1558024 - RNA, 18 nt, Homo sapiens
caaggacagccaccaaga

SEQ ID NO: 1558025 - RNA, 19 nt, Homo sapiens
caaggacauuucucaaggg

SEQ ID NO: 1558026 - RNA, 22 nt, Homo sapiens
caaggaguauauggacacuaca

SEQ ID NO: 1558027 - RNA, 15 nt, Homo sapiens
caaggagugaaaaac

SEQ ID NO: 1558028 - RNA, 23 nt, Homo sapiens
caaggcauuugucuuuguaauau

SEQ ID NO: 1558029 - RNA, 23 nt, Homo sapiens
caaggcugcgggagaagaaguuu

SEQ ID NO: 1558030 - RNA, 21 nt, Homo sapiens
caagggaauucggugugcacc

SEQ ID NO: 1558031 - RNA, 21 nt, Homo sapiens
caagggcuuuguuuugcacac

SEQ ID NO: 1558032 - RNA, 14 nt, Homo sapiens
caaggguuuuccag

SEQ ID NO: 1558033 - RNA, 23 nt, Homo sapiens
caaggguuuuccagguguagcua

SEQ ID NO: 1558034 - RNA, 21 nt, Homo sapiens
caaggugauuucagacugcag

SEQ ID NO: 1558035 - RNA, 21 nt, Homo sapiens
caaggugggcggaucaccuga

SEQ ID NO: 1558036 - RNA, 23 nt, Homo sapiens
caagguggugaaaucccaucucu

SEQ ID NO: 1558037 - RNA, 18 nt, Homo sapiens
caagguggugugaucuua

SEQ ID NO: 1558038 - RNA, 22 nt, Homo sapiens
caagguggugugaucuuaauau

SEQ ID NO: 1558039 - RNA, 18 nt, Homo sapiens
caaggugugcucugagcc

SEQ ID NO: 1558040 - RNA, 14 nt, Homo sapiens
caagguugcacagc

SEQ ID NO: 1558041 - RNA, 15 nt, Homo sapiens
caaguaacugaacca

SEQ ID NO: 1558042 - RNA, 21 nt, Homo sapiens
caaguaagaaagugaagcaaa

SEQ ID NO: 1558043 - RNA, 14 nt, Homo sapiens
caaguaauugugaa

SEQ ID NO: 1558044 - RNA, 12 nt, Homo sapiens
caaguacaugug

SEQ ID NO: 1558045 - RNA, 12 nt, Homo sapiens
caaguaccaaaa

SEQ ID NO: 1558046 - RNA, 13 nt, Homo sapiens
caaguauccaauu

SEQ ID NO: 1558047 - RNA, 17 nt, Homo sapiens
caaguauuauuuuacaa

SEQ ID NO: 1558048 - RNA, 20 nt, Homo sapiens
caaguauuuuugacauuuac

SEQ ID NO: 1558049 - RNA, 18 nt, Homo sapiens
caagucauggucacagua

SEQ ID NO: 1558050 - RNA, 13 nt, Homo sapiens
caagucuaaacca

SEQ ID NO: 1558051 - RNA, 20 nt, Homo sapiens
auaccccacuccacaucaac

SEQ ID NO: 1558052 - RNA, 23 nt, Homo sapiens
auaccuuauuuauuuuuguguag

SEQ ID NO: 1558053 - RNA, 16 nt, Homo sapiens
auaccuuuuuguguca

SEQ ID NO: 1558054 - RNA, 23 nt, Homo sapiens
aagggaaccauguauaugagcuu

SEQ ID NO: 1558055 - RNA, 14 nt, Homo sapiens
aagggaauugcuca

SEQ ID NO: 1558056 - RNA, 21 nt, Homo sapiens
aagggagaacuugaaacagau

SEQ ID NO: 1558057 - RNA, 21 nt, Homo sapiens
aagggaucaucaugcagcuca

SEQ ID NO: 1558058 - RNA, 19 nt, Homo sapiens
aagggcaacagaucaguaa

SEQ ID NO: 1558059 - RNA, 17 nt, Homo sapiens
aagggcuagaaccugga

SEQ ID NO: 1558060 - RNA, 15 nt, Homo sapiens
aaggggaauggaaga

SEQ ID NO: 1558061 - RNA, 21 nt, Homo sapiens
aaggggacaccuguacauucu

SEQ ID NO: 1558062 - RNA, 23 nt, Homo sapiens
aagggggugaccucuugccucga

SEQ ID NO: 1558063 - RNA, 19 nt, Homo sapiens
aaggguaauagaaaugcau

SEQ ID NO: 1558064 - RNA, 13 nt, Homo sapiens
aagguaaauccca

SEQ ID NO: 1558065 - RNA, 23 nt, Homo sapiens
aagguaacaagaguauguggcaa

SEQ ID NO: 1558066 - RNA, 20 nt, Homo sapiens
aagguaaugaccaguuguua

SEQ ID NO: 1558067 - RNA, 23 nt, Homo sapiens
aagguaugcauuuuauacaugua

SEQ ID NO: 1558068 - RNA, 17 nt, Homo sapiens
aagguaugugucagcca

SEQ ID NO: 1558069 - RNA, 13 nt, Homo sapiens
aaggucaccagca

SEQ ID NO: 1558070 - RNA, 21 nt, Homo sapiens
aaggucauaagggagcaugau

SEQ ID NO: 1558071 - RNA, 19 nt, Homo sapiens
aaggucuccuaaaacuggg

SEQ ID NO: 1558072 - RNA, 14 nt, Homo sapiens
aaggucugaugucu

SEQ ID NO: 1558073 - RNA, 12 nt, Homo sapiens
aaggugaaucug

SEQ ID NO: 1558074 - RNA, 20 nt, Homo sapiens
aaggugcuggacuguuacug

SEQ ID NO: 1558075 - RNA, 13 nt, Homo sapiens
aaggugucuuccu

SEQ ID NO: 1558076 - RNA, 19 nt, Homo sapiens
aaggugugcucugagccac

SEQ ID NO: 1558077 - RNA, 21 nt, Homo sapiens
aaggugugcucugagccacag

SEQ ID NO: 1558078 - RNA, 18 nt, Homo sapiens
aagguguguacucagggc

SEQ ID NO: 1558079 - RNA, 18 nt, Homo sapiens
aagguguuguaaugguga

SEQ ID NO: 1558080 - RNA, 12 nt, Homo sapiens
aagguugcacag

SEQ ID NO: 1558081 - RNA, 12 nt, Homo sapiens
aaguaaaaccac

SEQ ID NO: 1558082 - RNA, 16 nt, Homo sapiens
aaguaaaagucuaccu

SEQ ID NO: 1558083 - RNA, 21 nt, Homo sapiens
aaguaacugaaccauuccaac

SEQ ID NO: 1558084 - RNA, 15 nt, Homo sapiens
aaguaauacaaacua

SEQ ID NO: 1558085 - RNA, 16 nt, Homo sapiens
aaguaauacaaacuaa

SEQ ID NO: 1558086 - RNA, 19 nt, Homo sapiens
aaguaauauaaugaugcug

SEQ ID NO: 1558087 - RNA, 13 nt, Homo sapiens
aaguaaugaauuu

SEQ ID NO: 1558088 - RNA, 18 nt, Homo sapiens
aaguacauguuaaacuua

SEQ ID NO: 1558089 - RNA, 16 nt, Homo sapiens
aaguacuaaagcaccu

SEQ ID NO: 1558090 - RNA, 11 nt, Homo sapiens
aaguacuuuac

SEQ ID NO: 1558091 - RNA, 16 nt, Homo sapiens
aaguagaggaauccau

SEQ ID NO: 1558092 - RNA, 19 nt, Homo sapiens
aaguagaggaauccaugua

SEQ ID NO: 1558093 - RNA, 23 nt, Homo sapiens
aaguagcaaauguuuacuguauc

SEQ ID NO: 1558094 - RNA, 20 nt, Homo sapiens
aaguagcaucccaucccaac

SEQ ID NO: 1558095 - RNA, 22 nt, Homo sapiens
aaguauaggccaggcacagugg

SEQ ID NO: 1558096 - RNA, 15 nt, Homo sapiens
aaguauccacagaaa

SEQ ID NO: 1558097 - RNA, 14 nt, Homo sapiens
aaguauuacaacca

SEQ ID NO: 1558098 - RNA, 11 nt, Homo sapiens
aaguauuccac

SEQ ID NO: 1558099 - RNA, 13 nt, Homo sapiens
aagucauagccau

SEQ ID NO: 1558100 - RNA, 15 nt, Homo sapiens
aagucaucuugcuac

SEQ ID NO: 1558101 - RNA, 10 nt, Homo sapiens
aagucauuuu

SEQ ID NO: 1558102 - RNA, 18 nt, Homo sapiens
aaguccaagcauaccaac

SEQ ID NO: 1558103 - RNA, 14 nt, Homo sapiens
aaguccaucugaca

SEQ ID NO: 1558104 - RNA, 22 nt, Homo sapiens
aagucccucuccuggugcucca

SEQ ID NO: 1558105 - RNA, 14 nt, Homo sapiens
aagucuaacgcuga

SEQ ID NO: 1558106 - RNA, 17 nt, Homo sapiens
aagucuaagaaagcaau

SEQ ID NO: 1558107 - RNA, 20 nt, Homo sapiens
aagucugaauagaaucugga

SEQ ID NO: 1558108 - RNA, 14 nt, Homo sapiens
aagugaacucucaa

SEQ ID NO: 1558109 - RNA, 24 nt, Homo sapiens
aagugacuucuggagaaagcucau

SEQ ID NO: 1558110 - RNA, 15 nt, Homo sapiens
aagugagacccaaag

SEQ ID NO: 1558111 - RNA, 23 nt, Homo sapiens
aagugaggugugucacaaugaga

SEQ ID NO: 1558112 - RNA, 16 nt, Homo sapiens
aagugaugucauuuga

SEQ ID NO: 1558113 - RNA, 22 nt, Homo sapiens
aagugcuggcccacccagucca

SEQ ID NO: 1558114 - RNA, 22 nt, Homo sapiens
aagugcugggauuacaggugua

SEQ ID NO: 1558115 - RNA, 11 nt, Homo sapiens
aagugcuguuu

SEQ ID NO: 1558116 - RNA, 19 nt, Homo sapiens
aaguggccaagaagcagug

SEQ ID NO: 1558117 - RNA, 16 nt, Homo sapiens
aagugggacauucaaa

SEQ ID NO: 1558118 - RNA, 23 nt, Homo sapiens
aagugggaucugucacaccagcc

SEQ ID NO: 1558119 - RNA, 20 nt, Homo sapiens
aaguggggagagagcccuuc

SEQ ID NO: 1558120 - RNA, 14 nt, Homo sapiens
aagugguacuugau

SEQ ID NO: 1558121 - RNA, 21 nt, Homo sapiens
aagugguauuuuccagcacuu

SEQ ID NO: 1558122 - RNA, 15 nt, Homo sapiens
aagugguucucugcc

SEQ ID NO: 1558123 - RNA, 17 nt, Homo sapiens
aaguguaacagauauca

SEQ ID NO: 1558124 - RNA, 24 nt, Homo sapiens
aaguguauuuauuuuacagcucau

SEQ ID NO: 1558125 - RNA, 15 nt, Homo sapiens
aaguucagaucuuaa

SEQ ID NO: 1558126 - RNA, 15 nt, Homo sapiens
aaguucagcaacugu

SEQ ID NO: 1558127 - RNA, 19 nt, Homo sapiens
aaguucugaagaugaugcg

SEQ ID NO: 1558128 - RNA, 17 nt, Homo sapiens
aaguucuggaucuuaua

SEQ ID NO: 1558129 - RNA, 18 nt, Homo sapiens
aaguucuuaguguugguu

SEQ ID NO: 1558130 - RNA, 19 nt, Homo sapiens
aaguucuuggauuacuuua

SEQ ID NO: 1558131 - RNA, 20 nt, Homo sapiens
aaguucuuggauuacuuuac

SEQ ID NO: 1558132 - RNA, 22 nt, Homo sapiens
aaguucuuggauuacuuuacac

SEQ ID NO: 1558133 - RNA, 21 nt, Homo sapiens
aaguugcugcuugugaucuca

SEQ ID NO: 1558134 - RNA, 21 nt, Homo sapiens
aaguuguaaaguauguauuau

SEQ ID NO: 1558135 - RNA, 20 nt, Homo sapiens
aaguuguugacugugauuag

SEQ ID NO: 1558136 - RNA, 16 nt, Homo sapiens
aaguuuaaucagagga

SEQ ID NO: 1558137 - RNA, 14 nt, Homo sapiens
aaguuuaaugccua

SEQ ID NO: 1558138 - RNA, 16 nt, Homo sapiens
aaguuuaauugacuua

SEQ ID NO: 1558139 - RNA, 19 nt, Homo sapiens
aaguuuacaaucaaaggaa

SEQ ID NO: 1558140 - RNA, 22 nt, Homo sapiens
aaguuucccuucucccagucca

SEQ ID NO: 1558141 - RNA, 23 nt, Homo sapiens
aaguuuguuauagucuaugugau

SEQ ID NO: 1558142 - RNA, 15 nt, Homo sapiens
aauaaaaaaucugaa

SEQ ID NO: 1558143 - RNA, 11 nt, Homo sapiens
aauaaaaagcu

SEQ ID NO: 1558144 - RNA, 17 nt, Homo sapiens
aauaaaaagugccuaaa

SEQ ID NO: 1558145 - RNA, 20 nt, Homo sapiens
aauaaaauucuguaauuuga

SEQ ID NO: 1558146 - RNA, 14 nt, Homo sapiens
aauaaacacugugu

SEQ ID NO: 1558147 - RNA, 13 nt, Homo sapiens
aauaaacauguca

SEQ ID NO: 1558148 - RNA, 19 nt, Homo sapiens
aauaaacaugucacaauac

SEQ ID NO: 1558149 - RNA, 15 nt, Homo sapiens
aauaaaccaguguga

SEQ ID NO: 1558150 - RNA, 18 nt, Homo sapiens
aauaaacccucagagccu

SEQ ID NO: 1558151 - RNA, 18 nt, Homo sapiens
aauaaaccgaaaguguua

SEQ ID NO: 1558152 - RNA, 18 nt, Homo sapiens
aauaaacugaaaauggac

SEQ ID NO: 1558153 - RNA, 16 nt, Homo sapiens
aauaaagauacaugau

SEQ ID NO: 1558154 - RNA, 14 nt, Homo sapiens
aauaaagcagucau

SEQ ID NO: 1558155 - RNA, 13 nt, Homo sapiens
aauaaaggcagcu

SEQ ID NO: 1558156 - RNA, 18 nt, Homo sapiens
aauaaaggcagcugccuc

SEQ ID NO: 1558157 - RNA, 15 nt, Homo sapiens
aauaaaggcauuuca

SEQ ID NO: 1558158 - RNA, 15 nt, Homo sapiens
aauaaaguugaauau

SEQ ID NO: 1558159 - RNA, 24 nt, Homo sapiens
aauaaauaaaacagcagcagcaaa

SEQ ID NO: 1558160 - RNA, 14 nt, Homo sapiens
aauaaauaaucauc

SEQ ID NO: 1558161 - RNA, 20 nt, Homo sapiens
aauaaaugguuucucauuaa

SEQ ID NO: 1558162 - RNA, 15 nt, Homo sapiens
aauaaauucuaccuc

SEQ ID NO: 1558163 - RNA, 18 nt, Homo sapiens
aauaacauuuaaauucca

SEQ ID NO: 1558164 - RNA, 19 nt, Homo sapiens
aauaagaacagaucaggaa

SEQ ID NO: 1558165 - RNA, 22 nt, Homo sapiens
aauaagauguaguaacacugug

SEQ ID NO: 1558166 - RNA, 16 nt, Homo sapiens
aauaagcaaaaugcca

SEQ ID NO: 1558167 - RNA, 13 nt, Homo sapiens
aauaagcaaucaa

SEQ ID NO: 1558168 - RNA, 15 nt, Homo sapiens
aauaagguacaagaa

SEQ ID NO: 1558169 - RNA, 20 nt, Homo sapiens
aauaaguaucacacuguaua

SEQ ID NO: 1558170 - RNA, 12 nt, Homo sapiens
aauaagugccag

SEQ ID NO: 1558171 - RNA, 14 nt, Homo sapiens
aauaauaaacagug

SEQ ID NO: 1558172 - RNA, 15 nt, Homo sapiens
aauguucaaugccac

SEQ ID NO: 1558173 - RNA, 22 nt, Homo sapiens
aauguucuguuugcuguggaac

SEQ ID NO: 1558174 - RNA, 15 nt, Homo sapiens
aauguugacaggcaa

SEQ ID NO: 1558175 - RNA, 16 nt, Homo sapiens
aauguugacaggcaaa

SEQ ID NO: 1558176 - RNA, 13 nt, Homo sapiens
aauguuguucucu

SEQ ID NO: 1558177 - RNA, 16 nt, Homo sapiens
aauguuuguccuguau

SEQ ID NO: 1558178 - RNA, 13 nt, Homo sapiens
aauguuuucauac

SEQ ID NO: 1558179 - RNA, 16 nt, Homo sapiens
aauuaaaaaagcauac

SEQ ID NO: 1558180 - RNA, 20 nt, Homo sapiens
aauuaaagccuuaagcacaa

SEQ ID NO: 1558181 - RNA, 14 nt, Homo sapiens
aauuaaaguacuuu

SEQ ID NO: 1558182 - RNA, 16 nt, Homo sapiens
aauuaaauagugugau

SEQ ID NO: 1558183 - RNA, 15 nt, Homo sapiens
aauuaaaucuagaca

SEQ ID NO: 1558184 - RNA, 15 nt, Homo sapiens
aauuaagauuaugug

SEQ ID NO: 1558185 - RNA, 22 nt, Homo sapiens
aauuaaggguaugauuaacucu

SEQ ID NO: 1558186 - RNA, 22 nt, Homo sapiens
aauuaauaacuuucucugugaa

SEQ ID NO: 1558187 - RNA, 14 nt, Homo sapiens
aauuaauauaucau

SEQ ID NO: 1558188 - RNA, 19 nt, Homo sapiens
aauuaauguaauaaaguga

SEQ ID NO: 1558189 - RNA, 14 nt, Homo sapiens
aauuacaagcugua

SEQ ID NO: 1558190 - RNA, 11 nt, Homo sapiens
aauuaccaugc

SEQ ID NO: 1558191 - RNA, 18 nt, Homo sapiens
aauuaccaugcuucacaa

SEQ ID NO: 1558192 - RNA, 22 nt, Homo sapiens
aauuacuuauuggauauucauu

SEQ ID NO: 1558193 - RNA, 12 nt, Homo sapiens
aauuacuugaag

SEQ ID NO: 1558194 - RNA, 18 nt, Homo sapiens
aauuagaauauccaugac

SEQ ID NO: 1558195 - RNA, 21 nt, Homo sapiens
aauuagcuuguuacaauucua

SEQ ID NO: 1558196 - RNA, 15 nt, Homo sapiens
aauuaguaacaugug

SEQ ID NO: 1558197 - RNA, 13 nt, Homo sapiens
aauuagugaacca

SEQ ID NO: 1558198 - RNA, 17 nt, Homo sapiens
aauuagugaaccaaaaa

SEQ ID NO: 1558199 - RNA, 21 nt, Homo sapiens
aauuaucaucuuuugaucuuu

SEQ ID NO: 1558200 - RNA, 14 nt, Homo sapiens
aauuaucuauagcu

SEQ ID NO: 1558201 - RNA, 16 nt, Homo sapiens
aauuaugcacuaaaua

SEQ ID NO: 1558202 - RNA, 16 nt, Homo sapiens
aauuaugguaguuauu

SEQ ID NO: 1558203 - RNA, 16 nt, Homo sapiens
aauuauugacacugaa

SEQ ID NO: 1558204 - RNA, 21 nt, Homo sapiens
aauuauugcuucuaguccacu

SEQ ID NO: 1558205 - RNA, 16 nt, Homo sapiens
aauuauuucugucaca

SEQ ID NO: 1558206 - RNA, 12 nt, Homo sapiens
aauucaaaaaca

SEQ ID NO: 1558207 - RNA, 13 nt, Homo sapiens
aauucagcacuua

SEQ ID NO: 1558208 - RNA, 19 nt, Homo sapiens
aauucagcaguuuuauccu

SEQ ID NO: 1558209 - RNA, 19 nt, Homo sapiens
aauucaggaagcagcaaaa

SEQ ID NO: 1558210 - RNA, 23 nt, Homo sapiens
aauucauaacagcaaccuugaaa

SEQ ID NO: 1558211 - RNA, 13 nt, Homo sapiens
aauuccacucaaa

SEQ ID NO: 1558212 - RNA, 13 nt, Homo sapiens
aauuccgagugca

SEQ ID NO: 1558213 - RNA, 15 nt, Homo sapiens
aauuccuugcacaua

SEQ ID NO: 1558214 - RNA, 22 nt, Homo sapiens
aauucuaaaauacaaacccaug

SEQ ID NO: 1558215 - RNA, 23 nt, Homo sapiens
aauucuaaauaaauuucccaguu

SEQ ID NO: 1558216 - RNA, 11 nt, Homo sapiens
aauucuacugg

SEQ ID NO: 1558217 - RNA, 17 nt, Homo sapiens
aauucuccugccucagc

SEQ ID NO: 1558218 - RNA, 19 nt, Homo sapiens
aauucuccugccucagccu

SEQ ID NO: 1558219 - RNA, 17 nt, Homo sapiens
aauucugaauuugcaaa

SEQ ID NO: 1558220 - RNA, 11 nt, Homo sapiens
aauucugugac

SEQ ID NO: 1558221 - RNA, 16 nt, Homo sapiens
aauucuugcuaugaaa

SEQ ID NO: 1558222 - RNA, 16 nt, Homo sapiens
aauucuuucuguugaa

SEQ ID NO: 1558223 - RNA, 20 nt, Homo sapiens
aauucuuuucacucauucac

SEQ ID NO: 1558224 - RNA, 19 nt, Homo sapiens
aauugaaaaggaacuugcc

SEQ ID NO: 1558225 - RNA, 18 nt, Homo sapiens
aauugaaaaguacaacua

SEQ ID NO: 1558226 - RNA, 20 nt, Homo sapiens
aauugaagcaacuacaacuu

SEQ ID NO: 1558227 - RNA, 13 nt, Homo sapiens
aauugacaugugc

SEQ ID NO: 1558228 - RNA, 23 nt, Homo sapiens
aauugaccauacaauuucauccu

SEQ ID NO: 1558229 - RNA, 16 nt, Homo sapiens
aauugacccacaagaa

SEQ ID NO: 1558230 - RNA, 21 nt, Homo sapiens
aauugaccuuuagguauuaca

SEQ ID NO: 1558231 - RNA, 16 nt, Homo sapiens
aauugaugaugcaguu

SEQ ID NO: 1558232 - RNA, 21 nt, Homo sapiens
aauugauucuuagacauugca

SEQ ID NO: 1558233 - RNA, 16 nt, Homo sapiens
aauugcaaaucuugaa

SEQ ID NO: 1558234 - RNA, 13 nt, Homo sapiens
aauugcaauacau

SEQ ID NO: 1558235 - RNA, 22 nt, Homo sapiens
aauugcagaauucaaaagugau

SEQ ID NO: 1558236 - RNA, 16 nt, Homo sapiens
aauugcuaauguugcu

SEQ ID NO: 1558237 - RNA, 23 nt, Homo sapiens
aauugcuuuugaaaaacaacugc

SEQ ID NO: 1558238 - RNA, 17 nt, Homo sapiens
aauuggaacaaagugaa

SEQ ID NO: 1558239 - RNA, 15 nt, Homo sapiens
aauugggcagucuua

SEQ ID NO: 1558240 - RNA, 19 nt, Homo sapiens
aauuguaaauccuguguuu

SEQ ID NO: 1558241 - RNA, 21 nt, Homo sapiens
aauuguaauuccaaaauccaa

SEQ ID NO: 1558242 - RNA, 13 nt, Homo sapiens
aauuguacaagca

SEQ ID NO: 1558243 - RNA, 18 nt, Homo sapiens
aauuguaucaaaugugac

SEQ ID NO: 1558244 - RNA, 20 nt, Homo sapiens
aauuguaucucauuacuuau

SEQ ID NO: 1558245 - RNA, 19 nt, Homo sapiens
aauugucugccauuacacc

SEQ ID NO: 1558246 - RNA, 20 nt, Homo sapiens
aauugugaaaaugaauauca

SEQ ID NO: 1558247 - RNA, 16 nt, Homo sapiens
aauugugcaguacuuu

SEQ ID NO: 1558248 - RNA, 14 nt, Homo sapiens
aauugugcuuucac

SEQ ID NO: 1558249 - RNA, 12 nt, Homo sapiens
aauuguguuacu

SEQ ID NO: 1558250 - RNA, 14 nt, Homo sapiens
aauuguuuaugugu

SEQ ID NO: 1558251 - RNA, 23 nt, Homo sapiens
aauuguuuuuaaguuuucaugaa

SEQ ID NO: 1558252 - RNA, 17 nt, Homo sapiens
aauuguuuuuugcucuu

SEQ ID NO: 1558253 - RNA, 18 nt, Homo sapiens
aauuuaaaaaaagcaaaa

SEQ ID NO: 1558254 - RNA, 14 nt, Homo sapiens
aauuuaaaagcaca

SEQ ID NO: 1558255 - RNA, 14 nt, Homo sapiens
aauuuaaacucuga

SEQ ID NO: 1558256 - RNA, 19 nt, Homo sapiens
aauuuaccuaagauuacaa

SEQ ID NO: 1558257 - RNA, 12 nt, Homo sapiens
aauuuacuguga

SEQ ID NO: 1558258 - RNA, 16 nt, Homo sapiens
aauuuagaaagcuuaa

SEQ ID NO: 1558259 - RNA, 15 nt, Homo sapiens
aauuuauaagcauuu

SEQ ID NO: 1558260 - RNA, 16 nt, Homo sapiens
aauuuauacuuaaaaa

SEQ ID NO: 1558261 - RNA, 19 nt, Homo sapiens
aauuucauaccuaucaucu

SEQ ID NO: 1558262 - RNA, 19 nt, Homo sapiens
aauuucuccucccuuccuu

SEQ ID NO: 1558263 - RNA, 16 nt, Homo sapiens
aauuucucugaggaca

SEQ ID NO: 1558264 - RNA, 15 nt, Homo sapiens
aauuugagauucuac

SEQ ID NO: 1558265 - RNA, 18 nt, Homo sapiens
aauuugcaaaguacugua

SEQ ID NO: 1558266 - RNA, 21 nt, Homo sapiens
aauuuggagcacaaaauucaa

SEQ ID NO: 1558267 - RNA, 20 nt, Homo sapiens
aauuugguaaaaaugcugcu

SEQ ID NO: 1558268 - RNA, 21 nt, Homo sapiens
aauuuguaagcaacuugcuuc

SEQ ID NO: 1558269 - RNA, 20 nt, Homo sapiens
aauuuuaacacuaaccaaac

SEQ ID NO: 1558270 - RNA, 16 nt, Homo sapiens
aauuuuaagaauuuca

SEQ ID NO: 1558271 - RNA, 17 nt, Homo sapiens
aauuuuaguguuaauga

SEQ ID NO: 1558272 - RNA, 22 nt, Homo sapiens
aauuuuaguguuaaugacucuu

SEQ ID NO: 1558273 - RNA, 18 nt, Homo sapiens
aauuuuauuacauaugau

SEQ ID NO: 1558274 - RNA, 20 nt, Homo sapiens
aauuuuauucaagaaugcca

SEQ ID NO: 1558275 - RNA, 16 nt, Homo sapiens
aauuuucaauuugaga

SEQ ID NO: 1558276 - RNA, 22 nt, Homo sapiens
aauuuucuuccuuugaagcuuu

SEQ ID NO: 1558277 - RNA, 20 nt, Homo sapiens
aauuuucuugguucuuucag

SEQ ID NO: 1558278 - RNA, 22 nt, Homo sapiens
aauuuugagauuaagaaugcca

SEQ ID NO: 1558279 - RNA, 17 nt, Homo sapiens
aauuuugaguugccaca

SEQ ID NO: 1558280 - RNA, 20 nt, Homo sapiens
aauuuugauauaaucuuuca

SEQ ID NO: 1558281 - RNA, 14 nt, Homo sapiens
aauuuugcaccagc

SEQ ID NO: 1558282 - RNA, 14 nt, Homo sapiens
aauuuugcacugaa

SEQ ID NO: 1558283 - RNA, 20 nt, Homo sapiens
aauuuugguuuaugacucuu

SEQ ID NO: 1558284 - RNA, 15 nt, Homo sapiens
aauuuuguaugccaa

SEQ ID NO: 1558285 - RNA, 20 nt, Homo sapiens
aauuuuuaaaacccauuuaa

SEQ ID NO: 1558286 - RNA, 18 nt, Homo sapiens
aauuuuuaagcugcaaau

SEQ ID NO: 1558287 - RNA, 14 nt, Homo sapiens
aauuuuuaggcaaa

SEQ ID NO: 1558288 - RNA, 13 nt, Homo sapiens
acaaaaaauacuu

SEQ ID NO: 1558289 - RNA, 13 nt, Homo sapiens
acaaaaacacagc

SEQ ID NO: 1558290 - RNA, 20 nt, Homo sapiens
acaaaaacuuagaugggcau

SEQ ID NO: 1558291 - RNA, 20 nt, Homo sapiens
auguuaggccuaagaggcuu

SEQ ID NO: 1558292 - RNA, 22 nt, Homo sapiens
auguuauagaacuucauggauc

SEQ ID NO: 1558293 - RNA, 20 nt, Homo sapiens
auguuccaauaaaacuuuau

SEQ ID NO: 1558294 - RNA, 15 nt, Homo sapiens
auguuccacuaaccc

SEQ ID NO: 1558295 - RNA, 12 nt, Homo sapiens
auguuccagaca

SEQ ID NO: 1558296 - RNA, 18 nt, Homo sapiens
auguuccagacauucucg

SEQ ID NO: 1558297 - RNA, 19 nt, Homo sapiens
auguucuuuaaaggcaucu

SEQ ID NO: 1558298 - RNA, 22 nt, Homo sapiens
auguugagaauguucaucucuc

SEQ ID NO: 1558299 - RNA, 14 nt, Homo sapiens
auguugcaauguga

SEQ ID NO: 1558300 - RNA, 17 nt, Homo sapiens
auguugcuuuugcaccu

SEQ ID NO: 1558301 - RNA, 18 nt, Homo sapiens
auguugcuuuugcaccua

SEQ ID NO: 1558302 - RNA, 21 nt, Homo sapiens
auguuuauaaaucuuaugcuc

SEQ ID NO: 1558303 - RNA, 15 nt, Homo sapiens
auguuucaaauacuu

SEQ ID NO: 1558304 - RNA, 21 nt, Homo sapiens
auguuuccacuggcuuuugcc

SEQ ID NO: 1558305 - RNA, 24 nt, Homo sapiens
auguuugacaaaacacagccaagg

SEQ ID NO: 1558306 - RNA, 15 nt, Homo sapiens
auguuugcaaacuug

SEQ ID NO: 1558307 - RNA, 15 nt, Homo sapiens
auguuuucucuaaga

SEQ ID NO: 1558308 - RNA, 15 nt, Homo sapiens
auguuuucuuucuca

SEQ ID NO: 1558309 - RNA, 16 nt, Homo sapiens
auguuuugaucaaauu

SEQ ID NO: 1558310 - RNA, 21 nt, Homo sapiens
auguuuugguguauugucagc

SEQ ID NO: 1558311 - RNA, 14 nt, Homo sapiens
auguuuuucuucau

SEQ ID NO: 1558312 - RNA, 17 nt, Homo sapiens
auuaaaaaaucagagaa

SEQ ID NO: 1558313 - RNA, 15 nt, Homo sapiens
auuaaaaaccugaug

SEQ ID NO: 1558314 - RNA, 23 nt, Homo sapiens
auuaaaaaggaaaguuugccagg

SEQ ID NO: 1558315 - RNA, 14 nt, Homo sapiens
auuaaaaccagaga

SEQ ID NO: 1558316 - RNA, 23 nt, Homo sapiens
auuaaaacucauuuuuguuuuca

SEQ ID NO: 1558317 - RNA, 20 nt, Homo sapiens
auuaaaccuuuccauuuuac

SEQ ID NO: 1558318 - RNA, 19 nt, Homo sapiens
auuaaagaauguuuuggaa

SEQ ID NO: 1558319 - RNA, 13 nt, Homo sapiens
auuaaagccuuaa

SEQ ID NO: 1558320 - RNA, 13 nt, Homo sapiens
auuaaaggcagca

SEQ ID NO: 1558321 - RNA, 14 nt, Homo sapiens
auuaaaugugucau

SEQ ID NO: 1558322 - RNA, 13 nt, Homo sapiens
auuaaauguuuca

SEQ ID NO: 1558323 - RNA, 13 nt, Homo sapiens
auuaaauuaggaa

SEQ ID NO: 1558324 - RNA, 17 nt, Homo sapiens
auuaaauucacaaacuu

SEQ ID NO: 1558325 - RNA, 22 nt, Homo sapiens
auuaaccuuacuaauuauacua

SEQ ID NO: 1558326 - RNA, 22 nt, Homo sapiens
auuaacuccuccugagcucuga

SEQ ID NO: 1558327 - RNA, 20 nt, Homo sapiens
auuaacugcacaaacaauau

SEQ ID NO: 1558328 - RNA, 15 nt, Homo sapiens
auuaagaagcaauaa

SEQ ID NO: 1558329 - RNA, 13 nt, Homo sapiens
auuaagaaugcca

SEQ ID NO: 1558330 - RNA, 22 nt, Homo sapiens
auuaagucccuuuuaguuugau

SEQ ID NO: 1558331 - RNA, 13 nt, Homo sapiens
auuaauaccaaag

SEQ ID NO: 1558332 - RNA, 19 nt, Homo sapiens
auuaauacucugcagugau

SEQ ID NO: 1558333 - RNA, 14 nt, Homo sapiens
auuaaucaccucuc

SEQ ID NO: 1558334 - RNA, 18 nt, Homo sapiens
auuaaugagaauuccuua

SEQ ID NO: 1558335 - RNA, 12 nt, Homo sapiens
auuaaugaugau

SEQ ID NO: 1558336 - RNA, 15 nt, Homo sapiens
auuaaugcacuuucu

SEQ ID NO: 1558337 - RNA, 19 nt, Homo sapiens
auuaauguaauaaagugaa

SEQ ID NO: 1558338 - RNA, 16 nt, Homo sapiens
auuaauugugcuguuu

SEQ ID NO: 1558339 - RNA, 16 nt, Homo sapiens
auuacaaaaaaacacg

SEQ ID NO: 1558340 - RNA, 22 nt, Homo sapiens
auuacaagcuguagaccaccua

SEQ ID NO: 1558341 - RNA, 16 nt, Homo sapiens
auuacaauacaucuaa

SEQ ID NO: 1558342 - RNA, 14 nt, Homo sapiens
auuacaauguaucu

SEQ ID NO: 1558343 - RNA, 22 nt, Homo sapiens
auuacacugaucuuauguguua

SEQ ID NO: 1558344 - RNA, 14 nt, Homo sapiens
auuacagugcaguu

SEQ ID NO: 1558345 - RNA, 16 nt, Homo sapiens
auuacagugcaguuua

SEQ ID NO: 1558346 - RNA, 19 nt, Homo sapiens
auuacauuucaaaccaauu

SEQ ID NO: 1558347 - RNA, 16 nt, Homo sapiens
auuaccaaaaucauuu

SEQ ID NO: 1558348 - RNA, 21 nt, Homo sapiens
auuaccacucaagaagacacu

SEQ ID NO: 1558349 - RNA, 14 nt, Homo sapiens
auuaccauuuguua

SEQ ID NO: 1558350 - RNA, 18 nt, Homo sapiens
auuacccaaauauaacca

SEQ ID NO: 1558351 - RNA, 16 nt, Homo sapiens
auuacccugagcugca

SEQ ID NO: 1558352 - RNA, 22 nt, Homo sapiens
auuaccgucauuggccugugaa

SEQ ID NO: 1558353 - RNA, 21 nt, Homo sapiens
auuaccugccaauugcuaccg

SEQ ID NO: 1558354 - RNA, 18 nt, Homo sapiens
auuaccuggucauuucaa

SEQ ID NO: 1558355 - RNA, 16 nt, Homo sapiens
auuacuaucauaauuc

SEQ ID NO: 1558356 - RNA, 23 nt, Homo sapiens
auuacuaucauaauucagcacuu

SEQ ID NO: 1558357 - RNA, 15 nt, Homo sapiens
auuacuaucauggca

SEQ ID NO: 1558358 - RNA, 18 nt, Homo sapiens
auuacugaaaaugauucc

SEQ ID NO: 1558359 - RNA, 18 nt, Homo sapiens
auuacugccuuacuguac

SEQ ID NO: 1558360 - RNA, 19 nt, Homo sapiens
auuacuugaaguauccaca

SEQ ID NO: 1558361 - RNA, 14 nt, Homo sapiens
auuagaaacuacca

SEQ ID NO: 1558362 - RNA, 15 nt, Homo sapiens
auuagcaaagcaaaa

SEQ ID NO: 1558363 - RNA, 13 nt, Homo sapiens
auuagccaaggau

SEQ ID NO: 1558364 - RNA, 19 nt, Homo sapiens
auuagccauuucacucuca

SEQ ID NO: 1558365 - RNA, 15 nt, Homo sapiens
auuaguaacugcaca

SEQ ID NO: 1558366 - RNA, 21 nt, Homo sapiens
auuagucuuuuguaauaucaa

SEQ ID NO: 1558367 - RNA, 20 nt, Homo sapiens
auuauaaaguucagauguuu

SEQ ID NO: 1558368 - RNA, 21 nt, Homo sapiens
auuauagaauucuguacuuga

SEQ ID NO: 1558369 - RNA, 14 nt, Homo sapiens
auuauagugaaaca

SEQ ID NO: 1558370 - RNA, 23 nt, Homo sapiens
auuauauaaagguggugggcaaa

SEQ ID NO: 1558371 - RNA, 15 nt, Homo sapiens
auuauaucugugaau

SEQ ID NO: 1558372 - RNA, 17 nt, Homo sapiens
auuauaugcacuagcaa

SEQ ID NO: 1558373 - RNA, 16 nt, Homo sapiens
auuauauuagucuguu

SEQ ID NO: 1558374 - RNA, 17 nt, Homo sapiens
auuauauuugugcuaua

SEQ ID NO: 1558375 - RNA, 23 nt, Homo sapiens
auuauauuugugugaaaauguga

SEQ ID NO: 1558376 - RNA, 15 nt, Homo sapiens
auuaucagaugcuuu

SEQ ID NO: 1558377 - RNA, 17 nt, Homo sapiens
auuaucuauuaucucaa

SEQ ID NO: 1558378 - RNA, 13 nt, Homo sapiens
auuaucucacuua

SEQ ID NO: 1558379 - RNA, 16 nt, Homo sapiens
auuaucuuugcuguua

SEQ ID NO: 1558380 - RNA, 13 nt, Homo sapiens
auuaugaaccgca

SEQ ID NO: 1558381 - RNA, 16 nt, Homo sapiens
auuaugagaggcaaug

SEQ ID NO: 1558382 - RNA, 18 nt, Homo sapiens
auuauggaauuacucuac

SEQ ID NO: 1558383 - RNA, 13 nt, Homo sapiens
auuaugugacuug

SEQ ID NO: 1558384 - RNA, 16 nt, Homo sapiens
auuaugugacuugcaa

SEQ ID NO: 1558385 - RNA, 17 nt, Homo sapiens
auuaugugacuugcaau

SEQ ID NO: 1558386 - RNA, 22 nt, Homo sapiens
auuauguguugccaaaaccaaa

SEQ ID NO: 1558387 - RNA, 12 nt, Homo sapiens
auuauucccaug

SEQ ID NO: 1558388 - RNA, 18 nt, Homo sapiens
auuauuguagacaugccc

SEQ ID NO: 1558389 - RNA, 16 nt, Homo sapiens
auuauuuacaagaaga

SEQ ID NO: 1558390 - RNA, 14 nt, Homo sapiens
auuauuucuaaucc

SEQ ID NO: 1558391 - RNA, 20 nt, Homo sapiens
auuauuuuuguuagcaaaga

SEQ ID NO: 1558392 - RNA, 14 nt, Homo sapiens
auucaaaagugauu

SEQ ID NO: 1558393 - RNA, 18 nt, Homo sapiens
auucaaacauuauucuca

SEQ ID NO: 1558394 - RNA, 20 nt, Homo sapiens
auucaaauccauagauuucg

SEQ ID NO: 1558395 - RNA, 14 nt, Homo sapiens
auucaaauucugcc

SEQ ID NO: 1558396 - RNA, 21 nt, Homo sapiens
auucaacucuccaauguucua

SEQ ID NO: 1558397 - RNA, 21 nt, Homo sapiens
auucaaggagaauaugauaaa

SEQ ID NO: 1558398 - RNA, 23 nt, Homo sapiens
auucaaucuuuggaggcuuuuaa

SEQ ID NO: 1558399 - RNA, 19 nt, Homo sapiens
auucacaagacccaaaagg

SEQ ID NO: 1558400 - RNA, 13 nt, Homo sapiens
auucacagcaagu

SEQ ID NO: 1558401 - RNA, 15 nt, Homo sapiens
auucacagugcaaga

SEQ ID NO: 1558402 - RNA, 17 nt, Homo sapiens
auucacccuucuuccca

SEQ ID NO: 1558403 - RNA, 20 nt, Homo sapiens
auucaccuguaaaacuuuau

SEQ ID NO: 1558404 - RNA, 18 nt, Homo sapiens
auucagcaaaaaucuccc

SEQ ID NO: 1558405 - RNA, 14 nt, Homo sapiens
auucaggacuugaa

SEQ ID NO: 1558406 - RNA, 17 nt, Homo sapiens
auucaggccagcccagc

SEQ ID NO: 1558407 - RNA, 20 nt, Homo sapiens
auucaguuucuaaaauugag

SEQ ID NO: 1558408 - RNA, 13 nt, Homo sapiens
auucauaauaugu

SEQ ID NO: 1558409 - RNA, 14 nt, Homo sapiens
cccugucucaaaaa

SEQ ID NO: 1558410 - RNA, 14 nt, Homo sapiens
cccuguggcacuca

SEQ ID NO: 1558411 - RNA, 23 nt, Homo sapiens
cccuguguggucuccaugcucac

SEQ ID NO: 1558412 - RNA, 17 nt, Homo sapiens
cccuguuuaacauuuca

SEQ ID NO: 1558413 - RNA, 22 nt, Homo sapiens
cccuuaacugacaugggccuuu

SEQ ID NO: 1558414 - RNA, 12 nt, Homo sapiens
cccuuaaguuca

SEQ ID NO: 1558415 - RNA, 19 nt, Homo sapiens
cccuuauucuaaagcugcc

SEQ ID NO: 1558416 - RNA, 23 nt, Homo sapiens
cccuuccgacaggagcacugcau

SEQ ID NO: 1558417 - RNA, 17 nt, Homo sapiens
cccuuccucccauuucc

SEQ ID NO: 1558418 - RNA, 19 nt, Homo sapiens
cccuuccucccauuuccca

SEQ ID NO: 1558419 - RNA, 15 nt, Homo sapiens
cccuuccuggcacau

SEQ ID NO: 1558420 - RNA, 14 nt, Homo sapiens
cccuucguguuucc

SEQ ID NO: 1558421 - RNA, 18 nt, Homo sapiens
cccuucuauacccaccca

SEQ ID NO: 1558422 - RNA, 18 nt, Homo sapiens
cccuugagaagcugccau

SEQ ID NO: 1558423 - RNA, 13 nt, Homo sapiens
cccuugcagcuag

SEQ ID NO: 1558424 - RNA, 15 nt, Homo sapiens
cccuuggacauuuua

SEQ ID NO: 1558425 - RNA, 16 nt, Homo sapiens
cccuugguacugaaaa

SEQ ID NO: 1558426 - RNA, 17 nt, Homo sapiens
cccuuucagaugucuuc

SEQ ID NO: 1558427 - RNA, 23 nt, Homo sapiens
cccuuuugggccuagaauucuga

SEQ ID NO: 1558428 - RNA, 18 nt, Homo sapiens
cccuuuuuuuacauuuca

SEQ ID NO: 1558429 - RNA, 21 nt, Homo sapiens
ccgacacugagcugugaccca

SEQ ID NO: 1558430 - RNA, 16 nt, Homo sapiens
ccgaccucaggugauc

SEQ ID NO: 1558431 - RNA, 17 nt, Homo sapiens
ccgagccuccaguccaa

SEQ ID NO: 1558432 - RNA, 17 nt, Homo sapiens
ccgaggcccucaaucca

SEQ ID NO: 1558433 - RNA, 13 nt, Homo sapiens
ccgagggcccaac

SEQ ID NO: 1558434 - RNA, 22 nt, Homo sapiens
ccgauaccgggacacagaauua

SEQ ID NO: 1558435 - RNA, 19 nt, Homo sapiens
ccgauauacucuagaugaa

SEQ ID NO: 1558436 - RNA, 15 nt, Homo sapiens
ccgauggccauguaa

SEQ ID NO: 1558437 - RNA, 19 nt, Homo sapiens
ccgcaaaagacaagucuuu

SEQ ID NO: 1558438 - RNA, 19 nt, Homo sapiens
ccgcagagccugacgcuca

SEQ ID NO: 1558439 - RNA, 22 nt, Homo sapiens
ccgcuucuccaagucugcugau

SEQ ID NO: 1558440 - RNA, 23 nt, Homo sapiens
ccggaggucgaggcuacagugag

SEQ ID NO: 1558441 - RNA, 17 nt, Homo sapiens
ccggcugguugugggca

SEQ ID NO: 1558442 - RNA, 20 nt, Homo sapiens
ccgggaagagggugauugcu

SEQ ID NO: 1558443 - RNA, 15 nt, Homo sapiens
ccgggagacucaaag

SEQ ID NO: 1558444 - RNA, 19 nt, Homo sapiens
ccgggaggcagccacaggg

SEQ ID NO: 1558445 - RNA, 13 nt, Homo sapiens
ccgggcauggugg

SEQ ID NO: 1558446 - RNA, 22 nt, Homo sapiens
ccgggccccucucuagggaccc

SEQ ID NO: 1558447 - RNA, 15 nt, Homo sapiens
ccgggcuggcccaag

SEQ ID NO: 1558448 - RNA, 21 nt, Homo sapiens
ccggggauucuguacaugcau

SEQ ID NO: 1558449 - RNA, 15 nt, Homo sapiens
ccggggccagcacuu

SEQ ID NO: 1558450 - RNA, 17 nt, Homo sapiens
ccguacaucugcaauau

SEQ ID NO: 1558451 - RNA, 21 nt, Homo sapiens
ccgucggacugcccccagaaa

SEQ ID NO: 1558452 - RNA, 22 nt, Homo sapiens
ccgucucaaaaaaaagaaaaug

SEQ ID NO: 1558453 - RNA, 13 nt, Homo sapiens
ccgucucuuuaaa

SEQ ID NO: 1558454 - RNA, 15 nt, Homo sapiens
ccgucuggaccuggg

SEQ ID NO: 1558455 - RNA, 11 nt, Homo sapiens
ccgucuucucc

SEQ ID NO: 1558456 - RNA, 22 nt, Homo sapiens
ccgugcucgcccacaaacugau

SEQ ID NO: 1558457 - RNA, 23 nt, Homo sapiens
ccgugguuucucaugagcugugu

SEQ ID NO: 1558458 - RNA, 13 nt, Homo sapiens
ccguuucuugcaa

SEQ ID NO: 1558459 - RNA, 18 nt, Homo sapiens
ccguuuucauuguucacu

SEQ ID NO: 1558460 - RNA, 15 nt, Homo sapiens
ccuaaaacaauccug

SEQ ID NO: 1558461 - RNA, 19 nt, Homo sapiens
ccuaaaagugggcuugauu

SEQ ID NO: 1558462 - RNA, 13 nt, Homo sapiens
ccuaaaaugcuuc

SEQ ID NO: 1558463 - RNA, 12 nt, Homo sapiens
ccuaaacuguau

SEQ ID NO: 1558464 - RNA, 17 nt, Homo sapiens
ccuaagcauguguccca

SEQ ID NO: 1558465 - RNA, 23 nt, Homo sapiens
ccuaaugaaagugaugacauauu

SEQ ID NO: 1558466 - RNA, 18 nt, Homo sapiens
ccuaauguuaaaugacga

SEQ ID NO: 1558467 - RNA, 16 nt, Homo sapiens
ccuaauuuaugugcua

SEQ ID NO: 1558468 - RNA, 21 nt, Homo sapiens
ccuacagaagggcagugacuc

SEQ ID NO: 1558469 - RNA, 13 nt, Homo sapiens
ccuaccccaguuc

SEQ ID NO: 1558470 - RNA, 22 nt, Homo sapiens
ccuacccugccucccuugacuu

SEQ ID NO: 1558471 - RNA, 21 nt, Homo sapiens
ccuaccucuccacaaggggau

SEQ ID NO: 1558472 - RNA, 15 nt, Homo sapiens
ccuacucuuugccaa

SEQ ID NO: 1558473 - RNA, 14 nt, Homo sapiens
ccuagaaagacaga

SEQ ID NO: 1558474 - RNA, 21 nt, Homo sapiens
ccuagaagucuuaauuguguu

SEQ ID NO: 1558475 - RNA, 15 nt, Homo sapiens
ccuagacaaaccauc

SEQ ID NO: 1558476 - RNA, 16 nt, Homo sapiens
ccuagaccugggcucc

SEQ ID NO: 1558477 - RNA, 20 nt, Homo sapiens
ccuagacucugucuaccugg

SEQ ID NO: 1558478 - RNA, 22 nt, Homo sapiens
ccuagacuggauagugggggug

SEQ ID NO: 1558479 - RNA, 23 nt, Homo sapiens
ccuagagguggaguucuuagcua

SEQ ID NO: 1558480 - RNA, 21 nt, Homo sapiens
ccuagagugacucuaccugca

SEQ ID NO: 1558481 - RNA, 17 nt, Homo sapiens
ccuagauuacaucugcc

SEQ ID NO: 1558482 - RNA, 21 nt, Homo sapiens
ccuagauuacaucugccuuaa

SEQ ID NO: 1558483 - RNA, 15 nt, Homo sapiens
ccuagcaauacaggg

SEQ ID NO: 1558484 - RNA, 15 nt, Homo sapiens
ccuaggauacccaga

SEQ ID NO: 1558485 - RNA, 14 nt, Homo sapiens
ccuaguagaacuca

SEQ ID NO: 1558486 - RNA, 20 nt, Homo sapiens
ccuauaauggguccccaaaa

SEQ ID NO: 1558487 - RNA, 19 nt, Homo sapiens
ccuauagcacugagcucac

SEQ ID NO: 1558488 - RNA, 22 nt, Homo sapiens
ccuauagcagaagcacauuuuc

SEQ ID NO: 1558489 - RNA, 23 nt, Homo sapiens
ccuauagcagaagcacauuuuca

SEQ ID NO: 1558490 - RNA, 23 nt, Homo sapiens
ccuaucuaacccucccauggcac

SEQ ID NO: 1558491 - RNA, 13 nt, Homo sapiens
ccuaucugaccaa

SEQ ID NO: 1558492 - RNA, 18 nt, Homo sapiens
ccuaucuuccuuccucuc

SEQ ID NO: 1558493 - RNA, 12 nt, Homo sapiens
ccuaugcaaaua

SEQ ID NO: 1558494 - RNA, 12 nt, Homo sapiens
ccuaugcaauaa

SEQ ID NO: 1558495 - RNA, 21 nt, Homo sapiens
ccuaugcacugaagagcucuu

SEQ ID NO: 1558496 - RNA, 16 nt, Homo sapiens
ccuaugcccagggaau

SEQ ID NO: 1558497 - RNA, 20 nt, Homo sapiens
ccuaugcugcaauacauuaa

SEQ ID NO: 1558498 - RNA, 20 nt, Homo sapiens
ccuaugggucuaggacacag

SEQ ID NO: 1558499 - RNA, 23 nt, Homo sapiens
ccuauggucacagacuucuggcc

SEQ ID NO: 1558500 - RNA, 17 nt, Homo sapiens
ccuauuuuucaauggga

SEQ ID NO: 1558501 - RNA, 22 nt, Homo sapiens
ccucaaauacaugcacagucau

SEQ ID NO: 1558502 - RNA, 21 nt, Homo sapiens
ccucaacauugcauggugcua

SEQ ID NO: 1558503 - RNA, 18 nt, Homo sapiens
ccucaacuccgugcuuaa

SEQ ID NO: 1558504 - RNA, 11 nt, Homo sapiens
ccucaagaaga

SEQ ID NO: 1558505 - RNA, 17 nt, Homo sapiens
ccucaauccuaucacag

SEQ ID NO: 1558506 - RNA, 19 nt, Homo sapiens
ccucaauccuccauuugcu

SEQ ID NO: 1558507 - RNA, 23 nt, Homo sapiens
ccucacaaaccugaauggucuga

SEQ ID NO: 1558508 - RNA, 13 nt, Homo sapiens
ccucacaguccca

SEQ ID NO: 1558509 - RNA, 18 nt, Homo sapiens
ccucacccaucaaaagca

SEQ ID NO: 1558510 - RNA, 14 nt, Homo sapiens
ccucacccauccua

SEQ ID NO: 1558511 - RNA, 20 nt, Homo sapiens
ccucacccccuccuucauau

SEQ ID NO: 1558512 - RNA, 22 nt, Homo sapiens
ccucaccuagccugaugagauu

SEQ ID NO: 1558513 - RNA, 22 nt, Homo sapiens
ccucacucuguuuccuggucag

SEQ ID NO: 1558514 - RNA, 23 nt, Homo sapiens
ccucacucuuuauagugcacaaa

SEQ ID NO: 1558515 - RNA, 23 nt, Homo sapiens
ccucacugcuguagacauuugcu

SEQ ID NO: 1558516 - RNA, 19 nt, Homo sapiens
ccucacuggggcagacaau

SEQ ID NO: 1558517 - RNA, 15 nt, Homo sapiens
ccucagaauccacaa

SEQ ID NO: 1558518 - RNA, 17 nt, Homo sapiens
ccucagaauugaucauu

SEQ ID NO: 1558519 - RNA, 12 nt, Homo sapiens
ccucagauucca

SEQ ID NO: 1558520 - RNA, 14 nt, Homo sapiens
ccucagccaugagg

SEQ ID NO: 1558521 - RNA, 19 nt, Homo sapiens
ccucagccuaagaaacacu

SEQ ID NO: 1558522 - RNA, 21 nt, Homo sapiens
ccucagccuuccaacuagcug

SEQ ID NO: 1558523 - RNA, 20 nt, Homo sapiens
ccucagcugccucacuuccu

SEQ ID NO: 1558524 - RNA, 14 nt, Homo sapiens
ccucaggcccagga

SEQ ID NO: 1558525 - RNA, 23 nt, Homo sapiens
ccucaggcccaggaguccaggcc

SEQ ID NO: 1558526 - RNA, 18 nt, Homo sapiens
ccuuugcucucuggccac

SEQ ID NO: 1558527 - RNA, 21 nt, Homo sapiens
ccuuuggggugaacuaccuug

SEQ ID NO: 1558528 - RNA, 16 nt, Homo sapiens
ccuuugugagucaaua

SEQ ID NO: 1558529 - RNA, 15 nt, Homo sapiens
ccuuuuaaguuugaa

SEQ ID NO: 1558530 - RNA, 18 nt, Homo sapiens
ccuuuuaccccugcacag

SEQ ID NO: 1558531 - RNA, 19 nt, Homo sapiens
ccuuuuagggaauaauauu

SEQ ID NO: 1558532 - RNA, 14 nt, Homo sapiens
ccuuuuauaauacu

SEQ ID NO: 1558533 - RNA, 14 nt, Homo sapiens
ccuuuuauguguug

SEQ ID NO: 1558534 - RNA, 20 nt, Homo sapiens
ccuuuuccaggaguucugaa

SEQ ID NO: 1558535 - RNA, 18 nt, Homo sapiens
ccuuuuccccagucccag

SEQ ID NO: 1558536 - RNA, 21 nt, Homo sapiens
ccuuuucuuuguucaagauga

SEQ ID NO: 1558537 - RNA, 13 nt, Homo sapiens
ccuuuugcauugc

SEQ ID NO: 1558538 - RNA, 18 nt, Homo sapiens
ccuuuuggcauguuccca

SEQ ID NO: 1558539 - RNA, 19 nt, Homo sapiens
ccuuuuuauucagcuagaa

SEQ ID NO: 1558540 - RNA, 12 nt, Homo sapiens
ccuuuuucauaa

SEQ ID NO: 1558541 - RNA, 17 nt, Homo sapiens
ccuuuuuccauaguguu

SEQ ID NO: 1558542 - RNA, 14 nt, Homo sapiens
ccuuuuuccuguga

SEQ ID NO: 1558543 - RNA, 17 nt, Homo sapiens
ccuuuuuguuucaauga

SEQ ID NO: 1558544 - RNA, 16 nt, Homo sapiens
cgaagccuuaacuuua

SEQ ID NO: 1558545 - RNA, 20 nt, Homo sapiens
cgacacugagcugugaccca

SEQ ID NO: 1558546 - RNA, 23 nt, Homo sapiens
cgacagaggagcuuuucuggaau

SEQ ID NO: 1558547 - RNA, 19 nt, Homo sapiens
cgaccacuuccaggggaac

SEQ ID NO: 1558548 - RNA, 11 nt, Homo sapiens
cgacccauuca

SEQ ID NO: 1558549 - RNA, 17 nt, Homo sapiens
cgacuaauuucaaaaug

SEQ ID NO: 1558550 - RNA, 13 nt, Homo sapiens
cgacugggcucaa

SEQ ID NO: 1558551 - RNA, 17 nt, Homo sapiens
cgacuuagccugaguca

SEQ ID NO: 1558552 - RNA, 12 nt, Homo sapiens
cgagaaccaguu

SEQ ID NO: 1558553 - RNA, 21 nt, Homo sapiens
cgagacuccaccucuaccaaa

SEQ ID NO: 1558554 - RNA, 19 nt, Homo sapiens
cgagagcuuggacuacaca

SEQ ID NO: 1558555 - RNA, 14 nt, Homo sapiens
cgagauugcacugc

SEQ ID NO: 1558556 - RNA, 15 nt, Homo sapiens
cgagccaccaugcuu

SEQ ID NO: 1558557 - RNA, 23 nt, Homo sapiens
cgagggaggaacaccugaucuua

SEQ ID NO: 1558558 - RNA, 22 nt, Homo sapiens
cgaggguaugucagugucacug

SEQ ID NO: 1558559 - RNA, 19 nt, Homo sapiens
cgaguaacuccccucaggg

SEQ ID NO: 1558560 - RNA, 10 nt, Homo sapiens
cgaguacuuc

SEQ ID NO: 1558561 - RNA, 15 nt, Homo sapiens
cgagucauggcuaau

SEQ ID NO: 1558562 - RNA, 19 nt, Homo sapiens
cgagugaaacuccgucuca

SEQ ID NO: 1558563 - RNA, 14 nt, Homo sapiens
cgaguuaagaacau

SEQ ID NO: 1558564 - RNA, 14 nt, Homo sapiens
cgaguuccagaccc

SEQ ID NO: 1558565 - RNA, 14 nt, Homo sapiens
cgauaucagaauuu

SEQ ID NO: 1558566 - RNA, 18 nt, Homo sapiens
cgauccuggauucacuca

SEQ ID NO: 1558567 - RNA, 19 nt, Homo sapiens
cgaucucagcucaccucaa

SEQ ID NO: 1558568 - RNA, 19 nt, Homo sapiens
cgaugaaguuaugcuguca

SEQ ID NO: 1558569 - RNA, 14 nt, Homo sapiens
cgaugacaguguuc

SEQ ID NO: 1558570 - RNA, 20 nt, Homo sapiens
cgauuccuuuauauuugcuc

SEQ ID NO: 1558571 - RNA, 20 nt, Homo sapiens
cgauuuaugccucagccacu

SEQ ID NO: 1558572 - RNA, 13 nt, Homo sapiens
cgauuucuuugua

SEQ ID NO: 1558573 - RNA, 16 nt, Homo sapiens
cgcaaugugacuuaau

SEQ ID NO: 1558574 - RNA, 16 nt, Homo sapiens
cgcaggccagcaacuc

SEQ ID NO: 1558575 - RNA, 18 nt, Homo sapiens
cgcaguuuggagucacug

SEQ ID NO: 1558576 - RNA, 16 nt, Homo sapiens
cgcauuggugacucac

SEQ ID NO: 1558577 - RNA, 17 nt, Homo sapiens
cgccacugguacccgcc

SEQ ID NO: 1558578 - RNA, 15 nt, Homo sapiens
cgccagcagcuguca

SEQ ID NO: 1558579 - RNA, 17 nt, Homo sapiens
cgcccgucucuuucuca

SEQ ID NO: 1558580 - RNA, 12 nt, Homo sapiens
cgcccucagggg

SEQ ID NO: 1558581 - RNA, 14 nt, Homo sapiens
cgccgccgcugccc

SEQ ID NO: 1558582 - RNA, 21 nt, Homo sapiens
cgccugccaguccuagcugca

SEQ ID NO: 1558583 - RNA, 16 nt, Homo sapiens
cgccugcccagacuga

SEQ ID NO: 1558584 - RNA, 20 nt, Homo sapiens
cgccuguaaucccagcacuu

SEQ ID NO: 1558585 - RNA, 15 nt, Homo sapiens
cgccuucucccacau

SEQ ID NO: 1558586 - RNA, 11 nt, Homo sapiens
cgcgacuucca

SEQ ID NO: 1558587 - RNA, 19 nt, Homo sapiens
cgcgcucgcccagcaggag

SEQ ID NO: 1558588 - RNA, 17 nt, Homo sapiens
cgcuaauucaaggaauu

SEQ ID NO: 1558589 - RNA, 22 nt, Homo sapiens
cgcuagagauugcuacaaaucu

SEQ ID NO: 1558590 - RNA, 13 nt, Homo sapiens
cgcucacucccuc

SEQ ID NO: 1558591 - RNA, 12 nt, Homo sapiens
cgcucugucacc

SEQ ID NO: 1558592 - RNA, 20 nt, Homo sapiens
cgcugcugugcucuggggau

SEQ ID NO: 1558593 - RNA, 17 nt, Homo sapiens
cggacugcccccagaaa

SEQ ID NO: 1558594 - RNA, 18 nt, Homo sapiens
cggagagagaauguauuu

SEQ ID NO: 1558595 - RNA, 20 nt, Homo sapiens
cggagcaggggucugagcca

SEQ ID NO: 1558596 - RNA, 13 nt, Homo sapiens
cggaggacugagc

SEQ ID NO: 1558597 - RNA, 23 nt, Homo sapiens
cggauggaccaaccugcucuguc

SEQ ID NO: 1558598 - RNA, 17 nt, Homo sapiens
cggcaagcgagcacagu

SEQ ID NO: 1558599 - RNA, 13 nt, Homo sapiens
cggccacaccccu

SEQ ID NO: 1558600 - RNA, 14 nt, Homo sapiens
cggcccugaccaau

SEQ ID NO: 1558601 - RNA, 12 nt, Homo sapiens
cggccucagugc

SEQ ID NO: 1558602 - RNA, 15 nt, Homo sapiens
cggcgaagaggaccc

SEQ ID NO: 1558603 - RNA, 15 nt, Homo sapiens
cggcuacucuggaau

SEQ ID NO: 1558604 - RNA, 21 nt, Homo sapiens
cggcugguugugggcacuggc

SEQ ID NO: 1558605 - RNA, 15 nt, Homo sapiens
cggcuuuaagugugc

SEQ ID NO: 1558606 - RNA, 22 nt, Homo sapiens
cgggaacuggagucugucucuu

SEQ ID NO: 1558607 - RNA, 19 nt, Homo sapiens
cgggacugcugcucuccca

SEQ ID NO: 1558608 - RNA, 21 nt, Homo sapiens
cgggagaagaaguuugaccau

SEQ ID NO: 1558609 - RNA, 18 nt, Homo sapiens
cgggagacucaaagggag

SEQ ID NO: 1558610 - RNA, 21 nt, Homo sapiens
cgggaugguucuucuccaguu

SEQ ID NO: 1558611 - RNA, 21 nt, Homo sapiens
cggggacgcccccaccagcuc

SEQ ID NO: 1558612 - RNA, 19 nt, Homo sapiens
cgggggugaugugaaaaag

SEQ ID NO: 1558613 - RNA, 16 nt, Homo sapiens
cgggugcaagcacucg

SEQ ID NO: 1558614 - RNA, 20 nt, Homo sapiens
cggguggaucaccugagguc

SEQ ID NO: 1558615 - RNA, 17 nt, Homo sapiens
cggucagccacaccagg

SEQ ID NO: 1558616 - RNA, 14 nt, Homo sapiens
cggucagugccuuu

SEQ ID NO: 1558617 - RNA, 16 nt, Homo sapiens
cggucucauuucuucu

SEQ ID NO: 1558618 - RNA, 14 nt, Homo sapiens
cggugcuccaucuc

SEQ ID NO: 1558619 - RNA, 17 nt, Homo sapiens
cgguggcugccccggcc

SEQ ID NO: 1558620 - RNA, 17 nt, Homo sapiens
cguaagugguaugcaug

SEQ ID NO: 1558621 - RNA, 17 nt, Homo sapiens
cguaauuguacaagcag

SEQ ID NO: 1558622 - RNA, 18 nt, Homo sapiens
cguaccaccaugcacugu

SEQ ID NO: 1558623 - RNA, 14 nt, Homo sapiens
cguaguucccugaa

SEQ ID NO: 1558624 - RNA, 16 nt, Homo sapiens
cguauaaugcuuucug

SEQ ID NO: 1558625 - RNA, 20 nt, Homo sapiens
cguaugccaccaacuuacaa

SEQ ID NO: 1558626 - RNA, 14 nt, Homo sapiens
cgucaagucuaaac

SEQ ID NO: 1558627 - RNA, 21 nt, Homo sapiens
cguccacuccuccuacuguau

SEQ ID NO: 1558628 - RNA, 17 nt, Homo sapiens
cgucccacaucagggcg

SEQ ID NO: 1558629 - RNA, 14 nt, Homo sapiens
cguccccaguugcc

SEQ ID NO: 1558630 - RNA, 13 nt, Homo sapiens
cguccuacuguau

SEQ ID NO: 1558631 - RNA, 14 nt, Homo sapiens
cgucuaacuggaaa

SEQ ID NO: 1558632 - RNA, 15 nt, Homo sapiens
cgucuccucccucag

SEQ ID NO: 1558633 - RNA, 19 nt, Homo sapiens
cgucugcuccaaugacuga

SEQ ID NO: 1558634 - RNA, 9 nt, Homo sapiens
cgucuuccc

SEQ ID NO: 1558635 - RNA, 18 nt, Homo sapiens
cgugacgaggcucaaaaa

SEQ ID NO: 1558636 - RNA, 22 nt, Homo sapiens
cgugaguaguuguuggucugua

SEQ ID NO: 1558637 - RNA, 16 nt, Homo sapiens
cgugcacuccccgugu

SEQ ID NO: 1558638 - RNA, 13 nt, Homo sapiens
cgugcccggccaa

SEQ ID NO: 1558639 - RNA, 23 nt, Homo sapiens
cgugccugcuacgaacgcuccaa

SEQ ID NO: 1558640 - RNA, 15 nt, Homo sapiens
cgugggaacaacugg

SEQ ID NO: 1558641 - RNA, 21 nt, Homo sapiens
cguguggaugagcgugcacuc

SEQ ID NO: 1558642 - RNA, 20 nt, Homo sapiens
cgugugugugugugcacauc

SEQ ID NO: 1558643 - RNA, 21 nt, Homo sapiens
cguuacuaaaaguacauuaaa

SEQ ID NO: 1558644 - RNA, 17 nt, Homo sapiens
cguuaguucuacauuau

SEQ ID NO: 1558645 - RNA, 19 nt, Homo sapiens
cuagaaccaagaagggcua

SEQ ID NO: 1558646 - RNA, 19 nt, Homo sapiens
cuagaaccuagaagggcua

SEQ ID NO: 1558647 - RNA, 17 nt, Homo sapiens
cuagaaccucucguagu

SEQ ID NO: 1558648 - RNA, 19 nt, Homo sapiens
cuagaaccuggaagggcua

SEQ ID NO: 1558649 - RNA, 13 nt, Homo sapiens
cuagaaccuggag

SEQ ID NO: 1558650 - RNA, 15 nt, Homo sapiens
cuagaagccaaggga

SEQ ID NO: 1558651 - RNA, 23 nt, Homo sapiens
cuagaagugguuuccugauaaca

SEQ ID NO: 1558652 - RNA, 22 nt, Homo sapiens
cuagaaucauacuuaacauuuc

SEQ ID NO: 1558653 - RNA, 12 nt, Homo sapiens
cuagaaugagca

SEQ ID NO: 1558654 - RNA, 17 nt, Homo sapiens
cuagaccucaguuauuu

SEQ ID NO: 1558655 - RNA, 13 nt, Homo sapiens
cuagagacagaug

SEQ ID NO: 1558656 - RNA, 22 nt, Homo sapiens
cuagagcuagaugugucuuacc

SEQ ID NO: 1558657 - RNA, 20 nt, Homo sapiens
cuagagugcgguggcgcgau

SEQ ID NO: 1558658 - RNA, 13 nt, Homo sapiens
cuagaugcacgug

SEQ ID NO: 1558659 - RNA, 14 nt, Homo sapiens
cuagaugugucuua

SEQ ID NO: 1558660 - RNA, 20 nt, Homo sapiens
cuagauuacaucugccuuaa

SEQ ID NO: 1558661 - RNA, 19 nt, Homo sapiens
cuagcaacauuuguuuuag

SEQ ID NO: 1558662 - RNA, 23 nt, Homo sapiens
cuagcacugccccacaugcaugu

SEQ ID NO: 1558663 - RNA, 14 nt, Homo sapiens
cuagccagcuguca

SEQ ID NO: 1558664 - RNA, 22 nt, Homo sapiens
cuagccuuggccucuuuccuca

SEQ ID NO: 1558665 - RNA, 19 nt, Homo sapiens
cuagcugggacuacaggug

SEQ ID NO: 1558666 - RNA, 23 nt, Homo sapiens
cuagcuuacugaguuaucaggug

SEQ ID NO: 1558667 - RNA, 19 nt, Homo sapiens
cuaggcgauuuugucuacc

SEQ ID NO: 1558668 - RNA, 20 nt, Homo sapiens
cuaggcucagagaugugcac

SEQ ID NO: 1558669 - RNA, 18 nt, Homo sapiens
cuaggcugcccacucucc

SEQ ID NO: 1558670 - RNA, 22 nt, Homo sapiens
cuagggacaugaaauuuacaaa

SEQ ID NO: 1558671 - RNA, 14 nt, Homo sapiens
cuagggaucccuca

SEQ ID NO: 1558672 - RNA, 15 nt, Homo sapiens
cuagggaucccucau

SEQ ID NO: 1558673 - RNA, 19 nt, Homo sapiens
cuagggauucaggcugcuu

SEQ ID NO: 1558674 - RNA, 17 nt, Homo sapiens
cuaggugcuauuuguca

SEQ ID NO: 1558675 - RNA, 22 nt, Homo sapiens
cuaguaaguaauuaugcacuaa

SEQ ID NO: 1558676 - RNA, 13 nt, Homo sapiens
cuaguacuauuau

SEQ ID NO: 1558677 - RNA, 19 nt, Homo sapiens
cuaguagcugggauuacag

SEQ ID NO: 1558678 - RNA, 13 nt, Homo sapiens
cuagucacaaaga

SEQ ID NO: 1558679 - RNA, 14 nt, Homo sapiens
cuagucaguuggcu

SEQ ID NO: 1558680 - RNA, 23 nt, Homo sapiens
cuagucauuaacccaucucugaa

SEQ ID NO: 1558681 - RNA, 23 nt, Homo sapiens
cuagugcuuuucagugauacuca

SEQ ID NO: 1558682 - RNA, 13 nt, Homo sapiens
cuagugggaguua

SEQ ID NO: 1558683 - RNA, 16 nt, Homo sapiens
cuagugguauggggcu

SEQ ID NO: 1558684 - RNA, 23 nt, Homo sapiens
cuaguuugcucauacuacauuga

SEQ ID NO: 1558685 - RNA, 14 nt, Homo sapiens
cuauaacuaagcau

SEQ ID NO: 1558686 - RNA, 20 nt, Homo sapiens
cuauaagaauaaggcuuuuu

SEQ ID NO: 1558687 - RNA, 20 nt, Homo sapiens
cuauaagaugaaacaucauu

SEQ ID NO: 1558688 - RNA, 18 nt, Homo sapiens
cuauaaggccauaaaaca

SEQ ID NO: 1558689 - RNA, 12 nt, Homo sapiens
cuauacaaguug

SEQ ID NO: 1558690 - RNA, 18 nt, Homo sapiens
cuauagggugugaugaag

SEQ ID NO: 1558691 - RNA, 21 nt, Homo sapiens
cuauagggugugaugaaguca

SEQ ID NO: 1558692 - RNA, 13 nt, Homo sapiens
cuauauaccucac

SEQ ID NO: 1558693 - RNA, 19 nt, Homo sapiens
cuauauaccucacuagcca

SEQ ID NO: 1558694 - RNA, 17 nt, Homo sapiens
cuauaucaaaaaaccuu

SEQ ID NO: 1558695 - RNA, 14 nt, Homo sapiens
cuauaugauaugca

SEQ ID NO: 1558696 - RNA, 21 nt, Homo sapiens
cuauauggcaaauagccacaa

SEQ ID NO: 1558697 - RNA, 18 nt, Homo sapiens
cuauauugcuuaccugau

SEQ ID NO: 1558698 - RNA, 13 nt, Homo sapiens
cuaucaacaaaga

SEQ ID NO: 1558699 - RNA, 14 nt, Homo sapiens
cuaucaagcacuaa

SEQ ID NO: 1558700 - RNA, 12 nt, Homo sapiens
cuaucacagggu

SEQ ID NO: 1558701 - RNA, 16 nt, Homo sapiens
cuaucauggugaaaag

SEQ ID NO: 1558702 - RNA, 22 nt, Homo sapiens
cuaucauuggccuccaaacaca

SEQ ID NO: 1558703 - RNA, 17 nt, Homo sapiens
cuaucccuaggcacuua

SEQ ID NO: 1558704 - RNA, 18 nt, Homo sapiens
cuaucccugcggccucca

SEQ ID NO: 1558705 - RNA, 20 nt, Homo sapiens
cuauccguguugcagguuca

SEQ ID NO: 1558706 - RNA, 12 nt, Homo sapiens
cuauccuuccag

SEQ ID NO: 1558707 - RNA, 14 nt, Homo sapiens
cuaucuacuacaaa

SEQ ID NO: 1558708 - RNA, 23 nt, Homo sapiens
cuaucucagccauaggugcaguu

SEQ ID NO: 1558709 - RNA, 14 nt, Homo sapiens
cuaucucuacugaa

SEQ ID NO: 1558710 - RNA, 19 nt, Homo sapiens
cuaucugggcugugggcaa

SEQ ID NO: 1558711 - RNA, 14 nt, Homo sapiens
cuaucuugauuuga

SEQ ID NO: 1558712 - RNA, 16 nt, Homo sapiens
cuaugaaaagcacaag

SEQ ID NO: 1558713 - RNA, 20 nt, Homo sapiens
cuaugaaaaugagcccuggc

SEQ ID NO: 1558714 - RNA, 22 nt, Homo sapiens
cuaugaaaugacuucuuaaaua

SEQ ID NO: 1558715 - RNA, 24 nt, Homo sapiens
cuaugaacagaaacuacauuucua

SEQ ID NO: 1558716 - RNA, 17 nt, Homo sapiens
cuaugaauuuucaagua

SEQ ID NO: 1558717 - RNA, 14 nt, Homo sapiens
cuaugagccaggca

SEQ ID NO: 1558718 - RNA, 17 nt, Homo sapiens
cuaugauaauuauuuac

SEQ ID NO: 1558719 - RNA, 17 nt, Homo sapiens
cuaugauauaacaugug

SEQ ID NO: 1558720 - RNA, 18 nt, Homo sapiens
cuaugcauuaagaguaaa

SEQ ID NO: 1558721 - RNA, 14 nt, Homo sapiens
cuaugccuguggug

SEQ ID NO: 1558722 - RNA, 22 nt, Homo sapiens
cuaugcgggggugccuaaggag

SEQ ID NO: 1558723 - RNA, 14 nt, Homo sapiens
cuaugcugcaauac

SEQ ID NO: 1558724 - RNA, 23 nt, Homo sapiens
cuaugcuggauaagaaauggugg

SEQ ID NO: 1558725 - RNA, 14 nt, Homo sapiens
cuauggccagucug

SEQ ID NO: 1558726 - RNA, 22 nt, Homo sapiens
cuaugugauucuggaagcaaau

SEQ ID NO: 1558727 - RNA, 14 nt, Homo sapiens
cuauguuauauuga

SEQ ID NO: 1558728 - RNA, 11 nt, Homo sapiens
cuauguucccc

SEQ ID NO: 1558729 - RNA, 15 nt, Homo sapiens
cuauguuucaucuug

SEQ ID NO: 1558730 - RNA, 20 nt, Homo sapiens
cuauguuugcggaaugcauu

SEQ ID NO: 1558731 - RNA, 19 nt, Homo sapiens
cuauuaaaugagcacguuu

SEQ ID NO: 1558732 - RNA, 18 nt, Homo sapiens
cuauuacuaguacuauua

SEQ ID NO: 1558733 - RNA, 19 nt, Homo sapiens
cuauuacugaugugugcaa

SEQ ID NO: 1558734 - RNA, 13 nt, Homo sapiens
cuauuaucucaau

SEQ ID NO: 1558735 - RNA, 19 nt, Homo sapiens
cuauuauggaaaacugugu

SEQ ID NO: 1558736 - RNA, 14 nt, Homo sapiens
cuauucuugauuua

SEQ ID NO: 1558737 - RNA, 16 nt, Homo sapiens
cuauuuaagugcaauu

SEQ ID NO: 1558738 - RNA, 21 nt, Homo sapiens
cuauuuauuuauuuauucauu

SEQ ID NO: 1558739 - RNA, 23 nt, Homo sapiens
cuauuucaucuauuuuuggcagu

SEQ ID NO: 1558740 - RNA, 18 nt, Homo sapiens
cuauuuccaaaagcacau

SEQ ID NO: 1558741 - RNA, 16 nt, Homo sapiens
cuauuucuccaaagcc

SEQ ID NO: 1558742 - RNA, 14 nt, Homo sapiens
cuauuuguacaauu

SEQ ID NO: 1558743 - RNA, 15 nt, Homo sapiens
cuauuuugagcauua

SEQ ID NO: 1558744 - RNA, 17 nt, Homo sapiens
cuauuuugugaagccau

SEQ ID NO: 1558745 - RNA, 15 nt, Homo sapiens
cuauuuuuaaugcac

SEQ ID NO: 1558746 - RNA, 16 nt, Homo sapiens
cucaaaacugcacugu

SEQ ID NO: 1558747 - RNA, 13 nt, Homo sapiens
cucaaaaucuuuc

SEQ ID NO: 1558748 - RNA, 21 nt, Homo sapiens
cucaaaauuuaacaguuaccu

SEQ ID NO: 1558749 - RNA, 12 nt, Homo sapiens
cucaaacucauu

SEQ ID NO: 1558750 - RNA, 18 nt, Homo sapiens
cucaaacuccugaccuca

SEQ ID NO: 1558751 - RNA, 16 nt, Homo sapiens
cucaaacuuccaguca

SEQ ID NO: 1558752 - RNA, 22 nt, Homo sapiens
cucaaagaagucggaaugucau

SEQ ID NO: 1558753 - RNA, 23 nt, Homo sapiens
cucaaagaagucggaaugucaua

SEQ ID NO: 1558754 - RNA, 19 nt, Homo sapiens
cucaaagggagaggucuca

SEQ ID NO: 1558755 - RNA, 21 nt, Homo sapiens
cucaaauacaugcacagucau

SEQ ID NO: 1558756 - RNA, 22 nt, Homo sapiens
cucaacggcuccaucaccagcc

SEQ ID NO: 1558757 - RNA, 22 nt, Homo sapiens
cucaauaaacagucacuggaaa

SEQ ID NO: 1558758 - RNA, 19 nt, Homo sapiens
cucaaucccugaggacuga

SEQ ID NO: 1558759 - RNA, 15 nt, Homo sapiens
cucaauccuaucaca

SEQ ID NO: 1558760 - RNA, 18 nt, Homo sapiens
cucaaucucccuggggca

SEQ ID NO: 1558761 - RNA, 23 nt, Homo sapiens
cucaaugcaauggcucaucagau

SEQ ID NO: 1558762 - RNA, 23 nt, Homo sapiens
cucaauuuaguuuguuauuuauc

SEQ ID NO: 1558763 - RNA, 14 nt, Homo sapiens
gcccagacugauga

SEQ ID NO: 1558764 - RNA, 23 nt, Homo sapiens
gcccagagugagcuuuagcucuc

SEQ ID NO: 1558765 - RNA, 21 nt, Homo sapiens
gcccagcaaagucugcaucug

SEQ ID NO: 1558766 - RNA, 13 nt, Homo sapiens
gcccagcccagcu

SEQ ID NO: 1558767 - RNA, 21 nt, Homo sapiens
gcccagcccuggcccaggugc

SEQ ID NO: 1558768 - RNA, 19 nt, Homo sapiens
gcccagccuggaugccauc

SEQ ID NO: 1558769 - RNA, 15 nt, Homo sapiens
gcccaggagccucac

SEQ ID NO: 1558770 - RNA, 20 nt, Homo sapiens
gcccaggcugggaacucauc

SEQ ID NO: 1558771 - RNA, 19 nt, Homo sapiens
gcccaggucagccacuguu

SEQ ID NO: 1558772 - RNA, 15 nt, Homo sapiens
gcccaguacauuuaa

SEQ ID NO: 1558773 - RNA, 14 nt, Homo sapiens
gcccauaaccagua

SEQ ID NO: 1558774 - RNA, 19 nt, Homo sapiens
gcccaugcccaccugccca

SEQ ID NO: 1558775 - RNA, 16 nt, Homo sapiens
gcccauuucuccauac

SEQ ID NO: 1558776 - RNA, 17 nt, Homo sapiens
gccccaaagacagcucc

SEQ ID NO: 1558777 - RNA, 16 nt, Homo sapiens
gccccacauggcuuag

SEQ ID NO: 1558778 - RNA, 16 nt, Homo sapiens
gccccaggcauugcca

SEQ ID NO: 1558779 - RNA, 19 nt, Homo sapiens
gccccaggcauugccaagg

SEQ ID NO: 1558780 - RNA, 15 nt, Homo sapiens
gccccaugccugucc

SEQ ID NO: 1558781 - RNA, 22 nt, Homo sapiens
gcccccaaccccuccucccuca

SEQ ID NO: 1558782 - RNA, 20 nt, Homo sapiens
gcccccaauaaaggcagcug

SEQ ID NO: 1558783 - RNA, 21 nt, Homo sapiens
gcccccaccggaacugggcug

SEQ ID NO: 1558784 - RNA, 18 nt, Homo sapiens
gcccccacuguccuguga

SEQ ID NO: 1558785 - RNA, 16 nt, Homo sapiens
gcccccuuucagaugu

SEQ ID NO: 1558786 - RNA, 17 nt, Homo sapiens
gccccgugggcugugcc

SEQ ID NO: 1558787 - RNA, 16 nt, Homo sapiens
gccccuacccuggacu

SEQ ID NO: 1558788 - RNA, 18 nt, Homo sapiens
gccccuccccagacucuc

SEQ ID NO: 1558789 - RNA, 15 nt, Homo sapiens
gccccuccucccuca

SEQ ID NO: 1558790 - RNA, 16 nt, Homo sapiens
gccccuccucccucaa

SEQ ID NO: 1558791 - RNA, 15 nt, Homo sapiens
gccccucucuaggga

SEQ ID NO: 1558792 - RNA, 18 nt, Homo sapiens
gccccuggagccucagaa

SEQ ID NO: 1558793 - RNA, 13 nt, Homo sapiens
gccccuucuuauu

SEQ ID NO: 1558794 - RNA, 22 nt, Homo sapiens
gccccuugggagacuccaggga

SEQ ID NO: 1558795 - RNA, 21 nt, Homo sapiens
gcccucaccccugguucucau

SEQ ID NO: 1558796 - RNA, 18 nt, Homo sapiens
gcccuccccacaaugcca

SEQ ID NO: 1558797 - RNA, 21 nt, Homo sapiens
gcccugaccaaugugugaagu

SEQ ID NO: 1558798 - RNA, 17 nt, Homo sapiens
gcccugacuccuggacu

SEQ ID NO: 1558799 - RNA, 17 nt, Homo sapiens
gcccugaggccuagacu

SEQ ID NO: 1558800 - RNA, 17 nt, Homo sapiens
gcccugcacgucauggg

SEQ ID NO: 1558801 - RNA, 19 nt, Homo sapiens
gcccugcagcccaccagac

SEQ ID NO: 1558802 - RNA, 16 nt, Homo sapiens
gcccugcugugggaga

SEQ ID NO: 1558803 - RNA, 17 nt, Homo sapiens
gcccuggcaugucaaca

SEQ ID NO: 1558804 - RNA, 19 nt, Homo sapiens
gcccugggccccaccaccu

SEQ ID NO: 1558805 - RNA, 19 nt, Homo sapiens
gcccugguguguuuccaga

SEQ ID NO: 1558806 - RNA, 20 nt, Homo sapiens
gcccuuaauaauaaugccaa

SEQ ID NO: 1558807 - RNA, 21 nt, Homo sapiens
gcccuucccacaggacauuuc

SEQ ID NO: 1558808 - RNA, 18 nt, Homo sapiens
gcccuuccucccauuucc

SEQ ID NO: 1558809 - RNA, 20 nt, Homo sapiens
gcccuuccucccauuuccca

SEQ ID NO: 1558810 - RNA, 20 nt, Homo sapiens
gcccuugcacuccuacugag

SEQ ID NO: 1558811 - RNA, 20 nt, Homo sapiens
gcccuugggguaagccagag

SEQ ID NO: 1558812 - RNA, 16 nt, Homo sapiens
gccgagaguccaucag

SEQ ID NO: 1558813 - RNA, 21 nt, Homo sapiens
gccgagaguccaucagccucc

SEQ ID NO: 1558814 - RNA, 22 nt, Homo sapiens
gccgcauuggugacucacuuca

SEQ ID NO: 1558815 - RNA, 16 nt, Homo sapiens
gccggaucugagggag

SEQ ID NO: 1558816 - RNA, 14 nt, Homo sapiens
gccggccguggaag

SEQ ID NO: 1558817 - RNA, 17 nt, Homo sapiens
gccggcucuaguaccuu

SEQ ID NO: 1558818 - RNA, 19 nt, Homo sapiens
gccgggcaccaacuccaug

SEQ ID NO: 1558819 - RNA, 18 nt, Homo sapiens
gccgggcaugauggugca

SEQ ID NO: 1558820 - RNA, 22 nt, Homo sapiens
gccgugcucgcccacaaacuga

SEQ ID NO: 1558821 - RNA, 19 nt, Homo sapiens
gccuaaccccauuccugug

SEQ ID NO: 1558822 - RNA, 15 nt, Homo sapiens
gccuaauaguaacug

SEQ ID NO: 1558823 - RNA, 22 nt, Homo sapiens
gccuaaugagagugcacugcuc

SEQ ID NO: 1558824 - RNA, 12 nt, Homo sapiens
gccuacagccag

SEQ ID NO: 1558825 - RNA, 14 nt, Homo sapiens
gccuaccccaguuc

SEQ ID NO: 1558826 - RNA, 22 nt, Homo sapiens
gccuaccccaguuccuagcacu

SEQ ID NO: 1558827 - RNA, 16 nt, Homo sapiens
gccuaccucagccucc

SEQ ID NO: 1558828 - RNA, 11 nt, Homo sapiens
gccuaccuggg

SEQ ID NO: 1558829 - RNA, 15 nt, Homo sapiens
gccuagacuguuacu

SEQ ID NO: 1558830 - RNA, 21 nt, Homo sapiens
gccuagcuccugccacaugga

SEQ ID NO: 1558831 - RNA, 18 nt, Homo sapiens
gccuaucuggaagccacc

SEQ ID NO: 1558832 - RNA, 21 nt, Homo sapiens
gccucaagcaauccaccugcc

SEQ ID NO: 1558833 - RNA, 12 nt, Homo sapiens
gccucacauucc

SEQ ID NO: 1558834 - RNA, 22 nt, Homo sapiens
gccucacuggggcagacaauaa

SEQ ID NO: 1558835 - RNA, 18 nt, Homo sapiens
gccuccaccgcugccuaa

SEQ ID NO: 1558836 - RNA, 12 nt, Homo sapiens
gccucccaaagu

SEQ ID NO: 1558837 - RNA, 18 nt, Homo sapiens
gccucccuuguggcagca

SEQ ID NO: 1558838 - RNA, 13 nt, Homo sapiens
gccuccuggccag

SEQ ID NO: 1558839 - RNA, 18 nt, Homo sapiens
gccuccuguggucucagg

SEQ ID NO: 1558840 - RNA, 16 nt, Homo sapiens
gccucucccugcugcu

SEQ ID NO: 1558841 - RNA, 17 nt, Homo sapiens
gccucuccugggacaac

SEQ ID NO: 1558842 - RNA, 13 nt, Homo sapiens
gccucucucugcu

SEQ ID NO: 1558843 - RNA, 17 nt, Homo sapiens
gccucucuuuuugggcu

SEQ ID NO: 1558844 - RNA, 14 nt, Homo sapiens
gccucugaagccua

SEQ ID NO: 1558845 - RNA, 22 nt, Homo sapiens
gccucugccuuugugauccuga

SEQ ID NO: 1558846 - RNA, 22 nt, Homo sapiens
gccucugcggagcacacuggcu

SEQ ID NO: 1558847 - RNA, 20 nt, Homo sapiens
gccucugcucccaugcucau

SEQ ID NO: 1558848 - RNA, 20 nt, Homo sapiens
gccucugcuccccugugaac

SEQ ID NO: 1558849 - RNA, 19 nt, Homo sapiens
gccucugcuggcucaggag

SEQ ID NO: 1558850 - RNA, 17 nt, Homo sapiens
gccucuguguaucucag

SEQ ID NO: 1558851 - RNA, 13 nt, Homo sapiens
gccucuuaggacu

SEQ ID NO: 1558852 - RNA, 20 nt, Homo sapiens
gccucuuuuaccugcugcuu

SEQ ID NO: 1558853 - RNA, 20 nt, Homo sapiens
gccugaagauauuacuacuu

SEQ ID NO: 1558854 - RNA, 15 nt, Homo sapiens
gccugacacauagaa

SEQ ID NO: 1558855 - RNA, 20 nt, Homo sapiens
gccugagaccaggguggcca

SEQ ID NO: 1558856 - RNA, 20 nt, Homo sapiens
gccugagcacacugcccugu

SEQ ID NO: 1558857 - RNA, 19 nt, Homo sapiens
gccugagcaggggcgggga

SEQ ID NO: 1558858 - RNA, 21 nt, Homo sapiens
gccugagccaaugggacaguu

SEQ ID NO: 1558859 - RNA, 17 nt, Homo sapiens
gccugagguuugccagc

SEQ ID NO: 1558860 - RNA, 22 nt, Homo sapiens
gccugauacuuuagccaucaua

SEQ ID NO: 1558861 - RNA, 20 nt, Homo sapiens
gccugcaaaccuuccuggga

SEQ ID NO: 1558862 - RNA, 13 nt, Homo sapiens
gccugcaagcuuc

SEQ ID NO: 1558863 - RNA, 15 nt, Homo sapiens
gccugcccagacuga

SEQ ID NO: 1558864 - RNA, 19 nt, Homo sapiens
gccugcuagucacuggaaa

SEQ ID NO: 1558865 - RNA, 16 nt, Homo sapiens
gccugcuguguggacu

SEQ ID NO: 1558866 - RNA, 22 nt, Homo sapiens
gccuggacacuguaccgacuuu

SEQ ID NO: 1558867 - RNA, 20 nt, Homo sapiens
gccuggagacaaggugcuaa

SEQ ID NO: 1558868 - RNA, 15 nt, Homo sapiens
gccuggaggugggca

SEQ ID NO: 1558869 - RNA, 15 nt, Homo sapiens
gccuggccaccagcc

SEQ ID NO: 1558870 - RNA, 18 nt, Homo sapiens
gccuggccucaucucaga

SEQ ID NO: 1558871 - RNA, 15 nt, Homo sapiens
gccugggauggggcu

SEQ ID NO: 1558872 - RNA, 17 nt, Homo sapiens
gccugggauggggcuuc

SEQ ID NO: 1558873 - RNA, 21 nt, Homo sapiens
gccuggggcaggucacuuuac

SEQ ID NO: 1558874 - RNA, 19 nt, Homo sapiens
gccuguacucccagcacuu

SEQ ID NO: 1558875 - RNA, 17 nt, Homo sapiens
gccuguagcaauggcca

SEQ ID NO: 1558876 - RNA, 17 nt, Homo sapiens
gccugucgcaugagaac

SEQ ID NO: 1558877 - RNA, 22 nt, Homo sapiens
gccuguggguuugguccuugaa

SEQ ID NO: 1558878 - RNA, 14 nt, Homo sapiens
gccuguguacaacu

SEQ ID NO: 1558879 - RNA, 22 nt, Homo sapiens
gccuuaccuccugcccaggaga

SEQ ID NO: 1558880 - RNA, 19 nt, Homo sapiens
ggaaaauggagccaugaca

SEQ ID NO: 1558881 - RNA, 21 nt, Homo sapiens
ggaaaauggagccaugacaag

SEQ ID NO: 1558882 - RNA, 19 nt, Homo sapiens
ggaaacaaccaugucauuu

SEQ ID NO: 1558883 - RNA, 17 nt, Homo sapiens
ggaaaccuuccacccag

SEQ ID NO: 1558884 - RNA, 21 nt, Homo sapiens
ggaaagaaacuugcagcuuua

SEQ ID NO: 1558885 - RNA, 22 nt, Homo sapiens
ggaaagacguuuuugugcugug

SEQ ID NO: 1558886 - RNA, 21 nt, Homo sapiens
ggaaaggauuuuaccaaagca

SEQ ID NO: 1558887 - RNA, 21 nt, Homo sapiens
ggaaagggagacgcccuuuca

SEQ ID NO: 1558888 - RNA, 21 nt, Homo sapiens
ggaaauaaaaaagucucuauu

SEQ ID NO: 1558889 - RNA, 17 nt, Homo sapiens
ggaaauuaagacuuuau

SEQ ID NO: 1558890 - RNA, 19 nt, Homo sapiens
ggaaauuguuuauguguua

SEQ ID NO: 1558891 - RNA, 22 nt, Homo sapiens
ggaacaaacagaaaugacugug

SEQ ID NO: 1558892 - RNA, 15 nt, Homo sapiens
ggaacaucaguggau

SEQ ID NO: 1558893 - RNA, 16 nt, Homo sapiens
ggaacuccuggccuuu

SEQ ID NO: 1558894 - RNA, 12 nt, Homo sapiens
ggaacuggcaaa

SEQ ID NO: 1558895 - RNA, 14 nt, Homo sapiens
ggaacuuagccauu

SEQ ID NO: 1558896 - RNA, 18 nt, Homo sapiens
ggaagaaagaauguuacu

SEQ ID NO: 1558897 - RNA, 16 nt, Homo sapiens
ggaagaaccacugucu

SEQ ID NO: 1558898 - RNA, 21 nt, Homo sapiens
ggaagcaacaggaaucaagag

SEQ ID NO: 1558899 - RNA, 11 nt, Homo sapiens
ggaagcacuug

SEQ ID NO: 1558900 - RNA, 16 nt, Homo sapiens
ggaagccagucagggc

SEQ ID NO: 1558901 - RNA, 21 nt, Homo sapiens
ggaagccauuuuccagugacu

SEQ ID NO: 1558902 - RNA, 20 nt, Homo sapiens
ggaagccccugggcccagua

SEQ ID NO: 1558903 - RNA, 16 nt, Homo sapiens
ggaagcccucaaagaa

SEQ ID NO: 1558904 - RNA, 16 nt, Homo sapiens
ggaagcuacccaagga

SEQ ID NO: 1558905 - RNA, 14 nt, Homo sapiens
ggaaggaacaaaga

SEQ ID NO: 1558906 - RNA, 23 nt, Homo sapiens
ggaaggagguucucccagcccau

SEQ ID NO: 1558907 - RNA, 20 nt, Homo sapiens
ggaaguuucuggugccauuu

SEQ ID NO: 1558908 - RNA, 17 nt, Homo sapiens
ggaauaaaaaauacugu

SEQ ID NO: 1558909 - RNA, 17 nt, Homo sapiens
ggaauaaaaucuggcca

SEQ ID NO: 1558910 - RNA, 16 nt, Homo sapiens
ggaauaauacauacua

SEQ ID NO: 1558911 - RNA, 13 nt, Homo sapiens
ggaauaguggcau

SEQ ID NO: 1558912 - RNA, 12 nt, Homo sapiens
ggaaucagagag

SEQ ID NO: 1558913 - RNA, 16 nt, Homo sapiens
ggaaucgaaguguuua

SEQ ID NO: 1558914 - RNA, 18 nt, Homo sapiens
ggaaucuuuguaccaaaa

SEQ ID NO: 1558915 - RNA, 16 nt, Homo sapiens
ggaauuacaagcccug

SEQ ID NO: 1558916 - RNA, 16 nt, Homo sapiens
ggaauuacgugcucug

SEQ ID NO: 1558917 - RNA, 20 nt, Homo sapiens
ggaauucuaaauaaauuucc

SEQ ID NO: 1558918 - RNA, 18 nt, Homo sapiens
ggaauucuuucuguugaa

SEQ ID NO: 1558919 - RNA, 18 nt, Homo sapiens
ggaauugaacgacuguau

SEQ ID NO: 1558920 - RNA, 14 nt, Homo sapiens
ggacaaaacuggag

SEQ ID NO: 1558921 - RNA, 19 nt, Homo sapiens
ggacaaagaaauuccccaa

SEQ ID NO: 1558922 - RNA, 21 nt, Homo sapiens
ggacaagaggguucacacagc

SEQ ID NO: 1558923 - RNA, 18 nt, Homo sapiens
ggacaaucuuauguuucc

SEQ ID NO: 1558924 - RNA, 20 nt, Homo sapiens
ggacacagaauuauagaugu

SEQ ID NO: 1558925 - RNA, 16 nt, Homo sapiens
ggacacuaucacucau

SEQ ID NO: 1558926 - RNA, 14 nt, Homo sapiens
ggacagaaaaugca

SEQ ID NO: 1558927 - RNA, 23 nt, Homo sapiens
ggacagaaagagacuccgucuca

SEQ ID NO: 1558928 - RNA, 16 nt, Homo sapiens
ggacagacaccgugga

SEQ ID NO: 1558929 - RNA, 20 nt, Homo sapiens
ggacagcaaagcagcagugu

SEQ ID NO: 1558930 - RNA, 22 nt, Homo sapiens
ggacagccaccaagaaguggcu

SEQ ID NO: 1558931 - RNA, 20 nt, Homo sapiens
ggacaguuuaucaugaagcc

SEQ ID NO: 1558932 - RNA, 17 nt, Homo sapiens
ggacaugaagauucuuu

SEQ ID NO: 1558933 - RNA, 10 nt, Homo sapiens
ggacaugccc

SEQ ID NO: 1558934 - RNA, 17 nt, Homo sapiens
ggacauucugcuaagau

SEQ ID NO: 1558935 - RNA, 19 nt, Homo sapiens
ggacauuuaaaauucaauu

SEQ ID NO: 1558936 - RNA, 16 nt, Homo sapiens
ggaccaccaauggauu

SEQ ID NO: 1558937 - RNA, 16 nt, Homo sapiens
ggaccagccucuccac

SEQ ID NO: 1558938 - RNA, 20 nt, Homo sapiens
ggacccaccccaacucuccc

SEQ ID NO: 1558939 - RNA, 20 nt, Homo sapiens
ggacccacgaaacugcccug

SEQ ID NO: 1558940 - RNA, 22 nt, Homo sapiens
ggaccccagcauuuaagugacc

SEQ ID NO: 1558941 - RNA, 18 nt, Homo sapiens
ggacccccaacauucugc

SEQ ID NO: 1558942 - RNA, 21 nt, Homo sapiens
ggacccgucuccagcugcuga

SEQ ID NO: 1558943 - RNA, 21 nt, Homo sapiens
ggacccuucuggguccaggga

SEQ ID NO: 1558944 - RNA, 18 nt, Homo sapiens
ggaccucagugacucaga

SEQ ID NO: 1558945 - RNA, 17 nt, Homo sapiens
ggacuccggaggacuga

SEQ ID NO: 1558946 - RNA, 20 nt, Homo sapiens
ggacuccuccuuuauuucag

SEQ ID NO: 1558947 - RNA, 16 nt, Homo sapiens
ggacucucagggauuc

SEQ ID NO: 1558948 - RNA, 12 nt, Homo sapiens
ggacucuuccac

SEQ ID NO: 1558949 - RNA, 19 nt, Homo sapiens
ggacucuuccaccucccaa

SEQ ID NO: 1558950 - RNA, 22 nt, Homo sapiens
ggacugccggcucuaguaccuu

SEQ ID NO: 1558951 - RNA, 17 nt, Homo sapiens
ggacugcugcucuccca

SEQ ID NO: 1558952 - RNA, 22 nt, Homo sapiens
ggacuggugucauaaacuuucu

SEQ ID NO: 1558953 - RNA, 23 nt, Homo sapiens
ggacuguuccaggcccuccagug

SEQ ID NO: 1558954 - RNA, 13 nt, Homo sapiens
ggacuuugcacac

SEQ ID NO: 1558955 - RNA, 19 nt, Homo sapiens
ggacuuuugauaguucuau

SEQ ID NO: 1558956 - RNA, 18 nt, Homo sapiens
ggagaaagcucauggcug

SEQ ID NO: 1558957 - RNA, 13 nt, Homo sapiens
ggagaaaugccag

SEQ ID NO: 1558958 - RNA, 21 nt, Homo sapiens
ggagaagagaugcugccauuu

SEQ ID NO: 1558959 - RNA, 18 nt, Homo sapiens
ggagaaguugagauucaa

SEQ ID NO: 1558960 - RNA, 22 nt, Homo sapiens
ggagaaucuccgcuuguccaag

SEQ ID NO: 1558961 - RNA, 21 nt, Homo sapiens
ggagacagggcugcuccccaa

SEQ ID NO: 1558962 - RNA, 19 nt, Homo sapiens
ggagacccugaacucagaa

SEQ ID NO: 1558963 - RNA, 20 nt, Homo sapiens
ggagacuccuggucugugaa

SEQ ID NO: 1558964 - RNA, 20 nt, Homo sapiens
ggagagacauggaaagggag

SEQ ID NO: 1558965 - RNA, 15 nt, Homo sapiens
ggagagagugcuauu

SEQ ID NO: 1558966 - RNA, 15 nt, Homo sapiens
ggagaguggaccugu

SEQ ID NO: 1558967 - RNA, 14 nt, Homo sapiens
ggagauagugccag

SEQ ID NO: 1558968 - RNA, 22 nt, Homo sapiens
ggagaucauccuaacaaugugg

SEQ ID NO: 1558969 - RNA, 14 nt, Homo sapiens
ggagauccacuggg

SEQ ID NO: 1558970 - RNA, 15 nt, Homo sapiens
ggagaugccaugagc

SEQ ID NO: 1558971 - RNA, 21 nt, Homo sapiens
ggagauuucuuguugcucaaa

SEQ ID NO: 1558972 - RNA, 12 nt, Homo sapiens
ggagcacgugga

SEQ ID NO: 1558973 - RNA, 23 nt, Homo sapiens
ggagcacguggagauagugccag

SEQ ID NO: 1558974 - RNA, 19 nt, Homo sapiens
ggagcagaguguucccuga

SEQ ID NO: 1558975 - RNA, 13 nt, Homo sapiens
ggagcccagugaa

SEQ ID NO: 1558976 - RNA, 21 nt, Homo sapiens
ggagccugguccuucccugau

SEQ ID NO: 1558977 - RNA, 21 nt, Homo sapiens
ggagccuuaguugagauuuca

SEQ ID NO: 1558978 - RNA, 17 nt, Homo sapiens
ggagccuucugccacca

SEQ ID NO: 1558979 - RNA, 13 nt, Homo sapiens
ggagcgcuaccca

SEQ ID NO: 1558980 - RNA, 16 nt, Homo sapiens
ggagcuggcccucucc

SEQ ID NO: 1558981 - RNA, 23 nt, Homo sapiens
ggagcugggcccugccugcagcc

SEQ ID NO: 1558982 - RNA, 22 nt, Homo sapiens
ggaggaaaaggcuuggugucug

SEQ ID NO: 1558983 - RNA, 16 nt, Homo sapiens
ggaggaagcuacccaa

SEQ ID NO: 1558984 - RNA, 19 nt, Homo sapiens
ggaggaauccuggaccaag

SEQ ID NO: 1558985 - RNA, 14 nt, Homo sapiens
ggaggagcagcagc

SEQ ID NO: 1558986 - RNA, 20 nt, Homo sapiens
ggaggcaagcguguucucag

SEQ ID NO: 1558987 - RNA, 15 nt, Homo sapiens
ggaggcagcucagga

SEQ ID NO: 1558988 - RNA, 19 nt, Homo sapiens
ggaggcagggcagccucgc

SEQ ID NO: 1558989 - RNA, 21 nt, Homo sapiens
ggaggccaagaacuugcaaua

SEQ ID NO: 1558990 - RNA, 19 nt, Homo sapiens
ggaggccuggggaggcccu

SEQ ID NO: 1558991 - RNA, 13 nt, Homo sapiens
ggagggcaggcau

SEQ ID NO: 1558992 - RNA, 17 nt, Homo sapiens
ggagggccagcgcugug

SEQ ID NO: 1558993 - RNA, 17 nt, Homo sapiens
ggagguaucuagcaaug

SEQ ID NO: 1558994 - RNA, 15 nt, Homo sapiens
ggagguugaagccaa

SEQ ID NO: 1558995 - RNA, 19 nt, Homo sapiens
ggagguuguggggccucag

SEQ ID NO: 1558996 - RNA, 12 nt, Homo sapiens
ggagucagggac

SEQ ID NO: 1558997 - RNA, 17 nt, Homo sapiens
ggggcuucuagcugacu

SEQ ID NO: 1558998 - RNA, 13 nt, Homo sapiens
gggggacagacag

SEQ ID NO: 1558999 - RNA, 18 nt, Homo sapiens
gggggcaauuuugcacug

SEQ ID NO: 1559000 - RNA, 12 nt, Homo sapiens
gggggcugugag

SEQ ID NO: 1559001 - RNA, 16 nt, Homo sapiens
ggggguucuguuuuca

SEQ ID NO: 1559002 - RNA, 21 nt, Homo sapiens
gggguacagcccuugcacucc

SEQ ID NO: 1559003 - RNA, 16 nt, Homo sapiens
ggggucaaaauuugcu

SEQ ID NO: 1559004 - RNA, 11 nt, Homo sapiens
ggggucucaga

SEQ ID NO: 1559005 - RNA, 15 nt, Homo sapiens
gggguggaggggugu

SEQ ID NO: 1559006 - RNA, 15 nt, Homo sapiens
ggguacagaugugcu

SEQ ID NO: 1559007 - RNA, 17 nt, Homo sapiens
ggguacagaugugcugu

SEQ ID NO: 1559008 - RNA, 17 nt, Homo sapiens
ggguccugccgguggga

SEQ ID NO: 1559009 - RNA, 19 nt, Homo sapiens
ggguccuuuugacacugcu

SEQ ID NO: 1559010 - RNA, 10 nt, Homo sapiens
gggucugugu

SEQ ID NO: 1559011 - RNA, 20 nt, Homo sapiens
gggucuuguuucacauuugu

SEQ ID NO: 1559012 - RNA, 20 nt, Homo sapiens
gggucuuugugagagugagc

SEQ ID NO: 1559013 - RNA, 16 nt, Homo sapiens
gggugacagugccuuc

SEQ ID NO: 1559014 - RNA, 21 nt, Homo sapiens
ggguggaggggagugugugca

SEQ ID NO: 1559015 - RNA, 19 nt, Homo sapiens
gggugggauccacacugag

SEQ ID NO: 1559016 - RNA, 17 nt, Homo sapiens
gggugucaagugccugc

SEQ ID NO: 1559017 - RNA, 21 nt, Homo sapiens
gggugucaauaaagcugugcu

SEQ ID NO: 1559018 - RNA, 11 nt, Homo sapiens
ggguguugcua

SEQ ID NO: 1559019 - RNA, 16 nt, Homo sapiens
ggguuaauucauuugg

SEQ ID NO: 1559020 - RNA, 20 nt, Homo sapiens
ggguucaugaugcagucucc

SEQ ID NO: 1559021 - RNA, 14 nt, Homo sapiens
ggguucaugcuuaa

SEQ ID NO: 1559022 - RNA, 17 nt, Homo sapiens
ggguuggacaaccucau

SEQ ID NO: 1559023 - RNA, 23 nt, Homo sapiens
ggguuuuuaaucuuugugacagg

SEQ ID NO: 1559024 - RNA, 21 nt, Homo sapiens
gguaaaaaggagaauuuuucc

SEQ ID NO: 1559025 - RNA, 14 nt, Homo sapiens
gguaagaagggugg

SEQ ID NO: 1559026 - RNA, 21 nt, Homo sapiens
gguaaggugugaaccuaccug

SEQ ID NO: 1559027 - RNA, 15 nt, Homo sapiens
gguaaugugaauaaa

SEQ ID NO: 1559028 - RNA, 21 nt, Homo sapiens
gguacagacacucccacuugg

SEQ ID NO: 1559029 - RNA, 18 nt, Homo sapiens
gguacauaggcuucuauu

SEQ ID NO: 1559030 - RNA, 20 nt, Homo sapiens
gguaccaauucagugucugu

SEQ ID NO: 1559031 - RNA, 16 nt, Homo sapiens
gguacugaaagccuua

SEQ ID NO: 1559032 - RNA, 16 nt, Homo sapiens
gguagaaaaauuauua

SEQ ID NO: 1559033 - RNA, 16 nt, Homo sapiens
gguagagaaggagcag

SEQ ID NO: 1559034 - RNA, 17 nt, Homo sapiens
gguagagucauguuugc

SEQ ID NO: 1559035 - RNA, 22 nt, Homo sapiens
gguauaugcacaaaacuacuuu

SEQ ID NO: 1559036 - RNA, 15 nt, Homo sapiens
gguaucuacuucuac

SEQ ID NO: 1559037 - RNA, 22 nt, Homo sapiens
gguaugaaguaucuuugacaug

SEQ ID NO: 1559038 - RNA, 14 nt, Homo sapiens
gguaugauauugca

SEQ ID NO: 1559039 - RNA, 23 nt, Homo sapiens
gguaugccaacuuaaguauuuac

SEQ ID NO: 1559040 - RNA, 16 nt, Homo sapiens
gguaugucagugucac

SEQ ID NO: 1559041 - RNA, 22 nt, Homo sapiens
gguauguguggaugaugcugcc

SEQ ID NO: 1559042 - RNA, 18 nt, Homo sapiens
gguauuagcaaagcaaaa

SEQ ID NO: 1559043 - RNA, 20 nt, Homo sapiens
gguauuuugguacugugaug

SEQ ID NO: 1559044 - RNA, 13 nt, Homo sapiens
ggucaaaauuugc

SEQ ID NO: 1559045 - RNA, 16 nt, Homo sapiens
ggucacagagugagac

SEQ ID NO: 1559046 - RNA, 12 nt, Homo sapiens
ggucacaugaug

SEQ ID NO: 1559047 - RNA, 16 nt, Homo sapiens
ggucacccaaccugac

SEQ ID NO: 1559048 - RNA, 21 nt, Homo sapiens
ggucacguuuggugcuucuca

SEQ ID NO: 1559049 - RNA, 23 nt, Homo sapiens
ggucacuuaaagggucuuaugaa

SEQ ID NO: 1559050 - RNA, 18 nt, Homo sapiens
ggucacuucauuuuuauu

SEQ ID NO: 1559051 - RNA, 13 nt, Homo sapiens
ggucagcauguac

SEQ ID NO: 1559052 - RNA, 14 nt, Homo sapiens
ggucagccacuguu

SEQ ID NO: 1559053 - RNA, 20 nt, Homo sapiens
ggucagcuuuuguuguuuau

SEQ ID NO: 1559054 - RNA, 14 nt, Homo sapiens
ggucaucacuuuga

SEQ ID NO: 1559055 - RNA, 23 nt, Homo sapiens
ggucauccgggaggacaaccaga

SEQ ID NO: 1559056 - RNA, 19 nt, Homo sapiens
ggucaugacaagaugggac

SEQ ID NO: 1559057 - RNA, 18 nt, Homo sapiens
ggucauucuuuugccaca

SEQ ID NO: 1559058 - RNA, 16 nt, Homo sapiens
ggucauuguaaucacu

SEQ ID NO: 1559059 - RNA, 18 nt, Homo sapiens
ggucauuuccuaugcaaa

SEQ ID NO: 1559060 - RNA, 17 nt, Homo sapiens
gguccaaaaauagucaa

SEQ ID NO: 1559061 - RNA, 15 nt, Homo sapiens
gguccaaggucucca

SEQ ID NO: 1559062 - RNA, 14 nt, Homo sapiens
gguccaccuccuga

SEQ ID NO: 1559063 - RNA, 18 nt, Homo sapiens
gguccagggagggguccc

SEQ ID NO: 1559064 - RNA, 15 nt, Homo sapiens
gguccauucucugag

SEQ ID NO: 1559065 - RNA, 18 nt, Homo sapiens
ggucccaggcuucccaaa

SEQ ID NO: 1559066 - RNA, 21 nt, Homo sapiens
gguccccccgagucuccggga

SEQ ID NO: 1559067 - RNA, 13 nt, Homo sapiens
ggucccugagcuc

SEQ ID NO: 1559068 - RNA, 22 nt, Homo sapiens
ggucccuggagggcaagcccug

SEQ ID NO: 1559069 - RNA, 20 nt, Homo sapiens
gguccuagaugccaaagggg

SEQ ID NO: 1559070 - RNA, 13 nt, Homo sapiens
gguccuccugucc

SEQ ID NO: 1559071 - RNA, 21 nt, Homo sapiens
gguccuucccucucaugacuu

SEQ ID NO: 1559072 - RNA, 16 nt, Homo sapiens
ggucguuuuccaaaga

SEQ ID NO: 1559073 - RNA, 14 nt, Homo sapiens
ggucucccaaacgc

SEQ ID NO: 1559074 - RNA, 15 nt, Homo sapiens
ggucuguuggggucu

SEQ ID NO: 1559075 - RNA, 13 nt, Homo sapiens
ggucuuucugugc

SEQ ID NO: 1559076 - RNA, 22 nt, Homo sapiens
ggugaaagcuacugaaauaagc

SEQ ID NO: 1559077 - RNA, 23 nt, Homo sapiens
ggugaaaguuaauccacugugac

SEQ ID NO: 1559078 - RNA, 12 nt, Homo sapiens
ggugaacuccac

SEQ ID NO: 1559079 - RNA, 12 nt, Homo sapiens
ggugaauaugca

SEQ ID NO: 1559080 - RNA, 21 nt, Homo sapiens
ggugacacucuauaagauucc

SEQ ID NO: 1559081 - RNA, 21 nt, Homo sapiens
ggugauuggccacacacugag

SEQ ID NO: 1559082 - RNA, 13 nt, Homo sapiens
ggugcaagcacuc

SEQ ID NO: 1559083 - RNA, 19 nt, Homo sapiens
ggugcccuuuggggucccg

SEQ ID NO: 1559084 - RNA, 21 nt, Homo sapiens
ggugccuuuauuuccacugug

SEQ ID NO: 1559085 - RNA, 14 nt, Homo sapiens
ggugcuccaucucc

SEQ ID NO: 1559086 - RNA, 23 nt, Homo sapiens
ggugcugcuuucuuguugcugca

SEQ ID NO: 1559087 - RNA, 23 nt, Homo sapiens
ggugcuugcuccccaagacacau

SEQ ID NO: 1559088 - RNA, 17 nt, Homo sapiens
gguggagguugcaguga

SEQ ID NO: 1559089 - RNA, 22 nt, Homo sapiens
gguggauauuaaaaaucuguaa

SEQ ID NO: 1559090 - RNA, 21 nt, Homo sapiens
gguggaucacgaggucaggag

SEQ ID NO: 1559091 - RNA, 12 nt, Homo sapiens
gguggcaucaca

SEQ ID NO: 1559092 - RNA, 19 nt, Homo sapiens
gguggcccuugcaguucag

SEQ ID NO: 1559093 - RNA, 16 nt, Homo sapiens
ggugggacuccagcuc

SEQ ID NO: 1559094 - RNA, 21 nt, Homo sapiens
ggugucaagugccugcaccag

SEQ ID NO: 1559095 - RNA, 9 nt, Homo sapiens
ggugucaau

SEQ ID NO: 1559096 - RNA, 16 nt, Homo sapiens
ggugucugugacauuu

SEQ ID NO: 1559097 - RNA, 17 nt, Homo sapiens
ggugugcaccuguaauc

SEQ ID NO: 1559098 - RNA, 13 nt, Homo sapiens
gguguggccucag

SEQ ID NO: 1559099 - RNA, 17 nt, Homo sapiens
gguguggcucugcccug

SEQ ID NO: 1559100 - RNA, 13 nt, Homo sapiens
gguuaaagcuaaa

SEQ ID NO: 1559101 - RNA, 16 nt, Homo sapiens
gguuaacuuggucaga

SEQ ID NO: 1559102 - RNA, 20 nt, Homo sapiens
gguuaugugcauuauucaua

SEQ ID NO: 1559103 - RNA, 21 nt, Homo sapiens
gguucaauuucagaaguaaug

SEQ ID NO: 1559104 - RNA, 23 nt, Homo sapiens
gguuccuggcugcugccaugucu

SEQ ID NO: 1559105 - RNA, 16 nt, Homo sapiens
gguucuaaaugcaaua

SEQ ID NO: 1559106 - RNA, 22 nt, Homo sapiens
gguucuaggagaacugucauga

SEQ ID NO: 1559107 - RNA, 14 nt, Homo sapiens
gguucugccucucc

SEQ ID NO: 1559108 - RNA, 21 nt, Homo sapiens
gguugaacucugguggcacag

SEQ ID NO: 1559109 - RNA, 21 nt, Homo sapiens
gguuggcaugacugucugugc

SEQ ID NO: 1559110 - RNA, 19 nt, Homo sapiens
gguuuaacaagcugucuac

SEQ ID NO: 1559111 - RNA, 17 nt, Homo sapiens
gguuuaauucagcagag

SEQ ID NO: 1559112 - RNA, 17 nt, Homo sapiens
gguuuaucagcaaaaaa

SEQ ID NO: 1559113 - RNA, 21 nt, Homo sapiens
gguuuauuccagagaagccag

SEQ ID NO: 1559114 - RNA, 22 nt, Homo sapiens
gguuuauuccagagaagccagg

SEQ ID NO: 1559115 - RNA, 19 nt, Homo sapiens
uccugugguuuuauuacaa

SEQ ID NO: 1559116 - RNA, 19 nt, Homo sapiens
uccuguguaccucacuguc

SEQ ID NO: 1559117 - RNA, 14 nt, Homo sapiens
uccugugucacuga

SEQ ID NO: 1559118 - RNA, 15 nt, Homo sapiens
uccuguucacucugu

SEQ ID NO: 1559119 - RNA, 23 nt, Homo sapiens
uccuuaccgucuugaucggaaag

SEQ ID NO: 1559120 - RNA, 16 nt, Homo sapiens
uccuuagacucuuuuc

SEQ ID NO: 1559121 - RNA, 17 nt, Homo sapiens
uccuuaggugugagguc

SEQ ID NO: 1559122 - RNA, 21 nt, Homo sapiens
uccuucacucugacaguauua

SEQ ID NO: 1559123 - RNA, 18 nt, Homo sapiens
uccuucaugaucaucaca

SEQ ID NO: 1559124 - RNA, 21 nt, Homo sapiens
uccuucauuaaugaugaucuu

SEQ ID NO: 1559125 - RNA, 18 nt, Homo sapiens
uccuuccagaccuuauca

SEQ ID NO: 1559126 - RNA, 12 nt, Homo sapiens
uccuuccauccc

SEQ ID NO: 1559127 - RNA, 16 nt, Homo sapiens
uccuuccaucccuacc

SEQ ID NO: 1559128 - RNA, 17 nt, Homo sapiens
uccuucccucucugaug

SEQ ID NO: 1559129 - RNA, 14 nt, Homo sapiens
uccuuccuucccug

SEQ ID NO: 1559130 - RNA, 23 nt, Homo sapiens
uccuugagaagugggagcacccu

SEQ ID NO: 1559131 - RNA, 23 nt, Homo sapiens
uccuugagaggagaaaugcaaua

SEQ ID NO: 1559132 - RNA, 13 nt, Homo sapiens
uccuugaguuuca

SEQ ID NO: 1559133 - RNA, 15 nt, Homo sapiens
uccuugccugugacu

SEQ ID NO: 1559134 - RNA, 14 nt, Homo sapiens
uccuugcgccucag

SEQ ID NO: 1559135 - RNA, 16 nt, Homo sapiens
uccuuggaccguauca

SEQ ID NO: 1559136 - RNA, 21 nt, Homo sapiens
uccuugucaacaaagugcuuu

SEQ ID NO: 1559137 - RNA, 21 nt, Homo sapiens
uccuuuccccucccucaggcc

SEQ ID NO: 1559138 - RNA, 15 nt, Homo sapiens
uccuuucuccuguga

SEQ ID NO: 1559139 - RNA, 20 nt, Homo sapiens
uccuuugaaaagagaauauu

SEQ ID NO: 1559140 - RNA, 23 nt, Homo sapiens
uccuuugaauuuuuuaucugcau

SEQ ID NO: 1559141 - RNA, 18 nt, Homo sapiens
uccuuuggcaugggaugg

SEQ ID NO: 1559142 - RNA, 16 nt, Homo sapiens
uccuuuuaauuuuccu

SEQ ID NO: 1559143 - RNA, 22 nt, Homo sapiens
uccuuuucuaggaagcacgggg

SEQ ID NO: 1559144 - RNA, 16 nt, Homo sapiens
uccuuuuugacacuga

SEQ ID NO: 1559145 - RNA, 14 nt, Homo sapiens
uccuuuuugcagca

SEQ ID NO: 1559146 - RNA, 19 nt, Homo sapiens
uccuuuuuucaauaugcaa

SEQ ID NO: 1559147 - RNA, 21 nt, Homo sapiens
ucgacccuggggcgugcagca

SEQ ID NO: 1559148 - RNA, 19 nt, Homo sapiens
ucgacuguauucgugcauu

SEQ ID NO: 1559149 - RNA, 20 nt, Homo sapiens
ucgauccuggauucacucac

SEQ ID NO: 1559150 - RNA, 21 nt, Homo sapiens
ucgcaccacugcacuccagcc

SEQ ID NO: 1559151 - RNA, 20 nt, Homo sapiens
ucgcccacaaacugauuucu

SEQ ID NO: 1559152 - RNA, 21 nt, Homo sapiens
ucgccccaggcccucccugac

SEQ ID NO: 1559153 - RNA, 21 nt, Homo sapiens
ucgcugcgcagccuccagggc

SEQ ID NO: 1559154 - RNA, 13 nt, Homo sapiens
ucgcuugcuggaa

SEQ ID NO: 1559155 - RNA, 23 nt, Homo sapiens
ucggacaagacccccagcacuug

SEQ ID NO: 1559156 - RNA, 20 nt, Homo sapiens
ucggauuugccauagccuug

SEQ ID NO: 1559157 - RNA, 14 nt, Homo sapiens
ucggccaccacaga

SEQ ID NO: 1559158 - RNA, 14 nt, Homo sapiens
ucggccccaucucu

SEQ ID NO: 1559159 - RNA, 21 nt, Homo sapiens
ucggggacgcccccaccagcu

SEQ ID NO: 1559160 - RNA, 13 nt, Homo sapiens
ucggggucccugg

SEQ ID NO: 1559161 - RNA, 19 nt, Homo sapiens
ucggucgccccguguuugc

SEQ ID NO: 1559162 - RNA, 12 nt, Homo sapiens
ucggugugcacc

SEQ ID NO: 1559163 - RNA, 19 nt, Homo sapiens
ucgguuguucuuuccucac

SEQ ID NO: 1559164 - RNA, 13 nt, Homo sapiens
ucguccugggacu

SEQ ID NO: 1559165 - RNA, 18 nt, Homo sapiens
ucgugggguaacaucugu

SEQ ID NO: 1559166 - RNA, 13 nt, Homo sapiens
ucuaaaccaaaaa

SEQ ID NO: 1559167 - RNA, 20 nt, Homo sapiens
ucuaaagguggugaggcaau

SEQ ID NO: 1559168 - RNA, 18 nt, Homo sapiens
ucuaacagcccuccucug

SEQ ID NO: 1559169 - RNA, 14 nt, Homo sapiens
ucuaacugcuguua

SEQ ID NO: 1559170 - RNA, 21 nt, Homo sapiens
ucuaaggcugugccaucagcu

SEQ ID NO: 1559171 - RNA, 22 nt, Homo sapiens
ucuaaggcugugccaucagcuc

SEQ ID NO: 1559172 - RNA, 17 nt, Homo sapiens
ucuaaucaagaaaagaa

SEQ ID NO: 1559173 - RNA, 21 nt, Homo sapiens
ucuaaucaagaaaagaauuac

SEQ ID NO: 1559174 - RNA, 14 nt, Homo sapiens
ucuaauccagcaaa

SEQ ID NO: 1559175 - RNA, 18 nt, Homo sapiens
ucuaauccuugcuauuaa

SEQ ID NO: 1559176 - RNA, 18 nt, Homo sapiens
ucuaauccuuuuccuuau

SEQ ID NO: 1559177 - RNA, 14 nt, Homo sapiens
ucuaauguuuacua

SEQ ID NO: 1559178 - RNA, 18 nt, Homo sapiens
ucuaauuaaaauugugca

SEQ ID NO: 1559179 - RNA, 18 nt, Homo sapiens
ucuaauucggauuugcca

SEQ ID NO: 1559180 - RNA, 14 nt, Homo sapiens
ucuaauugcaaaga

SEQ ID NO: 1559181 - RNA, 18 nt, Homo sapiens
ucuaauuuuacacucugu

SEQ ID NO: 1559182 - RNA, 16 nt, Homo sapiens
ucuacacauugcuacc

SEQ ID NO: 1559183 - RNA, 18 nt, Homo sapiens
ucuacacauugcuaccuc

SEQ ID NO: 1559184 - RNA, 19 nt, Homo sapiens
ucuacagagcuucccugac

SEQ ID NO: 1559185 - RNA, 12 nt, Homo sapiens
ucuacagugaua

SEQ ID NO: 1559186 - RNA, 19 nt, Homo sapiens
ucuacagugaugauugaau

SEQ ID NO: 1559187 - RNA, 16 nt, Homo sapiens
ucuacauacuauggaa

SEQ ID NO: 1559188 - RNA, 17 nt, Homo sapiens
ucuacauccaauguaug

SEQ ID NO: 1559189 - RNA, 16 nt, Homo sapiens
ucuaccccugcuccca

SEQ ID NO: 1559190 - RNA, 19 nt, Homo sapiens
ucuacuaaaaacacaaaaa

SEQ ID NO: 1559191 - RNA, 21 nt, Homo sapiens
ucuacuacaaacuucaaagag

SEQ ID NO: 1559192 - RNA, 17 nt, Homo sapiens
ucuacugaacaguccau

SEQ ID NO: 1559193 - RNA, 22 nt, Homo sapiens
ucuacugcuuuggauccugggu

SEQ ID NO: 1559194 - RNA, 13 nt, Homo sapiens
ucuagaagccaag

SEQ ID NO: 1559195 - RNA, 22 nt, Homo sapiens
ucuagaaugucugaaguacaaa

SEQ ID NO: 1559196 - RNA, 17 nt, Homo sapiens
ucuagacaucauuguca

SEQ ID NO: 1559197 - RNA, 22 nt, Homo sapiens
ucuagacucaaaaccuggagau

SEQ ID NO: 1559198 - RNA, 18 nt, Homo sapiens
ucuagauuauaaacugac

SEQ ID NO: 1559199 - RNA, 16 nt, Homo sapiens
ucuaggagaugcuuuc

SEQ ID NO: 1559200 - RNA, 15 nt, Homo sapiens
ucuaggaugugauga

SEQ ID NO: 1559201 - RNA, 21 nt, Homo sapiens
ucuaggccuucaggacucuag

SEQ ID NO: 1559202 - RNA, 16 nt, Homo sapiens
ucuaggucacuucuca

SEQ ID NO: 1559203 - RNA, 20 nt, Homo sapiens
ucuaguauuggaucugaaaa

SEQ ID NO: 1559204 - RNA, 14 nt, Homo sapiens
ucuaguucauugaa

SEQ ID NO: 1559205 - RNA, 18 nt, Homo sapiens
ucuauaaaugaaugugcu

SEQ ID NO: 1559206 - RNA, 14 nt, Homo sapiens
ucuauaauuuaccu

SEQ ID NO: 1559207 - RNA, 20 nt, Homo sapiens
ucuauacaaaaugauuuuga

SEQ ID NO: 1559208 - RNA, 22 nt, Homo sapiens
ucuaucaaccuucaaguaucca

SEQ ID NO: 1559209 - RNA, 17 nt, Homo sapiens
ucuaugagcaugccaag

SEQ ID NO: 1559210 - RNA, 16 nt, Homo sapiens
ucuauggauucacuuc

SEQ ID NO: 1559211 - RNA, 15 nt, Homo sapiens
ucuaugucucaugau

SEQ ID NO: 1559212 - RNA, 12 nt, Homo sapiens
ucuaugugacau

SEQ ID NO: 1559213 - RNA, 18 nt, Homo sapiens
ucuauucuagccugcauu

SEQ ID NO: 1559214 - RNA, 14 nt, Homo sapiens
ucuauugauguaca

SEQ ID NO: 1559215 - RNA, 21 nt, Homo sapiens
ucuauuugccuccagugcagu

SEQ ID NO: 1559216 - RNA, 21 nt, Homo sapiens
ucuauuuuaagacugauuuua

SEQ ID NO: 1559217 - RNA, 14 nt, Homo sapiens
ucuauuuugcaaac

SEQ ID NO: 1559218 - RNA, 16 nt, Homo sapiens
ucucaaagaaggcauu

SEQ ID NO: 1559219 - RNA, 14 nt, Homo sapiens
ucucaacauacugu

SEQ ID NO: 1559220 - RNA, 19 nt, Homo sapiens
ucucaaggagaggcaaaga

SEQ ID NO: 1559221 - RNA, 20 nt, Homo sapiens
ucucaaggggcccagccucc

SEQ ID NO: 1559222 - RNA, 14 nt, Homo sapiens
ucucaaugugcaau

SEQ ID NO: 1559223 - RNA, 19 nt, Homo sapiens
ucucacaaggaaaaggcca

SEQ ID NO: 1559224 - RNA, 22 nt, Homo sapiens
ucucacauaagcccaguucauc

SEQ ID NO: 1559225 - RNA, 16 nt, Homo sapiens
ucucaccagcugcaaa

SEQ ID NO: 1559226 - RNA, 15 nt, Homo sapiens
ucucacccaggcaau

SEQ ID NO: 1559227 - RNA, 14 nt, Homo sapiens
ucucacuucgcuuc

SEQ ID NO: 1559228 - RNA, 23 nt, Homo sapiens
ucucacuucguuggugaccaguu

SEQ ID NO: 1559229 - RNA, 13 nt, Homo sapiens
ucucagcacuuug

SEQ ID NO: 1559230 - RNA, 20 nt, Homo sapiens
ucucagccauaggugcaguu

SEQ ID NO: 1559231 - RNA, 14 nt, Homo sapiens
ucucagcccagaag

SEQ ID NO: 1559232 - RNA, 16 nt, Homo sapiens
ucucagcucaccucaa

SEQ ID NO: 1559233 - RNA, 21 nt, Homo sapiens
ucuuucuuaaugaaccuuaga

SEQ ID NO: 1559234 - RNA, 22 nt, Homo sapiens
ucuuugaacugcagcaaucaca

SEQ ID NO: 1559235 - RNA, 14 nt, Homo sapiens
ucuuugcaccaaag

SEQ ID NO: 1559236 - RNA, 18 nt, Homo sapiens
ucuuugcuaguaccaaaa

SEQ ID NO: 1559237 - RNA, 13 nt, Homo sapiens
ucuuugguuuugg

SEQ ID NO: 1559238 - RNA, 19 nt, Homo sapiens
ucuuuguaaugucaccacc

SEQ ID NO: 1559239 - RNA, 14 nt, Homo sapiens
ucuuuguaccaaaa

SEQ ID NO: 1559240 - RNA, 18 nt, Homo sapiens
ucuuuguuacuuccuuau

SEQ ID NO: 1559241 - RNA, 18 nt, Homo sapiens
ucuuuucuccuuuaccag

SEQ ID NO: 1559242 - RNA, 21 nt, Homo sapiens
ucuuuugaaaauaaccaugaa

SEQ ID NO: 1559243 - RNA, 18 nt, Homo sapiens
ucuuuugaacaaaugaca

SEQ ID NO: 1559244 - RNA, 16 nt, Homo sapiens
ucuuuugacaccuuag

SEQ ID NO: 1559245 - RNA, 12 nt, Homo sapiens
ucuuuugagggc

SEQ ID NO: 1559246 - RNA, 13 nt, Homo sapiens
ucuuuuguucucu

SEQ ID NO: 1559247 - RNA, 16 nt, Homo sapiens
ucuuuuuucucucuua

SEQ ID NO: 1559248 - RNA, 22 nt, Homo sapiens
ucuuuuuuuuuaaguucuuaug

SEQ ID NO: 1559249 - RNA, 20 nt, Homo sapiens
ucuuuuuuuuuucgucuucc

SEQ ID NO: 1559250 - RNA, 18 nt, Homo sapiens
ugaaaaaaacauauccaa

SEQ ID NO: 1559251 - RNA, 11 nt, Homo sapiens
ugaaaaaagcu

SEQ ID NO: 1559252 - RNA, 19 nt, Homo sapiens
ugaaaaaauauauguauau

SEQ ID NO: 1559253 - RNA, 18 nt, Homo sapiens
ugaaaaacagcucuguug

SEQ ID NO: 1559254 - RNA, 22 nt, Homo sapiens
ugaaaaaggagagacauggaaa

SEQ ID NO: 1559255 - RNA, 13 nt, Homo sapiens
ugaaaaauuccac

SEQ ID NO: 1559256 - RNA, 16 nt, Homo sapiens
ugaaaacacugugcac

SEQ ID NO: 1559257 - RNA, 21 nt, Homo sapiens
ugaaaaccaaaaugacaucuu

SEQ ID NO: 1559258 - RNA, 21 nt, Homo sapiens
ugaaaacgucuuccuucuuua

SEQ ID NO: 1559259 - RNA, 20 nt, Homo sapiens
ugaaaaggguacagaugugc

SEQ ID NO: 1559260 - RNA, 15 nt, Homo sapiens
ugaaaaggguguugc

SEQ ID NO: 1559261 - RNA, 20 nt, Homo sapiens
ugaaaaggugauugucacca

SEQ ID NO: 1559262 - RNA, 23 nt, Homo sapiens
ugaaaauaaaaugacgucacaag

SEQ ID NO: 1559263 - RNA, 17 nt, Homo sapiens
ugaaaauaagaauuauu

SEQ ID NO: 1559264 - RNA, 17 nt, Homo sapiens
ugaaaauauuuguauca

SEQ ID NO: 1559265 - RNA, 20 nt, Homo sapiens
ugaaaauauuuuguugccuu

SEQ ID NO: 1559266 - RNA, 15 nt, Homo sapiens
ugaaaaugaaagugu

SEQ ID NO: 1559267 - RNA, 14 nt, Homo sapiens
ugaaaaugaaccau

SEQ ID NO: 1559268 - RNA, 20 nt, Homo sapiens
ugaaaauguccauuuacacg

SEQ ID NO: 1559269 - RNA, 16 nt, Homo sapiens
ugaaaauugcaauaca

SEQ ID NO: 1559270 - RNA, 15 nt, Homo sapiens
ugaaacagcugccuu

SEQ ID NO: 1559271 - RNA, 20 nt, Homo sapiens
ugaaacagggaaaaugaagc

SEQ ID NO: 1559272 - RNA, 16 nt, Homo sapiens
ugaaacccccaucucu

SEQ ID NO: 1559273 - RNA, 20 nt, Homo sapiens
ugaaacgucuaggaaaucua

SEQ ID NO: 1559274 - RNA, 21 nt, Homo sapiens
ugaaacuauuaagcuucuuaa

SEQ ID NO: 1559275 - RNA, 22 nt, Homo sapiens
ugaaacuugggcacaugcucag

SEQ ID NO: 1559276 - RNA, 22 nt, Homo sapiens
ugaaagaagagaugagaaauga

SEQ ID NO: 1559277 - RNA, 13 nt, Homo sapiens
ugaaagaaguauu

SEQ ID NO: 1559278 - RNA, 20 nt, Homo sapiens
ugaaagacaguccaagcccu

SEQ ID NO: 1559279 - RNA, 21 nt, Homo sapiens
ugaaagacugugcuguccuuu

SEQ ID NO: 1559280 - RNA, 23 nt, Homo sapiens
ugaaagagaaaaugcgucucucc

SEQ ID NO: 1559281 - RNA, 20 nt, Homo sapiens
ugaaagaggggugggaucca

SEQ ID NO: 1559282 - RNA, 19 nt, Homo sapiens
ugaaagcagggacuugaac

SEQ ID NO: 1559283 - RNA, 20 nt, Homo sapiens
ugaaagcuggagucugucaa

SEQ ID NO: 1559284 - RNA, 19 nt, Homo sapiens
ugaaaggagacauugcucu

SEQ ID NO: 1559285 - RNA, 16 nt, Homo sapiens
ugaaagggaaacuggg

SEQ ID NO: 1559286 - RNA, 16 nt, Homo sapiens
ugaaaggggacaccug

SEQ ID NO: 1559287 - RNA, 16 nt, Homo sapiens
ugaaaguggacaagga

SEQ ID NO: 1559288 - RNA, 16 nt, Homo sapiens
ugaaaguugcuuuuau

SEQ ID NO: 1559289 - RNA, 15 nt, Homo sapiens
ugaaaguuuucuaaa

SEQ ID NO: 1559290 - RNA, 19 nt, Homo sapiens
ugaaaguuuucuaaacuca

SEQ ID NO: 1559291 - RNA, 15 nt, Homo sapiens
ugaaauaaaagcaca

SEQ ID NO: 1559292 - RNA, 19 nt, Homo sapiens
ugaaauauugugacucugg

SEQ ID NO: 1559293 - RNA, 14 nt, Homo sapiens
ugaaaucagugccu

SEQ ID NO: 1559294 - RNA, 18 nt, Homo sapiens
ugaaaucccaucucuaca

SEQ ID NO: 1559295 - RNA, 23 nt, Homo sapiens
ugaaaugaaagggaaacugggaa

SEQ ID NO: 1559296 - RNA, 22 nt, Homo sapiens
ugaaaugaauguaaucuaauag

SEQ ID NO: 1559297 - RNA, 14 nt, Homo sapiens
ugaaaugaugguaa

SEQ ID NO: 1559298 - RNA, 12 nt, Homo sapiens
ugaaaugccaaa

SEQ ID NO: 1559299 - RNA, 13 nt, Homo sapiens
ugaaaugccaaag

SEQ ID NO: 1559300 - RNA, 17 nt, Homo sapiens
ugaaaugcucaagaaug

SEQ ID NO: 1559301 - RNA, 14 nt, Homo sapiens
ugaaaugcuuuuau

SEQ ID NO: 1559302 - RNA, 15 nt, Homo sapiens
ugaaauuuugcacca

SEQ ID NO: 1559303 - RNA, 12 nt, Homo sapiens
ugaacaaacaau

SEQ ID NO: 1559304 - RNA, 18 nt, Homo sapiens
ugaacaacuguugggaua

SEQ ID NO: 1559305 - RNA, 22 nt, Homo sapiens
ugaacaauguauacaaugcacu

SEQ ID NO: 1559306 - RNA, 14 nt, Homo sapiens
ugaacacaucagcu

SEQ ID NO: 1559307 - RNA, 15 nt, Homo sapiens
ugaacacuguucuac

SEQ ID NO: 1559308 - RNA, 15 nt, Homo sapiens
ugaacagaaacuaca

SEQ ID NO: 1559309 - RNA, 20 nt, Homo sapiens
ugaacagcccucucucucac

SEQ ID NO: 1559310 - RNA, 13 nt, Homo sapiens
ugaacagguguuu

SEQ ID NO: 1559311 - RNA, 18 nt, Homo sapiens
ugaacauaaguaaucacu

SEQ ID NO: 1559312 - RNA, 19 nt, Homo sapiens
ugaacauuguacuguugcu

SEQ ID NO: 1559313 - RNA, 11 nt, Homo sapiens
ugaacauuuca

SEQ ID NO: 1559314 - RNA, 14 nt, Homo sapiens
ugaaccacugugua

SEQ ID NO: 1559315 - RNA, 21 nt, Homo sapiens
ugaaccaucuucguacaugaa

SEQ ID NO: 1559316 - RNA, 24 nt, Homo sapiens
ugaaccucaguuuccucaucugca

SEQ ID NO: 1559317 - RNA, 19 nt, Homo sapiens
ugaacgacuguauauugcu

SEQ ID NO: 1559318 - RNA, 14 nt, Homo sapiens
ugaacgugccugac

SEQ ID NO: 1559319 - RNA, 24 nt, Homo sapiens
ugaacuaaauuuaagcuuaagcca

SEQ ID NO: 1559320 - RNA, 19 nt, Homo sapiens
ugaacuagggcaagucuua

SEQ ID NO: 1559321 - RNA, 21 nt, Homo sapiens
ugaacucaccauagagaccca

SEQ ID NO: 1559322 - RNA, 14 nt, Homo sapiens
ugaacucucaaauc

SEQ ID NO: 1559323 - RNA, 16 nt, Homo sapiens
ugaacuggucuuccuu

SEQ ID NO: 1559324 - RNA, 22 nt, Homo sapiens
ugaacuuuccaaaaccuaaaga

SEQ ID NO: 1559325 - RNA, 22 nt, Homo sapiens
ugaagaacuggaaccccagcuu

SEQ ID NO: 1559326 - RNA, 22 nt, Homo sapiens
ugaagaaguuuuuggugucaca

SEQ ID NO: 1559327 - RNA, 16 nt, Homo sapiens
ugaagaaucuacuuaa

SEQ ID NO: 1559328 - RNA, 13 nt, Homo sapiens
ugaagaauuuaga

SEQ ID NO: 1559329 - RNA, 14 nt, Homo sapiens
ugaagagcaaaggg

SEQ ID NO: 1559330 - RNA, 15 nt, Homo sapiens
ugaagagcuagucua

SEQ ID NO: 1559331 - RNA, 20 nt, Homo sapiens
ugaagauccccaacugcucc

SEQ ID NO: 1559332 - RNA, 16 nt, Homo sapiens
ugaagcaaagugccca

SEQ ID NO: 1559333 - RNA, 23 nt, Homo sapiens
ugaagcaaaucagaaacuuguga

SEQ ID NO: 1559334 - RNA, 13 nt, Homo sapiens
ugaagcacaucaa

SEQ ID NO: 1559335 - RNA, 13 nt, Homo sapiens
ugaagcacugagc

SEQ ID NO: 1559336 - RNA, 15 nt, Homo sapiens
ugaagcagucuugcu

SEQ ID NO: 1559337 - RNA, 12 nt, Homo sapiens
ugaagcauuaug

SEQ ID NO: 1559338 - RNA, 13 nt, Homo sapiens
ugaagccaaagaa

SEQ ID NO: 1559339 - RNA, 14 nt, Homo sapiens
ugaagcugagcuuu

SEQ ID NO: 1559340 - RNA, 16 nt, Homo sapiens
ugaaggauuacucucc

SEQ ID NO: 1559341 - RNA, 14 nt, Homo sapiens
ugaagggcuuuauu

SEQ ID NO: 1559342 - RNA, 15 nt, Homo sapiens
ugaaggggaggucac

SEQ ID NO: 1559343 - RNA, 20 nt, Homo sapiens
ugaaggggguggggaagaag

SEQ ID NO: 1559344 - RNA, 13 nt, Homo sapiens
ugaaggguggaug

SEQ ID NO: 1559345 - RNA, 23 nt, Homo sapiens
ugaaguaaugaauuuuuaugaua

SEQ ID NO: 1559346 - RNA, 23 nt, Homo sapiens
ugaaguacaguaguuucccuacu

SEQ ID NO: 1559347 - RNA, 18 nt, Homo sapiens
ugaaguaggcauauauca

SEQ ID NO: 1559348 - RNA, 14 nt, Homo sapiens
ugaagucuaugaug

SEQ ID NO: 1559349 - RNA, 13 nt, Homo sapiens
ugaagucucagga

SEQ ID NO: 1559350 - RNA, 16 nt, Homo sapiens
ugaagugagaacucca

SEQ ID NO: 1559351 - RNA, 18 nt, Homo sapiens
ugagccaugcuacaguua

SEQ ID NO: 1559352 - RNA, 16 nt, Homo sapiens
ugagcccccauuccac

SEQ ID NO: 1559353 - RNA, 12 nt, Homo sapiens
ugagcuaacuua

SEQ ID NO: 1559354 - RNA, 14 nt, Homo sapiens
ugagcucaaaguac

SEQ ID NO: 1559355 - RNA, 16 nt, Homo sapiens
ugagcucaaaguacua

SEQ ID NO: 1559356 - RNA, 14 nt, Homo sapiens
ugagcucaggaguu

SEQ ID NO: 1559357 - RNA, 21 nt, Homo sapiens
ugagcucgguggcucaugccu

SEQ ID NO: 1559358 - RNA, 21 nt, Homo sapiens
ugagcugagacagauaagaga

SEQ ID NO: 1559359 - RNA, 20 nt, Homo sapiens
ugagcugcagcugagccuga

SEQ ID NO: 1559360 - RNA, 18 nt, Homo sapiens
ugagcuggggaugucucu

SEQ ID NO: 1559361 - RNA, 20 nt, Homo sapiens
ugagcuggggaugucucuca

SEQ ID NO: 1559362 - RNA, 19 nt, Homo sapiens
ugagcugguaggauguaag

SEQ ID NO: 1559363 - RNA, 12 nt, Homo sapiens
ugagcugugcag

SEQ ID NO: 1559364 - RNA, 20 nt, Homo sapiens
ugaggaaaaguccacaagaa

SEQ ID NO: 1559365 - RNA, 22 nt, Homo sapiens
ugaggaaaaguccacaagaaca

SEQ ID NO: 1559366 - RNA, 13 nt, Homo sapiens
ugaggaaacugag

SEQ ID NO: 1559367 - RNA, 21 nt, Homo sapiens
ugaggaaagcaagaaucagag

SEQ ID NO: 1559368 - RNA, 16 nt, Homo sapiens
ugaggaaggaacagca

SEQ ID NO: 1559369 - RNA, 18 nt, Homo sapiens
ugaggaguccagcacaac

SEQ ID NO: 1559370 - RNA, 21 nt, Homo sapiens
ugaggauauaaugugugcuuu

SEQ ID NO: 1559371 - RNA, 18 nt, Homo sapiens
ugaggcaggagaaucacu

SEQ ID NO: 1559372 - RNA, 13 nt, Homo sapiens
ugaggccucucau

SEQ ID NO: 1559373 - RNA, 21 nt, Homo sapiens
ugaggccugggagucucuuga

SEQ ID NO: 1559374 - RNA, 18 nt, Homo sapiens
ugaggcggcccugaccaa

SEQ ID NO: 1559375 - RNA, 20 nt, Homo sapiens
ugaggcuacagaacuaaaaa

SEQ ID NO: 1559376 - RNA, 23 nt, Homo sapiens
ugagggaauccauugaacuggaa

SEQ ID NO: 1559377 - RNA, 20 nt, Homo sapiens
ugagggagacaggaacggcu

SEQ ID NO: 1559378 - RNA, 16 nt, Homo sapiens
ugagggagaugccaug

SEQ ID NO: 1559379 - RNA, 22 nt, Homo sapiens
ugagggcucuguuugugggacu

SEQ ID NO: 1559380 - RNA, 16 nt, Homo sapiens
ugaggggcucucucau

SEQ ID NO: 1559381 - RNA, 17 nt, Homo sapiens
ugagguaucuucuuuag

SEQ ID NO: 1559382 - RNA, 18 nt, Homo sapiens
ugaguaauacaucaaaga

SEQ ID NO: 1559383 - RNA, 18 nt, Homo sapiens
ugaguccaucuaacauca

SEQ ID NO: 1559384 - RNA, 20 nt, Homo sapiens
ugagucgagauugcacugcu

SEQ ID NO: 1559385 - RNA, 20 nt, Homo sapiens
ugagucugaguccugucucu

SEQ ID NO: 1559386 - RNA, 19 nt, Homo sapiens
ugagugcccaacccuaucc

SEQ ID NO: 1559387 - RNA, 16 nt, Homo sapiens
ugagugccuguaauca

SEQ ID NO: 1559388 - RNA, 15 nt, Homo sapiens
ugaguggccugcuaa

SEQ ID NO: 1559389 - RNA, 13 nt, Homo sapiens
ugaguguguuugu

SEQ ID NO: 1559390 - RNA, 12 nt, Homo sapiens
ugaguuacuuag

SEQ ID NO: 1559391 - RNA, 15 nt, Homo sapiens
ugaguugcacauuaa

SEQ ID NO: 1559392 - RNA, 16 nt, Homo sapiens
ugaguuuuguguuugu

SEQ ID NO: 1559393 - RNA, 19 nt, Homo sapiens
ugauacauuuuuguacuaa

SEQ ID NO: 1559394 - RNA, 17 nt, Homo sapiens
ugauacuuuaguacaau

SEQ ID NO: 1559395 - RNA, 19 nt, Homo sapiens
ugauagauuucuacacuga

SEQ ID NO: 1559396 - RNA, 16 nt, Homo sapiens
ugauagcagauaucac

SEQ ID NO: 1559397 - RNA, 17 nt, Homo sapiens
ugauaggaggacaacca

SEQ ID NO: 1559398 - RNA, 19 nt, Homo sapiens
ugauauaauuguacugugu

SEQ ID NO: 1559399 - RNA, 15 nt, Homo sapiens
ugauauugcagcuua

SEQ ID NO: 1559400 - RNA, 23 nt, Homo sapiens
ugauauuuauuagugguguauau

SEQ ID NO: 1559401 - RNA, 15 nt, Homo sapiens
ugauauuucuugcuu

SEQ ID NO: 1559402 - RNA, 16 nt, Homo sapiens
ugaucaccugccaaau

SEQ ID NO: 1559403 - RNA, 23 nt, Homo sapiens
ugaucauuuuccccccacucucc

SEQ ID NO: 1559404 - RNA, 19 nt, Homo sapiens
ugauccaccccgccuuggc

SEQ ID NO: 1559405 - RNA, 23 nt, Homo sapiens
ugauccugcaauuccacuuauag

SEQ ID NO: 1559406 - RNA, 16 nt, Homo sapiens
ugauccuugcugauaa

SEQ ID NO: 1559407 - RNA, 17 nt, Homo sapiens
ugauccuugcugauaaa

SEQ ID NO: 1559408 - RNA, 18 nt, Homo sapiens
ugaucgcuucucccccac

SEQ ID NO: 1559409 - RNA, 17 nt, Homo sapiens
ugaucggaaagcucuuc

SEQ ID NO: 1559410 - RNA, 16 nt, Homo sapiens
ugaucuacuugccuca

SEQ ID NO: 1559411 - RNA, 15 nt, Homo sapiens
ugaucuauacaaauu

SEQ ID NO: 1559412 - RNA, 15 nt, Homo sapiens
ugaucuuugagccca

SEQ ID NO: 1559413 - RNA, 21 nt, Homo sapiens
ugaugaaaacuaaggauuuuu

SEQ ID NO: 1559414 - RNA, 12 nt, Homo sapiens
ugaugaaugaga

SEQ ID NO: 1559415 - RNA, 23 nt, Homo sapiens
ugaugagacccuuuuaucugcug

SEQ ID NO: 1559416 - RNA, 17 nt, Homo sapiens
ugaugaugcaguuuuca

SEQ ID NO: 1559417 - RNA, 21 nt, Homo sapiens
ugaugcagcauuugauaauga

SEQ ID NO: 1559418 - RNA, 23 nt, Homo sapiens
ugaugccauuacagaaccaaauc

SEQ ID NO: 1559419 - RNA, 21 nt, Homo sapiens
ugaugcucaaaaucuuuccaa

SEQ ID NO: 1559420 - RNA, 15 nt, Homo sapiens
ugaugcugggacccu

SEQ ID NO: 1559421 - RNA, 15 nt, Homo sapiens
ugauggccaccagcu

SEQ ID NO: 1559422 - RNA, 20 nt, Homo sapiens
ugaugguauaaacaggagac

SEQ ID NO: 1559423 - RNA, 19 nt, Homo sapiens
ugauguacagucugucaug

SEQ ID NO: 1559424 - RNA, 17 nt, Homo sapiens
ugauguagauuacugaa

SEQ ID NO: 1559425 - RNA, 20 nt, Homo sapiens
ugauguauguaauacauaua

SEQ ID NO: 1559426 - RNA, 15 nt, Homo sapiens
ugaugucuccaagua

SEQ ID NO: 1559427 - RNA, 19 nt, Homo sapiens
ugauguuuggggaucgaug

SEQ ID NO: 1559428 - RNA, 20 nt, Homo sapiens
ugauuaaaauguuugagcac

SEQ ID NO: 1559429 - RNA, 22 nt, Homo sapiens
ugauuaccaaaauauauauuaa

SEQ ID NO: 1559430 - RNA, 24 nt, Homo sapiens
ugauuagaaauuaccuguggauau

SEQ ID NO: 1559431 - RNA, 14 nt, Homo sapiens
ugauuauauucaca

SEQ ID NO: 1559432 - RNA, 15 nt, Homo sapiens
ugauucaacagggaa

SEQ ID NO: 1559433 - RNA, 19 nt, Homo sapiens
ugauucauaguaacuucuu

SEQ ID NO: 1559434 - RNA, 18 nt, Homo sapiens
ugauuccaccuacaugag

SEQ ID NO: 1559435 - RNA, 12 nt, Homo sapiens
ugauucuauguc

SEQ ID NO: 1559436 - RNA, 18 nt, Homo sapiens
ugauugaucacacagugu

SEQ ID NO: 1559437 - RNA, 20 nt, Homo sapiens
ugauuggccacacacugagu

SEQ ID NO: 1559438 - RNA, 18 nt, Homo sapiens
ugauugguugcauccagg

SEQ ID NO: 1559439 - RNA, 14 nt, Homo sapiens
ugauugucaccaug

SEQ ID NO: 1559440 - RNA, 15 nt, Homo sapiens
ugauugucaccauga

SEQ ID NO: 1559441 - RNA, 19 nt, Homo sapiens
ugauugugugacuauucau

SEQ ID NO: 1559442 - RNA, 14 nt, Homo sapiens
ugauuucagaagga

SEQ ID NO: 1559443 - RNA, 18 nt, Homo sapiens
ugauuucugacucuauca

SEQ ID NO: 1559444 - RNA, 21 nt, Homo sapiens
ugauuuucucuggcagcauaa

SEQ ID NO: 1559445 - RNA, 14 nt, Homo sapiens
ugcaaaacauaucu

SEQ ID NO: 1559446 - RNA, 17 nt, Homo sapiens
ugcaaaacauaucuuga

SEQ ID NO: 1559447 - RNA, 16 nt, Homo sapiens
ugcaaaacuccaggca

SEQ ID NO: 1559448 - RNA, 16 nt, Homo sapiens
ugcaaaaggacucuca

SEQ ID NO: 1559449 - RNA, 15 nt, Homo sapiens
ugcaaaaggagagac

SEQ ID NO: 1559450 - RNA, 17 nt, Homo sapiens
ugcaaaauguguuucag

SEQ ID NO: 1559451 - RNA, 18 nt, Homo sapiens
ugcaaaccauagcacagg

SEQ ID NO: 1559452 - RNA, 15 nt, Homo sapiens
ugcaaacugcuuuau

SEQ ID NO: 1559453 - RNA, 13 nt, Homo sapiens
ugcaaagcacuga

SEQ ID NO: 1559454 - RNA, 10 nt, Homo sapiens
ugcaaaucag

SEQ ID NO: 1559455 - RNA, 21 nt, Homo sapiens
ugcaacauaugaguguuuuga

SEQ ID NO: 1559456 - RNA, 16 nt, Homo sapiens
ugcaacccuuaccccu

SEQ ID NO: 1559457 - RNA, 21 nt, Homo sapiens
ugcaaccuccacaucccaugu

SEQ ID NO: 1559458 - RNA, 13 nt, Homo sapiens
ugcaaccucugcc

SEQ ID NO: 1559459 - RNA, 17 nt, Homo sapiens
ugcaagaguggacugaa

SEQ ID NO: 1559460 - RNA, 19 nt, Homo sapiens
ugcaagcacagcauaccug

SEQ ID NO: 1559461 - RNA, 22 nt, Homo sapiens
ugcaagguacucuggugaguca

SEQ ID NO: 1559462 - RNA, 15 nt, Homo sapiens
ugcaauaaugcagua

SEQ ID NO: 1559463 - RNA, 20 nt, Homo sapiens
ugcaauccaggcuguucuca

SEQ ID NO: 1559464 - RNA, 19 nt, Homo sapiens
ugcaaucuucuacuuuaag

SEQ ID NO: 1559465 - RNA, 13 nt, Homo sapiens
ugcaaugagccau

SEQ ID NO: 1559466 - RNA, 16 nt, Homo sapiens
ugcaauguagucaaua

SEQ ID NO: 1559467 - RNA, 14 nt, Homo sapiens
ugcaauugcuccca

SEQ ID NO: 1559468 - RNA, 21 nt, Homo sapiens
ugcacaaguucccuggagaaa

SEQ ID NO: 1559469 - RNA, 21 nt, Homo sapiens
aaaugugguuuguacauauca

SEQ ID NO: 1559470 - RNA, 20 nt, Homo sapiens
aaauguguuagcacugauag

SEQ ID NO: 1559471 - RNA, 18 nt, Homo sapiens
aaauguuaacaaugccua

SEQ ID NO: 1559472 - RNA, 14 nt, Homo sapiens
aaauguuaugacua

SEQ ID NO: 1559473 - RNA, 21 nt, Homo sapiens
aaauguuauuaaaauauccag

SEQ ID NO: 1559474 - RNA, 19 nt, Homo sapiens
aaauguucaagucaugccu

SEQ ID NO: 1559475 - RNA, 22 nt, Homo sapiens
aaauguucaagucaugccugag

SEQ ID NO: 1559476 - RNA, 18 nt, Homo sapiens
aaauguugagaaucccaa

SEQ ID NO: 1559477 - RNA, 19 nt, Homo sapiens
aaauguuuauacguggaaa

SEQ ID NO: 1559478 - RNA, 18 nt, Homo sapiens
aaauguuuguuuauauca

SEQ ID NO: 1559479 - RNA, 23 nt, Homo sapiens
aaauguuuucauuuuacugguau

SEQ ID NO: 1559480 - RNA, 18 nt, Homo sapiens
aaauuaaaccaacaacaa

SEQ ID NO: 1559481 - RNA, 15 nt, Homo sapiens
aaauuaacacaaagg

SEQ ID NO: 1559482 - RNA, 14 nt, Homo sapiens
aaauuaagacuuua

SEQ ID NO: 1559483 - RNA, 16 nt, Homo sapiens
aaauuacagugcaguu

SEQ ID NO: 1559484 - RNA, 18 nt, Homo sapiens
aaauuacugauccucgca

SEQ ID NO: 1559485 - RNA, 21 nt, Homo sapiens
aaauuagauuugugcaaacau

SEQ ID NO: 1559486 - RNA, 18 nt, Homo sapiens
aaauuagccauuucacuc

SEQ ID NO: 1559487 - RNA, 19 nt, Homo sapiens
aaauuagugaaccaaaaau

SEQ ID NO: 1559488 - RNA, 15 nt, Homo sapiens
aaauuauacugagaa

SEQ ID NO: 1559489 - RNA, 16 nt, Homo sapiens
aaauuauacugagaac

SEQ ID NO: 1559490 - RNA, 19 nt, Homo sapiens
aaauuauauuugugcuaua

SEQ ID NO: 1559491 - RNA, 18 nt, Homo sapiens
aaauuauggaauaucauc

SEQ ID NO: 1559492 - RNA, 15 nt, Homo sapiens
aaauuauuuaucaag

SEQ ID NO: 1559493 - RNA, 19 nt, Homo sapiens
aaauucaaauaaaaauccu

SEQ ID NO: 1559494 - RNA, 18 nt, Homo sapiens
aaauucaauuaggauuaa

SEQ ID NO: 1559495 - RNA, 13 nt, Homo sapiens
aaauucacuuuca

SEQ ID NO: 1559496 - RNA, 17 nt, Homo sapiens
aaauucagaugcuguua

SEQ ID NO: 1559497 - RNA, 14 nt, Homo sapiens
aaauucaucuagac

SEQ ID NO: 1559498 - RNA, 16 nt, Homo sapiens
aaauucauuucuagac

SEQ ID NO: 1559499 - RNA, 20 nt, Homo sapiens
aaauucauuugcuugcaauc

SEQ ID NO: 1559500 - RNA, 19 nt, Homo sapiens
aaauuccaaauucauggca

SEQ ID NO: 1559501 - RNA, 16 nt, Homo sapiens
aaauuccacagauuau

SEQ ID NO: 1559502 - RNA, 19 nt, Homo sapiens
aaauuccacagauuaucaa

SEQ ID NO: 1559503 - RNA, 13 nt, Homo sapiens
aaauuccacucaa

SEQ ID NO: 1559504 - RNA, 17 nt, Homo sapiens
aaauuccucaacagugu

SEQ ID NO: 1559505 - RNA, 22 nt, Homo sapiens
aaauugaaagcaggacauauga

SEQ ID NO: 1559506 - RNA, 14 nt, Homo sapiens
aaauugaagcaacu

SEQ ID NO: 1559507 - RNA, 13 nt, Homo sapiens
aaauugaugagag

SEQ ID NO: 1559508 - RNA, 14 nt, Homo sapiens
aaauugcaguaaca

SEQ ID NO: 1559509 - RNA, 16 nt, Homo sapiens
aaauugccaacauaag

SEQ ID NO: 1559510 - RNA, 13 nt, Homo sapiens
aaauugcuucuag

SEQ ID NO: 1559511 - RNA, 22 nt, Homo sapiens
aaauugcuuuugaaaaacaacu

SEQ ID NO: 1559512 - RNA, 21 nt, Homo sapiens
aaauuguaggcauguuugaua

SEQ ID NO: 1559513 - RNA, 17 nt, Homo sapiens
aaauuguauggugauaa

SEQ ID NO: 1559514 - RNA, 22 nt, Homo sapiens
aaauuguauuaucaacagcauu

SEQ ID NO: 1559515 - RNA, 21 nt, Homo sapiens
aaauuuaauuaaagccuuaag

SEQ ID NO: 1559516 - RNA, 17 nt, Homo sapiens
aaauuuagaaagcuuaa

SEQ ID NO: 1559517 - RNA, 19 nt, Homo sapiens
aaauuuauaaaggucugca

SEQ ID NO: 1559518 - RNA, 22 nt, Homo sapiens
aaauuuauaaaggucugcacuc

SEQ ID NO: 1559519 - RNA, 23 nt, Homo sapiens
aaauuucaccauugcugucaagu

SEQ ID NO: 1559520 - RNA, 13 nt, Homo sapiens
aaauuucauagcu

SEQ ID NO: 1559521 - RNA, 12 nt, Homo sapiens
aaauuugcacug

SEQ ID NO: 1559522 - RNA, 13 nt, Homo sapiens
aaauuuuacacac

SEQ ID NO: 1559523 - RNA, 16 nt, Homo sapiens
aaauuuuacaguagaa

SEQ ID NO: 1559524 - RNA, 21 nt, Homo sapiens
aaauuuuaguaguuacuaaaa

SEQ ID NO: 1559525 - RNA, 21 nt, Homo sapiens
aaauuuucuggugcuaagucu

SEQ ID NO: 1559526 - RNA, 13 nt, Homo sapiens
aaauuuugcacca

SEQ ID NO: 1559527 - RNA, 14 nt, Homo sapiens
aaauuuugcacuuu

SEQ ID NO: 1559528 - RNA, 17 nt, Homo sapiens
aaauuuuguaugccaau

SEQ ID NO: 1559529 - RNA, 15 nt, Homo sapiens
aaauuuuuaggcaaa

SEQ ID NO: 1559530 - RNA, 19 nt, Homo sapiens
aacaaaaagaaaaacaaau

SEQ ID NO: 1559531 - RNA, 13 nt, Homo sapiens
aacaaaaagguaa

SEQ ID NO: 1559532 - RNA, 16 nt, Homo sapiens
aacaaaagauucccuu

SEQ ID NO: 1559533 - RNA, 13 nt, Homo sapiens
aacaaacaaugaa

SEQ ID NO: 1559534 - RNA, 14 nt, Homo sapiens
aacaaagacaacca

SEQ ID NO: 1559535 - RNA, 12 nt, Homo sapiens
aacaaaguaaua

SEQ ID NO: 1559536 - RNA, 20 nt, Homo sapiens
aacaaagugaaggacauaga

SEQ ID NO: 1559537 - RNA, 20 nt, Homo sapiens
aacaaaguuccacuuccagg

SEQ ID NO: 1559538 - RNA, 22 nt, Homo sapiens
aacaaaguuucagaguauauug

SEQ ID NO: 1559539 - RNA, 15 nt, Homo sapiens
aacaaauaauuuaga

SEQ ID NO: 1559540 - RNA, 17 nt, Homo sapiens
aacaaaugggucccuca

SEQ ID NO: 1559541 - RNA, 18 nt, Homo sapiens
aacaaccaugucauuuca

SEQ ID NO: 1559542 - RNA, 16 nt, Homo sapiens
aacaacuuacacuuau

SEQ ID NO: 1559543 - RNA, 15 nt, Homo sapiens
aacaagccaaagagc

SEQ ID NO: 1559544 - RNA, 22 nt, Homo sapiens
aacaagguggugugaucuuaau

SEQ ID NO: 1559545 - RNA, 22 nt, Homo sapiens
aacaaguauauaauuuacuuug

SEQ ID NO: 1559546 - RNA, 22 nt, Homo sapiens
aacaauaaaguacuuuaccuaa

SEQ ID NO: 1559547 - RNA, 16 nt, Homo sapiens
aacaauaugaaguaca

SEQ ID NO: 1559548 - RNA, 22 nt, Homo sapiens
aacaaugccuuguuguauuccu

SEQ ID NO: 1559549 - RNA, 22 nt, Homo sapiens
aacaauggaagauuugcccauu

SEQ ID NO: 1559550 - RNA, 15 nt, Homo sapiens
aacaauguauacaau

SEQ ID NO: 1559551 - RNA, 13 nt, Homo sapiens
aacacaagcaaaa

SEQ ID NO: 1559552 - RNA, 22 nt, Homo sapiens
aacacacagacccaagauucau

SEQ ID NO: 1559553 - RNA, 23 nt, Homo sapiens
aacacaccaaucagcgcucugua

SEQ ID NO: 1559554 - RNA, 20 nt, Homo sapiens
aacacagcaacaaugacuua

SEQ ID NO: 1559555 - RNA, 18 nt, Homo sapiens
aacacccagaggucucau

SEQ ID NO: 1559556 - RNA, 16 nt, Homo sapiens
aacacccuuucaucuc

SEQ ID NO: 1559557 - RNA, 21 nt, Homo sapiens
aacacgagcaggcuacuguca

SEQ ID NO: 1559558 - RNA, 23 nt, Homo sapiens
aacacgcagauccuuugucuaca

SEQ ID NO: 1559559 - RNA, 14 nt, Homo sapiens
aacacuaaacauuc

SEQ ID NO: 1559560 - RNA, 14 nt, Homo sapiens
aacacuaaucacaa

SEQ ID NO: 1559561 - RNA, 24 nt, Homo sapiens
aacacucaguggcccauggcauuu

SEQ ID NO: 1559562 - RNA, 15 nt, Homo sapiens
aacacugaagugcuu

SEQ ID NO: 1559563 - RNA, 19 nt, Homo sapiens
aacacugucacuagucuca

SEQ ID NO: 1559564 - RNA, 22 nt, Homo sapiens
aacacuucguucgcagagcuuu

SEQ ID NO: 1559565 - RNA, 21 nt, Homo sapiens
aacagaaaccagaaaagcaau

SEQ ID NO: 1559566 - RNA, 12 nt, Homo sapiens
aacagaaagcau

SEQ ID NO: 1559567 - RNA, 19 nt, Homo sapiens
aacagaauggauugccagu

SEQ ID NO: 1559568 - RNA, 13 nt, Homo sapiens
aacagacucucac

SEQ ID NO: 1559569 - RNA, 16 nt, Homo sapiens
aacagagcuaagaaau

SEQ ID NO: 1559570 - RNA, 22 nt, Homo sapiens
aacagagggaguuuaauacagg

SEQ ID NO: 1559571 - RNA, 19 nt, Homo sapiens
aacagaucaggaauucuaa

SEQ ID NO: 1559572 - RNA, 22 nt, Homo sapiens
aacagauuucaaaaaaaaaccc

SEQ ID NO: 1559573 - RNA, 20 nt, Homo sapiens
aacagauuuuguuggcauag

SEQ ID NO: 1559574 - RNA, 13 nt, Homo sapiens
aacagcaaaucac

SEQ ID NO: 1559575 - RNA, 16 nt, Homo sapiens
aacagcaucaauuuuc

SEQ ID NO: 1559576 - RNA, 12 nt, Homo sapiens
aacagcauguac

SEQ ID NO: 1559577 - RNA, 19 nt, Homo sapiens
aacagccaaaaaggacuuu

SEQ ID NO: 1559578 - RNA, 18 nt, Homo sapiens
aacagcccucucucucac

SEQ ID NO: 1559579 - RNA, 14 nt, Homo sapiens
aacagccuacugaa

SEQ ID NO: 1559580 - RNA, 17 nt, Homo sapiens
aacagcucuguugaauc

SEQ ID NO: 1559581 - RNA, 19 nt, Homo sapiens
aacaggacagcacugggaa

SEQ ID NO: 1559582 - RNA, 23 nt, Homo sapiens
aacaggcaaaguuuuacagagag

SEQ ID NO: 1559583 - RNA, 16 nt, Homo sapiens
aacaggguaccucaag

SEQ ID NO: 1559584 - RNA, 18 nt, Homo sapiens
aacagguaaaacagggcc

SEQ ID NO: 1559585 - RNA, 19 nt, Homo sapiens
aacaguacugguuacuuuc

SEQ ID NO: 1559586 - RNA, 19 nt, Homo sapiens
aacagugguggcaacauuc

SEQ ID NO: 1559587 - RNA, 16 nt, Homo sapiens
agucaaggucacuuaa

SEQ ID NO: 1559588 - RNA, 23 nt, Homo sapiens
agucaauccccucauucaggaaa

SEQ ID NO: 1559589 - RNA, 13 nt, Homo sapiens
agucaauuucuac

SEQ ID NO: 1559590 - RNA, 21 nt, Homo sapiens
agucacauuugcaucauagac

SEQ ID NO: 1559591 - RNA, 17 nt, Homo sapiens
agucacugacaguuaau

SEQ ID NO: 1559592 - RNA, 17 nt, Homo sapiens
agucacugccaagucau

SEQ ID NO: 1559593 - RNA, 11 nt, Homo sapiens
agucacuguag

SEQ ID NO: 1559594 - RNA, 23 nt, Homo sapiens
agucagaaugugaaaaaggaaua

SEQ ID NO: 1559595 - RNA, 22 nt, Homo sapiens
agucagacuuuguguucauuuc

SEQ ID NO: 1559596 - RNA, 21 nt, Homo sapiens
agucagauccuguuacuugcu

SEQ ID NO: 1559597 - RNA, 21 nt, Homo sapiens
agucagggaccugcugcucag

SEQ ID NO: 1559598 - RNA, 15 nt, Homo sapiens
agucaguugcucaaa

SEQ ID NO: 1559599 - RNA, 17 nt, Homo sapiens
agucaguuuuaggguug

SEQ ID NO: 1559600 - RNA, 16 nt, Homo sapiens
agucauccucagauca

SEQ ID NO: 1559601 - RNA, 16 nt, Homo sapiens
agucaucucauuccac

SEQ ID NO: 1559602 - RNA, 18 nt, Homo sapiens
agucauggauaacuacau

SEQ ID NO: 1559603 - RNA, 19 nt, Homo sapiens
agucauggcuaauuuaaca

SEQ ID NO: 1559604 - RNA, 12 nt, Homo sapiens
agucauuaccac

SEQ ID NO: 1559605 - RNA, 13 nt, Homo sapiens
agucauucagauu

SEQ ID NO: 1559606 - RNA, 23 nt, Homo sapiens
agucauucagcagcaaauuuuca

SEQ ID NO: 1559607 - RNA, 23 nt, Homo sapiens
acagcuugggaggaaaccugaga

SEQ ID NO: 1559608 - RNA, 19 nt, Homo sapiens
acaggaaacuccugugacc

SEQ ID NO: 1559609 - RNA, 12 nt, Homo sapiens
acaggagcacug

SEQ ID NO: 1559610 - RNA, 16 nt, Homo sapiens
acaggagcacugcaug

SEQ ID NO: 1559611 - RNA, 14 nt, Homo sapiens
acaggccauuguga

SEQ ID NO: 1559612 - RNA, 15 nt, Homo sapiens
acaggccauugugaa

SEQ ID NO: 1559613 - RNA, 20 nt, Homo sapiens
acaggcgcccgccaccaugc

SEQ ID NO: 1559614 - RNA, 21 nt, Homo sapiens
acaggcgcccgccaccaugcc

SEQ ID NO: 1559615 - RNA, 21 nt, Homo sapiens
acaggcucaugccaucaugcc

SEQ ID NO: 1559616 - RNA, 13 nt, Homo sapiens
acaggcuccccau

SEQ ID NO: 1559617 - RNA, 22 nt, Homo sapiens
acagggaagcaaauaucuuacc

SEQ ID NO: 1559618 - RNA, 18 nt, Homo sapiens
acagggccaugugcugcc

SEQ ID NO: 1559619 - RNA, 17 nt, Homo sapiens
acaggguuucuccaugu

SEQ ID NO: 1559620 - RNA, 16 nt, Homo sapiens
acagguaaaacagggc

SEQ ID NO: 1559621 - RNA, 23 nt, Homo sapiens
acagguaauauaaaaagcuucca

SEQ ID NO: 1559622 - RNA, 15 nt, Homo sapiens
acagguggugcaaau

SEQ ID NO: 1559623 - RNA, 19 nt, Homo sapiens
acaguacacagauaccuug

SEQ ID NO: 1559624 - RNA, 20 nt, Homo sapiens
acaguagaacugucugugaa

SEQ ID NO: 1559625 - RNA, 16 nt, Homo sapiens
acaguauuuucccaau

SEQ ID NO: 1559626 - RNA, 14 nt, Homo sapiens
acagucaaaaccaa

SEQ ID NO: 1559627 - RNA, 17 nt, Homo sapiens
acagucaauggauccac

SEQ ID NO: 1559628 - RNA, 14 nt, Homo sapiens
acagucacauucca

SEQ ID NO: 1559629 - RNA, 16 nt, Homo sapiens
acagucauacaaguca

SEQ ID NO: 1559630 - RNA, 21 nt, Homo sapiens
acagucaucuagaauucacug

SEQ ID NO: 1559631 - RNA, 13 nt, Homo sapiens
acaguccacaggg

SEQ ID NO: 1559632 - RNA, 20 nt, Homo sapiens
acagucucaggaaaucaaau

SEQ ID NO: 1559633 - RNA, 19 nt, Homo sapiens
acagucuggagaagguauu

SEQ ID NO: 1559634 - RNA, 21 nt, Homo sapiens
acagugagacccccaucucua

SEQ ID NO: 1559635 - RNA, 16 nt, Homo sapiens
acagugaugauugaau

SEQ ID NO: 1559636 - RNA, 10 nt, Homo sapiens
acagugcaag

SEQ ID NO: 1559637 - RNA, 11 nt, Homo sapiens
acagugcaguu

SEQ ID NO: 1559638 - RNA, 18 nt, Homo sapiens
acagugcuugauacagga

SEQ ID NO: 1559639 - RNA, 20 nt, Homo sapiens
acaguggcucacgccuguaa

SEQ ID NO: 1559640 - RNA, 23 nt, Homo sapiens
acaguguuggagguuaaggcaua

SEQ ID NO: 1559641 - RNA, 16 nt, Homo sapiens
acaguucaacauaaag

SEQ ID NO: 1559642 - RNA, 22 nt, Homo sapiens
acaguucaacauaaagagcaau

SEQ ID NO: 1559643 - RNA, 16 nt, Homo sapiens
acaguugccacaucac

SEQ ID NO: 1559644 - RNA, 20 nt, Homo sapiens
acaguuuuacaauagacauu

SEQ ID NO: 1559645 - RNA, 16 nt, Homo sapiens
acaguuuucugagaaa

SEQ ID NO: 1559646 - RNA, 23 nt, Homo sapiens
acaguuuuuaacucuacugugua

SEQ ID NO: 1559647 - RNA, 23 nt, Homo sapiens
acauaaaugucuguauuucauuc

SEQ ID NO: 1559648 - RNA, 18 nt, Homo sapiens
acauaacauuguaugcau

SEQ ID NO: 1559649 - RNA, 17 nt, Homo sapiens
acauaacccacucuguc

SEQ ID NO: 1559650 - RNA, 19 nt, Homo sapiens
acauaacuccugucccuuu

SEQ ID NO: 1559651 - RNA, 14 nt, Homo sapiens
acauaaguuccuau

SEQ ID NO: 1559652 - RNA, 13 nt, Homo sapiens
acauaauucuucc

SEQ ID NO: 1559653 - RNA, 22 nt, Homo sapiens
acauacaccucgucaagagcau

SEQ ID NO: 1559654 - RNA, 17 nt, Homo sapiens
acauacacuguauguua

SEQ ID NO: 1559655 - RNA, 17 nt, Homo sapiens
acauacauauuaucuca

SEQ ID NO: 1559656 - RNA, 16 nt, Homo sapiens
acauacgggaaguuua

SEQ ID NO: 1559657 - RNA, 16 nt, Homo sapiens
acauacuccuuccauc

SEQ ID NO: 1559658 - RNA, 14 nt, Homo sapiens
acauacuguucuca

SEQ ID NO: 1559659 - RNA, 15 nt, Homo sapiens
acauacuuaaugcau

SEQ ID NO: 1559660 - RNA, 22 nt, Homo sapiens
acauacuuucauccugacucug

SEQ ID NO: 1559661 - RNA, 13 nt, Homo sapiens
acauagccaacuc

SEQ ID NO: 1559662 - RNA, 22 nt, Homo sapiens
acauaguagguacccaauucaa

SEQ ID NO: 1559663 - RNA, 14 nt, Homo sapiens
acauauagagcucc

SEQ ID NO: 1559664 - RNA, 12 nt, Homo sapiens
acauaugacaau

SEQ ID NO: 1559665 - RNA, 13 nt, Homo sapiens
acauaugacaaug

SEQ ID NO: 1559666 - RNA, 15 nt, Homo sapiens
acauauugagcacuu

SEQ ID NO: 1559667 - RNA, 22 nt, Homo sapiens
acaucaaaacuaaccaucugaa

SEQ ID NO: 1559668 - RNA, 15 nt, Homo sapiens
acaucaaaccugagu

SEQ ID NO: 1559669 - RNA, 24 nt, Homo sapiens
acaucauuacugccaucuuuauca

SEQ ID NO: 1559670 - RNA, 14 nt, Homo sapiens
acauccaugaaaau

SEQ ID NO: 1559671 - RNA, 16 nt, Homo sapiens
acaucccauugcccug

SEQ ID NO: 1559672 - RNA, 22 nt, Homo sapiens
acauccuaccccuuugcacuug

SEQ ID NO: 1559673 - RNA, 20 nt, Homo sapiens
acauccuccagauaguguag

SEQ ID NO: 1559674 - RNA, 17 nt, Homo sapiens
acauccugucaguguca

SEQ ID NO: 1559675 - RNA, 22 nt, Homo sapiens
acaucuaccuaaaggacuauua

SEQ ID NO: 1559676 - RNA, 13 nt, Homo sapiens
acaucugcaauau

SEQ ID NO: 1559677 - RNA, 23 nt, Homo sapiens
acaucugccuuaaaaccaaagag

SEQ ID NO: 1559678 - RNA, 15 nt, Homo sapiens
acaucugugucuugu

SEQ ID NO: 1559679 - RNA, 17 nt, Homo sapiens
acaucuuaaagcuaaaa

SEQ ID NO: 1559680 - RNA, 13 nt, Homo sapiens
acaucuuccacca

SEQ ID NO: 1559681 - RNA, 22 nt, Homo sapiens
acaucuuuucacaacuuaccuu

SEQ ID NO: 1559682 - RNA, 22 nt, Homo sapiens
acaucuuuuuaaagcuuaucca

SEQ ID NO: 1559683 - RNA, 19 nt, Homo sapiens
acaugaacacuuuuuauca

SEQ ID NO: 1559684 - RNA, 13 nt, Homo sapiens
acaugacuggugg

SEQ ID NO: 1559685 - RNA, 15 nt, Homo sapiens
acaugauaagacauu

SEQ ID NO: 1559686 - RNA, 20 nt, Homo sapiens
acaugauaccucugaucaag

SEQ ID NO: 1559687 - RNA, 14 nt, Homo sapiens
acaugauccugcaa

SEQ ID NO: 1559688 - RNA, 16 nt, Homo sapiens
acaugauugaaaccaa

SEQ ID NO: 1559689 - RNA, 13 nt, Homo sapiens
acaugcagaauaa

SEQ ID NO: 1559690 - RNA, 17 nt, Homo sapiens
acaugcauugagcucuc

SEQ ID NO: 1559691 - RNA, 21 nt, Homo sapiens
acaugccccuugguccuggca

SEQ ID NO: 1559692 - RNA, 17 nt, Homo sapiens
acaugcuuuagccauac

SEQ ID NO: 1559693 - RNA, 15 nt, Homo sapiens
acauggccugagcau

SEQ ID NO: 1559694 - RNA, 20 nt, Homo sapiens
acauguacuacagcuauauu

SEQ ID NO: 1559695 - RNA, 16 nt, Homo sapiens
acaugucaaucugucc

SEQ ID NO: 1559696 - RNA, 22 nt, Homo sapiens
acaugucaauuaaaaugcccau

SEQ ID NO: 1559697 - RNA, 16 nt, Homo sapiens
acaugugauugugauu

SEQ ID NO: 1559698 - RNA, 18 nt, Homo sapiens
acaugugcuggacacugu

SEQ ID NO: 1559699 - RNA, 22 nt, Homo sapiens
aaaguauauguuaaaaagugag

SEQ ID NO: 1559700 - RNA, 18 nt, Homo sapiens
aaaguauuaucagaugcu

SEQ ID NO: 1559701 - RNA, 17 nt, Homo sapiens
aaaguauuccaccuuaa

SEQ ID NO: 1559702 - RNA, 22 nt, Homo sapiens
aaaguauuggcauucaaaaaga

SEQ ID NO: 1559703 - RNA, 22 nt, Homo sapiens
aaagucacacggcuugugggca

SEQ ID NO: 1559704 - RNA, 12 nt, Homo sapiens
aaaguccacaag

SEQ ID NO: 1559705 - RNA, 17 nt, Homo sapiens
aaaguccauaccuuaua

SEQ ID NO: 1559706 - RNA, 19 nt, Homo sapiens
aaagucccucccugccuga

SEQ ID NO: 1559707 - RNA, 18 nt, Homo sapiens
aaagucuacauacuuuca

SEQ ID NO: 1559708 - RNA, 21 nt, Homo sapiens
aaagugcugggauuacaggcg

SEQ ID NO: 1559709 - RNA, 21 nt, Homo sapiens
aaagugcuuuuucacugccua

SEQ ID NO: 1559710 - RNA, 18 nt, Homo sapiens
aaaguggacaaggagugu

SEQ ID NO: 1559711 - RNA, 21 nt, Homo sapiens
aaagugggcaaaagcuuacaa

SEQ ID NO: 1559712 - RNA, 18 nt, Homo sapiens
aaaguggggguggaggac

SEQ ID NO: 1559713 - RNA, 21 nt, Homo sapiens
aaaguguugggauuacaggcg

SEQ ID NO: 1559714 - RNA, 15 nt, Homo sapiens
aaaguuauugugaua

SEQ ID NO: 1559715 - RNA, 17 nt, Homo sapiens
aaaguucugcagauaaa

SEQ ID NO: 1559716 - RNA, 16 nt, Homo sapiens
aaaguugagcgucauu

SEQ ID NO: 1559717 - RNA, 21 nt, Homo sapiens
aaaguuuaacaaaugacugua

SEQ ID NO: 1559718 - RNA, 21 nt, Homo sapiens
aaaguuucaccuguauugaau

SEQ ID NO: 1559719 - RNA, 20 nt, Homo sapiens
aaaguuuucuccacuggaaa

SEQ ID NO: 1559720 - RNA, 21 nt, Homo sapiens
aaaguuuuuuauuaugcauua

SEQ ID NO: 1559721 - RNA, 16 nt, Homo sapiens
aaauaaaacagcagca

SEQ ID NO: 1559722 - RNA, 21 nt, Homo sapiens
aaauaaacagauacauucaca

SEQ ID NO: 1559723 - RNA, 22 nt, Homo sapiens
aaauaaacagauacauucacau

SEQ ID NO: 1559724 - RNA, 19 nt, Homo sapiens
aaauaaagaucacacauca

SEQ ID NO: 1559725 - RNA, 16 nt, Homo sapiens
aaauaaauauaccacu

SEQ ID NO: 1559726 - RNA, 13 nt, Homo sapiens
aaauaagcauuua

SEQ ID NO: 1559727 - RNA, 14 nt, Homo sapiens
aaauaauaauagua

SEQ ID NO: 1559728 - RNA, 15 nt, Homo sapiens
aaauacaaaaagcaa

SEQ ID NO: 1559729 - RNA, 13 nt, Homo sapiens
aaauacaacacug

SEQ ID NO: 1559730 - RNA, 22 nt, Homo sapiens
auuggauuuccuaauacuguca

SEQ ID NO: 1559731 - RNA, 21 nt, Homo sapiens
auuggccacuggauccugcug

SEQ ID NO: 1559732 - RNA, 17 nt, Homo sapiens
auuggcuaaaagacaug

SEQ ID NO: 1559733 - RNA, 17 nt, Homo sapiens
auuggcucacacugaga

SEQ ID NO: 1559734 - RNA, 13 nt, Homo sapiens
auuggcugagaua

SEQ ID NO: 1559735 - RNA, 22 nt, Homo sapiens
auugggacccuccagugcugga

SEQ ID NO: 1559736 - RNA, 15 nt, Homo sapiens
auugggauacuguaa

SEQ ID NO: 1559737 - RNA, 23 nt, Homo sapiens
auugguugccucugccuuuguga

SEQ ID NO: 1559738 - RNA, 19 nt, Homo sapiens
auuguaaacuaguacuauu

SEQ ID NO: 1559739 - RNA, 20 nt, Homo sapiens
auuguaaacuaguacuauua

SEQ ID NO: 1559740 - RNA, 13 nt, Homo sapiens
auuguacaagcag

SEQ ID NO: 1559741 - RNA, 18 nt, Homo sapiens
auuguacaaguauuacaa

SEQ ID NO: 1559742 - RNA, 14 nt, Homo sapiens
auuguagcuaugau

SEQ ID NO: 1559743 - RNA, 17 nt, Homo sapiens
auuguauaaaugcaaua

SEQ ID NO: 1559744 - RNA, 19 nt, Homo sapiens
auuguaucaaaugugacau

SEQ ID NO: 1559745 - RNA, 20 nt, Homo sapiens
auuguaucaaaugugacauu

SEQ ID NO: 1559746 - RNA, 12 nt, Homo sapiens
auuguaugucaa

SEQ ID NO: 1559747 - RNA, 15 nt, Homo sapiens
auuguaugucaagau

SEQ ID NO: 1559748 - RNA, 20 nt, Homo sapiens
auuguauuccucaugucauc

SEQ ID NO: 1559749 - RNA, 23 nt, Homo sapiens
auuguauuuuggauuuuuacaca

SEQ ID NO: 1559750 - RNA, 20 nt, Homo sapiens
auugucacagaugaagacau

SEQ ID NO: 1559751 - RNA, 21 nt, Homo sapiens
auugucuaaucuguagaagcu

SEQ ID NO: 1559752 - RNA, 20 nt, Homo sapiens
auugucuccuugguuauauu

SEQ ID NO: 1559753 - RNA, 14 nt, Homo sapiens
auugucugucucua

SEQ ID NO: 1559754 - RNA, 14 nt, Homo sapiens
auugucuuacuguu

SEQ ID NO: 1559755 - RNA, 17 nt, Homo sapiens
auugugcaguacuuugu

SEQ ID NO: 1559756 - RNA, 20 nt, Homo sapiens
auugugccccugcacuccag

SEQ ID NO: 1559757 - RNA, 22 nt, Homo sapiens
auugugguuuauugaaugugau

SEQ ID NO: 1559758 - RNA, 23 nt, Homo sapiens
auugugugugugaagaugcucug

SEQ ID NO: 1559759 - RNA, 20 nt, Homo sapiens
auuguguuaggacagcauau

SEQ ID NO: 1559760 - RNA, 20 nt, Homo sapiens
auuguuacauuauguggaaa

SEQ ID NO: 1559761 - RNA, 20 nt, Homo sapiens
auuguuugugacccugagaa

SEQ ID NO: 1559762 - RNA, 18 nt, Homo sapiens
auuguuuuuauucuguau

SEQ ID NO: 1559763 - RNA, 18 nt, Homo sapiens
auuuaaaaaaaaaccuga

SEQ ID NO: 1559764 - RNA, 16 nt, Homo sapiens
auuuaaaaaacuguau

SEQ ID NO: 1559765 - RNA, 15 nt, Homo sapiens
auuuaaaaacauuuu

SEQ ID NO: 1559766 - RNA, 21 nt, Homo sapiens
auuuaaaacagacacuggcau

SEQ ID NO: 1559767 - RNA, 17 nt, Homo sapiens
auuuaaaacaucauuac

SEQ ID NO: 1559768 - RNA, 13 nt, Homo sapiens
auuuaaaauggaa

SEQ ID NO: 1559769 - RNA, 14 nt, Homo sapiens
auuuaaagcaucau

SEQ ID NO: 1559770 - RNA, 16 nt, Homo sapiens
auuuaaagcaucaucu

SEQ ID NO: 1559771 - RNA, 17 nt, Homo sapiens
auuuaaagcaucaucug

SEQ ID NO: 1559772 - RNA, 22 nt, Homo sapiens
auuuaaauguuaugacuaugua

SEQ ID NO: 1559773 - RNA, 22 nt, Homo sapiens
auuuaacacccuuuagaaccuu

SEQ ID NO: 1559774 - RNA, 11 nt, Homo sapiens
auuuaacuuaa

SEQ ID NO: 1559775 - RNA, 20 nt, Homo sapiens
auuuaagugaauacauuaac

SEQ ID NO: 1559776 - RNA, 14 nt, Homo sapiens
auuuaagugcaauu

SEQ ID NO: 1559777 - RNA, 19 nt, Homo sapiens
auuuaauguuuuuaaucac

SEQ ID NO: 1559778 - RNA, 19 nt, Homo sapiens
auuuaauuagggugaaaau

SEQ ID NO: 1559779 - RNA, 16 nt, Homo sapiens
auuuaauuucauguau

SEQ ID NO: 1559780 - RNA, 23 nt, Homo sapiens
auuuacaagaagaacucaccagg

SEQ ID NO: 1559781 - RNA, 21 nt, Homo sapiens
auuuacacagugagacuguac

SEQ ID NO: 1559782 - RNA, 14 nt, Homo sapiens
auuuacccuuuucc

SEQ ID NO: 1559783 - RNA, 14 nt, Homo sapiens
auuuacuaaaucaa

SEQ ID NO: 1559784 - RNA, 13 nt, Homo sapiens
auuuacuacuuau

SEQ ID NO: 1559785 - RNA, 21 nt, Homo sapiens
auuuacuuagcagaaccacau

SEQ ID NO: 1559786 - RNA, 20 nt, Homo sapiens
auuuagaaaaagaacaugca

SEQ ID NO: 1559787 - RNA, 18 nt, Homo sapiens
auuuagacccugcauuua

SEQ ID NO: 1559788 - RNA, 15 nt, Homo sapiens
auuuagaugcacuuu

SEQ ID NO: 1559789 - RNA, 21 nt, Homo sapiens
auuuagcccgagaucuggucu

SEQ ID NO: 1559790 - RNA, 19 nt, Homo sapiens
auuuagcccucacauuaga

SEQ ID NO: 1559791 - RNA, 22 nt, Homo sapiens
auuuaguuugauuauucagugu

SEQ ID NO: 1559792 - RNA, 20 nt, Homo sapiens
auuuaguuuuuaacaaucua

SEQ ID NO: 1559793 - RNA, 15 nt, Homo sapiens
auuuauaagccaaag

SEQ ID NO: 1559794 - RNA, 18 nt, Homo sapiens
auuuauagcuaugaaacc

SEQ ID NO: 1559795 - RNA, 17 nt, Homo sapiens
auuuauaucacacaaua

SEQ ID NO: 1559796 - RNA, 17 nt, Homo sapiens
auuuauauggguuuauu

SEQ ID NO: 1559797 - RNA, 22 nt, Homo sapiens
auuuaucuauaauuuaccuaag

SEQ ID NO: 1559798 - RNA, 13 nt, Homo sapiens
auuuaucuuucaa

SEQ ID NO: 1559799 - RNA, 15 nt, Homo sapiens
auuuaugaugcaguu

SEQ ID NO: 1559800 - RNA, 22 nt, Homo sapiens
auuuauggucuucaaccaaggc

SEQ ID NO: 1559801 - RNA, 15 nt, Homo sapiens
auuuaugguucucag

SEQ ID NO: 1559802 - RNA, 18 nt, Homo sapiens
auuuauguggauuuugca

SEQ ID NO: 1559803 - RNA, 17 nt, Homo sapiens
auuuauuaacuaaucaa

SEQ ID NO: 1559804 - RNA, 14 nt, Homo sapiens
auuuauucuacuuu

SEQ ID NO: 1559805 - RNA, 21 nt, Homo sapiens
auuuauugaaaugauuucaca

SEQ ID NO: 1559806 - RNA, 18 nt, Homo sapiens
auuuauugagcaucuagu

SEQ ID NO: 1559807 - RNA, 22 nt, Homo sapiens
auuuauugguuuugcagaagaa

SEQ ID NO: 1559808 - RNA, 14 nt, Homo sapiens
auuuauuuauucau

SEQ ID NO: 1559809 - RNA, 16 nt, Homo sapiens
auuuauuucauccagu

SEQ ID NO: 1559810 - RNA, 18 nt, Homo sapiens
auuuauuuuuauguucuu

SEQ ID NO: 1559811 - RNA, 21 nt, Homo sapiens
auuuauuuuuauguucuuggc

SEQ ID NO: 1559812 - RNA, 19 nt, Homo sapiens
auuucaaaauauacauuca

SEQ ID NO: 1559813 - RNA, 13 nt, Homo sapiens
auuucaaauaucu

SEQ ID NO: 1559814 - RNA, 15 nt, Homo sapiens
auuucaagucucuca

SEQ ID NO: 1559815 - RNA, 16 nt, Homo sapiens
auuucaagugccuaga

SEQ ID NO: 1559816 - RNA, 13 nt, Homo sapiens
auuucacucucaa

SEQ ID NO: 1559817 - RNA, 20 nt, Homo sapiens
auuucagaaguuaguuugua

SEQ ID NO: 1559818 - RNA, 13 nt, Homo sapiens
auuucagccaaaa

SEQ ID NO: 1559819 - RNA, 18 nt, Homo sapiens
auuucauaccuaucaucu

SEQ ID NO: 1559820 - RNA, 20 nt, Homo sapiens
auuucauaccuaucaucuua

SEQ ID NO: 1559821 - RNA, 21 nt, Homo sapiens
auuucaugcacugauuaaaau

SEQ ID NO: 1559822 - RNA, 18 nt, Homo sapiens
auuucauuaugcuuugaa

SEQ ID NO: 1559823 - RNA, 15 nt, Homo sapiens
auuucauuuccagca

SEQ ID NO: 1559824 - RNA, 17 nt, Homo sapiens
auuuccaguugcccaua

SEQ ID NO: 1559825 - RNA, 21 nt, Homo sapiens
auuuccaguuuuucuuuacuu

SEQ ID NO: 1559826 - RNA, 21 nt, Homo sapiens
auuuccccccuccgccuccag

SEQ ID NO: 1559827 - RNA, 20 nt, Homo sapiens
auuucccccuaaaccaacug

SEQ ID NO: 1559828 - RNA, 23 nt, Homo sapiens
auuucccccuaaaccaacugaag

SEQ ID NO: 1559829 - RNA, 21 nt, Homo sapiens
auuuccgugaacucuggugcu

SEQ ID NO: 1559830 - RNA, 13 nt, Homo sapiens
auuuccuaugcaa

SEQ ID NO: 1559831 - RNA, 18 nt, Homo sapiens
auuuccuuuuugacacug

SEQ ID NO: 1559832 - RNA, 19 nt, Homo sapiens
auuuccuuuuugacacuga

SEQ ID NO: 1559833 - RNA, 20 nt, Homo sapiens
auuuccuuuuugacacugaa

SEQ ID NO: 1559834 - RNA, 21 nt, Homo sapiens
auuucgaagccacagagucuc

SEQ ID NO: 1559835 - RNA, 19 nt, Homo sapiens
auuucgaagucaucauucc

SEQ ID NO: 1559836 - RNA, 11 nt, Homo sapiens
auuucuaaucc

SEQ ID NO: 1559837 - RNA, 14 nt, Homo sapiens
auuucuacucuuaa

SEQ ID NO: 1559838 - RNA, 15 nt, Homo sapiens
gaguuaaaucucaaa

SEQ ID NO: 1559839 - RNA, 19 nt, Homo sapiens
gaguuacuuagaaugccau

SEQ ID NO: 1559840 - RNA, 18 nt, Homo sapiens
gaguuaucuucuuuauua

SEQ ID NO: 1559841 - RNA, 20 nt, Homo sapiens
gaguuauucaaaugaaggug

SEQ ID NO: 1559842 - RNA, 16 nt, Homo sapiens
gaguucugaagcugac

SEQ ID NO: 1559843 - RNA, 16 nt, Homo sapiens
gaguugcagcucugua

SEQ ID NO: 1559844 - RNA, 23 nt, Homo sapiens
gaguuggacuucagucuugccua

SEQ ID NO: 1559845 - RNA, 16 nt, Homo sapiens
gaguugggcagccagg

SEQ ID NO: 1559846 - RNA, 15 nt, Homo sapiens
gaguuuaguuuuaua

SEQ ID NO: 1559847 - RNA, 19 nt, Homo sapiens
gaguuuauuggaggaucaa

SEQ ID NO: 1559848 - RNA, 15 nt, Homo sapiens
gaguuucuauggauu

SEQ ID NO: 1559849 - RNA, 21 nt, Homo sapiens
gaguuugagcugccuucccua

SEQ ID NO: 1559850 - RNA, 20 nt, Homo sapiens
gaguuuuuccucccagugag

SEQ ID NO: 1559851 - RNA, 17 nt, Homo sapiens
gauaaagagacagugau

SEQ ID NO: 1559852 - RNA, 17 nt, Homo sapiens
gauaaagcuuaggucaa

SEQ ID NO: 1559853 - RNA, 16 nt, Homo sapiens
gauaaaugcaauauuc

SEQ ID NO: 1559854 - RNA, 18 nt, Homo sapiens
gauaacuggcacccagag

SEQ ID NO: 1559855 - RNA, 20 nt, Homo sapiens
gauaacuggcacccagagaa

SEQ ID NO: 1559856 - RNA, 15 nt, Homo sapiens
gauaagagaauaccu

SEQ ID NO: 1559857 - RNA, 16 nt, Homo sapiens
gauaagagaauaccuu

SEQ ID NO: 1559858 - RNA, 19 nt, Homo sapiens
gauaaguggggacuagugu

SEQ ID NO: 1559859 - RNA, 19 nt, Homo sapiens
gauaauaaaggcauuucaa

SEQ ID NO: 1559860 - RNA, 14 nt, Homo sapiens
gauaaucacacugc

SEQ ID NO: 1559861 - RNA, 18 nt, Homo sapiens
gauaaucucuccauuccc

SEQ ID NO: 1559862 - RNA, 15 nt, Homo sapiens
gauacaauaaauugc

SEQ ID NO: 1559863 - RNA, 21 nt, Homo sapiens
gauacacaaucugaaacagcu

SEQ ID NO: 1559864 - RNA, 23 nt, Homo sapiens
gauacacagauauauacacacag

SEQ ID NO: 1559865 - RNA, 21 nt, Homo sapiens
gauacauaaugggccacugaa

SEQ ID NO: 1559866 - RNA, 20 nt, Homo sapiens
gauacaugauugaaaccaag

SEQ ID NO: 1559867 - RNA, 16 nt, Homo sapiens
gauaccaaauaccaug

SEQ ID NO: 1559868 - RNA, 23 nt, Homo sapiens
gauaccuguuccuuuuucugggu

SEQ ID NO: 1559869 - RNA, 20 nt, Homo sapiens
gauacuaauaggugugugag

SEQ ID NO: 1559870 - RNA, 11 nt, Homo sapiens
gauacuuugac

SEQ ID NO: 1559871 - RNA, 16 nt, Homo sapiens
gauacuuugacagugu

SEQ ID NO: 1559872 - RNA, 22 nt, Homo sapiens
gauagagaauguuccagacauu

SEQ ID NO: 1559873 - RNA, 11 nt, Homo sapiens
gauagagcaaa

SEQ ID NO: 1559874 - RNA, 15 nt, Homo sapiens
gauagauaaugccuu

SEQ ID NO: 1559875 - RNA, 14 nt, Homo sapiens
gauagcagauauca

SEQ ID NO: 1559876 - RNA, 23 nt, Homo sapiens
gauaggauggggugucuguguua

SEQ ID NO: 1559877 - RNA, 19 nt, Homo sapiens
gauagguaccugagugacg

SEQ ID NO: 1559878 - RNA, 21 nt, Homo sapiens
gauauaaucuuucaaaccagc

SEQ ID NO: 1559879 - RNA, 12 nt, Homo sapiens
gauauaccaaau

SEQ ID NO: 1559880 - RNA, 20 nt, Homo sapiens
gauauauguguauacauaca

SEQ ID NO: 1559881 - RNA, 13 nt, Homo sapiens
gauauauuuccaa

SEQ ID NO: 1559882 - RNA, 21 nt, Homo sapiens
gauaucauuuaggaguauuau

SEQ ID NO: 1559883 - RNA, 23 nt, Homo sapiens
gauauccuuucacucugcauggu

SEQ ID NO: 1559884 - RNA, 20 nt, Homo sapiens
gauaucuuggacaaaucaca

SEQ ID NO: 1559885 - RNA, 18 nt, Homo sapiens
gauaugcaaguaagaaau

SEQ ID NO: 1559886 - RNA, 23 nt, Homo sapiens
gauaugucuuggccacuauggac

SEQ ID NO: 1559887 - RNA, 23 nt, Homo sapiens
gauauguuauacugaaccaggcc

SEQ ID NO: 1559888 - RNA, 20 nt, Homo sapiens
gauauuaagauucuugacuu

SEQ ID NO: 1559889 - RNA, 18 nt, Homo sapiens
gauauuacuacuuaccau

SEQ ID NO: 1559890 - RNA, 16 nt, Homo sapiens
gauauuuaguaauauu

SEQ ID NO: 1559891 - RNA, 22 nt, Homo sapiens
gaucaaauugugcaguacuuug

SEQ ID NO: 1559892 - RNA, 21 nt, Homo sapiens
gaucagaugcugaauugagaa

SEQ ID NO: 1559893 - RNA, 15 nt, Homo sapiens
gaucagcgacccuga

SEQ ID NO: 1559894 - RNA, 20 nt, Homo sapiens
gaucagcugguucaguacug

SEQ ID NO: 1559895 - RNA, 15 nt, Homo sapiens
gaucaucuuugccac

SEQ ID NO: 1559896 - RNA, 20 nt, Homo sapiens
gauccaagcagccugagcaa

SEQ ID NO: 1559897 - RNA, 12 nt, Homo sapiens
gaucccaugagc

SEQ ID NO: 1559898 - RNA, 21 nt, Homo sapiens
gauccgucuuuggccuccucc

SEQ ID NO: 1559899 - RNA, 19 nt, Homo sapiens
gauccuuucucucaagggc

SEQ ID NO: 1559900 - RNA, 20 nt, Homo sapiens
gaucuaauauugacugccuc

SEQ ID NO: 1559901 - RNA, 12 nt, Homo sapiens
gaucuaucuaca

SEQ ID NO: 1559902 - RNA, 17 nt, Homo sapiens
gaucuauguuucaucuu

SEQ ID NO: 1559903 - RNA, 20 nt, Homo sapiens
gaucucagcagugaaguaua

SEQ ID NO: 1559904 - RNA, 16 nt, Homo sapiens
gaucucgguuugccaa

SEQ ID NO: 1559905 - RNA, 16 nt, Homo sapiens
gaucugcucgcugaga

SEQ ID NO: 1559906 - RNA, 17 nt, Homo sapiens
gaucuggucccuugcag

SEQ ID NO: 1559907 - RNA, 15 nt, Homo sapiens
gaucuguacuuugug

SEQ ID NO: 1559908 - RNA, 15 nt, Homo sapiens
gaucuucccacagga

SEQ ID NO: 1559909 - RNA, 20 nt, Homo sapiens
gaucuugcaaaacagggauu

SEQ ID NO: 1559910 - RNA, 18 nt, Homo sapiens
gaugaaauaaaauaucaa

SEQ ID NO: 1559911 - RNA, 21 nt, Homo sapiens
gaugaaguuuuacauuguuga

SEQ ID NO: 1559912 - RNA, 15 nt, Homo sapiens
gaugaaucauauuca

SEQ ID NO: 1559913 - RNA, 19 nt, Homo sapiens
gaugacaggucagcaguau

SEQ ID NO: 1559914 - RNA, 23 nt, Homo sapiens
gaugaccacauaagaaggcaauu

SEQ ID NO: 1559915 - RNA, 17 nt, Homo sapiens
gaugaccauacucagac

SEQ ID NO: 1559916 - RNA, 16 nt, Homo sapiens
gaugacuauuacuuuu

SEQ ID NO: 1559917 - RNA, 18 nt, Homo sapiens
gaugagacagacauucac

SEQ ID NO: 1559918 - RNA, 17 nt, Homo sapiens
gaugagcaagacauacu

SEQ ID NO: 1559919 - RNA, 16 nt, Homo sapiens
gaugagcgugcacucc

SEQ ID NO: 1559920 - RNA, 18 nt, Homo sapiens
gaugaguuaacugugaaa

SEQ ID NO: 1559921 - RNA, 12 nt, Homo sapiens
gaugaugcaguu

SEQ ID NO: 1559922 - RNA, 16 nt, Homo sapiens
gaugauggaugccaau

SEQ ID NO: 1559923 - RNA, 16 nt, Homo sapiens
gacuagaugauggaug

SEQ ID NO: 1559924 - RNA, 22 nt, Homo sapiens
gacuauguuccaauaaaacuuu

SEQ ID NO: 1559925 - RNA, 15 nt, Homo sapiens
gacucaauguggaaa

SEQ ID NO: 1559926 - RNA, 16 nt, Homo sapiens
gacucagaaagccaac

SEQ ID NO: 1559927 - RNA, 17 nt, Homo sapiens
gacucagagguccaggc

SEQ ID NO: 1559928 - RNA, 16 nt, Homo sapiens
gacuccaccucuacca

SEQ ID NO: 1559929 - RNA, 22 nt, Homo sapiens
gacuccaccuuggaccucagug

SEQ ID NO: 1559930 - RNA, 16 nt, Homo sapiens
gacuccaggaacaaaa

SEQ ID NO: 1559931 - RNA, 20 nt, Homo sapiens
gacucccuccauagcgacac

SEQ ID NO: 1559932 - RNA, 15 nt, Homo sapiens
gacuccuccuccaaa

SEQ ID NO: 1559933 - RNA, 18 nt, Homo sapiens
gacucgacaaaggccaca

SEQ ID NO: 1559934 - RNA, 19 nt, Homo sapiens
gacucggagacuauggccu

SEQ ID NO: 1559935 - RNA, 13 nt, Homo sapiens
gacucuaacagua

SEQ ID NO: 1559936 - RNA, 20 nt, Homo sapiens
gacucuaacaguaguugcaa

SEQ ID NO: 1559937 - RNA, 16 nt, Homo sapiens
gacucuaauaugauua

SEQ ID NO: 1559938 - RNA, 24 nt, Homo sapiens
gacucugggaaugacaacaccugg

SEQ ID NO: 1559939 - RNA, 17 nt, Homo sapiens
gacucuguaauugaaua

SEQ ID NO: 1559940 - RNA, 13 nt, Homo sapiens
gacugagcagaac

SEQ ID NO: 1559941 - RNA, 18 nt, Homo sapiens
gacugaugagcacaucuc

SEQ ID NO: 1559942 - RNA, 12 nt, Homo sapiens
gacugauuucag

SEQ ID NO: 1559943 - RNA, 17 nt, Homo sapiens
gacugcuaccucugaga

SEQ ID NO: 1559944 - RNA, 13 nt, Homo sapiens
gacuggagcucau

SEQ ID NO: 1559945 - RNA, 17 nt, Homo sapiens
gacuggagcucaucugc

SEQ ID NO: 1559946 - RNA, 19 nt, Homo sapiens
gacuggccucaaagcaagc

SEQ ID NO: 1559947 - RNA, 19 nt, Homo sapiens
gacugugauuagaucacau

SEQ ID NO: 1559948 - RNA, 17 nt, Homo sapiens
gacuguugccacuuaac

SEQ ID NO: 1559949 - RNA, 18 nt, Homo sapiens
gacuuaaggggcugggau

SEQ ID NO: 1559950 - RNA, 16 nt, Homo sapiens
gacuuagccugaguca

SEQ ID NO: 1559951 - RNA, 18 nt, Homo sapiens
gacuuauucauuccucac

SEQ ID NO: 1559952 - RNA, 19 nt, Homo sapiens
gacuuauucauuccucaca

SEQ ID NO: 1559953 - RNA, 17 nt, Homo sapiens
gacuucagucuugccua

SEQ ID NO: 1559954 - RNA, 17 nt, Homo sapiens
gacuuccacaaaccugg

SEQ ID NO: 1559955 - RNA, 20 nt, Homo sapiens
gacuuccucugccacucccu

SEQ ID NO: 1559956 - RNA, 16 nt, Homo sapiens
gacuugaagcacagag

SEQ ID NO: 1559957 - RNA, 16 nt, Homo sapiens
gacuugagccacuccu

SEQ ID NO: 1559958 - RNA, 17 nt, Homo sapiens
gacuugagccacuccuu

SEQ ID NO: 1559959 - RNA, 13 nt, Homo sapiens
gacuuggaaucag

SEQ ID NO: 1559960 - RNA, 18 nt, Homo sapiens
gacuuucaugcagccuaa

SEQ ID NO: 1559961 - RNA, 19 nt, Homo sapiens
gacuuucaugcagccuaaa

SEQ ID NO: 1559962 - RNA, 16 nt, Homo sapiens
gacuuugaaacuauua

SEQ ID NO: 1559963 - RNA, 18 nt, Homo sapiens
gacuuuguguucauuuca

SEQ ID NO: 1559964 - RNA, 18 nt, Homo sapiens
gacuuuuccugcugccug

SEQ ID NO: 1559965 - RNA, 21 nt, Homo sapiens
gagaaaaaugcuccccacagc

SEQ ID NO: 1559966 - RNA, 14 nt, Homo sapiens
gagaaaagccucuc

SEQ ID NO: 1559967 - RNA, 16 nt, Homo sapiens
gagaaaauuccuagaa

SEQ ID NO: 1559968 - RNA, 22 nt, Homo sapiens
gagaaagcagaaaaucuaccaa

SEQ ID NO: 1559969 - RNA, 21 nt, Homo sapiens
gagaaauuuaaacuauaagca

SEQ ID NO: 1559970 - RNA, 18 nt, Homo sapiens
gagaaccuaaugcacucu

SEQ ID NO: 1559971 - RNA, 12 nt, Homo sapiens
gagaacugccuu

SEQ ID NO: 1559972 - RNA, 23 nt, Homo sapiens
gagaagaauuuucagaccccagc

SEQ ID NO: 1559973 - RNA, 20 nt, Homo sapiens
gagaagagaugcugccauuu

SEQ ID NO: 1559974 - RNA, 17 nt, Homo sapiens
gagaagauuuaugucag

SEQ ID NO: 1559975 - RNA, 16 nt, Homo sapiens
gagaagcaauggguca

SEQ ID NO: 1559976 - RNA, 17 nt, Homo sapiens
gagaagcaucauuuccc

SEQ ID NO: 1559977 - RNA, 20 nt, Homo sapiens
gagaagccagcuuuccucau

SEQ ID NO: 1559978 - RNA, 17 nt, Homo sapiens
gagaagcucucgaggga

SEQ ID NO: 1559979 - RNA, 23 nt, Homo sapiens
gagaagguauuagcaaagcaaaa

SEQ ID NO: 1559980 - RNA, 18 nt, Homo sapiens
gagaauaccuuggucuca

SEQ ID NO: 1559981 - RNA, 14 nt, Homo sapiens
gagaauauaccuua

SEQ ID NO: 1559982 - RNA, 22 nt, Homo sapiens
gagaaucacugcuccaggccug

SEQ ID NO: 1559983 - RNA, 13 nt, Homo sapiens
gagaaugucagua

SEQ ID NO: 1559984 - RNA, 16 nt, Homo sapiens
gagaauguucaucucu

SEQ ID NO: 1559985 - RNA, 14 nt, Homo sapiens
gagacaacagguaa

SEQ ID NO: 1559986 - RNA, 13 nt, Homo sapiens
gagacaacaguac

SEQ ID NO: 1559987 - RNA, 16 nt, Homo sapiens
gagacaagcagaguaa

SEQ ID NO: 1559988 - RNA, 15 nt, Homo sapiens
gagacaaggugcuaa

SEQ ID NO: 1559989 - RNA, 20 nt, Homo sapiens
gagacacacuuaacuacuua

SEQ ID NO: 1559990 - RNA, 23 nt, Homo sapiens
gagacagcacagccaaccuagcu

SEQ ID NO: 1559991 - RNA, 14 nt, Homo sapiens
gagacaguugcccg

SEQ ID NO: 1559992 - RNA, 13 nt, Homo sapiens
gagacauugcucu

SEQ ID NO: 1559993 - RNA, 13 nt, Homo sapiens
gagaccagggugg

SEQ ID NO: 1559994 - RNA, 23 nt, Homo sapiens
gagaccccucaauccccaaaggu

SEQ ID NO: 1559995 - RNA, 21 nt, Homo sapiens
gagacgggguuucaccauguu

SEQ ID NO: 1559996 - RNA, 20 nt, Homo sapiens
gagacucaccucugccucaa

SEQ ID NO: 1559997 - RNA, 23 nt, Homo sapiens
gagacuccaucucuuuaaaaaca

SEQ ID NO: 1559998 - RNA, 12 nt, Homo sapiens
gagacucuaggg

SEQ ID NO: 1559999 - RNA, 13 nt, Homo sapiens
gagacugcaaugu

SEQ ID NO: 1560000 - RNA, 16 nt, Homo sapiens
gagacugucccugaaa

SEQ ID NO: 1560001 - RNA, 20 nt, Homo sapiens
gagacuugugcucaaggaau

SEQ ID NO: 1560002 - RNA, 20 nt, Homo sapiens
gagacuuugaaacuaucuca

SEQ ID NO: 1560003 - RNA, 15 nt, Homo sapiens
gagagagacaggcag

SEQ ID NO: 1560004 - RNA, 19 nt, Homo sapiens
gagagagucuuacucugcc

SEQ ID NO: 1560005 - RNA, 18 nt, Homo sapiens
gagaggcacucagugagc

SEQ ID NO: 1560006 - RNA, 16 nt, Homo sapiens
gagaggcaggcauaga

SEQ ID NO: 1560007 - RNA, 19 nt, Homo sapiens
gagaggccacagugcaauu

SEQ ID NO: 1560008 - RNA, 13 nt, Homo sapiens
gagagucacuuga

SEQ ID NO: 1560009 - RNA, 14 nt, Homo sapiens
gagagugagacuca

SEQ ID NO: 1560010 - RNA, 13 nt, Homo sapiens
gagagugcacugc

SEQ ID NO: 1560011 - RNA, 23 nt, Homo sapiens
gagaguuucuauggauucacuuc

SEQ ID NO: 1560012 - RNA, 15 nt, Homo sapiens
gagauaaaagcaauu

SEQ ID NO: 1560013 - RNA, 13 nt, Homo sapiens
gagauaaagcuua

SEQ ID NO: 1560014 - RNA, 18 nt, Homo sapiens
gagauaagaucuauagcc

SEQ ID NO: 1560015 - RNA, 11 nt, Homo sapiens
gagaucccaac

SEQ ID NO: 1560016 - RNA, 20 nt, Homo sapiens
gagaucgugcuacugcacuc

SEQ ID NO: 1560017 - RNA, 21 nt, Homo sapiens
gagaucgugcuacugcacucc

SEQ ID NO: 1560018 - RNA, 17 nt, Homo sapiens
gagaucuuucuuuccaa

SEQ ID NO: 1560019 - RNA, 20 nt, Homo sapiens
gagaugcuucucuccuugcc

SEQ ID NO: 1560020 - RNA, 18 nt, Homo sapiens
gagauggaggcgggaaaa

SEQ ID NO: 1560021 - RNA, 22 nt, Homo sapiens
gagauggagucuugcucuguca

SEQ ID NO: 1560022 - RNA, 19 nt, Homo sapiens
gagauggucacaugaccca

SEQ ID NO: 1560023 - RNA, 17 nt, Homo sapiens
gagauuaccuccugaga

SEQ ID NO: 1560024 - RNA, 22 nt, Homo sapiens
gagcaaaacuccgucucaaaaa

SEQ ID NO: 1560025 - RNA, 15 nt, Homo sapiens
gagcaaaauaaugca

SEQ ID NO: 1560026 - RNA, 20 nt, Homo sapiens
gagcaacucccucucagcua

SEQ ID NO: 1560027 - RNA, 20 nt, Homo sapiens
gagcaccacacccaguggga

SEQ ID NO: 1560028 - RNA, 18 nt, Homo sapiens
gagcaccuggacauguca

SEQ ID NO: 1560029 - RNA, 21 nt, Homo sapiens
gagcacggacugucaguucuc

SEQ ID NO: 1560030 - RNA, 18 nt, Homo sapiens
gagcacucauuccuuccc

SEQ ID NO: 1560031 - RNA, 16 nt, Homo sapiens
gagcacuccuggugca

SEQ ID NO: 1560032 - RNA, 15 nt, Homo sapiens
gagcagaagcuggag

SEQ ID NO: 1560033 - RNA, 15 nt, Homo sapiens
gagcagagcuuccac

SEQ ID NO: 1560034 - RNA, 14 nt, Homo sapiens
gagcagcagcacca

SEQ ID NO: 1560035 - RNA, 16 nt, Homo sapiens
gagcaggcuacuguca

SEQ ID NO: 1560036 - RNA, 17 nt, Homo sapiens
gagcaggcuacugucag

SEQ ID NO: 1560037 - RNA, 20 nt, Homo sapiens
gagcaggggacuacauguga

SEQ ID NO: 1560038 - RNA, 22 nt, Homo sapiens
gagcaguaaacuuucucugcaa

SEQ ID NO: 1560039 - RNA, 14 nt, Homo sapiens
gagcaucaagccac

SEQ ID NO: 1560040 - RNA, 23 nt, Homo sapiens
gagcaucaaucuuguuacugcug

SEQ ID NO: 1560041 - RNA, 21 nt, Homo sapiens
gagcaucagauuuuaccuaau

SEQ ID NO: 1560042 - RNA, 12 nt, Homo sapiens
ggaggcugagac

SEQ ID NO: 1560043 - RNA, 14 nt, Homo sapiens
ggagggagugcugu

SEQ ID NO: 1560044 - RNA, 21 nt, Homo sapiens
ggagggcccuccgaccacuuc

SEQ ID NO: 1560045 - RNA, 15 nt, Homo sapiens
ggagguauaugauga

SEQ ID NO: 1560046 - RNA, 17 nt, Homo sapiens
ggaggucagaacauucg

SEQ ID NO: 1560047 - RNA, 19 nt, Homo sapiens
ggaggugaccaaaucagug

SEQ ID NO: 1560048 - RNA, 19 nt, Homo sapiens
ggaggugggguacauuucu

SEQ ID NO: 1560049 - RNA, 14 nt, Homo sapiens
ggagucacacagug

SEQ ID NO: 1560050 - RNA, 16 nt, Homo sapiens
ggaguccacaggcucc

SEQ ID NO: 1560051 - RNA, 13 nt, Homo sapiens
ggaguccagaccc

SEQ ID NO: 1560052 - RNA, 23 nt, Homo sapiens
ggaguccagaccccccagccccu

SEQ ID NO: 1560053 - RNA, 22 nt, Homo sapiens
ggagucuugcucugucacccag

SEQ ID NO: 1560054 - RNA, 16 nt, Homo sapiens
ggaguggaucuauuua

SEQ ID NO: 1560055 - RNA, 14 nt, Homo sapiens
ggaguguucccgug

SEQ ID NO: 1560056 - RNA, 22 nt, Homo sapiens
ggaguucaagaccagccugucc

SEQ ID NO: 1560057 - RNA, 16 nt, Homo sapiens
ggaguuggaagugaag

SEQ ID NO: 1560058 - RNA, 18 nt, Homo sapiens
ggauaacuggcacccaga

SEQ ID NO: 1560059 - RNA, 13 nt, Homo sapiens
ggauacuggcaca

SEQ ID NO: 1560060 - RNA, 21 nt, Homo sapiens
ggauauuuacugcucuuuauu

SEQ ID NO: 1560061 - RNA, 19 nt, Homo sapiens
ggaucaguuaacuauugca

SEQ ID NO: 1560062 - RNA, 14 nt, Homo sapiens
ggauccucccucau

SEQ ID NO: 1560063 - RNA, 13 nt, Homo sapiens
ggauccugcacuc

SEQ ID NO: 1560064 - RNA, 17 nt, Homo sapiens
ggaucuaccagcauaaa

SEQ ID NO: 1560065 - RNA, 18 nt, Homo sapiens
ggaucuauugauuugaaa

SEQ ID NO: 1560066 - RNA, 14 nt, Homo sapiens
ggaucuguuccuug

SEQ ID NO: 1560067 - RNA, 23 nt, Homo sapiens
ggaugaaucauauucauaugcag

SEQ ID NO: 1560068 - RNA, 16 nt, Homo sapiens
ggaugagcaugcuguu

SEQ ID NO: 1560069 - RNA, 17 nt, Homo sapiens
ggaugauucaagccauu

SEQ ID NO: 1560070 - RNA, 12 nt, Homo sapiens
ggaugcaugugc

SEQ ID NO: 1560071 - RNA, 22 nt, Homo sapiens
ggaugcccccuguggaugcugc

SEQ ID NO: 1560072 - RNA, 17 nt, Homo sapiens
ggaugguggagggccac

SEQ ID NO: 1560073 - RNA, 11 nt, Homo sapiens
ggaugucauag

SEQ ID NO: 1560074 - RNA, 15 nt, Homo sapiens
ggaugucucucauga

SEQ ID NO: 1560075 - RNA, 22 nt, Homo sapiens
ggauguugaagugagcugagau

SEQ ID NO: 1560076 - RNA, 20 nt, Homo sapiens
ggauuacagguguaagccac

SEQ ID NO: 1560077 - RNA, 23 nt, Homo sapiens
ggauuaccagggacuaucuuugc

SEQ ID NO: 1560078 - RNA, 14 nt, Homo sapiens
ggauuagaaugccg

SEQ ID NO: 1560079 - RNA, 20 nt, Homo sapiens
ggauuauucccaccugccac

SEQ ID NO: 1560080 - RNA, 12 nt, Homo sapiens
ggauuccucacc

SEQ ID NO: 1560081 - RNA, 23 nt, Homo sapiens
ggauugaaaaaaagggcacucug

SEQ ID NO: 1560082 - RNA, 12 nt, Homo sapiens
ggauugugcuuu

SEQ ID NO: 1560083 - RNA, 23 nt, Homo sapiens
ggcaaaaguaaucauguuuuaau

SEQ ID NO: 1560084 - RNA, 17 nt, Homo sapiens
ggcaaagaaaggagaua

SEQ ID NO: 1560085 - RNA, 18 nt, Homo sapiens
ggcaaagaacucauuuga

SEQ ID NO: 1560086 - RNA, 22 nt, Homo sapiens
ggcaaagauuuuuggcacuuug

SEQ ID NO: 1560087 - RNA, 17 nt, Homo sapiens
ggcaaaugccugacuca

SEQ ID NO: 1560088 - RNA, 19 nt, Homo sapiens
ggcaaaugccugacucagu

SEQ ID NO: 1560089 - RNA, 18 nt, Homo sapiens
ggcaacagggccaugugc

SEQ ID NO: 1560090 - RNA, 14 nt, Homo sapiens
ggcaacuguaugaa

SEQ ID NO: 1560091 - RNA, 15 nt, Homo sapiens
ggcaagagaauugaa

SEQ ID NO: 1560092 - RNA, 17 nt, Homo sapiens
ggcaagcccugcccaca

SEQ ID NO: 1560093 - RNA, 20 nt, Homo sapiens
ggcaagcccugcccacagaa

SEQ ID NO: 1560094 - RNA, 22 nt, Homo sapiens
ggcaagcguguucucagcacau

SEQ ID NO: 1560095 - RNA, 23 nt, Homo sapiens
ggcaaugcucaccucuucuuuac

SEQ ID NO: 1560096 - RNA, 18 nt, Homo sapiens
ggcaauuuuugacauuaa

SEQ ID NO: 1560097 - RNA, 22 nt, Homo sapiens
ggcacaagugucccugggccua

SEQ ID NO: 1560098 - RNA, 13 nt, Homo sapiens
ggcacaguggcuc

SEQ ID NO: 1560099 - RNA, 22 nt, Homo sapiens
ggcacauacaccucgucaagag

SEQ ID NO: 1560100 - RNA, 20 nt, Homo sapiens
ggcacauguauacauaugua

SEQ ID NO: 1560101 - RNA, 13 nt, Homo sapiens
ggcaccaacucca

SEQ ID NO: 1560102 - RNA, 13 nt, Homo sapiens
ggcacuacaggca

SEQ ID NO: 1560103 - RNA, 14 nt, Homo sapiens
ggcacucagucucu

SEQ ID NO: 1560104 - RNA, 20 nt, Homo sapiens
ggcacuccuggagauaugaa

SEQ ID NO: 1560105 - RNA, 23 nt, Homo sapiens
ggcacuguaaggugcuugcuccc

SEQ ID NO: 1560106 - RNA, 21 nt, Homo sapiens
ggcagaaacacucaaguugau

SEQ ID NO: 1560107 - RNA, 15 nt, Homo sapiens
ggcagaaugaaucua

SEQ ID NO: 1560108 - RNA, 17 nt, Homo sapiens
ggcagagggagaaucca

SEQ ID NO: 1560109 - RNA, 14 nt, Homo sapiens
ggcagauccugccc

SEQ ID NO: 1560110 - RNA, 12 nt, Homo sapiens
ggcagcaauuua

SEQ ID NO: 1560111 - RNA, 13 nt, Homo sapiens
ggcagcacaggaa

SEQ ID NO: 1560112 - RNA, 21 nt, Homo sapiens
ggcagcauggagcuauaacua

SEQ ID NO: 1560113 - RNA, 10 nt, Homo sapiens
ggcagccacc

SEQ ID NO: 1560114 - RNA, 13 nt, Homo sapiens
ggcagcccagugc

SEQ ID NO: 1560115 - RNA, 18 nt, Homo sapiens
ggcagcuacaagugcagc

SEQ ID NO: 1560116 - RNA, 16 nt, Homo sapiens
ggcagcugccucugcu

SEQ ID NO: 1560117 - RNA, 20 nt, Homo sapiens
ggcaggagaaucacuugaac

SEQ ID NO: 1560118 - RNA, 14 nt, Homo sapiens
ggcaggagagucac

SEQ ID NO: 1560119 - RNA, 22 nt, Homo sapiens
ggcaggcggaucaugaggucag

SEQ ID NO: 1560120 - RNA, 22 nt, Homo sapiens
ggcaggcucacugccaggccag

SEQ ID NO: 1560121 - RNA, 16 nt, Homo sapiens
ggcaggcuccaggccu

SEQ ID NO: 1560122 - RNA, 18 nt, Homo sapiens
ggcaggcugggccauguc

SEQ ID NO: 1560123 - RNA, 21 nt, Homo sapiens
ggcaggggcuucuagcugacu

SEQ ID NO: 1560124 - RNA, 15 nt, Homo sapiens
ggcaggucacuuuac

SEQ ID NO: 1560125 - RNA, 15 nt, Homo sapiens
ggcagucaucaguca

SEQ ID NO: 1560126 - RNA, 15 nt, Homo sapiens
ggcagugagugccau

SEQ ID NO: 1560127 - RNA, 22 nt, Homo sapiens
ggcagugagugccaugcuuuuu

SEQ ID NO: 1560128 - RNA, 10 nt, Homo sapiens
ggcaguuuuu

SEQ ID NO: 1560129 - RNA, 11 nt, Homo sapiens
ggcauaugcac

SEQ ID NO: 1560130 - RNA, 22 nt, Homo sapiens
ggcaucacacuuauauuuuaug

SEQ ID NO: 1560131 - RNA, 21 nt, Homo sapiens
ggcaucaguaugucacucugg

SEQ ID NO: 1560132 - RNA, 14 nt, Homo sapiens
ggcaucuauuuccu

SEQ ID NO: 1560133 - RNA, 13 nt, Homo sapiens
ggcaugauggugc

SEQ ID NO: 1560134 - RNA, 23 nt, Homo sapiens
ggcauggugguuuacgccuauaa

SEQ ID NO: 1560135 - RNA, 14 nt, Homo sapiens
ggcaugucauuugc

SEQ ID NO: 1560136 - RNA, 16 nt, Homo sapiens
ggccaacaugucagaa

SEQ ID NO: 1560137 - RNA, 22 nt, Homo sapiens
ggccaagcaggcugguuugcaa

SEQ ID NO: 1560138 - RNA, 22 nt, Homo sapiens
ggccaagccuaucaaaggaaau

SEQ ID NO: 1560139 - RNA, 14 nt, Homo sapiens
ggccaauauaccua

SEQ ID NO: 1560140 - RNA, 21 nt, Homo sapiens
ggccacaaaaguucccucuca

SEQ ID NO: 1560141 - RNA, 13 nt, Homo sapiens
ggccacaggcagu

SEQ ID NO: 1560142 - RNA, 22 nt, Homo sapiens
ggccagagagggcgugggcgcu

SEQ ID NO: 1560143 - RNA, 15 nt, Homo sapiens
ggccagcacuuccau

SEQ ID NO: 1560144 - RNA, 15 nt, Homo sapiens
ggccagcauuuucau

SEQ ID NO: 1560145 - RNA, 15 nt, Homo sapiens
ggccaggauggucuc

SEQ ID NO: 1560146 - RNA, 20 nt, Homo sapiens
ggccaggcuggucuugaacu

SEQ ID NO: 1560147 - RNA, 18 nt, Homo sapiens
ggccaggcuuacugagcu

SEQ ID NO: 1560148 - RNA, 23 nt, Homo sapiens
ggccaugccuggagacauaucac

SEQ ID NO: 1560149 - RNA, 22 nt, Homo sapiens
ggccauggaagguucucugugc

SEQ ID NO: 1560150 - RNA, 14 nt, Homo sapiens
ggcccaggagucca

SEQ ID NO: 1560151 - RNA, 14 nt, Homo sapiens
ggccccaccagugc

SEQ ID NO: 1560152 - RNA, 17 nt, Homo sapiens
ggccccaccggggucua

SEQ ID NO: 1560153 - RNA, 23 nt, Homo sapiens
ggcccccaaugacacccaugcca

SEQ ID NO: 1560154 - RNA, 21 nt, Homo sapiens
ggcccucccugucuccagggc

SEQ ID NO: 1560155 - RNA, 18 nt, Homo sapiens
ggcccuguuccccaagga

SEQ ID NO: 1560156 - RNA, 23 nt, Homo sapiens
ggcccuucccacaggacauuucu

SEQ ID NO: 1560157 - RNA, 20 nt, Homo sapiens
ggcccuucucugcagucaag

SEQ ID NO: 1560158 - RNA, 18 nt, Homo sapiens
ggccgccagacucgagag

SEQ ID NO: 1560159 - RNA, 19 nt, Homo sapiens
ggccggacagaacuggugc

SEQ ID NO: 1560160 - RNA, 21 nt, Homo sapiens
ggccucaacuccucccauaga

SEQ ID NO: 1560161 - RNA, 14 nt, Homo sapiens
gaaugcuauguucu

SEQ ID NO: 1560162 - RNA, 16 nt, Homo sapiens
gaaugcuugcuguaau

SEQ ID NO: 1560163 - RNA, 17 nt, Homo sapiens
gaaugggagcugcaaac

SEQ ID NO: 1560164 - RNA, 21 nt, Homo sapiens
gaaugggcuugaaacauuaua

SEQ ID NO: 1560165 - RNA, 23 nt, Homo sapiens
gaauguaaaaaagaaaaaacugg

SEQ ID NO: 1560166 - RNA, 22 nt, Homo sapiens
gaauguacaguugagcucaggu

SEQ ID NO: 1560167 - RNA, 13 nt, Homo sapiens
gaauguauuuuca

SEQ ID NO: 1560168 - RNA, 14 nt, Homo sapiens
gaauguucaucucu

SEQ ID NO: 1560169 - RNA, 15 nt, Homo sapiens
gaauuacgugcucug

SEQ ID NO: 1560170 - RNA, 12 nt, Homo sapiens
gaauuacuuuau

SEQ ID NO: 1560171 - RNA, 16 nt, Homo sapiens
gaauuauugacacuga

SEQ ID NO: 1560172 - RNA, 22 nt, Homo sapiens
gaauuauuguagacaugcccaa

SEQ ID NO: 1560173 - RNA, 14 nt, Homo sapiens
gaauucaaaaguga

SEQ ID NO: 1560174 - RNA, 20 nt, Homo sapiens
gaauugaacgacuguauauu

SEQ ID NO: 1560175 - RNA, 20 nt, Homo sapiens
gaauuggcuuccagauuuua

SEQ ID NO: 1560176 - RNA, 12 nt, Homo sapiens
gaauuugagugc

SEQ ID NO: 1560177 - RNA, 14 nt, Homo sapiens
gaauuugcaaagua

SEQ ID NO: 1560178 - RNA, 21 nt, Homo sapiens
gaauuuugggacuucuaccca

SEQ ID NO: 1560179 - RNA, 16 nt, Homo sapiens
gaauuuuugcaauaau

SEQ ID NO: 1560180 - RNA, 20 nt, Homo sapiens
gaauuuuugcuaugcuguaa

SEQ ID NO: 1560181 - RNA, 23 nt, Homo sapiens
gaauuuuuugagagaaugagaug

SEQ ID NO: 1560182 - RNA, 23 nt, Homo sapiens
gaauuuuuuuuuuuaagcucaaa

SEQ ID NO: 1560183 - RNA, 16 nt, Homo sapiens
gacaaaauucauuugc

SEQ ID NO: 1560184 - RNA, 21 nt, Homo sapiens
gacaaagaauuccaaagcaaa

SEQ ID NO: 1560185 - RNA, 18 nt, Homo sapiens
gacaaauauucugaauca

SEQ ID NO: 1560186 - RNA, 19 nt, Homo sapiens
gacaacaccuuccuccugc

SEQ ID NO: 1560187 - RNA, 18 nt, Homo sapiens
gacaacaguucugagcug

SEQ ID NO: 1560188 - RNA, 11 nt, Homo sapiens
gacaacauguu

SEQ ID NO: 1560189 - RNA, 23 nt, Homo sapiens
gacaaccaccaggugucaaauga

SEQ ID NO: 1560190 - RNA, 11 nt, Homo sapiens
gacaacucugu

SEQ ID NO: 1560191 - RNA, 20 nt, Homo sapiens
gacaagacccccagcacuug

SEQ ID NO: 1560192 - RNA, 19 nt, Homo sapiens
gacaagcgccgcugugagg

SEQ ID NO: 1560193 - RNA, 13 nt, Homo sapiens
gacaagcuguaua

SEQ ID NO: 1560194 - RNA, 17 nt, Homo sapiens
gacaaggaggaguucca

SEQ ID NO: 1560195 - RNA, 12 nt, Homo sapiens
gacaaugaaggg

SEQ ID NO: 1560196 - RNA, 12 nt, Homo sapiens
gacaaugccaau

SEQ ID NO: 1560197 - RNA, 14 nt, Homo sapiens
gacaaugccaauag

SEQ ID NO: 1560198 - RNA, 23 nt, Homo sapiens
gacaauguugcauuuaugaugca

SEQ ID NO: 1560199 - RNA, 15 nt, Homo sapiens
gacacacuguuacac

SEQ ID NO: 1560200 - RNA, 16 nt, Homo sapiens
gacacagcaucagcuc

SEQ ID NO: 1560201 - RNA, 11 nt, Homo sapiens
gacacauauca

SEQ ID NO: 1560202 - RNA, 16 nt, Homo sapiens
gacaccauucauucca

SEQ ID NO: 1560203 - RNA, 15 nt, Homo sapiens
gacacccugaucuuc

SEQ ID NO: 1560204 - RNA, 17 nt, Homo sapiens
gacacccugaucuucac

SEQ ID NO: 1560205 - RNA, 19 nt, Homo sapiens
gacaccuguacauucuucc

SEQ ID NO: 1560206 - RNA, 19 nt, Homo sapiens
gacacuccccgaagucuuu

SEQ ID NO: 1560207 - RNA, 19 nt, Homo sapiens
gacacuguccaugaagcac

SEQ ID NO: 1560208 - RNA, 13 nt, Homo sapiens
gacagaaagcaga

SEQ ID NO: 1560209 - RNA, 18 nt, Homo sapiens
gacagaacuggugcucuc

SEQ ID NO: 1560210 - RNA, 13 nt, Homo sapiens
gacagaagcuauu

SEQ ID NO: 1560211 - RNA, 13 nt, Homo sapiens
gacagaauguguu

SEQ ID NO: 1560212 - RNA, 11 nt, Homo sapiens
gacagacaccg

SEQ ID NO: 1560213 - RNA, 18 nt, Homo sapiens
gacagcaucccuucccac

SEQ ID NO: 1560214 - RNA, 15 nt, Homo sapiens
gacagccaccaagaa

SEQ ID NO: 1560215 - RNA, 16 nt, Homo sapiens
gacagccaccaagaag

SEQ ID NO: 1560216 - RNA, 22 nt, Homo sapiens
gacagcccuuccucccauuucc

SEQ ID NO: 1560217 - RNA, 15 nt, Homo sapiens
gacaggcaggccaga

SEQ ID NO: 1560218 - RNA, 18 nt, Homo sapiens
gacagggcugcuccccaa

SEQ ID NO: 1560219 - RNA, 17 nt, Homo sapiens
gacaggugaggucuguu

SEQ ID NO: 1560220 - RNA, 14 nt, Homo sapiens
gacaguaaacacuc

SEQ ID NO: 1560221 - RNA, 12 nt, Homo sapiens
gacaguaccuga

SEQ ID NO: 1560222 - RNA, 21 nt, Homo sapiens
gacagucgcucagucuguuca

SEQ ID NO: 1560223 - RNA, 19 nt, Homo sapiens
gacagugcccuuggugcga

SEQ ID NO: 1560224 - RNA, 16 nt, Homo sapiens
gacaguuacacuugac

SEQ ID NO: 1560225 - RNA, 22 nt, Homo sapiens
gacauagauuucauaguauuuu

SEQ ID NO: 1560226 - RNA, 16 nt, Homo sapiens
gacauagcgagacucc

SEQ ID NO: 1560227 - RNA, 13 nt, Homo sapiens
gacauauaucuau

SEQ ID NO: 1560228 - RNA, 15 nt, Homo sapiens
gacaucaagacuuug

SEQ ID NO: 1560229 - RNA, 14 nt, Homo sapiens
gacaugacauucuu

SEQ ID NO: 1560230 - RNA, 15 nt, Homo sapiens
gacaugcccaaaacu

SEQ ID NO: 1560231 - RNA, 17 nt, Homo sapiens
gacaugcuuuccauuuu

SEQ ID NO: 1560232 - RNA, 21 nt, Homo sapiens
gacauggcaaucuagaccggu

SEQ ID NO: 1560233 - RNA, 22 nt, Homo sapiens
gacaugugcuggacacugucca

SEQ ID NO: 1560234 - RNA, 18 nt, Homo sapiens
gacauguuggaaauguag

SEQ ID NO: 1560235 - RNA, 13 nt, Homo sapiens
gacauucacugag

SEQ ID NO: 1560236 - RNA, 17 nt, Homo sapiens
gacauucuuagcuguaa

SEQ ID NO: 1560237 - RNA, 21 nt, Homo sapiens
gaccaauauuguacaguuuuu

SEQ ID NO: 1560238 - RNA, 23 nt, Homo sapiens
gaccaaugugugaaguaugcacu

SEQ ID NO: 1560239 - RNA, 15 nt, Homo sapiens
gaccacccaaccuca

SEQ ID NO: 1560240 - RNA, 16 nt, Homo sapiens
gaccaccuaauaucaa

SEQ ID NO: 1560241 - RNA, 18 nt, Homo sapiens
cucccuggcuucuguggg

SEQ ID NO: 1560242 - RNA, 19 nt, Homo sapiens
cucccuucucguguuugcu

SEQ ID NO: 1560243 - RNA, 21 nt, Homo sapiens
cuccgaccacuuccaggggaa

SEQ ID NO: 1560244 - RNA, 13 nt, Homo sapiens
cuccgaggccagu

SEQ ID NO: 1560245 - RNA, 15 nt, Homo sapiens
cuccgucugcuccaa

SEQ ID NO: 1560246 - RNA, 20 nt, Homo sapiens
cuccgugcuuaaccaaagaa

SEQ ID NO: 1560247 - RNA, 13 nt, Homo sapiens
cuccuacccugau

SEQ ID NO: 1560248 - RNA, 22 nt, Homo sapiens
cuccuagaagaaccaaauaccu

SEQ ID NO: 1560249 - RNA, 21 nt, Homo sapiens
cuccucaggcacacagcuacu

SEQ ID NO: 1560250 - RNA, 23 nt, Homo sapiens
cuccucaggcccagcugcucccc

SEQ ID NO: 1560251 - RNA, 20 nt, Homo sapiens
cuccuccagggccacgugcc

SEQ ID NO: 1560252 - RNA, 19 nt, Homo sapiens
cuccucggucgccccgugu

SEQ ID NO: 1560253 - RNA, 22 nt, Homo sapiens
cuccucuuucaaccucagugau

SEQ ID NO: 1560254 - RNA, 23 nt, Homo sapiens
cuccugaaguugcugcugugaau

SEQ ID NO: 1560255 - RNA, 19 nt, Homo sapiens
cuccugagccccucaaucc

SEQ ID NO: 1560256 - RNA, 21 nt, Homo sapiens
cuccugauaaaacaacagcuc

SEQ ID NO: 1560257 - RNA, 16 nt, Homo sapiens
cuccugcacuguuuaa

SEQ ID NO: 1560258 - RNA, 18 nt, Homo sapiens
cuccugccuaauuuugaa

SEQ ID NO: 1560259 - RNA, 19 nt, Homo sapiens
cuccugcucauauugugau

SEQ ID NO: 1560260 - RNA, 17 nt, Homo sapiens
cuccuggaccaggucuc

SEQ ID NO: 1560261 - RNA, 17 nt, Homo sapiens
cuccuggggacuuggaa

SEQ ID NO: 1560262 - RNA, 14 nt, Homo sapiens
cuccuggugcucca

SEQ ID NO: 1560263 - RNA, 17 nt, Homo sapiens
cuccuguaccucagugg

SEQ ID NO: 1560264 - RNA, 21 nt, Homo sapiens
cuccuguauuuaacaaaaagu

SEQ ID NO: 1560265 - RNA, 13 nt, Homo sapiens
cuccuucagcucu

SEQ ID NO: 1560266 - RNA, 15 nt, Homo sapiens
cuccuuccaccacaa

SEQ ID NO: 1560267 - RNA, 23 nt, Homo sapiens
cuccuuccuggagcccagaggag

SEQ ID NO: 1560268 - RNA, 17 nt, Homo sapiens
cuccuucuuccuagcca

SEQ ID NO: 1560269 - RNA, 17 nt, Homo sapiens
cuccuugaucaugucuu

SEQ ID NO: 1560270 - RNA, 15 nt, Homo sapiens
cuccuuggccacaga

SEQ ID NO: 1560271 - RNA, 15 nt, Homo sapiens
cuccuuuaccuuuca

SEQ ID NO: 1560272 - RNA, 15 nt, Homo sapiens
cuccuuuccaauaga

SEQ ID NO: 1560273 - RNA, 16 nt, Homo sapiens
cucgaggccugcaaac

SEQ ID NO: 1560274 - RNA, 13 nt, Homo sapiens
cucgaguacugug

SEQ ID NO: 1560275 - RNA, 21 nt, Homo sapiens
cucgcaagggaaguccuugca

SEQ ID NO: 1560276 - RNA, 12 nt, Homo sapiens
cucggacugugu

SEQ ID NO: 1560277 - RNA, 22 nt, Homo sapiens
cucggggacgcccccaccagcu

SEQ ID NO: 1560278 - RNA, 14 nt, Homo sapiens
cucggggucccugg

SEQ ID NO: 1560279 - RNA, 15 nt, Homo sapiens
cucgugagucauuua

SEQ ID NO: 1560280 - RNA, 11 nt, Homo sapiens
cucgugccaug

SEQ ID NO: 1560281 - RNA, 20 nt, Homo sapiens
cucgugguaggacuguagaa

SEQ ID NO: 1560282 - RNA, 15 nt, Homo sapiens
cucguguuugcuuaa

SEQ ID NO: 1560283 - RNA, 16 nt, Homo sapiens
cucguuagccuuccuc

SEQ ID NO: 1560284 - RNA, 16 nt, Homo sapiens
cucuaacaaugacauu

SEQ ID NO: 1560285 - RNA, 18 nt, Homo sapiens
cucuaacaguaguugcaa

SEQ ID NO: 1560286 - RNA, 16 nt, Homo sapiens
cucuaacuccugccau

SEQ ID NO: 1560287 - RNA, 22 nt, Homo sapiens
cucuaagauaucuuugcugcuu

SEQ ID NO: 1560288 - RNA, 12 nt, Homo sapiens
cucuacccugag

SEQ ID NO: 1560289 - RNA, 19 nt, Homo sapiens
cucuacuaaaauucaaaaa

SEQ ID NO: 1560290 - RNA, 19 nt, Homo sapiens
cucuacuugucauaucacu

SEQ ID NO: 1560291 - RNA, 23 nt, Homo sapiens
cucuagaaagcucuaaagaccau

SEQ ID NO: 1560292 - RNA, 13 nt, Homo sapiens
cucuagaagccaa

SEQ ID NO: 1560293 - RNA, 20 nt, Homo sapiens
cucuagcuuaaguguaaaug

SEQ ID NO: 1560294 - RNA, 22 nt, Homo sapiens
cucuagguacgaugacaguguu

SEQ ID NO: 1560295 - RNA, 21 nt, Homo sapiens
cucuaguaaauuuaaguccac

SEQ ID NO: 1560296 - RNA, 22 nt, Homo sapiens
cucuauacaaaaugauuuugaa

SEQ ID NO: 1560297 - RNA, 22 nt, Homo sapiens
cucuauuuuacuuuucugccaa

SEQ ID NO: 1560298 - RNA, 19 nt, Homo sapiens
cucucaacaggacuuaaca

SEQ ID NO: 1560299 - RNA, 13 nt, Homo sapiens
cucucacccucau

SEQ ID NO: 1560300 - RNA, 13 nt, Homo sapiens
cucucaccucauu

SEQ ID NO: 1560301 - RNA, 16 nt, Homo sapiens
cucucaccugcuccca

SEQ ID NO: 1560302 - RNA, 11 nt, Homo sapiens
cucucaucucu

SEQ ID NO: 1560303 - RNA, 14 nt, Homo sapiens
cucuccauccugcu

SEQ ID NO: 1560304 - RNA, 13 nt, Homo sapiens
cucucccagugaa

SEQ ID NO: 1560305 - RNA, 21 nt, Homo sapiens
cucuccccagccuccccgugc

SEQ ID NO: 1560306 - RNA, 16 nt, Homo sapiens
cucucccugccaaguc

SEQ ID NO: 1560307 - RNA, 13 nt, Homo sapiens
cucuccugcugca

SEQ ID NO: 1560308 - RNA, 20 nt, Homo sapiens
cucuccuguaagccaaagaa

SEQ ID NO: 1560309 - RNA, 22 nt, Homo sapiens
cucuccuuaaccuccagcagac

SEQ ID NO: 1560310 - RNA, 17 nt, Homo sapiens
cucuccuuggccacaga

SEQ ID NO: 1560311 - RNA, 18 nt, Homo sapiens
cucucgacaguauccaca

SEQ ID NO: 1560312 - RNA, 16 nt, Homo sapiens
cucucuaucccugaaa

SEQ ID NO: 1560313 - RNA, 11 nt, Homo sapiens
cucucucauga

SEQ ID NO: 1560314 - RNA, 13 nt, Homo sapiens
cucucucaugaua

SEQ ID NO: 1560315 - RNA, 20 nt, Homo sapiens
cucucucuagaaugagcaag

SEQ ID NO: 1560316 - RNA, 18 nt, Homo sapiens
cucucugccauucugugc

SEQ ID NO: 1560317 - RNA, 17 nt, Homo sapiens
cucucugggacucuccu

SEQ ID NO: 1560318 - RNA, 21 nt, Homo sapiens
cucugacaguauuaacaucaa

SEQ ID NO: 1560319 - RNA, 22 nt, Homo sapiens
cucugacaguccacaggggcca

SEQ ID NO: 1560320 - RNA, 18 nt, Homo sapiens
cucugacucagggcuccu

SEQ ID NO: 1560321 - RNA, 19 nt, Homo sapiens
cucugagaagacacaaggu

SEQ ID NO: 1560322 - RNA, 22 nt, Homo sapiens
cucugagauacuaauaggugug

SEQ ID NO: 1560323 - RNA, 14 nt, Homo sapiens
cucugauagcuguu

SEQ ID NO: 1560324 - RNA, 15 nt, Homo sapiens
cucugaucaaguauu

SEQ ID NO: 1560325 - RNA, 14 nt, Homo sapiens
cucugcacccagug

SEQ ID NO: 1560326 - RNA, 14 nt, Homo sapiens
cucugcauagacaa

SEQ ID NO: 1560327 - RNA, 22 nt, Homo sapiens
cucugcauccagagauucauuu

SEQ ID NO: 1560328 - RNA, 23 nt, Homo sapiens
cucugcccagccgggcacagugg

SEQ ID NO: 1560329 - RNA, 21 nt, Homo sapiens
cucugcccauccugccccuga

SEQ ID NO: 1560330 - RNA, 15 nt, Homo sapiens
cucugccuuaaacac

SEQ ID NO: 1560331 - RNA, 21 nt, Homo sapiens
cucugccuuaaacacacauug

SEQ ID NO: 1560332 - RNA, 22 nt, Homo sapiens
cucugccuuaaacacacauugc

SEQ ID NO: 1560333 - RNA, 18 nt, Homo sapiens
cucugcuaccaucucauu

SEQ ID NO: 1560334 - RNA, 20 nt, Homo sapiens
cucuggacacucuauaugua

SEQ ID NO: 1560335 - RNA, 16 nt, Homo sapiens
cucuggaccauauacc

SEQ ID NO: 1560336 - RNA, 14 nt, Homo sapiens
cucuggcaccacac

SEQ ID NO: 1560337 - RNA, 14 nt, Homo sapiens
cucuggcacuuuga

SEQ ID NO: 1560338 - RNA, 20 nt, Homo sapiens
cucuguaaaacgcaccaauc

SEQ ID NO: 1560339 - RNA, 20 nt, Homo sapiens
cucuguaaaaugcaccaauc

SEQ ID NO: 1560340 - RNA, 14 nt, Homo sapiens
cucuguaauugaau

SEQ ID NO: 1560341 - RNA, 23 nt, Homo sapiens
cucuguacagcugcucuuaccca

SEQ ID NO: 1560342 - RNA, 23 nt, Homo sapiens
cucuguagagagcagcauuccca

SEQ ID NO: 1560343 - RNA, 12 nt, Homo sapiens
cucugucagcca

SEQ ID NO: 1560344 - RNA, 14 nt, Homo sapiens
cucugucauaugca

SEQ ID NO: 1560345 - RNA, 18 nt, Homo sapiens
cugauggccuuaauuucc

SEQ ID NO: 1560346 - RNA, 20 nt, Homo sapiens
cugaugugggagcugaacca

SEQ ID NO: 1560347 - RNA, 21 nt, Homo sapiens
cugauguguucucugaucugc

SEQ ID NO: 1560348 - RNA, 14 nt, Homo sapiens
cugauucugaacaa

SEQ ID NO: 1560349 - RNA, 15 nt, Homo sapiens
cugauuuacauucaa

SEQ ID NO: 1560350 - RNA, 21 nt, Homo sapiens
cugauuucuauggcuuucaaa

SEQ ID NO: 1560351 - RNA, 19 nt, Homo sapiens
cugcaaaaaugaaauccag

SEQ ID NO: 1560352 - RNA, 17 nt, Homo sapiens
cugcaaaacuccaggca

SEQ ID NO: 1560353 - RNA, 18 nt, Homo sapiens
cugcaaaccuuccuggga

SEQ ID NO: 1560354 - RNA, 14 nt, Homo sapiens
cugcaaauacugua

SEQ ID NO: 1560355 - RNA, 15 nt, Homo sapiens
cugcaaauacuguau

SEQ ID NO: 1560356 - RNA, 23 nt, Homo sapiens
cugcaagaagaaaucaugauaua

SEQ ID NO: 1560357 - RNA, 13 nt, Homo sapiens
cugcaagaccacg

SEQ ID NO: 1560358 - RNA, 17 nt, Homo sapiens
cugcaauccaaugcacu

SEQ ID NO: 1560359 - RNA, 16 nt, Homo sapiens
cugcacaaaagcagau

SEQ ID NO: 1560360 - RNA, 22 nt, Homo sapiens
cugcacaaaagcagauacuuga

SEQ ID NO: 1560361 - RNA, 14 nt, Homo sapiens
cucaccaaacacaa

SEQ ID NO: 1560362 - RNA, 14 nt, Homo sapiens
cucaccaagcucaa

SEQ ID NO: 1560363 - RNA, 15 nt, Homo sapiens
cucaccacuaccagc

SEQ ID NO: 1560364 - RNA, 19 nt, Homo sapiens
cucacccaccccugcacag

SEQ ID NO: 1560365 - RNA, 15 nt, Homo sapiens
cucacccaggcaauc

SEQ ID NO: 1560366 - RNA, 15 nt, Homo sapiens
cucaccucuugccuu

SEQ ID NO: 1560367 - RNA, 15 nt, Homo sapiens
cucacucacucugau

SEQ ID NO: 1560368 - RNA, 15 nt, Homo sapiens
cucacuccaccaccc

SEQ ID NO: 1560369 - RNA, 16 nt, Homo sapiens
cucacucuguugccca

SEQ ID NO: 1560370 - RNA, 22 nt, Homo sapiens
cucacugcugcaaauacuguau

SEQ ID NO: 1560371 - RNA, 23 nt, Homo sapiens
cucacugcugcaaauacuguaua

SEQ ID NO: 1560372 - RNA, 14 nt, Homo sapiens
cucacuguauccag

SEQ ID NO: 1560373 - RNA, 15 nt, Homo sapiens
cucacugucuauuua

SEQ ID NO: 1560374 - RNA, 17 nt, Homo sapiens
cucagaacaauccgauu

SEQ ID NO: 1560375 - RNA, 17 nt, Homo sapiens
cucagaaccauuucacc

SEQ ID NO: 1560376 - RNA, 14 nt, Homo sapiens
cucagaagcacaga

SEQ ID NO: 1560377 - RNA, 17 nt, Homo sapiens
cucagaaggccccagag

SEQ ID NO: 1560378 - RNA, 21 nt, Homo sapiens
cucagaauucggugugcugcc

SEQ ID NO: 1560379 - RNA, 14 nt, Homo sapiens
cucagacccaacag

SEQ ID NO: 1560380 - RNA, 13 nt, Homo sapiens
cucagacccagga

SEQ ID NO: 1560381 - RNA, 19 nt, Homo sapiens
cucagacccugcuuaggau

SEQ ID NO: 1560382 - RNA, 17 nt, Homo sapiens
cucagagugacagucau

SEQ ID NO: 1560383 - RNA, 13 nt, Homo sapiens
cucagauguugaa

SEQ ID NO: 1560384 - RNA, 13 nt, Homo sapiens
cucagauucuuca

SEQ ID NO: 1560385 - RNA, 22 nt, Homo sapiens
cucagcacaccggcauccccac

SEQ ID NO: 1560386 - RNA, 14 nt, Homo sapiens
cucagcacugggau

SEQ ID NO: 1560387 - RNA, 16 nt, Homo sapiens
cucagccacugucaca

SEQ ID NO: 1560388 - RNA, 21 nt, Homo sapiens
cucagccacugucacaggcau

SEQ ID NO: 1560389 - RNA, 16 nt, Homo sapiens
cucagcccuuccccau

SEQ ID NO: 1560390 - RNA, 12 nt, Homo sapiens
cucagccuaaga

SEQ ID NO: 1560391 - RNA, 15 nt, Homo sapiens
cucagcuacugcaaa

SEQ ID NO: 1560392 - RNA, 15 nt, Homo sapiens
cucagcuucuucaca

SEQ ID NO: 1560393 - RNA, 18 nt, Homo sapiens
cucagcuucuucuuucau

SEQ ID NO: 1560394 - RNA, 16 nt, Homo sapiens
cucaggaaccgaggca

SEQ ID NO: 1560395 - RNA, 17 nt, Homo sapiens
cucaggacugcaacagg

SEQ ID NO: 1560396 - RNA, 17 nt, Homo sapiens
cucaggagucucuggua

SEQ ID NO: 1560397 - RNA, 19 nt, Homo sapiens
cucaggcccaggaguccag

SEQ ID NO: 1560398 - RNA, 22 nt, Homo sapiens
cucagggagcagggaaggccug

SEQ ID NO: 1560399 - RNA, 17 nt, Homo sapiens
cucagggccucaggcac

SEQ ID NO: 1560400 - RNA, 15 nt, Homo sapiens
cucaguaaaaguaaa

SEQ ID NO: 1560401 - RNA, 13 nt, Homo sapiens
cucaguacuggug

SEQ ID NO: 1560402 - RNA, 17 nt, Homo sapiens
cucagucccuacugagu

SEQ ID NO: 1560403 - RNA, 13 nt, Homo sapiens
cucagugaaggcu

SEQ ID NO: 1560404 - RNA, 14 nt, Homo sapiens
cucagugaccagug

SEQ ID NO: 1560405 - RNA, 20 nt, Homo sapiens
cucaguggcuucuccaggga

SEQ ID NO: 1560406 - RNA, 21 nt, Homo sapiens
cucaguugaaauaacaacaga

SEQ ID NO: 1560407 - RNA, 20 nt, Homo sapiens
cucaguuuaagguacacugu

SEQ ID NO: 1560408 - RNA, 13 nt, Homo sapiens
cucauacaaugau

SEQ ID NO: 1560409 - RNA, 18 nt, Homo sapiens
cucauaccuacaucagac

SEQ ID NO: 1560410 - RNA, 18 nt, Homo sapiens
cucauagauuauuaucua

SEQ ID NO: 1560411 - RNA, 16 nt, Homo sapiens
cucauagguugagcaa

SEQ ID NO: 1560412 - RNA, 16 nt, Homo sapiens
cucaucuuucuccuuc

SEQ ID NO: 1560413 - RNA, 15 nt, Homo sapiens
cucaucuuucuucca

SEQ ID NO: 1560414 - RNA, 14 nt, Homo sapiens
cucaugauguauug

SEQ ID NO: 1560415 - RNA, 18 nt, Homo sapiens
cucaugccuguaaucuca

SEQ ID NO: 1560416 - RNA, 15 nt, Homo sapiens
cucaugcgcaaugag

SEQ ID NO: 1560417 - RNA, 21 nt, Homo sapiens
cucaugcugcagaggguacuu

SEQ ID NO: 1560418 - RNA, 22 nt, Homo sapiens
cucaugcuguugcugcuacugu

SEQ ID NO: 1560419 - RNA, 15 nt, Homo sapiens
cucauguuuacaggg

SEQ ID NO: 1560420 - RNA, 17 nt, Homo sapiens
cucauguuuuuggaaac

SEQ ID NO: 1560421 - RNA, 16 nt, Homo sapiens
cucauuagaauuacca

SEQ ID NO: 1560422 - RNA, 21 nt, Homo sapiens
cucauuaucuugcagcuguaa

SEQ ID NO: 1560423 - RNA, 23 nt, Homo sapiens
cucauucauucauucaguauuua

SEQ ID NO: 1560424 - RNA, 16 nt, Homo sapiens
cucauuccuucacuca

SEQ ID NO: 1560425 - RNA, 12 nt, Homo sapiens
cucauugaagca

SEQ ID NO: 1560426 - RNA, 21 nt, Homo sapiens
cucauuggacccuuccauggu

SEQ ID NO: 1560427 - RNA, 19 nt, Homo sapiens
cucauuuaaaacaggcaaa

SEQ ID NO: 1560428 - RNA, 15 nt, Homo sapiens
cucauuuaagggaaa

SEQ ID NO: 1560429 - RNA, 13 nt, Homo sapiens
cucauuucaucuc

SEQ ID NO: 1560430 - RNA, 16 nt, Homo sapiens
cucauuuuacacaaag

SEQ ID NO: 1560431 - RNA, 15 nt, Homo sapiens
cuccaaaacauuucu

SEQ ID NO: 1560432 - RNA, 22 nt, Homo sapiens
cuccaaagaaauguaagggaaa

SEQ ID NO: 1560433 - RNA, 23 nt, Homo sapiens
cuccaaauccaaggaaacaugca

SEQ ID NO: 1560434 - RNA, 20 nt, Homo sapiens
cuccaaauguccuuucucag

SEQ ID NO: 1560435 - RNA, 20 nt, Homo sapiens
cuccaagauuuaaccugcaa

SEQ ID NO: 1560436 - RNA, 18 nt, Homo sapiens
cuccaagccugccuccca

SEQ ID NO: 1560437 - RNA, 22 nt, Homo sapiens
cuccaagcgcgguuacuauggc

SEQ ID NO: 1560438 - RNA, 22 nt, Homo sapiens
cuccaaggaccucucucaaugc

SEQ ID NO: 1560439 - RNA, 21 nt, Homo sapiens
cuccacagagauacacagaua

SEQ ID NO: 1560440 - RNA, 17 nt, Homo sapiens
cuccacaucugccuuaa

SEQ ID NO: 1560441 - RNA, 15 nt, Homo sapiens
cuccaccucuaccaa

SEQ ID NO: 1560442 - RNA, 15 nt, Homo sapiens
cuccaccugcacauu

SEQ ID NO: 1560443 - RNA, 19 nt, Homo sapiens
cuccacgguagcacuugac

SEQ ID NO: 1560444 - RNA, 22 nt, Homo sapiens
cuccacguggcgggaaugagcu

SEQ ID NO: 1560445 - RNA, 18 nt, Homo sapiens
cuccagagauuugcucaa

SEQ ID NO: 1560446 - RNA, 20 nt, Homo sapiens
cuccagauaguguagcugag

SEQ ID NO: 1560447 - RNA, 22 nt, Homo sapiens
cuccagcccagacccaguggac

SEQ ID NO: 1560448 - RNA, 21 nt, Homo sapiens
cuccagccugggggacagaaa

SEQ ID NO: 1560449 - RNA, 16 nt, Homo sapiens
cuccagcgauggugcu

SEQ ID NO: 1560450 - RNA, 15 nt, Homo sapiens
cuccagcugauccag

SEQ ID NO: 1560451 - RNA, 18 nt, Homo sapiens
cuccaggcuuucaauguu

SEQ ID NO: 1560452 - RNA, 22 nt, Homo sapiens
cuccagggaugauucaagccau

SEQ ID NO: 1560453 - RNA, 13 nt, Homo sapiens
cuccagugcaguc

SEQ ID NO: 1560454 - RNA, 22 nt, Homo sapiens
cuccauaucccuuccucucagg

SEQ ID NO: 1560455 - RNA, 14 nt, Homo sapiens
cuccaucaccagcc

SEQ ID NO: 1560456 - RNA, 14 nt, Homo sapiens
cucccaaaacauuu

SEQ ID NO: 1560457 - RNA, 20 nt, Homo sapiens
cucccaaagggcacaccccu

SEQ ID NO: 1560458 - RNA, 13 nt, Homo sapiens
cucccaagcugcc

SEQ ID NO: 1560459 - RNA, 19 nt, Homo sapiens
cucccaaguagcugggauu

SEQ ID NO: 1560460 - RNA, 22 nt, Homo sapiens
cucccacaaccccccacacucc

SEQ ID NO: 1560461 - RNA, 13 nt, Homo sapiens
cucccacagcuuc

SEQ ID NO: 1560462 - RNA, 12 nt, Homo sapiens
cucccaccucag

SEQ ID NO: 1560463 - RNA, 17 nt, Homo sapiens
cucccaggaagcccagg

SEQ ID NO: 1560464 - RNA, 20 nt, Homo sapiens
cucccaggccccaggggaga

SEQ ID NO: 1560465 - RNA, 21 nt, Homo sapiens
cucccagggucccugcccacu

SEQ ID NO: 1560466 - RNA, 13 nt, Homo sapiens
cucccaguacaac

SEQ ID NO: 1560467 - RNA, 22 nt, Homo sapiens
cucccaugagggagaugccaug

SEQ ID NO: 1560468 - RNA, 20 nt, Homo sapiens
aggcuacuauagguccagaa

SEQ ID NO: 1560469 - RNA, 22 nt, Homo sapiens
aggcuacuguucuugacaauca

SEQ ID NO: 1560470 - RNA, 19 nt, Homo sapiens
aggcuaugggguaggagaa

SEQ ID NO: 1560471 - RNA, 15 nt, Homo sapiens
aggcucaaguuuuua

SEQ ID NO: 1560472 - RNA, 14 nt, Homo sapiens
aggcucacagauuu

SEQ ID NO: 1560473 - RNA, 16 nt, Homo sapiens
aggcucacagauuuaa

SEQ ID NO: 1560474 - RNA, 15 nt, Homo sapiens
aggcucaugccauca

SEQ ID NO: 1560475 - RNA, 21 nt, Homo sapiens
aggcuccaucguccauccucu

SEQ ID NO: 1560476 - RNA, 13 nt, Homo sapiens
aggcucccggggc

SEQ ID NO: 1560477 - RNA, 15 nt, Homo sapiens
aggcugacuucagag

SEQ ID NO: 1560478 - RNA, 22 nt, Homo sapiens
aggcugaugggcaaaaaaccaa

SEQ ID NO: 1560479 - RNA, 16 nt, Homo sapiens
aggcugccagugccug

SEQ ID NO: 1560480 - RNA, 16 nt, Homo sapiens
aggcugccucccaaca

SEQ ID NO: 1560481 - RNA, 22 nt, Homo sapiens
aggcuggaaaugguuucacuug

SEQ ID NO: 1560482 - RNA, 17 nt, Homo sapiens
aggcugggccaugucca

SEQ ID NO: 1560483 - RNA, 18 nt, Homo sapiens
aggcugggccauguccaa

SEQ ID NO: 1560484 - RNA, 15 nt, Homo sapiens
aggcuggguccugcc

SEQ ID NO: 1560485 - RNA, 12 nt, Homo sapiens
aggcuggucuca

SEQ ID NO: 1560486 - RNA, 12 nt, Homo sapiens
aggcugguggga

SEQ ID NO: 1560487 - RNA, 11 nt, Homo sapiens
aggcuguaacu

SEQ ID NO: 1560488 - RNA, 14 nt, Homo sapiens
aggcugugagccaa

SEQ ID NO: 1560489 - RNA, 18 nt, Homo sapiens
aggcuguucucagcguuu

SEQ ID NO: 1560490 - RNA, 22 nt, Homo sapiens
aggcuucccugacuugcuuuag

SEQ ID NO: 1560491 - RNA, 12 nt, Homo sapiens
aggcuucuucag

SEQ ID NO: 1560492 - RNA, 21 nt, Homo sapiens
aggcuugcgcuggaccugguu

SEQ ID NO: 1560493 - RNA, 15 nt, Homo sapiens
aggcuugggauuugc

SEQ ID NO: 1560494 - RNA, 14 nt, Homo sapiens
aggcuuuacagugu

SEQ ID NO: 1560495 - RNA, 20 nt, Homo sapiens
aggcuuuguacagagugcuu

SEQ ID NO: 1560496 - RNA, 21 nt, Homo sapiens
aggcuuuguacagagugcuuu

SEQ ID NO: 1560497 - RNA, 22 nt, Homo sapiens
agggaaaaggaguagggaguuc

SEQ ID NO: 1560498 - RNA, 22 nt, Homo sapiens
agggaaauuguuuauguguuau

SEQ ID NO: 1560499 - RNA, 22 nt, Homo sapiens
agggaaauuuuggggggaacau

SEQ ID NO: 1560500 - RNA, 19 nt, Homo sapiens
agggaagagucccagugaa

SEQ ID NO: 1560501 - RNA, 17 nt, Homo sapiens
agggaagcacuugcuca

SEQ ID NO: 1560502 - RNA, 16 nt, Homo sapiens
agggaaggaucccaug

SEQ ID NO: 1560503 - RNA, 19 nt, Homo sapiens
agggaaguaguccuuggca

SEQ ID NO: 1560504 - RNA, 20 nt, Homo sapiens
agggaaguaguccuuggcau

SEQ ID NO: 1560505 - RNA, 17 nt, Homo sapiens
agggaaugcagcaggaa

SEQ ID NO: 1560506 - RNA, 13 nt, Homo sapiens
agggaaugcucag

SEQ ID NO: 1560507 - RNA, 20 nt, Homo sapiens
agggacaccaagccuuggcu

SEQ ID NO: 1560508 - RNA, 21 nt, Homo sapiens
agggacaugcccuguguggcu

SEQ ID NO: 1560509 - RNA, 17 nt, Homo sapiens
agggaccugcugcucag

SEQ ID NO: 1560510 - RNA, 19 nt, Homo sapiens
agggaccugcugcucagua

SEQ ID NO: 1560511 - RNA, 16 nt, Homo sapiens
agggacgccugggggu

SEQ ID NO: 1560512 - RNA, 22 nt, Homo sapiens
agggacuucugucuucacaaca

SEQ ID NO: 1560513 - RNA, 14 nt, Homo sapiens
agggagcuggaaaa

SEQ ID NO: 1560514 - RNA, 18 nt, Homo sapiens
agggaggagggcuuugaa

SEQ ID NO: 1560515 - RNA, 16 nt, Homo sapiens
agggaggucacuggaa

SEQ ID NO: 1560516 - RNA, 15 nt, Homo sapiens
agggaucaguugccc

SEQ ID NO: 1560517 - RNA, 18 nt, Homo sapiens
agggaucaucaugcagcu

SEQ ID NO: 1560518 - RNA, 17 nt, Homo sapiens
agggaugauucaagcca

SEQ ID NO: 1560519 - RNA, 18 nt, Homo sapiens
agggauuuggggcucaga

SEQ ID NO: 1560520 - RNA, 15 nt, Homo sapiens
agggcaacuguagaa

SEQ ID NO: 1560521 - RNA, 22 nt, Homo sapiens
agggcaagcccugcccacagaa

SEQ ID NO: 1560522 - RNA, 14 nt, Homo sapiens
agggcagauucaag

SEQ ID NO: 1560523 - RNA, 20 nt, Homo sapiens
agggcaguucugaguguuua

SEQ ID NO: 1560524 - RNA, 14 nt, Homo sapiens
agggcaugauuaac

SEQ ID NO: 1560525 - RNA, 20 nt, Homo sapiens
agggcaugauuaacaaagca

SEQ ID NO: 1560526 - RNA, 23 nt, Homo sapiens
agggccacauagaugcugaugga

SEQ ID NO: 1560527 - RNA, 14 nt, Homo sapiens
agggccacauggga

SEQ ID NO: 1560528 - RNA, 18 nt, Homo sapiens
agggcgggcagagggcug

SEQ ID NO: 1560529 - RNA, 14 nt, Homo sapiens
agggcuagaaccua

SEQ ID NO: 1560530 - RNA, 17 nt, Homo sapiens
agggcuagaaccuggaa

SEQ ID NO: 1560531 - RNA, 15 nt, Homo sapiens
agggcucccaggcca

SEQ ID NO: 1560532 - RNA, 19 nt, Homo sapiens
agggcugcgacgcuugcuc

SEQ ID NO: 1560533 - RNA, 23 nt, Homo sapiens
agggcuggaaucuggagagcuag

SEQ ID NO: 1560534 - RNA, 14 nt, Homo sapiens
agggcuugucacag

SEQ ID NO: 1560535 - RNA, 19 nt, Homo sapiens
agggcuugucacagucucu

SEQ ID NO: 1560536 - RNA, 14 nt, Homo sapiens
aggggaaccugucc

SEQ ID NO: 1560537 - RNA, 16 nt, Homo sapiens
aggggauuuggggcuu

SEQ ID NO: 1560538 - RNA, 14 nt, Homo sapiens
aggggcagaugcca

SEQ ID NO: 1560539 - RNA, 21 nt, Homo sapiens
aggggcagccacaccacugcc

SEQ ID NO: 1560540 - RNA, 18 nt, Homo sapiens
aggggcccuggccaggac

SEQ ID NO: 1560541 - RNA, 19 nt, Homo sapiens
aggggcguucucccaaaga

SEQ ID NO: 1560542 - RNA, 14 nt, Homo sapiens
aggggcucucucau

SEQ ID NO: 1560543 - RNA, 22 nt, Homo sapiens
aggggcugcagggccacuggaa

SEQ ID NO: 1560544 - RNA, 22 nt, Homo sapiens
aggggcuuugugaccagaaagc

SEQ ID NO: 1560545 - RNA, 21 nt, Homo sapiens
agggggcccugccugguggca

SEQ ID NO: 1560546 - RNA, 22 nt, Homo sapiens
agggggggccgggccaggagaa

SEQ ID NO: 1560547 - RNA, 17 nt, Homo sapiens
agggggugggauuccac

SEQ ID NO: 1560548 - RNA, 11 nt, Homo sapiens
agggguccagg

SEQ ID NO: 1560549 - RNA, 19 nt, Homo sapiens
aggggugcugcagguggca

SEQ ID NO: 1560550 - RNA, 20 nt, Homo sapiens
aggggugggauccacacuga

SEQ ID NO: 1560551 - RNA, 18 nt, Homo sapiens
agggguuauagcuucagg

SEQ ID NO: 1560552 - RNA, 13 nt, Homo sapiens
agggguuccucaa

SEQ ID NO: 1560553 - RNA, 15 nt, Homo sapiens
agggguuucagaauu

SEQ ID NO: 1560554 - RNA, 22 nt, Homo sapiens
aggguaagggaauuuaauacuu

SEQ ID NO: 1560555 - RNA, 23 nt, Homo sapiens
aggguacagaugugcuguagcag

SEQ ID NO: 1560556 - RNA, 20 nt, Homo sapiens
aggguacuuuaagacauacu

SEQ ID NO: 1560557 - RNA, 17 nt, Homo sapiens
agggucuccacacugcu

SEQ ID NO: 1560558 - RNA, 18 nt, Homo sapiens
agggucuucccuaccuca

SEQ ID NO: 1560559 - RNA, 18 nt, Homo sapiens
aggguggcccuugcaguu

SEQ ID NO: 1560560 - RNA, 16 nt, Homo sapiens
aggguguaauggagca

SEQ ID NO: 1560561 - RNA, 15 nt, Homo sapiens
aggguuccaaagggc

SEQ ID NO: 1560562 - RNA, 19 nt, Homo sapiens
aggguucuaaaugcaauaa

SEQ ID NO: 1560563 - RNA, 16 nt, Homo sapiens
aggguucuaaguggga

SEQ ID NO: 1560564 - RNA, 17 nt, Homo sapiens
aggguuggaggcaaugu

SEQ ID NO: 1560565 - RNA, 18 nt, Homo sapiens
caaaaggccucuuguaaa

SEQ ID NO: 1560566 - RNA, 18 nt, Homo sapiens
caaaaguaaucacuuaaa

SEQ ID NO: 1560567 - RNA, 14 nt, Homo sapiens
caaaaguuccuaaa

SEQ ID NO: 1560568 - RNA, 18 nt, Homo sapiens
caaaauaaucuauauuaa

SEQ ID NO: 1560569 - RNA, 13 nt, Homo sapiens
caaaauaaugagg

SEQ ID NO: 1560570 - RNA, 14 nt, Homo sapiens
caaaauacaaaagu

SEQ ID NO: 1560571 - RNA, 15 nt, Homo sapiens
caaaauacacauucu

SEQ ID NO: 1560572 - RNA, 11 nt, Homo sapiens
caaaauacuuc

SEQ ID NO: 1560573 - RNA, 23 nt, Homo sapiens
caaaauagggacuaucuaucuua

SEQ ID NO: 1560574 - RNA, 20 nt, Homo sapiens
ccagugcuguccaugcuucu

SEQ ID NO: 1560575 - RNA, 21 nt, Homo sapiens
ccagugcuuugcacacaagcu

SEQ ID NO: 1560576 - RNA, 21 nt, Homo sapiens
ccaguggcuggaucugugagg

SEQ ID NO: 1560577 - RNA, 16 nt, Homo sapiens
ccaguguggugucuug

SEQ ID NO: 1560578 - RNA, 18 nt, Homo sapiens
ccaguguuccugaagcug

SEQ ID NO: 1560579 - RNA, 22 nt, Homo sapiens
ccaguuaaagauuauugugacu

SEQ ID NO: 1560580 - RNA, 19 nt, Homo sapiens
ccaguuccacagcaguguc

SEQ ID NO: 1560581 - RNA, 14 nt, Homo sapiens
ccaguuguggcagg

SEQ ID NO: 1560582 - RNA, 12 nt, Homo sapiens
ccaguuuguacg

SEQ ID NO: 1560583 - RNA, 19 nt, Homo sapiens
ccaguuuuuguuuuugcau

SEQ ID NO: 1560584 - RNA, 17 nt, Homo sapiens
ccauaagcuacugccau

SEQ ID NO: 1560585 - RNA, 13 nt, Homo sapiens
ccauaaugcauuc

SEQ ID NO: 1560586 - RNA, 19 nt, Homo sapiens
ccauaauuaugaaaacuca

SEQ ID NO: 1560587 - RNA, 13 nt, Homo sapiens
ccauacacauucu

SEQ ID NO: 1560588 - RNA, 12 nt, Homo sapiens
ccauacauuugu

SEQ ID NO: 1560589 - RNA, 19 nt, Homo sapiens
ccauaggcacuugggaugu

SEQ ID NO: 1560590 - RNA, 19 nt, Homo sapiens
ccauaucccuuccucucag

SEQ ID NO: 1560591 - RNA, 12 nt, Homo sapiens
ccauaucuggca

SEQ ID NO: 1560592 - RNA, 18 nt, Homo sapiens
ccauaucuuccaaccccc

SEQ ID NO: 1560593 - RNA, 15 nt, Homo sapiens
ccauauugagucaaa

SEQ ID NO: 1560594 - RNA, 12 nt, Homo sapiens
ccaucacuggag

SEQ ID NO: 1560595 - RNA, 17 nt, Homo sapiens
ccaucaggauccagucu

SEQ ID NO: 1560596 - RNA, 22 nt, Homo sapiens
ccaucaggauccagucuggaaa

SEQ ID NO: 1560597 - RNA, 13 nt, Homo sapiens
ccaucaggguucu

SEQ ID NO: 1560598 - RNA, 14 nt, Homo sapiens
ccaucagugcuccc

SEQ ID NO: 1560599 - RNA, 16 nt, Homo sapiens
ccaucagugcucugua

SEQ ID NO: 1560600 - RNA, 22 nt, Homo sapiens
ccaucauaauucuaaucuaaca

SEQ ID NO: 1560601 - RNA, 22 nt, Homo sapiens
ccaucaugcggugggugcugcc

SEQ ID NO: 1560602 - RNA, 17 nt, Homo sapiens
ccaucccuuuuuuuaca

SEQ ID NO: 1560603 - RNA, 22 nt, Homo sapiens
ccaucccuuuuuuuacauuuca

SEQ ID NO: 1560604 - RNA, 19 nt, Homo sapiens
ccaucuaaaacucauacaa

SEQ ID NO: 1560605 - RNA, 23 nt, Homo sapiens
ccaucuaaaacucauacaaugau

SEQ ID NO: 1560606 - RNA, 15 nt, Homo sapiens
ccaucuccgccucca

SEQ ID NO: 1560607 - RNA, 19 nt, Homo sapiens
ccaucugaacacaaccaga

SEQ ID NO: 1560608 - RNA, 14 nt, Homo sapiens
ccaucugacaaaau

SEQ ID NO: 1560609 - RNA, 21 nt, Homo sapiens
ccaucugccaaaaauuacuga

SEQ ID NO: 1560610 - RNA, 17 nt, Homo sapiens
ccaucuggcucagcaua

SEQ ID NO: 1560611 - RNA, 23 nt, Homo sapiens
ccaucugggcuuauauguacuuu

SEQ ID NO: 1560612 - RNA, 17 nt, Homo sapiens
ccaucugugugcaacua

SEQ ID NO: 1560613 - RNA, 16 nt, Homo sapiens
ccaucuugagugguca

SEQ ID NO: 1560614 - RNA, 22 nt, Homo sapiens
ccaucuuuaucaugaagcacau

SEQ ID NO: 1560615 - RNA, 16 nt, Homo sapiens
ccaugaagccuuuuga

SEQ ID NO: 1560616 - RNA, 10 nt, Homo sapiens
ccaugaauua

SEQ ID NO: 1560617 - RNA, 18 nt, Homo sapiens
ccaugaccuaguuuucca

SEQ ID NO: 1560618 - RNA, 20 nt, Homo sapiens
ccaugaggaaggaacagcaa

SEQ ID NO: 1560619 - RNA, 15 nt, Homo sapiens
ccaugauauaacuuu

SEQ ID NO: 1560620 - RNA, 16 nt, Homo sapiens
ccaugaucacuuauca

SEQ ID NO: 1560621 - RNA, 22 nt, Homo sapiens
ccaugcaggggucagugcagca

SEQ ID NO: 1560622 - RNA, 20 nt, Homo sapiens
ccaugcugggccacugggga

SEQ ID NO: 1560623 - RNA, 13 nt, Homo sapiens
ccaugcugugcug

SEQ ID NO: 1560624 - RNA, 19 nt, Homo sapiens
ccaugcuucucaucugcaa

SEQ ID NO: 1560625 - RNA, 15 nt, Homo sapiens
ccaugcuuuaugugg

SEQ ID NO: 1560626 - RNA, 18 nt, Homo sapiens
ccauggaagguucucugu

SEQ ID NO: 1560627 - RNA, 16 nt, Homo sapiens
ccauggugugaucguc

SEQ ID NO: 1560628 - RNA, 15 nt, Homo sapiens
ccaugguucugccuc

SEQ ID NO: 1560629 - RNA, 16 nt, Homo sapiens
ccauguaaauugcaaa

SEQ ID NO: 1560630 - RNA, 23 nt, Homo sapiens
ccauguacucaaguaccaccaag

SEQ ID NO: 1560631 - RNA, 10 nt, Homo sapiens
ccauguccaa

SEQ ID NO: 1560632 - RNA, 13 nt, Homo sapiens
ccauguccaaaga

SEQ ID NO: 1560633 - RNA, 15 nt, Homo sapiens
ccauguccauaugca

SEQ ID NO: 1560634 - RNA, 21 nt, Homo sapiens
ccauguccauaugcaucuacu

SEQ ID NO: 1560635 - RNA, 12 nt, Homo sapiens
ccaugugcaaua

SEQ ID NO: 1560636 - RNA, 20 nt, Homo sapiens
ccaugugccuuucuuugccu

SEQ ID NO: 1560637 - RNA, 13 nt, Homo sapiens
ccaugugcugccc

SEQ ID NO: 1560638 - RNA, 15 nt, Homo sapiens
ccaugugugcuaaua

SEQ ID NO: 1560639 - RNA, 18 nt, Homo sapiens
ccauguuaauauuugaau

SEQ ID NO: 1560640 - RNA, 23 nt, Homo sapiens
ccauguuauuuauaguguugcuu

SEQ ID NO: 1560641 - RNA, 14 nt, Homo sapiens
ccauuaaagagcca

SEQ ID NO: 1560642 - RNA, 17 nt, Homo sapiens
ccauuaaagagccaguu

SEQ ID NO: 1560643 - RNA, 20 nt, Homo sapiens
ccauuaaagagccaguuuau

SEQ ID NO: 1560644 - RNA, 13 nt, Homo sapiens
ccauucacaauaa

SEQ ID NO: 1560645 - RNA, 19 nt, Homo sapiens
ccauucacuucauaaucca

SEQ ID NO: 1560646 - RNA, 20 nt, Homo sapiens
ccauuccuuuucguuuagaa

SEQ ID NO: 1560647 - RNA, 17 nt, Homo sapiens
ccauucucauguuuaca

SEQ ID NO: 1560648 - RNA, 14 nt, Homo sapiens
ccauucugugcagg

SEQ ID NO: 1560649 - RNA, 12 nt, Homo sapiens
ccauucuuugcu

SEQ ID NO: 1560650 - RNA, 16 nt, Homo sapiens
ccauugugaaccaaug

SEQ ID NO: 1560651 - RNA, 17 nt, Homo sapiens
ccauugugaaccaaugc

SEQ ID NO: 1560652 - RNA, 11 nt, Homo sapiens
ccauuuacacg

SEQ ID NO: 1560653 - RNA, 16 nt, Homo sapiens
ccauuuacacuuuuga

SEQ ID NO: 1560654 - RNA, 18 nt, Homo sapiens
ccauuucuacucuuaaau

SEQ ID NO: 1560655 - RNA, 22 nt, Homo sapiens
ccauuugcuuagaaagucugau

SEQ ID NO: 1560656 - RNA, 16 nt, Homo sapiens
ccauuugugaagcuua

SEQ ID NO: 1560657 - RNA, 13 nt, Homo sapiens
ccauuuucauucu

SEQ ID NO: 1560658 - RNA, 17 nt, Homo sapiens
cccaaaaauuacuuugg

SEQ ID NO: 1560659 - RNA, 12 nt, Homo sapiens
cccaaagcuuua

SEQ ID NO: 1560660 - RNA, 13 nt, Homo sapiens
cccaaagugcuga

SEQ ID NO: 1560661 - RNA, 20 nt, Homo sapiens
cccaacaagaacugcaucug

SEQ ID NO: 1560662 - RNA, 19 nt, Homo sapiens
cccaacaccugccucugac

SEQ ID NO: 1560663 - RNA, 20 nt, Homo sapiens
cccaacauuucuuaaauuau

SEQ ID NO: 1560664 - RNA, 15 nt, Homo sapiens
cccaaccagaacuuu

SEQ ID NO: 1560665 - RNA, 20 nt, Homo sapiens
cccaaccugacuuccucugc

SEQ ID NO: 1560666 - RNA, 21 nt, Homo sapiens
cccaaccuucuugucauugaa

SEQ ID NO: 1560667 - RNA, 22 nt, Homo sapiens
cccaagaggacugagacuggca

SEQ ID NO: 1560668 - RNA, 13 nt, Homo sapiens
cccaagauucaua

SEQ ID NO: 1560669 - RNA, 17 nt, Homo sapiens
cccaaggacucuuccac

SEQ ID NO: 1560670 - RNA, 17 nt, Homo sapiens
cccaaggccuaccccag

SEQ ID NO: 1560671 - RNA, 18 nt, Homo sapiens
cccaaggcucaugguccu

SEQ ID NO: 1560672 - RNA, 15 nt, Homo sapiens
cccaagucccuguca

SEQ ID NO: 1560673 - RNA, 22 nt, Homo sapiens
cccaagucccugucauuugaac

SEQ ID NO: 1560674 - RNA, 14 nt, Homo sapiens
cccaauccaugcuu

SEQ ID NO: 1560675 - RNA, 12 nt, Homo sapiens
cccaaugaauua

SEQ ID NO: 1560676 - RNA, 19 nt, Homo sapiens
cccaaugacacccaugcca

SEQ ID NO: 1560677 - RNA, 21 nt, Homo sapiens
cccaaugggcucaaacuucua

SEQ ID NO: 1560678 - RNA, 16 nt, Homo sapiens
cccaauucacaucuaa

SEQ ID NO: 1560679 - RNA, 22 nt, Homo sapiens
cccaauuucggauuuuuuccaa

SEQ ID NO: 1560680 - RNA, 22 nt, Homo sapiens
cccacaaucuggcuuagugcca

SEQ ID NO: 1560681 - RNA, 23 nt, Homo sapiens
cccacaaucuggcuuagugccac

SEQ ID NO: 1560682 - RNA, 14 nt, Homo sapiens
cccacaaugccaga

SEQ ID NO: 1560683 - RNA, 23 nt, Homo sapiens
cccacaccauaagcuacugccau

SEQ ID NO: 1560684 - RNA, 15 nt, Homo sapiens
cccacauuuuccuua

SEQ ID NO: 1560685 - RNA, 16 nt, Homo sapiens
cccaccacugauauca

SEQ ID NO: 1560686 - RNA, 11 nt, Homo sapiens
cccaccagcuc

SEQ ID NO: 1560687 - RNA, 17 nt, Homo sapiens
cccaccaguuauuccuu

SEQ ID NO: 1560688 - RNA, 22 nt, Homo sapiens
cccaccuauccccauucucugc

SEQ ID NO: 1560689 - RNA, 14 nt, Homo sapiens
cccaccugaagggu

SEQ ID NO: 1560690 - RNA, 18 nt, Homo sapiens
cccacugacccacucgga

SEQ ID NO: 1560691 - RNA, 17 nt, Homo sapiens
cccacuguccugugagg

SEQ ID NO: 1560692 - RNA, 22 nt, Homo sapiens
aaagaaaaguuuaccaucugaa

SEQ ID NO: 1560693 - RNA, 18 nt, Homo sapiens
aaagaaaauuuuccacau

SEQ ID NO: 1560694 - RNA, 13 nt, Homo sapiens
aaagaaaugcacu

SEQ ID NO: 1560695 - RNA, 16 nt, Homo sapiens
aaagaaauuccccaag

SEQ ID NO: 1560696 - RNA, 16 nt, Homo sapiens
aaagaacucauuugaa

SEQ ID NO: 1560697 - RNA, 16 nt, Homo sapiens
aaagaagauaaacaca

SEQ ID NO: 1560698 - RNA, 17 nt, Homo sapiens
aaagaaggcucacagau

SEQ ID NO: 1560699 - RNA, 14 nt, Homo sapiens
aaagaaguaaaagc

SEQ ID NO: 1560700 - RNA, 14 nt, Homo sapiens
aaagaaguauuuaa

SEQ ID NO: 1560701 - RNA, 14 nt, Homo sapiens
aaagaauacuugaa

SEQ ID NO: 1560702 - RNA, 23 nt, Homo sapiens
aaagaaucccaauguuugacaaa

SEQ ID NO: 1560703 - RNA, 18 nt, Homo sapiens
aaagaaucgccaugccca

SEQ ID NO: 1560704 - RNA, 21 nt, Homo sapiens
aaagaauguuacugccuuaau

SEQ ID NO: 1560705 - RNA, 15 nt, Homo sapiens
aaagaauuccaaagc

SEQ ID NO: 1560706 - RNA, 14 nt, Homo sapiens
aaagacaaagacau

SEQ ID NO: 1560707 - RNA, 17 nt, Homo sapiens
aaagacaggcaaacggc

SEQ ID NO: 1560708 - RNA, 11 nt, Homo sapiens
aaagacaucag

SEQ ID NO: 1560709 - RNA, 12 nt, Homo sapiens
aaagacaucagu

SEQ ID NO: 1560710 - RNA, 19 nt, Homo sapiens
aaagacauuuauauggguu

SEQ ID NO: 1560711 - RNA, 19 nt, Homo sapiens
aaagacauuuguucuccca

SEQ ID NO: 1560712 - RNA, 17 nt, Homo sapiens
aaagacauuuguuggga

SEQ ID NO: 1560713 - RNA, 21 nt, Homo sapiens
aaagacauuuuuuaaaagccu

SEQ ID NO: 1560714 - RNA, 15 nt, Homo sapiens
aaagacguucccuuu

SEQ ID NO: 1560715 - RNA, 15 nt, Homo sapiens
aaagacguuuuccca

SEQ ID NO: 1560716 - RNA, 14 nt, Homo sapiens
aaagacuccaaaga

SEQ ID NO: 1560717 - RNA, 12 nt, Homo sapiens
aaagacugaguc

SEQ ID NO: 1560718 - RNA, 15 nt, Homo sapiens
aaagacugagucaag

SEQ ID NO: 1560719 - RNA, 13 nt, Homo sapiens
aaagagaaaaugc

SEQ ID NO: 1560720 - RNA, 15 nt, Homo sapiens
aaagagaacaccucc

SEQ ID NO: 1560721 - RNA, 16 nt, Homo sapiens
aaagagaauauuuaca

SEQ ID NO: 1560722 - RNA, 22 nt, Homo sapiens
aaagagaauggaaaaaugauuu

SEQ ID NO: 1560723 - RNA, 13 nt, Homo sapiens
aaagagcagucag

SEQ ID NO: 1560724 - RNA, 15 nt, Homo sapiens
aaagagccaguuuau

SEQ ID NO: 1560725 - RNA, 15 nt, Homo sapiens
aaagaggcugccccu

SEQ ID NO: 1560726 - RNA, 20 nt, Homo sapiens
aaagaggcugccccucucac

SEQ ID NO: 1560727 - RNA, 14 nt, Homo sapiens
aaagagggcuuccu

SEQ ID NO: 1560728 - RNA, 20 nt, Homo sapiens
aaagagugcaggugcaguuu

SEQ ID NO: 1560729 - RNA, 17 nt, Homo sapiens
aaagaguugaagacagc

SEQ ID NO: 1560730 - RNA, 13 nt, Homo sapiens
aaagaucacacau

SEQ ID NO: 1560731 - RNA, 21 nt, Homo sapiens
aaagaucauuuauaauacugu

SEQ ID NO: 1560732 - RNA, 18 nt, Homo sapiens
aaagaucuucucuaacaa

SEQ ID NO: 1560733 - RNA, 23 nt, Homo sapiens
aaagauggccauauuaccccuuu

SEQ ID NO: 1560734 - RNA, 19 nt, Homo sapiens
aaagaugucuauguagcug

SEQ ID NO: 1560735 - RNA, 14 nt, Homo sapiens
aaagauuaaaugug

SEQ ID NO: 1560736 - RNA, 20 nt, Homo sapiens
aaagauugauuaaugaacua

SEQ ID NO: 1560737 - RNA, 15 nt, Homo sapiens
aaagauuugauguau

SEQ ID NO: 1560738 - RNA, 20 nt, Homo sapiens
aaagauuugugaacuggaag

SEQ ID NO: 1560739 - RNA, 18 nt, Homo sapiens
aaagauuuuuggcacuuu

SEQ ID NO: 1560740 - RNA, 13 nt, Homo sapiens
aaagcaaaagcaa

SEQ ID NO: 1560741 - RNA, 19 nt, Homo sapiens
aaagcaaaaggcugagaag

SEQ ID NO: 1560742 - RNA, 23 nt, Homo sapiens
aaagcaaaauaaaaacuauucga

SEQ ID NO: 1560743 - RNA, 21 nt, Homo sapiens
aaagcaacaaagauugagaag

SEQ ID NO: 1560744 - RNA, 18 nt, Homo sapiens
aaagcaagggaccuucau

SEQ ID NO: 1560745 - RNA, 14 nt, Homo sapiens
aaagcaaguguuca

SEQ ID NO: 1560746 - RNA, 18 nt, Homo sapiens
aaagcacauguauugaca

SEQ ID NO: 1560747 - RNA, 12 nt, Homo sapiens
aaagcaccugcc

SEQ ID NO: 1560748 - RNA, 21 nt, Homo sapiens
aaagcagaaaaucuaccaaga

SEQ ID NO: 1560749 - RNA, 18 nt, Homo sapiens
aaagcagacccaccuccc

SEQ ID NO: 1560750 - RNA, 15 nt, Homo sapiens
aaagcagauaccuca

SEQ ID NO: 1560751 - RNA, 19 nt, Homo sapiens
aaagcagggacuugaaccc

SEQ ID NO: 1560752 - RNA, 15 nt, Homo sapiens
aaagcaggggcagau

SEQ ID NO: 1560753 - RNA, 12 nt, Homo sapiens
aaagcaucaaag

SEQ ID NO: 1560754 - RNA, 18 nt, Homo sapiens
aaagccaaauaaaaaucu

SEQ ID NO: 1560755 - RNA, 19 nt, Homo sapiens
aaagccacuguaugauucu

SEQ ID NO: 1560756 - RNA, 18 nt, Homo sapiens
aaagccacuuuuccaaau

SEQ ID NO: 1560757 - RNA, 14 nt, Homo sapiens
aaagcccaaggugc

SEQ ID NO: 1560758 - RNA, 18 nt, Homo sapiens
aaagcccgcuugcucgcu

SEQ ID NO: 1560759 - RNA, 18 nt, Homo sapiens
aaagcuaaugugcaggga

SEQ ID NO: 1560760 - RNA, 23 nt, Homo sapiens
aaagcuacaauauucucucuuau

SEQ ID NO: 1560761 - RNA, 16 nt, Homo sapiens
aaagcugauagccaga

SEQ ID NO: 1560762 - RNA, 17 nt, Homo sapiens
aaagcugcuaaaucucc

SEQ ID NO: 1560763 - RNA, 20 nt, Homo sapiens
aaagcuggagucugucaaug

SEQ ID NO: 1560764 - RNA, 13 nt, Homo sapiens
aaagcuucaggga

SEQ ID NO: 1560765 - RNA, 20 nt, Homo sapiens
aaaggaaaaucacaucucca

SEQ ID NO: 1560766 - RNA, 16 nt, Homo sapiens
aaaggaauacauugca

SEQ ID NO: 1560767 - RNA, 20 nt, Homo sapiens
aaaggaaucacguuagagga

SEQ ID NO: 1560768 - RNA, 18 nt, Homo sapiens
aaaggacaacaguucuga

SEQ ID NO: 1560769 - RNA, 13 nt, Homo sapiens
aaaggaccucauu

SEQ ID NO: 1560770 - RNA, 14 nt, Homo sapiens
aaaggagacauauc

SEQ ID NO: 1560771 - RNA, 20 nt, Homo sapiens
aaaggcauuucaaagucuca

SEQ ID NO: 1560772 - RNA, 17 nt, Homo sapiens
aaaggccgucauuucau

SEQ ID NO: 1560773 - RNA, 14 nt, Homo sapiens
aaagggacacuuuu

SEQ ID NO: 1560774 - RNA, 16 nt, Homo sapiens
aaagggucuuaugaaa

SEQ ID NO: 1560775 - RNA, 20 nt, Homo sapiens
aaagggucuuaugaaacaau

SEQ ID NO: 1560776 - RNA, 15 nt, Homo sapiens
aaagguagauuuuac

SEQ ID NO: 1560777 - RNA, 14 nt, Homo sapiens
aaagguaugcauuu

SEQ ID NO: 1560778 - RNA, 13 nt, Homo sapiens
aaagguccuguaa

SEQ ID NO: 1560779 - RNA, 14 nt, Homo sapiens
aaaggugucuuccu

SEQ ID NO: 1560780 - RNA, 13 nt, Homo sapiens
aaagguuguguag

SEQ ID NO: 1560781 - RNA, 17 nt, Homo sapiens
aaaguaaauucauguaa

SEQ ID NO: 1560782 - RNA, 17 nt, Homo sapiens
aaaguaagcauuuccag

SEQ ID NO: 1560783 - RNA, 23 nt, Homo sapiens
aaaguaaggugcuuggaguuuac

SEQ ID NO: 1560784 - RNA, 21 nt, Homo sapiens
aaaguacauugcuuaaaauau

SEQ ID NO: 1560785 - RNA, 18 nt, Homo sapiens
aaaguagacugauuacac

SEQ ID NO: 1560786 - RNA, 21 nt, Homo sapiens
aaaguagaggaauccauguaa

SEQ ID NO: 1560787 - RNA, 22 nt, Homo sapiens
aaaguagucucuccccuggcca

SEQ ID NO: 1560788 - RNA, 21 nt, Homo sapiens
aaaguauguuuucaauguuuc

SEQ ID NO: 1560789 - RNA, 15 nt, Homo sapiens
aaaguauuccaccuu

SEQ ID NO: 1560790 - RNA, 19 nt, Homo sapiens
aaaguauucuucucuuccu

SEQ ID NO: 1560791 - RNA, 15 nt, Homo sapiens
aaagucaacuuccac

SEQ ID NO: 1560792 - RNA, 22 nt, Homo sapiens
aaaguccacauuagaucagaua

SEQ ID NO: 1560793 - RNA, 19 nt, Homo sapiens
aaagucuaucuaaugacau

SEQ ID NO: 1560794 - RNA, 19 nt, Homo sapiens
aaagugaggcucagauuaa

SEQ ID NO: 1560795 - RNA, 15 nt, Homo sapiens
aaagugaucuugaga

SEQ ID NO: 1560796 - RNA, 19 nt, Homo sapiens
aaagugcugagauugcaga

SEQ ID NO: 1560797 - RNA, 16 nt, Homo sapiens
aaagugcugcacucaa

SEQ ID NO: 1560798 - RNA, 22 nt, Homo sapiens
aaagugcuuuagucauauauga

SEQ ID NO: 1560799 - RNA, 13 nt, Homo sapiens
aaagugucuugaa

SEQ ID NO: 1560800 - RNA, 14 nt, Homo sapiens
aaagugugagcaaa

SEQ ID NO: 1560801 - RNA, 13 nt, Homo sapiens
aaagugugugauu

SEQ ID NO: 1560802 - RNA, 16 nt, Homo sapiens
aaaguguucauuguuu

SEQ ID NO: 1560803 - RNA, 20 nt, Homo sapiens
aaaguguuuugcccuauaua

SEQ ID NO: 1560804 - RNA, 23 nt, Homo sapiens
aaaguuaccuggaaucaaauaaa

SEQ ID NO: 1560805 - RNA, 14 nt, Homo sapiens
aaaguuauugugau

SEQ ID NO: 1560806 - RNA, 20 nt, Homo sapiens
aaaguucauaacagugccau

SEQ ID NO: 1560807 - RNA, 19 nt, Homo sapiens
aaaguuggccaauuucacc

SEQ ID NO: 1560808 - RNA, 19 nt, Homo sapiens
aaaguuguauuucaaauau

SEQ ID NO: 1560809 - RNA, 22 nt, Homo sapiens
aaaguuguauuucaaauaucua

SEQ ID NO: 1560810 - RNA, 23 nt, Homo sapiens
aaaguuguucgccgcguggaaug

SEQ ID NO: 1560811 - RNA, 16 nt, Homo sapiens
acauaaccaauuugua

SEQ ID NO: 1560812 - RNA, 13 nt, Homo sapiens
acauaagaaggca

SEQ ID NO: 1560813 - RNA, 20 nt, Homo sapiens
acauaaucccgccccagggc

SEQ ID NO: 1560814 - RNA, 20 nt, Homo sapiens
acauacagagguaacuauca

SEQ ID NO: 1560815 - RNA, 15 nt, Homo sapiens
acauacauccaacau

SEQ ID NO: 1560816 - RNA, 22 nt, Homo sapiens
acauaccuggcccugugccuug

SEQ ID NO: 1560817 - RNA, 19 nt, Homo sapiens
acauacuaaugaaguauua

SEQ ID NO: 1560818 - RNA, 14 nt, Homo sapiens
acauacuuucaucc

SEQ ID NO: 1560819 - RNA, 17 nt, Homo sapiens
acauagaaaacaaucaa

SEQ ID NO: 1560820 - RNA, 22 nt, Homo sapiens
acauagaaacucgggcuugagu

SEQ ID NO: 1560821 - RNA, 13 nt, Homo sapiens
acauagagaucua

SEQ ID NO: 1560822 - RNA, 18 nt, Homo sapiens
acauaggaaaaugccaug

SEQ ID NO: 1560823 - RNA, 23 nt, Homo sapiens
acauaggaaaaugccaugaaaau

SEQ ID NO: 1560824 - RNA, 19 nt, Homo sapiens
acauagucuuuguuuacau

SEQ ID NO: 1560825 - RNA, 13 nt, Homo sapiens
acauaucaaauag

SEQ ID NO: 1560826 - RNA, 19 nt, Homo sapiens
acauauuacuccacaccuu

SEQ ID NO: 1560827 - RNA, 12 nt, Homo sapiens
acauauuuuaga

SEQ ID NO: 1560828 - RNA, 19 nt, Homo sapiens
acaucaaagugguaaauac

SEQ ID NO: 1560829 - RNA, 16 nt, Homo sapiens
acaucacaccugcccu

SEQ ID NO: 1560830 - RNA, 14 nt, Homo sapiens
acaucagucuccaa

SEQ ID NO: 1560831 - RNA, 23 nt, Homo sapiens
acaucauuacuuaugaugaugaa

SEQ ID NO: 1560832 - RNA, 19 nt, Homo sapiens
acaucauuccacacuccuu

SEQ ID NO: 1560833 - RNA, 20 nt, Homo sapiens
acaucccuauagaccacugg

SEQ ID NO: 1560834 - RNA, 20 nt, Homo sapiens
acauccucugcuaccaucuc

SEQ ID NO: 1560835 - RNA, 23 nt, Homo sapiens
acaucucuuccuccgaggccagu

SEQ ID NO: 1560836 - RNA, 19 nt, Homo sapiens
acaucuguccuacacuuga

SEQ ID NO: 1560837 - RNA, 15 nt, Homo sapiens
acaucuuaaauucau

SEQ ID NO: 1560838 - RNA, 22 nt, Homo sapiens
acaugaagcuguugugugaggu

SEQ ID NO: 1560839 - RNA, 21 nt, Homo sapiens
acaugacauucuuagcuguaa

SEQ ID NO: 1560840 - RNA, 20 nt, Homo sapiens
acaugacccaggccuggcca

SEQ ID NO: 1560841 - RNA, 19 nt, Homo sapiens
acaugagaaggaacuucca

SEQ ID NO: 1560842 - RNA, 16 nt, Homo sapiens
acaugaguucaaauac

SEQ ID NO: 1560843 - RNA, 19 nt, Homo sapiens
acaugaguucaaauacuuu

SEQ ID NO: 1560844 - RNA, 20 nt, Homo sapiens
acaugauccugcaauuccac

SEQ ID NO: 1560845 - RNA, 20 nt, Homo sapiens
acaugauuuaaagacuacaa

SEQ ID NO: 1560846 - RNA, 18 nt, Homo sapiens
acaugcaacagaagugac

SEQ ID NO: 1560847 - RNA, 14 nt, Homo sapiens
acaugcacagucau

SEQ ID NO: 1560848 - RNA, 10 nt, Homo sapiens
acaugcaguu

SEQ ID NO: 1560849 - RNA, 20 nt, Homo sapiens
acaugcauguucuccucuau

SEQ ID NO: 1560850 - RNA, 16 nt, Homo sapiens
acaugcugcuugccuc

SEQ ID NO: 1560851 - RNA, 16 nt, Homo sapiens
acaugcuuauaacauu

SEQ ID NO: 1560852 - RNA, 20 nt, Homo sapiens
acauggagaaaucuacugaa

SEQ ID NO: 1560853 - RNA, 17 nt, Homo sapiens
acauggagcugucauca

SEQ ID NO: 1560854 - RNA, 15 nt, Homo sapiens
acauggcacauguau

SEQ ID NO: 1560855 - RNA, 20 nt, Homo sapiens
acauggucuucguccuugac

SEQ ID NO: 1560856 - RNA, 19 nt, Homo sapiens
acauguaagaaaauguuac

SEQ ID NO: 1560857 - RNA, 19 nt, Homo sapiens
acauguaagcauaacuuau

SEQ ID NO: 1560858 - RNA, 15 nt, Homo sapiens
acauguaauuugaug

SEQ ID NO: 1560859 - RNA, 14 nt, Homo sapiens
acauguauacauau

SEQ ID NO: 1560860 - RNA, 14 nt, Homo sapiens
acaugucagaacua

SEQ ID NO: 1560861 - RNA, 14 nt, Homo sapiens
acauguccuauuac

SEQ ID NO: 1560862 - RNA, 17 nt, Homo sapiens
acaugugauguggugcg

SEQ ID NO: 1560863 - RNA, 18 nt, Homo sapiens
acauuaacaaaagcaauu

SEQ ID NO: 1560864 - RNA, 13 nt, Homo sapiens
acauuagaucuag

SEQ ID NO: 1560865 - RNA, 12 nt, Homo sapiens
acauuaucucac

SEQ ID NO: 1560866 - RNA, 21 nt, Homo sapiens
acauuauguggcccucuggau

SEQ ID NO: 1560867 - RNA, 18 nt, Homo sapiens
acauuauuuuuuauuucu

SEQ ID NO: 1560868 - RNA, 13 nt, Homo sapiens
acauucacaccau

SEQ ID NO: 1560869 - RNA, 16 nt, Homo sapiens
acauucagcugagguu

SEQ ID NO: 1560870 - RNA, 22 nt, Homo sapiens
acauucauagucuuuggagaaa

SEQ ID NO: 1560871 - RNA, 22 nt, Homo sapiens
acauucuacaaaauaucccugg

SEQ ID NO: 1560872 - RNA, 21 nt, Homo sapiens
acauucuagcugagaagcaau

SEQ ID NO: 1560873 - RNA, 14 nt, Homo sapiens
acauucugccuugg

SEQ ID NO: 1560874 - RNA, 19 nt, Homo sapiens
acauucuuuuucuguugaa

SEQ ID NO: 1560875 - RNA, 22 nt, Homo sapiens
acauucuuuuucuguugaaacu

SEQ ID NO: 1560876 - RNA, 16 nt, Homo sapiens
acauugagaguaagca

SEQ ID NO: 1560877 - RNA, 21 nt, Homo sapiens
acauugaguagacacauuuaa

SEQ ID NO: 1560878 - RNA, 22 nt, Homo sapiens
acauugaucuguuuuacaggaa

SEQ ID NO: 1560879 - RNA, 22 nt, Homo sapiens
acauugauuugcucuuacuaca

SEQ ID NO: 1560880 - RNA, 14 nt, Homo sapiens
acauugccaaaaag

SEQ ID NO: 1560881 - RNA, 18 nt, Homo sapiens
acauugccuucuggagcu

SEQ ID NO: 1560882 - RNA, 20 nt, Homo sapiens
acauugcuaccucagugcuc

SEQ ID NO: 1560883 - RNA, 13 nt, Homo sapiens
acauuguacuguu

SEQ ID NO: 1560884 - RNA, 17 nt, Homo sapiens
acauuuaauaauaucaa

SEQ ID NO: 1560885 - RNA, 19 nt, Homo sapiens
acauuucucaagggccaug

SEQ ID NO: 1560886 - RNA, 16 nt, Homo sapiens
acauuugagccauguc

SEQ ID NO: 1560887 - RNA, 14 nt, Homo sapiens
acauuuguuccaug

SEQ ID NO: 1560888 - RNA, 22 nt, Homo sapiens
acauuuguuuuagucugaacaa

SEQ ID NO: 1560889 - RNA, 14 nt, Homo sapiens
acauuuuaaaugaa

SEQ ID NO: 1560890 - RNA, 13 nt, Homo sapiens
acauuuuacagua

SEQ ID NO: 1560891 - RNA, 17 nt, Homo sapiens
acauuuucacaacucuu

SEQ ID NO: 1560892 - RNA, 15 nt, Homo sapiens
acauuuugacacaaa

SEQ ID NO: 1560893 - RNA, 16 nt, Homo sapiens
acauuuugacacaaaa

SEQ ID NO: 1560894 - RNA, 18 nt, Homo sapiens
acauuuuguaacaaagaa

SEQ ID NO: 1560895 - RNA, 17 nt, Homo sapiens
acauuuuucaacauuuu

SEQ ID NO: 1560896 - RNA, 18 nt, Homo sapiens
acauuuuucauucaugaa

SEQ ID NO: 1560897 - RNA, 22 nt, Homo sapiens
acauuuuuugagguaucacugc

SEQ ID NO: 1560898 - RNA, 15 nt, Homo sapiens
acauuuuuugggcag

SEQ ID NO: 1560899 - RNA, 15 nt, Homo sapiens
accaaaaagaccaga

SEQ ID NO: 1560900 - RNA, 17 nt, Homo sapiens
accaaacacccagaggu

SEQ ID NO: 1560901 - RNA, 13 nt, Homo sapiens
accaaaccccacu

SEQ ID NO: 1560902 - RNA, 20 nt, Homo sapiens
accaaagacaucagucucca

SEQ ID NO: 1560903 - RNA, 19 nt, Homo sapiens
accaaagucacaaaucauc

SEQ ID NO: 1560904 - RNA, 21 nt, Homo sapiens
accaaagugcaggacaucaaa

SEQ ID NO: 1560905 - RNA, 18 nt, Homo sapiens
accaaaucguggcacgua

SEQ ID NO: 1560906 - RNA, 16 nt, Homo sapiens
accaaaucucaguggc

SEQ ID NO: 1560907 - RNA, 18 nt, Homo sapiens
accaaaugaaaugccaaa

SEQ ID NO: 1560908 - RNA, 13 nt, Homo sapiens
accaacuaagaaa

SEQ ID NO: 1560909 - RNA, 17 nt, Homo sapiens
accaacugaaggcuaaa

SEQ ID NO: 1560910 - RNA, 15 nt, Homo sapiens
accaacuuuacuguc

SEQ ID NO: 1560911 - RNA, 14 nt, Homo sapiens
accaagaaguggcu

SEQ ID NO: 1560912 - RNA, 18 nt, Homo sapiens
accaagauuaugugacuu

SEQ ID NO: 1560913 - RNA, 22 nt, Homo sapiens
accaagauuaugugacuugcaa

SEQ ID NO: 1560914 - RNA, 14 nt, Homo sapiens
accaaggcgaguuu

SEQ ID NO: 1560915 - RNA, 12 nt, Homo sapiens
accaagugcaau

SEQ ID NO: 1560916 - RNA, 21 nt, Homo sapiens
accaaguuccuuggccaugca

SEQ ID NO: 1560917 - RNA, 13 nt, Homo sapiens
accaauaaacagc

SEQ ID NO: 1560918 - RNA, 19 nt, Homo sapiens
accaauacuacugacgucc

SEQ ID NO: 1560919 - RNA, 19 nt, Homo sapiens
accaauagggcugagcucu

SEQ ID NO: 1560920 - RNA, 18 nt, Homo sapiens
accaauauucuuuuguuc

SEQ ID NO: 1560921 - RNA, 13 nt, Homo sapiens
accaauauuguac

SEQ ID NO: 1560922 - RNA, 14 nt, Homo sapiens
accaaucagcacuc

SEQ ID NO: 1560923 - RNA, 19 nt, Homo sapiens
accaauggauuguggaaaa

SEQ ID NO: 1560924 - RNA, 19 nt, Homo sapiens
accaauucuggacagacag

SEQ ID NO: 1560925 - RNA, 20 nt, Homo sapiens
accaauucuggacagacaga

SEQ ID NO: 1560926 - RNA, 15 nt, Homo sapiens
accacaagacauuuc

SEQ ID NO: 1560927 - RNA, 16 nt, Homo sapiens
accacaagccugagaa

SEQ ID NO: 1560928 - RNA, 21 nt, Homo sapiens
accacagaaaucacagucaau

SEQ ID NO: 1560929 - RNA, 20 nt, Homo sapiens
acucccuccucaccucugga

SEQ ID NO: 1560930 - RNA, 15 nt, Homo sapiens
acucccugcugugug

SEQ ID NO: 1560931 - RNA, 18 nt, Homo sapiens
acucccugcugugugacu

SEQ ID NO: 1560932 - RNA, 18 nt, Homo sapiens
acuccggcugugcuggga

SEQ ID NO: 1560933 - RNA, 19 nt, Homo sapiens
acuccgugcuuaaccaaag

SEQ ID NO: 1560934 - RNA, 12 nt, Homo sapiens
acuccucagacg

SEQ ID NO: 1560935 - RNA, 19 nt, Homo sapiens
acuccucaggcagcgugug

SEQ ID NO: 1560936 - RNA, 18 nt, Homo sapiens
acuccuccgugagcacca

SEQ ID NO: 1560937 - RNA, 17 nt, Homo sapiens
acuccuccugagcucug

SEQ ID NO: 1560938 - RNA, 19 nt, Homo sapiens
acuccucucccacagagug

SEQ ID NO: 1560939 - RNA, 18 nt, Homo sapiens
acuccugcucucuaucca

SEQ ID NO: 1560940 - RNA, 11 nt, Homo sapiens
acuccuuccau

SEQ ID NO: 1560941 - RNA, 13 nt, Homo sapiens
acuccuuccuuca

SEQ ID NO: 1560942 - RNA, 17 nt, Homo sapiens
acuccuuucagccacau

SEQ ID NO: 1560943 - RNA, 14 nt, Homo sapiens
acucuaccugcaag

SEQ ID NO: 1560944 - RNA, 15 nt, Homo sapiens
acucuaccugcaaga

SEQ ID NO: 1560945 - RNA, 15 nt, Homo sapiens
acucuaggguccagu

SEQ ID NO: 1560946 - RNA, 18 nt, Homo sapiens
acucuauaagauuccaaa

SEQ ID NO: 1560947 - RNA, 21 nt, Homo sapiens
acucuaugaguuggacuucag

SEQ ID NO: 1560948 - RNA, 16 nt, Homo sapiens
acucuccaauguucua

SEQ ID NO: 1560949 - RNA, 12 nt, Homo sapiens
acucugaaaaug

SEQ ID NO: 1560950 - RNA, 14 nt, Homo sapiens
acucugaaagagca

SEQ ID NO: 1560951 - RNA, 15 nt, Homo sapiens
acucugcacuacucc

SEQ ID NO: 1560952 - RNA, 14 nt, Homo sapiens
acucugccauuaaa

SEQ ID NO: 1560953 - RNA, 21 nt, Homo sapiens
acucuggagguuuguuuagaa

SEQ ID NO: 1560954 - RNA, 19 nt, Homo sapiens
acucuguaaaacgcaccaa

SEQ ID NO: 1560955 - RNA, 22 nt, Homo sapiens
acucuguaauugaauauaaaug

SEQ ID NO: 1560956 - RNA, 18 nt, Homo sapiens
acucuguguggcugugca

SEQ ID NO: 1560957 - RNA, 22 nt, Homo sapiens
acucuguguggcugugcaauuu

SEQ ID NO: 1560958 - RNA, 18 nt, Homo sapiens
acucuuccaccucccaac

SEQ ID NO: 1560959 - RNA, 23 nt, Homo sapiens
acucuugagucucuuuaccuaau

SEQ ID NO: 1560960 - RNA, 12 nt, Homo sapiens
acucuuugccaa

SEQ ID NO: 1560961 - RNA, 20 nt, Homo sapiens
acucuuugcuaguaccaaaa

SEQ ID NO: 1560962 - RNA, 20 nt, Homo sapiens
acugaaccauuccaacuuca

SEQ ID NO: 1560963 - RNA, 14 nt, Homo sapiens
acugaagagcucuu

SEQ ID NO: 1560964 - RNA, 19 nt, Homo sapiens
acugaagagcucuuggccc

SEQ ID NO: 1560965 - RNA, 15 nt, Homo sapiens
acugaagaugcagcu

SEQ ID NO: 1560966 - RNA, 16 nt, Homo sapiens
acugaagccugcuccu

SEQ ID NO: 1560967 - RNA, 13 nt, Homo sapiens
acugaaggcauau

SEQ ID NO: 1560968 - RNA, 14 nt, Homo sapiens
acugaaugagguca

SEQ ID NO: 1560969 - RNA, 22 nt, Homo sapiens
acugaauuuggaggcuggagua

SEQ ID NO: 1560970 - RNA, 14 nt, Homo sapiens
acugacacuacuaa

SEQ ID NO: 1560971 - RNA, 18 nt, Homo sapiens
acugaggaaucagcucaa

SEQ ID NO: 1560972 - RNA, 16 nt, Homo sapiens
acugaggggccaggga

SEQ ID NO: 1560973 - RNA, 14 nt, Homo sapiens
acugaguacucuuu

SEQ ID NO: 1560974 - RNA, 22 nt, Homo sapiens
acugagugccuacucuuugcca

SEQ ID NO: 1560975 - RNA, 20 nt, Homo sapiens
acugaguuuuguuucacuuu

SEQ ID NO: 1560976 - RNA, 15 nt, Homo sapiens
acugauagaugucua

SEQ ID NO: 1560977 - RNA, 21 nt, Homo sapiens
acugauagaugucuauucuug

SEQ ID NO: 1560978 - RNA, 15 nt, Homo sapiens
acugaugagcacauc

SEQ ID NO: 1560979 - RNA, 16 nt, Homo sapiens
acugaugaugacaggu

SEQ ID NO: 1560980 - RNA, 12 nt, Homo sapiens
acugaugcauug

SEQ ID NO: 1560981 - RNA, 17 nt, Homo sapiens
acugauggaaaauacca

SEQ ID NO: 1560982 - RNA, 17 nt, Homo sapiens
acugauggcagacaucu

SEQ ID NO: 1560983 - RNA, 20 nt, Homo sapiens
acugaugugugaagugagaa

SEQ ID NO: 1560984 - RNA, 14 nt, Homo sapiens
acugauuaccuccu

SEQ ID NO: 1560985 - RNA, 20 nt, Homo sapiens
acugcaaccuccacauccca

SEQ ID NO: 1560986 - RNA, 16 nt, Homo sapiens
acugcaaccucugccu

SEQ ID NO: 1560987 - RNA, 23 nt, Homo sapiens
acugcaaccucugccucccaggu

SEQ ID NO: 1560988 - RNA, 15 nt, Homo sapiens
acugcacaaacaaua

SEQ ID NO: 1560989 - RNA, 22 nt, Homo sapiens
acugcacuuuccaaugccacag

SEQ ID NO: 1560990 - RNA, 22 nt, Homo sapiens
acugcagaauguaaagguuuca

SEQ ID NO: 1560991 - RNA, 22 nt, Homo sapiens
acugcagggaaaauuauuugca

SEQ ID NO: 1560992 - RNA, 23 nt, Homo sapiens
acugcagggaaaauuauuugcau

SEQ ID NO: 1560993 - RNA, 16 nt, Homo sapiens
acugcauccucugccu

SEQ ID NO: 1560994 - RNA, 16 nt, Homo sapiens
acugcaugucagagca

SEQ ID NO: 1560995 - RNA, 19 nt, Homo sapiens
acugccaucuuuaucauga

SEQ ID NO: 1560996 - RNA, 21 nt, Homo sapiens
acugcccaggccuaucuggaa

SEQ ID NO: 1560997 - RNA, 21 nt, Homo sapiens
acugccuuuagaaaauauaag

SEQ ID NO: 1560998 - RNA, 13 nt, Homo sapiens
acugcgacuguga

SEQ ID NO: 1560999 - RNA, 19 nt, Homo sapiens
acugcgaggacaucaaagu

SEQ ID NO: 1561000 - RNA, 20 nt, Homo sapiens
acugcuagcuuucuccuuac

SEQ ID NO: 1561001 - RNA, 20 nt, Homo sapiens
acugcuuuuaaaagugcaca

SEQ ID NO: 1561002 - RNA, 17 nt, Homo sapiens
acuggaagaaagcaaca

SEQ ID NO: 1561003 - RNA, 21 nt, Homo sapiens
acuggaagaaagcaacaaaga

SEQ ID NO: 1561004 - RNA, 20 nt, Homo sapiens
acuggacaaagaauuccaaa

SEQ ID NO: 1561005 - RNA, 16 nt, Homo sapiens
acuggagccaucucuu

SEQ ID NO: 1561006 - RNA, 20 nt, Homo sapiens
acuggaucucuuaagacagc

SEQ ID NO: 1561007 - RNA, 16 nt, Homo sapiens
acuggauucauucuca

SEQ ID NO: 1561008 - RNA, 21 nt, Homo sapiens
acuggcacagagguagucuca

SEQ ID NO: 1561009 - RNA, 22 nt, Homo sapiens
acuggcacaguuuucugagaaa

SEQ ID NO: 1561010 - RNA, 13 nt, Homo sapiens
acuggccaugccu

SEQ ID NO: 1561011 - RNA, 21 nt, Homo sapiens
acuggcuggccagucuggguc

SEQ ID NO: 1561012 - RNA, 22 nt, Homo sapiens
acuggggaggaauccuggacca

SEQ ID NO: 1561013 - RNA, 17 nt, Homo sapiens
acugggucugacaugaa

SEQ ID NO: 1561014 - RNA, 18 nt, Homo sapiens
acugguagaaaaacaucu

SEQ ID NO: 1561015 - RNA, 23 nt, Homo sapiens
acugguauguguggaugaugcug

SEQ ID NO: 1561016 - RNA, 14 nt, Homo sapiens
acuggugcucucuu

SEQ ID NO: 1561017 - RNA, 24 nt, Homo sapiens
acugguuaaaaaacaaauguucau

SEQ ID NO: 1561018 - RNA, 16 nt, Homo sapiens
acugguucacauccua

SEQ ID NO: 1561019 - RNA, 19 nt, Homo sapiens
acuguaauguaacuaucuc

SEQ ID NO: 1561020 - RNA, 23 nt, Homo sapiens
acuguagccacagcugcuguucu

SEQ ID NO: 1561021 - RNA, 17 nt, Homo sapiens
acuguauaaacaaaaga

SEQ ID NO: 1561022 - RNA, 22 nt, Homo sapiens
acuguauauucaggacuugaaa

SEQ ID NO: 1561023 - RNA, 21 nt, Homo sapiens
acuguauauuuguaugauauu

SEQ ID NO: 1561024 - RNA, 16 nt, Homo sapiens
acuguauucgugcauu

SEQ ID NO: 1561025 - RNA, 18 nt, Homo sapiens
acuguauuugaaauaaga

SEQ ID NO: 1561026 - RNA, 15 nt, Homo sapiens
acugucagauuaaau

SEQ ID NO: 1561027 - RNA, 12 nt, Homo sapiens
acugucaggguu

SEQ ID NO: 1561028 - RNA, 14 nt, Homo sapiens
acuguccugugagg

SEQ ID NO: 1561029 - RNA, 13 nt, Homo sapiens
acugucuccaugg

SEQ ID NO: 1561030 - RNA, 18 nt, Homo sapiens
acugucuuaaagagagag

SEQ ID NO: 1561031 - RNA, 22 nt, Homo sapiens
acugucuucuucaugucaucaa

SEQ ID NO: 1561032 - RNA, 19 nt, Homo sapiens
acugugaaaauaguguaag

SEQ ID NO: 1561033 - RNA, 20 nt, Homo sapiens
acugugaaauaccacaagcc

SEQ ID NO: 1561034 - RNA, 17 nt, Homo sapiens
acugugauacaguuuug

SEQ ID NO: 1561035 - RNA, 16 nt, Homo sapiens
acuguggggcacuuga

SEQ ID NO: 1561036 - RNA, 19 nt, Homo sapiens
acuguggggcacuugauau

SEQ ID NO: 1561037 - RNA, 19 nt, Homo sapiens
acuguguucauguguaaag

SEQ ID NO: 1561038 - RNA, 20 nt, Homo sapiens
acuguuacacgugccuguag

SEQ ID NO: 1561039 - RNA, 18 nt, Homo sapiens
acuguucccccugugcag

SEQ ID NO: 1561040 - RNA, 21 nt, Homo sapiens
acuguucucaacauacuguaa

SEQ ID NO: 1561041 - RNA, 18 nt, Homo sapiens
acuguucuugacaaucau

SEQ ID NO: 1561042 - RNA, 10 nt, Homo sapiens
acuguugcau

SEQ ID NO: 1561043 - RNA, 22 nt, Homo sapiens
acuguugguauuauauaauuca

SEQ ID NO: 1561044 - RNA, 16 nt, Homo sapiens
acuguuguacaagcuc

SEQ ID NO: 1561045 - RNA, 16 nt, Homo sapiens
acuguuugauuuggau

SEQ ID NO: 1561046 - RNA, 18 nt, Homo sapiens
agagccuucaagugccaa

SEQ ID NO: 1561047 - RNA, 20 nt, Homo sapiens
agagccuucagaaugcuccu

SEQ ID NO: 1561048 - RNA, 24 nt, Homo sapiens
agagccuugucuucuuagcuguca

SEQ ID NO: 1561049 - RNA, 21 nt, Homo sapiens
agagcuaagaaauaaggcuaa

SEQ ID NO: 1561050 - RNA, 13 nt, Homo sapiens
agagcuccauuuc

SEQ ID NO: 1561051 - RNA, 17 nt, Homo sapiens
agagcugaacuauuaga

SEQ ID NO: 1561052 - RNA, 17 nt, Homo sapiens
agagcuuccacaagaca

SEQ ID NO: 1561053 - RNA, 14 nt, Homo sapiens
agagcuucccugac

SEQ ID NO: 1561054 - RNA, 20 nt, Homo sapiens
agaggaaaagaaagaaguua

SEQ ID NO: 1561055 - RNA, 21 nt, Homo sapiens
agaggaaauucaaaucccuuu

SEQ ID NO: 1561056 - RNA, 17 nt, Homo sapiens
agaggagaaacuggaac

SEQ ID NO: 1561057 - RNA, 14 nt, Homo sapiens
agaggcaccaggaa

SEQ ID NO: 1561058 - RNA, 13 nt, Homo sapiens
agaggcacucagu

SEQ ID NO: 1561059 - RNA, 22 nt, Homo sapiens
agaggccagcacauuaucuuca

SEQ ID NO: 1561060 - RNA, 19 nt, Homo sapiens
agaggcuaauucaguguca

SEQ ID NO: 1561061 - RNA, 21 nt, Homo sapiens
agaggcuaauucagugucaca

SEQ ID NO: 1561062 - RNA, 12 nt, Homo sapiens
agaggcuccagc

SEQ ID NO: 1561063 - RNA, 15 nt, Homo sapiens
agagggagaaacuuc

SEQ ID NO: 1561064 - RNA, 17 nt, Homo sapiens
agagggaggcaggugga

SEQ ID NO: 1561065 - RNA, 15 nt, Homo sapiens
agagggaggucacug

SEQ ID NO: 1561066 - RNA, 22 nt, Homo sapiens
agagggggaaaaacacauaaag

SEQ ID NO: 1561067 - RNA, 17 nt, Homo sapiens
agagggggucugugaau

SEQ ID NO: 1561068 - RNA, 22 nt, Homo sapiens
agagggguggaguuuuaacugu

SEQ ID NO: 1561069 - RNA, 15 nt, Homo sapiens
agagguaacuaucaa

SEQ ID NO: 1561070 - RNA, 17 nt, Homo sapiens
agaggucagcacacauu

SEQ ID NO: 1561071 - RNA, 22 nt, Homo sapiens
agaggugggaggaacuccuugc

SEQ ID NO: 1561072 - RNA, 20 nt, Homo sapiens
agaguacacucagccacugu

SEQ ID NO: 1561073 - RNA, 17 nt, Homo sapiens
agaguccacuguggcac

SEQ ID NO: 1561074 - RNA, 17 nt, Homo sapiens
agaguccagugcucugc

SEQ ID NO: 1561075 - RNA, 13 nt, Homo sapiens
agagucucaggac

SEQ ID NO: 1561076 - RNA, 19 nt, Homo sapiens
agagucuccaguuacugaa

SEQ ID NO: 1561077 - RNA, 22 nt, Homo sapiens
agagugaaaaucuucucuucaa

SEQ ID NO: 1561078 - RNA, 15 nt, Homo sapiens
agagugacagucaua

SEQ ID NO: 1561079 - RNA, 14 nt, Homo sapiens
agagugacaugugc

SEQ ID NO: 1561080 - RNA, 20 nt, Homo sapiens
agagugagacccugucucaa

SEQ ID NO: 1561081 - RNA, 19 nt, Homo sapiens
agagugagacuccaucuca

SEQ ID NO: 1561082 - RNA, 20 nt, Homo sapiens
agagugagacuccaucucaa

SEQ ID NO: 1561083 - RNA, 12 nt, Homo sapiens
agagugcacugc

SEQ ID NO: 1561084 - RNA, 21 nt, Homo sapiens
agagugcaggugcaguuucau

SEQ ID NO: 1561085 - RNA, 21 nt, Homo sapiens
agagugccagucagcagucau

SEQ ID NO: 1561086 - RNA, 16 nt, Homo sapiens
agaguggagucugagu

SEQ ID NO: 1561087 - RNA, 12 nt, Homo sapiens
agaguggugggg

SEQ ID NO: 1561088 - RNA, 14 nt, Homo sapiens
agagugguuuccaa

SEQ ID NO: 1561089 - RNA, 19 nt, Homo sapiens
agaguuguuguuugccaag

SEQ ID NO: 1561090 - RNA, 14 nt, Homo sapiens
agaguuuuaucaac

SEQ ID NO: 1561091 - RNA, 14 nt, Homo sapiens
agauaaaccaauaa

SEQ ID NO: 1561092 - RNA, 13 nt, Homo sapiens
agauaaccuuguu

SEQ ID NO: 1561093 - RNA, 22 nt, Homo sapiens
agauaaguuugcaguuggcuaa

SEQ ID NO: 1561094 - RNA, 17 nt, Homo sapiens
agauaaucuugugcaaa

SEQ ID NO: 1561095 - RNA, 19 nt, Homo sapiens
agauaaugccaccaaagga

SEQ ID NO: 1561096 - RNA, 17 nt, Homo sapiens
agauaauuuauuauaca

SEQ ID NO: 1561097 - RNA, 22 nt, Homo sapiens
agauacacaaucugaaacagcu

SEQ ID NO: 1561098 - RNA, 19 nt, Homo sapiens
agauacaguggagacaucu

SEQ ID NO: 1561099 - RNA, 23 nt, Homo sapiens
agauagauauuccuauugugcaa

SEQ ID NO: 1561100 - RNA, 16 nt, Homo sapiens
agauagcuacagugua

SEQ ID NO: 1561101 - RNA, 14 nt, Homo sapiens
agauagcugugacu

SEQ ID NO: 1561102 - RNA, 14 nt, Homo sapiens
agauaguaugcacu

SEQ ID NO: 1561103 - RNA, 14 nt, Homo sapiens
agauagugccaggu

SEQ ID NO: 1561104 - RNA, 17 nt, Homo sapiens
agauaguguaacuugcu

SEQ ID NO: 1561105 - RNA, 13 nt, Homo sapiens
agauauaccuaau

SEQ ID NO: 1561106 - RNA, 15 nt, Homo sapiens
agauauaccuaaugu

SEQ ID NO: 1561107 - RNA, 15 nt, Homo sapiens
agauaucagugucuc

SEQ ID NO: 1561108 - RNA, 17 nt, Homo sapiens
agauauugauuacuauc

SEQ ID NO: 1561109 - RNA, 21 nt, Homo sapiens
agaucacgccauuguacucca

SEQ ID NO: 1561110 - RNA, 20 nt, Homo sapiens
agaucacuuucucaguuuuc

SEQ ID NO: 1561111 - RNA, 13 nt, Homo sapiens
agaucagugccuc

SEQ ID NO: 1561112 - RNA, 14 nt, Homo sapiens
agaucauccuaaca

SEQ ID NO: 1561113 - RNA, 11 nt, Homo sapiens
agaucaugcca

SEQ ID NO: 1561114 - RNA, 13 nt, Homo sapiens
agaucccaacacu

SEQ ID NO: 1561115 - RNA, 14 nt, Homo sapiens
agauccuaaacucu

SEQ ID NO: 1561116 - RNA, 16 nt, Homo sapiens
agauccuggguacuga

SEQ ID NO: 1561117 - RNA, 21 nt, Homo sapiens
agaucgauccuggauucacuc

SEQ ID NO: 1561118 - RNA, 21 nt, Homo sapiens
agaucuaauauugacugccuc

SEQ ID NO: 1561119 - RNA, 22 nt, Homo sapiens
agaucuaauauugacugccucu

SEQ ID NO: 1561120 - RNA, 14 nt, Homo sapiens
agaucuacacaugu

SEQ ID NO: 1561121 - RNA, 18 nt, Homo sapiens
agaucuaguuacuguggu

SEQ ID NO: 1561122 - RNA, 17 nt, Homo sapiens
agaucucgguuugccaa

SEQ ID NO: 1561123 - RNA, 18 nt, Homo sapiens
agaucucuccugcaaaag

SEQ ID NO: 1561124 - RNA, 13 nt, Homo sapiens
agaucuuccccaa

SEQ ID NO: 1561125 - RNA, 16 nt, Homo sapiens
agaugaauaaacugaa

SEQ ID NO: 1561126 - RNA, 20 nt, Homo sapiens
agaugagccggguccggccu

SEQ ID NO: 1561127 - RNA, 13 nt, Homo sapiens
agaugaucucucc

SEQ ID NO: 1561128 - RNA, 15 nt, Homo sapiens
agaugaugcuuugag

SEQ ID NO: 1561129 - RNA, 17 nt, Homo sapiens
agaugauggaugccaau

SEQ ID NO: 1561130 - RNA, 22 nt, Homo sapiens
agaugcaaguggcugaggccaa

SEQ ID NO: 1561131 - RNA, 17 nt, Homo sapiens
agaugcaauugcuccca

SEQ ID NO: 1561132 - RNA, 18 nt, Homo sapiens
agaugcagccaccacauc

SEQ ID NO: 1561133 - RNA, 19 nt, Homo sapiens
agaugcaugucugccaaaa

SEQ ID NO: 1561134 - RNA, 18 nt, Homo sapiens
agaugccccagagcuguu

SEQ ID NO: 1561135 - RNA, 21 nt, Homo sapiens
agaugcuggccagcauuuuca

SEQ ID NO: 1561136 - RNA, 17 nt, Homo sapiens
agaugcuuuccugcaca

SEQ ID NO: 1561137 - RNA, 20 nt, Homo sapiens
agauggcauaaccugucuca

SEQ ID NO: 1561138 - RNA, 14 nt, Homo sapiens
agauggcuuuuccu

SEQ ID NO: 1561139 - RNA, 21 nt, Homo sapiens
agaugggcgucacuacugcua

SEQ ID NO: 1561140 - RNA, 16 nt, Homo sapiens
agaugggugggaggag

SEQ ID NO: 1561141 - RNA, 15 nt, Homo sapiens
agaugguaugccucu

SEQ ID NO: 1561142 - RNA, 23 nt, Homo sapiens
agaugguggagauuggcaugcca

SEQ ID NO: 1561143 - RNA, 22 nt, Homo sapiens
agauguauucuuuauaauugaa

SEQ ID NO: 1561144 - RNA, 17 nt, Homo sapiens
agaugucaucaagcucc

SEQ ID NO: 1561145 - RNA, 15 nt, Homo sapiens
agaugucauuuccac

SEQ ID NO: 1561146 - RNA, 20 nt, Homo sapiens
agaugucuuaaccucaggga

SEQ ID NO: 1561147 - RNA, 20 nt, Homo sapiens
agaugugagccaccgugccu

SEQ ID NO: 1561148 - RNA, 19 nt, Homo sapiens
agaugugggcagugauguc

SEQ ID NO: 1561149 - RNA, 16 nt, Homo sapiens
agaugugucuuaccag

SEQ ID NO: 1561150 - RNA, 18 nt, Homo sapiens
agauguguuuuugggaag

SEQ ID NO: 1561151 - RNA, 14 nt, Homo sapiens
agauguuuauuuca

SEQ ID NO: 1561152 - RNA, 18 nt, Homo sapiens
agauuacaucugccuuaa

SEQ ID NO: 1561153 - RNA, 16 nt, Homo sapiens
agauuacugaugugau

SEQ ID NO: 1561154 - RNA, 16 nt, Homo sapiens
agauuagaaacuacca

SEQ ID NO: 1561155 - RNA, 22 nt, Homo sapiens
agauuauugugacuucacugua

SEQ ID NO: 1561156 - RNA, 22 nt, Homo sapiens
agauucaaggccccgagcuguu

SEQ ID NO: 1561157 - RNA, 11 nt, Homo sapiens
agauucaccug

SEQ ID NO: 1561158 - RNA, 22 nt, Homo sapiens
agauucauuuucuagauacaau

SEQ ID NO: 1561159 - RNA, 12 nt, Homo sapiens
agauuccaccua

SEQ ID NO: 1561160 - RNA, 21 nt, Homo sapiens
agauucccuugaaauuuagau

SEQ ID NO: 1561161 - RNA, 14 nt, Homo sapiens
agauucugagcaaa

SEQ ID NO: 1561162 - RNA, 23 nt, Homo sapiens
agauugaucaaaguguaaacacc

SEQ ID NO: 1561163 - RNA, 21 nt, Homo sapiens
agauugauuaaugaacuauug

SEQ ID NO: 1561164 - RNA, 20 nt, Homo sapiens
aggcuggagugcaguggcau

SEQ ID NO: 1561165 - RNA, 16 nt, Homo sapiens
aggcugggccaugucc

SEQ ID NO: 1561166 - RNA, 15 nt, Homo sapiens
aggcugguuugcaag

SEQ ID NO: 1561167 - RNA, 21 nt, Homo sapiens
aggcugugagccaaggaggga

SEQ ID NO: 1561168 - RNA, 15 nt, Homo sapiens
aggcuuuacagugua

SEQ ID NO: 1561169 - RNA, 18 nt, Homo sapiens
agggaaaauuauuugcau

SEQ ID NO: 1561170 - RNA, 19 nt, Homo sapiens
agggaaacuggcugagggg

SEQ ID NO: 1561171 - RNA, 14 nt, Homo sapiens
agggaaacugggaa

SEQ ID NO: 1561172 - RNA, 16 nt, Homo sapiens
agggaaaggggugcuu

SEQ ID NO: 1561173 - RNA, 14 nt, Homo sapiens
agggaagcacuugc

SEQ ID NO: 1561174 - RNA, 19 nt, Homo sapiens
agggaagcuggccgagggu

SEQ ID NO: 1561175 - RNA, 15 nt, Homo sapiens
agggaaguccuugca

SEQ ID NO: 1561176 - RNA, 21 nt, Homo sapiens
agggaauccugagaaacaauc

SEQ ID NO: 1561177 - RNA, 23 nt, Homo sapiens
agggacaaccaccaggugucaaa

SEQ ID NO: 1561178 - RNA, 15 nt, Homo sapiens
agggacaaugccaau

SEQ ID NO: 1561179 - RNA, 20 nt, Homo sapiens
agggacaggcuccucugggg

SEQ ID NO: 1561180 - RNA, 12 nt, Homo sapiens
agggaccugcug

SEQ ID NO: 1561181 - RNA, 20 nt, Homo sapiens
agggagaaacuucugcucag

SEQ ID NO: 1561182 - RNA, 15 nt, Homo sapiens
agggagaacuugaaa

SEQ ID NO: 1561183 - RNA, 20 nt, Homo sapiens
agggagaauguuguugucua

SEQ ID NO: 1561184 - RNA, 14 nt, Homo sapiens
agggagaccaugcc

SEQ ID NO: 1561185 - RNA, 16 nt, Homo sapiens
agggagagagugcuau

SEQ ID NO: 1561186 - RNA, 15 nt, Homo sapiens
agggagaggucucag

SEQ ID NO: 1561187 - RNA, 21 nt, Homo sapiens
agggaggaacaccugaucuua

SEQ ID NO: 1561188 - RNA, 19 nt, Homo sapiens
agggagggguuauagcuuc

SEQ ID NO: 1561189 - RNA, 14 nt, Homo sapiens
agggagguggugau

SEQ ID NO: 1561190 - RNA, 22 nt, Homo sapiens
agggcaaaaagucuacauacuu

SEQ ID NO: 1561191 - RNA, 14 nt, Homo sapiens
agggcaacagauca

SEQ ID NO: 1561192 - RNA, 18 nt, Homo sapiens
agggcacccaaaacucaa

SEQ ID NO: 1561193 - RNA, 12 nt, Homo sapiens
agggcagcagaa

SEQ ID NO: 1561194 - RNA, 17 nt, Homo sapiens
agggccaggcuuacuga

SEQ ID NO: 1561195 - RNA, 10 nt, Homo sapiens
agggcccaac

SEQ ID NO: 1561196 - RNA, 13 nt, Homo sapiens
agggccucaggca

SEQ ID NO: 1561197 - RNA, 17 nt, Homo sapiens
agggcuagaaccuggag

SEQ ID NO: 1561198 - RNA, 23 nt, Homo sapiens
agggcuuccucaaauacaugcac

SEQ ID NO: 1561199 - RNA, 22 nt, Homo sapiens
aggggaaaagaaaaucuuuuaa

SEQ ID NO: 1561200 - RNA, 13 nt, Homo sapiens
aggggaauggagg

SEQ ID NO: 1561201 - RNA, 20 nt, Homo sapiens
aggggacucagcccugaggu

SEQ ID NO: 1561202 - RNA, 17 nt, Homo sapiens
aggggauuuugcugaug

SEQ ID NO: 1561203 - RNA, 18 nt, Homo sapiens
aggggcaacuguaugaaa

SEQ ID NO: 1561204 - RNA, 14 nt, Homo sapiens
aggggcagccugaa

SEQ ID NO: 1561205 - RNA, 17 nt, Homo sapiens
aggggcuccagcaccuu

SEQ ID NO: 1561206 - RNA, 21 nt, Homo sapiens
aggggcuguggccgucuccuc

SEQ ID NO: 1561207 - RNA, 20 nt, Homo sapiens
aggggcuguguuuccaucuc

SEQ ID NO: 1561208 - RNA, 18 nt, Homo sapiens
agggggagaauggguguu

SEQ ID NO: 1561209 - RNA, 15 nt, Homo sapiens
agggggcugcuccca

SEQ ID NO: 1561210 - RNA, 23 nt, Homo sapiens
agggggugucugcaccuuagaaa

SEQ ID NO: 1561211 - RNA, 13 nt, Homo sapiens
agggguacauucu

SEQ ID NO: 1561212 - RNA, 13 nt, Homo sapiens
aggggucauucau

SEQ ID NO: 1561213 - RNA, 14 nt, Homo sapiens
aggggucauucaug

SEQ ID NO: 1561214 - RNA, 14 nt, Homo sapiens
agggguccagccuc

SEQ ID NO: 1561215 - RNA, 13 nt, Homo sapiens
agggguccaggcc

SEQ ID NO: 1561216 - RNA, 18 nt, Homo sapiens
aggguagcccgccugcca

SEQ ID NO: 1561217 - RNA, 17 nt, Homo sapiens
agggucauaagugggga

SEQ ID NO: 1561218 - RNA, 14 nt, Homo sapiens
aggguccaguggau

SEQ ID NO: 1561219 - RNA, 16 nt, Homo sapiens
agggucccuuuugcau

SEQ ID NO: 1561220 - RNA, 15 nt, Homo sapiens
agggucugcuucccc

SEQ ID NO: 1561221 - RNA, 17 nt, Homo sapiens
agggugugaugaaguca

SEQ ID NO: 1561222 - RNA, 14 nt, Homo sapiens
agguaaaacagggc

SEQ ID NO: 1561223 - RNA, 19 nt, Homo sapiens
agguaacucuuugcacaua

SEQ ID NO: 1561224 - RNA, 14 nt, Homo sapiens
agguaaugugaaua

SEQ ID NO: 1561225 - RNA, 20 nt, Homo sapiens
agguaauguuccugaaaauu

SEQ ID NO: 1561226 - RNA, 15 nt, Homo sapiens
agguagaacucaguc

SEQ ID NO: 1561227 - RNA, 17 nt, Homo sapiens
agguauaaugauacugc

SEQ ID NO: 1561228 - RNA, 17 nt, Homo sapiens
agguauacuuuaguaga

SEQ ID NO: 1561229 - RNA, 17 nt, Homo sapiens
agguaugaucucuucug

SEQ ID NO: 1561230 - RNA, 12 nt, Homo sapiens
agguaugcauuu

SEQ ID NO: 1561231 - RNA, 17 nt, Homo sapiens
agguauuggauuuucac

SEQ ID NO: 1561232 - RNA, 16 nt, Homo sapiens
agguauuggggaacag

SEQ ID NO: 1561233 - RNA, 12 nt, Homo sapiens
aggucacuggaa

SEQ ID NO: 1561234 - RNA, 20 nt, Homo sapiens
aggucacuuuaccucugugg

SEQ ID NO: 1561235 - RNA, 17 nt, Homo sapiens
aggucauaaacacugca

SEQ ID NO: 1561236 - RNA, 20 nt, Homo sapiens
agguccuuaggccucugaga

SEQ ID NO: 1561237 - RNA, 21 nt, Homo sapiens
agguccuuaggccucugagaa

SEQ ID NO: 1561238 - RNA, 18 nt, Homo sapiens
aggucgggacagcugugc

SEQ ID NO: 1561239 - RNA, 17 nt, Homo sapiens
aggucguuuuccaaaga

SEQ ID NO: 1561240 - RNA, 12 nt, Homo sapiens
aggucucaucuc

SEQ ID NO: 1561241 - RNA, 23 nt, Homo sapiens
aggugaacugggagcagcucugu

SEQ ID NO: 1561242 - RNA, 17 nt, Homo sapiens
aggugagaaaaccaugg

SEQ ID NO: 1561243 - RNA, 16 nt, Homo sapiens
aggugaggcucuucac

SEQ ID NO: 1561244 - RNA, 19 nt, Homo sapiens
aggugauccgccuaccuca

SEQ ID NO: 1561245 - RNA, 14 nt, Homo sapiens
aggugaugccauua

SEQ ID NO: 1561246 - RNA, 23 nt, Homo sapiens
aggugauugucaccaugaucacu

SEQ ID NO: 1561247 - RNA, 20 nt, Homo sapiens
aggugcgcgccaccgugccu

SEQ ID NO: 1561248 - RNA, 21 nt, Homo sapiens
aggugcuacaaaaacacagca

SEQ ID NO: 1561249 - RNA, 22 nt, Homo sapiens
aggugcugauccuaagaauuuu

SEQ ID NO: 1561250 - RNA, 16 nt, Homo sapiens
agguggaacucaguca

SEQ ID NO: 1561251 - RNA, 19 nt, Homo sapiens
agguggauccuguaggcua

SEQ ID NO: 1561252 - RNA, 16 nt, Homo sapiens
agguggcccuaaagga

SEQ ID NO: 1561253 - RNA, 16 nt, Homo sapiens
agguggcucagugcca

SEQ ID NO: 1561254 - RNA, 18 nt, Homo sapiens
aggugggcagaucacuug

SEQ ID NO: 1561255 - RNA, 19 nt, Homo sapiens
aggugggcggaucaccuga

SEQ ID NO: 1561256 - RNA, 16 nt, Homo sapiens
agguguacacaugcca

SEQ ID NO: 1561257 - RNA, 16 nt, Homo sapiens
agguguagaccagagu

SEQ ID NO: 1561258 - RNA, 18 nt, Homo sapiens
aggugucgggacaugguu

SEQ ID NO: 1561259 - RNA, 15 nt, Homo sapiens
aggugucugccuuca

SEQ ID NO: 1561260 - RNA, 20 nt, Homo sapiens
aggugugagccaccgugccc

SEQ ID NO: 1561261 - RNA, 18 nt, Homo sapiens
agguguugggucaguggc

SEQ ID NO: 1561262 - RNA, 13 nt, Homo sapiens
agguuaaggcaua

SEQ ID NO: 1561263 - RNA, 16 nt, Homo sapiens
agguuaaugaacuuca

SEQ ID NO: 1561264 - RNA, 16 nt, Homo sapiens
agguuacaagccugca

SEQ ID NO: 1561265 - RNA, 13 nt, Homo sapiens
agguuagaaccua

SEQ ID NO: 1561266 - RNA, 21 nt, Homo sapiens
agguuaggaaggcagcauucc

SEQ ID NO: 1561267 - RNA, 18 nt, Homo sapiens
agguucauggauuacuuc

SEQ ID NO: 1561268 - RNA, 18 nt, Homo sapiens
agguugagcucuucuuaa

SEQ ID NO: 1561269 - RNA, 17 nt, Homo sapiens
agguugagggcaaugga

SEQ ID NO: 1561270 - RNA, 12 nt, Homo sapiens
agguugcauugg

SEQ ID NO: 1561271 - RNA, 17 nt, Homo sapiens
agguuggauccaaggag

SEQ ID NO: 1561272 - RNA, 20 nt, Homo sapiens
agguuguggggccucaggcu

SEQ ID NO: 1561273 - RNA, 15 nt, Homo sapiens
agguuugccagcauu

SEQ ID NO: 1561274 - RNA, 16 nt, Homo sapiens
agguuugccagcauuu

SEQ ID NO: 1561275 - RNA, 14 nt, Homo sapiens
agguuuguaaaaug

SEQ ID NO: 1561276 - RNA, 23 nt, Homo sapiens
agguuuuuaaguugucugucuga

SEQ ID NO: 1561277 - RNA, 23 nt, Homo sapiens
agguuuuuaguuuguucuucaga

SEQ ID NO: 1561278 - RNA, 22 nt, Homo sapiens
aguaaaacucccccccacccaa

SEQ ID NO: 1561279 - RNA, 16 nt, Homo sapiens
aguaaaagucuaccug

SEQ ID NO: 1561280 - RNA, 18 nt, Homo sapiens
aguaaacuuucucugcaa

SEQ ID NO: 1561281 - RNA, 20 nt, Homo sapiens
aguaaagaguacacucagcc

SEQ ID NO: 1561282 - RNA, 20 nt, Homo sapiens
aguaaagcagaggaugcaac

SEQ ID NO: 1561283 - RNA, 12 nt, Homo sapiens
auuuuaccuguu

SEQ ID NO: 1561284 - RNA, 15 nt, Homo sapiens
auuuuacucacucac

SEQ ID NO: 1561285 - RNA, 16 nt, Homo sapiens
auuuuacucacucacu

SEQ ID NO: 1561286 - RNA, 19 nt, Homo sapiens
auuuuacuuuucugccaaa

SEQ ID NO: 1561287 - RNA, 20 nt, Homo sapiens
auuuuagaauaaauucccaa

SEQ ID NO: 1561288 - RNA, 23 nt, Homo sapiens
auuuuauaaagaucagaaugaua

SEQ ID NO: 1561289 - RNA, 18 nt, Homo sapiens
auuuuauaggcauaccuc

SEQ ID NO: 1561290 - RNA, 21 nt, Homo sapiens
auuuuauaggcauaccuccua

SEQ ID NO: 1561291 - RNA, 14 nt, Homo sapiens
auuuuauaucuguu

SEQ ID NO: 1561292 - RNA, 13 nt, Homo sapiens
auuuuauuucaau

SEQ ID NO: 1561293 - RNA, 24 nt, Homo sapiens
auuuucaagaauaaucacgcuuuc

SEQ ID NO: 1561294 - RNA, 19 nt, Homo sapiens
auuuucacuuuuaaacuac

SEQ ID NO: 1561295 - RNA, 13 nt, Homo sapiens
auuuucagacugc

SEQ ID NO: 1561296 - RNA, 22 nt, Homo sapiens
auuuucagucauaaaagcuuua

SEQ ID NO: 1561297 - RNA, 14 nt, Homo sapiens
auuuucauucuguu

SEQ ID NO: 1561298 - RNA, 21 nt, Homo sapiens
auuuuccuggugccaauuuca

SEQ ID NO: 1561299 - RNA, 14 nt, Homo sapiens
auuuucuaccccca

SEQ ID NO: 1561300 - RNA, 16 nt, Homo sapiens
auuuucuagauacaau

SEQ ID NO: 1561301 - RNA, 21 nt, Homo sapiens
auuuucuggccuuucauggca

SEQ ID NO: 1561302 - RNA, 23 nt, Homo sapiens
auuuugaaaugaaacaagcuuac

SEQ ID NO: 1561303 - RNA, 15 nt, Homo sapiens
auuuugaagugcugu

SEQ ID NO: 1561304 - RNA, 21 nt, Homo sapiens
auuuugauggugucugugaca

SEQ ID NO: 1561305 - RNA, 13 nt, Homo sapiens
auuuugcuaaaaa

SEQ ID NO: 1561306 - RNA, 16 nt, Homo sapiens
auuuugguacugugau

SEQ ID NO: 1561307 - RNA, 16 nt, Homo sapiens
auuuuguaaaauguau

SEQ ID NO: 1561308 - RNA, 19 nt, Homo sapiens
auuuuguaagaaggcaaua

SEQ ID NO: 1561309 - RNA, 17 nt, Homo sapiens
auuuuguaagaaguuuc

SEQ ID NO: 1561310 - RNA, 20 nt, Homo sapiens
auuuuguaugccaaucuuaa

SEQ ID NO: 1561311 - RNA, 15 nt, Homo sapiens
auuuugugacauucc

SEQ ID NO: 1561312 - RNA, 15 nt, Homo sapiens
auuuuguugcaucau

SEQ ID NO: 1561313 - RNA, 16 nt, Homo sapiens
auuuuguugcuuucuu

SEQ ID NO: 1561314 - RNA, 23 nt, Homo sapiens
auuuuuaaaggcauuagagucaa

SEQ ID NO: 1561315 - RNA, 14 nt, Homo sapiens
auuuuuacacaacu

SEQ ID NO: 1561316 - RNA, 22 nt, Homo sapiens
auuuuucaauauauugaacuuu

SEQ ID NO: 1561317 - RNA, 21 nt, Homo sapiens
auuuuucaaugggaagacuca

SEQ ID NO: 1561318 - RNA, 14 nt, Homo sapiens
auuuuuccacuuaa

SEQ ID NO: 1561319 - RNA, 23 nt, Homo sapiens
auuuuuccuaugcuauugacaau

SEQ ID NO: 1561320 - RNA, 12 nt, Homo sapiens
auuuuucugcac

SEQ ID NO: 1561321 - RNA, 20 nt, Homo sapiens
auuuuucuuagugugccaag

SEQ ID NO: 1561322 - RNA, 15 nt, Homo sapiens
auuuuugcuuagcuc

SEQ ID NO: 1561323 - RNA, 19 nt, Homo sapiens
auuuuuggugggaauccaa

SEQ ID NO: 1561324 - RNA, 15 nt, Homo sapiens
auuuuuguuuaugua

SEQ ID NO: 1561325 - RNA, 16 nt, Homo sapiens
auuuuuuaacauauug

SEQ ID NO: 1561326 - RNA, 20 nt, Homo sapiens
auuuuuuaauccuaccucaa

SEQ ID NO: 1561327 - RNA, 16 nt, Homo sapiens
auuuuuuaaugugcuc

SEQ ID NO: 1561328 - RNA, 23 nt, Homo sapiens
auuuuuucucuguaaacuuccaa

SEQ ID NO: 1561329 - RNA, 13 nt, Homo sapiens
auuuuuugacuuu

SEQ ID NO: 1561330 - RNA, 18 nt, Homo sapiens
auuuuuuuuccuugccug

SEQ ID NO: 1561331 - RNA, 16 nt, Homo sapiens
caaaaaaagagaacac

SEQ ID NO: 1561332 - RNA, 14 nt, Homo sapiens
caaaaaaaguaauu

SEQ ID NO: 1561333 - RNA, 21 nt, Homo sapiens
caaaaaaauuaaaauggaugc

SEQ ID NO: 1561334 - RNA, 17 nt, Homo sapiens
caaaaacaaacaaaagc

SEQ ID NO: 1561335 - RNA, 13 nt, Homo sapiens
caaaaacaagcaa

SEQ ID NO: 1561336 - RNA, 14 nt, Homo sapiens
caaaaaccaaacac

SEQ ID NO: 1561337 - RNA, 18 nt, Homo sapiens
caaaaaccauguugcguu

SEQ ID NO: 1561338 - RNA, 20 nt, Homo sapiens
caaaaauagcccugcaaaaa

SEQ ID NO: 1561339 - RNA, 19 nt, Homo sapiens
caaaaaucguuuugcccga

SEQ ID NO: 1561340 - RNA, 20 nt, Homo sapiens
caaaaaucuguguaacugua

SEQ ID NO: 1561341 - RNA, 17 nt, Homo sapiens
caaaaauugucccuuaa

SEQ ID NO: 1561342 - RNA, 22 nt, Homo sapiens
caaaaauuuauuauauauuuac

SEQ ID NO: 1561343 - RNA, 23 nt, Homo sapiens
caaaacaaaacccucagcacugu

SEQ ID NO: 1561344 - RNA, 18 nt, Homo sapiens
caaaacaauauuacuuug

SEQ ID NO: 1561345 - RNA, 18 nt, Homo sapiens
caaaacaauuaaucauuu

SEQ ID NO: 1561346 - RNA, 22 nt, Homo sapiens
caaaacaucuuuucacaacuua

SEQ ID NO: 1561347 - RNA, 11 nt, Homo sapiens
caaaaccucca

SEQ ID NO: 1561348 - RNA, 17 nt, Homo sapiens
caaaacuaaccaucuga

SEQ ID NO: 1561349 - RNA, 15 nt, Homo sapiens
caaaacuacaugaga

SEQ ID NO: 1561350 - RNA, 12 nt, Homo sapiens
caaaacuacuga

SEQ ID NO: 1561351 - RNA, 14 nt, Homo sapiens
caaaacuacugaca

SEQ ID NO: 1561352 - RNA, 15 nt, Homo sapiens
caaaacuccgucuca

SEQ ID NO: 1561353 - RNA, 17 nt, Homo sapiens
caaaagaaaauuuucca

SEQ ID NO: 1561354 - RNA, 16 nt, Homo sapiens
caaaagaaagaaccac

SEQ ID NO: 1561355 - RNA, 17 nt, Homo sapiens
caaaagaauaagacaag

SEQ ID NO: 1561356 - RNA, 19 nt, Homo sapiens
caaaagagaaaaacaaaac

SEQ ID NO: 1561357 - RNA, 17 nt, Homo sapiens
caaaagagcauggaugc

SEQ ID NO: 1561358 - RNA, 23 nt, Homo sapiens
caaaagagcauggaugcauuuca

SEQ ID NO: 1561359 - RNA, 13 nt, Homo sapiens
caaaagcaaggga

SEQ ID NO: 1561360 - RNA, 22 nt, Homo sapiens
caaaaggaacucuagaagacca

SEQ ID NO: 1561361 - RNA, 15 nt, Homo sapiens
caaaaggacucucag

SEQ ID NO: 1561362 - RNA, 18 nt, Homo sapiens
caaaaggagagacuccca

SEQ ID NO: 1561363 - RNA, 15 nt, Homo sapiens
caaaauaaaccuguu

SEQ ID NO: 1561364 - RNA, 17 nt, Homo sapiens
caaaauacacauucuug

SEQ ID NO: 1561365 - RNA, 17 nt, Homo sapiens
caaaauagaaaaguuau

SEQ ID NO: 1561366 - RNA, 15 nt, Homo sapiens
caaaauauauauuaa

SEQ ID NO: 1561367 - RNA, 17 nt, Homo sapiens
caaaauauuuaagugaa

SEQ ID NO: 1561368 - RNA, 19 nt, Homo sapiens
caaaauauuuaagugaagg

SEQ ID NO: 1561369 - RNA, 18 nt, Homo sapiens
caaaaucaacaugacugg

SEQ ID NO: 1561370 - RNA, 14 nt, Homo sapiens
caaaaucauggcuu

SEQ ID NO: 1561371 - RNA, 22 nt, Homo sapiens
caaaauccaaaaagcucugaaa

SEQ ID NO: 1561372 - RNA, 14 nt, Homo sapiens
caaaaucuuuccaa

SEQ ID NO: 1561373 - RNA, 18 nt, Homo sapiens
caaaauguaugucugguu

SEQ ID NO: 1561374 - RNA, 13 nt, Homo sapiens
caaaauguuuaua

SEQ ID NO: 1561375 - RNA, 20 nt, Homo sapiens
caaaauucauuugcuugcaa

SEQ ID NO: 1561376 - RNA, 22 nt, Homo sapiens
caaaauuuuguaaauaugcaaa

SEQ ID NO: 1561377 - RNA, 23 nt, Homo sapiens
caaacaaaacaaaaaccaaacac

SEQ ID NO: 1561378 - RNA, 19 nt, Homo sapiens
caaacaagaaacauuucag

SEQ ID NO: 1561379 - RNA, 20 nt, Homo sapiens
caaacaagaaacauuucaga

SEQ ID NO: 1561380 - RNA, 21 nt, Homo sapiens
caaacaagaaagcuauuccaa

SEQ ID NO: 1561381 - RNA, 13 nt, Homo sapiens
caaacaaugcaga

SEQ ID NO: 1561382 - RNA, 19 nt, Homo sapiens
caaacacugugauuacucu

SEQ ID NO: 1561383 - RNA, 13 nt, Homo sapiens
caaaccaagcaaa

SEQ ID NO: 1561384 - RNA, 15 nt, Homo sapiens
caaaccauugcucuu

SEQ ID NO: 1561385 - RNA, 15 nt, Homo sapiens
caaacccuggugcuu

SEQ ID NO: 1561386 - RNA, 15 nt, Homo sapiens
caaaccuaacaggag

SEQ ID NO: 1561387 - RNA, 22 nt, Homo sapiens
caaaccuggauuuuuuauguac

SEQ ID NO: 1561388 - RNA, 16 nt, Homo sapiens
caaacucccgaccuca

SEQ ID NO: 1561389 - RNA, 18 nt, Homo sapiens
caaacucuaaaauuauaa

SEQ ID NO: 1561390 - RNA, 14 nt, Homo sapiens
caaacuguaaaaau

SEQ ID NO: 1561391 - RNA, 11 nt, Homo sapiens
caaacugugaa

SEQ ID NO: 1561392 - RNA, 23 nt, Homo sapiens
caaacuguuuugacaaaugagca

SEQ ID NO: 1561393 - RNA, 16 nt, Homo sapiens
caaacuuuuauacucu

SEQ ID NO: 1561394 - RNA, 20 nt, Homo sapiens
caaagaaaaaaaaaaaagcc

SEQ ID NO: 1561395 - RNA, 20 nt, Homo sapiens
caaagaaaaauaacccuuug

SEQ ID NO: 1561396 - RNA, 17 nt, Homo sapiens
caaagaaaugaacauuc

SEQ ID NO: 1561397 - RNA, 24 nt, Homo sapiens
caaagaacugaaagcacuagagca

SEQ ID NO: 1561398 - RNA, 13 nt, Homo sapiens
caaagaaggcauu

SEQ ID NO: 1561399 - RNA, 20 nt, Homo sapiens
caaagaaugggcuugaaaca

SEQ ID NO: 1561400 - RNA, 17 nt, Homo sapiens
caaagaauuccaaagca

SEQ ID NO: 1561401 - RNA, 23 nt, Homo sapiens
caauugagaaaaauauauacuaa

SEQ ID NO: 1561402 - RNA, 23 nt, Homo sapiens
caauugguaaaacucacugugau

SEQ ID NO: 1561403 - RNA, 21 nt, Homo sapiens
caauuuauaccuagcacuuua

SEQ ID NO: 1561404 - RNA, 13 nt, Homo sapiens
caauuuauccaac

SEQ ID NO: 1561405 - RNA, 19 nt, Homo sapiens
caauuuauccaacccauuu

SEQ ID NO: 1561406 - RNA, 19 nt, Homo sapiens
caauuucagcuucauauca

SEQ ID NO: 1561407 - RNA, 14 nt, Homo sapiens
caauuucauacuaa

SEQ ID NO: 1561408 - RNA, 13 nt, Homo sapiens
caauuugaagaga

SEQ ID NO: 1561409 - RNA, 18 nt, Homo sapiens
caauuuugcacugaagag

SEQ ID NO: 1561410 - RNA, 18 nt, Homo sapiens
cacaaaauaaccaauccu

SEQ ID NO: 1561411 - RNA, 14 nt, Homo sapiens
cacaaaauucuuau

SEQ ID NO: 1561412 - RNA, 13 nt, Homo sapiens
cacaaacugugaa

SEQ ID NO: 1561413 - RNA, 16 nt, Homo sapiens
cacaaagacuccuucg

SEQ ID NO: 1561414 - RNA, 19 nt, Homo sapiens
cacaaaggcugacauucac

SEQ ID NO: 1561415 - RNA, 20 nt, Homo sapiens
cacaaaggcugacauucacu

SEQ ID NO: 1561416 - RNA, 19 nt, Homo sapiens
cacaaauaggauguacugu

SEQ ID NO: 1561417 - RNA, 22 nt, Homo sapiens
cacaaauucagucucugaauac

SEQ ID NO: 1561418 - RNA, 17 nt, Homo sapiens
cacaacgcaccagacac

SEQ ID NO: 1561419 - RNA, 16 nt, Homo sapiens
cacaacggcagugaag

SEQ ID NO: 1561420 - RNA, 22 nt, Homo sapiens
cacaacuuguaccaaguuuccc

SEQ ID NO: 1561421 - RNA, 17 nt, Homo sapiens
cacaagaccaagguaua

SEQ ID NO: 1561422 - RNA, 23 nt, Homo sapiens
cacaagaccaagguauacaucuu

SEQ ID NO: 1561423 - RNA, 14 nt, Homo sapiens
cacaagccagaccc

SEQ ID NO: 1561424 - RNA, 16 nt, Homo sapiens
cacaagccugagaacu

SEQ ID NO: 1561425 - RNA, 14 nt, Homo sapiens
cacaagcucagguc

SEQ ID NO: 1561426 - RNA, 14 nt, Homo sapiens
cacaaucugaaaca

SEQ ID NO: 1561427 - RNA, 12 nt, Homo sapiens
cacaaugcccaa

SEQ ID NO: 1561428 - RNA, 18 nt, Homo sapiens
cacaauguuaaguuauau

SEQ ID NO: 1561429 - RNA, 15 nt, Homo sapiens
cacaauuauuccaaa

SEQ ID NO: 1561430 - RNA, 21 nt, Homo sapiens
cacaauuauuggcaaaguuua

SEQ ID NO: 1561431 - RNA, 14 nt, Homo sapiens
cacacaaaaacaga

SEQ ID NO: 1561432 - RNA, 13 nt, Homo sapiens
cacacacagccug

SEQ ID NO: 1561433 - RNA, 13 nt, Homo sapiens
cacacacugaguu

SEQ ID NO: 1561434 - RNA, 14 nt, Homo sapiens
cacacagacuccac

SEQ ID NO: 1561435 - RNA, 22 nt, Homo sapiens
cacacagauuuuuauguuuucu

SEQ ID NO: 1561436 - RNA, 17 nt, Homo sapiens
cacacauccugucagug

SEQ ID NO: 1561437 - RNA, 22 nt, Homo sapiens
cacacaugaaucugcacaucug

SEQ ID NO: 1561438 - RNA, 12 nt, Homo sapiens
cacacauucacg

SEQ ID NO: 1561439 - RNA, 14 nt, Homo sapiens
cacacauugugcuu

SEQ ID NO: 1561440 - RNA, 17 nt, Homo sapiens
cacacauuuuaugagag

SEQ ID NO: 1561441 - RNA, 19 nt, Homo sapiens
cacaccccucugcugcaac

SEQ ID NO: 1561442 - RNA, 12 nt, Homo sapiens
cacaccucuaaa

SEQ ID NO: 1561443 - RNA, 22 nt, Homo sapiens
cacaccuggcauggugcaggga

SEQ ID NO: 1561444 - RNA, 15 nt, Homo sapiens
cacaccugggcauuu

SEQ ID NO: 1561445 - RNA, 17 nt, Homo sapiens
cacaccuuuuauugaca

SEQ ID NO: 1561446 - RNA, 13 nt, Homo sapiens
cacacgcauuaau

SEQ ID NO: 1561447 - RNA, 22 nt, Homo sapiens
cacacucuucucuugagcaguu

SEQ ID NO: 1561448 - RNA, 12 nt, Homo sapiens
cacacuuugcca

SEQ ID NO: 1561449 - RNA, 20 nt, Homo sapiens
cacagaaaucacagucaaug

SEQ ID NO: 1561450 - RNA, 17 nt, Homo sapiens
cacagaagguccuggug

SEQ ID NO: 1561451 - RNA, 17 nt, Homo sapiens
cacagagauucugaacu

SEQ ID NO: 1561452 - RNA, 22 nt, Homo sapiens
cacagagauucugaacuaaagu

SEQ ID NO: 1561453 - RNA, 16 nt, Homo sapiens
cacagaggagugcagc

SEQ ID NO: 1561454 - RNA, 20 nt, Homo sapiens
cacagaggcauagaauacac

SEQ ID NO: 1561455 - RNA, 22 nt, Homo sapiens
cacagagugcuggacuguucca

SEQ ID NO: 1561456 - RNA, 21 nt, Homo sapiens
cacagcaagggugaugggaaa

SEQ ID NO: 1561457 - RNA, 13 nt, Homo sapiens
cacagcagcauuu

SEQ ID NO: 1561458 - RNA, 22 nt, Homo sapiens
cacagcaggcugccagugccug

SEQ ID NO: 1561459 - RNA, 19 nt, Homo sapiens
cacagcaucagcucaagac

SEQ ID NO: 1561460 - RNA, 17 nt, Homo sapiens
cacagcaucgggagcac

SEQ ID NO: 1561461 - RNA, 13 nt, Homo sapiens
cacagcauuguau

SEQ ID NO: 1561462 - RNA, 23 nt, Homo sapiens
cacagccaaccuagcuagcaaca

SEQ ID NO: 1561463 - RNA, 16 nt, Homo sapiens
cacagcccaggccaca

SEQ ID NO: 1561464 - RNA, 20 nt, Homo sapiens
cacagccccuggagccucag

SEQ ID NO: 1561465 - RNA, 20 nt, Homo sapiens
cacagccuccucugucugcc

SEQ ID NO: 1561466 - RNA, 14 nt, Homo sapiens
cacagcuaaccacu

SEQ ID NO: 1561467 - RNA, 18 nt, Homo sapiens
cacagcuauuuagaagca

SEQ ID NO: 1561468 - RNA, 18 nt, Homo sapiens
cacagcuuagauuucaua

SEQ ID NO: 1561469 - RNA, 14 nt, Homo sapiens
cacaggaguguccu

SEQ ID NO: 1561470 - RNA, 16 nt, Homo sapiens
cacaggcauauucccu

SEQ ID NO: 1561471 - RNA, 18 nt, Homo sapiens
cacaguaccggauucucu

SEQ ID NO: 1561472 - RNA, 16 nt, Homo sapiens
cacaguagucuugaug

SEQ ID NO: 1561473 - RNA, 20 nt, Homo sapiens
cacagucacugauguacaau

SEQ ID NO: 1561474 - RNA, 17 nt, Homo sapiens
cacagucacuggcccaa

SEQ ID NO: 1561475 - RNA, 17 nt, Homo sapiens
cacagucauacaaguca

SEQ ID NO: 1561476 - RNA, 18 nt, Homo sapiens
cacagucauacaagucau

SEQ ID NO: 1561477 - RNA, 19 nt, Homo sapiens
cacagugaugaauguacua

SEQ ID NO: 1561478 - RNA, 24 nt, Homo sapiens
cacaguggguggugaguucugacu

SEQ ID NO: 1561479 - RNA, 16 nt, Homo sapiens
cacauaaagaaauuca

SEQ ID NO: 1561480 - RNA, 21 nt, Homo sapiens
cacauagauucaccuguaaaa

SEQ ID NO: 1561481 - RNA, 21 nt, Homo sapiens
cacauaggaaaaugccaugaa

SEQ ID NO: 1561482 - RNA, 13 nt, Homo sapiens
cacauaugacaau

SEQ ID NO: 1561483 - RNA, 18 nt, Homo sapiens
cacauauggaauuuugca

SEQ ID NO: 1561484 - RNA, 13 nt, Homo sapiens
cacauauugagaa

SEQ ID NO: 1561485 - RNA, 22 nt, Homo sapiens
cacaucagcuuuaggacugaca

SEQ ID NO: 1561486 - RNA, 21 nt, Homo sapiens
cacaugaagguaaauaaaaag

SEQ ID NO: 1561487 - RNA, 19 nt, Homo sapiens
cacaugagacuuacugcuc

SEQ ID NO: 1561488 - RNA, 12 nt, Homo sapiens
cacaugccccuu

SEQ ID NO: 1561489 - RNA, 20 nt, Homo sapiens
cacaugccuguaaucccagc

SEQ ID NO: 1561490 - RNA, 21 nt, Homo sapiens
cacaugcuuuagccauacaca

SEQ ID NO: 1561491 - RNA, 14 nt, Homo sapiens
cacauggaacuuua

SEQ ID NO: 1561492 - RNA, 17 nt, Homo sapiens
cacaugucaguaccuuc

SEQ ID NO: 1561493 - RNA, 17 nt, Homo sapiens
cacauguguuaucuacc

SEQ ID NO: 1561494 - RNA, 21 nt, Homo sapiens
cacauuaguacuuauguugca

SEQ ID NO: 1561495 - RNA, 14 nt, Homo sapiens
cacauuaucuucau

SEQ ID NO: 1561496 - RNA, 13 nt, Homo sapiens
cacauuccaaacu

SEQ ID NO: 1561497 - RNA, 21 nt, Homo sapiens
cacauuccaagccucaugucc

SEQ ID NO: 1561498 - RNA, 18 nt, Homo sapiens
cacauucgggaccaauau

SEQ ID NO: 1561499 - RNA, 14 nt, Homo sapiens
cacauucugccuug

SEQ ID NO: 1561500 - RNA, 23 nt, Homo sapiens
cacauucuucaguuuuucacuuc

SEQ ID NO: 1561501 - RNA, 23 nt, Homo sapiens
cacauugacuccuuuccaauaga

SEQ ID NO: 1561502 - RNA, 13 nt, Homo sapiens
cacauugcaaugu

SEQ ID NO: 1561503 - RNA, 12 nt, Homo sapiens
cacauugccuuc

SEQ ID NO: 1561504 - RNA, 13 nt, Homo sapiens
cacauugccuucu

SEQ ID NO: 1561505 - RNA, 15 nt, Homo sapiens
cacauugcuaccuca

SEQ ID NO: 1561506 - RNA, 23 nt, Homo sapiens
cacauugcuaccucagugcuccu

SEQ ID NO: 1561507 - RNA, 19 nt, Homo sapiens
cacauuggguggggcuccu

SEQ ID NO: 1561508 - RNA, 15 nt, Homo sapiens
cacauuugacuccac

SEQ ID NO: 1561509 - RNA, 22 nt, Homo sapiens
cacauuuuuuuaugcucuugaa

SEQ ID NO: 1561510 - RNA, 15 nt, Homo sapiens
caccaaagacaucag

SEQ ID NO: 1561511 - RNA, 18 nt, Homo sapiens
caccaaaggagacauauc

SEQ ID NO: 1561512 - RNA, 19 nt, Homo sapiens
caccaacugaaguggcuaa

SEQ ID NO: 1561513 - RNA, 23 nt, Homo sapiens
caccaaggcugagacagugaauu

SEQ ID NO: 1561514 - RNA, 20 nt, Homo sapiens
caccaagggaucugccauug

SEQ ID NO: 1561515 - RNA, 22 nt, Homo sapiens
caccaaguaccaguauaagcau

SEQ ID NO: 1561516 - RNA, 22 nt, Homo sapiens
caccaaucagcacucuguaaaa

SEQ ID NO: 1561517 - RNA, 19 nt, Homo sapiens
caccaaugaaaacauguac

SEQ ID NO: 1561518 - RNA, 14 nt, Homo sapiens
caccacacacacac

SEQ ID NO: 1561519 - RNA, 21 nt, Homo sapiens
cagcugugcacuuucuucucu

SEQ ID NO: 1561520 - RNA, 13 nt, Homo sapiens
cagcuguuuaugc

SEQ ID NO: 1561521 - RNA, 17 nt, Homo sapiens
cagcuuagauuucauag

SEQ ID NO: 1561522 - RNA, 19 nt, Homo sapiens
cagcuucccaaguagcugg

SEQ ID NO: 1561523 - RNA, 19 nt, Homo sapiens
cagcuucccgaguaccagu

SEQ ID NO: 1561524 - RNA, 21 nt, Homo sapiens
cagcuucugauaaacacaauc

SEQ ID NO: 1561525 - RNA, 15 nt, Homo sapiens
cagcuucuucuuuca

SEQ ID NO: 1561526 - RNA, 24 nt, Homo sapiens
cagcuugagaaggucacuacugca

SEQ ID NO: 1561527 - RNA, 13 nt, Homo sapiens
cagcuugccaaau

SEQ ID NO: 1561528 - RNA, 17 nt, Homo sapiens
cagcuuuucccaggaga

SEQ ID NO: 1561529 - RNA, 19 nt, Homo sapiens
cagcuuuuguuguuuauau

SEQ ID NO: 1561530 - RNA, 14 nt, Homo sapiens
caggaaaaaaacuu

SEQ ID NO: 1561531 - RNA, 19 nt, Homo sapiens
caggaaaauguauugauuc

SEQ ID NO: 1561532 - RNA, 16 nt, Homo sapiens
caggaagccaggugag

SEQ ID NO: 1561533 - RNA, 21 nt, Homo sapiens
caggaagcccaggagccucac

SEQ ID NO: 1561534 - RNA, 20 nt, Homo sapiens
caggaaggaacaaagacagg

SEQ ID NO: 1561535 - RNA, 16 nt, Homo sapiens
caggaagucccucucc

SEQ ID NO: 1561536 - RNA, 21 nt, Homo sapiens
caggaaguggcucagaccccu

SEQ ID NO: 1561537 - RNA, 18 nt, Homo sapiens
caggaauccccaacaugc

SEQ ID NO: 1561538 - RNA, 16 nt, Homo sapiens
caggacagaaccacug

SEQ ID NO: 1561539 - RNA, 13 nt, Homo sapiens
caggacuuaacau

SEQ ID NO: 1561540 - RNA, 21 nt, Homo sapiens
caggacuucucaccagcaguc

SEQ ID NO: 1561541 - RNA, 18 nt, Homo sapiens
caggagaaucacuugaac

SEQ ID NO: 1561542 - RNA, 18 nt, Homo sapiens
caggagacagaccacuug

SEQ ID NO: 1561543 - RNA, 18 nt, Homo sapiens
caggagagucacuugaac

SEQ ID NO: 1561544 - RNA, 15 nt, Homo sapiens
caggagccaccagca

SEQ ID NO: 1561545 - RNA, 16 nt, Homo sapiens
caggaggaucacuuga

SEQ ID NO: 1561546 - RNA, 15 nt, Homo sapiens
caggaggaucacuuu

SEQ ID NO: 1561547 - RNA, 21 nt, Homo sapiens
caggaggcaagcguguucuca

SEQ ID NO: 1561548 - RNA, 20 nt, Homo sapiens
caggaggcagacaaugaccc

SEQ ID NO: 1561549 - RNA, 18 nt, Homo sapiens
caggaggcagcucaggau

SEQ ID NO: 1561550 - RNA, 13 nt, Homo sapiens
caggaggggaaac

SEQ ID NO: 1561551 - RNA, 20 nt, Homo sapiens
caggaggguugggcgugcua

SEQ ID NO: 1561552 - RNA, 13 nt, Homo sapiens
caggagucccugc

SEQ ID NO: 1561553 - RNA, 18 nt, Homo sapiens
caggagucccugccauca

SEQ ID NO: 1561554 - RNA, 15 nt, Homo sapiens
caggagucucuggua

SEQ ID NO: 1561555 - RNA, 23 nt, Homo sapiens
caggaguuugagguuacagugau

SEQ ID NO: 1561556 - RNA, 22 nt, Homo sapiens
caggauacuggcacagagguag

SEQ ID NO: 1561557 - RNA, 13 nt, Homo sapiens
caggaucaccucc

SEQ ID NO: 1561558 - RNA, 21 nt, Homo sapiens
caggaucagugggucuaagug

SEQ ID NO: 1561559 - RNA, 19 nt, Homo sapiens
caggaucugucugugcaca

SEQ ID NO: 1561560 - RNA, 16 nt, Homo sapiens
caggauuauucccacc

SEQ ID NO: 1561561 - RNA, 22 nt, Homo sapiens
caggauuauucccaccugccac

SEQ ID NO: 1561562 - RNA, 15 nt, Homo sapiens
caggcaaucuugccu

SEQ ID NO: 1561563 - RNA, 18 nt, Homo sapiens
caggcacacagcuacucu

SEQ ID NO: 1561564 - RNA, 12 nt, Homo sapiens
caggcaccugcc

SEQ ID NO: 1561565 - RNA, 14 nt, Homo sapiens
caggcacugagaau

SEQ ID NO: 1561566 - RNA, 16 nt, Homo sapiens
caggcagaucugugcc

SEQ ID NO: 1561567 - RNA, 20 nt, Homo sapiens
caggcagaucugugccccau

SEQ ID NO: 1561568 - RNA, 16 nt, Homo sapiens
caggcaggugcaggga

SEQ ID NO: 1561569 - RNA, 15 nt, Homo sapiens
caggcauuugacuga

SEQ ID NO: 1561570 - RNA, 22 nt, Homo sapiens
caggccacagagaaccugaguu

SEQ ID NO: 1561571 - RNA, 16 nt, Homo sapiens
caggccagcaagcucu

SEQ ID NO: 1561572 - RNA, 12 nt, Homo sapiens
caggccaggugc

SEQ ID NO: 1561573 - RNA, 19 nt, Homo sapiens
caggccccgaggacccaga

SEQ ID NO: 1561574 - RNA, 17 nt, Homo sapiens
caggccccgcuugucca

SEQ ID NO: 1561575 - RNA, 18 nt, Homo sapiens
caggccgacccaagggag

SEQ ID NO: 1561576 - RNA, 18 nt, Homo sapiens
caggccucucucugcucc

SEQ ID NO: 1561577 - RNA, 20 nt, Homo sapiens
caggccucucucugcuccau

SEQ ID NO: 1561578 - RNA, 22 nt, Homo sapiens
caggccucuuggcagucacauc

SEQ ID NO: 1561579 - RNA, 14 nt, Homo sapiens
caggccugaacuca

SEQ ID NO: 1561580 - RNA, 21 nt, Homo sapiens
caggccugaacucaccauaga

SEQ ID NO: 1561581 - RNA, 19 nt, Homo sapiens
caggccuggccucaucuca

SEQ ID NO: 1561582 - RNA, 20 nt, Homo sapiens
caggcgccuauaaucccagc

SEQ ID NO: 1561583 - RNA, 20 nt, Homo sapiens
caggcgugagccaccgcgcc

SEQ ID NO: 1561584 - RNA, 17 nt, Homo sapiens
caggcuacugucagcuc

SEQ ID NO: 1561585 - RNA, 16 nt, Homo sapiens
caggcuagagugcaau

SEQ ID NO: 1561586 - RNA, 16 nt, Homo sapiens
caggcucaaccuucca

SEQ ID NO: 1561587 - RNA, 16 nt, Homo sapiens
caggcuggagugcagu

SEQ ID NO: 1561588 - RNA, 20 nt, Homo sapiens
caggcugggccauguccaaa

SEQ ID NO: 1561589 - RNA, 23 nt, Homo sapiens
caggcugggccauguccaaagag

SEQ ID NO: 1561590 - RNA, 13 nt, Homo sapiens
caggcuggucuca

SEQ ID NO: 1561591 - RNA, 15 nt, Homo sapiens
caggcugguuugcaa

SEQ ID NO: 1561592 - RNA, 16 nt, Homo sapiens
caggcugguuugcaag

SEQ ID NO: 1561593 - RNA, 15 nt, Homo sapiens
caggcuugugcaaca

SEQ ID NO: 1561594 - RNA, 15 nt, Homo sapiens
cagggaauucuuaca

SEQ ID NO: 1561595 - RNA, 13 nt, Homo sapiens
cagggagacaucu

SEQ ID NO: 1561596 - RNA, 19 nt, Homo sapiens
cagggagccuucugccacc

SEQ ID NO: 1561597 - RNA, 15 nt, Homo sapiens
cagggaguccagggu

SEQ ID NO: 1561598 - RNA, 22 nt, Homo sapiens
cagggaguccaggguuucucug

SEQ ID NO: 1561599 - RNA, 19 nt, Homo sapiens
cagggagugcacauaucca

SEQ ID NO: 1561600 - RNA, 17 nt, Homo sapiens
cagggaugacaaccugg

SEQ ID NO: 1561601 - RNA, 15 nt, Homo sapiens
cagggaugcugccaa

SEQ ID NO: 1561602 - RNA, 21 nt, Homo sapiens
cagggcagaugaugcuuugag

SEQ ID NO: 1561603 - RNA, 20 nt, Homo sapiens
cagggccaauggccugguga

SEQ ID NO: 1561604 - RNA, 15 nt, Homo sapiens
cagggccacauagau

SEQ ID NO: 1561605 - RNA, 19 nt, Homo sapiens
cagggccaccauugucuca

SEQ ID NO: 1561606 - RNA, 14 nt, Homo sapiens
cagggccacuggaa

SEQ ID NO: 1561607 - RNA, 14 nt, Homo sapiens
cagggccguugccc

SEQ ID NO: 1561608 - RNA, 14 nt, Homo sapiens
cagggccucaggca

SEQ ID NO: 1561609 - RNA, 18 nt, Homo sapiens
cagggccugacuugagcc

SEQ ID NO: 1561610 - RNA, 18 nt, Homo sapiens
cagggccuggagccccau

SEQ ID NO: 1561611 - RNA, 14 nt, Homo sapiens
cagggcugcucccc

SEQ ID NO: 1561612 - RNA, 22 nt, Homo sapiens
cagggcuuccucaaauacaugc

SEQ ID NO: 1561613 - RNA, 13 nt, Homo sapiens
cagggcuugucac

SEQ ID NO: 1561614 - RNA, 23 nt, Homo sapiens
caggggaaggcccugaggcggag

SEQ ID NO: 1561615 - RNA, 20 nt, Homo sapiens
caggggauucuguguuuuca

SEQ ID NO: 1561616 - RNA, 17 nt, Homo sapiens
caggggcuccccgcaga

SEQ ID NO: 1561617 - RNA, 14 nt, Homo sapiens
cagggguacauucu

SEQ ID NO: 1561618 - RNA, 22 nt, Homo sapiens
caggggugcacaauaaaggggg

SEQ ID NO: 1561619 - RNA, 18 nt, Homo sapiens
caggggugcuccugugcu

SEQ ID NO: 1561620 - RNA, 22 nt, Homo sapiens
caggggugcuccugugcucacc

SEQ ID NO: 1561621 - RNA, 23 nt, Homo sapiens
cagggguggggguggaggcuucc

SEQ ID NO: 1561622 - RNA, 20 nt, Homo sapiens
caggguccucuucugggccu

SEQ ID NO: 1561623 - RNA, 17 nt, Homo sapiens
cagggucuugcucuguc

SEQ ID NO: 1561624 - RNA, 15 nt, Homo sapiens
caggguuaucugcaa

SEQ ID NO: 1561625 - RNA, 18 nt, Homo sapiens
caggguuggcaugacugu

SEQ ID NO: 1561626 - RNA, 20 nt, Homo sapiens
caggguuucaccauguugcc

SEQ ID NO: 1561627 - RNA, 16 nt, Homo sapiens
cagguaaaacagggcc

SEQ ID NO: 1561628 - RNA, 20 nt, Homo sapiens
cagguaauaaaagcuuugac

SEQ ID NO: 1561629 - RNA, 14 nt, Homo sapiens
cagguaaugugaau

SEQ ID NO: 1561630 - RNA, 18 nt, Homo sapiens
caggucaaguuuuuuaua

SEQ ID NO: 1561631 - RNA, 21 nt, Homo sapiens
cagguccguuuccuuacacau

SEQ ID NO: 1561632 - RNA, 19 nt, Homo sapiens
cagguccugugcuaucaca

SEQ ID NO: 1561633 - RNA, 16 nt, Homo sapiens
caggucuccaccugca

SEQ ID NO: 1561634 - RNA, 17 nt, Homo sapiens
caggugaaaaggguaca

SEQ ID NO: 1561635 - RNA, 12 nt, Homo sapiens
caggugagcugg

SEQ ID NO: 1561636 - RNA, 14 nt, Homo sapiens
caggugaugccauu

SEQ ID NO: 1561637 - RNA, 19 nt, Homo sapiens
caucuccccucagauucca

SEQ ID NO: 1561638 - RNA, 20 nt, Homo sapiens
caucuccgccuccacacuga

SEQ ID NO: 1561639 - RNA, 14 nt, Homo sapiens
caucuccuugauca

SEQ ID NO: 1561640 - RNA, 13 nt, Homo sapiens
caucucugucaca

SEQ ID NO: 1561641 - RNA, 18 nt, Homo sapiens
caucucuuccccagagag

SEQ ID NO: 1561642 - RNA, 11 nt, Homo sapiens
caucugcaaua

SEQ ID NO: 1561643 - RNA, 18 nt, Homo sapiens
caucugcuccuguucaca

SEQ ID NO: 1561644 - RNA, 16 nt, Homo sapiens
caucuggcucagcaua

SEQ ID NO: 1561645 - RNA, 14 nt, Homo sapiens
caucuggggcaccu

SEQ ID NO: 1561646 - RNA, 21 nt, Homo sapiens
caucuguugacaaaugacaga

SEQ ID NO: 1561647 - RNA, 14 nt, Homo sapiens
caucuugaguauuu

SEQ ID NO: 1561648 - RNA, 11 nt, Homo sapiens
caucuuuacaa

SEQ ID NO: 1561649 - RNA, 13 nt, Homo sapiens
caucuuuucaagg

SEQ ID NO: 1561650 - RNA, 17 nt, Homo sapiens
caucuuuucacaacuua

SEQ ID NO: 1561651 - RNA, 18 nt, Homo sapiens
caucuuuuuuucuaugaa

SEQ ID NO: 1561652 - RNA, 16 nt, Homo sapiens
caugaagauucuuucc

SEQ ID NO: 1561653 - RNA, 19 nt, Homo sapiens
caugaagcacaucaauuac

SEQ ID NO: 1561654 - RNA, 16 nt, Homo sapiens
caugaauaacauuuaa

SEQ ID NO: 1561655 - RNA, 21 nt, Homo sapiens
caugacauccagagaugacua

SEQ ID NO: 1561656 - RNA, 19 nt, Homo sapiens
caugacauucuuagcugua

SEQ ID NO: 1561657 - RNA, 23 nt, Homo sapiens
caugaccaaaugcuuuuccucaa

SEQ ID NO: 1561658 - RNA, 18 nt, Homo sapiens
caugacgacaaagcugcu

SEQ ID NO: 1561659 - RNA, 15 nt, Homo sapiens
caugacggguuguga

SEQ ID NO: 1561660 - RNA, 18 nt, Homo sapiens
caugacgguguccaugcc

SEQ ID NO: 1561661 - RNA, 17 nt, Homo sapiens
caugaguuggcugggaa

SEQ ID NO: 1561662 - RNA, 14 nt, Homo sapiens
caugaucaucacaa

SEQ ID NO: 1561663 - RNA, 18 nt, Homo sapiens
caugaucaucacaaucau

SEQ ID NO: 1561664 - RNA, 18 nt, Homo sapiens
caugauuaacaaagcaac

SEQ ID NO: 1561665 - RNA, 17 nt, Homo sapiens
caugauuuccuugaaug

SEQ ID NO: 1561666 - RNA, 22 nt, Homo sapiens
caugcaaauaaauuaugcaauu

SEQ ID NO: 1561667 - RNA, 15 nt, Homo sapiens
caugcaaauugugaa

SEQ ID NO: 1561668 - RNA, 10 nt, Homo sapiens
caugcaauaa

SEQ ID NO: 1561669 - RNA, 16 nt, Homo sapiens
caugcaauacauacca

SEQ ID NO: 1561670 - RNA, 15 nt, Homo sapiens
caugcacagucauac

SEQ ID NO: 1561671 - RNA, 22 nt, Homo sapiens
caugcauaucauuaaacaaaua

SEQ ID NO: 1561672 - RNA, 18 nt, Homo sapiens
caugcaugucugccuaug

SEQ ID NO: 1561673 - RNA, 20 nt, Homo sapiens
caugcauguucuccucuauc

SEQ ID NO: 1561674 - RNA, 19 nt, Homo sapiens
caugccauugaaacuaaga

SEQ ID NO: 1561675 - RNA, 17 nt, Homo sapiens
caugcccuguaccugug

SEQ ID NO: 1561676 - RNA, 12 nt, Homo sapiens
caugcccugugu

SEQ ID NO: 1561677 - RNA, 16 nt, Homo sapiens
caugcccuguguggcu

SEQ ID NO: 1561678 - RNA, 23 nt, Homo sapiens
caugccuggagacauaucacuca

SEQ ID NO: 1561679 - RNA, 22 nt, Homo sapiens
caugccuguaaucucagcacuu

SEQ ID NO: 1561680 - RNA, 23 nt, Homo sapiens
caugcgaacauaaaugucuguau

SEQ ID NO: 1561681 - RNA, 14 nt, Homo sapiens
caugcucaaugaaa

SEQ ID NO: 1561682 - RNA, 15 nt, Homo sapiens
caugcucaccaagga

SEQ ID NO: 1561683 - RNA, 21 nt, Homo sapiens
caugcucagcacauauuugca

SEQ ID NO: 1561684 - RNA, 16 nt, Homo sapiens
caugcucaggagccac

SEQ ID NO: 1561685 - RNA, 22 nt, Homo sapiens
caugcucaggcuacuauagguc

SEQ ID NO: 1561686 - RNA, 13 nt, Homo sapiens
caugcucucucac

SEQ ID NO: 1561687 - RNA, 20 nt, Homo sapiens
caugcuggaaccugcaaaaa

SEQ ID NO: 1561688 - RNA, 22 nt, Homo sapiens
caugcuuaauaaacaugucaca

SEQ ID NO: 1561689 - RNA, 23 nt, Homo sapiens
caugcuuaauaaacaugucacaa

SEQ ID NO: 1561690 - RNA, 14 nt, Homo sapiens
caugcuugacauac

SEQ ID NO: 1561691 - RNA, 19 nt, Homo sapiens
caugcuuuagccauacaca

SEQ ID NO: 1561692 - RNA, 14 nt, Homo sapiens
cauggaaacaacuu

SEQ ID NO: 1561693 - RNA, 15 nt, Homo sapiens
cauggaaacaacuuc

SEQ ID NO: 1561694 - RNA, 19 nt, Homo sapiens
cauggaagaaaaggauuuu

SEQ ID NO: 1561695 - RNA, 17 nt, Homo sapiens
cauggagauguaaaaug

SEQ ID NO: 1561696 - RNA, 13 nt, Homo sapiens
cauggagcuauaa

SEQ ID NO: 1561697 - RNA, 18 nt, Homo sapiens
cauggaggccaagaacuu

SEQ ID NO: 1561698 - RNA, 21 nt, Homo sapiens
cauggcagaaggcaaacccau

SEQ ID NO: 1561699 - RNA, 12 nt, Homo sapiens
cauggcaucaga

SEQ ID NO: 1561700 - RNA, 23 nt, Homo sapiens
cauggcucuggcacaguguaauc

SEQ ID NO: 1561701 - RNA, 15 nt, Homo sapiens
caugggagcagucca

SEQ ID NO: 1561702 - RNA, 13 nt, Homo sapiens
caugggcucugac

SEQ ID NO: 1561703 - RNA, 20 nt, Homo sapiens
caugguacuuccucugugaa

SEQ ID NO: 1561704 - RNA, 17 nt, Homo sapiens
caugguggguccauggg

SEQ ID NO: 1561705 - RNA, 23 nt, Homo sapiens
caugguguaaauauuagugcagu

SEQ ID NO: 1561706 - RNA, 17 nt, Homo sapiens
cauguaaacugugcacc

SEQ ID NO: 1561707 - RNA, 16 nt, Homo sapiens
cauguaaauugcaaau

SEQ ID NO: 1561708 - RNA, 14 nt, Homo sapiens
cauguaaccacugc

SEQ ID NO: 1561709 - RNA, 20 nt, Homo sapiens
cauguaaccacugcacuuuc

SEQ ID NO: 1561710 - RNA, 18 nt, Homo sapiens
cauguaaggcuuaacaca

SEQ ID NO: 1561711 - RNA, 20 nt, Homo sapiens
cauguacucaaguaccacca

SEQ ID NO: 1561712 - RNA, 20 nt, Homo sapiens
cauguauaucuaacuucgaa

SEQ ID NO: 1561713 - RNA, 18 nt, Homo sapiens
cauguauguauauaauca

SEQ ID NO: 1561714 - RNA, 14 nt, Homo sapiens
caugucacaauaca

SEQ ID NO: 1561715 - RNA, 20 nt, Homo sapiens
caugucacacaaacugauga

SEQ ID NO: 1561716 - RNA, 20 nt, Homo sapiens
caugucaucaaaaucugcac

SEQ ID NO: 1561717 - RNA, 20 nt, Homo sapiens
cauguccacaaugcacaugu

SEQ ID NO: 1561718 - RNA, 18 nt, Homo sapiens
caugucccacccucccua

SEQ ID NO: 1561719 - RNA, 16 nt, Homo sapiens
cauguccuauuacuga

SEQ ID NO: 1561720 - RNA, 21 nt, Homo sapiens
caugucuccuggacucagggu

SEQ ID NO: 1561721 - RNA, 19 nt, Homo sapiens
caugucugccaaaaugcaa

SEQ ID NO: 1561722 - RNA, 20 nt, Homo sapiens
caugucugccuaugcacuga

SEQ ID NO: 1561723 - RNA, 15 nt, Homo sapiens
caugugagauaguuu

SEQ ID NO: 1561724 - RNA, 17 nt, Homo sapiens
caugugccagggcaaug

SEQ ID NO: 1561725 - RNA, 14 nt, Homo sapiens
caugugccucuuug

SEQ ID NO: 1561726 - RNA, 17 nt, Homo sapiens
caugugcuggacacugu

SEQ ID NO: 1561727 - RNA, 20 nt, Homo sapiens
caugugcuggacacugucca

SEQ ID NO: 1561728 - RNA, 23 nt, Homo sapiens
cauguguccccucacucugucag

SEQ ID NO: 1561729 - RNA, 20 nt, Homo sapiens
caugugugugccaagcccug

SEQ ID NO: 1561730 - RNA, 11 nt, Homo sapiens
cauguguuucu

SEQ ID NO: 1561731 - RNA, 19 nt, Homo sapiens
cauguuacuaagcaggcca

SEQ ID NO: 1561732 - RNA, 18 nt, Homo sapiens
cauguuauuuauaguguu

SEQ ID NO: 1561733 - RNA, 22 nt, Homo sapiens
cauguucagaaaagaagugaag

SEQ ID NO: 1561734 - RNA, 15 nt, Homo sapiens
cauguucucccaaau

SEQ ID NO: 1561735 - RNA, 15 nt, Homo sapiens
cauguucuccucuau

SEQ ID NO: 1561736 - RNA, 22 nt, Homo sapiens
cauguuggccaggcuggucuca

SEQ ID NO: 1561737 - RNA, 16 nt, Homo sapiens
cauguugguugcacuu

SEQ ID NO: 1561738 - RNA, 15 nt, Homo sapiens
cauguuuacaggggu

SEQ ID NO: 1561739 - RNA, 15 nt, Homo sapiens
cauguuugcaccugu

SEQ ID NO: 1561740 - RNA, 19 nt, Homo sapiens
cauguuugcaccugugcau

SEQ ID NO: 1561741 - RNA, 17 nt, Homo sapiens
cauguuugcacuuggca

SEQ ID NO: 1561742 - RNA, 16 nt, Homo sapiens
cauuaaagagccaguu

SEQ ID NO: 1561743 - RNA, 21 nt, Homo sapiens
cauuaauagcugccuucaagg

SEQ ID NO: 1561744 - RNA, 19 nt, Homo sapiens
cauuaauccacauguuuca

SEQ ID NO: 1561745 - RNA, 19 nt, Homo sapiens
cauuaauuuaaaugauuua

SEQ ID NO: 1561746 - RNA, 20 nt, Homo sapiens
cauuacuccuucagcucugg

SEQ ID NO: 1561747 - RNA, 23 nt, Homo sapiens
cauuaguuguuagugauggagcu

SEQ ID NO: 1561748 - RNA, 14 nt, Homo sapiens
cauuauaugcacua

SEQ ID NO: 1561749 - RNA, 20 nt, Homo sapiens
cauuaucagccugugccacg

SEQ ID NO: 1561750 - RNA, 22 nt, Homo sapiens
cauuauccuuuuaucucacaaa

SEQ ID NO: 1561751 - RNA, 18 nt, Homo sapiens
cauuaucuuugcuguuau

SEQ ID NO: 1561752 - RNA, 16 nt, Homo sapiens
cauuaugagaggcaau

SEQ ID NO: 1561753 - RNA, 17 nt, Homo sapiens
cauuaugcaaauggaga

SEQ ID NO: 1561754 - RNA, 15 nt, Homo sapiens
cauuauuacuuuucc

SEQ ID NO: 1561755 - RNA, 17 nt, Homo sapiens
ccaucgcaggaugacag

SEQ ID NO: 1561756 - RNA, 21 nt, Homo sapiens
ccaucuaaugcuuguuuauga

SEQ ID NO: 1561757 - RNA, 14 nt, Homo sapiens
ccaucuagucacaa

SEQ ID NO: 1561758 - RNA, 15 nt, Homo sapiens
ccaucuucuuuauac

SEQ ID NO: 1561759 - RNA, 19 nt, Homo sapiens
ccaugaaccaagaccauug

SEQ ID NO: 1561760 - RNA, 19 nt, Homo sapiens
ccaugagggagaugccaug

SEQ ID NO: 1561761 - RNA, 19 nt, Homo sapiens
ccaugaguuaucaugaauu

SEQ ID NO: 1561762 - RNA, 21 nt, Homo sapiens
ccaugccaggaaccuguccua

SEQ ID NO: 1561763 - RNA, 21 nt, Homo sapiens
ccauggggcugauuguauuua

SEQ ID NO: 1561764 - RNA, 21 nt, Homo sapiens
ccauggugaaaggguuugaua

SEQ ID NO: 1561765 - RNA, 21 nt, Homo sapiens
ccauguacauaauucuugcua

SEQ ID NO: 1561766 - RNA, 14 nt, Homo sapiens
ccauguccaaagag

SEQ ID NO: 1561767 - RNA, 12 nt, Homo sapiens
ccaugugccuuu

SEQ ID NO: 1561768 - RNA, 19 nt, Homo sapiens
ccauguggcagaagggaua

SEQ ID NO: 1561769 - RNA, 20 nt, Homo sapiens
ccauguugcacuguuugcau

SEQ ID NO: 1561770 - RNA, 15 nt, Homo sapiens
ccauuaaagagccag

SEQ ID NO: 1561771 - RNA, 12 nt, Homo sapiens
ccauuaccaaaa

SEQ ID NO: 1561772 - RNA, 21 nt, Homo sapiens
ccauuagcccuucaccaucua

SEQ ID NO: 1561773 - RNA, 12 nt, Homo sapiens
ccauuauacuuu

SEQ ID NO: 1561774 - RNA, 22 nt, Homo sapiens
ccauucacaauaaaagcuuaaa

SEQ ID NO: 1561775 - RNA, 15 nt, Homo sapiens
ccauucagagacugu

SEQ ID NO: 1561776 - RNA, 16 nt, Homo sapiens
ccauuccaaagcuuua

SEQ ID NO: 1561777 - RNA, 12 nt, Homo sapiens
ccauuccaaagu

SEQ ID NO: 1561778 - RNA, 18 nt, Homo sapiens
ccauuccucagcuucuuc

SEQ ID NO: 1561779 - RNA, 14 nt, Homo sapiens
ccauuccuucacau

SEQ ID NO: 1561780 - RNA, 17 nt, Homo sapiens
ccauugccuagcucuuu

SEQ ID NO: 1561781 - RNA, 15 nt, Homo sapiens
ccauuggauuacuuu

SEQ ID NO: 1561782 - RNA, 23 nt, Homo sapiens
ccauugucucaauucaaauccau

SEQ ID NO: 1561783 - RNA, 13 nt, Homo sapiens
ccauugugaagca

SEQ ID NO: 1561784 - RNA, 14 nt, Homo sapiens
ccauuguggucaca

SEQ ID NO: 1561785 - RNA, 14 nt, Homo sapiens
ccauuuaacauugu

SEQ ID NO: 1561786 - RNA, 14 nt, Homo sapiens
ccauuuaaguaucu

SEQ ID NO: 1561787 - RNA, 12 nt, Homo sapiens
ccauuuacacuu

SEQ ID NO: 1561788 - RNA, 22 nt, Homo sapiens
ccauuuacacuuuugagacuuu

SEQ ID NO: 1561789 - RNA, 21 nt, Homo sapiens
ccauuuagcgaacaaccacag

SEQ ID NO: 1561790 - RNA, 19 nt, Homo sapiens
ccauuucugaacuguuaca

SEQ ID NO: 1561791 - RNA, 12 nt, Homo sapiens
ccauuucugggg

SEQ ID NO: 1561792 - RNA, 21 nt, Homo sapiens
ccauuuggcaaugccaucauc

SEQ ID NO: 1561793 - RNA, 16 nt, Homo sapiens
ccauuuucauucuguu

SEQ ID NO: 1561794 - RNA, 16 nt, Homo sapiens
ccauuuugaugguguc

SEQ ID NO: 1561795 - RNA, 20 nt, Homo sapiens
ccauuuuuacauccaugaaa

SEQ ID NO: 1561796 - RNA, 17 nt, Homo sapiens
ccauuuuucaaagcaau

SEQ ID NO: 1561797 - RNA, 23 nt, Homo sapiens
ccauuuuuuuuaccucacaccca

SEQ ID NO: 1561798 - RNA, 20 nt, Homo sapiens
cccaaacccuuaacugacau

SEQ ID NO: 1561799 - RNA, 18 nt, Homo sapiens
cccaaacuggagugcagu

SEQ ID NO: 1561800 - RNA, 20 nt, Homo sapiens
cccaaagcucagacuugcca

SEQ ID NO: 1561801 - RNA, 15 nt, Homo sapiens
cccaaagcucugaau

SEQ ID NO: 1561802 - RNA, 15 nt, Homo sapiens
cccaacccaaugggc

SEQ ID NO: 1561803 - RNA, 13 nt, Homo sapiens
cccaacccauuca

SEQ ID NO: 1561804 - RNA, 22 nt, Homo sapiens
cccaaccgcgggggcugugagc

SEQ ID NO: 1561805 - RNA, 17 nt, Homo sapiens
cccaacugaccugccag

SEQ ID NO: 1561806 - RNA, 22 nt, Homo sapiens
cccaagccugauacuuuagcca

SEQ ID NO: 1561807 - RNA, 18 nt, Homo sapiens
cccaaggugcugauguca

SEQ ID NO: 1561808 - RNA, 16 nt, Homo sapiens
cccaauaaagccuuuu

SEQ ID NO: 1561809 - RNA, 15 nt, Homo sapiens
cccaauccccagacu

SEQ ID NO: 1561810 - RNA, 21 nt, Homo sapiens
cccaauuacagggugacucac

SEQ ID NO: 1561811 - RNA, 23 nt, Homo sapiens
cccacaaaagaaggcucacagau

SEQ ID NO: 1561812 - RNA, 23 nt, Homo sapiens
cccacagcgcucgauggaccuca

SEQ ID NO: 1561813 - RNA, 12 nt, Homo sapiens
cccacaguuuua

SEQ ID NO: 1561814 - RNA, 15 nt, Homo sapiens
cccacaugcaugucu

SEQ ID NO: 1561815 - RNA, 10 nt, Homo sapiens
cccaccacgu

SEQ ID NO: 1561816 - RNA, 12 nt, Homo sapiens
cccaccagugcc

SEQ ID NO: 1561817 - RNA, 17 nt, Homo sapiens
cccacccccuucucugc

SEQ ID NO: 1561818 - RNA, 16 nt, Homo sapiens
cccaccccuaccucua

SEQ ID NO: 1561819 - RNA, 20 nt, Homo sapiens
cccacgcugaccaugcguca

SEQ ID NO: 1561820 - RNA, 19 nt, Homo sapiens
cccacggcaccucggggac

SEQ ID NO: 1561821 - RNA, 21 nt, Homo sapiens
cccacuagaagcaacuaggaa

SEQ ID NO: 1561822 - RNA, 17 nt, Homo sapiens
cccacugaaccuucuga

SEQ ID NO: 1561823 - RNA, 15 nt, Homo sapiens
cccacugaggggcca

SEQ ID NO: 1561824 - RNA, 14 nt, Homo sapiens
cccacuuggcauca

SEQ ID NO: 1561825 - RNA, 18 nt, Homo sapiens
cccagaagaagauggcug

SEQ ID NO: 1561826 - RNA, 18 nt, Homo sapiens
cccagaaugagacaucca

SEQ ID NO: 1561827 - RNA, 21 nt, Homo sapiens
cccagacaccaugugcaauaa

SEQ ID NO: 1561828 - RNA, 13 nt, Homo sapiens
cccagacacuggc

SEQ ID NO: 1561829 - RNA, 19 nt, Homo sapiens
cccagacugaugagcacau

SEQ ID NO: 1561830 - RNA, 15 nt, Homo sapiens
cccagagagagcucu

SEQ ID NO: 1561831 - RNA, 22 nt, Homo sapiens
cccagaggagccaccaguucuc

SEQ ID NO: 1561832 - RNA, 23 nt, Homo sapiens
cccagagugagcuuuagcucucu

SEQ ID NO: 1561833 - RNA, 22 nt, Homo sapiens
cccagauuggcucacacugaga

SEQ ID NO: 1561834 - RNA, 20 nt, Homo sapiens
cccagcaaagucugcaucug

SEQ ID NO: 1561835 - RNA, 11 nt, Homo sapiens
cccagcacugc

SEQ ID NO: 1561836 - RNA, 13 nt, Homo sapiens
cccagcacuuuga

SEQ ID NO: 1561837 - RNA, 23 nt, Homo sapiens
cccagcagaggcaggcugggacg

SEQ ID NO: 1561838 - RNA, 16 nt, Homo sapiens
cccagcauuccagcuc

SEQ ID NO: 1561839 - RNA, 11 nt, Homo sapiens
cccagccacag

SEQ ID NO: 1561840 - RNA, 18 nt, Homo sapiens
cccagccccaaagacagc

SEQ ID NO: 1561841 - RNA, 14 nt, Homo sapiens
cccagccccuucca

SEQ ID NO: 1561842 - RNA, 21 nt, Homo sapiens
cccagccuggaaaccuacaga

SEQ ID NO: 1561843 - RNA, 21 nt, Homo sapiens
cccagcuccuuucaugcucca

SEQ ID NO: 1561844 - RNA, 13 nt, Homo sapiens
cccagcugugcug

SEQ ID NO: 1561845 - RNA, 15 nt, Homo sapiens
cccagcugugcugug

SEQ ID NO: 1561846 - RNA, 22 nt, Homo sapiens
cccaggacgccacucauuucau

SEQ ID NO: 1561847 - RNA, 14 nt, Homo sapiens
cccaggagacagac

SEQ ID NO: 1561848 - RNA, 17 nt, Homo sapiens
cccaggagccucacugg

SEQ ID NO: 1561849 - RNA, 20 nt, Homo sapiens
cccaggaggcagcucaggau

SEQ ID NO: 1561850 - RNA, 19 nt, Homo sapiens
cccaggccacagagaaccu

SEQ ID NO: 1561851 - RNA, 19 nt, Homo sapiens
cccaggccccagacagggu

SEQ ID NO: 1561852 - RNA, 16 nt, Homo sapiens
cccaggccgacccaag

SEQ ID NO: 1561853 - RNA, 19 nt, Homo sapiens
cccaggcuagagugcaaug

SEQ ID NO: 1561854 - RNA, 17 nt, Homo sapiens
cccaggcuggagugcag

SEQ ID NO: 1561855 - RNA, 19 nt, Homo sapiens
cccaggcuggagugcagug

SEQ ID NO: 1561856 - RNA, 22 nt, Homo sapiens
cccaggguuggcaugacugucu

SEQ ID NO: 1561857 - RNA, 18 nt, Homo sapiens
cccaggugcaggugcuga

SEQ ID NO: 1561858 - RNA, 14 nt, Homo sapiens
cccaguccaagacc

SEQ ID NO: 1561859 - RNA, 23 nt, Homo sapiens
cccaguccaagaccccaaaucac

SEQ ID NO: 1561860 - RNA, 13 nt, Homo sapiens
cccaguccacuga

SEQ ID NO: 1561861 - RNA, 19 nt, Homo sapiens
cccagucccagacaauucc

SEQ ID NO: 1561862 - RNA, 15 nt, Homo sapiens
cccagucccauuccu

SEQ ID NO: 1561863 - RNA, 22 nt, Homo sapiens
cccagugcuucuccaacacuga

SEQ ID NO: 1561864 - RNA, 13 nt, Homo sapiens
cccaguucagugu

SEQ ID NO: 1561865 - RNA, 23 nt, Homo sapiens
cccaguuccacagcagugucaca

SEQ ID NO: 1561866 - RNA, 19 nt, Homo sapiens
cccaguuuccuggggcaca

SEQ ID NO: 1561867 - RNA, 15 nt, Homo sapiens
cccauagauacucuc

SEQ ID NO: 1561868 - RNA, 20 nt, Homo sapiens
cccaucagacugucaagaag

SEQ ID NO: 1561869 - RNA, 14 nt, Homo sapiens
cccaucagcacucu

SEQ ID NO: 1561870 - RNA, 20 nt, Homo sapiens
cccaucagugcucuguaaaa

SEQ ID NO: 1561871 - RNA, 17 nt, Homo sapiens
cccaucuaaaacucaua

SEQ ID NO: 1561872 - RNA, 16 nt, Homo sapiens
cccaucuuuacaaaga

SEQ ID NO: 1561873 - RNA, 18 nt, Homo sapiens
cuggcacuuagcccaaga

SEQ ID NO: 1561874 - RNA, 15 nt, Homo sapiens
cuggcagggcgccaa

SEQ ID NO: 1561875 - RNA, 12 nt, Homo sapiens
cuggcaguacug

SEQ ID NO: 1561876 - RNA, 16 nt, Homo sapiens
cuggccagcacccucu

SEQ ID NO: 1561877 - RNA, 13 nt, Homo sapiens
cuggccagcauuu

SEQ ID NO: 1561878 - RNA, 15 nt, Homo sapiens
cuggcccacccaguc

SEQ ID NO: 1561879 - RNA, 17 nt, Homo sapiens
cuggcccugugccuugg

SEQ ID NO: 1561880 - RNA, 13 nt, Homo sapiens
cuggcccuugcaa

SEQ ID NO: 1561881 - RNA, 15 nt, Homo sapiens
cuggcgccucugcaa

SEQ ID NO: 1561882 - RNA, 20 nt, Homo sapiens
cuggcuccagagauggucac

SEQ ID NO: 1561883 - RNA, 14 nt, Homo sapiens
cuggcugagguucc

SEQ ID NO: 1561884 - RNA, 15 nt, Homo sapiens
cuggcuggaaaaagg

SEQ ID NO: 1561885 - RNA, 18 nt, Homo sapiens
cuggcuggaaaaagguga

SEQ ID NO: 1561886 - RNA, 15 nt, Homo sapiens
cuggcuguccuacca

SEQ ID NO: 1561887 - RNA, 20 nt, Homo sapiens
cuggcuguggccuaaccugc

SEQ ID NO: 1561888 - RNA, 20 nt, Homo sapiens
cugggaaugacaacaccugg

SEQ ID NO: 1561889 - RNA, 18 nt, Homo sapiens
cugggacaccauuaccaa

SEQ ID NO: 1561890 - RNA, 20 nt, Homo sapiens
cugggacccuuggcuaugaa

SEQ ID NO: 1561891 - RNA, 15 nt, Homo sapiens
cugggaccuccuuag

SEQ ID NO: 1561892 - RNA, 12 nt, Homo sapiens
cugggacugugc

SEQ ID NO: 1561893 - RNA, 22 nt, Homo sapiens
cugggagacccugaacucagaa

SEQ ID NO: 1561894 - RNA, 16 nt, Homo sapiens
cugggagcacuggugu

SEQ ID NO: 1561895 - RNA, 22 nt, Homo sapiens
cugggagcagcucugugacucc

SEQ ID NO: 1561896 - RNA, 13 nt, Homo sapiens
cugggaugccugu

SEQ ID NO: 1561897 - RNA, 21 nt, Homo sapiens
cugggaugugaagucucuggg

SEQ ID NO: 1561898 - RNA, 23 nt, Homo sapiens
cugggauuacagguguaagccac

SEQ ID NO: 1561899 - RNA, 14 nt, Homo sapiens
cugggcacagucag

SEQ ID NO: 1561900 - RNA, 15 nt, Homo sapiens
cugggccacugggga

SEQ ID NO: 1561901 - RNA, 15 nt, Homo sapiens
cugggccauguccaa

SEQ ID NO: 1561902 - RNA, 16 nt, Homo sapiens
cugggccauguccaaa

SEQ ID NO: 1561903 - RNA, 17 nt, Homo sapiens
cugggccauguccaaag

SEQ ID NO: 1561904 - RNA, 16 nt, Homo sapiens
cugggcccaagacaga

SEQ ID NO: 1561905 - RNA, 22 nt, Homo sapiens
cugggcccgagccugaacugag

SEQ ID NO: 1561906 - RNA, 15 nt, Homo sapiens
cugggccucaguuca

SEQ ID NO: 1561907 - RNA, 21 nt, Homo sapiens
cugggcugucugucaccagcu

SEQ ID NO: 1561908 - RNA, 17 nt, Homo sapiens
cuggggaagagguuuua

SEQ ID NO: 1561909 - RNA, 21 nt, Homo sapiens
cuggggacguugcugagccag

SEQ ID NO: 1561910 - RNA, 15 nt, Homo sapiens
cuggggacucaggga

SEQ ID NO: 1561911 - RNA, 17 nt, Homo sapiens
cuggggagcccacugag

SEQ ID NO: 1561912 - RNA, 18 nt, Homo sapiens
cuggggagcccaguccac

SEQ ID NO: 1561913 - RNA, 21 nt, Homo sapiens
cuggggaucuucccacaggag

SEQ ID NO: 1561914 - RNA, 19 nt, Homo sapiens
cuggggaugucucucauga

SEQ ID NO: 1561915 - RNA, 18 nt, Homo sapiens
cuggggcaggucacuuua

SEQ ID NO: 1561916 - RNA, 14 nt, Homo sapiens
cuggggccccaucu

SEQ ID NO: 1561917 - RNA, 19 nt, Homo sapiens
cugggggaggaacagggcu

SEQ ID NO: 1561918 - RNA, 22 nt, Homo sapiens
cugggggcugccgagccaccau

SEQ ID NO: 1561919 - RNA, 20 nt, Homo sapiens
cuggguaagaagaaagcaaa

SEQ ID NO: 1561920 - RNA, 23 nt, Homo sapiens
cuggguacugaaagccuuaggga

SEQ ID NO: 1561921 - RNA, 15 nt, Homo sapiens
cugggugagggcuau

SEQ ID NO: 1561922 - RNA, 21 nt, Homo sapiens
cugggugauggaaacugccaa

SEQ ID NO: 1561923 - RNA, 16 nt, Homo sapiens
cugggugcaucaaaca

SEQ ID NO: 1561924 - RNA, 17 nt, Homo sapiens
cuggguuucuaagcagu

SEQ ID NO: 1561925 - RNA, 18 nt, Homo sapiens
cugguaauaaaugugacu

SEQ ID NO: 1561926 - RNA, 20 nt, Homo sapiens
cugguacugcaggaccucca

SEQ ID NO: 1561927 - RNA, 22 nt, Homo sapiens
cugguacugcaggaccuccagc

SEQ ID NO: 1561928 - RNA, 21 nt, Homo sapiens
cuggucaacauagugagacac

SEQ ID NO: 1561929 - RNA, 16 nt, Homo sapiens
cuggucagcauguacu

SEQ ID NO: 1561930 - RNA, 21 nt, Homo sapiens
cuggucagcauguacuccccu

SEQ ID NO: 1561931 - RNA, 21 nt, Homo sapiens
cuggucccggggccagcacuu

SEQ ID NO: 1561932 - RNA, 22 nt, Homo sapiens
cuggucccggggccagcacuuc

SEQ ID NO: 1561933 - RNA, 18 nt, Homo sapiens
cuggucucuacauaaaau

SEQ ID NO: 1561934 - RNA, 16 nt, Homo sapiens
cuggugacaggccaaa

SEQ ID NO: 1561935 - RNA, 13 nt, Homo sapiens
cuggugcuccugc

SEQ ID NO: 1561936 - RNA, 18 nt, Homo sapiens
cugguggugggccccuga

SEQ ID NO: 1561937 - RNA, 16 nt, Homo sapiens
cugguucaguacuguc

SEQ ID NO: 1561938 - RNA, 16 nt, Homo sapiens
cugguucuaacugcug

SEQ ID NO: 1561939 - RNA, 16 nt, Homo sapiens
cuguaaaacagguuau

SEQ ID NO: 1561940 - RNA, 16 nt, Homo sapiens
cuguaaacuuccaagc

SEQ ID NO: 1561941 - RNA, 21 nt, Homo sapiens
cuguaagaagcggcauagcac

SEQ ID NO: 1561942 - RNA, 22 nt, Homo sapiens
cuguaagaagcggcauagcacc

SEQ ID NO: 1561943 - RNA, 21 nt, Homo sapiens
cuguaauaguuuuauauuguu

SEQ ID NO: 1561944 - RNA, 22 nt, Homo sapiens
cuguaaucaaaaggaggaauuu

SEQ ID NO: 1561945 - RNA, 14 nt, Homo sapiens
cuguaaucacagcu

SEQ ID NO: 1561946 - RNA, 15 nt, Homo sapiens
cuguaaucccaacac

SEQ ID NO: 1561947 - RNA, 23 nt, Homo sapiens
cuguaaucccagcuacuccggga

SEQ ID NO: 1561948 - RNA, 14 nt, Homo sapiens
cuguacacacuuua

SEQ ID NO: 1561949 - RNA, 14 nt, Homo sapiens
cuguacaugcauug

SEQ ID NO: 1561950 - RNA, 12 nt, Homo sapiens
cuguacauucuu

SEQ ID NO: 1561951 - RNA, 12 nt, Homo sapiens
cuguaccaguua

SEQ ID NO: 1561952 - RNA, 17 nt, Homo sapiens
cuguaccgacuuugaua

SEQ ID NO: 1561953 - RNA, 18 nt, Homo sapiens
cuguaccugugcacguug

SEQ ID NO: 1561954 - RNA, 15 nt, Homo sapiens
cuguacuaaggagca

SEQ ID NO: 1561955 - RNA, 22 nt, Homo sapiens
cuguagaaaaaaaaauucacau

SEQ ID NO: 1561956 - RNA, 21 nt, Homo sapiens
cuguagaagaagcccauauca

SEQ ID NO: 1561957 - RNA, 23 nt, Homo sapiens
cuguagaagaagcccauaucaca

SEQ ID NO: 1561958 - RNA, 21 nt, Homo sapiens
cuguagacauuugcuaugagc

SEQ ID NO: 1561959 - RNA, 20 nt, Homo sapiens
cuguagaccaccuaauauca

SEQ ID NO: 1561960 - RNA, 16 nt, Homo sapiens
cuguagaguccuuggc

SEQ ID NO: 1561961 - RNA, 14 nt, Homo sapiens
cuguaggaaccaau

SEQ ID NO: 1561962 - RNA, 14 nt, Homo sapiens
cuguagucccagcu

SEQ ID NO: 1561963 - RNA, 21 nt, Homo sapiens
cuguagucccagcuacuuggg

SEQ ID NO: 1561964 - RNA, 16 nt, Homo sapiens
cuguauauuuguauga

SEQ ID NO: 1561965 - RNA, 16 nt, Homo sapiens
cuguauuaagccacuu

SEQ ID NO: 1561966 - RNA, 21 nt, Homo sapiens
cuguauucuguuugcguacuu

SEQ ID NO: 1561967 - RNA, 14 nt, Homo sapiens
cuguauuucauucu

SEQ ID NO: 1561968 - RNA, 21 nt, Homo sapiens
cuguauuugaaauaagaauuc

SEQ ID NO: 1561969 - RNA, 20 nt, Homo sapiens
cuguauuuuauuggacaggu

SEQ ID NO: 1561970 - RNA, 17 nt, Homo sapiens
cuguauuuugauauaau

SEQ ID NO: 1561971 - RNA, 23 nt, Homo sapiens
cuguauuuugauauaauuguacu

SEQ ID NO: 1561972 - RNA, 12 nt, Homo sapiens
cugucaaugcag

SEQ ID NO: 1561973 - RNA, 23 nt, Homo sapiens
cugucacugaugguggcucuggu

SEQ ID NO: 1561974 - RNA, 13 nt, Homo sapiens
cugucagcugcaa

SEQ ID NO: 1561975 - RNA, 13 nt, Homo sapiens
cugucaugcuuuu

SEQ ID NO: 1561976 - RNA, 14 nt, Homo sapiens
cuguccacacccag

SEQ ID NO: 1561977 - RNA, 14 nt, Homo sapiens
cuguccaugaagca

SEQ ID NO: 1561978 - RNA, 20 nt, Homo sapiens
cuguccaugaagcacugagc

SEQ ID NO: 1561979 - RNA, 21 nt, Homo sapiens
cuguccaugaagcacugagca

SEQ ID NO: 1561980 - RNA, 18 nt, Homo sapiens
cugucccaccccuaccuc

SEQ ID NO: 1561981 - RNA, 17 nt, Homo sapiens
cugucccauucuagauc

SEQ ID NO: 1561982 - RNA, 22 nt, Homo sapiens
cuguccguucacauguguggua

SEQ ID NO: 1561983 - RNA, 21 nt, Homo sapiens
cuguccuaaucauacaccaga

SEQ ID NO: 1561984 - RNA, 15 nt, Homo sapiens
cuguccugcccguga

SEQ ID NO: 1561985 - RNA, 14 nt, Homo sapiens
cuguccuggaggca

SEQ ID NO: 1561986 - RNA, 22 nt, Homo sapiens
cuguccuugaaugccauaguca

SEQ ID NO: 1561987 - RNA, 19 nt, Homo sapiens
cugucuauuuaagugcaau

SEQ ID NO: 1561988 - RNA, 20 nt, Homo sapiens
cugucuauuuaagugcaauu

SEQ ID NO: 1561989 - RNA, 13 nt, Homo sapiens
cugucuccagggc

SEQ ID NO: 1561990 - RNA, 19 nt, Homo sapiens
cugucuccccacucagugg

SEQ ID NO: 1561991 - RNA, 14 nt, Homo sapiens
cuuugcccuaccuu

SEQ ID NO: 1561992 - RNA, 20 nt, Homo sapiens
cuuugccuucucuguucccu

SEQ ID NO: 1561993 - RNA, 17 nt, Homo sapiens
cuuugcugcagucaucu

SEQ ID NO: 1561994 - RNA, 20 nt, Homo sapiens
cuuuggauccugggucaaaa

SEQ ID NO: 1561995 - RNA, 19 nt, Homo sapiens
cuuuggugaccccauacau

SEQ ID NO: 1561996 - RNA, 13 nt, Homo sapiens
cuuuguacugcuu

SEQ ID NO: 1561997 - RNA, 19 nt, Homo sapiens
cuuuguaucauucaucuuc

SEQ ID NO: 1561998 - RNA, 20 nt, Homo sapiens
cuuuguaucuucacugccaa

SEQ ID NO: 1561999 - RNA, 14 nt, Homo sapiens
cuuuguaugacagu

SEQ ID NO: 1562000 - RNA, 21 nt, Homo sapiens
cuuuguccacugucaggguug

SEQ ID NO: 1562001 - RNA, 13 nt, Homo sapiens
cuuugucccagaa

SEQ ID NO: 1562002 - RNA, 15 nt, Homo sapiens
cuuugucuugccccu

SEQ ID NO: 1562003 - RNA, 11 nt, Homo sapiens
cuuugugacca

SEQ ID NO: 1562004 - RNA, 13 nt, Homo sapiens
cuuuguggaccaa

SEQ ID NO: 1562005 - RNA, 20 nt, Homo sapiens
cuuuguugcaagaugugaau

SEQ ID NO: 1562006 - RNA, 16 nt, Homo sapiens
cuuuguuuaaaugcca

SEQ ID NO: 1562007 - RNA, 19 nt, Homo sapiens
cuuuguuuacaugaguuca

SEQ ID NO: 1562008 - RNA, 19 nt, Homo sapiens
cuuuuaaaauaagcauuua

SEQ ID NO: 1562009 - RNA, 16 nt, Homo sapiens
cuuuuaaaauauucua

SEQ ID NO: 1562010 - RNA, 20 nt, Homo sapiens
cuuuuaaaaugguaugccaa

SEQ ID NO: 1562011 - RNA, 22 nt, Homo sapiens
cuuuuaaggcuaaaacuuaaca

SEQ ID NO: 1562012 - RNA, 19 nt, Homo sapiens
cuuuuaauccaauccacua

SEQ ID NO: 1562013 - RNA, 22 nt, Homo sapiens
cuuuuacaagugguuaaaacau

SEQ ID NO: 1562014 - RNA, 21 nt, Homo sapiens
cuuuuagggaauaauauucaa

SEQ ID NO: 1562015 - RNA, 13 nt, Homo sapiens
cuuuuauauucua

SEQ ID NO: 1562016 - RNA, 16 nt, Homo sapiens
cuuuuauggaugauua

SEQ ID NO: 1562017 - RNA, 16 nt, Homo sapiens
cuuuuauuccuuugaa

SEQ ID NO: 1562018 - RNA, 17 nt, Homo sapiens
cuuuuauugacacagaa

SEQ ID NO: 1562019 - RNA, 22 nt, Homo sapiens
cuuuucaagacuuccucaugaa

SEQ ID NO: 1562020 - RNA, 20 nt, Homo sapiens
cuuuucacaugcuaaugugc

SEQ ID NO: 1562021 - RNA, 23 nt, Homo sapiens
cuuuucaccaaaauuucuacacc

SEQ ID NO: 1562022 - RNA, 20 nt, Homo sapiens
cuuuucagaagcaagccaga

SEQ ID NO: 1562023 - RNA, 17 nt, Homo sapiens
cuuuucagugauacuca

SEQ ID NO: 1562024 - RNA, 18 nt, Homo sapiens
cuuuucagugauacucac

SEQ ID NO: 1562025 - RNA, 18 nt, Homo sapiens
cuuuucauuaaagaaugu

SEQ ID NO: 1562026 - RNA, 19 nt, Homo sapiens
cuuuuccacacgcauuaau

SEQ ID NO: 1562027 - RNA, 16 nt, Homo sapiens
cuuuuccccaguccca

SEQ ID NO: 1562028 - RNA, 12 nt, Homo sapiens
cuuuucugccaa

SEQ ID NO: 1562029 - RNA, 13 nt, Homo sapiens
cuuuucugccaaa

SEQ ID NO: 1562030 - RNA, 16 nt, Homo sapiens
cuuuucugucuuacaa

SEQ ID NO: 1562031 - RNA, 17 nt, Homo sapiens
cuuuugacaaaggcaag

SEQ ID NO: 1562032 - RNA, 20 nt, Homo sapiens
cuuuugacacugcucuaaca

SEQ ID NO: 1562033 - RNA, 19 nt, Homo sapiens
cuuuugcagaaaucacaau

SEQ ID NO: 1562034 - RNA, 10 nt, Homo sapiens
cuuuugccau

SEQ ID NO: 1562035 - RNA, 13 nt, Homo sapiens
cuuuugccuuuug

SEQ ID NO: 1562036 - RNA, 16 nt, Homo sapiens
cuuuugcucuucauaa

SEQ ID NO: 1562037 - RNA, 20 nt, Homo sapiens
cuuuugcuucaguugcauau

SEQ ID NO: 1562038 - RNA, 23 nt, Homo sapiens
cuuuugggauguuaccuucacau

SEQ ID NO: 1562039 - RNA, 19 nt, Homo sapiens
cuuuugguaucuacuucua

SEQ ID NO: 1562040 - RNA, 23 nt, Homo sapiens
cuuuugugaauuaggcuguaacu

SEQ ID NO: 1562041 - RNA, 18 nt, Homo sapiens
cuuuugugaugaacauau

SEQ ID NO: 1562042 - RNA, 20 nt, Homo sapiens
cuuuugugugccugguagaa

SEQ ID NO: 1562043 - RNA, 19 nt, Homo sapiens
cuuuuuauucccugcccaa

SEQ ID NO: 1562044 - RNA, 14 nt, Homo sapiens
cuuuuucaaagagg

SEQ ID NO: 1562045 - RNA, 20 nt, Homo sapiens
cuuuuucucuuuccaugaca

SEQ ID NO: 1562046 - RNA, 14 nt, Homo sapiens
cuuuuugacacuga

SEQ ID NO: 1562047 - RNA, 13 nt, Homo sapiens
cuuuuugggacca

SEQ ID NO: 1562048 - RNA, 14 nt, Homo sapiens
cuuuuuuucuguca

SEQ ID NO: 1562049 - RNA, 14 nt, Homo sapiens
gaaaaaaaaauuca

SEQ ID NO: 1562050 - RNA, 22 nt, Homo sapiens
gaaaaaaacugggauaacugau

SEQ ID NO: 1562051 - RNA, 15 nt, Homo sapiens
gaaaaacaaauaaaa

SEQ ID NO: 1562052 - RNA, 11 nt, Homo sapiens
gaaaaaccuug

SEQ ID NO: 1562053 - RNA, 21 nt, Homo sapiens
gaaaaacuaacuagacuaaga

SEQ ID NO: 1562054 - RNA, 15 nt, Homo sapiens
gaaaaacuaaugugu

SEQ ID NO: 1562055 - RNA, 20 nt, Homo sapiens
gaaaaagaccuaugagcaca

SEQ ID NO: 1562056 - RNA, 15 nt, Homo sapiens
gaaaaagccaccuag

SEQ ID NO: 1562057 - RNA, 22 nt, Homo sapiens
gaaaaagcuuaaugauucugau

SEQ ID NO: 1562058 - RNA, 19 nt, Homo sapiens
gaaaaaguucugcagauaa

SEQ ID NO: 1562059 - RNA, 16 nt, Homo sapiens
gaaaaauacaaugggg

SEQ ID NO: 1562060 - RNA, 12 nt, Homo sapiens
gaaaaauacuuu

SEQ ID NO: 1562061 - RNA, 17 nt, Homo sapiens
gaaaaauaucuuggccu

SEQ ID NO: 1562062 - RNA, 14 nt, Homo sapiens
gaaaaaugcuguuu

SEQ ID NO: 1562063 - RNA, 12 nt, Homo sapiens
gaaaaauuacuu

SEQ ID NO: 1562064 - RNA, 20 nt, Homo sapiens
gaaaacaaauauuucacuua

SEQ ID NO: 1562065 - RNA, 16 nt, Homo sapiens
gaaaacacugugcaca

SEQ ID NO: 1562066 - RNA, 19 nt, Homo sapiens
gaaaacacugugcacaucu

SEQ ID NO: 1562067 - RNA, 15 nt, Homo sapiens
gaaaacaucucauca

SEQ ID NO: 1562068 - RNA, 19 nt, Homo sapiens
gaaaaccaaagggugcuag

SEQ ID NO: 1562069 - RNA, 18 nt, Homo sapiens
gaaaacuagcauuacauu

SEQ ID NO: 1562070 - RNA, 19 nt, Homo sapiens
gaaaacuagcauuacauua

SEQ ID NO: 1562071 - RNA, 21 nt, Homo sapiens
gaaaacucaugaucaagauau

SEQ ID NO: 1562072 - RNA, 16 nt, Homo sapiens
gaaaacucccaauaca

SEQ ID NO: 1562073 - RNA, 20 nt, Homo sapiens
gaaaagaaaucagcagacac

SEQ ID NO: 1562074 - RNA, 13 nt, Homo sapiens
gaaaagaaaugca

SEQ ID NO: 1562075 - RNA, 19 nt, Homo sapiens
gaaaagagaauauuuacaa

SEQ ID NO: 1562076 - RNA, 17 nt, Homo sapiens
gaaaagggaacugaaca

SEQ ID NO: 1562077 - RNA, 16 nt, Homo sapiens
gaaaaggugauuguca

SEQ ID NO: 1562078 - RNA, 20 nt, Homo sapiens
gaaaaguccacaagaacaau

SEQ ID NO: 1562079 - RNA, 13 nt, Homo sapiens
gaaaagugaaucu

SEQ ID NO: 1562080 - RNA, 19 nt, Homo sapiens
gaaaaguuauuagugguuu

SEQ ID NO: 1562081 - RNA, 23 nt, Homo sapiens
gaaaaguucuuucaaccuauaca

SEQ ID NO: 1562082 - RNA, 20 nt, Homo sapiens
gaaaauaggaagugaaccca

SEQ ID NO: 1562083 - RNA, 18 nt, Homo sapiens
gaaaauauagacauucuc

SEQ ID NO: 1562084 - RNA, 21 nt, Homo sapiens
gaaaauauuuuguugccuuca

SEQ ID NO: 1562085 - RNA, 20 nt, Homo sapiens
gaaaauccauucauucaauc

SEQ ID NO: 1562086 - RNA, 15 nt, Homo sapiens
gaaaaucuaccaaga

SEQ ID NO: 1562087 - RNA, 15 nt, Homo sapiens
gaaaauggcuuucuc

SEQ ID NO: 1562088 - RNA, 21 nt, Homo sapiens
gaaaauguugagaaucccaaa

SEQ ID NO: 1562089 - RNA, 23 nt, Homo sapiens
gaaaauuauguuccuagaacaaa

SEQ ID NO: 1562090 - RNA, 12 nt, Homo sapiens
gaaaauuuacaa

SEQ ID NO: 1562091 - RNA, 19 nt, Homo sapiens
gaaaauuuuuaaauauuca

SEQ ID NO: 1562092 - RNA, 21 nt, Homo sapiens
gaaacaccagccgaggccaca

SEQ ID NO: 1562093 - RNA, 14 nt, Homo sapiens
gaaacacuuugccu

SEQ ID NO: 1562094 - RNA, 13 nt, Homo sapiens
gaaacagcuucau

SEQ ID NO: 1562095 - RNA, 19 nt, Homo sapiens
gaaacagggaaaaugaagc

SEQ ID NO: 1562096 - RNA, 17 nt, Homo sapiens
gaaacauacguucuuuu

SEQ ID NO: 1562097 - RNA, 14 nt, Homo sapiens
gaaacaucauuuca

SEQ ID NO: 1562098 - RNA, 16 nt, Homo sapiens
gaaacauccguuuuca

SEQ ID NO: 1562099 - RNA, 18 nt, Homo sapiens
gaaaccagaaaagcaaua

SEQ ID NO: 1562100 - RNA, 17 nt, Homo sapiens
gaaacccuauuucccca

SEQ ID NO: 1562101 - RNA, 14 nt, Homo sapiens
gaaaccuacagaca

SEQ ID NO: 1562102 - RNA, 22 nt, Homo sapiens
gaaaccucuuccuaggccacgu

SEQ ID NO: 1562103 - RNA, 19 nt, Homo sapiens
gaaaccuugaaagacauuu

SEQ ID NO: 1562104 - RNA, 15 nt, Homo sapiens
gaaacuacauuucua

SEQ ID NO: 1562105 - RNA, 24 nt, Homo sapiens
gaaacuauuucuguuccagucaca

SEQ ID NO: 1562106 - RNA, 14 nt, Homo sapiens
gaaacuccgucuca

SEQ ID NO: 1562107 - RNA, 16 nt, Homo sapiens
gaaacuccgucucaaa

SEQ ID NO: 1562108 - RNA, 19 nt, Homo sapiens
gaaacugagucacucacau

SEQ ID NO: 1562109 - RNA, 23 nt, Homo sapiens
gacgguaccaauucagugucugu

SEQ ID NO: 1562110 - RNA, 21 nt, Homo sapiens
gacgucacccuccauucugca

SEQ ID NO: 1562111 - RNA, 18 nt, Homo sapiens
gacgugauuuugcuguag

SEQ ID NO: 1562112 - RNA, 18 nt, Homo sapiens
gacuaagccuaccugcuc

SEQ ID NO: 1562113 - RNA, 14 nt, Homo sapiens
gacuaauuucaaaa

SEQ ID NO: 1562114 - RNA, 18 nt, Homo sapiens
gacuacaauaaaaccaaa

SEQ ID NO: 1562115 - RNA, 19 nt, Homo sapiens
gacuacuuggaacuaggcu

SEQ ID NO: 1562116 - RNA, 18 nt, Homo sapiens
gacuagauguaguauuuu

SEQ ID NO: 1562117 - RNA, 14 nt, Homo sapiens
gacuaugaaaagcu

SEQ ID NO: 1562118 - RNA, 22 nt, Homo sapiens
gacuauggauguguucucuagg

SEQ ID NO: 1562119 - RNA, 12 nt, Homo sapiens
gacuauuuccac

SEQ ID NO: 1562120 - RNA, 20 nt, Homo sapiens
gacucaaagggagaggucuc

SEQ ID NO: 1562121 - RNA, 13 nt, Homo sapiens
gacucagccuucc

SEQ ID NO: 1562122 - RNA, 24 nt, Homo sapiens
gacucaggagucugccacuuguca

SEQ ID NO: 1562123 - RNA, 13 nt, Homo sapiens
gacucaguauuau

SEQ ID NO: 1562124 - RNA, 18 nt, Homo sapiens
gacucauggccgggcuga

SEQ ID NO: 1562125 - RNA, 18 nt, Homo sapiens
gacucaugguguguuaca

SEQ ID NO: 1562126 - RNA, 23 nt, Homo sapiens
gacuccaaagaaauguaagggaa

SEQ ID NO: 1562127 - RNA, 13 nt, Homo sapiens
gacuccaguuaaa

SEQ ID NO: 1562128 - RNA, 16 nt, Homo sapiens
gacuccggaggacuga

SEQ ID NO: 1562129 - RNA, 14 nt, Homo sapiens
gacuccuccuuuau

SEQ ID NO: 1562130 - RNA, 16 nt, Homo sapiens
gacuccuggucuguga

SEQ ID NO: 1562131 - RNA, 13 nt, Homo sapiens
gacucgggaccaa

SEQ ID NO: 1562132 - RNA, 12 nt, Homo sapiens
gacucucaggga

SEQ ID NO: 1562133 - RNA, 11 nt, Homo sapiens
gacucucaggu

SEQ ID NO: 1562134 - RNA, 18 nt, Homo sapiens
gacucugagaacuccuca

SEQ ID NO: 1562135 - RNA, 19 nt, Homo sapiens
gacucugagaacuccucau

SEQ ID NO: 1562136 - RNA, 18 nt, Homo sapiens
gacucugauucuacagug

SEQ ID NO: 1562137 - RNA, 20 nt, Homo sapiens
gacucugauucuacagugau

SEQ ID NO: 1562138 - RNA, 21 nt, Homo sapiens
gacucugccauuaaaacauua

SEQ ID NO: 1562139 - RNA, 16 nt, Homo sapiens
gacucugucuaccugg

SEQ ID NO: 1562140 - RNA, 20 nt, Homo sapiens
gacucuuagccccagacucu

SEQ ID NO: 1562141 - RNA, 11 nt, Homo sapiens
gacucuuccac

SEQ ID NO: 1562142 - RNA, 18 nt, Homo sapiens
gacucuuuccaaccggcu

SEQ ID NO: 1562143 - RNA, 14 nt, Homo sapiens
gacugagauggagu

SEQ ID NO: 1562144 - RNA, 22 nt, Homo sapiens
gacugcacagcguccuguccac

SEQ ID NO: 1562145 - RNA, 17 nt, Homo sapiens
gacugccccugccuuuu

SEQ ID NO: 1562146 - RNA, 18 nt, Homo sapiens
gacuggccacacaggauc

SEQ ID NO: 1562147 - RNA, 16 nt, Homo sapiens
gacugguuuucugcca

SEQ ID NO: 1562148 - RNA, 11 nt, Homo sapiens
gacugucuaua

SEQ ID NO: 1562149 - RNA, 22 nt, Homo sapiens
gacugugcauacuuucccucau

SEQ ID NO: 1562150 - RNA, 17 nt, Homo sapiens
gacugugcccaguacuu

SEQ ID NO: 1562151 - RNA, 12 nt, Homo sapiens
gacugugccugg

SEQ ID NO: 1562152 - RNA, 15 nt, Homo sapiens
gacuguggugacuuc

SEQ ID NO: 1562153 - RNA, 14 nt, Homo sapiens
gacugugucugccu

SEQ ID NO: 1562154 - RNA, 16 nt, Homo sapiens
gacuguugccacuuaa

SEQ ID NO: 1562155 - RNA, 20 nt, Homo sapiens
gacuuaaccuugaaauggaa

SEQ ID NO: 1562156 - RNA, 23 nt, Homo sapiens
gacuuacuaugggauggggucca

SEQ ID NO: 1562157 - RNA, 12 nt, Homo sapiens
gacuuacugcuc

SEQ ID NO: 1562158 - RNA, 23 nt, Homo sapiens
gacuuacuuuccugugguuuuau

SEQ ID NO: 1562159 - RNA, 18 nt, Homo sapiens
gacuuaggaaccuaccag

SEQ ID NO: 1562160 - RNA, 14 nt, Homo sapiens
gacuucacuguaua

SEQ ID NO: 1562161 - RNA, 16 nt, Homo sapiens
gacuucuaccugcccu

SEQ ID NO: 1562162 - RNA, 20 nt, Homo sapiens
gacuugaacaaagacauuua

SEQ ID NO: 1562163 - RNA, 22 nt, Homo sapiens
gacuugcacagggauucucaca

SEQ ID NO: 1562164 - RNA, 17 nt, Homo sapiens
gacuuugauagauuucu

SEQ ID NO: 1562165 - RNA, 18 nt, Homo sapiens
gacuuuguaucuucacug

SEQ ID NO: 1562166 - RNA, 13 nt, Homo sapiens
gacuuuguguuca

SEQ ID NO: 1562167 - RNA, 18 nt, Homo sapiens
gagaaaaggacuccucag

SEQ ID NO: 1562168 - RNA, 20 nt, Homo sapiens
gagaaaaggacuccucagaa

SEQ ID NO: 1562169 - RNA, 19 nt, Homo sapiens
gagaaaucuauagaacuga

SEQ ID NO: 1562170 - RNA, 12 nt, Homo sapiens
gagaaccaggcu

SEQ ID NO: 1562171 - RNA, 17 nt, Homo sapiens
gagaacuccucauuccc

SEQ ID NO: 1562172 - RNA, 17 nt, Homo sapiens
gagaacuugaaacagau

SEQ ID NO: 1562173 - RNA, 22 nt, Homo sapiens
gagaagaaaaccucaaguaaua

SEQ ID NO: 1562174 - RNA, 18 nt, Homo sapiens
gagaagaaagagccugaa

SEQ ID NO: 1562175 - RNA, 12 nt, Homo sapiens
gagaagaagcag

SEQ ID NO: 1562176 - RNA, 17 nt, Homo sapiens
gagaagaaguuugacca

SEQ ID NO: 1562177 - RNA, 18 nt, Homo sapiens
gagaagacccacgugcua

SEQ ID NO: 1562178 - RNA, 20 nt, Homo sapiens
gagaagccacaggccugaga

SEQ ID NO: 1562179 - RNA, 16 nt, Homo sapiens
gagaagcuaaguaaua

SEQ ID NO: 1562180 - RNA, 12 nt, Homo sapiens
gagaagcuguag

SEQ ID NO: 1562181 - RNA, 19 nt, Homo sapiens
gagaaggaaggagacucac

SEQ ID NO: 1562182 - RNA, 12 nt, Homo sapiens
gagaagugcuuu

SEQ ID NO: 1562183 - RNA, 19 nt, Homo sapiens
gagaaucaacauuucucaa

SEQ ID NO: 1562184 - RNA, 13 nt, Homo sapiens
gagaaucacuuga

SEQ ID NO: 1562185 - RNA, 20 nt, Homo sapiens
gagaauugugcuuucaccag

SEQ ID NO: 1562186 - RNA, 18 nt, Homo sapiens
gagacaaccagaucagga

SEQ ID NO: 1562187 - RNA, 11 nt, Homo sapiens
gagacacugag

SEQ ID NO: 1562188 - RNA, 16 nt, Homo sapiens
gagacagaccacuugc

SEQ ID NO: 1562189 - RNA, 19 nt, Homo sapiens
gagacagagacaaguaauu

SEQ ID NO: 1562190 - RNA, 20 nt, Homo sapiens
gagacagaguuucaccaugu

SEQ ID NO: 1562191 - RNA, 19 nt, Homo sapiens
gagacauguaccuugacca

SEQ ID NO: 1562192 - RNA, 14 nt, Homo sapiens
gagaccauguuuca

SEQ ID NO: 1562193 - RNA, 13 nt, Homo sapiens
gagacccacaggu

SEQ ID NO: 1562194 - RNA, 16 nt, Homo sapiens
gagacccacaggucua

SEQ ID NO: 1562195 - RNA, 16 nt, Homo sapiens
gagaccccagucguga

SEQ ID NO: 1562196 - RNA, 15 nt, Homo sapiens
gagaccugcucaggc

SEQ ID NO: 1562197 - RNA, 15 nt, Homo sapiens
gagacgcacacagcu

SEQ ID NO: 1562198 - RNA, 19 nt, Homo sapiens
gagacuccaccucuaccaa

SEQ ID NO: 1562199 - RNA, 21 nt, Homo sapiens
gagacuccaccucuaccaaaa

SEQ ID NO: 1562200 - RNA, 19 nt, Homo sapiens
gagacuccaucucaaaaaa

SEQ ID NO: 1562201 - RNA, 13 nt, Homo sapiens
gagacucuagggu

SEQ ID NO: 1562202 - RNA, 16 nt, Homo sapiens
gagacucuagggucca

SEQ ID NO: 1562203 - RNA, 18 nt, Homo sapiens
gagacucuaggguccagu

SEQ ID NO: 1562204 - RNA, 18 nt, Homo sapiens
gagacugcguucugcaag

SEQ ID NO: 1562205 - RNA, 14 nt, Homo sapiens
gagacugggagcca

SEQ ID NO: 1562206 - RNA, 21 nt, Homo sapiens
gagacuuucuucuagugcuuu

SEQ ID NO: 1562207 - RNA, 13 nt, Homo sapiens
gagagacccaagg

SEQ ID NO: 1562208 - RNA, 22 nt, Homo sapiens
gagagaugggagcuccucuccu

SEQ ID NO: 1562209 - RNA, 18 nt, Homo sapiens
gagagauuagaauaucug

SEQ ID NO: 1562210 - RNA, 20 nt, Homo sapiens
gagagauuuaacauuaucua

SEQ ID NO: 1562211 - RNA, 15 nt, Homo sapiens
gagagcagcauuccc

SEQ ID NO: 1562212 - RNA, 20 nt, Homo sapiens
gagagcgagacccugucuca

SEQ ID NO: 1562213 - RNA, 18 nt, Homo sapiens
gagagcuugcugugacua

SEQ ID NO: 1562214 - RNA, 14 nt, Homo sapiens
gagaggaguccuuu

SEQ ID NO: 1562215 - RNA, 15 nt, Homo sapiens
gagaggauacauuua

SEQ ID NO: 1562216 - RNA, 18 nt, Homo sapiens
gagagggaggucacugga

SEQ ID NO: 1562217 - RNA, 18 nt, Homo sapiens
gagaggggacucaaacag

SEQ ID NO: 1562218 - RNA, 13 nt, Homo sapiens
gagaggggggcca

SEQ ID NO: 1562219 - RNA, 23 nt, Homo sapiens
gagagggguggaggcugccccau

SEQ ID NO: 1562220 - RNA, 22 nt, Homo sapiens
gagaguagaugguuugagccug

SEQ ID NO: 1562221 - RNA, 13 nt, Homo sapiens
gagagucauucag

SEQ ID NO: 1562222 - RNA, 16 nt, Homo sapiens
gagagucauucaggug

SEQ ID NO: 1562223 - RNA, 16 nt, Homo sapiens
gagagugcacaugccc

SEQ ID NO: 1562224 - RNA, 19 nt, Homo sapiens
gagauaccccacuccacau

SEQ ID NO: 1562225 - RNA, 13 nt, Homo sapiens
gagaucaacaaca

SEQ ID NO: 1562226 - RNA, 16 nt, Homo sapiens
gagaucccaacacugc

SEQ ID NO: 1562227 - RNA, 19 nt, Homo sapiens
gagaucgugcuacugcacu

SEQ ID NO: 1562228 - RNA, 22 nt, Homo sapiens
gauguggaucacgcagugcuuu

SEQ ID NO: 1562229 - RNA, 18 nt, Homo sapiens
gauguuccaccugccaca

SEQ ID NO: 1562230 - RNA, 17 nt, Homo sapiens
gauguugaaacuuugaa

SEQ ID NO: 1562231 - RNA, 17 nt, Homo sapiens
gauguugagaauguuca

SEQ ID NO: 1562232 - RNA, 15 nt, Homo sapiens
gauguuucuugccuu

SEQ ID NO: 1562233 - RNA, 15 nt, Homo sapiens
gauguuuguuuucaa

SEQ ID NO: 1562234 - RNA, 14 nt, Homo sapiens
gauuaaaaccagag

SEQ ID NO: 1562235 - RNA, 18 nt, Homo sapiens
gauuaaauugcaccagaa

SEQ ID NO: 1562236 - RNA, 13 nt, Homo sapiens
gauuaagauuuua

SEQ ID NO: 1562237 - RNA, 16 nt, Homo sapiens
gauuacacauuucacu

SEQ ID NO: 1562238 - RNA, 21 nt, Homo sapiens
gauuacaggcgugagccaccg

SEQ ID NO: 1562239 - RNA, 23 nt, Homo sapiens
gauuacauccguaggacaaguuu

SEQ ID NO: 1562240 - RNA, 18 nt, Homo sapiens
gauuaccagucugauuau

SEQ ID NO: 1562241 - RNA, 15 nt, Homo sapiens
gauuacccugagcug

SEQ ID NO: 1562242 - RNA, 20 nt, Homo sapiens
gauuacuaucauggcauaua

SEQ ID NO: 1562243 - RNA, 21 nt, Homo sapiens
gauuacugaauuguaucaauu

SEQ ID NO: 1562244 - RNA, 13 nt, Homo sapiens
gauuauaaacuga

SEQ ID NO: 1562245 - RNA, 12 nt, Homo sapiens
gauuauauucac

SEQ ID NO: 1562246 - RNA, 21 nt, Homo sapiens
gauuauuggcucauaagcaua

SEQ ID NO: 1562247 - RNA, 15 nt, Homo sapiens
gauucaauauugaau

SEQ ID NO: 1562248 - RNA, 17 nt, Homo sapiens
gauucagaauguguuau

SEQ ID NO: 1562249 - RNA, 20 nt, Homo sapiens
gauucagacuuggacuauga

SEQ ID NO: 1562250 - RNA, 16 nt, Homo sapiens
gauucagaggucacuu

SEQ ID NO: 1562251 - RNA, 12 nt, Homo sapiens
gauucagcaaaa

SEQ ID NO: 1562252 - RNA, 21 nt, Homo sapiens
gauucagccaaaugcagggag

SEQ ID NO: 1562253 - RNA, 20 nt, Homo sapiens
gauucaggggucugaugaca

SEQ ID NO: 1562254 - RNA, 21 nt, Homo sapiens
gauucauucucauaauuccua

SEQ ID NO: 1562255 - RNA, 13 nt, Homo sapiens
gauuccaaaaagc

SEQ ID NO: 1562256 - RNA, 18 nt, Homo sapiens
gauuccaaaaagcacaua

SEQ ID NO: 1562257 - RNA, 22 nt, Homo sapiens
gauuccaacauuucucacugaa

SEQ ID NO: 1562258 - RNA, 16 nt, Homo sapiens
gauuccuagauuacau

SEQ ID NO: 1562259 - RNA, 18 nt, Homo sapiens
gauuccuucaacuggcua

SEQ ID NO: 1562260 - RNA, 15 nt, Homo sapiens
gauucuacagugaug

SEQ ID NO: 1562261 - RNA, 15 nt, Homo sapiens
gauucuaugucucau

SEQ ID NO: 1562262 - RNA, 22 nt, Homo sapiens
gauucucucaucuaacugauga

SEQ ID NO: 1562263 - RNA, 19 nt, Homo sapiens
gauucugcaguaaaucuuu

SEQ ID NO: 1562264 - RNA, 16 nt, Homo sapiens
gauucuuccugcuuag

SEQ ID NO: 1562265 - RNA, 16 nt, Homo sapiens
gauugaaucugaacca

SEQ ID NO: 1562266 - RNA, 22 nt, Homo sapiens
gauugcagguggaacucaguca

SEQ ID NO: 1562267 - RNA, 22 nt, Homo sapiens
gauuggguuggaaugcuuucca

SEQ ID NO: 1562268 - RNA, 19 nt, Homo sapiens
gauugucauguaaggcuua

SEQ ID NO: 1562269 - RNA, 20 nt, Homo sapiens
gauugugccagugcacuccg

SEQ ID NO: 1562270 - RNA, 17 nt, Homo sapiens
gauuguggaaaauggag

SEQ ID NO: 1562271 - RNA, 17 nt, Homo sapiens
gauugugugacuauuca

SEQ ID NO: 1562272 - RNA, 22 nt, Homo sapiens
gauuuaauuuuuuaaacuguag

SEQ ID NO: 1562273 - RNA, 13 nt, Homo sapiens
gauuuaguacuug

SEQ ID NO: 1562274 - RNA, 17 nt, Homo sapiens
gauuuauuuuguaugaa

SEQ ID NO: 1562275 - RNA, 17 nt, Homo sapiens
gauuucagcauuuccua

SEQ ID NO: 1562276 - RNA, 19 nt, Homo sapiens
gauuucccacugcacucca

SEQ ID NO: 1562277 - RNA, 16 nt, Homo sapiens
gauuuccuuaaccuua

SEQ ID NO: 1562278 - RNA, 13 nt, Homo sapiens
gauuuccuugaau

SEQ ID NO: 1562279 - RNA, 16 nt, Homo sapiens
gauuuccuugugcaaa

SEQ ID NO: 1562280 - RNA, 22 nt, Homo sapiens
gauuucuuucuuugcaccaaag

SEQ ID NO: 1562281 - RNA, 17 nt, Homo sapiens
gauuugaugggccacaa

SEQ ID NO: 1562282 - RNA, 20 nt, Homo sapiens
gauuuggggcagagggacag

SEQ ID NO: 1562283 - RNA, 18 nt, Homo sapiens
gauuugugaacuggaaga

SEQ ID NO: 1562284 - RNA, 15 nt, Homo sapiens
gauuuuacaaguaua

SEQ ID NO: 1562285 - RNA, 15 nt, Homo sapiens
gauuuuaccaaagca

SEQ ID NO: 1562286 - RNA, 20 nt, Homo sapiens
gauuuuauggugaugucacu

SEQ ID NO: 1562287 - RNA, 16 nt, Homo sapiens
gauuuugcuguagaag

SEQ ID NO: 1562288 - RNA, 22 nt, Homo sapiens
gauuuuuagucuggcugcaccu

SEQ ID NO: 1562289 - RNA, 19 nt, Homo sapiens
gauuuuuaugccaccugaa

SEQ ID NO: 1562290 - RNA, 17 nt, Homo sapiens
gauuuuucugcacuaau

SEQ ID NO: 1562291 - RNA, 18 nt, Homo sapiens
gauuuuuuagaucuuccu

SEQ ID NO: 1562292 - RNA, 23 nt, Homo sapiens
gcaaaacaaaaguacauugcuua

SEQ ID NO: 1562293 - RNA, 12 nt, Homo sapiens
gcaaaaccaaac

SEQ ID NO: 1562294 - RNA, 16 nt, Homo sapiens
gcaaaaccuuaccuug

SEQ ID NO: 1562295 - RNA, 20 nt, Homo sapiens
gcaaaacuccgucucaaaaa

SEQ ID NO: 1562296 - RNA, 16 nt, Homo sapiens
gcaaaaggccucuugu

SEQ ID NO: 1562297 - RNA, 23 nt, Homo sapiens
gcaaaaguggggcuaaaugaagu

SEQ ID NO: 1562298 - RNA, 17 nt, Homo sapiens
gcaaaauauuugacuau

SEQ ID NO: 1562299 - RNA, 20 nt, Homo sapiens
gcaaaauuaaauacauaaau

SEQ ID NO: 1562300 - RNA, 21 nt, Homo sapiens
gcaaaauugucuaaaauguca

SEQ ID NO: 1562301 - RNA, 15 nt, Homo sapiens
gcaaaccuuccuggg

SEQ ID NO: 1562302 - RNA, 18 nt, Homo sapiens
gcaaagacuagauccuuu

SEQ ID NO: 1562303 - RNA, 22 nt, Homo sapiens
gcaaagauuuuuggcacuuugu

SEQ ID NO: 1562304 - RNA, 14 nt, Homo sapiens
gcaaagggaaauca

SEQ ID NO: 1562305 - RNA, 15 nt, Homo sapiens
gcaaaguaguacuuc

SEQ ID NO: 1562306 - RNA, 20 nt, Homo sapiens
gcaaaguauuguaaauuaua

SEQ ID NO: 1562307 - RNA, 13 nt, Homo sapiens
gcaaagugcccau

SEQ ID NO: 1562308 - RNA, 17 nt, Homo sapiens
gcaaauaaauuaugcaa

SEQ ID NO: 1562309 - RNA, 15 nt, Homo sapiens
gcaaauacacuccag

SEQ ID NO: 1562310 - RNA, 17 nt, Homo sapiens
gcaaauagagagucucc

SEQ ID NO: 1562311 - RNA, 15 nt, Homo sapiens
gcaaauagccacaau

SEQ ID NO: 1562312 - RNA, 23 nt, Homo sapiens
gcaaauccagucccaaugguccu

SEQ ID NO: 1562313 - RNA, 22 nt, Homo sapiens
gcaaaugcuacauauaugcaau

SEQ ID NO: 1562314 - RNA, 16 nt, Homo sapiens
gcaaauggccaaugag

SEQ ID NO: 1562315 - RNA, 19 nt, Homo sapiens
gcaaauguuuacuguauca

SEQ ID NO: 1562316 - RNA, 16 nt, Homo sapiens
gcaaauuaacuaauuu

SEQ ID NO: 1562317 - RNA, 17 nt, Homo sapiens
gcaacaauaaaguacuu

SEQ ID NO: 1562318 - RNA, 18 nt, Homo sapiens
gcaacaauaaaguacuuu

SEQ ID NO: 1562319 - RNA, 14 nt, Homo sapiens
gcaacauaauucuu

SEQ ID NO: 1562320 - RNA, 19 nt, Homo sapiens
gcaacccaaauguucauca

SEQ ID NO: 1562321 - RNA, 23 nt, Homo sapiens
gcaacgcaggcccccaggugcca

SEQ ID NO: 1562322 - RNA, 23 nt, Homo sapiens
gcaacguaagauguccuccuuga

SEQ ID NO: 1562323 - RNA, 20 nt, Homo sapiens
gcaacucuuuuaagugccuu

SEQ ID NO: 1562324 - RNA, 15 nt, Homo sapiens
gcaagaacagugggc

SEQ ID NO: 1562325 - RNA, 16 nt, Homo sapiens
gcaagcauuuuuccau

SEQ ID NO: 1562326 - RNA, 16 nt, Homo sapiens
gcaagccugucuucag

SEQ ID NO: 1562327 - RNA, 15 nt, Homo sapiens
gcaagcguguucuca

SEQ ID NO: 1562328 - RNA, 20 nt, Homo sapiens
gcaaggauuacacauuucac

SEQ ID NO: 1562329 - RNA, 21 nt, Homo sapiens
gcaagggcagaacacuaaccu

SEQ ID NO: 1562330 - RNA, 16 nt, Homo sapiens
gcaaggucaugaagga

SEQ ID NO: 1562331 - RNA, 19 nt, Homo sapiens
gcaaguccggcggaauuca

SEQ ID NO: 1562332 - RNA, 14 nt, Homo sapiens
gcaaguuagaacua

SEQ ID NO: 1562333 - RNA, 20 nt, Homo sapiens
gcaaguuagaacuagccaaa

SEQ ID NO: 1562334 - RNA, 13 nt, Homo sapiens
gcaaguugcuuau

SEQ ID NO: 1562335 - RNA, 22 nt, Homo sapiens
gcaauaacguuuaagccaaaac

SEQ ID NO: 1562336 - RNA, 17 nt, Homo sapiens
gcaauaagaauuacuuu

SEQ ID NO: 1562337 - RNA, 21 nt, Homo sapiens
gcaauauaucugaagagcuau

SEQ ID NO: 1562338 - RNA, 16 nt, Homo sapiens
gcaauauggaagcaac

SEQ ID NO: 1562339 - RNA, 21 nt, Homo sapiens
gcaauauggaagcaaccagca

SEQ ID NO: 1562340 - RNA, 15 nt, Homo sapiens
gcaaucaugagcaag

SEQ ID NO: 1562341 - RNA, 18 nt, Homo sapiens
gcaaucaugagcaaguga

SEQ ID NO: 1562342 - RNA, 21 nt, Homo sapiens
gcaaucccagcuacuuggaag

SEQ ID NO: 1562343 - RNA, 16 nt, Homo sapiens
gcaaucucagaugcag

SEQ ID NO: 1562344 - RNA, 17 nt, Homo sapiens
gcaaucuucuacuuuaa

SEQ ID NO: 1562345 - RNA, 18 nt, Homo sapiens
gucugaaaucagugccua

SEQ ID NO: 1562346 - RNA, 13 nt, Homo sapiens
gucugaggacuga

SEQ ID NO: 1562347 - RNA, 21 nt, Homo sapiens
gucugcacuguucaaaccucu

SEQ ID NO: 1562348 - RNA, 17 nt, Homo sapiens
gucugccuaugcacuga

SEQ ID NO: 1562349 - RNA, 14 nt, Homo sapiens
gucugcuguagaaa

SEQ ID NO: 1562350 - RNA, 22 nt, Homo sapiens
gucuggcaaugggacucugaga

SEQ ID NO: 1562351 - RNA, 16 nt, Homo sapiens
gucugggcacaagugu

SEQ ID NO: 1562352 - RNA, 16 nt, Homo sapiens
gucugggcacagucag

SEQ ID NO: 1562353 - RNA, 19 nt, Homo sapiens
gucuguaaaaaauggagcu

SEQ ID NO: 1562354 - RNA, 16 nt, Homo sapiens
gucugucuacauuucu

SEQ ID NO: 1562355 - RNA, 15 nt, Homo sapiens
gucugugacauuucc

SEQ ID NO: 1562356 - RNA, 13 nt, Homo sapiens
gucugugaucucu

SEQ ID NO: 1562357 - RNA, 12 nt, Homo sapiens
gucuguguuauu

SEQ ID NO: 1562358 - RNA, 21 nt, Homo sapiens
gucuuacuguugcauaacuau

SEQ ID NO: 1562359 - RNA, 18 nt, Homo sapiens
gucuuagacugcuagcuu

SEQ ID NO: 1562360 - RNA, 22 nt, Homo sapiens
gucuuaguuuugugaaggugau

SEQ ID NO: 1562361 - RNA, 15 nt, Homo sapiens
gucuucaccaaguga

SEQ ID NO: 1562362 - RNA, 19 nt, Homo sapiens
gucuuccugacacuuuaau

SEQ ID NO: 1562363 - RNA, 13 nt, Homo sapiens
gucuuguguuucu

SEQ ID NO: 1562364 - RNA, 21 nt, Homo sapiens
gucuuucaccgggcaauccaa

SEQ ID NO: 1562365 - RNA, 20 nt, Homo sapiens
gucuuuccugaaccaugugg

SEQ ID NO: 1562366 - RNA, 17 nt, Homo sapiens
gucuuuguucugugauu

SEQ ID NO: 1562367 - RNA, 19 nt, Homo sapiens
gugaaaaaggaaugauaua

SEQ ID NO: 1562368 - RNA, 14 nt, Homo sapiens
gugaaaagcuccau

SEQ ID NO: 1562369 - RNA, 23 nt, Homo sapiens
gugaaaaugaauaucaugcaaau

SEQ ID NO: 1562370 - RNA, 21 nt, Homo sapiens
gugaaaccccgucucuacuaa

SEQ ID NO: 1562371 - RNA, 20 nt, Homo sapiens
gugaaauaagccagacauca

SEQ ID NO: 1562372 - RNA, 20 nt, Homo sapiens
gugaaauaccacaagccuga

SEQ ID NO: 1562373 - RNA, 19 nt, Homo sapiens
gugaaauacuguacagggg

SEQ ID NO: 1562374 - RNA, 18 nt, Homo sapiens
gugaaauggccacuacuu

SEQ ID NO: 1562375 - RNA, 13 nt, Homo sapiens
gugaacacgugug

SEQ ID NO: 1562376 - RNA, 15 nt, Homo sapiens
gugaaccacugugua

SEQ ID NO: 1562377 - RNA, 22 nt, Homo sapiens
gugaacucaucccuuguuuaua

SEQ ID NO: 1562378 - RNA, 20 nt, Homo sapiens
gugaagaaaccguauccaua

SEQ ID NO: 1562379 - RNA, 19 nt, Homo sapiens
gugaagaguuucacaaauc

SEQ ID NO: 1562380 - RNA, 13 nt, Homo sapiens
gugaagcucuucc

SEQ ID NO: 1562381 - RNA, 15 nt, Homo sapiens
gugaagucucugggu

SEQ ID NO: 1562382 - RNA, 16 nt, Homo sapiens
gugaaguuuaaacucu

SEQ ID NO: 1562383 - RNA, 19 nt, Homo sapiens
gugaaguuuaauugucuca

SEQ ID NO: 1562384 - RNA, 15 nt, Homo sapiens
gugaauaaaccauca

SEQ ID NO: 1562385 - RNA, 22 nt, Homo sapiens
gugaauacauuaacggugcuaa

SEQ ID NO: 1562386 - RNA, 23 nt, Homo sapiens
gugaaucccuuuaggauguuuuc

SEQ ID NO: 1562387 - RNA, 16 nt, Homo sapiens
gugaaugauucagugu

SEQ ID NO: 1562388 - RNA, 23 nt, Homo sapiens
gugaauuaagcccaauuaauucc

SEQ ID NO: 1562389 - RNA, 21 nt, Homo sapiens
gugacaagggcacaagcucag

SEQ ID NO: 1562390 - RNA, 17 nt, Homo sapiens
gugacaugugcuggaca

SEQ ID NO: 1562391 - RNA, 19 nt, Homo sapiens
gugacauuuccaugcauaa

SEQ ID NO: 1562392 - RNA, 12 nt, Homo sapiens
gugacccugaga

SEQ ID NO: 1562393 - RNA, 19 nt, Homo sapiens
gugacuaaacuacauuaua

SEQ ID NO: 1562394 - RNA, 16 nt, Homo sapiens
gugacuucacuguaua

SEQ ID NO: 1562395 - RNA, 13 nt, Homo sapiens
gugagaaggcaac

SEQ ID NO: 1562396 - RNA, 17 nt, Homo sapiens
gugagacagcucugcau

SEQ ID NO: 1562397 - RNA, 15 nt, Homo sapiens
gugagacuccaucuc

SEQ ID NO: 1562398 - RNA, 16 nt, Homo sapiens
gugagacuguacauaa

SEQ ID NO: 1562399 - RNA, 21 nt, Homo sapiens
gugagacuucuguuugaucac

SEQ ID NO: 1562400 - RNA, 14 nt, Homo sapiens
gugagcaguggaca

SEQ ID NO: 1562401 - RNA, 14 nt, Homo sapiens
gugagccaaggagg

SEQ ID NO: 1562402 - RNA, 15 nt, Homo sapiens
gugagcugagauugc

SEQ ID NO: 1562403 - RNA, 14 nt, Homo sapiens
gugaggggcucucu

SEQ ID NO: 1562404 - RNA, 13 nt, Homo sapiens
gugauaagucauu

SEQ ID NO: 1562405 - RNA, 23 nt, Homo sapiens
gugauacaacuucaagugcaugc

SEQ ID NO: 1562406 - RNA, 21 nt, Homo sapiens
gugauacucacguuugcuuaa

SEQ ID NO: 1562407 - RNA, 19 nt, Homo sapiens
gugauauacugguucacau

SEQ ID NO: 1562408 - RNA, 17 nt, Homo sapiens
gugaugauagcacuggu

SEQ ID NO: 1562409 - RNA, 14 nt, Homo sapiens
gugaugccauuaca

SEQ ID NO: 1562410 - RNA, 18 nt, Homo sapiens
gugauggggucaucaaau

SEQ ID NO: 1562411 - RNA, 15 nt, Homo sapiens
gugauugguugcauc

SEQ ID NO: 1562412 - RNA, 16 nt, Homo sapiens
gugauugucaccauga

SEQ ID NO: 1562413 - RNA, 17 nt, Homo sapiens
gugauugucaccaugau

SEQ ID NO: 1562414 - RNA, 19 nt, Homo sapiens
gugauuucuuucuuugcac

SEQ ID NO: 1562415 - RNA, 21 nt, Homo sapiens
gugauuuuauggugaugucac

SEQ ID NO: 1562416 - RNA, 16 nt, Homo sapiens
gugcaaaaucuguuau

SEQ ID NO: 1562417 - RNA, 22 nt, Homo sapiens
gugcaauaagauugguguucgu

SEQ ID NO: 1562418 - RNA, 19 nt, Homo sapiens
gugcaauggcgcgaucuca

SEQ ID NO: 1562419 - RNA, 18 nt, Homo sapiens
gugcacaucuacaugcca

SEQ ID NO: 1562420 - RNA, 14 nt, Homo sapiens
gugcacucacuccu

SEQ ID NO: 1562421 - RNA, 17 nt, Homo sapiens
gugcagaguguuuaccu

SEQ ID NO: 1562422 - RNA, 18 nt, Homo sapiens
gugcagauaucacagagg

SEQ ID NO: 1562423 - RNA, 13 nt, Homo sapiens
gugcagcauuaaa

SEQ ID NO: 1562424 - RNA, 18 nt, Homo sapiens
gugcagggaagugcagag

SEQ ID NO: 1562425 - RNA, 19 nt, Homo sapiens
gugcagggagacaucugca

SEQ ID NO: 1562426 - RNA, 17 nt, Homo sapiens
gugcaguccauuuccua

SEQ ID NO: 1562427 - RNA, 19 nt, Homo sapiens
gugcaguggcgugaucucg

SEQ ID NO: 1562428 - RNA, 20 nt, Homo sapiens
gugcauaaugcuuuggaaaa

SEQ ID NO: 1562429 - RNA, 20 nt, Homo sapiens
gugcaugccuguagucucag

SEQ ID NO: 1562430 - RNA, 11 nt, Homo sapiens
gugccaaaaau

SEQ ID NO: 1562431 - RNA, 19 nt, Homo sapiens
gugccaccacgcccagcua

SEQ ID NO: 1562432 - RNA, 19 nt, Homo sapiens
gugccaccaugacuggcua

SEQ ID NO: 1562433 - RNA, 19 nt, Homo sapiens
gugccacccaccuuugcca

SEQ ID NO: 1562434 - RNA, 18 nt, Homo sapiens
gugccuacgacuaucugg

SEQ ID NO: 1562435 - RNA, 18 nt, Homo sapiens
gugccuacucuuugccaa

SEQ ID NO: 1562436 - RNA, 23 nt, Homo sapiens
gugccuagacuguuacuuuggca

SEQ ID NO: 1562437 - RNA, 19 nt, Homo sapiens
gugccuauggguuguuaau

SEQ ID NO: 1562438 - RNA, 17 nt, Homo sapiens
gugccuccuguggucuc

SEQ ID NO: 1562439 - RNA, 16 nt, Homo sapiens
gugccuguaaucacag

SEQ ID NO: 1562440 - RNA, 17 nt, Homo sapiens
gugccuucccagacacu

SEQ ID NO: 1562441 - RNA, 18 nt, Homo sapiens
gugccuuggugugcugua

SEQ ID NO: 1562442 - RNA, 13 nt, Homo sapiens
gugcggacagccc

SEQ ID NO: 1562443 - RNA, 11 nt, Homo sapiens
gugcgugccug

SEQ ID NO: 1562444 - RNA, 21 nt, Homo sapiens
gugcuaauuuguuuuggauau

SEQ ID NO: 1562445 - RNA, 21 nt, Homo sapiens
gugcuaugaauuuucaaguaa

SEQ ID NO: 1562446 - RNA, 20 nt, Homo sapiens
gugcucgcccacaaacugau

SEQ ID NO: 1562447 - RNA, 20 nt, Homo sapiens
gugcucucucagcacuggga

SEQ ID NO: 1562448 - RNA, 24 nt, Homo sapiens
gugcucugccucagacguugccug

SEQ ID NO: 1562449 - RNA, 15 nt, Homo sapiens
gugcugcacaaaagc

SEQ ID NO: 1562450 - RNA, 16 nt, Homo sapiens
gugcuggauuugauga

SEQ ID NO: 1562451 - RNA, 15 nt, Homo sapiens
gugcugggauuacag

SEQ ID NO: 1562452 - RNA, 21 nt, Homo sapiens
gugcugguccuguugauccca

SEQ ID NO: 1562453 - RNA, 22 nt, Homo sapiens
gugcuuucccagucccauuccu

SEQ ID NO: 1562454 - RNA, 18 nt, Homo sapiens
gugcuuuccuucaucucc

SEQ ID NO: 1562455 - RNA, 13 nt, Homo sapiens
gugcuuugugaua

SEQ ID NO: 1562456 - RNA, 14 nt, Homo sapiens
guggaacucaguca

SEQ ID NO: 1562457 - RNA, 22 nt, Homo sapiens
guggaauaauacauacuaauga

SEQ ID NO: 1562458 - RNA, 23 nt, Homo sapiens
guggaauauaaggaaagcaauaa

SEQ ID NO: 1562459 - RNA, 23 nt, Homo sapiens
guggagacccugccacagccaga

SEQ ID NO: 1562460 - RNA, 15 nt, Homo sapiens
guggaggccacuguu

SEQ ID NO: 1562461 - RNA, 13 nt, Homo sapiens
guggaggcuuccu

SEQ ID NO: 1562462 - RNA, 15 nt, Homo sapiens
guggcaacuugugau

SEQ ID NO: 1562463 - RNA, 14 nt, Homo sapiens
uaaauucaucuaga

SEQ ID NO: 1562464 - RNA, 13 nt, Homo sapiens
uaaauuccauaua

SEQ ID NO: 1562465 - RNA, 20 nt, Homo sapiens
uaaauucccaacuucucuug

SEQ ID NO: 1562466 - RNA, 18 nt, Homo sapiens
uaaauucccuggggaaaa

SEQ ID NO: 1562467 - RNA, 13 nt, Homo sapiens
uaaauucuaccuc

SEQ ID NO: 1562468 - RNA, 23 nt, Homo sapiens
uaaauucuauaggaacauaugaa

SEQ ID NO: 1562469 - RNA, 21 nt, Homo sapiens
uaaauucucauaaguagcauu

SEQ ID NO: 1562470 - RNA, 12 nt, Homo sapiens
uaaauugcacac

SEQ ID NO: 1562471 - RNA, 19 nt, Homo sapiens
uaaauugcuaauguugcug

SEQ ID NO: 1562472 - RNA, 15 nt, Homo sapiens
uaaauugucugccau

SEQ ID NO: 1562473 - RNA, 15 nt, Homo sapiens
uaaauuuaugugaug

SEQ ID NO: 1562474 - RNA, 16 nt, Homo sapiens
uaaauuuaugugaugg

SEQ ID NO: 1562475 - RNA, 19 nt, Homo sapiens
uaaauuuuaaguaucccau

SEQ ID NO: 1562476 - RNA, 17 nt, Homo sapiens
uaaauuuuucauagaag

SEQ ID NO: 1562477 - RNA, 23 nt, Homo sapiens
uaacaagaccucagugccuuccu

SEQ ID NO: 1562478 - RNA, 18 nt, Homo sapiens
uaacaagcaugcauaaau

SEQ ID NO: 1562479 - RNA, 13 nt, Homo sapiens
uaacacaaagaga

SEQ ID NO: 1562480 - RNA, 21 nt, Homo sapiens
uaacacacccugcuucauuga

SEQ ID NO: 1562481 - RNA, 17 nt, Homo sapiens
uaacagcauuaacuguc

SEQ ID NO: 1562482 - RNA, 14 nt, Homo sapiens
uaacauagauuuaa

SEQ ID NO: 1562483 - RNA, 16 nt, Homo sapiens
uaacaucuguuaucaa

SEQ ID NO: 1562484 - RNA, 13 nt, Homo sapiens
uaacaucuugaau

SEQ ID NO: 1562485 - RNA, 23 nt, Homo sapiens
uaacauggugaaaccccgucucu

SEQ ID NO: 1562486 - RNA, 13 nt, Homo sapiens
uaacauguguaug

SEQ ID NO: 1562487 - RNA, 13 nt, Homo sapiens
uaacauguuauca

SEQ ID NO: 1562488 - RNA, 22 nt, Homo sapiens
uaacauuaucuaguucauugaa

SEQ ID NO: 1562489 - RNA, 18 nt, Homo sapiens
uaacauuuaaauuccaca

SEQ ID NO: 1562490 - RNA, 19 nt, Homo sapiens
uaacauuuaaauuccacag

SEQ ID NO: 1562491 - RNA, 19 nt, Homo sapiens
uaaccaaagucacaaauca

SEQ ID NO: 1562492 - RNA, 20 nt, Homo sapiens
uaaccaagagauaacuguaa

SEQ ID NO: 1562493 - RNA, 18 nt, Homo sapiens
uaacccaagacaugacau

SEQ ID NO: 1562494 - RNA, 21 nt, Homo sapiens
uaacccaagacaugacauucu

SEQ ID NO: 1562495 - RNA, 15 nt, Homo sapiens
uaaccccauucuuug

SEQ ID NO: 1562496 - RNA, 14 nt, Homo sapiens
uaacccuuauucca

SEQ ID NO: 1562497 - RNA, 12 nt, Homo sapiens
uaacccuuuuuc

SEQ ID NO: 1562498 - RNA, 12 nt, Homo sapiens
uaaccucaggga

SEQ ID NO: 1562499 - RNA, 23 nt, Homo sapiens
uaaccuccagcagacuccugcuc

SEQ ID NO: 1562500 - RNA, 20 nt, Homo sapiens
uaaccucggagacgggaccc

SEQ ID NO: 1562501 - RNA, 20 nt, Homo sapiens
uaaccuguauacucuugaau

SEQ ID NO: 1562502 - RNA, 20 nt, Homo sapiens
uaaccugucuauacuacagu

SEQ ID NO: 1562503 - RNA, 12 nt, Homo sapiens
uaacgacaauuu

SEQ ID NO: 1562504 - RNA, 13 nt, Homo sapiens
uaacgauacaaau

SEQ ID NO: 1562505 - RNA, 14 nt, Homo sapiens
uaacuaacuggcag

SEQ ID NO: 1562506 - RNA, 13 nt, Homo sapiens
uaacuaucaauau

SEQ ID NO: 1562507 - RNA, 15 nt, Homo sapiens
uaacuauugcauuua

SEQ ID NO: 1562508 - RNA, 14 nt, Homo sapiens
uaacuccugccauu

SEQ ID NO: 1562509 - RNA, 18 nt, Homo sapiens
uaacucuaccugcacacu

SEQ ID NO: 1562510 - RNA, 17 nt, Homo sapiens
uaacucugcacuacucc

SEQ ID NO: 1562511 - RNA, 13 nt, Homo sapiens
uaacucugcauag

SEQ ID NO: 1562512 - RNA, 23 nt, Homo sapiens
uaacucugggaggggcucgagag

SEQ ID NO: 1562513 - RNA, 12 nt, Homo sapiens
uaacugcuucuu

SEQ ID NO: 1562514 - RNA, 21 nt, Homo sapiens
uaacugcuuucuguuccaaau

SEQ ID NO: 1562515 - RNA, 13 nt, Homo sapiens
uaacuggcaccca

SEQ ID NO: 1562516 - RNA, 16 nt, Homo sapiens
uaacuggcacccagag

SEQ ID NO: 1562517 - RNA, 17 nt, Homo sapiens
uaacuguaaacuuggaa

SEQ ID NO: 1562518 - RNA, 22 nt, Homo sapiens
uaacuguauuuuugaagacuau

SEQ ID NO: 1562519 - RNA, 22 nt, Homo sapiens
uaacuguccguaguaucagaga

SEQ ID NO: 1562520 - RNA, 20 nt, Homo sapiens
uaacugugaaauaccacaag

SEQ ID NO: 1562521 - RNA, 15 nt, Homo sapiens
uaacuguuaguauua

SEQ ID NO: 1562522 - RNA, 16 nt, Homo sapiens
uaacuguuaguauuaa

SEQ ID NO: 1562523 - RNA, 23 nt, Homo sapiens
uaacuuaaaaaacugcaucccac

SEQ ID NO: 1562524 - RNA, 13 nt, Homo sapiens
uaacuucaaauau

SEQ ID NO: 1562525 - RNA, 22 nt, Homo sapiens
uaacuuguuugguaguuagcca

SEQ ID NO: 1562526 - RNA, 14 nt, Homo sapiens
uaacuuuaccaaau

SEQ ID NO: 1562527 - RNA, 15 nt, Homo sapiens
uaacuuucucuguga

SEQ ID NO: 1562528 - RNA, 17 nt, Homo sapiens
uaacuuucucugugaaa

SEQ ID NO: 1562529 - RNA, 20 nt, Homo sapiens
uaacuuuuaaaaugaagcuu

SEQ ID NO: 1562530 - RNA, 22 nt, Homo sapiens
uaacuuuuaaaaugaagcuuug

SEQ ID NO: 1562531 - RNA, 18 nt, Homo sapiens
uaacuuuugguaucuacu

SEQ ID NO: 1562532 - RNA, 20 nt, Homo sapiens
uaacuuuuuuuucucucuuu

SEQ ID NO: 1562533 - RNA, 19 nt, Homo sapiens
uaagaaaaaaagcacaaag

SEQ ID NO: 1562534 - RNA, 16 nt, Homo sapiens
uaagaaagaucaaaga

SEQ ID NO: 1562535 - RNA, 16 nt, Homo sapiens
uaagaaagcacuauua

SEQ ID NO: 1562536 - RNA, 19 nt, Homo sapiens
uaagaaaucaaguaaugaa

SEQ ID NO: 1562537 - RNA, 15 nt, Homo sapiens
uaagaaaugaucuuu

SEQ ID NO: 1562538 - RNA, 22 nt, Homo sapiens
uaagaacagaucaggaauucua

SEQ ID NO: 1562539 - RNA, 12 nt, Homo sapiens
uaagaagacauu

SEQ ID NO: 1562540 - RNA, 12 nt, Homo sapiens
uaagaagcaaua

SEQ ID NO: 1562541 - RNA, 14 nt, Homo sapiens
uaagaauagaaaua

SEQ ID NO: 1562542 - RNA, 16 nt, Homo sapiens
uaagaauuauuuugau

SEQ ID NO: 1562543 - RNA, 19 nt, Homo sapiens
uaagacaauggacccuuuu

SEQ ID NO: 1562544 - RNA, 13 nt, Homo sapiens
uaagacacauuga

SEQ ID NO: 1562545 - RNA, 18 nt, Homo sapiens
uaagagaaggggugcaga

SEQ ID NO: 1562546 - RNA, 18 nt, Homo sapiens
uaagagaaucaacauuuc

SEQ ID NO: 1562547 - RNA, 13 nt, Homo sapiens
uaagagguugauu

SEQ ID NO: 1562548 - RNA, 18 nt, Homo sapiens
uaagaguaaaauuccucu

SEQ ID NO: 1562549 - RNA, 19 nt, Homo sapiens
uaagauguccuccuugaua

SEQ ID NO: 1562550 - RNA, 21 nt, Homo sapiens
uaagauuuuguuugcaucuga

SEQ ID NO: 1562551 - RNA, 14 nt, Homo sapiens
uaagcaaaaugcca

SEQ ID NO: 1562552 - RNA, 20 nt, Homo sapiens
uaagcaaaaugugauaugua

SEQ ID NO: 1562553 - RNA, 17 nt, Homo sapiens
uaagcagcuuacuuagu

SEQ ID NO: 1562554 - RNA, 13 nt, Homo sapiens
uaagcaucuucaa

SEQ ID NO: 1562555 - RNA, 17 nt, Homo sapiens
uaagcauggauuuuccc

SEQ ID NO: 1562556 - RNA, 18 nt, Homo sapiens
uaagcaugugucccagga

SEQ ID NO: 1562557 - RNA, 20 nt, Homo sapiens
uaagcauuugaguuugcaaa

SEQ ID NO: 1562558 - RNA, 15 nt, Homo sapiens
uaagcuaaagcagug

SEQ ID NO: 1562559 - RNA, 14 nt, Homo sapiens
uaagcuacugccau

SEQ ID NO: 1562560 - RNA, 20 nt, Homo sapiens
uaagcugagcuccuuagccu

SEQ ID NO: 1562561 - RNA, 16 nt, Homo sapiens
uaagcuguaaccgaua

SEQ ID NO: 1562562 - RNA, 23 nt, Homo sapiens
uaagcuguaagauaauguugcuu

SEQ ID NO: 1562563 - RNA, 13 nt, Homo sapiens
uaaggaaauauua

SEQ ID NO: 1562564 - RNA, 22 nt, Homo sapiens
uaaggaauuauagaccucuagu

SEQ ID NO: 1562565 - RNA, 22 nt, Homo sapiens
uaaggacgggaccauuuuuaca

SEQ ID NO: 1562566 - RNA, 21 nt, Homo sapiens
uaaggaguauaccaugagaug

SEQ ID NO: 1562567 - RNA, 18 nt, Homo sapiens
uaaggcagcuaagacaua

SEQ ID NO: 1562568 - RNA, 22 nt, Homo sapiens
uaaggcuguccacguacuuaau

SEQ ID NO: 1562569 - RNA, 14 nt, Homo sapiens
uaagggaaacugcc

SEQ ID NO: 1562570 - RNA, 16 nt, Homo sapiens
uaagggaaacugccag

SEQ ID NO: 1562571 - RNA, 18 nt, Homo sapiens
uaagggacauuucuauaa

SEQ ID NO: 1562572 - RNA, 21 nt, Homo sapiens
uaagggcuuguuuuucuucag

SEQ ID NO: 1562573 - RNA, 19 nt, Homo sapiens
uaaggucugacaucagagg

SEQ ID NO: 1562574 - RNA, 21 nt, Homo sapiens
uaagguggacagcagacaaga

SEQ ID NO: 1562575 - RNA, 16 nt, Homo sapiens
uaagguguguacucag

SEQ ID NO: 1562576 - RNA, 19 nt, Homo sapiens
uaagguguguacucagggc

SEQ ID NO: 1562577 - RNA, 18 nt, Homo sapiens
uaaguaucacacuguaua

SEQ ID NO: 1562578 - RNA, 14 nt, Homo sapiens
uaagucuacauuaa

SEQ ID NO: 1562579 - RNA, 20 nt, Homo sapiens
uaagucuuuaaugccgauau

SEQ ID NO: 1562580 - RNA, 19 nt, Homo sapiens
uaagugaugugcugaauuu

SEQ ID NO: 1562581 - RNA, 12 nt, Homo sapiens
uagcuuugcucu

SEQ ID NO: 1562582 - RNA, 17 nt, Homo sapiens
uaggaaaagugaaucuu

SEQ ID NO: 1562583 - RNA, 15 nt, Homo sapiens
uaggaaaaucacuug

SEQ ID NO: 1562584 - RNA, 20 nt, Homo sapiens
uaggaaauaaaauuaaugaa

SEQ ID NO: 1562585 - RNA, 22 nt, Homo sapiens
uaggaaggcagcauuccaugac

SEQ ID NO: 1562586 - RNA, 13 nt, Homo sapiens
uaggaaucccaga

SEQ ID NO: 1562587 - RNA, 15 nt, Homo sapiens
uaggaauuacuuuau

SEQ ID NO: 1562588 - RNA, 11 nt, Homo sapiens
uaggaauuugu

SEQ ID NO: 1562589 - RNA, 13 nt, Homo sapiens
uaggacagcauau

SEQ ID NO: 1562590 - RNA, 16 nt, Homo sapiens
uaggacauugugucag

SEQ ID NO: 1562591 - RNA, 20 nt, Homo sapiens
uaggagaacugucaugagua

SEQ ID NO: 1562592 - RNA, 16 nt, Homo sapiens
uaggagaugaaacugg

SEQ ID NO: 1562593 - RNA, 19 nt, Homo sapiens
uaggaugaaucauauucau

SEQ ID NO: 1562594 - RNA, 15 nt, Homo sapiens
uaggauuaauaaaga

SEQ ID NO: 1562595 - RNA, 13 nt, Homo sapiens
uaggcaaagaagg

SEQ ID NO: 1562596 - RNA, 21 nt, Homo sapiens
uaggcagcaaaagaccaaauc

SEQ ID NO: 1562597 - RNA, 14 nt, Homo sapiens
uaggcauaccuccu

SEQ ID NO: 1562598 - RNA, 21 nt, Homo sapiens
uaggcaugguggacucgccug

SEQ ID NO: 1562599 - RNA, 17 nt, Homo sapiens
uaggccugaaaugacau

SEQ ID NO: 1562600 - RNA, 21 nt, Homo sapiens
uaggcuuuguaugacagugaa

SEQ ID NO: 1562601 - RNA, 23 nt, Homo sapiens
uagggaguuagaggcuguacaag

SEQ ID NO: 1562602 - RNA, 14 nt, Homo sapiens
uagggcugagcucu

SEQ ID NO: 1562603 - RNA, 21 nt, Homo sapiens
uaggucccuuggucuguacaa

SEQ ID NO: 1562604 - RNA, 22 nt, Homo sapiens
uaggucccuuggucuguacaaa

SEQ ID NO: 1562605 - RNA, 19 nt, Homo sapiens
uaggucuuucucucaguga

SEQ ID NO: 1562606 - RNA, 21 nt, Homo sapiens
uaggugacuuguuuacucauu

SEQ ID NO: 1562607 - RNA, 20 nt, Homo sapiens
uagguguccagcauugcugg

SEQ ID NO: 1562608 - RNA, 12 nt, Homo sapiens
uaguaaagcaaa

SEQ ID NO: 1562609 - RNA, 14 nt, Homo sapiens
uaguaacaauacau

SEQ ID NO: 1562610 - RNA, 20 nt, Homo sapiens
uaguaaucuacaaaggaaau

SEQ ID NO: 1562611 - RNA, 23 nt, Homo sapiens
uaguaauuuuguuuaugcugcuc

SEQ ID NO: 1562612 - RNA, 17 nt, Homo sapiens
uaguaccuucaauacuu

SEQ ID NO: 1562613 - RNA, 14 nt, Homo sapiens
uaguacuauugcua

SEQ ID NO: 1562614 - RNA, 15 nt, Homo sapiens
uaguacuauugcuau

SEQ ID NO: 1562615 - RNA, 15 nt, Homo sapiens
uaguagacacacuau

SEQ ID NO: 1562616 - RNA, 22 nt, Homo sapiens
uaguauaagucugggcacugga

SEQ ID NO: 1562617 - RNA, 14 nt, Homo sapiens
uaguauacaaaaag

SEQ ID NO: 1562618 - RNA, 18 nt, Homo sapiens
uaguaucagagaugucca

SEQ ID NO: 1562619 - RNA, 19 nt, Homo sapiens
uaguauuccucauucugca

SEQ ID NO: 1562620 - RNA, 17 nt, Homo sapiens
uagucaauuucuacuuc

SEQ ID NO: 1562621 - RNA, 14 nt, Homo sapiens
uagucaccagagac

SEQ ID NO: 1562622 - RNA, 18 nt, Homo sapiens
uagucacucauccauccc

SEQ ID NO: 1562623 - RNA, 19 nt, Homo sapiens
uagucagacugacacuacu

SEQ ID NO: 1562624 - RNA, 17 nt, Homo sapiens
uagucauggauaacuac

SEQ ID NO: 1562625 - RNA, 21 nt, Homo sapiens
uagucauuaacccaucucuga

SEQ ID NO: 1562626 - RNA, 15 nt, Homo sapiens
uagucccacuacuug

SEQ ID NO: 1562627 - RNA, 23 nt, Homo sapiens
uagucccagaaauaaacugagaa

SEQ ID NO: 1562628 - RNA, 23 nt, Homo sapiens
uagucccauuuuucucuugccau

SEQ ID NO: 1562629 - RNA, 16 nt, Homo sapiens
uagucuaucagcaucu

SEQ ID NO: 1562630 - RNA, 18 nt, Homo sapiens
uagucuaucagcaucuga

SEQ ID NO: 1562631 - RNA, 14 nt, Homo sapiens
uagucucaccagcc

SEQ ID NO: 1562632 - RNA, 21 nt, Homo sapiens
uagucuugaaaugaaagggaa

SEQ ID NO: 1562633 - RNA, 13 nt, Homo sapiens
uagucuuugccag

SEQ ID NO: 1562634 - RNA, 21 nt, Homo sapiens
uagugaaaaaugucacuauau

SEQ ID NO: 1562635 - RNA, 15 nt, Homo sapiens
uagugaaaugccaca

SEQ ID NO: 1562636 - RNA, 19 nt, Homo sapiens
uagugaaauggccacuacu

SEQ ID NO: 1562637 - RNA, 15 nt, Homo sapiens
uagugaauaaaguca

SEQ ID NO: 1562638 - RNA, 17 nt, Homo sapiens
uagugaccuguguuuca

SEQ ID NO: 1562639 - RNA, 14 nt, Homo sapiens
uagugcaauuccaa

SEQ ID NO: 1562640 - RNA, 19 nt, Homo sapiens
uagugcacaaaaugaauga

SEQ ID NO: 1562641 - RNA, 20 nt, Homo sapiens
uagugccacccaccuuugcc

SEQ ID NO: 1562642 - RNA, 23 nt, Homo sapiens
uagugccagguggcucagugcca

SEQ ID NO: 1562643 - RNA, 14 nt, Homo sapiens
uagugcuggucaga

SEQ ID NO: 1562644 - RNA, 19 nt, Homo sapiens
uaguggguacaucaagucc

SEQ ID NO: 1562645 - RNA, 21 nt, Homo sapiens
uagugguuuaucagcaaaaaa

SEQ ID NO: 1562646 - RNA, 18 nt, Homo sapiens
uaguguauccauaaugca

SEQ ID NO: 1562647 - RNA, 13 nt, Homo sapiens
uaguguguaaaau

SEQ ID NO: 1562648 - RNA, 14 nt, Homo sapiens
uaguguucacaaac

SEQ ID NO: 1562649 - RNA, 19 nt, Homo sapiens
uaguguucacaaacuguga

SEQ ID NO: 1562650 - RNA, 20 nt, Homo sapiens
uaguguucacaaacugugaa

SEQ ID NO: 1562651 - RNA, 18 nt, Homo sapiens
uaguuagauucacuuuga

SEQ ID NO: 1562652 - RNA, 15 nt, Homo sapiens
uaguuagccaucuaa

SEQ ID NO: 1562653 - RNA, 18 nt, Homo sapiens
uaguucacauacaaauca

SEQ ID NO: 1562654 - RNA, 19 nt, Homo sapiens
uaguucuacauuauucuuc

SEQ ID NO: 1562655 - RNA, 11 nt, Homo sapiens
uaguucuagau

SEQ ID NO: 1562656 - RNA, 20 nt, Homo sapiens
uaguuguuggucuguagcaa

SEQ ID NO: 1562657 - RNA, 23 nt, Homo sapiens
uaguuguuggucuguagcaagcu

SEQ ID NO: 1562658 - RNA, 16 nt, Homo sapiens
uaguuucagacuugga

SEQ ID NO: 1562659 - RNA, 10 nt, Homo sapiens
uaguuugaua

SEQ ID NO: 1562660 - RNA, 14 nt, Homo sapiens
uaguuuuacuuuua

SEQ ID NO: 1562661 - RNA, 20 nt, Homo sapiens
uaguuuuagcuguagaucaa

SEQ ID NO: 1562662 - RNA, 15 nt, Homo sapiens
uauaaaaagcuucca

SEQ ID NO: 1562663 - RNA, 14 nt, Homo sapiens
uauaaaaaguggag

SEQ ID NO: 1562664 - RNA, 14 nt, Homo sapiens
uauaaaacagucau

SEQ ID NO: 1562665 - RNA, 18 nt, Homo sapiens
uauaaacagaacuccacu

SEQ ID NO: 1562666 - RNA, 23 nt, Homo sapiens
uauaaacuauaaccucuccuuca

SEQ ID NO: 1562667 - RNA, 15 nt, Homo sapiens
uauaaauacugcaaa

SEQ ID NO: 1562668 - RNA, 17 nt, Homo sapiens
uauaaaucaugaugcua

SEQ ID NO: 1562669 - RNA, 16 nt, Homo sapiens
uauaaaugcaauaaga

SEQ ID NO: 1562670 - RNA, 21 nt, Homo sapiens
uauaaaugugauugcagcuuu

SEQ ID NO: 1562671 - RNA, 11 nt, Homo sapiens
uauaacagugu

SEQ ID NO: 1562672 - RNA, 13 nt, Homo sapiens
uauaacaguguuu

SEQ ID NO: 1562673 - RNA, 14 nt, Homo sapiens
uauaacuaacaugu

SEQ ID NO: 1562674 - RNA, 22 nt, Homo sapiens
uauaacucuccuuugcucucug

SEQ ID NO: 1562675 - RNA, 18 nt, Homo sapiens
uauaacucugcacuacuc

SEQ ID NO: 1562676 - RNA, 12 nt, Homo sapiens
uauaacugucuu

SEQ ID NO: 1562677 - RNA, 18 nt, Homo sapiens
uauaagaaagaucaaaga

SEQ ID NO: 1562678 - RNA, 14 nt, Homo sapiens
uauaagauuccaaa

SEQ ID NO: 1562679 - RNA, 16 nt, Homo sapiens
uauaagcaucugccau

SEQ ID NO: 1562680 - RNA, 22 nt, Homo sapiens
uauaagcuuuuuucucaauaaa

SEQ ID NO: 1562681 - RNA, 21 nt, Homo sapiens
uauaauaaaaagcuucaggga

SEQ ID NO: 1562682 - RNA, 16 nt, Homo sapiens
uauaaucccacccacc

SEQ ID NO: 1562683 - RNA, 16 nt, Homo sapiens
uauaaugcuugcaccu

SEQ ID NO: 1562684 - RNA, 13 nt, Homo sapiens
uauaaugcuugga

SEQ ID NO: 1562685 - RNA, 18 nt, Homo sapiens
uauaauguauacauuaca

SEQ ID NO: 1562686 - RNA, 16 nt, Homo sapiens
uauacaaaacuuuauc

SEQ ID NO: 1562687 - RNA, 23 nt, Homo sapiens
uauacaauaauugaaguguuccc

SEQ ID NO: 1562688 - RNA, 21 nt, Homo sapiens
uauacauagucuuuguuuaca

SEQ ID NO: 1562689 - RNA, 10 nt, Homo sapiens
uauacauaug

SEQ ID NO: 1562690 - RNA, 22 nt, Homo sapiens
uauacaucuuccccuaaugccu

SEQ ID NO: 1562691 - RNA, 16 nt, Homo sapiens
uauacaugaccuuaau

SEQ ID NO: 1562692 - RNA, 16 nt, Homo sapiens
uauacauuacaucuga

SEQ ID NO: 1562693 - RNA, 22 nt, Homo sapiens
uauaccccaaauuguguauaua

SEQ ID NO: 1562694 - RNA, 23 nt, Homo sapiens
uauaccugccuuuuaaguuugaa

SEQ ID NO: 1562695 - RNA, 19 nt, Homo sapiens
uauacgcuggcaacacaga

SEQ ID NO: 1562696 - RNA, 15 nt, Homo sapiens
uauacguauaaauau

SEQ ID NO: 1562697 - RNA, 19 nt, Homo sapiens
uauacuaaaccaacucuaa

SEQ ID NO: 1562698 - RNA, 18 nt, Homo sapiens
uauacucagguaccucuu

SEQ ID NO: 1562699 - RNA, 19 nt, Homo sapiens
ucacuagaguucuuugaac

SEQ ID NO: 1562700 - RNA, 15 nt, Homo sapiens
ucacucacauugaga

SEQ ID NO: 1562701 - RNA, 17 nt, Homo sapiens
ucacuccucugucauau

SEQ ID NO: 1562702 - RNA, 19 nt, Homo sapiens
ucacucucaaacuucacua

SEQ ID NO: 1562703 - RNA, 17 nt, Homo sapiens
ucacucugucagccagc

SEQ ID NO: 1562704 - RNA, 14 nt, Homo sapiens
ucacucuguuaaua

SEQ ID NO: 1562705 - RNA, 12 nt, Homo sapiens
ucacucuguugc

SEQ ID NO: 1562706 - RNA, 14 nt, Homo sapiens
ucacugacaguuaa

SEQ ID NO: 1562707 - RNA, 12 nt, Homo sapiens
ucacugcaauuu

SEQ ID NO: 1562708 - RNA, 17 nt, Homo sapiens
ucacugccaucacauca

SEQ ID NO: 1562709 - RNA, 17 nt, Homo sapiens
ucacugccccucucuca

SEQ ID NO: 1562710 - RNA, 16 nt, Homo sapiens
ucacugcuguagacau

SEQ ID NO: 1562711 - RNA, 21 nt, Homo sapiens
ucacuggagguugaagccaag

SEQ ID NO: 1562712 - RNA, 15 nt, Homo sapiens
ucacuuaaacuuugu

SEQ ID NO: 1562713 - RNA, 19 nt, Homo sapiens
ucacuucauagcucaccag

SEQ ID NO: 1562714 - RNA, 18 nt, Homo sapiens
ucacuucuaccuacauau

SEQ ID NO: 1562715 - RNA, 16 nt, Homo sapiens
ucacuugaaccgggga

SEQ ID NO: 1562716 - RNA, 12 nt, Homo sapiens
ucacuugcucaa

SEQ ID NO: 1562717 - RNA, 17 nt, Homo sapiens
ucacuuguguguguacc

SEQ ID NO: 1562718 - RNA, 20 nt, Homo sapiens
ucacuuuaauagaagggcaa

SEQ ID NO: 1562719 - RNA, 17 nt, Homo sapiens
ucagaaaaaacaggccc

SEQ ID NO: 1562720 - RNA, 23 nt, Homo sapiens
ucagaaaacauaauauagcuuaa

SEQ ID NO: 1562721 - RNA, 14 nt, Homo sapiens
ucagaaaaccaaag

SEQ ID NO: 1562722 - RNA, 22 nt, Homo sapiens
ucagaaaauguucuguuugcug

SEQ ID NO: 1562723 - RNA, 13 nt, Homo sapiens
ucagaaagccaac

SEQ ID NO: 1562724 - RNA, 17 nt, Homo sapiens
ucagaacaagcaauugu

SEQ ID NO: 1562725 - RNA, 12 nt, Homo sapiens
ucagaagauauc

SEQ ID NO: 1562726 - RNA, 18 nt, Homo sapiens
ucagaaggccccagagag

SEQ ID NO: 1562727 - RNA, 17 nt, Homo sapiens
ucagaaguucaaggcca

SEQ ID NO: 1562728 - RNA, 15 nt, Homo sapiens
ucagaauagccacau

SEQ ID NO: 1562729 - RNA, 15 nt, Homo sapiens
ucagaauccacaacu

SEQ ID NO: 1562730 - RNA, 14 nt, Homo sapiens
ucagaauguguuau

SEQ ID NO: 1562731 - RNA, 16 nt, Homo sapiens
ucagaauuaagcagaa

SEQ ID NO: 1562732 - RNA, 20 nt, Homo sapiens
ucagacaucagucaauggaa

SEQ ID NO: 1562733 - RNA, 20 nt, Homo sapiens
ucagacauuuauauauugga

SEQ ID NO: 1562734 - RNA, 14 nt, Homo sapiens
ucagaccugcauug

SEQ ID NO: 1562735 - RNA, 12 nt, Homo sapiens
ucagacugcaau

SEQ ID NO: 1562736 - RNA, 23 nt, Homo sapiens
ucagacuuggaguaaaacuguau

SEQ ID NO: 1562737 - RNA, 13 nt, Homo sapiens
ucagacuugucaa

SEQ ID NO: 1562738 - RNA, 21 nt, Homo sapiens
ucagacuuuguguucauuuca

SEQ ID NO: 1562739 - RNA, 23 nt, Homo sapiens
ucagaggaccuguauuuaagcaa

SEQ ID NO: 1562740 - RNA, 12 nt, Homo sapiens
ucagagugccac

SEQ ID NO: 1562741 - RNA, 21 nt, Homo sapiens
ucagauaaugccaccaaagga

SEQ ID NO: 1562742 - RNA, 16 nt, Homo sapiens
ucagauaggagugaau

SEQ ID NO: 1562743 - RNA, 13 nt, Homo sapiens
ucagaucaugccc

SEQ ID NO: 1562744 - RNA, 16 nt, Homo sapiens
ucagaugaucucucca

SEQ ID NO: 1562745 - RNA, 19 nt, Homo sapiens
ucagaugcaauugcuccca

SEQ ID NO: 1562746 - RNA, 20 nt, Homo sapiens
ucagaugccucaguaggcau

SEQ ID NO: 1562747 - RNA, 14 nt, Homo sapiens
ucagauguaaauag

SEQ ID NO: 1562748 - RNA, 12 nt, Homo sapiens
ucagauguuuca

SEQ ID NO: 1562749 - RNA, 23 nt, Homo sapiens
ucagauuaccaguuauaggaaca

SEQ ID NO: 1562750 - RNA, 18 nt, Homo sapiens
ucagauuuugguugcuaa

SEQ ID NO: 1562751 - RNA, 21 nt, Homo sapiens
ucagauuuuuuccucugcauu

SEQ ID NO: 1562752 - RNA, 20 nt, Homo sapiens
ucagcaaacggugaccagca

SEQ ID NO: 1562753 - RNA, 21 nt, Homo sapiens
ucagcaacccuacaguauaua

SEQ ID NO: 1562754 - RNA, 16 nt, Homo sapiens
ucagcaacucgcuuua

SEQ ID NO: 1562755 - RNA, 16 nt, Homo sapiens
ucagcaacuguuuaac

SEQ ID NO: 1562756 - RNA, 21 nt, Homo sapiens
ucagcaaguuagaacuagcca

SEQ ID NO: 1562757 - RNA, 22 nt, Homo sapiens
ucagcaccuacaguguacaguc

SEQ ID NO: 1562758 - RNA, 17 nt, Homo sapiens
ucagcacucuguaaaac

SEQ ID NO: 1562759 - RNA, 14 nt, Homo sapiens
ucagcacuguuaca

SEQ ID NO: 1562760 - RNA, 15 nt, Homo sapiens
ucagcagacacaggu

SEQ ID NO: 1562761 - RNA, 16 nt, Homo sapiens
ucagcagugaaguaua

SEQ ID NO: 1562762 - RNA, 19 nt, Homo sapiens
ucagcauuuccacaccaag

SEQ ID NO: 1562763 - RNA, 15 nt, Homo sapiens
ucagcauuugaucug

SEQ ID NO: 1562764 - RNA, 23 nt, Homo sapiens
ucagcauuuucuucucugcacuu

SEQ ID NO: 1562765 - RNA, 13 nt, Homo sapiens
ucagccaagugca

SEQ ID NO: 1562766 - RNA, 21 nt, Homo sapiens
ucagccaauccgauugccuua

SEQ ID NO: 1562767 - RNA, 19 nt, Homo sapiens
ucagccacuugccugugcu

SEQ ID NO: 1562768 - RNA, 18 nt, Homo sapiens
ucagccauaggugcaguu

SEQ ID NO: 1562769 - RNA, 20 nt, Homo sapiens
ucagccaucguccugggacu

SEQ ID NO: 1562770 - RNA, 12 nt, Homo sapiens
ucagccaugagg

SEQ ID NO: 1562771 - RNA, 22 nt, Homo sapiens
ucagcccagccccuccaaaggu

SEQ ID NO: 1562772 - RNA, 22 nt, Homo sapiens
ucagccugggcaacauggugaa

SEQ ID NO: 1562773 - RNA, 17 nt, Homo sapiens
ucagcgcgguccugacu

SEQ ID NO: 1562774 - RNA, 14 nt, Homo sapiens
ucagcucaccucaa

SEQ ID NO: 1562775 - RNA, 14 nt, Homo sapiens
ucagcuccuuccac

SEQ ID NO: 1562776 - RNA, 15 nt, Homo sapiens
ucagcucugccuugc

SEQ ID NO: 1562777 - RNA, 15 nt, Homo sapiens
ucagcucuguuuacg

SEQ ID NO: 1562778 - RNA, 23 nt, Homo sapiens
ucagcucuguuuacgaagcaaua

SEQ ID NO: 1562779 - RNA, 19 nt, Homo sapiens
ucagcuuugggguuccuuu

SEQ ID NO: 1562780 - RNA, 20 nt, Homo sapiens
ucaggaaaucaaauaugcaa

SEQ ID NO: 1562781 - RNA, 16 nt, Homo sapiens
ucaggaagccagguga

SEQ ID NO: 1562782 - RNA, 20 nt, Homo sapiens
ucaggacagguggugcaaau

SEQ ID NO: 1562783 - RNA, 12 nt, Homo sapiens
ucaggaccugcu

SEQ ID NO: 1562784 - RNA, 13 nt, Homo sapiens
ucaggcacacagc

SEQ ID NO: 1562785 - RNA, 13 nt, Homo sapiens
ucaggccagccca

SEQ ID NO: 1562786 - RNA, 13 nt, Homo sapiens
ucaggcccaggag

SEQ ID NO: 1562787 - RNA, 20 nt, Homo sapiens
ucaggccuggccucaucuca

SEQ ID NO: 1562788 - RNA, 13 nt, Homo sapiens
ucagggaccugcu

SEQ ID NO: 1562789 - RNA, 24 nt, Homo sapiens
ucagggcccaucccuucucugcag

SEQ ID NO: 1562790 - RNA, 15 nt, Homo sapiens
ucagggccucaggca

SEQ ID NO: 1562791 - RNA, 16 nt, Homo sapiens
ucagggccucaggcac

SEQ ID NO: 1562792 - RNA, 21 nt, Homo sapiens
ucaggguaccuggggccaaac

SEQ ID NO: 1562793 - RNA, 14 nt, Homo sapiens
ucagguggaaaaac

SEQ ID NO: 1562794 - RNA, 21 nt, Homo sapiens
ucagguggagagcacuagaag

SEQ ID NO: 1562795 - RNA, 13 nt, Homo sapiens
ucaggugugacuc

SEQ ID NO: 1562796 - RNA, 17 nt, Homo sapiens
ucagguguuacuagaag

SEQ ID NO: 1562797 - RNA, 21 nt, Homo sapiens
ucagguuuguuuugugaauuu

SEQ ID NO: 1562798 - RNA, 20 nt, Homo sapiens
ucaguaaagaacguggucag

SEQ ID NO: 1562799 - RNA, 12 nt, Homo sapiens
ucaguaacauaa

SEQ ID NO: 1562800 - RNA, 18 nt, Homo sapiens
ucaguaacugugcaucug

SEQ ID NO: 1562801 - RNA, 15 nt, Homo sapiens
ucaguaagucucaua

SEQ ID NO: 1562802 - RNA, 19 nt, Homo sapiens
ucaguaauaaaaccgguca

SEQ ID NO: 1562803 - RNA, 19 nt, Homo sapiens
ucaguacaugccuagaccu

SEQ ID NO: 1562804 - RNA, 12 nt, Homo sapiens
ucaguaccccau

SEQ ID NO: 1562805 - RNA, 19 nt, Homo sapiens
ucaguagccauaucuucca

SEQ ID NO: 1562806 - RNA, 12 nt, Homo sapiens
ucaguaugucac

SEQ ID NO: 1562807 - RNA, 11 nt, Homo sapiens
ucaguaugugg

SEQ ID NO: 1562808 - RNA, 12 nt, Homo sapiens
ucaguaugugga

SEQ ID NO: 1562809 - RNA, 21 nt, Homo sapiens
ucaguauuaaauuagauaucu

SEQ ID NO: 1562810 - RNA, 14 nt, Homo sapiens
ucaguauuuucaca

SEQ ID NO: 1562811 - RNA, 14 nt, Homo sapiens
ucaguauuuuccag

SEQ ID NO: 1562812 - RNA, 17 nt, Homo sapiens
ucagucaaaacuuuaaa

SEQ ID NO: 1562813 - RNA, 15 nt, Homo sapiens
ucagucaauagccau

SEQ ID NO: 1562814 - RNA, 22 nt, Homo sapiens
ucagucauuucuucauguacag

SEQ ID NO: 1562815 - RNA, 16 nt, Homo sapiens
ucagucccuacugagu

SEQ ID NO: 1562816 - RNA, 21 nt, Homo sapiens
ucagucucugaauacacagua

SEQ ID NO: 1562817 - RNA, 21 nt, Homo sapiens
ucagugaagaauacuucucau

SEQ ID NO: 1562818 - RNA, 14 nt, Homo sapiens
ugcuguuaccaaau

SEQ ID NO: 1562819 - RNA, 19 nt, Homo sapiens
ugcuguuuaaagucacauc

SEQ ID NO: 1562820 - RNA, 17 nt, Homo sapiens
ugcuguuuauacuugag

SEQ ID NO: 1562821 - RNA, 21 nt, Homo sapiens
ugcuuaaacccuuuagugcuu

SEQ ID NO: 1562822 - RNA, 18 nt, Homo sapiens
ugcuuaaacuugacccag

SEQ ID NO: 1562823 - RNA, 14 nt, Homo sapiens
ugcuuaaucuugcu

SEQ ID NO: 1562824 - RNA, 16 nt, Homo sapiens
ugcuuaccugaucuca

SEQ ID NO: 1562825 - RNA, 23 nt, Homo sapiens
ugcuuagcuugagggugacuaug

SEQ ID NO: 1562826 - RNA, 23 nt, Homo sapiens
ugcuuaguauucuugagggacaa

SEQ ID NO: 1562827 - RNA, 18 nt, Homo sapiens
ugcuucacagguuuuaug

SEQ ID NO: 1562828 - RNA, 16 nt, Homo sapiens
ugcuucaguugcauau

SEQ ID NO: 1562829 - RNA, 22 nt, Homo sapiens
ugcuucuaguucugccaggaga

SEQ ID NO: 1562830 - RNA, 16 nt, Homo sapiens
ugcuucuuaugguggu

SEQ ID NO: 1562831 - RNA, 15 nt, Homo sapiens
ugcuugaauggagcu

SEQ ID NO: 1562832 - RNA, 14 nt, Homo sapiens
ugcuugaccaaaga

SEQ ID NO: 1562833 - RNA, 17 nt, Homo sapiens
ugcuugcaauguaguca

SEQ ID NO: 1562834 - RNA, 23 nt, Homo sapiens
ugcuugggaccagaaguguuuca

SEQ ID NO: 1562835 - RNA, 16 nt, Homo sapiens
ugcuugggagccugug

SEQ ID NO: 1562836 - RNA, 18 nt, Homo sapiens
ugcuuguuuacagcacua

SEQ ID NO: 1562837 - RNA, 21 nt, Homo sapiens
ugcuuuccuucuuugggauag

SEQ ID NO: 1562838 - RNA, 21 nt, Homo sapiens
ugcuuucuauuuuacauugag

SEQ ID NO: 1562839 - RNA, 16 nt, Homo sapiens
ugcuuucugcucuuua

SEQ ID NO: 1562840 - RNA, 19 nt, Homo sapiens
ugcuuucuuguugcugcau

SEQ ID NO: 1562841 - RNA, 12 nt, Homo sapiens
ugcuuugcugac

SEQ ID NO: 1562842 - RNA, 20 nt, Homo sapiens
ugcuuuuaaaagugcacauu

SEQ ID NO: 1562843 - RNA, 16 nt, Homo sapiens
ugcuuuuaacucuaga

SEQ ID NO: 1562844 - RNA, 15 nt, Homo sapiens
ugcuuuuacuucucu

SEQ ID NO: 1562845 - RNA, 16 nt, Homo sapiens
ugcuuuucccauugcc

SEQ ID NO: 1562846 - RNA, 18 nt, Homo sapiens
ugcuuuugaaaaacaacu

SEQ ID NO: 1562847 - RNA, 18 nt, Homo sapiens
ugcuuuuuggaaagucag

SEQ ID NO: 1562848 - RNA, 17 nt, Homo sapiens
ugcuuuuuuucagggaa

SEQ ID NO: 1562849 - RNA, 14 nt, Homo sapiens
ugcuuuuuuuccaa

SEQ ID NO: 1562850 - RNA, 16 nt, Homo sapiens
uggaaaaaugauuuaa

SEQ ID NO: 1562851 - RNA, 16 nt, Homo sapiens
uggaaacauggaggaa

SEQ ID NO: 1562852 - RNA, 15 nt, Homo sapiens
uggaaacugcucaga

SEQ ID NO: 1562853 - RNA, 16 nt, Homo sapiens
uggaaagucaugcaau

SEQ ID NO: 1562854 - RNA, 18 nt, Homo sapiens
uggaaaucugaacauucu

SEQ ID NO: 1562855 - RNA, 14 nt, Homo sapiens
uggaacaacagaug

SEQ ID NO: 1562856 - RNA, 14 nt, Homo sapiens
uggaacagauuuca

SEQ ID NO: 1562857 - RNA, 21 nt, Homo sapiens
uggaacagcauuacccuccuc

SEQ ID NO: 1562858 - RNA, 20 nt, Homo sapiens
uggaacuauacccgggacca

SEQ ID NO: 1562859 - RNA, 15 nt, Homo sapiens
uggaacuguguuuca

SEQ ID NO: 1562860 - RNA, 16 nt, Homo sapiens
uggaacuuacauacau

SEQ ID NO: 1562861 - RNA, 17 nt, Homo sapiens
uggaacuuuauuuacac

SEQ ID NO: 1562862 - RNA, 16 nt, Homo sapiens
uggaagaaagcaacaa

SEQ ID NO: 1562863 - RNA, 20 nt, Homo sapiens
uggaagaaagcaacaaagau

SEQ ID NO: 1562864 - RNA, 23 nt, Homo sapiens
uggaagagagaaagcauauugac

SEQ ID NO: 1562865 - RNA, 18 nt, Homo sapiens
uggaagcaggacagacac

SEQ ID NO: 1562866 - RNA, 18 nt, Homo sapiens
uggaagcuaauuugcauu

SEQ ID NO: 1562867 - RNA, 17 nt, Homo sapiens
uggaagcucuucuuccc

SEQ ID NO: 1562868 - RNA, 16 nt, Homo sapiens
uggaaggaacauggag

SEQ ID NO: 1562869 - RNA, 13 nt, Homo sapiens
uggaaggggucca

SEQ ID NO: 1562870 - RNA, 14 nt, Homo sapiens
uggaagucaucuca

SEQ ID NO: 1562871 - RNA, 20 nt, Homo sapiens
uggaagucaucucauuccac

SEQ ID NO: 1562872 - RNA, 15 nt, Homo sapiens
uggaaguccagaaca

SEQ ID NO: 1562873 - RNA, 20 nt, Homo sapiens
uggaagugugugccaagagc

SEQ ID NO: 1562874 - RNA, 20 nt, Homo sapiens
uggaauaaaguugcagauga

SEQ ID NO: 1562875 - RNA, 19 nt, Homo sapiens
uggaauaucaucugucauu

SEQ ID NO: 1562876 - RNA, 20 nt, Homo sapiens
uggaauauuaaaaaacuuca

SEQ ID NO: 1562877 - RNA, 12 nt, Homo sapiens
uggaaucuggag

SEQ ID NO: 1562878 - RNA, 17 nt, Homo sapiens
uggaaugaagguaauau

SEQ ID NO: 1562879 - RNA, 21 nt, Homo sapiens
uggaauuauuguagacaugcc

SEQ ID NO: 1562880 - RNA, 15 nt, Homo sapiens
uggaauucuacugga

SEQ ID NO: 1562881 - RNA, 16 nt, Homo sapiens
uggaauucuacuggaa

SEQ ID NO: 1562882 - RNA, 17 nt, Homo sapiens
uggaauucuacuggaaa

SEQ ID NO: 1562883 - RNA, 12 nt, Homo sapiens
uggaauucuucu

SEQ ID NO: 1562884 - RNA, 21 nt, Homo sapiens
uggaauuuugcaaagauuuaa

SEQ ID NO: 1562885 - RNA, 21 nt, Homo sapiens
uggacacaauaggucuuucuc

SEQ ID NO: 1562886 - RNA, 15 nt, Homo sapiens
uggacacucuauaug

SEQ ID NO: 1562887 - RNA, 14 nt, Homo sapiens
uggacacugagaac

SEQ ID NO: 1562888 - RNA, 10 nt, Homo sapiens
uggacacugu

SEQ ID NO: 1562889 - RNA, 14 nt, Homo sapiens
uggaccaagcacaa

SEQ ID NO: 1562890 - RNA, 22 nt, Homo sapiens
uggaccaauagggcugagcucu

SEQ ID NO: 1562891 - RNA, 17 nt, Homo sapiens
uggaccagccucuccac

SEQ ID NO: 1562892 - RNA, 14 nt, Homo sapiens
uggaccaugccaga

SEQ ID NO: 1562893 - RNA, 22 nt, Homo sapiens
uggacccaaaaaaucaucucac

SEQ ID NO: 1562894 - RNA, 14 nt, Homo sapiens
uggacccccuggaa

SEQ ID NO: 1562895 - RNA, 19 nt, Homo sapiens
uggacccccuggaagcuga

SEQ ID NO: 1562896 - RNA, 16 nt, Homo sapiens
uggacggaaugggaug

SEQ ID NO: 1562897 - RNA, 15 nt, Homo sapiens
uggacggacaagaca

SEQ ID NO: 1562898 - RNA, 14 nt, Homo sapiens
uggacgugucaggu

SEQ ID NO: 1562899 - RNA, 18 nt, Homo sapiens
uggacuaaaacauuuuga

SEQ ID NO: 1562900 - RNA, 13 nt, Homo sapiens
uggacuccaccuu

SEQ ID NO: 1562901 - RNA, 20 nt, Homo sapiens
uggacucgccuguaaucuca

SEQ ID NO: 1562902 - RNA, 21 nt, Homo sapiens
uggacuguuccaggcccucca

SEQ ID NO: 1562903 - RNA, 20 nt, Homo sapiens
uggacuuauucauuccucac

SEQ ID NO: 1562904 - RNA, 12 nt, Homo sapiens
uggacuuguccc

SEQ ID NO: 1562905 - RNA, 13 nt, Homo sapiens
uggagaaagcuca

SEQ ID NO: 1562906 - RNA, 16 nt, Homo sapiens
uggagaaaucuacuga

SEQ ID NO: 1562907 - RNA, 23 nt, Homo sapiens
uggagaaccagggcucuucucag

SEQ ID NO: 1562908 - RNA, 17 nt, Homo sapiens
uggagacaaggugcuaa

SEQ ID NO: 1562909 - RNA, 23 nt, Homo sapiens
uggagacccugccacagccagag

SEQ ID NO: 1562910 - RNA, 12 nt, Homo sapiens
uggagagccacc

SEQ ID NO: 1562911 - RNA, 23 nt, Homo sapiens
uggagauucaguuuucauuuggu

SEQ ID NO: 1562912 - RNA, 23 nt, Homo sapiens
uggagcuccucccuccagcugcg

SEQ ID NO: 1562913 - RNA, 15 nt, Homo sapiens
uggagcugacuguuc

SEQ ID NO: 1562914 - RNA, 11 nt, Homo sapiens
uggagcuguca

SEQ ID NO: 1562915 - RNA, 16 nt, Homo sapiens
uggaggaacuuuccaa

SEQ ID NO: 1562916 - RNA, 16 nt, Homo sapiens
uggaggaagagccacc

SEQ ID NO: 1562917 - RNA, 20 nt, Homo sapiens
uggaggacagagggagacag

SEQ ID NO: 1562918 - RNA, 23 nt, Homo sapiens
uggaggaccuuggccuguucauu

SEQ ID NO: 1562919 - RNA, 18 nt, Homo sapiens
uggaggcaacagggccau

SEQ ID NO: 1562920 - RNA, 14 nt, Homo sapiens
uggaggccacuguu

SEQ ID NO: 1562921 - RNA, 19 nt, Homo sapiens
uggagggcuagaaccugga

SEQ ID NO: 1562922 - RNA, 20 nt, Homo sapiens
uggagggcuagaaccuggca

SEQ ID NO: 1562923 - RNA, 19 nt, Homo sapiens
uggagggcuggaaucugga

SEQ ID NO: 1562924 - RNA, 22 nt, Homo sapiens
uggagggguggcccagagccau

SEQ ID NO: 1562925 - RNA, 18 nt, Homo sapiens
uggaguagauauuaauua

SEQ ID NO: 1562926 - RNA, 13 nt, Homo sapiens
uggagucacugua

SEQ ID NO: 1562927 - RNA, 20 nt, Homo sapiens
uggagugcaguggugccauc

SEQ ID NO: 1562928 - RNA, 21 nt, Homo sapiens
uggagugcaguggugccauca

SEQ ID NO: 1562929 - RNA, 15 nt, Homo sapiens
uggauaaauugcaca

SEQ ID NO: 1562930 - RNA, 22 nt, Homo sapiens
uggauagauaauuuuauuugaa

SEQ ID NO: 1562931 - RNA, 15 nt, Homo sapiens
uggaucaccauuaua

SEQ ID NO: 1562932 - RNA, 18 nt, Homo sapiens
uggaucaccugaggucag

SEQ ID NO: 1562933 - RNA, 12 nt, Homo sapiens
uggaucagaaua

SEQ ID NO: 1562934 - RNA, 14 nt, Homo sapiens
uggauccagcacug

SEQ ID NO: 1562935 - RNA, 16 nt, Homo sapiens
uggauccugcacucua

SEQ ID NO: 1562936 - RNA, 19 nt, Homo sapiens
ugugauguggugcguguga

SEQ ID NO: 1562937 - RNA, 14 nt, Homo sapiens
ugugauguguccug

SEQ ID NO: 1562938 - RNA, 23 nt, Homo sapiens
ugugauugaaggugauaagggaa

SEQ ID NO: 1562939 - RNA, 22 nt, Homo sapiens
ugugcaaacauggagaaaucua

SEQ ID NO: 1562940 - RNA, 22 nt, Homo sapiens
ugugcaagaccguuuguccacu

SEQ ID NO: 1562941 - RNA, 19 nt, Homo sapiens
ugugcacaucuacaugcca

SEQ ID NO: 1562942 - RNA, 15 nt, Homo sapiens
ugugcacccagaaga

SEQ ID NO: 1562943 - RNA, 17 nt, Homo sapiens
ugugcaccuguaauccc

SEQ ID NO: 1562944 - RNA, 14 nt, Homo sapiens
ugugcagauaucac

SEQ ID NO: 1562945 - RNA, 14 nt, Homo sapiens
ugugcagcauuaaa

SEQ ID NO: 1562946 - RNA, 15 nt, Homo sapiens
ugugcagcuucgagg

SEQ ID NO: 1562947 - RNA, 21 nt, Homo sapiens
ugugccaaaccuacuaggcca

SEQ ID NO: 1562948 - RNA, 18 nt, Homo sapiens
ugugcccaguacuuccug

SEQ ID NO: 1562949 - RNA, 19 nt, Homo sapiens
ugugcccgacugacuggag

SEQ ID NO: 1562950 - RNA, 14 nt, Homo sapiens
ugugccuauagucc

SEQ ID NO: 1562951 - RNA, 18 nt, Homo sapiens
ugugccuuccagauccuc

SEQ ID NO: 1562952 - RNA, 18 nt, Homo sapiens
ugugcuaucacaggguca

SEQ ID NO: 1562953 - RNA, 12 nt, Homo sapiens
ugugcugcucaa

SEQ ID NO: 1562954 - RNA, 13 nt, Homo sapiens
ugugcuggggucu

SEQ ID NO: 1562955 - RNA, 20 nt, Homo sapiens
ugugcugguacgacuaugug

SEQ ID NO: 1562956 - RNA, 19 nt, Homo sapiens
uguggaauaauacauacua

SEQ ID NO: 1562957 - RNA, 18 nt, Homo sapiens
uguggaccaccccacaga

SEQ ID NO: 1562958 - RNA, 16 nt, Homo sapiens
uguggaugagaggaac

SEQ ID NO: 1562959 - RNA, 23 nt, Homo sapiens
uguggcccucuggauccagccau

SEQ ID NO: 1562960 - RNA, 13 nt, Homo sapiens
uguggggauuuuc

SEQ ID NO: 1562961 - RNA, 13 nt, Homo sapiens
ugugggggguccu

SEQ ID NO: 1562962 - RNA, 17 nt, Homo sapiens
ugugggugccuuccaua

SEQ ID NO: 1562963 - RNA, 18 nt, Homo sapiens
uguggguuugguccuuga

SEQ ID NO: 1562964 - RNA, 14 nt, Homo sapiens
uguggucacaggaa

SEQ ID NO: 1562965 - RNA, 16 nt, Homo sapiens
uguguaauuagugcca

SEQ ID NO: 1562966 - RNA, 23 nt, Homo sapiens
uguguaauuuuuuuuccuugccu

SEQ ID NO: 1562967 - RNA, 21 nt, Homo sapiens
uguguacaguugguucauccc

SEQ ID NO: 1562968 - RNA, 14 nt, Homo sapiens
uguguacucagggc

SEQ ID NO: 1562969 - RNA, 14 nt, Homo sapiens
uguguauacauaca

SEQ ID NO: 1562970 - RNA, 22 nt, Homo sapiens
uguguccccucacucugucagc

SEQ ID NO: 1562971 - RNA, 12 nt, Homo sapiens
uguguccugggg

SEQ ID NO: 1562972 - RNA, 19 nt, Homo sapiens
ugugugcccuggacuguuu

SEQ ID NO: 1562973 - RNA, 11 nt, Homo sapiens
ugugugccuuu

SEQ ID NO: 1562974 - RNA, 19 nt, Homo sapiens
ugugugccuuuguuuccca

SEQ ID NO: 1562975 - RNA, 20 nt, Homo sapiens
ugugugcuugagugugugaa

SEQ ID NO: 1562976 - RNA, 24 nt, Homo sapiens
uguguucaagugcgugacuguaug

SEQ ID NO: 1562977 - RNA, 17 nt, Homo sapiens
uguguucaaucugugaa

SEQ ID NO: 1562978 - RNA, 15 nt, Homo sapiens
uguguuggcuuugca

SEQ ID NO: 1562979 - RNA, 13 nt, Homo sapiens
uguguuucuuuag

SEQ ID NO: 1562980 - RNA, 22 nt, Homo sapiens
uguguuuugaaugguguuguau

SEQ ID NO: 1562981 - RNA, 15 nt, Homo sapiens
uguuaaauacaggaa

SEQ ID NO: 1562982 - RNA, 13 nt, Homo sapiens
uguuaacauuagc

SEQ ID NO: 1562983 - RNA, 19 nt, Homo sapiens
uguuaacauuagcaaauau

SEQ ID NO: 1562984 - RNA, 14 nt, Homo sapiens
uguuaauaucacuc

SEQ ID NO: 1562985 - RNA, 15 nt, Homo sapiens
uguuaaucacauucc

SEQ ID NO: 1562986 - RNA, 20 nt, Homo sapiens
uguuacaacuuguauuucca

SEQ ID NO: 1562987 - RNA, 19 nt, Homo sapiens
uguuacacagcccaagagg

SEQ ID NO: 1562988 - RNA, 16 nt, Homo sapiens
uguuaccaaaucucag

SEQ ID NO: 1562989 - RNA, 15 nt, Homo sapiens
uguuaccauucacaa

SEQ ID NO: 1562990 - RNA, 22 nt, Homo sapiens
uguuaccuguagauucagguaa

SEQ ID NO: 1562991 - RNA, 14 nt, Homo sapiens
uguuacuguaauuc

SEQ ID NO: 1562992 - RNA, 20 nt, Homo sapiens
uguuagaacacuauuuucag

SEQ ID NO: 1562993 - RNA, 15 nt, Homo sapiens
uguuagacuugcucc

SEQ ID NO: 1562994 - RNA, 17 nt, Homo sapiens
uguuagaucaaccucca

SEQ ID NO: 1562995 - RNA, 16 nt, Homo sapiens
uguuauacugaaccag

SEQ ID NO: 1562996 - RNA, 18 nt, Homo sapiens
uguuauagaacuucaugg

SEQ ID NO: 1562997 - RNA, 14 nt, Homo sapiens
uguuauagcuuuaa

SEQ ID NO: 1562998 - RNA, 20 nt, Homo sapiens
uguuaucuuauacuguacaa

SEQ ID NO: 1562999 - RNA, 19 nt, Homo sapiens
uguuauguuucuacacauu

SEQ ID NO: 1563000 - RNA, 16 nt, Homo sapiens
uguuauuuauaguguu

SEQ ID NO: 1563001 - RNA, 22 nt, Homo sapiens
uguuauuuucuguugaaguuua

SEQ ID NO: 1563002 - RNA, 18 nt, Homo sapiens
uguucaaaccucugccgc

SEQ ID NO: 1563003 - RNA, 15 nt, Homo sapiens
uguucagcaugcaau

SEQ ID NO: 1563004 - RNA, 15 nt, Homo sapiens
uguucaguucauucc

SEQ ID NO: 1563005 - RNA, 18 nt, Homo sapiens
uguucauauuuauugauu

SEQ ID NO: 1563006 - RNA, 11 nt, Homo sapiens
uguucaucucu

SEQ ID NO: 1563007 - RNA, 14 nt, Homo sapiens
uguuccagacucag

SEQ ID NO: 1563008 - RNA, 15 nt, Homo sapiens
uguucccgugccugg

SEQ ID NO: 1563009 - RNA, 15 nt, Homo sapiens
uguucccuugaccau

SEQ ID NO: 1563010 - RNA, 17 nt, Homo sapiens
uguuccugaaaauugca

SEQ ID NO: 1563011 - RNA, 20 nt, Homo sapiens
uguuccugaaaauugcaaua

SEQ ID NO: 1563012 - RNA, 14 nt, Homo sapiens
uguuccuuaccaag

SEQ ID NO: 1563013 - RNA, 19 nt, Homo sapiens
uguucgauugaaauuuugc

SEQ ID NO: 1563014 - RNA, 17 nt, Homo sapiens
uguucgcucgugcagua

SEQ ID NO: 1563015 - RNA, 22 nt, Homo sapiens
uguucuaaaaauaaaaguauug

SEQ ID NO: 1563016 - RNA, 14 nt, Homo sapiens
uguucuacugagaa

SEQ ID NO: 1563017 - RNA, 19 nt, Homo sapiens
uguucuccggguguggccu

SEQ ID NO: 1563018 - RNA, 20 nt, Homo sapiens
uguucucuaggccuucagga

SEQ ID NO: 1563019 - RNA, 14 nt, Homo sapiens
uguucucugaucug

SEQ ID NO: 1563020 - RNA, 16 nt, Homo sapiens
uguucuggaagccaua

SEQ ID NO: 1563021 - RNA, 20 nt, Homo sapiens
uguucugguuacuguucuaa

SEQ ID NO: 1563022 - RNA, 15 nt, Homo sapiens
uguugaagucucagg

SEQ ID NO: 1563023 - RNA, 14 nt, Homo sapiens
uguugaaugcugcu

SEQ ID NO: 1563024 - RNA, 13 nt, Homo sapiens
uguugacugugau

SEQ ID NO: 1563025 - RNA, 15 nt, Homo sapiens
uguugauuuccucug

SEQ ID NO: 1563026 - RNA, 16 nt, Homo sapiens
uguugcagguucaugg

SEQ ID NO: 1563027 - RNA, 17 nt, Homo sapiens
uguugccaaaaccaaac

SEQ ID NO: 1563028 - RNA, 15 nt, Homo sapiens
uguugcugcaucucc

SEQ ID NO: 1563029 - RNA, 17 nt, Homo sapiens
uguugguauuauauaau

SEQ ID NO: 1563030 - RNA, 13 nt, Homo sapiens
uguuggucuguag

SEQ ID NO: 1563031 - RNA, 21 nt, Homo sapiens
uguuguguuuuuaacauguca

SEQ ID NO: 1563032 - RNA, 21 nt, Homo sapiens
uguuuaaaaaaccacauggca

SEQ ID NO: 1563033 - RNA, 12 nt, Homo sapiens
uguuuaaaccca

SEQ ID NO: 1563034 - RNA, 15 nt, Homo sapiens
uguuuaaaguggcaa

SEQ ID NO: 1563035 - RNA, 19 nt, Homo sapiens
uguuuaaauucucuuucac

SEQ ID NO: 1563036 - RNA, 19 nt, Homo sapiens
uguuuacagaggacaguau

SEQ ID NO: 1563037 - RNA, 19 nt, Homo sapiens
uguuuacagcacuacucug

SEQ ID NO: 1563038 - RNA, 12 nt, Homo sapiens
uguuuacagggg

SEQ ID NO: 1563039 - RNA, 19 nt, Homo sapiens
uguuuacaugaguucaaau

SEQ ID NO: 1563040 - RNA, 23 nt, Homo sapiens
uguuuauuucaggcauuggauau

SEQ ID NO: 1563041 - RNA, 15 nt, Homo sapiens
uguuucacauugcac

SEQ ID NO: 1563042 - RNA, 17 nt, Homo sapiens
uguuuccuaauaucaaa

SEQ ID NO: 1563043 - RNA, 22 nt, Homo sapiens
uguuucugucaagcuggugcua

SEQ ID NO: 1563044 - RNA, 14 nt, Homo sapiens
uguuucuguuccaa

SEQ ID NO: 1563045 - RNA, 12 nt, Homo sapiens
uguuugacaaaa

SEQ ID NO: 1563046 - RNA, 18 nt, Homo sapiens
uguuugcacuuggcaaaa

SEQ ID NO: 1563047 - RNA, 23 nt, Homo sapiens
uguuugguaguuagccaucuaau

SEQ ID NO: 1563048 - RNA, 14 nt, Homo sapiens
uguuuuauugggga

SEQ ID NO: 1563049 - RNA, 16 nt, Homo sapiens
uguuuucagacugccu

SEQ ID NO: 1563050 - RNA, 14 nt, Homo sapiens
uguuuuccaauauu

SEQ ID NO: 1563051 - RNA, 20 nt, Homo sapiens
uguuuugaaaguuuaacaaa

SEQ ID NO: 1563052 - RNA, 21 nt, Homo sapiens
uguuuuguguguaaggaguau

SEQ ID NO: 1563053 - RNA, 16 nt, Homo sapiens
uguuuuucaagccugu

SEQ ID NO: 1563054 - RNA, 19 nt, Homo sapiens
uguuuuucuucagcauuua

SEQ ID NO: 1563055 - RNA, 15 nt, Homo sapiens
uucauuccucacaau

SEQ ID NO: 1563056 - RNA, 15 nt, Homo sapiens
uucauucugccaaag

SEQ ID NO: 1563057 - RNA, 16 nt, Homo sapiens
uucauucuuguauuau

SEQ ID NO: 1563058 - RNA, 20 nt, Homo sapiens
uucauuguguuaccuguaga

SEQ ID NO: 1563059 - RNA, 13 nt, Homo sapiens
uucauuucagcau

SEQ ID NO: 1563060 - RNA, 14 nt, Homo sapiens
uucauuucauuuca

SEQ ID NO: 1563061 - RNA, 16 nt, Homo sapiens
uucauuucuagacuca

SEQ ID NO: 1563062 - RNA, 15 nt, Homo sapiens
uucauuugcuugcaa

SEQ ID NO: 1563063 - RNA, 15 nt, Homo sapiens
uucauuuuaguccag

SEQ ID NO: 1563064 - RNA, 19 nt, Homo sapiens
uuccaaacaggcucagagg

SEQ ID NO: 1563065 - RNA, 21 nt, Homo sapiens
uuccaaagcuuuauuaccagu

SEQ ID NO: 1563066 - RNA, 23 nt, Homo sapiens
uuccaagaaaauaucacuguaau

SEQ ID NO: 1563067 - RNA, 19 nt, Homo sapiens
uuccaaugccacagacaac

SEQ ID NO: 1563068 - RNA, 19 nt, Homo sapiens
uuccacaaagaaaauuccu

SEQ ID NO: 1563069 - RNA, 21 nt, Homo sapiens
uuccacacccucacugcugua

SEQ ID NO: 1563070 - RNA, 20 nt, Homo sapiens
uuccacauaggaaaaugcca

SEQ ID NO: 1563071 - RNA, 14 nt, Homo sapiens
uuccaccugccaca

SEQ ID NO: 1563072 - RNA, 16 nt, Homo sapiens
uuccaccuucuacgca

SEQ ID NO: 1563073 - RNA, 22 nt, Homo sapiens
uuccacgugggccucacauucc

SEQ ID NO: 1563074 - RNA, 16 nt, Homo sapiens
uuccagauuaacauaa

SEQ ID NO: 1563075 - RNA, 16 nt, Homo sapiens
uuccagccuaucuaau

SEQ ID NO: 1563076 - RNA, 13 nt, Homo sapiens
uuccagccuucua

SEQ ID NO: 1563077 - RNA, 22 nt, Homo sapiens
uuccaguuccucuuuugugcug

SEQ ID NO: 1563078 - RNA, 16 nt, Homo sapiens
uuccaucaucacugua

SEQ ID NO: 1563079 - RNA, 14 nt, Homo sapiens
uuccaugacaucaa

SEQ ID NO: 1563080 - RNA, 14 nt, Homo sapiens
uuccaugauucuau

SEQ ID NO: 1563081 - RNA, 21 nt, Homo sapiens
uuccauuaaguacaugugcca

SEQ ID NO: 1563082 - RNA, 13 nt, Homo sapiens
uuccauugauuca

SEQ ID NO: 1563083 - RNA, 21 nt, Homo sapiens
uuccauuuuaaaaugcaucau

SEQ ID NO: 1563084 - RNA, 23 nt, Homo sapiens
uucccaagcgucaucuguguaaa

SEQ ID NO: 1563085 - RNA, 19 nt, Homo sapiens
uucccaauagcacuuucau

SEQ ID NO: 1563086 - RNA, 23 nt, Homo sapiens
uucccaauagcacuuucauugcc

SEQ ID NO: 1563087 - RNA, 11 nt, Homo sapiens
uucccacucac

SEQ ID NO: 1563088 - RNA, 11 nt, Homo sapiens
uucccagagau

SEQ ID NO: 1563089 - RNA, 14 nt, Homo sapiens
uucccagcuaggaa

SEQ ID NO: 1563090 - RNA, 18 nt, Homo sapiens
uucccauuaaagagccag

SEQ ID NO: 1563091 - RNA, 19 nt, Homo sapiens
uucccauuaaagagccagu

SEQ ID NO: 1563092 - RNA, 17 nt, Homo sapiens
uucccauuuuugcuuag

SEQ ID NO: 1563093 - RNA, 15 nt, Homo sapiens
uuccccaacagggca

SEQ ID NO: 1563094 - RNA, 20 nt, Homo sapiens
uuccccaacagggcaacugu

SEQ ID NO: 1563095 - RNA, 23 nt, Homo sapiens
uuccccacaaacccccaccagca

SEQ ID NO: 1563096 - RNA, 19 nt, Homo sapiens
uuccccagguuccauacca

SEQ ID NO: 1563097 - RNA, 21 nt, Homo sapiens
uuccccaguucaguguugcau

SEQ ID NO: 1563098 - RNA, 13 nt, Homo sapiens
uucccccacugau

SEQ ID NO: 1563099 - RNA, 15 nt, Homo sapiens
uuccccgugcccuac

SEQ ID NO: 1563100 - RNA, 16 nt, Homo sapiens
uuccccuuccacugag

SEQ ID NO: 1563101 - RNA, 19 nt, Homo sapiens
uuccccuuuucccaaccug

SEQ ID NO: 1563102 - RNA, 14 nt, Homo sapiens
uucccgaugaacaa

SEQ ID NO: 1563103 - RNA, 17 nt, Homo sapiens
uucccugacuugcuuua

SEQ ID NO: 1563104 - RNA, 14 nt, Homo sapiens
uucccugauggccu

SEQ ID NO: 1563105 - RNA, 18 nt, Homo sapiens
uucccugcacacacaugc

SEQ ID NO: 1563106 - RNA, 19 nt, Homo sapiens
uucccugcacacacaugca

SEQ ID NO: 1563107 - RNA, 23 nt, Homo sapiens
uucccugcuuccaggaaacucca

SEQ ID NO: 1563108 - RNA, 17 nt, Homo sapiens
uucccuuuuccauccuc

SEQ ID NO: 1563109 - RNA, 14 nt, Homo sapiens
uuccgaaucucuuu

SEQ ID NO: 1563110 - RNA, 20 nt, Homo sapiens
uuccuaaaagagaauggaaa

SEQ ID NO: 1563111 - RNA, 15 nt, Homo sapiens
uuccuaauacuguca

SEQ ID NO: 1563112 - RNA, 16 nt, Homo sapiens
uuccuaaugugaucau

SEQ ID NO: 1563113 - RNA, 22 nt, Homo sapiens
uuccuacccacaccucugccag

SEQ ID NO: 1563114 - RNA, 22 nt, Homo sapiens
uuccuagaacaaaauguacaaa

SEQ ID NO: 1563115 - RNA, 18 nt, Homo sapiens
uuccuaguaaauuuaauu

SEQ ID NO: 1563116 - RNA, 15 nt, Homo sapiens
uuccucacaguccca

SEQ ID NO: 1563117 - RNA, 17 nt, Homo sapiens
uuccucaugucaucaaa

SEQ ID NO: 1563118 - RNA, 14 nt, Homo sapiens
uuccuccugcagac

SEQ ID NO: 1563119 - RNA, 20 nt, Homo sapiens
uuccugacacucaauaaaca

SEQ ID NO: 1563120 - RNA, 21 nt, Homo sapiens
uuccugacagaugccugguga

SEQ ID NO: 1563121 - RNA, 16 nt, Homo sapiens
uuccugagcuuuaugg

SEQ ID NO: 1563122 - RNA, 14 nt, Homo sapiens
uuccugcacauuaa

SEQ ID NO: 1563123 - RNA, 13 nt, Homo sapiens
uuccugcguagaa

SEQ ID NO: 1563124 - RNA, 13 nt, Homo sapiens
uuccugggaacau

SEQ ID NO: 1563125 - RNA, 20 nt, Homo sapiens
uuccuguucacucuguuaau

SEQ ID NO: 1563126 - RNA, 21 nt, Homo sapiens
uuccuguuuaaaaaaccacau

SEQ ID NO: 1563127 - RNA, 15 nt, Homo sapiens
uuccuuaaguauuau

SEQ ID NO: 1563128 - RNA, 13 nt, Homo sapiens
uuccuuccuuccu

SEQ ID NO: 1563129 - RNA, 17 nt, Homo sapiens
uuccuugccugugacuu

SEQ ID NO: 1563130 - RNA, 13 nt, Homo sapiens
uuccuugugguua

SEQ ID NO: 1563131 - RNA, 22 nt, Homo sapiens
uuccuuuauuuugcugcuugau

SEQ ID NO: 1563132 - RNA, 13 nt, Homo sapiens
uuccuuuggguua

SEQ ID NO: 1563133 - RNA, 15 nt, Homo sapiens
uucgagguggaucac

SEQ ID NO: 1563134 - RNA, 11 nt, Homo sapiens
uucgcacacac

SEQ ID NO: 1563135 - RNA, 14 nt, Homo sapiens
uucggauuugccau

SEQ ID NO: 1563136 - RNA, 17 nt, Homo sapiens
uucgucuguugugcgaa

SEQ ID NO: 1563137 - RNA, 16 nt, Homo sapiens
uucuaaaaaugguuau

SEQ ID NO: 1563138 - RNA, 19 nt, Homo sapiens
uucuaaaaccuuagucauc

SEQ ID NO: 1563139 - RNA, 19 nt, Homo sapiens
uucuaaacugcaucuggau

SEQ ID NO: 1563140 - RNA, 16 nt, Homo sapiens
uucuaagaaauaucug

SEQ ID NO: 1563141 - RNA, 17 nt, Homo sapiens
uucuaagacuacuauga

SEQ ID NO: 1563142 - RNA, 21 nt, Homo sapiens
uucuacagacaucauguuacu

SEQ ID NO: 1563143 - RNA, 13 nt, Homo sapiens
uucuacagauauu

SEQ ID NO: 1563144 - RNA, 13 nt, Homo sapiens
uucuacaugugag

SEQ ID NO: 1563145 - RNA, 22 nt, Homo sapiens
uucuacauuauucuucacuuaa

SEQ ID NO: 1563146 - RNA, 17 nt, Homo sapiens
uucuacccucaucauca

SEQ ID NO: 1563147 - RNA, 22 nt, Homo sapiens
uucuaccugccacucacacagc

SEQ ID NO: 1563148 - RNA, 17 nt, Homo sapiens
uucuacugaacagucca

SEQ ID NO: 1563149 - RNA, 21 nt, Homo sapiens
uucuacuuuaagguuugcaga

SEQ ID NO: 1563150 - RNA, 14 nt, Homo sapiens
uucuagaucucagc

SEQ ID NO: 1563151 - RNA, 16 nt, Homo sapiens
uucuagauuaccauga

SEQ ID NO: 1563152 - RNA, 19 nt, Homo sapiens
uucuaguucugccaggaga

SEQ ID NO: 1563153 - RNA, 12 nt, Homo sapiens
uucuauaacaua

SEQ ID NO: 1563154 - RNA, 16 nt, Homo sapiens
uucuauacccacccag

SEQ ID NO: 1563155 - RNA, 17 nt, Homo sapiens
uucuauacccacccaga

SEQ ID NO: 1563156 - RNA, 18 nt, Homo sapiens
uucuauacccacccagaa

SEQ ID NO: 1563157 - RNA, 23 nt, Homo sapiens
uucuaugcuguuuguagugaaau

SEQ ID NO: 1563158 - RNA, 19 nt, Homo sapiens
uucuauguauuagugucaa

SEQ ID NO: 1563159 - RNA, 18 nt, Homo sapiens
uucucaacauacuguaau

SEQ ID NO: 1563160 - RNA, 14 nt, Homo sapiens
uucucaaccagaga

SEQ ID NO: 1563161 - RNA, 21 nt, Homo sapiens
uucucaagcgcuauccacaga

SEQ ID NO: 1563162 - RNA, 23 nt, Homo sapiens
uucucagauguugaaacuuugaa

SEQ ID NO: 1563163 - RNA, 16 nt, Homo sapiens
uucucagucuccuuaa

SEQ ID NO: 1563164 - RNA, 23 nt, Homo sapiens
uucucaucaguaguucacauaca

SEQ ID NO: 1563165 - RNA, 17 nt, Homo sapiens
uucucaucuccccacgc

SEQ ID NO: 1563166 - RNA, 21 nt, Homo sapiens
uucuccagggguuuacaguga

SEQ ID NO: 1563167 - RNA, 17 nt, Homo sapiens
uucuccuaugucuuuca

SEQ ID NO: 1563168 - RNA, 13 nt, Homo sapiens
uucuccuccaugg

SEQ ID NO: 1563169 - RNA, 16 nt, Homo sapiens
uucuccucggacugug

SEQ ID NO: 1563170 - RNA, 14 nt, Homo sapiens
uucuccuucagccc

SEQ ID NO: 1563171 - RNA, 14 nt, Homo sapiens
uucuccuugaauau

SEQ ID NO: 1563172 - RNA, 16 nt, Homo sapiens
uucucguuuucacagg

SEQ ID NO: 1563173 - RNA, 18 nt, Homo sapiens
uucucuacaugcauaaca

SEQ ID NO: 1563174 - RNA, 14 nt, Homo sapiens
uuuauauauuggaa

SEQ ID NO: 1563175 - RNA, 23 nt, Homo sapiens
uuuauauguguugaaaaccaaaa

SEQ ID NO: 1563176 - RNA, 13 nt, Homo sapiens
uuuaucaugaagc

SEQ ID NO: 1563177 - RNA, 20 nt, Homo sapiens
uuuaucaugaagcacaucaa

SEQ ID NO: 1563178 - RNA, 14 nt, Homo sapiens
uuuaucaugauccu

SEQ ID NO: 1563179 - RNA, 18 nt, Homo sapiens
uuuaucccccgcaaagac

SEQ ID NO: 1563180 - RNA, 23 nt, Homo sapiens
uuuaucccccgcaaagacaucaa

SEQ ID NO: 1563181 - RNA, 13 nt, Homo sapiens
uuuaugacucuua

SEQ ID NO: 1563182 - RNA, 14 nt, Homo sapiens
uuuaugaugcaguu

SEQ ID NO: 1563183 - RNA, 15 nt, Homo sapiens
uuuaugcuaagugaa

SEQ ID NO: 1563184 - RNA, 23 nt, Homo sapiens
uuuaugguccuaaaagcaaaaua

SEQ ID NO: 1563185 - RNA, 11 nt, Homo sapiens
uuuaugguucu

SEQ ID NO: 1563186 - RNA, 17 nt, Homo sapiens
uuuauuaggauuaccca

SEQ ID NO: 1563187 - RNA, 20 nt, Homo sapiens
uuuauuccagagaagccagg

SEQ ID NO: 1563188 - RNA, 16 nt, Homo sapiens
uuuauugcauugcugg

SEQ ID NO: 1563189 - RNA, 14 nt, Homo sapiens
uuuauugcuuguug

SEQ ID NO: 1563190 - RNA, 20 nt, Homo sapiens
uuuauuggcugagauaugaa

SEQ ID NO: 1563191 - RNA, 21 nt, Homo sapiens
uuuauuuacacucuugauucu

SEQ ID NO: 1563192 - RNA, 15 nt, Homo sapiens
uuuauuuuccaggga

SEQ ID NO: 1563193 - RNA, 19 nt, Homo sapiens
uuucaaaauauacauucaa

SEQ ID NO: 1563194 - RNA, 22 nt, Homo sapiens
uuucaaacaagaaacauuucag

SEQ ID NO: 1563195 - RNA, 12 nt, Homo sapiens
uuucaagagauc

SEQ ID NO: 1563196 - RNA, 17 nt, Homo sapiens
uuucaauaaugugaaug

SEQ ID NO: 1563197 - RNA, 23 nt, Homo sapiens
uuucaauaguggcauaccaaaug

SEQ ID NO: 1563198 - RNA, 18 nt, Homo sapiens
uuucaauuugagauucua

SEQ ID NO: 1563199 - RNA, 22 nt, Homo sapiens
uuucacaaucauguacugggaa

SEQ ID NO: 1563200 - RNA, 14 nt, Homo sapiens
uuucacacauucac

SEQ ID NO: 1563201 - RNA, 16 nt, Homo sapiens
uuucaccccacucugu

SEQ ID NO: 1563202 - RNA, 21 nt, Homo sapiens
uuucaccccaucccuccuuaa

SEQ ID NO: 1563203 - RNA, 14 nt, Homo sapiens
uuucaccuguauug

SEQ ID NO: 1563204 - RNA, 17 nt, Homo sapiens
uuucaccuguauugaau

SEQ ID NO: 1563205 - RNA, 21 nt, Homo sapiens
uuucacuaaaagucuccaaaa

SEQ ID NO: 1563206 - RNA, 21 nt, Homo sapiens
uuucacuacucucuacucugu

SEQ ID NO: 1563207 - RNA, 16 nt, Homo sapiens
uuucacuauaauguga

SEQ ID NO: 1563208 - RNA, 15 nt, Homo sapiens
uuucacuuucugucu

SEQ ID NO: 1563209 - RNA, 20 nt, Homo sapiens
uuucagauuguggaauguug

SEQ ID NO: 1563210 - RNA, 13 nt, Homo sapiens
uuucagccaaaac

SEQ ID NO: 1563211 - RNA, 19 nt, Homo sapiens
uuucagguuccaaucagaa

SEQ ID NO: 1563212 - RNA, 16 nt, Homo sapiens
uuucaguaagucucau

SEQ ID NO: 1563213 - RNA, 15 nt, Homo sapiens
uuucaguuucuauca

SEQ ID NO: 1563214 - RNA, 16 nt, Homo sapiens
uuucaguuucuaucaa

SEQ ID NO: 1563215 - RNA, 13 nt, Homo sapiens
uuucauacaacag

SEQ ID NO: 1563216 - RNA, 16 nt, Homo sapiens
uuucauaccacuugaa

SEQ ID NO: 1563217 - RNA, 19 nt, Homo sapiens
uuucauacccaugucagau

SEQ ID NO: 1563218 - RNA, 20 nt, Homo sapiens
uuucauacuguaacauucag

SEQ ID NO: 1563219 - RNA, 22 nt, Homo sapiens
uuucauagugaccuguguuuca

SEQ ID NO: 1563220 - RNA, 22 nt, Homo sapiens
uuucauauauaagacugcugca

SEQ ID NO: 1563221 - RNA, 15 nt, Homo sapiens
uuucauauugaucuu

SEQ ID NO: 1563222 - RNA, 22 nt, Homo sapiens
uuucaucugcucuccuuccugg

SEQ ID NO: 1563223 - RNA, 14 nt, Homo sapiens
uuucauucugccaa

SEQ ID NO: 1563224 - RNA, 12 nt, Homo sapiens
uuucauucuugu

SEQ ID NO: 1563225 - RNA, 18 nt, Homo sapiens
uuucauugaugagcaaga

SEQ ID NO: 1563226 - RNA, 17 nt, Homo sapiens
uuucauuuaucuauaau

SEQ ID NO: 1563227 - RNA, 14 nt, Homo sapiens
uuuccaaagagccg

SEQ ID NO: 1563228 - RNA, 21 nt, Homo sapiens
uuuccacacuuaaauucucua

SEQ ID NO: 1563229 - RNA, 15 nt, Homo sapiens
uuuccagagcagagc

SEQ ID NO: 1563230 - RNA, 12 nt, Homo sapiens
uuuccaucuccc

SEQ ID NO: 1563231 - RNA, 17 nt, Homo sapiens
uuuccauuuuaaggaua

SEQ ID NO: 1563232 - RNA, 16 nt, Homo sapiens
uuucccaacaccucuu

SEQ ID NO: 1563233 - RNA, 21 nt, Homo sapiens
uuucccagucccauuccucag

SEQ ID NO: 1563234 - RNA, 19 nt, Homo sapiens
uuucccaucagacugucaa

SEQ ID NO: 1563235 - RNA, 15 nt, Homo sapiens
uuuccccagucccag

SEQ ID NO: 1563236 - RNA, 21 nt, Homo sapiens
uuuccccauuggaacuaguca

SEQ ID NO: 1563237 - RNA, 23 nt, Homo sapiens
uuucccugcagaccucaagccau

SEQ ID NO: 1563238 - RNA, 13 nt, Homo sapiens
uuuccgaaucucu

SEQ ID NO: 1563239 - RNA, 22 nt, Homo sapiens
uuuccuaaagucucugcugcua

SEQ ID NO: 1563240 - RNA, 18 nt, Homo sapiens
uuuccuaugcuauugaca

SEQ ID NO: 1563241 - RNA, 15 nt, Homo sapiens
uuuccucaccagucc

SEQ ID NO: 1563242 - RNA, 22 nt, Homo sapiens
uuuccucagccuuaagaaccau

SEQ ID NO: 1563243 - RNA, 22 nt, Homo sapiens
uuuccucagugcauuugugcua

SEQ ID NO: 1563244 - RNA, 16 nt, Homo sapiens
uuuccucaucugcaaa

SEQ ID NO: 1563245 - RNA, 15 nt, Homo sapiens
uuuccugugacaaaa

SEQ ID NO: 1563246 - RNA, 22 nt, Homo sapiens
uuuccuguucagcauucuuagc

SEQ ID NO: 1563247 - RNA, 22 nt, Homo sapiens
uuuccuguucuauuaauacaua

SEQ ID NO: 1563248 - RNA, 19 nt, Homo sapiens
uuuccuuaacgcuagagau

SEQ ID NO: 1563249 - RNA, 19 nt, Homo sapiens
uuucgaagucaucauuccu

SEQ ID NO: 1563250 - RNA, 12 nt, Homo sapiens
uuucuaagcaua

SEQ ID NO: 1563251 - RNA, 16 nt, Homo sapiens
uuucuaauguuuacua

SEQ ID NO: 1563252 - RNA, 14 nt, Homo sapiens
uuucuacacugagg

SEQ ID NO: 1563253 - RNA, 12 nt, Homo sapiens
uuucuaccacac

SEQ ID NO: 1563254 - RNA, 17 nt, Homo sapiens
uuucuaccaucucacgg

SEQ ID NO: 1563255 - RNA, 15 nt, Homo sapiens
uuucuagagacacau

SEQ ID NO: 1563256 - RNA, 13 nt, Homo sapiens
uuucuauccaaau

SEQ ID NO: 1563257 - RNA, 15 nt, Homo sapiens
uuucuauuauggaaa

SEQ ID NO: 1563258 - RNA, 14 nt, Homo sapiens
uuucuauucuguca

SEQ ID NO: 1563259 - RNA, 11 nt, Homo sapiens
uuucucaaggg

SEQ ID NO: 1563260 - RNA, 19 nt, Homo sapiens
uuucucaagggccaugugg

SEQ ID NO: 1563261 - RNA, 19 nt, Homo sapiens
uuucucagugcacaugcaa

SEQ ID NO: 1563262 - RNA, 20 nt, Homo sapiens
uuucucccucuuucuuccca

SEQ ID NO: 1563263 - RNA, 20 nt, Homo sapiens
uuucuccucacuguauccag

SEQ ID NO: 1563264 - RNA, 19 nt, Homo sapiens
uuucucuguaaacuuccaa

SEQ ID NO: 1563265 - RNA, 21 nt, Homo sapiens
uuucugauguguucucugauc

SEQ ID NO: 1563266 - RNA, 23 nt, Homo sapiens
uuucuggacaguaccugauugua

SEQ ID NO: 1563267 - RNA, 15 nt, Homo sapiens
uuucuggugccauuu

SEQ ID NO: 1563268 - RNA, 23 nt, Homo sapiens
uuucuguaauguaaauaaacuau

SEQ ID NO: 1563269 - RNA, 21 nt, Homo sapiens
uuucuuaaguauaaaccuuau

SEQ ID NO: 1563270 - RNA, 16 nt, Homo sapiens
uuucuuagugugccaa

SEQ ID NO: 1563271 - RNA, 21 nt, Homo sapiens
uuucuucauuguaaucugcaa

SEQ ID NO: 1563272 - RNA, 23 nt, Homo sapiens
uuucuucuacugcuaucuacuac

SEQ ID NO: 1563273 - RNA, 11 nt, Homo sapiens
uuucuuuccaa

SEQ ID NO: 1563274 - RNA, 11 nt, Homo sapiens
uuucuuugaau

SEQ ID NO: 1563275 - RNA, 17 nt, Homo sapiens
uuucuuugcaccaaaga

SEQ ID NO: 1563276 - RNA, 13 nt, Homo sapiens
uuucuuugcuuca

SEQ ID NO: 1563277 - RNA, 18 nt, Homo sapiens
uuucuuuuaaaauuuuga

SEQ ID NO: 1563278 - RNA, 19 nt, Homo sapiens
uuucuuuuacccaguagga

SEQ ID NO: 1563279 - RNA, 23 nt, Homo sapiens
uuugaaaaagccucuaauggacu

SEQ ID NO: 1563280 - RNA, 16 nt, Homo sapiens
uuugaaaaagcgaaaa

SEQ ID NO: 1563281 - RNA, 23 nt, Homo sapiens
uuugaaaaaugagagcuguaacu

SEQ ID NO: 1563282 - RNA, 15 nt, Homo sapiens
uuugaaacuaucuca

SEQ ID NO: 1563283 - RNA, 18 nt, Homo sapiens
uuugaaauuaaccucuca

SEQ ID NO: 1563284 - RNA, 22 nt, Homo sapiens
uuugaacaaauuuucuggugcu

SEQ ID NO: 1563285 - RNA, 20 nt, Homo sapiens
uuugaagcagucuugcucug

SEQ ID NO: 1563286 - RNA, 22 nt, Homo sapiens
uuugaagcuacuguguguguga

SEQ ID NO: 1563287 - RNA, 12 nt, Homo sapiens
uuugaaggcaaa

SEQ ID NO: 1563288 - RNA, 18 nt, Homo sapiens
uuugaagguagaauguuu

SEQ ID NO: 1563289 - RNA, 21 nt, Homo sapiens
uuugaauaaagaauacuugaa

SEQ ID NO: 1563290 - RNA, 21 nt, Homo sapiens
uuugaauaagcagaacauacu

SEQ ID NO: 1563291 - RNA, 17 nt, Homo sapiens
uuugaaugcuuaauuca

SEQ ID NO: 1563292 - RNA, 16 nt, Homo sapiens
aaauaguugcauagca

SEQ ID NO: 1563293 - RNA, 19 nt, Homo sapiens
aaauaguuuaugauuccac

SEQ ID NO: 1563294 - RNA, 14 nt, Homo sapiens
aaauauaauuuaca

SEQ ID NO: 1563295 - RNA, 18 nt, Homo sapiens
aaauauaauuuacauuaa

SEQ ID NO: 1563296 - RNA, 13 nt, Homo sapiens
aaauauacauuca

SEQ ID NO: 1563297 - RNA, 19 nt, Homo sapiens
aaauauagacauucucaca

SEQ ID NO: 1563298 - RNA, 17 nt, Homo sapiens
aaauauauagcuugaaa

SEQ ID NO: 1563299 - RNA, 14 nt, Homo sapiens
aaauauccauuuau

SEQ ID NO: 1563300 - RNA, 23 nt, Homo sapiens
aaauaucccugggguauuuuaga

SEQ ID NO: 1563301 - RNA, 19 nt, Homo sapiens
aaauaucucaauuaccaau

SEQ ID NO: 1563302 - RNA, 16 nt, Homo sapiens
aaauaucuugcuuuca

SEQ ID NO: 1563303 - RNA, 16 nt, Homo sapiens
aaauauuaacauucuu

SEQ ID NO: 1563304 - RNA, 15 nt, Homo sapiens
aaauauugacucaaa

SEQ ID NO: 1563305 - RNA, 17 nt, Homo sapiens
aaauauugcuaaaagca

SEQ ID NO: 1563306 - RNA, 15 nt, Homo sapiens
aaaucaaauauucca

SEQ ID NO: 1563307 - RNA, 19 nt, Homo sapiens
aaaucaagugguauuuucc

SEQ ID NO: 1563308 - RNA, 13 nt, Homo sapiens
aaaucacuugcca

SEQ ID NO: 1563309 - RNA, 21 nt, Homo sapiens
aaaucagacccacaacgaaug

SEQ ID NO: 1563310 - RNA, 20 nt, Homo sapiens
aaaucagcagacacaggugu

SEQ ID NO: 1563311 - RNA, 15 nt, Homo sapiens
aaaucauaggugaag

SEQ ID NO: 1563312 - RNA, 18 nt, Homo sapiens
aaaucaugccaguauuuu

SEQ ID NO: 1563313 - RNA, 16 nt, Homo sapiens
aaaucauuuauuuaca

SEQ ID NO: 1563314 - RNA, 18 nt, Homo sapiens
aaauccaagaugcuggca

SEQ ID NO: 1563315 - RNA, 18 nt, Homo sapiens
aaauccaaggaaacaugc

SEQ ID NO: 1563316 - RNA, 20 nt, Homo sapiens
aaauccagugagcacuagaa

SEQ ID NO: 1563317 - RNA, 21 nt, Homo sapiens
aaauccagugagcacuagaau

SEQ ID NO: 1563318 - RNA, 12 nt, Homo sapiens
aaauccauagau

SEQ ID NO: 1563319 - RNA, 20 nt, Homo sapiens
aaauccggucagccaagugc

SEQ ID NO: 1563320 - RNA, 22 nt, Homo sapiens
aaauccuggaaggacacaguga

SEQ ID NO: 1563321 - RNA, 14 nt, Homo sapiens
aaaucuaccaagaa

SEQ ID NO: 1563322 - RNA, 16 nt, Homo sapiens
aaaucuaccacuguau

SEQ ID NO: 1563323 - RNA, 12 nt, Homo sapiens
aaaucuagaaga

SEQ ID NO: 1563324 - RNA, 16 nt, Homo sapiens
aaaucuccaauccaca

SEQ ID NO: 1563325 - RNA, 23 nt, Homo sapiens
aaaucucuucuuugcugcaguca

SEQ ID NO: 1563326 - RNA, 19 nt, Homo sapiens
aaaucugcauccuuuucaa

SEQ ID NO: 1563327 - RNA, 19 nt, Homo sapiens
aaaucuggguaucuuucca

SEQ ID NO: 1563328 - RNA, 12 nt, Homo sapiens
aaaucugugaug

SEQ ID NO: 1563329 - RNA, 13 nt, Homo sapiens
aaaucugugccug

SEQ ID NO: 1563330 - RNA, 19 nt, Homo sapiens
aaaucuuauuccucaguga

SEQ ID NO: 1563331 - RNA, 15 nt, Homo sapiens
aaaucuugacuacag

SEQ ID NO: 1563332 - RNA, 19 nt, Homo sapiens
aaaucuuuggauuugauca

SEQ ID NO: 1563333 - RNA, 15 nt, Homo sapiens
aaaugaaaagccaaa

SEQ ID NO: 1563334 - RNA, 16 nt, Homo sapiens
aaaugaaacagggaaa

SEQ ID NO: 1563335 - RNA, 20 nt, Homo sapiens
aaaugaaugauucuacagcu

SEQ ID NO: 1563336 - RNA, 11 nt, Homo sapiens
aaaugacaauu

SEQ ID NO: 1563337 - RNA, 17 nt, Homo sapiens
aaaugacauuucacuaa

SEQ ID NO: 1563338 - RNA, 17 nt, Homo sapiens
aaaugacgucuucacca

SEQ ID NO: 1563339 - RNA, 18 nt, Homo sapiens
aaaugacgucuucaccaa

SEQ ID NO: 1563340 - RNA, 17 nt, Homo sapiens
aaaugagaaagcauuuc

SEQ ID NO: 1563341 - RNA, 15 nt, Homo sapiens
aaaugagaaugacag

SEQ ID NO: 1563342 - RNA, 20 nt, Homo sapiens
aaaugaggaaaugccacaaa

SEQ ID NO: 1563343 - RNA, 16 nt, Homo sapiens
aaaugauuauauucac

SEQ ID NO: 1563344 - RNA, 22 nt, Homo sapiens
aaaugcaacauacgggaaguuu

SEQ ID NO: 1563345 - RNA, 11 nt, Homo sapiens
aaaugcaauaa

SEQ ID NO: 1563346 - RNA, 15 nt, Homo sapiens
aaaugcaccaaucag

SEQ ID NO: 1563347 - RNA, 21 nt, Homo sapiens
aaaugccaaaggaaguuuuaa

SEQ ID NO: 1563348 - RNA, 13 nt, Homo sapiens
aaaugccucagcu

SEQ ID NO: 1563349 - RNA, 17 nt, Homo sapiens
aaaugcucaauuucagc

SEQ ID NO: 1563350 - RNA, 18 nt, Homo sapiens
aaaugcuguauuuuuaca

SEQ ID NO: 1563351 - RNA, 13 nt, Homo sapiens
aaaugcuguuuau

SEQ ID NO: 1563352 - RNA, 18 nt, Homo sapiens
aaauggaaagucaugcaa

SEQ ID NO: 1563353 - RNA, 18 nt, Homo sapiens
aaauggagauaaaagcaa

SEQ ID NO: 1563354 - RNA, 21 nt, Homo sapiens
aaaugggagaaaacgccagug

SEQ ID NO: 1563355 - RNA, 17 nt, Homo sapiens
aaaugggagacagccuc

SEQ ID NO: 1563356 - RNA, 19 nt, Homo sapiens
aaauggggcaaacagucua

SEQ ID NO: 1563357 - RNA, 13 nt, Homo sapiens
aaauguacacuuu

SEQ ID NO: 1563358 - RNA, 17 nt, Homo sapiens
aaauguacagacauauu

SEQ ID NO: 1563359 - RNA, 23 nt, Homo sapiens
aaauguaccuucuuucacucugu

SEQ ID NO: 1563360 - RNA, 14 nt, Homo sapiens
aaauguauacuaua

SEQ ID NO: 1563361 - RNA, 10 nt, Homo sapiens
aaaugucucc

SEQ ID NO: 1563362 - RNA, 18 nt, Homo sapiens
aaaugugguugcuuaauu

SEQ ID NO: 1563363 - RNA, 22 nt, Homo sapiens
aaauguuaacuguucuuggaaa

SEQ ID NO: 1563364 - RNA, 24 nt, Homo sapiens
aaauguuucaaaauagacaaguuu

SEQ ID NO: 1563365 - RNA, 13 nt, Homo sapiens
aaauguuucuaca

SEQ ID NO: 1563366 - RNA, 14 nt, Homo sapiens
aaauguuuuacuca

SEQ ID NO: 1563367 - RNA, 16 nt, Homo sapiens
aaauguuuuacucaga

SEQ ID NO: 1563368 - RNA, 22 nt, Homo sapiens
aaauguuuucauuuuacuggua

SEQ ID NO: 1563369 - RNA, 18 nt, Homo sapiens
aaauuaaacuuauuuaca

SEQ ID NO: 1563370 - RNA, 15 nt, Homo sapiens
aaauuaaauacauaa

SEQ ID NO: 1563371 - RNA, 19 nt, Homo sapiens
aaauuaacgucaccaguga

SEQ ID NO: 1563372 - RNA, 15 nt, Homo sapiens
aaauuaagaaggcaa

SEQ ID NO: 1563373 - RNA, 21 nt, Homo sapiens
aaauuaauauaucauuaucuu

SEQ ID NO: 1563374 - RNA, 21 nt, Homo sapiens
aaauuaauguaauaaagugaa

SEQ ID NO: 1563375 - RNA, 22 nt, Homo sapiens
aaauuaauguaauaaagugaac

SEQ ID NO: 1563376 - RNA, 22 nt, Homo sapiens
aaauuacagcuuuuauggauga

SEQ ID NO: 1563377 - RNA, 12 nt, Homo sapiens
aaauuacauguu

SEQ ID NO: 1563378 - RNA, 16 nt, Homo sapiens
aaauuagugaaccaaa

SEQ ID NO: 1563379 - RNA, 20 nt, Homo sapiens
aaauuaguuucaaauuuacc

SEQ ID NO: 1563380 - RNA, 17 nt, Homo sapiens
aaauuauauguuuauaa

SEQ ID NO: 1563381 - RNA, 16 nt, Homo sapiens
aaauuaugugacauuu

SEQ ID NO: 1563382 - RNA, 17 nt, Homo sapiens
aaauuauguuacuguau

SEQ ID NO: 1563383 - RNA, 13 nt, Homo sapiens
aaauuauuaucuu

SEQ ID NO: 1563384 - RNA, 22 nt, Homo sapiens
aaauuauugacgcuuaaccuuu

SEQ ID NO: 1563385 - RNA, 16 nt, Homo sapiens
aaauucacaaacuuuu

SEQ ID NO: 1563386 - RNA, 18 nt, Homo sapiens
aaauucagcaaagugguu

SEQ ID NO: 1563387 - RNA, 22 nt, Homo sapiens
aaauucccaacuucucuugcuu

SEQ ID NO: 1563388 - RNA, 11 nt, Homo sapiens
aaauuccccaa

SEQ ID NO: 1563389 - RNA, 18 nt, Homo sapiens
aaauuccucuuacuguaa

SEQ ID NO: 1563390 - RNA, 18 nt, Homo sapiens
aaauucucucucuugcag

SEQ ID NO: 1563391 - RNA, 14 nt, Homo sapiens
aaauucugccuuga

SEQ ID NO: 1563392 - RNA, 20 nt, Homo sapiens
aaauugaauaguuuauuucu

SEQ ID NO: 1563393 - RNA, 20 nt, Homo sapiens
aaauugagaccugagugaag

SEQ ID NO: 1563394 - RNA, 14 nt, Homo sapiens
aaauugcagaauuc

SEQ ID NO: 1563395 - RNA, 23 nt, Homo sapiens
aaauugcagaauucaaaagugau

SEQ ID NO: 1563396 - RNA, 14 nt, Homo sapiens
aaauugccugcaaa

SEQ ID NO: 1563397 - RNA, 23 nt, Homo sapiens
aaauugccugcaaaaaugaaauc

SEQ ID NO: 1563398 - RNA, 12 nt, Homo sapiens
aaauugcugcuu

SEQ ID NO: 1563399 - RNA, 20 nt, Homo sapiens
aaauuguaucaaaugugaca

SEQ ID NO: 1563400 - RNA, 14 nt, Homo sapiens
aaauuguauuauca

SEQ ID NO: 1563401 - RNA, 15 nt, Homo sapiens
aaauuguauuaucaa

SEQ ID NO: 1563402 - RNA, 17 nt, Homo sapiens
aaauuuaaguccaccuc

SEQ ID NO: 1563403 - RNA, 14 nt, Homo sapiens
aaauuuacugugag

SEQ ID NO: 1563404 - RNA, 16 nt, Homo sapiens
aaauuucuagccugca

SEQ ID NO: 1563405 - RNA, 14 nt, Homo sapiens
aaauuugauuuuga

SEQ ID NO: 1563406 - RNA, 20 nt, Homo sapiens
aaauuuuaaugaagugcaau

SEQ ID NO: 1563407 - RNA, 18 nt, Homo sapiens
aaauuuuggggggaacau

SEQ ID NO: 1563408 - RNA, 19 nt, Homo sapiens
aaauuuuuaaauauucaca

SEQ ID NO: 1563409 - RNA, 15 nt, Homo sapiens
aaauuuuuaccuuua

SEQ ID NO: 1563410 - RNA, 10 nt, Homo sapiens
aacaaaaagu

SEQ ID NO: 1563411 - RNA, 15 nt, Homo sapiens
aagcagauacuugag

SEQ ID NO: 1563412 - RNA, 16 nt, Homo sapiens
aagcagaugaacuaau

SEQ ID NO: 1563413 - RNA, 16 nt, Homo sapiens
aagcagcaacagcaaa

SEQ ID NO: 1563414 - RNA, 14 nt, Homo sapiens
aagcagcacuguga

SEQ ID NO: 1563415 - RNA, 15 nt, Homo sapiens
aagcagcacugugag

SEQ ID NO: 1563416 - RNA, 17 nt, Homo sapiens
aagcaggacagugcuug

SEQ ID NO: 1563417 - RNA, 18 nt, Homo sapiens
aagcaggcugguuugcaa

SEQ ID NO: 1563418 - RNA, 13 nt, Homo sapiens
aagcagguuuguu

SEQ ID NO: 1563419 - RNA, 19 nt, Homo sapiens
aagcagucuugcucuguua

SEQ ID NO: 1563420 - RNA, 20 nt, Homo sapiens
aagcaguuacuaauaugccu

SEQ ID NO: 1563421 - RNA, 13 nt, Homo sapiens
aagcauaacuuau

SEQ ID NO: 1563422 - RNA, 13 nt, Homo sapiens
aagcauacuuugu

SEQ ID NO: 1563423 - RNA, 14 nt, Homo sapiens
aagcauacuuugua

SEQ ID NO: 1563424 - RNA, 13 nt, Homo sapiens
aagcaucaucugu

SEQ ID NO: 1563425 - RNA, 23 nt, Homo sapiens
aagcaucauuuccccaacagggc

SEQ ID NO: 1563426 - RNA, 17 nt, Homo sapiens
aagcaucccucacccau

SEQ ID NO: 1563427 - RNA, 20 nt, Homo sapiens
aagcaucugagcuaacuuau

SEQ ID NO: 1563428 - RNA, 15 nt, Homo sapiens
aagcaucuggcucua

SEQ ID NO: 1563429 - RNA, 14 nt, Homo sapiens
aagcaugcauauca

SEQ ID NO: 1563430 - RNA, 14 nt, Homo sapiens
aagccaccucacca

SEQ ID NO: 1563431 - RNA, 17 nt, Homo sapiens
aagccacuugucuugaa

SEQ ID NO: 1563432 - RNA, 23 nt, Homo sapiens
aagccaggccuggcuggaggagc

SEQ ID NO: 1563433 - RNA, 16 nt, Homo sapiens
aagccaugugccagau

SEQ ID NO: 1563434 - RNA, 13 nt, Homo sapiens
aagccauuccaaa

SEQ ID NO: 1563435 - RNA, 15 nt, Homo sapiens
aagccauuccaaagu

SEQ ID NO: 1563436 - RNA, 13 nt, Homo sapiens
aagccccgucucu

SEQ ID NO: 1563437 - RNA, 16 nt, Homo sapiens
aagcccuuuauuuccu

SEQ ID NO: 1563438 - RNA, 23 nt, Homo sapiens
aagccggcuugauuuccgugaac

SEQ ID NO: 1563439 - RNA, 16 nt, Homo sapiens
aagccuaucaaaggaa

SEQ ID NO: 1563440 - RNA, 16 nt, Homo sapiens
aagccucaucaucaga

SEQ ID NO: 1563441 - RNA, 18 nt, Homo sapiens
aagccucuccagcaauaa

SEQ ID NO: 1563442 - RNA, 14 nt, Homo sapiens
aagccugcuccuuc

SEQ ID NO: 1563443 - RNA, 20 nt, Homo sapiens
aagccuggcccauaauguga

SEQ ID NO: 1563444 - RNA, 18 nt, Homo sapiens
aagccuggccuacauggu

SEQ ID NO: 1563445 - RNA, 17 nt, Homo sapiens
aagccuuuguaucuuuc

SEQ ID NO: 1563446 - RNA, 13 nt, Homo sapiens
aagcgagcacagu

SEQ ID NO: 1563447 - RNA, 21 nt, Homo sapiens
aagcgcggacccuucuggguc

SEQ ID NO: 1563448 - RNA, 15 nt, Homo sapiens
aagcgggccgucucc

SEQ ID NO: 1563449 - RNA, 18 nt, Homo sapiens
aagcguguucucagcaca

SEQ ID NO: 1563450 - RNA, 14 nt, Homo sapiens
aagcuaaucugccu

SEQ ID NO: 1563451 - RNA, 20 nt, Homo sapiens
aagcuacaauauucucucuu

SEQ ID NO: 1563452 - RNA, 15 nt, Homo sapiens
aagcuagaaccugga

SEQ ID NO: 1563453 - RNA, 18 nt, Homo sapiens
aagcuauugucuguaaua

SEQ ID NO: 1563454 - RNA, 12 nt, Homo sapiens
aagcuccaguga

SEQ ID NO: 1563455 - RNA, 23 nt, Homo sapiens
aagcucuguuccaugcaacugga

SEQ ID NO: 1563456 - RNA, 15 nt, Homo sapiens
aagcucuucuuccca

SEQ ID NO: 1563457 - RNA, 22 nt, Homo sapiens
aagcugaauguucuugaauuau

SEQ ID NO: 1563458 - RNA, 15 nt, Homo sapiens
aagcugauucacuau

SEQ ID NO: 1563459 - RNA, 19 nt, Homo sapiens
aagcugauuuugcuuacuu

SEQ ID NO: 1563460 - RNA, 20 nt, Homo sapiens
aagcugcucuccuucacucu

SEQ ID NO: 1563461 - RNA, 13 nt, Homo sapiens
aagcuggagagac

SEQ ID NO: 1563462 - RNA, 19 nt, Homo sapiens
aagcuggcuuuucccauuu

SEQ ID NO: 1563463 - RNA, 23 nt, Homo sapiens
aagcuggugucugauuuuggcca

SEQ ID NO: 1563464 - RNA, 17 nt, Homo sapiens
aagcuguaggacuguuu

SEQ ID NO: 1563465 - RNA, 23 nt, Homo sapiens
aagcuguguccuugcaccugcau

SEQ ID NO: 1563466 - RNA, 13 nt, Homo sapiens
aagcuuaggucaa

SEQ ID NO: 1563467 - RNA, 18 nt, Homo sapiens
aagcuucaaaaagccacu

SEQ ID NO: 1563468 - RNA, 16 nt, Homo sapiens
aagcuuuaucuuugug

SEQ ID NO: 1563469 - RNA, 14 nt, Homo sapiens
aagcuuuaugauuu

SEQ ID NO: 1563470 - RNA, 18 nt, Homo sapiens
aagcuuuaugauuuucau

SEQ ID NO: 1563471 - RNA, 11 nt, Homo sapiens
aagcuuuguga

SEQ ID NO: 1563472 - RNA, 16 nt, Homo sapiens
aaggaaaguagcaagg

SEQ ID NO: 1563473 - RNA, 21 nt, Homo sapiens
aaggaaauaguaccuucaaua

SEQ ID NO: 1563474 - RNA, 21 nt, Homo sapiens
aaggaacucuacuucagucaa

SEQ ID NO: 1563475 - RNA, 14 nt, Homo sapiens
aaggaagacuugaa

SEQ ID NO: 1563476 - RNA, 19 nt, Homo sapiens
aaggaagggacacauauca

SEQ ID NO: 1563477 - RNA, 23 nt, Homo sapiens
aaggaagucauccagucuauuca

SEQ ID NO: 1563478 - RNA, 18 nt, Homo sapiens
aaggaaguguguuugccu

SEQ ID NO: 1563479 - RNA, 14 nt, Homo sapiens
aaggaaucacguua

SEQ ID NO: 1563480 - RNA, 21 nt, Homo sapiens
aaggaaugauauauucuugaa

SEQ ID NO: 1563481 - RNA, 15 nt, Homo sapiens
aaggacaucagcaaa

SEQ ID NO: 1563482 - RNA, 21 nt, Homo sapiens
aaggacaucagcaaacaggau

SEQ ID NO: 1563483 - RNA, 19 nt, Homo sapiens
aaggacccaauccccagac

SEQ ID NO: 1563484 - RNA, 14 nt, Homo sapiens
aaggacucuuccac

SEQ ID NO: 1563485 - RNA, 19 nt, Homo sapiens
aaggacuuagugcaucaga

SEQ ID NO: 1563486 - RNA, 14 nt, Homo sapiens
aaggagacauguga

SEQ ID NO: 1563487 - RNA, 14 nt, Homo sapiens
aaggagagcauagg

SEQ ID NO: 1563488 - RNA, 16 nt, Homo sapiens
aaggagagggacugga

SEQ ID NO: 1563489 - RNA, 19 nt, Homo sapiens
aaggaguauaccaugagau

SEQ ID NO: 1563490 - RNA, 17 nt, Homo sapiens
aaggaguucagauguuu

SEQ ID NO: 1563491 - RNA, 19 nt, Homo sapiens
aaggauuacacauuucacu

SEQ ID NO: 1563492 - RNA, 16 nt, Homo sapiens
aaggauuacucuccau

SEQ ID NO: 1563493 - RNA, 17 nt, Homo sapiens
aaggauuuuaccaaagc

SEQ ID NO: 1563494 - RNA, 22 nt, Homo sapiens
aaggauuuuaccaaagcaucaa

SEQ ID NO: 1563495 - RNA, 23 nt, Homo sapiens
aaggcaauuccugauggaaaaug

SEQ ID NO: 1563496 - RNA, 14 nt, Homo sapiens
aaggcaauuucaua

SEQ ID NO: 1563497 - RNA, 14 nt, Homo sapiens
aaggcacacuguua

SEQ ID NO: 1563498 - RNA, 19 nt, Homo sapiens
aaggcagcugccucugcuc

SEQ ID NO: 1563499 - RNA, 23 nt, Homo sapiens
aaggcagcugccucugcucccuc

SEQ ID NO: 1563500 - RNA, 13 nt, Homo sapiens
aaggccagcugaa

SEQ ID NO: 1563501 - RNA, 19 nt, Homo sapiens
aaggcccaacugguucagg

SEQ ID NO: 1563502 - RNA, 14 nt, Homo sapiens
aaggccuaccccag

SEQ ID NO: 1563503 - RNA, 13 nt, Homo sapiens
aaggccucugugg

SEQ ID NO: 1563504 - RNA, 17 nt, Homo sapiens
aaggcuaaaaagcaaca

SEQ ID NO: 1563505 - RNA, 16 nt, Homo sapiens
aaggcucacagauuua

SEQ ID NO: 1563506 - RNA, 12 nt, Homo sapiens
aaggcucagacu

SEQ ID NO: 1563507 - RNA, 16 nt, Homo sapiens
aaggcuccuccuugcc

SEQ ID NO: 1563508 - RNA, 14 nt, Homo sapiens
aaggcucuuuugua

SEQ ID NO: 1563509 - RNA, 20 nt, Homo sapiens
aaggcugagacagugaauuu

SEQ ID NO: 1563510 - RNA, 14 nt, Homo sapiens
aaggcuuccaggcu

SEQ ID NO: 1563511 - RNA, 22 nt, Homo sapiens
aagggaaccauguauaugagcu

SEQ ID NO: 1563512 - RNA, 18 nt, Homo sapiens
aagggacaccaagccuug

SEQ ID NO: 1563513 - RNA, 14 nt, Homo sapiens
aagggacacuuuua

SEQ ID NO: 1563514 - RNA, 14 nt, Homo sapiens
aagggagaguucuu

SEQ ID NO: 1563515 - RNA, 12 nt, Homo sapiens
aagggcacucug

SEQ ID NO: 1563516 - RNA, 17 nt, Homo sapiens
aagggcccaaugaauua

SEQ ID NO: 1563517 - RNA, 16 nt, Homo sapiens
aaggggauauuuacug

SEQ ID NO: 1563518 - RNA, 23 nt, Homo sapiens
aaggggauuuuuaugucuggggc

SEQ ID NO: 1563519 - RNA, 19 nt, Homo sapiens
aaggguccguggaccagga

SEQ ID NO: 1563520 - RNA, 21 nt, Homo sapiens
aagggugcccuuugggguccc

SEQ ID NO: 1563521 - RNA, 15 nt, Homo sapiens
aagggugguuugcag

SEQ ID NO: 1563522 - RNA, 13 nt, Homo sapiens
aagguauguguca

SEQ ID NO: 1563523 - RNA, 18 nt, Homo sapiens
aaggucacuacugcauuu

SEQ ID NO: 1563524 - RNA, 19 nt, Homo sapiens
aaggucuccaaaccagacg

SEQ ID NO: 1563525 - RNA, 21 nt, Homo sapiens
aaggucugagccacagcagca

SEQ ID NO: 1563526 - RNA, 19 nt, Homo sapiens
aaggucugcacuccuuuau

SEQ ID NO: 1563527 - RNA, 17 nt, Homo sapiens
aaggugaguuugagcug

SEQ ID NO: 1563528 - RNA, 15 nt, Homo sapiens
aagguggaaguugca

SEQ ID NO: 1563529 - RNA, 22 nt, Homo sapiens
aagguuguguagcugugucaug

SEQ ID NO: 1563530 - RNA, 14 nt, Homo sapiens
aauuaaacaauuua

SEQ ID NO: 1563531 - RNA, 23 nt, Homo sapiens
aauuaaaccagauuggagcaauu

SEQ ID NO: 1563532 - RNA, 13 nt, Homo sapiens
aauuaaagccuua

SEQ ID NO: 1563533 - RNA, 18 nt, Homo sapiens
aauuaaaguggaccaaua

SEQ ID NO: 1563534 - RNA, 22 nt, Homo sapiens
aauuaaauauauguauguaaaa

SEQ ID NO: 1563535 - RNA, 14 nt, Homo sapiens
aauuaaaugaagcc

SEQ ID NO: 1563536 - RNA, 17 nt, Homo sapiens
aauuaaaugugagcaaa

SEQ ID NO: 1563537 - RNA, 17 nt, Homo sapiens
aauuaacauaugucacg

SEQ ID NO: 1563538 - RNA, 21 nt, Homo sapiens
aauuaaucacccuaccaacuu

SEQ ID NO: 1563539 - RNA, 15 nt, Homo sapiens
aauuacaaaugcaau

SEQ ID NO: 1563540 - RNA, 20 nt, Homo sapiens
aauuacagacucaguagcca

SEQ ID NO: 1563541 - RNA, 15 nt, Homo sapiens
aauuacagugcaguu

SEQ ID NO: 1563542 - RNA, 18 nt, Homo sapiens
aauuacugccuuacugua

SEQ ID NO: 1563543 - RNA, 22 nt, Homo sapiens
aauuacugccuuacuguacaua

SEQ ID NO: 1563544 - RNA, 22 nt, Homo sapiens
aauuacuuugauuccauuuuaa

SEQ ID NO: 1563545 - RNA, 19 nt, Homo sapiens
aauuaguguggcuaaccaa

SEQ ID NO: 1563546 - RNA, 16 nt, Homo sapiens
aauuauacuacuuugu

SEQ ID NO: 1563547 - RNA, 21 nt, Homo sapiens
aauuauauaacuguauuugaa

SEQ ID NO: 1563548 - RNA, 15 nt, Homo sapiens
aauuauauagcugcu

SEQ ID NO: 1563549 - RNA, 17 nt, Homo sapiens
aauuauauuguccuccc

SEQ ID NO: 1563550 - RNA, 17 nt, Homo sapiens
aauuauauuuuguugcu

SEQ ID NO: 1563551 - RNA, 18 nt, Homo sapiens
aauuaugaaacauuuuag

SEQ ID NO: 1563552 - RNA, 23 nt, Homo sapiens
aauuaugaguuugcccucuuucc

SEQ ID NO: 1563553 - RNA, 11 nt, Homo sapiens
aauuaugccuu

SEQ ID NO: 1563554 - RNA, 22 nt, Homo sapiens
aauuaugucucuugagcaucaa

SEQ ID NO: 1563555 - RNA, 16 nt, Homo sapiens
aauuauguuacuguau

SEQ ID NO: 1563556 - RNA, 15 nt, Homo sapiens
aauuauugacacuga

SEQ ID NO: 1563557 - RNA, 22 nt, Homo sapiens
aauuauuugcauaacaauuccu

SEQ ID NO: 1563558 - RNA, 16 nt, Homo sapiens
aauuauuuuauaucau

SEQ ID NO: 1563559 - RNA, 22 nt, Homo sapiens
aauucacaugaugcacuucaaa

SEQ ID NO: 1563560 - RNA, 16 nt, Homo sapiens
aauucaccaguguucc

SEQ ID NO: 1563561 - RNA, 17 nt, Homo sapiens
aauucagaacaagcaau

SEQ ID NO: 1563562 - RNA, 14 nt, Homo sapiens
aauucagcauuuga

SEQ ID NO: 1563563 - RNA, 15 nt, Homo sapiens
aauucagucucugaa

SEQ ID NO: 1563564 - RNA, 12 nt, Homo sapiens
aauucagugucu

SEQ ID NO: 1563565 - RNA, 16 nt, Homo sapiens
aauucauucauuucau

SEQ ID NO: 1563566 - RNA, 22 nt, Homo sapiens
aauucauuguguuaccuguaga

SEQ ID NO: 1563567 - RNA, 23 nt, Homo sapiens
aauucauuguguuaccuguagau

SEQ ID NO: 1563568 - RNA, 13 nt, Homo sapiens
aauuccaaagcaa

SEQ ID NO: 1563569 - RNA, 14 nt, Homo sapiens
aauuccaaagcaaa

SEQ ID NO: 1563570 - RNA, 22 nt, Homo sapiens
aauuccaaagcaaaaccagaac

SEQ ID NO: 1563571 - RNA, 19 nt, Homo sapiens
aauuccacuccuuccagaa

SEQ ID NO: 1563572 - RNA, 20 nt, Homo sapiens
aauucccaacauuucuuaaa

SEQ ID NO: 1563573 - RNA, 22 nt, Homo sapiens
aauuccucucaaauucagcucu

SEQ ID NO: 1563574 - RNA, 16 nt, Homo sapiens
aauuccucuuacugua

SEQ ID NO: 1563575 - RNA, 20 nt, Homo sapiens
aauuccugauggaaaaugca

SEQ ID NO: 1563576 - RNA, 23 nt, Homo sapiens
aauucuaacccagguauccaaaa

SEQ ID NO: 1563577 - RNA, 20 nt, Homo sapiens
aauucuagauuaccaugaag

SEQ ID NO: 1563578 - RNA, 17 nt, Homo sapiens
aauucucauaaguagca

SEQ ID NO: 1563579 - RNA, 21 nt, Homo sapiens
aauucugcccgcuccauggaa

SEQ ID NO: 1563580 - RNA, 14 nt, Homo sapiens
aauucugccuugaa

SEQ ID NO: 1563581 - RNA, 17 nt, Homo sapiens
aauucuguaucuguaga

SEQ ID NO: 1563582 - RNA, 20 nt, Homo sapiens
aauucugugacauacauauu

SEQ ID NO: 1563583 - RNA, 22 nt, Homo sapiens
aauucugugacauacauauuau

SEQ ID NO: 1563584 - RNA, 17 nt, Homo sapiens
aauugaaacacagaguu

SEQ ID NO: 1563585 - RNA, 16 nt, Homo sapiens
aauugaacgacuguau

SEQ ID NO: 1563586 - RNA, 13 nt, Homo sapiens
aauugauagucaa

SEQ ID NO: 1563587 - RNA, 14 nt, Homo sapiens
aauugaugaugcag

SEQ ID NO: 1563588 - RNA, 21 nt, Homo sapiens
aauugaugugcuauauacuua

SEQ ID NO: 1563589 - RNA, 16 nt, Homo sapiens
aauugauuugcauuga

SEQ ID NO: 1563590 - RNA, 23 nt, Homo sapiens
aauugcaaauaaaccacuuucua

SEQ ID NO: 1563591 - RNA, 14 nt, Homo sapiens
aauugcucuuucac

SEQ ID NO: 1563592 - RNA, 15 nt, Homo sapiens
aauugcuuugccaaa

SEQ ID NO: 1563593 - RNA, 17 nt, Homo sapiens
aauuggccgcugucacu

SEQ ID NO: 1563594 - RNA, 17 nt, Homo sapiens
aauuggcuuccagauuu

SEQ ID NO: 1563595 - RNA, 22 nt, Homo sapiens
aauugguaaaacucacugugau

SEQ ID NO: 1563596 - RNA, 19 nt, Homo sapiens
aauugucgaaaagagucuu

SEQ ID NO: 1563597 - RNA, 20 nt, Homo sapiens
aauugucuuuguucugugau

SEQ ID NO: 1563598 - RNA, 17 nt, Homo sapiens
aauugugcaaaggauaa

SEQ ID NO: 1563599 - RNA, 16 nt, Homo sapiens
aauuuaaaauaauuau

SEQ ID NO: 1563600 - RNA, 18 nt, Homo sapiens
aauuuaaaguaucuugca

SEQ ID NO: 1563601 - RNA, 22 nt, Homo sapiens
aauuuagaucaaauuaguaauu

SEQ ID NO: 1563602 - RNA, 14 nt, Homo sapiens
aauuuauccauuca

SEQ ID NO: 1563603 - RNA, 18 nt, Homo sapiens
aauuuaucuuuaccaaaa

SEQ ID NO: 1563604 - RNA, 21 nt, Homo sapiens
aauuuaugggagaauugcaca

SEQ ID NO: 1563605 - RNA, 15 nt, Homo sapiens
aauuuauguaugcau

SEQ ID NO: 1563606 - RNA, 16 nt, Homo sapiens
aauuuauuacugaaaa

SEQ ID NO: 1563607 - RNA, 19 nt, Homo sapiens
aauuuauuauacaccuuag

SEQ ID NO: 1563608 - RNA, 21 nt, Homo sapiens
aauuucaguccuguaguuuua

SEQ ID NO: 1563609 - RNA, 20 nt, Homo sapiens
aauuucauaccuaucaucuu

SEQ ID NO: 1563610 - RNA, 21 nt, Homo sapiens
aauuucauaccuaucaucuua

SEQ ID NO: 1563611 - RNA, 19 nt, Homo sapiens
aauuucauuuccagcauuu

SEQ ID NO: 1563612 - RNA, 21 nt, Homo sapiens
aauuucccaguuaaagauuau

SEQ ID NO: 1563613 - RNA, 14 nt, Homo sapiens
aauuucuacuuuga

SEQ ID NO: 1563614 - RNA, 22 nt, Homo sapiens
aauuucuagccugcacuuugau

SEQ ID NO: 1563615 - RNA, 19 nt, Homo sapiens
aauuucuguacauuugcaa

SEQ ID NO: 1563616 - RNA, 15 nt, Homo sapiens
aauuucugucuuucu

SEQ ID NO: 1563617 - RNA, 18 nt, Homo sapiens
aauuugagauucuacagu

SEQ ID NO: 1563618 - RNA, 15 nt, Homo sapiens
aauuugcguaacuaa

SEQ ID NO: 1563619 - RNA, 17 nt, Homo sapiens
aauuugggcuuggacca

SEQ ID NO: 1563620 - RNA, 17 nt, Homo sapiens
aauuuguaauaaaacua

SEQ ID NO: 1563621 - RNA, 15 nt, Homo sapiens
aauuuguaaugauuu

SEQ ID NO: 1563622 - RNA, 20 nt, Homo sapiens
aauuugugugguaugucacu

SEQ ID NO: 1563623 - RNA, 21 nt, Homo sapiens
aauuuuaaagaguguguuaua

SEQ ID NO: 1563624 - RNA, 12 nt, Homo sapiens
aauuuuacuucu

SEQ ID NO: 1563625 - RNA, 17 nt, Homo sapiens
aauuuuauuacauauga

SEQ ID NO: 1563626 - RNA, 15 nt, Homo sapiens
aauuuucagcauuaa

SEQ ID NO: 1563627 - RNA, 17 nt, Homo sapiens
aauuuucgguaagucua

SEQ ID NO: 1563628 - RNA, 18 nt, Homo sapiens
aauuuucuaaaagcuuuc

SEQ ID NO: 1563629 - RNA, 12 nt, Homo sapiens
aauuuugauuca

SEQ ID NO: 1563630 - RNA, 22 nt, Homo sapiens
aauuuuguaugccaaucuuaaa

SEQ ID NO: 1563631 - RNA, 17 nt, Homo sapiens
aauuuuuaagcugcaaa

SEQ ID NO: 1563632 - RNA, 17 nt, Homo sapiens
aauuuuuuaaacuguag

SEQ ID NO: 1563633 - RNA, 13 nt, Homo sapiens
acaaaaaggcaaa

SEQ ID NO: 1563634 - RNA, 17 nt, Homo sapiens
acaaaacacagccaagg

SEQ ID NO: 1563635 - RNA, 23 nt, Homo sapiens
acaaaacaucuuuucacaacuua

SEQ ID NO: 1563636 - RNA, 20 nt, Homo sapiens
acaaaacccucagcacuguu

SEQ ID NO: 1563637 - RNA, 12 nt, Homo sapiens
acaaaacuuccu

SEQ ID NO: 1563638 - RNA, 19 nt, Homo sapiens
acaaaagaaggcucacaga

SEQ ID NO: 1563639 - RNA, 12 nt, Homo sapiens
acaaaagaauaa

SEQ ID NO: 1563640 - RNA, 20 nt, Homo sapiens
acaaaagaauaacauuuucu

SEQ ID NO: 1563641 - RNA, 18 nt, Homo sapiens
acaaaauauuuaagugaa

SEQ ID NO: 1563642 - RNA, 15 nt, Homo sapiens
acaaaaugauuuuga

SEQ ID NO: 1563643 - RNA, 17 nt, Homo sapiens
acaaaauguucaguuua

SEQ ID NO: 1563644 - RNA, 17 nt, Homo sapiens
acaaaauucaaagcaug

SEQ ID NO: 1563645 - RNA, 17 nt, Homo sapiens
acaaacauguaagcaua

SEQ ID NO: 1563646 - RNA, 14 nt, Homo sapiens
acaaaccacaccac

SEQ ID NO: 1563647 - RNA, 14 nt, Homo sapiens
acaaaccauuaccu

SEQ ID NO: 1563648 - RNA, 19 nt, Homo sapiens
acauacuuuaucaaugugu

SEQ ID NO: 1563649 - RNA, 16 nt, Homo sapiens
acauagcgagacucca

SEQ ID NO: 1563650 - RNA, 20 nt, Homo sapiens
acauagcgagacuccaccuc

SEQ ID NO: 1563651 - RNA, 13 nt, Homo sapiens
acauauccaaaau

SEQ ID NO: 1563652 - RNA, 15 nt, Homo sapiens
acauaugggaacuau

SEQ ID NO: 1563653 - RNA, 15 nt, Homo sapiens
acauauuuuuauacu

SEQ ID NO: 1563654 - RNA, 18 nt, Homo sapiens
acauauuuuuauacuuua

SEQ ID NO: 1563655 - RNA, 22 nt, Homo sapiens
acauauuuuuauacuuuauuga

SEQ ID NO: 1563656 - RNA, 23 nt, Homo sapiens
acauauuuuuauacuuuauugaa

SEQ ID NO: 1563657 - RNA, 16 nt, Homo sapiens
acaucaaaacuaacca

SEQ ID NO: 1563658 - RNA, 23 nt, Homo sapiens
acaucaaagugguaaauacugug

SEQ ID NO: 1563659 - RNA, 14 nt, Homo sapiens
acaucaacauucca

SEQ ID NO: 1563660 - RNA, 20 nt, Homo sapiens
acaucaagacuaucuacaaa

SEQ ID NO: 1563661 - RNA, 17 nt, Homo sapiens
acaucagcaaacaggau

SEQ ID NO: 1563662 - RNA, 16 nt, Homo sapiens
acaucaguauaguguu

SEQ ID NO: 1563663 - RNA, 17 nt, Homo sapiens
acaucagucuccaacau

SEQ ID NO: 1563664 - RNA, 23 nt, Homo sapiens
acaucaugcuggaaccugcaaaa

SEQ ID NO: 1563665 - RNA, 21 nt, Homo sapiens
acaucauuacuuaugaugaug

SEQ ID NO: 1563666 - RNA, 19 nt, Homo sapiens
acauccacaugauaccucu

SEQ ID NO: 1563667 - RNA, 18 nt, Homo sapiens
acauccagcagauuucca

SEQ ID NO: 1563668 - RNA, 12 nt, Homo sapiens
acauccaugaaa

SEQ ID NO: 1563669 - RNA, 17 nt, Homo sapiens
acauccguuuucauugu

SEQ ID NO: 1563670 - RNA, 18 nt, Homo sapiens
acaucuccaggcuuucaa

SEQ ID NO: 1563671 - RNA, 22 nt, Homo sapiens
acaucuccaggcuuucaauguu

SEQ ID NO: 1563672 - RNA, 21 nt, Homo sapiens
acaucuccccucucaccucau

SEQ ID NO: 1563673 - RNA, 15 nt, Homo sapiens
acaucucucugcccu

SEQ ID NO: 1563674 - RNA, 21 nt, Homo sapiens
acaucuugaauacucugcccu

SEQ ID NO: 1563675 - RNA, 21 nt, Homo sapiens
acaugaggcaguuccuuccag

SEQ ID NO: 1563676 - RNA, 17 nt, Homo sapiens
acaugaggccacuggag

SEQ ID NO: 1563677 - RNA, 16 nt, Homo sapiens
acaugaggccaucuca

SEQ ID NO: 1563678 - RNA, 17 nt, Homo sapiens
acaugaugcacuucaaa

SEQ ID NO: 1563679 - RNA, 18 nt, Homo sapiens
acaugauuuuacaaguau

SEQ ID NO: 1563680 - RNA, 20 nt, Homo sapiens
acaugcagaagauguuuaaa

SEQ ID NO: 1563681 - RNA, 17 nt, Homo sapiens
acaugccaacacuuaau

SEQ ID NO: 1563682 - RNA, 13 nt, Homo sapiens
acaugccaugccu

SEQ ID NO: 1563683 - RNA, 19 nt, Homo sapiens
acaugcccaaaacuuaucc

SEQ ID NO: 1563684 - RNA, 13 nt, Homo sapiens
acaugcccugugu

SEQ ID NO: 1563685 - RNA, 15 nt, Homo sapiens
acaugcucaggcuac

SEQ ID NO: 1563686 - RNA, 23 nt, Homo sapiens
acaugcugaaaaauauagccuuu

SEQ ID NO: 1563687 - RNA, 16 nt, Homo sapiens
acaugcuugcauuaua

SEQ ID NO: 1563688 - RNA, 14 nt, Homo sapiens
acauggagauguaa

SEQ ID NO: 1563689 - RNA, 17 nt, Homo sapiens
acauggaggaacaguau

SEQ ID NO: 1563690 - RNA, 10 nt, Homo sapiens
acaugggagc

SEQ ID NO: 1563691 - RNA, 16 nt, Homo sapiens
acaugggagcagucca

SEQ ID NO: 1563692 - RNA, 22 nt, Homo sapiens
acaugggagcaguccaugcaug

SEQ ID NO: 1563693 - RNA, 20 nt, Homo sapiens
acaugggugaacuuacuugc

SEQ ID NO: 1563694 - RNA, 22 nt, Homo sapiens
acaugggugaacuuacuugcau

SEQ ID NO: 1563695 - RNA, 20 nt, Homo sapiens
acauguaauccuaaauuuac

SEQ ID NO: 1563696 - RNA, 12 nt, Homo sapiens
acauguauacau

SEQ ID NO: 1563697 - RNA, 14 nt, Homo sapiens
acauguaugugugc

SEQ ID NO: 1563698 - RNA, 14 nt, Homo sapiens
acaugugagccaaa

SEQ ID NO: 1563699 - RNA, 14 nt, Homo sapiens
acaugugauuguga

SEQ ID NO: 1563700 - RNA, 12 nt, Homo sapiens
acauguguaaac

SEQ ID NO: 1563701 - RNA, 14 nt, Homo sapiens
acauguguguacau

SEQ ID NO: 1563702 - RNA, 14 nt, Homo sapiens
acauguugccuugc

SEQ ID NO: 1563703 - RNA, 13 nt, Homo sapiens
acauuaaugccug

SEQ ID NO: 1563704 - RNA, 12 nt, Homo sapiens
acauuaccaaaa

SEQ ID NO: 1563705 - RNA, 22 nt, Homo sapiens
acauuaguaucccacuagccca

SEQ ID NO: 1563706 - RNA, 20 nt, Homo sapiens
acauuauaaaaauugacaau

SEQ ID NO: 1563707 - RNA, 16 nt, Homo sapiens
acauuauucaucucuc

SEQ ID NO: 1563708 - RNA, 17 nt, Homo sapiens
acauuauucaucucucc

SEQ ID NO: 1563709 - RNA, 19 nt, Homo sapiens
acauuauucuucacuuaaa

SEQ ID NO: 1563710 - RNA, 18 nt, Homo sapiens
acauuccaguagccagua

SEQ ID NO: 1563711 - RNA, 19 nt, Homo sapiens
acauuccaguccuuugaga

SEQ ID NO: 1563712 - RNA, 21 nt, Homo sapiens
acauucuuagcuguaacuuaa

SEQ ID NO: 1563713 - RNA, 21 nt, Homo sapiens
acauucuucaguuuuucacuu

SEQ ID NO: 1563714 - RNA, 19 nt, Homo sapiens
acauugcagcuucaacuuu

SEQ ID NO: 1563715 - RNA, 23 nt, Homo sapiens
acauugcuuaaaauauauaguga

SEQ ID NO: 1563716 - RNA, 17 nt, Homo sapiens
acauuggaaugccuugg

SEQ ID NO: 1563717 - RNA, 19 nt, Homo sapiens
acauuggagcugacuguuc

SEQ ID NO: 1563718 - RNA, 16 nt, Homo sapiens
acauugggagucugua

SEQ ID NO: 1563719 - RNA, 15 nt, Homo sapiens
acauuguacuguugc

SEQ ID NO: 1563720 - RNA, 20 nt, Homo sapiens
acauuguauuaauaccaaag

SEQ ID NO: 1563721 - RNA, 23 nt, Homo sapiens
acauugugucagauuaccaguua

SEQ ID NO: 1563722 - RNA, 23 nt, Homo sapiens
acauuguguucccauuucagcug

SEQ ID NO: 1563723 - RNA, 16 nt, Homo sapiens
acauuuaaaauucaau

SEQ ID NO: 1563724 - RNA, 14 nt, Homo sapiens
acauuuauaaucua

SEQ ID NO: 1563725 - RNA, 21 nt, Homo sapiens
acauuuauagauaauugauau

SEQ ID NO: 1563726 - RNA, 13 nt, Homo sapiens
acauuuaucacug

SEQ ID NO: 1563727 - RNA, 15 nt, Homo sapiens
acauuuaucacugaa

SEQ ID NO: 1563728 - RNA, 22 nt, Homo sapiens
acauuucaccccacucuguaca

SEQ ID NO: 1563729 - RNA, 24 nt, Homo sapiens
acauuucauuguacaaguauuaca

SEQ ID NO: 1563730 - RNA, 23 nt, Homo sapiens
acauuucucuaacuccugccauu

SEQ ID NO: 1563731 - RNA, 20 nt, Homo sapiens
acauuugacaaaacuaaccu

SEQ ID NO: 1563732 - RNA, 12 nt, Homo sapiens
acauuugcugaa

SEQ ID NO: 1563733 - RNA, 23 nt, Homo sapiens
acauuuguauucucagacacuga

SEQ ID NO: 1563734 - RNA, 18 nt, Homo sapiens
acauuuguuuguggucua

SEQ ID NO: 1563735 - RNA, 16 nt, Homo sapiens
acauuuuaaaugaaag

SEQ ID NO: 1563736 - RNA, 14 nt, Homo sapiens
acauuuuacauuaa

SEQ ID NO: 1563737 - RNA, 14 nt, Homo sapiens
acauuuucauugau

SEQ ID NO: 1563738 - RNA, 13 nt, Homo sapiens
acauuuugacaca

SEQ ID NO: 1563739 - RNA, 17 nt, Homo sapiens
acauuuuuaaaacaacu

SEQ ID NO: 1563740 - RNA, 21 nt, Homo sapiens
acauuuuugucagagugcaca

SEQ ID NO: 1563741 - RNA, 19 nt, Homo sapiens
acauuuuuuucuaccuaua

SEQ ID NO: 1563742 - RNA, 14 nt, Homo sapiens
accaaaaacauuug

SEQ ID NO: 1563743 - RNA, 23 nt, Homo sapiens
accaaaaauaaaacuuuucaugu

SEQ ID NO: 1563744 - RNA, 14 nt, Homo sapiens
accaaagacaucag

SEQ ID NO: 1563745 - RNA, 16 nt, Homo sapiens
accaaagacaucaguc

SEQ ID NO: 1563746 - RNA, 21 nt, Homo sapiens
accaaaggagacauaucacug

SEQ ID NO: 1563747 - RNA, 14 nt, Homo sapiens
accaaauaccucaa

SEQ ID NO: 1563748 - RNA, 13 nt, Homo sapiens
accaaaucucagu

SEQ ID NO: 1563749 - RNA, 20 nt, Homo sapiens
accaaaucucaguagcugau

SEQ ID NO: 1563750 - RNA, 23 nt, Homo sapiens
accaaaucuugguugaugccaaa

SEQ ID NO: 1563751 - RNA, 14 nt, Homo sapiens
accaaauugcuucu

SEQ ID NO: 1563752 - RNA, 14 nt, Homo sapiens
accaacauggagaa

SEQ ID NO: 1563753 - RNA, 15 nt, Homo sapiens
accaaccacagcauc

SEQ ID NO: 1563754 - RNA, 15 nt, Homo sapiens
accaaccugcucugu

SEQ ID NO: 1563755 - RNA, 22 nt, Homo sapiens
accaacugaaguggcuaaagag

SEQ ID NO: 1563756 - RNA, 18 nt, Homo sapiens
accaacugggcccaagac

SEQ ID NO: 1563757 - RNA, 13 nt, Homo sapiens
accaagaacagag

SEQ ID NO: 1563758 - RNA, 14 nt, Homo sapiens
accaagaacagagu

SEQ ID NO: 1563759 - RNA, 21 nt, Homo sapiens
accaagaacagagucucagga

SEQ ID NO: 1563760 - RNA, 23 nt, Homo sapiens
accaagaagggcuagaaccugga

SEQ ID NO: 1563761 - RNA, 17 nt, Homo sapiens
accaagagauaacugua

SEQ ID NO: 1563762 - RNA, 18 nt, Homo sapiens
accaaggaaucaugucag

SEQ ID NO: 1563763 - RNA, 19 nt, Homo sapiens
accaagggaucugccauug

SEQ ID NO: 1563764 - RNA, 14 nt, Homo sapiens
accaagguauacau

SEQ ID NO: 1563765 - RNA, 21 nt, Homo sapiens
accaaguugauacuugaauaa

SEQ ID NO: 1563766 - RNA, 23 nt, Homo sapiens
aggagggccagcgcuguggaccu

SEQ ID NO: 1563767 - RNA, 23 nt, Homo sapiens
aggaggguguaauggagcaucaa

SEQ ID NO: 1563768 - RNA, 20 nt, Homo sapiens
aggaggugaccaaaucagug

SEQ ID NO: 1563769 - RNA, 15 nt, Homo sapiens
aggagucaacuggcu

SEQ ID NO: 1563770 - RNA, 14 nt, Homo sapiens
aggagucagggaga

SEQ ID NO: 1563771 - RNA, 20 nt, Homo sapiens
aggagucugggcacaagugu

SEQ ID NO: 1563772 - RNA, 13 nt, Homo sapiens
aggagugcugaua

SEQ ID NO: 1563773 - RNA, 22 nt, Homo sapiens
aggaguuugagguuacagugau

SEQ ID NO: 1563774 - RNA, 22 nt, Homo sapiens
aggauaccaaauaccauguaca

SEQ ID NO: 1563775 - RNA, 20 nt, Homo sapiens
aggauaggugguauggagcu

SEQ ID NO: 1563776 - RNA, 16 nt, Homo sapiens
aggauaucacauugga

SEQ ID NO: 1563777 - RNA, 17 nt, Homo sapiens
aggaucaaagaacugaa

SEQ ID NO: 1563778 - RNA, 17 nt, Homo sapiens
aggaucagcacugccag

SEQ ID NO: 1563779 - RNA, 13 nt, Homo sapiens
aggaucgcucaag

SEQ ID NO: 1563780 - RNA, 17 nt, Homo sapiens
aggaugaaucauauuca

SEQ ID NO: 1563781 - RNA, 23 nt, Homo sapiens
aggaugaucaaaaauaaugcauc

SEQ ID NO: 1563782 - RNA, 16 nt, Homo sapiens
aggauggaacaucagu

SEQ ID NO: 1563783 - RNA, 14 nt, Homo sapiens
aggauggagcugaa

SEQ ID NO: 1563784 - RNA, 20 nt, Homo sapiens
aggauggggugucuguguua

SEQ ID NO: 1563785 - RNA, 19 nt, Homo sapiens
aggaugugauuguggaaug

SEQ ID NO: 1563786 - RNA, 22 nt, Homo sapiens
aggauuaauaaagauggcacuu

SEQ ID NO: 1563787 - RNA, 22 nt, Homo sapiens
aggauuauucccaccugccaca

SEQ ID NO: 1563788 - RNA, 19 nt, Homo sapiens
aggauuauuuuaaauacaa

SEQ ID NO: 1563789 - RNA, 22 nt, Homo sapiens
aggauucuguucugcaacucca

SEQ ID NO: 1563790 - RNA, 21 nt, Homo sapiens
aggauuugaaccaugaaguca

SEQ ID NO: 1563791 - RNA, 15 nt, Homo sapiens
aggcaacauccaaaa

SEQ ID NO: 1563792 - RNA, 12 nt, Homo sapiens
aggcaagcacuu

SEQ ID NO: 1563793 - RNA, 17 nt, Homo sapiens
aggcaagcguguucuca

SEQ ID NO: 1563794 - RNA, 23 nt, Homo sapiens
aggcaaggaguuugagaccagcu

SEQ ID NO: 1563795 - RNA, 14 nt, Homo sapiens
aggcaauccuaccu

SEQ ID NO: 1563796 - RNA, 18 nt, Homo sapiens
aggcaauuccuaccucuu

SEQ ID NO: 1563797 - RNA, 22 nt, Homo sapiens
aggcacaacgcaccagacacuc

SEQ ID NO: 1563798 - RNA, 15 nt, Homo sapiens
aggcacagcuaacca

SEQ ID NO: 1563799 - RNA, 12 nt, Homo sapiens
aggcacaguggc

SEQ ID NO: 1563800 - RNA, 14 nt, Homo sapiens
aggcaccaucauuu

SEQ ID NO: 1563801 - RNA, 19 nt, Homo sapiens
aggcacgcaccaccaugcc

SEQ ID NO: 1563802 - RNA, 15 nt, Homo sapiens
aggcagagacugaaa

SEQ ID NO: 1563803 - RNA, 17 nt, Homo sapiens
aggcagagacugaaaau

SEQ ID NO: 1563804 - RNA, 16 nt, Homo sapiens
aggcagccacagggaa

SEQ ID NO: 1563805 - RNA, 21 nt, Homo sapiens
aggcagcuucuacuccugccu

SEQ ID NO: 1563806 - RNA, 16 nt, Homo sapiens
aggcagcuucuagaca

SEQ ID NO: 1563807 - RNA, 16 nt, Homo sapiens
aggcaggagaaucacu

SEQ ID NO: 1563808 - RNA, 21 nt, Homo sapiens
aggcaggagaaucacuugaac

SEQ ID NO: 1563809 - RNA, 18 nt, Homo sapiens
aggcaggaggaucacuuu

SEQ ID NO: 1563810 - RNA, 21 nt, Homo sapiens
aggcagggaaggaucccauga

SEQ ID NO: 1563811 - RNA, 21 nt, Homo sapiens
aggcagggcucucccgugcau

SEQ ID NO: 1563812 - RNA, 18 nt, Homo sapiens
aggcaggguagccugaau

SEQ ID NO: 1563813 - RNA, 16 nt, Homo sapiens
aggcaggugcagggaa

SEQ ID NO: 1563814 - RNA, 13 nt, Homo sapiens
aggcagguuucau

SEQ ID NO: 1563815 - RNA, 16 nt, Homo sapiens
aggcauagaggcuucu

SEQ ID NO: 1563816 - RNA, 20 nt, Homo sapiens
aggcauggcggcgcaugccu

SEQ ID NO: 1563817 - RNA, 17 nt, Homo sapiens
aggcauuuagcccucac

SEQ ID NO: 1563818 - RNA, 18 nt, Homo sapiens
aggcauuugcaggguccu

SEQ ID NO: 1563819 - RNA, 13 nt, Homo sapiens
aggccacagggag

SEQ ID NO: 1563820 - RNA, 17 nt, Homo sapiens
aggccacagugcaauuu

SEQ ID NO: 1563821 - RNA, 13 nt, Homo sapiens
aggccacauggga

SEQ ID NO: 1563822 - RNA, 12 nt, Homo sapiens
aggccagagcaa

SEQ ID NO: 1563823 - RNA, 18 nt, Homo sapiens
aggccagcaacucccagc

SEQ ID NO: 1563824 - RNA, 16 nt, Homo sapiens
aggccagcaagcucuu

SEQ ID NO: 1563825 - RNA, 20 nt, Homo sapiens
aggccaggcauggugguuua

SEQ ID NO: 1563826 - RNA, 12 nt, Homo sapiens
aggccagugcua

SEQ ID NO: 1563827 - RNA, 19 nt, Homo sapiens
aggccaguguggugucuug

SEQ ID NO: 1563828 - RNA, 16 nt, Homo sapiens
aggcccaaaacauaua

SEQ ID NO: 1563829 - RNA, 15 nt, Homo sapiens
aggcccacuguaaua

SEQ ID NO: 1563830 - RNA, 17 nt, Homo sapiens
aggcccaggaguccagg

SEQ ID NO: 1563831 - RNA, 16 nt, Homo sapiens
aggccgacccaaggga

SEQ ID NO: 1563832 - RNA, 14 nt, Homo sapiens
aggccgugccuugu

SEQ ID NO: 1563833 - RNA, 21 nt, Homo sapiens
aggccguuggcugugcuguau

SEQ ID NO: 1563834 - RNA, 12 nt, Homo sapiens
aggccuacccca

SEQ ID NO: 1563835 - RNA, 17 nt, Homo sapiens
aggccuauuuauuaaua

SEQ ID NO: 1563836 - RNA, 23 nt, Homo sapiens
aggccucucggugcuccaucucc

SEQ ID NO: 1563837 - RNA, 18 nt, Homo sapiens
aggccuggggaggcccua

SEQ ID NO: 1563838 - RNA, 13 nt, Homo sapiens
aggcgaagggugg

SEQ ID NO: 1563839 - RNA, 18 nt, Homo sapiens
aggcgauugaaaccauug

SEQ ID NO: 1563840 - RNA, 17 nt, Homo sapiens
aggcgccuauaauccca

SEQ ID NO: 1563841 - RNA, 16 nt, Homo sapiens
aggcgccugccaucau

SEQ ID NO: 1563842 - RNA, 20 nt, Homo sapiens
aggcgccugccaucaugccu

SEQ ID NO: 1563843 - RNA, 20 nt, Homo sapiens
aggcgggaggauugcuugag

SEQ ID NO: 1563844 - RNA, 21 nt, Homo sapiens
aggcgugccccccuccuccag

SEQ ID NO: 1563845 - RNA, 13 nt, Homo sapiens
aggcuacagggcc

SEQ ID NO: 1563846 - RNA, 22 nt, Homo sapiens
aggcuacuauagguccagaagu

SEQ ID NO: 1563847 - RNA, 16 nt, Homo sapiens
aggcuagagacagaug

SEQ ID NO: 1563848 - RNA, 16 nt, Homo sapiens
aggcuaucaacaaaga

SEQ ID NO: 1563849 - RNA, 19 nt, Homo sapiens
aggcuaucuggccugagac

SEQ ID NO: 1563850 - RNA, 13 nt, Homo sapiens
aggcucacagauu

SEQ ID NO: 1563851 - RNA, 19 nt, Homo sapiens
aggcucacugcaacuucug

SEQ ID NO: 1563852 - RNA, 18 nt, Homo sapiens
aggcucauuuaaaacagg

SEQ ID NO: 1563853 - RNA, 23 nt, Homo sapiens
aggcuccgggcaccaggggccaa

SEQ ID NO: 1563854 - RNA, 16 nt, Homo sapiens
aggcugacauucacug

SEQ ID NO: 1563855 - RNA, 17 nt, Homo sapiens
aggcugagacaggagaa

SEQ ID NO: 1563856 - RNA, 21 nt, Homo sapiens
aggcugaggugguaggaucac

SEQ ID NO: 1563857 - RNA, 14 nt, Homo sapiens
aggcugcaaugagc

SEQ ID NO: 1563858 - RNA, 18 nt, Homo sapiens
aggcugcccacucuccau

SEQ ID NO: 1563859 - RNA, 16 nt, Homo sapiens
aggcugccccucucac

SEQ ID NO: 1563860 - RNA, 15 nt, Homo sapiens
aggcuggaaaugguu

SEQ ID NO: 1563861 - RNA, 20 nt, Homo sapiens
aggcuggaagauagcuguga

SEQ ID NO: 1563862 - RNA, 20 nt, Homo sapiens
aggcuggagugcaguggugu

SEQ ID NO: 1563863 - RNA, 22 nt, Homo sapiens
aggcugggaacucaucugguug

SEQ ID NO: 1563864 - RNA, 12 nt, Homo sapiens
aggcugggagac

SEQ ID NO: 1563865 - RNA, 17 nt, Homo sapiens
aggcuuaacacaguggg

SEQ ID NO: 1563866 - RNA, 19 nt, Homo sapiens
aggcuuaaggagaggagaa

SEQ ID NO: 1563867 - RNA, 10 nt, Homo sapiens
aggcuuccug

SEQ ID NO: 1563868 - RNA, 23 nt, Homo sapiens
aggcuucucacggcgaccaauaa

SEQ ID NO: 1563869 - RNA, 18 nt, Homo sapiens
agggaaaaggaguaggga

SEQ ID NO: 1563870 - RNA, 20 nt, Homo sapiens
agggaaauguacacuuuuua

SEQ ID NO: 1563871 - RNA, 19 nt, Homo sapiens
agggaacugaacauuccag

SEQ ID NO: 1563872 - RNA, 16 nt, Homo sapiens
agggaagcaauugaaa

SEQ ID NO: 1563873 - RNA, 20 nt, Homo sapiens
agggaagccugggugucaag

SEQ ID NO: 1563874 - RNA, 23 nt, Homo sapiens
agggaaggcuguuugagaaccau

SEQ ID NO: 1563875 - RNA, 13 nt, Homo sapiens
agggaaguuuuau

SEQ ID NO: 1563876 - RNA, 16 nt, Homo sapiens
agggaauggagcucag

SEQ ID NO: 1563877 - RNA, 20 nt, Homo sapiens
agggaaugggucugcacaga

SEQ ID NO: 1563878 - RNA, 14 nt, Homo sapiens
agggaauugcucag

SEQ ID NO: 1563879 - RNA, 15 nt, Homo sapiens
agggacagucaguuu

SEQ ID NO: 1563880 - RNA, 16 nt, Homo sapiens
agggaccugcugcuca

SEQ ID NO: 1563881 - RNA, 16 nt, Homo sapiens
agggaccuucaugccc

SEQ ID NO: 1563882 - RNA, 20 nt, Homo sapiens
agggagaacuugaaacagau

SEQ ID NO: 1563883 - RNA, 13 nt, Homo sapiens
agggagacaggaa

SEQ ID NO: 1563884 - RNA, 23 nt, Homo sapiens
auaaaucaacaccuuaauaugcu

SEQ ID NO: 1563885 - RNA, 12 nt, Homo sapiens
auaaaucacuug

SEQ ID NO: 1563886 - RNA, 14 nt, Homo sapiens
auaaaugacaaugu

SEQ ID NO: 1563887 - RNA, 15 nt, Homo sapiens
auaaauggagauuca

SEQ ID NO: 1563888 - RNA, 23 nt, Homo sapiens
auaaauguaccagagagaguugu

SEQ ID NO: 1563889 - RNA, 15 nt, Homo sapiens
auaaauucacuuuca

SEQ ID NO: 1563890 - RNA, 22 nt, Homo sapiens
auaaauucuauaggaacauaug

SEQ ID NO: 1563891 - RNA, 22 nt, Homo sapiens
auaaauuuuaaaauugguauau

SEQ ID NO: 1563892 - RNA, 11 nt, Homo sapiens
auaacaguguu

SEQ ID NO: 1563893 - RNA, 22 nt, Homo sapiens
auaacaucucaccuucagucaa

SEQ ID NO: 1563894 - RNA, 16 nt, Homo sapiens
auaacauuuaaauucc

SEQ ID NO: 1563895 - RNA, 23 nt, Homo sapiens
auaacauuuaaauuccacagauu

SEQ ID NO: 1563896 - RNA, 20 nt, Homo sapiens
auaacccacuuuaaaauauc

SEQ ID NO: 1563897 - RNA, 21 nt, Homo sapiens
auaacguuagagaaacugaaa

SEQ ID NO: 1563898 - RNA, 19 nt, Homo sapiens
auaacuggcacccagagaa

SEQ ID NO: 1563899 - RNA, 18 nt, Homo sapiens
auaacuuucucugugaaa

SEQ ID NO: 1563900 - RNA, 21 nt, Homo sapiens
auaacuuuugguaucuacuuc

SEQ ID NO: 1563901 - RNA, 15 nt, Homo sapiens
auaagacaaugacau

SEQ ID NO: 1563902 - RNA, 19 nt, Homo sapiens
auaagagaaucaacauuuc

SEQ ID NO: 1563903 - RNA, 19 nt, Homo sapiens
auaagauauuuaguaauau

SEQ ID NO: 1563904 - RNA, 12 nt, Homo sapiens
auaagcauuuag

SEQ ID NO: 1563905 - RNA, 15 nt, Homo sapiens
auaagcuacugccau

SEQ ID NO: 1563906 - RNA, 23 nt, Homo sapiens
auaagcucaguaacugugcaucu

SEQ ID NO: 1563907 - RNA, 18 nt, Homo sapiens
auaaguaucacacuguau

SEQ ID NO: 1563908 - RNA, 15 nt, Homo sapiens
auaagucuacauuaa

SEQ ID NO: 1563909 - RNA, 18 nt, Homo sapiens
auaagucugggcacugga

SEQ ID NO: 1563910 - RNA, 16 nt, Homo sapiens
auaaguuugcaguugg

SEQ ID NO: 1563911 - RNA, 21 nt, Homo sapiens
auaaguuuuauguuaaaucaa

SEQ ID NO: 1563912 - RNA, 13 nt, Homo sapiens
auaauacauauua

SEQ ID NO: 1563913 - RNA, 16 nt, Homo sapiens
auaauaguacuauuac

SEQ ID NO: 1563914 - RNA, 12 nt, Homo sapiens
auaauagucaau

SEQ ID NO: 1563915 - RNA, 22 nt, Homo sapiens
auaauauagcuuaaaacacuuc

SEQ ID NO: 1563916 - RNA, 23 nt, Homo sapiens
auaauaugaaaaucuccaucuca

SEQ ID NO: 1563917 - RNA, 13 nt, Homo sapiens
auaaucaaccugg

SEQ ID NO: 1563918 - RNA, 17 nt, Homo sapiens
auaaucacacugcggua

SEQ ID NO: 1563919 - RNA, 20 nt, Homo sapiens
auaaucaucaaguaauacaa

SEQ ID NO: 1563920 - RNA, 13 nt, Homo sapiens
auaaucauuuuag

SEQ ID NO: 1563921 - RNA, 15 nt, Homo sapiens
auaaucccacccacc

SEQ ID NO: 1563922 - RNA, 22 nt, Homo sapiens
auaaucuuggcaauuuuugaca

SEQ ID NO: 1563923 - RNA, 18 nt, Homo sapiens
auaaugacaggcauccaa

SEQ ID NO: 1563924 - RNA, 15 nt, Homo sapiens
auaaugagcuauuaa

SEQ ID NO: 1563925 - RNA, 14 nt, Homo sapiens
auaaugaugcuguc

SEQ ID NO: 1563926 - RNA, 20 nt, Homo sapiens
auaaugccaaugaacaucuc

SEQ ID NO: 1563927 - RNA, 21 nt, Homo sapiens
auaaugccaaugaacaucuca

SEQ ID NO: 1563928 - RNA, 16 nt, Homo sapiens
auaauguaauuuagcu

SEQ ID NO: 1563929 - RNA, 13 nt, Homo sapiens
auaauuaauuacu

SEQ ID NO: 1563930 - RNA, 17 nt, Homo sapiens
auaauuagcuuguuaca

SEQ ID NO: 1563931 - RNA, 18 nt, Homo sapiens
auaauucuaaucuaacaa

SEQ ID NO: 1563932 - RNA, 15 nt, Homo sapiens
auaauugcuuugcca

SEQ ID NO: 1563933 - RNA, 18 nt, Homo sapiens
auaauuggcuugaugucc

SEQ ID NO: 1563934 - RNA, 16 nt, Homo sapiens
auaauuuaccuaagau

SEQ ID NO: 1563935 - RNA, 19 nt, Homo sapiens
auaauuugucuuaguugau

SEQ ID NO: 1563936 - RNA, 16 nt, Homo sapiens
auaauuuuaugcugga

SEQ ID NO: 1563937 - RNA, 13 nt, Homo sapiens
auacaaacucuca

SEQ ID NO: 1563938 - RNA, 22 nt, Homo sapiens
auacaacacugagccauuugcu

SEQ ID NO: 1563939 - RNA, 17 nt, Homo sapiens
auacaaccuucauuuaa

SEQ ID NO: 1563940 - RNA, 13 nt, Homo sapiens
auacaagaaccaa

SEQ ID NO: 1563941 - RNA, 20 nt, Homo sapiens
auacacaguacuuccuccca

SEQ ID NO: 1563942 - RNA, 19 nt, Homo sapiens
auacagaaagugacaaggg

SEQ ID NO: 1563943 - RNA, 22 nt, Homo sapiens
auacaggaggcagacaaugacc

SEQ ID NO: 1563944 - RNA, 15 nt, Homo sapiens
auacaguacggauuu

SEQ ID NO: 1563945 - RNA, 15 nt, Homo sapiens
auacagucuuccaca

SEQ ID NO: 1563946 - RNA, 17 nt, Homo sapiens
auacaguuacuuaauga

SEQ ID NO: 1563947 - RNA, 15 nt, Homo sapiens
auacauauuaucuca

SEQ ID NO: 1563948 - RNA, 17 nt, Homo sapiens
auacauauuaucucauu

SEQ ID NO: 1563949 - RNA, 12 nt, Homo sapiens
auacaucaaaga

SEQ ID NO: 1563950 - RNA, 15 nt, Homo sapiens
auacaucauuccaca

SEQ ID NO: 1563951 - RNA, 10 nt, Homo sapiens
auacaugauu

SEQ ID NO: 1563952 - RNA, 23 nt, Homo sapiens
auacauguaucugguuugucagg

SEQ ID NO: 1563953 - RNA, 23 nt, Homo sapiens
auacauuguauuaauaccaaagu

SEQ ID NO: 1563954 - RNA, 14 nt, Homo sapiens
auacauuucaauua

SEQ ID NO: 1563955 - RNA, 20 nt, Homo sapiens
auacauuucaauuauacuaa

SEQ ID NO: 1563956 - RNA, 16 nt, Homo sapiens
auacauuuuugucaga

SEQ ID NO: 1563957 - RNA, 16 nt, Homo sapiens
auaccaaauggcacuu

SEQ ID NO: 1563958 - RNA, 19 nt, Homo sapiens
auaccaaguugauacuuga

SEQ ID NO: 1563959 - RNA, 22 nt, Homo sapiens
auaccaauauucuuuuguucua

SEQ ID NO: 1563960 - RNA, 12 nt, Homo sapiens
auaccacaagac

SEQ ID NO: 1563961 - RNA, 20 nt, Homo sapiens
auaccacuaauuuucgcuua

SEQ ID NO: 1563962 - RNA, 14 nt, Homo sapiens
auaccacugaauga

SEQ ID NO: 1563963 - RNA, 16 nt, Homo sapiens
auaccagagccuucaa

SEQ ID NO: 1563964 - RNA, 18 nt, Homo sapiens
auaccagcuuaugagcuc

SEQ ID NO: 1563965 - RNA, 14 nt, Homo sapiens
auaccuccuauggg

SEQ ID NO: 1563966 - RNA, 23 nt, Homo sapiens
auaccugauugaucacacagugu

SEQ ID NO: 1563967 - RNA, 17 nt, Homo sapiens
auaccuuuagauuucag

SEQ ID NO: 1563968 - RNA, 15 nt, Homo sapiens
auaccuuuuuguguc

SEQ ID NO: 1563969 - RNA, 17 nt, Homo sapiens
auacgcuuuuaaugaaa

SEQ ID NO: 1563970 - RNA, 19 nt, Homo sapiens
auacguacuuuagcuggaa

SEQ ID NO: 1563971 - RNA, 20 nt, Homo sapiens
auacguacuuuagcuggaau

SEQ ID NO: 1563972 - RNA, 18 nt, Homo sapiens
auacuaaggaaccaacaa

SEQ ID NO: 1563973 - RNA, 23 nt, Homo sapiens
auacuauauugcuguaugguaua

SEQ ID NO: 1563974 - RNA, 19 nt, Homo sapiens
auacucacguuugcuuaaa

SEQ ID NO: 1563975 - RNA, 22 nt, Homo sapiens
auacucacguuugcuuaaaccc

SEQ ID NO: 1563976 - RNA, 23 nt, Homo sapiens
auacucagguaccucuuucaggg

SEQ ID NO: 1563977 - RNA, 18 nt, Homo sapiens
auacugaaccaggccaga

SEQ ID NO: 1563978 - RNA, 15 nt, Homo sapiens
auacugccuuugcag

SEQ ID NO: 1563979 - RNA, 20 nt, Homo sapiens
auacuggccaugccuggaga

SEQ ID NO: 1563980 - RNA, 19 nt, Homo sapiens
auacuguaacauucaggaa

SEQ ID NO: 1563981 - RNA, 23 nt, Homo sapiens
auacuguauugcuguaugguaua

SEQ ID NO: 1563982 - RNA, 16 nt, Homo sapiens
auacuuaacauuucau

SEQ ID NO: 1563983 - RNA, 15 nt, Homo sapiens
auacuuaaugcauau

SEQ ID NO: 1563984 - RNA, 17 nt, Homo sapiens
auacuugaaaccaguau

SEQ ID NO: 1563985 - RNA, 19 nt, Homo sapiens
auacuuuauuucugaucua

SEQ ID NO: 1563986 - RNA, 16 nt, Homo sapiens
auacuuugcaauccaa

SEQ ID NO: 1563987 - RNA, 18 nt, Homo sapiens
auacuuugcaauccaaau

SEQ ID NO: 1563988 - RNA, 13 nt, Homo sapiens
auacuuuuuacaa

SEQ ID NO: 1563989 - RNA, 19 nt, Homo sapiens
auagaaacguaaacuauga

SEQ ID NO: 1563990 - RNA, 17 nt, Homo sapiens
auagaaagaugacaaaa

SEQ ID NO: 1563991 - RNA, 19 nt, Homo sapiens
auagaaaugcauaccagua

SEQ ID NO: 1563992 - RNA, 18 nt, Homo sapiens
auagaagugcauucuccu

SEQ ID NO: 1563993 - RNA, 18 nt, Homo sapiens
auagaaguguugagccau

SEQ ID NO: 1563994 - RNA, 22 nt, Homo sapiens
auagaaugagcacccauuccaa

SEQ ID NO: 1563995 - RNA, 14 nt, Homo sapiens
auagaauucaguca

SEQ ID NO: 1563996 - RNA, 20 nt, Homo sapiens
auagacaaaagaauaagaca

SEQ ID NO: 1563997 - RNA, 15 nt, Homo sapiens
auagacauucucaca

SEQ ID NO: 1563998 - RNA, 19 nt, Homo sapiens
auagacuuaauacaugcaa

SEQ ID NO: 1563999 - RNA, 21 nt, Homo sapiens
auagagcaaaaucaacaugac

SEQ ID NO: 1564000 - RNA, 18 nt, Homo sapiens
auagaggauggucuuaca

SEQ ID NO: 1564001 - RNA, 12 nt, Homo sapiens
auagaggcuucu

SEQ ID NO: 1564002 - RNA, 17 nt, Homo sapiens
augcagcaucuuugugg

SEQ ID NO: 1564003 - RNA, 16 nt, Homo sapiens
augcagcuacuggaau

SEQ ID NO: 1564004 - RNA, 18 nt, Homo sapiens
augcaguauugagcacug

SEQ ID NO: 1564005 - RNA, 21 nt, Homo sapiens
augcaguuucaaguaccaaaa

SEQ ID NO: 1564006 - RNA, 17 nt, Homo sapiens
augcaguuuucauauau

SEQ ID NO: 1564007 - RNA, 13 nt, Homo sapiens
augcauaaacuau

SEQ ID NO: 1564008 - RNA, 16 nt, Homo sapiens
augcauaaaugcgauc

SEQ ID NO: 1564009 - RNA, 13 nt, Homo sapiens
augcauaacaaac

SEQ ID NO: 1564010 - RNA, 13 nt, Homo sapiens
augcaucauuaau

SEQ ID NO: 1564011 - RNA, 20 nt, Homo sapiens
augcauccagcaguacaaua

SEQ ID NO: 1564012 - RNA, 18 nt, Homo sapiens
augcaugcgaacauaaau

SEQ ID NO: 1564013 - RNA, 13 nt, Homo sapiens
augcaugcugauu

SEQ ID NO: 1564014 - RNA, 16 nt, Homo sapiens
augcaugucugccaaa

SEQ ID NO: 1564015 - RNA, 17 nt, Homo sapiens
augcauuauaucaaauc

SEQ ID NO: 1564016 - RNA, 22 nt, Homo sapiens
augcauuugauggccaccagcu

SEQ ID NO: 1564017 - RNA, 21 nt, Homo sapiens
augccaaguacuaaagcaccu

SEQ ID NO: 1564018 - RNA, 20 nt, Homo sapiens
augccaauaaaguuugccca

SEQ ID NO: 1564019 - RNA, 14 nt, Homo sapiens
augccaccaaagga

SEQ ID NO: 1564020 - RNA, 22 nt, Homo sapiens
augccauccagaugugugcaau

SEQ ID NO: 1564021 - RNA, 13 nt, Homo sapiens
augccauuacaga

SEQ ID NO: 1564022 - RNA, 21 nt, Homo sapiens
augcccaacuuacugucuucu

SEQ ID NO: 1564023 - RNA, 16 nt, Homo sapiens
augcccccuguggaug

SEQ ID NO: 1564024 - RNA, 22 nt, Homo sapiens
augcccccuguggaugcugcug

SEQ ID NO: 1564025 - RNA, 15 nt, Homo sapiens
augccuaucugacca

SEQ ID NO: 1564026 - RNA, 12 nt, Homo sapiens
augccuuacucu

SEQ ID NO: 1564027 - RNA, 16 nt, Homo sapiens
augccuugaggggugu

SEQ ID NO: 1564028 - RNA, 18 nt, Homo sapiens
augccuuuaaaucuguga

SEQ ID NO: 1564029 - RNA, 22 nt, Homo sapiens
augccuuuucccaaaauguuga

SEQ ID NO: 1564030 - RNA, 18 nt, Homo sapiens
augcggccucugagacau

SEQ ID NO: 1564031 - RNA, 14 nt, Homo sapiens
augcgggggugccu

SEQ ID NO: 1564032 - RNA, 16 nt, Homo sapiens
augcggugaaguuuaa

SEQ ID NO: 1564033 - RNA, 16 nt, Homo sapiens
augcgucaggggccua

SEQ ID NO: 1564034 - RNA, 13 nt, Homo sapiens
augcguguuccag

SEQ ID NO: 1564035 - RNA, 14 nt, Homo sapiens
augcuaacaaagac

SEQ ID NO: 1564036 - RNA, 21 nt, Homo sapiens
augcucaaugaaaaggugauu

SEQ ID NO: 1564037 - RNA, 14 nt, Homo sapiens
augcucauaccucu

SEQ ID NO: 1564038 - RNA, 20 nt, Homo sapiens
augcuccauuuuuaaccacu

SEQ ID NO: 1564039 - RNA, 20 nt, Homo sapiens
augcugcaacaaaauguaga

SEQ ID NO: 1564040 - RNA, 16 nt, Homo sapiens
augcugcaauacauua

SEQ ID NO: 1564041 - RNA, 19 nt, Homo sapiens
augcuggaaccugcaaaaa

SEQ ID NO: 1564042 - RNA, 23 nt, Homo sapiens
augcuggggacacacauucugcc

SEQ ID NO: 1564043 - RNA, 22 nt, Homo sapiens
augcugggucuccacguggugu

SEQ ID NO: 1564044 - RNA, 21 nt, Homo sapiens
augcugguggaggaagggcug

SEQ ID NO: 1564045 - RNA, 17 nt, Homo sapiens
augcugucugaacaggu

SEQ ID NO: 1564046 - RNA, 15 nt, Homo sapiens
augcugugcuaugaa

SEQ ID NO: 1564047 - RNA, 15 nt, Homo sapiens
augcuguuaaccaaa

SEQ ID NO: 1564048 - RNA, 17 nt, Homo sapiens
augcuguuaaccaaagg

SEQ ID NO: 1564049 - RNA, 19 nt, Homo sapiens
augcuuagucccucaugca

SEQ ID NO: 1564050 - RNA, 23 nt, Homo sapiens
augcuuauugaugagguuuauuc

SEQ ID NO: 1564051 - RNA, 15 nt, Homo sapiens
augcuucaugugcug

SEQ ID NO: 1564052 - RNA, 15 nt, Homo sapiens
augcuugcauuauau

SEQ ID NO: 1564053 - RNA, 17 nt, Homo sapiens
augcuuuagccauacac

SEQ ID NO: 1564054 - RNA, 19 nt, Homo sapiens
augcuuugcucaugcgcaa

SEQ ID NO: 1564055 - RNA, 15 nt, Homo sapiens
augcuuuugcuugca

SEQ ID NO: 1564056 - RNA, 18 nt, Homo sapiens
augcuuuugcuugcaaug

SEQ ID NO: 1564057 - RNA, 16 nt, Homo sapiens
auggaacuuagccauu

SEQ ID NO: 1564058 - RNA, 22 nt, Homo sapiens
auggaagguucucugugcuccu

SEQ ID NO: 1564059 - RNA, 17 nt, Homo sapiens
auggaauaacauaucaa

SEQ ID NO: 1564060 - RNA, 13 nt, Homo sapiens
auggacacuacac

SEQ ID NO: 1564061 - RNA, 17 nt, Homo sapiens
auggacacuacacuggg

SEQ ID NO: 1564062 - RNA, 22 nt, Homo sapiens
auggacacuacacuggggcccu

SEQ ID NO: 1564063 - RNA, 19 nt, Homo sapiens
auggacaugcuaccugaaa

SEQ ID NO: 1564064 - RNA, 23 nt, Homo sapiens
auggaccuccguggccaaaaagu

SEQ ID NO: 1564065 - RNA, 14 nt, Homo sapiens
auggagauucugau

SEQ ID NO: 1564066 - RNA, 18 nt, Homo sapiens
auggagcaucaagccacu

SEQ ID NO: 1564067 - RNA, 18 nt, Homo sapiens
auggagccaugacaagaa

SEQ ID NO: 1564068 - RNA, 12 nt, Homo sapiens
auggagcuuugu

SEQ ID NO: 1564069 - RNA, 20 nt, Homo sapiens
auggaggaagaacaacaaag

SEQ ID NO: 1564070 - RNA, 19 nt, Homo sapiens
auggaguguuuuaguucuu

SEQ ID NO: 1564071 - RNA, 12 nt, Homo sapiens
auggauucacuu

SEQ ID NO: 1564072 - RNA, 18 nt, Homo sapiens
auggauugggggggccaa

SEQ ID NO: 1564073 - RNA, 20 nt, Homo sapiens
auggauuuuucuuuaacugc

SEQ ID NO: 1564074 - RNA, 13 nt, Homo sapiens
auggcaaguucug

SEQ ID NO: 1564075 - RNA, 14 nt, Homo sapiens
auggcagaagggaa

SEQ ID NO: 1564076 - RNA, 19 nt, Homo sapiens
auggcagcugguugcucca

SEQ ID NO: 1564077 - RNA, 17 nt, Homo sapiens
auggcagcuuuccucaa

SEQ ID NO: 1564078 - RNA, 23 nt, Homo sapiens
auggcagggccaggccucugcug

SEQ ID NO: 1564079 - RNA, 23 nt, Homo sapiens
auggcccccaauaaaggcagcug

SEQ ID NO: 1564080 - RNA, 22 nt, Homo sapiens
auggccccuccacuggggaaug

SEQ ID NO: 1564081 - RNA, 23 nt, Homo sapiens
auggcuacucugcucacaugcac

SEQ ID NO: 1564082 - RNA, 20 nt, Homo sapiens
auggcucuaacaaugacauu

SEQ ID NO: 1564083 - RNA, 19 nt, Homo sapiens
auggcugcccaggagacag

SEQ ID NO: 1564084 - RNA, 17 nt, Homo sapiens
auggcugcgcaccaucu

SEQ ID NO: 1564085 - RNA, 20 nt, Homo sapiens
auggcuuaggaucgacaaga

SEQ ID NO: 1564086 - RNA, 18 nt, Homo sapiens
auggcuuuguacuuguga

SEQ ID NO: 1564087 - RNA, 18 nt, Homo sapiens
augggaagcagacaauaa

SEQ ID NO: 1564088 - RNA, 19 nt, Homo sapiens
augggagaguuucuuuaca

SEQ ID NO: 1564089 - RNA, 14 nt, Homo sapiens
augggagcuccucu

SEQ ID NO: 1564090 - RNA, 20 nt, Homo sapiens
augggcaaacccuggugcuu

SEQ ID NO: 1564091 - RNA, 17 nt, Homo sapiens
augggcuaucaacuuaa

SEQ ID NO: 1564092 - RNA, 15 nt, Homo sapiens
auggguucaccagcc

SEQ ID NO: 1564093 - RNA, 21 nt, Homo sapiens
auggguuguuaauacuauauu

SEQ ID NO: 1564094 - RNA, 14 nt, Homo sapiens
augguaaaccagau

SEQ ID NO: 1564095 - RNA, 20 nt, Homo sapiens
augguaucaauggauuuauc

SEQ ID NO: 1564096 - RNA, 20 nt, Homo sapiens
auggucaaugcuagcacaau

SEQ ID NO: 1564097 - RNA, 15 nt, Homo sapiens
auggucacacacuga

SEQ ID NO: 1564098 - RNA, 15 nt, Homo sapiens
auggucuuaugcaca

SEQ ID NO: 1564099 - RNA, 14 nt, Homo sapiens
auggugaugucacu

SEQ ID NO: 1564100 - RNA, 23 nt, Homo sapiens
augguggccagccagaucaagga

SEQ ID NO: 1564101 - RNA, 13 nt, Homo sapiens
auggugugccuuc

SEQ ID NO: 1564102 - RNA, 11 nt, Homo sapiens
augguguuaca

SEQ ID NO: 1564103 - RNA, 16 nt, Homo sapiens
augguguuuugucaga

SEQ ID NO: 1564104 - RNA, 17 nt, Homo sapiens
augguuaauacuauuaa

SEQ ID NO: 1564105 - RNA, 16 nt, Homo sapiens
augguuagcugucaca

SEQ ID NO: 1564106 - RNA, 14 nt, Homo sapiens
augguuaugugcau

SEQ ID NO: 1564107 - RNA, 19 nt, Homo sapiens
augguucucagaaccauuu

SEQ ID NO: 1564108 - RNA, 13 nt, Homo sapiens
augguuuuaucaa

SEQ ID NO: 1564109 - RNA, 20 nt, Homo sapiens
auguaaaacauucuuuugca

SEQ ID NO: 1564110 - RNA, 20 nt, Homo sapiens
auguaaagauuugcuuccau

SEQ ID NO: 1564111 - RNA, 19 nt, Homo sapiens
auguaaaggaaacauauuu

SEQ ID NO: 1564112 - RNA, 14 nt, Homo sapiens
auguaaccacugca

SEQ ID NO: 1564113 - RNA, 16 nt, Homo sapiens
auguaaccuacaauuc

SEQ ID NO: 1564114 - RNA, 16 nt, Homo sapiens
auguaauaaagugaac

SEQ ID NO: 1564115 - RNA, 20 nt, Homo sapiens
auguaauuaauaacuuucuc

SEQ ID NO: 1564116 - RNA, 17 nt, Homo sapiens
auguacagggguaguuu

SEQ ID NO: 1564117 - RNA, 15 nt, Homo sapiens
auguacaugucaaua

SEQ ID NO: 1564118 - RNA, 16 nt, Homo sapiens
auguacccgagcacau

SEQ ID NO: 1564119 - RNA, 18 nt, Homo sapiens
auguaccguaggcuuugu

SEQ ID NO: 1564120 - RNA, 16 nt, Homo sapiens
auuacugguccaaaag

SEQ ID NO: 1564121 - RNA, 17 nt, Homo sapiens
auuagaauauccaugac

SEQ ID NO: 1564122 - RNA, 13 nt, Homo sapiens
auuagacuccucc

SEQ ID NO: 1564123 - RNA, 22 nt, Homo sapiens
auuagcaaguuacagugaugcu

SEQ ID NO: 1564124 - RNA, 20 nt, Homo sapiens
auuagccauuucacucucaa

SEQ ID NO: 1564125 - RNA, 15 nt, Homo sapiens
auuagcuuuuucuca

SEQ ID NO: 1564126 - RNA, 18 nt, Homo sapiens
auuaggcuguaacuacuu

SEQ ID NO: 1564127 - RNA, 20 nt, Homo sapiens
auuagguagaccuugaauac

SEQ ID NO: 1564128 - RNA, 12 nt, Homo sapiens
auuaggucuuaa

SEQ ID NO: 1564129 - RNA, 18 nt, Homo sapiens
auuaguacuuauguugca

SEQ ID NO: 1564130 - RNA, 20 nt, Homo sapiens
auuaguacuuauguugcaca

SEQ ID NO: 1564131 - RNA, 18 nt, Homo sapiens
auuaguugggcauggugg

SEQ ID NO: 1564132 - RNA, 14 nt, Homo sapiens
auuauaaaguuuuc

SEQ ID NO: 1564133 - RNA, 14 nt, Homo sapiens
auuauaacuguaaa

SEQ ID NO: 1564134 - RNA, 23 nt, Homo sapiens
auuauacgcuggcaacacagagg

SEQ ID NO: 1564135 - RNA, 18 nt, Homo sapiens
auuauagugaaacaugua

SEQ ID NO: 1564136 - RNA, 16 nt, Homo sapiens
auuauaugcacuagca

SEQ ID NO: 1564137 - RNA, 20 nt, Homo sapiens
auuaucaaggggacuaaagu

SEQ ID NO: 1564138 - RNA, 19 nt, Homo sapiens
auuaucaaugggauaugau

SEQ ID NO: 1564139 - RNA, 17 nt, Homo sapiens
auuaugauugcauugua

SEQ ID NO: 1564140 - RNA, 13 nt, Homo sapiens
auuaugcuuugaa

SEQ ID NO: 1564141 - RNA, 13 nt, Homo sapiens
auuauguccugug

SEQ ID NO: 1564142 - RNA, 14 nt, Homo sapiens
auuauguggaauaa

SEQ ID NO: 1564143 - RNA, 21 nt, Homo sapiens
auuauguguugccaaaaccaa

SEQ ID NO: 1564144 - RNA, 20 nt, Homo sapiens
auuauguuuccuaacuguga

SEQ ID NO: 1564145 - RNA, 20 nt, Homo sapiens
auuauuaaugaaaauaagaa

SEQ ID NO: 1564146 - RNA, 13 nt, Homo sapiens
auuauuaauugca

SEQ ID NO: 1564147 - RNA, 13 nt, Homo sapiens
auuauuacuguuc

SEQ ID NO: 1564148 - RNA, 15 nt, Homo sapiens
auuauucccauucua

SEQ ID NO: 1564149 - RNA, 21 nt, Homo sapiens
auuauucccauucuacauacu

SEQ ID NO: 1564150 - RNA, 19 nt, Homo sapiens
auuauucuaugucaaugau

SEQ ID NO: 1564151 - RNA, 21 nt, Homo sapiens
auuauugugacuucacuguau

SEQ ID NO: 1564152 - RNA, 17 nt, Homo sapiens
auuauuuaaacucgcuc

SEQ ID NO: 1564153 - RNA, 22 nt, Homo sapiens
auuauuuauuugagaguuaaua

SEQ ID NO: 1564154 - RNA, 16 nt, Homo sapiens
auuauuuucuaugaca

SEQ ID NO: 1564155 - RNA, 16 nt, Homo sapiens
auucaaaucacaugga

SEQ ID NO: 1564156 - RNA, 12 nt, Homo sapiens
auucaaauccau

SEQ ID NO: 1564157 - RNA, 22 nt, Homo sapiens
auucaaauguuuuaaaguuuaa

SEQ ID NO: 1564158 - RNA, 20 nt, Homo sapiens
auucaacagagacugaauag

SEQ ID NO: 1564159 - RNA, 16 nt, Homo sapiens
auucaacucuccaaug

SEQ ID NO: 1564160 - RNA, 14 nt, Homo sapiens
auucaagagccagc

SEQ ID NO: 1564161 - RNA, 21 nt, Homo sapiens
auucaagagccagcaggucaa

SEQ ID NO: 1564162 - RNA, 16 nt, Homo sapiens
auucacaagacccaaa

SEQ ID NO: 1564163 - RNA, 20 nt, Homo sapiens
auucacagcaagucacuggc

SEQ ID NO: 1564164 - RNA, 14 nt, Homo sapiens
auucacagugcaag

SEQ ID NO: 1564165 - RNA, 14 nt, Homo sapiens
auucacagugcucu

SEQ ID NO: 1564166 - RNA, 22 nt, Homo sapiens
auucacuauggggggaggugua

SEQ ID NO: 1564167 - RNA, 23 nt, Homo sapiens
auucacuggggcaugagauuuug

SEQ ID NO: 1564168 - RNA, 20 nt, Homo sapiens
auucagaaaagaugugcaga

SEQ ID NO: 1564169 - RNA, 17 nt, Homo sapiens
auucagaguccuugcaa

SEQ ID NO: 1564170 - RNA, 22 nt, Homo sapiens
auucagcaaaaaucucccagug

SEQ ID NO: 1564171 - RNA, 17 nt, Homo sapiens
auucagcucugaucuga

SEQ ID NO: 1564172 - RNA, 21 nt, Homo sapiens
auucaggcagcacugacaaua

SEQ ID NO: 1564173 - RNA, 14 nt, Homo sapiens
auucagguaauaca

SEQ ID NO: 1564174 - RNA, 15 nt, Homo sapiens
auucagguaauacaa

SEQ ID NO: 1564175 - RNA, 22 nt, Homo sapiens
auucauaaaccuugucuaugaa

SEQ ID NO: 1564176 - RNA, 17 nt, Homo sapiens
auucaucauagggauaa

SEQ ID NO: 1564177 - RNA, 12 nt, Homo sapiens
auucaucucucc

SEQ ID NO: 1564178 - RNA, 16 nt, Homo sapiens
auucauggcuaccuca

SEQ ID NO: 1564179 - RNA, 18 nt, Homo sapiens
auucauggcuaccucaga

SEQ ID NO: 1564180 - RNA, 16 nt, Homo sapiens
auucauuccaugucca

SEQ ID NO: 1564181 - RNA, 12 nt, Homo sapiens
auucauucucau

SEQ ID NO: 1564182 - RNA, 19 nt, Homo sapiens
auucauuguguuaccugua

SEQ ID NO: 1564183 - RNA, 19 nt, Homo sapiens
auucauuuucuagauacaa

SEQ ID NO: 1564184 - RNA, 13 nt, Homo sapiens
auuccaaaugcca

SEQ ID NO: 1564185 - RNA, 18 nt, Homo sapiens
auuccaacauuucucacu

SEQ ID NO: 1564186 - RNA, 15 nt, Homo sapiens
auuccacacccucac

SEQ ID NO: 1564187 - RNA, 14 nt, Homo sapiens
auuccacagauuau

SEQ ID NO: 1564188 - RNA, 17 nt, Homo sapiens
auuccaccuagagcuag

SEQ ID NO: 1564189 - RNA, 19 nt, Homo sapiens
auuccaccuagagcuagau

SEQ ID NO: 1564190 - RNA, 13 nt, Homo sapiens
auuccacugaaaa

SEQ ID NO: 1564191 - RNA, 20 nt, Homo sapiens
auuccagagaagccaggaag

SEQ ID NO: 1564192 - RNA, 18 nt, Homo sapiens
auuccagguagcucggca

SEQ ID NO: 1564193 - RNA, 21 nt, Homo sapiens
auuccauguccauaugcaucu

SEQ ID NO: 1564194 - RNA, 12 nt, Homo sapiens
auuccauugccu

SEQ ID NO: 1564195 - RNA, 21 nt, Homo sapiens
auucccaccugccacaguuca

SEQ ID NO: 1564196 - RNA, 13 nt, Homo sapiens
auucccauucuac

SEQ ID NO: 1564197 - RNA, 23 nt, Homo sapiens
auucccucagccuaagaaacacu

SEQ ID NO: 1564198 - RNA, 20 nt, Homo sapiens
auuccgucaccacgacuggc

SEQ ID NO: 1564199 - RNA, 14 nt, Homo sapiens
auuccuaaaacacc

SEQ ID NO: 1564200 - RNA, 21 nt, Homo sapiens
auuccugauggaaaaugcaaa

SEQ ID NO: 1564201 - RNA, 15 nt, Homo sapiens
auuccugugcggaca

SEQ ID NO: 1564202 - RNA, 19 nt, Homo sapiens
auuccuucucccaucucuu

SEQ ID NO: 1564203 - RNA, 15 nt, Homo sapiens
auuccuucuguagug

SEQ ID NO: 1564204 - RNA, 12 nt, Homo sapiens
auuccuugcaca

SEQ ID NO: 1564205 - RNA, 15 nt, Homo sapiens
auucggauuugccau

SEQ ID NO: 1564206 - RNA, 20 nt, Homo sapiens
auucgugcauuuuuggauca

SEQ ID NO: 1564207 - RNA, 19 nt, Homo sapiens
auucuaaaaaugguuauca

SEQ ID NO: 1564208 - RNA, 17 nt, Homo sapiens
auucuaaaacacaacaa

SEQ ID NO: 1564209 - RNA, 14 nt, Homo sapiens
auucuacccugaaa

SEQ ID NO: 1564210 - RNA, 14 nt, Homo sapiens
auucuacugaacag
